United States Patent 12,043,843 (MATERIALS AND METHODS FOR TREATMENT OF HEMOGLOBINOPATHIES) - sequence listing, part 4

SEQ ID NO: 100888 - DNA, 22 bp, Artificial Sequence
  chemically synthesized
ttgtatctacaggttcctacct

SEQ ID NO: 100889 - DNA, 22 bp, Artificial Sequence
  chemically synthesized
tgtatctacaggttcctacctt

SEQ ID NO: 100890 - DNA, 22 bp, Artificial Sequence
  chemically synthesized
gtatctacaggttcctaccttc

SEQ ID NO: 100891 - DNA, 22 bp, Artificial Sequence
  chemically synthesized
tatctacaggttcctaccttca

SEQ ID NO: 100892 - DNA, 22 bp, Artificial Sequence
  chemically synthesized
caggttcctaccttcatttata

SEQ ID NO: 100893 - DNA, 22 bp, Artificial Sequence
  chemically synthesized
ctaccttcatttatattttaaa

SEQ ID NO: 100894 - DNA, 22 bp, Artificial Sequence
  chemically synthesized
ccttcatttatattttaaagta

SEQ ID NO: 100895 - DNA, 22 bp, Artificial Sequence
  chemically synthesized
catttatattttaaagtaggtg

SEQ ID NO: 100896 - DNA, 22 bp, Artificial Sequence
  chemically synthesized
atttatattttaaagtaggtga

SEQ ID NO: 100897 - DNA, 22 bp, Artificial Sequence
  chemically synthesized
atattttaaagtaggtgagcaa

SEQ ID NO: 100898 - DNA, 22 bp, Artificial Sequence
  chemically synthesized
tattttaaagtaggtgagcaaa

SEQ ID NO: 100899 - DNA, 22 bp, Artificial Sequence
  chemically synthesized
taaagtaggtgagcaaatgcat

SEQ ID NO: 100900 - DNA, 22 bp, Artificial Sequence
  chemically synthesized
aaagtaggtgagcaaatgcatt

SEQ ID NO: 100901 - DNA, 22 bp, Artificial Sequence
  chemically synthesized
aagtaggtgagcaaatgcattt

SEQ ID NO: 100902 - DNA, 22 bp, Artificial Sequence
  chemically synthesized
taacactccaagatagatttag

SEQ ID NO: 100903 - DNA, 22 bp, Artificial Sequence
  chemically synthesized
aacactccaagatagatttaga

SEQ ID NO: 100904 - DNA, 22 bp, Artificial Sequence
  chemically synthesized
acactccaagatagatttagat

SEQ ID NO: 100905 - DNA, 22 bp, Artificial Sequence
  chemically synthesized
caagatagatttagattaaaac

SEQ ID NO: 100906 - DNA, 22 bp, Artificial Sequence
  chemically synthesized
agattaaaacatctaaccagga

SEQ ID NO: 100907 - DNA, 22 bp, Artificial Sequence
  chemically synthesized
gattaaaacatctaaccaggat

SEQ ID NO: 100908 - DNA, 22 bp, Artificial Sequence
  chemically synthesized
aaacatctaaccaggataaaca

SEQ ID NO: 100909 - DNA, 22 bp, Artificial Sequence
  chemically synthesized
accaggataaacattgctgtct

SEQ ID NO: 100910 - DNA, 22 bp, Artificial Sequence
  chemically synthesized
ctgtctaaatgtatttgttgtt

SEQ ID NO: 100911 - DNA, 22 bp, Artificial Sequence
  chemically synthesized
tctaaatgtatttgttgtttta

SEQ ID NO: 100912 - DNA, 22 bp, Artificial Sequence
  chemically synthesized
aatgtatttgttgttttaatct

SEQ ID NO: 100913 - DNA, 22 bp, Artificial Sequence
  chemically synthesized
gttgttttaatctcttccgtta

SEQ ID NO: 100914 - DNA, 22 bp, Artificial Sequence
  chemically synthesized
ttgttttaatctcttccgttat

SEQ ID NO: 100915 - DNA, 22 bp, Artificial Sequence
  chemically synthesized
ttttaatctcttccgttattgt

SEQ ID NO: 100916 - DNA, 22 bp, Artificial Sequence
  chemically synthesized
taatctcttccgttattgtaac

SEQ ID NO: 100917 - DNA, 22 bp, Artificial Sequence
  chemically synthesized
aatctcttccgttattgtaaca

SEQ ID NO: 100918 - DNA, 22 bp, Artificial Sequence
  chemically synthesized
atctcttccgttattgtaacat

SEQ ID NO: 100919 - DNA, 22 bp, Artificial Sequence
  chemically synthesized
ttccgttattgtaacatgatga

SEQ ID NO: 100920 - DNA, 22 bp, Artificial Sequence
  chemically synthesized
ccgttattgtaacatgatgagg

SEQ ID NO: 100921 - DNA, 22 bp, Artificial Sequence
  chemically synthesized
cgttattgtaacatgatgagga

SEQ ID NO: 100922 - DNA, 22 bp, Artificial Sequence
  chemically synthesized
ttgtaacatgatgaggagacat

SEQ ID NO: 100923 - DNA, 22 bp, Artificial Sequence
  chemically synthesized
taacatgatgaggagacatgga

SEQ ID NO: 100924 - DNA, 22 bp, Artificial Sequence
  chemically synthesized
ctgctaatttctcctttaaagt

SEQ ID NO: 100925 - DNA, 22 bp, Artificial Sequence
  chemically synthesized
tgctaatttctcctttaaagtc

SEQ ID NO: 100926 - DNA, 22 bp, Artificial Sequence
  chemically synthesized
ctaatttctcctttaaagtcac

SEQ ID NO: 100927 - DNA, 22 bp, Artificial Sequence
  chemically synthesized
atttctcctttaaagtcacttc

SEQ ID NO: 100928 - DNA, 22 bp, Artificial Sequence
  chemically synthesized
ctcctttaaagtcacttcacat

SEQ ID NO: 100929 - DNA, 22 bp, Artificial Sequence
  chemically synthesized
tcctttaaagtcacttcacatt

SEQ ID NO: 100930 - DNA, 22 bp, Artificial Sequence
  chemically synthesized
ctttaaagtcacttcacattag

SEQ ID NO: 100931 - DNA, 22 bp, Artificial Sequence
  chemically synthesized
taaagtcacttcacattagtta

SEQ ID NO: 100932 - DNA, 22 bp, Artificial Sequence
  chemically synthesized
aaagtcacttcacattagttat

SEQ ID NO: 100933 - DNA, 22 bp, Artificial Sequence
  chemically synthesized
aagtcacttcacattagttatc

SEQ ID NO: 100934 - DNA, 22 bp, Artificial Sequence
  chemically synthesized
cacattagttatctcttacata

SEQ ID NO: 100935 - DNA, 22 bp, Artificial Sequence
  chemically synthesized
acattagttatctcttacatat

SEQ ID NO: 100936 - DNA, 22 bp, Artificial Sequence
  chemically synthesized
gttatctcttacatatgagtcc

SEQ ID NO: 100937 - DNA, 22 bp, Artificial Sequence
  chemically synthesized
tctcttacatatgagtccctgg

SEQ ID NO: 100938 - DNA, 22 bp, Artificial Sequence
  chemically synthesized
ttacatatgagtccctggcagt

SEQ ID NO: 100939 - DNA, 22 bp, Artificial Sequence
  chemically synthesized
acatatgagtccctggcagtgt

SEQ ID NO: 100940 - DNA, 22 bp, Artificial Sequence
  chemically synthesized
catatgagtccctggcagtgtc

SEQ ID NO: 100941 - DNA, 22 bp, Artificial Sequence
  chemically synthesized
gcagtgtcagttgaccattcct

SEQ ID NO: 100942 - DNA, 22 bp, Artificial Sequence
  chemically synthesized
accattccttttcatgacccta

SEQ ID NO: 100943 - DNA, 22 bp, Artificial Sequence
  chemically synthesized
cttttcatgaccctaaagactt

SEQ ID NO: 100944 - DNA, 22 bp, Artificial Sequence
  chemically synthesized
ttcatgaccctaaagacttctg

SEQ ID NO: 100945 - DNA, 22 bp, Artificial Sequence
  chemically synthesized
tcatgaccctaaagacttctga

SEQ ID NO: 100946 - DNA, 22 bp, Artificial Sequence
  chemically synthesized
catgaccctaaagacttctgat

SEQ ID NO: 100947 - DNA, 22 bp, Artificial Sequence
  chemically synthesized
atgaccctaaagacttctgata

SEQ ID NO: 100948 - DNA, 22 bp, Artificial Sequence
  chemically synthesized
aagacttctgataaatatactg

SEQ ID NO: 100949 - DNA, 22 bp, Artificial Sequence
  chemically synthesized
ctgataaatatactgcattttt

SEQ ID NO: 100950 - DNA, 22 bp, Artificial Sequence
  chemically synthesized
tgataaatatactgcatttttc

SEQ ID NO: 100951 - DNA, 22 bp, Artificial Sequence
  chemically synthesized
ataaatatactgcatttttcta

SEQ ID NO: 100952 - DNA, 22 bp, Artificial Sequence
  chemically synthesized
catttttctatagctcatttca

SEQ ID NO: 100953 - DNA, 22 bp, Artificial Sequence
  chemically synthesized
ttctatagctcatttcaaccta

SEQ ID NO: 100954 - DNA, 22 bp, Artificial Sequence
  chemically synthesized
tctatagctcatttcaacctac

SEQ ID NO: 100955 - DNA, 22 bp, Artificial Sequence
  chemically synthesized
ctatagctcatttcaacctaca

SEQ ID NO: 100956 - DNA, 22 bp, Artificial Sequence
  chemically synthesized
tatagctcatttcaacctacac

SEQ ID NO: 100957 - DNA, 22 bp, Artificial Sequence
  chemically synthesized
tagctcatttcaacctacacaa

SEQ ID NO: 100958 - DNA, 22 bp, Artificial Sequence
  chemically synthesized
atttcaacctacacaaattatg

SEQ ID NO: 100959 - DNA, 22 bp, Artificial Sequence
  chemically synthesized
caacctacacaaattatgggtt

SEQ ID NO: 100960 - DNA, 22 bp, Artificial Sequence
  chemically synthesized
aacctacacaaattatgggttt

SEQ ID NO: 100961 - DNA, 22 bp, Artificial Sequence
  chemically synthesized
cacaaattatgggtttgcatgc

SEQ ID NO: 100962 - DNA, 22 bp, Artificial Sequence
  chemically synthesized
tgggtttgcatgcctttatccc

SEQ ID NO: 100963 - DNA, 22 bp, Artificial Sequence
  chemically synthesized
gcatgcctttatccctaattag

SEQ ID NO: 100964 - DNA, 22 bp, Artificial Sequence
  chemically synthesized
catgcctttatccctaattagg

SEQ ID NO: 100965 - DNA, 22 bp, Artificial Sequence
  chemically synthesized
tatccctaattaggctacacag

SEQ ID NO: 100966 - DNA, 22 bp, Artificial Sequence
  chemically synthesized
atccctaattaggctacacagc

SEQ ID NO: 100967 - DNA, 22 bp, Artificial Sequence
  chemically synthesized
tccctaattaggctacacagct

SEQ ID NO: 100968 - DNA, 22 bp, Artificial Sequence
  chemically synthesized
attaggctacacagctgtttaa

SEQ ID NO: 100969 - DNA, 22 bp, Artificial Sequence
  chemically synthesized
ggctacacagctgtttaaatta

SEQ ID NO: 100970 - DNA, 22 bp, Artificial Sequence
  chemically synthesized
cacagctgtttaaattaggaat

SEQ ID NO: 100971 - DNA, 22 bp, Artificial Sequence
  chemically synthesized
tttaaattaggaattacagatt

SEQ ID NO: 100972 - DNA, 22 bp, Artificial Sequence
  chemically synthesized
aaattaggaattacagatttcg

SEQ ID NO: 100973 - DNA, 22 bp, Artificial Sequence
  chemically synthesized
aattaggaattacagatttcgc

SEQ ID NO: 100974 - DNA, 22 bp, Artificial Sequence
  chemically synthesized
ggaattacagatttcgccagat

SEQ ID NO: 100975 - DNA, 22 bp, Artificial Sequence
  chemically synthesized
cagatttcgccagataattgta

SEQ ID NO: 100976 - DNA, 22 bp, Artificial Sequence
  chemically synthesized
cgccagataattgtatatctga

SEQ ID NO: 100977 - DNA, 22 bp, Artificial Sequence
  chemically synthesized
gccagataattgtatatctgat

SEQ ID NO: 100978 - DNA, 22 bp, Artificial Sequence
  chemically synthesized
tatatctgatacagattaggca

SEQ ID NO: 100979 - DNA, 22 bp, Artificial Sequence
  chemically synthesized
atacagattaggcatttaataa

SEQ ID NO: 100980 - DNA, 22 bp, Artificial Sequence
  chemically synthesized
ggcatttaataaattttggtga

SEQ ID NO: 100981 - DNA, 22 bp, Artificial Sequence
  chemically synthesized
aataaattttggtgaataggta

SEQ ID NO: 100982 - DNA, 22 bp, Artificial Sequence
  chemically synthesized
ataaattttggtgaataggtaa

SEQ ID NO: 100983 - DNA, 22 bp, Artificial Sequence
  chemically synthesized
tggtgaataggtaaacactaaa

SEQ ID NO: 100984 - DNA, 22 bp, Artificial Sequence
  chemically synthesized
ggtgaataggtaaacactaaat

SEQ ID NO: 100985 - DNA, 22 bp, Artificial Sequence
  chemically synthesized
gtgaataggtaaacactaaatt

SEQ ID NO: 100986 - DNA, 22 bp, Artificial Sequence
  chemically synthesized
aattgttcctcaaacatttgtc

SEQ ID NO: 100987 - DNA, 22 bp, Artificial Sequence
  chemically synthesized
ttcctcaaacatttgtcagatg

SEQ ID NO: 100988 - DNA, 22 bp, Artificial Sequence
  chemically synthesized
ctcaaacatttgtcagatgttc

SEQ ID NO: 100989 - DNA, 22 bp, Artificial Sequence
  chemically synthesized
aaacatttgtcagatgttcact

SEQ ID NO: 100990 - DNA, 22 bp, Artificial Sequence
  chemically synthesized
gtcagatgttcactatgatacc

SEQ ID NO: 100991 - DNA, 22 bp, Artificial Sequence
  chemically synthesized
tcagatgttcactatgatacct

SEQ ID NO: 100992 - DNA, 22 bp, Artificial Sequence
  chemically synthesized
actatgatacctacttattgag

SEQ ID NO: 100993 - DNA, 22 bp, Artificial Sequence
  chemically synthesized
tgatacctacttattgagaatc

SEQ ID NO: 100994 - DNA, 22 bp, Artificial Sequence
  chemically synthesized
cttattgagaatcaagtaaata

SEQ ID NO: 100995 - DNA, 22 bp, Artificial Sequence
  chemically synthesized
attgagaatcaagtaaatagag

SEQ ID NO: 100996 - DNA, 22 bp, Artificial Sequence
  chemically synthesized
ttgagaatcaagtaaatagaga

SEQ ID NO: 100997 - DNA, 22 bp, Artificial Sequence
  chemically synthesized
agaatcaagtaaatagagatat

SEQ ID NO: 100998 - DNA, 22 bp, Artificial Sequence
  chemically synthesized
agacacattacagagaagtata

SEQ ID NO: 100999 - DNA, 22 bp, Artificial Sequence
  chemically synthesized
cagagaagtatatacttacaaa

SEQ ID NO: 101000 - DNA, 22 bp, Artificial Sequence
  chemically synthesized
acaaactcaaagtatttgacac

SEQ ID NO: 101001 - DNA, 22 bp, Artificial Sequence
  chemically synthesized
caaactcaaagtatttgacacc

SEQ ID NO: 101002 - DNA, 22 bp, Artificial Sequence
  chemically synthesized
aaagtatttgacacccctaggc

SEQ ID NO: 101003 - DNA, 22 bp, Artificial Sequence
  chemically synthesized
gacacccctaggcacatgaaac

SEQ ID NO: 101004 - DNA, 22 bp, Artificial Sequence
  chemically synthesized
acacccctaggcacatgaaaca

SEQ ID NO: 101005 - DNA, 22 bp, Artificial Sequence
  chemically synthesized
ggcacatgaaacacttttgaat

SEQ ID NO: 101006 - DNA, 22 bp, Artificial Sequence
  chemically synthesized
ttgaatatacagcacactttta

SEQ ID NO: 101007 - DNA, 22 bp, Artificial Sequence
  chemically synthesized
tgaatatacagcacacttttac

SEQ ID NO: 101008 - DNA, 22 bp, Artificial Sequence
  chemically synthesized
gaatatacagcacacttttaca

SEQ ID NO: 101009 - DNA, 22 bp, Artificial Sequence
  chemically synthesized
aatatacagcacacttttacat

SEQ ID NO: 101010 - DNA, 22 bp, Artificial Sequence
  chemically synthesized
ttacatacacattattcataaa

SEQ ID NO: 101011 - DNA, 22 bp, Artificial Sequence
  chemically synthesized
tacatacacattattcataaac

SEQ ID NO: 101012 - DNA, 22 bp, Artificial Sequence
  chemically synthesized
acatacacattattcataaaca

SEQ ID NO: 101013 - DNA, 22 bp, Artificial Sequence
  chemically synthesized
catacacattattcataaacat

SEQ ID NO: 101014 - DNA, 22 bp, Artificial Sequence
  chemically synthesized
ttcataaacattgccaatgcat

SEQ ID NO: 101015 - DNA, 22 bp, Artificial Sequence
  chemically synthesized
ataaacattgccaatgcatgca

SEQ ID NO: 101016 - DNA, 22 bp, Artificial Sequence
  chemically synthesized
ccaatgcatgcagaaagaagct

SEQ ID NO: 101017 - DNA, 22 bp, Artificial Sequence
  chemically synthesized
aatgtggattttacatatactt

SEQ ID NO: 101018 - DNA, 22 bp, Artificial Sequence
  chemically synthesized
atgtggattttacatatacttt

SEQ ID NO: 101019 - DNA, 22 bp, Artificial Sequence
  chemically synthesized
tacatatactttcatgaacata

SEQ ID NO: 101020 - DNA, 22 bp, Artificial Sequence
  chemically synthesized
acatatactttcatgaacatag

SEQ ID NO: 101021 - DNA, 22 bp, Artificial Sequence
  chemically synthesized
catatactttcatgaacatagc

SEQ ID NO: 101022 - DNA, 22 bp, Artificial Sequence
  chemically synthesized
tcatgaacatagccttgccaac

SEQ ID NO: 101023 - DNA, 22 bp, Artificial Sequence
  chemically synthesized
catgaacatagccttgccaaca

SEQ ID NO: 101024 - DNA, 22 bp, Artificial Sequence
  chemically synthesized
atgaacatagccttgccaacat

SEQ ID NO: 101025 - DNA, 22 bp, Artificial Sequence
  chemically synthesized
gccaacatcctttccctttctg

SEQ ID NO: 101026 - DNA, 22 bp, Artificial Sequence
  chemically synthesized
ccaacatcctttccctttctgt

SEQ ID NO: 101027 - DNA, 22 bp, Artificial Sequence
  chemically synthesized
tccctttctgttagagtcacct

SEQ ID NO: 101028 - DNA, 22 bp, Artificial Sequence
  chemically synthesized
ccctttctgttagagtcacctg

SEQ ID NO: 101029 - DNA, 22 bp, Artificial Sequence
  chemically synthesized
cctttctgttagagtcacctgc

SEQ ID NO: 101030 - DNA, 22 bp, Artificial Sequence
  chemically synthesized
tctgttagagtcacctgccttc

SEQ ID NO: 101031 - DNA, 22 bp, Artificial Sequence
  chemically synthesized
ctgttagagtcacctgccttca

SEQ ID NO: 101032 - DNA, 22 bp, Artificial Sequence
  chemically synthesized
tgttagagtcacctgccttcat

SEQ ID NO: 101033 - DNA, 22 bp, Artificial Sequence
  chemically synthesized
ttagagtcacctgccttcatcc

SEQ ID NO: 101034 - DNA, 22 bp, Artificial Sequence
  chemically synthesized
gagtcacctgccttcatccatc

SEQ ID NO: 101035 - DNA, 22 bp, Artificial Sequence
  chemically synthesized
ccttcatccatcccttggatat

SEQ ID NO: 101036 - DNA, 22 bp, Artificial Sequence
  chemically synthesized
catccatcccttggatatgata

SEQ ID NO: 101037 - DNA, 22 bp, Artificial Sequence
  chemically synthesized
atccatcccttggatatgatac

SEQ ID NO: 101038 - DNA, 22 bp, Artificial Sequence
  chemically synthesized
ggatatgataccttgagttatc

SEQ ID NO: 101039 - DNA, 22 bp, Artificial Sequence
  chemically synthesized
gatatgataccttgagttatcc

SEQ ID NO: 101040 - DNA, 22 bp, Artificial Sequence
  chemically synthesized
gagttatccccacacccaaatc

SEQ ID NO: 101041 - DNA, 22 bp, Artificial Sequence
  chemically synthesized
agttatccccacacccaaatct

SEQ ID NO: 101042 - DNA, 22 bp, Artificial Sequence
  chemically synthesized
tccccacacccaaatcttcaac

SEQ ID NO: 101043 - DNA, 22 bp, Artificial Sequence
  chemically synthesized
caacagacagaaatgtaaagtc

SEQ ID NO: 101044 - DNA, 22 bp, Artificial Sequence
  chemically synthesized
aacagacagaaatgtaaagtcc

SEQ ID NO: 101045 - DNA, 22 bp, Artificial Sequence
  chemically synthesized
aatgtgtgatagatgaactaaa

SEQ ID NO: 101046 - DNA, 22 bp, Artificial Sequence
  chemically synthesized
atgtgtgatagatgaactaaat

SEQ ID NO: 101047 - DNA, 22 bp, Artificial Sequence
  chemically synthesized
aatattctatctcagtattcat

SEQ ID NO: 101048 - DNA, 22 bp, Artificial Sequence
  chemically synthesized
tatctcagtattcatctgacag

SEQ ID NO: 101049 - DNA, 22 bp, Artificial Sequence
  chemically synthesized
tctcagtattcatctgacagca

SEQ ID NO: 101050 - DNA, 22 bp, Artificial Sequence
  chemically synthesized
agtattcatctgacagcatagg

SEQ ID NO: 101051 - DNA, 22 bp, Artificial Sequence
  chemically synthesized
atctgacagcataggaaggaga

SEQ ID NO: 101052 - DNA, 22 bp, Artificial Sequence
  chemically synthesized
acagcataggaaggagagaaat

SEQ ID NO: 101053 - DNA, 22 bp, Artificial Sequence
  chemically synthesized
tgtctcatttataccacatatt

SEQ ID NO: 101054 - DNA, 22 bp, Artificial Sequence
  chemically synthesized
tctcatttataccacatattgt

SEQ ID NO: 101055 - DNA, 22 bp, Artificial Sequence
  chemically synthesized
atttataccacatattgtgttt

SEQ ID NO: 101056 - DNA, 22 bp, Artificial Sequence
  chemically synthesized
ataccacatattgtgtttctat

SEQ ID NO: 101057 - DNA, 22 bp, Artificial Sequence
  chemically synthesized
taccacatattgtgtttctatg

SEQ ID NO: 101058 - DNA, 22 bp, Artificial Sequence
  chemically synthesized
tgtttctatggccgaatcagct

SEQ ID NO: 101059 - DNA, 22 bp, Artificial Sequence
  chemically synthesized
ctatggccgaatcagcttaggt

SEQ ID NO: 101060 - DNA, 22 bp, Artificial Sequence
  chemically synthesized
tatggccgaatcagcttaggtt

SEQ ID NO: 101061 - DNA, 22 bp, Artificial Sequence
  chemically synthesized
tggccgaatcagcttaggttct

SEQ ID NO: 101062 - DNA, 22 bp, Artificial Sequence
  chemically synthesized
aggttctacattgtgtggtttt

SEQ ID NO: 101063 - DNA, 22 bp, Artificial Sequence
  chemically synthesized
ggttctacattgtgtggttttg

SEQ ID NO: 101064 - DNA, 22 bp, Artificial Sequence
  chemically synthesized
tacattgtgtggttttggataa

SEQ ID NO: 101065 - DNA, 22 bp, Artificial Sequence
  chemically synthesized
cattgtgtggttttggataaat

SEQ ID NO: 101066 - DNA, 22 bp, Artificial Sequence
  chemically synthesized
tgtggttttggataaattactt

SEQ ID NO: 101067 - DNA, 22 bp, Artificial Sequence
  chemically synthesized
tggataaattacttaacctacc

SEQ ID NO: 101068 - DNA, 22 bp, Artificial Sequence
  chemically synthesized
ggataaattacttaacctacct

SEQ ID NO: 101069 - DNA, 22 bp, Artificial Sequence
  chemically synthesized
gataaattacttaacctaccta

SEQ ID NO: 101070 - DNA, 22 bp, Artificial Sequence
  chemically synthesized
cttaacctacctaagtaaggca

SEQ ID NO: 101071 - DNA, 22 bp, Artificial Sequence
  chemically synthesized
aacctacctaagtaaggcacct

SEQ ID NO: 101072 - DNA, 22 bp, Artificial Sequence
  chemically synthesized
acctacctaagtaaggcaccta

SEQ ID NO: 101073 - DNA, 22 bp, Artificial Sequence
  chemically synthesized
cctaagtaaggcacctacgtgt

SEQ ID NO: 101074 - DNA, 22 bp, Artificial Sequence
  chemically synthesized
agtaaggcacctacgtgtcagt

SEQ ID NO: 101075 - DNA, 22 bp, Artificial Sequence
  chemically synthesized
cgtgtcagtctcttcatgtgta

SEQ ID NO: 101076 - DNA, 22 bp, Artificial Sequence
  chemically synthesized
ttcatgtgtagtcaggaattat

SEQ ID NO: 101077 - DNA, 22 bp, Artificial Sequence
  chemically synthesized
catgtgtagtcaggaattataa

SEQ ID NO: 101078 - DNA, 22 bp, Artificial Sequence
  chemically synthesized
atgtgtagtcaggaattataat

SEQ ID NO: 101079 - DNA, 22 bp, Artificial Sequence
  chemically synthesized
taatgaaaagtaactcgaagta

SEQ ID NO: 101080 - DNA, 22 bp, Artificial Sequence
  chemically synthesized
gaagtatttttgtgataatcag

SEQ ID NO: 101081 - DNA, 22 bp, Artificial Sequence
  chemically synthesized
ttgtgataatcagttagataaa

SEQ ID NO: 101082 - DNA, 22 bp, Artificial Sequence
  chemically synthesized
tgtgataatcagttagataaaa

SEQ ID NO: 101083 - DNA, 22 bp, Artificial Sequence
  chemically synthesized
gtgataatcagttagataaaaa

SEQ ID NO: 101084 - DNA, 22 bp, Artificial Sequence
  chemically synthesized
tgataatcagttagataaaaat

SEQ ID NO: 101085 - DNA, 22 bp, Artificial Sequence
  chemically synthesized
gataaaaatgtgaacctcttaa

SEQ ID NO: 101086 - DNA, 22 bp, Artificial Sequence
  chemically synthesized
ttaagacactagcaacttgaat

SEQ ID NO: 101087 - DNA, 22 bp, Artificial Sequence
  chemically synthesized
aagacactagcaacttgaatac

SEQ ID NO: 101088 - DNA, 22 bp, Artificial Sequence
  chemically synthesized
agacactagcaacttgaataca

SEQ ID NO: 101089 - DNA, 22 bp, Artificial Sequence
  chemically synthesized
gcaacttgaatacataattgat

SEQ ID NO: 101090 - DNA, 22 bp, Artificial Sequence
  chemically synthesized
gaatacataattgattttttat

SEQ ID NO: 101091 - DNA, 22 bp, Artificial Sequence
  chemically synthesized
aatacataattgattttttatt

SEQ ID NO: 101092 - DNA, 22 bp, Artificial Sequence
  chemically synthesized
attttttattctgttacaatta

SEQ ID NO: 101093 - DNA, 22 bp, Artificial Sequence
  chemically synthesized
tttattctgttacaattatata

SEQ ID NO: 101094 - DNA, 22 bp, Artificial Sequence
  chemically synthesized
ttattctgttacaattatatac

SEQ ID NO: 101095 - DNA, 22 bp, Artificial Sequence
  chemically synthesized
tattctgttacaattatatact

SEQ ID NO: 101096 - DNA, 22 bp, Artificial Sequence
  chemically synthesized
attctgttacaattatatactg

SEQ ID NO: 101097 - DNA, 22 bp, Artificial Sequence
  chemically synthesized
ttctgttacaattatatactga

SEQ ID NO: 101098 - DNA, 22 bp, Artificial Sequence
  chemically synthesized
tgttacaattatatactgaact

SEQ ID NO: 101099 - DNA, 22 bp, Artificial Sequence
  chemically synthesized
ttacaattatatactgaactca

SEQ ID NO: 101100 - DNA, 22 bp, Artificial Sequence
  chemically synthesized
caattatatactgaactcatgt

SEQ ID NO: 101101 - DNA, 22 bp, Artificial Sequence
  chemically synthesized
tatactgaactcatgtgaggat

SEQ ID NO: 101102 - DNA, 22 bp, Artificial Sequence
  chemically synthesized
aactcatgtgaggatccagttt

SEQ ID NO: 101103 - DNA, 22 bp, Artificial Sequence
  chemically synthesized
atgtgaggatccagtttctata

SEQ ID NO: 101104 - DNA, 22 bp, Artificial Sequence
  chemically synthesized
ctatatctaggcttttcaaact

SEQ ID NO: 101105 - DNA, 22 bp, Artificial Sequence
  chemically synthesized
tatatctaggcttttcaaacta

SEQ ID NO: 101106 - DNA, 22 bp, Artificial Sequence
  chemically synthesized
tatctaggcttttcaaactacc

SEQ ID NO: 101107 - DNA, 22 bp, Artificial Sequence
  chemically synthesized
ggcttttcaaactaccttagag

SEQ ID NO: 101108 - DNA, 22 bp, Artificial Sequence
  chemically synthesized
ttcaaactaccttagagaaata

SEQ ID NO: 101109 - DNA, 22 bp, Artificial Sequence
  chemically synthesized
tcaaactaccttagagaaatac

SEQ ID NO: 101110 - DNA, 22 bp, Artificial Sequence
  chemically synthesized
caaactaccttagagaaatact

SEQ ID NO: 101111 - DNA, 22 bp, Artificial Sequence
  chemically synthesized
aaactaccttagagaaatactt

SEQ ID NO: 101112 - DNA, 22 bp, Artificial Sequence
  chemically synthesized
ccttagagaaatacttgtatat

SEQ ID NO: 101113 - DNA, 22 bp, Artificial Sequence
  chemically synthesized
agagaaatacttgtatatcttc

SEQ ID NO: 101114 - DNA, 22 bp, Artificial Sequence
  chemically synthesized
gagaaatacttgtatatcttcc

SEQ ID NO: 101115 - DNA, 22 bp, Artificial Sequence
  chemically synthesized
gtatatcttccttgtaggtata

SEQ ID NO: 101116 - DNA, 22 bp, Artificial Sequence
  chemically synthesized
tatatcttccttgtaggtatag

SEQ ID NO: 101117 - DNA, 22 bp, Artificial Sequence
  chemically synthesized
ccttgtaggtatagagtaaaat

SEQ ID NO: 101118 - DNA, 22 bp, Artificial Sequence
  chemically synthesized
cttgtaggtatagagtaaaata

SEQ ID NO: 101119 - DNA, 22 bp, Artificial Sequence
  chemically synthesized
gtaggtatagagtaaaatacta

SEQ ID NO: 101120 - DNA, 22 bp, Artificial Sequence
  chemically synthesized
taggtatagagtaaaatactaa

SEQ ID NO: 101121 - DNA, 22 bp, Artificial Sequence
  chemically synthesized
acttcaggtttagtaccaatgc

SEQ ID NO: 101122 - DNA, 22 bp, Artificial Sequence
  chemically synthesized
caggtttagtaccaatgcttat

SEQ ID NO: 101123 - DNA, 22 bp, Artificial Sequence
  chemically synthesized
aggtttagtaccaatgcttatc

SEQ ID NO: 101124 - DNA, 22 bp, Artificial Sequence
  chemically synthesized
agtaccaatgcttatccatatt

SEQ ID NO: 101125 - DNA, 22 bp, Artificial Sequence
  chemically synthesized
gtaccaatgcttatccatatta

SEQ ID NO: 101126 - DNA, 22 bp, Artificial Sequence
  chemically synthesized
atccatattataatttacattg

SEQ ID NO: 101127 - DNA, 22 bp, Artificial Sequence
  chemically synthesized
tccatattataatttacattgc

SEQ ID NO: 101128 - DNA, 22 bp, Artificial Sequence
  chemically synthesized
taatttacattgcaagttttat

SEQ ID NO: 101129 - DNA, 22 bp, Artificial Sequence
  chemically synthesized
acattgcaagttttattttctg

SEQ ID NO: 101130 - DNA, 22 bp, Artificial Sequence
  chemically synthesized
cattgcaagttttattttctgt

SEQ ID NO: 101131 - DNA, 22 bp, Artificial Sequence
  chemically synthesized
caagttttattttctgttcctt

SEQ ID NO: 101132 - DNA, 22 bp, Artificial Sequence
  chemically synthesized
tattttctgttccttattggtc

SEQ ID NO: 101133 - DNA, 22 bp, Artificial Sequence
  chemically synthesized
attttctgttccttattggtca

SEQ ID NO: 101134 - DNA, 22 bp, Artificial Sequence
  chemically synthesized
ttttctgttccttattggtcaa

SEQ ID NO: 101135 - DNA, 22 bp, Artificial Sequence
  chemically synthesized
tctgttccttattggtcaatac

SEQ ID NO: 101136 - DNA, 22 bp, Artificial Sequence
  chemically synthesized
ctgttccttattggtcaatact

SEQ ID NO: 101137 - DNA, 22 bp, Artificial Sequence
  chemically synthesized
tgttccttattggtcaatactt

SEQ ID NO: 101138 - DNA, 22 bp, Artificial Sequence
  chemically synthesized
ttccttattggtcaatactttt

SEQ ID NO: 101139 - DNA, 22 bp, Artificial Sequence
  chemically synthesized
cttattggtcaatacttttgga

SEQ ID NO: 101140 - DNA, 22 bp, Artificial Sequence
  chemically synthesized
attggtcaatacttttggatcc

SEQ ID NO: 101141 - DNA, 22 bp, Artificial Sequence
  chemically synthesized
ttggtcaatacttttggatcca

SEQ ID NO: 101142 - DNA, 22 bp, Artificial Sequence
  chemically synthesized
gtcaatacttttggatccagct

SEQ ID NO: 101143 - DNA, 22 bp, Artificial Sequence
  chemically synthesized
ttggatccagctgttcaactgt

SEQ ID NO: 101144 - DNA, 22 bp, Artificial Sequence
  chemically synthesized
tggatccagctgttcaactgtg

SEQ ID NO: 101145 - DNA, 22 bp, Artificial Sequence
  chemically synthesized
ggatccagctgttcaactgtgg

SEQ ID NO: 101146 - DNA, 22 bp, Artificial Sequence
  chemically synthesized
gatccagctgttcaactgtggt

SEQ ID NO: 101147 - DNA, 22 bp, Artificial Sequence
  chemically synthesized
ttcaactgtggtaacacttgat

SEQ ID NO: 101148 - DNA, 22 bp, Artificial Sequence
  chemically synthesized
aactgtggtaacacttgataat

SEQ ID NO: 101149 - DNA, 22 bp, Artificial Sequence
  chemically synthesized
tggtaacacttgataataatgc

SEQ ID NO: 101150 - DNA, 22 bp, Artificial Sequence
  chemically synthesized
gataataatgccaagaggctgg

SEQ ID NO: 101151 - DNA, 22 bp, Artificial Sequence
  chemically synthesized
ataataatgccaagaggctggg

SEQ ID NO: 101152 - DNA, 22 bp, Artificial Sequence
  chemically synthesized
gggtgagctataagaggagtca

SEQ ID NO: 101153 - DNA, 22 bp, Artificial Sequence
  chemically synthesized
taagaggagtcaaggctaatca

SEQ ID NO: 101154 - DNA, 22 bp, Artificial Sequence
  chemically synthesized
atcagtacagcaagaggaatga

SEQ ID NO: 101155 - DNA, 22 bp, Artificial Sequence
  chemically synthesized
gataaagggaacggcgtgggag

SEQ ID NO: 101156 - DNA, 22 bp, Artificial Sequence
  chemically synthesized
cctgagggaatattcatgagac

SEQ ID NO: 101157 - DNA, 22 bp, Artificial Sequence
  chemically synthesized
ctgagggaatattcatgagaca

SEQ ID NO: 101158 - DNA, 22 bp, Artificial Sequence
  chemically synthesized
agggaatattcatgagacaaac

SEQ ID NO: 101159 - DNA, 22 bp, Artificial Sequence
  chemically synthesized
atgagacaaacagagaataaag

SEQ ID NO: 101160 - DNA, 22 bp, Artificial Sequence
  chemically synthesized
atatacaagtgatttctagaaa

SEQ ID NO: 101161 - DNA, 22 bp, Artificial Sequence
  chemically synthesized
ctagaaagtgcatgaataagac

SEQ ID NO: 101162 - DNA, 22 bp, Artificial Sequence
  chemically synthesized
tagaaagtgcatgaataagaca

SEQ ID NO: 101163 - DNA, 22 bp, Artificial Sequence
  chemically synthesized
gaaagtgcatgaataagacagc

SEQ ID NO: 101164 - DNA, 22 bp, Artificial Sequence
  chemically synthesized
gaaagatagaaagacctggcac

SEQ ID NO: 101165 - DNA, 22 bp, Artificial Sequence
  chemically synthesized
gcacttaaaatgtgaatgtgaa

SEQ ID NO: 101166 - DNA, 22 bp, Artificial Sequence
  chemically synthesized
aaaatgtgaatgtgaaacagtt

SEQ ID NO: 101167 - DNA, 22 bp, Artificial Sequence
  chemically synthesized
aaatgtgaatgtgaaacagttc

SEQ ID NO: 101168 - DNA, 22 bp, Artificial Sequence
  chemically synthesized
tggctgagagaaatatctcagg

SEQ ID NO: 101169 - DNA, 22 bp, Artificial Sequence
  chemically synthesized
gctgagagaaatatctcaggaa

SEQ ID NO: 101170 - DNA, 22 bp, Artificial Sequence
  chemically synthesized
agagaaatatctcaggaatggc

SEQ ID NO: 101171 - DNA, 22 bp, Artificial Sequence
  chemically synthesized
aggaatggccatgttccaggct

SEQ ID NO: 101172 - DNA, 22 bp, Artificial Sequence
  chemically synthesized
caggcttcagggtaggacccat

SEQ ID NO: 101173 - DNA, 22 bp, Artificial Sequence
  chemically synthesized
cagggtaggacccatgccaggg

SEQ ID NO: 101174 - DNA, 22 bp, Artificial Sequence
  chemically synthesized
agggtaggacccatgccaggga

SEQ ID NO: 101175 - DNA, 22 bp, Artificial Sequence
  chemically synthesized
ttctgcctaaaatttctctgcc

SEQ ID NO: 101176 - DNA, 22 bp, Artificial Sequence
  chemically synthesized
tctgcctaaaatttctctgcct

SEQ ID NO: 101177 - DNA, 22 bp, Artificial Sequence
  chemically synthesized
ctgcctaaaatttctctgcctc

SEQ ID NO: 101178 - DNA, 22 bp, Artificial Sequence
  chemically synthesized
tgcctaaaatttctctgcctcc

SEQ ID NO: 101179 - DNA, 22 bp, Artificial Sequence
  chemically synthesized
cctaaaatttctctgcctcctg

SEQ ID NO: 101180 - DNA, 22 bp, Artificial Sequence
  chemically synthesized
aaatttctctgcctcctgtccc

SEQ ID NO: 101181 - DNA, 22 bp, Artificial Sequence
  chemically synthesized
ctctgcctcctgtccctatcat

SEQ ID NO: 101182 - DNA, 22 bp, Artificial Sequence
  chemically synthesized
tctgcctcctgtccctatcatt

SEQ ID NO: 101183 - DNA, 22 bp, Artificial Sequence
  chemically synthesized
tgcctcctgtccctatcattag

SEQ ID NO: 101184 - DNA, 22 bp, Artificial Sequence
  chemically synthesized
cctcctgtccctatcattagga

SEQ ID NO: 101185 - DNA, 22 bp, Artificial Sequence
  chemically synthesized
ctgtccctatcattaggaggcc

SEQ ID NO: 101186 - DNA, 22 bp, Artificial Sequence
  chemically synthesized
tccctatcattaggaggccagg

SEQ ID NO: 101187 - DNA, 22 bp, Artificial Sequence
  chemically synthesized
tcattaggaggccagggtggga

SEQ ID NO: 101188 - DNA, 22 bp, Artificial Sequence
  chemically synthesized
ggaggccagggtgggaggattg

SEQ ID NO: 101189 - DNA, 22 bp, Artificial Sequence
  chemically synthesized
cttgaggttaggaattggagag

SEQ ID NO: 101190 - DNA, 22 bp, Artificial Sequence
  chemically synthesized
gaggttaggaattggagagcag

SEQ ID NO: 101191 - DNA, 22 bp, Artificial Sequence
  chemically synthesized
aggttaggaattggagagcagc

SEQ ID NO: 101192 - DNA, 22 bp, Artificial Sequence
  chemically synthesized
ggaattggagagcagcctcggc

SEQ ID NO: 101193 - DNA, 22 bp, Artificial Sequence
  chemically synthesized
gagagcagcctcggcaacataa

SEQ ID NO: 101194 - DNA, 22 bp, Artificial Sequence
  chemically synthesized
ggcaacataacatgatcccata

SEQ ID NO: 101195 - DNA, 22 bp, Artificial Sequence
  chemically synthesized
acaaaaaataaaaacattagct

SEQ ID NO: 101196 - DNA, 22 bp, Artificial Sequence
  chemically synthesized
caaaaaataaaaacattagcta

SEQ ID NO: 101197 - DNA, 22 bp, Artificial Sequence
  chemically synthesized
gctaggtgcagtggcataaacc

SEQ ID NO: 101198 - DNA, 22 bp, Artificial Sequence
  chemically synthesized
ggtgcagtggcataaacctgta

SEQ ID NO: 101199 - DNA, 22 bp, Artificial Sequence
  chemically synthesized
tagtcctaggtactcaaaaagc

SEQ ID NO: 101200 - DNA, 22 bp, Artificial Sequence
  chemically synthesized
ggtactcaaaaagctgaggaag

SEQ ID NO: 101201 - DNA, 22 bp, Artificial Sequence
  chemically synthesized
aaaaagctgaggaagaaggatt

SEQ ID NO: 101202 - DNA, 22 bp, Artificial Sequence
  chemically synthesized
aggaagaaggattgcttgagcc

SEQ ID NO: 101203 - DNA, 22 bp, Artificial Sequence
  chemically synthesized
cttgagcccaggatttcaaggc

SEQ ID NO: 101204 - DNA, 22 bp, Artificial Sequence
  chemically synthesized
gagcccaggatttcaaggctgc

SEQ ID NO: 101205 - DNA, 22 bp, Artificial Sequence
  chemically synthesized
agcccaggatttcaaggctgca

SEQ ID NO: 101206 - DNA, 22 bp, Artificial Sequence
  chemically synthesized
caaggctgcagtgagctgtgat

SEQ ID NO: 101207 - DNA, 22 bp, Artificial Sequence
  chemically synthesized
aaggctgcagtgagctgtgatg

SEQ ID NO: 101208 - DNA, 22 bp, Artificial Sequence
  chemically synthesized
cagtgagctgtgatggcaccac

SEQ ID NO: 101209 - DNA, 22 bp, Artificial Sequence
  chemically synthesized
tgatggcaccactgcactccag

SEQ ID NO: 101210 - DNA, 22 bp, Artificial Sequence
  chemically synthesized
cactccagcctgggcaacagag

SEQ ID NO: 101211 - DNA, 22 bp, Artificial Sequence
  chemically synthesized
cagcctgggcaacagagcaaga

SEQ ID NO: 101212 - DNA, 22 bp, Artificial Sequence
  chemically synthesized
ggcaacagagcaagatcatgtc

SEQ ID NO: 101213 - DNA, 22 bp, Artificial Sequence
  chemically synthesized
taaaaataaataaataaataaa

SEQ ID NO: 101214 - DNA, 22 bp, Artificial Sequence
  chemically synthesized
tagccacaccagacaagtaaca

SEQ ID NO: 101215 - DNA, 22 bp, Artificial Sequence
  chemically synthesized
agccacaccagacaagtaacat

SEQ ID NO: 101216 - DNA, 22 bp, Artificial Sequence
  chemically synthesized
gccacaccagacaagtaacatt

SEQ ID NO: 101217 - DNA, 22 bp, Artificial Sequence
  chemically synthesized
tgtatttttaaaggactgcatt

SEQ ID NO: 101218 - DNA, 22 bp, Artificial Sequence
  chemically synthesized
ttaaaggactgcattaataaat

SEQ ID NO: 101219 - DNA, 22 bp, Artificial Sequence
  chemically synthesized
taaaggactgcattaataaatt

SEQ ID NO: 101220 - DNA, 22 bp, Artificial Sequence
  chemically synthesized
aaaggactgcattaataaattt

SEQ ID NO: 101221 - DNA, 22 bp, Artificial Sequence
  chemically synthesized
aaggactgcattaataaatttg

SEQ ID NO: 101222 - DNA, 22 bp, Artificial Sequence
  chemically synthesized
cattaataaatttgggggttta

SEQ ID NO: 101223 - DNA, 22 bp, Artificial Sequence
  chemically synthesized
ataaatttgggggtttacagaa

SEQ ID NO: 101224 - DNA, 22 bp, Artificial Sequence
  chemically synthesized
gggggtttacagaatggcaggt

SEQ ID NO: 101225 - DNA, 22 bp, Artificial Sequence
  chemically synthesized
ggggtttacagaatggcaggta

SEQ ID NO: 101226 - DNA, 22 bp, Artificial Sequence
  chemically synthesized
acagaatggcaggtagttatcc

SEQ ID NO: 101227 - DNA, 22 bp, Artificial Sequence
  chemically synthesized
cagaatggcaggtagttatcct

SEQ ID NO: 101228 - DNA, 22 bp, Artificial Sequence
  chemically synthesized
tccttgggaagacaatatgctg

SEQ ID NO: 101229 - DNA, 22 bp, Artificial Sequence
  chemically synthesized
gggaagacaatatgctgatggg

SEQ ID NO: 101230 - DNA, 22 bp, Artificial Sequence
  chemically synthesized
ggaagacaatatgctgatgggg

SEQ ID NO: 101231 - DNA, 22 bp, Artificial Sequence
  chemically synthesized
atggggaaatataattactgcc

SEQ ID NO: 101232 - DNA, 22 bp, Artificial Sequence
  chemically synthesized
ctgccctgactaaactcacagt

SEQ ID NO: 101233 - DNA, 22 bp, Artificial Sequence
  chemically synthesized
ccctgactaaactcacagtatg

SEQ ID NO: 101234 - DNA, 22 bp, Artificial Sequence
  chemically synthesized
actaaactcacagtatgacaga

SEQ ID NO: 101235 - DNA, 22 bp, Artificial Sequence
  chemically synthesized
aactcacagtatgacagagaat

SEQ ID NO: 101236 - DNA, 22 bp, Artificial Sequence
  chemically synthesized
acagtatgacagagaattaact

SEQ ID NO: 101237 - DNA, 22 bp, Artificial Sequence
  chemically synthesized
actgtgctgacttgataattcc

SEQ ID NO: 101238 - DNA, 22 bp, Artificial Sequence
  chemically synthesized
tgctgacttgataattcctcag

SEQ ID NO: 101239 - DNA, 22 bp, Artificial Sequence
  chemically synthesized
acttgataattcctcagagcag

SEQ ID NO: 101240 - DNA, 22 bp, Artificial Sequence
  chemically synthesized
gataattcctcagagcagatct

SEQ ID NO: 101241 - DNA, 22 bp, Artificial Sequence
  chemically synthesized
ataattcctcagagcagatctc

SEQ ID NO: 101242 - DNA, 22 bp, Artificial Sequence
  chemically synthesized
ctcagagcagatctctaagaga

SEQ ID NO: 101243 - DNA, 22 bp, Artificial Sequence
  chemically synthesized
agagcagatctctaagagagct

SEQ ID NO: 101244 - DNA, 22 bp, Artificial Sequence
  chemically synthesized
taagagagcttatagacacaac

SEQ ID NO: 101245 - DNA, 22 bp, Artificial Sequence
  chemically synthesized
agagagcttatagacacaacgc

SEQ ID NO: 101246 - DNA, 22 bp, Artificial Sequence
  chemically synthesized
atagacacaacgcctgcttcac

SEQ ID NO: 101247 - DNA, 22 bp, Artificial Sequence
  chemically synthesized
tagacacaacgcctgcttcaca

SEQ ID NO: 101248 - DNA, 22 bp, Artificial Sequence
  chemically synthesized
cttcacaaggttctcaagtatg

SEQ ID NO: 101249 - DNA, 22 bp, Artificial Sequence
  chemically synthesized
cacaaggttctcaagtatggca

SEQ ID NO: 101250 - DNA, 22 bp, Artificial Sequence
  chemically synthesized
acaaggttctcaagtatggcaa

SEQ ID NO: 101251 - DNA, 22 bp, Artificial Sequence
  chemically synthesized
tcaagtatggcaaacttgtcag

SEQ ID NO: 101252 - DNA, 22 bp, Artificial Sequence
  chemically synthesized
aagtatggcaaacttgtcagtc

SEQ ID NO: 101253 - DNA, 22 bp, Artificial Sequence
  chemically synthesized
gtcagtcagggtgagactgagg

SEQ ID NO: 101254 - DNA, 22 bp, Artificial Sequence
  chemically synthesized
tcagtcagggtgagactgagga

SEQ ID NO: 101255 - DNA, 22 bp, Artificial Sequence
  chemically synthesized
aggatgaggtctaagagacttg

SEQ ID NO: 101256 - DNA, 22 bp, Artificial Sequence
  chemically synthesized
agagacttgtctggaagctgca

SEQ ID NO: 101257 - DNA, 22 bp, Artificial Sequence
  chemically synthesized
gtctggaagctgcacttgtttg

SEQ ID NO: 101258 - DNA, 22 bp, Artificial Sequence
  chemically synthesized
tctggaagctgcacttgtttga

SEQ ID NO: 101259 - DNA, 22 bp, Artificial Sequence
  chemically synthesized
gaagctgcacttgtttgaaagg

SEQ ID NO: 101260 - DNA, 22 bp, Artificial Sequence
  chemically synthesized
cacttgtttgaaaggacactga

SEQ ID NO: 101261 - DNA, 22 bp, Artificial Sequence
  chemically synthesized
gtttgaaaggacactgatttta

SEQ ID NO: 101262 - DNA, 22 bp, Artificial Sequence
  chemically synthesized
tttgaaaggacactgattttac

SEQ ID NO: 101263 - DNA, 22 bp, Artificial Sequence
  chemically synthesized
gaaaggacactgattttacttc

SEQ ID NO: 101264 - DNA, 22 bp, Artificial Sequence
  chemically synthesized
aaaggacactgattttacttca

SEQ ID NO: 101265 - DNA, 22 bp, Artificial Sequence
  chemically synthesized
attttacttcagtggtgcaata

SEQ ID NO: 101266 - DNA, 22 bp, Artificial Sequence
  chemically synthesized
tacttcagtggtgcaataaatg

SEQ ID NO: 101267 - DNA, 22 bp, Artificial Sequence
  chemically synthesized
acttcagtggtgcaataaatgt

SEQ ID NO: 101268 - DNA, 22 bp, Artificial Sequence
  chemically synthesized
cttcagtggtgcaataaatgtc

SEQ ID NO: 101269 - DNA, 22 bp, Artificial Sequence
  chemically synthesized
cagtggtgcaataaatgtcctt

SEQ ID NO: 101270 - DNA, 22 bp, Artificial Sequence
  chemically synthesized
agtggtgcaataaatgtcctta

SEQ ID NO: 101271 - DNA, 22 bp, Artificial Sequence
  chemically synthesized
atatatcactggatcagcaggt

SEQ ID NO: 101272 - DNA, 22 bp, Artificial Sequence
  chemically synthesized
tatatcactggatcagcaggtg

SEQ ID NO: 101273 - DNA, 22 bp, Artificial Sequence
  chemically synthesized
gatcagcaggtggatgctgact

SEQ ID NO: 101274 - DNA, 22 bp, Artificial Sequence
  chemically synthesized
acttaataattgaaaggatttt

SEQ ID NO: 101275 - DNA, 22 bp, Artificial Sequence
  chemically synthesized
aataattgaaaggattttcaaa

SEQ ID NO: 101276 - DNA, 22 bp, Artificial Sequence
  chemically synthesized
ataattgaaaggattttcaaac

SEQ ID NO: 101277 - DNA, 22 bp, Artificial Sequence
  chemically synthesized
aaaggattttcaaactaagaag

SEQ ID NO: 101278 - DNA, 22 bp, Artificial Sequence
  chemically synthesized
tcaaactaagaagttgtaaaat

SEQ ID NO: 101279 - DNA, 22 bp, Artificial Sequence
  chemically synthesized
caaactaagaagttgtaaaata

SEQ ID NO: 101280 - DNA, 22 bp, Artificial Sequence
  chemically synthesized
aaactaagaagttgtaaaatat

SEQ ID NO: 101281 - DNA, 22 bp, Artificial Sequence
  chemically synthesized
agaagttgtaaaatataatata

SEQ ID NO: 101282 - DNA, 22 bp, Artificial Sequence
  chemically synthesized
taaaatataatatataggttat

SEQ ID NO: 101283 - DNA, 22 bp, Artificial Sequence
  chemically synthesized
tgaatataattaaaattaaaac

SEQ ID NO: 101284 - DNA, 22 bp, Artificial Sequence
  chemically synthesized
aaattaaaacgcataaatatac

SEQ ID NO: 101285 - DNA, 22 bp, Artificial Sequence
  chemically synthesized
aaacgcataaatatacatttac

SEQ ID NO: 101286 - DNA, 22 bp, Artificial Sequence
  chemically synthesized
acttaagaaaatgagtgatttt

SEQ ID NO: 101287 - DNA, 22 bp, Artificial Sequence
  chemically synthesized
cttaagaaaatgagtgattttt

SEQ ID NO: 101288 - DNA, 22 bp, Artificial Sequence
  chemically synthesized
aagaaaatgagtgatttttaaa

SEQ ID NO: 101289 - DNA, 22 bp, Artificial Sequence
  chemically synthesized
agaaaatgagtgatttttaaaa

SEQ ID NO: 101290 - DNA, 22 bp, Artificial Sequence
  chemically synthesized
ttaaaatttatcctttttaatt

SEQ ID NO: 101291 - DNA, 22 bp, Artificial Sequence
  chemically synthesized
taaaatttatcctttttaattg

SEQ ID NO: 101292 - DNA, 22 bp, Artificial Sequence
  chemically synthesized
aaaatttatcctttttaattga

SEQ ID NO: 101293 - DNA, 22 bp, Artificial Sequence
  chemically synthesized
aaatttatcctttttaattgat

SEQ ID NO: 101294 - DNA, 22 bp, Artificial Sequence
  chemically synthesized
atcctttttaattgatttttga

SEQ ID NO: 101295 - DNA, 22 bp, Artificial Sequence
  chemically synthesized
tcctttttaattgatttttgac

SEQ ID NO: 101296 - DNA, 22 bp, Artificial Sequence
  chemically synthesized
tttaattgatttttgactattg

SEQ ID NO: 101297 - DNA, 22 bp, Artificial Sequence
  chemically synthesized
ttaattgatttttgactattga

SEQ ID NO: 101298 - DNA, 22 bp, Artificial Sequence
  chemically synthesized
taattgatttttgactattgat

SEQ ID NO: 101299 - DNA, 22 bp, Artificial Sequence
  chemically synthesized
aattgatttttgactattgata

SEQ ID NO: 101300 - DNA, 22 bp, Artificial Sequence
  chemically synthesized
attgatttttgactattgatac

SEQ ID NO: 101301 - DNA, 22 bp, Artificial Sequence
  chemically synthesized
atttttgactattgatacaggc

SEQ ID NO: 101302 - DNA, 22 bp, Artificial Sequence
  chemically synthesized
ttgactattgatacaggctgtt

SEQ ID NO: 101303 - DNA, 22 bp, Artificial Sequence
  chemically synthesized
tgactattgatacaggctgttt

SEQ ID NO: 101304 - DNA, 22 bp, Artificial Sequence
  chemically synthesized
gactattgatacaggctgttta

SEQ ID NO: 101305 - DNA, 22 bp, Artificial Sequence
  chemically synthesized
actattgatacaggctgtttaa

SEQ ID NO: 101306 - DNA, 22 bp, Artificial Sequence
  chemically synthesized
ttgatacaggctgtttaaagat

SEQ ID NO: 101307 - DNA, 22 bp, Artificial Sequence
  chemically synthesized
atacaggctgtttaaagatcaa

SEQ ID NO: 101308 - DNA, 22 bp, Artificial Sequence
  chemically synthesized
tttaaagatcaataggctataa

SEQ ID NO: 101309 - DNA, 22 bp, Artificial Sequence
  chemically synthesized
aaagatcaataggctataatat

SEQ ID NO: 101310 - DNA, 22 bp, Artificial Sequence
  chemically synthesized
aagatcaataggctataatatc

SEQ ID NO: 101311 - DNA, 22 bp, Artificial Sequence
  chemically synthesized
taatatcatattatgtcatccc

SEQ ID NO: 101312 - DNA, 22 bp, Artificial Sequence
  chemically synthesized
tgtcatcccttgctaacatatg

SEQ ID NO: 101313 - DNA, 22 bp, Artificial Sequence
  chemically synthesized
gctaacatatgagtaaacttga

SEQ ID NO: 101314 - DNA, 22 bp, Artificial Sequence
  chemically synthesized
ctaacatatgagtaaacttgag

SEQ ID NO: 101315 - DNA, 22 bp, Artificial Sequence
  chemically synthesized
acatatgagtaaacttgagctc

SEQ ID NO: 101316 - DNA, 22 bp, Artificial Sequence
  chemically synthesized
gagctctcaacttgatcttccc

SEQ ID NO: 101317 - DNA, 22 bp, Artificial Sequence
  chemically synthesized
agctctcaacttgatcttccca

SEQ ID NO: 101318 - DNA, 22 bp, Artificial Sequence
  chemically synthesized
tcaacttgatcttcccacttct

SEQ ID NO: 101319 - DNA, 22 bp, Artificial Sequence
  chemically synthesized
aacttgatcttcccacttcttc

SEQ ID NO: 101320 - DNA, 22 bp, Artificial Sequence
  chemically synthesized
gatcttcccacttcttcttatt

SEQ ID NO: 101321 - DNA, 22 bp, Artificial Sequence
  chemically synthesized
atcttcccacttcttcttattt

SEQ ID NO: 101322 - DNA, 22 bp, Artificial Sequence
  chemically synthesized
cccacttcttcttatttataat

SEQ ID NO: 101323 - DNA, 22 bp, Artificial Sequence
  chemically synthesized
ccacttcttcttatttataatt

SEQ ID NO: 101324 - DNA, 22 bp, Artificial Sequence
  chemically synthesized
cttcttatttataattagatac

SEQ ID NO: 101325 - DNA, 22 bp, Artificial Sequence
  chemically synthesized
ttcttatttataattagatacc

SEQ ID NO: 101326 - DNA, 22 bp, Artificial Sequence
  chemically synthesized
cttatttataattagatacctc

SEQ ID NO: 101327 - DNA, 22 bp, Artificial Sequence
  chemically synthesized
ttatttataattagatacctct

SEQ ID NO: 101328 - DNA, 22 bp, Artificial Sequence
  chemically synthesized
atttataattagatacctctgt

SEQ ID NO: 101329 - DNA, 22 bp, Artificial Sequence
  chemically synthesized
tttataattagatacctctgtt

SEQ ID NO: 101330 - DNA, 22 bp, Artificial Sequence
  chemically synthesized
ataattagatacctctgtttct

SEQ ID NO: 101331 - DNA, 22 bp, Artificial Sequence
  chemically synthesized
taattagatacctctgtttctt

SEQ ID NO: 101332 - DNA, 22 bp, Artificial Sequence
  chemically synthesized
gatacctctgtttcttagactt

SEQ ID NO: 101333 - DNA, 22 bp, Artificial Sequence
  chemically synthesized
tgtttcttagacttcgctatca

SEQ ID NO: 101334 - DNA, 22 bp, Artificial Sequence
  chemically synthesized
tttcttagacttcgctatcata

SEQ ID NO: 101335 - DNA, 22 bp, Artificial Sequence
  chemically synthesized
cttagacttcgctatcatacct

SEQ ID NO: 101336 - DNA, 22 bp, Artificial Sequence
  chemically synthesized
ttagacttcgctatcatacctt

SEQ ID NO: 101337 - DNA, 22 bp, Artificial Sequence
  chemically synthesized
agacttcgctatcataccttat

SEQ ID NO: 101338 - DNA, 22 bp, Artificial Sequence
  chemically synthesized
gacttcgctatcataccttatt

SEQ ID NO: 101339 - DNA, 22 bp, Artificial Sequence
  chemically synthesized
cgctatcataccttattttcag

SEQ ID NO: 101340 - DNA, 22 bp, Artificial Sequence
  chemically synthesized
gctatcataccttattttcagc

SEQ ID NO: 101341 - DNA, 22 bp, Artificial Sequence
  chemically synthesized
tcataccttattttcagcacat

SEQ ID NO: 101342 - DNA, 22 bp, Artificial Sequence
  chemically synthesized
attttcagcacatcgcccctaa

SEQ ID NO: 101343 - DNA, 22 bp, Artificial Sequence
  chemically synthesized
ttttcagcacatcgcccctaag

SEQ ID NO: 101344 - DNA, 22 bp, Artificial Sequence
  chemically synthesized
tcagcacatcgcccctaagttt

SEQ ID NO: 101345 - DNA, 22 bp, Artificial Sequence
  chemically synthesized
cagcacatcgcccctaagtttg

SEQ ID NO: 101346 - DNA, 22 bp, Artificial Sequence
  chemically synthesized
agcacatcgcccctaagtttgc

SEQ ID NO: 101347 - DNA, 22 bp, Artificial Sequence
  chemically synthesized
agtttgcattacacatttacac

SEQ ID NO: 101348 - DNA, 22 bp, Artificial Sequence
  chemically synthesized
gcattacacatttacacattgt

SEQ ID NO: 101349 - DNA, 22 bp, Artificial Sequence
  chemically synthesized
cattacacatttacacattgtt

SEQ ID NO: 101350 - DNA, 22 bp, Artificial Sequence
  chemically synthesized
cacatttacacattgttgtagg

SEQ ID NO: 101351 - DNA, 22 bp, Artificial Sequence
  chemically synthesized
acacattgttgtaggctgtctt

SEQ ID NO: 101352 - DNA, 22 bp, Artificial Sequence
  chemically synthesized
cacattgttgtaggctgtcttc

SEQ ID NO: 101353 - DNA, 22 bp, Artificial Sequence
  chemically synthesized
ttgtaggctgtcttcttataac

SEQ ID NO: 101354 - DNA, 22 bp, Artificial Sequence
  chemically synthesized
taggctgtcttcttataacaat

SEQ ID NO: 101355 - DNA, 22 bp, Artificial Sequence
  chemically synthesized
tcttcttataacaatcaagaaa

SEQ ID NO: 101356 - DNA, 22 bp, Artificial Sequence
  chemically synthesized
cttataacaatcaagaaaacag

SEQ ID NO: 101357 - DNA, 22 bp, Artificial Sequence
  chemically synthesized
ttataacaatcaagaaaacagc

SEQ ID NO: 101358 - DNA, 22 bp, Artificial Sequence
  chemically synthesized
ataacaatcaagaaaacagcat

SEQ ID NO: 101359 - DNA, 22 bp, Artificial Sequence
  chemically synthesized
taacaatcaagaaaacagcatc

SEQ ID NO: 101360 - DNA, 22 bp, Artificial Sequence
  chemically synthesized
ctgacaaatacatttgccattt

SEQ ID NO: 101361 - DNA, 22 bp, Artificial Sequence
  chemically synthesized
acaaatacatttgccattttta

SEQ ID NO: 101362 - DNA, 22 bp, Artificial Sequence
  chemically synthesized
gccatttttacaaaaaaccctt

SEQ ID NO: 101363 - DNA, 22 bp, Artificial Sequence
  chemically synthesized
ccatttttacaaaaaaccctta

SEQ ID NO: 101364 - DNA, 22 bp, Artificial Sequence
  chemically synthesized
ttacaaaaaacccttattcgcc

SEQ ID NO: 101365 - DNA, 22 bp, Artificial Sequence
  chemically synthesized
tacaaaaaacccttattcgcct

SEQ ID NO: 101366 - DNA, 22 bp, Artificial Sequence
  chemically synthesized
acaaaaaacccttattcgcctg

SEQ ID NO: 101367 - DNA, 22 bp, Artificial Sequence
  chemically synthesized
caaaaaacccttattcgcctga

SEQ ID NO: 101368 - DNA, 22 bp, Artificial Sequence
  chemically synthesized
attcgcctgaaaattttaatac

SEQ ID NO: 101369 - DNA, 22 bp, Artificial Sequence
  chemically synthesized
ttcgcctgaaaattttaatacc

SEQ ID NO: 101370 - DNA, 22 bp, Artificial Sequence
  chemically synthesized
gcctgaaaattttaataccgct

SEQ ID NO: 101371 - DNA, 22 bp, Artificial Sequence
  chemically synthesized
aaaattttaataccgctatgtt

SEQ ID NO: 101372 - DNA, 22 bp, Artificial Sequence
  chemically synthesized
taataccgctatgttttttact

SEQ ID NO: 101373 - DNA, 22 bp, Artificial Sequence
  chemically synthesized
aataccgctatgttttttactc

SEQ ID NO: 101374 - DNA, 22 bp, Artificial Sequence
  chemically synthesized
ataccgctatgttttttactct

SEQ ID NO: 101375 - DNA, 22 bp, Artificial Sequence
  chemically synthesized
tgttttttactcttacagacat

SEQ ID NO: 101376 - DNA, 22 bp, Artificial Sequence
  chemically synthesized
tttactcttacagacatccttt

SEQ ID NO: 101377 - DNA, 22 bp, Artificial Sequence
  chemically synthesized
ttactcttacagacatcctttc

SEQ ID NO: 101378 - DNA, 22 bp, Artificial Sequence
  chemically synthesized
tactcttacagacatcctttca

SEQ ID NO: 101379 - DNA, 22 bp, Artificial Sequence
  chemically synthesized
actcttacagacatcctttcag

SEQ ID NO: 101380 - DNA, 22 bp, Artificial Sequence
  chemically synthesized
ctcttacagacatcctttcagt

SEQ ID NO: 101381 - DNA, 22 bp, Artificial Sequence
  chemically synthesized
ttacagacatcctttcagtggt

SEQ ID NO: 101382 - DNA, 22 bp, Artificial Sequence
  chemically synthesized
acagacatcctttcagtggtca

SEQ ID NO: 101383 - DNA, 22 bp, Artificial Sequence
  chemically synthesized
cagacatcctttcagtggtcaa

SEQ ID NO: 101384 - DNA, 22 bp, Artificial Sequence
  chemically synthesized
tcagtggtcaatagagatgcag

SEQ ID NO: 101385 - DNA, 22 bp, Artificial Sequence
  chemically synthesized
cagtggtcaatagagatgcagc

SEQ ID NO: 101386 - DNA, 22 bp, Artificial Sequence
  chemically synthesized
agtggtcaatagagatgcagct

SEQ ID NO: 101387 - DNA, 22 bp, Artificial Sequence
  chemically synthesized
tcctaaatgtagtttgtatgtt

SEQ ID NO: 101388 - DNA, 22 bp, Artificial Sequence
  chemically synthesized
cctaaatgtagtttgtatgtta

SEQ ID NO: 101389 - DNA, 22 bp, Artificial Sequence
  chemically synthesized
ctaaatgtagtttgtatgttag

SEQ ID NO: 101390 - DNA, 22 bp, Artificial Sequence
  chemically synthesized
aatgtagtttgtatgttagcac

SEQ ID NO: 101391 - DNA, 22 bp, Artificial Sequence
  chemically synthesized
gtatgttagcacaatgtgcatt

SEQ ID NO: 101392 - DNA, 22 bp, Artificial Sequence
  chemically synthesized
tatgttagcacaatgtgcattt

SEQ ID NO: 101393 - DNA, 22 bp, Artificial Sequence
  chemically synthesized
gcacaatgtgcattttagacca

SEQ ID NO: 101394 - DNA, 22 bp, Artificial Sequence
  chemically synthesized
tagaccaaacaacaaaggcaac

SEQ ID NO: 101395 - DNA, 22 bp, Artificial Sequence
  chemically synthesized
agaccaaacaacaaaggcaacc

SEQ ID NO: 101396 - DNA, 22 bp, Artificial Sequence
  chemically synthesized
gaccaaacaacaaaggcaacca

SEQ ID NO: 101397 - DNA, 22 bp, Artificial Sequence
  chemically synthesized
ctaaatagaataaactctgtat

SEQ ID NO: 101398 - DNA, 22 bp, Artificial Sequence
  chemically synthesized
taaatagaataaactctgtatg

SEQ ID NO: 101399 - DNA, 22 bp, Artificial Sequence
  chemically synthesized
aatagaataaactctgtatgcc

SEQ ID NO: 101400 - DNA, 22 bp, Artificial Sequence
  chemically synthesized
tgtatgccaactttggaaaaac

SEQ ID NO: 101401 - DNA, 22 bp, Artificial Sequence
  chemically synthesized
tatgccaactttggaaaaacaa

SEQ ID NO: 101402 - DNA, 22 bp, Artificial Sequence
  chemically synthesized
tggaaaaacaaataaataaatt

SEQ ID NO: 101403 - DNA, 22 bp, Artificial Sequence
  chemically synthesized
ggaaaaacaaataaataaattt

SEQ ID NO: 101404 - DNA, 22 bp, Artificial Sequence
  chemically synthesized
gaaaaacaaataaataaatttt

SEQ ID NO: 101405 - DNA, 22 bp, Artificial Sequence
  chemically synthesized
tacacagagaataacaactaaa

SEQ ID NO: 101406 - DNA, 22 bp, Artificial Sequence
  chemically synthesized
acacagagaataacaactaaaa

SEQ ID NO: 101407 - DNA, 22 bp, Artificial Sequence
  chemically synthesized
cacagagaataacaactaaaat

SEQ ID NO: 101408 - DNA, 22 bp, Artificial Sequence
  chemically synthesized
aaatgacaatgaataaaccccc

SEQ ID NO: 101409 - DNA, 22 bp, Artificial Sequence
  chemically synthesized
ctttcaaagaactctcacaaac

SEQ ID NO: 101410 - DNA, 22 bp, Artificial Sequence
  chemically synthesized
tcaaagaactctcacaaacaat

SEQ ID NO: 101411 - DNA, 22 bp, Artificial Sequence
  chemically synthesized
caaagaactctcacaaacaatt

SEQ ID NO: 101412 - DNA, 22 bp, Artificial Sequence
  chemically synthesized
aaagaactctcacaaacaattc

SEQ ID NO: 101413 - DNA, 22 bp, Artificial Sequence
  chemically synthesized
tcacaaacaattcgcacaataa

SEQ ID NO: 101414 - DNA, 22 bp, Artificial Sequence
  chemically synthesized
acaaacaattcgcacaataact

SEQ ID NO: 101415 - DNA, 22 bp, Artificial Sequence
  chemically synthesized
gcacaataactgaatccttcag

SEQ ID NO: 101416 - DNA, 22 bp, Artificial Sequence
  chemically synthesized
aatccttcaggagtagtcattt

SEQ ID NO: 101417 - DNA, 22 bp, Artificial Sequence
  chemically synthesized
caggagtagtcatttattagtt

SEQ ID NO: 101418 - DNA, 22 bp, Artificial Sequence
  chemically synthesized
aggagtagtcatttattagttt

SEQ ID NO: 101419 - DNA, 22 bp, Artificial Sequence
  chemically synthesized
attagtttttatttttcctgca

SEQ ID NO: 101420 - DNA, 22 bp, Artificial Sequence
  chemically synthesized
ttagtttttatttttcctgcat

SEQ ID NO: 101421 - DNA, 22 bp, Artificial Sequence
  chemically synthesized
gtttttatttttcctgcatcca

SEQ ID NO: 101422 - DNA, 22 bp, Artificial Sequence
  chemically synthesized
ttatttttcctgcatccaaatg

SEQ ID NO: 101423 - DNA, 22 bp, Artificial Sequence
  chemically synthesized
tatttttcctgcatccaaatgg

SEQ ID NO: 101424 - DNA, 22 bp, Artificial Sequence
  chemically synthesized
atttttcctgcatccaaatggg

SEQ ID NO: 101425 - DNA, 22 bp, Artificial Sequence
  chemically synthesized
tttttcctgcatccaaatgggc

SEQ ID NO: 101426 - DNA, 22 bp, Artificial Sequence
  chemically synthesized
ttcctgcatccaaatgggcctt

SEQ ID NO: 101427 - DNA, 22 bp, Artificial Sequence
  chemically synthesized
tcctgcatccaaatgggccttc

SEQ ID NO: 101428 - DNA, 22 bp, Artificial Sequence
  chemically synthesized
cctgcatccaaatgggccttct

SEQ ID NO: 101429 - DNA, 22 bp, Artificial Sequence
  chemically synthesized
ctgcatccaaatgggccttcta

SEQ ID NO: 101430 - DNA, 22 bp, Artificial Sequence
  chemically synthesized
catccaaatgggccttctaatt

SEQ ID NO: 101431 - DNA, 22 bp, Artificial Sequence
  chemically synthesized
ctaatttggagaaatactgcat

SEQ ID NO: 101432 - DNA, 22 bp, Artificial Sequence
  chemically synthesized
taatttggagaaatactgcatt

SEQ ID NO: 101433 - DNA, 22 bp, Artificial Sequence
  chemically synthesized
atttggagaaatactgcattat

SEQ ID NO: 101434 - DNA, 22 bp, Artificial Sequence
  chemically synthesized
ggagaaatactgcattatttag

SEQ ID NO: 101435 - DNA, 22 bp, Artificial Sequence
  chemically synthesized
gagaaatactgcattatttagc

SEQ ID NO: 101436 - DNA, 22 bp, Artificial Sequence
  chemically synthesized
cattatttagctttagttttca

SEQ ID NO: 101437 - DNA, 22 bp, Artificial Sequence
  chemically synthesized
tttagctttagttttcagtaag

SEQ ID NO: 101438 - DNA, 22 bp, Artificial Sequence
  chemically synthesized
agctttagttttcagtaagtat

SEQ ID NO: 101439 - DNA, 22 bp, Artificial Sequence
  chemically synthesized
gctttagttttcagtaagtatt

SEQ ID NO: 101440 - DNA, 22 bp, Artificial Sequence
  chemically synthesized
tagttttcagtaagtattttct

SEQ ID NO: 101441 - DNA, 22 bp, Artificial Sequence
  chemically synthesized
agttttcagtaagtattttctt

SEQ ID NO: 101442 - DNA, 22 bp, Artificial Sequence
  chemically synthesized
gttttcagtaagtattttctta

SEQ ID NO: 101443 - DNA, 22 bp, Artificial Sequence
  chemically synthesized
tcagtaagtattttcttatcaa

SEQ ID NO: 101444 - DNA, 22 bp, Artificial Sequence
  chemically synthesized
cagtaagtattttcttatcaaa

SEQ ID NO: 101445 - DNA, 22 bp, Artificial Sequence
  chemically synthesized
agtaagtattttcttatcaaat

SEQ ID NO: 101446 - DNA, 22 bp, Artificial Sequence
  chemically synthesized
tcttatcaaatctctggaatat

SEQ ID NO: 101447 - DNA, 22 bp, Artificial Sequence
  chemically synthesized
cttatcaaatctctggaatatt

SEQ ID NO: 101448 - DNA, 22 bp, Artificial Sequence
  chemically synthesized
ttatcaaatctctggaatattt

SEQ ID NO: 101449 - DNA, 22 bp, Artificial Sequence
  chemically synthesized
atcaaatctctggaatattttc

SEQ ID NO: 101450 - DNA, 22 bp, Artificial Sequence
  chemically synthesized
tcaaatctctggaatattttca

SEQ ID NO: 101451 - DNA, 22 bp, Artificial Sequence
  chemically synthesized
tggaatattttcagagtgctca

SEQ ID NO: 101452 - DNA, 22 bp, Artificial Sequence
  chemically synthesized
gaatattttcagagtgctcact

SEQ ID NO: 101453 - DNA, 22 bp, Artificial Sequence
  chemically synthesized
tcagagtgctcactgtccagat

SEQ ID NO: 101454 - DNA, 22 bp, Artificial Sequence
  chemically synthesized
cagagtgctcactgtccagatg

SEQ ID NO: 101455 - DNA, 22 bp, Artificial Sequence
  chemically synthesized
agagtgctcactgtccagatgt

SEQ ID NO: 101456 - DNA, 22 bp, Artificial Sequence
  chemically synthesized
actgtccagatgtaaaataaat

SEQ ID NO: 101457 - DNA, 22 bp, Artificial Sequence
  chemically synthesized
tccagatgtaaaataaatatga

SEQ ID NO: 101458 - DNA, 22 bp, Artificial Sequence
  chemically synthesized
cttaagtgaagcagagagaatt

SEQ ID NO: 101459 - DNA, 22 bp, Artificial Sequence
  chemically synthesized
ttaagtgaagcagagagaattt

SEQ ID NO: 101460 - DNA, 22 bp, Artificial Sequence
  chemically synthesized
aagtgaagcagagagaatttag

SEQ ID NO: 101461 - DNA, 22 bp, Artificial Sequence
  chemically synthesized
agtgaagcagagagaatttaga

SEQ ID NO: 101462 - DNA, 22 bp, Artificial Sequence
  chemically synthesized
agaatggaataattatatactg

SEQ ID NO: 101463 - DNA, 22 bp, Artificial Sequence
  chemically synthesized
gaatggaataattatatactgg

SEQ ID NO: 101464 - DNA, 22 bp, Artificial Sequence
  chemically synthesized
tatactgggttctgaacatgga

SEQ ID NO: 101465 - DNA, 22 bp, Artificial Sequence
  chemically synthesized
ggttctgaacatggactttcaa

SEQ ID NO: 101466 - DNA, 22 bp, Artificial Sequence
  chemically synthesized
tgaacatggactttcaatcaga

SEQ ID NO: 101467 - DNA, 22 bp, Artificial Sequence
  chemically synthesized
aacatggactttcaatcagaaa

SEQ ID NO: 101468 - DNA, 22 bp, Artificial Sequence
  chemically synthesized
tcaatcagaaaagaaaatatta

SEQ ID NO: 101469 - DNA, 22 bp, Artificial Sequence
  chemically synthesized
caatcagaaaagaaaatattag

SEQ ID NO: 101470 - DNA, 22 bp, Artificial Sequence
  chemically synthesized
aatcagaaaagaaaatattaga

SEQ ID NO: 101471 - DNA, 22 bp, Artificial Sequence
  chemically synthesized
gaagcaagctcaacgagaactt

SEQ ID NO: 101472 - DNA, 22 bp, Artificial Sequence
  chemically synthesized
aacgagaacttaaaaattggaa

SEQ ID NO: 101473 - DNA, 22 bp, Artificial Sequence
  chemically synthesized
aaaaattggaagaaacagcagt

SEQ ID NO: 101474 - DNA, 22 bp, Artificial Sequence
  chemically synthesized
aaaattggaagaaacagcagtc

SEQ ID NO: 101475 - DNA, 22 bp, Artificial Sequence
  chemically synthesized
gaagaaacagcagtcttcagag

SEQ ID NO: 101476 - DNA, 22 bp, Artificial Sequence
  chemically synthesized
cagagaggaatgaatgcaactt

SEQ ID NO: 101477 - DNA, 22 bp, Artificial Sequence
  chemically synthesized
agagaggaatgaatgcaacttt

SEQ ID NO: 101478 - DNA, 22 bp, Artificial Sequence
  chemically synthesized
ttgagattagtttcctataagg

SEQ ID NO: 101479 - DNA, 22 bp, Artificial Sequence
  chemically synthesized
tgagattagtttcctataagga

SEQ ID NO: 101480 - DNA, 22 bp, Artificial Sequence
  chemically synthesized
gagattagtttcctataaggag

SEQ ID NO: 101481 - DNA, 22 bp, Artificial Sequence
  chemically synthesized
agattagtttcctataaggaga

SEQ ID NO: 101482 - DNA, 22 bp, Artificial Sequence
  chemically synthesized
gtttcctataaggagatcagct

SEQ ID NO: 101483 - DNA, 22 bp, Artificial Sequence
  chemically synthesized
cctataaggagatcagctgcaa

SEQ ID NO: 101484 - DNA, 22 bp, Artificial Sequence
  chemically synthesized
ctataaggagatcagctgcaaa

SEQ ID NO: 101485 - DNA, 22 bp, Artificial Sequence
  chemically synthesized
taaggagatcagctgcaaatac

SEQ ID NO: 101486 - DNA, 22 bp, Artificial Sequence
  chemically synthesized
caaatactagcgcagaactagc

SEQ ID NO: 101487 - DNA, 22 bp, Artificial Sequence
  chemically synthesized
gcgcagaactagcagtagatga

SEQ ID NO: 101488 - DNA, 22 bp, Artificial Sequence
  chemically synthesized
gcagtagatgaagaaattgtca

SEQ ID NO: 101489 - DNA, 22 bp, Artificial Sequence
  chemically synthesized
tcatcccctgttacactaatag

SEQ ID NO: 101490 - DNA, 22 bp, Artificial Sequence
  chemically synthesized
ttacactaatagcaagtggtag

SEQ ID NO: 101491 - DNA, 22 bp, Artificial Sequence
  chemically synthesized
cactaatagcaagtggtagact

SEQ ID NO: 101492 - DNA, 22 bp, Artificial Sequence
  chemically synthesized
atagcaagtggtagactgcggt

SEQ ID NO: 101493 - DNA, 22 bp, Artificial Sequence
  chemically synthesized
cggttcagacccaatgaacagc

SEQ ID NO: 101494 - DNA, 22 bp, Artificial Sequence
  chemically synthesized
agacccaatgaacagcataaag

SEQ ID NO: 101495 - DNA, 22 bp, Artificial Sequence
  chemically synthesized
acaaacactttgaagaagattg

SEQ ID NO: 101496 - DNA, 22 bp, Artificial Sequence
  chemically synthesized
caaacactttgaagaagattga

SEQ ID NO: 101497 - DNA, 22 bp, Artificial Sequence
  chemically synthesized
tgaagaagattgaaggaagaaa

SEQ ID NO: 101498 - DNA, 22 bp, Artificial Sequence
  chemically synthesized
gaagaagattgaaggaagaaac

SEQ ID NO: 101499 - DNA, 22 bp, Artificial Sequence
  chemically synthesized
aagaagattgaaggaagaaact

SEQ ID NO: 101500 - DNA, 22 bp, Artificial Sequence
  chemically synthesized
aaggaagaaactattccatcag

SEQ ID NO: 101501 - DNA, 22 bp, Artificial Sequence
  chemically synthesized
ttccatcagtgaaaaatttcta

SEQ ID NO: 101502 - DNA, 22 bp, Artificial Sequence
  chemically synthesized
catcagtgaaaaatttctaaaa

SEQ ID NO: 101503 - DNA, 22 bp, Artificial Sequence
  chemically synthesized
ctaaaatataacattacctttg

SEQ ID NO: 101504 - DNA, 22 bp, Artificial Sequence
  chemically synthesized
taaaatataacattacctttgc

SEQ ID NO: 101505 - DNA, 22 bp, Artificial Sequence
  chemically synthesized
aaatataacattacctttgcca

SEQ ID NO: 101506 - DNA, 22 bp, Artificial Sequence
  chemically synthesized
cctttgccaagtttttgcatta

SEQ ID NO: 101507 - DNA, 22 bp, Artificial Sequence
  chemically synthesized
tgccaagtttttgcattaatta

SEQ ID NO: 101508 - DNA, 22 bp, Artificial Sequence
  chemically synthesized
gccaagtttttgcattaattat

SEQ ID NO: 101509 - DNA, 22 bp, Artificial Sequence
  chemically synthesized
ccaagtttttgcattaattatc

SEQ ID NO: 101510 - DNA, 22 bp, Artificial Sequence
  chemically synthesized
ttgcattaattatcaaaactat

SEQ ID NO: 101511 - DNA, 22 bp, Artificial Sequence
  chemically synthesized
tgcattaattatcaaaactatt

SEQ ID NO: 101512 - DNA, 22 bp, Artificial Sequence
  chemically synthesized
gcattaattatcaaaactattt

SEQ ID NO: 101513 - DNA, 22 bp, Artificial Sequence
  chemically synthesized
cattaattatcaaaactatttc

SEQ ID NO: 101514 - DNA, 22 bp, Artificial Sequence
  chemically synthesized
attatcaaaactatttcatgaa

SEQ ID NO: 101515 - DNA, 22 bp, Artificial Sequence
  chemically synthesized
tcaaaactatttcatgaagtga

SEQ ID NO: 101516 - DNA, 22 bp, Artificial Sequence
  chemically synthesized
tttcatgaagtgaaaaagtctc

SEQ ID NO: 101517 - DNA, 22 bp, Artificial Sequence
  chemically synthesized
catgaagtgaaaaagtctcgag

SEQ ID NO: 101518 - DNA, 22 bp, Artificial Sequence
  chemically synthesized
atgaagtgaaaaagtctcgaga

SEQ ID NO: 101519 - DNA, 22 bp, Artificial Sequence
  chemically synthesized
gagattttttatgtgagaagca

SEQ ID NO: 101520 - DNA, 22 bp, Artificial Sequence
  chemically synthesized
tttatgtgagaagcaagagggg

SEQ ID NO: 101521 - DNA, 22 bp, Artificial Sequence
  chemically synthesized
ttatgtgagaagcaagagggga

SEQ ID NO: 101522 - DNA, 22 bp, Artificial Sequence
  chemically synthesized
tatgtgagaagcaagaggggaa

SEQ ID NO: 101523 - DNA, 22 bp, Artificial Sequence
  chemically synthesized
atgtgagaagcaagaggggaaa

SEQ ID NO: 101524 - DNA, 22 bp, Artificial Sequence
  chemically synthesized
tgtgagaagcaagaggggaaat

SEQ ID NO: 101525 - DNA, 22 bp, Artificial Sequence
  chemically synthesized
aatttatagttggttatttttt

SEQ ID NO: 101526 - DNA, 22 bp, Artificial Sequence
  chemically synthesized
atagttggttatttttttcaga

SEQ ID NO: 101527 - DNA, 22 bp, Artificial Sequence
  chemically synthesized
tagttggttatttttttcagaa

SEQ ID NO: 101528 - DNA, 22 bp, Artificial Sequence
  chemically synthesized
gttatttttttcagaagaaaaa

SEQ ID NO: 101529 - DNA, 22 bp, Artificial Sequence
  chemically synthesized
tttttttcagaagaaaaatgtc

SEQ ID NO: 101530 - DNA, 22 bp, Artificial Sequence
  chemically synthesized
ttttcagaagaaaaatgtcagg

SEQ ID NO: 101531 - DNA, 22 bp, Artificial Sequence
  chemically synthesized
tttcagaagaaaaatgtcagga

SEQ ID NO: 101532 - DNA, 22 bp, Artificial Sequence
  chemically synthesized
ttcagaagaaaaatgtcaggag

SEQ ID NO: 101533 - DNA, 22 bp, Artificial Sequence
  chemically synthesized
tcagaagaaaaatgtcaggaga

SEQ ID NO: 101534 - DNA, 22 bp, Artificial Sequence
  chemically synthesized
cagaagaaaaatgtcaggagac

SEQ ID NO: 101535 - DNA, 22 bp, Artificial Sequence
  chemically synthesized
agaagaaaaatgtcaggagaca

SEQ ID NO: 101536 - DNA, 22 bp, Artificial Sequence
  chemically synthesized
gaaagaagaaaaagtattaagt

SEQ ID NO: 101537 - DNA, 22 bp, Artificial Sequence
  chemically synthesized
agttagtttcagcagacaatgg

SEQ ID NO: 101538 - DNA, 22 bp, Artificial Sequence
  chemically synthesized
gtttcagcagacaatgggaaga

SEQ ID NO: 101539 - DNA, 22 bp, Artificial Sequence
  chemically synthesized
cagcagacaatgggaagaagga

SEQ ID NO: 101540 - DNA, 22 bp, Artificial Sequence
  chemically synthesized
agcagacaatgggaagaaggaa

SEQ ID NO: 101541 - DNA, 22 bp, Artificial Sequence
  chemically synthesized
ggatatctggcttccacgagat

SEQ ID NO: 101542 - DNA, 22 bp, Artificial Sequence
  chemically synthesized
gcttccacgagatgataagaaa

SEQ ID NO: 101543 - DNA, 22 bp, Artificial Sequence
  chemically synthesized
ccacgagatgataagaaatgtg

SEQ ID NO: 101544 - DNA, 22 bp, Artificial Sequence
  chemically synthesized
cacgagatgataagaaatgtgt

SEQ ID NO: 101545 - DNA, 22 bp, Artificial Sequence
  chemically synthesized
gctgctatttagctgttagtct

SEQ ID NO: 101546 - DNA, 22 bp, Artificial Sequence
  chemically synthesized
ctgctatttagctgttagtctg

SEQ ID NO: 101547 - DNA, 22 bp, Artificial Sequence
  chemically synthesized
ctatttagctgttagtctgtat

SEQ ID NO: 101548 - DNA, 22 bp, Artificial Sequence
  chemically synthesized
tttagctgttagtctgtatcac

SEQ ID NO: 101549 - DNA, 22 bp, Artificial Sequence
  chemically synthesized
agctgttagtctgtatcacacg

SEQ ID NO: 101550 - DNA, 22 bp, Artificial Sequence
  chemically synthesized
gctgttagtctgtatcacacgc

SEQ ID NO: 101551 - DNA, 22 bp, Artificial Sequence
  chemically synthesized
ttagtctgtatcacacgccttt

SEQ ID NO: 101552 - DNA, 22 bp, Artificial Sequence
  chemically synthesized
gtctgtatcacacgccttttag

SEQ ID NO: 101553 - DNA, 22 bp, Artificial Sequence
  chemically synthesized
tatcacacgccttttagtagta

SEQ ID NO: 101554 - DNA, 22 bp, Artificial Sequence
  chemically synthesized
ttagtagtaaaatatgccagtc

SEQ ID NO: 101555 - DNA, 22 bp, Artificial Sequence
  chemically synthesized
tagtagtaaaatatgccagtct

SEQ ID NO: 101556 - DNA, 22 bp, Artificial Sequence
  chemically synthesized
agtagtaaaatatgccagtcta

SEQ ID NO: 101557 - DNA, 22 bp, Artificial Sequence
  chemically synthesized
gtagtaaaatatgccagtctac

SEQ ID NO: 101558 - DNA, 22 bp, Artificial Sequence
  chemically synthesized
ctaagggaaattacatttcatg

SEQ ID NO: 101559 - DNA, 22 bp, Artificial Sequence
  chemically synthesized
agggaaattacatttcatgagt

SEQ ID NO: 101560 - DNA, 22 bp, Artificial Sequence
  chemically synthesized
catttcatgagtaagcttccta

SEQ ID NO: 101561 - DNA, 22 bp, Artificial Sequence
  chemically synthesized
catgagtaagcttcctaaagtt

SEQ ID NO: 101562 - DNA, 22 bp, Artificial Sequence
  chemically synthesized
atgagtaagcttcctaaagttc

SEQ ID NO: 101563 - DNA, 22 bp, Artificial Sequence
  chemically synthesized
cctaaagttctagatatttgct

SEQ ID NO: 101564 - DNA, 22 bp, Artificial Sequence
  chemically synthesized
ctaaagttctagatatttgctg

SEQ ID NO: 101565 - DNA, 22 bp, Artificial Sequence
  chemically synthesized
aagttctagatatttgctgttt

SEQ ID NO: 101566 - DNA, 22 bp, Artificial Sequence
  chemically synthesized
tagatatttgctgtttagcctc

SEQ ID NO: 101567 - DNA, 22 bp, Artificial Sequence
  chemically synthesized
gatatttgctgtttagcctcac

SEQ ID NO: 101568 - DNA, 22 bp, Artificial Sequence
  chemically synthesized
gctgtttagcctcacacaagtt

SEQ ID NO: 101569 - DNA, 22 bp, Artificial Sequence
  chemically synthesized
ctgtttagcctcacacaagttt

SEQ ID NO: 101570 - DNA, 22 bp, Artificial Sequence
  chemically synthesized
tttagcctcacacaagtttgct

SEQ ID NO: 101571 - DNA, 22 bp, Artificial Sequence
  chemically synthesized
agcctcacacaagtttgcttac

SEQ ID NO: 101572 - DNA, 22 bp, Artificial Sequence
  chemically synthesized
gcctcacacaagtttgcttact

SEQ ID NO: 101573 - DNA, 22 bp, Artificial Sequence
  chemically synthesized
acacaagtttgcttactaatca

SEQ ID NO: 101574 - DNA, 22 bp, Artificial Sequence
  chemically synthesized
gcttactaatcaagcaagatcc

SEQ ID NO: 101575 - DNA, 22 bp, Artificial Sequence
  chemically synthesized
cttactaatcaagcaagatcct

SEQ ID NO: 101576 - DNA, 22 bp, Artificial Sequence
  chemically synthesized
actaatcaagcaagatcctttt

SEQ ID NO: 101577 - DNA, 22 bp, Artificial Sequence
  chemically synthesized
ctaatcaagcaagatccttttc

SEQ ID NO: 101578 - DNA, 22 bp, Artificial Sequence
  chemically synthesized
atcaagcaagatccttttcaga

SEQ ID NO: 101579 - DNA, 22 bp, Artificial Sequence
  chemically synthesized
ttcagagtaactagtttcaaag

SEQ ID NO: 101580 - DNA, 22 bp, Artificial Sequence
  chemically synthesized
tcagagtaactagtttcaaagt

SEQ ID NO: 101581 - DNA, 22 bp, Artificial Sequence
  chemically synthesized
cagagtaactagtttcaaagta

SEQ ID NO: 101582 - DNA, 22 bp, Artificial Sequence
  chemically synthesized
agagtaactagtttcaaagtat

SEQ ID NO: 101583 - DNA, 22 bp, Artificial Sequence
  chemically synthesized
gtttcaaagtatggagatgaaa

SEQ ID NO: 101584 - DNA, 22 bp, Artificial Sequence
  chemically synthesized
caaagtatggagatgaaaatat

SEQ ID NO: 101585 - DNA, 22 bp, Artificial Sequence
  chemically synthesized
aaagtatggagatgaaaatatg

SEQ ID NO: 101586 - DNA, 22 bp, Artificial Sequence
  chemically synthesized
ttcaaattcacctttataagac

SEQ ID NO: 101587 - DNA, 22 bp, Artificial Sequence
  chemically synthesized
aaattcacctttataagacaca

SEQ ID NO: 101588 - DNA, 22 bp, Artificial Sequence
  chemically synthesized
acctttataagacacataaaat

SEQ ID NO: 101589 - DNA, 22 bp, Artificial Sequence
  chemically synthesized
tataagacacataaaatgtacc

SEQ ID NO: 101590 - DNA, 22 bp, Artificial Sequence
  chemically synthesized
ataagacacataaaatgtacct

SEQ ID NO: 101591 - DNA, 22 bp, Artificial Sequence
  chemically synthesized
taagacacataaaatgtacctc

SEQ ID NO: 101592 - DNA, 22 bp, Artificial Sequence
  chemically synthesized
caactgcacatttttctttaga

SEQ ID NO: 101593 - DNA, 22 bp, Artificial Sequence
  chemically synthesized
cacatttttctttagatgaact

SEQ ID NO: 101594 - DNA, 22 bp, Artificial Sequence
  chemically synthesized
ttctttagatgaactgtatttg

SEQ ID NO: 101595 - DNA, 22 bp, Artificial Sequence
  chemically synthesized
tctttagatgaactgtatttga

SEQ ID NO: 101596 - DNA, 22 bp, Artificial Sequence
  chemically synthesized
ctttagatgaactgtatttgac

SEQ ID NO: 101597 - DNA, 22 bp, Artificial Sequence
  chemically synthesized
tttagatgaactgtatttgacc

SEQ ID NO: 101598 - DNA, 22 bp, Artificial Sequence
  chemically synthesized
tagatgaactgtatttgaccca

SEQ ID NO: 101599 - DNA, 22 bp, Artificial Sequence
  chemically synthesized
agatgaactgtatttgacccaa

SEQ ID NO: 101600 - DNA, 22 bp, Artificial Sequence
  chemically synthesized
gatgaactgtatttgacccaag

SEQ ID NO: 101601 - DNA, 22 bp, Artificial Sequence
  chemically synthesized
tatttgacccaagctgctttag

SEQ ID NO: 101602 - DNA, 22 bp, Artificial Sequence
  chemically synthesized
gacccaagctgctttagtccac

SEQ ID NO: 101603 - DNA, 22 bp, Artificial Sequence
  chemically synthesized
acccaagctgctttagtccact

SEQ ID NO: 101604 - DNA, 22 bp, Artificial Sequence
  chemically synthesized
ctttagtccacttatcttgact

SEQ ID NO: 101605 - DNA, 22 bp, Artificial Sequence
  chemically synthesized
tagtccacttatcttgactatt

SEQ ID NO: 101606 - DNA, 22 bp, Artificial Sequence
  chemically synthesized
agtccacttatcttgactattt

SEQ ID NO: 101607 - DNA, 22 bp, Artificial Sequence
  chemically synthesized
gtccacttatcttgactatttc

SEQ ID NO: 101608 - DNA, 22 bp, Artificial Sequence
  chemically synthesized
atcttgactatttctgaaatca

SEQ ID NO: 101609 - DNA, 22 bp, Artificial Sequence
  chemically synthesized
tcttgactatttctgaaatcat

SEQ ID NO: 101610 - DNA, 22 bp, Artificial Sequence
  chemically synthesized
gactatttctgaaatcatagtt

SEQ ID NO: 101611 - DNA, 22 bp, Artificial Sequence
  chemically synthesized
actatttctgaaatcatagtta

SEQ ID NO: 101612 - DNA, 22 bp, Artificial Sequence
  chemically synthesized
tttctgaaatcatagttactct

SEQ ID NO: 101613 - DNA, 22 bp, Artificial Sequence
  chemically synthesized
ctgaaatcatagttactcttct

SEQ ID NO: 101614 - DNA, 22 bp, Artificial Sequence
  chemically synthesized
tgaaatcatagttactcttctt

SEQ ID NO: 101615 - DNA, 22 bp, Artificial Sequence
  chemically synthesized
aaatcatagttactcttctttt

SEQ ID NO: 101616 - DNA, 22 bp, Artificial Sequence
  chemically synthesized
ctcttcttttggattgttatat

SEQ ID NO: 101617 - DNA, 22 bp, Artificial Sequence
  chemically synthesized
ttcttttggattgttatatctc

SEQ ID NO: 101618 - DNA, 22 bp, Artificial Sequence
  chemically synthesized
cttttggattgttatatctcct

SEQ ID NO: 101619 - DNA, 22 bp, Artificial Sequence
  chemically synthesized
ttttggattgttatatctcctc

SEQ ID NO: 101620 - DNA, 22 bp, Artificial Sequence
  chemically synthesized
ttggattgttatatctcctctg

SEQ ID NO: 101621 - DNA, 22 bp, Artificial Sequence
  chemically synthesized
tggattgttatatctcctctgc

SEQ ID NO: 101622 - DNA, 22 bp, Artificial Sequence
  chemically synthesized
ggattgttatatctcctctgct

SEQ ID NO: 101623 - DNA, 22 bp, Artificial Sequence
  chemically synthesized
gattgttatatctcctctgctt

SEQ ID NO: 101624 - DNA, 22 bp, Artificial Sequence
  chemically synthesized
ttatatctcctctgcttcctgt

SEQ ID NO: 101625 - DNA, 22 bp, Artificial Sequence
  chemically synthesized
tatctcctctgcttcctgtatt

SEQ ID NO: 101626 - DNA, 22 bp, Artificial Sequence
  chemically synthesized
ctctgcttcctgtattcttttt

SEQ ID NO: 101627 - DNA, 22 bp, Artificial Sequence
  chemically synthesized
tgcttcctgtattctttttctt

SEQ ID NO: 101628 - DNA, 22 bp, Artificial Sequence
  chemically synthesized
cttcctgtattctttttcttca

SEQ ID NO: 101629 - DNA, 22 bp, Artificial Sequence
  chemically synthesized
cctgtattctttttcttcagca

SEQ ID NO: 101630 - DNA, 22 bp, Artificial Sequence
  chemically synthesized
ctgtattctttttcttcagcat

SEQ ID NO: 101631 - DNA, 22 bp, Artificial Sequence
  chemically synthesized
tattctttttcttcagcatcac

SEQ ID NO: 101632 - DNA, 22 bp, Artificial Sequence
  chemically synthesized
tttttcttcagcatcactggca

SEQ ID NO: 101633 - DNA, 22 bp, Artificial Sequence
  chemically synthesized
tttcttcagcatcactggcatt

SEQ ID NO: 101634 - DNA, 22 bp, Artificial Sequence
  chemically synthesized
ttcttcagcatcactggcattc

SEQ ID NO: 101635 - DNA, 22 bp, Artificial Sequence
  chemically synthesized
tcttcagcatcactggcattcc

SEQ ID NO: 101636 - DNA, 22 bp, Artificial Sequence
  chemically synthesized
cttcagcatcactggcattccc

SEQ ID NO: 101637 - DNA, 22 bp, Artificial Sequence
  chemically synthesized
ttcagcatcactggcattccct

SEQ ID NO: 101638 - DNA, 22 bp, Artificial Sequence
  chemically synthesized
cagcatcactggcattccctct

SEQ ID NO: 101639 - DNA, 22 bp, Artificial Sequence
  chemically synthesized
agcatcactggcattccctctt

SEQ ID NO: 101640 - DNA, 22 bp, Artificial Sequence
  chemically synthesized
gcattccctctttattaggtga

SEQ ID NO: 101641 - DNA, 22 bp, Artificial Sequence
  chemically synthesized
cctctttattaggtgatatata

SEQ ID NO: 101642 - DNA, 22 bp, Artificial Sequence
  chemically synthesized
tttattaggtgatatatatata

SEQ ID NO: 101643 - DNA, 22 bp, Artificial Sequence
  chemically synthesized
tattaggtgatatatatatata

SEQ ID NO: 101644 - DNA, 22 bp, Artificial Sequence
  chemically synthesized
attaggtgatatatatatatat

SEQ ID NO: 101645 - DNA, 22 bp, Artificial Sequence
  chemically synthesized
ttaggtgatatatatatatata

SEQ ID NO: 101646 - DNA, 22 bp, Artificial Sequence
  chemically synthesized
ggtgatatatatatatatatat

SEQ ID NO: 101647 - DNA, 22 bp, Artificial Sequence
  chemically synthesized
ctcgctcacatcagctttttca

SEQ ID NO: 101648 - DNA, 22 bp, Artificial Sequence
  chemically synthesized
tcgctcacatcagctttttcat

SEQ ID NO: 101649 - DNA, 22 bp, Artificial Sequence
  chemically synthesized
gctcacatcagctttttcatgt

SEQ ID NO: 101650 - DNA, 22 bp, Artificial Sequence
  chemically synthesized
acatcagctttttcatgtgata

SEQ ID NO: 101651 - DNA, 22 bp, Artificial Sequence
  chemically synthesized
tttcatgtgataattaaaattg

SEQ ID NO: 101652 - DNA, 22 bp, Artificial Sequence
  chemically synthesized
ttcatgtgataattaaaattga

SEQ ID NO: 101653 - DNA, 22 bp, Artificial Sequence
  chemically synthesized
tcatgtgataattaaaattgaa

SEQ ID NO: 101654 - DNA, 22 bp, Artificial Sequence
  chemically synthesized
catgtgataattaaaattgaat

SEQ ID NO: 101655 - DNA, 22 bp, Artificial Sequence
  chemically synthesized
atgtgataattaaaattgaatc

SEQ ID NO: 101656 - DNA, 22 bp, Artificial Sequence
  chemically synthesized
aaattgaatctaactctgagga

SEQ ID NO: 101657 - DNA, 22 bp, Artificial Sequence
  chemically synthesized
aatctaactctgaggaaaaaaa

SEQ ID NO: 101658 - DNA, 22 bp, Artificial Sequence
  chemically synthesized
actctgaggaaaaaaaagtgtg

SEQ ID NO: 101659 - DNA, 22 bp, Artificial Sequence
  chemically synthesized
tgaggaaaaaaaagtgtggata

SEQ ID NO: 101660 - DNA, 22 bp, Artificial Sequence
  chemically synthesized
aggaaaaaaaagtgtggatata

SEQ ID NO: 101661 - DNA, 22 bp, Artificial Sequence
  chemically synthesized
cttttcagtaatgggagaggcc

SEQ ID NO: 101662 - DNA, 22 bp, Artificial Sequence
  chemically synthesized
ttcagtaatgggagaggcccag

SEQ ID NO: 101663 - DNA, 22 bp, Artificial Sequence
  chemically synthesized
tcagtaatgggagaggcccaga

SEQ ID NO: 101664 - DNA, 22 bp, Artificial Sequence
  chemically synthesized
cagtaatgggagaggcccagaa

SEQ ID NO: 101665 - DNA, 22 bp, Artificial Sequence
  chemically synthesized
agtaatgggagaggcccagaaa

SEQ ID NO: 101666 - DNA, 22 bp, Artificial Sequence
  chemically synthesized
gagatcttgagattctgaaata

SEQ ID NO: 101667 - DNA, 22 bp, Artificial Sequence
  chemically synthesized
gagattctgaaataagggctca

SEQ ID NO: 101668 - DNA, 22 bp, Artificial Sequence
  chemically synthesized
agattctgaaataagggctcaa

SEQ ID NO: 101669 - DNA, 22 bp, Artificial Sequence
  chemically synthesized
tgaaataagggctcaagcccta

SEQ ID NO: 101670 - DNA, 22 bp, Artificial Sequence
  chemically synthesized
aaataagggctcaagccctact

SEQ ID NO: 101671 - DNA, 22 bp, Artificial Sequence
  chemically synthesized
aagccctactctgcccagaaaa

SEQ ID NO: 101672 - DNA, 22 bp, Artificial Sequence
  chemically synthesized
ctctgcccagaaaataggcgaa

SEQ ID NO: 101673 - DNA, 22 bp, Artificial Sequence
  chemically synthesized
tgcccagaaaataggcgaataa

SEQ ID NO: 101674 - DNA, 22 bp, Artificial Sequence
  chemically synthesized
cccagaaaataggcgaataatg

SEQ ID NO: 101675 - DNA, 22 bp, Artificial Sequence
  chemically synthesized
ctttgaatctgcttggtcttga

SEQ ID NO: 101676 - DNA, 22 bp, Artificial Sequence
  chemically synthesized
tttgaatctgcttggtcttgat

SEQ ID NO: 101677 - DNA, 22 bp, Artificial Sequence
  chemically synthesized
tgaatctgcttggtcttgatgc

SEQ ID NO: 101678 - DNA, 22 bp, Artificial Sequence
  chemically synthesized
gaatctgcttggtcttgatgct

SEQ ID NO: 101679 - DNA, 22 bp, Artificial Sequence
  chemically synthesized
aatctgcttggtcttgatgcta

SEQ ID NO: 101680 - DNA, 22 bp, Artificial Sequence
  chemically synthesized
cttggtcttgatgctataaatg

SEQ ID NO: 101681 - DNA, 22 bp, Artificial Sequence
  chemically synthesized
ggtcttgatgctataaatgata

SEQ ID NO: 101682 - DNA, 22 bp, Artificial Sequence
  chemically synthesized
gtcttgatgctataaatgatag

SEQ ID NO: 101683 - DNA, 22 bp, Artificial Sequence
  chemically synthesized
gatgctataaatgataggattc

SEQ ID NO: 101684 - DNA, 22 bp, Artificial Sequence
  chemically synthesized
atgctataaatgataggattca

SEQ ID NO: 101685 - DNA, 22 bp, Artificial Sequence
  chemically synthesized
taaatgataggattcacgaatg

SEQ ID NO: 101686 - DNA, 22 bp, Artificial Sequence
  chemically synthesized
acgaatggaggaaagagaaaat

SEQ ID NO: 101687 - DNA, 22 bp, Artificial Sequence
  chemically synthesized
atggtaatggggaccacatgag

SEQ ID NO: 101688 - DNA, 22 bp, Artificial Sequence
  chemically synthesized
cccaaacctgtgaatgaatgac

SEQ ID NO: 101689 - DNA, 22 bp, Artificial Sequence
  chemically synthesized
ccaaacctgtgaatgaatgaca

SEQ ID NO: 101690 - DNA, 22 bp, Artificial Sequence
  chemically synthesized
tgaatgaatgacagtcccatca

SEQ ID NO: 101691 - DNA, 22 bp, Artificial Sequence
  chemically synthesized
ggacacagctaatatgggagac

SEQ ID NO: 101692 - DNA, 22 bp, Artificial Sequence
  chemically synthesized
atatgggagacacaagtgttga

SEQ ID NO: 101693 - DNA, 22 bp, Artificial Sequence
  chemically synthesized
agagatttagcttcctcttgtc

SEQ ID NO: 101694 - DNA, 22 bp, Artificial Sequence
  chemically synthesized
agcttcctcttgtccagacgca

SEQ ID NO: 101695 - DNA, 22 bp, Artificial Sequence
  chemically synthesized
gcttcctcttgtccagacgcaa

SEQ ID NO: 101696 - DNA, 22 bp, Artificial Sequence
  chemically synthesized
cctcttgtccagacgcaatgcc

SEQ ID NO: 101697 - DNA, 22 bp, Artificial Sequence
  chemically synthesized
ctcttgtccagacgcaatgccc

SEQ ID NO: 101698 - DNA, 22 bp, Artificial Sequence
  chemically synthesized
ttgtccagacgcaatgcccatc

SEQ ID NO: 101699 - DNA, 22 bp, Artificial Sequence
  chemically synthesized
gtccagacgcaatgcccatcac

SEQ ID NO: 101700 - DNA, 22 bp, Artificial Sequence
  chemically synthesized
tccagacgcaatgcccatcact

SEQ ID NO: 101701 - DNA, 22 bp, Artificial Sequence
  chemically synthesized
tcttgaggattagtatataaga

SEQ ID NO: 101702 - DNA, 22 bp, Artificial Sequence
  chemically synthesized
gaggattagtatataagaaaag

SEQ ID NO: 101703 - DNA, 22 bp, Artificial Sequence
  chemically synthesized
aggattagtatataagaaaaga

SEQ ID NO: 101704 - DNA, 22 bp, Artificial Sequence
  chemically synthesized
gtatataagaaaagatgatgat

SEQ ID NO: 101705 - DNA, 22 bp, Artificial Sequence
  chemically synthesized
gagcatctaaaaagacagtcaa

SEQ ID NO: 101706 - DNA, 22 bp, Artificial Sequence
  chemically synthesized
aaaagacagtcaaagaagtctg

SEQ ID NO: 101707 - DNA, 22 bp, Artificial Sequence
  chemically synthesized
aataattggatatatgtgatta

SEQ ID NO: 101708 - DNA, 22 bp, Artificial Sequence
  chemically synthesized
gatatatgtgattaaacgtgat

SEQ ID NO: 101709 - DNA, 22 bp, Artificial Sequence
  chemically synthesized
aacgtgatatcagcacaggcga

SEQ ID NO: 101710 - DNA, 22 bp, Artificial Sequence
  chemically synthesized
tatgacatcttgatggaggcaa

SEQ ID NO: 101711 - DNA, 22 bp, Artificial Sequence
  chemically synthesized
atgacatcttgatggaggcaaa

SEQ ID NO: 101712 - DNA, 22 bp, Artificial Sequence
  chemically synthesized
tgacatcttgatggaggcaaaa

SEQ ID NO: 101713 - DNA, 22 bp, Artificial Sequence
  chemically synthesized
gatggaggcaaaatgtgtgcaa

SEQ ID NO: 101714 - DNA, 22 bp, Artificial Sequence
  chemically synthesized
atggaggcaaaatgtgtgcaag

SEQ ID NO: 101715 - DNA, 22 bp, Artificial Sequence
  chemically synthesized
tgggcaaaatggacataaaacc

SEQ ID NO: 101716 - DNA, 22 bp, Artificial Sequence
  chemically synthesized
tcatcagtacccccagtcctat

SEQ ID NO: 101717 - DNA, 22 bp, Artificial Sequence
  chemically synthesized
atcagtacccccagtcctatgt

SEQ ID NO: 101718 - DNA, 22 bp, Artificial Sequence
  chemically synthesized
tgttcatcactcgggaattggt

SEQ ID NO: 101719 - DNA, 22 bp, Artificial Sequence
  chemically synthesized
atcactcgggaattggtaagaa

SEQ ID NO: 101720 - DNA, 22 bp, Artificial Sequence
  chemically synthesized
gggaattggtaagaatgcagtt

SEQ ID NO: 101721 - DNA, 22 bp, Artificial Sequence
  chemically synthesized
gtaagaatgcagttgtacctca

SEQ ID NO: 101722 - DNA, 22 bp, Artificial Sequence
  chemically synthesized
tacctcagtggtgtgcggatgg

SEQ ID NO: 101723 - DNA, 22 bp, Artificial Sequence
  chemically synthesized
agtggtgtgcggatggcaatga

SEQ ID NO: 101724 - DNA, 22 bp, Artificial Sequence
  chemically synthesized
attctacaatggccagtgaatg

SEQ ID NO: 101725 - DNA, 22 bp, Artificial Sequence
  chemically synthesized
tacaatggccagtgaatgaatg

SEQ ID NO: 101726 - DNA, 22 bp, Artificial Sequence
  chemically synthesized
caatggccagtgaatgaatgaa

SEQ ID NO: 101727 - DNA, 22 bp, Artificial Sequence
  chemically synthesized
ggtgaaacaggcagcatgggca

SEQ ID NO: 101728 - DNA, 22 bp, Artificial Sequence
  chemically synthesized
cctctggtctagcagcaggaca

SEQ ID NO: 101729 - DNA, 22 bp, Artificial Sequence
  chemically synthesized
tggtctagcagcaggacaccca

SEQ ID NO: 101730 - DNA, 22 bp, Artificial Sequence
  chemically synthesized
gtctagcagcaggacacccagg

SEQ ID NO: 101731 - DNA, 22 bp, Artificial Sequence
  chemically synthesized
gcagcaggacacccaggactgt

SEQ ID NO: 101732 - DNA, 22 bp, Artificial Sequence
  chemically synthesized
tgggcattgtagtgaatgtcat

SEQ ID NO: 101733 - DNA, 22 bp, Artificial Sequence
  chemically synthesized
tagtgaatgtcatcccaaggtc

SEQ ID NO: 101734 - DNA, 22 bp, Artificial Sequence
  chemically synthesized
ccagcatagccaggaagtagta

SEQ ID NO: 101735 - DNA, 22 bp, Artificial Sequence
  chemically synthesized
atggaggctgtgatcattccaa

SEQ ID NO: 101736 - DNA, 22 bp, Artificial Sequence
  chemically synthesized
tgatcattccaaatgaggacaa

SEQ ID NO: 101737 - DNA, 22 bp, Artificial Sequence
  chemically synthesized
caaatgaggacaagaagagtgc

SEQ ID NO: 101738 - DNA, 22 bp, Artificial Sequence
  chemically synthesized
ccaaaaaggacggagaagtaga

SEQ ID NO: 101739 - DNA, 22 bp, Artificial Sequence
  chemically synthesized
caaaaaggacggagaagtagat

SEQ ID NO: 101740 - DNA, 22 bp, Artificial Sequence
  chemically synthesized
cctctgagcccaagaagccagt

SEQ ID NO: 101741 - DNA, 22 bp, Artificial Sequence
  chemically synthesized
tgagcccaagaagccagtcagc

SEQ ID NO: 101742 - DNA, 22 bp, Artificial Sequence
  chemically synthesized
agcccaagaagccagtcagcaa

SEQ ID NO: 101743 - DNA, 22 bp, Artificial Sequence
  chemically synthesized
ttgttataccacatggtaggtt

SEQ ID NO: 101744 - DNA, 22 bp, Artificial Sequence
  chemically synthesized
ttataccacatggtaggttttg

SEQ ID NO: 101745 - DNA, 22 bp, Artificial Sequence
  chemically synthesized
taccacatggtaggttttgcag

SEQ ID NO: 101746 - DNA, 22 bp, Artificial Sequence
  chemically synthesized
tgcaggtggagaagatattttt

SEQ ID NO: 101747 - DNA, 22 bp, Artificial Sequence
  chemically synthesized
gcaggtggagaagatatttttt

SEQ ID NO: 101748 - DNA, 22 bp, Artificial Sequence
  chemically synthesized
caggtggagaagatatttttta

SEQ ID NO: 101749 - DNA, 22 bp, Artificial Sequence
  chemically synthesized
tttaggggtgatgacctccaaa

SEQ ID NO: 101750 - DNA, 22 bp, Artificial Sequence
  chemically synthesized
ttaggggtgatgacctccaaag

SEQ ID NO: 101751 - DNA, 22 bp, Artificial Sequence
  chemically synthesized
taggggtgatgacctccaaaga

SEQ ID NO: 101752 - DNA, 22 bp, Artificial Sequence
  chemically synthesized
aggggtgatgacctccaaagat

SEQ ID NO: 101753 - DNA, 22 bp, Artificial Sequence
  chemically synthesized
ggggtgatgacctccaaagatg

SEQ ID NO: 101754 - DNA, 22 bp, Artificial Sequence
  chemically synthesized
caaagatgcagttttctttttt

SEQ ID NO: 101755 - DNA, 22 bp, Artificial Sequence
  chemically synthesized
tcttttttctctcacaatcttc

SEQ ID NO: 101756 - DNA, 22 bp, Artificial Sequence
  chemically synthesized
cttttttctctcacaatcttct

SEQ ID NO: 101757 - DNA, 22 bp, Artificial Sequence
  chemically synthesized
ttttttctctcacaatcttctt

SEQ ID NO: 101758 - DNA, 22 bp, Artificial Sequence
  chemically synthesized
ttttctctcacaatcttcttgt

SEQ ID NO: 101759 - DNA, 22 bp, Artificial Sequence
  chemically synthesized
tttctctcacaatcttcttgta

SEQ ID NO: 101760 - DNA, 22 bp, Artificial Sequence
  chemically synthesized
ttctctcacaatcttcttgtag

SEQ ID NO: 101761 - DNA, 22 bp, Artificial Sequence
  chemically synthesized
tctctcacaatcttcttgtagc

SEQ ID NO: 101762 - DNA, 22 bp, Artificial Sequence
  chemically synthesized
ctctcacaatcttcttgtagca

SEQ ID NO: 101763 - DNA, 22 bp, Artificial Sequence
  chemically synthesized
tctcacaatcttcttgtagcac

SEQ ID NO: 101764 - DNA, 22 bp, Artificial Sequence
  chemically synthesized
tcacaatcttcttgtagcacat

SEQ ID NO: 101765 - DNA, 22 bp, Artificial Sequence
  chemically synthesized
acaatcttcttgtagcacatca

SEQ ID NO: 101766 - DNA, 22 bp, Artificial Sequence
  chemically synthesized
cttgtagcacatcatcaggcca

SEQ ID NO: 101767 - DNA, 22 bp, Artificial Sequence
  chemically synthesized
ttgtagcacatcatcaggccat

SEQ ID NO: 101768 - DNA, 22 bp, Artificial Sequence
  chemically synthesized
gtagcacatcatcaggccattt

SEQ ID NO: 101769 - DNA, 22 bp, Artificial Sequence
  chemically synthesized
tagcacatcatcaggccatttt

SEQ ID NO: 101770 - DNA, 22 bp, Artificial Sequence
  chemically synthesized
tttacctcaaaacttaaatatt

SEQ ID NO: 101771 - DNA, 22 bp, Artificial Sequence
  chemically synthesized
ttacctcaaaacttaaatattt

SEQ ID NO: 101772 - DNA, 22 bp, Artificial Sequence
  chemically synthesized
tacctcaaaacttaaatatttt

SEQ ID NO: 101773 - DNA, 22 bp, Artificial Sequence
  chemically synthesized
acctcaaaacttaaatattttt

SEQ ID NO: 101774 - DNA, 22 bp, Artificial Sequence
  chemically synthesized
cctcaaaacttaaatatttttc

SEQ ID NO: 101775 - DNA, 22 bp, Artificial Sequence
  chemically synthesized
aaaacttaaatatttttctgga

SEQ ID NO: 101776 - DNA, 22 bp, Artificial Sequence
  chemically synthesized
aaatatttttctggattgtctc

SEQ ID NO: 101777 - DNA, 22 bp, Artificial Sequence
  chemically synthesized
aatatttttctggattgtctca

SEQ ID NO: 101778 - DNA, 22 bp, Artificial Sequence
  chemically synthesized
ttctggattgtctcatacttaa

SEQ ID NO: 101779 - DNA, 22 bp, Artificial Sequence
  chemically synthesized
tctggattgtctcatacttaat

SEQ ID NO: 101780 - DNA, 22 bp, Artificial Sequence
  chemically synthesized
ctggattgtctcatacttaatt

SEQ ID NO: 101781 - DNA, 22 bp, Artificial Sequence
  chemically synthesized
tggattgtctcatacttaatta

SEQ ID NO: 101782 - DNA, 22 bp, Artificial Sequence
  chemically synthesized
gattgtctcatacttaattaat

SEQ ID NO: 101783 - DNA, 22 bp, Artificial Sequence
  chemically synthesized
tctcatacttaattaattgtaa

SEQ ID NO: 101784 - DNA, 22 bp, Artificial Sequence
  chemically synthesized
atacttaattaattgtaagcct

SEQ ID NO: 101785 - DNA, 22 bp, Artificial Sequence
  chemically synthesized
aattaattgtaagcctgtactc

SEQ ID NO: 101786 - DNA, 22 bp, Artificial Sequence
  chemically synthesized
attaattgtaagcctgtactca

SEQ ID NO: 101787 - DNA, 22 bp, Artificial Sequence
  chemically synthesized
attgtaagcctgtactcacaag

SEQ ID NO: 101788 - DNA, 22 bp, Artificial Sequence
  chemically synthesized
taagcctgtactcacaaggcct

SEQ ID NO: 101789 - DNA, 22 bp, Artificial Sequence
  chemically synthesized
tactcacaaggcctttccctag

SEQ ID NO: 101790 - DNA, 22 bp, Artificial Sequence
  chemically synthesized
acaaggcctttccctagaataa

SEQ ID NO: 101791 - DNA, 22 bp, Artificial Sequence
  chemically synthesized
tccctagaataacaaataacaa

SEQ ID NO: 101792 - DNA, 22 bp, Artificial Sequence
  chemically synthesized
ccctagaataacaaataacaaa

SEQ ID NO: 101793 - DNA, 22 bp, Artificial Sequence
  chemically synthesized
cctagaataacaaataacaaaa

SEQ ID NO: 101794 - DNA, 22 bp, Artificial Sequence
  chemically synthesized
gaataacaaataacaaaaatca

SEQ ID NO: 101795 - DNA, 22 bp, Artificial Sequence
  chemically synthesized
caattcactatgaagcatacaa

SEQ ID NO: 101796 - DNA, 22 bp, Artificial Sequence
  chemically synthesized
actatgaagcatacaaccttta

SEQ ID NO: 101797 - DNA, 22 bp, Artificial Sequence
  chemically synthesized
tgaagcatacaacctttatttt

SEQ ID NO: 101798 - DNA, 22 bp, Artificial Sequence
  chemically synthesized
tattttttcaacactcatctta

SEQ ID NO: 101799 - DNA, 22 bp, Artificial Sequence
  chemically synthesized
attttttcaacactcatcttac

SEQ ID NO: 101800 - DNA, 22 bp, Artificial Sequence
  chemically synthesized
ttttttcaacactcatcttacg

SEQ ID NO: 101801 - DNA, 22 bp, Artificial Sequence
  chemically synthesized
tttcaacactcatcttacgtct

SEQ ID NO: 101802 - DNA, 22 bp, Artificial Sequence
  chemically synthesized
ttcaacactcatcttacgtctg

SEQ ID NO: 101803 - DNA, 22 bp, Artificial Sequence
  chemically synthesized
tcaacactcatcttacgtctgt

SEQ ID NO: 101804 - DNA, 22 bp, Artificial Sequence
  chemically synthesized
caacactcatcttacgtctgtg

SEQ ID NO: 101805 - DNA, 22 bp, Artificial Sequence
  chemically synthesized
aacactcatcttacgtctgtgc

SEQ ID NO: 101806 - DNA, 22 bp, Artificial Sequence
  chemically synthesized
atcttacgtctgtgctcatagc

SEQ ID NO: 101807 - DNA, 22 bp, Artificial Sequence
  chemically synthesized
acgtctgtgctcatagccttga

SEQ ID NO: 101808 - DNA, 22 bp, Artificial Sequence
  chemically synthesized
cgtctgtgctcatagccttgac

SEQ ID NO: 101809 - DNA, 22 bp, Artificial Sequence
  chemically synthesized
tgctcatagccttgactcttgg

SEQ ID NO: 101810 - DNA, 22 bp, Artificial Sequence
  chemically synthesized
atagccttgactcttggtccca

SEQ ID NO: 101811 - DNA, 22 bp, Artificial Sequence
  chemically synthesized
gactcttggtcccaaataggac

SEQ ID NO: 101812 - DNA, 22 bp, Artificial Sequence
  chemically synthesized
actcttggtcccaaataggact

SEQ ID NO: 101813 - DNA, 22 bp, Artificial Sequence
  chemically synthesized
ttggtcccaaataggactcctt

SEQ ID NO: 101814 - DNA, 22 bp, Artificial Sequence
  chemically synthesized
ggtcccaaataggactcctttg

SEQ ID NO: 101815 - DNA, 22 bp, Artificial Sequence
  chemically synthesized
gtcccaaataggactcctttgt

SEQ ID NO: 101816 - DNA, 22 bp, Artificial Sequence
  chemically synthesized
ctttgttcccttttattctctt

SEQ ID NO: 101817 - DNA, 22 bp, Artificial Sequence
  chemically synthesized
tgttcccttttattctctttac

SEQ ID NO: 101818 - DNA, 22 bp, Artificial Sequence
  chemically synthesized
gttcccttttattctctttact

SEQ ID NO: 101819 - DNA, 22 bp, Artificial Sequence
  chemically synthesized
ttcccttttattctctttactc

SEQ ID NO: 101820 - DNA, 22 bp, Artificial Sequence
  chemically synthesized
ccttttattctctttactcttt

SEQ ID NO: 101821 - DNA, 22 bp, Artificial Sequence
  chemically synthesized
ttattctctttactcttttatt

SEQ ID NO: 101822 - DNA, 22 bp, Artificial Sequence
  chemically synthesized
tattctctttactcttttattc

SEQ ID NO: 101823 - DNA, 22 bp, Artificial Sequence
  chemically synthesized
attctctttactcttttattcc

SEQ ID NO: 101824 - DNA, 22 bp, Artificial Sequence
  chemically synthesized
ttctctttactcttttattcct

SEQ ID NO: 101825 - DNA, 22 bp, Artificial Sequence
  chemically synthesized
tctttactcttttattcctcct

SEQ ID NO: 101826 - DNA, 22 bp, Artificial Sequence
  chemically synthesized
tttactcttttattcctcctcc

SEQ ID NO: 101827 - DNA, 22 bp, Artificial Sequence
  chemically synthesized
tactcttttattcctcctccta

SEQ ID NO: 101828 - DNA, 22 bp, Artificial Sequence
  chemically synthesized
actcttttattcctcctcctat

SEQ ID NO: 101829 - DNA, 22 bp, Artificial Sequence
  chemically synthesized
ctcttttattcctcctcctatt

SEQ ID NO: 101830 - DNA, 22 bp, Artificial Sequence
  chemically synthesized
ttttattcctcctcctattatt

SEQ ID NO: 101831 - DNA, 22 bp, Artificial Sequence
  chemically synthesized
ttattcctcctcctattattta

SEQ ID NO: 101832 - DNA, 22 bp, Artificial Sequence
  chemically synthesized
tattcctcctcctattatttat

SEQ ID NO: 101833 - DNA, 22 bp, Artificial Sequence
  chemically synthesized
attcctcctcctattatttatc

SEQ ID NO: 101834 - DNA, 22 bp, Artificial Sequence
  chemically synthesized
ttcctcctcctattatttatca

SEQ ID NO: 101835 - DNA, 22 bp, Artificial Sequence
  chemically synthesized
ctcctcctattatttatcatat

SEQ ID NO: 101836 - DNA, 22 bp, Artificial Sequence
  chemically synthesized
ctcctattatttatcatatggg

SEQ ID NO: 101837 - DNA, 22 bp, Artificial Sequence
  chemically synthesized
ctattatttatcatatgggccc

SEQ ID NO: 101838 - DNA, 22 bp, Artificial Sequence
  chemically synthesized
ttatttatcatatgggccctta

SEQ ID NO: 101839 - DNA, 22 bp, Artificial Sequence
  chemically synthesized
tttatcatatgggcccttactg

SEQ ID NO: 101840 - DNA, 22 bp, Artificial Sequence
  chemically synthesized
atcatatgggcccttactgtgt

SEQ ID NO: 101841 - DNA, 22 bp, Artificial Sequence
  chemically synthesized
tcatatgggcccttactgtgtt

SEQ ID NO: 101842 - DNA, 22 bp, Artificial Sequence
  chemically synthesized
actgtgttactatccaagttga

SEQ ID NO: 101843 - DNA, 22 bp, Artificial Sequence
  chemically synthesized
ctgtgttactatccaagttgag

SEQ ID NO: 101844 - DNA, 22 bp, Artificial Sequence
  chemically synthesized
tgttactatccaagttgagtca

SEQ ID NO: 101845 - DNA, 22 bp, Artificial Sequence
  chemically synthesized
ctatccaagttgagtcagttca

SEQ ID NO: 101846 - DNA, 22 bp, Artificial Sequence
  chemically synthesized
tccaagttgagtcagttcaaat

SEQ ID NO: 101847 - DNA, 22 bp, Artificial Sequence
  chemically synthesized
agtcagttcaaattttttctct

SEQ ID NO: 101848 - DNA, 22 bp, Artificial Sequence
  chemically synthesized
aaattttttctcttgaaactaa

SEQ ID NO: 101849 - DNA, 22 bp, Artificial Sequence
  chemically synthesized
tttctcttgaaactaatgggac

SEQ ID NO: 101850 - DNA, 22 bp, Artificial Sequence
  chemically synthesized
ttctcttgaaactaatgggaca

SEQ ID NO: 101851 - DNA, 22 bp, Artificial Sequence
  chemically synthesized
tctcttgaaactaatgggacag

SEQ ID NO: 101852 - DNA, 22 bp, Artificial Sequence
  chemically synthesized
ctcttgaaactaatgggacagc

SEQ ID NO: 101853 - DNA, 22 bp, Artificial Sequence
  chemically synthesized
tcttgaaactaatgggacagct

SEQ ID NO: 101854 - DNA, 22 bp, Artificial Sequence
  chemically synthesized
ttgaaactaatgggacagctgt

SEQ ID NO: 101855 - DNA, 22 bp, Artificial Sequence
  chemically synthesized
gaaactaatgggacagctgtat

SEQ ID NO: 101856 - DNA, 22 bp, Artificial Sequence
  chemically synthesized
aaactaatgggacagctgtatt

SEQ ID NO: 101857 - DNA, 22 bp, Artificial Sequence
  chemically synthesized
atgggacagctgtatttaggat

SEQ ID NO: 101858 - DNA, 22 bp, Artificial Sequence
  chemically synthesized
tatttaggattaaccactgagg

SEQ ID NO: 101859 - DNA, 22 bp, Artificial Sequence
  chemically synthesized
aggattaaccactgaggaaaat

SEQ ID NO: 101860 - DNA, 22 bp, Artificial Sequence
  chemically synthesized
ggattaaccactgaggaaaatg

SEQ ID NO: 101861 - DNA, 22 bp, Artificial Sequence
  chemically synthesized
accactgaggaaaatgcttatt

SEQ ID NO: 101862 - DNA, 22 bp, Artificial Sequence
  chemically synthesized
aggaaaatgcttattcaataga

SEQ ID NO: 101863 - DNA, 22 bp, Artificial Sequence
  chemically synthesized
attcaatagaaatgactgagaa

SEQ ID NO: 101864 - DNA, 22 bp, Artificial Sequence
  chemically synthesized
ttcaatagaaatgactgagaaa

SEQ ID NO: 101865 - DNA, 22 bp, Artificial Sequence
  chemically synthesized
aatagaaatgactgagaaatat

SEQ ID NO: 101866 - DNA, 22 bp, Artificial Sequence
  chemically synthesized
agaaatattgtgatcaatgttg

SEQ ID NO: 101867 - DNA, 22 bp, Artificial Sequence
  chemically synthesized
tgatcaatgttgctatctcaag

SEQ ID NO: 101868 - DNA, 22 bp, Artificial Sequence
  chemically synthesized
ctatctcaagtggactgtgaat

SEQ ID NO: 101869 - DNA, 22 bp, Artificial Sequence
  chemically synthesized
tctcaagtggactgtgaataag

SEQ ID NO: 101870 - DNA, 22 bp, Artificial Sequence
  chemically synthesized
aagtggactgtgaataagaaga

SEQ ID NO: 101871 - DNA, 22 bp, Artificial Sequence
  chemically synthesized
tgaataagaagagaacccagcc

SEQ ID NO: 101872 - DNA, 22 bp, Artificial Sequence
  chemically synthesized
ggcaacatagctagaccctgcc

SEQ ID NO: 101873 - DNA, 22 bp, Artificial Sequence
  chemically synthesized
gaccctgcctccaccaaaaaaa

SEQ ID NO: 101874 - DNA, 22 bp, Artificial Sequence
  chemically synthesized
cctccaccaaaaaaaaaagaaa

SEQ ID NO: 101875 - DNA, 22 bp, Artificial Sequence
  chemically synthesized
caccaaaaaaaaaagaaaagat

SEQ ID NO: 101876 - DNA, 22 bp, Artificial Sequence
  chemically synthesized
gctgggcacaggggcacacatc

SEQ ID NO: 101877 - DNA, 22 bp, Artificial Sequence
  chemically synthesized
ggcacaggggcacacatcacct

SEQ ID NO: 101878 - DNA, 22 bp, Artificial Sequence
  chemically synthesized
agcccaggactgtgaggctgca

SEQ ID NO: 101879 - DNA, 22 bp, Artificial Sequence
  chemically synthesized
tgaggctgcagggagctatgat

SEQ ID NO: 101880 - DNA, 22 bp, Artificial Sequence
  chemically synthesized
cagggagctatgattgcagcac

SEQ ID NO: 101881 - DNA, 22 bp, Artificial Sequence
  chemically synthesized
tgattgcagcactgctctccag

SEQ ID NO: 101882 - DNA, 22 bp, Artificial Sequence
  chemically synthesized
cagcactgctctccagcctggg

SEQ ID NO: 101883 - DNA, 22 bp, Artificial Sequence
  chemically synthesized
ctctccagcctgggcaacggag

SEQ ID NO: 101884 - DNA, 22 bp, Artificial Sequence
  chemically synthesized
tccagcctgggcaacggagtca

SEQ ID NO: 101885 - DNA, 22 bp, Artificial Sequence
  chemically synthesized
cagcctgggcaacggagtcaga

SEQ ID NO: 101886 - DNA, 22 bp, Artificial Sequence
  chemically synthesized
ggcaacggagtcagactctgtc

SEQ ID NO: 101887 - DNA, 22 bp, Artificial Sequence
  chemically synthesized
tgtctctataaaaaataaaata

SEQ ID NO: 101888 - DNA, 22 bp, Artificial Sequence
  chemically synthesized
tctctataaaaaataaaataaa

SEQ ID NO: 101889 - DNA, 22 bp, Artificial Sequence
  chemically synthesized
tataaaaaataaaataaaataa

SEQ ID NO: 101890 - DNA, 22 bp, Artificial Sequence
  chemically synthesized
taaaaaataaaataaaataaaa

SEQ ID NO: 101891 - DNA, 22 bp, Artificial Sequence
  chemically synthesized
atctattgtgagtttccacaga

SEQ ID NO: 101892 - DNA, 22 bp, Artificial Sequence
  chemically synthesized
ttgtgagtttccacagaaatct

SEQ ID NO: 101893 - DNA, 22 bp, Artificial Sequence
  chemically synthesized
tgagtttccacagaaatctgaa

SEQ ID NO: 101894 - DNA, 22 bp, Artificial Sequence
  chemically synthesized
ccacagaaatctgaacacctga

SEQ ID NO: 101895 - DNA, 22 bp, Artificial Sequence
  chemically synthesized
cacagaaatctgaacacctgaa

SEQ ID NO: 101896 - DNA, 22 bp, Artificial Sequence
  chemically synthesized
aacacctgaacaagtgggtaaa

SEQ ID NO: 101897 - DNA, 22 bp, Artificial Sequence
  chemically synthesized
aacaagtgggtaaagttagtaa

SEQ ID NO: 101898 - DNA, 22 bp, Artificial Sequence
  chemically synthesized
gtaaactcattttagaaaggtg

SEQ ID NO: 101899 - DNA, 22 bp, Artificial Sequence
  chemically synthesized
attttagaaaggtgtaattact

SEQ ID NO: 101900 - DNA, 22 bp, Artificial Sequence
  chemically synthesized
tagaaaggtgtaattactcagt

SEQ ID NO: 101901 - DNA, 22 bp, Artificial Sequence
  chemically synthesized
agaaaggtgtaattactcagtg

SEQ ID NO: 101902 - DNA, 22 bp, Artificial Sequence
  chemically synthesized
gaaaggtgtaattactcagtgg

SEQ ID NO: 101903 - DNA, 22 bp, Artificial Sequence
  chemically synthesized
ctcagtggacttgggactcagc

SEQ ID NO: 101904 - DNA, 22 bp, Artificial Sequence
  chemically synthesized
agtggacttgggactcagcaag

SEQ ID NO: 101905 - DNA, 22 bp, Artificial Sequence
  chemically synthesized
gggactcagcaagttccctatg

SEQ ID NO: 101906 - DNA, 22 bp, Artificial Sequence
  chemically synthesized
ggactcagcaagttccctatgc

SEQ ID NO: 101907 - DNA, 22 bp, Artificial Sequence
  chemically synthesized
agcaagttccctatgctgcaaa

SEQ ID NO: 101908 - DNA, 22 bp, Artificial Sequence
  chemically synthesized
cctatgctgcaaaaagtctgag

SEQ ID NO: 101909 - DNA, 22 bp, Artificial Sequence
  chemically synthesized
tgctgcaaaaagtctgagtttt

SEQ ID NO: 101910 - DNA, 22 bp, Artificial Sequence
  chemically synthesized
caaaaagtctgagttttggcac

SEQ ID NO: 101911 - DNA, 22 bp, Artificial Sequence
  chemically synthesized
agttttggcacattagggacaa

SEQ ID NO: 101912 - DNA, 22 bp, Artificial Sequence
  chemically synthesized
tggcacattagggacaaacatg

SEQ ID NO: 101913 - DNA, 22 bp, Artificial Sequence
  chemically synthesized
ggcacattagggacaaacatga

SEQ ID NO: 101914 - DNA, 22 bp, Artificial Sequence
  chemically synthesized
gcacattagggacaaacatgaa

SEQ ID NO: 101915 - DNA, 22 bp, Artificial Sequence
  chemically synthesized
gggacaaacatgaaaataggag

SEQ ID NO: 101916 - DNA, 22 bp, Artificial Sequence
  chemically synthesized
atgttggaagctcataacggaa

SEQ ID NO: 101917 - DNA, 22 bp, Artificial Sequence
  chemically synthesized
gaagctcataacggaaatattt

SEQ ID NO: 101918 - DNA, 22 bp, Artificial Sequence
  chemically synthesized
ataacggaaatattttaaggac

SEQ ID NO: 101919 - DNA, 22 bp, Artificial Sequence
  chemically synthesized
taaggacatacttctacaatga

SEQ ID NO: 101920 - DNA, 22 bp, Artificial Sequence
  chemically synthesized
aaggacatacttctacaatgag

SEQ ID NO: 101921 - DNA, 22 bp, Artificial Sequence
  chemically synthesized
aggacatacttctacaatgagg

SEQ ID NO: 101922 - DNA, 22 bp, Artificial Sequence
  chemically synthesized
ctacaatgagggcctccacaaa

SEQ ID NO: 101923 - DNA, 22 bp, Artificial Sequence
  chemically synthesized
tacaatgagggcctccacaaaa

SEQ ID NO: 101924 - DNA, 22 bp, Artificial Sequence
  chemically synthesized
caatgagggcctccacaaaagc

SEQ ID NO: 101925 - DNA, 22 bp, Artificial Sequence
  chemically synthesized
cacaaaagcctaatacttgtta

SEQ ID NO: 101926 - DNA, 22 bp, Artificial Sequence
  chemically synthesized
atacttgttagagtcatagatt

SEQ ID NO: 101927 - DNA, 22 bp, Artificial Sequence
  chemically synthesized
gttagagtcatagattcgtaag

SEQ ID NO: 101928 - DNA, 22 bp, Artificial Sequence
  chemically synthesized
ttagagtcatagattcgtaagt

SEQ ID NO: 101929 - DNA, 22 bp, Artificial Sequence
  chemically synthesized
gagtcatagattcgtaagtatg

SEQ ID NO: 101930 - DNA, 22 bp, Artificial Sequence
  chemically synthesized
gtaagtatgttgatctgaaggg

SEQ ID NO: 101931 - DNA, 22 bp, Artificial Sequence
  chemically synthesized
atctgaagggcaatagtaatat

SEQ ID NO: 101932 - DNA, 22 bp, Artificial Sequence
  chemically synthesized
aagggcaatagtaatatcggaa

SEQ ID NO: 101933 - DNA, 22 bp, Artificial Sequence
  chemically synthesized
gtaattgagttaataaacttca

SEQ ID NO: 101934 - DNA, 22 bp, Artificial Sequence
  chemically synthesized
agttaataaacttcacacaacc

SEQ ID NO: 101935 - DNA, 22 bp, Artificial Sequence
  chemically synthesized
ataaacttcacacaaccagttc

SEQ ID NO: 101936 - DNA, 22 bp, Artificial Sequence
  chemically synthesized
cacacaaccagttctagggaaa

SEQ ID NO: 101937 - DNA, 22 bp, Artificial Sequence
  chemically synthesized
acacaaccagttctagggaaaa

SEQ ID NO: 101938 - DNA, 22 bp, Artificial Sequence
  chemically synthesized
tagggaaaagataagcactccc

SEQ ID NO: 101939 - DNA, 22 bp, Artificial Sequence
  chemically synthesized
gggaaaagataagcactcccag

SEQ ID NO: 101940 - DNA, 22 bp, Artificial Sequence
  chemically synthesized
ccagagagaaaatacggcaact

SEQ ID NO: 101941 - DNA, 22 bp, Artificial Sequence
  chemically synthesized
tgttgctgatggagacaatctt

SEQ ID NO: 101942 - DNA, 22 bp, Artificial Sequence
  chemically synthesized
ctgatggagacaatcttacaga

SEQ ID NO: 101943 - DNA, 22 bp, Artificial Sequence
  chemically synthesized
atggagacaatcttacagaccc

SEQ ID NO: 101944 - DNA, 22 bp, Artificial Sequence
  chemically synthesized
acagaccctctaatcattatga

SEQ ID NO: 101945 - DNA, 22 bp, Artificial Sequence
  chemically synthesized
cagaccctctaatcattatgaa

SEQ ID NO: 101946 - DNA, 22 bp, Artificial Sequence
  chemically synthesized
taatcattatgaatctgtaaga

SEQ ID NO: 101947 - DNA, 22 bp, Artificial Sequence
  chemically synthesized
atcattatgaatctgtaagact

SEQ ID NO: 101948 - DNA, 22 bp, Artificial Sequence
  chemically synthesized
tgaatctgtaagactcgtattg

SEQ ID NO: 101949 - DNA, 22 bp, Artificial Sequence
  chemically synthesized
taagactcgtattgagaaaaat

SEQ ID NO: 101950 - DNA, 22 bp, Artificial Sequence
  chemically synthesized
gtattgagaaaaattcacaagg

SEQ ID NO: 101951 - DNA, 22 bp, Artificial Sequence
  chemically synthesized
agaaaaattcacaaggatcctc

SEQ ID NO: 101952 - DNA, 22 bp, Artificial Sequence
  chemically synthesized
acaaggatcctcatagggaact

SEQ ID NO: 101953 - DNA, 22 bp, Artificial Sequence
  chemically synthesized
atagggaactatgaagtctatt

SEQ ID NO: 101954 - DNA, 22 bp, Artificial Sequence
  chemically synthesized
tgaagtctatttataattaata

SEQ ID NO: 101955 - DNA, 22 bp, Artificial Sequence
  chemically synthesized
tttataattaatatttatttat

SEQ ID NO: 101956 - DNA, 22 bp, Artificial Sequence
  chemically synthesized
ataattaatatttatttatatt

SEQ ID NO: 101957 - DNA, 22 bp, Artificial Sequence
  chemically synthesized
taattaatatttatttatattt

SEQ ID NO: 101958 - DNA, 22 bp, Artificial Sequence
  chemically synthesized
atatttatttatatttataatt

SEQ ID NO: 101959 - DNA, 22 bp, Artificial Sequence
  chemically synthesized
atttatatttataattacactt

SEQ ID NO: 101960 - DNA, 22 bp, Artificial Sequence
  chemically synthesized
tttatatttataattacacttt

SEQ ID NO: 101961 - DNA, 22 bp, Artificial Sequence
  chemically synthesized
atatttataattacacttttac

SEQ ID NO: 101962 - DNA, 22 bp, Artificial Sequence
  chemically synthesized
tatttataattacacttttaca

SEQ ID NO: 101963 - DNA, 22 bp, Artificial Sequence
  chemically synthesized
ataattacacttttacaaagtc

SEQ ID NO: 101964 - DNA, 22 bp, Artificial Sequence
  chemically synthesized
taattacacttttacaaagtca

SEQ ID NO: 101965 - DNA, 22 bp, Artificial Sequence
  chemically synthesized
cacttttacaaagtcaagattt

SEQ ID NO: 101966 - DNA, 22 bp, Artificial Sequence
  chemically synthesized
ttacaaagtcaagatttttgtt

SEQ ID NO: 101967 - DNA, 22 bp, Artificial Sequence
  chemically synthesized
tacaaagtcaagatttttgttg

SEQ ID NO: 101968 - DNA, 22 bp, Artificial Sequence
  chemically synthesized
acaaagtcaagatttttgttgt

SEQ ID NO: 101969 - DNA, 22 bp, Artificial Sequence
  chemically synthesized
caaagtcaagatttttgttgtt

SEQ ID NO: 101970 - DNA, 22 bp, Artificial Sequence
  chemically synthesized
ttgttgttgtgataccaagaaa

SEQ ID NO: 101971 - DNA, 22 bp, Artificial Sequence
  chemically synthesized
tgttgttgtgataccaagaaat

SEQ ID NO: 101972 - DNA, 22 bp, Artificial Sequence
  chemically synthesized
gttgttgtgataccaagaaatt

SEQ ID NO: 101973 - DNA, 22 bp, Artificial Sequence
  chemically synthesized
ttgttgtgataccaagaaattt

SEQ ID NO: 101974 - DNA, 22 bp, Artificial Sequence
  chemically synthesized
ttgtgataccaagaaattttgt

SEQ ID NO: 101975 - DNA, 22 bp, Artificial Sequence
  chemically synthesized
tgataccaagaaattttgtagc

SEQ ID NO: 101976 - DNA, 22 bp, Artificial Sequence
  chemically synthesized
tgtagcaggtttattgggaaaa

SEQ ID NO: 101977 - DNA, 22 bp, Artificial Sequence
  chemically synthesized
gtagcaggtttattgggaaaac

SEQ ID NO: 101978 - DNA, 22 bp, Artificial Sequence
  chemically synthesized
tagcaggtttattgggaaaaca

SEQ ID NO: 101979 - DNA, 22 bp, Artificial Sequence
  chemically synthesized
attgggaaaacaaagagaacta

SEQ ID NO: 101980 - DNA, 22 bp, Artificial Sequence
  chemically synthesized
ttgggaaaacaaagagaactac

SEQ ID NO: 101981 - DNA, 22 bp, Artificial Sequence
  chemically synthesized
ggaaaacaaagagaactacaag

SEQ ID NO: 101982 - DNA, 22 bp, Artificial Sequence
  chemically synthesized
caagggaaactcagtttctccc

SEQ ID NO: 101983 - DNA, 22 bp, Artificial Sequence
  chemically synthesized
agtttctcccaaattcaattga

SEQ ID NO: 101984 - DNA, 22 bp, Artificial Sequence
  chemically synthesized
ctcccaaattcaattgattctg

SEQ ID NO: 101985 - DNA, 22 bp, Artificial Sequence
  chemically synthesized
tcccaaattcaattgattctgt

SEQ ID NO: 101986 - DNA, 22 bp, Artificial Sequence
  chemically synthesized
ccaaattcaattgattctgtat

SEQ ID NO: 101987 - DNA, 22 bp, Artificial Sequence
  chemically synthesized
aattgattctgtatgtgtccag

SEQ ID NO: 101988 - DNA, 22 bp, Artificial Sequence
  chemically synthesized
attctgtatgtgtccagagtct

SEQ ID NO: 101989 - DNA, 22 bp, Artificial Sequence
  chemically synthesized
tgtatgtgtccagagtctttta

SEQ ID NO: 101990 - DNA, 22 bp, Artificial Sequence
  chemically synthesized
tatgtgtccagagtcttttaaa

SEQ ID NO: 101991 - DNA, 22 bp, Artificial Sequence
  chemically synthesized
ttaaaatatcattcaatattat

SEQ ID NO: 101992 - DNA, 22 bp, Artificial Sequence
  chemically synthesized
taaaatatcattcaatattata

SEQ ID NO: 101993 - DNA, 22 bp, Artificial Sequence
  chemically synthesized
aaaatatcattcaatattataa

SEQ ID NO: 101994 - DNA, 22 bp, Artificial Sequence
  chemically synthesized
aaatatcattcaatattataaa

SEQ ID NO: 101995 - DNA, 22 bp, Artificial Sequence
  chemically synthesized
aatattataaatattactaccg

SEQ ID NO: 101996 - DNA, 22 bp, Artificial Sequence
  chemically synthesized
taaatattactaccgacacctt

SEQ ID NO: 101997 - DNA, 22 bp, Artificial Sequence
  chemically synthesized
ctaccgacacctttgaagtgta

SEQ ID NO: 101998 - DNA, 22 bp, Artificial Sequence
  chemically synthesized
ccgacacctttgaagtgtaatt

SEQ ID NO: 101999 - DNA, 22 bp, Artificial Sequence
  chemically synthesized
tgaagtgtaattcagtaaaaat

SEQ ID NO: 102000 - DNA, 22 bp, Artificial Sequence
  chemically synthesized
gaagtgtaattcagtaaaaatg

SEQ ID NO: 102001 - DNA, 22 bp, Artificial Sequence
  chemically synthesized
aagtgtaattcagtaaaaatga

SEQ ID NO: 102002 - DNA, 22 bp, Artificial Sequence
  chemically synthesized
agtaaaaatgaagtgataacaa

SEQ ID NO: 102003 - DNA, 22 bp, Artificial Sequence
  chemically synthesized
tgcaccttttttattttataaa

SEQ ID NO: 102004 - DNA, 22 bp, Artificial Sequence
  chemically synthesized
gcaccttttttattttataaaa

SEQ ID NO: 102005 - DNA, 22 bp, Artificial Sequence
  chemically synthesized
caccttttttattttataaaaa

SEQ ID NO: 102006 - DNA, 22 bp, Artificial Sequence
  chemically synthesized
ttttattttataaaaacctata

SEQ ID NO: 102007 - DNA, 22 bp, Artificial Sequence
  chemically synthesized
tttattttataaaaacctatag

SEQ ID NO: 102008 - DNA, 22 bp, Artificial Sequence
  chemically synthesized
ttattttataaaaacctataga

SEQ ID NO: 102009 - DNA, 22 bp, Artificial Sequence
  chemically synthesized
tattttataaaaacctatagaa

SEQ ID NO: 102010 - DNA, 22 bp, Artificial Sequence
  chemically synthesized
attttataaaaacctatagaaa

SEQ ID NO: 102011 - DNA, 22 bp, Artificial Sequence
  chemically synthesized
ttttataaaaacctatagaaac

SEQ ID NO: 102012 - DNA, 22 bp, Artificial Sequence
  chemically synthesized
tataaaaacctatagaaacaat

SEQ ID NO: 102013 - DNA, 22 bp, Artificial Sequence
  chemically synthesized
ataaaaacctatagaaacaata

SEQ ID NO: 102014 - DNA, 22 bp, Artificial Sequence
  chemically synthesized
taaaaacctatagaaacaataa

SEQ ID NO: 102015 - DNA, 22 bp, Artificial Sequence
  chemically synthesized
tagaaacaataataattatatg

SEQ ID NO: 102016 - DNA, 22 bp, Artificial Sequence
  chemically synthesized
tatgtttcagaattttggcaca

SEQ ID NO: 102017 - DNA, 22 bp, Artificial Sequence
  chemically synthesized
cagaattttggcacatagtaac

SEQ ID NO: 102018 - DNA, 22 bp, Artificial Sequence
  chemically synthesized
agaattttggcacatagtaaca

SEQ ID NO: 102019 - DNA, 22 bp, Artificial Sequence
  chemically synthesized
tggcacatagtaacatctctaa

SEQ ID NO: 102020 - DNA, 22 bp, Artificial Sequence
  chemically synthesized
ggcacatagtaacatctctaat

SEQ ID NO: 102021 - DNA, 22 bp, Artificial Sequence
  chemically synthesized
gcacatagtaacatctctaata

SEQ ID NO: 102022 - DNA, 22 bp, Artificial Sequence
  chemically synthesized
taatataagcaattattggtgg

SEQ ID NO: 102023 - DNA, 22 bp, Artificial Sequence
  chemically synthesized
atataagcaattattggtggag

SEQ ID NO: 102024 - DNA, 22 bp, Artificial Sequence
  chemically synthesized
ttggtggagagagatggacaga

SEQ ID NO: 102025 - DNA, 22 bp, Artificial Sequence
  chemically synthesized
gtggagagagatggacagagga

SEQ ID NO: 102026 - DNA, 22 bp, Artificial Sequence
  chemically synthesized
ttgaaagggctgctacttcagg

SEQ ID NO: 102027 - DNA, 22 bp, Artificial Sequence
  chemically synthesized
tgaaagggctgctacttcaggg

SEQ ID NO: 102028 - DNA, 22 bp, Artificial Sequence
  chemically synthesized
gaaagggctgctacttcagggg

SEQ ID NO: 102029 - DNA, 22 bp, Artificial Sequence
  chemically synthesized
aaagggctgctacttcagggga

SEQ ID NO: 102030 - DNA, 22 bp, Artificial Sequence
  chemically synthesized
ctacttcaggggacactgttga

SEQ ID NO: 102031 - DNA, 22 bp, Artificial Sequence
  chemically synthesized
cttcaggggacactgttgataa

SEQ ID NO: 102032 - DNA, 22 bp, Artificial Sequence
  chemically synthesized
caggggacactgttgataacaa

SEQ ID NO: 102033 - DNA, 22 bp, Artificial Sequence
  chemically synthesized
aggggacactgttgataacaaa

SEQ ID NO: 102034 - DNA, 22 bp, Artificial Sequence
  chemically synthesized
ttgataacaaaaatgtcagtct

SEQ ID NO: 102035 - DNA, 22 bp, Artificial Sequence
  chemically synthesized
ataacaaaaatgtcagtctagg

SEQ ID NO: 102036 - DNA, 22 bp, Artificial Sequence
  chemically synthesized
ggcactgcagtagcagagacta

SEQ ID NO: 102037 - DNA, 22 bp, Artificial Sequence
  chemically synthesized
cagtagcagagactatgttcat

SEQ ID NO: 102038 - DNA, 22 bp, Artificial Sequence
  chemically synthesized
tgttcatatggatactaaaaac

SEQ ID NO: 102039 - DNA, 22 bp, Artificial Sequence
  chemically synthesized
atatggatactaaaaacactgc

SEQ ID NO: 102040 - DNA, 22 bp, Artificial Sequence
  chemically synthesized
aaaacactgctaactaacttga

SEQ ID NO: 102041 - DNA, 22 bp, Artificial Sequence
  chemically synthesized
ctaactaacttgatccactgaa

SEQ ID NO: 102042 - DNA, 22 bp, Artificial Sequence
  chemically synthesized
actaacttgatccactgaatta

SEQ ID NO: 102043 - DNA, 22 bp, Artificial Sequence
  chemically synthesized
acttgatccactgaattatgac

SEQ ID NO: 102044 - DNA, 22 bp, Artificial Sequence
  chemically synthesized
gatccactgaattatgacctgc

SEQ ID NO: 102045 - DNA, 22 bp, Artificial Sequence
  chemically synthesized
atccactgaattatgacctgca

SEQ ID NO: 102046 - DNA, 22 bp, Artificial Sequence
  chemically synthesized
aattatgacctgcatagtgctt

SEQ ID NO: 102047 - DNA, 22 bp, Artificial Sequence
  chemically synthesized
tgacctgcatagtgcttaatgt

SEQ ID NO: 102048 - DNA, 22 bp, Artificial Sequence
  chemically synthesized
catagtgcttaatgtggcagaa

SEQ ID NO: 102049 - DNA, 22 bp, Artificial Sequence
  chemically synthesized
aatgtggcagaacttatctacc

SEQ ID NO: 102050 - DNA, 22 bp, Artificial Sequence
  chemically synthesized
atgtggcagaacttatctaccg

SEQ ID NO: 102051 - DNA, 22 bp, Artificial Sequence
  chemically synthesized
atctaccgccacaggagtgatg

SEQ ID NO: 102052 - DNA, 22 bp, Artificial Sequence
  chemically synthesized
tctaccgccacaggagtgatgt

SEQ ID NO: 102053 - DNA, 22 bp, Artificial Sequence
  chemically synthesized
ccgccacaggagtgatgtgtat

SEQ ID NO: 102054 - DNA, 22 bp, Artificial Sequence
  chemically synthesized
taagttctcttaaccttccaat

SEQ ID NO: 102055 - DNA, 22 bp, Artificial Sequence
  chemically synthesized
tcttaaccttccaatgttgcct

SEQ ID NO: 102056 - DNA, 22 bp, Artificial Sequence
  chemically synthesized
ttaaccttccaatgttgcctta

SEQ ID NO: 102057 - DNA, 22 bp, Artificial Sequence
  chemically synthesized
aaccttccaatgttgccttata

SEQ ID NO: 102058 - DNA, 22 bp, Artificial Sequence
  chemically synthesized
accttccaatgttgccttataa

SEQ ID NO: 102059 - DNA, 22 bp, Artificial Sequence
  chemically synthesized
ccaatgttgccttataagagaa

SEQ ID NO: 102060 - DNA, 22 bp, Artificial Sequence
  chemically synthesized
caatgttgccttataagagaat

SEQ ID NO: 102061 - DNA, 22 bp, Artificial Sequence
  chemically synthesized
ccttataagagaatggattaat

SEQ ID NO: 102062 - DNA, 22 bp, Artificial Sequence
  chemically synthesized
ataagagaatggattaatgcca

SEQ ID NO: 102063 - DNA, 22 bp, Artificial Sequence
  chemically synthesized
taagagaatggattaatgccaa

SEQ ID NO: 102064 - DNA, 22 bp, Artificial Sequence
  chemically synthesized
atgccaaaatttgttgtacagg

SEQ ID NO: 102065 - DNA, 22 bp, Artificial Sequence
  chemically synthesized
gttgtacaggataagagctaac

SEQ ID NO: 102066 - DNA, 22 bp, Artificial Sequence
  chemically synthesized
ttgtacaggataagagctaacc

SEQ ID NO: 102067 - DNA, 22 bp, Artificial Sequence
  chemically synthesized
tacaggataagagctaaccact

SEQ ID NO: 102068 - DNA, 22 bp, Artificial Sequence
  chemically synthesized
accacttatttggatctactgt

SEQ ID NO: 102069 - DNA, 22 bp, Artificial Sequence
  chemically synthesized
atttggatctactgtcacccag

SEQ ID NO: 102070 - DNA, 22 bp, Artificial Sequence
  chemically synthesized
tttggatctactgtcacccaga

SEQ ID NO: 102071 - DNA, 22 bp, Artificial Sequence
  chemically synthesized
ggatctactgtcacccagataa

SEQ ID NO: 102072 - DNA, 22 bp, Artificial Sequence
  chemically synthesized
gatctactgtcacccagataat

SEQ ID NO: 102073 - DNA, 22 bp, Artificial Sequence
  chemically synthesized
ctgtcacccagataatggacca

SEQ ID NO: 102074 - DNA, 22 bp, Artificial Sequence
  chemically synthesized
tcacccagataatggaccagat

SEQ ID NO: 102075 - DNA, 22 bp, Artificial Sequence
  chemically synthesized
attattcttaaactatagtcgt

SEQ ID NO: 102076 - DNA, 22 bp, Artificial Sequence
  chemically synthesized
ttcttaaactatagtcgtgttt

SEQ ID NO: 102077 - DNA, 22 bp, Artificial Sequence
  chemically synthesized
ttaaactatagtcgtgttttca

SEQ ID NO: 102078 - DNA, 22 bp, Artificial Sequence
  chemically synthesized
aaactatagtcgtgttttcaaa

SEQ ID NO: 102079 - DNA, 22 bp, Artificial Sequence
  chemically synthesized
aactatagtcgtgttttcaaaa

SEQ ID NO: 102080 - DNA, 22 bp, Artificial Sequence
  chemically synthesized
tagtcgtgttttcaaaacctga

SEQ ID NO: 102081 - DNA, 22 bp, Artificial Sequence
  chemically synthesized
tcaaaacctgagctgcgtttgg

SEQ ID NO: 102082 - DNA, 22 bp, Artificial Sequence
  chemically synthesized
caaaacctgagctgcgtttggg

SEQ ID NO: 102083 - DNA, 22 bp, Artificial Sequence
  chemically synthesized
aaaacctgagctgcgtttggga

SEQ ID NO: 102084 - DNA, 22 bp, Artificial Sequence
  chemically synthesized
agctgcgtttgggacatgcgga

SEQ ID NO: 102085 - DNA, 22 bp, Artificial Sequence
  chemically synthesized
cgtttgggacatgcggatgcac

SEQ ID NO: 102086 - DNA, 22 bp, Artificial Sequence
  chemically synthesized
gggacatgcggatgcacagggt

SEQ ID NO: 102087 - DNA, 22 bp, Artificial Sequence
  chemically synthesized
ggacatgcggatgcacagggtt

SEQ ID NO: 102088 - DNA, 22 bp, Artificial Sequence
  chemically synthesized
tattaaaactgtgtggtaatta

SEQ ID NO: 102089 - DNA, 22 bp, Artificial Sequence
  chemically synthesized
attaaaactgtgtggtaattac

SEQ ID NO: 102090 - DNA, 22 bp, Artificial Sequence
  chemically synthesized
ttaaaactgtgtggtaattact

SEQ ID NO: 102091 - DNA, 22 bp, Artificial Sequence
  chemically synthesized
aaactgtgtggtaattactggg

SEQ ID NO: 102092 - DNA, 22 bp, Artificial Sequence
  chemically synthesized
tgtggtaattactggggaaata

SEQ ID NO: 102093 - DNA, 22 bp, Artificial Sequence
  chemically synthesized
ctggggaaatagttaatacaat

SEQ ID NO: 102094 - DNA, 22 bp, Artificial Sequence
  chemically synthesized
gggaaatagttaatacaattta

SEQ ID NO: 102095 - DNA, 22 bp, Artificial Sequence
  chemically synthesized
atacaatttataagtatatttt

SEQ ID NO: 102096 - DNA, 22 bp, Artificial Sequence
  chemically synthesized
ataagtatattttattgaccta

SEQ ID NO: 102097 - DNA, 22 bp, Artificial Sequence
  chemically synthesized
taagtatattttattgacctaa

SEQ ID NO: 102098 - DNA, 22 bp, Artificial Sequence
  chemically synthesized
tattgacctaaagatagccctc

SEQ ID NO: 102099 - DNA, 22 bp, Artificial Sequence
  chemically synthesized
attgacctaaagatagccctct

SEQ ID NO: 102100 - DNA, 22 bp, Artificial Sequence
  chemically synthesized
ttgacctaaagatagccctcta

SEQ ID NO: 102101 - DNA, 22 bp, Artificial Sequence
  chemically synthesized
acctaaagatagccctctattt

SEQ ID NO: 102102 - DNA, 22 bp, Artificial Sequence
  chemically synthesized
aagatagccctctatttaacat

SEQ ID NO: 102103 - DNA, 22 bp, Artificial Sequence
  chemically synthesized
tatttaacatctgcagtctcta

SEQ ID NO: 102104 - DNA, 22 bp, Artificial Sequence
  chemically synthesized
tttaacatctgcagtctctagc

SEQ ID NO: 102105 - DNA, 22 bp, Artificial Sequence
  chemically synthesized
aacatctgcagtctctagcaaa

SEQ ID NO: 102106 - DNA, 22 bp, Artificial Sequence
  chemically synthesized
acatctgcagtctctagcaaaa

SEQ ID NO: 102107 - DNA, 22 bp, Artificial Sequence
  chemically synthesized
cagtctctagcaaaacagctac

SEQ ID NO: 102108 - DNA, 22 bp, Artificial Sequence
  chemically synthesized
tagcaaaacagctacgctggca

SEQ ID NO: 102109 - DNA, 22 bp, Artificial Sequence
  chemically synthesized
gcaaaacagctacgctggcatt

SEQ ID NO: 102110 - DNA, 22 bp, Artificial Sequence
  chemically synthesized
cgctggcatttaattgtggcaa

SEQ ID NO: 102111 - DNA, 22 bp, Artificial Sequence
  chemically synthesized
gcatttaattgtggcaaatttg

SEQ ID NO: 102112 - DNA, 22 bp, Artificial Sequence
  chemically synthesized
aattgtggcaaatttggtagta

SEQ ID NO: 102113 - DNA, 22 bp, Artificial Sequence
  chemically synthesized
attgtggcaaatttggtagtac

SEQ ID NO: 102114 - DNA, 22 bp, Artificial Sequence
  chemically synthesized
tggcaaatttggtagtaccaga

SEQ ID NO: 102115 - DNA, 22 bp, Artificial Sequence
  chemically synthesized
ggtagtaccagaaactgtccac

SEQ ID NO: 102116 - DNA, 22 bp, Artificial Sequence
  chemically synthesized
gtagtaccagaaactgtccaca

SEQ ID NO: 102117 - DNA, 22 bp, Artificial Sequence
  chemically synthesized
tccacatacccaaatattccag

SEQ ID NO: 102118 - DNA, 22 bp, Artificial Sequence
  chemically synthesized
cagggagaatagttgccctaat

SEQ ID NO: 102119 - DNA, 22 bp, Artificial Sequence
  chemically synthesized
ccctaatagtttagggagtctc

SEQ ID NO: 102120 - DNA, 22 bp, Artificial Sequence
  chemically synthesized
atagtttagggagtctcctaga

SEQ ID NO: 102121 - DNA, 22 bp, Artificial Sequence
  chemically synthesized
agggagtctcctagaatgtgat

SEQ ID NO: 102122 - DNA, 22 bp, Artificial Sequence
  chemically synthesized
gggagtctcctagaatgtgata

SEQ ID NO: 102123 - DNA, 22 bp, Artificial Sequence
  chemically synthesized
ctagaatgtgatacatgacaaa

SEQ ID NO: 102124 - DNA, 22 bp, Artificial Sequence
  chemically synthesized
gaatgtgatacatgacaaaagt

SEQ ID NO: 102125 - DNA, 22 bp, Artificial Sequence
  chemically synthesized
tagtggaatttatcactctcag

SEQ ID NO: 102126 - DNA, 22 bp, Artificial Sequence
  chemically synthesized
agtggaatttatcactctcagg

SEQ ID NO: 102127 - DNA, 22 bp, Artificial Sequence
  chemically synthesized
gtggaatttatcactctcaggc

SEQ ID NO: 102128 - DNA, 22 bp, Artificial Sequence
  chemically synthesized
atcactctcaggcaagcataga

SEQ ID NO: 102129 - DNA, 22 bp, Artificial Sequence
  chemically synthesized
tcactctcaggcaagcatagag

SEQ ID NO: 102130 - DNA, 22 bp, Artificial Sequence
  chemically synthesized
tcaggcaagcatagaggccccc

SEQ ID NO: 102131 - DNA, 22 bp, Artificial Sequence
  chemically synthesized
aggcaagcatagaggccccctg

SEQ ID NO: 102132 - DNA, 22 bp, Artificial Sequence
  chemically synthesized
agggatgcaaaaatgactggct

SEQ ID NO: 102133 - DNA, 22 bp, Artificial Sequence
  chemically synthesized
gctcactgttctcttgcccctt

SEQ ID NO: 102134 - DNA, 22 bp, Artificial Sequence
  chemically synthesized
actgttctcttgcccctttctg

SEQ ID NO: 102135 - DNA, 22 bp, Artificial Sequence
  chemically synthesized
ttctcttgcccctttctgagtg

SEQ ID NO: 102136 - DNA, 22 bp, Artificial Sequence
  chemically synthesized
tcttgcccctttctgagtgcct

SEQ ID NO: 102137 - DNA, 22 bp, Artificial Sequence
  chemically synthesized
ttgcccctttctgagtgccttt

SEQ ID NO: 102138 - DNA, 22 bp, Artificial Sequence
  chemically synthesized
gcccctttctgagtgcctttgg

SEQ ID NO: 102139 - DNA, 22 bp, Artificial Sequence
  chemically synthesized
cccctttctgagtgcctttgga

SEQ ID NO: 102140 - DNA, 22 bp, Artificial Sequence
  chemically synthesized
tctgagtgcctttggactgatt

SEQ ID NO: 102141 - DNA, 22 bp, Artificial Sequence
  chemically synthesized
ctgagtgcctttggactgattc

SEQ ID NO: 102142 - DNA, 22 bp, Artificial Sequence
  chemically synthesized
tgagtgcctttggactgattct

SEQ ID NO: 102143 - DNA, 22 bp, Artificial Sequence
  chemically synthesized
agtgcctttggactgattcttt

SEQ ID NO: 102144 - DNA, 22 bp, Artificial Sequence
  chemically synthesized
tggactgattctttgacagcaa

SEQ ID NO: 102145 - DNA, 22 bp, Artificial Sequence
  chemically synthesized
ggactgattctttgacagcaac

SEQ ID NO: 102146 - DNA, 22 bp, Artificial Sequence
  chemically synthesized
gactgattctttgacagcaact

SEQ ID NO: 102147 - DNA, 22 bp, Artificial Sequence
  chemically synthesized
attctttgacagcaactatccc

SEQ ID NO: 102148 - DNA, 22 bp, Artificial Sequence
  chemically synthesized
tttgacagcaactatcccagag

SEQ ID NO: 102149 - DNA, 22 bp, Artificial Sequence
  chemically synthesized
tgacagcaactatcccagagtc

SEQ ID NO: 102150 - DNA, 22 bp, Artificial Sequence
  chemically synthesized
gacagcaactatcccagagtcc

SEQ ID NO: 102151 - DNA, 22 bp, Artificial Sequence
  chemically synthesized
acagcaactatcccagagtcct

SEQ ID NO: 102152 - DNA, 22 bp, Artificial Sequence
  chemically synthesized
tcccagagtcctcaagagtttc

SEQ ID NO: 102153 - DNA, 22 bp, Artificial Sequence
  chemically synthesized
aagagtttctgaaggtaacata

SEQ ID NO: 102154 - DNA, 22 bp, Artificial Sequence
  chemically synthesized
ctgaaggtaacatagatccatc

SEQ ID NO: 102155 - DNA, 22 bp, Artificial Sequence
  chemically synthesized
tgaaggtaacatagatccatca

SEQ ID NO: 102156 - DNA, 22 bp, Artificial Sequence
  chemically synthesized
aaggtaacatagatccatcatc

SEQ ID NO: 102157 - DNA, 22 bp, Artificial Sequence
  chemically synthesized
cttcaacttgccatgctgacaa

SEQ ID NO: 102158 - DNA, 22 bp, Artificial Sequence
  chemically synthesized
ttcaacttgccatgctgacaaa

SEQ ID NO: 102159 - DNA, 22 bp, Artificial Sequence
  chemically synthesized
caacttgccatgctgacaaaaa

SEQ ID NO: 102160 - DNA, 22 bp, Artificial Sequence
  chemically synthesized
aacttgccatgctgacaaaaag

SEQ ID NO: 102161 - DNA, 22 bp, Artificial Sequence
  chemically synthesized
gccatgctgacaaaaagcttag

SEQ ID NO: 102162 - DNA, 22 bp, Artificial Sequence
  chemically synthesized
ccatgctgacaaaaagcttagg

SEQ ID NO: 102163 - DNA, 22 bp, Artificial Sequence
  chemically synthesized
acaaaaagcttaggaactgttc

SEQ ID NO: 102164 - DNA, 22 bp, Artificial Sequence
  chemically synthesized
aggaactgttcaggaaaccatt

SEQ ID NO: 102165 - DNA, 22 bp, Artificial Sequence
  chemically synthesized
ggaactgttcaggaaaccattt

SEQ ID NO: 102166 - DNA, 22 bp, Artificial Sequence
  chemically synthesized
ttcaggaaaccatttataaaga

SEQ ID NO: 102167 - DNA, 22 bp, Artificial Sequence
  chemically synthesized
aggaaaccatttataaagacat

SEQ ID NO: 102168 - DNA, 22 bp, Artificial Sequence
  chemically synthesized
ataaagacataaactaaaatga

SEQ ID NO: 102169 - DNA, 22 bp, Artificial Sequence
  chemically synthesized
taaagacataaactaaaatgag

SEQ ID NO: 102170 - DNA, 22 bp, Artificial Sequence
  chemically synthesized
aaatgagaagacaaaaagagaa

SEQ ID NO: 102171 - DNA, 22 bp, Artificial Sequence
  chemically synthesized
agatcgtgttaaaaaagaacag

SEQ ID NO: 102172 - DNA, 22 bp, Artificial Sequence
  chemically synthesized
aaaaagaacagtcttccgttta

SEQ ID NO: 102173 - DNA, 22 bp, Artificial Sequence
  chemically synthesized
ccgtttagttccagataatctg

SEQ ID NO: 102174 - DNA, 22 bp, Artificial Sequence
  chemically synthesized
cgtttagttccagataatctgc

SEQ ID NO: 102175 - DNA, 22 bp, Artificial Sequence
  chemically synthesized
agttccagataatctgcaagtg

SEQ ID NO: 102176 - DNA, 22 bp, Artificial Sequence
  chemically synthesized
gttccagataatctgcaagtgc

SEQ ID NO: 102177 - DNA, 22 bp, Artificial Sequence
  chemically synthesized
cagataatctgcaagtgccctg

SEQ ID NO: 102178 - DNA, 22 bp, Artificial Sequence
  chemically synthesized
caagtgccctgtacaatcagtg

SEQ ID NO: 102179 - DNA, 22 bp, Artificial Sequence
  chemically synthesized
tacaatcagtgtcccctgaatc

SEQ ID NO: 102180 - DNA, 22 bp, Artificial Sequence
  chemically synthesized
aatccactttttcatctccaca

SEQ ID NO: 102181 - DNA, 22 bp, Artificial Sequence
  chemically synthesized
tttcatctccacatattgcccc

SEQ ID NO: 102182 - DNA, 22 bp, Artificial Sequence
  chemically synthesized
ttcatctccacatattgcccca

SEQ ID NO: 102183 - DNA, 22 bp, Artificial Sequence
  chemically synthesized
tcatctccacatattgccccaa

SEQ ID NO: 102184 - DNA, 22 bp, Artificial Sequence
  chemically synthesized
catctccacatattgccccaaa

SEQ ID NO: 102185 - DNA, 22 bp, Artificial Sequence
  chemically synthesized
atctccacatattgccccaaaa

SEQ ID NO: 102186 - DNA, 22 bp, Artificial Sequence
  chemically synthesized
cacatattgccccaaaattgtg

SEQ ID NO: 102187 - DNA, 22 bp, Artificial Sequence
  chemically synthesized
ccccaaaattgtgttcctatag

SEQ ID NO: 102188 - DNA, 22 bp, Artificial Sequence
  chemically synthesized
tgttcctatagaagaaattaat

SEQ ID NO: 102189 - DNA, 22 bp, Artificial Sequence
  chemically synthesized
ctatagaagaaattaataaata

SEQ ID NO: 102190 - DNA, 22 bp, Artificial Sequence
  chemically synthesized
tagaagaaattaataaatatac

SEQ ID NO: 102191 - DNA, 22 bp, Artificial Sequence
  chemically synthesized
ataaatataccaaaataaatat

SEQ ID NO: 102192 - DNA, 22 bp, Artificial Sequence
  chemically synthesized
aaagtcaactgacaatgggaag

SEQ ID NO: 102193 - DNA, 22 bp, Artificial Sequence
  chemically synthesized
aagtcaactgacaatgggaagc

SEQ ID NO: 102194 - DNA, 22 bp, Artificial Sequence
  chemically synthesized
acaatgggaagccatgagatga

SEQ ID NO: 102195 - DNA, 22 bp, Artificial Sequence
  chemically synthesized
aaaaatctcagcttttaagtga

SEQ ID NO: 102196 - DNA, 22 bp, Artificial Sequence
  chemically synthesized
agcttttaagtgacttttttat

SEQ ID NO: 102197 - DNA, 22 bp, Artificial Sequence
  chemically synthesized
ttaagtgacttttttatatctt

SEQ ID NO: 102198 - DNA, 22 bp, Artificial Sequence
  chemically synthesized
taagtgacttttttatatctta

SEQ ID NO: 102199 - DNA, 22 bp, Artificial Sequence
  chemically synthesized
aagtgacttttttatatcttac

SEQ ID NO: 102200 - DNA, 22 bp, Artificial Sequence
  chemically synthesized
agtgacttttttatatcttacc

SEQ ID NO: 102201 - DNA, 22 bp, Artificial Sequence
  chemically synthesized
ttttatatcttaccttaagtac

SEQ ID NO: 102202 - DNA, 22 bp, Artificial Sequence
  chemically synthesized
tttatatcttaccttaagtaca

SEQ ID NO: 102203 - DNA, 22 bp, Artificial Sequence
  chemically synthesized
ttatatcttaccttaagtacaa

SEQ ID NO: 102204 - DNA, 22 bp, Artificial Sequence
  chemically synthesized
tatatcttaccttaagtacaaa

SEQ ID NO: 102205 - DNA, 22 bp, Artificial Sequence
  chemically synthesized
atatcttaccttaagtacaaat

SEQ ID NO: 102206 - DNA, 22 bp, Artificial Sequence
  chemically synthesized
tatcttaccttaagtacaaatt

SEQ ID NO: 102207 - DNA, 22 bp, Artificial Sequence
  chemically synthesized
accttaagtacaaattaaaatg

SEQ ID NO: 102208 - DNA, 22 bp, Artificial Sequence
  chemically synthesized
ccttaagtacaaattaaaatgg

SEQ ID NO: 102209 - DNA, 22 bp, Artificial Sequence
  chemically synthesized
aagtacaaattaaaatggaaga

SEQ ID NO: 102210 - DNA, 22 bp, Artificial Sequence
  chemically synthesized
agtacaaattaaaatggaagag

SEQ ID NO: 102211 - DNA, 22 bp, Artificial Sequence
  chemically synthesized
aaatggaagaggtggccaggca

SEQ ID NO: 102212 - DNA, 22 bp, Artificial Sequence
  chemically synthesized
atgcctgtaatcctagcacttt

SEQ ID NO: 102213 - DNA, 22 bp, Artificial Sequence
  chemically synthesized
taatcctagcactttggaaggc

SEQ ID NO: 102214 - DNA, 22 bp, Artificial Sequence
  chemically synthesized
gcactttggaaggctgaggtgg

SEQ ID NO: 102215 - DNA, 22 bp, Artificial Sequence
  chemically synthesized
tggaaggctgaggtggatcacg

SEQ ID NO: 102216 - DNA, 22 bp, Artificial Sequence
  chemically synthesized
ggaaggctgaggtggatcacga

SEQ ID NO: 102217 - DNA, 22 bp, Artificial Sequence
  chemically synthesized
gaaggctgaggtggatcacgag

SEQ ID NO: 102218 - DNA, 22 bp, Artificial Sequence
  chemically synthesized
aggtggatcacgaggtcagcag

SEQ ID NO: 102219 - DNA, 22 bp, Artificial Sequence
  chemically synthesized
gagactagcctggccaacatgg

SEQ ID NO: 102220 - DNA, 22 bp, Artificial Sequence
  chemically synthesized
agactagcctggccaacatggt

SEQ ID NO: 102221 - DNA, 22 bp, Artificial Sequence
  chemically synthesized
gcctggccaacatggtgaaacc

SEQ ID NO: 102222 - DNA, 22 bp, Artificial Sequence
  chemically synthesized
gccaacatggtgaaaccctgtc

SEQ ID NO: 102223 - DNA, 22 bp, Artificial Sequence
  chemically synthesized
tctctactaaaaatacaaaaat

SEQ ID NO: 102224 - DNA, 22 bp, Artificial Sequence
  chemically synthesized
tactaaaaatacaaaaattagc

SEQ ID NO: 102225 - DNA, 22 bp, Artificial Sequence
  chemically synthesized
ctaaaaatacaaaaattagctg

SEQ ID NO: 102226 - DNA, 22 bp, Artificial Sequence
  chemically synthesized
aaaatacaaaaattagctgggt

SEQ ID NO: 102227 - DNA, 22 bp, Artificial Sequence
  chemically synthesized
gctgggtgtggtggtgagcgcc

SEQ ID NO: 102228 - DNA, 22 bp, Artificial Sequence
  chemically synthesized
ggtgtggtggtgagcgcctgta

SEQ ID NO: 102229 - DNA, 22 bp, Artificial Sequence
  chemically synthesized
taatcccagctactcgggaggc

SEQ ID NO: 102230 - DNA, 22 bp, Artificial Sequence
  chemically synthesized
ctcgggaggctgaggcaggaga

SEQ ID NO: 102231 - DNA, 22 bp, Artificial Sequence
  chemically synthesized
gggaggctgaggcaggagaatt

SEQ ID NO: 102232 - DNA, 22 bp, Artificial Sequence
  chemically synthesized
aggcaggagaattgctttaaaa

SEQ ID NO: 102233 - DNA, 22 bp, Artificial Sequence
  chemically synthesized
ctttaaaaaaactggggagcag

SEQ ID NO: 102234 - DNA, 22 bp, Artificial Sequence
  chemically synthesized
taaaaaaactggggagcagagg

SEQ ID NO: 102235 - DNA, 22 bp, Artificial Sequence
  chemically synthesized
aaaaaaactggggagcagaggt

SEQ ID NO: 102236 - DNA, 22 bp, Artificial Sequence
  chemically synthesized
aaaaaactggggagcagaggtc

SEQ ID NO: 102237 - DNA, 22 bp, Artificial Sequence
  chemically synthesized
gggagcagaggtcgtcgcagtg

SEQ ID NO: 102238 - DNA, 22 bp, Artificial Sequence
  chemically synthesized
tgccactgcactacagcctggg

SEQ ID NO: 102239 - DNA, 22 bp, Artificial Sequence
  chemically synthesized
cactacagcctgggcgacaaag

SEQ ID NO: 102240 - DNA, 22 bp, Artificial Sequence
  chemically synthesized
cagcctgggcgacaaagcaagg

SEQ ID NO: 102241 - DNA, 22 bp, Artificial Sequence
  chemically synthesized
ggcgacaaagcaaggctctgtc

SEQ ID NO: 102242 - DNA, 22 bp, Artificial Sequence
  chemically synthesized
tgtctcaaaaaaaaaaaaaaaa

SEQ ID NO: 102243 - DNA, 22 bp, Artificial Sequence
  chemically synthesized
tctcaaaaaaaaaaaaaaaaaa

SEQ ID NO: 102244 - DNA, 22 bp, Artificial Sequence
  chemically synthesized
aaaaaaaaaaaaaaaaaaggtt

SEQ ID NO: 102245 - DNA, 22 bp, Artificial Sequence
  chemically synthesized
ggagagaaacattgggaaacta

SEQ ID NO: 102246 - DNA, 22 bp, Artificial Sequence
  chemically synthesized
gagagaaacattgggaaactag

SEQ ID NO: 102247 - DNA, 22 bp, Artificial Sequence
  chemically synthesized
ggaaactaggacaaattttgct

SEQ ID NO: 102248 - DNA, 22 bp, Artificial Sequence
  chemically synthesized
ggacaaattttgctctcagtaa

SEQ ID NO: 102249 - DNA, 22 bp, Artificial Sequence
  chemically synthesized
tgctctcagtaaaaagaaagat

SEQ ID NO: 102250 - DNA, 22 bp, Artificial Sequence
  chemically synthesized
gctctcagtaaaaagaaagatc

SEQ ID NO: 102251 - DNA, 22 bp, Artificial Sequence
  chemically synthesized
ctctcagtaaaaagaaagatct

SEQ ID NO: 102252 - DNA, 22 bp, Artificial Sequence
  chemically synthesized
tcagtaaaaagaaagatctcaa

SEQ ID NO: 102253 - DNA, 22 bp, Artificial Sequence
  chemically synthesized
agtaaaaagaaagatctcaaag

SEQ ID NO: 102254 - DNA, 22 bp, Artificial Sequence
  chemically synthesized
aaaggagatagacaaagaagca

SEQ ID NO: 102255 - DNA, 22 bp, Artificial Sequence
  chemically synthesized
atctgtatttacaaaaaaacaa

SEQ ID NO: 102256 - DNA, 22 bp, Artificial Sequence
  chemically synthesized
tatttacaaaaaaacaatgaaa

SEQ ID NO: 102257 - DNA, 22 bp, Artificial Sequence
  chemically synthesized
acaaaaaaacaatgaaaaggga

SEQ ID NO: 102258 - DNA, 22 bp, Artificial Sequence
  chemically synthesized
caaaaaaacaatgaaaagggaa

SEQ ID NO: 102259 - DNA, 22 bp, Artificial Sequence
  chemically synthesized
ataggagtggatactatggtag

SEQ ID NO: 102260 - DNA, 22 bp, Artificial Sequence
  chemically synthesized
taggagtggatactatggtagg

SEQ ID NO: 102261 - DNA, 22 bp, Artificial Sequence
  chemically synthesized
tggtaggttaatagtgaaaaat

SEQ ID NO: 102262 - DNA, 22 bp, Artificial Sequence
  chemically synthesized
atagtgaaaaatatagaattat

SEQ ID NO: 102263 - DNA, 22 bp, Artificial Sequence
  chemically synthesized
tcaattaatataaacatagagg

SEQ ID NO: 102264 - DNA, 22 bp, Artificial Sequence
  chemically synthesized
atataaacatagaggtgttgat

SEQ ID NO: 102265 - DNA, 22 bp, Artificial Sequence
  chemically synthesized
attgtttggggcaactaggtct

SEQ ID NO: 102266 - DNA, 22 bp, Artificial Sequence
  chemically synthesized
tttggggcaactaggtctttgg

SEQ ID NO: 102267 - DNA, 22 bp, Artificial Sequence
  chemically synthesized
ggggcaactaggtctttggtaa

SEQ ID NO: 102268 - DNA, 22 bp, Artificial Sequence
  chemically synthesized
gggcaactaggtctttggtaat

SEQ ID NO: 102269 - DNA, 22 bp, Artificial Sequence
  chemically synthesized
ggtctttggtaatattgacaat

SEQ ID NO: 102270 - DNA, 22 bp, Artificial Sequence
  chemically synthesized
tggtaatattgacaatttcaac

SEQ ID NO: 102271 - DNA, 22 bp, Artificial Sequence
  chemically synthesized
ggtaatattgacaatttcaaca

SEQ ID NO: 102272 - DNA, 22 bp, Artificial Sequence
  chemically synthesized
gtaatattgacaatttcaacat

SEQ ID NO: 102273 - DNA, 22 bp, Artificial Sequence
  chemically synthesized
acaatttcaacataatggcaga

SEQ ID NO: 102274 - DNA, 22 bp, Artificial Sequence
  chemically synthesized
caacataatggcagaaatgaat

SEQ ID NO: 102275 - DNA, 22 bp, Artificial Sequence
  chemically synthesized
aacataatggcagaaatgaatg

SEQ ID NO: 102276 - DNA, 22 bp, Artificial Sequence
  chemically synthesized
atgactgtgagacaaaaagtga

SEQ ID NO: 102277 - DNA, 22 bp, Artificial Sequence
  chemically synthesized
tgagacaaaaagtgagtaaaaa

SEQ ID NO: 102278 - DNA, 22 bp, Artificial Sequence
  chemically synthesized
ggcacggtggctcatgcctata

SEQ ID NO: 102279 - DNA, 22 bp, Artificial Sequence
  chemically synthesized
atgcctataatcccagcacttt

SEQ ID NO: 102280 - DNA, 22 bp, Artificial Sequence
  chemically synthesized
taatcccagcactttgggaggc

SEQ ID NO: 102281 - DNA, 22 bp, Artificial Sequence
  chemically synthesized
tgggaggccgaggagggtggat

SEQ ID NO: 102282 - DNA, 22 bp, Artificial Sequence
  chemically synthesized
gggaggccgaggagggtggatc

SEQ ID NO: 102283 - DNA, 22 bp, Artificial Sequence
  chemically synthesized
ggaggccgaggagggtggatca

SEQ ID NO: 102284 - DNA, 22 bp, Artificial Sequence
  chemically synthesized
gagttcaggagttcgagaccag

SEQ ID NO: 102285 - DNA, 22 bp, Artificial Sequence
  chemically synthesized
agttcaggagttcgagaccagc

SEQ ID NO: 102286 - DNA, 22 bp, Artificial Sequence
  chemically synthesized
aggagttcgagaccagctgggc

SEQ ID NO: 102287 - DNA, 22 bp, Artificial Sequence
  chemically synthesized
gagaccagctgggccaacatgg

SEQ ID NO: 102288 - DNA, 22 bp, Artificial Sequence
  chemically synthesized
ggccaacatggcaaaacaccat

SEQ ID NO: 102289 - DNA, 22 bp, Artificial Sequence
  chemically synthesized
ctataattacaaaaataagcca

SEQ ID NO: 102290 - DNA, 22 bp, Artificial Sequence
  chemically synthesized
taattacaaaaataagccaggt

SEQ ID NO: 102291 - DNA, 22 bp, Artificial Sequence
  chemically synthesized
caaaaataagccaggtgtggtg

SEQ ID NO: 102292 - DNA, 22 bp, Artificial Sequence
  chemically synthesized
ctctggaggctgaggcatgaga

SEQ ID NO: 102293 - DNA, 22 bp, Artificial Sequence
  chemically synthesized
tggaggctgaggcatgagaatc

SEQ ID NO: 102294 - DNA, 22 bp, Artificial Sequence
  chemically synthesized
gaggctgaggcatgagaatccc

SEQ ID NO: 102295 - DNA, 22 bp, Artificial Sequence
  chemically synthesized
aggcatgagaatcccctgaacc

SEQ ID NO: 102296 - DNA, 22 bp, Artificial Sequence
  chemically synthesized
aaccctggtggaggaggtcgca

SEQ ID NO: 102297 - DNA, 22 bp, Artificial Sequence
  chemically synthesized
gtggaggaggtcgcagtgagct

SEQ ID NO: 102298 - DNA, 22 bp, Artificial Sequence
  chemically synthesized
agatcgcaccactgcactctag

SEQ ID NO: 102299 - DNA, 22 bp, Artificial Sequence
  chemically synthesized
cactctagcctgggcaacagag

SEQ ID NO: 102300 - DNA, 22 bp, Artificial Sequence
  chemically synthesized
tagcctgggcaacagagaaaaa

SEQ ID NO: 102301 - DNA, 22 bp, Artificial Sequence
  chemically synthesized
gcctgggcaacagagaaaaatc

SEQ ID NO: 102302 - DNA, 22 bp, Artificial Sequence
  chemically synthesized
ggcaacagagaaaaatctgtta

SEQ ID NO: 102303 - DNA, 22 bp, Artificial Sequence
  chemically synthesized
ttaaagagagagagagaaaaga

SEQ ID NO: 102304 - DNA, 22 bp, Artificial Sequence
  chemically synthesized
aagagagagagagaaaagaaaa

SEQ ID NO: 102305 - DNA, 22 bp, Artificial Sequence
  chemically synthesized
ttttatttatattgttatggtg

SEQ ID NO: 102306 - DNA, 22 bp, Artificial Sequence
  chemically synthesized
tatttatattgttatggtgagg

SEQ ID NO: 102307 - DNA, 22 bp, Artificial Sequence
  chemically synthesized
atttatattgttatggtgagga

SEQ ID NO: 102308 - DNA, 22 bp, Artificial Sequence
  chemically synthesized
tttatattgttatggtgaggaa

SEQ ID NO: 102309 - DNA, 22 bp, Artificial Sequence
  chemically synthesized
atattgttatggtgaggaaatt

SEQ ID NO: 102310 - DNA, 22 bp, Artificial Sequence
  chemically synthesized
tattgttatggtgaggaaattg

SEQ ID NO: 102311 - DNA, 22 bp, Artificial Sequence
  chemically synthesized
ttatggtgaggaaattgagcct

SEQ ID NO: 102312 - DNA, 22 bp, Artificial Sequence
  chemically synthesized
tggtgaggaaattgagccttag

SEQ ID NO: 102313 - DNA, 22 bp, Artificial Sequence
  chemically synthesized
agccttagacaagttaagcaat

SEQ ID NO: 102314 - DNA, 22 bp, Artificial Sequence
  chemically synthesized
agacaagttaagcaattagcct

SEQ ID NO: 102315 - DNA, 22 bp, Artificial Sequence
  chemically synthesized
gacaagttaagcaattagccta

SEQ ID NO: 102316 - DNA, 22 bp, Artificial Sequence
  chemically synthesized
agcaattagcctaagatcacgc

SEQ ID NO: 102317 - DNA, 22 bp, Artificial Sequence
  chemically synthesized
gcctaagatcacgcaactaata

SEQ ID NO: 102318 - DNA, 22 bp, Artificial Sequence
  chemically synthesized
agatcacgcaactaatatgtgt

SEQ ID NO: 102319 - DNA, 22 bp, Artificial Sequence
  chemically synthesized
atatgtgtcataaaggaattca

SEQ ID NO: 102320 - DNA, 22 bp, Artificial Sequence
  chemically synthesized
aaacacaggtttatctaaccca

SEQ ID NO: 102321 - DNA, 22 bp, Artificial Sequence
  chemically synthesized
atctaacccaaaacccaagctc

SEQ ID NO: 102322 - DNA, 22 bp, Artificial Sequence
  chemically synthesized
tctaacccaaaacccaagctca

SEQ ID NO: 102323 - DNA, 22 bp, Artificial Sequence
  chemically synthesized
acccaaaacccaagctcatatt

SEQ ID NO: 102324 - DNA, 22 bp, Artificial Sequence
  chemically synthesized
atattctcaaccaatgtccatc

SEQ ID NO: 102325 - DNA, 22 bp, Artificial Sequence
  chemically synthesized
tcaaccaatgtccatcaaatgg

SEQ ID NO: 102326 - DNA, 22 bp, Artificial Sequence
  chemically synthesized
aaccaatgtccatcaaatggaa

SEQ ID NO: 102327 - DNA, 22 bp, Artificial Sequence
  chemically synthesized
aacttgcttcccgtatttgaat

SEQ ID NO: 102328 - DNA, 22 bp, Artificial Sequence
  chemically synthesized
gcttcccgtatttgaatccttg

SEQ ID NO: 102329 - DNA, 22 bp, Artificial Sequence
  chemically synthesized
cttcccgtatttgaatccttgg

SEQ ID NO: 102330 - DNA, 22 bp, Artificial Sequence
  chemically synthesized
cccgtatttgaatccttggctt

SEQ ID NO: 102331 - DNA, 22 bp, Artificial Sequence
  chemically synthesized
ccgtatttgaatccttggcttt

SEQ ID NO: 102332 - DNA, 22 bp, Artificial Sequence
  chemically synthesized
gaatccttggcttttcttacct

SEQ ID NO: 102333 - DNA, 22 bp, Artificial Sequence
  chemically synthesized
aatccttggcttttcttacctg

SEQ ID NO: 102334 - DNA, 22 bp, Artificial Sequence
  chemically synthesized
ggcttttcttacctgagccaca

SEQ ID NO: 102335 - DNA, 22 bp, Artificial Sequence
  chemically synthesized
gcttttcttacctgagccacag

SEQ ID NO: 102336 - DNA, 22 bp, Artificial Sequence
  chemically synthesized
ttcttacctgagccacagtttt

SEQ ID NO: 102337 - DNA, 22 bp, Artificial Sequence
  chemically synthesized
tcttacctgagccacagttttc

SEQ ID NO: 102338 - DNA, 22 bp, Artificial Sequence
  chemically synthesized
cttacctgagccacagttttct

SEQ ID NO: 102339 - DNA, 22 bp, Artificial Sequence
  chemically synthesized
ttacctgagccacagttttctc

SEQ ID NO: 102340 - DNA, 22 bp, Artificial Sequence
  chemically synthesized
acctgagccacagttttctctt

SEQ ID NO: 102341 - DNA, 22 bp, Artificial Sequence
  chemically synthesized
cctgagccacagttttctcttt

SEQ ID NO: 102342 - DNA, 22 bp, Artificial Sequence
  chemically synthesized
agccacagttttctctttgcgg

SEQ ID NO: 102343 - DNA, 22 bp, Artificial Sequence
  chemically synthesized
tctctttgcggtttctgagcat

SEQ ID NO: 102344 - DNA, 22 bp, Artificial Sequence
  chemically synthesized
ctctttgcggtttctgagcatg

SEQ ID NO: 102345 - DNA, 22 bp, Artificial Sequence
  chemically synthesized
tctttgcggtttctgagcatga

SEQ ID NO: 102346 - DNA, 22 bp, Artificial Sequence
  chemically synthesized
tttgcggtttctgagcatgacc

SEQ ID NO: 102347 - DNA, 22 bp, Artificial Sequence
  chemically synthesized
tgcggtttctgagcatgacctg

SEQ ID NO: 102348 - DNA, 22 bp, Artificial Sequence
  chemically synthesized
gcggtttctgagcatgacctga

SEQ ID NO: 102349 - DNA, 22 bp, Artificial Sequence
  chemically synthesized
cggtttctgagcatgacctgaa

SEQ ID NO: 102350 - DNA, 22 bp, Artificial Sequence
  chemically synthesized
ctgagcatgacctgaatattgg

SEQ ID NO: 102351 - DNA, 22 bp, Artificial Sequence
  chemically synthesized
tgagcatgacctgaatattggt

SEQ ID NO: 102352 - DNA, 22 bp, Artificial Sequence
  chemically synthesized
agcatgacctgaatattggttg

SEQ ID NO: 102353 - DNA, 22 bp, Artificial Sequence
  chemically synthesized
aatattggttgtttgctatatc

SEQ ID NO: 102354 - DNA, 22 bp, Artificial Sequence
  chemically synthesized
gttgtttgctatatcctcagta

SEQ ID NO: 102355 - DNA, 22 bp, Artificial Sequence
  chemically synthesized
tttgctatatcctcagtattta

SEQ ID NO: 102356 - DNA, 22 bp, Artificial Sequence
  chemically synthesized
gctatatcctcagtatttactc

SEQ ID NO: 102357 - DNA, 22 bp, Artificial Sequence
  chemically synthesized
ctatatcctcagtatttactct

SEQ ID NO: 102358 - DNA, 22 bp, Artificial Sequence
  chemically synthesized
tatcctcagtatttactcttaa

SEQ ID NO: 102359 - DNA, 22 bp, Artificial Sequence
  chemically synthesized
agtatttactcttaattctgat

SEQ ID NO: 102360 - DNA, 22 bp, Artificial Sequence
  chemically synthesized
actcttaattctgatgagagat

SEQ ID NO: 102361 - DNA, 22 bp, Artificial Sequence
  chemically synthesized
ctcttaattctgatgagagata

SEQ ID NO: 102362 - DNA, 22 bp, Artificial Sequence
  chemically synthesized
ttaattctgatgagagatatat

SEQ ID NO: 102363 - DNA, 22 bp, Artificial Sequence
  chemically synthesized
aattctgatgagagatatattt

SEQ ID NO: 102364 - DNA, 22 bp, Artificial Sequence
  chemically synthesized
attctgatgagagatatatttg

SEQ ID NO: 102365 - DNA, 22 bp, Artificial Sequence
  chemically synthesized
tgatgagagatatatttgttac

SEQ ID NO: 102366 - DNA, 22 bp, Artificial Sequence
  chemically synthesized
atgagagatatatttgttacac

SEQ ID NO: 102367 - DNA, 22 bp, Artificial Sequence
  chemically synthesized
gttacacaaacaactctcaagg

SEQ ID NO: 102368 - DNA, 22 bp, Artificial Sequence
  chemically synthesized
ttacacaaacaactctcaaggg

SEQ ID NO: 102369 - DNA, 22 bp, Artificial Sequence
  chemically synthesized
cacaaacaactctcaaggggtt

SEQ ID NO: 102370 - DNA, 22 bp, Artificial Sequence
  chemically synthesized
tcaaggggttattctagctcat

SEQ ID NO: 102371 - DNA, 22 bp, Artificial Sequence
  chemically synthesized
aaggggttattctagctcattt

SEQ ID NO: 102372 - DNA, 22 bp, Artificial Sequence
  chemically synthesized
ttctagctcatttccacatagg

SEQ ID NO: 102373 - DNA, 22 bp, Artificial Sequence
  chemically synthesized
tagctcatttccacataggata

SEQ ID NO: 102374 - DNA, 22 bp, Artificial Sequence
  chemically synthesized
gctcatttccacataggatatt

SEQ ID NO: 102375 - DNA, 22 bp, Artificial Sequence
  chemically synthesized
atttccacataggatatttggg

SEQ ID NO: 102376 - DNA, 22 bp, Artificial Sequence
  chemically synthesized
ccacataggatatttgggaata

SEQ ID NO: 102377 - DNA, 22 bp, Artificial Sequence
  chemically synthesized
cacataggatatttgggaatag

SEQ ID NO: 102378 - DNA, 22 bp, Artificial Sequence
  chemically synthesized
gggaatagtgtaccaaataatt

SEQ ID NO: 102379 - DNA, 22 bp, Artificial Sequence
  chemically synthesized
ggaatagtgtaccaaataattc

SEQ ID NO: 102380 - DNA, 22 bp, Artificial Sequence
  chemically synthesized
tcttttcctccccaacctggga

SEQ ID NO: 102381 - DNA, 22 bp, Artificial Sequence
  chemically synthesized
ttttcctccccaacctgggaaa

SEQ ID NO: 102382 - DNA, 22 bp, Artificial Sequence
  chemically synthesized
ttcctccccaacctgggaaaga

SEQ ID NO: 102383 - DNA, 22 bp, Artificial Sequence
  chemically synthesized
tcctccccaacctgggaaagat

SEQ ID NO: 102384 - DNA, 22 bp, Artificial Sequence
  chemically synthesized
cctccccaacctgggaaagatc

SEQ ID NO: 102385 - DNA, 22 bp, Artificial Sequence
  chemically synthesized
ctccccaacctgggaaagatct

SEQ ID NO: 102386 - DNA, 22 bp, Artificial Sequence
  chemically synthesized
cccaacctgggaaagatctggg

SEQ ID NO: 102387 - DNA, 22 bp, Artificial Sequence
  chemically synthesized
ggaaagatctgggccattgaaa

SEQ ID NO: 102388 - DNA, 22 bp, Artificial Sequence
  chemically synthesized
ggccattgaaactggtccccat

SEQ ID NO: 102389 - DNA, 22 bp, Artificial Sequence
  chemically synthesized
aaactggtccccatggccttta

SEQ ID NO: 102390 - DNA, 22 bp, Artificial Sequence
  chemically synthesized
gtccccatggcctttatttttt

SEQ ID NO: 102391 - DNA, 22 bp, Artificial Sequence
  chemically synthesized
tattttttctttggaaggagag

SEQ ID NO: 102392 - DNA, 22 bp, Artificial Sequence
  chemically synthesized
attttttctttggaaggagagt

SEQ ID NO: 102393 - DNA, 22 bp, Artificial Sequence
  chemically synthesized
ttttttctttggaaggagagtc

SEQ ID NO: 102394 - DNA, 22 bp, Artificial Sequence
  chemically synthesized
tttctttggaaggagagtctct

SEQ ID NO: 102395 - DNA, 22 bp, Artificial Sequence
  chemically synthesized
ttctttggaaggagagtctcta

SEQ ID NO: 102396 - DNA, 22 bp, Artificial Sequence
  chemically synthesized
tctttggaaggagagtctctaa

SEQ ID NO: 102397 - DNA, 22 bp, Artificial Sequence
  chemically synthesized
ctttggaaggagagtctctaag

SEQ ID NO: 102398 - DNA, 22 bp, Artificial Sequence
  chemically synthesized
tttggaaggagagtctctaaga

SEQ ID NO: 102399 - DNA, 22 bp, Artificial Sequence
  chemically synthesized
tggaaggagagtctctaagaga

SEQ ID NO: 102400 - DNA, 22 bp, Artificial Sequence
  chemically synthesized
ggaaggagagtctctaagagaa

SEQ ID NO: 102401 - DNA, 22 bp, Artificial Sequence
  chemically synthesized
gaaggagagtctctaagagaag

SEQ ID NO: 102402 - DNA, 22 bp, Artificial Sequence
  chemically synthesized
taagagaagttgtgtctctaac

SEQ ID NO: 102403 - DNA, 22 bp, Artificial Sequence
  chemically synthesized
agagaagttgtgtctctaacat

SEQ ID NO: 102404 - DNA, 22 bp, Artificial Sequence
  chemically synthesized
tgtctctaacatcagatgaggc

SEQ ID NO: 102405 - DNA, 22 bp, Artificial Sequence
  chemically synthesized
taacatcagatgaggcatgacc

SEQ ID NO: 102406 - DNA, 22 bp, Artificial Sequence
  chemically synthesized
acatcagatgaggcatgaccga

SEQ ID NO: 102407 - DNA, 22 bp, Artificial Sequence
  chemically synthesized
tcaagtgttccattggtcttag

SEQ ID NO: 102408 - DNA, 22 bp, Artificial Sequence
  chemically synthesized
aagtgttccattggtcttagag

SEQ ID NO: 102409 - DNA, 22 bp, Artificial Sequence
  chemically synthesized
cattggtcttagagtgggaaga

SEQ ID NO: 102410 - DNA, 22 bp, Artificial Sequence
  chemically synthesized
gtcttagagtgggaagaccagt

SEQ ID NO: 102411 - DNA, 22 bp, Artificial Sequence
  chemically synthesized
agagtgggaagaccagtcactt

SEQ ID NO: 102412 - DNA, 22 bp, Artificial Sequence
  chemically synthesized
gagtgggaagaccagtcacttt

SEQ ID NO: 102413 - DNA, 22 bp, Artificial Sequence
  chemically synthesized
tgtctttgtaaatgttaacatt

SEQ ID NO: 102414 - DNA, 22 bp, Artificial Sequence
  chemically synthesized
gtctttgtaaatgttaacattt

SEQ ID NO: 102415 - DNA, 22 bp, Artificial Sequence
  chemically synthesized
tctttgtaaatgttaacatttg

SEQ ID NO: 102416 - DNA, 22 bp, Artificial Sequence
  chemically synthesized
tgtaaatgttaacatttgaaga

SEQ ID NO: 102417 - DNA, 22 bp, Artificial Sequence
  chemically synthesized
gtaaatgttaacatttgaagaa

SEQ ID NO: 102418 - DNA, 22 bp, Artificial Sequence
  chemically synthesized
taaatgttaacatttgaagaac

SEQ ID NO: 102419 - DNA, 22 bp, Artificial Sequence
  chemically synthesized
acatttgaagaacattgcccct

SEQ ID NO: 102420 - DNA, 22 bp, Artificial Sequence
  chemically synthesized
gaagaacattgccccttttcaa

SEQ ID NO: 102421 - DNA, 22 bp, Artificial Sequence
  chemically synthesized
aagaacattgccccttttcaaa

SEQ ID NO: 102422 - DNA, 22 bp, Artificial Sequence
  chemically synthesized
ccccttttcaaactgtattata

SEQ ID NO: 102423 - DNA, 22 bp, Artificial Sequence
  chemically synthesized
ttcaaactgtattatattctct

SEQ ID NO: 102424 - DNA, 22 bp, Artificial Sequence
  chemically synthesized
tcaaactgtattatattctcta

SEQ ID NO: 102425 - DNA, 22 bp, Artificial Sequence
  chemically synthesized
caaactgtattatattctctaa

SEQ ID NO: 102426 - DNA, 22 bp, Artificial Sequence
  chemically synthesized
aaactgtattatattctctaat

SEQ ID NO: 102427 - DNA, 22 bp, Artificial Sequence
  chemically synthesized
tattatattctctaattcaacc

SEQ ID NO: 102428 - DNA, 22 bp, Artificial Sequence
  chemically synthesized
tattctctaattcaacccttta

SEQ ID NO: 102429 - DNA, 22 bp, Artificial Sequence
  chemically synthesized
tctaattcaaccctttacaaaa

SEQ ID NO: 102430 - DNA, 22 bp, Artificial Sequence
  chemically synthesized
taattcaaccctttacaaaatc

SEQ ID NO: 102431 - DNA, 22 bp, Artificial Sequence
  chemically synthesized
attcaaccctttacaaaatcct

SEQ ID NO: 102432 - DNA, 22 bp, Artificial Sequence
  chemically synthesized
aaccctttacaaaatccttgag

SEQ ID NO: 102433 - DNA, 22 bp, Artificial Sequence
  chemically synthesized
tacaaaatccttgagccaccac

SEQ ID NO: 102434 - DNA, 22 bp, Artificial Sequence
  chemically synthesized
acaaaatccttgagccaccacc

SEQ ID NO: 102435 - DNA, 22 bp, Artificial Sequence
  chemically synthesized
caaaatccttgagccaccacca

SEQ ID NO: 102436 - DNA, 22 bp, Artificial Sequence
  chemically synthesized
gagccaccaccaaaccttttcg

SEQ ID NO: 102437 - DNA, 22 bp, Artificial Sequence
  chemically synthesized
agccaccaccaaaccttttcgt

SEQ ID NO: 102438 - DNA, 22 bp, Artificial Sequence
  chemically synthesized
ttcgtcttgatgattattcatc

SEQ ID NO: 102439 - DNA, 22 bp, Artificial Sequence
  chemically synthesized
tcgtcttgatgattattcatca

SEQ ID NO: 102440 - DNA, 22 bp, Artificial Sequence
  chemically synthesized
cgtcttgatgattattcatcag

SEQ ID NO: 102441 - DNA, 22 bp, Artificial Sequence
  chemically synthesized
gtcttgatgattattcatcaga

SEQ ID NO: 102442 - DNA, 22 bp, Artificial Sequence
  chemically synthesized
gatgattattcatcagacattt

SEQ ID NO: 102443 - DNA, 22 bp, Artificial Sequence
  chemically synthesized
atgattattcatcagacattta

SEQ ID NO: 102444 - DNA, 22 bp, Artificial Sequence
  chemically synthesized
ttcatcagacatttatttattc

SEQ ID NO: 102445 - DNA, 22 bp, Artificial Sequence
  chemically synthesized
atcagacatttatttattcttt

SEQ ID NO: 102446 - DNA, 22 bp, Artificial Sequence
  chemically synthesized
atttattctttctattgattca

SEQ ID NO: 102447 - DNA, 22 bp, Artificial Sequence
  chemically synthesized
tttattctttctattgattcaa

SEQ ID NO: 102448 - DNA, 22 bp, Artificial Sequence
  chemically synthesized
attctttctattgattcaaaac

SEQ ID NO: 102449 - DNA, 22 bp, Artificial Sequence
  chemically synthesized
ttctttctattgattcaaaact

SEQ ID NO: 102450 - DNA, 22 bp, Artificial Sequence
  chemically synthesized
tttctattgattcaaaactcac

SEQ ID NO: 102451 - DNA, 22 bp, Artificial Sequence
  chemically synthesized
tctattgattcaaaactcacta

SEQ ID NO: 102452 - DNA, 22 bp, Artificial Sequence
  chemically synthesized
ctattgattcaaaactcactac

SEQ ID NO: 102453 - DNA, 22 bp, Artificial Sequence
  chemically synthesized
tattgattcaaaactcactacc

SEQ ID NO: 102454 - DNA, 22 bp, Artificial Sequence
  chemically synthesized
ttgattcaaaactcactaccct

SEQ ID NO: 102455 - DNA, 22 bp, Artificial Sequence
  chemically synthesized
attcaaaactcactaccctacc

SEQ ID NO: 102456 - DNA, 22 bp, Artificial Sequence
  chemically synthesized
aaaactcactaccctaccctga

SEQ ID NO: 102457 - DNA, 22 bp, Artificial Sequence
  chemically synthesized
actaccctaccctgagctatct

SEQ ID NO: 102458 - DNA, 22 bp, Artificial Sequence
  chemically synthesized
ccctaccctgagctatctcatt

SEQ ID NO: 102459 - DNA, 22 bp, Artificial Sequence
  chemically synthesized
ccctgagctatctcattcatat

SEQ ID NO: 102460 - DNA, 22 bp, Artificial Sequence
  chemically synthesized
agctatctcattcatatatatg

SEQ ID NO: 102461 - DNA, 22 bp, Artificial Sequence
  chemically synthesized
tctcattcatatatatgtgggt

SEQ ID NO: 102462 - DNA, 22 bp, Artificial Sequence
  chemically synthesized
attcatatatatgtgggtttca

SEQ ID NO: 102463 - DNA, 22 bp, Artificial Sequence
  chemically synthesized
atatatatgtgggtttcattta

SEQ ID NO: 102464 - DNA, 22 bp, Artificial Sequence
  chemically synthesized
catttaattatttagtatatgt

SEQ ID NO: 102465 - DNA, 22 bp, Artificial Sequence
  chemically synthesized
atttaattatttagtatatgta

SEQ ID NO: 102466 - DNA, 22 bp, Artificial Sequence
  chemically synthesized
aattatttagtatatgtatata

SEQ ID NO: 102467 - DNA, 22 bp, Artificial Sequence
  chemically synthesized
attatttagtatatgtatatat

SEQ ID NO: 102468 - DNA, 22 bp, Artificial Sequence
  chemically synthesized
tttagtatatgtatatatggta

SEQ ID NO: 102469 - DNA, 22 bp, Artificial Sequence
  chemically synthesized
agtatatgtatatatggtattt

SEQ ID NO: 102470 - DNA, 22 bp, Artificial Sequence
  chemically synthesized
gtatatgtatatatggtattta

SEQ ID NO: 102471 - DNA, 22 bp, Artificial Sequence
  chemically synthesized
actatcaatatatgtatgcata

SEQ ID NO: 102472 - DNA, 22 bp, Artificial Sequence
  chemically synthesized
ctatcaatatatgtatgcatag

SEQ ID NO: 102473 - DNA, 22 bp, Artificial Sequence
  chemically synthesized
tcaatatatgtatgcataggtg

SEQ ID NO: 102474 - DNA, 22 bp, Artificial Sequence
  chemically synthesized
acagacagagacagtgagagag

SEQ ID NO: 102475 - DNA, 22 bp, Artificial Sequence
  chemically synthesized
ctctgaaacatataatatctac

SEQ ID NO: 102476 - DNA, 22 bp, Artificial Sequence
  chemically synthesized
tctgaaacatataatatctact

SEQ ID NO: 102477 - DNA, 22 bp, Artificial Sequence
  chemically synthesized
tgaaacatataatatctactcc

SEQ ID NO: 102478 - DNA, 22 bp, Artificial Sequence
  chemically synthesized
aaacatataatatctactcctt

SEQ ID NO: 102479 - DNA, 22 bp, Artificial Sequence
  chemically synthesized
ctccttatatttaggtctgatc

SEQ ID NO: 102480 - DNA, 22 bp, Artificial Sequence
  chemically synthesized
cttatatttaggtctgatctcc

SEQ ID NO: 102481 - DNA, 22 bp, Artificial Sequence
  chemically synthesized
atatttaggtctgatctccaga

SEQ ID NO: 102482 - DNA, 22 bp, Artificial Sequence
  chemically synthesized
tatttaggtctgatctccagaa

SEQ ID NO: 102483 - DNA, 22 bp, Artificial Sequence
  chemically synthesized
aggtctgatctccagaataaaa

SEQ ID NO: 102484 - DNA, 22 bp, Artificial Sequence
  chemically synthesized
ggtctgatctccagaataaaat

SEQ ID NO: 102485 - DNA, 22 bp, Artificial Sequence
  chemically synthesized
atctccagaataaaataaccat

SEQ ID NO: 102486 - DNA, 22 bp, Artificial Sequence
  chemically synthesized
cagaataaaataaccatatatt

SEQ ID NO: 102487 - DNA, 22 bp, Artificial Sequence
  chemically synthesized
gccattatattcatacataatt

SEQ ID NO: 102488 - DNA, 22 bp, Artificial Sequence
  chemically synthesized
tattcatacataatttttttct

SEQ ID NO: 102489 - DNA, 22 bp, Artificial Sequence
  chemically synthesized
atacataatttttttctagatg

SEQ ID NO: 102490 - DNA, 22 bp, Artificial Sequence
  chemically synthesized
ttttctagatgtataaagatat

SEQ ID NO: 102491 - DNA, 22 bp, Artificial Sequence
  chemically synthesized
tttctagatgtataaagatatc

SEQ ID NO: 102492 - DNA, 22 bp, Artificial Sequence
  chemically synthesized
ttctagatgtataaagatatct

SEQ ID NO: 102493 - DNA, 22 bp, Artificial Sequence
  chemically synthesized
tctagatgtataaagatatctg

SEQ ID NO: 102494 - DNA, 22 bp, Artificial Sequence
  chemically synthesized
ctagatgtataaagatatctgc

SEQ ID NO: 102495 - DNA, 22 bp, Artificial Sequence
  chemically synthesized
tagatgtataaagatatctgca

SEQ ID NO: 102496 - DNA, 22 bp, Artificial Sequence
  chemically synthesized
gatgtataaagatatctgcatt

SEQ ID NO: 102497 - DNA, 22 bp, Artificial Sequence
  chemically synthesized
cattaaaaaccctaagacttct

SEQ ID NO: 102498 - DNA, 22 bp, Artificial Sequence
  chemically synthesized
aaaaccctaagacttctttcct

SEQ ID NO: 102499 - DNA, 22 bp, Artificial Sequence
  chemically synthesized
agacttctttcctgatgggtga

SEQ ID NO: 102500 - DNA, 22 bp, Artificial Sequence
  chemically synthesized
ctttcctgatgggtgaaccaat

SEQ ID NO: 102501 - DNA, 22 bp, Artificial Sequence
  chemically synthesized
tttcctgatgggtgaaccaata

SEQ ID NO: 102502 - DNA, 22 bp, Artificial Sequence
  chemically synthesized
tcctgatgggtgaaccaatatc

SEQ ID NO: 102503 - DNA, 22 bp, Artificial Sequence
  chemically synthesized
cctgatgggtgaaccaatatca

SEQ ID NO: 102504 - DNA, 22 bp, Artificial Sequence
  chemically synthesized
ctgatgggtgaaccaatatcaa

SEQ ID NO: 102505 - DNA, 22 bp, Artificial Sequence
  chemically synthesized
atgggtgaaccaatatcaacag

SEQ ID NO: 102506 - DNA, 22 bp, Artificial Sequence
  chemically synthesized
taaatgtttatcatgtaattat

SEQ ID NO: 102507 - DNA, 22 bp, Artificial Sequence
  chemically synthesized
aaatgtttatcatgtaattatt

SEQ ID NO: 102508 - DNA, 22 bp, Artificial Sequence
  chemically synthesized
aatgtttatcatgtaattattc

SEQ ID NO: 102509 - DNA, 22 bp, Artificial Sequence
  chemically synthesized
atcatgtaattattcctaatcc

SEQ ID NO: 102510 - DNA, 22 bp, Artificial Sequence
  chemically synthesized
tcatgtaattattcctaatcct

SEQ ID NO: 102511 - DNA, 22 bp, Artificial Sequence
  chemically synthesized
ttcctaatcctgatttatttcc

SEQ ID NO: 102512 - DNA, 22 bp, Artificial Sequence
  chemically synthesized
ctaatcctgatttatttcctat

SEQ ID NO: 102513 - DNA, 22 bp, Artificial Sequence
  chemically synthesized
atcctgatttatttcctatgat

SEQ ID NO: 102514 - DNA, 22 bp, Artificial Sequence
  chemically synthesized
atttatttcctatgatgctcca

SEQ ID NO: 102515 - DNA, 22 bp, Artificial Sequence
  chemically synthesized
atttcctatgatgctccacctt

SEQ ID NO: 102516 - DNA, 22 bp, Artificial Sequence
  chemically synthesized
tttcctatgatgctccacctta

SEQ ID NO: 102517 - DNA, 22 bp, Artificial Sequence
  chemically synthesized
cctatgatgctccaccttattg

SEQ ID NO: 102518 - DNA, 22 bp, Artificial Sequence
  chemically synthesized
ctatgatgctccaccttattga

SEQ ID NO: 102519 - DNA, 22 bp, Artificial Sequence
  chemically synthesized
tgatgctccaccttattgaaca

SEQ ID NO: 102520 - DNA, 22 bp, Artificial Sequence
  chemically synthesized
caccttattgaacataataatc

SEQ ID NO: 102521 - DNA, 22 bp, Artificial Sequence
  chemically synthesized
attgaacataataatccagatg

SEQ ID NO: 102522 - DNA, 22 bp, Artificial Sequence
  chemically synthesized
ttgaacataataatccagatgt

SEQ ID NO: 102523 - DNA, 22 bp, Artificial Sequence
  chemically synthesized
aacataataatccagatgttgt

SEQ ID NO: 102524 - DNA, 22 bp, Artificial Sequence
  chemically synthesized
tcatattagtcccattctgaaa

SEQ ID NO: 102525 - DNA, 22 bp, Artificial Sequence
  chemically synthesized
gtcccattctgaaatctctttt

SEQ ID NO: 102526 - DNA, 22 bp, Artificial Sequence
  chemically synthesized
tgaaatctcttttttcattgga

SEQ ID NO: 102527 - DNA, 22 bp, Artificial Sequence
  chemically synthesized
aaatctcttttttcattggatt

SEQ ID NO: 102528 - DNA, 22 bp, Artificial Sequence
  chemically synthesized
ttttttcattggattatgtgct

SEQ ID NO: 102529 - DNA, 22 bp, Artificial Sequence
  chemically synthesized
ttttcattggattatgtgctga

SEQ ID NO: 102530 - DNA, 22 bp, Artificial Sequence
  chemically synthesized
tttcattggattatgtgctgag

SEQ ID NO: 102531 - DNA, 22 bp, Artificial Sequence
  chemically synthesized
ttcattggattatgtgctgagt

SEQ ID NO: 102532 - DNA, 22 bp, Artificial Sequence
  chemically synthesized
tcattggattatgtgctgagtt

SEQ ID NO: 102533 - DNA, 22 bp, Artificial Sequence
  chemically synthesized
cattggattatgtgctgagttt

SEQ ID NO: 102534 - DNA, 22 bp, Artificial Sequence
  chemically synthesized
attggattatgtgctgagtttc

SEQ ID NO: 102535 - DNA, 22 bp, Artificial Sequence
  chemically synthesized
gattatgtgctgagtttctatt

SEQ ID NO: 102536 - DNA, 22 bp, Artificial Sequence
  chemically synthesized
tgtgctgagtttctatttaagt

SEQ ID NO: 102537 - DNA, 22 bp, Artificial Sequence
  chemically synthesized
agtttctatttaagtagtctaa

SEQ ID NO: 102538 - DNA, 22 bp, Artificial Sequence
  chemically synthesized
ctatttaagtagtctaagatcg

SEQ ID NO: 102539 - DNA, 22 bp, Artificial Sequence
  chemically synthesized
tatttaagtagtctaagatcgt

SEQ ID NO: 102540 - DNA, 22 bp, Artificial Sequence
  chemically synthesized
tttaagtagtctaagatcgtgc

SEQ ID NO: 102541 - DNA, 22 bp, Artificial Sequence
  chemically synthesized
aagtagtctaagatcgtgcaga

SEQ ID NO: 102542 - DNA, 22 bp, Artificial Sequence
  chemically synthesized
agtagtctaagatcgtgcagat

SEQ ID NO: 102543 - DNA, 22 bp, Artificial Sequence
  chemically synthesized
agatcgtgcagatacacaactc

SEQ ID NO: 102544 - DNA, 22 bp, Artificial Sequence
  chemically synthesized
taccctaaactcttatctcaaa

SEQ ID NO: 102545 - DNA, 22 bp, Artificial Sequence
  chemically synthesized
ccctaaactcttatctcaaaac

SEQ ID NO: 102546 - DNA, 22 bp, Artificial Sequence
  chemically synthesized
aactcttatctcaaaacatgtc

SEQ ID NO: 102547 - DNA, 22 bp, Artificial Sequence
  chemically synthesized
ttatctcaaaacatgtcaaatt

SEQ ID NO: 102548 - DNA, 22 bp, Artificial Sequence
  chemically synthesized
atctcaaaacatgtcaaattca

SEQ ID NO: 102549 - DNA, 22 bp, Artificial Sequence
  chemically synthesized
tctcaaaacatgtcaaattcag

SEQ ID NO: 102550 - DNA, 22 bp, Artificial Sequence
  chemically synthesized
aaaacatgtcaaattcagtctt

SEQ ID NO: 102551 - DNA, 22 bp, Artificial Sequence
  chemically synthesized
agtctttcagatttaaaatagt

SEQ ID NO: 102552 - DNA, 22 bp, Artificial Sequence
  chemically synthesized
tcagatttaaaatagtgataaa

SEQ ID NO: 102553 - DNA, 22 bp, Artificial Sequence
  chemically synthesized
cagatttaaaatagtgataaaa

SEQ ID NO: 102554 - DNA, 22 bp, Artificial Sequence
  chemically synthesized
agatttaaaatagtgataaaat

SEQ ID NO: 102555 - DNA, 22 bp, Artificial Sequence
  chemically synthesized
aaaatagtgataaaatgcatat

SEQ ID NO: 102556 - DNA, 22 bp, Artificial Sequence
  chemically synthesized
aaatagtgataaaatgcatatt

SEQ ID NO: 102557 - DNA, 22 bp, Artificial Sequence
  chemically synthesized
tacataatatatgtgacactcg

SEQ ID NO: 102558 - DNA, 22 bp, Artificial Sequence
  chemically synthesized
cataatatatgtgacactcgca

SEQ ID NO: 102559 - DNA, 22 bp, Artificial Sequence
  chemically synthesized
gcagcaagttactctatttact

SEQ ID NO: 102560 - DNA, 22 bp, Artificial Sequence
  chemically synthesized
ctctatttactatcacctgttt

SEQ ID NO: 102561 - DNA, 22 bp, Artificial Sequence
  chemically synthesized
tatttactatcacctgtttata

SEQ ID NO: 102562 - DNA, 22 bp, Artificial Sequence
  chemically synthesized
tttactatcacctgtttatact

SEQ ID NO: 102563 - DNA, 22 bp, Artificial Sequence
  chemically synthesized
actatcacctgtttatacttag

SEQ ID NO: 102564 - DNA, 22 bp, Artificial Sequence
  chemically synthesized
ctatcacctgtttatacttagg

SEQ ID NO: 102565 - DNA, 22 bp, Artificial Sequence
  chemically synthesized
tcacctgtttatacttagggga

SEQ ID NO: 102566 - DNA, 22 bp, Artificial Sequence
  chemically synthesized
tttatacttaggggaaaaaaac

SEQ ID NO: 102567 - DNA, 22 bp, Artificial Sequence
  chemically synthesized
atacttaggggaaaaaaaccta

SEQ ID NO: 102568 - DNA, 22 bp, Artificial Sequence
  chemically synthesized
tacttaggggaaaaaaacctaa

SEQ ID NO: 102569 - DNA, 22 bp, Artificial Sequence
  chemically synthesized
aggggaaaaaaacctaaatatc

SEQ ID NO: 102570 - DNA, 22 bp, Artificial Sequence
  chemically synthesized
ggggaaaaaaacctaaatatcc

SEQ ID NO: 102571 - DNA, 22 bp, Artificial Sequence
  chemically synthesized
aatatcctctcatatattcagg

SEQ ID NO: 102572 - DNA, 22 bp, Artificial Sequence
  chemically synthesized
tcatatattcaggtaagatttt

SEQ ID NO: 102573 - DNA, 22 bp, Artificial Sequence
  chemically synthesized
atatattcaggtaagattttgc

SEQ ID NO: 102574 - DNA, 22 bp, Artificial Sequence
  chemically synthesized
aggtaagattttgccaaaacgt

SEQ ID NO: 102575 - DNA, 22 bp, Artificial Sequence
  chemically synthesized
tgccaaaacgtgattttaggtc

SEQ ID NO: 102576 - DNA, 22 bp, Artificial Sequence
  chemically synthesized
gccaaaacgtgattttaggtca

SEQ ID NO: 102577 - DNA, 22 bp, Artificial Sequence
  chemically synthesized
ccaaaacgtgattttaggtcat

SEQ ID NO: 102578 - DNA, 22 bp, Artificial Sequence
  chemically synthesized
taggtcatacagcaataaatgc

SEQ ID NO: 102579 - DNA, 22 bp, Artificial Sequence
  chemically synthesized
aggtcatacagcaataaatgca

SEQ ID NO: 102580 - DNA, 22 bp, Artificial Sequence
  chemically synthesized
ggtcatacagcaataaatgcat

SEQ ID NO: 102581 - DNA, 22 bp, Artificial Sequence
  chemically synthesized
cagaattcattttgcagaacct

SEQ ID NO: 102582 - DNA, 22 bp, Artificial Sequence
  chemically synthesized
attttgcagaacctgttgattc

SEQ ID NO: 102583 - DNA, 22 bp, Artificial Sequence
  chemically synthesized
tgcagaacctgttgattctaga

SEQ ID NO: 102584 - DNA, 22 bp, Artificial Sequence
  chemically synthesized
gcagaacctgttgattctagac

SEQ ID NO: 102585 - DNA, 22 bp, Artificial Sequence
  chemically synthesized
cagaacctgttgattctagact

SEQ ID NO: 102586 - DNA, 22 bp, Artificial Sequence
  chemically synthesized
ttgattctagacttgtagctaa

SEQ ID NO: 102587 - DNA, 22 bp, Artificial Sequence
  chemically synthesized
attctagacttgtagctaagaa

SEQ ID NO: 102588 - DNA, 22 bp, Artificial Sequence
  chemically synthesized
tagacttgtagctaagaagtga

SEQ ID NO: 102589 - DNA, 22 bp, Artificial Sequence
  chemically synthesized
gacttgtagctaagaagtgacg

SEQ ID NO: 102590 - DNA, 22 bp, Artificial Sequence
  chemically synthesized
gtagctaagaagtgacggcttg

SEQ ID NO: 102591 - DNA, 22 bp, Artificial Sequence
  chemically synthesized
tagctaagaagtgacggcttgg

SEQ ID NO: 102592 - DNA, 22 bp, Artificial Sequence
  chemically synthesized
agaagtgacggcttggtaaata

SEQ ID NO: 102593 - DNA, 22 bp, Artificial Sequence
  chemically synthesized
ggtaaataaccatatcataaag

SEQ ID NO: 102594 - DNA, 22 bp, Artificial Sequence
  chemically synthesized
gtaaataaccatatcataaagt

SEQ ID NO: 102595 - DNA, 22 bp, Artificial Sequence
  chemically synthesized
tctttgtactcacagtaaaaca

SEQ ID NO: 102596 - DNA, 22 bp, Artificial Sequence
  chemically synthesized
tttgtactcacagtaaaacaaa

SEQ ID NO: 102597 - DNA, 22 bp, Artificial Sequence
  chemically synthesized
tgtactcacagtaaaacaaaac

SEQ ID NO: 102598 - DNA, 22 bp, Artificial Sequence
  chemically synthesized
gtactcacagtaaaacaaaact

SEQ ID NO: 102599 - DNA, 22 bp, Artificial Sequence
  chemically synthesized
tactcacagtaaaacaaaactt

SEQ ID NO: 102600 - DNA, 22 bp, Artificial Sequence
  chemically synthesized
acagtaaaacaaaacttctgaa

SEQ ID NO: 102601 - DNA, 22 bp, Artificial Sequence
  chemically synthesized
ctgaaagattttaagtgagtga

SEQ ID NO: 102602 - DNA, 22 bp, Artificial Sequence
  chemically synthesized
tgaaagattttaagtgagtgac

SEQ ID NO: 102603 - DNA, 22 bp, Artificial Sequence
  chemically synthesized
aaagattttaagtgagtgacat

SEQ ID NO: 102604 - DNA, 22 bp, Artificial Sequence
  chemically synthesized
taagtgagtgacattttcagtg

SEQ ID NO: 102605 - DNA, 22 bp, Artificial Sequence
  chemically synthesized
aagtgagtgacattttcagtgc

SEQ ID NO: 102606 - DNA, 22 bp, Artificial Sequence
  chemically synthesized
agtgagtgacattttcagtgct

SEQ ID NO: 102607 - DNA, 22 bp, Artificial Sequence
  chemically synthesized
tcagtgcttaaaatggagctta

SEQ ID NO: 102608 - DNA, 22 bp, Artificial Sequence
  chemically synthesized
cagtgcttaaaatggagcttaa

SEQ ID NO: 102609 - DNA, 22 bp, Artificial Sequence
  chemically synthesized
agtgcttaaaatggagcttaac

SEQ ID NO: 102610 - DNA, 22 bp, Artificial Sequence
  chemically synthesized
aaaatggagcttaacatatagt

SEQ ID NO: 102611 - DNA, 22 bp, Artificial Sequence
  chemically synthesized
aaatggagcttaacatatagtg

SEQ ID NO: 102612 - DNA, 22 bp, Artificial Sequence
  chemically synthesized
aacatatagtgggtgctcagta

SEQ ID NO: 102613 - DNA, 22 bp, Artificial Sequence
  chemically synthesized
acatatagtgggtgctcagtaa

SEQ ID NO: 102614 - DNA, 22 bp, Artificial Sequence
  chemically synthesized
agtaagtactagttaagcaaat

SEQ ID NO: 102615 - DNA, 22 bp, Artificial Sequence
  chemically synthesized
gttaagcaaatgaatgctattc

SEQ ID NO: 102616 - DNA, 22 bp, Artificial Sequence
  chemically synthesized
agcaaatgaatgctattcttgt

SEQ ID NO: 102617 - DNA, 22 bp, Artificial Sequence
  chemically synthesized
ttcttgtgatcaagccattggt

SEQ ID NO: 102618 - DNA, 22 bp, Artificial Sequence
  chemically synthesized
ttgtgatcaagccattggtttt

SEQ ID NO: 102619 - DNA, 22 bp, Artificial Sequence
  chemically synthesized
gtgatcaagccattggttttgt

SEQ ID NO: 102620 - DNA, 22 bp, Artificial Sequence
  chemically synthesized
tgatcaagccattggttttgta

SEQ ID NO: 102621 - DNA, 22 bp, Artificial Sequence
  chemically synthesized
gttttgtagccaaattgtagac

SEQ ID NO: 102622 - DNA, 22 bp, Artificial Sequence
  chemically synthesized
tgtagccaaattgtagaccttt

SEQ ID NO: 102623 - DNA, 22 bp, Artificial Sequence
  chemically synthesized
gtagccaaattgtagaccttta

SEQ ID NO: 102624 - DNA, 22 bp, Artificial Sequence
  chemically synthesized
tagccaaattgtagacctttac

SEQ ID NO: 102625 - DNA, 22 bp, Artificial Sequence
  chemically synthesized
tagacctttacaacctctacat

SEQ ID NO: 102626 - DNA, 22 bp, Artificial Sequence
  chemically synthesized
tacaacctctacatctgtttgt

SEQ ID NO: 102627 - DNA, 22 bp, Artificial Sequence
  chemically synthesized
acaacctctacatctgtttgta

SEQ ID NO: 102628 - DNA, 22 bp, Artificial Sequence
  chemically synthesized
caacctctacatctgtttgtaa

SEQ ID NO: 102629 - DNA, 22 bp, Artificial Sequence
  chemically synthesized
tacatctgtttgtaataagatt

SEQ ID NO: 102630 - DNA, 22 bp, Artificial Sequence
  chemically synthesized
catctgtttgtaataagattac

SEQ ID NO: 102631 - DNA, 22 bp, Artificial Sequence
  chemically synthesized
tttgtaataagattactagttc

SEQ ID NO: 102632 - DNA, 22 bp, Artificial Sequence
  chemically synthesized
gtaataagattactagttcaag

SEQ ID NO: 102633 - DNA, 22 bp, Artificial Sequence
  chemically synthesized
taataagattactagttcaagc

SEQ ID NO: 102634 - DNA, 22 bp, Artificial Sequence
  chemically synthesized
ctagttcaagcatgccaaacaa

SEQ ID NO: 102635 - DNA, 22 bp, Artificial Sequence
  chemically synthesized
gttcaagcatgccaaacaatgc

SEQ ID NO: 102636 - DNA, 22 bp, Artificial Sequence
  chemically synthesized
aagcatgccaaacaatgctatc

SEQ ID NO: 102637 - DNA, 22 bp, Artificial Sequence
  chemically synthesized
tctccttttctttattgtttag

SEQ ID NO: 102638 - DNA, 22 bp, Artificial Sequence
  chemically synthesized
cttttctttattgtttagtact

SEQ ID NO: 102639 - DNA, 22 bp, Artificial Sequence
  chemically synthesized
ttctttattgtttagtacttcg

SEQ ID NO: 102640 - DNA, 22 bp, Artificial Sequence
  chemically synthesized
tctttattgtttagtacttcga

SEQ ID NO: 102641 - DNA, 22 bp, Artificial Sequence
  chemically synthesized
ctttattgtttagtacttcgat

SEQ ID NO: 102642 - DNA, 22 bp, Artificial Sequence
  chemically synthesized
tttattgtttagtacttcgatg

SEQ ID NO: 102643 - DNA, 22 bp, Artificial Sequence
  chemically synthesized
tattgtttagtacttcgatgtc

SEQ ID NO: 102644 - DNA, 22 bp, Artificial Sequence
  chemically synthesized
attgtttagtacttcgatgtct

SEQ ID NO: 102645 - DNA, 22 bp, Artificial Sequence
  chemically synthesized
ttgtttagtacttcgatgtctc

SEQ ID NO: 102646 - DNA, 22 bp, Artificial Sequence
  chemically synthesized
tttagtacttcgatgtctctaa

SEQ ID NO: 102647 - DNA, 22 bp, Artificial Sequence
  chemically synthesized
agtacttcgatgtctctaattt

SEQ ID NO: 102648 - DNA, 22 bp, Artificial Sequence
  chemically synthesized
gtacttcgatgtctctaatttt

SEQ ID NO: 102649 - DNA, 22 bp, Artificial Sequence
  chemically synthesized
cgatgtctctaatttttacatc

SEQ ID NO: 102650 - DNA, 22 bp, Artificial Sequence
  chemically synthesized
gatgtctctaatttttacatca

SEQ ID NO: 102651 - DNA, 22 bp, Artificial Sequence
  chemically synthesized
taatttttacatcaatcatggt

SEQ ID NO: 102652 - DNA, 22 bp, Artificial Sequence
  chemically synthesized
atttttacatcaatcatggttc

SEQ ID NO: 102653 - DNA, 22 bp, Artificial Sequence
  chemically synthesized
ttacatcaatcatggttcagag

SEQ ID NO: 102654 - DNA, 22 bp, Artificial Sequence
  chemically synthesized
tacatcaatcatggttcagaga

SEQ ID NO: 102655 - DNA, 22 bp, Artificial Sequence
  chemically synthesized
acatcaatcatggttcagagaa

SEQ ID NO: 102656 - DNA, 22 bp, Artificial Sequence
  chemically synthesized
catcaatcatggttcagagaaa

SEQ ID NO: 102657 - DNA, 22 bp, Artificial Sequence
  chemically synthesized
agagaaaaatccataacaacat

SEQ ID NO: 102658 - DNA, 22 bp, Artificial Sequence
  chemically synthesized
tttgaagtttccttccttcctc

SEQ ID NO: 102659 - DNA, 22 bp, Artificial Sequence
  chemically synthesized
ttgaagtttccttccttcctcc

SEQ ID NO: 102660 - DNA, 22 bp, Artificial Sequence
  chemically synthesized
tgaagtttccttccttcctccc

SEQ ID NO: 102661 - DNA, 22 bp, Artificial Sequence
  chemically synthesized
gaagtttccttccttcctccct

SEQ ID NO: 102662 - DNA, 22 bp, Artificial Sequence
  chemically synthesized
aagtttccttccttcctccctc

SEQ ID NO: 102663 - DNA, 22 bp, Artificial Sequence
  chemically synthesized
ccttccttcctccctccctccc

SEQ ID NO: 102664 - DNA, 22 bp, Artificial Sequence
  chemically synthesized
cttccttcctccctccctccct

SEQ ID NO: 102665 - DNA, 22 bp, Artificial Sequence
  chemically synthesized
ccttcctccctccctccctccc

SEQ ID NO: 102666 - DNA, 22 bp, Artificial Sequence
  chemically synthesized
cttcctccctccctccctcccc

SEQ ID NO: 102667 - DNA, 22 bp, Artificial Sequence
  chemically synthesized
cctccctccctccctccccctt

SEQ ID NO: 102668 - DNA, 22 bp, Artificial Sequence
  chemically synthesized
ctccctccctccctcccccttc

SEQ ID NO: 102669 - DNA, 22 bp, Artificial Sequence
  chemically synthesized
cctccctccctcccccttcccc

SEQ ID NO: 102670 - DNA, 22 bp, Artificial Sequence
  chemically synthesized
cctccctcccccttcccccttc

SEQ ID NO: 102671 - DNA, 22 bp, Artificial Sequence
  chemically synthesized
cctcccccttcccccttccccc

SEQ ID NO: 102672 - DNA, 22 bp, Artificial Sequence
  chemically synthesized
ccccttcccccttcccccttcc

SEQ ID NO: 102673 - DNA, 22 bp, Artificial Sequence
  chemically synthesized
cccccttcccccttccctcctt

SEQ ID NO: 102674 - DNA, 22 bp, Artificial Sequence
  chemically synthesized
ccccttcccccttccctccttc

SEQ ID NO: 102675 - DNA, 22 bp, Artificial Sequence
  chemically synthesized
cccccttccctccttccctcct

SEQ ID NO: 102676 - DNA, 22 bp, Artificial Sequence
  chemically synthesized
ccccttccctccttccctcctt

SEQ ID NO: 102677 - DNA, 22 bp, Artificial Sequence
  chemically synthesized
ccctccttccctccttccctca

SEQ ID NO: 102678 - DNA, 22 bp, Artificial Sequence
  chemically synthesized
cctccttccctccttccctcat

SEQ ID NO: 102679 - DNA, 22 bp, Artificial Sequence
  chemically synthesized
cttccctccttccctcattcct

SEQ ID NO: 102680 - DNA, 22 bp, Artificial Sequence
  chemically synthesized
ccctccttccctcattccttcc

SEQ ID NO: 102681 - DNA, 22 bp, Artificial Sequence
  chemically synthesized
cctccttccctcattccttcct

SEQ ID NO: 102682 - DNA, 22 bp, Artificial Sequence
  chemically synthesized
cttccctcattccttcctttct

SEQ ID NO: 102683 - DNA, 22 bp, Artificial Sequence
  chemically synthesized
ccctcattccttcctttctttt

SEQ ID NO: 102684 - DNA, 22 bp, Artificial Sequence
  chemically synthesized
cctcattccttcctttcttttt

SEQ ID NO: 102685 - DNA, 22 bp, Artificial Sequence
  chemically synthesized
attccttcctttcttttttctt

SEQ ID NO: 102686 - DNA, 22 bp, Artificial Sequence
  chemically synthesized
cttcctttcttttttctttctt

SEQ ID NO: 102687 - DNA, 22 bp, Artificial Sequence
  chemically synthesized
cctttcttttttctttctttcc

SEQ ID NO: 102688 - DNA, 22 bp, Artificial Sequence
  chemically synthesized
ctttcttttttctttctttcct

SEQ ID NO: 102689 - DNA, 22 bp, Artificial Sequence
  chemically synthesized
tcttttttctttctttccttat

SEQ ID NO: 102690 - DNA, 22 bp, Artificial Sequence
  chemically synthesized
cttttttctttctttccttatt

SEQ ID NO: 102691 - DNA, 22 bp, Artificial Sequence
  chemically synthesized
ttttttctttctttccttattt

SEQ ID NO: 102692 - DNA, 22 bp, Artificial Sequence
  chemically synthesized
ttttctttctttccttatttct

SEQ ID NO: 102693 - DNA, 22 bp, Artificial Sequence
  chemically synthesized
tttctttctttccttatttctc

SEQ ID NO: 102694 - DNA, 22 bp, Artificial Sequence
  chemically synthesized
ttctttctttccttatttctct

SEQ ID NO: 102695 - DNA, 22 bp, Artificial Sequence
  chemically synthesized
tctttctttccttatttctctc

SEQ ID NO: 102696 - DNA, 22 bp, Artificial Sequence
  chemically synthesized
ctttctttccttatttctctct

SEQ ID NO: 102697 - DNA, 22 bp, Artificial Sequence
  chemically synthesized
tttctttccttatttctctctc

SEQ ID NO: 102698 - DNA, 22 bp, Artificial Sequence
  chemically synthesized
tctttccttatttctctctctc

SEQ ID NO: 102699 - DNA, 22 bp, Artificial Sequence
  chemically synthesized
ctttccttatttctctctctct

SEQ ID NO: 102700 - DNA, 22 bp, Artificial Sequence
  chemically synthesized
tttccttatttctctctctctt

SEQ ID NO: 102701 - DNA, 22 bp, Artificial Sequence
  chemically synthesized
tccttatttctctctctctttt

SEQ ID NO: 102702 - DNA, 22 bp, Artificial Sequence
  chemically synthesized
ccttatttctctctctcttttt

SEQ ID NO: 102703 - DNA, 22 bp, Artificial Sequence
  chemically synthesized
cttatttctctctctctttttc

SEQ ID NO: 102704 - DNA, 22 bp, Artificial Sequence
  chemically synthesized
atttctctctctctttttcttc

SEQ ID NO: 102705 - DNA, 22 bp, Artificial Sequence
  chemically synthesized
tttctctctctctttttcttcc

SEQ ID NO: 102706 - DNA, 22 bp, Artificial Sequence
  chemically synthesized
ctctctctctttttcttccttc

SEQ ID NO: 102707 - DNA, 22 bp, Artificial Sequence
  chemically synthesized
tctctctctttttcttccttcc

SEQ ID NO: 102708 - DNA, 22 bp, Artificial Sequence
  chemically synthesized
tctctctttttcttccttcctt

SEQ ID NO: 102709 - DNA, 22 bp, Artificial Sequence
  chemically synthesized
tctctttttcttccttccttcc

SEQ ID NO: 102710 - DNA, 22 bp, Artificial Sequence
  chemically synthesized
tctttttcttccttccttcctt

SEQ ID NO: 102711 - DNA, 22 bp, Artificial Sequence
  chemically synthesized
tttttcttccttccttcctttc

SEQ ID NO: 102712 - DNA, 22 bp, Artificial Sequence
  chemically synthesized
tttcttccttccttcctttctt

SEQ ID NO: 102713 - DNA, 22 bp, Artificial Sequence
  chemically synthesized
ttcttccttccttcctttcttt

SEQ ID NO: 102714 - DNA, 22 bp, Artificial Sequence
  chemically synthesized
tcttccttccttcctttctttc

SEQ ID NO: 102715 - DNA, 22 bp, Artificial Sequence
  chemically synthesized
cttccttccttcctttctttct

SEQ ID NO: 102716 - DNA, 22 bp, Artificial Sequence
  chemically synthesized
ttccttccttcctttctttctc

SEQ ID NO: 102717 - DNA, 22 bp, Artificial Sequence
  chemically synthesized
ccttccttcctttctttctccc

SEQ ID NO: 102718 - DNA, 22 bp, Artificial Sequence
  chemically synthesized
cttccttcctttctttctccct

SEQ ID NO: 102719 - DNA, 22 bp, Artificial Sequence
  chemically synthesized
ccttcctttctttctccctttc

SEQ ID NO: 102720 - DNA, 22 bp, Artificial Sequence
  chemically synthesized
cttcctttctttctccctttcc

SEQ ID NO: 102721 - DNA, 22 bp, Artificial Sequence
  chemically synthesized
cctttctttctccctttccttt

SEQ ID NO: 102722 - DNA, 22 bp, Artificial Sequence
  chemically synthesized
ctttctttctccctttcctttc

SEQ ID NO: 102723 - DNA, 22 bp, Artificial Sequence
  chemically synthesized
tctttctccctttcctttcctt

SEQ ID NO: 102724 - DNA, 22 bp, Artificial Sequence
  chemically synthesized
ctttctccctttcctttccttt

SEQ ID NO: 102725 - DNA, 22 bp, Artificial Sequence
  chemically synthesized
tttctccctttcctttcctttc

SEQ ID NO: 102726 - DNA, 22 bp, Artificial Sequence
  chemically synthesized
tctccctttcctttcctttcct

SEQ ID NO: 102727 - DNA, 22 bp, Artificial Sequence
  chemically synthesized
ctccctttcctttcctttcctt

SEQ ID NO: 102728 - DNA, 22 bp, Artificial Sequence
  chemically synthesized
tccctttcctttcctttccttt

SEQ ID NO: 102729 - DNA, 22 bp, Artificial Sequence
  chemically synthesized
cctttcctttcctttcctttta

SEQ ID NO: 102730 - DNA, 22 bp, Artificial Sequence
  chemically synthesized
tcctttcctttccttttattct

SEQ ID NO: 102731 - DNA, 22 bp, Artificial Sequence
  chemically synthesized
cctttcctttccttttattctc

SEQ ID NO: 102732 - DNA, 22 bp, Artificial Sequence
  chemically synthesized
ctttcctttccttttattctct

SEQ ID NO: 102733 - DNA, 22 bp, Artificial Sequence
  chemically synthesized
tcctttccttttattctctttt

SEQ ID NO: 102734 - DNA, 22 bp, Artificial Sequence
  chemically synthesized
cctttccttttattctcttttc

SEQ ID NO: 102735 - DNA, 22 bp, Artificial Sequence
  chemically synthesized
ctttccttttattctcttttct

SEQ ID NO: 102736 - DNA, 22 bp, Artificial Sequence
  chemically synthesized
tccttttattctcttttctttt

SEQ ID NO: 102737 - DNA, 22 bp, Artificial Sequence
  chemically synthesized
ccttttattctcttttcttttc

SEQ ID NO: 102738 - DNA, 22 bp, Artificial Sequence
  chemically synthesized
cttttattctcttttcttttct

SEQ ID NO: 102739 - DNA, 22 bp, Artificial Sequence
  chemically synthesized
ttattctcttttcttttctttc

SEQ ID NO: 102740 - DNA, 22 bp, Artificial Sequence
  chemically synthesized
tattctcttttcttttctttcc

SEQ ID NO: 102741 - DNA, 22 bp, Artificial Sequence
  chemically synthesized
attctcttttcttttctttcct

SEQ ID NO: 102742 - DNA, 22 bp, Artificial Sequence
  chemically synthesized
ttctcttttcttttctttcctc

SEQ ID NO: 102743 - DNA, 22 bp, Artificial Sequence
  chemically synthesized
tcttttcttttctttcctctct

SEQ ID NO: 102744 - DNA, 22 bp, Artificial Sequence
  chemically synthesized
ttttcttttctttcctctcttt

SEQ ID NO: 102745 - DNA, 22 bp, Artificial Sequence
  chemically synthesized
ttcttttctttcctctcttttg

SEQ ID NO: 102746 - DNA, 22 bp, Artificial Sequence
  chemically synthesized
tcttttctttcctctcttttga

SEQ ID NO: 102747 - DNA, 22 bp, Artificial Sequence
  chemically synthesized
cttttctttcctctcttttgag

SEQ ID NO: 102748 - DNA, 22 bp, Artificial Sequence
  chemically synthesized
ttttctttcctctcttttgaga

SEQ ID NO: 102749 - DNA, 22 bp, Artificial Sequence
  chemically synthesized
ttctttcctctcttttgagaca

SEQ ID NO: 102750 - DNA, 22 bp, Artificial Sequence
  chemically synthesized
tctttcctctcttttgagacag

SEQ ID NO: 102751 - DNA, 22 bp, Artificial Sequence
  chemically synthesized
ctttcctctcttttgagacagt

SEQ ID NO: 102752 - DNA, 22 bp, Artificial Sequence
  chemically synthesized
tttcctctcttttgagacagtg

SEQ ID NO: 102753 - DNA, 22 bp, Artificial Sequence
  chemically synthesized
tcctctcttttgagacagtgtc

SEQ ID NO: 102754 - DNA, 22 bp, Artificial Sequence
  chemically synthesized
cctctcttttgagacagtgtct

SEQ ID NO: 102755 - DNA, 22 bp, Artificial Sequence
  chemically synthesized
ctctcttttgagacagtgtctt

SEQ ID NO: 102756 - DNA, 22 bp, Artificial Sequence
  chemically synthesized
tcttttgagacagtgtcttgct

SEQ ID NO: 102757 - DNA, 22 bp, Artificial Sequence
  chemically synthesized
ttttgagacagtgtcttgctct

SEQ ID NO: 102758 - DNA, 22 bp, Artificial Sequence
  chemically synthesized
ttgagacagtgtcttgctctgt

SEQ ID NO: 102759 - DNA, 22 bp, Artificial Sequence
  chemically synthesized
tgagacagtgtcttgctctgtc

SEQ ID NO: 102760 - DNA, 22 bp, Artificial Sequence
  chemically synthesized
gagacagtgtcttgctctgtca

SEQ ID NO: 102761 - DNA, 22 bp, Artificial Sequence
  chemically synthesized
agacagtgtcttgctctgtcac

SEQ ID NO: 102762 - DNA, 22 bp, Artificial Sequence
  chemically synthesized
gctctgtcacccaggagggagt

SEQ ID NO: 102763 - DNA, 22 bp, Artificial Sequence
  chemically synthesized
ctctgtcacccaggagggagtg

SEQ ID NO: 102764 - DNA, 22 bp, Artificial Sequence
  chemically synthesized
tgtcacccaggagggagtgcag

SEQ ID NO: 102765 - DNA, 22 bp, Artificial Sequence
  chemically synthesized
tcacccaggagggagtgcagtg

SEQ ID NO: 102766 - DNA, 22 bp, Artificial Sequence
  chemically synthesized
actgcagcctcaagcttttagg

SEQ ID NO: 102767 - DNA, 22 bp, Artificial Sequence
  chemically synthesized
ctgcagcctcaagcttttaggc

SEQ ID NO: 102768 - DNA, 22 bp, Artificial Sequence
  chemically synthesized
cagcctcaagcttttaggctta

SEQ ID NO: 102769 - DNA, 22 bp, Artificial Sequence
  chemically synthesized
aagcttttaggcttaagtgatt

SEQ ID NO: 102770 - DNA, 22 bp, Artificial Sequence
  chemically synthesized
ttaggcttaagtgatttttaca

SEQ ID NO: 102771 - DNA, 22 bp, Artificial Sequence
  chemically synthesized
taggcttaagtgatttttacac

SEQ ID NO: 102772 - DNA, 22 bp, Artificial Sequence
  chemically synthesized
aggcttaagtgatttttacacc

SEQ ID NO: 102773 - DNA, 22 bp, Artificial Sequence
  chemically synthesized
ggcttaagtgatttttacacct

SEQ ID NO: 102774 - DNA, 22 bp, Artificial Sequence
  chemically synthesized
aagtgatttttacacctcagcc

SEQ ID NO: 102775 - DNA, 22 bp, Artificial Sequence
  chemically synthesized
agtgatttttacacctcagcct

SEQ ID NO: 102776 - DNA, 22 bp, Artificial Sequence
  chemically synthesized
ttacacctcagcctcccaaata

SEQ ID NO: 102777 - DNA, 22 bp, Artificial Sequence
  chemically synthesized
tacacctcagcctcccaaatag

SEQ ID NO: 102778 - DNA, 22 bp, Artificial Sequence
  chemically synthesized
acacctcagcctcccaaatagc

SEQ ID NO: 102779 - DNA, 22 bp, Artificial Sequence
  chemically synthesized
cacctcagcctcccaaatagct

SEQ ID NO: 102780 - DNA, 22 bp, Artificial Sequence
  chemically synthesized
agcctcccaaatagctgtgacc

SEQ ID NO: 102781 - DNA, 22 bp, Artificial Sequence
  chemically synthesized
ccaaatagctgtgaccacatga

SEQ ID NO: 102782 - DNA, 22 bp, Artificial Sequence
  chemically synthesized
tgaccacatgagaagagacatt

SEQ ID NO: 102783 - DNA, 22 bp, Artificial Sequence
  chemically synthesized
atgtgtttttttccttcttagt

SEQ ID NO: 102784 - DNA, 22 bp, Artificial Sequence
  chemically synthesized
tgtgtttttttccttcttagta

SEQ ID NO: 102785 - DNA, 22 bp, Artificial Sequence
  chemically synthesized
ttttccttcttagtactttggc

SEQ ID NO: 102786 - DNA, 22 bp, Artificial Sequence
  chemically synthesized
tttccttcttagtactttggct

SEQ ID NO: 102787 - DNA, 22 bp, Artificial Sequence
  chemically synthesized
ttccttcttagtactttggctg

SEQ ID NO: 102788 - DNA, 22 bp, Artificial Sequence
  chemically synthesized
tccttcttagtactttggctgc

SEQ ID NO: 102789 - DNA, 22 bp, Artificial Sequence
  chemically synthesized
ccttcttagtactttggctgca

SEQ ID NO: 102790 - DNA, 22 bp, Artificial Sequence
  chemically synthesized
cttcttagtactttggctgcaa

SEQ ID NO: 102791 - DNA, 22 bp, Artificial Sequence
  chemically synthesized
cttagtactttggctgcaagtg

SEQ ID NO: 102792 - DNA, 22 bp, Artificial Sequence
  chemically synthesized
ttagtactttggctgcaagtga

SEQ ID NO: 102793 - DNA, 22 bp, Artificial Sequence
  chemically synthesized
agtactttggctgcaagtgagt

SEQ ID NO: 102794 - DNA, 22 bp, Artificial Sequence
  chemically synthesized
gtactttggctgcaagtgagtc

SEQ ID NO: 102795 - DNA, 22 bp, Artificial Sequence
  chemically synthesized
tggctgcaagtgagtctcaagg

SEQ ID NO: 102796 - DNA, 22 bp, Artificial Sequence
  chemically synthesized
ggctgcaagtgagtctcaaggt

SEQ ID NO: 102797 - DNA, 22 bp, Artificial Sequence
  chemically synthesized
gctgcaagtgagtctcaaggta

SEQ ID NO: 102798 - DNA, 22 bp, Artificial Sequence
  chemically synthesized
caagtgagtctcaaggtaagat

SEQ ID NO: 102799 - DNA, 22 bp, Artificial Sequence
  chemically synthesized
aaggtaagatgttttaaccact

SEQ ID NO: 102800 - DNA, 22 bp, Artificial Sequence
  chemically synthesized
taaccacttatggaacttatat

SEQ ID NO: 102801 - DNA, 22 bp, Artificial Sequence
  chemically synthesized
aaccacttatggaacttatatt

SEQ ID NO: 102802 - DNA, 22 bp, Artificial Sequence
  chemically synthesized
accacttatggaacttatattc

SEQ ID NO: 102803 - DNA, 22 bp, Artificial Sequence
  chemically synthesized
atggaacttatattctcccatt

SEQ ID NO: 102804 - DNA, 22 bp, Artificial Sequence
  chemically synthesized
tggaacttatattctcccattc

SEQ ID NO: 102805 - DNA, 22 bp, Artificial Sequence
  chemically synthesized
atattctcccattccaatgaaa

SEQ ID NO: 102806 - DNA, 22 bp, Artificial Sequence
  chemically synthesized
tattctcccattccaatgaaaa

SEQ ID NO: 102807 - DNA, 22 bp, Artificial Sequence
  chemically synthesized
tcccattccaatgaaaagacta

SEQ ID NO: 102808 - DNA, 22 bp, Artificial Sequence
  chemically synthesized
ccattccaatgaaaagactact

SEQ ID NO: 102809 - DNA, 22 bp, Artificial Sequence
  chemically synthesized
caatgaaaagactactttgaaa

SEQ ID NO: 102810 - DNA, 22 bp, Artificial Sequence
  chemically synthesized
ctttgaaaatgtttttgttgat

SEQ ID NO: 102811 - DNA, 22 bp, Artificial Sequence
  chemically synthesized
tgaaaatgtttttgttgatgtc

SEQ ID NO: 102812 - DNA, 22 bp, Artificial Sequence
  chemically synthesized
gaaaatgtttttgttgatgtct

SEQ ID NO: 102813 - DNA, 22 bp, Artificial Sequence
  chemically synthesized
aaaatgtttttgttgatgtcta

SEQ ID NO: 102814 - DNA, 22 bp, Artificial Sequence
  chemically synthesized
ttgttgatgtctaaatacacca

SEQ ID NO: 102815 - DNA, 22 bp, Artificial Sequence
  chemically synthesized
tgttgatgtctaaatacaccaa

SEQ ID NO: 102816 - DNA, 22 bp, Artificial Sequence
  chemically synthesized
gttgatgtctaaatacaccaag

SEQ ID NO: 102817 - DNA, 22 bp, Artificial Sequence
  chemically synthesized
ttgatgtctaaatacaccaagt

SEQ ID NO: 102818 - DNA, 22 bp, Artificial Sequence
  chemically synthesized
atgtctaaatacaccaagtcta

SEQ ID NO: 102819 - DNA, 22 bp, Artificial Sequence
  chemically synthesized
aatacaccaagtctacaatttc

SEQ ID NO: 102820 - DNA, 22 bp, Artificial Sequence
  chemically synthesized
caatttcctgtgatctatctat

SEQ ID NO: 102821 - DNA, 22 bp, Artificial Sequence
  chemically synthesized
cctgtgatctatctatactact

SEQ ID NO: 102822 - DNA, 22 bp, Artificial Sequence
  chemically synthesized
ctgtgatctatctatactacta

SEQ ID NO: 102823 - DNA, 22 bp, Artificial Sequence
  chemically synthesized
tgatctatctatactactaaat

SEQ ID NO: 102824 - DNA, 22 bp, Artificial Sequence
  chemically synthesized
tctatactactaaatagctaga

SEQ ID NO: 102825 - DNA, 22 bp, Artificial Sequence
  chemically synthesized
tactactaaatagctagaccaa

SEQ ID NO: 102826 - DNA, 22 bp, Artificial Sequence
  chemically synthesized
ctaaatagctagaccaatacat

SEQ ID NO: 102827 - DNA, 22 bp, Artificial Sequence
  chemically synthesized
aatagctagaccaatacatgaa

SEQ ID NO: 102828 - DNA, 22 bp, Artificial Sequence
  chemically synthesized
gaccaatacatgaaaagaaact

SEQ ID NO: 102829 - DNA, 22 bp, Artificial Sequence
  chemically synthesized
ttattctcaataaagaactgta

SEQ ID NO: 102830 - DNA, 22 bp, Artificial Sequence
  chemically synthesized
attctcaataaagaactgtacc

SEQ ID NO: 102831 - DNA, 22 bp, Artificial Sequence
  chemically synthesized
ttctcaataaagaactgtaccc

SEQ ID NO: 102832 - DNA, 22 bp, Artificial Sequence
  chemically synthesized
tcaataaagaactgtaccccaa

SEQ ID NO: 102833 - DNA, 22 bp, Artificial Sequence
  chemically synthesized
aataaagaactgtaccccaaca

SEQ ID NO: 102834 - DNA, 22 bp, Artificial Sequence
  chemically synthesized
taccccaacaataatatatcag

SEQ ID NO: 102835 - DNA, 22 bp, Artificial Sequence
  chemically synthesized
tatgtcttttttatcttctttg

SEQ ID NO: 102836 - DNA, 22 bp, Artificial Sequence
  chemically synthesized
ttttatcttctttgtgtcttat

SEQ ID NO: 102837 - DNA, 22 bp, Artificial Sequence
  chemically synthesized
tttatcttctttgtgtcttatc

SEQ ID NO: 102838 - DNA, 22 bp, Artificial Sequence
  chemically synthesized
ttatcttctttgtgtcttatca

SEQ ID NO: 102839 - DNA, 22 bp, Artificial Sequence
  chemically synthesized
tatcttctttgtgtcttatcag

SEQ ID NO: 102840 - DNA, 22 bp, Artificial Sequence
  chemically synthesized
atcttctttgtgtcttatcagt

SEQ ID NO: 102841 - DNA, 22 bp, Artificial Sequence
  chemically synthesized
tcttctttgtgtcttatcagtt

SEQ ID NO: 102842 - DNA, 22 bp, Artificial Sequence
  chemically synthesized
ctttgtgtcttatcagttatgt

SEQ ID NO: 102843 - DNA, 22 bp, Artificial Sequence
  chemically synthesized
tttgtgtcttatcagttatgtt

SEQ ID NO: 102844 - DNA, 22 bp, Artificial Sequence
  chemically synthesized
tgtgtcttatcagttatgttac

SEQ ID NO: 102845 - DNA, 22 bp, Artificial Sequence
  chemically synthesized
gtgtcttatcagttatgttacc

SEQ ID NO: 102846 - DNA, 22 bp, Artificial Sequence
  chemically synthesized
tgtcttatcagttatgttacca

SEQ ID NO: 102847 - DNA, 22 bp, Artificial Sequence
  chemically synthesized
atcagttatgttaccatatagg

SEQ ID NO: 102848 - DNA, 22 bp, Artificial Sequence
  chemically synthesized
tcagttatgttaccatatagga

SEQ ID NO: 102849 - DNA, 22 bp, Artificial Sequence
  chemically synthesized
tgttaccatataggaagagaaa

SEQ ID NO: 102850 - DNA, 22 bp, Artificial Sequence
  chemically synthesized
ccatataggaagagaaagaaaa

SEQ ID NO: 102851 - DNA, 22 bp, Artificial Sequence
  chemically synthesized
taagtgaaatcactgtgtacca

SEQ ID NO: 102852 - DNA, 22 bp, Artificial Sequence
  chemically synthesized
tgtaccatctcacatctatgca

SEQ ID NO: 102853 - DNA, 22 bp, Artificial Sequence
  chemically synthesized
acatctatgcaaggcaaatagg

SEQ ID NO: 102854 - DNA, 22 bp, Artificial Sequence
  chemically synthesized
tgcaaggcaaataggactaata

SEQ ID NO: 102855 - DNA, 22 bp, Artificial Sequence
  chemically synthesized
atagtacagggacaaggctgaa

SEQ ID NO: 102856 - DNA, 22 bp, Artificial Sequence
  chemically synthesized
aaaggagacattttaaggttga

SEQ ID NO: 102857 - DNA, 22 bp, Artificial Sequence
  chemically synthesized
taaggttgaaggtatgcagtaa

SEQ ID NO: 102858 - DNA, 22 bp, Artificial Sequence
  chemically synthesized
aaggttgaaggtatgcagtaaa

SEQ ID NO: 102859 - DNA, 22 bp, Artificial Sequence
  chemically synthesized
aggttgaaggtatgcagtaaaa

SEQ ID NO: 102860 - DNA, 22 bp, Artificial Sequence
  chemically synthesized
aaggtatgcagtaaaacttgtt

SEQ ID NO: 102861 - DNA, 22 bp, Artificial Sequence
  chemically synthesized
gttttctggagattacgttgaa

SEQ ID NO: 102862 - DNA, 22 bp, Artificial Sequence
  chemically synthesized
ttttctggagattacgttgaaa

SEQ ID NO: 102863 - DNA, 22 bp, Artificial Sequence
  chemically synthesized
tctggagattacgttgaaagaa

SEQ ID NO: 102864 - DNA, 22 bp, Artificial Sequence
  chemically synthesized
ctggagattacgttgaaagaag

SEQ ID NO: 102865 - DNA, 22 bp, Artificial Sequence
  chemically synthesized
tggagattacgttgaaagaagt

SEQ ID NO: 102866 - DNA, 22 bp, Artificial Sequence
  chemically synthesized
gagattacgttgaaagaagtta

SEQ ID NO: 102867 - DNA, 22 bp, Artificial Sequence
  chemically synthesized
cgttgaaagaagttacagtcag

SEQ ID NO: 102868 - DNA, 22 bp, Artificial Sequence
  chemically synthesized
aaagaagttacagtcagtcaat

SEQ ID NO: 102869 - DNA, 22 bp, Artificial Sequence
  chemically synthesized
cagtcagtcaatctaatgaggt

SEQ ID NO: 102870 - DNA, 22 bp, Artificial Sequence
  chemically synthesized
atgaggttgtagaagatgaaac

SEQ ID NO: 102871 - DNA, 22 bp, Artificial Sequence
  chemically synthesized
tagaagatgaaacaactaagct

SEQ ID NO: 102872 - DNA, 22 bp, Artificial Sequence
  chemically synthesized
agctggtgctcctggtaatgac

SEQ ID NO: 102873 - DNA, 22 bp, Artificial Sequence
  chemically synthesized
gtgctcctggtaatgacttgat

SEQ ID NO: 102874 - DNA, 22 bp, Artificial Sequence
  chemically synthesized
ctggtaatgacttgatacctgc

SEQ ID NO: 102875 - DNA, 22 bp, Artificial Sequence
  chemically synthesized
gtaatgacttgatacctgcgaa

SEQ ID NO: 102876 - DNA, 22 bp, Artificial Sequence
  chemically synthesized
gatacctgcgaagtgtctaaat

SEQ ID NO: 102877 - DNA, 22 bp, Artificial Sequence
  chemically synthesized
atacctgcgaagtgtctaaata

SEQ ID NO: 102878 - DNA, 22 bp, Artificial Sequence
  chemically synthesized
cgaagtgtctaaatatgtatag

SEQ ID NO: 102879 - DNA, 22 bp, Artificial Sequence
  chemically synthesized
aatatgtatagaggagttgata

SEQ ID NO: 102880 - DNA, 22 bp, Artificial Sequence
  chemically synthesized
ataatatagaccaattgcactt

SEQ ID NO: 102881 - DNA, 22 bp, Artificial Sequence
  chemically synthesized
cactttgggcccctgctgagta

SEQ ID NO: 102882 - DNA, 22 bp, Artificial Sequence
  chemically synthesized
tgggcccctgctgagtaagatt

SEQ ID NO: 102883 - DNA, 22 bp, Artificial Sequence
  chemically synthesized
gggcccctgctgagtaagattt

SEQ ID NO: 102884 - DNA, 22 bp, Artificial Sequence
  chemically synthesized
ggcccctgctgagtaagatttt

SEQ ID NO: 102885 - DNA, 22 bp, Artificial Sequence
  chemically synthesized
ctgagtaagattttgtgtcaac

SEQ ID NO: 102886 - DNA, 22 bp, Artificial Sequence
  chemically synthesized
agtaagattttgtgtcaactaa

SEQ ID NO: 102887 - DNA, 22 bp, Artificial Sequence
  chemically synthesized
tgtgtcaactaaacaaaacgat

SEQ ID NO: 102888 - DNA, 22 bp, Artificial Sequence
  chemically synthesized
gtgtcaactaaacaaaacgata

SEQ ID NO: 102889 - DNA, 22 bp, Artificial Sequence
  chemically synthesized
tgtcaactaaacaaaacgatag

SEQ ID NO: 102890 - DNA, 22 bp, Artificial Sequence
  chemically synthesized
aacaaaacgataggaaattgta

SEQ ID NO: 102891 - DNA, 22 bp, Artificial Sequence
  chemically synthesized
tatttccccaaagacattttgg

SEQ ID NO: 102892 - DNA, 22 bp, Artificial Sequence
  chemically synthesized
ccccaaagacattttggaaacg

SEQ ID NO: 102893 - DNA, 22 bp, Artificial Sequence
  chemically synthesized
cccaaagacattttggaaacgt

SEQ ID NO: 102894 - DNA, 22 bp, Artificial Sequence
  chemically synthesized
tggaaacgttctccttcagcac

SEQ ID NO: 102895 - DNA, 22 bp, Artificial Sequence
  chemically synthesized
ggaaacgttctccttcagcacc

SEQ ID NO: 102896 - DNA, 22 bp, Artificial Sequence
  chemically synthesized
gaaacgttctccttcagcacca

SEQ ID NO: 102897 - DNA, 22 bp, Artificial Sequence
  chemically synthesized
tccttcagcaccaatggtagca

SEQ ID NO: 102898 - DNA, 22 bp, Artificial Sequence
  chemically synthesized
cttcagcaccaatggtagcacc

SEQ ID NO: 102899 - DNA, 22 bp, Artificial Sequence
  chemically synthesized
cagcaccaatggtagcacctgg

SEQ ID NO: 102900 - DNA, 22 bp, Artificial Sequence
  chemically synthesized
agcaccaatggtagcacctgga

SEQ ID NO: 102901 - DNA, 22 bp, Artificial Sequence
  chemically synthesized
gaactgaccatccaacttccaa

SEQ ID NO: 102902 - DNA, 22 bp, Artificial Sequence
  chemically synthesized
accatccaacttccaagccaaa

SEQ ID NO: 102903 - DNA, 22 bp, Artificial Sequence
  chemically synthesized
ccaagccaaacaacttcaccca

SEQ ID NO: 102904 - DNA, 22 bp, Artificial Sequence
  chemically synthesized
caagccaaacaacttcacccat

SEQ ID NO: 102905 - DNA, 22 bp, Artificial Sequence
  chemically synthesized
cacccataaatctacattcctc

SEQ ID NO: 102906 - DNA, 22 bp, Artificial Sequence
  chemically synthesized
acccataaatctacattcctcc

SEQ ID NO: 102907 - DNA, 22 bp, Artificial Sequence
  chemically synthesized
cattcctccaatctctttcctc

SEQ ID NO: 102908 - DNA, 22 bp, Artificial Sequence
  chemically synthesized
ctccaatctctttcctccatca

SEQ ID NO: 102909 - DNA, 22 bp, Artificial Sequence
  chemically synthesized
caatctctttcctccatcatgg

SEQ ID NO: 102910 - DNA, 22 bp, Artificial Sequence
  chemically synthesized
tttcctccatcatggaaacagc

SEQ ID NO: 102911 - DNA, 22 bp, Artificial Sequence
  chemically synthesized
tcctccatcatggaaacagccc

SEQ ID NO: 102912 - DNA, 22 bp, Artificial Sequence
  chemically synthesized
cctccatcatggaaacagccct

SEQ ID NO: 102913 - DNA, 22 bp, Artificial Sequence
  chemically synthesized
ctccatcatggaaacagccctg

SEQ ID NO: 102914 - DNA, 22 bp, Artificial Sequence
  chemically synthesized
catcatggaaacagccctgcat

SEQ ID NO: 102915 - DNA, 22 bp, Artificial Sequence
  chemically synthesized
catattcaaaagtgagtgtccc

SEQ ID NO: 102916 - DNA, 22 bp, Artificial Sequence
  chemically synthesized
aaaagtgagtgtccctctctta

SEQ ID NO: 102917 - DNA, 22 bp, Artificial Sequence
  chemically synthesized
tcttatacctcgtcagagagat

SEQ ID NO: 102918 - DNA, 22 bp, Artificial Sequence
  chemically synthesized
ttatacctcgtcagagagattc

SEQ ID NO: 102919 - DNA, 22 bp, Artificial Sequence
  chemically synthesized
atacctcgtcagagagattcaa

SEQ ID NO: 102920 - DNA, 22 bp, Artificial Sequence
  chemically synthesized
tacctcgtcagagagattcaaa

SEQ ID NO: 102921 - DNA, 22 bp, Artificial Sequence
  chemically synthesized
gtcagagagattcaaatattgt

SEQ ID NO: 102922 - DNA, 22 bp, Artificial Sequence
  chemically synthesized
aaatattgtcatattcacaatc

SEQ ID NO: 102923 - DNA, 22 bp, Artificial Sequence
  chemically synthesized
tcatattcacaatccacaacag

SEQ ID NO: 102924 - DNA, 22 bp, Artificial Sequence
  chemically synthesized
acaatccacaacaggcccagat

SEQ ID NO: 102925 - DNA, 22 bp, Artificial Sequence
  chemically synthesized
agtgatgctggtcatcactgaa

SEQ ID NO: 102926 - DNA, 22 bp, Artificial Sequence
  chemically synthesized
gtcatcactgaagatagattga

SEQ ID NO: 102927 - DNA, 22 bp, Artificial Sequence
  chemically synthesized
aagatagattgaatcttccttt

SEQ ID NO: 102928 - DNA, 22 bp, Artificial Sequence
  chemically synthesized
aatcttcctttcttcttggacg

SEQ ID NO: 102929 - DNA, 22 bp, Artificial Sequence
  chemically synthesized
cctttcttcttggacgtaaatt

SEQ ID NO: 102930 - DNA, 22 bp, Artificial Sequence
  chemically synthesized
ctttcttcttggacgtaaattg

SEQ ID NO: 102931 - DNA, 22 bp, Artificial Sequence
  chemically synthesized
tcttcttggacgtaaattgcag

SEQ ID NO: 102932 - DNA, 22 bp, Artificial Sequence
  chemically synthesized
cttcttggacgtaaattgcagg

SEQ ID NO: 102933 - DNA, 22 bp, Artificial Sequence
  chemically synthesized
ttcttggacgtaaattgcaggt

SEQ ID NO: 102934 - DNA, 22 bp, Artificial Sequence
  chemically synthesized
cttggacgtaaattgcaggtta

SEQ ID NO: 102935 - DNA, 22 bp, Artificial Sequence
  chemically synthesized
ttggacgtaaattgcaggttat

SEQ ID NO: 102936 - DNA, 22 bp, Artificial Sequence
  chemically synthesized
ggacgtaaattgcaggttattg

SEQ ID NO: 102937 - DNA, 22 bp, Artificial Sequence
  chemically synthesized
gacgtaaattgcaggttattga

SEQ ID NO: 102938 - DNA, 22 bp, Artificial Sequence
  chemically synthesized
caggttattgaaaaaactataa

SEQ ID NO: 102939 - DNA, 22 bp, Artificial Sequence
  chemically synthesized
ttgaaaaaactataacttgaag

SEQ ID NO: 102940 - DNA, 22 bp, Artificial Sequence
  chemically synthesized
aaaaaactataacttgaagttt

SEQ ID NO: 102941 - DNA, 22 bp, Artificial Sequence
  chemically synthesized
taacttgaagtttcatagcaga

SEQ ID NO: 102942 - DNA, 22 bp, Artificial Sequence
  chemically synthesized
gaagtttcatagcagaaagttg

SEQ ID NO: 102943 - DNA, 22 bp, Artificial Sequence
  chemically synthesized
aagtttcatagcagaaagttgg

SEQ ID NO: 102944 - DNA, 22 bp, Artificial Sequence
  chemically synthesized
catagcagaaagttggcatctt

SEQ ID NO: 102945 - DNA, 22 bp, Artificial Sequence
  chemically synthesized
atagcagaaagttggcatcttt

SEQ ID NO: 102946 - DNA, 22 bp, Artificial Sequence
  chemically synthesized
gcatctttctcactaagcatga

SEQ ID NO: 102947 - DNA, 22 bp, Artificial Sequence
  chemically synthesized
tctcactaagcatgagaaaaac

SEQ ID NO: 102948 - DNA, 22 bp, Artificial Sequence
  chemically synthesized
ctcactaagcatgagaaaaact

SEQ ID NO: 102949 - DNA, 22 bp, Artificial Sequence
  chemically synthesized
tcactaagcatgagaaaaacta

SEQ ID NO: 102950 - DNA, 22 bp, Artificial Sequence
  chemically synthesized
actaagcatgagaaaaactaac

SEQ ID NO: 102951 - DNA, 22 bp, Artificial Sequence
  chemically synthesized
agcatgagaaaaactaacagag

SEQ ID NO: 102952 - DNA, 22 bp, Artificial Sequence
  chemically synthesized
acagagttttaatttgaagggc

SEQ ID NO: 102953 - DNA, 22 bp, Artificial Sequence
  chemically synthesized
taatttgaagggccttagccaa

SEQ ID NO: 102954 - DNA, 22 bp, Artificial Sequence
  chemically synthesized
aatttgaagggccttagccaac

SEQ ID NO: 102955 - DNA, 22 bp, Artificial Sequence
  chemically synthesized
atttgaagggccttagccaact

SEQ ID NO: 102956 - DNA, 22 bp, Artificial Sequence
  chemically synthesized
gaagggccttagccaacttagc

SEQ ID NO: 102957 - DNA, 22 bp, Artificial Sequence
  chemically synthesized
aagggccttagccaacttagct

SEQ ID NO: 102958 - DNA, 22 bp, Artificial Sequence
  chemically synthesized
agccaacttagctgaagtccct

SEQ ID NO: 102959 - DNA, 22 bp, Artificial Sequence
  chemically synthesized
gccaacttagctgaagtccctt

SEQ ID NO: 102960 - DNA, 22 bp, Artificial Sequence
  chemically synthesized
agctgaagtcccttccacctaa

SEQ ID NO: 102961 - DNA, 22 bp, Artificial Sequence
  chemically synthesized
gctgaagtcccttccacctaag

SEQ ID NO: 102962 - DNA, 22 bp, Artificial Sequence
  chemically synthesized
aagtcccttccacctaagataa

SEQ ID NO: 102963 - DNA, 22 bp, Artificial Sequence
  chemically synthesized
ccacctaagataaagctgtaaa

SEQ ID NO: 102964 - DNA, 22 bp, Artificial Sequence
  chemically synthesized
cacctaagataaagctgtaaaa

SEQ ID NO: 102965 - DNA, 22 bp, Artificial Sequence
  chemically synthesized
agataaagctgtaaaagaggag

SEQ ID NO: 102966 - DNA, 22 bp, Artificial Sequence
  chemically synthesized
taaaagaggagcagatgtataa

SEQ ID NO: 102967 - DNA, 22 bp, Artificial Sequence
  chemically synthesized
agatattggagcagcatgcagt

SEQ ID NO: 102968 - DNA, 22 bp, Artificial Sequence
  chemically synthesized
gatattggagcagcatgcagta

SEQ ID NO: 102969 - DNA, 22 bp, Artificial Sequence
  chemically synthesized
gagcagcatgcagtatcaaaat

SEQ ID NO: 102970 - DNA, 22 bp, Artificial Sequence
  chemically synthesized
atgagcaccaaagaagccatat

SEQ ID NO: 102971 - DNA, 22 bp, Artificial Sequence
  chemically synthesized
ttcacagtttctattcttccaa

SEQ ID NO: 102972 - DNA, 22 bp, Artificial Sequence
  chemically synthesized
tcacagtttctattcttccaaa

SEQ ID NO: 102973 - DNA, 22 bp, Artificial Sequence
  chemically synthesized
cacagtttctattcttccaaaa

SEQ ID NO: 102974 - DNA, 22 bp, Artificial Sequence
  chemically synthesized
acagtttctattcttccaaaat

SEQ ID NO: 102975 - DNA, 22 bp, Artificial Sequence
  chemically synthesized
ctattcttccaaaataacttac

SEQ ID NO: 102976 - DNA, 22 bp, Artificial Sequence
  chemically synthesized
tattcttccaaaataacttaca

SEQ ID NO: 102977 - DNA, 22 bp, Artificial Sequence
  chemically synthesized
ttcttccaaaataacttacaaa

SEQ ID NO: 102978 - DNA, 22 bp, Artificial Sequence
  chemically synthesized
ttccaaaataacttacaaagac

SEQ ID NO: 102979 - DNA, 22 bp, Artificial Sequence
  chemically synthesized
ccaaaataacttacaaagacag

SEQ ID NO: 102980 - DNA, 22 bp, Artificial Sequence
  chemically synthesized
caaaataacttacaaagacagt

SEQ ID NO: 102981 - DNA, 22 bp, Artificial Sequence
  chemically synthesized
acaaagacagtctttcctctgt

SEQ ID NO: 102982 - DNA, 22 bp, Artificial Sequence
  chemically synthesized
caaagacagtctttcctctgtc

SEQ ID NO: 102983 - DNA, 22 bp, Artificial Sequence
  chemically synthesized
tcctctgtcataagaacctgca

SEQ ID NO: 102984 - DNA, 22 bp, Artificial Sequence
  chemically synthesized
cctctgtcataagaacctgcac

SEQ ID NO: 102985 - DNA, 22 bp, Artificial Sequence
  chemically synthesized
ctctgtcataagaacctgcacc

SEQ ID NO: 102986 - DNA, 22 bp, Artificial Sequence
  chemically synthesized
tgtcataagaacctgcacccag

SEQ ID NO: 102987 - DNA, 22 bp, Artificial Sequence
  chemically synthesized
tcataagaacctgcacccaggt

SEQ ID NO: 102988 - DNA, 22 bp, Artificial Sequence
  chemically synthesized
cacccaggtcagcaaatcaaga

SEQ ID NO: 102989 - DNA, 22 bp, Artificial Sequence
  chemically synthesized
aaatttcctaccaacacactaa

SEQ ID NO: 102990 - DNA, 22 bp, Artificial Sequence
  chemically synthesized
cctaccaacacactaataaaca

SEQ ID NO: 102991 - DNA, 22 bp, Artificial Sequence
  chemically synthesized
ctaccaacacactaataaacat

SEQ ID NO: 102992 - DNA, 22 bp, Artificial Sequence
  chemically synthesized
ccaacacactaataaacattag

SEQ ID NO: 102993 - DNA, 22 bp, Artificial Sequence
  chemically synthesized
ataaacattaggaacttactgg

SEQ ID NO: 102994 - DNA, 22 bp, Artificial Sequence
  chemically synthesized
ggaacttactgggcacattatg

SEQ ID NO: 102995 - DNA, 22 bp, Artificial Sequence
  chemically synthesized
actgggcacattatgagaaaca

SEQ ID NO: 102996 - DNA, 22 bp, Artificial Sequence
  chemically synthesized
ctgggcacattatgagaaacag

SEQ ID NO: 102997 - DNA, 22 bp, Artificial Sequence
  chemically synthesized
ggcacattatgagaaacagagg

SEQ ID NO: 102998 - DNA, 22 bp, Artificial Sequence
  chemically synthesized
tgagaaacagaggagtctttgg

SEQ ID NO: 102999 - DNA, 22 bp, Artificial Sequence
  chemically synthesized
tgggggataaccagattttaag

SEQ ID NO: 103000 - DNA, 22 bp, Artificial Sequence
  chemically synthesized
gggggataaccagattttaaga

SEQ ID NO: 103001 - DNA, 22 bp, Artificial Sequence
  chemically synthesized
ggggataaccagattttaagat

SEQ ID NO: 103002 - DNA, 22 bp, Artificial Sequence
  chemically synthesized
taagatttgtgtttatactcag

SEQ ID NO: 103003 - DNA, 22 bp, Artificial Sequence
  chemically synthesized
aagatttgtgtttatactcagt

SEQ ID NO: 103004 - DNA, 22 bp, Artificial Sequence
  chemically synthesized
agatttgtgtttatactcagta

SEQ ID NO: 103005 - DNA, 22 bp, Artificial Sequence
  chemically synthesized
gtgtttatactcagtatcaata

SEQ ID NO: 103006 - DNA, 22 bp, Artificial Sequence
  chemically synthesized
tgtttatactcagtatcaatag

SEQ ID NO: 103007 - DNA, 22 bp, Artificial Sequence
  chemically synthesized
atactcagtatcaatagcttaa

SEQ ID NO: 103008 - DNA, 22 bp, Artificial Sequence
  chemically synthesized
tactcagtatcaatagcttaaa

SEQ ID NO: 103009 - DNA, 22 bp, Artificial Sequence
  chemically synthesized
agtatcaatagcttaaacattg

SEQ ID NO: 103010 - DNA, 22 bp, Artificial Sequence
  chemically synthesized
aaacattgtactcaatagcata

SEQ ID NO: 103011 - DNA, 22 bp, Artificial Sequence
  chemically synthesized
aacattgtactcaatagcatat

SEQ ID NO: 103012 - DNA, 22 bp, Artificial Sequence
  chemically synthesized
tactcaatagcatataattttg

SEQ ID NO: 103013 - DNA, 22 bp, Artificial Sequence
  chemically synthesized
aatagcatataattttgcttac

SEQ ID NO: 103014 - DNA, 22 bp, Artificial Sequence
  chemically synthesized
tgcttacagcatgcattgggta

SEQ ID NO: 103015 - DNA, 22 bp, Artificial Sequence
  chemically synthesized
gcttacagcatgcattgggtaa

SEQ ID NO: 103016 - DNA, 22 bp, Artificial Sequence
  chemically synthesized
cttacagcatgcattgggtaaa

SEQ ID NO: 103017 - DNA, 22 bp, Artificial Sequence
  chemically synthesized
acagcatgcattgggtaaataa

SEQ ID NO: 103018 - DNA, 22 bp, Artificial Sequence
  chemically synthesized
cagcatgcattgggtaaataat

SEQ ID NO: 103019 - DNA, 22 bp, Artificial Sequence
  chemically synthesized
ggtaaataatcggttttacaat

SEQ ID NO: 103020 - DNA, 22 bp, Artificial Sequence
  chemically synthesized
tacaattgattcagtatgaaaa

SEQ ID NO: 103021 - DNA, 22 bp, Artificial Sequence
  chemically synthesized
acaattgattcagtatgaaaaa

SEQ ID NO: 103022 - DNA, 22 bp, Artificial Sequence
  chemically synthesized
caattgattcagtatgaaaaag

SEQ ID NO: 103023 - DNA, 22 bp, Artificial Sequence
  chemically synthesized
attcagtatgaaaaagttttaa

SEQ ID NO: 103024 - DNA, 22 bp, Artificial Sequence
  chemically synthesized
agtatgaaaaagttttaataca

SEQ ID NO: 103025 - DNA, 22 bp, Artificial Sequence
  chemically synthesized
taatacaaggacatacagaaaa

SEQ ID NO: 103026 - DNA, 22 bp, Artificial Sequence
  chemically synthesized
aatacaaggacatacagaaaac

SEQ ID NO: 103027 - DNA, 22 bp, Artificial Sequence
  chemically synthesized
atacaaggacatacagaaaact

SEQ ID NO: 103028 - DNA, 22 bp, Artificial Sequence
  chemically synthesized
gcgcctacacctatttttttaa

SEQ ID NO: 103029 - DNA, 22 bp, Artificial Sequence
  chemically synthesized
cgcctacacctatttttttaag

SEQ ID NO: 103030 - DNA, 22 bp, Artificial Sequence
  chemically synthesized
cacctatttttttaagcattcc

SEQ ID NO: 103031 - DNA, 22 bp, Artificial Sequence
  chemically synthesized
tttttttaagcattccatagat

SEQ ID NO: 103032 - DNA, 22 bp, Artificial Sequence
  chemically synthesized
ttttaagcattccatagattgg

SEQ ID NO: 103033 - DNA, 22 bp, Artificial Sequence
  chemically synthesized
tttaagcattccatagattgga

SEQ ID NO: 103034 - DNA, 22 bp, Artificial Sequence
  chemically synthesized
ttaagcattccatagattggat

SEQ ID NO: 103035 - DNA, 22 bp, Artificial Sequence
  chemically synthesized
taagcattccatagattggatc

SEQ ID NO: 103036 - DNA, 22 bp, Artificial Sequence
  chemically synthesized
aagcattccatagattggatct

SEQ ID NO: 103037 - DNA, 22 bp, Artificial Sequence
  chemically synthesized
agcattccatagattggatctc

SEQ ID NO: 103038 - DNA, 22 bp, Artificial Sequence
  chemically synthesized
catagattggatctcatttctc

SEQ ID NO: 103039 - DNA, 22 bp, Artificial Sequence
  chemically synthesized
gatctcatttctctccacattt

SEQ ID NO: 103040 - DNA, 22 bp, Artificial Sequence
  chemically synthesized
atttctctccacatttttatgt

SEQ ID NO: 103041 - DNA, 22 bp, Artificial Sequence
  chemically synthesized
ctctccacatttttatgtcttc

SEQ ID NO: 103042 - DNA, 22 bp, Artificial Sequence
  chemically synthesized
tctccacatttttatgtcttcc

SEQ ID NO: 103043 - DNA, 22 bp, Artificial Sequence
  chemically synthesized
tccacatttttatgtcttccca

SEQ ID NO: 103044 - DNA, 22 bp, Artificial Sequence
  chemically synthesized
cacatttttatgtcttcccaat

SEQ ID NO: 103045 - DNA, 22 bp, Artificial Sequence
  chemically synthesized
ttatgtcttcccaatataaaac

SEQ ID NO: 103046 - DNA, 22 bp, Artificial Sequence
  chemically synthesized
tatgtcttcccaatataaaact

SEQ ID NO: 103047 - DNA, 22 bp, Artificial Sequence
  chemically synthesized
atgtcttcccaatataaaactt

SEQ ID NO: 103048 - DNA, 22 bp, Artificial Sequence
  chemically synthesized
tgtcttcccaatataaaacttt

SEQ ID NO: 103049 - DNA, 22 bp, Artificial Sequence
  chemically synthesized
cccaatataaaactttactcag

SEQ ID NO: 103050 - DNA, 22 bp, Artificial Sequence
  chemically synthesized
ccaatataaaactttactcagg

SEQ ID NO: 103051 - DNA, 22 bp, Artificial Sequence
  chemically synthesized
tactcaggccgggcgcggtggc

SEQ ID NO: 103052 - DNA, 22 bp, Artificial Sequence
  chemically synthesized
actcaggccgggcgcggtggct

SEQ ID NO: 103053 - DNA, 22 bp, Artificial Sequence
  chemically synthesized
ctcaggccgggcgcggtggctc

SEQ ID NO: 103054 - DNA, 22 bp, Artificial Sequence
  chemically synthesized
aggccgggcgcggtggctcacg

SEQ ID NO: 103055 - DNA, 22 bp, Artificial Sequence
  chemically synthesized
acgcctgtaatcccagcacttt

SEQ ID NO: 103056 - DNA, 22 bp, Artificial Sequence
  chemically synthesized
taatcccagcactttgggaggc

SEQ ID NO: 103057 - DNA, 22 bp, Artificial Sequence
  chemically synthesized
tgggaggccgaggcgggtggat

SEQ ID NO: 103058 - DNA, 22 bp, Artificial Sequence
  chemically synthesized
gggaggccgaggcgggtggatc

SEQ ID NO: 103059 - DNA, 22 bp, Artificial Sequence
  chemically synthesized
ggaggccgaggcgggtggatca

SEQ ID NO: 103060 - DNA, 22 bp, Artificial Sequence
  chemically synthesized
gctaacacagtgaaaccccgtc

SEQ ID NO: 103061 - DNA, 22 bp, Artificial Sequence
  chemically synthesized
acacagtgaaaccccgtctcta

SEQ ID NO: 103062 - DNA, 22 bp, Artificial Sequence
  chemically synthesized
tactaaaaagacaaaaaaattt

SEQ ID NO: 103063 - DNA, 22 bp, Artificial Sequence
  chemically synthesized
ctaaaaagacaaaaaaatttgc

SEQ ID NO: 103064 - DNA, 22 bp, Artificial Sequence
  chemically synthesized
aaaagacaaaaaaatttgcctg

SEQ ID NO: 103065 - DNA, 22 bp, Artificial Sequence
  chemically synthesized
gcctggcgtggtggcgggcgcc

SEQ ID NO: 103066 - DNA, 22 bp, Artificial Sequence
  chemically synthesized
cctggcgtggtggcgggcgcct

SEQ ID NO: 103067 - DNA, 22 bp, Artificial Sequence
  chemically synthesized
gcgtggtggcgggcgcctgtag

SEQ ID NO: 103068 - DNA, 22 bp, Artificial Sequence
  chemically synthesized
tagtcccagctactcgggaggc

SEQ ID NO: 103069 - DNA, 22 bp, Artificial Sequence
  chemically synthesized
ctcgggaggctgaggcaggaga

SEQ ID NO: 103070 - DNA, 22 bp, Artificial Sequence
  chemically synthesized
gggaggctgaggcaggagaatg

SEQ ID NO: 103071 - DNA, 22 bp, Artificial Sequence
  chemically synthesized
aggcaggagaatggcgtgaacc

SEQ ID NO: 103072 - DNA, 22 bp, Artificial Sequence
  chemically synthesized
gcagtgagctgagatcacgcca

SEQ ID NO: 103073 - DNA, 22 bp, Artificial Sequence
  chemically synthesized
cagtgagctgagatcacgccac

SEQ ID NO: 103074 - DNA, 22 bp, Artificial Sequence
  chemically synthesized
agatcacgccactgcactccag

SEQ ID NO: 103075 - DNA, 22 bp, Artificial Sequence
  chemically synthesized
cactccagcctgggcgacagag

SEQ ID NO: 103076 - DNA, 22 bp, Artificial Sequence
  chemically synthesized
cagcctgggcgacagagcgaga

SEQ ID NO: 103077 - DNA, 22 bp, Artificial Sequence
  chemically synthesized
ggcgacagagcgagactccatc

SEQ ID NO: 103078 - DNA, 22 bp, Artificial Sequence
  chemically synthesized
catctcaaaaacaaaacaaaac

SEQ ID NO: 103079 - DNA, 22 bp, Artificial Sequence
  chemically synthesized
aaaaacaaaacaaaacaaagca

SEQ ID NO: 103080 - DNA, 22 bp, Artificial Sequence
  chemically synthesized
tactcagtgaagtccagagcaa

SEQ ID NO: 103081 - DNA, 22 bp, Artificial Sequence
  chemically synthesized
actcagtgaagtccagagcaaa

SEQ ID NO: 103082 - DNA, 22 bp, Artificial Sequence
  chemically synthesized
ctcagtgaagtccagagcaaag

SEQ ID NO: 103083 - DNA, 22 bp, Artificial Sequence
  chemically synthesized
agtgaagtccagagcaaagatt

SEQ ID NO: 103084 - DNA, 22 bp, Artificial Sequence
  chemically synthesized
gttgcaaacaaatcaccagttc

SEQ ID NO: 103085 - DNA, 22 bp, Artificial Sequence
  chemically synthesized
ttgcaaacaaatcaccagttct

SEQ ID NO: 103086 - DNA, 22 bp, Artificial Sequence
  chemically synthesized
caaacaaatcaccagttcttat

SEQ ID NO: 103087 - DNA, 22 bp, Artificial Sequence
  chemically synthesized
ttatctttctccgtgaaaatgt

SEQ ID NO: 103088 - DNA, 22 bp, Artificial Sequence
  chemically synthesized
atctttctccgtgaaaatgtac

SEQ ID NO: 103089 - DNA, 22 bp, Artificial Sequence
  chemically synthesized
tctttctccgtgaaaatgtacc

SEQ ID NO: 103090 - DNA, 22 bp, Artificial Sequence
  chemically synthesized
tctccgtgaaaatgtacctgta

SEQ ID NO: 103091 - DNA, 22 bp, Artificial Sequence
  chemically synthesized
ctccgtgaaaatgtacctgtaa

SEQ ID NO: 103092 - DNA, 22 bp, Artificial Sequence
  chemically synthesized
tccgtgaaaatgtacctgtaaa

SEQ ID NO: 103093 - DNA, 22 bp, Artificial Sequence
  chemically synthesized
cgtgaaaatgtacctgtaaaat

SEQ ID NO: 103094 - DNA, 22 bp, Artificial Sequence
  chemically synthesized
taaaatgtggatgccacatatt

SEQ ID NO: 103095 - DNA, 22 bp, Artificial Sequence
  chemically synthesized
ttaggtctggaaggattgcatt

SEQ ID NO: 103096 - DNA, 22 bp, Artificial Sequence
  chemically synthesized
taggtctggaaggattgcatta

SEQ ID NO: 103097 - DNA, 22 bp, Artificial Sequence
  chemically synthesized
aggtctggaaggattgcattat

SEQ ID NO: 103098 - DNA, 22 bp, Artificial Sequence
  chemically synthesized
ggtctggaaggattgcattatc

SEQ ID NO: 103099 - DNA, 22 bp, Artificial Sequence
  chemically synthesized
gaaggattgcattatcttttat

SEQ ID NO: 103100 - DNA, 22 bp, Artificial Sequence
  chemically synthesized
cattatcttttatctgtattgc

SEQ ID NO: 103101 - DNA, 22 bp, Artificial Sequence
  chemically synthesized
tcttttatctgtattgcattat

SEQ ID NO: 103102 - DNA, 22 bp, Artificial Sequence
  chemically synthesized
ttatctgtattgcattatcata

SEQ ID NO: 103103 - DNA, 22 bp, Artificial Sequence
  chemically synthesized
tatctgtattgcattatcataa

SEQ ID NO: 103104 - DNA, 22 bp, Artificial Sequence
  chemically synthesized
atctgtattgcattatcataaa

SEQ ID NO: 103105 - DNA, 22 bp, Artificial Sequence
  chemically synthesized
tctgtattgcattatcataaaa

SEQ ID NO: 103106 - DNA, 22 bp, Artificial Sequence
  chemically synthesized
tattgcattatcataaaatctc

SEQ ID NO: 103107 - DNA, 22 bp, Artificial Sequence
  chemically synthesized
cattatcataaaatctctagtt

SEQ ID NO: 103108 - DNA, 22 bp, Artificial Sequence
  chemically synthesized
tcataaaatctctagttgagtg

SEQ ID NO: 103109 - DNA, 22 bp, Artificial Sequence
  chemically synthesized
tagttgagtgaaaaaatttgtt

SEQ ID NO: 103110 - DNA, 22 bp, Artificial Sequence
  chemically synthesized
gttgagtgaaaaaatttgttaa

SEQ ID NO: 103111 - DNA, 22 bp, Artificial Sequence
  chemically synthesized
agtgaaaaaatttgttaaatca

SEQ ID NO: 103112 - DNA, 22 bp, Artificial Sequence
  chemically synthesized
gttaaatcatttctttaactga

SEQ ID NO: 103113 - DNA, 22 bp, Artificial Sequence
  chemically synthesized
ttaaatcatttctttaactgaa

SEQ ID NO: 103114 - DNA, 22 bp, Artificial Sequence
  chemically synthesized
aatcatttctttaactgaaaac

SEQ ID NO: 103115 - DNA, 22 bp, Artificial Sequence
  chemically synthesized
ctttaactgaaaactgaaccca

SEQ ID NO: 103116 - DNA, 22 bp, Artificial Sequence
  chemically synthesized
tttaactgaaaactgaacccag

SEQ ID NO: 103117 - DNA, 22 bp, Artificial Sequence
  chemically synthesized
taactgaaaactgaacccagga

SEQ ID NO: 103118 - DNA, 22 bp, Artificial Sequence
  chemically synthesized
aactgaaaactgaacccaggag

SEQ ID NO: 103119 - DNA, 22 bp, Artificial Sequence
  chemically synthesized
actgaaaactgaacccaggagg

SEQ ID NO: 103120 - DNA, 22 bp, Artificial Sequence
  chemically synthesized
aaaactgaacccaggaggcaga

SEQ ID NO: 103121 - DNA, 22 bp, Artificial Sequence
  chemically synthesized
aacccaggaggcagaggttgca

SEQ ID NO: 103122 - DNA, 22 bp, Artificial Sequence
  chemically synthesized
cagtcagccgagatcaaggcac

SEQ ID NO: 103123 - DNA, 22 bp, Artificial Sequence
  chemically synthesized
aaaacttcctttctccagaaag

SEQ ID NO: 103124 - DNA, 22 bp, Artificial Sequence
  chemically synthesized
cctttctccagaaagcttgtct

SEQ ID NO: 103125 - DNA, 22 bp, Artificial Sequence
  chemically synthesized
ctttctccagaaagcttgtctc

SEQ ID NO: 103126 - DNA, 22 bp, Artificial Sequence
  chemically synthesized
tctccagaaagcttgtctcatt

SEQ ID NO: 103127 - DNA, 22 bp, Artificial Sequence
  chemically synthesized
ctccagaaagcttgtctcattt

SEQ ID NO: 103128 - DNA, 22 bp, Artificial Sequence
  chemically synthesized
tccagaaagcttgtctcatttt

SEQ ID NO: 103129 - DNA, 22 bp, Artificial Sequence
  chemically synthesized
cagaaagcttgtctcattttct

SEQ ID NO: 103130 - DNA, 22 bp, Artificial Sequence
  chemically synthesized
gtctcattttcttcttccatgg

SEQ ID NO: 103131 - DNA, 22 bp, Artificial Sequence
  chemically synthesized
tctcattttcttcttccatgga

SEQ ID NO: 103132 - DNA, 22 bp, Artificial Sequence
  chemically synthesized
attttcttcttccatggaatat

SEQ ID NO: 103133 - DNA, 22 bp, Artificial Sequence
  chemically synthesized
tcttcttccatggaatattcca

SEQ ID NO: 103134 - DNA, 22 bp, Artificial Sequence
  chemically synthesized
cttcttccatggaatattccaa

SEQ ID NO: 103135 - DNA, 22 bp, Artificial Sequence
  chemically synthesized
ttcttccatggaatattccaag

SEQ ID NO: 103136 - DNA, 22 bp, Artificial Sequence
  chemically synthesized
cttccatggaatattccaagga

SEQ ID NO: 103137 - DNA, 22 bp, Artificial Sequence
  chemically synthesized
ttccatggaatattccaaggaa

SEQ ID NO: 103138 - DNA, 22 bp, Artificial Sequence
  chemically synthesized
ccatggaatattccaaggaata

SEQ ID NO: 103139 - DNA, 22 bp, Artificial Sequence
  chemically synthesized
catggaatattccaaggaatat

SEQ ID NO: 103140 - DNA, 22 bp, Artificial Sequence
  chemically synthesized
caaggaatattctttgaaaagc

SEQ ID NO: 103141 - DNA, 22 bp, Artificial Sequence
  chemically synthesized
tttgaaaagcagaatattcaga

SEQ ID NO: 103142 - DNA, 22 bp, Artificial Sequence
  chemically synthesized
tgaaaagcagaatattcagagt

SEQ ID NO: 103143 - DNA, 22 bp, Artificial Sequence
  chemically synthesized
gaaaagcagaatattcagagtg

SEQ ID NO: 103144 - DNA, 22 bp, Artificial Sequence
  chemically synthesized
aaaagcagaatattcagagtga

SEQ ID NO: 103145 - DNA, 22 bp, Artificial Sequence
  chemically synthesized
agagtgagaggaagtagagaga

SEQ ID NO: 103146 - DNA, 22 bp, Artificial Sequence
  chemically synthesized
aggtagaatctgggcatattga

SEQ ID NO: 103147 - DNA, 22 bp, Artificial Sequence
  chemically synthesized
ggtagaatctgggcatattgaa

SEQ ID NO: 103148 - DNA, 22 bp, Artificial Sequence
  chemically synthesized
ggcatattgaagggaagacatc

SEQ ID NO: 103149 - DNA, 22 bp, Artificial Sequence
  chemically synthesized
aagggaagacatcaataattca

SEQ ID NO: 103150 - DNA, 22 bp, Artificial Sequence
  chemically synthesized
acagtagccaaggaatagaaac

SEQ ID NO: 103151 - DNA, 22 bp, Artificial Sequence
  chemically synthesized
tcaacagatgcgtatatcaaca

SEQ ID NO: 103152 - DNA, 22 bp, Artificial Sequence
  chemically synthesized
atatatgtgatagaatattatt

SEQ ID NO: 103153 - DNA, 22 bp, Artificial Sequence
  chemically synthesized
tatatgtgatagaatattattt

SEQ ID NO: 103154 - DNA, 22 bp, Artificial Sequence
  chemically synthesized
tttatctataaaaagtaggtct

SEQ ID NO: 103155 - DNA, 22 bp, Artificial Sequence
  chemically synthesized
atctataaaaagtaggtctgac

SEQ ID NO: 103156 - DNA, 22 bp, Artificial Sequence
  chemically synthesized
tctataaaaagtaggtctgaca

SEQ ID NO: 103157 - DNA, 22 bp, Artificial Sequence
  chemically synthesized
taaaaagtaggtctgacacatg

SEQ ID NO: 103158 - DNA, 22 bp, Artificial Sequence
  chemically synthesized
acacatgctacaacatgaataa

SEQ ID NO: 103159 - DNA, 22 bp, Artificial Sequence
  chemically synthesized
caacatgaataaaccttaaaaa

SEQ ID NO: 103160 - DNA, 22 bp, Artificial Sequence
  chemically synthesized
aaaaaactatcctaagtgcaat

SEQ ID NO: 103161 - DNA, 22 bp, Artificial Sequence
  chemically synthesized
aaaaactatcctaagtgcaata

SEQ ID NO: 103162 - DNA, 22 bp, Artificial Sequence
  chemically synthesized
tcctaagtgcaataagtcatac

SEQ ID NO: 103163 - DNA, 22 bp, Artificial Sequence
  chemically synthesized
agtgcaataagtcatacgcaaa

SEQ ID NO: 103164 - DNA, 22 bp, Artificial Sequence
  chemically synthesized
tctgatttcacttacatgagct

SEQ ID NO: 103165 - DNA, 22 bp, Artificial Sequence
  chemically synthesized
atttcacttacatgagctatct

SEQ ID NO: 103166 - DNA, 22 bp, Artificial Sequence
  chemically synthesized
cacttacatgagctatctagaa

SEQ ID NO: 103167 - DNA, 22 bp, Artificial Sequence
  chemically synthesized
acttacatgagctatctagaat

SEQ ID NO: 103168 - DNA, 22 bp, Artificial Sequence
  chemically synthesized
acatgagctatctagaataggc

SEQ ID NO: 103169 - DNA, 22 bp, Artificial Sequence
  chemically synthesized
catgagctatctagaataggca

SEQ ID NO: 103170 - DNA, 22 bp, Artificial Sequence
  chemically synthesized
tctagaataggcaaattcatag

SEQ ID NO: 103171 - DNA, 22 bp, Artificial Sequence
  chemically synthesized
gaataggcaaattcatagagac

SEQ ID NO: 103172 - DNA, 22 bp, Artificial Sequence
  chemically synthesized
atagagacaaaaagtagattag

SEQ ID NO: 103173 - DNA, 22 bp, Artificial Sequence
  chemically synthesized
gaagttaccagagtgtaggaag

SEQ ID NO: 103174 - DNA, 22 bp, Artificial Sequence
  chemically synthesized
ccagagtgtaggaagaacatgg

SEQ ID NO: 103175 - DNA, 22 bp, Artificial Sequence
  chemically synthesized
gggagtaactgattaatcaata

SEQ ID NO: 103176 - DNA, 22 bp, Artificial Sequence
  chemically synthesized
attaatcaatatagagttttta

SEQ ID NO: 103177 - DNA, 22 bp, Artificial Sequence
  chemically synthesized
atcaatatagagtttttatttg

SEQ ID NO: 103178 - DNA, 22 bp, Artificial Sequence
  chemically synthesized
ttatttggtgtaatacaaaatt

SEQ ID NO: 103179 - DNA, 22 bp, Artificial Sequence
  chemically synthesized
tatttggtgtaatacaaaattt

SEQ ID NO: 103180 - DNA, 22 bp, Artificial Sequence
  chemically synthesized
atttggtgtaatacaaaatttt

SEQ ID NO: 103181 - DNA, 22 bp, Artificial Sequence
  chemically synthesized
tttggtgtaatacaaaatttta

SEQ ID NO: 103182 - DNA, 22 bp, Artificial Sequence
  chemically synthesized
ggtgtaatacaaaattttagaa

SEQ ID NO: 103183 - DNA, 22 bp, Artificial Sequence
  chemically synthesized
gtgtaatacaaaattttagaaa

SEQ ID NO: 103184 - DNA, 22 bp, Artificial Sequence
  chemically synthesized
tagaaatagtggtggtgattgc

SEQ ID NO: 103185 - DNA, 22 bp, Artificial Sequence
  chemically synthesized
agaaatagtggtggtgattgca

SEQ ID NO: 103186 - DNA, 22 bp, Artificial Sequence
  chemically synthesized
gaaatagtggtggtgattgcac

SEQ ID NO: 103187 - DNA, 22 bp, Artificial Sequence
  chemically synthesized
cacaacatggcaaatgtaataa

SEQ ID NO: 103188 - DNA, 22 bp, Artificial Sequence
  chemically synthesized
cattatacattataaaaaggct

SEQ ID NO: 103189 - DNA, 22 bp, Artificial Sequence
  chemically synthesized
tacattataaaaaggctaaagt

SEQ ID NO: 103190 - DNA, 22 bp, Artificial Sequence
  chemically synthesized
taaaaaggctaaagtggcaaat

SEQ ID NO: 103191 - DNA, 22 bp, Artificial Sequence
  chemically synthesized
aagtggcaaattgtatatatta

SEQ ID NO: 103192 - DNA, 22 bp, Artificial Sequence
  chemically synthesized
tatatattaccactataaaaat

SEQ ID NO: 103193 - DNA, 22 bp, Artificial Sequence
  chemically synthesized
ccactataaaaataaaacaata

SEQ ID NO: 103194 - DNA, 22 bp, Artificial Sequence
  chemically synthesized
taaaaataaaacaataaatgta

SEQ ID NO: 103195 - DNA, 22 bp, Artificial Sequence
  chemically synthesized
caattcattaaatttattgtga

SEQ ID NO: 103196 - DNA, 22 bp, Artificial Sequence
  chemically synthesized
aattcattaaatttattgtgaa

SEQ ID NO: 103197 - DNA, 22 bp, Artificial Sequence
  chemically synthesized
attaaatttattgtgaaaggtt

SEQ ID NO: 103198 - DNA, 22 bp, Artificial Sequence
  chemically synthesized
aatttattgtgaaaggtttaaa

SEQ ID NO: 103199 - DNA, 22 bp, Artificial Sequence
  chemically synthesized
attgtgaaaggtttaaaaacaa

SEQ ID NO: 103200 - DNA, 22 bp, Artificial Sequence
  chemically synthesized
ttgtgaaaggtttaaaaacaag

SEQ ID NO: 103201 - DNA, 22 bp, Artificial Sequence
  chemically synthesized
tgaaaggtttaaaaacaagagt

SEQ ID NO: 103202 - DNA, 22 bp, Artificial Sequence
  chemically synthesized
aaaaacaagagtttgaggttaa

SEQ ID NO: 103203 - DNA, 22 bp, Artificial Sequence
  chemically synthesized
aaaacaagagtttgaggttaaa

SEQ ID NO: 103204 - DNA, 22 bp, Artificial Sequence
  chemically synthesized
gaggttaaaaattatgtctaag

SEQ ID NO: 103205 - DNA, 22 bp, Artificial Sequence
  chemically synthesized
aggttaaaaattatgtctaaga

SEQ ID NO: 103206 - DNA, 22 bp, Artificial Sequence
  chemically synthesized
aaaattatgtctaagataaaat

SEQ ID NO: 103207 - DNA, 22 bp, Artificial Sequence
  chemically synthesized
tgtctaagataaaatattaaaa

SEQ ID NO: 103208 - DNA, 22 bp, Artificial Sequence
  chemically synthesized
agataaaatattaaaagattta

SEQ ID NO: 103209 - DNA, 22 bp, Artificial Sequence
  chemically synthesized
aaagatttattccacatgtgca

SEQ ID NO: 103210 - DNA, 22 bp, Artificial Sequence
  chemically synthesized
attccacatgtgcaggtgtcca

SEQ ID NO: 103211 - DNA, 22 bp, Artificial Sequence
  chemically synthesized
ttccacatgtgcaggtgtccac

SEQ ID NO: 103212 - DNA, 22 bp, Artificial Sequence
  chemically synthesized
cacatgtgcaggtgtccacaca

SEQ ID NO: 103213 - DNA, 22 bp, Artificial Sequence
  chemically synthesized
tatatatacatactaggataaa

SEQ ID NO: 103214 - DNA, 22 bp, Artificial Sequence
  chemically synthesized
ggataaagtctcttatatctta

SEQ ID NO: 103215 - DNA, 22 bp, Artificial Sequence
  chemically synthesized
ttatatcttaaagaccatttat

SEQ ID NO: 103216 - DNA, 22 bp, Artificial Sequence
  chemically synthesized
atatcttaaagaccatttattt

SEQ ID NO: 103217 - DNA, 22 bp, Artificial Sequence
  chemically synthesized
tatcttaaagaccatttatttg

SEQ ID NO: 103218 - DNA, 22 bp, Artificial Sequence
  chemically synthesized
aaagaccatttatttgatttta

SEQ ID NO: 103219 - DNA, 22 bp, Artificial Sequence
  chemically synthesized
aagaccatttatttgattttaa

SEQ ID NO: 103220 - DNA, 22 bp, Artificial Sequence
  chemically synthesized
atttgattttaataaatagaat

SEQ ID NO: 103221 - DNA, 22 bp, Artificial Sequence
  chemically synthesized
tttgattttaataaatagaata

SEQ ID NO: 103222 - DNA, 22 bp, Artificial Sequence
  chemically synthesized
gattttaataaatagaatagga

SEQ ID NO: 103223 - DNA, 22 bp, Artificial Sequence
  chemically synthesized
attttaataaatagaataggat

SEQ ID NO: 103224 - DNA, 22 bp, Artificial Sequence
  chemically synthesized
taataaatagaataggatggtt

SEQ ID NO: 103225 - DNA, 22 bp, Artificial Sequence
  chemically synthesized
aataaatagaataggatggttg

SEQ ID NO: 103226 - DNA, 22 bp, Artificial Sequence
  chemically synthesized
ataaatagaataggatggttga

SEQ ID NO: 103227 - DNA, 22 bp, Artificial Sequence
  chemically synthesized
actcaacaatttcacttgagag

SEQ ID NO: 103228 - DNA, 22 bp, Artificial Sequence
  chemically synthesized
aacaatttcacttgagagaaag

SEQ ID NO: 103229 - DNA, 22 bp, Artificial Sequence
  chemically synthesized
cacttgagagaaagaatcaagc

SEQ ID NO: 103230 - DNA, 22 bp, Artificial Sequence
  chemically synthesized
acttgagagaaagaatcaagca

SEQ ID NO: 103231 - DNA, 22 bp, Artificial Sequence
  chemically synthesized
gagagaaagaatcaagcataga

SEQ ID NO: 103232 - DNA, 22 bp, Artificial Sequence
  chemically synthesized
agagaaagaatcaagcatagat

SEQ ID NO: 103233 - DNA, 22 bp, Artificial Sequence
  chemically synthesized
ttttcagttccatatggtcctc

SEQ ID NO: 103234 - DNA, 22 bp, Artificial Sequence
  chemically synthesized
tcagttccatatggtcctcctc

SEQ ID NO: 103235 - DNA, 22 bp, Artificial Sequence
  chemically synthesized
cagttccatatggtcctcctca

SEQ ID NO: 103236 - DNA, 22 bp, Artificial Sequence
  chemically synthesized
agttccatatggtcctcctcaa

SEQ ID NO: 103237 - DNA, 22 bp, Artificial Sequence
  chemically synthesized
catatggtcctcctcaaatatc

SEQ ID NO: 103238 - DNA, 22 bp, Artificial Sequence
  chemically synthesized
ctcaaatatctatgattggaca

SEQ ID NO: 103239 - DNA, 22 bp, Artificial Sequence
  chemically synthesized
aaatatctatgattggacatct

SEQ ID NO: 103240 - DNA, 22 bp, Artificial Sequence
  chemically synthesized
tgattggacatctgtgaaggca

SEQ ID NO: 103241 - DNA, 22 bp, Artificial Sequence
  chemically synthesized
gacatctgtgaaggcatgccgc

SEQ ID NO: 103242 - DNA, 22 bp, Artificial Sequence
  chemically synthesized
tgaaggcatgccgcaaatctag

SEQ ID NO: 103243 - DNA, 22 bp, Artificial Sequence
  chemically synthesized
gggtaactaacataagcactca

SEQ ID NO: 103244 - DNA, 22 bp, Artificial Sequence
  chemically synthesized
acataagcactcatgaaaaaac

SEQ ID NO: 103245 - DNA, 22 bp, Artificial Sequence
  chemically synthesized
atgaaaaaacttcatttttcaa

SEQ ID NO: 103246 - DNA, 22 bp, Artificial Sequence
  chemically synthesized
catttttcaataaattcttgtt

SEQ ID NO: 103247 - DNA, 22 bp, Artificial Sequence
  chemically synthesized
atttttcaataaattcttgtta

SEQ ID NO: 103248 - DNA, 22 bp, Artificial Sequence
  chemically synthesized
ttcaataaattcttgttattta

SEQ ID NO: 103249 - DNA, 22 bp, Artificial Sequence
  chemically synthesized
tcaataaattcttgttatttac

SEQ ID NO: 103250 - DNA, 22 bp, Artificial Sequence
  chemically synthesized
caataaattcttgttatttact

SEQ ID NO: 103251 - DNA, 22 bp, Artificial Sequence
  chemically synthesized
aataaattcttgttatttactc

SEQ ID NO: 103252 - DNA, 22 bp, Artificial Sequence
  chemically synthesized
ttgttatttactcatctggtaa

SEQ ID NO: 103253 - DNA, 22 bp, Artificial Sequence
  chemically synthesized
gttatttactcatctggtaatt

SEQ ID NO: 103254 - DNA, 22 bp, Artificial Sequence
  chemically synthesized
ttatttactcatctggtaattc

SEQ ID NO: 103255 - DNA, 22 bp, Artificial Sequence
  chemically synthesized
tttactcatctggtaattcaga

SEQ ID NO: 103256 - DNA, 22 bp, Artificial Sequence
  chemically synthesized
actcatctggtaattcagaatt

SEQ ID NO: 103257 - DNA, 22 bp, Artificial Sequence
  chemically synthesized
ctcatctggtaattcagaattt

SEQ ID NO: 103258 - DNA, 22 bp, Artificial Sequence
  chemically synthesized
atctggtaattcagaatttagt

SEQ ID NO: 103259 - DNA, 22 bp, Artificial Sequence
  chemically synthesized
gtaattcagaatttagttaatc

SEQ ID NO: 103260 - DNA, 22 bp, Artificial Sequence
  chemically synthesized
agaatttagttaatccatcttc

SEQ ID NO: 103261 - DNA, 22 bp, Artificial Sequence
  chemically synthesized
agttaatccatcttcctattta

SEQ ID NO: 103262 - DNA, 22 bp, Artificial Sequence
  chemically synthesized
gttaatccatcttcctatttat

SEQ ID NO: 103263 - DNA, 22 bp, Artificial Sequence
  chemically synthesized
atccatcttcctatttatgttt

SEQ ID NO: 103264 - DNA, 22 bp, Artificial Sequence
  chemically synthesized
cctatttatgtttgtatcagat

SEQ ID NO: 103265 - DNA, 22 bp, Artificial Sequence
  chemically synthesized
ctatttatgtttgtatcagatt

SEQ ID NO: 103266 - DNA, 22 bp, Artificial Sequence
  chemically synthesized
tttatgtttgtatcagattatc

SEQ ID NO: 103267 - DNA, 22 bp, Artificial Sequence
  chemically synthesized
atgtttgtatcagattatctgg

SEQ ID NO: 103268 - DNA, 22 bp, Artificial Sequence
  chemically synthesized
tgtttgtatcagattatctggc

SEQ ID NO: 103269 - DNA, 22 bp, Artificial Sequence
  chemically synthesized
gtatcagattatctggctctaa

SEQ ID NO: 103270 - DNA, 22 bp, Artificial Sequence
  chemically synthesized
tatcagattatctggctctaac

SEQ ID NO: 103271 - DNA, 22 bp, Artificial Sequence
  chemically synthesized
tctggctctaaccagttgtatc

SEQ ID NO: 103272 - DNA, 22 bp, Artificial Sequence
  chemically synthesized
gctctaaccagttgtatcatat

SEQ ID NO: 103273 - DNA, 22 bp, Artificial Sequence
  chemically synthesized
taaccagttgtatcatataatt

SEQ ID NO: 103274 - DNA, 22 bp, Artificial Sequence
  chemically synthesized
accagttgtatcatataattga

SEQ ID NO: 103275 - DNA, 22 bp, Artificial Sequence
  chemically synthesized
tatcatataattgatatattat

SEQ ID NO: 103276 - DNA, 22 bp, Artificial Sequence
  chemically synthesized
atatattatctcacgtttggca

SEQ ID NO: 103277 - DNA, 22 bp, Artificial Sequence
  chemically synthesized
tctcacgtttggcagtattttt

SEQ ID NO: 103278 - DNA, 22 bp, Artificial Sequence
  chemically synthesized
acgtttggcagtattttttgga

SEQ ID NO: 103279 - DNA, 22 bp, Artificial Sequence
  chemically synthesized
ggcagtattttttggactgcta

SEQ ID NO: 103280 - DNA, 22 bp, Artificial Sequence
  chemically synthesized
gcagtattttttggactgctat

SEQ ID NO: 103281 - DNA, 22 bp, Artificial Sequence
  chemically synthesized
tttggactgctattttaaaact

SEQ ID NO: 103282 - DNA, 22 bp, Artificial Sequence
  chemically synthesized
ttggactgctattttaaaactg

SEQ ID NO: 103283 - DNA, 22 bp, Artificial Sequence
  chemically synthesized
tggactgctattttaaaactgg

SEQ ID NO: 103284 - DNA, 22 bp, Artificial Sequence
  chemically synthesized
ggactgctattttaaaactggg

SEQ ID NO: 103285 - DNA, 22 bp, Artificial Sequence
  chemically synthesized
gactgctattttaaaactgggt

SEQ ID NO: 103286 - DNA, 22 bp, Artificial Sequence
  chemically synthesized
ctattttaaaactgggtctact

SEQ ID NO: 103287 - DNA, 22 bp, Artificial Sequence
  chemically synthesized
ttttaaaactgggtctacttca

SEQ ID NO: 103288 - DNA, 22 bp, Artificial Sequence
  chemically synthesized
taaaactgggtctacttcagtg

SEQ ID NO: 103289 - DNA, 22 bp, Artificial Sequence
  chemically synthesized
aaaactgggtctacttcagtga

SEQ ID NO: 103290 - DNA, 22 bp, Artificial Sequence
  chemically synthesized
aaactgggtctacttcagtgaa

SEQ ID NO: 103291 - DNA, 22 bp, Artificial Sequence
  chemically synthesized
ggtctacttcagtgaatgacac

SEQ ID NO: 103292 - DNA, 22 bp, Artificial Sequence
  chemically synthesized
cttcagtgaatgacacccaaga

SEQ ID NO: 103293 - DNA, 22 bp, Artificial Sequence
  chemically synthesized
cagtgaatgacacccaagaaaa

SEQ ID NO: 103294 - DNA, 22 bp, Artificial Sequence
  chemically synthesized
agtgaatgacacccaagaaaaa

SEQ ID NO: 103295 - DNA, 22 bp, Artificial Sequence
  chemically synthesized
tcctgctttctcctaggatagt

SEQ ID NO: 103296 - DNA, 22 bp, Artificial Sequence
  chemically synthesized
ctttctcctaggatagtgagcc

SEQ ID NO: 103297 - DNA, 22 bp, Artificial Sequence
  chemically synthesized
tctcctaggatagtgagccact

SEQ ID NO: 103298 - DNA, 22 bp, Artificial Sequence
  chemically synthesized
ctcctaggatagtgagccactg

SEQ ID NO: 103299 - DNA, 22 bp, Artificial Sequence
  chemically synthesized
tcctaggatagtgagccactgt

SEQ ID NO: 103300 - DNA, 22 bp, Artificial Sequence
  chemically synthesized
ctaggatagtgagccactgttt

SEQ ID NO: 103301 - DNA, 22 bp, Artificial Sequence
  chemically synthesized
ggatagtgagccactgtttcac

SEQ ID NO: 103302 - DNA, 22 bp, Artificial Sequence
  chemically synthesized
tttcacttattctctgaccttc

SEQ ID NO: 103303 - DNA, 22 bp, Artificial Sequence
  chemically synthesized
cacttattctctgaccttcttt

SEQ ID NO: 103304 - DNA, 22 bp, Artificial Sequence
  chemically synthesized
acttattctctgaccttctttg

SEQ ID NO: 103305 - DNA, 22 bp, Artificial Sequence
  chemically synthesized
attctctgaccttctttgggtg

SEQ ID NO: 103306 - DNA, 22 bp, Artificial Sequence
  chemically synthesized
ttctctgaccttctttgggtgt

SEQ ID NO: 103307 - DNA, 22 bp, Artificial Sequence
  chemically synthesized
tctgaccttctttgggtgtcat

SEQ ID NO: 103308 - DNA, 22 bp, Artificial Sequence
  chemically synthesized
tgaccttctttgggtgtcatct

SEQ ID NO: 103309 - DNA, 22 bp, Artificial Sequence
  chemically synthesized
accttctttgggtgtcatctgc

SEQ ID NO: 103310 - DNA, 22 bp, Artificial Sequence
  chemically synthesized
ctttgggtgtcatctgcttcag

SEQ ID NO: 103311 - DNA, 22 bp, Artificial Sequence
  chemically synthesized
tttgggtgtcatctgcttcagt

SEQ ID NO: 103312 - DNA, 22 bp, Artificial Sequence
  chemically synthesized
tgggtgtcatctgcttcagttt

SEQ ID NO: 103313 - DNA, 22 bp, Artificial Sequence
  chemically synthesized
gggtgtcatctgcttcagtttg

SEQ ID NO: 103314 - DNA, 22 bp, Artificial Sequence
  chemically synthesized
ggtgtcatctgcttcagtttgt

SEQ ID NO: 103315 - DNA, 22 bp, Artificial Sequence
  chemically synthesized
cttcagtttgtttctgttgtct

SEQ ID NO: 103316 - DNA, 22 bp, Artificial Sequence
  chemically synthesized
cagtttgtttctgttgtcttgc

SEQ ID NO: 103317 - DNA, 22 bp, Artificial Sequence
  chemically synthesized
agtttgtttctgttgtcttgca

SEQ ID NO: 103318 - DNA, 22 bp, Artificial Sequence
  chemically synthesized
gtttctgttgtcttgcatctgt

SEQ ID NO: 103319 - DNA, 22 bp, Artificial Sequence
  chemically synthesized
tttctgttgtcttgcatctgta

SEQ ID NO: 103320 - DNA, 22 bp, Artificial Sequence
  chemically synthesized
ctgttgtcttgcatctgtaaat

SEQ ID NO: 103321 - DNA, 22 bp, Artificial Sequence
  chemically synthesized
tgttgtcttgcatctgtaaatt

SEQ ID NO: 103322 - DNA, 22 bp, Artificial Sequence
  chemically synthesized
ttgtcttgcatctgtaaattct

SEQ ID NO: 103323 - DNA, 22 bp, Artificial Sequence
  chemically synthesized
tcttgcatctgtaaattctcat

SEQ ID NO: 103324 - DNA, 22 bp, Artificial Sequence
  chemically synthesized
gcatctgtaaattctcatcatt

SEQ ID NO: 103325 - DNA, 22 bp, Artificial Sequence
  chemically synthesized
catctgtaaattctcatcattt

SEQ ID NO: 103326 - DNA, 22 bp, Artificial Sequence
  chemically synthesized
taaattctcatcattttctgac

SEQ ID NO: 103327 - DNA, 22 bp, Artificial Sequence
  chemically synthesized
tcatcattttctgacatatgtc

SEQ ID NO: 103328 - DNA, 22 bp, Artificial Sequence
  chemically synthesized
atcattttctgacatatgtctt

SEQ ID NO: 103329 - DNA, 22 bp, Artificial Sequence
  chemically synthesized
tctgacatatgtcttgccttta

SEQ ID NO: 103330 - DNA, 22 bp, Artificial Sequence
  chemically synthesized
ctgacatatgtcttgcctttac

SEQ ID NO: 103331 - DNA, 22 bp, Artificial Sequence
  chemically synthesized
tgacatatgtcttgcctttact

SEQ ID NO: 103332 - DNA, 22 bp, Artificial Sequence
  chemically synthesized
acatatgtcttgcctttactat

SEQ ID NO: 103333 - DNA, 22 bp, Artificial Sequence
  chemically synthesized
gcctttactatgactcttcatg

SEQ ID NO: 103334 - DNA, 22 bp, Artificial Sequence
  chemically synthesized
cctttactatgactcttcatga

SEQ ID NO: 103335 - DNA, 22 bp, Artificial Sequence
  chemically synthesized
tactatgactcttcatgatcag

SEQ ID NO: 103336 - DNA, 22 bp, Artificial Sequence
  chemically synthesized
actatgactcttcatgatcagg

SEQ ID NO: 103337 - DNA, 22 bp, Artificial Sequence
  chemically synthesized
ctatgactcttcatgatcaggc

SEQ ID NO: 103338 - DNA, 22 bp, Artificial Sequence
  chemically synthesized
tgactcttcatgatcaggcaaa

SEQ ID NO: 103339 - DNA, 22 bp, Artificial Sequence
  chemically synthesized
ttcatgatcaggcaaaaagaaa

SEQ ID NO: 103340 - DNA, 22 bp, Artificial Sequence
  chemically synthesized
catgatcaggcaaaaagaaata

SEQ ID NO: 103341 - DNA, 22 bp, Artificial Sequence
  chemically synthesized
atgatcaggcaaaaagaaatac

SEQ ID NO: 103342 - DNA, 22 bp, Artificial Sequence
  chemically synthesized
aaatgatttgaatgaatgattt

SEQ ID NO: 103343 - DNA, 22 bp, Artificial Sequence
  chemically synthesized
gaatgaatgatttttttaatta

SEQ ID NO: 103344 - DNA, 22 bp, Artificial Sequence
  chemically synthesized
aatgaatgatttttttaattat

SEQ ID NO: 103345 - DNA, 22 bp, Artificial Sequence
  chemically synthesized
ttttaattattaagctaatatt

SEQ ID NO: 103346 - DNA, 22 bp, Artificial Sequence
  chemically synthesized
tttaattattaagctaatattt

SEQ ID NO: 103347 - DNA, 22 bp, Artificial Sequence
  chemically synthesized
ttaattattaagctaatatttt

SEQ ID NO: 103348 - DNA, 22 bp, Artificial Sequence
  chemically synthesized
taattattaagctaatattttg

SEQ ID NO: 103349 - DNA, 22 bp, Artificial Sequence
  chemically synthesized
aattattaagctaatattttgt

SEQ ID NO: 103350 - DNA, 22 bp, Artificial Sequence
  chemically synthesized
attattaagctaatattttgtt

SEQ ID NO: 103351 - DNA, 22 bp, Artificial Sequence
  chemically synthesized
ttaagctaatattttgttttta

SEQ ID NO: 103352 - DNA, 22 bp, Artificial Sequence
  chemically synthesized
agctaatattttgtttttaaaa

SEQ ID NO: 103353 - DNA, 22 bp, Artificial Sequence
  chemically synthesized
atattttgtttttaaaagtcta

SEQ ID NO: 103354 - DNA, 22 bp, Artificial Sequence
  chemically synthesized
tgtttttaaaagtctagttcta

SEQ ID NO: 103355 - DNA, 22 bp, Artificial Sequence
  chemically synthesized
gtttttaaaagtctagttctac

SEQ ID NO: 103356 - DNA, 22 bp, Artificial Sequence
  chemically synthesized
tttttaaaagtctagttctaca

SEQ ID NO: 103357 - DNA, 22 bp, Artificial Sequence
  chemically synthesized
ttaaaagtctagttctacagtt

SEQ ID NO: 103358 - DNA, 22 bp, Artificial Sequence
  chemically synthesized
taaaagtctagttctacagttt

SEQ ID NO: 103359 - DNA, 22 bp, Artificial Sequence
  chemically synthesized
aaaagtctagttctacagtttg

SEQ ID NO: 103360 - DNA, 22 bp, Artificial Sequence
  chemically synthesized
aaagtctagttctacagtttga

SEQ ID NO: 103361 - DNA, 22 bp, Artificial Sequence
  chemically synthesized
gttctacagtttgaaatacttc

SEQ ID NO: 103362 - DNA, 22 bp, Artificial Sequence
  chemically synthesized
tacagtttgaaatacttccttc

SEQ ID NO: 103363 - DNA, 22 bp, Artificial Sequence
  chemically synthesized
cagtttgaaatacttccttcaa

SEQ ID NO: 103364 - DNA, 22 bp, Artificial Sequence
  chemically synthesized
gaaatacttccttcaattgctt

SEQ ID NO: 103365 - DNA, 22 bp, Artificial Sequence
  chemically synthesized
aaatacttccttcaattgcttt

SEQ ID NO: 103366 - DNA, 22 bp, Artificial Sequence
  chemically synthesized
ccttcaattgctttcttaaatc

SEQ ID NO: 103367 - DNA, 22 bp, Artificial Sequence
  chemically synthesized
cttcaattgctttcttaaatca

SEQ ID NO: 103368 - DNA, 22 bp, Artificial Sequence
  chemically synthesized
caattgctttcttaaatcacat

SEQ ID NO: 103369 - DNA, 22 bp, Artificial Sequence
  chemically synthesized
aattgctttcttaaatcacatg

SEQ ID NO: 103370 - DNA, 22 bp, Artificial Sequence
  chemically synthesized
ctttcttaaatcacatgtttat

SEQ ID NO: 103371 - DNA, 22 bp, Artificial Sequence
  chemically synthesized
tcttaaatcacatgtttattat

SEQ ID NO: 103372 - DNA, 22 bp, Artificial Sequence
  chemically synthesized
cttaaatcacatgtttattatt

SEQ ID NO: 103373 - DNA, 22 bp, Artificial Sequence
  chemically synthesized
ttaaatcacatgtttattattt

SEQ ID NO: 103374 - DNA, 22 bp, Artificial Sequence
  chemically synthesized
aaatcacatgtttattattttg

SEQ ID NO: 103375 - DNA, 22 bp, Artificial Sequence
  chemically synthesized
aatcacatgtttattattttga

SEQ ID NO: 103376 - DNA, 22 bp, Artificial Sequence
  chemically synthesized
attattttgactcattctcagt

SEQ ID NO: 103377 - DNA, 22 bp, Artificial Sequence
  chemically synthesized
ttattttgactcattctcagtg

SEQ ID NO: 103378 - DNA, 22 bp, Artificial Sequence
  chemically synthesized
ttttgactcattctcagtgtcc

SEQ ID NO: 103379 - DNA, 22 bp, Artificial Sequence
  chemically synthesized
tgactcattctcagtgtcccac

SEQ ID NO: 103380 - DNA, 22 bp, Artificial Sequence
  chemically synthesized
gactcattctcagtgtcccaca

SEQ ID NO: 103381 - DNA, 22 bp, Artificial Sequence
  chemically synthesized
actcattctcagtgtcccacaa

SEQ ID NO: 103382 - DNA, 22 bp, Artificial Sequence
  chemically synthesized
attctcagtgtcccacaacttt

SEQ ID NO: 103383 - DNA, 22 bp, Artificial Sequence
  chemically synthesized
tcagtgtcccacaactttaaaa

SEQ ID NO: 103384 - DNA, 22 bp, Artificial Sequence
  chemically synthesized
agtgtcccacaactttaaaaat

SEQ ID NO: 103385 - DNA, 22 bp, Artificial Sequence
  chemically synthesized
taaaaattataatgattcttct

SEQ ID NO: 103386 - DNA, 22 bp, Artificial Sequence
  chemically synthesized
aaaaattataatgattcttctt

SEQ ID NO: 103387 - DNA, 22 bp, Artificial Sequence
  chemically synthesized
aaaattataatgattcttctta

SEQ ID NO: 103388 - DNA, 22 bp, Artificial Sequence
  chemically synthesized
taatgattcttcttatttatag

SEQ ID NO: 103389 - DNA, 22 bp, Artificial Sequence
  chemically synthesized
ttcttatttatagacaatacat

SEQ ID NO: 103390 - DNA, 22 bp, Artificial Sequence
  chemically synthesized
cttatttatagacaatacataa

SEQ ID NO: 103391 - DNA, 22 bp, Artificial Sequence
  chemically synthesized
ttatttatagacaatacataat

SEQ ID NO: 103392 - DNA, 22 bp, Artificial Sequence
  chemically synthesized
atttatagacaatacataatca

SEQ ID NO: 103393 - DNA, 22 bp, Artificial Sequence
  chemically synthesized
tttatagacaatacataatcag

SEQ ID NO: 103394 - DNA, 22 bp, Artificial Sequence
  chemically synthesized
atagacaatacataatcagtga

SEQ ID NO: 103395 - DNA, 22 bp, Artificial Sequence
  chemically synthesized
tagacaatacataatcagtgac

SEQ ID NO: 103396 - DNA, 22 bp, Artificial Sequence
  chemically synthesized
cctttcttttggcactgccttt

SEQ ID NO: 103397 - DNA, 22 bp, Artificial Sequence
  chemically synthesized
tcttttggcactgcctttcttc

SEQ ID NO: 103398 - DNA, 22 bp, Artificial Sequence
  chemically synthesized
cttttggcactgcctttcttcc

SEQ ID NO: 103399 - DNA, 22 bp, Artificial Sequence
  chemically synthesized
ttttggcactgcctttcttcca

SEQ ID NO: 103400 - DNA, 22 bp, Artificial Sequence
  chemically synthesized
ttggcactgcctttcttccaag

SEQ ID NO: 103401 - DNA, 22 bp, Artificial Sequence
  chemically synthesized
tggcactgcctttcttccaaga

SEQ ID NO: 103402 - DNA, 22 bp, Artificial Sequence
  chemically synthesized
ggcactgcctttcttccaagaa

SEQ ID NO: 103403 - DNA, 22 bp, Artificial Sequence
  chemically synthesized
gcactgcctttcttccaagaac

SEQ ID NO: 103404 - DNA, 22 bp, Artificial Sequence
  chemically synthesized
cctttcttccaagaacatgtca

SEQ ID NO: 103405 - DNA, 22 bp, Artificial Sequence
  chemically synthesized
tcttccaagaacatgtcagaaa

SEQ ID NO: 103406 - DNA, 22 bp, Artificial Sequence
  chemically synthesized
cttccaagaacatgtcagaaat

SEQ ID NO: 103407 - DNA, 22 bp, Artificial Sequence
  chemically synthesized
ttccaagaacatgtcagaaatt

SEQ ID NO: 103408 - DNA, 22 bp, Artificial Sequence
  chemically synthesized
ccaagaacatgtcagaaattga

SEQ ID NO: 103409 - DNA, 22 bp, Artificial Sequence
  chemically synthesized
caagaacatgtcagaaattgat

SEQ ID NO: 103410 - DNA, 22 bp, Artificial Sequence
  chemically synthesized
atggtgatttttgctcctttcc

SEQ ID NO: 103411 - DNA, 22 bp, Artificial Sequence
  chemically synthesized
ttgctcctttccaactctttct

SEQ ID NO: 103412 - DNA, 22 bp, Artificial Sequence
  chemically synthesized
tgctcctttccaactctttctt

SEQ ID NO: 103413 - DNA, 22 bp, Artificial Sequence
  chemically synthesized
gctcctttccaactctttcttt

SEQ ID NO: 103414 - DNA, 22 bp, Artificial Sequence
  chemically synthesized
ctcctttccaactctttctttc

SEQ ID NO: 103415 - DNA, 22 bp, Artificial Sequence
  chemically synthesized
ctttccaactctttctttcctc

SEQ ID NO: 103416 - DNA, 22 bp, Artificial Sequence
  chemically synthesized
tccaactctttctttcctctgc

SEQ ID NO: 103417 - DNA, 22 bp, Artificial Sequence
  chemically synthesized
ccaactctttctttcctctgct

SEQ ID NO: 103418 - DNA, 22 bp, Artificial Sequence
  chemically synthesized
caactctttctttcctctgctt

SEQ ID NO: 103419 - DNA, 22 bp, Artificial Sequence
  chemically synthesized
tttctttcctctgcttttctaa

SEQ ID NO: 103420 - DNA, 22 bp, Artificial Sequence
  chemically synthesized
tctttcctctgcttttctaaat

SEQ ID NO: 103421 - DNA, 22 bp, Artificial Sequence
  chemically synthesized
ctttcctctgcttttctaaata

SEQ ID NO: 103422 - DNA, 22 bp, Artificial Sequence
  chemically synthesized
tttcctctgcttttctaaataa

SEQ ID NO: 103423 - DNA, 22 bp, Artificial Sequence
  chemically synthesized
tcctctgcttttctaaataacc

SEQ ID NO: 103424 - DNA, 22 bp, Artificial Sequence
  chemically synthesized
cctctgcttttctaaataacct

SEQ ID NO: 103425 - DNA, 22 bp, Artificial Sequence
  chemically synthesized
ctctgcttttctaaataacctg

SEQ ID NO: 103426 - DNA, 22 bp, Artificial Sequence
  chemically synthesized
tgcttttctaaataacctgtaa

SEQ ID NO: 103427 - DNA, 22 bp, Artificial Sequence
  chemically synthesized
cttttctaaataacctgtaaac

SEQ ID NO: 103428 - DNA, 22 bp, Artificial Sequence
  chemically synthesized
ttctaaataacctgtaaacctt

SEQ ID NO: 103429 - DNA, 22 bp, Artificial Sequence
  chemically synthesized
tctaaataacctgtaaacctta

SEQ ID NO: 103430 - DNA, 22 bp, Artificial Sequence
  chemically synthesized
ctaaataacctgtaaaccttat

SEQ ID NO: 103431 - DNA, 22 bp, Artificial Sequence
  chemically synthesized
taaataacctgtaaaccttatt

SEQ ID NO: 103432 - DNA, 22 bp, Artificial Sequence
  chemically synthesized
aataacctgtaaaccttattat

SEQ ID NO: 103433 - DNA, 22 bp, Artificial Sequence
  chemically synthesized
taaaccttattatatttagacc

SEQ ID NO: 103434 - DNA, 22 bp, Artificial Sequence
  chemically synthesized
attatatttagaccttaaatat

SEQ ID NO: 103435 - DNA, 22 bp, Artificial Sequence
  chemically synthesized
ttatatttagaccttaaatatt

SEQ ID NO: 103436 - DNA, 22 bp, Artificial Sequence
  chemically synthesized
tatttagaccttaaatatttgt

SEQ ID NO: 103437 - DNA, 22 bp, Artificial Sequence
  chemically synthesized
agaccttaaatatttgtcatat

SEQ ID NO: 103438 - DNA, 22 bp, Artificial Sequence
  chemically synthesized
gaccttaaatatttgtcatatc

SEQ ID NO: 103439 - DNA, 22 bp, Artificial Sequence
  chemically synthesized
aaatatttgtcatatctctcca

SEQ ID NO: 103440 - DNA, 22 bp, Artificial Sequence
  chemically synthesized
aatatttgtcatatctctccat

SEQ ID NO: 103441 - DNA, 22 bp, Artificial Sequence
  chemically synthesized
gtcatatctctccattaccatt

SEQ ID NO: 103442 - DNA, 22 bp, Artificial Sequence
  chemically synthesized
tcatatctctccattaccattt

SEQ ID NO: 103443 - DNA, 22 bp, Artificial Sequence
  chemically synthesized
tccattaccatttccactttcc

SEQ ID NO: 103444 - DNA, 22 bp, Artificial Sequence
  chemically synthesized
cattaccatttccactttccta

SEQ ID NO: 103445 - DNA, 22 bp, Artificial Sequence
  chemically synthesized
ccatttccactttcctaaattg

SEQ ID NO: 103446 - DNA, 22 bp, Artificial Sequence
  chemically synthesized
ccactttcctaaattgagttac

SEQ ID NO: 103447 - DNA, 22 bp, Artificial Sequence
  chemically synthesized
cactttcctaaattgagttact

SEQ ID NO: 103448 - DNA, 22 bp, Artificial Sequence
  chemically synthesized
tcctaaattgagttactattat

SEQ ID NO: 103449 - DNA, 22 bp, Artificial Sequence
  chemically synthesized
cctaaattgagttactattatc

SEQ ID NO: 103450 - DNA, 22 bp, Artificial Sequence
  chemically synthesized
ctaaattgagttactattatct

SEQ ID NO: 103451 - DNA, 22 bp, Artificial Sequence
  chemically synthesized
aattgagttactattatctttc

SEQ ID NO: 103452 - DNA, 22 bp, Artificial Sequence
  chemically synthesized
agttactattatctttcttcaa

SEQ ID NO: 103453 - DNA, 22 bp, Artificial Sequence
  chemically synthesized
ctattatctttcttcaaattac

SEQ ID NO: 103454 - DNA, 22 bp, Artificial Sequence
  chemically synthesized
ttatctttcttcaaattactct

SEQ ID NO: 103455 - DNA, 22 bp, Artificial Sequence
  chemically synthesized
tctttcttcaaattactctaat

SEQ ID NO: 103456 - DNA, 22 bp, Artificial Sequence
  chemically synthesized
tcttcaaattactctaatattc

SEQ ID NO: 103457 - DNA, 22 bp, Artificial Sequence
  chemically synthesized
cttcaaattactctaatattct

SEQ ID NO: 103458 - DNA, 22 bp, Artificial Sequence
  chemically synthesized
ttcaaattactctaatattctg

SEQ ID NO: 103459 - DNA, 22 bp, Artificial Sequence
  chemically synthesized
caaattactctaatattctgcc

SEQ ID NO: 103460 - DNA, 22 bp, Artificial Sequence
  chemically synthesized
aaattactctaatattctgccc

SEQ ID NO: 103461 - DNA, 22 bp, Artificial Sequence
  chemically synthesized
ctctaatattctgccctttccc

SEQ ID NO: 103462 - DNA, 22 bp, Artificial Sequence
  chemically synthesized
taatattctgccctttccctgc

SEQ ID NO: 103463 - DNA, 22 bp, Artificial Sequence
  chemically synthesized
atattctgccctttccctgcct

SEQ ID NO: 103464 - DNA, 22 bp, Artificial Sequence
  chemically synthesized
tgccctttccctgcctccctca

SEQ ID NO: 103465 - DNA, 22 bp, Artificial Sequence
  chemically synthesized
ccctttccctgcctccctcaat

SEQ ID NO: 103466 - DNA, 22 bp, Artificial Sequence
  chemically synthesized
tccctgcctccctcaattccat

SEQ ID NO: 103467 - DNA, 22 bp, Artificial Sequence
  chemically synthesized
ccctgcctccctcaattccatt

SEQ ID NO: 103468 - DNA, 22 bp, Artificial Sequence
  chemically synthesized
cctgcctccctcaattccattt

SEQ ID NO: 103469 - DNA, 22 bp, Artificial Sequence
  chemically synthesized
cctccctcaattccattttata

SEQ ID NO: 103470 - DNA, 22 bp, Artificial Sequence
  chemically synthesized
cctcaattccattttataaata

SEQ ID NO: 103471 - DNA, 22 bp, Artificial Sequence
  chemically synthesized
aattccattttataaataatat

SEQ ID NO: 103472 - DNA, 22 bp, Artificial Sequence
  chemically synthesized
cattttataaataatattgaag

SEQ ID NO: 103473 - DNA, 22 bp, Artificial Sequence
  chemically synthesized
tataaataatattgaagtaatt

SEQ ID NO: 103474 - DNA, 22 bp, Artificial Sequence
  chemically synthesized
ataaataatattgaagtaattt

SEQ ID NO: 103475 - DNA, 22 bp, Artificial Sequence
  chemically synthesized
taaataatattgaagtaatttt

SEQ ID NO: 103476 - DNA, 22 bp, Artificial Sequence
  chemically synthesized
aagtaattttaaaacatcaatg

SEQ ID NO: 103477 - DNA, 22 bp, Artificial Sequence
  chemically synthesized
taaaacatcaatgaattatgca

SEQ ID NO: 103478 - DNA, 22 bp, Artificial Sequence
  chemically synthesized
aaaacatcaatgaattatgcag

SEQ ID NO: 103479 - DNA, 22 bp, Artificial Sequence
  chemically synthesized
aaacatcaatgaattatgcagc

SEQ ID NO: 103480 - DNA, 22 bp, Artificial Sequence
  chemically synthesized
tgcagcttctttcagtagcttt

SEQ ID NO: 103481 - DNA, 22 bp, Artificial Sequence
  chemically synthesized
ctttcagtagctttccatgact

SEQ ID NO: 103482 - DNA, 22 bp, Artificial Sequence
  chemically synthesized
tttcagtagctttccatgactc

SEQ ID NO: 103483 - DNA, 22 bp, Artificial Sequence
  chemically synthesized
tcagtagctttccatgactccg

SEQ ID NO: 103484 - DNA, 22 bp, Artificial Sequence
  chemically synthesized
cagtagctttccatgactccga

SEQ ID NO: 103485 - DNA, 22 bp, Artificial Sequence
  chemically synthesized
agtagctttccatgactccgag

SEQ ID NO: 103486 - DNA, 22 bp, Artificial Sequence
  chemically synthesized
tccatgactccgagtagagact

SEQ ID NO: 103487 - DNA, 22 bp, Artificial Sequence
  chemically synthesized
ccatgactccgagtagagactc

SEQ ID NO: 103488 - DNA, 22 bp, Artificial Sequence
  chemically synthesized
catgactccgagtagagactca

SEQ ID NO: 103489 - DNA, 22 bp, Artificial Sequence
  chemically synthesized
cgagtagagactcaaactctta

SEQ ID NO: 103490 - DNA, 22 bp, Artificial Sequence
  chemically synthesized
aaactcttatgatgaccaataa

SEQ ID NO: 103491 - DNA, 22 bp, Artificial Sequence
  chemically synthesized
ttatgatgaccaataaggccat

SEQ ID NO: 103492 - DNA, 22 bp, Artificial Sequence
  chemically synthesized
atgatgaccaataaggccattc

SEQ ID NO: 103493 - DNA, 22 bp, Artificial Sequence
  chemically synthesized
tgatgaccaataaggccattcc

SEQ ID NO: 103494 - DNA, 22 bp, Artificial Sequence
  chemically synthesized
cttccctcttcagcctcttctc

SEQ ID NO: 103495 - DNA, 22 bp, Artificial Sequence
  chemically synthesized
ccctcttcagcctcttctcaaa

SEQ ID NO: 103496 - DNA, 22 bp, Artificial Sequence
  chemically synthesized
cctcttcagcctcttctcaaag

SEQ ID NO: 103497 - DNA, 22 bp, Artificial Sequence
  chemically synthesized
ttcagcctcttctcaaagcaaa

SEQ ID NO: 103498 - DNA, 22 bp, Artificial Sequence
  chemically synthesized
cagcctcttctcaaagcaaaca

SEQ ID NO: 103499 - DNA, 22 bp, Artificial Sequence
  chemically synthesized
agcctcttctcaaagcaaacac

SEQ ID NO: 103500 - DNA, 22 bp, Artificial Sequence
  chemically synthesized
ttctcaaagcaaacaccctctt

SEQ ID NO: 103501 - DNA, 22 bp, Artificial Sequence
  chemically synthesized
ctcaaagcaaacaccctcttcc

SEQ ID NO: 103502 - DNA, 22 bp, Artificial Sequence
  chemically synthesized
tcaaagcaaacaccctcttcca

SEQ ID NO: 103503 - DNA, 22 bp, Artificial Sequence
  chemically synthesized
aaagcaaacaccctcttccagt

SEQ ID NO: 103504 - DNA, 22 bp, Artificial Sequence
  chemically synthesized
ttccagtagccaccttccctaa

SEQ ID NO: 103505 - DNA, 22 bp, Artificial Sequence
  chemically synthesized
ccagtagccaccttccctaata

SEQ ID NO: 103506 - DNA, 22 bp, Artificial Sequence
  chemically synthesized
cagtagccaccttccctaatat

SEQ ID NO: 103507 - DNA, 22 bp, Artificial Sequence
  chemically synthesized
ccctaatataaaccaacctagc

SEQ ID NO: 103508 - DNA, 22 bp, Artificial Sequence
  chemically synthesized
cctaatataaaccaacctagct

SEQ ID NO: 103509 - DNA, 22 bp, Artificial Sequence
  chemically synthesized
atataaaccaacctagctgagg

SEQ ID NO: 103510 - DNA, 22 bp, Artificial Sequence
  chemically synthesized
gctgaggtctccacacacactc

SEQ ID NO: 103511 - DNA, 22 bp, Artificial Sequence
  chemically synthesized
aggtctccacacacactccttc

SEQ ID NO: 103512 - DNA, 22 bp, Artificial Sequence
  chemically synthesized
cacacacactccttcagtctta

SEQ ID NO: 103513 - DNA, 22 bp, Artificial Sequence
  chemically synthesized
cttcagtcttagaatattcttg

SEQ ID NO: 103514 - DNA, 22 bp, Artificial Sequence
  chemically synthesized
cagtcttagaatattcttgtct

SEQ ID NO: 103515 - DNA, 22 bp, Artificial Sequence
  chemically synthesized
agtcttagaatattcttgtctg

SEQ ID NO: 103516 - DNA, 22 bp, Artificial Sequence
  chemically synthesized
agaatattcttgtctgtatttt

SEQ ID NO: 103517 - DNA, 22 bp, Artificial Sequence
  chemically synthesized
gaatattcttgtctgtattttc

SEQ ID NO: 103518 - DNA, 22 bp, Artificial Sequence
  chemically synthesized
ttgtctgtattttcaccagtta

SEQ ID NO: 103519 - DNA, 22 bp, Artificial Sequence
  chemically synthesized
gtctgtattttcaccagttagt

SEQ ID NO: 103520 - DNA, 22 bp, Artificial Sequence
  chemically synthesized
tctgtattttcaccagttagtt

SEQ ID NO: 103521 - DNA, 22 bp, Artificial Sequence
  chemically synthesized
tattttcaccagttagtttcta

SEQ ID NO: 103522 - DNA, 22 bp, Artificial Sequence
  chemically synthesized
tcaccagttagtttctaatcca

SEQ ID NO: 103523 - DNA, 22 bp, Artificial Sequence
  chemically synthesized
caccagttagtttctaatccat

SEQ ID NO: 103524 - DNA, 22 bp, Artificial Sequence
  chemically synthesized
accagttagtttctaatccatt

SEQ ID NO: 103525 - DNA, 22 bp, Artificial Sequence
  chemically synthesized
gtttctaatccattttcaggtc

SEQ ID NO: 103526 - DNA, 22 bp, Artificial Sequence
  chemically synthesized
ctaatccattttcaggtctcag

SEQ ID NO: 103527 - DNA, 22 bp, Artificial Sequence
  chemically synthesized
taatccattttcaggtctcagc

SEQ ID NO: 103528 - DNA, 22 bp, Artificial Sequence
  chemically synthesized
atccattttcaggtctcagctg

SEQ ID NO: 103529 - DNA, 22 bp, Artificial Sequence
  chemically synthesized
tcaggtctcagctgaagggaca

SEQ ID NO: 103530 - DNA, 22 bp, Artificial Sequence
  chemically synthesized
caggtctcagctgaagggacac

SEQ ID NO: 103531 - DNA, 22 bp, Artificial Sequence
  chemically synthesized
aggtctcagctgaagggacact

SEQ ID NO: 103532 - DNA, 22 bp, Artificial Sequence
  chemically synthesized
agctgaagggacactttctcag

SEQ ID NO: 103533 - DNA, 22 bp, Artificial Sequence
  chemically synthesized
aagggacactttctcagggaat

SEQ ID NO: 103534 - DNA, 22 bp, Artificial Sequence
  chemically synthesized
tctcagggaatcttacccttat

SEQ ID NO: 103535 - DNA, 22 bp, Artificial Sequence
  chemically synthesized
ctcagggaatcttacccttatt

SEQ ID NO: 103536 - DNA, 22 bp, Artificial Sequence
  chemically synthesized
tcagggaatcttacccttattt

SEQ ID NO: 103537 - DNA, 22 bp, Artificial Sequence
  chemically synthesized
agggaatcttacccttatttca

SEQ ID NO: 103538 - DNA, 22 bp, Artificial Sequence
  chemically synthesized
acccttatttcaagccataacc

SEQ ID NO: 103539 - DNA, 22 bp, Artificial Sequence
  chemically synthesized
cccttatttcaagccataacct

SEQ ID NO: 103540 - DNA, 22 bp, Artificial Sequence
  chemically synthesized
atttcaagccataacctcaagc

SEQ ID NO: 103541 - DNA, 22 bp, Artificial Sequence
  chemically synthesized
tttcaagccataacctcaagcc

SEQ ID NO: 103542 - DNA, 22 bp, Artificial Sequence
  chemically synthesized
caagccataacctcaagccttt

SEQ ID NO: 103543 - DNA, 22 bp, Artificial Sequence
  chemically synthesized
aagccataacctcaagcctttt

SEQ ID NO: 103544 - DNA, 22 bp, Artificial Sequence
  chemically synthesized
aagccttttttgagacccacac

SEQ ID NO: 103545 - DNA, 22 bp, Artificial Sequence
  chemically synthesized
ttttgagacccacactctccat

SEQ ID NO: 103546 - DNA, 22 bp, Artificial Sequence
  chemically synthesized
tttgagacccacactctccatt

SEQ ID NO: 103547 - DNA, 22 bp, Artificial Sequence
  chemically synthesized
ttgagacccacactctccattc

SEQ ID NO: 103548 - DNA, 22 bp, Artificial Sequence
  chemically synthesized
tgagacccacactctccattca

SEQ ID NO: 103549 - DNA, 22 bp, Artificial Sequence
  chemically synthesized
gagacccacactctccattcag

SEQ ID NO: 103550 - DNA, 22 bp, Artificial Sequence
  chemically synthesized
agacccacactctccattcagt

SEQ ID NO: 103551 - DNA, 22 bp, Artificial Sequence
  chemically synthesized
tccattcagtgtcttctttctg

SEQ ID NO: 103552 - DNA, 22 bp, Artificial Sequence
  chemically synthesized
cattcagtgtcttctttctgct

SEQ ID NO: 103553 - DNA, 22 bp, Artificial Sequence
  chemically synthesized
agtgtcttctttctgctttatg

SEQ ID NO: 103554 - DNA, 22 bp, Artificial Sequence
  chemically synthesized
ctttctgctttatgattaatca

SEQ ID NO: 103555 - DNA, 22 bp, Artificial Sequence
  chemically synthesized
tttctgctttatgattaatcac

SEQ ID NO: 103556 - DNA, 22 bp, Artificial Sequence
  chemically synthesized
tctgctttatgattaatcacag

SEQ ID NO: 103557 - DNA, 22 bp, Artificial Sequence
  chemically synthesized
ctgctttatgattaatcacagc

SEQ ID NO: 103558 - DNA, 22 bp, Artificial Sequence
  chemically synthesized
tgctttatgattaatcacagca

SEQ ID NO: 103559 - DNA, 22 bp, Artificial Sequence
  chemically synthesized
ctttatgattaatcacagcact

SEQ ID NO: 103560 - DNA, 22 bp, Artificial Sequence
  chemically synthesized
tatgattaatcacagcacttgt

SEQ ID NO: 103561 - DNA, 22 bp, Artificial Sequence
  chemically synthesized
atgattaatcacagcacttgtt

SEQ ID NO: 103562 - DNA, 22 bp, Artificial Sequence
  chemically synthesized
tgattaatcacagcacttgttt

SEQ ID NO: 103563 - DNA, 22 bp, Artificial Sequence
  chemically synthesized
atcacagcacttgttttaaatt

SEQ ID NO: 103564 - DNA, 22 bp, Artificial Sequence
  chemically synthesized
gttttaaatttggatttctttt

SEQ ID NO: 103565 - DNA, 22 bp, Artificial Sequence
  chemically synthesized
ttttaaatttggatttctttta

SEQ ID NO: 103566 - DNA, 22 bp, Artificial Sequence
  chemically synthesized
taaatttggatttcttttattc

SEQ ID NO: 103567 - DNA, 22 bp, Artificial Sequence
  chemically synthesized
aaatttggatttcttttattct

SEQ ID NO: 103568 - DNA, 22 bp, Artificial Sequence
  chemically synthesized
aatttggatttcttttattctt

SEQ ID NO: 103569 - DNA, 22 bp, Artificial Sequence
  chemically synthesized
ggatttcttttattctttgagt

SEQ ID NO: 103570 - DNA, 22 bp, Artificial Sequence
  chemically synthesized
gatttcttttattctttgagtc

SEQ ID NO: 103571 - DNA, 22 bp, Artificial Sequence
  chemically synthesized
cttttattctttgagtccccac

SEQ ID NO: 103572 - DNA, 22 bp, Artificial Sequence
  chemically synthesized
ttttattctttgagtccccact

SEQ ID NO: 103573 - DNA, 22 bp, Artificial Sequence
  chemically synthesized
ttattctttgagtccccactta

SEQ ID NO: 103574 - DNA, 22 bp, Artificial Sequence
  chemically synthesized
tattctttgagtccccacttat

SEQ ID NO: 103575 - DNA, 22 bp, Artificial Sequence
  chemically synthesized
attctttgagtccccacttatt

SEQ ID NO: 103576 - DNA, 22 bp, Artificial Sequence
  chemically synthesized
ttctttgagtccccacttattt

SEQ ID NO: 103577 - DNA, 22 bp, Artificial Sequence
  chemically synthesized
tttgagtccccacttatttgaa

SEQ ID NO: 103578 - DNA, 22 bp, Artificial Sequence
  chemically synthesized
tgagtccccacttatttgaaga

SEQ ID NO: 103579 - DNA, 22 bp, Artificial Sequence
  chemically synthesized
gagtccccacttatttgaagac

SEQ ID NO: 103580 - DNA, 22 bp, Artificial Sequence
  chemically synthesized
agtccccacttatttgaagact

SEQ ID NO: 103581 - DNA, 22 bp, Artificial Sequence
  chemically synthesized
atttgaagactttaagaagaaa

SEQ ID NO: 103582 - DNA, 22 bp, Artificial Sequence
  chemically synthesized
tttgaagactttaagaagaaaa

SEQ ID NO: 103583 - DNA, 22 bp, Artificial Sequence
  chemically synthesized
gaagactttaagaagaaaagtt

SEQ ID NO: 103584 - DNA, 22 bp, Artificial Sequence
  chemically synthesized
aagactttaagaagaaaagttt

SEQ ID NO: 103585 - DNA, 22 bp, Artificial Sequence
  chemically synthesized
taagaagaaaagtttgtctatt

SEQ ID NO: 103586 - DNA, 22 bp, Artificial Sequence
  chemically synthesized
aagaagaaaagtttgtctattt

SEQ ID NO: 103587 - DNA, 22 bp, Artificial Sequence
  chemically synthesized
agaagaaaagtttgtctatttg

SEQ ID NO: 103588 - DNA, 22 bp, Artificial Sequence
  chemically synthesized
gtctatttgctctcttatatca

SEQ ID NO: 103589 - DNA, 22 bp, Artificial Sequence
  chemically synthesized
tctatttgctctcttatatcat

SEQ ID NO: 103590 - DNA, 22 bp, Artificial Sequence
  chemically synthesized
tttgctctcttatatcattttt

SEQ ID NO: 103591 - DNA, 22 bp, Artificial Sequence
  chemically synthesized
gctctcttatatcatttttgct

SEQ ID NO: 103592 - DNA, 22 bp, Artificial Sequence
  chemically synthesized
ctctcttatatcatttttgctt

SEQ ID NO: 103593 - DNA, 22 bp, Artificial Sequence
  chemically synthesized
tcttatatcatttttgcttagc

SEQ ID NO: 103594 - DNA, 22 bp, Artificial Sequence
  chemically synthesized
ttatatcatttttgcttagcaa

SEQ ID NO: 103595 - DNA, 22 bp, Artificial Sequence
  chemically synthesized
atatcatttttgcttagcaagg

SEQ ID NO: 103596 - DNA, 22 bp, Artificial Sequence
  chemically synthesized
tatcatttttgcttagcaaggt

SEQ ID NO: 103597 - DNA, 22 bp, Artificial Sequence
  chemically synthesized
ttgcttagcaaggtgacccata

SEQ ID NO: 103598 - DNA, 22 bp, Artificial Sequence
  chemically synthesized
tgcttagcaaggtgacccataa

SEQ ID NO: 103599 - DNA, 22 bp, Artificial Sequence
  chemically synthesized
gcttagcaaggtgacccataat

SEQ ID NO: 103600 - DNA, 22 bp, Artificial Sequence
  chemically synthesized
cttagcaaggtgacccataata

SEQ ID NO: 103601 - DNA, 22 bp, Artificial Sequence
  chemically synthesized
agcaaggtgacccataatagtg

SEQ ID NO: 103602 - DNA, 22 bp, Artificial Sequence
  chemically synthesized
gcaaggtgacccataatagtgc

SEQ ID NO: 103603 - DNA, 22 bp, Artificial Sequence
  chemically synthesized
aaaaaattaaccaaaggaatga

SEQ ID NO: 103604 - DNA, 22 bp, Artificial Sequence
  chemically synthesized
aaaaattaaccaaaggaatgat

SEQ ID NO: 103605 - DNA, 22 bp, Artificial Sequence
  chemically synthesized
accaaaggaatgattaaatatt

SEQ ID NO: 103606 - DNA, 22 bp, Artificial Sequence
  chemically synthesized
aatattagtggtgtttccacga

SEQ ID NO: 103607 - DNA, 22 bp, Artificial Sequence
  chemically synthesized
gtggtgtttccacgaaaatagg

SEQ ID NO: 103608 - DNA, 22 bp, Artificial Sequence
  chemically synthesized
ccacgaaaataggcacatgagg

SEQ ID NO: 103609 - DNA, 22 bp, Artificial Sequence
  chemically synthesized
cacgaaaataggcacatgagga

SEQ ID NO: 103610 - DNA, 22 bp, Artificial Sequence
  chemically synthesized
aaagtcctactctcctccaaac

SEQ ID NO: 103611 - DNA, 22 bp, Artificial Sequence
  chemically synthesized
aagtcctactctcctccaaaca

SEQ ID NO: 103612 - DNA, 22 bp, Artificial Sequence
  chemically synthesized
ctctcctccaaacacaaaccct

SEQ ID NO: 103613 - DNA, 22 bp, Artificial Sequence
  chemically synthesized
tcctccaaacacaaaccctttt

SEQ ID NO: 103614 - DNA, 22 bp, Artificial Sequence
  chemically synthesized
ctccaaacacaaacccttttaa

SEQ ID NO: 103615 - DNA, 22 bp, Artificial Sequence
  chemically synthesized
caaacacaaacccttttaaaca

SEQ ID NO: 103616 - DNA, 22 bp, Artificial Sequence
  chemically synthesized
ttaaacataggatatgtacaaa

SEQ ID NO: 103617 - DNA, 22 bp, Artificial Sequence
  chemically synthesized
taaacataggatatgtacaaat

SEQ ID NO: 103618 - DNA, 22 bp, Artificial Sequence
  chemically synthesized
aaacataggatatgtacaaata

SEQ ID NO: 103619 - DNA, 22 bp, Artificial Sequence
  chemically synthesized
aacataggatatgtacaaataa

SEQ ID NO: 103620 - DNA, 22 bp, Artificial Sequence
  chemically synthesized
ggcaaaagtataagaaaaagat

SEQ ID NO: 103621 - DNA, 22 bp, Artificial Sequence
  chemically synthesized
aagtcagcaagggctttgatag

SEQ ID NO: 103622 - DNA, 22 bp, Artificial Sequence
  chemically synthesized
tgatagtatggctccaatactt

SEQ ID NO: 103623 - DNA, 22 bp, Artificial Sequence
  chemically synthesized
gatagtatggctccaatacttc

SEQ ID NO: 103624 - DNA, 22 bp, Artificial Sequence
  chemically synthesized
atagtatggctccaatacttca

SEQ ID NO: 103625 - DNA, 22 bp, Artificial Sequence
  chemically synthesized
caatacttcagtagataaagta

SEQ ID NO: 103626 - DNA, 22 bp, Artificial Sequence
  chemically synthesized
cagtagataaagtaaataataa

SEQ ID NO: 103627 - DNA, 22 bp, Artificial Sequence
  chemically synthesized
agtagataaagtaaataataaa

SEQ ID NO: 103628 - DNA, 22 bp, Artificial Sequence
  chemically synthesized
ttaaattgtgtatatagcaaga

SEQ ID NO: 103629 - DNA, 22 bp, Artificial Sequence
  chemically synthesized
taaattgtgtatatagcaagac

SEQ ID NO: 103630 - DNA, 22 bp, Artificial Sequence
  chemically synthesized
aaattgtgtatatagcaagaca

SEQ ID NO: 103631 - DNA, 22 bp, Artificial Sequence
  chemically synthesized
aattgtgtatatagcaagacaa

SEQ ID NO: 103632 - DNA, 22 bp, Artificial Sequence
  chemically synthesized
tgtatatagcaagacaaacaga

SEQ ID NO: 103633 - DNA, 22 bp, Artificial Sequence
  chemically synthesized
ggaaaatacgtacactaaaaat

SEQ ID NO: 103634 - DNA, 22 bp, Artificial Sequence
  chemically synthesized
aaaataaaacactagagataat

SEQ ID NO: 103635 - DNA, 22 bp, Artificial Sequence
  chemically synthesized
gagataatacataataaacttc

SEQ ID NO: 103636 - DNA, 22 bp, Artificial Sequence
  chemically synthesized
cttaaaatcaattataaaagga

SEQ ID NO: 103637 - DNA, 22 bp, Artificial Sequence
  chemically synthesized
ttaaaatcaattataaaaggat

SEQ ID NO: 103638 - DNA, 22 bp, Artificial Sequence
  chemically synthesized
aaaatcaattataaaaggatga

SEQ ID NO: 103639 - DNA, 22 bp, Artificial Sequence
  chemically synthesized
aaatcaattataaaaggatgaa

SEQ ID NO: 103640 - DNA, 22 bp, Artificial Sequence
  chemically synthesized
taaaaggatgaaaattagcaaa

SEQ ID NO: 103641 - DNA, 22 bp, Artificial Sequence
  chemically synthesized
gcaaaatatatgatcaaataaa

SEQ ID NO: 103642 - DNA, 22 bp, Artificial Sequence
  chemically synthesized
gtgagatttccaagttgctgca

SEQ ID NO: 103643 - DNA, 22 bp, Artificial Sequence
  chemically synthesized
ccaagttgctgcaacaaattga

SEQ ID NO: 103644 - DNA, 22 bp, Artificial Sequence
  chemically synthesized
caagttgctgcaacaaattgag

SEQ ID NO: 103645 - DNA, 22 bp, Artificial Sequence
  chemically synthesized
ctgcaacaaattgagatcactt

SEQ ID NO: 103646 - DNA, 22 bp, Artificial Sequence
  chemically synthesized
caacaaattgagatcacttgtg

SEQ ID NO: 103647 - DNA, 22 bp, Artificial Sequence
  chemically synthesized
agatcacttgtgatttattaga

SEQ ID NO: 103648 - DNA, 22 bp, Artificial Sequence
  chemically synthesized
gtgatttattagaataaaaaat

SEQ ID NO: 103649 - DNA, 22 bp, Artificial Sequence
  chemically synthesized
tgatttattagaataaaaaata

SEQ ID NO: 103650 - DNA, 22 bp, Artificial Sequence
  chemically synthesized
attagaataaaaaataaattga

SEQ ID NO: 103651 - DNA, 22 bp, Artificial Sequence
  chemically synthesized
ttagaataaaaaataaattgaa

SEQ ID NO: 103652 - DNA, 22 bp, Artificial Sequence
  chemically synthesized
gaataaaaaataaattgaatat

SEQ ID NO: 103653 - DNA, 22 bp, Artificial Sequence
  chemically synthesized
aatatacaaaaaggaaaatatc

SEQ ID NO: 103654 - DNA, 22 bp, Artificial Sequence
  chemically synthesized
tatttcatctattggacatatc

SEQ ID NO: 103655 - DNA, 22 bp, Artificial Sequence
  chemically synthesized
catctattggacatatcagaaa

SEQ ID NO: 103656 - DNA, 22 bp, Artificial Sequence
  chemically synthesized
atctattggacatatcagaaat

SEQ ID NO: 103657 - DNA, 22 bp, Artificial Sequence
  chemically synthesized
ttggacatatcagaaatgtttc

SEQ ID NO: 103658 - DNA, 22 bp, Artificial Sequence
  chemically synthesized
gacatatcagaaatgtttctat

SEQ ID NO: 103659 - DNA, 22 bp, Artificial Sequence
  chemically synthesized
ctatccagcatttagagagaac

SEQ ID NO: 103660 - DNA, 22 bp, Artificial Sequence
  chemically synthesized
tatccagcatttagagagaaca

SEQ ID NO: 103661 - DNA, 22 bp, Artificial Sequence
  chemically synthesized
tccagcatttagagagaacaca

SEQ ID NO: 103662 - DNA, 22 bp, Artificial Sequence
  chemically synthesized
agagagaacacaagatcaaaag

SEQ ID NO: 103663 - DNA, 22 bp, Artificial Sequence
  chemically synthesized
gagagaacacaagatcaaaaga

SEQ ID NO: 103664 - DNA, 22 bp, Artificial Sequence
  chemically synthesized
actcatgaaatgagcaactagg

SEQ ID NO: 103665 - DNA, 22 bp, Artificial Sequence
  chemically synthesized
atgaaatgagcaactaggaaat

SEQ ID NO: 103666 - DNA, 22 bp, Artificial Sequence
  chemically synthesized
ggaaatttatgaatttagagag

SEQ ID NO: 103667 - DNA, 22 bp, Artificial Sequence
  chemically synthesized
atgaatttagagagtctctact

SEQ ID NO: 103668 - DNA, 22 bp, Artificial Sequence
  chemically synthesized
tgaatttagagagtctctactg

SEQ ID NO: 103669 - DNA, 22 bp, Artificial Sequence
  chemically synthesized
agagagtctctactgtaaaact

SEQ ID NO: 103670 - DNA, 22 bp, Artificial Sequence
  chemically synthesized
gagagtctctactgtaaaactt

SEQ ID NO: 103671 - DNA, 22 bp, Artificial Sequence
  chemically synthesized
tactgtaaaactttatagatga

SEQ ID NO: 103672 - DNA, 22 bp, Artificial Sequence
  chemically synthesized
ctgtaaaactttatagatgaca

SEQ ID NO: 103673 - DNA, 22 bp, Artificial Sequence
  chemically synthesized
taaaactttatagatgacattg

SEQ ID NO: 103674 - DNA, 22 bp, Artificial Sequence
  chemically synthesized
tatagatgacattgtatcattt

SEQ ID NO: 103675 - DNA, 22 bp, Artificial Sequence
  chemically synthesized
atagatgacattgtatcatttt

SEQ ID NO: 103676 - DNA, 22 bp, Artificial Sequence
  chemically synthesized
tagatgacattgtatcattttg

SEQ ID NO: 103677 - DNA, 22 bp, Artificial Sequence
  chemically synthesized
tatcattttgaaagaaaactca

SEQ ID NO: 103678 - DNA, 22 bp, Artificial Sequence
  chemically synthesized
tgaaagaaaactcaagacacca

SEQ ID NO: 103679 - DNA, 22 bp, Artificial Sequence
  chemically synthesized
gaaagaaaactcaagacaccaa

SEQ ID NO: 103680 - DNA, 22 bp, Artificial Sequence
  chemically synthesized
aaagaaaactcaagacaccaaa

SEQ ID NO: 103681 - DNA, 22 bp, Artificial Sequence
  chemically synthesized
aagacaccaaaagcaactgcaa

SEQ ID NO: 103682 - DNA, 22 bp, Artificial Sequence
  chemically synthesized
caaaaaaaaattgacaaatggg

SEQ ID NO: 103683 - DNA, 22 bp, Artificial Sequence
  chemically synthesized
acaaatgggatctaattaaatt

SEQ ID NO: 103684 - DNA, 22 bp, Artificial Sequence
  chemically synthesized
attaaattaaagagcttctgca

SEQ ID NO: 103685 - DNA, 22 bp, Artificial Sequence
  chemically synthesized
aattaaagagcttctgcacagc

SEQ ID NO: 103686 - DNA, 22 bp, Artificial Sequence
  chemically synthesized
aagagcttctgcacagcaaaag

SEQ ID NO: 103687 - DNA, 22 bp, Artificial Sequence
  chemically synthesized
ctgcacagcaaaagaaactatc

SEQ ID NO: 103688 - DNA, 22 bp, Artificial Sequence
  chemically synthesized
tgcacagcaaaagaaactatca

SEQ ID NO: 103689 - DNA, 22 bp, Artificial Sequence
  chemically synthesized
cacagcaaaagaaactatcatc

SEQ ID NO: 103690 - DNA, 22 bp, Artificial Sequence
  chemically synthesized
tcatcagagataacagacaacc

SEQ ID NO: 103691 - DNA, 22 bp, Artificial Sequence
  chemically synthesized
cagaatagaagaaaatttttgc

SEQ ID NO: 103692 - DNA, 22 bp, Artificial Sequence
  chemically synthesized
ttgcaatttctccatctgacaa

SEQ ID NO: 103693 - DNA, 22 bp, Artificial Sequence
  chemically synthesized
tgcaatttctccatctgacaaa

SEQ ID NO: 103694 - DNA, 22 bp, Artificial Sequence
  chemically synthesized
gcaatttctccatctgacaaaa

SEQ ID NO: 103695 - DNA, 22 bp, Artificial Sequence
  chemically synthesized
caatttctccatctgacaaaag

SEQ ID NO: 103696 - DNA, 22 bp, Artificial Sequence
  chemically synthesized
ctccatctgacaaaagtctaat

SEQ ID NO: 103697 - DNA, 22 bp, Artificial Sequence
  chemically synthesized
tccatctgacaaaagtctaata

SEQ ID NO: 103698 - DNA, 22 bp, Artificial Sequence
  chemically synthesized
catctgacaaaagtctaatatc

SEQ ID NO: 103699 - DNA, 22 bp, Artificial Sequence
  chemically synthesized
acaaaagtctaatatctggagt

SEQ ID NO: 103700 - DNA, 22 bp, Artificial Sequence
  chemically synthesized
atatctggagtctatgaggaac

SEQ ID NO: 103701 - DNA, 22 bp, Artificial Sequence
  chemically synthesized
gagtctatgaggaactaaaaca

SEQ ID NO: 103702 - DNA, 22 bp, Artificial Sequence
  chemically synthesized
tgaggaactaaaacaaatttac

SEQ ID NO: 103703 - DNA, 22 bp, Artificial Sequence
  chemically synthesized
aaacaaatttacaagaaaaaaa

SEQ ID NO: 103704 - DNA, 22 bp, Artificial Sequence
  chemically synthesized
acaagaaaaaaacaaccccatt

SEQ ID NO: 103705 - DNA, 22 bp, Artificial Sequence
  chemically synthesized
caagaaaaaaacaaccccatta

SEQ ID NO: 103706 - DNA, 22 bp, Artificial Sequence
  chemically synthesized
aaaagtggggaatgacatgaat

SEQ ID NO: 103707 - DNA, 22 bp, Artificial Sequence
  chemically synthesized
ctctaaagaagacattcatgct

SEQ ID NO: 103708 - DNA, 22 bp, Artificial Sequence
  chemically synthesized
tctaaagaagacattcatgctt

SEQ ID NO: 103709 - DNA, 22 bp, Artificial Sequence
  chemically synthesized
taaagaagacattcatgcttct

SEQ ID NO: 103710 - DNA, 22 bp, Artificial Sequence
  chemically synthesized
aagaagacattcatgcttctaa

SEQ ID NO: 103711 - DNA, 22 bp, Artificial Sequence
  chemically synthesized
atgcttctaataaacatatgaa

SEQ ID NO: 103712 - DNA, 22 bp, Artificial Sequence
  chemically synthesized
ctaataaacatatgaaaaaaaa

SEQ ID NO: 103713 - DNA, 22 bp, Artificial Sequence
  chemically synthesized
taataaacatatgaaaaaaaaa

SEQ ID NO: 103714 - DNA, 22 bp, Artificial Sequence
  chemically synthesized
ataaacatatgaaaaaaaaaaa

SEQ ID NO: 103715 - DNA, 22 bp, Artificial Sequence
  chemically synthesized
aaccttactggtcattagaaaa

SEQ ID NO: 103716 - DNA, 22 bp, Artificial Sequence
  chemically synthesized
actggtcattagaaaaatgcaa

SEQ ID NO: 103717 - DNA, 22 bp, Artificial Sequence
  chemically synthesized
ctggtcattagaaaaatgcaaa

SEQ ID NO: 103718 - DNA, 22 bp, Artificial Sequence
  chemically synthesized
gtcattagaaaaatgcaaatca

SEQ ID NO: 103719 - DNA, 22 bp, Artificial Sequence
  chemically synthesized
gaaaaatgcaaatcaaaaccac

SEQ ID NO: 103720 - DNA, 22 bp, Artificial Sequence
  chemically synthesized
acaccagtcagaatggcaatta

SEQ ID NO: 103721 - DNA, 22 bp, Artificial Sequence
  chemically synthesized
ttaaaaagtcaagaaacaacag

SEQ ID NO: 103722 - DNA, 22 bp, Artificial Sequence
  chemically synthesized
aaaagtcaagaaacaacagttg

SEQ ID NO: 103723 - DNA, 22 bp, Artificial Sequence
  chemically synthesized
ctggcaaggttgcagagagaaa

SEQ ID NO: 103724 - DNA, 22 bp, Artificial Sequence
  chemically synthesized
gcaaggttgcagagagaaagga

SEQ ID NO: 103725 - DNA, 22 bp, Artificial Sequence
  chemically synthesized
cagagagaaaggaatggaatgc

SEQ ID NO: 103726 - DNA, 22 bp, Artificial Sequence
  chemically synthesized
ttacactgttaacgggagagta

SEQ ID NO: 103727 - DNA, 22 bp, Artificial Sequence
  chemically synthesized
tacactgttaacgggagagtaa

SEQ ID NO: 103728 - DNA, 22 bp, Artificial Sequence
  chemically synthesized
acactgttaacgggagagtaaa

SEQ ID NO: 103729 - DNA, 22 bp, Artificial Sequence
  chemically synthesized
cactgttaacgggagagtaaat

SEQ ID NO: 103730 - DNA, 22 bp, Artificial Sequence
  chemically synthesized
ttaacgggagagtaaattagtt

SEQ ID NO: 103731 - DNA, 22 bp, Artificial Sequence
  chemically synthesized
acgggagagtaaattagttcaa

SEQ ID NO: 103732 - DNA, 22 bp, Artificial Sequence
  chemically synthesized
gttcaaacattgtggaagagag

SEQ ID NO: 103733 - DNA, 22 bp, Artificial Sequence
  chemically synthesized
aaacattgtggaagagagtgta

SEQ ID NO: 103734 - DNA, 22 bp, Artificial Sequence
  chemically synthesized
tggaagagagtgtagcctttcc

SEQ ID NO: 103735 - DNA, 22 bp, Artificial Sequence
  chemically synthesized
tcctcaaagatgtagaagcaga

SEQ ID NO: 103736 - DNA, 22 bp, Artificial Sequence
  chemically synthesized
cctcaaagatgtagaagcagaa

SEQ ID NO: 103737 - DNA, 22 bp, Artificial Sequence
  chemically synthesized
ctcaaagatgtagaagcagaaa

SEQ ID NO: 103738 - DNA, 22 bp, Artificial Sequence
  chemically synthesized
aaagatgtagaagcagaaatac

SEQ ID NO: 103739 - DNA, 22 bp, Artificial Sequence
  chemically synthesized
gactcagcaatctcattactgg

SEQ ID NO: 103740 - DNA, 22 bp, Artificial Sequence
  chemically synthesized
actcagcaatctcattactggg

SEQ ID NO: 103741 - DNA, 22 bp, Artificial Sequence
  chemically synthesized
agcaatctcattactgggtata

SEQ ID NO: 103742 - DNA, 22 bp, Artificial Sequence
  chemically synthesized
attactgggtatatacccaaag

SEQ ID NO: 103743 - DNA, 22 bp, Artificial Sequence
  chemically synthesized
ctgggtatatacccaaaggaat

SEQ ID NO: 103744 - DNA, 22 bp, Artificial Sequence
  chemically synthesized
ggtatatacccaaaggaatata

SEQ ID NO: 103745 - DNA, 22 bp, Artificial Sequence
  chemically synthesized
ttataaaaatacaggcatgctt

SEQ ID NO: 103746 - DNA, 22 bp, Artificial Sequence
  chemically synthesized
taaaaatacaggcatgcttatg

SEQ ID NO: 103747 - DNA, 22 bp, Artificial Sequence
  chemically synthesized
atgttcattgcagcattattca

SEQ ID NO: 103748 - DNA, 22 bp, Artificial Sequence
  chemically synthesized
tgttcattgcagcattattcat

SEQ ID NO: 103749 - DNA, 22 bp, Artificial Sequence
  chemically synthesized
attgcagcattattcataatag

SEQ ID NO: 103750 - DNA, 22 bp, Artificial Sequence
  chemically synthesized
cagcattattcataatagccaa

SEQ ID NO: 103751 - DNA, 22 bp, Artificial Sequence
  chemically synthesized
ttcataatagccaagatgtgga

SEQ ID NO: 103752 - DNA, 22 bp, Artificial Sequence
  chemically synthesized
ataatagccaagatgtggaatc

SEQ ID NO: 103753 - DNA, 22 bp, Artificial Sequence
  chemically synthesized
tacagccataaaaaggaaaagg

SEQ ID NO: 103754 - DNA, 22 bp, Artificial Sequence
  chemically synthesized
tgttccttgcagggacatgaat

SEQ ID NO: 103755 - DNA, 22 bp, Artificial Sequence
  chemically synthesized
cttgcagggacatgaatggagc

SEQ ID NO: 103756 - DNA, 22 bp, Artificial Sequence
  chemically synthesized
gcagggacatgaatggagctgg

SEQ ID NO: 103757 - DNA, 22 bp, Artificial Sequence
  chemically synthesized
cagggacatgaatggagctgga

SEQ ID NO: 103758 - DNA, 22 bp, Artificial Sequence
  chemically synthesized
gaagccattatcctcatcaaac

SEQ ID NO: 103759 - DNA, 22 bp, Artificial Sequence
  chemically synthesized
tcctcatcaaactaacacagga

SEQ ID NO: 103760 - DNA, 22 bp, Artificial Sequence
  chemically synthesized
atcaaactaacacaggaacaga

SEQ ID NO: 103761 - DNA, 22 bp, Artificial Sequence
  chemically synthesized
acacaggaacagaaaaccaaac

SEQ ID NO: 103762 - DNA, 22 bp, Artificial Sequence
  chemically synthesized
tcacacagaaatgggagctgaa

SEQ ID NO: 103763 - DNA, 22 bp, Artificial Sequence
  chemically synthesized
acacagaaatgggagctgaaca

SEQ ID NO: 103764 - DNA, 22 bp, Artificial Sequence
  chemically synthesized
aacagtgagaacacatggacac

SEQ ID NO: 103765 - DNA, 22 bp, Artificial Sequence
  chemically synthesized
gtggggaacaacacacacaggg

SEQ ID NO: 103766 - DNA, 22 bp, Artificial Sequence
  chemically synthesized
tggggaacaacacacacagggg

SEQ ID NO: 103767 - DNA, 22 bp, Artificial Sequence
  chemically synthesized
tccggtagtgggtggggaggag

SEQ ID NO: 103768 - DNA, 22 bp, Artificial Sequence
  chemically synthesized
acgaatgcagcaaacctgcatg

SEQ ID NO: 103769 - DNA, 22 bp, Artificial Sequence
  chemically synthesized
catggcacacatttacctatgt

SEQ ID NO: 103770 - DNA, 22 bp, Artificial Sequence
  chemically synthesized
acctatgtaataaacctgcaca

SEQ ID NO: 103771 - DNA, 22 bp, Artificial Sequence
  chemically synthesized
cctatgtaataaacctgcacat

SEQ ID NO: 103772 - DNA, 22 bp, Artificial Sequence
  chemically synthesized
tgtaataaacctgcacatcctg

SEQ ID NO: 103773 - DNA, 22 bp, Artificial Sequence
  chemically synthesized
cacatcctgcacatgtgccctg

SEQ ID NO: 103774 - DNA, 22 bp, Artificial Sequence
  chemically synthesized
cacatgtgccctggaacttaaa

SEQ ID NO: 103775 - DNA, 22 bp, Artificial Sequence
  chemically synthesized
gaacttaaaatatattatgttg

SEQ ID NO: 103776 - DNA, 22 bp, Artificial Sequence
  chemically synthesized
aaaatatattatgttggtacaa

SEQ ID NO: 103777 - DNA, 22 bp, Artificial Sequence
  chemically synthesized
aaatatattatgttggtacaaa

SEQ ID NO: 103778 - DNA, 22 bp, Artificial Sequence
  chemically synthesized
tgttggtacaaaagtaatttct

SEQ ID NO: 103779 - DNA, 22 bp, Artificial Sequence
  chemically synthesized
gtacaaaagtaatttctgtgaa

SEQ ID NO: 103780 - DNA, 22 bp, Artificial Sequence
  chemically synthesized
ctgtgaactgcaattacctttg

SEQ ID NO: 103781 - DNA, 22 bp, Artificial Sequence
  chemically synthesized
tgtgaactgcaattacctttgc

SEQ ID NO: 103782 - DNA, 22 bp, Artificial Sequence
  chemically synthesized
tgaactgcaattacctttgcac

SEQ ID NO: 103783 - DNA, 22 bp, Artificial Sequence
  chemically synthesized
caattacctttgcacctaccta

SEQ ID NO: 103784 - DNA, 22 bp, Artificial Sequence
  chemically synthesized
cctttgcacctacctaataagt

SEQ ID NO: 103785 - DNA, 22 bp, Artificial Sequence
  chemically synthesized
tgcacctacctaataagttgaa

SEQ ID NO: 103786 - DNA, 22 bp, Artificial Sequence
  chemically synthesized
gcacctacctaataagttgaag

SEQ ID NO: 103787 - DNA, 22 bp, Artificial Sequence
  chemically synthesized
cacctacctaataagttgaagg

SEQ ID NO: 103788 - DNA, 22 bp, Artificial Sequence
  chemically synthesized
cctaataagttgaaggaaaata

SEQ ID NO: 103789 - DNA, 22 bp, Artificial Sequence
  chemically synthesized
ataagttgaaggaaaataaaat

SEQ ID NO: 103790 - DNA, 22 bp, Artificial Sequence
  chemically synthesized
aaggaaaataaaatctatttta

SEQ ID NO: 103791 - DNA, 22 bp, Artificial Sequence
  chemically synthesized
ttttaaaaaaaaaaaaaaaaaa

SEQ ID NO: 103792 - DNA, 22 bp, Artificial Sequence
  chemically synthesized
taaaaaaaaaaaaaaaaaagga

SEQ ID NO: 103793 - DNA, 22 bp, Artificial Sequence
  chemically synthesized
aaaaaaaaaaaaaaaaaaggaa

SEQ ID NO: 103794 - DNA, 22 bp, Artificial Sequence
  chemically synthesized
aaaaaaaaaaaaaaaaaggaaa

SEQ ID NO: 103795 - DNA, 22 bp, Artificial Sequence
  chemically synthesized
ccctgaaatagagtagttttga

SEQ ID NO: 103796 - DNA, 22 bp, Artificial Sequence
  chemically synthesized
aaatagagtagttttgagatta

SEQ ID NO: 103797 - DNA, 22 bp, Artificial Sequence
  chemically synthesized
tgagattatagtagagttccat

SEQ ID NO: 103798 - DNA, 22 bp, Artificial Sequence
  chemically synthesized
gagattatagtagagttccatg

SEQ ID NO: 103799 - DNA, 22 bp, Artificial Sequence
  chemically synthesized
agattatagtagagttccatga

SEQ ID NO: 103800 - DNA, 22 bp, Artificial Sequence
  chemically synthesized
tagtagagttccatgacctcaa

SEQ ID NO: 103801 - DNA, 22 bp, Artificial Sequence
  chemically synthesized
catgacctcaattcacatgcta

SEQ ID NO: 103802 - DNA, 22 bp, Artificial Sequence
  chemically synthesized
aattcacatgctataattcatc

SEQ ID NO: 103803 - DNA, 22 bp, Artificial Sequence
  chemically synthesized
acatgctataattcatctttat

SEQ ID NO: 103804 - DNA, 22 bp, Artificial Sequence
  chemically synthesized
taattcatctttatatggccaa

SEQ ID NO: 103805 - DNA, 22 bp, Artificial Sequence
  chemically synthesized
atctttatatggccaaaactag

SEQ ID NO: 103806 - DNA, 22 bp, Artificial Sequence
  chemically synthesized
tatatggccaaaactagatctg

SEQ ID NO: 103807 - DNA, 22 bp, Artificial Sequence
  chemically synthesized
atatggccaaaactagatctgc

SEQ ID NO: 103808 - DNA, 22 bp, Artificial Sequence
  chemically synthesized
tatggccaaaactagatctgca

SEQ ID NO: 103809 - DNA, 22 bp, Artificial Sequence
  chemically synthesized
gatctgcaattgcacatttttc

SEQ ID NO: 103810 - DNA, 22 bp, Artificial Sequence
  chemically synthesized
caattgcacatttttccttctg

SEQ ID NO: 103811 - DNA, 22 bp, Artificial Sequence
  chemically synthesized
cacatttttccttctgtaggct

SEQ ID NO: 103812 - DNA, 22 bp, Artificial Sequence
  chemically synthesized
ttccttctgtaggctttggttg

SEQ ID NO: 103813 - DNA, 22 bp, Artificial Sequence
  chemically synthesized
tccttctgtaggctttggttga

SEQ ID NO: 103814 - DNA, 22 bp, Artificial Sequence
  chemically synthesized
ccttctgtaggctttggttgaa

SEQ ID NO: 103815 - DNA, 22 bp, Artificial Sequence
  chemically synthesized
cttctgtaggctttggttgaac

SEQ ID NO: 103816 - DNA, 22 bp, Artificial Sequence
  chemically synthesized
ctgtaggctttggttgaactag

SEQ ID NO: 103817 - DNA, 22 bp, Artificial Sequence
  chemically synthesized
tgtaggctttggttgaactaga

SEQ ID NO: 103818 - DNA, 22 bp, Artificial Sequence
  chemically synthesized
taggctttggttgaactagact

SEQ ID NO: 103819 - DNA, 22 bp, Artificial Sequence
  chemically synthesized
tggttgaactagactggccact

SEQ ID NO: 103820 - DNA, 22 bp, Artificial Sequence
  chemically synthesized
ggttgaactagactggccactt

SEQ ID NO: 103821 - DNA, 22 bp, Artificial Sequence
  chemically synthesized
gttgaactagactggccacttg

SEQ ID NO: 103822 - DNA, 22 bp, Artificial Sequence
  chemically synthesized
aactagactggccacttgactc

SEQ ID NO: 103823 - DNA, 22 bp, Artificial Sequence
  chemically synthesized
gactggccacttgactcttcct

SEQ ID NO: 103824 - DNA, 22 bp, Artificial Sequence
  chemically synthesized
gccacttgactcttcctaaaat

SEQ ID NO: 103825 - DNA, 22 bp, Artificial Sequence
  chemically synthesized
gactcttcctaaaatggtactt

SEQ ID NO: 103826 - DNA, 22 bp, Artificial Sequence
  chemically synthesized
actcttcctaaaatggtacttt

SEQ ID NO: 103827 - DNA, 22 bp, Artificial Sequence
  chemically synthesized
ttcctaaaatggtactttcagt

SEQ ID NO: 103828 - DNA, 22 bp, Artificial Sequence
  chemically synthesized
cctaaaatggtactttcagttc

SEQ ID NO: 103829 - DNA, 22 bp, Artificial Sequence
  chemically synthesized
ctaaaatggtactttcagttct

SEQ ID NO: 103830 - DNA, 22 bp, Artificial Sequence
  chemically synthesized
aaatggtactttcagttcttat

SEQ ID NO: 103831 - DNA, 22 bp, Artificial Sequence
  chemically synthesized
tcagttcttatgaatacaggtt

SEQ ID NO: 103832 - DNA, 22 bp, Artificial Sequence
  chemically synthesized
cagttcttatgaatacaggtta

SEQ ID NO: 103833 - DNA, 22 bp, Artificial Sequence
  chemically synthesized
agttcttatgaatacaggttat

SEQ ID NO: 103834 - DNA, 22 bp, Artificial Sequence
  chemically synthesized
ttatgaatacaggttatgaata

SEQ ID NO: 103835 - DNA, 22 bp, Artificial Sequence
  chemically synthesized
atgaatacaggttatgaataac

SEQ ID NO: 103836 - DNA, 22 bp, Artificial Sequence
  chemically synthesized
tgaatacaggttatgaataacc

SEQ ID NO: 103837 - DNA, 22 bp, Artificial Sequence
  chemically synthesized
tgaataaccatattttccctga

SEQ ID NO: 103838 - DNA, 22 bp, Artificial Sequence
  chemically synthesized
tccctgattattagggtattta

SEQ ID NO: 103839 - DNA, 22 bp, Artificial Sequence
  chemically synthesized
ccctgattattagggtatttat

SEQ ID NO: 103840 - DNA, 22 bp, Artificial Sequence
  chemically synthesized
cctgattattagggtatttatc

SEQ ID NO: 103841 - DNA, 22 bp, Artificial Sequence
  chemically synthesized
attattagggtatttatctaca

SEQ ID NO: 103842 - DNA, 22 bp, Artificial Sequence
  chemically synthesized
ttagggtatttatctacatgtt

SEQ ID NO: 103843 - DNA, 22 bp, Artificial Sequence
  chemically synthesized
gggtatttatctacatgtttta

SEQ ID NO: 103844 - DNA, 22 bp, Artificial Sequence
  chemically synthesized
atctacatgttttatctccata

SEQ ID NO: 103845 - DNA, 22 bp, Artificial Sequence
  chemically synthesized
tctacatgttttatctccatat

SEQ ID NO: 103846 - DNA, 22 bp, Artificial Sequence
  chemically synthesized
catgttttatctccatattcaa

SEQ ID NO: 103847 - DNA, 22 bp, Artificial Sequence
  chemically synthesized
tatctccatattcaatagtatt

SEQ ID NO: 103848 - DNA, 22 bp, Artificial Sequence
  chemically synthesized
atctccatattcaatagtattc

SEQ ID NO: 103849 - DNA, 22 bp, Artificial Sequence
  chemically synthesized
tctccatattcaatagtattcc

SEQ ID NO: 103850 - DNA, 22 bp, Artificial Sequence
  chemically synthesized
catattcaatagtattccactt

SEQ ID NO: 103851 - DNA, 22 bp, Artificial Sequence
  chemically synthesized
aatagtattccactttcctagt

SEQ ID NO: 103852 - DNA, 22 bp, Artificial Sequence
  chemically synthesized
cactttcctagtatctctcaat

SEQ ID NO: 103853 - DNA, 22 bp, Artificial Sequence
  chemically synthesized
tcctagtatctctcaatagata

SEQ ID NO: 103854 - DNA, 22 bp, Artificial Sequence
  chemically synthesized
cctagtatctctcaatagatag

SEQ ID NO: 103855 - DNA, 22 bp, Artificial Sequence
  chemically synthesized
ctagtatctctcaatagatagg

SEQ ID NO: 103856 - DNA, 22 bp, Artificial Sequence
  chemically synthesized
gtatctctcaatagataggtaa

SEQ ID NO: 103857 - DNA, 22 bp, Artificial Sequence
  chemically synthesized
tcaatagataggtaaattatag

SEQ ID NO: 103858 - DNA, 22 bp, Artificial Sequence
  chemically synthesized
aatagataggtaaattatagat

SEQ ID NO: 103859 - DNA, 22 bp, Artificial Sequence
  chemically synthesized
tagatatatctccctcgataaa

SEQ ID NO: 103860 - DNA, 22 bp, Artificial Sequence
  chemically synthesized
cctcgataaagctttacatcta

SEQ ID NO: 103861 - DNA, 22 bp, Artificial Sequence
  chemically synthesized
gataaagctttacatctacata

SEQ ID NO: 103862 - DNA, 22 bp, Artificial Sequence
  chemically synthesized
tacatctacatatgaatacatt

SEQ ID NO: 103863 - DNA, 22 bp, Artificial Sequence
  chemically synthesized
acatctacatatgaatacattt

SEQ ID NO: 103864 - DNA, 22 bp, Artificial Sequence
  chemically synthesized
catctacatatgaatacattta

SEQ ID NO: 103865 - DNA, 22 bp, Artificial Sequence
  chemically synthesized
catatgaatacatttatacata

SEQ ID NO: 103866 - DNA, 22 bp, Artificial Sequence
  chemically synthesized
atacatatatttatgtatttat

SEQ ID NO: 103867 - DNA, 22 bp, Artificial Sequence
  chemically synthesized
tacatatatttatgtatttatc

SEQ ID NO: 103868 - DNA, 22 bp, Artificial Sequence
  chemically synthesized
atgtatttatcaattgatcaat

SEQ ID NO: 103869 - DNA, 22 bp, Artificial Sequence
  chemically synthesized
tgtatttatcaattgatcaatt

SEQ ID NO: 103870 - DNA, 22 bp, Artificial Sequence
  chemically synthesized
atcaattgatcaattgatggat

SEQ ID NO: 103871 - DNA, 22 bp, Artificial Sequence
  chemically synthesized
tcaattgatcaattgatggata

SEQ ID NO: 103872 - DNA, 22 bp, Artificial Sequence
  chemically synthesized
atcaattgatggatacattcat

SEQ ID NO: 103873 - DNA, 22 bp, Artificial Sequence
  chemically synthesized
atggatacattcattgtattat

SEQ ID NO: 103874 - DNA, 22 bp, Artificial Sequence
  chemically synthesized
attgtattattgttccatgtag

SEQ ID NO: 103875 - DNA, 22 bp, Artificial Sequence
  chemically synthesized
tattattgttccatgtagcttt

SEQ ID NO: 103876 - DNA, 22 bp, Artificial Sequence
  chemically synthesized
ttgttccatgtagcttttcact

SEQ ID NO: 103877 - DNA, 22 bp, Artificial Sequence
  chemically synthesized
ttccatgtagcttttcacttta

SEQ ID NO: 103878 - DNA, 22 bp, Artificial Sequence
  chemically synthesized
catgtagcttttcactttagat

SEQ ID NO: 103879 - DNA, 22 bp, Artificial Sequence
  chemically synthesized
ttcactttagataatagttaaa

SEQ ID NO: 103880 - DNA, 22 bp, Artificial Sequence
  chemically synthesized
tcactttagataatagttaaag

SEQ ID NO: 103881 - DNA, 22 bp, Artificial Sequence
  chemically synthesized
cactttagataatagttaaagc

SEQ ID NO: 103882 - DNA, 22 bp, Artificial Sequence
  chemically synthesized
actttagataatagttaaagcc

SEQ ID NO: 103883 - DNA, 22 bp, Artificial Sequence
  chemically synthesized
tagataatagttaaagcctatc

SEQ ID NO: 103884 - DNA, 22 bp, Artificial Sequence
  chemically synthesized
agataatagttaaagcctatct

SEQ ID NO: 103885 - DNA, 22 bp, Artificial Sequence
  chemically synthesized
gataatagttaaagcctatcta

SEQ ID NO: 103886 - DNA, 22 bp, Artificial Sequence
  chemically synthesized
aagcctatctaacactgataca

SEQ ID NO: 103887 - DNA, 22 bp, Artificial Sequence
  chemically synthesized
tctaacactgatacaagagata

SEQ ID NO: 103888 - DNA, 22 bp, Artificial Sequence
  chemically synthesized
acactgatacaagagatattgg

SEQ ID NO: 103889 - DNA, 22 bp, Artificial Sequence
  chemically synthesized
atacaagagatattgggtataa

SEQ ID NO: 103890 - DNA, 22 bp, Artificial Sequence
  chemically synthesized
ggtataaaataagctcctttcc

SEQ ID NO: 103891 - DNA, 22 bp, Artificial Sequence
  chemically synthesized
ctttccaattactcaaaaggcc

SEQ ID NO: 103892 - DNA, 22 bp, Artificial Sequence
  chemically synthesized
tccaattactcaaaaggcccag

SEQ ID NO: 103893 - DNA, 22 bp, Artificial Sequence
  chemically synthesized
ccaattactcaaaaggcccaga

SEQ ID NO: 103894 - DNA, 22 bp, Artificial Sequence
  chemically synthesized
caattactcaaaaggcccagaa

SEQ ID NO: 103895 - DNA, 22 bp, Artificial Sequence
  chemically synthesized
ctcaaaaggcccagaaatcatg

SEQ ID NO: 103896 - DNA, 22 bp, Artificial Sequence
  chemically synthesized
aaaaggcccagaaatcatgaag

SEQ ID NO: 103897 - DNA, 22 bp, Artificial Sequence
  chemically synthesized
tgaaaaaagggctcaagccatt

SEQ ID NO: 103898 - DNA, 22 bp, Artificial Sequence
  chemically synthesized
aaaaaagggctcaagccattct

SEQ ID NO: 103899 - DNA, 22 bp, Artificial Sequence
  chemically synthesized
aagccattctgtgcccagaaaa

SEQ ID NO: 103900 - DNA, 22 bp, Artificial Sequence
  chemically synthesized
tgtgcccagaaaataggcgaac

SEQ ID NO: 103901 - DNA, 22 bp, Artificial Sequence
  chemically synthesized
tgcccagaaaataggcgaacaa

SEQ ID NO: 103902 - DNA, 22 bp, Artificial Sequence
  chemically synthesized
ctttggatctgcttggtttgat

SEQ ID NO: 103903 - DNA, 22 bp, Artificial Sequence
  chemically synthesized
tttggatctgcttggtttgatg

SEQ ID NO: 103904 - DNA, 22 bp, Artificial Sequence
  chemically synthesized
tggatctgcttggtttgatgct

SEQ ID NO: 103905 - DNA, 22 bp, Artificial Sequence
  chemically synthesized
ggatctgcttggtttgatgctg

SEQ ID NO: 103906 - DNA, 22 bp, Artificial Sequence
  chemically synthesized
gatctgcttggtttgatgctgt

SEQ ID NO: 103907 - DNA, 22 bp, Artificial Sequence
  chemically synthesized
cttggtttgatgctgtatataa

SEQ ID NO: 103908 - DNA, 22 bp, Artificial Sequence
  chemically synthesized
ggtttgatgctgtatataatag

SEQ ID NO: 103909 - DNA, 22 bp, Artificial Sequence
  chemically synthesized
gtttgatgctgtatataatagg

SEQ ID NO: 103910 - DNA, 22 bp, Artificial Sequence
  chemically synthesized
gatgctgtatataatagggttc

SEQ ID NO: 103911 - DNA, 22 bp, Artificial Sequence
  chemically synthesized
atgctgtatataatagggttca

SEQ ID NO: 103912 - DNA, 22 bp, Artificial Sequence
  chemically synthesized
tatataatagggttcatgaatg

SEQ ID NO: 103913 - DNA, 22 bp, Artificial Sequence
  chemically synthesized
atgaatggaggaaaaagaaatg

SEQ ID NO: 103914 - DNA, 22 bp, Artificial Sequence
  chemically synthesized
gctcacggtaatgtgcaccaca

SEQ ID NO: 103915 - DNA, 22 bp, Artificial Sequence
  chemically synthesized
acggtaatgtgcaccacatgtg

SEQ ID NO: 103916 - DNA, 22 bp, Artificial Sequence
  chemically synthesized
cccaaacctgtgaatgaaagtc

SEQ ID NO: 103917 - DNA, 22 bp, Artificial Sequence
  chemically synthesized
ccaaacctgtgaatgaaagtct

SEQ ID NO: 103918 - DNA, 22 bp, Artificial Sequence
  chemically synthesized
tgaatgaaagtctcactgatca

SEQ ID NO: 103919 - DNA, 22 bp, Artificial Sequence
  chemically synthesized
actgatcacggtgatgtgaaat

SEQ ID NO: 103920 - DNA, 22 bp, Artificial Sequence
  chemically synthesized
atcacggtgatgtgaaatacca

SEQ ID NO: 103921 - DNA, 22 bp, Artificial Sequence
  chemically synthesized
atatgggagacacacatgttga

SEQ ID NO: 103922 - DNA, 22 bp, Artificial Sequence
  chemically synthesized
agagctttggcttgctcttttc

SEQ ID NO: 103923 - DNA, 22 bp, Artificial Sequence
  chemically synthesized
tggcttgctcttttctggaggc

SEQ ID NO: 103924 - DNA, 22 bp, Artificial Sequence
  chemically synthesized
ggcttgctcttttctggaggca

SEQ ID NO: 103925 - DNA, 22 bp, Artificial Sequence
  chemically synthesized
gcttgctcttttctggaggcaa

SEQ ID NO: 103926 - DNA, 22 bp, Artificial Sequence
  chemically synthesized
gctcttttctggaggcaatacc

SEQ ID NO: 103927 - DNA, 22 bp, Artificial Sequence
  chemically synthesized
ctcttttctggaggcaatacct

SEQ ID NO: 103928 - DNA, 22 bp, Artificial Sequence
  chemically synthesized
ttttctggaggcaataccttta

SEQ ID NO: 103929 - DNA, 22 bp, Artificial Sequence
  chemically synthesized
ttctggaggcaatacctttaac

SEQ ID NO: 103930 - DNA, 22 bp, Artificial Sequence
  chemically synthesized
tctggaggcaatacctttaact

SEQ ID NO: 103931 - DNA, 22 bp, Artificial Sequence
  chemically synthesized
ctggaggcaatacctttaactg

SEQ ID NO: 103932 - DNA, 22 bp, Artificial Sequence
  chemically synthesized
tggaggcaatacctttaactgt

SEQ ID NO: 103933 - DNA, 22 bp, Artificial Sequence
  chemically synthesized
gaggcaatacctttaactgttt

SEQ ID NO: 103934 - DNA, 22 bp, Artificial Sequence
  chemically synthesized
taactgttttaaggatcaggat

SEQ ID NO: 103935 - DNA, 22 bp, Artificial Sequence
  chemically synthesized
aactgttttaaggatcaggata

SEQ ID NO: 103936 - DNA, 22 bp, Artificial Sequence
  chemically synthesized
actgttttaaggatcaggatat

SEQ ID NO: 103937 - DNA, 22 bp, Artificial Sequence
  chemically synthesized
ttttaaggatcaggatataaga

SEQ ID NO: 103938 - DNA, 22 bp, Artificial Sequence
  chemically synthesized
taaggatcaggatataagaaaa

SEQ ID NO: 103939 - DNA, 22 bp, Artificial Sequence
  chemically synthesized
aaggatcaggatataagaaaag

SEQ ID NO: 103940 - DNA, 22 bp, Artificial Sequence
  chemically synthesized
aggatcaggatataagaaaaga

SEQ ID NO: 103941 - DNA, 22 bp, Artificial Sequence
  chemically synthesized
ggaagaaaatcaaagcaaccag

SEQ ID NO: 103942 - DNA, 22 bp, Artificial Sequence
  chemically synthesized
ggtataagtgattgaatgtaat

SEQ ID NO: 103943 - DNA, 22 bp, Artificial Sequence
  chemically synthesized
aatgtaatatcagcacaggcaa

SEQ ID NO: 103944 - DNA, 22 bp, Artificial Sequence
  chemically synthesized
caggacatcttgatggagaaaa

SEQ ID NO: 103945 - DNA, 22 bp, Artificial Sequence
  chemically synthesized
aggacatcttgatggagaaaaa

SEQ ID NO: 103946 - DNA, 22 bp, Artificial Sequence
  chemically synthesized
gatggagaaaaaaggtgtggaa

SEQ ID NO: 103947 - DNA, 22 bp, Artificial Sequence
  chemically synthesized
atggagaaaaaaggtgtggaag

SEQ ID NO: 103948 - DNA, 22 bp, Artificial Sequence
  chemically synthesized
gaggcacgagggataaaaagtc

SEQ ID NO: 103949 - DNA, 22 bp, Artificial Sequence
  chemically synthesized
ataaatagccacagttctatct

SEQ ID NO: 103950 - DNA, 22 bp, Artificial Sequence
  chemically synthesized
tatcttcacccaagatttagta

SEQ ID NO: 103951 - DNA, 22 bp, Artificial Sequence
  chemically synthesized
tcttcacccaagatttagtaga

SEQ ID NO: 103952 - DNA, 22 bp, Artificial Sequence
  chemically synthesized
cacccaagatttagtagaaata

SEQ ID NO: 103953 - DNA, 22 bp, Artificial Sequence
  chemically synthesized
acccaagatttagtagaaatag

SEQ ID NO: 103954 - DNA, 22 bp, Artificial Sequence
  chemically synthesized
agtagaaatagttatacctgag

SEQ ID NO: 103955 - DNA, 22 bp, Artificial Sequence
  chemically synthesized
gtagaaatagttatacctgaga

SEQ ID NO: 103956 - DNA, 22 bp, Artificial Sequence
  chemically synthesized
tacctgagaagcatgtggatga

SEQ ID NO: 103957 - DNA, 22 bp, Artificial Sequence
  chemically synthesized
agaagcatgtggatgataatga

SEQ ID NO: 103958 - DNA, 22 bp, Artificial Sequence
  chemically synthesized
acaggagaatacctgattctgc

SEQ ID NO: 103959 - DNA, 22 bp, Artificial Sequence
  chemically synthesized
attctgcaagtggataatggga

SEQ ID NO: 103960 - DNA, 22 bp, Artificial Sequence
  chemically synthesized
tgcaagtggataatgggagtgg

SEQ ID NO: 103961 - DNA, 22 bp, Artificial Sequence
  chemically synthesized
caagtggataatgggagtggat

SEQ ID NO: 103962 - DNA, 22 bp, Artificial Sequence
  chemically synthesized
caagaagcaggccccatggata

SEQ ID NO: 103963 - DNA, 22 bp, Artificial Sequence
  chemically synthesized
tttgtgattcatccacaagacg

SEQ ID NO: 103964 - DNA, 22 bp, Artificial Sequence
  chemically synthesized
tgtgattcatccacaagacgcc

SEQ ID NO: 103965 - DNA, 22 bp, Artificial Sequence
  chemically synthesized
gtgattcatccacaagacgccc

SEQ ID NO: 103966 - DNA, 22 bp, Artificial Sequence
  chemically synthesized
tgattcatccacaagacgccca

SEQ ID NO: 103967 - DNA, 22 bp, Artificial Sequence
  chemically synthesized
atccacaagacgcccattacag

SEQ ID NO: 103968 - DNA, 22 bp, Artificial Sequence
  chemically synthesized
cagtgggcatcatggtcaattt

SEQ ID NO: 103969 - DNA, 22 bp, Artificial Sequence
  chemically synthesized
caccatgaggtcttgcctcagt

SEQ ID NO: 103970 - DNA, 22 bp, Artificial Sequence
  chemically synthesized
accatgaggtcttgcctcagtg

SEQ ID NO: 103971 - DNA, 22 bp, Artificial Sequence
  chemically synthesized
gcctcagtgtggcaaggaaaca

SEQ ID NO: 103972 - DNA, 22 bp, Artificial Sequence
  chemically synthesized
cctcagtgtggcaaggaaacag

SEQ ID NO: 103973 - DNA, 22 bp, Artificial Sequence
  chemically synthesized
agtgtggcaaggaaacagtaca

SEQ ID NO: 103974 - DNA, 22 bp, Artificial Sequence
  chemically synthesized
gtgaagactgtggtcatgcttg

SEQ ID NO: 103975 - DNA, 22 bp, Artificial Sequence
  chemically synthesized
tggtcatgcttgatgaggtaga

SEQ ID NO: 103976 - DNA, 22 bp, Artificial Sequence
  chemically synthesized
gatgaggtagaggagcttgcca

SEQ ID NO: 103977 - DNA, 22 bp, Artificial Sequence
  chemically synthesized
atgaggtagaggagcttgccat

SEQ ID NO: 103978 - DNA, 22 bp, Artificial Sequence
  chemically synthesized
gccattgccaagaaggacgcac

SEQ ID NO: 103979 - DNA, 22 bp, Artificial Sequence
  chemically synthesized
ccattgccaagaaggacgcaca

SEQ ID NO: 103980 - DNA, 22 bp, Artificial Sequence
  chemically synthesized
ccaagaaggacgcacacataaa

SEQ ID NO: 103981 - DNA, 22 bp, Artificial Sequence
  chemically synthesized
cctccagtactgaaaagccagg

SEQ ID NO: 103982 - DNA, 22 bp, Artificial Sequence
  chemically synthesized
cagtactgaaaagccaggcagc

SEQ ID NO: 103983 - DNA, 22 bp, Artificial Sequence
  chemically synthesized
aaaagccaggcagcaaaaaagg

SEQ ID NO: 103984 - DNA, 22 bp, Artificial Sequence
  chemically synthesized
tgtgttcacaagtggcaagtag

SEQ ID NO: 103985 - DNA, 22 bp, Artificial Sequence
  chemically synthesized
acaagtggcaagtagctttata

SEQ ID NO: 103986 - DNA, 22 bp, Artificial Sequence
  chemically synthesized
tatagaaactattacactgaaa

SEQ ID NO: 103987 - DNA, 22 bp, Artificial Sequence
  chemically synthesized
atagaaactattacactgaaat

SEQ ID NO: 103988 - DNA, 22 bp, Artificial Sequence
  chemically synthesized
tagaaactattacactgaaatc

SEQ ID NO: 103989 - DNA, 22 bp, Artificial Sequence
  chemically synthesized
ttacactgaaatccctgcctta

SEQ ID NO: 103990 - DNA, 22 bp, Artificial Sequence
  chemically synthesized
cactgaaatccctgccttatca

SEQ ID NO: 103991 - DNA, 22 bp, Artificial Sequence
  chemically synthesized
aaatccctgccttatcagtttt

SEQ ID NO: 103992 - DNA, 22 bp, Artificial Sequence
  chemically synthesized
ccttatcagtttttactacctt

SEQ ID NO: 103993 - DNA, 22 bp, Artificial Sequence
  chemically synthesized
atcagtttttactaccttcttg

SEQ ID NO: 103994 - DNA, 22 bp, Artificial Sequence
  chemically synthesized
tcagtttttactaccttcttgt

SEQ ID NO: 103995 - DNA, 22 bp, Artificial Sequence
  chemically synthesized
ttactaccttcttgtgaaactg

SEQ ID NO: 103996 - DNA, 22 bp, Artificial Sequence
  chemically synthesized
tactaccttcttgtgaaactgt

SEQ ID NO: 103997 - DNA, 22 bp, Artificial Sequence
  chemically synthesized
actaccttcttgtgaaactgta

SEQ ID NO: 103998 - DNA, 22 bp, Artificial Sequence
  chemically synthesized
ctaccttcttgtgaaactgtat

SEQ ID NO: 103999 - DNA, 22 bp, Artificial Sequence
  chemically synthesized
ccttcttgtgaaactgtatttc

SEQ ID NO: 104000 - DNA, 22 bp, Artificial Sequence
  chemically synthesized
cttgtgaaactgtatttctgca

SEQ ID NO: 104001 - DNA, 22 bp, Artificial Sequence
  chemically synthesized
ttgtgaaactgtatttctgcag

SEQ ID NO: 104002 - DNA, 22 bp, Artificial Sequence
  chemically synthesized
gtgaaactgtatttctgcagcc

SEQ ID NO: 104003 - DNA, 22 bp, Artificial Sequence
  chemically synthesized
tgaaactgtatttctgcagcct

SEQ ID NO: 104004 - DNA, 22 bp, Artificial Sequence
  chemically synthesized
tatttctgcagcctcaatccta

SEQ ID NO: 104005 - DNA, 22 bp, Artificial Sequence
  chemically synthesized
ctgcagcctcaatcctaatatt

SEQ ID NO: 104006 - DNA, 22 bp, Artificial Sequence
  chemically synthesized
tgcagcctcaatcctaatattc

SEQ ID NO: 104007 - DNA, 22 bp, Artificial Sequence
  chemically synthesized
cagcctcaatcctaatattcat

SEQ ID NO: 104008 - DNA, 22 bp, Artificial Sequence
  chemically synthesized
aatcctaatattcatatttagc

SEQ ID NO: 104009 - DNA, 22 bp, Artificial Sequence
  chemically synthesized
atattcatatttagcaataatt

SEQ ID NO: 104010 - DNA, 22 bp, Artificial Sequence
  chemically synthesized
atatttagcaataatttattgg

SEQ ID NO: 104011 - DNA, 22 bp, Artificial Sequence
  chemically synthesized
agcaataatttattggtatatg

SEQ ID NO: 104012 - DNA, 22 bp, Artificial Sequence
  chemically synthesized
gcaataatttattggtatatgc

SEQ ID NO: 104013 - DNA, 22 bp, Artificial Sequence
  chemically synthesized
attggtatatgcatgaatgtgc

SEQ ID NO: 104014 - DNA, 22 bp, Artificial Sequence
  chemically synthesized
ttggtatatgcatgaatgtgca

SEQ ID NO: 104015 - DNA, 22 bp, Artificial Sequence
  chemically synthesized
gtatatgcatgaatgtgcaaca

SEQ ID NO: 104016 - DNA, 22 bp, Artificial Sequence
  chemically synthesized
tcttatagaagagcaatacatt

SEQ ID NO: 104017 - DNA, 22 bp, Artificial Sequence
  chemically synthesized
cttatagaagagcaatacattt

SEQ ID NO: 104018 - DNA, 22 bp, Artificial Sequence
  chemically synthesized
ttatagaagagcaatacattta

SEQ ID NO: 104019 - DNA, 22 bp, Artificial Sequence
  chemically synthesized
atagaagagcaatacatttata

SEQ ID NO: 104020 - DNA, 22 bp, Artificial Sequence
  chemically synthesized
tagaagagcaatacatttatag

SEQ ID NO: 104021 - DNA, 22 bp, Artificial Sequence
  chemically synthesized
atagactgtgctagagataagg

SEQ ID NO: 104022 - DNA, 22 bp, Artificial Sequence
  chemically synthesized
tagactgtgctagagataagga

SEQ ID NO: 104023 - DNA, 22 bp, Artificial Sequence
  chemically synthesized
tgctagagataaggaatgatga

SEQ ID NO: 104024 - DNA, 22 bp, Artificial Sequence
  chemically synthesized
gagataaggaatgatgatcatt

SEQ ID NO: 104025 - DNA, 22 bp, Artificial Sequence
  chemically synthesized
cttcagttatgaataattaagt

SEQ ID NO: 104026 - DNA, 22 bp, Artificial Sequence
  chemically synthesized
ttcagttatgaataattaagta

SEQ ID NO: 104027 - DNA, 22 bp, Artificial Sequence
  chemically synthesized
cagttatgaataattaagtagt

SEQ ID NO: 104028 - DNA, 22 bp, Artificial Sequence
  chemically synthesized
agttatgaataattaagtagtt

SEQ ID NO: 104029 - DNA, 22 bp, Artificial Sequence
  chemically synthesized
tgaataattaagtagttaagca

SEQ ID NO: 104030 - DNA, 22 bp, Artificial Sequence
  chemically synthesized
agtagttaagcattcttaatct

SEQ ID NO: 104031 - DNA, 22 bp, Artificial Sequence
  chemically synthesized
agcattcttaatctaaaaaaca

SEQ ID NO: 104032 - DNA, 22 bp, Artificial Sequence
  chemically synthesized
ttaatctaaaaaacacatttta

SEQ ID NO: 104033 - DNA, 22 bp, Artificial Sequence
  chemically synthesized
aatctaaaaaacacattttaaa

SEQ ID NO: 104034 - DNA, 22 bp, Artificial Sequence
  chemically synthesized
atctaaaaaacacattttaaaa

SEQ ID NO: 104035 - DNA, 22 bp, Artificial Sequence
  chemically synthesized
aaaaacacattttaaaaaatgc

SEQ ID NO: 104036 - DNA, 22 bp, Artificial Sequence
  chemically synthesized
taaaaaatgcatcatgcccctc

SEQ ID NO: 104037 - DNA, 22 bp, Artificial Sequence
  chemically synthesized
aaaaaatgcatcatgcccctct

SEQ ID NO: 104038 - DNA, 22 bp, Artificial Sequence
  chemically synthesized
aaaaatgcatcatgcccctctg

SEQ ID NO: 104039 - DNA, 22 bp, Artificial Sequence
  chemically synthesized
tgtggtgtgcttgctgcacaat

SEQ ID NO: 104040 - DNA, 22 bp, Artificial Sequence
  chemically synthesized
tggtgtgcttgctgcacaatgt

SEQ ID NO: 104041 - DNA, 22 bp, Artificial Sequence
  chemically synthesized
gctgcacaatgtttgaaccaat

SEQ ID NO: 104042 - DNA, 22 bp, Artificial Sequence
  chemically synthesized
ctgcacaatgtttgaaccaata

SEQ ID NO: 104043 - DNA, 22 bp, Artificial Sequence
  chemically synthesized
cacaatgtttgaaccaatagta

SEQ ID NO: 104044 - DNA, 22 bp, Artificial Sequence
  chemically synthesized
gaaccaatagtaacaaaaaaga

SEQ ID NO: 104045 - DNA, 22 bp, Artificial Sequence
  chemically synthesized
aaccaatagtaacaaaaaagaa

SEQ ID NO: 104046 - DNA, 22 bp, Artificial Sequence
  chemically synthesized
gataataattgtacatagttaa

SEQ ID NO: 104047 - DNA, 22 bp, Artificial Sequence
  chemically synthesized
tacatagttaacctgctgctta

SEQ ID NO: 104048 - DNA, 22 bp, Artificial Sequence
  chemically synthesized
acctgctgcttagcttaattgc

SEQ ID NO: 104049 - DNA, 22 bp, Artificial Sequence
  chemically synthesized
ctgcttagcttaattgcatatt

SEQ ID NO: 104050 - DNA, 22 bp, Artificial Sequence
  chemically synthesized
cttagcttaattgcatatttgg

SEQ ID NO: 104051 - DNA, 22 bp, Artificial Sequence
  chemically synthesized
agcttaattgcatatttggata

SEQ ID NO: 104052 - DNA, 22 bp, Artificial Sequence
  chemically synthesized
gcttaattgcatatttggatac

SEQ ID NO: 104053 - DNA, 22 bp, Artificial Sequence
  chemically synthesized
aattgcatatttggatacattt

SEQ ID NO: 104054 - DNA, 22 bp, Artificial Sequence
  chemically synthesized
attgcatatttggatacattta

SEQ ID NO: 104055 - DNA, 22 bp, Artificial Sequence
  chemically synthesized
catatttggatacatttaaact

SEQ ID NO: 104056 - DNA, 22 bp, Artificial Sequence
  chemically synthesized
ggatacatttaaacttgatttt

SEQ ID NO: 104057 - DNA, 22 bp, Artificial Sequence
  chemically synthesized
gatacatttaaacttgattttt

SEQ ID NO: 104058 - DNA, 22 bp, Artificial Sequence
  chemically synthesized
aaacttgatttttattttatgt

SEQ ID NO: 104059 - DNA, 22 bp, Artificial Sequence
  chemically synthesized
aacttgatttttattttatgtt

SEQ ID NO: 104060 - DNA, 22 bp, Artificial Sequence
  chemically synthesized
gatttttattttatgtttcaca

SEQ ID NO: 104061 - DNA, 22 bp, Artificial Sequence
  chemically synthesized
atttttattttatgtttcacaa

SEQ ID NO: 104062 - DNA, 22 bp, Artificial Sequence
  chemically synthesized
ttattttatgtttcacaatcat

SEQ ID NO: 104063 - DNA, 22 bp, Artificial Sequence
  chemically synthesized
tattttatgtttcacaatcatg

SEQ ID NO: 104064 - DNA, 22 bp, Artificial Sequence
  chemically synthesized
attttatgtttcacaatcatga

SEQ ID NO: 104065 - DNA, 22 bp, Artificial Sequence
  chemically synthesized
ttttatgtttcacaatcatgat

SEQ ID NO: 104066 - DNA, 22 bp, Artificial Sequence
  chemically synthesized
tatgtttcacaatcatgatata

SEQ ID NO: 104067 - DNA, 22 bp, Artificial Sequence
  chemically synthesized
atgtttcacaatcatgatatag

SEQ ID NO: 104068 - DNA, 22 bp, Artificial Sequence
  chemically synthesized
tgtttcacaatcatgatataga

SEQ ID NO: 104069 - DNA, 22 bp, Artificial Sequence
  chemically synthesized
cacaatcatgatatagacatag

SEQ ID NO: 104070 - DNA, 22 bp, Artificial Sequence
  chemically synthesized
acaatcatgatatagacatagt

SEQ ID NO: 104071 - DNA, 22 bp, Artificial Sequence
  chemically synthesized
tgttagaaaacttttctttgtt

SEQ ID NO: 104072 - DNA, 22 bp, Artificial Sequence
  chemically synthesized
gttagaaaacttttctttgttt

SEQ ID NO: 104073 - DNA, 22 bp, Artificial Sequence
  chemically synthesized
ttagaaaacttttctttgttta

SEQ ID NO: 104074 - DNA, 22 bp, Artificial Sequence
  chemically synthesized
gaaaacttttctttgtttagtt

SEQ ID NO: 104075 - DNA, 22 bp, Artificial Sequence
  chemically synthesized
ttctttgtttagttttgaaata

SEQ ID NO: 104076 - DNA, 22 bp, Artificial Sequence
  chemically synthesized
tctttgtttagttttgaaatag

SEQ ID NO: 104077 - DNA, 22 bp, Artificial Sequence
  chemically synthesized
ctttgtttagttttgaaataga

SEQ ID NO: 104078 - DNA, 22 bp, Artificial Sequence
  chemically synthesized
tttgtttagttttgaaatagaa

SEQ ID NO: 104079 - DNA, 22 bp, Artificial Sequence
  chemically synthesized
tgtttagttttgaaatagaatg

SEQ ID NO: 104080 - DNA, 22 bp, Artificial Sequence
  chemically synthesized
gtttagttttgaaatagaatgt

SEQ ID NO: 104081 - DNA, 22 bp, Artificial Sequence
  chemically synthesized
tttagttttgaaatagaatgtt

SEQ ID NO: 104082 - DNA, 22 bp, Artificial Sequence
  chemically synthesized
agttttgaaatagaatgttaat

SEQ ID NO: 104083 - DNA, 22 bp, Artificial Sequence
  chemically synthesized
gttttgaaatagaatgttaatg

SEQ ID NO: 104084 - DNA, 22 bp, Artificial Sequence
  chemically synthesized
tgaaatagaatgttaatgtttt

SEQ ID NO: 104085 - DNA, 22 bp, Artificial Sequence
  chemically synthesized
gaaatagaatgttaatgtttta

SEQ ID NO: 104086 - DNA, 22 bp, Artificial Sequence
  chemically synthesized
aaatagaatgttaatgttttat

SEQ ID NO: 104087 - DNA, 22 bp, Artificial Sequence
  chemically synthesized
atgttttatggaattctaacaa

SEQ ID NO: 104088 - DNA, 22 bp, Artificial Sequence
  chemically synthesized
tatggaattctaacaaaagcca

SEQ ID NO: 104089 - DNA, 22 bp, Artificial Sequence
  chemically synthesized
atggaattctaacaaaagccat

SEQ ID NO: 104090 - DNA, 22 bp, Artificial Sequence
  chemically synthesized
tggaattctaacaaaagccatg

SEQ ID NO: 104091 - DNA, 22 bp, Artificial Sequence
  chemically synthesized
taacaaaagccatgagccctct

SEQ ID NO: 104092 - DNA, 22 bp, Artificial Sequence
  chemically synthesized
acaaaagccatgagccctctgt

SEQ ID NO: 104093 - DNA, 22 bp, Artificial Sequence
  chemically synthesized
tgtggagaaaaatggacaaaag

SEQ ID NO: 104094 - DNA, 22 bp, Artificial Sequence
  chemically synthesized
tggagaaaaatggacaaaagca

SEQ ID NO: 104095 - DNA, 22 bp, Artificial Sequence
  chemically synthesized
agtctaaaaatattcacacgtt

SEQ ID NO: 104096 - DNA, 22 bp, Artificial Sequence
  chemically synthesized
gtctaaaaatattcacacgttt

SEQ ID NO: 104097 - DNA, 22 bp, Artificial Sequence
  chemically synthesized
aaaatattcacacgttttcctg

SEQ ID NO: 104098 - DNA, 22 bp, Artificial Sequence
  chemically synthesized
acacgttttcctgaagctaatc

SEQ ID NO: 104099 - DNA, 22 bp, Artificial Sequence
  chemically synthesized
tcctgaagctaatccatgagca

SEQ ID NO: 104100 - DNA, 22 bp, Artificial Sequence
  chemically synthesized
cctgaagctaatccatgagcac

SEQ ID NO: 104101 - DNA, 22 bp, Artificial Sequence
  chemically synthesized
ctgaagctaatccatgagcacc

SEQ ID NO: 104102 - DNA, 22 bp, Artificial Sequence
  chemically synthesized
aagctaatccatgagcaccaca

SEQ ID NO: 104103 - DNA, 22 bp, Artificial Sequence
  chemically synthesized
atccatgagcaccacatttgaa

SEQ ID NO: 104104 - DNA, 22 bp, Artificial Sequence
  chemically synthesized
gaaacttcaagcctgccttgaa

SEQ ID NO: 104105 - DNA, 22 bp, Artificial Sequence
  chemically synthesized
aaacttcaagcctgccttgaaa

SEQ ID NO: 104106 - DNA, 22 bp, Artificial Sequence
  chemically synthesized
caagcctgccttgaaacatgtg

SEQ ID NO: 104107 - DNA, 22 bp, Artificial Sequence
  chemically synthesized
aagcctgccttgaaacatgtgt

SEQ ID NO: 104108 - DNA, 22 bp, Artificial Sequence
  chemically synthesized
ccttgaaacatgtgttgagatg

SEQ ID NO: 104109 - DNA, 22 bp, Artificial Sequence
  chemically synthesized
gaaacatgtgttgagatgaaaa

SEQ ID NO: 104110 - DNA, 22 bp, Artificial Sequence
  chemically synthesized
aaacatgtgttgagatgaaaaa

SEQ ID NO: 104111 - DNA, 22 bp, Artificial Sequence
  chemically synthesized
agatgaaaaagtctgtgcttta

SEQ ID NO: 104112 - DNA, 22 bp, Artificial Sequence
  chemically synthesized
tgctttaggtgttggtcatccc

SEQ ID NO: 104113 - DNA, 22 bp, Artificial Sequence
  chemically synthesized
taggtgttggtcatcccagatg

SEQ ID NO: 104114 - DNA, 22 bp, Artificial Sequence
  chemically synthesized
aggtgttggtcatcccagatgg

SEQ ID NO: 104115 - DNA, 22 bp, Artificial Sequence
  chemically synthesized
ggtgttggtcatcccagatgga

SEQ ID NO: 104116 - DNA, 22 bp, Artificial Sequence
  chemically synthesized
gtcatcccagatggagtatgtt

SEQ ID NO: 104117 - DNA, 22 bp, Artificial Sequence
  chemically synthesized
tcctatgcagacctctgaaaat

SEQ ID NO: 104118 - DNA, 22 bp, Artificial Sequence
  chemically synthesized
ctatgcagacctctgaaaatct

SEQ ID NO: 104119 - DNA, 22 bp, Artificial Sequence
  chemically synthesized
tgcagacctctgaaaatcttcc

SEQ ID NO: 104120 - DNA, 22 bp, Artificial Sequence
  chemically synthesized
tgaaaatcttcctatcttctct

SEQ ID NO: 104121 - DNA, 22 bp, Artificial Sequence
  chemically synthesized
aaaatcttcctatcttctcttc

SEQ ID NO: 104122 - DNA, 22 bp, Artificial Sequence
  chemically synthesized
cctatcttctcttcgctgcatc

SEQ ID NO: 104123 - DNA, 22 bp, Artificial Sequence
  chemically synthesized
ctatcttctcttcgctgcatct

SEQ ID NO: 104124 - DNA, 22 bp, Artificial Sequence
  chemically synthesized
tcttctcttcgctgcatctaac

SEQ ID NO: 104125 - DNA, 22 bp, Artificial Sequence
  chemically synthesized
ctcttcgctgcatctaacataa

SEQ ID NO: 104126 - DNA, 22 bp, Artificial Sequence
  chemically synthesized
tcttcgctgcatctaacataag

SEQ ID NO: 104127 - DNA, 22 bp, Artificial Sequence
  chemically synthesized
ttcgctgcatctaacataagaa

SEQ ID NO: 104128 - DNA, 22 bp, Artificial Sequence
  chemically synthesized
cgctgcatctaacataagaagg

SEQ ID NO: 104129 - DNA, 22 bp, Artificial Sequence
  chemically synthesized
gctgcatctaacataagaagga

SEQ ID NO: 104130 - DNA, 22 bp, Artificial Sequence
  chemically synthesized
catctaacataagaaggaagag

SEQ ID NO: 104131 - DNA, 22 bp, Artificial Sequence
  chemically synthesized
acataagaaggaagaggaatca

SEQ ID NO: 104132 - DNA, 22 bp, Artificial Sequence
  chemically synthesized
cttattcctgttcctggcactc

SEQ ID NO: 104133 - DNA, 22 bp, Artificial Sequence
  chemically synthesized
attcctgttcctggcactcacc

SEQ ID NO: 104134 - DNA, 22 bp, Artificial Sequence
  chemically synthesized
ttcctgttcctggcactcacct

SEQ ID NO: 104135 - DNA, 22 bp, Artificial Sequence
  chemically synthesized
ctgttcctggcactcacctatg

SEQ ID NO: 104136 - DNA, 22 bp, Artificial Sequence
  chemically synthesized
ttcctggcactcacctatgctg

SEQ ID NO: 104137 - DNA, 22 bp, Artificial Sequence
  chemically synthesized
ctggcactcacctatgctgtca

SEQ ID NO: 104138 - DNA, 22 bp, Artificial Sequence
  chemically synthesized
gcactcacctatgctgtcattt

SEQ ID NO: 104139 - DNA, 22 bp, Artificial Sequence
  chemically synthesized
acctatgctgtcattttcttgc

SEQ ID NO: 104140 - DNA, 22 bp, Artificial Sequence
  chemically synthesized
tgctgtcattttcttgctggaa

SEQ ID NO: 104141 - DNA, 22 bp, Artificial Sequence
  chemically synthesized
tcattttcttgctggaataagg

SEQ ID NO: 104142 - DNA, 22 bp, Artificial Sequence
  chemically synthesized
tcttgctggaataaggacccat

SEQ ID NO: 104143 - DNA, 22 bp, Artificial Sequence
  chemically synthesized
cttgctggaataaggacccatt

SEQ ID NO: 104144 - DNA, 22 bp, Artificial Sequence
  chemically synthesized
ttgctggaataaggacccattc

SEQ ID NO: 104145 - DNA, 22 bp, Artificial Sequence
  chemically synthesized
gctggaataaggacccattcct

SEQ ID NO: 104146 - DNA, 22 bp, Artificial Sequence
  chemically synthesized
ctggaataaggacccattcctg

SEQ ID NO: 104147 - DNA, 22 bp, Artificial Sequence
  chemically synthesized
gaataaggacccattcctgctc

SEQ ID NO: 104148 - DNA, 22 bp, Artificial Sequence
  chemically synthesized
ctgctctatttgaagactcagt

SEQ ID NO: 104149 - DNA, 22 bp, Artificial Sequence
  chemically synthesized
ctctatttgaagactcagttca

SEQ ID NO: 104150 - DNA, 22 bp, Artificial Sequence
  chemically synthesized
tatttgaagactcagttcagac

SEQ ID NO: 104151 - DNA, 22 bp, Artificial Sequence
  chemically synthesized
tttgaagactcagttcagacac

SEQ ID NO: 104152 - DNA, 22 bp, Artificial Sequence
  chemically synthesized
gaagactcagttcagacactca

SEQ ID NO: 104153 - DNA, 22 bp, Artificial Sequence
  chemically synthesized
aagactcagttcagacactcac

SEQ ID NO: 104154 - DNA, 22 bp, Artificial Sequence
  chemically synthesized
agttcagacactcacttctcaa

SEQ ID NO: 104155 - DNA, 22 bp, Artificial Sequence
  chemically synthesized
agacactcacttctcaaagact

SEQ ID NO: 104156 - DNA, 22 bp, Artificial Sequence
  chemically synthesized
acttctcaaagactattcaaga

SEQ ID NO: 104157 - DNA, 22 bp, Artificial Sequence
  chemically synthesized
ctcaaagactattcaagaggcc

SEQ ID NO: 104158 - DNA, 22 bp, Artificial Sequence
  chemically synthesized
tcaaagactattcaagaggcca

SEQ ID NO: 104159 - DNA, 22 bp, Artificial Sequence
  chemically synthesized
aaagactattcaagaggccaaa

SEQ ID NO: 104160 - DNA, 22 bp, Artificial Sequence
  chemically synthesized
ttcaagaggccaaattagagag

SEQ ID NO: 104161 - DNA, 22 bp, Artificial Sequence
  chemically synthesized
aagaggccaaattagagagttt

SEQ ID NO: 104162 - DNA, 22 bp, Artificial Sequence
  chemically synthesized
gagagtttatgtatgtggaaat

SEQ ID NO: 104163 - DNA, 22 bp, Artificial Sequence
  chemically synthesized
atgtatgtggaaatcacttccc

SEQ ID NO: 104164 - DNA, 22 bp, Artificial Sequence
  chemically synthesized
tgtatgtggaaatcacttcccc

SEQ ID NO: 104165 - DNA, 22 bp, Artificial Sequence
  chemically synthesized
ccccagagtttcctctttccaa

SEQ ID NO: 104166 - DNA, 22 bp, Artificial Sequence
  chemically synthesized
cccagagtttcctctttccaaa

SEQ ID NO: 104167 - DNA, 22 bp, Artificial Sequence
  chemically synthesized
cctctttccaaatactcagaag

SEQ ID NO: 104168 - DNA, 22 bp, Artificial Sequence
  chemically synthesized
ctctttccaaatactcagaaga

SEQ ID NO: 104169 - DNA, 22 bp, Artificial Sequence
  chemically synthesized
tttccaaatactcagaagaacc

SEQ ID NO: 104170 - DNA, 22 bp, Artificial Sequence
  chemically synthesized
tccaaatactcagaagaaccct

SEQ ID NO: 104171 - DNA, 22 bp, Artificial Sequence
  chemically synthesized
ccaaatactcagaagaaccctt

SEQ ID NO: 104172 - DNA, 22 bp, Artificial Sequence
  chemically synthesized
caaatactcagaagaacccttg

SEQ ID NO: 104173 - DNA, 22 bp, Artificial Sequence
  chemically synthesized
agaagaacccttgatctcccct

SEQ ID NO: 104174 - DNA, 22 bp, Artificial Sequence
  chemically synthesized
gatctcccctccctcctctgtc

SEQ ID NO: 104175 - DNA, 22 bp, Artificial Sequence
  chemically synthesized
atctcccctccctcctctgtct

SEQ ID NO: 104176 - DNA, 22 bp, Artificial Sequence
  chemically synthesized
ccctccctcctctgtctgggag

SEQ ID NO: 104177 - DNA, 22 bp, Artificial Sequence
  chemically synthesized
cctcctctgtctgggagaagca

SEQ ID NO: 104178 - DNA, 22 bp, Artificial Sequence
  chemically synthesized
ctctgtctgggagaagcaggga

SEQ ID NO: 104179 - DNA, 22 bp, Artificial Sequence
  chemically synthesized
tgtctgggagaagcagggacgc

SEQ ID NO: 104180 - DNA, 22 bp, Artificial Sequence
  chemically synthesized
tctgggagaagcagggacgctc

SEQ ID NO: 104181 - DNA, 22 bp, Artificial Sequence
  chemically synthesized
ggagaagcagggacgctcaacc

SEQ ID NO: 104182 - DNA, 22 bp, Artificial Sequence
  chemically synthesized
aaccaatgtcctcggaactttc

SEQ ID NO: 104183 - DNA, 22 bp, Artificial Sequence
  chemically synthesized
ggaactttcaggtatttctcca

SEQ ID NO: 104184 - DNA, 22 bp, Artificial Sequence
  chemically synthesized
tcaggtatttctccaaggatgg

SEQ ID NO: 104185 - DNA, 22 bp, Artificial Sequence
  chemically synthesized
caggtatttctccaaggatgga

SEQ ID NO: 104186 - DNA, 22 bp, Artificial Sequence
  chemically synthesized
aggtatttctccaaggatggat

SEQ ID NO: 104187 - DNA, 22 bp, Artificial Sequence
  chemically synthesized
ctccaaggatggatgagaaaag

SEQ ID NO: 104188 - DNA, 22 bp, Artificial Sequence
  chemically synthesized
tccaaggatggatgagaaaagc

SEQ ID NO: 104189 - DNA, 22 bp, Artificial Sequence
  chemically synthesized
caaggatggatgagaaaagctg

SEQ ID NO: 104190 - DNA, 22 bp, Artificial Sequence
  chemically synthesized
catactccaatgccacctctac

SEQ ID NO: 104191 - DNA, 22 bp, Artificial Sequence
  chemically synthesized
caatgccacctctacattggga

SEQ ID NO: 104192 - DNA, 22 bp, Artificial Sequence
  chemically synthesized
tacattgggatgccaggactta

SEQ ID NO: 104193 - DNA, 22 bp, Artificial Sequence
  chemically synthesized
cattgggatgccaggacttaat

SEQ ID NO: 104194 - DNA, 22 bp, Artificial Sequence
  chemically synthesized
ggatgccaggacttaattatgt

SEQ ID NO: 104195 - DNA, 22 bp, Artificial Sequence
  chemically synthesized
aattatgtgacccttcaggacc

SEQ ID NO: 104196 - DNA, 22 bp, Artificial Sequence
  chemically synthesized
attatgtgacccttcaggaccc

SEQ ID NO: 104197 - DNA, 22 bp, Artificial Sequence
  chemically synthesized
tgtgacccttcaggaccctaag

SEQ ID NO: 104198 - DNA, 22 bp, Artificial Sequence
  chemically synthesized
caggaccctaagcatcagtaca

SEQ ID NO: 104199 - DNA, 22 bp, Artificial Sequence
  chemically synthesized
aggaccctaagcatcagtacac

SEQ ID NO: 104200 - DNA, 22 bp, Artificial Sequence
  chemically synthesized
agcatcagtacacagtatatcc

SEQ ID NO: 104201 - DNA, 22 bp, Artificial Sequence
  chemically synthesized
tgcattgtctgtctcaatacaa

SEQ ID NO: 104202 - DNA, 22 bp, Artificial Sequence
  chemically synthesized
gcattgtctgtctcaatacaat

SEQ ID NO: 104203 - DNA, 22 bp, Artificial Sequence
  chemically synthesized
cattgtctgtctcaatacaatg

SEQ ID NO: 104204 - DNA, 22 bp, Artificial Sequence
  chemically synthesized
tctgtctcaatacaatgcaaag

SEQ ID NO: 104205 - DNA, 22 bp, Artificial Sequence
  chemically synthesized
tctcaatacaatgcaaagtatt

SEQ ID NO: 104206 - DNA, 22 bp, Artificial Sequence
  chemically synthesized
aatacaatgcaaagtattgaga

SEQ ID NO: 104207 - DNA, 22 bp, Artificial Sequence
  chemically synthesized
agagatactagttgaatgcagg

SEQ ID NO: 104208 - DNA, 22 bp, Artificial Sequence
  chemically synthesized
gttgaatgcagggtcacatgtg

SEQ ID NO: 104209 - DNA, 22 bp, Artificial Sequence
  chemically synthesized
aatgcagggtcacatgtgtctt

SEQ ID NO: 104210 - DNA, 22 bp, Artificial Sequence
  chemically synthesized
tgtcctggagtttatgcatttc

SEQ ID NO: 104211 - DNA, 22 bp, Artificial Sequence
  chemically synthesized
gtcctggagtttatgcatttca

SEQ ID NO: 104212 - DNA, 22 bp, Artificial Sequence
  chemically synthesized
tcctggagtttatgcatttcaa

SEQ ID NO: 104213 - DNA, 22 bp, Artificial Sequence
  chemically synthesized
gagtttatgcatttcaattgca

SEQ ID NO: 104214 - DNA, 22 bp, Artificial Sequence
  chemically synthesized
atgcatttcaattgcattgttg

SEQ ID NO: 104215 - DNA, 22 bp, Artificial Sequence
  chemically synthesized
tgcatttcaattgcattgttgt

SEQ ID NO: 104216 - DNA, 22 bp, Artificial Sequence
  chemically synthesized
caattgcattgttgtcttttct

SEQ ID NO: 104217 - DNA, 22 bp, Artificial Sequence
  chemically synthesized
aattgcattgttgtcttttctg

SEQ ID NO: 104218 - DNA, 22 bp, Artificial Sequence
  chemically synthesized
cattgttgtcttttctgatact

SEQ ID NO: 104219 - DNA, 22 bp, Artificial Sequence
  chemically synthesized
ttgtcttttctgatactttggg

SEQ ID NO: 104220 - DNA, 22 bp, Artificial Sequence
  chemically synthesized
tcttttctgatactttgggaaa

SEQ ID NO: 104221 - DNA, 22 bp, Artificial Sequence
  chemically synthesized
ttctgatactttgggaaaatca

SEQ ID NO: 104222 - DNA, 22 bp, Artificial Sequence
  chemically synthesized
tctgatactttgggaaaatcag

SEQ ID NO: 104223 - DNA, 22 bp, Artificial Sequence
  chemically synthesized
ctgatactttgggaaaatcagt

SEQ ID NO: 104224 - DNA, 22 bp, Artificial Sequence
  chemically synthesized
tgatactttgggaaaatcagtt

SEQ ID NO: 104225 - DNA, 22 bp, Artificial Sequence
  chemically synthesized
atactttgggaaaatcagttct

SEQ ID NO: 104226 - DNA, 22 bp, Artificial Sequence
  chemically synthesized
tgggaaaatcagttctgatcca

SEQ ID NO: 104227 - DNA, 22 bp, Artificial Sequence
  chemically synthesized
gggaaaatcagttctgatccac

SEQ ID NO: 104228 - DNA, 22 bp, Artificial Sequence
  chemically synthesized
ggaaaatcagttctgatccaca

SEQ ID NO: 104229 - DNA, 22 bp, Artificial Sequence
  chemically synthesized
tgatccacaggaacctcaatgg

SEQ ID NO: 104230 - DNA, 22 bp, Artificial Sequence
  chemically synthesized
atccacaggaacctcaatggat

SEQ ID NO: 104231 - DNA, 22 bp, Artificial Sequence
  chemically synthesized
aatggatctattaatagccaag

SEQ ID NO: 104232 - DNA, 22 bp, Artificial Sequence
  chemically synthesized
ttaatagccaagtaaatgaagg

SEQ ID NO: 104233 - DNA, 22 bp, Artificial Sequence
  chemically synthesized
atagccaagtaaatgaagggcc

SEQ ID NO: 104234 - DNA, 22 bp, Artificial Sequence
  chemically synthesized
ttatattttgtcttaaaataac

SEQ ID NO: 104235 - DNA, 22 bp, Artificial Sequence
  chemically synthesized
tattttgtcttaaaataacttt

SEQ ID NO: 104236 - DNA, 22 bp, Artificial Sequence
  chemically synthesized
tgtcttaaaataactttgttta

SEQ ID NO: 104237 - DNA, 22 bp, Artificial Sequence
  chemically synthesized
gtcttaaaataactttgtttat

SEQ ID NO: 104238 - DNA, 22 bp, Artificial Sequence
  chemically synthesized
tcttaaaataactttgtttata

SEQ ID NO: 104239 - DNA, 22 bp, Artificial Sequence
  chemically synthesized
aaaataactttgtttatataaa

SEQ ID NO: 104240 - DNA, 22 bp, Artificial Sequence
  chemically synthesized
aaataactttgtttatataaaa

SEQ ID NO: 104241 - DNA, 22 bp, Artificial Sequence
  chemically synthesized
tgtttatataaaaatcactgcc

SEQ ID NO: 104242 - DNA, 22 bp, Artificial Sequence
  chemically synthesized
gtttatataaaaatcactgccc

SEQ ID NO: 104243 - DNA, 22 bp, Artificial Sequence
  chemically synthesized
tttatataaaaatcactgccca

SEQ ID NO: 104244 - DNA, 22 bp, Artificial Sequence
  chemically synthesized
atataaaaatcactgcccattt

SEQ ID NO: 104245 - DNA, 22 bp, Artificial Sequence
  chemically synthesized
tataaaaatcactgcccatttc

SEQ ID NO: 104246 - DNA, 22 bp, Artificial Sequence
  chemically synthesized
cccatttcataccaggttcagg

SEQ ID NO: 104247 - DNA, 22 bp, Artificial Sequence
  chemically synthesized
cataccaggttcaggatagact

SEQ ID NO: 104248 - DNA, 22 bp, Artificial Sequence
  chemically synthesized
ataccaggttcaggatagactt

SEQ ID NO: 104249 - DNA, 22 bp, Artificial Sequence
  chemically synthesized
aggatagacttgtttttattta

SEQ ID NO: 104250 - DNA, 22 bp, Artificial Sequence
  chemically synthesized
gtttttatttatttgttttttc

SEQ ID NO: 104251 - DNA, 22 bp, Artificial Sequence
  chemically synthesized
tttttatttatttgttttttct

SEQ ID NO: 104252 - DNA, 22 bp, Artificial Sequence
  chemically synthesized
ttatttatttgttttttctttt

SEQ ID NO: 104253 - DNA, 22 bp, Artificial Sequence
  chemically synthesized
tatttatttgttttttctttta

SEQ ID NO: 104254 - DNA, 22 bp, Artificial Sequence
  chemically synthesized
atttatttgttttttcttttaa

SEQ ID NO: 104255 - DNA, 22 bp, Artificial Sequence
  chemically synthesized
tttatttgttttttcttttaaa

SEQ ID NO: 104256 - DNA, 22 bp, Artificial Sequence
  chemically synthesized
atttgttttttcttttaaattt

SEQ ID NO: 104257 - DNA, 22 bp, Artificial Sequence
  chemically synthesized
tttgttttttcttttaaatttt

SEQ ID NO: 104258 - DNA, 22 bp, Artificial Sequence
  chemically synthesized
gttttttcttttaaattttcaa

SEQ ID NO: 104259 - DNA, 22 bp, Artificial Sequence
  chemically synthesized
ttttttcttttaaattttcaac

SEQ ID NO: 104260 - DNA, 22 bp, Artificial Sequence
  chemically synthesized
tttcttttaaattttcaacatt

SEQ ID NO: 104261 - DNA, 22 bp, Artificial Sequence
  chemically synthesized
ttcttttaaattttcaacattt

SEQ ID NO: 104262 - DNA, 22 bp, Artificial Sequence
  chemically synthesized
tcttttaaattttcaacattta

SEQ ID NO: 104263 - DNA, 22 bp, Artificial Sequence
  chemically synthesized
cttttaaattttcaacatttac

SEQ ID NO: 104264 - DNA, 22 bp, Artificial Sequence
  chemically synthesized
ttttaaattttcaacatttact

SEQ ID NO: 104265 - DNA, 22 bp, Artificial Sequence
  chemically synthesized
ttaaattttcaacatttacttt

SEQ ID NO: 104266 - DNA, 22 bp, Artificial Sequence
  chemically synthesized
taaattttcaacatttacttta

SEQ ID NO: 104267 - DNA, 22 bp, Artificial Sequence
  chemically synthesized
aaattttcaacatttactttag

SEQ ID NO: 104268 - DNA, 22 bp, Artificial Sequence
  chemically synthesized
aattttcaacatttactttaga

SEQ ID NO: 104269 - DNA, 22 bp, Artificial Sequence
  chemically synthesized
tcaacatttactttagatacag

SEQ ID NO: 104270 - DNA, 22 bp, Artificial Sequence
  chemically synthesized
caacatttactttagatacagt

SEQ ID NO: 104271 - DNA, 22 bp, Artificial Sequence
  chemically synthesized
aacatttactttagatacagtg

SEQ ID NO: 104272 - DNA, 22 bp, Artificial Sequence
  chemically synthesized
actttagatacagtgggtactt

SEQ ID NO: 104273 - DNA, 22 bp, Artificial Sequence
  chemically synthesized
ctttagatacagtgggtacttg

SEQ ID NO: 104274 - DNA, 22 bp, Artificial Sequence
  chemically synthesized
tagatacagtgggtacttgtgc

SEQ ID NO: 104275 - DNA, 22 bp, Artificial Sequence
  chemically synthesized
agatacagtgggtacttgtgca

SEQ ID NO: 104276 - DNA, 22 bp, Artificial Sequence
  chemically synthesized
gatacagtgggtacttgtgcag

SEQ ID NO: 104277 - DNA, 22 bp, Artificial Sequence
  chemically synthesized
gtgcaggttttttacatggata

SEQ ID NO: 104278 - DNA, 22 bp, Artificial Sequence
  chemically synthesized
tgcaggttttttacatggatat

SEQ ID NO: 104279 - DNA, 22 bp, Artificial Sequence
  chemically synthesized
tttacatggatatattgcatgc

SEQ ID NO: 104280 - DNA, 22 bp, Artificial Sequence
  chemically synthesized
ttacatggatatattgcatgca

SEQ ID NO: 104281 - DNA, 22 bp, Artificial Sequence
  chemically synthesized
tacatggatatattgcatgcag

SEQ ID NO: 104282 - DNA, 22 bp, Artificial Sequence
  chemically synthesized
acatggatatattgcatgcagt

SEQ ID NO: 104283 - DNA, 22 bp, Artificial Sequence
  chemically synthesized
catggatatattgcatgcagtg

SEQ ID NO: 104284 - DNA, 22 bp, Artificial Sequence
  chemically synthesized
catgcagtggtgagcatactat

SEQ ID NO: 104285 - DNA, 22 bp, Artificial Sequence
  chemically synthesized
tccaatagattttttaaccctc

SEQ ID NO: 104286 - DNA, 22 bp, Artificial Sequence
  chemically synthesized
tttaaccctctcccgcatctct

SEQ ID NO: 104287 - DNA, 22 bp, Artificial Sequence
  chemically synthesized
ttaaccctctcccgcatctctc

SEQ ID NO: 104288 - DNA, 22 bp, Artificial Sequence
  chemically synthesized
taaccctctcccgcatctctcc

SEQ ID NO: 104289 - DNA, 22 bp, Artificial Sequence
  chemically synthesized
aaccctctcccgcatctctccc

SEQ ID NO: 104290 - DNA, 22 bp, Artificial Sequence
  chemically synthesized
accctctcccgcatctctccct

SEQ ID NO: 104291 - DNA, 22 bp, Artificial Sequence
  chemically synthesized
tcccgcatctctccctgcccct

SEQ ID NO: 104292 - DNA, 22 bp, Artificial Sequence
  chemically synthesized
ccgcatctctccctgccccttg

SEQ ID NO: 104293 - DNA, 22 bp, Artificial Sequence
  chemically synthesized
tccctgccccttgtagtagttt

SEQ ID NO: 104294 - DNA, 22 bp, Artificial Sequence
  chemically synthesized
cctgccccttgtagtagtttca

SEQ ID NO: 104295 - DNA, 22 bp, Artificial Sequence
  chemically synthesized
ccccttgtagtagtttcaagtg

SEQ ID NO: 104296 - DNA, 22 bp, Artificial Sequence
  chemically synthesized
gtagtagtttcaagtggctatt

SEQ ID NO: 104297 - DNA, 22 bp, Artificial Sequence
  chemically synthesized
tagtagtttcaagtggctattg

SEQ ID NO: 104298 - DNA, 22 bp, Artificial Sequence
  chemically synthesized
caagtggctattgttcccatgt

SEQ ID NO: 104299 - DNA, 22 bp, Artificial Sequence
  chemically synthesized
aagtggctattgttcccatgtt

SEQ ID NO: 104300 - DNA, 22 bp, Artificial Sequence
  chemically synthesized
ttgttcccatgtttatatccac

SEQ ID NO: 104301 - DNA, 22 bp, Artificial Sequence
  chemically synthesized
ttcccatgtttatatccacgtg

SEQ ID NO: 104302 - DNA, 22 bp, Artificial Sequence
  chemically synthesized
ccatgtttatatccacgtgtac

SEQ ID NO: 104303 - DNA, 22 bp, Artificial Sequence
  chemically synthesized
atatccacgtgtactcaatgtt

SEQ ID NO: 104304 - DNA, 22 bp, Artificial Sequence
  chemically synthesized
tatccacgtgtactcaatgttt

SEQ ID NO: 104305 - DNA, 22 bp, Artificial Sequence
  chemically synthesized
aatgtttagcttccacttataa

SEQ ID NO: 104306 - DNA, 22 bp, Artificial Sequence
  chemically synthesized
agcttccacttataaatgagaa

SEQ ID NO: 104307 - DNA, 22 bp, Artificial Sequence
  chemically synthesized
gcttccacttataaatgagaat

SEQ ID NO: 104308 - DNA, 22 bp, Artificial Sequence
  chemically synthesized
ccacttataaatgagaatatat

SEQ ID NO: 104309 - DNA, 22 bp, Artificial Sequence
  chemically synthesized
cacttataaatgagaatatatg

SEQ ID NO: 104310 - DNA, 22 bp, Artificial Sequence
  chemically synthesized
ataaatgagaatatatggtatt

SEQ ID NO: 104311 - DNA, 22 bp, Artificial Sequence
  chemically synthesized
taaatgagaatatatggtattt

SEQ ID NO: 104312 - DNA, 22 bp, Artificial Sequence
  chemically synthesized
gcttttgtgttcttgcgttaat

SEQ ID NO: 104313 - DNA, 22 bp, Artificial Sequence
  chemically synthesized
cttttgtgttcttgcgttaatt

SEQ ID NO: 104314 - DNA, 22 bp, Artificial Sequence
  chemically synthesized
ttgtgttcttgcgttaatttgc

SEQ ID NO: 104315 - DNA, 22 bp, Artificial Sequence
  chemically synthesized
tgtgttcttgcgttaatttgct

SEQ ID NO: 104316 - DNA, 22 bp, Artificial Sequence
  chemically synthesized
gtgttcttgcgttaatttgctt

SEQ ID NO: 104317 - DNA, 22 bp, Artificial Sequence
  chemically synthesized
tgttcttgcgttaatttgctta

SEQ ID NO: 104318 - DNA, 22 bp, Artificial Sequence
  chemically synthesized
ttgcgttaatttgcttaggatt

SEQ ID NO: 104319 - DNA, 22 bp, Artificial Sequence
  chemically synthesized
gcgttaatttgcttaggattat

SEQ ID NO: 104320 - DNA, 22 bp, Artificial Sequence
  chemically synthesized
cgttaatttgcttaggattata

SEQ ID NO: 104321 - DNA, 22 bp, Artificial Sequence
  chemically synthesized
atttgcttaggattatagcctc

SEQ ID NO: 104322 - DNA, 22 bp, Artificial Sequence
  chemically synthesized
gcttaggattatagcctccagc

SEQ ID NO: 104323 - DNA, 22 bp, Artificial Sequence
  chemically synthesized
cttaggattatagcctccagct

SEQ ID NO: 104324 - DNA, 22 bp, Artificial Sequence
  chemically synthesized
aggattatagcctccagctcca

SEQ ID NO: 104325 - DNA, 22 bp, Artificial Sequence
  chemically synthesized
ggattatagcctccagctccac

SEQ ID NO: 104326 - DNA, 22 bp, Artificial Sequence
  chemically synthesized
tagcctccagctccacccatgt

SEQ ID NO: 104327 - DNA, 22 bp, Artificial Sequence
  chemically synthesized
cagctccacccatgttgctgaa

SEQ ID NO: 104328 - DNA, 22 bp, Artificial Sequence
  chemically synthesized
cacccatgttgctgaaaaggac

SEQ ID NO: 104329 - DNA, 22 bp, Artificial Sequence
  chemically synthesized
ctgaaaaggacatgatttcatt

SEQ ID NO: 104330 - DNA, 22 bp, Artificial Sequence
  chemically synthesized
aaaaggacatgatttcatttgt

SEQ ID NO: 104331 - DNA, 22 bp, Artificial Sequence
  chemically synthesized
catttgttcttattgccacata

SEQ ID NO: 104332 - DNA, 22 bp, Artificial Sequence
  chemically synthesized
atttgttcttattgccacatag

SEQ ID NO: 104333 - DNA, 22 bp, Artificial Sequence
  chemically synthesized
gttcttattgccacatagtggt

SEQ ID NO: 104334 - DNA, 22 bp, Artificial Sequence
  chemically synthesized
ttcttattgccacatagtggtg

SEQ ID NO: 104335 - DNA, 22 bp, Artificial Sequence
  chemically synthesized
ttattgccacatagtggtggtg

SEQ ID NO: 104336 - DNA, 22 bp, Artificial Sequence
  chemically synthesized
attgccacatagtggtggtgta

SEQ ID NO: 104337 - DNA, 22 bp, Artificial Sequence
  chemically synthesized
ttgccacatagtggtggtgtat

SEQ ID NO: 104338 - DNA, 22 bp, Artificial Sequence
  chemically synthesized
ccacatagtggtggtgtatatg

SEQ ID NO: 104339 - DNA, 22 bp, Artificial Sequence
  chemically synthesized
ctttatcccgtccgcctttgat

SEQ ID NO: 104340 - DNA, 22 bp, Artificial Sequence
  chemically synthesized
tttatcccgtccgcctttgata

SEQ ID NO: 104341 - DNA, 22 bp, Artificial Sequence
  chemically synthesized
tatcccgtccgcctttgataga

SEQ ID NO: 104342 - DNA, 22 bp, Artificial Sequence
  chemically synthesized
atcccgtccgcctttgatagac

SEQ ID NO: 104343 - DNA, 22 bp, Artificial Sequence
  chemically synthesized
tcccgtccgcctttgatagaca

SEQ ID NO: 104344 - DNA, 22 bp, Artificial Sequence
  chemically synthesized
tgatagacacctaggccagtta

SEQ ID NO: 104345 - DNA, 22 bp, Artificial Sequence
  chemically synthesized
gatagacacctaggccagttat

SEQ ID NO: 104346 - DNA, 22 bp, Artificial Sequence
  chemically synthesized
atagacacctaggccagttatt

SEQ ID NO: 104347 - DNA, 22 bp, Artificial Sequence
  chemically synthesized
ggccagttatttgtatttgcta

SEQ ID NO: 104348 - DNA, 22 bp, Artificial Sequence
  chemically synthesized
tttgtatttgctattctaaaca

SEQ ID NO: 104349 - DNA, 22 bp, Artificial Sequence
  chemically synthesized
gtatttgctattctaaacagca

SEQ ID NO: 104350 - DNA, 22 bp, Artificial Sequence
  chemically synthesized
tatttgctattctaaacagcat

SEQ ID NO: 104351 - DNA, 22 bp, Artificial Sequence
  chemically synthesized
gctattctaaacagcattacag

SEQ ID NO: 104352 - DNA, 22 bp, Artificial Sequence
  chemically synthesized
ctattctaaacagcattacagt

SEQ ID NO: 104353 - DNA, 22 bp, Artificial Sequence
  chemically synthesized
ttctaaacagcattacagtgaa

SEQ ID NO: 104354 - DNA, 22 bp, Artificial Sequence
  chemically synthesized
taaacagcattacagtgaacat

SEQ ID NO: 104355 - DNA, 22 bp, Artificial Sequence
  chemically synthesized
aacagcattacagtgaacatgc

SEQ ID NO: 104356 - DNA, 22 bp, Artificial Sequence
  chemically synthesized
cagtgaacatgcaagtgcatgt

SEQ ID NO: 104357 - DNA, 22 bp, Artificial Sequence
  chemically synthesized
gttggtctaatgctctgttttc

SEQ ID NO: 104358 - DNA, 22 bp, Artificial Sequence
  chemically synthesized
gtctaatgctctgttttcctat

SEQ ID NO: 104359 - DNA, 22 bp, Artificial Sequence
  chemically synthesized
atgctctgttttcctatggata

SEQ ID NO: 104360 - DNA, 22 bp, Artificial Sequence
  chemically synthesized
tgttttcctatggatatatacc

SEQ ID NO: 104361 - DNA, 22 bp, Artificial Sequence
  chemically synthesized
ttttcctatggatatataccca

SEQ ID NO: 104362 - DNA, 22 bp, Artificial Sequence
  chemically synthesized
tcctatggatatatacccagta

SEQ ID NO: 104363 - DNA, 22 bp, Artificial Sequence
  chemically synthesized
cctatggatatatacccagtag

SEQ ID NO: 104364 - DNA, 22 bp, Artificial Sequence
  chemically synthesized
ctatggatatatacccagtagc

SEQ ID NO: 104365 - DNA, 22 bp, Artificial Sequence
  chemically synthesized
tggatatatacccagtagcggg

SEQ ID NO: 104366 - DNA, 22 bp, Artificial Sequence
  chemically synthesized
ctgtgtcaaattgtagctctgc

SEQ ID NO: 104367 - DNA, 22 bp, Artificial Sequence
  chemically synthesized
tgtcaaattgtagctctgctta

SEQ ID NO: 104368 - DNA, 22 bp, Artificial Sequence
  chemically synthesized
tagctctgcttaaagttctttg

SEQ ID NO: 104369 - DNA, 22 bp, Artificial Sequence
  chemically synthesized
tgcttaaagttctttgaagact

SEQ ID NO: 104370 - DNA, 22 bp, Artificial Sequence
  chemically synthesized
cttaaagttctttgaagactct

SEQ ID NO: 104371 - DNA, 22 bp, Artificial Sequence
  chemically synthesized
aaagttctttgaagactctcca

SEQ ID NO: 104372 - DNA, 22 bp, Artificial Sequence
  chemically synthesized
aagttctttgaagactctccaa

SEQ ID NO: 104373 - DNA, 22 bp, Artificial Sequence
  chemically synthesized
tttgaagactctccaaactgtt

SEQ ID NO: 104374 - DNA, 22 bp, Artificial Sequence
  chemically synthesized
tgaagactctccaaactgtttt

SEQ ID NO: 104375 - DNA, 22 bp, Artificial Sequence
  chemically synthesized
gaagactctccaaactgttttc

SEQ ID NO: 104376 - DNA, 22 bp, Artificial Sequence
  chemically synthesized
aagactctccaaactgttttct

SEQ ID NO: 104377 - DNA, 22 bp, Artificial Sequence
  chemically synthesized
tccaaactgttttctgcagtgg

SEQ ID NO: 104378 - DNA, 22 bp, Artificial Sequence
  chemically synthesized
caaactgttttctgcagtggtt

SEQ ID NO: 104379 - DNA, 22 bp, Artificial Sequence
  chemically synthesized
ttttctgcagtggttgaactaa

SEQ ID NO: 104380 - DNA, 22 bp, Artificial Sequence
  chemically synthesized
tctgcagtggttgaactaattt

SEQ ID NO: 104381 - DNA, 22 bp, Artificial Sequence
  chemically synthesized
ctgcagtggttgaactaattta

SEQ ID NO: 104382 - DNA, 22 bp, Artificial Sequence
  chemically synthesized
tgcagtggttgaactaatttac

SEQ ID NO: 104383 - DNA, 22 bp, Artificial Sequence
  chemically synthesized
cagtggttgaactaatttacat

SEQ ID NO: 104384 - DNA, 22 bp, Artificial Sequence
  chemically synthesized
aactaatttacatccccatcat

SEQ ID NO: 104385 - DNA, 22 bp, Artificial Sequence
  chemically synthesized
atttacatccccatcatcattg

SEQ ID NO: 104386 - DNA, 22 bp, Artificial Sequence
  chemically synthesized
acatccccatcatcattgtata

SEQ ID NO: 104387 - DNA, 22 bp, Artificial Sequence
  chemically synthesized
catccccatcatcattgtataa

SEQ ID NO: 104388 - DNA, 22 bp, Artificial Sequence
  chemically synthesized
tataagtgttcccttttctcca

SEQ ID NO: 104389 - DNA, 22 bp, Artificial Sequence
  chemically synthesized
ccttttctccatagcctcatga

SEQ ID NO: 104390 - DNA, 22 bp, Artificial Sequence
  chemically synthesized
ttctccatagcctcatgagaat

SEQ ID NO: 104391 - DNA, 22 bp, Artificial Sequence
  chemically synthesized
tctccatagcctcatgagaatc

SEQ ID NO: 104392 - DNA, 22 bp, Artificial Sequence
  chemically synthesized
ctccatagcctcatgagaatct

SEQ ID NO: 104393 - DNA, 22 bp, Artificial Sequence
  chemically synthesized
tccatagcctcatgagaatctg

SEQ ID NO: 104394 - DNA, 22 bp, Artificial Sequence
  chemically synthesized
catagcctcatgagaatctgtt

SEQ ID NO: 104395 - DNA, 22 bp, Artificial Sequence
  chemically synthesized
atgagaatctgttttttggctt

SEQ ID NO: 104396 - DNA, 22 bp, Artificial Sequence
  chemically synthesized
ttttttggctttttaaaaatag

SEQ ID NO: 104397 - DNA, 22 bp, Artificial Sequence
  chemically synthesized
tttggctttttaaaaatagcta

SEQ ID NO: 104398 - DNA, 22 bp, Artificial Sequence
  chemically synthesized
ttggctttttaaaaatagctat

SEQ ID NO: 104399 - DNA, 22 bp, Artificial Sequence
  chemically synthesized
tggctttttaaaaatagctatt

SEQ ID NO: 104400 - DNA, 22 bp, Artificial Sequence
  chemically synthesized
ggctttttaaaaatagctattc

SEQ ID NO: 104401 - DNA, 22 bp, Artificial Sequence
  chemically synthesized
gctttttaaaaatagctattct

SEQ ID NO: 104402 - DNA, 22 bp, Artificial Sequence
  chemically synthesized
tttaaaaatagctattctgact

SEQ ID NO: 104403 - DNA, 22 bp, Artificial Sequence
  chemically synthesized
ttaaaaatagctattctgactg

SEQ ID NO: 104404 - DNA, 22 bp, Artificial Sequence
  chemically synthesized
taaaaatagctattctgactgg

SEQ ID NO: 104405 - DNA, 22 bp, Artificial Sequence
  chemically synthesized
aaaaatagctattctgactggt

SEQ ID NO: 104406 - DNA, 22 bp, Artificial Sequence
  chemically synthesized
aaaatagctattctgactggta

SEQ ID NO: 104407 - DNA, 22 bp, Artificial Sequence
  chemically synthesized
ttctgactggtatgagatagta

SEQ ID NO: 104408 - DNA, 22 bp, Artificial Sequence
  chemically synthesized
tgactggtatgagatagtatct

SEQ ID NO: 104409 - DNA, 22 bp, Artificial Sequence
  chemically synthesized
actggtatgagatagtatctct

SEQ ID NO: 104410 - DNA, 22 bp, Artificial Sequence
  chemically synthesized
gtatgagatagtatctcttgtg

SEQ ID NO: 104411 - DNA, 22 bp, Artificial Sequence
  chemically synthesized
ttgtggttttgatttgcatttc

SEQ ID NO: 104412 - DNA, 22 bp, Artificial Sequence
  chemically synthesized
gtggttttgatttgcatttctc

SEQ ID NO: 104413 - DNA, 22 bp, Artificial Sequence
  chemically synthesized
tggttttgatttgcatttctct

SEQ ID NO: 104414 - DNA, 22 bp, Artificial Sequence
  chemically synthesized
tgatttgcatttctctcattag

SEQ ID NO: 104415 - DNA, 22 bp, Artificial Sequence
  chemically synthesized
gatttgcatttctctcattagt

SEQ ID NO: 104416 - DNA, 22 bp, Artificial Sequence
  chemically synthesized
atttgcatttctctcattagtg

SEQ ID NO: 104417 - DNA, 22 bp, Artificial Sequence
  chemically synthesized
gcatttctctcattagtgatga

SEQ ID NO: 104418 - DNA, 22 bp, Artificial Sequence
  chemically synthesized
catttctctcattagtgatgat

SEQ ID NO: 104419 - DNA, 22 bp, Artificial Sequence
  chemically synthesized
ctctcattagtgatgatgatca

SEQ ID NO: 104420 - DNA, 22 bp, Artificial Sequence
  chemically synthesized
tctcattagtgatgatgatcat

SEQ ID NO: 104421 - DNA, 22 bp, Artificial Sequence
  chemically synthesized
tcattagtgatgatgatcattt

SEQ ID NO: 104422 - DNA, 22 bp, Artificial Sequence
  chemically synthesized
attagtgatgatgatcattttt

SEQ ID NO: 104423 - DNA, 22 bp, Artificial Sequence
  chemically synthesized
gtgatgatgatcatttttgtat

SEQ ID NO: 104424 - DNA, 22 bp, Artificial Sequence
  chemically synthesized
ttgtatatatttgttggctgcc

SEQ ID NO: 104425 - DNA, 22 bp, Artificial Sequence
  chemically synthesized
tgtatatatttgttggctgcct

SEQ ID NO: 104426 - DNA, 22 bp, Artificial Sequence
  chemically synthesized
gtatatatttgttggctgcctg

SEQ ID NO: 104427 - DNA, 22 bp, Artificial Sequence
  chemically synthesized
tatatatttgttggctgcctgt

SEQ ID NO: 104428 - DNA, 22 bp, Artificial Sequence
  chemically synthesized
gttggctgcctgtatgtcttct

SEQ ID NO: 104429 - DNA, 22 bp, Artificial Sequence
  chemically synthesized
ttggctgcctgtatgtcttctc

SEQ ID NO: 104430 - DNA, 22 bp, Artificial Sequence
  chemically synthesized
gctgcctgtatgtcttctcttg

SEQ ID NO: 104431 - DNA, 22 bp, Artificial Sequence
  chemically synthesized
cctgtatgtcttctcttgagaa

SEQ ID NO: 104432 - DNA, 22 bp, Artificial Sequence
  chemically synthesized
tatgtcttctcttgagaagagt

SEQ ID NO: 104433 - DNA, 22 bp, Artificial Sequence
  chemically synthesized
ctcttgagaagagtctgttcgt

SEQ ID NO: 104434 - DNA, 22 bp, Artificial Sequence
  chemically synthesized
tcttgagaagagtctgttcgtg

SEQ ID NO: 104435 - DNA, 22 bp, Artificial Sequence
  chemically synthesized
ttgagaagagtctgttcgtgga

SEQ ID NO: 104436 - DNA, 22 bp, Artificial Sequence
  chemically synthesized
gagaagagtctgttcgtggatt

SEQ ID NO: 104437 - DNA, 22 bp, Artificial Sequence
  chemically synthesized
agaagagtctgttcgtggattt

SEQ ID NO: 104438 - DNA, 22 bp, Artificial Sequence
  chemically synthesized
ttcgtggattttgcccattttt

SEQ ID NO: 104439 - DNA, 22 bp, Artificial Sequence
  chemically synthesized
gtggattttgcccatttttaaa

SEQ ID NO: 104440 - DNA, 22 bp, Artificial Sequence
  chemically synthesized
tgcccatttttaaatggaattg

SEQ ID NO: 104441 - DNA, 22 bp, Artificial Sequence
  chemically synthesized
gcccatttttaaatggaattgt

SEQ ID NO: 104442 - DNA, 22 bp, Artificial Sequence
  chemically synthesized
cccatttttaaatggaattgtt

SEQ ID NO: 104443 - DNA, 22 bp, Artificial Sequence
  chemically synthesized
ttaaatggaattgtttgctttt

SEQ ID NO: 104444 - DNA, 22 bp, Artificial Sequence
  chemically synthesized
taaatggaattgtttgcttttt

SEQ ID NO: 104445 - DNA, 22 bp, Artificial Sequence
  chemically synthesized
aaatggaattgtttgctttttg

SEQ ID NO: 104446 - DNA, 22 bp, Artificial Sequence
  chemically synthesized
aatggaattgtttgctttttgc

SEQ ID NO: 104447 - DNA, 22 bp, Artificial Sequence
  chemically synthesized
tttgctttttgcttgctgatat

SEQ ID NO: 104448 - DNA, 22 bp, Artificial Sequence
  chemically synthesized
gctttttgcttgctgatatgtt

SEQ ID NO: 104449 - DNA, 22 bp, Artificial Sequence
  chemically synthesized
ctttttgcttgctgatatgttc

SEQ ID NO: 104450 - DNA, 22 bp, Artificial Sequence
  chemically synthesized
tttgcttgctgatatgttcgaa

SEQ ID NO: 104451 - DNA, 22 bp, Artificial Sequence
  chemically synthesized
ttgcttgctgatatgttcgaat

SEQ ID NO: 104452 - DNA, 22 bp, Artificial Sequence
  chemically synthesized
tgcttgctgatatgttcgaatt

SEQ ID NO: 104453 - DNA, 22 bp, Artificial Sequence
  chemically synthesized
gcttgctgatatgttcgaattc

SEQ ID NO: 104454 - DNA, 22 bp, Artificial Sequence
  chemically synthesized
cttgctgatatgttcgaattcc

SEQ ID NO: 104455 - DNA, 22 bp, Artificial Sequence
  chemically synthesized
gctgatatgttcgaattcctta

SEQ ID NO: 104456 - DNA, 22 bp, Artificial Sequence
  chemically synthesized
ctgatatgttcgaattccttat

SEQ ID NO: 104457 - DNA, 22 bp, Artificial Sequence
  chemically synthesized
atatgttcgaattccttataga

SEQ ID NO: 104458 - DNA, 22 bp, Artificial Sequence
  chemically synthesized
gaattccttatagattctgaat

SEQ ID NO: 104459 - DNA, 22 bp, Artificial Sequence
  chemically synthesized
cttatagattctgaatattaga

SEQ ID NO: 104460 - DNA, 22 bp, Artificial Sequence
  chemically synthesized
atagattctgaatattagacct

SEQ ID NO: 104461 - DNA, 22 bp, Artificial Sequence
  chemically synthesized
tagattctgaatattagacctt

SEQ ID NO: 104462 - DNA, 22 bp, Artificial Sequence
  chemically synthesized
tgaatattagaccttttccaga

SEQ ID NO: 104463 - DNA, 22 bp, Artificial Sequence
  chemically synthesized
aatattagaccttttccagatg

SEQ ID NO: 104464 - DNA, 22 bp, Artificial Sequence
  chemically synthesized
gaccttttccagatgcacagtt

SEQ ID NO: 104465 - DNA, 22 bp, Artificial Sequence
  chemically synthesized
ttccagatgcacagtttgtgaa

SEQ ID NO: 104466 - DNA, 22 bp, Artificial Sequence
  chemically synthesized
tccagatgcacagtttgtgaat

SEQ ID NO: 104467 - DNA, 22 bp, Artificial Sequence
  chemically synthesized
ccagatgcacagtttgtgaata

SEQ ID NO: 104468 - DNA, 22 bp, Artificial Sequence
  chemically synthesized
cagatgcacagtttgtgaatag

SEQ ID NO: 104469 - DNA, 22 bp, Artificial Sequence
  chemically synthesized
gtgaatagtttctcctatcctg

SEQ ID NO: 104470 - DNA, 22 bp, Artificial Sequence
  chemically synthesized
tgaatagtttctcctatcctgt

SEQ ID NO: 104471 - DNA, 22 bp, Artificial Sequence
  chemically synthesized
ctcctatcctgtagattgtcag

SEQ ID NO: 104472 - DNA, 22 bp, Artificial Sequence
  chemically synthesized
tcctatcctgtagattgtcagt

SEQ ID NO: 104473 - DNA, 22 bp, Artificial Sequence
  chemically synthesized
ctatcctgtagattgtcagttt

SEQ ID NO: 104474 - DNA, 22 bp, Artificial Sequence
  chemically synthesized
tcctgtagattgtcagtttact

SEQ ID NO: 104475 - DNA, 22 bp, Artificial Sequence
  chemically synthesized
tagattgtcagtttactctgtt

SEQ ID NO: 104476 - DNA, 22 bp, Artificial Sequence
  chemically synthesized
tcagtttactctgttgatagtt

SEQ ID NO: 104477 - DNA, 22 bp, Artificial Sequence
  chemically synthesized
actctgttgatagtttcttctg

SEQ ID NO: 104478 - DNA, 22 bp, Artificial Sequence
  chemically synthesized
ctctgttgatagtttcttctgc

SEQ ID NO: 104479 - DNA, 22 bp, Artificial Sequence
  chemically synthesized
tgttgatagtttcttctgctgc

SEQ ID NO: 104480 - DNA, 22 bp, Artificial Sequence
  chemically synthesized
ttgatagtttcttctgctgcac

SEQ ID NO: 104481 - DNA, 22 bp, Artificial Sequence
  chemically synthesized
atagtttcttctgctgcacaga

SEQ ID NO: 104482 - DNA, 22 bp, Artificial Sequence
  chemically synthesized
cttctgctgcacagaagctctt

SEQ ID NO: 104483 - DNA, 22 bp, Artificial Sequence
  chemically synthesized
ttctgctgcacagaagctcttt

SEQ ID NO: 104484 - DNA, 22 bp, Artificial Sequence
  chemically synthesized
ctgctgcacagaagctcttttt

SEQ ID NO: 104485 - DNA, 22 bp, Artificial Sequence
  chemically synthesized
tgctgcacagaagctcttttta

SEQ ID NO: 104486 - DNA, 22 bp, Artificial Sequence
  chemically synthesized
ctgcacagaagctctttttatt

SEQ ID NO: 104487 - DNA, 22 bp, Artificial Sequence
  chemically synthesized
cacagaagctctttttattatt

SEQ ID NO: 104488 - DNA, 22 bp, Artificial Sequence
  chemically synthesized
tttttattattattattatact

SEQ ID NO: 104489 - DNA, 22 bp, Artificial Sequence
  chemically synthesized
tttattattattattatacttt

SEQ ID NO: 104490 - DNA, 22 bp, Artificial Sequence
  chemically synthesized
ttattattattattatacttta

SEQ ID NO: 104491 - DNA, 22 bp, Artificial Sequence
  chemically synthesized
tattattattattatactttaa

SEQ ID NO: 104492 - DNA, 22 bp, Artificial Sequence
  chemically synthesized
attattattattatactttaag

SEQ ID NO: 104493 - DNA, 22 bp, Artificial Sequence
  chemically synthesized
ttattattattatactttaagt

SEQ ID NO: 104494 - DNA, 22 bp, Artificial Sequence
  chemically synthesized
ttattattatactttaagttct

SEQ ID NO: 104495 - DNA, 22 bp, Artificial Sequence
  chemically synthesized
ttattatactttaagttctagg

SEQ ID NO: 104496 - DNA, 22 bp, Artificial Sequence
  chemically synthesized
ttatactttaagttctagggta

SEQ ID NO: 104497 - DNA, 22 bp, Artificial Sequence
  chemically synthesized
tactttaagttctagggtacat

SEQ ID NO: 104498 - DNA, 22 bp, Artificial Sequence
  chemically synthesized
taagttctagggtacatgtgcg

SEQ ID NO: 104499 - DNA, 22 bp, Artificial Sequence
  chemically synthesized
aagttctagggtacatgtgcgc

SEQ ID NO: 104500 - DNA, 22 bp, Artificial Sequence
  chemically synthesized
agttctagggtacatgtgcgca

SEQ ID NO: 104501 - DNA, 22 bp, Artificial Sequence
  chemically synthesized
tagggtacatgtgcgcaacgtg

SEQ ID NO: 104502 - DNA, 22 bp, Artificial Sequence
  chemically synthesized
gggtacatgtgcgcaacgtgca

SEQ ID NO: 104503 - DNA, 22 bp, Artificial Sequence
  chemically synthesized
gttacatatgtatacatgtgcc

SEQ ID NO: 104504 - DNA, 22 bp, Artificial Sequence
  chemically synthesized
ttacatatgtatacatgtgcca

SEQ ID NO: 104505 - DNA, 22 bp, Artificial Sequence
  chemically synthesized
catatgtatacatgtgccatgt

SEQ ID NO: 104506 - DNA, 22 bp, Artificial Sequence
  chemically synthesized
gtgtgctgcacccattaactca

SEQ ID NO: 104507 - DNA, 22 bp, Artificial Sequence
  chemically synthesized
cacccattaactcatcatttac

SEQ ID NO: 104508 - DNA, 22 bp, Artificial Sequence
  chemically synthesized
actcatcatttacattaggtat

SEQ ID NO: 104509 - DNA, 22 bp, Artificial Sequence
  chemically synthesized
atcatttacattaggtatatct

SEQ ID NO: 104510 - DNA, 22 bp, Artificial Sequence
  chemically synthesized
acattaggtatatctcctaatg

SEQ ID NO: 104511 - DNA, 22 bp, Artificial Sequence
  chemically synthesized
cattaggtatatctcctaatgc

SEQ ID NO: 104512 - DNA, 22 bp, Artificial Sequence
  chemically synthesized
ggtatatctcctaatgctatcc

SEQ ID NO: 104513 - DNA, 22 bp, Artificial Sequence
  chemically synthesized
ctaatgctatccctctccaccc

SEQ ID NO: 104514 - DNA, 22 bp, Artificial Sequence
  chemically synthesized
atgctatccctctccacccccc

SEQ ID NO: 104515 - DNA, 22 bp, Artificial Sequence
  chemically synthesized
tccctctccaccccccaccccc

SEQ ID NO: 104516 - DNA, 22 bp, Artificial Sequence
  chemically synthesized
tccaccccccacccccacccca

SEQ ID NO: 104517 - DNA, 22 bp, Artificial Sequence
  chemically synthesized
caccccccacccccaccccaca

SEQ ID NO: 104518 - DNA, 22 bp, Artificial Sequence
  chemically synthesized
gtgtgtgatgttccccttcctc

SEQ ID NO: 104519 - DNA, 22 bp, Artificial Sequence
  chemically synthesized
cccttcctctgtccaagtgttc

SEQ ID NO: 104520 - DNA, 22 bp, Artificial Sequence
  chemically synthesized
cctctgtccaagtgttctcatt

SEQ ID NO: 104521 - DNA, 22 bp, Artificial Sequence
  chemically synthesized
ctctgtccaagtgttctcattg

SEQ ID NO: 104522 - DNA, 22 bp, Artificial Sequence
  chemically synthesized
tgtccaagtgttctcattgttc

SEQ ID NO: 104523 - DNA, 22 bp, Artificial Sequence
  chemically synthesized
tccaagtgttctcattgttcaa

SEQ ID NO: 104524 - DNA, 22 bp, Artificial Sequence
  chemically synthesized
tcattgttcaattcccacctat

SEQ ID NO: 104525 - DNA, 22 bp, Artificial Sequence
  chemically synthesized
attgttcaattcccacctataa

SEQ ID NO: 104526 - DNA, 22 bp, Artificial Sequence
  chemically synthesized
ttcaattcccacctataagtga

SEQ ID NO: 104527 - DNA, 22 bp, Artificial Sequence
  chemically synthesized
aattcccacctataagtgagaa

SEQ ID NO: 104528 - DNA, 22 bp, Artificial Sequence
  chemically synthesized
ccacctataagtgagaacatgt

SEQ ID NO: 104529 - DNA, 22 bp, Artificial Sequence
  chemically synthesized
taagtgagaacatgtggtattt

SEQ ID NO: 104530 - DNA, 22 bp, Artificial Sequence
  chemically synthesized
ggttttttgtccttgtgatagt

SEQ ID NO: 104531 - DNA, 22 bp, Artificial Sequence
  chemically synthesized
gttttttgtccttgtgatagtt

SEQ ID NO: 104532 - DNA, 22 bp, Artificial Sequence
  chemically synthesized
tttgtccttgtgatagtttgct

SEQ ID NO: 104533 - DNA, 22 bp, Artificial Sequence
  chemically synthesized
ttgtccttgtgatagtttgctg

SEQ ID NO: 104534 - DNA, 22 bp, Artificial Sequence
  chemically synthesized
tgtccttgtgatagtttgctga

SEQ ID NO: 104535 - DNA, 22 bp, Artificial Sequence
  chemically synthesized
gtccttgtgatagtttgctgag

SEQ ID NO: 104536 - DNA, 22 bp, Artificial Sequence
  chemically synthesized
tccttgtgatagtttgctgaga

SEQ ID NO: 104537 - DNA, 22 bp, Artificial Sequence
  chemically synthesized
gtgatagtttgctgagaatgat

SEQ ID NO: 104538 - DNA, 22 bp, Artificial Sequence
  chemically synthesized
tgatagtttgctgagaatgatg

SEQ ID NO: 104539 - DNA, 22 bp, Artificial Sequence
  chemically synthesized
gctgagaatgatggtttccagc

SEQ ID NO: 104540 - DNA, 22 bp, Artificial Sequence
  chemically synthesized
ctgagaatgatggtttccagct

SEQ ID NO: 104541 - DNA, 22 bp, Artificial Sequence
  chemically synthesized
agaatgatggtttccagcttca

SEQ ID NO: 104542 - DNA, 22 bp, Artificial Sequence
  chemically synthesized
ccagcttcatccatgtccctac

SEQ ID NO: 104543 - DNA, 22 bp, Artificial Sequence
  chemically synthesized
cagcttcatccatgtccctaca

SEQ ID NO: 104544 - DNA, 22 bp, Artificial Sequence
  chemically synthesized
catccatgtccctacaaaggac

SEQ ID NO: 104545 - DNA, 22 bp, Artificial Sequence
  chemically synthesized
atccatgtccctacaaaggaca

SEQ ID NO: 104546 - DNA, 22 bp, Artificial Sequence
  chemically synthesized
caaaggacatgaactcatcatt

SEQ ID NO: 104547 - DNA, 22 bp, Artificial Sequence
  chemically synthesized
atcattttttatggctgcatag

SEQ ID NO: 104548 - DNA, 22 bp, Artificial Sequence
  chemically synthesized
tttatggctgcatagtattcca

SEQ ID NO: 104549 - DNA, 22 bp, Artificial Sequence
  chemically synthesized
ttatggctgcatagtattccat

SEQ ID NO: 104550 - DNA, 22 bp, Artificial Sequence
  chemically synthesized
tatggctgcatagtattccatg

SEQ ID NO: 104551 - DNA, 22 bp, Artificial Sequence
  chemically synthesized
atggctgcatagtattccatgg

SEQ ID NO: 104552 - DNA, 22 bp, Artificial Sequence
  chemically synthesized
tggctgcatagtattccatggt

SEQ ID NO: 104553 - DNA, 22 bp, Artificial Sequence
  chemically synthesized
catagtattccatggtgtatat

SEQ ID NO: 104554 - DNA, 22 bp, Artificial Sequence
  chemically synthesized
catggtgtatatgtgccacatt

SEQ ID NO: 104555 - DNA, 22 bp, Artificial Sequence
  chemically synthesized
tcttaatccattctatcattgt

SEQ ID NO: 104556 - DNA, 22 bp, Artificial Sequence
  chemically synthesized
cttaatccattctatcattgtt

SEQ ID NO: 104557 - DNA, 22 bp, Artificial Sequence
  chemically synthesized
ttaatccattctatcattgttg

SEQ ID NO: 104558 - DNA, 22 bp, Artificial Sequence
  chemically synthesized
aatccattctatcattgttgga

SEQ ID NO: 104559 - DNA, 22 bp, Artificial Sequence
  chemically synthesized
atccattctatcattgttggac

SEQ ID NO: 104560 - DNA, 22 bp, Artificial Sequence
  chemically synthesized
tatcattgttggacatttgggt

SEQ ID NO: 104561 - DNA, 22 bp, Artificial Sequence
  chemically synthesized
tcattgttggacatttgggttg

SEQ ID NO: 104562 - DNA, 22 bp, Artificial Sequence
  chemically synthesized
ttggacatttgggttggttcca

SEQ ID NO: 104563 - DNA, 22 bp, Artificial Sequence
  chemically synthesized
gacatttgggttggttccaagt

SEQ ID NO: 104564 - DNA, 22 bp, Artificial Sequence
  chemically synthesized
gggttggttccaagtctttgtt

SEQ ID NO: 104565 - DNA, 22 bp, Artificial Sequence
  chemically synthesized
ggttggttccaagtctttgtta

SEQ ID NO: 104566 - DNA, 22 bp, Artificial Sequence
  chemically synthesized
gttccaagtctttgttattgtg

SEQ ID NO: 104567 - DNA, 22 bp, Artificial Sequence
  chemically synthesized
caagtctttgttattgtgaata

SEQ ID NO: 104568 - DNA, 22 bp, Artificial Sequence
  chemically synthesized
tgttattgtgaatagtgaagct

SEQ ID NO: 104569 - DNA, 22 bp, Artificial Sequence
  chemically synthesized
gttattgtgaatagtgaagctc

SEQ ID NO: 104570 - DNA, 22 bp, Artificial Sequence
  chemically synthesized
ttattgtgaatagtgaagctct

SEQ ID NO: 104571 - DNA, 22 bp, Artificial Sequence
  chemically synthesized
ttgtgaatagtgaagctcttta

SEQ ID NO: 104572 - DNA, 22 bp, Artificial Sequence
  chemically synthesized
tgaatagtgaagctctttagtt

SEQ ID NO: 104573 - DNA, 22 bp, Artificial Sequence
  chemically synthesized
tttagtttaattaggttccact

SEQ ID NO: 104574 - DNA, 22 bp, Artificial Sequence
  chemically synthesized
tagtttaattaggttccacttg

SEQ ID NO: 104575 - DNA, 22 bp, Artificial Sequence
  chemically synthesized
agtttaattaggttccacttgt

SEQ ID NO: 104576 - DNA, 22 bp, Artificial Sequence
  chemically synthesized
gtttaattaggttccacttgtg

SEQ ID NO: 104577 - DNA, 22 bp, Artificial Sequence
  chemically synthesized
aattaggttccacttgtgaatt

SEQ ID NO: 104578 - DNA, 22 bp, Artificial Sequence
  chemically synthesized
attaggttccacttgtgaattt

SEQ ID NO: 104579 - DNA, 22 bp, Artificial Sequence
  chemically synthesized
ggttccacttgtgaatttttct

SEQ ID NO: 104580 - DNA, 22 bp, Artificial Sequence
  chemically synthesized
cacttgtgaatttttctttgca

SEQ ID NO: 104581 - DNA, 22 bp, Artificial Sequence
  chemically synthesized
gtgaatttttctttgcattgca

SEQ ID NO: 104582 - DNA, 22 bp, Artificial Sequence
  chemically synthesized
tgaatttttctttgcattgcaa

SEQ ID NO: 104583 - DNA, 22 bp, Artificial Sequence
  chemically synthesized
ttctttgcattgcaattgcttt

SEQ ID NO: 104584 - DNA, 22 bp, Artificial Sequence
  chemically synthesized
tctttgcattgcaattgctttt

SEQ ID NO: 104585 - DNA, 22 bp, Artificial Sequence
  chemically synthesized
ctttgcattgcaattgcttttg

SEQ ID NO: 104586 - DNA, 22 bp, Artificial Sequence
  chemically synthesized
tttgcattgcaattgcttttgg

SEQ ID NO: 104587 - DNA, 22 bp, Artificial Sequence
  chemically synthesized
tgcattgcaattgcttttgggg

SEQ ID NO: 104588 - DNA, 22 bp, Artificial Sequence
  chemically synthesized
gcattgcaattgcttttggggg

SEQ ID NO: 104589 - DNA, 22 bp, Artificial Sequence
  chemically synthesized
cattgcaattgcttttgggggc

SEQ ID NO: 104590 - DNA, 22 bp, Artificial Sequence
  chemically synthesized
caattgcttttgggggcttagc

SEQ ID NO: 104591 - DNA, 22 bp, Artificial Sequence
  chemically synthesized
cttttgggggcttagccaaaaa

SEQ ID NO: 104592 - DNA, 22 bp, Artificial Sequence
  chemically synthesized
ttgggggcttagccaaaaatgc

SEQ ID NO: 104593 - DNA, 22 bp, Artificial Sequence
  chemically synthesized
tgggggcttagccaaaaatgca

SEQ ID NO: 104594 - DNA, 22 bp, Artificial Sequence
  chemically synthesized
gggggcttagccaaaaatgcac

SEQ ID NO: 104595 - DNA, 22 bp, Artificial Sequence
  chemically synthesized
ggggcttagccaaaaatgcact

SEQ ID NO: 104596 - DNA, 22 bp, Artificial Sequence
  chemically synthesized
agccaaaaatgcactgccagtg

SEQ ID NO: 104597 - DNA, 22 bp, Artificial Sequence
  chemically synthesized
gccaaaaatgcactgccagtgc

SEQ ID NO: 104598 - DNA, 22 bp, Artificial Sequence
  chemically synthesized
ccagtgcaggtaagatttgaga

SEQ ID NO: 104599 - DNA, 22 bp, Artificial Sequence
  chemically synthesized
gagatcttacatttaagttttg

SEQ ID NO: 104600 - DNA, 22 bp, Artificial Sequence
  chemically synthesized
agatcttacatttaagttttga

SEQ ID NO: 104601 - DNA, 22 bp, Artificial Sequence
  chemically synthesized
acatttaagttttgaattcatt

SEQ ID NO: 104602 - DNA, 22 bp, Artificial Sequence
  chemically synthesized
catttaagttttgaattcattt

SEQ ID NO: 104603 - DNA, 22 bp, Artificial Sequence
  chemically synthesized
aagttttgaattcattttcagt

SEQ ID NO: 104604 - DNA, 22 bp, Artificial Sequence
  chemically synthesized
agttttgaattcattttcagtt

SEQ ID NO: 104605 - DNA, 22 bp, Artificial Sequence
  chemically synthesized
tgaattcattttcagttgattt

SEQ ID NO: 104606 - DNA, 22 bp, Artificial Sequence
  chemically synthesized
gaattcattttcagttgatttc

SEQ ID NO: 104607 - DNA, 22 bp, Artificial Sequence
  chemically synthesized
aattcattttcagttgatttct

SEQ ID NO: 104608 - DNA, 22 bp, Artificial Sequence
  chemically synthesized
attttcagttgatttctctaaa

SEQ ID NO: 104609 - DNA, 22 bp, Artificial Sequence
  chemically synthesized
tcagttgatttctctaaatggt

SEQ ID NO: 104610 - DNA, 22 bp, Artificial Sequence
  chemically synthesized
cagttgatttctctaaatggtg

SEQ ID NO: 104611 - DNA, 22 bp, Artificial Sequence
  chemically synthesized
agttgatttctctaaatggtgt

SEQ ID NO: 104612 - DNA, 22 bp, Artificial Sequence
  chemically synthesized
atttctctaaatggtgtaaggt

SEQ ID NO: 104613 - DNA, 22 bp, Artificial Sequence
  chemically synthesized
ctctaaatggtgtaaggtaagg

SEQ ID NO: 104614 - DNA, 22 bp, Artificial Sequence
  chemically synthesized
tctaaatggtgtaaggtaaggg

SEQ ID NO: 104615 - DNA, 22 bp, Artificial Sequence
  chemically synthesized
taaatggtgtaaggtaagggtc

SEQ ID NO: 104616 - DNA, 22 bp, Artificial Sequence
  chemically synthesized
aatggtgtaaggtaagggtcta

SEQ ID NO: 104617 - DNA, 22 bp, Artificial Sequence
  chemically synthesized
gtttcattcttctgcatatggc

SEQ ID NO: 104618 - DNA, 22 bp, Artificial Sequence
  chemically synthesized
cattcttctgcatatggctagc

SEQ ID NO: 104619 - DNA, 22 bp, Artificial Sequence
  chemically synthesized
attcttctgcatatggctagcc

SEQ ID NO: 104620 - DNA, 22 bp, Artificial Sequence
  chemically synthesized
ttctgcatatggctagccacgt

SEQ ID NO: 104621 - DNA, 22 bp, Artificial Sequence
  chemically synthesized
ctgcatatggctagccacgtat

SEQ ID NO: 104622 - DNA, 22 bp, Artificial Sequence
  chemically synthesized
tgcatatggctagccacgtatt

SEQ ID NO: 104623 - DNA, 22 bp, Artificial Sequence
  chemically synthesized
catatggctagccacgtattcc

SEQ ID NO: 104624 - DNA, 22 bp, Artificial Sequence
  chemically synthesized
gccacgtattccagcacagttt

SEQ ID NO: 104625 - DNA, 22 bp, Artificial Sequence
  chemically synthesized
cagcacagtttattggataggt

SEQ ID NO: 104626 - DNA, 22 bp, Artificial Sequence
  chemically synthesized
attggataggtagtccttttcc

SEQ ID NO: 104627 - DNA, 22 bp, Artificial Sequence
  chemically synthesized
ttggataggtagtccttttccc

SEQ ID NO: 104628 - DNA, 22 bp, Artificial Sequence
  chemically synthesized
gataggtagtccttttcccgct

SEQ ID NO: 104629 - DNA, 22 bp, Artificial Sequence
  chemically synthesized
ttcccgctgcttgtttttgtca

SEQ ID NO: 104630 - DNA, 22 bp, Artificial Sequence
  chemically synthesized
tcccgctgcttgtttttgtcag

SEQ ID NO: 104631 - DNA, 22 bp, Artificial Sequence
  chemically synthesized
cccgctgcttgtttttgtcagt

SEQ ID NO: 104632 - DNA, 22 bp, Artificial Sequence
  chemically synthesized
ccgctgcttgtttttgtcagtg

SEQ ID NO: 104633 - DNA, 22 bp, Artificial Sequence
  chemically synthesized
cttgtttttgtcagtgttgttg

SEQ ID NO: 104634 - DNA, 22 bp, Artificial Sequence
  chemically synthesized
gtttttgtcagtgttgttgaag

SEQ ID NO: 104635 - DNA, 22 bp, Artificial Sequence
  chemically synthesized
tttttgtcagtgttgttgaaga

SEQ ID NO: 104636 - DNA, 22 bp, Artificial Sequence
  chemically synthesized
ttgtcagtgttgttgaagatca

SEQ ID NO: 104637 - DNA, 22 bp, Artificial Sequence
  chemically synthesized
tgtcagtgttgttgaagatcag

SEQ ID NO: 104638 - DNA, 22 bp, Artificial Sequence
  chemically synthesized
gtcagtgttgttgaagatcaga

SEQ ID NO: 104639 - DNA, 22 bp, Artificial Sequence
  chemically synthesized
tcagtgttgttgaagatcagat

SEQ ID NO: 104640 - DNA, 22 bp, Artificial Sequence
  chemically synthesized
ttgaagatcagatggttgtaac

SEQ ID NO: 104641 - DNA, 22 bp, Artificial Sequence
  chemically synthesized
aagatcagatggttgtaactat

SEQ ID NO: 104642 - DNA, 22 bp, Artificial Sequence
  chemically synthesized
taactatgtagctttatttttg

SEQ ID NO: 104643 - DNA, 22 bp, Artificial Sequence
  chemically synthesized
tgtagctttatttttgagtttt

SEQ ID NO: 104644 - DNA, 22 bp, Artificial Sequence
  chemically synthesized
tatttttgagttttctattgtg

SEQ ID NO: 104645 - DNA, 22 bp, Artificial Sequence
  chemically synthesized
atttttgagttttctattgtgt

SEQ ID NO: 104646 - DNA, 22 bp, Artificial Sequence
  chemically synthesized
tttttgagttttctattgtgtt

SEQ ID NO: 104647 - DNA, 22 bp, Artificial Sequence
  chemically synthesized
ttgagttttctattgtgtttcc

SEQ ID NO: 104648 - DNA, 22 bp, Artificial Sequence
  chemically synthesized
tgagttttctattgtgtttcct

SEQ ID NO: 104649 - DNA, 22 bp, Artificial Sequence
  chemically synthesized
gagttttctattgtgtttcctt

SEQ ID NO: 104650 - DNA, 22 bp, Artificial Sequence
  chemically synthesized
agttttctattgtgtttcctta

SEQ ID NO: 104651 - DNA, 22 bp, Artificial Sequence
  chemically synthesized
tctattgtgtttccttagtcaa

SEQ ID NO: 104652 - DNA, 22 bp, Artificial Sequence
  chemically synthesized
ctattgtgtttccttagtcaat

SEQ ID NO: 104653 - DNA, 22 bp, Artificial Sequence
  chemically synthesized
tattgtgtttccttagtcaatg

SEQ ID NO: 104654 - DNA, 22 bp, Artificial Sequence
  chemically synthesized
ttgtgtttccttagtcaatgtg

SEQ ID NO: 104655 - DNA, 22 bp, Artificial Sequence
  chemically synthesized
tgtttccttagtcaatgtgtct

SEQ ID NO: 104656 - DNA, 22 bp, Artificial Sequence
  chemically synthesized
ccttagtcaatgtgtctatttt

SEQ ID NO: 104657 - DNA, 22 bp, Artificial Sequence
  chemically synthesized
cttagtcaatgtgtctattttt

SEQ ID NO: 104658 - DNA, 22 bp, Artificial Sequence
  chemically synthesized
agtcaatgtgtctatttttgta

SEQ ID NO: 104659 - DNA, 22 bp, Artificial Sequence
  chemically synthesized
gtcaatgtgtctatttttgtaa

SEQ ID NO: 104660 - DNA, 22 bp, Artificial Sequence
  chemically synthesized
tttttgtaacaatatcatgctg

SEQ ID NO: 104661 - DNA, 22 bp, Artificial Sequence
  chemically synthesized
ttgtaacaatatcatgctgttt

SEQ ID NO: 104662 - DNA, 22 bp, Artificial Sequence
  chemically synthesized
tgtaacaatatcatgctgtttg

SEQ ID NO: 104663 - DNA, 22 bp, Artificial Sequence
  chemically synthesized
gtaacaatatcatgctgtttgg

SEQ ID NO: 104664 - DNA, 22 bp, Artificial Sequence
  chemically synthesized
taacaatatcatgctgtttggg

SEQ ID NO: 104665 - DNA, 22 bp, Artificial Sequence
  chemically synthesized
tttggggtactgtggccttata

SEQ ID NO: 104666 - DNA, 22 bp, Artificial Sequence
  chemically synthesized
ggggtactgtggccttataatg

SEQ ID NO: 104667 - DNA, 22 bp, Artificial Sequence
  chemically synthesized
gggtactgtggccttataatgt

SEQ ID NO: 104668 - DNA, 22 bp, Artificial Sequence
  chemically synthesized
tggccttataatgtagtttctt

SEQ ID NO: 104669 - DNA, 22 bp, Artificial Sequence
  chemically synthesized
ataatgtagtttctttcctttc

SEQ ID NO: 104670 - DNA, 22 bp, Artificial Sequence
  chemically synthesized
taatgtagtttctttcctttct

SEQ ID NO: 104671 - DNA, 22 bp, Artificial Sequence
  chemically synthesized
ctttcctttcttccctctcttt

SEQ ID NO: 104672 - DNA, 22 bp, Artificial Sequence
  chemically synthesized
tttcctttcttccctctctttc

SEQ ID NO: 104673 - DNA, 22 bp, Artificial Sequence
  chemically synthesized
tcctttcttccctctctttctt

SEQ ID NO: 104674 - DNA, 22 bp, Artificial Sequence
  chemically synthesized
cctttcttccctctctttcttt

SEQ ID NO: 104675 - DNA, 22 bp, Artificial Sequence
  chemically synthesized
ctttcttccctctctttctttc

SEQ ID NO: 104676 - DNA, 22 bp, Artificial Sequence
  chemically synthesized
tcttccctctctttctttcttt

SEQ ID NO: 104677 - DNA, 22 bp, Artificial Sequence
  chemically synthesized
cttccctctctttctttctttt

SEQ ID NO: 104678 - DNA, 22 bp, Artificial Sequence
  chemically synthesized
ttccctctctttctttcttttc

SEQ ID NO: 104679 - DNA, 22 bp, Artificial Sequence
  chemically synthesized
ccctctctttctttcttttctt

SEQ ID NO: 104680 - DNA, 22 bp, Artificial Sequence
  chemically synthesized
cctctctttctttcttttcttt

SEQ ID NO: 104681 - DNA, 22 bp, Artificial Sequence
  chemically synthesized
tctttctttcttttctttcttt

SEQ ID NO: 104682 - DNA, 22 bp, Artificial Sequence
  chemically synthesized
tttctttcttttctttcttttt

SEQ ID NO: 104683 - DNA, 22 bp, Artificial Sequence
  chemically synthesized
tctttcttttctttcttttttt

SEQ ID NO: 104684 - DNA, 22 bp, Artificial Sequence
  chemically synthesized
ctttcttttctttcttttttta

SEQ ID NO: 104685 - DNA, 22 bp, Artificial Sequence
  chemically synthesized
tttcttttctttctttttttat

SEQ ID NO: 104686 - DNA, 22 bp, Artificial Sequence
  chemically synthesized
tcttttctttctttttttattt

SEQ ID NO: 104687 - DNA, 22 bp, Artificial Sequence
  chemically synthesized
cttttctttctttttttatttt

SEQ ID NO: 104688 - DNA, 22 bp, Artificial Sequence
  chemically synthesized
ttttctttctttttttattttt

SEQ ID NO: 104689 - DNA, 22 bp, Artificial Sequence
  chemically synthesized
ttctttctttttttattttttc

SEQ ID NO: 104690 - DNA, 22 bp, Artificial Sequence
  chemically synthesized
tctttctttttttattttttca

SEQ ID NO: 104691 - DNA, 22 bp, Artificial Sequence
  chemically synthesized
ctttctttttttattttttcag

SEQ ID NO: 104692 - DNA, 22 bp, Artificial Sequence
  chemically synthesized
tttctttttttattttttcaga

SEQ ID NO: 104693 - DNA, 22 bp, Artificial Sequence
  chemically synthesized
tctttttttattttttcagagt

SEQ ID NO: 104694 - DNA, 22 bp, Artificial Sequence
  chemically synthesized
ctttttttattttttcagagtt

SEQ ID NO: 104695 - DNA, 22 bp, Artificial Sequence
  chemically synthesized
tttttttattttttcagagttt

SEQ ID NO: 104696 - DNA, 22 bp, Artificial Sequence
  chemically synthesized
tttttattttttcagagtttca

SEQ ID NO: 104697 - DNA, 22 bp, Artificial Sequence
  chemically synthesized
ttttattttttcagagtttcac

SEQ ID NO: 104698 - DNA, 22 bp, Artificial Sequence
  chemically synthesized
tttattttttcagagtttcact

SEQ ID NO: 104699 - DNA, 22 bp, Artificial Sequence
  chemically synthesized
ttattttttcagagtttcactc

SEQ ID NO: 104700 - DNA, 22 bp, Artificial Sequence
  chemically synthesized
tattttttcagagtttcactct

SEQ ID NO: 104701 - DNA, 22 bp, Artificial Sequence
  chemically synthesized
attttttcagagtttcactctg

SEQ ID NO: 104702 - DNA, 22 bp, Artificial Sequence
  chemically synthesized
ttttttcagagtttcactctgt

SEQ ID NO: 104703 - DNA, 22 bp, Artificial Sequence
  chemically synthesized
tttcagagtttcactctgtcac

SEQ ID NO: 104704 - DNA, 22 bp, Artificial Sequence
  chemically synthesized
ttcagagtttcactctgtcacc

SEQ ID NO: 104705 - DNA, 22 bp, Artificial Sequence
  chemically synthesized
tcagagtttcactctgtcaccc

SEQ ID NO: 104706 - DNA, 22 bp, Artificial Sequence
  chemically synthesized
cagagtttcactctgtcaccca

SEQ ID NO: 104707 - DNA, 22 bp, Artificial Sequence
  chemically synthesized
agagtttcactctgtcacccag

SEQ ID NO: 104708 - DNA, 22 bp, Artificial Sequence
  chemically synthesized
cactctgtcacccaggctggag

SEQ ID NO: 104709 - DNA, 22 bp, Artificial Sequence
  chemically synthesized
actctgtcacccaggctggagt

SEQ ID NO: 104710 - DNA, 22 bp, Artificial Sequence
  chemically synthesized
tgtcacccaggctggagtgcag

SEQ ID NO: 104711 - DNA, 22 bp, Artificial Sequence
  chemically synthesized
tcacccaggctggagtgcagtg

SEQ ID NO: 104712 - DNA, 22 bp, Artificial Sequence
  chemically synthesized
gagtgcagtggtgcgatcttgg

SEQ ID NO: 104713 - DNA, 22 bp, Artificial Sequence
  chemically synthesized
ggctcactgcaccgtctgcctc

SEQ ID NO: 104714 - DNA, 22 bp, Artificial Sequence
  chemically synthesized
gctcactgcaccgtctgcctcc

SEQ ID NO: 104715 - DNA, 22 bp, Artificial Sequence
  chemically synthesized
actgcaccgtctgcctccagag

SEQ ID NO: 104716 - DNA, 22 bp, Artificial Sequence
  chemically synthesized
caccgtctgcctccagagttca

SEQ ID NO: 104717 - DNA, 22 bp, Artificial Sequence
  chemically synthesized
cctccagagttcaagcaattct

SEQ ID NO: 104718 - DNA, 22 bp, Artificial Sequence
  chemically synthesized
cagagttcaagcaattctcctg

SEQ ID NO: 104719 - DNA, 22 bp, Artificial Sequence
  chemically synthesized
aagcaattctcctgcctcagcc

SEQ ID NO: 104720 - DNA, 22 bp, Artificial Sequence
  chemically synthesized
tcctgcctcagccttccgagta

SEQ ID NO: 104721 - DNA, 22 bp, Artificial Sequence
  chemically synthesized
ctgcctcagccttccgagtagc

SEQ ID NO: 104722 - DNA, 22 bp, Artificial Sequence
  chemically synthesized
cctcagccttccgagtagctgg

SEQ ID NO: 104723 - DNA, 22 bp, Artificial Sequence
  chemically synthesized
agccttccgagtagctgggatt

SEQ ID NO: 104724 - DNA, 22 bp, Artificial Sequence
  chemically synthesized
ccgagtagctgggattacagcc

SEQ ID NO: 104725 - DNA, 22 bp, Artificial Sequence
  chemically synthesized
cgagtagctgggattacagccc

SEQ ID NO: 104726 - DNA, 22 bp, Artificial Sequence
  chemically synthesized
ggattacagcccccaccaccac

SEQ ID NO: 104727 - DNA, 22 bp, Artificial Sequence
  chemically synthesized
cagcccccaccaccacagccgg

SEQ ID NO: 104728 - DNA, 22 bp, Artificial Sequence
  chemically synthesized
attttgtatttttagtagagac

SEQ ID NO: 104729 - DNA, 22 bp, Artificial Sequence
  chemically synthesized
tgtatttttagtagagacagtg

SEQ ID NO: 104730 - DNA, 22 bp, Artificial Sequence
  chemically synthesized
gtatttttagtagagacagtgt

SEQ ID NO: 104731 - DNA, 22 bp, Artificial Sequence
  chemically synthesized
tatttttagtagagacagtgtt

SEQ ID NO: 104732 - DNA, 22 bp, Artificial Sequence
  chemically synthesized
ttagtagagacagtgtttcacc

SEQ ID NO: 104733 - DNA, 22 bp, Artificial Sequence
  chemically synthesized
tagtagagacagtgtttcacca

SEQ ID NO: 104734 - DNA, 22 bp, Artificial Sequence
  chemically synthesized
agtagagacagtgtttcaccat

SEQ ID NO: 104735 - DNA, 22 bp, Artificial Sequence
  chemically synthesized
gtagagacagtgtttcaccatg

SEQ ID NO: 104736 - DNA, 22 bp, Artificial Sequence
  chemically synthesized
caccatgttgaccaggctggtc

SEQ ID NO: 104737 - DNA, 22 bp, Artificial Sequence
  chemically synthesized
accatgttgaccaggctggtct

SEQ ID NO: 104738 - DNA, 22 bp, Artificial Sequence
  chemically synthesized
accaggctggtcttgaactcct

SEQ ID NO: 104739 - DNA, 22 bp, Artificial Sequence
  chemically synthesized
gtcttgaactcctgacctcagg

SEQ ID NO: 104740 - DNA, 22 bp, Artificial Sequence
  chemically synthesized
gaactcctgacctcaggtgata

SEQ ID NO: 104741 - DNA, 22 bp, Artificial Sequence
  chemically synthesized
aactcctgacctcaggtgatac

SEQ ID NO: 104742 - DNA, 22 bp, Artificial Sequence
  chemically synthesized
ctgacctcaggtgatacaccca

SEQ ID NO: 104743 - DNA, 22 bp, Artificial Sequence
  chemically synthesized
acctcaggtgatacacccacct

SEQ ID NO: 104744 - DNA, 22 bp, Artificial Sequence
  chemically synthesized
aggtgatacacccacctcagcc

SEQ ID NO: 104745 - DNA, 22 bp, Artificial Sequence
  chemically synthesized
agccccctaaagtgctagagtt

SEQ ID NO: 104746 - DNA, 22 bp, Artificial Sequence
  chemically synthesized
aagtgctagagttacaggcgtg

SEQ ID NO: 104747 - DNA, 22 bp, Artificial Sequence
  chemically synthesized
gagttacaggcgtgagccaccg

SEQ ID NO: 104748 - DNA, 22 bp, Artificial Sequence
  chemically synthesized
caggcgtgagccaccgtgcctg

SEQ ID NO: 104749 - DNA, 22 bp, Artificial Sequence
  chemically synthesized
gcctgtagtttcaagtcaggtg

SEQ ID NO: 104750 - DNA, 22 bp, Artificial Sequence
  chemically synthesized
tagtttcaagtcaggtggtgtg

SEQ ID NO: 104751 - DNA, 22 bp, Artificial Sequence
  chemically synthesized
caagtcaggtggtgtggtgctt

SEQ ID NO: 104752 - DNA, 22 bp, Artificial Sequence
  chemically synthesized
aagtcaggtggtgtggtgcttc

SEQ ID NO: 104753 - DNA, 22 bp, Artificial Sequence
  chemically synthesized
ccaattttgttctttctgctta

SEQ ID NO: 104754 - DNA, 22 bp, Artificial Sequence
  chemically synthesized
caattttgttctttctgcttaa

SEQ ID NO: 104755 - DNA, 22 bp, Artificial Sequence
  chemically synthesized
tgttctttctgcttaagattgc

SEQ ID NO: 104756 - DNA, 22 bp, Artificial Sequence
  chemically synthesized
gttctttctgcttaagattgct

SEQ ID NO: 104757 - DNA, 22 bp, Artificial Sequence
  chemically synthesized
ttctttctgcttaagattgctt

SEQ ID NO: 104758 - DNA, 22 bp, Artificial Sequence
  chemically synthesized
tttctgcttaagattgctttgc

SEQ ID NO: 104759 - DNA, 22 bp, Artificial Sequence
  chemically synthesized
tctgcttaagattgctttgcct

SEQ ID NO: 104760 - DNA, 22 bp, Artificial Sequence
  chemically synthesized
ctgcttaagattgctttgcctg

SEQ ID NO: 104761 - DNA, 22 bp, Artificial Sequence
  chemically synthesized
tgcttaagattgctttgcctgt

SEQ ID NO: 104762 - DNA, 22 bp, Artificial Sequence
  chemically synthesized
cttaagattgctttgcctgttc

SEQ ID NO: 104763 - DNA, 22 bp, Artificial Sequence
  chemically synthesized
aagattgctttgcctgttcagg

SEQ ID NO: 104764 - DNA, 22 bp, Artificial Sequence
  chemically synthesized
agattgctttgcctgttcaggc

SEQ ID NO: 104765 - DNA, 22 bp, Artificial Sequence
  chemically synthesized
ctttgcctgttcaggctctttt

SEQ ID NO: 104766 - DNA, 22 bp, Artificial Sequence
  chemically synthesized
tgcctgttcaggctctttttgg

SEQ ID NO: 104767 - DNA, 22 bp, Artificial Sequence
  chemically synthesized
gcctgttcaggctctttttggt

SEQ ID NO: 104768 - DNA, 22 bp, Artificial Sequence
  chemically synthesized
cctgttcaggctctttttggtt

SEQ ID NO: 104769 - DNA, 22 bp, Artificial Sequence
  chemically synthesized
ttcaggctctttttggttccat

SEQ ID NO: 104770 - DNA, 22 bp, Artificial Sequence
  chemically synthesized
aggctctttttggttccatatg

SEQ ID NO: 104771 - DNA, 22 bp, Artificial Sequence
  chemically synthesized
tttttggttccatatgaatttt

SEQ ID NO: 104772 - DNA, 22 bp, Artificial Sequence
  chemically synthesized
tttggttccatatgaattttaa

SEQ ID NO: 104773 - DNA, 22 bp, Artificial Sequence
  chemically synthesized
ttggttccatatgaattttaaa

SEQ ID NO: 104774 - DNA, 22 bp, Artificial Sequence
  chemically synthesized
tggttccatatgaattttaaac

SEQ ID NO: 104775 - DNA, 22 bp, Artificial Sequence
  chemically synthesized
ggttccatatgaattttaaact

SEQ ID NO: 104776 - DNA, 22 bp, Artificial Sequence
  chemically synthesized
gttccatatgaattttaaacta

SEQ ID NO: 104777 - DNA, 22 bp, Artificial Sequence
  chemically synthesized
catatgaattttaaactagttt

SEQ ID NO: 104778 - DNA, 22 bp, Artificial Sequence
  chemically synthesized
taaactagtttttctaatactg

SEQ ID NO: 104779 - DNA, 22 bp, Artificial Sequence
  chemically synthesized
aaactagtttttctaatactgt

SEQ ID NO: 104780 - DNA, 22 bp, Artificial Sequence
  chemically synthesized
aactagtttttctaatactgtg

SEQ ID NO: 104781 - DNA, 22 bp, Artificial Sequence
  chemically synthesized
gtttttctaatactgtgaagaa

SEQ ID NO: 104782 - DNA, 22 bp, Artificial Sequence
  chemically synthesized
ttctaatactgtgaagaatgac

SEQ ID NO: 104783 - DNA, 22 bp, Artificial Sequence
  chemically synthesized
tctaatactgtgaagaatgaca

SEQ ID NO: 104784 - DNA, 22 bp, Artificial Sequence
  chemically synthesized
ctaatactgtgaagaatgacat

SEQ ID NO: 104785 - DNA, 22 bp, Artificial Sequence
  chemically synthesized
taatactgtgaagaatgacatt

SEQ ID NO: 104786 - DNA, 22 bp, Artificial Sequence
  chemically synthesized
atactgtgaagaatgacattgg

SEQ ID NO: 104787 - DNA, 22 bp, Artificial Sequence
  chemically synthesized
tgaagaatgacattggtaattg

SEQ ID NO: 104788 - DNA, 22 bp, Artificial Sequence
  chemically synthesized
gtaattggatagaaattgcaat

SEQ ID NO: 104789 - DNA, 22 bp, Artificial Sequence
  chemically synthesized
gatagaaattgcaatgaatgtc

SEQ ID NO: 104790 - DNA, 22 bp, Artificial Sequence
  chemically synthesized
caatgaatgtctaaattgcttt

SEQ ID NO: 104791 - DNA, 22 bp, Artificial Sequence
  chemically synthesized
aattgctttgagcagtatggcc

SEQ ID NO: 104792 - DNA, 22 bp, Artificial Sequence
  chemically synthesized
ctttgagcagtatggccattta

SEQ ID NO: 104793 - DNA, 22 bp, Artificial Sequence
  chemically synthesized
tgagcagtatggccatttaaat

SEQ ID NO: 104794 - DNA, 22 bp, Artificial Sequence
  chemically synthesized
gagcagtatggccatttaaatt

SEQ ID NO: 104795 - DNA, 22 bp, Artificial Sequence
  chemically synthesized
agcagtatggccatttaaattc

SEQ ID NO: 104796 - DNA, 22 bp, Artificial Sequence
  chemically synthesized
aaattcatattgattcttccaa

SEQ ID NO: 104797 - DNA, 22 bp, Artificial Sequence
  chemically synthesized
aattcatattgattcttccaat

SEQ ID NO: 104798 - DNA, 22 bp, Artificial Sequence
  chemically synthesized
atattgattcttccaatccatg

SEQ ID NO: 104799 - DNA, 22 bp, Artificial Sequence
  chemically synthesized
attcttccaatccatgagcctg

SEQ ID NO: 104800 - DNA, 22 bp, Artificial Sequence
  chemically synthesized
ttccaatccatgagcctggaaa

SEQ ID NO: 104801 - DNA, 22 bp, Artificial Sequence
  chemically synthesized
ccaatccatgagcctggaaagc

SEQ ID NO: 104802 - DNA, 22 bp, Artificial Sequence
  chemically synthesized
caatccatgagcctggaaagct

SEQ ID NO: 104803 - DNA, 22 bp, Artificial Sequence
  chemically synthesized
gaaagcttttatttatttattt

SEQ ID NO: 104804 - DNA, 22 bp, Artificial Sequence
  chemically synthesized
ttatttatttatttgtgttgtt

SEQ ID NO: 104805 - DNA, 22 bp, Artificial Sequence
  chemically synthesized
tatttatttatttgtgttgttt

SEQ ID NO: 104806 - DNA, 22 bp, Artificial Sequence
  chemically synthesized
atttatttatttgtgttgtttc

SEQ ID NO: 104807 - DNA, 22 bp, Artificial Sequence
  chemically synthesized
tttatttatttgtgttgtttct

SEQ ID NO: 104808 - DNA, 22 bp, Artificial Sequence
  chemically synthesized
atttatttgtgttgtttctgat

SEQ ID NO: 104809 - DNA, 22 bp, Artificial Sequence
  chemically synthesized
tttatttgtgttgtttctgatt

SEQ ID NO: 104810 - DNA, 22 bp, Artificial Sequence
  chemically synthesized
atttgtgttgtttctgatttct

SEQ ID NO: 104811 - DNA, 22 bp, Artificial Sequence
  chemically synthesized
tttgtgttgtttctgatttctt

SEQ ID NO: 104812 - DNA, 22 bp, Artificial Sequence
  chemically synthesized
gtgttgtttctgatttctttca

SEQ ID NO: 104813 - DNA, 22 bp, Artificial Sequence
  chemically synthesized
tgttgtttctgatttctttcag

SEQ ID NO: 104814 - DNA, 22 bp, Artificial Sequence
  chemically synthesized
tttctgatttctttcagcagtg

SEQ ID NO: 104815 - DNA, 22 bp, Artificial Sequence
  chemically synthesized
ctgatttctttcagcagtgttt

SEQ ID NO: 104816 - DNA, 22 bp, Artificial Sequence
  chemically synthesized
tgatttctttcagcagtgtttt

SEQ ID NO: 104817 - DNA, 22 bp, Artificial Sequence
  chemically synthesized
atttctttcagcagtgttttgt

SEQ ID NO: 104818 - DNA, 22 bp, Artificial Sequence
  chemically synthesized
ctttcagcagtgttttgtagtt

SEQ ID NO: 104819 - DNA, 22 bp, Artificial Sequence
  chemically synthesized
tttcagcagtgttttgtagttc

SEQ ID NO: 104820 - DNA, 22 bp, Artificial Sequence
  chemically synthesized
tcagcagtgttttgtagttctc

SEQ ID NO: 104821 - DNA, 22 bp, Artificial Sequence
  chemically synthesized
cagcagtgttttgtagttctcc

SEQ ID NO: 104822 - DNA, 22 bp, Artificial Sequence
  chemically synthesized
agcagtgttttgtagttctcct

SEQ ID NO: 104823 - DNA, 22 bp, Artificial Sequence
  chemically synthesized
tgtagttctccttgtagagatc

SEQ ID NO: 104824 - DNA, 22 bp, Artificial Sequence
  chemically synthesized
gtagttctccttgtagagatct

SEQ ID NO: 104825 - DNA, 22 bp, Artificial Sequence
  chemically synthesized
tagttctccttgtagagatctt

SEQ ID NO: 104826 - DNA, 22 bp, Artificial Sequence
  chemically synthesized
tccttgtagagatctttcacct

SEQ ID NO: 104827 - DNA, 22 bp, Artificial Sequence
  chemically synthesized
cttgtagagatctttcacctcc

SEQ ID NO: 104828 - DNA, 22 bp, Artificial Sequence
  chemically synthesized
gtagagatctttcacctcccac

SEQ ID NO: 104829 - DNA, 22 bp, Artificial Sequence
  chemically synthesized
tagagatctttcacctcccaca

SEQ ID NO: 104830 - DNA, 22 bp, Artificial Sequence
  chemically synthesized
tcacctcccacaaaccatatga

SEQ ID NO: 104831 - DNA, 22 bp, Artificial Sequence
  chemically synthesized
cacctcccacaaaccatatgat

SEQ ID NO: 104832 - DNA, 22 bp, Artificial Sequence
  chemically synthesized
acctcccacaaaccatatgatc

SEQ ID NO: 104833 - DNA, 22 bp, Artificial Sequence
  chemically synthesized
ccacaaaccatatgatcatctc

SEQ ID NO: 104834 - DNA, 22 bp, Artificial Sequence
  chemically synthesized
aatagactgagaaaaacctttc

SEQ ID NO: 104835 - DNA, 22 bp, Artificial Sequence
  chemically synthesized
agaaaaacctttcaataaaatt

SEQ ID NO: 104836 - DNA, 22 bp, Artificial Sequence
  chemically synthesized
tcaataaaattcaacatccctt

SEQ ID NO: 104837 - DNA, 22 bp, Artificial Sequence
  chemically synthesized
caataaaattcaacatcccttc

SEQ ID NO: 104838 - DNA, 22 bp, Artificial Sequence
  chemically synthesized
aataaaattcaacatcccttca

SEQ ID NO: 104839 - DNA, 22 bp, Artificial Sequence
  chemically synthesized
aacatcccttcatgataaaaac

SEQ ID NO: 104840 - DNA, 22 bp, Artificial Sequence
  chemically synthesized
catgataaaaacctccaacaga

SEQ ID NO: 104841 - DNA, 22 bp, Artificial Sequence
  chemically synthesized
atgataaaaacctccaacagac

SEQ ID NO: 104842 - DNA, 22 bp, Artificial Sequence
  chemically synthesized
caacagactaggcatcaaagga

SEQ ID NO: 104843 - DNA, 22 bp, Artificial Sequence
  chemically synthesized
ggcatcaaaggaacatacctca

SEQ ID NO: 104844 - DNA, 22 bp, Artificial Sequence
  chemically synthesized
aaaagaataaaagccacgtatg

SEQ ID NO: 104845 - DNA, 22 bp, Artificial Sequence
  chemically synthesized
aatgggcaaaagctggaactat

SEQ ID NO: 104846 - DNA, 22 bp, Artificial Sequence
  chemically synthesized
gaactattctcctcgaaaactg

SEQ ID NO: 104847 - DNA, 22 bp, Artificial Sequence
  chemically synthesized
ttctcctcgaaaactgcaacaa

SEQ ID NO: 104848 - DNA, 22 bp, Artificial Sequence
  chemically synthesized
tcctcgaaaactgcaacaagac

SEQ ID NO: 104849 - DNA, 22 bp, Artificial Sequence
  chemically synthesized
ctcgaaaactgcaacaagacaa

SEQ ID NO: 104850 - DNA, 22 bp, Artificial Sequence
  chemically synthesized
gaaaactgcaacaagacaagga

SEQ ID NO: 104851 - DNA, 22 bp, Artificial Sequence
  chemically synthesized
caacaagacaaggattcccatt

SEQ ID NO: 104852 - DNA, 22 bp, Artificial Sequence
  chemically synthesized
ccattctcaccactcctagtga

SEQ ID NO: 104853 - DNA, 22 bp, Artificial Sequence
  chemically synthesized
tcaccactcctagtgaacataa

SEQ ID NO: 104854 - DNA, 22 bp, Artificial Sequence
  chemically synthesized
accactcctagtgaacataaaa

SEQ ID NO: 104855 - DNA, 22 bp, Artificial Sequence
  chemically synthesized
ctagtgaacataaaattggaag

SEQ ID NO: 104856 - DNA, 22 bp, Artificial Sequence
  chemically synthesized
gtgaacataaaattggaagtcc

SEQ ID NO: 104857 - DNA, 22 bp, Artificial Sequence
  chemically synthesized
gaagtcctaaccagggcaatca

SEQ ID NO: 104858 - DNA, 22 bp, Artificial Sequence
  chemically synthesized
accagggcaatcaggcgagaga

SEQ ID NO: 104859 - DNA, 22 bp, Artificial Sequence
  chemically synthesized
tctctctttgctgatgatatga

SEQ ID NO: 104860 - DNA, 22 bp, Artificial Sequence
  chemically synthesized
tctttgctgatgatatgactct

SEQ ID NO: 104861 - DNA, 22 bp, Artificial Sequence
  chemically synthesized
tttgctgatgatatgactctat

SEQ ID NO: 104862 - DNA, 22 bp, Artificial Sequence
  chemically synthesized
tgctgatgatatgactctatac

SEQ ID NO: 104863 - DNA, 22 bp, Artificial Sequence
  chemically synthesized
gctgatgatatgactctatact

SEQ ID NO: 104864 - DNA, 22 bp, Artificial Sequence
  chemically synthesized
ctgatgatatgactctatactt

SEQ ID NO: 104865 - DNA, 22 bp, Artificial Sequence
  chemically synthesized
atgatatgactctatacttaga

SEQ ID NO: 104866 - DNA, 22 bp, Artificial Sequence
  chemically synthesized
tatacttagaaaatcctacaga

SEQ ID NO: 104867 - DNA, 22 bp, Artificial Sequence
  chemically synthesized
tacttagaaaatcctacagatt

SEQ ID NO: 104868 - DNA, 22 bp, Artificial Sequence
  chemically synthesized
agaaaatcctacagattcttcc

SEQ ID NO: 104869 - DNA, 22 bp, Artificial Sequence
  chemically synthesized
gaaaatcctacagattcttcca

SEQ ID NO: 104870 - DNA, 22 bp, Artificial Sequence
  chemically synthesized
cagattcttccaaaaggctgct

SEQ ID NO: 104871 - DNA, 22 bp, Artificial Sequence
  chemically synthesized
ttccaaaaggctgctagaactg

SEQ ID NO: 104872 - DNA, 22 bp, Artificial Sequence
  chemically synthesized
ccaaaaggctgctagaactgat

SEQ ID NO: 104873 - DNA, 22 bp, Artificial Sequence
  chemically synthesized
caaaaggctgctagaactgata

SEQ ID NO: 104874 - DNA, 22 bp, Artificial Sequence
  chemically synthesized
ctagaactgataaacaatttta

SEQ ID NO: 104875 - DNA, 22 bp, Artificial Sequence
  chemically synthesized
gaactgataaacaattttagca

SEQ ID NO: 104876 - DNA, 22 bp, Artificial Sequence
  chemically synthesized
ataaacaattttagcaaggttt

SEQ ID NO: 104877 - DNA, 22 bp, Artificial Sequence
  chemically synthesized
tagcaaggtttcaggatacaaa

SEQ ID NO: 104878 - DNA, 22 bp, Artificial Sequence
  chemically synthesized
agcaaggtttcaggatacaaaa

SEQ ID NO: 104879 - DNA, 22 bp, Artificial Sequence
  chemically synthesized
gcaaggtttcaggatacaaaat

SEQ ID NO: 104880 - DNA, 22 bp, Artificial Sequence
  chemically synthesized
caggatacaaaatcacatacaa

SEQ ID NO: 104881 - DNA, 22 bp, Artificial Sequence
  chemically synthesized
aggatacaaaatcacatacaaa

SEQ ID NO: 104882 - DNA, 22 bp, Artificial Sequence
  chemically synthesized
ccatacaccaataaggcccagg

SEQ ID NO: 104883 - DNA, 22 bp, Artificial Sequence
  chemically synthesized
catacaccaataaggcccaggc

SEQ ID NO: 104884 - DNA, 22 bp, Artificial Sequence
  chemically synthesized
agagtcaaatcgagaacacaat

SEQ ID NO: 104885 - DNA, 22 bp, Artificial Sequence
  chemically synthesized
agaacagccacaaagaaaatga

SEQ ID NO: 104886 - DNA, 22 bp, Artificial Sequence
  chemically synthesized
ggacttgttctttttattgaaa

SEQ ID NO: 104887 - DNA, 22 bp, Artificial Sequence
  chemically synthesized
gttctttttattgaaatttaaa

SEQ ID NO: 104888 - DNA, 22 bp, Artificial Sequence
  chemically synthesized
ttctttttattgaaatttaaaa

SEQ ID NO: 104889 - DNA, 22 bp, Artificial Sequence
  chemically synthesized
tttttattgaaatttaaaaccc

SEQ ID NO: 104890 - DNA, 22 bp, Artificial Sequence
  chemically synthesized
tttattgaaatttaaaacccaa

SEQ ID NO: 104891 - DNA, 22 bp, Artificial Sequence
  chemically synthesized
ttattgaaatttaaaacccaag

SEQ ID NO: 104892 - DNA, 22 bp, Artificial Sequence
  chemically synthesized
tattgaaatttaaaacccaagc

SEQ ID NO: 104893 - DNA, 22 bp, Artificial Sequence
  chemically synthesized
attgaaatttaaaacccaagca

SEQ ID NO: 104894 - DNA, 22 bp, Artificial Sequence
  chemically synthesized
ttgaaatttaaaacccaagcag

SEQ ID NO: 104895 - DNA, 22 bp, Artificial Sequence
  chemically synthesized
aaatttaaaacccaagcaggca

SEQ ID NO: 104896 - DNA, 22 bp, Artificial Sequence
  chemically synthesized
aaaacccaagcaggcactagaa

SEQ ID NO: 104897 - DNA, 22 bp, Artificial Sequence
  chemically synthesized
aaacccaagcaggcactagaaa

SEQ ID NO: 104898 - DNA, 22 bp, Artificial Sequence
  chemically synthesized
gaaagaaaatatttaccatgaa

SEQ ID NO: 104899 - DNA, 22 bp, Artificial Sequence
  chemically synthesized
accatgaattcatacaacacta

SEQ ID NO: 104900 - DNA, 22 bp, Artificial Sequence
  chemically synthesized
ccatgaattcatacaacactat

SEQ ID NO: 104901 - DNA, 22 bp, Artificial Sequence
  chemically synthesized
atacaacactatcattactacg

SEQ ID NO: 104902 - DNA, 22 bp, Artificial Sequence
  chemically synthesized
tcattactacgtgaatattagt

SEQ ID NO: 104903 - DNA, 22 bp, Artificial Sequence
  chemically synthesized
ctacgtgaatattagtgtgcta

SEQ ID NO: 104904 - DNA, 22 bp, Artificial Sequence
  chemically synthesized
cgtgaatattagtgtgctatga

SEQ ID NO: 104905 - DNA, 22 bp, Artificial Sequence
  chemically synthesized
gtgtgctatgagagacacatca

SEQ ID NO: 104906 - DNA, 22 bp, Artificial Sequence
  chemically synthesized
tgagagacacatcaaataaatt

SEQ ID NO: 104907 - DNA, 22 bp, Artificial Sequence
  chemically synthesized
ctgggatcagggaacattttcc

SEQ ID NO: 104908 - DNA, 22 bp, Artificial Sequence
  chemically synthesized
tgggatcagggaacattttcca

SEQ ID NO: 104909 - DNA, 22 bp, Artificial Sequence
  chemically synthesized
ggatcagggaacattttccaga

SEQ ID NO: 104910 - DNA, 22 bp, Artificial Sequence
  chemically synthesized
tccagaagaaatgctacttaag

SEQ ID NO: 104911 - DNA, 22 bp, Artificial Sequence
  chemically synthesized
ccagaagaaatgctacttaagc

SEQ ID NO: 104912 - DNA, 22 bp, Artificial Sequence
  chemically synthesized
cagaagaaatgctacttaagct

SEQ ID NO: 104913 - DNA, 22 bp, Artificial Sequence
  chemically synthesized
cttaagctgagaattaaatgct

SEQ ID NO: 104914 - DNA, 22 bp, Artificial Sequence
  chemically synthesized
aagctgagaattaaatgctact

SEQ ID NO: 104915 - DNA, 22 bp, Artificial Sequence
  chemically synthesized
agctgagaattaaatgctacta

SEQ ID NO: 104916 - DNA, 22 bp, Artificial Sequence
  chemically synthesized
agaattaaatgctactatatta

SEQ ID NO: 104917 - DNA, 22 bp, Artificial Sequence
  chemically synthesized
aatgctactatattagtagtgt

SEQ ID NO: 104918 - DNA, 22 bp, Artificial Sequence
  chemically synthesized
ctatattagtagtgtagtagta

SEQ ID NO: 104919 - DNA, 22 bp, Artificial Sequence
  chemically synthesized
tattagtagtgtagtagtattt

SEQ ID NO: 104920 - DNA, 22 bp, Artificial Sequence
  chemically synthesized
gtagtgtagtagtatttggtgg

SEQ ID NO: 104921 - DNA, 22 bp, Artificial Sequence
  chemically synthesized
ggtggggtagtgcaatcattgc

SEQ ID NO: 104922 - DNA, 22 bp, Artificial Sequence
  chemically synthesized
gtggggtagtgcaatcattgcg

SEQ ID NO: 104923 - DNA, 22 bp, Artificial Sequence
  chemically synthesized
cgtacaggtgaaaagaacaaac

SEQ ID NO: 104924 - DNA, 22 bp, Artificial Sequence
  chemically synthesized
aagtttgtaaaatgtacattgg

SEQ ID NO: 104925 - DNA, 22 bp, Artificial Sequence
  chemically synthesized
gtaaaatgtacattggtaatgg

SEQ ID NO: 104926 - DNA, 22 bp, Artificial Sequence
  chemically synthesized
taaaatgtacattggtaatggg

SEQ ID NO: 104927 - DNA, 22 bp, Artificial Sequence
  chemically synthesized
gtaatggggcaagattaaatac

SEQ ID NO: 104928 - DNA, 22 bp, Artificial Sequence
  chemically synthesized
aatactataaattcaaataaaa

SEQ ID NO: 104929 - DNA, 22 bp, Artificial Sequence
  chemically synthesized
taaattcaaataaaaataattt

SEQ ID NO: 104930 - DNA, 22 bp, Artificial Sequence
  chemically synthesized
aaataaaaataattttattcaa

SEQ ID NO: 104931 - DNA, 22 bp, Artificial Sequence
  chemically synthesized
tattcaaaatatacattaagga

SEQ ID NO: 104932 - DNA, 22 bp, Artificial Sequence
  chemically synthesized
attcaaaatatacattaaggaa

SEQ ID NO: 104933 - DNA, 22 bp, Artificial Sequence
  chemically synthesized
ttcaaaatatacattaaggaag

SEQ ID NO: 104934 - DNA, 22 bp, Artificial Sequence
  chemically synthesized
aaaatatacattaaggaagtat

SEQ ID NO: 104935 - DNA, 22 bp, Artificial Sequence
  chemically synthesized
aggaagtataatatctcttgaa

SEQ ID NO: 104936 - DNA, 22 bp, Artificial Sequence
  chemically synthesized
ttgaacaacaatacatgaaaaa

SEQ ID NO: 104937 - DNA, 22 bp, Artificial Sequence
  chemically synthesized
gaacaacaatacatgaaaaaaa

SEQ ID NO: 104938 - DNA, 22 bp, Artificial Sequence
  chemically synthesized
aacaacaatacatgaaaaaaag

SEQ ID NO: 104939 - DNA, 22 bp, Artificial Sequence
  chemically synthesized
gagagaaaatgaatctgtagta

SEQ ID NO: 104940 - DNA, 22 bp, Artificial Sequence
  chemically synthesized
agagaaaatgaatctgtagtag

SEQ ID NO: 104941 - DNA, 22 bp, Artificial Sequence
  chemically synthesized
tagtagtagcaggttctgatca

SEQ ID NO: 104942 - DNA, 22 bp, Artificial Sequence
  chemically synthesized
tgatcacaatatatcttgcaaa

SEQ ID NO: 104943 - DNA, 22 bp, Artificial Sequence
  chemically synthesized
atcacaatatatcttgcaaatc

SEQ ID NO: 104944 - DNA, 22 bp, Artificial Sequence
  chemically synthesized
gcaaatcatgtaaaacattttg

SEQ ID NO: 104945 - DNA, 22 bp, Artificial Sequence
  chemically synthesized
caaatcatgtaaaacattttga

SEQ ID NO: 104946 - DNA, 22 bp, Artificial Sequence
  chemically synthesized
tgacattaccataagggaatga

SEQ ID NO: 104947 - DNA, 22 bp, Artificial Sequence
  chemically synthesized
gacattaccataagggaatgaa

SEQ ID NO: 104948 - DNA, 22 bp, Artificial Sequence
  chemically synthesized
acattaccataagggaatgaat

SEQ ID NO: 104949 - DNA, 22 bp, Artificial Sequence
  chemically synthesized
ccataagggaatgaatataaaa

SEQ ID NO: 104950 - DNA, 22 bp, Artificial Sequence
  chemically synthesized
ataatcaagtagttattgttta

SEQ ID NO: 104951 - DNA, 22 bp, Artificial Sequence
  chemically synthesized
taatcaagtagttattgtttaa

SEQ ID NO: 104952 - DNA, 22 bp, Artificial Sequence
  chemically synthesized
ttgtttaaagttactatggcta

SEQ ID NO: 104953 - DNA, 22 bp, Artificial Sequence
  chemically synthesized
tttaaagttactatggctacag

SEQ ID NO: 104954 - DNA, 22 bp, Artificial Sequence
  chemically synthesized
aaagttactatggctacagtat

SEQ ID NO: 104955 - DNA, 22 bp, Artificial Sequence
  chemically synthesized
aagttactatggctacagtatg

SEQ ID NO: 104956 - DNA, 22 bp, Artificial Sequence
  chemically synthesized
ctatggctacagtatgagaaac

SEQ ID NO: 104957 - DNA, 22 bp, Artificial Sequence
  chemically synthesized
tggctacagtatgagaaacatg

SEQ ID NO: 104958 - DNA, 22 bp, Artificial Sequence
  chemically synthesized
cagtatgagaaacatgttggaa

SEQ ID NO: 104959 - DNA, 22 bp, Artificial Sequence
  chemically synthesized
gaaaagggggagaacaggtaaa

SEQ ID NO: 104960 - DNA, 22 bp, Artificial Sequence
  chemically synthesized
tgttggtgtggttttgactagt

SEQ ID NO: 104961 - DNA, 22 bp, Artificial Sequence
  chemically synthesized
gtgtggttttgactagttgtta

SEQ ID NO: 104962 - DNA, 22 bp, Artificial Sequence
  chemically synthesized
tgactagttgttatcagtagca

SEQ ID NO: 104963 - DNA, 22 bp, Artificial Sequence
  chemically synthesized
gactagttgttatcagtagcat

SEQ ID NO: 104964 - DNA, 22 bp, Artificial Sequence
  chemically synthesized
actagttgttatcagtagcatt

SEQ ID NO: 104965 - DNA, 22 bp, Artificial Sequence
  chemically synthesized
gttgttatcagtagcattagaa

SEQ ID NO: 104966 - DNA, 22 bp, Artificial Sequence
  chemically synthesized
ttatcagtagcattagaaaggc

SEQ ID NO: 104967 - DNA, 22 bp, Artificial Sequence
  chemically synthesized
tcagtagcattagaaaggcttg

SEQ ID NO: 104968 - DNA, 22 bp, Artificial Sequence
  chemically synthesized
gaaaggcttgaatagaagagag

SEQ ID NO: 104969 - DNA, 22 bp, Artificial Sequence
  chemically synthesized
gaatagaagagagattctatga

SEQ ID NO: 104970 - DNA, 22 bp, Artificial Sequence
  chemically synthesized
aatagaagagagattctatgac

SEQ ID NO: 104971 - DNA, 22 bp, Artificial Sequence
  chemically synthesized
tatgacttagaatagaactgag

SEQ ID NO: 104972 - DNA, 22 bp, Artificial Sequence
  chemically synthesized
tgacttagaatagaactgagtg

SEQ ID NO: 104973 - DNA, 22 bp, Artificial Sequence
  chemically synthesized
agaatagaactgagtgattgaa

SEQ ID NO: 104974 - DNA, 22 bp, Artificial Sequence
  chemically synthesized
gaatagaactgagtgattgaag

SEQ ID NO: 104975 - DNA, 22 bp, Artificial Sequence
  chemically synthesized
agtgattgaaggtagtagatta

SEQ ID NO: 104976 - DNA, 22 bp, Artificial Sequence
  chemically synthesized
aaggtagtagattaaagagaaa

SEQ ID NO: 104977 - DNA, 22 bp, Artificial Sequence
  chemically synthesized
aagagaaagaagcgtaagtaat

SEQ ID NO: 104978 - DNA, 22 bp, Artificial Sequence
  chemically synthesized
aatttctgagttttgctgaatg

SEQ ID NO: 104979 - DNA, 22 bp, Artificial Sequence
  chemically synthesized
ctgagttttgctgaatggagag

SEQ ID NO: 104980 - DNA, 22 bp, Artificial Sequence
  chemically synthesized
tgagttttgctgaatggagagt

SEQ ID NO: 104981 - DNA, 22 bp, Artificial Sequence
  chemically synthesized
agttttgctgaatggagagtag

SEQ ID NO: 104982 - DNA, 22 bp, Artificial Sequence
  chemically synthesized
tgctgaatggagagtagttcca

SEQ ID NO: 104983 - DNA, 22 bp, Artificial Sequence
  chemically synthesized
gctgaatggagagtagttccat

SEQ ID NO: 104984 - DNA, 22 bp, Artificial Sequence
  chemically synthesized
ctgaatggagagtagttccatt

SEQ ID NO: 104985 - DNA, 22 bp, Artificial Sequence
  chemically synthesized
aatggagagtagttccattgac

SEQ ID NO: 104986 - DNA, 22 bp, Artificial Sequence
  chemically synthesized
cattgacttccatagttatcac

SEQ ID NO: 104987 - DNA, 22 bp, Artificial Sequence
  chemically synthesized
acttccatagttatcacaagaa

SEQ ID NO: 104988 - DNA, 22 bp, Artificial Sequence
  chemically synthesized
ccatagttatcacaagaagata

SEQ ID NO: 104989 - DNA, 22 bp, Artificial Sequence
  chemically synthesized
catagttatcacaagaagataa

SEQ ID NO: 104990 - DNA, 22 bp, Artificial Sequence
  chemically synthesized
tcacaagaagataatgacttta

SEQ ID NO: 104991 - DNA, 22 bp, Artificial Sequence
  chemically synthesized
tattcactaatcaacagttatt

SEQ ID NO: 104992 - DNA, 22 bp, Artificial Sequence
  chemically synthesized
attcactaatcaacagttattt

SEQ ID NO: 104993 - DNA, 22 bp, Artificial Sequence
  chemically synthesized
ttcactaatcaacagttattta

SEQ ID NO: 104994 - DNA, 22 bp, Artificial Sequence
  chemically synthesized
actaatcaacagttatttattg

SEQ ID NO: 104995 - DNA, 22 bp, Artificial Sequence
  chemically synthesized
atcaacagttatttattgattg

SEQ ID NO: 104996 - DNA, 22 bp, Artificial Sequence
  chemically synthesized
tttattgattggtcattgtaca

SEQ ID NO: 104997 - DNA, 22 bp, Artificial Sequence
  chemically synthesized
attgattggtcattgtacatta

SEQ ID NO: 104998 - DNA, 22 bp, Artificial Sequence
  chemically synthesized
ttgattggtcattgtacattaa

SEQ ID NO: 104999 - DNA, 22 bp, Artificial Sequence
  chemically synthesized
attggtcattgtacattaatga

SEQ ID NO: 105000 - DNA, 22 bp, Artificial Sequence
  chemically synthesized
gtcattgtacattaatgagtgt

SEQ ID NO: 105001 - DNA, 22 bp, Artificial Sequence
  chemically synthesized
tacattaatgagtgttttacat

SEQ ID NO: 105002 - DNA, 22 bp, Artificial Sequence
  chemically synthesized
atgagtgttttacatgctgact

SEQ ID NO: 105003 - DNA, 22 bp, Artificial Sequence
  chemically synthesized
tacatgctgactttgtagaaaa

SEQ ID NO: 105004 - DNA, 22 bp, Artificial Sequence
  chemically synthesized
acatgctgactttgtagaaaag

SEQ ID NO: 105005 - DNA, 22 bp, Artificial Sequence
  chemically synthesized
catgctgactttgtagaaaaga

SEQ ID NO: 105006 - DNA, 22 bp, Artificial Sequence
  chemically synthesized
actttgtagaaaagatgaagag

SEQ ID NO: 105007 - DNA, 22 bp, Artificial Sequence
  chemically synthesized
tgtagaaaagatgaagagaatc

SEQ ID NO: 105008 - DNA, 22 bp, Artificial Sequence
  chemically synthesized
gtagaaaagatgaagagaatca

SEQ ID NO: 105009 - DNA, 22 bp, Artificial Sequence
  chemically synthesized
tagaaaagatgaagagaatcag

SEQ ID NO: 105010 - DNA, 22 bp, Artificial Sequence
  chemically synthesized
caatgaagtgctttgcacaaag

SEQ ID NO: 105011 - DNA, 22 bp, Artificial Sequence
  chemically synthesized
aatgaagtgctttgcacaaagg

SEQ ID NO: 105012 - DNA, 22 bp, Artificial Sequence
  chemically synthesized
tgcacaaaggataccctggaga

SEQ ID NO: 105013 - DNA, 22 bp, Artificial Sequence
  chemically synthesized
gcacaaaggataccctggagaa

SEQ ID NO: 105014 - DNA, 22 bp, Artificial Sequence
  chemically synthesized
cacaaaggataccctggagaaa

SEQ ID NO: 105015 - DNA, 22 bp, Artificial Sequence
  chemically synthesized
gagaaaattactcatatcattt

SEQ ID NO: 105016 - DNA, 22 bp, Artificial Sequence
  chemically synthesized
ctcatatcattttcttttctaa

SEQ ID NO: 105017 - DNA, 22 bp, Artificial Sequence
  chemically synthesized
atatcattttcttttctaacag

SEQ ID NO: 105018 - DNA, 22 bp, Artificial Sequence
  chemically synthesized
tcttttctaacagtttcattaa

SEQ ID NO: 105019 - DNA, 22 bp, Artificial Sequence
  chemically synthesized
cttttctaacagtttcattaac

SEQ ID NO: 105020 - DNA, 22 bp, Artificial Sequence
  chemically synthesized
ttttctaacagtttcattaaca

SEQ ID NO: 105021 - DNA, 22 bp, Artificial Sequence
  chemically synthesized
ttctaacagtttcattaacata

SEQ ID NO: 105022 - DNA, 22 bp, Artificial Sequence
  chemically synthesized
tctaacagtttcattaacatat

SEQ ID NO: 105023 - DNA, 22 bp, Artificial Sequence
  chemically synthesized
ctaacagtttcattaacatata

SEQ ID NO: 105024 - DNA, 22 bp, Artificial Sequence
  chemically synthesized
taacagtttcattaacatatag

SEQ ID NO: 105025 - DNA, 22 bp, Artificial Sequence
  chemically synthesized
acagtttcattaacatataggt

SEQ ID NO: 105026 - DNA, 22 bp, Artificial Sequence
  chemically synthesized
cattaacatataggtaaagaca

SEQ ID NO: 105027 - DNA, 22 bp, Artificial Sequence
  chemically synthesized
attaacatataggtaaagacag

SEQ ID NO: 105028 - DNA, 22 bp, Artificial Sequence
  chemically synthesized
acatataggtaaagacaggata

SEQ ID NO: 105029 - DNA, 22 bp, Artificial Sequence
  chemically synthesized
acatagtacagtgtcattaata

SEQ ID NO: 105030 - DNA, 22 bp, Artificial Sequence
  chemically synthesized
ataggttaatcaggtcatgtgg

SEQ ID NO: 105031 - DNA, 22 bp, Artificial Sequence
  chemically synthesized
atcaggtcatgtggtaaagtgg

SEQ ID NO: 105032 - DNA, 22 bp, Artificial Sequence
  chemically synthesized
aataaggatattattttgtttt

SEQ ID NO: 105033 - DNA, 22 bp, Artificial Sequence
  chemically synthesized
ttttgtttttagagaatttaaa

SEQ ID NO: 105034 - DNA, 22 bp, Artificial Sequence
  chemically synthesized
tgtttttagagaatttaaagga

SEQ ID NO: 105035 - DNA, 22 bp, Artificial Sequence
  chemically synthesized
gtttttagagaatttaaaggaa

SEQ ID NO: 105036 - DNA, 22 bp, Artificial Sequence
  chemically synthesized
tttttagagaatttaaaggaag

SEQ ID NO: 105037 - DNA, 22 bp, Artificial Sequence
  chemically synthesized
ttagagaatttaaaggaagctg

SEQ ID NO: 105038 - DNA, 22 bp, Artificial Sequence
  chemically synthesized
tagagaatttaaaggaagctgt

SEQ ID NO: 105039 - DNA, 22 bp, Artificial Sequence
  chemically synthesized
agagaatttaaaggaagctgtc

SEQ ID NO: 105040 - DNA, 22 bp, Artificial Sequence
  chemically synthesized
gagaatttaaaggaagctgtcc

SEQ ID NO: 105041 - DNA, 22 bp, Artificial Sequence
  chemically synthesized
aaaggaagctgtcctccttatt

SEQ ID NO: 105042 - DNA, 22 bp, Artificial Sequence
  chemically synthesized
aaggaagctgtcctccttatta

SEQ ID NO: 105043 - DNA, 22 bp, Artificial Sequence
  chemically synthesized
tcctccttattaaaaatatgac

SEQ ID NO: 105044 - DNA, 22 bp, Artificial Sequence
  chemically synthesized
cttattaaaaatatgacagaag

SEQ ID NO: 105045 - DNA, 22 bp, Artificial Sequence
  chemically synthesized
attaaaaatatgacagaagagt

SEQ ID NO: 105046 - DNA, 22 bp, Artificial Sequence
  chemically synthesized
ttaaaaatatgacagaagagtg

SEQ ID NO: 105047 - DNA, 22 bp, Artificial Sequence
  chemically synthesized
aaaatatgacagaagagtgata

SEQ ID NO: 105048 - DNA, 22 bp, Artificial Sequence
  chemically synthesized
gtttggtttaatgaagtattgg

SEQ ID NO: 105049 - DNA, 22 bp, Artificial Sequence
  chemically synthesized
ggtttaatgaagtattggcttg

SEQ ID NO: 105050 - DNA, 22 bp, Artificial Sequence
  chemically synthesized
gtttaatgaagtattggcttgt

SEQ ID NO: 105051 - DNA, 22 bp, Artificial Sequence
  chemically synthesized
aatgaagtattggcttgtgccc

SEQ ID NO: 105052 - DNA, 22 bp, Artificial Sequence
  chemically synthesized
atgaagtattggcttgtgccct

SEQ ID NO: 105053 - DNA, 22 bp, Artificial Sequence
  chemically synthesized
gcttgtgccctcagaagggact

SEQ ID NO: 105054 - DNA, 22 bp, Artificial Sequence
  chemically synthesized
gtgccctcagaagggactgtgt

SEQ ID NO: 105055 - DNA, 22 bp, Artificial Sequence
  chemically synthesized
tgccctcagaagggactgtgta

SEQ ID NO: 105056 - DNA, 22 bp, Artificial Sequence
  chemically synthesized
agaagggactgtgtatctttta

SEQ ID NO: 105057 - DNA, 22 bp, Artificial Sequence
  chemically synthesized
tgtatcttttatcatgaaagtt

SEQ ID NO: 105058 - DNA, 22 bp, Artificial Sequence
  chemically synthesized
ttatcatgaaagttgatatttc

SEQ ID NO: 105059 - DNA, 22 bp, Artificial Sequence
  chemically synthesized
tatcatgaaagttgatatttca

SEQ ID NO: 105060 - DNA, 22 bp, Artificial Sequence
  chemically synthesized
atcatgaaagttgatatttcag

SEQ ID NO: 105061 - DNA, 22 bp, Artificial Sequence
  chemically synthesized
tcatgaaagttgatatttcaga

SEQ ID NO: 105062 - DNA, 22 bp, Artificial Sequence
  chemically synthesized
atatttcagagcactaataact

SEQ ID NO: 105063 - DNA, 22 bp, Artificial Sequence
  chemically synthesized
cagagcactaataacttagttt

SEQ ID NO: 105064 - DNA, 22 bp, Artificial Sequence
  chemically synthesized
agagcactaataacttagtttc

SEQ ID NO: 105065 - DNA, 22 bp, Artificial Sequence
  chemically synthesized
ataacttagtttccttctatgt

SEQ ID NO: 105066 - DNA, 22 bp, Artificial Sequence
  chemically synthesized
agtttccttctatgtaaaagat

SEQ ID NO: 105067 - DNA, 22 bp, Artificial Sequence
  chemically synthesized
gtttccttctatgtaaaagatg

SEQ ID NO: 105068 - DNA, 22 bp, Artificial Sequence
  chemically synthesized
ccttctatgtaaaagatgaaaa

SEQ ID NO: 105069 - DNA, 22 bp, Artificial Sequence
  chemically synthesized
cttctatgtaaaagatgaaaag

SEQ ID NO: 105070 - DNA, 22 bp, Artificial Sequence
  chemically synthesized
ctatgtaaaagatgaaaagtct

SEQ ID NO: 105071 - DNA, 22 bp, Artificial Sequence
  chemically synthesized
tatgtaaaagatgaaaagtctc

SEQ ID NO: 105072 - DNA, 22 bp, Artificial Sequence
  chemically synthesized
tgtaaaagatgaaaagtctcaa

SEQ ID NO: 105073 - DNA, 22 bp, Artificial Sequence
  chemically synthesized
aatgaaataaaatgctagtgga

SEQ ID NO: 105074 - DNA, 22 bp, Artificial Sequence
  chemically synthesized
gtggattcagatcaccctctta

SEQ ID NO: 105075 - DNA, 22 bp, Artificial Sequence
  chemically synthesized
agatcaccctcttagaatcaat

SEQ ID NO: 105076 - DNA, 22 bp, Artificial Sequence
  chemically synthesized
ttagaatcaatttgaaaaatat

SEQ ID NO: 105077 - DNA, 22 bp, Artificial Sequence
  chemically synthesized
agaatcaatttgaaaaatattt

SEQ ID NO: 105078 - DNA, 22 bp, Artificial Sequence
  chemically synthesized
gaatcaatttgaaaaatatttt

SEQ ID NO: 105079 - DNA, 22 bp, Artificial Sequence
  chemically synthesized
gaaaaatattttctttaaacaa

SEQ ID NO: 105080 - DNA, 22 bp, Artificial Sequence
  chemically synthesized
aaaaatattttctttaaacaac

SEQ ID NO: 105081 - DNA, 22 bp, Artificial Sequence
  chemically synthesized
tctttaaacaaccatgaaggca

SEQ ID NO: 105082 - DNA, 22 bp, Artificial Sequence
  chemically synthesized
ctttaaacaaccatgaaggcac

SEQ ID NO: 105083 - DNA, 22 bp, Artificial Sequence
  chemically synthesized
tttaaacaaccatgaaggcacc

SEQ ID NO: 105084 - DNA, 22 bp, Artificial Sequence
  chemically synthesized
taaacaaccatgaaggcaccaa

SEQ ID NO: 105085 - DNA, 22 bp, Artificial Sequence
  chemically synthesized
aaacaaccatgaaggcaccaag

SEQ ID NO: 105086 - DNA, 22 bp, Artificial Sequence
  chemically synthesized
aacaaccatgaaggcaccaaga

SEQ ID NO: 105087 - DNA, 22 bp, Artificial Sequence
  chemically synthesized
aacgtctaaaccagtttaagga

SEQ ID NO: 105088 - DNA, 22 bp, Artificial Sequence
  chemically synthesized
aaccagtttaaggacaacgtca

SEQ ID NO: 105089 - DNA, 22 bp, Artificial Sequence
  chemically synthesized
aaggacaacgtcattaataata

SEQ ID NO: 105090 - DNA, 22 bp, Artificial Sequence
  chemically synthesized
aggacaacgtcattaataataa

SEQ ID NO: 105091 - DNA, 22 bp, Artificial Sequence
  chemically synthesized
ataataaacatatttcccaata

SEQ ID NO: 105092 - DNA, 22 bp, Artificial Sequence
  chemically synthesized
cccaataatttgggcttctttc

SEQ ID NO: 105093 - DNA, 22 bp, Artificial Sequence
  chemically synthesized
ccaataatttgggcttctttca

SEQ ID NO: 105094 - DNA, 22 bp, Artificial Sequence
  chemically synthesized
gggcttctttcatcttggaaac

SEQ ID NO: 105095 - DNA, 22 bp, Artificial Sequence
  chemically synthesized
ggcttctttcatcttggaaaca

SEQ ID NO: 105096 - DNA, 22 bp, Artificial Sequence
  chemically synthesized
ctttcatcttggaaacaacact

SEQ ID NO: 105097 - DNA, 22 bp, Artificial Sequence
  chemically synthesized
tttcatcttggaaacaacactg

SEQ ID NO: 105098 - DNA, 22 bp, Artificial Sequence
  chemically synthesized
tcatcttggaaacaacactgct

SEQ ID NO: 105099 - DNA, 22 bp, Artificial Sequence
  chemically synthesized
catcttggaaacaacactgctt

SEQ ID NO: 105100 - DNA, 22 bp, Artificial Sequence
  chemically synthesized
atcttggaaacaacactgctta

SEQ ID NO: 105101 - DNA, 22 bp, Artificial Sequence
  chemically synthesized
ggaaacaacactgcttatccaa

SEQ ID NO: 105102 - DNA, 22 bp, Artificial Sequence
  chemically synthesized
gaaacaacactgcttatccaaa

SEQ ID NO: 105103 - DNA, 22 bp, Artificial Sequence
  chemically synthesized
cttatccaaagtaagcacctcc

SEQ ID NO: 105104 - DNA, 22 bp, Artificial Sequence
  chemically synthesized
atccaaagtaagcacctcctta

SEQ ID NO: 105105 - DNA, 22 bp, Artificial Sequence
  chemically synthesized
tccaaagtaagcacctccttat

SEQ ID NO: 105106 - DNA, 22 bp, Artificial Sequence
  chemically synthesized
cttatacctattcagtgaggct

SEQ ID NO: 105107 - DNA, 22 bp, Artificial Sequence
  chemically synthesized
atacctattcagtgaggctgca

SEQ ID NO: 105108 - DNA, 22 bp, Artificial Sequence
  chemically synthesized
tacctattcagtgaggctgcaa

SEQ ID NO: 105109 - DNA, 22 bp, Artificial Sequence
  chemically synthesized
ttcagtgaggctgcaatattgc

SEQ ID NO: 105110 - DNA, 22 bp, Artificial Sequence
  chemically synthesized
agtgaggctgcaatattgccat

SEQ ID NO: 105111 - DNA, 22 bp, Artificial Sequence
  chemically synthesized
caatattgccatatcctcaacc

SEQ ID NO: 105112 - DNA, 22 bp, Artificial Sequence
  chemically synthesized
ccatatcctcaacccaccatat

SEQ ID NO: 105113 - DNA, 22 bp, Artificial Sequence
  chemically synthesized
aacccaccatatacacaaaagg

SEQ ID NO: 105114 - DNA, 22 bp, Artificial Sequence
  chemically synthesized
ctccatcatggtttgaaacttc

SEQ ID NO: 105115 - DNA, 22 bp, Artificial Sequence
  chemically synthesized
catcatggtttgaaacttcctt

SEQ ID NO: 105116 - DNA, 22 bp, Artificial Sequence
  chemically synthesized
gaaacttccttatttctcacac

SEQ ID NO: 105117 - DNA, 22 bp, Artificial Sequence
  chemically synthesized
aaacttccttatttctcacaca

SEQ ID NO: 105118 - DNA, 22 bp, Artificial Sequence
  chemically synthesized
ccttatttctcacacatgtggc

SEQ ID NO: 105119 - DNA, 22 bp, Artificial Sequence
  chemically synthesized
cttatttctcacacatgtggca

SEQ ID NO: 105120 - DNA, 22 bp, Artificial Sequence
  chemically synthesized
atttctcacacatgtggcaggt

SEQ ID NO: 105121 - DNA, 22 bp, Artificial Sequence
  chemically synthesized
tttctcacacatgtggcaggta

SEQ ID NO: 105122 - DNA, 22 bp, Artificial Sequence
  chemically synthesized
ctcacacatgtggcaggtaatt

SEQ ID NO: 105123 - DNA, 22 bp, Artificial Sequence
  chemically synthesized
tcacacatgtggcaggtaatta

SEQ ID NO: 105124 - DNA, 22 bp, Artificial Sequence
  chemically synthesized
acacatgtggcaggtaattaaa

SEQ ID NO: 105125 - DNA, 22 bp, Artificial Sequence
  chemically synthesized
aactatggcttgaagtcctggc

SEQ ID NO: 105126 - DNA, 22 bp, Artificial Sequence
  chemically synthesized
tggcttgaagtcctggccttgg

SEQ ID NO: 105127 - DNA, 22 bp, Artificial Sequence
  chemically synthesized
gaagtcctggccttggccagtt

SEQ ID NO: 105128 - DNA, 22 bp, Artificial Sequence
  chemically synthesized
aagtcctggccttggccagtta

SEQ ID NO: 105129 - DNA, 22 bp, Artificial Sequence
  chemically synthesized
gccttggccagttaaactaaga

SEQ ID NO: 105130 - DNA, 22 bp, Artificial Sequence
  chemically synthesized
ggccagttaaactaagagtcct

SEQ ID NO: 105131 - DNA, 22 bp, Artificial Sequence
  chemically synthesized
gccagttaaactaagagtcctt

SEQ ID NO: 105132 - DNA, 22 bp, Artificial Sequence
  chemically synthesized
aactaagagtccttccatcaaa

SEQ ID NO: 105133 - DNA, 22 bp, Artificial Sequence
  chemically synthesized
agagtccttccatcaaatgtat

SEQ ID NO: 105134 - DNA, 22 bp, Artificial Sequence
  chemically synthesized
ccatcaaatgtatcactgtaaa

SEQ ID NO: 105135 - DNA, 22 bp, Artificial Sequence
  chemically synthesized
catcaaatgtatcactgtaaaa

SEQ ID NO: 105136 - DNA, 22 bp, Artificial Sequence
  chemically synthesized
taaaacagatagcctatcctca

SEQ ID NO: 105137 - DNA, 22 bp, Artificial Sequence
  chemically synthesized
tcctcaaaatttagatatcaga

SEQ ID NO: 105138 - DNA, 22 bp, Artificial Sequence
  chemically synthesized
aaaatttagatatcagatgggg

SEQ ID NO: 105139 - DNA, 22 bp, Artificial Sequence
  chemically synthesized
agatatcagatggggatataat

SEQ ID NO: 105140 - DNA, 22 bp, Artificial Sequence
  chemically synthesized
gatatcagatggggatataata

SEQ ID NO: 105141 - DNA, 22 bp, Artificial Sequence
  chemically synthesized
gtgattaccacagcaacttgtg

SEQ ID NO: 105142 - DNA, 22 bp, Artificial Sequence
  chemically synthesized
tgattaccacagcaacttgtga

SEQ ID NO: 105143 - DNA, 22 bp, Artificial Sequence
  chemically synthesized
ccacagcaacttgtgatgtccc

SEQ ID NO: 105144 - DNA, 22 bp, Artificial Sequence
  chemically synthesized
gtgatgtcccacagcttctgtt

SEQ ID NO: 105145 - DNA, 22 bp, Artificial Sequence
  chemically synthesized
tgatgtcccacagcttctgttc

SEQ ID NO: 105146 - DNA, 22 bp, Artificial Sequence
  chemically synthesized
ctgttctacaaagatgggaaac

SEQ ID NO: 105147 - DNA, 22 bp, Artificial Sequence
  chemically synthesized
tgttctacaaagatgggaaaca

SEQ ID NO: 105148 - DNA, 22 bp, Artificial Sequence
  chemically synthesized
ttctacaaagatgggaaacaaa

SEQ ID NO: 105149 - DNA, 22 bp, Artificial Sequence
  chemically synthesized
tacaaagatgggaaacaaaggc

SEQ ID NO: 105150 - DNA, 22 bp, Artificial Sequence
  chemically synthesized
caaagatgggaaacaaaggcag

SEQ ID NO: 105151 - DNA, 22 bp, Artificial Sequence
  chemically synthesized
tcctcagctacaagaggttctg

SEQ ID NO: 105152 - DNA, 22 bp, Artificial Sequence
  chemically synthesized
cctcagctacaagaggttctgc

SEQ ID NO: 105153 - DNA, 22 bp, Artificial Sequence
  chemically synthesized
ctcagctacaagaggttctgca

SEQ ID NO: 105154 - DNA, 22 bp, Artificial Sequence
  chemically synthesized
agctacaagaggttctgcatca

SEQ ID NO: 105155 - DNA, 22 bp, Artificial Sequence
  chemically synthesized
caagaggttctgcatcaagata

SEQ ID NO: 105156 - DNA, 22 bp, Artificial Sequence
  chemically synthesized
tgcatcaagatagcaaatcaag

SEQ ID NO: 105157 - DNA, 22 bp, Artificial Sequence
  chemically synthesized
catcaagatagcaaatcaagat

SEQ ID NO: 105158 - DNA, 22 bp, Artificial Sequence
  chemically synthesized
tccgaaatgagatttttccatt

SEQ ID NO: 105159 - DNA, 22 bp, Artificial Sequence
  chemically synthesized
ttccattaagatgcctagatgt

SEQ ID NO: 105160 - DNA, 22 bp, Artificial Sequence
  chemically synthesized
tccattaagatgcctagatgta

SEQ ID NO: 105161 - DNA, 22 bp, Artificial Sequence
  chemically synthesized
ccattaagatgcctagatgtat

SEQ ID NO: 105162 - DNA, 22 bp, Artificial Sequence
  chemically synthesized
cattaagatgcctagatgtatt

SEQ ID NO: 105163 - DNA, 22 bp, Artificial Sequence
  chemically synthesized
agatgcctagatgtattataga

SEQ ID NO: 105164 - DNA, 22 bp, Artificial Sequence
  chemically synthesized
gatgtattatagacctcatggt

SEQ ID NO: 105165 - DNA, 22 bp, Artificial Sequence
  chemically synthesized
tagacctcatggtcacatataa

SEQ ID NO: 105166 - DNA, 22 bp, Artificial Sequence
  chemically synthesized
atggtcacatataaggaacaga

SEQ ID NO: 105167 - DNA, 22 bp, Artificial Sequence
  chemically synthesized
tggtagataactgacttttagg

SEQ ID NO: 105168 - DNA, 22 bp, Artificial Sequence
  chemically synthesized
ggtagataactgacttttagga

SEQ ID NO: 105169 - DNA, 22 bp, Artificial Sequence
  chemically synthesized
gtagataactgacttttaggat

SEQ ID NO: 105170 - DNA, 22 bp, Artificial Sequence
  chemically synthesized
acttttaggatttgagtttata

SEQ ID NO: 105171 - DNA, 22 bp, Artificial Sequence
  chemically synthesized
ttaggatttgagtttatattca

SEQ ID NO: 105172 - DNA, 22 bp, Artificial Sequence
  chemically synthesized
taggatttgagtttatattcag

SEQ ID NO: 105173 - DNA, 22 bp, Artificial Sequence
  chemically synthesized
aggatttgagtttatattcagc

SEQ ID NO: 105174 - DNA, 22 bp, Artificial Sequence
  chemically synthesized
ggatttgagtttatattcagca

SEQ ID NO: 105175 - DNA, 22 bp, Artificial Sequence
  chemically synthesized
gagtttatattcagcatcaata

SEQ ID NO: 105176 - DNA, 22 bp, Artificial Sequence
  chemically synthesized
agtttatattcagcatcaataa

SEQ ID NO: 105177 - DNA, 22 bp, Artificial Sequence
  chemically synthesized
atattcagcatcaataacttga

SEQ ID NO: 105178 - DNA, 22 bp, Artificial Sequence
  chemically synthesized
tattcagcatcaataacttgaa

SEQ ID NO: 105179 - DNA, 22 bp, Artificial Sequence
  chemically synthesized
agcatcaataacttgaacatta

SEQ ID NO: 105180 - DNA, 22 bp, Artificial Sequence
  chemically synthesized
gaacattatactctgagatagg

SEQ ID NO: 105181 - DNA, 22 bp, Artificial Sequence
  chemically synthesized
aacattatactctgagataggt

SEQ ID NO: 105182 - DNA, 22 bp, Artificial Sequence
  chemically synthesized
tactctgagataggttttcccc

SEQ ID NO: 105183 - DNA, 22 bp, Artificial Sequence
  chemically synthesized
tgagataggttttccccttttg

SEQ ID NO: 105184 - DNA, 22 bp, Artificial Sequence
  chemically synthesized
agataggttttccccttttgaa

SEQ ID NO: 105185 - DNA, 22 bp, Artificial Sequence
  chemically synthesized
tccccttttgaaatttgtggat

SEQ ID NO: 105186 - DNA, 22 bp, Artificial Sequence
  chemically synthesized
ccccttttgaaatttgtggatg

SEQ ID NO: 105187 - DNA, 22 bp, Artificial Sequence
  chemically synthesized
cccttttgaaatttgtggatga

SEQ ID NO: 105188 - DNA, 22 bp, Artificial Sequence
  chemically synthesized
ttgaaatttgtggatgaaaatc

SEQ ID NO: 105189 - DNA, 22 bp, Artificial Sequence
  chemically synthesized
tgaaatttgtggatgaaaatcc

SEQ ID NO: 105190 - DNA, 22 bp, Artificial Sequence
  chemically synthesized
gaaatttgtggatgaaaatcct

SEQ ID NO: 105191 - DNA, 22 bp, Artificial Sequence
  chemically synthesized
aaatttgtggatgaaaatcctg

SEQ ID NO: 105192 - DNA, 22 bp, Artificial Sequence
  chemically synthesized
gtggatgaaaatcctgtttcac

SEQ ID NO: 105193 - DNA, 22 bp, Artificial Sequence
  chemically synthesized
tggatgaaaatcctgtttcaca

SEQ ID NO: 105194 - DNA, 22 bp, Artificial Sequence
  chemically synthesized
tttcacaattaaatcagtctaa

SEQ ID NO: 105195 - DNA, 22 bp, Artificial Sequence
  chemically synthesized
cacaattaaatcagtctaaaag

SEQ ID NO: 105196 - DNA, 22 bp, Artificial Sequence
  chemically synthesized
acaattaaatcagtctaaaaga

SEQ ID NO: 105197 - DNA, 22 bp, Artificial Sequence
  chemically synthesized
aatcagtctaaaagaagctttt

SEQ ID NO: 105198 - DNA, 22 bp, Artificial Sequence
  chemically synthesized
aaagaagcttttagtacacagt

SEQ ID NO: 105199 - DNA, 22 bp, Artificial Sequence
  chemically synthesized
ttagtacacagtcacacaaaaa

SEQ ID NO: 105200 - DNA, 22 bp, Artificial Sequence
  chemically synthesized
tagtacacagtcacacaaaaac

SEQ ID NO: 105201 - DNA, 22 bp, Artificial Sequence
  chemically synthesized
agtacacagtcacacaaaaact

SEQ ID NO: 105202 - DNA, 22 bp, Artificial Sequence
  chemically synthesized
gtacacagtcacacaaaaactc

SEQ ID NO: 105203 - DNA, 22 bp, Artificial Sequence
  chemically synthesized
ctcccaccacaattttttagtc

SEQ ID NO: 105204 - DNA, 22 bp, Artificial Sequence
  chemically synthesized
ccaccacaattttttagtcatt

SEQ ID NO: 105205 - DNA, 22 bp, Artificial Sequence
  chemically synthesized
tttagtcattggatgaattgaa

SEQ ID NO: 105206 - DNA, 22 bp, Artificial Sequence
  chemically synthesized
ttagtcattggatgaattgaaa

SEQ ID NO: 105207 - DNA, 22 bp, Artificial Sequence
  chemically synthesized
tagtcattggatgaattgaaat

SEQ ID NO: 105208 - DNA, 22 bp, Artificial Sequence
  chemically synthesized
agtcattggatgaattgaaatc

SEQ ID NO: 105209 - DNA, 22 bp, Artificial Sequence
  chemically synthesized
gtcattggatgaattgaaatcc

SEQ ID NO: 105210 - DNA, 22 bp, Artificial Sequence
  chemically synthesized
gatgaattgaaatccatttctc

SEQ ID NO: 105211 - DNA, 22 bp, Artificial Sequence
  chemically synthesized
aaatccatttctctcaacattg

SEQ ID NO: 105212 - DNA, 22 bp, Artificial Sequence
  chemically synthesized
ctctcaacattgttggtcttcc

SEQ ID NO: 105213 - DNA, 22 bp, Artificial Sequence
  chemically synthesized
tctcaacattgttggtcttcct

SEQ ID NO: 105214 - DNA, 22 bp, Artificial Sequence
  chemically synthesized
tcaacattgttggtcttcctaa

SEQ ID NO: 105215 - DNA, 22 bp, Artificial Sequence
  chemically synthesized
aacattgttggtcttcctaata

SEQ ID NO: 105216 - DNA, 22 bp, Artificial Sequence
  chemically synthesized
ttggtcttcctaatatagagag

SEQ ID NO: 105217 - DNA, 22 bp, Artificial Sequence
  chemically synthesized
gtcttcctaatatagagagttt

SEQ ID NO: 105218 - DNA, 22 bp, Artificial Sequence
  chemically synthesized
cctaatatagagagtttacagt

SEQ ID NO: 105219 - DNA, 22 bp, Artificial Sequence
  chemically synthesized
ctaatatagagagtttacagta

SEQ ID NO: 105220 - DNA, 22 bp, Artificial Sequence
  chemically synthesized
atatagagagtttacagtagat

SEQ ID NO: 105221 - DNA, 22 bp, Artificial Sequence
  chemically synthesized
acagtagatgtcagagaaagta

SEQ ID NO: 105222 - DNA, 22 bp, Artificial Sequence
  chemically synthesized
cagtagatgtcagagaaagtat

SEQ ID NO: 105223 - DNA, 22 bp, Artificial Sequence
  chemically synthesized
atggcaaaagaatcaccatttc

SEQ ID NO: 105224 - DNA, 22 bp, Artificial Sequence
  chemically synthesized
tggcaaaagaatcaccatttct

SEQ ID NO: 105225 - DNA, 22 bp, Artificial Sequence
  chemically synthesized
ctaatttttccctctgaacata

SEQ ID NO: 105226 - DNA, 22 bp, Artificial Sequence
  chemically synthesized
taatttttccctctgaacatat

SEQ ID NO: 105227 - DNA, 22 bp, Artificial Sequence
  chemically synthesized
atttttccctctgaacatatat

SEQ ID NO: 105228 - DNA, 22 bp, Artificial Sequence
  chemically synthesized
ttccctctgaacatatataaag

SEQ ID NO: 105229 - DNA, 22 bp, Artificial Sequence
  chemically synthesized
tccctctgaacatatataaagt

SEQ ID NO: 105230 - DNA, 22 bp, Artificial Sequence
  chemically synthesized
ccctctgaacatatataaagta

SEQ ID NO: 105231 - DNA, 22 bp, Artificial Sequence
  chemically synthesized
cctctgaacatatataaagtat

SEQ ID NO: 105232 - DNA, 22 bp, Artificial Sequence
  chemically synthesized
tgaacatatataaagtatatat

SEQ ID NO: 105233 - DNA, 22 bp, Artificial Sequence
  chemically synthesized
aacatatataaagtatatataa

SEQ ID NO: 105234 - DNA, 22 bp, Artificial Sequence
  chemically synthesized
gtgaagtaatgatgtctcatat

SEQ ID NO: 105235 - DNA, 22 bp, Artificial Sequence
  chemically synthesized
tgaagtaatgatgtctcatatt

SEQ ID NO: 105236 - DNA, 22 bp, Artificial Sequence
  chemically synthesized
atatttttcattctagaatggc

SEQ ID NO: 105237 - DNA, 22 bp, Artificial Sequence
  chemically synthesized
ttcattctagaatggctatatt

SEQ ID NO: 105238 - DNA, 22 bp, Artificial Sequence
  chemically synthesized
tcattctagaatggctatattt

SEQ ID NO: 105239 - DNA, 22 bp, Artificial Sequence
  chemically synthesized
cattctagaatggctatatttt

SEQ ID NO: 105240 - DNA, 22 bp, Artificial Sequence
  chemically synthesized
attctagaatggctatattttc

SEQ ID NO: 105241 - DNA, 22 bp, Artificial Sequence
  chemically synthesized
tagaatggctatattttctatt

SEQ ID NO: 105242 - DNA, 22 bp, Artificial Sequence
  chemically synthesized
gaatggctatattttctatttt

SEQ ID NO: 105243 - DNA, 22 bp, Artificial Sequence
  chemically synthesized
tattttctatttttgaatagag

SEQ ID NO: 105244 - DNA, 22 bp, Artificial Sequence
  chemically synthesized
tctatttttgaatagagccttg

SEQ ID NO: 105245 - DNA, 22 bp, Artificial Sequence
  chemically synthesized
ctatttttgaatagagccttga

SEQ ID NO: 105246 - DNA, 22 bp, Artificial Sequence
  chemically synthesized
tatttttgaatagagccttgac

SEQ ID NO: 105247 - DNA, 22 bp, Artificial Sequence
  chemically synthesized
tttttgaatagagccttgaccc

SEQ ID NO: 105248 - DNA, 22 bp, Artificial Sequence
  chemically synthesized
ttgaatagagccttgacccttc

SEQ ID NO: 105249 - DNA, 22 bp, Artificial Sequence
  chemically synthesized
tgaatagagccttgacccttcc

SEQ ID NO: 105250 - DNA, 22 bp, Artificial Sequence
  chemically synthesized
gaatagagccttgacccttcct

SEQ ID NO: 105251 - DNA, 22 bp, Artificial Sequence
  chemically synthesized
aatagagccttgacccttccta

SEQ ID NO: 105252 - DNA, 22 bp, Artificial Sequence
  chemically synthesized
gacccttcctattattaggcca

SEQ ID NO: 105253 - DNA, 22 bp, Artificial Sequence
  chemically synthesized
acccttcctattattaggccaa

SEQ ID NO: 105254 - DNA, 22 bp, Artificial Sequence
  chemically synthesized
cctattattaggccaagggaaa

SEQ ID NO: 105255 - DNA, 22 bp, Artificial Sequence
  chemically synthesized
ctattattaggccaagggaaaa

SEQ ID NO: 105256 - DNA, 22 bp, Artificial Sequence
  chemically synthesized
ttattaggccaagggaaaagta

SEQ ID NO: 105257 - DNA, 22 bp, Artificial Sequence
  chemically synthesized
ttaggccaagggaaaagtatgt

SEQ ID NO: 105258 - DNA, 22 bp, Artificial Sequence
  chemically synthesized
ggccaagggaaaagtatgttaa

SEQ ID NO: 105259 - DNA, 22 bp, Artificial Sequence
  chemically synthesized
aaatcatctgaagagcaaacat

SEQ ID NO: 105260 - DNA, 22 bp, Artificial Sequence
  chemically synthesized
aagagcaaacatactcttaaaa

SEQ ID NO: 105261 - DNA, 22 bp, Artificial Sequence
  chemically synthesized
ttaaaaactcactttttacttt

SEQ ID NO: 105262 - DNA, 22 bp, Artificial Sequence
  chemically synthesized
aaaaactcactttttacttttt

SEQ ID NO: 105263 - DNA, 22 bp, Artificial Sequence
  chemically synthesized
aaaactcactttttactttttt

SEQ ID NO: 105264 - DNA, 22 bp, Artificial Sequence
  chemically synthesized
actttttacttttttacgagct

SEQ ID NO: 105265 - DNA, 22 bp, Artificial Sequence
  chemically synthesized
tttacttttttacgagctgaca

SEQ ID NO: 105266 - DNA, 22 bp, Artificial Sequence
  chemically synthesized
ttacttttttacgagctgacaa

SEQ ID NO: 105267 - DNA, 22 bp, Artificial Sequence
  chemically synthesized
tacttttttacgagctgacaag

SEQ ID NO: 105268 - DNA, 22 bp, Artificial Sequence
  chemically synthesized
acttttttacgagctgacaaga

SEQ ID NO: 105269 - DNA, 22 bp, Artificial Sequence
  chemically synthesized
cttttttacgagctgacaagaa

SEQ ID NO: 105270 - DNA, 22 bp, Artificial Sequence
  chemically synthesized
ttttacgagctgacaagaagct

SEQ ID NO: 105271 - DNA, 22 bp, Artificial Sequence
  chemically synthesized
tttacgagctgacaagaagctt

SEQ ID NO: 105272 - DNA, 22 bp, Artificial Sequence
  chemically synthesized
ttacgagctgacaagaagcttg

SEQ ID NO: 105273 - DNA, 22 bp, Artificial Sequence
  chemically synthesized
tacgagctgacaagaagcttgt

SEQ ID NO: 105274 - DNA, 22 bp, Artificial Sequence
  chemically synthesized
acgagctgacaagaagcttgtc

SEQ ID NO: 105275 - DNA, 22 bp, Artificial Sequence
  chemically synthesized
cgagctgacaagaagcttgtct

SEQ ID NO: 105276 - DNA, 22 bp, Artificial Sequence
  chemically synthesized
acaagaagcttgtctaggtttt

SEQ ID NO: 105277 - DNA, 22 bp, Artificial Sequence
  chemically synthesized
gtctaggtttttccttctaaga

SEQ ID NO: 105278 - DNA, 22 bp, Artificial Sequence
  chemically synthesized
tctaggtttttccttctaagat

SEQ ID NO: 105279 - DNA, 22 bp, Artificial Sequence
  chemically synthesized
ggtttttccttctaagattttt

SEQ ID NO: 105280 - DNA, 22 bp, Artificial Sequence
  chemically synthesized
ttccttctaagatttttttggg

SEQ ID NO: 105281 - DNA, 22 bp, Artificial Sequence
  chemically synthesized
tccttctaagatttttttgggc

SEQ ID NO: 105282 - DNA, 22 bp, Artificial Sequence
  chemically synthesized
ccttctaagatttttttgggca

SEQ ID NO: 105283 - DNA, 22 bp, Artificial Sequence
  chemically synthesized
cttctaagatttttttgggcaa

SEQ ID NO: 105284 - DNA, 22 bp, Artificial Sequence
  chemically synthesized
ctaagatttttttgggcaaaag

SEQ ID NO: 105285 - DNA, 22 bp, Artificial Sequence
  chemically synthesized
taagatttttttgggcaaaaga

SEQ ID NO: 105286 - DNA, 22 bp, Artificial Sequence
  chemically synthesized
agatttttttgggcaaaagaat

SEQ ID NO: 105287 - DNA, 22 bp, Artificial Sequence
  chemically synthesized
ttttgggcaaaagaatatttat

SEQ ID NO: 105288 - DNA, 22 bp, Artificial Sequence
  chemically synthesized
tttgggcaaaagaatatttata

SEQ ID NO: 105289 - DNA, 22 bp, Artificial Sequence
  chemically synthesized
ttgggcaaaagaatatttatag

SEQ ID NO: 105290 - DNA, 22 bp, Artificial Sequence
  chemically synthesized
tgggcaaaagaatatttataga

SEQ ID NO: 105291 - DNA, 22 bp, Artificial Sequence
  chemically synthesized
gggcaaaagaatatttatagaa

SEQ ID NO: 105292 - DNA, 22 bp, Artificial Sequence
  chemically synthesized
ggcaaaagaatatttatagaag

SEQ ID NO: 105293 - DNA, 22 bp, Artificial Sequence
  chemically synthesized
atagaagaatgaggtaaagaaa

SEQ ID NO: 105294 - DNA, 22 bp, Artificial Sequence
  chemically synthesized
tagaagaatgaggtaaagaaat

SEQ ID NO: 105295 - DNA, 22 bp, Artificial Sequence
  chemically synthesized
ttataaaatccagacatcctgc

SEQ ID NO: 105296 - DNA, 22 bp, Artificial Sequence
  chemically synthesized
tataaaatccagacatcctgca

SEQ ID NO: 105297 - DNA, 22 bp, Artificial Sequence
  chemically synthesized
ataaaatccagacatcctgcaa

SEQ ID NO: 105298 - DNA, 22 bp, Artificial Sequence
  chemically synthesized
taaaatccagacatcctgcaag

SEQ ID NO: 105299 - DNA, 22 bp, Artificial Sequence
  chemically synthesized
caaggaatgtattgaaaattaa

SEQ ID NO: 105300 - DNA, 22 bp, Artificial Sequence
  chemically synthesized
aaaattaaaaagctcttattga

SEQ ID NO: 105301 - DNA, 22 bp, Artificial Sequence
  chemically synthesized
aaaagctcttattgaaatactc

SEQ ID NO: 105302 - DNA, 22 bp, Artificial Sequence
  chemically synthesized
ttattgaaatactctgtaagtg

SEQ ID NO: 105303 - DNA, 22 bp, Artificial Sequence
  chemically synthesized
attgaaatactctgtaagtgac

SEQ ID NO: 105304 - DNA, 22 bp, Artificial Sequence
  chemically synthesized
ttgaaatactctgtaagtgact

SEQ ID NO: 105305 - DNA, 22 bp, Artificial Sequence
  chemically synthesized
aaatactctgtaagtgacttac

SEQ ID NO: 105306 - DNA, 22 bp, Artificial Sequence
  chemically synthesized
tgtaagtgacttacgactgtat

SEQ ID NO: 105307 - DNA, 22 bp, Artificial Sequence
  chemically synthesized
taagtgacttacgactgtattt

SEQ ID NO: 105308 - DNA, 22 bp, Artificial Sequence
  chemically synthesized
acgactgtatttagaaaatatt

SEQ ID NO: 105309 - DNA, 22 bp, Artificial Sequence
  chemically synthesized
cgactgtatttagaaaatatta

SEQ ID NO: 105310 - DNA, 22 bp, Artificial Sequence
  chemically synthesized
tatttagaaaatattaaatgca

SEQ ID NO: 105311 - DNA, 22 bp, Artificial Sequence
  chemically synthesized
agaaaatattaaatgcaaatca

SEQ ID NO: 105312 - DNA, 22 bp, Artificial Sequence
  chemically synthesized
gaaaatattaaatgcaaatcat

SEQ ID NO: 105313 - DNA, 22 bp, Artificial Sequence
  chemically synthesized
aatgcaaatcatggccctagag

SEQ ID NO: 105314 - DNA, 22 bp, Artificial Sequence
  chemically synthesized
gagagtaccctaactcagggta

SEQ ID NO: 105315 - DNA, 22 bp, Artificial Sequence
  chemically synthesized
actcagggtagaggacagttaa

SEQ ID NO: 105316 - DNA, 22 bp, Artificial Sequence
  chemically synthesized
agggtagaggacagttaaaaga

SEQ ID NO: 105317 - DNA, 22 bp, Artificial Sequence
  chemically synthesized
aaagataaccaacacttactta

SEQ ID NO: 105318 - DNA, 22 bp, Artificial Sequence
  chemically synthesized
acttatttaaaagtaaatttaa

SEQ ID NO: 105319 - DNA, 22 bp, Artificial Sequence
  chemically synthesized
cttatttaaaagtaaatttaaa

SEQ ID NO: 105320 - DNA, 22 bp, Artificial Sequence
  chemically synthesized
atttaaaagtaaatttaaaatg

SEQ ID NO: 105321 - DNA, 22 bp, Artificial Sequence
  chemically synthesized
tttaaaagtaaatttaaaatgt

SEQ ID NO: 105322 - DNA, 22 bp, Artificial Sequence
  chemically synthesized
aaaagtaaatttaaaatgttag

SEQ ID NO: 105323 - DNA, 22 bp, Artificial Sequence
  chemically synthesized
aaagtaaatttaaaatgttagt

SEQ ID NO: 105324 - DNA, 22 bp, Artificial Sequence
  chemically synthesized
aaaatgttagtttcttatcact

SEQ ID NO: 105325 - DNA, 22 bp, Artificial Sequence
  chemically synthesized
aaatgttagtttcttatcacta

SEQ ID NO: 105326 - DNA, 22 bp, Artificial Sequence
  chemically synthesized
gtttcttatcactatatttgcc

SEQ ID NO: 105327 - DNA, 22 bp, Artificial Sequence
  chemically synthesized
cttatcactatatttgccatga

SEQ ID NO: 105328 - DNA, 22 bp, Artificial Sequence
  chemically synthesized
ttatcactatatttgccatgag

SEQ ID NO: 105329 - DNA, 22 bp, Artificial Sequence
  chemically synthesized
atcactatatttgccatgagaa

SEQ ID NO: 105330 - DNA, 22 bp, Artificial Sequence
  chemically synthesized
tcactatatttgccatgagaat

SEQ ID NO: 105331 - DNA, 22 bp, Artificial Sequence
  chemically synthesized
tatttgccatgagaataatgaa

SEQ ID NO: 105332 - DNA, 22 bp, Artificial Sequence
  chemically synthesized
gccatgagaataatgaaaattt

SEQ ID NO: 105333 - DNA, 22 bp, Artificial Sequence
  chemically synthesized
ccatgagaataatgaaaatttt

SEQ ID NO: 105334 - DNA, 22 bp, Artificial Sequence
  chemically synthesized
taaataagaatttatttctaga

SEQ ID NO: 105335 - DNA, 22 bp, Artificial Sequence
  chemically synthesized
aaataagaatttatttctagag

SEQ ID NO: 105336 - DNA, 22 bp, Artificial Sequence
  chemically synthesized
aataagaatttatttctagaga

SEQ ID NO: 105337 - DNA, 22 bp, Artificial Sequence
  chemically synthesized
atttctagagaatgatgatcaa

SEQ ID NO: 105338 - DNA, 22 bp, Artificial Sequence
  chemically synthesized
tttctagagaatgatgatcaac

SEQ ID NO: 105339 - DNA, 22 bp, Artificial Sequence
  chemically synthesized
ctagagaatgatgatcaacttt

SEQ ID NO: 105340 - DNA, 22 bp, Artificial Sequence
  chemically synthesized
tagagaatgatgatcaactttt

SEQ ID NO: 105341 - DNA, 22 bp, Artificial Sequence
  chemically synthesized
gagaatgatgatcaactttttt

SEQ ID NO: 105342 - DNA, 22 bp, Artificial Sequence
  chemically synthesized
ttttttttacacttgtgtgcat

SEQ ID NO: 105343 - DNA, 22 bp, Artificial Sequence
  chemically synthesized
tttttttacacttgtgtgcatt

SEQ ID NO: 105344 - DNA, 22 bp, Artificial Sequence
  chemically synthesized
ttttttacacttgtgtgcatta

SEQ ID NO: 105345 - DNA, 22 bp, Artificial Sequence
  chemically synthesized
tttttacacttgtgtgcattag

SEQ ID NO: 105346 - DNA, 22 bp, Artificial Sequence
  chemically synthesized
ttttacacttgtgtgcattagc

SEQ ID NO: 105347 - DNA, 22 bp, Artificial Sequence
  chemically synthesized
tttacacttgtgtgcattagcc

SEQ ID NO: 105348 - DNA, 22 bp, Artificial Sequence
  chemically synthesized
ttacacttgtgtgcattagcct

SEQ ID NO: 105349 - DNA, 22 bp, Artificial Sequence
  chemically synthesized
tacacttgtgtgcattagccta

SEQ ID NO: 105350 - DNA, 22 bp, Artificial Sequence
  chemically synthesized
acacttgtgtgcattagcctat

SEQ ID NO: 105351 - DNA, 22 bp, Artificial Sequence
  chemically synthesized
cacttgtgtgcattagcctatg

SEQ ID NO: 105352 - DNA, 22 bp, Artificial Sequence
  chemically synthesized
gtgtgcattagcctatgcaaac

SEQ ID NO: 105353 - DNA, 22 bp, Artificial Sequence
  chemically synthesized
tgtgcattagcctatgcaaaca

SEQ ID NO: 105354 - DNA, 22 bp, Artificial Sequence
  chemically synthesized
gcctatgcaaacacataaacat

SEQ ID NO: 105355 - DNA, 22 bp, Artificial Sequence
  chemically synthesized
tgcaaacacataaacatgtatg

SEQ ID NO: 105356 - DNA, 22 bp, Artificial Sequence
  chemically synthesized
aggcaaaagtttttcatagaga

SEQ ID NO: 105357 - DNA, 22 bp, Artificial Sequence
  chemically synthesized
ttcatagagattatatgttctg

SEQ ID NO: 105358 - DNA, 22 bp, Artificial Sequence
  chemically synthesized
tcatagagattatatgttctgc

SEQ ID NO: 105359 - DNA, 22 bp, Artificial Sequence
  chemically synthesized
catagagattatatgttctgcc

SEQ ID NO: 105360 - DNA, 22 bp, Artificial Sequence
  chemically synthesized
atagagattatatgttctgcct

SEQ ID NO: 105361 - DNA, 22 bp, Artificial Sequence
  chemically synthesized
tatgttctgccttttcctcaaa

SEQ ID NO: 105362 - DNA, 22 bp, Artificial Sequence
  chemically synthesized
tgccttttcctcaaatttcact

SEQ ID NO: 105363 - DNA, 22 bp, Artificial Sequence
  chemically synthesized
ccttttcctcaaatttcactga

SEQ ID NO: 105364 - DNA, 22 bp, Artificial Sequence
  chemically synthesized
ttcctcaaatttcactgaggtg

SEQ ID NO: 105365 - DNA, 22 bp, Artificial Sequence
  chemically synthesized
tcctcaaatttcactgaggtgg

SEQ ID NO: 105366 - DNA, 22 bp, Artificial Sequence
  chemically synthesized
cctcaaatttcactgaggtggc

SEQ ID NO: 105367 - DNA, 22 bp, Artificial Sequence
  chemically synthesized
ctcaaatttcactgaggtggct

SEQ ID NO: 105368 - DNA, 22 bp, Artificial Sequence
  chemically synthesized
aaatttcactgaggtggctaat

SEQ ID NO: 105369 - DNA, 22 bp, Artificial Sequence
  chemically synthesized
cactgaggtggctaatttcagg

SEQ ID NO: 105370 - DNA, 22 bp, Artificial Sequence
  chemically synthesized
actgaggtggctaatttcaggt

SEQ ID NO: 105371 - DNA, 22 bp, Artificial Sequence
  chemically synthesized
aggtggctaatttcaggtgcat

SEQ ID NO: 105372 - DNA, 22 bp, Artificial Sequence
  chemically synthesized
atttcaggtgcatttgaaagaa

SEQ ID NO: 105373 - DNA, 22 bp, Artificial Sequence
  chemically synthesized
caggtgcatttgaaagaagaat

SEQ ID NO: 105374 - DNA, 22 bp, Artificial Sequence
  chemically synthesized
aggtgcatttgaaagaagaatt

SEQ ID NO: 105375 - DNA, 22 bp, Artificial Sequence
  chemically synthesized
gaaagaagaatttaaatataga

SEQ ID NO: 105376 - DNA, 22 bp, Artificial Sequence
  chemically synthesized
aaagaagaatttaaatatagac

SEQ ID NO: 105377 - DNA, 22 bp, Artificial Sequence
  chemically synthesized
aaatatagactttttcagttcc

SEQ ID NO: 105378 - DNA, 22 bp, Artificial Sequence
  chemically synthesized
aatatagactttttcagttcca

SEQ ID NO: 105379 - DNA, 22 bp, Artificial Sequence
  chemically synthesized
tttcagttccatatggtctatt

SEQ ID NO: 105380 - DNA, 22 bp, Artificial Sequence
  chemically synthesized
ttcagttccatatggtctattc

SEQ ID NO: 105381 - DNA, 22 bp, Artificial Sequence
  chemically synthesized
tcagttccatatggtctattca

SEQ ID NO: 105382 - DNA, 22 bp, Artificial Sequence
  chemically synthesized
cagttccatatggtctattcag

SEQ ID NO: 105383 - DNA, 22 bp, Artificial Sequence
  chemically synthesized
agttccatatggtctattcagt

SEQ ID NO: 105384 - DNA, 22 bp, Artificial Sequence
  chemically synthesized
catatggtctattcagtgttct

SEQ ID NO: 105385 - DNA, 22 bp, Artificial Sequence
  chemically synthesized
ttcagtgttctgtcaccagact

SEQ ID NO: 105386 - DNA, 22 bp, Artificial Sequence
  chemically synthesized
agtgttctgtcaccagacttct

SEQ ID NO: 105387 - DNA, 22 bp, Artificial Sequence
  chemically synthesized
tgtcaccagacttctcctaaga

SEQ ID NO: 105388 - DNA, 22 bp, Artificial Sequence
  chemically synthesized
tcaccagacttctcctaagata

SEQ ID NO: 105389 - DNA, 22 bp, Artificial Sequence
  chemically synthesized
ctcctaagatatgcccccaacc

SEQ ID NO: 105390 - DNA, 22 bp, Artificial Sequence
  chemically synthesized
tcctaagatatgcccccaaccc

SEQ ID NO: 105391 - DNA, 22 bp, Artificial Sequence
  chemically synthesized
ctaagatatgcccccaacccta

SEQ ID NO: 105392 - DNA, 22 bp, Artificial Sequence
  chemically synthesized
agatatgcccccaaccctatgg

SEQ ID NO: 105393 - DNA, 22 bp, Artificial Sequence
  chemically synthesized
tggtaaagtacttaagtccttg

SEQ ID NO: 105394 - DNA, 22 bp, Artificial Sequence
  chemically synthesized
aagtccttgtgagtgacaacat

SEQ ID NO: 105395 - DNA, 22 bp, Artificial Sequence
  chemically synthesized
agtccttgtgagtgacaacatt

SEQ ID NO: 105396 - DNA, 22 bp, Artificial Sequence
  chemically synthesized
gtgagtgacaacattgtcttcc

SEQ ID NO: 105397 - DNA, 22 bp, Artificial Sequence
  chemically synthesized
tgagtgacaacattgtcttcca

SEQ ID NO: 105398 - DNA, 22 bp, Artificial Sequence
  chemically synthesized
tcttccagtatacccttgctct

SEQ ID NO: 105399 - DNA, 22 bp, Artificial Sequence
  chemically synthesized
ccagtatacccttgctctttgc

SEQ ID NO: 105400 - DNA, 22 bp, Artificial Sequence
  chemically synthesized
cagtatacccttgctctttgct

SEQ ID NO: 105401 - DNA, 22 bp, Artificial Sequence
  chemically synthesized
gctctttgctaagaaagaactc

SEQ ID NO: 105402 - DNA, 22 bp, Artificial Sequence
  chemically synthesized
ctctttgctaagaaagaactcc

SEQ ID NO: 105403 - DNA, 22 bp, Artificial Sequence
  chemically synthesized
tttgctaagaaagaactccagg

SEQ ID NO: 105404 - DNA, 22 bp, Artificial Sequence
  chemically synthesized
tgctaagaaagaactccaggct

SEQ ID NO: 105405 - DNA, 22 bp, Artificial Sequence
  chemically synthesized
gctaagaaagaactccaggctt

SEQ ID NO: 105406 - DNA, 22 bp, Artificial Sequence
  chemically synthesized
ctaagaaagaactccaggcttt

SEQ ID NO: 105407 - DNA, 22 bp, Artificial Sequence
  chemically synthesized
agaaagaactccaggctttcat

SEQ ID NO: 105408 - DNA, 22 bp, Artificial Sequence
  chemically synthesized
caggctttcatttttcattctg

SEQ ID NO: 105409 - DNA, 22 bp, Artificial Sequence
  chemically synthesized
tcatttttcattctggcttcat

SEQ ID NO: 105410 - DNA, 22 bp, Artificial Sequence
  chemically synthesized
catttttcattctggcttcatt

SEQ ID NO: 105411 - DNA, 22 bp, Artificial Sequence
  chemically synthesized
atttttcattctggcttcattt

SEQ ID NO: 105412 - DNA, 22 bp, Artificial Sequence
  chemically synthesized
ttcattctggcttcatttttat

SEQ ID NO: 105413 - DNA, 22 bp, Artificial Sequence
  chemically synthesized
tcattctggcttcatttttatg

SEQ ID NO: 105414 - DNA, 22 bp, Artificial Sequence
  chemically synthesized
cattctggcttcatttttatgt

SEQ ID NO: 105415 - DNA, 22 bp, Artificial Sequence
  chemically synthesized
attctggcttcatttttatgtc

SEQ ID NO: 105416 - DNA, 22 bp, Artificial Sequence
  chemically synthesized
tggcttcatttttatgtctgtg

SEQ ID NO: 105417 - DNA, 22 bp, Artificial Sequence
  chemically synthesized
gcttcatttttatgtctgtgtc

SEQ ID NO: 105418 - DNA, 22 bp, Artificial Sequence
  chemically synthesized
catttttatgtctgtgtctgat

SEQ ID NO: 105419 - DNA, 22 bp, Artificial Sequence
  chemically synthesized
atttttatgtctgtgtctgatt

SEQ ID NO: 105420 - DNA, 22 bp, Artificial Sequence
  chemically synthesized
ttatgtctgtgtctgattctcc

SEQ ID NO: 105421 - DNA, 22 bp, Artificial Sequence
  chemically synthesized
tatgtctgtgtctgattctcca

SEQ ID NO: 105422 - DNA, 22 bp, Artificial Sequence
  chemically synthesized
atgtctgtgtctgattctccag

SEQ ID NO: 105423 - DNA, 22 bp, Artificial Sequence
  chemically synthesized
tgtctgtgtctgattctccaga

SEQ ID NO: 105424 - DNA, 22 bp, Artificial Sequence
  chemically synthesized
tgtctgattctccagatccgag

SEQ ID NO: 105425 - DNA, 22 bp, Artificial Sequence
  chemically synthesized
attctccagatccgagtttaac

SEQ ID NO: 105426 - DNA, 22 bp, Artificial Sequence
  chemically synthesized
tccagatccgagtttaactact

SEQ ID NO: 105427 - DNA, 22 bp, Artificial Sequence
  chemically synthesized
cagatccgagtttaactactaa

SEQ ID NO: 105428 - DNA, 22 bp, Artificial Sequence
  chemically synthesized
aactactaaacctatgtttaga

SEQ ID NO: 105429 - DNA, 22 bp, Artificial Sequence
  chemically synthesized
actactaaacctatgtttagat

SEQ ID NO: 105430 - DNA, 22 bp, Artificial Sequence
  chemically synthesized
ctaaacctatgtttagataaaa

SEQ ID NO: 105431 - DNA, 22 bp, Artificial Sequence
  chemically synthesized
aacctatgtttagataaaaggc

SEQ ID NO: 105432 - DNA, 22 bp, Artificial Sequence
  chemically synthesized
tgtttagataaaaggcggataa

SEQ ID NO: 105433 - DNA, 22 bp, Artificial Sequence
  chemically synthesized
agataaaaggcggataatgcca

SEQ ID NO: 105434 - DNA, 22 bp, Artificial Sequence
  chemically synthesized
gataaaaggcggataatgccat

SEQ ID NO: 105435 - DNA, 22 bp, Artificial Sequence
  chemically synthesized
tatttgcttggttttgatgctg

SEQ ID NO: 105436 - DNA, 22 bp, Artificial Sequence
  chemically synthesized
gcttggttttgatgctgtagat

SEQ ID NO: 105437 - DNA, 22 bp, Artificial Sequence
  chemically synthesized
cttggttttgatgctgtagatg

SEQ ID NO: 105438 - DNA, 22 bp, Artificial Sequence
  chemically synthesized
ggttttgatgctgtagatgaca

SEQ ID NO: 105439 - DNA, 22 bp, Artificial Sequence
  chemically synthesized
gttttgatgctgtagatgacag

SEQ ID NO: 105440 - DNA, 22 bp, Artificial Sequence
  chemically synthesized
tgatgctgtagatgacagggtt

SEQ ID NO: 105441 - DNA, 22 bp, Artificial Sequence
  chemically synthesized
gatgctgtagatgacagggttc

SEQ ID NO: 105442 - DNA, 22 bp, Artificial Sequence
  chemically synthesized
atgctgtagatgacagggttca

SEQ ID NO: 105443 - DNA, 22 bp, Artificial Sequence
  chemically synthesized
tagatgacagggttcattaaag

SEQ ID NO: 105444 - DNA, 22 bp, Artificial Sequence
  chemically synthesized
attaaaggaggaaagaggaagt

SEQ ID NO: 105445 - DNA, 22 bp, Artificial Sequence
  chemically synthesized
aaggaggaaagaggaagtagat

SEQ ID NO: 105446 - DNA, 22 bp, Artificial Sequence
  chemically synthesized
atgataatgtggacaacctctg

SEQ ID NO: 105447 - DNA, 22 bp, Artificial Sequence
  chemically synthesized
tggcacattcttcccaaatctg

SEQ ID NO: 105448 - DNA, 22 bp, Artificial Sequence
  chemically synthesized
gcacattcttcccaaatctgta

SEQ ID NO: 105449 - DNA, 22 bp, Artificial Sequence
  chemically synthesized
ttcccaaatctgtaaatgaatg

SEQ ID NO: 105450 - DNA, 22 bp, Artificial Sequence
  chemically synthesized
cccaaatctgtaaatgaatgtc

SEQ ID NO: 105451 - DNA, 22 bp, Artificial Sequence
  chemically synthesized
ccaaatctgtaaatgaatgtca

SEQ ID NO: 105452 - DNA, 22 bp, Artificial Sequence
  chemically synthesized
taaatgaatgtcaaacccatca

SEQ ID NO: 105453 - DNA, 22 bp, Artificial Sequence
  chemically synthesized
taacatagaagataagaacaca

SEQ ID NO: 105454 - DNA, 22 bp, Artificial Sequence
  chemically synthesized
atgtgggagatacaggtattga

SEQ ID NO: 105455 - DNA, 22 bp, Artificial Sequence
  chemically synthesized
agggctttggctctctcttcac

SEQ ID NO: 105456 - DNA, 22 bp, Artificial Sequence
  chemically synthesized
tggctctctcttcaccagaagc

SEQ ID NO: 105457 - DNA, 22 bp, Artificial Sequence
  chemically synthesized
ggctctctcttcaccagaagca

SEQ ID NO: 105458 - DNA, 22 bp, Artificial Sequence
  chemically synthesized
gctctctcttcaccagaagcaa

SEQ ID NO: 105459 - DNA, 22 bp, Artificial Sequence
  chemically synthesized
tctcttcaccagaagcaatgcc

SEQ ID NO: 105460 - DNA, 22 bp, Artificial Sequence
  chemically synthesized
tcttcaccagaagcaatgccta

SEQ ID NO: 105461 - DNA, 22 bp, Artificial Sequence
  chemically synthesized
ttcaccagaagcaatgcctatg

SEQ ID NO: 105462 - DNA, 22 bp, Artificial Sequence
  chemically synthesized
caccagaagcaatgcctatgac

SEQ ID NO: 105463 - DNA, 22 bp, Artificial Sequence
  chemically synthesized
accagaagcaatgcctatgaca

SEQ ID NO: 105464 - DNA, 22 bp, Artificial Sequence
  chemically synthesized
tgacagtattaagaattagaat

SEQ ID NO: 105465 - DNA, 22 bp, Artificial Sequence
  chemically synthesized
agaattagaatataggagaaga

SEQ ID NO: 105466 - DNA, 22 bp, Artificial Sequence
  chemically synthesized
gaatataggagaagaggatgat

SEQ ID NO: 105467 - DNA, 22 bp, Artificial Sequence
  chemically synthesized
ggaagattgttaaagagatcaa

SEQ ID NO: 105468 - DNA, 22 bp, Artificial Sequence
  chemically synthesized
ttaaagagatcaaaattacagg

SEQ ID NO: 105469 - DNA, 22 bp, Artificial Sequence
  chemically synthesized
aagagatcaaaattacagggta

SEQ ID NO: 105470 - DNA, 22 bp, Artificial Sequence
  chemically synthesized
cagggtaaagtctattgaaagt

SEQ ID NO: 105471 - DNA, 22 bp, Artificial Sequence
  chemically synthesized
ttgaaagttatgtcagcacaag

SEQ ID NO: 105472 - DNA, 22 bp, Artificial Sequence
  chemically synthesized
aaagttatgtcagcacaagcca

SEQ ID NO: 105473 - DNA, 22 bp, Artificial Sequence
  chemically synthesized
tgtcagcacaagccagtctcat

SEQ ID NO: 105474 - DNA, 22 bp, Artificial Sequence
  chemically synthesized
atgatttcttggtggaggcaga

SEQ ID NO: 105475 - DNA, 22 bp, Artificial Sequence
  chemically synthesized
cttggtggaggcagaaagcacg

SEQ ID NO: 105476 - DNA, 22 bp, Artificial Sequence
  chemically synthesized
ttggtggaggcagaaagcacgt

SEQ ID NO: 105477 - DNA, 22 bp, Artificial Sequence
  chemically synthesized
ggtggaggcagaaagcacgtgt

SEQ ID NO: 105478 - DNA, 22 bp, Artificial Sequence
  chemically synthesized
gtggaggcagaaagcacgtgtg

SEQ ID NO: 105479 - DNA, 22 bp, Artificial Sequence
  chemically synthesized
gcaatatgaaaatgaaaaaaga

SEQ ID NO: 105480 - DNA, 22 bp, Artificial Sequence
  chemically synthesized
caatatgaaaatgaaaaaagac

SEQ ID NO: 105481 - DNA, 22 bp, Artificial Sequence
  chemically synthesized
caggcaggatggatacaaaacc

SEQ ID NO: 105482 - DNA, 22 bp, Artificial Sequence
  chemically synthesized
agaaacactcccactcctaacg

SEQ ID NO: 105483 - DNA, 22 bp, Artificial Sequence
  chemically synthesized
gaaacactcccactcctaacgc

SEQ ID NO: 105484 - DNA, 22 bp, Artificial Sequence
  chemically synthesized
ccactcctaacgctatgactct

SEQ ID NO: 105485 - DNA, 22 bp, Artificial Sequence
  chemically synthesized
ctaacgctatgactctagtatt

SEQ ID NO: 105486 - DNA, 22 bp, Artificial Sequence
  chemically synthesized
acgctatgactctagtattggt

SEQ ID NO: 105487 - DNA, 22 bp, Artificial Sequence
  chemically synthesized
tgactctagtattggtgagaat

SEQ ID NO: 105488 - DNA, 22 bp, Artificial Sequence
  chemically synthesized
tagtattggtgagaatggaagc

SEQ ID NO: 105489 - DNA, 22 bp, Artificial Sequence
  chemically synthesized
gtattggtgagaatggaagcat

SEQ ID NO: 105490 - DNA, 22 bp, Artificial Sequence
  chemically synthesized
gtgagaatggaagcatatctca

SEQ ID NO: 105491 - DNA, 22 bp, Artificial Sequence
  chemically synthesized
aaaggattgcggatggcaatga

SEQ ID NO: 105492 - DNA, 22 bp, Artificial Sequence
  chemically synthesized
cggatggcaatgaaacaatcat

SEQ ID NO: 105493 - DNA, 22 bp, Artificial Sequence
  chemically synthesized
ccaggagggaacctgattccac

SEQ ID NO: 105494 - DNA, 22 bp, Artificial Sequence
  chemically synthesized
attccacaacagaaagggagtg

SEQ ID NO: 105495 - DNA, 22 bp, Artificial Sequence
  chemically synthesized
cacaacagaaagggagtgaata

SEQ ID NO: 105496 - DNA, 22 bp, Artificial Sequence
  chemically synthesized
taggaagcagcccacactgcta

SEQ ID NO: 105497 - DNA, 22 bp, Artificial Sequence
  chemically synthesized
ctaatctccctgtgattcaccc

SEQ ID NO: 105498 - DNA, 22 bp, Artificial Sequence
  chemically synthesized
atctccctgtgattcacccata

SEQ ID NO: 105499 - DNA, 22 bp, Artificial Sequence
  chemically synthesized
cctgtgattcacccataggatg

SEQ ID NO: 105500 - DNA, 22 bp, Artificial Sequence
  chemically synthesized
tgattcacccataggatgccca

SEQ ID NO: 105501 - DNA, 22 bp, Artificial Sequence
  chemically synthesized
acccataggatgcccattacag

SEQ ID NO: 105502 - DNA, 22 bp, Artificial Sequence
  chemically synthesized
cagtaggcatcgtggtcaatgt

SEQ ID NO: 105503 - DNA, 22 bp, Artificial Sequence
  chemically synthesized
tgcctgccagcatggtgaggaa

SEQ ID NO: 105504 - DNA, 22 bp, Artificial Sequence
  chemically synthesized
ccagcatggtgaggaagtagta

SEQ ID NO: 105505 - DNA, 22 bp, Artificial Sequence
  chemically synthesized
atgaagactgtggtcatgcttg

SEQ ID NO: 105506 - DNA, 22 bp, Artificial Sequence
  chemically synthesized
tggtcatgcttgatgaggtaga

SEQ ID NO: 105507 - DNA, 22 bp, Artificial Sequence
  chemically synthesized
gatgaggtagaggagcatgcca

SEQ ID NO: 105508 - DNA, 22 bp, Artificial Sequence
  chemically synthesized
atgaggtagaggagcatgccat

SEQ ID NO: 105509 - DNA, 22 bp, Artificial Sequence
  chemically synthesized
cccagaaggatgcacacataaa

SEQ ID NO: 105510 - DNA, 22 bp, Artificial Sequence
  chemically synthesized
cctccagccctggaaagccagt

SEQ ID NO: 105511 - DNA, 22 bp, Artificial Sequence
  chemically synthesized
cagccctggaaagccagtcagc

SEQ ID NO: 105512 - DNA, 22 bp, Artificial Sequence
  chemically synthesized
gaaagccagtcagcaaaaaagg

SEQ ID NO: 105513 - DNA, 22 bp, Artificial Sequence
  chemically synthesized
cagtaatattgggccacatagt

SEQ ID NO: 105514 - DNA, 22 bp, Artificial Sequence
  chemically synthesized
ggccacatagtgtatccaccgg

SEQ ID NO: 105515 - DNA, 22 bp, Artificial Sequence
  chemically synthesized
cttgaaaccttgaaaccaggag

SEQ ID NO: 105516 - DNA, 22 bp, Artificial Sequence
  chemically synthesized
ttgaaaccttgaaaccaggagc

SEQ ID NO: 105517 - DNA, 22 bp, Artificial Sequence
  chemically synthesized
gaaaccttgaaaccaggagcct

SEQ ID NO: 105518 - DNA, 22 bp, Artificial Sequence
  chemically synthesized
aaaccttgaaaccaggagcctc

SEQ ID NO: 105519 - DNA, 22 bp, Artificial Sequence
  chemically synthesized
gaaaccaggagcctccaatctt

SEQ ID NO: 105520 - DNA, 22 bp, Artificial Sequence
  chemically synthesized
aaaccaggagcctccaatcttc

SEQ ID NO: 105521 - DNA, 22 bp, Artificial Sequence
  chemically synthesized
caatcttcctgcttggagatga

SEQ ID NO: 105522 - DNA, 22 bp, Artificial Sequence
  chemically synthesized
cctgcttggagatgattaactg

SEQ ID NO: 105523 - DNA, 22 bp, Artificial Sequence
  chemically synthesized
ctgcttggagatgattaactgg

SEQ ID NO: 105524 - DNA, 22 bp, Artificial Sequence
  chemically synthesized
cttggagatgattaactggtgt

SEQ ID NO: 105525 - DNA, 22 bp, Artificial Sequence
  chemically synthesized
ggagatgattaactggtgtgat

SEQ ID NO: 105526 - DNA, 22 bp, Artificial Sequence
  chemically synthesized
gagatgattaactggtgtgata

SEQ ID NO: 105527 - DNA, 22 bp, Artificial Sequence
  chemically synthesized
actggtgtgataaatttgactc

SEQ ID NO: 105528 - DNA, 22 bp, Artificial Sequence
  chemically synthesized
gtgtgataaatttgactctgca

SEQ ID NO: 105529 - DNA, 22 bp, Artificial Sequence
  chemically synthesized
gactctgcaactattttcctga

SEQ ID NO: 105530 - DNA, 22 bp, Artificial Sequence
  chemically synthesized
actctgcaactattttcctgaa

SEQ ID NO: 105531 - DNA, 22 bp, Artificial Sequence
  chemically synthesized
tgcaactattttcctgaagaag

SEQ ID NO: 105532 - DNA, 22 bp, Artificial Sequence
  chemically synthesized
caactattttcctgaagaagaa

SEQ ID NO: 105533 - DNA, 22 bp, Artificial Sequence
  chemically synthesized
ttttcctgaagaagaatagcat

SEQ ID NO: 105534 - DNA, 22 bp, Artificial Sequence
  chemically synthesized
tcctgaagaagaatagcatgta

SEQ ID NO: 105535 - DNA, 22 bp, Artificial Sequence
  chemically synthesized
cctgaagaagaatagcatgtac

SEQ ID NO: 105536 - DNA, 22 bp, Artificial Sequence
  chemically synthesized
ctgaagaagaatagcatgtaca

SEQ ID NO: 105537 - DNA, 22 bp, Artificial Sequence
  chemically synthesized
aagaagaatagcatgtacagac

SEQ ID NO: 105538 - DNA, 22 bp, Artificial Sequence
  chemically synthesized
tggttttttccctaattagaaa

SEQ ID NO: 105539 - DNA, 22 bp, Artificial Sequence
  chemically synthesized
tttccctaattagaaaaaatac

SEQ ID NO: 105540 - DNA, 22 bp, Artificial Sequence
  chemically synthesized
ttccctaattagaaaaaatact

SEQ ID NO: 105541 - DNA, 22 bp, Artificial Sequence
  chemically synthesized
tccctaattagaaaaaatactg

SEQ ID NO: 105542 - DNA, 22 bp, Artificial Sequence
  chemically synthesized
ccctaattagaaaaaatactga

SEQ ID NO: 105543 - DNA, 22 bp, Artificial Sequence
  chemically synthesized
cctaattagaaaaaatactgag

SEQ ID NO: 105544 - DNA, 22 bp, Artificial Sequence
  chemically synthesized
attagaaaaaatactgagttaa

SEQ ID NO: 105545 - DNA, 22 bp, Artificial Sequence
  chemically synthesized
gaaaaaatactgagttaatggt

SEQ ID NO: 105546 - DNA, 22 bp, Artificial Sequence
  chemically synthesized
agttaatggttcgatttttctc

SEQ ID NO: 105547 - DNA, 22 bp, Artificial Sequence
  chemically synthesized
atggttcgatttttctcaaatt

SEQ ID NO: 105548 - DNA, 22 bp, Artificial Sequence
  chemically synthesized
gatttttctcaaattcaaaaat

SEQ ID NO: 105549 - DNA, 22 bp, Artificial Sequence
  chemically synthesized
ttctcaaattcaaaaatttttc

SEQ ID NO: 105550 - DNA, 22 bp, Artificial Sequence
  chemically synthesized
tctcaaattcaaaaatttttca

SEQ ID NO: 105551 - DNA, 22 bp, Artificial Sequence
  chemically synthesized
ctcaaattcaaaaatttttcat

SEQ ID NO: 105552 - DNA, 22 bp, Artificial Sequence
  chemically synthesized
tcaaattcaaaaatttttcatt

SEQ ID NO: 105553 - DNA, 22 bp, Artificial Sequence
  chemically synthesized
aaattcaaaaatttttcattaa

SEQ ID NO: 105554 - DNA, 22 bp, Artificial Sequence
  chemically synthesized
aaaaatttttcattaattttaa

SEQ ID NO: 105555 - DNA, 22 bp, Artificial Sequence
  chemically synthesized
ttcattaattttaaatatatta

SEQ ID NO: 105556 - DNA, 22 bp, Artificial Sequence
  chemically synthesized
tcattaattttaaatatattat

SEQ ID NO: 105557 - DNA, 22 bp, Artificial Sequence
  chemically synthesized
cattaattttaaatatattatc

SEQ ID NO: 105558 - DNA, 22 bp, Artificial Sequence
  chemically synthesized
attaattttaaatatattatcc

SEQ ID NO: 105559 - DNA, 22 bp, Artificial Sequence
  chemically synthesized
attttaaatatattatccgcaa

SEQ ID NO: 105560 - DNA, 22 bp, Artificial Sequence
  chemically synthesized
taaatatattatccgcaactat

SEQ ID NO: 105561 - DNA, 22 bp, Artificial Sequence
  chemically synthesized
aaatatattatccgcaactatt

SEQ ID NO: 105562 - DNA, 22 bp, Artificial Sequence
  chemically synthesized
aatatattatccgcaactattt

SEQ ID NO: 105563 - DNA, 22 bp, Artificial Sequence
  chemically synthesized
tccgcaactattttgagggtac

SEQ ID NO: 105564 - DNA, 22 bp, Artificial Sequence
  chemically synthesized
ttttgagggtacttataaatat

SEQ ID NO: 105565 - DNA, 22 bp, Artificial Sequence
  chemically synthesized
tgagggtacttataaatatttg

SEQ ID NO: 105566 - DNA, 22 bp, Artificial Sequence
  chemically synthesized
gagggtacttataaatatttgc

SEQ ID NO: 105567 - DNA, 22 bp, Artificial Sequence
  chemically synthesized
agggtacttataaatatttgca

SEQ ID NO: 105568 - DNA, 22 bp, Artificial Sequence
  chemically synthesized
ataaatatttgcaacaacagtg

SEQ ID NO: 105569 - DNA, 22 bp, Artificial Sequence
  chemically synthesized
taaatatttgcaacaacagtga

SEQ ID NO: 105570 - DNA, 22 bp, Artificial Sequence
  chemically synthesized
gcaacaacagtgataacaaaaa

SEQ ID NO: 105571 - DNA, 22 bp, Artificial Sequence
  chemically synthesized
caacaacagtgataacaaaaac

SEQ ID NO: 105572 - DNA, 22 bp, Artificial Sequence
  chemically synthesized
gcttagttgtcttcttgctgtg

SEQ ID NO: 105573 - DNA, 22 bp, Artificial Sequence
  chemically synthesized
agttgtcttcttgctgtgatta

SEQ ID NO: 105574 - DNA, 22 bp, Artificial Sequence
  chemically synthesized
gttgtcttcttgctgtgattac

SEQ ID NO: 105575 - DNA, 22 bp, Artificial Sequence
  chemically synthesized
tcttcttgctgtgattactgac

SEQ ID NO: 105576 - DNA, 22 bp, Artificial Sequence
  chemically synthesized
cttgctgtgattactgaccatt

SEQ ID NO: 105577 - DNA, 22 bp, Artificial Sequence
  chemically synthesized
ttgctgtgattactgaccattt

SEQ ID NO: 105578 - DNA, 22 bp, Artificial Sequence
  chemically synthesized
gctgtgattactgaccatttgg

SEQ ID NO: 105579 - DNA, 22 bp, Artificial Sequence
  chemically synthesized
ctgtgattactgaccatttgga

SEQ ID NO: 105580 - DNA, 22 bp, Artificial Sequence
  chemically synthesized
tgattactgaccatttggaaat

SEQ ID NO: 105581 - DNA, 22 bp, Artificial Sequence
  chemically synthesized
ctgaccatttggaaatgattgt

SEQ ID NO: 105582 - DNA, 22 bp, Artificial Sequence
  chemically synthesized
accatttggaaatgattgttgt

SEQ ID NO: 105583 - DNA, 22 bp, Artificial Sequence
  chemically synthesized
ggaaatgattgttgtaatttta

SEQ ID NO: 105584 - DNA, 22 bp, Artificial Sequence
  chemically synthesized
gaaatgattgttgtaattttac

SEQ ID NO: 105585 - DNA, 22 bp, Artificial Sequence
  chemically synthesized
ttgtaattttacatttcacgat

SEQ ID NO: 105586 - DNA, 22 bp, Artificial Sequence
  chemically synthesized
taattttacatttcacgattat

SEQ ID NO: 105587 - DNA, 22 bp, Artificial Sequence
  chemically synthesized
tacatttcacgattatgatgaa

SEQ ID NO: 105588 - DNA, 22 bp, Artificial Sequence
  chemically synthesized
acatttcacgattatgatgaag

SEQ ID NO: 105589 - DNA, 22 bp, Artificial Sequence
  chemically synthesized
catttcacgattatgatgaaga

SEQ ID NO: 105590 - DNA, 22 bp, Artificial Sequence
  chemically synthesized
cacgattatgatgaagacagtt

SEQ ID NO: 105591 - DNA, 22 bp, Artificial Sequence
  chemically synthesized
acgattatgatgaagacagttt

SEQ ID NO: 105592 - DNA, 22 bp, Artificial Sequence
  chemically synthesized
tgatgaagacagttttttcagt

SEQ ID NO: 105593 - DNA, 22 bp, Artificial Sequence
  chemically synthesized
tttcagttaatgcagtttttct

SEQ ID NO: 105594 - DNA, 22 bp, Artificial Sequence
  chemically synthesized
ttcagttaatgcagtttttctc

SEQ ID NO: 105595 - DNA, 22 bp, Artificial Sequence
  chemically synthesized
tcagttaatgcagtttttctca

SEQ ID NO: 105596 - DNA, 22 bp, Artificial Sequence
  chemically synthesized
cagttaatgcagtttttctcat

SEQ ID NO: 105597 - DNA, 22 bp, Artificial Sequence
  chemically synthesized
agttaatgcagtttttctcatt

SEQ ID NO: 105598 - DNA, 22 bp, Artificial Sequence
  chemically synthesized
atgcagtttttctcattttttt

SEQ ID NO: 105599 - DNA, 22 bp, Artificial Sequence
  chemically synthesized
ttctcattttttttggaaattg

SEQ ID NO: 105600 - DNA, 22 bp, Artificial Sequence
  chemically synthesized
tctcattttttttggaaattga

SEQ ID NO: 105601 - DNA, 22 bp, Artificial Sequence
  chemically synthesized
ctcattttttttggaaattgaa

SEQ ID NO: 105602 - DNA, 22 bp, Artificial Sequence
  chemically synthesized
tcattttttttggaaattgaat

SEQ ID NO: 105603 - DNA, 22 bp, Artificial Sequence
  chemically synthesized
attttttttggaaattgaatgt

SEQ ID NO: 105604 - DNA, 22 bp, Artificial Sequence
  chemically synthesized
tttttggaaattgaatgtcagt

SEQ ID NO: 105605 - DNA, 22 bp, Artificial Sequence
  chemically synthesized
ttttggaaattgaatgtcagtg

SEQ ID NO: 105606 - DNA, 22 bp, Artificial Sequence
  chemically synthesized
tttggaaattgaatgtcagtgt

SEQ ID NO: 105607 - DNA, 22 bp, Artificial Sequence
  chemically synthesized
ttggaaattgaatgtcagtgtt

SEQ ID NO: 105608 - DNA, 22 bp, Artificial Sequence
  chemically synthesized
tggaaattgaatgtcagtgttt

SEQ ID NO: 105609 - DNA, 22 bp, Artificial Sequence
  chemically synthesized
ggaaattgaatgtcagtgtttt

SEQ ID NO: 105610 - DNA, 22 bp, Artificial Sequence
  chemically synthesized
gaaattgaatgtcagtgtttta

SEQ ID NO: 105611 - DNA, 22 bp, Artificial Sequence
  chemically synthesized
aatgtcagtgttttatgcacta

SEQ ID NO: 105612 - DNA, 22 bp, Artificial Sequence
  chemically synthesized
tatgcactatagcgtgcatcac

SEQ ID NO: 105613 - DNA, 22 bp, Artificial Sequence
  chemically synthesized
atgcactatagcgtgcatcacc

SEQ ID NO: 105614 - DNA, 22 bp, Artificial Sequence
  chemically synthesized
tgcactatagcgtgcatcacca

SEQ ID NO: 105615 - DNA, 22 bp, Artificial Sequence
  chemically synthesized
tagcgtgcatcaccatcactac

SEQ ID NO: 105616 - DNA, 22 bp, Artificial Sequence
  chemically synthesized
ccaatgaacggctttgtcactc

SEQ ID NO: 105617 - DNA, 22 bp, Artificial Sequence
  chemically synthesized
tgtcactctaacagttacttga

SEQ ID NO: 105618 - DNA, 22 bp, Artificial Sequence
  chemically synthesized
gtcactctaacagttacttgag

SEQ ID NO: 105619 - DNA, 22 bp, Artificial Sequence
  chemically synthesized
tcactctaacagttacttgagc

SEQ ID NO: 105620 - DNA, 22 bp, Artificial Sequence
  chemically synthesized
taacagttacttgagcttggcc

SEQ ID NO: 105621 - DNA, 22 bp, Artificial Sequence
  chemically synthesized
acagttacttgagcttggccac

SEQ ID NO: 105622 - DNA, 22 bp, Artificial Sequence
  chemically synthesized
cttgagcttggccaccagagtt

SEQ ID NO: 105623 - DNA, 22 bp, Artificial Sequence
  chemically synthesized
gagcttggccaccagagttgtg

SEQ ID NO: 105624 - DNA, 22 bp, Artificial Sequence
  chemically synthesized
agcttggccaccagagttgtgg

SEQ ID NO: 105625 - DNA, 22 bp, Artificial Sequence
  chemically synthesized
ggccaccagagttgtggatcac

SEQ ID NO: 105626 - DNA, 22 bp, Artificial Sequence
  chemically synthesized
gccaccagagttgtggatcaca

SEQ ID NO: 105627 - DNA, 22 bp, Artificial Sequence
  chemically synthesized
tggatcacagactagacgcagc

SEQ ID NO: 105628 - DNA, 22 bp, Artificial Sequence
  chemically synthesized
gacgcagctaacaagcagcggg

SEQ ID NO: 105629 - DNA, 22 bp, Artificial Sequence
  chemically synthesized
acaagcagcgggcttgttaggc

SEQ ID NO: 105630 - DNA, 22 bp, Artificial Sequence
  chemically synthesized
gttaggcatgcagcctcagatt

SEQ ID NO: 105631 - DNA, 22 bp, Artificial Sequence
  chemically synthesized
ttaggcatgcagcctcagattc

SEQ ID NO: 105632 - DNA, 22 bp, Artificial Sequence
  chemically synthesized
ggcatgcagcctcagattctgc

SEQ ID NO: 105633 - DNA, 22 bp, Artificial Sequence
  chemically synthesized
agattctgccccttccaacatt

SEQ ID NO: 105634 - DNA, 22 bp, Artificial Sequence
  chemically synthesized
tgccccttccaacattctgaat

SEQ ID NO: 105635 - DNA, 22 bp, Artificial Sequence
  chemically synthesized
ccccttccaacattctgaatca

SEQ ID NO: 105636 - DNA, 22 bp, Artificial Sequence
  chemically synthesized
ccaacattctgaatcaaattcg

SEQ ID NO: 105637 - DNA, 22 bp, Artificial Sequence
  chemically synthesized
caacattctgaatcaaattcgc

SEQ ID NO: 105638 - DNA, 22 bp, Artificial Sequence
  chemically synthesized
tgaatcaaattcgcttttttca

SEQ ID NO: 105639 - DNA, 22 bp, Artificial Sequence
  chemically synthesized
aatcaaattcgcttttttcagg

SEQ ID NO: 105640 - DNA, 22 bp, Artificial Sequence
  chemically synthesized
gcttttttcaggtcctcaggtg

SEQ ID NO: 105641 - DNA, 22 bp, Artificial Sequence
  chemically synthesized
ttttcaggtcctcaggtgattc

SEQ ID NO: 105642 - DNA, 22 bp, Artificial Sequence
  chemically synthesized
tttcaggtcctcaggtgattcc

SEQ ID NO: 105643 - DNA, 22 bp, Artificial Sequence
  chemically synthesized
ttcaggtcctcaggtgattcca

SEQ ID NO: 105644 - DNA, 22 bp, Artificial Sequence
  chemically synthesized
tcaggtcctcaggtgattccag

SEQ ID NO: 105645 - DNA, 22 bp, Artificial Sequence
  chemically synthesized
caggtcctcaggtgattccagt

SEQ ID NO: 105646 - DNA, 22 bp, Artificial Sequence
  chemically synthesized
aggtcctcaggtgattccagtg

SEQ ID NO: 105647 - DNA, 22 bp, Artificial Sequence
  chemically synthesized
aggtgattccagtgcaaaacaa

SEQ ID NO: 105648 - DNA, 22 bp, Artificial Sequence
  chemically synthesized
cagtgcaaaacaatgtctgggc

SEQ ID NO: 105649 - DNA, 22 bp, Artificial Sequence
  chemically synthesized
ggcatcactgctataagcattt

SEQ ID NO: 105650 - DNA, 22 bp, Artificial Sequence
  chemically synthesized
ctataagcatttcatacctaat

SEQ ID NO: 105651 - DNA, 22 bp, Artificial Sequence
  chemically synthesized
taagcatttcatacctaatcca

SEQ ID NO: 105652 - DNA, 22 bp, Artificial Sequence
  chemically synthesized
catacctaatccatctttcgag

SEQ ID NO: 105653 - DNA, 22 bp, Artificial Sequence
  chemically synthesized
atacctaatccatctttcgaga

SEQ ID NO: 105654 - DNA, 22 bp, Artificial Sequence
  chemically synthesized
atccatctttcgagatagaaac

SEQ ID NO: 105655 - DNA, 22 bp, Artificial Sequence
  chemically synthesized
tcgagatagaaaccttttaatg

SEQ ID NO: 105656 - DNA, 22 bp, Artificial Sequence
  chemically synthesized
cgagatagaaaccttttaatgc

SEQ ID NO: 105657 - DNA, 22 bp, Artificial Sequence
  chemically synthesized
gagatagaaaccttttaatgct

SEQ ID NO: 105658 - DNA, 22 bp, Artificial Sequence
  chemically synthesized
ttaatgcttccatccagttgat

SEQ ID NO: 105659 - DNA, 22 bp, Artificial Sequence
  chemically synthesized
taatgcttccatccagttgatt

SEQ ID NO: 105660 - DNA, 22 bp, Artificial Sequence
  chemically synthesized
aatgcttccatccagttgattt

SEQ ID NO: 105661 - DNA, 22 bp, Artificial Sequence
  chemically synthesized
atgcttccatccagttgatttt

SEQ ID NO: 105662 - DNA, 22 bp, Artificial Sequence
  chemically synthesized
ccatccagttgattttctcatt

SEQ ID NO: 105663 - DNA, 22 bp, Artificial Sequence
  chemically synthesized
catccagttgattttctcattt

SEQ ID NO: 105664 - DNA, 22 bp, Artificial Sequence
  chemically synthesized
attttctcattttctccaaata

SEQ ID NO: 105665 - DNA, 22 bp, Artificial Sequence
  chemically synthesized
tctcattttctccaaatatctt

SEQ ID NO: 105666 - DNA, 22 bp, Artificial Sequence
  chemically synthesized
ctcattttctccaaatatcttc

SEQ ID NO: 105667 - DNA, 22 bp, Artificial Sequence
  chemically synthesized
tcattttctccaaatatcttca

SEQ ID NO: 105668 - DNA, 22 bp, Artificial Sequence
  chemically synthesized
attttctccaaatatcttcata

SEQ ID NO: 105669 - DNA, 22 bp, Artificial Sequence
  chemically synthesized
tctccaaatatcttcatacaat

SEQ ID NO: 105670 - DNA, 22 bp, Artificial Sequence
  chemically synthesized
ctccaaatatcttcatacaatt

SEQ ID NO: 105671 - DNA, 22 bp, Artificial Sequence
  chemically synthesized
tccaaatatcttcatacaatta

SEQ ID NO: 105672 - DNA, 22 bp, Artificial Sequence
  chemically synthesized
caaatatcttcatacaattatc

SEQ ID NO: 105673 - DNA, 22 bp, Artificial Sequence
  chemically synthesized
catacaattatcttttttatgt

SEQ ID NO: 105674 - DNA, 22 bp, Artificial Sequence
  chemically synthesized
atacaattatcttttttatgtt

SEQ ID NO: 105675 - DNA, 22 bp, Artificial Sequence
  chemically synthesized
tcttttttatgtttctttcacc

SEQ ID NO: 105676 - DNA, 22 bp, Artificial Sequence
  chemically synthesized
ttttatgtttctttcaccattt

SEQ ID NO: 105677 - DNA, 22 bp, Artificial Sequence
  chemically synthesized
tttatgtttctttcaccattta

SEQ ID NO: 105678 - DNA, 22 bp, Artificial Sequence
  chemically synthesized
ttatgtttctttcaccatttac

SEQ ID NO: 105679 - DNA, 22 bp, Artificial Sequence
  chemically synthesized
tatgtttctttcaccatttact

SEQ ID NO: 105680 - DNA, 22 bp, Artificial Sequence
  chemically synthesized
atgtttctttcaccatttactg

SEQ ID NO: 105681 - DNA, 22 bp, Artificial Sequence
  chemically synthesized
tgtttctttcaccatttactgg

SEQ ID NO: 105682 - DNA, 22 bp, Artificial Sequence
  chemically synthesized
ctttcaccatttactggctttc

SEQ ID NO: 105683 - DNA, 22 bp, Artificial Sequence
  chemically synthesized
tttcaccatttactggctttct

SEQ ID NO: 105684 - DNA, 22 bp, Artificial Sequence
  chemically synthesized
tcaccatttactggctttcttt

SEQ ID NO: 105685 - DNA, 22 bp, Artificial Sequence
  chemically synthesized
caccatttactggctttctttc

SEQ ID NO: 105686 - DNA, 22 bp, Artificial Sequence
  chemically synthesized
accatttactggctttctttct

SEQ ID NO: 105687 - DNA, 22 bp, Artificial Sequence
  chemically synthesized
actggctttctttctgccactt

SEQ ID NO: 105688 - DNA, 22 bp, Artificial Sequence
  chemically synthesized
ctggctttctttctgccacttg

SEQ ID NO: 105689 - DNA, 22 bp, Artificial Sequence
  chemically synthesized
gctttctttctgccacttgccc

SEQ ID NO: 105690 - DNA, 22 bp, Artificial Sequence
  chemically synthesized
tctttctgccacttgccctttc

SEQ ID NO: 105691 - DNA, 22 bp, Artificial Sequence
  chemically synthesized
ctttctgccacttgccctttcc

SEQ ID NO: 105692 - DNA, 22 bp, Artificial Sequence
  chemically synthesized
tttctgccacttgccctttcca

SEQ ID NO: 105693 - DNA, 22 bp, Artificial Sequence
  chemically synthesized
tctgccacttgccctttccaac

SEQ ID NO: 105694 - DNA, 22 bp, Artificial Sequence
  chemically synthesized
ctgccacttgccctttccaaca

SEQ ID NO: 105695 - DNA, 22 bp, Artificial Sequence
  chemically synthesized
tgccacttgccctttccaacat

SEQ ID NO: 105696 - DNA, 22 bp, Artificial Sequence
  chemically synthesized
ccacttgccctttccaacatta

SEQ ID NO: 105697 - DNA, 22 bp, Artificial Sequence
  chemically synthesized
gccctttccaacattatttccc

SEQ ID NO: 105698 - DNA, 22 bp, Artificial Sequence
  chemically synthesized
ccctttccaacattatttccca

SEQ ID NO: 105699 - DNA, 22 bp, Artificial Sequence
  chemically synthesized
tccaacattatttcccataatt

SEQ ID NO: 105700 - DNA, 22 bp, Artificial Sequence
  chemically synthesized
ccaacattatttcccataatta

SEQ ID NO: 105701 - DNA, 22 bp, Artificial Sequence
  chemically synthesized
caacattatttcccataattaa

SEQ ID NO: 105702 - DNA, 22 bp, Artificial Sequence
  chemically synthesized
tttcccataattaaatacttag

SEQ ID NO: 105703 - DNA, 22 bp, Artificial Sequence
  chemically synthesized
cccataattaaatacttagctg

SEQ ID NO: 105704 - DNA, 22 bp, Artificial Sequence
  chemically synthesized
ccataattaaatacttagctgg

SEQ ID NO: 105705 - DNA, 22 bp, Artificial Sequence
  chemically synthesized
aatacttagctggttttctgtc

SEQ ID NO: 105706 - DNA, 22 bp, Artificial Sequence
  chemically synthesized
agctggttttctgtccttctta

SEQ ID NO: 105707 - DNA, 22 bp, Artificial Sequence
  chemically synthesized
gctggttttctgtccttcttac

SEQ ID NO: 105708 - DNA, 22 bp, Artificial Sequence
  chemically synthesized
gttttctgtccttcttacctct

SEQ ID NO: 105709 - DNA, 22 bp, Artificial Sequence
  chemically synthesized
tctgtccttcttacctctctct

SEQ ID NO: 105710 - DNA, 22 bp, Artificial Sequence
  chemically synthesized
ctgtccttcttacctctctctg

SEQ ID NO: 105711 - DNA, 22 bp, Artificial Sequence
  chemically synthesized
tgtccttcttacctctctctgc

SEQ ID NO: 105712 - DNA, 22 bp, Artificial Sequence
  chemically synthesized
tccttcttacctctctctgctt

SEQ ID NO: 105713 - DNA, 22 bp, Artificial Sequence
  chemically synthesized
cttacctctctctgcttttcca

SEQ ID NO: 105714 - DNA, 22 bp, Artificial Sequence
  chemically synthesized
ttacctctctctgcttttccat

SEQ ID NO: 105715 - DNA, 22 bp, Artificial Sequence
  chemically synthesized
acctctctctgcttttccatca

SEQ ID NO: 105716 - DNA, 22 bp, Artificial Sequence
  chemically synthesized
cctctctctgcttttccatcaa

SEQ ID NO: 105717 - DNA, 22 bp, Artificial Sequence
  chemically synthesized
tctctgcttttccatcaactcc

SEQ ID NO: 105718 - DNA, 22 bp, Artificial Sequence
  chemically synthesized
tctgcttttccatcaactccaa

SEQ ID NO: 105719 - DNA, 22 bp, Artificial Sequence
  chemically synthesized
tgcttttccatcaactccaaac

SEQ ID NO: 105720 - DNA, 22 bp, Artificial Sequence
  chemically synthesized
cttttccatcaactccaaactc

SEQ ID NO: 105721 - DNA, 22 bp, Artificial Sequence
  chemically synthesized
ttccatcaactccaaactcctg

SEQ ID NO: 105722 - DNA, 22 bp, Artificial Sequence
  chemically synthesized
tccatcaactccaaactcctga

SEQ ID NO: 105723 - DNA, 22 bp, Artificial Sequence
  chemically synthesized
ccatcaactccaaactcctgag

SEQ ID NO: 105724 - DNA, 22 bp, Artificial Sequence
  chemically synthesized
catcaactccaaactcctgagg

SEQ ID NO: 105725 - DNA, 22 bp, Artificial Sequence
  chemically synthesized
caaactcctgaggaactgttgc

SEQ ID NO: 105726 - DNA, 22 bp, Artificial Sequence
  chemically synthesized
ctgaggaactgttgcagttctg

SEQ ID NO: 105727 - DNA, 22 bp, Artificial Sequence
  chemically synthesized
aggaactgttgcagttctgtaa

SEQ ID NO: 105728 - DNA, 22 bp, Artificial Sequence
  chemically synthesized
ttgcagttctgtaacaggtaaa

SEQ ID NO: 105729 - DNA, 22 bp, Artificial Sequence
  chemically synthesized
cagttctgtaacaggtaaaatt

SEQ ID NO: 105730 - DNA, 22 bp, Artificial Sequence
  chemically synthesized
tgtaacaggtaaaattataatg

SEQ ID NO: 105731 - DNA, 22 bp, Artificial Sequence
  chemically synthesized
taacaggtaaaattataatgtt

SEQ ID NO: 105732 - DNA, 22 bp, Artificial Sequence
  chemically synthesized
taatgtttccacagcctaagga

SEQ ID NO: 105733 - DNA, 22 bp, Artificial Sequence
  chemically synthesized
ccacagcctaaggatgccagcc

SEQ ID NO: 105734 - DNA, 22 bp, Artificial Sequence
  chemically synthesized
cacagcctaaggatgccagcca

SEQ ID NO: 105735 - DNA, 22 bp, Artificial Sequence
  chemically synthesized
aggatgccagccatcactactg

SEQ ID NO: 105736 - DNA, 22 bp, Artificial Sequence
  chemically synthesized
ctgtttctgttttcttggttgc

SEQ ID NO: 105737 - DNA, 22 bp, Artificial Sequence
  chemically synthesized
tttctgttttcttggttgccac

SEQ ID NO: 105738 - DNA, 22 bp, Artificial Sequence
  chemically synthesized
ctgttttcttggttgccacgat

SEQ ID NO: 105739 - DNA, 22 bp, Artificial Sequence
  chemically synthesized
tgttttcttggttgccacgatc

SEQ ID NO: 105740 - DNA, 22 bp, Artificial Sequence
  chemically synthesized
ttttcttggttgccacgatcca

SEQ ID NO: 105741 - DNA, 22 bp, Artificial Sequence
  chemically synthesized
tcttggttgccacgatccaaga

SEQ ID NO: 105742 - DNA, 22 bp, Artificial Sequence
  chemically synthesized
cttggttgccacgatccaagag

SEQ ID NO: 105743 - DNA, 22 bp, Artificial Sequence
  chemically synthesized
ttggttgccacgatccaagagg

SEQ ID NO: 105744 - DNA, 22 bp, Artificial Sequence
  chemically synthesized
ggttgccacgatccaagagggg

SEQ ID NO: 105745 - DNA, 22 bp, Artificial Sequence
  chemically synthesized
gttgccacgatccaagaggggt

SEQ ID NO: 105746 - DNA, 22 bp, Artificial Sequence
  chemically synthesized
ccacgatccaagaggggtatgg

SEQ ID NO: 105747 - DNA, 22 bp, Artificial Sequence
  chemically synthesized
attaccagctctgctgcagtct

SEQ ID NO: 105748 - DNA, 22 bp, Artificial Sequence
  chemically synthesized
ttaccagctctgctgcagtctt

SEQ ID NO: 105749 - DNA, 22 bp, Artificial Sequence
  chemically synthesized
ccagctctgctgcagtcttatt

SEQ ID NO: 105750 - DNA, 22 bp, Artificial Sequence
  chemically synthesized
tgctgcagtcttatttaacgag

SEQ ID NO: 105751 - DNA, 22 bp, Artificial Sequence
  chemically synthesized
ctgcagtcttatttaacgagaa

SEQ ID NO: 105752 - DNA, 22 bp, Artificial Sequence
  chemically synthesized
cagtcttatttaacgagaaatt

SEQ ID NO: 105753 - DNA, 22 bp, Artificial Sequence
  chemically synthesized
atttaacgagaaattcagaatc

SEQ ID NO: 105754 - DNA, 22 bp, Artificial Sequence
  chemically synthesized
tttaacgagaaattcagaatcc

SEQ ID NO: 105755 - DNA, 22 bp, Artificial Sequence
  chemically synthesized
aacgagaaattcagaatcctgg

SEQ ID NO: 105756 - DNA, 22 bp, Artificial Sequence
  chemically synthesized
acgagaaattcagaatcctgga

SEQ ID NO: 105757 - DNA, 22 bp, Artificial Sequence
  chemically synthesized
agaatcctggaggcaagtcttt

SEQ ID NO: 105758 - DNA, 22 bp, Artificial Sequence
  chemically synthesized
gaggcaagtctttagcacctag

SEQ ID NO: 105759 - DNA, 22 bp, Artificial Sequence
  chemically synthesized
tagcacctagcagttttcttca

SEQ ID NO: 105760 - DNA, 22 bp, Artificial Sequence
  chemically synthesized
agcacctagcagttttcttcat

SEQ ID NO: 105761 - DNA, 22 bp, Artificial Sequence
  chemically synthesized
gcacctagcagttttcttcata

SEQ ID NO: 105762 - DNA, 22 bp, Artificial Sequence
  chemically synthesized
gcagttttcttcataaaatggc

SEQ ID NO: 105763 - DNA, 22 bp, Artificial Sequence
  chemically synthesized
tcttcataaaatggcctcagta

SEQ ID NO: 105764 - DNA, 22 bp, Artificial Sequence
  chemically synthesized
cttcataaaatggcctcagtat

SEQ ID NO: 105765 - DNA, 22 bp, Artificial Sequence
  chemically synthesized
ttcataaaatggcctcagtatc

SEQ ID NO: 105766 - DNA, 22 bp, Artificial Sequence
  chemically synthesized
cataaaatggcctcagtatcaa

SEQ ID NO: 105767 - DNA, 22 bp, Artificial Sequence
  chemically synthesized
ataaaatggcctcagtatcaaa

SEQ ID NO: 105768 - DNA, 22 bp, Artificial Sequence
  chemically synthesized
agtatcaaaaataaatcagaat

SEQ ID NO: 105769 - DNA, 22 bp, Artificial Sequence
  chemically synthesized
catattgtataaggaaatgttc

SEQ ID NO: 105770 - DNA, 22 bp, Artificial Sequence
  chemically synthesized
atattgtataaggaaatgttct

SEQ ID NO: 105771 - DNA, 22 bp, Artificial Sequence
  chemically synthesized
tataaggaaatgttctgatgct

SEQ ID NO: 105772 - DNA, 22 bp, Artificial Sequence
  chemically synthesized
tgatgctacctctgtatcagct

SEQ ID NO: 105773 - DNA, 22 bp, Artificial Sequence
  chemically synthesized
atgctacctctgtatcagctcc

SEQ ID NO: 105774 - DNA, 22 bp, Artificial Sequence
  chemically synthesized
cctctgtatcagctcctgtgag

SEQ ID NO: 105775 - DNA, 22 bp, Artificial Sequence
  chemically synthesized
tgtatcagctcctgtgagtcag

SEQ ID NO: 105776 - DNA, 22 bp, Artificial Sequence
  chemically synthesized
tatcagctcctgtgagtcagga

SEQ ID NO: 105777 - DNA, 22 bp, Artificial Sequence
  chemically synthesized
ctgtgagtcaggattactaact

SEQ ID NO: 105778 - DNA, 22 bp, Artificial Sequence
  chemically synthesized
tgagtcaggattactaacttac

SEQ ID NO: 105779 - DNA, 22 bp, Artificial Sequence
  chemically synthesized
ctaacttactgagattgaaatc

SEQ ID NO: 105780 - DNA, 22 bp, Artificial Sequence
  chemically synthesized
acttactgagattgaaatcacc

SEQ ID NO: 105781 - DNA, 22 bp, Artificial Sequence
  chemically synthesized
actgagattgaaatcaccaaca

SEQ ID NO: 105782 - DNA, 22 bp, Artificial Sequence
  chemically synthesized
ctgagattgaaatcaccaacac

SEQ ID NO: 105783 - DNA, 22 bp, Artificial Sequence
  chemically synthesized
agattgaaatcaccaacactag

SEQ ID NO: 105784 - DNA, 22 bp, Artificial Sequence
  chemically synthesized
aaatcaccaacactagggaatc

SEQ ID NO: 105785 - DNA, 22 bp, Artificial Sequence
  chemically synthesized
gggaatccctaaaattaaatca

SEQ ID NO: 105786 - DNA, 22 bp, Artificial Sequence
  chemically synthesized
aaattaaatcacattgaattca

SEQ ID NO: 105787 - DNA, 22 bp, Artificial Sequence
  chemically synthesized
aatcacattgaattcatataga

SEQ ID NO: 105788 - DNA, 22 bp, Artificial Sequence
  chemically synthesized
aattcatatagaagactgaatt

SEQ ID NO: 105789 - DNA, 22 bp, Artificial Sequence
  chemically synthesized
atatagaagactgaattataat

SEQ ID NO: 105790 - DNA, 22 bp, Artificial Sequence
  chemically synthesized
aattataattattacacaaatg

SEQ ID NO: 105791 - DNA, 22 bp, Artificial Sequence
  chemically synthesized
taattattacacaaatgttgtt

SEQ ID NO: 105792 - DNA, 22 bp, Artificial Sequence
  chemically synthesized
ttacacaaatgttgttctacct

SEQ ID NO: 105793 - DNA, 22 bp, Artificial Sequence
  chemically synthesized
cacaaatgttgttctaccttcg

SEQ ID NO: 105794 - DNA, 22 bp, Artificial Sequence
  chemically synthesized
ttctaccttcgaaagatccttc

SEQ ID NO: 105795 - DNA, 22 bp, Artificial Sequence
  chemically synthesized
taccttcgaaagatccttcatg

SEQ ID NO: 105796 - DNA, 22 bp, Artificial Sequence
  chemically synthesized
ccttcgaaagatccttcatgct

SEQ ID NO: 105797 - DNA, 22 bp, Artificial Sequence
  chemically synthesized
cgaaagatccttcatgcttaaa

SEQ ID NO: 105798 - DNA, 22 bp, Artificial Sequence
  chemically synthesized
gaaagatccttcatgcttaaaa

SEQ ID NO: 105799 - DNA, 22 bp, Artificial Sequence
  chemically synthesized
catgcttaaaaacacagattga

SEQ ID NO: 105800 - DNA, 22 bp, Artificial Sequence
  chemically synthesized
atgcttaaaaacacagattgag

SEQ ID NO: 105801 - DNA, 22 bp, Artificial Sequence
  chemically synthesized
aaaaacacagattgaggaataa

SEQ ID NO: 105802 - DNA, 22 bp, Artificial Sequence
  chemically synthesized
aaaacacagattgaggaataag

SEQ ID NO: 105803 - DNA, 22 bp, Artificial Sequence
  chemically synthesized
aggaataagaggatgtacggaa

SEQ ID NO: 105804 - DNA, 22 bp, Artificial Sequence
  chemically synthesized
gagaaaggacaaattggtgaca

SEQ ID NO: 105805 - DNA, 22 bp, Artificial Sequence
  chemically synthesized
gtgacacatattctgaagggta

SEQ ID NO: 105806 - DNA, 22 bp, Artificial Sequence
  chemically synthesized
tgaagggtaaacatagaagaaa

SEQ ID NO: 105807 - DNA, 22 bp, Artificial Sequence
  chemically synthesized
aagggtaaacatagaagaaagt

SEQ ID NO: 105808 - DNA, 22 bp, Artificial Sequence
  chemically synthesized
aaattttttttaattaaagttt

SEQ ID NO: 105809 - DNA, 22 bp, Artificial Sequence
  chemically synthesized
tttttaattaaagttttaaaaa

SEQ ID NO: 105810 - DNA, 22 bp, Artificial Sequence
  chemically synthesized
ttttaattaaagttttaaaaaa

SEQ ID NO: 105811 - DNA, 22 bp, Artificial Sequence
  chemically synthesized
tttaattaaagttttaaaaaat

SEQ ID NO: 105812 - DNA, 22 bp, Artificial Sequence
  chemically synthesized
ttaattaaagttttaaaaaatt

SEQ ID NO: 105813 - DNA, 22 bp, Artificial Sequence
  chemically synthesized
taattaaagttttaaaaaattt

SEQ ID NO: 105814 - DNA, 22 bp, Artificial Sequence
  chemically synthesized
aattaaagttttaaaaaatttt

SEQ ID NO: 105815 - DNA, 22 bp, Artificial Sequence
  chemically synthesized
attaaagttttaaaaaatttta

SEQ ID NO: 105816 - DNA, 22 bp, Artificial Sequence
  chemically synthesized
aagttttaaaaaattttaaaaa

SEQ ID NO: 105817 - DNA, 22 bp, Artificial Sequence
  chemically synthesized
taaaaaattttaaaaataaaaa

SEQ ID NO: 105818 - DNA, 22 bp, Artificial Sequence
  chemically synthesized
aaaaaattttaaaaataaaaaa

SEQ ID NO: 105819 - DNA, 22 bp, Artificial Sequence
  chemically synthesized
aaaaattttaaaaataaaaaat

SEQ ID NO: 105820 - DNA, 22 bp, Artificial Sequence
  chemically synthesized
taaaaataaaaaatttttaaaa

SEQ ID NO: 105821 - DNA, 22 bp, Artificial Sequence
  chemically synthesized
aaaaataaaaaatttttaaaaa

SEQ ID NO: 105822 - DNA, 22 bp, Artificial Sequence
  chemically synthesized
aaaataaaaaatttttaaaaag

SEQ ID NO: 105823 - DNA, 22 bp, Artificial Sequence
  chemically synthesized
ttaaaaagaaagccataaaatc

SEQ ID NO: 105824 - DNA, 22 bp, Artificial Sequence
  chemically synthesized
taaaaagaaagccataaaatct

SEQ ID NO: 105825 - DNA, 22 bp, Artificial Sequence
  chemically synthesized
aaaaagaaagccataaaatctg

SEQ ID NO: 105826 - DNA, 22 bp, Artificial Sequence
  chemically synthesized
aaaagaaagccataaaatctgg

SEQ ID NO: 105827 - DNA, 22 bp, Artificial Sequence
  chemically synthesized
ggattcctttaaaaaaaattgt

SEQ ID NO: 105828 - DNA, 22 bp, Artificial Sequence
  chemically synthesized
ctttaaaaaaaattgtgtaagg

SEQ ID NO: 105829 - DNA, 22 bp, Artificial Sequence
  chemically synthesized
taaaaaaaattgtgtaaggatc

SEQ ID NO: 105830 - DNA, 22 bp, Artificial Sequence
  chemically synthesized
aaaaaaaattgtgtaaggatca

SEQ ID NO: 105831 - DNA, 22 bp, Artificial Sequence
  chemically synthesized
aaaaaaattgtgtaaggatcaa

SEQ ID NO: 105832 - DNA, 22 bp, Artificial Sequence
  chemically synthesized
tgtaaggatcaaactagatttc

SEQ ID NO: 105833 - DNA, 22 bp, Artificial Sequence
  chemically synthesized
gatttccagagcacaagtactt

SEQ ID NO: 105834 - DNA, 22 bp, Artificial Sequence
  chemically synthesized
ccagagcacaagtactttttaa

SEQ ID NO: 105835 - DNA, 22 bp, Artificial Sequence
  chemically synthesized
cagagcacaagtactttttaaa

SEQ ID NO: 105836 - DNA, 22 bp, Artificial Sequence
  chemically synthesized
tttaaaatgtttgtgagctttt

SEQ ID NO: 105837 - DNA, 22 bp, Artificial Sequence
  chemically synthesized
ttaaaatgtttgtgagcttttc

SEQ ID NO: 105838 - DNA, 22 bp, Artificial Sequence
  chemically synthesized
taaaatgtttgtgagcttttcc

SEQ ID NO: 105839 - DNA, 22 bp, Artificial Sequence
  chemically synthesized
aaaatgtttgtgagcttttcct

SEQ ID NO: 105840 - DNA, 22 bp, Artificial Sequence
  chemically synthesized
aaatgtttgtgagcttttcctt

SEQ ID NO: 105841 - DNA, 22 bp, Artificial Sequence
  chemically synthesized
gtgagcttttccttaaaaaaca

SEQ ID NO: 105842 - DNA, 22 bp, Artificial Sequence
  chemically synthesized
tgagcttttccttaaaaaacaa

SEQ ID NO: 105843 - DNA, 22 bp, Artificial Sequence
  chemically synthesized
ttccttaaaaaacaataacgtc

SEQ ID NO: 105844 - DNA, 22 bp, Artificial Sequence
  chemically synthesized
tccttaaaaaacaataacgtct

SEQ ID NO: 105845 - DNA, 22 bp, Artificial Sequence
  chemically synthesized
ccttaaaaaacaataacgtctt

SEQ ID NO: 105846 - DNA, 22 bp, Artificial Sequence
  chemically synthesized
cttaaaaaacaataacgtcttt

SEQ ID NO: 105847 - DNA, 22 bp, Artificial Sequence
  chemically synthesized
aaaaaacaataacgtctttaga

SEQ ID NO: 105848 - DNA, 22 bp, Artificial Sequence
  chemically synthesized
aaaaacaataacgtctttagag

SEQ ID NO: 105849 - DNA, 22 bp, Artificial Sequence
  chemically synthesized
tagagaaattggccataaaaca

SEQ ID NO: 105850 - DNA, 22 bp, Artificial Sequence
  chemically synthesized
agagaaattggccataaaacac

SEQ ID NO: 105851 - DNA, 22 bp, Artificial Sequence
  chemically synthesized
gagaaattggccataaaacact

SEQ ID NO: 105852 - DNA, 22 bp, Artificial Sequence
  chemically synthesized
gccataaaacacttgaaaccaa

SEQ ID NO: 105853 - DNA, 22 bp, Artificial Sequence
  chemically synthesized
gaaaccaaaaaagaaagttttt

SEQ ID NO: 105854 - DNA, 22 bp, Artificial Sequence
  chemically synthesized
aaaccaaaaaagaaagtttttt

SEQ ID NO: 105855 - DNA, 22 bp, Artificial Sequence
  chemically synthesized
tttattatatttatgagcagaa

SEQ ID NO: 105856 - DNA, 22 bp, Artificial Sequence
  chemically synthesized
ttattatatttatgagcagaaa

SEQ ID NO: 105857 - DNA, 22 bp, Artificial Sequence
  chemically synthesized
tattatatttatgagcagaaaa

SEQ ID NO: 105858 - DNA, 22 bp, Artificial Sequence
  chemically synthesized
attatatttatgagcagaaaaa

SEQ ID NO: 105859 - DNA, 22 bp, Artificial Sequence
  chemically synthesized
ttatatttatgagcagaaaaaa

SEQ ID NO: 105860 - DNA, 22 bp, Artificial Sequence
  chemically synthesized
tatttatgagcagaaaaaaatg

SEQ ID NO: 105861 - DNA, 22 bp, Artificial Sequence
  chemically synthesized
atgagcagaaaaaaatgtttac

SEQ ID NO: 105862 - DNA, 22 bp, Artificial Sequence
  chemically synthesized
tgagcagaaaaaaatgtttaca

SEQ ID NO: 105863 - DNA, 22 bp, Artificial Sequence
  chemically synthesized
acagtcatatctccctccatct

SEQ ID NO: 105864 - DNA, 22 bp, Artificial Sequence
  chemically synthesized
cagtcatatctccctccatctc

SEQ ID NO: 105865 - DNA, 22 bp, Artificial Sequence
  chemically synthesized
cctccatctctaagcttgggtc

SEQ ID NO: 105866 - DNA, 22 bp, Artificial Sequence
  chemically synthesized
catctctaagcttgggtcatta

SEQ ID NO: 105867 - DNA, 22 bp, Artificial Sequence
  chemically synthesized
taagcttgggtcattaaaagta

SEQ ID NO: 105868 - DNA, 22 bp, Artificial Sequence
  chemically synthesized
agcttgggtcattaaaagtaag

SEQ ID NO: 105869 - DNA, 22 bp, Artificial Sequence
  chemically synthesized
gggtcattaaaagtaagacagg

SEQ ID NO: 105870 - DNA, 22 bp, Artificial Sequence
  chemically synthesized
ggtcattaaaagtaagacaggg

SEQ ID NO: 105871 - DNA, 22 bp, Artificial Sequence
  chemically synthesized
aaagtaagacagggaaggttat

SEQ ID NO: 105872 - DNA, 22 bp, Artificial Sequence
  chemically synthesized
tggtacctcaaagaaaatgaaa

SEQ ID NO: 105873 - DNA, 22 bp, Artificial Sequence
  chemically synthesized
aaagaaaatgaaaggtaaatca

SEQ ID NO: 105874 - DNA, 22 bp, Artificial Sequence
  chemically synthesized
agattttgggaataaaaagaaa

SEQ ID NO: 105875 - DNA, 22 bp, Artificial Sequence
  chemically synthesized
tgggaataaaaagaaacacaaa

SEQ ID NO: 105876 - DNA, 22 bp, Artificial Sequence
  chemically synthesized
gggaataaaaagaaacacaaaa

SEQ ID NO: 105877 - DNA, 22 bp, Artificial Sequence
  chemically synthesized
ggaataaaaagaaacacaaaag

SEQ ID NO: 105878 - DNA, 22 bp, Artificial Sequence
  chemically synthesized
cccaacactgggaagccgttga

SEQ ID NO: 105879 - DNA, 22 bp, Artificial Sequence
  chemically synthesized
ggaagccgttgatatttaccca

SEQ ID NO: 105880 - DNA, 22 bp, Artificial Sequence
  chemically synthesized
atatttacccagaggcaggcgt

SEQ ID NO: 105881 - DNA, 22 bp, Artificial Sequence
  chemically synthesized
acccagaggcaggcgtgtgggg

SEQ ID NO: 105882 - DNA, 22 bp, Artificial Sequence
  chemically synthesized
cccagaggcaggcgtgtgggga

SEQ ID NO: 105883 - DNA, 22 bp, Artificial Sequence
  chemically synthesized
taggagagctagatactgtcat

SEQ ID NO: 105884 - DNA, 22 bp, Artificial Sequence
  chemically synthesized
ggagagctagatactgtcatca

SEQ ID NO: 105885 - DNA, 22 bp, Artificial Sequence
  chemically synthesized
gatactgtcatcaaactgaggc

SEQ ID NO: 105886 - DNA, 22 bp, Artificial Sequence
  chemically synthesized
tcatcaaactgaggcccactat

SEQ ID NO: 105887 - DNA, 22 bp, Artificial Sequence
  chemically synthesized
aggcccactataagcagtgtca

SEQ ID NO: 105888 - DNA, 22 bp, Artificial Sequence
  chemically synthesized
taagcagtgtcaccagagatga

SEQ ID NO: 105889 - DNA, 22 bp, Artificial Sequence
  chemically synthesized
tatgcatgctcccaaggctgca

SEQ ID NO: 105890 - DNA, 22 bp, Artificial Sequence
  chemically synthesized
ccaaggctgcactatgtggcaa

SEQ ID NO: 105891 - DNA, 22 bp, Artificial Sequence
  chemically synthesized
cactatgtggcaaaattccatt

SEQ ID NO: 105892 - DNA, 22 bp, Artificial Sequence
  chemically synthesized
tgtggcaaaattccattcagat

SEQ ID NO: 105893 - DNA, 22 bp, Artificial Sequence
  chemically synthesized
cattcagatggcttagctatta

SEQ ID NO: 105894 - DNA, 22 bp, Artificial Sequence
  chemically synthesized
agatggcttagctattaacaag

SEQ ID NO: 105895 - DNA, 22 bp, Artificial Sequence
  chemically synthesized
agctattaacaagtgttaagaa

SEQ ID NO: 105896 - DNA, 22 bp, Artificial Sequence
  chemically synthesized
gctattaacaagtgttaagaaa

SEQ ID NO: 105897 - DNA, 22 bp, Artificial Sequence
  chemically synthesized
ttaacaagtgttaagaaaatta

SEQ ID NO: 105898 - DNA, 22 bp, Artificial Sequence
  chemically synthesized
acaagtgttaagaaaattatac

SEQ ID NO: 105899 - DNA, 22 bp, Artificial Sequence
  chemically synthesized
agaaaattatactagaagcaca

SEQ ID NO: 105900 - DNA, 22 bp, Artificial Sequence
  chemically synthesized
tactagaagcacaagaactagt

SEQ ID NO: 105901 - DNA, 22 bp, Artificial Sequence
  chemically synthesized
gaagcacaagaactagtttttc

SEQ ID NO: 105902 - DNA, 22 bp, Artificial Sequence
  chemically synthesized
gtttttctggataaaggtggag

SEQ ID NO: 105903 - DNA, 22 bp, Artificial Sequence
  chemically synthesized
ttctggataaaggtggagcagc

SEQ ID NO: 105904 - DNA, 22 bp, Artificial Sequence
  chemically synthesized
tctggataaaggtggagcagct

SEQ ID NO: 105905 - DNA, 22 bp, Artificial Sequence
  chemically synthesized
ctggataaaggtggagcagcta

SEQ ID NO: 105906 - DNA, 22 bp, Artificial Sequence
  chemically synthesized
tggataaaggtggagcagctat

SEQ ID NO: 105907 - DNA, 22 bp, Artificial Sequence
  chemically synthesized
gataaaggtggagcagctatgg

SEQ ID NO: 105908 - DNA, 22 bp, Artificial Sequence
  chemically synthesized
tggctgtgaaattgataggcag

SEQ ID NO: 105909 - DNA, 22 bp, Artificial Sequence
  chemically synthesized
tgaaattgataggcagctctca

SEQ ID NO: 105910 - DNA, 22 bp, Artificial Sequence
  chemically synthesized
ataggcagctctcaactcagaa

SEQ ID NO: 105911 - DNA, 22 bp, Artificial Sequence
  chemically synthesized
tcaactcagaacataaatgttt

SEQ ID NO: 105912 - DNA, 22 bp, Artificial Sequence
  chemically synthesized
aactcagaacataaatgtttag

SEQ ID NO: 105913 - DNA, 22 bp, Artificial Sequence
  chemically synthesized
agaacataaatgtttagtgatt

SEQ ID NO: 105914 - DNA, 22 bp, Artificial Sequence
  chemically synthesized
agtgatttcctaaggatctggg

SEQ ID NO: 105915 - DNA, 22 bp, Artificial Sequence
  chemically synthesized
gtgatttcctaaggatctgggg

SEQ ID NO: 105916 - DNA, 22 bp, Artificial Sequence
  chemically synthesized
cctaaggatctggggtcctgac

SEQ ID NO: 105917 - DNA, 22 bp, Artificial Sequence
  chemically synthesized
ctaaggatctggggtcctgact

SEQ ID NO: 105918 - DNA, 22 bp, Artificial Sequence
  chemically synthesized
aggatctggggtcctgacttga

SEQ ID NO: 105919 - DNA, 22 bp, Artificial Sequence
  chemically synthesized
gggtcctgacttgatgtgtgat

SEQ ID NO: 105920 - DNA, 22 bp, Artificial Sequence
  chemically synthesized
acttgatgtgtgatgatttttc

SEQ ID NO: 105921 - DNA, 22 bp, Artificial Sequence
  chemically synthesized
gatgtgtgatgatttttccttg

SEQ ID NO: 105922 - DNA, 22 bp, Artificial Sequence
  chemically synthesized
atgtgtgatgatttttccttga

SEQ ID NO: 105923 - DNA, 22 bp, Artificial Sequence
  chemically synthesized
ttccttgaactgatatatcata

SEQ ID NO: 105924 - DNA, 22 bp, Artificial Sequence
  chemically synthesized
tccttgaactgatatatcatat

SEQ ID NO: 105925 - DNA, 22 bp, Artificial Sequence
  chemically synthesized
ccttgaactgatatatcatata

SEQ ID NO: 105926 - DNA, 22 bp, Artificial Sequence
  chemically synthesized
cttgaactgatatatcatatat

SEQ ID NO: 105927 - DNA, 22 bp, Artificial Sequence
  chemically synthesized
gaactgatatatcatatatgaa

SEQ ID NO: 105928 - DNA, 22 bp, Artificial Sequence
  chemically synthesized
aactgatatatcatatatgaag

SEQ ID NO: 105929 - DNA, 22 bp, Artificial Sequence
  chemically synthesized
atatatcatatatgaagatata

SEQ ID NO: 105930 - DNA, 22 bp, Artificial Sequence
  chemically synthesized
taggagctccattcaccaatac

SEQ ID NO: 105931 - DNA, 22 bp, Artificial Sequence
  chemically synthesized
cattcaccaataccatctggga

SEQ ID NO: 105932 - DNA, 22 bp, Artificial Sequence
  chemically synthesized
accaataccatctgggacaagt

SEQ ID NO: 105933 - DNA, 22 bp, Artificial Sequence
  chemically synthesized
ggacaagttggaaaatgactat

SEQ ID NO: 105934 - DNA, 22 bp, Artificial Sequence
  chemically synthesized
gaaaatgactattttgagtcag

SEQ ID NO: 105935 - DNA, 22 bp, Artificial Sequence
  chemically synthesized
ttttgagtcagcacagaattgg

SEQ ID NO: 105936 - DNA, 22 bp, Artificial Sequence
  chemically synthesized
tgagtcagcacagaattggtga

SEQ ID NO: 105937 - DNA, 22 bp, Artificial Sequence
  chemically synthesized
gagtcagcacagaattggtgag

SEQ ID NO: 105938 - DNA, 22 bp, Artificial Sequence
  chemically synthesized
agtcagcacagaattggtgagc

SEQ ID NO: 105939 - DNA, 22 bp, Artificial Sequence
  chemically synthesized
gtgagcacatgccacacaactg

SEQ ID NO: 105940 - DNA, 22 bp, Artificial Sequence
  chemically synthesized
cactgtgtttagttctaaataa

SEQ ID NO: 105941 - DNA, 22 bp, Artificial Sequence
  chemically synthesized
tgtttagttctaaataaccatg

SEQ ID NO: 105942 - DNA, 22 bp, Artificial Sequence
  chemically synthesized
agttctaaataaccatgtaata

SEQ ID NO: 105943 - DNA, 22 bp, Artificial Sequence
  chemically synthesized
gttctaaataaccatgtaataa

SEQ ID NO: 105944 - DNA, 22 bp, Artificial Sequence
  chemically synthesized
taaataaccatgtaataagcac

SEQ ID NO: 105945 - DNA, 22 bp, Artificial Sequence
  chemically synthesized
aataaccatgtaataagcacag

SEQ ID NO: 105946 - DNA, 22 bp, Artificial Sequence
  chemically synthesized
ctcttaagaagctctcaatatg

SEQ ID NO: 105947 - DNA, 22 bp, Artificial Sequence
  chemically synthesized
ttaagaagctctcaatatggcc

SEQ ID NO: 105948 - DNA, 22 bp, Artificial Sequence
  chemically synthesized
aagaagctctcaatatggccta

SEQ ID NO: 105949 - DNA, 22 bp, Artificial Sequence
  chemically synthesized
agaagctctcaatatggcctat

SEQ ID NO: 105950 - DNA, 22 bp, Artificial Sequence
  chemically synthesized
tcaatatggcctatgagtttat

SEQ ID NO: 105951 - DNA, 22 bp, Artificial Sequence
  chemically synthesized
aatatggcctatgagtttataa

SEQ ID NO: 105952 - DNA, 22 bp, Artificial Sequence
  chemically synthesized
tgagtttataatagtgcttaat

SEQ ID NO: 105953 - DNA, 22 bp, Artificial Sequence
  chemically synthesized
ataatagtgcttaatattctcc

SEQ ID NO: 105954 - DNA, 22 bp, Artificial Sequence
  chemically synthesized
taatagtgcttaatattctccc

SEQ ID NO: 105955 - DNA, 22 bp, Artificial Sequence
  chemically synthesized
aatattctcccttcaattttat

SEQ ID NO: 105956 - DNA, 22 bp, Artificial Sequence
  chemically synthesized
atattctcccttcaattttatg

SEQ ID NO: 105957 - DNA, 22 bp, Artificial Sequence
  chemically synthesized
tcccttcaattttatgcagaat

SEQ ID NO: 105958 - DNA, 22 bp, Artificial Sequence
  chemically synthesized
ccttcaattttatgcagaatat

SEQ ID NO: 105959 - DNA, 22 bp, Artificial Sequence
  chemically synthesized
caattttatgcagaatattgcc

SEQ ID NO: 105960 - DNA, 22 bp, Artificial Sequence
  chemically synthesized
aattttatgcagaatattgccc

SEQ ID NO: 105961 - DNA, 22 bp, Artificial Sequence
  chemically synthesized
tatgcagaatattgcccttgaa

SEQ ID NO: 105962 - DNA, 22 bp, Artificial Sequence
  chemically synthesized
atgcagaatattgcccttgaat

SEQ ID NO: 105963 - DNA, 22 bp, Artificial Sequence
  chemically synthesized
tgcagaatattgcccttgaatg

SEQ ID NO: 105964 - DNA, 22 bp, Artificial Sequence
  chemically synthesized
cccttgaatgtctcaacaggat

SEQ ID NO: 105965 - DNA, 22 bp, Artificial Sequence
  chemically synthesized
gaatgtctcaacaggatccata

SEQ ID NO: 105966 - DNA, 22 bp, Artificial Sequence
  chemically synthesized
aatgtctcaacaggatccataa

SEQ ID NO: 105967 - DNA, 22 bp, Artificial Sequence
  chemically synthesized
aacaggatccataatgctgaaa

SEQ ID NO: 105968 - DNA, 22 bp, Artificial Sequence
  chemically synthesized
aaaacttgagaaaaatcataga

SEQ ID NO: 105969 - DNA, 22 bp, Artificial Sequence
  chemically synthesized
gagaaaaatcatagatctaagc

SEQ ID NO: 105970 - DNA, 22 bp, Artificial Sequence
  chemically synthesized
agaaaaatcatagatctaagcc

SEQ ID NO: 105971 - DNA, 22 bp, Artificial Sequence
  chemically synthesized
agccctgcttcattctagcttc

SEQ ID NO: 105972 - DNA, 22 bp, Artificial Sequence
  chemically synthesized
cttcattctagcttcattctag

SEQ ID NO: 105973 - DNA, 22 bp, Artificial Sequence
  chemically synthesized
cattctagcttcattctagatg

SEQ ID NO: 105974 - DNA, 22 bp, Artificial Sequence
  chemically synthesized
attctagcttcattctagatgt

SEQ ID NO: 105975 - DNA, 22 bp, Artificial Sequence
  chemically synthesized
tagcttcattctagatgttcta

SEQ ID NO: 105976 - DNA, 22 bp, Artificial Sequence
  chemically synthesized
gcttcattctagatgttctatt

SEQ ID NO: 105977 - DNA, 22 bp, Artificial Sequence
  chemically synthesized
cattctagatgttctattgacc

SEQ ID NO: 105978 - DNA, 22 bp, Artificial Sequence
  chemically synthesized
attctagatgttctattgacct

SEQ ID NO: 105979 - DNA, 22 bp, Artificial Sequence
  chemically synthesized
tagatgttctattgacctgaat

SEQ ID NO: 105980 - DNA, 22 bp, Artificial Sequence
  chemically synthesized
gatgttctattgacctgaattt

SEQ ID NO: 105981 - DNA, 22 bp, Artificial Sequence
  chemically synthesized
tattgacctgaatttcacatga

SEQ ID NO: 105982 - DNA, 22 bp, Artificial Sequence
  chemically synthesized
ttgacctgaatttcacatgatg

SEQ ID NO: 105983 - DNA, 22 bp, Artificial Sequence
  chemically synthesized
acctgaatttcacatgatgata

SEQ ID NO: 105984 - DNA, 22 bp, Artificial Sequence
  chemically synthesized
aatttcacatgatgatatattt

SEQ ID NO: 105985 - DNA, 22 bp, Artificial Sequence
  chemically synthesized
cacatgatgatatatttctaga

SEQ ID NO: 105986 - DNA, 22 bp, Artificial Sequence
  chemically synthesized
acatgatgatatatttctagat

SEQ ID NO: 105987 - DNA, 22 bp, Artificial Sequence
  chemically synthesized
ctagatgaataagattcctata

SEQ ID NO: 105988 - DNA, 22 bp, Artificial Sequence
  chemically synthesized
tagatgaataagattcctatac

SEQ ID NO: 105989 - DNA, 22 bp, Artificial Sequence
  chemically synthesized
gatgaataagattcctatactt

SEQ ID NO: 105990 - DNA, 22 bp, Artificial Sequence
  chemically synthesized
ctatacttgtagcaacactctc

SEQ ID NO: 105991 - DNA, 22 bp, Artificial Sequence
  chemically synthesized
tacttgtagcaacactctcacc

SEQ ID NO: 105992 - DNA, 22 bp, Artificial Sequence
  chemically synthesized
gtagcaacactctcaccaagat

SEQ ID NO: 105993 - DNA, 22 bp, Artificial Sequence
  chemically synthesized
tagcaacactctcaccaagatg

SEQ ID NO: 105994 - DNA, 22 bp, Artificial Sequence
  chemically synthesized
tcaccaagatgcataaatacat

SEQ ID NO: 105995 - DNA, 22 bp, Artificial Sequence
  chemically synthesized
accaagatgcataaatacatac

SEQ ID NO: 105996 - DNA, 22 bp, Artificial Sequence
  chemically synthesized
tcatgctcactttgagaacata

SEQ ID NO: 105997 - DNA, 22 bp, Artificial Sequence
  chemically synthesized
actttgagaacataatttgaat

SEQ ID NO: 105998 - DNA, 22 bp, Artificial Sequence
  chemically synthesized
tgagaacataatttgaatgtta

SEQ ID NO: 105999 - DNA, 22 bp, Artificial Sequence
  chemically synthesized
gagaacataatttgaatgttac

SEQ ID NO: 106000 - DNA, 22 bp, Artificial Sequence
  chemically synthesized
agaacataatttgaatgttacc

SEQ ID NO: 106001 - DNA, 22 bp, Artificial Sequence
  chemically synthesized
gaatgttaccagatacaaggga

SEQ ID NO: 106002 - DNA, 22 bp, Artificial Sequence
  chemically synthesized
aatgttaccagatacaagggag

SEQ ID NO: 106003 - DNA, 22 bp, Artificial Sequence
  chemically synthesized
ccagatacaagggagtaaagga

SEQ ID NO: 106004 - DNA, 22 bp, Artificial Sequence
  chemically synthesized
tgtagtatgaagaaggaacaga

SEQ ID NO: 106005 - DNA, 22 bp, Artificial Sequence
  chemically synthesized
gtagtatgaagaaggaacagac

SEQ ID NO: 106006 - DNA, 22 bp, Artificial Sequence
  chemically synthesized
tagtatgaagaaggaacagaca

SEQ ID NO: 106007 - DNA, 22 bp, Artificial Sequence
  chemically synthesized
ttagcctcaagaaaatgtagta

SEQ ID NO: 106008 - DNA, 22 bp, Artificial Sequence
  chemically synthesized
gcctcaagaaaatgtagtaaat

SEQ ID NO: 106009 - DNA, 22 bp, Artificial Sequence
  chemically synthesized
aagaaaatgtagtaaatagtga

SEQ ID NO: 106010 - DNA, 22 bp, Artificial Sequence
  chemically synthesized
ttatacagtctacataaacaag

SEQ ID NO: 106011 - DNA, 22 bp, Artificial Sequence
  chemically synthesized
tacagtctacataaacaagtga

SEQ ID NO: 106012 - DNA, 22 bp, Artificial Sequence
  chemically synthesized
cataaacaagtgaaagaggaaa

SEQ ID NO: 106013 - DNA, 22 bp, Artificial Sequence
  chemically synthesized
ctcctttccctcatcttctcat

SEQ ID NO: 106014 - DNA, 22 bp, Artificial Sequence
  chemically synthesized
ctttccctcatcttctcatttc

SEQ ID NO: 106015 - DNA, 22 bp, Artificial Sequence
  chemically synthesized
tccctcatcttctcatttccta

SEQ ID NO: 106016 - DNA, 22 bp, Artificial Sequence
  chemically synthesized
ccctcatcttctcatttcctac

SEQ ID NO: 106017 - DNA, 22 bp, Artificial Sequence
  chemically synthesized
cctcatcttctcatttcctact

SEQ ID NO: 106018 - DNA, 22 bp, Artificial Sequence
  chemically synthesized
atcttctcatttcctactctgc

SEQ ID NO: 106019 - DNA, 22 bp, Artificial Sequence
  chemically synthesized
ctcatttcctactctgccctcc

SEQ ID NO: 106020 - DNA, 22 bp, Artificial Sequence
  chemically synthesized
tcatttcctactctgccctcct

SEQ ID NO: 106021 - DNA, 22 bp, Artificial Sequence
  chemically synthesized
atttcctactctgccctccttc

SEQ ID NO: 106022 - DNA, 22 bp, Artificial Sequence
  chemically synthesized
cctactctgccctccttctgag

SEQ ID NO: 106023 - DNA, 22 bp, Artificial Sequence
  chemically synthesized
ctactctgccctccttctgagt

SEQ ID NO: 106024 - DNA, 22 bp, Artificial Sequence
  chemically synthesized
ctctgccctccttctgagttgg

SEQ ID NO: 106025 - DNA, 22 bp, Artificial Sequence
  chemically synthesized
tgccctccttctgagttggatg

SEQ ID NO: 106026 - DNA, 22 bp, Artificial Sequence
  chemically synthesized
ccctccttctgagttggatgga

SEQ ID NO: 106027 - DNA, 22 bp, Artificial Sequence
  chemically synthesized
cttctgagttggatggaagatg

SEQ ID NO: 106028 - DNA, 22 bp, Artificial Sequence
  chemically synthesized
ctgagttggatggaagatgtgt

SEQ ID NO: 106029 - DNA, 22 bp, Artificial Sequence
  chemically synthesized
tgagttggatggaagatgtgtc

SEQ ID NO: 106030 - DNA, 22 bp, Artificial Sequence
  chemically synthesized
agttggatggaagatgtgtccc

SEQ ID NO: 106031 - DNA, 22 bp, Artificial Sequence
  chemically synthesized
gatggaagatgtgtccccgcac

SEQ ID NO: 106032 - DNA, 22 bp, Artificial Sequence
  chemically synthesized
cctaaggagatgggccctgtct

SEQ ID NO: 106033 - DNA, 22 bp, Artificial Sequence
  chemically synthesized
ctaaggagatgggccctgtctc

SEQ ID NO: 106034 - DNA, 22 bp, Artificial Sequence
  chemically synthesized
aggagatgggccctgtctctag

SEQ ID NO: 106035 - DNA, 22 bp, Artificial Sequence
  chemically synthesized
tctctagaatttttctagtgag

SEQ ID NO: 106036 - DNA, 22 bp, Artificial Sequence
  chemically synthesized
tagaatttttctagtgagtccc

SEQ ID NO: 106037 - DNA, 22 bp, Artificial Sequence
  chemically synthesized
gaatttttctagtgagtcccac

SEQ ID NO: 106038 - DNA, 22 bp, Artificial Sequence
  chemically synthesized
ttctagtgagtcccactgacta

SEQ ID NO: 106039 - DNA, 22 bp, Artificial Sequence
  chemically synthesized
tctagtgagtcccactgactac

SEQ ID NO: 106040 - DNA, 22 bp, Artificial Sequence
  chemically synthesized
ctagtgagtcccactgactact

SEQ ID NO: 106041 - DNA, 22 bp, Artificial Sequence
  chemically synthesized
tagtgagtcccactgactactc

SEQ ID NO: 106042 - DNA, 22 bp, Artificial Sequence
  chemically synthesized
gtgagtcccactgactactcat

SEQ ID NO: 106043 - DNA, 22 bp, Artificial Sequence
  chemically synthesized
actactcatgccatctcttaga

SEQ ID NO: 106044 - DNA, 22 bp, Artificial Sequence
  chemically synthesized
ctcatgccatctcttagagcag

SEQ ID NO: 106045 - DNA, 22 bp, Artificial Sequence
  chemically synthesized
atgccatctcttagagcagttc

SEQ ID NO: 106046 - DNA, 22 bp, Artificial Sequence
  chemically synthesized
ttagagcagttcttcaaacaaa

SEQ ID NO: 106047 - DNA, 22 bp, Artificial Sequence
  chemically synthesized
agagcagttcttcaaacaaaca

SEQ ID NO: 106048 - DNA, 22 bp, Artificial Sequence
  chemically synthesized
gagcagttcttcaaacaaacac

SEQ ID NO: 106049 - DNA, 22 bp, Artificial Sequence
  chemically synthesized
ttcaaacaaacacacagacaca

SEQ ID NO: 106050 - DNA, 22 bp, Artificial Sequence
  chemically synthesized
caaacaaacacacagacacaca

SEQ ID NO: 106051 - DNA, 22 bp, Artificial Sequence
  chemically synthesized
aaacaaacacacagacacacat

SEQ ID NO: 106052 - DNA, 22 bp, Artificial Sequence
  chemically synthesized
caaggggtgttgtttggatctt

SEQ ID NO: 106053 - DNA, 22 bp, Artificial Sequence
  chemically synthesized
aaggggtgttgtttggatctta

SEQ ID NO: 106054 - DNA, 22 bp, Artificial Sequence
  chemically synthesized
tttggatcttataaattaaatt

SEQ ID NO: 106055 - DNA, 22 bp, Artificial Sequence
  chemically synthesized
ggatcttataaattaaattgtt

SEQ ID NO: 106056 - DNA, 22 bp, Artificial Sequence
  chemically synthesized
gatcttataaattaaattgtta

SEQ ID NO: 106057 - DNA, 22 bp, Artificial Sequence
  chemically synthesized
ataaattaaattgttatatgtt

SEQ ID NO: 106058 - DNA, 22 bp, Artificial Sequence
  chemically synthesized
taaattaaattgttatatgtta

SEQ ID NO: 106059 - DNA, 22 bp, Artificial Sequence
  chemically synthesized
aattgttatatgttaaaatggt

SEQ ID NO: 106060 - DNA, 22 bp, Artificial Sequence
  chemically synthesized
ttatatgttaaaatggtgactt

SEQ ID NO: 106061 - DNA, 22 bp, Artificial Sequence
  chemically synthesized
tatgttaaaatggtgacttttc

SEQ ID NO: 106062 - DNA, 22 bp, Artificial Sequence
  chemically synthesized
aaatggtgacttttctttctat

SEQ ID NO: 106063 - DNA, 22 bp, Artificial Sequence
  chemically synthesized
ttctttctataaatttcaggat

SEQ ID NO: 106064 - DNA, 22 bp, Artificial Sequence
  chemically synthesized
tctttctataaatttcaggatc

SEQ ID NO: 106065 - DNA, 22 bp, Artificial Sequence
  chemically synthesized
ctttctataaatttcaggatct

SEQ ID NO: 106066 - DNA, 22 bp, Artificial Sequence
  chemically synthesized
tttctataaatttcaggatctt

SEQ ID NO: 106067 - DNA, 22 bp, Artificial Sequence
  chemically synthesized
tctataaatttcaggatcttag

SEQ ID NO: 106068 - DNA, 22 bp, Artificial Sequence
  chemically synthesized
ctataaatttcaggatcttagc

SEQ ID NO: 106069 - DNA, 22 bp, Artificial Sequence
  chemically synthesized
tataaatttcaggatcttagca

SEQ ID NO: 106070 - DNA, 22 bp, Artificial Sequence
  chemically synthesized
taaatttcaggatcttagcaga

SEQ ID NO: 106071 - DNA, 22 bp, Artificial Sequence
  chemically synthesized
caggatcttagcagagtgcaga

SEQ ID NO: 106072 - DNA, 22 bp, Artificial Sequence
  chemically synthesized
aggatcttagcagagtgcagaa

SEQ ID NO: 106073 - DNA, 22 bp, Artificial Sequence
  chemically synthesized
agcagagtgcagaagctcagcc

SEQ ID NO: 106074 - DNA, 22 bp, Artificial Sequence
  chemically synthesized
gcagagtgcagaagctcagcct

SEQ ID NO: 106075 - DNA, 22 bp, Artificial Sequence
  chemically synthesized
agcctgtttaggttcagaactc

SEQ ID NO: 106076 - DNA, 22 bp, Artificial Sequence
  chemically synthesized
tttaggttcagaactccgtgct

SEQ ID NO: 106077 - DNA, 22 bp, Artificial Sequence
  chemically synthesized
aggttcagaactccgtgctctc

SEQ ID NO: 106078 - DNA, 22 bp, Artificial Sequence
  chemically synthesized
ggttcagaactccgtgctctca

SEQ ID NO: 106079 - DNA, 22 bp, Artificial Sequence
  chemically synthesized
agaactccgtgctctcacgcat

SEQ ID NO: 106080 - DNA, 22 bp, Artificial Sequence
  chemically synthesized
cgtgctctcacgcattgtcttt

SEQ ID NO: 106081 - DNA, 22 bp, Artificial Sequence
  chemically synthesized
tcacgcattgtctttaatcttc

SEQ ID NO: 106082 - DNA, 22 bp, Artificial Sequence
  chemically synthesized
acgcattgtctttaatcttcaa

SEQ ID NO: 106083 - DNA, 22 bp, Artificial Sequence
  chemically synthesized
tctttaatcttcaaaaaagtga

SEQ ID NO: 106084 - DNA, 22 bp, Artificial Sequence
  chemically synthesized
taatcttcaaaaaagtgagtcc

SEQ ID NO: 106085 - DNA, 22 bp, Artificial Sequence
  chemically synthesized
aatcttcaaaaaagtgagtcct

SEQ ID NO: 106086 - DNA, 22 bp, Artificial Sequence
  chemically synthesized
atcttcaaaaaagtgagtcctc

SEQ ID NO: 106087 - DNA, 22 bp, Artificial Sequence
  chemically synthesized
caaaaaagtgagtcctccattt

SEQ ID NO: 106088 - DNA, 22 bp, Artificial Sequence
  chemically synthesized
aaaaaagtgagtcctccatttg

SEQ ID NO: 106089 - DNA, 22 bp, Artificial Sequence
  chemically synthesized
catttggccccagtcctgaggg

SEQ ID NO: 106090 - DNA, 22 bp, Artificial Sequence
  chemically synthesized
ggccccagtcctgagggcctga

SEQ ID NO: 106091 - DNA, 22 bp, Artificial Sequence
  chemically synthesized
gccccagtcctgagggcctgac

SEQ ID NO: 106092 - DNA, 22 bp, Artificial Sequence
  chemically synthesized
agggcctgacagttgggactac

SEQ ID NO: 106093 - DNA, 22 bp, Artificial Sequence
  chemically synthesized
acagttgggactacccaactct

SEQ ID NO: 106094 - DNA, 22 bp, Artificial Sequence
  chemically synthesized
ggactacccaactctcagattt

SEQ ID NO: 106095 - DNA, 22 bp, Artificial Sequence
  chemically synthesized
cccaactctcagatttctattg

SEQ ID NO: 106096 - DNA, 22 bp, Artificial Sequence
  chemically synthesized
tcagatttctattgtccacaag

SEQ ID NO: 106097 - DNA, 22 bp, Artificial Sequence
  chemically synthesized
agatttctattgtccacaagtt

SEQ ID NO: 106098 - DNA, 22 bp, Artificial Sequence
  chemically synthesized
ctattgtccacaagttaaattc

SEQ ID NO: 106099 - DNA, 22 bp, Artificial Sequence
  chemically synthesized
tattgtccacaagttaaattcc

SEQ ID NO: 106100 - DNA, 22 bp, Artificial Sequence
  chemically synthesized
ttgtccacaagttaaattcctc

SEQ ID NO: 106101 - DNA, 22 bp, Artificial Sequence
  chemically synthesized
tccacaagttaaattcctcctg

SEQ ID NO: 106102 - DNA, 22 bp, Artificial Sequence
  chemically synthesized
aattcctcctgccttctccaac

SEQ ID NO: 106103 - DNA, 22 bp, Artificial Sequence
  chemically synthesized
ctcctgccttctccaacccagt

SEQ ID NO: 106104 - DNA, 22 bp, Artificial Sequence
  chemically synthesized
ctgccttctccaacccagtcca

SEQ ID NO: 106105 - DNA, 22 bp, Artificial Sequence
  chemically synthesized
ccttctccaacccagtccaata

SEQ ID NO: 106106 - DNA, 22 bp, Artificial Sequence
  chemically synthesized
ctccaacccagtccaatatatt

SEQ ID NO: 106107 - DNA, 22 bp, Artificial Sequence
  chemically synthesized
tccaacccagtccaatatatta

SEQ ID NO: 106108 - DNA, 22 bp, Artificial Sequence
  chemically synthesized
caacccagtccaatatattatc

SEQ ID NO: 106109 - DNA, 22 bp, Artificial Sequence
  chemically synthesized
tcatctgccatcaatatgattt

SEQ ID NO: 106110 - DNA, 22 bp, Artificial Sequence
  chemically synthesized
ccatcaatatgatttcattttc

SEQ ID NO: 106111 - DNA, 22 bp, Artificial Sequence
  chemically synthesized
cattttcaatccaatttgcttt

SEQ ID NO: 106112 - DNA, 22 bp, Artificial Sequence
  chemically synthesized
attttcaatccaatttgctttc

SEQ ID NO: 106113 - DNA, 22 bp, Artificial Sequence
  chemically synthesized
tcaatccaatttgctttcttag

SEQ ID NO: 106114 - DNA, 22 bp, Artificial Sequence
  chemically synthesized
caatccaatttgctttcttaga

SEQ ID NO: 106115 - DNA, 22 bp, Artificial Sequence
  chemically synthesized
aatccaatttgctttcttagat

SEQ ID NO: 106116 - DNA, 22 bp, Artificial Sequence
  chemically synthesized
gctttcttagatcttaatttgg

SEQ ID NO: 106117 - DNA, 22 bp, Artificial Sequence
  chemically synthesized
ctttcttagatcttaatttggc

SEQ ID NO: 106118 - DNA, 22 bp, Artificial Sequence
  chemically synthesized
tcttagatcttaatttggctgc

SEQ ID NO: 106119 - DNA, 22 bp, Artificial Sequence
  chemically synthesized
cttagatcttaatttggctgcc

SEQ ID NO: 106120 - DNA, 22 bp, Artificial Sequence
  chemically synthesized
ttagatcttaatttggctgccc

SEQ ID NO: 106121 - DNA, 22 bp, Artificial Sequence
  chemically synthesized
agatcttaatttggctgccctt

SEQ ID NO: 106122 - DNA, 22 bp, Artificial Sequence
  chemically synthesized
gatcttaatttggctgcccttt

SEQ ID NO: 106123 - DNA, 22 bp, Artificial Sequence
  chemically synthesized
aatttggctgcccttttctaag

SEQ ID NO: 106124 - DNA, 22 bp, Artificial Sequence
  chemically synthesized
atttggctgcccttttctaagc

SEQ ID NO: 106125 - DNA, 22 bp, Artificial Sequence
  chemically synthesized
ggctgcccttttctaagccttt

SEQ ID NO: 106126 - DNA, 22 bp, Artificial Sequence
  chemically synthesized
gctgcccttttctaagcctttc

SEQ ID NO: 106127 - DNA, 22 bp, Artificial Sequence
  chemically synthesized
cccttttctaagcctttcaact

SEQ ID NO: 106128 - DNA, 22 bp, Artificial Sequence
  chemically synthesized
ttctaagcctttcaactcgatt

SEQ ID NO: 106129 - DNA, 22 bp, Artificial Sequence
  chemically synthesized
tctaagcctttcaactcgattc

SEQ ID NO: 106130 - DNA, 22 bp, Artificial Sequence
  chemically synthesized
ctaagcctttcaactcgattca

SEQ ID NO: 106131 - DNA, 22 bp, Artificial Sequence
  chemically synthesized
taagcctttcaactcgattcag

SEQ ID NO: 106132 - DNA, 22 bp, Artificial Sequence
  chemically synthesized
agcctttcaactcgattcagaa

SEQ ID NO: 106133 - DNA, 22 bp, Artificial Sequence
  chemically synthesized
tcaactcgattcagaatttttt

SEQ ID NO: 106134 - DNA, 22 bp, Artificial Sequence
  chemically synthesized
caactcgattcagaattttttg

SEQ ID NO: 106135 - DNA, 22 bp, Artificial Sequence
  chemically synthesized
aactcgattcagaattttttgt

SEQ ID NO: 106136 - DNA, 22 bp, Artificial Sequence
  chemically synthesized
gattcagaattttttgtctact

SEQ ID NO: 106137 - DNA, 22 bp, Artificial Sequence
  chemically synthesized
agaattttttgtctactcttca

SEQ ID NO: 106138 - DNA, 22 bp, Artificial Sequence
  chemically synthesized
tttgtctactcttcagagaaaa

SEQ ID NO: 106139 - DNA, 22 bp, Artificial Sequence
  chemically synthesized
ttgtctactcttcagagaaaaa

SEQ ID NO: 106140 - DNA, 22 bp, Artificial Sequence
  chemically synthesized
tgtctactcttcagagaaaaac

SEQ ID NO: 106141 - DNA, 22 bp, Artificial Sequence
  chemically synthesized
gtctactcttcagagaaaaact

SEQ ID NO: 106142 - DNA, 22 bp, Artificial Sequence
  chemically synthesized
tctactcttcagagaaaaacta

SEQ ID NO: 106143 - DNA, 22 bp, Artificial Sequence
  chemically synthesized
ctcttcagagaaaaactatcaa

SEQ ID NO: 106144 - DNA, 22 bp, Artificial Sequence
  chemically synthesized
ttcagagaaaaactatcaacaa

SEQ ID NO: 106145 - DNA, 22 bp, Artificial Sequence
  chemically synthesized
cagagaaaaactatcaacaaaa

SEQ ID NO: 106146 - DNA, 22 bp, Artificial Sequence
  chemically synthesized
agagaaaaactatcaacaaaaa

SEQ ID NO: 106147 - DNA, 22 bp, Artificial Sequence
  chemically synthesized
tcaacaaaaaatcctctgaaca

SEQ ID NO: 106148 - DNA, 22 bp, Artificial Sequence
  chemically synthesized
tgaacaggaaagttatcaataa

SEQ ID NO: 106149 - DNA, 22 bp, Artificial Sequence
  chemically synthesized
aacaggaaagttatcaataaaa

SEQ ID NO: 106150 - DNA, 22 bp, Artificial Sequence
  chemically synthesized
tcaataaaaaataaacgtaaaa

SEQ ID NO: 106151 - DNA, 22 bp, Artificial Sequence
  chemically synthesized
tctggataaacaaaaactgagt

SEQ ID NO: 106152 - DNA, 22 bp, Artificial Sequence
  chemically synthesized
ctggataaacaaaaactgagtt

SEQ ID NO: 106153 - DNA, 22 bp, Artificial Sequence
  chemically synthesized
tggataaacaaaaactgagttg

SEQ ID NO: 106154 - DNA, 22 bp, Artificial Sequence
  chemically synthesized
gataaacaaaaactgagttgat

SEQ ID NO: 106155 - DNA, 22 bp, Artificial Sequence
  chemically synthesized
agttgatttcaactaagttgaa

SEQ ID NO: 106156 - DNA, 22 bp, Artificial Sequence
  chemically synthesized
atttcaactaagttgaaaccaa

SEQ ID NO: 106157 - DNA, 22 bp, Artificial Sequence
  chemically synthesized
caactaagttgaaaccaaatga

SEQ ID NO: 106158 - DNA, 22 bp, Artificial Sequence
  chemically synthesized
aactaagttgaaaccaaatgac

SEQ ID NO: 106159 - DNA, 22 bp, Artificial Sequence
  chemically synthesized
agttgaaaccaaatgaccaaag

SEQ ID NO: 106160 - DNA, 22 bp, Artificial Sequence
  chemically synthesized
aaaccaaatgaccaaagatgat

SEQ ID NO: 106161 - DNA, 22 bp, Artificial Sequence
  chemically synthesized
gaatctacataaaatgacaaaa

SEQ ID NO: 106162 - DNA, 22 bp, Artificial Sequence
  chemically synthesized
aatctacataaaatgacaaaag

SEQ ID NO: 106163 - DNA, 22 bp, Artificial Sequence
  chemically synthesized
cataaaatgacaaaagcaccag

SEQ ID NO: 106164 - DNA, 22 bp, Artificial Sequence
  chemically synthesized
tagaagacattatgcatacata

SEQ ID NO: 106165 - DNA, 22 bp, Artificial Sequence
  chemically synthesized
tgcatacatattcctttctgct

SEQ ID NO: 106166 - DNA, 22 bp, Artificial Sequence
  chemically synthesized
ctttctgcttcttattttcaaa

SEQ ID NO: 106167 - DNA, 22 bp, Artificial Sequence
  chemically synthesized
tctgcttcttattttcaaaaat

SEQ ID NO: 106168 - DNA, 22 bp, Artificial Sequence
  chemically synthesized
ctgcttcttattttcaaaaatg

SEQ ID NO: 106169 - DNA, 22 bp, Artificial Sequence
  chemically synthesized
tgcttcttattttcaaaaatga

SEQ ID NO: 106170 - DNA, 22 bp, Artificial Sequence
  chemically synthesized
cttcttattttcaaaaatgaat

SEQ ID NO: 106171 - DNA, 22 bp, Artificial Sequence
  chemically synthesized
cttattttcaaaaatgaatgta

SEQ ID NO: 106172 - DNA, 22 bp, Artificial Sequence
  chemically synthesized
ttattttcaaaaatgaatgtat

SEQ ID NO: 106173 - DNA, 22 bp, Artificial Sequence
  chemically synthesized
attttcaaaaatgaatgtatta

SEQ ID NO: 106174 - DNA, 22 bp, Artificial Sequence
  chemically synthesized
ttttcaaaaatgaatgtattac

SEQ ID NO: 106175 - DNA, 22 bp, Artificial Sequence
  chemically synthesized
tcaaaaatgaatgtattacaat

SEQ ID NO: 106176 - DNA, 22 bp, Artificial Sequence
  chemically synthesized
caaaaatgaatgtattacaata

SEQ ID NO: 106177 - DNA, 22 bp, Artificial Sequence
  chemically synthesized
aaaaatgaatgtattacaataa

SEQ ID NO: 106178 - DNA, 22 bp, Artificial Sequence
  chemically synthesized
caataaaaaatagaattgcatt

SEQ ID NO: 106179 - DNA, 22 bp, Artificial Sequence
  chemically synthesized
cattgctggaactattacaaat

SEQ ID NO: 106180 - DNA, 22 bp, Artificial Sequence
  chemically synthesized
ctggaactattacaaatataaa

SEQ ID NO: 106181 - DNA, 22 bp, Artificial Sequence
  chemically synthesized
gaactattacaaatataaatgt

SEQ ID NO: 106182 - DNA, 22 bp, Artificial Sequence
  chemically synthesized
ttacaaatataaatgtaatata

SEQ ID NO: 106183 - DNA, 22 bp, Artificial Sequence
  chemically synthesized
caaatataaatgtaatatattt

SEQ ID NO: 106184 - DNA, 22 bp, Artificial Sequence
  chemically synthesized
accaataactgaacaaaggagg

SEQ ID NO: 106185 - DNA, 22 bp, Artificial Sequence
  chemically synthesized
ccaataactgaacaaaggaggt

SEQ ID NO: 106186 - DNA, 22 bp, Artificial Sequence
  chemically synthesized
aacaaaggaggtgagtgataac

SEQ ID NO: 106187 - DNA, 22 bp, Artificial Sequence
  chemically synthesized
ttttggaatgaagaaatattct

SEQ ID NO: 106188 - DNA, 22 bp, Artificial Sequence
  chemically synthesized
tggaatgaagaaatattctctg

SEQ ID NO: 106189 - DNA, 22 bp, Artificial Sequence
  chemically synthesized
ggaatgaagaaatattctctga

SEQ ID NO: 106190 - DNA, 22 bp, Artificial Sequence
  chemically synthesized
gaatgaagaaatattctctgaa

SEQ ID NO: 106191 - DNA, 22 bp, Artificial Sequence
  chemically synthesized
tctgaaaaaaaagctataaaca

SEQ ID NO: 106192 - DNA, 22 bp, Artificial Sequence
  chemically synthesized
tgaaaaaaaagctataaacatc

SEQ ID NO: 106193 - DNA, 22 bp, Artificial Sequence
  chemically synthesized
aaaaaaaagctataaacatcta

SEQ ID NO: 106194 - DNA, 22 bp, Artificial Sequence
  chemically synthesized
taaacatctacatagaaaaatg

SEQ ID NO: 106195 - DNA, 22 bp, Artificial Sequence
  chemically synthesized
catagaaaaatgagtaagaatg

SEQ ID NO: 106196 - DNA, 22 bp, Artificial Sequence
  chemically synthesized
tgagcattaacaattatactta

SEQ ID NO: 106197 - DNA, 22 bp, Artificial Sequence
  chemically synthesized
agcattaacaattatacttatg

SEQ ID NO: 106198 - DNA, 22 bp, Artificial Sequence
  chemically synthesized
acaattatacttatgccaatcc

SEQ ID NO: 106199 - DNA, 22 bp, Artificial Sequence
  chemically synthesized
tacttatgccaatccaagggtc

SEQ ID NO: 106200 - DNA, 22 bp, Artificial Sequence
  chemically synthesized
atgccaatccaagggtcccaga

SEQ ID NO: 106201 - DNA, 22 bp, Artificial Sequence
  chemically synthesized
tgccaatccaagggtcccagat

SEQ ID NO: 106202 - DNA, 22 bp, Artificial Sequence
  chemically synthesized
gaaaacctaaatctatcacagt

SEQ ID NO: 106203 - DNA, 22 bp, Artificial Sequence
  chemically synthesized
aatctatcacagttccttaaat

SEQ ID NO: 106204 - DNA, 22 bp, Artificial Sequence
  chemically synthesized
tcacagttccttaaatactctt

SEQ ID NO: 106205 - DNA, 22 bp, Artificial Sequence
  chemically synthesized
cttaaatactctttcaaaaaag

SEQ ID NO: 106206 - DNA, 22 bp, Artificial Sequence
  chemically synthesized
aaatactctttcaaaaaagaaa

SEQ ID NO: 106207 - DNA, 22 bp, Artificial Sequence
  chemically synthesized
aatactctttcaaaaaagaaaa

SEQ ID NO: 106208 - DNA, 22 bp, Artificial Sequence
  chemically synthesized
tttcaaaaaagaaaaaaaaaaa

SEQ ID NO: 106209 - DNA, 22 bp, Artificial Sequence
  chemically synthesized
tcaaaaaagaaaaaaaaaaatc

SEQ ID NO: 106210 - DNA, 22 bp, Artificial Sequence
  chemically synthesized
caaaaaagaaaaaaaaaaatct

SEQ ID NO: 106211 - DNA, 22 bp, Artificial Sequence
  chemically synthesized
aaaaaagaaaaaaaaaaatctg

SEQ ID NO: 106212 - DNA, 22 bp, Artificial Sequence
  chemically synthesized
tgctgtaggatatcccacctca

SEQ ID NO: 106213 - DNA, 22 bp, Artificial Sequence
  chemically synthesized
taggatatcccacctcagctgt

SEQ ID NO: 106214 - DNA, 22 bp, Artificial Sequence
  chemically synthesized
agctgtgatctttacctctagg

SEQ ID NO: 106215 - DNA, 22 bp, Artificial Sequence
  chemically synthesized
tgatctttacctctaggcagac

SEQ ID NO: 106216 - DNA, 22 bp, Artificial Sequence
  chemically synthesized
tacctctaggcagacctctgga

SEQ ID NO: 106217 - DNA, 22 bp, Artificial Sequence
  chemically synthesized
acctctaggcagacctctggaa

SEQ ID NO: 106218 - DNA, 22 bp, Artificial Sequence
  chemically synthesized
cctctaggcagacctctggaaa

SEQ ID NO: 106219 - DNA, 22 bp, Artificial Sequence
  chemically synthesized
taggcagacctctggaaaacct

SEQ ID NO: 106220 - DNA, 22 bp, Artificial Sequence
  chemically synthesized
ggcagacctctggaaaaccttc

SEQ ID NO: 106221 - DNA, 22 bp, Artificial Sequence
  chemically synthesized
tggaaaaccttcttatatgctt

SEQ ID NO: 106222 - DNA, 22 bp, Artificial Sequence
  chemically synthesized
gaaaaccttcttatatgctttc

SEQ ID NO: 106223 - DNA, 22 bp, Artificial Sequence
  chemically synthesized
cttatatgctttccttgagtgc

SEQ ID NO: 106224 - DNA, 22 bp, Artificial Sequence
  chemically synthesized
ttatatgctttccttgagtgca

SEQ ID NO: 106225 - DNA, 22 bp, Artificial Sequence
  chemically synthesized
atatgctttccttgagtgcatc

SEQ ID NO: 106226 - DNA, 22 bp, Artificial Sequence
  chemically synthesized
tatgctttccttgagtgcatct

SEQ ID NO: 106227 - DNA, 22 bp, Artificial Sequence
  chemically synthesized
tccttgagtgcatctcacatca

SEQ ID NO: 106228 - DNA, 22 bp, Artificial Sequence
  chemically synthesized
ccttgagtgcatctcacatcag

SEQ ID NO: 106229 - DNA, 22 bp, Artificial Sequence
  chemically synthesized
cttgagtgcatctcacatcaga

SEQ ID NO: 106230 - DNA, 22 bp, Artificial Sequence
  chemically synthesized
gagtgcatctcacatcagaaga

SEQ ID NO: 106231 - DNA, 22 bp, Artificial Sequence
  chemically synthesized
agtgcatctcacatcagaagag

SEQ ID NO: 106232 - DNA, 22 bp, Artificial Sequence
  chemically synthesized
acatcagaagagagaggaatca

SEQ ID NO: 106233 - DNA, 22 bp, Artificial Sequence
  chemically synthesized
catattcaagttcctggcactc

SEQ ID NO: 106234 - DNA, 22 bp, Artificial Sequence
  chemically synthesized
aagttcctggcactcacccact

SEQ ID NO: 106235 - DNA, 22 bp, Artificial Sequence
  chemically synthesized
ctggcactcacccactcacagt

SEQ ID NO: 106236 - DNA, 22 bp, Artificial Sequence
  chemically synthesized
gcactcacccactcacagtatt

SEQ ID NO: 106237 - DNA, 22 bp, Artificial Sequence
  chemically synthesized
acccactcacagtattgtggct

SEQ ID NO: 106238 - DNA, 22 bp, Artificial Sequence
  chemically synthesized
acagtattgtggctaaaatagg

SEQ ID NO: 106239 - DNA, 22 bp, Artificial Sequence
  chemically synthesized
tggctaaaataggaacctattc

SEQ ID NO: 106240 - DNA, 22 bp, Artificial Sequence
  chemically synthesized
aaataggaacctattcctgtcc

SEQ ID NO: 106241 - DNA, 22 bp, Artificial Sequence
  chemically synthesized
ttcctgtcctctttgaggactc

SEQ ID NO: 106242 - DNA, 22 bp, Artificial Sequence
  chemically synthesized
ctgtcctctttgaggactcagt

SEQ ID NO: 106243 - DNA, 22 bp, Artificial Sequence
  chemically synthesized
tcctctttgaggactcagttca

SEQ ID NO: 106244 - DNA, 22 bp, Artificial Sequence
  chemically synthesized
tttgaggactcagttcagatca

SEQ ID NO: 106245 - DNA, 22 bp, Artificial Sequence
  chemically synthesized
tgaggactcagttcagatcatt

SEQ ID NO: 106246 - DNA, 22 bp, Artificial Sequence
  chemically synthesized
gaggactcagttcagatcattc

SEQ ID NO: 106247 - DNA, 22 bp, Artificial Sequence
  chemically synthesized
aggactcagttcagatcattca

SEQ ID NO: 106248 - DNA, 22 bp, Artificial Sequence
  chemically synthesized
agttcagatcattcactcacag

SEQ ID NO: 106249 - DNA, 22 bp, Artificial Sequence
  chemically synthesized
agatcattcactcacagacctc

SEQ ID NO: 106250 - DNA, 22 bp, Artificial Sequence
  chemically synthesized
actcacagacctctcatgaggc

SEQ ID NO: 106251 - DNA, 22 bp, Artificial Sequence
  chemically synthesized
acagacctctcatgaggcctca

SEQ ID NO: 106252 - DNA, 22 bp, Artificial Sequence
  chemically synthesized
tcatgaggcctcattttaaagc

SEQ ID NO: 106253 - DNA, 22 bp, Artificial Sequence
  chemically synthesized
atgaggcctcattttaaagctt

SEQ ID NO: 106254 - DNA, 22 bp, Artificial Sequence
  chemically synthesized
attttaaagcttatgcatgtgg

SEQ ID NO: 106255 - DNA, 22 bp, Artificial Sequence
  chemically synthesized
taaagcttatgcatgtggaaat

SEQ ID NO: 106256 - DNA, 22 bp, Artificial Sequence
  chemically synthesized
aaagcttatgcatgtggaaatc

SEQ ID NO: 106257 - DNA, 22 bp, Artificial Sequence
  chemically synthesized
aagcttatgcatgtggaaatca

SEQ ID NO: 106258 - DNA, 22 bp, Artificial Sequence
  chemically synthesized
atgcatgtggaaatcacctccc

SEQ ID NO: 106259 - DNA, 22 bp, Artificial Sequence
  chemically synthesized
tgcatgtggaaatcacctcccc

SEQ ID NO: 106260 - DNA, 22 bp, Artificial Sequence
  chemically synthesized
ccctgagtttcatctttctagc

SEQ ID NO: 106261 - DNA, 22 bp, Artificial Sequence
  chemically synthesized
agtttcatctttctagcatctc

SEQ ID NO: 106262 - DNA, 22 bp, Artificial Sequence
  chemically synthesized
catctttctagcatctcaggag

SEQ ID NO: 106263 - DNA, 22 bp, Artificial Sequence
  chemically synthesized
atctttctagcatctcaggaga

SEQ ID NO: 106264 - DNA, 22 bp, Artificial Sequence
  chemically synthesized
tctagcatctcaggagacccct

SEQ ID NO: 106265 - DNA, 22 bp, Artificial Sequence
  chemically synthesized
ctagcatctcaggagacccctt

SEQ ID NO: 106266 - DNA, 22 bp, Artificial Sequence
  chemically synthesized
tagcatctcaggagaccccttg

SEQ ID NO: 106267 - DNA, 22 bp, Artificial Sequence
  chemically synthesized
gcatctcaggagaccccttgat

SEQ ID NO: 106268 - DNA, 22 bp, Artificial Sequence
  chemically synthesized
aggagaccccttgatctccctt

SEQ ID NO: 106269 - DNA, 22 bp, Artificial Sequence
  chemically synthesized
gatctcccttccctctcttctc

SEQ ID NO: 106270 - DNA, 22 bp, Artificial Sequence
  chemically synthesized
atctcccttccctctcttctct

SEQ ID NO: 106271 - DNA, 22 bp, Artificial Sequence
  chemically synthesized
ccttccctctcttctctgttcg

SEQ ID NO: 106272 - DNA, 22 bp, Artificial Sequence
  chemically synthesized
ccctctcttctctgttcgggag

SEQ ID NO: 106273 - DNA, 22 bp, Artificial Sequence
  chemically synthesized
cctctcttctctgttcgggagg

SEQ ID NO: 106274 - DNA, 22 bp, Artificial Sequence
  chemically synthesized
tcttctctgttcgggaggaaca

SEQ ID NO: 106275 - DNA, 22 bp, Artificial Sequence
  chemically synthesized
ttctctgttcgggaggaacagg

SEQ ID NO: 106276 - DNA, 22 bp, Artificial Sequence
  chemically synthesized
ctctgttcgggaggaacagggc

SEQ ID NO: 106277 - DNA, 22 bp, Artificial Sequence
  chemically synthesized
tctgttcgggaggaacagggcc

SEQ ID NO: 106278 - DNA, 22 bp, Artificial Sequence
  chemically synthesized
tgttcgggaggaacagggcccc

SEQ ID NO: 106279 - DNA, 22 bp, Artificial Sequence
  chemically synthesized
ttcgggaggaacagggccccac

SEQ ID NO: 106280 - DNA, 22 bp, Artificial Sequence
  chemically synthesized
gggaggaacagggccccacaac

SEQ ID NO: 106281 - DNA, 22 bp, Artificial Sequence
  chemically synthesized
atgtcctcgggattttcaggtg

SEQ ID NO: 106282 - DNA, 22 bp, Artificial Sequence
  chemically synthesized
gggattttcaggtgtttcctga

SEQ ID NO: 106283 - DNA, 22 bp, Artificial Sequence
  chemically synthesized
tcaggtgtttcctgaagaatgg

SEQ ID NO: 106284 - DNA, 22 bp, Artificial Sequence
  chemically synthesized
caggtgtttcctgaagaatggg

SEQ ID NO: 106285 - DNA, 22 bp, Artificial Sequence
  chemically synthesized
aggtgtttcctgaagaatgggg

SEQ ID NO: 106286 - DNA, 22 bp, Artificial Sequence
  chemically synthesized
cctgaagaatggggtgaggaaa

SEQ ID NO: 106287 - DNA, 22 bp, Artificial Sequence
  chemically synthesized
ctgaagaatggggtgaggaaaa

SEQ ID NO: 106288 - DNA, 22 bp, Artificial Sequence
  chemically synthesized
aagaatggggtgaggaaaattt

SEQ ID NO: 106289 - DNA, 22 bp, Artificial Sequence
  chemically synthesized
gaaattcaaaaaccagctgatg

SEQ ID NO: 106290 - DNA, 22 bp, Artificial Sequence
  chemically synthesized
aaattcaaaaaccagctgatgt

SEQ ID NO: 106291 - DNA, 22 bp, Artificial Sequence
  chemically synthesized
aaaaaccagctgatgtaagata

SEQ ID NO: 106292 - DNA, 22 bp, Artificial Sequence
  chemically synthesized
atgtaagatagggataccaggg

SEQ ID NO: 106293 - DNA, 22 bp, Artificial Sequence
  chemically synthesized
ggttatgtgacccaaggaggct

SEQ ID NO: 106294 - DNA, 22 bp, Artificial Sequence
  chemically synthesized
gttatgtgacccaaggaggctc

SEQ ID NO: 106295 - DNA, 22 bp, Artificial Sequence
  chemically synthesized
tgtgacccaaggaggctcagca

SEQ ID NO: 106296 - DNA, 22 bp, Artificial Sequence
  chemically synthesized
agcatcataacttagtttattt

SEQ ID NO: 106297 - DNA, 22 bp, Artificial Sequence
  chemically synthesized
agtttatttgaaagggttaggg

SEQ ID NO: 106298 - DNA, 22 bp, Artificial Sequence
  chemically synthesized
gtttatttgaaagggttagggg

SEQ ID NO: 106299 - DNA, 22 bp, Artificial Sequence
  chemically synthesized
atttgaaagggttaggggatat

SEQ ID NO: 106300 - DNA, 22 bp, Artificial Sequence
  chemically synthesized
tttgaaagggttaggggatatc

SEQ ID NO: 106301 - DNA, 22 bp, Artificial Sequence
  chemically synthesized
gaaagggttaggggatatcggt

SEQ ID NO: 106302 - DNA, 22 bp, Artificial Sequence
  chemically synthesized
aaagggttaggggatatcggtt

SEQ ID NO: 106303 - DNA, 22 bp, Artificial Sequence
  chemically synthesized
ggggatatcggttgtcttcagg

SEQ ID NO: 106304 - DNA, 22 bp, Artificial Sequence
  chemically synthesized
tcttcagggatcatatgtacct

SEQ ID NO: 106305 - DNA, 22 bp, Artificial Sequence
  chemically synthesized
cagggatcatatgtacctctac

SEQ ID NO: 106306 - DNA, 22 bp, Artificial Sequence
  chemically synthesized
agggatcatatgtacctctacg

SEQ ID NO: 106307 - DNA, 22 bp, Artificial Sequence
  chemically synthesized
tacgggtcctagagcttatgaa

SEQ ID NO: 106308 - DNA, 22 bp, Artificial Sequence
  chemically synthesized
cgggtcctagagcttatgaatt

SEQ ID NO: 106309 - DNA, 22 bp, Artificial Sequence
  chemically synthesized
gagcttatgaattccaattgcg

SEQ ID NO: 106310 - DNA, 22 bp, Artificial Sequence
  chemically synthesized
atgaattccaattgcgtttttg

SEQ ID NO: 106311 - DNA, 22 bp, Artificial Sequence
  chemically synthesized
tgaattccaattgcgtttttgt

SEQ ID NO: 106312 - DNA, 22 bp, Artificial Sequence
  chemically synthesized
caattgcgtttttgtctttcct

SEQ ID NO: 106313 - DNA, 22 bp, Artificial Sequence
  chemically synthesized
cgtttttgtctttcctgttact

SEQ ID NO: 106314 - DNA, 22 bp, Artificial Sequence
  chemically synthesized
ttgtctttcctgttactttggt

SEQ ID NO: 106315 - DNA, 22 bp, Artificial Sequence
  chemically synthesized
tgtctttcctgttactttggta

SEQ ID NO: 106316 - DNA, 22 bp, Artificial Sequence
  chemically synthesized
gtctttcctgttactttggtaa

SEQ ID NO: 106317 - DNA, 22 bp, Artificial Sequence
  chemically synthesized
tctttcctgttactttggtaaa

SEQ ID NO: 106318 - DNA, 22 bp, Artificial Sequence
  chemically synthesized
tcctgttactttggtaaaattt

SEQ ID NO: 106319 - DNA, 22 bp, Artificial Sequence
  chemically synthesized
cctgttactttggtaaaatttg

SEQ ID NO: 106320 - DNA, 22 bp, Artificial Sequence
  chemically synthesized
ctgttactttggtaaaatttgt

SEQ ID NO: 106321 - DNA, 22 bp, Artificial Sequence
  chemically synthesized
ttactttggtaaaatttgttct

SEQ ID NO: 106322 - DNA, 22 bp, Artificial Sequence
  chemically synthesized
ctttggtaaaatttgttcttat

SEQ ID NO: 106323 - DNA, 22 bp, Artificial Sequence
  chemically synthesized
tggtaaaatttgttcttatcta

SEQ ID NO: 106324 - DNA, 22 bp, Artificial Sequence
  chemically synthesized
ggtaaaatttgttcttatctac

SEQ ID NO: 106325 - DNA, 22 bp, Artificial Sequence
  chemically synthesized
gtaaaatttgttcttatctact

SEQ ID NO: 106326 - DNA, 22 bp, Artificial Sequence
  chemically synthesized
gttcttatctactggaacttca

SEQ ID NO: 106327 - DNA, 22 bp, Artificial Sequence
  chemically synthesized
ttcttatctactggaacttcaa

SEQ ID NO: 106328 - DNA, 22 bp, Artificial Sequence
  chemically synthesized
ttatctactggaacttcaatgg

SEQ ID NO: 106329 - DNA, 22 bp, Artificial Sequence
  chemically synthesized
atctactggaacttcaatggat

SEQ ID NO: 106330 - DNA, 22 bp, Artificial Sequence
  chemically synthesized
tctactggaacttcaatggatc

SEQ ID NO: 106331 - DNA, 22 bp, Artificial Sequence
  chemically synthesized
ctggaacttcaatggatctgtt

SEQ ID NO: 106332 - DNA, 22 bp, Artificial Sequence
  chemically synthesized
gaacttcaatggatctgttaat

SEQ ID NO: 106333 - DNA, 22 bp, Artificial Sequence
  chemically synthesized
caatggatctgttaatagtcat

SEQ ID NO: 106334 - DNA, 22 bp, Artificial Sequence
  chemically synthesized
aatggatctgttaatagtcatg

SEQ ID NO: 106335 - DNA, 22 bp, Artificial Sequence
  chemically synthesized
ttaatagtcatgcagattcatg

SEQ ID NO: 106336 - DNA, 22 bp, Artificial Sequence
  chemically synthesized
atagtcatgcagattcatgaca

SEQ ID NO: 106337 - DNA, 22 bp, Artificial Sequence
  chemically synthesized
atgacattcagctttttttttt

SEQ ID NO: 106338 - DNA, 22 bp, Artificial Sequence
  chemically synthesized
agcttttttttttttttttttt

SEQ ID NO: 106339 - DNA, 22 bp, Artificial Sequence
  chemically synthesized
tttttttttttttttttttttt

SEQ ID NO: 106340 - DNA, 22 bp, Artificial Sequence
  chemically synthesized
tttttttttttttttttttttt

SEQ ID NO: 106341 - DNA, 22 bp, Artificial Sequence
  chemically synthesized
tttttttttttttttttttttt

SEQ ID NO: 106342 - DNA, 22 bp, Artificial Sequence
  chemically synthesized
tttttttttttttttttttttt

SEQ ID NO: 106343 - DNA, 22 bp, Artificial Sequence
  chemically synthesized
tttttttttttttttttttttt

SEQ ID NO: 106344 - DNA, 22 bp, Artificial Sequence
  chemically synthesized
ttttttttttttttttttttta

SEQ ID NO: 106345 - DNA, 22 bp, Artificial Sequence
  chemically synthesized
ttttttttttttttttttttag

SEQ ID NO: 106346 - DNA, 22 bp, Artificial Sequence
  chemically synthesized
tttttttttttttttttttaga

SEQ ID NO: 106347 - DNA, 22 bp, Artificial Sequence
  chemically synthesized
ttttttttttttttttttagat

SEQ ID NO: 106348 - DNA, 22 bp, Artificial Sequence
  chemically synthesized
tttttttttttttttttagata

SEQ ID NO: 106349 - DNA, 22 bp, Artificial Sequence
  chemically synthesized
ttttttttttttttttagatag

SEQ ID NO: 106350 - DNA, 22 bp, Artificial Sequence
  chemically synthesized
tttttttttttttttagataga

SEQ ID NO: 106351 - DNA, 22 bp, Artificial Sequence
  chemically synthesized
ttttttttttttttagatagag

SEQ ID NO: 106352 - DNA, 22 bp, Artificial Sequence
  chemically synthesized
tttttttttttttagatagagt

SEQ ID NO: 106353 - DNA, 22 bp, Artificial Sequence
  chemically synthesized
ttttttttttttagatagagtc

SEQ ID NO: 106354 - DNA, 22 bp, Artificial Sequence
  chemically synthesized
tttttttttttagatagagtct

SEQ ID NO: 106355 - DNA, 22 bp, Artificial Sequence
  chemically synthesized
ttttttttttagatagagtctc

SEQ ID NO: 106356 - DNA, 22 bp, Artificial Sequence
  chemically synthesized
tttttttttagatagagtctca

SEQ ID NO: 106357 - DNA, 22 bp, Artificial Sequence
  chemically synthesized
ttttttttagatagagtctcac

SEQ ID NO: 106358 - DNA, 22 bp, Artificial Sequence
  chemically synthesized
tttttttagatagagtctcact

SEQ ID NO: 106359 - DNA, 22 bp, Artificial Sequence
  chemically synthesized
ttttttagatagagtctcactc

SEQ ID NO: 106360 - DNA, 22 bp, Artificial Sequence
  chemically synthesized
tttttagatagagtctcactct

SEQ ID NO: 106361 - DNA, 22 bp, Artificial Sequence
  chemically synthesized
ttttagatagagtctcactctg

SEQ ID NO: 106362 - DNA, 22 bp, Artificial Sequence
  chemically synthesized
tttagatagagtctcactctgt

SEQ ID NO: 106363 - DNA, 22 bp, Artificial Sequence
  chemically synthesized
ttagatagagtctcactctgtc

SEQ ID NO: 106364 - DNA, 22 bp, Artificial Sequence
  chemically synthesized
tagatagagtctcactctgtcg

SEQ ID NO: 106365 - DNA, 22 bp, Artificial Sequence
  chemically synthesized
agatagagtctcactctgtcgc

SEQ ID NO: 106366 - DNA, 22 bp, Artificial Sequence
  chemically synthesized
gatagagtctcactctgtcgcc

SEQ ID NO: 106367 - DNA, 22 bp, Artificial Sequence
  chemically synthesized
actctgtcgccaggctggagtg

SEQ ID NO: 106368 - DNA, 22 bp, Artificial Sequence
  chemically synthesized
tgtcgccaggctggagtgcagt

SEQ ID NO: 106369 - DNA, 22 bp, Artificial Sequence
  chemically synthesized
tcgccaggctggagtgcagtag

SEQ ID NO: 106370 - DNA, 22 bp, Artificial Sequence
  chemically synthesized
gagtgcagtagcacaatctcag

SEQ ID NO: 106371 - DNA, 22 bp, Artificial Sequence
  chemically synthesized
agctcactgcaaactccacctc

SEQ ID NO: 106372 - DNA, 22 bp, Artificial Sequence
  chemically synthesized
actgcaaactccacctcccagg

SEQ ID NO: 106373 - DNA, 22 bp, Artificial Sequence
  chemically synthesized
caaactccacctcccaggttca

SEQ ID NO: 106374 - DNA, 22 bp, Artificial Sequence
  chemically synthesized
cacctcccaggttcaagtgatt

SEQ ID NO: 106375 - DNA, 22 bp, Artificial Sequence
  chemically synthesized
ccaggttcaagtgattctcctg

SEQ ID NO: 106376 - DNA, 22 bp, Artificial Sequence
  chemically synthesized
aagtgattctcctgccacagcc

SEQ ID NO: 106377 - DNA, 22 bp, Artificial Sequence
  chemically synthesized
tcctgccacagcctcctgagaa

SEQ ID NO: 106378 - DNA, 22 bp, Artificial Sequence
  chemically synthesized
ctgccacagcctcctgagaagc

SEQ ID NO: 106379 - DNA, 22 bp, Artificial Sequence
  chemically synthesized
ccacagcctcctgagaagctgg

SEQ ID NO: 106380 - DNA, 22 bp, Artificial Sequence
  chemically synthesized
ctgagaagctgggactacagta

SEQ ID NO: 106381 - DNA, 22 bp, Artificial Sequence
  chemically synthesized
agaagctgggactacagtagcg

SEQ ID NO: 106382 - DNA, 22 bp, Artificial Sequence
  chemically synthesized
ggactacagtagcgcgtcacca

SEQ ID NO: 106383 - DNA, 22 bp, Artificial Sequence
  chemically synthesized
cagtagcgcgtcaccacaccca

SEQ ID NO: 106384 - DNA, 22 bp, Artificial Sequence
  chemically synthesized
atttttgtatttttagtagaca

SEQ ID NO: 106385 - DNA, 22 bp, Artificial Sequence
  chemically synthesized
ttgtatttttagtagacacggg

SEQ ID NO: 106386 - DNA, 22 bp, Artificial Sequence
  chemically synthesized
tgtatttttagtagacacgggg

SEQ ID NO: 106387 - DNA, 22 bp, Artificial Sequence
  chemically synthesized
gtatttttagtagacacggggt

SEQ ID NO: 106388 - DNA, 22 bp, Artificial Sequence
  chemically synthesized
tatttttagtagacacggggtt

SEQ ID NO: 106389 - DNA, 22 bp, Artificial Sequence
  chemically synthesized
ttagtagacacggggtttcacc

SEQ ID NO: 106390 - DNA, 22 bp, Artificial Sequence
  chemically synthesized
tagtagacacggggtttcacca

SEQ ID NO: 106391 - DNA, 22 bp, Artificial Sequence
  chemically synthesized
agtagacacggggtttcaccat

SEQ ID NO: 106392 - DNA, 22 bp, Artificial Sequence
  chemically synthesized
gtagacacggggtttcaccata

SEQ ID NO: 106393 - DNA, 22 bp, Artificial Sequence
  chemically synthesized
caccatattggccaggatggtc

SEQ ID NO: 106394 - DNA, 22 bp, Artificial Sequence
  chemically synthesized
accatattggccaggatggtct

SEQ ID NO: 106395 - DNA, 22 bp, Artificial Sequence
  chemically synthesized
gccaggatggtctcgatctctt

SEQ ID NO: 106396 - DNA, 22 bp, Artificial Sequence
  chemically synthesized
gatctcttgacctcgtgatcca

SEQ ID NO: 106397 - DNA, 22 bp, Artificial Sequence
  chemically synthesized
ttgacctcgtgatccaccctcc

SEQ ID NO: 106398 - DNA, 22 bp, Artificial Sequence
  chemically synthesized
gacctcgtgatccaccctcctt

SEQ ID NO: 106399 - DNA, 22 bp, Artificial Sequence
  chemically synthesized
acctcgtgatccaccctccttg

SEQ ID NO: 106400 - DNA, 22 bp, Artificial Sequence
  chemically synthesized
gtgatccaccctccttggcctc

SEQ ID NO: 106401 - DNA, 22 bp, Artificial Sequence
  chemically synthesized
cttggcctcccaaagtgctggg

SEQ ID NO: 106402 - DNA, 22 bp, Artificial Sequence
  chemically synthesized
ggcctcccaaagtgctgggatt

SEQ ID NO: 106403 - DNA, 22 bp, Artificial Sequence
  chemically synthesized
gcctcccaaagtgctgggattg

SEQ ID NO: 106404 - DNA, 22 bp, Artificial Sequence
  chemically synthesized
ccaaagtgctgggattgcaggt

SEQ ID NO: 106405 - DNA, 22 bp, Artificial Sequence
  chemically synthesized
ggattgcaggtgtgagtcactg

SEQ ID NO: 106406 - DNA, 22 bp, Artificial Sequence
  chemically synthesized
caggtgtgagtcactgcgcccg

SEQ ID NO: 106407 - DNA, 22 bp, Artificial Sequence
  chemically synthesized
cgcccggctgacattcagcttt

SEQ ID NO: 106408 - DNA, 22 bp, Artificial Sequence
  chemically synthesized
acattcagctttttatcttaaa

SEQ ID NO: 106409 - DNA, 22 bp, Artificial Sequence
  chemically synthesized
agctttttatcttaaaattata

SEQ ID NO: 106410 - DNA, 22 bp, Artificial Sequence
  chemically synthesized
tttatcttaaaattatattact

SEQ ID NO: 106411 - DNA, 22 bp, Artificial Sequence
  chemically synthesized
ttatcttaaaattatattactt

SEQ ID NO: 106412 - DNA, 22 bp, Artificial Sequence
  chemically synthesized
tatcttaaaattatattacttg

SEQ ID NO: 106413 - DNA, 22 bp, Artificial Sequence
  chemically synthesized
atcttaaaattatattacttgt

SEQ ID NO: 106414 - DNA, 22 bp, Artificial Sequence
  chemically synthesized
tcttaaaattatattacttgta

SEQ ID NO: 106415 - DNA, 22 bp, Artificial Sequence
  chemically synthesized
aaaattatattacttgtagctc

SEQ ID NO: 106416 - DNA, 22 bp, Artificial Sequence
  chemically synthesized
aaattatattacttgtagctca

SEQ ID NO: 106417 - DNA, 22 bp, Artificial Sequence
  chemically synthesized
tattacttgtagctcattgccc

SEQ ID NO: 106418 - DNA, 22 bp, Artificial Sequence
  chemically synthesized
cttgtagctcattgcccttttt

SEQ ID NO: 106419 - DNA, 22 bp, Artificial Sequence
  chemically synthesized
gtagctcattgccctttttttt

SEQ ID NO: 106420 - DNA, 22 bp, Artificial Sequence
  chemically synthesized
tagctcattgcccttttttttt

SEQ ID NO: 106421 - DNA, 22 bp, Artificial Sequence
  chemically synthesized
attgcccttttttttttttttt

SEQ ID NO: 106422 - DNA, 22 bp, Artificial Sequence
  chemically synthesized
ccctttttttttttttttgcca

SEQ ID NO: 106423 - DNA, 22 bp, Artificial Sequence
  chemically synthesized
tttttttttttttgccagatac

SEQ ID NO: 106424 - DNA, 22 bp, Artificial Sequence
  chemically synthesized
ttttttttttttgccagataca

SEQ ID NO: 106425 - DNA, 22 bp, Artificial Sequence
  chemically synthesized
tttttttttttgccagatacac

SEQ ID NO: 106426 - DNA, 22 bp, Artificial Sequence
  chemically synthesized
ttttttttttgccagatacaca

SEQ ID NO: 106427 - DNA, 22 bp, Artificial Sequence
  chemically synthesized
tttttttttgccagatacacaa

SEQ ID NO: 106428 - DNA, 22 bp, Artificial Sequence
  chemically synthesized
ttttttttgccagatacacaat

SEQ ID NO: 106429 - DNA, 22 bp, Artificial Sequence
  chemically synthesized
tttttttgccagatacacaatg

SEQ ID NO: 106430 - DNA, 22 bp, Artificial Sequence
  chemically synthesized
ttttttgccagatacacaatga

SEQ ID NO: 106431 - DNA, 22 bp, Artificial Sequence
  chemically synthesized
tttttgccagatacacaatgag

SEQ ID NO: 106432 - DNA, 22 bp, Artificial Sequence
  chemically synthesized
ttttgccagatacacaatgagg

SEQ ID NO: 106433 - DNA, 22 bp, Artificial Sequence
  chemically synthesized
tttgccagatacacaatgagga

SEQ ID NO: 106434 - DNA, 22 bp, Artificial Sequence
  chemically synthesized
ttgccagatacacaatgaggag

SEQ ID NO: 106435 - DNA, 22 bp, Artificial Sequence
  chemically synthesized
tgccagatacacaatgaggagc

SEQ ID NO: 106436 - DNA, 22 bp, Artificial Sequence
  chemically synthesized
gccagatacacaatgaggagca

SEQ ID NO: 106437 - DNA, 22 bp, Artificial Sequence
  chemically synthesized
ccagatacacaatgaggagcat

SEQ ID NO: 106438 - DNA, 22 bp, Artificial Sequence
  chemically synthesized
tattcacagaatgtaaatagtg

SEQ ID NO: 106439 - DNA, 22 bp, Artificial Sequence
  chemically synthesized
attcacagaatgtaaatagtgt

SEQ ID NO: 106440 - DNA, 22 bp, Artificial Sequence
  chemically synthesized
ttcacagaatgtaaatagtgtg

SEQ ID NO: 106441 - DNA, 22 bp, Artificial Sequence
  chemically synthesized
acagaatgtaaatagtgtgtaa

SEQ ID NO: 106442 - DNA, 22 bp, Artificial Sequence
  chemically synthesized
ccacaaattttcatagcactat

SEQ ID NO: 106443 - DNA, 22 bp, Artificial Sequence
  chemically synthesized
tcatagcactatcattactgca

SEQ ID NO: 106444 - DNA, 22 bp, Artificial Sequence
  chemically synthesized
catagcactatcattactgcat

SEQ ID NO: 106445 - DNA, 22 bp, Artificial Sequence
  chemically synthesized
atagcactatcattactgcata

SEQ ID NO: 106446 - DNA, 22 bp, Artificial Sequence
  chemically synthesized
tcattactgcatagatggtagc

SEQ ID NO: 106447 - DNA, 22 bp, Artificial Sequence
  chemically synthesized
ctgcatagatggtagcatgcta

SEQ ID NO: 106448 - DNA, 22 bp, Artificial Sequence
  chemically synthesized
catagatggtagcatgctaaag

SEQ ID NO: 106449 - DNA, 22 bp, Artificial Sequence
  chemically synthesized
aagggagcccacagaaagcatc

SEQ ID NO: 106450 - DNA, 22 bp, Artificial Sequence
  chemically synthesized
tggggcaggggaaaatttctca

SEQ ID NO: 106451 - DNA, 22 bp, Artificial Sequence
  chemically synthesized
ggggcaggggaaaatttctcaa

SEQ ID NO: 106452 - DNA, 22 bp, Artificial Sequence
  chemically synthesized
gggcaggggaaaatttctcaaa

SEQ ID NO: 106453 - DNA, 22 bp, Artificial Sequence
  chemically synthesized
ctcaaaagaaatattatttaag

SEQ ID NO: 106454 - DNA, 22 bp, Artificial Sequence
  chemically synthesized
tcaaaagaaatattatttaagc

SEQ ID NO: 106455 - DNA, 22 bp, Artificial Sequence
  chemically synthesized
aaaagaaatattatttaagcta

SEQ ID NO: 106456 - DNA, 22 bp, Artificial Sequence
  chemically synthesized
tttaagctaataattgaaaaac

SEQ ID NO: 106457 - DNA, 22 bp, Artificial Sequence
  chemically synthesized
aagctaataattgaaaaacaag

SEQ ID NO: 106458 - DNA, 22 bp, Artificial Sequence
  chemically synthesized
agctaataattgaaaaacaagg

SEQ ID NO: 106459 - DNA, 22 bp, Artificial Sequence
  chemically synthesized
ataattgaaaaacaaggaaggt

SEQ ID NO: 106460 - DNA, 22 bp, Artificial Sequence
  chemically synthesized
aaaaacaaggaaggtaacaaat

SEQ ID NO: 106461 - DNA, 22 bp, Artificial Sequence
  chemically synthesized
gtataagtggggtacagtttat

SEQ ID NO: 106462 - DNA, 22 bp, Artificial Sequence
  chemically synthesized
tataagtggggtacagtttata

SEQ ID NO: 106463 - DNA, 22 bp, Artificial Sequence
  chemically synthesized
ataaaggaagaaaaaatacaca

SEQ ID NO: 106464 - DNA, 22 bp, Artificial Sequence
  chemically synthesized
taaaggaagaaaaaatacacag

SEQ ID NO: 106465 - DNA, 22 bp, Artificial Sequence
  chemically synthesized
tggggaaagagaaaatatgaca

SEQ ID NO: 106466 - DNA, 22 bp, Artificial Sequence
  chemically synthesized
aaatcaagagaattctagcaga

SEQ ID NO: 106467 - DNA, 22 bp, Artificial Sequence
  chemically synthesized
tagcagagccagaataacaaaa

SEQ ID NO: 106468 - DNA, 22 bp, Artificial Sequence
  chemically synthesized
gcagagccagaataacaaaaca

SEQ ID NO: 106469 - DNA, 22 bp, Artificial Sequence
  chemically synthesized
aacacaaagagaatctgtggta

SEQ ID NO: 106470 - DNA, 22 bp, Artificial Sequence
  chemically synthesized
tggtagcctgttggtttttgtt

SEQ ID NO: 106471 - DNA, 22 bp, Artificial Sequence
  chemically synthesized
ttggtttttgttaatccaaaat

SEQ ID NO: 106472 - DNA, 22 bp, Artificial Sequence
  chemically synthesized
gtttttgttaatccaaaataat

SEQ ID NO: 106473 - DNA, 22 bp, Artificial Sequence
  chemically synthesized
ttgttaatccaaaataatgtat

SEQ ID NO: 106474 - DNA, 22 bp, Artificial Sequence
  chemically synthesized
tgttaatccaaaataatgtatt

SEQ ID NO: 106475 - DNA, 22 bp, Artificial Sequence
  chemically synthesized
gttaatccaaaataatgtattt

SEQ ID NO: 106476 - DNA, 22 bp, Artificial Sequence
  chemically synthesized
ttaatccaaaataatgtatttt

SEQ ID NO: 106477 - DNA, 22 bp, Artificial Sequence
  chemically synthesized
atccaaaataatgtatttttat

SEQ ID NO: 106478 - DNA, 22 bp, Artificial Sequence
  chemically synthesized
ttattattattattattatact

SEQ ID NO: 106479 - DNA, 22 bp, Artificial Sequence
  chemically synthesized
tattattattattattatactt

SEQ ID NO: 106480 - DNA, 22 bp, Artificial Sequence
  chemically synthesized
attattattattattatacttt

SEQ ID NO: 106481 - DNA, 22 bp, Artificial Sequence
  chemically synthesized
ttattattattattatacttta

SEQ ID NO: 106482 - DNA, 22 bp, Artificial Sequence
  chemically synthesized
ttattattattatactttaagt

SEQ ID NO: 106483 - DNA, 22 bp, Artificial Sequence
  chemically synthesized
ttattattatactttaagtttt

SEQ ID NO: 106484 - DNA, 22 bp, Artificial Sequence
  chemically synthesized
ttattatactttaagttttagg

SEQ ID NO: 106485 - DNA, 22 bp, Artificial Sequence
  chemically synthesized
ttatactttaagttttagggta

SEQ ID NO: 106486 - DNA, 22 bp, Artificial Sequence
  chemically synthesized
tactttaagttttagggtacat

SEQ ID NO: 106487 - DNA, 22 bp, Artificial Sequence
  chemically synthesized
taagttttagggtacatgtgca

SEQ ID NO: 106488 - DNA, 22 bp, Artificial Sequence
  chemically synthesized
aagttttagggtacatgtgcac

SEQ ID NO: 106489 - DNA, 22 bp, Artificial Sequence
  chemically synthesized
agttttagggtacatgtgcaca

SEQ ID NO: 106490 - DNA, 22 bp, Artificial Sequence
  chemically synthesized
tagggtacatgtgcacaatgtg

SEQ ID NO: 106491 - DNA, 22 bp, Artificial Sequence
  chemically synthesized
agggtacatgtgcacaatgtgc

SEQ ID NO: 106492 - DNA, 22 bp, Artificial Sequence
  chemically synthesized
gggtacatgtgcacaatgtgca

SEQ ID NO: 106493 - DNA, 22 bp, Artificial Sequence
  chemically synthesized
gttacatatgtatacatgtgcc

SEQ ID NO: 106494 - DNA, 22 bp, Artificial Sequence
  chemically synthesized
ttacatatgtatacatgtgcca

SEQ ID NO: 106495 - DNA, 22 bp, Artificial Sequence
  chemically synthesized
catatgtatacatgtgccatgt

SEQ ID NO: 106496 - DNA, 22 bp, Artificial Sequence
  chemically synthesized
gtgtgctgcacccattaacttg

SEQ ID NO: 106497 - DNA, 22 bp, Artificial Sequence
  chemically synthesized
cacccattaacttgtcacttag

SEQ ID NO: 106498 - DNA, 22 bp, Artificial Sequence
  chemically synthesized
acttgtcacttagcattaggta

SEQ ID NO: 106499 - DNA, 22 bp, Artificial Sequence
  chemically synthesized
gtcacttagcattaggtatatc

SEQ ID NO: 106500 - DNA, 22 bp, Artificial Sequence
  chemically synthesized
tcacttagcattaggtatatct

SEQ ID NO: 106501 - DNA, 22 bp, Artificial Sequence
  chemically synthesized
agcattaggtatatctcctaat

SEQ ID NO: 106502 - DNA, 22 bp, Artificial Sequence
  chemically synthesized
gcattaggtatatctcctaatg

SEQ ID NO: 106503 - DNA, 22 bp, Artificial Sequence
  chemically synthesized
ggtatatctcctaatgctctct

SEQ ID NO: 106504 - DNA, 22 bp, Artificial Sequence
  chemically synthesized
ctaatgctctctctcccccttc

SEQ ID NO: 106505 - DNA, 22 bp, Artificial Sequence
  chemically synthesized
atgctctctctcccccttcccc

SEQ ID NO: 106506 - DNA, 22 bp, Artificial Sequence
  chemically synthesized
tctctcccccttccccccacct

SEQ ID NO: 106507 - DNA, 22 bp, Artificial Sequence
  chemically synthesized
tctcccccttccccccacctca

SEQ ID NO: 106508 - DNA, 22 bp, Artificial Sequence
  chemically synthesized
tcccccttccccccacctcaca

SEQ ID NO: 106509 - DNA, 22 bp, Artificial Sequence
  chemically synthesized
ccccttccccccacctcacaac

SEQ ID NO: 106510 - DNA, 22 bp, Artificial Sequence
  chemically synthesized
ccccccacctcacaacagtccc

SEQ ID NO: 106511 - DNA, 22 bp, Artificial Sequence
  chemically synthesized
cccccacctcacaacagtcccc

SEQ ID NO: 106512 - DNA, 22 bp, Artificial Sequence
  chemically synthesized
acaacagtccccggagtgtgtt

SEQ ID NO: 106513 - DNA, 22 bp, Artificial Sequence
  chemically synthesized
ttccccttcctgtgtccatgtg

SEQ ID NO: 106514 - DNA, 22 bp, Artificial Sequence
  chemically synthesized
cccttcctgtgtccatgtgttc

SEQ ID NO: 106515 - DNA, 22 bp, Artificial Sequence
  chemically synthesized
cctgtgtccatgtgttctcatt

SEQ ID NO: 106516 - DNA, 22 bp, Artificial Sequence
  chemically synthesized
ctgtgtccatgtgttctcattg

SEQ ID NO: 106517 - DNA, 22 bp, Artificial Sequence
  chemically synthesized
tgtccatgtgttctcattgttc

SEQ ID NO: 106518 - DNA, 22 bp, Artificial Sequence
  chemically synthesized
tcattgttcaattcccacctat

SEQ ID NO: 106519 - DNA, 22 bp, Artificial Sequence
  chemically synthesized
attgttcaattcccacctatga

SEQ ID NO: 106520 - DNA, 22 bp, Artificial Sequence
  chemically synthesized
ttcaattcccacctatgagtga

SEQ ID NO: 106521 - DNA, 22 bp, Artificial Sequence
  chemically synthesized
aattcccacctatgagtgagaa

SEQ ID NO: 106522 - DNA, 22 bp, Artificial Sequence
  chemically synthesized
ccacctatgagtgagaacatgc

SEQ ID NO: 106523 - DNA, 22 bp, Artificial Sequence
  chemically synthesized
tgagtgagaacatgcagtgctt

SEQ ID NO: 106524 - DNA, 22 bp, Artificial Sequence
  chemically synthesized
ggttttttgtccttgcgatagt

SEQ ID NO: 106525 - DNA, 22 bp, Artificial Sequence
  chemically synthesized
gttttttgtccttgcgatagtt

SEQ ID NO: 106526 - DNA, 22 bp, Artificial Sequence
  chemically synthesized
tttgtccttgcgatagtttgct

SEQ ID NO: 106527 - DNA, 22 bp, Artificial Sequence
  chemically synthesized
ttgtccttgcgatagtttgctg

SEQ ID NO: 106528 - DNA, 22 bp, Artificial Sequence
  chemically synthesized
tgtccttgcgatagtttgctga

SEQ ID NO: 106529 - DNA, 22 bp, Artificial Sequence
  chemically synthesized
gtccttgcgatagtttgctgag

SEQ ID NO: 106530 - DNA, 22 bp, Artificial Sequence
  chemically synthesized
tccttgcgatagtttgctgaga

SEQ ID NO: 106531 - DNA, 22 bp, Artificial Sequence
  chemically synthesized
gcgatagtttgctgagaatgat

SEQ ID NO: 106532 - DNA, 22 bp, Artificial Sequence
  chemically synthesized
cgatagtttgctgagaatgatg

SEQ ID NO: 106533 - DNA, 22 bp, Artificial Sequence
  chemically synthesized
gctgagaatgatggtttccagt

SEQ ID NO: 106534 - DNA, 22 bp, Artificial Sequence
  chemically synthesized
ctgagaatgatggtttccagtt

SEQ ID NO: 106535 - DNA, 22 bp, Artificial Sequence
  chemically synthesized
agaatgatggtttccagtttca

SEQ ID NO: 106536 - DNA, 22 bp, Artificial Sequence
  chemically synthesized
ccagtttcatccatgtccctac

SEQ ID NO: 106537 - DNA, 22 bp, Artificial Sequence
  chemically synthesized
cagtttcatccatgtccctaca

SEQ ID NO: 106538 - DNA, 22 bp, Artificial Sequence
  chemically synthesized
catccatgtccctacaaatgac

SEQ ID NO: 106539 - DNA, 22 bp, Artificial Sequence
  chemically synthesized
atccatgtccctacaaatgaca

SEQ ID NO: 106540 - DNA, 22 bp, Artificial Sequence
  chemically synthesized
caaatgacatgaactcttcatt

SEQ ID NO: 106541 - DNA, 22 bp, Artificial Sequence
  chemically synthesized
ttcattttttatggctgcatag

SEQ ID NO: 106542 - DNA, 22 bp, Artificial Sequence
  chemically synthesized
cattttttatggctgcatagta

SEQ ID NO: 106543 - DNA, 22 bp, Artificial Sequence
  chemically synthesized
attttttatggctgcatagtat

SEQ ID NO: 106544 - DNA, 22 bp, Artificial Sequence
  chemically synthesized
tttatggctgcatagtattcca

SEQ ID NO: 106545 - DNA, 22 bp, Artificial Sequence
  chemically synthesized
ttatggctgcatagtattccat

SEQ ID NO: 106546 - DNA, 22 bp, Artificial Sequence
  chemically synthesized
tatggctgcatagtattccatg

SEQ ID NO: 106547 - DNA, 22 bp, Artificial Sequence
  chemically synthesized
atggctgcatagtattccatgg

SEQ ID NO: 106548 - DNA, 22 bp, Artificial Sequence
  chemically synthesized
tggctgcatagtattccatggt

SEQ ID NO: 106549 - DNA, 22 bp, Artificial Sequence
  chemically synthesized
catagtattccatggtgtatat

SEQ ID NO: 106550 - DNA, 22 bp, Artificial Sequence
  chemically synthesized
catggtgtatatgtgccacatt

SEQ ID NO: 106551 - DNA, 22 bp, Artificial Sequence
  chemically synthesized
tcttaattcagtctatcattgt

SEQ ID NO: 106552 - DNA, 22 bp, Artificial Sequence
  chemically synthesized
cttaattcagtctatcattgtt

SEQ ID NO: 106553 - DNA, 22 bp, Artificial Sequence
  chemically synthesized
ttaattcagtctatcattgttg

SEQ ID NO: 106554 - DNA, 22 bp, Artificial Sequence
  chemically synthesized
aattcagtctatcattgttgga

SEQ ID NO: 106555 - DNA, 22 bp, Artificial Sequence
  chemically synthesized
attcagtctatcattgttggac

SEQ ID NO: 106556 - DNA, 22 bp, Artificial Sequence
  chemically synthesized
agtctatcattgttggacattt

SEQ ID NO: 106557 - DNA, 22 bp, Artificial Sequence
  chemically synthesized
tcattgttggacatttgggttg

SEQ ID NO: 106558 - DNA, 22 bp, Artificial Sequence
  chemically synthesized
ttggacatttgggttggttcca

SEQ ID NO: 106559 - DNA, 22 bp, Artificial Sequence
  chemically synthesized
gacatttgggttggttccaagt

SEQ ID NO: 106560 - DNA, 22 bp, Artificial Sequence
  chemically synthesized
gggttggttccaagtctttgct

SEQ ID NO: 106561 - DNA, 22 bp, Artificial Sequence
  chemically synthesized
ggttggttccaagtctttgcta

SEQ ID NO: 106562 - DNA, 22 bp, Artificial Sequence
  chemically synthesized
gttccaagtctttgctattgtg

SEQ ID NO: 106563 - DNA, 22 bp, Artificial Sequence
  chemically synthesized
caagtctttgctattgtgaata

SEQ ID NO: 106564 - DNA, 22 bp, Artificial Sequence
  chemically synthesized
tgctattgtgaatagtgccaca

SEQ ID NO: 106565 - DNA, 22 bp, Artificial Sequence
  chemically synthesized
gctattgtgaatagtgccacag

SEQ ID NO: 106566 - DNA, 22 bp, Artificial Sequence
  chemically synthesized
ctattgtgaatagtgccacagt

SEQ ID NO: 106567 - DNA, 22 bp, Artificial Sequence
  chemically synthesized
ttgtgaatagtgccacagtaaa

SEQ ID NO: 106568 - DNA, 22 bp, Artificial Sequence
  chemically synthesized
tgaatagtgccacagtaaacat

SEQ ID NO: 106569 - DNA, 22 bp, Artificial Sequence
  chemically synthesized
tatagcagcatgatttataatc

SEQ ID NO: 106570 - DNA, 22 bp, Artificial Sequence
  chemically synthesized
atagcagcatgatttataatcc

SEQ ID NO: 106571 - DNA, 22 bp, Artificial Sequence
  chemically synthesized
tagcagcatgatttataatccg

SEQ ID NO: 106572 - DNA, 22 bp, Artificial Sequence
  chemically synthesized
ataatccgttgggtatataccc

SEQ ID NO: 106573 - DNA, 22 bp, Artificial Sequence
  chemically synthesized
taatccgttgggtatataccca

SEQ ID NO: 106574 - DNA, 22 bp, Artificial Sequence
  chemically synthesized
ggtatatacccagtaatgggat

SEQ ID NO: 106575 - DNA, 22 bp, Artificial Sequence
  chemically synthesized
ggtcaaatggtatttctagttc

SEQ ID NO: 106576 - DNA, 22 bp, Artificial Sequence
  chemically synthesized
ctagttctagatccctgaggaa

SEQ ID NO: 106577 - DNA, 22 bp, Artificial Sequence
  chemically synthesized
tagttctagatccctgaggaat

SEQ ID NO: 106578 - DNA, 22 bp, Artificial Sequence
  chemically synthesized
gttctagatccctgaggaatcg

SEQ ID NO: 106579 - DNA, 22 bp, Artificial Sequence
  chemically synthesized
tagatccctgaggaatcgccac

SEQ ID NO: 106580 - DNA, 22 bp, Artificial Sequence
  chemically synthesized
gatccctgaggaatcgccacac

SEQ ID NO: 106581 - DNA, 22 bp, Artificial Sequence
  chemically synthesized
aggaatcgccacactgacttcc

SEQ ID NO: 106582 - DNA, 22 bp, Artificial Sequence
  chemically synthesized
acttccacaatggttgaactag

SEQ ID NO: 106583 - DNA, 22 bp, Artificial Sequence
  chemically synthesized
ccacaatggttgaactagttta

SEQ ID NO: 106584 - DNA, 22 bp, Artificial Sequence
  chemically synthesized
cacaatggttgaactagtttac

SEQ ID NO: 106585 - DNA, 22 bp, Artificial Sequence
  chemically synthesized
aactagtttacagtcccaccaa

SEQ ID NO: 106586 - DNA, 22 bp, Artificial Sequence
  chemically synthesized
gtttacagtcccaccaagagtg

SEQ ID NO: 106587 - DNA, 22 bp, Artificial Sequence
  chemically synthesized
acagtcccaccaagagtgtaaa

SEQ ID NO: 106588 - DNA, 22 bp, Artificial Sequence
  chemically synthesized
cagtcccaccaagagtgtaaaa

SEQ ID NO: 106589 - DNA, 22 bp, Artificial Sequence
  chemically synthesized
ctatttctccacatcctctcca

SEQ ID NO: 106590 - DNA, 22 bp, Artificial Sequence
  chemically synthesized
tttctccacatcctctccagca

SEQ ID NO: 106591 - DNA, 22 bp, Artificial Sequence
  chemically synthesized
ctccacatcctctccagcacct

SEQ ID NO: 106592 - DNA, 22 bp, Artificial Sequence
  chemically synthesized
tccacatcctctccagcacctg

SEQ ID NO: 106593 - DNA, 22 bp, Artificial Sequence
  chemically synthesized
cacatcctctccagcacctgtt

SEQ ID NO: 106594 - DNA, 22 bp, Artificial Sequence
  chemically synthesized
tccagcacctgttgttccctga

SEQ ID NO: 106595 - DNA, 22 bp, Artificial Sequence
  chemically synthesized
cagcacctgttgttccctgact

SEQ ID NO: 106596 - DNA, 22 bp, Artificial Sequence
  chemically synthesized
ttgttccctgactttttaatga

SEQ ID NO: 106597 - DNA, 22 bp, Artificial Sequence
  chemically synthesized
ttccctgactttttaatgattg

SEQ ID NO: 106598 - DNA, 22 bp, Artificial Sequence
  chemically synthesized
cctgactttttaatgattgcca

SEQ ID NO: 106599 - DNA, 22 bp, Artificial Sequence
  chemically synthesized
actttttaatgattgccattct

SEQ ID NO: 106600 - DNA, 22 bp, Artificial Sequence
  chemically synthesized
tttaatgattgccattctaact

SEQ ID NO: 106601 - DNA, 22 bp, Artificial Sequence
  chemically synthesized
ttaatgattgccattctaactg

SEQ ID NO: 106602 - DNA, 22 bp, Artificial Sequence
  chemically synthesized
taatgattgccattctaactgg

SEQ ID NO: 106603 - DNA, 22 bp, Artificial Sequence
  chemically synthesized
aatgattgccattctaactggt

SEQ ID NO: 106604 - DNA, 22 bp, Artificial Sequence
  chemically synthesized
atgattgccattctaactggtg

SEQ ID NO: 106605 - DNA, 22 bp, Artificial Sequence
  chemically synthesized
ccattctaactggtgtgagatg

SEQ ID NO: 106606 - DNA, 22 bp, Artificial Sequence
  chemically synthesized
taactggtgtgagatggtatct

SEQ ID NO: 106607 - DNA, 22 bp, Artificial Sequence
  chemically synthesized
actggtgtgagatggtatctct

SEQ ID NO: 106608 - DNA, 22 bp, Artificial Sequence
  chemically synthesized
gtgtgagatggtatctctttgt

SEQ ID NO: 106609 - DNA, 22 bp, Artificial Sequence
  chemically synthesized
tttgtggttttgatttgcattg

SEQ ID NO: 106610 - DNA, 22 bp, Artificial Sequence
  chemically synthesized
tgtggttttgatttgcattgtg

SEQ ID NO: 106611 - DNA, 22 bp, Artificial Sequence
  chemically synthesized
gtggttttgatttgcattgtga

SEQ ID NO: 106612 - DNA, 22 bp, Artificial Sequence
  chemically synthesized
tggttttgatttgcattgtgac

SEQ ID NO: 106613 - DNA, 22 bp, Artificial Sequence
  chemically synthesized
tgatttgcattgtgacgtgtta

SEQ ID NO: 106614 - DNA, 22 bp, Artificial Sequence
  chemically synthesized
gatttgcattgtgacgtgttag

SEQ ID NO: 106615 - DNA, 22 bp, Artificial Sequence
  chemically synthesized
atttgcattgtgacgtgttagt

SEQ ID NO: 106616 - DNA, 22 bp, Artificial Sequence
  chemically synthesized
gcattgtgacgtgttagtttta

SEQ ID NO: 106617 - DNA, 22 bp, Artificial Sequence
  chemically synthesized
cattgtgacgtgttagttttaa

SEQ ID NO: 106618 - DNA, 22 bp, Artificial Sequence
  chemically synthesized
tgacgtgttagttttaaagtat

SEQ ID NO: 106619 - DNA, 22 bp, Artificial Sequence
  chemically synthesized
gttttaaagtatgtgtgaaata

SEQ ID NO: 106620 - DNA, 22 bp, Artificial Sequence
  chemically synthesized
taaagtatgtgtgaaataattt

SEQ ID NO: 106621 - DNA, 22 bp, Artificial Sequence
  chemically synthesized
aaagtatgtgtgaaataatttt

SEQ ID NO: 106622 - DNA, 22 bp, Artificial Sequence
  chemically synthesized
aagtatgtgtgaaataattttt

SEQ ID NO: 106623 - DNA, 22 bp, Artificial Sequence
  chemically synthesized
ttattcttaacatttttttgat

SEQ ID NO: 106624 - DNA, 22 bp, Artificial Sequence
  chemically synthesized
tattcttaacatttttttgatg

SEQ ID NO: 106625 - DNA, 22 bp, Artificial Sequence
  chemically synthesized
attcttaacatttttttgatga

SEQ ID NO: 106626 - DNA, 22 bp, Artificial Sequence
  chemically synthesized
ttcttaacatttttttgatgaa

SEQ ID NO: 106627 - DNA, 22 bp, Artificial Sequence
  chemically synthesized
ttaacatttttttgatgaagca

SEQ ID NO: 106628 - DNA, 22 bp, Artificial Sequence
  chemically synthesized
aacatttttttgatgaagcaca

SEQ ID NO: 106629 - DNA, 22 bp, Artificial Sequence
  chemically synthesized
acatttttttgatgaagcacag

SEQ ID NO: 106630 - DNA, 22 bp, Artificial Sequence
  chemically synthesized
ttttgatgaagcacagtgtctg

SEQ ID NO: 106631 - DNA, 22 bp, Artificial Sequence
  chemically synthesized
tttgatgaagcacagtgtctga

SEQ ID NO: 106632 - DNA, 22 bp, Artificial Sequence
  chemically synthesized
ttgatgaagcacagtgtctgaa

SEQ ID NO: 106633 - DNA, 22 bp, Artificial Sequence
  chemically synthesized
tgatgaagcacagtgtctgaaa

SEQ ID NO: 106634 - DNA, 22 bp, Artificial Sequence
  chemically synthesized
gatgaagcacagtgtctgaaag

SEQ ID NO: 106635 - DNA, 22 bp, Artificial Sequence
  chemically synthesized
atgaagcacagtgtctgaaagg

SEQ ID NO: 106636 - DNA, 22 bp, Artificial Sequence
  chemically synthesized
aaagggtggtagcccaatcaag

SEQ ID NO: 106637 - DNA, 22 bp, Artificial Sequence
  chemically synthesized
aaaaccagaacacagctaatgt

SEQ ID NO: 106638 - DNA, 22 bp, Artificial Sequence
  chemically synthesized
atgtgagaaatacaagtattta

SEQ ID NO: 106639 - DNA, 22 bp, Artificial Sequence
  chemically synthesized
agggccttagtctgctccttgt

SEQ ID NO: 106640 - DNA, 22 bp, Artificial Sequence
  chemically synthesized
gggccttagtctgctccttgtc

SEQ ID NO: 106641 - DNA, 22 bp, Artificial Sequence
  chemically synthesized
agtctgctccttgtctgaggca

SEQ ID NO: 106642 - DNA, 22 bp, Artificial Sequence
  chemically synthesized
gtctgctccttgtctgaggcaa

SEQ ID NO: 106643 - DNA, 22 bp, Artificial Sequence
  chemically synthesized
ctccttgtctgaggcaattccc

SEQ ID NO: 106644 - DNA, 22 bp, Artificial Sequence
  chemically synthesized
cttgtctgaggcaattcccatg

SEQ ID NO: 106645 - DNA, 22 bp, Artificial Sequence
  chemically synthesized
gtctgaggcaattcccatgacc

SEQ ID NO: 106646 - DNA, 22 bp, Artificial Sequence
  chemically synthesized
tctgaggcaattcccatgacct

SEQ ID NO: 106647 - DNA, 22 bp, Artificial Sequence
  chemically synthesized
aggcaattcccatgaccttctt

SEQ ID NO: 106648 - DNA, 22 bp, Artificial Sequence
  chemically synthesized
ccatgaccttcttaaggatcag

SEQ ID NO: 106649 - DNA, 22 bp, Artificial Sequence
  chemically synthesized
cttaaggatcagaatgtaagag

SEQ ID NO: 106650 - DNA, 22 bp, Artificial Sequence
  chemically synthesized
ttaaggatcagaatgtaagaga

SEQ ID NO: 106651 - DNA, 22 bp, Artificial Sequence
  chemically synthesized
aaggatcagaatgtaagagata

SEQ ID NO: 106652 - DNA, 22 bp, Artificial Sequence
  chemically synthesized
aggatcagaatgtaagagataa

SEQ ID NO: 106653 - DNA, 22 bp, Artificial Sequence
  chemically synthesized
atgagaccaggactataggata

SEQ ID NO: 106654 - DNA, 22 bp, Artificial Sequence
  chemically synthesized
taggataaagtctattaaaggt

SEQ ID NO: 106655 - DNA, 22 bp, Artificial Sequence
  chemically synthesized
ttaaaggtgatgtctgcacagg

SEQ ID NO: 106656 - DNA, 22 bp, Artificial Sequence
  chemically synthesized
aaggtgatgtctgcacaggcca

SEQ ID NO: 106657 - DNA, 22 bp, Artificial Sequence
  chemically synthesized
cacaggccagtttgatcacatc

SEQ ID NO: 106658 - DNA, 22 bp, Artificial Sequence
  chemically synthesized
gatcacatctggtgcaggcaga

SEQ ID NO: 106659 - DNA, 22 bp, Artificial Sequence
  chemically synthesized
atcacatctggtgcaggcagaa

SEQ ID NO: 106660 - DNA, 22 bp, Artificial Sequence
  chemically synthesized
gtgcaggcagaaagcatgggag

SEQ ID NO: 106661 - DNA, 22 bp, Artificial Sequence
  chemically synthesized
acagtaggggaatccagagagg

SEQ ID NO: 106662 - DNA, 22 bp, Artificial Sequence
  chemically synthesized
tgggcacaattagcataacaaa

SEQ ID NO: 106663 - DNA, 22 bp, Artificial Sequence
  chemically synthesized
gcataacaaatcccctcatttg

SEQ ID NO: 106664 - DNA, 22 bp, Artificial Sequence
  chemically synthesized
atttgaacccccagatctatct

SEQ ID NO: 106665 - DNA, 22 bp, Artificial Sequence
  chemically synthesized
gaacccccagatctatcttcac

SEQ ID NO: 106666 - DNA, 22 bp, Artificial Sequence
  chemically synthesized
aacccccagatctatcttcacc

SEQ ID NO: 106667 - DNA, 22 bp, Artificial Sequence
  chemically synthesized
tcttcaccaccttagcattggt

SEQ ID NO: 106668 - DNA, 22 bp, Artificial Sequence
  chemically synthesized
caccaccttagcattggtgaga

SEQ ID NO: 106669 - DNA, 22 bp, Artificial Sequence
  chemically synthesized
accaccttagcattggtgagaa

SEQ ID NO: 106670 - DNA, 22 bp, Artificial Sequence
  chemically synthesized
agcattggtgagaatggaggtg

SEQ ID NO: 106671 - DNA, 22 bp, Artificial Sequence
  chemically synthesized
gcattggtgagaatggaggtgt

SEQ ID NO: 106672 - DNA, 22 bp, Artificial Sequence
  chemically synthesized
gtgagaatggaggtgtatctca

SEQ ID NO: 106673 - DNA, 22 bp, Artificial Sequence
  chemically synthesized
aggggattatggatgccaataa

SEQ ID NO: 106674 - DNA, 22 bp, Artificial Sequence
  chemically synthesized
tggatgccaataaaacagtcat

SEQ ID NO: 106675 - DNA, 22 bp, Artificial Sequence
  chemically synthesized
tggactccacgatagagaggga

SEQ ID NO: 106676 - DNA, 22 bp, Artificial Sequence
  chemically synthesized
gactccacgatagagagggagt

SEQ ID NO: 106677 - DNA, 22 bp, Artificial Sequence
  chemically synthesized
cacgatagagagggagtggatt

SEQ ID NO: 106678 - DNA, 22 bp, Artificial Sequence
  chemically synthesized
gataggcctggaggaagcaggc

SEQ ID NO: 106679 - DNA, 22 bp, Artificial Sequence
  chemically synthesized
gaggaagcaggctccatggctc

SEQ ID NO: 106680 - DNA, 22 bp, Artificial Sequence
  chemically synthesized
catggctcattttcctgtgatc

SEQ ID NO: 106681 - DNA, 22 bp, Artificial Sequence
  chemically synthesized
attttcctgtgatctagccaga

SEQ ID NO: 106682 - DNA, 22 bp, Artificial Sequence
  chemically synthesized
tcctgtgatctagccagagaac

SEQ ID NO: 106683 - DNA, 22 bp, Artificial Sequence
  chemically synthesized
cctgtgatctagccagagaaca

SEQ ID NO: 106684 - DNA, 22 bp, Artificial Sequence
  chemically synthesized
ctgtgatctagccagagaacac

SEQ ID NO: 106685 - DNA, 22 bp, Artificial Sequence
  chemically synthesized
tgatctagccagagaacaccaa

SEQ ID NO: 106686 - DNA, 22 bp, Artificial Sequence
  chemically synthesized
gccagagaacaccaaggacagt

SEQ ID NO: 106687 - DNA, 22 bp, Artificial Sequence
  chemically synthesized
ttgtcaaagttacaccaaggtc

SEQ ID NO: 106688 - DNA, 22 bp, Artificial Sequence
  chemically synthesized
tcaaagttacaccaaggtctat

SEQ ID NO: 106689 - DNA, 22 bp, Artificial Sequence
  chemically synthesized
caccaaggtctatggctgccag

SEQ ID NO: 106690 - DNA, 22 bp, Artificial Sequence
  chemically synthesized
tggctgccagtatagtcagaga

SEQ ID NO: 106691 - DNA, 22 bp, Artificial Sequence
  chemically synthesized
ccagtatagtcagagagtagta

SEQ ID NO: 106692 - DNA, 22 bp, Artificial Sequence
  chemically synthesized
atgaagagtgcagtcttctctg

SEQ ID NO: 106693 - DNA, 22 bp, Artificial Sequence
  chemically synthesized
ctctgataaagaggaggaggct

SEQ ID NO: 106694 - DNA, 22 bp, Artificial Sequence
  chemically synthesized
tctgataaagaggaggaggctg

SEQ ID NO: 106695 - DNA, 22 bp, Artificial Sequence
  chemically synthesized
tgataaagaggaggaggctgcc

SEQ ID NO: 106696 - DNA, 22 bp, Artificial Sequence
  chemically synthesized
ataaagaggaggaggctgccat

SEQ ID NO: 106697 - DNA, 22 bp, Artificial Sequence
  chemically synthesized
ccattgccaaggactgtagaga

SEQ ID NO: 106698 - DNA, 22 bp, Artificial Sequence
  chemically synthesized
ccaaggactgtagagacataga

SEQ ID NO: 106699 - DNA, 22 bp, Artificial Sequence
  chemically synthesized
tagagacatagatgataaagaa

SEQ ID NO: 106700 - DNA, 22 bp, Artificial Sequence
  chemically synthesized
caaggatgaaatctctccagac

SEQ ID NO: 106701 - DNA, 22 bp, Artificial Sequence
  chemically synthesized
tccagacctggaaagccagtga

SEQ ID NO: 106702 - DNA, 22 bp, Artificial Sequence
  chemically synthesized
cagacctggaaagccagtgagg

SEQ ID NO: 106703 - DNA, 22 bp, Artificial Sequence
  chemically synthesized
gaaagccagtgaggagaaaagg

SEQ ID NO: 106704 - DNA, 22 bp, Artificial Sequence
  chemically synthesized
aggagaaacaaacaaacaaaac

SEQ ID NO: 106705 - DNA, 22 bp, Artificial Sequence
  chemically synthesized
tctagaccagcactatgtggtg

SEQ ID NO: 106706 - DNA, 22 bp, Artificial Sequence
  chemically synthesized
tagaccagcactatgtggtgga

SEQ ID NO: 106707 - DNA, 22 bp, Artificial Sequence
  chemically synthesized
gaccagcactatgtggtggaaa

SEQ ID NO: 106708 - DNA, 22 bp, Artificial Sequence
  chemically synthesized
tgtggtggaaatataattagag

SEQ ID NO: 106709 - DNA, 22 bp, Artificial Sequence
  chemically synthesized
gagctaaatatgtgatgttaaa

SEQ ID NO: 106710 - DNA, 22 bp, Artificial Sequence
  chemically synthesized
aatatgtgatgttaaatgttct

SEQ ID NO: 106711 - DNA, 22 bp, Artificial Sequence
  chemically synthesized
aatgttctggtagtcacattaa

SEQ ID NO: 106712 - DNA, 22 bp, Artificial Sequence
  chemically synthesized
tggtagtcacattaaaaggagt

SEQ ID NO: 106713 - DNA, 22 bp, Artificial Sequence
  chemically synthesized
gtagtcacattaaaaggagtaa

SEQ ID NO: 106714 - DNA, 22 bp, Artificial Sequence
  chemically synthesized
aaaggagtaaaaagaaaagtgg

SEQ ID NO: 106715 - DNA, 22 bp, Artificial Sequence
  chemically synthesized
atattagtatgtcttatttaag

SEQ ID NO: 106716 - DNA, 22 bp, Artificial Sequence
  chemically synthesized
gtatgtcttatttaagctacta

SEQ ID NO: 106717 - DNA, 22 bp, Artificial Sequence
  chemically synthesized
atttaagctactatatcaaaaa

SEQ ID NO: 106718 - DNA, 22 bp, Artificial Sequence
  chemically synthesized
tttaagctactatatcaaaaat

SEQ ID NO: 106719 - DNA, 22 bp, Artificial Sequence
  chemically synthesized
aagctactatatcaaaaatatt

SEQ ID NO: 106720 - DNA, 22 bp, Artificial Sequence
  chemically synthesized
agctactatatcaaaaatatta

SEQ ID NO: 106721 - DNA, 22 bp, Artificial Sequence
  chemically synthesized
ctatatcaaaaatattatcatt

SEQ ID NO: 106722 - DNA, 22 bp, Artificial Sequence
  chemically synthesized
tatcaaaaatattatcatttta

SEQ ID NO: 106723 - DNA, 22 bp, Artificial Sequence
  chemically synthesized
tcattttaatagataatcagca

SEQ ID NO: 106724 - DNA, 22 bp, Artificial Sequence
  chemically synthesized
taatagataatcagcataaaaa

SEQ ID NO: 106725 - DNA, 22 bp, Artificial Sequence
  chemically synthesized
aatagataatcagcataaaaat

SEQ ID NO: 106726 - DNA, 22 bp, Artificial Sequence
  chemically synthesized
atagataatcagcataaaaatc

SEQ ID NO: 106727 - DNA, 22 bp, Artificial Sequence
  chemically synthesized
ccacgatttttttttggtacaa

SEQ ID NO: 106728 - DNA, 22 bp, Artificial Sequence
  chemically synthesized
ttttttggtacaaattcttcaa

SEQ ID NO: 106729 - DNA, 22 bp, Artificial Sequence
  chemically synthesized
tttttggtacaaattcttcaaa

SEQ ID NO: 106730 - DNA, 22 bp, Artificial Sequence
  chemically synthesized
ttttggtacaaattcttcaaaa

SEQ ID NO: 106731 - DNA, 22 bp, Artificial Sequence
  chemically synthesized
tttggtacaaattcttcaaaat

SEQ ID NO: 106732 - DNA, 22 bp, Artificial Sequence
  chemically synthesized
ttggtacaaattcttcaaaatc

SEQ ID NO: 106733 - DNA, 22 bp, Artificial Sequence
  chemically synthesized
tggtacaaattcttcaaaatcg

SEQ ID NO: 106734 - DNA, 22 bp, Artificial Sequence
  chemically synthesized
ggtacaaattcttcaaaatcga

SEQ ID NO: 106735 - DNA, 22 bp, Artificial Sequence
  chemically synthesized
gtacaaattcttcaaaatcgag

SEQ ID NO: 106736 - DNA, 22 bp, Artificial Sequence
  chemically synthesized
ttcaaaatcgagtgtttacact

SEQ ID NO: 106737 - DNA, 22 bp, Artificial Sequence
  chemically synthesized
caaaatcgagtgtttacactta

SEQ ID NO: 106738 - DNA, 22 bp, Artificial Sequence
  chemically synthesized
aaaatcgagtgtttacacttac

SEQ ID NO: 106739 - DNA, 22 bp, Artificial Sequence
  chemically synthesized
acacttacagaaaattctgact

SEQ ID NO: 106740 - DNA, 22 bp, Artificial Sequence
  chemically synthesized
cacttacagaaaattctgactc

SEQ ID NO: 106741 - DNA, 22 bp, Artificial Sequence
  chemically synthesized
acagaaaattctgactcaagct

SEQ ID NO: 106742 - DNA, 22 bp, Artificial Sequence
  chemically synthesized
cagaaaattctgactcaagcta

SEQ ID NO: 106743 - DNA, 22 bp, Artificial Sequence
  chemically synthesized
tgactcaagctaaccagatgct

SEQ ID NO: 106744 - DNA, 22 bp, Artificial Sequence
  chemically synthesized
actcaagctaaccagatgctac

SEQ ID NO: 106745 - DNA, 22 bp, Artificial Sequence
  chemically synthesized
aagctaaccagatgctactgtt

SEQ ID NO: 106746 - DNA, 22 bp, Artificial Sequence
  chemically synthesized
accagatgctactgttttggac

SEQ ID NO: 106747 - DNA, 22 bp, Artificial Sequence
  chemically synthesized
ctgttttggacagcacagctct

SEQ ID NO: 106748 - DNA, 22 bp, Artificial Sequence
  chemically synthesized
ttttggacagcacagctctaga

SEQ ID NO: 106749 - DNA, 22 bp, Artificial Sequence
  chemically synthesized
tggacagcacagctctagacta

SEQ ID NO: 106750 - DNA, 22 bp, Artificial Sequence
  chemically synthesized
ggacagcacagctctagactat

SEQ ID NO: 106751 - DNA, 22 bp, Artificial Sequence
  chemically synthesized
gacagcacagctctagactata

SEQ ID NO: 106752 - DNA, 22 bp, Artificial Sequence
  chemically synthesized
tagactatacgacttcatcctc

SEQ ID NO: 106753 - DNA, 22 bp, Artificial Sequence
  chemically synthesized
gactatacgacttcatcctcag

SEQ ID NO: 106754 - DNA, 22 bp, Artificial Sequence
  chemically synthesized
tacgacttcatcctcagtttcg

SEQ ID NO: 106755 - DNA, 22 bp, Artificial Sequence
  chemically synthesized
catcctcagtttcgactccagc

SEQ ID NO: 106756 - DNA, 22 bp, Artificial Sequence
  chemically synthesized
atcctcagtttcgactccagct

SEQ ID NO: 106757 - DNA, 22 bp, Artificial Sequence
  chemically synthesized
agtttcgactccagctgctttc

SEQ ID NO: 106758 - DNA, 22 bp, Artificial Sequence
  chemically synthesized
cgactccagctgctttctacca

SEQ ID NO: 106759 - DNA, 22 bp, Artificial Sequence
  chemically synthesized
gactccagctgctttctaccac

SEQ ID NO: 106760 - DNA, 22 bp, Artificial Sequence
  chemically synthesized
cagctgctttctaccacccttt

SEQ ID NO: 106761 - DNA, 22 bp, Artificial Sequence
  chemically synthesized
ctttctaccaccctttcagaca

SEQ ID NO: 106762 - DNA, 22 bp, Artificial Sequence
  chemically synthesized
tctaccaccctttcagacattg

SEQ ID NO: 106763 - DNA, 22 bp, Artificial Sequence
  chemically synthesized
ctaccaccctttcagacattgt

SEQ ID NO: 106764 - DNA, 22 bp, Artificial Sequence
  chemically synthesized
taccaccctttcagacattgtg

SEQ ID NO: 106765 - DNA, 22 bp, Artificial Sequence
  chemically synthesized
ccaccctttcagacattgtgct

SEQ ID NO: 106766 - DNA, 22 bp, Artificial Sequence
  chemically synthesized
tcagacattgtgcttcatcaaa

SEQ ID NO: 106767 - DNA, 22 bp, Artificial Sequence
  chemically synthesized
cagacattgtgcttcatcaaaa

SEQ ID NO: 106768 - DNA, 22 bp, Artificial Sequence
  chemically synthesized
agacattgtgcttcatcaaaaa

SEQ ID NO: 106769 - DNA, 22 bp, Artificial Sequence
  chemically synthesized
tgcttcatcaaaaaaatgttaa

SEQ ID NO: 106770 - DNA, 22 bp, Artificial Sequence
  chemically synthesized
catcaaaaaaatgttaagaata

SEQ ID NO: 106771 - DNA, 22 bp, Artificial Sequence
  chemically synthesized
atcaaaaaaatgttaagaataa

SEQ ID NO: 106772 - DNA, 22 bp, Artificial Sequence
  chemically synthesized
agaataaaaattatttcacaca

SEQ ID NO: 106773 - DNA, 22 bp, Artificial Sequence
  chemically synthesized
tttcacacatactttaaaacta

SEQ ID NO: 106774 - DNA, 22 bp, Artificial Sequence
  chemically synthesized
cacacatactttaaaactaaca

SEQ ID NO: 106775 - DNA, 22 bp, Artificial Sequence
  chemically synthesized
acacatactttaaaactaacac

SEQ ID NO: 106776 - DNA, 22 bp, Artificial Sequence
  chemically synthesized
taaaactaacacatatattgga

SEQ ID NO: 106777 - DNA, 22 bp, Artificial Sequence
  chemically synthesized
aaaactaacacatatattggaa

SEQ ID NO: 106778 - DNA, 22 bp, Artificial Sequence
  chemically synthesized
aaactaacacatatattggaaa

SEQ ID NO: 106779 - DNA, 22 bp, Artificial Sequence
  chemically synthesized
acacatatattggaaaagaaag

SEQ ID NO: 106780 - DNA, 22 bp, Artificial Sequence
  chemically synthesized
gaaaagaaagtctcctctctca

SEQ ID NO: 106781 - DNA, 22 bp, Artificial Sequence
  chemically synthesized
ctctctcactagctatttttta

SEQ ID NO: 106782 - DNA, 22 bp, Artificial Sequence
  chemically synthesized
tctcactagctattttttaaat

SEQ ID NO: 106783 - DNA, 22 bp, Artificial Sequence
  chemically synthesized
tcactagctattttttaaatgg

SEQ ID NO: 106784 - DNA, 22 bp, Artificial Sequence
  chemically synthesized
actagctattttttaaatggtg

SEQ ID NO: 106785 - DNA, 22 bp, Artificial Sequence
  chemically synthesized
gctattttttaaatggtgtgat

SEQ ID NO: 106786 - DNA, 22 bp, Artificial Sequence
  chemically synthesized
ttttttaaatggtgtgataggc

SEQ ID NO: 106787 - DNA, 22 bp, Artificial Sequence
  chemically synthesized
tttaaatggtgtgataggcata

SEQ ID NO: 106788 - DNA, 22 bp, Artificial Sequence
  chemically synthesized
ttaaatggtgtgataggcataa

SEQ ID NO: 106789 - DNA, 22 bp, Artificial Sequence
  chemically synthesized
taaatggtgtgataggcataat

SEQ ID NO: 106790 - DNA, 22 bp, Artificial Sequence
  chemically synthesized
aaatggtgtgataggcataatt

SEQ ID NO: 106791 - DNA, 22 bp, Artificial Sequence
  chemically synthesized
aatggtgtgataggcataattt

SEQ ID NO: 106792 - DNA, 22 bp, Artificial Sequence
  chemically synthesized
taaaaacctttctaccacaaga

SEQ ID NO: 106793 - DNA, 22 bp, Artificial Sequence
  chemically synthesized
aaaaacctttctaccacaagat

SEQ ID NO: 106794 - DNA, 22 bp, Artificial Sequence
  chemically synthesized
aaaacctttctaccacaagatt

SEQ ID NO: 106795 - DNA, 22 bp, Artificial Sequence
  chemically synthesized
tctaccacaagatttcctatcc

SEQ ID NO: 106796 - DNA, 22 bp, Artificial Sequence
  chemically synthesized
ctaccacaagatttcctatcct

SEQ ID NO: 106797 - DNA, 22 bp, Artificial Sequence
  chemically synthesized
taccacaagatttcctatccta

SEQ ID NO: 106798 - DNA, 22 bp, Artificial Sequence
  chemically synthesized
ccacaagatttcctatcctaat

SEQ ID NO: 106799 - DNA, 22 bp, Artificial Sequence
  chemically synthesized
cctatcctaatttctaggactg

SEQ ID NO: 106800 - DNA, 22 bp, Artificial Sequence
  chemically synthesized
ctatcctaatttctaggactgt

SEQ ID NO: 106801 - DNA, 22 bp, Artificial Sequence
  chemically synthesized
tcctaatttctaggactgtgaa

SEQ ID NO: 106802 - DNA, 22 bp, Artificial Sequence
  chemically synthesized
atttctaggactgtgaatatga

SEQ ID NO: 106803 - DNA, 22 bp, Artificial Sequence
  chemically synthesized
ctaggactgtgaatatgataca

SEQ ID NO: 106804 - DNA, 22 bp, Artificial Sequence
  chemically synthesized
taggactgtgaatatgatacaa

SEQ ID NO: 106805 - DNA, 22 bp, Artificial Sequence
  chemically synthesized
ggactgtgaatatgatacaata

SEQ ID NO: 106806 - DNA, 22 bp, Artificial Sequence
  chemically synthesized
tgaatatgatacaatatcatgc

SEQ ID NO: 106807 - DNA, 22 bp, Artificial Sequence
  chemically synthesized
ggggttatacagatgtaattaa

SEQ ID NO: 106808 - DNA, 22 bp, Artificial Sequence
  chemically synthesized
gggttatacagatgtaattaaa

SEQ ID NO: 106809 - DNA, 22 bp, Artificial Sequence
  chemically synthesized
tacagatgtaattaaagttgct

SEQ ID NO: 106810 - DNA, 22 bp, Artificial Sequence
  chemically synthesized
aagttgctgatctattgacttt

SEQ ID NO: 106811 - DNA, 22 bp, Artificial Sequence
  chemically synthesized
ctgatctattgactttgagtta

SEQ ID NO: 106812 - DNA, 22 bp, Artificial Sequence
  chemically synthesized
atctattgactttgagttaatt

SEQ ID NO: 106813 - DNA, 22 bp, Artificial Sequence
  chemically synthesized
ttgactttgagttaattgaaaa

SEQ ID NO: 106814 - DNA, 22 bp, Artificial Sequence
  chemically synthesized
actttgagttaattgaaaagga

SEQ ID NO: 106815 - DNA, 22 bp, Artificial Sequence
  chemically synthesized
tgagttaattgaaaaggaaatt

SEQ ID NO: 106816 - DNA, 22 bp, Artificial Sequence
  chemically synthesized
gagttaattgaaaaggaaatta

SEQ ID NO: 106817 - DNA, 22 bp, Artificial Sequence
  chemically synthesized
agttaattgaaaaggaaattac

SEQ ID NO: 106818 - DNA, 22 bp, Artificial Sequence
  chemically synthesized
attgaaaaggaaattactcagg

SEQ ID NO: 106819 - DNA, 22 bp, Artificial Sequence
  chemically synthesized
aaaaggaaattactcaggggaa

SEQ ID NO: 106820 - DNA, 22 bp, Artificial Sequence
  chemically synthesized
ctcaggggaacctagtctaatt

SEQ ID NO: 106821 - DNA, 22 bp, Artificial Sequence
  chemically synthesized
aggggaacctagtctaattcca

SEQ ID NO: 106822 - DNA, 22 bp, Artificial Sequence
  chemically synthesized
gtctaattccatgagcccctaa

SEQ ID NO: 106823 - DNA, 22 bp, Artificial Sequence
  chemically synthesized
attccatgagcccctaaaagca

SEQ ID NO: 106824 - DNA, 22 bp, Artificial Sequence
  chemically synthesized
catgagcccctaaaagcagagt

SEQ ID NO: 106825 - DNA, 22 bp, Artificial Sequence
  chemically synthesized
aaagcagagttttcaccaagta

SEQ ID NO: 106826 - DNA, 22 bp, Artificial Sequence
  chemically synthesized
tcaccaagtagtaggagaatag

SEQ ID NO: 106827 - DNA, 22 bp, Artificial Sequence
  chemically synthesized
caccaagtagtaggagaatagg

SEQ ID NO: 106828 - DNA, 22 bp, Artificial Sequence
  chemically synthesized
accaagtagtaggagaatagga

SEQ ID NO: 106829 - DNA, 22 bp, Artificial Sequence
  chemically synthesized
aaaatttgagaaaggttcatgg

SEQ ID NO: 106830 - DNA, 22 bp, Artificial Sequence
  chemically synthesized
gagaaaggttcatgggtcagtt

SEQ ID NO: 106831 - DNA, 22 bp, Artificial Sequence
  chemically synthesized
agaaaggttcatgggtcagttg

SEQ ID NO: 106832 - DNA, 22 bp, Artificial Sequence
  chemically synthesized
atgggtcagttgctggtttgaa

SEQ ID NO: 106833 - DNA, 22 bp, Artificial Sequence
  chemically synthesized
ctggtttgaaatataaggaggt

SEQ ID NO: 106834 - DNA, 22 bp, Artificial Sequence
  chemically synthesized
gtttgaaatataaggaggtcac

SEQ ID NO: 106835 - DNA, 22 bp, Artificial Sequence
  chemically synthesized
gaaatataaggaggtcacaaaa

SEQ ID NO: 106836 - DNA, 22 bp, Artificial Sequence
  chemically synthesized
aaatataaggaggtcacaaaag

SEQ ID NO: 106837 - DNA, 22 bp, Artificial Sequence
  chemically synthesized
ggtacagaacgggcatcctagc

SEQ ID NO: 106838 - DNA, 22 bp, Artificial Sequence
  chemically synthesized
gctaacagcctgcaaacaaaca

SEQ ID NO: 106839 - DNA, 22 bp, Artificial Sequence
  chemically synthesized
acagcctgcaaacaaacaaaca

SEQ ID NO: 106840 - DNA, 22 bp, Artificial Sequence
  chemically synthesized
caaacaaacaaacaaaaaacaa

SEQ ID NO: 106841 - DNA, 22 bp, Artificial Sequence
  chemically synthesized
cagagttcagcagtaggaaact

SEQ ID NO: 106842 - DNA, 22 bp, Artificial Sequence
  chemically synthesized
agagttcagcagtaggaaactg

SEQ ID NO: 106843 - DNA, 22 bp, Artificial Sequence
  chemically synthesized
agcagtaggaaactgaactctg

SEQ ID NO: 106844 - DNA, 22 bp, Artificial Sequence
  chemically synthesized
aactctgacagccgggtgcaat

SEQ ID NO: 106845 - DNA, 22 bp, Artificial Sequence
  chemically synthesized
tgacagccgggtgcaatggctc

SEQ ID NO: 106846 - DNA, 22 bp, Artificial Sequence
  chemically synthesized
acagccgggtgcaatggctcat

SEQ ID NO: 106847 - DNA, 22 bp, Artificial Sequence
  chemically synthesized
attcaagcctgtaatcccagca

SEQ ID NO: 106848 - DNA, 22 bp, Artificial Sequence
  chemically synthesized
aagcctgtaatcccagcacttt

SEQ ID NO: 106849 - DNA, 22 bp, Artificial Sequence
  chemically synthesized
taatcccagcactttgggaggc

SEQ ID NO: 106850 - DNA, 22 bp, Artificial Sequence
  chemically synthesized
tgggaggccaaggcgggcggat

SEQ ID NO: 106851 - DNA, 22 bp, Artificial Sequence
  chemically synthesized
gggaggccaaggcgggcggatc

SEQ ID NO: 106852 - DNA, 22 bp, Artificial Sequence
  chemically synthesized
ggaggccaaggcgggcggatca

SEQ ID NO: 106853 - DNA, 22 bp, Artificial Sequence
  chemically synthesized
aggtcaggagttccagaccagc

SEQ ID NO: 106854 - DNA, 22 bp, Artificial Sequence
  chemically synthesized
cagaccagcctggccaacatgg

SEQ ID NO: 106855 - DNA, 22 bp, Artificial Sequence
  chemically synthesized
gccaacatggtgaaattccatc

SEQ ID NO: 106856 - DNA, 22 bp, Artificial Sequence
  chemically synthesized
catccctaccaaaaaatataaa

SEQ ID NO: 106857 - DNA, 22 bp, Artificial Sequence
  chemically synthesized
ccaaaaaatataaaaattagcc

SEQ ID NO: 106858 - DNA, 22 bp, Artificial Sequence
  chemically synthesized
gccaggtgtggttgcagttgcc

SEQ ID NO: 106859 - DNA, 22 bp, Artificial Sequence
  chemically synthesized
cagttgcctgtagttccagcta

SEQ ID NO: 106860 - DNA, 22 bp, Artificial Sequence
  chemically synthesized
cctgtagttccagctacttggg

SEQ ID NO: 106861 - DNA, 22 bp, Artificial Sequence
  chemically synthesized
tagttccagctacttgggaaac

SEQ ID NO: 106862 - DNA, 22 bp, Artificial Sequence
  chemically synthesized
cagctacttgggaaactgaggc

SEQ ID NO: 106863 - DNA, 22 bp, Artificial Sequence
  chemically synthesized
cttgggaaactgaggcaggaga

SEQ ID NO: 106864 - DNA, 22 bp, Artificial Sequence
  chemically synthesized
gggaaactgaggcaggagaatt

SEQ ID NO: 106865 - DNA, 22 bp, Artificial Sequence
  chemically synthesized
ggaaactgaggcaggagaattg

SEQ ID NO: 106866 - DNA, 22 bp, Artificial Sequence
  chemically synthesized
aggcaggagaattgcttgaacc

SEQ ID NO: 106867 - DNA, 22 bp, Artificial Sequence
  chemically synthesized
cttgaacccgggaggcacaggt

SEQ ID NO: 106868 - DNA, 22 bp, Artificial Sequence
  chemically synthesized
gaacccgggaggcacaggttgc

SEQ ID NO: 106869 - DNA, 22 bp, Artificial Sequence
  chemically synthesized
aacccgggaggcacaggttgca

SEQ ID NO: 106870 - DNA, 22 bp, Artificial Sequence
  chemically synthesized
cagggagcaagagattgtgcca

SEQ ID NO: 106871 - DNA, 22 bp, Artificial Sequence
  chemically synthesized
tgccactgcactccaggctggg

SEQ ID NO: 106872 - DNA, 22 bp, Artificial Sequence
  chemically synthesized
cactccaggctgggtgacagag

SEQ ID NO: 106873 - DNA, 22 bp, Artificial Sequence
  chemically synthesized
caggctgggtgacagagcgaga

SEQ ID NO: 106874 - DNA, 22 bp, Artificial Sequence
  chemically synthesized
ggtgacagagcgagactccatc

SEQ ID NO: 106875 - DNA, 22 bp, Artificial Sequence
  chemically synthesized
catctcaaaaaaaaaaaaaaaa

SEQ ID NO: 106876 - DNA, 22 bp, Artificial Sequence
  chemically synthesized
aaaaaaaaaaaaaaaaaaaaga

SEQ ID NO: 106877 - DNA, 22 bp, Artificial Sequence
  chemically synthesized
agctctgactacaatctgaatg

SEQ ID NO: 106878 - DNA, 22 bp, Artificial Sequence
  chemically synthesized
tgactacaatctgaatgaacgt

SEQ ID NO: 106879 - DNA, 22 bp, Artificial Sequence
  chemically synthesized
actacaatctgaatgaacgtgg

SEQ ID NO: 106880 - DNA, 22 bp, Artificial Sequence
  chemically synthesized
caatctgaatgaacgtggaagc

SEQ ID NO: 106881 - DNA, 22 bp, Artificial Sequence
  chemically synthesized
aatgaacgtggaagcgaattct

SEQ ID NO: 106882 - DNA, 22 bp, Artificial Sequence
  chemically synthesized
ttccccagagcctttggataag

SEQ ID NO: 106883 - DNA, 22 bp, Artificial Sequence
  chemically synthesized
ccccagagcctttggataagag

SEQ ID NO: 106884 - DNA, 22 bp, Artificial Sequence
  chemically synthesized
cccagagcctttggataagagc

SEQ ID NO: 106885 - DNA, 22 bp, Artificial Sequence
  chemically synthesized
tggataagagcccagccctccc

SEQ ID NO: 106886 - DNA, 22 bp, Artificial Sequence
  chemically synthesized
ggataagagcccagccctcccg

SEQ ID NO: 106887 - DNA, 22 bp, Artificial Sequence
  chemically synthesized
gataagagcccagccctcccga

SEQ ID NO: 106888 - DNA, 22 bp, Artificial Sequence
  chemically synthesized
ccgatattttgaatttgacctt

SEQ ID NO: 106889 - DNA, 22 bp, Artificial Sequence
  chemically synthesized
tgaatttgaccttatgataccc

SEQ ID NO: 106890 - DNA, 22 bp, Artificial Sequence
  chemically synthesized
gaatttgaccttatgataccct

SEQ ID NO: 106891 - DNA, 22 bp, Artificial Sequence
  chemically synthesized
aatttgaccttatgatacccta

SEQ ID NO: 106892 - DNA, 22 bp, Artificial Sequence
  chemically synthesized
gaccttatgataccctaagcag

SEQ ID NO: 106893 - DNA, 22 bp, Artificial Sequence
  chemically synthesized
accttatgataccctaagcaga

SEQ ID NO: 106894 - DNA, 22 bp, Artificial Sequence
  chemically synthesized
atgataccctaagcagagaact

SEQ ID NO: 106895 - DNA, 22 bp, Artificial Sequence
  chemically synthesized
tgataccctaagcagagaactc

SEQ ID NO: 106896 - DNA, 22 bp, Artificial Sequence
  chemically synthesized
agcagagaactcagttaagcct

SEQ ID NO: 106897 - DNA, 22 bp, Artificial Sequence
  chemically synthesized
agttaagcctatgagagtgcag

SEQ ID NO: 106898 - DNA, 22 bp, Artificial Sequence
  chemically synthesized
agcctatgagagtgcagaccta

SEQ ID NO: 106899 - DNA, 22 bp, Artificial Sequence
  chemically synthesized
tgagagtgcagacctatagaaa

SEQ ID NO: 106900 - DNA, 22 bp, Artificial Sequence
  chemically synthesized
tagaaatgtgatataataaact

SEQ ID NO: 106901 - DNA, 22 bp, Artificial Sequence
  chemically synthesized
ataatgtttgaagcagctcaag

SEQ ID NO: 106902 - DNA, 22 bp, Artificial Sequence
  chemically synthesized
gaagcagctcaagttgcagtaa

SEQ ID NO: 106903 - DNA, 22 bp, Artificial Sequence
  chemically synthesized
aagcagctcaagttgcagtaat

SEQ ID NO: 106904 - DNA, 22 bp, Artificial Sequence
  chemically synthesized
aagttgcagtaatttatgtata

SEQ ID NO: 106905 - DNA, 22 bp, Artificial Sequence
  chemically synthesized
cagtaatttatgtataacaata

SEQ ID NO: 106906 - DNA, 22 bp, Artificial Sequence
  chemically synthesized
atgtataacaatagaaaactaa

SEQ ID NO: 106907 - DNA, 22 bp, Artificial Sequence
  chemically synthesized
tgtataacaatagaaaactaat

SEQ ID NO: 106908 - DNA, 22 bp, Artificial Sequence
  chemically synthesized
atgcaaagtattactattatcc

SEQ ID NO: 106909 - DNA, 22 bp, Artificial Sequence
  chemically synthesized
ctattatccatattttattaag

SEQ ID NO: 106910 - DNA, 22 bp, Artificial Sequence
  chemically synthesized
ttatccatattttattaagagt

SEQ ID NO: 106911 - DNA, 22 bp, Artificial Sequence
  chemically synthesized
tccatattttattaagagttta

SEQ ID NO: 106912 - DNA, 22 bp, Artificial Sequence
  chemically synthesized
tattaagagtttatagagttct

SEQ ID NO: 106913 - DNA, 22 bp, Artificial Sequence
  chemically synthesized
attaagagtttatagagttcta

SEQ ID NO: 106914 - DNA, 22 bp, Artificial Sequence
  chemically synthesized
ttaagagtttatagagttctat

SEQ ID NO: 106915 - DNA, 22 bp, Artificial Sequence
  chemically synthesized
agagtttatagagttctataat

SEQ ID NO: 106916 - DNA, 22 bp, Artificial Sequence
  chemically synthesized
atagagttctataataaactaa

SEQ ID NO: 106917 - DNA, 22 bp, Artificial Sequence
  chemically synthesized
tagagttctataataaactaat

SEQ ID NO: 106918 - DNA, 22 bp, Artificial Sequence
  chemically synthesized
tataataaactaatatttacag

SEQ ID NO: 106919 - DNA, 22 bp, Artificial Sequence
  chemically synthesized
taataaactaatatttacaggg

SEQ ID NO: 106920 - DNA, 22 bp, Artificial Sequence
  chemically synthesized
atatttacagggtttatgtaaa

SEQ ID NO: 106921 - DNA, 22 bp, Artificial Sequence
  chemically synthesized
acagggtttatgtaaattattg

SEQ ID NO: 106922 - DNA, 22 bp, Artificial Sequence
  chemically synthesized
cagggtttatgtaaattattgt

SEQ ID NO: 106923 - DNA, 22 bp, Artificial Sequence
  chemically synthesized
atgtaaattattgtatcattta

SEQ ID NO: 106924 - DNA, 22 bp, Artificial Sequence
  chemically synthesized
tgtaaattattgtatcatttat

SEQ ID NO: 106925 - DNA, 22 bp, Artificial Sequence
  chemically synthesized
ttgtatcatttatctattatca

SEQ ID NO: 106926 - DNA, 22 bp, Artificial Sequence
  chemically synthesized
tatcatttatctattatcacag

SEQ ID NO: 106927 - DNA, 22 bp, Artificial Sequence
  chemically synthesized
atctattatcacagaattgtca

SEQ ID NO: 106928 - DNA, 22 bp, Artificial Sequence
  chemically synthesized
tctattatcacagaattgtcac

SEQ ID NO: 106929 - DNA, 22 bp, Artificial Sequence
  chemically synthesized
ttatcacagaattgtcacatca

SEQ ID NO: 106930 - DNA, 22 bp, Artificial Sequence
  chemically synthesized
tcacagaattgtcacatcacaa

SEQ ID NO: 106931 - DNA, 22 bp, Artificial Sequence
  chemically synthesized
tcacatcacaaagccctgtata

SEQ ID NO: 106932 - DNA, 22 bp, Artificial Sequence
  chemically synthesized
tatagcatcagtggctgacaac

SEQ ID NO: 106933 - DNA, 22 bp, Artificial Sequence
  chemically synthesized
acaacattaaacatttattttt

SEQ ID NO: 106934 - DNA, 22 bp, Artificial Sequence
  chemically synthesized
aacatttatttttcactctaat

SEQ ID NO: 106935 - DNA, 22 bp, Artificial Sequence
  chemically synthesized
atttttcactctaatgcatggt

SEQ ID NO: 106936 - DNA, 22 bp, Artificial Sequence
  chemically synthesized
tttttcactctaatgcatggtt

SEQ ID NO: 106937 - DNA, 22 bp, Artificial Sequence
  chemically synthesized
ttcactctaatgcatggttcaa

SEQ ID NO: 106938 - DNA, 22 bp, Artificial Sequence
  chemically synthesized
tcactctaatgcatggttcaac

SEQ ID NO: 106939 - DNA, 22 bp, Artificial Sequence
  chemically synthesized
cactctaatgcatggttcaact

SEQ ID NO: 106940 - DNA, 22 bp, Artificial Sequence
  chemically synthesized
actctaatgcatggttcaactt

SEQ ID NO: 106941 - DNA, 22 bp, Artificial Sequence
  chemically synthesized
taatgcatggttcaacttattt

SEQ ID NO: 106942 - DNA, 22 bp, Artificial Sequence
  chemically synthesized
atgcatggttcaacttatttag

SEQ ID NO: 106943 - DNA, 22 bp, Artificial Sequence
  chemically synthesized
aacttatttaggctgggcttgg

SEQ ID NO: 106944 - DNA, 22 bp, Artificial Sequence
  chemically synthesized
atttaggctgggcttggctggg

SEQ ID NO: 106945 - DNA, 22 bp, Artificial Sequence
  chemically synthesized
tttaggctgggcttggctgggc

SEQ ID NO: 106946 - DNA, 22 bp, Artificial Sequence
  chemically synthesized
aggctgggcttggctgggcagc

SEQ ID NO: 106947 - DNA, 22 bp, Artificial Sequence
  chemically synthesized
ggctgggcttggctgggcagca

SEQ ID NO: 106948 - DNA, 22 bp, Artificial Sequence
  chemically synthesized
ggcttggctgggcagcactgat

SEQ ID NO: 106949 - DNA, 22 bp, Artificial Sequence
  chemically synthesized
ggctgggcagcactgatcattt

SEQ ID NO: 106950 - DNA, 22 bp, Artificial Sequence
  chemically synthesized
gctgggcagcactgatcatttc

SEQ ID NO: 106951 - DNA, 22 bp, Artificial Sequence
  chemically synthesized
ggcagcactgatcatttctgca

SEQ ID NO: 106952 - DNA, 22 bp, Artificial Sequence
  chemically synthesized
atcatttctgcaccatctgctc

SEQ ID NO: 106953 - DNA, 22 bp, Artificial Sequence
  chemically synthesized
ctgcaccatctgctcaggtaca

SEQ ID NO: 106954 - DNA, 22 bp, Artificial Sequence
  chemically synthesized
tgcaccatctgctcaggtacat

SEQ ID NO: 106955 - DNA, 22 bp, Artificial Sequence
  chemically synthesized
caccatctgctcaggtacatag

SEQ ID NO: 106956 - DNA, 22 bp, Artificial Sequence
  chemically synthesized
ctcaggtacatagggtgcagct

SEQ ID NO: 106957 - DNA, 22 bp, Artificial Sequence
  chemically synthesized
aggtacatagggtgcagctgta

SEQ ID NO: 106958 - DNA, 22 bp, Artificial Sequence
  chemically synthesized
tacgtcatccctatcctattgt

SEQ ID NO: 106959 - DNA, 22 bp, Artificial Sequence
  chemically synthesized
tcctattgttttcctgtgtcgt

SEQ ID NO: 106960 - DNA, 22 bp, Artificial Sequence
  chemically synthesized
ttgttttcctgtgtcgttcttc

SEQ ID NO: 106961 - DNA, 22 bp, Artificial Sequence
  chemically synthesized
ttttcctgtgtcgttcttccta

SEQ ID NO: 106962 - DNA, 22 bp, Artificial Sequence
  chemically synthesized
tcctgtgtcgttcttcctatat

SEQ ID NO: 106963 - DNA, 22 bp, Artificial Sequence
  chemically synthesized
cctgtgtcgttcttcctatatc

SEQ ID NO: 106964 - DNA, 22 bp, Artificial Sequence
  chemically synthesized
ctgtgtcgttcttcctatatcc

SEQ ID NO: 106965 - DNA, 22 bp, Artificial Sequence
  chemically synthesized
tgtcgttcttcctatatccatc

SEQ ID NO: 106966 - DNA, 22 bp, Artificial Sequence
  chemically synthesized
ttcctatatccatcaccctttt

SEQ ID NO: 106967 - DNA, 22 bp, Artificial Sequence
  chemically synthesized
cctatatccatcacccttttgt

SEQ ID NO: 106968 - DNA, 22 bp, Artificial Sequence
  chemically synthesized
ctatatccatcacccttttgtt

SEQ ID NO: 106969 - DNA, 22 bp, Artificial Sequence
  chemically synthesized
tatccatcacccttttgttgta

SEQ ID NO: 106970 - DNA, 22 bp, Artificial Sequence
  chemically synthesized
ttgttgtatctatttctatatt

SEQ ID NO: 106971 - DNA, 22 bp, Artificial Sequence
  chemically synthesized
tgttgtatctatttctatattg

SEQ ID NO: 106972 - DNA, 22 bp, Artificial Sequence
  chemically synthesized
gttgtatctatttctatattgt

SEQ ID NO: 106973 - DNA, 22 bp, Artificial Sequence
  chemically synthesized
ttgtatctatttctatattgtc

SEQ ID NO: 106974 - DNA, 22 bp, Artificial Sequence
  chemically synthesized
tatctatttctatattgtctct

SEQ ID NO: 106975 - DNA, 22 bp, Artificial Sequence
  chemically synthesized
tttctatattgtctcttatttt

SEQ ID NO: 106976 - DNA, 22 bp, Artificial Sequence
  chemically synthesized
ctatattgtctcttattttgcc

SEQ ID NO: 106977 - DNA, 22 bp, Artificial Sequence
  chemically synthesized
tatattgtctcttattttgccc

SEQ ID NO: 106978 - DNA, 22 bp, Artificial Sequence
  chemically synthesized
tattgtctcttattttgccctc

SEQ ID NO: 106979 - DNA, 22 bp, Artificial Sequence
  chemically synthesized
tctcttattttgccctctctaa

SEQ ID NO: 106980 - DNA, 22 bp, Artificial Sequence
  chemically synthesized
ttattttgccctctctaactaa

SEQ ID NO: 106981 - DNA, 22 bp, Artificial Sequence
  chemically synthesized
attttgccctctctaactaaac

SEQ ID NO: 106982 - DNA, 22 bp, Artificial Sequence
  chemically synthesized
ttttgccctctctaactaaacc

SEQ ID NO: 106983 - DNA, 22 bp, Artificial Sequence
  chemically synthesized
tgccctctctaactaaacccca

SEQ ID NO: 106984 - DNA, 22 bp, Artificial Sequence
  chemically synthesized
gccctctctaactaaaccccag

SEQ ID NO: 106985 - DNA, 22 bp, Artificial Sequence
  chemically synthesized
ccctctctaactaaaccccaga

SEQ ID NO: 106986 - DNA, 22 bp, Artificial Sequence
  chemically synthesized
tctaactaaaccccagatgtct

SEQ ID NO: 106987 - DNA, 22 bp, Artificial Sequence
  chemically synthesized
taactaaaccccagatgtctct

SEQ ID NO: 106988 - DNA, 22 bp, Artificial Sequence
  chemically synthesized
actaaaccccagatgtctcttt

SEQ ID NO: 106989 - DNA, 22 bp, Artificial Sequence
  chemically synthesized
aaccccagatgtctcttttgca

SEQ ID NO: 106990 - DNA, 22 bp, Artificial Sequence
  chemically synthesized
ttttgcatcacccagactttag

SEQ ID NO: 106991 - DNA, 22 bp, Artificial Sequence
  chemically synthesized
ttgcatcacccagactttagca

SEQ ID NO: 106992 - DNA, 22 bp, Artificial Sequence
  chemically synthesized
tgcatcacccagactttagcat

SEQ ID NO: 106993 - DNA, 22 bp, Artificial Sequence
  chemically synthesized
gcatcacccagactttagcata

SEQ ID NO: 106994 - DNA, 22 bp, Artificial Sequence
  chemically synthesized
catcacccagactttagcataa

SEQ ID NO: 106995 - DNA, 22 bp, Artificial Sequence
  chemically synthesized
tagcataaaacttagcacaaaa

SEQ ID NO: 106996 - DNA, 22 bp, Artificial Sequence
  chemically synthesized
agcataaaacttagcacaaaat

SEQ ID NO: 106997 - DNA, 22 bp, Artificial Sequence
  chemically synthesized
gcataaaacttagcacaaaatt

SEQ ID NO: 106998 - DNA, 22 bp, Artificial Sequence
  chemically synthesized
agcacaaaatttttactgttta

SEQ ID NO: 106999 - DNA, 22 bp, Artificial Sequence
  chemically synthesized
gcacaaaatttttactgtttac

SEQ ID NO: 107000 - DNA, 22 bp, Artificial Sequence
  chemically synthesized
ttactgtttacattcttttact

SEQ ID NO: 107001 - DNA, 22 bp, Artificial Sequence
  chemically synthesized
tactgtttacattcttttacta

SEQ ID NO: 107002 - DNA, 22 bp, Artificial Sequence
  chemically synthesized
actgtttacattcttttactag

SEQ ID NO: 107003 - DNA, 22 bp, Artificial Sequence
  chemically synthesized
ctgtttacattcttttactagt

SEQ ID NO: 107004 - DNA, 22 bp, Artificial Sequence
  chemically synthesized
tttacattcttttactagtctc

SEQ ID NO: 107005 - DNA, 22 bp, Artificial Sequence
  chemically synthesized
acattcttttactagtctctca

SEQ ID NO: 107006 - DNA, 22 bp, Artificial Sequence
  chemically synthesized
cattcttttactagtctctcag

SEQ ID NO: 107007 - DNA, 22 bp, Artificial Sequence
  chemically synthesized
ttttactagtctctcagaccta

SEQ ID NO: 107008 - DNA, 22 bp, Artificial Sequence
  chemically synthesized
ttactagtctctcagacctagt

SEQ ID NO: 107009 - DNA, 22 bp, Artificial Sequence
  chemically synthesized
tactagtctctcagacctagtg

SEQ ID NO: 107010 - DNA, 22 bp, Artificial Sequence
  chemically synthesized
actagtctctcagacctagtgg

SEQ ID NO: 107011 - DNA, 22 bp, Artificial Sequence
  chemically synthesized
ctagtctctcagacctagtggc

SEQ ID NO: 107012 - DNA, 22 bp, Artificial Sequence
  chemically synthesized
gtctctcagacctagtggctct

SEQ ID NO: 107013 - DNA, 22 bp, Artificial Sequence
  chemically synthesized
tcagacctagtggctctaactc

SEQ ID NO: 107014 - DNA, 22 bp, Artificial Sequence
  chemically synthesized
agacctagtggctctaactcat

SEQ ID NO: 107015 - DNA, 22 bp, Artificial Sequence
  chemically synthesized
gtggctctaactcattgtagta

SEQ ID NO: 107016 - DNA, 22 bp, Artificial Sequence
  chemically synthesized
taactcattgtagtaaaaaaca

SEQ ID NO: 107017 - DNA, 22 bp, Artificial Sequence
  chemically synthesized
actcattgtagtaaaaaacacg

SEQ ID NO: 107018 - DNA, 22 bp, Artificial Sequence
  chemically synthesized
attgtagtaaaaaacacggttc

SEQ ID NO: 107019 - DNA, 22 bp, Artificial Sequence
  chemically synthesized
tagtaaaaaacacggttctact

SEQ ID NO: 107020 - DNA, 22 bp, Artificial Sequence
  chemically synthesized
tactcccactccaacactaaca

SEQ ID NO: 107021 - DNA, 22 bp, Artificial Sequence
  chemically synthesized
ctcccactccaacactaacatt

SEQ ID NO: 107022 - DNA, 22 bp, Artificial Sequence
  chemically synthesized
ccactccaacactaacattgct

SEQ ID NO: 107023 - DNA, 22 bp, Artificial Sequence
  chemically synthesized
caacactaacattgcttacttt

SEQ ID NO: 107024 - DNA, 22 bp, Artificial Sequence
  chemically synthesized
acattgcttactttactaagtg

SEQ ID NO: 107025 - DNA, 22 bp, Artificial Sequence
  chemically synthesized
cttactttactaagtgttgtat

SEQ ID NO: 107026 - DNA, 22 bp, Artificial Sequence
  chemically synthesized
actttactaagtgttgtattaa

SEQ ID NO: 107027 - DNA, 22 bp, Artificial Sequence
  chemically synthesized
ctttactaagtgttgtattaac

SEQ ID NO: 107028 - DNA, 22 bp, Artificial Sequence
  chemically synthesized
tactaagtgttgtattaacaca

SEQ ID NO: 107029 - DNA, 22 bp, Artificial Sequence
  chemically synthesized
actaagtgttgtattaacacac

SEQ ID NO: 107030 - DNA, 22 bp, Artificial Sequence
  chemically synthesized
ctaagtgttgtattaacacacc

SEQ ID NO: 107031 - DNA, 22 bp, Artificial Sequence
  chemically synthesized
agtgttgtattaacacaccaat

SEQ ID NO: 107032 - DNA, 22 bp, Artificial Sequence
  chemically synthesized
tattaacacaccaatggccctg

SEQ ID NO: 107033 - DNA, 22 bp, Artificial Sequence
  chemically synthesized
acacaccaatggccctggaagc

SEQ ID NO: 107034 - DNA, 22 bp, Artificial Sequence
  chemically synthesized
gaagcaatgacagagtttgaca

SEQ ID NO: 107035 - DNA, 22 bp, Artificial Sequence
  chemically synthesized
gacatattgattgtaaggttat

SEQ ID NO: 107036 - DNA, 22 bp, Artificial Sequence
  chemically synthesized
acatattgattgtaaggttatt

SEQ ID NO: 107037 - DNA, 22 bp, Artificial Sequence
  chemically synthesized
attgtaaggttatttataaaat

SEQ ID NO: 107038 - DNA, 22 bp, Artificial Sequence
  chemically synthesized
taaggttatttataaaatttta

SEQ ID NO: 107039 - DNA, 22 bp, Artificial Sequence
  chemically synthesized
tttataaaattttaattacttt

SEQ ID NO: 107040 - DNA, 22 bp, Artificial Sequence
  chemically synthesized
ataaaattttaattactttatg

SEQ ID NO: 107041 - DNA, 22 bp, Artificial Sequence
  chemically synthesized
taaaattttaattactttatga

SEQ ID NO: 107042 - DNA, 22 bp, Artificial Sequence
  chemically synthesized
taattactttatgattaacaca

SEQ ID NO: 107043 - DNA, 22 bp, Artificial Sequence
  chemically synthesized
aattactttatgattaacacat

SEQ ID NO: 107044 - DNA, 22 bp, Artificial Sequence
  chemically synthesized
attactttatgattaacacatt

SEQ ID NO: 107045 - DNA, 22 bp, Artificial Sequence
  chemically synthesized
ctttatgattaacacattgatc

SEQ ID NO: 107046 - DNA, 22 bp, Artificial Sequence
  chemically synthesized
tatgattaacacattgatcact

SEQ ID NO: 107047 - DNA, 22 bp, Artificial Sequence
  chemically synthesized
atgattaacacattgatcacta

SEQ ID NO: 107048 - DNA, 22 bp, Artificial Sequence
  chemically synthesized
tgattaacacattgatcactaa

SEQ ID NO: 107049 - DNA, 22 bp, Artificial Sequence
  chemically synthesized
acacattgatcactaactgact

SEQ ID NO: 107050 - DNA, 22 bp, Artificial Sequence
  chemically synthesized
atcactaactgactggtatgct

SEQ ID NO: 107051 - DNA, 22 bp, Artificial Sequence
  chemically synthesized
actgactggtatgctgattgtt

SEQ ID NO: 107052 - DNA, 22 bp, Artificial Sequence
  chemically synthesized
actggtatgctgattgttaaac

SEQ ID NO: 107053 - DNA, 22 bp, Artificial Sequence
  chemically synthesized
gtatgctgattgttaaactgac

SEQ ID NO: 107054 - DNA, 22 bp, Artificial Sequence
  chemically synthesized
attgttaaactgacttaggtaa

SEQ ID NO: 107055 - DNA, 22 bp, Artificial Sequence
  chemically synthesized
ttaaactgacttaggtaagaac

SEQ ID NO: 107056 - DNA, 22 bp, Artificial Sequence
  chemically synthesized
aactgacttaggtaagaacagt

SEQ ID NO: 107057 - DNA, 22 bp, Artificial Sequence
  chemically synthesized
acttaggtaagaacagtgactt

SEQ ID NO: 107058 - DNA, 22 bp, Artificial Sequence
  chemically synthesized
aggtaagaacagtgacttcaaa

SEQ ID NO: 107059 - DNA, 22 bp, Artificial Sequence
  chemically synthesized
ggtaagaacagtgacttcaaaa

SEQ ID NO: 107060 - DNA, 22 bp, Artificial Sequence
  chemically synthesized
caaaatattactaatatactaa

SEQ ID NO: 107061 - DNA, 22 bp, Artificial Sequence
  chemically synthesized
aaaatattactaatatactaat

SEQ ID NO: 107062 - DNA, 22 bp, Artificial Sequence
  chemically synthesized
ctaatatactaattggctaata

SEQ ID NO: 107063 - DNA, 22 bp, Artificial Sequence
  chemically synthesized
atatactaattggctaatatat

SEQ ID NO: 107064 - DNA, 22 bp, Artificial Sequence
  chemically synthesized
attggctaatatataagctgaa

SEQ ID NO: 107065 - DNA, 22 bp, Artificial Sequence
  chemically synthesized
gctaatatataagctgaaaatg

SEQ ID NO: 107066 - DNA, 22 bp, Artificial Sequence
  chemically synthesized
atatataagctgaaaatgtggg

SEQ ID NO: 107067 - DNA, 22 bp, Artificial Sequence
  chemically synthesized
aaaatgtgggagctacaaagta

SEQ ID NO: 107068 - DNA, 22 bp, Artificial Sequence
  chemically synthesized
caaagtagaggaggaagaaggc

SEQ ID NO: 107069 - DNA, 22 bp, Artificial Sequence
  chemically synthesized
agcctagagaactgcatcaaga

SEQ ID NO: 107070 - DNA, 22 bp, Artificial Sequence
  chemically synthesized
gagaactgcatcaagaggagga

SEQ ID NO: 107071 - DNA, 22 bp, Artificial Sequence
  chemically synthesized
catcaagaggaggaggagaggt

SEQ ID NO: 107072 - DNA, 22 bp, Artificial Sequence
  chemically synthesized
caggtgtcatggtgaccccacc

SEQ ID NO: 107073 - DNA, 22 bp, Artificial Sequence
  chemically synthesized
cacattcactcccagagtcagt

SEQ ID NO: 107074 - DNA, 22 bp, Artificial Sequence
  chemically synthesized
actcccagagtcagtctctttc

SEQ ID NO: 107075 - DNA, 22 bp, Artificial Sequence
  chemically synthesized
ccagagtcagtctctttcctct

SEQ ID NO: 107076 - DNA, 22 bp, Artificial Sequence
  chemically synthesized
tttcctctcctgcctcttccaa

SEQ ID NO: 107077 - DNA, 22 bp, Artificial Sequence
  chemically synthesized
tcctctcctgcctcttccaaag

SEQ ID NO: 107078 - DNA, 22 bp, Artificial Sequence
  chemically synthesized
cctctcctgcctcttccaaaga

SEQ ID NO: 107079 - DNA, 22 bp, Artificial Sequence
  chemically synthesized
ctctcctgcctcttccaaagaa

SEQ ID NO: 107080 - DNA, 22 bp, Artificial Sequence
  chemically synthesized
tcctgcctcttccaaagaaaat

SEQ ID NO: 107081 - DNA, 22 bp, Artificial Sequence
  chemically synthesized
ctgcctcttccaaagaaaattt

SEQ ID NO: 107082 - DNA, 22 bp, Artificial Sequence
  chemically synthesized
cctcttccaaagaaaatttcta

SEQ ID NO: 107083 - DNA, 22 bp, Artificial Sequence
  chemically synthesized
ttccaaagaaaatttctattgt

SEQ ID NO: 107084 - DNA, 22 bp, Artificial Sequence
  chemically synthesized
ccaaagaaaatttctattgtag

SEQ ID NO: 107085 - DNA, 22 bp, Artificial Sequence
  chemically synthesized
caaagaaaatttctattgtagg

SEQ ID NO: 107086 - DNA, 22 bp, Artificial Sequence
  chemically synthesized
ctattgtaggaaaagtgttctt

SEQ ID NO: 107087 - DNA, 22 bp, Artificial Sequence
  chemically synthesized
tattgtaggaaaagtgttctta

SEQ ID NO: 107088 - DNA, 22 bp, Artificial Sequence
  chemically synthesized
ttgtaggaaaagtgttcttaat

SEQ ID NO: 107089 - DNA, 22 bp, Artificial Sequence
  chemically synthesized
taggaaaagtgttcttaatagc

SEQ ID NO: 107090 - DNA, 22 bp, Artificial Sequence
  chemically synthesized
ttaatagcgctgagctaacaag

SEQ ID NO: 107091 - DNA, 22 bp, Artificial Sequence
  chemically synthesized
aatagcgctgagctaacaagaa

SEQ ID NO: 107092 - DNA, 22 bp, Artificial Sequence
  chemically synthesized
atagcgctgagctaacaagaac

SEQ ID NO: 107093 - DNA, 22 bp, Artificial Sequence
  chemically synthesized
agctaacaagaacttctagata

SEQ ID NO: 107094 - DNA, 22 bp, Artificial Sequence
  chemically synthesized
acaagaacttctagatatcaac

SEQ ID NO: 107095 - DNA, 22 bp, Artificial Sequence
  chemically synthesized
ctagatatcaactcagaactct

SEQ ID NO: 107096 - DNA, 22 bp, Artificial Sequence
  chemically synthesized
tagatatcaactcagaactctt

SEQ ID NO: 107097 - DNA, 22 bp, Artificial Sequence
  chemically synthesized
gatatcaactcagaactcttaa

SEQ ID NO: 107098 - DNA, 22 bp, Artificial Sequence
  chemically synthesized
agaactcttaattattcatgta

SEQ ID NO: 107099 - DNA, 22 bp, Artificial Sequence
  chemically synthesized
ttaattattcatgtaagcaccc

SEQ ID NO: 107100 - DNA, 22 bp, Artificial Sequence
  chemically synthesized
aattattcatgtaagcacccat

SEQ ID NO: 107101 - DNA, 22 bp, Artificial Sequence
  chemically synthesized
attattcatgtaagcacccatc

SEQ ID NO: 107102 - DNA, 22 bp, Artificial Sequence
  chemically synthesized
ttcatgtaagcacccatcacat

SEQ ID NO: 107103 - DNA, 22 bp, Artificial Sequence
  chemically synthesized
atgtaagcacccatcacataaa

SEQ ID NO: 107104 - DNA, 22 bp, Artificial Sequence
  chemically synthesized
ctgtttttatttcagagttaac

SEQ ID NO: 107105 - DNA, 22 bp, Artificial Sequence
  chemically synthesized
tttttatttcagagttaacatt

SEQ ID NO: 107106 - DNA, 22 bp, Artificial Sequence
  chemically synthesized
ttatttcagagttaacatttgc

SEQ ID NO: 107107 - DNA, 22 bp, Artificial Sequence
  chemically synthesized
tatttcagagttaacatttgct

SEQ ID NO: 107108 - DNA, 22 bp, Artificial Sequence
  chemically synthesized
atttcagagttaacatttgcta

SEQ ID NO: 107109 - DNA, 22 bp, Artificial Sequence
  chemically synthesized
tttcagagttaacatttgctag

SEQ ID NO: 107110 - DNA, 22 bp, Artificial Sequence
  chemically synthesized
cagagttaacatttgctaggaa

SEQ ID NO: 107111 - DNA, 22 bp, Artificial Sequence
  chemically synthesized
agagttaacatttgctaggaag

SEQ ID NO: 107112 - DNA, 22 bp, Artificial Sequence
  chemically synthesized
acatttgctaggaagttgaact

SEQ ID NO: 107113 - DNA, 22 bp, Artificial Sequence
  chemically synthesized
gctaggaagttgaacttttatg

SEQ ID NO: 107114 - DNA, 22 bp, Artificial Sequence
  chemically synthesized
ctaggaagttgaacttttatgt

SEQ ID NO: 107115 - DNA, 22 bp, Artificial Sequence
  chemically synthesized
ggaagttgaacttttatgttgg

SEQ ID NO: 107116 - DNA, 22 bp, Artificial Sequence
  chemically synthesized
aacttttatgttggaggttgat

SEQ ID NO: 107117 - DNA, 22 bp, Artificial Sequence
  chemically synthesized
ttatgttggaggttgatacacc

SEQ ID NO: 107118 - DNA, 22 bp, Artificial Sequence
  chemically synthesized
tatgttggaggttgatacaccc

SEQ ID NO: 107119 - DNA, 22 bp, Artificial Sequence
  chemically synthesized
atgttggaggttgatacacccg

SEQ ID NO: 107120 - DNA, 22 bp, Artificial Sequence
  chemically synthesized
tgttggaggttgatacacccgg

SEQ ID NO: 107121 - DNA, 22 bp, Artificial Sequence
  chemically synthesized
gaggttgatacacccggcagaa

SEQ ID NO: 107122 - DNA, 22 bp, Artificial Sequence
  chemically synthesized
atacacccggcagaatctgtag

SEQ ID NO: 107123 - DNA, 22 bp, Artificial Sequence
  chemically synthesized
tagatacagatatcttgcctct

SEQ ID NO: 107124 - DNA, 22 bp, Artificial Sequence
  chemically synthesized
gcctcttttctctatttaccct

SEQ ID NO: 107125 - DNA, 22 bp, Artificial Sequence
  chemically synthesized
cctcttttctctatttaccctc

SEQ ID NO: 107126 - DNA, 22 bp, Artificial Sequence
  chemically synthesized
ttttctctatttaccctcttgc

SEQ ID NO: 107127 - DNA, 22 bp, Artificial Sequence
  chemically synthesized
ttctctatttaccctcttgcaa

SEQ ID NO: 107128 - DNA, 22 bp, Artificial Sequence
  chemically synthesized
tctctatttaccctcttgcaac

SEQ ID NO: 107129 - DNA, 22 bp, Artificial Sequence
  chemically synthesized
ctctatttaccctcttgcaaca

SEQ ID NO: 107130 - DNA, 22 bp, Artificial Sequence
  chemically synthesized
tctatttaccctcttgcaacaa

SEQ ID NO: 107131 - DNA, 22 bp, Artificial Sequence
  chemically synthesized
tatttaccctcttgcaacaact

SEQ ID NO: 107132 - DNA, 22 bp, Artificial Sequence
  chemically synthesized
tttaccctcttgcaacaactat

SEQ ID NO: 107133 - DNA, 22 bp, Artificial Sequence
  chemically synthesized
accctcttgcaacaactatgtg

SEQ ID NO: 107134 - DNA, 22 bp, Artificial Sequence
  chemically synthesized
ccctcttgcaacaactatgtgg

SEQ ID NO: 107135 - DNA, 22 bp, Artificial Sequence
  chemically synthesized
ttgcaacaactatgtggtggaa

SEQ ID NO: 107136 - DNA, 22 bp, Artificial Sequence
  chemically synthesized
gcaacaactatgtggtggaaga

SEQ ID NO: 107137 - DNA, 22 bp, Artificial Sequence
  chemically synthesized
caacaactatgtggtggaagag

SEQ ID NO: 107138 - DNA, 22 bp, Artificial Sequence
  chemically synthesized
tgtggtggaagagaatccaaga

SEQ ID NO: 107139 - DNA, 22 bp, Artificial Sequence
  chemically synthesized
gtctttattttcctctcaatta

SEQ ID NO: 107140 - DNA, 22 bp, Artificial Sequence
  chemically synthesized
tattttcctctcaattaccttc

SEQ ID NO: 107141 - DNA, 22 bp, Artificial Sequence
  chemically synthesized
attttcctctcaattaccttca

SEQ ID NO: 107142 - DNA, 22 bp, Artificial Sequence
  chemically synthesized
ttttcctctcaattaccttcat

SEQ ID NO: 107143 - DNA, 22 bp, Artificial Sequence
  chemically synthesized
tcctctcaattaccttcattcc

SEQ ID NO: 107144 - DNA, 22 bp, Artificial Sequence
  chemically synthesized
cctctcaattaccttcattcca

SEQ ID NO: 107145 - DNA, 22 bp, Artificial Sequence
  chemically synthesized
ctctcaattaccttcattccat

SEQ ID NO: 107146 - DNA, 22 bp, Artificial Sequence
  chemically synthesized
tcaattaccttcattccattct

SEQ ID NO: 107147 - DNA, 22 bp, Artificial Sequence
  chemically synthesized
aattaccttcattccattctcc

SEQ ID NO: 107148 - DNA, 22 bp, Artificial Sequence
  chemically synthesized
ccttcattccattctcccatag

SEQ ID NO: 107149 - DNA, 22 bp, Artificial Sequence
  chemically synthesized
cattccattctcccatagtcac

SEQ ID NO: 107150 - DNA, 22 bp, Artificial Sequence
  chemically synthesized
attccattctcccatagtcact

SEQ ID NO: 107151 - DNA, 22 bp, Artificial Sequence
  chemically synthesized
cattctcccatagtcactagag

SEQ ID NO: 107152 - DNA, 22 bp, Artificial Sequence
  chemically synthesized
tcccatagtcactagagcctga

SEQ ID NO: 107153 - DNA, 22 bp, Artificial Sequence
  chemically synthesized
ccatagtcactagagcctgacc

SEQ ID NO: 107154 - DNA, 22 bp, Artificial Sequence
  chemically synthesized
gagcctgacctggggtatcaga

SEQ ID NO: 107155 - DNA, 22 bp, Artificial Sequence
  chemically synthesized
acctggggtatcagaaattaag

SEQ ID NO: 107156 - DNA, 22 bp, Artificial Sequence
  chemically synthesized
gggtatcagaaattaaggggag

SEQ ID NO: 107157 - DNA, 22 bp, Artificial Sequence
  chemically synthesized
aggggagaggtaattgctgagt

SEQ ID NO: 107158 - DNA, 22 bp, Artificial Sequence
  chemically synthesized
ctgagtcctggtgtagaaattg

SEQ ID NO: 107159 - DNA, 22 bp, Artificial Sequence
  chemically synthesized
agtcctggtgtagaaattggtt

SEQ ID NO: 107160 - DNA, 22 bp, Artificial Sequence
  chemically synthesized
gtgtagaaattggtttaaatgg

SEQ ID NO: 107161 - DNA, 22 bp, Artificial Sequence
  chemically synthesized
gtttaaatggtatctctgaaga

SEQ ID NO: 107162 - DNA, 22 bp, Artificial Sequence
  chemically synthesized
aaatggtatctctgaagactgc

SEQ ID NO: 107163 - DNA, 22 bp, Artificial Sequence
  chemically synthesized
aatggtatctctgaagactgct

SEQ ID NO: 107164 - DNA, 22 bp, Artificial Sequence
  chemically synthesized
tgaagactgctaacagggttaa

SEQ ID NO: 107165 - DNA, 22 bp, Artificial Sequence
  chemically synthesized
aagactgctaacagggttaatt

SEQ ID NO: 107166 - DNA, 22 bp, Artificial Sequence
  chemically synthesized
ctaacagggttaatttgtgagg

SEQ ID NO: 107167 - DNA, 22 bp, Artificial Sequence
  chemically synthesized
acagggttaatttgtgaggtta

SEQ ID NO: 107168 - DNA, 22 bp, Artificial Sequence
  chemically synthesized
atttgtgaggttatttgtattc

SEQ ID NO: 107169 - DNA, 22 bp, Artificial Sequence
  chemically synthesized
gtgaggttatttgtattcaaaa

SEQ ID NO: 107170 - DNA, 22 bp, Artificial Sequence
  chemically synthesized
tgaggttatttgtattcaaaat

SEQ ID NO: 107171 - DNA, 22 bp, Artificial Sequence
  chemically synthesized
tttgtattcaaaattgttcccc

SEQ ID NO: 107172 - DNA, 22 bp, Artificial Sequence
  chemically synthesized
gtattcaaaattgttccccagt

SEQ ID NO: 107173 - DNA, 22 bp, Artificial Sequence
  chemically synthesized
tattcaaaattgttccccagta

SEQ ID NO: 107174 - DNA, 22 bp, Artificial Sequence
  chemically synthesized
aaaattgttccccagtatctgt

SEQ ID NO: 107175 - DNA, 22 bp, Artificial Sequence
  chemically synthesized
ttccccagtatctgtcttgatg

SEQ ID NO: 107176 - DNA, 22 bp, Artificial Sequence
  chemically synthesized
cccagtatctgtcttgatgctg

SEQ ID NO: 107177 - DNA, 22 bp, Artificial Sequence
  chemically synthesized
tcttgatgctggataattaggc

SEQ ID NO: 107178 - DNA, 22 bp, Artificial Sequence
  chemically synthesized
gatgctggataattaggctact

SEQ ID NO: 107179 - DNA, 22 bp, Artificial Sequence
  chemically synthesized
atgctggataattaggctactg

SEQ ID NO: 107180 - DNA, 22 bp, Artificial Sequence
  chemically synthesized
gataattaggctactgggatat

SEQ ID NO: 107181 - DNA, 22 bp, Artificial Sequence
  chemically synthesized
ggctactgggatattttttttc

SEQ ID NO: 107182 - DNA, 22 bp, Artificial Sequence
  chemically synthesized
ctgggatattttttttcaagcc

SEQ ID NO: 107183 - DNA, 22 bp, Artificial Sequence
  chemically synthesized
ggatattttttttcaagcctcc

SEQ ID NO: 107184 - DNA, 22 bp, Artificial Sequence
  chemically synthesized
tttttcaagcctcctttggaga

SEQ ID NO: 107185 - DNA, 22 bp, Artificial Sequence
  chemically synthesized
ttttcaagcctcctttggagaa

SEQ ID NO: 107186 - DNA, 22 bp, Artificial Sequence
  chemically synthesized
tttcaagcctcctttggagaag

SEQ ID NO: 107187 - DNA, 22 bp, Artificial Sequence
  chemically synthesized
ttcaagcctcctttggagaagg

SEQ ID NO: 107188 - DNA, 22 bp, Artificial Sequence
  chemically synthesized
tcaagcctcctttggagaagga

SEQ ID NO: 107189 - DNA, 22 bp, Artificial Sequence
  chemically synthesized
caagcctcctttggagaaggaa

SEQ ID NO: 107190 - DNA, 22 bp, Artificial Sequence
  chemically synthesized
aagcctcctttggagaaggaag

SEQ ID NO: 107191 - DNA, 22 bp, Artificial Sequence
  chemically synthesized
ctttggagaaggaagtgggctc

SEQ ID NO: 107192 - DNA, 22 bp, Artificial Sequence
  chemically synthesized
tggagaaggaagtgggctccag

SEQ ID NO: 107193 - DNA, 22 bp, Artificial Sequence
  chemically synthesized
ggagaaggaagtgggctccaga

SEQ ID NO: 107194 - DNA, 22 bp, Artificial Sequence
  chemically synthesized
gagaaggaagtgggctccagaa

SEQ ID NO: 107195 - DNA, 22 bp, Artificial Sequence
  chemically synthesized
cagaactgtgttcttaaagccc

SEQ ID NO: 107196 - DNA, 22 bp, Artificial Sequence
  chemically synthesized
tgttcttaaagccccatatttt

SEQ ID NO: 107197 - DNA, 22 bp, Artificial Sequence
  chemically synthesized
ttaaagccccatattttctttg

SEQ ID NO: 107198 - DNA, 22 bp, Artificial Sequence
  chemically synthesized
aaagccccatattttctttgca

SEQ ID NO: 107199 - DNA, 22 bp, Artificial Sequence
  chemically synthesized
aagccccatattttctttgcaa

SEQ ID NO: 107200 - DNA, 22 bp, Artificial Sequence
  chemically synthesized
tctttgcaaaaagaaaacagaa

SEQ ID NO: 107201 - DNA, 22 bp, Artificial Sequence
  chemically synthesized
ctttgcaaaaagaaaacagaat

SEQ ID NO: 107202 - DNA, 22 bp, Artificial Sequence
  chemically synthesized
tttgcaaaaagaaaacagaatt

SEQ ID NO: 107203 - DNA, 22 bp, Artificial Sequence
  chemically synthesized
tgcaaaaagaaaacagaattgt

SEQ ID NO: 107204 - DNA, 22 bp, Artificial Sequence
  chemically synthesized
gcaaaaagaaaacagaattgta

SEQ ID NO: 107205 - DNA, 22 bp, Artificial Sequence
  chemically synthesized
caaaaagaaaacagaattgtag

SEQ ID NO: 107206 - DNA, 22 bp, Artificial Sequence
  chemically synthesized
tagcttcatccagcacatggaa

SEQ ID NO: 107207 - DNA, 22 bp, Artificial Sequence
  chemically synthesized
catccagcacatggaagtcatg

SEQ ID NO: 107208 - DNA, 22 bp, Artificial Sequence
  chemically synthesized
atccagcacatggaagtcatgc

SEQ ID NO: 107209 - DNA, 22 bp, Artificial Sequence
  chemically synthesized
tctaactacctttgccttgtat

SEQ ID NO: 107210 - DNA, 22 bp, Artificial Sequence
  chemically synthesized
actacctttgccttgtatgatt

SEQ ID NO: 107211 - DNA, 22 bp, Artificial Sequence
  chemically synthesized
cctttgccttgtatgattcccc

SEQ ID NO: 107212 - DNA, 22 bp, Artificial Sequence
  chemically synthesized
tgccttgtatgattccccacct

SEQ ID NO: 107213 - DNA, 22 bp, Artificial Sequence
  chemically synthesized
gccttgtatgattccccacctc

SEQ ID NO: 107214 - DNA, 22 bp, Artificial Sequence
  chemically synthesized
ccttgtatgattccccacctca

SEQ ID NO: 107215 - DNA, 22 bp, Artificial Sequence
  chemically synthesized
gtatgattccccacctcaaaaa

SEQ ID NO: 107216 - DNA, 22 bp, Artificial Sequence
  chemically synthesized
tatgattccccacctcaaaaag

SEQ ID NO: 107217 - DNA, 22 bp, Artificial Sequence
  chemically synthesized
cccacctcaaaaagaagatacc

SEQ ID NO: 107218 - DNA, 22 bp, Artificial Sequence
  chemically synthesized
aaaaagaagataccgtgaagcc

SEQ ID NO: 107219 - DNA, 22 bp, Artificial Sequence
  chemically synthesized
cttttgttattccttaaccctg

SEQ ID NO: 107220 - DNA, 22 bp, Artificial Sequence
  chemically synthesized
ttgttattccttaaccctgtag

SEQ ID NO: 107221 - DNA, 22 bp, Artificial Sequence
  chemically synthesized
tgttattccttaaccctgtagc

SEQ ID NO: 107222 - DNA, 22 bp, Artificial Sequence
  chemically synthesized
gttattccttaaccctgtagcc

SEQ ID NO: 107223 - DNA, 22 bp, Artificial Sequence
  chemically synthesized
ttattccttaaccctgtagcca

SEQ ID NO: 107224 - DNA, 22 bp, Artificial Sequence
  chemically synthesized
ttccttaaccctgtagccaata

SEQ ID NO: 107225 - DNA, 22 bp, Artificial Sequence
  chemically synthesized
cttaaccctgtagccaataagc

SEQ ID NO: 107226 - DNA, 22 bp, Artificial Sequence
  chemically synthesized
aaccctgtagccaataagctca

SEQ ID NO: 107227 - DNA, 22 bp, Artificial Sequence
  chemically synthesized
accctgtagccaataagctcac

SEQ ID NO: 107228 - DNA, 22 bp, Artificial Sequence
  chemically synthesized
tagccaataagctcactcaact

SEQ ID NO: 107229 - DNA, 22 bp, Artificial Sequence
  chemically synthesized
actcaacttagacaaagcttaa

SEQ ID NO: 107230 - DNA, 22 bp, Artificial Sequence
  chemically synthesized
aacttagacaaagcttaataat

SEQ ID NO: 107231 - DNA, 22 bp, Artificial Sequence
  chemically synthesized
agacaaagcttaataatccctc

SEQ ID NO: 107232 - DNA, 22 bp, Artificial Sequence
  chemically synthesized
gacaaagcttaataatccctca

SEQ ID NO: 107233 - DNA, 22 bp, Artificial Sequence
  chemically synthesized
aataatccctcacacttaatct

SEQ ID NO: 107234 - DNA, 22 bp, Artificial Sequence
  chemically synthesized
ataatccctcacacttaatctt

SEQ ID NO: 107235 - DNA, 22 bp, Artificial Sequence
  chemically synthesized
acacttaatcttttcttggttt

SEQ ID NO: 107236 - DNA, 22 bp, Artificial Sequence
  chemically synthesized
aatcttttcttggtttcaaata

SEQ ID NO: 107237 - DNA, 22 bp, Artificial Sequence
  chemically synthesized
atcttttcttggtttcaaataa

SEQ ID NO: 107238 - DNA, 22 bp, Artificial Sequence
  chemically synthesized
ttcttggtttcaaataagattg

SEQ ID NO: 107239 - DNA, 22 bp, Artificial Sequence
  chemically synthesized
tcttggtttcaaataagattgt

SEQ ID NO: 107240 - DNA, 22 bp, Artificial Sequence
  chemically synthesized
cttggtttcaaataagattgtt

SEQ ID NO: 107241 - DNA, 22 bp, Artificial Sequence
  chemically synthesized
ttggtttcaaataagattgttt

SEQ ID NO: 107242 - DNA, 22 bp, Artificial Sequence
  chemically synthesized
ggtttcaaataagattgtttgt

SEQ ID NO: 107243 - DNA, 22 bp, Artificial Sequence
  chemically synthesized
gtttcaaataagattgtttgtt

SEQ ID NO: 107244 - DNA, 22 bp, Artificial Sequence
  chemically synthesized
caaataagattgtttgttatat

SEQ ID NO: 107245 - DNA, 22 bp, Artificial Sequence
  chemically synthesized
aaataagattgtttgttatata

SEQ ID NO: 107246 - DNA, 22 bp, Artificial Sequence
  chemically synthesized
tttgttatatatactcacaaat

SEQ ID NO: 107247 - DNA, 22 bp, Artificial Sequence
  chemically synthesized
gttatatatactcacaaatgag

SEQ ID NO: 107248 - DNA, 22 bp, Artificial Sequence
  chemically synthesized
ttatatatactcacaaatgagt

SEQ ID NO: 107249 - DNA, 22 bp, Artificial Sequence
  chemically synthesized
tatatactcacaaatgagtgct

SEQ ID NO: 107250 - DNA, 22 bp, Artificial Sequence
  chemically synthesized
acaaatgagtgctgctgataag

SEQ ID NO: 107251 - DNA, 22 bp, Artificial Sequence
  chemically synthesized
ctgataagttctttcaaacagt

SEQ ID NO: 107252 - DNA, 22 bp, Artificial Sequence
  chemically synthesized
ataagttctttcaaacagtaag

SEQ ID NO: 107253 - DNA, 22 bp, Artificial Sequence
  chemically synthesized
tttcaaacagtaagcttgtttt

SEQ ID NO: 107254 - DNA, 22 bp, Artificial Sequence
  chemically synthesized
tcaaacagtaagcttgttttct

SEQ ID NO: 107255 - DNA, 22 bp, Artificial Sequence
  chemically synthesized
caaacagtaagcttgttttctg

SEQ ID NO: 107256 - DNA, 22 bp, Artificial Sequence
  chemically synthesized
aaacagtaagcttgttttctgt

SEQ ID NO: 107257 - DNA, 22 bp, Artificial Sequence
  chemically synthesized
gttttctgtctcttggtaagtc

SEQ ID NO: 107258 - DNA, 22 bp, Artificial Sequence
  chemically synthesized
ttttctgtctcttggtaagtct

SEQ ID NO: 107259 - DNA, 22 bp, Artificial Sequence
  chemically synthesized
tctgtctcttggtaagtcttgc

SEQ ID NO: 107260 - DNA, 22 bp, Artificial Sequence
  chemically synthesized
ctgtctcttggtaagtcttgcc

SEQ ID NO: 107261 - DNA, 22 bp, Artificial Sequence
  chemically synthesized
tgtctcttggtaagtcttgccc

SEQ ID NO: 107262 - DNA, 22 bp, Artificial Sequence
  chemically synthesized
tctcttggtaagtcttgcccaa

SEQ ID NO: 107263 - DNA, 22 bp, Artificial Sequence
  chemically synthesized
ttggtaagtcttgcccaagaat

SEQ ID NO: 107264 - DNA, 22 bp, Artificial Sequence
  chemically synthesized
ggtaagtcttgcccaagaatca

SEQ ID NO: 107265 - DNA, 22 bp, Artificial Sequence
  chemically synthesized
gtaagtcttgcccaagaatcag

SEQ ID NO: 107266 - DNA, 22 bp, Artificial Sequence
  chemically synthesized
gcccaagaatcagagttactgc

SEQ ID NO: 107267 - DNA, 22 bp, Artificial Sequence
  chemically synthesized
cccaagaatcagagttactgct

SEQ ID NO: 107268 - DNA, 22 bp, Artificial Sequence
  chemically synthesized
ctgcttctggagcaatataaat

SEQ ID NO: 107269 - DNA, 22 bp, Artificial Sequence
  chemically synthesized
cttctggagcaatataaatcaa

SEQ ID NO: 107270 - DNA, 22 bp, Artificial Sequence
  chemically synthesized
ctggagcaatataaatcaagtt

SEQ ID NO: 107271 - DNA, 22 bp, Artificial Sequence
  chemically synthesized
tggagcaatataaatcaagttt

SEQ ID NO: 107272 - DNA, 22 bp, Artificial Sequence
  chemically synthesized
gagcaatataaatcaagtttaa

SEQ ID NO: 107273 - DNA, 22 bp, Artificial Sequence
  chemically synthesized
aaaaaattttatttaagtgtcc

SEQ ID NO: 107274 - DNA, 22 bp, Artificial Sequence
  chemically synthesized
aaaaattttatttaagtgtcct

SEQ ID NO: 107275 - DNA, 22 bp, Artificial Sequence
  chemically synthesized
tatttaagtgtcctgtagtaat

SEQ ID NO: 107276 - DNA, 22 bp, Artificial Sequence
  chemically synthesized
atttaagtgtcctgtagtaatg

SEQ ID NO: 107277 - DNA, 22 bp, Artificial Sequence
  chemically synthesized
tttaagtgtcctgtagtaatgt

SEQ ID NO: 107278 - DNA, 22 bp, Artificial Sequence
  chemically synthesized
aagtgtcctgtagtaatgttaa

SEQ ID NO: 107279 - DNA, 22 bp, Artificial Sequence
  chemically synthesized
agtgtcctgtagtaatgttaaa

SEQ ID NO: 107280 - DNA, 22 bp, Artificial Sequence
  chemically synthesized
tagtaatgttaaaaaggggaca

SEQ ID NO: 107281 - DNA, 22 bp, Artificial Sequence
  chemically synthesized
aaaaggggacatggtggaggta

SEQ ID NO: 107282 - DNA, 22 bp, Artificial Sequence
  chemically synthesized
tttaatccctggctttgtctga

SEQ ID NO: 107283 - DNA, 22 bp, Artificial Sequence
  chemically synthesized
taatccctggctttgtctgaca

SEQ ID NO: 107284 - DNA, 22 bp, Artificial Sequence
  chemically synthesized
aatccctggctttgtctgacaa

SEQ ID NO: 107285 - DNA, 22 bp, Artificial Sequence
  chemically synthesized
atccctggctttgtctgacaat

SEQ ID NO: 107286 - DNA, 22 bp, Artificial Sequence
  chemically synthesized
gctttgtctgacaatttgtact

SEQ ID NO: 107287 - DNA, 22 bp, Artificial Sequence
  chemically synthesized
tgtctgacaatttgtacttgaa

SEQ ID NO: 107288 - DNA, 22 bp, Artificial Sequence
  chemically synthesized
gtctgacaatttgtacttgaat

SEQ ID NO: 107289 - DNA, 22 bp, Artificial Sequence
  chemically synthesized
tctgacaatttgtacttgaata

SEQ ID NO: 107290 - DNA, 22 bp, Artificial Sequence
  chemically synthesized
acaatttgtacttgaatacaat

SEQ ID NO: 107291 - DNA, 22 bp, Artificial Sequence
  chemically synthesized
gtacttgaatacaatcatctca

SEQ ID NO: 107292 - DNA, 22 bp, Artificial Sequence
  chemically synthesized
tacttgaatacaatcatctcat

SEQ ID NO: 107293 - DNA, 22 bp, Artificial Sequence
  chemically synthesized
gaatacaatcatctcatagtct

SEQ ID NO: 107294 - DNA, 22 bp, Artificial Sequence
  chemically synthesized
aatacaatcatctcatagtctg

SEQ ID NO: 107295 - DNA, 22 bp, Artificial Sequence
  chemically synthesized
atagtctgtcagagaaataagg

SEQ ID NO: 107296 - DNA, 22 bp, Artificial Sequence
  chemically synthesized
tcagagaaataaggatctgaga

SEQ ID NO: 107297 - DNA, 22 bp, Artificial Sequence
  chemically synthesized
agaatttctattgtctcatcag

SEQ ID NO: 107298 - DNA, 22 bp, Artificial Sequence
  chemically synthesized
ctattgtctcatcagtcttaaa

SEQ ID NO: 107299 - DNA, 22 bp, Artificial Sequence
  chemically synthesized
tattgtctcatcagtcttaaat

SEQ ID NO: 107300 - DNA, 22 bp, Artificial Sequence
  chemically synthesized
ttgtctcatcagtcttaaatcc

SEQ ID NO: 107301 - DNA, 22 bp, Artificial Sequence
  chemically synthesized
tctcatcagtcttaaatcctaa

SEQ ID NO: 107302 - DNA, 22 bp, Artificial Sequence
  chemically synthesized
atcagtcttaaatcctaaattt

SEQ ID NO: 107303 - DNA, 22 bp, Artificial Sequence
  chemically synthesized
aaatcctaaatttatcctggaa

SEQ ID NO: 107304 - DNA, 22 bp, Artificial Sequence
  chemically synthesized
aatcctaaatttatcctggaac

SEQ ID NO: 107305 - DNA, 22 bp, Artificial Sequence
  chemically synthesized
aatttatcctggaacttagccc

SEQ ID NO: 107306 - DNA, 22 bp, Artificial Sequence
  chemically synthesized
atcctggaacttagcccaacta

SEQ ID NO: 107307 - DNA, 22 bp, Artificial Sequence
  chemically synthesized
tcctggaacttagcccaactat

SEQ ID NO: 107308 - DNA, 22 bp, Artificial Sequence
  chemically synthesized
gaacttagcccaactatgagat

SEQ ID NO: 107309 - DNA, 22 bp, Artificial Sequence
  chemically synthesized
agcccaactatgagattttaaa

SEQ ID NO: 107310 - DNA, 22 bp, Artificial Sequence
  chemically synthesized
gcccaactatgagattttaaaa

SEQ ID NO: 107311 - DNA, 22 bp, Artificial Sequence
  chemically synthesized
tgagattttaaaatgagtatgg

SEQ ID NO: 107312 - DNA, 22 bp, Artificial Sequence
  chemically synthesized
taaaatgagtatgggtgcaatg

SEQ ID NO: 107313 - DNA, 22 bp, Artificial Sequence
  chemically synthesized
aaaatgagtatgggtgcaatgt

SEQ ID NO: 107314 - DNA, 22 bp, Artificial Sequence
  chemically synthesized
aaatgagtatgggtgcaatgtg

SEQ ID NO: 107315 - DNA, 22 bp, Artificial Sequence
  chemically synthesized
tggtgcctgacatttcacatca

SEQ ID NO: 107316 - DNA, 22 bp, Artificial Sequence
  chemically synthesized
ggtgcctgacatttcacatcag

SEQ ID NO: 107317 - DNA, 22 bp, Artificial Sequence
  chemically synthesized
gtgcctgacatttcacatcagt

SEQ ID NO: 107318 - DNA, 22 bp, Artificial Sequence
  chemically synthesized
acatttcacatcagttaagttc

SEQ ID NO: 107319 - DNA, 22 bp, Artificial Sequence
  chemically synthesized
cacatcagttaagttcctcctg

SEQ ID NO: 107320 - DNA, 22 bp, Artificial Sequence
  chemically synthesized
acatcagttaagttcctcctga

SEQ ID NO: 107321 - DNA, 22 bp, Artificial Sequence
  chemically synthesized
agttcctcctgaactgcattct

SEQ ID NO: 107322 - DNA, 22 bp, Artificial Sequence
  chemically synthesized
ctcctgaactgcattctgctca

SEQ ID NO: 107323 - DNA, 22 bp, Artificial Sequence
  chemically synthesized
ctgaactgcattctgctcatag

SEQ ID NO: 107324 - DNA, 22 bp, Artificial Sequence
  chemically synthesized
aactgcattctgctcataggtc

SEQ ID NO: 107325 - DNA, 22 bp, Artificial Sequence
  chemically synthesized
cattctgctcataggtcttcct

SEQ ID NO: 107326 - DNA, 22 bp, Artificial Sequence
  chemically synthesized
tgctcataggtcttcctaaatg

SEQ ID NO: 107327 - DNA, 22 bp, Artificial Sequence
  chemically synthesized
ctcataggtcttcctaaatgta

SEQ ID NO: 107328 - DNA, 22 bp, Artificial Sequence
  chemically synthesized
ataggtcttcctaaatgtaagc

SEQ ID NO: 107329 - DNA, 22 bp, Artificial Sequence
  chemically synthesized
cctaaatgtaagcagaatagta

SEQ ID NO: 107330 - DNA, 22 bp, Artificial Sequence
  chemically synthesized
ctaaatgtaagcagaatagtag

SEQ ID NO: 107331 - DNA, 22 bp, Artificial Sequence
  chemically synthesized
aatgtaagcagaatagtagtag

SEQ ID NO: 107332 - DNA, 22 bp, Artificial Sequence
  chemically synthesized
aaagtcagtctctggaaatggc

SEQ ID NO: 107333 - DNA, 22 bp, Artificial Sequence
  chemically synthesized
tggaaatggcttaagtctgaaa

SEQ ID NO: 107334 - DNA, 22 bp, Artificial Sequence
  chemically synthesized
gaaatggcttaagtctgaaaat

SEQ ID NO: 107335 - DNA, 22 bp, Artificial Sequence
  chemically synthesized
aagtctgaaaatttgtgtgtcc

SEQ ID NO: 107336 - DNA, 22 bp, Artificial Sequence
  chemically synthesized
agtctgaaaatttgtgtgtcct

SEQ ID NO: 107337 - DNA, 22 bp, Artificial Sequence
  chemically synthesized
aaaatttgtgtgtcctctttgt

SEQ ID NO: 107338 - DNA, 22 bp, Artificial Sequence
  chemically synthesized
gtgtgtcctctttgtactaagt

SEQ ID NO: 107339 - DNA, 22 bp, Artificial Sequence
  chemically synthesized
tgtgtcctctttgtactaagtt

SEQ ID NO: 107340 - DNA, 22 bp, Artificial Sequence
  chemically synthesized
tttgtactaagttaaaatttag

SEQ ID NO: 107341 - DNA, 22 bp, Artificial Sequence
  chemically synthesized
tgtactaagttaaaatttaggt

SEQ ID NO: 107342 - DNA, 22 bp, Artificial Sequence
  chemically synthesized
gtactaagttaaaatttaggtc

SEQ ID NO: 107343 - DNA, 22 bp, Artificial Sequence
  chemically synthesized
tactaagttaaaatttaggtct

SEQ ID NO: 107344 - DNA, 22 bp, Artificial Sequence
  chemically synthesized
agttaaaatttaggtctggatt

SEQ ID NO: 107345 - DNA, 22 bp, Artificial Sequence
  chemically synthesized
aaatttaggtctggattgattt

SEQ ID NO: 107346 - DNA, 22 bp, Artificial Sequence
  chemically synthesized
aggtctggattgatttagggga

SEQ ID NO: 107347 - DNA, 22 bp, Artificial Sequence
  chemically synthesized
ggtctggattgatttaggggag

SEQ ID NO: 107348 - DNA, 22 bp, Artificial Sequence
  chemically synthesized
gattgatttaggggagccatgc

SEQ ID NO: 107349 - DNA, 22 bp, Artificial Sequence
  chemically synthesized
atttaggggagccatgctttga

SEQ ID NO: 107350 - DNA, 22 bp, Artificial Sequence
  chemically synthesized
aggggagccatgctttgaactt

SEQ ID NO: 107351 - DNA, 22 bp, Artificial Sequence
  chemically synthesized
ggggagccatgctttgaactta

SEQ ID NO: 107352 - DNA, 22 bp, Artificial Sequence
  chemically synthesized
tgaacttaaaatgaggtgaggt

SEQ ID NO: 107353 - DNA, 22 bp, Artificial Sequence
  chemically synthesized
gaacttaaaatgaggtgaggta

SEQ ID NO: 107354 - DNA, 22 bp, Artificial Sequence
  chemically synthesized
aacttaaaatgaggtgaggtag

SEQ ID NO: 107355 - DNA, 22 bp, Artificial Sequence
  chemically synthesized
aaaatgaggtgaggtagtaaga

SEQ ID NO: 107356 - DNA, 22 bp, Artificial Sequence
  chemically synthesized
aaatgaggtgaggtagtaagac

SEQ ID NO: 107357 - DNA, 22 bp, Artificial Sequence
  chemically synthesized
agataactgatttaatttcagg

SEQ ID NO: 107358 - DNA, 22 bp, Artificial Sequence
  chemically synthesized
atttaatttcaggctgccctcc

SEQ ID NO: 107359 - DNA, 22 bp, Artificial Sequence
  chemically synthesized
aatttcaggctgccctcccatt

SEQ ID NO: 107360 - DNA, 22 bp, Artificial Sequence
  chemically synthesized
atttcaggctgccctcccattt

SEQ ID NO: 107361 - DNA, 22 bp, Artificial Sequence
  chemically synthesized
caggctgccctcccatttcatt

SEQ ID NO: 107362 - DNA, 22 bp, Artificial Sequence
  chemically synthesized
aggctgccctcccatttcatta

SEQ ID NO: 107363 - DNA, 22 bp, Artificial Sequence
  chemically synthesized
ccctcccatttcattagtaggt

SEQ ID NO: 107364 - DNA, 22 bp, Artificial Sequence
  chemically synthesized
ccatttcattagtaggtatatt

SEQ ID NO: 107365 - DNA, 22 bp, Artificial Sequence
  chemically synthesized
cattagtaggtatattgaccct

SEQ ID NO: 107366 - DNA, 22 bp, Artificial Sequence
  chemically synthesized
attagtaggtatattgaccctc

SEQ ID NO: 107367 - DNA, 22 bp, Artificial Sequence
  chemically synthesized
gtaggtatattgaccctctcac

SEQ ID NO: 107368 - DNA, 22 bp, Artificial Sequence
  chemically synthesized
accctctcactggcagtacacg

SEQ ID NO: 107369 - DNA, 22 bp, Artificial Sequence
  chemically synthesized
tcactggcagtacacgaatctt

SEQ ID NO: 107370 - DNA, 22 bp, Artificial Sequence
  chemically synthesized
actggcagtacacgaatcttct

SEQ ID NO: 107371 - DNA, 22 bp, Artificial Sequence
  chemically synthesized
gcagtacacgaatcttctgccc

SEQ ID NO: 107372 - DNA, 22 bp, Artificial Sequence
  chemically synthesized
ctgccccataaatatgactcta

SEQ ID NO: 107373 - DNA, 22 bp, Artificial Sequence
  chemically synthesized
tgccccataaatatgactctat

SEQ ID NO: 107374 - DNA, 22 bp, Artificial Sequence
  chemically synthesized
ccccataaatatgactctattc

SEQ ID NO: 107375 - DNA, 22 bp, Artificial Sequence
  chemically synthesized
tattcctggaaacatcacttat

SEQ ID NO: 107376 - DNA, 22 bp, Artificial Sequence
  chemically synthesized
ttcctggaaacatcacttatct

SEQ ID NO: 107377 - DNA, 22 bp, Artificial Sequence
  chemically synthesized
ctggaaacatcacttatcttag

SEQ ID NO: 107378 - DNA, 22 bp, Artificial Sequence
  chemically synthesized
gaaacatcacttatcttagaac

SEQ ID NO: 107379 - DNA, 22 bp, Artificial Sequence
  chemically synthesized
atcttagaacagatataaagta

SEQ ID NO: 107380 - DNA, 22 bp, Artificial Sequence
  chemically synthesized
tcttagaacagatataaagtaa

SEQ ID NO: 107381 - DNA, 22 bp, Artificial Sequence
  chemically synthesized
agaacagatataaagtaatttc

SEQ ID NO: 107382 - DNA, 22 bp, Artificial Sequence
  chemically synthesized
gaacagatataaagtaatttcc

SEQ ID NO: 107383 - DNA, 22 bp, Artificial Sequence
  chemically synthesized
cctgcagactgccccagagttg

SEQ ID NO: 107384 - DNA, 22 bp, Artificial Sequence
  chemically synthesized
ctgcagactgccccagagttgg

SEQ ID NO: 107385 - DNA, 22 bp, Artificial Sequence
  chemically synthesized
cagactgccccagagttgggat

SEQ ID NO: 107386 - DNA, 22 bp, Artificial Sequence
  chemically synthesized
ccccagagttgggataaaatct

SEQ ID NO: 107387 - DNA, 22 bp, Artificial Sequence
  chemically synthesized
ggataaaatctcatgtgaagtg

SEQ ID NO: 107388 - DNA, 22 bp, Artificial Sequence
  chemically synthesized
atgtgaagtgacactgttggtg

SEQ ID NO: 107389 - DNA, 22 bp, Artificial Sequence
  chemically synthesized
ttggtggaggataagcctccag

SEQ ID NO: 107390 - DNA, 22 bp, Artificial Sequence
  chemically synthesized
gtggaggataagcctccagaga

SEQ ID NO: 107391 - DNA, 22 bp, Artificial Sequence
  chemically synthesized
cagagaatgggaacaactatta

SEQ ID NO: 107392 - DNA, 22 bp, Artificial Sequence
  chemically synthesized
ttatcagccaacactcaaagtc

SEQ ID NO: 107393 - DNA, 22 bp, Artificial Sequence
  chemically synthesized
tcagccaacactcaaagtcacc

SEQ ID NO: 107394 - DNA, 22 bp, Artificial Sequence
  chemically synthesized
aaagtcaccaagcttaggggca

SEQ ID NO: 107395 - DNA, 22 bp, Artificial Sequence
  chemically synthesized
aggggcactgggaggaagtagg

SEQ ID NO: 107396 - DNA, 22 bp, Artificial Sequence
  chemically synthesized
ggggcactgggaggaagtaggc

SEQ ID NO: 107397 - DNA, 22 bp, Artificial Sequence
  chemically synthesized
ggaggaagtaggcagggcaccc

SEQ ID NO: 107398 - DNA, 22 bp, Artificial Sequence
  chemically synthesized
ctatttccttaaatagccattg

SEQ ID NO: 107399 - DNA, 22 bp, Artificial Sequence
  chemically synthesized
tatttccttaaatagccattga

SEQ ID NO: 107400 - DNA, 22 bp, Artificial Sequence
  chemically synthesized
tttccttaaatagccattgatg

SEQ ID NO: 107401 - DNA, 22 bp, Artificial Sequence
  chemically synthesized
ccttaaatagccattgatgtgt

SEQ ID NO: 107402 - DNA, 22 bp, Artificial Sequence
  chemically synthesized
cttaaatagccattgatgtgtc

SEQ ID NO: 107403 - DNA, 22 bp, Artificial Sequence
  chemically synthesized
aaatagccattgatgtgtctct

SEQ ID NO: 107404 - DNA, 22 bp, Artificial Sequence
  chemically synthesized
aatagccattgatgtgtctctc

SEQ ID NO: 107405 - DNA, 22 bp, Artificial Sequence
  chemically synthesized
atgtgtctctcattcatgtatt

SEQ ID NO: 107406 - DNA, 22 bp, Artificial Sequence
  chemically synthesized
tcattcatgtattttctaagac

SEQ ID NO: 107407 - DNA, 22 bp, Artificial Sequence
  chemically synthesized
attcatgtattttctaagacct

SEQ ID NO: 107408 - DNA, 22 bp, Artificial Sequence
  chemically synthesized
atgtattttctaagaccttgtt

SEQ ID NO: 107409 - DNA, 22 bp, Artificial Sequence
  chemically synthesized
tctaagaccttgttcattcttt

SEQ ID NO: 107410 - DNA, 22 bp, Artificial Sequence
  chemically synthesized
ctaagaccttgttcattctttt

SEQ ID NO: 107411 - DNA, 22 bp, Artificial Sequence
  chemically synthesized
taagaccttgttcattcttttc

SEQ ID NO: 107412 - DNA, 22 bp, Artificial Sequence
  chemically synthesized
agaccttgttcattcttttcat

SEQ ID NO: 107413 - DNA, 22 bp, Artificial Sequence
  chemically synthesized
gttcattcttttcatatttcct

SEQ ID NO: 107414 - DNA, 22 bp, Artificial Sequence
  chemically synthesized
ttcattcttttcatatttcctg

SEQ ID NO: 107415 - DNA, 22 bp, Artificial Sequence
  chemically synthesized
attcttttcatatttcctgctg

SEQ ID NO: 107416 - DNA, 22 bp, Artificial Sequence
  chemically synthesized
ttttcatatttcctgctgtatt

SEQ ID NO: 107417 - DNA, 22 bp, Artificial Sequence
  chemically synthesized
ttcatatttcctgctgtattgc

SEQ ID NO: 107418 - DNA, 22 bp, Artificial Sequence
  chemically synthesized
tcatatttcctgctgtattgcc

SEQ ID NO: 107419 - DNA, 22 bp, Artificial Sequence
  chemically synthesized
catatttcctgctgtattgcct

SEQ ID NO: 107420 - DNA, 22 bp, Artificial Sequence
  chemically synthesized
atatttcctgctgtattgcctg

SEQ ID NO: 107421 - DNA, 22 bp, Artificial Sequence
  chemically synthesized
cctgctgtattgcctgtgaagt

SEQ ID NO: 107422 - DNA, 22 bp, Artificial Sequence
  chemically synthesized
ctgctgtattgcctgtgaagta

SEQ ID NO: 107423 - DNA, 22 bp, Artificial Sequence
  chemically synthesized
ctgtattgcctgtgaagtaaag

SEQ ID NO: 107424 - DNA, 22 bp, Artificial Sequence
  chemically synthesized
tattgcctgtgaagtaaagtat

SEQ ID NO: 107425 - DNA, 22 bp, Artificial Sequence
  chemically synthesized
cctgtgaagtaaagtatcatgt

SEQ ID NO: 107426 - DNA, 22 bp, Artificial Sequence
  chemically synthesized
tgaagtaaagtatcatgtcaca

SEQ ID NO: 107427 - DNA, 22 bp, Artificial Sequence
  chemically synthesized
agattgggaaggacctccatct

SEQ ID NO: 107428 - DNA, 22 bp, Artificial Sequence
  chemically synthesized
ggaaggacctccatctcctgta

SEQ ID NO: 107429 - DNA, 22 bp, Artificial Sequence
  chemically synthesized
catctcctgtaataaaagcctt

SEQ ID NO: 107430 - DNA, 22 bp, Artificial Sequence
  chemically synthesized
ctgtaataaaagccttctttga

SEQ ID NO: 107431 - DNA, 22 bp, Artificial Sequence
  chemically synthesized
taataaaagccttctttgatgc

SEQ ID NO: 107432 - DNA, 22 bp, Artificial Sequence
  chemically synthesized
ctttgatgcagtgtttcctgac

SEQ ID NO: 107433 - DNA, 22 bp, Artificial Sequence
  chemically synthesized
tttgatgcagtgtttcctgaca

SEQ ID NO: 107434 - DNA, 22 bp, Artificial Sequence
  chemically synthesized
tgatgcagtgtttcctgacaag

SEQ ID NO: 107435 - DNA, 22 bp, Artificial Sequence
  chemically synthesized
gatgcagtgtttcctgacaagg

SEQ ID NO: 107436 - DNA, 22 bp, Artificial Sequence
  chemically synthesized
atgcagtgtttcctgacaaggg

SEQ ID NO: 107437 - DNA, 22 bp, Artificial Sequence
  chemically synthesized
cctgacaagggtcatccgctga

SEQ ID NO: 107438 - DNA, 22 bp, Artificial Sequence
  chemically synthesized
ctgacaagggtcatccgctgag

SEQ ID NO: 107439 - DNA, 22 bp, Artificial Sequence
  chemically synthesized
acaagggtcatccgctgagtgc

SEQ ID NO: 107440 - DNA, 22 bp, Artificial Sequence
  chemically synthesized
agtgcctgtctctttctaaatc

SEQ ID NO: 107441 - DNA, 22 bp, Artificial Sequence
  chemically synthesized
tctctttctaaatcacataaca

SEQ ID NO: 107442 - DNA, 22 bp, Artificial Sequence
  chemically synthesized
tttctaaatcacataacacaat

SEQ ID NO: 107443 - DNA, 22 bp, Artificial Sequence
  chemically synthesized
tctaaatcacataacacaatat

SEQ ID NO: 107444 - DNA, 22 bp, Artificial Sequence
  chemically synthesized
ctaaatcacataacacaatatt

SEQ ID NO: 107445 - DNA, 22 bp, Artificial Sequence
  chemically synthesized
taaatcacataacacaatattt

SEQ ID NO: 107446 - DNA, 22 bp, Artificial Sequence
  chemically synthesized
aatcacataacacaatatttat

SEQ ID NO: 107447 - DNA, 22 bp, Artificial Sequence
  chemically synthesized
attagaatatctgtgctgaaaa

SEQ ID NO: 107448 - DNA, 22 bp, Artificial Sequence
  chemically synthesized
ttagaatatctgtgctgaaaat

SEQ ID NO: 107449 - DNA, 22 bp, Artificial Sequence
  chemically synthesized
gaatatctgtgctgaaaatact

SEQ ID NO: 107450 - DNA, 22 bp, Artificial Sequence
  chemically synthesized
tgctgaaaatactcaggcagcc

SEQ ID NO: 107451 - DNA, 22 bp, Artificial Sequence
  chemically synthesized
aaaatactcaggcagccacatt

SEQ ID NO: 107452 - DNA, 22 bp, Artificial Sequence
  chemically synthesized
aggcagccacattattagaaat

SEQ ID NO: 107453 - DNA, 22 bp, Artificial Sequence
  chemically synthesized
ttagaaattacctaacttttta

SEQ ID NO: 107454 - DNA, 22 bp, Artificial Sequence
  chemically synthesized
gaaattacctaactttttaaaa

SEQ ID NO: 107455 - DNA, 22 bp, Artificial Sequence
  chemically synthesized
cctaactttttaaaatgaaaat

SEQ ID NO: 107456 - DNA, 22 bp, Artificial Sequence
  chemically synthesized
actttttaaaatgaaaatattt

SEQ ID NO: 107457 - DNA, 22 bp, Artificial Sequence
  chemically synthesized
tttaaaatgaaaatatttttct

SEQ ID NO: 107458 - DNA, 22 bp, Artificial Sequence
  chemically synthesized
ttaaaatgaaaatatttttctg

SEQ ID NO: 107459 - DNA, 22 bp, Artificial Sequence
  chemically synthesized
taaaatgaaaatatttttctgg

SEQ ID NO: 107460 - DNA, 22 bp, Artificial Sequence
  chemically synthesized
aaaatgaaaatatttttctggt

SEQ ID NO: 107461 - DNA, 22 bp, Artificial Sequence
  chemically synthesized
aaatgaaaatatttttctggtc

SEQ ID NO: 107462 - DNA, 22 bp, Artificial Sequence
  chemically synthesized
ttctggtcttcctattccttgg

SEQ ID NO: 107463 - DNA, 22 bp, Artificial Sequence
  chemically synthesized
tctggtcttcctattccttggc

SEQ ID NO: 107464 - DNA, 22 bp, Artificial Sequence
  chemically synthesized
ctggtcttcctattccttggct

SEQ ID NO: 107465 - DNA, 22 bp, Artificial Sequence
  chemically synthesized
tggtcttcctattccttggctc

SEQ ID NO: 107466 - DNA, 22 bp, Artificial Sequence
  chemically synthesized
gtcttcctattccttggctctt

SEQ ID NO: 107467 - DNA, 22 bp, Artificial Sequence
  chemically synthesized
cctattccttggctcttggtct

SEQ ID NO: 107468 - DNA, 22 bp, Artificial Sequence
  chemically synthesized
ctattccttggctcttggtctg

SEQ ID NO: 107469 - DNA, 22 bp, Artificial Sequence
  chemically synthesized
ttccttggctcttggtctgagc

SEQ ID NO: 107470 - DNA, 22 bp, Artificial Sequence
  chemically synthesized
cttggctcttggtctgagctct

SEQ ID NO: 107471 - DNA, 22 bp, Artificial Sequence
  chemically synthesized
ggctcttggtctgagctctggc

SEQ ID NO: 107472 - DNA, 22 bp, Artificial Sequence
  chemically synthesized
gctcttggtctgagctctggca

SEQ ID NO: 107473 - DNA, 22 bp, Artificial Sequence
  chemically synthesized
ttggtctgagctctggcatcac

SEQ ID NO: 107474 - DNA, 22 bp, Artificial Sequence
  chemically synthesized
ggtctgagctctggcatcacag

SEQ ID NO: 107475 - DNA, 22 bp, Artificial Sequence
  chemically synthesized
gtctgagctctggcatcacagt

SEQ ID NO: 107476 - DNA, 22 bp, Artificial Sequence
  chemically synthesized
agctctggcatcacagtctata

SEQ ID NO: 107477 - DNA, 22 bp, Artificial Sequence
  chemically synthesized
tggcatcacagtctatatctaa

SEQ ID NO: 107478 - DNA, 22 bp, Artificial Sequence
  chemically synthesized
gcatcacagtctatatctaact

SEQ ID NO: 107479 - DNA, 22 bp, Artificial Sequence
  chemically synthesized
tatctaactgctgccttatatt

SEQ ID NO: 107480 - DNA, 22 bp, Artificial Sequence
  chemically synthesized
actgctgccttatattacatat

SEQ ID NO: 107481 - DNA, 22 bp, Artificial Sequence
  chemically synthesized
ctgccttatattacatatggca

SEQ ID NO: 107482 - DNA, 22 bp, Artificial Sequence
  chemically synthesized
ccttatattacatatggcatat

SEQ ID NO: 107483 - DNA, 22 bp, Artificial Sequence
  chemically synthesized
atattacatatggcatatagga

SEQ ID NO: 107484 - DNA, 22 bp, Artificial Sequence
  chemically synthesized
tattacatatggcatataggaa

SEQ ID NO: 107485 - DNA, 22 bp, Artificial Sequence
  chemically synthesized
catatggcatataggaaggcaa

SEQ ID NO: 107486 - DNA, 22 bp, Artificial Sequence
  chemically synthesized
aagtataataagcttatatcgc

SEQ ID NO: 107487 - DNA, 22 bp, Artificial Sequence
  chemically synthesized
atatcgctaacgattcaggaag

SEQ ID NO: 107488 - DNA, 22 bp, Artificial Sequence
  chemically synthesized
tatcgctaacgattcaggaagg

SEQ ID NO: 107489 - DNA, 22 bp, Artificial Sequence
  chemically synthesized
acgattcaggaaggtctctatc

SEQ ID NO: 107490 - DNA, 22 bp, Artificial Sequence
  chemically synthesized
aggaaggtctctatcctaggat

SEQ ID NO: 107491 - DNA, 22 bp, Artificial Sequence
  chemically synthesized
tatcctaggatttttgctgttt

SEQ ID NO: 107492 - DNA, 22 bp, Artificial Sequence
  chemically synthesized
tcctaggatttttgctgtttgt

SEQ ID NO: 107493 - DNA, 22 bp, Artificial Sequence
  chemically synthesized
ggatttttgctgtttgttgagt

SEQ ID NO: 107494 - DNA, 22 bp, Artificial Sequence
  chemically synthesized
ttgctgtttgttgagtaagtct

SEQ ID NO: 107495 - DNA, 22 bp, Artificial Sequence
  chemically synthesized
tgctgtttgttgagtaagtctg

SEQ ID NO: 107496 - DNA, 22 bp, Artificial Sequence
  chemically synthesized
gctgtttgttgagtaagtctgt

SEQ ID NO: 107497 - DNA, 22 bp, Artificial Sequence
  chemically synthesized
ctgtttgttgagtaagtctgtg

SEQ ID NO: 107498 - DNA, 22 bp, Artificial Sequence
  chemically synthesized
tttgttgagtaagtctgtgctg

SEQ ID NO: 107499 - DNA, 22 bp, Artificial Sequence
  chemically synthesized
gttgagtaagtctgtgctgaca

SEQ ID NO: 107500 - DNA, 22 bp, Artificial Sequence
  chemically synthesized
ttgagtaagtctgtgctgacaa

SEQ ID NO: 107501 - DNA, 22 bp, Artificial Sequence
  chemically synthesized
agtaagtctgtgctgacaatac

SEQ ID NO: 107502 - DNA, 22 bp, Artificial Sequence
  chemically synthesized
tgctgacaataccagcttcttt

SEQ ID NO: 107503 - DNA, 22 bp, Artificial Sequence
  chemically synthesized
acaataccagcttctttttttt

SEQ ID NO: 107504 - DNA, 22 bp, Artificial Sequence
  chemically synthesized
cttttttttttttttctgtgta

SEQ ID NO: 107505 - DNA, 22 bp, Artificial Sequence
  chemically synthesized
ttttttttttttttctgtgtag

SEQ ID NO: 107506 - DNA, 22 bp, Artificial Sequence
  chemically synthesized
ttttttttttttctgtgtagtt

SEQ ID NO: 107507 - DNA, 22 bp, Artificial Sequence
  chemically synthesized
tttttttttttctgtgtagttt

SEQ ID NO: 107508 - DNA, 22 bp, Artificial Sequence
  chemically synthesized
ttttttttttctgtgtagtttg

SEQ ID NO: 107509 - DNA, 22 bp, Artificial Sequence
  chemically synthesized
tttttttttctgtgtagtttga

SEQ ID NO: 107510 - DNA, 22 bp, Artificial Sequence
  chemically synthesized
ttttttttctgtgtagtttgat

SEQ ID NO: 107511 - DNA, 22 bp, Artificial Sequence
  chemically synthesized
tttttttctgtgtagtttgatt

SEQ ID NO: 107512 - DNA, 22 bp, Artificial Sequence
  chemically synthesized
ttttttctgtgtagtttgattc

SEQ ID NO: 107513 - DNA, 22 bp, Artificial Sequence
  chemically synthesized
tttttctgtgtagtttgattct

SEQ ID NO: 107514 - DNA, 22 bp, Artificial Sequence
  chemically synthesized
ttttctgtgtagtttgattcta

SEQ ID NO: 107515 - DNA, 22 bp, Artificial Sequence
  chemically synthesized
tttctgtgtagtttgattctat

SEQ ID NO: 107516 - DNA, 22 bp, Artificial Sequence
  chemically synthesized
ttctgtgtagtttgattctatt

SEQ ID NO: 107517 - DNA, 22 bp, Artificial Sequence
  chemically synthesized
tctgtgtagtttgattctatta

SEQ ID NO: 107518 - DNA, 22 bp, Artificial Sequence
  chemically synthesized
ctgtgtagtttgattctattat

SEQ ID NO: 107519 - DNA, 22 bp, Artificial Sequence
  chemically synthesized
tgtgtagtttgattctattatc

SEQ ID NO: 107520 - DNA, 22 bp, Artificial Sequence
  chemically synthesized
tgtagtttgattctattatctg

SEQ ID NO: 107521 - DNA, 22 bp, Artificial Sequence
  chemically synthesized
gattctattatctgtcagcctt

SEQ ID NO: 107522 - DNA, 22 bp, Artificial Sequence
  chemically synthesized
attctattatctgtcagccttc

SEQ ID NO: 107523 - DNA, 22 bp, Artificial Sequence
  chemically synthesized
tattatctgtcagccttctgga

SEQ ID NO: 107524 - DNA, 22 bp, Artificial Sequence
  chemically synthesized
ttatctgtcagccttctggatt

SEQ ID NO: 107525 - DNA, 22 bp, Artificial Sequence
  chemically synthesized
tctgtcagccttctggattcca

SEQ ID NO: 107526 - DNA, 22 bp, Artificial Sequence
  chemically synthesized
tcagccttctggattccacaat

SEQ ID NO: 107527 - DNA, 22 bp, Artificial Sequence
  chemically synthesized
ctggattccacaattatctccg

SEQ ID NO: 107528 - DNA, 22 bp, Artificial Sequence
  chemically synthesized
tggattccacaattatctccga

SEQ ID NO: 107529 - DNA, 22 bp, Artificial Sequence
  chemically synthesized
gattccacaattatctccgaag

SEQ ID NO: 107530 - DNA, 22 bp, Artificial Sequence
  chemically synthesized
cacaattatctccgaagattcc

SEQ ID NO: 107531 - DNA, 22 bp, Artificial Sequence
  chemically synthesized
tctccgaagattccatccttta

SEQ ID NO: 107532 - DNA, 22 bp, Artificial Sequence
  chemically synthesized
cgaagattccatcctttaactc

SEQ ID NO: 107533 - DNA, 22 bp, Artificial Sequence
  chemically synthesized
catcctttaactcatcctctac

SEQ ID NO: 107534 - DNA, 22 bp, Artificial Sequence
  chemically synthesized
taactcatcctctacaggctct

SEQ ID NO: 107535 - DNA, 22 bp, Artificial Sequence
  chemically synthesized
aactcatcctctacaggctctg

SEQ ID NO: 107536 - DNA, 22 bp, Artificial Sequence
  chemically synthesized
actcatcctctacaggctctga

SEQ ID NO: 107537 - DNA, 22 bp, Artificial Sequence
  chemically synthesized
atcctctacaggctctgatggt

SEQ ID NO: 107538 - DNA, 22 bp, Artificial Sequence
  chemically synthesized
tacaggctctgatggttaattt

SEQ ID NO: 107539 - DNA, 22 bp, Artificial Sequence
  chemically synthesized
caggctctgatggttaatttta

SEQ ID NO: 107540 - DNA, 22 bp, Artificial Sequence
  chemically synthesized
tgatggttaattttatatgcca

SEQ ID NO: 107541 - DNA, 22 bp, Artificial Sequence
  chemically synthesized
atggttaattttatatgccaat

SEQ ID NO: 107542 - DNA, 22 bp, Artificial Sequence
  chemically synthesized
attttatatgccaatttgactg

SEQ ID NO: 107543 - DNA, 22 bp, Artificial Sequence
  chemically synthesized
tatatgccaatttgactgggcc

SEQ ID NO: 107544 - DNA, 22 bp, Artificial Sequence
  chemically synthesized
atatgccaatttgactgggcca

SEQ ID NO: 107545 - DNA, 22 bp, Artificial Sequence
  chemically synthesized
tatgccaatttgactgggccat

SEQ ID NO: 107546 - DNA, 22 bp, Artificial Sequence
  chemically synthesized
gactgggccatggggtgcccaa

SEQ ID NO: 107547 - DNA, 22 bp, Artificial Sequence
  chemically synthesized
actgggccatggggtgcccaaa

SEQ ID NO: 107548 - DNA, 22 bp, Artificial Sequence
  chemically synthesized
ggccatggggtgcccaaatatt

SEQ ID NO: 107549 - DNA, 22 bp, Artificial Sequence
  chemically synthesized
gtcaaacattattctagatgtt

SEQ ID NO: 107550 - DNA, 22 bp, Artificial Sequence
  chemically synthesized
tcaaacattattctagatgttt

SEQ ID NO: 107551 - DNA, 22 bp, Artificial Sequence
  chemically synthesized
ttctagatgtttttgtgagggt

SEQ ID NO: 107552 - DNA, 22 bp, Artificial Sequence
  chemically synthesized
tagatgtttttgtgagggtgtt

SEQ ID NO: 107553 - DNA, 22 bp, Artificial Sequence
  chemically synthesized
gatgtttttgtgagggtgtttt

SEQ ID NO: 107554 - DNA, 22 bp, Artificial Sequence
  chemically synthesized
ttgtgagggtgtttttaggcaa

SEQ ID NO: 107555 - DNA, 22 bp, Artificial Sequence
  chemically synthesized
tgtgagggtgtttttaggcaag

SEQ ID NO: 107556 - DNA, 22 bp, Artificial Sequence
  chemically synthesized
gtgagggtgtttttaggcaaga

SEQ ID NO: 107557 - DNA, 22 bp, Artificial Sequence
  chemically synthesized
tgagggtgtttttaggcaagat

SEQ ID NO: 107558 - DNA, 22 bp, Artificial Sequence
  chemically synthesized
ttaggcaagattaacatttaaa

SEQ ID NO: 107559 - DNA, 22 bp, Artificial Sequence
  chemically synthesized
taggcaagattaacatttaaat

SEQ ID NO: 107560 - DNA, 22 bp, Artificial Sequence
  chemically synthesized
aggcaagattaacatttaaatc

SEQ ID NO: 107561 - DNA, 22 bp, Artificial Sequence
  chemically synthesized
ggcaagattaacatttaaatcg

SEQ ID NO: 107562 - DNA, 22 bp, Artificial Sequence
  chemically synthesized
acatttaaatcggtagaccaag

SEQ ID NO: 107563 - DNA, 22 bp, Artificial Sequence
  chemically synthesized
aaatcggtagaccaagtagagc

SEQ ID NO: 107564 - DNA, 22 bp, Artificial Sequence
  chemically synthesized
aatcggtagaccaagtagagca

SEQ ID NO: 107565 - DNA, 22 bp, Artificial Sequence
  chemically synthesized
cctattgcaggcggcttcctcc

SEQ ID NO: 107566 - DNA, 22 bp, Artificial Sequence
  chemically synthesized
ctattgcaggcggcttcctcca

SEQ ID NO: 107567 - DNA, 22 bp, Artificial Sequence
  chemically synthesized
ttgcaggcggcttcctccaatc

SEQ ID NO: 107568 - DNA, 22 bp, Artificial Sequence
  chemically synthesized
caggcggcttcctccaatcagt

SEQ ID NO: 107569 - DNA, 22 bp, Artificial Sequence
  chemically synthesized
cctccaatcagttgaaaacctg

SEQ ID NO: 107570 - DNA, 22 bp, Artificial Sequence
  chemically synthesized
ctccaatcagttgaaaacctga

SEQ ID NO: 107571 - DNA, 22 bp, Artificial Sequence
  chemically synthesized
caatcagttgaaaacctgaata

SEQ ID NO: 107572 - DNA, 22 bp, Artificial Sequence
  chemically synthesized
aaaacctgaatagaacaaaaag

SEQ ID NO: 107573 - DNA, 22 bp, Artificial Sequence
  chemically synthesized
aatagaacaaaaagtctgaccc

SEQ ID NO: 107574 - DNA, 22 bp, Artificial Sequence
  chemically synthesized
acccttccccaaatcagagaga

SEQ ID NO: 107575 - DNA, 22 bp, Artificial Sequence
  chemically synthesized
ccccaaatcagagagaattatt

SEQ ID NO: 107576 - DNA, 22 bp, Artificial Sequence
  chemically synthesized
cccaaatcagagagaattattc

SEQ ID NO: 107577 - DNA, 22 bp, Artificial Sequence
  chemically synthesized
ttccttattgatggccttcaaa

SEQ ID NO: 107578 - DNA, 22 bp, Artificial Sequence
  chemically synthesized
cttattgatggccttcaaactg

SEQ ID NO: 107579 - DNA, 22 bp, Artificial Sequence
  chemically synthesized
attgatggccttcaaactggaa

SEQ ID NO: 107580 - DNA, 22 bp, Artificial Sequence
  chemically synthesized
ttgatggccttcaaactggaat

SEQ ID NO: 107581 - DNA, 22 bp, Artificial Sequence
  chemically synthesized
atggccttcaaactggaatcta

SEQ ID NO: 107582 - DNA, 22 bp, Artificial Sequence
  chemically synthesized
caaactggaatctagacctttt

SEQ ID NO: 107583 - DNA, 22 bp, Artificial Sequence
  chemically synthesized
aaactggaatctagaccttttt

SEQ ID NO: 107584 - DNA, 22 bp, Artificial Sequence
  chemically synthesized
gaatctagacctttttttctgc

SEQ ID NO: 107585 - DNA, 22 bp, Artificial Sequence
  chemically synthesized
gacctttttttctgcctttaga

SEQ ID NO: 107586 - DNA, 22 bp, Artificial Sequence
  chemically synthesized
tttttctgcctttagattgaac

SEQ ID NO: 107587 - DNA, 22 bp, Artificial Sequence
  chemically synthesized
ttttctgcctttagattgaact

SEQ ID NO: 107588 - DNA, 22 bp, Artificial Sequence
  chemically synthesized
tttctgcctttagattgaactg

SEQ ID NO: 107589 - DNA, 22 bp, Artificial Sequence
  chemically synthesized
ttctgcctttagattgaactga

SEQ ID NO: 107590 - DNA, 22 bp, Artificial Sequence
  chemically synthesized
tctgcctttagattgaactgaa

SEQ ID NO: 107591 - DNA, 22 bp, Artificial Sequence
  chemically synthesized
ctgcctttagattgaactgaaa

SEQ ID NO: 107592 - DNA, 22 bp, Artificial Sequence
  chemically synthesized
tgcctttagattgaactgaaac

SEQ ID NO: 107593 - DNA, 22 bp, Artificial Sequence
  chemically synthesized
cctttagattgaactgaaacat

SEQ ID NO: 107594 - DNA, 22 bp, Artificial Sequence
  chemically synthesized
tagattgaactgaaacatcaaa

SEQ ID NO: 107595 - DNA, 22 bp, Artificial Sequence
  chemically synthesized
agattgaactgaaacatcaaaa

SEQ ID NO: 107596 - DNA, 22 bp, Artificial Sequence
  chemically synthesized
gattgaactgaaacatcaaaac

SEQ ID NO: 107597 - DNA, 22 bp, Artificial Sequence
  chemically synthesized
aactgaaacatcaaaacttcct

SEQ ID NO: 107598 - DNA, 22 bp, Artificial Sequence
  chemically synthesized
aaacatcaaaacttcctgggtc

SEQ ID NO: 107599 - DNA, 22 bp, Artificial Sequence
  chemically synthesized
cctgggtctgaagcctgatggc

SEQ ID NO: 107600 - DNA, 22 bp, Artificial Sequence
  chemically synthesized
ctgggtctgaagcctgatggct

SEQ ID NO: 107601 - DNA, 22 bp, Artificial Sequence
  chemically synthesized
ggtctgaagcctgatggctttt

SEQ ID NO: 107602 - DNA, 22 bp, Artificial Sequence
  chemically synthesized
aagcctgatggcttttgggttg

SEQ ID NO: 107603 - DNA, 22 bp, Artificial Sequence
  chemically synthesized
atggcttttgggttgcaagtac

SEQ ID NO: 107604 - DNA, 22 bp, Artificial Sequence
  chemically synthesized
ttgggttgcaagtacaccatca

SEQ ID NO: 107605 - DNA, 22 bp, Artificial Sequence
  chemically synthesized
tgggttgcaagtacaccatcaa

SEQ ID NO: 107606 - DNA, 22 bp, Artificial Sequence
  chemically synthesized
gggttgcaagtacaccatcaat

SEQ ID NO: 107607 - DNA, 22 bp, Artificial Sequence
  chemically synthesized
ggttgcaagtacaccatcaatc

SEQ ID NO: 107608 - DNA, 22 bp, Artificial Sequence
  chemically synthesized
caagtacaccatcaatcctcct

SEQ ID NO: 107609 - DNA, 22 bp, Artificial Sequence
  chemically synthesized
ctgtttcccaggccttcagact

SEQ ID NO: 107610 - DNA, 22 bp, Artificial Sequence
  chemically synthesized
tttcccaggccttcagacttgg

SEQ ID NO: 107611 - DNA, 22 bp, Artificial Sequence
  chemically synthesized
cccaggccttcagacttggact

SEQ ID NO: 107612 - DNA, 22 bp, Artificial Sequence
  chemically synthesized
ccaggccttcagacttggactg

SEQ ID NO: 107613 - DNA, 22 bp, Artificial Sequence
  chemically synthesized
cagacttggactgggactaaac

SEQ ID NO: 107614 - DNA, 22 bp, Artificial Sequence
  chemically synthesized
agacttggactgggactaaact

SEQ ID NO: 107615 - DNA, 22 bp, Artificial Sequence
  chemically synthesized
ggactgggactaaactaccagg

SEQ ID NO: 107616 - DNA, 22 bp, Artificial Sequence
  chemically synthesized
gactgggactaaactaccaggc

SEQ ID NO: 107617 - DNA, 22 bp, Artificial Sequence
  chemically synthesized
ggactaaactaccaggctctct

SEQ ID NO: 107618 - DNA, 22 bp, Artificial Sequence
  chemically synthesized
aactaccaggctctcttgagtt

SEQ ID NO: 107619 - DNA, 22 bp, Artificial Sequence
  chemically synthesized
ccaggctctcttgagttttcaa

SEQ ID NO: 107620 - DNA, 22 bp, Artificial Sequence
  chemically synthesized
tcttgagttttcaacttgatga

SEQ ID NO: 107621 - DNA, 22 bp, Artificial Sequence
  chemically synthesized
ttgagttttcaacttgatgact

SEQ ID NO: 107622 - DNA, 22 bp, Artificial Sequence
  chemically synthesized
gagttttcaacttgatgactca

SEQ ID NO: 107623 - DNA, 22 bp, Artificial Sequence
  chemically synthesized
agttttcaacttgatgactcac

SEQ ID NO: 107624 - DNA, 22 bp, Artificial Sequence
  chemically synthesized
tcaacttgatgactcactctgc

SEQ ID NO: 107625 - DNA, 22 bp, Artificial Sequence
  chemically synthesized
caacttgatgactcactctgca

SEQ ID NO: 107626 - DNA, 22 bp, Artificial Sequence
  chemically synthesized
aacttgatgactcactctgcat

SEQ ID NO: 107627 - DNA, 22 bp, Artificial Sequence
  chemically synthesized
gatgactcactctgcatatctt

SEQ ID NO: 107628 - DNA, 22 bp, Artificial Sequence
  chemically synthesized
atgactcactctgcatatcttg

SEQ ID NO: 107629 - DNA, 22 bp, Artificial Sequence
  chemically synthesized
actctgcatatcttgggacttg

SEQ ID NO: 107630 - DNA, 22 bp, Artificial Sequence
  chemically synthesized
tgcatatcttgggacttgcctt

SEQ ID NO: 107631 - DNA, 22 bp, Artificial Sequence
  chemically synthesized
catatcttgggacttgccttcc

SEQ ID NO: 107632 - DNA, 22 bp, Artificial Sequence
  chemically synthesized
gggacttgccttcctccataat

SEQ ID NO: 107633 - DNA, 22 bp, Artificial Sequence
  chemically synthesized
ggacttgccttcctccataatc

SEQ ID NO: 107634 - DNA, 22 bp, Artificial Sequence
  chemically synthesized
gccttcctccataatcacatct

SEQ ID NO: 107635 - DNA, 22 bp, Artificial Sequence
  chemically synthesized
ccttcctccataatcacatctg

SEQ ID NO: 107636 - DNA, 22 bp, Artificial Sequence
  chemically synthesized
cctccataatcacatctgctat

SEQ ID NO: 107637 - DNA, 22 bp, Artificial Sequence
  chemically synthesized
ctccataatcacatctgctatt

SEQ ID NO: 107638 - DNA, 22 bp, Artificial Sequence
  chemically synthesized
cataatcacatctgctatttcc

SEQ ID NO: 107639 - DNA, 22 bp, Artificial Sequence
  chemically synthesized
ctatttccttatattaggttgg

SEQ ID NO: 107640 - DNA, 22 bp, Artificial Sequence
  chemically synthesized
tttccttatattaggttggtgc

SEQ ID NO: 107641 - DNA, 22 bp, Artificial Sequence
  chemically synthesized
ccttatattaggttggtgcaac

SEQ ID NO: 107642 - DNA, 22 bp, Artificial Sequence
  chemically synthesized
cttatattaggttggtgcaaca

SEQ ID NO: 107643 - DNA, 22 bp, Artificial Sequence
  chemically synthesized
atattaggttggtgcaacagta

SEQ ID NO: 107644 - DNA, 22 bp, Artificial Sequence
  chemically synthesized
tattaggttggtgcaacagtaa

SEQ ID NO: 107645 - DNA, 22 bp, Artificial Sequence
  chemically synthesized
ggttggtgcaacagtaattgca

SEQ ID NO: 107646 - DNA, 22 bp, Artificial Sequence
  chemically synthesized
gtgcaacagtaattgcagtttt

SEQ ID NO: 107647 - DNA, 22 bp, Artificial Sequence
  chemically synthesized
cagtttttgccattattttttt

SEQ ID NO: 107648 - DNA, 22 bp, Artificial Sequence
  chemically synthesized
ttgccattatttttttttaatg

SEQ ID NO: 107649 - DNA, 22 bp, Artificial Sequence
  chemically synthesized
tgccattatttttttttaatgc

SEQ ID NO: 107650 - DNA, 22 bp, Artificial Sequence
  chemically synthesized
gccattatttttttttaatgca

SEQ ID NO: 107651 - DNA, 22 bp, Artificial Sequence
  chemically synthesized
ccattatttttttttaatgcag

SEQ ID NO: 107652 - DNA, 22 bp, Artificial Sequence
  chemically synthesized
tttttttttaatgcagtgaatt

SEQ ID NO: 107653 - DNA, 22 bp, Artificial Sequence
  chemically synthesized
ttttttaatgcagtgaattaca

SEQ ID NO: 107654 - DNA, 22 bp, Artificial Sequence
  chemically synthesized
tttttaatgcagtgaattacat

SEQ ID NO: 107655 - DNA, 22 bp, Artificial Sequence
  chemically synthesized
ttttaatgcagtgaattacatt

SEQ ID NO: 107656 - DNA, 22 bp, Artificial Sequence
  chemically synthesized
tttaatgcagtgaattacattt

SEQ ID NO: 107657 - DNA, 22 bp, Artificial Sequence
  chemically synthesized
ttaatgcagtgaattacattta

SEQ ID NO: 107658 - DNA, 22 bp, Artificial Sequence
  chemically synthesized
taatgcagtgaattacatttat

SEQ ID NO: 107659 - DNA, 22 bp, Artificial Sequence
  chemically synthesized
aatgcagtgaattacatttatt

SEQ ID NO: 107660 - DNA, 22 bp, Artificial Sequence
  chemically synthesized
atgcagtgaattacatttatta

SEQ ID NO: 107661 - DNA, 22 bp, Artificial Sequence
  chemically synthesized
catttattaatttccatatttt

SEQ ID NO: 107662 - DNA, 22 bp, Artificial Sequence
  chemically synthesized
attaatttccatatttttatgt

SEQ ID NO: 107663 - DNA, 22 bp, Artificial Sequence
  chemically synthesized
ttaatttccatatttttatgta

SEQ ID NO: 107664 - DNA, 22 bp, Artificial Sequence
  chemically synthesized
atttccatatttttatgtacat

SEQ ID NO: 107665 - DNA, 22 bp, Artificial Sequence
  chemically synthesized
ccatatttttatgtacattcaa

SEQ ID NO: 107666 - DNA, 22 bp, Artificial Sequence
  chemically synthesized
catatttttatgtacattcaat

SEQ ID NO: 107667 - DNA, 22 bp, Artificial Sequence
  chemically synthesized
ttatgtacattcaattttttta

SEQ ID NO: 107668 - DNA, 22 bp, Artificial Sequence
  chemically synthesized
tatgtacattcaatttttttaa

SEQ ID NO: 107669 - DNA, 22 bp, Artificial Sequence
  chemically synthesized
atgtacattcaatttttttaat

SEQ ID NO: 107670 - DNA, 22 bp, Artificial Sequence
  chemically synthesized
tgtacattcaatttttttaatt

SEQ ID NO: 107671 - DNA, 22 bp, Artificial Sequence
  chemically synthesized
aatttttttaatttttaagttc

SEQ ID NO: 107672 - DNA, 22 bp, Artificial Sequence
  chemically synthesized
ttttaatttttaagttctgagg

SEQ ID NO: 107673 - DNA, 22 bp, Artificial Sequence
  chemically synthesized
tttaatttttaagttctgaggt

SEQ ID NO: 107674 - DNA, 22 bp, Artificial Sequence
  chemically synthesized
ttaatttttaagttctgaggta

SEQ ID NO: 107675 - DNA, 22 bp, Artificial Sequence
  chemically synthesized
taatttttaagttctgaggtac

SEQ ID NO: 107676 - DNA, 22 bp, Artificial Sequence
  chemically synthesized
aatttttaagttctgaggtaca

SEQ ID NO: 107677 - DNA, 22 bp, Artificial Sequence
  chemically synthesized
atttttaagttctgaggtacat

SEQ ID NO: 107678 - DNA, 22 bp, Artificial Sequence
  chemically synthesized
ttaagttctgaggtacatgtgc

SEQ ID NO: 107679 - DNA, 22 bp, Artificial Sequence
  chemically synthesized
taagttctgaggtacatgtgca

SEQ ID NO: 107680 - DNA, 22 bp, Artificial Sequence
  chemically synthesized
aagttctgaggtacatgtgcag

SEQ ID NO: 107681 - DNA, 22 bp, Artificial Sequence
  chemically synthesized
agttctgaggtacatgtgcagg

SEQ ID NO: 107682 - DNA, 22 bp, Artificial Sequence
  chemically synthesized
tgaggtacatgtgcaggatgtg

SEQ ID NO: 107683 - DNA, 22 bp, Artificial Sequence
  chemically synthesized
aggtacatgtgcaggatgtgca

SEQ ID NO: 107684 - DNA, 22 bp, Artificial Sequence
  chemically synthesized
attacatacgtaaatgtgtgca

SEQ ID NO: 107685 - DNA, 22 bp, Artificial Sequence
  chemically synthesized
ttacatacgtaaatgtgtgcaa

SEQ ID NO: 107686 - DNA, 22 bp, Artificial Sequence
  chemically synthesized
catacgtaaatgtgtgcaatgg

SEQ ID NO: 107687 - DNA, 22 bp, Artificial Sequence
  chemically synthesized
gctgtacctatcaacccatcac

SEQ ID NO: 107688 - DNA, 22 bp, Artificial Sequence
  chemically synthesized
ctgtacctatcaacccatcacc

SEQ ID NO: 107689 - DNA, 22 bp, Artificial Sequence
  chemically synthesized
tacctatcaacccatcacctag

SEQ ID NO: 107690 - DNA, 22 bp, Artificial Sequence
  chemically synthesized
tcaacccatcacctaggtgtta

SEQ ID NO: 107691 - DNA, 22 bp, Artificial Sequence
  chemically synthesized
ggtgttaagcccagcatgcatt

SEQ ID NO: 107692 - DNA, 22 bp, Artificial Sequence
  chemically synthesized
agcccagcatgcattagctatt

SEQ ID NO: 107693 - DNA, 22 bp, Artificial Sequence
  chemically synthesized
gctattttttctaatgctcccc

SEQ ID NO: 107694 - DNA, 22 bp, Artificial Sequence
  chemically synthesized
ttttttctaatgctccccttca

SEQ ID NO: 107695 - DNA, 22 bp, Artificial Sequence
  chemically synthesized
tttctaatgctccccttcacca

SEQ ID NO: 107696 - DNA, 22 bp, Artificial Sequence
  chemically synthesized
ttctaatgctccccttcaccac

SEQ ID NO: 107697 - DNA, 22 bp, Artificial Sequence
  chemically synthesized
tctaatgctccccttcaccaca

SEQ ID NO: 107698 - DNA, 22 bp, Artificial Sequence
  chemically synthesized
ctaatgctccccttcaccacac

SEQ ID NO: 107699 - DNA, 22 bp, Artificial Sequence
  chemically synthesized
taatgctccccttcaccacacc

SEQ ID NO: 107700 - DNA, 22 bp, Artificial Sequence
  chemically synthesized
atgctccccttcaccacacccc

SEQ ID NO: 107701 - DNA, 22 bp, Artificial Sequence
  chemically synthesized
cccttcaccacaccccatgccc

SEQ ID NO: 107702 - DNA, 22 bp, Artificial Sequence
  chemically synthesized
caccacaccccatgccctgaca

SEQ ID NO: 107703 - DNA, 22 bp, Artificial Sequence
  chemically synthesized
accacaccccatgccctgacag

SEQ ID NO: 107704 - DNA, 22 bp, Artificial Sequence
  chemically synthesized
acaggctccagtgtgtgttctt

SEQ ID NO: 107705 - DNA, 22 bp, Artificial Sequence
  chemically synthesized
cagtgtgtgttcttcccctcac

SEQ ID NO: 107706 - DNA, 22 bp, Artificial Sequence
  chemically synthesized
ttcccctcactgtttccatgtg

SEQ ID NO: 107707 - DNA, 22 bp, Artificial Sequence
  chemically synthesized
cccctcactgtttccatgtgtt

SEQ ID NO: 107708 - DNA, 22 bp, Artificial Sequence
  chemically synthesized
ccctcactgtttccatgtgttc

SEQ ID NO: 107709 - DNA, 22 bp, Artificial Sequence
  chemically synthesized
actgtttccatgtgttctcatt

SEQ ID NO: 107710 - DNA, 22 bp, Artificial Sequence
  chemically synthesized
tttccatgtgttctcattctca

SEQ ID NO: 107711 - DNA, 22 bp, Artificial Sequence
  chemically synthesized
ccatgtgttctcattctcattg

SEQ ID NO: 107712 - DNA, 22 bp, Artificial Sequence
  chemically synthesized
catgtgttctcattctcattgt

SEQ ID NO: 107713 - DNA, 22 bp, Artificial Sequence
  chemically synthesized
tcattctcattgttcagctccc

SEQ ID NO: 107714 - DNA, 22 bp, Artificial Sequence
  chemically synthesized
attctcattgttcagctcccac

SEQ ID NO: 107715 - DNA, 22 bp, Artificial Sequence
  chemically synthesized
tcattgttcagctcccacttct

SEQ ID NO: 107716 - DNA, 22 bp, Artificial Sequence
  chemically synthesized
attgttcagctcccacttctaa

SEQ ID NO: 107717 - DNA, 22 bp, Artificial Sequence
  chemically synthesized
ttcagctcccacttctaagtga

SEQ ID NO: 107718 - DNA, 22 bp, Artificial Sequence
  chemically synthesized
agctcccacttctaagtgagaa

SEQ ID NO: 107719 - DNA, 22 bp, Artificial Sequence
  chemically synthesized
ccacttctaagtgagaacatgt

SEQ ID NO: 107720 - DNA, 22 bp, Artificial Sequence
  chemically synthesized
ctaagtgagaacatgtggtgtt

SEQ ID NO: 107721 - DNA, 22 bp, Artificial Sequence
  chemically synthesized
taagtgagaacatgtggtgttt

SEQ ID NO: 107722 - DNA, 22 bp, Artificial Sequence
  chemically synthesized
agtgagaacatgtggtgtttgg

SEQ ID NO: 107723 - DNA, 22 bp, Artificial Sequence
  chemically synthesized
ggttttctgttcctgcattagt

SEQ ID NO: 107724 - DNA, 22 bp, Artificial Sequence
  chemically synthesized
gttttctgttcctgcattagtt

SEQ ID NO: 107725 - DNA, 22 bp, Artificial Sequence
  chemically synthesized
tctgttcctgcattagtttact

SEQ ID NO: 107726 - DNA, 22 bp, Artificial Sequence
  chemically synthesized
ctgttcctgcattagtttactg

SEQ ID NO: 107727 - DNA, 22 bp, Artificial Sequence
  chemically synthesized
tgttcctgcattagtttactga

SEQ ID NO: 107728 - DNA, 22 bp, Artificial Sequence
  chemically synthesized
ttcctgcattagtttactgaag

SEQ ID NO: 107729 - DNA, 22 bp, Artificial Sequence
  chemically synthesized
ctgcattagtttactgaagata

SEQ ID NO: 107730 - DNA, 22 bp, Artificial Sequence
  chemically synthesized
cattagtttactgaagataatg

SEQ ID NO: 107731 - DNA, 22 bp, Artificial Sequence
  chemically synthesized
gtttactgaagataatggcttt

SEQ ID NO: 107732 - DNA, 22 bp, Artificial Sequence
  chemically synthesized
actgaagataatggctttcggc

SEQ ID NO: 107733 - DNA, 22 bp, Artificial Sequence
  chemically synthesized
ctgaagataatggctttcggct

SEQ ID NO: 107734 - DNA, 22 bp, Artificial Sequence
  chemically synthesized
aagataatggctttcggctcca

SEQ ID NO: 107735 - DNA, 22 bp, Artificial Sequence
  chemically synthesized
tcggctccatccatgtcccagc

SEQ ID NO: 107736 - DNA, 22 bp, Artificial Sequence
  chemically synthesized
cggctccatccatgtcccagca

SEQ ID NO: 107737 - DNA, 22 bp, Artificial Sequence
  chemically synthesized
ggctccatccatgtcccagcaa

SEQ ID NO: 107738 - DNA, 22 bp, Artificial Sequence
  chemically synthesized
catccatgtcccagcaaagggc

SEQ ID NO: 107739 - DNA, 22 bp, Artificial Sequence
  chemically synthesized
atccctttttatggttagatag

SEQ ID NO: 107740 - DNA, 22 bp, Artificial Sequence
  chemically synthesized
tttatggttagatagtatttca

SEQ ID NO: 107741 - DNA, 22 bp, Artificial Sequence
  chemically synthesized
ttatggttagatagtatttcat

SEQ ID NO: 107742 - DNA, 22 bp, Artificial Sequence
  chemically synthesized
tatggttagatagtatttcatg

SEQ ID NO: 107743 - DNA, 22 bp, Artificial Sequence
  chemically synthesized
atggttagatagtatttcatgg

SEQ ID NO: 107744 - DNA, 22 bp, Artificial Sequence
  chemically synthesized
tggttagatagtatttcatggt

SEQ ID NO: 107745 - DNA, 22 bp, Artificial Sequence
  chemically synthesized
gatagtatttcatggtttatat

SEQ ID NO: 107746 - DNA, 22 bp, Artificial Sequence
  chemically synthesized
catggtttatatgtaccacatt

SEQ ID NO: 107747 - DNA, 22 bp, Artificial Sequence
  chemically synthesized
atggtttatatgtaccacattt

SEQ ID NO: 107748 - DNA, 22 bp, Artificial Sequence
  chemically synthesized
atatgtaccacattttttaaat

SEQ ID NO: 107749 - DNA, 22 bp, Artificial Sequence
  chemically synthesized
tatgtaccacattttttaaatt

SEQ ID NO: 107750 - DNA, 22 bp, Artificial Sequence
  chemically synthesized
tttaaattgtctatcattgatg

SEQ ID NO: 107751 - DNA, 22 bp, Artificial Sequence
  chemically synthesized
ttaaattgtctatcattgatgg

SEQ ID NO: 107752 - DNA, 22 bp, Artificial Sequence
  chemically synthesized
taaattgtctatcattgatggc

SEQ ID NO: 107753 - DNA, 22 bp, Artificial Sequence
  chemically synthesized
aaattgtctatcattgatggcc

SEQ ID NO: 107754 - DNA, 22 bp, Artificial Sequence
  chemically synthesized
aattgtctatcattgatggcca

SEQ ID NO: 107755 - DNA, 22 bp, Artificial Sequence
  chemically synthesized
tctatcattgatggccatttgg

SEQ ID NO: 107756 - DNA, 22 bp, Artificial Sequence
  chemically synthesized
tcattgatggccatttgggttg

SEQ ID NO: 107757 - DNA, 22 bp, Artificial Sequence
  chemically synthesized
atggccatttgggttgattcta

SEQ ID NO: 107758 - DNA, 22 bp, Artificial Sequence
  chemically synthesized
gggttgattctatgtctttgct

SEQ ID NO: 107759 - DNA, 22 bp, Artificial Sequence
  chemically synthesized
ggttgattctatgtctttgcta

SEQ ID NO: 107760 - DNA, 22 bp, Artificial Sequence
  chemically synthesized
attctatgtctttgctattgtg

SEQ ID NO: 107761 - DNA, 22 bp, Artificial Sequence
  chemically synthesized
tatgtctttgctattgtgaata

SEQ ID NO: 107762 - DNA, 22 bp, Artificial Sequence
  chemically synthesized
tgtctttgctattgtgaatagt

SEQ ID NO: 107763 - DNA, 22 bp, Artificial Sequence
  chemically synthesized
tgctattgtgaatagtgctaca

SEQ ID NO: 107764 - DNA, 22 bp, Artificial Sequence
  chemically synthesized
gctattgtgaatagtgctacaa

SEQ ID NO: 107765 - DNA, 22 bp, Artificial Sequence
  chemically synthesized
ctattgtgaatagtgctacaat

SEQ ID NO: 107766 - DNA, 22 bp, Artificial Sequence
  chemically synthesized
ttgtgaatagtgctacaatgaa

SEQ ID NO: 107767 - DNA, 22 bp, Artificial Sequence
  chemically synthesized
tgaatagtgctacaatgaacat

SEQ ID NO: 107768 - DNA, 22 bp, Artificial Sequence
  chemically synthesized
caatgaacatacatgtgcatgt

SEQ ID NO: 107769 - DNA, 22 bp, Artificial Sequence
  chemically synthesized
agtaatagaatgatttatactc

SEQ ID NO: 107770 - DNA, 22 bp, Artificial Sequence
  chemically synthesized
gtaatagaatgatttatactcc

SEQ ID NO: 107771 - DNA, 22 bp, Artificial Sequence
  chemically synthesized
atactcctttaggtatataccc

SEQ ID NO: 107772 - DNA, 22 bp, Artificial Sequence
  chemically synthesized
tactcctttaggtatataccca

SEQ ID NO: 107773 - DNA, 22 bp, Artificial Sequence
  chemically synthesized
ctttaggtatatacccagtaat

SEQ ID NO: 107774 - DNA, 22 bp, Artificial Sequence
  chemically synthesized
taggtatatacccagtaatggg

SEQ ID NO: 107775 - DNA, 22 bp, Artificial Sequence
  chemically synthesized
aggtatatacccagtaatggga

SEQ ID NO: 107776 - DNA, 22 bp, Artificial Sequence
  chemically synthesized
ggtatatacccagtaatgggat

SEQ ID NO: 107777 - DNA, 22 bp, Artificial Sequence
  chemically synthesized
tgaggtcaaatggtatttctgg

SEQ ID NO: 107778 - DNA, 22 bp, Artificial Sequence
  chemically synthesized
ctggttctaaatctttgaggaa

SEQ ID NO: 107779 - DNA, 22 bp, Artificial Sequence
  chemically synthesized
tggttctaaatctttgaggaat

SEQ ID NO: 107780 - DNA, 22 bp, Artificial Sequence
  chemically synthesized
gttctaaatctttgaggaattg

SEQ ID NO: 107781 - DNA, 22 bp, Artificial Sequence
  chemically synthesized
taaatctttgaggaattgccac

SEQ ID NO: 107782 - DNA, 22 bp, Artificial Sequence
  chemically synthesized
aatctttgaggaattgccacac

SEQ ID NO: 107783 - DNA, 22 bp, Artificial Sequence
  chemically synthesized
tgaggaattgccacactgtctt

SEQ ID NO: 107784 - DNA, 22 bp, Artificial Sequence
  chemically synthesized
gaggaattgccacactgtcttc

SEQ ID NO: 107785 - DNA, 22 bp, Artificial Sequence
  chemically synthesized
aggaattgccacactgtcttcc

SEQ ID NO: 107786 - DNA, 22 bp, Artificial Sequence
  chemically synthesized
ccacactgtcttccacaatggt

SEQ ID NO: 107787 - DNA, 22 bp, Artificial Sequence
  chemically synthesized
tcttccacaatggttgaattag

SEQ ID NO: 107788 - DNA, 22 bp, Artificial Sequence
  chemically synthesized
ccacaatggttgaattagttta

SEQ ID NO: 107789 - DNA, 22 bp, Artificial Sequence
  chemically synthesized
cacaatggttgaattagtttac

SEQ ID NO: 107790 - DNA, 22 bp, Artificial Sequence
  chemically synthesized
aattagtttacagtcccaccaa

SEQ ID NO: 107791 - DNA, 22 bp, Artificial Sequence
  chemically synthesized
gtttacagtcccaccaacagtg

SEQ ID NO: 107792 - DNA, 22 bp, Artificial Sequence
  chemically synthesized
acagtcccaccaacagtgtaaa

SEQ ID NO: 107793 - DNA, 22 bp, Artificial Sequence
  chemically synthesized
cagtcccaccaacagtgtaaaa

SEQ ID NO: 107794 - DNA, 22 bp, Artificial Sequence
  chemically synthesized
ctatttctctgcaaccttgcta

SEQ ID NO: 107795 - DNA, 22 bp, Artificial Sequence
  chemically synthesized
tttctctgcaaccttgctagca

SEQ ID NO: 107796 - DNA, 22 bp, Artificial Sequence
  chemically synthesized
ctctgcaaccttgctagcatct

SEQ ID NO: 107797 - DNA, 22 bp, Artificial Sequence
  chemically synthesized
tctgcaaccttgctagcatctg

SEQ ID NO: 107798 - DNA, 22 bp, Artificial Sequence
  chemically synthesized
tgcaaccttgctagcatctgtt

SEQ ID NO: 107799 - DNA, 22 bp, Artificial Sequence
  chemically synthesized
caaccttgctagcatctgttgt

SEQ ID NO: 107800 - DNA, 22 bp, Artificial Sequence
  chemically synthesized
gctagcatctgttgtttcttga

SEQ ID NO: 107801 - DNA, 22 bp, Artificial Sequence
  chemically synthesized
ctagcatctgttgtttcttgac

SEQ ID NO: 107802 - DNA, 22 bp, Artificial Sequence
  chemically synthesized
gcatctgttgtttcttgacttt

SEQ ID NO: 107803 - DNA, 22 bp, Artificial Sequence
  chemically synthesized
ttgtttcttgactttaaaaacc

SEQ ID NO: 107804 - DNA, 22 bp, Artificial Sequence
  chemically synthesized
tttcttgactttaaaaaccacc

SEQ ID NO: 107805 - DNA, 22 bp, Artificial Sequence
  chemically synthesized
cttgactttaaaaaccaccatt

SEQ ID NO: 107806 - DNA, 22 bp, Artificial Sequence
  chemically synthesized
ttgactttaaaaaccaccattc

SEQ ID NO: 107807 - DNA, 22 bp, Artificial Sequence
  chemically synthesized
gactttaaaaaccaccattctg

SEQ ID NO: 107808 - DNA, 22 bp, Artificial Sequence
  chemically synthesized
actttaaaaaccaccattctga

SEQ ID NO: 107809 - DNA, 22 bp, Artificial Sequence
  chemically synthesized
taaaaaccaccattctgactgg

SEQ ID NO: 107810 - DNA, 22 bp, Artificial Sequence
  chemically synthesized
aaaaaccaccattctgactggt

SEQ ID NO: 107811 - DNA, 22 bp, Artificial Sequence
  chemically synthesized
aaaaccaccattctgactggtg

SEQ ID NO: 107812 - DNA, 22 bp, Artificial Sequence
  chemically synthesized
tgactggtgtcagatggtattt

SEQ ID NO: 107813 - DNA, 22 bp, Artificial Sequence
  chemically synthesized
actggtgtcagatggtatttca

SEQ ID NO: 107814 - DNA, 22 bp, Artificial Sequence
  chemically synthesized
gtgtcagatggtatttcattgt

SEQ ID NO: 107815 - DNA, 22 bp, Artificial Sequence
  chemically synthesized
cattgtggttttgatttgcatt

SEQ ID NO: 107816 - DNA, 22 bp, Artificial Sequence
  chemically synthesized
attgtggttttgatttgcattt

SEQ ID NO: 107817 - DNA, 22 bp, Artificial Sequence
  chemically synthesized
tggttttgatttgcatttctct

SEQ ID NO: 107818 - DNA, 22 bp, Artificial Sequence
  chemically synthesized
tgatttgcatttctctaatgat

SEQ ID NO: 107819 - DNA, 22 bp, Artificial Sequence
  chemically synthesized
gatttgcatttctctaatgatc

SEQ ID NO: 107820 - DNA, 22 bp, Artificial Sequence
  chemically synthesized
atttgcatttctctaatgatca

SEQ ID NO: 107821 - DNA, 22 bp, Artificial Sequence
  chemically synthesized
gcatttctctaatgatcagtga

SEQ ID NO: 107822 - DNA, 22 bp, Artificial Sequence
  chemically synthesized
catttctctaatgatcagtgac

SEQ ID NO: 107823 - DNA, 22 bp, Artificial Sequence
  chemically synthesized
ctctaatgatcagtgacattga

SEQ ID NO: 107824 - DNA, 22 bp, Artificial Sequence
  chemically synthesized
tctaatgatcagtgacattgag

SEQ ID NO: 107825 - DNA, 22 bp, Artificial Sequence
  chemically synthesized
taatgatcagtgacattgagac

SEQ ID NO: 107826 - DNA, 22 bp, Artificial Sequence
  chemically synthesized
atgatcagtgacattgagactt

SEQ ID NO: 107827 - DNA, 22 bp, Artificial Sequence
  chemically synthesized
agacttttttcgtatgtttctt

SEQ ID NO: 107828 - DNA, 22 bp, Artificial Sequence
  chemically synthesized
ttttcgtatgtttcttagccac

SEQ ID NO: 107829 - DNA, 22 bp, Artificial Sequence
  chemically synthesized
tttcgtatgtttcttagccaca

SEQ ID NO: 107830 - DNA, 22 bp, Artificial Sequence
  chemically synthesized
ttcgtatgtttcttagccacat

SEQ ID NO: 107831 - DNA, 22 bp, Artificial Sequence
  chemically synthesized
tcgtatgtttcttagccacata

SEQ ID NO: 107832 - DNA, 22 bp, Artificial Sequence
  chemically synthesized
cgtatgtttcttagccacataa

SEQ ID NO: 107833 - DNA, 22 bp, Artificial Sequence
  chemically synthesized
gtatgtttcttagccacataaa

SEQ ID NO: 107834 - DNA, 22 bp, Artificial Sequence
  chemically synthesized
cttagccacataaatgtcttct

SEQ ID NO: 107835 - DNA, 22 bp, Artificial Sequence
  chemically synthesized
ttagccacataaatgtcttctt

SEQ ID NO: 107836 - DNA, 22 bp, Artificial Sequence
  chemically synthesized
agccacataaatgtcttctttt

SEQ ID NO: 107837 - DNA, 22 bp, Artificial Sequence
  chemically synthesized
gccacataaatgtcttcttttg

SEQ ID NO: 107838 - DNA, 22 bp, Artificial Sequence
  chemically synthesized
cttttgagaagtgtctgttcat

SEQ ID NO: 107839 - DNA, 22 bp, Artificial Sequence
  chemically synthesized
ttttgagaagtgtctgttcatg

SEQ ID NO: 107840 - DNA, 22 bp, Artificial Sequence
  chemically synthesized
ttgagaagtgtctgttcatgtc

SEQ ID NO: 107841 - DNA, 22 bp, Artificial Sequence
  chemically synthesized
tgagaagtgtctgttcatgtcc

SEQ ID NO: 107842 - DNA, 22 bp, Artificial Sequence
  chemically synthesized
gagaagtgtctgttcatgtcct

SEQ ID NO: 107843 - DNA, 22 bp, Artificial Sequence
  chemically synthesized
agaagtgtctgttcatgtcctt

SEQ ID NO: 107844 - DNA, 22 bp, Artificial Sequence
  chemically synthesized
ttcatgtcctttgcccactttt

SEQ ID NO: 107845 - DNA, 22 bp, Artificial Sequence
  chemically synthesized
atgtcctttgcccactttttaa

SEQ ID NO: 107846 - DNA, 22 bp, Artificial Sequence
  chemically synthesized
tgcccactttttaatggggttg

SEQ ID NO: 107847 - DNA, 22 bp, Artificial Sequence
  chemically synthesized
gcccactttttaatggggttgt

SEQ ID NO: 107848 - DNA, 22 bp, Artificial Sequence
  chemically synthesized
cccactttttaatggggttgtt

SEQ ID NO: 107849 - DNA, 22 bp, Artificial Sequence
  chemically synthesized
tttaatggggttgtttgtgtgt

SEQ ID NO: 107850 - DNA, 22 bp, Artificial Sequence
  chemically synthesized
ttaatggggttgtttgtgtgtt

SEQ ID NO: 107851 - DNA, 22 bp, Artificial Sequence
  chemically synthesized
taatggggttgtttgtgtgttt

SEQ ID NO: 107852 - DNA, 22 bp, Artificial Sequence
  chemically synthesized
aatggggttgtttgtgtgtttc

SEQ ID NO: 107853 - DNA, 22 bp, Artificial Sequence
  chemically synthesized
atggggttgtttgtgtgtttct

SEQ ID NO: 107854 - DNA, 22 bp, Artificial Sequence
  chemically synthesized
tttgtgtgtttcttttgtaaat

SEQ ID NO: 107855 - DNA, 22 bp, Artificial Sequence
  chemically synthesized
gtgtgtttcttttgtaaatatg

SEQ ID NO: 107856 - DNA, 22 bp, Artificial Sequence
  chemically synthesized
tgtgtttcttttgtaaatatgt

SEQ ID NO: 107857 - DNA, 22 bp, Artificial Sequence
  chemically synthesized
cttttgtaaatatgtctaagtt

SEQ ID NO: 107858 - DNA, 22 bp, Artificial Sequence
  chemically synthesized
ttttgtaaatatgtctaagttc

SEQ ID NO: 107859 - DNA, 22 bp, Artificial Sequence
  chemically synthesized
ttgtaaatatgtctaagttcct

SEQ ID NO: 107860 - DNA, 22 bp, Artificial Sequence
  chemically synthesized
tgtaaatatgtctaagttcctc

SEQ ID NO: 107861 - DNA, 22 bp, Artificial Sequence
  chemically synthesized
gtaaatatgtctaagttcctca

SEQ ID NO: 107862 - DNA, 22 bp, Artificial Sequence
  chemically synthesized
taaatatgtctaagttcctcat

SEQ ID NO: 107863 - DNA, 22 bp, Artificial Sequence
  chemically synthesized
agttcctcatagattctggata

SEQ ID NO: 107864 - DNA, 22 bp, Artificial Sequence
  chemically synthesized
ctcatagattctggatattaga

SEQ ID NO: 107865 - DNA, 22 bp, Artificial Sequence
  chemically synthesized
atagattctggatattagacct

SEQ ID NO: 107866 - DNA, 22 bp, Artificial Sequence
  chemically synthesized
tggatattagacctttgtcaga

SEQ ID NO: 107867 - DNA, 22 bp, Artificial Sequence
  chemically synthesized
gatattagacctttgtcagatg

SEQ ID NO: 107868 - DNA, 22 bp, Artificial Sequence
  chemically synthesized
gacctttgtcagatgggtagat

SEQ ID NO: 107869 - DNA, 22 bp, Artificial Sequence
  chemically synthesized
tgtcagatgggtagattgcaga

SEQ ID NO: 107870 - DNA, 22 bp, Artificial Sequence
  chemically synthesized
gtcagatgggtagattgcagaa

SEQ ID NO: 107871 - DNA, 22 bp, Artificial Sequence
  chemically synthesized
tcagatgggtagattgcagaaa

SEQ ID NO: 107872 - DNA, 22 bp, Artificial Sequence
  chemically synthesized
cagaaattttctcccattctgt

SEQ ID NO: 107873 - DNA, 22 bp, Artificial Sequence
  chemically synthesized
tctcccattctgtaggttgcct

SEQ ID NO: 107874 - DNA, 22 bp, Artificial Sequence
  chemically synthesized
ctcccattctgtaggttgcctg

SEQ ID NO: 107875 - DNA, 22 bp, Artificial Sequence
  chemically synthesized
tcccattctgtaggttgcctgt

SEQ ID NO: 107876 - DNA, 22 bp, Artificial Sequence
  chemically synthesized
ccattctgtaggttgcctgttc

SEQ ID NO: 107877 - DNA, 22 bp, Artificial Sequence
  chemically synthesized
tgtaggttgcctgttcgctctg

SEQ ID NO: 107878 - DNA, 22 bp, Artificial Sequence
  chemically synthesized
taggttgcctgttcgctctgat

SEQ ID NO: 107879 - DNA, 22 bp, Artificial Sequence
  chemically synthesized
cctgttcgctctgatgatagtt

SEQ ID NO: 107880 - DNA, 22 bp, Artificial Sequence
  chemically synthesized
ttcgctctgatgatagtttatt

SEQ ID NO: 107881 - DNA, 22 bp, Artificial Sequence
  chemically synthesized
gctctgatgatagtttattttg

SEQ ID NO: 107882 - DNA, 22 bp, Artificial Sequence
  chemically synthesized
tgatgatagtttattttgctgt

SEQ ID NO: 107883 - DNA, 22 bp, Artificial Sequence
  chemically synthesized
atgatagtttattttgctgttt

SEQ ID NO: 107884 - DNA, 22 bp, Artificial Sequence
  chemically synthesized
attttgctgtttagaagctctg

SEQ ID NO: 107885 - DNA, 22 bp, Artificial Sequence
  chemically synthesized
ttttgctgtttagaagctctgt

SEQ ID NO: 107886 - DNA, 22 bp, Artificial Sequence
  chemically synthesized
tgctgtttagaagctctgtatt

SEQ ID NO: 107887 - DNA, 22 bp, Artificial Sequence
  chemically synthesized
gctgtttagaagctctgtattt

SEQ ID NO: 107888 - DNA, 22 bp, Artificial Sequence
  chemically synthesized
ctgtttagaagctctgtattta

SEQ ID NO: 107889 - DNA, 22 bp, Artificial Sequence
  chemically synthesized
tttagaagctctgtatttaatt

SEQ ID NO: 107890 - DNA, 22 bp, Artificial Sequence
  chemically synthesized
agaagctctgtatttaattgta

SEQ ID NO: 107891 - DNA, 22 bp, Artificial Sequence
  chemically synthesized
gaagctctgtatttaattgtat

SEQ ID NO: 107892 - DNA, 22 bp, Artificial Sequence
  chemically synthesized
tgtatttaattgtatttttctt

SEQ ID NO: 107893 - DNA, 22 bp, Artificial Sequence
  chemically synthesized
tatttaattgtatttttcttta

SEQ ID NO: 107894 - DNA, 22 bp, Artificial Sequence
  chemically synthesized
aattgtatttttctttattttg

SEQ ID NO: 107895 - DNA, 22 bp, Artificial Sequence
  chemically synthesized
attgtatttttctttattttga

SEQ ID NO: 107896 - DNA, 22 bp, Artificial Sequence
  chemically synthesized
tatttttctttattttgagatg

SEQ ID NO: 107897 - DNA, 22 bp, Artificial Sequence
  chemically synthesized
ttctttattttgagatgaagtc

SEQ ID NO: 107898 - DNA, 22 bp, Artificial Sequence
  chemically synthesized
tctttattttgagatgaagtct

SEQ ID NO: 107899 - DNA, 22 bp, Artificial Sequence
  chemically synthesized
ctttattttgagatgaagtctc

SEQ ID NO: 107900 - DNA, 22 bp, Artificial Sequence
  chemically synthesized
tttattttgagatgaagtctca

SEQ ID NO: 107901 - DNA, 22 bp, Artificial Sequence
  chemically synthesized
tattttgagatgaagtctcact

SEQ ID NO: 107902 - DNA, 22 bp, Artificial Sequence
  chemically synthesized
attttgagatgaagtctcactc

SEQ ID NO: 107903 - DNA, 22 bp, Artificial Sequence
  chemically synthesized
ttttgagatgaagtctcactct

SEQ ID NO: 107904 - DNA, 22 bp, Artificial Sequence
  chemically synthesized
tgagatgaagtctcactctttc

SEQ ID NO: 107905 - DNA, 22 bp, Artificial Sequence
  chemically synthesized
gagatgaagtctcactctttca

SEQ ID NO: 107906 - DNA, 22 bp, Artificial Sequence
  chemically synthesized
agatgaagtctcactctttcac

SEQ ID NO: 107907 - DNA, 22 bp, Artificial Sequence
  chemically synthesized
actctttcacccatgctagagt

SEQ ID NO: 107908 - DNA, 22 bp, Artificial Sequence
  chemically synthesized
tttcacccatgctagagtgcag

SEQ ID NO: 107909 - DNA, 22 bp, Artificial Sequence
  chemically synthesized
tcacccatgctagagtgcagtg

SEQ ID NO: 107910 - DNA, 22 bp, Artificial Sequence
  chemically synthesized
cacccatgctagagtgcagtgg

SEQ ID NO: 107911 - DNA, 22 bp, Artificial Sequence
  chemically synthesized
acccatgctagagtgcagtggt

SEQ ID NO: 107912 - DNA, 22 bp, Artificial Sequence
  chemically synthesized
gagtgcagtggtgcgatctcag

SEQ ID NO: 107913 - DNA, 22 bp, Artificial Sequence
  chemically synthesized
agctcactgcaacctctgcctc

SEQ ID NO: 107914 - DNA, 22 bp, Artificial Sequence
  chemically synthesized
actgcaacctctgcctcctggg

SEQ ID NO: 107915 - DNA, 22 bp, Artificial Sequence
  chemically synthesized
caacctctgcctcctgggttca

SEQ ID NO: 107916 - DNA, 22 bp, Artificial Sequence
  chemically synthesized
tgcctcctgggttcaagcaatt

SEQ ID NO: 107917 - DNA, 22 bp, Artificial Sequence
  chemically synthesized
cctcctgggttcaagcaattct

SEQ ID NO: 107918 - DNA, 22 bp, Artificial Sequence
  chemically synthesized
ctgggttcaagcaattctcctg

SEQ ID NO: 107919 - DNA, 22 bp, Artificial Sequence
  chemically synthesized
ggttcaagcaattctcctgcct

SEQ ID NO: 107920 - DNA, 22 bp, Artificial Sequence
  chemically synthesized
aagcaattctcctgcctcagcc

SEQ ID NO: 107921 - DNA, 22 bp, Artificial Sequence
  chemically synthesized
tcctgcctcagcctcctgagta

SEQ ID NO: 107922 - DNA, 22 bp, Artificial Sequence
  chemically synthesized
ctgcctcagcctcctgagtagc

SEQ ID NO: 107923 - DNA, 22 bp, Artificial Sequence
  chemically synthesized
cctcagcctcctgagtagctga

SEQ ID NO: 107924 - DNA, 22 bp, Artificial Sequence
  chemically synthesized
agcctcctgagtagctgagatt

SEQ ID NO: 107925 - DNA, 22 bp, Artificial Sequence
  chemically synthesized
ctgagtagctgagattacaggt

SEQ ID NO: 107926 - DNA, 22 bp, Artificial Sequence
  chemically synthesized
agtagctgagattacaggtacg

SEQ ID NO: 107927 - DNA, 22 bp, Artificial Sequence
  chemically synthesized
agattacaggtacgcaccacca

SEQ ID NO: 107928 - DNA, 22 bp, Artificial Sequence
  chemically synthesized
caggtacgcaccaccataccca

SEQ ID NO: 107929 - DNA, 22 bp, Artificial Sequence
  chemically synthesized
tttgtatttttagtagagatgg

SEQ ID NO: 107930 - DNA, 22 bp, Artificial Sequence
  chemically synthesized
ttgtatttttagtagagatgga

SEQ ID NO: 107931 - DNA, 22 bp, Artificial Sequence
  chemically synthesized
tgtatttttagtagagatggag

SEQ ID NO: 107932 - DNA, 22 bp, Artificial Sequence
  chemically synthesized
gtatttttagtagagatggagt

SEQ ID NO: 107933 - DNA, 22 bp, Artificial Sequence
  chemically synthesized
tatttttagtagagatggagtt

SEQ ID NO: 107934 - DNA, 22 bp, Artificial Sequence
  chemically synthesized
ttagtagagatggagtttcacc

SEQ ID NO: 107935 - DNA, 22 bp, Artificial Sequence
  chemically synthesized
tagtagagatggagtttcacca

SEQ ID NO: 107936 - DNA, 22 bp, Artificial Sequence
  chemically synthesized
agtagagatggagtttcaccat

SEQ ID NO: 107937 - DNA, 22 bp, Artificial Sequence
  chemically synthesized
gtagagatggagtttcaccatg

SEQ ID NO: 107938 - DNA, 22 bp, Artificial Sequence
  chemically synthesized
caccatgttggccaggctgctc

SEQ ID NO: 107939 - DNA, 22 bp, Artificial Sequence
  chemically synthesized
accatgttggccaggctgctct

SEQ ID NO: 107940 - DNA, 22 bp, Artificial Sequence
  chemically synthesized
gccaggctgctcttatactccc

SEQ ID NO: 107941 - DNA, 22 bp, Artificial Sequence
  chemically synthesized
ctcttatactccccacctcaag

SEQ ID NO: 107942 - DNA, 22 bp, Artificial Sequence
  chemically synthesized
ttatactccccacctcaagtga

SEQ ID NO: 107943 - DNA, 22 bp, Artificial Sequence
  chemically synthesized
atactccccacctcaagtgatc

SEQ ID NO: 107944 - DNA, 22 bp, Artificial Sequence
  chemically synthesized
tactccccacctcaagtgatcc

SEQ ID NO: 107945 - DNA, 22 bp, Artificial Sequence
  chemically synthesized
cccacctcaagtgatccaccca

SEQ ID NO: 107946 - DNA, 22 bp, Artificial Sequence
  chemically synthesized
aagtgatccacccaccttggcc

SEQ ID NO: 107947 - DNA, 22 bp, Artificial Sequence
  chemically synthesized
ggcctcccaaagtgctgggatt

SEQ ID NO: 107948 - DNA, 22 bp, Artificial Sequence
  chemically synthesized
gcctcccaaagtgctgggatta

SEQ ID NO: 107949 - DNA, 22 bp, Artificial Sequence
  chemically synthesized
ccaaagtgctgggattacaggc

SEQ ID NO: 107950 - DNA, 22 bp, Artificial Sequence
  chemically synthesized
ggattacaggcgtgagccacca

SEQ ID NO: 107951 - DNA, 22 bp, Artificial Sequence
  chemically synthesized
caggcgtgagccaccatgcccg

SEQ ID NO: 107952 - DNA, 22 bp, Artificial Sequence
  chemically synthesized
tttagtttaattagatctcatt

SEQ ID NO: 107953 - DNA, 22 bp, Artificial Sequence
  chemically synthesized
tagtttaattagatctcatttg

SEQ ID NO: 107954 - DNA, 22 bp, Artificial Sequence
  chemically synthesized
agtttaattagatctcatttga

SEQ ID NO: 107955 - DNA, 22 bp, Artificial Sequence
  chemically synthesized
gtttaattagatctcatttgac

SEQ ID NO: 107956 - DNA, 22 bp, Artificial Sequence
  chemically synthesized
aattagatctcatttgacagtg

SEQ ID NO: 107957 - DNA, 22 bp, Artificial Sequence
  chemically synthesized
attagatctcatttgacagtgt

SEQ ID NO: 107958 - DNA, 22 bp, Artificial Sequence
  chemically synthesized
gatctcatttgacagtgtttgc

SEQ ID NO: 107959 - DNA, 22 bp, Artificial Sequence
  chemically synthesized
atttgacagtgtttgcttttgt

SEQ ID NO: 107960 - DNA, 22 bp, Artificial Sequence
  chemically synthesized
gacagtgtttgcttttgttgca

SEQ ID NO: 107961 - DNA, 22 bp, Artificial Sequence
  chemically synthesized
acagtgtttgcttttgttgcaa

SEQ ID NO: 107962 - DNA, 22 bp, Artificial Sequence
  chemically synthesized
gcttttgttgcaattgtttttg

SEQ ID NO: 107963 - DNA, 22 bp, Artificial Sequence
  chemically synthesized
cttttgttgcaattgtttttga

SEQ ID NO: 107964 - DNA, 22 bp, Artificial Sequence
  chemically synthesized
ttgttgcaattgtttttgacat

SEQ ID NO: 107965 - DNA, 22 bp, Artificial Sequence
  chemically synthesized
tgttgcaattgtttttgacatt

SEQ ID NO: 107966 - DNA, 22 bp, Artificial Sequence
  chemically synthesized
gttgcaattgtttttgacattt

SEQ ID NO: 107967 - DNA, 22 bp, Artificial Sequence
  chemically synthesized
ttgcaattgtttttgacatttt

SEQ ID NO: 107968 - DNA, 22 bp, Artificial Sequence
  chemically synthesized
caattgtttttgacattttcat

SEQ ID NO: 107969 - DNA, 22 bp, Artificial Sequence
  chemically synthesized
tttttgacattttcatcatgaa

SEQ ID NO: 107970 - DNA, 22 bp, Artificial Sequence
  chemically synthesized
ttgacattttcatcatgaaatc

SEQ ID NO: 107971 - DNA, 22 bp, Artificial Sequence
  chemically synthesized
tgacattttcatcatgaaatct

SEQ ID NO: 107972 - DNA, 22 bp, Artificial Sequence
  chemically synthesized
gacattttcatcatgaaatctt

SEQ ID NO: 107973 - DNA, 22 bp, Artificial Sequence
  chemically synthesized
acattttcatcatgaaatcttt

SEQ ID NO: 107974 - DNA, 22 bp, Artificial Sequence
  chemically synthesized
tcatcatgaaatctttgcctgt

SEQ ID NO: 107975 - DNA, 22 bp, Artificial Sequence
  chemically synthesized
catcatgaaatctttgcctgtg

SEQ ID NO: 107976 - DNA, 22 bp, Artificial Sequence
  chemically synthesized
atcatgaaatctttgcctgtgt

SEQ ID NO: 107977 - DNA, 22 bp, Artificial Sequence
  chemically synthesized
tgcctgtgtctatgtccggaat

SEQ ID NO: 107978 - DNA, 22 bp, Artificial Sequence
  chemically synthesized
gcctgtgtctatgtccggaatg

SEQ ID NO: 107979 - DNA, 22 bp, Artificial Sequence
  chemically synthesized
cctgtgtctatgtccggaatgg

SEQ ID NO: 107980 - DNA, 22 bp, Artificial Sequence
  chemically synthesized
tgtctatgtccggaatggtatt

SEQ ID NO: 107981 - DNA, 22 bp, Artificial Sequence
  chemically synthesized
tgtccggaatggtattgcctag

SEQ ID NO: 107982 - DNA, 22 bp, Artificial Sequence
  chemically synthesized
cctaggttttcttctaaagttt

SEQ ID NO: 107983 - DNA, 22 bp, Artificial Sequence
  chemically synthesized
ggttttcttctaaagtttttat

SEQ ID NO: 107984 - DNA, 22 bp, Artificial Sequence
  chemically synthesized
tcttctaaagtttttatagttt

SEQ ID NO: 107985 - DNA, 22 bp, Artificial Sequence
  chemically synthesized
cttctaaagtttttatagtttt

SEQ ID NO: 107986 - DNA, 22 bp, Artificial Sequence
  chemically synthesized
ttctaaagtttttatagttttg

SEQ ID NO: 107987 - DNA, 22 bp, Artificial Sequence
  chemically synthesized
ctaaagtttttatagttttggg

SEQ ID NO: 107988 - DNA, 22 bp, Artificial Sequence
  chemically synthesized
taaagtttttatagttttgggt

SEQ ID NO: 107989 - DNA, 22 bp, Artificial Sequence
  chemically synthesized
aagtttttatagttttgggttt

SEQ ID NO: 107990 - DNA, 22 bp, Artificial Sequence
  chemically synthesized
ttatagttttgggttttacact

SEQ ID NO: 107991 - DNA, 22 bp, Artificial Sequence
  chemically synthesized
tatagttttgggttttacactt

SEQ ID NO: 107992 - DNA, 22 bp, Artificial Sequence
  chemically synthesized
atagttttgggttttacactta

SEQ ID NO: 107993 - DNA, 22 bp, Artificial Sequence
  chemically synthesized
tagttttgggttttacacttaa

SEQ ID NO: 107994 - DNA, 22 bp, Artificial Sequence
  chemically synthesized
tgggttttacacttaagtcttt

SEQ ID NO: 107995 - DNA, 22 bp, Artificial Sequence
  chemically synthesized
gggttttacacttaagtcttta

SEQ ID NO: 107996 - DNA, 22 bp, Artificial Sequence
  chemically synthesized
ggttttacacttaagtctttaa

SEQ ID NO: 107997 - DNA, 22 bp, Artificial Sequence
  chemically synthesized
tacacttaagtctttaatgcat

SEQ ID NO: 107998 - DNA, 22 bp, Artificial Sequence
  chemically synthesized
acacttaagtctttaatgcatc

SEQ ID NO: 107999 - DNA, 22 bp, Artificial Sequence
  chemically synthesized
cacttaagtctttaatgcatct

SEQ ID NO: 108000 - DNA, 22 bp, Artificial Sequence
  chemically synthesized
aagtctttaatgcatcttgagt

SEQ ID NO: 108001 - DNA, 22 bp, Artificial Sequence
  chemically synthesized
agtctttaatgcatcttgagtt

SEQ ID NO: 108002 - DNA, 22 bp, Artificial Sequence
  chemically synthesized
taatgcatcttgagttaattta

SEQ ID NO: 108003 - DNA, 22 bp, Artificial Sequence
  chemically synthesized
aatgcatcttgagttaatttat

SEQ ID NO: 108004 - DNA, 22 bp, Artificial Sequence
  chemically synthesized
atgcatcttgagttaatttatg

SEQ ID NO: 108005 - DNA, 22 bp, Artificial Sequence
  chemically synthesized
gagttaatttatgtataagatg

SEQ ID NO: 108006 - DNA, 22 bp, Artificial Sequence
  chemically synthesized
agttaatttatgtataagatgt

SEQ ID NO: 108007 - DNA, 22 bp, Artificial Sequence
  chemically synthesized
atttatgtataagatgtaagga

SEQ ID NO: 108008 - DNA, 22 bp, Artificial Sequence
  chemically synthesized
atgtataagatgtaaggaaggg

SEQ ID NO: 108009 - DNA, 22 bp, Artificial Sequence
  chemically synthesized
tgtataagatgtaaggaagggg

SEQ ID NO: 108010 - DNA, 22 bp, Artificial Sequence
  chemically synthesized
caattttctgcatatggctagc

SEQ ID NO: 108011 - DNA, 22 bp, Artificial Sequence
  chemically synthesized
aattttctgcatatggctagcc

SEQ ID NO: 108012 - DNA, 22 bp, Artificial Sequence
  chemically synthesized
tctgcatatggctagccagttc

SEQ ID NO: 108013 - DNA, 22 bp, Artificial Sequence
  chemically synthesized
ctgcatatggctagccagttct

SEQ ID NO: 108014 - DNA, 22 bp, Artificial Sequence
  chemically synthesized
tgcatatggctagccagttctc

SEQ ID NO: 108015 - DNA, 22 bp, Artificial Sequence
  chemically synthesized
catatggctagccagttctccc

SEQ ID NO: 108016 - DNA, 22 bp, Artificial Sequence
  chemically synthesized
gccagttctcccagcacaattt

SEQ ID NO: 108017 - DNA, 22 bp, Artificial Sequence
  chemically synthesized
tcccagcacaatttataaaata

SEQ ID NO: 108018 - DNA, 22 bp, Artificial Sequence
  chemically synthesized
ccagcacaatttataaaatagg

SEQ ID NO: 108019 - DNA, 22 bp, Artificial Sequence
  chemically synthesized
ataaaatagggaatcccttccc

SEQ ID NO: 108020 - DNA, 22 bp, Artificial Sequence
  chemically synthesized
taaaatagggaatcccttcccc

SEQ ID NO: 108021 - DNA, 22 bp, Artificial Sequence
  chemically synthesized
ccccattacttgtttttaccag

SEQ ID NO: 108022 - DNA, 22 bp, Artificial Sequence
  chemically synthesized
cccattacttgtttttaccagg

SEQ ID NO: 108023 - DNA, 22 bp, Artificial Sequence
  chemically synthesized
cttgtttttaccaggtttgttg

SEQ ID NO: 108024 - DNA, 22 bp, Artificial Sequence
  chemically synthesized
gtttttaccaggtttgttgaag

SEQ ID NO: 108025 - DNA, 22 bp, Artificial Sequence
  chemically synthesized
tttttaccaggtttgttgaaga

SEQ ID NO: 108026 - DNA, 22 bp, Artificial Sequence
  chemically synthesized
ttaccaggtttgttgaagatca

SEQ ID NO: 108027 - DNA, 22 bp, Artificial Sequence
  chemically synthesized
taccaggtttgttgaagatcag

SEQ ID NO: 108028 - DNA, 22 bp, Artificial Sequence
  chemically synthesized
accaggtttgttgaagatcaga

SEQ ID NO: 108029 - DNA, 22 bp, Artificial Sequence
  chemically synthesized
ccaggtttgttgaagatcagat

SEQ ID NO: 108030 - DNA, 22 bp, Artificial Sequence
  chemically synthesized
gttgaagatcagattgtttcag

SEQ ID NO: 108031 - DNA, 22 bp, Artificial Sequence
  chemically synthesized
ttgaagatcagattgtttcaga

SEQ ID NO: 108032 - DNA, 22 bp, Artificial Sequence
  chemically synthesized
aagatcagattgtttcagatgc

SEQ ID NO: 108033 - DNA, 22 bp, Artificial Sequence
  chemically synthesized
tttcagatgcgcggtcttactt

SEQ ID NO: 108034 - DNA, 22 bp, Artificial Sequence
  chemically synthesized
cagatgcgcggtcttacttctg

SEQ ID NO: 108035 - DNA, 22 bp, Artificial Sequence
  chemically synthesized
agatgcgcggtcttacttctga

SEQ ID NO: 108036 - DNA, 22 bp, Artificial Sequence
  chemically synthesized
acttctgagttctccattctgt

SEQ ID NO: 108037 - DNA, 22 bp, Artificial Sequence
  chemically synthesized
cttctgagttctccattctgtt

SEQ ID NO: 108038 - DNA, 22 bp, Artificial Sequence
  chemically synthesized
ctgagttctccattctgttcca

SEQ ID NO: 108039 - DNA, 22 bp, Artificial Sequence
  chemically synthesized
tgagttctccattctgttccat

SEQ ID NO: 108040 - DNA, 22 bp, Artificial Sequence
  chemically synthesized
agttctccattctgttccatta

SEQ ID NO: 108041 - DNA, 22 bp, Artificial Sequence
  chemically synthesized
tccattctgttccattagtcag

SEQ ID NO: 108042 - DNA, 22 bp, Artificial Sequence
  chemically synthesized
cattctgttccattagtcagtg

SEQ ID NO: 108043 - DNA, 22 bp, Artificial Sequence
  chemically synthesized
tgttccattagtcagtgtgtct

SEQ ID NO: 108044 - DNA, 22 bp, Artificial Sequence
  chemically synthesized
ttccattagtcagtgtgtctgt

SEQ ID NO: 108045 - DNA, 22 bp, Artificial Sequence
  chemically synthesized
cattagtcagtgtgtctgtttg

SEQ ID NO: 108046 - DNA, 22 bp, Artificial Sequence
  chemically synthesized
gtcagtgtgtctgtttggtatc

SEQ ID NO: 108047 - DNA, 22 bp, Artificial Sequence
  chemically synthesized
tttggtatcagtaccatgctgt

SEQ ID NO: 108048 - DNA, 22 bp, Artificial Sequence
  chemically synthesized
ggtatcagtaccatgctgtttc

SEQ ID NO: 108049 - DNA, 22 bp, Artificial Sequence
  chemically synthesized
gtatcagtaccatgctgtttca

SEQ ID NO: 108050 - DNA, 22 bp, Artificial Sequence
  chemically synthesized
tttcagttagttactgtcacct

SEQ ID NO: 108051 - DNA, 22 bp, Artificial Sequence
  chemically synthesized
cagttagttactgtcaccttgt

SEQ ID NO: 108052 - DNA, 22 bp, Artificial Sequence
  chemically synthesized
agttagttactgtcaccttgta

SEQ ID NO: 108053 - DNA, 22 bp, Artificial Sequence
  chemically synthesized
gttactgtcaccttgtagtata

SEQ ID NO: 108054 - DNA, 22 bp, Artificial Sequence
  chemically synthesized
ctgtcaccttgtagtataattt

SEQ ID NO: 108055 - DNA, 22 bp, Artificial Sequence
  chemically synthesized
tcaccttgtagtataatttgaa

SEQ ID NO: 108056 - DNA, 22 bp, Artificial Sequence
  chemically synthesized
gtagtataatttgaagttgggt

SEQ ID NO: 108057 - DNA, 22 bp, Artificial Sequence
  chemically synthesized
tagtataatttgaagttgggta

SEQ ID NO: 108058 - DNA, 22 bp, Artificial Sequence
  chemically synthesized
gaagttgggtaaatcctgttga

SEQ ID NO: 108059 - DNA, 22 bp, Artificial Sequence
  chemically synthesized
aagttgggtaaatcctgttgat

SEQ ID NO: 108060 - DNA, 22 bp, Artificial Sequence
  chemically synthesized
ggtaaatcctgttgattctatt

SEQ ID NO: 108061 - DNA, 22 bp, Artificial Sequence
  chemically synthesized
ttgattctatttttctggagaa

SEQ ID NO: 108062 - DNA, 22 bp, Artificial Sequence
  chemically synthesized
attctatttttctggagaacca

SEQ ID NO: 108063 - DNA, 22 bp, Artificial Sequence
  chemically synthesized
tatttttctggagaaccatgac

SEQ ID NO: 108064 - DNA, 22 bp, Artificial Sequence
  chemically synthesized
tttttctggagaaccatgacta

SEQ ID NO: 108065 - DNA, 22 bp, Artificial Sequence
  chemically synthesized
ttctggagaaccatgactaaca

SEQ ID NO: 108066 - DNA, 22 bp, Artificial Sequence
  chemically synthesized
tctggagaaccatgactaacat

SEQ ID NO: 108067 - DNA, 22 bp, Artificial Sequence
  chemically synthesized
ctggagaaccatgactaacata

SEQ ID NO: 108068 - DNA, 22 bp, Artificial Sequence
  chemically synthesized
tggagaaccatgactaacatag

SEQ ID NO: 108069 - DNA, 22 bp, Artificial Sequence
  chemically synthesized
gagaaccatgactaacataggg

SEQ ID NO: 108070 - DNA, 22 bp, Artificial Sequence
  chemically synthesized
acatagggccatctatttttga

SEQ ID NO: 108071 - DNA, 22 bp, Artificial Sequence
  chemically synthesized
tttttgaggcactttgtgacta

SEQ ID NO: 108072 - DNA, 22 bp, Artificial Sequence
  chemically synthesized
ttgaggcactttgtgactaatc

SEQ ID NO: 108073 - DNA, 22 bp, Artificial Sequence
  chemically synthesized
tgaggcactttgtgactaatca

SEQ ID NO: 108074 - DNA, 22 bp, Artificial Sequence
  chemically synthesized
gaggcactttgtgactaatcac

SEQ ID NO: 108075 - DNA, 22 bp, Artificial Sequence
  chemically synthesized
aggcactttgtgactaatcact

SEQ ID NO: 108076 - DNA, 22 bp, Artificial Sequence
  chemically synthesized
tgtgactaatcactgtcatctg

SEQ ID NO: 108077 - DNA, 22 bp, Artificial Sequence
  chemically synthesized
gtgactaatcactgtcatctgt

SEQ ID NO: 108078 - DNA, 22 bp, Artificial Sequence
  chemically synthesized
tgactaatcactgtcatctgtc

SEQ ID NO: 108079 - DNA, 22 bp, Artificial Sequence
  chemically synthesized
atcactgtcatctgtcagtttg

SEQ ID NO: 108080 - DNA, 22 bp, Artificial Sequence
  chemically synthesized
tcatctgtcagtttggtggcat

SEQ ID NO: 108081 - DNA, 22 bp, Artificial Sequence
  chemically synthesized
tcagtttggtggcatgtacttg

SEQ ID NO: 108082 - DNA, 22 bp, Artificial Sequence
  chemically synthesized
ggtggcatgtacttgaaatcta

SEQ ID NO: 108083 - DNA, 22 bp, Artificial Sequence
  chemically synthesized
gtggcatgtacttgaaatctag

SEQ ID NO: 108084 - DNA, 22 bp, Artificial Sequence
  chemically synthesized
gaaatctagggacataaactcc

SEQ ID NO: 108085 - DNA, 22 bp, Artificial Sequence
  chemically synthesized
aaatctagggacataaactcct

SEQ ID NO: 108086 - DNA, 22 bp, Artificial Sequence
  chemically synthesized
gggacataaactcctaaatttc

SEQ ID NO: 108087 - DNA, 22 bp, Artificial Sequence
  chemically synthesized
ctaaatttcccataaaataaat

SEQ ID NO: 108088 - DNA, 22 bp, Artificial Sequence
  chemically synthesized
aatttcccataaaataaatttt

SEQ ID NO: 108089 - DNA, 22 bp, Artificial Sequence
  chemically synthesized
cccataaaataaattttgtcta

SEQ ID NO: 108090 - DNA, 22 bp, Artificial Sequence
  chemically synthesized
ccataaaataaattttgtctat

SEQ ID NO: 108091 - DNA, 22 bp, Artificial Sequence
  chemically synthesized
tgtctatgagtttattaataac

SEQ ID NO: 108092 - DNA, 22 bp, Artificial Sequence
  chemically synthesized
gtctatgagtttattaataaca

SEQ ID NO: 108093 - DNA, 22 bp, Artificial Sequence
  chemically synthesized
tctatgagtttattaataacaa

SEQ ID NO: 108094 - DNA, 22 bp, Artificial Sequence
  chemically synthesized
tgagtttattaataacaatgac

SEQ ID NO: 108095 - DNA, 22 bp, Artificial Sequence
  chemically synthesized
attaataacaatgactgtgtct

SEQ ID NO: 108096 - DNA, 22 bp, Artificial Sequence
  chemically synthesized
ttaataacaatgactgtgtcta

SEQ ID NO: 108097 - DNA, 22 bp, Artificial Sequence
  chemically synthesized
ataacaatgactgtgtctaagg

SEQ ID NO: 108098 - DNA, 22 bp, Artificial Sequence
  chemically synthesized
tgtctaaggatttaggctataa

SEQ ID NO: 108099 - DNA, 22 bp, Artificial Sequence
  chemically synthesized
aggatttaggctataaaatcaa

SEQ ID NO: 108100 - DNA, 22 bp, Artificial Sequence
  chemically synthesized
aggctataaaatcaaaaacaga

SEQ ID NO: 108101 - DNA, 22 bp, Artificial Sequence
  chemically synthesized
ggctataaaatcaaaaacagat

SEQ ID NO: 108102 - DNA, 22 bp, Artificial Sequence
  chemically synthesized
taaaatcaaaaacagatttaca

SEQ ID NO: 108103 - DNA, 22 bp, Artificial Sequence
  chemically synthesized
acattctttaattggacatgga

SEQ ID NO: 108104 - DNA, 22 bp, Artificial Sequence
  chemically synthesized
cattctttaattggacatggag

SEQ ID NO: 108105 - DNA, 22 bp, Artificial Sequence
  chemically synthesized
tttaattggacatggagacctc

SEQ ID NO: 108106 - DNA, 22 bp, Artificial Sequence
  chemically synthesized
taattggacatggagacctctg

SEQ ID NO: 108107 - DNA, 22 bp, Artificial Sequence
  chemically synthesized
aattggacatggagacctctgg

SEQ ID NO: 108108 - DNA, 22 bp, Artificial Sequence
  chemically synthesized
attggacatggagacctctggg

SEQ ID NO: 108109 - DNA, 22 bp, Artificial Sequence
  chemically synthesized
gacatggagacctctgggtcct

SEQ ID NO: 108110 - DNA, 22 bp, Artificial Sequence
  chemically synthesized
tgggtccttaatcatttctaat

SEQ ID NO: 108111 - DNA, 22 bp, Artificial Sequence
  chemically synthesized
ggtccttaatcatttctaatca

SEQ ID NO: 108112 - DNA, 22 bp, Artificial Sequence
  chemically synthesized
aatcatttctaatcatccttgc

SEQ ID NO: 108113 - DNA, 22 bp, Artificial Sequence
  chemically synthesized
atcatttctaatcatccttgct

SEQ ID NO: 108114 - DNA, 22 bp, Artificial Sequence
  chemically synthesized
ctaatcatccttgctgcccaat

SEQ ID NO: 108115 - DNA, 22 bp, Artificial Sequence
  chemically synthesized
taatcatccttgctgcccaatt

SEQ ID NO: 108116 - DNA, 22 bp, Artificial Sequence
  chemically synthesized
atcatccttgctgcccaattta

SEQ ID NO: 108117 - DNA, 22 bp, Artificial Sequence
  chemically synthesized
gctgcccaatttaatactcata

SEQ ID NO: 108118 - DNA, 22 bp, Artificial Sequence
  chemically synthesized
ctgcccaatttaatactcatat

SEQ ID NO: 108119 - DNA, 22 bp, Artificial Sequence
  chemically synthesized
cccaatttaatactcatataat

SEQ ID NO: 108120 - DNA, 22 bp, Artificial Sequence
  chemically synthesized
aatactcatataatctagtaag

SEQ ID NO: 108121 - DNA, 22 bp, Artificial Sequence
  chemically synthesized
atactcatataatctagtaagt

SEQ ID NO: 108122 - DNA, 22 bp, Artificial Sequence
  chemically synthesized
atataatctagtaagtatcttt

SEQ ID NO: 108123 - DNA, 22 bp, Artificial Sequence
  chemically synthesized
gtaagtatctttaaatatatca

SEQ ID NO: 108124 - DNA, 22 bp, Artificial Sequence
  chemically synthesized
taaatatatcacctttcattta

SEQ ID NO: 108125 - DNA, 22 bp, Artificial Sequence
  chemically synthesized
aaatatatcacctttcatttac

SEQ ID NO: 108126 - DNA, 22 bp, Artificial Sequence
  chemically synthesized
aatatatcacctttcatttacc

SEQ ID NO: 108127 - DNA, 22 bp, Artificial Sequence
  chemically synthesized
tcatttaccctataaaaatctg

SEQ ID NO: 108128 - DNA, 22 bp, Artificial Sequence
  chemically synthesized
catttaccctataaaaatctgc

SEQ ID NO: 108129 - DNA, 22 bp, Artificial Sequence
  chemically synthesized
atttaccctataaaaatctgca

SEQ ID NO: 108130 - DNA, 22 bp, Artificial Sequence
  chemically synthesized
accctataaaaatctgcatctc

SEQ ID NO: 108131 - DNA, 22 bp, Artificial Sequence
  chemically synthesized
ccctataaaaatctgcatctct

SEQ ID NO: 108132 - DNA, 22 bp, Artificial Sequence
  chemically synthesized
taaaaatctgcatctctggtga

SEQ ID NO: 108133 - DNA, 22 bp, Artificial Sequence
  chemically synthesized
catctctggtgaaggaacccag

SEQ ID NO: 108134 - DNA, 22 bp, Artificial Sequence
  chemically synthesized
tggtgaaggaacccagcaatta

SEQ ID NO: 108135 - DNA, 22 bp, Artificial Sequence
  chemically synthesized
gtgaaggaacccagcaattatt

SEQ ID NO: 108136 - DNA, 22 bp, Artificial Sequence
  chemically synthesized
tttgttaatgagaggaataaag

SEQ ID NO: 108137 - DNA, 22 bp, Artificial Sequence
  chemically synthesized
gttaatgagaggaataaagttc

SEQ ID NO: 108138 - DNA, 22 bp, Artificial Sequence
  chemically synthesized
ttaatgagaggaataaagttca

SEQ ID NO: 108139 - DNA, 22 bp, Artificial Sequence
  chemically synthesized
atgagaggaataaagttcatct

SEQ ID NO: 108140 - DNA, 22 bp, Artificial Sequence
  chemically synthesized
atcttccccttatctagtataa

SEQ ID NO: 108141 - DNA, 22 bp, Artificial Sequence
  chemically synthesized
ccccttatctagtataaattca

SEQ ID NO: 108142 - DNA, 22 bp, Artificial Sequence
  chemically synthesized
cccttatctagtataaattcat

SEQ ID NO: 108143 - DNA, 22 bp, Artificial Sequence
  chemically synthesized
atctagtataaattcattttat

SEQ ID NO: 108144 - DNA, 22 bp, Artificial Sequence
  chemically synthesized
tctagtataaattcattttata

SEQ ID NO: 108145 - DNA, 22 bp, Artificial Sequence
  chemically synthesized
gtataaattcattttatatggg

SEQ ID NO: 108146 - DNA, 22 bp, Artificial Sequence
  chemically synthesized
attttatatgggaggaaaagtg

SEQ ID NO: 108147 - DNA, 22 bp, Artificial Sequence
  chemically synthesized
tatatgggaggaaaagtgatct

SEQ ID NO: 108148 - DNA, 22 bp, Artificial Sequence
  chemically synthesized
atatgggaggaaaagtgatctg

SEQ ID NO: 108149 - DNA, 22 bp, Artificial Sequence
  chemically synthesized
tatgggaggaaaagtgatctgt

SEQ ID NO: 108150 - DNA, 22 bp, Artificial Sequence
  chemically synthesized
taaactcattagaccatacata

SEQ ID NO: 108151 - DNA, 22 bp, Artificial Sequence
  chemically synthesized
attagaccatacatattttttc

SEQ ID NO: 108152 - DNA, 22 bp, Artificial Sequence
  chemically synthesized
gaccatacatattttttcagtg

SEQ ID NO: 108153 - DNA, 22 bp, Artificial Sequence
  chemically synthesized
tttcagtgtgtctctaagattc

SEQ ID NO: 108154 - DNA, 22 bp, Artificial Sequence
  chemically synthesized
ttcagtgtgtctctaagattct

SEQ ID NO: 108155 - DNA, 22 bp, Artificial Sequence
  chemically synthesized
tcagtgtgtctctaagattctt

SEQ ID NO: 108156 - DNA, 22 bp, Artificial Sequence
  chemically synthesized
cagtgtgtctctaagattcttc

SEQ ID NO: 108157 - DNA, 22 bp, Artificial Sequence
  chemically synthesized
agtgtgtctctaagattcttcc

SEQ ID NO: 108158 - DNA, 22 bp, Artificial Sequence
  chemically synthesized
taagattcttccacgtcttctt

SEQ ID NO: 108159 - DNA, 22 bp, Artificial Sequence
  chemically synthesized
agattcttccacgtcttcttaa

SEQ ID NO: 108160 - DNA, 22 bp, Artificial Sequence
  chemically synthesized
ttccacgtcttcttaatcattt

SEQ ID NO: 108161 - DNA, 22 bp, Artificial Sequence
  chemically synthesized
ccacgtcttcttaatcatttct

SEQ ID NO: 108162 - DNA, 22 bp, Artificial Sequence
  chemically synthesized
cacgtcttcttaatcatttcta

SEQ ID NO: 108163 - DNA, 22 bp, Artificial Sequence
  chemically synthesized
cttaatcatttctaagattggc

SEQ ID NO: 108164 - DNA, 22 bp, Artificial Sequence
  chemically synthesized
ttaatcatttctaagattggct

SEQ ID NO: 108165 - DNA, 22 bp, Artificial Sequence
  chemically synthesized
aatcatttctaagattggctta

SEQ ID NO: 108166 - DNA, 22 bp, Artificial Sequence
  chemically synthesized
atcatttctaagattggcttag

SEQ ID NO: 108167 - DNA, 22 bp, Artificial Sequence
  chemically synthesized
ctaagattggcttagtctacag

SEQ ID NO: 108168 - DNA, 22 bp, Artificial Sequence
  chemically synthesized
taagattggcttagtctacaga

SEQ ID NO: 108169 - DNA, 22 bp, Artificial Sequence
  chemically synthesized
agattggcttagtctacagaaa

SEQ ID NO: 108170 - DNA, 22 bp, Artificial Sequence
  chemically synthesized
gcttagtctacagaaatgcaca

SEQ ID NO: 108171 - DNA, 22 bp, Artificial Sequence
  chemically synthesized
agtctacagaaatgcacactta

SEQ ID NO: 108172 - DNA, 22 bp, Artificial Sequence
  chemically synthesized
gtctacagaaatgcacacttag

SEQ ID NO: 108173 - DNA, 22 bp, Artificial Sequence
  chemically synthesized
cagaaatgcacacttagccttt

SEQ ID NO: 108174 - DNA, 22 bp, Artificial Sequence
  chemically synthesized
agcctttcatttcctgactcaa

SEQ ID NO: 108175 - DNA, 22 bp, Artificial Sequence
  chemically synthesized
gcctttcatttcctgactcaaa

SEQ ID NO: 108176 - DNA, 22 bp, Artificial Sequence
  chemically synthesized
tcatttcctgactcaaattaaa

SEQ ID NO: 108177 - DNA, 22 bp, Artificial Sequence
  chemically synthesized
catttcctgactcaaattaaat

SEQ ID NO: 108178 - DNA, 22 bp, Artificial Sequence
  chemically synthesized
atttcctgactcaaattaaata

SEQ ID NO: 108179 - DNA, 22 bp, Artificial Sequence
  chemically synthesized
cctgactcaaattaaatattct

SEQ ID NO: 108180 - DNA, 22 bp, Artificial Sequence
  chemically synthesized
ctgactcaaattaaatattctt

SEQ ID NO: 108181 - DNA, 22 bp, Artificial Sequence
  chemically synthesized
actcaaattaaatattcttatg

SEQ ID NO: 108182 - DNA, 22 bp, Artificial Sequence
  chemically synthesized
aaattaaatattcttatggtat

SEQ ID NO: 108183 - DNA, 22 bp, Artificial Sequence
  chemically synthesized
aatattcttatggtatgttatc

SEQ ID NO: 108184 - DNA, 22 bp, Artificial Sequence
  chemically synthesized
ttatggtatgttatcccttcaa

SEQ ID NO: 108185 - DNA, 22 bp, Artificial Sequence
  chemically synthesized
atggtatgttatcccttcaagc

SEQ ID NO: 108186 - DNA, 22 bp, Artificial Sequence
  chemically synthesized
tggtatgttatcccttcaagcc

SEQ ID NO: 108187 - DNA, 22 bp, Artificial Sequence
  chemically synthesized
tcccttcaagcccatactacac

SEQ ID NO: 108188 - DNA, 22 bp, Artificial Sequence
  chemically synthesized
caagcccatactacacaagtat

SEQ ID NO: 108189 - DNA, 22 bp, Artificial Sequence
  chemically synthesized
aagcccatactacacaagtata

SEQ ID NO: 108190 - DNA, 22 bp, Artificial Sequence
  chemically synthesized
cacaagtatattattatttgaa

SEQ ID NO: 108191 - DNA, 22 bp, Artificial Sequence
  chemically synthesized
ttatttgaaaaagaaaggatgg

SEQ ID NO: 108192 - DNA, 22 bp, Artificial Sequence
  chemically synthesized
tttgaaaaagaaaggatggtat

SEQ ID NO: 108193 - DNA, 22 bp, Artificial Sequence
  chemically synthesized
gaaaaagaaaggatggtatttg

SEQ ID NO: 108194 - DNA, 22 bp, Artificial Sequence
  chemically synthesized
aaaaagaaaggatggtatttgg

SEQ ID NO: 108195 - DNA, 22 bp, Artificial Sequence
  chemically synthesized
ggcaagggctttttttaatgta

SEQ ID NO: 108196 - DNA, 22 bp, Artificial Sequence
  chemically synthesized
gcaagggctttttttaatgtat

SEQ ID NO: 108197 - DNA, 22 bp, Artificial Sequence
  chemically synthesized
tttttaatgtatattcttttac

SEQ ID NO: 108198 - DNA, 22 bp, Artificial Sequence
  chemically synthesized
ttttaatgtatattcttttaca

SEQ ID NO: 108199 - DNA, 22 bp, Artificial Sequence
  chemically synthesized
tttaatgtatattcttttacac

SEQ ID NO: 108200 - DNA, 22 bp, Artificial Sequence
  chemically synthesized
ttaatgtatattcttttacacc

SEQ ID NO: 108201 - DNA, 22 bp, Artificial Sequence
  chemically synthesized
taatgtatattcttttacacct

SEQ ID NO: 108202 - DNA, 22 bp, Artificial Sequence
  chemically synthesized
aatgtatattcttttacacctt

SEQ ID NO: 108203 - DNA, 22 bp, Artificial Sequence
  chemically synthesized
atgtatattcttttacacctta

SEQ ID NO: 108204 - DNA, 22 bp, Artificial Sequence
  chemically synthesized
ttttacaccttagatttcccat

SEQ ID NO: 108205 - DNA, 22 bp, Artificial Sequence
  chemically synthesized
ttacaccttagatttcccataa

SEQ ID NO: 108206 - DNA, 22 bp, Artificial Sequence
  chemically synthesized
tacaccttagatttcccataac

SEQ ID NO: 108207 - DNA, 22 bp, Artificial Sequence
  chemically synthesized
acaccttagatttcccataact

SEQ ID NO: 108208 - DNA, 22 bp, Artificial Sequence
  chemically synthesized
caccttagatttcccataacta

SEQ ID NO: 108209 - DNA, 22 bp, Artificial Sequence
  chemically synthesized
agatttcccataactacatggt

SEQ ID NO: 108210 - DNA, 22 bp, Artificial Sequence
  chemically synthesized
gatttcccataactacatggta

SEQ ID NO: 108211 - DNA, 22 bp, Artificial Sequence
  chemically synthesized
cccataactacatggtacttat

SEQ ID NO: 108212 - DNA, 22 bp, Artificial Sequence
  chemically synthesized
ccataactacatggtacttatt

SEQ ID NO: 108213 - DNA, 22 bp, Artificial Sequence
  chemically synthesized
catggtacttatttatcttaat

SEQ ID NO: 108214 - DNA, 22 bp, Artificial Sequence
  chemically synthesized
atttatcttaataggcaccatg

SEQ ID NO: 108215 - DNA, 22 bp, Artificial Sequence
  chemically synthesized
tttatcttaataggcaccatga

SEQ ID NO: 108216 - DNA, 22 bp, Artificial Sequence
  chemically synthesized
atcttaataggcaccatgaaat

SEQ ID NO: 108217 - DNA, 22 bp, Artificial Sequence
  chemically synthesized
tcttaataggcaccatgaaatt

SEQ ID NO: 108218 - DNA, 22 bp, Artificial Sequence
  chemically synthesized
aataggcaccatgaaatttatt

SEQ ID NO: 108219 - DNA, 22 bp, Artificial Sequence
  chemically synthesized
ataggcaccatgaaatttattc

SEQ ID NO: 108220 - DNA, 22 bp, Artificial Sequence
  chemically synthesized
attcctcatgaggtccttctct

SEQ ID NO: 108221 - DNA, 22 bp, Artificial Sequence
  chemically synthesized
ttcctcatgaggtccttctcta

SEQ ID NO: 108222 - DNA, 22 bp, Artificial Sequence
  chemically synthesized
ctcatgaggtccttctctatat

SEQ ID NO: 108223 - DNA, 22 bp, Artificial Sequence
  chemically synthesized
atgaggtccttctctatataag

SEQ ID NO: 108224 - DNA, 22 bp, Artificial Sequence
  chemically synthesized
ctctatataagttatattcttc

SEQ ID NO: 108225 - DNA, 22 bp, Artificial Sequence
  chemically synthesized
tctatataagttatattcttct

SEQ ID NO: 108226 - DNA, 22 bp, Artificial Sequence
  chemically synthesized
tatataagttatattcttcttt

SEQ ID NO: 108227 - DNA, 22 bp, Artificial Sequence
  chemically synthesized
tataagttatattcttctttca

SEQ ID NO: 108228 - DNA, 22 bp, Artificial Sequence
  chemically synthesized
tattcttctttcagtcttgaat

SEQ ID NO: 108229 - DNA, 22 bp, Artificial Sequence
  chemically synthesized
ttctttcagtcttgaatgatga

SEQ ID NO: 108230 - DNA, 22 bp, Artificial Sequence
  chemically synthesized
ctttcagtcttgaatgatgaaa

SEQ ID NO: 108231 - DNA, 22 bp, Artificial Sequence
  chemically synthesized
tttcagtcttgaatgatgaaaa

SEQ ID NO: 108232 - DNA, 22 bp, Artificial Sequence
  chemically synthesized
tcagtcttgaatgatgaaaagc

SEQ ID NO: 108233 - DNA, 22 bp, Artificial Sequence
  chemically synthesized
cagtcttgaatgatgaaaagct

SEQ ID NO: 108234 - DNA, 22 bp, Artificial Sequence
  chemically synthesized
agtcttgaatgatgaaaagctg

SEQ ID NO: 108235 - DNA, 22 bp, Artificial Sequence
  chemically synthesized
gaatgatgaaaagctgaattac

SEQ ID NO: 108236 - DNA, 22 bp, Artificial Sequence
  chemically synthesized
aatgatgaaaagctgaattaca

SEQ ID NO: 108237 - DNA, 22 bp, Artificial Sequence
  chemically synthesized
aattacaggcttcacctgctgt

SEQ ID NO: 108238 - DNA, 22 bp, Artificial Sequence
  chemically synthesized
caggcttcacctgctgtaagaa

SEQ ID NO: 108239 - DNA, 22 bp, Artificial Sequence
  chemically synthesized
cacctgctgtaagaaggtggtt

SEQ ID NO: 108240 - DNA, 22 bp, Artificial Sequence
  chemically synthesized
acctgctgtaagaaggtggttc

SEQ ID NO: 108241 - DNA, 22 bp, Artificial Sequence
  chemically synthesized
ctgtaagaaggtggttcaccag

SEQ ID NO: 108242 - DNA, 22 bp, Artificial Sequence
  chemically synthesized
taagaaggtggttcaccagttt

SEQ ID NO: 108243 - DNA, 22 bp, Artificial Sequence
  chemically synthesized
accagtttgttagtccactgga

SEQ ID NO: 108244 - DNA, 22 bp, Artificial Sequence
  chemically synthesized
gttagtccactggaccactctg

SEQ ID NO: 108245 - DNA, 22 bp, Artificial Sequence
  chemically synthesized
ttagtccactggaccactctga

SEQ ID NO: 108246 - DNA, 22 bp, Artificial Sequence
  chemically synthesized
gtccactggaccactctgaatt

SEQ ID NO: 108247 - DNA, 22 bp, Artificial Sequence
  chemically synthesized
gaccactctgaattctactctt

SEQ ID NO: 108248 - DNA, 22 bp, Artificial Sequence
  chemically synthesized
tgaattctactcttcttatgaa

SEQ ID NO: 108249 - DNA, 22 bp, Artificial Sequence
  chemically synthesized
aattctactcttcttatgaata

SEQ ID NO: 108250 - DNA, 22 bp, Artificial Sequence
  chemically synthesized
tactcttcttatgaatacaaat

SEQ ID NO: 108251 - DNA, 22 bp, Artificial Sequence
  chemically synthesized
ctcttcttatgaatacaaattc

SEQ ID NO: 108252 - DNA, 22 bp, Artificial Sequence
  chemically synthesized
ttcttatgaatacaaattcatg

SEQ ID NO: 108253 - DNA, 22 bp, Artificial Sequence
  chemically synthesized
cttatgaatacaaattcatgtg

SEQ ID NO: 108254 - DNA, 22 bp, Artificial Sequence
  chemically synthesized
ttatgaatacaaattcatgtgc

SEQ ID NO: 108255 - DNA, 22 bp, Artificial Sequence
  chemically synthesized
atgaatacaaattcatgtgcag

SEQ ID NO: 108256 - DNA, 22 bp, Artificial Sequence
  chemically synthesized
tgaatacaaattcatgtgcagt

SEQ ID NO: 108257 - DNA, 22 bp, Artificial Sequence
  chemically synthesized
atgtgcagtgtttcctaggaga

SEQ ID NO: 108258 - DNA, 22 bp, Artificial Sequence
  chemically synthesized
cctaggagatagtgttataaat

SEQ ID NO: 108259 - DNA, 22 bp, Artificial Sequence
  chemically synthesized
ctaggagatagtgttataaata

SEQ ID NO: 108260 - DNA, 22 bp, Artificial Sequence
  chemically synthesized
ggagatagtgttataaataggc

SEQ ID NO: 108261 - DNA, 22 bp, Artificial Sequence
  chemically synthesized
taaataggcttcttttcctaac

SEQ ID NO: 108262 - DNA, 22 bp, Artificial Sequence
  chemically synthesized
cttttcctaactaacttttatt

SEQ ID NO: 108263 - DNA, 22 bp, Artificial Sequence
  chemically synthesized
ttttcctaactaacttttattt

SEQ ID NO: 108264 - DNA, 22 bp, Artificial Sequence
  chemically synthesized
ttcctaactaacttttatttta

SEQ ID NO: 108265 - DNA, 22 bp, Artificial Sequence
  chemically synthesized
tcctaactaacttttattttag

SEQ ID NO: 108266 - DNA, 22 bp, Artificial Sequence
  chemically synthesized
cctaactaacttttattttagg

SEQ ID NO: 108267 - DNA, 22 bp, Artificial Sequence
  chemically synthesized
ctaactaacttttattttaggt

SEQ ID NO: 108268 - DNA, 22 bp, Artificial Sequence
  chemically synthesized
actaacttttattttaggttca

SEQ ID NO: 108269 - DNA, 22 bp, Artificial Sequence
  chemically synthesized
acttttattttaggttcaggag

SEQ ID NO: 108270 - DNA, 22 bp, Artificial Sequence
  chemically synthesized
ttattttaggttcaggagtaca

SEQ ID NO: 108271 - DNA, 22 bp, Artificial Sequence
  chemically synthesized
tattttaggttcaggagtacaa

SEQ ID NO: 108272 - DNA, 22 bp, Artificial Sequence
  chemically synthesized
attttaggttcaggagtacaag

SEQ ID NO: 108273 - DNA, 22 bp, Artificial Sequence
  chemically synthesized
ttttaggttcaggagtacaaga

SEQ ID NO: 108274 - DNA, 22 bp, Artificial Sequence
  chemically synthesized
taggttcaggagtacaagagca

SEQ ID NO: 108275 - DNA, 22 bp, Artificial Sequence
  chemically synthesized
aggttcaggagtacaagagcag

SEQ ID NO: 108276 - DNA, 22 bp, Artificial Sequence
  chemically synthesized
ggttcaggagtacaagagcagg

SEQ ID NO: 108277 - DNA, 22 bp, Artificial Sequence
  chemically synthesized
aggagtacaagagcaggtctgt

SEQ ID NO: 108278 - DNA, 22 bp, Artificial Sequence
  chemically synthesized
ttacatatttaaacttgtgtca

SEQ ID NO: 108279 - DNA, 22 bp, Artificial Sequence
  chemically synthesized
catatttaaacttgtgtcacga

SEQ ID NO: 108280 - DNA, 22 bp, Artificial Sequence
  chemically synthesized
aaacttgtgtcacgagggtttg

SEQ ID NO: 108281 - DNA, 22 bp, Artificial Sequence
  chemically synthesized
aacttgtgtcacgagggtttgt

SEQ ID NO: 108282 - DNA, 22 bp, Artificial Sequence
  chemically synthesized
gtgtcacgagggtttgttgtac

SEQ ID NO: 108283 - DNA, 22 bp, Artificial Sequence
  chemically synthesized
tgtcacgagggtttgttgtaca

SEQ ID NO: 108284 - DNA, 22 bp, Artificial Sequence
  chemically synthesized
gttgtacagattatgtcatcac

SEQ ID NO: 108285 - DNA, 22 bp, Artificial Sequence
  chemically synthesized
ttgtacagattatgtcatcact

SEQ ID NO: 108286 - DNA, 22 bp, Artificial Sequence
  chemically synthesized
tacagattatgtcatcactcac

SEQ ID NO: 108287 - DNA, 22 bp, Artificial Sequence
  chemically synthesized
tgtcatcactcactcaggtatt

SEQ ID NO: 108288 - DNA, 22 bp, Artificial Sequence
  chemically synthesized
actcaggtattaagcctagtac

SEQ ID NO: 108289 - DNA, 22 bp, Artificial Sequence
  chemically synthesized
aggtattaagcctagtaccctt

SEQ ID NO: 108290 - DNA, 22 bp, Artificial Sequence
  chemically synthesized
agcctagtacccttttgttact

SEQ ID NO: 108291 - DNA, 22 bp, Artificial Sequence
  chemically synthesized
gtacccttttgttacttttcct

SEQ ID NO: 108292 - DNA, 22 bp, Artificial Sequence
  chemically synthesized
ttgttacttttcctgatcctct

SEQ ID NO: 108293 - DNA, 22 bp, Artificial Sequence
  chemically synthesized
tgttacttttcctgatcctctc

SEQ ID NO: 108294 - DNA, 22 bp, Artificial Sequence
  chemically synthesized
gttacttttcctgatcctctcc

SEQ ID NO: 108295 - DNA, 22 bp, Artificial Sequence
  chemically synthesized
ttacttttcctgatcctctccc

SEQ ID NO: 108296 - DNA, 22 bp, Artificial Sequence
  chemically synthesized
cttttcctgatcctctccctcc

SEQ ID NO: 108297 - DNA, 22 bp, Artificial Sequence
  chemically synthesized
ttcctgatcctctccctccttt

SEQ ID NO: 108298 - DNA, 22 bp, Artificial Sequence
  chemically synthesized
tcctgatcctctccctcctttc

SEQ ID NO: 108299 - DNA, 22 bp, Artificial Sequence
  chemically synthesized
cctgatcctctccctcctttca

SEQ ID NO: 108300 - DNA, 22 bp, Artificial Sequence
  chemically synthesized
ctgatcctctccctcctttcac

SEQ ID NO: 108301 - DNA, 22 bp, Artificial Sequence
  chemically synthesized
atcctctccctcctttcaccct

SEQ ID NO: 108302 - DNA, 22 bp, Artificial Sequence
  chemically synthesized
tccctcctttcaccctccatcc

SEQ ID NO: 108303 - DNA, 22 bp, Artificial Sequence
  chemically synthesized
cctcctttcaccctccatcctc

SEQ ID NO: 108304 - DNA, 22 bp, Artificial Sequence
  chemically synthesized
ctttcaccctccatcctccaat

SEQ ID NO: 108305 - DNA, 22 bp, Artificial Sequence
  chemically synthesized
tcaccctccatcctccaatagg

SEQ ID NO: 108306 - DNA, 22 bp, Artificial Sequence
  chemically synthesized
caccctccatcctccaataggc

SEQ ID NO: 108307 - DNA, 22 bp, Artificial Sequence
  chemically synthesized
accctccatcctccaataggcc

SEQ ID NO: 108308 - DNA, 22 bp, Artificial Sequence
  chemically synthesized
catcctccaataggccccagtg

SEQ ID NO: 108309 - DNA, 22 bp, Artificial Sequence
  chemically synthesized
caataggccccagtgtgtgatg

SEQ ID NO: 108310 - DNA, 22 bp, Artificial Sequence
  chemically synthesized
ccctccatgtgtccatgtgttc

SEQ ID NO: 108311 - DNA, 22 bp, Artificial Sequence
  chemically synthesized
catgtgtccatgtgttctcatc

SEQ ID NO: 108312 - DNA, 22 bp, Artificial Sequence
  chemically synthesized
tcatcatttagctcccactcat

SEQ ID NO: 108313 - DNA, 22 bp, Artificial Sequence
  chemically synthesized
atcatttagctcccactcataa

SEQ ID NO: 108314 - DNA, 22 bp, Artificial Sequence
  chemically synthesized
agctcccactcataagtgagaa

SEQ ID NO: 108315 - DNA, 22 bp, Artificial Sequence
  chemically synthesized
gctcccactcataagtgagaac

SEQ ID NO: 108316 - DNA, 22 bp, Artificial Sequence
  chemically synthesized
ccactcataagtgagaacacgt

SEQ ID NO: 108317 - DNA, 22 bp, Artificial Sequence
  chemically synthesized
ataagtgagaacacgtggtatt

SEQ ID NO: 108318 - DNA, 22 bp, Artificial Sequence
  chemically synthesized
ggttttctgttcctgtattaat

SEQ ID NO: 108319 - DNA, 22 bp, Artificial Sequence
  chemically synthesized
gttttctgttcctgtattaatt

SEQ ID NO: 108320 - DNA, 22 bp, Artificial Sequence
  chemically synthesized
tctgttcctgtattaatttgct

SEQ ID NO: 108321 - DNA, 22 bp, Artificial Sequence
  chemically synthesized
ctgttcctgtattaatttgcta

SEQ ID NO: 108322 - DNA, 22 bp, Artificial Sequence
  chemically synthesized
tgttcctgtattaatttgctaa

SEQ ID NO: 108323 - DNA, 22 bp, Artificial Sequence
  chemically synthesized
ttcctgtattaatttgctaagg

SEQ ID NO: 108324 - DNA, 22 bp, Artificial Sequence
  chemically synthesized
ctgtattaatttgctaaggctt

SEQ ID NO: 108325 - DNA, 22 bp, Artificial Sequence
  chemically synthesized
tattaatttgctaaggcttcta

SEQ ID NO: 108326 - DNA, 22 bp, Artificial Sequence
  chemically synthesized
atttgctaaggcttctaatagt

SEQ ID NO: 108327 - DNA, 22 bp, Artificial Sequence
  chemically synthesized
gctaaggcttctaatagtacat

SEQ ID NO: 108328 - DNA, 22 bp, Artificial Sequence
  chemically synthesized
ctaaggcttctaatagtacata

SEQ ID NO: 108329 - DNA, 22 bp, Artificial Sequence
  chemically synthesized
aggcttctaatagtacatagca

SEQ ID NO: 108330 - DNA, 22 bp, Artificial Sequence
  chemically synthesized
ctaatagtacatagcattttac

SEQ ID NO: 108331 - DNA, 22 bp, Artificial Sequence
  chemically synthesized
taatagtacatagcattttacc

SEQ ID NO: 108332 - DNA, 22 bp, Artificial Sequence
  chemically synthesized
atagtacatagcattttaccac

SEQ ID NO: 108333 - DNA, 22 bp, Artificial Sequence
  chemically synthesized
taccacaggaagacttgtagga

SEQ ID NO: 108334 - DNA, 22 bp, Artificial Sequence
  chemically synthesized
accacaggaagacttgtaggag

SEQ ID NO: 108335 - DNA, 22 bp, Artificial Sequence
  chemically synthesized
ccacaggaagacttgtaggaga

SEQ ID NO: 108336 - DNA, 22 bp, Artificial Sequence
  chemically synthesized
gtaggagatcacagaaagttct

SEQ ID NO: 108337 - DNA, 22 bp, Artificial Sequence
  chemically synthesized
taggagatcacagaaagttcta

SEQ ID NO: 108338 - DNA, 22 bp, Artificial Sequence
  chemically synthesized
taaattttatgataatactaac

SEQ ID NO: 108339 - DNA, 22 bp, Artificial Sequence
  chemically synthesized
aattttatgataatactaacat

SEQ ID NO: 108340 - DNA, 22 bp, Artificial Sequence
  chemically synthesized
tatgataatactaacatactgt

SEQ ID NO: 108341 - DNA, 22 bp, Artificial Sequence
  chemically synthesized
atgataatactaacatactgtg

SEQ ID NO: 108342 - DNA, 22 bp, Artificial Sequence
  chemically synthesized
tgataatactaacatactgtgt

SEQ ID NO: 108343 - DNA, 22 bp, Artificial Sequence
  chemically synthesized
acatactgtgtttatgttgatt

SEQ ID NO: 108344 - DNA, 22 bp, Artificial Sequence
  chemically synthesized
tgtttatgttgattgttacaat

SEQ ID NO: 108345 - DNA, 22 bp, Artificial Sequence
  chemically synthesized
atgttgattgttacaatgggtt

SEQ ID NO: 108346 - DNA, 22 bp, Artificial Sequence
  chemically synthesized
tgttgattgttacaatgggttt

SEQ ID NO: 108347 - DNA, 22 bp, Artificial Sequence
  chemically synthesized
attgttacaatgggttttgaat

SEQ ID NO: 108348 - DNA, 22 bp, Artificial Sequence
  chemically synthesized
ttacaatgggttttgaatagaa

SEQ ID NO: 108349 - DNA, 22 bp, Artificial Sequence
  chemically synthesized
caatgggttttgaatagaaaaa

SEQ ID NO: 108350 - DNA, 22 bp, Artificial Sequence
  chemically synthesized
tgaatagaaaaacatgtctgag

SEQ ID NO: 108351 - DNA, 22 bp, Artificial Sequence
  chemically synthesized
gaatagaaaaacatgtctgagt

SEQ ID NO: 108352 - DNA, 22 bp, Artificial Sequence
  chemically synthesized
aatagaaaaacatgtctgagtg

SEQ ID NO: 108353 - DNA, 22 bp, Artificial Sequence
  chemically synthesized
agtggatttccaccatgtagcc

SEQ ID NO: 108354 - DNA, 22 bp, Artificial Sequence
  chemically synthesized
ccaccatgtagccttctgtata

SEQ ID NO: 108355 - DNA, 22 bp, Artificial Sequence
  chemically synthesized
caccatgtagccttctgtataa

SEQ ID NO: 108356 - DNA, 22 bp, Artificial Sequence
  chemically synthesized
ctgtataactaagtttgagata

SEQ ID NO: 108357 - DNA, 22 bp, Artificial Sequence
  chemically synthesized
tgtataactaagtttgagataa

SEQ ID NO: 108358 - DNA, 22 bp, Artificial Sequence
  chemically synthesized
tataactaagtttgagataatt

SEQ ID NO: 108359 - DNA, 22 bp, Artificial Sequence
  chemically synthesized
agtttgagataattatttagtc

SEQ ID NO: 108360 - DNA, 22 bp, Artificial Sequence
  chemically synthesized
gagataattatttagtcttccc

SEQ ID NO: 108361 - DNA, 22 bp, Artificial Sequence
  chemically synthesized
agataattatttagtcttcccc

SEQ ID NO: 108362 - DNA, 22 bp, Artificial Sequence
  chemically synthesized
tttagtcttccccccacctccg

SEQ ID NO: 108363 - DNA, 22 bp, Artificial Sequence
  chemically synthesized
agtcttccccccacctccgatg

SEQ ID NO: 108364 - DNA, 22 bp, Artificial Sequence
  chemically synthesized
gtcttccccccacctccgatgt

SEQ ID NO: 108365 - DNA, 22 bp, Artificial Sequence
  chemically synthesized
ccccccacctccgatgtcctgt

SEQ ID NO: 108366 - DNA, 22 bp, Artificial Sequence
  chemically synthesized
cccccacctccgatgtcctgtg

SEQ ID NO: 108367 - DNA, 22 bp, Artificial Sequence
  chemically synthesized
cgatgtcctgtgtctgtattca

SEQ ID NO: 108368 - DNA, 22 bp, Artificial Sequence
  chemically synthesized
tgtctgtattcatcctacagca

SEQ ID NO: 108369 - DNA, 22 bp, Artificial Sequence
  chemically synthesized
tattcatcctacagcatcttct

SEQ ID NO: 108370 - DNA, 22 bp, Artificial Sequence
  chemically synthesized
atcctacagcatcttctcagtg

SEQ ID NO: 108371 - DNA, 22 bp, Artificial Sequence
  chemically synthesized
cagcatcttctcagtgaattta

SEQ ID NO: 108372 - DNA, 22 bp, Artificial Sequence
  chemically synthesized
ctcagtgaatttagtttcacac

SEQ ID NO: 108373 - DNA, 22 bp, Artificial Sequence
  chemically synthesized
tcagtgaatttagtttcacact

SEQ ID NO: 108374 - DNA, 22 bp, Artificial Sequence
  chemically synthesized
agtgaatttagtttcacactta

SEQ ID NO: 108375 - DNA, 22 bp, Artificial Sequence
  chemically synthesized
agtttcacacttactttcaagt

SEQ ID NO: 108376 - DNA, 22 bp, Artificial Sequence
  chemically synthesized
gtttcacacttactttcaagtc

SEQ ID NO: 108377 - DNA, 22 bp, Artificial Sequence
  chemically synthesized
cacacttactttcaagtcagaa

SEQ ID NO: 108378 - DNA, 22 bp, Artificial Sequence
  chemically synthesized
acacttactttcaagtcagaaa

SEQ ID NO: 108379 - DNA, 22 bp, Artificial Sequence
  chemically synthesized
actttcaagtcagaaatgaact

SEQ ID NO: 108380 - DNA, 22 bp, Artificial Sequence
  chemically synthesized
ctttcaagtcagaaatgaactt

SEQ ID NO: 108381 - DNA, 22 bp, Artificial Sequence
  chemically synthesized
tcaagtcagaaatgaacttctt

SEQ ID NO: 108382 - DNA, 22 bp, Artificial Sequence
  chemically synthesized
caagtcagaaatgaacttctta

SEQ ID NO: 108383 - DNA, 22 bp, Artificial Sequence
  chemically synthesized
aagtcagaaatgaacttcttaa

SEQ ID NO: 108384 - DNA, 22 bp, Artificial Sequence
  chemically synthesized
cttaaacaagggaaataacttc

SEQ ID NO: 108385 - DNA, 22 bp, Artificial Sequence
  chemically synthesized
ttaaacaagggaaataacttca

SEQ ID NO: 108386 - DNA, 22 bp, Artificial Sequence
  chemically synthesized
aaacaagggaaataacttcata

SEQ ID NO: 108387 - DNA, 22 bp, Artificial Sequence
  chemically synthesized
aacaagggaaataacttcataa

SEQ ID NO: 108388 - DNA, 22 bp, Artificial Sequence
  chemically synthesized
cataaatcattcaccaaatggt

SEQ ID NO: 108389 - DNA, 22 bp, Artificial Sequence
  chemically synthesized
ataaatcattcaccaaatggtc

SEQ ID NO: 108390 - DNA, 22 bp, Artificial Sequence
  chemically synthesized
accaaatggtcaactttcctgc

SEQ ID NO: 108391 - DNA, 22 bp, Artificial Sequence
  chemically synthesized
tcctgccatttttaggttccat

SEQ ID NO: 108392 - DNA, 22 bp, Artificial Sequence
  chemically synthesized
cctgccatttttaggttccatt

SEQ ID NO: 108393 - DNA, 22 bp, Artificial Sequence
  chemically synthesized
ctgccatttttaggttccattt

SEQ ID NO: 108394 - DNA, 22 bp, Artificial Sequence
  chemically synthesized
ccatttttaggttccatttcct

SEQ ID NO: 108395 - DNA, 22 bp, Artificial Sequence
  chemically synthesized
ttaggttccatttcctgtattt

SEQ ID NO: 108396 - DNA, 22 bp, Artificial Sequence
  chemically synthesized
taggttccatttcctgtatttt

SEQ ID NO: 108397 - DNA, 22 bp, Artificial Sequence
  chemically synthesized
aggttccatttcctgtatttta

SEQ ID NO: 108398 - DNA, 22 bp, Artificial Sequence
  chemically synthesized
ggttccatttcctgtattttag

SEQ ID NO: 108399 - DNA, 22 bp, Artificial Sequence
  chemically synthesized
catttcctgtattttagaaaaa

SEQ ID NO: 108400 - DNA, 22 bp, Artificial Sequence
  chemically synthesized
cctgtattttagaaaaagaggc

SEQ ID NO: 108401 - DNA, 22 bp, Artificial Sequence
  chemically synthesized
ctgtattttagaaaaagaggca

SEQ ID NO: 108402 - DNA, 22 bp, Artificial Sequence
  chemically synthesized
tattttagaaaaagaggcagct

SEQ ID NO: 108403 - DNA, 22 bp, Artificial Sequence
  chemically synthesized
tagaaaaagaggcagctcttct

SEQ ID NO: 108404 - DNA, 22 bp, Artificial Sequence
  chemically synthesized
agaaaaagaggcagctcttcta

SEQ ID NO: 108405 - DNA, 22 bp, Artificial Sequence
  chemically synthesized
gaaaaagaggcagctcttctac

SEQ ID NO: 108406 - DNA, 22 bp, Artificial Sequence
  chemically synthesized
ttctacctaacagtattttcca

SEQ ID NO: 108407 - DNA, 22 bp, Artificial Sequence
  chemically synthesized
ctacctaacagtattttccagt

SEQ ID NO: 108408 - DNA, 22 bp, Artificial Sequence
  chemically synthesized
tacctaacagtattttccagtt

SEQ ID NO: 108409 - DNA, 22 bp, Artificial Sequence
  chemically synthesized
cctaacagtattttccagtttt

SEQ ID NO: 108410 - DNA, 22 bp, Artificial Sequence
  chemically synthesized
acagtattttccagttttaaat

SEQ ID NO: 108411 - DNA, 22 bp, Artificial Sequence
  chemically synthesized
tccagttttaaatattagttag

SEQ ID NO: 108412 - DNA, 22 bp, Artificial Sequence
  chemically synthesized
ccagttttaaatattagttaga

SEQ ID NO: 108413 - DNA, 22 bp, Artificial Sequence
  chemically synthesized
cagttttaaatattagttagag

SEQ ID NO: 108414 - DNA, 22 bp, Artificial Sequence
  chemically synthesized
taaatattagttagagaagatt

SEQ ID NO: 108415 - DNA, 22 bp, Artificial Sequence
  chemically synthesized
aaatattagttagagaagattc

SEQ ID NO: 108416 - DNA, 22 bp, Artificial Sequence
  chemically synthesized
aatattagttagagaagattca

SEQ ID NO: 108417 - DNA, 22 bp, Artificial Sequence
  chemically synthesized
gttagagaagattcacatatct

SEQ ID NO: 108418 - DNA, 22 bp, Artificial Sequence
  chemically synthesized
gagaagattcacatatctataa

SEQ ID NO: 108419 - DNA, 22 bp, Artificial Sequence
  chemically synthesized
acatatctataactgagatgat

SEQ ID NO: 108420 - DNA, 22 bp, Artificial Sequence
  chemically synthesized
taactgagatgatataattatt

SEQ ID NO: 108421 - DNA, 22 bp, Artificial Sequence
  chemically synthesized
agatgatataattattaatagc

SEQ ID NO: 108422 - DNA, 22 bp, Artificial Sequence
  chemically synthesized
ttaatagcctttggttataagt

SEQ ID NO: 108423 - DNA, 22 bp, Artificial Sequence
  chemically synthesized
atagcctttggttataagtgaa

SEQ ID NO: 108424 - DNA, 22 bp, Artificial Sequence
  chemically synthesized
tggttataagtgaaactcaact

SEQ ID NO: 108425 - DNA, 22 bp, Artificial Sequence
  chemically synthesized
ggttataagtgaaactcaactg

SEQ ID NO: 108426 - DNA, 22 bp, Artificial Sequence
  chemically synthesized
gttataagtgaaactcaactga

SEQ ID NO: 108427 - DNA, 22 bp, Artificial Sequence
  chemically synthesized
taagtgaaactcaactgaaact

SEQ ID NO: 108428 - DNA, 22 bp, Artificial Sequence
  chemically synthesized
aactgaaactaggctgaacaaa

SEQ ID NO: 108429 - DNA, 22 bp, Artificial Sequence
  chemically synthesized
aaactaggctgaacaaaacaaa

SEQ ID NO: 108430 - DNA, 22 bp, Artificial Sequence
  chemically synthesized
ggctgaacaaaacaaattacaa

SEQ ID NO: 108431 - DNA, 22 bp, Artificial Sequence
  chemically synthesized
aacaaaacaaattacaagaaga

SEQ ID NO: 108432 - DNA, 22 bp, Artificial Sequence
  chemically synthesized
caagaagaggagtttattaggc

SEQ ID NO: 108433 - DNA, 22 bp, Artificial Sequence
  chemically synthesized
attaggctgtggaatcaaaaaa

SEQ ID NO: 108434 - DNA, 22 bp, Artificial Sequence
  chemically synthesized
ttaggctgtggaatcaaaaaaa

SEQ ID NO: 108435 - DNA, 22 bp, Artificial Sequence
  chemically synthesized
ggctgtggaatcaaaaaaaaga

SEQ ID NO: 108436 - DNA, 22 bp, Artificial Sequence
  chemically synthesized
tggaatcaaaaaaaagattcaa

SEQ ID NO: 108437 - DNA, 22 bp, Artificial Sequence
  chemically synthesized
aaactgtcctccttgtcactga

SEQ ID NO: 108438 - DNA, 22 bp, Artificial Sequence
  chemically synthesized
tcctccttgtcactgagtctca

SEQ ID NO: 108439 - DNA, 22 bp, Artificial Sequence
  chemically synthesized
cttgtcactgagtctcaggaaa

SEQ ID NO: 108440 - DNA, 22 bp, Artificial Sequence
  chemically synthesized
gtcactgagtctcaggaaaaca

SEQ ID NO: 108441 - DNA, 22 bp, Artificial Sequence
  chemically synthesized
tcactgagtctcaggaaaacat

SEQ ID NO: 108442 - DNA, 22 bp, Artificial Sequence
  chemically synthesized
agtctcaggaaaacatggaatc

SEQ ID NO: 108443 - DNA, 22 bp, Artificial Sequence
  chemically synthesized
aggaaaacatggaatcagagat

SEQ ID NO: 108444 - DNA, 22 bp, Artificial Sequence
  chemically synthesized
gaagattctttttatttattat

SEQ ID NO: 108445 - DNA, 22 bp, Artificial Sequence
  chemically synthesized
aagattctttttatttattatc

SEQ ID NO: 108446 - DNA, 22 bp, Artificial Sequence
  chemically synthesized
tttttatttattatcatttctt

SEQ ID NO: 108447 - DNA, 22 bp, Artificial Sequence
  chemically synthesized
tttatttattatcatttcttta

SEQ ID NO: 108448 - DNA, 22 bp, Artificial Sequence
  chemically synthesized
ttatttattatcatttctttat

SEQ ID NO: 108449 - DNA, 22 bp, Artificial Sequence
  chemically synthesized
tatttattatcatttctttatc

SEQ ID NO: 108450 - DNA, 22 bp, Artificial Sequence
  chemically synthesized
atttattatcatttctttatct

SEQ ID NO: 108451 - DNA, 22 bp, Artificial Sequence
  chemically synthesized
tttattatcatttctttatcta

SEQ ID NO: 108452 - DNA, 22 bp, Artificial Sequence
  chemically synthesized
attatcatttctttatctataa

SEQ ID NO: 108453 - DNA, 22 bp, Artificial Sequence
  chemically synthesized
ttatcatttctttatctataat

SEQ ID NO: 108454 - DNA, 22 bp, Artificial Sequence
  chemically synthesized
tcatttctttatctataattta

SEQ ID NO: 108455 - DNA, 22 bp, Artificial Sequence
  chemically synthesized
ctttatctataatttactctaa

SEQ ID NO: 108456 - DNA, 22 bp, Artificial Sequence
  chemically synthesized
tttatctataatttactctaaa

SEQ ID NO: 108457 - DNA, 22 bp, Artificial Sequence
  chemically synthesized
tatctataatttactctaaata

SEQ ID NO: 108458 - DNA, 22 bp, Artificial Sequence
  chemically synthesized
atctataatttactctaaatat

SEQ ID NO: 108459 - DNA, 22 bp, Artificial Sequence
  chemically synthesized
tctataatttactctaaatatt

SEQ ID NO: 108460 - DNA, 22 bp, Artificial Sequence
  chemically synthesized
taatttactctaaatatttatt

SEQ ID NO: 108461 - DNA, 22 bp, Artificial Sequence
  chemically synthesized
actctaaatatttattatagtt

SEQ ID NO: 108462 - DNA, 22 bp, Artificial Sequence
  chemically synthesized
ctctaaatatttattatagttt

SEQ ID NO: 108463 - DNA, 22 bp, Artificial Sequence
  chemically synthesized
taaatatttattatagtttgaa

SEQ ID NO: 108464 - DNA, 22 bp, Artificial Sequence
  chemically synthesized
aatatttattatagtttgaagt

SEQ ID NO: 108465 - DNA, 22 bp, Artificial Sequence
  chemically synthesized
attatagtttgaagtcacttgc

SEQ ID NO: 108466 - DNA, 22 bp, Artificial Sequence
  chemically synthesized
ttatagtttgaagtcacttgcc

SEQ ID NO: 108467 - DNA, 22 bp, Artificial Sequence
  chemically synthesized
tagtttgaagtcacttgcctga

SEQ ID NO: 108468 - DNA, 22 bp, Artificial Sequence
  chemically synthesized
gaagtcacttgcctgatgaaaa

SEQ ID NO: 108469 - DNA, 22 bp, Artificial Sequence
  chemically synthesized
aagtcacttgcctgatgaaaaa

SEQ ID NO: 108470 - DNA, 22 bp, Artificial Sequence
  chemically synthesized
gcctgatgaaaaacattgtcat

SEQ ID NO: 108471 - DNA, 22 bp, Artificial Sequence
  chemically synthesized
cctgatgaaaaacattgtcatt

SEQ ID NO: 108472 - DNA, 22 bp, Artificial Sequence
  chemically synthesized
atgaaaaacattgtcattaaca

SEQ ID NO: 108473 - DNA, 22 bp, Artificial Sequence
  chemically synthesized
tcattaacaattctaagcattg

SEQ ID NO: 108474 - DNA, 22 bp, Artificial Sequence
  chemically synthesized
acaattctaagcattgcatttt

SEQ ID NO: 108475 - DNA, 22 bp, Artificial Sequence
  chemically synthesized
taagcattgcattttagtaatt

SEQ ID NO: 108476 - DNA, 22 bp, Artificial Sequence
  chemically synthesized
agcattgcattttagtaattct

SEQ ID NO: 108477 - DNA, 22 bp, Artificial Sequence
  chemically synthesized
cattttagtaattctacaacaa

SEQ ID NO: 108478 - DNA, 22 bp, Artificial Sequence
  chemically synthesized
tagtaattctacaacaaaagca

SEQ ID NO: 108479 - DNA, 22 bp, Artificial Sequence
  chemically synthesized
agtaattctacaacaaaagcat

SEQ ID NO: 108480 - DNA, 22 bp, Artificial Sequence
  chemically synthesized
gtaattctacaacaaaagcatt

SEQ ID NO: 108481 - DNA, 22 bp, Artificial Sequence
  chemically synthesized
tacaacaaaagcattactcttt

SEQ ID NO: 108482 - DNA, 22 bp, Artificial Sequence
  chemically synthesized
caacaaaagcattactcttttt

SEQ ID NO: 108483 - DNA, 22 bp, Artificial Sequence
  chemically synthesized
ctctttttttttttgcaatgtc

SEQ ID NO: 108484 - DNA, 22 bp, Artificial Sequence
  chemically synthesized
tttttttttttgcaatgtcata

SEQ ID NO: 108485 - DNA, 22 bp, Artificial Sequence
  chemically synthesized
tttttttttgcaatgtcatatt

SEQ ID NO: 108486 - DNA, 22 bp, Artificial Sequence
  chemically synthesized
ttttttttgcaatgtcatattg

SEQ ID NO: 108487 - DNA, 22 bp, Artificial Sequence
  chemically synthesized
tttttttgcaatgtcatattga

SEQ ID NO: 108488 - DNA, 22 bp, Artificial Sequence
  chemically synthesized
ttttttgcaatgtcatattgaa

SEQ ID NO: 108489 - DNA, 22 bp, Artificial Sequence
  chemically synthesized
tttttgcaatgtcatattgaaa

SEQ ID NO: 108490 - DNA, 22 bp, Artificial Sequence
  chemically synthesized
ttttgcaatgtcatattgaaaa

SEQ ID NO: 108491 - DNA, 22 bp, Artificial Sequence
  chemically synthesized
tttgcaatgtcatattgaaaaa

SEQ ID NO: 108492 - DNA, 22 bp, Artificial Sequence
  chemically synthesized
ttgcaatgtcatattgaaaaat

SEQ ID NO: 108493 - DNA, 22 bp, Artificial Sequence
  chemically synthesized
tgcaatgtcatattgaaaaatt

SEQ ID NO: 108494 - DNA, 22 bp, Artificial Sequence
  chemically synthesized
gcaatgtcatattgaaaaattc

SEQ ID NO: 108495 - DNA, 22 bp, Artificial Sequence
  chemically synthesized
caatgtcatattgaaaaattct

SEQ ID NO: 108496 - DNA, 22 bp, Artificial Sequence
  chemically synthesized
aaaaattctttttaaaaaagtt

SEQ ID NO: 108497 - DNA, 22 bp, Artificial Sequence
  chemically synthesized
tttttaaaaaagttcttctact

SEQ ID NO: 108498 - DNA, 22 bp, Artificial Sequence
  chemically synthesized
tttaaaaaagttcttctactgc

SEQ ID NO: 108499 - DNA, 22 bp, Artificial Sequence
  chemically synthesized
ttaaaaaagttcttctactgcg

SEQ ID NO: 108500 - DNA, 22 bp, Artificial Sequence
  chemically synthesized
taaaaaagttcttctactgcgg

SEQ ID NO: 108501 - DNA, 22 bp, Artificial Sequence
  chemically synthesized
aaaaaagttcttctactgcggt

SEQ ID NO: 108502 - DNA, 22 bp, Artificial Sequence
  chemically synthesized
aaaaagttcttctactgcggtt

SEQ ID NO: 108503 - DNA, 22 bp, Artificial Sequence
  chemically synthesized
ttctactgcggttaggagtttg

SEQ ID NO: 108504 - DNA, 22 bp, Artificial Sequence
  chemically synthesized
ctactgcggttaggagtttgga

SEQ ID NO: 108505 - DNA, 22 bp, Artificial Sequence
  chemically synthesized
tactgcggttaggagtttggag

SEQ ID NO: 108506 - DNA, 22 bp, Artificial Sequence
  chemically synthesized
ctgcggttaggagtttggagat

SEQ ID NO: 108507 - DNA, 22 bp, Artificial Sequence
  chemically synthesized
cggttaggagtttggagataca

SEQ ID NO: 108508 - DNA, 22 bp, Artificial Sequence
  chemically synthesized
ggagtttggagatacaatgcaa

SEQ ID NO: 108509 - DNA, 22 bp, Artificial Sequence
  chemically synthesized
ggagatacaatgcaaaatatca

SEQ ID NO: 108510 - DNA, 22 bp, Artificial Sequence
  chemically synthesized
gagatacaatgcaaaatatcag

SEQ ID NO: 108511 - DNA, 22 bp, Artificial Sequence
  chemically synthesized
tcatagggaacaatatttttgg

SEQ ID NO: 108512 - DNA, 22 bp, Artificial Sequence
  chemically synthesized
catagggaacaatatttttgga

SEQ ID NO: 108513 - DNA, 22 bp, Artificial Sequence
  chemically synthesized
atagggaacaatatttttggag

SEQ ID NO: 108514 - DNA, 22 bp, Artificial Sequence
  chemically synthesized
ttggagtagaaggaggagaaat

SEQ ID NO: 108515 - DNA, 22 bp, Artificial Sequence
  chemically synthesized
tggagtagaaggaggagaaatt

SEQ ID NO: 108516 - DNA, 22 bp, Artificial Sequence
  chemically synthesized
ggagtagaaggaggagaaattt

SEQ ID NO: 108517 - DNA, 22 bp, Artificial Sequence
  chemically synthesized
gagtagaaggaggagaaatttt

SEQ ID NO: 108518 - DNA, 22 bp, Artificial Sequence
  chemically synthesized
tcagaaaaagaaagtaggtact

SEQ ID NO: 108519 - DNA, 22 bp, Artificial Sequence
  chemically synthesized
cagaaaaagaaagtaggtacta

SEQ ID NO: 108520 - DNA, 22 bp, Artificial Sequence
  chemically synthesized
agaaaaagaaagtaggtactac

SEQ ID NO: 108521 - DNA, 22 bp, Artificial Sequence
  chemically synthesized
caagcatgacggaatacaaggc

SEQ ID NO: 108522 - DNA, 22 bp, Artificial Sequence
  chemically synthesized
aggatagtctactgtagtggag

SEQ ID NO: 108523 - DNA, 22 bp, Artificial Sequence
  chemically synthesized
ctgtagtggagtaccattcaca

SEQ ID NO: 108524 - DNA, 22 bp, Artificial Sequence
  chemically synthesized
tagtggagtaccattcacactg

SEQ ID NO: 108525 - DNA, 22 bp, Artificial Sequence
  chemically synthesized
acactggccttatagttagaag

SEQ ID NO: 108526 - DNA, 22 bp, Artificial Sequence
  chemically synthesized
gccttatagttagaagatataa

SEQ ID NO: 108527 - DNA, 22 bp, Artificial Sequence
  chemically synthesized
atagttagaagatataaatttg

SEQ ID NO: 108528 - DNA, 22 bp, Artificial Sequence
  chemically synthesized
tagttagaagatataaatttga

SEQ ID NO: 108529 - DNA, 22 bp, Artificial Sequence
  chemically synthesized
gaagatataaatttgaatcatg

SEQ ID NO: 108530 - DNA, 22 bp, Artificial Sequence
  chemically synthesized
gaatcatgactataccaattaa

SEQ ID NO: 108531 - DNA, 22 bp, Artificial Sequence
  chemically synthesized
aatcatgactataccaattaaa

SEQ ID NO: 108532 - DNA, 22 bp, Artificial Sequence
  chemically synthesized
taccaattaaaaatgttatgcc

SEQ ID NO: 108533 - DNA, 22 bp, Artificial Sequence
  chemically synthesized
aaaatgttatgcccttggaggg

SEQ ID NO: 108534 - DNA, 22 bp, Artificial Sequence
  chemically synthesized
tgcccttggagggaatatttaa

SEQ ID NO: 108535 - DNA, 22 bp, Artificial Sequence
  chemically synthesized
ggagggaatatttaactttttt

SEQ ID NO: 108536 - DNA, 22 bp, Artificial Sequence
  chemically synthesized
gagggaatatttaactttttta

SEQ ID NO: 108537 - DNA, 22 bp, Artificial Sequence
  chemically synthesized
aacttttttatattaaatttcc

SEQ ID NO: 108538 - DNA, 22 bp, Artificial Sequence
  chemically synthesized
acttttttatattaaatttccc

SEQ ID NO: 108539 - DNA, 22 bp, Artificial Sequence
  chemically synthesized
ttttatattaaatttccccatc

SEQ ID NO: 108540 - DNA, 22 bp, Artificial Sequence
  chemically synthesized
tttatattaaatttccccatca

SEQ ID NO: 108541 - DNA, 22 bp, Artificial Sequence
  chemically synthesized
ttatattaaatttccccatcaa

SEQ ID NO: 108542 - DNA, 22 bp, Artificial Sequence
  chemically synthesized
tatattaaatttccccatcaag

SEQ ID NO: 108543 - DNA, 22 bp, Artificial Sequence
  chemically synthesized
atattaaatttccccatcaaga

SEQ ID NO: 108544 - DNA, 22 bp, Artificial Sequence
  chemically synthesized
tattaaatttccccatcaagaa

SEQ ID NO: 108545 - DNA, 22 bp, Artificial Sequence
  chemically synthesized
aatttccccatcaagaaaacag

SEQ ID NO: 108546 - DNA, 22 bp, Artificial Sequence
  chemically synthesized
ccccatcaagaaaacagtgata

SEQ ID NO: 108547 - DNA, 22 bp, Artificial Sequence
  chemically synthesized
cccatcaagaaaacagtgataa

SEQ ID NO: 108548 - DNA, 22 bp, Artificial Sequence
  chemically synthesized
ccccacaatatttttatgaata

SEQ ID NO: 108549 - DNA, 22 bp, Artificial Sequence
  chemically synthesized
ttatgaataaaataagttgtgg

SEQ ID NO: 108550 - DNA, 22 bp, Artificial Sequence
  chemically synthesized
tatgaataaaataagttgtgga

SEQ ID NO: 108551 - DNA, 22 bp, Artificial Sequence
  chemically synthesized
atgaataaaataagttgtggat

SEQ ID NO: 108552 - DNA, 22 bp, Artificial Sequence
  chemically synthesized
tgaataaaataagttgtggatg

SEQ ID NO: 108553 - DNA, 22 bp, Artificial Sequence
  chemically synthesized
tggatgtagtagagcataatta

SEQ ID NO: 108554 - DNA, 22 bp, Artificial Sequence
  chemically synthesized
agggacacatgtttggttttat

SEQ ID NO: 108555 - DNA, 22 bp, Artificial Sequence
  chemically synthesized
ggttttatgaatgattgaaaac

SEQ ID NO: 108556 - DNA, 22 bp, Artificial Sequence
  chemically synthesized
gttttatgaatgattgaaaaca

SEQ ID NO: 108557 - DNA, 22 bp, Artificial Sequence
  chemically synthesized
tatgaatgattgaaaacaggac

SEQ ID NO: 108558 - DNA, 22 bp, Artificial Sequence
  chemically synthesized
atgaatgattgaaaacaggaca

SEQ ID NO: 108559 - DNA, 22 bp, Artificial Sequence
  chemically synthesized
tgaatgattgaaaacaggacaa

SEQ ID NO: 108560 - DNA, 22 bp, Artificial Sequence
  chemically synthesized
aaaacaggacaaaaacctacca

SEQ ID NO: 108561 - DNA, 22 bp, Artificial Sequence
  chemically synthesized
ccatcacatatatgcactcaca

SEQ ID NO: 108562 - DNA, 22 bp, Artificial Sequence
  chemically synthesized
acactcacaatttagtattcag

SEQ ID NO: 108563 - DNA, 22 bp, Artificial Sequence
  chemically synthesized
acaatttagtattcagactgtg

SEQ ID NO: 108564 - DNA, 22 bp, Artificial Sequence
  chemically synthesized
agtattcagactgtgttgctca

SEQ ID NO: 108565 - DNA, 22 bp, Artificial Sequence
  chemically synthesized
gtattcagactgtgttgctcag

SEQ ID NO: 108566 - DNA, 22 bp, Artificial Sequence
  chemically synthesized
agactgtgttgctcaggtgaca

SEQ ID NO: 108567 - DNA, 22 bp, Artificial Sequence
  chemically synthesized
tgttgctcaggtgacatggcgt

SEQ ID NO: 108568 - DNA, 22 bp, Artificial Sequence
  chemically synthesized
ctcaggtgacatggcgtgacaa

SEQ ID NO: 108569 - DNA, 22 bp, Artificial Sequence
  chemically synthesized
aggtgacatggcgtgacaagga

SEQ ID NO: 108570 - DNA, 22 bp, Artificial Sequence
  chemically synthesized
atttttttatatgttcagttct

SEQ ID NO: 108571 - DNA, 22 bp, Artificial Sequence
  chemically synthesized
ttttatatgttcagttctttca

SEQ ID NO: 108572 - DNA, 22 bp, Artificial Sequence
  chemically synthesized
tttatatgttcagttctttcac

SEQ ID NO: 108573 - DNA, 22 bp, Artificial Sequence
  chemically synthesized
ttatatgttcagttctttcaca

SEQ ID NO: 108574 - DNA, 22 bp, Artificial Sequence
  chemically synthesized
tatatgttcagttctttcacaa

SEQ ID NO: 108575 - DNA, 22 bp, Artificial Sequence
  chemically synthesized
atatgttcagttctttcacaat

SEQ ID NO: 108576 - DNA, 22 bp, Artificial Sequence
  chemically synthesized
tatgttcagttctttcacaatt

SEQ ID NO: 108577 - DNA, 22 bp, Artificial Sequence
  chemically synthesized
agttctttcacaattacatctc

SEQ ID NO: 108578 - DNA, 22 bp, Artificial Sequence
  chemically synthesized
tttcacaattacatctcttaat

SEQ ID NO: 108579 - DNA, 22 bp, Artificial Sequence
  chemically synthesized
tcacaattacatctcttaatga

SEQ ID NO: 108580 - DNA, 22 bp, Artificial Sequence
  chemically synthesized
cacaattacatctcttaatgaa

SEQ ID NO: 108581 - DNA, 22 bp, Artificial Sequence
  chemically synthesized
acaattacatctcttaatgaaa

SEQ ID NO: 108582 - DNA, 22 bp, Artificial Sequence
  chemically synthesized
catctcttaatgaaacagaata

SEQ ID NO: 108583 - DNA, 22 bp, Artificial Sequence
  chemically synthesized
ttaatgaaacagaatataaata

SEQ ID NO: 108584 - DNA, 22 bp, Artificial Sequence
  chemically synthesized
aatgaaacagaatataaataag

SEQ ID NO: 108585 - DNA, 22 bp, Artificial Sequence
  chemically synthesized
atgaaacagaatataaataagg

SEQ ID NO: 108586 - DNA, 22 bp, Artificial Sequence
  chemically synthesized
cagtttttcttaagttggactc

SEQ ID NO: 108587 - DNA, 22 bp, Artificial Sequence
  chemically synthesized
ttcttaagttggactctctatg

SEQ ID NO: 108588 - DNA, 22 bp, Artificial Sequence
  chemically synthesized
tcttaagttggactctctatga

SEQ ID NO: 108589 - DNA, 22 bp, Artificial Sequence
  chemically synthesized
cttaagttggactctctatgag

SEQ ID NO: 108590 - DNA, 22 bp, Artificial Sequence
  chemically synthesized
ttaagttggactctctatgagc

SEQ ID NO: 108591 - DNA, 22 bp, Artificial Sequence
  chemically synthesized
aagttggactctctatgagcaa

SEQ ID NO: 108592 - DNA, 22 bp, Artificial Sequence
  chemically synthesized
agttggactctctatgagcaat

SEQ ID NO: 108593 - DNA, 22 bp, Artificial Sequence
  chemically synthesized
gactctctatgagcaatacctg

SEQ ID NO: 108594 - DNA, 22 bp, Artificial Sequence
  chemically synthesized
tctatgagcaatacctgagata

SEQ ID NO: 108595 - DNA, 22 bp, Artificial Sequence
  chemically synthesized
tatgagcaatacctgagatagg

SEQ ID NO: 108596 - DNA, 22 bp, Artificial Sequence
  chemically synthesized
tgagcaatacctgagataggga

SEQ ID NO: 108597 - DNA, 22 bp, Artificial Sequence
  chemically synthesized
agatagggattcaaatgtgtgc

SEQ ID NO: 108598 - DNA, 22 bp, Artificial Sequence
  chemically synthesized
aaatgtgtgcaatttattaatg

SEQ ID NO: 108599 - DNA, 22 bp, Artificial Sequence
  chemically synthesized
attaatgaatgctctcaggaga

SEQ ID NO: 108600 - DNA, 22 bp, Artificial Sequence
  chemically synthesized
ttaatgaatgctctcaggagac

SEQ ID NO: 108601 - DNA, 22 bp, Artificial Sequence
  chemically synthesized
atgaatgctctcaggagacagg

SEQ ID NO: 108602 - DNA, 22 bp, Artificial Sequence
  chemically synthesized
tcaggagacagggagcaagtaa

SEQ ID NO: 108603 - DNA, 22 bp, Artificial Sequence
  chemically synthesized
aggagacagggagcaagtaaaa

SEQ ID NO: 108604 - DNA, 22 bp, Artificial Sequence
  chemically synthesized
aagctggagcttagcttcagaa

SEQ ID NO: 108605 - DNA, 22 bp, Artificial Sequence
  chemically synthesized
gagcttagcttcagaaggcaag

SEQ ID NO: 108606 - DNA, 22 bp, Artificial Sequence
  chemically synthesized
agcttcagaaggcaagagggtc

SEQ ID NO: 108607 - DNA, 22 bp, Artificial Sequence
  chemically synthesized
gcttcagaaggcaagagggtca

SEQ ID NO: 108608 - DNA, 22 bp, Artificial Sequence
  chemically synthesized
cagaaggcaagagggtcagtat

SEQ ID NO: 108609 - DNA, 22 bp, Artificial Sequence
  chemically synthesized
agaaggcaagagggtcagtatt

SEQ ID NO: 108610 - DNA, 22 bp, Artificial Sequence
  chemically synthesized
gcctatggcctgctacctaagg

SEQ ID NO: 108611 - DNA, 22 bp, Artificial Sequence
  chemically synthesized
cctatggcctgctacctaagga

SEQ ID NO: 108612 - DNA, 22 bp, Artificial Sequence
  chemically synthesized
tggcctgctacctaaggagcag

SEQ ID NO: 108613 - DNA, 22 bp, Artificial Sequence
  chemically synthesized
ctacctaaggagcaggggccat

SEQ ID NO: 108614 - DNA, 22 bp, Artificial Sequence
  chemically synthesized
cctaaggagcaggggccatttt

SEQ ID NO: 108615 - DNA, 22 bp, Artificial Sequence
  chemically synthesized
aggagcaggggccattttcttc

SEQ ID NO: 108616 - DNA, 22 bp, Artificial Sequence
  chemically synthesized
tcttcataagacatttcctgct

SEQ ID NO: 108617 - DNA, 22 bp, Artificial Sequence
  chemically synthesized
cttcataagacatttcctgctg

SEQ ID NO: 108618 - DNA, 22 bp, Artificial Sequence
  chemically synthesized
ttcataagacatttcctgctga

SEQ ID NO: 108619 - DNA, 22 bp, Artificial Sequence
  chemically synthesized
cataagacatttcctgctgagt

SEQ ID NO: 108620 - DNA, 22 bp, Artificial Sequence
  chemically synthesized
ataagacatttcctgctgagtt

SEQ ID NO: 108621 - DNA, 22 bp, Artificial Sequence
  chemically synthesized
cctgctgagttgagaacaacaa

SEQ ID NO: 108622 - DNA, 22 bp, Artificial Sequence
  chemically synthesized
ctgctgagttgagaacaacaac

SEQ ID NO: 108623 - DNA, 22 bp, Artificial Sequence
  chemically synthesized
ctgagttgagaacaacaacctg

SEQ ID NO: 108624 - DNA, 22 bp, Artificial Sequence
  chemically synthesized
agttgagaacaacaacctgcag

SEQ ID NO: 108625 - DNA, 22 bp, Artificial Sequence
  chemically synthesized
agaacaacaacctgcagaaagc

SEQ ID NO: 108626 - DNA, 22 bp, Artificial Sequence
  chemically synthesized
cagaaagcagaaacatgaacaa

SEQ ID NO: 108627 - DNA, 22 bp, Artificial Sequence
  chemically synthesized
acaggtgcacaattctgtaaaa

SEQ ID NO: 108628 - DNA, 22 bp, Artificial Sequence
  chemically synthesized
tgtaaaatgatcggggtaaaac

SEQ ID NO: 108629 - DNA, 22 bp, Artificial Sequence
  chemically synthesized
taaaatgatcggggtaaaacac

SEQ ID NO: 108630 - DNA, 22 bp, Artificial Sequence
  chemically synthesized
ctatatagtcccctctcttgtc

SEQ ID NO: 108631 - DNA, 22 bp, Artificial Sequence
  chemically synthesized
tatatagtcccctctcttgtct

SEQ ID NO: 108632 - DNA, 22 bp, Artificial Sequence
  chemically synthesized
tatagtcccctctcttgtctca

SEQ ID NO: 108633 - DNA, 22 bp, Artificial Sequence
  chemically synthesized
tcttgtctcactgaagtattat

SEQ ID NO: 108634 - DNA, 22 bp, Artificial Sequence
  chemically synthesized
ttgtctcactgaagtattattt

SEQ ID NO: 108635 - DNA, 22 bp, Artificial Sequence
  chemically synthesized
gtctcactgaagtattattttt

SEQ ID NO: 108636 - DNA, 22 bp, Artificial Sequence
  chemically synthesized
tctcactgaagtattatttttg

SEQ ID NO: 108637 - DNA, 22 bp, Artificial Sequence
  chemically synthesized
actgaagtattatttttgctct

SEQ ID NO: 108638 - DNA, 22 bp, Artificial Sequence
  chemically synthesized
aagtattatttttgctctgatt

SEQ ID NO: 108639 - DNA, 22 bp, Artificial Sequence
  chemically synthesized
tttttgctctgattaaagtata

SEQ ID NO: 108640 - DNA, 22 bp, Artificial Sequence
  chemically synthesized
ttgctctgattaaagtataatt

SEQ ID NO: 108641 - DNA, 22 bp, Artificial Sequence
  chemically synthesized
tgctctgattaaagtataatta

SEQ ID NO: 108642 - DNA, 22 bp, Artificial Sequence
  chemically synthesized
gctctgattaaagtataattaa

SEQ ID NO: 108643 - DNA, 22 bp, Artificial Sequence
  chemically synthesized
ctctgattaaagtataattaag

SEQ ID NO: 108644 - DNA, 22 bp, Artificial Sequence
  chemically synthesized
tgattaaagtataattaagaca

SEQ ID NO: 108645 - DNA, 22 bp, Artificial Sequence
  chemically synthesized
attaaagtataattaagacata

SEQ ID NO: 108646 - DNA, 22 bp, Artificial Sequence
  chemically synthesized
aagtataattaagacataacct

SEQ ID NO: 108647 - DNA, 22 bp, Artificial Sequence
  chemically synthesized
agacataacctccctcttttta

SEQ ID NO: 108648 - DNA, 22 bp, Artificial Sequence
  chemically synthesized
cctctttttaggatattttaaa

SEQ ID NO: 108649 - DNA, 22 bp, Artificial Sequence
  chemically synthesized
tttttaggatattttaaattga

SEQ ID NO: 108650 - DNA, 22 bp, Artificial Sequence
  chemically synthesized
tttaggatattttaaattgagt

SEQ ID NO: 108651 - DNA, 22 bp, Artificial Sequence
  chemically synthesized
ttaggatattttaaattgagtt

SEQ ID NO: 108652 - DNA, 22 bp, Artificial Sequence
  chemically synthesized
taggatattttaaattgagtta

SEQ ID NO: 108653 - DNA, 22 bp, Artificial Sequence
  chemically synthesized
aggatattttaaattgagttat

SEQ ID NO: 108654 - DNA, 22 bp, Artificial Sequence
  chemically synthesized
ggatattttaaattgagttatg

SEQ ID NO: 108655 - DNA, 22 bp, Artificial Sequence
  chemically synthesized
taaattgagttatgggtccctt

SEQ ID NO: 108656 - DNA, 22 bp, Artificial Sequence
  chemically synthesized
aaattgagttatgggtcccttc

SEQ ID NO: 108657 - DNA, 22 bp, Artificial Sequence
  chemically synthesized
aattgagttatgggtcccttcc

SEQ ID NO: 108658 - DNA, 22 bp, Artificial Sequence
  chemically synthesized
agttatgggtcccttcctaact

SEQ ID NO: 108659 - DNA, 22 bp, Artificial Sequence
  chemically synthesized
tgggtcccttcctaactcatca

SEQ ID NO: 108660 - DNA, 22 bp, Artificial Sequence
  chemically synthesized
cctaactcatcagacaatttta

SEQ ID NO: 108661 - DNA, 22 bp, Artificial Sequence
  chemically synthesized
ctaactcatcagacaattttaa

SEQ ID NO: 108662 - DNA, 22 bp, Artificial Sequence
  chemically synthesized
actcatcagacaattttaatca

SEQ ID NO: 108663 - DNA, 22 bp, Artificial Sequence
  chemically synthesized
atcagacaattttaatcaaatg

SEQ ID NO: 108664 - DNA, 22 bp, Artificial Sequence
  chemically synthesized
taatcaaatgagaatgacattg

SEQ ID NO: 108665 - DNA, 22 bp, Artificial Sequence
  chemically synthesized
aatcaaatgagaatgacattgt

SEQ ID NO: 108666 - DNA, 22 bp, Artificial Sequence
  chemically synthesized
atcaaatgagaatgacattgtt

SEQ ID NO: 108667 - DNA, 22 bp, Artificial Sequence
  chemically synthesized
ttgtattctttgggaaatttac

SEQ ID NO: 108668 - DNA, 22 bp, Artificial Sequence
  chemically synthesized
tattctttgggaaatttacact

SEQ ID NO: 108669 - DNA, 22 bp, Artificial Sequence
  chemically synthesized
tttgggaaatttacacttatta

SEQ ID NO: 108670 - DNA, 22 bp, Artificial Sequence
  chemically synthesized
tgggaaatttacacttattaca

SEQ ID NO: 108671 - DNA, 22 bp, Artificial Sequence
  chemically synthesized
gggaaatttacacttattacat

SEQ ID NO: 108672 - DNA, 22 bp, Artificial Sequence
  chemically synthesized
ggaaatttacacttattacatg

SEQ ID NO: 108673 - DNA, 22 bp, Artificial Sequence
  chemically synthesized
acacttattacatggaatcaga

SEQ ID NO: 108674 - DNA, 22 bp, Artificial Sequence
  chemically synthesized
cacttattacatggaatcagaa

SEQ ID NO: 108675 - DNA, 22 bp, Artificial Sequence
  chemically synthesized
attacatggaatcagaatgtat

SEQ ID NO: 108676 - DNA, 22 bp, Artificial Sequence
  chemically synthesized
ttacatggaatcagaatgtatg

SEQ ID NO: 108677 - DNA, 22 bp, Artificial Sequence
  chemically synthesized
catggaatcagaatgtatgtac

SEQ ID NO: 108678 - DNA, 22 bp, Artificial Sequence
  chemically synthesized
ttcaaaaaaatgcagaaaccta

SEQ ID NO: 108679 - DNA, 22 bp, Artificial Sequence
  chemically synthesized
caaaaaaatgcagaaacctatt

SEQ ID NO: 108680 - DNA, 22 bp, Artificial Sequence
  chemically synthesized
aaaaaaatgcagaaacctattt

SEQ ID NO: 108681 - DNA, 22 bp, Artificial Sequence
  chemically synthesized
tttttttttgttccttcagacc

SEQ ID NO: 108682 - DNA, 22 bp, Artificial Sequence
  chemically synthesized
ttttttgttccttcagaccttt

SEQ ID NO: 108683 - DNA, 22 bp, Artificial Sequence
  chemically synthesized
tttttgttccttcagacctttt

SEQ ID NO: 108684 - DNA, 22 bp, Artificial Sequence
  chemically synthesized
ttttgttccttcagaccttttt

SEQ ID NO: 108685 - DNA, 22 bp, Artificial Sequence
  chemically synthesized
tttgttccttcagacctttttc

SEQ ID NO: 108686 - DNA, 22 bp, Artificial Sequence
  chemically synthesized
ttgttccttcagacctttttca

SEQ ID NO: 108687 - DNA, 22 bp, Artificial Sequence
  chemically synthesized
tgttccttcagacctttttcat

SEQ ID NO: 108688 - DNA, 22 bp, Artificial Sequence
  chemically synthesized
gttccttcagacctttttcata

SEQ ID NO: 108689 - DNA, 22 bp, Artificial Sequence
  chemically synthesized
ttccttcagacctttttcatag

SEQ ID NO: 108690 - DNA, 22 bp, Artificial Sequence
  chemically synthesized
cttcagacctttttcatagcaa

SEQ ID NO: 108691 - DNA, 22 bp, Artificial Sequence
  chemically synthesized
cagacctttttcatagcaaaag

SEQ ID NO: 108692 - DNA, 22 bp, Artificial Sequence
  chemically synthesized
agacctttttcatagcaaaagg

SEQ ID NO: 108693 - DNA, 22 bp, Artificial Sequence
  chemically synthesized
tttcatagcaaaaggagggtga

SEQ ID NO: 108694 - DNA, 22 bp, Artificial Sequence
  chemically synthesized
ttcatagcaaaaggagggtgaa

SEQ ID NO: 108695 - DNA, 22 bp, Artificial Sequence
  chemically synthesized
tcatagcaaaaggagggtgaag

SEQ ID NO: 108696 - DNA, 22 bp, Artificial Sequence
  chemically synthesized
catagcaaaaggagggtgaagg

SEQ ID NO: 108697 - DNA, 22 bp, Artificial Sequence
  chemically synthesized
atagcaaaaggagggtgaagga

SEQ ID NO: 108698 - DNA, 22 bp, Artificial Sequence
  chemically synthesized
tctcttccactaatttggacta

SEQ ID NO: 108699 - DNA, 22 bp, Artificial Sequence
  chemically synthesized
ttccactaatttggactagtca

SEQ ID NO: 108700 - DNA, 22 bp, Artificial Sequence
  chemically synthesized
ccactaatttggactagtcagc

SEQ ID NO: 108701 - DNA, 22 bp, Artificial Sequence
  chemically synthesized
cactaatttggactagtcagcc

SEQ ID NO: 108702 - DNA, 22 bp, Artificial Sequence
  chemically synthesized
atttggactagtcagccagcgt

SEQ ID NO: 108703 - DNA, 22 bp, Artificial Sequence
  chemically synthesized
ggactagtcagccagcgtagat

SEQ ID NO: 108704 - DNA, 22 bp, Artificial Sequence
  chemically synthesized
gactagtcagccagcgtagata

SEQ ID NO: 108705 - DNA, 22 bp, Artificial Sequence
  chemically synthesized
gtcagccagcgtagatatctga

SEQ ID NO: 108706 - DNA, 22 bp, Artificial Sequence
  chemically synthesized
aggatggcctcaacattggagc

SEQ ID NO: 108707 - DNA, 22 bp, Artificial Sequence
  chemically synthesized
aacattggagctagcaactagg

SEQ ID NO: 108708 - DNA, 22 bp, Artificial Sequence
  chemically synthesized
gagctagcaactagggtagtag

SEQ ID NO: 108709 - DNA, 22 bp, Artificial Sequence
  chemically synthesized
gcaactagggtagtagaataag

SEQ ID NO: 108710 - DNA, 22 bp, Artificial Sequence
  chemically synthesized
gggtagtagaataagaatgaga

SEQ ID NO: 108711 - DNA, 22 bp, Artificial Sequence
  chemically synthesized
actgtgtctacgtcctctcatt

SEQ ID NO: 108712 - DNA, 22 bp, Artificial Sequence
  chemically synthesized
tgtctacgtcctctcatttatc

SEQ ID NO: 108713 - DNA, 22 bp, Artificial Sequence
  chemically synthesized
cgtcctctcatttatccgtgat

SEQ ID NO: 108714 - DNA, 22 bp, Artificial Sequence
  chemically synthesized
tcatttatccgtgattcctctt

SEQ ID NO: 108715 - DNA, 22 bp, Artificial Sequence
  chemically synthesized
atttatccgtgattcctcttct

SEQ ID NO: 108716 - DNA, 22 bp, Artificial Sequence
  chemically synthesized
atccgtgattcctcttctcaca

SEQ ID NO: 108717 - DNA, 22 bp, Artificial Sequence
  chemically synthesized
tccgtgattcctcttctcacat

SEQ ID NO: 108718 - DNA, 22 bp, Artificial Sequence
  chemically synthesized
ctcttctcacatttttttgtta

SEQ ID NO: 108719 - DNA, 22 bp, Artificial Sequence
  chemically synthesized
ttctcacatttttttgttacaa

SEQ ID NO: 108720 - DNA, 22 bp, Artificial Sequence
  chemically synthesized
ctcacatttttttgttacaagt

SEQ ID NO: 108721 - DNA, 22 bp, Artificial Sequence
  chemically synthesized
tcacatttttttgttacaagtt

SEQ ID NO: 108722 - DNA, 22 bp, Artificial Sequence
  chemically synthesized
acatttttttgttacaagtttg

SEQ ID NO: 108723 - DNA, 22 bp, Artificial Sequence
  chemically synthesized
ttttgttacaagtttgtcagaa

SEQ ID NO: 108724 - DNA, 22 bp, Artificial Sequence
  chemically synthesized
tttgttacaagtttgtcagaag

SEQ ID NO: 108725 - DNA, 22 bp, Artificial Sequence
  chemically synthesized
ttgttacaagtttgtcagaagg

SEQ ID NO: 108726 - DNA, 22 bp, Artificial Sequence
  chemically synthesized
tgttacaagtttgtcagaaggt

SEQ ID NO: 108727 - DNA, 22 bp, Artificial Sequence
  chemically synthesized
gttacaagtttgtcagaaggta

SEQ ID NO: 108728 - DNA, 22 bp, Artificial Sequence
  chemically synthesized
ttacaagtttgtcagaaggtac

SEQ ID NO: 108729 - DNA, 22 bp, Artificial Sequence
  chemically synthesized
caagtttgtcagaaggtactgc

SEQ ID NO: 108730 - DNA, 22 bp, Artificial Sequence
  chemically synthesized
gtcagaaggtactgccttgggg

SEQ ID NO: 108731 - DNA, 22 bp, Artificial Sequence
  chemically synthesized
tcagaaggtactgccttgggga

SEQ ID NO: 108732 - DNA, 22 bp, Artificial Sequence
  chemically synthesized
ccttggggaataaatatgagtt

SEQ ID NO: 108733 - DNA, 22 bp, Artificial Sequence
  chemically synthesized
ggggaataaatatgagtttatg

SEQ ID NO: 108734 - DNA, 22 bp, Artificial Sequence
  chemically synthesized
gggaataaatatgagtttatgg

SEQ ID NO: 108735 - DNA, 22 bp, Artificial Sequence
  chemically synthesized
atggtttttgagacaaattcat

SEQ ID NO: 108736 - DNA, 22 bp, Artificial Sequence
  chemically synthesized
tggtttttgagacaaattcatt

SEQ ID NO: 108737 - DNA, 22 bp, Artificial Sequence
  chemically synthesized
ttgagacaaattcattataatt

SEQ ID NO: 108738 - DNA, 22 bp, Artificial Sequence
  chemically synthesized
tgagacaaattcattataattt

SEQ ID NO: 108739 - DNA, 22 bp, Artificial Sequence
  chemically synthesized
gagacaaattcattataatttg

SEQ ID NO: 108740 - DNA, 22 bp, Artificial Sequence
  chemically synthesized
agacaaattcattataatttga

SEQ ID NO: 108741 - DNA, 22 bp, Artificial Sequence
  chemically synthesized
attataatttgatggagggagg

SEQ ID NO: 108742 - DNA, 22 bp, Artificial Sequence
  chemically synthesized
taatttgatggagggaggagga

SEQ ID NO: 108743 - DNA, 22 bp, Artificial Sequence
  chemically synthesized
gatggagggaggaggaaccaac

SEQ ID NO: 108744 - DNA, 22 bp, Artificial Sequence
  chemically synthesized
atggagggaggaggaaccaact

SEQ ID NO: 108745 - DNA, 22 bp, Artificial Sequence
  chemically synthesized
gactgttgagatgataagtaat

SEQ ID NO: 108746 - DNA, 22 bp, Artificial Sequence
  chemically synthesized
ttgagatgataagtaattaggt

SEQ ID NO: 108747 - DNA, 22 bp, Artificial Sequence
  chemically synthesized
agatgataagtaattaggtcac

SEQ ID NO: 108748 - DNA, 22 bp, Artificial Sequence
  chemically synthesized
ggtcactgatcaaagaagatta

SEQ ID NO: 108749 - DNA, 22 bp, Artificial Sequence
  chemically synthesized
atcaaagaagattatattcttt

SEQ ID NO: 108750 - DNA, 22 bp, Artificial Sequence
  chemically synthesized
tattcttttttgcaggaaaatt

SEQ ID NO: 108751 - DNA, 22 bp, Artificial Sequence
  chemically synthesized
ttttttgcaggaaaattcctgg

SEQ ID NO: 108752 - DNA, 22 bp, Artificial Sequence
  chemically synthesized
ttttgcaggaaaattcctggac

SEQ ID NO: 108753 - DNA, 22 bp, Artificial Sequence
  chemically synthesized
tttgcaggaaaattcctggact

SEQ ID NO: 108754 - DNA, 22 bp, Artificial Sequence
  chemically synthesized
ttgcaggaaaattcctggactt

SEQ ID NO: 108755 - DNA, 22 bp, Artificial Sequence
  chemically synthesized
tgcaggaaaattcctggacttc

SEQ ID NO: 108756 - DNA, 22 bp, Artificial Sequence
  chemically synthesized
gcaggaaaattcctggacttca

SEQ ID NO: 108757 - DNA, 22 bp, Artificial Sequence
  chemically synthesized
caggaaaattcctggacttcag

SEQ ID NO: 108758 - DNA, 22 bp, Artificial Sequence
  chemically synthesized
ctggacttcagtgaccaaattt

SEQ ID NO: 108759 - DNA, 22 bp, Artificial Sequence
  chemically synthesized
gacttcagtgaccaaatttata

SEQ ID NO: 108760 - DNA, 22 bp, Artificial Sequence
  chemically synthesized
cagtgaccaaatttataggttc

SEQ ID NO: 108761 - DNA, 22 bp, Artificial Sequence
  chemically synthesized
agtgaccaaatttataggttcc

SEQ ID NO: 108762 - DNA, 22 bp, Artificial Sequence
  chemically synthesized
ataggttcccattgtttgtatg

SEQ ID NO: 108763 - DNA, 22 bp, Artificial Sequence
  chemically synthesized
taggttcccattgtttgtatgg

SEQ ID NO: 108764 - DNA, 22 bp, Artificial Sequence
  chemically synthesized
ccattgtttgtatggacacctg

SEQ ID NO: 108765 - DNA, 22 bp, Artificial Sequence
  chemically synthesized
tttgtatggacacctgcagaga

SEQ ID NO: 108766 - DNA, 22 bp, Artificial Sequence
  chemically synthesized
gtatggacacctgcagagaaat

SEQ ID NO: 108767 - DNA, 22 bp, Artificial Sequence
  chemically synthesized
tatggacacctgcagagaaatt

SEQ ID NO: 108768 - DNA, 22 bp, Artificial Sequence
  chemically synthesized
cagagaaattcataagagttgg

SEQ ID NO: 108769 - DNA, 22 bp, Artificial Sequence
  chemically synthesized
ataagagttggaaattagattt

SEQ ID NO: 108770 - DNA, 22 bp, Artificial Sequence
  chemically synthesized
gaaattagatttgacatagtaa

SEQ ID NO: 108771 - DNA, 22 bp, Artificial Sequence
  chemically synthesized
gatttgacatagtaaaccaaac

SEQ ID NO: 108772 - DNA, 22 bp, Artificial Sequence
  chemically synthesized
gacatagtaaaccaaactctat

SEQ ID NO: 108773 - DNA, 22 bp, Artificial Sequence
  chemically synthesized
acatagtaaaccaaactctatt

SEQ ID NO: 108774 - DNA, 22 bp, Artificial Sequence
  chemically synthesized
tattccatttcactcgaaccaa

SEQ ID NO: 108775 - DNA, 22 bp, Artificial Sequence
  chemically synthesized
ttccatttcactcgaaccaact

SEQ ID NO: 108776 - DNA, 22 bp, Artificial Sequence
  chemically synthesized
catttcactcgaaccaactaat

SEQ ID NO: 108777 - DNA, 22 bp, Artificial Sequence
  chemically synthesized
cactcgaaccaactaataattt

SEQ ID NO: 108778 - DNA, 22 bp, Artificial Sequence
  chemically synthesized
actcgaaccaactaataatttt

SEQ ID NO: 108779 - DNA, 22 bp, Artificial Sequence
  chemically synthesized
gaaccaactaataattttatat

SEQ ID NO: 108780 - DNA, 22 bp, Artificial Sequence
  chemically synthesized
ataattttatatttttatgatt

SEQ ID NO: 108781 - DNA, 22 bp, Artificial Sequence
  chemically synthesized
tatatttttatgattctgttcc

SEQ ID NO: 108782 - DNA, 22 bp, Artificial Sequence
  chemically synthesized
atatttttatgattctgttcct

SEQ ID NO: 108783 - DNA, 22 bp, Artificial Sequence
  chemically synthesized
tatttttatgattctgttccta

SEQ ID NO: 108784 - DNA, 22 bp, Artificial Sequence
  chemically synthesized
ttatgattctgttcctatctgc

SEQ ID NO: 108785 - DNA, 22 bp, Artificial Sequence
  chemically synthesized
tatgattctgttcctatctgct

SEQ ID NO: 108786 - DNA, 22 bp, Artificial Sequence
  chemically synthesized
atgattctgttcctatctgcta

SEQ ID NO: 108787 - DNA, 22 bp, Artificial Sequence
  chemically synthesized
tgattctgttcctatctgctaa

SEQ ID NO: 108788 - DNA, 22 bp, Artificial Sequence
  chemically synthesized
tgttcctatctgctaactttat

SEQ ID NO: 108789 - DNA, 22 bp, Artificial Sequence
  chemically synthesized
ttcctatctgctaactttatac

SEQ ID NO: 108790 - DNA, 22 bp, Artificial Sequence
  chemically synthesized
ctatctgctaactttataccat

SEQ ID NO: 108791 - DNA, 22 bp, Artificial Sequence
  chemically synthesized
tctgctaactttataccatgaa

SEQ ID NO: 108792 - DNA, 22 bp, Artificial Sequence
  chemically synthesized
ctaactttataccatgaaataa

SEQ ID NO: 108793 - DNA, 22 bp, Artificial Sequence
  chemically synthesized
actttataccatgaaataaaca

SEQ ID NO: 108794 - DNA, 22 bp, Artificial Sequence
  chemically synthesized
tataccatgaaataaacatatg

SEQ ID NO: 108795 - DNA, 22 bp, Artificial Sequence
  chemically synthesized
ataccatgaaataaacatatgt

SEQ ID NO: 108796 - DNA, 22 bp, Artificial Sequence
  chemically synthesized
taccatgaaataaacatatgtt

SEQ ID NO: 108797 - DNA, 22 bp, Artificial Sequence
  chemically synthesized
gttacattatagacataccaat

SEQ ID NO: 108798 - DNA, 22 bp, Artificial Sequence
  chemically synthesized
cattatagacataccaatagat

SEQ ID NO: 108799 - DNA, 22 bp, Artificial Sequence
  chemically synthesized
tagacataccaatagatgccta

SEQ ID NO: 108800 - DNA, 22 bp, Artificial Sequence
  chemically synthesized
aggtattgttatcacaataatt

SEQ ID NO: 108801 - DNA, 22 bp, Artificial Sequence
  chemically synthesized
ttatcacaataatttagtggaa

SEQ ID NO: 108802 - DNA, 22 bp, Artificial Sequence
  chemically synthesized
tcacaataatttagtggaaagc

SEQ ID NO: 108803 - DNA, 22 bp, Artificial Sequence
  chemically synthesized
agtggaaagcttagagaaatat

SEQ ID NO: 108804 - DNA, 22 bp, Artificial Sequence
  chemically synthesized
gtggaaagcttagagaaatatt

SEQ ID NO: 108805 - DNA, 22 bp, Artificial Sequence
  chemically synthesized
agagaaatattccgtttacagg

SEQ ID NO: 108806 - DNA, 22 bp, Artificial Sequence
  chemically synthesized
gagaaatattccgtttacagga

SEQ ID NO: 108807 - DNA, 22 bp, Artificial Sequence
  chemically synthesized
cgtttacaggaatgcaacaaaa

SEQ ID NO: 108808 - DNA, 22 bp, Artificial Sequence
  chemically synthesized
acaggaatgcaacaaaaatttg

SEQ ID NO: 108809 - DNA, 22 bp, Artificial Sequence
  chemically synthesized
caggaatgcaacaaaaatttgt

SEQ ID NO: 108810 - DNA, 22 bp, Artificial Sequence
  chemically synthesized
gtacaaactacatttagctaaa

SEQ ID NO: 108811 - DNA, 22 bp, Artificial Sequence
  chemically synthesized
tacaaactacatttagctaaag

SEQ ID NO: 108812 - DNA, 22 bp, Artificial Sequence
  chemically synthesized
catttagctaaagagttgggct

SEQ ID NO: 108813 - DNA, 22 bp, Artificial Sequence
  chemically synthesized
agctaaagagttgggcttaaag

SEQ ID NO: 108814 - DNA, 22 bp, Artificial Sequence
  chemically synthesized
gctaaagagttgggcttaaaga

SEQ ID NO: 108815 - DNA, 22 bp, Artificial Sequence
  chemically synthesized
aagagttgggcttaaagagata

SEQ ID NO: 108816 - DNA, 22 bp, Artificial Sequence
  chemically synthesized
ggcttaaagagataccttaggg

SEQ ID NO: 108817 - DNA, 22 bp, Artificial Sequence
  chemically synthesized
aaagagataccttagggaaact

SEQ ID NO: 108818 - DNA, 22 bp, Artificial Sequence
  chemically synthesized
aagagataccttagggaaactt

SEQ ID NO: 108819 - DNA, 22 bp, Artificial Sequence
  chemically synthesized
agggaaacttgaagctgtattt

SEQ ID NO: 108820 - DNA, 22 bp, Artificial Sequence
  chemically synthesized
gggaaacttgaagctgtatttt

SEQ ID NO: 108821 - DNA, 22 bp, Artificial Sequence
  chemically synthesized
gaagctgtattttaacacctat

SEQ ID NO: 108822 - DNA, 22 bp, Artificial Sequence
  chemically synthesized
aagctgtattttaacacctatt

SEQ ID NO: 108823 - DNA, 22 bp, Artificial Sequence
  chemically synthesized
tattttaacacctattttacca

SEQ ID NO: 108824 - DNA, 22 bp, Artificial Sequence
  chemically synthesized
taacacctattttaccaagtca

SEQ ID NO: 108825 - DNA, 22 bp, Artificial Sequence
  chemically synthesized
aacacctattttaccaagtcat

SEQ ID NO: 108826 - DNA, 22 bp, Artificial Sequence
  chemically synthesized
acacctattttaccaagtcata

SEQ ID NO: 108827 - DNA, 22 bp, Artificial Sequence
  chemically synthesized
ttttaccaagtcatatgagcat

SEQ ID NO: 108828 - DNA, 22 bp, Artificial Sequence
  chemically synthesized
taccaagtcatatgagcatgca

SEQ ID NO: 108829 - DNA, 22 bp, Artificial Sequence
  chemically synthesized
accaagtcatatgagcatgcat

SEQ ID NO: 108830 - DNA, 22 bp, Artificial Sequence
  chemically synthesized
ccaagtcatatgagcatgcatg

SEQ ID NO: 108831 - DNA, 22 bp, Artificial Sequence
  chemically synthesized
gatatgagacttctttgctctc

SEQ ID NO: 108832 - DNA, 22 bp, Artificial Sequence
  chemically synthesized
ctttgctctcctgctaaatatt

SEQ ID NO: 108833 - DNA, 22 bp, Artificial Sequence
  chemically synthesized
tttgctctcctgctaaatatta

SEQ ID NO: 108834 - DNA, 22 bp, Artificial Sequence
  chemically synthesized
tgctctcctgctaaatattaga

SEQ ID NO: 108835 - DNA, 22 bp, Artificial Sequence
  chemically synthesized
gctctcctgctaaatattagag

SEQ ID NO: 108836 - DNA, 22 bp, Artificial Sequence
  chemically synthesized
ctctcctgctaaatattagagt

SEQ ID NO: 108837 - DNA, 22 bp, Artificial Sequence
  chemically synthesized
tcctgctaaatattagagtttt

SEQ ID NO: 108838 - DNA, 22 bp, Artificial Sequence
  chemically synthesized
ctgctaaatattagagttttta

SEQ ID NO: 108839 - DNA, 22 bp, Artificial Sequence
  chemically synthesized
ctaaatattagagtttttacat

SEQ ID NO: 108840 - DNA, 22 bp, Artificial Sequence
  chemically synthesized
aatattagagtttttacattct

SEQ ID NO: 108841 - DNA, 22 bp, Artificial Sequence
  chemically synthesized
gagtttttacattctgtgagag

SEQ ID NO: 108842 - DNA, 22 bp, Artificial Sequence
  chemically synthesized
ttacattctgtgagagtgactg

SEQ ID NO: 108843 - DNA, 22 bp, Artificial Sequence
  chemically synthesized
tacattctgtgagagtgactgt

SEQ ID NO: 108844 - DNA, 22 bp, Artificial Sequence
  chemically synthesized
acattctgtgagagtgactgtg

SEQ ID NO: 108845 - DNA, 22 bp, Artificial Sequence
  chemically synthesized
cattctgtgagagtgactgtga

SEQ ID NO: 108846 - DNA, 22 bp, Artificial Sequence
  chemically synthesized
tgtgagagtgactgtgatgatt

SEQ ID NO: 108847 - DNA, 22 bp, Artificial Sequence
  chemically synthesized
tgagagtgactgtgatgattgg

SEQ ID NO: 108848 - DNA, 22 bp, Artificial Sequence
  chemically synthesized
tgatgattggagatcaggttcc

SEQ ID NO: 108849 - DNA, 22 bp, Artificial Sequence
  chemically synthesized
gagatcaggttccaattctatg

SEQ ID NO: 108850 - DNA, 22 bp, Artificial Sequence
  chemically synthesized
caattctatgggtagtaaaaag

SEQ ID NO: 108851 - DNA, 22 bp, Artificial Sequence
  chemically synthesized
tatgggtagtaaaaaggtgaag

SEQ ID NO: 108852 - DNA, 22 bp, Artificial Sequence
  chemically synthesized
tgggtagtaaaaaggtgaagaa

SEQ ID NO: 108853 - DNA, 22 bp, Artificial Sequence
  chemically synthesized
tgaatctgcttggtcttgacac

SEQ ID NO: 108854 - DNA, 22 bp, Artificial Sequence
  chemically synthesized
aatctgcttggtcttgacacta

SEQ ID NO: 108855 - DNA, 22 bp, Artificial Sequence
  chemically synthesized
cttggtcttgacactatatgtt

SEQ ID NO: 108856 - DNA, 22 bp, Artificial Sequence
  chemically synthesized
ggtcttgacactatatgttata

SEQ ID NO: 108857 - DNA, 22 bp, Artificial Sequence
  chemically synthesized
gtcttgacactatatgttatag

SEQ ID NO: 108858 - DNA, 22 bp, Artificial Sequence
  chemically synthesized
gacactatatgttataggattc

SEQ ID NO: 108859 - DNA, 22 bp, Artificial Sequence
  chemically synthesized
acactatatgttataggattca

SEQ ID NO: 108860 - DNA, 22 bp, Artificial Sequence
  chemically synthesized
tatgttataggattcattagtg

SEQ ID NO: 108861 - DNA, 22 bp, Artificial Sequence
  chemically synthesized
taggattcattagtggagggaa

SEQ ID NO: 108862 - DNA, 22 bp, Artificial Sequence
  chemically synthesized
attagtggagggaacagaaaat

SEQ ID NO: 108863 - DNA, 22 bp, Artificial Sequence
  chemically synthesized
gtggagggaacagaaaataggc

SEQ ID NO: 108864 - DNA, 22 bp, Artificial Sequence
  chemically synthesized
ataatgaggtgaacaatatgtg

SEQ ID NO: 108865 - DNA, 22 bp, Artificial Sequence
  chemically synthesized
ctttccaaaacgatgaatcaga

SEQ ID NO: 108866 - DNA, 22 bp, Artificial Sequence
  chemically synthesized
tccaaaacgatgaatcagagac

SEQ ID NO: 108867 - DNA, 22 bp, Artificial Sequence
  chemically synthesized
ccaaaacgatgaatcagagaca

SEQ ID NO: 108868 - DNA, 22 bp, Artificial Sequence
  chemically synthesized
caaaacgatgaatcagagacaa

SEQ ID NO: 108869 - DNA, 22 bp, Artificial Sequence
  chemically synthesized
tgacataaaaaaccaggacaca

SEQ ID NO: 108870 - DNA, 22 bp, Artificial Sequence
  chemically synthesized
ggccctctcctctctggaggca

SEQ ID NO: 108871 - DNA, 22 bp, Artificial Sequence
  chemically synthesized
gccctctcctctctggaggcaa

SEQ ID NO: 108872 - DNA, 22 bp, Artificial Sequence
  chemically synthesized
tcctctctggaggcaatgctca

SEQ ID NO: 108873 - DNA, 22 bp, Artificial Sequence
  chemically synthesized
ctctctggaggcaatgctcagg

SEQ ID NO: 108874 - DNA, 22 bp, Artificial Sequence
  chemically synthesized
tctggaggcaatgctcaggaca

SEQ ID NO: 108875 - DNA, 22 bp, Artificial Sequence
  chemically synthesized
tggaggcaatgctcaggacagt

SEQ ID NO: 108876 - DNA, 22 bp, Artificial Sequence
  chemically synthesized
gaggcaatgctcaggacagtct

SEQ ID NO: 108877 - DNA, 22 bp, Artificial Sequence
  chemically synthesized
aggacagtcttgagtatcaaca

SEQ ID NO: 108878 - DNA, 22 bp, Artificial Sequence
  chemically synthesized
gagtatcaacacataggagatg

SEQ ID NO: 108879 - DNA, 22 bp, Artificial Sequence
  chemically synthesized
agtatcaacacataggagatga

SEQ ID NO: 108880 - DNA, 22 bp, Artificial Sequence
  chemically synthesized
caagcacagctgggtacagtcg

SEQ ID NO: 108881 - DNA, 22 bp, Artificial Sequence
  chemically synthesized
ggtacagtcggttgaaggtggt

SEQ ID NO: 108882 - DNA, 22 bp, Artificial Sequence
  chemically synthesized
aaggtggtatcagcacaggcga

SEQ ID NO: 108883 - DNA, 22 bp, Artificial Sequence
  chemically synthesized
aatgacatcctggtgaaggcag

SEQ ID NO: 108884 - DNA, 22 bp, Artificial Sequence
  chemically synthesized
atgacatcctggtgaaggcaga

SEQ ID NO: 108885 - DNA, 22 bp, Artificial Sequence
  chemically synthesized
gtgaaggcagaatgcatgtgaa

SEQ ID NO: 108886 - DNA, 22 bp, Artificial Sequence
  chemically synthesized
attgggggaacaacggatacaa

SEQ ID NO: 108887 - DNA, 22 bp, Artificial Sequence
  chemically synthesized
ggggaacaacggatacaaatcc

SEQ ID NO: 108888 - DNA, 22 bp, Artificial Sequence
  chemically synthesized
atcagaactcccagcccaatct

SEQ ID NO: 108889 - DNA, 22 bp, Artificial Sequence
  chemically synthesized
ccagcccaatcttcactactcg

SEQ ID NO: 108890 - DNA, 22 bp, Artificial Sequence
  chemically synthesized
cactactcgagtattagtaagt

SEQ ID NO: 108891 - DNA, 22 bp, Artificial Sequence
  chemically synthesized
actactcgagtattagtaagta

SEQ ID NO: 108892 - DNA, 22 bp, Artificial Sequence
  chemically synthesized
ctcgagtattagtaagtacaga

SEQ ID NO: 108893 - DNA, 22 bp, Artificial Sequence
  chemically synthesized
gagtattagtaagtacagaggt

SEQ ID NO: 108894 - DNA, 22 bp, Artificial Sequence
  chemically synthesized
gtaagtacagaggtatatctaa

SEQ ID NO: 108895 - DNA, 22 bp, Artificial Sequence
  chemically synthesized
agagggttgcagatggcaataa

SEQ ID NO: 108896 - DNA, 22 bp, Artificial Sequence
  chemically synthesized
cagatggcaataaaacggtcat

SEQ ID NO: 108897 - DNA, 22 bp, Artificial Sequence
  chemically synthesized
gagaaaggaaagtgagtgtata

SEQ ID NO: 108898 - DNA, 22 bp, Artificial Sequence
  chemically synthesized
ggaaaagcaggccgcacttcca

SEQ ID NO: 108899 - DNA, 22 bp, Artificial Sequence
  chemically synthesized
ccaatctccctgtgatccagcc

SEQ ID NO: 108900 - DNA, 22 bp, Artificial Sequence
  chemically synthesized
caatctccctgtgatccagcca

SEQ ID NO: 108901 - DNA, 22 bp, Artificial Sequence
  chemically synthesized
cctgtgatccagccagaggact

SEQ ID NO: 108902 - DNA, 22 bp, Artificial Sequence
  chemically synthesized
tgatccagccagaggactccca

SEQ ID NO: 108903 - DNA, 22 bp, Artificial Sequence
  chemically synthesized
ccagcaccgtgggcattgtggt

SEQ ID NO: 108904 - DNA, 22 bp, Artificial Sequence
  chemically synthesized
tggtcagggccagccccaggtc

SEQ ID NO: 108905 - DNA, 22 bp, Artificial Sequence
  chemically synthesized
tggcagccagcatggccagaaa

SEQ ID NO: 108906 - DNA, 22 bp, Artificial Sequence
  chemically synthesized
atgaagattgtgatcttcctta

SEQ ID NO: 108907 - DNA, 22 bp, Artificial Sequence
  chemically synthesized
tgatcttccttaatgagaagaa

SEQ ID NO: 108908 - DNA, 22 bp, Artificial Sequence
  chemically synthesized
ccttaatgagaagaaggagggt

SEQ ID NO: 108909 - DNA, 22 bp, Artificial Sequence
  chemically synthesized
cttaatgagaagaaggagggtg

SEQ ID NO: 108910 - DNA, 22 bp, Artificial Sequence
  chemically synthesized
aatgagaagaaggagggtgcca

SEQ ID NO: 108911 - DNA, 22 bp, Artificial Sequence
  chemically synthesized
atgagaagaaggagggtgccat

SEQ ID NO: 108912 - DNA, 22 bp, Artificial Sequence
  chemically synthesized
ccaaaaaggatggatatataca

SEQ ID NO: 108913 - DNA, 22 bp, Artificial Sequence
  chemically synthesized
cctccaagcctggaaaaccagt

SEQ ID NO: 108914 - DNA, 22 bp, Artificial Sequence
  chemically synthesized
ctccaagcctggaaaaccagtc

SEQ ID NO: 108915 - DNA, 22 bp, Artificial Sequence
  chemically synthesized
caagcctggaaaaccagtcaat

SEQ ID NO: 108916 - DNA, 22 bp, Artificial Sequence
  chemically synthesized
gaaaaccagtcaataggaaggg

SEQ ID NO: 108917 - DNA, 22 bp, Artificial Sequence
  chemically synthesized
ccgctggacgacatcctgggtt

SEQ ID NO: 108918 - DNA, 22 bp, Artificial Sequence
  chemically synthesized
gacgacatcctgggtttatata

SEQ ID NO: 108919 - DNA, 22 bp, Artificial Sequence
  chemically synthesized
ggtttatatagaagaaatgtct

SEQ ID NO: 108920 - DNA, 22 bp, Artificial Sequence
  chemically synthesized
atatagaagaaatgtctttctg

SEQ ID NO: 108921 - DNA, 22 bp, Artificial Sequence
  chemically synthesized
tatagaagaaatgtctttctgt

SEQ ID NO: 108922 - DNA, 22 bp, Artificial Sequence
  chemically synthesized
tctgtttctgttattaccacag

SEQ ID NO: 108923 - DNA, 22 bp, Artificial Sequence
  chemically synthesized
ctgtttctgttattaccacagt

SEQ ID NO: 108924 - DNA, 22 bp, Artificial Sequence
  chemically synthesized
tgtttctgttattaccacagtg

SEQ ID NO: 108925 - DNA, 22 bp, Artificial Sequence
  chemically synthesized
tttctgttattaccacagtgca

SEQ ID NO: 108926 - DNA, 22 bp, Artificial Sequence
  chemically synthesized
ctgttattaccacagtgcacag

SEQ ID NO: 108927 - DNA, 22 bp, Artificial Sequence
  chemically synthesized
tgttattaccacagtgcacagt

SEQ ID NO: 108928 - DNA, 22 bp, Artificial Sequence
  chemically synthesized
ttattaccacagtgcacagttc

SEQ ID NO: 108929 - DNA, 22 bp, Artificial Sequence
  chemically synthesized
ttaccacagtgcacagttctac

SEQ ID NO: 108930 - DNA, 22 bp, Artificial Sequence
  chemically synthesized
ccacagtgcacagttctacctt

SEQ ID NO: 108931 - DNA, 22 bp, Artificial Sequence
  chemically synthesized
taccttcaaggtatcacttcga

SEQ ID NO: 108932 - DNA, 22 bp, Artificial Sequence
  chemically synthesized
ccttcaaggtatcacttcgact

SEQ ID NO: 108933 - DNA, 22 bp, Artificial Sequence
  chemically synthesized
caaggtatcacttcgactatat

SEQ ID NO: 108934 - DNA, 22 bp, Artificial Sequence
  chemically synthesized
aaggtatcacttcgactatatc

SEQ ID NO: 108935 - DNA, 22 bp, Artificial Sequence
  chemically synthesized
cgactatatcattctcagaatt

SEQ ID NO: 108936 - DNA, 22 bp, Artificial Sequence
  chemically synthesized
gactatatcattctcagaattt

SEQ ID NO: 108937 - DNA, 22 bp, Artificial Sequence
  chemically synthesized
tatcattctcagaattttttcc

SEQ ID NO: 108938 - DNA, 22 bp, Artificial Sequence
  chemically synthesized
tcagaattttttcctaaagata

SEQ ID NO: 108939 - DNA, 22 bp, Artificial Sequence
  chemically synthesized
agaattttttcctaaagataat

SEQ ID NO: 108940 - DNA, 22 bp, Artificial Sequence
  chemically synthesized
tttcctaaagataataatgaca

SEQ ID NO: 108941 - DNA, 22 bp, Artificial Sequence
  chemically synthesized
ttcctaaagataataatgacat

SEQ ID NO: 108942 - DNA, 22 bp, Artificial Sequence
  chemically synthesized
tcctaaagataataatgacatc

SEQ ID NO: 108943 - DNA, 22 bp, Artificial Sequence
  chemically synthesized
cctaaagataataatgacatca

SEQ ID NO: 108944 - DNA, 22 bp, Artificial Sequence
  chemically synthesized
ctaaagataataatgacatcaa

SEQ ID NO: 108945 - DNA, 22 bp, Artificial Sequence
  chemically synthesized
aagataataatgacatcaatat

SEQ ID NO: 108946 - DNA, 22 bp, Artificial Sequence
  chemically synthesized
tttctcaaaatacattctcagg

SEQ ID NO: 108947 - DNA, 22 bp, Artificial Sequence
  chemically synthesized
ctcaaaatacattctcagggtt

SEQ ID NO: 108948 - DNA, 22 bp, Artificial Sequence
  chemically synthesized
tcaaaatacattctcagggtta

SEQ ID NO: 108949 - DNA, 22 bp, Artificial Sequence
  chemically synthesized
aaaatacattctcagggttact

SEQ ID NO: 108950 - DNA, 22 bp, Artificial Sequence
  chemically synthesized
tcagggttactcatactatttg

SEQ ID NO: 108951 - DNA, 22 bp, Artificial Sequence
  chemically synthesized
agggttactcatactatttgta

SEQ ID NO: 108952 - DNA, 22 bp, Artificial Sequence
  chemically synthesized
ctcatactatttgtattcttaa

SEQ ID NO: 108953 - DNA, 22 bp, Artificial Sequence
  chemically synthesized
atactatttgtattcttaactg

SEQ ID NO: 108954 - DNA, 22 bp, Artificial Sequence
  chemically synthesized
tttgtattcttaactgcacatt

SEQ ID NO: 108955 - DNA, 22 bp, Artificial Sequence
  chemically synthesized
gtattcttaactgcacattcca

SEQ ID NO: 108956 - DNA, 22 bp, Artificial Sequence
  chemically synthesized
tattcttaactgcacattccag

SEQ ID NO: 108957 - DNA, 22 bp, Artificial Sequence
  chemically synthesized
ttaactgcacattccaggatct

SEQ ID NO: 108958 - DNA, 22 bp, Artificial Sequence
  chemically synthesized
aactgcacattccaggatctat

SEQ ID NO: 108959 - DNA, 22 bp, Artificial Sequence
  chemically synthesized
actgcacattccaggatctatc

SEQ ID NO: 108960 - DNA, 22 bp, Artificial Sequence
  chemically synthesized
cacattccaggatctatctcct

SEQ ID NO: 108961 - DNA, 22 bp, Artificial Sequence
  chemically synthesized
caggatctatctcctacctacg

SEQ ID NO: 108962 - DNA, 22 bp, Artificial Sequence
  chemically synthesized
tctcctacctacgtaatcaaat

SEQ ID NO: 108963 - DNA, 22 bp, Artificial Sequence
  chemically synthesized
ctacctacgtaatcaaattctt

SEQ ID NO: 108964 - DNA, 22 bp, Artificial Sequence
  chemically synthesized
cctacgtaatcaaattcttgga

SEQ ID NO: 108965 - DNA, 22 bp, Artificial Sequence
  chemically synthesized
cgtaatcaaattcttggagttt

SEQ ID NO: 108966 - DNA, 22 bp, Artificial Sequence
  chemically synthesized
ttggagtttcaactgtttatat

SEQ ID NO: 108967 - DNA, 22 bp, Artificial Sequence
  chemically synthesized
ggagtttcaactgtttatatgc

SEQ ID NO: 108968 - DNA, 22 bp, Artificial Sequence
  chemically synthesized
gagtttcaactgtttatatgca

SEQ ID NO: 108969 - DNA, 22 bp, Artificial Sequence
  chemically synthesized
caactgtttatatgcatttaag

SEQ ID NO: 108970 - DNA, 22 bp, Artificial Sequence
  chemically synthesized
aactgtttatatgcatttaagc

SEQ ID NO: 108971 - DNA, 22 bp, Artificial Sequence
  chemically synthesized
tttatatgcatttaagcattct

SEQ ID NO: 108972 - DNA, 22 bp, Artificial Sequence
  chemically synthesized
atatgcatttaagcattctctt

SEQ ID NO: 108973 - DNA, 22 bp, Artificial Sequence
  chemically synthesized
tatgcatttaagcattctcttc

SEQ ID NO: 108974 - DNA, 22 bp, Artificial Sequence
  chemically synthesized
aagcattctcttcagaaaaaaa

SEQ ID NO: 108975 - DNA, 22 bp, Artificial Sequence
  chemically synthesized
agcattctcttcagaaaaaaaa

SEQ ID NO: 108976 - DNA, 22 bp, Artificial Sequence
  chemically synthesized
tcttcagaaaaaaaattatgta

SEQ ID NO: 108977 - DNA, 22 bp, Artificial Sequence
  chemically synthesized
ttcagaaaaaaaattatgtaaa

SEQ ID NO: 108978 - DNA, 22 bp, Artificial Sequence
  chemically synthesized
cagaaaaaaaattatgtaaact

SEQ ID NO: 108979 - DNA, 22 bp, Artificial Sequence
  chemically synthesized
agaaaaaaaattatgtaaacta

SEQ ID NO: 108980 - DNA, 22 bp, Artificial Sequence
  chemically synthesized
tgtaaactacaacttctaaact

SEQ ID NO: 108981 - DNA, 22 bp, Artificial Sequence
  chemically synthesized
caacttctaaactgttaccctt

SEQ ID NO: 108982 - DNA, 22 bp, Artificial Sequence
  chemically synthesized
ctaaactgttacccttaactat

SEQ ID NO: 108983 - DNA, 22 bp, Artificial Sequence
  chemically synthesized
taaactgttacccttaactatg

SEQ ID NO: 108984 - DNA, 22 bp, Artificial Sequence
  chemically synthesized
aactgttacccttaactatgca

SEQ ID NO: 108985 - DNA, 22 bp, Artificial Sequence
  chemically synthesized
ttacccttaactatgcagattt

SEQ ID NO: 108986 - DNA, 22 bp, Artificial Sequence
  chemically synthesized
cccttaactatgcagattttaa

SEQ ID NO: 108987 - DNA, 22 bp, Artificial Sequence
  chemically synthesized
aactatgcagattttaaagaat

SEQ ID NO: 108988 - DNA, 22 bp, Artificial Sequence
  chemically synthesized
actatgcagattttaaagaatt

SEQ ID NO: 108989 - DNA, 22 bp, Artificial Sequence
  chemically synthesized
tgcagattttaaagaattcgta

SEQ ID NO: 108990 - DNA, 22 bp, Artificial Sequence
  chemically synthesized
taaagaattcgtattctatggg

SEQ ID NO: 108991 - DNA, 22 bp, Artificial Sequence
  chemically synthesized
aaagaattcgtattctatgggg

SEQ ID NO: 108992 - DNA, 22 bp, Artificial Sequence
  chemically synthesized
aagaattcgtattctatggggc

SEQ ID NO: 108993 - DNA, 22 bp, Artificial Sequence
  chemically synthesized
gtattctatggggcattcaagg

SEQ ID NO: 108994 - DNA, 22 bp, Artificial Sequence
  chemically synthesized
tatggggcattcaaggggattt

SEQ ID NO: 108995 - DNA, 22 bp, Artificial Sequence
  chemically synthesized
tggggcattcaaggggatttcc

SEQ ID NO: 108996 - DNA, 22 bp, Artificial Sequence
  chemically synthesized
aaggggatttccagaaagctaa

SEQ ID NO: 108997 - DNA, 22 bp, Artificial Sequence
  chemically synthesized
ccagaaagctaacactaatttt

SEQ ID NO: 108998 - DNA, 22 bp, Artificial Sequence
  chemically synthesized
cagaaagctaacactaattttt

SEQ ID NO: 108999 - DNA, 22 bp, Artificial Sequence
  chemically synthesized
acactaatttttttctggtcta

SEQ ID NO: 109000 - DNA, 22 bp, Artificial Sequence
  chemically synthesized
atttttttctggtctaccacct

SEQ ID NO: 109001 - DNA, 22 bp, Artificial Sequence
  chemically synthesized
ttttctggtctaccacctaaac

SEQ ID NO: 109002 - DNA, 22 bp, Artificial Sequence
  chemically synthesized
tttctggtctaccacctaaacc

SEQ ID NO: 109003 - DNA, 22 bp, Artificial Sequence
  chemically synthesized
ttctggtctaccacctaaacct

SEQ ID NO: 109004 - DNA, 22 bp, Artificial Sequence
  chemically synthesized
tctggtctaccacctaaacctg

SEQ ID NO: 109005 - DNA, 22 bp, Artificial Sequence
  chemically synthesized
ctggtctaccacctaaacctgt

SEQ ID NO: 109006 - DNA, 22 bp, Artificial Sequence
  chemically synthesized
tggtctaccacctaaacctgta

SEQ ID NO: 109007 - DNA, 22 bp, Artificial Sequence
  chemically synthesized
gtctaccacctaaacctgtaat

SEQ ID NO: 109008 - DNA, 22 bp, Artificial Sequence
  chemically synthesized
ccacctaaacctgtaattgcct

SEQ ID NO: 109009 - DNA, 22 bp, Artificial Sequence
  chemically synthesized
aacctgtaattgccttcacagt

SEQ ID NO: 109010 - DNA, 22 bp, Artificial Sequence
  chemically synthesized
taattgccttcacagtagtgat

SEQ ID NO: 109011 - DNA, 22 bp, Artificial Sequence
  chemically synthesized
ccttcacagtagtgatccctaa

SEQ ID NO: 109012 - DNA, 22 bp, Artificial Sequence
  chemically synthesized
cacagtagtgatccctaatcca

SEQ ID NO: 109013 - DNA, 22 bp, Artificial Sequence
  chemically synthesized
acagtagtgatccctaatccac

SEQ ID NO: 109014 - DNA, 22 bp, Artificial Sequence
  chemically synthesized
atccacattttcctgcatgtaa

SEQ ID NO: 109015 - DNA, 22 bp, Artificial Sequence
  chemically synthesized
tcctgcatgtaaagacttacct

SEQ ID NO: 109016 - DNA, 22 bp, Artificial Sequence
  chemically synthesized
cctgcatgtaaagacttacctg

SEQ ID NO: 109017 - DNA, 22 bp, Artificial Sequence
  chemically synthesized
ctgcatgtaaagacttacctga

SEQ ID NO: 109018 - DNA, 22 bp, Artificial Sequence
  chemically synthesized
catgtaaagacttacctgaatt

SEQ ID NO: 109019 - DNA, 22 bp, Artificial Sequence
  chemically synthesized
acctgaattatcagctaaagtc

SEQ ID NO: 109020 - DNA, 22 bp, Artificial Sequence
  chemically synthesized
cctgaattatcagctaaagtct

SEQ ID NO: 109021 - DNA, 22 bp, Artificial Sequence
  chemically synthesized
aattatcagctaaagtctcaac

SEQ ID NO: 109022 - DNA, 22 bp, Artificial Sequence
  chemically synthesized
tcagctaaagtctcaacagcct

SEQ ID NO: 109023 - DNA, 22 bp, Artificial Sequence
  chemically synthesized
aagtctcaacagcctaagaaag

SEQ ID NO: 109024 - DNA, 22 bp, Artificial Sequence
  chemically synthesized
aacagcctaagaaagaaaagtg

SEQ ID NO: 109025 - DNA, 22 bp, Artificial Sequence
  chemically synthesized
agaaagaaaagtgtgggaagag

SEQ ID NO: 109026 - DNA, 22 bp, Artificial Sequence
  chemically synthesized
tgccactaccactgtagctaag

SEQ ID NO: 109027 - DNA, 22 bp, Artificial Sequence
  chemically synthesized
ccactaccactgtagctaagga

SEQ ID NO: 109028 - DNA, 22 bp, Artificial Sequence
  chemically synthesized
ccactgtagctaaggagcagtc

SEQ ID NO: 109029 - DNA, 22 bp, Artificial Sequence
  chemically synthesized
tagctaaggagcagtcagattg

SEQ ID NO: 109030 - DNA, 22 bp, Artificial Sequence
  chemically synthesized
aggagcagtcagattgagaaag

SEQ ID NO: 109031 - DNA, 22 bp, Artificial Sequence
  chemically synthesized
agaaagagacacttggcctcca

SEQ ID NO: 109032 - DNA, 22 bp, Artificial Sequence
  chemically synthesized
ggcctccagatttcatggacta

SEQ ID NO: 109033 - DNA, 22 bp, Artificial Sequence
  chemically synthesized
gcctccagatttcatggactag

SEQ ID NO: 109034 - DNA, 22 bp, Artificial Sequence
  chemically synthesized
cagatttcatggactagtgatg

SEQ ID NO: 109035 - DNA, 22 bp, Artificial Sequence
  chemically synthesized
catggactagtgatggggaaca

SEQ ID NO: 109036 - DNA, 22 bp, Artificial Sequence
  chemically synthesized
atggactagtgatggggaacag

SEQ ID NO: 109037 - DNA, 22 bp, Artificial Sequence
  chemically synthesized
gtgatggggaacagacattcac

SEQ ID NO: 109038 - DNA, 22 bp, Artificial Sequence
  chemically synthesized
acgattagtgtgaattaccctc

SEQ ID NO: 109039 - DNA, 22 bp, Artificial Sequence
  chemically synthesized
gtgtgaattaccctcttgtaga

SEQ ID NO: 109040 - DNA, 22 bp, Artificial Sequence
  chemically synthesized
ccctcttgtagaatccttcagt

SEQ ID NO: 109041 - DNA, 22 bp, Artificial Sequence
  chemically synthesized
ttgtagaatccttcagtactac

SEQ ID NO: 109042 - DNA, 22 bp, Artificial Sequence
  chemically synthesized
gtagaatccttcagtactactc

SEQ ID NO: 109043 - DNA, 22 bp, Artificial Sequence
  chemically synthesized
tagaatccttcagtactactca

SEQ ID NO: 109044 - DNA, 22 bp, Artificial Sequence
  chemically synthesized
cagtactactcactacttgtga

SEQ ID NO: 109045 - DNA, 22 bp, Artificial Sequence
  chemically synthesized
agtactactcactacttgtgac

SEQ ID NO: 109046 - DNA, 22 bp, Artificial Sequence
  chemically synthesized
ctcactacttgtgacaatagct

SEQ ID NO: 109047 - DNA, 22 bp, Artificial Sequence
  chemically synthesized
actacttgtgacaatagctcag

SEQ ID NO: 109048 - DNA, 22 bp, Artificial Sequence
  chemically synthesized
cttgtgacaatagctcagtcta

SEQ ID NO: 109049 - DNA, 22 bp, Artificial Sequence
  chemically synthesized
gtgacaatagctcagtctaatt

SEQ ID NO: 109050 - DNA, 22 bp, Artificial Sequence
  chemically synthesized
tgacaatagctcagtctaatta

SEQ ID NO: 109051 - DNA, 22 bp, Artificial Sequence
  chemically synthesized
agtctaattataagttagactt

SEQ ID NO: 109052 - DNA, 22 bp, Artificial Sequence
  chemically synthesized
attataagttagactttggggc

SEQ ID NO: 109053 - DNA, 22 bp, Artificial Sequence
  chemically synthesized
taagttagactttggggctgga

SEQ ID NO: 109054 - DNA, 22 bp, Artificial Sequence
  chemically synthesized
gactttggggctggaataaatg

SEQ ID NO: 109055 - DNA, 22 bp, Artificial Sequence
  chemically synthesized
tggggctggaataaatgattag

SEQ ID NO: 109056 - DNA, 22 bp, Artificial Sequence
  chemically synthesized
ggggctggaataaatgattagg

SEQ ID NO: 109057 - DNA, 22 bp, Artificial Sequence
  chemically synthesized
gggctggaataaatgattaggc

SEQ ID NO: 109058 - DNA, 22 bp, Artificial Sequence
  chemically synthesized
gaataaatgattaggccagcca

SEQ ID NO: 109059 - DNA, 22 bp, Artificial Sequence
  chemically synthesized
ggccagccaaagacatcactta

SEQ ID NO: 109060 - DNA, 22 bp, Artificial Sequence
  chemically synthesized
ataatagtgtatctccttcagt

SEQ ID NO: 109061 - DNA, 22 bp, Artificial Sequence
  chemically synthesized
taatagtgtatctccttcagtt

SEQ ID NO: 109062 - DNA, 22 bp, Artificial Sequence
  chemically synthesized
cttcagtttaaacatcttactg

SEQ ID NO: 109063 - DNA, 22 bp, Artificial Sequence
  chemically synthesized
cagtttaaacatcttactgttt

SEQ ID NO: 109064 - DNA, 22 bp, Artificial Sequence
  chemically synthesized
agtttaaacatcttactgtttc

SEQ ID NO: 109065 - DNA, 22 bp, Artificial Sequence
  chemically synthesized
aaacatcttactgtttcttatt

SEQ ID NO: 109066 - DNA, 22 bp, Artificial Sequence
  chemically synthesized
aacatcttactgtttcttattt

SEQ ID NO: 109067 - DNA, 22 bp, Artificial Sequence
  chemically synthesized
actgtttcttatttacaagtag

SEQ ID NO: 109068 - DNA, 22 bp, Artificial Sequence
  chemically synthesized
ctgtttcttatttacaagtagt

SEQ ID NO: 109069 - DNA, 22 bp, Artificial Sequence
  chemically synthesized
tttcttatttacaagtagtgtc

SEQ ID NO: 109070 - DNA, 22 bp, Artificial Sequence
  chemically synthesized
cttatttacaagtagtgtcttt

SEQ ID NO: 109071 - DNA, 22 bp, Artificial Sequence
  chemically synthesized
ttatttacaagtagtgtctttt

SEQ ID NO: 109072 - DNA, 22 bp, Artificial Sequence
  chemically synthesized
atttacaagtagtgtctttttc

SEQ ID NO: 109073 - DNA, 22 bp, Artificial Sequence
  chemically synthesized
tttacaagtagtgtctttttct

SEQ ID NO: 109074 - DNA, 22 bp, Artificial Sequence
  chemically synthesized
acaagtagtgtctttttctttt

SEQ ID NO: 109075 - DNA, 22 bp, Artificial Sequence
  chemically synthesized
caagtagtgtctttttcttttt

SEQ ID NO: 109076 - DNA, 22 bp, Artificial Sequence
  chemically synthesized
tttctttttaaattatttttct

SEQ ID NO: 109077 - DNA, 22 bp, Artificial Sequence
  chemically synthesized
ttctttttaaattatttttcta

SEQ ID NO: 109078 - DNA, 22 bp, Artificial Sequence
  chemically synthesized
tctttttaaattatttttctat

SEQ ID NO: 109079 - DNA, 22 bp, Artificial Sequence
  chemically synthesized
ctttttaaattatttttctata

SEQ ID NO: 109080 - DNA, 22 bp, Artificial Sequence
  chemically synthesized
tttttaaattatttttctatag

SEQ ID NO: 109081 - DNA, 22 bp, Artificial Sequence
  chemically synthesized
tttaaattatttttctataggc

SEQ ID NO: 109082 - DNA, 22 bp, Artificial Sequence
  chemically synthesized
ttaaattatttttctataggcc

SEQ ID NO: 109083 - DNA, 22 bp, Artificial Sequence
  chemically synthesized
taaattatttttctataggcct

SEQ ID NO: 109084 - DNA, 22 bp, Artificial Sequence
  chemically synthesized
aaattatttttctataggccta

SEQ ID NO: 109085 - DNA, 22 bp, Artificial Sequence
  chemically synthesized
aattatttttctataggcctac

SEQ ID NO: 109086 - DNA, 22 bp, Artificial Sequence
  chemically synthesized
tttttctataggcctactgaag

SEQ ID NO: 109087 - DNA, 22 bp, Artificial Sequence
  chemically synthesized
ttctataggcctactgaagtaa

SEQ ID NO: 109088 - DNA, 22 bp, Artificial Sequence
  chemically synthesized
tctataggcctactgaagtaat

SEQ ID NO: 109089 - DNA, 22 bp, Artificial Sequence
  chemically synthesized
ctataggcctactgaagtaatt

SEQ ID NO: 109090 - DNA, 22 bp, Artificial Sequence
  chemically synthesized
tataggcctactgaagtaattc

SEQ ID NO: 109091 - DNA, 22 bp, Artificial Sequence
  chemically synthesized
taggcctactgaagtaattccc

SEQ ID NO: 109092 - DNA, 22 bp, Artificial Sequence
  chemically synthesized
ctgaagtaattccctagaatct

SEQ ID NO: 109093 - DNA, 22 bp, Artificial Sequence
  chemically synthesized
aagtaattccctagaatctgac

SEQ ID NO: 109094 - DNA, 22 bp, Artificial Sequence
  chemically synthesized
cctagaatctgacctctctcat

SEQ ID NO: 109095 - DNA, 22 bp, Artificial Sequence
  chemically synthesized
gaatctgacctctctcatttca

SEQ ID NO: 109096 - DNA, 22 bp, Artificial Sequence
  chemically synthesized
acctctctcatttcaagttctc

SEQ ID NO: 109097 - DNA, 22 bp, Artificial Sequence
  chemically synthesized
tctcatttcaagttctccattt

SEQ ID NO: 109098 - DNA, 22 bp, Artificial Sequence
  chemically synthesized
tcatttcaagttctccatttat

SEQ ID NO: 109099 - DNA, 22 bp, Artificial Sequence
  chemically synthesized
atttcaagttctccatttatat

SEQ ID NO: 109100 - DNA, 22 bp, Artificial Sequence
  chemically synthesized
caagttctccatttatatttaa

SEQ ID NO: 109101 - DNA, 22 bp, Artificial Sequence
  chemically synthesized
aagttctccatttatatttaaa

SEQ ID NO: 109102 - DNA, 22 bp, Artificial Sequence
  chemically synthesized
tccatttatatttaaacatcca

SEQ ID NO: 109103 - DNA, 22 bp, Artificial Sequence
  chemically synthesized
catttatatttaaacatccatc

SEQ ID NO: 109104 - DNA, 22 bp, Artificial Sequence
  chemically synthesized
atatttaaacatccatcttcct

SEQ ID NO: 109105 - DNA, 22 bp, Artificial Sequence
  chemically synthesized
tatttaaacatccatcttcctg

SEQ ID NO: 109106 - DNA, 22 bp, Artificial Sequence
  chemically synthesized
aaacatccatcttcctggtttc

SEQ ID NO: 109107 - DNA, 22 bp, Artificial Sequence
  chemically synthesized
aacatccatcttcctggtttcc

SEQ ID NO: 109108 - DNA, 22 bp, Artificial Sequence
  chemically synthesized
cctggtttccttccctttatcc

SEQ ID NO: 109109 - DNA, 22 bp, Artificial Sequence
  chemically synthesized
ctggtttccttccctttatccc

SEQ ID NO: 109110 - DNA, 22 bp, Artificial Sequence
  chemically synthesized
gtttccttccctttatccccag

SEQ ID NO: 109111 - DNA, 22 bp, Artificial Sequence
  chemically synthesized
ccttccctttatccccagccat

SEQ ID NO: 109112 - DNA, 22 bp, Artificial Sequence
  chemically synthesized
cttccctttatccccagccata

SEQ ID NO: 109113 - DNA, 22 bp, Artificial Sequence
  chemically synthesized
ccctttatccccagccataggc

SEQ ID NO: 109114 - DNA, 22 bp, Artificial Sequence
  chemically synthesized
cctttatccccagccataggct

SEQ ID NO: 109115 - DNA, 22 bp, Artificial Sequence
  chemically synthesized
tatccccagccataggcttctg

SEQ ID NO: 109116 - DNA, 22 bp, Artificial Sequence
  chemically synthesized
atccccagccataggcttctga

SEQ ID NO: 109117 - DNA, 22 bp, Artificial Sequence
  chemically synthesized
tccccagccataggcttctgaa

SEQ ID NO: 109118 - DNA, 22 bp, Artificial Sequence
  chemically synthesized
ctgaatctgttctccccaatac

SEQ ID NO: 109119 - DNA, 22 bp, Artificial Sequence
  chemically synthesized
tgaatctgttctccccaatact

SEQ ID NO: 109120 - DNA, 22 bp, Artificial Sequence
  chemically synthesized
aatctgttctccccaatactga

SEQ ID NO: 109121 - DNA, 22 bp, Artificial Sequence
  chemically synthesized
ttctccccaatactgagtgaga

SEQ ID NO: 109122 - DNA, 22 bp, Artificial Sequence
  chemically synthesized
tccccaatactgagtgagagct

SEQ ID NO: 109123 - DNA, 22 bp, Artificial Sequence
  chemically synthesized
cccaatactgagtgagagctat

SEQ ID NO: 109124 - DNA, 22 bp, Artificial Sequence
  chemically synthesized
agtgagagctatttccctgctt

SEQ ID NO: 109125 - DNA, 22 bp, Artificial Sequence
  chemically synthesized
tttccctgcttaaacgtggtgc

SEQ ID NO: 109126 - DNA, 22 bp, Artificial Sequence
  chemically synthesized
ccctgcttaaacgtggtgctgt

SEQ ID NO: 109127 - DNA, 22 bp, Artificial Sequence
  chemically synthesized
cctgcttaaacgtggtgctgtc

SEQ ID NO: 109128 - DNA, 22 bp, Artificial Sequence
  chemically synthesized
cttaaacgtggtgctgtctttt

SEQ ID NO: 109129 - DNA, 22 bp, Artificial Sequence
  chemically synthesized
aaacgtggtgctgtcttttact

SEQ ID NO: 109130 - DNA, 22 bp, Artificial Sequence
  chemically synthesized
aacgtggtgctgtcttttactg

SEQ ID NO: 109131 - DNA, 22 bp, Artificial Sequence
  chemically synthesized
tcttttactgaagagaagagat

SEQ ID NO: 109132 - DNA, 22 bp, Artificial Sequence
  chemically synthesized
ttactgaagagaagagattagt

SEQ ID NO: 109133 - DNA, 22 bp, Artificial Sequence
  chemically synthesized
tactgaagagaagagattagtc

SEQ ID NO: 109134 - DNA, 22 bp, Artificial Sequence
  chemically synthesized
actgaagagaagagattagtcc

SEQ ID NO: 109135 - DNA, 22 bp, Artificial Sequence
  chemically synthesized
ctgaagagaagagattagtcct

SEQ ID NO: 109136 - DNA, 22 bp, Artificial Sequence
  chemically synthesized
aagagaagagattagtcctttg

SEQ ID NO: 109137 - DNA, 22 bp, Artificial Sequence
  chemically synthesized
gtcctttgagaaggttttaata

SEQ ID NO: 109138 - DNA, 22 bp, Artificial Sequence
  chemically synthesized
tgagaaggttttaatattcctt

SEQ ID NO: 109139 - DNA, 22 bp, Artificial Sequence
  chemically synthesized
gagaaggttttaatattccttc

SEQ ID NO: 109140 - DNA, 22 bp, Artificial Sequence
  chemically synthesized
agaaggttttaatattccttct

SEQ ID NO: 109141 - DNA, 22 bp, Artificial Sequence
  chemically synthesized
taatattccttctgccactaga

SEQ ID NO: 109142 - DNA, 22 bp, Artificial Sequence
  chemically synthesized
aatattccttctgccactagac

SEQ ID NO: 109143 - DNA, 22 bp, Artificial Sequence
  chemically synthesized
atattccttctgccactagact

SEQ ID NO: 109144 - DNA, 22 bp, Artificial Sequence
  chemically synthesized
cttctgccactagactaggggc

SEQ ID NO: 109145 - DNA, 22 bp, Artificial Sequence
  chemically synthesized
ctgccactagactaggggcttc

SEQ ID NO: 109146 - DNA, 22 bp, Artificial Sequence
  chemically synthesized
tgccactagactaggggcttct

SEQ ID NO: 109147 - DNA, 22 bp, Artificial Sequence
  chemically synthesized
ccactagactaggggcttcttg

SEQ ID NO: 109148 - DNA, 22 bp, Artificial Sequence
  chemically synthesized
gactaggggcttcttgcatata

SEQ ID NO: 109149 - DNA, 22 bp, Artificial Sequence
  chemically synthesized
ggggcttcttgcatatagacat

SEQ ID NO: 109150 - DNA, 22 bp, Artificial Sequence
  chemically synthesized
cttgcatatagacatggtgttt

SEQ ID NO: 109151 - DNA, 22 bp, Artificial Sequence
  chemically synthesized
ttgcatatagacatggtgttta

SEQ ID NO: 109152 - DNA, 22 bp, Artificial Sequence
  chemically synthesized
gcatatagacatggtgtttatt

SEQ ID NO: 109153 - DNA, 22 bp, Artificial Sequence
  chemically synthesized
catatagacatggtgtttattt

SEQ ID NO: 109154 - DNA, 22 bp, Artificial Sequence
  chemically synthesized
atttgctttgctcaacaccttg

SEQ ID NO: 109155 - DNA, 22 bp, Artificial Sequence
  chemically synthesized
tttgctttgctcaacaccttgc

SEQ ID NO: 109156 - DNA, 22 bp, Artificial Sequence
  chemically synthesized
gctttgctcaacaccttgcaaa

SEQ ID NO: 109157 - DNA, 22 bp, Artificial Sequence
  chemically synthesized
ctttgctcaacaccttgcaaag

SEQ ID NO: 109158 - DNA, 22 bp, Artificial Sequence
  chemically synthesized
tgctcaacaccttgcaaagtat

SEQ ID NO: 109159 - DNA, 22 bp, Artificial Sequence
  chemically synthesized
gctcaacaccttgcaaagtatc

SEQ ID NO: 109160 - DNA, 22 bp, Artificial Sequence
  chemically synthesized
ctcaacaccttgcaaagtatct

SEQ ID NO: 109161 - DNA, 22 bp, Artificial Sequence
  chemically synthesized
aacaccttgcaaagtatctaac

SEQ ID NO: 109162 - DNA, 22 bp, Artificial Sequence
  chemically synthesized
gcaaagtatctaacatgtgact

SEQ ID NO: 109163 - DNA, 22 bp, Artificial Sequence
  chemically synthesized
caaagtatctaacatgtgactg

SEQ ID NO: 109164 - DNA, 22 bp, Artificial Sequence
  chemically synthesized
acatgtgactgataaacatttc

SEQ ID NO: 109165 - DNA, 22 bp, Artificial Sequence
  chemically synthesized
ataaacatttcttagttcacct

SEQ ID NO: 109166 - DNA, 22 bp, Artificial Sequence
  chemically synthesized
cttagttcacctaatatttgtg

SEQ ID NO: 109167 - DNA, 22 bp, Artificial Sequence
  chemically synthesized
ttagttcacctaatatttgtga

SEQ ID NO: 109168 - DNA, 22 bp, Artificial Sequence
  chemically synthesized
agttcacctaatatttgtgaac

SEQ ID NO: 109169 - DNA, 22 bp, Artificial Sequence
  chemically synthesized
gttcacctaatatttgtgaaca

SEQ ID NO: 109170 - DNA, 22 bp, Artificial Sequence
  chemically synthesized
acctaatatttgtgaacacgca

SEQ ID NO: 109171 - DNA, 22 bp, Artificial Sequence
  chemically synthesized
atatttgtgaacacgcatcatg

SEQ ID NO: 109172 - DNA, 22 bp, Artificial Sequence
  chemically synthesized
gtgaacacgcatcatgtgacag

SEQ ID NO: 109173 - DNA, 22 bp, Artificial Sequence
  chemically synthesized
tgaacacgcatcatgtgacagc

SEQ ID NO: 109174 - DNA, 22 bp, Artificial Sequence
  chemically synthesized
aaagctctctggaattaaatgg

SEQ ID NO: 109175 - DNA, 22 bp, Artificial Sequence
  chemically synthesized
aagctctctggaattaaatggt

SEQ ID NO: 109176 - DNA, 22 bp, Artificial Sequence
  chemically synthesized
tctggaattaaatggtaataag

SEQ ID NO: 109177 - DNA, 22 bp, Artificial Sequence
  chemically synthesized
tggaattaaatggtaataagac

SEQ ID NO: 109178 - DNA, 22 bp, Artificial Sequence
  chemically synthesized
gaattaaatggtaataagacaa

SEQ ID NO: 109179 - DNA, 22 bp, Artificial Sequence
  chemically synthesized
aatggtaataagacaaagtccc

SEQ ID NO: 109180 - DNA, 22 bp, Artificial Sequence
  chemically synthesized
atcttataaaccataaattaag

SEQ ID NO: 109181 - DNA, 22 bp, Artificial Sequence
  chemically synthesized
ataaaccataaattaagttgaa

SEQ ID NO: 109182 - DNA, 22 bp, Artificial Sequence
  chemically synthesized
taaaccataaattaagttgaaa

SEQ ID NO: 109183 - DNA, 22 bp, Artificial Sequence
  chemically synthesized
agttgaaaaataaataagacaa

SEQ ID NO: 109184 - DNA, 22 bp, Artificial Sequence
  chemically synthesized
aaaaataaataagacaatttta

SEQ ID NO: 109185 - DNA, 22 bp, Artificial Sequence
  chemically synthesized
taaacaaatataaatgcaagtt

SEQ ID NO: 109186 - DNA, 22 bp, Artificial Sequence
  chemically synthesized
aaacaaatataaatgcaagttt

SEQ ID NO: 109187 - DNA, 22 bp, Artificial Sequence
  chemically synthesized
aacaaatataaatgcaagttta

SEQ ID NO: 109188 - DNA, 22 bp, Artificial Sequence
  chemically synthesized
aacataaaacagtactacttga

SEQ ID NO: 109189 - DNA, 22 bp, Artificial Sequence
  chemically synthesized
acataaaacagtactacttgat

SEQ ID NO: 109190 - DNA, 22 bp, Artificial Sequence
  chemically synthesized
cttgatgtagattaattggatg

SEQ ID NO: 109191 - DNA, 22 bp, Artificial Sequence
  chemically synthesized
gatgtagattaattggatggta

SEQ ID NO: 109192 - DNA, 22 bp, Artificial Sequence
  chemically synthesized
atgtagattaattggatggtat

SEQ ID NO: 109193 - DNA, 22 bp, Artificial Sequence
  chemically synthesized
attggatggtattgtatacaag

SEQ ID NO: 109194 - DNA, 22 bp, Artificial Sequence
  chemically synthesized
gatggtattgtatacaagatag

SEQ ID NO: 109195 - DNA, 22 bp, Artificial Sequence
  chemically synthesized
tatacaagatagtatagcagtt

SEQ ID NO: 109196 - DNA, 22 bp, Artificial Sequence
  chemically synthesized
gaggggcctagaactgcaccta

SEQ ID NO: 109197 - DNA, 22 bp, Artificial Sequence
  chemically synthesized
aggggcctagaactgcacctat

SEQ ID NO: 109198 - DNA, 22 bp, Artificial Sequence
  chemically synthesized
gaactgcacctatgaggaggtc

SEQ ID NO: 109199 - DNA, 22 bp, Artificial Sequence
  chemically synthesized
cacctatgaggaggtcccattt

SEQ ID NO: 109200 - DNA, 22 bp, Artificial Sequence
  chemically synthesized
tgaggaggtcccatttgaactg

SEQ ID NO: 109201 - DNA, 22 bp, Artificial Sequence
  chemically synthesized
gaactgagacctcaatacaaaa

SEQ ID NO: 109202 - DNA, 22 bp, Artificial Sequence
  chemically synthesized
aactgagacctcaatacaaaag

SEQ ID NO: 109203 - DNA, 22 bp, Artificial Sequence
  chemically synthesized
agacctcaatacaaaagaaaac

SEQ ID NO: 109204 - DNA, 22 bp, Artificial Sequence
  chemically synthesized
aatacaaaagaaaacctgaccg

SEQ ID NO: 109205 - DNA, 22 bp, Artificial Sequence
  chemically synthesized
accgtatacagacctagaggaa

SEQ ID NO: 109206 - DNA, 22 bp, Artificial Sequence
  chemically synthesized
gaggaaaactgttccagaggga

SEQ ID NO: 109207 - DNA, 22 bp, Artificial Sequence
  chemically synthesized
ttccagagggaaaatcagcatg

SEQ ID NO: 109208 - DNA, 22 bp, Artificial Sequence
  chemically synthesized
cagagggaaaatcagcatgact

SEQ ID NO: 109209 - DNA, 22 bp, Artificial Sequence
  chemically synthesized
gcatttgataagaaaacaggag

SEQ ID NO: 109210 - DNA, 22 bp, Artificial Sequence
  chemically synthesized
gataagaaaacaggagagggac

SEQ ID NO: 109211 - DNA, 22 bp, Artificial Sequence
  chemically synthesized
ataagaaaacaggagagggaca

SEQ ID NO: 109212 - DNA, 22 bp, Artificial Sequence
  chemically synthesized
acagaccaccacggaatttttg

SEQ ID NO: 109213 - DNA, 22 bp, Artificial Sequence
  chemically synthesized
cagaccaccacggaatttttgt

SEQ ID NO: 109214 - DNA, 22 bp, Artificial Sequence
  chemically synthesized
ttgttttgttttgttttcttct

SEQ ID NO: 109215 - DNA, 22 bp, Artificial Sequence
  chemically synthesized
tgttttgttttgttttcttctt

SEQ ID NO: 109216 - DNA, 22 bp, Artificial Sequence
  chemically synthesized
gttttgttttgttttcttctta

SEQ ID NO: 109217 - DNA, 22 bp, Artificial Sequence
  chemically synthesized
ttttgttttgttttcttcttac

SEQ ID NO: 109218 - DNA, 22 bp, Artificial Sequence
  chemically synthesized
tgttttgttttcttcttactat

SEQ ID NO: 109219 - DNA, 22 bp, Artificial Sequence
  chemically synthesized
gttttgttttcttcttactata

SEQ ID NO: 109220 - DNA, 22 bp, Artificial Sequence
  chemically synthesized
ttttgttttcttcttactataa

SEQ ID NO: 109221 - DNA, 22 bp, Artificial Sequence
  chemically synthesized
tgttttcttcttactataaatg

SEQ ID NO: 109222 - DNA, 22 bp, Artificial Sequence
  chemically synthesized
gttttcttcttactataaatgt

SEQ ID NO: 109223 - DNA, 22 bp, Artificial Sequence
  chemically synthesized
ttttcttcttactataaatgta

SEQ ID NO: 109224 - DNA, 22 bp, Artificial Sequence
  chemically synthesized
tcttcttactataaatgtagta

SEQ ID NO: 109225 - DNA, 22 bp, Artificial Sequence
  chemically synthesized
cttcttactataaatgtagtaa

SEQ ID NO: 109226 - DNA, 22 bp, Artificial Sequence
  chemically synthesized
ttcttactataaatgtagtaaa

SEQ ID NO: 109227 - DNA, 22 bp, Artificial Sequence
  chemically synthesized
cttactataaatgtagtaaaga

SEQ ID NO: 109228 - DNA, 22 bp, Artificial Sequence
  chemically synthesized
ttactataaatgtagtaaagac

SEQ ID NO: 109229 - DNA, 22 bp, Artificial Sequence
  chemically synthesized
actataaatgtagtaaagacat

SEQ ID NO: 109230 - DNA, 22 bp, Artificial Sequence
  chemically synthesized
ctataaatgtagtaaagacatt

SEQ ID NO: 109231 - DNA, 22 bp, Artificial Sequence
  chemically synthesized
taaatgtagtaaagacattagg

SEQ ID NO: 109232 - DNA, 22 bp, Artificial Sequence
  chemically synthesized
ggacactttgaaaatcacaatg

SEQ ID NO: 109233 - DNA, 22 bp, Artificial Sequence
  chemically synthesized
tgaaaatcacaatggaaaatag

SEQ ID NO: 109234 - DNA, 22 bp, Artificial Sequence
  chemically synthesized
gaaaatcacaatggaaaatagt

SEQ ID NO: 109235 - DNA, 22 bp, Artificial Sequence
  chemically synthesized
aaaatcacaatggaaaatagtg

SEQ ID NO: 109236 - DNA, 22 bp, Artificial Sequence
  chemically synthesized
tgatttgtatttttaaattact

SEQ ID NO: 109237 - DNA, 22 bp, Artificial Sequence
  chemically synthesized
atttgtatttttaaattactca

SEQ ID NO: 109238 - DNA, 22 bp, Artificial Sequence
  chemically synthesized
gtatttttaaattactcactta

SEQ ID NO: 109239 - DNA, 22 bp, Artificial Sequence
  chemically synthesized
tatttttaaattactcacttag

SEQ ID NO: 109240 - DNA, 22 bp, Artificial Sequence
  chemically synthesized
ttaaattactcacttagactgc

SEQ ID NO: 109241 - DNA, 22 bp, Artificial Sequence
  chemically synthesized
taaattactcacttagactgct

SEQ ID NO: 109242 - DNA, 22 bp, Artificial Sequence
  chemically synthesized
aaattactcacttagactgcta

SEQ ID NO: 109243 - DNA, 22 bp, Artificial Sequence
  chemically synthesized
aattactcacttagactgctat

SEQ ID NO: 109244 - DNA, 22 bp, Artificial Sequence
  chemically synthesized
ctcacttagactgctatgtgaa

SEQ ID NO: 109245 - DNA, 22 bp, Artificial Sequence
  chemically synthesized
acttagactgctatgtgaagaa

SEQ ID NO: 109246 - DNA, 22 bp, Artificial Sequence
  chemically synthesized
agactgctatgtgaagaagact

SEQ ID NO: 109247 - DNA, 22 bp, Artificial Sequence
  chemically synthesized
gactgctatgtgaagaagacta

SEQ ID NO: 109248 - DNA, 22 bp, Artificial Sequence
  chemically synthesized
ctatgtgaagaagactaagcaa

SEQ ID NO: 109249 - DNA, 22 bp, Artificial Sequence
  chemically synthesized
tgtgaagaagactaagcaagag

SEQ ID NO: 109250 - DNA, 22 bp, Artificial Sequence
  chemically synthesized
agcaagagacaagaaaagagat

SEQ ID NO: 109251 - DNA, 22 bp, Artificial Sequence
  chemically synthesized
gaaagctattttaaaaatccat

SEQ ID NO: 109252 - DNA, 22 bp, Artificial Sequence
  chemically synthesized
ttttaaaaatccatatgaagag

SEQ ID NO: 109253 - DNA, 22 bp, Artificial Sequence
  chemically synthesized
taaaaatccatatgaagagtca

SEQ ID NO: 109254 - DNA, 22 bp, Artificial Sequence
  chemically synthesized
aaaaatccatatgaagagtcat

SEQ ID NO: 109255 - DNA, 22 bp, Artificial Sequence
  chemically synthesized
aaaatccatatgaagagtcatg

SEQ ID NO: 109256 - DNA, 22 bp, Artificial Sequence
  chemically synthesized
gactaggagagaagcaggggaa

SEQ ID NO: 109257 - DNA, 22 bp, Artificial Sequence
  chemically synthesized
actaggagagaagcaggggaaa

SEQ ID NO: 109258 - DNA, 22 bp, Artificial Sequence
  chemically synthesized
ggagagaagcaggggaaatgaa

SEQ ID NO: 109259 - DNA, 22 bp, Artificial Sequence
  chemically synthesized
aaacagagacagatgcattttt

SEQ ID NO: 109260 - DNA, 22 bp, Artificial Sequence
  chemically synthesized
aacagagacagatgcatttttg

SEQ ID NO: 109261 - DNA, 22 bp, Artificial Sequence
  chemically synthesized
ttgaagtagtgccaagatttgc

SEQ ID NO: 109262 - DNA, 22 bp, Artificial Sequence
  chemically synthesized
tgaagtagtgccaagatttgct

SEQ ID NO: 109263 - DNA, 22 bp, Artificial Sequence
  chemically synthesized
gaagtagtgccaagatttgctg

SEQ ID NO: 109264 - DNA, 22 bp, Artificial Sequence
  chemically synthesized
aagtagtgccaagatttgctga

SEQ ID NO: 109265 - DNA, 22 bp, Artificial Sequence
  chemically synthesized
gctgatatattaaaaatgggag

SEQ ID NO: 109266 - DNA, 22 bp, Artificial Sequence
  chemically synthesized
ctgatatattaaaaatgggagt

SEQ ID NO: 109267 - DNA, 22 bp, Artificial Sequence
  chemically synthesized
atatattaaaaatgggagtgag

SEQ ID NO: 109268 - DNA, 22 bp, Artificial Sequence
  chemically synthesized
aaaatgggagtgagggaaaaat

SEQ ID NO: 109269 - DNA, 22 bp, Artificial Sequence
  chemically synthesized
cccctagatttctgtttgaaca

SEQ ID NO: 109270 - DNA, 22 bp, Artificial Sequence
  chemically synthesized
ccctagatttctgtttgaacaa

SEQ ID NO: 109271 - DNA, 22 bp, Artificial Sequence
  chemically synthesized
gatttctgtttgaacaaatgaa

SEQ ID NO: 109272 - DNA, 22 bp, Artificial Sequence
  chemically synthesized
ctgtttgaacaaatgaaagaat

SEQ ID NO: 109273 - DNA, 22 bp, Artificial Sequence
  chemically synthesized
tgtttgaacaaatgaaagaatg

SEQ ID NO: 109274 - DNA, 22 bp, Artificial Sequence
  chemically synthesized
tttgaacaaatgaaagaatggt

SEQ ID NO: 109275 - DNA, 22 bp, Artificial Sequence
  chemically synthesized
gaacaaatgaaagaatggtgaa

SEQ ID NO: 109276 - DNA, 22 bp, Artificial Sequence
  chemically synthesized
aacaaatgaaagaatggtgaag

SEQ ID NO: 109277 - DNA, 22 bp, Artificial Sequence
  chemically synthesized
actcaaaatggaagtctgaggg

SEQ ID NO: 109278 - DNA, 22 bp, Artificial Sequence
  chemically synthesized
ctcaaaatggaagtctgagggg

SEQ ID NO: 109279 - DNA, 22 bp, Artificial Sequence
  chemically synthesized
aaaatggaagtctgagggggat

SEQ ID NO: 109280 - DNA, 22 bp, Artificial Sequence
  chemically synthesized
agggggatacatattcacttgt

SEQ ID NO: 109281 - DNA, 22 bp, Artificial Sequence
  chemically synthesized
acttgtgaggaaatcaagagtc

SEQ ID NO: 109282 - DNA, 22 bp, Artificial Sequence
  chemically synthesized
gtgaggaaatcaagagtcatta

SEQ ID NO: 109283 - DNA, 22 bp, Artificial Sequence
  chemically synthesized
tgaggaaatcaagagtcattag

SEQ ID NO: 109284 - DNA, 22 bp, Artificial Sequence
  chemically synthesized
gtaaatatagctgaattagagc

SEQ ID NO: 109285 - DNA, 22 bp, Artificial Sequence
  chemically synthesized
aattagagcaaatgcatccctt

SEQ ID NO: 109286 - DNA, 22 bp, Artificial Sequence
  chemically synthesized
gagcaaatgcatcccttgcttt

SEQ ID NO: 109287 - DNA, 22 bp, Artificial Sequence
  chemically synthesized
gcttttttttcttgtcacatgc

SEQ ID NO: 109288 - DNA, 22 bp, Artificial Sequence
  chemically synthesized
cttttttttcttgtcacatgcc

SEQ ID NO: 109289 - DNA, 22 bp, Artificial Sequence
  chemically synthesized
ttttttcttgtcacatgccaga

SEQ ID NO: 109290 - DNA, 22 bp, Artificial Sequence
  chemically synthesized
tttttcttgtcacatgccagaa

SEQ ID NO: 109291 - DNA, 22 bp, Artificial Sequence
  chemically synthesized
ttttcttgtcacatgccagaac

SEQ ID NO: 109292 - DNA, 22 bp, Artificial Sequence
  chemically synthesized
tttcttgtcacatgccagaaca

SEQ ID NO: 109293 - DNA, 22 bp, Artificial Sequence
  chemically synthesized
ttcttgtcacatgccagaacaa

SEQ ID NO: 109294 - DNA, 22 bp, Artificial Sequence
  chemically synthesized
tcttgtcacatgccagaacaac

SEQ ID NO: 109295 - DNA, 22 bp, Artificial Sequence
  chemically synthesized
cttgtcacatgccagaacaact

SEQ ID NO: 109296 - DNA, 22 bp, Artificial Sequence
  chemically synthesized
ttgtcacatgccagaacaactt

SEQ ID NO: 109297 - DNA, 22 bp, Artificial Sequence
  chemically synthesized
gtcacatgccagaacaacttct

SEQ ID NO: 109298 - DNA, 22 bp, Artificial Sequence
  chemically synthesized
tcacatgccagaacaacttctt

SEQ ID NO: 109299 - DNA, 22 bp, Artificial Sequence
  chemically synthesized
cttgaagttgtttttatcctaa

SEQ ID NO: 109300 - DNA, 22 bp, Artificial Sequence
  chemically synthesized
ttgaagttgtttttatcctaag

SEQ ID NO: 109301 - DNA, 22 bp, Artificial Sequence
  chemically synthesized
gaagttgtttttatcctaagtt

SEQ ID NO: 109302 - DNA, 22 bp, Artificial Sequence
  chemically synthesized
aagttgtttttatcctaagtta

SEQ ID NO: 109303 - DNA, 22 bp, Artificial Sequence
  chemically synthesized
tttttatcctaagttaaaaaga

SEQ ID NO: 109304 - DNA, 22 bp, Artificial Sequence
  chemically synthesized
ttatcctaagttaaaaagatgg

SEQ ID NO: 109305 - DNA, 22 bp, Artificial Sequence
  chemically synthesized
tatcctaagttaaaaagatggt

SEQ ID NO: 109306 - DNA, 22 bp, Artificial Sequence
  chemically synthesized
atcctaagttaaaaagatggtc

SEQ ID NO: 109307 - DNA, 22 bp, Artificial Sequence
  chemically synthesized
tcctaagttaaaaagatggtcg

SEQ ID NO: 109308 - DNA, 22 bp, Artificial Sequence
  chemically synthesized
agttaaaaagatggtcgtatcc

SEQ ID NO: 109309 - DNA, 22 bp, Artificial Sequence
  chemically synthesized
aaaagatggtcgtatccaaata

SEQ ID NO: 109310 - DNA, 22 bp, Artificial Sequence
  chemically synthesized
cagagttactttgtcagtgtaa

SEQ ID NO: 109311 - DNA, 22 bp, Artificial Sequence
  chemically synthesized
agagttactttgtcagtgtaag

SEQ ID NO: 109312 - DNA, 22 bp, Artificial Sequence
  chemically synthesized
ctttgtcagtgtaaggcactac

SEQ ID NO: 109313 - DNA, 22 bp, Artificial Sequence
  chemically synthesized
tgtcagtgtaaggcactaccct

SEQ ID NO: 109314 - DNA, 22 bp, Artificial Sequence
  chemically synthesized
gtcagtgtaaggcactacccta

SEQ ID NO: 109315 - DNA, 22 bp, Artificial Sequence
  chemically synthesized
tcagtgtaaggcactaccctaa

SEQ ID NO: 109316 - DNA, 22 bp, Artificial Sequence
  chemically synthesized
ccctaaagatgccaccaaagga

SEQ ID NO: 109317 - DNA, 22 bp, Artificial Sequence
  chemically synthesized
aagatgccaccaaaggaaacga

SEQ ID NO: 109318 - DNA, 22 bp, Artificial Sequence
  chemically synthesized
ttaccttccacccatagagatg

SEQ ID NO: 109319 - DNA, 22 bp, Artificial Sequence
  chemically synthesized
accttccacccatagagatgag

SEQ ID NO: 109320 - DNA, 22 bp, Artificial Sequence
  chemically synthesized
ccttccacccatagagatgaga

SEQ ID NO: 109321 - DNA, 22 bp, Artificial Sequence
  chemically synthesized
ccacccatagagatgagatcta

SEQ ID NO: 109322 - DNA, 22 bp, Artificial Sequence
  chemically synthesized
cacccatagagatgagatctaa

SEQ ID NO: 109323 - DNA, 22 bp, Artificial Sequence
  chemically synthesized
actgtaatagtttcagtgaaga

SEQ ID NO: 109324 - DNA, 22 bp, Artificial Sequence
  chemically synthesized
taatagtttcagtgaagagatg

SEQ ID NO: 109325 - DNA, 22 bp, Artificial Sequence
  chemically synthesized
cagtgaagagatgccagacaac

SEQ ID NO: 109326 - DNA, 22 bp, Artificial Sequence
  chemically synthesized
agtgaagagatgccagacaact

SEQ ID NO: 109327 - DNA, 22 bp, Artificial Sequence
  chemically synthesized
ggcgtgaggcaacaactcagca

SEQ ID NO: 109328 - DNA, 22 bp, Artificial Sequence
  chemically synthesized
agcactttgaaagaatcatttt

SEQ ID NO: 109329 - DNA, 22 bp, Artificial Sequence
  chemically synthesized
tgaaagaatcatttttcagcat

SEQ ID NO: 109330 - DNA, 22 bp, Artificial Sequence
  chemically synthesized
gaaagaatcatttttcagcatc

SEQ ID NO: 109331 - DNA, 22 bp, Artificial Sequence
  chemically synthesized
aaagaatcatttttcagcatcc

SEQ ID NO: 109332 - DNA, 22 bp, Artificial Sequence
  chemically synthesized
ttcagcatccatattctgtcct

SEQ ID NO: 109333 - DNA, 22 bp, Artificial Sequence
  chemically synthesized
tcagcatccatattctgtccta

SEQ ID NO: 109334 - DNA, 22 bp, Artificial Sequence
  chemically synthesized
cagcatccatattctgtcctag

SEQ ID NO: 109335 - DNA, 22 bp, Artificial Sequence
  chemically synthesized
agcatccatattctgtcctagg

SEQ ID NO: 109336 - DNA, 22 bp, Artificial Sequence
  chemically synthesized
tgtcctaggactgagagacata

SEQ ID NO: 109337 - DNA, 22 bp, Artificial Sequence
  chemically synthesized
tcctaggactgagagacataaa

SEQ ID NO: 109338 - DNA, 22 bp, Artificial Sequence
  chemically synthesized
ggactgagagacataaaccaga

SEQ ID NO: 109339 - DNA, 22 bp, Artificial Sequence
  chemically synthesized
agagacataaaccagaattcag

SEQ ID NO: 109340 - DNA, 22 bp, Artificial Sequence
  chemically synthesized
agtgcctactgaacatacaatg

SEQ ID NO: 109341 - DNA, 22 bp, Artificial Sequence
  chemically synthesized
ctgaacatacaatgagtgatgt

SEQ ID NO: 109342 - DNA, 22 bp, Artificial Sequence
  chemically synthesized
aacatacaatgagtgatgtata

SEQ ID NO: 109343 - DNA, 22 bp, Artificial Sequence
  chemically synthesized
ttcagttactagacgcaaagat

SEQ ID NO: 109344 - DNA, 22 bp, Artificial Sequence
  chemically synthesized
cagttactagacgcaaagataa

SEQ ID NO: 109345 - DNA, 22 bp, Artificial Sequence
  chemically synthesized
agttactagacgcaaagataat

SEQ ID NO: 109346 - DNA, 22 bp, Artificial Sequence
  chemically synthesized
ctagacgcaaagataatccagc

SEQ ID NO: 109347 - DNA, 22 bp, Artificial Sequence
  chemically synthesized
gacgcaaagataatccagctta

SEQ ID NO: 109348 - DNA, 22 bp, Artificial Sequence
  chemically synthesized
agctcctccccttctgtgttct

SEQ ID NO: 109349 - DNA, 22 bp, Artificial Sequence
  chemically synthesized
gctcctccccttctgtgttcta

SEQ ID NO: 109350 - DNA, 22 bp, Artificial Sequence
  chemically synthesized
ctccccttctgtgttctatgta

SEQ ID NO: 109351 - DNA, 22 bp, Artificial Sequence
  chemically synthesized
cccttctgtgttctatgtactt

SEQ ID NO: 109352 - DNA, 22 bp, Artificial Sequence
  chemically synthesized
ctgtgttctatgtacttcattt

SEQ ID NO: 109353 - DNA, 22 bp, Artificial Sequence
  chemically synthesized
tgtgttctatgtacttcatttc

SEQ ID NO: 109354 - DNA, 22 bp, Artificial Sequence
  chemically synthesized
tgttctatgtacttcatttctc

SEQ ID NO: 109355 - DNA, 22 bp, Artificial Sequence
  chemically synthesized
tatgtacttcatttctctgtca

SEQ ID NO: 109356 - DNA, 22 bp, Artificial Sequence
  chemically synthesized
tgtacttcatttctctgtcaac

SEQ ID NO: 109357 - DNA, 22 bp, Artificial Sequence
  chemically synthesized
catttctctgtcaacactctta

SEQ ID NO: 109358 - DNA, 22 bp, Artificial Sequence
  chemically synthesized
atttctctgtcaacactcttac

SEQ ID NO: 109359 - DNA, 22 bp, Artificial Sequence
  chemically synthesized
ctctgtcaacactcttacttct

SEQ ID NO: 109360 - DNA, 22 bp, Artificial Sequence
  chemically synthesized
tctgtcaacactcttacttctc

SEQ ID NO: 109361 - DNA, 22 bp, Artificial Sequence
  chemically synthesized
tgtcaacactcttacttctctg

SEQ ID NO: 109362 - DNA, 22 bp, Artificial Sequence
  chemically synthesized
tcaacactcttacttctctgac

SEQ ID NO: 109363 - DNA, 22 bp, Artificial Sequence
  chemically synthesized
ttacttctctgacgtttcagca

SEQ ID NO: 109364 - DNA, 22 bp, Artificial Sequence
  chemically synthesized
acttctctgacgtttcagcaat

SEQ ID NO: 109365 - DNA, 22 bp, Artificial Sequence
  chemically synthesized
cttctctgacgtttcagcaata

SEQ ID NO: 109366 - DNA, 22 bp, Artificial Sequence
  chemically synthesized
ctctgacgtttcagcaataatc

SEQ ID NO: 109367 - DNA, 22 bp, Artificial Sequence
  chemically synthesized
tctgacgtttcagcaataatct

SEQ ID NO: 109368 - DNA, 22 bp, Artificial Sequence
  chemically synthesized
tgacgtttcagcaataatctcc

SEQ ID NO: 109369 - DNA, 22 bp, Artificial Sequence
  chemically synthesized
acgtttcagcaataatctcctt

SEQ ID NO: 109370 - DNA, 22 bp, Artificial Sequence
  chemically synthesized
cagcaataatctcctttaacct

SEQ ID NO: 109371 - DNA, 22 bp, Artificial Sequence
  chemically synthesized
agcaataatctcctttaaccta

SEQ ID NO: 109372 - DNA, 22 bp, Artificial Sequence
  chemically synthesized
ctttaacctaatctttcactgt

SEQ ID NO: 109373 - DNA, 22 bp, Artificial Sequence
  chemically synthesized
taacctaatctttcactgtatc

SEQ ID NO: 109374 - DNA, 22 bp, Artificial Sequence
  chemically synthesized
aacctaatctttcactgtatct

SEQ ID NO: 109375 - DNA, 22 bp, Artificial Sequence
  chemically synthesized
acctaatctttcactgtatctc

SEQ ID NO: 109376 - DNA, 22 bp, Artificial Sequence
  chemically synthesized
atctttcactgtatctcaactt

SEQ ID NO: 109377 - DNA, 22 bp, Artificial Sequence
  chemically synthesized
tcactgtatctcaactttgtga

SEQ ID NO: 109378 - DNA, 22 bp, Artificial Sequence
  chemically synthesized
cactgtatctcaactttgtgaa

SEQ ID NO: 109379 - DNA, 22 bp, Artificial Sequence
  chemically synthesized
actgtatctcaactttgtgaaa

SEQ ID NO: 109380 - DNA, 22 bp, Artificial Sequence
  chemically synthesized
tatctcaactttgtgaaaaatt

SEQ ID NO: 109381 - DNA, 22 bp, Artificial Sequence
  chemically synthesized
aactttgtgaaaaattccttct

SEQ ID NO: 109382 - DNA, 22 bp, Artificial Sequence
  chemically synthesized
tgtgaaaaattccttcttatca

SEQ ID NO: 109383 - DNA, 22 bp, Artificial Sequence
  chemically synthesized
gtgaaaaattccttcttatcag

SEQ ID NO: 109384 - DNA, 22 bp, Artificial Sequence
  chemically synthesized
tgaaaaattccttcttatcaga

SEQ ID NO: 109385 - DNA, 22 bp, Artificial Sequence
  chemically synthesized
cttcttatcagagaatatgcag

SEQ ID NO: 109386 - DNA, 22 bp, Artificial Sequence
  chemically synthesized
cttatcagagaatatgcagcac

SEQ ID NO: 109387 - DNA, 22 bp, Artificial Sequence
  chemically synthesized
ttatcagagaatatgcagcaca

SEQ ID NO: 109388 - DNA, 22 bp, Artificial Sequence
  chemically synthesized
atcagagaatatgcagcacaag

SEQ ID NO: 109389 - DNA, 22 bp, Artificial Sequence
  chemically synthesized
tcagagaatatgcagcacaagt

SEQ ID NO: 109390 - DNA, 22 bp, Artificial Sequence
  chemically synthesized
cagggaaagctaaccaaactgt

SEQ ID NO: 109391 - DNA, 22 bp, Artificial Sequence
  chemically synthesized
accaaactgtaaggcaatgatt

SEQ ID NO: 109392 - DNA, 22 bp, Artificial Sequence
  chemically synthesized
taaggcaatgattgtattttgc

SEQ ID NO: 109393 - DNA, 22 bp, Artificial Sequence
  chemically synthesized
tattttgccaataataacctgc

SEQ ID NO: 109394 - DNA, 22 bp, Artificial Sequence
  chemically synthesized
tgccaataataacctgcaactt

SEQ ID NO: 109395 - DNA, 22 bp, Artificial Sequence
  chemically synthesized
gccaataataacctgcaactta

SEQ ID NO: 109396 - DNA, 22 bp, Artificial Sequence
  chemically synthesized
ccaataataacctgcaacttaa

SEQ ID NO: 109397 - DNA, 22 bp, Artificial Sequence
  chemically synthesized
caacttaaagtttcctccttct

SEQ ID NO: 109398 - DNA, 22 bp, Artificial Sequence
  chemically synthesized
aaagtttcctccttctccattc

SEQ ID NO: 109399 - DNA, 22 bp, Artificial Sequence
  chemically synthesized
aagtttcctccttctccattcc

SEQ ID NO: 109400 - DNA, 22 bp, Artificial Sequence
  chemically synthesized
cctccttctccattcccaagaa

SEQ ID NO: 109401 - DNA, 22 bp, Artificial Sequence
  chemically synthesized
ctccttctccattcccaagaat

SEQ ID NO: 109402 - DNA, 22 bp, Artificial Sequence
  chemically synthesized
cttctccattcccaagaattcc

SEQ ID NO: 109403 - DNA, 22 bp, Artificial Sequence
  chemically synthesized
ctccattcccaagaattccatg

SEQ ID NO: 109404 - DNA, 22 bp, Artificial Sequence
  chemically synthesized
tccattcccaagaattccatgc

SEQ ID NO: 109405 - DNA, 22 bp, Artificial Sequence
  chemically synthesized
cattcccaagaattccatgcag

SEQ ID NO: 109406 - DNA, 22 bp, Artificial Sequence
  chemically synthesized
ccaagaattccatgcagacata

SEQ ID NO: 109407 - DNA, 22 bp, Artificial Sequence
  chemically synthesized
catgcagacatacctggtaatg

SEQ ID NO: 109408 - DNA, 22 bp, Artificial Sequence
  chemically synthesized
gtaatgcagctataatagtgat

SEQ ID NO: 109409 - DNA, 22 bp, Artificial Sequence
  chemically synthesized
taatagtgatctatggaatcac

SEQ ID NO: 109410 - DNA, 22 bp, Artificial Sequence
  chemically synthesized
tggaatcactctactttgtttt

SEQ ID NO: 109411 - DNA, 22 bp, Artificial Sequence
  chemically synthesized
tactttgttttgtgaaaattct

SEQ ID NO: 109412 - DNA, 22 bp, Artificial Sequence
  chemically synthesized
ctttgttttgtgaaaattcttg

SEQ ID NO: 109413 - DNA, 22 bp, Artificial Sequence
  chemically synthesized
tgttttgtgaaaattcttgtgt

SEQ ID NO: 109414 - DNA, 22 bp, Artificial Sequence
  chemically synthesized
gttttgtgaaaattcttgtgtc

SEQ ID NO: 109415 - DNA, 22 bp, Artificial Sequence
  chemically synthesized
ttttgtgaaaattcttgtgtcc

SEQ ID NO: 109416 - DNA, 22 bp, Artificial Sequence
  chemically synthesized
tgtgaaaattcttgtgtcctca

SEQ ID NO: 109417 - DNA, 22 bp, Artificial Sequence
  chemically synthesized
gtgaaaattcttgtgtcctcag

SEQ ID NO: 109418 - DNA, 22 bp, Artificial Sequence
  chemically synthesized
tgaaaattcttgtgtcctcagc

SEQ ID NO: 109419 - DNA, 22 bp, Artificial Sequence
  chemically synthesized
ttgtgtcctcagctagtcgtgg

SEQ ID NO: 109420 - DNA, 22 bp, Artificial Sequence
  chemically synthesized
gtgtcctcagctagtcgtggct

SEQ ID NO: 109421 - DNA, 22 bp, Artificial Sequence
  chemically synthesized
tgtcctcagctagtcgtggctc

SEQ ID NO: 109422 - DNA, 22 bp, Artificial Sequence
  chemically synthesized
agctagtcgtggctcttggttt

SEQ ID NO: 109423 - DNA, 22 bp, Artificial Sequence
  chemically synthesized
gtcgtggctcttggtttctgag

SEQ ID NO: 109424 - DNA, 22 bp, Artificial Sequence
  chemically synthesized
ttggtttctgagaagaaagaca

SEQ ID NO: 109425 - DNA, 22 bp, Artificial Sequence
  chemically synthesized
ggtttctgagaagaaagacaat

SEQ ID NO: 109426 - DNA, 22 bp, Artificial Sequence
  chemically synthesized
gtttctgagaagaaagacaatg

SEQ ID NO: 109427 - DNA, 22 bp, Artificial Sequence
  chemically synthesized
ctgagaagaaagacaatgagag

SEQ ID NO: 109428 - DNA, 22 bp, Artificial Sequence
  chemically synthesized
tgagaagaaagacaatgagaga

SEQ ID NO: 109429 - DNA, 22 bp, Artificial Sequence
  chemically synthesized
agaagaaagacaatgagagaag

SEQ ID NO: 109430 - DNA, 22 bp, Artificial Sequence
  chemically synthesized
aggaaaaaaaatatagggaagg

SEQ ID NO: 109431 - DNA, 22 bp, Artificial Sequence
  chemically synthesized
aggatagaagcaagaagattct

SEQ ID NO: 109432 - DNA, 22 bp, Artificial Sequence
  chemically synthesized
tataatggaacacctagaaaat

SEQ ID NO: 109433 - DNA, 22 bp, Artificial Sequence
  chemically synthesized
taatggaacacctagaaaatca

SEQ ID NO: 109434 - DNA, 22 bp, Artificial Sequence
  chemically synthesized
gaaaatcagataaacttctaac

SEQ ID NO: 109435 - DNA, 22 bp, Artificial Sequence
  chemically synthesized
ctaacatttacagccataattt

SEQ ID NO: 109436 - DNA, 22 bp, Artificial Sequence
  chemically synthesized
taacatttacagccataatttt

SEQ ID NO: 109437 - DNA, 22 bp, Artificial Sequence
  chemically synthesized
acatttacagccataatttttc

SEQ ID NO: 109438 - DNA, 22 bp, Artificial Sequence
  chemically synthesized
acagccataatttttctctgct

SEQ ID NO: 109439 - DNA, 22 bp, Artificial Sequence
  chemically synthesized
cagccataatttttctctgctt

SEQ ID NO: 109440 - DNA, 22 bp, Artificial Sequence
  chemically synthesized
ttctctgctttgtttaaaaagt

SEQ ID NO: 109441 - DNA, 22 bp, Artificial Sequence
  chemically synthesized
tctctgctttgtttaaaaagta

SEQ ID NO: 109442 - DNA, 22 bp, Artificial Sequence
  chemically synthesized
ctctgctttgtttaaaaagtaa

SEQ ID NO: 109443 - DNA, 22 bp, Artificial Sequence
  chemically synthesized
tctgctttgtttaaaaagtaaa

SEQ ID NO: 109444 - DNA, 22 bp, Artificial Sequence
  chemically synthesized
tgctttgtttaaaaagtaaaat

SEQ ID NO: 109445 - DNA, 22 bp, Artificial Sequence
  chemically synthesized
ctttgtttaaaaagtaaaatgt

SEQ ID NO: 109446 - DNA, 22 bp, Artificial Sequence
  chemically synthesized
tgtttaaaaagtaaaatgtagt

SEQ ID NO: 109447 - DNA, 22 bp, Artificial Sequence
  chemically synthesized
gtttaaaaagtaaaatgtagta

SEQ ID NO: 109448 - DNA, 22 bp, Artificial Sequence
  chemically synthesized
tttaaaaagtaaaatgtagtag

SEQ ID NO: 109449 - DNA, 22 bp, Artificial Sequence
  chemically synthesized
aaaaagtaaaatgtagtagaat

SEQ ID NO: 109450 - DNA, 22 bp, Artificial Sequence
  chemically synthesized
aaaagtaaaatgtagtagaata

SEQ ID NO: 109451 - DNA, 22 bp, Artificial Sequence
  chemically synthesized
cctgttcatcttttagaaagga

SEQ ID NO: 109452 - DNA, 22 bp, Artificial Sequence
  chemically synthesized
ctgttcatcttttagaaaggaa

SEQ ID NO: 109453 - DNA, 22 bp, Artificial Sequence
  chemically synthesized
ttcatcttttagaaaggaaaga

SEQ ID NO: 109454 - DNA, 22 bp, Artificial Sequence
  chemically synthesized
atcttttagaaaggaaagaaga

SEQ ID NO: 109455 - DNA, 22 bp, Artificial Sequence
  chemically synthesized
ttagaaaggaaagaagacatat

SEQ ID NO: 109456 - DNA, 22 bp, Artificial Sequence
  chemically synthesized
tagaaaggaaagaagacatatg

SEQ ID NO: 109457 - DNA, 22 bp, Artificial Sequence
  chemically synthesized
agaaaggaaagaagacatatga

SEQ ID NO: 109458 - DNA, 22 bp, Artificial Sequence
  chemically synthesized
gaaaggaaagaagacatatgag

SEQ ID NO: 109459 - DNA, 22 bp, Artificial Sequence
  chemically synthesized
acatcactgagtacagaaggtc

SEQ ID NO: 109460 - DNA, 22 bp, Artificial Sequence
  chemically synthesized
agtacagaaggtcttaggtagt

SEQ ID NO: 109461 - DNA, 22 bp, Artificial Sequence
  chemically synthesized
aggtagttggttggtagcactt

SEQ ID NO: 109462 - DNA, 22 bp, Artificial Sequence
  chemically synthesized
ggtagttggttggtagcacttg

SEQ ID NO: 109463 - DNA, 22 bp, Artificial Sequence
  chemically synthesized
gttggtagcacttggaattgct

SEQ ID NO: 109464 - DNA, 22 bp, Artificial Sequence
  chemically synthesized
gtagcacttggaattgcttttg

SEQ ID NO: 109465 - DNA, 22 bp, Artificial Sequence
  chemically synthesized
ggaattgcttttgaagttctat

SEQ ID NO: 109466 - DNA, 22 bp, Artificial Sequence
  chemically synthesized
gaattgcttttgaagttctatc

SEQ ID NO: 109467 - DNA, 22 bp, Artificial Sequence
  chemically synthesized
cttttgaagttctatcaacttc

SEQ ID NO: 109468 - DNA, 22 bp, Artificial Sequence
  chemically synthesized
ttgaagttctatcaacttcaga

SEQ ID NO: 109469 - DNA, 22 bp, Artificial Sequence
  chemically synthesized
tgaagttctatcaacttcagac

SEQ ID NO: 109470 - DNA, 22 bp, Artificial Sequence
  chemically synthesized
gaagttctatcaacttcagact

SEQ ID NO: 109471 - DNA, 22 bp, Artificial Sequence
  chemically synthesized
aagttctatcaacttcagactg

SEQ ID NO: 109472 - DNA, 22 bp, Artificial Sequence
  chemically synthesized
tatcaacttcagactgaaatct

SEQ ID NO: 109473 - DNA, 22 bp, Artificial Sequence
  chemically synthesized
tcaacttcagactgaaatctgt

SEQ ID NO: 109474 - DNA, 22 bp, Artificial Sequence
  chemically synthesized
cagactgaaatctgtgcacaca

SEQ ID NO: 109475 - DNA, 22 bp, Artificial Sequence
  chemically synthesized
agactgaaatctgtgcacacat

SEQ ID NO: 109476 - DNA, 22 bp, Artificial Sequence
  chemically synthesized
aaatctgtgcacacatccaaag

SEQ ID NO: 109477 - DNA, 22 bp, Artificial Sequence
  chemically synthesized
tgcacacatccaaagctgtgga

SEQ ID NO: 109478 - DNA, 22 bp, Artificial Sequence
  chemically synthesized
tggactattgagatccttcact

SEQ ID NO: 109479 - DNA, 22 bp, Artificial Sequence
  chemically synthesized
ttgagatccttcacttcttctc

SEQ ID NO: 109480 - DNA, 22 bp, Artificial Sequence
  chemically synthesized
agatccttcacttcttctccgt

SEQ ID NO: 109481 - DNA, 22 bp, Artificial Sequence
  chemically synthesized
cacttcttctccgtatctttct

SEQ ID NO: 109482 - DNA, 22 bp, Artificial Sequence
  chemically synthesized
acttcttctccgtatctttctc

SEQ ID NO: 109483 - DNA, 22 bp, Artificial Sequence
  chemically synthesized
cttctccgtatctttctctgga

SEQ ID NO: 109484 - DNA, 22 bp, Artificial Sequence
  chemically synthesized
ttctccgtatctttctctggag

SEQ ID NO: 109485 - DNA, 22 bp, Artificial Sequence
  chemically synthesized
ctccgtatctttctctggagag

SEQ ID NO: 109486 - DNA, 22 bp, Artificial Sequence
  chemically synthesized
tccgtatctttctctggagagc

SEQ ID NO: 109487 - DNA, 22 bp, Artificial Sequence
  chemically synthesized
cgtatctttctctggagagctt

SEQ ID NO: 109488 - DNA, 22 bp, Artificial Sequence
  chemically synthesized
tctctggagagcttatagagga

SEQ ID NO: 109489 - DNA, 22 bp, Artificial Sequence
  chemically synthesized
ctctggagagcttatagaggag

SEQ ID NO: 109490 - DNA, 22 bp, Artificial Sequence
  chemically synthesized
tctggagagcttatagaggagt

SEQ ID NO: 109491 - DNA, 22 bp, Artificial Sequence
  chemically synthesized
tggagagcttatagaggagtct

SEQ ID NO: 109492 - DNA, 22 bp, Artificial Sequence
  chemically synthesized
gagagcttatagaggagtctcc

SEQ ID NO: 109493 - DNA, 22 bp, Artificial Sequence
  chemically synthesized
atagaggagtctcctagtacac

SEQ ID NO: 109494 - DNA, 22 bp, Artificial Sequence
  chemically synthesized
tagaggagtctcctagtacact

SEQ ID NO: 109495 - DNA, 22 bp, Artificial Sequence
  chemically synthesized
ctagtacactctttatatatct

SEQ ID NO: 109496 - DNA, 22 bp, Artificial Sequence
  chemically synthesized
gtacactctttatatatctagg

SEQ ID NO: 109497 - DNA, 22 bp, Artificial Sequence
  chemically synthesized
tttatatatctaggagtatttc

SEQ ID NO: 109498 - DNA, 22 bp, Artificial Sequence
  chemically synthesized
tatatatctaggagtatttcac

SEQ ID NO: 109499 - DNA, 22 bp, Artificial Sequence
  chemically synthesized
atatatctaggagtatttcacc

SEQ ID NO: 109500 - DNA, 22 bp, Artificial Sequence
  chemically synthesized
tatatctaggagtatttcacca

SEQ ID NO: 109501 - DNA, 22 bp, Artificial Sequence
  chemically synthesized
ggagtatttcaccatactccca

SEQ ID NO: 109502 - DNA, 22 bp, Artificial Sequence
  chemically synthesized
caccatactcccaggtaccata

SEQ ID NO: 109503 - DNA, 22 bp, Artificial Sequence
  chemically synthesized
accatactcccaggtaccataa

SEQ ID NO: 109504 - DNA, 22 bp, Artificial Sequence
  chemically synthesized
ccaggtaccataacttgtttga

SEQ ID NO: 109505 - DNA, 22 bp, Artificial Sequence
  chemically synthesized
gtttgatggtgaggaagagcag

SEQ ID NO: 109506 - DNA, 22 bp, Artificial Sequence
  chemically synthesized
tttgatggtgaggaagagcagg

SEQ ID NO: 109507 - DNA, 22 bp, Artificial Sequence
  chemically synthesized
gatggtgaggaagagcagggtt

SEQ ID NO: 109508 - DNA, 22 bp, Artificial Sequence
  chemically synthesized
atggtgaggaagagcagggttc

SEQ ID NO: 109509 - DNA, 22 bp, Artificial Sequence
  chemically synthesized
ttgtgtcttacctaaagactta

SEQ ID NO: 109510 - DNA, 22 bp, Artificial Sequence
  chemically synthesized
gtgtcttacctaaagacttaga

SEQ ID NO: 109511 - DNA, 22 bp, Artificial Sequence
  chemically synthesized
tgtcttacctaaagacttagat

SEQ ID NO: 109512 - DNA, 22 bp, Artificial Sequence
  chemically synthesized
acctaaagacttagatcatgtt

SEQ ID NO: 109513 - DNA, 22 bp, Artificial Sequence
  chemically synthesized
cctaaagacttagatcatgttg

SEQ ID NO: 109514 - DNA, 22 bp, Artificial Sequence
  chemically synthesized
aagacttagatcatgttgttcc

SEQ ID NO: 109515 - DNA, 22 bp, Artificial Sequence
  chemically synthesized
agatcatgttgttccttctcaa

SEQ ID NO: 109516 - DNA, 22 bp, Artificial Sequence
  chemically synthesized
gatcatgttgttccttctcaac

SEQ ID NO: 109517 - DNA, 22 bp, Artificial Sequence
  chemically synthesized
ttccttctcaacatctgtgaag

SEQ ID NO: 109518 - DNA, 22 bp, Artificial Sequence
  chemically synthesized
cttctcaacatctgtgaagaga

SEQ ID NO: 109519 - DNA, 22 bp, Artificial Sequence
  chemically synthesized
ctcaacatctgtgaagagaagc

SEQ ID NO: 109520 - DNA, 22 bp, Artificial Sequence
  chemically synthesized
tcaacatctgtgaagagaagca

SEQ ID NO: 109521 - DNA, 22 bp, Artificial Sequence
  chemically synthesized
aacatctgtgaagagaagcagt

SEQ ID NO: 109522 - DNA, 22 bp, Artificial Sequence
  chemically synthesized
tgaagagaagcagtcactgtgg

SEQ ID NO: 109523 - DNA, 22 bp, Artificial Sequence
  chemically synthesized
tggttattaataaagatagcac

SEQ ID NO: 109524 - DNA, 22 bp, Artificial Sequence
  chemically synthesized
ttaataaagatagcaccttccc

SEQ ID NO: 109525 - DNA, 22 bp, Artificial Sequence
  chemically synthesized
ataaagatagcaccttcccaga

SEQ ID NO: 109526 - DNA, 22 bp, Artificial Sequence
  chemically synthesized
cccagatgtctcccttttatag

SEQ ID NO: 109527 - DNA, 22 bp, Artificial Sequence
  chemically synthesized
ccagatgtctcccttttatagc

SEQ ID NO: 109528 - DNA, 22 bp, Artificial Sequence
  chemically synthesized
ccttttatagccaacttggatc

SEQ ID NO: 109529 - DNA, 22 bp, Artificial Sequence
  chemically synthesized
ttatagccaacttggatcttaa

SEQ ID NO: 109530 - DNA, 22 bp, Artificial Sequence
  chemically synthesized
tatagccaacttggatcttaag

SEQ ID NO: 109531 - DNA, 22 bp, Artificial Sequence
  chemically synthesized
atagccaacttggatcttaaga

SEQ ID NO: 109532 - DNA, 22 bp, Artificial Sequence
  chemically synthesized
tagccaacttggatcttaagaa

SEQ ID NO: 109533 - DNA, 22 bp, Artificial Sequence
  chemically synthesized
ggatcttaagaaatatttactc

SEQ ID NO: 109534 - DNA, 22 bp, Artificial Sequence
  chemically synthesized
gatcttaagaaatatttactct

SEQ ID NO: 109535 - DNA, 22 bp, Artificial Sequence
  chemically synthesized
aagaaatatttactctgtatta

SEQ ID NO: 109536 - DNA, 22 bp, Artificial Sequence
  chemically synthesized
agaaatatttactctgtattaa

SEQ ID NO: 109537 - DNA, 22 bp, Artificial Sequence
  chemically synthesized
actctgtattaactcctcctta

SEQ ID NO: 109538 - DNA, 22 bp, Artificial Sequence
  chemically synthesized
ctctgtattaactcctccttag

SEQ ID NO: 109539 - DNA, 22 bp, Artificial Sequence
  chemically synthesized
tgtattaactcctccttagagg

SEQ ID NO: 109540 - DNA, 22 bp, Artificial Sequence
  chemically synthesized
tattaactcctccttagaggga

SEQ ID NO: 109541 - DNA, 22 bp, Artificial Sequence
  chemically synthesized
actcctccttagagggagctgg

SEQ ID NO: 109542 - DNA, 22 bp, Artificial Sequence
  chemically synthesized
ctccttagagggagctggaaca

SEQ ID NO: 109543 - DNA, 22 bp, Artificial Sequence
  chemically synthesized
cttagagggagctggaacactt

SEQ ID NO: 109544 - DNA, 22 bp, Artificial Sequence
  chemically synthesized
agagggagctggaacacttaat

SEQ ID NO: 109545 - DNA, 22 bp, Artificial Sequence
  chemically synthesized
gagggagctggaacacttaatt

SEQ ID NO: 109546 - DNA, 22 bp, Artificial Sequence
  chemically synthesized
gaacacttaattagtcccccca

SEQ ID NO: 109547 - DNA, 22 bp, Artificial Sequence
  chemically synthesized
aattagtccccccaagctttta

SEQ ID NO: 109548 - DNA, 22 bp, Artificial Sequence
  chemically synthesized
attagtccccccaagcttttaa

SEQ ID NO: 109549 - DNA, 22 bp, Artificial Sequence
  chemically synthesized
gtccccccaagcttttaaataa

SEQ ID NO: 109550 - DNA, 22 bp, Artificial Sequence
  chemically synthesized
ttaaataatctttcttttttca

SEQ ID NO: 109551 - DNA, 22 bp, Artificial Sequence
  chemically synthesized
taaataatctttcttttttcaa

SEQ ID NO: 109552 - DNA, 22 bp, Artificial Sequence
  chemically synthesized
aaataatctttcttttttcaaa

SEQ ID NO: 109553 - DNA, 22 bp, Artificial Sequence
  chemically synthesized
aataatctttcttttttcaaat

SEQ ID NO: 109554 - DNA, 22 bp, Artificial Sequence
  chemically synthesized
tcttttttcaaataagttactg

SEQ ID NO: 109555 - DNA, 22 bp, Artificial Sequence
  chemically synthesized
cttttttcaaataagttactgg

SEQ ID NO: 109556 - DNA, 22 bp, Artificial Sequence
  chemically synthesized
ttttttcaaataagttactggc

SEQ ID NO: 109557 - DNA, 22 bp, Artificial Sequence
  chemically synthesized
ttttcaaataagttactggctg

SEQ ID NO: 109558 - DNA, 22 bp, Artificial Sequence
  chemically synthesized
tttcaaataagttactggctga

SEQ ID NO: 109559 - DNA, 22 bp, Artificial Sequence
  chemically synthesized
ttcaaataagttactggctgaa

SEQ ID NO: 109560 - DNA, 22 bp, Artificial Sequence
  chemically synthesized
tcaaataagttactggctgaat

SEQ ID NO: 109561 - DNA, 22 bp, Artificial Sequence
  chemically synthesized
caaataagttactggctgaatc

SEQ ID NO: 109562 - DNA, 22 bp, Artificial Sequence
  chemically synthesized
aaataagttactggctgaatca

SEQ ID NO: 109563 - DNA, 22 bp, Artificial Sequence
  chemically synthesized
ctggctgaatcaagccactggt

SEQ ID NO: 109564 - DNA, 22 bp, Artificial Sequence
  chemically synthesized
gctgaatcaagccactggtagg

SEQ ID NO: 109565 - DNA, 22 bp, Artificial Sequence
  chemically synthesized
aatcaagccactggtaggacct

SEQ ID NO: 109566 - DNA, 22 bp, Artificial Sequence
  chemically synthesized
gtaggacctttatgtgtgggga

SEQ ID NO: 109567 - DNA, 22 bp, Artificial Sequence
  chemically synthesized
tatgtgtggggaatcagacagc

SEQ ID NO: 109568 - DNA, 22 bp, Artificial Sequence
  chemically synthesized
atgtgtggggaatcagacagcc

SEQ ID NO: 109569 - DNA, 22 bp, Artificial Sequence
  chemically synthesized
tgtgtggggaatcagacagcct

SEQ ID NO: 109570 - DNA, 22 bp, Artificial Sequence
  chemically synthesized
tcttcatagccccagcagactc

SEQ ID NO: 109571 - DNA, 22 bp, Artificial Sequence
  chemically synthesized
catagccccagcagactctggt

SEQ ID NO: 109572 - DNA, 22 bp, Artificial Sequence
  chemically synthesized
atagccccagcagactctggta

SEQ ID NO: 109573 - DNA, 22 bp, Artificial Sequence
  chemically synthesized
tggtatcacctctgggaggtaa

SEQ ID NO: 109574 - DNA, 22 bp, Artificial Sequence
  chemically synthesized
gtatcacctctgggaggtaatt

SEQ ID NO: 109575 - DNA, 22 bp, Artificial Sequence
  chemically synthesized
tgggaggtaatttattccctac

SEQ ID NO: 109576 - DNA, 22 bp, Artificial Sequence
  chemically synthesized
ggaggtaatttattccctacat

SEQ ID NO: 109577 - DNA, 22 bp, Artificial Sequence
  chemically synthesized
attccctacatttacttcaaca

SEQ ID NO: 109578 - DNA, 22 bp, Artificial Sequence
  chemically synthesized
ttccctacatttacttcaacag

SEQ ID NO: 109579 - DNA, 22 bp, Artificial Sequence
  chemically synthesized
cctacatttacttcaacagtca

SEQ ID NO: 109580 - DNA, 22 bp, Artificial Sequence
  chemically synthesized
catttacttcaacagtcaaatc

SEQ ID NO: 109581 - DNA, 22 bp, Artificial Sequence
  chemically synthesized
acttcaacagtcaaatctttcc

SEQ ID NO: 109582 - DNA, 22 bp, Artificial Sequence
  chemically synthesized
cttcaacagtcaaatctttccc

SEQ ID NO: 109583 - DNA, 22 bp, Artificial Sequence
  chemically synthesized
caacagtcaaatctttcccagt

SEQ ID NO: 109584 - DNA, 22 bp, Artificial Sequence
  chemically synthesized
aacagtcaaatctttcccagtt

SEQ ID NO: 109585 - DNA, 22 bp, Artificial Sequence
  chemically synthesized
tcccagtttatctcaagagaaa

SEQ ID NO: 109586 - DNA, 22 bp, Artificial Sequence
  chemically synthesized
cccagtttatctcaagagaaag

SEQ ID NO: 109587 - DNA, 22 bp, Artificial Sequence
  chemically synthesized
ccagtttatctcaagagaaagc

SEQ ID NO: 109588 - DNA, 22 bp, Artificial Sequence
  chemically synthesized
atctcaagagaaagcctatata

SEQ ID NO: 109589 - DNA, 22 bp, Artificial Sequence
  chemically synthesized
tctcaagagaaagcctatatat

SEQ ID NO: 109590 - DNA, 22 bp, Artificial Sequence
  chemically synthesized
aagagaaagcctatatatcttc

SEQ ID NO: 109591 - DNA, 22 bp, Artificial Sequence
  chemically synthesized
tatatcttcttggcctatgtaa

SEQ ID NO: 109592 - DNA, 22 bp, Artificial Sequence
  chemically synthesized
cttggcctatgtaacctgaatt

SEQ ID NO: 109593 - DNA, 22 bp, Artificial Sequence
  chemically synthesized
ttggcctatgtaacctgaattt

SEQ ID NO: 109594 - DNA, 22 bp, Artificial Sequence
  chemically synthesized
ggcctatgtaacctgaatttct

SEQ ID NO: 109595 - DNA, 22 bp, Artificial Sequence
  chemically synthesized
gcctatgtaacctgaatttcta

SEQ ID NO: 109596 - DNA, 22 bp, Artificial Sequence
  chemically synthesized
tgtaacctgaatttctactata

SEQ ID NO: 109597 - DNA, 22 bp, Artificial Sequence
  chemically synthesized
aatttctactatatttcctgct

SEQ ID NO: 109598 - DNA, 22 bp, Artificial Sequence
  chemically synthesized
ctactatatttcctgcttggtt

SEQ ID NO: 109599 - DNA, 22 bp, Artificial Sequence
  chemically synthesized
tactatatttcctgcttggttt

SEQ ID NO: 109600 - DNA, 22 bp, Artificial Sequence
  chemically synthesized
ctatatttcctgcttggtttag

SEQ ID NO: 109601 - DNA, 22 bp, Artificial Sequence
  chemically synthesized
tatttcctgcttggtttagatc

SEQ ID NO: 109602 - DNA, 22 bp, Artificial Sequence
  chemically synthesized
cctgcttggtttagatcagaga

SEQ ID NO: 109603 - DNA, 22 bp, Artificial Sequence
  chemically synthesized
ctgcttggtttagatcagagaa

SEQ ID NO: 109604 - DNA, 22 bp, Artificial Sequence
  chemically synthesized
cttggtttagatcagagaaagc

SEQ ID NO: 109605 - DNA, 22 bp, Artificial Sequence
  chemically synthesized
ggtttagatcagagaaagcttg

SEQ ID NO: 109606 - DNA, 22 bp, Artificial Sequence
  chemically synthesized
gtttagatcagagaaagcttga

SEQ ID NO: 109607 - DNA, 22 bp, Artificial Sequence
  chemically synthesized
agatcagagaaagcttgaaagc

SEQ ID NO: 109608 - DNA, 22 bp, Artificial Sequence
  chemically synthesized
gatcagagaaagcttgaaagca

SEQ ID NO: 109609 - DNA, 22 bp, Artificial Sequence
  chemically synthesized
gaaagcagagagctagatagac

SEQ ID NO: 109610 - DNA, 22 bp, Artificial Sequence
  chemically synthesized
aaagcagagagctagatagact

SEQ ID NO: 109611 - DNA, 22 bp, Artificial Sequence
  chemically synthesized
gatagactagagtcaatataat

SEQ ID NO: 109612 - DNA, 22 bp, Artificial Sequence
  chemically synthesized
gagtcaatataataaaattcag

SEQ ID NO: 109613 - DNA, 22 bp, Artificial Sequence
  chemically synthesized
aggcagccttctctagtaccca

SEQ ID NO: 109614 - DNA, 22 bp, Artificial Sequence
  chemically synthesized
ctctagtacccaacgtgaacgc

SEQ ID NO: 109615 - DNA, 22 bp, Artificial Sequence
  chemically synthesized
tctagtacccaacgtgaacgca

SEQ ID NO: 109616 - DNA, 22 bp, Artificial Sequence
  chemically synthesized
tagtacccaacgtgaacgcaca

SEQ ID NO: 109617 - DNA, 22 bp, Artificial Sequence
  chemically synthesized
gtacccaacgtgaacgcacatt

SEQ ID NO: 109618 - DNA, 22 bp, Artificial Sequence
  chemically synthesized
tgcagttatcactaactattcc

SEQ ID NO: 109619 - DNA, 22 bp, Artificial Sequence
  chemically synthesized
cagttatcactaactattccct

SEQ ID NO: 109620 - DNA, 22 bp, Artificial Sequence
  chemically synthesized
tcactaactattcccttcttga

SEQ ID NO: 109621 - DNA, 22 bp, Artificial Sequence
  chemically synthesized
actattcccttcttgagtttag

SEQ ID NO: 109622 - DNA, 22 bp, Artificial Sequence
  chemically synthesized
ttcccttcttgagtttagccta

SEQ ID NO: 109623 - DNA, 22 bp, Artificial Sequence
  chemically synthesized
ccttcttgagtttagcctacca

SEQ ID NO: 109624 - DNA, 22 bp, Artificial Sequence
  chemically synthesized
cttgagtttagcctaccagaag

SEQ ID NO: 109625 - DNA, 22 bp, Artificial Sequence
  chemically synthesized
ttgagtttagcctaccagaagt

SEQ ID NO: 109626 - DNA, 22 bp, Artificial Sequence
  chemically synthesized
gagtttagcctaccagaagttt

SEQ ID NO: 109627 - DNA, 22 bp, Artificial Sequence
  chemically synthesized
agtttagcctaccagaagtttt

SEQ ID NO: 109628 - DNA, 22 bp, Artificial Sequence
  chemically synthesized
agcctaccagaagttttctctt

SEQ ID NO: 109629 - DNA, 22 bp, Artificial Sequence
  chemically synthesized
gcctaccagaagttttctcttt

SEQ ID NO: 109630 - DNA, 22 bp, Artificial Sequence
  chemically synthesized
ccagaagttttctcttttccag

SEQ ID NO: 109631 - DNA, 22 bp, Artificial Sequence
  chemically synthesized
tctcttttccaggggatgcagc

SEQ ID NO: 109632 - DNA, 22 bp, Artificial Sequence
  chemically synthesized
ctcttttccaggggatgcagca

SEQ ID NO: 109633 - DNA, 22 bp, Artificial Sequence
  chemically synthesized
tcttttccaggggatgcagcag

SEQ ID NO: 109634 - DNA, 22 bp, Artificial Sequence
  chemically synthesized
ttttccaggggatgcagcaggc

SEQ ID NO: 109635 - DNA, 22 bp, Artificial Sequence
  chemically synthesized
ttccaggggatgcagcaggcat

SEQ ID NO: 109636 - DNA, 22 bp, Artificial Sequence
  chemically synthesized
tccaggggatgcagcaggcata

SEQ ID NO: 109637 - DNA, 22 bp, Artificial Sequence
  chemically synthesized
ccaggggatgcagcaggcatac

SEQ ID NO: 109638 - DNA, 22 bp, Artificial Sequence
  chemically synthesized
caggggatgcagcaggcatact

SEQ ID NO: 109639 - DNA, 22 bp, Artificial Sequence
  chemically synthesized
atcacatggtgcttcagccaag

SEQ ID NO: 109640 - DNA, 22 bp, Artificial Sequence
  chemically synthesized
cagccaagcacaccacatcact

SEQ ID NO: 109641 - DNA, 22 bp, Artificial Sequence
  chemically synthesized
agccaagcacaccacatcactt

SEQ ID NO: 109642 - DNA, 22 bp, Artificial Sequence
  chemically synthesized
tgtgatggcaattattatatgc

SEQ ID NO: 109643 - DNA, 22 bp, Artificial Sequence
  chemically synthesized
gtgatggcaattattatatgcg

SEQ ID NO: 109644 - DNA, 22 bp, Artificial Sequence
  chemically synthesized
tgatggcaattattatatgcgt

SEQ ID NO: 109645 - DNA, 22 bp, Artificial Sequence
  chemically synthesized
ttatatgcgttttacagtaagg

SEQ ID NO: 109646 - DNA, 22 bp, Artificial Sequence
  chemically synthesized
tatgcgttttacagtaaggact

SEQ ID NO: 109647 - DNA, 22 bp, Artificial Sequence
  chemically synthesized
tacagtaaggactatgaaatgc

SEQ ID NO: 109648 - DNA, 22 bp, Artificial Sequence
  chemically synthesized
acagtaaggactatgaaatgca

SEQ ID NO: 109649 - DNA, 22 bp, Artificial Sequence
  chemically synthesized
cagtaaggactatgaaatgcaa

SEQ ID NO: 109650 - DNA, 22 bp, Artificial Sequence
  chemically synthesized
tgaaatgcaatgagataaaata

SEQ ID NO: 109651 - DNA, 22 bp, Artificial Sequence
  chemically synthesized
caaagtagcacagcaagagcca

SEQ ID NO: 109652 - DNA, 22 bp, Artificial Sequence
  chemically synthesized
aacctccaacagaggaaaacct

SEQ ID NO: 109653 - DNA, 22 bp, Artificial Sequence
  chemically synthesized
caacagaggaaaacctccagta

SEQ ID NO: 109654 - DNA, 22 bp, Artificial Sequence
  chemically synthesized
cagtaaaagccaggacagagac

SEQ ID NO: 109655 - DNA, 22 bp, Artificial Sequence
  chemically synthesized
gagttgtgctgttcaaagccca

SEQ ID NO: 109656 - DNA, 22 bp, Artificial Sequence
  chemically synthesized
agttgtgctgttcaaagcccaa

SEQ ID NO: 109657 - DNA, 22 bp, Artificial Sequence
  chemically synthesized
tgctgttcaaagcccaataccc

SEQ ID NO: 109658 - DNA, 22 bp, Artificial Sequence
  chemically synthesized
ttcaaagcccaatacccacaag

SEQ ID NO: 109659 - DNA, 22 bp, Artificial Sequence
  chemically synthesized
aaagcccaatacccacaaggct

SEQ ID NO: 109660 - DNA, 22 bp, Artificial Sequence
  chemically synthesized
agggcacaaataatagagaaaa

SEQ ID NO: 109661 - DNA, 22 bp, Artificial Sequence
  chemically synthesized
tctaaatcaggaatggtctctg

SEQ ID NO: 109662 - DNA, 22 bp, Artificial Sequence
  chemically synthesized
aatcaggaatggtctctgggga

SEQ ID NO: 109663 - DNA, 22 bp, Artificial Sequence
  chemically synthesized
tggggaggagcttctaaaataa

SEQ ID NO: 109664 - DNA, 22 bp, Artificial Sequence
  chemically synthesized
gggaggagcttctaaaataaat

SEQ ID NO: 109665 - DNA, 22 bp, Artificial Sequence
  chemically synthesized
ctaaaataaatgttcctaccag

SEQ ID NO: 109666 - DNA, 22 bp, Artificial Sequence
  chemically synthesized
taaaataaatgttcctaccagc

SEQ ID NO: 109667 - DNA, 22 bp, Artificial Sequence
  chemically synthesized
aaataaatgttcctaccagcca

SEQ ID NO: 109668 - DNA, 22 bp, Artificial Sequence
  chemically synthesized
ctaccagccaggctcatgtgca

SEQ ID NO: 109669 - DNA, 22 bp, Artificial Sequence
  chemically synthesized
ccagccaggctcatgtgcagat

SEQ ID NO: 109670 - DNA, 22 bp, Artificial Sequence
  chemically synthesized
atgtgcagattctgaaaagatg

SEQ ID NO: 109671 - DNA, 22 bp, Artificial Sequence
  chemically synthesized
tgaaaagatgatgcccaaatct

SEQ ID NO: 109672 - DNA, 22 bp, Artificial Sequence
  chemically synthesized
aaaagatgatgcccaaatcttt

SEQ ID NO: 109673 - DNA, 22 bp, Artificial Sequence
  chemically synthesized
tcatacggctaaagatgtgaga

SEQ ID NO: 109674 - DNA, 22 bp, Artificial Sequence
  chemically synthesized
catacggctaaagatgtgagat

SEQ ID NO: 109675 - DNA, 22 bp, Artificial Sequence
  chemically synthesized
atacggctaaagatgtgagata

SEQ ID NO: 109676 - DNA, 22 bp, Artificial Sequence
  chemically synthesized
aagatgtgagatacatgactat

SEQ ID NO: 109677 - DNA, 22 bp, Artificial Sequence
  chemically synthesized
tggaactgaagaatggaaggga

SEQ ID NO: 109678 - DNA, 22 bp, Artificial Sequence
  chemically synthesized
aagaatggaagggaacaaagtt

SEQ ID NO: 109679 - DNA, 22 bp, Artificial Sequence
  chemically synthesized
caggtcagtgagggtatttaat

SEQ ID NO: 109680 - DNA, 22 bp, Artificial Sequence
  chemically synthesized
aggtcagtgagggtatttaatg

SEQ ID NO: 109681 - DNA, 22 bp, Artificial Sequence
  chemically synthesized
aatgaatctcctctgtaagatc

SEQ ID NO: 109682 - DNA, 22 bp, Artificial Sequence
  chemically synthesized
atgaatctcctctgtaagatct

SEQ ID NO: 109683 - DNA, 22 bp, Artificial Sequence
  chemically synthesized
ctctgtaagatctcattgcagg

SEQ ID NO: 109684 - DNA, 22 bp, Artificial Sequence
  chemically synthesized
tgtaagatctcattgcaggaac

SEQ ID NO: 109685 - DNA, 22 bp, Artificial Sequence
  chemically synthesized
taagatctcattgcaggaacca

SEQ ID NO: 109686 - DNA, 22 bp, Artificial Sequence
  chemically synthesized
attgcaggaaccaaggcaaaaa

SEQ ID NO: 109687 - DNA, 22 bp, Artificial Sequence
  chemically synthesized
caggaaccaaggcaaaaaaaaa

SEQ ID NO: 109688 - DNA, 22 bp, Artificial Sequence
  chemically synthesized
atttcttagcaagagaaaagta

SEQ ID NO: 109689 - DNA, 22 bp, Artificial Sequence
  chemically synthesized
cttagcaagagaaaagtaatag

SEQ ID NO: 109690 - DNA, 22 bp, Artificial Sequence
  chemically synthesized
ttagcaagagaaaagtaatagt

SEQ ID NO: 109691 - DNA, 22 bp, Artificial Sequence
  chemically synthesized
agcaagagaaaagtaatagtgt

SEQ ID NO: 109692 - DNA, 22 bp, Artificial Sequence
  chemically synthesized
gcaagagaaaagtaatagtgtt

SEQ ID NO: 109693 - DNA, 22 bp, Artificial Sequence
  chemically synthesized
tctgctaagagtagatatatgt

SEQ ID NO: 109694 - DNA, 22 bp, Artificial Sequence
  chemically synthesized
ctaagagtagatatatgtagta

SEQ ID NO: 109695 - DNA, 22 bp, Artificial Sequence
  chemically synthesized
agagtagatatatgtagtaggc

SEQ ID NO: 109696 - DNA, 22 bp, Artificial Sequence
  chemically synthesized
aagactccctgacatctctaaa

SEQ ID NO: 109697 - DNA, 22 bp, Artificial Sequence
  chemically synthesized
cctgacatctctaaaacttggt

SEQ ID NO: 109698 - DNA, 22 bp, Artificial Sequence
  chemically synthesized
acatctctaaaacttggtttct

SEQ ID NO: 109699 - DNA, 22 bp, Artificial Sequence
  chemically synthesized
taaaacttggtttctttgagag

SEQ ID NO: 109700 - DNA, 22 bp, Artificial Sequence
  chemically synthesized
aaacttggtttctttgagagtt

SEQ ID NO: 109701 - DNA, 22 bp, Artificial Sequence
  chemically synthesized
ggtttctttgagagttacctct

SEQ ID NO: 109702 - DNA, 22 bp, Artificial Sequence
  chemically synthesized
gtttctttgagagttacctctt

SEQ ID NO: 109703 - DNA, 22 bp, Artificial Sequence
  chemically synthesized
ctttgagagttacctcttcaaa

SEQ ID NO: 109704 - DNA, 22 bp, Artificial Sequence
  chemically synthesized
tttgagagttacctcttcaaat

SEQ ID NO: 109705 - DNA, 22 bp, Artificial Sequence
  chemically synthesized
tgagagttacctcttcaaatat

SEQ ID NO: 109706 - DNA, 22 bp, Artificial Sequence
  chemically synthesized
gagagttacctcttcaaatata

SEQ ID NO: 109707 - DNA, 22 bp, Artificial Sequence
  chemically synthesized
agagttacctcttcaaatataa

SEQ ID NO: 109708 - DNA, 22 bp, Artificial Sequence
  chemically synthesized
cctcttcaaatataaaaaagtg

SEQ ID NO: 109709 - DNA, 22 bp, Artificial Sequence
  chemically synthesized
ttcaaatataaaaaagtgaagg

SEQ ID NO: 109710 - DNA, 22 bp, Artificial Sequence
  chemically synthesized
caaatataaaaaagtgaaggat

SEQ ID NO: 109711 - DNA, 22 bp, Artificial Sequence
  chemically synthesized
aaatataaaaaagtgaaggata

SEQ ID NO: 109712 - DNA, 22 bp, Artificial Sequence
  chemically synthesized
tggaacacataaggcaaacaat

SEQ ID NO: 109713 - DNA, 22 bp, Artificial Sequence
  chemically synthesized
gaacacataaggcaaacaattc

SEQ ID NO: 109714 - DNA, 22 bp, Artificial Sequence
  chemically synthesized
tacgaacaaaccagagcatggg

SEQ ID NO: 109715 - DNA, 22 bp, Artificial Sequence
  chemically synthesized
cgaacaaaccagagcatgggtg

SEQ ID NO: 109716 - DNA, 22 bp, Artificial Sequence
  chemically synthesized
actcaggcatgaattatggggt

SEQ ID NO: 109717 - DNA, 22 bp, Artificial Sequence
  chemically synthesized
aggcatgaattatggggttgta

SEQ ID NO: 109718 - DNA, 22 bp, Artificial Sequence
  chemically synthesized
tggggttgtagtaatttctctc

SEQ ID NO: 109719 - DNA, 22 bp, Artificial Sequence
  chemically synthesized
tagtaatttctctccacctgac

SEQ ID NO: 109720 - DNA, 22 bp, Artificial Sequence
  chemically synthesized
ctctccacctgactgattcttt

SEQ ID NO: 109721 - DNA, 22 bp, Artificial Sequence
  chemically synthesized
tctccacctgactgattcttta

SEQ ID NO: 109722 - DNA, 22 bp, Artificial Sequence
  chemically synthesized
tccacctgactgattctttaat

SEQ ID NO: 109723 - DNA, 22 bp, Artificial Sequence
  chemically synthesized
cacctgactgattctttaatct

SEQ ID NO: 109724 - DNA, 22 bp, Artificial Sequence
  chemically synthesized
actgattctttaatctctctgg

SEQ ID NO: 109725 - DNA, 22 bp, Artificial Sequence
  chemically synthesized
attctttaatctctctggcttc

SEQ ID NO: 109726 - DNA, 22 bp, Artificial Sequence
  chemically synthesized
tttaatctctctggcttccatt

SEQ ID NO: 109727 - DNA, 22 bp, Artificial Sequence
  chemically synthesized
taatctctctggcttccattct

SEQ ID NO: 109728 - DNA, 22 bp, Artificial Sequence
  chemically synthesized
aatctctctggcttccattcta

SEQ ID NO: 109729 - DNA, 22 bp, Artificial Sequence
  chemically synthesized
atctctctggcttccattctaa

SEQ ID NO: 109730 - DNA, 22 bp, Artificial Sequence
  chemically synthesized
tctggcttccattctaaccctg

SEQ ID NO: 109731 - DNA, 22 bp, Artificial Sequence
  chemically synthesized
tggcttccattctaaccctgag

SEQ ID NO: 109732 - DNA, 22 bp, Artificial Sequence
  chemically synthesized
gcttccattctaaccctgagag

SEQ ID NO: 109733 - DNA, 22 bp, Artificial Sequence
  chemically synthesized
ccattctaaccctgagagtccc

SEQ ID NO: 109734 - DNA, 22 bp, Artificial Sequence
  chemically synthesized
cattctaaccctgagagtcccc

SEQ ID NO: 109735 - DNA, 22 bp, Artificial Sequence
  chemically synthesized
taaccctgagagtccccctgcc

SEQ ID NO: 109736 - DNA, 22 bp, Artificial Sequence
  chemically synthesized
accctgagagtccccctgcccc

SEQ ID NO: 109737 - DNA, 22 bp, Artificial Sequence
  chemically synthesized
agagtccccctgcccccaaccc

SEQ ID NO: 109738 - DNA, 22 bp, Artificial Sequence
  chemically synthesized
cccccaaccccatgtcttttac

SEQ ID NO: 109739 - DNA, 22 bp, Artificial Sequence
  chemically synthesized
ttaccttagaagtccagataag

SEQ ID NO: 109740 - DNA, 22 bp, Artificial Sequence
  chemically synthesized
taccttagaagtccagataagt

SEQ ID NO: 109741 - DNA, 22 bp, Artificial Sequence
  chemically synthesized
accttagaagtccagataagtg

SEQ ID NO: 109742 - DNA, 22 bp, Artificial Sequence
  chemically synthesized
ccttagaagtccagataagtgc

SEQ ID NO: 109743 - DNA, 22 bp, Artificial Sequence
  chemically synthesized
agaagtccagataagtgccaaa

SEQ ID NO: 109744 - DNA, 22 bp, Artificial Sequence
  chemically synthesized
gaagtccagataagtgccaaat

SEQ ID NO: 109745 - DNA, 22 bp, Artificial Sequence
  chemically synthesized
ttccaaattcttgaggaggtat

SEQ ID NO: 109746 - DNA, 22 bp, Artificial Sequence
  chemically synthesized
ccaaattcttgaggaggtatac

SEQ ID NO: 109747 - DNA, 22 bp, Artificial Sequence
  chemically synthesized
caaattcttgaggaggtatacc

SEQ ID NO: 109748 - DNA, 22 bp, Artificial Sequence
  chemically synthesized
ttgaggaggtatacctctgtaa

SEQ ID NO: 109749 - DNA, 22 bp, Artificial Sequence
  chemically synthesized
gaggaggtatacctctgtaatc

SEQ ID NO: 109750 - DNA, 22 bp, Artificial Sequence
  chemically synthesized
aggaggtatacctctgtaatca

SEQ ID NO: 109751 - DNA, 22 bp, Artificial Sequence
  chemically synthesized
tgtaatcatcagaggttcaaat

SEQ ID NO: 109752 - DNA, 22 bp, Artificial Sequence
  chemically synthesized
taatcatcagaggttcaaatac

SEQ ID NO: 109753 - DNA, 22 bp, Artificial Sequence
  chemically synthesized
aaatactttctagaaaaaaagt

SEQ ID NO: 109754 - DNA, 22 bp, Artificial Sequence
  chemically synthesized
tctagaaaaaaagtcactatct

SEQ ID NO: 109755 - DNA, 22 bp, Artificial Sequence
  chemically synthesized
ctagaaaaaaagtcactatctg

SEQ ID NO: 109756 - DNA, 22 bp, Artificial Sequence
  chemically synthesized
tagaaaaaaagtcactatctga

SEQ ID NO: 109757 - DNA, 22 bp, Artificial Sequence
  chemically synthesized
gaaaaaaagtcactatctgacc

SEQ ID NO: 109758 - DNA, 22 bp, Artificial Sequence
  chemically synthesized
tctgaccatatgactaataaac

SEQ ID NO: 109759 - DNA, 22 bp, Artificial Sequence
  chemically synthesized
accatatgactaataaaccaat

SEQ ID NO: 109760 - DNA, 22 bp, Artificial Sequence
  chemically synthesized
ataaaccaattcaaaattaagc

SEQ ID NO: 109761 - DNA, 22 bp, Artificial Sequence
  chemically synthesized
aaaattaagcttggacggagct

SEQ ID NO: 109762 - DNA, 22 bp, Artificial Sequence
  chemically synthesized
agcttggacggagcttgggtta

SEQ ID NO: 109763 - DNA, 22 bp, Artificial Sequence
  chemically synthesized
ggacggagcttgggttatgtgt

SEQ ID NO: 109764 - DNA, 22 bp, Artificial Sequence
  chemically synthesized
gacggagcttgggttatgtgtg

SEQ ID NO: 109765 - DNA, 22 bp, Artificial Sequence
  chemically synthesized
gggttatgtgtgcctctggatc

SEQ ID NO: 109766 - DNA, 22 bp, Artificial Sequence
  chemically synthesized
ggttatgtgtgcctctggatca

SEQ ID NO: 109767 - DNA, 22 bp, Artificial Sequence
  chemically synthesized
tgtgtgcctctggatcaggggt

SEQ ID NO: 109768 - DNA, 22 bp, Artificial Sequence
  chemically synthesized
tggatcaggggtacagattcac

SEQ ID NO: 109769 - DNA, 22 bp, Artificial Sequence
  chemically synthesized
gatcaggggtacagattcacat

SEQ ID NO: 109770 - DNA, 22 bp, Artificial Sequence
  chemically synthesized
acatagcctgtgtgactttagc

SEQ ID NO: 109771 - DNA, 22 bp, Artificial Sequence
  chemically synthesized
tgtgactttagcacctggaaag

SEQ ID NO: 109772 - DNA, 22 bp, Artificial Sequence
  chemically synthesized
tagcacctggaaaggtttatat

SEQ ID NO: 109773 - DNA, 22 bp, Artificial Sequence
  chemically synthesized
agcacctggaaaggtttatatt

SEQ ID NO: 109774 - DNA, 22 bp, Artificial Sequence
  chemically synthesized
gcacctggaaaggtttatattg

SEQ ID NO: 109775 - DNA, 22 bp, Artificial Sequence
  chemically synthesized
gaaaggtttatattgtgtaaca

SEQ ID NO: 109776 - DNA, 22 bp, Artificial Sequence
  chemically synthesized
atattgtgtaacaggcatccac

SEQ ID NO: 109777 - DNA, 22 bp, Artificial Sequence
  chemically synthesized
tattgtgtaacaggcatccact

SEQ ID NO: 109778 - DNA, 22 bp, Artificial Sequence
  chemically synthesized
tgtaacaggcatccactactct

SEQ ID NO: 109779 - DNA, 22 bp, Artificial Sequence
  chemically synthesized
ctcttccatcttcttttgcctg

SEQ ID NO: 109780 - DNA, 22 bp, Artificial Sequence
  chemically synthesized
ttccatcttcttttgcctgctt

SEQ ID NO: 109781 - DNA, 22 bp, Artificial Sequence
  chemically synthesized
ccatcttcttttgcctgctttc

SEQ ID NO: 109782 - DNA, 22 bp, Artificial Sequence
  chemically synthesized
catcttcttttgcctgctttct

SEQ ID NO: 109783 - DNA, 22 bp, Artificial Sequence
  chemically synthesized
cttttgcctgctttcttctagc

SEQ ID NO: 109784 - DNA, 22 bp, Artificial Sequence
  chemically synthesized
ttttgcctgctttcttctagcc

SEQ ID NO: 109785 - DNA, 22 bp, Artificial Sequence
  chemically synthesized
ttgcctgctttcttctagccgc

SEQ ID NO: 109786 - DNA, 22 bp, Artificial Sequence
  chemically synthesized
tgcctgctttcttctagccgcc

SEQ ID NO: 109787 - DNA, 22 bp, Artificial Sequence
  chemically synthesized
gcctgctttcttctagccgccc

SEQ ID NO: 109788 - DNA, 22 bp, Artificial Sequence
  chemically synthesized
cctgctttcttctagccgccct

SEQ ID NO: 109789 - DNA, 22 bp, Artificial Sequence
  chemically synthesized
ctttcttctagccgccctggca

SEQ ID NO: 109790 - DNA, 22 bp, Artificial Sequence
  chemically synthesized
tcttctagccgccctggcagct

SEQ ID NO: 109791 - DNA, 22 bp, Artificial Sequence
  chemically synthesized
cttctagccgccctggcagctg

SEQ ID NO: 109792 - DNA, 22 bp, Artificial Sequence
  chemically synthesized
ttctagccgccctggcagctga

SEQ ID NO: 109793 - DNA, 22 bp, Artificial Sequence
  chemically synthesized
ctagccgccctggcagctgatt

SEQ ID NO: 109794 - DNA, 22 bp, Artificial Sequence
  chemically synthesized
tagccgccctggcagctgatta

SEQ ID NO: 109795 - DNA, 22 bp, Artificial Sequence
  chemically synthesized
gccgccctggcagctgattaga

SEQ ID NO: 109796 - DNA, 22 bp, Artificial Sequence
  chemically synthesized
gcagctgattagatagtaccca

SEQ ID NO: 109797 - DNA, 22 bp, Artificial Sequence
  chemically synthesized
attagatagtacccacccagac

SEQ ID NO: 109798 - DNA, 22 bp, Artificial Sequence
  chemically synthesized
gatagtacccacccagacggag

SEQ ID NO: 109799 - DNA, 22 bp, Artificial Sequence
  chemically synthesized
cctctcccagtctactgactca

SEQ ID NO: 109800 - DNA, 22 bp, Artificial Sequence
  chemically synthesized
tcccagtctactgactcaaatg

SEQ ID NO: 109801 - DNA, 22 bp, Artificial Sequence
  chemically synthesized
ccagtctactgactcaaatgtt

SEQ ID NO: 109802 - DNA, 22 bp, Artificial Sequence
  chemically synthesized
ctgactcaaatgttaatctcct

SEQ ID NO: 109803 - DNA, 22 bp, Artificial Sequence
  chemically synthesized
actcaaatgttaatctcctttg

SEQ ID NO: 109804 - DNA, 22 bp, Artificial Sequence
  chemically synthesized
aaatgttaatctcctttggcaa

SEQ ID NO: 109805 - DNA, 22 bp, Artificial Sequence
  chemically synthesized
atctcctttggcaacaccctta

SEQ ID NO: 109806 - DNA, 22 bp, Artificial Sequence
  chemically synthesized
ctttggcaacacccttacagca

SEQ ID NO: 109807 - DNA, 22 bp, Artificial Sequence
  chemically synthesized
tggcaacacccttacagcacac

SEQ ID NO: 109808 - DNA, 22 bp, Artificial Sequence
  chemically synthesized
ggcaacacccttacagcacacc

SEQ ID NO: 109809 - DNA, 22 bp, Artificial Sequence
  chemically synthesized
gcaacacccttacagcacaccc

SEQ ID NO: 109810 - DNA, 22 bp, Artificial Sequence
  chemically synthesized
acagcacacccaggaacaatac

SEQ ID NO: 109811 - DNA, 22 bp, Artificial Sequence
  chemically synthesized
cagcacacccaggaacaatact

SEQ ID NO: 109812 - DNA, 22 bp, Artificial Sequence
  chemically synthesized
tgcatccttcaatccaatcaag

SEQ ID NO: 109813 - DNA, 22 bp, Artificial Sequence
  chemically synthesized
gcatccttcaatccaatcaagt

SEQ ID NO: 109814 - DNA, 22 bp, Artificial Sequence
  chemically synthesized
catccttcaatccaatcaagtt

SEQ ID NO: 109815 - DNA, 22 bp, Artificial Sequence
  chemically synthesized
caatccaatcaagtttgcactc

SEQ ID NO: 109816 - DNA, 22 bp, Artificial Sequence
  chemically synthesized
aatccaatcaagtttgcactca

SEQ ID NO: 109817 - DNA, 22 bp, Artificial Sequence
  chemically synthesized
gcactcaatattaaccatcaca

SEQ ID NO: 109818 - DNA, 22 bp, Artificial Sequence
  chemically synthesized
cactcaatattaaccatcacag

SEQ ID NO: 109819 - DNA, 22 bp, Artificial Sequence
  chemically synthesized
aatattaaccatcacagaaagg

SEQ ID NO: 109820 - DNA, 22 bp, Artificial Sequence
  chemically synthesized
accatcacagaaaggataatag

SEQ ID NO: 109821 - DNA, 22 bp, Artificial Sequence
  chemically synthesized
agtgcttgagacagaaaagagt

SEQ ID NO: 109822 - DNA, 22 bp, Artificial Sequence
  chemically synthesized
gagacagaaaagagtgtcagga

SEQ ID NO: 109823 - DNA, 22 bp, Artificial Sequence
  chemically synthesized
agacagaaaagagtgtcaggaa

SEQ ID NO: 109824 - DNA, 22 bp, Artificial Sequence
  chemically synthesized
acatctgaatgggctcctgctg

SEQ ID NO: 109825 - DNA, 22 bp, Artificial Sequence
  chemically synthesized
aatgggctcctgctgaggtgtc

SEQ ID NO: 109826 - DNA, 22 bp, Artificial Sequence
  chemically synthesized
ctgctgaggtgtctgcatagag

SEQ ID NO: 109827 - DNA, 22 bp, Artificial Sequence
  chemically synthesized
ctgaggtgtctgcatagagcca

SEQ ID NO: 109828 - DNA, 22 bp, Artificial Sequence
  chemically synthesized
aggtgtctgcatagagccatca

SEQ ID NO: 109829 - DNA, 22 bp, Artificial Sequence
  chemically synthesized
catagagccatcagtttatgcg

SEQ ID NO: 109830 - DNA, 22 bp, Artificial Sequence
  chemically synthesized
atgcggcagagtttgagacttt

SEQ ID NO: 109831 - DNA, 22 bp, Artificial Sequence
  chemically synthesized
tgcggcagagtttgagactttg

SEQ ID NO: 109832 - DNA, 22 bp, Artificial Sequence
  chemically synthesized
gagactttgagaattagtttct

SEQ ID NO: 109833 - DNA, 22 bp, Artificial Sequence
  chemically synthesized
agactttgagaattagtttctc

SEQ ID NO: 109834 - DNA, 22 bp, Artificial Sequence
  chemically synthesized
tgagaattagtttctcattaat

SEQ ID NO: 109835 - DNA, 22 bp, Artificial Sequence
  chemically synthesized
gagaattagtttctcattaata

SEQ ID NO: 109836 - DNA, 22 bp, Artificial Sequence
  chemically synthesized
agaattagtttctcattaataa

SEQ ID NO: 109837 - DNA, 22 bp, Artificial Sequence
  chemically synthesized
gtttctcattaataaaaactca

SEQ ID NO: 109838 - DNA, 22 bp, Artificial Sequence
  chemically synthesized
ctcattaataaaaactcaagtc

SEQ ID NO: 109839 - DNA, 22 bp, Artificial Sequence
  chemically synthesized
tcattaataaaaactcaagtct

SEQ ID NO: 109840 - DNA, 22 bp, Artificial Sequence
  chemically synthesized
attaataaaaactcaagtctat

SEQ ID NO: 109841 - DNA, 22 bp, Artificial Sequence
  chemically synthesized
ataaaaactcaagtctattcta

SEQ ID NO: 109842 - DNA, 22 bp, Artificial Sequence
  chemically synthesized
aagtctattctatgacagagac

SEQ ID NO: 109843 - DNA, 22 bp, Artificial Sequence
  chemically synthesized
ttctatgacagagaccctggaa

SEQ ID NO: 109844 - DNA, 22 bp, Artificial Sequence
  chemically synthesized
tatgacagagaccctggaagag

SEQ ID NO: 109845 - DNA, 22 bp, Artificial Sequence
  chemically synthesized
tgacagagaccctggaagaggg

SEQ ID NO: 109846 - DNA, 22 bp, Artificial Sequence
  chemically synthesized
gaagagggtgaatggctgcagg

SEQ ID NO: 109847 - DNA, 22 bp, Artificial Sequence
  chemically synthesized
cagggatgaggcaaaggtttta

SEQ ID NO: 109848 - DNA, 22 bp, Artificial Sequence
  chemically synthesized
tagatttttatcccctctgaaa

SEQ ID NO: 109849 - DNA, 22 bp, Artificial Sequence
  chemically synthesized
agatttttatcccctctgaaac

SEQ ID NO: 109850 - DNA, 22 bp, Artificial Sequence
  chemically synthesized
gatttttatcccctctgaaact

SEQ ID NO: 109851 - DNA, 22 bp, Artificial Sequence
  chemically synthesized
ttatcccctctgaaactcacag

SEQ ID NO: 109852 - DNA, 22 bp, Artificial Sequence
  chemically synthesized
tatcccctctgaaactcacaga

SEQ ID NO: 109853 - DNA, 22 bp, Artificial Sequence
  chemically synthesized
atcccctctgaaactcacagat

SEQ ID NO: 109854 - DNA, 22 bp, Artificial Sequence
  chemically synthesized
tcccctctgaaactcacagatc

SEQ ID NO: 109855 - DNA, 22 bp, Artificial Sequence
  chemically synthesized
tgaaactcacagatcatctcat

SEQ ID NO: 109856 - DNA, 22 bp, Artificial Sequence
  chemically synthesized
aaactcacagatcatctcatat

SEQ ID NO: 109857 - DNA, 22 bp, Artificial Sequence
  chemically synthesized
acagatcatctcatataccaca

SEQ ID NO: 109858 - DNA, 22 bp, Artificial Sequence
  chemically synthesized
atataccacaaaagcaactgag

SEQ ID NO: 109859 - DNA, 22 bp, Artificial Sequence
  chemically synthesized
agtgaatcaagtgaaagcactc

SEQ ID NO: 109860 - DNA, 22 bp, Artificial Sequence
  chemically synthesized
agttttcaatatgaaaacagac

SEQ ID NO: 109861 - DNA, 22 bp, Artificial Sequence
  chemically synthesized
tcaatatgaaaacagacaagac

SEQ ID NO: 109862 - DNA, 22 bp, Artificial Sequence
  chemically synthesized
caatatgaaaacagacaagaca

SEQ ID NO: 109863 - DNA, 22 bp, Artificial Sequence
  chemically synthesized
aatatgaaaacagacaagacaa

SEQ ID NO: 109864 - DNA, 22 bp, Artificial Sequence
  chemically synthesized
ttttaaggattcttcccaaaaa

SEQ ID NO: 109865 - DNA, 22 bp, Artificial Sequence
  chemically synthesized
taaggattcttcccaaaaaatg

SEQ ID NO: 109866 - DNA, 22 bp, Artificial Sequence
  chemically synthesized
aaggattcttcccaaaaaatga

SEQ ID NO: 109867 - DNA, 22 bp, Artificial Sequence
  chemically synthesized
aggattcttcccaaaaaatgag

SEQ ID NO: 109868 - DNA, 22 bp, Artificial Sequence
  chemically synthesized
ttcccaaaaaatgaggtgtata

SEQ ID NO: 109869 - DNA, 22 bp, Artificial Sequence
  chemically synthesized
cccaaaaaatgaggtgtatata

SEQ ID NO: 109870 - DNA, 22 bp, Artificial Sequence
  chemically synthesized
ccaaaaaatgaggtgtatataa

SEQ ID NO: 109871 - DNA, 22 bp, Artificial Sequence
  chemically synthesized
gacacacggtagaaattcaaca

SEQ ID NO: 109872 - DNA, 22 bp, Artificial Sequence
  chemically synthesized
acacacggtagaaattcaacaa

SEQ ID NO: 109873 - DNA, 22 bp, Artificial Sequence
  chemically synthesized
aacaattatttgttccatacat

SEQ ID NO: 109874 - DNA, 22 bp, Artificial Sequence
  chemically synthesized
tttgttccatacatttgtttct

SEQ ID NO: 109875 - DNA, 22 bp, Artificial Sequence
  chemically synthesized
gttccatacatttgtttctcag

SEQ ID NO: 109876 - DNA, 22 bp, Artificial Sequence
  chemically synthesized
ttccatacatttgtttctcagc

SEQ ID NO: 109877 - DNA, 22 bp, Artificial Sequence
  chemically synthesized
catacatttgtttctcagcttt

SEQ ID NO: 109878 - DNA, 22 bp, Artificial Sequence
  chemically synthesized
gtttctcagctttattttccct

SEQ ID NO: 109879 - DNA, 22 bp, Artificial Sequence
  chemically synthesized
tttctcagctttattttcccta

SEQ ID NO: 109880 - DNA, 22 bp, Artificial Sequence
  chemically synthesized
ctcagctttattttccctatct

SEQ ID NO: 109881 - DNA, 22 bp, Artificial Sequence
  chemically synthesized
tcagctttattttccctatctg

SEQ ID NO: 109882 - DNA, 22 bp, Artificial Sequence
  chemically synthesized
agctttattttccctatctggt

SEQ ID NO: 109883 - DNA, 22 bp, Artificial Sequence
  chemically synthesized
tattttccctatctggtattcc

SEQ ID NO: 109884 - DNA, 22 bp, Artificial Sequence
  chemically synthesized
attttccctatctggtattcct

SEQ ID NO: 109885 - DNA, 22 bp, Artificial Sequence
  chemically synthesized
ttttccctatctggtattccta

SEQ ID NO: 109886 - DNA, 22 bp, Artificial Sequence
  chemically synthesized
tccctatctggtattcctactc

SEQ ID NO: 109887 - DNA, 22 bp, Artificial Sequence
  chemically synthesized
ccctatctggtattcctactcc

SEQ ID NO: 109888 - DNA, 22 bp, Artificial Sequence
  chemically synthesized
cctatctggtattcctactcct

SEQ ID NO: 109889 - DNA, 22 bp, Artificial Sequence
  chemically synthesized
tctggtattcctactcctgttt

SEQ ID NO: 109890 - DNA, 22 bp, Artificial Sequence
  chemically synthesized
gtattcctactcctgttttttt

SEQ ID NO: 109891 - DNA, 22 bp, Artificial Sequence
  chemically synthesized
ctactcctgtttttttttaatt

SEQ ID NO: 109892 - DNA, 22 bp, Artificial Sequence
  chemically synthesized
ctcctgtttttttttaatttat

SEQ ID NO: 109893 - DNA, 22 bp, Artificial Sequence
  chemically synthesized
ctgtttttttttaatttatcaa

SEQ ID NO: 109894 - DNA, 22 bp, Artificial Sequence
  chemically synthesized
tttttttttaatttatcaatta

SEQ ID NO: 109895 - DNA, 22 bp, Artificial Sequence
  chemically synthesized
ttttttaatttatcaattatat

SEQ ID NO: 109896 - DNA, 22 bp, Artificial Sequence
  chemically synthesized
tttttaatttatcaattatatg

SEQ ID NO: 109897 - DNA, 22 bp, Artificial Sequence
  chemically synthesized
ttttaatttatcaattatatgt

SEQ ID NO: 109898 - DNA, 22 bp, Artificial Sequence
  chemically synthesized
tttaatttatcaattatatgtt

SEQ ID NO: 109899 - DNA, 22 bp, Artificial Sequence
  chemically synthesized
ttaatttatcaattatatgttt

SEQ ID NO: 109900 - DNA, 22 bp, Artificial Sequence
  chemically synthesized
taatttatcaattatatgttta

SEQ ID NO: 109901 - DNA, 22 bp, Artificial Sequence
  chemically synthesized
aatttatcaattatatgtttat

SEQ ID NO: 109902 - DNA, 22 bp, Artificial Sequence
  chemically synthesized
atttatcaattatatgtttatt

SEQ ID NO: 109903 - DNA, 22 bp, Artificial Sequence
  chemically synthesized
atcaattatatgtttatttagt

SEQ ID NO: 109904 - DNA, 22 bp, Artificial Sequence
  chemically synthesized
tcaattatatgtttatttagta

SEQ ID NO: 109905 - DNA, 22 bp, Artificial Sequence
  chemically synthesized
tatgtttatttagtagtaatat

SEQ ID NO: 109906 - DNA, 22 bp, Artificial Sequence
  chemically synthesized
atttagtagtaatataacacaa

SEQ ID NO: 109907 - DNA, 22 bp, Artificial Sequence
  chemically synthesized
tttagtagtaatataacacaat

SEQ ID NO: 109908 - DNA, 22 bp, Artificial Sequence
  chemically synthesized
agtagtaatataacacaattaa

SEQ ID NO: 109909 - DNA, 22 bp, Artificial Sequence
  chemically synthesized
gtagtaatataacacaattaac

SEQ ID NO: 109910 - DNA, 22 bp, Artificial Sequence
  chemically synthesized
actagattaatgttctgtatta

SEQ ID NO: 109911 - DNA, 22 bp, Artificial Sequence
  chemically synthesized
gattaatgttctgtattatctt

SEQ ID NO: 109912 - DNA, 22 bp, Artificial Sequence
  chemically synthesized
atgttctgtattatcttttccc

SEQ ID NO: 109913 - DNA, 22 bp, Artificial Sequence
  chemically synthesized
tgtattatcttttccctcccag

SEQ ID NO: 109914 - DNA, 22 bp, Artificial Sequence
  chemically synthesized
tattatcttttccctcccagct

SEQ ID NO: 109915 - DNA, 22 bp, Artificial Sequence
  chemically synthesized
tcttttccctcccagctttatt

SEQ ID NO: 109916 - DNA, 22 bp, Artificial Sequence
  chemically synthesized
ttccctcccagctttatttagg

SEQ ID NO: 109917 - DNA, 22 bp, Artificial Sequence
  chemically synthesized
tccctcccagctttatttaggt

SEQ ID NO: 109918 - DNA, 22 bp, Artificial Sequence
  chemically synthesized
ccctcccagctttatttaggta

SEQ ID NO: 109919 - DNA, 22 bp, Artificial Sequence
  chemically synthesized
cctcccagctttatttaggtat

SEQ ID NO: 109920 - DNA, 22 bp, Artificial Sequence
  chemically synthesized
ccagctttatttaggtatattt

SEQ ID NO: 109921 - DNA, 22 bp, Artificial Sequence
  chemically synthesized
tatttaggtatatttaaaattt

SEQ ID NO: 109922 - DNA, 22 bp, Artificial Sequence
  chemically synthesized
atttaggtatatttaaaatttg

SEQ ID NO: 109923 - DNA, 22 bp, Artificial Sequence
  chemically synthesized
tttaggtatatttaaaatttgc

SEQ ID NO: 109924 - DNA, 22 bp, Artificial Sequence
  chemically synthesized
aggtatatttaaaatttgctaa

SEQ ID NO: 109925 - DNA, 22 bp, Artificial Sequence
  chemically synthesized
ggtatatttaaaatttgctaag

SEQ ID NO: 109926 - DNA, 22 bp, Artificial Sequence
  chemically synthesized
aaaatttgctaagaaagcagac

SEQ ID NO: 109927 - DNA, 22 bp, Artificial Sequence
  chemically synthesized
aaatttgctaagaaagcagacc

SEQ ID NO: 109928 - DNA, 22 bp, Artificial Sequence
  chemically synthesized
gctaagaaagcagacctcacat

SEQ ID NO: 109929 - DNA, 22 bp, Artificial Sequence
  chemically synthesized
ctaagaaagcagacctcacata

SEQ ID NO: 109930 - DNA, 22 bp, Artificial Sequence
  chemically synthesized
agaaagcagacctcacatattt

SEQ ID NO: 109931 - DNA, 22 bp, Artificial Sequence
  chemically synthesized
acatatttttactaccaaaaaa

SEQ ID NO: 109932 - DNA, 22 bp, Artificial Sequence
  chemically synthesized
ttactaccaaaaaaattaaagt

SEQ ID NO: 109933 - DNA, 22 bp, Artificial Sequence
  chemically synthesized
tactaccaaaaaaattaaagtt

SEQ ID NO: 109934 - DNA, 22 bp, Artificial Sequence
  chemically synthesized
actaccaaaaaaattaaagtta

SEQ ID NO: 109935 - DNA, 22 bp, Artificial Sequence
  chemically synthesized
ctaccaaaaaaattaaagttat

SEQ ID NO: 109936 - DNA, 22 bp, Artificial Sequence
  chemically synthesized
ccaaaaaaattaaagttattat

SEQ ID NO: 109937 - DNA, 22 bp, Artificial Sequence
  chemically synthesized
aagttattatgtgaggtgatag

SEQ ID NO: 109938 - DNA, 22 bp, Artificial Sequence
  chemically synthesized
ttatgtgaggtgatagatatat

SEQ ID NO: 109939 - DNA, 22 bp, Artificial Sequence
  chemically synthesized
tgtgaggtgatagatatattaa

SEQ ID NO: 109940 - DNA, 22 bp, Artificial Sequence
  chemically synthesized
attagtttgattatggtaatca

SEQ ID NO: 109941 - DNA, 22 bp, Artificial Sequence
  chemically synthesized
gtttgattatggtaatcattta

SEQ ID NO: 109942 - DNA, 22 bp, Artificial Sequence
  chemically synthesized
gattatggtaatcatttaacaa

SEQ ID NO: 109943 - DNA, 22 bp, Artificial Sequence
  chemically synthesized
attatggtaatcatttaacaat

SEQ ID NO: 109944 - DNA, 22 bp, Artificial Sequence
  chemically synthesized
tggtaatcatttaacaatgaat

SEQ ID NO: 109945 - DNA, 22 bp, Artificial Sequence
  chemically synthesized
aacaatgaatacctataataaa

SEQ ID NO: 109946 - DNA, 22 bp, Artificial Sequence
  chemically synthesized
acaatgaatacctataataaaa

SEQ ID NO: 109947 - DNA, 22 bp, Artificial Sequence
  chemically synthesized
taataaaacaataagttatata

SEQ ID NO: 109948 - DNA, 22 bp, Artificial Sequence
  chemically synthesized
tatacctatgtacaatttttat

SEQ ID NO: 109949 - DNA, 22 bp, Artificial Sequence
  chemically synthesized
tgtacaatttttatttgccata

SEQ ID NO: 109950 - DNA, 22 bp, Artificial Sequence
  chemically synthesized
ttatttgccatactgcttcttt

SEQ ID NO: 109951 - DNA, 22 bp, Artificial Sequence
  chemically synthesized
tatttgccatactgcttcttta

SEQ ID NO: 109952 - DNA, 22 bp, Artificial Sequence
  chemically synthesized
atttgccatactgcttctttaa

SEQ ID NO: 109953 - DNA, 22 bp, Artificial Sequence
  chemically synthesized
tttgccatactgcttctttaat

SEQ ID NO: 109954 - DNA, 22 bp, Artificial Sequence
  chemically synthesized
gccatactgcttctttaatcct

SEQ ID NO: 109955 - DNA, 22 bp, Artificial Sequence
  chemically synthesized
ccatactgcttctttaatcctg

SEQ ID NO: 109956 - DNA, 22 bp, Artificial Sequence
  chemically synthesized
cttctttaatcctgcataagct

SEQ ID NO: 109957 - DNA, 22 bp, Artificial Sequence
  chemically synthesized
ctttaatcctgcataagctgag

SEQ ID NO: 109958 - DNA, 22 bp, Artificial Sequence
  chemically synthesized
tttaatcctgcataagctgagt

SEQ ID NO: 109959 - DNA, 22 bp, Artificial Sequence
  chemically synthesized
taatcctgcataagctgagtat

SEQ ID NO: 109960 - DNA, 22 bp, Artificial Sequence
  chemically synthesized
aatcctgcataagctgagtatt

SEQ ID NO: 109961 - DNA, 22 bp, Artificial Sequence
  chemically synthesized
atcctgcataagctgagtattg

SEQ ID NO: 109962 - DNA, 22 bp, Artificial Sequence
  chemically synthesized
cataagctgagtattgtctgaa

SEQ ID NO: 109963 - DNA, 22 bp, Artificial Sequence
  chemically synthesized
agtattgtctgaacctctcact

SEQ ID NO: 109964 - DNA, 22 bp, Artificial Sequence
  chemically synthesized
tctgaacctctcactggcaggc

SEQ ID NO: 109965 - DNA, 22 bp, Artificial Sequence
  chemically synthesized
aacctctcactggcaggcagat

SEQ ID NO: 109966 - DNA, 22 bp, Artificial Sequence
  chemically synthesized
tcactggcaggcagattgagca

SEQ ID NO: 109967 - DNA, 22 bp, Artificial Sequence
  chemically synthesized
actggcaggcagattgagcaat

SEQ ID NO: 109968 - DNA, 22 bp, Artificial Sequence
  chemically synthesized
gcaggcagattgagcaataata

SEQ ID NO: 109969 - DNA, 22 bp, Artificial Sequence
  chemically synthesized
agcaataatacctccttttctc

SEQ ID NO: 109970 - DNA, 22 bp, Artificial Sequence
  chemically synthesized
cttttctcactttttgaggaca

SEQ ID NO: 109971 - DNA, 22 bp, Artificial Sequence
  chemically synthesized
ttctcactttttgaggacagag

SEQ ID NO: 109972 - DNA, 22 bp, Artificial Sequence
  chemically synthesized
tctcactttttgaggacagagt

SEQ ID NO: 109973 - DNA, 22 bp, Artificial Sequence
  chemically synthesized
ctcactttttgaggacagagtt

SEQ ID NO: 109974 - DNA, 22 bp, Artificial Sequence
  chemically synthesized
tcactttttgaggacagagttg

SEQ ID NO: 109975 - DNA, 22 bp, Artificial Sequence
  chemically synthesized
actttttgaggacagagttgct

SEQ ID NO: 109976 - DNA, 22 bp, Artificial Sequence
  chemically synthesized
tttgaggacagagttgctttcc

SEQ ID NO: 109977 - DNA, 22 bp, Artificial Sequence
  chemically synthesized
ttgaggacagagttgctttccc

SEQ ID NO: 109978 - DNA, 22 bp, Artificial Sequence
  chemically synthesized
tgaggacagagttgctttcccc

SEQ ID NO: 109979 - DNA, 22 bp, Artificial Sequence
  chemically synthesized
gaggacagagttgctttcccct

SEQ ID NO: 109980 - DNA, 22 bp, Artificial Sequence
  chemically synthesized
aggacagagttgctttcccctc

SEQ ID NO: 109981 - DNA, 22 bp, Artificial Sequence
  chemically synthesized
ctttcccctctacttccctcag

SEQ ID NO: 109982 - DNA, 22 bp, Artificial Sequence
  chemically synthesized
tcccctctacttccctcagtcc

SEQ ID NO: 109983 - DNA, 22 bp, Artificial Sequence
  chemically synthesized
cccctctacttccctcagtccc

SEQ ID NO: 109984 - DNA, 22 bp, Artificial Sequence
  chemically synthesized
ccctctacttccctcagtccca

SEQ ID NO: 109985 - DNA, 22 bp, Artificial Sequence
  chemically synthesized
tacttccctcagtcccaatgcc

SEQ ID NO: 109986 - DNA, 22 bp, Artificial Sequence
  chemically synthesized
cttccctcagtcccaatgcccc

SEQ ID NO: 109987 - DNA, 22 bp, Artificial Sequence
  chemically synthesized
ccctcagtcccaatgccccagg

SEQ ID NO: 109988 - DNA, 22 bp, Artificial Sequence
  chemically synthesized
cctcagtcccaatgccccaggc

SEQ ID NO: 109989 - DNA, 22 bp, Artificial Sequence
  chemically synthesized
agtcccaatgccccaggctcaa

SEQ ID NO: 109990 - DNA, 22 bp, Artificial Sequence
  chemically synthesized
aacgttacttttagctatgtca

SEQ ID NO: 109991 - DNA, 22 bp, Artificial Sequence
  chemically synthesized
cttttagctatgtcagaagttc

SEQ ID NO: 109992 - DNA, 22 bp, Artificial Sequence
  chemically synthesized
ttagctatgtcagaagttccca

SEQ ID NO: 109993 - DNA, 22 bp, Artificial Sequence
  chemically synthesized
tagctatgtcagaagttcccac

SEQ ID NO: 109994 - DNA, 22 bp, Artificial Sequence
  chemically synthesized
agctatgtcagaagttcccaca

SEQ ID NO: 109995 - DNA, 22 bp, Artificial Sequence
  chemically synthesized
gctatgtcagaagttcccacat

SEQ ID NO: 109996 - DNA, 22 bp, Artificial Sequence
  chemically synthesized
tgtcagaagttcccacattggc

SEQ ID NO: 109997 - DNA, 22 bp, Artificial Sequence
  chemically synthesized
ccacattggctcatcaatcttt

SEQ ID NO: 109998 - DNA, 22 bp, Artificial Sequence
  chemically synthesized
gctcatcaatcttttctccttt

SEQ ID NO: 109999 - DNA, 22 bp, Artificial Sequence
  chemically synthesized
atcaatcttttctcctttccct

SEQ ID NO: 110000 - DNA, 22 bp, Artificial Sequence
  chemically synthesized
ttctcctttccctttcccaccc

SEQ ID NO: 110001 - DNA, 22 bp, Artificial Sequence
  chemically synthesized
tctcctttccctttcccaccca

SEQ ID NO: 110002 - DNA, 22 bp, Artificial Sequence
  chemically synthesized
ctcctttccctttcccacccag

SEQ ID NO: 110003 - DNA, 22 bp, Artificial Sequence
  chemically synthesized
tcctttccctttcccacccaga

SEQ ID NO: 110004 - DNA, 22 bp, Artificial Sequence
  chemically synthesized
ctttccctttcccacccagaca

SEQ ID NO: 110005 - DNA, 22 bp, Artificial Sequence
  chemically synthesized
tccctttcccacccagacatat

SEQ ID NO: 110006 - DNA, 22 bp, Artificial Sequence
  chemically synthesized
ccctttcccacccagacatatc

SEQ ID NO: 110007 - DNA, 22 bp, Artificial Sequence
  chemically synthesized
cctttcccacccagacatatca

SEQ ID NO: 110008 - DNA, 22 bp, Artificial Sequence
  chemically synthesized
tcccacccagacatatcacatt

SEQ ID NO: 110009 - DNA, 22 bp, Artificial Sequence
  chemically synthesized
cccacccagacatatcacattt

SEQ ID NO: 110010 - DNA, 22 bp, Artificial Sequence
  chemically synthesized
ccacccagacatatcacatttt

SEQ ID NO: 110011 - DNA, 22 bp, Artificial Sequence
  chemically synthesized
tatctgctgattagagaaacta

SEQ ID NO: 110012 - DNA, 22 bp, Artificial Sequence
  chemically synthesized
atctgctgattagagaaactat

SEQ ID NO: 110013 - DNA, 22 bp, Artificial Sequence
  chemically synthesized
tctgctgattagagaaactata

SEQ ID NO: 110014 - DNA, 22 bp, Artificial Sequence
  chemically synthesized
ctgattagagaaactatagttt

SEQ ID NO: 110015 - DNA, 22 bp, Artificial Sequence
  chemically synthesized
attagagaaactatagtttaat

SEQ ID NO: 110016 - DNA, 22 bp, Artificial Sequence
  chemically synthesized
gagaaactatagtttaatatct

SEQ ID NO: 110017 - DNA, 22 bp, Artificial Sequence
  chemically synthesized
tagtttaatatctttatttaaa

SEQ ID NO: 110018 - DNA, 22 bp, Artificial Sequence
  chemically synthesized
aatatctttatttaaagtcaaa

SEQ ID NO: 110019 - DNA, 22 bp, Artificial Sequence
  chemically synthesized
atatctttatttaaagtcaaac

SEQ ID NO: 110020 - DNA, 22 bp, Artificial Sequence
  chemically synthesized
tatttaaagtcaaacacaggct

SEQ ID NO: 110021 - DNA, 22 bp, Artificial Sequence
  chemically synthesized
atttaaagtcaaacacaggctc

SEQ ID NO: 110022 - DNA, 22 bp, Artificial Sequence
  chemically synthesized
tttaaagtcaaacacaggctcc

SEQ ID NO: 110023 - DNA, 22 bp, Artificial Sequence
  chemically synthesized
aaagtcaaacacaggctcctaa

SEQ ID NO: 110024 - DNA, 22 bp, Artificial Sequence
  chemically synthesized
aagtcaaacacaggctcctaaa

SEQ ID NO: 110025 - DNA, 22 bp, Artificial Sequence
  chemically synthesized
ctaaaaaccccatcatcatctt

SEQ ID NO: 110026 - DNA, 22 bp, Artificial Sequence
  chemically synthesized
aaaaccccatcatcatcttata

SEQ ID NO: 110027 - DNA, 22 bp, Artificial Sequence
  chemically synthesized
atatctgttcccaaggcttcca

SEQ ID NO: 110028 - DNA, 22 bp, Artificial Sequence
  chemically synthesized
tatctgttcccaaggcttccac

SEQ ID NO: 110029 - DNA, 22 bp, Artificial Sequence
  chemically synthesized
ttcccaaggcttccacagaaaa

SEQ ID NO: 110030 - DNA, 22 bp, Artificial Sequence
  chemically synthesized
ccaaggcttccacagaaaaaaa

SEQ ID NO: 110031 - DNA, 22 bp, Artificial Sequence
  chemically synthesized
ccacagaaaaaaaggaaatcat

SEQ ID NO: 110032 - DNA, 22 bp, Artificial Sequence
  chemically synthesized
cacagaaaaaaaggaaatcatt

SEQ ID NO: 110033 - DNA, 22 bp, Artificial Sequence
  chemically synthesized
gacacacctctgggtgaataat

SEQ ID NO: 110034 - DNA, 22 bp, Artificial Sequence
  chemically synthesized
acacacctctgggtgaataatc

SEQ ID NO: 110035 - DNA, 22 bp, Artificial Sequence
  chemically synthesized
tgggtgaataatcctgacatgt

SEQ ID NO: 110036 - DNA, 22 bp, Artificial Sequence
  chemically synthesized
ggtgaataatcctgacatgtac

SEQ ID NO: 110037 - DNA, 22 bp, Artificial Sequence
  chemically synthesized
acatgtactcactagagaaaga

SEQ ID NO: 110038 - DNA, 22 bp, Artificial Sequence
  chemically synthesized
actagagaaagagaaaggaggt

SEQ ID NO: 110039 - DNA, 22 bp, Artificial Sequence
  chemically synthesized
gagaaagagaaaggaggtactt

SEQ ID NO: 110040 - DNA, 22 bp, Artificial Sequence
  chemically synthesized
ctctgaaacaataacaaaaaca

SEQ ID NO: 110041 - DNA, 22 bp, Artificial Sequence
  chemically synthesized
tctgaaacaataacaaaaacac

SEQ ID NO: 110042 - DNA, 22 bp, Artificial Sequence
  chemically synthesized
tgaaacaataacaaaaacacaa

SEQ ID NO: 110043 - DNA, 22 bp, Artificial Sequence
  chemically synthesized
aaacaataacaaaaacacaaaa

SEQ ID NO: 110044 - DNA, 22 bp, Artificial Sequence
  chemically synthesized
tccactctttacaaaacatttc

SEQ ID NO: 110045 - DNA, 22 bp, Artificial Sequence
  chemically synthesized
tttacaaaacatttccccttac

SEQ ID NO: 110046 - DNA, 22 bp, Artificial Sequence
  chemically synthesized
tacaaaacatttccccttactt

SEQ ID NO: 110047 - DNA, 22 bp, Artificial Sequence
  chemically synthesized
acaaaacatttccccttacttt

SEQ ID NO: 110048 - DNA, 22 bp, Artificial Sequence
  chemically synthesized
caaaacatttccccttactttg

SEQ ID NO: 110049 - DNA, 22 bp, Artificial Sequence
  chemically synthesized
ccccttactttgtgtcaagaga

SEQ ID NO: 110050 - DNA, 22 bp, Artificial Sequence
  chemically synthesized
cccttactttgtgtcaagagaa

SEQ ID NO: 110051 - DNA, 22 bp, Artificial Sequence
  chemically synthesized
actttgtgtcaagagaatgact

SEQ ID NO: 110052 - DNA, 22 bp, Artificial Sequence
  chemically synthesized
ctttgtgtcaagagaatgactg

SEQ ID NO: 110053 - DNA, 22 bp, Artificial Sequence
  chemically synthesized
tgtgtcaagagaatgactgaga

SEQ ID NO: 110054 - DNA, 22 bp, Artificial Sequence
  chemically synthesized
gtgtcaagagaatgactgagaa

SEQ ID NO: 110055 - DNA, 22 bp, Artificial Sequence
  chemically synthesized
tgtcaagagaatgactgagaag

SEQ ID NO: 110056 - DNA, 22 bp, Artificial Sequence
  chemically synthesized
agaagacagaaatcactagtag

SEQ ID NO: 110057 - DNA, 22 bp, Artificial Sequence
  chemically synthesized
gtagtctttacaggttatgtaa

SEQ ID NO: 110058 - DNA, 22 bp, Artificial Sequence
  chemically synthesized
tacaggttatgtaaccaaatct

SEQ ID NO: 110059 - DNA, 22 bp, Artificial Sequence
  chemically synthesized
acaggttatgtaaccaaatctc

SEQ ID NO: 110060 - DNA, 22 bp, Artificial Sequence
  chemically synthesized
caggttatgtaaccaaatctca

SEQ ID NO: 110061 - DNA, 22 bp, Artificial Sequence
  chemically synthesized
tgtaaccaaatctcaagattaa

SEQ ID NO: 110062 - DNA, 22 bp, Artificial Sequence
  chemically synthesized
aagattaaattactttcccaag

SEQ ID NO: 110063 - DNA, 22 bp, Artificial Sequence
  chemically synthesized
aattactttcccaagatcatta

SEQ ID NO: 110064 - DNA, 22 bp, Artificial Sequence
  chemically synthesized
ctttcccaagatcattattgtt

SEQ ID NO: 110065 - DNA, 22 bp, Artificial Sequence
  chemically synthesized
tcccaagatcattattgttaga

SEQ ID NO: 110066 - DNA, 22 bp, Artificial Sequence
  chemically synthesized
cccaagatcattattgttagaa

SEQ ID NO: 110067 - DNA, 22 bp, Artificial Sequence
  chemically synthesized
ccaagatcattattgttagaaa

SEQ ID NO: 110068 - DNA, 22 bp, Artificial Sequence
  chemically synthesized
ttgttagaaagagcagagctga

SEQ ID NO: 110069 - DNA, 22 bp, Artificial Sequence
  chemically synthesized
ttagaaagagcagagctgaaac

SEQ ID NO: 110070 - DNA, 22 bp, Artificial Sequence
  chemically synthesized
gaaagagcagagctgaaacttc

SEQ ID NO: 110071 - DNA, 22 bp, Artificial Sequence
  chemically synthesized
aaacttcaacaaattcttctga

SEQ ID NO: 110072 - DNA, 22 bp, Artificial Sequence
  chemically synthesized
caacaaattcttctgaaaatga

SEQ ID NO: 110073 - DNA, 22 bp, Artificial Sequence
  chemically synthesized
aacaaattcttctgaaaatgaa

SEQ ID NO: 110074 - DNA, 22 bp, Artificial Sequence
  chemically synthesized
ttctgaaaatgaaagtccagta

SEQ ID NO: 110075 - DNA, 22 bp, Artificial Sequence
  chemically synthesized
ctgaaaatgaaagtccagtaat

SEQ ID NO: 110076 - DNA, 22 bp, Artificial Sequence
  chemically synthesized
tgaaaatgaaagtccagtaatc

SEQ ID NO: 110077 - DNA, 22 bp, Artificial Sequence
  chemically synthesized
aaaatgaaagtccagtaatctt

SEQ ID NO: 110078 - DNA, 22 bp, Artificial Sequence
  chemically synthesized
ggatgcattcttttcatggaca

SEQ ID NO: 110079 - DNA, 22 bp, Artificial Sequence
  chemically synthesized
gatgcattcttttcatggacag

SEQ ID NO: 110080 - DNA, 22 bp, Artificial Sequence
  chemically synthesized
ttttcatggacagaaagaggtc

SEQ ID NO: 110081 - DNA, 22 bp, Artificial Sequence
  chemically synthesized
ttcatggacagaaagaggtctt

SEQ ID NO: 110082 - DNA, 22 bp, Artificial Sequence
  chemically synthesized
tcatggacagaaagaggtcttg

SEQ ID NO: 110083 - DNA, 22 bp, Artificial Sequence
  chemically synthesized
catggacagaaagaggtcttgt

SEQ ID NO: 110084 - DNA, 22 bp, Artificial Sequence
  chemically synthesized
atggacagaaagaggtcttgta

SEQ ID NO: 110085 - DNA, 22 bp, Artificial Sequence
  chemically synthesized
gtaaatcgtgcataaatttaca

SEQ ID NO: 110086 - DNA, 22 bp, Artificial Sequence
  chemically synthesized
taaatcgtgcataaatttacat

SEQ ID NO: 110087 - DNA, 22 bp, Artificial Sequence
  chemically synthesized
acatcaatatgctctttcaata

SEQ ID NO: 110088 - DNA, 22 bp, Artificial Sequence
  chemically synthesized
catcaatatgctctttcaatag

SEQ ID NO: 110089 - DNA, 22 bp, Artificial Sequence
  chemically synthesized
tttcaatagtatatgagatgta

SEQ ID NO: 110090 - DNA, 22 bp, Artificial Sequence
  chemically synthesized
tcaatagtatatgagatgtata

SEQ ID NO: 110091 - DNA, 22 bp, Artificial Sequence
  chemically synthesized
caatagtatatgagatgtatag

SEQ ID NO: 110092 - DNA, 22 bp, Artificial Sequence
  chemically synthesized
aatagtatatgagatgtatagt

SEQ ID NO: 110093 - DNA, 22 bp, Artificial Sequence
  chemically synthesized
ttttctctggctcatgccacca

SEQ ID NO: 110094 - DNA, 22 bp, Artificial Sequence
  chemically synthesized
tctctggctcatgccaccaaca

SEQ ID NO: 110095 - DNA, 22 bp, Artificial Sequence
  chemically synthesized
ctctggctcatgccaccaacac

SEQ ID NO: 110096 - DNA, 22 bp, Artificial Sequence
  chemically synthesized
tctggctcatgccaccaacaca

SEQ ID NO: 110097 - DNA, 22 bp, Artificial Sequence
  chemically synthesized
tggctcatgccaccaacacaca

SEQ ID NO: 110098 - DNA, 22 bp, Artificial Sequence
  chemically synthesized
gctcatgccaccaacacacaat

SEQ ID NO: 110099 - DNA, 22 bp, Artificial Sequence
  chemically synthesized
atgccaccaacacacaatttat

SEQ ID NO: 110100 - DNA, 22 bp, Artificial Sequence
  chemically synthesized
atgtattctcagaggttggctg

SEQ ID NO: 110101 - DNA, 22 bp, Artificial Sequence
  chemically synthesized
tgtattctcagaggttggctgc

SEQ ID NO: 110102 - DNA, 22 bp, Artificial Sequence
  chemically synthesized
tcagaggttggctgcctgcacc

SEQ ID NO: 110103 - DNA, 22 bp, Artificial Sequence
  chemically synthesized
agaggttggctgcctgcaccag

SEQ ID NO: 110104 - DNA, 22 bp, Artificial Sequence
  chemically synthesized
gctgcctgcaccagctgaaatc

SEQ ID NO: 110105 - DNA, 22 bp, Artificial Sequence
  chemically synthesized
cctgcaccagctgaaatcttag

SEQ ID NO: 110106 - DNA, 22 bp, Artificial Sequence
  chemically synthesized
caccagctgaaatcttagaatt

SEQ ID NO: 110107 - DNA, 22 bp, Artificial Sequence
  chemically synthesized
aaatcttagaattctaatgagt

SEQ ID NO: 110108 - DNA, 22 bp, Artificial Sequence
  chemically synthesized
agaattctaatgagtcacagag

SEQ ID NO: 110109 - DNA, 22 bp, Artificial Sequence
  chemically synthesized
gaattctaatgagtcacagagc

SEQ ID NO: 110110 - DNA, 22 bp, Artificial Sequence
  chemically synthesized
taatgagtcacagagccttctc

SEQ ID NO: 110111 - DNA, 22 bp, Artificial Sequence
  chemically synthesized
atgagtcacagagccttctcac

SEQ ID NO: 110112 - DNA, 22 bp, Artificial Sequence
  chemically synthesized
ctcacttttgtcaaatcccatc

SEQ ID NO: 110113 - DNA, 22 bp, Artificial Sequence
  chemically synthesized
tcacttttgtcaaatcccatca

SEQ ID NO: 110114 - DNA, 22 bp, Artificial Sequence
  chemically synthesized
acttttgtcaaatcccatcaga

SEQ ID NO: 110115 - DNA, 22 bp, Artificial Sequence
  chemically synthesized
ttgtcaaatcccatcagattcc

SEQ ID NO: 110116 - DNA, 22 bp, Artificial Sequence
  chemically synthesized
tgtcaaatcccatcagattcca

SEQ ID NO: 110117 - DNA, 22 bp, Artificial Sequence
  chemically synthesized
gtcaaatcccatcagattccat

SEQ ID NO: 110118 - DNA, 22 bp, Artificial Sequence
  chemically synthesized
tcaaatcccatcagattccata

SEQ ID NO: 110119 - DNA, 22 bp, Artificial Sequence
  chemically synthesized
catagttttaaaaaaaaaattc

SEQ ID NO: 110120 - DNA, 22 bp, Artificial Sequence
  chemically synthesized
taaaaaaaaaattctccttgat

SEQ ID NO: 110121 - DNA, 22 bp, Artificial Sequence
  chemically synthesized
aaaaaaaaaattctccttgatc

SEQ ID NO: 110122 - DNA, 22 bp, Artificial Sequence
  chemically synthesized
aaaaaaaaattctccttgatct

SEQ ID NO: 110123 - DNA, 22 bp, Artificial Sequence
  chemically synthesized
tccttgatcttgcctaaattac

SEQ ID NO: 110124 - DNA, 22 bp, Artificial Sequence
  chemically synthesized
cttgatcttgcctaaattacca

SEQ ID NO: 110125 - DNA, 22 bp, Artificial Sequence
  chemically synthesized
gatcttgcctaaattaccaatt

SEQ ID NO: 110126 - DNA, 22 bp, Artificial Sequence
  chemically synthesized
atcttgcctaaattaccaattt

SEQ ID NO: 110127 - DNA, 22 bp, Artificial Sequence
  chemically synthesized
gcctaaattaccaatttttatt

SEQ ID NO: 110128 - DNA, 22 bp, Artificial Sequence
  chemically synthesized
cctaaattaccaatttttattt

SEQ ID NO: 110129 - DNA, 22 bp, Artificial Sequence
  chemically synthesized
aattaccaatttttatttttgc

SEQ ID NO: 110130 - DNA, 22 bp, Artificial Sequence
  chemically synthesized
ccaatttttatttttgcatcac

SEQ ID NO: 110131 - DNA, 22 bp, Artificial Sequence
  chemically synthesized
ttatttttgcatcaccaagtag

SEQ ID NO: 110132 - DNA, 22 bp, Artificial Sequence
  chemically synthesized
tatttttgcatcaccaagtagg

SEQ ID NO: 110133 - DNA, 22 bp, Artificial Sequence
  chemically synthesized
atttttgcatcaccaagtaggt

SEQ ID NO: 110134 - DNA, 22 bp, Artificial Sequence
  chemically synthesized
tttttgcatcaccaagtaggtg

SEQ ID NO: 110135 - DNA, 22 bp, Artificial Sequence
  chemically synthesized
ttgcatcaccaagtaggtgata

SEQ ID NO: 110136 - DNA, 22 bp, Artificial Sequence
  chemically synthesized
tgcatcaccaagtaggtgatat

SEQ ID NO: 110137 - DNA, 22 bp, Artificial Sequence
  chemically synthesized
gcatcaccaagtaggtgatatg

SEQ ID NO: 110138 - DNA, 22 bp, Artificial Sequence
  chemically synthesized
catcaccaagtaggtgatatgc

SEQ ID NO: 110139 - DNA, 22 bp, Artificial Sequence
  chemically synthesized
ggtgctattatcaattagtgcc

SEQ ID NO: 110140 - DNA, 22 bp, Artificial Sequence
  chemically synthesized
gtgctattatcaattagtgcct

SEQ ID NO: 110141 - DNA, 22 bp, Artificial Sequence
  chemically synthesized
ttatcaattagtgccttcaaaa

SEQ ID NO: 110142 - DNA, 22 bp, Artificial Sequence
  chemically synthesized
tcaattagtgccttcaaaagct

SEQ ID NO: 110143 - DNA, 22 bp, Artificial Sequence
  chemically synthesized
gtgccttcaaaagcttatcatc

SEQ ID NO: 110144 - DNA, 22 bp, Artificial Sequence
  chemically synthesized
caaaagcttatcatcaaatcca

SEQ ID NO: 110145 - DNA, 22 bp, Artificial Sequence
  chemically synthesized
aaaagcttatcatcaaatccac

SEQ ID NO: 110146 - DNA, 22 bp, Artificial Sequence
  chemically synthesized
atcatcaaatccacattttact

SEQ ID NO: 110147 - DNA, 22 bp, Artificial Sequence
  chemically synthesized
tcatcaaatccacattttactg

SEQ ID NO: 110148 - DNA, 22 bp, Artificial Sequence
  chemically synthesized
tactgtttattcttcaatttat

SEQ ID NO: 110149 - DNA, 22 bp, Artificial Sequence
  chemically synthesized
actgtttattcttcaatttata

SEQ ID NO: 110150 - DNA, 22 bp, Artificial Sequence
  chemically synthesized
ctgtttattcttcaatttatat

SEQ ID NO: 110151 - DNA, 22 bp, Artificial Sequence
  chemically synthesized
tttattcttcaatttatattat

SEQ ID NO: 110152 - DNA, 22 bp, Artificial Sequence
  chemically synthesized
attcttcaatttatattatgaa

SEQ ID NO: 110153 - DNA, 22 bp, Artificial Sequence
  chemically synthesized
ttcttcaatttatattatgaaa

SEQ ID NO: 110154 - DNA, 22 bp, Artificial Sequence
  chemically synthesized
ttcaatttatattatgaaaatt

SEQ ID NO: 110155 - DNA, 22 bp, Artificial Sequence
  chemically synthesized
caatttatattatgaaaatttg

SEQ ID NO: 110156 - DNA, 22 bp, Artificial Sequence
  chemically synthesized
aatttatattatgaaaatttga

SEQ ID NO: 110157 - DNA, 22 bp, Artificial Sequence
  chemically synthesized
atattatgaaaatttgaattct

SEQ ID NO: 110158 - DNA, 22 bp, Artificial Sequence
  chemically synthesized
tattatgaaaatttgaattctt

SEQ ID NO: 110159 - DNA, 22 bp, Artificial Sequence
  chemically synthesized
tgaaaatttgaattctttgaag

SEQ ID NO: 110160 - DNA, 22 bp, Artificial Sequence
  chemically synthesized
gaattctttgaagcagtgtatc

SEQ ID NO: 110161 - DNA, 22 bp, Artificial Sequence
  chemically synthesized
aattctttgaagcagtgtatca

SEQ ID NO: 110162 - DNA, 22 bp, Artificial Sequence
  chemically synthesized
tttgaagcagtgtatcaataac

SEQ ID NO: 110163 - DNA, 22 bp, Artificial Sequence
  chemically synthesized
tgaagcagtgtatcaataacta

SEQ ID NO: 110164 - DNA, 22 bp, Artificial Sequence
  chemically synthesized
gaagcagtgtatcaataactag

SEQ ID NO: 110165 - DNA, 22 bp, Artificial Sequence
  chemically synthesized
aagcagtgtatcaataactagg

SEQ ID NO: 110166 - DNA, 22 bp, Artificial Sequence
  chemically synthesized
gggttataaagctgggcaactt

SEQ ID NO: 110167 - DNA, 22 bp, Artificial Sequence
  chemically synthesized
taaagctgggcaacttagagtt

SEQ ID NO: 110168 - DNA, 22 bp, Artificial Sequence
  chemically synthesized
ggcaacttagagttctatgtgc

SEQ ID NO: 110169 - DNA, 22 bp, Artificial Sequence
  chemically synthesized
agagttctatgtgctttggaaa

SEQ ID NO: 110170 - DNA, 22 bp, Artificial Sequence
  chemically synthesized
gagttctatgtgctttggaaac

SEQ ID NO: 110171 - DNA, 22 bp, Artificial Sequence
  chemically synthesized
tatgtgctttggaaacacacac

SEQ ID NO: 110172 - DNA, 22 bp, Artificial Sequence
  chemically synthesized
tgtgctttggaaacacacacag

SEQ ID NO: 110173 - DNA, 22 bp, Artificial Sequence
  chemically synthesized
tggaaacacacacaggtaagtc

SEQ ID NO: 110174 - DNA, 22 bp, Artificial Sequence
  chemically synthesized
ggaaacacacacaggtaagtca

SEQ ID NO: 110175 - DNA, 22 bp, Artificial Sequence
  chemically synthesized
gaaacacacacaggtaagtcac

SEQ ID NO: 110176 - DNA, 22 bp, Artificial Sequence
  chemically synthesized
ttacgtcattttctaactaccc

SEQ ID NO: 110177 - DNA, 22 bp, Artificial Sequence
  chemically synthesized
acgtcattttctaactacccaa

SEQ ID NO: 110178 - DNA, 22 bp, Artificial Sequence
  chemically synthesized
cgtcattttctaactacccaaa

SEQ ID NO: 110179 - DNA, 22 bp, Artificial Sequence
  chemically synthesized
tctaactacccaaaagtctctg

SEQ ID NO: 110180 - DNA, 22 bp, Artificial Sequence
  chemically synthesized
ctaactacccaaaagtctctgg

SEQ ID NO: 110181 - DNA, 22 bp, Artificial Sequence
  chemically synthesized
taactacccaaaagtctctgga

SEQ ID NO: 110182 - DNA, 22 bp, Artificial Sequence
  chemically synthesized
actacccaaaagtctctggagc

SEQ ID NO: 110183 - DNA, 22 bp, Artificial Sequence
  chemically synthesized
cccaaaagtctctggagcttca

SEQ ID NO: 110184 - DNA, 22 bp, Artificial Sequence
  chemically synthesized
tggagcttcatcaattgaattt

SEQ ID NO: 110185 - DNA, 22 bp, Artificial Sequence
  chemically synthesized
gagcttcatcaattgaattttc

SEQ ID NO: 110186 - DNA, 22 bp, Artificial Sequence
  chemically synthesized
catcaattgaattttccctcca

SEQ ID NO: 110187 - DNA, 22 bp, Artificial Sequence
  chemically synthesized
atcaattgaattttccctccag

SEQ ID NO: 110188 - DNA, 22 bp, Artificial Sequence
  chemically synthesized
aattttccctccaggaatattg

SEQ ID NO: 110189 - DNA, 22 bp, Artificial Sequence
  chemically synthesized
tccctccaggaatattgaagaa

SEQ ID NO: 110190 - DNA, 22 bp, Artificial Sequence
  chemically synthesized
ccctccaggaatattgaagaaa

SEQ ID NO: 110191 - DNA, 22 bp, Artificial Sequence
  chemically synthesized
cctccaggaatattgaagaaaa

SEQ ID NO: 110192 - DNA, 22 bp, Artificial Sequence
  chemically synthesized
caggaatattgaagaaaagtca

SEQ ID NO: 110193 - DNA, 22 bp, Artificial Sequence
  chemically synthesized
aagaaaagtcaatctctgaaat

SEQ ID NO: 110194 - DNA, 22 bp, Artificial Sequence
  chemically synthesized
tgaaatttactattttattgta

SEQ ID NO: 110195 - DNA, 22 bp, Artificial Sequence
  chemically synthesized
aaatttactattttattgtatt

SEQ ID NO: 110196 - DNA, 22 bp, Artificial Sequence
  chemically synthesized
actattttattgtatttgctca

SEQ ID NO: 110197 - DNA, 22 bp, Artificial Sequence
  chemically synthesized
ctattttattgtatttgctcat

SEQ ID NO: 110198 - DNA, 22 bp, Artificial Sequence
  chemically synthesized
ttttattgtatttgctcatata

SEQ ID NO: 110199 - DNA, 22 bp, Artificial Sequence
  chemically synthesized
tattgtatttgctcatatattt

SEQ ID NO: 110200 - DNA, 22 bp, Artificial Sequence
  chemically synthesized
attgtatttgctcatatatttc

SEQ ID NO: 110201 - DNA, 22 bp, Artificial Sequence
  chemically synthesized
ttgtatttgctcatatatttct

SEQ ID NO: 110202 - DNA, 22 bp, Artificial Sequence
  chemically synthesized
tatttgctcatatatttcttac

SEQ ID NO: 110203 - DNA, 22 bp, Artificial Sequence
  chemically synthesized
gctcatatatttcttacttgtg

SEQ ID NO: 110204 - DNA, 22 bp, Artificial Sequence
  chemically synthesized
ctcatatatttcttacttgtgt

SEQ ID NO: 110205 - DNA, 22 bp, Artificial Sequence
  chemically synthesized
atatatttcttacttgtgtatt

SEQ ID NO: 110206 - DNA, 22 bp, Artificial Sequence
  chemically synthesized
cttacttgtgtatttgtttttc

SEQ ID NO: 110207 - DNA, 22 bp, Artificial Sequence
  chemically synthesized
ttacttgtgtatttgtttttcc

SEQ ID NO: 110208 - DNA, 22 bp, Artificial Sequence
  chemically synthesized
acttgtgtatttgtttttccat

SEQ ID NO: 110209 - DNA, 22 bp, Artificial Sequence
  chemically synthesized
cttgtgtatttgtttttccata

SEQ ID NO: 110210 - DNA, 22 bp, Artificial Sequence
  chemically synthesized
gtgtatttgtttttccatataa

SEQ ID NO: 110211 - DNA, 22 bp, Artificial Sequence
  chemically synthesized
tgtatttgtttttccatataat

SEQ ID NO: 110212 - DNA, 22 bp, Artificial Sequence
  chemically synthesized
gtttttccatataatctttata

SEQ ID NO: 110213 - DNA, 22 bp, Artificial Sequence
  chemically synthesized
tttttccatataatctttatat

SEQ ID NO: 110214 - DNA, 22 bp, Artificial Sequence
  chemically synthesized
ttccatataatctttatatctg

SEQ ID NO: 110215 - DNA, 22 bp, Artificial Sequence
  chemically synthesized
tccatataatctttatatctgc

SEQ ID NO: 110216 - DNA, 22 bp, Artificial Sequence
  chemically synthesized
ccatataatctttatatctgct

SEQ ID NO: 110217 - DNA, 22 bp, Artificial Sequence
  chemically synthesized
catataatctttatatctgctt

SEQ ID NO: 110218 - DNA, 22 bp, Artificial Sequence
  chemically synthesized
tatatctgcttttccaatagtg

SEQ ID NO: 110219 - DNA, 22 bp, Artificial Sequence
  chemically synthesized
atatctgcttttccaatagtgc

SEQ ID NO: 110220 - DNA, 22 bp, Artificial Sequence
  chemically synthesized
tatctgcttttccaatagtgct

SEQ ID NO: 110221 - DNA, 22 bp, Artificial Sequence
  chemically synthesized
cttttccaatagtgcttagaac

SEQ ID NO: 110222 - DNA, 22 bp, Artificial Sequence
  chemically synthesized
ttccaatagtgcttagaaccat

SEQ ID NO: 110223 - DNA, 22 bp, Artificial Sequence
  chemically synthesized
tccaatagtgcttagaaccatt

SEQ ID NO: 110224 - DNA, 22 bp, Artificial Sequence
  chemically synthesized
ccaatagtgcttagaaccattt

SEQ ID NO: 110225 - DNA, 22 bp, Artificial Sequence
  chemically synthesized
caatagtgcttagaaccatttt

SEQ ID NO: 110226 - DNA, 22 bp, Artificial Sequence
  chemically synthesized
agaaccatttttctactgatct

SEQ ID NO: 110227 - DNA, 22 bp, Artificial Sequence
  chemically synthesized
gaaccatttttctactgatctt

SEQ ID NO: 110228 - DNA, 22 bp, Artificial Sequence
  chemically synthesized
ttctactgatcttttaggtctc

SEQ ID NO: 110229 - DNA, 22 bp, Artificial Sequence
  chemically synthesized
tctactgatcttttaggtctca

SEQ ID NO: 110230 - DNA, 22 bp, Artificial Sequence
  chemically synthesized
ctactgatcttttaggtctcac

SEQ ID NO: 110231 - DNA, 22 bp, Artificial Sequence
  chemically synthesized
tactgatcttttaggtctcaca

SEQ ID NO: 110232 - DNA, 22 bp, Artificial Sequence
  chemically synthesized
ctgatcttttaggtctcacata

SEQ ID NO: 110233 - DNA, 22 bp, Artificial Sequence
  chemically synthesized
atcttttaggtctcacatagcc

SEQ ID NO: 110234 - DNA, 22 bp, Artificial Sequence
  chemically synthesized
ttaggtctcacatagcctggga

SEQ ID NO: 110235 - DNA, 22 bp, Artificial Sequence
  chemically synthesized
taggtctcacatagcctgggaa

SEQ ID NO: 110236 - DNA, 22 bp, Artificial Sequence
  chemically synthesized
aggtctcacatagcctgggaaa

SEQ ID NO: 110237 - DNA, 22 bp, Artificial Sequence
  chemically synthesized
ggtctcacatagcctgggaaac

SEQ ID NO: 110238 - DNA, 22 bp, Artificial Sequence
  chemically synthesized
acatagcctgggaaacctttac

SEQ ID NO: 110239 - DNA, 22 bp, Artificial Sequence
  chemically synthesized
ggaaacctttacatccacccta

SEQ ID NO: 110240 - DNA, 22 bp, Artificial Sequence
  chemically synthesized
tacatccaccctataataccac

SEQ ID NO: 110241 - DNA, 22 bp, Artificial Sequence
  chemically synthesized
acatccaccctataataccacc

SEQ ID NO: 110242 - DNA, 22 bp, Artificial Sequence
  chemically synthesized
catccaccctataataccacca

SEQ ID NO: 110243 - DNA, 22 bp, Artificial Sequence
  chemically synthesized
taataccaccagtcaggatgaa

SEQ ID NO: 110244 - DNA, 22 bp, Artificial Sequence
  chemically synthesized
taagtttcaggccattacagca

SEQ ID NO: 110245 - DNA, 22 bp, Artificial Sequence
  chemically synthesized
caggccattacagcactattca

SEQ ID NO: 110246 - DNA, 22 bp, Artificial Sequence
  chemically synthesized
aggccattacagcactattcaa

SEQ ID NO: 110247 - DNA, 22 bp, Artificial Sequence
  chemically synthesized
cagcactattcaaatatagtga

SEQ ID NO: 110248 - DNA, 22 bp, Artificial Sequence
  chemically synthesized
ttcaaatatagtgatttcttct

SEQ ID NO: 110249 - DNA, 22 bp, Artificial Sequence
  chemically synthesized
aaatatagtgatttcttctttc

SEQ ID NO: 110250 - DNA, 22 bp, Artificial Sequence
  chemically synthesized
cttctttcattttgtttttatt

SEQ ID NO: 110251 - DNA, 22 bp, Artificial Sequence
  chemically synthesized
ttctttcattttgtttttattt

SEQ ID NO: 110252 - DNA, 22 bp, Artificial Sequence
  chemically synthesized
ctttcattttgtttttattttc

SEQ ID NO: 110253 - DNA, 22 bp, Artificial Sequence
  chemically synthesized
tttcattttgtttttattttct

SEQ ID NO: 110254 - DNA, 22 bp, Artificial Sequence
  chemically synthesized
tcattttgtttttattttctgg

SEQ ID NO: 110255 - DNA, 22 bp, Artificial Sequence
  chemically synthesized
cattttgtttttattttctggg

SEQ ID NO: 110256 - DNA, 22 bp, Artificial Sequence
  chemically synthesized
attttgtttttattttctgggt

SEQ ID NO: 110257 - DNA, 22 bp, Artificial Sequence
  chemically synthesized
tgtttttattttctgggttata

SEQ ID NO: 110258 - DNA, 22 bp, Artificial Sequence
  chemically synthesized
gtttttattttctgggttatat

SEQ ID NO: 110259 - DNA, 22 bp, Artificial Sequence
  chemically synthesized
tttttattttctgggttatatg

SEQ ID NO: 110260 - DNA, 22 bp, Artificial Sequence
  chemically synthesized
ttattttctgggttatatgatt

SEQ ID NO: 110261 - DNA, 22 bp, Artificial Sequence
  chemically synthesized
tattttctgggttatatgattt

SEQ ID NO: 110262 - DNA, 22 bp, Artificial Sequence
  chemically synthesized
attttctgggttatatgattta

SEQ ID NO: 110263 - DNA, 22 bp, Artificial Sequence
  chemically synthesized
ttttctgggttatatgatttac

SEQ ID NO: 110264 - DNA, 22 bp, Artificial Sequence
  chemically synthesized
tctgggttatatgatttacaat

SEQ ID NO: 110265 - DNA, 22 bp, Artificial Sequence
  chemically synthesized
ctgggttatatgatttacaatg

SEQ ID NO: 110266 - DNA, 22 bp, Artificial Sequence
  chemically synthesized
tgggttatatgatttacaatga

SEQ ID NO: 110267 - DNA, 22 bp, Artificial Sequence
  chemically synthesized
ggttatatgatttacaatgaat

SEQ ID NO: 110268 - DNA, 22 bp, Artificial Sequence
  chemically synthesized
tatgatttacaatgaattcaac

SEQ ID NO: 110269 - DNA, 22 bp, Artificial Sequence
  chemically synthesized
acaatgaattcaacaatgttta

SEQ ID NO: 110270 - DNA, 22 bp, Artificial Sequence
  chemically synthesized
caatgaattcaacaatgtttat

SEQ ID NO: 110271 - DNA, 22 bp, Artificial Sequence
  chemically synthesized
aacaatgtttattctgcatgaa

SEQ ID NO: 110272 - DNA, 22 bp, Artificial Sequence
  chemically synthesized
attctgcatgaatagctgtatc

SEQ ID NO: 110273 - DNA, 22 bp, Artificial Sequence
  chemically synthesized
ttctgcatgaatagctgtatcc

SEQ ID NO: 110274 - DNA, 22 bp, Artificial Sequence
  chemically synthesized
tgcatgaatagctgtatcccca

SEQ ID NO: 110275 - DNA, 22 bp, Artificial Sequence
  chemically synthesized
catgaatagctgtatccccaac

SEQ ID NO: 110276 - DNA, 22 bp, Artificial Sequence
  chemically synthesized
tatccccaacgtagtatccaat

SEQ ID NO: 110277 - DNA, 22 bp, Artificial Sequence
  chemically synthesized
acatagagtaaaccctaaataa

SEQ ID NO: 110278 - DNA, 22 bp, Artificial Sequence
  chemically synthesized
catagagtaaaccctaaataat

SEQ ID NO: 110279 - DNA, 22 bp, Artificial Sequence
  chemically synthesized
aataatatcttctttatacatt

SEQ ID NO: 110280 - DNA, 22 bp, Artificial Sequence
  chemically synthesized
ctttatacattctattttccca

SEQ ID NO: 110281 - DNA, 22 bp, Artificial Sequence
  chemically synthesized
tttatacattctattttcccat

SEQ ID NO: 110282 - DNA, 22 bp, Artificial Sequence
  chemically synthesized
tatacattctattttcccatac

SEQ ID NO: 110283 - DNA, 22 bp, Artificial Sequence
  chemically synthesized
atacattctattttcccatacc

SEQ ID NO: 110284 - DNA, 22 bp, Artificial Sequence
  chemically synthesized
tacattctattttcccatacct

SEQ ID NO: 110285 - DNA, 22 bp, Artificial Sequence
  chemically synthesized
tattttcccatacctaggatct

SEQ ID NO: 110286 - DNA, 22 bp, Artificial Sequence
  chemically synthesized
ttttcccatacctaggatctcc

SEQ ID NO: 110287 - DNA, 22 bp, Artificial Sequence
  chemically synthesized
tcccatacctaggatctcccag

SEQ ID NO: 110288 - DNA, 22 bp, Artificial Sequence
  chemically synthesized
cccatacctaggatctcccagg

SEQ ID NO: 110289 - DNA, 22 bp, Artificial Sequence
  chemically synthesized
ccatacctaggatctcccagga

SEQ ID NO: 110290 - DNA, 22 bp, Artificial Sequence
  chemically synthesized
ggatctcccaggaatgactaaa

SEQ ID NO: 110291 - DNA, 22 bp, Artificial Sequence
  chemically synthesized
ccaggaatgactaaattatcat

SEQ ID NO: 110292 - DNA, 22 bp, Artificial Sequence
  chemically synthesized
aattatcatccttgctgtcact

SEQ ID NO: 110293 - DNA, 22 bp, Artificial Sequence
  chemically synthesized
tcatccttgctgtcactgaaag

SEQ ID NO: 110294 - DNA, 22 bp, Artificial Sequence
  chemically synthesized
gctgtcactgaaagtcaggact

SEQ ID NO: 110295 - DNA, 22 bp, Artificial Sequence
  chemically synthesized
ctgtcactgaaagtcaggactg

SEQ ID NO: 110296 - DNA, 22 bp, Artificial Sequence
  chemically synthesized
tcactgaaagtcaggactggtg

SEQ ID NO: 110297 - DNA, 22 bp, Artificial Sequence
  chemically synthesized
aaagtcaggactggtgaacatc

SEQ ID NO: 110298 - DNA, 22 bp, Artificial Sequence
  chemically synthesized
gtgaacatcttatgaacaggta

SEQ ID NO: 110299 - DNA, 22 bp, Artificial Sequence
  chemically synthesized
atgaacaggtagaattctcaag

SEQ ID NO: 110300 - DNA, 22 bp, Artificial Sequence
  chemically synthesized
tgaacaggtagaattctcaagg

SEQ ID NO: 110301 - DNA, 22 bp, Artificial Sequence
  chemically synthesized
tcaaggagcaacttttatacaa

SEQ ID NO: 110302 - DNA, 22 bp, Artificial Sequence
  chemically synthesized
aaggagcaacttttatacaact

SEQ ID NO: 110303 - DNA, 22 bp, Artificial Sequence
  chemically synthesized
ttatacaactgattactattgc

SEQ ID NO: 110304 - DNA, 22 bp, Artificial Sequence
  chemically synthesized
tatacaactgattactattgct

SEQ ID NO: 110305 - DNA, 22 bp, Artificial Sequence
  chemically synthesized
atacaactgattactattgctt

SEQ ID NO: 110306 - DNA, 22 bp, Artificial Sequence
  chemically synthesized
tacaactgattactattgcttt

SEQ ID NO: 110307 - DNA, 22 bp, Artificial Sequence
  chemically synthesized
attactattgctttacctggag

SEQ ID NO: 110308 - DNA, 22 bp, Artificial Sequence
  chemically synthesized
ctattgctttacctggagtaaa

SEQ ID NO: 110309 - DNA, 22 bp, Artificial Sequence
  chemically synthesized
ttgctttacctggagtaaatat

SEQ ID NO: 110310 - DNA, 22 bp, Artificial Sequence
  chemically synthesized
ctttacctggagtaaatatttg

SEQ ID NO: 110311 - DNA, 22 bp, Artificial Sequence
  chemically synthesized
tacctggagtaaatatttgcct

SEQ ID NO: 110312 - DNA, 22 bp, Artificial Sequence
  chemically synthesized
acctggagtaaatatttgcctc

SEQ ID NO: 110313 - DNA, 22 bp, Artificial Sequence
  chemically synthesized
cctggagtaaatatttgcctct

SEQ ID NO: 110314 - DNA, 22 bp, Artificial Sequence
  chemically synthesized
gagtaaatatttgcctctttgc

SEQ ID NO: 110315 - DNA, 22 bp, Artificial Sequence
  chemically synthesized
gcctctttgcaaagctggcaat

SEQ ID NO: 110316 - DNA, 22 bp, Artificial Sequence
  chemically synthesized
cctctttgcaaagctggcaatg

SEQ ID NO: 110317 - DNA, 22 bp, Artificial Sequence
  chemically synthesized
tttgcaaagctggcaatggggc

SEQ ID NO: 110318 - DNA, 22 bp, Artificial Sequence
  chemically synthesized
tgcaaagctggcaatggggctc

SEQ ID NO: 110319 - DNA, 22 bp, Artificial Sequence
  chemically synthesized
gcaaagctggcaatggggctca

SEQ ID NO: 110320 - DNA, 22 bp, Artificial Sequence
  chemically synthesized
caaagctggcaatggggctcaa

SEQ ID NO: 110321 - DNA, 22 bp, Artificial Sequence
  chemically synthesized
gcaatggggctcaataagtctg

SEQ ID NO: 110322 - DNA, 22 bp, Artificial Sequence
  chemically synthesized
aataagtctgcttccaccttcc

SEQ ID NO: 110323 - DNA, 22 bp, Artificial Sequence
  chemically synthesized
cttccaccttccagcttactgg

SEQ ID NO: 110324 - DNA, 22 bp, Artificial Sequence
  chemically synthesized
ccaccttccagcttactggctt

SEQ ID NO: 110325 - DNA, 22 bp, Artificial Sequence
  chemically synthesized
caccttccagcttactggcttc

SEQ ID NO: 110326 - DNA, 22 bp, Artificial Sequence
  chemically synthesized
ccagcttactggcttcccaggc

SEQ ID NO: 110327 - DNA, 22 bp, Artificial Sequence
  chemically synthesized
cagcttactggcttcccaggca

SEQ ID NO: 110328 - DNA, 22 bp, Artificial Sequence
  chemically synthesized
actggcttcccaggcatggaga

SEQ ID NO: 110329 - DNA, 22 bp, Artificial Sequence
  chemically synthesized
ctggcttcccaggcatggagaa

SEQ ID NO: 110330 - DNA, 22 bp, Artificial Sequence
  chemically synthesized
gcttcccaggcatggagaaggc

SEQ ID NO: 110331 - DNA, 22 bp, Artificial Sequence
  chemically synthesized
cccaggcatggagaaggcacat

SEQ ID NO: 110332 - DNA, 22 bp, Artificial Sequence
  chemically synthesized
ccaggcatggagaaggcacatc

SEQ ID NO: 110333 - DNA, 22 bp, Artificial Sequence
  chemically synthesized
gatattcatcccattattggca

SEQ ID NO: 110334 - DNA, 22 bp, Artificial Sequence
  chemically synthesized
atcccattattggcagcctaca

SEQ ID NO: 110335 - DNA, 22 bp, Artificial Sequence
  chemically synthesized
ttggcagcctacatctccatac

SEQ ID NO: 110336 - DNA, 22 bp, Artificial Sequence
  chemically synthesized
gcagcctacatctccatacttc

SEQ ID NO: 110337 - DNA, 22 bp, Artificial Sequence
  chemically synthesized
catctccatacttcttggcaat

SEQ ID NO: 110338 - DNA, 22 bp, Artificial Sequence
  chemically synthesized
catacttcttggcaatggcact

SEQ ID NO: 110339 - DNA, 22 bp, Artificial Sequence
  chemically synthesized
cttggcaatggcactcttctct

SEQ ID NO: 110340 - DNA, 22 bp, Artificial Sequence
  chemically synthesized
ttggcaatggcactcttctctt

SEQ ID NO: 110341 - DNA, 22 bp, Artificial Sequence
  chemically synthesized
ggcaatggcactcttctctttc

SEQ ID NO: 110342 - DNA, 22 bp, Artificial Sequence
  chemically synthesized
gcaatggcactcttctctttct

SEQ ID NO: 110343 - DNA, 22 bp, Artificial Sequence
  chemically synthesized
ttctctttctcatcaggaatga

SEQ ID NO: 110344 - DNA, 22 bp, Artificial Sequence
  chemically synthesized
ctctttctcatcaggaatgatc

SEQ ID NO: 110345 - DNA, 22 bp, Artificial Sequence
  chemically synthesized
tctttctcatcaggaatgatca

SEQ ID NO: 110346 - DNA, 22 bp, Artificial Sequence
  chemically synthesized
tttctcatcaggaatgatcata

SEQ ID NO: 110347 - DNA, 22 bp, Artificial Sequence
  chemically synthesized
tctcatcaggaatgatcataac

SEQ ID NO: 110348 - DNA, 22 bp, Artificial Sequence
  chemically synthesized
ctcatcaggaatgatcataacc

SEQ ID NO: 110349 - DNA, 22 bp, Artificial Sequence
  chemically synthesized
tcatcaggaatgatcataacct

SEQ ID NO: 110350 - DNA, 22 bp, Artificial Sequence
  chemically synthesized
atcaggaatgatcataacctcc

SEQ ID NO: 110351 - DNA, 22 bp, Artificial Sequence
  chemically synthesized
catgagcccatgtactatttct

SEQ ID NO: 110352 - DNA, 22 bp, Artificial Sequence
  chemically synthesized
tttcttagctatgttggcagct

SEQ ID NO: 110353 - DNA, 22 bp, Artificial Sequence
  chemically synthesized
cttagctatgttggcagctaca

SEQ ID NO: 110354 - DNA, 22 bp, Artificial Sequence
  chemically synthesized
ttagctatgttggcagctacag

SEQ ID NO: 110355 - DNA, 22 bp, Artificial Sequence
  chemically synthesized
agctatgttggcagctacagac

SEQ ID NO: 110356 - DNA, 22 bp, Artificial Sequence
  chemically synthesized
gctatgttggcagctacagacc

SEQ ID NO: 110357 - DNA, 22 bp, Artificial Sequence
  chemically synthesized
tgttggcagctacagacctcgg

SEQ ID NO: 110358 - DNA, 22 bp, Artificial Sequence
  chemically synthesized
gcagctacagacctcggagtga

SEQ ID NO: 110359 - DNA, 22 bp, Artificial Sequence
  chemically synthesized
cagacctcggagtgacattgac

SEQ ID NO: 110360 - DNA, 22 bp, Artificial Sequence
  chemically synthesized
ggagtgacattgaccacaatgc

SEQ ID NO: 110361 - DNA, 22 bp, Artificial Sequence
  chemically synthesized
accacaatgcccacagtgctag

SEQ ID NO: 110362 - DNA, 22 bp, Artificial Sequence
  chemically synthesized
ggtgttctgtggttagatcaca

SEQ ID NO: 110363 - DNA, 22 bp, Artificial Sequence
  chemically synthesized
tgtggttagatcacagggagat

SEQ ID NO: 110364 - DNA, 22 bp, Artificial Sequence
  chemically synthesized
tggttagatcacagggagattg

SEQ ID NO: 110365 - DNA, 22 bp, Artificial Sequence
  chemically synthesized
gatcacagggagattggccatg

SEQ ID NO: 110366 - DNA, 22 bp, Artificial Sequence
  chemically synthesized
gccatggagcctgcttctctca

SEQ ID NO: 110367 - DNA, 22 bp, Artificial Sequence
  chemically synthesized
cttctctcaggcctattttatc

SEQ ID NO: 110368 - DNA, 22 bp, Artificial Sequence
  chemically synthesized
ctctcaggcctattttatccat

SEQ ID NO: 110369 - DNA, 22 bp, Artificial Sequence
  chemically synthesized
tctcaggcctattttatccata

SEQ ID NO: 110370 - DNA, 22 bp, Artificial Sequence
  chemically synthesized
tcaggcctattttatccatact

SEQ ID NO: 110371 - DNA, 22 bp, Artificial Sequence
  chemically synthesized
aggcctattttatccatactct

SEQ ID NO: 110372 - DNA, 22 bp, Artificial Sequence
  chemically synthesized
ttttatccatactctttctgtc

SEQ ID NO: 110373 - DNA, 22 bp, Artificial Sequence
  chemically synthesized
tatccatactctttctgtcatg

SEQ ID NO: 110374 - DNA, 22 bp, Artificial Sequence
  chemically synthesized
atccatactctttctgtcatgg

SEQ ID NO: 110375 - DNA, 22 bp, Artificial Sequence
  chemically synthesized
tccatactctttctgtcatgga

SEQ ID NO: 110376 - DNA, 22 bp, Artificial Sequence
  chemically synthesized
tttctgtcatggagtcaggtgt

SEQ ID NO: 110377 - DNA, 22 bp, Artificial Sequence
  chemically synthesized
tctgtcatggagtcaggtgtct

SEQ ID NO: 110378 - DNA, 22 bp, Artificial Sequence
  chemically synthesized
ctgtcatggagtcaggtgtctt

SEQ ID NO: 110379 - DNA, 22 bp, Artificial Sequence
  chemically synthesized
tgtcatggagtcaggtgtcttg

SEQ ID NO: 110380 - DNA, 22 bp, Artificial Sequence
  chemically synthesized
tcatggagtcaggtgtcttgct

SEQ ID NO: 110381 - DNA, 22 bp, Artificial Sequence
  chemically synthesized
gcttgccatggcttatgactgt

SEQ ID NO: 110382 - DNA, 22 bp, Artificial Sequence
  chemically synthesized
cttgccatggcttatgactgtt

SEQ ID NO: 110383 - DNA, 22 bp, Artificial Sequence
  chemically synthesized
gccatggcttatgactgtttca

SEQ ID NO: 110384 - DNA, 22 bp, Artificial Sequence
  chemically synthesized
ccatggcttatgactgtttcat

SEQ ID NO: 110385 - DNA, 22 bp, Artificial Sequence
  chemically synthesized
atgactgtttcattaccatccg

SEQ ID NO: 110386 - DNA, 22 bp, Artificial Sequence
  chemically synthesized
tgactgtttcattaccatccgc

SEQ ID NO: 110387 - DNA, 22 bp, Artificial Sequence
  chemically synthesized
tttcattaccatccgcagcccc

SEQ ID NO: 110388 - DNA, 22 bp, Artificial Sequence
  chemically synthesized
cattaccatccgcagcccctta

SEQ ID NO: 110389 - DNA, 22 bp, Artificial Sequence
  chemically synthesized
attaccatccgcagccccttaa

SEQ ID NO: 110390 - DNA, 22 bp, Artificial Sequence
  chemically synthesized
ccatccgcagccccttaagata

SEQ ID NO: 110391 - DNA, 22 bp, Artificial Sequence
  chemically synthesized
aagatatacctctatcctgacc

SEQ ID NO: 110392 - DNA, 22 bp, Artificial Sequence
  chemically synthesized
agatatacctctatcctgacca

SEQ ID NO: 110393 - DNA, 22 bp, Artificial Sequence
  chemically synthesized
tatcctgaccaacacccaggta

SEQ ID NO: 110394 - DNA, 22 bp, Artificial Sequence
  chemically synthesized
tcctgaccaacacccaggtaat

SEQ ID NO: 110395 - DNA, 22 bp, Artificial Sequence
  chemically synthesized
accaacacccaggtaatgaaga

SEQ ID NO: 110396 - DNA, 22 bp, Artificial Sequence
  chemically synthesized
gtgtgcgggtattgacaagggc

SEQ ID NO: 110397 - DNA, 22 bp, Artificial Sequence
  chemically synthesized
acaagggctggtctgtccatta

SEQ ID NO: 110398 - DNA, 22 bp, Artificial Sequence
  chemically synthesized
gtctgtccattatgccaatagt

SEQ ID NO: 110399 - DNA, 22 bp, Artificial Sequence
  chemically synthesized
tccattatgccaatagttgttc

SEQ ID NO: 110400 - DNA, 22 bp, Artificial Sequence
  chemically synthesized
tgccaatagttgttcgcctaca

SEQ ID NO: 110401 - DNA, 22 bp, Artificial Sequence
  chemically synthesized
ttcgcctacactggtttcccta

SEQ ID NO: 110402 - DNA, 22 bp, Artificial Sequence
  chemically synthesized
gcctacactggtttccctactg

SEQ ID NO: 110403 - DNA, 22 bp, Artificial Sequence
  chemically synthesized
cactggtttccctactgtcgat

SEQ ID NO: 110404 - DNA, 22 bp, Artificial Sequence
  chemically synthesized
gtttccctactgtcgatcccat

SEQ ID NO: 110405 - DNA, 22 bp, Artificial Sequence
  chemically synthesized
ccctactgtcgatcccatgtac

SEQ ID NO: 110406 - DNA, 22 bp, Artificial Sequence
  chemically synthesized
cctactgtcgatcccatgtact

SEQ ID NO: 110407 - DNA, 22 bp, Artificial Sequence
  chemically synthesized
ctgtcgatcccatgtactctcc

SEQ ID NO: 110408 - DNA, 22 bp, Artificial Sequence
  chemically synthesized
tcgatcccatgtactctcccat

SEQ ID NO: 110409 - DNA, 22 bp, Artificial Sequence
  chemically synthesized
tcccatgctttctgtctacacc

SEQ ID NO: 110410 - DNA, 22 bp, Artificial Sequence
  chemically synthesized
ccatgctttctgtctacaccaa

SEQ ID NO: 110411 - DNA, 22 bp, Artificial Sequence
  chemically synthesized
tctgtctacaccaagatgtcat

SEQ ID NO: 110412 - DNA, 22 bp, Artificial Sequence
  chemically synthesized
ctgtctacaccaagatgtcatc

SEQ ID NO: 110413 - DNA, 22 bp, Artificial Sequence
  chemically synthesized
tgtctacaccaagatgtcatca

SEQ ID NO: 110414 - DNA, 22 bp, Artificial Sequence
  chemically synthesized
tctacaccaagatgtcatcaag

SEQ ID NO: 110415 - DNA, 22 bp, Artificial Sequence
  chemically synthesized
caccaagatgtcatcaagctag

SEQ ID NO: 110416 - DNA, 22 bp, Artificial Sequence
  chemically synthesized
gcctgtgctgacatcaccttca

SEQ ID NO: 110417 - DNA, 22 bp, Artificial Sequence
  chemically synthesized
tgctgacatcaccttcaaccgt

SEQ ID NO: 110418 - DNA, 22 bp, Artificial Sequence
  chemically synthesized
acatcaccttcaaccgtctcta

SEQ ID NO: 110419 - DNA, 22 bp, Artificial Sequence
  chemically synthesized
caaccgtctctatccagttgta

SEQ ID NO: 110420 - DNA, 22 bp, Artificial Sequence
  chemically synthesized
aaccgtctctatccagttgtag

SEQ ID NO: 110421 - DNA, 22 bp, Artificial Sequence
  chemically synthesized
tatccagttgtagttttatttg

SEQ ID NO: 110422 - DNA, 22 bp, Artificial Sequence
  chemically synthesized
tccagttgtagttttatttgca

SEQ ID NO: 110423 - DNA, 22 bp, Artificial Sequence
  chemically synthesized
tagttttatttgcaatggtctt

SEQ ID NO: 110424 - DNA, 22 bp, Artificial Sequence
  chemically synthesized
tatttgcaatggtcttgttgga

SEQ ID NO: 110425 - DNA, 22 bp, Artificial Sequence
  chemically synthesized
atttgcaatggtcttgttggac

SEQ ID NO: 110426 - DNA, 22 bp, Artificial Sequence
  chemically synthesized
tttgcaatggtcttgttggact

SEQ ID NO: 110427 - DNA, 22 bp, Artificial Sequence
  chemically synthesized
gcaatggtcttgttggactttc

SEQ ID NO: 110428 - DNA, 22 bp, Artificial Sequence
  chemically synthesized
caatggtcttgttggactttct

SEQ ID NO: 110429 - DNA, 22 bp, Artificial Sequence
  chemically synthesized
gttggactttctcatcatcttt

SEQ ID NO: 110430 - DNA, 22 bp, Artificial Sequence
  chemically synthesized
ttggactttctcatcatctttt

SEQ ID NO: 110431 - DNA, 22 bp, Artificial Sequence
  chemically synthesized
gactttctcatcatctttttct

SEQ ID NO: 110432 - DNA, 22 bp, Artificial Sequence
  chemically synthesized
tctcatcatctttttctcctac

SEQ ID NO: 110433 - DNA, 22 bp, Artificial Sequence
  chemically synthesized
ctcatcatctttttctcctaca

SEQ ID NO: 110434 - DNA, 22 bp, Artificial Sequence
  chemically synthesized
tcatcatctttttctcctacat

SEQ ID NO: 110435 - DNA, 22 bp, Artificial Sequence
  chemically synthesized
atcatctttttctcctacattt

SEQ ID NO: 110436 - DNA, 22 bp, Artificial Sequence
  chemically synthesized
tttctcctacattttgattctc

SEQ ID NO: 110437 - DNA, 22 bp, Artificial Sequence
  chemically synthesized
ttctcctacattttgattctca

SEQ ID NO: 110438 - DNA, 22 bp, Artificial Sequence
  chemically synthesized
tctcctacattttgattctcaa

SEQ ID NO: 110439 - DNA, 22 bp, Artificial Sequence
  chemically synthesized
ctcctacattttgattctcaag

SEQ ID NO: 110440 - DNA, 22 bp, Artificial Sequence
  chemically synthesized
tcctacattttgattctcaaga

SEQ ID NO: 110441 - DNA, 22 bp, Artificial Sequence
  chemically synthesized
ctacattttgattctcaagact

SEQ ID NO: 110442 - DNA, 22 bp, Artificial Sequence
  chemically synthesized
cattttgattctcaagactgtc

SEQ ID NO: 110443 - DNA, 22 bp, Artificial Sequence
  chemically synthesized
tgattctcaagactgtcatggg

SEQ ID NO: 110444 - DNA, 22 bp, Artificial Sequence
  chemically synthesized
gattctcaagactgtcatgggc

SEQ ID NO: 110445 - DNA, 22 bp, Artificial Sequence
  chemically synthesized
attctcaagactgtcatgggca

SEQ ID NO: 110446 - DNA, 22 bp, Artificial Sequence
  chemically synthesized
tcaagactgtcatgggcattgg

SEQ ID NO: 110447 - DNA, 22 bp, Artificial Sequence
  chemically synthesized
aagactgtcatgggcattggtt

SEQ ID NO: 110448 - DNA, 22 bp, Artificial Sequence
  chemically synthesized
tcatgggcattggttctggagg

SEQ ID NO: 110449 - DNA, 22 bp, Artificial Sequence
  chemically synthesized
gttctggaggagaaagggccaa

SEQ ID NO: 110450 - DNA, 22 bp, Artificial Sequence
  chemically synthesized
tggaggagaaagggccaaggcc

SEQ ID NO: 110451 - DNA, 22 bp, Artificial Sequence
  chemically synthesized
gaggagaaagggccaaggccct

SEQ ID NO: 110452 - DNA, 22 bp, Artificial Sequence
  chemically synthesized
aacacatgtgtctctcatatct

SEQ ID NO: 110453 - DNA, 22 bp, Artificial Sequence
  chemically synthesized
tcatatctgctgcatcctggtc

SEQ ID NO: 110454 - DNA, 22 bp, Artificial Sequence
  chemically synthesized
atatctgctgcatcctggtctt

SEQ ID NO: 110455 - DNA, 22 bp, Artificial Sequence
  chemically synthesized
ctgcatcctggtcttctatgtc

SEQ ID NO: 110456 - DNA, 22 bp, Artificial Sequence
  chemically synthesized
catcctggtcttctatgtcact

SEQ ID NO: 110457 - DNA, 22 bp, Artificial Sequence
  chemically synthesized
gtcttctatgtcactgtagttt

SEQ ID NO: 110458 - DNA, 22 bp, Artificial Sequence
  chemically synthesized
ctatgtcactgtagtttgtctg

SEQ ID NO: 110459 - DNA, 22 bp, Artificial Sequence
  chemically synthesized
tatgtcactgtagtttgtctga

SEQ ID NO: 110460 - DNA, 22 bp, Artificial Sequence
  chemically synthesized
tgtcactgtagtttgtctgaca

SEQ ID NO: 110461 - DNA, 22 bp, Artificial Sequence
  chemically synthesized
tagtttgtctgacatttattca

SEQ ID NO: 110462 - DNA, 22 bp, Artificial Sequence
  chemically synthesized
gtctgacatttattcataggtt

SEQ ID NO: 110463 - DNA, 22 bp, Artificial Sequence
  chemically synthesized
tctgacatttattcataggttt

SEQ ID NO: 110464 - DNA, 22 bp, Artificial Sequence
  chemically synthesized
acatttattcataggtttggaa

SEQ ID NO: 110465 - DNA, 22 bp, Artificial Sequence
  chemically synthesized
attcataggtttggaaagcatg

SEQ ID NO: 110466 - DNA, 22 bp, Artificial Sequence
  chemically synthesized
ttcataggtttggaaagcatgt

SEQ ID NO: 110467 - DNA, 22 bp, Artificial Sequence
  chemically synthesized
ataggtttggaaagcatgttcc

SEQ ID NO: 110468 - DNA, 22 bp, Artificial Sequence
  chemically synthesized
ggaaagcatgttcctcatgtcg

SEQ ID NO: 110469 - DNA, 22 bp, Artificial Sequence
  chemically synthesized
gaaagcatgttcctcatgtcgt

SEQ ID NO: 110470 - DNA, 22 bp, Artificial Sequence
  chemically synthesized
ctcatgtcgttcacatcacaat

SEQ ID NO: 110471 - DNA, 22 bp, Artificial Sequence
  chemically synthesized
atgtcgttcacatcacaatgag

SEQ ID NO: 110472 - DNA, 22 bp, Artificial Sequence
  chemically synthesized
acatcacaatgagctacatcca

SEQ ID NO: 110473 - DNA, 22 bp, Artificial Sequence
  chemically synthesized
catccacttccttttcccacct

SEQ ID NO: 110474 - DNA, 22 bp, Artificial Sequence
  chemically synthesized
ccttttcccaccttttatgaac

SEQ ID NO: 110475 - DNA, 22 bp, Artificial Sequence
  chemically synthesized
cttttcccaccttttatgaacc

SEQ ID NO: 110476 - DNA, 22 bp, Artificial Sequence
  chemically synthesized
ttcccaccttttatgaacccat

SEQ ID NO: 110477 - DNA, 22 bp, Artificial Sequence
  chemically synthesized
tcccaccttttatgaacccatt

SEQ ID NO: 110478 - DNA, 22 bp, Artificial Sequence
  chemically synthesized
cccaccttttatgaacccattt

SEQ ID NO: 110479 - DNA, 22 bp, Artificial Sequence
  chemically synthesized
ccaccttttatgaacccattta

SEQ ID NO: 110480 - DNA, 22 bp, Artificial Sequence
  chemically synthesized
ttatgaacccatttatctatag

SEQ ID NO: 110481 - DNA, 22 bp, Artificial Sequence
  chemically synthesized
tatgaacccatttatctatagc

SEQ ID NO: 110482 - DNA, 22 bp, Artificial Sequence
  chemically synthesized
atgaacccatttatctatagca

SEQ ID NO: 110483 - DNA, 22 bp, Artificial Sequence
  chemically synthesized
tgaacccatttatctatagcat

SEQ ID NO: 110484 - DNA, 22 bp, Artificial Sequence
  chemically synthesized
atctatagcattaaaactaagc

SEQ ID NO: 110485 - DNA, 22 bp, Artificial Sequence
  chemically synthesized
tctatagcattaaaactaagca

SEQ ID NO: 110486 - DNA, 22 bp, Artificial Sequence
  chemically synthesized
tagcattaaaactaagcagatt

SEQ ID NO: 110487 - DNA, 22 bp, Artificial Sequence
  chemically synthesized
aaactaagcagattcagagtgg

SEQ ID NO: 110488 - DNA, 22 bp, Artificial Sequence
  chemically synthesized
agcagattcagagtggcatact

SEQ ID NO: 110489 - DNA, 22 bp, Artificial Sequence
  chemically synthesized
agagtggcatacttcgtttatt

SEQ ID NO: 110490 - DNA, 22 bp, Artificial Sequence
  chemically synthesized
cgtttattctctctgcctcact

SEQ ID NO: 110491 - DNA, 22 bp, Artificial Sequence
  chemically synthesized
gtttattctctctgcctcactc

SEQ ID NO: 110492 - DNA, 22 bp, Artificial Sequence
  chemically synthesized
attctctctgcctcactctaga

SEQ ID NO: 110493 - DNA, 22 bp, Artificial Sequence
  chemically synthesized
ttctctctgcctcactctagag

SEQ ID NO: 110494 - DNA, 22 bp, Artificial Sequence
  chemically synthesized
tctctgcctcactctagagcat

SEQ ID NO: 110495 - DNA, 22 bp, Artificial Sequence
  chemically synthesized
tctgcctcactctagagcatga

SEQ ID NO: 110496 - DNA, 22 bp, Artificial Sequence
  chemically synthesized
tgcctcactctagagcatgaca

SEQ ID NO: 110497 - DNA, 22 bp, Artificial Sequence
  chemically synthesized
cctcactctagagcatgacatt

SEQ ID NO: 110498 - DNA, 22 bp, Artificial Sequence
  chemically synthesized
actctagagcatgacattgttt

SEQ ID NO: 110499 - DNA, 22 bp, Artificial Sequence
  chemically synthesized
tagagcatgacattgtttcact

SEQ ID NO: 110500 - DNA, 22 bp, Artificial Sequence
  chemically synthesized
gagcatgacattgtttcactgg

SEQ ID NO: 110501 - DNA, 22 bp, Artificial Sequence
  chemically synthesized
tttcactggtctctgaggaata

SEQ ID NO: 110502 - DNA, 22 bp, Artificial Sequence
  chemically synthesized
cactggtctctgaggaataatt

SEQ ID NO: 110503 - DNA, 22 bp, Artificial Sequence
  chemically synthesized
actggtctctgaggaataattc

SEQ ID NO: 110504 - DNA, 22 bp, Artificial Sequence
  chemically synthesized
gtctctgaggaataattcaggg

SEQ ID NO: 110505 - DNA, 22 bp, Artificial Sequence
  chemically synthesized
tgaggaataattcaggggacct

SEQ ID NO: 110506 - DNA, 22 bp, Artificial Sequence
  chemically synthesized
aggaataattcaggggacctgg

SEQ ID NO: 110507 - DNA, 22 bp, Artificial Sequence
  chemically synthesized
aggggacctggacaggatgaca

SEQ ID NO: 110508 - DNA, 22 bp, Artificial Sequence
  chemically synthesized
gacaggatgacaatgttgccag

SEQ ID NO: 110509 - DNA, 22 bp, Artificial Sequence
  chemically synthesized
ccagcataagtaactagggaaa

SEQ ID NO: 110510 - DNA, 22 bp, Artificial Sequence
  chemically synthesized
gggaaagtcatttcaatgagaa

SEQ ID NO: 110511 - DNA, 22 bp, Artificial Sequence
  chemically synthesized
caatgagaactaatcaatccct

SEQ ID NO: 110512 - DNA, 22 bp, Artificial Sequence
  chemically synthesized
aatgagaactaatcaatccctg

SEQ ID NO: 110513 - DNA, 22 bp, Artificial Sequence
  chemically synthesized
atcaatccctgagcatttcagt

SEQ ID NO: 110514 - DNA, 22 bp, Artificial Sequence
  chemically synthesized
agcatttcagtggaaatcagtc

SEQ ID NO: 110515 - DNA, 22 bp, Artificial Sequence
  chemically synthesized
cagtggaaatcagtcaatccct

SEQ ID NO: 110516 - DNA, 22 bp, Artificial Sequence
  chemically synthesized
agtggaaatcagtcaatccctc

SEQ ID NO: 110517 - DNA, 22 bp, Artificial Sequence
  chemically synthesized
tgctacttagaacattatttta

SEQ ID NO: 110518 - DNA, 22 bp, Artificial Sequence
  chemically synthesized
ctacttagaacattattttacc

SEQ ID NO: 110519 - DNA, 22 bp, Artificial Sequence
  chemically synthesized
cttagaacattattttaccctg

SEQ ID NO: 110520 - DNA, 22 bp, Artificial Sequence
  chemically synthesized
agaacattattttaccctgcct

SEQ ID NO: 110521 - DNA, 22 bp, Artificial Sequence
  chemically synthesized
gaacattattttaccctgcctg

SEQ ID NO: 110522 - DNA, 22 bp, Artificial Sequence
  chemically synthesized
ttttaccctgcctgtctattgc

SEQ ID NO: 110523 - DNA, 22 bp, Artificial Sequence
  chemically synthesized
taccctgcctgtctattgctga

SEQ ID NO: 110524 - DNA, 22 bp, Artificial Sequence
  chemically synthesized
accctgcctgtctattgctgat

SEQ ID NO: 110525 - DNA, 22 bp, Artificial Sequence
  chemically synthesized
ccctgcctgtctattgctgatt

SEQ ID NO: 110526 - DNA, 22 bp, Artificial Sequence
  chemically synthesized
cctgtctattgctgatttgtat

SEQ ID NO: 110527 - DNA, 22 bp, Artificial Sequence
  chemically synthesized
tctattgctgatttgtataaga

SEQ ID NO: 110528 - DNA, 22 bp, Artificial Sequence
  chemically synthesized
ttgctgatttgtataagatata

SEQ ID NO: 110529 - DNA, 22 bp, Artificial Sequence
  chemically synthesized
ctgatttgtataagatatatgt

SEQ ID NO: 110530 - DNA, 22 bp, Artificial Sequence
  chemically synthesized
atttgtataagatatatgtaca

SEQ ID NO: 110531 - DNA, 22 bp, Artificial Sequence
  chemically synthesized
gtataagatatatgtacaacac

SEQ ID NO: 110532 - DNA, 22 bp, Artificial Sequence
  chemically synthesized
tataagatatatgtacaacact

SEQ ID NO: 110533 - DNA, 22 bp, Artificial Sequence
  chemically synthesized
agtacatatctcagtgctcaac

SEQ ID NO: 110534 - DNA, 22 bp, Artificial Sequence
  chemically synthesized
agtgctcaactgatattgtttt

SEQ ID NO: 110535 - DNA, 22 bp, Artificial Sequence
  chemically synthesized
aactgatattgttttctcaggt

SEQ ID NO: 110536 - DNA, 22 bp, Artificial Sequence
  chemically synthesized
atattgttttctcaggtaattt

SEQ ID NO: 110537 - DNA, 22 bp, Artificial Sequence
  chemically synthesized
ttttctcaggtaatttaactca

SEQ ID NO: 110538 - DNA, 22 bp, Artificial Sequence
  chemically synthesized
tctcaggtaatttaactcacat

SEQ ID NO: 110539 - DNA, 22 bp, Artificial Sequence
  chemically synthesized
ctcaggtaatttaactcacatt

SEQ ID NO: 110540 - DNA, 22 bp, Artificial Sequence
  chemically synthesized
tcaggtaatttaactcacattg

SEQ ID NO: 110541 - DNA, 22 bp, Artificial Sequence
  chemically synthesized
aggtaatttaactcacattgtt

SEQ ID NO: 110542 - DNA, 22 bp, Artificial Sequence
  chemically synthesized
aactcacattgtttgattagct

SEQ ID NO: 110543 - DNA, 22 bp, Artificial Sequence
  chemically synthesized
actcacattgtttgattagctt

SEQ ID NO: 110544 - DNA, 22 bp, Artificial Sequence
  chemically synthesized
acattgtttgattagcttatgg

SEQ ID NO: 110545 - DNA, 22 bp, Artificial Sequence
  chemically synthesized
tttgattagcttatggctggca

SEQ ID NO: 110546 - DNA, 22 bp, Artificial Sequence
  chemically synthesized
gattagcttatggctggcacca

SEQ ID NO: 110547 - DNA, 22 bp, Artificial Sequence
  chemically synthesized
attagcttatggctggcaccat

SEQ ID NO: 110548 - DNA, 22 bp, Artificial Sequence
  chemically synthesized
gcttatggctggcaccatacac

SEQ ID NO: 110549 - DNA, 22 bp, Artificial Sequence
  chemically synthesized
atggctggcaccatacacatac

SEQ ID NO: 110550 - DNA, 22 bp, Artificial Sequence
  chemically synthesized
tggctggcaccatacacataca

SEQ ID NO: 110551 - DNA, 22 bp, Artificial Sequence
  chemically synthesized
gcaccatacacatacatacata

SEQ ID NO: 110552 - DNA, 22 bp, Artificial Sequence
  chemically synthesized
acacacatacatatacacacac

SEQ ID NO: 110553 - DNA, 22 bp, Artificial Sequence
  chemically synthesized
cacacatacatatacacacaca

SEQ ID NO: 110554 - DNA, 22 bp, Artificial Sequence
  chemically synthesized
ttatatatatttaatatatata

SEQ ID NO: 110555 - DNA, 22 bp, Artificial Sequence
  chemically synthesized
tatatatttaatatatataata

SEQ ID NO: 110556 - DNA, 22 bp, Artificial Sequence
  chemically synthesized
aatatatataatacacactatt

SEQ ID NO: 110557 - DNA, 22 bp, Artificial Sequence
  chemically synthesized
atatatataatacacactatta

SEQ ID NO: 110558 - DNA, 22 bp, Artificial Sequence
  chemically synthesized
ttatatatacttaatatataat

SEQ ID NO: 110559 - DNA, 22 bp, Artificial Sequence
  chemically synthesized
tatatacttaatatataatagt

SEQ ID NO: 110560 - DNA, 22 bp, Artificial Sequence
  chemically synthesized
aatatataatagtgtgtgtatg

SEQ ID NO: 110561 - DNA, 22 bp, Artificial Sequence
  chemically synthesized
atatataatagtgtgtgtatgt

SEQ ID NO: 110562 - DNA, 22 bp, Artificial Sequence
  chemically synthesized
tgtgtgtttatatatattatat

SEQ ID NO: 110563 - DNA, 22 bp, Artificial Sequence
  chemically synthesized
atatatattatataaataatat

SEQ ID NO: 110564 - DNA, 22 bp, Artificial Sequence
  chemically synthesized
tatatattatataaataatata

SEQ ID NO: 110565 - DNA, 22 bp, Artificial Sequence
  chemically synthesized
tataaataatatatatatatga

SEQ ID NO: 110566 - DNA, 22 bp, Artificial Sequence
  chemically synthesized
tatatataattcttgggtctat

SEQ ID NO: 110567 - DNA, 22 bp, Artificial Sequence
  chemically synthesized
ttgggtctatgatttgggtcac

SEQ ID NO: 110568 - DNA, 22 bp, Artificial Sequence
  chemically synthesized
gggtctatgatttgggtcaccg

SEQ ID NO: 110569 - DNA, 22 bp, Artificial Sequence
  chemically synthesized
ggtctatgatttgggtcaccgg

SEQ ID NO: 110570 - DNA, 22 bp, Artificial Sequence
  chemically synthesized
tgatttgggtcaccggcatttc

SEQ ID NO: 110571 - DNA, 22 bp, Artificial Sequence
  chemically synthesized
gggtcaccggcatttcagtcaa

SEQ ID NO: 110572 - DNA, 22 bp, Artificial Sequence
  chemically synthesized
ggtcaccggcatttcagtcaat

SEQ ID NO: 110573 - DNA, 22 bp, Artificial Sequence
  chemically synthesized
cagtcaatgcccattgctctcc

SEQ ID NO: 110574 - DNA, 22 bp, Artificial Sequence
  chemically synthesized
agtcaatgcccattgctctcca

SEQ ID NO: 110575 - DNA, 22 bp, Artificial Sequence
  chemically synthesized
ctctccatatggcttgcatata

SEQ ID NO: 110576 - DNA, 22 bp, Artificial Sequence
  chemically synthesized
tccatatggcttgcatatatta

SEQ ID NO: 110577 - DNA, 22 bp, Artificial Sequence
  chemically synthesized
catatggcttgcatatattagt

SEQ ID NO: 110578 - DNA, 22 bp, Artificial Sequence
  chemically synthesized
gcatatattagtcctgttatac

SEQ ID NO: 110579 - DNA, 22 bp, Artificial Sequence
  chemically synthesized
catatattagtcctgttataca

SEQ ID NO: 110580 - DNA, 22 bp, Artificial Sequence
  chemically synthesized
gtcctgttatacataggaataa

SEQ ID NO: 110581 - DNA, 22 bp, Artificial Sequence
  chemically synthesized
ttatacataggaataaggcatt

SEQ ID NO: 110582 - DNA, 22 bp, Artificial Sequence
  chemically synthesized
tacataggaataaggcattttt

SEQ ID NO: 110583 - DNA, 22 bp, Artificial Sequence
  chemically synthesized
ttggcttcagacatacatccag

SEQ ID NO: 110584 - DNA, 22 bp, Artificial Sequence
  chemically synthesized
tggcttcagacatacatccagt

SEQ ID NO: 110585 - DNA, 22 bp, Artificial Sequence
  chemically synthesized
ggcttcagacatacatccagtt

SEQ ID NO: 110586 - DNA, 22 bp, Artificial Sequence
  chemically synthesized
gcttcagacatacatccagttc

SEQ ID NO: 110587 - DNA, 22 bp, Artificial Sequence
  chemically synthesized
cagacatacatccagttctctt

SEQ ID NO: 110588 - DNA, 22 bp, Artificial Sequence
  chemically synthesized
agacatacatccagttctcttg

SEQ ID NO: 110589 - DNA, 22 bp, Artificial Sequence
  chemically synthesized
tcttgcatatatggagctggct

SEQ ID NO: 110590 - DNA, 22 bp, Artificial Sequence
  chemically synthesized
ttgcatatatggagctggctgc

SEQ ID NO: 110591 - DNA, 22 bp, Artificial Sequence
  chemically synthesized
gcatatatggagctggctgctg

SEQ ID NO: 110592 - DNA, 22 bp, Artificial Sequence
  chemically synthesized
catatatggagctggctgctgt

SEQ ID NO: 110593 - DNA, 22 bp, Artificial Sequence
  chemically synthesized
gctgctgtttctagaaaattgc

SEQ ID NO: 110594 - DNA, 22 bp, Artificial Sequence
  chemically synthesized
ctgtttctagaaaattgcacgt

SEQ ID NO: 110595 - DNA, 22 bp, Artificial Sequence
  chemically synthesized
tttctagaaaattgcacgtgaa

SEQ ID NO: 110596 - DNA, 22 bp, Artificial Sequence
  chemically synthesized
ctagaaaattgcacgtgaagaa

SEQ ID NO: 110597 - DNA, 22 bp, Artificial Sequence
  chemically synthesized
tagaaaattgcacgtgaagaaa

SEQ ID NO: 110598 - DNA, 22 bp, Artificial Sequence
  chemically synthesized
gaaaattgcacgtgaagaaatg

SEQ ID NO: 110599 - DNA, 22 bp, Artificial Sequence
  chemically synthesized
cacgtgaagaaatgagactttc

SEQ ID NO: 110600 - DNA, 22 bp, Artificial Sequence
  chemically synthesized
tcttcaatgagagtaagccatt

SEQ ID NO: 110601 - DNA, 22 bp, Artificial Sequence
  chemically synthesized
cttcaatgagagtaagccattt

SEQ ID NO: 110602 - DNA, 22 bp, Artificial Sequence
  chemically synthesized
ttcaatgagagtaagccatttc

SEQ ID NO: 110603 - DNA, 22 bp, Artificial Sequence
  chemically synthesized
caatgagagtaagccatttccc

SEQ ID NO: 110604 - DNA, 22 bp, Artificial Sequence
  chemically synthesized
aatgagagtaagccatttccct

SEQ ID NO: 110605 - DNA, 22 bp, Artificial Sequence
  chemically synthesized
ccctcaattactttcttcaatg

SEQ ID NO: 110606 - DNA, 22 bp, Artificial Sequence
  chemically synthesized
cctcaattactttcttcaatga

SEQ ID NO: 110607 - DNA, 22 bp, Artificial Sequence
  chemically synthesized
aattactttcttcaatgagggt

SEQ ID NO: 110608 - DNA, 22 bp, Artificial Sequence
  chemically synthesized
ctttcttcaatgagggtaaacc

SEQ ID NO: 110609 - DNA, 22 bp, Artificial Sequence
  chemically synthesized
tcttcaatgagggtaaaccatt

SEQ ID NO: 110610 - DNA, 22 bp, Artificial Sequence
  chemically synthesized
cttcaatgagggtaaaccattt

SEQ ID NO: 110611 - DNA, 22 bp, Artificial Sequence
  chemically synthesized
ttcaatgagggtaaaccatttc

SEQ ID NO: 110612 - DNA, 22 bp, Artificial Sequence
  chemically synthesized
caatgagggtaaaccatttccc

SEQ ID NO: 110613 - DNA, 22 bp, Artificial Sequence
  chemically synthesized
aatgagggtaaaccatttccct

SEQ ID NO: 110614 - DNA, 22 bp, Artificial Sequence
  chemically synthesized
ccctcaattcaaaatgatgagt

SEQ ID NO: 110615 - DNA, 22 bp, Artificial Sequence
  chemically synthesized
cctcaattcaaaatgatgagtc

SEQ ID NO: 110616 - DNA, 22 bp, Artificial Sequence
  chemically synthesized
aattcaaaatgatgagtctagg

SEQ ID NO: 110617 - DNA, 22 bp, Artificial Sequence
  chemically synthesized
aaaatgatgagtctagggaaag

SEQ ID NO: 110618 - DNA, 22 bp, Artificial Sequence
  chemically synthesized
gggaaagtatctctatgagaaa

SEQ ID NO: 110619 - DNA, 22 bp, Artificial Sequence
  chemically synthesized
tatgagaaatgtgttcagttaa

SEQ ID NO: 110620 - DNA, 22 bp, Artificial Sequence
  chemically synthesized
tgagaaatgtgttcagttaaaa

SEQ ID NO: 110621 - DNA, 22 bp, Artificial Sequence
  chemically synthesized
agttaaaactttggttaacatt

SEQ ID NO: 110622 - DNA, 22 bp, Artificial Sequence
  chemically synthesized
aaactttggttaacatttatca

SEQ ID NO: 110623 - DNA, 22 bp, Artificial Sequence
  chemically synthesized
tggttaacatttatcaaataat

SEQ ID NO: 110624 - DNA, 22 bp, Artificial Sequence
  chemically synthesized
ggttaacatttatcaaataata

SEQ ID NO: 110625 - DNA, 22 bp, Artificial Sequence
  chemically synthesized
gttaacatttatcaaataatat

SEQ ID NO: 110626 - DNA, 22 bp, Artificial Sequence
  chemically synthesized
acatttatcaaataatattgat

SEQ ID NO: 110627 - DNA, 22 bp, Artificial Sequence
  chemically synthesized
atcaaataatattgataataat

SEQ ID NO: 110628 - DNA, 22 bp, Artificial Sequence
  chemically synthesized
tcaaataatattgataataatt

SEQ ID NO: 110629 - DNA, 22 bp, Artificial Sequence
  chemically synthesized
ataataatttgaaaacagagat

SEQ ID NO: 110630 - DNA, 22 bp, Artificial Sequence
  chemically synthesized
gaaaacagagatataatttcta

SEQ ID NO: 110631 - DNA, 22 bp, Artificial Sequence
  chemically synthesized
aaaacagagatataatttctaa

SEQ ID NO: 110632 - DNA, 22 bp, Artificial Sequence
  chemically synthesized
ctaattcagatgaccattgtct

SEQ ID NO: 110633 - DNA, 22 bp, Artificial Sequence
  chemically synthesized
taattcagatgaccattgtctt

SEQ ID NO: 110634 - DNA, 22 bp, Artificial Sequence
  chemically synthesized
attcagatgaccattgtcttga

SEQ ID NO: 110635 - DNA, 22 bp, Artificial Sequence
  chemically synthesized
agatgaccattgtcttgatagt

SEQ ID NO: 110636 - DNA, 22 bp, Artificial Sequence
  chemically synthesized
tcttgatagttaattccagtta

SEQ ID NO: 110637 - DNA, 22 bp, Artificial Sequence
  chemically synthesized
gatagttaattccagttactac

SEQ ID NO: 110638 - DNA, 22 bp, Artificial Sequence
  chemically synthesized
atagttaattccagttactact

SEQ ID NO: 110639 - DNA, 22 bp, Artificial Sequence
  chemically synthesized
attccagttactactgaacaga

SEQ ID NO: 110640 - DNA, 22 bp, Artificial Sequence
  chemically synthesized
cagttactactgaacagagaga

SEQ ID NO: 110641 - DNA, 22 bp, Artificial Sequence
  chemically synthesized
ctactgaacagagagatgcatt

SEQ ID NO: 110642 - DNA, 22 bp, Artificial Sequence
  chemically synthesized
ctgaacagagagatgcattttc

SEQ ID NO: 110643 - DNA, 22 bp, Artificial Sequence
  chemically synthesized
aacagagagatgcattttcata

SEQ ID NO: 110644 - DNA, 22 bp, Artificial Sequence
  chemically synthesized
tcataaagtggtatgagaggtc

SEQ ID NO: 110645 - DNA, 22 bp, Artificial Sequence
  chemically synthesized
cataaagtggtatgagaggtct

SEQ ID NO: 110646 - DNA, 22 bp, Artificial Sequence
  chemically synthesized
ataaagtggtatgagaggtctg

SEQ ID NO: 110647 - DNA, 22 bp, Artificial Sequence
  chemically synthesized
gtttaggggaacatcagagata

SEQ ID NO: 110648 - DNA, 22 bp, Artificial Sequence
  chemically synthesized
aggggaacatcagagataagac

SEQ ID NO: 110649 - DNA, 22 bp, Artificial Sequence
  chemically synthesized
ggggaacatcagagataagact

SEQ ID NO: 110650 - DNA, 22 bp, Artificial Sequence
  chemically synthesized
gataggggtgtctggcatgtgc

SEQ ID NO: 110651 - DNA, 22 bp, Artificial Sequence
  chemically synthesized
gcatgtgcaaaatagcagagtt

SEQ ID NO: 110652 - DNA, 22 bp, Artificial Sequence
  chemically synthesized
aaaaacaaacagttggtcatat

SEQ ID NO: 110653 - DNA, 22 bp, Artificial Sequence
  chemically synthesized
gtcatatgtggagagtggggag

SEQ ID NO: 110654 - DNA, 22 bp, Artificial Sequence
  chemically synthesized
ataactagaagataaaatggcc

SEQ ID NO: 110655 - DNA, 22 bp, Artificial Sequence
  chemically synthesized
gaagataaaatggccttttctg

SEQ ID NO: 110656 - DNA, 22 bp, Artificial Sequence
  chemically synthesized
ttctggctccaaatacttttga

SEQ ID NO: 110657 - DNA, 22 bp, Artificial Sequence
  chemically synthesized
tctggctccaaatacttttgat

SEQ ID NO: 110658 - DNA, 22 bp, Artificial Sequence
  chemically synthesized
ctggctccaaatacttttgatt

SEQ ID NO: 110659 - DNA, 22 bp, Artificial Sequence
  chemically synthesized
tggctccaaatacttttgattc

SEQ ID NO: 110660 - DNA, 22 bp, Artificial Sequence
  chemically synthesized
gctccaaatacttttgattctt

SEQ ID NO: 110661 - DNA, 22 bp, Artificial Sequence
  chemically synthesized
caaatacttttgattcttttca

SEQ ID NO: 110662 - DNA, 22 bp, Artificial Sequence
  chemically synthesized
ttgattcttttcagagtctagg

SEQ ID NO: 110663 - DNA, 22 bp, Artificial Sequence
  chemically synthesized
tgattcttttcagagtctaggc

SEQ ID NO: 110664 - DNA, 22 bp, Artificial Sequence
  chemically synthesized
gattcttttcagagtctaggca

SEQ ID NO: 110665 - DNA, 22 bp, Artificial Sequence
  chemically synthesized
attcttttcagagtctaggcat

SEQ ID NO: 110666 - DNA, 22 bp, Artificial Sequence
  chemically synthesized
ttttcagagtctaggcatgaga

SEQ ID NO: 110667 - DNA, 22 bp, Artificial Sequence
  chemically synthesized
ttcagagtctaggcatgagaag

SEQ ID NO: 110668 - DNA, 22 bp, Artificial Sequence
  chemically synthesized
tcagagtctaggcatgagaaga

SEQ ID NO: 110669 - DNA, 22 bp, Artificial Sequence
  chemically synthesized
cagagtctaggcatgagaagag

SEQ ID NO: 110670 - DNA, 22 bp, Artificial Sequence
  chemically synthesized
agagtctaggcatgagaagagg

SEQ ID NO: 110671 - DNA, 22 bp, Artificial Sequence
  chemically synthesized
ggcatgagaagagggggtttgt

SEQ ID NO: 110672 - DNA, 22 bp, Artificial Sequence
  chemically synthesized
gtggtcctatggccaggtgaag

SEQ ID NO: 110673 - DNA, 22 bp, Artificial Sequence
  chemically synthesized
tggtcctatggccaggtgaaga

SEQ ID NO: 110674 - DNA, 22 bp, Artificial Sequence
  chemically synthesized
tggccaggtgaagagccagtat

SEQ ID NO: 110675 - DNA, 22 bp, Artificial Sequence
  chemically synthesized
aaatgataagttttaaattaat

SEQ ID NO: 110676 - DNA, 22 bp, Artificial Sequence
  chemically synthesized
taaattaattttaaaagaaaga

SEQ ID NO: 110677 - DNA, 22 bp, Artificial Sequence
  chemically synthesized
aaattaattttaaaagaaagat

SEQ ID NO: 110678 - DNA, 22 bp, Artificial Sequence
  chemically synthesized
aattaattttaaaagaaagata

SEQ ID NO: 110679 - DNA, 22 bp, Artificial Sequence
  chemically synthesized
attttaaaagaaagatattctt

SEQ ID NO: 110680 - DNA, 22 bp, Artificial Sequence
  chemically synthesized
taaaagaaagatattcttttga

SEQ ID NO: 110681 - DNA, 22 bp, Artificial Sequence
  chemically synthesized
aaaagaaagatattcttttgac

SEQ ID NO: 110682 - DNA, 22 bp, Artificial Sequence
  chemically synthesized
aaagaaagatattcttttgacc

SEQ ID NO: 110683 - DNA, 22 bp, Artificial Sequence
  chemically synthesized
ttttgaccaaaatacagggtat

SEQ ID NO: 110684 - DNA, 22 bp, Artificial Sequence
  chemically synthesized
ttgaccaaaatacagggtatga

SEQ ID NO: 110685 - DNA, 22 bp, Artificial Sequence
  chemically synthesized
tgaccaaaatacagggtatgat

SEQ ID NO: 110686 - DNA, 22 bp, Artificial Sequence
  chemically synthesized
gaccaaaatacagggtatgatg

SEQ ID NO: 110687 - DNA, 22 bp, Artificial Sequence
  chemically synthesized
accaaaatacagggtatgatgt

SEQ ID NO: 110688 - DNA, 22 bp, Artificial Sequence
  chemically synthesized
ggactacacaaggggccaccca

SEQ ID NO: 110689 - DNA, 22 bp, Artificial Sequence
  chemically synthesized
gactacacaaggggccacccag

SEQ ID NO: 110690 - DNA, 22 bp, Artificial Sequence
  chemically synthesized
cacaaggggccacccagtgacc

SEQ ID NO: 110691 - DNA, 22 bp, Artificial Sequence
  chemically synthesized
gatgcccctcatctctggcctc

SEQ ID NO: 110692 - DNA, 22 bp, Artificial Sequence
  chemically synthesized
atctctggcctctgtcatactg

SEQ ID NO: 110693 - DNA, 22 bp, Artificial Sequence
  chemically synthesized
tggcctctgtcatactgacact

SEQ ID NO: 110694 - DNA, 22 bp, Artificial Sequence
  chemically synthesized
gcctctgtcatactgacactca

SEQ ID NO: 110695 - DNA, 22 bp, Artificial Sequence
  chemically synthesized
tgtcatactgacactcagtgat

SEQ ID NO: 110696 - DNA, 22 bp, Artificial Sequence
  chemically synthesized
tcatactgacactcagtgatct

SEQ ID NO: 110697 - DNA, 22 bp, Artificial Sequence
  chemically synthesized
acactcagtgatctatggctgc

SEQ ID NO: 110698 - DNA, 22 bp, Artificial Sequence
  chemically synthesized
agtgatctatggctgcccacct

SEQ ID NO: 110699 - DNA, 22 bp, Artificial Sequence
  chemically synthesized
tggctgcccacctactcttcat

SEQ ID NO: 110700 - DNA, 22 bp, Artificial Sequence
  chemically synthesized
cccacctactcttcatcacaga

SEQ ID NO: 110701 - DNA, 22 bp, Artificial Sequence
  chemically synthesized
ctcttcatcacagaaaggtggg

SEQ ID NO: 110702 - DNA, 22 bp, Artificial Sequence
  chemically synthesized
ttcatcacagaaaggtggggat

SEQ ID NO: 110703 - DNA, 22 bp, Artificial Sequence
  chemically synthesized
catcacagaaaggtggggattt

SEQ ID NO: 110704 - DNA, 22 bp, Artificial Sequence
  chemically synthesized
atcacagaaaggtggggatttt

SEQ ID NO: 110705 - DNA, 22 bp, Artificial Sequence
  chemically synthesized
tttaggattcttgggatgtata

SEQ ID NO: 110706 - DNA, 22 bp, Artificial Sequence
  chemically synthesized
ttaggattcttgggatgtataa

SEQ ID NO: 110707 - DNA, 22 bp, Artificial Sequence
  chemically synthesized
taggattcttgggatgtataaa

SEQ ID NO: 110708 - DNA, 22 bp, Artificial Sequence
  chemically synthesized
aggattcttgggatgtataaat

SEQ ID NO: 110709 - DNA, 22 bp, Artificial Sequence
  chemically synthesized
ggattcttgggatgtataaata

SEQ ID NO: 110710 - DNA, 22 bp, Artificial Sequence
  chemically synthesized
ttgggatgtataaataacacag

SEQ ID NO: 110711 - DNA, 22 bp, Artificial Sequence
  chemically synthesized
gggatgtataaataacacagag

SEQ ID NO: 110712 - DNA, 22 bp, Artificial Sequence
  chemically synthesized
ggatgtataaataacacagaga

SEQ ID NO: 110713 - DNA, 22 bp, Artificial Sequence
  chemically synthesized
cacaatagtttccaggctagta

SEQ ID NO: 110714 - DNA, 22 bp, Artificial Sequence
  chemically synthesized
acaatagtttccaggctagtaa

SEQ ID NO: 110715 - DNA, 22 bp, Artificial Sequence
  chemically synthesized
ccaggctagtaaatgatcttta

SEQ ID NO: 110716 - DNA, 22 bp, Artificial Sequence
  chemically synthesized
caggctagtaaatgatctttat

SEQ ID NO: 110717 - DNA, 22 bp, Artificial Sequence
  chemically synthesized
gtaaatgatctttatctgatta

SEQ ID NO: 110718 - DNA, 22 bp, Artificial Sequence
  chemically synthesized
tatctgattagaccaaaagatt

SEQ ID NO: 110719 - DNA, 22 bp, Artificial Sequence
  chemically synthesized
atctgattagaccaaaagattt

SEQ ID NO: 110720 - DNA, 22 bp, Artificial Sequence
  chemically synthesized
tctgattagaccaaaagatttt

SEQ ID NO: 110721 - DNA, 22 bp, Artificial Sequence
  chemically synthesized
attagaccaaaagattttgttt

SEQ ID NO: 110722 - DNA, 22 bp, Artificial Sequence
  chemically synthesized
gaccaaaagattttgtttgttt

SEQ ID NO: 110723 - DNA, 22 bp, Artificial Sequence
  chemically synthesized
tgtttgttttactcaacttggc

SEQ ID NO: 110724 - DNA, 22 bp, Artificial Sequence
  chemically synthesized
gtttgttttactcaacttggct

SEQ ID NO: 110725 - DNA, 22 bp, Artificial Sequence
  chemically synthesized
tttgttttactcaacttggctg

SEQ ID NO: 110726 - DNA, 22 bp, Artificial Sequence
  chemically synthesized
gttttactcaacttggctgtgt

SEQ ID NO: 110727 - DNA, 22 bp, Artificial Sequence
  chemically synthesized
ttttactcaacttggctgtgtg

SEQ ID NO: 110728 - DNA, 22 bp, Artificial Sequence
  chemically synthesized
tactcaacttggctgtgtgtga

SEQ ID NO: 110729 - DNA, 22 bp, Artificial Sequence
  chemically synthesized
actcaacttggctgtgtgtgaa

SEQ ID NO: 110730 - DNA, 22 bp, Artificial Sequence
  chemically synthesized
ctcaacttggctgtgtgtgaaa

SEQ ID NO: 110731 - DNA, 22 bp, Artificial Sequence
  chemically synthesized
aacttggctgtgtgtgaaattt

SEQ ID NO: 110732 - DNA, 22 bp, Artificial Sequence
  chemically synthesized
ggctgtgtgtgaaatttgcctt

SEQ ID NO: 110733 - DNA, 22 bp, Artificial Sequence
  chemically synthesized
gctgtgtgtgaaatttgccttt

SEQ ID NO: 110734 - DNA, 22 bp, Artificial Sequence
  chemically synthesized
tgtgtgaaatttgcctttctct

SEQ ID NO: 110735 - DNA, 22 bp, Artificial Sequence
  chemically synthesized
gcctttctcttttgtagcttct

SEQ ID NO: 110736 - DNA, 22 bp, Artificial Sequence
  chemically synthesized
cctttctcttttgtagcttctt

SEQ ID NO: 110737 - DNA, 22 bp, Artificial Sequence
  chemically synthesized
tctcttttgtagcttcttgact

SEQ ID NO: 110738 - DNA, 22 bp, Artificial Sequence
  chemically synthesized
ctcttttgtagcttcttgactg

SEQ ID NO: 110739 - DNA, 22 bp, Artificial Sequence
  chemically synthesized
tcttttgtagcttcttgactgt

SEQ ID NO: 110740 - DNA, 22 bp, Artificial Sequence
  chemically synthesized
ttttgtagcttcttgactgtgt

SEQ ID NO: 110741 - DNA, 22 bp, Artificial Sequence
  chemically synthesized
ttgtagcttcttgactgtgtgc

SEQ ID NO: 110742 - DNA, 22 bp, Artificial Sequence
  chemically synthesized
tgtagcttcttgactgtgtgct

SEQ ID NO: 110743 - DNA, 22 bp, Artificial Sequence
  chemically synthesized
gtagcttcttgactgtgtgctc

SEQ ID NO: 110744 - DNA, 22 bp, Artificial Sequence
  chemically synthesized
tagcttcttgactgtgtgctcg

SEQ ID NO: 110745 - DNA, 22 bp, Artificial Sequence
  chemically synthesized
cttgactgtgtgctcgaggatg

SEQ ID NO: 110746 - DNA, 22 bp, Artificial Sequence
  chemically synthesized
ttgactgtgtgctcgaggatgg

SEQ ID NO: 110747 - DNA, 22 bp, Artificial Sequence
  chemically synthesized
gactgtgtgctcgaggatggta

SEQ ID NO: 110748 - DNA, 22 bp, Artificial Sequence
  chemically synthesized
actgtgtgctcgaggatggtaa

SEQ ID NO: 110749 - DNA, 22 bp, Artificial Sequence
  chemically synthesized
tgtgctcgaggatggtaaatat

SEQ ID NO: 110750 - DNA, 22 bp, Artificial Sequence
  chemically synthesized
gaggatggtaaatataacatag

SEQ ID NO: 110751 - DNA, 22 bp, Artificial Sequence
  chemically synthesized
ttattccctactgtattacaga

SEQ ID NO: 110752 - DNA, 22 bp, Artificial Sequence
  chemically synthesized
attccctactgtattacagaac

SEQ ID NO: 110753 - DNA, 22 bp, Artificial Sequence
  chemically synthesized
ttccctactgtattacagaact

SEQ ID NO: 110754 - DNA, 22 bp, Artificial Sequence
  chemically synthesized
cctactgtattacagaacttct

SEQ ID NO: 110755 - DNA, 22 bp, Artificial Sequence
  chemically synthesized
ctgtattacagaacttctcaca

SEQ ID NO: 110756 - DNA, 22 bp, Artificial Sequence
  chemically synthesized
tattacagaacttctcacatag

SEQ ID NO: 110757 - DNA, 22 bp, Artificial Sequence
  chemically synthesized
cagaacttctcacatagaccat

SEQ ID NO: 110758 - DNA, 22 bp, Artificial Sequence
  chemically synthesized
ctcacatagaccatttttaaca

SEQ ID NO: 110759 - DNA, 22 bp, Artificial Sequence
  chemically synthesized
tcacatagaccatttttaacaa

SEQ ID NO: 110760 - DNA, 22 bp, Artificial Sequence
  chemically synthesized
acatagaccatttttaacaaaa

SEQ ID NO: 110761 - DNA, 22 bp, Artificial Sequence
  chemically synthesized
ttaacaaaatataatttttcat

SEQ ID NO: 110762 - DNA, 22 bp, Artificial Sequence
  chemically synthesized
taacaaaatataatttttcatt

SEQ ID NO: 110763 - DNA, 22 bp, Artificial Sequence
  chemically synthesized
aacaaaatataatttttcatta

SEQ ID NO: 110764 - DNA, 22 bp, Artificial Sequence
  chemically synthesized
acaaaatataatttttcattaa

SEQ ID NO: 110765 - DNA, 22 bp, Artificial Sequence
  chemically synthesized
ttcattaaaatgaataaataaa

SEQ ID NO: 110766 - DNA, 22 bp, Artificial Sequence
  chemically synthesized
tcattaaaatgaataaataaaa

SEQ ID NO: 110767 - DNA, 22 bp, Artificial Sequence
  chemically synthesized
cattaaaatgaataaataaaat

SEQ ID NO: 110768 - DNA, 22 bp, Artificial Sequence
  chemically synthesized
attaaaatgaataaataaaatt

SEQ ID NO: 110769 - DNA, 22 bp, Artificial Sequence
  chemically synthesized
aaatgaataaataaaatttaaa

SEQ ID NO: 110770 - DNA, 22 bp, Artificial Sequence
  chemically synthesized
aaagtgacccatgtctttctgt

SEQ ID NO: 110771 - DNA, 22 bp, Artificial Sequence
  chemically synthesized
aagtgacccatgtctttctgtg

SEQ ID NO: 110772 - DNA, 22 bp, Artificial Sequence
  chemically synthesized
tctgtgtgtctgctagttcttc

SEQ ID NO: 110773 - DNA, 22 bp, Artificial Sequence
  chemically synthesized
ctgtgtgtctgctagttcttct

SEQ ID NO: 110774 - DNA, 22 bp, Artificial Sequence
  chemically synthesized
tgtgtgtctgctagttcttctg

SEQ ID NO: 110775 - DNA, 22 bp, Artificial Sequence
  chemically synthesized
tgtgtctgctagttcttctgtc

SEQ ID NO: 110776 - DNA, 22 bp, Artificial Sequence
  chemically synthesized
ctagttcttctgtctgttactg

SEQ ID NO: 110777 - DNA, 22 bp, Artificial Sequence
  chemically synthesized
gttcttctgtctgttactgctc

SEQ ID NO: 110778 - DNA, 22 bp, Artificial Sequence
  chemically synthesized
ttctgtctgttactgctctctg

SEQ ID NO: 110779 - DNA, 22 bp, Artificial Sequence
  chemically synthesized
ctgtctgttactgctctctgta

SEQ ID NO: 110780 - DNA, 22 bp, Artificial Sequence
  chemically synthesized
tgtctgttactgctctctgtat

SEQ ID NO: 110781 - DNA, 22 bp, Artificial Sequence
  chemically synthesized
tctgttactgctctctgtattg

SEQ ID NO: 110782 - DNA, 22 bp, Artificial Sequence
  chemically synthesized
ttactgctctctgtattgtctt

SEQ ID NO: 110783 - DNA, 22 bp, Artificial Sequence
  chemically synthesized
ctgctctctgtattgtcttcca

SEQ ID NO: 110784 - DNA, 22 bp, Artificial Sequence
  chemically synthesized
ctctctgtattgtcttccaaga

SEQ ID NO: 110785 - DNA, 22 bp, Artificial Sequence
  chemically synthesized
tctgtattgtcttccaagatat

SEQ ID NO: 110786 - DNA, 22 bp, Artificial Sequence
  chemically synthesized
tgtattgtcttccaagatatgg

SEQ ID NO: 110787 - DNA, 22 bp, Artificial Sequence
  chemically synthesized
tattgtcttccaagatatgggc

SEQ ID NO: 110788 - DNA, 22 bp, Artificial Sequence
  chemically synthesized
tcttccaagatatgggcaatgt

SEQ ID NO: 110789 - DNA, 22 bp, Artificial Sequence
  chemically synthesized
ccaagatatgggcaatgtatac

SEQ ID NO: 110790 - DNA, 22 bp, Artificial Sequence
  chemically synthesized
caagatatgggcaatgtatact

SEQ ID NO: 110791 - DNA, 22 bp, Artificial Sequence
  chemically synthesized
aatcctgttctttcttcccttg

SEQ ID NO: 110792 - DNA, 22 bp, Artificial Sequence
  chemically synthesized
atcctgttctttcttcccttgg

SEQ ID NO: 110793 - DNA, 22 bp, Artificial Sequence
  chemically synthesized
ttctttcttcccttgggctttt

SEQ ID NO: 110794 - DNA, 22 bp, Artificial Sequence
  chemically synthesized
tttcttcccttgggcttttggg

SEQ ID NO: 110795 - DNA, 22 bp, Artificial Sequence
  chemically synthesized
tcttcccttgggcttttgggaa

SEQ ID NO: 110796 - DNA, 22 bp, Artificial Sequence
  chemically synthesized
cttcccttgggcttttgggaat

SEQ ID NO: 110797 - DNA, 22 bp, Artificial Sequence
  chemically synthesized
ttcccttgggcttttgggaatg

SEQ ID NO: 110798 - DNA, 22 bp, Artificial Sequence
  chemically synthesized
cccttgggcttttgggaatgaa

SEQ ID NO: 110799 - DNA, 22 bp, Artificial Sequence
  chemically synthesized
ccttgggcttttgggaatgaat

SEQ ID NO: 110800 - DNA, 22 bp, Artificial Sequence
  chemically synthesized
gggcttttgggaatgaattcag

SEQ ID NO: 110801 - DNA, 22 bp, Artificial Sequence
  chemically synthesized
ggcttttgggaatgaattcagg

SEQ ID NO: 110802 - DNA, 22 bp, Artificial Sequence
  chemically synthesized
ttgggaatgaattcagggggat

SEQ ID NO: 110803 - DNA, 22 bp, Artificial Sequence
  chemically synthesized
tgggaatgaattcagggggatc

SEQ ID NO: 110804 - DNA, 22 bp, Artificial Sequence
  chemically synthesized
gggaatgaattcagggggatct

SEQ ID NO: 110805 - DNA, 22 bp, Artificial Sequence
  chemically synthesized
ggaatgaattcagggggatcta

SEQ ID NO: 110806 - DNA, 22 bp, Artificial Sequence
  chemically synthesized
agggggatctaagccacatcaa

SEQ ID NO: 110807 - DNA, 22 bp, Artificial Sequence
  chemically synthesized
agccacatcaaagaaaatcttt

SEQ ID NO: 110808 - DNA, 22 bp, Artificial Sequence
  chemically synthesized
tcttgactcaccctctaggtcc

SEQ ID NO: 110809 - DNA, 22 bp, Artificial Sequence
  chemically synthesized
cttgactcaccctctaggtcca

SEQ ID NO: 110810 - DNA, 22 bp, Artificial Sequence
  chemically synthesized
ttgactcaccctctaggtccag

SEQ ID NO: 110811 - DNA, 22 bp, Artificial Sequence
  chemically synthesized
gactcaccctctaggtccagtg

SEQ ID NO: 110812 - DNA, 22 bp, Artificial Sequence
  chemically synthesized
actcaccctctaggtccagtga

SEQ ID NO: 110813 - DNA, 22 bp, Artificial Sequence
  chemically synthesized
accctctaggtccagtgatcct

SEQ ID NO: 110814 - DNA, 22 bp, Artificial Sequence
  chemically synthesized
taggtccagtgatcctgaaacc

SEQ ID NO: 110815 - DNA, 22 bp, Artificial Sequence
  chemically synthesized
ggtccagtgatcctgaaacctg

SEQ ID NO: 110816 - DNA, 22 bp, Artificial Sequence
  chemically synthesized
aaacctgccatagcaggctagt

SEQ ID NO: 110817 - DNA, 22 bp, Artificial Sequence
  chemically synthesized
ccatagcaggctagtataaaga

SEQ ID NO: 110818 - DNA, 22 bp, Artificial Sequence
  chemically synthesized
gtataaagataactaggataac

SEQ ID NO: 110819 - DNA, 22 bp, Artificial Sequence
  chemically synthesized
ggataacaatacattttataaa

SEQ ID NO: 110820 - DNA, 22 bp, Artificial Sequence
  chemically synthesized
tataaattctgtaaatggacac

SEQ ID NO: 110821 - DNA, 22 bp, Artificial Sequence
  chemically synthesized
ataaattctgtaaatggacaca

SEQ ID NO: 110822 - DNA, 22 bp, Artificial Sequence
  chemically synthesized
taaattctgtaaatggacacat

SEQ ID NO: 110823 - DNA, 22 bp, Artificial Sequence
  chemically synthesized
tgtaaatggacacatttgactg

SEQ ID NO: 110824 - DNA, 22 bp, Artificial Sequence
  chemically synthesized
taaatggacacatttgactgac

SEQ ID NO: 110825 - DNA, 22 bp, Artificial Sequence
  chemically synthesized
gactgacaaccctgagtttctc

SEQ ID NO: 110826 - DNA, 22 bp, Artificial Sequence
  chemically synthesized
actgacaaccctgagtttctct

SEQ ID NO: 110827 - DNA, 22 bp, Artificial Sequence
  chemically synthesized
acaaccctgagtttctctcctc

SEQ ID NO: 110828 - DNA, 22 bp, Artificial Sequence
  chemically synthesized
agtttctctcctccctttctgt

SEQ ID NO: 110829 - DNA, 22 bp, Artificial Sequence
  chemically synthesized
ctctcctccctttctgttcttc

SEQ ID NO: 110830 - DNA, 22 bp, Artificial Sequence
  chemically synthesized
tctcctccctttctgttcttcc

SEQ ID NO: 110831 - DNA, 22 bp, Artificial Sequence
  chemically synthesized
tcctccctttctgttcttcctt

SEQ ID NO: 110832 - DNA, 22 bp, Artificial Sequence
  chemically synthesized
ctccctttctgttcttccttat

SEQ ID NO: 110833 - DNA, 22 bp, Artificial Sequence
  chemically synthesized
cctttctgttcttccttatact

SEQ ID NO: 110834 - DNA, 22 bp, Artificial Sequence
  chemically synthesized
tctgttcttccttatactgaag

SEQ ID NO: 110835 - DNA, 22 bp, Artificial Sequence
  chemically synthesized
ctgttcttccttatactgaaga

SEQ ID NO: 110836 - DNA, 22 bp, Artificial Sequence
  chemically synthesized
tgttcttccttatactgaagag

SEQ ID NO: 110837 - DNA, 22 bp, Artificial Sequence
  chemically synthesized
ttcttccttatactgaagagat

SEQ ID NO: 110838 - DNA, 22 bp, Artificial Sequence
  chemically synthesized
ttccttatactgaagagatgtg

SEQ ID NO: 110839 - DNA, 22 bp, Artificial Sequence
  chemically synthesized
ccttatactgaagagatgtgat

SEQ ID NO: 110840 - DNA, 22 bp, Artificial Sequence
  chemically synthesized
cttatactgaagagatgtgatg

SEQ ID NO: 110841 - DNA, 22 bp, Artificial Sequence
  chemically synthesized
atactgaagagatgtgatgaag

SEQ ID NO: 110842 - DNA, 22 bp, Artificial Sequence
  chemically synthesized
tactgaagagatgtgatgaaga

SEQ ID NO: 110843 - DNA, 22 bp, Artificial Sequence
  chemically synthesized
aagagatgtgatgaagagacaa

SEQ ID NO: 110844 - DNA, 22 bp, Artificial Sequence
  chemically synthesized
ggacttgcagttctctttgtgg

SEQ ID NO: 110845 - DNA, 22 bp, Artificial Sequence
  chemically synthesized
gcagttctctttgtggagtccc

SEQ ID NO: 110846 - DNA, 22 bp, Artificial Sequence
  chemically synthesized
cagttctctttgtggagtcccg

SEQ ID NO: 110847 - DNA, 22 bp, Artificial Sequence
  chemically synthesized
tctttgtggagtcccgtgaaac

SEQ ID NO: 110848 - DNA, 22 bp, Artificial Sequence
  chemically synthesized
tttgtggagtcccgtgaaacag

SEQ ID NO: 110849 - DNA, 22 bp, Artificial Sequence
  chemically synthesized
tgtggagtcccgtgaaacagag

SEQ ID NO: 110850 - DNA, 22 bp, Artificial Sequence
  chemically synthesized
gtggagtcccgtgaaacagagc

SEQ ID NO: 110851 - DNA, 22 bp, Artificial Sequence
  chemically synthesized
tggagtcccgtgaaacagagca

SEQ ID NO: 110852 - DNA, 22 bp, Artificial Sequence
  chemically synthesized
tgggctcccgatggtccctgaa

SEQ ID NO: 110853 - DNA, 22 bp, Artificial Sequence
  chemically synthesized
ggctcccgatggtccctgaaca

SEQ ID NO: 110854 - DNA, 22 bp, Artificial Sequence
  chemically synthesized
ccgatggtccctgaacaacata

SEQ ID NO: 110855 - DNA, 22 bp, Artificial Sequence
  chemically synthesized
aacaacatatcaacagtagggt

SEQ ID NO: 110856 - DNA, 22 bp, Artificial Sequence
  chemically synthesized
acccctcctcatgatcctcccc

SEQ ID NO: 110857 - DNA, 22 bp, Artificial Sequence
  chemically synthesized
ctcatgatcctccccacttcct

SEQ ID NO: 110858 - DNA, 22 bp, Artificial Sequence
  chemically synthesized
atgatcctccccacttcctccc

SEQ ID NO: 110859 - DNA, 22 bp, Artificial Sequence
  chemically synthesized
cccacttcctcccgcccctcca

SEQ ID NO: 110860 - DNA, 22 bp, Artificial Sequence
  chemically synthesized
cctcccgcccctccacgccacc

SEQ ID NO: 110861 - DNA, 22 bp, Artificial Sequence
  chemically synthesized
ctcccgcccctccacgccacca

SEQ ID NO: 110862 - DNA, 22 bp, Artificial Sequence
  chemically synthesized
ccgcccctccacgccaccagcc

SEQ ID NO: 110863 - DNA, 22 bp, Artificial Sequence
  chemically synthesized
cacgccaccagccacactgagc

SEQ ID NO: 110864 - DNA, 22 bp, Artificial Sequence
  chemically synthesized
agcgctcagctcctcccaggtc

SEQ ID NO: 110865 - DNA, 22 bp, Artificial Sequence
  chemically synthesized
agctcctcccaggtcctggacc

SEQ ID NO: 110866 - DNA, 22 bp, Artificial Sequence
  chemically synthesized
ctcccaggtcctggacctgcag

SEQ ID NO: 110867 - DNA, 22 bp, Artificial Sequence
  chemically synthesized
ccaggtcctggacctgcagccc

SEQ ID NO: 110868 - DNA, 22 bp, Artificial Sequence
  chemically synthesized
gacctgcagccctggccaacat

SEQ ID NO: 110869 - DNA, 22 bp, Artificial Sequence
  chemically synthesized
cagccctggccaacatcaagag

SEQ ID NO: 110870 - DNA, 22 bp, Artificial Sequence
  chemically synthesized
gccaacatcaagagggcatctt

SEQ ID NO: 110871 - DNA, 22 bp, Artificial Sequence
  chemically synthesized
tgccaagaatgcctggaagaga

SEQ ID NO: 110872 - DNA, 22 bp, Artificial Sequence
  chemically synthesized
gccaagaatgcctggaagagac

SEQ ID NO: 110873 - DNA, 22 bp, Artificial Sequence
  chemically synthesized
ccaagaatgcctggaagagact

SEQ ID NO: 110874 - DNA, 22 bp, Artificial Sequence
  chemically synthesized
gaagagactcagccactcacag

SEQ ID NO: 110875 - DNA, 22 bp, Artificial Sequence
  chemically synthesized
agccactcacaggaaaacgtcc

SEQ ID NO: 110876 - DNA, 22 bp, Artificial Sequence
  chemically synthesized
acaggaaaacgtcctccagaag

SEQ ID NO: 110877 - DNA, 22 bp, Artificial Sequence
  chemically synthesized
cagaagccagggaaagctgctg

SEQ ID NO: 110878 - DNA, 22 bp, Artificial Sequence
  chemically synthesized
ctgagacaaaagacaaacagtt

SEQ ID NO: 110879 - DNA, 22 bp, Artificial Sequence
  chemically synthesized
agacaaaagacaaacagtttga

SEQ ID NO: 110880 - DNA, 22 bp, Artificial Sequence
  chemically synthesized
gaagaatatgtccagaacttca

SEQ ID NO: 110881 - DNA, 22 bp, Artificial Sequence
  chemically synthesized
aagaatatgtccagaacttcaa

SEQ ID NO: 110882 - DNA, 22 bp, Artificial Sequence
  chemically synthesized
caagccacaagaagcagagggt

SEQ ID NO: 110883 - DNA, 22 bp, Artificial Sequence
  chemically synthesized
aagccacaagaagcagagggta

SEQ ID NO: 110884 - DNA, 22 bp, Artificial Sequence
  chemically synthesized
agagaactctgaggatgtttag

SEQ ID NO: 110885 - DNA, 22 bp, Artificial Sequence
  chemically synthesized
tgaggatgtttagaagcaatca

SEQ ID NO: 110886 - DNA, 22 bp, Artificial Sequence
  chemically synthesized
aggatgtttagaagcaatcaaa

SEQ ID NO: 110887 - DNA, 22 bp, Artificial Sequence
  chemically synthesized
agaagcaatcaaaggcattcaa

SEQ ID NO: 110888 - DNA, 22 bp, Artificial Sequence
  chemically synthesized
gaagcaatcaaaggcattcaag

SEQ ID NO: 110889 - DNA, 22 bp, Artificial Sequence
  chemically synthesized
aagagaccttgacgaagctgag

SEQ ID NO: 110890 - DNA, 22 bp, Artificial Sequence
  chemically synthesized
gacgaagctgagtcactgtgtg

SEQ ID NO: 110891 - DNA, 22 bp, Artificial Sequence
  chemically synthesized
acgaagctgagtcactgtgtga

SEQ ID NO: 110892 - DNA, 22 bp, Artificial Sequence
  chemically synthesized
agtcactgtgtgaagtctgtgc

SEQ ID NO: 110893 - DNA, 22 bp, Artificial Sequence
  chemically synthesized
tgtgaagtctgtgcgctggatt

SEQ ID NO: 110894 - DNA, 22 bp, Artificial Sequence
  chemically synthesized
tgcgctggattggtctgggcag

SEQ ID NO: 110895 - DNA, 22 bp, Artificial Sequence
  chemically synthesized
gattggtctgggcaggaaggtg

SEQ ID NO: 110896 - DNA, 22 bp, Artificial Sequence
  chemically synthesized
gtctgggcaggaaggtgtgaaa

SEQ ID NO: 110897 - DNA, 22 bp, Artificial Sequence
  chemically synthesized
ggcaggaaggtgtgaaaatggt

SEQ ID NO: 110898 - DNA, 22 bp, Artificial Sequence
  chemically synthesized
gtgagaaaggtgatgtgctctg

SEQ ID NO: 110899 - DNA, 22 bp, Artificial Sequence
  chemically synthesized
tgggaggatatccacaaaaaac

SEQ ID NO: 110900 - DNA, 22 bp, Artificial Sequence
  chemically synthesized
ggaggatatccacaaaaaactc

SEQ ID NO: 110901 - DNA, 22 bp, Artificial Sequence
  chemically synthesized
atggatgcatccttgctaacac

SEQ ID NO: 110902 - DNA, 22 bp, Artificial Sequence
  chemically synthesized
gctaacactggaaaactacctg

SEQ ID NO: 110903 - DNA, 22 bp, Artificial Sequence
  chemically synthesized
ctaacactggaaaactacctgg

SEQ ID NO: 110904 - DNA, 22 bp, Artificial Sequence
  chemically synthesized
acactggaaaactacctggacc

SEQ ID NO: 110905 - DNA, 22 bp, Artificial Sequence
  chemically synthesized
gaaaactacctggaccaatttc

SEQ ID NO: 110906 - DNA, 22 bp, Artificial Sequence
  chemically synthesized
cctggaccaatttcctgacttg

SEQ ID NO: 110907 - DNA, 22 bp, Artificial Sequence
  chemically synthesized
gaccaatttcctgacttgaaga

SEQ ID NO: 110908 - DNA, 22 bp, Artificial Sequence
  chemically synthesized
cctgacttgaagaatcacatca

SEQ ID NO: 110909 - DNA, 22 bp, Artificial Sequence
  chemically synthesized
ctgacttgaagaatcacatcac

SEQ ID NO: 110910 - DNA, 22 bp, Artificial Sequence
  chemically synthesized
acttgaagaatcacatcaccaa

SEQ ID NO: 110911 - DNA, 22 bp, Artificial Sequence
  chemically synthesized
gaagaatcacatcaccaagtgc

SEQ ID NO: 110912 - DNA, 22 bp, Artificial Sequence
  chemically synthesized
aagaatcacatcaccaagtgca

SEQ ID NO: 110913 - DNA, 22 bp, Artificial Sequence
  chemically synthesized
acggactatgacagtgcctgcc

SEQ ID NO: 110914 - DNA, 22 bp, Artificial Sequence
  chemically synthesized
cggactatgacagtgcctgccc

SEQ ID NO: 110915 - DNA, 22 bp, Artificial Sequence
  chemically synthesized
tgacagtgcctgcccacctcca

SEQ ID NO: 110916 - DNA, 22 bp, Artificial Sequence
  chemically synthesized
cccacctccatcgggctcaaca

SEQ ID NO: 110917 - DNA, 22 bp, Artificial Sequence
  chemically synthesized
catcgggctcaacagagcttca

SEQ ID NO: 110918 - DNA, 22 bp, Artificial Sequence
  chemically synthesized
aacagagcttcaggaggaagga

SEQ ID NO: 110919 - DNA, 22 bp, Artificial Sequence
  chemically synthesized
caggaggaaggataggagcctc

SEQ ID NO: 110920 - DNA, 22 bp, Artificial Sequence
  chemically synthesized
aggaggaaggataggagcctct

SEQ ID NO: 110921 - DNA, 22 bp, Artificial Sequence
  chemically synthesized
tgtctaaggcagaagtagaatt

SEQ ID NO: 110922 - DNA, 22 bp, Artificial Sequence
  chemically synthesized
tctaaggcagaagtagaatttc

SEQ ID NO: 110923 - DNA, 22 bp, Artificial Sequence
  chemically synthesized
aggcagaagtagaatttcagaa

SEQ ID NO: 110924 - DNA, 22 bp, Artificial Sequence
  chemically synthesized
cagaaagcatagagaaagtttg

SEQ ID NO: 110925 - DNA, 22 bp, Artificial Sequence
  chemically synthesized
agaaagcatagagaaagtttga

SEQ ID NO: 110926 - DNA, 22 bp, Artificial Sequence
  chemically synthesized
gaagagtttaatggtgacttac

SEQ ID NO: 110927 - DNA, 22 bp, Artificial Sequence
  chemically synthesized
aagagtttaatggtgacttaca

SEQ ID NO: 110928 - DNA, 22 bp, Artificial Sequence
  chemically synthesized
aatggtgacttacaagaaaagt

SEQ ID NO: 110929 - DNA, 22 bp, Artificial Sequence
  chemically synthesized
atggtgacttacaagaaaagtt

SEQ ID NO: 110930 - DNA, 22 bp, Artificial Sequence
  chemically synthesized
acaagaaaagttaccattatta

SEQ ID NO: 110931 - DNA, 22 bp, Artificial Sequence
  chemically synthesized
caagaaaagttaccattattat

SEQ ID NO: 110932 - DNA, 22 bp, Artificial Sequence
  chemically synthesized
ccattattatagtcaagacgaa

SEQ ID NO: 110933 - DNA, 22 bp, Artificial Sequence
  chemically synthesized
ttatagtcaagacgaattggat

SEQ ID NO: 110934 - DNA, 22 bp, Artificial Sequence
  chemically synthesized
tagtcaagacgaattggatttt

SEQ ID NO: 110935 - DNA, 22 bp, Artificial Sequence
  chemically synthesized
gattttatattaatactttcaa

SEQ ID NO: 110936 - DNA, 22 bp, Artificial Sequence
  chemically synthesized
tatattaatactttcaaaaaca

SEQ ID NO: 110937 - DNA, 22 bp, Artificial Sequence
  chemically synthesized
atattaatactttcaaaaacat

SEQ ID NO: 110938 - DNA, 22 bp, Artificial Sequence
  chemically synthesized
tattaatactttcaaaaacatc

SEQ ID NO: 110939 - DNA, 22 bp, Artificial Sequence
  chemically synthesized
atactttcaaaaacatctccag

SEQ ID NO: 110940 - DNA, 22 bp, Artificial Sequence
  chemically synthesized
tcaaaaacatctccagccttga

SEQ ID NO: 110941 - DNA, 22 bp, Artificial Sequence
  chemically synthesized
caaaaacatctccagccttgaa

SEQ ID NO: 110942 - DNA, 22 bp, Artificial Sequence
  chemically synthesized
aaaaacatctccagccttgaag

SEQ ID NO: 110943 - DNA, 22 bp, Artificial Sequence
  chemically synthesized
cagccttgaagctaagtttcat

SEQ ID NO: 110944 - DNA, 22 bp, Artificial Sequence
  chemically synthesized
gaagctaagtttcataaggaaa

SEQ ID NO: 110945 - DNA, 22 bp, Artificial Sequence
  chemically synthesized
aagctaagtttcataaggaaac

SEQ ID NO: 110946 - DNA, 22 bp, Artificial Sequence
  chemically synthesized
agtttcataaggaaactgtggt

SEQ ID NO: 110947 - DNA, 22 bp, Artificial Sequence
  chemically synthesized
cataaggaaactgtggtgcttt

SEQ ID NO: 110948 - DNA, 22 bp, Artificial Sequence
  chemically synthesized
ataaggaaactgtggtgctttg

SEQ ID NO: 110949 - DNA, 22 bp, Artificial Sequence
  chemically synthesized
tggtgctttggtacaaacagta

SEQ ID NO: 110950 - DNA, 22 bp, Artificial Sequence
  chemically synthesized
tggtacaaacagtatgaagtga

SEQ ID NO: 110951 - DNA, 22 bp, Artificial Sequence
  chemically synthesized
ggtacaaacagtatgaagtgat

SEQ ID NO: 110952 - DNA, 22 bp, Artificial Sequence
  chemically synthesized
gtacaaacagtatgaagtgatg

SEQ ID NO: 110953 - DNA, 22 bp, Artificial Sequence
  chemically synthesized
ggtgaccagtatgctgacaagg

SEQ ID NO: 110954 - DNA, 22 bp, Artificial Sequence
  chemically synthesized
acaaggccttcaacattcaaag

SEQ ID NO: 110955 - DNA, 22 bp, Artificial Sequence
  chemically synthesized
caacattcaaagagcaacaccc

SEQ ID NO: 110956 - DNA, 22 bp, Artificial Sequence
  chemically synthesized
aacattcaaagagcaacaccca

SEQ ID NO: 110957 - DNA, 22 bp, Artificial Sequence
  chemically synthesized
aaagagcaacacccactgattt

SEQ ID NO: 110958 - DNA, 22 bp, Artificial Sequence
  chemically synthesized
atttgggtcctctccacattgc

SEQ ID NO: 110959 - DNA, 22 bp, Artificial Sequence
  chemically synthesized
gggtcctctccacattgcaaag

SEQ ID NO: 110960 - DNA, 22 bp, Artificial Sequence
  chemically synthesized
ggtcctctccacattgcaaaga

SEQ ID NO: 110961 - DNA, 22 bp, Artificial Sequence
  chemically synthesized
tccacattgcaaagatgtcctc

SEQ ID NO: 110962 - DNA, 22 bp, Artificial Sequence
  chemically synthesized
cacattgcaaagatgtcctcat

SEQ ID NO: 110963 - DNA, 22 bp, Artificial Sequence
  chemically synthesized
caaagatgtcctcatggcctag

SEQ ID NO: 110964 - DNA, 22 bp, Artificial Sequence
  chemically synthesized
atggcctagggagctttcattc

SEQ ID NO: 110965 - DNA, 22 bp, Artificial Sequence
  chemically synthesized
gggagctttcattccaccccag

SEQ ID NO: 110966 - DNA, 22 bp, Artificial Sequence
  chemically synthesized
tcattccaccccagcccaacaa

SEQ ID NO: 110967 - DNA, 22 bp, Artificial Sequence
  chemically synthesized
cattccaccccagcccaacaac

SEQ ID NO: 110968 - DNA, 22 bp, Artificial Sequence
  chemically synthesized
attccaccccagcccaacaact

SEQ ID NO: 110969 - DNA, 22 bp, Artificial Sequence
  chemically synthesized
caccccagcccaacaactagtt

SEQ ID NO: 110970 - DNA, 22 bp, Artificial Sequence
  chemically synthesized
gttcaagtgaaacactagcacc

SEQ ID NO: 110971 - DNA, 22 bp, Artificial Sequence
  chemically synthesized
aagtgaaacactagcacctgct

SEQ ID NO: 110972 - DNA, 22 bp, Artificial Sequence
  chemically synthesized
gcacctgcttctcctatgccag

SEQ ID NO: 110973 - DNA, 22 bp, Artificial Sequence
  chemically synthesized
cttctcctatgccagcatgacc

SEQ ID NO: 110974 - DNA, 22 bp, Artificial Sequence
  chemically synthesized
ctcctatgccagcatgacctga

SEQ ID NO: 110975 - DNA, 22 bp, Artificial Sequence
  chemically synthesized
tcctatgccagcatgacctgag

SEQ ID NO: 110976 - DNA, 22 bp, Artificial Sequence
  chemically synthesized
ctatgccagcatgacctgagtc

SEQ ID NO: 110977 - DNA, 22 bp, Artificial Sequence
  chemically synthesized
tgccagcatgacctgagtcact

SEQ ID NO: 110978 - DNA, 22 bp, Artificial Sequence
  chemically synthesized
agtcactcttgcagtcctgtat

SEQ ID NO: 110979 - DNA, 22 bp, Artificial Sequence
  chemically synthesized
ttgcagtcctgtatctgtctaa

SEQ ID NO: 110980 - DNA, 22 bp, Artificial Sequence
  chemically synthesized
gcagtcctgtatctgtctaaag

SEQ ID NO: 110981 - DNA, 22 bp, Artificial Sequence
  chemically synthesized
cagtcctgtatctgtctaaagt

SEQ ID NO: 110982 - DNA, 22 bp, Artificial Sequence
  chemically synthesized
tatctgtctaaagtcacttgac

SEQ ID NO: 110983 - DNA, 22 bp, Artificial Sequence
  chemically synthesized
tctaaagtcacttgacaaagga

SEQ ID NO: 110984 - DNA, 22 bp, Artificial Sequence
  chemically synthesized
aagtcacttgacaaaggaactg

SEQ ID NO: 110985 - DNA, 22 bp, Artificial Sequence
  chemically synthesized
gacaaaggaactgcagcaggaa

SEQ ID NO: 110986 - DNA, 22 bp, Artificial Sequence
  chemically synthesized
acaaaggaactgcagcaggaaa

SEQ ID NO: 110987 - DNA, 22 bp, Artificial Sequence
  chemically synthesized
cagcaggaaaaatatcatcttc

SEQ ID NO: 110988 - DNA, 22 bp, Artificial Sequence
  chemically synthesized
cacagactgtcctaaagtaaga

SEQ ID NO: 110989 - DNA, 22 bp, Artificial Sequence
  chemically synthesized
acagactgtcctaaagtaagat

SEQ ID NO: 110990 - DNA, 22 bp, Artificial Sequence
  chemically synthesized
tcctaaagtaagataggtgatg

SEQ ID NO: 110991 - DNA, 22 bp, Artificial Sequence
  chemically synthesized
aagtaagataggtgatgtgtac

SEQ ID NO: 110992 - DNA, 22 bp, Artificial Sequence
  chemically synthesized
tatccacaaatcatctgtaaaa

SEQ ID NO: 110993 - DNA, 22 bp, Artificial Sequence
  chemically synthesized
taaaagttatgttttcagtggt

SEQ ID NO: 110994 - DNA, 22 bp, Artificial Sequence
  chemically synthesized
tgttttcagtggtgtgtcattt

SEQ ID NO: 110995 - DNA, 22 bp, Artificial Sequence
  chemically synthesized
tcagtggtgtgtcatttcaaat

SEQ ID NO: 110996 - DNA, 22 bp, Artificial Sequence
  chemically synthesized
cagtggtgtgtcatttcaaata

SEQ ID NO: 110997 - DNA, 22 bp, Artificial Sequence
  chemically synthesized
agtggtgtgtcatttcaaataa

SEQ ID NO: 110998 - DNA, 22 bp, Artificial Sequence
  chemically synthesized
caaataaaccttgggaaatttc

SEQ ID NO: 110999 - DNA, 22 bp, Artificial Sequence
  chemically synthesized
aaataaaccttgggaaatttct

SEQ ID NO: 111000 - DNA, 22 bp, Artificial Sequence
  chemically synthesized
gggaaatttctaacaattacct

SEQ ID NO: 111001 - DNA, 22 bp, Artificial Sequence
  chemically synthesized
ggaaatttctaacaattacctt

SEQ ID NO: 111002 - DNA, 22 bp, Artificial Sequence
  chemically synthesized
ctaacaattacctttaaaaatt

SEQ ID NO: 111003 - DNA, 22 bp, Artificial Sequence
  chemically synthesized
taacaattacctttaaaaatta

SEQ ID NO: 111004 - DNA, 22 bp, Artificial Sequence
  chemically synthesized
acaattacctttaaaaattaaa

SEQ ID NO: 111005 - DNA, 22 bp, Artificial Sequence
  chemically synthesized
cctttaaaaattaaaaaaaaaa

SEQ ID NO: 111006 - DNA, 22 bp, Artificial Sequence
  chemically synthesized
taaaaattaaaaaaaaaaaaaa

SEQ ID NO: 111007 - DNA, 22 bp, Artificial Sequence
  chemically synthesized
aaaaattaaaaaaaaaaaaaag

SEQ ID NO: 111008 - DNA, 22 bp, Artificial Sequence
  chemically synthesized
aaaattaaaaaaaaaaaaaaga

SEQ ID NO: 111009 - DNA, 22 bp, Artificial Sequence
  chemically synthesized
aaaaaaaaaaaaagagtagggt

SEQ ID NO: 111010 - DNA, 22 bp, Artificial Sequence
  chemically synthesized
tcttaaaggatcaatgtaatgc

SEQ ID NO: 111011 - DNA, 22 bp, Artificial Sequence
  chemically synthesized
cttaaaggatcaatgtaatgcc

SEQ ID NO: 111012 - DNA, 22 bp, Artificial Sequence
  chemically synthesized
ttaaaggatcaatgtaatgccc

SEQ ID NO: 111013 - DNA, 22 bp, Artificial Sequence
  chemically synthesized
aaaggatcaatgtaatgccctg

SEQ ID NO: 111014 - DNA, 22 bp, Artificial Sequence
  chemically synthesized
aaggatcaatgtaatgccctgc

SEQ ID NO: 111015 - DNA, 22 bp, Artificial Sequence
  chemically synthesized
ctctgattcctgtagtgacata

SEQ ID NO: 111016 - DNA, 22 bp, Artificial Sequence
  chemically synthesized
tgattcctgtagtgacataggc

SEQ ID NO: 111017 - DNA, 22 bp, Artificial Sequence
  chemically synthesized
attcctgtagtgacataggcgt

SEQ ID NO: 111018 - DNA, 22 bp, Artificial Sequence
  chemically synthesized
ctgtagtgacataggcgtcaat

SEQ ID NO: 111019 - DNA, 22 bp, Artificial Sequence
  chemically synthesized
tagtgacataggcgtcaatata

SEQ ID NO: 111020 - DNA, 22 bp, Artificial Sequence
  chemically synthesized
gaagttcttttaaaaatctgct

SEQ ID NO: 111021 - DNA, 22 bp, Artificial Sequence
  chemically synthesized
ttttaaaaatctgctgcaagct

SEQ ID NO: 111022 - DNA, 22 bp, Artificial Sequence
  chemically synthesized
ttaaaaatctgctgcaagctga

SEQ ID NO: 111023 - DNA, 22 bp, Artificial Sequence
  chemically synthesized
taaaaatctgctgcaagctgag

SEQ ID NO: 111024 - DNA, 22 bp, Artificial Sequence
  chemically synthesized
aaaaatctgctgcaagctgagg

SEQ ID NO: 111025 - DNA, 22 bp, Artificial Sequence
  chemically synthesized
aaaatctgctgcaagctgaggg

SEQ ID NO: 111026 - DNA, 22 bp, Artificial Sequence
  chemically synthesized
ctgcaagctgagggtcctgtta

SEQ ID NO: 111027 - DNA, 22 bp, Artificial Sequence
  chemically synthesized
caagctgagggtcctgttagaa

SEQ ID NO: 111028 - DNA, 22 bp, Artificial Sequence
  chemically synthesized
agggtcctgttagaaggaaaac

SEQ ID NO: 111029 - DNA, 22 bp, Artificial Sequence
  chemically synthesized
ttagaaggaaaactaacaaaca

SEQ ID NO: 111030 - DNA, 22 bp, Artificial Sequence
  chemically synthesized
gaaggaaaactaacaaacagaa

SEQ ID NO: 111031 - DNA, 22 bp, Artificial Sequence
  chemically synthesized
acaaacagaaaggacatccaca

SEQ ID NO: 111032 - DNA, 22 bp, Artificial Sequence
  chemically synthesized
tacgtcaccatcatcaaagacc

SEQ ID NO: 111033 - DNA, 22 bp, Artificial Sequence
  chemically synthesized
gaaactctaaaaatcagagtgc

SEQ ID NO: 111034 - DNA, 22 bp, Artificial Sequence
  chemically synthesized
taaaaatcagagtgcctctcct

SEQ ID NO: 111035 - DNA, 22 bp, Artificial Sequence
  chemically synthesized
aaaatcagagtgcctctcctcc

SEQ ID NO: 111036 - DNA, 22 bp, Artificial Sequence
  chemically synthesized
tcctcctccaaaggaatgcagc

SEQ ID NO: 111037 - DNA, 22 bp, Artificial Sequence
  chemically synthesized
ctcctccaaaggaatgcagctc

SEQ ID NO: 111038 - DNA, 22 bp, Artificial Sequence
  chemically synthesized
ctccaaaggaatgcagctcctc

SEQ ID NO: 111039 - DNA, 22 bp, Artificial Sequence
  chemically synthesized
caaaggaatgcagctcctcacc

SEQ ID NO: 111040 - DNA, 22 bp, Artificial Sequence
  chemically synthesized
ctcaccagcaacggtacaaagc

SEQ ID NO: 111041 - DNA, 22 bp, Artificial Sequence
  chemically synthesized
accagcaacggtacaaagctgg

SEQ ID NO: 111042 - DNA, 22 bp, Artificial Sequence
  chemically synthesized
gacagagaatgactttgacaag

SEQ ID NO: 111043 - DNA, 22 bp, Artificial Sequence
  chemically synthesized
tgacaagttgagagaagaaggc

SEQ ID NO: 111044 - DNA, 22 bp, Artificial Sequence
  chemically synthesized
gacaagttgagagaagaaggct

SEQ ID NO: 111045 - DNA, 22 bp, Artificial Sequence
  chemically synthesized
acaagttgagagaagaaggctt

SEQ ID NO: 111046 - DNA, 22 bp, Artificial Sequence
  chemically synthesized
agagaagaaggcttcagacgat

SEQ ID NO: 111047 - DNA, 22 bp, Artificial Sequence
  chemically synthesized
cagacgatcaaactactccgag

SEQ ID NO: 111048 - DNA, 22 bp, Artificial Sequence
  chemically synthesized
agacgatcaaactactccgagc

SEQ ID NO: 111049 - DNA, 22 bp, Artificial Sequence
  chemically synthesized
ctccgagctaaaggaggaagct

SEQ ID NO: 111050 - DNA, 22 bp, Artificial Sequence
  chemically synthesized
cgagctaaaggaggaagctcga

SEQ ID NO: 111051 - DNA, 22 bp, Artificial Sequence
  chemically synthesized
aaggaggaagctcgaacccatg

SEQ ID NO: 111052 - DNA, 22 bp, Artificial Sequence
  chemically synthesized
gaacccatggcaaaaaagttaa

SEQ ID NO: 111053 - DNA, 22 bp, Artificial Sequence
  chemically synthesized
aaaaccttgaaaataaattaga

SEQ ID NO: 111054 - DNA, 22 bp, Artificial Sequence
  chemically synthesized
gaaaataaattagactaatggc

SEQ ID NO: 111055 - DNA, 22 bp, Artificial Sequence
  chemically synthesized
aaaataaattagactaatggct

SEQ ID NO: 111056 - DNA, 22 bp, Artificial Sequence
  chemically synthesized
gactaatggctaactagaataa

SEQ ID NO: 111057 - DNA, 22 bp, Artificial Sequence
  chemically synthesized
atggctaactagaataaccaat

SEQ ID NO: 111058 - DNA, 22 bp, Artificial Sequence
  chemically synthesized
actagaataaccaatacagaga

SEQ ID NO: 111059 - DNA, 22 bp, Artificial Sequence
  chemically synthesized
gaataaccaatacagagaagtc

SEQ ID NO: 111060 - DNA, 22 bp, Artificial Sequence
  chemically synthesized
aaaggacctgatggagctgaaa

SEQ ID NO: 111061 - DNA, 22 bp, Artificial Sequence
  chemically synthesized
aaggacctgatggagctgaaaa

SEQ ID NO: 111062 - DNA, 22 bp, Artificial Sequence
  chemically synthesized
atggagctgaaaaccaaggcat

SEQ ID NO: 111063 - DNA, 22 bp, Artificial Sequence
  chemically synthesized
aaaaccaaggcatgagaactac

SEQ ID NO: 111064 - DNA, 22 bp, Artificial Sequence
  chemically synthesized
catgatgaatgcacaagactca

SEQ ID NO: 111065 - DNA, 22 bp, Artificial Sequence
  chemically synthesized
agtagctgattcgatcaactgg

SEQ ID NO: 111066 - DNA, 22 bp, Artificial Sequence
  chemically synthesized
attcgatcaactggaagaaagg

SEQ ID NO: 111067 - DNA, 22 bp, Artificial Sequence
  chemically synthesized
gatcaactggaagaaagggtat

SEQ ID NO: 111068 - DNA, 22 bp, Artificial Sequence
  chemically synthesized
gaagaaagggtatcagtgatgg

SEQ ID NO: 111069 - DNA, 22 bp, Artificial Sequence
  chemically synthesized
agagaaaaaagaataaaaagaa

SEQ ID NO: 111070 - DNA, 22 bp, Artificial Sequence
  chemically synthesized
gagaaaaaagaataaaaagaaa

SEQ ID NO: 111071 - DNA, 22 bp, Artificial Sequence
  chemically synthesized
caagaaatatgggactatgtga

SEQ ID NO: 111072 - DNA, 22 bp, Artificial Sequence
  chemically synthesized
tgtgaaaagaccaaatctatat

SEQ ID NO: 111073 - DNA, 22 bp, Artificial Sequence
  chemically synthesized
tatctgattggtgtacctgaaa

SEQ ID NO: 111074 - DNA, 22 bp, Artificial Sequence
  chemically synthesized
attggtgtacctgaaagtgacg

SEQ ID NO: 111075 - DNA, 22 bp, Artificial Sequence
  chemically synthesized
gtgtacctgaaagtgacgggca

SEQ ID NO: 111076 - DNA, 22 bp, Artificial Sequence
  chemically synthesized
aaagtgacgggcagaatggaac

SEQ ID NO: 111077 - DNA, 22 bp, Artificial Sequence
  chemically synthesized
gaaaacactctgcaggatatta

SEQ ID NO: 111078 - DNA, 22 bp, Artificial Sequence
  chemically synthesized
tgcaggatattatccaggagaa

SEQ ID NO: 111079 - DNA, 22 bp, Artificial Sequence
  chemically synthesized
caggatattatccaggagaact

SEQ ID NO: 111080 - DNA, 22 bp, Artificial Sequence
  chemically synthesized
tccaggagaacttccccaatct

SEQ ID NO: 111081 - DNA, 22 bp, Artificial Sequence
  chemically synthesized
ccccaatctagcaaggcaggtc

SEQ ID NO: 111082 - DNA, 22 bp, Artificial Sequence
  chemically synthesized
cccaatctagcaaggcaggtca

SEQ ID NO: 111083 - DNA, 22 bp, Artificial Sequence
  chemically synthesized
gcaaggcaggtcaacattcaaa

SEQ ID NO: 111084 - DNA, 22 bp, Artificial Sequence
  chemically synthesized
aaattcaggaaatacagagaac

SEQ ID NO: 111085 - DNA, 22 bp, Artificial Sequence
  chemically synthesized
aggaaatacagagaacgccaca

SEQ ID NO: 111086 - DNA, 22 bp, Artificial Sequence
  chemically synthesized
cttgagaagagcaactacaagg

SEQ ID NO: 111087 - DNA, 22 bp, Artificial Sequence
  chemically synthesized
gagaagagcaactacaaggcac

SEQ ID NO: 111088 - DNA, 22 bp, Artificial Sequence
  chemically synthesized
agaagagcaactacaaggcaca

SEQ ID NO: 111089 - DNA, 22 bp, Artificial Sequence
  chemically synthesized
caaggcacataattgtcagatt

SEQ ID NO: 111090 - DNA, 22 bp, Artificial Sequence
  chemically synthesized
tcagattcaccaaagttgaaat

SEQ ID NO: 111091 - DNA, 22 bp, Artificial Sequence
  chemically synthesized
accaaagttgaaatgaagggaa

SEQ ID NO: 111092 - DNA, 22 bp, Artificial Sequence
  chemically synthesized
aaatgaagggaaaaatgttaag

SEQ ID NO: 111093 - DNA, 22 bp, Artificial Sequence
  chemically synthesized
agggtagccagagagaaaggtc

SEQ ID NO: 111094 - DNA, 22 bp, Artificial Sequence
  chemically synthesized
cccacaaagggaagcccatcag

SEQ ID NO: 111095 - DNA, 22 bp, Artificial Sequence
  chemically synthesized
tcagcagaaactctacaagcca

SEQ ID NO: 111096 - DNA, 22 bp, Artificial Sequence
  chemically synthesized
agcagaaactctacaagccaga

SEQ ID NO: 111097 - DNA, 22 bp, Artificial Sequence
  chemically synthesized
tacaagccagaagagagtgggg

SEQ ID NO: 111098 - DNA, 22 bp, Artificial Sequence
  chemically synthesized
caagccagaagagagtgggggc

SEQ ID NO: 111099 - DNA, 22 bp, Artificial Sequence
  chemically synthesized
aacatccttaaaggaaagaatt

SEQ ID NO: 111100 - DNA, 22 bp, Artificial Sequence
  chemically synthesized
aaaggaaagaattttcaacaca

SEQ ID NO: 111101 - DNA, 22 bp, Artificial Sequence
  chemically synthesized
aaggaaagaattttcaacacag

SEQ ID NO: 111102 - DNA, 22 bp, Artificial Sequence
  chemically synthesized
tcaacacagaatttcatatcca

SEQ ID NO: 111103 - DNA, 22 bp, Artificial Sequence
  chemically synthesized
caacacagaatttcatatccag

SEQ ID NO: 111104 - DNA, 22 bp, Artificial Sequence
  chemically synthesized
aacacagaatttcatatccagc

SEQ ID NO: 111105 - DNA, 22 bp, Artificial Sequence
  chemically synthesized
catatccagccaaactaagctt

SEQ ID NO: 111106 - DNA, 22 bp, Artificial Sequence
  chemically synthesized
atatccagccaaactaagcttc

SEQ ID NO: 111107 - DNA, 22 bp, Artificial Sequence
  chemically synthesized
agcttcataagtgaaggagaaa

SEQ ID NO: 111108 - DNA, 22 bp, Artificial Sequence
  chemically synthesized
cataagtgaaggagaaataaaa

SEQ ID NO: 111109 - DNA, 22 bp, Artificial Sequence
  chemically synthesized
ataagtgaaggagaaataaaat

SEQ ID NO: 111110 - DNA, 22 bp, Artificial Sequence
  chemically synthesized
tacagacaagcaaatgctgaga

SEQ ID NO: 111111 - DNA, 22 bp, Artificial Sequence
  chemically synthesized
acagacaagcaaatgctgagag

SEQ ID NO: 111112 - DNA, 22 bp, Artificial Sequence
  chemically synthesized
cagacaagcaaatgctgagaga

SEQ ID NO: 111113 - DNA, 22 bp, Artificial Sequence
  chemically synthesized
agagattttgtcatcaccaggc

SEQ ID NO: 111114 - DNA, 22 bp, Artificial Sequence
  chemically synthesized
tgtcatcaccaggcctgaccta

SEQ ID NO: 111115 - DNA, 22 bp, Artificial Sequence
  chemically synthesized
gtcatcaccaggcctgacctaa

SEQ ID NO: 111116 - DNA, 22 bp, Artificial Sequence
  chemically synthesized
tcatcaccaggcctgacctaaa

SEQ ID NO: 111117 - DNA, 22 bp, Artificial Sequence
  chemically synthesized
acctaaaagagctcctgaagga

SEQ ID NO: 111118 - DNA, 22 bp, Artificial Sequence
  chemically synthesized
aaagagctcctgaaggaagcac

SEQ ID NO: 111119 - DNA, 22 bp, Artificial Sequence
  chemically synthesized
ctgaaggaagcactaaatatgg

SEQ ID NO: 111120 - DNA, 22 bp, Artificial Sequence
  chemically synthesized
aaggaagcactaaatatggaaa

SEQ ID NO: 111121 - DNA, 22 bp, Artificial Sequence
  chemically synthesized
aatatggaaaggcacaaccggt

SEQ ID NO: 111122 - DNA, 22 bp, Artificial Sequence
  chemically synthesized
caaaaacatgccaaattgtaaa

SEQ ID NO: 111123 - DNA, 22 bp, Artificial Sequence
  chemically synthesized
taaagaccattgaggctaggaa

SEQ ID NO: 111124 - DNA, 22 bp, Artificial Sequence
  chemically synthesized
aggctaggaagaaactgcatca

SEQ ID NO: 111125 - DNA, 22 bp, Artificial Sequence
  chemically synthesized
ggaagaaactgcatcaactaat

SEQ ID NO: 111126 - DNA, 22 bp, Artificial Sequence
  chemically synthesized
catcaactaatgagcaaaataa

SEQ ID NO: 111127 - DNA, 22 bp, Artificial Sequence
  chemically synthesized
atgagcaaaataaccagctaac

SEQ ID NO: 111128 - DNA, 22 bp, Artificial Sequence
  chemically synthesized
acatcataatgacaggatcaaa

SEQ ID NO: 111129 - DNA, 22 bp, Artificial Sequence
  chemically synthesized
acacataacaatattaacctta

SEQ ID NO: 111130 - DNA, 22 bp, Artificial Sequence
  chemically synthesized
accttaatgtaaatgggctaaa

SEQ ID NO: 111131 - DNA, 22 bp, Artificial Sequence
  chemically synthesized
aatgtaaatgggctaaatgctc

SEQ ID NO: 111132 - DNA, 22 bp, Artificial Sequence
  chemically synthesized
atgtaaatgggctaaatgctcc

SEQ ID NO: 111133 - DNA, 22 bp, Artificial Sequence
  chemically synthesized
aatgctccagtaaaaagacaca

SEQ ID NO: 111134 - DNA, 22 bp, Artificial Sequence
  chemically synthesized
cagtaaaaagacacagacgggc

SEQ ID NO: 111135 - DNA, 22 bp, Artificial Sequence
  chemically synthesized
gataaagagtcaagacccatca

SEQ ID NO: 111136 - DNA, 22 bp, Artificial Sequence
  chemically synthesized
tattcaggaaacccatctcatg

SEQ ID NO: 111137 - DNA, 22 bp, Artificial Sequence
  chemically synthesized
aggaaacccatctcatgtgcac

SEQ ID NO: 111138 - DNA, 22 bp, Artificial Sequence
  chemically synthesized
atgtgcacacacacacataggc

SEQ ID NO: 111139 - DNA, 22 bp, Artificial Sequence
  chemically synthesized
aaaataaagggatggaggaaga

SEQ ID NO: 111140 - DNA, 22 bp, Artificial Sequence
  chemically synthesized
ccaagaaaatggaaaacaaaaa

SEQ ID NO: 111141 - DNA, 22 bp, Artificial Sequence
  chemically synthesized
caatcctcatctctgataaaac

SEQ ID NO: 111142 - DNA, 22 bp, Artificial Sequence
  chemically synthesized
atctctgataaaacaggcttta

SEQ ID NO: 111143 - DNA, 22 bp, Artificial Sequence
  chemically synthesized
tgataaaacaggctttaaacca

SEQ ID NO: 111144 - DNA, 22 bp, Artificial Sequence
  chemically synthesized
ataaaacaggctttaaaccaac

SEQ ID NO: 111145 - DNA, 22 bp, Artificial Sequence
  chemically synthesized
taaaccaacaaagatcaaaaga

SEQ ID NO: 111146 - DNA, 22 bp, Artificial Sequence
  chemically synthesized
aaaccaacaaagatcaaaagag

SEQ ID NO: 111147 - DNA, 22 bp, Artificial Sequence
  chemically synthesized
aaccaacaaagatcaaaagaga

SEQ ID NO: 111148 - DNA, 22 bp, Artificial Sequence
  chemically synthesized
cataatggtaaagggatcaatt

SEQ ID NO: 111149 - DNA, 22 bp, Artificial Sequence
  chemically synthesized
aacaagaagagctaactatcct

SEQ ID NO: 111150 - DNA, 22 bp, Artificial Sequence
  chemically synthesized
actatcctaaacatatatgcac

SEQ ID NO: 111151 - DNA, 22 bp, Artificial Sequence
  chemically synthesized
tcctaaacatatatgcacccaa

SEQ ID NO: 111152 - DNA, 22 bp, Artificial Sequence
  chemically synthesized
aacatatatgcacccaatacag

SEQ ID NO: 111153 - DNA, 22 bp, Artificial Sequence
  chemically synthesized
ataaagcaagtccttagagacc

SEQ ID NO: 111154 - DNA, 22 bp, Artificial Sequence
  chemically synthesized
agagacctacaaagagacttag

SEQ ID NO: 111155 - DNA, 22 bp, Artificial Sequence
  chemically synthesized
gagacctacaaagagacttaga

SEQ ID NO: 111156 - DNA, 22 bp, Artificial Sequence
  chemically synthesized
caaagagacttagactctcaca

SEQ ID NO: 111157 - DNA, 22 bp, Artificial Sequence
  chemically synthesized
agactctcacacaataacaatg

SEQ ID NO: 111158 - DNA, 22 bp, Artificial Sequence
  chemically synthesized
gactctcacacaataacaatgg

SEQ ID NO: 111159 - DNA, 22 bp, Artificial Sequence
  chemically synthesized
tcacacaataacaatgggagac

SEQ ID NO: 111160 - DNA, 22 bp, Artificial Sequence
  chemically synthesized
acacaataacaatgggagactt

SEQ ID NO: 111161 - DNA, 22 bp, Artificial Sequence
  chemically synthesized
taacaccccactgtcaacatta

SEQ ID NO: 111162 - DNA, 22 bp, Artificial Sequence
  chemically synthesized
aacaccccactgtcaacattag

SEQ ID NO: 111163 - DNA, 22 bp, Artificial Sequence
  chemically synthesized
acaccccactgtcaacattaga

SEQ ID NO: 111164 - DNA, 22 bp, Artificial Sequence
  chemically synthesized
tcaacattagacagatcaacat

SEQ ID NO: 111165 - DNA, 22 bp, Artificial Sequence
  chemically synthesized
gacagatcaacattagacagat

SEQ ID NO: 111166 - DNA, 22 bp, Artificial Sequence
  chemically synthesized
gacagatcaacgagacagaaag

SEQ ID NO: 111167 - DNA, 22 bp, Artificial Sequence
  chemically synthesized
acaaggatatccaggaattgaa

SEQ ID NO: 111168 - DNA, 22 bp, Artificial Sequence
  chemically synthesized
aactcagctctgcaccaagcgg

SEQ ID NO: 111169 - DNA, 22 bp, Artificial Sequence
  chemically synthesized
agctctgcaccaagcggaccta

SEQ ID NO: 111170 - DNA, 22 bp, Artificial Sequence
  chemically synthesized
tgcaccaagcggacctaataga

SEQ ID NO: 111171 - DNA, 22 bp, Artificial Sequence
  chemically synthesized
caccaagcggacctaatagaca

SEQ ID NO: 111172 - DNA, 22 bp, Artificial Sequence
  chemically synthesized
atagacatctacagaactctcc

SEQ ID NO: 111173 - DNA, 22 bp, Artificial Sequence
  chemically synthesized
cagaactctccaccccaaatca

SEQ ID NO: 111174 - DNA, 22 bp, Artificial Sequence
  chemically synthesized
tccaccccaaatcaacagaata

SEQ ID NO: 111175 - DNA, 22 bp, Artificial Sequence
  chemically synthesized
caccccaaatcaacagaatata

SEQ ID NO: 111176 - DNA, 22 bp, Artificial Sequence
  chemically synthesized
ttttcagcaccacaccacacct

SEQ ID NO: 111177 - DNA, 22 bp, Artificial Sequence
  chemically synthesized
ttcagcaccacaccacacctat

SEQ ID NO: 111178 - DNA, 22 bp, Artificial Sequence
  chemically synthesized
tcagcaccacaccacacctatt

SEQ ID NO: 111179 - DNA, 22 bp, Artificial Sequence
  chemically synthesized
cagcaccacaccacacctattc

SEQ ID NO: 111180 - DNA, 22 bp, Artificial Sequence
  chemically synthesized
agcaccacaccacacctattcc

SEQ ID NO: 111181 - DNA, 22 bp, Artificial Sequence
  chemically synthesized
ttccaaaattgaccacatagtt

SEQ ID NO: 111182 - DNA, 22 bp, Artificial Sequence
  chemically synthesized
caaaattgaccacatagttgga

SEQ ID NO: 111183 - DNA, 22 bp, Artificial Sequence
  chemically synthesized
accacatagttggaagtaaagc

SEQ ID NO: 111184 - DNA, 22 bp, Artificial Sequence
  chemically synthesized
gaagtaaagcactcctcagcaa

SEQ ID NO: 111185 - DNA, 22 bp, Artificial Sequence
  chemically synthesized
ctcagcaaatgtaaaagaacag

SEQ ID NO: 111186 - DNA, 22 bp, Artificial Sequence
  chemically synthesized
agcaaatgtaaaagaacagaaa

SEQ ID NO: 111187 - DNA, 22 bp, Artificial Sequence
  chemically synthesized
taacaaactgtctctcagacca

SEQ ID NO: 111188 - DNA, 22 bp, Artificial Sequence
  chemically synthesized
tctctcagaccacagtgcaatc

SEQ ID NO: 111189 - DNA, 22 bp, Artificial Sequence
  chemically synthesized
tcagaccacagtgcaatcaaac

SEQ ID NO: 111190 - DNA, 22 bp, Artificial Sequence
  chemically synthesized
agaccacagtgcaatcaaacta

SEQ ID NO: 111191 - DNA, 22 bp, Artificial Sequence
  chemically synthesized
gaactcaggattaagaaactca

SEQ ID NO: 111192 - DNA, 22 bp, Artificial Sequence
  chemically synthesized
aggattaagaaactcactcaaa

SEQ ID NO: 111193 - DNA, 22 bp, Artificial Sequence
  chemically synthesized
agaaactcactcaaaaccgctc

SEQ ID NO: 111194 - DNA, 22 bp, Artificial Sequence
  chemically synthesized
actcaaaaccgctcaactacat

SEQ ID NO: 111195 - DNA, 22 bp, Artificial Sequence
  chemically synthesized
aaaaccgctcaactacatggaa

SEQ ID NO: 111196 - DNA, 22 bp, Artificial Sequence
  chemically synthesized
aactacatggaaaccgaacaaa

SEQ ID NO: 111197 - DNA, 22 bp, Artificial Sequence
  chemically synthesized
catggaaaccgaacaaattgct

SEQ ID NO: 111198 - DNA, 22 bp, Artificial Sequence
  chemically synthesized
ctcctgaatgactactgggttc

SEQ ID NO: 111199 - DNA, 22 bp, Artificial Sequence
  chemically synthesized
ctgaatgactactgggttcata

SEQ ID NO: 111200 - DNA, 22 bp, Artificial Sequence
  chemically synthesized
aatgactactgggttcataaca

SEQ ID NO: 111201 - DNA, 22 bp, Artificial Sequence
  chemically synthesized
ctgggttcataacaaaatgaag

SEQ ID NO: 111202 - DNA, 22 bp, Artificial Sequence
  chemically synthesized
ggttcataacaaaatgaaggca

SEQ ID NO: 111203 - DNA, 22 bp, Artificial Sequence
  chemically synthesized
ataacaaaatgaaggcagaaat

SEQ ID NO: 111204 - DNA, 22 bp, Artificial Sequence
  chemically synthesized
tttggaaccaaagagaacaaag

SEQ ID NO: 111205 - DNA, 22 bp, Artificial Sequence
  chemically synthesized
tggaaccaaagagaacaaagac

SEQ ID NO: 111206 - DNA, 22 bp, Artificial Sequence
  chemically synthesized
ggaaccaaagagaacaaagaca

SEQ ID NO: 111207 - DNA, 22 bp, Artificial Sequence
  chemically synthesized
gaaccaaagagaacaaagacac

SEQ ID NO: 111208 - DNA, 22 bp, Artificial Sequence
  chemically synthesized
tgggacacattcaaagcagtgt

SEQ ID NO: 111209 - DNA, 22 bp, Artificial Sequence
  chemically synthesized
ggacacattcaaagcagtgtgt

SEQ ID NO: 111210 - DNA, 22 bp, Artificial Sequence
  chemically synthesized
aaagcagtgtgtagagggaaat

SEQ ID NO: 111211 - DNA, 22 bp, Artificial Sequence
  chemically synthesized
atagcactaaacgcccagaaga

SEQ ID NO: 111212 - DNA, 22 bp, Artificial Sequence
  chemically synthesized
tagcactaaacgcccagaagag

SEQ ID NO: 111213 - DNA, 22 bp, Artificial Sequence
  chemically synthesized
aacgcccagaagagaaagcagg

SEQ ID NO: 111214 - DNA, 22 bp, Artificial Sequence
  chemically synthesized
aaattgacaccctaacatcaca

SEQ ID NO: 111215 - DNA, 22 bp, Artificial Sequence
  chemically synthesized
acaccctaacatcacaattaaa

SEQ ID NO: 111216 - DNA, 22 bp, Artificial Sequence
  chemically synthesized
acatcacaattaaaagaactag

SEQ ID NO: 111217 - DNA, 22 bp, Artificial Sequence
  chemically synthesized
aaagaactagagaagcaagagc

SEQ ID NO: 111218 - DNA, 22 bp, Artificial Sequence
  chemically synthesized
gagaagcaagagcaaacacatt

SEQ ID NO: 111219 - DNA, 22 bp, Artificial Sequence
  chemically synthesized
aaatgctagcagaaggcaagaa

SEQ ID NO: 111220 - DNA, 22 bp, Artificial Sequence
  chemically synthesized
gcagaaggcaagaaataactaa

SEQ ID NO: 111221 - DNA, 22 bp, Artificial Sequence
  chemically synthesized
aaatcagagcagaactgaagga

SEQ ID NO: 111222 - DNA, 22 bp, Artificial Sequence
  chemically synthesized
aaggaaatagagacacaaaaaa

SEQ ID NO: 111223 - DNA, 22 bp, Artificial Sequence
  chemically synthesized
caaaaaatcaatgaatccagaa

SEQ ID NO: 111224 - DNA, 22 bp, Artificial Sequence
  chemically synthesized
aaaaaatcaatgaatccagaag

SEQ ID NO: 111225 - DNA, 22 bp, Artificial Sequence
  chemically synthesized
gtttttcaaaaagatcaacaaa

SEQ ID NO: 111226 - DNA, 22 bp, Artificial Sequence
  chemically synthesized
ttcaaaaagatcaacaaaattg

SEQ ID NO: 111227 - DNA, 22 bp, Artificial Sequence
  chemically synthesized
tcaaaaagatcaacaaaattga

SEQ ID NO: 111228 - DNA, 22 bp, Artificial Sequence
  chemically synthesized
caaaaagatcaacaaaattgat

SEQ ID NO: 111229 - DNA, 22 bp, Artificial Sequence
  chemically synthesized
aaaaagatcaacaaaattgata

SEQ ID NO: 111230 - DNA, 22 bp, Artificial Sequence
  chemically synthesized
atagactgctagcaagactaat

SEQ ID NO: 111231 - DNA, 22 bp, Artificial Sequence
  chemically synthesized
ctagcaagactaataaagaaga

SEQ ID NO: 111232 - DNA, 22 bp, Artificial Sequence
  chemically synthesized
gcaagactaataaagaagaaaa

SEQ ID NO: 111233 - DNA, 22 bp, Artificial Sequence
  chemically synthesized
ataaagaagaaaagagagaaga

SEQ ID NO: 111234 - DNA, 22 bp, Artificial Sequence
  chemically synthesized
taaacacctctacacaaataaa

SEQ ID NO: 111235 - DNA, 22 bp, Artificial Sequence
  chemically synthesized
tacacaaataaactagaaaatc

SEQ ID NO: 111236 - DNA, 22 bp, Artificial Sequence
  chemically synthesized
cacaaataaactagaaaatcta

SEQ ID NO: 111237 - DNA, 22 bp, Artificial Sequence
  chemically synthesized
gaaaatctagaagaaatggata

SEQ ID NO: 111238 - DNA, 22 bp, Artificial Sequence
  chemically synthesized
gaagaaatggataaattccttg

SEQ ID NO: 111239 - DNA, 22 bp, Artificial Sequence
  chemically synthesized
cttgacacatacaccctcccaa

SEQ ID NO: 111240 - DNA, 22 bp, Artificial Sequence
  chemically synthesized
gacacatacaccctcccaagac

SEQ ID NO: 111241 - DNA, 22 bp, Artificial Sequence
  chemically synthesized
acacatacaccctcccaagact

SEQ ID NO: 111242 - DNA, 22 bp, Artificial Sequence
  chemically synthesized
ccaagactaaaccaggaagaag

SEQ ID NO: 111243 - DNA, 22 bp, Artificial Sequence
  chemically synthesized
aaccaggaagaagttgaatctc

SEQ ID NO: 111244 - DNA, 22 bp, Artificial Sequence
  chemically synthesized
aatctctgaatagaccaataac

SEQ ID NO: 111245 - DNA, 22 bp, Artificial Sequence
  chemically synthesized
tgaatagaccaataacaggatc

SEQ ID NO: 111246 - DNA, 22 bp, Artificial Sequence
  chemically synthesized
aatagaccaataacaggatctg

SEQ ID NO: 111247 - DNA, 22 bp, Artificial Sequence
  chemically synthesized
aaattgaggcaataattaatag

SEQ ID NO: 111248 - DNA, 22 bp, Artificial Sequence
  chemically synthesized
aggcaataattaatagcttacc

SEQ ID NO: 111249 - DNA, 22 bp, Artificial Sequence
  chemically synthesized
atagcttaccaaccaaaaacag

SEQ ID NO: 111250 - DNA, 22 bp, Artificial Sequence
  chemically synthesized
accaaccaaaaacagtccagga

SEQ ID NO: 111251 - DNA, 22 bp, Artificial Sequence
  chemically synthesized
ccaaccaaaaacagtccaggac

SEQ ID NO: 111252 - DNA, 22 bp, Artificial Sequence
  chemically synthesized
taccagaggtacaaggaggagc

SEQ ID NO: 111253 - DNA, 22 bp, Artificial Sequence
  chemically synthesized
ccagaggtacaaggaggagctg

SEQ ID NO: 111254 - DNA, 22 bp, Artificial Sequence
  chemically synthesized
gtaccattccctctgaaactat

SEQ ID NO: 111255 - DNA, 22 bp, Artificial Sequence
  chemically synthesized
cctctgaaactattcgaatcaa

SEQ ID NO: 111256 - DNA, 22 bp, Artificial Sequence
  chemically synthesized
tgaaactattcgaatcaatagt

SEQ ID NO: 111257 - DNA, 22 bp, Artificial Sequence
  chemically synthesized
aaactattcgaatcaatagtaa

SEQ ID NO: 111258 - DNA, 22 bp, Artificial Sequence
  chemically synthesized
ttcgaatcaatagtaaaagagg

SEQ ID NO: 111259 - DNA, 22 bp, Artificial Sequence
  chemically synthesized
gaatcaatagtaaaagagggaa

SEQ ID NO: 111260 - DNA, 22 bp, Artificial Sequence
  chemically synthesized
cctaactcattttatgaggcca

SEQ ID NO: 111261 - DNA, 22 bp, Artificial Sequence
  chemically synthesized
actcattttatgaggccagcat

SEQ ID NO: 111262 - DNA, 22 bp, Artificial Sequence
  chemically synthesized
attttatgaggccagcatcatc

SEQ ID NO: 111263 - DNA, 22 bp, Artificial Sequence
  chemically synthesized
tatgaggccagcatcatcctga

SEQ ID NO: 111264 - DNA, 22 bp, Artificial Sequence
  chemically synthesized
atgaggccagcatcatcctgat

SEQ ID NO: 111265 - DNA, 22 bp, Artificial Sequence
  chemically synthesized
tgaggccagcatcatcctgata

SEQ ID NO: 111266 - DNA, 22 bp, Artificial Sequence
  chemically synthesized
ataccaaagccgggcagagaca

SEQ ID NO: 111267 - DNA, 22 bp, Artificial Sequence
  chemically synthesized
tagaccaatatccctgatggac

SEQ ID NO: 111268 - DNA, 22 bp, Artificial Sequence
  chemically synthesized
agaccaatatccctgatggaca

SEQ ID NO: 111269 - DNA, 22 bp, Artificial Sequence
  chemically synthesized
gaccaatatccctgatggacat

SEQ ID NO: 111270 - DNA, 22 bp, Artificial Sequence
  chemically synthesized
atggacatcgatgcaaaaaacc

SEQ ID NO: 111271 - DNA, 22 bp, Artificial Sequence
  chemically synthesized
aataaaatactggcaaagcaaa

SEQ ID NO: 111272 - DNA, 22 bp, Artificial Sequence
  chemically synthesized
gcaaagcaaatccagcagcaca

SEQ ID NO: 111273 - DNA, 22 bp, Artificial Sequence
  chemically synthesized
atccaccatgatcaagtgggct

SEQ ID NO: 111274 - DNA, 22 bp, Artificial Sequence
  chemically synthesized
tccaccatgatcaagtgggctt

SEQ ID NO: 111275 - DNA, 22 bp, Artificial Sequence
  chemically synthesized
catccctgggatgcaaggctgg

SEQ ID NO: 111276 - DNA, 22 bp, Artificial Sequence
  chemically synthesized
atccctgggatgcaaggctggt

SEQ ID NO: 111277 - DNA, 22 bp, Artificial Sequence
  chemically synthesized
ggatgcaaggctggttcaacat

SEQ ID NO: 111278 - DNA, 22 bp, Artificial Sequence
  chemically synthesized
gttcaacatatgcaaatcaata

SEQ ID NO: 111279 - DNA, 22 bp, Artificial Sequence
  chemically synthesized
aacatatgcaaatcaataaatg

SEQ ID NO: 111280 - DNA, 22 bp, Artificial Sequence
  chemically synthesized
tctcaatagatgcagaaaaggc

SEQ ID NO: 111281 - DNA, 22 bp, Artificial Sequence
  chemically synthesized
aatagatgcagaaaaggccttt

SEQ ID NO: 111282 - DNA, 22 bp, Artificial Sequence
  chemically synthesized
tgacaaaattcaacaacccttc

SEQ ID NO: 111283 - DNA, 22 bp, Artificial Sequence
  chemically synthesized
gacaaaattcaacaacccttca

SEQ ID NO: 111284 - DNA, 22 bp, Artificial Sequence
  chemically synthesized
acaaaattcaacaacccttcat

SEQ ID NO: 111285 - DNA, 22 bp, Artificial Sequence
  chemically synthesized
aacaacccttcatgctaaaaac

SEQ ID NO: 111286 - DNA, 22 bp, Artificial Sequence
  chemically synthesized
catgctaaaaactctcaataaa

SEQ ID NO: 111287 - DNA, 22 bp, Artificial Sequence
  chemically synthesized
atgctaaaaactctcaataaat

SEQ ID NO: 111288 - DNA, 22 bp, Artificial Sequence
  chemically synthesized
aaaactctcaataaattaggta

SEQ ID NO: 111289 - DNA, 22 bp, Artificial Sequence
  chemically synthesized
tcaataaattaggtattgatgg

SEQ ID NO: 111290 - DNA, 22 bp, Artificial Sequence
  chemically synthesized
aataaattaggtattgatggga

SEQ ID NO: 111291 - DNA, 22 bp, Artificial Sequence
  chemically synthesized
ggtattgatgggacgtatctca

SEQ ID NO: 111292 - DNA, 22 bp, Artificial Sequence
  chemically synthesized
atgggacgtatctcaaaataat

SEQ ID NO: 111293 - DNA, 22 bp, Artificial Sequence
  chemically synthesized
aaaataataagagccatctatg

SEQ ID NO: 111294 - DNA, 22 bp, Artificial Sequence
  chemically synthesized
tgacaaacccacagccaatatc

SEQ ID NO: 111295 - DNA, 22 bp, Artificial Sequence
  chemically synthesized
aatggacaaaaactggaagcat

SEQ ID NO: 111296 - DNA, 22 bp, Artificial Sequence
  chemically synthesized
gaagcattccctttgaaaactg

SEQ ID NO: 111297 - DNA, 22 bp, Artificial Sequence
  chemically synthesized
cctttgaaaactggcacaagac

SEQ ID NO: 111298 - DNA, 22 bp, Artificial Sequence
  chemically synthesized
tgaaaactggcacaagacaggg

SEQ ID NO: 111299 - DNA, 22 bp, Artificial Sequence
  chemically synthesized
gaaaactggcacaagacaggga

SEQ ID NO: 111300 - DNA, 22 bp, Artificial Sequence
  chemically synthesized
aaaactggcacaagacagggat

SEQ ID NO: 111301 - DNA, 22 bp, Artificial Sequence
  chemically synthesized
gcacaagacagggatgccctct

SEQ ID NO: 111302 - DNA, 22 bp, Artificial Sequence
  chemically synthesized
tctcactactcctattcaacat

SEQ ID NO: 111303 - DNA, 22 bp, Artificial Sequence
  chemically synthesized
tcactactcctattcaacatag

SEQ ID NO: 111304 - DNA, 22 bp, Artificial Sequence
  chemically synthesized
actactcctattcaacatagtg

SEQ ID NO: 111305 - DNA, 22 bp, Artificial Sequence
  chemically synthesized
ctcctattcaacatagtgttgg

SEQ ID NO: 111306 - DNA, 22 bp, Artificial Sequence
  chemically synthesized
ctattcaacatagtgttggaat

SEQ ID NO: 111307 - DNA, 22 bp, Artificial Sequence
  chemically synthesized
ttcaacatagtgttggaatttc

SEQ ID NO: 111308 - DNA, 22 bp, Artificial Sequence
  chemically synthesized
aacatagtgttggaatttctgg

SEQ ID NO: 111309 - DNA, 22 bp, Artificial Sequence
  chemically synthesized
gaatttctggccagggcaatta

SEQ ID NO: 111310 - DNA, 22 bp, Artificial Sequence
  chemically synthesized
ctggccagggcaattaggcagg

SEQ ID NO: 111311 - DNA, 22 bp, Artificial Sequence
  chemically synthesized
tggccagggcaattaggcagga

SEQ ID NO: 111312 - DNA, 22 bp, Artificial Sequence
  chemically synthesized
gccagggcaattaggcaggaga

SEQ ID NO: 111313 - DNA, 22 bp, Artificial Sequence
  chemically synthesized
ggcaggagaaggaaaaaaaggt

SEQ ID NO: 111314 - DNA, 22 bp, Artificial Sequence
  chemically synthesized
aattaggaaaagaggaagtcaa

SEQ ID NO: 111315 - DNA, 22 bp, Artificial Sequence
  chemically synthesized
ggaaaagaggaagtcaaattgt

SEQ ID NO: 111316 - DNA, 22 bp, Artificial Sequence
  chemically synthesized
tccctgtttgcagatgacacga

SEQ ID NO: 111317 - DNA, 22 bp, Artificial Sequence
  chemically synthesized
tttgcagatgacacgattgtat

SEQ ID NO: 111318 - DNA, 22 bp, Artificial Sequence
  chemically synthesized
gcagatgacacgattgtatatc

SEQ ID NO: 111319 - DNA, 22 bp, Artificial Sequence
  chemically synthesized
cagatgacacgattgtatatct

SEQ ID NO: 111320 - DNA, 22 bp, Artificial Sequence
  chemically synthesized
tatatctagaaaaccccactgt

SEQ ID NO: 111321 - DNA, 22 bp, Artificial Sequence
  chemically synthesized
gaaaaccccactgtctcagccc

SEQ ID NO: 111322 - DNA, 22 bp, Artificial Sequence
  chemically synthesized
tctcagcccaaaatgtccttaa

SEQ ID NO: 111323 - DNA, 22 bp, Artificial Sequence
  chemically synthesized
agcccaaaatgtccttaaactg

SEQ ID NO: 111324 - DNA, 22 bp, Artificial Sequence
  chemically synthesized
aaactgataggcaacttcagca

SEQ ID NO: 111325 - DNA, 22 bp, Artificial Sequence
  chemically synthesized
aactgataggcaacttcagcaa

SEQ ID NO: 111326 - DNA, 22 bp, Artificial Sequence
  chemically synthesized
ataggcaacttcagcaaagtct

SEQ ID NO: 111327 - DNA, 22 bp, Artificial Sequence
  chemically synthesized
cagcaaagtctcaggatacaaa

SEQ ID NO: 111328 - DNA, 22 bp, Artificial Sequence
  chemically synthesized
agcaaagtctcaggatacaaaa

SEQ ID NO: 111329 - DNA, 22 bp, Artificial Sequence
  chemically synthesized
aggatacaaaatcaatgtgcaa

SEQ ID NO: 111330 - DNA, 22 bp, Artificial Sequence
  chemically synthesized
ttatacaccaataacagacaaa

SEQ ID NO: 111331 - DNA, 22 bp, Artificial Sequence
  chemically synthesized
atacaccaataacagacaaaca

SEQ ID NO: 111332 - DNA, 22 bp, Artificial Sequence
  chemically synthesized
tacaccaataacagacaaacag

SEQ ID NO: 111333 - DNA, 22 bp, Artificial Sequence
  chemically synthesized
ccattcacaattgcttcaaaga

SEQ ID NO: 111334 - DNA, 22 bp, Artificial Sequence
  chemically synthesized
acaattgcttcaaagagaataa

SEQ ID NO: 111335 - DNA, 22 bp, Artificial Sequence
  chemically synthesized
cttcaaagagaataaaatacct

SEQ ID NO: 111336 - DNA, 22 bp, Artificial Sequence
  chemically synthesized
caaagagaataaaatacctagg

SEQ ID NO: 111337 - DNA, 22 bp, Artificial Sequence
  chemically synthesized
aaagagaataaaatacctagga

SEQ ID NO: 111338 - DNA, 22 bp, Artificial Sequence
  chemically synthesized
ggaatccaacttacaagagagg

SEQ ID NO: 111339 - DNA, 22 bp, Artificial Sequence
  chemically synthesized
acaagagaggtgaaggacctct

SEQ ID NO: 111340 - DNA, 22 bp, Artificial Sequence
  chemically synthesized
caagagaggtgaaggacctctt

SEQ ID NO: 111341 - DNA, 22 bp, Artificial Sequence
  chemically synthesized
ttcaaggagaactacaaaccac

SEQ ID NO: 111342 - DNA, 22 bp, Artificial Sequence
  chemically synthesized
caaggagaactacaaaccactg

SEQ ID NO: 111343 - DNA, 22 bp, Artificial Sequence
  chemically synthesized
aaggagaactacaaaccactgc

SEQ ID NO: 111344 - DNA, 22 bp, Artificial Sequence
  chemically synthesized
caaaccactgctgaatgaaata

SEQ ID NO: 111345 - DNA, 22 bp, Artificial Sequence
  chemically synthesized
ctgaatgaaataaaagaagata

SEQ ID NO: 111346 - DNA, 22 bp, Artificial Sequence
  chemically synthesized
aatgaaataaaagaagatacaa

SEQ ID NO: 111347 - DNA, 22 bp, Artificial Sequence
  chemically synthesized
catgctcatgggtaggaagaat

SEQ ID NO: 111348 - DNA, 22 bp, Artificial Sequence
  chemically synthesized
atgggtaggaagaatcaatatc

SEQ ID NO: 111349 - DNA, 22 bp, Artificial Sequence
  chemically synthesized
atagattcaatgccatccccat

SEQ ID NO: 111350 - DNA, 22 bp, Artificial Sequence
  chemically synthesized
tagattcaatgccatccccatc

SEQ ID NO: 111351 - DNA, 22 bp, Artificial Sequence
  chemically synthesized
aatgccatccccatcaagctac

SEQ ID NO: 111352 - DNA, 22 bp, Artificial Sequence
  chemically synthesized
ccaatgactttcttcacagaat

SEQ ID NO: 111353 - DNA, 22 bp, Artificial Sequence
  chemically synthesized
tcttcacagaattggaaaaaac

SEQ ID NO: 111354 - DNA, 22 bp, Artificial Sequence
  chemically synthesized
cttcacagaattggaaaaaact

SEQ ID NO: 111355 - DNA, 22 bp, Artificial Sequence
  chemically synthesized
ttcacagaattggaaaaaacta

SEQ ID NO: 111356 - DNA, 22 bp, Artificial Sequence
  chemically synthesized
cacagaattggaaaaaactact

SEQ ID NO: 111357 - DNA, 22 bp, Artificial Sequence
  chemically synthesized
acagaattggaaaaaactactt

SEQ ID NO: 111358 - DNA, 22 bp, Artificial Sequence
  chemically synthesized
gaaaaaactactttaaagttca

SEQ ID NO: 111359 - DNA, 22 bp, Artificial Sequence
  chemically synthesized
ctttaaagttcatatggaacca

SEQ ID NO: 111360 - DNA, 22 bp, Artificial Sequence
  chemically synthesized
taaagttcatatggaaccaaaa

SEQ ID NO: 111361 - DNA, 22 bp, Artificial Sequence
  chemically synthesized
aaagttcatatggaaccaaaaa

SEQ ID NO: 111362 - DNA, 22 bp, Artificial Sequence
  chemically synthesized
aagttcatatggaaccaaaaaa

SEQ ID NO: 111363 - DNA, 22 bp, Artificial Sequence
  chemically synthesized
atatggaaccaaaaaagagccc

SEQ ID NO: 111364 - DNA, 22 bp, Artificial Sequence
  chemically synthesized
acatgccaatcctaagccaaaa

SEQ ID NO: 111365 - DNA, 22 bp, Artificial Sequence
  chemically synthesized
agccaaaagaacaaagctggag

SEQ ID NO: 111366 - DNA, 22 bp, Artificial Sequence
  chemically synthesized
gaggcatcacgctacctgactt

SEQ ID NO: 111367 - DNA, 22 bp, Artificial Sequence
  chemically synthesized
cctgacttcaaactatactaca

SEQ ID NO: 111368 - DNA, 22 bp, Artificial Sequence
  chemically synthesized
acttcaaactatactacaaggc

SEQ ID NO: 111369 - DNA, 22 bp, Artificial Sequence
  chemically synthesized
caaactatactacaaggctaca

SEQ ID NO: 111370 - DNA, 22 bp, Artificial Sequence
  chemically synthesized
aaactatactacaaggctacag

SEQ ID NO: 111371 - DNA, 22 bp, Artificial Sequence
  chemically synthesized
tactacaaggctacagtaacca

SEQ ID NO: 111372 - DNA, 22 bp, Artificial Sequence
  chemically synthesized
caaggctacagtaaccaaaaca

SEQ ID NO: 111373 - DNA, 22 bp, Artificial Sequence
  chemically synthesized
cagtaaccaaaacagcatggta

SEQ ID NO: 111374 - DNA, 22 bp, Artificial Sequence
  chemically synthesized
gtaccaaaacagagatatagac

SEQ ID NO: 111375 - DNA, 22 bp, Artificial Sequence
  chemically synthesized
agaaataatgccgcatgtctac

SEQ ID NO: 111376 - DNA, 22 bp, Artificial Sequence
  chemically synthesized
caaccatctgatctttgacaaa

SEQ ID NO: 111377 - DNA, 22 bp, Artificial Sequence
  chemically synthesized
atctttgacaaacctgacaaaa

SEQ ID NO: 111378 - DNA, 22 bp, Artificial Sequence
  chemically synthesized
tgacaaacctgacaaaaaaaac

SEQ ID NO: 111379 - DNA, 22 bp, Artificial Sequence
  chemically synthesized
gacaaacctgacaaaaaaaaca

SEQ ID NO: 111380 - DNA, 22 bp, Artificial Sequence
  chemically synthesized
acaaacctgacaaaaaaaacaa

SEQ ID NO: 111381 - DNA, 22 bp, Artificial Sequence
  chemically synthesized
acaaaaaaaacaaatggggaaa

SEQ ID NO: 111382 - DNA, 22 bp, Artificial Sequence
  chemically synthesized
cctatttaataaatggtgctgg

SEQ ID NO: 111383 - DNA, 22 bp, Artificial Sequence
  chemically synthesized
tttaataaatggtgctgggaaa

SEQ ID NO: 111384 - DNA, 22 bp, Artificial Sequence
  chemically synthesized
aataaatggtgctgggaaaact

SEQ ID NO: 111385 - DNA, 22 bp, Artificial Sequence
  chemically synthesized
ataaatggtgctgggaaaactg

SEQ ID NO: 111386 - DNA, 22 bp, Artificial Sequence
  chemically synthesized
ggaaaactggctaaccatacgc

SEQ ID NO: 111387 - DNA, 22 bp, Artificial Sequence
  chemically synthesized
gctaaccatacgcagaaagctg

SEQ ID NO: 111388 - DNA, 22 bp, Artificial Sequence
  chemically synthesized
accatacgcagaaagctgaaac

SEQ ID NO: 111389 - DNA, 22 bp, Artificial Sequence
  chemically synthesized
aaactggatccctttcttacac

SEQ ID NO: 111390 - DNA, 22 bp, Artificial Sequence
  chemically synthesized
gatccctttcttacaccttata

SEQ ID NO: 111391 - DNA, 22 bp, Artificial Sequence
  chemically synthesized
tcttacaccttatacaaaaatt

SEQ ID NO: 111392 - DNA, 22 bp, Artificial Sequence
  chemically synthesized
cttacaccttatacaaaaatta

SEQ ID NO: 111393 - DNA, 22 bp, Artificial Sequence
  chemically synthesized
ttacaccttatacaaaaattaa

SEQ ID NO: 111394 - DNA, 22 bp, Artificial Sequence
  chemically synthesized
acaccttatacaaaaattaatt

SEQ ID NO: 111395 - DNA, 22 bp, Artificial Sequence
  chemically synthesized
caccttatacaaaaattaattc

SEQ ID NO: 111396 - DNA, 22 bp, Artificial Sequence
  chemically synthesized
atacaaaaattaattcaagatg

SEQ ID NO: 111397 - DNA, 22 bp, Artificial Sequence
  chemically synthesized
tacaaaaattaattcaagatgg

SEQ ID NO: 111398 - DNA, 22 bp, Artificial Sequence
  chemically synthesized
attcaagatggattacagactt

SEQ ID NO: 111399 - DNA, 22 bp, Artificial Sequence
  chemically synthesized
aagatggattacagacttaaat

SEQ ID NO: 111400 - DNA, 22 bp, Artificial Sequence
  chemically synthesized
cagacttaaatgttagactgaa

SEQ ID NO: 111401 - DNA, 22 bp, Artificial Sequence
  chemically synthesized
aaatgttagactgaaaaccata

SEQ ID NO: 111402 - DNA, 22 bp, Artificial Sequence
  chemically synthesized
aatgttagactgaaaaccataa

SEQ ID NO: 111403 - DNA, 22 bp, Artificial Sequence
  chemically synthesized
gactgaaaaccataaaaactct

SEQ ID NO: 111404 - DNA, 22 bp, Artificial Sequence
  chemically synthesized
aaaaccataaaaactctggaag

SEQ ID NO: 111405 - DNA, 22 bp, Artificial Sequence
  chemically synthesized
tggaagaaaacctaggcaatac

SEQ ID NO: 111406 - DNA, 22 bp, Artificial Sequence
  chemically synthesized
gaagaaaacctaggcaatacca

SEQ ID NO: 111407 - DNA, 22 bp, Artificial Sequence
  chemically synthesized
ggcaataccattcaggacatag

SEQ ID NO: 111408 - DNA, 22 bp, Artificial Sequence
  chemically synthesized
aggacataggcatgggcaagga

SEQ ID NO: 111409 - DNA, 22 bp, Artificial Sequence
  chemically synthesized
catgtctaaaacaccaaaagca

SEQ ID NO: 111410 - DNA, 22 bp, Artificial Sequence
  chemically synthesized
atgtctaaaacaccaaaagcaa

SEQ ID NO: 111411 - DNA, 22 bp, Artificial Sequence
  chemically synthesized
aaacaccaaaagcaatggcaac

SEQ ID NO: 111412 - DNA, 22 bp, Artificial Sequence
  chemically synthesized
attaaactaaagagcttctgca

SEQ ID NO: 111413 - DNA, 22 bp, Artificial Sequence
  chemically synthesized
aactaaagagcttctgcacagc

SEQ ID NO: 111414 - DNA, 22 bp, Artificial Sequence
  chemically synthesized
aagagcttctgcacagcaaaag

SEQ ID NO: 111415 - DNA, 22 bp, Artificial Sequence
  chemically synthesized
ctgcacagcaaaagaaactacc

SEQ ID NO: 111416 - DNA, 22 bp, Artificial Sequence
  chemically synthesized
tgcacagcaaaagaaactacca

SEQ ID NO: 111417 - DNA, 22 bp, Artificial Sequence
  chemically synthesized
cacagcaaaagaaactaccatc

SEQ ID NO: 111418 - DNA, 22 bp, Artificial Sequence
  chemically synthesized
ccatcagagtgaacaggcaaca

SEQ ID NO: 111419 - DNA, 22 bp, Artificial Sequence
  chemically synthesized
ttgcaatctactcatccgacaa

SEQ ID NO: 111420 - DNA, 22 bp, Artificial Sequence
  chemically synthesized
tgcaatctactcatccgacaaa

SEQ ID NO: 111421 - DNA, 22 bp, Artificial Sequence
  chemically synthesized
gcaatctactcatccgacaaag

SEQ ID NO: 111422 - DNA, 22 bp, Artificial Sequence
  chemically synthesized
caatctactcatccgacaaagg

SEQ ID NO: 111423 - DNA, 22 bp, Artificial Sequence
  chemically synthesized
ctcatccgacaaagggctaata

SEQ ID NO: 111424 - DNA, 22 bp, Artificial Sequence
  chemically synthesized
atccgacaaagggctaatatcc

SEQ ID NO: 111425 - DNA, 22 bp, Artificial Sequence
  chemically synthesized
atatccagaatctatgatgaac

SEQ ID NO: 111426 - DNA, 22 bp, Artificial Sequence
  chemically synthesized
tgatgaactcaaacaaatttac

SEQ ID NO: 111427 - DNA, 22 bp, Artificial Sequence
  chemically synthesized
aaacaaatttacaagaaaaaaa

SEQ ID NO: 111428 - DNA, 22 bp, Artificial Sequence
  chemically synthesized
acaagaaaaaaacaaccccatc

SEQ ID NO: 111429 - DNA, 22 bp, Artificial Sequence
  chemically synthesized
caagaaaaaaacaaccccatca

SEQ ID NO: 111430 - DNA, 22 bp, Artificial Sequence
  chemically synthesized
ctcaaaagaagacatttatgca

SEQ ID NO: 111431 - DNA, 22 bp, Artificial Sequence
  chemically synthesized
tcaaaagaagacatttatgcag

SEQ ID NO: 111432 - DNA, 22 bp, Artificial Sequence
  chemically synthesized
aaaagaagacatttatgcagtc

SEQ ID NO: 111433 - DNA, 22 bp, Artificial Sequence
  chemically synthesized
atgcagtcaacagacacatgaa

SEQ ID NO: 111434 - DNA, 22 bp, Artificial Sequence
  chemically synthesized
tgcagtcaacagacacatgaaa

SEQ ID NO: 111435 - DNA, 22 bp, Artificial Sequence
  chemically synthesized
atcatcactggccatcagagaa

SEQ ID NO: 111436 - DNA, 22 bp, Artificial Sequence
  chemically synthesized
gccatcagagaaatacaaatca

SEQ ID NO: 111437 - DNA, 22 bp, Artificial Sequence
  chemically synthesized
acaccagttagaatggcgatca

SEQ ID NO: 111438 - DNA, 22 bp, Artificial Sequence
  chemically synthesized
gaatggcgatcattaaaaagtc

SEQ ID NO: 111439 - DNA, 22 bp, Artificial Sequence
  chemically synthesized
aaaagtcaggaaacaacaggtg

SEQ ID NO: 111440 - DNA, 22 bp, Artificial Sequence
  chemically synthesized
gagaggatgtgaagaagtagga

SEQ ID NO: 111441 - DNA, 22 bp, Artificial Sequence
  chemically synthesized
ttacactgttggtgagactgta

SEQ ID NO: 111442 - DNA, 22 bp, Artificial Sequence
  chemically synthesized
tacactgttggtgagactgtaa

SEQ ID NO: 111443 - DNA, 22 bp, Artificial Sequence
  chemically synthesized
acactgttggtgagactgtaaa

SEQ ID NO: 111444 - DNA, 22 bp, Artificial Sequence
  chemically synthesized
cactgttggtgagactgtaaac

SEQ ID NO: 111445 - DNA, 22 bp, Artificial Sequence
  chemically synthesized
ttggtgagactgtaaactagtt

SEQ ID NO: 111446 - DNA, 22 bp, Artificial Sequence
  chemically synthesized
gtgagactgtaaactagttcaa

SEQ ID NO: 111447 - DNA, 22 bp, Artificial Sequence
  chemically synthesized
taaactagttcaaccattgtgg

SEQ ID NO: 111448 - DNA, 22 bp, Artificial Sequence
  chemically synthesized
gttcaaccattgtggaagtcag

SEQ ID NO: 111449 - DNA, 22 bp, Artificial Sequence
  chemically synthesized
aaccattgtggaagtcagtgtg

SEQ ID NO: 111450 - DNA, 22 bp, Artificial Sequence
  chemically synthesized
tggaagtcagtgtggcgattcc

SEQ ID NO: 111451 - DNA, 22 bp, Artificial Sequence
  chemically synthesized
ctcagggatctagaactagaaa

SEQ ID NO: 111452 - DNA, 22 bp, Artificial Sequence
  chemically synthesized
agggatctagaactagaaatac

SEQ ID NO: 111453 - DNA, 22 bp, Artificial Sequence
  chemically synthesized
gaactagaaataccatttgacc

SEQ ID NO: 111454 - DNA, 22 bp, Artificial Sequence
  chemically synthesized
gaaataccatttgacccagcca

SEQ ID NO: 111455 - DNA, 22 bp, Artificial Sequence
  chemically synthesized
gacccagccatcccattactgg

SEQ ID NO: 111456 - DNA, 22 bp, Artificial Sequence
  chemically synthesized
acccagccatcccattactggg

SEQ ID NO: 111457 - DNA, 22 bp, Artificial Sequence
  chemically synthesized
ctgggtacatactcaaaggatt

SEQ ID NO: 111458 - DNA, 22 bp, Artificial Sequence
  chemically synthesized
ggtacatactcaaaggattata

SEQ ID NO: 111459 - DNA, 22 bp, Artificial Sequence
  chemically synthesized
aaaggattataaatcatgctgc

SEQ ID NO: 111460 - DNA, 22 bp, Artificial Sequence
  chemically synthesized
taaatcatgctgctataaagac

SEQ ID NO: 111461 - DNA, 22 bp, Artificial Sequence
  chemically synthesized
ctataaagacacatgcacatgt

SEQ ID NO: 111462 - DNA, 22 bp, Artificial Sequence
  chemically synthesized
taaagacacatgcacatgtatg

SEQ ID NO: 111463 - DNA, 22 bp, Artificial Sequence
  chemically synthesized
attgtggcactattcacaatag

SEQ ID NO: 111464 - DNA, 22 bp, Artificial Sequence
  chemically synthesized
ttgtggcactattcacaatagc

SEQ ID NO: 111465 - DNA, 22 bp, Artificial Sequence
  chemically synthesized
tggcactattcacaatagcaaa

SEQ ID NO: 111466 - DNA, 22 bp, Artificial Sequence
  chemically synthesized
ttcacaatagcaaagacttgga

SEQ ID NO: 111467 - DNA, 22 bp, Artificial Sequence
  chemically synthesized
acaatagcaaagacttggaacc

SEQ ID NO: 111468 - DNA, 22 bp, Artificial Sequence
  chemically synthesized
ggaaccaacccaaatgtccaac

SEQ ID NO: 111469 - DNA, 22 bp, Artificial Sequence
  chemically synthesized
gaaccaacccaaatgtccaaca

SEQ ID NO: 111470 - DNA, 22 bp, Artificial Sequence
  chemically synthesized
gattaagaaaacgtggcacata

SEQ ID NO: 111471 - DNA, 22 bp, Artificial Sequence
  chemically synthesized
agaaaacgtggcacatatacac

SEQ ID NO: 111472 - DNA, 22 bp, Artificial Sequence
  chemically synthesized
tgcagccataaaaaatgaagag

SEQ ID NO: 111473 - DNA, 22 bp, Artificial Sequence
  chemically synthesized
atgtcctttgtagggacatgga

SEQ ID NO: 111474 - DNA, 22 bp, Artificial Sequence
  chemically synthesized
tgtagggacatggatgaagctg

SEQ ID NO: 111475 - DNA, 22 bp, Artificial Sequence
  chemically synthesized
gtagggacatggatgaagctgg

SEQ ID NO: 111476 - DNA, 22 bp, Artificial Sequence
  chemically synthesized
tagggacatggatgaagctgga

SEQ ID NO: 111477 - DNA, 22 bp, Artificial Sequence
  chemically synthesized
gaaaccatcattctcagcaaac

SEQ ID NO: 111478 - DNA, 22 bp, Artificial Sequence
  chemically synthesized
tcagcaaactatcgcaaggaca

SEQ ID NO: 111479 - DNA, 22 bp, Artificial Sequence
  chemically synthesized
agcaaactatcgcaaggacaaa

SEQ ID NO: 111480 - DNA, 22 bp, Artificial Sequence
  chemically synthesized
tcgcaaggacaaaaaccaaaca

SEQ ID NO: 111481 - DNA, 22 bp, Artificial Sequence
  chemically synthesized
catgttctcactcataggtggg

SEQ ID NO: 111482 - DNA, 22 bp, Artificial Sequence
  chemically synthesized
tcactcataggtgggaattgaa

SEQ ID NO: 111483 - DNA, 22 bp, Artificial Sequence
  chemically synthesized
actcataggtgggaattgaaca

SEQ ID NO: 111484 - DNA, 22 bp, Artificial Sequence
  chemically synthesized
ataggtgggaattgaacaatga

SEQ ID NO: 111485 - DNA, 22 bp, Artificial Sequence
  chemically synthesized
aacaatgagaacacatggacac

SEQ ID NO: 111486 - DNA, 22 bp, Artificial Sequence
  chemically synthesized
cagtggggtgggggtcgggggg

SEQ ID NO: 111487 - DNA, 22 bp, Artificial Sequence
  chemically synthesized
ggagatatacctaatgctaagt

SEQ ID NO: 111488 - DNA, 22 bp, Artificial Sequence
  chemically synthesized
atgctaagtgacgagttaatgg

SEQ ID NO: 111489 - DNA, 22 bp, Artificial Sequence
  chemically synthesized
agtgacgagttaatgggtgcag

SEQ ID NO: 111490 - DNA, 22 bp, Artificial Sequence
  chemically synthesized
atgggtgcagcacaccaacatg

SEQ ID NO: 111491 - DNA, 22 bp, Artificial Sequence
  chemically synthesized
cacgttgtgcaaatgtacccta

SEQ ID NO: 111492 - DNA, 22 bp, Artificial Sequence
  chemically synthesized
tgcaaatgtaccctaaaactta

SEQ ID NO: 111493 - DNA, 22 bp, Artificial Sequence
  chemically synthesized
aaacttaaagtataataataaa

SEQ ID NO: 111494 - DNA, 22 bp, Artificial Sequence
  chemically synthesized
aaagtataataataaaagaaag

SEQ ID NO: 111495 - DNA, 22 bp, Artificial Sequence
  chemically synthesized
aagtataataataaaagaaaga

SEQ ID NO: 111496 - DNA, 22 bp, Artificial Sequence
  chemically synthesized
ctgcaaaaaggccatcctccct

SEQ ID NO: 111497 - DNA, 22 bp, Artificial Sequence
  chemically synthesized
caaaaaggccatcctccctaca

SEQ ID NO: 111498 - DNA, 22 bp, Artificial Sequence
  chemically synthesized
cctacattttcttttctacccc

SEQ ID NO: 111499 - DNA, 22 bp, Artificial Sequence
  chemically synthesized
cattttcttttctacccctatg

SEQ ID NO: 111500 - DNA, 22 bp, Artificial Sequence
  chemically synthesized
tcttttctacccctatgtgatg

SEQ ID NO: 111501 - DNA, 22 bp, Artificial Sequence
  chemically synthesized
cttttctacccctatgtgatgc

SEQ ID NO: 111502 - DNA, 22 bp, Artificial Sequence
  chemically synthesized
ttttctacccctatgtgatgct

SEQ ID NO: 111503 - DNA, 22 bp, Artificial Sequence
  chemically synthesized
ttctacccctatgtgatgctta

SEQ ID NO: 111504 - DNA, 22 bp, Artificial Sequence
  chemically synthesized
tctacccctatgtgatgcttaa

SEQ ID NO: 111505 - DNA, 22 bp, Artificial Sequence
  chemically synthesized
ctacccctatgtgatgcttaaa

SEQ ID NO: 111506 - DNA, 22 bp, Artificial Sequence
  chemically synthesized
tacccctatgtgatgcttaaaa

SEQ ID NO: 111507 - DNA, 22 bp, Artificial Sequence
  chemically synthesized
cccctatgtgatgcttaaaata

SEQ ID NO: 111508 - DNA, 22 bp, Artificial Sequence
  chemically synthesized
tgtgatgcttaaaataaatctt

SEQ ID NO: 111509 - DNA, 22 bp, Artificial Sequence
  chemically synthesized
aaaataaatcttatttctggag

SEQ ID NO: 111510 - DNA, 22 bp, Artificial Sequence
  chemically synthesized
aaataaatcttatttctggaga

SEQ ID NO: 111511 - DNA, 22 bp, Artificial Sequence
  chemically synthesized
atttctggagatgtggctaatt

SEQ ID NO: 111512 - DNA, 22 bp, Artificial Sequence
  chemically synthesized
tttctggagatgtggctaattc

SEQ ID NO: 111513 - DNA, 22 bp, Artificial Sequence
  chemically synthesized
ctggagatgtggctaattccct

SEQ ID NO: 111514 - DNA, 22 bp, Artificial Sequence
  chemically synthesized
tggagatgtggctaattcccta

SEQ ID NO: 111515 - DNA, 22 bp, Artificial Sequence
  chemically synthesized
gagatgtggctaattccctaac

SEQ ID NO: 111516 - DNA, 22 bp, Artificial Sequence
  chemically synthesized
attccctaacctagatgcagga

SEQ ID NO: 111517 - DNA, 22 bp, Artificial Sequence
  chemically synthesized
cctaacctagatgcaggaagaa

SEQ ID NO: 111518 - DNA, 22 bp, Artificial Sequence
  chemically synthesized
acctagatgcaggaagaaacct

SEQ ID NO: 111519 - DNA, 22 bp, Artificial Sequence
  chemically synthesized
gatgcaggaagaaaccttagcg

SEQ ID NO: 111520 - DNA, 22 bp, Artificial Sequence
  chemically synthesized
agcgactcctgttccaaagttc

SEQ ID NO: 111521 - DNA, 22 bp, Artificial Sequence
  chemically synthesized
gcgactcctgttccaaagttct

SEQ ID NO: 111522 - DNA, 22 bp, Artificial Sequence
  chemically synthesized
ctgttccaaagttctaaatccc

SEQ ID NO: 111523 - DNA, 22 bp, Artificial Sequence
  chemically synthesized
ttccaaagttctaaatccctca

SEQ ID NO: 111524 - DNA, 22 bp, Artificial Sequence
  chemically synthesized
caaagttctaaatccctcaggc

SEQ ID NO: 111525 - DNA, 22 bp, Artificial Sequence
  chemically synthesized
taaatccctcaggctgggagaa

SEQ ID NO: 111526 - DNA, 22 bp, Artificial Sequence
  chemically synthesized
aatccctcaggctgggagaata

SEQ ID NO: 111527 - DNA, 22 bp, Artificial Sequence
  chemically synthesized
aggctgggagaataaagaagga

SEQ ID NO: 111528 - DNA, 22 bp, Artificial Sequence
  chemically synthesized
ggagaataaagaaggagggagg

SEQ ID NO: 111529 - DNA, 22 bp, Artificial Sequence
  chemically synthesized
ctgaaactaattttctttgcag

SEQ ID NO: 111530 - DNA, 22 bp, Artificial Sequence
  chemically synthesized
tgaaactaattttctttgcagc

SEQ ID NO: 111531 - DNA, 22 bp, Artificial Sequence
  chemically synthesized
aaactaattttctttgcagctt

SEQ ID NO: 111532 - DNA, 22 bp, Artificial Sequence
  chemically synthesized
attttctttgcagcttggcttc

SEQ ID NO: 111533 - DNA, 22 bp, Artificial Sequence
  chemically synthesized
tctttgcagcttggcttctgag

SEQ ID NO: 111534 - DNA, 22 bp, Artificial Sequence
  chemically synthesized
ctttgcagcttggcttctgagt

SEQ ID NO: 111535 - DNA, 22 bp, Artificial Sequence
  chemically synthesized
tttgcagcttggcttctgagta

SEQ ID NO: 111536 - DNA, 22 bp, Artificial Sequence
  chemically synthesized
tgcagcttggcttctgagtata

SEQ ID NO: 111537 - DNA, 22 bp, Artificial Sequence
  chemically synthesized
gcagcttggcttctgagtatag

SEQ ID NO: 111538 - DNA, 22 bp, Artificial Sequence
  chemically synthesized
cagcttggcttctgagtatagt

SEQ ID NO: 111539 - DNA, 22 bp, Artificial Sequence
  chemically synthesized
ggcttctgagtatagtctaaaa

SEQ ID NO: 111540 - DNA, 22 bp, Artificial Sequence
  chemically synthesized
gcttctgagtatagtctaaaaa

SEQ ID NO: 111541 - DNA, 22 bp, Artificial Sequence
  chemically synthesized
ctgagtatagtctaaaaagttg

SEQ ID NO: 111542 - DNA, 22 bp, Artificial Sequence
  chemically synthesized
tgagtatagtctaaaaagttgg

SEQ ID NO: 111543 - DNA, 22 bp, Artificial Sequence
  chemically synthesized
agtatagtctaaaaagttggtg

SEQ ID NO: 111544 - DNA, 22 bp, Artificial Sequence
  chemically synthesized
aaaagttggtgttggatccaat

SEQ ID NO: 111545 - DNA, 22 bp, Artificial Sequence
  chemically synthesized
gtgttggatccaatatcttgac

SEQ ID NO: 111546 - DNA, 22 bp, Artificial Sequence
  chemically synthesized
gatccaatatcttgaccaggct

SEQ ID NO: 111547 - DNA, 22 bp, Artificial Sequence
  chemically synthesized
gaccaggcttaggggttcatag

SEQ ID NO: 111548 - DNA, 22 bp, Artificial Sequence
  chemically synthesized
accaggcttaggggttcatagt

SEQ ID NO: 111549 - DNA, 22 bp, Artificial Sequence
  chemically synthesized
aggggttcatagtcacatctgt

SEQ ID NO: 111550 - DNA, 22 bp, Artificial Sequence
  chemically synthesized
ggggttcatagtcacatctgtg

SEQ ID NO: 111551 - DNA, 22 bp, Artificial Sequence
  chemically synthesized
atagtcacatctgtggcaacaa

SEQ ID NO: 111552 - DNA, 22 bp, Artificial Sequence
  chemically synthesized
tggcaacaatgaacagacttat

SEQ ID NO: 111553 - DNA, 22 bp, Artificial Sequence
  chemically synthesized
atgaacaggtcggtaaagaact

SEQ ID NO: 111554 - DNA, 22 bp, Artificial Sequence
  chemically synthesized
tgaacaggtcggtaaagaactc

SEQ ID NO: 111555 - DNA, 22 bp, Artificial Sequence
  chemically synthesized
cagtgtgtcttggcctagaggc

SEQ ID NO: 111556 - DNA, 22 bp, Artificial Sequence
  chemically synthesized
ggcctagaggctccgcatagga

SEQ ID NO: 111557 - DNA, 22 bp, Artificial Sequence
  chemically synthesized
gcctagaggctccgcataggaa

SEQ ID NO: 111558 - DNA, 22 bp, Artificial Sequence
  chemically synthesized
gaggctccgcataggaatgagc

SEQ ID NO: 111559 - DNA, 22 bp, Artificial Sequence
  chemically synthesized
cgcataggaatgagcagtagac

SEQ ID NO: 111560 - DNA, 22 bp, Artificial Sequence
  chemically synthesized
gcttatcagagattgcagagag

SEQ ID NO: 111561 - DNA, 22 bp, Artificial Sequence
  chemically synthesized
atcagagattgcagagagggaa

SEQ ID NO: 111562 - DNA, 22 bp, Artificial Sequence
  chemically synthesized
tcagagattgcagagagggaaa

SEQ ID NO: 111563 - DNA, 22 bp, Artificial Sequence
  chemically synthesized
cagagagggaaatgcagtaatg

SEQ ID NO: 111564 - DNA, 22 bp, Artificial Sequence
  chemically synthesized
tcatcccaaagactccctaaaa

SEQ ID NO: 111565 - DNA, 22 bp, Artificial Sequence
  chemically synthesized
cctaaaatctttagaacttggc

SEQ ID NO: 111566 - DNA, 22 bp, Artificial Sequence
  chemically synthesized
aaatctttagaacttggcttct

SEQ ID NO: 111567 - DNA, 22 bp, Artificial Sequence
  chemically synthesized
tagaacttggcttctgaataat

SEQ ID NO: 111568 - DNA, 22 bp, Artificial Sequence
  chemically synthesized
agaacttggcttctgaataatc

SEQ ID NO: 111569 - DNA, 22 bp, Artificial Sequence
  chemically synthesized
gaacttggcttctgaataatct

SEQ ID NO: 111570 - DNA, 22 bp, Artificial Sequence
  chemically synthesized
ggcttctgaataatctcttttg

SEQ ID NO: 111571 - DNA, 22 bp, Artificial Sequence
  chemically synthesized
gcttctgaataatctcttttgc

SEQ ID NO: 111572 - DNA, 22 bp, Artificial Sequence
  chemically synthesized
ctgaataatctcttttgcaaat

SEQ ID NO: 111573 - DNA, 22 bp, Artificial Sequence
  chemically synthesized
tgaataatctcttttgcaaatt

SEQ ID NO: 111574 - DNA, 22 bp, Artificial Sequence
  chemically synthesized
aataatctcttttgcaaattcc

SEQ ID NO: 111575 - DNA, 22 bp, Artificial Sequence
  chemically synthesized
ttttgcaaattcctagaagagg

SEQ ID NO: 111576 - DNA, 22 bp, Artificial Sequence
  chemically synthesized
ttgcaaattcctagaagaggga

SEQ ID NO: 111577 - DNA, 22 bp, Artificial Sequence
  chemically synthesized
tgcaaattcctagaagagggaa

SEQ ID NO: 111578 - DNA, 22 bp, Artificial Sequence
  chemically synthesized
gcaaattcctagaagagggaaa

SEQ ID NO: 111579 - DNA, 22 bp, Artificial Sequence
  chemically synthesized
caaattcctagaagagggaaaa

SEQ ID NO: 111580 - DNA, 22 bp, Artificial Sequence
  chemically synthesized
ctagaagagggaaaatcctaga

SEQ ID NO: 111581 - DNA, 22 bp, Artificial Sequence
  chemically synthesized
gaagagggaaaatcctagatct

SEQ ID NO: 111582 - DNA, 22 bp, Artificial Sequence
  chemically synthesized
gatctcctttttcattccctag

SEQ ID NO: 111583 - DNA, 22 bp, Artificial Sequence
  chemically synthesized
ctttttcattccctagcagagt

SEQ ID NO: 111584 - DNA, 22 bp, Artificial Sequence
  chemically synthesized
tttcattccctagcagagtgat

SEQ ID NO: 111585 - DNA, 22 bp, Artificial Sequence
  chemically synthesized
ttcattccctagcagagtgatc

SEQ ID NO: 111586 - DNA, 22 bp, Artificial Sequence
  chemically synthesized
tcattccctagcagagtgatct

SEQ ID NO: 111587 - DNA, 22 bp, Artificial Sequence
  chemically synthesized
cattccctagcagagtgatcta

SEQ ID NO: 111588 - DNA, 22 bp, Artificial Sequence
  chemically synthesized
attccctagcagagtgatctag

SEQ ID NO: 111589 - DNA, 22 bp, Artificial Sequence
  chemically synthesized
cctagcagagtgatctagttag

SEQ ID NO: 111590 - DNA, 22 bp, Artificial Sequence
  chemically synthesized
gcagagtgatctagttaggaaa

SEQ ID NO: 111591 - DNA, 22 bp, Artificial Sequence
  chemically synthesized
gttaggaaaaaatcaagttgaa

SEQ ID NO: 111592 - DNA, 22 bp, Artificial Sequence
  chemically synthesized
ggaaaaaatcaagttgaaaatc

SEQ ID NO: 111593 - DNA, 22 bp, Artificial Sequence
  chemically synthesized
aaaatccacgggaatacagaat

SEQ ID NO: 111594 - DNA, 22 bp, Artificial Sequence
  chemically synthesized
tggtgtagttccagactctggt

SEQ ID NO: 111595 - DNA, 22 bp, Artificial Sequence
  chemically synthesized
gtgtagttccagactctggttt

SEQ ID NO: 111596 - DNA, 22 bp, Artificial Sequence
  chemically synthesized
cagactctggtttggattatct

SEQ ID NO: 111597 - DNA, 22 bp, Artificial Sequence
  chemically synthesized
tggtttggattatctatttcct

SEQ ID NO: 111598 - DNA, 22 bp, Artificial Sequence
  chemically synthesized
gtttggattatctatttccttt

SEQ ID NO: 111599 - DNA, 22 bp, Artificial Sequence
  chemically synthesized
ggattatctatttcctttgttg

SEQ ID NO: 111600 - DNA, 22 bp, Artificial Sequence
  chemically synthesized
gattatctatttcctttgttgc

SEQ ID NO: 111601 - DNA, 22 bp, Artificial Sequence
  chemically synthesized
tctatttcctttgttgctctct

SEQ ID NO: 111602 - DNA, 22 bp, Artificial Sequence
  chemically synthesized
tttcctttgttgctctcttcgg

SEQ ID NO: 111603 - DNA, 22 bp, Artificial Sequence
  chemically synthesized
cctttgttgctctcttcgggct

SEQ ID NO: 111604 - DNA, 22 bp, Artificial Sequence
  chemically synthesized
ctttgttgctctcttcgggctg

SEQ ID NO: 111605 - DNA, 22 bp, Artificial Sequence
  chemically synthesized
tgttgctctcttcgggctgcat

SEQ ID NO: 111606 - DNA, 22 bp, Artificial Sequence
  chemically synthesized
gttgctctcttcgggctgcata

SEQ ID NO: 111607 - DNA, 22 bp, Artificial Sequence
  chemically synthesized
ttgctctcttcgggctgcataa

SEQ ID NO: 111608 - DNA, 22 bp, Artificial Sequence
  chemically synthesized
ctctcttcgggctgcataaacc

SEQ ID NO: 111609 - DNA, 22 bp, Artificial Sequence
  chemically synthesized
tcttcgggctgcataaaccagc

SEQ ID NO: 111610 - DNA, 22 bp, Artificial Sequence
  chemically synthesized
ttcgggctgcataaaccagctt

SEQ ID NO: 111611 - DNA, 22 bp, Artificial Sequence
  chemically synthesized
cgggctgcataaaccagcttcc

SEQ ID NO: 111612 - DNA, 22 bp, Artificial Sequence
  chemically synthesized
gggctgcataaaccagcttcct

SEQ ID NO: 111613 - DNA, 22 bp, Artificial Sequence
  chemically synthesized
cataaaccagcttcctctttgc

SEQ ID NO: 111614 - DNA, 22 bp, Artificial Sequence
  chemically synthesized
cctctttgcctctatgtgttct

SEQ ID NO: 111615 - DNA, 22 bp, Artificial Sequence
  chemically synthesized
ctctttgcctctatgtgttcta

SEQ ID NO: 111616 - DNA, 22 bp, Artificial Sequence
  chemically synthesized
tttgcctctatgtgttctacca

SEQ ID NO: 111617 - DNA, 22 bp, Artificial Sequence
  chemically synthesized
tgcctctatgtgttctaccaag

SEQ ID NO: 111618 - DNA, 22 bp, Artificial Sequence
  chemically synthesized
gcctctatgtgttctaccaagt

SEQ ID NO: 111619 - DNA, 22 bp, Artificial Sequence
  chemically synthesized
cctctatgtgttctaccaagta

SEQ ID NO: 111620 - DNA, 22 bp, Artificial Sequence
  chemically synthesized
tatgtgttctaccaagtactta

SEQ ID NO: 111621 - DNA, 22 bp, Artificial Sequence
  chemically synthesized
tgtgttctaccaagtacttact

SEQ ID NO: 111622 - DNA, 22 bp, Artificial Sequence
  chemically synthesized
taccaagtacttactcccaaaa

SEQ ID NO: 111623 - DNA, 22 bp, Artificial Sequence
  chemically synthesized
ccaagtacttactcccaaaaaa

SEQ ID NO: 111624 - DNA, 22 bp, Artificial Sequence
  chemically synthesized
actcccaaaaaagatgaagtta

SEQ ID NO: 111625 - DNA, 22 bp, Artificial Sequence
  chemically synthesized
ctcccaaaaaagatgaagttag

SEQ ID NO: 111626 - DNA, 22 bp, Artificial Sequence
  chemically synthesized
ccaaaaaagatgaagttagagt

SEQ ID NO: 111627 - DNA, 22 bp, Artificial Sequence
  chemically synthesized
gagtgaggataggggacactgt

SEQ ID NO: 111628 - DNA, 22 bp, Artificial Sequence
  chemically synthesized
taatgacaagggtatagactaa

SEQ ID NO: 111629 - DNA, 22 bp, Artificial Sequence
  chemically synthesized
acagaaagaaaaacttaccaaa

SEQ ID NO: 111630 - DNA, 22 bp, Artificial Sequence
  chemically synthesized
accaaatagattagtgtcagat

SEQ ID NO: 111631 - DNA, 22 bp, Artificial Sequence
  chemically synthesized
ccaaatagattagtgtcagatt

SEQ ID NO: 111632 - DNA, 22 bp, Artificial Sequence
  chemically synthesized
gtgtcagattgagtaaagcaaa

SEQ ID NO: 111633 - DNA, 22 bp, Artificial Sequence
  chemically synthesized
agtaaagcaaactttgacatga

SEQ ID NO: 111634 - DNA, 22 bp, Artificial Sequence
  chemically synthesized
tgacatgaggcacaatgcttta

SEQ ID NO: 111635 - DNA, 22 bp, Artificial Sequence
  chemically synthesized
gacatgaggcacaatgctttaa

SEQ ID NO: 111636 - DNA, 22 bp, Artificial Sequence
  chemically synthesized
acatgaggcacaatgctttaaa

SEQ ID NO: 111637 - DNA, 22 bp, Artificial Sequence
  chemically synthesized
taaattgctgcatattcccaga

SEQ ID NO: 111638 - DNA, 22 bp, Artificial Sequence
  chemically synthesized
aaattgctgcatattcccagaa

SEQ ID NO: 111639 - DNA, 22 bp, Artificial Sequence
  chemically synthesized
aattgctgcatattcccagaaa

SEQ ID NO: 111640 - DNA, 22 bp, Artificial Sequence
  chemically synthesized
ctgcatattcccagaaatgagc

SEQ ID NO: 111641 - DNA, 22 bp, Artificial Sequence
  chemically synthesized
catattcccagaaatgagccta

SEQ ID NO: 111642 - DNA, 22 bp, Artificial Sequence
  chemically synthesized
ccagaaatgagcctagtatcca

SEQ ID NO: 111643 - DNA, 22 bp, Artificial Sequence
  chemically synthesized
gtatccatcagaaaatgtatgc

SEQ ID NO: 111644 - DNA, 22 bp, Artificial Sequence
  chemically synthesized
ataaaccaaagtcagagagagc

SEQ ID NO: 111645 - DNA, 22 bp, Artificial Sequence
  chemically synthesized
taaaccaaagtcagagagagct

SEQ ID NO: 111646 - DNA, 22 bp, Artificial Sequence
  chemically synthesized
gttggttcacttcattccatgc

SEQ ID NO: 111647 - DNA, 22 bp, Artificial Sequence
  chemically synthesized
ttggttcacttcattccatgct

SEQ ID NO: 111648 - DNA, 22 bp, Artificial Sequence
  chemically synthesized
gttcacttcattccatgctgag

SEQ ID NO: 111649 - DNA, 22 bp, Artificial Sequence
  chemically synthesized
acttcattccatgctgagctat

SEQ ID NO: 111650 - DNA, 22 bp, Artificial Sequence
  chemically synthesized
cattccatgctgagctatcagc

SEQ ID NO: 111651 - DNA, 22 bp, Artificial Sequence
  chemically synthesized
attccatgctgagctatcagca

SEQ ID NO: 111652 - DNA, 22 bp, Artificial Sequence
  chemically synthesized
catgctgagctatcagcactgc

SEQ ID NO: 111653 - DNA, 22 bp, Artificial Sequence
  chemically synthesized
agctatcagcactgcagatttt

SEQ ID NO: 111654 - DNA, 22 bp, Artificial Sequence
  chemically synthesized
tcagcactgcagattttgaaga

SEQ ID NO: 111655 - DNA, 22 bp, Artificial Sequence
  chemically synthesized
cagattttgaagatctcaacca

SEQ ID NO: 111656 - DNA, 22 bp, Artificial Sequence
  chemically synthesized
tgaagatctcaaccacacccag

SEQ ID NO: 111657 - DNA, 22 bp, Artificial Sequence
  chemically synthesized
gaagatctcaaccacacccaga

SEQ ID NO: 111658 - DNA, 22 bp, Artificial Sequence
  chemically synthesized
aagatctcaaccacacccagat

SEQ ID NO: 111659 - DNA, 22 bp, Artificial Sequence
  chemically synthesized
aaccacacccagatagagagtg

SEQ ID NO: 111660 - DNA, 22 bp, Artificial Sequence
  chemically synthesized
ctgtcgggggatgggagtagat

SEQ ID NO: 111661 - DNA, 22 bp, Artificial Sequence
  chemically synthesized
tgtcgggggatgggagtagata

SEQ ID NO: 111662 - DNA, 22 bp, Artificial Sequence
  chemically synthesized
tcgggggatgggagtagataag

SEQ ID NO: 111663 - DNA, 22 bp, Artificial Sequence
  chemically synthesized
actatttttaccagcaggggaa

SEQ ID NO: 111664 - DNA, 22 bp, Artificial Sequence
  chemically synthesized
ctatttttaccagcaggggaaa

SEQ ID NO: 111665 - DNA, 22 bp, Artificial Sequence
  chemically synthesized
tttttaccagcaggggaaacta

SEQ ID NO: 111666 - DNA, 22 bp, Artificial Sequence
  chemically synthesized
ttaccagcaggggaaactaccc

SEQ ID NO: 111667 - DNA, 22 bp, Artificial Sequence
  chemically synthesized
taccagcaggggaaactaccca

SEQ ID NO: 111668 - DNA, 22 bp, Artificial Sequence
  chemically synthesized
accagcaggggaaactacccag

SEQ ID NO: 111669 - DNA, 22 bp, Artificial Sequence
  chemically synthesized
ccagcaggggaaactacccaga

SEQ ID NO: 111670 - DNA, 22 bp, Artificial Sequence
  chemically synthesized
cccagatgaaaatggtgctgga

SEQ ID NO: 111671 - DNA, 22 bp, Artificial Sequence
  chemically synthesized
gatgctttgggcaaaaagccat

SEQ ID NO: 111672 - DNA, 22 bp, Artificial Sequence
  chemically synthesized
tgggcaaaaagccattcagagc

SEQ ID NO: 111673 - DNA, 22 bp, Artificial Sequence
  chemically synthesized
gggcaaaaagccattcagagcc

SEQ ID NO: 111674 - DNA, 22 bp, Artificial Sequence
  chemically synthesized
ggcaaaaagccattcagagcca

SEQ ID NO: 111675 - DNA, 22 bp, Artificial Sequence
  chemically synthesized
agagccataatcaactacgaag

SEQ ID NO: 111676 - DNA, 22 bp, Artificial Sequence
  chemically synthesized
cgaagatggtcaggaatttagt

SEQ ID NO: 111677 - DNA, 22 bp, Artificial Sequence
  chemically synthesized
agtgtatttgtagatcagatga

SEQ ID NO: 111678 - DNA, 22 bp, Artificial Sequence
  chemically synthesized
gtgtatttgtagatcagatgat

SEQ ID NO: 111679 - DNA, 22 bp, Artificial Sequence
  chemically synthesized
gtagatcagatgatcagtctat

SEQ ID NO: 111680 - DNA, 22 bp, Artificial Sequence
  chemically synthesized
tagatcagatgatcagtctatg

SEQ ID NO: 111681 - DNA, 22 bp, Artificial Sequence
  chemically synthesized
tggctttggaaaattgtgaaca

SEQ ID NO: 111682 - DNA, 22 bp, Artificial Sequence
  chemically synthesized
tggaaaattgtgaacattagtt

SEQ ID NO: 111683 - DNA, 22 bp, Artificial Sequence
  chemically synthesized
ggaaaattgtgaacattagttg

SEQ ID NO: 111684 - DNA, 22 bp, Artificial Sequence
  chemically synthesized
gaaaattgtgaacattagttgt

SEQ ID NO: 111685 - DNA, 22 bp, Artificial Sequence
  chemically synthesized
tgaacattagttgttgagcctt

SEQ ID NO: 111686 - DNA, 22 bp, Artificial Sequence
  chemically synthesized
gttgttgagccttataatgaga

SEQ ID NO: 111687 - DNA, 22 bp, Artificial Sequence
  chemically synthesized
ttgagccttataatgagaatgt

SEQ ID NO: 111688 - DNA, 22 bp, Artificial Sequence
  chemically synthesized
agccttataatgagaatgtgat

SEQ ID NO: 111689 - DNA, 22 bp, Artificial Sequence
  chemically synthesized
ataatgagaatgtgatgattaa

SEQ ID NO: 111690 - DNA, 22 bp, Artificial Sequence
  chemically synthesized
taatgagaatgtgatgattaaa

SEQ ID NO: 111691 - DNA, 22 bp, Artificial Sequence
  chemically synthesized
aatcaggtctactggatactat

SEQ ID NO: 111692 - DNA, 22 bp, Artificial Sequence
  chemically synthesized
ctggatactatgaatcagaata

SEQ ID NO: 111693 - DNA, 22 bp, Artificial Sequence
  chemically synthesized
gatactatgaatcagaatagat

SEQ ID NO: 111694 - DNA, 22 bp, Artificial Sequence
  chemically synthesized
tgaatcagaatagataacattg

SEQ ID NO: 111695 - DNA, 22 bp, Artificial Sequence
  chemically synthesized
ttagatataattacctagtcag

SEQ ID NO: 111696 - DNA, 22 bp, Artificial Sequence
  chemically synthesized
gatataattacctagtcagaga

SEQ ID NO: 111697 - DNA, 22 bp, Artificial Sequence
  chemically synthesized
cctagtcagagagcagagatga

SEQ ID NO: 111698 - DNA, 22 bp, Artificial Sequence
  chemically synthesized
gtcagagagcagagatgaagtc

SEQ ID NO: 111699 - DNA, 22 bp, Artificial Sequence
  chemically synthesized
ctggtggcagagtggtggctta

SEQ ID NO: 111700 - DNA, 22 bp, Artificial Sequence
  chemically synthesized
tggtggcagagtggtggcttag

SEQ ID NO: 111701 - DNA, 22 bp, Artificial Sequence
  chemically synthesized
gtggcagagtggtggcttagcc

SEQ ID NO: 111702 - DNA, 22 bp, Artificial Sequence
  chemically synthesized
agcctgctggggcaaaatggag

SEQ ID NO: 111703 - DNA, 22 bp, Artificial Sequence
  chemically synthesized
gcctgctggggcaaaatggagc

SEQ ID NO: 111704 - DNA, 22 bp, Artificial Sequence
  chemically synthesized
ctggggcaaaatggagctcaag

SEQ ID NO: 111705 - DNA, 22 bp, Artificial Sequence
  chemically synthesized
gggcaaaatggagctcaaggcc

SEQ ID NO: 111706 - DNA, 22 bp, Artificial Sequence
  chemically synthesized
aaggccatgagcagatacaaca

SEQ ID NO: 111707 - DNA, 22 bp, Artificial Sequence
  chemically synthesized
tcttcccccatctgattgtaga

SEQ ID NO: 111708 - DNA, 22 bp, Artificial Sequence
  chemically synthesized
cccccatctgattgtagagctt

SEQ ID NO: 111709 - DNA, 22 bp, Artificial Sequence
  chemically synthesized
ccccatctgattgtagagcttt

SEQ ID NO: 111710 - DNA, 22 bp, Artificial Sequence
  chemically synthesized
attgtagagcttttggccatcg

SEQ ID NO: 111711 - DNA, 22 bp, Artificial Sequence
  chemically synthesized
tagagcttttggccatcgacat

SEQ ID NO: 111712 - DNA, 22 bp, Artificial Sequence
  chemically synthesized
ttggccatcgacatgttcttca

SEQ ID NO: 111713 - DNA, 22 bp, Artificial Sequence
  chemically synthesized
tggccatcgacatgttcttcac

SEQ ID NO: 111714 - DNA, 22 bp, Artificial Sequence
  chemically synthesized
ggccatcgacatgttcttcacc

SEQ ID NO: 111715 - DNA, 22 bp, Artificial Sequence
  chemically synthesized
gccatcgacatgttcttcacca

SEQ ID NO: 111716 - DNA, 22 bp, Artificial Sequence
  chemically synthesized
ttcaccacctggttctttgttt

SEQ ID NO: 111717 - DNA, 22 bp, Artificial Sequence
  chemically synthesized
caccacctggttctttgtttac

SEQ ID NO: 111718 - DNA, 22 bp, Artificial Sequence
  chemically synthesized
accacctggttctttgtttacg

SEQ ID NO: 111719 - DNA, 22 bp, Artificial Sequence
  chemically synthesized
gttctttgtttacgaggtcacc

SEQ ID NO: 111720 - DNA, 22 bp, Artificial Sequence
  chemically synthesized
tttgtttacgaggtcacctcta

SEQ ID NO: 111721 - DNA, 22 bp, Artificial Sequence
  chemically synthesized
tgtttacgaggtcacctctacc

SEQ ID NO: 111722 - DNA, 22 bp, Artificial Sequence
  chemically synthesized
gtttacgaggtcacctctacca

SEQ ID NO: 111723 - DNA, 22 bp, Artificial Sequence
  chemically synthesized
tttacgaggtcacctctaccaa

SEQ ID NO: 111724 - DNA, 22 bp, Artificial Sequence
  chemically synthesized
acgaggtcacctctaccaagta

SEQ ID NO: 111725 - DNA, 22 bp, Artificial Sequence
  chemically synthesized
cgaggtcacctctaccaagtac

SEQ ID NO: 111726 - DNA, 22 bp, Artificial Sequence
  chemically synthesized
taccaagtacacttgtgatatc

SEQ ID NO: 111727 - DNA, 22 bp, Artificial Sequence
  chemically synthesized
ccaagtacacttgtgatatcta

SEQ ID NO: 111728 - DNA, 22 bp, Artificial Sequence
  chemically synthesized
gtgatatctataaagagtatct

SEQ ID NO: 111729 - DNA, 22 bp, Artificial Sequence
  chemically synthesized
tgatatctataaagagtatctc

SEQ ID NO: 111730 - DNA, 22 bp, Artificial Sequence
  chemically synthesized
taaagagtatctccttggtggc

SEQ ID NO: 111731 - DNA, 22 bp, Artificial Sequence
  chemically synthesized
cttggtggcctcactcttcatg

SEQ ID NO: 111732 - DNA, 22 bp, Artificial Sequence
  chemically synthesized
ggtggcctcactcttcatgggc

SEQ ID NO: 111733 - DNA, 22 bp, Artificial Sequence
  chemically synthesized
gtggcctcactcttcatgggct

SEQ ID NO: 111734 - DNA, 22 bp, Artificial Sequence
  chemically synthesized
actcttcatgggctttgaagtc

SEQ ID NO: 111735 - DNA, 22 bp, Artificial Sequence
  chemically synthesized
ttcatgggctttgaagtcctct

SEQ ID NO: 111736 - DNA, 22 bp, Artificial Sequence
  chemically synthesized
catgggctttgaagtcctcttc

SEQ ID NO: 111737 - DNA, 22 bp, Artificial Sequence
  chemically synthesized
atgggctttgaagtcctcttcc

SEQ ID NO: 111738 - DNA, 22 bp, Artificial Sequence
  chemically synthesized
tgaagtcctcttcctgatgctc

SEQ ID NO: 111739 - DNA, 22 bp, Artificial Sequence
  chemically synthesized
gaagtcctcttcctgatgctct

SEQ ID NO: 111740 - DNA, 22 bp, Artificial Sequence
  chemically synthesized
aagtcctcttcctgatgctctg

SEQ ID NO: 111741 - DNA, 22 bp, Artificial Sequence
  chemically synthesized
ttcctgatgctctgggttggca

SEQ ID NO: 111742 - DNA, 22 bp, Artificial Sequence
  chemically synthesized
cctgatgctctgggttggcatc

SEQ ID NO: 111743 - DNA, 22 bp, Artificial Sequence
  chemically synthesized
ctgatgctctgggttggcatct

SEQ ID NO: 111744 - DNA, 22 bp, Artificial Sequence
  chemically synthesized
atgctctgggttggcatctaca

SEQ ID NO: 111745 - DNA, 22 bp, Artificial Sequence
  chemically synthesized
tgggttggcatctacatgtgag

SEQ ID NO: 111746 - DNA, 22 bp, Artificial Sequence
  chemically synthesized
ggttggcatctacatgtgagtg

SEQ ID NO: 111747 - DNA, 22 bp, Artificial Sequence
  chemically synthesized
gcatctacatgtgagtgcccaa

SEQ ID NO: 111748 - DNA, 22 bp, Artificial Sequence
  chemically synthesized
catgtgagtgcccaagagtaac

SEQ ID NO: 111749 - DNA, 22 bp, Artificial Sequence
  chemically synthesized
cactgaatccctgcttttgtaa

SEQ ID NO: 111750 - DNA, 22 bp, Artificial Sequence
  chemically synthesized
actgaatccctgcttttgtaaa

SEQ ID NO: 111751 - DNA, 22 bp, Artificial Sequence
  chemically synthesized
aatccctgcttttgtaaattaa

SEQ ID NO: 111752 - DNA, 22 bp, Artificial Sequence
  chemically synthesized
cttttgtaaattaagttttctt

SEQ ID NO: 111753 - DNA, 22 bp, Artificial Sequence
  chemically synthesized
ttgtaaattaagttttctttct

SEQ ID NO: 111754 - DNA, 22 bp, Artificial Sequence
  chemically synthesized
tgtaaattaagttttctttcta

SEQ ID NO: 111755 - DNA, 22 bp, Artificial Sequence
  chemically synthesized
gtaaattaagttttctttctat

SEQ ID NO: 111756 - DNA, 22 bp, Artificial Sequence
  chemically synthesized
taaattaagttttctttctatt

SEQ ID NO: 111757 - DNA, 22 bp, Artificial Sequence
  chemically synthesized
agttttctttctattgctggaa

SEQ ID NO: 111758 - DNA, 22 bp, Artificial Sequence
  chemically synthesized
tctttctattgctggaagtgtc

SEQ ID NO: 111759 - DNA, 22 bp, Artificial Sequence
  chemically synthesized
ctttctattgctggaagtgtcc

SEQ ID NO: 111760 - DNA, 22 bp, Artificial Sequence
  chemically synthesized
tttctattgctggaagtgtccc

SEQ ID NO: 111761 - DNA, 22 bp, Artificial Sequence
  chemically synthesized
tctattgctggaagtgtcccgc

SEQ ID NO: 111762 - DNA, 22 bp, Artificial Sequence
  chemically synthesized
ctattgctggaagtgtcccgcc

SEQ ID NO: 111763 - DNA, 22 bp, Artificial Sequence
  chemically synthesized
tattgctggaagtgtcccgcct

SEQ ID NO: 111764 - DNA, 22 bp, Artificial Sequence
  chemically synthesized
ttgctggaagtgtcccgcctgt

SEQ ID NO: 111765 - DNA, 22 bp, Artificial Sequence
  chemically synthesized
ctggaagtgtcccgcctgttgc

SEQ ID NO: 111766 - DNA, 22 bp, Artificial Sequence
  chemically synthesized
gaagtgtcccgcctgttgctta

SEQ ID NO: 111767 - DNA, 22 bp, Artificial Sequence
  chemically synthesized
ttgcttataataaatgcagatg

SEQ ID NO: 111768 - DNA, 22 bp, Artificial Sequence
  chemically synthesized
cttataataaatgcagatgtat

SEQ ID NO: 111769 - DNA, 22 bp, Artificial Sequence
  chemically synthesized
ataataaatgcagatgtatggc

SEQ ID NO: 111770 - DNA, 22 bp, Artificial Sequence
  chemically synthesized
taataaatgcagatgtatggca

SEQ ID NO: 111771 - DNA, 22 bp, Artificial Sequence
  chemically synthesized
aaaaaaaaaaagaaataataga

SEQ ID NO: 111772 - DNA, 22 bp, Artificial Sequence
  chemically synthesized
ggcagggattggggcatgaagg

SEQ ID NO: 111773 - DNA, 22 bp, Artificial Sequence
  chemically synthesized
gggcatgaaggttgaaaacaag

SEQ ID NO: 111774 - DNA, 22 bp, Artificial Sequence
  chemically synthesized
aaaacaaggaaaaggagcccaa

SEQ ID NO: 111775 - DNA, 22 bp, Artificial Sequence
  chemically synthesized
taaaatgtgctaagtagatgtc

SEQ ID NO: 111776 - DNA, 22 bp, Artificial Sequence
  chemically synthesized
agtagatgtctgagtggcattc

SEQ ID NO: 111777 - DNA, 22 bp, Artificial Sequence
  chemically synthesized
agtggcattcctccatgagaga

SEQ ID NO: 111778 - DNA, 22 bp, Artificial Sequence
  chemically synthesized
ctccatgagagaaagcttaagg

SEQ ID NO: 111779 - DNA, 22 bp, Artificial Sequence
  chemically synthesized
catgagagaaagcttaagggaa

SEQ ID NO: 111780 - DNA, 22 bp, Artificial Sequence
  chemically synthesized
aagggaagaaagagaccctgag

SEQ ID NO: 111781 - DNA, 22 bp, Artificial Sequence
  chemically synthesized
agggaagaaagagaccctgagt

SEQ ID NO: 111782 - DNA, 22 bp, Artificial Sequence
  chemically synthesized
agtgtcttcaaaactcaaagtt

SEQ ID NO: 111783 - DNA, 22 bp, Artificial Sequence
  chemically synthesized
caaaactcaaagttttacgaac

SEQ ID NO: 111784 - DNA, 22 bp, Artificial Sequence
  chemically synthesized
aaaactcaaagttttacgaaca

SEQ ID NO: 111785 - DNA, 22 bp, Artificial Sequence
  chemically synthesized
aaagttttacgaacagaatgat

SEQ ID NO: 111786 - DNA, 22 bp, Artificial Sequence
  chemically synthesized
tacgaacagaatgattagtctg

SEQ ID NO: 111787 - DNA, 22 bp, Artificial Sequence
  chemically synthesized
acgaacagaatgattagtctgg

SEQ ID NO: 111788 - DNA, 22 bp, Artificial Sequence
  chemically synthesized
cgaacagaatgattagtctgga

SEQ ID NO: 111789 - DNA, 22 bp, Artificial Sequence
  chemically synthesized
gtctggagaaatcatttttcat

SEQ ID NO: 111790 - DNA, 22 bp, Artificial Sequence
  chemically synthesized
gagaaatcatttttcatcaata

SEQ ID NO: 111791 - DNA, 22 bp, Artificial Sequence
  chemically synthesized
ttcatcaatacaggatctcaag

SEQ ID NO: 111792 - DNA, 22 bp, Artificial Sequence
  chemically synthesized
tcatcaatacaggatctcaagt

SEQ ID NO: 111793 - DNA, 22 bp, Artificial Sequence
  chemically synthesized
catcaatacaggatctcaagtg

SEQ ID NO: 111794 - DNA, 22 bp, Artificial Sequence
  chemically synthesized
atcaatacaggatctcaagtgt

SEQ ID NO: 111795 - DNA, 22 bp, Artificial Sequence
  chemically synthesized
aagtgtttccccacaacgaacc

SEQ ID NO: 111796 - DNA, 22 bp, Artificial Sequence
  chemically synthesized
ccccacaacgaacccaacccct

SEQ ID NO: 111797 - DNA, 22 bp, Artificial Sequence
  chemically synthesized
cccacaacgaacccaacccctc

SEQ ID NO: 111798 - DNA, 22 bp, Artificial Sequence
  chemically synthesized
acacacacacacacacacacac

SEQ ID NO: 111799 - DNA, 22 bp, Artificial Sequence
  chemically synthesized
ttcaagtcatgatgcagcagta

SEQ ID NO: 111800 - DNA, 22 bp, Artificial Sequence
  chemically synthesized
tcaagtcatgatgcagcagtat

SEQ ID NO: 111801 - DNA, 22 bp, Artificial Sequence
  chemically synthesized
caagtcatgatgcagcagtatt

SEQ ID NO: 111802 - DNA, 22 bp, Artificial Sequence
  chemically synthesized
aagtcatgatgcagcagtattg

SEQ ID NO: 111803 - DNA, 22 bp, Artificial Sequence
  chemically synthesized
gaattacagttttttttggttt

SEQ ID NO: 111804 - DNA, 22 bp, Artificial Sequence
  chemically synthesized
cagttttttttggtttttgttt

SEQ ID NO: 111805 - DNA, 22 bp, Artificial Sequence
  chemically synthesized
tttttggtttttgttttttttt

SEQ ID NO: 111806 - DNA, 22 bp, Artificial Sequence
  chemically synthesized
ttttggtttttgttttttttta

SEQ ID NO: 111807 - DNA, 22 bp, Artificial Sequence
  chemically synthesized
tttggtttttgtttttttttac

SEQ ID NO: 111808 - DNA, 22 bp, Artificial Sequence
  chemically synthesized
ttggtttttgtttttttttact

SEQ ID NO: 111809 - DNA, 22 bp, Artificial Sequence
  chemically synthesized
tggtttttgtttttttttactt

SEQ ID NO: 111810 - DNA, 22 bp, Artificial Sequence
  chemically synthesized
ggtttttgtttttttttacttc

SEQ ID NO: 111811 - DNA, 22 bp, Artificial Sequence
  chemically synthesized
gtttttgtttttttttacttca

SEQ ID NO: 111812 - DNA, 22 bp, Artificial Sequence
  chemically synthesized
ttgtttttttttacttcaagct

SEQ ID NO: 111813 - DNA, 22 bp, Artificial Sequence
  chemically synthesized
tgtttttttttacttcaagcta

SEQ ID NO: 111814 - DNA, 22 bp, Artificial Sequence
  chemically synthesized
gtttttttttacttcaagctat

SEQ ID NO: 111815 - DNA, 22 bp, Artificial Sequence
  chemically synthesized
tttttttttacttcaagctatg

SEQ ID NO: 111816 - DNA, 22 bp, Artificial Sequence
  chemically synthesized
ttttttacttcaagctatggtg

SEQ ID NO: 111817 - DNA, 22 bp, Artificial Sequence
  chemically synthesized
tttttacttcaagctatggtgt

SEQ ID NO: 111818 - DNA, 22 bp, Artificial Sequence
  chemically synthesized
ttttacttcaagctatggtgtt

SEQ ID NO: 111819 - DNA, 22 bp, Artificial Sequence
  chemically synthesized
tttacttcaagctatggtgttg

SEQ ID NO: 111820 - DNA, 22 bp, Artificial Sequence
  chemically synthesized
ttacttcaagctatggtgttga

SEQ ID NO: 111821 - DNA, 22 bp, Artificial Sequence
  chemically synthesized
tacttcaagctatggtgttgag

SEQ ID NO: 111822 - DNA, 22 bp, Artificial Sequence
  chemically synthesized
acttcaagctatggtgttgagt

SEQ ID NO: 111823 - DNA, 22 bp, Artificial Sequence
  chemically synthesized
cttcaagctatggtgttgagta

SEQ ID NO: 111824 - DNA, 22 bp, Artificial Sequence
  chemically synthesized
caagctatggtgttgagtacat

SEQ ID NO: 111825 - DNA, 22 bp, Artificial Sequence
  chemically synthesized
aagctatggtgttgagtacatg

SEQ ID NO: 111826 - DNA, 22 bp, Artificial Sequence
  chemically synthesized
tggtgttgagtacatgatccta

SEQ ID NO: 111827 - DNA, 22 bp, Artificial Sequence
  chemically synthesized
agtacatgatcctaatcaccaa

SEQ ID NO: 111828 - DNA, 22 bp, Artificial Sequence
  chemically synthesized
atcaccaattaattgttccttt

SEQ ID NO: 111829 - DNA, 22 bp, Artificial Sequence
  chemically synthesized
attgttcctttaagcccttaac

SEQ ID NO: 111830 - DNA, 22 bp, Artificial Sequence
  chemically synthesized
ttcctttaagcccttaacctct

SEQ ID NO: 111831 - DNA, 22 bp, Artificial Sequence
  chemically synthesized
ctttaagcccttaacctcttga

SEQ ID NO: 111832 - DNA, 22 bp, Artificial Sequence
  chemically synthesized
taagcccttaacctcttgacac

SEQ ID NO: 111833 - DNA, 22 bp, Artificial Sequence
  chemically synthesized
aagcccttaacctcttgacaca

SEQ ID NO: 111834 - DNA, 22 bp, Artificial Sequence
  chemically synthesized
agcccttaacctcttgacacac

SEQ ID NO: 111835 - DNA, 22 bp, Artificial Sequence
  chemically synthesized
aacctcttgacacacatacaca

SEQ ID NO: 111836 - DNA, 22 bp, Artificial Sequence
  chemically synthesized
acctcttgacacacatacacac

SEQ ID NO: 111837 - DNA, 22 bp, Artificial Sequence
  chemically synthesized
ttgacacacatacacacacact

SEQ ID NO: 111838 - DNA, 22 bp, Artificial Sequence
  chemically synthesized
gacacacatacacacacactct

SEQ ID NO: 111839 - DNA, 22 bp, Artificial Sequence
  chemically synthesized
acacacatacacacacactctc

SEQ ID NO: 111840 - DNA, 22 bp, Artificial Sequence
  chemically synthesized
tctctctcacacaaaagcgcca

SEQ ID NO: 111841 - DNA, 22 bp, Artificial Sequence
  chemically synthesized
tctctcacacaaaagcgccaca

SEQ ID NO: 111842 - DNA, 22 bp, Artificial Sequence
  chemically synthesized
tctcacacaaaagcgccacaca

SEQ ID NO: 111843 - DNA, 22 bp, Artificial Sequence
  chemically synthesized
tcacacaaaagcgccacacaca

SEQ ID NO: 111844 - DNA, 22 bp, Artificial Sequence
  chemically synthesized
acacaaaagcgccacacacaca

SEQ ID NO: 111845 - DNA, 22 bp, Artificial Sequence
  chemically synthesized
agctccatgaggtacactcact

SEQ ID NO: 111846 - DNA, 22 bp, Artificial Sequence
  chemically synthesized
catgaggtacactcactacttt

SEQ ID NO: 111847 - DNA, 22 bp, Artificial Sequence
  chemically synthesized
actacttttattaaaccaagca

SEQ ID NO: 111848 - DNA, 22 bp, Artificial Sequence
  chemically synthesized
cttttattaaaccaagcacaga

SEQ ID NO: 111849 - DNA, 22 bp, Artificial Sequence
  chemically synthesized
ttattaaaccaagcacagatac

SEQ ID NO: 111850 - DNA, 22 bp, Artificial Sequence
  chemically synthesized
tattaaaccaagcacagatacc

SEQ ID NO: 111851 - DNA, 22 bp, Artificial Sequence
  chemically synthesized
attaaaccaagcacagatacca

SEQ ID NO: 111852 - DNA, 22 bp, Artificial Sequence
  chemically synthesized
ttaaaccaagcacagataccaa

SEQ ID NO: 111853 - DNA, 22 bp, Artificial Sequence
  chemically synthesized
aaccaagcacagataccaagtt

SEQ ID NO: 111854 - DNA, 22 bp, Artificial Sequence
  chemically synthesized
ttgagtgtgaatgcagaaagaa

SEQ ID NO: 111855 - DNA, 22 bp, Artificial Sequence
  chemically synthesized
tgagtgtgaatgcagaaagaag

SEQ ID NO: 111856 - DNA, 22 bp, Artificial Sequence
  chemically synthesized
gagtgtgaatgcagaaagaaga

SEQ ID NO: 111857 - DNA, 22 bp, Artificial Sequence
  chemically synthesized
agtgtgaatgcagaaagaagat

SEQ ID NO: 111858 - DNA, 22 bp, Artificial Sequence
  chemically synthesized
aggtagatttttctcatagata

SEQ ID NO: 111859 - DNA, 22 bp, Artificial Sequence
  chemically synthesized
ttctcatagatactactaagat

SEQ ID NO: 111860 - DNA, 22 bp, Artificial Sequence
  chemically synthesized
tctcatagatactactaagatt

SEQ ID NO: 111861 - DNA, 22 bp, Artificial Sequence
  chemically synthesized
ctcatagatactactaagatta

SEQ ID NO: 111862 - DNA, 22 bp, Artificial Sequence
  chemically synthesized
tcatagatactactaagattat

SEQ ID NO: 111863 - DNA, 22 bp, Artificial Sequence
  chemically synthesized
atagatactactaagattatat

SEQ ID NO: 111864 - DNA, 22 bp, Artificial Sequence
  chemically synthesized
ctaagattatattgtctggaat

SEQ ID NO: 111865 - DNA, 22 bp, Artificial Sequence
  chemically synthesized
agattatattgtctggaatctt

SEQ ID NO: 111866 - DNA, 22 bp, Artificial Sequence
  chemically synthesized
tattgtctggaatcttatgtga

SEQ ID NO: 111867 - DNA, 22 bp, Artificial Sequence
  chemically synthesized
tctggaatcttatgtgacacag

SEQ ID NO: 111868 - DNA, 22 bp, Artificial Sequence
  chemically synthesized
gaatcttatgtgacacagaaaa

SEQ ID NO: 111869 - DNA, 22 bp, Artificial Sequence
  chemically synthesized
atgtgacacagaaaaagaacaa

SEQ ID NO: 111870 - DNA, 22 bp, Artificial Sequence
  chemically synthesized
tgtgacacagaaaaagaacaac

SEQ ID NO: 111871 - DNA, 22 bp, Artificial Sequence
  chemically synthesized
tgccatttggccatttgcttgt

SEQ ID NO: 111872 - DNA, 22 bp, Artificial Sequence
  chemically synthesized
ccatttggccatttgcttgtgt

SEQ ID NO: 111873 - DNA, 22 bp, Artificial Sequence
  chemically synthesized
ggccatttgcttgtgtttggac

SEQ ID NO: 111874 - DNA, 22 bp, Artificial Sequence
  chemically synthesized
gccatttgcttgtgtttggact

SEQ ID NO: 111875 - DNA, 22 bp, Artificial Sequence
  chemically synthesized
gcttgtgtttggacttgtgaag

SEQ ID NO: 111876 - DNA, 22 bp, Artificial Sequence
  chemically synthesized
cttgtgtttggacttgtgaagg

SEQ ID NO: 111877 - DNA, 22 bp, Artificial Sequence
  chemically synthesized
gtgtttggacttgtgaaggtct

SEQ ID NO: 111878 - DNA, 22 bp, Artificial Sequence
  chemically synthesized
tgtttggacttgtgaaggtctt

SEQ ID NO: 111879 - DNA, 22 bp, Artificial Sequence
  chemically synthesized
ggacttgtgaaggtctttccat

SEQ ID NO: 111880 - DNA, 22 bp, Artificial Sequence
  chemically synthesized
gacttgtgaaggtctttccatc

SEQ ID NO: 111881 - DNA, 22 bp, Artificial Sequence
  chemically synthesized
gtgaaggtctttccatcattct

SEQ ID NO: 111882 - DNA, 22 bp, Artificial Sequence
  chemically synthesized
tgaaggtctttccatcattctg

SEQ ID NO: 111883 - DNA, 22 bp, Artificial Sequence
  chemically synthesized
tccatcattctgttattggaaa

SEQ ID NO: 111884 - DNA, 22 bp, Artificial Sequence
  chemically synthesized
ccatcattctgttattggaaag

SEQ ID NO: 111885 - DNA, 22 bp, Artificial Sequence
  chemically synthesized
catcattctgttattggaaagc

SEQ ID NO: 111886 - DNA, 22 bp, Artificial Sequence
  chemically synthesized
tgttattggaaagcgggaaagt

SEQ ID NO: 111887 - DNA, 22 bp, Artificial Sequence
  chemically synthesized
ttattggaaagcgggaaagtag

SEQ ID NO: 111888 - DNA, 22 bp, Artificial Sequence
  chemically synthesized
ttggaaagcgggaaagtagcat

SEQ ID NO: 111889 - DNA, 22 bp, Artificial Sequence
  chemically synthesized
gaaagcgggaaagtagcatttt

SEQ ID NO: 111890 - DNA, 22 bp, Artificial Sequence
  chemically synthesized
tcatgaggattctattaaaaac

SEQ ID NO: 111891 - DNA, 22 bp, Artificial Sequence
  chemically synthesized
catgaggattctattaaaaact

SEQ ID NO: 111892 - DNA, 22 bp, Artificial Sequence
  chemically synthesized
atgaggattctattaaaaacta

SEQ ID NO: 111893 - DNA, 22 bp, Artificial Sequence
  chemically synthesized
tattaaaaactagggaccatat

SEQ ID NO: 111894 - DNA, 22 bp, Artificial Sequence
  chemically synthesized
ttaaaaactagggaccatatgc

SEQ ID NO: 111895 - DNA, 22 bp, Artificial Sequence
  chemically synthesized
aaaactagggaccatatgcaat

SEQ ID NO: 111896 - DNA, 22 bp, Artificial Sequence
  chemically synthesized
gggaccatatgcaatacatcca

SEQ ID NO: 111897 - DNA, 22 bp, Artificial Sequence
  chemically synthesized
tatttagtgtacaatagaaagc

SEQ ID NO: 111898 - DNA, 22 bp, Artificial Sequence
  chemically synthesized
agtgtacaatagaaagcaatta

SEQ ID NO: 111899 - DNA, 22 bp, Artificial Sequence
  chemically synthesized
gtgtacaatagaaagcaattac

SEQ ID NO: 111900 - DNA, 22 bp, Artificial Sequence
  chemically synthesized
ccatagcaattatgttccctag

SEQ ID NO: 111901 - DNA, 22 bp, Artificial Sequence
  chemically synthesized
tgttccctagctgtcttctctc

SEQ ID NO: 111902 - DNA, 22 bp, Artificial Sequence
  chemically synthesized
cctagctgtcttctctctttgc

SEQ ID NO: 111903 - DNA, 22 bp, Artificial Sequence
  chemically synthesized
gctgtcttctctctttgcaaac

SEQ ID NO: 111904 - DNA, 22 bp, Artificial Sequence
  chemically synthesized
tcttctctctttgcaaacccca

SEQ ID NO: 111905 - DNA, 22 bp, Artificial Sequence
  chemically synthesized
ctctctttgcaaaccccagccc

SEQ ID NO: 111906 - DNA, 22 bp, Artificial Sequence
  chemically synthesized
tctctttgcaaaccccagcccc

SEQ ID NO: 111907 - DNA, 22 bp, Artificial Sequence
  chemically synthesized
tctttgcaaaccccagccccca

SEQ ID NO: 111908 - DNA, 22 bp, Artificial Sequence
  chemically synthesized
tttgcaaaccccagcccccact

SEQ ID NO: 111909 - DNA, 22 bp, Artificial Sequence
  chemically synthesized
tgcaaaccccagcccccactca

SEQ ID NO: 111910 - DNA, 22 bp, Artificial Sequence
  chemically synthesized
gcaaaccccagcccccactcag

SEQ ID NO: 111911 - DNA, 22 bp, Artificial Sequence
  chemically synthesized
caaaccccagcccccactcagc

SEQ ID NO: 111912 - DNA, 22 bp, Artificial Sequence
  chemically synthesized
agcatgacatggcaggtataaa

SEQ ID NO: 111913 - DNA, 22 bp, Artificial Sequence
  chemically synthesized
agacccatttctgtaaaggagg

SEQ ID NO: 111914 - DNA, 22 bp, Artificial Sequence
  chemically synthesized
ctgtaaaggaggagaagcttgt

SEQ ID NO: 111915 - DNA, 22 bp, Artificial Sequence
  chemically synthesized
tgtaaaggaggagaagcttgtg

SEQ ID NO: 111916 - DNA, 22 bp, Artificial Sequence
  chemically synthesized
taaaggaggagaagcttgtgtt

SEQ ID NO: 111917 - DNA, 22 bp, Artificial Sequence
  chemically synthesized
gtgttaggaatggaagaatgcc

SEQ ID NO: 111918 - DNA, 22 bp, Artificial Sequence
  chemically synthesized
tgttaggaatggaagaatgcct

SEQ ID NO: 111919 - DNA, 22 bp, Artificial Sequence
  chemically synthesized
ggaatggaagaatgcctgggct

SEQ ID NO: 111920 - DNA, 22 bp, Artificial Sequence
  chemically synthesized
ggctggagaacagggcttcaca

SEQ ID NO: 111921 - DNA, 22 bp, Artificial Sequence
  chemically synthesized
gagaacagggcttcacaacagt

SEQ ID NO: 111922 - DNA, 22 bp, Artificial Sequence
  chemically synthesized
cacaacagtgtagtgatagatt

SEQ ID NO: 111923 - DNA, 22 bp, Artificial Sequence
  chemically synthesized
acaacagtgtagtgatagattc

SEQ ID NO: 111924 - DNA, 22 bp, Artificial Sequence
  chemically synthesized
acccacatattatgtgatgtgg

SEQ ID NO: 111925 - DNA, 22 bp, Artificial Sequence
  chemically synthesized
tgtgatgtggacctctgagcca

SEQ ID NO: 111926 - DNA, 22 bp, Artificial Sequence
  chemically synthesized
tgagccaggtactatctcattc

SEQ ID NO: 111927 - DNA, 22 bp, Artificial Sequence
  chemically synthesized
agccaggtactatctcattctc

SEQ ID NO: 111928 - DNA, 22 bp, Artificial Sequence
  chemically synthesized
tctcattctccatggttgcaat

SEQ ID NO: 111929 - DNA, 22 bp, Artificial Sequence
  chemically synthesized
attctccatggttgcaataagg

SEQ ID NO: 111930 - DNA, 22 bp, Artificial Sequence
  chemically synthesized
tccatggttgcaataaggtcga

SEQ ID NO: 111931 - DNA, 22 bp, Artificial Sequence
  chemically synthesized
catggttgcaataaggtcgatt

SEQ ID NO: 111932 - DNA, 22 bp, Artificial Sequence
  chemically synthesized
caataaggtcgattatagattc

SEQ ID NO: 111933 - DNA, 22 bp, Artificial Sequence
  chemically synthesized
tagattcaataaaggaagaggt

SEQ ID NO: 111934 - DNA, 22 bp, Artificial Sequence
  chemically synthesized
aataaaggaagaggtatctcaa

SEQ ID NO: 111935 - DNA, 22 bp, Artificial Sequence
  chemically synthesized
aacactaaagaaagagtaaaat

SEQ ID NO: 111936 - DNA, 22 bp, Artificial Sequence
  chemically synthesized
aagaaagagtaaaattttcagg

SEQ ID NO: 111937 - DNA, 22 bp, Artificial Sequence
  chemically synthesized
tcagggttcaacaagcgaccac

SEQ ID NO: 111938 - DNA, 22 bp, Artificial Sequence
  chemically synthesized
cagggttcaacaagcgaccacc

SEQ ID NO: 111939 - DNA, 22 bp, Artificial Sequence
  chemically synthesized
agggttcaacaagcgaccacct

SEQ ID NO: 111940 - DNA, 22 bp, Artificial Sequence
  chemically synthesized
aacaagcgaccacctaagggca

SEQ ID NO: 111941 - DNA, 22 bp, Artificial Sequence
  chemically synthesized
agggcaaaatattttcctaaat

SEQ ID NO: 111942 - DNA, 22 bp, Artificial Sequence
  chemically synthesized
tcctaaattttgacaaacttta

SEQ ID NO: 111943 - DNA, 22 bp, Artificial Sequence
  chemically synthesized
cctaaattttgacaaactttaa

SEQ ID NO: 111944 - DNA, 22 bp, Artificial Sequence
  chemically synthesized
ctaaattttgacaaactttaag

SEQ ID NO: 111945 - DNA, 22 bp, Artificial Sequence
  chemically synthesized
aattttgacaaactttaagttc

SEQ ID NO: 111946 - DNA, 22 bp, Artificial Sequence
  chemically synthesized
tgacaaactttaagttcaaaaa

SEQ ID NO: 111947 - DNA, 22 bp, Artificial Sequence
  chemically synthesized
gacaaactttaagttcaaaaag

SEQ ID NO: 111948 - DNA, 22 bp, Artificial Sequence
  chemically synthesized
acaaactttaagttcaaaaagc

SEQ ID NO: 111949 - DNA, 22 bp, Artificial Sequence
  chemically synthesized
taagttcaaaaagctcatctag

SEQ ID NO: 111950 - DNA, 22 bp, Artificial Sequence
  chemically synthesized
aagttcaaaaagctcatctagc

SEQ ID NO: 111951 - DNA, 22 bp, Artificial Sequence
  chemically synthesized
agttcaaaaagctcatctagct

SEQ ID NO: 111952 - DNA, 22 bp, Artificial Sequence
  chemically synthesized
aaaaagctcatctagctatgac

SEQ ID NO: 111953 - DNA, 22 bp, Artificial Sequence
  chemically synthesized
atctagctatgacaaagtttga

SEQ ID NO: 111954 - DNA, 22 bp, Artificial Sequence
  chemically synthesized
gctatgacaaagtttgacatag

SEQ ID NO: 111955 - DNA, 22 bp, Artificial Sequence
  chemically synthesized
tgacaaagtttgacatagttag

SEQ ID NO: 111956 - DNA, 22 bp, Artificial Sequence
  chemically synthesized
gacatagttagatgagcttttg

SEQ ID NO: 111957 - DNA, 22 bp, Artificial Sequence
  chemically synthesized
acatagttagatgagcttttga

SEQ ID NO: 111958 - DNA, 22 bp, Artificial Sequence
  chemically synthesized
gatgagcttttgatctgtgcac

SEQ ID NO: 111959 - DNA, 22 bp, Artificial Sequence
  chemically synthesized
ttgatctgtgcactttccctcg

SEQ ID NO: 111960 - DNA, 22 bp, Artificial Sequence
  chemically synthesized
tgatctgtgcactttccctcga

SEQ ID NO: 111961 - DNA, 22 bp, Artificial Sequence
  chemically synthesized
gatctgtgcactttccctcgac

SEQ ID NO: 111962 - DNA, 22 bp, Artificial Sequence
  chemically synthesized
atctgtgcactttccctcgacc

SEQ ID NO: 111963 - DNA, 22 bp, Artificial Sequence
  chemically synthesized
tgcactttccctcgaccttgac

SEQ ID NO: 111964 - DNA, 22 bp, Artificial Sequence
  chemically synthesized
tccctcgaccttgaccaccaat

SEQ ID NO: 111965 - DNA, 22 bp, Artificial Sequence
  chemically synthesized
ccctcgaccttgaccaccaatc

SEQ ID NO: 111966 - DNA, 22 bp, Artificial Sequence
  chemically synthesized
cctcgaccttgaccaccaatct

SEQ ID NO: 111967 - DNA, 22 bp, Artificial Sequence
  chemically synthesized
gaccttgaccaccaatcttgac

SEQ ID NO: 111968 - DNA, 22 bp, Artificial Sequence
  chemically synthesized
gaccaccaatcttgacttcaca

SEQ ID NO: 111969 - DNA, 22 bp, Artificial Sequence
  chemically synthesized
accaccaatcttgacttcacaa

SEQ ID NO: 111970 - DNA, 22 bp, Artificial Sequence
  chemically synthesized
gacttcacaaaaccattggaat

SEQ ID NO: 111971 - DNA, 22 bp, Artificial Sequence
  chemically synthesized
acttcacaaaaccattggaatt

SEQ ID NO: 111972 - DNA, 22 bp, Artificial Sequence
  chemically synthesized
cacaaaaccattggaatttggg

SEQ ID NO: 111973 - DNA, 22 bp, Artificial Sequence
  chemically synthesized
acaaaaccattggaatttgggg

SEQ ID NO: 111974 - DNA, 22 bp, Artificial Sequence
  chemically synthesized
gaatttggggtgatatggaggc

SEQ ID NO: 111975 - DNA, 22 bp, Artificial Sequence
  chemically synthesized
ggggtgatatggaggcaagcca

SEQ ID NO: 111976 - DNA, 22 bp, Artificial Sequence
  chemically synthesized
gggtgatatggaggcaagccaa

SEQ ID NO: 111977 - DNA, 22 bp, Artificial Sequence
  chemically synthesized
tgatgcagtttaggagctatgt

SEQ ID NO: 111978 - DNA, 22 bp, Artificial Sequence
  chemically synthesized
aggagctatgtgatgtgtcatt

SEQ ID NO: 111979 - DNA, 22 bp, Artificial Sequence
  chemically synthesized
ggagctatgtgatgtgtcattt

SEQ ID NO: 111980 - DNA, 22 bp, Artificial Sequence
  chemically synthesized
tgtgatgtgtcatttctgtgac

SEQ ID NO: 111981 - DNA, 22 bp, Artificial Sequence
  chemically synthesized
ctgtgacaggatatgagagctg

SEQ ID NO: 111982 - DNA, 22 bp, Artificial Sequence
  chemically synthesized
tgtgacaggatatgagagctgc

SEQ ID NO: 111983 - DNA, 22 bp, Artificial Sequence
  chemically synthesized
tgacaggatatgagagctgcac

SEQ ID NO: 111984 - DNA, 22 bp, Artificial Sequence
  chemically synthesized
cacatctttctgtttagaaatt

SEQ ID NO: 111985 - DNA, 22 bp, Artificial Sequence
  chemically synthesized
tctgtttagaaattcctgccat

SEQ ID NO: 111986 - DNA, 22 bp, Artificial Sequence
  chemically synthesized
ctgtttagaaattcctgccata

SEQ ID NO: 111987 - DNA, 22 bp, Artificial Sequence
  chemically synthesized
tgtttagaaattcctgccatat

SEQ ID NO: 111988 - DNA, 22 bp, Artificial Sequence
  chemically synthesized
tttagaaattcctgccatattt

SEQ ID NO: 111989 - DNA, 22 bp, Artificial Sequence
  chemically synthesized
agaaattcctgccatatttgta

SEQ ID NO: 111990 - DNA, 22 bp, Artificial Sequence
  chemically synthesized
gaaattcctgccatatttgtaa

SEQ ID NO: 111991 - DNA, 22 bp, Artificial Sequence
  chemically synthesized
ctgccatatttgtaattctcaa

SEQ ID NO: 111992 - DNA, 22 bp, Artificial Sequence
  chemically synthesized
ccatatttgtaattctcaatgg

SEQ ID NO: 111993 - DNA, 22 bp, Artificial Sequence
  chemically synthesized
gtaattctcaatggtcagtctc

SEQ ID NO: 111994 - DNA, 22 bp, Artificial Sequence
  chemically synthesized
taattctcaatggtcagtctcc

SEQ ID NO: 111995 - DNA, 22 bp, Artificial Sequence
  chemically synthesized
tcaatggtcagtctccttgctg

SEQ ID NO: 111996 - DNA, 22 bp, Artificial Sequence
  chemically synthesized
aatggtcagtctccttgctgga

SEQ ID NO: 111997 - DNA, 22 bp, Artificial Sequence
  chemically synthesized
cttgctggactataaattcaac

SEQ ID NO: 111998 - DNA, 22 bp, Artificial Sequence
  chemically synthesized
gctggactataaattcaactac

SEQ ID NO: 111999 - DNA, 22 bp, Artificial Sequence
  chemically synthesized
ctggactataaattcaactaca

SEQ ID NO: 112000 - DNA, 22 bp, Artificial Sequence
  chemically synthesized
gactataaattcaactacatgc

SEQ ID NO: 112001 - DNA, 22 bp, Artificial Sequence
  chemically synthesized
taaattcaactacatgccagct

SEQ ID NO: 112002 - DNA, 22 bp, Artificial Sequence
  chemically synthesized
aactacatgccagctttaagca

SEQ ID NO: 112003 - DNA, 22 bp, Artificial Sequence
  chemically synthesized
catgccagctttaagcacagtg

SEQ ID NO: 112004 - DNA, 22 bp, Artificial Sequence
  chemically synthesized
taagcacagtgctttgaagaga

SEQ ID NO: 112005 - DNA, 22 bp, Artificial Sequence
  chemically synthesized
aagcacagtgctttgaagagag

SEQ ID NO: 112006 - DNA, 22 bp, Artificial Sequence
  chemically synthesized
agcacagtgctttgaagagagt

SEQ ID NO: 112007 - DNA, 22 bp, Artificial Sequence
  chemically synthesized
tgaagagagtaggagcttaaaa

SEQ ID NO: 112008 - DNA, 22 bp, Artificial Sequence
  chemically synthesized
gaagagagtaggagcttaaaaa

SEQ ID NO: 112009 - DNA, 22 bp, Artificial Sequence
  chemically synthesized
aagagagtaggagcttaaaaaa

SEQ ID NO: 112010 - DNA, 22 bp, Artificial Sequence
  chemically synthesized
aaaaaatattctgtattaaatg

SEQ ID NO: 112011 - DNA, 22 bp, Artificial Sequence
  chemically synthesized
aaaaatattctgtattaaatga

SEQ ID NO: 112012 - DNA, 22 bp, Artificial Sequence
  chemically synthesized
tgtattaaatgaaaaaataaac

SEQ ID NO: 112013 - DNA, 22 bp, Artificial Sequence
  chemically synthesized
tattaaatgaaaaaataaacta

SEQ ID NO: 112014 - DNA, 22 bp, Artificial Sequence
  chemically synthesized
aatgaaaaaataaactaagcgt

SEQ ID NO: 112015 - DNA, 22 bp, Artificial Sequence
  chemically synthesized
agcgtgagaggtatttatgtgt

SEQ ID NO: 112016 - DNA, 22 bp, Artificial Sequence
  chemically synthesized
atgtgtctctctcttcctcttc

SEQ ID NO: 112017 - DNA, 22 bp, Artificial Sequence
  chemically synthesized
tgtgtctctctcttcctcttct

SEQ ID NO: 112018 - DNA, 22 bp, Artificial Sequence
  chemically synthesized
tctcttcctcttctcactccat

SEQ ID NO: 112019 - DNA, 22 bp, Artificial Sequence
  chemically synthesized
tcttcctcttctcactccatcc

SEQ ID NO: 112020 - DNA, 22 bp, Artificial Sequence
  chemically synthesized
ttcctcttctcactccatcctc

SEQ ID NO: 112021 - DNA, 22 bp, Artificial Sequence
  chemically synthesized
cctcttctcactccatcctcat

SEQ ID NO: 112022 - DNA, 22 bp, Artificial Sequence
  chemically synthesized
ctcttctcactccatcctcatg

SEQ ID NO: 112023 - DNA, 22 bp, Artificial Sequence
  chemically synthesized
ttctcactccatcctcatgtgc

SEQ ID NO: 112024 - DNA, 22 bp, Artificial Sequence
  chemically synthesized
ctcactccatcctcatgtgcat

SEQ ID NO: 112025 - DNA, 22 bp, Artificial Sequence
  chemically synthesized
tcactccatcctcatgtgcatc

SEQ ID NO: 112026 - DNA, 22 bp, Artificial Sequence
  chemically synthesized
actccatcctcatgtgcatctc

SEQ ID NO: 112027 - DNA, 22 bp, Artificial Sequence
  chemically synthesized
catcctcatgtgcatctctgaa

SEQ ID NO: 112028 - DNA, 22 bp, Artificial Sequence
  chemically synthesized
atgtgcatctctgaatatctct

SEQ ID NO: 112029 - DNA, 22 bp, Artificial Sequence
  chemically synthesized
tgaatatctctgattttgtgca

SEQ ID NO: 112030 - DNA, 22 bp, Artificial Sequence
  chemically synthesized
aatatctctgattttgtgcact

SEQ ID NO: 112031 - DNA, 22 bp, Artificial Sequence
  chemically synthesized
tgattttgtgcactctaaggca

SEQ ID NO: 112032 - DNA, 22 bp, Artificial Sequence
  chemically synthesized
attttgtgcactctaaggcagc

SEQ ID NO: 112033 - DNA, 22 bp, Artificial Sequence
  chemically synthesized
tgtgcactctaaggcagccctc

SEQ ID NO: 112034 - DNA, 22 bp, Artificial Sequence
  chemically synthesized
gtgcactctaaggcagccctct

SEQ ID NO: 112035 - DNA, 22 bp, Artificial Sequence
  chemically synthesized
tgcactctaaggcagccctcta

SEQ ID NO: 112036 - DNA, 22 bp, Artificial Sequence
  chemically synthesized
taaggcagccctctaagctgtt

SEQ ID NO: 112037 - DNA, 22 bp, Artificial Sequence
  chemically synthesized
aggcagccctctaagctgtttg

SEQ ID NO: 112038 - DNA, 22 bp, Artificial Sequence
  chemically synthesized
taagctgtttgcccatccagca

SEQ ID NO: 112039 - DNA, 22 bp, Artificial Sequence
  chemically synthesized
agctgtttgcccatccagcata

SEQ ID NO: 112040 - DNA, 22 bp, Artificial Sequence
  chemically synthesized
tttgcccatccagcatatgaca

SEQ ID NO: 112041 - DNA, 22 bp, Artificial Sequence
  chemically synthesized
gcccatccagcatatgacagaa

SEQ ID NO: 112042 - DNA, 22 bp, Artificial Sequence
  chemically synthesized
cccatccagcatatgacagaag

SEQ ID NO: 112043 - DNA, 22 bp, Artificial Sequence
  chemically synthesized
ttcaaagtgaatgatcaaagtc

SEQ ID NO: 112044 - DNA, 22 bp, Artificial Sequence
  chemically synthesized
caaagtgaatgatcaaagtccc

SEQ ID NO: 112045 - DNA, 22 bp, Artificial Sequence
  chemically synthesized
aaagtgaatgatcaaagtccct

SEQ ID NO: 112046 - DNA, 22 bp, Artificial Sequence
  chemically synthesized
gtttacagggtccccccaccct

SEQ ID NO: 112047 - DNA, 22 bp, Artificial Sequence
  chemically synthesized
tttacagggtccccccaccctc

SEQ ID NO: 112048 - DNA, 22 bp, Artificial Sequence
  chemically synthesized
acagggtccccccaccctcttc

SEQ ID NO: 112049 - DNA, 22 bp, Artificial Sequence
  chemically synthesized
cagggtccccccaccctcttcc

SEQ ID NO: 112050 - DNA, 22 bp, Artificial Sequence
  chemically synthesized
ttccttcctgagcatgtgttct

SEQ ID NO: 112051 - DNA, 22 bp, Artificial Sequence
  chemically synthesized
ccttcctgagcatgtgttctgg

SEQ ID NO: 112052 - DNA, 22 bp, Artificial Sequence
  chemically synthesized
cttcctgagcatgtgttctgga

SEQ ID NO: 112053 - DNA, 22 bp, Artificial Sequence
  chemically synthesized
cctgagcatgtgttctggatat

SEQ ID NO: 112054 - DNA, 22 bp, Artificial Sequence
  chemically synthesized
ctgagcatgtgttctggatatg

SEQ ID NO: 112055 - DNA, 22 bp, Artificial Sequence
  chemically synthesized
agcatgtgttctggatatgctg

SEQ ID NO: 112056 - DNA, 22 bp, Artificial Sequence
  chemically synthesized
tggatatgctgaagccaacctc

SEQ ID NO: 112057 - DNA, 22 bp, Artificial Sequence
  chemically synthesized
gatatgctgaagccaacctcac

SEQ ID NO: 112058 - DNA, 22 bp, Artificial Sequence
  chemically synthesized
aagccaacctcacaggactttg

SEQ ID NO: 112059 - DNA, 22 bp, Artificial Sequence
  chemically synthesized
acaggactttgttacctttcct

SEQ ID NO: 112060 - DNA, 22 bp, Artificial Sequence
  chemically synthesized
tgttacctttcctaagtttcta

SEQ ID NO: 112061 - DNA, 22 bp, Artificial Sequence
  chemically synthesized
gttacctttcctaagtttctat

SEQ ID NO: 112062 - DNA, 22 bp, Artificial Sequence
  chemically synthesized
ttacctttcctaagtttctatt

SEQ ID NO: 112063 - DNA, 22 bp, Artificial Sequence
  chemically synthesized
cctttcctaagtttctattggt

SEQ ID NO: 112064 - DNA, 22 bp, Artificial Sequence
  chemically synthesized
tcctaagtttctattggtgaat

SEQ ID NO: 112065 - DNA, 22 bp, Artificial Sequence
  chemically synthesized
cctaagtttctattggtgaatt

SEQ ID NO: 112066 - DNA, 22 bp, Artificial Sequence
  chemically synthesized
ctaagtttctattggtgaattt

SEQ ID NO: 112067 - DNA, 22 bp, Artificial Sequence
  chemically synthesized
agtttctattggtgaatttcca

SEQ ID NO: 112068 - DNA, 22 bp, Artificial Sequence
  chemically synthesized
ctattggtgaatttccatttaa

SEQ ID NO: 112069 - DNA, 22 bp, Artificial Sequence
  chemically synthesized
tattggtgaatttccatttaat

SEQ ID NO: 112070 - DNA, 22 bp, Artificial Sequence
  chemically synthesized
ttggtgaatttccatttaatat

SEQ ID NO: 112071 - DNA, 22 bp, Artificial Sequence
  chemically synthesized
gtgaatttccatttaatatagt

SEQ ID NO: 112072 - DNA, 22 bp, Artificial Sequence
  chemically synthesized
ccatttaatatagttttattaa

SEQ ID NO: 112073 - DNA, 22 bp, Artificial Sequence
  chemically synthesized
catttaatatagttttattaaa

SEQ ID NO: 112074 - DNA, 22 bp, Artificial Sequence
  chemically synthesized
aatatagttttattaaatgatt

SEQ ID NO: 112075 - DNA, 22 bp, Artificial Sequence
  chemically synthesized
atatagttttattaaatgattt

SEQ ID NO: 112076 - DNA, 22 bp, Artificial Sequence
  chemically synthesized
tattaaatgattttagtaaata

SEQ ID NO: 112077 - DNA, 22 bp, Artificial Sequence
  chemically synthesized
attaaatgattttagtaaataa

SEQ ID NO: 112078 - DNA, 22 bp, Artificial Sequence
  chemically synthesized
ttaaatgattttagtaaataat

SEQ ID NO: 112079 - DNA, 22 bp, Artificial Sequence
  chemically synthesized
aatgattttagtaaataatttt

SEQ ID NO: 112080 - DNA, 22 bp, Artificial Sequence
  chemically synthesized
tagtaaataatttttaatcatt

SEQ ID NO: 112081 - DNA, 22 bp, Artificial Sequence
  chemically synthesized
agtaaataatttttaatcattg

SEQ ID NO: 112082 - DNA, 22 bp, Artificial Sequence
  chemically synthesized
gtaaataatttttaatcattgt

SEQ ID NO: 112083 - DNA, 22 bp, Artificial Sequence
  chemically synthesized
ttaatcattgtagcttctatgg

SEQ ID NO: 112084 - DNA, 22 bp, Artificial Sequence
  chemically synthesized
taatcattgtagcttctatggt

SEQ ID NO: 112085 - DNA, 22 bp, Artificial Sequence
  chemically synthesized
aatcattgtagcttctatggtg

SEQ ID NO: 112086 - DNA, 22 bp, Artificial Sequence
  chemically synthesized
atcattgtagcttctatggtgg

SEQ ID NO: 112087 - DNA, 22 bp, Artificial Sequence
  chemically synthesized
tagcttctatggtggatacaca

SEQ ID NO: 112088 - DNA, 22 bp, Artificial Sequence
  chemically synthesized
ctatggtggatacacaaggaga

SEQ ID NO: 112089 - DNA, 22 bp, Artificial Sequence
  chemically synthesized
tatggtggatacacaaggagaa

SEQ ID NO: 112090 - DNA, 22 bp, Artificial Sequence
  chemically synthesized
tggtggatacacaaggagaagc

SEQ ID NO: 112091 - DNA, 22 bp, Artificial Sequence
  chemically synthesized
caaggggatttctcaagtaact

SEQ ID NO: 112092 - DNA, 22 bp, Artificial Sequence
  chemically synthesized
ctcaagtaactgcttcttcttg

SEQ ID NO: 112093 - DNA, 22 bp, Artificial Sequence
  chemically synthesized
tcaagtaactgcttcttcttgt

SEQ ID NO: 112094 - DNA, 22 bp, Artificial Sequence
  chemically synthesized
aagtaactgcttcttcttgtca

SEQ ID NO: 112095 - DNA, 22 bp, Artificial Sequence
  chemically synthesized
cttcttcttgtcattcttgtca

SEQ ID NO: 112096 - DNA, 22 bp, Artificial Sequence
  chemically synthesized
cttcttgtcattcttgtcacag

SEQ ID NO: 112097 - DNA, 22 bp, Artificial Sequence
  chemically synthesized
ttcttgtcattcttgtcacagc

SEQ ID NO: 112098 - DNA, 22 bp, Artificial Sequence
  chemically synthesized
cttgtcattcttgtcacagcaa

SEQ ID NO: 112099 - DNA, 22 bp, Artificial Sequence
  chemically synthesized
ttgtcattcttgtcacagcaat

SEQ ID NO: 112100 - DNA, 22 bp, Artificial Sequence
  chemically synthesized
gtcattcttgtcacagcaatga

SEQ ID NO: 112101 - DNA, 22 bp, Artificial Sequence
  chemically synthesized
tcattcttgtcacagcaatgaa

SEQ ID NO: 112102 - DNA, 22 bp, Artificial Sequence
  chemically synthesized
ttgtcacagcaatgaatcttgg

SEQ ID NO: 112103 - DNA, 22 bp, Artificial Sequence
  chemically synthesized
gtcacagcaatgaatcttgggc

SEQ ID NO: 112104 - DNA, 22 bp, Artificial Sequence
  chemically synthesized
tcacagcaatgaatcttgggca

SEQ ID NO: 112105 - DNA, 22 bp, Artificial Sequence
  chemically synthesized
gggcaaataagggacactcaat

SEQ ID NO: 112106 - DNA, 22 bp, Artificial Sequence
  chemically synthesized
ggcaaataagggacactcaata

SEQ ID NO: 112107 - DNA, 22 bp, Artificial Sequence
  chemically synthesized
aataaaaccaaatgtgtcaata

SEQ ID NO: 112108 - DNA, 22 bp, Artificial Sequence
  chemically synthesized
gtaataaccttgaattcaagtg

SEQ ID NO: 112109 - DNA, 22 bp, Artificial Sequence
  chemically synthesized
taataaccttgaattcaagtgg

SEQ ID NO: 112110 - DNA, 22 bp, Artificial Sequence
  chemically synthesized
gaattcaagtggtagcttatca

SEQ ID NO: 112111 - DNA, 22 bp, Artificial Sequence
  chemically synthesized
aattcaagtggtagcttatcac

SEQ ID NO: 112112 - DNA, 22 bp, Artificial Sequence
  chemically synthesized
aagtggtagcttatcacaactg

SEQ ID NO: 112113 - DNA, 22 bp, Artificial Sequence
  chemically synthesized
atcacaactgctaaataacttt

SEQ ID NO: 112114 - DNA, 22 bp, Artificial Sequence
  chemically synthesized
tcacaactgctaaataactttt

SEQ ID NO: 112115 - DNA, 22 bp, Artificial Sequence
  chemically synthesized
ctaaataacttttcttctttgt

SEQ ID NO: 112116 - DNA, 22 bp, Artificial Sequence
  chemically synthesized
aataacttttcttctttgtctg

SEQ ID NO: 112117 - DNA, 22 bp, Artificial Sequence
  chemically synthesized
ttcttctttgtctggtgagttc

SEQ ID NO: 112118 - DNA, 22 bp, Artificial Sequence
  chemically synthesized
tcttctttgtctggtgagttct

SEQ ID NO: 112119 - DNA, 22 bp, Artificial Sequence
  chemically synthesized
cttctttgtctggtgagttctg

SEQ ID NO: 112120 - DNA, 22 bp, Artificial Sequence
  chemically synthesized
ttctttgtctggtgagttctgt

SEQ ID NO: 112121 - DNA, 22 bp, Artificial Sequence
  chemically synthesized
ctttgtctggtgagttctgtag

SEQ ID NO: 112122 - DNA, 22 bp, Artificial Sequence
  chemically synthesized
tttgtctggtgagttctgtaga

SEQ ID NO: 112123 - DNA, 22 bp, Artificial Sequence
  chemically synthesized
tgtctggtgagttctgtagaca

SEQ ID NO: 112124 - DNA, 22 bp, Artificial Sequence
  chemically synthesized
gtctggtgagttctgtagacat

SEQ ID NO: 112125 - DNA, 22 bp, Artificial Sequence
  chemically synthesized
tctggtgagttctgtagacatt

SEQ ID NO: 112126 - DNA, 22 bp, Artificial Sequence
  chemically synthesized
gtgagttctgtagacatttaga

SEQ ID NO: 112127 - DNA, 22 bp, Artificial Sequence
  chemically synthesized
tgtagacatttagagtgtaggg

SEQ ID NO: 112128 - DNA, 22 bp, Artificial Sequence
  chemically synthesized
tagacatttagagtgtagggct

SEQ ID NO: 112129 - DNA, 22 bp, Artificial Sequence
  chemically synthesized
agagtgtagggctggcaactgt

SEQ ID NO: 112130 - DNA, 22 bp, Artificial Sequence
  chemically synthesized
gagtgtagggctggcaactgtg

SEQ ID NO: 112131 - DNA, 22 bp, Artificial Sequence
  chemically synthesized
gcaactgtgtttaaaataagtt

SEQ ID NO: 112132 - DNA, 22 bp, Artificial Sequence
  chemically synthesized
tgtttaaaataagttgtctatt

SEQ ID NO: 112133 - DNA, 22 bp, Artificial Sequence
  chemically synthesized
aaaataagttgtctattatatc

SEQ ID NO: 112134 - DNA, 22 bp, Artificial Sequence
  chemically synthesized
aaataagttgtctattatatca

SEQ ID NO: 112135 - DNA, 22 bp, Artificial Sequence
  chemically synthesized
tctattatatcaggactccatg

SEQ ID NO: 112136 - DNA, 22 bp, Artificial Sequence
  chemically synthesized
ttatatcaggactccatggaaa

SEQ ID NO: 112137 - DNA, 22 bp, Artificial Sequence
  chemically synthesized
tatcaggactccatggaaacat

SEQ ID NO: 112138 - DNA, 22 bp, Artificial Sequence
  chemically synthesized
catggaaacatctagtgaacca

SEQ ID NO: 112139 - DNA, 22 bp, Artificial Sequence
  chemically synthesized
gtgaaccagaagggctggtggt

SEQ ID NO: 112140 - DNA, 22 bp, Artificial Sequence
  chemically synthesized
gtggtgagaacagtgttattag

SEQ ID NO: 112141 - DNA, 22 bp, Artificial Sequence
  chemically synthesized
ttagaataccactggtgtttgc

SEQ ID NO: 112142 - DNA, 22 bp, Artificial Sequence
  chemically synthesized
gaataccactggtgtttgccag

SEQ ID NO: 112143 - DNA, 22 bp, Artificial Sequence
  chemically synthesized
gtgtttgccagctgtggaaaac

SEQ ID NO: 112144 - DNA, 22 bp, Artificial Sequence
  chemically synthesized
gccagctgtggaaaacatgggt

SEQ ID NO: 112145 - DNA, 22 bp, Artificial Sequence
  chemically synthesized
ccagctgtggaaaacatgggta

SEQ ID NO: 112146 - DNA, 22 bp, Artificial Sequence
  chemically synthesized
tggaaaacatgggtatagagca

SEQ ID NO: 112147 - DNA, 22 bp, Artificial Sequence
  chemically synthesized
atgccaaaggcaaaccaatgca

SEQ ID NO: 112148 - DNA, 22 bp, Artificial Sequence
  chemically synthesized
gtcccggcatggcaacaagtaa

SEQ ID NO: 112149 - DNA, 22 bp, Artificial Sequence
  chemically synthesized
tagaaatcgctgtggagagatg

SEQ ID NO: 112150 - DNA, 22 bp, Artificial Sequence
  chemically synthesized
tggagagatgcatttagatgaa

SEQ ID NO: 112151 - DNA, 22 bp, Artificial Sequence
  chemically synthesized
agatgaaaaggtaacccaattc

SEQ ID NO: 112152 - DNA, 22 bp, Artificial Sequence
  chemically synthesized
gatgaaaaggtaacccaattct

SEQ ID NO: 112153 - DNA, 22 bp, Artificial Sequence
  chemically synthesized
tggtctgccagtcagcaaccat

SEQ ID NO: 112154 - DNA, 22 bp, Artificial Sequence
  chemically synthesized
gtctgccagtcagcaaccattt

SEQ ID NO: 112155 - DNA, 22 bp, Artificial Sequence
  chemically synthesized
ccagtcagcaaccattttcctg

SEQ ID NO: 112156 - DNA, 22 bp, Artificial Sequence
  chemically synthesized
tcctgtctatgcacaggatagg

SEQ ID NO: 112157 - DNA, 22 bp, Artificial Sequence
  chemically synthesized
cctgtctatgcacaggatagga

SEQ ID NO: 112158 - DNA, 22 bp, Artificial Sequence
  chemically synthesized
ctgtctatgcacaggataggat

SEQ ID NO: 112159 - DNA, 22 bp, Artificial Sequence
  chemically synthesized
tctatgcacaggataggatatg

SEQ ID NO: 112160 - DNA, 22 bp, Artificial Sequence
  chemically synthesized
tgcacaggataggatatggctg

SEQ ID NO: 112161 - DNA, 22 bp, Artificial Sequence
  chemically synthesized
tactacctcgaagttttttcac

SEQ ID NO: 112162 - DNA, 22 bp, Artificial Sequence
  chemically synthesized
cctcgaagttttttcacaaagc

SEQ ID NO: 112163 - DNA, 22 bp, Artificial Sequence
  chemically synthesized
gaagttttttcacaaagcatat

SEQ ID NO: 112164 - DNA, 22 bp, Artificial Sequence
  chemically synthesized
tttcacaaagcatattgataca

SEQ ID NO: 112165 - DNA, 22 bp, Artificial Sequence
  chemically synthesized
ttcacaaagcatattgatacac

SEQ ID NO: 112166 - DNA, 22 bp, Artificial Sequence
  chemically synthesized
tcacaaagcatattgatacaca

SEQ ID NO: 112167 - DNA, 22 bp, Artificial Sequence
  chemically synthesized
cacaaagcatattgatacacaa

SEQ ID NO: 112168 - DNA, 22 bp, Artificial Sequence
  chemically synthesized
acaaagcatattgatacacaaa

SEQ ID NO: 112169 - DNA, 22 bp, Artificial Sequence
  chemically synthesized
atacacaaaaacattatcgaga

SEQ ID NO: 112170 - DNA, 22 bp, Artificial Sequence
  chemically synthesized
tcgagatgcacatgacatcggt

SEQ ID NO: 112171 - DNA, 22 bp, Artificial Sequence
  chemically synthesized
gccatgacagggctcttggtgt

SEQ ID NO: 112172 - DNA, 22 bp, Artificial Sequence
  chemically synthesized
ccatgacagggctcttggtgtg

SEQ ID NO: 112173 - DNA, 22 bp, Artificial Sequence
  chemically synthesized
ttggtgtgaatctgactactgt

SEQ ID NO: 112174 - DNA, 22 bp, Artificial Sequence
  chemically synthesized
ggtgtgaatctgactactgtct

SEQ ID NO: 112175 - DNA, 22 bp, Artificial Sequence
  chemically synthesized
gtgtgaatctgactactgtctt

SEQ ID NO: 112176 - DNA, 22 bp, Artificial Sequence
  chemically synthesized
actactgtcttaacacacctcc

SEQ ID NO: 112177 - DNA, 22 bp, Artificial Sequence
  chemically synthesized
ctgtcttaacacacctccaaat

SEQ ID NO: 112178 - DNA, 22 bp, Artificial Sequence
  chemically synthesized
tcttaacacacctccaaatgtg

SEQ ID NO: 112179 - DNA, 22 bp, Artificial Sequence
  chemically synthesized
aacacacctccaaatgtgttga

SEQ ID NO: 112180 - DNA, 22 bp, Artificial Sequence
  chemically synthesized
acacacctccaaatgtgttgag

SEQ ID NO: 112181 - DNA, 22 bp, Artificial Sequence
  chemically synthesized
caaatgtgttgaggccctaatg

SEQ ID NO: 112182 - DNA, 22 bp, Artificial Sequence
  chemically synthesized
aggccctaatgagaaacatccc

SEQ ID NO: 112183 - DNA, 22 bp, Artificial Sequence
  chemically synthesized
atgagaaacatccctgatttta

SEQ ID NO: 112184 - DNA, 22 bp, Artificial Sequence
  chemically synthesized
attttattcaacccaaactgat

SEQ ID NO: 112185 - DNA, 22 bp, Artificial Sequence
  chemically synthesized
tattcaacccaaactgatacat

SEQ ID NO: 112186 - DNA, 22 bp, Artificial Sequence
  chemically synthesized
attcaacccaaactgatacatt

SEQ ID NO: 112187 - DNA, 22 bp, Artificial Sequence
  chemically synthesized
ttcaacccaaactgatacattt

SEQ ID NO: 112188 - DNA, 22 bp, Artificial Sequence
  chemically synthesized
aacccaaactgatacatttaaa

SEQ ID NO: 112189 - DNA, 22 bp, Artificial Sequence
  chemically synthesized
atacatttaaattgtcctgtaa

SEQ ID NO: 112190 - DNA, 22 bp, Artificial Sequence
  chemically synthesized
aaattgtcctgtaattatttaa

SEQ ID NO: 112191 - DNA, 22 bp, Artificial Sequence
  chemically synthesized
aattgtcctgtaattatttaaa

SEQ ID NO: 112192 - DNA, 22 bp, Artificial Sequence
  chemically synthesized
tcctgtaattatttaaaaaata

SEQ ID NO: 112193 - DNA, 22 bp, Artificial Sequence
  chemically synthesized
taattatttaaaaaatagatat

SEQ ID NO: 112194 - DNA, 22 bp, Artificial Sequence
  chemically synthesized
tttaaaaaatagatataagctt

SEQ ID NO: 112195 - DNA, 22 bp, Artificial Sequence
  chemically synthesized
aaaaaatagatataagcttttg

SEQ ID NO: 112196 - DNA, 22 bp, Artificial Sequence
  chemically synthesized
aaaaatagatataagcttttga

SEQ ID NO: 112197 - DNA, 22 bp, Artificial Sequence
  chemically synthesized
ttgagggcagatattataatcc

SEQ ID NO: 112198 - DNA, 22 bp, Artificial Sequence
  chemically synthesized
tgagggcagatattataatcca

SEQ ID NO: 112199 - DNA, 22 bp, Artificial Sequence
  chemically synthesized
gagggcagatattataatccag

SEQ ID NO: 112200 - DNA, 22 bp, Artificial Sequence
  chemically synthesized
agggcagatattataatccagg

SEQ ID NO: 112201 - DNA, 22 bp, Artificial Sequence
  chemically synthesized
taatccaggcatcacctccatt

SEQ ID NO: 112202 - DNA, 22 bp, Artificial Sequence
  chemically synthesized
cattacccacattgtctagcac

SEQ ID NO: 112203 - DNA, 22 bp, Artificial Sequence
  chemically synthesized
cccacattgtctagcacattat

SEQ ID NO: 112204 - DNA, 22 bp, Artificial Sequence
  chemically synthesized
tctagcacattatagatgctta

SEQ ID NO: 112205 - DNA, 22 bp, Artificial Sequence
  chemically synthesized
gcacattatagatgcttagtat

SEQ ID NO: 112206 - DNA, 22 bp, Artificial Sequence
  chemically synthesized
tagatgcttagtatgtgctggc

SEQ ID NO: 112207 - DNA, 22 bp, Artificial Sequence
  chemically synthesized
agtatgtgctggcttgatgaca

SEQ ID NO: 112208 - DNA, 22 bp, Artificial Sequence
  chemically synthesized
gtatgtgctggcttgatgacag

SEQ ID NO: 112209 - DNA, 22 bp, Artificial Sequence
  chemically synthesized
gcttgatgacaggatgaagttt

SEQ ID NO: 112210 - DNA, 22 bp, Artificial Sequence
  chemically synthesized
gatgacaggatgaagtttaagt

SEQ ID NO: 112211 - DNA, 22 bp, Artificial Sequence
  chemically synthesized
atgacaggatgaagtttaagtt

SEQ ID NO: 112212 - DNA, 22 bp, Artificial Sequence
  chemically synthesized
aagttgctaaccattcttagag

SEQ ID NO: 112213 - DNA, 22 bp, Artificial Sequence
  chemically synthesized
agttgctaaccattcttagagg

SEQ ID NO: 112214 - DNA, 22 bp, Artificial Sequence
  chemically synthesized
ctaaccattcttagaggaactc

SEQ ID NO: 112215 - DNA, 22 bp, Artificial Sequence
  chemically synthesized
accattcttagaggaactctgc

SEQ ID NO: 112216 - DNA, 22 bp, Artificial Sequence
  chemically synthesized
ttagaggaactctgcttacctc

SEQ ID NO: 112217 - DNA, 22 bp, Artificial Sequence
  chemically synthesized
agaggaactctgcttacctctt

SEQ ID NO: 112218 - DNA, 22 bp, Artificial Sequence
  chemically synthesized
gaggaactctgcttacctcttg

SEQ ID NO: 112219 - DNA, 22 bp, Artificial Sequence
  chemically synthesized
tgcttacctcttgggttctgaa

SEQ ID NO: 112220 - DNA, 22 bp, Artificial Sequence
  chemically synthesized
cttacctcttgggttctgaagg

SEQ ID NO: 112221 - DNA, 22 bp, Artificial Sequence
  chemically synthesized
acctcttgggttctgaagggtc

SEQ ID NO: 112222 - DNA, 22 bp, Artificial Sequence
  chemically synthesized
cctcttgggttctgaagggtct

SEQ ID NO: 112223 - DNA, 22 bp, Artificial Sequence
  chemically synthesized
ttgggttctgaagggtctgact

SEQ ID NO: 112224 - DNA, 22 bp, Artificial Sequence
  chemically synthesized
gggttctgaagggtctgactga

SEQ ID NO: 112225 - DNA, 22 bp, Artificial Sequence
  chemically synthesized
ggttctgaagggtctgactgac

SEQ ID NO: 112226 - DNA, 22 bp, Artificial Sequence
  chemically synthesized
tgaagggtctgactgaccagag

SEQ ID NO: 112227 - DNA, 22 bp, Artificial Sequence
  chemically synthesized
aagggtctgactgaccagagag

SEQ ID NO: 112228 - DNA, 22 bp, Artificial Sequence
  chemically synthesized
actgaccagagaggcatgaagg

SEQ ID NO: 112229 - DNA, 22 bp, Artificial Sequence
  chemically synthesized
accagagaggcatgaagggggc

SEQ ID NO: 112230 - DNA, 22 bp, Artificial Sequence
  chemically synthesized
agcatgatcaccagcactgaga

SEQ ID NO: 112231 - DNA, 22 bp, Artificial Sequence
  chemically synthesized
agaaccacacaaactgaagaac

SEQ ID NO: 112232 - DNA, 22 bp, Artificial Sequence
  chemically synthesized
aagaactgctaggtgctggcta

SEQ ID NO: 112233 - DNA, 22 bp, Artificial Sequence
  chemically synthesized
ctaggtgctggctagtgggaga

SEQ ID NO: 112234 - DNA, 22 bp, Artificial Sequence
  chemically synthesized
ggtgctggctagtgggagactt

SEQ ID NO: 112235 - DNA, 22 bp, Artificial Sequence
  chemically synthesized
gctagtgggagacttaagacca

SEQ ID NO: 112236 - DNA, 22 bp, Artificial Sequence
  chemically synthesized
gtgggagacttaagaccaacca

SEQ ID NO: 112237 - DNA, 22 bp, Artificial Sequence
  chemically synthesized
aagaccaaccaaccaccctatg

SEQ ID NO: 112238 - DNA, 22 bp, Artificial Sequence
  chemically synthesized
agaccaaccaaccaccctatgg

SEQ ID NO: 112239 - DNA, 22 bp, Artificial Sequence
  chemically synthesized
tggagcagccaggtaatcagca

SEQ ID NO: 112240 - DNA, 22 bp, Artificial Sequence
  chemically synthesized
gggggctgttaatggaagagtt

SEQ ID NO: 112241 - DNA, 22 bp, Artificial Sequence
  chemically synthesized
ggggctgttaatggaagagttg

SEQ ID NO: 112242 - DNA, 22 bp, Artificial Sequence
  chemically synthesized
ttaatggaagagttgctgaggg

SEQ ID NO: 112243 - DNA, 22 bp, Artificial Sequence
  chemically synthesized
atggaagagttgctgaggggta

SEQ ID NO: 112244 - DNA, 22 bp, Artificial Sequence
  chemically synthesized
ctgaggggtatgcttacttgtc

SEQ ID NO: 112245 - DNA, 22 bp, Artificial Sequence
  chemically synthesized
aggggtatgcttacttgtccag

SEQ ID NO: 112246 - DNA, 22 bp, Artificial Sequence
  chemically synthesized
acttgtccagttgtgtgtgact

SEQ ID NO: 112247 - DNA, 22 bp, Artificial Sequence
  chemically synthesized
cttgtccagttgtgtgtgactt

SEQ ID NO: 112248 - DNA, 22 bp, Artificial Sequence
  chemically synthesized
gtccagttgtgtgtgacttaga

SEQ ID NO: 112249 - DNA, 22 bp, Artificial Sequence
  chemically synthesized
tccagttgtgtgtgacttagag

SEQ ID NO: 112250 - DNA, 22 bp, Artificial Sequence
  chemically synthesized
tgtgtgacttagaggtgaaccc

SEQ ID NO: 112251 - DNA, 22 bp, Artificial Sequence
  chemically synthesized
agaggtgaacccagtgggcaaa

SEQ ID NO: 112252 - DNA, 22 bp, Artificial Sequence
  chemically synthesized
gaggtgaacccagtgggcaaaa

SEQ ID NO: 112253 - DNA, 22 bp, Artificial Sequence
  chemically synthesized
aagtaggaagttaaggatgagg

SEQ ID NO: 112254 - DNA, 22 bp, Artificial Sequence
  chemically synthesized
agtaggaagttaaggatgaggg

SEQ ID NO: 112255 - DNA, 22 bp, Artificial Sequence
  chemically synthesized
aggatgagggaaacaggaagga

SEQ ID NO: 112256 - DNA, 22 bp, Artificial Sequence
  chemically synthesized
aaaaggagctcaagggaaggtt

SEQ ID NO: 112257 - DNA, 22 bp, Artificial Sequence
  chemically synthesized
aagggaaggttcctctgtgggt

SEQ ID NO: 112258 - DNA, 22 bp, Artificial Sequence
  chemically synthesized
ctctgtgggtagcctgttaaag

SEQ ID NO: 112259 - DNA, 22 bp, Artificial Sequence
  chemically synthesized
tgtgggtagcctgttaaagaaa

SEQ ID NO: 112260 - DNA, 22 bp, Artificial Sequence
  chemically synthesized
tgggtagcctgttaaagaaaag

SEQ ID NO: 112261 - DNA, 22 bp, Artificial Sequence
  chemically synthesized
ttaaagaaaaggctacattaca

SEQ ID NO: 112262 - DNA, 22 bp, Artificial Sequence
  chemically synthesized
aagaaaaggctacattacagac

SEQ ID NO: 112263 - DNA, 22 bp, Artificial Sequence
  chemically synthesized
cattacagactcatgcctgtaa

SEQ ID NO: 112264 - DNA, 22 bp, Artificial Sequence
  chemically synthesized
cagactcatgcctgtaatccca

SEQ ID NO: 112265 - DNA, 22 bp, Artificial Sequence
  chemically synthesized
atgcctgtaatcccagcacttt

SEQ ID NO: 112266 - DNA, 22 bp, Artificial Sequence
  chemically synthesized
taatcccagcactttgggtggc

SEQ ID NO: 112267 - DNA, 22 bp, Artificial Sequence
  chemically synthesized
tgggtggctgaggcaggaggat

SEQ ID NO: 112268 - DNA, 22 bp, Artificial Sequence
  chemically synthesized
gggtggctgaggcaggaggatc

SEQ ID NO: 112269 - DNA, 22 bp, Artificial Sequence
  chemically synthesized
ggtggctgaggcaggaggatca

SEQ ID NO: 112270 - DNA, 22 bp, Artificial Sequence
  chemically synthesized
aggcaggaggatcacctgaggg

SEQ ID NO: 112271 - DNA, 22 bp, Artificial Sequence
  chemically synthesized
agggcaagagttcgagaccagc

SEQ ID NO: 112272 - DNA, 22 bp, Artificial Sequence
  chemically synthesized
gagaccagcctgaccaacatgg

SEQ ID NO: 112273 - DNA, 22 bp, Artificial Sequence
  chemically synthesized
accaacatggtgaaaccctgtc

SEQ ID NO: 112274 - DNA, 22 bp, Artificial Sequence
  chemically synthesized
tctctaataaaaatacaaaaaa

SEQ ID NO: 112275 - DNA, 22 bp, Artificial Sequence
  chemically synthesized
taataaaaatacaaaaaaatta

SEQ ID NO: 112276 - DNA, 22 bp, Artificial Sequence
  chemically synthesized
ataaaaatacaaaaaaattagc

SEQ ID NO: 112277 - DNA, 22 bp, Artificial Sequence
  chemically synthesized
gcagggcctggtggcagatgcc

SEQ ID NO: 112278 - DNA, 22 bp, Artificial Sequence
  chemically synthesized
gtggcagatgcctgtaattgca

SEQ ID NO: 112279 - DNA, 22 bp, Artificial Sequence
  chemically synthesized
taattgcagctacacaggaggc

SEQ ID NO: 112280 - DNA, 22 bp, Artificial Sequence
  chemically synthesized
cagctacacaggaggctgaggt

SEQ ID NO: 112281 - DNA, 22 bp, Artificial Sequence
  chemically synthesized
cacaggaggctgaggtaggaga

SEQ ID NO: 112282 - DNA, 22 bp, Artificial Sequence
  chemically synthesized
aggtaggagaatcgcttgaacc

SEQ ID NO: 112283 - DNA, 22 bp, Artificial Sequence
  chemically synthesized
gaacctgggaggcggaggttgc

SEQ ID NO: 112284 - DNA, 22 bp, Artificial Sequence
  chemically synthesized
aacctgggaggcggaggttgca

SEQ ID NO: 112285 - DNA, 22 bp, Artificial Sequence
  chemically synthesized
ggaggcggaggttgcagtgagc

SEQ ID NO: 112286 - DNA, 22 bp, Artificial Sequence
  chemically synthesized
cagtgagccgagatcgcgccat

SEQ ID NO: 112287 - DNA, 22 bp, Artificial Sequence
  chemically synthesized
cactccagcagcctggaaggca

SEQ ID NO: 112288 - DNA, 22 bp, Artificial Sequence
  chemically synthesized
cagcagcctggaaggcaaaagc

SEQ ID NO: 112289 - DNA, 22 bp, Artificial Sequence
  chemically synthesized
gaaggcaaaagcaagatgagaa

SEQ ID NO: 112290 - DNA, 22 bp, Artificial Sequence
  chemically synthesized
acttgagattcaaagtctttag

SEQ ID NO: 112291 - DNA, 22 bp, Artificial Sequence
  chemically synthesized
gagattcaaagtctttagaata

SEQ ID NO: 112292 - DNA, 22 bp, Artificial Sequence
  chemically synthesized
agattcaaagtctttagaataa

SEQ ID NO: 112293 - DNA, 22 bp, Artificial Sequence
  chemically synthesized
aaagtctttagaataaaaatta

SEQ ID NO: 112294 - DNA, 22 bp, Artificial Sequence
  chemically synthesized
tagaataaaaattaaaatttgg

SEQ ID NO: 112295 - DNA, 22 bp, Artificial Sequence
  chemically synthesized
agaataaaaattaaaatttggg

SEQ ID NO: 112296 - DNA, 22 bp, Artificial Sequence
  chemically synthesized
gaataaaaattaaaatttggga

SEQ ID NO: 112297 - DNA, 22 bp, Artificial Sequence
  chemically synthesized
aaatttgggaaaataagtttgt

SEQ ID NO: 112298 - DNA, 22 bp, Artificial Sequence
  chemically synthesized
gggaaaataagtttgtattgat

SEQ ID NO: 112299 - DNA, 22 bp, Artificial Sequence
  chemically synthesized
ggaaaataagtttgtattgatg

SEQ ID NO: 112300 - DNA, 22 bp, Artificial Sequence
  chemically synthesized
gtattgatgactaattccaatc

SEQ ID NO: 112301 - DNA, 22 bp, Artificial Sequence
  chemically synthesized
tattgatgactaattccaatcc

SEQ ID NO: 112302 - DNA, 22 bp, Artificial Sequence
  chemically synthesized
atgactaattccaatcccaagc

SEQ ID NO: 112303 - DNA, 22 bp, Artificial Sequence
  chemically synthesized
attccaatcccaagcacgggtc

SEQ ID NO: 112304 - DNA, 22 bp, Artificial Sequence
  chemically synthesized
caatcccaagcacgggtctctg

SEQ ID NO: 112305 - DNA, 22 bp, Artificial Sequence
  chemically synthesized
tgtgcaatgcaggactgggaag

SEQ ID NO: 112306 - DNA, 22 bp, Artificial Sequence
  chemically synthesized
tgcaatgcaggactgggaaggt

SEQ ID NO: 112307 - DNA, 22 bp, Artificial Sequence
  chemically synthesized
ggaaggtttaggcaggggtgct

SEQ ID NO: 112308 - DNA, 22 bp, Artificial Sequence
  chemically synthesized
aggcaggggtgctatctgattc

SEQ ID NO: 112309 - DNA, 22 bp, Artificial Sequence
  chemically synthesized
ggcaggggtgctatctgattca

SEQ ID NO: 112310 - DNA, 22 bp, Artificial Sequence
  chemically synthesized
tctgattcatgagacaacaggc

SEQ ID NO: 112311 - DNA, 22 bp, Artificial Sequence
  chemically synthesized
attcatgagacaacaggcacaa

SEQ ID NO: 112312 - DNA, 22 bp, Artificial Sequence
  chemically synthesized
atgagacaacaggcacaaagtt

SEQ ID NO: 112313 - DNA, 22 bp, Artificial Sequence
  chemically synthesized
tagtccctgcctggacttggtg

SEQ ID NO: 112314 - DNA, 22 bp, Artificial Sequence
  chemically synthesized
agtccctgcctggacttggtgt

SEQ ID NO: 112315 - DNA, 22 bp, Artificial Sequence
  chemically synthesized
gtccctgcctggacttggtgtc

SEQ ID NO: 112316 - DNA, 22 bp, Artificial Sequence
  chemically synthesized
cctggacttggtgtcatctctt

SEQ ID NO: 112317 - DNA, 22 bp, Artificial Sequence
  chemically synthesized
gacttggtgtcatctcttgagc

SEQ ID NO: 112318 - DNA, 22 bp, Artificial Sequence
  chemically synthesized
ggtgtcatctcttgagcacatg

SEQ ID NO: 112319 - DNA, 22 bp, Artificial Sequence
  chemically synthesized
gtgtcatctcttgagcacatgc

SEQ ID NO: 112320 - DNA, 22 bp, Artificial Sequence
  chemically synthesized
ttgagcacatgcctaatggtct

SEQ ID NO: 112321 - DNA, 22 bp, Artificial Sequence
  chemically synthesized
gagcacatgcctaatggtctcc

SEQ ID NO: 112322 - DNA, 22 bp, Artificial Sequence
  chemically synthesized
agcacatgcctaatggtctcct

SEQ ID NO: 112323 - DNA, 22 bp, Artificial Sequence
  chemically synthesized
atggtctcctaacattcccctc

SEQ ID NO: 112324 - DNA, 22 bp, Artificial Sequence
  chemically synthesized
ctaacattcccctcccaaagtt

SEQ ID NO: 112325 - DNA, 22 bp, Artificial Sequence
  chemically synthesized
acattcccctcccaaagtttga

SEQ ID NO: 112326 - DNA, 22 bp, Artificial Sequence
  chemically synthesized
ccctcccaaagtttgaaaatgc

SEQ ID NO: 112327 - DNA, 22 bp, Artificial Sequence
  chemically synthesized
ccaaagtttgaaaatgcttcca

SEQ ID NO: 112328 - DNA, 22 bp, Artificial Sequence
  chemically synthesized
gaaaatgcttccacctcccgct

SEQ ID NO: 112329 - DNA, 22 bp, Artificial Sequence
  chemically synthesized
aaaatgcttccacctcccgctg

SEQ ID NO: 112330 - DNA, 22 bp, Artificial Sequence
  chemically synthesized
ccacctcccgctgcagtccatg

SEQ ID NO: 112331 - DNA, 22 bp, Artificial Sequence
  chemically synthesized
cacctcccgctgcagtccatga

SEQ ID NO: 112332 - DNA, 22 bp, Artificial Sequence
  chemically synthesized
ccgctgcagtccatgaaccagg

SEQ ID NO: 112333 - DNA, 22 bp, Artificial Sequence
  chemically synthesized
cagtccatgaaccaggataaaa

SEQ ID NO: 112334 - DNA, 22 bp, Artificial Sequence
  chemically synthesized
tctagcagcagagaccaaagac

SEQ ID NO: 112335 - DNA, 22 bp, Artificial Sequence
  chemically synthesized
tagcagcagagaccaaagacat

SEQ ID NO: 112336 - DNA, 22 bp, Artificial Sequence
  chemically synthesized
gcagcagagaccaaagacattc

SEQ ID NO: 112337 - DNA, 22 bp, Artificial Sequence
  chemically synthesized
tctcaagtctcaggaatgtggt

SEQ ID NO: 112338 - DNA, 22 bp, Artificial Sequence
  chemically synthesized
tcaagtctcaggaatgtggttc

SEQ ID NO: 112339 - DNA, 22 bp, Artificial Sequence
  chemically synthesized
aagtctcaggaatgtggttctg

SEQ ID NO: 112340 - DNA, 22 bp, Artificial Sequence
  chemically synthesized
aggaatgtggttctgaaggaag

SEQ ID NO: 112341 - DNA, 22 bp, Artificial Sequence
  chemically synthesized
tgaaggaagagaagctctgcca

SEQ ID NO: 112342 - DNA, 22 bp, Artificial Sequence
  chemically synthesized
aaggaagagaagctctgccaca

SEQ ID NO: 112343 - DNA, 22 bp, Artificial Sequence
  chemically synthesized
tgccacacatacacatgccacc

SEQ ID NO: 112344 - DNA, 22 bp, Artificial Sequence
  chemically synthesized
ccacacatacacatgccacctt

SEQ ID NO: 112345 - DNA, 22 bp, Artificial Sequence
  chemically synthesized
gcaaagccacttagtgacacag

SEQ ID NO: 112346 - DNA, 22 bp, Artificial Sequence
  chemically synthesized
caaagccacttagtgacacaga

SEQ ID NO: 112347 - DNA, 22 bp, Artificial Sequence
  chemically synthesized
agtgacacagagttttagttat

SEQ ID NO: 112348 - DNA, 22 bp, Artificial Sequence
  chemically synthesized
gtgacacagagttttagttatt

SEQ ID NO: 112349 - DNA, 22 bp, Artificial Sequence
  chemically synthesized
tagttatttcattgtgaactgg

SEQ ID NO: 112350 - DNA, 22 bp, Artificial Sequence
  chemically synthesized
agttatttcattgtgaactgga

SEQ ID NO: 112351 - DNA, 22 bp, Artificial Sequence
  chemically synthesized
gttatttcattgtgaactggaa

SEQ ID NO: 112352 - DNA, 22 bp, Artificial Sequence
  chemically synthesized
tttcattgtgaactggaataaa

SEQ ID NO: 112353 - DNA, 22 bp, Artificial Sequence
  chemically synthesized
cattgtgaactggaataaaatc

SEQ ID NO: 112354 - DNA, 22 bp, Artificial Sequence
  chemically synthesized
attgtgaactggaataaaatca

SEQ ID NO: 112355 - DNA, 22 bp, Artificial Sequence
  chemically synthesized
tgaactggaataaaatcatttt

SEQ ID NO: 112356 - DNA, 22 bp, Artificial Sequence
  chemically synthesized
gaataaaatcattttgaaagga

SEQ ID NO: 112357 - DNA, 22 bp, Artificial Sequence
  chemically synthesized
tgaaaggagatttttgaagtta

SEQ ID NO: 112358 - DNA, 22 bp, Artificial Sequence
  chemically synthesized
gaaaggagatttttgaagttaa

SEQ ID NO: 112359 - DNA, 22 bp, Artificial Sequence
  chemically synthesized
aaaggagatttttgaagttaaa

SEQ ID NO: 112360 - DNA, 22 bp, Artificial Sequence
  chemically synthesized
ttgaagttaaaagcattgccag

SEQ ID NO: 112361 - DNA, 22 bp, Artificial Sequence
  chemically synthesized
tgaagttaaaagcattgccaga

SEQ ID NO: 112362 - DNA, 22 bp, Artificial Sequence
  chemically synthesized
gaagttaaaagcattgccagaa

SEQ ID NO: 112363 - DNA, 22 bp, Artificial Sequence
  chemically synthesized
aagttaaaagcattgccagaaa

SEQ ID NO: 112364 - DNA, 22 bp, Artificial Sequence
  chemically synthesized
aaagcattgccagaaaggagtc

SEQ ID NO: 112365 - DNA, 22 bp, Artificial Sequence
  chemically synthesized
ccagaaaggagtcacaatccag

SEQ ID NO: 112366 - DNA, 22 bp, Artificial Sequence
  chemically synthesized
agagagggttcttggatttcgt

SEQ ID NO: 112367 - DNA, 22 bp, Artificial Sequence
  chemically synthesized
ttggatttcgtgcccaagaaag

SEQ ID NO: 112368 - DNA, 22 bp, Artificial Sequence
  chemically synthesized
ggatttcgtgcccaagaaagaa

SEQ ID NO: 112369 - DNA, 22 bp, Artificial Sequence
  chemically synthesized
gatttcgtgcccaagaaagaat

SEQ ID NO: 112370 - DNA, 22 bp, Artificial Sequence
  chemically synthesized
cgtgcccaagaaagaatttggg

SEQ ID NO: 112371 - DNA, 22 bp, Artificial Sequence
  chemically synthesized
gtgcccaagaaagaatttgggg

SEQ ID NO: 112372 - DNA, 22 bp, Artificial Sequence
  chemically synthesized
ggggcaaatccatacagaaaag

SEQ ID NO: 112373 - DNA, 22 bp, Artificial Sequence
  chemically synthesized
gggcaaatccatacagaaaagt

SEQ ID NO: 112374 - DNA, 22 bp, Artificial Sequence
  chemically synthesized
attaagaaagtaaaggagtaaa

SEQ ID NO: 112375 - DNA, 22 bp, Artificial Sequence
  chemically synthesized
agaaagtaaaggagtaaaataa

SEQ ID NO: 112376 - DNA, 22 bp, Artificial Sequence
  chemically synthesized
ccctataggcagaacagtcctg

SEQ ID NO: 112377 - DNA, 22 bp, Artificial Sequence
  chemically synthesized
taggcagaacagtcctgaggac

SEQ ID NO: 112378 - DNA, 22 bp, Artificial Sequence
  chemically synthesized
aggactgctggttgcccatttt

SEQ ID NO: 112379 - DNA, 22 bp, Artificial Sequence
  chemically synthesized
ctggttgcccatttttatggtt

SEQ ID NO: 112380 - DNA, 22 bp, Artificial Sequence
  chemically synthesized
gttgcccatttttatggttatt

SEQ ID NO: 112381 - DNA, 22 bp, Artificial Sequence
  chemically synthesized
cccatttttatggttatttatt

SEQ ID NO: 112382 - DNA, 22 bp, Artificial Sequence
  chemically synthesized
ttatggttatttattgatgata

SEQ ID NO: 112383 - DNA, 22 bp, Artificial Sequence
  chemically synthesized
tatggttatttattgatgatat

SEQ ID NO: 112384 - DNA, 22 bp, Artificial Sequence
  chemically synthesized
atggttatttattgatgatatg

SEQ ID NO: 112385 - DNA, 22 bp, Artificial Sequence
  chemically synthesized
tggttatttattgatgatatgc

SEQ ID NO: 112386 - DNA, 22 bp, Artificial Sequence
  chemically synthesized
tttattgatgatatgctaaaca

SEQ ID NO: 112387 - DNA, 22 bp, Artificial Sequence
  chemically synthesized
attgatgatatgctaaacaagg

SEQ ID NO: 112388 - DNA, 22 bp, Artificial Sequence
  chemically synthesized
ttgatgatatgctaaacaaggg

SEQ ID NO: 112389 - DNA, 22 bp, Artificial Sequence
  chemically synthesized
atgatatgctaaacaaggggtg

SEQ ID NO: 112390 - DNA, 22 bp, Artificial Sequence
  chemically synthesized
aacaaggggtggattattcatg

SEQ ID NO: 112391 - DNA, 22 bp, Artificial Sequence
  chemically synthesized
ttcatgcctccccttttcagac

SEQ ID NO: 112392 - DNA, 22 bp, Artificial Sequence
  chemically synthesized
atgcctccccttttcagaccgc

SEQ ID NO: 112393 - DNA, 22 bp, Artificial Sequence
  chemically synthesized
cccttttcagaccgcttagcgt

SEQ ID NO: 112394 - DNA, 22 bp, Artificial Sequence
  chemically synthesized
ttcagaccgcttagcgtaactt

SEQ ID NO: 112395 - DNA, 22 bp, Artificial Sequence
  chemically synthesized
tcagaccgcttagcgtaacttc

SEQ ID NO: 112396 - DNA, 22 bp, Artificial Sequence
  chemically synthesized
cagaccgcttagcgtaacttcc

SEQ ID NO: 112397 - DNA, 22 bp, Artificial Sequence
  chemically synthesized
agaccgcttagcgtaacttcct

SEQ ID NO: 112398 - DNA, 22 bp, Artificial Sequence
  chemically synthesized
agcgtaacttcctgatgttgcc

SEQ ID NO: 112399 - DNA, 22 bp, Artificial Sequence
  chemically synthesized
gcgtaacttcctgatgttgcca

SEQ ID NO: 112400 - DNA, 22 bp, Artificial Sequence
  chemically synthesized
cctgatgttgccatggcatttc

SEQ ID NO: 112401 - DNA, 22 bp, Artificial Sequence
  chemically synthesized
ctgatgttgccatggcatttct

SEQ ID NO: 112402 - DNA, 22 bp, Artificial Sequence
  chemically synthesized
atgttgccatggcatttctaaa

SEQ ID NO: 112403 - DNA, 22 bp, Artificial Sequence
  chemically synthesized
ccatggcatttctaaacagtca

SEQ ID NO: 112404 - DNA, 22 bp, Artificial Sequence
  chemically synthesized
ctaaacagtcatagtgctggtg

SEQ ID NO: 112405 - DNA, 22 bp, Artificial Sequence
  chemically synthesized
taaacagtcatagtgctggtgg

SEQ ID NO: 112406 - DNA, 22 bp, Artificial Sequence
  chemically synthesized
aacagtcatagtgctggtggga

SEQ ID NO: 112407 - DNA, 22 bp, Artificial Sequence
  chemically synthesized
gtgggagagtagcagtgaggac

SEQ ID NO: 112408 - DNA, 22 bp, Artificial Sequence
  chemically synthesized
ccagaggtcactctcatcacaa

SEQ ID NO: 112409 - DNA, 22 bp, Artificial Sequence
  chemically synthesized
tcatcacaatcttggtttggtg

SEQ ID NO: 112410 - DNA, 22 bp, Artificial Sequence
  chemically synthesized
atcacaatcttggtttggtggg

SEQ ID NO: 112411 - DNA, 22 bp, Artificial Sequence
  chemically synthesized
ggtttggtgggtttcagccagc

SEQ ID NO: 112412 - DNA, 22 bp, Artificial Sequence
  chemically synthesized
gtttggtgggtttcagccagct

SEQ ID NO: 112413 - DNA, 22 bp, Artificial Sequence
  chemically synthesized
ggtgggtttcagccagcttctt

SEQ ID NO: 112414 - DNA, 22 bp, Artificial Sequence
  chemically synthesized
gtgggtttcagccagcttcttt

SEQ ID NO: 112415 - DNA, 22 bp, Artificial Sequence
  chemically synthesized
cagccagcttctttactgcaaa

SEQ ID NO: 112416 - DNA, 22 bp, Artificial Sequence
  chemically synthesized
agccagcttctttactgcaaac

SEQ ID NO: 112417 - DNA, 22 bp, Artificial Sequence
  chemically synthesized
ctttactgcaaactgttttttc

SEQ ID NO: 112418 - DNA, 22 bp, Artificial Sequence
  chemically synthesized
tttactgcaaactgttttttca

SEQ ID NO: 112419 - DNA, 22 bp, Artificial Sequence
  chemically synthesized
tactgcaaactgttttttcagc

SEQ ID NO: 112420 - DNA, 22 bp, Artificial Sequence
  chemically synthesized
actgcaaactgttttttcagca

SEQ ID NO: 112421 - DNA, 22 bp, Artificial Sequence
  chemically synthesized
ctgcaaactgttttttcagcaa

SEQ ID NO: 112422 - DNA, 22 bp, Artificial Sequence
  chemically synthesized
caaactgttttttcagcaaggt

SEQ ID NO: 112423 - DNA, 22 bp, Artificial Sequence
  chemically synthesized
ttttttcagcaaggtctttatg

SEQ ID NO: 112424 - DNA, 22 bp, Artificial Sequence
  chemically synthesized
tttcagcaaggtctttatgacc

SEQ ID NO: 112425 - DNA, 22 bp, Artificial Sequence
  chemically synthesized
ttcagcaaggtctttatgacct

SEQ ID NO: 112426 - DNA, 22 bp, Artificial Sequence
  chemically synthesized
tcagcaaggtctttatgacctg

SEQ ID NO: 112427 - DNA, 22 bp, Artificial Sequence
  chemically synthesized
cagcaaggtctttatgacctgt

SEQ ID NO: 112428 - DNA, 22 bp, Artificial Sequence
  chemically synthesized
agcaaggtctttatgacctgta

SEQ ID NO: 112429 - DNA, 22 bp, Artificial Sequence
  chemically synthesized
tatgacctgtatcttgtgccaa

SEQ ID NO: 112430 - DNA, 22 bp, Artificial Sequence
  chemically synthesized
atgacctgtatcttgtgccaac

SEQ ID NO: 112431 - DNA, 22 bp, Artificial Sequence
  chemically synthesized
tgacctgtatcttgtgccaacc

SEQ ID NO: 112432 - DNA, 22 bp, Artificial Sequence
  chemically synthesized
tatcttgtgccaacctcttatc

SEQ ID NO: 112433 - DNA, 22 bp, Artificial Sequence
  chemically synthesized
gtgccaacctcttatctcatcc

SEQ ID NO: 112434 - DNA, 22 bp, Artificial Sequence
  chemically synthesized
tgccaacctcttatctcatcct

SEQ ID NO: 112435 - DNA, 22 bp, Artificial Sequence
  chemically synthesized
ttatctcatcctgtgactgaga

SEQ ID NO: 112436 - DNA, 22 bp, Artificial Sequence
  chemically synthesized
atctcatcctgtgactgagaat

SEQ ID NO: 112437 - DNA, 22 bp, Artificial Sequence
  chemically synthesized
tctcatcctgtgactgagaatg

SEQ ID NO: 112438 - DNA, 22 bp, Artificial Sequence
  chemically synthesized
atcctgtgactgagaatgccta

SEQ ID NO: 112439 - DNA, 22 bp, Artificial Sequence
  chemically synthesized
tgactgagaatgcctaactttc

SEQ ID NO: 112440 - DNA, 22 bp, Artificial Sequence
  chemically synthesized
agaatgcctaactttctgggaa

SEQ ID NO: 112441 - DNA, 22 bp, Artificial Sequence
  chemically synthesized
actttctgggaatacagcccag

SEQ ID NO: 112442 - DNA, 22 bp, Artificial Sequence
  chemically synthesized
tctgggaatacagcccagtagg

SEQ ID NO: 112443 - DNA, 22 bp, Artificial Sequence
  chemically synthesized
ctgggaatacagcccagtaggt

SEQ ID NO: 112444 - DNA, 22 bp, Artificial Sequence
  chemically synthesized
tgggaatacagcccagtaggtc

SEQ ID NO: 112445 - DNA, 22 bp, Artificial Sequence
  chemically synthesized
ggaatacagcccagtaggtctc

SEQ ID NO: 112446 - DNA, 22 bp, Artificial Sequence
  chemically synthesized
agccttattgtacccagctcct

SEQ ID NO: 112447 - DNA, 22 bp, Artificial Sequence
  chemically synthesized
attgtacccagctcctatttaa

SEQ ID NO: 112448 - DNA, 22 bp, Artificial Sequence
  chemically synthesized
ttgtacccagctcctatttaag

SEQ ID NO: 112449 - DNA, 22 bp, Artificial Sequence
  chemically synthesized
tacccagctcctatttaagatg

SEQ ID NO: 112450 - DNA, 22 bp, Artificial Sequence
  chemically synthesized
ctatttaagatggagttgctct

SEQ ID NO: 112451 - DNA, 22 bp, Artificial Sequence
  chemically synthesized
tttaagatggagttgctctggt

SEQ ID NO: 112452 - DNA, 22 bp, Artificial Sequence
  chemically synthesized
aagatggagttgctctggttca

SEQ ID NO: 112453 - DNA, 22 bp, Artificial Sequence
  chemically synthesized
agatggagttgctctggttcaa

SEQ ID NO: 112454 - DNA, 22 bp, Artificial Sequence
  chemically synthesized
ctctggttcaaatgcctctgac

SEQ ID NO: 112455 - DNA, 22 bp, Artificial Sequence
  chemically synthesized
tggttcaaatgcctctgacaaa

SEQ ID NO: 112456 - DNA, 22 bp, Artificial Sequence
  chemically synthesized
gttcaaatgcctctgacaaaag

SEQ ID NO: 112457 - DNA, 22 bp, Artificial Sequence
  chemically synthesized
aaatgcctctgacaaaaggaac

SEQ ID NO: 112458 - DNA, 22 bp, Artificial Sequence
  chemically synthesized
tgacaaaaggaacaaaaatgtt

SEQ ID NO: 112459 - DNA, 22 bp, Artificial Sequence
  chemically synthesized
acaaaaggaacaaaaatgttgt

SEQ ID NO: 112460 - DNA, 22 bp, Artificial Sequence
  chemically synthesized
tttctggtatgctagcacccag

SEQ ID NO: 112461 - DNA, 22 bp, Artificial Sequence
  chemically synthesized
ctggtatgctagcacccagaat

SEQ ID NO: 112462 - DNA, 22 bp, Artificial Sequence
  chemically synthesized
tggtatgctagcacccagaata

SEQ ID NO: 112463 - DNA, 22 bp, Artificial Sequence
  chemically synthesized
gtatgctagcacccagaataga

SEQ ID NO: 112464 - DNA, 22 bp, Artificial Sequence
  chemically synthesized
gcacccagaatagaggcacttg

SEQ ID NO: 112465 - DNA, 22 bp, Artificial Sequence
  chemically synthesized
gcacaatatatgcattcaaaaa

SEQ ID NO: 112466 - DNA, 22 bp, Artificial Sequence
  chemically synthesized
cacaatatatgcattcaaaaat

SEQ ID NO: 112467 - DNA, 22 bp, Artificial Sequence
  chemically synthesized
aaaaatgtattttttttcactt

SEQ ID NO: 112468 - DNA, 22 bp, Artificial Sequence
  chemically synthesized
tttttcacttgtgctttctgcc

SEQ ID NO: 112469 - DNA, 22 bp, Artificial Sequence
  chemically synthesized
ttttcacttgtgctttctgcct

SEQ ID NO: 112470 - DNA, 22 bp, Artificial Sequence
  chemically synthesized
tttcacttgtgctttctgccta

SEQ ID NO: 112471 - DNA, 22 bp, Artificial Sequence
  chemically synthesized
ttcacttgtgctttctgcctat

SEQ ID NO: 112472 - DNA, 22 bp, Artificial Sequence
  chemically synthesized
tcacttgtgctttctgcctata

SEQ ID NO: 112473 - DNA, 22 bp, Artificial Sequence
  chemically synthesized
cacttgtgctttctgcctatat

SEQ ID NO: 112474 - DNA, 22 bp, Artificial Sequence
  chemically synthesized
acttgtgctttctgcctatatc

SEQ ID NO: 112475 - DNA, 22 bp, Artificial Sequence
  chemically synthesized
gtgctttctgcctatatctatt

SEQ ID NO: 112476 - DNA, 22 bp, Artificial Sequence
  chemically synthesized
tgctttctgcctatatctattt

SEQ ID NO: 112477 - DNA, 22 bp, Artificial Sequence
  chemically synthesized
tctgcctatatctatttttatg

SEQ ID NO: 112478 - DNA, 22 bp, Artificial Sequence
  chemically synthesized
ctgcctatatctatttttatgt

SEQ ID NO: 112479 - DNA, 22 bp, Artificial Sequence
  chemically synthesized
tgcctatatctatttttatgtc

SEQ ID NO: 112480 - DNA, 22 bp, Artificial Sequence
  chemically synthesized
cctatatctatttttatgtcct

SEQ ID NO: 112481 - DNA, 22 bp, Artificial Sequence
  chemically synthesized
tatctatttttatgtcctcatg

SEQ ID NO: 112482 - DNA, 22 bp, Artificial Sequence
  chemically synthesized
tttttatgtcctcatgcttaaa

SEQ ID NO: 112483 - DNA, 22 bp, Artificial Sequence
  chemically synthesized
ttatgtcctcatgcttaaatct

SEQ ID NO: 112484 - DNA, 22 bp, Artificial Sequence
  chemically synthesized
tatgtcctcatgcttaaatctt

SEQ ID NO: 112485 - DNA, 22 bp, Artificial Sequence
  chemically synthesized
atgtcctcatgcttaaatcttg

SEQ ID NO: 112486 - DNA, 22 bp, Artificial Sequence
  chemically synthesized
tgtcctcatgcttaaatcttga

SEQ ID NO: 112487 - DNA, 22 bp, Artificial Sequence
  chemically synthesized
atgcttaaatcttgaccaaggc

SEQ ID NO: 112488 - DNA, 22 bp, Artificial Sequence
  chemically synthesized
aaatcttgaccaaggctatgca

SEQ ID NO: 112489 - DNA, 22 bp, Artificial Sequence
  chemically synthesized
aatcttgaccaaggctatgcat

SEQ ID NO: 112490 - DNA, 22 bp, Artificial Sequence
  chemically synthesized
gaccaaggctatgcattttcct

SEQ ID NO: 112491 - DNA, 22 bp, Artificial Sequence
  chemically synthesized
accaaggctatgcattttccta

SEQ ID NO: 112492 - DNA, 22 bp, Artificial Sequence
  chemically synthesized
tgcattttcctatccttactca

SEQ ID NO: 112493 - DNA, 22 bp, Artificial Sequence
  chemically synthesized
tcctatccttactcagcagttt

SEQ ID NO: 112494 - DNA, 22 bp, Artificial Sequence
  chemically synthesized
cctatccttactcagcagtttg

SEQ ID NO: 112495 - DNA, 22 bp, Artificial Sequence
  chemically synthesized
ctatccttactcagcagtttgt

SEQ ID NO: 112496 - DNA, 22 bp, Artificial Sequence
  chemically synthesized
tccttactcagcagtttgtgag

SEQ ID NO: 112497 - DNA, 22 bp, Artificial Sequence
  chemically synthesized
actcagcagtttgtgaggaatc

SEQ ID NO: 112498 - DNA, 22 bp, Artificial Sequence
  chemically synthesized
ctcagcagtttgtgaggaatca

SEQ ID NO: 112499 - DNA, 22 bp, Artificial Sequence
  chemically synthesized
agcagtttgtgaggaatcagac

SEQ ID NO: 112500 - DNA, 22 bp, Artificial Sequence
  chemically synthesized
gtgaggaatcagacattcttca

SEQ ID NO: 112501 - DNA, 22 bp, Artificial Sequence
  chemically synthesized
tgaggaatcagacattcttcaa

SEQ ID NO: 112502 - DNA, 22 bp, Artificial Sequence
  chemically synthesized
ttcaaagtttcacttctaccag

SEQ ID NO: 112503 - DNA, 22 bp, Artificial Sequence
  chemically synthesized
caaagtttcacttctaccagag

SEQ ID NO: 112504 - DNA, 22 bp, Artificial Sequence
  chemically synthesized
aaagtttcacttctaccagagt

SEQ ID NO: 112505 - DNA, 22 bp, Artificial Sequence
  chemically synthesized
cacttctaccagagtagagcta

SEQ ID NO: 112506 - DNA, 22 bp, Artificial Sequence
  chemically synthesized
acttctaccagagtagagctac

SEQ ID NO: 112507 - DNA, 22 bp, Artificial Sequence
  chemically synthesized
ctaccagagtagagctacttct

SEQ ID NO: 112508 - DNA, 22 bp, Artificial Sequence
  chemically synthesized
taccagagtagagctacttctc

SEQ ID NO: 112509 - DNA, 22 bp, Artificial Sequence
  chemically synthesized
ccagagtagagctacttctctt

SEQ ID NO: 112510 - DNA, 22 bp, Artificial Sequence
  chemically synthesized
cttctcttctaattatatctta

SEQ ID NO: 112511 - DNA, 22 bp, Artificial Sequence
  chemically synthesized
ctcttctaattatatcttacac

SEQ ID NO: 112512 - DNA, 22 bp, Artificial Sequence
  chemically synthesized
tcttctaattatatcttacacc

SEQ ID NO: 112513 - DNA, 22 bp, Artificial Sequence
  chemically synthesized
ttctaattatatcttacacccc

SEQ ID NO: 112514 - DNA, 22 bp, Artificial Sequence
  chemically synthesized
ctaattatatcttacaccccac

SEQ ID NO: 112515 - DNA, 22 bp, Artificial Sequence
  chemically synthesized
taattatatcttacaccccaca

SEQ ID NO: 112516 - DNA, 22 bp, Artificial Sequence
  chemically synthesized
attatatcttacaccccacaac

SEQ ID NO: 112517 - DNA, 22 bp, Artificial Sequence
  chemically synthesized
tatcttacaccccacaactaac

SEQ ID NO: 112518 - DNA, 22 bp, Artificial Sequence
  chemically synthesized
acaccccacaactaacccaagc

SEQ ID NO: 112519 - DNA, 22 bp, Artificial Sequence
  chemically synthesized
caccccacaactaacccaagct

SEQ ID NO: 112520 - DNA, 22 bp, Artificial Sequence
  chemically synthesized
acccaagcttcacttggttctt

SEQ ID NO: 112521 - DNA, 22 bp, Artificial Sequence
  chemically synthesized
cacttggttctttgctcctatg

SEQ ID NO: 112522 - DNA, 22 bp, Artificial Sequence
  chemically synthesized
acttggttctttgctcctatgg

SEQ ID NO: 112523 - DNA, 22 bp, Artificial Sequence
  chemically synthesized
ggttctttgctcctatggagac

SEQ ID NO: 112524 - DNA, 22 bp, Artificial Sequence
  chemically synthesized
gttctttgctcctatggagacc

SEQ ID NO: 112525 - DNA, 22 bp, Artificial Sequence
  chemically synthesized
tttgctcctatggagacccagg

SEQ ID NO: 112526 - DNA, 22 bp, Artificial Sequence
  chemically synthesized
tgctcctatggagacccaggct

SEQ ID NO: 112527 - DNA, 22 bp, Artificial Sequence
  chemically synthesized
gctcctatggagacccaggctc

SEQ ID NO: 112528 - DNA, 22 bp, Artificial Sequence
  chemically synthesized
ctcctatggagacccaggctca

SEQ ID NO: 112529 - DNA, 22 bp, Artificial Sequence
  chemically synthesized
ctatggagacccaggctcactc

SEQ ID NO: 112530 - DNA, 22 bp, Artificial Sequence
  chemically synthesized
tggagacccaggctcactcaga

SEQ ID NO: 112531 - DNA, 22 bp, Artificial Sequence
  chemically synthesized
actcagaactctctttctttgt

SEQ ID NO: 112532 - DNA, 22 bp, Artificial Sequence
  chemically synthesized
agaactctctttctttgttttt

SEQ ID NO: 112533 - DNA, 22 bp, Artificial Sequence
  chemically synthesized
tctttctttgttttttcctctg

SEQ ID NO: 112534 - DNA, 22 bp, Artificial Sequence
  chemically synthesized
tttctttgttttttcctctgcc

SEQ ID NO: 112535 - DNA, 22 bp, Artificial Sequence
  chemically synthesized
tctttgttttttcctctgccat

SEQ ID NO: 112536 - DNA, 22 bp, Artificial Sequence
  chemically synthesized
ctttgttttttcctctgccatt

SEQ ID NO: 112537 - DNA, 22 bp, Artificial Sequence
  chemically synthesized
tttgttttttcctctgccattc

SEQ ID NO: 112538 - DNA, 22 bp, Artificial Sequence
  chemically synthesized
tgttttttcctctgccattcag

SEQ ID NO: 112539 - DNA, 22 bp, Artificial Sequence
  chemically synthesized
gttttttcctctgccattcaga

SEQ ID NO: 112540 - DNA, 22 bp, Artificial Sequence
  chemically synthesized
ttttttcctctgccattcagat

SEQ ID NO: 112541 - DNA, 22 bp, Artificial Sequence
  chemically synthesized
tttcctctgccattcagatttg

SEQ ID NO: 112542 - DNA, 22 bp, Artificial Sequence
  chemically synthesized
ttcctctgccattcagatttgt

SEQ ID NO: 112543 - DNA, 22 bp, Artificial Sequence
  chemically synthesized
tcctctgccattcagatttgtt

SEQ ID NO: 112544 - DNA, 22 bp, Artificial Sequence
  chemically synthesized
cctctgccattcagatttgttg

SEQ ID NO: 112545 - DNA, 22 bp, Artificial Sequence
  chemically synthesized
ctctgccattcagatttgttgc

SEQ ID NO: 112546 - DNA, 22 bp, Artificial Sequence
  chemically synthesized
tgccattcagatttgttgcatc

SEQ ID NO: 112547 - DNA, 22 bp, Artificial Sequence
  chemically synthesized
ccattcagatttgttgcatctt

SEQ ID NO: 112548 - DNA, 22 bp, Artificial Sequence
  chemically synthesized
agatttgttgcatcttcaacca

SEQ ID NO: 112549 - DNA, 22 bp, Artificial Sequence
  chemically synthesized
gttgcatcttcaaccaataact

SEQ ID NO: 112550 - DNA, 22 bp, Artificial Sequence
  chemically synthesized
ttgcatcttcaaccaataactt

SEQ ID NO: 112551 - DNA, 22 bp, Artificial Sequence
  chemically synthesized
catcttcaaccaataacttaac

SEQ ID NO: 112552 - DNA, 22 bp, Artificial Sequence
  chemically synthesized
caaccaataacttaactatgaa

SEQ ID NO: 112553 - DNA, 22 bp, Artificial Sequence
  chemically synthesized
aaccaataacttaactatgaac

SEQ ID NO: 112554 - DNA, 22 bp, Artificial Sequence
  chemically synthesized
aactatgaaccagcatgaaaaa

SEQ ID NO: 112555 - DNA, 22 bp, Artificial Sequence
  chemically synthesized
actatgaaccagcatgaaaaat

SEQ ID NO: 112556 - DNA, 22 bp, Artificial Sequence
  chemically synthesized
tgaaccagcatgaaaaatcctg

SEQ ID NO: 112557 - DNA, 22 bp, Artificial Sequence
  chemically synthesized
ttaagtgttctgtaggcttctt

SEQ ID NO: 112558 - DNA, 22 bp, Artificial Sequence
  chemically synthesized
agtgttctgtaggcttcttgaa

SEQ ID NO: 112559 - DNA, 22 bp, Artificial Sequence
  chemically synthesized
tgtaggcttcttgaaacctatt

SEQ ID NO: 112560 - DNA, 22 bp, Artificial Sequence
  chemically synthesized
taggcttcttgaaacctattgt

SEQ ID NO: 112561 - DNA, 22 bp, Artificial Sequence
  chemically synthesized
cttgaaacctattgtttcatgc

SEQ ID NO: 112562 - DNA, 22 bp, Artificial Sequence
  chemically synthesized
ttgaaacctattgtttcatgct

SEQ ID NO: 112563 - DNA, 22 bp, Artificial Sequence
  chemically synthesized
gaaacctattgtttcatgcttc

SEQ ID NO: 112564 - DNA, 22 bp, Artificial Sequence
  chemically synthesized
aaacctattgtttcatgcttct

SEQ ID NO: 112565 - DNA, 22 bp, Artificial Sequence
  chemically synthesized
ttgtttcatgcttcttcataca

SEQ ID NO: 112566 - DNA, 22 bp, Artificial Sequence
  chemically synthesized
tttcatgcttcttcatacagtc

SEQ ID NO: 112567 - DNA, 22 bp, Artificial Sequence
  chemically synthesized
catgcttcttcatacagtctta

SEQ ID NO: 112568 - DNA, 22 bp, Artificial Sequence
  chemically synthesized
atgcttcttcatacagtcttat

SEQ ID NO: 112569 - DNA, 22 bp, Artificial Sequence
  chemically synthesized
cttcatacagtcttatgcagta

SEQ ID NO: 112570 - DNA, 22 bp, Artificial Sequence
  chemically synthesized
ttcatacagtcttatgcagtag

SEQ ID NO: 112571 - DNA, 22 bp, Artificial Sequence
  chemically synthesized
catacagtcttatgcagtagtt

SEQ ID NO: 112572 - DNA, 22 bp, Artificial Sequence
  chemically synthesized
atacagtcttatgcagtagttt

SEQ ID NO: 112573 - DNA, 22 bp, Artificial Sequence
  chemically synthesized
atgcagtagttttgggaattaa

SEQ ID NO: 112574 - DNA, 22 bp, Artificial Sequence
  chemically synthesized
tgcagtagttttgggaattaaa

SEQ ID NO: 112575 - DNA, 22 bp, Artificial Sequence
  chemically synthesized
tgggaattaaacagtttggttt

SEQ ID NO: 112576 - DNA, 22 bp, Artificial Sequence
  chemically synthesized
gggaattaaacagtttggttta

SEQ ID NO: 112577 - DNA, 22 bp, Artificial Sequence
  chemically synthesized
ggaattaaacagtttggtttac

SEQ ID NO: 112578 - DNA, 22 bp, Artificial Sequence
  chemically synthesized
aacagtttggtttacaatccca

SEQ ID NO: 112579 - DNA, 22 bp, Artificial Sequence
  chemically synthesized
ggtttacaatcccaccttccac

SEQ ID NO: 112580 - DNA, 22 bp, Artificial Sequence
  chemically synthesized
gtttacaatcccaccttccact

SEQ ID NO: 112581 - DNA, 22 bp, Artificial Sequence
  chemically synthesized
acaatcccaccttccacttatt

SEQ ID NO: 112582 - DNA, 22 bp, Artificial Sequence
  chemically synthesized
caatcccaccttccacttattg

SEQ ID NO: 112583 - DNA, 22 bp, Artificial Sequence
  chemically synthesized
ccacttattggctgcgtaccct

SEQ ID NO: 112584 - DNA, 22 bp, Artificial Sequence
  chemically synthesized
cacttattggctgcgtacccta

SEQ ID NO: 112585 - DNA, 22 bp, Artificial Sequence
  chemically synthesized
attggctgcgtaccctatagca

SEQ ID NO: 112586 - DNA, 22 bp, Artificial Sequence
  chemically synthesized
ttggctgcgtaccctatagcaa

SEQ ID NO: 112587 - DNA, 22 bp, Artificial Sequence
  chemically synthesized
gctgcgtaccctatagcaaagc

SEQ ID NO: 112588 - DNA, 22 bp, Artificial Sequence
  chemically synthesized
cgtaccctatagcaaagcaatt

SEQ ID NO: 112589 - DNA, 22 bp, Artificial Sequence
  chemically synthesized
tagcaaagcaatttatctttct

SEQ ID NO: 112590 - DNA, 22 bp, Artificial Sequence
  chemically synthesized
atctttctgtgttttggtccac

SEQ ID NO: 112591 - DNA, 22 bp, Artificial Sequence
  chemically synthesized
tctttctgtgttttggtccact

SEQ ID NO: 112592 - DNA, 22 bp, Artificial Sequence
  chemically synthesized
tctgtgttttggtccactcatc

SEQ ID NO: 112593 - DNA, 22 bp, Artificial Sequence
  chemically synthesized
ctgtgttttggtccactcatct

SEQ ID NO: 112594 - DNA, 22 bp, Artificial Sequence
  chemically synthesized
tgtgttttggtccactcatctt

SEQ ID NO: 112595 - DNA, 22 bp, Artificial Sequence
  chemically synthesized
tgttttggtccactcatcttta

SEQ ID NO: 112596 - DNA, 22 bp, Artificial Sequence
  chemically synthesized
tggtccactcatctttaagtgg

SEQ ID NO: 112597 - DNA, 22 bp, Artificial Sequence
  chemically synthesized
ggtccactcatctttaagtggg

SEQ ID NO: 112598 - DNA, 22 bp, Artificial Sequence
  chemically synthesized
gtccactcatctttaagtgggg

SEQ ID NO: 112599 - DNA, 22 bp, Artificial Sequence
  chemically synthesized
atctttaagtggggataccaat

SEQ ID NO: 112600 - DNA, 22 bp, Artificial Sequence
  chemically synthesized
taagtggggataccaatagtac

SEQ ID NO: 112601 - DNA, 22 bp, Artificial Sequence
  chemically synthesized
aagtggggataccaatagtacc

SEQ ID NO: 112602 - DNA, 22 bp, Artificial Sequence
  chemically synthesized
agtggggataccaatagtaccc

SEQ ID NO: 112603 - DNA, 22 bp, Artificial Sequence
  chemically synthesized
aattattttaatgattaaatac

SEQ ID NO: 112604 - DNA, 22 bp, Artificial Sequence
  chemically synthesized
ttttaatgattaaatacattaa

SEQ ID NO: 112605 - DNA, 22 bp, Artificial Sequence
  chemically synthesized
taatgattaaatacattaatat

SEQ ID NO: 112606 - DNA, 22 bp, Artificial Sequence
  chemically synthesized
aatgattaaatacattaatatg

SEQ ID NO: 112607 - DNA, 22 bp, Artificial Sequence
  chemically synthesized
atgattaaatacattaatatgt

SEQ ID NO: 112608 - DNA, 22 bp, Artificial Sequence
  chemically synthesized
aatacattaatatgtctaacgt

SEQ ID NO: 112609 - DNA, 22 bp, Artificial Sequence
  chemically synthesized
atatgtctaacgtgttcaatag

SEQ ID NO: 112610 - DNA, 22 bp, Artificial Sequence
  chemically synthesized
acgtgttcaatagtgcctggtc

SEQ ID NO: 112611 - DNA, 22 bp, Artificial Sequence
  chemically synthesized
aatagtgcctggtccattgtaa

SEQ ID NO: 112612 - DNA, 22 bp, Artificial Sequence
  chemically synthesized
gtccattgtaagtattatagaa

SEQ ID NO: 112613 - DNA, 22 bp, Artificial Sequence
  chemically synthesized
taagtattatagaaatcattgc

SEQ ID NO: 112614 - DNA, 22 bp, Artificial Sequence
  chemically synthesized
tagaaatcattgctattattac

SEQ ID NO: 112615 - DNA, 22 bp, Artificial Sequence
  chemically synthesized
ctattattactataatcatcat

SEQ ID NO: 112616 - DNA, 22 bp, Artificial Sequence
  chemically synthesized
ttattactataatcatcattga

SEQ ID NO: 112617 - DNA, 22 bp, Artificial Sequence
  chemically synthesized
ttactataatcatcattgaaaa

SEQ ID NO: 112618 - DNA, 22 bp, Artificial Sequence
  chemically synthesized
ctataatcatcattgaaaattt

SEQ ID NO: 112619 - DNA, 22 bp, Artificial Sequence
  chemically synthesized
taatcatcattgaaaattttgt

SEQ ID NO: 112620 - DNA, 22 bp, Artificial Sequence
  chemically synthesized
aaaattttgtgaaaatgagaca

SEQ ID NO: 112621 - DNA, 22 bp, Artificial Sequence
  chemically synthesized
tgtgaaaatgagacaatttgac

SEQ ID NO: 112622 - DNA, 22 bp, Artificial Sequence
  chemically synthesized
gtgaaaatgagacaatttgacc

SEQ ID NO: 112623 - DNA, 22 bp, Artificial Sequence
  chemically synthesized
tgaaaatgagacaatttgacct

SEQ ID NO: 112624 - DNA, 22 bp, Artificial Sequence
  chemically synthesized
gacctttgggctgagaagatac

SEQ ID NO: 112625 - DNA, 22 bp, Artificial Sequence
  chemically synthesized
acctttgggctgagaagatact

SEQ ID NO: 112626 - DNA, 22 bp, Artificial Sequence
  chemically synthesized
tgggctgagaagatactctgtc

SEQ ID NO: 112627 - DNA, 22 bp, Artificial Sequence
  chemically synthesized
gggctgagaagatactctgtct

SEQ ID NO: 112628 - DNA, 22 bp, Artificial Sequence
  chemically synthesized
ggctgagaagatactctgtcta

SEQ ID NO: 112629 - DNA, 22 bp, Artificial Sequence
  chemically synthesized
agaagatactctgtctagctct

SEQ ID NO: 112630 - DNA, 22 bp, Artificial Sequence
  chemically synthesized
tgtctagctctgacaaagaaaa

SEQ ID NO: 112631 - DNA, 22 bp, Artificial Sequence
  chemically synthesized
tctagctctgacaaagaaaata

SEQ ID NO: 112632 - DNA, 22 bp, Artificial Sequence
  chemically synthesized
gctctgacaaagaaaataaaaa

SEQ ID NO: 112633 - DNA, 22 bp, Artificial Sequence
  chemically synthesized
tgacaaagaaaataaaaacctt

SEQ ID NO: 112634 - DNA, 22 bp, Artificial Sequence
  chemically synthesized
acaaagaaaataaaaaccttta

SEQ ID NO: 112635 - DNA, 22 bp, Artificial Sequence
  chemically synthesized
taaaaagctctctcacaatcgt

SEQ ID NO: 112636 - DNA, 22 bp, Artificial Sequence
  chemically synthesized
aaaaagctctctcacaatcgta

SEQ ID NO: 112637 - DNA, 22 bp, Artificial Sequence
  chemically synthesized
aaaagctctctcacaatcgtaa

SEQ ID NO: 112638 - DNA, 22 bp, Artificial Sequence
  chemically synthesized
tctcacaatcgtaatacttgaa

SEQ ID NO: 112639 - DNA, 22 bp, Artificial Sequence
  chemically synthesized
tcacaatcgtaatacttgaagt

SEQ ID NO: 112640 - DNA, 22 bp, Artificial Sequence
  chemically synthesized
acaatcgtaatacttgaagtta

SEQ ID NO: 112641 - DNA, 22 bp, Artificial Sequence
  chemically synthesized
gaagttacacaagatattctaa

SEQ ID NO: 112642 - DNA, 22 bp, Artificial Sequence
  chemically synthesized
aagttacacaagatattctaac

SEQ ID NO: 112643 - DNA, 22 bp, Artificial Sequence
  chemically synthesized
cacaagatattctaacataaag

SEQ ID NO: 112644 - DNA, 22 bp, Artificial Sequence
  chemically synthesized
taacataaagactttgtgtttt

SEQ ID NO: 112645 - DNA, 22 bp, Artificial Sequence
  chemically synthesized
acataaagactttgtgttttat

SEQ ID NO: 112646 - DNA, 22 bp, Artificial Sequence
  chemically synthesized
tgtgttttattctcacatgcat

SEQ ID NO: 112647 - DNA, 22 bp, Artificial Sequence
  chemically synthesized
gtgttttattctcacatgcatc

SEQ ID NO: 112648 - DNA, 22 bp, Artificial Sequence
  chemically synthesized
tgttttattctcacatgcatcc

SEQ ID NO: 112649 - DNA, 22 bp, Artificial Sequence
  chemically synthesized
tattctcacatgcatcctgtga

SEQ ID NO: 112650 - DNA, 22 bp, Artificial Sequence
  chemically synthesized
attctcacatgcatcctgtgag

SEQ ID NO: 112651 - DNA, 22 bp, Artificial Sequence
  chemically synthesized
ttctcacatgcatcctgtgaga

SEQ ID NO: 112652 - DNA, 22 bp, Artificial Sequence
  chemically synthesized
tcacatgcatcctgtgagaaag

SEQ ID NO: 112653 - DNA, 22 bp, Artificial Sequence
  chemically synthesized
acatgcatcctgtgagaaagca

SEQ ID NO: 112654 - DNA, 22 bp, Artificial Sequence
  chemically synthesized
tgagaaagcagagcatagtaga

SEQ ID NO: 112655 - DNA, 22 bp, Artificial Sequence
  chemically synthesized
cagttttatctgtcaagagcaa

SEQ ID NO: 112656 - DNA, 22 bp, Artificial Sequence
  chemically synthesized
agttttatctgtcaagagcaaa

SEQ ID NO: 112657 - DNA, 22 bp, Artificial Sequence
  chemically synthesized
tatctgtcaagagcaaaatttg

SEQ ID NO: 112658 - DNA, 22 bp, Artificial Sequence
  chemically synthesized
atctgtcaagagcaaaatttga

SEQ ID NO: 112659 - DNA, 22 bp, Artificial Sequence
  chemically synthesized
tctgtcaagagcaaaatttgag

SEQ ID NO: 112660 - DNA, 22 bp, Artificial Sequence
  chemically synthesized
tcaagagcaaaatttgaggttt

SEQ ID NO: 112661 - DNA, 22 bp, Artificial Sequence
  chemically synthesized
gaggtttctaaacattgagtta

SEQ ID NO: 112662 - DNA, 22 bp, Artificial Sequence
  chemically synthesized
aggtttctaaacattgagttac

SEQ ID NO: 112663 - DNA, 22 bp, Artificial Sequence
  chemically synthesized
ctaaacattgagttactcaaaa

SEQ ID NO: 112664 - DNA, 22 bp, Artificial Sequence
  chemically synthesized
taaacattgagttactcaaaat

SEQ ID NO: 112665 - DNA, 22 bp, Artificial Sequence
  chemically synthesized
aacattgagttactcaaaatat

SEQ ID NO: 112666 - DNA, 22 bp, Artificial Sequence
  chemically synthesized
agttactcaaaatattatgctt

SEQ ID NO: 112667 - DNA, 22 bp, Artificial Sequence
  chemically synthesized
ctcaaaatattatgctttaaaa

SEQ ID NO: 112668 - DNA, 22 bp, Artificial Sequence
  chemically synthesized
aaaatattatgctttaaaactg

SEQ ID NO: 112669 - DNA, 22 bp, Artificial Sequence
  chemically synthesized
tgctttaaaactgaaggaagca

SEQ ID NO: 112670 - DNA, 22 bp, Artificial Sequence
  chemically synthesized
taaaactgaaggaagcaaaacc

SEQ ID NO: 112671 - DNA, 22 bp, Artificial Sequence
  chemically synthesized
aaaactgaaggaagcaaaacct

SEQ ID NO: 112672 - DNA, 22 bp, Artificial Sequence
  chemically synthesized
aaactgaaggaagcaaaacctc

SEQ ID NO: 112673 - DNA, 22 bp, Artificial Sequence
  chemically synthesized
aaggaagcaaaacctcagcata

SEQ ID NO: 112674 - DNA, 22 bp, Artificial Sequence
  chemically synthesized
agcataggccttctgaaagctt

SEQ ID NO: 112675 - DNA, 22 bp, Artificial Sequence
  chemically synthesized
ctgaaagcttacgatggctttt

SEQ ID NO: 112676 - DNA, 22 bp, Artificial Sequence
  chemically synthesized
tgaaagcttacgatggcttttc

SEQ ID NO: 112677 - DNA, 22 bp, Artificial Sequence
  chemically synthesized
aaagcttacgatggcttttctt

SEQ ID NO: 112678 - DNA, 22 bp, Artificial Sequence
  chemically synthesized
acgatggcttttctttttttcc

SEQ ID NO: 112679 - DNA, 22 bp, Artificial Sequence
  chemically synthesized
cgatggcttttctttttttccc

SEQ ID NO: 112680 - DNA, 22 bp, Artificial Sequence
  chemically synthesized
ttctttttttcccccagggcaa

SEQ ID NO: 112681 - DNA, 22 bp, Artificial Sequence
  chemically synthesized
tctttttttcccccagggcaaa

SEQ ID NO: 112682 - DNA, 22 bp, Artificial Sequence
  chemically synthesized
ctttttttcccccagggcaaag

SEQ ID NO: 112683 - DNA, 22 bp, Artificial Sequence
  chemically synthesized
tttttttcccccagggcaaagt

SEQ ID NO: 112684 - DNA, 22 bp, Artificial Sequence
  chemically synthesized
tttttcccccagggcaaagtgt

SEQ ID NO: 112685 - DNA, 22 bp, Artificial Sequence
  chemically synthesized
ttttcccccagggcaaagtgtt

SEQ ID NO: 112686 - DNA, 22 bp, Artificial Sequence
  chemically synthesized
tttcccccagggcaaagtgttc

SEQ ID NO: 112687 - DNA, 22 bp, Artificial Sequence
  chemically synthesized
ttcccccagggcaaagtgttct

SEQ ID NO: 112688 - DNA, 22 bp, Artificial Sequence
  chemically synthesized
tcccccagggcaaagtgttctt

SEQ ID NO: 112689 - DNA, 22 bp, Artificial Sequence
  chemically synthesized
cccccagggcaaagtgttctta

SEQ ID NO: 112690 - DNA, 22 bp, Artificial Sequence
  chemically synthesized
ccccagggcaaagtgttcttag

SEQ ID NO: 112691 - DNA, 22 bp, Artificial Sequence
  chemically synthesized
ttaggagcaagatgttggaatt

SEQ ID NO: 112692 - DNA, 22 bp, Artificial Sequence
  chemically synthesized
aggagcaagatgttggaattta

SEQ ID NO: 112693 - DNA, 22 bp, Artificial Sequence
  chemically synthesized
ggagcaagatgttggaatttac

SEQ ID NO: 112694 - DNA, 22 bp, Artificial Sequence
  chemically synthesized
gaatttacaccattcttatgtg

SEQ ID NO: 112695 - DNA, 22 bp, Artificial Sequence
  chemically synthesized
acaccattcttatgtggattaa

SEQ ID NO: 112696 - DNA, 22 bp, Artificial Sequence
  chemically synthesized
caccattcttatgtggattaag

SEQ ID NO: 112697 - DNA, 22 bp, Artificial Sequence
  chemically synthesized
ttatgtggattaagagaggttt

SEQ ID NO: 112698 - DNA, 22 bp, Artificial Sequence
  chemically synthesized
atgtggattaagagaggtttcc

SEQ ID NO: 112699 - DNA, 22 bp, Artificial Sequence
  chemically synthesized
tgtggattaagagaggtttcct

SEQ ID NO: 112700 - DNA, 22 bp, Artificial Sequence
  chemically synthesized
agagaggtttccttctgaggat

SEQ ID NO: 112701 - DNA, 22 bp, Artificial Sequence
  chemically synthesized
ccttctgaggatgttggaagcc

SEQ ID NO: 112702 - DNA, 22 bp, Artificial Sequence
  chemically synthesized
cttctgaggatgttggaagcct

SEQ ID NO: 112703 - DNA, 22 bp, Artificial Sequence
  chemically synthesized
ctgaggatgttggaagcctctg

SEQ ID NO: 112704 - DNA, 22 bp, Artificial Sequence
  chemically synthesized
tgaggatgttggaagcctctgt

SEQ ID NO: 112705 - DNA, 22 bp, Artificial Sequence
  chemically synthesized
aggatgttggaagcctctgttc

SEQ ID NO: 112706 - DNA, 22 bp, Artificial Sequence
  chemically synthesized
gaagcctctgttcaggaacttt

SEQ ID NO: 112707 - DNA, 22 bp, Artificial Sequence
  chemically synthesized
tgttcaggaactttttctttcc

SEQ ID NO: 112708 - DNA, 22 bp, Artificial Sequence
  chemically synthesized
ttcaggaactttttctttccgg

SEQ ID NO: 112709 - DNA, 22 bp, Artificial Sequence
  chemically synthesized
aggaactttttctttccggatc

SEQ ID NO: 112710 - DNA, 22 bp, Artificial Sequence
  chemically synthesized
tttctttccggatcatgcttac

SEQ ID NO: 112711 - DNA, 22 bp, Artificial Sequence
  chemically synthesized
ttctttccggatcatgcttaca

SEQ ID NO: 112712 - DNA, 22 bp, Artificial Sequence
  chemically synthesized
tctttccggatcatgcttacag

SEQ ID NO: 112713 - DNA, 22 bp, Artificial Sequence
  chemically synthesized
ctttccggatcatgcttacaga

SEQ ID NO: 112714 - DNA, 22 bp, Artificial Sequence
  chemically synthesized
tttccggatcatgcttacagat

SEQ ID NO: 112715 - DNA, 22 bp, Artificial Sequence
  chemically synthesized
tccggatcatgcttacagatct

SEQ ID NO: 112716 - DNA, 22 bp, Artificial Sequence
  chemically synthesized
ccggatcatgcttacagatctg

SEQ ID NO: 112717 - DNA, 22 bp, Artificial Sequence
  chemically synthesized
cggatcatgcttacagatctga

SEQ ID NO: 112718 - DNA, 22 bp, Artificial Sequence
  chemically synthesized
acagatctgattacacccaaga

SEQ ID NO: 112719 - DNA, 22 bp, Artificial Sequence
  chemically synthesized
cagatctgattacacccaagaa

SEQ ID NO: 112720 - DNA, 22 bp, Artificial Sequence
  chemically synthesized
attacacccaagaagcctaaat

SEQ ID NO: 112721 - DNA, 22 bp, Artificial Sequence
  chemically synthesized
cacccaagaagcctaaattgtg

SEQ ID NO: 112722 - DNA, 22 bp, Artificial Sequence
  chemically synthesized
aattgtgtgtcagccaactaga

SEQ ID NO: 112723 - DNA, 22 bp, Artificial Sequence
  chemically synthesized
tgtgtcagccaactagatgtgg

SEQ ID NO: 112724 - DNA, 22 bp, Artificial Sequence
  chemically synthesized
gatgtggacaagatagttttta

SEQ ID NO: 112725 - DNA, 22 bp, Artificial Sequence
  chemically synthesized
ttagcctccttctgggactaga

SEQ ID NO: 112726 - DNA, 22 bp, Artificial Sequence
  chemically synthesized
tagcctccttctgggactagat

SEQ ID NO: 112727 - DNA, 22 bp, Artificial Sequence
  chemically synthesized
agcctccttctgggactagata

SEQ ID NO: 112728 - DNA, 22 bp, Artificial Sequence
  chemically synthesized
gcctccttctgggactagatat

SEQ ID NO: 112729 - DNA, 22 bp, Artificial Sequence
  chemically synthesized
cttctgggactagatattcatt

SEQ ID NO: 112730 - DNA, 22 bp, Artificial Sequence
  chemically synthesized
ctgggactagatattcattcac

SEQ ID NO: 112731 - DNA, 22 bp, Artificial Sequence
  chemically synthesized
tgggactagatattcattcacc

SEQ ID NO: 112732 - DNA, 22 bp, Artificial Sequence
  chemically synthesized
ggactagatattcattcaccaa

SEQ ID NO: 112733 - DNA, 22 bp, Artificial Sequence
  chemically synthesized
gatattcattcaccaagatgag

SEQ ID NO: 112734 - DNA, 22 bp, Artificial Sequence
  chemically synthesized
attcaccaagatgagtgccttt

SEQ ID NO: 112735 - DNA, 22 bp, Artificial Sequence
  chemically synthesized
accaagatgagtgcctttgaag

SEQ ID NO: 112736 - DNA, 22 bp, Artificial Sequence
  chemically synthesized
tgaagcagaatctgtgataggg

SEQ ID NO: 112737 - DNA, 22 bp, Artificial Sequence
  chemically synthesized
gaagcagaatctgtgatagggt

SEQ ID NO: 112738 - DNA, 22 bp, Artificial Sequence
  chemically synthesized
aagcagaatctgtgatagggtg

SEQ ID NO: 112739 - DNA, 22 bp, Artificial Sequence
  chemically synthesized
tgatagggtggttgggccacct

SEQ ID NO: 112740 - DNA, 22 bp, Artificial Sequence
  chemically synthesized
ggccacctagagacatatggcc

SEQ ID NO: 112741 - DNA, 22 bp, Artificial Sequence
  chemically synthesized
gagacatatggccatgactaga

SEQ ID NO: 112742 - DNA, 22 bp, Artificial Sequence
  chemically synthesized
gaatctaaggttagacatacag

SEQ ID NO: 112743 - DNA, 22 bp, Artificial Sequence
  chemically synthesized
aggttagacatacagaaaggat

SEQ ID NO: 112744 - DNA, 22 bp, Artificial Sequence
  chemically synthesized
gacatacagaaaggatgaagtc

SEQ ID NO: 112745 - DNA, 22 bp, Artificial Sequence
  chemically synthesized
taaaaataggcattcattcatt

SEQ ID NO: 112746 - DNA, 22 bp, Artificial Sequence
  chemically synthesized
aaaaataggcattcattcattt

SEQ ID NO: 112747 - DNA, 22 bp, Artificial Sequence
  chemically synthesized
aaaataggcattcattcattta

SEQ ID NO: 112748 - DNA, 22 bp, Artificial Sequence
  chemically synthesized
attcatttattcatccattcac

SEQ ID NO: 112749 - DNA, 22 bp, Artificial Sequence
  chemically synthesized
atttattcatccattcacacat

SEQ ID NO: 112750 - DNA, 22 bp, Artificial Sequence
  chemically synthesized
attcatccattcacacatataa

SEQ ID NO: 112751 - DNA, 22 bp, Artificial Sequence
  chemically synthesized
ttcatccattcacacatataac

SEQ ID NO: 112752 - DNA, 22 bp, Artificial Sequence
  chemically synthesized
atccattcacacatataacctg

SEQ ID NO: 112753 - DNA, 22 bp, Artificial Sequence
  chemically synthesized
acacatataacctgagtcccta

SEQ ID NO: 112754 - DNA, 22 bp, Artificial Sequence
  chemically synthesized
agtccctactgattttctagta

SEQ ID NO: 112755 - DNA, 22 bp, Artificial Sequence
  chemically synthesized
ctgattttctagtactgtactg

SEQ ID NO: 112756 - DNA, 22 bp, Artificial Sequence
  chemically synthesized
attttctagtactgtactgaat

SEQ ID NO: 112757 - DNA, 22 bp, Artificial Sequence
  chemically synthesized
tctagtactgtactgaatgagg

SEQ ID NO: 112758 - DNA, 22 bp, Artificial Sequence
  chemically synthesized
ctagtactgtactgaatgaggc

SEQ ID NO: 112759 - DNA, 22 bp, Artificial Sequence
  chemically synthesized
tagtactgtactgaatgaggcc

SEQ ID NO: 112760 - DNA, 22 bp, Artificial Sequence
  chemically synthesized
gtactgtactgaatgaggccaa

SEQ ID NO: 112761 - DNA, 22 bp, Artificial Sequence
  chemically synthesized
tactgaatgaggccaacatgat

SEQ ID NO: 112762 - DNA, 22 bp, Artificial Sequence
  chemically synthesized
aatgaggccaacatgatagaag

SEQ ID NO: 112763 - DNA, 22 bp, Artificial Sequence
  chemically synthesized
aacaaatattaattaaagttat

SEQ ID NO: 112764 - DNA, 22 bp, Artificial Sequence
  chemically synthesized
acaaatattaattaaagttatt

SEQ ID NO: 112765 - DNA, 22 bp, Artificial Sequence
  chemically synthesized
attaaagttattattactagtt

SEQ ID NO: 112766 - DNA, 22 bp, Artificial Sequence
  chemically synthesized
aagttattattactagttagtg

SEQ ID NO: 112767 - DNA, 22 bp, Artificial Sequence
  chemically synthesized
ttattactagttagtggaatac

SEQ ID NO: 112768 - DNA, 22 bp, Artificial Sequence
  chemically synthesized
ttactagttagtggaatactat

SEQ ID NO: 112769 - DNA, 22 bp, Artificial Sequence
  chemically synthesized
ctagttagtggaatactattaa

SEQ ID NO: 112770 - DNA, 22 bp, Artificial Sequence
  chemically synthesized
gttagtggaatactattaacaa

SEQ ID NO: 112771 - DNA, 22 bp, Artificial Sequence
  chemically synthesized
gtggaatactattaacaataat

SEQ ID NO: 112772 - DNA, 22 bp, Artificial Sequence
  chemically synthesized
ttaacaataatattttagcagc

SEQ ID NO: 112773 - DNA, 22 bp, Artificial Sequence
  chemically synthesized
acaataatattttagcagccac

SEQ ID NO: 112774 - DNA, 22 bp, Artificial Sequence
  chemically synthesized
tagcagccactatttgcaaaat

SEQ ID NO: 112775 - DNA, 22 bp, Artificial Sequence
  chemically synthesized
agcagccactatttgcaaaata

SEQ ID NO: 112776 - DNA, 22 bp, Artificial Sequence
  chemically synthesized
gcagccactatttgcaaaatat

SEQ ID NO: 112777 - DNA, 22 bp, Artificial Sequence
  chemically synthesized
tttgcaaaatataacactttta

SEQ ID NO: 112778 - DNA, 22 bp, Artificial Sequence
  chemically synthesized
gcaaaatataacacttttagga

SEQ ID NO: 112779 - DNA, 22 bp, Artificial Sequence
  chemically synthesized
caaaatataacacttttaggag

SEQ ID NO: 112780 - DNA, 22 bp, Artificial Sequence
  chemically synthesized
ttaggagaattacatctattat

SEQ ID NO: 112781 - DNA, 22 bp, Artificial Sequence
  chemically synthesized
taggagaattacatctattata

SEQ ID NO: 112782 - DNA, 22 bp, Artificial Sequence
  chemically synthesized
aggagaattacatctattatac

SEQ ID NO: 112783 - DNA, 22 bp, Artificial Sequence
  chemically synthesized
ggagaattacatctattatacc

SEQ ID NO: 112784 - DNA, 22 bp, Artificial Sequence
  chemically synthesized
catctattatacctcagtaaaa

SEQ ID NO: 112785 - DNA, 22 bp, Artificial Sequence
  chemically synthesized
ttatacctcagtaaaactctat

SEQ ID NO: 112786 - DNA, 22 bp, Artificial Sequence
  chemically synthesized
tacctcagtaaaactctatgaa

SEQ ID NO: 112787 - DNA, 22 bp, Artificial Sequence
  chemically synthesized
agtaaaactctatgaaacagac

SEQ ID NO: 112788 - DNA, 22 bp, Artificial Sequence
  chemically synthesized
tatgaaacagactttttatata

SEQ ID NO: 112789 - DNA, 22 bp, Artificial Sequence
  chemically synthesized
tgaaacagactttttatatatt

SEQ ID NO: 112790 - DNA, 22 bp, Artificial Sequence
  chemically synthesized
tttatatattttttctggataa

SEQ ID NO: 112791 - DNA, 22 bp, Artificial Sequence
  chemically synthesized
ttatatattttttctggataaa

SEQ ID NO: 112792 - DNA, 22 bp, Artificial Sequence
  chemically synthesized
tatatattttttctggataaaa

SEQ ID NO: 112793 - DNA, 22 bp, Artificial Sequence
  chemically synthesized
atatattttttctggataaaaa

SEQ ID NO: 112794 - DNA, 22 bp, Artificial Sequence
  chemically synthesized
tatattttttctggataaaaaa

SEQ ID NO: 112795 - DNA, 22 bp, Artificial Sequence
  chemically synthesized
tttctggataaaaaataaaatc

SEQ ID NO: 112796 - DNA, 22 bp, Artificial Sequence
  chemically synthesized
ttctggataaaaaataaaatct

SEQ ID NO: 112797 - DNA, 22 bp, Artificial Sequence
  chemically synthesized
tctggataaaaaataaaatctg

SEQ ID NO: 112798 - DNA, 22 bp, Artificial Sequence
  chemically synthesized
ctggataaaaaataaaatctga

SEQ ID NO: 112799 - DNA, 22 bp, Artificial Sequence
  chemically synthesized
tggataaaaaataaaatctgat

SEQ ID NO: 112800 - DNA, 22 bp, Artificial Sequence
  chemically synthesized
gataaaaaataaaatctgataa

SEQ ID NO: 112801 - DNA, 22 bp, Artificial Sequence
  chemically synthesized
ataatttgagacatttaaaaaa

SEQ ID NO: 112802 - DNA, 22 bp, Artificial Sequence
  chemically synthesized
gagacatttaaaaaagtataca

SEQ ID NO: 112803 - DNA, 22 bp, Artificial Sequence
  chemically synthesized
agacatttaaaaaagtatacaa

SEQ ID NO: 112804 - DNA, 22 bp, Artificial Sequence
  chemically synthesized
aaaaaagtatacaactagtaag

SEQ ID NO: 112805 - DNA, 22 bp, Artificial Sequence
  chemically synthesized
aaaaagtatacaactagtaagt

SEQ ID NO: 112806 - DNA, 22 bp, Artificial Sequence
  chemically synthesized
gtaagtagttgtatttttaaaa

SEQ ID NO: 112807 - DNA, 22 bp, Artificial Sequence
  chemically synthesized
tatttttaaaattttccattca

SEQ ID NO: 112808 - DNA, 22 bp, Artificial Sequence
  chemically synthesized
ttaaaattttccattcactatc

SEQ ID NO: 112809 - DNA, 22 bp, Artificial Sequence
  chemically synthesized
taaaattttccattcactatcc

SEQ ID NO: 112810 - DNA, 22 bp, Artificial Sequence
  chemically synthesized
aaaattttccattcactatcct

SEQ ID NO: 112811 - DNA, 22 bp, Artificial Sequence
  chemically synthesized
aaattttccattcactatccta

SEQ ID NO: 112812 - DNA, 22 bp, Artificial Sequence
  chemically synthesized
tccattcactatcctaaatatg

SEQ ID NO: 112813 - DNA, 22 bp, Artificial Sequence
  chemically synthesized
ccattcactatcctaaatatgt

SEQ ID NO: 112814 - DNA, 22 bp, Artificial Sequence
  chemically synthesized
cattcactatcctaaatatgtc

SEQ ID NO: 112815 - DNA, 22 bp, Artificial Sequence
  chemically synthesized
actatcctaaatatgtctatga

SEQ ID NO: 112816 - DNA, 22 bp, Artificial Sequence
  chemically synthesized
tcctaaatatgtctatgatata

SEQ ID NO: 112817 - DNA, 22 bp, Artificial Sequence
  chemically synthesized
aatatgtctatgatataattta

SEQ ID NO: 112818 - DNA, 22 bp, Artificial Sequence
  chemically synthesized
tgatataatttaaaaaattata

SEQ ID NO: 112819 - DNA, 22 bp, Artificial Sequence
  chemically synthesized
aaaaaattatatatactccatg

SEQ ID NO: 112820 - DNA, 22 bp, Artificial Sequence
  chemically synthesized
aaaaattatatatactccatgt

SEQ ID NO: 112821 - DNA, 22 bp, Artificial Sequence
  chemically synthesized
tatatactccatgtatattaaa

SEQ ID NO: 112822 - DNA, 22 bp, Artificial Sequence
  chemically synthesized
catgtatattaaatataaagta

SEQ ID NO: 112823 - DNA, 22 bp, Artificial Sequence
  chemically synthesized
aatataaagtaaagacctttta

SEQ ID NO: 112824 - DNA, 22 bp, Artificial Sequence
  chemically synthesized
ttatccttacctttctatcctc

SEQ ID NO: 112825 - DNA, 22 bp, Artificial Sequence
  chemically synthesized
tatccttacctttctatcctcc

SEQ ID NO: 112826 - DNA, 22 bp, Artificial Sequence
  chemically synthesized
atccttacctttctatcctccc

SEQ ID NO: 112827 - DNA, 22 bp, Artificial Sequence
  chemically synthesized
tccttacctttctatcctccct

SEQ ID NO: 112828 - DNA, 22 bp, Artificial Sequence
  chemically synthesized
acctttctatcctccctggaga

SEQ ID NO: 112829 - DNA, 22 bp, Artificial Sequence
  chemically synthesized
cctttctatcctccctggagat

SEQ ID NO: 112830 - DNA, 22 bp, Artificial Sequence
  chemically synthesized
tctatcctccctggagataatt

SEQ ID NO: 112831 - DNA, 22 bp, Artificial Sequence
  chemically synthesized
ctatcctccctggagataattt

SEQ ID NO: 112832 - DNA, 22 bp, Artificial Sequence
  chemically synthesized
tatcctccctggagataatttc

SEQ ID NO: 112833 - DNA, 22 bp, Artificial Sequence
  chemically synthesized
tcctccctggagataatttccc

SEQ ID NO: 112834 - DNA, 22 bp, Artificial Sequence
  chemically synthesized
cctggagataatttccctttat

SEQ ID NO: 112835 - DNA, 22 bp, Artificial Sequence
  chemically synthesized
gagataatttccctttataatc

SEQ ID NO: 112836 - DNA, 22 bp, Artificial Sequence
  chemically synthesized
ccctttataatctgccatacat

SEQ ID NO: 112837 - DNA, 22 bp, Artificial Sequence
  chemically synthesized
cctttataatctgccatacatt

SEQ ID NO: 112838 - DNA, 22 bp, Artificial Sequence
  chemically synthesized
tataatctgccatacatttctc

SEQ ID NO: 112839 - DNA, 22 bp, Artificial Sequence
  chemically synthesized
ataatctgccatacatttctct

SEQ ID NO: 112840 - DNA, 22 bp, Artificial Sequence
  chemically synthesized
taatctgccatacatttctctg

SEQ ID NO: 112841 - DNA, 22 bp, Artificial Sequence
  chemically synthesized
ccatacatttctctgcaacttt

SEQ ID NO: 112842 - DNA, 22 bp, Artificial Sequence
  chemically synthesized
ctctgcaacttttctacacatt

SEQ ID NO: 112843 - DNA, 22 bp, Artificial Sequence
  chemically synthesized
tctgcaacttttctacacattt

SEQ ID NO: 112844 - DNA, 22 bp, Artificial Sequence
  chemically synthesized
tgcaacttttctacacatttat

SEQ ID NO: 112845 - DNA, 22 bp, Artificial Sequence
  chemically synthesized
caacttttctacacatttatat

SEQ ID NO: 112846 - DNA, 22 bp, Artificial Sequence
  chemically synthesized
ttctacacatttatatatacat

SEQ ID NO: 112847 - DNA, 22 bp, Artificial Sequence
  chemically synthesized
tctacacatttatatatacata

SEQ ID NO: 112848 - DNA, 22 bp, Artificial Sequence
  chemically synthesized
ctacacatttatatatacatat

SEQ ID NO: 112849 - DNA, 22 bp, Artificial Sequence
  chemically synthesized
tacacatttatatatacatata

SEQ ID NO: 112850 - DNA, 22 bp, Artificial Sequence
  chemically synthesized
cacatttatatatacatatatg

SEQ ID NO: 112851 - DNA, 22 bp, Artificial Sequence
  chemically synthesized
atatatacatatatgaacatac

SEQ ID NO: 112852 - DNA, 22 bp, Artificial Sequence
  chemically synthesized
tatatacatatatgaacatact

SEQ ID NO: 112853 - DNA, 22 bp, Artificial Sequence
  chemically synthesized
aaataaatagtcctattggctg

SEQ ID NO: 112854 - DNA, 22 bp, Artificial Sequence
  chemically synthesized
ttggctggtagcaagggctatg

SEQ ID NO: 112855 - DNA, 22 bp, Artificial Sequence
  chemically synthesized
gctggtagcaagggctatgtgt

SEQ ID NO: 112856 - DNA, 22 bp, Artificial Sequence
  chemically synthesized
gtagcaagggctatgtgtagca

SEQ ID NO: 112857 - DNA, 22 bp, Artificial Sequence
  chemically synthesized
tgtgtagcactgttatttccat

SEQ ID NO: 112858 - DNA, 22 bp, Artificial Sequence
  chemically synthesized
ttatttccatgatgccacacta

SEQ ID NO: 112859 - DNA, 22 bp, Artificial Sequence
  chemically synthesized
tttccatgatgccacactaaaa

SEQ ID NO: 112860 - DNA, 22 bp, Artificial Sequence
  chemically synthesized
ccatgatgccacactaaaatca

SEQ ID NO: 112861 - DNA, 22 bp, Artificial Sequence
  chemically synthesized
catgatgccacactaaaatcag

SEQ ID NO: 112862 - DNA, 22 bp, Artificial Sequence
  chemically synthesized
aaatcagtgctgcttgtctgca

SEQ ID NO: 112863 - DNA, 22 bp, Artificial Sequence
  chemically synthesized
cttgtctgcatttttgtgttac

SEQ ID NO: 112864 - DNA, 22 bp, Artificial Sequence
  chemically synthesized
gtctgcatttttgtgttacagt

SEQ ID NO: 112865 - DNA, 22 bp, Artificial Sequence
  chemically synthesized
tctgcatttttgtgttacagtg

SEQ ID NO: 112866 - DNA, 22 bp, Artificial Sequence
  chemically synthesized
catttttgtgttacagtgaatg

SEQ ID NO: 112867 - DNA, 22 bp, Artificial Sequence
  chemically synthesized
ttgtgttacagtgaatgtagac

SEQ ID NO: 112868 - DNA, 22 bp, Artificial Sequence
  chemically synthesized
tgtgttacagtgaatgtagact

SEQ ID NO: 112869 - DNA, 22 bp, Artificial Sequence
  chemically synthesized
gtgttacagtgaatgtagacta

SEQ ID NO: 112870 - DNA, 22 bp, Artificial Sequence
  chemically synthesized
tgttacagtgaatgtagactaa

SEQ ID NO: 112871 - DNA, 22 bp, Artificial Sequence
  chemically synthesized
cagtgaatgtagactaaaatcc

SEQ ID NO: 112872 - DNA, 22 bp, Artificial Sequence
  chemically synthesized
aaatccaaaataagtcaacagt

SEQ ID NO: 112873 - DNA, 22 bp, Artificial Sequence
  chemically synthesized
ttaaaagtgatgacctcattgg

SEQ ID NO: 112874 - DNA, 22 bp, Artificial Sequence
  chemically synthesized
aaagtgatgacctcattggttt

SEQ ID NO: 112875 - DNA, 22 bp, Artificial Sequence
  chemically synthesized
attggttttgctatcaacatag

SEQ ID NO: 112876 - DNA, 22 bp, Artificial Sequence
  chemically synthesized
gttttgctatcaacatagaaag

SEQ ID NO: 112877 - DNA, 22 bp, Artificial Sequence
  chemically synthesized
tgctatcaacatagaaagaaag

SEQ ID NO: 112878 - DNA, 22 bp, Artificial Sequence
  chemically synthesized
gctatcaacatagaaagaaagg

SEQ ID NO: 112879 - DNA, 22 bp, Artificial Sequence
  chemically synthesized
ctatcaacatagaaagaaaggg

SEQ ID NO: 112880 - DNA, 22 bp, Artificial Sequence
  chemically synthesized
tcaacatagaaagaaagggaag

SEQ ID NO: 112881 - DNA, 22 bp, Artificial Sequence
  chemically synthesized
tctcaggatttttactcaagga

SEQ ID NO: 112882 - DNA, 22 bp, Artificial Sequence
  chemically synthesized
ctcaggatttttactcaaggaa

SEQ ID NO: 112883 - DNA, 22 bp, Artificial Sequence
  chemically synthesized
tcaggatttttactcaaggaaa

SEQ ID NO: 112884 - DNA, 22 bp, Artificial Sequence
  chemically synthesized
aggatttttactcaaggaaagg

SEQ ID NO: 112885 - DNA, 22 bp, Artificial Sequence
  chemically synthesized
ttactcaaggaaaggcagtggg

SEQ ID NO: 112886 - DNA, 22 bp, Artificial Sequence
  chemically synthesized
tactcaaggaaaggcagtgggg

SEQ ID NO: 112887 - DNA, 22 bp, Artificial Sequence
  chemically synthesized
actcaaggaaaggcagtgggga

SEQ ID NO: 112888 - DNA, 22 bp, Artificial Sequence
  chemically synthesized
ctcaaggaaaggcagtggggaa

SEQ ID NO: 112889 - DNA, 22 bp, Artificial Sequence
  chemically synthesized
aaggaaaggcagtggggaaaga

SEQ ID NO: 112890 - DNA, 22 bp, Artificial Sequence
  chemically synthesized
tggtattctgtgtcaatctgta

SEQ ID NO: 112891 - DNA, 22 bp, Artificial Sequence
  chemically synthesized
ggtattctgtgtcaatctgtat

SEQ ID NO: 112892 - DNA, 22 bp, Artificial Sequence
  chemically synthesized
gtattctgtgtcaatctgtatc

SEQ ID NO: 112893 - DNA, 22 bp, Artificial Sequence
  chemically synthesized
tgtgtcaatctgtatcaacaag

SEQ ID NO: 112894 - DNA, 22 bp, Artificial Sequence
  chemically synthesized
tgtcaatctgtatcaacaagat

SEQ ID NO: 112895 - DNA, 22 bp, Artificial Sequence
  chemically synthesized
tatcaacaagatcttcaaacct

SEQ ID NO: 112896 - DNA, 22 bp, Artificial Sequence
  chemically synthesized
caaacctccctctgcatggccc

SEQ ID NO: 112897 - DNA, 22 bp, Artificial Sequence
  chemically synthesized
aaacctccctctgcatggcccc

SEQ ID NO: 112898 - DNA, 22 bp, Artificial Sequence
  chemically synthesized
cctctgcatggccccaggagag

SEQ ID NO: 112899 - DNA, 22 bp, Artificial Sequence
  chemically synthesized
tgcatggccccaggagagtcag

SEQ ID NO: 112900 - DNA, 22 bp, Artificial Sequence
  chemically synthesized
catggccccaggagagtcagtg

SEQ ID NO: 112901 - DNA, 22 bp, Artificial Sequence
  chemically synthesized
cacaaacctctcctgccatctt

SEQ ID NO: 112902 - DNA, 22 bp, Artificial Sequence
  chemically synthesized
tcctgccatcttatggtttgta

SEQ ID NO: 112903 - DNA, 22 bp, Artificial Sequence
  chemically synthesized
ctgccatcttatggtttgtaca

SEQ ID NO: 112904 - DNA, 22 bp, Artificial Sequence
  chemically synthesized
ccatcttatggtttgtacagca

SEQ ID NO: 112905 - DNA, 22 bp, Artificial Sequence
  chemically synthesized
atggtttgtacagcatgtgcaa

SEQ ID NO: 112906 - DNA, 22 bp, Artificial Sequence
  chemically synthesized
tggtttgtacagcatgtgcaag

SEQ ID NO: 112907 - DNA, 22 bp, Artificial Sequence
  chemically synthesized
gtacagcatgtgcaagctgctt

SEQ ID NO: 112908 - DNA, 22 bp, Artificial Sequence
  chemically synthesized
tacagcatgtgcaagctgcttc

SEQ ID NO: 112909 - DNA, 22 bp, Artificial Sequence
  chemically synthesized
cttctatagaaatgcatataga

SEQ ID NO: 112910 - DNA, 22 bp, Artificial Sequence
  chemically synthesized
ctatagaaatgcatatagaaaa

SEQ ID NO: 112911 - DNA, 22 bp, Artificial Sequence
  chemically synthesized
tatagaaatgcatatagaaaat

SEQ ID NO: 112912 - DNA, 22 bp, Artificial Sequence
  chemically synthesized
tagaaatgcatatagaaaatac

SEQ ID NO: 112913 - DNA, 22 bp, Artificial Sequence
  chemically synthesized
gaggctaccaagttgtaattta

SEQ ID NO: 112914 - DNA, 22 bp, Artificial Sequence
  chemically synthesized
ccaagttgtaatttaaaaataa

SEQ ID NO: 112915 - DNA, 22 bp, Artificial Sequence
  chemically synthesized
taatttaaaaataatgctcata

SEQ ID NO: 112916 - DNA, 22 bp, Artificial Sequence
  chemically synthesized
aaaaataatgctcataatcatc

SEQ ID NO: 112917 - DNA, 22 bp, Artificial Sequence
  chemically synthesized
aaaataatgctcataatcatca

SEQ ID NO: 112918 - DNA, 22 bp, Artificial Sequence
  chemically synthesized
ataatcatcaatgtatttatta

SEQ ID NO: 112919 - DNA, 22 bp, Artificial Sequence
  chemically synthesized
attattatcattaacagtcaca

SEQ ID NO: 112920 - DNA, 22 bp, Artificial Sequence
  chemically synthesized
ttattatcattaacagtcacag

SEQ ID NO: 112921 - DNA, 22 bp, Artificial Sequence
  chemically synthesized
ttatcattaacagtcacagtct

SEQ ID NO: 112922 - DNA, 22 bp, Artificial Sequence
  chemically synthesized
tcattaacagtcacagtctttt

SEQ ID NO: 112923 - DNA, 22 bp, Artificial Sequence
  chemically synthesized
acagtcacagtcttttatagta

SEQ ID NO: 112924 - DNA, 22 bp, Artificial Sequence
  chemically synthesized
ttatagtaaatcctaaagttga

SEQ ID NO: 112925 - DNA, 22 bp, Artificial Sequence
  chemically synthesized
tatagtaaatcctaaagttgaa

SEQ ID NO: 112926 - DNA, 22 bp, Artificial Sequence
  chemically synthesized
atagtaaatcctaaagttgaag

SEQ ID NO: 112927 - DNA, 22 bp, Artificial Sequence
  chemically synthesized
tagtaaatcctaaagttgaagg

SEQ ID NO: 112928 - DNA, 22 bp, Artificial Sequence
  chemically synthesized
aagttgaaggtttgaatgttta

SEQ ID NO: 112929 - DNA, 22 bp, Artificial Sequence
  chemically synthesized
aaggtttgaatgtttaatgcta

SEQ ID NO: 112930 - DNA, 22 bp, Artificial Sequence
  chemically synthesized
gaatgtttaatgctatgaaata

SEQ ID NO: 112931 - DNA, 22 bp, Artificial Sequence
  chemically synthesized
aatgtttaatgctatgaaatat

SEQ ID NO: 112932 - DNA, 22 bp, Artificial Sequence
  chemically synthesized
aatgctatgaaatattaaataa

SEQ ID NO: 112933 - DNA, 22 bp, Artificial Sequence
  chemically synthesized
atgctatgaaatattaaataag

SEQ ID NO: 112934 - DNA, 22 bp, Artificial Sequence
  chemically synthesized
tgaaatattaaataagtgacga

SEQ ID NO: 112935 - DNA, 22 bp, Artificial Sequence
  chemically synthesized
aataagtgacgatagtatcttt

SEQ ID NO: 112936 - DNA, 22 bp, Artificial Sequence
  chemically synthesized
ttatgctgactgtccaggattg

SEQ ID NO: 112937 - DNA, 22 bp, Artificial Sequence
  chemically synthesized
tatgctgactgtccaggattgg

SEQ ID NO: 112938 - DNA, 22 bp, Artificial Sequence
  chemically synthesized
atgctgactgtccaggattgga

SEQ ID NO: 112939 - DNA, 22 bp, Artificial Sequence
  chemically synthesized
tgctgactgtccaggattggaa

SEQ ID NO: 112940 - DNA, 22 bp, Artificial Sequence
  chemically synthesized
actgtccaggattggaaatgct

SEQ ID NO: 112941 - DNA, 22 bp, Artificial Sequence
  chemically synthesized
tccaggattggaaatgctacag

SEQ ID NO: 112942 - DNA, 22 bp, Artificial Sequence
  chemically synthesized
gaaatgctacagcaaagtgaga

SEQ ID NO: 112943 - DNA, 22 bp, Artificial Sequence
  chemically synthesized
cagcaaagtgagataggcattt

SEQ ID NO: 112944 - DNA, 22 bp, Artificial Sequence
  chemically synthesized
tatgtatatcatctgcaaagac

SEQ ID NO: 112945 - DNA, 22 bp, Artificial Sequence
  chemically synthesized
atgtatatcatctgcaaagact

SEQ ID NO: 112946 - DNA, 22 bp, Artificial Sequence
  chemically synthesized
tgtatatcatctgcaaagacta

SEQ ID NO: 112947 - DNA, 22 bp, Artificial Sequence
  chemically synthesized
caaagactaaactaaaatagct

SEQ ID NO: 112948 - DNA, 22 bp, Artificial Sequence
  chemically synthesized
aactaaaatagctgggttgtca

SEQ ID NO: 112949 - DNA, 22 bp, Artificial Sequence
  chemically synthesized
aaatagctgggttgtcaggtca

SEQ ID NO: 112950 - DNA, 22 bp, Artificial Sequence
  chemically synthesized
ggttgtcaggtcagagcaattt

SEQ ID NO: 112951 - DNA, 22 bp, Artificial Sequence
  chemically synthesized
tcaggtcagagcaatttacagg

SEQ ID NO: 112952 - DNA, 22 bp, Artificial Sequence
  chemically synthesized
acagggaaaattaaattcaaat

SEQ ID NO: 112953 - DNA, 22 bp, Artificial Sequence
  chemically synthesized
cagggaaaattaaattcaaatc

SEQ ID NO: 112954 - DNA, 22 bp, Artificial Sequence
  chemically synthesized
aattcaaatcttcagaggatca

SEQ ID NO: 112955 - DNA, 22 bp, Artificial Sequence
  chemically synthesized
aaatcttcagaggatcatttgt

SEQ ID NO: 112956 - DNA, 22 bp, Artificial Sequence
  chemically synthesized
cagaggatcatttgttggtatg

SEQ ID NO: 112957 - DNA, 22 bp, Artificial Sequence
  chemically synthesized
agaggatcatttgttggtatgt

SEQ ID NO: 112958 - DNA, 22 bp, Artificial Sequence
  chemically synthesized
gttggtatgtctctgtccaatt

SEQ ID NO: 112959 - DNA, 22 bp, Artificial Sequence
  chemically synthesized
ttggtatgtctctgtccaattt

SEQ ID NO: 112960 - DNA, 22 bp, Artificial Sequence
  chemically synthesized
gtatgtctctgtccaatttgag

SEQ ID NO: 112961 - DNA, 22 bp, Artificial Sequence
  chemically synthesized
tgtccaatttgagggcaataat

SEQ ID NO: 112962 - DNA, 22 bp, Artificial Sequence
  chemically synthesized
tccaatttgagggcaataattt

SEQ ID NO: 112963 - DNA, 22 bp, Artificial Sequence
  chemically synthesized
gagggcaataatttaatgccag

SEQ ID NO: 112964 - DNA, 22 bp, Artificial Sequence
  chemically synthesized
agggcaataatttaatgccaga

SEQ ID NO: 112965 - DNA, 22 bp, Artificial Sequence
  chemically synthesized
aatgccagaaaatatctattct

SEQ ID NO: 112966 - DNA, 22 bp, Artificial Sequence
  chemically synthesized
atgccagaaaatatctattctt

SEQ ID NO: 112967 - DNA, 22 bp, Artificial Sequence
  chemically synthesized
ttctttatctcactctctttct

SEQ ID NO: 112968 - DNA, 22 bp, Artificial Sequence
  chemically synthesized
tttatctcactctctttctttc

SEQ ID NO: 112969 - DNA, 22 bp, Artificial Sequence
  chemically synthesized
tatctcactctctttctttcat

SEQ ID NO: 112970 - DNA, 22 bp, Artificial Sequence
  chemically synthesized
atctcactctctttctttcatt

SEQ ID NO: 112971 - DNA, 22 bp, Artificial Sequence
  chemically synthesized
tctcactctctttctttcattc

SEQ ID NO: 112972 - DNA, 22 bp, Artificial Sequence
  chemically synthesized
actctctttctttcattcttac

SEQ ID NO: 112973 - DNA, 22 bp, Artificial Sequence
  chemically synthesized
tctttctttcattcttactttc

SEQ ID NO: 112974 - DNA, 22 bp, Artificial Sequence
  chemically synthesized
tttctttcattcttactttctg

SEQ ID NO: 112975 - DNA, 22 bp, Artificial Sequence
  chemically synthesized
tctttcattcttactttctgtc

SEQ ID NO: 112976 - DNA, 22 bp, Artificial Sequence
  chemically synthesized
ctttcattcttactttctgtct

SEQ ID NO: 112977 - DNA, 22 bp, Artificial Sequence
  chemically synthesized
tttcattcttactttctgtctt

SEQ ID NO: 112978 - DNA, 22 bp, Artificial Sequence
  chemically synthesized
tcattcttactttctgtctttc

SEQ ID NO: 112979 - DNA, 22 bp, Artificial Sequence
  chemically synthesized
cattcttactttctgtctttct

SEQ ID NO: 112980 - DNA, 22 bp, Artificial Sequence
  chemically synthesized
attcttactttctgtctttctc

SEQ ID NO: 112981 - DNA, 22 bp, Artificial Sequence
  chemically synthesized
ttactttctgtctttctccctt

SEQ ID NO: 112982 - DNA, 22 bp, Artificial Sequence
  chemically synthesized
actttctgtctttctccctttc

SEQ ID NO: 112983 - DNA, 22 bp, Artificial Sequence
  chemically synthesized
ctttctgtctttctccctttct

SEQ ID NO: 112984 - DNA, 22 bp, Artificial Sequence
  chemically synthesized
tctgtctttctccctttctcac

SEQ ID NO: 112985 - DNA, 22 bp, Artificial Sequence
  chemically synthesized
ctgtctttctccctttctcact

SEQ ID NO: 112986 - DNA, 22 bp, Artificial Sequence
  chemically synthesized
tgtctttctccctttctcactc

SEQ ID NO: 112987 - DNA, 22 bp, Artificial Sequence
  chemically synthesized
tctttctccctttctcactctt

SEQ ID NO: 112988 - DNA, 22 bp, Artificial Sequence
  chemically synthesized
tctccctttctcactctttctg

SEQ ID NO: 112989 - DNA, 22 bp, Artificial Sequence
  chemically synthesized
ctccctttctcactctttctgt

SEQ ID NO: 112990 - DNA, 22 bp, Artificial Sequence
  chemically synthesized
tccctttctcactctttctgtg

SEQ ID NO: 112991 - DNA, 22 bp, Artificial Sequence
  chemically synthesized
cctttctcactctttctgtgtt

SEQ ID NO: 112992 - DNA, 22 bp, Artificial Sequence
  chemically synthesized
tctcactctttctgtgtttaga

SEQ ID NO: 112993 - DNA, 22 bp, Artificial Sequence
  chemically synthesized
ctcactctttctgtgtttagaa

SEQ ID NO: 112994 - DNA, 22 bp, Artificial Sequence
  chemically synthesized
tcactctttctgtgtttagaaa

SEQ ID NO: 112995 - DNA, 22 bp, Artificial Sequence
  chemically synthesized
actctttctgtgtttagaaatg

SEQ ID NO: 112996 - DNA, 22 bp, Artificial Sequence
  chemically synthesized
tttctgtgtttagaaatgaata

SEQ ID NO: 112997 - DNA, 22 bp, Artificial Sequence
  chemically synthesized
tctgtgtttagaaatgaataat

SEQ ID NO: 112998 - DNA, 22 bp, Artificial Sequence
  chemically synthesized
ctgtgtttagaaatgaataata

SEQ ID NO: 112999 - DNA, 22 bp, Artificial Sequence
  chemically synthesized
tgtgtttagaaatgaataatag

SEQ ID NO: 113000 - DNA, 22 bp, Artificial Sequence
  chemically synthesized
tgtttagaaatgaataatagaa

SEQ ID NO: 113001 - DNA, 22 bp, Artificial Sequence
  chemically synthesized
agaaatgaataatagaataact

SEQ ID NO: 113002 - DNA, 22 bp, Artificial Sequence
  chemically synthesized
gaaatgaataatagaataacta

SEQ ID NO: 113003 - DNA, 22 bp, Artificial Sequence
  chemically synthesized
aatacatttatttaacaagcgg

SEQ ID NO: 113004 - DNA, 22 bp, Artificial Sequence
  chemically synthesized
atttaacaagcggtcattgttt

SEQ ID NO: 113005 - DNA, 22 bp, Artificial Sequence
  chemically synthesized
tttaacaagcggtcattgttta

SEQ ID NO: 113006 - DNA, 22 bp, Artificial Sequence
  chemically synthesized
aacaagcggtcattgtttagtt

SEQ ID NO: 113007 - DNA, 22 bp, Artificial Sequence
  chemically synthesized
acaagcggtcattgtttagttg

SEQ ID NO: 113008 - DNA, 22 bp, Artificial Sequence
  chemically synthesized
tttagttgtttgtttatctaat

SEQ ID NO: 113009 - DNA, 22 bp, Artificial Sequence
  chemically synthesized
agttgtttgtttatctaatgag

SEQ ID NO: 113010 - DNA, 22 bp, Artificial Sequence
  chemically synthesized
gttgtttgtttatctaatgaga

SEQ ID NO: 113011 - DNA, 22 bp, Artificial Sequence
  chemically synthesized
tttgtttatctaatgagaggct

SEQ ID NO: 113012 - DNA, 22 bp, Artificial Sequence
  chemically synthesized
gtttatctaatgagaggcttct

SEQ ID NO: 113013 - DNA, 22 bp, Artificial Sequence
  chemically synthesized
tttatctaatgagaggcttctc

SEQ ID NO: 113014 - DNA, 22 bp, Artificial Sequence
  chemically synthesized
atctaatgagaggcttctctat

SEQ ID NO: 113015 - DNA, 22 bp, Artificial Sequence
  chemically synthesized
tctaatgagaggcttctctatt

SEQ ID NO: 113016 - DNA, 22 bp, Artificial Sequence
  chemically synthesized
atgagaggcttctctattttag

SEQ ID NO: 113017 - DNA, 22 bp, Artificial Sequence
  chemically synthesized
ctctattttagcaactactggg

SEQ ID NO: 113018 - DNA, 22 bp, Artificial Sequence
  chemically synthesized
tctattttagcaactactgggt

SEQ ID NO: 113019 - DNA, 22 bp, Artificial Sequence
  chemically synthesized
tattttagcaactactgggtac

SEQ ID NO: 113020 - DNA, 22 bp, Artificial Sequence
  chemically synthesized
ttttagcaactactgggtacaa

SEQ ID NO: 113021 - DNA, 22 bp, Artificial Sequence
  chemically synthesized
tagcaactactgggtacaaaaa

SEQ ID NO: 113022 - DNA, 22 bp, Artificial Sequence
  chemically synthesized
agcaactactgggtacaaaaat

SEQ ID NO: 113023 - DNA, 22 bp, Artificial Sequence
  chemically synthesized
gcaactactgggtacaaaaata

SEQ ID NO: 113024 - DNA, 22 bp, Artificial Sequence
  chemically synthesized
ctgggtacaaaaatacattggt

SEQ ID NO: 113025 - DNA, 22 bp, Artificial Sequence
  chemically synthesized
ggtacaaaaatacattggtgca

SEQ ID NO: 113026 - DNA, 22 bp, Artificial Sequence
  chemically synthesized
gtgcatatattctctgttccta

SEQ ID NO: 113027 - DNA, 22 bp, Artificial Sequence
  chemically synthesized
tctgttcctatgaagcttgtat

SEQ ID NO: 113028 - DNA, 22 bp, Artificial Sequence
  chemically synthesized
tgttcctatgaagcttgtattt

SEQ ID NO: 113029 - DNA, 22 bp, Artificial Sequence
  chemically synthesized
ttcctatgaagcttgtatttta

SEQ ID NO: 113030 - DNA, 22 bp, Artificial Sequence
  chemically synthesized
ctatgaagcttgtattttaacg

SEQ ID NO: 113031 - DNA, 22 bp, Artificial Sequence
  chemically synthesized
tgaagcttgtattttaacggaa

SEQ ID NO: 113032 - DNA, 22 bp, Artificial Sequence
  chemically synthesized
gtattttaacggaaaggaaata

SEQ ID NO: 113033 - DNA, 22 bp, Artificial Sequence
  chemically synthesized
tattttaacggaaaggaaataa

SEQ ID NO: 113034 - DNA, 22 bp, Artificial Sequence
  chemically synthesized
taacggaaaggaaataataaaa

SEQ ID NO: 113035 - DNA, 22 bp, Artificial Sequence
  chemically synthesized
aacggaaaggaaataataaaaa

SEQ ID NO: 113036 - DNA, 22 bp, Artificial Sequence
  chemically synthesized
acggaaaggaaataataaaaaa

SEQ ID NO: 113037 - DNA, 22 bp, Artificial Sequence
  chemically synthesized
caacctcatatagctgctatga

SEQ ID NO: 113038 - DNA, 22 bp, Artificial Sequence
  chemically synthesized
atatagctgctatgaaagaaag

SEQ ID NO: 113039 - DNA, 22 bp, Artificial Sequence
  chemically synthesized
ctatgaaagaaagaaaaaattt

SEQ ID NO: 113040 - DNA, 22 bp, Artificial Sequence
  chemically synthesized
tgaaagaaagaaaaaatttgat

SEQ ID NO: 113041 - DNA, 22 bp, Artificial Sequence
  chemically synthesized
gatgcaatagagaataacaaaa

SEQ ID NO: 113042 - DNA, 22 bp, Artificial Sequence
  chemically synthesized
atgcaatagagaataacaaaat

SEQ ID NO: 113043 - DNA, 22 bp, Artificial Sequence
  chemically synthesized
atgtaagctagtgtgacaaatg

SEQ ID NO: 113044 - DNA, 22 bp, Artificial Sequence
  chemically synthesized
tgtaagctagtgtgacaaatgc

SEQ ID NO: 113045 - DNA, 22 bp, Artificial Sequence
  chemically synthesized
gtgtgacaaatgcgggttctga

SEQ ID NO: 113046 - DNA, 22 bp, Artificial Sequence
  chemically synthesized
tgagaggaggtaatatttcagc

SEQ ID NO: 113047 - DNA, 22 bp, Artificial Sequence
  chemically synthesized
agaggaggtaatatttcagctg

SEQ ID NO: 113048 - DNA, 22 bp, Artificial Sequence
  chemically synthesized
cagctgtgacctgagagttgta

SEQ ID NO: 113049 - DNA, 22 bp, Artificial Sequence
  chemically synthesized
agctgtgacctgagagttgtag

SEQ ID NO: 113050 - DNA, 22 bp, Artificial Sequence
  chemically synthesized
tgacctgagagttgtagaggca

SEQ ID NO: 113051 - DNA, 22 bp, Artificial Sequence
  chemically synthesized
agagttgtagaggcaaaagaag

SEQ ID NO: 113052 - DNA, 22 bp, Artificial Sequence
  chemically synthesized
tagaggcaaaagaagtattgcc

SEQ ID NO: 113053 - DNA, 22 bp, Artificial Sequence
  chemically synthesized
ccatagtggtattggtcctgga

SEQ ID NO: 113054 - DNA, 22 bp, Artificial Sequence
  chemically synthesized
gtcctggagctctggttcaatg

SEQ ID NO: 113055 - DNA, 22 bp, Artificial Sequence
  chemically synthesized
gagctctggttcaatgagcaga

SEQ ID NO: 113056 - DNA, 22 bp, Artificial Sequence
  chemically synthesized
tggttcaatgagcagacagaag

SEQ ID NO: 113057 - DNA, 22 bp, Artificial Sequence
  chemically synthesized
gttcaatgagcagacagaagga

SEQ ID NO: 113058 - DNA, 22 bp, Artificial Sequence
  chemically synthesized
aatgagcagacagaaggaagag

SEQ ID NO: 113059 - DNA, 22 bp, Artificial Sequence
  chemically synthesized
caggaaaaagacttacacatga

SEQ ID NO: 113060 - DNA, 22 bp, Artificial Sequence
  chemically synthesized
aggaaaaagacttacacatgat

SEQ ID NO: 113061 - DNA, 22 bp, Artificial Sequence
  chemically synthesized
acacatgattggggctacccaa

SEQ ID NO: 113062 - DNA, 22 bp, Artificial Sequence
  chemically synthesized
cacatgattggggctacccaaa

SEQ ID NO: 113063 - DNA, 22 bp, Artificial Sequence
  chemically synthesized
gggctacccaaagggactggtt

SEQ ID NO: 113064 - DNA, 22 bp, Artificial Sequence
  chemically synthesized
cccaaagggactggtttttcca

SEQ ID NO: 113065 - DNA, 22 bp, Artificial Sequence
  chemically synthesized
gtttttccaagagcagataatt

SEQ ID NO: 113066 - DNA, 22 bp, Artificial Sequence
  chemically synthesized
ttccaagagcagataatttgag

SEQ ID NO: 113067 - DNA, 22 bp, Artificial Sequence
  chemically synthesized
tccaagagcagataatttgagt

SEQ ID NO: 113068 - DNA, 22 bp, Artificial Sequence
  chemically synthesized
ccaagagcagataatttgagtg

SEQ ID NO: 113069 - DNA, 22 bp, Artificial Sequence
  chemically synthesized
caagagcagataatttgagtga

SEQ ID NO: 113070 - DNA, 22 bp, Artificial Sequence
  chemically synthesized
gagtgataaaaatagtgatttt

SEQ ID NO: 113071 - DNA, 22 bp, Artificial Sequence
  chemically synthesized
agtgataaaaatagtgattttg

SEQ ID NO: 113072 - DNA, 22 bp, Artificial Sequence
  chemically synthesized
tgaacccttccttctgctagcc

SEQ ID NO: 113073 - DNA, 22 bp, Artificial Sequence
  chemically synthesized
gaacccttccttctgctagccc

SEQ ID NO: 113074 - DNA, 22 bp, Artificial Sequence
  chemically synthesized
aacccttccttctgctagccct

SEQ ID NO: 113075 - DNA, 22 bp, Artificial Sequence
  chemically synthesized
ccttctgctagccctagctatg

SEQ ID NO: 113076 - DNA, 22 bp, Artificial Sequence
  chemically synthesized
cttctgctagccctagctatgg

SEQ ID NO: 113077 - DNA, 22 bp, Artificial Sequence
  chemically synthesized
ctgctagccctagctatggacc

SEQ ID NO: 113078 - DNA, 22 bp, Artificial Sequence
  chemically synthesized
tgctagccctagctatggacca

SEQ ID NO: 113079 - DNA, 22 bp, Artificial Sequence
  chemically synthesized
ctagccctagctatggaccacc

SEQ ID NO: 113080 - DNA, 22 bp, Artificial Sequence
  chemically synthesized
gccctagctatggaccaccatg

SEQ ID NO: 113081 - DNA, 22 bp, Artificial Sequence
  chemically synthesized
gctatggaccaccatggatatt

SEQ ID NO: 113082 - DNA, 22 bp, Artificial Sequence
  chemically synthesized
tggaccaccatggatattgaag

SEQ ID NO: 113083 - DNA, 22 bp, Artificial Sequence
  chemically synthesized
aagtaagggctttgttttggaa

SEQ ID NO: 113084 - DNA, 22 bp, Artificial Sequence
  chemically synthesized
tgttttggaattactctccaca

SEQ ID NO: 113085 - DNA, 22 bp, Artificial Sequence
  chemically synthesized
gttttggaattactctccacac

SEQ ID NO: 113086 - DNA, 22 bp, Artificial Sequence
  chemically synthesized
ttttggaattactctccacaca

SEQ ID NO: 113087 - DNA, 22 bp, Artificial Sequence
  chemically synthesized
tggaattactctccacacattc

SEQ ID NO: 113088 - DNA, 22 bp, Artificial Sequence
  chemically synthesized
ggaattactctccacacattct

SEQ ID NO: 113089 - DNA, 22 bp, Artificial Sequence
  chemically synthesized
gaattactctccacacattctg

SEQ ID NO: 113090 - DNA, 22 bp, Artificial Sequence
  chemically synthesized
ctctccacacattctgaggata

SEQ ID NO: 113091 - DNA, 22 bp, Artificial Sequence
  chemically synthesized
tccacacattctgaggatatac

SEQ ID NO: 113092 - DNA, 22 bp, Artificial Sequence
  chemically synthesized
cacacattctgaggatatacaa

SEQ ID NO: 113093 - DNA, 22 bp, Artificial Sequence
  chemically synthesized
tgaggatatacaagggcactga

SEQ ID NO: 113094 - DNA, 22 bp, Artificial Sequence
  chemically synthesized
aggatatacaagggcactgaaa

SEQ ID NO: 113095 - DNA, 22 bp, Artificial Sequence
  chemically synthesized
aaatattctagaaagtccatag

SEQ ID NO: 113096 - DNA, 22 bp, Artificial Sequence
  chemically synthesized
tagaaagtccatagcacattct

SEQ ID NO: 113097 - DNA, 22 bp, Artificial Sequence
  chemically synthesized
gaaagtccatagcacattctga

SEQ ID NO: 113098 - DNA, 22 bp, Artificial Sequence
  chemically synthesized
tgatgtttatactctaagccac

SEQ ID NO: 113099 - DNA, 22 bp, Artificial Sequence
  chemically synthesized
atgtttatactctaagccacac

SEQ ID NO: 113100 - DNA, 22 bp, Artificial Sequence
  chemically synthesized
atactctaagccacacagcacc

SEQ ID NO: 113101 - DNA, 22 bp, Artificial Sequence
  chemically synthesized
tactctaagccacacagcacct

SEQ ID NO: 113102 - DNA, 22 bp, Artificial Sequence
  chemically synthesized
taagccacacagcacctttccc

SEQ ID NO: 113103 - DNA, 22 bp, Artificial Sequence
  chemically synthesized
agccacacagcacctttccccg

SEQ ID NO: 113104 - DNA, 22 bp, Artificial Sequence
  chemically synthesized
tccccggatctagggtctttca

SEQ ID NO: 113105 - DNA, 22 bp, Artificial Sequence
  chemically synthesized
ccccggatctagggtctttcac

SEQ ID NO: 113106 - DNA, 22 bp, Artificial Sequence
  chemically synthesized
cccggatctagggtctttcaca

SEQ ID NO: 113107 - DNA, 22 bp, Artificial Sequence
  chemically synthesized
gggtctttcacattaggttaat

SEQ ID NO: 113108 - DNA, 22 bp, Artificial Sequence
  chemically synthesized
tcacattaggttaattttttta

SEQ ID NO: 113109 - DNA, 22 bp, Artificial Sequence
  chemically synthesized
cacattaggttaatttttttaa

SEQ ID NO: 113110 - DNA, 22 bp, Artificial Sequence
  chemically synthesized
acattaggttaatttttttaaa

SEQ ID NO: 113111 - DNA, 22 bp, Artificial Sequence
  chemically synthesized
ggttaatttttttaaaactcaa

SEQ ID NO: 113112 - DNA, 22 bp, Artificial Sequence
  chemically synthesized
atttttttaaaactcaaacaca

SEQ ID NO: 113113 - DNA, 22 bp, Artificial Sequence
  chemically synthesized
ttttaaaactcaaacacagaag

SEQ ID NO: 113114 - DNA, 22 bp, Artificial Sequence
  chemically synthesized
tttaaaactcaaacacagaagt

SEQ ID NO: 113115 - DNA, 22 bp, Artificial Sequence
  chemically synthesized
ttaaaactcaaacacagaagtt

SEQ ID NO: 113116 - DNA, 22 bp, Artificial Sequence
  chemically synthesized
taaaactcaaacacagaagttc

SEQ ID NO: 113117 - DNA, 22 bp, Artificial Sequence
  chemically synthesized
aaaactcaaacacagaagttca

SEQ ID NO: 113118 - DNA, 22 bp, Artificial Sequence
  chemically synthesized
aaactcaaacacagaagttcaa

SEQ ID NO: 113119 - DNA, 22 bp, Artificial Sequence
  chemically synthesized
aaacacagaagttcaaaaaaat

SEQ ID NO: 113120 - DNA, 22 bp, Artificial Sequence
  chemically synthesized
aaaaaaattgaacatataattc

SEQ ID NO: 113121 - DNA, 22 bp, Artificial Sequence
  chemically synthesized
aacatataattctcattctctg

SEQ ID NO: 113122 - DNA, 22 bp, Artificial Sequence
  chemically synthesized
tcattctctgtggctcataaac

SEQ ID NO: 113123 - DNA, 22 bp, Artificial Sequence
  chemically synthesized
attctctgtggctcataaacat

SEQ ID NO: 113124 - DNA, 22 bp, Artificial Sequence
  chemically synthesized
tctgtggctcataaacatttaa

SEQ ID NO: 113125 - DNA, 22 bp, Artificial Sequence
  chemically synthesized
tgtggctcataaacatttaata

SEQ ID NO: 113126 - DNA, 22 bp, Artificial Sequence
  chemically synthesized
tggctcataaacatttaataga

SEQ ID NO: 113127 - DNA, 22 bp, Artificial Sequence
  chemically synthesized
ataaacatttaatagagacatt

SEQ ID NO: 113128 - DNA, 22 bp, Artificial Sequence
  chemically synthesized
aatagagacattgatgaaactg

SEQ ID NO: 113129 - DNA, 22 bp, Artificial Sequence
  chemically synthesized
atagagacattgatgaaactgt

SEQ ID NO: 113130 - DNA, 22 bp, Artificial Sequence
  chemically synthesized
atgaaactgtaaaaccctgagt

SEQ ID NO: 113131 - DNA, 22 bp, Artificial Sequence
  chemically synthesized
taaaaccctgagttgtaggccg

SEQ ID NO: 113132 - DNA, 22 bp, Artificial Sequence
  chemically synthesized
agttgtaggccggagatataaa

SEQ ID NO: 113133 - DNA, 22 bp, Artificial Sequence
  chemically synthesized
taggccggagatataaaatttc

SEQ ID NO: 113134 - DNA, 22 bp, Artificial Sequence
  chemically synthesized
caacataaagaatgaacaaaat

SEQ ID NO: 113135 - DNA, 22 bp, Artificial Sequence
  chemically synthesized
aacataaagaatgaacaaaatg

SEQ ID NO: 113136 - DNA, 22 bp, Artificial Sequence
  chemically synthesized
agagacagtgatagctgtatct

SEQ ID NO: 113137 - DNA, 22 bp, Artificial Sequence
  chemically synthesized
tatctaaagagtactgatatta

SEQ ID NO: 113138 - DNA, 22 bp, Artificial Sequence
  chemically synthesized
aagagtactgatattaaaaata

SEQ ID NO: 113139 - DNA, 22 bp, Artificial Sequence
  chemically synthesized
atattaaaaatagagaaaaaca

SEQ ID NO: 113140 - DNA, 22 bp, Artificial Sequence
  chemically synthesized
aaaatagagaaaaacatatatc

SEQ ID NO: 113141 - DNA, 22 bp, Artificial Sequence
  chemically synthesized
attatatccaaagggttacata

SEQ ID NO: 113142 - DNA, 22 bp, Artificial Sequence
  chemically synthesized
tatccaaagggttacataagtt

SEQ ID NO: 113143 - DNA, 22 bp, Artificial Sequence
  chemically synthesized
cataagttttaagagtggaaat

SEQ ID NO: 113144 - DNA, 22 bp, Artificial Sequence
  chemically synthesized
taagagtggaaataacatgaag

SEQ ID NO: 113145 - DNA, 22 bp, Artificial Sequence
  chemically synthesized
aagagtggaaataacatgaagg

SEQ ID NO: 113146 - DNA, 22 bp, Artificial Sequence
  chemically synthesized
agagtggaaataacatgaagga

SEQ ID NO: 113147 - DNA, 22 bp, Artificial Sequence
  chemically synthesized
aacaattaggaaacagaaattt

SEQ ID NO: 113148 - DNA, 22 bp, Artificial Sequence
  chemically synthesized
ggaaacagaaatttgacttgct

SEQ ID NO: 113149 - DNA, 22 bp, Artificial Sequence
  chemically synthesized
gacttgcttcagataaaagctt

SEQ ID NO: 113150 - DNA, 22 bp, Artificial Sequence
  chemically synthesized
acttgcttcagataaaagcttt

SEQ ID NO: 113151 - DNA, 22 bp, Artificial Sequence
  chemically synthesized
gcttcagataaaagcttttaaa

SEQ ID NO: 113152 - DNA, 22 bp, Artificial Sequence
  chemically synthesized
cttcagataaaagcttttaaaa

SEQ ID NO: 113153 - DNA, 22 bp, Artificial Sequence
  chemically synthesized
cagataaaagcttttaaaatat

SEQ ID NO: 113154 - DNA, 22 bp, Artificial Sequence
  chemically synthesized
agataaaagcttttaaaatatt

SEQ ID NO: 113155 - DNA, 22 bp, Artificial Sequence
  chemically synthesized
ttaaaatattttatctgaaaca

SEQ ID NO: 113156 - DNA, 22 bp, Artificial Sequence
  chemically synthesized
taaaatattttatctgaaacaa

SEQ ID NO: 113157 - DNA, 22 bp, Artificial Sequence
  chemically synthesized
aaaatattttatctgaaacaag

SEQ ID NO: 113158 - DNA, 22 bp, Artificial Sequence
  chemically synthesized
aaatattttatctgaaacaagt

SEQ ID NO: 113159 - DNA, 22 bp, Artificial Sequence
  chemically synthesized
tatctgaaacaagtaagcttgt

SEQ ID NO: 113160 - DNA, 22 bp, Artificial Sequence
  chemically synthesized
atctgaaacaagtaagcttgtt

SEQ ID NO: 113161 - DNA, 22 bp, Artificial Sequence
  chemically synthesized
tctgaaacaagtaagcttgttc

SEQ ID NO: 113162 - DNA, 22 bp, Artificial Sequence
  chemically synthesized
aaacaagtaagcttgttcaaaa

SEQ ID NO: 113163 - DNA, 22 bp, Artificial Sequence
  chemically synthesized
gttcaaaaaatataggatatat

SEQ ID NO: 113164 - DNA, 22 bp, Artificial Sequence
  chemically synthesized
ttcaaaaaatataggatatatg

SEQ ID NO: 113165 - DNA, 22 bp, Artificial Sequence
  chemically synthesized
aaaaaatataggatatatgtgt

SEQ ID NO: 113166 - DNA, 22 bp, Artificial Sequence
  chemically synthesized
cttcaatcaagcaaattaacct

SEQ ID NO: 113167 - DNA, 22 bp, Artificial Sequence
  chemically synthesized
caatcaagcaaattaacctatc

SEQ ID NO: 113168 - DNA, 22 bp, Artificial Sequence
  chemically synthesized
aatcaagcaaattaacctatcc

SEQ ID NO: 113169 - DNA, 22 bp, Artificial Sequence
  chemically synthesized
acctatccatcaatacaacacc

SEQ ID NO: 113170 - DNA, 22 bp, Artificial Sequence
  chemically synthesized
tccatcaatacaacaccttcca

SEQ ID NO: 113171 - DNA, 22 bp, Artificial Sequence
  chemically synthesized
ccatagataccttttgcttttt

SEQ ID NO: 113172 - DNA, 22 bp, Artificial Sequence
  chemically synthesized
catagataccttttgctttttc

SEQ ID NO: 113173 - DNA, 22 bp, Artificial Sequence
  chemically synthesized
ttgctttttctttgtgtaaggg

SEQ ID NO: 113174 - DNA, 22 bp, Artificial Sequence
  chemically synthesized
tgctttttctttgtgtaagggc

SEQ ID NO: 113175 - DNA, 22 bp, Artificial Sequence
  chemically synthesized
gctttttctttgtgtaagggca

SEQ ID NO: 113176 - DNA, 22 bp, Artificial Sequence
  chemically synthesized
ctttttctttgtgtaagggcat

SEQ ID NO: 113177 - DNA, 22 bp, Artificial Sequence
  chemically synthesized
tttctttgtgtaagggcatcta

SEQ ID NO: 113178 - DNA, 22 bp, Artificial Sequence
  chemically synthesized
ttctttgtgtaagggcatctaa

SEQ ID NO: 113179 - DNA, 22 bp, Artificial Sequence
  chemically synthesized
tctttgtgtaagggcatctaac

SEQ ID NO: 113180 - DNA, 22 bp, Artificial Sequence
  chemically synthesized
ctttgtgtaagggcatctaaca

SEQ ID NO: 113181 - DNA, 22 bp, Artificial Sequence
  chemically synthesized
tttgtgtaagggcatctaacat

SEQ ID NO: 113182 - DNA, 22 bp, Artificial Sequence
  chemically synthesized
tgtgtaagggcatctaacatct

SEQ ID NO: 113183 - DNA, 22 bp, Artificial Sequence
  chemically synthesized
gtgtaagggcatctaacatcta

SEQ ID NO: 113184 - DNA, 22 bp, Artificial Sequence
  chemically synthesized
tgtaagggcatctaacatctac

SEQ ID NO: 113185 - DNA, 22 bp, Artificial Sequence
  chemically synthesized
acatctactgtcataacaaatg

SEQ ID NO: 113186 - DNA, 22 bp, Artificial Sequence
  chemically synthesized
ctgtcataacaaatgtttagtt

SEQ ID NO: 113187 - DNA, 22 bp, Artificial Sequence
  chemically synthesized
tcataacaaatgtttagtttac

SEQ ID NO: 113188 - DNA, 22 bp, Artificial Sequence
  chemically synthesized
agtttacagtacagtattaagt

SEQ ID NO: 113189 - DNA, 22 bp, Artificial Sequence
  chemically synthesized
gtttacagtacagtattaagtc

SEQ ID NO: 113190 - DNA, 22 bp, Artificial Sequence
  chemically synthesized
acagtacagtattaagtcttca

SEQ ID NO: 113191 - DNA, 22 bp, Artificial Sequence
  chemically synthesized
cagtacagtattaagtcttcat

SEQ ID NO: 113192 - DNA, 22 bp, Artificial Sequence
  chemically synthesized
agtcttcatgccatacactaga

SEQ ID NO: 113193 - DNA, 22 bp, Artificial Sequence
  chemically synthesized
catgccatacactagatctcta

SEQ ID NO: 113194 - DNA, 22 bp, Artificial Sequence
  chemically synthesized
atgccatacactagatctctaa

SEQ ID NO: 113195 - DNA, 22 bp, Artificial Sequence
  chemically synthesized
gatctctaaacttatttatcct

SEQ ID NO: 113196 - DNA, 22 bp, Artificial Sequence
  chemically synthesized
taaacttatttatcctatacag

SEQ ID NO: 113197 - DNA, 22 bp, Artificial Sequence
  chemically synthesized
aacttatttatcctatacagct

SEQ ID NO: 113198 - DNA, 22 bp, Artificial Sequence
  chemically synthesized
atttatcctatacagctgcaag

SEQ ID NO: 113199 - DNA, 22 bp, Artificial Sequence
  chemically synthesized
tttatcctatacagctgcaagt

SEQ ID NO: 113200 - DNA, 22 bp, Artificial Sequence
  chemically synthesized
atcctatacagctgcaagttta

SEQ ID NO: 113201 - DNA, 22 bp, Artificial Sequence
  chemically synthesized
tcctatacagctgcaagtttat

SEQ ID NO: 113202 - DNA, 22 bp, Artificial Sequence
  chemically synthesized
tacagctgcaagtttataacct

SEQ ID NO: 113203 - DNA, 22 bp, Artificial Sequence
  chemically synthesized
caagtttataacctttgaccta

SEQ ID NO: 113204 - DNA, 22 bp, Artificial Sequence
  chemically synthesized
ataacctttgacctacttctcc

SEQ ID NO: 113205 - DNA, 22 bp, Artificial Sequence
  chemically synthesized
taacctttgacctacttctccc

SEQ ID NO: 113206 - DNA, 22 bp, Artificial Sequence
  chemically synthesized
tgacctacttctccctattttc

SEQ ID NO: 113207 - DNA, 22 bp, Artificial Sequence
  chemically synthesized
gacctacttctccctattttct

SEQ ID NO: 113208 - DNA, 22 bp, Artificial Sequence
  chemically synthesized
acctacttctccctattttctc

SEQ ID NO: 113209 - DNA, 22 bp, Artificial Sequence
  chemically synthesized
cttctccctattttctctttct

SEQ ID NO: 113210 - DNA, 22 bp, Artificial Sequence
  chemically synthesized
ctccctattttctctttctttc

SEQ ID NO: 113211 - DNA, 22 bp, Artificial Sequence
  chemically synthesized
tccctattttctctttctttct

SEQ ID NO: 113212 - DNA, 22 bp, Artificial Sequence
  chemically synthesized
cctattttctctttctttcttc

SEQ ID NO: 113213 - DNA, 22 bp, Artificial Sequence
  chemically synthesized
ttttctctttctttcttcccct

SEQ ID NO: 113214 - DNA, 22 bp, Artificial Sequence
  chemically synthesized
tctctttctttcttcccctttt

SEQ ID NO: 113215 - DNA, 22 bp, Artificial Sequence
  chemically synthesized
ctctttctttcttccccttttt

SEQ ID NO: 113216 - DNA, 22 bp, Artificial Sequence
  chemically synthesized
tctttctttcttccccttttta

SEQ ID NO: 113217 - DNA, 22 bp, Artificial Sequence
  chemically synthesized
tttctttcttcccctttttaca

SEQ ID NO: 113218 - DNA, 22 bp, Artificial Sequence
  chemically synthesized
tctttcttcccctttttacact

SEQ ID NO: 113219 - DNA, 22 bp, Artificial Sequence
  chemically synthesized
ctttcttcccctttttacactg

SEQ ID NO: 113220 - DNA, 22 bp, Artificial Sequence
  chemically synthesized
tttcttcccctttttacactgt

SEQ ID NO: 113221 - DNA, 22 bp, Artificial Sequence
  chemically synthesized
tcttcccctttttacactgttt

SEQ ID NO: 113222 - DNA, 22 bp, Artificial Sequence
  chemically synthesized
cttcccctttttacactgtttc

SEQ ID NO: 113223 - DNA, 22 bp, Artificial Sequence
  chemically synthesized
ttcccctttttacactgtttct

SEQ ID NO: 113224 - DNA, 22 bp, Artificial Sequence
  chemically synthesized
cccctttttacactgtttctat

SEQ ID NO: 113225 - DNA, 22 bp, Artificial Sequence
  chemically synthesized
ccctttttacactgtttctatg

SEQ ID NO: 113226 - DNA, 22 bp, Artificial Sequence
  chemically synthesized
tttacactgtttctatgcattt

SEQ ID NO: 113227 - DNA, 22 bp, Artificial Sequence
  chemically synthesized
ttacactgtttctatgcatttg

SEQ ID NO: 113228 - DNA, 22 bp, Artificial Sequence
  chemically synthesized
tacactgtttctatgcatttga

SEQ ID NO: 113229 - DNA, 22 bp, Artificial Sequence
  chemically synthesized
acactgtttctatgcatttgac

SEQ ID NO: 113230 - DNA, 22 bp, Artificial Sequence
  chemically synthesized
cactgtttctatgcatttgacc

SEQ ID NO: 113231 - DNA, 22 bp, Artificial Sequence
  chemically synthesized
tttctatgcatttgaccttatt

SEQ ID NO: 113232 - DNA, 22 bp, Artificial Sequence
  chemically synthesized
ctatgcatttgaccttattttt

SEQ ID NO: 113233 - DNA, 22 bp, Artificial Sequence
  chemically synthesized
tatgcatttgaccttatttttc

SEQ ID NO: 113234 - DNA, 22 bp, Artificial Sequence
  chemically synthesized
tgcatttgaccttatttttctt

SEQ ID NO: 113235 - DNA, 22 bp, Artificial Sequence
  chemically synthesized
gaccttatttttcttttgagat

SEQ ID NO: 113236 - DNA, 22 bp, Artificial Sequence
  chemically synthesized
accttatttttcttttgagatt

SEQ ID NO: 113237 - DNA, 22 bp, Artificial Sequence
  chemically synthesized
atttttcttttgagattccaca

SEQ ID NO: 113238 - DNA, 22 bp, Artificial Sequence
  chemically synthesized
tttttcttttgagattccacat

SEQ ID NO: 113239 - DNA, 22 bp, Artificial Sequence
  chemically synthesized
ttcttttgagattccacatata

SEQ ID NO: 113240 - DNA, 22 bp, Artificial Sequence
  chemically synthesized
tcttttgagattccacatataa

SEQ ID NO: 113241 - DNA, 22 bp, Artificial Sequence
  chemically synthesized
cttttgagattccacatataag

SEQ ID NO: 113242 - DNA, 22 bp, Artificial Sequence
  chemically synthesized
ttttgagattccacatataagt

SEQ ID NO: 113243 - DNA, 22 bp, Artificial Sequence
  chemically synthesized
ttgagattccacatataagtaa

SEQ ID NO: 113244 - DNA, 22 bp, Artificial Sequence
  chemically synthesized
tgagattccacatataagtaat

SEQ ID NO: 113245 - DNA, 22 bp, Artificial Sequence
  chemically synthesized
gagattccacatataagtaata

SEQ ID NO: 113246 - DNA, 22 bp, Artificial Sequence
  chemically synthesized
agattccacatataagtaatat

SEQ ID NO: 113247 - DNA, 22 bp, Artificial Sequence
  chemically synthesized
cacatataagtaatatcatgcc

SEQ ID NO: 113248 - DNA, 22 bp, Artificial Sequence
  chemically synthesized
tatttgtttctgtgtctggttt

SEQ ID NO: 113249 - DNA, 22 bp, Artificial Sequence
  chemically synthesized
atttgtttctgtgtctggttta

SEQ ID NO: 113250 - DNA, 22 bp, Artificial Sequence
  chemically synthesized
tttgtttctgtgtctggtttat

SEQ ID NO: 113251 - DNA, 22 bp, Artificial Sequence
  chemically synthesized
gtttctgtgtctggtttatttc

SEQ ID NO: 113252 - DNA, 22 bp, Artificial Sequence
  chemically synthesized
tttctgtgtctggtttatttca

SEQ ID NO: 113253 - DNA, 22 bp, Artificial Sequence
  chemically synthesized
ctgtgtctggtttatttcactt

SEQ ID NO: 113254 - DNA, 22 bp, Artificial Sequence
  chemically synthesized
tgtgtctggtttatttcactta

SEQ ID NO: 113255 - DNA, 22 bp, Artificial Sequence
  chemically synthesized
tgtctggtttatttcacttagc

SEQ ID NO: 113256 - DNA, 22 bp, Artificial Sequence
  chemically synthesized
gtttatttcacttagcaaaatg

SEQ ID NO: 113257 - DNA, 22 bp, Artificial Sequence
  chemically synthesized
atttcacttagcaaaatgtact

SEQ ID NO: 113258 - DNA, 22 bp, Artificial Sequence
  chemically synthesized
tttcacttagcaaaatgtactc

SEQ ID NO: 113259 - DNA, 22 bp, Artificial Sequence
  chemically synthesized
cacttagcaaaatgtactctag

SEQ ID NO: 113260 - DNA, 22 bp, Artificial Sequence
  chemically synthesized
acttagcaaaatgtactctagg

SEQ ID NO: 113261 - DNA, 22 bp, Artificial Sequence
  chemically synthesized
agcaaaatgtactctaggttta

SEQ ID NO: 113262 - DNA, 22 bp, Artificial Sequence
  chemically synthesized
gcaaaatgtactctaggtttat

SEQ ID NO: 113263 - DNA, 22 bp, Artificial Sequence
  chemically synthesized
taggtttatacattccccccat

SEQ ID NO: 113264 - DNA, 22 bp, Artificial Sequence
  chemically synthesized
ggtttatacattccccccatct

SEQ ID NO: 113265 - DNA, 22 bp, Artificial Sequence
  chemically synthesized
atacattccccccatctccttt

SEQ ID NO: 113266 - DNA, 22 bp, Artificial Sequence
  chemically synthesized
tacattccccccatctcctttt

SEQ ID NO: 113267 - DNA, 22 bp, Artificial Sequence
  chemically synthesized
cccccatctccttttttaaggc

SEQ ID NO: 113268 - DNA, 22 bp, Artificial Sequence
  chemically synthesized
cttttttaaggctgaataatat

SEQ ID NO: 113269 - DNA, 22 bp, Artificial Sequence
  chemically synthesized
ttttaaggctgaataatattgt

SEQ ID NO: 113270 - DNA, 22 bp, Artificial Sequence
  chemically synthesized
tttaaggctgaataatattgtg

SEQ ID NO: 113271 - DNA, 22 bp, Artificial Sequence
  chemically synthesized
ttaaggctgaataatattgtga

SEQ ID NO: 113272 - DNA, 22 bp, Artificial Sequence
  chemically synthesized
taaggctgaataatattgtgat

SEQ ID NO: 113273 - DNA, 22 bp, Artificial Sequence
  chemically synthesized
aaggctgaataatattgtgata

SEQ ID NO: 113274 - DNA, 22 bp, Artificial Sequence
  chemically synthesized
aggctgaataatattgtgatat

SEQ ID NO: 113275 - DNA, 22 bp, Artificial Sequence
  chemically synthesized
aataatattgtgatatcataca

SEQ ID NO: 113276 - DNA, 22 bp, Artificial Sequence
  chemically synthesized
tgatatcatacatacatatgac

SEQ ID NO: 113277 - DNA, 22 bp, Artificial Sequence
  chemically synthesized
tcacaatgtctttatctgttca

SEQ ID NO: 113278 - DNA, 22 bp, Artificial Sequence
  chemically synthesized
tatctgttcatctatatataga

SEQ ID NO: 113279 - DNA, 22 bp, Artificial Sequence
  chemically synthesized
atctgttcatctatatatagat

SEQ ID NO: 113280 - DNA, 22 bp, Artificial Sequence
  chemically synthesized
tctgttcatctatatatagata

SEQ ID NO: 113281 - DNA, 22 bp, Artificial Sequence
  chemically synthesized
ttcatctatatatagataccac

SEQ ID NO: 113282 - DNA, 22 bp, Artificial Sequence
  chemically synthesized
atctatatatagataccactta

SEQ ID NO: 113283 - DNA, 22 bp, Artificial Sequence
  chemically synthesized
tatatagataccacttagattg

SEQ ID NO: 113284 - DNA, 22 bp, Artificial Sequence
  chemically synthesized
agattgtttccatgtcttggct

SEQ ID NO: 113285 - DNA, 22 bp, Artificial Sequence
  chemically synthesized
gattgtttccatgtcttggcta

SEQ ID NO: 113286 - DNA, 22 bp, Artificial Sequence
  chemically synthesized
tttccatgtcttggctattgtg

SEQ ID NO: 113287 - DNA, 22 bp, Artificial Sequence
  chemically synthesized
ccatgtcttggctattgtgaat

SEQ ID NO: 113288 - DNA, 22 bp, Artificial Sequence
  chemically synthesized
catgtcttggctattgtgaata

SEQ ID NO: 113289 - DNA, 22 bp, Artificial Sequence
  chemically synthesized
ggctattgtgaataatgctgca

SEQ ID NO: 113290 - DNA, 22 bp, Artificial Sequence
  chemically synthesized
gctattgtgaataatgctgcaa

SEQ ID NO: 113291 - DNA, 22 bp, Artificial Sequence
  chemically synthesized
ttgtgaataatgctgcaattaa

SEQ ID NO: 113292 - DNA, 22 bp, Artificial Sequence
  chemically synthesized
tgaataatgctgcaattaacat

SEQ ID NO: 113293 - DNA, 22 bp, Artificial Sequence
  chemically synthesized
caattaacatgagagtgcagat

SEQ ID NO: 113294 - DNA, 22 bp, Artificial Sequence
  chemically synthesized
acatgagagtgcagatagctct

SEQ ID NO: 113295 - DNA, 22 bp, Artificial Sequence
  chemically synthesized
tagaaaatgcggattttattta

SEQ ID NO: 113296 - DNA, 22 bp, Artificial Sequence
  chemically synthesized
gaaaatgcggattttatttatt

SEQ ID NO: 113297 - DNA, 22 bp, Artificial Sequence
  chemically synthesized
tatttattttggatacatatac

SEQ ID NO: 113298 - DNA, 22 bp, Artificial Sequence
  chemically synthesized
atttattttggatacatataca

SEQ ID NO: 113299 - DNA, 22 bp, Artificial Sequence
  chemically synthesized
tttattttggatacatatacag

SEQ ID NO: 113300 - DNA, 22 bp, Artificial Sequence
  chemically synthesized
attttggatacatatacagcag

SEQ ID NO: 113301 - DNA, 22 bp, Artificial Sequence
  chemically synthesized
ttttggatacatatacagcaga

SEQ ID NO: 113302 - DNA, 22 bp, Artificial Sequence
  chemically synthesized
tggatacatatacagcagagaa

SEQ ID NO: 113303 - DNA, 22 bp, Artificial Sequence
  chemically synthesized
ggatacatatacagcagagaaa

SEQ ID NO: 113304 - DNA, 22 bp, Artificial Sequence
  chemically synthesized
gatacatatacagcagagaaat

SEQ ID NO: 113305 - DNA, 22 bp, Artificial Sequence
  chemically synthesized
cttcatcatacaataactctat

SEQ ID NO: 113306 - DNA, 22 bp, Artificial Sequence
  chemically synthesized
ttcatcatacaataactctatt

SEQ ID NO: 113307 - DNA, 22 bp, Artificial Sequence
  chemically synthesized
catcatacaataactctatttt

SEQ ID NO: 113308 - DNA, 22 bp, Artificial Sequence
  chemically synthesized
atcatacaataactctattttt

SEQ ID NO: 113309 - DNA, 22 bp, Artificial Sequence
  chemically synthesized
tatttttagttgtttgagaaac

SEQ ID NO: 113310 - DNA, 22 bp, Artificial Sequence
  chemically synthesized
tttttagttgtttgagaaactt

SEQ ID NO: 113311 - DNA, 22 bp, Artificial Sequence
  chemically synthesized
ttagttgtttgagaaacttcca

SEQ ID NO: 113312 - DNA, 22 bp, Artificial Sequence
  chemically synthesized
tagttgtttgagaaacttccat

SEQ ID NO: 113313 - DNA, 22 bp, Artificial Sequence
  chemically synthesized
agttgtttgagaaacttccata

SEQ ID NO: 113314 - DNA, 22 bp, Artificial Sequence
  chemically synthesized
gttgtttgagaaacttccatac

SEQ ID NO: 113315 - DNA, 22 bp, Artificial Sequence
  chemically synthesized
tttgagaaacttccatacgttt

SEQ ID NO: 113316 - DNA, 22 bp, Artificial Sequence
  chemically synthesized
gagaaacttccatacgttttct

SEQ ID NO: 113317 - DNA, 22 bp, Artificial Sequence
  chemically synthesized
agaaacttccatacgttttcta

SEQ ID NO: 113318 - DNA, 22 bp, Artificial Sequence
  chemically synthesized
ccatacgttttctataatggct

SEQ ID NO: 113319 - DNA, 22 bp, Artificial Sequence
  chemically synthesized
catacgttttctataatggcta

SEQ ID NO: 113320 - DNA, 22 bp, Artificial Sequence
  chemically synthesized
tctataatggctatgttaactt

SEQ ID NO: 113321 - DNA, 22 bp, Artificial Sequence
  chemically synthesized
ctataatggctatgttaactta

SEQ ID NO: 113322 - DNA, 22 bp, Artificial Sequence
  chemically synthesized
tataatggctatgttaacttac

SEQ ID NO: 113323 - DNA, 22 bp, Artificial Sequence
  chemically synthesized
taatggctatgttaacttacat

SEQ ID NO: 113324 - DNA, 22 bp, Artificial Sequence
  chemically synthesized
tgttaacttacattcccaccag

SEQ ID NO: 113325 - DNA, 22 bp, Artificial Sequence
  chemically synthesized
acttacattcccaccagctatg

SEQ ID NO: 113326 - DNA, 22 bp, Artificial Sequence
  chemically synthesized
acattcccaccagctatgcaca

SEQ ID NO: 113327 - DNA, 22 bp, Artificial Sequence
  chemically synthesized
cattcccaccagctatgcacaa

SEQ ID NO: 113328 - DNA, 22 bp, Artificial Sequence
  chemically synthesized
ccaccagctatgcacaagagtt

SEQ ID NO: 113329 - DNA, 22 bp, Artificial Sequence
  chemically synthesized
tgcacaagagttctcctttctc

SEQ ID NO: 113330 - DNA, 22 bp, Artificial Sequence
  chemically synthesized
tcctttctccacagcctctcca

SEQ ID NO: 113331 - DNA, 22 bp, Artificial Sequence
  chemically synthesized
ctttctccacagcctctccaac

SEQ ID NO: 113332 - DNA, 22 bp, Artificial Sequence
  chemically synthesized
tctccacagcctctccaacccc

SEQ ID NO: 113333 - DNA, 22 bp, Artificial Sequence
  chemically synthesized
ctccacagcctctccaacccct

SEQ ID NO: 113334 - DNA, 22 bp, Artificial Sequence
  chemically synthesized
tccacagcctctccaaccccta

SEQ ID NO: 113335 - DNA, 22 bp, Artificial Sequence
  chemically synthesized
cacagcctctccaacccctatc

SEQ ID NO: 113336 - DNA, 22 bp, Artificial Sequence
  chemically synthesized
tccaacccctatctcttgtctt

SEQ ID NO: 113337 - DNA, 22 bp, Artificial Sequence
  chemically synthesized
caacccctatctcttgtctttt

SEQ ID NO: 113338 - DNA, 22 bp, Artificial Sequence
  chemically synthesized
tctcttgtcttttttgataata

SEQ ID NO: 113339 - DNA, 22 bp, Artificial Sequence
  chemically synthesized
ttgtcttttttgataatagcca

SEQ ID NO: 113340 - DNA, 22 bp, Artificial Sequence
  chemically synthesized
gtcttttttgataatagccatc

SEQ ID NO: 113341 - DNA, 22 bp, Artificial Sequence
  chemically synthesized
tcttttttgataatagccatct

SEQ ID NO: 113342 - DNA, 22 bp, Artificial Sequence
  chemically synthesized
ttttgataatagccatctcaac

SEQ ID NO: 113343 - DNA, 22 bp, Artificial Sequence
  chemically synthesized
tttgataatagccatctcaaca

SEQ ID NO: 113344 - DNA, 22 bp, Artificial Sequence
  chemically synthesized
ttgataatagccatctcaacag

SEQ ID NO: 113345 - DNA, 22 bp, Artificial Sequence
  chemically synthesized
tgataatagccatctcaacagg

SEQ ID NO: 113346 - DNA, 22 bp, Artificial Sequence
  chemically synthesized
gataatagccatctcaacaggt

SEQ ID NO: 113347 - DNA, 22 bp, Artificial Sequence
  chemically synthesized
ataatagccatctcaacaggtg

SEQ ID NO: 113348 - DNA, 22 bp, Artificial Sequence
  chemically synthesized
aacaggtgtgagtgatacttgt

SEQ ID NO: 113349 - DNA, 22 bp, Artificial Sequence
  chemically synthesized
gtggttttgatttgcattttcc

SEQ ID NO: 113350 - DNA, 22 bp, Artificial Sequence
  chemically synthesized
tggttttgatttgcattttcct

SEQ ID NO: 113351 - DNA, 22 bp, Artificial Sequence
  chemically synthesized
tgatttgcattttcctgatgat

SEQ ID NO: 113352 - DNA, 22 bp, Artificial Sequence
  chemically synthesized
gatttgcattttcctgatgatt

SEQ ID NO: 113353 - DNA, 22 bp, Artificial Sequence
  chemically synthesized
atttgcattttcctgatgattg

SEQ ID NO: 113354 - DNA, 22 bp, Artificial Sequence
  chemically synthesized
gcattttcctgatgattggtga

SEQ ID NO: 113355 - DNA, 22 bp, Artificial Sequence
  chemically synthesized
cattttcctgatgattggtgat

SEQ ID NO: 113356 - DNA, 22 bp, Artificial Sequence
  chemically synthesized
tcctgatgattggtgatgtagt

SEQ ID NO: 113357 - DNA, 22 bp, Artificial Sequence
  chemically synthesized
cctgatgattggtgatgtagtg

SEQ ID NO: 113358 - DNA, 22 bp, Artificial Sequence
  chemically synthesized
ctgatgattggtgatgtagtgc

SEQ ID NO: 113359 - DNA, 22 bp, Artificial Sequence
  chemically synthesized
atgattggtgatgtagtgcacc

SEQ ID NO: 113360 - DNA, 22 bp, Artificial Sequence
  chemically synthesized
gtgatgtagtgcaccttttcat

SEQ ID NO: 113361 - DNA, 22 bp, Artificial Sequence
  chemically synthesized
ttcatatgcctgctgaccattt

SEQ ID NO: 113362 - DNA, 22 bp, Artificial Sequence
  chemically synthesized
tcatatgcctgctgaccatttg

SEQ ID NO: 113363 - DNA, 22 bp, Artificial Sequence
  chemically synthesized
catatgcctgctgaccatttgc

SEQ ID NO: 113364 - DNA, 22 bp, Artificial Sequence
  chemically synthesized
atatgcctgctgaccatttgca

SEQ ID NO: 113365 - DNA, 22 bp, Artificial Sequence
  chemically synthesized
ctgaccatttgcatgtcttcag

SEQ ID NO: 113366 - DNA, 22 bp, Artificial Sequence
  chemically synthesized
accatttgcatgtcttcagaga

SEQ ID NO: 113367 - DNA, 22 bp, Artificial Sequence
  chemically synthesized
gcatgtcttcagagaaatgtat

SEQ ID NO: 113368 - DNA, 22 bp, Artificial Sequence
  chemically synthesized
catgtcttcagagaaatgtata

SEQ ID NO: 113369 - DNA, 22 bp, Artificial Sequence
  chemically synthesized
cagagaaatgtatattcagatc

SEQ ID NO: 113370 - DNA, 22 bp, Artificial Sequence
  chemically synthesized
agagaaatgtatattcagatcc

SEQ ID NO: 113371 - DNA, 22 bp, Artificial Sequence
  chemically synthesized
agatcctttgcccatttttact

SEQ ID NO: 113372 - DNA, 22 bp, Artificial Sequence
  chemically synthesized
tgcccatttttacttaggttac

SEQ ID NO: 113373 - DNA, 22 bp, Artificial Sequence
  chemically synthesized
gcccatttttacttaggttact

SEQ ID NO: 113374 - DNA, 22 bp, Artificial Sequence
  chemically synthesized
cccatttttacttaggttacta

SEQ ID NO: 113375 - DNA, 22 bp, Artificial Sequence
  chemically synthesized
ttacttaggttactattatatt

SEQ ID NO: 113376 - DNA, 22 bp, Artificial Sequence
  chemically synthesized
tacttaggttactattatattt

SEQ ID NO: 113377 - DNA, 22 bp, Artificial Sequence
  chemically synthesized
acttaggttactattatatttt

SEQ ID NO: 113378 - DNA, 22 bp, Artificial Sequence
  chemically synthesized
cttaggttactattatattttt

SEQ ID NO: 113379 - DNA, 22 bp, Artificial Sequence
  chemically synthesized
aggttactattatattttttca

SEQ ID NO: 113380 - DNA, 22 bp, Artificial Sequence
  chemically synthesized
ggttactattatattttttcat

SEQ ID NO: 113381 - DNA, 22 bp, Artificial Sequence
  chemically synthesized
ctattatattttttcatattta

SEQ ID NO: 113382 - DNA, 22 bp, Artificial Sequence
  chemically synthesized
ttatattttttcatatttagtt

SEQ ID NO: 113383 - DNA, 22 bp, Artificial Sequence
  chemically synthesized
tattttttcatatttagttgat

SEQ ID NO: 113384 - DNA, 22 bp, Artificial Sequence
  chemically synthesized
tttcatatttagttgattgagt

SEQ ID NO: 113385 - DNA, 22 bp, Artificial Sequence
  chemically synthesized
ttcatatttagttgattgagtt

SEQ ID NO: 113386 - DNA, 22 bp, Artificial Sequence
  chemically synthesized
tcatatttagttgattgagttc

SEQ ID NO: 113387 - DNA, 22 bp, Artificial Sequence
  chemically synthesized
catatttagttgattgagttcc

SEQ ID NO: 113388 - DNA, 22 bp, Artificial Sequence
  chemically synthesized
atatttagttgattgagttcct

SEQ ID NO: 113389 - DNA, 22 bp, Artificial Sequence
  chemically synthesized
agttgattgagttccttatata

SEQ ID NO: 113390 - DNA, 22 bp, Artificial Sequence
  chemically synthesized
gttgattgagttccttatatat

SEQ ID NO: 113391 - DNA, 22 bp, Artificial Sequence
  chemically synthesized
attgagttccttatatattttg

SEQ ID NO: 113392 - DNA, 22 bp, Artificial Sequence
  chemically synthesized
agttccttatatattttgggta

SEQ ID NO: 113393 - DNA, 22 bp, Artificial Sequence
  chemically synthesized
cttatatattttgggtattaga

SEQ ID NO: 113394 - DNA, 22 bp, Artificial Sequence
  chemically synthesized
atatattttgggtattagactt

SEQ ID NO: 113395 - DNA, 22 bp, Artificial Sequence
  chemically synthesized
tatattttgggtattagacttg

SEQ ID NO: 113396 - DNA, 22 bp, Artificial Sequence
  chemically synthesized
tgggtattagacttgtatcaga

SEQ ID NO: 113397 - DNA, 22 bp, Artificial Sequence
  chemically synthesized
gggtattagacttgtatcagat

SEQ ID NO: 113398 - DNA, 22 bp, Artificial Sequence
  chemically synthesized
ggtattagacttgtatcagata

SEQ ID NO: 113399 - DNA, 22 bp, Artificial Sequence
  chemically synthesized
gacttgtatcagatatatgatc

SEQ ID NO: 113400 - DNA, 22 bp, Artificial Sequence
  chemically synthesized
gtatcagatatatgatctgtaa

SEQ ID NO: 113401 - DNA, 22 bp, Artificial Sequence
  chemically synthesized
tatcagatatatgatctgtaaa

SEQ ID NO: 113402 - DNA, 22 bp, Artificial Sequence
  chemically synthesized
taaatattttctcccaaactgt

SEQ ID NO: 113403 - DNA, 22 bp, Artificial Sequence
  chemically synthesized
tctcccaaactgttccttttga

SEQ ID NO: 113404 - DNA, 22 bp, Artificial Sequence
  chemically synthesized
ctcccaaactgttccttttgat

SEQ ID NO: 113405 - DNA, 22 bp, Artificial Sequence
  chemically synthesized
tcccaaactgttccttttgatg

SEQ ID NO: 113406 - DNA, 22 bp, Artificial Sequence
  chemically synthesized
ccaaactgttccttttgatgat

SEQ ID NO: 113407 - DNA, 22 bp, Artificial Sequence
  chemically synthesized
ttccttttgatgattgttttct

SEQ ID NO: 113408 - DNA, 22 bp, Artificial Sequence
  chemically synthesized
cttttgatgattgttttctttg

SEQ ID NO: 113409 - DNA, 22 bp, Artificial Sequence
  chemically synthesized
ttgatgattgttttctttgctg

SEQ ID NO: 113410 - DNA, 22 bp, Artificial Sequence
  chemically synthesized
tgatgattgttttctttgctgt

SEQ ID NO: 113411 - DNA, 22 bp, Artificial Sequence
  chemically synthesized
gatgattgttttctttgctgtg

SEQ ID NO: 113412 - DNA, 22 bp, Artificial Sequence
  chemically synthesized
atgattgttttctttgctgtgc

SEQ ID NO: 113413 - DNA, 22 bp, Artificial Sequence
  chemically synthesized
ttttctttgctgtgcagaaaat

SEQ ID NO: 113414 - DNA, 22 bp, Artificial Sequence
  chemically synthesized
tctttgctgtgcagaaaatatt

SEQ ID NO: 113415 - DNA, 22 bp, Artificial Sequence
  chemically synthesized
ctttgctgtgcagaaaatattt

SEQ ID NO: 113416 - DNA, 22 bp, Artificial Sequence
  chemically synthesized
tttgctgtgcagaaaatattta

SEQ ID NO: 113417 - DNA, 22 bp, Artificial Sequence
  chemically synthesized
tgctgtgcagaaaatatttagt

SEQ ID NO: 113418 - DNA, 22 bp, Artificial Sequence
  chemically synthesized
gctgtgcagaaaatatttagtt

SEQ ID NO: 113419 - DNA, 22 bp, Artificial Sequence
  chemically synthesized
ctgtgcagaaaatatttagttt

SEQ ID NO: 113420 - DNA, 22 bp, Artificial Sequence
  chemically synthesized
tgcagaaaatatttagtttgat

SEQ ID NO: 113421 - DNA, 22 bp, Artificial Sequence
  chemically synthesized
agtttgatgttgctccacttgt

SEQ ID NO: 113422 - DNA, 22 bp, Artificial Sequence
  chemically synthesized
gtttgatgttgctccacttgtt

SEQ ID NO: 113423 - DNA, 22 bp, Artificial Sequence
  chemically synthesized
gatgttgctccacttgtttatt

SEQ ID NO: 113424 - DNA, 22 bp, Artificial Sequence
  chemically synthesized
atgttgctccacttgtttattt

SEQ ID NO: 113425 - DNA, 22 bp, Artificial Sequence
  chemically synthesized
ctccacttgtttatttttgctt

SEQ ID NO: 113426 - DNA, 22 bp, Artificial Sequence
  chemically synthesized
cacttgtttatttttgcttttg

SEQ ID NO: 113427 - DNA, 22 bp, Artificial Sequence
  chemically synthesized
gtttatttttgcttttgttacc

SEQ ID NO: 113428 - DNA, 22 bp, Artificial Sequence
  chemically synthesized
tttatttttgcttttgttacct

SEQ ID NO: 113429 - DNA, 22 bp, Artificial Sequence
  chemically synthesized
atttttgcttttgttacctgag

SEQ ID NO: 113430 - DNA, 22 bp, Artificial Sequence
  chemically synthesized
tttttgcttttgttacctgagc

SEQ ID NO: 113431 - DNA, 22 bp, Artificial Sequence
  chemically synthesized
ttgcttttgttacctgagctct

SEQ ID NO: 113432 - DNA, 22 bp, Artificial Sequence
  chemically synthesized
tgcttttgttacctgagctctg

SEQ ID NO: 113433 - DNA, 22 bp, Artificial Sequence
  chemically synthesized
gcttttgttacctgagctctgg

SEQ ID NO: 113434 - DNA, 22 bp, Artificial Sequence
  chemically synthesized
cttttgttacctgagctctggc

SEQ ID NO: 113435 - DNA, 22 bp, Artificial Sequence
  chemically synthesized
ttgttacctgagctctggcaca

SEQ ID NO: 113436 - DNA, 22 bp, Artificial Sequence
  chemically synthesized
tgttacctgagctctggcacat

SEQ ID NO: 113437 - DNA, 22 bp, Artificial Sequence
  chemically synthesized
gttacctgagctctggcacatt

SEQ ID NO: 113438 - DNA, 22 bp, Artificial Sequence
  chemically synthesized
ttacctgagctctggcacattt

SEQ ID NO: 113439 - DNA, 22 bp, Artificial Sequence
  chemically synthesized
cctgagctctggcacattttac

SEQ ID NO: 113440 - DNA, 22 bp, Artificial Sequence
  chemically synthesized
agctctggcacattttacagaa

SEQ ID NO: 113441 - DNA, 22 bp, Artificial Sequence
  chemically synthesized
tggcacattttacagaaaacaa

SEQ ID NO: 113442 - DNA, 22 bp, Artificial Sequence
  chemically synthesized
gcacattttacagaaaacaatt

SEQ ID NO: 113443 - DNA, 22 bp, Artificial Sequence
  chemically synthesized
tacagaaaacaatttgaaaatt

SEQ ID NO: 113444 - DNA, 22 bp, Artificial Sequence
  chemically synthesized
acagaaaacaatttgaaaattt

SEQ ID NO: 113445 - DNA, 22 bp, Artificial Sequence
  chemically synthesized
cagaaaacaatttgaaaatttg

SEQ ID NO: 113446 - DNA, 22 bp, Artificial Sequence
  chemically synthesized
gaaaatttgtatgaaaccacag

SEQ ID NO: 113447 - DNA, 22 bp, Artificial Sequence
  chemically synthesized
aaaatttgtatgaaaccacaga

SEQ ID NO: 113448 - DNA, 22 bp, Artificial Sequence
  chemically synthesized
gtatgaaaccacagaacacccc

SEQ ID NO: 113449 - DNA, 22 bp, Artificial Sequence
  chemically synthesized
tatgaaaccacagaacaccccc

SEQ ID NO: 113450 - DNA, 22 bp, Artificial Sequence
  chemically synthesized
gagaaagaaaaaccaacttgat

SEQ ID NO: 113451 - DNA, 22 bp, Artificial Sequence
  chemically synthesized
agaaagaaaaaccaacttgatg

SEQ ID NO: 113452 - DNA, 22 bp, Artificial Sequence
  chemically synthesized
gatggcagcacacgttctgatt

SEQ ID NO: 113453 - DNA, 22 bp, Artificial Sequence
  chemically synthesized
atggcagcacacgttctgattt

SEQ ID NO: 113454 - DNA, 22 bp, Artificial Sequence
  chemically synthesized
tgatttcaaattatattacaaa

SEQ ID NO: 113455 - DNA, 22 bp, Artificial Sequence
  chemically synthesized
atttcaaattatattacaaagc

SEQ ID NO: 113456 - DNA, 22 bp, Artificial Sequence
  chemically synthesized
caaattatattacaaagctata

SEQ ID NO: 113457 - DNA, 22 bp, Artificial Sequence
  chemically synthesized
aaattatattacaaagctatag

SEQ ID NO: 113458 - DNA, 22 bp, Artificial Sequence
  chemically synthesized
tattacaaagctatagtaacca

SEQ ID NO: 113459 - DNA, 22 bp, Artificial Sequence
  chemically synthesized
caaagctatagtaaccaaaaaa

SEQ ID NO: 113460 - DNA, 22 bp, Artificial Sequence
  chemically synthesized
tagtaaccaaaaaagtatggta

SEQ ID NO: 113461 - DNA, 22 bp, Artificial Sequence
  chemically synthesized
tcacataaatagacacatagac

SEQ ID NO: 113462 - DNA, 22 bp, Artificial Sequence
  chemically synthesized
aacagaataaagagcccagaaa

SEQ ID NO: 113463 - DNA, 22 bp, Artificial Sequence
  chemically synthesized
acgtatatacagtccagtaatt

SEQ ID NO: 113464 - DNA, 22 bp, Artificial Sequence
  chemically synthesized
cgtatatacagtccagtaattc

SEQ ID NO: 113465 - DNA, 22 bp, Artificial Sequence
  chemically synthesized
tcaacaaggccaccaacacaat

SEQ ID NO: 113466 - DNA, 22 bp, Artificial Sequence
  chemically synthesized
aacaaggccaccaacacaatag

SEQ ID NO: 113467 - DNA, 22 bp, Artificial Sequence
  chemically synthesized
ctcaacaaatagtgttgggaaa

SEQ ID NO: 113468 - DNA, 22 bp, Artificial Sequence
  chemically synthesized
aacaaatagtgttgggaaaact

SEQ ID NO: 113469 - DNA, 22 bp, Artificial Sequence
  chemically synthesized
ggaaaactggatatccaaatgc

SEQ ID NO: 113470 - DNA, 22 bp, Artificial Sequence
  chemically synthesized
gatatccaaatgcaaaagaata

SEQ ID NO: 113471 - DNA, 22 bp, Artificial Sequence
  chemically synthesized
gacctttaccttaagccataag

SEQ ID NO: 113472 - DNA, 22 bp, Artificial Sequence
  chemically synthesized
taccttaagccataagtcaact

SEQ ID NO: 113473 - DNA, 22 bp, Artificial Sequence
  chemically synthesized
accttaagccataagtcaactc

SEQ ID NO: 113474 - DNA, 22 bp, Artificial Sequence
  chemically synthesized
ccttaagccataagtcaactca

SEQ ID NO: 113475 - DNA, 22 bp, Artificial Sequence
  chemically synthesized
aagccataagtcaactcaaaat

SEQ ID NO: 113476 - DNA, 22 bp, Artificial Sequence
  chemically synthesized
agccataagtcaactcaaaata

SEQ ID NO: 113477 - DNA, 22 bp, Artificial Sequence
  chemically synthesized
aaaatagattaaagacataaat

SEQ ID NO: 113478 - DNA, 22 bp, Artificial Sequence
  chemically synthesized
aagacataaatgtaagacctga

SEQ ID NO: 113479 - DNA, 22 bp, Artificial Sequence
  chemically synthesized
aaatcacaaaactcctggaaga

SEQ ID NO: 113480 - DNA, 22 bp, Artificial Sequence
  chemically synthesized
ctggaagaacatgtatagagat

SEQ ID NO: 113481 - DNA, 22 bp, Artificial Sequence
  chemically synthesized
gaagaacatgtatagagatagc

SEQ ID NO: 113482 - DNA, 22 bp, Artificial Sequence
  chemically synthesized
cttgatatcagtctcggcaatt

SEQ ID NO: 113483 - DNA, 22 bp, Artificial Sequence
  chemically synthesized
gatatcagtctcggcaattttt

SEQ ID NO: 113484 - DNA, 22 bp, Artificial Sequence
  chemically synthesized
atatcagtctcggcaatttttt

SEQ ID NO: 113485 - DNA, 22 bp, Artificial Sequence
  chemically synthesized
ggcaattttttagatattgtct

SEQ ID NO: 113486 - DNA, 22 bp, Artificial Sequence
  chemically synthesized
tttagatattgtcttgatttga

SEQ ID NO: 113487 - DNA, 22 bp, Artificial Sequence
  chemically synthesized
ttagatattgtcttgatttgaa

SEQ ID NO: 113488 - DNA, 22 bp, Artificial Sequence
  chemically synthesized
tagatattgtcttgatttgaag

SEQ ID NO: 113489 - DNA, 22 bp, Artificial Sequence
  chemically synthesized
agatattgtcttgatttgaaga

SEQ ID NO: 113490 - DNA, 22 bp, Artificial Sequence
  chemically synthesized
gatattgtcttgatttgaagaa

SEQ ID NO: 113491 - DNA, 22 bp, Artificial Sequence
  chemically synthesized
tcttgatttgaagaaaattttc

SEQ ID NO: 113492 - DNA, 22 bp, Artificial Sequence
  chemically synthesized
gatttgaagaaaattttcactg

SEQ ID NO: 113493 - DNA, 22 bp, Artificial Sequence
  chemically synthesized
atttgaagaaaattttcactgg

SEQ ID NO: 113494 - DNA, 22 bp, Artificial Sequence
  chemically synthesized
gaagaaaattttcactggaagt

SEQ ID NO: 113495 - DNA, 22 bp, Artificial Sequence
  chemically synthesized
aagaaaattttcactggaagtc

SEQ ID NO: 113496 - DNA, 22 bp, Artificial Sequence
  chemically synthesized
tcactggaagtctatattgatc

SEQ ID NO: 113497 - DNA, 22 bp, Artificial Sequence
  chemically synthesized
cactggaagtctatattgatcg

SEQ ID NO: 113498 - DNA, 22 bp, Artificial Sequence
  chemically synthesized
actggaagtctatattgatcga

SEQ ID NO: 113499 - DNA, 22 bp, Artificial Sequence
  chemically synthesized
gaagtctatattgatcgatttt

SEQ ID NO: 113500 - DNA, 22 bp, Artificial Sequence
  chemically synthesized
tattgatcgattttttctttca

SEQ ID NO: 113501 - DNA, 22 bp, Artificial Sequence
  chemically synthesized
atcgattttttctttcacaaat

SEQ ID NO: 113502 - DNA, 22 bp, Artificial Sequence
  chemically synthesized
tttctttcacaaataaagttcc

SEQ ID NO: 113503 - DNA, 22 bp, Artificial Sequence
  chemically synthesized
ttctttcacaaataaagttcca

SEQ ID NO: 113504 - DNA, 22 bp, Artificial Sequence
  chemically synthesized
tctttcacaaataaagttccag

SEQ ID NO: 113505 - DNA, 22 bp, Artificial Sequence
  chemically synthesized
ctttcacaaataaagttccagt

SEQ ID NO: 113506 - DNA, 22 bp, Artificial Sequence
  chemically synthesized
tttcacaaataaagttccagtt

SEQ ID NO: 113507 - DNA, 22 bp, Artificial Sequence
  chemically synthesized
tcacaaataaagttccagtttt

SEQ ID NO: 113508 - DNA, 22 bp, Artificial Sequence
  chemically synthesized
cacaaataaagttccagttttt

SEQ ID NO: 113509 - DNA, 22 bp, Artificial Sequence
  chemically synthesized
acaaataaagttccagtttttg

SEQ ID NO: 113510 - DNA, 22 bp, Artificial Sequence
  chemically synthesized
cagtttttgagccaagatggcc

SEQ ID NO: 113511 - DNA, 22 bp, Artificial Sequence
  chemically synthesized
ttgagccaagatggccaaatag

SEQ ID NO: 113512 - DNA, 22 bp, Artificial Sequence
  chemically synthesized
tgagccaagatggccaaatagg

SEQ ID NO: 113513 - DNA, 22 bp, Artificial Sequence
  chemically synthesized
gagccaagatggccaaatagga

SEQ ID NO: 113514 - DNA, 22 bp, Artificial Sequence
  chemically synthesized
agccaagatggccaaataggaa

SEQ ID NO: 113515 - DNA, 22 bp, Artificial Sequence
  chemically synthesized
tggtctacagctcccagcgtga

SEQ ID NO: 113516 - DNA, 22 bp, Artificial Sequence
  chemically synthesized
gtctacagctcccagcgtgaac

SEQ ID NO: 113517 - DNA, 22 bp, Artificial Sequence
  chemically synthesized
cagctcccagcgtgaacaacac

SEQ ID NO: 113518 - DNA, 22 bp, Artificial Sequence
  chemically synthesized
ccagcgtgaacaacacagaaga

SEQ ID NO: 113519 - DNA, 22 bp, Artificial Sequence
  chemically synthesized
ctgcatttccatctgaggtatg

SEQ ID NO: 113520 - DNA, 22 bp, Artificial Sequence
  chemically synthesized
tgcatttccatctgaggtatgg

SEQ ID NO: 113521 - DNA, 22 bp, Artificial Sequence
  chemically synthesized
catttccatctgaggtatgggg

SEQ ID NO: 113522 - DNA, 22 bp, Artificial Sequence
  chemically synthesized
ccatctgaggtatggggttcat

SEQ ID NO: 113523 - DNA, 22 bp, Artificial Sequence
  chemically synthesized
catctgaggtatggggttcatc

SEQ ID NO: 113524 - DNA, 22 bp, Artificial Sequence
  chemically synthesized
aggtatggggttcatctcgcta

SEQ ID NO: 113525 - DNA, 22 bp, Artificial Sequence
  chemically synthesized
atctcgctagggagtgccagac

SEQ ID NO: 113526 - DNA, 22 bp, Artificial Sequence
  chemically synthesized
gctagggagtgccagacagtgg

SEQ ID NO: 113527 - DNA, 22 bp, Artificial Sequence
  chemically synthesized
gggagtgccagacagtgggcac

SEQ ID NO: 113528 - DNA, 22 bp, Artificial Sequence
  chemically synthesized
cctcacttgggaagcacaaggg

SEQ ID NO: 113529 - DNA, 22 bp, Artificial Sequence
  chemically synthesized
acttgggaagcacaaggggtca

SEQ ID NO: 113530 - DNA, 22 bp, Artificial Sequence
  chemically synthesized
gggaagcacaaggggtcatgga

SEQ ID NO: 113531 - DNA, 22 bp, Artificial Sequence
  chemically synthesized
ggaagcacaaggggtcatggag

SEQ ID NO: 113532 - DNA, 22 bp, Artificial Sequence
  chemically synthesized
cctttcctggtcaaggaaaggg

SEQ ID NO: 113533 - DNA, 22 bp, Artificial Sequence
  chemically synthesized
tcctggtcaaggaaaggggtga

SEQ ID NO: 113534 - DNA, 22 bp, Artificial Sequence
  chemically synthesized
cctggtcaaggaaaggggtgac

SEQ ID NO: 113535 - DNA, 22 bp, Artificial Sequence
  chemically synthesized
ctggtcaaggaaaggggtgaca

SEQ ID NO: 113536 - DNA, 22 bp, Artificial Sequence
  chemically synthesized
gtcaaggaaaggggtgacatac

SEQ ID NO: 113537 - DNA, 22 bp, Artificial Sequence
  chemically synthesized
gaaaattgggccactcccaccc

SEQ ID NO: 113538 - DNA, 22 bp, Artificial Sequence
  chemically synthesized
ggccactcccacccgaatactg

SEQ ID NO: 113539 - DNA, 22 bp, Artificial Sequence
  chemically synthesized
ccacccgaatactgtgcttttc

SEQ ID NO: 113540 - DNA, 22 bp, Artificial Sequence
  chemically synthesized
tgcttttctgacaggcttagga

SEQ ID NO: 113541 - DNA, 22 bp, Artificial Sequence
  chemically synthesized
ttctgacaggcttaggaaatgg

SEQ ID NO: 113542 - DNA, 22 bp, Artificial Sequence
  chemically synthesized
tctgacaggcttaggaaatggc

SEQ ID NO: 113543 - DNA, 22 bp, Artificial Sequence
  chemically synthesized
ctgacaggcttaggaaatggcg

SEQ ID NO: 113544 - DNA, 22 bp, Artificial Sequence
  chemically synthesized
tgacaggcttaggaaatggcgc

SEQ ID NO: 113545 - DNA, 22 bp, Artificial Sequence
  chemically synthesized
acaggcttaggaaatggcgcac

SEQ ID NO: 113546 - DNA, 22 bp, Artificial Sequence
  chemically synthesized
aggaaatggcgcaccaggagat

SEQ ID NO: 113547 - DNA, 22 bp, Artificial Sequence
  chemically synthesized
ggaaatggcgcaccaggagatt

SEQ ID NO: 113548 - DNA, 22 bp, Artificial Sequence
  chemically synthesized
tatcctgcacatggctccgagg

SEQ ID NO: 113549 - DNA, 22 bp, Artificial Sequence
  chemically synthesized
cacatggctccgagggtcctac

SEQ ID NO: 113550 - DNA, 22 bp, Artificial Sequence
  chemically synthesized
cgagggtcctacgcccacggag

SEQ ID NO: 113551 - DNA, 22 bp, Artificial Sequence
  chemically synthesized
cgcccacggagtctccctgatt

SEQ ID NO: 113552 - DNA, 22 bp, Artificial Sequence
  chemically synthesized
cctgattgctagcacagcagtc

SEQ ID NO: 113553 - DNA, 22 bp, Artificial Sequence
  chemically synthesized
attgctagcacagcagtctgag

SEQ ID NO: 113554 - DNA, 22 bp, Artificial Sequence
  chemically synthesized
ctagcacagcagtctgagatca

SEQ ID NO: 113555 - DNA, 22 bp, Artificial Sequence
  chemically synthesized
gcacagcagtctgagatcaaac

SEQ ID NO: 113556 - DNA, 22 bp, Artificial Sequence
  chemically synthesized
agatcaaactgcaaggtggcag

SEQ ID NO: 113557 - DNA, 22 bp, Artificial Sequence
  chemically synthesized
caaggtggcagcgaggctgggg

SEQ ID NO: 113558 - DNA, 22 bp, Artificial Sequence
  chemically synthesized
ggggaggggcagccgccattgc

SEQ ID NO: 113559 - DNA, 22 bp, Artificial Sequence
  chemically synthesized
cccaggcttgcttaggtaaaca

SEQ ID NO: 113560 - DNA, 22 bp, Artificial Sequence
  chemically synthesized
gcttaggtaaacaaagcagcca

SEQ ID NO: 113561 - DNA, 22 bp, Artificial Sequence
  chemically synthesized
cttaggtaaacaaagcagccag

SEQ ID NO: 113562 - DNA, 22 bp, Artificial Sequence
  chemically synthesized
aggtaaacaaagcagccaggaa

SEQ ID NO: 113563 - DNA, 22 bp, Artificial Sequence
  chemically synthesized
ggtaaacaaagcagccaggaag

SEQ ID NO: 113564 - DNA, 22 bp, Artificial Sequence
  chemically synthesized
aaactgggtggaccccaccaca

SEQ ID NO: 113565 - DNA, 22 bp, Artificial Sequence
  chemically synthesized
ggtggaccccaccacagctcaa

SEQ ID NO: 113566 - DNA, 22 bp, Artificial Sequence
  chemically synthesized
aaggaggcctgcctgcctctgt

SEQ ID NO: 113567 - DNA, 22 bp, Artificial Sequence
  chemically synthesized
cctgcctctgtaggctccacct

SEQ ID NO: 113568 - DNA, 22 bp, Artificial Sequence
  chemically synthesized
cctctgtaggctccacctttgg

SEQ ID NO: 113569 - DNA, 22 bp, Artificial Sequence
  chemically synthesized
tgtaggctccacctttgggggc

SEQ ID NO: 113570 - DNA, 22 bp, Artificial Sequence
  chemically synthesized
taggctccacctttgggggcag

SEQ ID NO: 113571 - DNA, 22 bp, Artificial Sequence
  chemically synthesized
cacctttgggggcagggcacag

SEQ ID NO: 113572 - DNA, 22 bp, Artificial Sequence
  chemically synthesized
tgggggcagggcacagacaaac

SEQ ID NO: 113573 - DNA, 22 bp, Artificial Sequence
  chemically synthesized
gggggcagggcacagacaaaca

SEQ ID NO: 113574 - DNA, 22 bp, Artificial Sequence
  chemically synthesized
ggggcagggcacagacaaacaa

SEQ ID NO: 113575 - DNA, 22 bp, Artificial Sequence
  chemically synthesized
tgcagacttaaatgtccctgtc

SEQ ID NO: 113576 - DNA, 22 bp, Artificial Sequence
  chemically synthesized
cagacttaaatgtccctgtctg

SEQ ID NO: 113577 - DNA, 22 bp, Artificial Sequence
  chemically synthesized
aaatgtccctgtctgacagctt

SEQ ID NO: 113578 - DNA, 22 bp, Artificial Sequence
  chemically synthesized
aatgtccctgtctgacagcttt

SEQ ID NO: 113579 - DNA, 22 bp, Artificial Sequence
  chemically synthesized
tctgacagctttgaggagagca

SEQ ID NO: 113580 - DNA, 22 bp, Artificial Sequence
  chemically synthesized
acagctttgaggagagcagtgg

SEQ ID NO: 113581 - DNA, 22 bp, Artificial Sequence
  chemically synthesized
tgaggagagcagtggttctccc

SEQ ID NO: 113582 - DNA, 22 bp, Artificial Sequence
  chemically synthesized
gaggagagcagtggttctccca

SEQ ID NO: 113583 - DNA, 22 bp, Artificial Sequence
  chemically synthesized
aggagagcagtggttctcccag

SEQ ID NO: 113584 - DNA, 22 bp, Artificial Sequence
  chemically synthesized
tcccagcacacagctggagatc

SEQ ID NO: 113585 - DNA, 22 bp, Artificial Sequence
  chemically synthesized
ccagcacacagctggagatctg

SEQ ID NO: 113586 - DNA, 22 bp, Artificial Sequence
  chemically synthesized
gagatctgagaacgggcagact

SEQ ID NO: 113587 - DNA, 22 bp, Artificial Sequence
  chemically synthesized
agaacgggcagactgcctcctc

SEQ ID NO: 113588 - DNA, 22 bp, Artificial Sequence
  chemically synthesized
cctcctcaagtgggtccctgac

SEQ ID NO: 113589 - DNA, 22 bp, Artificial Sequence
  chemically synthesized
ctcaagtgggtccctgacccct

SEQ ID NO: 113590 - DNA, 22 bp, Artificial Sequence
  chemically synthesized
aagtgggtccctgacccctgac

SEQ ID NO: 113591 - DNA, 22 bp, Artificial Sequence
  chemically synthesized
acccctgacccccgagcagcct

SEQ ID NO: 113592 - DNA, 22 bp, Artificial Sequence
  chemically synthesized
acccccgagcagcctaactggg

SEQ ID NO: 113593 - DNA, 22 bp, Artificial Sequence
  chemically synthesized
actgggaggcacccccaagtaa

SEQ ID NO: 113594 - DNA, 22 bp, Artificial Sequence
  chemically synthesized
ggaggcacccccaagtaagggc

SEQ ID NO: 113595 - DNA, 22 bp, Artificial Sequence
  chemically synthesized
acacctcacacggccaggtact

SEQ ID NO: 113596 - DNA, 22 bp, Artificial Sequence
  chemically synthesized
acacggccaggtactcctctga

SEQ ID NO: 113597 - DNA, 22 bp, Artificial Sequence
  chemically synthesized
ctctgagacaaaacttccagag

SEQ ID NO: 113598 - DNA, 22 bp, Artificial Sequence
  chemically synthesized
tgagacaaaacttccagaggaa

SEQ ID NO: 113599 - DNA, 22 bp, Artificial Sequence
  chemically synthesized
agacaaaacttccagaggaacg

SEQ ID NO: 113600 - DNA, 22 bp, Artificial Sequence
  chemically synthesized
ccagaggaacgatcagacagca

SEQ ID NO: 113601 - DNA, 22 bp, Artificial Sequence
  chemically synthesized
cagaggaacgatcagacagcag

SEQ ID NO: 113602 - DNA, 22 bp, Artificial Sequence
  chemically synthesized
gcggatcacgaaaatctgcggt

SEQ ID NO: 113603 - DNA, 22 bp, Artificial Sequence
  chemically synthesized
cggttctgcagacaccgctgct

SEQ ID NO: 113604 - DNA, 22 bp, Artificial Sequence
  chemically synthesized
tgcagacaccgctgctgatacc

SEQ ID NO: 113605 - DNA, 22 bp, Artificial Sequence
  chemically synthesized
cagacaccgctgctgataccca

SEQ ID NO: 113606 - DNA, 22 bp, Artificial Sequence
  chemically synthesized
ctgatacccaggcaaacagggt

SEQ ID NO: 113607 - DNA, 22 bp, Artificial Sequence
  chemically synthesized
atacccaggcaaacagggtctg

SEQ ID NO: 113608 - DNA, 22 bp, Artificial Sequence
  chemically synthesized
gagtggacctctagcaaactcc

SEQ ID NO: 113609 - DNA, 22 bp, Artificial Sequence
  chemically synthesized
tagcaaactccaacagacctgc

SEQ ID NO: 113610 - DNA, 22 bp, Artificial Sequence
  chemically synthesized
gcaaactccaacagacctgcag

SEQ ID NO: 113611 - DNA, 22 bp, Artificial Sequence
  chemically synthesized
caacagacctgcagctgagggt

SEQ ID NO: 113612 - DNA, 22 bp, Artificial Sequence
  chemically synthesized
cagctgagggtcctgtctgtta

SEQ ID NO: 113613 - DNA, 22 bp, Artificial Sequence
  chemically synthesized
agggtcctgtctgttagaagga

SEQ ID NO: 113614 - DNA, 22 bp, Artificial Sequence
  chemically synthesized
tctgttagaaggaaaactaaca

SEQ ID NO: 113615 - DNA, 22 bp, Artificial Sequence
  chemically synthesized
ttagaaggaaaactaacaaaca

SEQ ID NO: 113616 - DNA, 22 bp, Artificial Sequence
  chemically synthesized
gaaggaaaactaacaaacagaa

SEQ ID NO: 113617 - DNA, 22 bp, Artificial Sequence
  chemically synthesized
acaaacagaaaggacatccaca

SEQ ID NO: 113618 - DNA, 22 bp, Artificial Sequence
  chemically synthesized
tcatcaaagaccaaaagtagat

SEQ ID NO: 113619 - DNA, 22 bp, Artificial Sequence
  chemically synthesized
gggaaaaaacagagcagaaaaa

SEQ ID NO: 113620 - DNA, 22 bp, Artificial Sequence
  chemically synthesized
gaaactctaaaaagcagagcac

SEQ ID NO: 113621 - DNA, 22 bp, Artificial Sequence
  chemically synthesized
taaaaagcagagcacctttcct

SEQ ID NO: 113622 - DNA, 22 bp, Artificial Sequence
  chemically synthesized
aaaagcagagcacctttcctcc

SEQ ID NO: 113623 - DNA, 22 bp, Artificial Sequence
  chemically synthesized
tcctcctccaaaggaaagcagt

SEQ ID NO: 113624 - DNA, 22 bp, Artificial Sequence
  chemically synthesized
cctcctccaaaggaaagcagtt

SEQ ID NO: 113625 - DNA, 22 bp, Artificial Sequence
  chemically synthesized
ctcctccaaaggaaagcagttc

SEQ ID NO: 113626 - DNA, 22 bp, Artificial Sequence
  chemically synthesized
ctccaaaggaaagcagttcctc

SEQ ID NO: 113627 - DNA, 22 bp, Artificial Sequence
  chemically synthesized
caaaggaaagcagttcctcacc

SEQ ID NO: 113628 - DNA, 22 bp, Artificial Sequence
  chemically synthesized
ctcaccagcaacggaacaaagc

SEQ ID NO: 113629 - DNA, 22 bp, Artificial Sequence
  chemically synthesized
accagcaacggaacaaagctgg

SEQ ID NO: 113630 - DNA, 22 bp, Artificial Sequence
  chemically synthesized
gatggagaatgactttgacgag

SEQ ID NO: 113631 - DNA, 22 bp, Artificial Sequence
  chemically synthesized
tgacgagctgagagaagaagac

SEQ ID NO: 113632 - DNA, 22 bp, Artificial Sequence
  chemically synthesized
gacgagctgagagaagaagact

SEQ ID NO: 113633 - DNA, 22 bp, Artificial Sequence
  chemically synthesized
acgagctgagagaagaagactt

SEQ ID NO: 113634 - DNA, 22 bp, Artificial Sequence
  chemically synthesized
agagaagaagacttcagacgat

SEQ ID NO: 113635 - DNA, 22 bp, Artificial Sequence
  chemically synthesized
cagacgatgaaactactccgag

SEQ ID NO: 113636 - DNA, 22 bp, Artificial Sequence
  chemically synthesized
agacgatgaaactactccgagc

SEQ ID NO: 113637 - DNA, 22 bp, Artificial Sequence
  chemically synthesized
ctccgagctacaggaggaaatt

SEQ ID NO: 113638 - DNA, 22 bp, Artificial Sequence
  chemically synthesized
cgagctacaggaggaaattcaa

SEQ ID NO: 113639 - DNA, 22 bp, Artificial Sequence
  chemically synthesized
caggaggaaattcaaaccaaag

SEQ ID NO: 113640 - DNA, 22 bp, Artificial Sequence
  chemically synthesized
aaaccaaaggcaaagaagataa

SEQ ID NO: 113641 - DNA, 22 bp, Artificial Sequence
  chemically synthesized
tgaaaaaaaatttagatgaatg

SEQ ID NO: 113642 - DNA, 22 bp, Artificial Sequence
  chemically synthesized
gaaaaaaaatttagatgaatgt

SEQ ID NO: 113643 - DNA, 22 bp, Artificial Sequence
  chemically synthesized
aaaaaaaatttagatgaatgta

SEQ ID NO: 113644 - DNA, 22 bp, Artificial Sequence
  chemically synthesized
agatgaatgtataactagaata

SEQ ID NO: 113645 - DNA, 22 bp, Artificial Sequence
  chemically synthesized
gatgaatgtataactagaataa

SEQ ID NO: 113646 - DNA, 22 bp, Artificial Sequence
  chemically synthesized
gaataaccaatacagagaagtg

SEQ ID NO: 113647 - DNA, 22 bp, Artificial Sequence
  chemically synthesized
aaaggagctgatggagctgaaa

SEQ ID NO: 113648 - DNA, 22 bp, Artificial Sequence
  chemically synthesized
aaggagctgatggagctgaaag

SEQ ID NO: 113649 - DNA, 22 bp, Artificial Sequence
  chemically synthesized
atggagctgaaagccaaggctc

SEQ ID NO: 113650 - DNA, 22 bp, Artificial Sequence
  chemically synthesized
aaagccaaggctcgagaatgac

SEQ ID NO: 113651 - DNA, 22 bp, Artificial Sequence
  chemically synthesized
gagaatgacgtgaagaatggag

SEQ ID NO: 113652 - DNA, 22 bp, Artificial Sequence
  chemically synthesized
aggagctgatgcgatcaactgg

SEQ ID NO: 113653 - DNA, 22 bp, Artificial Sequence
  chemically synthesized
atgcgatcaactggaagaaagg

SEQ ID NO: 113654 - DNA, 22 bp, Artificial Sequence
  chemically synthesized
gaagaaagggtatcagtgatgg

SEQ ID NO: 113655 - DNA, 22 bp, Artificial Sequence
  chemically synthesized
agagaaaaaagaataaaaagaa

SEQ ID NO: 113656 - DNA, 22 bp, Artificial Sequence
  chemically synthesized
gagaaaaaagaataaaaagaaa

SEQ ID NO: 113657 - DNA, 22 bp, Artificial Sequence
  chemically synthesized
caagaaatatgggactatgtga

SEQ ID NO: 113658 - DNA, 22 bp, Artificial Sequence
  chemically synthesized
tgtgaaaagatcaaatctaggt

SEQ ID NO: 113659 - DNA, 22 bp, Artificial Sequence
  chemically synthesized
ggtctgattggtgtacctgaaa

SEQ ID NO: 113660 - DNA, 22 bp, Artificial Sequence
  chemically synthesized
attggtgtacctgaaagtgacg

SEQ ID NO: 113661 - DNA, 22 bp, Artificial Sequence
  chemically synthesized
gtgtacctgaaagtgacgggga

SEQ ID NO: 113662 - DNA, 22 bp, Artificial Sequence
  chemically synthesized
aaagtgacggggagaatcgaac

SEQ ID NO: 113663 - DNA, 22 bp, Artificial Sequence
  chemically synthesized
gaaaacactctgcaggatatta

SEQ ID NO: 113664 - DNA, 22 bp, Artificial Sequence
  chemically synthesized
tgcaggatattatccaggagaa

SEQ ID NO: 113665 - DNA, 22 bp, Artificial Sequence
  chemically synthesized
caggatattatccaggagaact

SEQ ID NO: 113666 - DNA, 22 bp, Artificial Sequence
  chemically synthesized
tccaggagaacttccccaatct

SEQ ID NO: 113667 - DNA, 22 bp, Artificial Sequence
  chemically synthesized
ccccaatctagcaaggcaggcc

SEQ ID NO: 113668 - DNA, 22 bp, Artificial Sequence
  chemically synthesized
cccaatctagcaaggcaggcca

SEQ ID NO: 113669 - DNA, 22 bp, Artificial Sequence
  chemically synthesized
gcaaggcaggccaacattcaga

SEQ ID NO: 113670 - DNA, 22 bp, Artificial Sequence
  chemically synthesized
agattcaggaaatacagagaac

SEQ ID NO: 113671 - DNA, 22 bp, Artificial Sequence
  chemically synthesized
aggaaatacagagaacgccaca

SEQ ID NO: 113672 - DNA, 22 bp, Artificial Sequence
  chemically synthesized
ctcgagaagagcaactccaaga

SEQ ID NO: 113673 - DNA, 22 bp, Artificial Sequence
  chemically synthesized
gagaagagcaactccaagacac

SEQ ID NO: 113674 - DNA, 22 bp, Artificial Sequence
  chemically synthesized
caagacacataattgtcagatt

SEQ ID NO: 113675 - DNA, 22 bp, Artificial Sequence
  chemically synthesized
tcagattcaccaaagttgaaat

SEQ ID NO: 113676 - DNA, 22 bp, Artificial Sequence
  chemically synthesized
accaaagttgaaatgaaggaaa

SEQ ID NO: 113677 - DNA, 22 bp, Artificial Sequence
  chemically synthesized
aaatgaaggaaaaaatgttaag

SEQ ID NO: 113678 - DNA, 22 bp, Artificial Sequence
  chemically synthesized
agggcagccagagagaaaggtc

SEQ ID NO: 113679 - DNA, 22 bp, Artificial Sequence
  chemically synthesized
cccacaaagggaagcccatcag

SEQ ID NO: 113680 - DNA, 22 bp, Artificial Sequence
  chemically synthesized
acagcagctctcttggcagaaa

SEQ ID NO: 113681 - DNA, 22 bp, Artificial Sequence
  chemically synthesized
tcttggcagaaactctacaagc

SEQ ID NO: 113682 - DNA, 22 bp, Artificial Sequence
  chemically synthesized
ttggcagaaactctacaagcca

SEQ ID NO: 113683 - DNA, 22 bp, Artificial Sequence
  chemically synthesized
ggcagaaactctacaagccaga

SEQ ID NO: 113684 - DNA, 22 bp, Artificial Sequence
  chemically synthesized
gcagaaactctacaagccagaa

SEQ ID NO: 113685 - DNA, 22 bp, Artificial Sequence
  chemically synthesized
tacaagccagaagagagtgggg

SEQ ID NO: 113686 - DNA, 22 bp, Artificial Sequence
  chemically synthesized
caagccagaagagagtgggggc

SEQ ID NO: 113687 - DNA, 22 bp, Artificial Sequence
  chemically synthesized
aacatccttaaaggaaagaatt

SEQ ID NO: 113688 - DNA, 22 bp, Artificial Sequence
  chemically synthesized
aaaggaaagaattttcaacaca

SEQ ID NO: 113689 - DNA, 22 bp, Artificial Sequence
  chemically synthesized
aaggaaagaattttcaacacag

SEQ ID NO: 113690 - DNA, 22 bp, Artificial Sequence
  chemically synthesized
tcaacacagaatttaatatcca

SEQ ID NO: 113691 - DNA, 22 bp, Artificial Sequence
  chemically synthesized
caacacagaatttaatatccag

SEQ ID NO: 113692 - DNA, 22 bp, Artificial Sequence
  chemically synthesized
aacacagaatttaatatccagc

SEQ ID NO: 113693 - DNA, 22 bp, Artificial Sequence
  chemically synthesized
aatatccagccaaactaagctt

SEQ ID NO: 113694 - DNA, 22 bp, Artificial Sequence
  chemically synthesized
atatccagccaaactaagcttc

SEQ ID NO: 113695 - DNA, 22 bp, Artificial Sequence
  chemically synthesized
agcttcataagtgaaggagaaa

SEQ ID NO: 113696 - DNA, 22 bp, Artificial Sequence
  chemically synthesized
cataagtgaaggagaaataaaa

SEQ ID NO: 113697 - DNA, 22 bp, Artificial Sequence
  chemically synthesized
ataagtgaaggagaaataaaat

SEQ ID NO: 113698 - DNA, 22 bp, Artificial Sequence
  chemically synthesized
tacagacaagcaaatgctgaga

SEQ ID NO: 113699 - DNA, 22 bp, Artificial Sequence
  chemically synthesized
acagacaagcaaatgctgagag

SEQ ID NO: 113700 - DNA, 22 bp, Artificial Sequence
  chemically synthesized
cagacaagcaaatgctgagaga

SEQ ID NO: 113701 - DNA, 22 bp, Artificial Sequence
  chemically synthesized
agagattttgtcatcaccaggc

SEQ ID NO: 113702 - DNA, 22 bp, Artificial Sequence
  chemically synthesized
tgtcatcaccaggcctgaccta

SEQ ID NO: 113703 - DNA, 22 bp, Artificial Sequence
  chemically synthesized
gtcatcaccaggcctgacctaa

SEQ ID NO: 113704 - DNA, 22 bp, Artificial Sequence
  chemically synthesized
tcatcaccaggcctgacctaaa

SEQ ID NO: 113705 - DNA, 22 bp, Artificial Sequence
  chemically synthesized
acctaaaagagctcctgaagga

SEQ ID NO: 113706 - DNA, 22 bp, Artificial Sequence
  chemically synthesized
aaagagctcctgaaggaagcac

SEQ ID NO: 113707 - DNA, 22 bp, Artificial Sequence
  chemically synthesized
ctgaaggaagcactaaacatgg

SEQ ID NO: 113708 - DNA, 22 bp, Artificial Sequence
  chemically synthesized
aaggaagcactaaacatggaaa

SEQ ID NO: 113709 - DNA, 22 bp, Artificial Sequence
  chemically synthesized
aacatggaaaggcacaaccggt

SEQ ID NO: 113710 - DNA, 22 bp, Artificial Sequence
  chemically synthesized
caaaatcaggccaaaatgtgaa

SEQ ID NO: 113711 - DNA, 22 bp, Artificial Sequence
  chemically synthesized
ggaagaaactgcatcaactaac

SEQ ID NO: 113712 - DNA, 22 bp, Artificial Sequence
  chemically synthesized
catcaactaacgagcaaaataa

SEQ ID NO: 113713 - DNA, 22 bp, Artificial Sequence
  chemically synthesized
acgagcaaaataaccagctatc

SEQ ID NO: 113714 - DNA, 22 bp, Artificial Sequence
  chemically synthesized
tcataatgacaggatcaaattc

SEQ ID NO: 113715 - DNA, 22 bp, Artificial Sequence
  chemically synthesized
acacatacaatattaactttaa

SEQ ID NO: 113716 - DNA, 22 bp, Artificial Sequence
  chemically synthesized
actttaaatgtaaatggactaa

SEQ ID NO: 113717 - DNA, 22 bp, Artificial Sequence
  chemically synthesized
taaatgtaaatggactaagtgc

SEQ ID NO: 113718 - DNA, 22 bp, Artificial Sequence
  chemically synthesized
aaatgtaaatggactaagtgct

SEQ ID NO: 113719 - DNA, 22 bp, Artificial Sequence
  chemically synthesized
aatgtaaatggactaagtgctc

SEQ ID NO: 113720 - DNA, 22 bp, Artificial Sequence
  chemically synthesized
agtgctccaattgaaagacaca

SEQ ID NO: 113721 - DNA, 22 bp, Artificial Sequence
  chemically synthesized
caattgaaagacacagactggc

SEQ ID NO: 113722 - DNA, 22 bp, Artificial Sequence
  chemically synthesized
aaagacacagactggcaaattg

SEQ ID NO: 113723 - DNA, 22 bp, Artificial Sequence
  chemically synthesized
gcaaattggataaagagtgtat

SEQ ID NO: 113724 - DNA, 22 bp, Artificial Sequence
  chemically synthesized
gataaagagtgtattcaggaaa

SEQ ID NO: 113725 - DNA, 22 bp, Artificial Sequence
  chemically synthesized
aggaaacccatctcatgtgcac

SEQ ID NO: 113726 - DNA, 22 bp, Artificial Sequence
  chemically synthesized
atgtgcacacacacacataggc

SEQ ID NO: 113727 - DNA, 22 bp, Artificial Sequence
  chemically synthesized
aaaataaaaggatggaggaaga

SEQ ID NO: 113728 - DNA, 22 bp, Artificial Sequence
  chemically synthesized
ccaagcaaatggaaaacaaaaa

SEQ ID NO: 113729 - DNA, 22 bp, Artificial Sequence
  chemically synthesized
caatcctagtctctgataaaac

SEQ ID NO: 113730 - DNA, 22 bp, Artificial Sequence
  chemically synthesized
gtctctgataaaacaggcttta

SEQ ID NO: 113731 - DNA, 22 bp, Artificial Sequence
  chemically synthesized
tgataaaacaggctttaaacca

SEQ ID NO: 113732 - DNA, 22 bp, Artificial Sequence
  chemically synthesized
ataaaacaggctttaaaccaac

SEQ ID NO: 113733 - DNA, 22 bp, Artificial Sequence
  chemically synthesized
taaaccaacaaagatcaaaaga

SEQ ID NO: 113734 - DNA, 22 bp, Artificial Sequence
  chemically synthesized
aaaccaacaaagatcaaaagag

SEQ ID NO: 113735 - DNA, 22 bp, Artificial Sequence
  chemically synthesized
aaccaacaaagatcaaaagaga

SEQ ID NO: 113736 - DNA, 22 bp, Artificial Sequence
  chemically synthesized
cataatggtaaagggatcaatt

SEQ ID NO: 113737 - DNA, 22 bp, Artificial Sequence
  chemically synthesized
aacaagaagagctaactatcct

SEQ ID NO: 113738 - DNA, 22 bp, Artificial Sequence
  chemically synthesized
actatcctaaatatatatgcac

SEQ ID NO: 113739 - DNA, 22 bp, Artificial Sequence
  chemically synthesized
tcctaaatatatatgcacccaa

SEQ ID NO: 113740 - DNA, 22 bp, Artificial Sequence
  chemically synthesized
aatatatatgcacccaatacag

SEQ ID NO: 113741 - DNA, 22 bp, Artificial Sequence
  chemically synthesized
ataaagcaagtccttagagacc

SEQ ID NO: 113742 - DNA, 22 bp, Artificial Sequence
  chemically synthesized
agagacctacaaagagacttag

SEQ ID NO: 113743 - DNA, 22 bp, Artificial Sequence
  chemically synthesized
gagacctacaaagagacttaga

SEQ ID NO: 113744 - DNA, 22 bp, Artificial Sequence
  chemically synthesized
caaagagacttagactcccaca

SEQ ID NO: 113745 - DNA, 22 bp, Artificial Sequence
  chemically synthesized
agactcccacactttaataatg

SEQ ID NO: 113746 - DNA, 22 bp, Artificial Sequence
  chemically synthesized
gactcccacactttaataatgg

SEQ ID NO: 113747 - DNA, 22 bp, Artificial Sequence
  chemically synthesized
ccacactttaataatgggagac

SEQ ID NO: 113748 - DNA, 22 bp, Artificial Sequence
  chemically synthesized
taataatgggagactttaatac

SEQ ID NO: 113749 - DNA, 22 bp, Artificial Sequence
  chemically synthesized
aataatgggagactttaatacc

SEQ ID NO: 113750 - DNA, 22 bp, Artificial Sequence
  chemically synthesized
ataatgggagactttaataccc

SEQ ID NO: 113751 - DNA, 22 bp, Artificial Sequence
  chemically synthesized
taataccccactgtcaacatta

SEQ ID NO: 113752 - DNA, 22 bp, Artificial Sequence
  chemically synthesized
aataccccactgtcaacattag

SEQ ID NO: 113753 - DNA, 22 bp, Artificial Sequence
  chemically synthesized
ataccccactgtcaacattaga

SEQ ID NO: 113754 - DNA, 22 bp, Artificial Sequence
  chemically synthesized
tcaacattagacagatcaacga

SEQ ID NO: 113755 - DNA, 22 bp, Artificial Sequence
  chemically synthesized
gacagatcaacgagacagaaag

SEQ ID NO: 113756 - DNA, 22 bp, Artificial Sequence
  chemically synthesized
acaaggatatccaggaattgaa

SEQ ID NO: 113757 - DNA, 22 bp, Artificial Sequence
  chemically synthesized
aacacagctctgcaccaagcag

SEQ ID NO: 113758 - DNA, 22 bp, Artificial Sequence
  chemically synthesized
tgcaccaagcagacctaataga

SEQ ID NO: 113759 - DNA, 22 bp, Artificial Sequence
  chemically synthesized
caccaagcagacctaatagaca

SEQ ID NO: 113760 - DNA, 22 bp, Artificial Sequence
  chemically synthesized
atagacatctacagaactctcc

SEQ ID NO: 113761 - DNA, 22 bp, Artificial Sequence
  chemically synthesized
cagaactctccaccccaaatca

SEQ ID NO: 113762 - DNA, 22 bp, Artificial Sequence
  chemically synthesized
tccaccccaaatcaacagaata

SEQ ID NO: 113763 - DNA, 22 bp, Artificial Sequence
  chemically synthesized
caccccaaatcaacagaatata

SEQ ID NO: 113764 - DNA, 22 bp, Artificial Sequence
  chemically synthesized
tttttcagcaccacacaacacc

SEQ ID NO: 113765 - DNA, 22 bp, Artificial Sequence
  chemically synthesized
ttttcagcaccacacaacacct

SEQ ID NO: 113766 - DNA, 22 bp, Artificial Sequence
  chemically synthesized
tttcagcaccacacaacaccta

SEQ ID NO: 113767 - DNA, 22 bp, Artificial Sequence
  chemically synthesized
ttcagcaccacacaacacctat

SEQ ID NO: 113768 - DNA, 22 bp, Artificial Sequence
  chemically synthesized
tcagcaccacacaacacctatt

SEQ ID NO: 113769 - DNA, 22 bp, Artificial Sequence
  chemically synthesized
cagcaccacacaacacctattc

SEQ ID NO: 113770 - DNA, 22 bp, Artificial Sequence
  chemically synthesized
agcaccacacaacacctattcc

SEQ ID NO: 113771 - DNA, 22 bp, Artificial Sequence
  chemically synthesized
ttccaaaattgaccacatactt

SEQ ID NO: 113772 - DNA, 22 bp, Artificial Sequence
  chemically synthesized
caaaattgaccacatacttgga

SEQ ID NO: 113773 - DNA, 22 bp, Artificial Sequence
  chemically synthesized
accacatacttggaagtaaagc

SEQ ID NO: 113774 - DNA, 22 bp, Artificial Sequence
  chemically synthesized
ggaagtaaagctctcctcagca

SEQ ID NO: 113775 - DNA, 22 bp, Artificial Sequence
  chemically synthesized
gaagtaaagctctcctcagcaa

SEQ ID NO: 113776 - DNA, 22 bp, Artificial Sequence
  chemically synthesized
tcctcagcaaatataaaagaac

SEQ ID NO: 113777 - DNA, 22 bp, Artificial Sequence
  chemically synthesized
ctcagcaaatataaaagaacag

SEQ ID NO: 113778 - DNA, 22 bp, Artificial Sequence
  chemically synthesized
agcaaatataaaagaacagaaa

SEQ ID NO: 113779 - DNA, 22 bp, Artificial Sequence
  chemically synthesized
taacaaactgtctctcagacca

SEQ ID NO: 113780 - DNA, 22 bp, Artificial Sequence
  chemically synthesized
tctctcagaccacagtgcaatc

SEQ ID NO: 113781 - DNA, 22 bp, Artificial Sequence
  chemically synthesized
tcagaccacagtgcaatcaaac

SEQ ID NO: 113782 - DNA, 22 bp, Artificial Sequence
  chemically synthesized
agaccacagtgcaatcaaacta

SEQ ID NO: 113783 - DNA, 22 bp, Artificial Sequence
  chemically synthesized
gaactcaggattaagaaactca

SEQ ID NO: 113784 - DNA, 22 bp, Artificial Sequence
  chemically synthesized
aggattaagaaactcactcaaa

SEQ ID NO: 113785 - DNA, 22 bp, Artificial Sequence
  chemically synthesized
agaaactcactcaaaaccactc

SEQ ID NO: 113786 - DNA, 22 bp, Artificial Sequence
  chemically synthesized
actcaaaaccactcaactacat

SEQ ID NO: 113787 - DNA, 22 bp, Artificial Sequence
  chemically synthesized
aaaaccactcaactacatggaa

SEQ ID NO: 113788 - DNA, 22 bp, Artificial Sequence
  chemically synthesized
aactacatggaaactgaacaac

SEQ ID NO: 113789 - DNA, 22 bp, Artificial Sequence
  chemically synthesized
catggaaactgaacaacctgct

SEQ ID NO: 113790 - DNA, 22 bp, Artificial Sequence
  chemically synthesized
aacaacctgctcctgaatgact

SEQ ID NO: 113791 - DNA, 22 bp, Artificial Sequence
  chemically synthesized
ctcctgaatgactactgggtac

SEQ ID NO: 113792 - DNA, 22 bp, Artificial Sequence
  chemically synthesized
ctgaatgactactgggtacata

SEQ ID NO: 113793 - DNA, 22 bp, Artificial Sequence
  chemically synthesized
aatgactactgggtacataacg

SEQ ID NO: 113794 - DNA, 22 bp, Artificial Sequence
  chemically synthesized
ctgggtacataacgaaatgaag

SEQ ID NO: 113795 - DNA, 22 bp, Artificial Sequence
  chemically synthesized
ggtacataacgaaatgaaggca

SEQ ID NO: 113796 - DNA, 22 bp, Artificial Sequence
  chemically synthesized
tttgaaaccaatgagaacaaag

SEQ ID NO: 113797 - DNA, 22 bp, Artificial Sequence
  chemically synthesized
tgaaaccaatgagaacaaagac

SEQ ID NO: 113798 - DNA, 22 bp, Artificial Sequence
  chemically synthesized
gaaaccaatgagaacaaagaca

SEQ ID NO: 113799 - DNA, 22 bp, Artificial Sequence
  chemically synthesized
aaaccaatgagaacaaagacac

SEQ ID NO: 113800 - DNA, 22 bp, Artificial Sequence
  chemically synthesized
tgggacacattcgaatcagtgt

SEQ ID NO: 113801 - DNA, 22 bp, Artificial Sequence
  chemically synthesized
ggacacattcgaatcagtgtgt

SEQ ID NO: 113802 - DNA, 22 bp, Artificial Sequence
  chemically synthesized
gaatcagtgtgtagggggaaat

SEQ ID NO: 113803 - DNA, 22 bp, Artificial Sequence
  chemically synthesized
atagcactaaacgcccacaaga

SEQ ID NO: 113804 - DNA, 22 bp, Artificial Sequence
  chemically synthesized
tagcactaaacgcccacaagag

SEQ ID NO: 113805 - DNA, 22 bp, Artificial Sequence
  chemically synthesized
aacgcccacaagagaaagcaag

SEQ ID NO: 113806 - DNA, 22 bp, Artificial Sequence
  chemically synthesized
acaccctaacatcacaattaaa

SEQ ID NO: 113807 - DNA, 22 bp, Artificial Sequence
  chemically synthesized
acatcacaattaaaagaactag

SEQ ID NO: 113808 - DNA, 22 bp, Artificial Sequence
  chemically synthesized
aaagaactagataagcaagagc

SEQ ID NO: 113809 - DNA, 22 bp, Artificial Sequence
  chemically synthesized
gataagcaagagcaaacacatt

SEQ ID NO: 113810 - DNA, 22 bp, Artificial Sequence
  chemically synthesized
aaaagctagcagaagtcaagaa

SEQ ID NO: 113811 - DNA, 22 bp, Artificial Sequence
  chemically synthesized
gcagaagtcaagaaataactaa

SEQ ID NO: 113812 - DNA, 22 bp, Artificial Sequence
  chemically synthesized
aaatcagagcagaactgaagga

SEQ ID NO: 113813 - DNA, 22 bp, Artificial Sequence
  chemically synthesized
aaggaaacagagacacaaaaaa

SEQ ID NO: 113814 - DNA, 22 bp, Artificial Sequence
  chemically synthesized
caaaaaattaatgaatctggga

SEQ ID NO: 113815 - DNA, 22 bp, Artificial Sequence
  chemically synthesized
aaaaaattaatgaatctgggag

SEQ ID NO: 113816 - DNA, 22 bp, Artificial Sequence
  chemically synthesized
atgaatctgggagctggttttt

SEQ ID NO: 113817 - DNA, 22 bp, Artificial Sequence
  chemically synthesized
ggagctggttttttgaaaggat

SEQ ID NO: 113818 - DNA, 22 bp, Artificial Sequence
  chemically synthesized
gttttttgaaaggatcaacaaa

SEQ ID NO: 113819 - DNA, 22 bp, Artificial Sequence
  chemically synthesized
tttgaaaggatcaacaaaactg

SEQ ID NO: 113820 - DNA, 22 bp, Artificial Sequence
  chemically synthesized
ttgaaaggatcaacaaaactga

SEQ ID NO: 113821 - DNA, 22 bp, Artificial Sequence
  chemically synthesized
tgaaaggatcaacaaaactgat

SEQ ID NO: 113822 - DNA, 22 bp, Artificial Sequence
  chemically synthesized
gaaaggatcaacaaaactgata

SEQ ID NO: 113823 - DNA, 22 bp, Artificial Sequence
  chemically synthesized
aaaggatcaacaaaactgatag

SEQ ID NO: 113824 - DNA, 22 bp, Artificial Sequence
  chemically synthesized
atagaccgctagcaagactaat

SEQ ID NO: 113825 - DNA, 22 bp, Artificial Sequence
  chemically synthesized
gcaagactaataagaaaagaga

SEQ ID NO: 113826 - DNA, 22 bp, Artificial Sequence
  chemically synthesized
ataagaaaagagagaagaatca

SEQ ID NO: 113827 - DNA, 22 bp, Artificial Sequence
  chemically synthesized
ccatcagagaatactacaaaca

SEQ ID NO: 113828 - DNA, 22 bp, Artificial Sequence
  chemically synthesized
caaacacctctacgcaaataaa

SEQ ID NO: 113829 - DNA, 22 bp, Artificial Sequence
  chemically synthesized
tacgcaaataaactagaaaatc

SEQ ID NO: 113830 - DNA, 22 bp, Artificial Sequence
  chemically synthesized
cgcaaataaactagaaaatcta

SEQ ID NO: 113831 - DNA, 22 bp, Artificial Sequence
  chemically synthesized
gaaaatctagaagaaatggata

SEQ ID NO: 113832 - DNA, 22 bp, Artificial Sequence
  chemically synthesized
gaagaaatggataaattcctgg

SEQ ID NO: 113833 - DNA, 22 bp, Artificial Sequence
  chemically synthesized
ctggacacatacactatcccaa

SEQ ID NO: 113834 - DNA, 22 bp, Artificial Sequence
  chemically synthesized
gacacatacactatcccaagac

SEQ ID NO: 113835 - DNA, 22 bp, Artificial Sequence
  chemically synthesized
tcccaagactaaaccaggaaga

SEQ ID NO: 113836 - DNA, 22 bp, Artificial Sequence
  chemically synthesized
aaccaggaagaagttgaatctc

SEQ ID NO: 113837 - DNA, 22 bp, Artificial Sequence
  chemically synthesized
aatctctgaatagaccaataac

SEQ ID NO: 113838 - DNA, 22 bp, Artificial Sequence
  chemically synthesized
tgaatagaccaataacaggatc

SEQ ID NO: 113839 - DNA, 22 bp, Artificial Sequence
  chemically synthesized
aatagaccaataacaggatctg

SEQ ID NO: 113840 - DNA, 22 bp, Artificial Sequence
  chemically synthesized
aaattgtggcaataatcaatag

SEQ ID NO: 113841 - DNA, 22 bp, Artificial Sequence
  chemically synthesized
tggcaataatcaatagcttacc

SEQ ID NO: 113842 - DNA, 22 bp, Artificial Sequence
  chemically synthesized
accaaccaaaaagagtccagga

SEQ ID NO: 113843 - DNA, 22 bp, Artificial Sequence
  chemically synthesized
ccaaccaaaaagagtccaggac

SEQ ID NO: 113844 - DNA, 22 bp, Artificial Sequence
  chemically synthesized
acagccaaattctaacagaggt

SEQ ID NO: 113845 - DNA, 22 bp, Artificial Sequence
  chemically synthesized
taacagaggtacaaggaggaat

SEQ ID NO: 113846 - DNA, 22 bp, Artificial Sequence
  chemically synthesized
acagaggtacaaggaggaattg

SEQ ID NO: 113847 - DNA, 22 bp, Artificial Sequence
  chemically synthesized
gtaccattccttctgaaactat

SEQ ID NO: 113848 - DNA, 22 bp, Artificial Sequence
  chemically synthesized
cttctgaaactattccaatcaa

SEQ ID NO: 113849 - DNA, 22 bp, Artificial Sequence
  chemically synthesized
ctgaaactattccaatcaacag

SEQ ID NO: 113850 - DNA, 22 bp, Artificial Sequence
  chemically synthesized
tgaaactattccaatcaacaga

SEQ ID NO: 113851 - DNA, 22 bp, Artificial Sequence
  chemically synthesized
aaactattccaatcaacagaaa

SEQ ID NO: 113852 - DNA, 22 bp, Artificial Sequence
  chemically synthesized
ttccaatcaacagaaaaagaag

SEQ ID NO: 113853 - DNA, 22 bp, Artificial Sequence
  chemically synthesized
caatcaacagaaaaagaaggaa

SEQ ID NO: 113854 - DNA, 22 bp, Artificial Sequence
  chemically synthesized
cctaactcattttatgaggcca

SEQ ID NO: 113855 - DNA, 22 bp, Artificial Sequence
  chemically synthesized
actcattttatgaggccagcat

SEQ ID NO: 113856 - DNA, 22 bp, Artificial Sequence
  chemically synthesized
attttatgaggccagcatcatc

SEQ ID NO: 113857 - DNA, 22 bp, Artificial Sequence
  chemically synthesized
tatgaggccagcatcatcctaa

SEQ ID NO: 113858 - DNA, 22 bp, Artificial Sequence
  chemically synthesized
atgaggccagcatcatcctaat

SEQ ID NO: 113859 - DNA, 22 bp, Artificial Sequence
  chemically synthesized
tgaggccagcatcatcctaata

SEQ ID NO: 113860 - DNA, 22 bp, Artificial Sequence
  chemically synthesized
ataccaaagccagaaagagaca

SEQ ID NO: 113861 - DNA, 22 bp, Artificial Sequence
  chemically synthesized
tagatgaatatccctgatgaac

SEQ ID NO: 113862 - DNA, 22 bp, Artificial Sequence
  chemically synthesized
agatgaatatccctgatgaaca

SEQ ID NO: 113863 - DNA, 22 bp, Artificial Sequence
  chemically synthesized
gatgaatatccctgatgaacat

SEQ ID NO: 113864 - DNA, 22 bp, Artificial Sequence
  chemically synthesized
atgaacatcgatgcaaaaatcc

SEQ ID NO: 113865 - DNA, 22 bp, Artificial Sequence
  chemically synthesized
aataaaatactggcaaaccgaa

SEQ ID NO: 113866 - DNA, 22 bp, Artificial Sequence
  chemically synthesized
gcaaaccgaatccagcagcaca

SEQ ID NO: 113867 - DNA, 22 bp, Artificial Sequence
  chemically synthesized
atccacgatgatcaagtggact

SEQ ID NO: 113868 - DNA, 22 bp, Artificial Sequence
  chemically synthesized
tccacgatgatcaagtggactt

SEQ ID NO: 113869 - DNA, 22 bp, Artificial Sequence
  chemically synthesized
catccctgggatgcaaggctgg

SEQ ID NO: 113870 - DNA, 22 bp, Artificial Sequence
  chemically synthesized
atccctgggatgcaaggctggt

SEQ ID NO: 113871 - DNA, 22 bp, Artificial Sequence
  chemically synthesized
ggatgcaaggctggttcaatat

SEQ ID NO: 113872 - DNA, 22 bp, Artificial Sequence
  chemically synthesized
gttcaatatatgcaaatcaata

SEQ ID NO: 113873 - DNA, 22 bp, Artificial Sequence
  chemically synthesized
aatatatgcaaatcaataaatg

SEQ ID NO: 113874 - DNA, 22 bp, Artificial Sequence
  chemically synthesized
tctcaatagatgcagaaaaggc

SEQ ID NO: 113875 - DNA, 22 bp, Artificial Sequence
  chemically synthesized
aatagatgcagaaaaggccttt

SEQ ID NO: 113876 - DNA, 22 bp, Artificial Sequence
  chemically synthesized
tgacaaaattcaacaacccttc

SEQ ID NO: 113877 - DNA, 22 bp, Artificial Sequence
  chemically synthesized
gacaaaattcaacaacccttca

SEQ ID NO: 113878 - DNA, 22 bp, Artificial Sequence
  chemically synthesized
acaaaattcaacaacccttcat

SEQ ID NO: 113879 - DNA, 22 bp, Artificial Sequence
  chemically synthesized
aacaacccttcatgctaaaaac

SEQ ID NO: 113880 - DNA, 22 bp, Artificial Sequence
  chemically synthesized
catgctaaaaactttcaataaa

SEQ ID NO: 113881 - DNA, 22 bp, Artificial Sequence
  chemically synthesized
atgctaaaaactttcaataaat

SEQ ID NO: 113882 - DNA, 22 bp, Artificial Sequence
  chemically synthesized
aaaactttcaataaattaggta

SEQ ID NO: 113883 - DNA, 22 bp, Artificial Sequence
  chemically synthesized
tcaataaattaggtattgatgg

SEQ ID NO: 113884 - DNA, 22 bp, Artificial Sequence
  chemically synthesized
caataaattaggtattgatggg

SEQ ID NO: 113885 - DNA, 22 bp, Artificial Sequence
  chemically synthesized
aataaattaggtattgatggga

SEQ ID NO: 113886 - DNA, 22 bp, Artificial Sequence
  chemically synthesized
ggtattgatgggacatatctca

SEQ ID NO: 113887 - DNA, 22 bp, Artificial Sequence
  chemically synthesized
atgggacatatctcaaaataat

SEQ ID NO: 113888 - DNA, 22 bp, Artificial Sequence
  chemically synthesized
aaaataataagagctatctatg

SEQ ID NO: 113889 - DNA, 22 bp, Artificial Sequence
  chemically synthesized
tctatgacaaacccacagccaa

SEQ ID NO: 113890 - DNA, 22 bp, Artificial Sequence
  chemically synthesized
tgacaaacccacagccaatatc

SEQ ID NO: 113891 - DNA, 22 bp, Artificial Sequence
  chemically synthesized
aatgggcaaaaactggaagcat

SEQ ID NO: 113892 - DNA, 22 bp, Artificial Sequence
  chemically synthesized
gaagcattccctttgtaaactg

SEQ ID NO: 113893 - DNA, 22 bp, Artificial Sequence
  chemically synthesized
cctttgtaaactggcacaagac

SEQ ID NO: 113894 - DNA, 22 bp, Artificial Sequence
  chemically synthesized
tgtaaactggcacaagacaggg

SEQ ID NO: 113895 - DNA, 22 bp, Artificial Sequence
  chemically synthesized
gtaaactggcacaagacaggga

SEQ ID NO: 113896 - DNA, 22 bp, Artificial Sequence
  chemically synthesized
taaactggcacaagacagggat

SEQ ID NO: 113897 - DNA, 22 bp, Artificial Sequence
  chemically synthesized
gcacaagacagggatgccctct

SEQ ID NO: 113898 - DNA, 22 bp, Artificial Sequence
  chemically synthesized
tctcactactcctattcaacat

SEQ ID NO: 113899 - DNA, 22 bp, Artificial Sequence
  chemically synthesized
tcactactcctattcaacatag

SEQ ID NO: 113900 - DNA, 22 bp, Artificial Sequence
  chemically synthesized
actactcctattcaacatagtg

SEQ ID NO: 113901 - DNA, 22 bp, Artificial Sequence
  chemically synthesized
ctcctattcaacatagtgttgg

SEQ ID NO: 113902 - DNA, 22 bp, Artificial Sequence
  chemically synthesized
ctattcaacatagtgttggaag

SEQ ID NO: 113903 - DNA, 22 bp, Artificial Sequence
  chemically synthesized
ttcaacatagtgttggaagttc

SEQ ID NO: 113904 - DNA, 22 bp, Artificial Sequence
  chemically synthesized
aacatagtgttggaagttctgg

SEQ ID NO: 113905 - DNA, 22 bp, Artificial Sequence
  chemically synthesized
gaagttctggccagggcaatta

SEQ ID NO: 113906 - DNA, 22 bp, Artificial Sequence
  chemically synthesized
tggccagggcaattaggcagaa

SEQ ID NO: 113907 - DNA, 22 bp, Artificial Sequence
  chemically synthesized
gccagggcaattaggcagaaga

SEQ ID NO: 113908 - DNA, 22 bp, Artificial Sequence
  chemically synthesized
ggcagaagacaggaaaaaaggg

SEQ ID NO: 113909 - DNA, 22 bp, Artificial Sequence
  chemically synthesized
aattaagaaaagaggaagtcaa

SEQ ID NO: 113910 - DNA, 22 bp, Artificial Sequence
  chemically synthesized
agaaaagaggaagtcaaattgt

SEQ ID NO: 113911 - DNA, 22 bp, Artificial Sequence
  chemically synthesized
tccctgtttgcagacgacatga

SEQ ID NO: 113912 - DNA, 22 bp, Artificial Sequence
  chemically synthesized
tttgcagacgacatgattgtat

SEQ ID NO: 113913 - DNA, 22 bp, Artificial Sequence
  chemically synthesized
gcagacgacatgattgtatatc

SEQ ID NO: 113914 - DNA, 22 bp, Artificial Sequence
  chemically synthesized
cagacgacatgattgtatatct

SEQ ID NO: 113915 - DNA, 22 bp, Artificial Sequence
  chemically synthesized
tatatctagaaaacccccttgt

SEQ ID NO: 113916 - DNA, 22 bp, Artificial Sequence
  chemically synthesized
gaaaacccccttgtctcagccc

SEQ ID NO: 113917 - DNA, 22 bp, Artificial Sequence
  chemically synthesized
gtctcagcccaaaatctcctta

SEQ ID NO: 113918 - DNA, 22 bp, Artificial Sequence
  chemically synthesized
tctcagcccaaaatctccttaa

SEQ ID NO: 113919 - DNA, 22 bp, Artificial Sequence
  chemically synthesized
agcccaaaatctccttaagctg

SEQ ID NO: 113920 - DNA, 22 bp, Artificial Sequence
  chemically synthesized
cttaagctgataagcaacttca

SEQ ID NO: 113921 - DNA, 22 bp, Artificial Sequence
  chemically synthesized
aagctgataagcaacttcagca

SEQ ID NO: 113922 - DNA, 22 bp, Artificial Sequence
  chemically synthesized
agctgataagcaacttcagcaa

SEQ ID NO: 113923 - DNA, 22 bp, Artificial Sequence
  chemically synthesized
ataagcaacttcagcaaagcct

SEQ ID NO: 113924 - DNA, 22 bp, Artificial Sequence
  chemically synthesized
cagcaaagcctcaggatacaaa

SEQ ID NO: 113925 - DNA, 22 bp, Artificial Sequence
  chemically synthesized
agcaaagcctcaggatacaaaa

SEQ ID NO: 113926 - DNA, 22 bp, Artificial Sequence
  chemically synthesized
aggatacaaaaccaatgtgcaa

SEQ ID NO: 113927 - DNA, 22 bp, Artificial Sequence
  chemically synthesized
ttatacaccaataacagacaaa

SEQ ID NO: 113928 - DNA, 22 bp, Artificial Sequence
  chemically synthesized
atacaccaataacagacaaaca

SEQ ID NO: 113929 - DNA, 22 bp, Artificial Sequence
  chemically synthesized
tacaccaataacagacaaacag

SEQ ID NO: 113930 - DNA, 22 bp, Artificial Sequence
  chemically synthesized
ccattcacaattgcttcaaaga

SEQ ID NO: 113931 - DNA, 22 bp, Artificial Sequence
  chemically synthesized
acaattgcttcaaagagaataa

SEQ ID NO: 113932 - DNA, 22 bp, Artificial Sequence
  chemically synthesized
cttcaaagagaataaaatacct

SEQ ID NO: 113933 - DNA, 22 bp, Artificial Sequence
  chemically synthesized
caaagagaataaaatacctagg

SEQ ID NO: 113934 - DNA, 22 bp, Artificial Sequence
  chemically synthesized
aaagagaataaaatacctagga

SEQ ID NO: 113935 - DNA, 22 bp, Artificial Sequence
  chemically synthesized
ggaatccaacttacaagggatg

SEQ ID NO: 113936 - DNA, 22 bp, Artificial Sequence
  chemically synthesized
acaagggatgtgaaggacctct

SEQ ID NO: 113937 - DNA, 22 bp, Artificial Sequence
  chemically synthesized
caagggatgtgaaggacctctt

SEQ ID NO: 113938 - DNA, 22 bp, Artificial Sequence
  chemically synthesized
ttcaaggagaactacaaaccac

SEQ ID NO: 113939 - DNA, 22 bp, Artificial Sequence
  chemically synthesized
caaggagaactacaaaccactg

SEQ ID NO: 113940 - DNA, 22 bp, Artificial Sequence
  chemically synthesized
aaggagaactacaaaccactgc

SEQ ID NO: 113941 - DNA, 22 bp, Artificial Sequence
  chemically synthesized
caaaccactgctcaatgaaata

SEQ ID NO: 113942 - DNA, 22 bp, Artificial Sequence
  chemically synthesized
ctcaatgaaataaaagaagata

SEQ ID NO: 113943 - DNA, 22 bp, Artificial Sequence
  chemically synthesized
aatgaaataaaagaagatacaa

SEQ ID NO: 113944 - DNA, 22 bp, Artificial Sequence
  chemically synthesized
catgcttatgggtaggaagaat

SEQ ID NO: 113945 - DNA, 22 bp, Artificial Sequence
  chemically synthesized
atgggtaggaagaatcaatatc

SEQ ID NO: 113946 - DNA, 22 bp, Artificial Sequence
  chemically synthesized
tgggtaggaagaatcaatatca

SEQ ID NO: 113947 - DNA, 22 bp, Artificial Sequence
  chemically synthesized
atagattcaatgccatccccat

SEQ ID NO: 113948 - DNA, 22 bp, Artificial Sequence
  chemically synthesized
tagattcaatgccatccccatc

SEQ ID NO: 113949 - DNA, 22 bp, Artificial Sequence
  chemically synthesized
aatgccatccccatcaagctac

SEQ ID NO: 113950 - DNA, 22 bp, Artificial Sequence
  chemically synthesized
ccaatgattttcttcacagaat

SEQ ID NO: 113951 - DNA, 22 bp, Artificial Sequence
  chemically synthesized
tcttcacagaattggaaaaacg

SEQ ID NO: 113952 - DNA, 22 bp, Artificial Sequence
  chemically synthesized
cttcacagaattggaaaaacga

SEQ ID NO: 113953 - DNA, 22 bp, Artificial Sequence
  chemically synthesized
ttcacagaattggaaaaacgac

SEQ ID NO: 113954 - DNA, 22 bp, Artificial Sequence
  chemically synthesized
cacagaattggaaaaacgactt

SEQ ID NO: 113955 - DNA, 22 bp, Artificial Sequence
  chemically synthesized
acagaattggaaaaacgacttt

SEQ ID NO: 113956 - DNA, 22 bp, Artificial Sequence
  chemically synthesized
gaaaaacgactttaaagttcat

SEQ ID NO: 113957 - DNA, 22 bp, Artificial Sequence
  chemically synthesized
taaagttcatatggaaccaaaa

SEQ ID NO: 113958 - DNA, 22 bp, Artificial Sequence
  chemically synthesized
aaagttcatatggaaccaaaaa

SEQ ID NO: 113959 - DNA, 22 bp, Artificial Sequence
  chemically synthesized
aagttcatatggaaccaaaaaa

SEQ ID NO: 113960 - DNA, 22 bp, Artificial Sequence
  chemically synthesized
atatggaaccaaaaaagagcct

SEQ ID NO: 113961 - DNA, 22 bp, Artificial Sequence
  chemically synthesized
cattgccaagtcaatcctaagc

SEQ ID NO: 113962 - DNA, 22 bp, Artificial Sequence
  chemically synthesized
ccaagtcaatcctaagccaaaa

SEQ ID NO: 113963 - DNA, 22 bp, Artificial Sequence
  chemically synthesized
agccaaaagaacaaagctggag

SEQ ID NO: 113964 - DNA, 22 bp, Artificial Sequence
  chemically synthesized
gaggcatcaggctacctcactt

SEQ ID NO: 113965 - DNA, 22 bp, Artificial Sequence
  chemically synthesized
cctcacttcaaactatactaca

SEQ ID NO: 113966 - DNA, 22 bp, Artificial Sequence
  chemically synthesized
acttcaaactatactacaaggc

SEQ ID NO: 113967 - DNA, 22 bp, Artificial Sequence
  chemically synthesized
caaactatactacaaggctaca

SEQ ID NO: 113968 - DNA, 22 bp, Artificial Sequence
  chemically synthesized
aaactatactacaaggctacag

SEQ ID NO: 113969 - DNA, 22 bp, Artificial Sequence
  chemically synthesized
tactacaaggctacagtaacca

SEQ ID NO: 113970 - DNA, 22 bp, Artificial Sequence
  chemically synthesized
caaggctacagtaaccaaaaca

SEQ ID NO: 113971 - DNA, 22 bp, Artificial Sequence
  chemically synthesized
cagtaaccaaaacagcatgtta

SEQ ID NO: 113972 - DNA, 22 bp, Artificial Sequence
  chemically synthesized
ctggtaccaaaacacagatata

SEQ ID NO: 113973 - DNA, 22 bp, Artificial Sequence
  chemically synthesized
gtaccaaaacacagatatagat

SEQ ID NO: 113974 - DNA, 22 bp, Artificial Sequence
  chemically synthesized
agaaataacgacgcatatctac

SEQ ID NO: 113975 - DNA, 22 bp, Artificial Sequence
  chemically synthesized
caactatctgatctttgaaaaa

SEQ ID NO: 113976 - DNA, 22 bp, Artificial Sequence
  chemically synthesized
tctgatctttgaaaaacctgag

SEQ ID NO: 113977 - DNA, 22 bp, Artificial Sequence
  chemically synthesized
atctttgaaaaacctgagaaaa

SEQ ID NO: 113978 - DNA, 22 bp, Artificial Sequence
  chemically synthesized
tgaaaaacctgagaaaaacaag

SEQ ID NO: 113979 - DNA, 22 bp, Artificial Sequence
  chemically synthesized
gaaaaacctgagaaaaacaaga

SEQ ID NO: 113980 - DNA, 22 bp, Artificial Sequence
  chemically synthesized
aaaaacctgagaaaaacaagaa

SEQ ID NO: 113981 - DNA, 22 bp, Artificial Sequence
  chemically synthesized
agaaaaacaagaaatggggaaa

SEQ ID NO: 113982 - DNA, 22 bp, Artificial Sequence
  chemically synthesized
cctatttaataaatggtgctgg

SEQ ID NO: 113983 - DNA, 22 bp, Artificial Sequence
  chemically synthesized
tttaataaatggtgctgggaga

SEQ ID NO: 113984 - DNA, 22 bp, Artificial Sequence
  chemically synthesized
aataaatggtgctgggagaact

SEQ ID NO: 113985 - DNA, 22 bp, Artificial Sequence
  chemically synthesized
ataaatggtgctgggagaactg

SEQ ID NO: 113986 - DNA, 22 bp, Artificial Sequence
  chemically synthesized
ggagaactggctagccatatgt

SEQ ID NO: 113987 - DNA, 22 bp, Artificial Sequence
  chemically synthesized
gctagccatatgtagaatgctg

SEQ ID NO: 113988 - DNA, 22 bp, Artificial Sequence
  chemically synthesized
gccatatgtagaatgctgaaac

SEQ ID NO: 113989 - DNA, 22 bp, Artificial Sequence
  chemically synthesized
aaactggatcccttccttacac

SEQ ID NO: 113990 - DNA, 22 bp, Artificial Sequence
  chemically synthesized
gatcccttccttacaccttata

SEQ ID NO: 113991 - DNA, 22 bp, Artificial Sequence
  chemically synthesized
ccttacaccttatacaaaaatt

SEQ ID NO: 113992 - DNA, 22 bp, Artificial Sequence
  chemically synthesized
cttacaccttatacaaaaatta

SEQ ID NO: 113993 - DNA, 22 bp, Artificial Sequence
  chemically synthesized
acaccttatacaaaaattaatt

SEQ ID NO: 113994 - DNA, 22 bp, Artificial Sequence
  chemically synthesized
caccttatacaaaaattaattc

SEQ ID NO: 113995 - DNA, 22 bp, Artificial Sequence
  chemically synthesized
atacaaaaattaattcaagatg

SEQ ID NO: 113996 - DNA, 22 bp, Artificial Sequence
  chemically synthesized
tacaaaaattaattcaagatgg

SEQ ID NO: 113997 - DNA, 22 bp, Artificial Sequence
  chemically synthesized
attcaagatggattaaagactt

SEQ ID NO: 113998 - DNA, 22 bp, Artificial Sequence
  chemically synthesized
aagatggattaaagacttaaac

SEQ ID NO: 113999 - DNA, 22 bp, Artificial Sequence
  chemically synthesized
aagacttaaacattagacctaa

SEQ ID NO: 114000 - DNA, 22 bp, Artificial Sequence
  chemically synthesized
aaacattagacctaaaaccata

SEQ ID NO: 114001 - DNA, 22 bp, Artificial Sequence
  chemically synthesized
aacattagacctaaaaccataa

SEQ ID NO: 114002 - DNA, 22 bp, Artificial Sequence
  chemically synthesized
gacctaaaaccataaaaaccct

SEQ ID NO: 114003 - DNA, 22 bp, Artificial Sequence
  chemically synthesized
aaaccataaaaaccctagaaga

SEQ ID NO: 114004 - DNA, 22 bp, Artificial Sequence
  chemically synthesized
gaagaaaacgcaggcattacca

SEQ ID NO: 114005 - DNA, 22 bp, Artificial Sequence
  chemically synthesized
ccattcaggacataggcatggg

SEQ ID NO: 114006 - DNA, 22 bp, Artificial Sequence
  chemically synthesized
aggacataggcatgggcaagga

SEQ ID NO: 114007 - DNA, 22 bp, Artificial Sequence
  chemically synthesized
catgtctaaaacaccaaaagcg

SEQ ID NO: 114008 - DNA, 22 bp, Artificial Sequence
  chemically synthesized
atgtctaaaacaccaaaagcga

SEQ ID NO: 114009 - DNA, 22 bp, Artificial Sequence
  chemically synthesized
aaacaccaaaagcgatggcaac

SEQ ID NO: 114010 - DNA, 22 bp, Artificial Sequence
  chemically synthesized
actaatgggatctaatgaaact

SEQ ID NO: 114011 - DNA, 22 bp, Artificial Sequence
  chemically synthesized
atgggatctaatgaaactaaag

SEQ ID NO: 114012 - DNA, 22 bp, Artificial Sequence
  chemically synthesized
atgaaactaaagagcttctgca

SEQ ID NO: 114013 - DNA, 22 bp, Artificial Sequence
  chemically synthesized
aagagcttctgcacagctaaag

SEQ ID NO: 114014 - DNA, 22 bp, Artificial Sequence
  chemically synthesized
ctgcacagctaaagaaactacc

SEQ ID NO: 114015 - DNA, 22 bp, Artificial Sequence
  chemically synthesized
tgcacagctaaagaaactacca

SEQ ID NO: 114016 - DNA, 22 bp, Artificial Sequence
  chemically synthesized
cacagctaaagaaactaccatc

SEQ ID NO: 114017 - DNA, 22 bp, Artificial Sequence
  chemically synthesized
aagaaactaccatcagagtgaa

SEQ ID NO: 114018 - DNA, 22 bp, Artificial Sequence
  chemically synthesized
ccatcagagtgaacaggcaacc

SEQ ID NO: 114019 - DNA, 22 bp, Artificial Sequence
  chemically synthesized
cacaatgggagaaaattttcac

SEQ ID NO: 114020 - DNA, 22 bp, Artificial Sequence
  chemically synthesized
tcacaacctactcatctgacaa

SEQ ID NO: 114021 - DNA, 22 bp, Artificial Sequence
  chemically synthesized
cacaacctactcatctgacaaa

SEQ ID NO: 114022 - DNA, 22 bp, Artificial Sequence
  chemically synthesized
acaacctactcatctgacaaag

SEQ ID NO: 114023 - DNA, 22 bp, Artificial Sequence
  chemically synthesized
ctcatctgacaaagggctaata

SEQ ID NO: 114024 - DNA, 22 bp, Artificial Sequence
  chemically synthesized
atctgacaaagggctaatatcc

SEQ ID NO: 114025 - DNA, 22 bp, Artificial Sequence
  chemically synthesized
acaaagggctaatatccagaat

SEQ ID NO: 114026 - DNA, 22 bp, Artificial Sequence
  chemically synthesized
atatccagaatctataatgaac

SEQ ID NO: 114027 - DNA, 22 bp, Artificial Sequence
  chemically synthesized
taatgaactcaaacaaatttac

SEQ ID NO: 114028 - DNA, 22 bp, Artificial Sequence
  chemically synthesized
aaacaaatttacaagaaaaaaa

SEQ ID NO: 114029 - DNA, 22 bp, Artificial Sequence
  chemically synthesized
acaagaaaaaaacaaacagccc

SEQ ID NO: 114030 - DNA, 22 bp, Artificial Sequence
  chemically synthesized
caagaaaaaaacaaacagcccc

SEQ ID NO: 114031 - DNA, 22 bp, Artificial Sequence
  chemically synthesized
ctcaaaagaaaacatttatgca

SEQ ID NO: 114032 - DNA, 22 bp, Artificial Sequence
  chemically synthesized
tcaaaagaaaacatttatgcaa

SEQ ID NO: 114033 - DNA, 22 bp, Artificial Sequence
  chemically synthesized
aaaagaaaacatttatgcaacc

SEQ ID NO: 114034 - DNA, 22 bp, Artificial Sequence
  chemically synthesized
atgcaaccaaaagacacatgaa

SEQ ID NO: 114035 - DNA, 22 bp, Artificial Sequence
  chemically synthesized
tgcaaccaaaagacacatgaaa

SEQ ID NO: 114036 - DNA, 22 bp, Artificial Sequence
  chemically synthesized
atcatcactggccatcagagaa

SEQ ID NO: 114037 - DNA, 22 bp, Artificial Sequence
  chemically synthesized
gccatcagagaaatgcaaatca

SEQ ID NO: 114038 - DNA, 22 bp, Artificial Sequence
  chemically synthesized
ataccagttagaatggcaatca

SEQ ID NO: 114039 - DNA, 22 bp, Artificial Sequence
  chemically synthesized
gaatggcaatcattaaaaagtc

SEQ ID NO: 114040 - DNA, 22 bp, Artificial Sequence
  chemically synthesized
aaaagtcaggaaacaacaggtg

SEQ ID NO: 114041 - DNA, 22 bp, Artificial Sequence
  chemically synthesized
gagaggatgtggagaaatagga

SEQ ID NO: 114042 - DNA, 22 bp, Artificial Sequence
  chemically synthesized
ttacactcttggtgggactgta

SEQ ID NO: 114043 - DNA, 22 bp, Artificial Sequence
  chemically synthesized
tacactcttggtgggactgtaa

SEQ ID NO: 114044 - DNA, 22 bp, Artificial Sequence
  chemically synthesized
acactcttggtgggactgtaaa

SEQ ID NO: 114045 - DNA, 22 bp, Artificial Sequence
  chemically synthesized
cactcttggtgggactgtaaac

SEQ ID NO: 114046 - DNA, 22 bp, Artificial Sequence
  chemically synthesized
ttggtgggactgtaaactagtt

SEQ ID NO: 114047 - DNA, 22 bp, Artificial Sequence
  chemically synthesized
ggtgggactgtaaactagttca

SEQ ID NO: 114048 - DNA, 22 bp, Artificial Sequence
  chemically synthesized
gtgggactgtaaactagttcaa

SEQ ID NO: 114049 - DNA, 22 bp, Artificial Sequence
  chemically synthesized
taaactagttcaaccattgtgg

SEQ ID NO: 114050 - DNA, 22 bp, Artificial Sequence
  chemically synthesized
gttcaaccattgtggaagtcag

SEQ ID NO: 114051 - DNA, 22 bp, Artificial Sequence
  chemically synthesized
aaccattgtggaagtcagtgtg

SEQ ID NO: 114052 - DNA, 22 bp, Artificial Sequence
  chemically synthesized
tggaagtcagtgtggcgattcc

SEQ ID NO: 114053 - DNA, 22 bp, Artificial Sequence
  chemically synthesized
ctcagggatctagaactagaaa

SEQ ID NO: 114054 - DNA, 22 bp, Artificial Sequence
  chemically synthesized
agggatctagaactagaaatac

SEQ ID NO: 114055 - DNA, 22 bp, Artificial Sequence
  chemically synthesized
gaactagaaataccatttgacc

SEQ ID NO: 114056 - DNA, 22 bp, Artificial Sequence
  chemically synthesized
gaaataccatttgacccagcca

SEQ ID NO: 114057 - DNA, 22 bp, Artificial Sequence
  chemically synthesized
gacccagccatcccattactgg

SEQ ID NO: 114058 - DNA, 22 bp, Artificial Sequence
  chemically synthesized
acccagccatcccattactggg

SEQ ID NO: 114059 - DNA, 22 bp, Artificial Sequence
  chemically synthesized
ctgggtatatacccaaaggaat

SEQ ID NO: 114060 - DNA, 22 bp, Artificial Sequence
  chemically synthesized
ggtatatacccaaaggaatata

SEQ ID NO: 114061 - DNA, 22 bp, Artificial Sequence
  chemically synthesized
ctataaagacacatgcacacgt

SEQ ID NO: 114062 - DNA, 22 bp, Artificial Sequence
  chemically synthesized
taaagacacatgcacacgtatg

SEQ ID NO: 114063 - DNA, 22 bp, Artificial Sequence
  chemically synthesized
attgcggtactattcacaatag

SEQ ID NO: 114064 - DNA, 22 bp, Artificial Sequence
  chemically synthesized
ttgcggtactattcacaatagc

SEQ ID NO: 114065 - DNA, 22 bp, Artificial Sequence
  chemically synthesized
cggtactattcacaatagcaaa

SEQ ID NO: 114066 - DNA, 22 bp, Artificial Sequence
  chemically synthesized
ttcacaatagcaaagacttgga

SEQ ID NO: 114067 - DNA, 22 bp, Artificial Sequence
  chemically synthesized
acaatagcaaagacttggaacc

SEQ ID NO: 114068 - DNA, 22 bp, Artificial Sequence
  chemically synthesized
ggaaccaacccaaatgtccaac

SEQ ID NO: 114069 - DNA, 22 bp, Artificial Sequence
  chemically synthesized
gaaccaacccaaatgtccaaca

SEQ ID NO: 114070 - DNA, 22 bp, Artificial Sequence
  chemically synthesized
gattaagaaaatgtggcacata

SEQ ID NO: 114071 - DNA, 22 bp, Artificial Sequence
  chemically synthesized
agaaaatgtggcacatatacac

SEQ ID NO: 114072 - DNA, 22 bp, Artificial Sequence
  chemically synthesized
tgcagccataaaaatgatgagt

SEQ ID NO: 114073 - DNA, 22 bp, Artificial Sequence
  chemically synthesized
atgtcctttgtagggacatgga

SEQ ID NO: 114074 - DNA, 22 bp, Artificial Sequence
  chemically synthesized
tgtagggacatggatgaaattg

SEQ ID NO: 114075 - DNA, 22 bp, Artificial Sequence
  chemically synthesized
gtagggacatggatgaaattgg

SEQ ID NO: 114076 - DNA, 22 bp, Artificial Sequence
  chemically synthesized
tagggacatggatgaaattgga

SEQ ID NO: 114077 - DNA, 22 bp, Artificial Sequence
  chemically synthesized
gaaatcatcattctcagtaaac

SEQ ID NO: 114078 - DNA, 22 bp, Artificial Sequence
  chemically synthesized
tcagtaaactatcgcaaggaca

SEQ ID NO: 114079 - DNA, 22 bp, Artificial Sequence
  chemically synthesized
agtaaactatcgcaaggacaaa

SEQ ID NO: 114080 - DNA, 22 bp, Artificial Sequence
  chemically synthesized
tcgcaaggacaaaaaaccaaac

SEQ ID NO: 114081 - DNA, 22 bp, Artificial Sequence
  chemically synthesized
tcactcatagatgggaactgaa

SEQ ID NO: 114082 - DNA, 22 bp, Artificial Sequence
  chemically synthesized
actcatagatgggaactgaaca

SEQ ID NO: 114083 - DNA, 22 bp, Artificial Sequence
  chemically synthesized
atagatgggaactgaacaatga

SEQ ID NO: 114084 - DNA, 22 bp, Artificial Sequence
  chemically synthesized
aacaatgagaacacatggacac

SEQ ID NO: 114085 - DNA, 22 bp, Artificial Sequence
  chemically synthesized
tggggactgttgtggggtgggg

SEQ ID NO: 114086 - DNA, 22 bp, Artificial Sequence
  chemically synthesized
gggactgttgtggggtgggggt

SEQ ID NO: 114087 - DNA, 22 bp, Artificial Sequence
  chemically synthesized
ttgtggggtgggggtgcaggga

SEQ ID NO: 114088 - DNA, 22 bp, Artificial Sequence
  chemically synthesized
tggggtgggggtgcagggaggg

SEQ ID NO: 114089 - DNA, 22 bp, Artificial Sequence
  chemically synthesized
ggagatatacctaatgctaaat

SEQ ID NO: 114090 - DNA, 22 bp, Artificial Sequence
  chemically synthesized
atgctaaattacgagttaatgg

SEQ ID NO: 114091 - DNA, 22 bp, Artificial Sequence
  chemically synthesized
aattacgagttaatgggtgcag

SEQ ID NO: 114092 - DNA, 22 bp, Artificial Sequence
  chemically synthesized
cgagttaatgggtgcagcacac

SEQ ID NO: 114093 - DNA, 22 bp, Artificial Sequence
  chemically synthesized
atgggtgcagcacaccaacatg

SEQ ID NO: 114094 - DNA, 22 bp, Artificial Sequence
  chemically synthesized
accggcacattatgcacatgta

SEQ ID NO: 114095 - DNA, 22 bp, Artificial Sequence
  chemically synthesized
tgcacatgtaccctaaatctta

SEQ ID NO: 114096 - DNA, 22 bp, Artificial Sequence
  chemically synthesized
aatcttaaagtataataataat

SEQ ID NO: 114097 - DNA, 22 bp, Artificial Sequence
  chemically synthesized
aaagtataataataataataaa

SEQ ID NO: 114098 - DNA, 22 bp, Artificial Sequence
  chemically synthesized
aagtataataataataataaat

SEQ ID NO: 114099 - DNA, 22 bp, Artificial Sequence
  chemically synthesized
cagtttattttttcaggtttcc

SEQ ID NO: 114100 - DNA, 22 bp, Artificial Sequence
  chemically synthesized
attttttcaggtttccgttgtt

SEQ ID NO: 114101 - DNA, 22 bp, Artificial Sequence
  chemically synthesized
ttttttcaggtttccgttgttt

SEQ ID NO: 114102 - DNA, 22 bp, Artificial Sequence
  chemically synthesized
tttcaggtttccgttgtttcct

SEQ ID NO: 114103 - DNA, 22 bp, Artificial Sequence
  chemically synthesized
ttcaggtttccgttgtttcctc

SEQ ID NO: 114104 - DNA, 22 bp, Artificial Sequence
  chemically synthesized
tcaggtttccgttgtttcctct

SEQ ID NO: 114105 - DNA, 22 bp, Artificial Sequence
  chemically synthesized
caggtttccgttgtttcctcta

SEQ ID NO: 114106 - DNA, 22 bp, Artificial Sequence
  chemically synthesized
aggtttccgttgtttcctctaa

SEQ ID NO: 114107 - DNA, 22 bp, Artificial Sequence
  chemically synthesized
ccgttgtttcctctaataattt

SEQ ID NO: 114108 - DNA, 22 bp, Artificial Sequence
  chemically synthesized
cgttgtttcctctaataatttt

SEQ ID NO: 114109 - DNA, 22 bp, Artificial Sequence
  chemically synthesized
tttcctctaataattttcttgt

SEQ ID NO: 114110 - DNA, 22 bp, Artificial Sequence
  chemically synthesized
cctctaataattttcttgtatg

SEQ ID NO: 114111 - DNA, 22 bp, Artificial Sequence
  chemically synthesized
ctctaataattttcttgtatgc

SEQ ID NO: 114112 - DNA, 22 bp, Artificial Sequence
  chemically synthesized
taataattttcttgtatgcaat

SEQ ID NO: 114113 - DNA, 22 bp, Artificial Sequence
  chemically synthesized
ataattttcttgtatgcaatgt

SEQ ID NO: 114114 - DNA, 22 bp, Artificial Sequence
  chemically synthesized
tcttgtatgcaatgtgtctttt

SEQ ID NO: 114115 - DNA, 22 bp, Artificial Sequence
  chemically synthesized
cttgtatgcaatgtgtcttttt

SEQ ID NO: 114116 - DNA, 22 bp, Artificial Sequence
  chemically synthesized
ttgtatgcaatgtgtctttttc

SEQ ID NO: 114117 - DNA, 22 bp, Artificial Sequence
  chemically synthesized
gtatgcaatgtgtctttttcta

SEQ ID NO: 114118 - DNA, 22 bp, Artificial Sequence
  chemically synthesized
tatgcaatgtgtctttttctat

SEQ ID NO: 114119 - DNA, 22 bp, Artificial Sequence
  chemically synthesized
tttctatgtctgcttttaagat

SEQ ID NO: 114120 - DNA, 22 bp, Artificial Sequence
  chemically synthesized
ttctatgtctgcttttaagatt

SEQ ID NO: 114121 - DNA, 22 bp, Artificial Sequence
  chemically synthesized
tctatgtctgcttttaagattg

SEQ ID NO: 114122 - DNA, 22 bp, Artificial Sequence
  chemically synthesized
ctatgtctgcttttaagattgg

SEQ ID NO: 114123 - DNA, 22 bp, Artificial Sequence
  chemically synthesized
tatgtctgcttttaagattggc

SEQ ID NO: 114124 - DNA, 22 bp, Artificial Sequence
  chemically synthesized
tgtctgcttttaagattggcat

SEQ ID NO: 114125 - DNA, 22 bp, Artificial Sequence
  chemically synthesized
cttttaagattggcatacattt

SEQ ID NO: 114126 - DNA, 22 bp, Artificial Sequence
  chemically synthesized
ttaagattggcatacatttgtt

SEQ ID NO: 114127 - DNA, 22 bp, Artificial Sequence
  chemically synthesized
taagattggcatacatttgttg

SEQ ID NO: 114128 - DNA, 22 bp, Artificial Sequence
  chemically synthesized
aagattggcatacatttgttgt

SEQ ID NO: 114129 - DNA, 22 bp, Artificial Sequence
  chemically synthesized
agattggcatacatttgttgtt

SEQ ID NO: 114130 - DNA, 22 bp, Artificial Sequence
  chemically synthesized
gcatacatttgttgtttatgcc

SEQ ID NO: 114131 - DNA, 22 bp, Artificial Sequence
  chemically synthesized
gttgtttatgccatttgtaaga

SEQ ID NO: 114132 - DNA, 22 bp, Artificial Sequence
  chemically synthesized
ttgtttatgccatttgtaagat

SEQ ID NO: 114133 - DNA, 22 bp, Artificial Sequence
  chemically synthesized
tttatgccatttgtaagatatg

SEQ ID NO: 114134 - DNA, 22 bp, Artificial Sequence
  chemically synthesized
atgccatttgtaagatatgcat

SEQ ID NO: 114135 - DNA, 22 bp, Artificial Sequence
  chemically synthesized
tgccatttgtaagatatgcatt

SEQ ID NO: 114136 - DNA, 22 bp, Artificial Sequence
  chemically synthesized
gtaagatatgcatttagttgtg

SEQ ID NO: 114137 - DNA, 22 bp, Artificial Sequence
  chemically synthesized
taagatatgcatttagttgtgt

SEQ ID NO: 114138 - DNA, 22 bp, Artificial Sequence
  chemically synthesized
agttgtgttttattttttaatt

SEQ ID NO: 114139 - DNA, 22 bp, Artificial Sequence
  chemically synthesized
gttgtgttttattttttaattg

SEQ ID NO: 114140 - DNA, 22 bp, Artificial Sequence
  chemically synthesized
tgttttattttttaattgacat

SEQ ID NO: 114141 - DNA, 22 bp, Artificial Sequence
  chemically synthesized
tattttttaattgacattgctc

SEQ ID NO: 114142 - DNA, 22 bp, Artificial Sequence
  chemically synthesized
attttttaattgacattgctca

SEQ ID NO: 114143 - DNA, 22 bp, Artificial Sequence
  chemically synthesized
ttttttaattgacattgctcaa

SEQ ID NO: 114144 - DNA, 22 bp, Artificial Sequence
  chemically synthesized
tttaattgacattgctcaaggt

SEQ ID NO: 114145 - DNA, 22 bp, Artificial Sequence
  chemically synthesized
ttaattgacattgctcaaggtt

SEQ ID NO: 114146 - DNA, 22 bp, Artificial Sequence
  chemically synthesized
taattgacattgctcaaggtta

SEQ ID NO: 114147 - DNA, 22 bp, Artificial Sequence
  chemically synthesized
aattgacattgctcaaggttag

SEQ ID NO: 114148 - DNA, 22 bp, Artificial Sequence
  chemically synthesized
attgacattgctcaaggttagc

SEQ ID NO: 114149 - DNA, 22 bp, Artificial Sequence
  chemically synthesized
acattgctcaaggttagctaaa

SEQ ID NO: 114150 - DNA, 22 bp, Artificial Sequence
  chemically synthesized
ctcaaggttagctaaagatatg

SEQ ID NO: 114151 - DNA, 22 bp, Artificial Sequence
  chemically synthesized
aaggttagctaaagatatgaat

SEQ ID NO: 114152 - DNA, 22 bp, Artificial Sequence
  chemically synthesized
gctaaagatatgaattaataga

SEQ ID NO: 114153 - DNA, 22 bp, Artificial Sequence
  chemically synthesized
aagatatgaattaatagatttt

SEQ ID NO: 114154 - DNA, 22 bp, Artificial Sequence
  chemically synthesized
atagattttatgtccagatgtt

SEQ ID NO: 114155 - DNA, 22 bp, Artificial Sequence
  chemically synthesized
tatgtccagatgttgaaacatt

SEQ ID NO: 114156 - DNA, 22 bp, Artificial Sequence
  chemically synthesized
atgtccagatgttgaaacattc

SEQ ID NO: 114157 - DNA, 22 bp, Artificial Sequence
  chemically synthesized
tgtccagatgttgaaacattca

SEQ ID NO: 114158 - DNA, 22 bp, Artificial Sequence
  chemically synthesized
aaacattcagtcaataattcct

SEQ ID NO: 114159 - DNA, 22 bp, Artificial Sequence
  chemically synthesized
agtcaataattcctcaaaaaac

SEQ ID NO: 114160 - DNA, 22 bp, Artificial Sequence
  chemically synthesized
ctcaaaaaacgtttaatccatt

SEQ ID NO: 114161 - DNA, 22 bp, Artificial Sequence
  chemically synthesized
aaaaaacgtttaatccattttt

SEQ ID NO: 114162 - DNA, 22 bp, Artificial Sequence
  chemically synthesized
aatccattttttgtttcctttt

SEQ ID NO: 114163 - DNA, 22 bp, Artificial Sequence
  chemically synthesized
atccattttttgtttcctttta

SEQ ID NO: 114164 - DNA, 22 bp, Artificial Sequence
  chemically synthesized
tttgtttccttttagaattcta

SEQ ID NO: 114165 - DNA, 22 bp, Artificial Sequence
  chemically synthesized
ttgtttccttttagaattctaa

SEQ ID NO: 114166 - DNA, 22 bp, Artificial Sequence
  chemically synthesized
tgtttccttttagaattctaat

SEQ ID NO: 114167 - DNA, 22 bp, Artificial Sequence
  chemically synthesized
gtttccttttagaattctaatt

SEQ ID NO: 114168 - DNA, 22 bp, Artificial Sequence
  chemically synthesized
tttccttttagaattctaattt

SEQ ID NO: 114169 - DNA, 22 bp, Artificial Sequence
  chemically synthesized
ccttttagaattctaatttcac

SEQ ID NO: 114170 - DNA, 22 bp, Artificial Sequence
  chemically synthesized
cttttagaattctaatttcaca

SEQ ID NO: 114171 - DNA, 22 bp, Artificial Sequence
  chemically synthesized
ttagaattctaatttcacatat

SEQ ID NO: 114172 - DNA, 22 bp, Artificial Sequence
  chemically synthesized
tagaattctaatttcacatatg

SEQ ID NO: 114173 - DNA, 22 bp, Artificial Sequence
  chemically synthesized
agaattctaatttcacatatgg

SEQ ID NO: 114174 - DNA, 22 bp, Artificial Sequence
  chemically synthesized
gaattctaatttcacatatggt

SEQ ID NO: 114175 - DNA, 22 bp, Artificial Sequence
  chemically synthesized
taatttcacatatggtggacag

SEQ ID NO: 114176 - DNA, 22 bp, Artificial Sequence
  chemically synthesized
atttcacatatggtggacagct

SEQ ID NO: 114177 - DNA, 22 bp, Artificial Sequence
  chemically synthesized
cacatatggtggacagcttgat

SEQ ID NO: 114178 - DNA, 22 bp, Artificial Sequence
  chemically synthesized
acatatggtggacagcttgata

SEQ ID NO: 114179 - DNA, 22 bp, Artificial Sequence
  chemically synthesized
gatactttcccatgagtctggc

SEQ ID NO: 114180 - DNA, 22 bp, Artificial Sequence
  chemically synthesized
atactttcccatgagtctggct

SEQ ID NO: 114181 - DNA, 22 bp, Artificial Sequence
  chemically synthesized
tcccatgagtctggctttctgg

SEQ ID NO: 114182 - DNA, 22 bp, Artificial Sequence
  chemically synthesized
cccatgagtctggctttctggg

SEQ ID NO: 114183 - DNA, 22 bp, Artificial Sequence
  chemically synthesized
ccatgagtctggctttctgggt

SEQ ID NO: 114184 - DNA, 22 bp, Artificial Sequence
  chemically synthesized
gctttctgggtttctctccctg

SEQ ID NO: 114185 - DNA, 22 bp, Artificial Sequence
  chemically synthesized
tctgggtttctctccctggcgt

SEQ ID NO: 114186 - DNA, 22 bp, Artificial Sequence
  chemically synthesized
ctgggtttctctccctggcgtc

SEQ ID NO: 114187 - DNA, 22 bp, Artificial Sequence
  chemically synthesized
tgggtttctctccctggcgtcc

SEQ ID NO: 114188 - DNA, 22 bp, Artificial Sequence
  chemically synthesized
ggtttctctccctggcgtcctc

SEQ ID NO: 114189 - DNA, 22 bp, Artificial Sequence
  chemically synthesized
ctctccctggcgtcctctctca

SEQ ID NO: 114190 - DNA, 22 bp, Artificial Sequence
  chemically synthesized
tctccctggcgtcctctctcat

SEQ ID NO: 114191 - DNA, 22 bp, Artificial Sequence
  chemically synthesized
tccctggcgtcctctctcatca

SEQ ID NO: 114192 - DNA, 22 bp, Artificial Sequence
  chemically synthesized
cctggcgtcctctctcatcatg

SEQ ID NO: 114193 - DNA, 22 bp, Artificial Sequence
  chemically synthesized
gcgtcctctctcatcatgtgat

SEQ ID NO: 114194 - DNA, 22 bp, Artificial Sequence
  chemically synthesized
tctcatcatgtgatctccttgc

SEQ ID NO: 114195 - DNA, 22 bp, Artificial Sequence
  chemically synthesized
tcatcatgtgatctccttgcat

SEQ ID NO: 114196 - DNA, 22 bp, Artificial Sequence
  chemically synthesized
atcatgtgatctccttgcatgc

SEQ ID NO: 114197 - DNA, 22 bp, Artificial Sequence
  chemically synthesized
cttgcatgcacttgctctttgt

SEQ ID NO: 114198 - DNA, 22 bp, Artificial Sequence
  chemically synthesized
gcatgcacttgctctttgtctg

SEQ ID NO: 114199 - DNA, 22 bp, Artificial Sequence
  chemically synthesized
catgcacttgctctttgtctgc

SEQ ID NO: 114200 - DNA, 22 bp, Artificial Sequence
  chemically synthesized
gctctttgtctgctttctgcca

SEQ ID NO: 114201 - DNA, 22 bp, Artificial Sequence
  chemically synthesized
ctctttgtctgctttctgccat

SEQ ID NO: 114202 - DNA, 22 bp, Artificial Sequence
  chemically synthesized
tttgtctgctttctgccatgtt

SEQ ID NO: 114203 - DNA, 22 bp, Artificial Sequence
  chemically synthesized
tgtctgctttctgccatgtttg

SEQ ID NO: 114204 - DNA, 22 bp, Artificial Sequence
  chemically synthesized
gtctgctttctgccatgtttgg

SEQ ID NO: 114205 - DNA, 22 bp, Artificial Sequence
  chemically synthesized
tctgctttctgccatgtttgga

SEQ ID NO: 114206 - DNA, 22 bp, Artificial Sequence
  chemically synthesized
ctttctgccatgtttggaacca

SEQ ID NO: 114207 - DNA, 22 bp, Artificial Sequence
  chemically synthesized
tctgccatgtttggaaccagca

SEQ ID NO: 114208 - DNA, 22 bp, Artificial Sequence
  chemically synthesized
ctgccatgtttggaaccagcat

SEQ ID NO: 114209 - DNA, 22 bp, Artificial Sequence
  chemically synthesized
tgccatgtttggaaccagcatg

SEQ ID NO: 114210 - DNA, 22 bp, Artificial Sequence
  chemically synthesized
ccatgtttggaaccagcatgag

SEQ ID NO: 114211 - DNA, 22 bp, Artificial Sequence
  chemically synthesized
ggaaccagcatgagacctttat

SEQ ID NO: 114212 - DNA, 22 bp, Artificial Sequence
  chemically synthesized
gaaccagcatgagacctttatc

SEQ ID NO: 114213 - DNA, 22 bp, Artificial Sequence
  chemically synthesized
tatcagatgcaaccgcccgatc

SEQ ID NO: 114214 - DNA, 22 bp, Artificial Sequence
  chemically synthesized
atcagatgcaaccgcccgatct

SEQ ID NO: 114215 - DNA, 22 bp, Artificial Sequence
  chemically synthesized
tcagatgcaaccgcccgatctt

SEQ ID NO: 114216 - DNA, 22 bp, Artificial Sequence
  chemically synthesized
ggacttttaagtcaccagaatc

SEQ ID NO: 114217 - DNA, 22 bp, Artificial Sequence
  chemically synthesized
gacttttaagtcaccagaatca

SEQ ID NO: 114218 - DNA, 22 bp, Artificial Sequence
  chemically synthesized
ttaagtcaccagaatcatgaac

SEQ ID NO: 114219 - DNA, 22 bp, Artificial Sequence
  chemically synthesized
taagtcaccagaatcatgaacc

SEQ ID NO: 114220 - DNA, 22 bp, Artificial Sequence
  chemically synthesized
aagtcaccagaatcatgaacca

SEQ ID NO: 114221 - DNA, 22 bp, Artificial Sequence
  chemically synthesized
agtcaccagaatcatgaaccaa

SEQ ID NO: 114222 - DNA, 22 bp, Artificial Sequence
  chemically synthesized
taaaaaaaaaaaataagctacc

SEQ ID NO: 114223 - DNA, 22 bp, Artificial Sequence
  chemically synthesized
aaaaaaaaaaaataagctaccc

SEQ ID NO: 114224 - DNA, 22 bp, Artificial Sequence
  chemically synthesized
aaaaaaaaaaataagctaccca

SEQ ID NO: 114225 - DNA, 22 bp, Artificial Sequence
  chemically synthesized
cccagactcaggtactctgtta

SEQ ID NO: 114226 - DNA, 22 bp, Artificial Sequence
  chemically synthesized
aggtactctgttatagcaaatc

SEQ ID NO: 114227 - DNA, 22 bp, Artificial Sequence
  chemically synthesized
tgttatagcaaatcaaaatatg

SEQ ID NO: 114228 - DNA, 22 bp, Artificial Sequence
  chemically synthesized
ttatagcaaatcaaaatatgca

SEQ ID NO: 114229 - DNA, 22 bp, Artificial Sequence
  chemically synthesized
tagcaaatcaaaatatgcaaaa

SEQ ID NO: 114230 - DNA, 22 bp, Artificial Sequence
  chemically synthesized
aaactttagcccaacttggagt

SEQ ID NO: 114231 - DNA, 22 bp, Artificial Sequence
  chemically synthesized
tagcccaacttggagtggggag

SEQ ID NO: 114232 - DNA, 22 bp, Artificial Sequence
  chemically synthesized
agcccaacttggagtggggaga

SEQ ID NO: 114233 - DNA, 22 bp, Artificial Sequence
  chemically synthesized
gcccaacttggagtggggagaa

SEQ ID NO: 114234 - DNA, 22 bp, Artificial Sequence
  chemically synthesized
ggagtggggagaagagatggtt

SEQ ID NO: 114235 - DNA, 22 bp, Artificial Sequence
  chemically synthesized
gagtggggagaagagatggttt

SEQ ID NO: 114236 - DNA, 22 bp, Artificial Sequence
  chemically synthesized
cccaaaaggggtctctctgaaa

SEQ ID NO: 114237 - DNA, 22 bp, Artificial Sequence
  chemically synthesized
ccaaaaggggtctctctgaaaa

SEQ ID NO: 114238 - DNA, 22 bp, Artificial Sequence
  chemically synthesized
tctgaaaagttttcacaatgaa

SEQ ID NO: 114239 - DNA, 22 bp, Artificial Sequence
  chemically synthesized
tgaaaagttttcacaatgaaaa

SEQ ID NO: 114240 - DNA, 22 bp, Artificial Sequence
  chemically synthesized
aaaagttttcacaatgaaaatg

SEQ ID NO: 114241 - DNA, 22 bp, Artificial Sequence
  chemically synthesized
tcacaatgaaaatgaaaatcgg

SEQ ID NO: 114242 - DNA, 22 bp, Artificial Sequence
  chemically synthesized
cacaatgaaaatgaaaatcggt

SEQ ID NO: 114243 - DNA, 22 bp, Artificial Sequence
  chemically synthesized
acaatgaaaatgaaaatcggtt

SEQ ID NO: 114244 - DNA, 22 bp, Artificial Sequence
  chemically synthesized
cctttcataatgactgaagaga

SEQ ID NO: 114245 - DNA, 22 bp, Artificial Sequence
  chemically synthesized
tcataatgactgaagagaggta

SEQ ID NO: 114246 - DNA, 22 bp, Artificial Sequence
  chemically synthesized
cataatgactgaagagaggtag

SEQ ID NO: 114247 - DNA, 22 bp, Artificial Sequence
  chemically synthesized
ataatgactgaagagaggtagg

SEQ ID NO: 114248 - DNA, 22 bp, Artificial Sequence
  chemically synthesized
aagagaggtaggatgttacgaa

SEQ ID NO: 114249 - DNA, 22 bp, Artificial Sequence
  chemically synthesized
cgaaagaaggcgtttctgaaag

SEQ ID NO: 114250 - DNA, 22 bp, Artificial Sequence
  chemically synthesized
ctgaaagagttgctgtgggaag

SEQ ID NO: 114251 - DNA, 22 bp, Artificial Sequence
  chemically synthesized
tgaaagagttgctgtgggaaga

SEQ ID NO: 114252 - DNA, 22 bp, Artificial Sequence
  chemically synthesized
aaagagttgctgtgggaagatg

SEQ ID NO: 114253 - DNA, 22 bp, Artificial Sequence
  chemically synthesized
ctgtgggaagatgtggagactt

SEQ ID NO: 114254 - DNA, 22 bp, Artificial Sequence
  chemically synthesized
tgggaagatgtggagacttctc

SEQ ID NO: 114255 - DNA, 22 bp, Artificial Sequence
  chemically synthesized
ctctgtaaaccttccagactct

SEQ ID NO: 114256 - DNA, 22 bp, Artificial Sequence
  chemically synthesized
tctgtaaaccttccagactctc

SEQ ID NO: 114257 - DNA, 22 bp, Artificial Sequence
  chemically synthesized
tgtaaaccttccagactctctg

SEQ ID NO: 114258 - DNA, 22 bp, Artificial Sequence
  chemically synthesized
taaaccttccagactctctgtg

SEQ ID NO: 114259 - DNA, 22 bp, Artificial Sequence
  chemically synthesized
ccagactctctgtgcacacaca

SEQ ID NO: 114260 - DNA, 22 bp, Artificial Sequence
  chemically synthesized
cagactctctgtgcacacacag

SEQ ID NO: 114261 - DNA, 22 bp, Artificial Sequence
  chemically synthesized
tctgtgcacacacagatgcagg

SEQ ID NO: 114262 - DNA, 22 bp, Artificial Sequence
  chemically synthesized
tgtgcacacacagatgcaggtg

SEQ ID NO: 114263 - DNA, 22 bp, Artificial Sequence
  chemically synthesized
tgcacacacagatgcaggtgtc

SEQ ID NO: 114264 - DNA, 22 bp, Artificial Sequence
  chemically synthesized
caacatgaaaatttcttagggg

SEQ ID NO: 114265 - DNA, 22 bp, Artificial Sequence
  chemically synthesized
cttaggggctgtggaccagtcc

SEQ ID NO: 114266 - DNA, 22 bp, Artificial Sequence
  chemically synthesized
ttaggggctgtggaccagtcca

SEQ ID NO: 114267 - DNA, 22 bp, Artificial Sequence
  chemically synthesized
aggggctgtggaccagtccaga

SEQ ID NO: 114268 - DNA, 22 bp, Artificial Sequence
  chemically synthesized
ggggctgtggaccagtccagaa

SEQ ID NO: 114269 - DNA, 22 bp, Artificial Sequence
  chemically synthesized
tggaccagtccagaagaccctt

SEQ ID NO: 114270 - DNA, 22 bp, Artificial Sequence
  chemically synthesized
ttggcaatcctaacttctgtgg

SEQ ID NO: 114271 - DNA, 22 bp, Artificial Sequence
  chemically synthesized
tggcaatcctaacttctgtggg

SEQ ID NO: 114272 - DNA, 22 bp, Artificial Sequence
  chemically synthesized
ggcaatcctaacttctgtgggt

SEQ ID NO: 114273 - DNA, 22 bp, Artificial Sequence
  chemically synthesized
gcaatcctaacttctgtgggtc

SEQ ID NO: 114274 - DNA, 22 bp, Artificial Sequence
  chemically synthesized
acttctgtgggtctctccagtc

SEQ ID NO: 114275 - DNA, 22 bp, Artificial Sequence
  chemically synthesized
ctgtgggtctctccagtctgaa

SEQ ID NO: 114276 - DNA, 22 bp, Artificial Sequence
  chemically synthesized
tgtgggtctctccagtctgaaa

SEQ ID NO: 114277 - DNA, 22 bp, Artificial Sequence
  chemically synthesized
tgggtctctccagtctgaaaga

SEQ ID NO: 114278 - DNA, 22 bp, Artificial Sequence
  chemically synthesized
tccagtctgaaagacccgcatc

SEQ ID NO: 114279 - DNA, 22 bp, Artificial Sequence
  chemically synthesized
cagtctgaaagacccgcatcga

SEQ ID NO: 114280 - DNA, 22 bp, Artificial Sequence
  chemically synthesized
aaagacccgcatcgatctcaca

SEQ ID NO: 114281 - DNA, 22 bp, Artificial Sequence
  chemically synthesized
acaccacaaaatggagttcttc

SEQ ID NO: 114282 - DNA, 22 bp, Artificial Sequence
  chemically synthesized
ttctgggaaggacttgttctaa

SEQ ID NO: 114283 - DNA, 22 bp, Artificial Sequence
  chemically synthesized
ctgggaaggacttgttctaaca

SEQ ID NO: 114284 - DNA, 22 bp, Artificial Sequence
  chemically synthesized
tgggaaggacttgttctaacag

SEQ ID NO: 114285 - DNA, 22 bp, Artificial Sequence
  chemically synthesized
ggaaggacttgttctaacaggc

SEQ ID NO: 114286 - DNA, 22 bp, Artificial Sequence
  chemically synthesized
gttctaacaggcctgagagtga

SEQ ID NO: 114287 - DNA, 22 bp, Artificial Sequence
  chemically synthesized
ttctaacaggcctgagagtgag

SEQ ID NO: 114288 - DNA, 22 bp, Artificial Sequence
  chemically synthesized
taacaggcctgagagtgaggtg

SEQ ID NO: 114289 - DNA, 22 bp, Artificial Sequence
  chemically synthesized
acaggcctgagagtgaggtgac

SEQ ID NO: 114290 - DNA, 22 bp, Artificial Sequence
  chemically synthesized
agagtgaggtgaccttgtggcc

SEQ ID NO: 114291 - DNA, 22 bp, Artificial Sequence
  chemically synthesized
gtggccattttctgtgacagag

SEQ ID NO: 114292 - DNA, 22 bp, Artificial Sequence
  chemically synthesized
tggccattttctgtgacagaga

SEQ ID NO: 114293 - DNA, 22 bp, Artificial Sequence
  chemically synthesized
tctgtgacagagacacctaaaa

SEQ ID NO: 114294 - DNA, 22 bp, Artificial Sequence
  chemically synthesized
ctgtgacagagacacctaaaaa

SEQ ID NO: 114295 - DNA, 22 bp, Artificial Sequence
  chemically synthesized
tgtgacagagacacctaaaaag

SEQ ID NO: 114296 - DNA, 22 bp, Artificial Sequence
  chemically synthesized
tgacagagacacctaaaaagag

SEQ ID NO: 114297 - DNA, 22 bp, Artificial Sequence
  chemically synthesized
aaaagagtctgttgtgagtctg

SEQ ID NO: 114298 - DNA, 22 bp, Artificial Sequence
  chemically synthesized
ttgtgagtctggagacattgag

SEQ ID NO: 114299 - DNA, 22 bp, Artificial Sequence
  chemically synthesized
tgagtctggagacattgagaac

SEQ ID NO: 114300 - DNA, 22 bp, Artificial Sequence
  chemically synthesized
gagacattgagaaccctgtgag

SEQ ID NO: 114301 - DNA, 22 bp, Artificial Sequence
  chemically synthesized
agaaccctgtgagtaaggattt

SEQ ID NO: 114302 - DNA, 22 bp, Artificial Sequence
  chemically synthesized
tgagtaaggattttatttaggt

SEQ ID NO: 114303 - DNA, 22 bp, Artificial Sequence
  chemically synthesized
tatttaggtctgtttctggtca

SEQ ID NO: 114304 - DNA, 22 bp, Artificial Sequence
  chemically synthesized
atttaggtctgtttctggtcag

SEQ ID NO: 114305 - DNA, 22 bp, Artificial Sequence
  chemically synthesized
tttaggtctgtttctggtcaga

SEQ ID NO: 114306 - DNA, 22 bp, Artificial Sequence
  chemically synthesized
aggtctgtttctggtcagagtg

SEQ ID NO: 114307 - DNA, 22 bp, Artificial Sequence
  chemically synthesized
ggtctgtttctggtcagagtgg

SEQ ID NO: 114308 - DNA, 22 bp, Artificial Sequence
  chemically synthesized
tttctggtcagagtggggattt

SEQ ID NO: 114309 - DNA, 22 bp, Artificial Sequence
  chemically synthesized
ctggtcagagtggggatttaag

SEQ ID NO: 114310 - DNA, 22 bp, Artificial Sequence
  chemically synthesized
tggtcagagtggggatttaagg

SEQ ID NO: 114311 - DNA, 22 bp, Artificial Sequence
  chemically synthesized
gtcagagtggggatttaaggct

SEQ ID NO: 114312 - DNA, 22 bp, Artificial Sequence
  chemically synthesized
aaggcttggtcaatatgattaa

SEQ ID NO: 114313 - DNA, 22 bp, Artificial Sequence
  chemically synthesized
aggcttggtcaatatgattaag

SEQ ID NO: 114314 - DNA, 22 bp, Artificial Sequence
  chemically synthesized
ggtcaatatgattaagactaaa

SEQ ID NO: 114315 - DNA, 22 bp, Artificial Sequence
  chemically synthesized
gtcaatatgattaagactaaag

SEQ ID NO: 114316 - DNA, 22 bp, Artificial Sequence
  chemically synthesized
agactaaaggccacacacatag

SEQ ID NO: 114317 - DNA, 22 bp, Artificial Sequence
  chemically synthesized
aaggccacacacatagatttgt

SEQ ID NO: 114318 - DNA, 22 bp, Artificial Sequence
  chemically synthesized
gtgtgagattaccatctgtaaa

SEQ ID NO: 114319 - DNA, 22 bp, Artificial Sequence
  chemically synthesized
tgtgagattaccatctgtaaaa

SEQ ID NO: 114320 - DNA, 22 bp, Artificial Sequence
  chemically synthesized
ccatctgtaaaaatctgaaaaa

SEQ ID NO: 114321 - DNA, 22 bp, Artificial Sequence
  chemically synthesized
taaaaatctgaaaaagctaaga

SEQ ID NO: 114322 - DNA, 22 bp, Artificial Sequence
  chemically synthesized
aaaaagctaagaaaacctatct

SEQ ID NO: 114323 - DNA, 22 bp, Artificial Sequence
  chemically synthesized
agaaaacctatctctctccatc

SEQ ID NO: 114324 - DNA, 22 bp, Artificial Sequence
  chemically synthesized
tctctctccatcaattttagtt

SEQ ID NO: 114325 - DNA, 22 bp, Artificial Sequence
  chemically synthesized
tctccatcaattttagttttta

SEQ ID NO: 114326 - DNA, 22 bp, Artificial Sequence
  chemically synthesized
tccatcaattttagtttttatg

SEQ ID NO: 114327 - DNA, 22 bp, Artificial Sequence
  chemically synthesized
catcaattttagtttttatgtg

SEQ ID NO: 114328 - DNA, 22 bp, Artificial Sequence
  chemically synthesized
tagtttttatgtgtttgtaaga

SEQ ID NO: 114329 - DNA, 22 bp, Artificial Sequence
  chemically synthesized
agtttttatgtgtttgtaagat

SEQ ID NO: 114330 - DNA, 22 bp, Artificial Sequence
  chemically synthesized
gtttttatgtgtttgtaagatg

SEQ ID NO: 114331 - DNA, 22 bp, Artificial Sequence
  chemically synthesized
ttatgtgtttgtaagatgtaga

SEQ ID NO: 114332 - DNA, 22 bp, Artificial Sequence
  chemically synthesized
tatgtgtttgtaagatgtagat

SEQ ID NO: 114333 - DNA, 22 bp, Artificial Sequence
  chemically synthesized
atgtgtttgtaagatgtagata

SEQ ID NO: 114334 - DNA, 22 bp, Artificial Sequence
  chemically synthesized
tgtgtttgtaagatgtagatat

SEQ ID NO: 114335 - DNA, 22 bp, Artificial Sequence
  chemically synthesized
gtaagatgtagatatgtctatt

SEQ ID NO: 114336 - DNA, 22 bp, Artificial Sequence
  chemically synthesized
taagatgtagatatgtctattt

SEQ ID NO: 114337 - DNA, 22 bp, Artificial Sequence
  chemically synthesized
ttttgtgcatgagagagaggaa

SEQ ID NO: 114338 - DNA, 22 bp, Artificial Sequence
  chemically synthesized
tgtgcatgagagagaggaagat

SEQ ID NO: 114339 - DNA, 22 bp, Artificial Sequence
  chemically synthesized
gtgcatgagagagaggaagatc

SEQ ID NO: 114340 - DNA, 22 bp, Artificial Sequence
  chemically synthesized
tgcatgagagagaggaagatca

SEQ ID NO: 114341 - DNA, 22 bp, Artificial Sequence
  chemically synthesized
aaaggaagaatgaactggttgg

SEQ ID NO: 114342 - DNA, 22 bp, Artificial Sequence
  chemically synthesized
gttggcagctttcagctgtgta

SEQ ID NO: 114343 - DNA, 22 bp, Artificial Sequence
  chemically synthesized
gcagctttcagctgtgtagtgg

SEQ ID NO: 114344 - DNA, 22 bp, Artificial Sequence
  chemically synthesized
tcagctgtgtagtgggtattga

SEQ ID NO: 114345 - DNA, 22 bp, Artificial Sequence
  chemically synthesized
cagctgtgtagtgggtattgag

SEQ ID NO: 114346 - DNA, 22 bp, Artificial Sequence
  chemically synthesized
agctgtgtagtgggtattgagg

SEQ ID NO: 114347 - DNA, 22 bp, Artificial Sequence
  chemically synthesized
tgtagtgggtattgaggacacg

SEQ ID NO: 114348 - DNA, 22 bp, Artificial Sequence
  chemically synthesized
aggacacgggaaggtggtgctg

SEQ ID NO: 114349 - DNA, 22 bp, Artificial Sequence
  chemically synthesized
gaagaaaagccacattttcttg

SEQ ID NO: 114350 - DNA, 22 bp, Artificial Sequence
  chemically synthesized
tcttgtgccctggggatagtag

SEQ ID NO: 114351 - DNA, 22 bp, Artificial Sequence
  chemically synthesized
cttgtgccctggggatagtagg

SEQ ID NO: 114352 - DNA, 22 bp, Artificial Sequence
  chemically synthesized
ttgtgccctggggatagtaggg

SEQ ID NO: 114353 - DNA, 22 bp, Artificial Sequence
  chemically synthesized
gtgccctggggatagtagggcc

SEQ ID NO: 114354 - DNA, 22 bp, Artificial Sequence
  chemically synthesized
tgccctggggatagtagggcct

SEQ ID NO: 114355 - DNA, 22 bp, Artificial Sequence
  chemically synthesized
gggatagtagggccttggtgct

SEQ ID NO: 114356 - DNA, 22 bp, Artificial Sequence
  chemically synthesized
ggtgctggtcagaatttaagcc

SEQ ID NO: 114357 - DNA, 22 bp, Artificial Sequence
  chemically synthesized
gtgctggtcagaatttaagcct

SEQ ID NO: 114358 - DNA, 22 bp, Artificial Sequence
  chemically synthesized
gtcagaatttaagcctatcctt

SEQ ID NO: 114359 - DNA, 22 bp, Artificial Sequence
  chemically synthesized
aagcctatccttgggctgaatg

SEQ ID NO: 114360 - DNA, 22 bp, Artificial Sequence
  chemically synthesized
agcctatccttgggctgaatgc

SEQ ID NO: 114361 - DNA, 22 bp, Artificial Sequence
  chemically synthesized
tccttgggctgaatgctccccc

SEQ ID NO: 114362 - DNA, 22 bp, Artificial Sequence
  chemically synthesized
gggctgaatgctccccctggtg

SEQ ID NO: 114363 - DNA, 22 bp, Artificial Sequence
  chemically synthesized
ggctgaatgctccccctggtgg

SEQ ID NO: 114364 - DNA, 22 bp, Artificial Sequence
  chemically synthesized
aatgctccccctggtggctaca

SEQ ID NO: 114365 - DNA, 22 bp, Artificial Sequence
  chemically synthesized
cccctggtggctacattggaaa

SEQ ID NO: 114366 - DNA, 22 bp, Artificial Sequence
  chemically synthesized
gtggctacattggaaaaccaca

SEQ ID NO: 114367 - DNA, 22 bp, Artificial Sequence
  chemically synthesized
cattggaaaaccacagcatgtg

SEQ ID NO: 114368 - DNA, 22 bp, Artificial Sequence
  chemically synthesized
gaaaaccacagcatgtgtacag

SEQ ID NO: 114369 - DNA, 22 bp, Artificial Sequence
  chemically synthesized
ggggattcagttctcctgaagg

SEQ ID NO: 114370 - DNA, 22 bp, Artificial Sequence
  chemically synthesized
gggattcagttctcctgaagga

SEQ ID NO: 114371 - DNA, 22 bp, Artificial Sequence
  chemically synthesized
agttctcctgaaggaatctcct

SEQ ID NO: 114372 - DNA, 22 bp, Artificial Sequence
  chemically synthesized
tcctgaaggaatctcctacttc

SEQ ID NO: 114373 - DNA, 22 bp, Artificial Sequence
  chemically synthesized
ctgaaggaatctcctacttcac

SEQ ID NO: 114374 - DNA, 22 bp, Artificial Sequence
  chemically synthesized
aaggaatctcctacttcaccaa

SEQ ID NO: 114375 - DNA, 22 bp, Artificial Sequence
  chemically synthesized
ctacttcaccaagcctggctca

SEQ ID NO: 114376 - DNA, 22 bp, Artificial Sequence
  chemically synthesized
cttcaccaagcctggctcagtg

SEQ ID NO: 114377 - DNA, 22 bp, Artificial Sequence
  chemically synthesized
caccaagcctggctcagtgggc

SEQ ID NO: 114378 - DNA, 22 bp, Artificial Sequence
  chemically synthesized
accaagcctggctcagtgggct

SEQ ID NO: 114379 - DNA, 22 bp, Artificial Sequence
  chemically synthesized
gctcagtgggctggctaggtat

SEQ ID NO: 114380 - DNA, 22 bp, Artificial Sequence
  chemically synthesized
agtgggctggctaggtatcaat

SEQ ID NO: 114381 - DNA, 22 bp, Artificial Sequence
  chemically synthesized
gctaggtatcaattctggatag

SEQ ID NO: 114382 - DNA, 22 bp, Artificial Sequence
  chemically synthesized
ggtatcaattctggatagaggt

SEQ ID NO: 114383 - DNA, 22 bp, Artificial Sequence
  chemically synthesized
tggatagaggttccttaaataa

SEQ ID NO: 114384 - DNA, 22 bp, Artificial Sequence
  chemically synthesized
gatagaggttccttaaataaaa

SEQ ID NO: 114385 - DNA, 22 bp, Artificial Sequence
  chemically synthesized
cttaaataaaacttatactggc

SEQ ID NO: 114386 - DNA, 22 bp, Artificial Sequence
  chemically synthesized
aaataaaacttatactggcccc

SEQ ID NO: 114387 - DNA, 22 bp, Artificial Sequence
  chemically synthesized
aataaaacttatactggcccct

SEQ ID NO: 114388 - DNA, 22 bp, Artificial Sequence
  chemically synthesized
atactggccccttgaaagccag

SEQ ID NO: 114389 - DNA, 22 bp, Artificial Sequence
  chemically synthesized
tactggccccttgaaagccagg

SEQ ID NO: 114390 - DNA, 22 bp, Artificial Sequence
  chemically synthesized
gccccttgaaagccaggctttc

SEQ ID NO: 114391 - DNA, 22 bp, Artificial Sequence
  chemically synthesized
gaaagccaggctttccacccca

SEQ ID NO: 114392 - DNA, 22 bp, Artificial Sequence
  chemically synthesized
aaagccaggctttccaccccac

SEQ ID NO: 114393 - DNA, 22 bp, Artificial Sequence
  chemically synthesized
tccaccccaccatacccccacc

SEQ ID NO: 114394 - DNA, 22 bp, Artificial Sequence
  chemically synthesized
ccaccccaccatacccccaccc

SEQ ID NO: 114395 - DNA, 22 bp, Artificial Sequence
  chemically synthesized
caccccaccatacccccacccc

SEQ ID NO: 114396 - DNA, 22 bp, Artificial Sequence
  chemically synthesized
tctctctctgtcgctcgctcgc

SEQ ID NO: 114397 - DNA, 22 bp, Artificial Sequence
  chemically synthesized
tctctctgtcgctcgctcgctg

SEQ ID NO: 114398 - DNA, 22 bp, Artificial Sequence
  chemically synthesized
tctctgtcgctcgctcgctgtt

SEQ ID NO: 114399 - DNA, 22 bp, Artificial Sequence
  chemically synthesized
tctgtcgctcgctcgctgtttc

SEQ ID NO: 114400 - DNA, 22 bp, Artificial Sequence
  chemically synthesized
tgtcgctcgctcgctgtttctc

SEQ ID NO: 114401 - DNA, 22 bp, Artificial Sequence
  chemically synthesized
tcgctcgctcgctgtttctctc

SEQ ID NO: 114402 - DNA, 22 bp, Artificial Sequence
  chemically synthesized
gctcgctgtttctctctctctc

SEQ ID NO: 114403 - DNA, 22 bp, Artificial Sequence
  chemically synthesized
gctgtttctctctctctctctc

SEQ ID NO: 114404 - DNA, 22 bp, Artificial Sequence
  chemically synthesized
tttctctctctctctctcacac

SEQ ID NO: 114405 - DNA, 22 bp, Artificial Sequence
  chemically synthesized
ctctctctctctctcacacaca

SEQ ID NO: 114406 - DNA, 22 bp, Artificial Sequence
  chemically synthesized
tctctctctctctcacacacac

SEQ ID NO: 114407 - DNA, 22 bp, Artificial Sequence
  chemically synthesized
tctctctctctcacacacacac

SEQ ID NO: 114408 - DNA, 22 bp, Artificial Sequence
  chemically synthesized
tctctctctcacacacacacaa

SEQ ID NO: 114409 - DNA, 22 bp, Artificial Sequence
  chemically synthesized
tctctctcacacacacacaaac

SEQ ID NO: 114410 - DNA, 22 bp, Artificial Sequence
  chemically synthesized
tctctcacacacacacaaacaa

SEQ ID NO: 114411 - DNA, 22 bp, Artificial Sequence
  chemically synthesized
tctcacacacacacaaacaata

SEQ ID NO: 114412 - DNA, 22 bp, Artificial Sequence
  chemically synthesized
tcacacacacacaaacaatatt

SEQ ID NO: 114413 - DNA, 22 bp, Artificial Sequence
  chemically synthesized
acacacacacaaacaatattac

SEQ ID NO: 114414 - DNA, 22 bp, Artificial Sequence
  chemically synthesized
catgcaatgaaaaccatttgca

SEQ ID NO: 114415 - DNA, 22 bp, Artificial Sequence
  chemically synthesized
gcacattaacaaataggtacac

SEQ ID NO: 114416 - DNA, 22 bp, Artificial Sequence
  chemically synthesized
cacattaacaaataggtacact

SEQ ID NO: 114417 - DNA, 22 bp, Artificial Sequence
  chemically synthesized
acaaataggtacactgttacag

SEQ ID NO: 114418 - DNA, 22 bp, Artificial Sequence
  chemically synthesized
ttacagtgacacttttcacttt

SEQ ID NO: 114419 - DNA, 22 bp, Artificial Sequence
  chemically synthesized
cagtgacacttttcacttttag

SEQ ID NO: 114420 - DNA, 22 bp, Artificial Sequence
  chemically synthesized
ttcacttttagtaatggattta

SEQ ID NO: 114421 - DNA, 22 bp, Artificial Sequence
  chemically synthesized
tcacttttagtaatggatttag

SEQ ID NO: 114422 - DNA, 22 bp, Artificial Sequence
  chemically synthesized
cacttttagtaatggatttaga

SEQ ID NO: 114423 - DNA, 22 bp, Artificial Sequence
  chemically synthesized
acttttagtaatggatttagat

SEQ ID NO: 114424 - DNA, 22 bp, Artificial Sequence
  chemically synthesized
ttagtaatggatttagattctt

SEQ ID NO: 114425 - DNA, 22 bp, Artificial Sequence
  chemically synthesized
tagtaatggatttagattcttt

SEQ ID NO: 114426 - DNA, 22 bp, Artificial Sequence
  chemically synthesized
agtaatggatttagattcttta

SEQ ID NO: 114427 - DNA, 22 bp, Artificial Sequence
  chemically synthesized
gtaatggatttagattctttaa

SEQ ID NO: 114428 - DNA, 22 bp, Artificial Sequence
  chemically synthesized
agattctttaataatgaattct

SEQ ID NO: 114429 - DNA, 22 bp, Artificial Sequence
  chemically synthesized
gattctttaataatgaattcta

SEQ ID NO: 114430 - DNA, 22 bp, Artificial Sequence
  chemically synthesized
tttaataatgaattctaatacc

SEQ ID NO: 114431 - DNA, 22 bp, Artificial Sequence
  chemically synthesized
taataatgaattctaatacctt

SEQ ID NO: 114432 - DNA, 22 bp, Artificial Sequence
  chemically synthesized
aataatgaattctaatacctta

SEQ ID NO: 114433 - DNA, 22 bp, Artificial Sequence
  chemically synthesized
ataatgaattctaataccttaa

SEQ ID NO: 114434 - DNA, 22 bp, Artificial Sequence
  chemically synthesized
taataccttaaaggttaaggcc

SEQ ID NO: 114435 - DNA, 22 bp, Artificial Sequence
  chemically synthesized
ataccttaaaggttaaggcctg

SEQ ID NO: 114436 - DNA, 22 bp, Artificial Sequence
  chemically synthesized
aaaggttaaggcctgaatgcct

SEQ ID NO: 114437 - DNA, 22 bp, Artificial Sequence
  chemically synthesized
aaggttaaggcctgaatgcctc

SEQ ID NO: 114438 - DNA, 22 bp, Artificial Sequence
  chemically synthesized
aggcctgaatgcctcacactaa

SEQ ID NO: 114439 - DNA, 22 bp, Artificial Sequence
  chemically synthesized
aatgcctcacactaatgtgttg

SEQ ID NO: 114440 - DNA, 22 bp, Artificial Sequence
  chemically synthesized
acactaatgtgttgatacttca

SEQ ID NO: 114441 - DNA, 22 bp, Artificial Sequence
  chemically synthesized
atgtgttgatacttcaccttcc

SEQ ID NO: 114442 - DNA, 22 bp, Artificial Sequence
  chemically synthesized
atacttcaccttccccaaccat

SEQ ID NO: 114443 - DNA, 22 bp, Artificial Sequence
  chemically synthesized
caccttccccaaccatcatgca

SEQ ID NO: 114444 - DNA, 22 bp, Artificial Sequence
  chemically synthesized
accttccccaaccatcatgcac

SEQ ID NO: 114445 - DNA, 22 bp, Artificial Sequence
  chemically synthesized
ccccaaccatcatgcacccaca

SEQ ID NO: 114446 - DNA, 22 bp, Artificial Sequence
  chemically synthesized
cccaaccatcatgcacccacat

SEQ ID NO: 114447 - DNA, 22 bp, Artificial Sequence
  chemically synthesized
acttcacctaatattcgcatga

SEQ ID NO: 114448 - DNA, 22 bp, Artificial Sequence
  chemically synthesized
cacctaatattcgcatgattac

SEQ ID NO: 114449 - DNA, 22 bp, Artificial Sequence
  chemically synthesized
acctaatattcgcatgattacc

SEQ ID NO: 114450 - DNA, 22 bp, Artificial Sequence
  chemically synthesized
atattcgcatgattacccacag

SEQ ID NO: 114451 - DNA, 22 bp, Artificial Sequence
  chemically synthesized
gcatgattacccacagtgatag

SEQ ID NO: 114452 - DNA, 22 bp, Artificial Sequence
  chemically synthesized
cccacagtgatagagataggtc

SEQ ID NO: 114453 - DNA, 22 bp, Artificial Sequence
  chemically synthesized
gctccttcattgtccccatcat

SEQ ID NO: 114454 - DNA, 22 bp, Artificial Sequence
  chemically synthesized
ctccttcattgtccccatcatc

SEQ ID NO: 114455 - DNA, 22 bp, Artificial Sequence
  chemically synthesized
cttcattgtccccatcatcctc

SEQ ID NO: 114456 - DNA, 22 bp, Artificial Sequence
  chemically synthesized
cattgtccccatcatcctcctc

SEQ ID NO: 114457 - DNA, 22 bp, Artificial Sequence
  chemically synthesized
attgtccccatcatcctcctct

SEQ ID NO: 114458 - DNA, 22 bp, Artificial Sequence
  chemically synthesized
tccccatcatcctcctcttggc

SEQ ID NO: 114459 - DNA, 22 bp, Artificial Sequence
  chemically synthesized
ctcttggcctccaggcttcaga

SEQ ID NO: 114460 - DNA, 22 bp, Artificial Sequence
  chemically synthesized
ttggcctccaggcttcagaaac

SEQ ID NO: 114461 - DNA, 22 bp, Artificial Sequence
  chemically synthesized
ggcctccaggcttcagaaacta

SEQ ID NO: 114462 - DNA, 22 bp, Artificial Sequence
  chemically synthesized
gcctccaggcttcagaaactac

SEQ ID NO: 114463 - DNA, 22 bp, Artificial Sequence
  chemically synthesized
caggcttcagaaactacctctg

SEQ ID NO: 114464 - DNA, 22 bp, Artificial Sequence
  chemically synthesized
cagaaactacctctgccttcct

SEQ ID NO: 114465 - DNA, 22 bp, Artificial Sequence
  chemically synthesized
agaaactacctctgccttccta

SEQ ID NO: 114466 - DNA, 22 bp, Artificial Sequence
  chemically synthesized
cctctgccttcctagcctgggc

SEQ ID NO: 114467 - DNA, 22 bp, Artificial Sequence
  chemically synthesized
tgccttcctagcctgggctagt

SEQ ID NO: 114468 - DNA, 22 bp, Artificial Sequence
  chemically synthesized
ccttcctagcctgggctagtga

SEQ ID NO: 114469 - DNA, 22 bp, Artificial Sequence
  chemically synthesized
cctagcctgggctagtgaccct

SEQ ID NO: 114470 - DNA, 22 bp, Artificial Sequence
  chemically synthesized
ctagcctgggctagtgacccta

SEQ ID NO: 114471 - DNA, 22 bp, Artificial Sequence
  chemically synthesized
gcctgggctagtgaccctattt

SEQ ID NO: 114472 - DNA, 22 bp, Artificial Sequence
  chemically synthesized
ggctagtgaccctattttggaa

SEQ ID NO: 114473 - DNA, 22 bp, Artificial Sequence
  chemically synthesized
gtgaccctattttggaaacttc

SEQ ID NO: 114474 - DNA, 22 bp, Artificial Sequence
  chemically synthesized
ttttggaaacttcgttgaacaa

SEQ ID NO: 114475 - DNA, 22 bp, Artificial Sequence
  chemically synthesized
tggaaacttcgttgaacaatct

SEQ ID NO: 114476 - DNA, 22 bp, Artificial Sequence
  chemically synthesized
ggaaacttcgttgaacaatcta

SEQ ID NO: 114477 - DNA, 22 bp, Artificial Sequence
  chemically synthesized
gaaacttcgttgaacaatctaa

SEQ ID NO: 114478 - DNA, 22 bp, Artificial Sequence
  chemically synthesized
cgttgaacaatctaacatcttt

SEQ ID NO: 114479 - DNA, 22 bp, Artificial Sequence
  chemically synthesized
gttgaacaatctaacatcttta

SEQ ID NO: 114480 - DNA, 22 bp, Artificial Sequence
  chemically synthesized
aacaatctaacatctttactca

SEQ ID NO: 114481 - DNA, 22 bp, Artificial Sequence
  chemically synthesized
acatctttactcaatgtgagct

SEQ ID NO: 114482 - DNA, 22 bp, Artificial Sequence
  chemically synthesized
tactcaatgtgagcttcataaa

SEQ ID NO: 114483 - DNA, 22 bp, Artificial Sequence
  chemically synthesized
actcaatgtgagcttcataaag

SEQ ID NO: 114484 - DNA, 22 bp, Artificial Sequence
  chemically synthesized
ctcaatgtgagcttcataaagg

SEQ ID NO: 114485 - DNA, 22 bp, Artificial Sequence
  chemically synthesized
aatgtgagcttcataaaggcaa

SEQ ID NO: 114486 - DNA, 22 bp, Artificial Sequence
  chemically synthesized
cataaaggcaagaccatgacat

SEQ ID NO: 114487 - DNA, 22 bp, Artificial Sequence
  chemically synthesized
ataaaggcaagaccatgacatg

SEQ ID NO: 114488 - DNA, 22 bp, Artificial Sequence
  chemically synthesized
atctgtctatcttcaagttctt

SEQ ID NO: 114489 - DNA, 22 bp, Artificial Sequence
  chemically synthesized
tctatcttcaagttcttgatca

SEQ ID NO: 114490 - DNA, 22 bp, Artificial Sequence
  chemically synthesized
tcttcaagttcttgatcagagt

SEQ ID NO: 114491 - DNA, 22 bp, Artificial Sequence
  chemically synthesized
caagttcttgatcagagtttct

SEQ ID NO: 114492 - DNA, 22 bp, Artificial Sequence
  chemically synthesized
aagttcttgatcagagtttctc

SEQ ID NO: 114493 - DNA, 22 bp, Artificial Sequence
  chemically synthesized
ttgatcagagtttctcacagga

SEQ ID NO: 114494 - DNA, 22 bp, Artificial Sequence
  chemically synthesized
gatcagagtttctcacaggacg

SEQ ID NO: 114495 - DNA, 22 bp, Artificial Sequence
  chemically synthesized
atcagagtttctcacaggacgc

SEQ ID NO: 114496 - DNA, 22 bp, Artificial Sequence
  chemically synthesized
ctcacaggacgcacttaatgca

SEQ ID NO: 114497 - DNA, 22 bp, Artificial Sequence
  chemically synthesized
tcacaggacgcacttaatgcac

SEQ ID NO: 114498 - DNA, 22 bp, Artificial Sequence
  chemically synthesized
acaggacgcacttaatgcacgt

SEQ ID NO: 114499 - DNA, 22 bp, Artificial Sequence
  chemically synthesized
aatgcacgtcaatgaaaattga

SEQ ID NO: 114500 - DNA, 22 bp, Artificial Sequence
  chemically synthesized
atgcacgtcaatgaaaattgat

SEQ ID NO: 114501 - DNA, 22 bp, Artificial Sequence
  chemically synthesized
atgagaatgtttaatgtaattt

SEQ ID NO: 114502 - DNA, 22 bp, Artificial Sequence
  chemically synthesized
aatgtaatttcagtcacacttc

SEQ ID NO: 114503 - DNA, 22 bp, Artificial Sequence
  chemically synthesized
atgtaatttcagtcacacttca

SEQ ID NO: 114504 - DNA, 22 bp, Artificial Sequence
  chemically synthesized
cagtcacacttcaaagaggact

SEQ ID NO: 114505 - DNA, 22 bp, Artificial Sequence
  chemically synthesized
agtcacacttcaaagaggacta

SEQ ID NO: 114506 - DNA, 22 bp, Artificial Sequence
  chemically synthesized
caaagaggactattttgtgata

SEQ ID NO: 114507 - DNA, 22 bp, Artificial Sequence
  chemically synthesized
aaagaggactattttgtgatat

SEQ ID NO: 114508 - DNA, 22 bp, Artificial Sequence
  chemically synthesized
ttttgtgatatgataaaacaaa

SEQ ID NO: 114509 - DNA, 22 bp, Artificial Sequence
  chemically synthesized
tgtgatatgataaaacaaatct

SEQ ID NO: 114510 - DNA, 22 bp, Artificial Sequence
  chemically synthesized
gtgatatgataaaacaaatcta

SEQ ID NO: 114511 - DNA, 22 bp, Artificial Sequence
  chemically synthesized
tgatatgataaaacaaatctaa

SEQ ID NO: 114512 - DNA, 22 bp, Artificial Sequence
  chemically synthesized
aaggtcatttagagcaataaag

SEQ ID NO: 114513 - DNA, 22 bp, Artificial Sequence
  chemically synthesized
agagcaataaagaatcaaaaat

SEQ ID NO: 114514 - DNA, 22 bp, Artificial Sequence
  chemically synthesized
gagcaataaagaatcaaaaatg

SEQ ID NO: 114515 - DNA, 22 bp, Artificial Sequence
  chemically synthesized
agttctttcatttggttttcaa

SEQ ID NO: 114516 - DNA, 22 bp, Artificial Sequence
  chemically synthesized
tttcatttggttttcaaataaa

SEQ ID NO: 114517 - DNA, 22 bp, Artificial Sequence
  chemically synthesized
tcatttggttttcaaataaatc

SEQ ID NO: 114518 - DNA, 22 bp, Artificial Sequence
  chemically synthesized
catttggttttcaaataaatct

SEQ ID NO: 114519 - DNA, 22 bp, Artificial Sequence
  chemically synthesized
atttggttttcaaataaatcta

SEQ ID NO: 114520 - DNA, 22 bp, Artificial Sequence
  chemically synthesized
ggttttcaaataaatctattgc

SEQ ID NO: 114521 - DNA, 22 bp, Artificial Sequence
  chemically synthesized
gttttcaaataaatctattgct

SEQ ID NO: 114522 - DNA, 22 bp, Artificial Sequence
  chemically synthesized
tcaaataaatctattgcttgga

SEQ ID NO: 114523 - DNA, 22 bp, Artificial Sequence
  chemically synthesized
caaataaatctattgcttggaa

SEQ ID NO: 114524 - DNA, 22 bp, Artificial Sequence
  chemically synthesized
aaataaatctattgcttggaaa

SEQ ID NO: 114525 - DNA, 22 bp, Artificial Sequence
  chemically synthesized
ttgcttggaaactggtccttca

SEQ ID NO: 114526 - DNA, 22 bp, Artificial Sequence
  chemically synthesized
cttggaaactggtccttcaatt

SEQ ID NO: 114527 - DNA, 22 bp, Artificial Sequence
  chemically synthesized
ggaaactggtccttcaattata

SEQ ID NO: 114528 - DNA, 22 bp, Artificial Sequence
  chemically synthesized
gaaactggtccttcaattatat

SEQ ID NO: 114529 - DNA, 22 bp, Artificial Sequence
  chemically synthesized
gtccttcaattatataattcag

SEQ ID NO: 114530 - DNA, 22 bp, Artificial Sequence
  chemically synthesized
caattatataattcagagaaat

SEQ ID NO: 114531 - DNA, 22 bp, Artificial Sequence
  chemically synthesized
aattatataattcagagaaata

SEQ ID NO: 114532 - DNA, 22 bp, Artificial Sequence
  chemically synthesized
tataattcagagaaatagaata

SEQ ID NO: 114533 - DNA, 22 bp, Artificial Sequence
  chemically synthesized
agagaaatagaatataaagcta

SEQ ID NO: 114534 - DNA, 22 bp, Artificial Sequence
  chemically synthesized
ttatacagatgttagtttaaaa

SEQ ID NO: 114535 - DNA, 22 bp, Artificial Sequence
  chemically synthesized
tacagatgttagtttaaaaaag

SEQ ID NO: 114536 - DNA, 22 bp, Artificial Sequence
  chemically synthesized
gtttaaaaaagtaagcaaatat

SEQ ID NO: 114537 - DNA, 22 bp, Artificial Sequence
  chemically synthesized
aaaaaagtaagcaaatattaga

SEQ ID NO: 114538 - DNA, 22 bp, Artificial Sequence
  chemically synthesized
aaaaagtaagcaaatattagag

SEQ ID NO: 114539 - DNA, 22 bp, Artificial Sequence
  chemically synthesized
gagatctctaaatggtaggtta

SEQ ID NO: 114540 - DNA, 22 bp, Artificial Sequence
  chemically synthesized
taaatggtaggttatccactaa

SEQ ID NO: 114541 - DNA, 22 bp, Artificial Sequence
  chemically synthesized
aatggtaggttatccactaaac

SEQ ID NO: 114542 - DNA, 22 bp, Artificial Sequence
  chemically synthesized
tccactaaacagtattgtttat

SEQ ID NO: 114543 - DNA, 22 bp, Artificial Sequence
  chemically synthesized
aacagtattgtttatctacgta

SEQ ID NO: 114544 - DNA, 22 bp, Artificial Sequence
  chemically synthesized
tttatctacgtaaaaagctgtc

SEQ ID NO: 114545 - DNA, 22 bp, Artificial Sequence
  chemically synthesized
atctacgtaaaaagctgtcaat

SEQ ID NO: 114546 - DNA, 22 bp, Artificial Sequence
  chemically synthesized
tctacgtaaaaagctgtcaatt

SEQ ID NO: 114547 - DNA, 22 bp, Artificial Sequence
  chemically synthesized
cgtaaaaagctgtcaattacat

SEQ ID NO: 114548 - DNA, 22 bp, Artificial Sequence
  chemically synthesized
tcaattacatatctgcatccag

SEQ ID NO: 114549 - DNA, 22 bp, Artificial Sequence
  chemically synthesized
catatctgcatccagctccata

SEQ ID NO: 114550 - DNA, 22 bp, Artificial Sequence
  chemically synthesized
catccagctccatacaccaaaa

SEQ ID NO: 114551 - DNA, 22 bp, Artificial Sequence
  chemically synthesized
catacaccaaaataacatctgt

SEQ ID NO: 114552 - DNA, 22 bp, Artificial Sequence
  chemically synthesized
tttccagtgcagactttaaatc

SEQ ID NO: 114553 - DNA, 22 bp, Artificial Sequence
  chemically synthesized
ccagtgcagactttaaatcctt

SEQ ID NO: 114554 - DNA, 22 bp, Artificial Sequence
  chemically synthesized
cagtgcagactttaaatccttc

SEQ ID NO: 114555 - DNA, 22 bp, Artificial Sequence
  chemically synthesized
taaatccttcctgcatattgtt

SEQ ID NO: 114556 - DNA, 22 bp, Artificial Sequence
  chemically synthesized
aaatccttcctgcatattgtta

SEQ ID NO: 114557 - DNA, 22 bp, Artificial Sequence
  chemically synthesized
aatccttcctgcatattgttaa

SEQ ID NO: 114558 - DNA, 22 bp, Artificial Sequence
  chemically synthesized
cctgcatattgttaacaatgta

SEQ ID NO: 114559 - DNA, 22 bp, Artificial Sequence
  chemically synthesized
ctgcatattgttaacaatgtac

SEQ ID NO: 114560 - DNA, 22 bp, Artificial Sequence
  chemically synthesized
catattgttaacaatgtactct

SEQ ID NO: 114561 - DNA, 22 bp, Artificial Sequence
  chemically synthesized
ttaacaatgtactctggaaaat

SEQ ID NO: 114562 - DNA, 22 bp, Artificial Sequence
  chemically synthesized
acaatgtactctggaaaatatg

SEQ ID NO: 114563 - DNA, 22 bp, Artificial Sequence
  chemically synthesized
tggaaaatatgattgttatctc

SEQ ID NO: 114564 - DNA, 22 bp, Artificial Sequence
  chemically synthesized
gaaaatatgattgttatctcct

SEQ ID NO: 114565 - DNA, 22 bp, Artificial Sequence
  chemically synthesized
ttatctcctgcctttttaaacc

SEQ ID NO: 114566 - DNA, 22 bp, Artificial Sequence
  chemically synthesized
tctcctgcctttttaaacccaa

SEQ ID NO: 114567 - DNA, 22 bp, Artificial Sequence
  chemically synthesized
ctgcctttttaaacccaaccat

SEQ ID NO: 114568 - DNA, 22 bp, Artificial Sequence
  chemically synthesized
cctttttaaacccaaccatcaa

SEQ ID NO: 114569 - DNA, 22 bp, Artificial Sequence
  chemically synthesized
tttaaacccaaccatcaaaatg

SEQ ID NO: 114570 - DNA, 22 bp, Artificial Sequence
  chemically synthesized
ttaaacccaaccatcaaaatgt

SEQ ID NO: 114571 - DNA, 22 bp, Artificial Sequence
  chemically synthesized
taaacccaaccatcaaaatgtg

SEQ ID NO: 114572 - DNA, 22 bp, Artificial Sequence
  chemically synthesized
aaacccaaccatcaaaatgtgt

SEQ ID NO: 114573 - DNA, 22 bp, Artificial Sequence
  chemically synthesized
aacccaaccatcaaaatgtgta

SEQ ID NO: 114574 - DNA, 22 bp, Artificial Sequence
  chemically synthesized
gacatgtcatataaactcattc

SEQ ID NO: 114575 - DNA, 22 bp, Artificial Sequence
  chemically synthesized
acatgtcatataaactcattca

SEQ ID NO: 114576 - DNA, 22 bp, Artificial Sequence
  chemically synthesized
attcagggtcttgcccctgcct

SEQ ID NO: 114577 - DNA, 22 bp, Artificial Sequence
  chemically synthesized
agggtcttgcccctgcctacct

SEQ ID NO: 114578 - DNA, 22 bp, Artificial Sequence
  chemically synthesized
gcccctgcctacctctactgtt

SEQ ID NO: 114579 - DNA, 22 bp, Artificial Sequence
  chemically synthesized
cccctgcctacctctactgttt

SEQ ID NO: 114580 - DNA, 22 bp, Artificial Sequence
  chemically synthesized
cctacctctactgttttattcc

SEQ ID NO: 114581 - DNA, 22 bp, Artificial Sequence
  chemically synthesized
cctctactgttttattccaagg

SEQ ID NO: 114582 - DNA, 22 bp, Artificial Sequence
  chemically synthesized
tactgttttattccaaggtatt

SEQ ID NO: 114583 - DNA, 22 bp, Artificial Sequence
  chemically synthesized
ctgttttattccaaggtattaa

SEQ ID NO: 114584 - DNA, 22 bp, Artificial Sequence
  chemically synthesized
ttttattccaaggtattaactc

SEQ ID NO: 114585 - DNA, 22 bp, Artificial Sequence
  chemically synthesized
tattccaaggtattaactctct

SEQ ID NO: 114586 - DNA, 22 bp, Artificial Sequence
  chemically synthesized
attccaaggtattaactctctt

SEQ ID NO: 114587 - DNA, 22 bp, Artificial Sequence
  chemically synthesized
ttccaaggtattaactctctta

SEQ ID NO: 114588 - DNA, 22 bp, Artificial Sequence
  chemically synthesized
caaggtattaactctcttaaat

SEQ ID NO: 114589 - DNA, 22 bp, Artificial Sequence
  chemically synthesized
actctcttaaatgttatatttg

SEQ ID NO: 114590 - DNA, 22 bp, Artificial Sequence
  chemically synthesized
tcttaaatgttatatttgatca

SEQ ID NO: 114591 - DNA, 22 bp, Artificial Sequence
  chemically synthesized
ttaaatgttatatttgatcacc

SEQ ID NO: 114592 - DNA, 22 bp, Artificial Sequence
  chemically synthesized
aaatgttatatttgatcaccgg

SEQ ID NO: 114593 - DNA, 22 bp, Artificial Sequence
  chemically synthesized
aatgttatatttgatcaccgga

SEQ ID NO: 114594 - DNA, 22 bp, Artificial Sequence
  chemically synthesized
tatttgatcaccggaaaatctt

SEQ ID NO: 114595 - DNA, 22 bp, Artificial Sequence
  chemically synthesized
gatcaccggaaaatcttatagt

SEQ ID NO: 114596 - DNA, 22 bp, Artificial Sequence
  chemically synthesized
atcaccggaaaatcttatagtt

SEQ ID NO: 114597 - DNA, 22 bp, Artificial Sequence
  chemically synthesized
atagttctcaaaacacataaac

SEQ ID NO: 114598 - DNA, 22 bp, Artificial Sequence
  chemically synthesized
tagttctcaaaacacataaaca

SEQ ID NO: 114599 - DNA, 22 bp, Artificial Sequence
  chemically synthesized
tcaaaacacataaacaactttt

SEQ ID NO: 114600 - DNA, 22 bp, Artificial Sequence
  chemically synthesized
aaaacacataaacaacttttcc

SEQ ID NO: 114601 - DNA, 22 bp, Artificial Sequence
  chemically synthesized
ttcctcacctccatgcccttgc

SEQ ID NO: 114602 - DNA, 22 bp, Artificial Sequence
  chemically synthesized
tcctcacctccatgcccttgct

SEQ ID NO: 114603 - DNA, 22 bp, Artificial Sequence
  chemically synthesized
cctcacctccatgcccttgctt

SEQ ID NO: 114604 - DNA, 22 bp, Artificial Sequence
  chemically synthesized
ctcacctccatgcccttgctta

SEQ ID NO: 114605 - DNA, 22 bp, Artificial Sequence
  chemically synthesized
acctccatgcccttgcttacac

SEQ ID NO: 114606 - DNA, 22 bp, Artificial Sequence
  chemically synthesized
catgcccttgcttacactaccc

SEQ ID NO: 114607 - DNA, 22 bp, Artificial Sequence
  chemically synthesized
gcttacactacccctccttttt

SEQ ID NO: 114608 - DNA, 22 bp, Artificial Sequence
  chemically synthesized
cttacactacccctcctttttg

SEQ ID NO: 114609 - DNA, 22 bp, Artificial Sequence
  chemically synthesized
acactacccctcctttttggaa

SEQ ID NO: 114610 - DNA, 22 bp, Artificial Sequence
  chemically synthesized
cactacccctcctttttggaaa

SEQ ID NO: 114611 - DNA, 22 bp, Artificial Sequence
  chemically synthesized
cccctcctttttggaaatacct

SEQ ID NO: 114612 - DNA, 22 bp, Artificial Sequence
  chemically synthesized
ctttttggaaatacctttctat

SEQ ID NO: 114613 - DNA, 22 bp, Artificial Sequence
  chemically synthesized
tttggaaatacctttctataaa

SEQ ID NO: 114614 - DNA, 22 bp, Artificial Sequence
  chemically synthesized
ttggaaatacctttctataaag

SEQ ID NO: 114615 - DNA, 22 bp, Artificial Sequence
  chemically synthesized
tggaaatacctttctataaagc

SEQ ID NO: 114616 - DNA, 22 bp, Artificial Sequence
  chemically synthesized
ggaaatacctttctataaagcc

SEQ ID NO: 114617 - DNA, 22 bp, Artificial Sequence
  chemically synthesized
gaaatacctttctataaagccc

SEQ ID NO: 114618 - DNA, 22 bp, Artificial Sequence
  chemically synthesized
tctataaagccctatctgtggt

SEQ ID NO: 114619 - DNA, 22 bp, Artificial Sequence
  chemically synthesized
ctataaagccctatctgtggtt

SEQ ID NO: 114620 - DNA, 22 bp, Artificial Sequence
  chemically synthesized
tataaagccctatctgtggttg

SEQ ID NO: 114621 - DNA, 22 bp, Artificial Sequence
  chemically synthesized
taaagccctatctgtggttgat

SEQ ID NO: 114622 - DNA, 22 bp, Artificial Sequence
  chemically synthesized
tctgtggttgattcttaattag

SEQ ID NO: 114623 - DNA, 22 bp, Artificial Sequence
  chemically synthesized
tggttgattcttaattagtctt

SEQ ID NO: 114624 - DNA, 22 bp, Artificial Sequence
  chemically synthesized
attcttaattagtcttcatagc

SEQ ID NO: 114625 - DNA, 22 bp, Artificial Sequence
  chemically synthesized
ttaattagtcttcatagctcag

SEQ ID NO: 114626 - DNA, 22 bp, Artificial Sequence
  chemically synthesized
aattagtcttcatagctcaggt

SEQ ID NO: 114627 - DNA, 22 bp, Artificial Sequence
  chemically synthesized
attagtcttcatagctcaggtt

SEQ ID NO: 114628 - DNA, 22 bp, Artificial Sequence
  chemically synthesized
gtcttcatagctcaggttgggg

SEQ ID NO: 114629 - DNA, 22 bp, Artificial Sequence
  chemically synthesized
catagctcaggttggggccttc

SEQ ID NO: 114630 - DNA, 22 bp, Artificial Sequence
  chemically synthesized
atagctcaggttggggccttcc

SEQ ID NO: 114631 - DNA, 22 bp, Artificial Sequence
  chemically synthesized
aggttggggccttccctggccc

SEQ ID NO: 114632 - DNA, 22 bp, Artificial Sequence
  chemically synthesized
gggccttccctggccctcacct

SEQ ID NO: 114633 - DNA, 22 bp, Artificial Sequence
  chemically synthesized
ccctggccctcacctgtgggcc

SEQ ID NO: 114634 - DNA, 22 bp, Artificial Sequence
  chemically synthesized
cctggccctcacctgtgggcca

SEQ ID NO: 114635 - DNA, 22 bp, Artificial Sequence
  chemically synthesized
gccctcacctgtgggccaggtg

SEQ ID NO: 114636 - DNA, 22 bp, Artificial Sequence
  chemically synthesized
acctgtgggccaggtgctaccc

SEQ ID NO: 114637 - DNA, 22 bp, Artificial Sequence
  chemically synthesized
tgggccaggtgctacccacaaa

SEQ ID NO: 114638 - DNA, 22 bp, Artificial Sequence
  chemically synthesized
cccacaaatattaatataattg

SEQ ID NO: 114639 - DNA, 22 bp, Artificial Sequence
  chemically synthesized
atataattgccatgtccatctc

SEQ ID NO: 114640 - DNA, 22 bp, Artificial Sequence
  chemically synthesized
ccatgtccatctcttacattgc

SEQ ID NO: 114641 - DNA, 22 bp, Artificial Sequence
  chemically synthesized
ttacattgcgctaagatagttg

SEQ ID NO: 114642 - DNA, 22 bp, Artificial Sequence
  chemically synthesized
acattgcgctaagatagttgtt

SEQ ID NO: 114643 - DNA, 22 bp, Artificial Sequence
  chemically synthesized
cattgcgctaagatagttgttt

SEQ ID NO: 114644 - DNA, 22 bp, Artificial Sequence
  chemically synthesized
cgctaagatagttgttttccta

SEQ ID NO: 114645 - DNA, 22 bp, Artificial Sequence
  chemically synthesized
agatagttgttttcctatctta

SEQ ID NO: 114646 - DNA, 22 bp, Artificial Sequence
  chemically synthesized
ttttcctatcttatgtgtgata

SEQ ID NO: 114647 - DNA, 22 bp, Artificial Sequence
  chemically synthesized
tcctatcttatgtgtgatagat

SEQ ID NO: 114648 - DNA, 22 bp, Artificial Sequence
  chemically synthesized
cctatcttatgtgtgatagatg

SEQ ID NO: 114649 - DNA, 22 bp, Artificial Sequence
  chemically synthesized
ctatcttatgtgtgatagatgc

SEQ ID NO: 114650 - DNA, 22 bp, Artificial Sequence
  chemically synthesized
tcttatgtgtgatagatgcccc

SEQ ID NO: 114651 - DNA, 22 bp, Artificial Sequence
  chemically synthesized
atgtgtgatagatgcccctgaa

SEQ ID NO: 114652 - DNA, 22 bp, Artificial Sequence
  chemically synthesized
tgtgtgatagatgcccctgaat

SEQ ID NO: 114653 - DNA, 22 bp, Artificial Sequence
  chemically synthesized
aataatagcaatatttgctgtt

SEQ ID NO: 114654 - DNA, 22 bp, Artificial Sequence
  chemically synthesized
gctgttgctggtaataatagca

SEQ ID NO: 114655 - DNA, 22 bp, Artificial Sequence
  chemically synthesized
ctgttgctggtaataatagcag

SEQ ID NO: 114656 - DNA, 22 bp, Artificial Sequence
  chemically synthesized
ttgctggtaataatagcagcat

SEQ ID NO: 114657 - DNA, 22 bp, Artificial Sequence
  chemically synthesized
ctggtaataatagcagcattgt

SEQ ID NO: 114658 - DNA, 22 bp, Artificial Sequence
  chemically synthesized
gtaataatagcagcattgttgc

SEQ ID NO: 114659 - DNA, 22 bp, Artificial Sequence
  chemically synthesized
ttgctgttatactgtccttggc

SEQ ID NO: 114660 - DNA, 22 bp, Artificial Sequence
  chemically synthesized
ctgttatactgtccttggctag

SEQ ID NO: 114661 - DNA, 22 bp, Artificial Sequence
  chemically synthesized
ttatactgtccttggctaggat

SEQ ID NO: 114662 - DNA, 22 bp, Artificial Sequence
  chemically synthesized
tactgtccttggctaggatccc

SEQ ID NO: 114663 - DNA, 22 bp, Artificial Sequence
  chemically synthesized
tccttggctaggatcccagtga

SEQ ID NO: 114664 - DNA, 22 bp, Artificial Sequence
  chemically synthesized
ggctaggatcccagtgaaatag

SEQ ID NO: 114665 - DNA, 22 bp, Artificial Sequence
  chemically synthesized
gctaggatcccagtgaaatagg

SEQ ID NO: 114666 - DNA, 22 bp, Artificial Sequence
  chemically synthesized
ggatcccagtgaaataggctaa

SEQ ID NO: 114667 - DNA, 22 bp, Artificial Sequence
  chemically synthesized
aaatcatgttcttaataaatgc

SEQ ID NO: 114668 - DNA, 22 bp, Artificial Sequence
  chemically synthesized
ttaataaatgcaggattttctg

SEQ ID NO: 114669 - DNA, 22 bp, Artificial Sequence
  chemically synthesized
aataaatgcaggattttctgaa

SEQ ID NO: 114670 - DNA, 22 bp, Artificial Sequence
  chemically synthesized
ataaatgcaggattttctgaaa

SEQ ID NO: 114671 - DNA, 22 bp, Artificial Sequence
  chemically synthesized
tctgaaatttttctggtagtgg

SEQ ID NO: 114672 - DNA, 22 bp, Artificial Sequence
  chemically synthesized
ctgaaatttttctggtagtggt

SEQ ID NO: 114673 - DNA, 22 bp, Artificial Sequence
  chemically synthesized
tgaaatttttctggtagtggtg

SEQ ID NO: 114674 - DNA, 22 bp, Artificial Sequence
  chemically synthesized
aaatttttctggtagtggtgcc

SEQ ID NO: 114675 - DNA, 22 bp, Artificial Sequence
  chemically synthesized
ttctggtagtggtgccctctcc

SEQ ID NO: 114676 - DNA, 22 bp, Artificial Sequence
  chemically synthesized
tctggtagtggtgccctctcct

SEQ ID NO: 114677 - DNA, 22 bp, Artificial Sequence
  chemically synthesized
ctggtagtggtgccctctccta

SEQ ID NO: 114678 - DNA, 22 bp, Artificial Sequence
  chemically synthesized
tggtagtggtgccctctcctac

SEQ ID NO: 114679 - DNA, 22 bp, Artificial Sequence
  chemically synthesized
gtagtggtgccctctcctacaa

SEQ ID NO: 114680 - DNA, 22 bp, Artificial Sequence
  chemically synthesized
tcctacaagcctaaatgaagat

SEQ ID NO: 114681 - DNA, 22 bp, Artificial Sequence
  chemically synthesized
ctacaagcctaaatgaagatgc

SEQ ID NO: 114682 - DNA, 22 bp, Artificial Sequence
  chemically synthesized
caagcctaaatgaagatgctca

SEQ ID NO: 114683 - DNA, 22 bp, Artificial Sequence
  chemically synthesized
aatgaagatgctcagctccttc

SEQ ID NO: 114684 - DNA, 22 bp, Artificial Sequence
  chemically synthesized
agctccttcctattgtaccgaa

SEQ ID NO: 114685 - DNA, 22 bp, Artificial Sequence
  chemically synthesized
cttcctattgtaccgaagccag

SEQ ID NO: 114686 - DNA, 22 bp, Artificial Sequence
  chemically synthesized
cctattgtaccgaagccagaac

SEQ ID NO: 114687 - DNA, 22 bp, Artificial Sequence
  chemically synthesized
ctattgtaccgaagccagaacc

SEQ ID NO: 114688 - DNA, 22 bp, Artificial Sequence
  chemically synthesized
ttgtaccgaagccagaaccttc

SEQ ID NO: 114689 - DNA, 22 bp, Artificial Sequence
  chemically synthesized
taccgaagccagaaccttcctc

SEQ ID NO: 114690 - DNA, 22 bp, Artificial Sequence
  chemically synthesized
cctcataactacaatttaataa

SEQ ID NO: 114691 - DNA, 22 bp, Artificial Sequence
  chemically synthesized
ctcataactacaatttaataag

SEQ ID NO: 114692 - DNA, 22 bp, Artificial Sequence
  chemically synthesized
ataactacaatttaataagaca

SEQ ID NO: 114693 - DNA, 22 bp, Artificial Sequence
  chemically synthesized
caatttaataagacatcctgct

SEQ ID NO: 114694 - DNA, 22 bp, Artificial Sequence
  chemically synthesized
aataagacatcctgctctctgc

SEQ ID NO: 114695 - DNA, 22 bp, Artificial Sequence
  chemically synthesized
ataagacatcctgctctctgca

SEQ ID NO: 114696 - DNA, 22 bp, Artificial Sequence
  chemically synthesized
ctctctgcatcttgtcctatca

SEQ ID NO: 114697 - DNA, 22 bp, Artificial Sequence
  chemically synthesized
tctgcatcttgtcctatcaccc

SEQ ID NO: 114698 - DNA, 22 bp, Artificial Sequence
  chemically synthesized
tgcatcttgtcctatcaccctg

SEQ ID NO: 114699 - DNA, 22 bp, Artificial Sequence
  chemically synthesized
catcttgtcctatcaccctgac

SEQ ID NO: 114700 - DNA, 22 bp, Artificial Sequence
  chemically synthesized
gtcctatcaccctgactctcct

SEQ ID NO: 114701 - DNA, 22 bp, Artificial Sequence
  chemically synthesized
tcctatcaccctgactctccta

SEQ ID NO: 114702 - DNA, 22 bp, Artificial Sequence
  chemically synthesized
tcaccctgactctcctacactc

SEQ ID NO: 114703 - DNA, 22 bp, Artificial Sequence
  chemically synthesized
actctcctacactctggcccta

SEQ ID NO: 114704 - DNA, 22 bp, Artificial Sequence
  chemically synthesized
tcctacactctggccctaacaa

SEQ ID NO: 114705 - DNA, 22 bp, Artificial Sequence
  chemically synthesized
ctacactctggccctaacaacc

SEQ ID NO: 114706 - DNA, 22 bp, Artificial Sequence
  chemically synthesized
cactctggccctaacaaccagt

SEQ ID NO: 114707 - DNA, 22 bp, Artificial Sequence
  chemically synthesized
tggccctaacaaccagttactt

SEQ ID NO: 114708 - DNA, 22 bp, Artificial Sequence
  chemically synthesized
gccctaacaaccagttacttac

SEQ ID NO: 114709 - DNA, 22 bp, Artificial Sequence
  chemically synthesized
acaaccagttacttacccggtg

SEQ ID NO: 114710 - DNA, 22 bp, Artificial Sequence
  chemically synthesized
cttacccggtgtaaggtggtgc

SEQ ID NO: 114711 - DNA, 22 bp, Artificial Sequence
  chemically synthesized
acccggtgtaaggtggtgccac

SEQ ID NO: 114712 - DNA, 22 bp, Artificial Sequence
  chemically synthesized
cccggtgtaaggtggtgccact

SEQ ID NO: 114713 - DNA, 22 bp, Artificial Sequence
  chemically synthesized
ctgtctgggtgtggtctgatca

SEQ ID NO: 114714 - DNA, 22 bp, Artificial Sequence
  chemically synthesized
tgtctgggtgtggtctgatcac

SEQ ID NO: 114715 - DNA, 22 bp, Artificial Sequence
  chemically synthesized
tctgggtgtggtctgatcacaa

SEQ ID NO: 114716 - DNA, 22 bp, Artificial Sequence
  chemically synthesized
ggtgtggtctgatcacaatggc

SEQ ID NO: 114717 - DNA, 22 bp, Artificial Sequence
  chemically synthesized
atcacaatggcatgtcataaac

SEQ ID NO: 114718 - DNA, 22 bp, Artificial Sequence
  chemically synthesized
catgggtctctgtcctggtttt

SEQ ID NO: 114719 - DNA, 22 bp, Artificial Sequence
  chemically synthesized
atgggtctctgtcctggtttta

SEQ ID NO: 114720 - DNA, 22 bp, Artificial Sequence
  chemically synthesized
tgtcctggttttagatctgtat

SEQ ID NO: 114721 - DNA, 22 bp, Artificial Sequence
  chemically synthesized
tcctggttttagatctgtatgc

SEQ ID NO: 114722 - DNA, 22 bp, Artificial Sequence
  chemically synthesized
gttttagatctgtatgccccgt

SEQ ID NO: 114723 - DNA, 22 bp, Artificial Sequence
  chemically synthesized
tagatctgtatgccccgttttg

SEQ ID NO: 114724 - DNA, 22 bp, Artificial Sequence
  chemically synthesized
agatctgtatgccccgttttgg

SEQ ID NO: 114725 - DNA, 22 bp, Artificial Sequence
  chemically synthesized
gatctgtatgccccgttttgga

SEQ ID NO: 114726 - DNA, 22 bp, Artificial Sequence
  chemically synthesized
tatgccccgttttggagctcat

SEQ ID NO: 114727 - DNA, 22 bp, Artificial Sequence
  chemically synthesized
tggagctcatccccacacaact

SEQ ID NO: 114728 - DNA, 22 bp, Artificial Sequence
  chemically synthesized
ggagctcatccccacacaactc

SEQ ID NO: 114729 - DNA, 22 bp, Artificial Sequence
  chemically synthesized
gagctcatccccacacaactct

SEQ ID NO: 114730 - DNA, 22 bp, Artificial Sequence
  chemically synthesized
atccccacacaactctaatcaa

SEQ ID NO: 114731 - DNA, 22 bp, Artificial Sequence
  chemically synthesized
taatcaaccatgccctatttaa

SEQ ID NO: 114732 - DNA, 22 bp, Artificial Sequence
  chemically synthesized
atcaaccatgccctatttaaag

SEQ ID NO: 114733 - DNA, 22 bp, Artificial Sequence
  chemically synthesized
tttaaaggatgtaataccttgc

SEQ ID NO: 114734 - DNA, 22 bp, Artificial Sequence
  chemically synthesized
aaaggatgtaataccttgcttc

SEQ ID NO: 114735 - DNA, 22 bp, Artificial Sequence
  chemically synthesized
aaggatgtaataccttgcttca

SEQ ID NO: 114736 - DNA, 22 bp, Artificial Sequence
  chemically synthesized
gcttcatgccagtctccaagag

SEQ ID NO: 114737 - DNA, 22 bp, Artificial Sequence
  chemically synthesized
cttcatgccagtctccaagagt

SEQ ID NO: 114738 - DNA, 22 bp, Artificial Sequence
  chemically synthesized
catgccagtctccaagagtgtg

SEQ ID NO: 114739 - DNA, 22 bp, Artificial Sequence
  chemically synthesized
atgccagtctccaagagtgtgt

SEQ ID NO: 114740 - DNA, 22 bp, Artificial Sequence
  chemically synthesized
caagagtgtgtgtgtgtttgtg

SEQ ID NO: 114741 - DNA, 22 bp, Artificial Sequence
  chemically synthesized
gtggtggagaggttgtgtgtga

SEQ ID NO: 114742 - DNA, 22 bp, Artificial Sequence
  chemically synthesized
tggtggagaggttgtgtgtgag

SEQ ID NO: 114743 - DNA, 22 bp, Artificial Sequence
  chemically synthesized
tgtgtgagttttgaaagaaaag

SEQ ID NO: 114744 - DNA, 22 bp, Artificial Sequence
  chemically synthesized
tgaaagaaaagagaaatgtaca

SEQ ID NO: 114745 - DNA, 22 bp, Artificial Sequence
  chemically synthesized
gaaagaaaagagaaatgtacac

SEQ ID NO: 114746 - DNA, 22 bp, Artificial Sequence
  chemically synthesized
aaagaaaagagaaatgtacaca

SEQ ID NO: 114747 - DNA, 22 bp, Artificial Sequence
  chemically synthesized
atcacattaactcaggttctgt

SEQ ID NO: 114748 - DNA, 22 bp, Artificial Sequence
  chemically synthesized
actcaggttctgtagcatagtc

SEQ ID NO: 114749 - DNA, 22 bp, Artificial Sequence
  chemically synthesized
aggttctgtagcatagtctggg

SEQ ID NO: 114750 - DNA, 22 bp, Artificial Sequence
  chemically synthesized
tgtagcatagtctggggaagaa

SEQ ID NO: 114751 - DNA, 22 bp, Artificial Sequence
  chemically synthesized
tagcatagtctggggaagaagt

SEQ ID NO: 114752 - DNA, 22 bp, Artificial Sequence
  chemically synthesized
gggaagaagtacaagactattt

SEQ ID NO: 114753 - DNA, 22 bp, Artificial Sequence
  chemically synthesized
tttttttttttctaaatgttga

SEQ ID NO: 114754 - DNA, 22 bp, Artificial Sequence
  chemically synthesized
ttttttttctaaatgttgatgg

SEQ ID NO: 114755 - DNA, 22 bp, Artificial Sequence
  chemically synthesized
tttttttctaaatgttgatggc

SEQ ID NO: 114756 - DNA, 22 bp, Artificial Sequence
  chemically synthesized
ttttttctaaatgttgatggca

SEQ ID NO: 114757 - DNA, 22 bp, Artificial Sequence
  chemically synthesized
tttttctaaatgttgatggcat

SEQ ID NO: 114758 - DNA, 22 bp, Artificial Sequence
  chemically synthesized
ttttctaaatgttgatggcatt

SEQ ID NO: 114759 - DNA, 22 bp, Artificial Sequence
  chemically synthesized
tttctaaatgttgatggcattt

SEQ ID NO: 114760 - DNA, 22 bp, Artificial Sequence
  chemically synthesized
ttctaaatgttgatggcatttg

SEQ ID NO: 114761 - DNA, 22 bp, Artificial Sequence
  chemically synthesized
tctaaatgttgatggcatttgc

SEQ ID NO: 114762 - DNA, 22 bp, Artificial Sequence
  chemically synthesized
ctaaatgttgatggcatttgct

SEQ ID NO: 114763 - DNA, 22 bp, Artificial Sequence
  chemically synthesized
taaatgttgatggcatttgcta

SEQ ID NO: 114764 - DNA, 22 bp, Artificial Sequence
  chemically synthesized
aatgttgatggcatttgctacc

SEQ ID NO: 114765 - DNA, 22 bp, Artificial Sequence
  chemically synthesized
atggcatttgctaccagaaaag

SEQ ID NO: 114766 - DNA, 22 bp, Artificial Sequence
  chemically synthesized
gctaccagaaaagaaggaaaaa

SEQ ID NO: 114767 - DNA, 22 bp, Artificial Sequence
  chemically synthesized
ctaccagaaaagaaggaaaaaa

SEQ ID NO: 114768 - DNA, 22 bp, Artificial Sequence
  chemically synthesized
ccagaaaagaaggaaaaaagtt

SEQ ID NO: 114769 - DNA, 22 bp, Artificial Sequence
  chemically synthesized
tgtaaaggctacttgttgtagg

SEQ ID NO: 114770 - DNA, 22 bp, Artificial Sequence
  chemically synthesized
gtaaaggctacttgttgtaggg

SEQ ID NO: 114771 - DNA, 22 bp, Artificial Sequence
  chemically synthesized
taaaggctacttgttgtagggc

SEQ ID NO: 114772 - DNA, 22 bp, Artificial Sequence
  chemically synthesized
cttgttgtagggctcattgaag

SEQ ID NO: 114773 - DNA, 22 bp, Artificial Sequence
  chemically synthesized
gttgtagggctcattgaaggaa

SEQ ID NO: 114774 - DNA, 22 bp, Artificial Sequence
  chemically synthesized
ttgtagggctcattgaaggaaa

SEQ ID NO: 114775 - DNA, 22 bp, Artificial Sequence
  chemically synthesized
tagggctcattgaaggaaagtc

SEQ ID NO: 114776 - DNA, 22 bp, Artificial Sequence
  chemically synthesized
attgaaggaaagtccagtgcat

SEQ ID NO: 114777 - DNA, 22 bp, Artificial Sequence
  chemically synthesized
aaggaaagtccagtgcattcaa

SEQ ID NO: 114778 - DNA, 22 bp, Artificial Sequence
  chemically synthesized
aaagatgaagtagagagctttg

SEQ ID NO: 114779 - DNA, 22 bp, Artificial Sequence
  chemically synthesized
tgggaaagcctgagacactgac

SEQ ID NO: 114780 - DNA, 22 bp, Artificial Sequence
  chemically synthesized
gggaaagcctgagacactgacc

SEQ ID NO: 114781 - DNA, 22 bp, Artificial Sequence
  chemically synthesized
ggaaagcctgagacactgacct

SEQ ID NO: 114782 - DNA, 22 bp, Artificial Sequence
  chemically synthesized
agacactgacctggacatttgt

SEQ ID NO: 114783 - DNA, 22 bp, Artificial Sequence
  chemically synthesized
acctggacatttgtttggggta

SEQ ID NO: 114784 - DNA, 22 bp, Artificial Sequence
  chemically synthesized
gacatttgtttggggtaggatt

SEQ ID NO: 114785 - DNA, 22 bp, Artificial Sequence
  chemically synthesized
gtttggggtaggattgaatatg

SEQ ID NO: 114786 - DNA, 22 bp, Artificial Sequence
  chemically synthesized
tttggggtaggattgaatatgc

SEQ ID NO: 114787 - DNA, 22 bp, Artificial Sequence
  chemically synthesized
ggggtaggattgaatatgcaag

SEQ ID NO: 114788 - DNA, 22 bp, Artificial Sequence
  chemically synthesized
gggtaggattgaatatgcaaga

SEQ ID NO: 114789 - DNA, 22 bp, Artificial Sequence
  chemically synthesized
aatatgcaagattgacttctag

SEQ ID NO: 114790 - DNA, 22 bp, Artificial Sequence
  chemically synthesized
acttctaggtccaaagatatag

SEQ ID NO: 114791 - DNA, 22 bp, Artificial Sequence
  chemically synthesized
ctaggtccaaagatatagaggc

SEQ ID NO: 114792 - DNA, 22 bp, Artificial Sequence
  chemically synthesized
taggtccaaagatatagaggct

SEQ ID NO: 114793 - DNA, 22 bp, Artificial Sequence
  chemically synthesized
ggtccaaagatatagaggctgg

SEQ ID NO: 114794 - DNA, 22 bp, Artificial Sequence
  chemically synthesized
gcagagatggagggcaatttaa

SEQ ID NO: 114795 - DNA, 22 bp, Artificial Sequence
  chemically synthesized
aattatctgcagtaaatggaaa

SEQ ID NO: 114796 - DNA, 22 bp, Artificial Sequence
  chemically synthesized
attatctgcagtaaatggaaat

SEQ ID NO: 114797 - DNA, 22 bp, Artificial Sequence
  chemically synthesized
tctgcagtaaatggaaatataa

SEQ ID NO: 114798 - DNA, 22 bp, Artificial Sequence
  chemically synthesized
cagtaaatggaaatataaaaat

SEQ ID NO: 114799 - DNA, 22 bp, Artificial Sequence
  chemically synthesized
gaagtagtggtgattgtggtgc

SEQ ID NO: 114800 - DNA, 22 bp, Artificial Sequence
  chemically synthesized
aagtagtggtgattgtggtgct

SEQ ID NO: 114801 - DNA, 22 bp, Artificial Sequence
  chemically synthesized
tggtgcttcaaggcagatgtgc

SEQ ID NO: 114802 - DNA, 22 bp, Artificial Sequence
  chemically synthesized
caaggcagatgtgcaatttaaa

SEQ ID NO: 114803 - DNA, 22 bp, Artificial Sequence
  chemically synthesized
aaggcagatgtgcaatttaaaa

SEQ ID NO: 114804 - DNA, 22 bp, Artificial Sequence
  chemically synthesized
aaaagccactgtgaacatcaca

SEQ ID NO: 114805 - DNA, 22 bp, Artificial Sequence
  chemically synthesized
aaagccactgtgaacatcacat

SEQ ID NO: 114806 - DNA, 22 bp, Artificial Sequence
  chemically synthesized
tgaacatcacatggataatcct

SEQ ID NO: 114807 - DNA, 22 bp, Artificial Sequence
  chemically synthesized
ttcatatactacatccgacctc

SEQ ID NO: 114808 - DNA, 22 bp, Artificial Sequence
  chemically synthesized
catatactacatccgacctctc

SEQ ID NO: 114809 - DNA, 22 bp, Artificial Sequence
  chemically synthesized
atatactacatccgacctctct

SEQ ID NO: 114810 - DNA, 22 bp, Artificial Sequence
  chemically synthesized
catccgacctctctggaaaacg

SEQ ID NO: 114811 - DNA, 22 bp, Artificial Sequence
  chemically synthesized
tctggaaaacgacgggtccatt

SEQ ID NO: 114812 - DNA, 22 bp, Artificial Sequence
  chemically synthesized
tggaaaacgacgggtccattac

SEQ ID NO: 114813 - DNA, 22 bp, Artificial Sequence
  chemically synthesized
gaaaacgacgggtccattacta

SEQ ID NO: 114814 - DNA, 22 bp, Artificial Sequence
  chemically synthesized
ctagtggataacagaagacagt

SEQ ID NO: 114815 - DNA, 22 bp, Artificial Sequence
  chemically synthesized
gtggataacagaagacagtaaa

SEQ ID NO: 114816 - DNA, 22 bp, Artificial Sequence
  chemically synthesized
acttctttatgaaattaaaaat

SEQ ID NO: 114817 - DNA, 22 bp, Artificial Sequence
  chemically synthesized
ctttatgaaattaaaaataaac

SEQ ID NO: 114818 - DNA, 22 bp, Artificial Sequence
  chemically synthesized
tttatgaaattaaaaataaaca

SEQ ID NO: 114819 - DNA, 22 bp, Artificial Sequence
  chemically synthesized
tatgaaattaaaaataaacaga

SEQ ID NO: 114820 - DNA, 22 bp, Artificial Sequence
  chemically synthesized
atgaaattaaaaataaacagat

SEQ ID NO: 114821 - DNA, 22 bp, Artificial Sequence
  chemically synthesized
tgaaattaaaaataaacagata

SEQ ID NO: 114822 - DNA, 22 bp, Artificial Sequence
  chemically synthesized
aaaataaacagataaggcagta

SEQ ID NO: 114823 - DNA, 22 bp, Artificial Sequence
  chemically synthesized
ttgttgcagcagatgtctgtgt

SEQ ID NO: 114824 - DNA, 22 bp, Artificial Sequence
  chemically synthesized
tgttgcagcagatgtctgtgta

SEQ ID NO: 114825 - DNA, 22 bp, Artificial Sequence
  chemically synthesized
gttgcagcagatgtctgtgtag

SEQ ID NO: 114826 - DNA, 22 bp, Artificial Sequence
  chemically synthesized
ttgcagcagatgtctgtgtagc

SEQ ID NO: 114827 - DNA, 22 bp, Artificial Sequence
  chemically synthesized
cagcagatgtctgtgtagccaa

SEQ ID NO: 114828 - DNA, 22 bp, Artificial Sequence
  chemically synthesized
tgtagccaaaacctggggactg

SEQ ID NO: 114829 - DNA, 22 bp, Artificial Sequence
  chemically synthesized
gggactgaatgctaaaaagtta

SEQ ID NO: 114830 - DNA, 22 bp, Artificial Sequence
  chemically synthesized
aatgctaaaaagttagggctct

SEQ ID NO: 114831 - DNA, 22 bp, Artificial Sequence
  chemically synthesized
aaaagttagggctcttcagctt

SEQ ID NO: 114832 - DNA, 22 bp, Artificial Sequence
  chemically synthesized
gggctcttcagcttcaggagac

SEQ ID NO: 114833 - DNA, 22 bp, Artificial Sequence
  chemically synthesized
ttcagcttcaggagacaggggt

SEQ ID NO: 114834 - DNA, 22 bp, Artificial Sequence
  chemically synthesized
cagcttcaggagacaggggtgg

SEQ ID NO: 114835 - DNA, 22 bp, Artificial Sequence
  chemically synthesized
agcttcaggagacaggggtgga

SEQ ID NO: 114836 - DNA, 22 bp, Artificial Sequence
  chemically synthesized
caggagacaggggtggagataa

SEQ ID NO: 114837 - DNA, 22 bp, Artificial Sequence
  chemically synthesized
aggagacaggggtggagataaa

SEQ ID NO: 114838 - DNA, 22 bp, Artificial Sequence
  chemically synthesized
cctgcccataggattcccagcc

SEQ ID NO: 114839 - DNA, 22 bp, Artificial Sequence
  chemically synthesized
ctgcccataggattcccagccc

SEQ ID NO: 114840 - DNA, 22 bp, Artificial Sequence
  chemically synthesized
cccataggattcccagccctgg

SEQ ID NO: 114841 - DNA, 22 bp, Artificial Sequence
  chemically synthesized
ccagccctggggaccctttgtt

SEQ ID NO: 114842 - DNA, 22 bp, Artificial Sequence
  chemically synthesized
gggaccctttgtttaccattaa

SEQ ID NO: 114843 - DNA, 22 bp, Artificial Sequence
  chemically synthesized
tgtttaccattaagttctccca

SEQ ID NO: 114844 - DNA, 22 bp, Artificial Sequence
  chemically synthesized
gtttaccattaagttctcccag

SEQ ID NO: 114845 - DNA, 22 bp, Artificial Sequence
  chemically synthesized
tttaccattaagttctcccagc

SEQ ID NO: 114846 - DNA, 22 bp, Artificial Sequence
  chemically synthesized
accattaagttctcccagctgg

SEQ ID NO: 114847 - DNA, 22 bp, Artificial Sequence
  chemically synthesized
ccattaagttctcccagctgga

SEQ ID NO: 114848 - DNA, 22 bp, Artificial Sequence
  chemically synthesized
agttctcccagctggagccatg

SEQ ID NO: 114849 - DNA, 22 bp, Artificial Sequence
  chemically synthesized
tcccagctggagccatggtctt

SEQ ID NO: 114850 - DNA, 22 bp, Artificial Sequence
  chemically synthesized
ccagctggagccatggtcttta

SEQ ID NO: 114851 - DNA, 22 bp, Artificial Sequence
  chemically synthesized
gagccatggtctttaggaggat

SEQ ID NO: 114852 - DNA, 22 bp, Artificial Sequence
  chemically synthesized
taggaggataaatccttctgtg

SEQ ID NO: 114853 - DNA, 22 bp, Artificial Sequence
  chemically synthesized
aggaggataaatccttctgtga

SEQ ID NO: 114854 - DNA, 22 bp, Artificial Sequence
  chemically synthesized
ggaggataaatccttctgtgac

SEQ ID NO: 114855 - DNA, 22 bp, Artificial Sequence
  chemically synthesized
ctgtgacagccacagccttgtg

SEQ ID NO: 114856 - DNA, 22 bp, Artificial Sequence
  chemically synthesized
tgtgacagccacagccttgtgc

SEQ ID NO: 114857 - DNA, 22 bp, Artificial Sequence
  chemically synthesized
tgacagccacagccttgtgcct

SEQ ID NO: 114858 - DNA, 22 bp, Artificial Sequence
  chemically synthesized
gtgcctctcagtgacccttgtg

SEQ ID NO: 114859 - DNA, 22 bp, Artificial Sequence
  chemically synthesized
tgcctctcagtgacccttgtgt

SEQ ID NO: 114860 - DNA, 22 bp, Artificial Sequence
  chemically synthesized
tcagtgacccttgtgtcatcct

SEQ ID NO: 114861 - DNA, 22 bp, Artificial Sequence
  chemically synthesized
agtgacccttgtgtcatcctta

SEQ ID NO: 114862 - DNA, 22 bp, Artificial Sequence
  chemically synthesized
gtgtcatccttatctatactct

SEQ ID NO: 114863 - DNA, 22 bp, Artificial Sequence
  chemically synthesized
tgtcatccttatctatactctt

SEQ ID NO: 114864 - DNA, 22 bp, Artificial Sequence
  chemically synthesized
atctatactcttctttcttcct

SEQ ID NO: 114865 - DNA, 22 bp, Artificial Sequence
  chemically synthesized
tctatactcttctttcttcctt

SEQ ID NO: 114866 - DNA, 22 bp, Artificial Sequence
  chemically synthesized
tactcttctttcttcctttgga

SEQ ID NO: 114867 - DNA, 22 bp, Artificial Sequence
  chemically synthesized
ttctttcttcctttggaaccta

SEQ ID NO: 114868 - DNA, 22 bp, Artificial Sequence
  chemically synthesized
ctttcttcctttggaacctact

SEQ ID NO: 114869 - DNA, 22 bp, Artificial Sequence
  chemically synthesized
tttcttcctttggaacctactc

SEQ ID NO: 114870 - DNA, 22 bp, Artificial Sequence
  chemically synthesized
tcttcctttggaacctactcat

SEQ ID NO: 114871 - DNA, 22 bp, Artificial Sequence
  chemically synthesized
cttcctttggaacctactcatt

SEQ ID NO: 114872 - DNA, 22 bp, Artificial Sequence
  chemically synthesized
ttcctttggaacctactcattg

SEQ ID NO: 114873 - DNA, 22 bp, Artificial Sequence
  chemically synthesized
cctttggaacctactcattggc

SEQ ID NO: 114874 - DNA, 22 bp, Artificial Sequence
  chemically synthesized
ctttggaacctactcattggct

SEQ ID NO: 114875 - DNA, 22 bp, Artificial Sequence
  chemically synthesized
tggaacctactcattggcttca

SEQ ID NO: 114876 - DNA, 22 bp, Artificial Sequence
  chemically synthesized
ggaacctactcattggcttcac

SEQ ID NO: 114877 - DNA, 22 bp, Artificial Sequence
  chemically synthesized
gaacctactcattggcttcaca

SEQ ID NO: 114878 - DNA, 22 bp, Artificial Sequence
  chemically synthesized
ctcattggcttcacatttttgt

SEQ ID NO: 114879 - DNA, 22 bp, Artificial Sequence
  chemically synthesized
attggcttcacatttttgttat

SEQ ID NO: 114880 - DNA, 22 bp, Artificial Sequence
  chemically synthesized
gcttcacatttttgttattacc

SEQ ID NO: 114881 - DNA, 22 bp, Artificial Sequence
  chemically synthesized
cacatttttgttattacctgct

SEQ ID NO: 114882 - DNA, 22 bp, Artificial Sequence
  chemically synthesized
acatttttgttattacctgctg

SEQ ID NO: 114883 - DNA, 22 bp, Artificial Sequence
  chemically synthesized
ttgttattacctgctggtgagt

SEQ ID NO: 114884 - DNA, 22 bp, Artificial Sequence
  chemically synthesized
tgttattacctgctggtgagtc

SEQ ID NO: 114885 - DNA, 22 bp, Artificial Sequence
  chemically synthesized
gttattacctgctggtgagtct

SEQ ID NO: 114886 - DNA, 22 bp, Artificial Sequence
  chemically synthesized
ttattacctgctggtgagtctc

SEQ ID NO: 114887 - DNA, 22 bp, Artificial Sequence
  chemically synthesized
ttacctgctggtgagtctcact

SEQ ID NO: 114888 - DNA, 22 bp, Artificial Sequence
  chemically synthesized
cctgctggtgagtctcactact

SEQ ID NO: 114889 - DNA, 22 bp, Artificial Sequence
  chemically synthesized
ctggtgagtctcactactgtct

SEQ ID NO: 114890 - DNA, 22 bp, Artificial Sequence
  chemically synthesized
gtgagtctcactactgtcttgt

SEQ ID NO: 114891 - DNA, 22 bp, Artificial Sequence
  chemically synthesized
actactgtcttgtgccggggtt

SEQ ID NO: 114892 - DNA, 22 bp, Artificial Sequence
  chemically synthesized
ctgtcttgtgccggggtttcag

SEQ ID NO: 114893 - DNA, 22 bp, Artificial Sequence
  chemically synthesized
tcttgtgccggggtttcaggag

SEQ ID NO: 114894 - DNA, 22 bp, Artificial Sequence
  chemically synthesized
gtgccggggtttcaggagtggg

SEQ ID NO: 114895 - DNA, 22 bp, Artificial Sequence
  chemically synthesized
tgccggggtttcaggagtgggt

SEQ ID NO: 114896 - DNA, 22 bp, Artificial Sequence
  chemically synthesized
caggagtgggtaattaggggga

SEQ ID NO: 114897 - DNA, 22 bp, Artificial Sequence
  chemically synthesized
aggagtgggtaattagggggac

SEQ ID NO: 114898 - DNA, 22 bp, Artificial Sequence
  chemically synthesized
gggggacatgggagagaggagg

SEQ ID NO: 114899 - DNA, 22 bp, Artificial Sequence
  chemically synthesized
agttacaattaaggcttttccc

SEQ ID NO: 114900 - DNA, 22 bp, Artificial Sequence
  chemically synthesized
caattaaggcttttcccccaaa

SEQ ID NO: 114901 - DNA, 22 bp, Artificial Sequence
  chemically synthesized
aggcttttcccccaaatgtttg

SEQ ID NO: 114902 - DNA, 22 bp, Artificial Sequence
  chemically synthesized
ttcccccaaatgtttgaatgtc

SEQ ID NO: 114903 - DNA, 22 bp, Artificial Sequence
  chemically synthesized
tcccccaaatgtttgaatgtcc

SEQ ID NO: 114904 - DNA, 22 bp, Artificial Sequence
  chemically synthesized
cccccaaatgtttgaatgtcct

SEQ ID NO: 114905 - DNA, 22 bp, Artificial Sequence
  chemically synthesized
ccccaaatgtttgaatgtcctt

SEQ ID NO: 114906 - DNA, 22 bp, Artificial Sequence
  chemically synthesized
gaatgtccttagccaaatggat

SEQ ID NO: 114907 - DNA, 22 bp, Artificial Sequence
  chemically synthesized
aatgtccttagccaaatggatt

SEQ ID NO: 114908 - DNA, 22 bp, Artificial Sequence
  chemically synthesized
agccaaatggattccccacatt

SEQ ID NO: 114909 - DNA, 22 bp, Artificial Sequence
  chemically synthesized
gccaaatggattccccacattc

SEQ ID NO: 114910 - DNA, 22 bp, Artificial Sequence
  chemically synthesized
cccacattccctgcactaagcc

SEQ ID NO: 114911 - DNA, 22 bp, Artificial Sequence
  chemically synthesized
cctgcactaagcctaatgggat

SEQ ID NO: 114912 - DNA, 22 bp, Artificial Sequence
  chemically synthesized
cactaagcctaatgggattttt

SEQ ID NO: 114913 - DNA, 22 bp, Artificial Sequence
  chemically synthesized
agcctaatgggatttttttttc

SEQ ID NO: 114914 - DNA, 22 bp, Artificial Sequence
  chemically synthesized
atgggatttttttttctttgtt

SEQ ID NO: 114915 - DNA, 22 bp, Artificial Sequence
  chemically synthesized
ttttttctttgttttcttttgt

SEQ ID NO: 114916 - DNA, 22 bp, Artificial Sequence
  chemically synthesized
tttttctttgttttcttttgtt

SEQ ID NO: 114917 - DNA, 22 bp, Artificial Sequence
  chemically synthesized
ttttctttgttttcttttgttg

SEQ ID NO: 114918 - DNA, 22 bp, Artificial Sequence
  chemically synthesized
tttctttgttttcttttgttgt

SEQ ID NO: 114919 - DNA, 22 bp, Artificial Sequence
  chemically synthesized
ttctttgttttcttttgttgtt

SEQ ID NO: 114920 - DNA, 22 bp, Artificial Sequence
  chemically synthesized
tctttgttttcttttgttgttg

SEQ ID NO: 114921 - DNA, 22 bp, Artificial Sequence
  chemically synthesized
ctttgttttcttttgttgttgt

SEQ ID NO: 114922 - DNA, 22 bp, Artificial Sequence
  chemically synthesized
tttgttttcttttgttgttgtt

SEQ ID NO: 114923 - DNA, 22 bp, Artificial Sequence
  chemically synthesized
tgttttcttttgttgttgtttc

SEQ ID NO: 114924 - DNA, 22 bp, Artificial Sequence
  chemically synthesized
gttttcttttgttgttgtttct

SEQ ID NO: 114925 - DNA, 22 bp, Artificial Sequence
  chemically synthesized
ttttcttttgttgttgtttctt

SEQ ID NO: 114926 - DNA, 22 bp, Artificial Sequence
  chemically synthesized
tcttttgttgttgtttctttgt

SEQ ID NO: 114927 - DNA, 22 bp, Artificial Sequence
  chemically synthesized
cttttgttgttgtttctttgtt

SEQ ID NO: 114928 - DNA, 22 bp, Artificial Sequence
  chemically synthesized
ttttgttgttgtttctttgttt

SEQ ID NO: 114929 - DNA, 22 bp, Artificial Sequence
  chemically synthesized
ttgttgttgtttctttgtttgt

SEQ ID NO: 114930 - DNA, 22 bp, Artificial Sequence
  chemically synthesized
tgttgttgtttctttgtttgtt

SEQ ID NO: 114931 - DNA, 22 bp, Artificial Sequence
  chemically synthesized
gttgttgtttctttgtttgttg

SEQ ID NO: 114932 - DNA, 22 bp, Artificial Sequence
  chemically synthesized
ttgttgtttctttgtttgttgt

SEQ ID NO: 114933 - DNA, 22 bp, Artificial Sequence
  chemically synthesized
ttgtttctttgtttgttgtttt

SEQ ID NO: 114934 - DNA, 22 bp, Artificial Sequence
  chemically synthesized
tttctttgtttgttgtttttag

SEQ ID NO: 114935 - DNA, 22 bp, Artificial Sequence
  chemically synthesized
ctttgtttgttgtttttagaaa

SEQ ID NO: 114936 - DNA, 22 bp, Artificial Sequence
  chemically synthesized
tttgtttgttgtttttagaaat

SEQ ID NO: 114937 - DNA, 22 bp, Artificial Sequence
  chemically synthesized
tgtttgttgtttttagaaatga

SEQ ID NO: 114938 - DNA, 22 bp, Artificial Sequence
  chemically synthesized
gtttgttgtttttagaaatgag

SEQ ID NO: 114939 - DNA, 22 bp, Artificial Sequence
  chemically synthesized
tttgttgtttttagaaatgagg

SEQ ID NO: 114940 - DNA, 22 bp, Artificial Sequence
  chemically synthesized
gttgtttttagaaatgaggtct

SEQ ID NO: 114941 - DNA, 22 bp, Artificial Sequence
  chemically synthesized
ttgtttttagaaatgaggtcta

SEQ ID NO: 114942 - DNA, 22 bp, Artificial Sequence
  chemically synthesized
tttttagaaatgaggtctagct

SEQ ID NO: 114943 - DNA, 22 bp, Artificial Sequence
  chemically synthesized
ttagaaatgaggtctagctctg

SEQ ID NO: 114944 - DNA, 22 bp, Artificial Sequence
  chemically synthesized
tagaaatgaggtctagctctgt

SEQ ID NO: 114945 - DNA, 22 bp, Artificial Sequence
  chemically synthesized
agaaatgaggtctagctctgtt

SEQ ID NO: 114946 - DNA, 22 bp, Artificial Sequence
  chemically synthesized
gaaatgaggtctagctctgtta

SEQ ID NO: 114947 - DNA, 22 bp, Artificial Sequence
  chemically synthesized
gctctgttacccaggctacagt

SEQ ID NO: 114948 - DNA, 22 bp, Artificial Sequence
  chemically synthesized
tgttacccaggctacagtgcag

SEQ ID NO: 114949 - DNA, 22 bp, Artificial Sequence
  chemically synthesized
ttacccaggctacagtgcagtg

SEQ ID NO: 114950 - DNA, 22 bp, Artificial Sequence
  chemically synthesized
cccaggctacagtgcagtggtg

SEQ ID NO: 114951 - DNA, 22 bp, Artificial Sequence
  chemically synthesized
cagtgcagtggtgtaatcatag

SEQ ID NO: 114952 - DNA, 22 bp, Artificial Sequence
  chemically synthesized
actgtaaactcaaaccggattc

SEQ ID NO: 114953 - DNA, 22 bp, Artificial Sequence
  chemically synthesized
taaactcaaaccggattcaagc

SEQ ID NO: 114954 - DNA, 22 bp, Artificial Sequence
  chemically synthesized
aaaccggattcaagcaatcctc

SEQ ID NO: 114955 - DNA, 22 bp, Artificial Sequence
  chemically synthesized
aagcaatcctcccaccttattc

SEQ ID NO: 114956 - DNA, 22 bp, Artificial Sequence
  chemically synthesized
ccaccttattcttccaagttgc

SEQ ID NO: 114957 - DNA, 22 bp, Artificial Sequence
  chemically synthesized
attcttccaagttgccaggatt

SEQ ID NO: 114958 - DNA, 22 bp, Artificial Sequence
  chemically synthesized
ttcttccaagttgccaggatta

SEQ ID NO: 114959 - DNA, 22 bp, Artificial Sequence
  chemically synthesized
ttccaagttgccaggattataa

SEQ ID NO: 114960 - DNA, 22 bp, Artificial Sequence
  chemically synthesized
ccaagttgccaggattataagt

SEQ ID NO: 114961 - DNA, 22 bp, Artificial Sequence
  chemically synthesized
caagttgccaggattataagtg

SEQ ID NO: 114962 - DNA, 22 bp, Artificial Sequence
  chemically synthesized
ccaggattataagtgtgaacca

SEQ ID NO: 114963 - DNA, 22 bp, Artificial Sequence
  chemically synthesized
taagtgtgaaccaccatataca

SEQ ID NO: 114964 - DNA, 22 bp, Artificial Sequence
  chemically synthesized
ggccttagatttttcacttgga

SEQ ID NO: 114965 - DNA, 22 bp, Artificial Sequence
  chemically synthesized
agatttttcacttggaaaatga

SEQ ID NO: 114966 - DNA, 22 bp, Artificial Sequence
  chemically synthesized
gatttttcacttggaaaatgaa

SEQ ID NO: 114967 - DNA, 22 bp, Artificial Sequence
  chemically synthesized
ttcacttggaaaatgaagtctt

SEQ ID NO: 114968 - DNA, 22 bp, Artificial Sequence
  chemically synthesized
tcacttggaaaatgaagtctta

SEQ ID NO: 114969 - DNA, 22 bp, Artificial Sequence
  chemically synthesized
cacttggaaaatgaagtcttag

SEQ ID NO: 114970 - DNA, 22 bp, Artificial Sequence
  chemically synthesized
acttggaaaatgaagtcttaga

SEQ ID NO: 114971 - DNA, 22 bp, Artificial Sequence
  chemically synthesized
ggaaaatgaagtcttagaaacc

SEQ ID NO: 114972 - DNA, 22 bp, Artificial Sequence
  chemically synthesized
gaaaatgaagtcttagaaacca

SEQ ID NO: 114973 - DNA, 22 bp, Artificial Sequence
  chemically synthesized
agaaaccagggttctcacagaa

SEQ ID NO: 114974 - DNA, 22 bp, Artificial Sequence
  chemically synthesized
gaaaccagggttctcacagaat

SEQ ID NO: 114975 - DNA, 22 bp, Artificial Sequence
  chemically synthesized
tcacagaatctcttctgatatt

SEQ ID NO: 114976 - DNA, 22 bp, Artificial Sequence
  chemically synthesized
acagaatctcttctgatattct

SEQ ID NO: 114977 - DNA, 22 bp, Artificial Sequence
  chemically synthesized
ttctgatattctcagagtctat

SEQ ID NO: 114978 - DNA, 22 bp, Artificial Sequence
  chemically synthesized
ctgatattctcagagtctatgc

SEQ ID NO: 114979 - DNA, 22 bp, Artificial Sequence
  chemically synthesized
tgatattctcagagtctatgca

SEQ ID NO: 114980 - DNA, 22 bp, Artificial Sequence
  chemically synthesized
atattctcagagtctatgcaca

SEQ ID NO: 114981 - DNA, 22 bp, Artificial Sequence
  chemically synthesized
tcagagtctatgcacagaacca

SEQ ID NO: 114982 - DNA, 22 bp, Artificial Sequence
  chemically synthesized
agagtctatgcacagaaccaga

SEQ ID NO: 114983 - DNA, 22 bp, Artificial Sequence
  chemically synthesized
tgcacagaaccagagccagaga

SEQ ID NO: 114984 - DNA, 22 bp, Artificial Sequence
  chemically synthesized
ctcttgctggaaaagaggcgag

SEQ ID NO: 114985 - DNA, 22 bp, Artificial Sequence
  chemically synthesized
tcttgctggaaaagaggcgagc

SEQ ID NO: 114986 - DNA, 22 bp, Artificial Sequence
  chemically synthesized
ttgctggaaaagaggcgagctc

SEQ ID NO: 114987 - DNA, 22 bp, Artificial Sequence
  chemically synthesized
gctggaaaagaggcgagctcat

SEQ ID NO: 114988 - DNA, 22 bp, Artificial Sequence
  chemically synthesized
ctggaaaagaggcgagctcatc

SEQ ID NO: 114989 - DNA, 22 bp, Artificial Sequence
  chemically synthesized
gaaaagaggcgagctcatctgc

SEQ ID NO: 114990 - DNA, 22 bp, Artificial Sequence
  chemically synthesized
atctgcagtattctgttaggaa

SEQ ID NO: 114991 - DNA, 22 bp, Artificial Sequence
  chemically synthesized
cagtattctgttaggaaggcca

SEQ ID NO: 114992 - DNA, 22 bp, Artificial Sequence
  chemically synthesized
tgttaggaaggccaggaggcag

SEQ ID NO: 114993 - DNA, 22 bp, Artificial Sequence
  chemically synthesized
ttaggaaggccaggaggcaggg

SEQ ID NO: 114994 - DNA, 22 bp, Artificial Sequence
  chemically synthesized
ggaaggccaggaggcagggctg

SEQ ID NO: 114995 - DNA, 22 bp, Artificial Sequence
  chemically synthesized
cctcactcccctgatgagtgcc

SEQ ID NO: 114996 - DNA, 22 bp, Artificial Sequence
  chemically synthesized
actcccctgatgagtgcctgca

SEQ ID NO: 114997 - DNA, 22 bp, Artificial Sequence
  chemically synthesized
ccctgatgagtgcctgcatggc

SEQ ID NO: 114998 - DNA, 22 bp, Artificial Sequence
  chemically synthesized
atgagtgcctgcatggccaggc

SEQ ID NO: 114999 - DNA, 22 bp, Artificial Sequence
  chemically synthesized
catggccaggccagcccctccc

SEQ ID NO: 115000 - DNA, 22 bp, Artificial Sequence
  chemically synthesized
cctggatcatgtctagaagtca

SEQ ID NO: 115001 - DNA, 22 bp, Artificial Sequence
  chemically synthesized
gatcatgtctagaagtcaggat

SEQ ID NO: 115002 - DNA, 22 bp, Artificial Sequence
  chemically synthesized
gaagtcaggatggcagaagccc

SEQ ID NO: 115003 - DNA, 22 bp, Artificial Sequence
  chemically synthesized
tggtctctatactctttcctgc

SEQ ID NO: 115004 - DNA, 22 bp, Artificial Sequence
  chemically synthesized
gtctctatactctttcctgccg

SEQ ID NO: 115005 - DNA, 22 bp, Artificial Sequence
  chemically synthesized
tatactctttcctgccgagcca

SEQ ID NO: 115006 - DNA, 22 bp, Artificial Sequence
  chemically synthesized
tactctttcctgccgagccatc

SEQ ID NO: 115007 - DNA, 22 bp, Artificial Sequence
  chemically synthesized
tttcctgccgagccatctggta

SEQ ID NO: 115008 - DNA, 22 bp, Artificial Sequence
  chemically synthesized
tcctgccgagccatctggtata

SEQ ID NO: 115009 - DNA, 22 bp, Artificial Sequence
  chemically synthesized
cctgccgagccatctggtatac

SEQ ID NO: 115010 - DNA, 22 bp, Artificial Sequence
  chemically synthesized
ctgccgagccatctggtataca

SEQ ID NO: 115011 - DNA, 22 bp, Artificial Sequence
  chemically synthesized
ccgagccatctggtatacacac

SEQ ID NO: 115012 - DNA, 22 bp, Artificial Sequence
  chemically synthesized
gtatacacaccctctccttact

SEQ ID NO: 115013 - DNA, 22 bp, Artificial Sequence
  chemically synthesized
tccttactctcatcagaaaaac

SEQ ID NO: 115014 - DNA, 22 bp, Artificial Sequence
  chemically synthesized
cttactctcatcagaaaaacag

SEQ ID NO: 115015 - DNA, 22 bp, Artificial Sequence
  chemically synthesized
actctcatcagaaaaacagtca

SEQ ID NO: 115016 - DNA, 22 bp, Artificial Sequence
  chemically synthesized
ctctcatcagaaaaacagtcat

SEQ ID NO: 115017 - DNA, 22 bp, Artificial Sequence
  chemically synthesized
tcatcagaaaaacagtcattca

SEQ ID NO: 115018 - DNA, 22 bp, Artificial Sequence
  chemically synthesized
atcagaaaaacagtcattcact

SEQ ID NO: 115019 - DNA, 22 bp, Artificial Sequence
  chemically synthesized
acttattcaacaaattattaaa

SEQ ID NO: 115020 - DNA, 22 bp, Artificial Sequence
  chemically synthesized
attcaacaaattattaaatgca

SEQ ID NO: 115021 - DNA, 22 bp, Artificial Sequence
  chemically synthesized
ttcaacaaattattaaatgcat

SEQ ID NO: 115022 - DNA, 22 bp, Artificial Sequence
  chemically synthesized
aacaaattattaaatgcatttt

SEQ ID NO: 115023 - DNA, 22 bp, Artificial Sequence
  chemically synthesized
ttaaatgcattttatatgctgg

SEQ ID NO: 115024 - DNA, 22 bp, Artificial Sequence
  chemically synthesized
aatgcattttatatgctggtcc

SEQ ID NO: 115025 - DNA, 22 bp, Artificial Sequence
  chemically synthesized
tatatgctggtccagttaacat

SEQ ID NO: 115026 - DNA, 22 bp, Artificial Sequence
  chemically synthesized
atatgctggtccagttaacata

SEQ ID NO: 115027 - DNA, 22 bp, Artificial Sequence
  chemically synthesized
tatgctggtccagttaacatag

SEQ ID NO: 115028 - DNA, 22 bp, Artificial Sequence
  chemically synthesized
gtccagttaacatagaaaagac

SEQ ID NO: 115029 - DNA, 22 bp, Artificial Sequence
  chemically synthesized
acatagaaaagaccccatcctc

SEQ ID NO: 115030 - DNA, 22 bp, Artificial Sequence
  chemically synthesized
aatctgcttattttaatccaaa

SEQ ID NO: 115031 - DNA, 22 bp, Artificial Sequence
  chemically synthesized
cttattttaatccaaacaacac

SEQ ID NO: 115032 - DNA, 22 bp, Artificial Sequence
  chemically synthesized
attttaatccaaacaacacctt

SEQ ID NO: 115033 - DNA, 22 bp, Artificial Sequence
  chemically synthesized
ttttaatccaaacaacaccttg

SEQ ID NO: 115034 - DNA, 22 bp, Artificial Sequence
  chemically synthesized
taatccaaacaacaccttgtaa

SEQ ID NO: 115035 - DNA, 22 bp, Artificial Sequence
  chemically synthesized
aatccaaacaacaccttgtaac

SEQ ID NO: 115036 - DNA, 22 bp, Artificial Sequence
  chemically synthesized
atccaaacaacaccttgtaact

SEQ ID NO: 115037 - DNA, 22 bp, Artificial Sequence
  chemically synthesized
gtaacttccccagtatccagga

SEQ ID NO: 115038 - DNA, 22 bp, Artificial Sequence
  chemically synthesized
taacttccccagtatccaggat

SEQ ID NO: 115039 - DNA, 22 bp, Artificial Sequence
  chemically synthesized
ccccagtatccaggatatggcc

SEQ ID NO: 115040 - DNA, 22 bp, Artificial Sequence
  chemically synthesized
cccagtatccaggatatggcct

SEQ ID NO: 115041 - DNA, 22 bp, Artificial Sequence
  chemically synthesized
cgccttccaaaatcctcctcta

SEQ ID NO: 115042 - DNA, 22 bp, Artificial Sequence
  chemically synthesized
gccttccaaaatcctcctctat

SEQ ID NO: 115043 - DNA, 22 bp, Artificial Sequence
  chemically synthesized
ccaaaatcctcctctatcctac

SEQ ID NO: 115044 - DNA, 22 bp, Artificial Sequence
  chemically synthesized
caaaatcctcctctatcctact

SEQ ID NO: 115045 - DNA, 22 bp, Artificial Sequence
  chemically synthesized
ctctatcctactaaaaacaggc

SEQ ID NO: 115046 - DNA, 22 bp, Artificial Sequence
  chemically synthesized
tatcctactaaaaacaggcatg

SEQ ID NO: 115047 - DNA, 22 bp, Artificial Sequence
  chemically synthesized
tcctactaaaaacaggcatgtt

SEQ ID NO: 115048 - DNA, 22 bp, Artificial Sequence
  chemically synthesized
ctaaaaacaggcatgtttacag

SEQ ID NO: 115049 - DNA, 22 bp, Artificial Sequence
  chemically synthesized
aaaacaggcatgtttacagatg

SEQ ID NO: 115050 - DNA, 22 bp, Artificial Sequence
  chemically synthesized
acagatgagtttgaccactgtg

SEQ ID NO: 115051 - DNA, 22 bp, Artificial Sequence
  chemically synthesized
cagatgagtttgaccactgtgg

SEQ ID NO: 115052 - DNA, 22 bp, Artificial Sequence
  chemically synthesized
gaccactgtggaaatgttctct

SEQ ID NO: 115053 - DNA, 22 bp, Artificial Sequence
  chemically synthesized
accactgtggaaatgttctcta

SEQ ID NO: 115054 - DNA, 22 bp, Artificial Sequence
  chemically synthesized
tggaaatgttctctaggggttc

SEQ ID NO: 115055 - DNA, 22 bp, Artificial Sequence
  chemically synthesized
tctaggggttcaaaaatgaata

SEQ ID NO: 115056 - DNA, 22 bp, Artificial Sequence
  chemically synthesized
taggggttcaaaaatgaataat

SEQ ID NO: 115057 - DNA, 22 bp, Artificial Sequence
  chemically synthesized
ggggttcaaaaatgaataatct

SEQ ID NO: 115058 - DNA, 22 bp, Artificial Sequence
  chemically synthesized
aaaaatgaataatctggttcaa

SEQ ID NO: 115059 - DNA, 22 bp, Artificial Sequence
  chemically synthesized
gttcaagtccttgtgtttaggt

SEQ ID NO: 115060 - DNA, 22 bp, Artificial Sequence
  chemically synthesized
aagtccttgtgtttaggtgcag

SEQ ID NO: 115061 - DNA, 22 bp, Artificial Sequence
  chemically synthesized
gtgtttaggtgcagcgtctttt

SEQ ID NO: 115062 - DNA, 22 bp, Artificial Sequence
  chemically synthesized
tgtttaggtgcagcgtcttttg

SEQ ID NO: 115063 - DNA, 22 bp, Artificial Sequence
  chemically synthesized
aggtgcagcgtcttttgcatat

SEQ ID NO: 115064 - DNA, 22 bp, Artificial Sequence
  chemically synthesized
ggtgcagcgtcttttgcatatt

SEQ ID NO: 115065 - DNA, 22 bp, Artificial Sequence
  chemically synthesized
ttgcatattctcctatttacaa

SEQ ID NO: 115066 - DNA, 22 bp, Artificial Sequence
  chemically synthesized
tgcatattctcctatttacaag

SEQ ID NO: 115067 - DNA, 22 bp, Artificial Sequence
  chemically synthesized
gcatattctcctatttacaaga

SEQ ID NO: 115068 - DNA, 22 bp, Artificial Sequence
  chemically synthesized
catattctcctatttacaagaa

SEQ ID NO: 115069 - DNA, 22 bp, Artificial Sequence
  chemically synthesized
tcctatttacaagaaacagtat

SEQ ID NO: 115070 - DNA, 22 bp, Artificial Sequence
  chemically synthesized
ctatttacaagaaacagtatcc

SEQ ID NO: 115071 - DNA, 22 bp, Artificial Sequence
  chemically synthesized
tttacaagaaacagtatcctcc

SEQ ID NO: 115072 - DNA, 22 bp, Artificial Sequence
  chemically synthesized
acaagaaacagtatcctccacc

SEQ ID NO: 115073 - DNA, 22 bp, Artificial Sequence
  chemically synthesized
caagaaacagtatcctccacca

SEQ ID NO: 115074 - DNA, 22 bp, Artificial Sequence
  chemically synthesized
caccaatgtagttcattaaaaa

SEQ ID NO: 115075 - DNA, 22 bp, Artificial Sequence
  chemically synthesized
attaaaaaataactaatattaa

SEQ ID NO: 115076 - DNA, 22 bp, Artificial Sequence
  chemically synthesized
aaaaataactaatattaaattc

SEQ ID NO: 115077 - DNA, 22 bp, Artificial Sequence
  chemically synthesized
atattaaattcaaacaaaagaa

SEQ ID NO: 115078 - DNA, 22 bp, Artificial Sequence
  chemically synthesized
aattcaaacaaaagaatattta

SEQ ID NO: 115079 - DNA, 22 bp, Artificial Sequence
  chemically synthesized
aaacaaaagaatatttagacac

SEQ ID NO: 115080 - DNA, 22 bp, Artificial Sequence
  chemically synthesized
agacacaggtgaggtagagagc

SEQ ID NO: 115081 - DNA, 22 bp, Artificial Sequence
  chemically synthesized
gacacaggtgaggtagagagcc

SEQ ID NO: 115082 - DNA, 22 bp, Artificial Sequence
  chemically synthesized
ctcattgtatactgaaaatctc

SEQ ID NO: 115083 - DNA, 22 bp, Artificial Sequence
  chemically synthesized
attgtatactgaaaatctcttt

SEQ ID NO: 115084 - DNA, 22 bp, Artificial Sequence
  chemically synthesized
tatactgaaaatctcttttcag

SEQ ID NO: 115085 - DNA, 22 bp, Artificial Sequence
  chemically synthesized
aaaatctcttttcaggaatttt

SEQ ID NO: 115086 - DNA, 22 bp, Artificial Sequence
  chemically synthesized
ttttcaggaattttctcctgtg

SEQ ID NO: 115087 - DNA, 22 bp, Artificial Sequence
  chemically synthesized
ttcaggaattttctcctgtgat

SEQ ID NO: 115088 - DNA, 22 bp, Artificial Sequence
  chemically synthesized
tcaggaattttctcctgtgatc

SEQ ID NO: 115089 - DNA, 22 bp, Artificial Sequence
  chemically synthesized
caggaattttctcctgtgatct

SEQ ID NO: 115090 - DNA, 22 bp, Artificial Sequence
  chemically synthesized
aggaattttctcctgtgatcta

SEQ ID NO: 115091 - DNA, 22 bp, Artificial Sequence
  chemically synthesized
tctcctgtgatctaagatgaat

SEQ ID NO: 115092 - DNA, 22 bp, Artificial Sequence
  chemically synthesized
ctcctgtgatctaagatgaatc

SEQ ID NO: 115093 - DNA, 22 bp, Artificial Sequence
  chemically synthesized
tcctgtgatctaagatgaatct

SEQ ID NO: 115094 - DNA, 22 bp, Artificial Sequence
  chemically synthesized
ctgtgatctaagatgaatctac

SEQ ID NO: 115095 - DNA, 22 bp, Artificial Sequence
  chemically synthesized
tgatctaagatgaatctactct

SEQ ID NO: 115096 - DNA, 22 bp, Artificial Sequence
  chemically synthesized
agatgaatctactctgccttga

SEQ ID NO: 115097 - DNA, 22 bp, Artificial Sequence
  chemically synthesized
ctctgccttgaatattttaatt

SEQ ID NO: 115098 - DNA, 22 bp, Artificial Sequence
  chemically synthesized
tgccttgaatattttaattatg

SEQ ID NO: 115099 - DNA, 22 bp, Artificial Sequence
  chemically synthesized
ccttgaatattttaattatgtt

SEQ ID NO: 115100 - DNA, 22 bp, Artificial Sequence
  chemically synthesized
gaatattttaattatgttgtaa

SEQ ID NO: 115101 - DNA, 22 bp, Artificial Sequence
  chemically synthesized
aatattttaattatgttgtaat

SEQ ID NO: 115102 - DNA, 22 bp, Artificial Sequence
  chemically synthesized
taattatgttgtaattagatgt

SEQ ID NO: 115103 - DNA, 22 bp, Artificial Sequence
  chemically synthesized
aattatgttgtaattagatgta

SEQ ID NO: 115104 - DNA, 22 bp, Artificial Sequence
  chemically synthesized
attatgttgtaattagatgtaa

SEQ ID NO: 115105 - DNA, 22 bp, Artificial Sequence
  chemically synthesized
tgttgtaattagatgtaactga

SEQ ID NO: 115106 - DNA, 22 bp, Artificial Sequence
  chemically synthesized
taattagatgtaactgactgct

SEQ ID NO: 115107 - DNA, 22 bp, Artificial Sequence
  chemically synthesized
gatgtaactgactgctctgagt

SEQ ID NO: 115108 - DNA, 22 bp, Artificial Sequence
  chemically synthesized
actgctctgagtggactcctcc

SEQ ID NO: 115109 - DNA, 22 bp, Artificial Sequence
  chemically synthesized
ctctgagtggactcctccattg

SEQ ID NO: 115110 - DNA, 22 bp, Artificial Sequence
  chemically synthesized
tgagtggactcctccattgctt

SEQ ID NO: 115111 - DNA, 22 bp, Artificial Sequence
  chemically synthesized
agtggactcctccattgcttag

SEQ ID NO: 115112 - DNA, 22 bp, Artificial Sequence
  chemically synthesized
ctccattgcttagtagacatga

SEQ ID NO: 115113 - DNA, 22 bp, Artificial Sequence
  chemically synthesized
cattgcttagtagacatgaaaa

SEQ ID NO: 115114 - DNA, 22 bp, Artificial Sequence
  chemically synthesized
cttagtagacatgaaaaaatga

SEQ ID NO: 115115 - DNA, 22 bp, Artificial Sequence
  chemically synthesized
agtagacatgaaaaaatgactg

SEQ ID NO: 115116 - DNA, 22 bp, Artificial Sequence
  chemically synthesized
gtagacatgaaaaaatgactgt

SEQ ID NO: 115117 - DNA, 22 bp, Artificial Sequence
  chemically synthesized
ttgctctcctatcatggataat

SEQ ID NO: 115118 - DNA, 22 bp, Artificial Sequence
  chemically synthesized
ctctcctatcatggataattat

SEQ ID NO: 115119 - DNA, 22 bp, Artificial Sequence
  chemically synthesized
tcctatcatggataattatctc

SEQ ID NO: 115120 - DNA, 22 bp, Artificial Sequence
  chemically synthesized
ctatcatggataattatctctc

SEQ ID NO: 115121 - DNA, 22 bp, Artificial Sequence
  chemically synthesized
tcatggataattatctctcttg

SEQ ID NO: 115122 - DNA, 22 bp, Artificial Sequence
  chemically synthesized
tctctcttgctaggagaaatcc

SEQ ID NO: 115123 - DNA, 22 bp, Artificial Sequence
  chemically synthesized
tcttgctaggagaaatccccta

SEQ ID NO: 115124 - DNA, 22 bp, Artificial Sequence
  chemically synthesized
ttgctaggagaaatcccctaaa

SEQ ID NO: 115125 - DNA, 22 bp, Artificial Sequence
  chemically synthesized
gctaggagaaatcccctaaagc

SEQ ID NO: 115126 - DNA, 22 bp, Artificial Sequence
  chemically synthesized
ctaggagaaatcccctaaagct

SEQ ID NO: 115127 - DNA, 22 bp, Artificial Sequence
  chemically synthesized
ggagaaatcccctaaagctttc

SEQ ID NO: 115128 - DNA, 22 bp, Artificial Sequence
  chemically synthesized
aagctttcttcccaagaggaag

SEQ ID NO: 115129 - DNA, 22 bp, Artificial Sequence
  chemically synthesized
tcttcccaagaggaagtatact

SEQ ID NO: 115130 - DNA, 22 bp, Artificial Sequence
  chemically synthesized
cttcccaagaggaagtatactt

SEQ ID NO: 115131 - DNA, 22 bp, Artificial Sequence
  chemically synthesized
ttcccaagaggaagtatacttt

SEQ ID NO: 115132 - DNA, 22 bp, Artificial Sequence
  chemically synthesized
cccaagaggaagtatactttcc

SEQ ID NO: 115133 - DNA, 22 bp, Artificial Sequence
  chemically synthesized
ccaagaggaagtatactttcca

SEQ ID NO: 115134 - DNA, 22 bp, Artificial Sequence
  chemically synthesized
tccaagagaaataatcccagcc

SEQ ID NO: 115135 - DNA, 22 bp, Artificial Sequence
  chemically synthesized
ccaagagaaataatcccagccc

SEQ ID NO: 115136 - DNA, 22 bp, Artificial Sequence
  chemically synthesized
caagagaaataatcccagccct

SEQ ID NO: 115137 - DNA, 22 bp, Artificial Sequence
  chemically synthesized
tcattgtctctgtatagacatc

SEQ ID NO: 115138 - DNA, 22 bp, Artificial Sequence
  chemically synthesized
tctctgtatagacatcttgttt

SEQ ID NO: 115139 - DNA, 22 bp, Artificial Sequence
  chemically synthesized
tgtatagacatcttgtttctac

SEQ ID NO: 115140 - DNA, 22 bp, Artificial Sequence
  chemically synthesized
tatagacatcttgtttctacca

SEQ ID NO: 115141 - DNA, 22 bp, Artificial Sequence
  chemically synthesized
gtttctaccagatccttctccc

SEQ ID NO: 115142 - DNA, 22 bp, Artificial Sequence
  chemically synthesized
tttctaccagatccttctccct

SEQ ID NO: 115143 - DNA, 22 bp, Artificial Sequence
  chemically synthesized
ctaccagatccttctccctgtc

SEQ ID NO: 115144 - DNA, 22 bp, Artificial Sequence
  chemically synthesized
taccagatccttctccctgtcc

SEQ ID NO: 115145 - DNA, 22 bp, Artificial Sequence
  chemically synthesized
ccagatccttctccctgtccat

SEQ ID NO: 115146 - DNA, 22 bp, Artificial Sequence
  chemically synthesized
ctccctgtccatctcatcactc

SEQ ID NO: 115147 - DNA, 22 bp, Artificial Sequence
  chemically synthesized
tccctgtccatctcatcactct

SEQ ID NO: 115148 - DNA, 22 bp, Artificial Sequence
  chemically synthesized
cctgtccatctcatcactctga

SEQ ID NO: 115149 - DNA, 22 bp, Artificial Sequence
  chemically synthesized
tccatctcatcactctgaagtt

SEQ ID NO: 115150 - DNA, 22 bp, Artificial Sequence
  chemically synthesized
atcactctgaagttggtgaaca

SEQ ID NO: 115151 - DNA, 22 bp, Artificial Sequence
  chemically synthesized
tgaagttggtgaacacagagct

SEQ ID NO: 115152 - DNA, 22 bp, Artificial Sequence
  chemically synthesized
aagttggtgaacacagagctga

SEQ ID NO: 115153 - DNA, 22 bp, Artificial Sequence
  chemically synthesized
gtgaacacagagctgacaacag

SEQ ID NO: 115154 - DNA, 22 bp, Artificial Sequence
  chemically synthesized
acaacagaaccccaggcacaaa

SEQ ID NO: 115155 - DNA, 22 bp, Artificial Sequence
  chemically synthesized
tatttattcacccatttagttt

SEQ ID NO: 115156 - DNA, 22 bp, Artificial Sequence
  chemically synthesized
atttattcacccatttagtttt

SEQ ID NO: 115157 - DNA, 22 bp, Artificial Sequence
  chemically synthesized
tttattcacccatttagttttt

SEQ ID NO: 115158 - DNA, 22 bp, Artificial Sequence
  chemically synthesized
attcacccatttagtttttcat

SEQ ID NO: 115159 - DNA, 22 bp, Artificial Sequence
  chemically synthesized
ttcacccatttagtttttcatg

SEQ ID NO: 115160 - DNA, 22 bp, Artificial Sequence
  chemically synthesized
acccatttagtttttcatgcaa

SEQ ID NO: 115161 - DNA, 22 bp, Artificial Sequence
  chemically synthesized
agtttttcatgcaaaaaaatat

SEQ ID NO: 115162 - DNA, 22 bp, Artificial Sequence
  chemically synthesized
gtttttcatgcaaaaaaatata

SEQ ID NO: 115163 - DNA, 22 bp, Artificial Sequence
  chemically synthesized
ttcatgcaaaaaaatatatata

SEQ ID NO: 115164 - DNA, 22 bp, Artificial Sequence
  chemically synthesized
tcatgcaaaaaaatatatatat

SEQ ID NO: 115165 - DNA, 22 bp, Artificial Sequence
  chemically synthesized
catgcaaaaaaatatatatata

SEQ ID NO: 115166 - DNA, 22 bp, Artificial Sequence
  chemically synthesized
atgcaaaaaaatatatatatag

SEQ ID NO: 115167 - DNA, 22 bp, Artificial Sequence
  chemically synthesized
ccacatcttagacactgtcagg

SEQ ID NO: 115168 - DNA, 22 bp, Artificial Sequence
  chemically synthesized
agacactgtcaggctccagggg

SEQ ID NO: 115169 - DNA, 22 bp, Artificial Sequence
  chemically synthesized
gacactgtcaggctccaggggc

SEQ ID NO: 115170 - DNA, 22 bp, Artificial Sequence
  chemically synthesized
tcaggctccaggggcctttaga

SEQ ID NO: 115171 - DNA, 22 bp, Artificial Sequence
  chemically synthesized
caggggcctttagagaattcca

SEQ ID NO: 115172 - DNA, 22 bp, Artificial Sequence
  chemically synthesized
tagagaattccagtctaatcaa

SEQ ID NO: 115173 - DNA, 22 bp, Artificial Sequence
  chemically synthesized
agagaattccagtctaatcaac

SEQ ID NO: 115174 - DNA, 22 bp, Artificial Sequence
  chemically synthesized
gagaattccagtctaatcaact

SEQ ID NO: 115175 - DNA, 22 bp, Artificial Sequence
  chemically synthesized
cagtctaatcaacttaaaaaat

SEQ ID NO: 115176 - DNA, 22 bp, Artificial Sequence
  chemically synthesized
atcaacttaaaaaatgaattat

SEQ ID NO: 115177 - DNA, 22 bp, Artificial Sequence
  chemically synthesized
aaaaaatgaattattaggttgg

SEQ ID NO: 115178 - DNA, 22 bp, Artificial Sequence
  chemically synthesized
aaaaatgaattattaggttggt

SEQ ID NO: 115179 - DNA, 22 bp, Artificial Sequence
  chemically synthesized
ttaggttggtgaaaaattaatg

SEQ ID NO: 115180 - DNA, 22 bp, Artificial Sequence
  chemically synthesized
ggttggtgaaaaattaatggca

SEQ ID NO: 115181 - DNA, 22 bp, Artificial Sequence
  chemically synthesized
gtgaaaaattaatggcagtttt

SEQ ID NO: 115182 - DNA, 22 bp, Artificial Sequence
  chemically synthesized
atggcagtttttgccaatataa

SEQ ID NO: 115183 - DNA, 22 bp, Artificial Sequence
  chemically synthesized
ttgccaatataaatttatgttc

SEQ ID NO: 115184 - DNA, 22 bp, Artificial Sequence
  chemically synthesized
tgccaatataaatttatgttct

SEQ ID NO: 115185 - DNA, 22 bp, Artificial Sequence
  chemically synthesized
gccaatataaatttatgttcta

SEQ ID NO: 115186 - DNA, 22 bp, Artificial Sequence
  chemically synthesized
ccaatataaatttatgttctaa

SEQ ID NO: 115187 - DNA, 22 bp, Artificial Sequence
  chemically synthesized
atgttctaaacatgtataataa

SEQ ID NO: 115188 - DNA, 22 bp, Artificial Sequence
  chemically synthesized
tgttctaaacatgtataataaa

SEQ ID NO: 115189 - DNA, 22 bp, Artificial Sequence
  chemically synthesized
taaacatgtataataaagaata

SEQ ID NO: 115190 - DNA, 22 bp, Artificial Sequence
  chemically synthesized
aacatgtataataaagaatacg

SEQ ID NO: 115191 - DNA, 22 bp, Artificial Sequence
  chemically synthesized
cctataatatatatgttgtaca

SEQ ID NO: 115192 - DNA, 22 bp, Artificial Sequence
  chemically synthesized
taatatatatgttgtacaaagt

SEQ ID NO: 115193 - DNA, 22 bp, Artificial Sequence
  chemically synthesized
tacaaagtatatatatgtgtac

SEQ ID NO: 115194 - DNA, 22 bp, Artificial Sequence
  chemically synthesized
atatttttgtatatttgtttac

SEQ ID NO: 115195 - DNA, 22 bp, Artificial Sequence
  chemically synthesized
ttgtatatttgtttacatatat

SEQ ID NO: 115196 - DNA, 22 bp, Artificial Sequence
  chemically synthesized
tgtatatttgtttacatatata

SEQ ID NO: 115197 - DNA, 22 bp, Artificial Sequence
  chemically synthesized
gtatatttgtttacatatataa

SEQ ID NO: 115198 - DNA, 22 bp, Artificial Sequence
  chemically synthesized
tatatttgtttacatatataaa

SEQ ID NO: 115199 - DNA, 22 bp, Artificial Sequence
  chemically synthesized
gtttacatatataaatatacag

SEQ ID NO: 115200 - DNA, 22 bp, Artificial Sequence
  chemically synthesized
tttacatatataaatatacaga

SEQ ID NO: 115201 - DNA, 22 bp, Artificial Sequence
  chemically synthesized
acatatataaatatacagacac

SEQ ID NO: 115202 - DNA, 22 bp, Artificial Sequence
  chemically synthesized
catatataaatatacagacaca

SEQ ID NO: 115203 - DNA, 22 bp, Artificial Sequence
  chemically synthesized
tacttatatataaaaaatctat

SEQ ID NO: 115204 - DNA, 22 bp, Artificial Sequence
  chemically synthesized
atatataaaaaatctataaagt

SEQ ID NO: 115205 - DNA, 22 bp, Artificial Sequence
  chemically synthesized
tatataaaaaatctataaagta

SEQ ID NO: 115206 - DNA, 22 bp, Artificial Sequence
  chemically synthesized
taaagtatataaagaatatata

SEQ ID NO: 115207 - DNA, 22 bp, Artificial Sequence
  chemically synthesized
aaatgtatattctataaagtat

SEQ ID NO: 115208 - DNA, 22 bp, Artificial Sequence
  chemically synthesized
tataaagtatttatgagtaaat

SEQ ID NO: 115209 - DNA, 22 bp, Artificial Sequence
  chemically synthesized
taaagtatttatgagtaaatct

SEQ ID NO: 115210 - DNA, 22 bp, Artificial Sequence
  chemically synthesized
atgagtaaatctatacacttat

SEQ ID NO: 115211 - DNA, 22 bp, Artificial Sequence
  chemically synthesized
tgagtaaatctatacacttata

SEQ ID NO: 115212 - DNA, 22 bp, Artificial Sequence
  chemically synthesized
tacacttatatgttatttaaac

SEQ ID NO: 115213 - DNA, 22 bp, Artificial Sequence
  chemically synthesized
atatgttatttaaacttataca

SEQ ID NO: 115214 - DNA, 22 bp, Artificial Sequence
  chemically synthesized
tatgttatttaaacttatacat

SEQ ID NO: 115215 - DNA, 22 bp, Artificial Sequence
  chemically synthesized
tttaaacttatacatatgtgta

SEQ ID NO: 115216 - DNA, 22 bp, Artificial Sequence
  chemically synthesized
aaacttatacatatgtgtactt

SEQ ID NO: 115217 - DNA, 22 bp, Artificial Sequence
  chemically synthesized
aacttatacatatgtgtactta

SEQ ID NO: 115218 - DNA, 22 bp, Artificial Sequence
  chemically synthesized
atacatatgtgtacttatatgg

SEQ ID NO: 115219 - DNA, 22 bp, Artificial Sequence
  chemically synthesized
tacatatgtgtacttatatgga

SEQ ID NO: 115220 - DNA, 22 bp, Artificial Sequence
  chemically synthesized
atatggatgtataagtatgttc

SEQ ID NO: 115221 - DNA, 22 bp, Artificial Sequence
  chemically synthesized
tatggatgtataagtatgttct

SEQ ID NO: 115222 - DNA, 22 bp, Artificial Sequence
  chemically synthesized
tatatatatatcaataagtata

SEQ ID NO: 115223 - DNA, 22 bp, Artificial Sequence
  chemically synthesized
tatatatatcaataagtatata

SEQ ID NO: 115224 - DNA, 22 bp, Artificial Sequence
  chemically synthesized
acaccttaatagtacattacag

SEQ ID NO: 115225 - DNA, 22 bp, Artificial Sequence
  chemically synthesized
caccttaatagtacattacagg

SEQ ID NO: 115226 - DNA, 22 bp, Artificial Sequence
  chemically synthesized
aatagtacattacaggtactac

SEQ ID NO: 115227 - DNA, 22 bp, Artificial Sequence
  chemically synthesized
atagtacattacaggtactacg

SEQ ID NO: 115228 - DNA, 22 bp, Artificial Sequence
  chemically synthesized
caggtactacgtgagaacagag

SEQ ID NO: 115229 - DNA, 22 bp, Artificial Sequence
  chemically synthesized
cgtgagaacagagaaagatgta

SEQ ID NO: 115230 - DNA, 22 bp, Artificial Sequence
  chemically synthesized
atgctacagaaggaagtcagga

SEQ ID NO: 115231 - DNA, 22 bp, Artificial Sequence
  chemically synthesized
cagaaggaagtcaggagagatt

SEQ ID NO: 115232 - DNA, 22 bp, Artificial Sequence
  chemically synthesized
gacagaagaagtgatatttgta

SEQ ID NO: 115233 - DNA, 22 bp, Artificial Sequence
  chemically synthesized
acagaagaagtgatatttgtac

SEQ ID NO: 115234 - DNA, 22 bp, Artificial Sequence
  chemically synthesized
gtactaagtcttaaaggatccg

SEQ ID NO: 115235 - DNA, 22 bp, Artificial Sequence
  chemically synthesized
tactaagtcttaaaggatccgc

SEQ ID NO: 115236 - DNA, 22 bp, Artificial Sequence
  chemically synthesized
agtcttaaaggatccgcaagtg

SEQ ID NO: 115237 - DNA, 22 bp, Artificial Sequence
  chemically synthesized
aaaggatccgcaagtgtttact

SEQ ID NO: 115238 - DNA, 22 bp, Artificial Sequence
  chemically synthesized
aaggatccgcaagtgtttactg

SEQ ID NO: 115239 - DNA, 22 bp, Artificial Sequence
  chemically synthesized
actggttggaaaaacaggggtg

SEQ ID NO: 115240 - DNA, 22 bp, Artificial Sequence
  chemically synthesized
ctggttggaaaaacaggggtgg

SEQ ID NO: 115241 - DNA, 22 bp, Artificial Sequence
  chemically synthesized
gttggaaaaacaggggtggttt

SEQ ID NO: 115242 - DNA, 22 bp, Artificial Sequence
  chemically synthesized
gaaaaacaggggtggtttttgc

SEQ ID NO: 115243 - DNA, 22 bp, Artificial Sequence
  chemically synthesized
ttgccaagaaagcaataaatat

SEQ ID NO: 115244 - DNA, 22 bp, Artificial Sequence
  chemically synthesized
tgccaagaaagcaataaatata

SEQ ID NO: 115245 - DNA, 22 bp, Artificial Sequence
  chemically synthesized
gccaagaaagcaataaatatag

SEQ ID NO: 115246 - DNA, 22 bp, Artificial Sequence
  chemically synthesized
ccaagaaagcaataaatataga

SEQ ID NO: 115247 - DNA, 22 bp, Artificial Sequence
  chemically synthesized
aagaaaaaaatgatatgggtgt

SEQ ID NO: 115248 - DNA, 22 bp, Artificial Sequence
  chemically synthesized
actgggaaaagatgggtttgga

SEQ ID NO: 115249 - DNA, 22 bp, Artificial Sequence
  chemically synthesized
ggaaaagatgggtttggaaagg

SEQ ID NO: 115250 - DNA, 22 bp, Artificial Sequence
  chemically synthesized
ggaaaggtgccaaaacaagaag

SEQ ID NO: 115251 - DNA, 22 bp, Artificial Sequence
  chemically synthesized
gaaaggtgccaaaacaagaagg

SEQ ID NO: 115252 - DNA, 22 bp, Artificial Sequence
  chemically synthesized
aagatggtgttacagggtgttt

SEQ ID NO: 115253 - DNA, 22 bp, Artificial Sequence
  chemically synthesized
cagggtgtttgaggctaccagg

SEQ ID NO: 115254 - DNA, 22 bp, Artificial Sequence
  chemically synthesized
gaggctaccagggccatgcata

SEQ ID NO: 115255 - DNA, 22 bp, Artificial Sequence
  chemically synthesized
aggctaccagggccatgcatag

SEQ ID NO: 115256 - DNA, 22 bp, Artificial Sequence
  chemically synthesized
ccagggccatgcatagagagac

SEQ ID NO: 115257 - DNA, 22 bp, Artificial Sequence
  chemically synthesized
atatcttatcctgattttcgct

SEQ ID NO: 115258 - DNA, 22 bp, Artificial Sequence
  chemically synthesized
atcctgattttcgctcactacc

SEQ ID NO: 115259 - DNA, 22 bp, Artificial Sequence
  chemically synthesized
tcctgattttcgctcactacca

SEQ ID NO: 115260 - DNA, 22 bp, Artificial Sequence
  chemically synthesized
attttcgctcactaccaggcct

SEQ ID NO: 115261 - DNA, 22 bp, Artificial Sequence
  chemically synthesized
tcgctcactaccaggccttggg

SEQ ID NO: 115262 - DNA, 22 bp, Artificial Sequence
  chemically synthesized
cgctcactaccaggccttggga

SEQ ID NO: 115263 - DNA, 22 bp, Artificial Sequence
  chemically synthesized
gctcactaccaggccttgggat

SEQ ID NO: 115264 - DNA, 22 bp, Artificial Sequence
  chemically synthesized
actaccaggccttgggatgatt

SEQ ID NO: 115265 - DNA, 22 bp, Artificial Sequence
  chemically synthesized
ccaggccttgggatgattgttt

SEQ ID NO: 115266 - DNA, 22 bp, Artificial Sequence
  chemically synthesized
gggatgattgtttacctttttg

SEQ ID NO: 115267 - DNA, 22 bp, Artificial Sequence
  chemically synthesized
ggatgattgtttacctttttgt

SEQ ID NO: 115268 - DNA, 22 bp, Artificial Sequence
  chemically synthesized
tttacctttttgtagttttctc

SEQ ID NO: 115269 - DNA, 22 bp, Artificial Sequence
  chemically synthesized
acctttttgtagttttctcctt

SEQ ID NO: 115270 - DNA, 22 bp, Artificial Sequence
  chemically synthesized
cctttttgtagttttctccttg

SEQ ID NO: 115271 - DNA, 22 bp, Artificial Sequence
  chemically synthesized
tttgtagttttctccttgtgaa

SEQ ID NO: 115272 - DNA, 22 bp, Artificial Sequence
  chemically synthesized
ttgtagttttctccttgtgaag

SEQ ID NO: 115273 - DNA, 22 bp, Artificial Sequence
  chemically synthesized
tgtagttttctccttgtgaagt

SEQ ID NO: 115274 - DNA, 22 bp, Artificial Sequence
  chemically synthesized
gtagttttctccttgtgaagta

SEQ ID NO: 115275 - DNA, 22 bp, Artificial Sequence
  chemically synthesized
tagttttctccttgtgaagtag

SEQ ID NO: 115276 - DNA, 22 bp, Artificial Sequence
  chemically synthesized
tctccttgtgaagtagtaataa

SEQ ID NO: 115277 - DNA, 22 bp, Artificial Sequence
  chemically synthesized
ctccttgtgaagtagtaataaa

SEQ ID NO: 115278 - DNA, 22 bp, Artificial Sequence
  chemically synthesized
tccttgtgaagtagtaataaaa

SEQ ID NO: 115279 - DNA, 22 bp, Artificial Sequence
  chemically synthesized
cttgtgaagtagtaataaaatg

SEQ ID NO: 115280 - DNA, 22 bp, Artificial Sequence
  chemically synthesized
gtgaagtagtaataaaatgttt

SEQ ID NO: 115281 - DNA, 22 bp, Artificial Sequence
  chemically synthesized
tgaagtagtaataaaatgtttc

SEQ ID NO: 115282 - DNA, 22 bp, Artificial Sequence
  chemically synthesized
catagttacatgaaatattcat

SEQ ID NO: 115283 - DNA, 22 bp, Artificial Sequence
  chemically synthesized
atagttacatgaaatattcatg

SEQ ID NO: 115284 - DNA, 22 bp, Artificial Sequence
  chemically synthesized
catgaaatattcatgattatgt

SEQ ID NO: 115285 - DNA, 22 bp, Artificial Sequence
  chemically synthesized
atgattatgtcaagcttttcac

SEQ ID NO: 115286 - DNA, 22 bp, Artificial Sequence
  chemically synthesized
tgtcaagcttttcacagcatct

SEQ ID NO: 115287 - DNA, 22 bp, Artificial Sequence
  chemically synthesized
ttcacagcatctaaatcatgta

SEQ ID NO: 115288 - DNA, 22 bp, Artificial Sequence
  chemically synthesized
tcacagcatctaaatcatgtat

SEQ ID NO: 115289 - DNA, 22 bp, Artificial Sequence
  chemically synthesized
cacagcatctaaatcatgtatg

SEQ ID NO: 115290 - DNA, 22 bp, Artificial Sequence
  chemically synthesized
acagcatctaaatcatgtatgg

SEQ ID NO: 115291 - DNA, 22 bp, Artificial Sequence
  chemically synthesized
aatcatgtatggcctcaataaa

SEQ ID NO: 115292 - DNA, 22 bp, Artificial Sequence
  chemically synthesized
aataaattggactatcaccaca

SEQ ID NO: 115293 - DNA, 22 bp, Artificial Sequence
  chemically synthesized
gactatcaccacagatctttta

SEQ ID NO: 115294 - DNA, 22 bp, Artificial Sequence
  chemically synthesized
tcaccacagatcttttacaagt

SEQ ID NO: 115295 - DNA, 22 bp, Artificial Sequence
  chemically synthesized
ttacaagtttgaactttattct

SEQ ID NO: 115296 - DNA, 22 bp, Artificial Sequence
  chemically synthesized
tacaagtttgaactttattcta

SEQ ID NO: 115297 - DNA, 22 bp, Artificial Sequence
  chemically synthesized
acaagtttgaactttattctaa

SEQ ID NO: 115298 - DNA, 22 bp, Artificial Sequence
  chemically synthesized
caagtttgaactttattctaat

SEQ ID NO: 115299 - DNA, 22 bp, Artificial Sequence
  chemically synthesized
gaactttattctaatgatagga

SEQ ID NO: 115300 - DNA, 22 bp, Artificial Sequence
  chemically synthesized
aactttattctaatgataggag

SEQ ID NO: 115301 - DNA, 22 bp, Artificial Sequence
  chemically synthesized
tattctaatgataggagctact

SEQ ID NO: 115302 - DNA, 22 bp, Artificial Sequence
  chemically synthesized
attctaatgataggagctactg

SEQ ID NO: 115303 - DNA, 22 bp, Artificial Sequence
  chemically synthesized
ttctaatgataggagctactga

SEQ ID NO: 115304 - DNA, 22 bp, Artificial Sequence
  chemically synthesized
taatgataggagctactgaagt

SEQ ID NO: 115305 - DNA, 22 bp, Artificial Sequence
  chemically synthesized
atgataggagctactgaagtac

SEQ ID NO: 115306 - DNA, 22 bp, Artificial Sequence
  chemically synthesized
ctgaagtactgaaaacagtgca

SEQ ID NO: 115307 - DNA, 22 bp, Artificial Sequence
  chemically synthesized
aagtactgaaaacagtgcagtg

SEQ ID NO: 115308 - DNA, 22 bp, Artificial Sequence
  chemically synthesized
aaaacagtgcagtgattcatag

SEQ ID NO: 115309 - DNA, 22 bp, Artificial Sequence
  chemically synthesized
atagagttagtactttctgcat

SEQ ID NO: 115310 - DNA, 22 bp, Artificial Sequence
  chemically synthesized
gtactttctgcataatctcggt

SEQ ID NO: 115311 - DNA, 22 bp, Artificial Sequence
  chemically synthesized
tctgcataatctcggtggctgc

SEQ ID NO: 115312 - DNA, 22 bp, Artificial Sequence
  chemically synthesized
ctgcataatctcggtggctgca

SEQ ID NO: 115313 - DNA, 22 bp, Artificial Sequence
  chemically synthesized
tgcataatctcggtggctgcag

SEQ ID NO: 115314 - DNA, 22 bp, Artificial Sequence
  chemically synthesized
cataatctcggtggctgcagta

SEQ ID NO: 115315 - DNA, 22 bp, Artificial Sequence
  chemically synthesized
ggtggctgcagtagaggatgga

SEQ ID NO: 115316 - DNA, 22 bp, Artificial Sequence
  chemically synthesized
cagtagaggatggaccaaggga

SEQ ID NO: 115317 - DNA, 22 bp, Artificial Sequence
  chemically synthesized
gctttgcatgttgaatgacagg

SEQ ID NO: 115318 - DNA, 22 bp, Artificial Sequence
  chemically synthesized
tgcatgttgaatgacaggtcag

SEQ ID NO: 115319 - DNA, 22 bp, Artificial Sequence
  chemically synthesized
gcatgttgaatgacaggtcagg

SEQ ID NO: 115320 - DNA, 22 bp, Artificial Sequence
  chemically synthesized
catgttgaatgacaggtcaggc

SEQ ID NO: 115321 - DNA, 22 bp, Artificial Sequence
  chemically synthesized
aatgacaggtcaggcaagcagg

SEQ ID NO: 115322 - DNA, 22 bp, Artificial Sequence
  chemically synthesized
agaacaaggacattggctacag

SEQ ID NO: 115323 - DNA, 22 bp, Artificial Sequence
  chemically synthesized
gctacagagatgaagatgaata

SEQ ID NO: 115324 - DNA, 22 bp, Artificial Sequence
  chemically synthesized
cagagatgaagatgaatagatt

SEQ ID NO: 115325 - DNA, 22 bp, Artificial Sequence
  chemically synthesized
cagggatagattaaaagaactt

SEQ ID NO: 115326 - DNA, 22 bp, Artificial Sequence
  chemically synthesized
aaagaacttagttaaaaattag

SEQ ID NO: 115327 - DNA, 22 bp, Artificial Sequence
  chemically synthesized
agttaaaaattagatacagaaa

SEQ ID NO: 115328 - DNA, 22 bp, Artificial Sequence
  chemically synthesized
gttaaaaattagatacagaaag

SEQ ID NO: 115329 - DNA, 22 bp, Artificial Sequence
  chemically synthesized
aaaattagatacagaaagaggg

SEQ ID NO: 115330 - DNA, 22 bp, Artificial Sequence
  chemically synthesized
gatacagaaagagggagagggt

SEQ ID NO: 115331 - DNA, 22 bp, Artificial Sequence
  chemically synthesized
agtagagcatcagctcaaaaat

SEQ ID NO: 115332 - DNA, 22 bp, Artificial Sequence
  chemically synthesized
aaaaatgttgtcttgaatggca

SEQ ID NO: 115333 - DNA, 22 bp, Artificial Sequence
  chemically synthesized
tcttgaatggcaggaaatggtg

SEQ ID NO: 115334 - DNA, 22 bp, Artificial Sequence
  chemically synthesized
gaatggcaggaaatggtgaata

SEQ ID NO: 115335 - DNA, 22 bp, Artificial Sequence
  chemically synthesized
aatggcaggaaatggtgaataa

SEQ ID NO: 115336 - DNA, 22 bp, Artificial Sequence
  chemically synthesized
taaaaaatgcataaatatgaga

SEQ ID NO: 115337 - DNA, 22 bp, Artificial Sequence
  chemically synthesized
ggctcaatattagacgtgttga

SEQ ID NO: 115338 - DNA, 22 bp, Artificial Sequence
  chemically synthesized
aatattagacgtgttgagtttc

SEQ ID NO: 115339 - DNA, 22 bp, Artificial Sequence
  chemically synthesized
gacgtgttgagtttcatcagta

SEQ ID NO: 115340 - DNA, 22 bp, Artificial Sequence
  chemically synthesized
agtttcatcagtatccttttgg

SEQ ID NO: 115341 - DNA, 22 bp, Artificial Sequence
  chemically synthesized
catcagtatccttttggaaaca

SEQ ID NO: 115342 - DNA, 22 bp, Artificial Sequence
  chemically synthesized
atcagtatccttttggaaacac

SEQ ID NO: 115343 - DNA, 22 bp, Artificial Sequence
  chemically synthesized
ttggaaacacctagtgagaagg

SEQ ID NO: 115344 - DNA, 22 bp, Artificial Sequence
  chemically synthesized
tggaaacacctagtgagaaggc

SEQ ID NO: 115345 - DNA, 22 bp, Artificial Sequence
  chemically synthesized
ggaaacacctagtgagaaggca

SEQ ID NO: 115346 - DNA, 22 bp, Artificial Sequence
  chemically synthesized
gaaacacctagtgagaaggcag

SEQ ID NO: 115347 - DNA, 22 bp, Artificial Sequence
  chemically synthesized
gtgagaaggcagaaactcaggc

SEQ ID NO: 115348 - DNA, 22 bp, Artificial Sequence
  chemically synthesized
aggcctgatatgtaacggagtt

SEQ ID NO: 115349 - DNA, 22 bp, Artificial Sequence
  chemically synthesized
atatgtaacggagttatctgga

SEQ ID NO: 115350 - DNA, 22 bp, Artificial Sequence
  chemically synthesized
tctggactagagattaatgtct

SEQ ID NO: 115351 - DNA, 22 bp, Artificial Sequence
  chemically synthesized
gactagagattaatgtctaaga

SEQ ID NO: 115352 - DNA, 22 bp, Artificial Sequence
  chemically synthesized
gagattaatgtctaagagccac

SEQ ID NO: 115353 - DNA, 22 bp, Artificial Sequence
  chemically synthesized
atgtctaagagccaccactgta

SEQ ID NO: 115354 - DNA, 22 bp, Artificial Sequence
  chemically synthesized
agagccaccactgtataagtaa

SEQ ID NO: 115355 - DNA, 22 bp, Artificial Sequence
  chemically synthesized
tataagtaataataataataga

SEQ ID NO: 115356 - DNA, 22 bp, Artificial Sequence
  chemically synthesized
aggtgttcaaggacagtaaact

SEQ ID NO: 115357 - DNA, 22 bp, Artificial Sequence
  chemically synthesized
aaggacagtaaactgaataaca

SEQ ID NO: 115358 - DNA, 22 bp, Artificial Sequence
  chemically synthesized
aataacataaatatttgagcaa

SEQ ID NO: 115359 - DNA, 22 bp, Artificial Sequence
  chemically synthesized
gagcaatggaaataagagagtg

SEQ ID NO: 115360 - DNA, 22 bp, Artificial Sequence
  chemically synthesized
agcaatggaaataagagagtgc

SEQ ID NO: 115361 - DNA, 22 bp, Artificial Sequence
  chemically synthesized
tcacaaaaatcagaagagaacc

SEQ ID NO: 115362 - DNA, 22 bp, Artificial Sequence
  chemically synthesized
ggcattaagaatttctagagag

SEQ ID NO: 115363 - DNA, 22 bp, Artificial Sequence
  chemically synthesized
gcattaagaatttctagagaga

SEQ ID NO: 115364 - DNA, 22 bp, Artificial Sequence
  chemically synthesized
agaatttctagagagagctcta

SEQ ID NO: 115365 - DNA, 22 bp, Artificial Sequence
  chemically synthesized
ctagagagagctctaaaaagga

SEQ ID NO: 115366 - DNA, 22 bp, Artificial Sequence
  chemically synthesized
tagagagagctctaaaaaggaa

SEQ ID NO: 115367 - DNA, 22 bp, Artificial Sequence
  chemically synthesized
gagagagctctaaaaaggaagg

SEQ ID NO: 115368 - DNA, 22 bp, Artificial Sequence
  chemically synthesized
taaaaaggaaggcatggccaga

SEQ ID NO: 115369 - DNA, 22 bp, Artificial Sequence
  chemically synthesized
aaaaggaaggcatggccagagc

SEQ ID NO: 115370 - DNA, 22 bp, Artificial Sequence
  chemically synthesized
ttgcacaaaaaaatcaataaaa

SEQ ID NO: 115371 - DNA, 22 bp, Artificial Sequence
  chemically synthesized
cacaaaaaaatcaataaaagca

SEQ ID NO: 115372 - DNA, 22 bp, Artificial Sequence
  chemically synthesized
agactctccattgcatttggcc

SEQ ID NO: 115373 - DNA, 22 bp, Artificial Sequence
  chemically synthesized
tccattgcatttggcccctaga

SEQ ID NO: 115374 - DNA, 22 bp, Artificial Sequence
  chemically synthesized
cattgcatttggcccctagaag

SEQ ID NO: 115375 - DNA, 22 bp, Artificial Sequence
  chemically synthesized
catttggcccctagaagtcact

SEQ ID NO: 115376 - DNA, 22 bp, Artificial Sequence
  chemically synthesized
ggcccctagaagtcactggtga

SEQ ID NO: 115377 - DNA, 22 bp, Artificial Sequence
  chemically synthesized
gcccctagaagtcactggtgaa

SEQ ID NO: 115378 - DNA, 22 bp, Artificial Sequence
  chemically synthesized
gaagtcactggtgaatttaagg

SEQ ID NO: 115379 - DNA, 22 bp, Artificial Sequence
  chemically synthesized
gtgaatttaaggagcattgctt

SEQ ID NO: 115380 - DNA, 22 bp, Artificial Sequence
  chemically synthesized
aaggagcattgctttagctaag

SEQ ID NO: 115381 - DNA, 22 bp, Artificial Sequence
  chemically synthesized
aggagcattgctttagctaagt

SEQ ID NO: 115382 - DNA, 22 bp, Artificial Sequence
  chemically synthesized
ctttagctaagtgggttttaaa

SEQ ID NO: 115383 - DNA, 22 bp, Artificial Sequence
  chemically synthesized
tagctaagtgggttttaaaaaa

SEQ ID NO: 115384 - DNA, 22 bp, Artificial Sequence
  chemically synthesized
agctaagtgggttttaaaaaaa

SEQ ID NO: 115385 - DNA, 22 bp, Artificial Sequence
  chemically synthesized
gctaagtgggttttaaaaaaaa

SEQ ID NO: 115386 - DNA, 22 bp, Artificial Sequence
  chemically synthesized
agtgggttttaaaaaaaacatt

SEQ ID NO: 115387 - DNA, 22 bp, Artificial Sequence
  chemically synthesized
taaaaaaaacattatagggtgg

SEQ ID NO: 115388 - DNA, 22 bp, Artificial Sequence
  chemically synthesized
aaaaaaaacattatagggtggt

SEQ ID NO: 115389 - DNA, 22 bp, Artificial Sequence
  chemically synthesized
aaaaaaacattatagggtggtt

SEQ ID NO: 115390 - DNA, 22 bp, Artificial Sequence
  chemically synthesized
tagggtggttggttgagtagta

SEQ ID NO: 115391 - DNA, 22 bp, Artificial Sequence
  chemically synthesized
gttgagtagtaaactgagaagt

SEQ ID NO: 115392 - DNA, 22 bp, Artificial Sequence
  chemically synthesized
agtagtaaactgagaagtaaag

SEQ ID NO: 115393 - DNA, 22 bp, Artificial Sequence
  chemically synthesized
agaagtaaagaaatggaaaaga

SEQ ID NO: 115394 - DNA, 22 bp, Artificial Sequence
  chemically synthesized
ttttttaccccttgccaaagtg

SEQ ID NO: 115395 - DNA, 22 bp, Artificial Sequence
  chemically synthesized
tttaccccttgccaaagtgatg

SEQ ID NO: 115396 - DNA, 22 bp, Artificial Sequence
  chemically synthesized
ttaccccttgccaaagtgatgt

SEQ ID NO: 115397 - DNA, 22 bp, Artificial Sequence
  chemically synthesized
taccccttgccaaagtgatgta

SEQ ID NO: 115398 - DNA, 22 bp, Artificial Sequence
  chemically synthesized
accccttgccaaagtgatgtaa

SEQ ID NO: 115399 - DNA, 22 bp, Artificial Sequence
  chemically synthesized
ccccttgccaaagtgatgtaag

SEQ ID NO: 115400 - DNA, 22 bp, Artificial Sequence
  chemically synthesized
gccaaagtgatgtaagccttat

SEQ ID NO: 115401 - DNA, 22 bp, Artificial Sequence
  chemically synthesized
ccaaagtgatgtaagccttata

SEQ ID NO: 115402 - DNA, 22 bp, Artificial Sequence
  chemically synthesized
atatccatgcagcacctctgct

SEQ ID NO: 115403 - DNA, 22 bp, Artificial Sequence
  chemically synthesized
tatccatgcagcacctctgctc

SEQ ID NO: 115404 - DNA, 22 bp, Artificial Sequence
  chemically synthesized
tgctctcaactcgaagctcaca

SEQ ID NO: 115405 - DNA, 22 bp, Artificial Sequence
  chemically synthesized
ctctcaactcgaagctcacaag

SEQ ID NO: 115406 - DNA, 22 bp, Artificial Sequence
  chemically synthesized
tcaactcgaagctcacaagtat

SEQ ID NO: 115407 - DNA, 22 bp, Artificial Sequence
  chemically synthesized
aactcgaagctcacaagtataa

SEQ ID NO: 115408 - DNA, 22 bp, Artificial Sequence
  chemically synthesized
gaagctcacaagtataataaaa

SEQ ID NO: 115409 - DNA, 22 bp, Artificial Sequence
  chemically synthesized
acaagtataataaaattcaaag

SEQ ID NO: 115410 - DNA, 22 bp, Artificial Sequence
  chemically synthesized
aaagtagcttgcgtgacctgca

SEQ ID NO: 115411 - DNA, 22 bp, Artificial Sequence
  chemically synthesized
gcgtgacctgcaagatcataca

SEQ ID NO: 115412 - DNA, 22 bp, Artificial Sequence
  chemically synthesized
cgtgacctgcaagatcatacat

SEQ ID NO: 115413 - DNA, 22 bp, Artificial Sequence
  chemically synthesized
caagatcatacatgacgtagca

SEQ ID NO: 115414 - DNA, 22 bp, Artificial Sequence
  chemically synthesized
agctgctacttcaagtggattt

SEQ ID NO: 115415 - DNA, 22 bp, Artificial Sequence
  chemically synthesized
gctgctacttcaagtggatttg

SEQ ID NO: 115416 - DNA, 22 bp, Artificial Sequence
  chemically synthesized
ctacttcaagtggatttgccac

SEQ ID NO: 115417 - DNA, 22 bp, Artificial Sequence
  chemically synthesized
cttcaagtggatttgccaccat

SEQ ID NO: 115418 - DNA, 22 bp, Artificial Sequence
  chemically synthesized
caagtggatttgccaccattcc

SEQ ID NO: 115419 - DNA, 22 bp, Artificial Sequence
  chemically synthesized
aagtggatttgccaccattccc

SEQ ID NO: 115420 - DNA, 22 bp, Artificial Sequence
  chemically synthesized
gccaccattccccaccttgctt

SEQ ID NO: 115421 - DNA, 22 bp, Artificial Sequence
  chemically synthesized
ccaccattccccaccttgcttc

SEQ ID NO: 115422 - DNA, 22 bp, Artificial Sequence
  chemically synthesized
cccaccttgcttcctccattga

SEQ ID NO: 115423 - DNA, 22 bp, Artificial Sequence
  chemically synthesized
gcttcctccattgaatatacat

SEQ ID NO: 115424 - DNA, 22 bp, Artificial Sequence
  chemically synthesized
cttcctccattgaatatacatt

SEQ ID NO: 115425 - DNA, 22 bp, Artificial Sequence
  chemically synthesized
cctccattgaatatacattggc

SEQ ID NO: 115426 - DNA, 22 bp, Artificial Sequence
  chemically synthesized
ctccattgaatatacattggcc

SEQ ID NO: 115427 - DNA, 22 bp, Artificial Sequence
  chemically synthesized
cattgaatatacattggccttc

SEQ ID NO: 115428 - DNA, 22 bp, Artificial Sequence
  chemically synthesized
aatatacattggccttcttttg

SEQ ID NO: 115429 - DNA, 22 bp, Artificial Sequence
  chemically synthesized
gccttcttttgtcttttaaact

SEQ ID NO: 115430 - DNA, 22 bp, Artificial Sequence
  chemically synthesized
cttttgtcttttaaacttgtca

SEQ ID NO: 115431 - DNA, 22 bp, Artificial Sequence
  chemically synthesized
ttttgtcttttaaacttgtcaa

SEQ ID NO: 115432 - DNA, 22 bp, Artificial Sequence
  chemically synthesized
ttgtcttttaaacttgtcaagc

SEQ ID NO: 115433 - DNA, 22 bp, Artificial Sequence
  chemically synthesized
tgtcttttaaacttgtcaagct

SEQ ID NO: 115434 - DNA, 22 bp, Artificial Sequence
  chemically synthesized
gtcttttaaacttgtcaagctg

SEQ ID NO: 115435 - DNA, 22 bp, Artificial Sequence
  chemically synthesized
tcttttaaacttgtcaagctgc

SEQ ID NO: 115436 - DNA, 22 bp, Artificial Sequence
  chemically synthesized
ttaaacttgtcaagctgctctc

SEQ ID NO: 115437 - DNA, 22 bp, Artificial Sequence
  chemically synthesized
taaacttgtcaagctgctctct

SEQ ID NO: 115438 - DNA, 22 bp, Artificial Sequence
  chemically synthesized
aaacttgtcaagctgctctctg

SEQ ID NO: 115439 - DNA, 22 bp, Artificial Sequence
  chemically synthesized
aacttgtcaagctgctctctgc

SEQ ID NO: 115440 - DNA, 22 bp, Artificial Sequence
  chemically synthesized
gtcaagctgctctctgcttcag

SEQ ID NO: 115441 - DNA, 22 bp, Artificial Sequence
  chemically synthesized
tcaagctgctctctgcttcagg

SEQ ID NO: 115442 - DNA, 22 bp, Artificial Sequence
  chemically synthesized
ctctctgcttcaggaactttca

SEQ ID NO: 115443 - DNA, 22 bp, Artificial Sequence
  chemically synthesized
tctgcttcaggaactttcactt

SEQ ID NO: 115444 - DNA, 22 bp, Artificial Sequence
  chemically synthesized
tgcttcaggaactttcacttgt

SEQ ID NO: 115445 - DNA, 22 bp, Artificial Sequence
  chemically synthesized
cttcaggaactttcacttgttc

SEQ ID NO: 115446 - DNA, 22 bp, Artificial Sequence
  chemically synthesized
caggaactttcacttgttcttc

SEQ ID NO: 115447 - DNA, 22 bp, Artificial Sequence
  chemically synthesized
aggaactttcacttgttcttcc

SEQ ID NO: 115448 - DNA, 22 bp, Artificial Sequence
  chemically synthesized
tcacttgttcttcctccttcct

SEQ ID NO: 115449 - DNA, 22 bp, Artificial Sequence
  chemically synthesized
cacttgttcttcctccttcctt

SEQ ID NO: 115450 - DNA, 22 bp, Artificial Sequence
  chemically synthesized
acttgttcttcctccttccttg

SEQ ID NO: 115451 - DNA, 22 bp, Artificial Sequence
  chemically synthesized
gttcttcctccttccttgaatg

SEQ ID NO: 115452 - DNA, 22 bp, Artificial Sequence
  chemically synthesized
ttcttcctccttccttgaatgt

SEQ ID NO: 115453 - DNA, 22 bp, Artificial Sequence
  chemically synthesized
ttcctccttccttgaatgtttt

SEQ ID NO: 115454 - DNA, 22 bp, Artificial Sequence
  chemically synthesized
cctccttccttgaatgtttttc

SEQ ID NO: 115455 - DNA, 22 bp, Artificial Sequence
  chemically synthesized
ctccttccttgaatgtttttcc

SEQ ID NO: 115456 - DNA, 22 bp, Artificial Sequence
  chemically synthesized
cttccttgaatgtttttcccta

SEQ ID NO: 115457 - DNA, 22 bp, Artificial Sequence
  chemically synthesized
ccttgaatgtttttccctaaga

SEQ ID NO: 115458 - DNA, 22 bp, Artificial Sequence
  chemically synthesized
cttgaatgtttttccctaagat

SEQ ID NO: 115459 - DNA, 22 bp, Artificial Sequence
  chemically synthesized
gaatgtttttccctaagatagc

SEQ ID NO: 115460 - DNA, 22 bp, Artificial Sequence
  chemically synthesized
aatgtttttccctaagatagcc

SEQ ID NO: 115461 - DNA, 22 bp, Artificial Sequence
  chemically synthesized
ttccctaagatagccacacact

SEQ ID NO: 115462 - DNA, 22 bp, Artificial Sequence
  chemically synthesized
tccctaagatagccacacactt

SEQ ID NO: 115463 - DNA, 22 bp, Artificial Sequence
  chemically synthesized
ccctaagatagccacacacttg

SEQ ID NO: 115464 - DNA, 22 bp, Artificial Sequence
  chemically synthesized
cctaagatagccacacacttgc

SEQ ID NO: 115465 - DNA, 22 bp, Artificial Sequence
  chemically synthesized
agatagccacacacttgccctc

SEQ ID NO: 115466 - DNA, 22 bp, Artificial Sequence
  chemically synthesized
gccctctgattttgatttcttc

SEQ ID NO: 115467 - DNA, 22 bp, Artificial Sequence
  chemically synthesized
ccctctgattttgatttcttct

SEQ ID NO: 115468 - DNA, 22 bp, Artificial Sequence
  chemically synthesized
tgattttgatttcttctctaaa

SEQ ID NO: 115469 - DNA, 22 bp, Artificial Sequence
  chemically synthesized
attttgatttcttctctaaaat

SEQ ID NO: 115470 - DNA, 22 bp, Artificial Sequence
  chemically synthesized
tgatttcttctctaaaattacc

SEQ ID NO: 115471 - DNA, 22 bp, Artificial Sequence
  chemically synthesized
gatttcttctctaaaattacct

SEQ ID NO: 115472 - DNA, 22 bp, Artificial Sequence
  chemically synthesized
atttcttctctaaaattaccta

SEQ ID NO: 115473 - DNA, 22 bp, Artificial Sequence
  chemically synthesized
cttctctaaaattacctactca

SEQ ID NO: 115474 - DNA, 22 bp, Artificial Sequence
  chemically synthesized
ttctctaaaattacctactcag

SEQ ID NO: 115475 - DNA, 22 bp, Artificial Sequence
  chemically synthesized
ctctaaaattacctactcagag

SEQ ID NO: 115476 - DNA, 22 bp, Artificial Sequence
  chemically synthesized
tctaaaattacctactcagaga

SEQ ID NO: 115477 - DNA, 22 bp, Artificial Sequence
  chemically synthesized
taaaattacctactcagagagg

SEQ ID NO: 115478 - DNA, 22 bp, Artificial Sequence
  chemically synthesized
aaattacctactcagagaggtc

SEQ ID NO: 115479 - DNA, 22 bp, Artificial Sequence
  chemically synthesized
cctactcagagaggtcttctct

SEQ ID NO: 115480 - DNA, 22 bp, Artificial Sequence
  chemically synthesized
ctcagagaggtcttctctgact

SEQ ID NO: 115481 - DNA, 22 bp, Artificial Sequence
  chemically synthesized
agagaggtcttctctgactacc

SEQ ID NO: 115482 - DNA, 22 bp, Artificial Sequence
  chemically synthesized
ctctgactaccctatataaaat

SEQ ID NO: 115483 - DNA, 22 bp, Artificial Sequence
  chemically synthesized
tctgactaccctatataaaatg

SEQ ID NO: 115484 - DNA, 22 bp, Artificial Sequence
  chemically synthesized
tgactaccctatataaaatgca

SEQ ID NO: 115485 - DNA, 22 bp, Artificial Sequence
  chemically synthesized
actaccctatataaaatgcatc

SEQ ID NO: 115486 - DNA, 22 bp, Artificial Sequence
  chemically synthesized
ccctatataaaatgcatcactc

SEQ ID NO: 115487 - DNA, 22 bp, Artificial Sequence
  chemically synthesized
tataaaatgcatcactcttacc

SEQ ID NO: 115488 - DNA, 22 bp, Artificial Sequence
  chemically synthesized
ttaccttcctcctttgctccct

SEQ ID NO: 115489 - DNA, 22 bp, Artificial Sequence
  chemically synthesized
accttcctcctttgctccctac

SEQ ID NO: 115490 - DNA, 22 bp, Artificial Sequence
  chemically synthesized
ccttcctcctttgctccctact

SEQ ID NO: 115491 - DNA, 22 bp, Artificial Sequence
  chemically synthesized
cctcctttgctccctacttctt

SEQ ID NO: 115492 - DNA, 22 bp, Artificial Sequence
  chemically synthesized
ctcctttgctccctacttcttt

SEQ ID NO: 115493 - DNA, 22 bp, Artificial Sequence
  chemically synthesized
ctttgctccctacttctttatt

SEQ ID NO: 115494 - DNA, 22 bp, Artificial Sequence
  chemically synthesized
tgctccctacttctttattgca

SEQ ID NO: 115495 - DNA, 22 bp, Artificial Sequence
  chemically synthesized
gctccctacttctttattgcat

SEQ ID NO: 115496 - DNA, 22 bp, Artificial Sequence
  chemically synthesized
ctccctacttctttattgcatt

SEQ ID NO: 115497 - DNA, 22 bp, Artificial Sequence
  chemically synthesized
cctacttctttattgcattaca

SEQ ID NO: 115498 - DNA, 22 bp, Artificial Sequence
  chemically synthesized
cttctttattgcattacattac

SEQ ID NO: 115499 - DNA, 22 bp, Artificial Sequence
  chemically synthesized
ctttattgcattacattacctt

SEQ ID NO: 115500 - DNA, 22 bp, Artificial Sequence
  chemically synthesized
tttattgcattacattaccttg

SEQ ID NO: 115501 - DNA, 22 bp, Artificial Sequence
  chemically synthesized
tattgcattacattaccttgca

SEQ ID NO: 115502 - DNA, 22 bp, Artificial Sequence
  chemically synthesized
attgcattacattaccttgcat

SEQ ID NO: 115503 - DNA, 22 bp, Artificial Sequence
  chemically synthesized
ttgcattacattaccttgcatt

SEQ ID NO: 115504 - DNA, 22 bp, Artificial Sequence
  chemically synthesized
cattacattaccttgcattgca

SEQ ID NO: 115505 - DNA, 22 bp, Artificial Sequence
  chemically synthesized
cattaccttgcattgcagtatg

SEQ ID NO: 115506 - DNA, 22 bp, Artificial Sequence
  chemically synthesized
ccttgcattgcagtatgtatgt

SEQ ID NO: 115507 - DNA, 22 bp, Artificial Sequence
  chemically synthesized
gcattgcagtatgtatgtatgt

SEQ ID NO: 115508 - DNA, 22 bp, Artificial Sequence
  chemically synthesized
cattgcagtatgtatgtatgtg

SEQ ID NO: 115509 - DNA, 22 bp, Artificial Sequence
  chemically synthesized
cagtatgtatgtatgtgtttat

SEQ ID NO: 115510 - DNA, 22 bp, Artificial Sequence
  chemically synthesized
atttttgtctctgttctgtttc

SEQ ID NO: 115511 - DNA, 22 bp, Artificial Sequence
  chemically synthesized
tttttgtctctgttctgtttct

SEQ ID NO: 115512 - DNA, 22 bp, Artificial Sequence
  chemically synthesized
ttgtctctgttctgtttctgtt

SEQ ID NO: 115513 - DNA, 22 bp, Artificial Sequence
  chemically synthesized
tgtctctgttctgtttctgttc

SEQ ID NO: 115514 - DNA, 22 bp, Artificial Sequence
  chemically synthesized
gtctctgttctgtttctgttca

SEQ ID NO: 115515 - DNA, 22 bp, Artificial Sequence
  chemically synthesized
tctctgttctgtttctgttcat

SEQ ID NO: 115516 - DNA, 22 bp, Artificial Sequence
  chemically synthesized
tgttctgtttctgttcattgta

SEQ ID NO: 115517 - DNA, 22 bp, Artificial Sequence
  chemically synthesized
ttctgtttctgttcattgtatt

SEQ ID NO: 115518 - DNA, 22 bp, Artificial Sequence
  chemically synthesized
tgtttctgttcattgtattttc

SEQ ID NO: 115519 - DNA, 22 bp, Artificial Sequence
  chemically synthesized
tttctgttcattgtattttcag

SEQ ID NO: 115520 - DNA, 22 bp, Artificial Sequence
  chemically synthesized
ctgttcattgtattttcagtac

SEQ ID NO: 115521 - DNA, 22 bp, Artificial Sequence
  chemically synthesized
tgttcattgtattttcagtacc

SEQ ID NO: 115522 - DNA, 22 bp, Artificial Sequence
  chemically synthesized
ttcattgtattttcagtaccta

SEQ ID NO: 115523 - DNA, 22 bp, Artificial Sequence
  chemically synthesized
attgtattttcagtacctaggt

SEQ ID NO: 115524 - DNA, 22 bp, Artificial Sequence
  chemically synthesized
tattttcagtacctaggtgtaa

SEQ ID NO: 115525 - DNA, 22 bp, Artificial Sequence
  chemically synthesized
tcagtacctaggtgtaaaagta

SEQ ID NO: 115526 - DNA, 22 bp, Artificial Sequence
  chemically synthesized
cagtacctaggtgtaaaagtaa

SEQ ID NO: 115527 - DNA, 22 bp, Artificial Sequence
  chemically synthesized
agtacctaggtgtaaaagtaat

SEQ ID NO: 115528 - DNA, 22 bp, Artificial Sequence
  chemically synthesized
ggtgtaaaagtaattgcagttc

SEQ ID NO: 115529 - DNA, 22 bp, Artificial Sequence
  chemically synthesized
cagttcttgccattgaaagtaa

SEQ ID NO: 115530 - DNA, 22 bp, Artificial Sequence
  chemically synthesized
ttgccattgaaagtaatggtaa

SEQ ID NO: 115531 - DNA, 22 bp, Artificial Sequence
  chemically synthesized
gccattgaaagtaatggtaaaa

SEQ ID NO: 115532 - DNA, 22 bp, Artificial Sequence
  chemically synthesized
ccattgaaagtaatggtaaaaa

SEQ ID NO: 115533 - DNA, 22 bp, Artificial Sequence
  chemically synthesized
aaagtaatggtaaaaaccacaa

SEQ ID NO: 115534 - DNA, 22 bp, Artificial Sequence
  chemically synthesized
cttttgcaccaacctaatagaa

SEQ ID NO: 115535 - DNA, 22 bp, Artificial Sequence
  chemically synthesized
ttgcaccaacctaatagaatta

SEQ ID NO: 115536 - DNA, 22 bp, Artificial Sequence
  chemically synthesized
tgcaccaacctaatagaattat

SEQ ID NO: 115537 - DNA, 22 bp, Artificial Sequence
  chemically synthesized
gcaccaacctaatagaattatg

SEQ ID NO: 115538 - DNA, 22 bp, Artificial Sequence
  chemically synthesized
caccaacctaatagaattatgt

SEQ ID NO: 115539 - DNA, 22 bp, Artificial Sequence
  chemically synthesized
atagaattatgtctgccatgta

SEQ ID NO: 115540 - DNA, 22 bp, Artificial Sequence
  chemically synthesized
tgtctgccatgtaatacaattt

SEQ ID NO: 115541 - DNA, 22 bp, Artificial Sequence
  chemically synthesized
ccatgtaatacaatttcaatat

SEQ ID NO: 115542 - DNA, 22 bp, Artificial Sequence
  chemically synthesized
caatatgtatttattgaatcaa

SEQ ID NO: 115543 - DNA, 22 bp, Artificial Sequence
  chemically synthesized
aatatgtatttattgaatcaat

SEQ ID NO: 115544 - DNA, 22 bp, Artificial Sequence
  chemically synthesized
attgaatcaattaatgaataat

SEQ ID NO: 115545 - DNA, 22 bp, Artificial Sequence
  chemically synthesized
ttgaatcaattaatgaataatt

SEQ ID NO: 115546 - DNA, 22 bp, Artificial Sequence
  chemically synthesized
aatcaattaatgaataattatt

SEQ ID NO: 115547 - DNA, 22 bp, Artificial Sequence
  chemically synthesized
atgaataattattgaaataatt

SEQ ID NO: 115548 - DNA, 22 bp, Artificial Sequence
  chemically synthesized
ttgaaataattgaatattgaaa

SEQ ID NO: 115549 - DNA, 22 bp, Artificial Sequence
  chemically synthesized
aaataattgaatattgaaataa

SEQ ID NO: 115550 - DNA, 22 bp, Artificial Sequence
  chemically synthesized
aatattgaaataattattgaaa

SEQ ID NO: 115551 - DNA, 22 bp, Artificial Sequence
  chemically synthesized
aaataattattgaaataagatt

SEQ ID NO: 115552 - DNA, 22 bp, Artificial Sequence
  chemically synthesized
ttgaaataagattaatggtaat

SEQ ID NO: 115553 - DNA, 22 bp, Artificial Sequence
  chemically synthesized
aaataagattaatggtaatgat

SEQ ID NO: 115554 - DNA, 22 bp, Artificial Sequence
  chemically synthesized
atggtaatgatacatatttaat

SEQ ID NO: 115555 - DNA, 22 bp, Artificial Sequence
  chemically synthesized
aataatttattcaaataatatt

SEQ ID NO: 115556 - DNA, 22 bp, Artificial Sequence
  chemically synthesized
ataatttattcaaataatattt

SEQ ID NO: 115557 - DNA, 22 bp, Artificial Sequence
  chemically synthesized
attcaaataatatttaaaggat

SEQ ID NO: 115558 - DNA, 22 bp, Artificial Sequence
  chemically synthesized
ttcaaataatatttaaaggatt

SEQ ID NO: 115559 - DNA, 22 bp, Artificial Sequence
  chemically synthesized
aaataatatttaaaggattcca

SEQ ID NO: 115560 - DNA, 22 bp, Artificial Sequence
  chemically synthesized
aaaggattccaatgatatggtg

SEQ ID NO: 115561 - DNA, 22 bp, Artificial Sequence
  chemically synthesized
aaggattccaatgatatggtgg

SEQ ID NO: 115562 - DNA, 22 bp, Artificial Sequence
  chemically synthesized
caatgatatggtggctaaaaaa

SEQ ID NO: 115563 - DNA, 22 bp, Artificial Sequence
  chemically synthesized
aaaaagtcaatccctagagcta

SEQ ID NO: 115564 - DNA, 22 bp, Artificial Sequence
  chemically synthesized
gagctaatattaaaattaaaaa

SEQ ID NO: 115565 - DNA, 22 bp, Artificial Sequence
  chemically synthesized
atattaaaattaaaaaagagac

SEQ ID NO: 115566 - DNA, 22 bp, Artificial Sequence
  chemically synthesized
aaattaaaaaagagacagtcat

SEQ ID NO: 115567 - DNA, 22 bp, Artificial Sequence
  chemically synthesized
aaaaagagacagtcatggttta

SEQ ID NO: 115568 - DNA, 22 bp, Artificial Sequence
  chemically synthesized
atgtccacaaggaattcacatt

SEQ ID NO: 115569 - DNA, 22 bp, Artificial Sequence
  chemically synthesized
tgtccacaaggaattcacatta

SEQ ID NO: 115570 - DNA, 22 bp, Artificial Sequence
  chemically synthesized
acattatagaagcaatacagaa

SEQ ID NO: 115571 - DNA, 22 bp, Artificial Sequence
  chemically synthesized
tagaagcaatacagaaattgac

SEQ ID NO: 115572 - DNA, 22 bp, Artificial Sequence
  chemically synthesized
acaatgctgcagggaaaatatc

SEQ ID NO: 115573 - DNA, 22 bp, Artificial Sequence
  chemically synthesized
cagggaaaatatcatggtaatt

SEQ ID NO: 115574 - DNA, 22 bp, Artificial Sequence
  chemically synthesized
gtgcatagtgaactacaggaac

SEQ ID NO: 115575 - DNA, 22 bp, Artificial Sequence
  chemically synthesized
caggaacacataggagagggta

SEQ ID NO: 115576 - DNA, 22 bp, Artificial Sequence
  chemically synthesized
aaactaaacttggggaatttaa

SEQ ID NO: 115577 - DNA, 22 bp, Artificial Sequence
  chemically synthesized
aacttggggaatttaagaaggc

SEQ ID NO: 115578 - DNA, 22 bp, Artificial Sequence
  chemically synthesized
ggggaatttaagaaggccttct

SEQ ID NO: 115579 - DNA, 22 bp, Artificial Sequence
  chemically synthesized
gggaatttaagaaggccttctg

SEQ ID NO: 115580 - DNA, 22 bp, Artificial Sequence
  chemically synthesized
aagaaggccttctgaaggacat

SEQ ID NO: 115581 - DNA, 22 bp, Artificial Sequence
  chemically synthesized
agaaggccttctgaaggacatc

SEQ ID NO: 115582 - DNA, 22 bp, Artificial Sequence
  chemically synthesized
ctgaaggacatcatatctaagc

SEQ ID NO: 115583 - DNA, 22 bp, Artificial Sequence
  chemically synthesized
tgaaggacatcatatctaagct

SEQ ID NO: 115584 - DNA, 22 bp, Artificial Sequence
  chemically synthesized
aaggacatcatatctaagctaa

SEQ ID NO: 115585 - DNA, 22 bp, Artificial Sequence
  chemically synthesized
agctaaggtgggttatattagt

SEQ ID NO: 115586 - DNA, 22 bp, Artificial Sequence
  chemically synthesized
aggtgggttatattagtagaag

SEQ ID NO: 115587 - DNA, 22 bp, Artificial Sequence
  chemically synthesized
tattagtagaagttaactagac

SEQ ID NO: 115588 - DNA, 22 bp, Artificial Sequence
  chemically synthesized
gtagaagttaactagacaaaga

SEQ ID NO: 115589 - DNA, 22 bp, Artificial Sequence
  chemically synthesized
actagacaaagattaagggaaa

SEQ ID NO: 115590 - DNA, 22 bp, Artificial Sequence
  chemically synthesized
gacaaagattaagggaaagcta

SEQ ID NO: 115591 - DNA, 22 bp, Artificial Sequence
  chemically synthesized
agggaaagctatttcaggaaaa

SEQ ID NO: 115592 - DNA, 22 bp, Artificial Sequence
  chemically synthesized
tttcaggaaaaaatgtttttat

SEQ ID NO: 115593 - DNA, 22 bp, Artificial Sequence
  chemically synthesized
caggaaaaaatgtttttattcc

SEQ ID NO: 115594 - DNA, 22 bp, Artificial Sequence
  chemically synthesized
aggaaaaaatgtttttattcca

SEQ ID NO: 115595 - DNA, 22 bp, Artificial Sequence
  chemically synthesized
ttattccaggaagaatgaaaat

SEQ ID NO: 115596 - DNA, 22 bp, Artificial Sequence
  chemically synthesized
tattccaggaagaatgaaaata

SEQ ID NO: 115597 - DNA, 22 bp, Artificial Sequence
  chemically synthesized
attccaggaagaatgaaaatac

SEQ ID NO: 115598 - DNA, 22 bp, Artificial Sequence
  chemically synthesized
ttccaggaagaatgaaaataca

SEQ ID NO: 115599 - DNA, 22 bp, Artificial Sequence
  chemically synthesized
caggaagaatgaaaatacaaat

SEQ ID NO: 115600 - DNA, 22 bp, Artificial Sequence
  chemically synthesized
acctatgagcaagcatactaga

SEQ ID NO: 115601 - DNA, 22 bp, Artificial Sequence
  chemically synthesized
cctatgagcaagcatactagat

SEQ ID NO: 115602 - DNA, 22 bp, Artificial Sequence
  chemically synthesized
tgagcaagcatactagataaac

SEQ ID NO: 115603 - DNA, 22 bp, Artificial Sequence
  chemically synthesized
gataaactggaagaattgttta

SEQ ID NO: 115604 - DNA, 22 bp, Artificial Sequence
  chemically synthesized
gaagaattgtttagtgtcatta

SEQ ID NO: 115605 - DNA, 22 bp, Artificial Sequence
  chemically synthesized
tttagtgtcattaacaccgtga

SEQ ID NO: 115606 - DNA, 22 bp, Artificial Sequence
  chemically synthesized
agtgtcattaacaccgtgaata

SEQ ID NO: 115607 - DNA, 22 bp, Artificial Sequence
  chemically synthesized
gtgtcattaacaccgtgaatat

SEQ ID NO: 115608 - DNA, 22 bp, Artificial Sequence
  chemically synthesized
acaccgtgaatatacagaggaa

SEQ ID NO: 115609 - DNA, 22 bp, Artificial Sequence
  chemically synthesized
ggatagataagaaaataggata

SEQ ID NO: 115610 - DNA, 22 bp, Artificial Sequence
  chemically synthesized
gaatgtcattttaaaccttttt

SEQ ID NO: 115611 - DNA, 22 bp, Artificial Sequence
  chemically synthesized
aatgtcattttaaacctttttt

SEQ ID NO: 115612 - DNA, 22 bp, Artificial Sequence
  chemically synthesized
taaaccttttttacttcattaa

SEQ ID NO: 115613 - DNA, 22 bp, Artificial Sequence
  chemically synthesized
aaaccttttttacttcattaaa

SEQ ID NO: 115614 - DNA, 22 bp, Artificial Sequence
  chemically synthesized
aaccttttttacttcattaaaa

SEQ ID NO: 115615 - DNA, 22 bp, Artificial Sequence
  chemically synthesized
ttttacttcattaaaaacttgt

SEQ ID NO: 115616 - DNA, 22 bp, Artificial Sequence
  chemically synthesized
tttacttcattaaaaacttgtt

SEQ ID NO: 115617 - DNA, 22 bp, Artificial Sequence
  chemically synthesized
ttacttcattaaaaacttgttt

SEQ ID NO: 115618 - DNA, 22 bp, Artificial Sequence
  chemically synthesized
tacttcattaaaaacttgttta

SEQ ID NO: 115619 - DNA, 22 bp, Artificial Sequence
  chemically synthesized
acttcattaaaaacttgtttat

SEQ ID NO: 115620 - DNA, 22 bp, Artificial Sequence
  chemically synthesized
cttcattaaaaacttgtttatg

SEQ ID NO: 115621 - DNA, 22 bp, Artificial Sequence
  chemically synthesized
cattaaaaacttgtttatgtat

SEQ ID NO: 115622 - DNA, 22 bp, Artificial Sequence
  chemically synthesized
attaaaaacttgtttatgtata

SEQ ID NO: 115623 - DNA, 22 bp, Artificial Sequence
  chemically synthesized
aaaacttgtttatgtatacgtc

SEQ ID NO: 115624 - DNA, 22 bp, Artificial Sequence
  chemically synthesized
gtttatgtatacgtctctcttg

SEQ ID NO: 115625 - DNA, 22 bp, Artificial Sequence
  chemically synthesized
tttatgtatacgtctctcttgc

SEQ ID NO: 115626 - DNA, 22 bp, Artificial Sequence
  chemically synthesized
atgtatacgtctctcttgctat

SEQ ID NO: 115627 - DNA, 22 bp, Artificial Sequence
  chemically synthesized
tgtatacgtctctcttgctata

SEQ ID NO: 115628 - DNA, 22 bp, Artificial Sequence
  chemically synthesized
tcttgctatatagtagtcaact

SEQ ID NO: 115629 - DNA, 22 bp, Artificial Sequence
  chemically synthesized
ttgctatatagtagtcaactga

SEQ ID NO: 115630 - DNA, 22 bp, Artificial Sequence
  chemically synthesized
gctatatagtagtcaactgaat

SEQ ID NO: 115631 - DNA, 22 bp, Artificial Sequence
  chemically synthesized
ctatatagtagtcaactgaata

SEQ ID NO: 115632 - DNA, 22 bp, Artificial Sequence
  chemically synthesized
tatagtagtcaactgaatacag

SEQ ID NO: 115633 - DNA, 22 bp, Artificial Sequence
  chemically synthesized
aatacagtagtacaaaagatga

SEQ ID NO: 115634 - DNA, 22 bp, Artificial Sequence
  chemically synthesized
gaatagtcctgaaagagtgatc

SEQ ID NO: 115635 - DNA, 22 bp, Artificial Sequence
  chemically synthesized
aaagagtgatctgaattagaat

SEQ ID NO: 115636 - DNA, 22 bp, Artificial Sequence
  chemically synthesized
aattagaatagcatcaatgaag

SEQ ID NO: 115637 - DNA, 22 bp, Artificial Sequence
  chemically synthesized
gaatagcatcaatgaaggtgac

SEQ ID NO: 115638 - DNA, 22 bp, Artificial Sequence
  chemically synthesized
gaggtattcagtaaacagaaac

SEQ ID NO: 115639 - DNA, 22 bp, Artificial Sequence
  chemically synthesized
aggtattcagtaaacagaaacc

SEQ ID NO: 115640 - DNA, 22 bp, Artificial Sequence
  chemically synthesized
agtaaacagaaaccctaggact

SEQ ID NO: 115641 - DNA, 22 bp, Artificial Sequence
  chemically synthesized
ggacttggtgattggttgatta

SEQ ID NO: 115642 - DNA, 22 bp, Artificial Sequence
  chemically synthesized
ggtgattggttgattagatact

SEQ ID NO: 115643 - DNA, 22 bp, Artificial Sequence
  chemically synthesized
gtgattggttgattagatacta

SEQ ID NO: 115644 - DNA, 22 bp, Artificial Sequence
  chemically synthesized
gttgattagatactatggagag

SEQ ID NO: 115645 - DNA, 22 bp, Artificial Sequence
  chemically synthesized
attagatactatggagagatgt

SEQ ID NO: 115646 - DNA, 22 bp, Artificial Sequence
  chemically synthesized
gatactatggagagatgtgata

SEQ ID NO: 115647 - DNA, 22 bp, Artificial Sequence
  chemically synthesized
tggagagatgtgatatggagaa

SEQ ID NO: 115648 - DNA, 22 bp, Artificial Sequence
  chemically synthesized
acataaaacatgacatttgact

SEQ ID NO: 115649 - DNA, 22 bp, Artificial Sequence
  chemically synthesized
gacttgagccactgagataatg

SEQ ID NO: 115650 - DNA, 22 bp, Artificial Sequence
  chemically synthesized
acttgagccactgagataatga

SEQ ID NO: 115651 - DNA, 22 bp, Artificial Sequence
  chemically synthesized
gagccactgagataatgaaaag

SEQ ID NO: 115652 - DNA, 22 bp, Artificial Sequence
  chemically synthesized
agccactgagataatgaaaagt

SEQ ID NO: 115653 - DNA, 22 bp, Artificial Sequence
  chemically synthesized
agataatgaaaagtacagatgt

SEQ ID NO: 115654 - DNA, 22 bp, Artificial Sequence
  chemically synthesized
ctagagtctggaaatcaaaaga

SEQ ID NO: 115655 - DNA, 22 bp, Artificial Sequence
  chemically synthesized
gagtctggaaatcaaaagagag

SEQ ID NO: 115656 - DNA, 22 bp, Artificial Sequence
  chemically synthesized
gaaatcaaaagagagaaagaca

SEQ ID NO: 115657 - DNA, 22 bp, Artificial Sequence
  chemically synthesized
tggaattatatatttgttattt

SEQ ID NO: 115658 - DNA, 22 bp, Artificial Sequence
  chemically synthesized
gaattatatatttgttatttat

SEQ ID NO: 115659 - DNA, 22 bp, Artificial Sequence
  chemically synthesized
tatatttgttatttatcaatat

SEQ ID NO: 115660 - DNA, 22 bp, Artificial Sequence
  chemically synthesized
gttatttatcaatatatggatg

SEQ ID NO: 115661 - DNA, 22 bp, Artificial Sequence
  chemically synthesized
ttatttatcaatatatggatgg

SEQ ID NO: 115662 - DNA, 22 bp, Artificial Sequence
  chemically synthesized
tttatcaatatatggatggtaa

SEQ ID NO: 115663 - DNA, 22 bp, Artificial Sequence
  chemically synthesized
atcaatatatggatggtaaatg

SEQ ID NO: 115664 - DNA, 22 bp, Artificial Sequence
  chemically synthesized
tcaatatatggatggtaaatga

SEQ ID NO: 115665 - DNA, 22 bp, Artificial Sequence
  chemically synthesized
agaagaaataatagaatatggc

SEQ ID NO: 115666 - DNA, 22 bp, Artificial Sequence
  chemically synthesized
ccaaggatgggaagaactatac

SEQ ID NO: 115667 - DNA, 22 bp, Artificial Sequence
  chemically synthesized
tacttaagggttgagcaataaa

SEQ ID NO: 115668 - DNA, 22 bp, Artificial Sequence
  chemically synthesized
aagggttgagcaataaaggcac

SEQ ID NO: 115669 - DNA, 22 bp, Artificial Sequence
  chemically synthesized
agggttgagcaataaaggcaca

SEQ ID NO: 115670 - DNA, 22 bp, Artificial Sequence
  chemically synthesized
agcaataaaggcacaccagcaa

SEQ ID NO: 115671 - DNA, 22 bp, Artificial Sequence
  chemically synthesized
aaataattgaaatacagaggaa

SEQ ID NO: 115672 - DNA, 22 bp, Artificial Sequence
  chemically synthesized
aaatacagaggaaaactggtga

SEQ ID NO: 115673 - DNA, 22 bp, Artificial Sequence
  chemically synthesized
gtgagggcgaggttatcaaaga

SEQ ID NO: 115674 - DNA, 22 bp, Artificial Sequence
  chemically synthesized
tcaaagaaagttcaataaagta

SEQ ID NO: 115675 - DNA, 22 bp, Artificial Sequence
  chemically synthesized
aataaagtagtgagattggcag

SEQ ID NO: 115676 - DNA, 22 bp, Artificial Sequence
  chemically synthesized
gcagaattcataagggtggagt

SEQ ID NO: 115677 - DNA, 22 bp, Artificial Sequence
  chemically synthesized
ataagggtggagtagataatac

SEQ ID NO: 115678 - DNA, 22 bp, Artificial Sequence
  chemically synthesized
aaggtgatgatgaccatggtac

SEQ ID NO: 115679 - DNA, 22 bp, Artificial Sequence
  chemically synthesized
cttgtgatgttgtgaatgttag

SEQ ID NO: 115680 - DNA, 22 bp, Artificial Sequence
  chemically synthesized
gtgatgttgtgaatgttagtga

SEQ ID NO: 115681 - DNA, 22 bp, Artificial Sequence
  chemically synthesized
tgatgttgtgaatgttagtgaa

SEQ ID NO: 115682 - DNA, 22 bp, Artificial Sequence
  chemically synthesized
tgaatgttagtgaagctgaaga

SEQ ID NO: 115683 - DNA, 22 bp, Artificial Sequence
  chemically synthesized
gtgaagctgaagaattaataac

SEQ ID NO: 115684 - DNA, 22 bp, Artificial Sequence
  chemically synthesized
aagaattaataaccagaaatat

SEQ ID NO: 115685 - DNA, 22 bp, Artificial Sequence
  chemically synthesized
ataaccagaaatatccatttat

SEQ ID NO: 115686 - DNA, 22 bp, Artificial Sequence
  chemically synthesized
attttcagctcaatccccgagg

SEQ ID NO: 115687 - DNA, 22 bp, Artificial Sequence
  chemically synthesized
ttttcagctcaatccccgagga

SEQ ID NO: 115688 - DNA, 22 bp, Artificial Sequence
  chemically synthesized
tcagctcaatccccgaggaatg

SEQ ID NO: 115689 - DNA, 22 bp, Artificial Sequence
  chemically synthesized
cagctcaatccccgaggaatgt

SEQ ID NO: 115690 - DNA, 22 bp, Artificial Sequence
  chemically synthesized
agctcaatccccgaggaatgtc

SEQ ID NO: 115691 - DNA, 22 bp, Artificial Sequence
  chemically synthesized
aatccccgaggaatgtcagtcc

SEQ ID NO: 115692 - DNA, 22 bp, Artificial Sequence
  chemically synthesized
gctcagtcctcaattcatgctg

SEQ ID NO: 115693 - DNA, 22 bp, Artificial Sequence
  chemically synthesized
agtcctcaattcatgctgctat

SEQ ID NO: 115694 - DNA, 22 bp, Artificial Sequence
  chemically synthesized
aattcatgctgctatccaacat

SEQ ID NO: 115695 - DNA, 22 bp, Artificial Sequence
  chemically synthesized
atgctgctatccaacattactc

SEQ ID NO: 115696 - DNA, 22 bp, Artificial Sequence
  chemically synthesized
ctatccaacattactcagttta

SEQ ID NO: 115697 - DNA, 22 bp, Artificial Sequence
  chemically synthesized
tccaacattactcagtttagcc

SEQ ID NO: 115698 - DNA, 22 bp, Artificial Sequence
  chemically synthesized
ctcagtttagccccatattcta

SEQ ID NO: 115699 - DNA, 22 bp, Artificial Sequence
  chemically synthesized
agtttagccccatattctatct

SEQ ID NO: 115700 - DNA, 22 bp, Artificial Sequence
  chemically synthesized
agccccatattctatctcacca

SEQ ID NO: 115701 - DNA, 22 bp, Artificial Sequence
  chemically synthesized
gccccatattctatctcaccag

SEQ ID NO: 115702 - DNA, 22 bp, Artificial Sequence
  chemically synthesized
tatctcaccagctttcctggat

SEQ ID NO: 115703 - DNA, 22 bp, Artificial Sequence
  chemically synthesized
tctcaccagctttcctggattg

SEQ ID NO: 115704 - DNA, 22 bp, Artificial Sequence
  chemically synthesized
accagctttcctggattggaag

SEQ ID NO: 115705 - DNA, 22 bp, Artificial Sequence
  chemically synthesized
tcctggattggaaggcatcaaa

SEQ ID NO: 115706 - DNA, 22 bp, Artificial Sequence
  chemically synthesized
cctggattggaaggcatcaaac

SEQ ID NO: 115707 - DNA, 22 bp, Artificial Sequence
  chemically synthesized
ctggattggaaggcatcaaaca

SEQ ID NO: 115708 - DNA, 22 bp, Artificial Sequence
  chemically synthesized
gattggaaggcatcaaacactg

SEQ ID NO: 115709 - DNA, 22 bp, Artificial Sequence
  chemically synthesized
gaaggcatcaaacactggattt

SEQ ID NO: 115710 - DNA, 22 bp, Artificial Sequence
  chemically synthesized
gattttcatcccctttttcttt

SEQ ID NO: 115711 - DNA, 22 bp, Artificial Sequence
  chemically synthesized
tcatcccctttttctttatgta

SEQ ID NO: 115712 - DNA, 22 bp, Artificial Sequence
  chemically synthesized
catcccctttttctttatgtac

SEQ ID NO: 115713 - DNA, 22 bp, Artificial Sequence
  chemically synthesized
atcccctttttctttatgtaca

SEQ ID NO: 115714 - DNA, 22 bp, Artificial Sequence
  chemically synthesized
tttctttatgtacatggttgcc

SEQ ID NO: 115715 - DNA, 22 bp, Artificial Sequence
  chemically synthesized
ttctttatgtacatggttgcca

SEQ ID NO: 115716 - DNA, 22 bp, Artificial Sequence
  chemically synthesized
tctttatgtacatggttgccat

SEQ ID NO: 115717 - DNA, 22 bp, Artificial Sequence
  chemically synthesized
ctttatgtacatggttgccatc

SEQ ID NO: 115718 - DNA, 22 bp, Artificial Sequence
  chemically synthesized
tttatgtacatggttgccatct

SEQ ID NO: 115719 - DNA, 22 bp, Artificial Sequence
  chemically synthesized
tatgtacatggttgccatctca

SEQ ID NO: 115720 - DNA, 22 bp, Artificial Sequence
  chemically synthesized
atgtacatggttgccatctcag

SEQ ID NO: 115721 - DNA, 22 bp, Artificial Sequence
  chemically synthesized
tgtacatggttgccatctcagg

SEQ ID NO: 115722 - DNA, 22 bp, Artificial Sequence
  chemically synthesized
ccatctcaggcaattgtttcat

SEQ ID NO: 115723 - DNA, 22 bp, Artificial Sequence
  chemically synthesized
aggcaattgtttcattctgatc

SEQ ID NO: 115724 - DNA, 22 bp, Artificial Sequence
  chemically synthesized
tttcattctgatcattattaag

SEQ ID NO: 115725 - DNA, 22 bp, Artificial Sequence
  chemically synthesized
cattctgatcattattaagacc

SEQ ID NO: 115726 - DNA, 22 bp, Artificial Sequence
  chemically synthesized
attctgatcattattaagacca

SEQ ID NO: 115727 - DNA, 22 bp, Artificial Sequence
  chemically synthesized
tgatcattattaagaccaaccc

SEQ ID NO: 115728 - DNA, 22 bp, Artificial Sequence
  chemically synthesized
atcattattaagaccaaccctc

SEQ ID NO: 115729 - DNA, 22 bp, Artificial Sequence
  chemically synthesized
ttaagaccaaccctcgtctgca

SEQ ID NO: 115730 - DNA, 22 bp, Artificial Sequence
  chemically synthesized
agaccaaccctcgtctgcacac

SEQ ID NO: 115731 - DNA, 22 bp, Artificial Sequence
  chemically synthesized
gtctgcacacacccatgtacta

SEQ ID NO: 115732 - DNA, 22 bp, Artificial Sequence
  chemically synthesized
cacacacccatgtactatctac

SEQ ID NO: 115733 - DNA, 22 bp, Artificial Sequence
  chemically synthesized
tctactatccttgctggccctc

SEQ ID NO: 115734 - DNA, 22 bp, Artificial Sequence
  chemically synthesized
ctatccttgctggccctcactg

SEQ ID NO: 115735 - DNA, 22 bp, Artificial Sequence
  chemically synthesized
tccttgctggccctcactgacc

SEQ ID NO: 115736 - DNA, 22 bp, Artificial Sequence
  chemically synthesized
gctggccctcactgacctgggg

SEQ ID NO: 115737 - DNA, 22 bp, Artificial Sequence
  chemically synthesized
ctggccctcactgacctggggc

SEQ ID NO: 115738 - DNA, 22 bp, Artificial Sequence
  chemically synthesized
gccctcactgacctggggctgt

SEQ ID NO: 115739 - DNA, 22 bp, Artificial Sequence
  chemically synthesized
actgacctggggctgtgtgtgt

SEQ ID NO: 115740 - DNA, 22 bp, Artificial Sequence
  chemically synthesized
acctggggctgtgtgtgtccac

SEQ ID NO: 115741 - DNA, 22 bp, Artificial Sequence
  chemically synthesized
gggctgtgtgtgtccacgttgc

SEQ ID NO: 115742 - DNA, 22 bp, Artificial Sequence
  chemically synthesized
tgtgtgtccacgttgcccacca

SEQ ID NO: 115743 - DNA, 22 bp, Artificial Sequence
  chemically synthesized
cccaccactatggggatcttct

SEQ ID NO: 115744 - DNA, 22 bp, Artificial Sequence
  chemically synthesized
tggggatcttctggtttaactc

SEQ ID NO: 115745 - DNA, 22 bp, Artificial Sequence
  chemically synthesized
ctggtttaactcccatagtatc

SEQ ID NO: 115746 - DNA, 22 bp, Artificial Sequence
  chemically synthesized
tggtttaactcccatagtatct

SEQ ID NO: 115747 - DNA, 22 bp, Artificial Sequence
  chemically synthesized
gtttaactcccatagtatctac

SEQ ID NO: 115748 - DNA, 22 bp, Artificial Sequence
  chemically synthesized
aactcccatagtatctactttg

SEQ ID NO: 115749 - DNA, 22 bp, Artificial Sequence
  chemically synthesized
actcccatagtatctactttgg

SEQ ID NO: 115750 - DNA, 22 bp, Artificial Sequence
  chemically synthesized
ccatagtatctactttggagcg

SEQ ID NO: 115751 - DNA, 22 bp, Artificial Sequence
  chemically synthesized
ctttggagcgtgtcaaatccag

SEQ ID NO: 115752 - DNA, 22 bp, Artificial Sequence
  chemically synthesized
tggagcgtgtcaaatccagatg

SEQ ID NO: 115753 - DNA, 22 bp, Artificial Sequence
  chemically synthesized
ggagcgtgtcaaatccagatgt

SEQ ID NO: 115754 - DNA, 22 bp, Artificial Sequence
  chemically synthesized
gagcgtgtcaaatccagatgtt

SEQ ID NO: 115755 - DNA, 22 bp, Artificial Sequence
  chemically synthesized
tgcatccactctttttccttca

SEQ ID NO: 115756 - DNA, 22 bp, Artificial Sequence
  chemically synthesized
catccactctttttccttcatg

SEQ ID NO: 115757 - DNA, 22 bp, Artificial Sequence
  chemically synthesized
tttttccttcatggagtcctca

SEQ ID NO: 115758 - DNA, 22 bp, Artificial Sequence
  chemically synthesized
tttccttcatggagtcctcagt

SEQ ID NO: 115759 - DNA, 22 bp, Artificial Sequence
  chemically synthesized
ttccttcatggagtcctcagtg

SEQ ID NO: 115760 - DNA, 22 bp, Artificial Sequence
  chemically synthesized
tccttcatggagtcctcagtgc

SEQ ID NO: 115761 - DNA, 22 bp, Artificial Sequence
  chemically synthesized
ccttcatggagtcctcagtgct

SEQ ID NO: 115762 - DNA, 22 bp, Artificial Sequence
  chemically synthesized
cttcatggagtcctcagtgctc

SEQ ID NO: 115763 - DNA, 22 bp, Artificial Sequence
  chemically synthesized
catggagtcctcagtgctcctc

SEQ ID NO: 115764 - DNA, 22 bp, Artificial Sequence
  chemically synthesized
atggagtcctcagtgctcctca

SEQ ID NO: 115765 - DNA, 22 bp, Artificial Sequence
  chemically synthesized
agtgctcctcatgatgtccttt

SEQ ID NO: 115766 - DNA, 22 bp, Artificial Sequence
  chemically synthesized
ctcatgatgtcctttgaccgcc

SEQ ID NO: 115767 - DNA, 22 bp, Artificial Sequence
  chemically synthesized
atgatgtcctttgaccgccttg

SEQ ID NO: 115768 - DNA, 22 bp, Artificial Sequence
  chemically synthesized
tgaccgccttgtggccatctgc

SEQ ID NO: 115769 - DNA, 22 bp, Artificial Sequence
  chemically synthesized
gaccgccttgtggccatctgcc

SEQ ID NO: 115770 - DNA, 22 bp, Artificial Sequence
  chemically synthesized
accgccttgtggccatctgcca

SEQ ID NO: 115771 - DNA, 22 bp, Artificial Sequence
  chemically synthesized
gtggccatctgccaccctctga

SEQ ID NO: 115772 - DNA, 22 bp, Artificial Sequence
  chemically synthesized
tggccatctgccaccctctgag

SEQ ID NO: 115773 - DNA, 22 bp, Artificial Sequence
  chemically synthesized
ccaccctctgaggtattcggtc

SEQ ID NO: 115774 - DNA, 22 bp, Artificial Sequence
  chemically synthesized
tgaggtattcggtcattatcac

SEQ ID NO: 115775 - DNA, 22 bp, Artificial Sequence
  chemically synthesized
aggtattcggtcattatcactg

SEQ ID NO: 115776 - DNA, 22 bp, Artificial Sequence
  chemically synthesized
ggtcattatcactggccagcaa

SEQ ID NO: 115777 - DNA, 22 bp, Artificial Sequence
  chemically synthesized
tcactggccagcaagtggtcag

SEQ ID NO: 115778 - DNA, 22 bp, Artificial Sequence
  chemically synthesized
gccagcaagtggtcagagcagg

SEQ ID NO: 115779 - DNA, 22 bp, Artificial Sequence
  chemically synthesized
attgtcatcttccggggacctg

SEQ ID NO: 115780 - DNA, 22 bp, Artificial Sequence
  chemically synthesized
tcatcttccggggacctgtggc

SEQ ID NO: 115781 - DNA, 22 bp, Artificial Sequence
  chemically synthesized
ccggggacctgtggccactatc

SEQ ID NO: 115782 - DNA, 22 bp, Artificial Sequence
  chemically synthesized
cggggacctgtggccactatcc

SEQ ID NO: 115783 - DNA, 22 bp, Artificial Sequence
  chemically synthesized
tggccactatccctattgtcct

SEQ ID NO: 115784 - DNA, 22 bp, Artificial Sequence
  chemically synthesized
tccctattgtcctcctcctgaa

SEQ ID NO: 115785 - DNA, 22 bp, Artificial Sequence
  chemically synthesized
ttgtcctcctcctgaaggcttt

SEQ ID NO: 115786 - DNA, 22 bp, Artificial Sequence
  chemically synthesized
tcctcctcctgaaggcttttcc

SEQ ID NO: 115787 - DNA, 22 bp, Artificial Sequence
  chemically synthesized
ctcctgaaggcttttccctact

SEQ ID NO: 115788 - DNA, 22 bp, Artificial Sequence
  chemically synthesized
ctgaaggcttttccctactgtg

SEQ ID NO: 115789 - DNA, 22 bp, Artificial Sequence
  chemically synthesized
aaggcttttccctactgtggat

SEQ ID NO: 115790 - DNA, 22 bp, Artificial Sequence
  chemically synthesized
ttccctactgtggatctgtggt

SEQ ID NO: 115791 - DNA, 22 bp, Artificial Sequence
  chemically synthesized
tccctactgtggatctgtggtc

SEQ ID NO: 115792 - DNA, 22 bp, Artificial Sequence
  chemically synthesized
ccctactgtggatctgtggtcc

SEQ ID NO: 115793 - DNA, 22 bp, Artificial Sequence
  chemically synthesized
cctactgtggatctgtggtcct

SEQ ID NO: 115794 - DNA, 22 bp, Artificial Sequence
  chemically synthesized
ctgtggatctgtggtcctctcc

SEQ ID NO: 115795 - DNA, 22 bp, Artificial Sequence
  chemically synthesized
tggatctgtggtcctctcccac

SEQ ID NO: 115796 - DNA, 22 bp, Artificial Sequence
  chemically synthesized
tggtcctctcccactcattttg

SEQ ID NO: 115797 - DNA, 22 bp, Artificial Sequence
  chemically synthesized
tcccactcattttgcctgcacc

SEQ ID NO: 115798 - DNA, 22 bp, Artificial Sequence
  chemically synthesized
ccactcattttgcctgcaccag

SEQ ID NO: 115799 - DNA, 22 bp, Artificial Sequence
  chemically synthesized
attttgcctgcaccaggaagtg

SEQ ID NO: 115800 - DNA, 22 bp, Artificial Sequence
  chemically synthesized
tgcctgcaccaggaagtgatac

SEQ ID NO: 115801 - DNA, 22 bp, Artificial Sequence
  chemically synthesized
gcctgcaccaggaagtgataca

SEQ ID NO: 115802 - DNA, 22 bp, Artificial Sequence
  chemically synthesized
cctgcaccaggaagtgatacag

SEQ ID NO: 115803 - DNA, 22 bp, Artificial Sequence
  chemically synthesized
caccaggaagtgatacagctgg

SEQ ID NO: 115804 - DNA, 22 bp, Artificial Sequence
  chemically synthesized
gcctgcacagatatcaccttca

SEQ ID NO: 115805 - DNA, 22 bp, Artificial Sequence
  chemically synthesized
cacagatatcaccttcaataat

SEQ ID NO: 115806 - DNA, 22 bp, Artificial Sequence
  chemically synthesized
caataatctgtatggactgatg

SEQ ID NO: 115807 - DNA, 22 bp, Artificial Sequence
  chemically synthesized
aataatctgtatggactgatgg

SEQ ID NO: 115808 - DNA, 22 bp, Artificial Sequence
  chemically synthesized
tatggactgatggtggtagttt

SEQ ID NO: 115809 - DNA, 22 bp, Artificial Sequence
  chemically synthesized
atggtggtagttttcactgtga

SEQ ID NO: 115810 - DNA, 22 bp, Artificial Sequence
  chemically synthesized
tcactgtgatgctggacctggt

SEQ ID NO: 115811 - DNA, 22 bp, Artificial Sequence
  chemically synthesized
cactgtgatgctggacctggtg

SEQ ID NO: 115812 - DNA, 22 bp, Artificial Sequence
  chemically synthesized
actgtgatgctggacctggtgc

SEQ ID NO: 115813 - DNA, 22 bp, Artificial Sequence
  chemically synthesized
tgatgctggacctggtgctcat

SEQ ID NO: 115814 - DNA, 22 bp, Artificial Sequence
  chemically synthesized
gacctggtgctcatcgcactgt

SEQ ID NO: 115815 - DNA, 22 bp, Artificial Sequence
  chemically synthesized
gtgctcatcgcactgtcctatg

SEQ ID NO: 115816 - DNA, 22 bp, Artificial Sequence
  chemically synthesized
atcgcactgtcctatggactca

SEQ ID NO: 115817 - DNA, 22 bp, Artificial Sequence
  chemically synthesized
tcctatggactcatcctgcaca

SEQ ID NO: 115818 - DNA, 22 bp, Artificial Sequence
  chemically synthesized
tggactcatcctgcacacagta

SEQ ID NO: 115819 - DNA, 22 bp, Artificial Sequence
  chemically synthesized
atcctgcacacagtagcaggcc

SEQ ID NO: 115820 - DNA, 22 bp, Artificial Sequence
  chemically synthesized
cacacagtagcaggcctggcct

SEQ ID NO: 115821 - DNA, 22 bp, Artificial Sequence
  chemically synthesized
gcctcccaagaggagcagcgcc

SEQ ID NO: 115822 - DNA, 22 bp, Artificial Sequence
  chemically synthesized
ccaagaggagcagcgccgtgcc

SEQ ID NO: 115823 - DNA, 22 bp, Artificial Sequence
  chemically synthesized
tcagacatgcaccgctcctctc

SEQ ID NO: 115824 - DNA, 22 bp, Artificial Sequence
  chemically synthesized
cagacatgcaccgctcctctct

SEQ ID NO: 115825 - DNA, 22 bp, Artificial Sequence
  chemically synthesized
agacatgcaccgctcctctctg

SEQ ID NO: 115826 - DNA, 22 bp, Artificial Sequence
  chemically synthesized
ctctctgtgctgtgctagtatt

SEQ ID NO: 115827 - DNA, 22 bp, Artificial Sequence
  chemically synthesized
tctgtgctgtgctagtattctt

SEQ ID NO: 115828 - DNA, 22 bp, Artificial Sequence
  chemically synthesized
tgtgctgtgctagtattctttg

SEQ ID NO: 115829 - DNA, 22 bp, Artificial Sequence
  chemically synthesized
tgctgtgctagtattctttgtg

SEQ ID NO: 115830 - DNA, 22 bp, Artificial Sequence
  chemically synthesized
tgctagtattctttgtgcccat

SEQ ID NO: 115831 - DNA, 22 bp, Artificial Sequence
  chemically synthesized
gtattctttgtgcccatgatgg

SEQ ID NO: 115832 - DNA, 22 bp, Artificial Sequence
  chemically synthesized
tttgtgcccatgatggggctgt

SEQ ID NO: 115833 - DNA, 22 bp, Artificial Sequence
  chemically synthesized
tgtgcccatgatggggctgtcc

SEQ ID NO: 115834 - DNA, 22 bp, Artificial Sequence
  chemically synthesized
gtgcccatgatggggctgtccc

SEQ ID NO: 115835 - DNA, 22 bp, Artificial Sequence
  chemically synthesized
tgcccatgatggggctgtccct

SEQ ID NO: 115836 - DNA, 22 bp, Artificial Sequence
  chemically synthesized
tccctggtgcaccgttttggga

SEQ ID NO: 115837 - DNA, 22 bp, Artificial Sequence
  chemically synthesized
gtgcaccgttttgggaagcatg

SEQ ID NO: 115838 - DNA, 22 bp, Artificial Sequence
  chemically synthesized
tgggaagcatgccccacctgct

SEQ ID NO: 115839 - DNA, 22 bp, Artificial Sequence
  chemically synthesized
gggaagcatgccccacctgcta

SEQ ID NO: 115840 - DNA, 22 bp, Artificial Sequence
  chemically synthesized
ggaagcatgccccacctgctat

SEQ ID NO: 115841 - DNA, 22 bp, Artificial Sequence
  chemically synthesized
ctattcatcttcttatggccaa

SEQ ID NO: 115842 - DNA, 22 bp, Artificial Sequence
  chemically synthesized
ttcatcttcttatggccaatgt

SEQ ID NO: 115843 - DNA, 22 bp, Artificial Sequence
  chemically synthesized
atcttcttatggccaatgtcta

SEQ ID NO: 115844 - DNA, 22 bp, Artificial Sequence
  chemically synthesized
cttatggccaatgtctaccttt

SEQ ID NO: 115845 - DNA, 22 bp, Artificial Sequence
  chemically synthesized
ttatggccaatgtctacctttt

SEQ ID NO: 115846 - DNA, 22 bp, Artificial Sequence
  chemically synthesized
atggccaatgtctacctttttg

SEQ ID NO: 115847 - DNA, 22 bp, Artificial Sequence
  chemically synthesized
tggccaatgtctacctttttgt

SEQ ID NO: 115848 - DNA, 22 bp, Artificial Sequence
  chemically synthesized
cctttttgtgcctcccatgctt

SEQ ID NO: 115849 - DNA, 22 bp, Artificial Sequence
  chemically synthesized
tttgtgcctcccatgcttaacc

SEQ ID NO: 115850 - DNA, 22 bp, Artificial Sequence
  chemically synthesized
ttgtgcctcccatgcttaaccc

SEQ ID NO: 115851 - DNA, 22 bp, Artificial Sequence
  chemically synthesized
tgtgcctcccatgcttaaccca

SEQ ID NO: 115852 - DNA, 22 bp, Artificial Sequence
  chemically synthesized
gtgcctcccatgcttaacccaa

SEQ ID NO: 115853 - DNA, 22 bp, Artificial Sequence
  chemically synthesized
tgcctcccatgcttaacccaat

SEQ ID NO: 115854 - DNA, 22 bp, Artificial Sequence
  chemically synthesized
ccatgcttaacccaatcatata

SEQ ID NO: 115855 - DNA, 22 bp, Artificial Sequence
  chemically synthesized
aacccaatcatatacagcatta

SEQ ID NO: 115856 - DNA, 22 bp, Artificial Sequence
  chemically synthesized
acccaatcatatacagcattaa

SEQ ID NO: 115857 - DNA, 22 bp, Artificial Sequence
  chemically synthesized
agaccaaggagatccaccgtgc

SEQ ID NO: 115858 - DNA, 22 bp, Artificial Sequence
  chemically synthesized
tcaagttcctaggtcttaaaaa

SEQ ID NO: 115859 - DNA, 22 bp, Artificial Sequence
  chemically synthesized
ctaggtcttaaaaaggccagta

SEQ ID NO: 115860 - DNA, 22 bp, Artificial Sequence
  chemically synthesized
ggtcttaaaaaggccagtaaat

SEQ ID NO: 115861 - DNA, 22 bp, Artificial Sequence
  chemically synthesized
aaaaaggccagtaaatgagtcc

SEQ ID NO: 115862 - DNA, 22 bp, Artificial Sequence
  chemically synthesized
aaaaggccagtaaatgagtcct

SEQ ID NO: 115863 - DNA, 22 bp, Artificial Sequence
  chemically synthesized
gggctaaaactccccctagagg

SEQ ID NO: 115864 - DNA, 22 bp, Artificial Sequence
  chemically synthesized
aaactccccctagaggcctata

SEQ ID NO: 115865 - DNA, 22 bp, Artificial Sequence
  chemically synthesized
cccctagaggcctataagaagg

SEQ ID NO: 115866 - DNA, 22 bp, Artificial Sequence
  chemically synthesized
gaggcctataagaaggccccaa

SEQ ID NO: 115867 - DNA, 22 bp, Artificial Sequence
  chemically synthesized
taagaaggccccaaattggact

SEQ ID NO: 115868 - DNA, 22 bp, Artificial Sequence
  chemically synthesized
gactgaaaatttggagtattga

SEQ ID NO: 115869 - DNA, 22 bp, Artificial Sequence
  chemically synthesized
aaaatttggagtattgagtata

SEQ ID NO: 115870 - DNA, 22 bp, Artificial Sequence
  chemically synthesized
ggagtattgagtatatagcatg

SEQ ID NO: 115871 - DNA, 22 bp, Artificial Sequence
  chemically synthesized
gagtattgagtatatagcatgc

SEQ ID NO: 115872 - DNA, 22 bp, Artificial Sequence
  chemically synthesized
agtatatagcatgctcttaaag

SEQ ID NO: 115873 - DNA, 22 bp, Artificial Sequence
  chemically synthesized
ttaaagattttttgcccctgtc

SEQ ID NO: 115874 - DNA, 22 bp, Artificial Sequence
  chemically synthesized
aaagattttttgcccctgtcct

SEQ ID NO: 115875 - DNA, 22 bp, Artificial Sequence
  chemically synthesized
aagattttttgcccctgtccta

SEQ ID NO: 115876 - DNA, 22 bp, Artificial Sequence
  chemically synthesized
tttgcccctgtcctaaataaaa

SEQ ID NO: 115877 - DNA, 22 bp, Artificial Sequence
  chemically synthesized
ttgcccctgtcctaaataaaat

SEQ ID NO: 115878 - DNA, 22 bp, Artificial Sequence
  chemically synthesized
tgcccctgtcctaaataaaata

SEQ ID NO: 115879 - DNA, 22 bp, Artificial Sequence
  chemically synthesized
gcccctgtcctaaataaaatat

SEQ ID NO: 115880 - DNA, 22 bp, Artificial Sequence
  chemically synthesized
cccctgtcctaaataaaatatg

SEQ ID NO: 115881 - DNA, 22 bp, Artificial Sequence
  chemically synthesized
tcctaaataaaatatgggcaaa

SEQ ID NO: 115882 - DNA, 22 bp, Artificial Sequence
  chemically synthesized
aataaaatatgggcaaatttat

SEQ ID NO: 115883 - DNA, 22 bp, Artificial Sequence
  chemically synthesized
atgtctggagttgtggctttaa

SEQ ID NO: 115884 - DNA, 22 bp, Artificial Sequence
  chemically synthesized
tgtctggagttgtggctttaaa

SEQ ID NO: 115885 - DNA, 22 bp, Artificial Sequence
  chemically synthesized
gagttgtggctttaaaaaactg

SEQ ID NO: 115886 - DNA, 22 bp, Artificial Sequence
  chemically synthesized
tggctttaaaaaactgaacttc

SEQ ID NO: 115887 - DNA, 22 bp, Artificial Sequence
  chemically synthesized
taaaaaactgaacttctcttgc

SEQ ID NO: 115888 - DNA, 22 bp, Artificial Sequence
  chemically synthesized
aaaaaactgaacttctcttgct

SEQ ID NO: 115889 - DNA, 22 bp, Artificial Sequence
  chemically synthesized
aaaaactgaacttctcttgctt

SEQ ID NO: 115890 - DNA, 22 bp, Artificial Sequence
  chemically synthesized
aacttctcttgcttagatttta

SEQ ID NO: 115891 - DNA, 22 bp, Artificial Sequence
  chemically synthesized
ctcttgcttagattttaatggc

SEQ ID NO: 115892 - DNA, 22 bp, Artificial Sequence
  chemically synthesized
tcttgcttagattttaatggct

SEQ ID NO: 115893 - DNA, 22 bp, Artificial Sequence
  chemically synthesized
ttgcttagattttaatggctcc

SEQ ID NO: 115894 - DNA, 22 bp, Artificial Sequence
  chemically synthesized
gcttagattttaatggctcctc

SEQ ID NO: 115895 - DNA, 22 bp, Artificial Sequence
  chemically synthesized
cttagattttaatggctcctcc

SEQ ID NO: 115896 - DNA, 22 bp, Artificial Sequence
  chemically synthesized
agattttaatggctcctcctac

SEQ ID NO: 115897 - DNA, 22 bp, Artificial Sequence
  chemically synthesized
gattttaatggctcctcctaca

SEQ ID NO: 115898 - DNA, 22 bp, Artificial Sequence
  chemically synthesized
taatggctcctcctacagctga

SEQ ID NO: 115899 - DNA, 22 bp, Artificial Sequence
  chemically synthesized
aatggctcctcctacagctgag

SEQ ID NO: 115900 - DNA, 22 bp, Artificial Sequence
  chemically synthesized
atggctcctcctacagctgaga

SEQ ID NO: 115901 - DNA, 22 bp, Artificial Sequence
  chemically synthesized
ctcctacagctgagaactggca

SEQ ID NO: 115902 - DNA, 22 bp, Artificial Sequence
  chemically synthesized
ctacagctgagaactggcattt

SEQ ID NO: 115903 - DNA, 22 bp, Artificial Sequence
  chemically synthesized
cagctgagaactggcatttttg

SEQ ID NO: 115904 - DNA, 22 bp, Artificial Sequence
  chemically synthesized
agaactggcatttttggtagca

SEQ ID NO: 115905 - DNA, 22 bp, Artificial Sequence
  chemically synthesized
gcatttttggtagcatcaaagc

SEQ ID NO: 115906 - DNA, 22 bp, Artificial Sequence
  chemically synthesized
ttggtagcatcaaagctatcca

SEQ ID NO: 115907 - DNA, 22 bp, Artificial Sequence
  chemically synthesized
tggtagcatcaaagctatccag

SEQ ID NO: 115908 - DNA, 22 bp, Artificial Sequence
  chemically synthesized
ggtagcatcaaagctatccaga

SEQ ID NO: 115909 - DNA, 22 bp, Artificial Sequence
  chemically synthesized
gtagcatcaaagctatccagaa

SEQ ID NO: 115910 - DNA, 22 bp, Artificial Sequence
  chemically synthesized
tccagaaggcaactttattgaa

SEQ ID NO: 115911 - DNA, 22 bp, Artificial Sequence
  chemically synthesized
tattgaaggtcatcatcaatgt

SEQ ID NO: 115912 - DNA, 22 bp, Artificial Sequence
  chemically synthesized
attgaaggtcatcatcaatgta

SEQ ID NO: 115913 - DNA, 22 bp, Artificial Sequence
  chemically synthesized
ttgaaggtcatcatcaatgtaa

SEQ ID NO: 115914 - DNA, 22 bp, Artificial Sequence
  chemically synthesized
aaggtcatcatcaatgtaacta

SEQ ID NO: 115915 - DNA, 22 bp, Artificial Sequence
  chemically synthesized
aaactaaaatgaaactaaataa

SEQ ID NO: 115916 - DNA, 22 bp, Artificial Sequence
  chemically synthesized
aaatgaaactaaataaaaacta

SEQ ID NO: 115917 - DNA, 22 bp, Artificial Sequence
  chemically synthesized
aataaaaactaaaaagaacaat

SEQ ID NO: 115918 - DNA, 22 bp, Artificial Sequence
  chemically synthesized
aaaagaacaataaataccagag

SEQ ID NO: 115919 - DNA, 22 bp, Artificial Sequence
  chemically synthesized
gcagagaccaggtaaatgccat

SEQ ID NO: 115920 - DNA, 22 bp, Artificial Sequence
  chemically synthesized
gctctaactcacctccggaaat

SEQ ID NO: 115921 - DNA, 22 bp, Artificial Sequence
  chemically synthesized
ctctaactcacctccggaaata

SEQ ID NO: 115922 - DNA, 22 bp, Artificial Sequence
  chemically synthesized
taactcacctccggaaatacac

SEQ ID NO: 115923 - DNA, 22 bp, Artificial Sequence
  chemically synthesized
actcacctccggaaatacacct

SEQ ID NO: 115924 - DNA, 22 bp, Artificial Sequence
  chemically synthesized
acctccggaaatacacctcctt

SEQ ID NO: 115925 - DNA, 22 bp, Artificial Sequence
  chemically synthesized
cggaaatacacctccttccatg

SEQ ID NO: 115926 - DNA, 22 bp, Artificial Sequence
  chemically synthesized
cttccatggttccttgggactg

SEQ ID NO: 115927 - DNA, 22 bp, Artificial Sequence
  chemically synthesized
ccatggttccttgggactgctt

SEQ ID NO: 115928 - DNA, 22 bp, Artificial Sequence
  chemically synthesized
catggttccttgggactgcttc

SEQ ID NO: 115929 - DNA, 22 bp, Artificial Sequence
  chemically synthesized
cttgggactgcttccatcttat

SEQ ID NO: 115930 - DNA, 22 bp, Artificial Sequence
  chemically synthesized
gggactgcttccatcttatcta

SEQ ID NO: 115931 - DNA, 22 bp, Artificial Sequence
  chemically synthesized
ggactgcttccatcttatctac

SEQ ID NO: 115932 - DNA, 22 bp, Artificial Sequence
  chemically synthesized
cttccatcttatctacctggcc

SEQ ID NO: 115933 - DNA, 22 bp, Artificial Sequence
  chemically synthesized
ccatcttatctacctggccaag

SEQ ID NO: 115934 - DNA, 22 bp, Artificial Sequence
  chemically synthesized
catcttatctacctggccaagt

SEQ ID NO: 115935 - DNA, 22 bp, Artificial Sequence
  chemically synthesized
atctacctggccaagtttcttc

SEQ ID NO: 115936 - DNA, 22 bp, Artificial Sequence
  chemically synthesized
tctacctggccaagtttcttct

SEQ ID NO: 115937 - DNA, 22 bp, Artificial Sequence
  chemically synthesized
cctggccaagtttcttctcatc

SEQ ID NO: 115938 - DNA, 22 bp, Artificial Sequence
  chemically synthesized
gccaagtttcttctcatctttt

SEQ ID NO: 115939 - DNA, 22 bp, Artificial Sequence
  chemically synthesized
cttctcatctttttctatcctg

SEQ ID NO: 115940 - DNA, 22 bp, Artificial Sequence
  chemically synthesized
ttctcatctttttctatcctgg

SEQ ID NO: 115941 - DNA, 22 bp, Artificial Sequence
  chemically synthesized
ctcatctttttctatcctggtc

SEQ ID NO: 115942 - DNA, 22 bp, Artificial Sequence
  chemically synthesized
tcatctttttctatcctggtca

SEQ ID NO: 115943 - DNA, 22 bp, Artificial Sequence
  chemically synthesized
atctttttctatcctggtcagc

SEQ ID NO: 115944 - DNA, 22 bp, Artificial Sequence
  chemically synthesized
tttctatcctggtcagcagtaa

SEQ ID NO: 115945 - DNA, 22 bp, Artificial Sequence
  chemically synthesized
ttctatcctggtcagcagtaac

SEQ ID NO: 115946 - DNA, 22 bp, Artificial Sequence
  chemically synthesized
tctatcctggtcagcagtaact

SEQ ID NO: 115947 - DNA, 22 bp, Artificial Sequence
  chemically synthesized
ctatcctggtcagcagtaactt

SEQ ID NO: 115948 - DNA, 22 bp, Artificial Sequence
  chemically synthesized
tatcctggtcagcagtaacttt

SEQ ID NO: 115949 - DNA, 22 bp, Artificial Sequence
  chemically synthesized
tcctggtcagcagtaactttca

SEQ ID NO: 115950 - DNA, 22 bp, Artificial Sequence
  chemically synthesized
gtcagcagtaactttcagaccc

SEQ ID NO: 115951 - DNA, 22 bp, Artificial Sequence
  chemically synthesized
tcagacccccaagtcacatcag

SEQ ID NO: 115952 - DNA, 22 bp, Artificial Sequence
  chemically synthesized
cagacccccaagtcacatcaga

SEQ ID NO: 115953 - DNA, 22 bp, Artificial Sequence
  chemically synthesized
agacccccaagtcacatcagaa

SEQ ID NO: 115954 - DNA, 22 bp, Artificial Sequence
  chemically synthesized
agaactcctgcattcttcctca

SEQ ID NO: 115955 - DNA, 22 bp, Artificial Sequence
  chemically synthesized
ctgcattcttcctcaacacctg

SEQ ID NO: 115956 - DNA, 22 bp, Artificial Sequence
  chemically synthesized
cattcttcctcaacacctgttt

SEQ ID NO: 115957 - DNA, 22 bp, Artificial Sequence
  chemically synthesized
ttcctcaacacctgtttcaagc

SEQ ID NO: 115958 - DNA, 22 bp, Artificial Sequence
  chemically synthesized
cctcaacacctgtttcaagcaa

SEQ ID NO: 115959 - DNA, 22 bp, Artificial Sequence
  chemically synthesized
ctcaacacctgtttcaagcaac

SEQ ID NO: 115960 - DNA, 22 bp, Artificial Sequence
  chemically synthesized
aacacctgtttcaagcaacacc

SEQ ID NO: 115961 - DNA, 22 bp, Artificial Sequence
  chemically synthesized
tttcaagcaacacccccccaaa

SEQ ID NO: 115962 - DNA, 22 bp, Artificial Sequence
  chemically synthesized
caagcaacacccccccaaattt

SEQ ID NO: 115963 - DNA, 22 bp, Artificial Sequence
  chemically synthesized
aagcaacacccccccaaatttc

SEQ ID NO: 115964 - DNA, 22 bp, Artificial Sequence
  chemically synthesized
ctaaggttgtgctctctcctga

SEQ ID NO: 115965 - DNA, 22 bp, Artificial Sequence
  chemically synthesized
taaggttgtgctctctcctgac

SEQ ID NO: 115966 - DNA, 22 bp, Artificial Sequence
  chemically synthesized
aggttgtgctctctcctgacca

SEQ ID NO: 115967 - DNA, 22 bp, Artificial Sequence
  chemically synthesized
tgctctctcctgaccatattcc

SEQ ID NO: 115968 - DNA, 22 bp, Artificial Sequence
  chemically synthesized
tctcctgaccatattcctctag

SEQ ID NO: 115969 - DNA, 22 bp, Artificial Sequence
  chemically synthesized
tcctgaccatattcctctagaa

SEQ ID NO: 115970 - DNA, 22 bp, Artificial Sequence
  chemically synthesized
ctgaccatattcctctagaaga

SEQ ID NO: 115971 - DNA, 22 bp, Artificial Sequence
  chemically synthesized
accatattcctctagaagaaga

SEQ ID NO: 115972 - DNA, 22 bp, Artificial Sequence
  chemically synthesized
ctctagaagaagagactttgat

SEQ ID NO: 115973 - DNA, 22 bp, Artificial Sequence
  chemically synthesized
tagaagaagagactttgatcct

SEQ ID NO: 115974 - DNA, 22 bp, Artificial Sequence
  chemically synthesized
gaagaagagactttgatcctat

SEQ ID NO: 115975 - DNA, 22 bp, Artificial Sequence
  chemically synthesized
tgatcctatccttgactcctct

SEQ ID NO: 115976 - DNA, 22 bp, Artificial Sequence
  chemically synthesized
gatcctatccttgactcctctc

SEQ ID NO: 115977 - DNA, 22 bp, Artificial Sequence
  chemically synthesized
atcctatccttgactcctctca

SEQ ID NO: 115978 - DNA, 22 bp, Artificial Sequence
  chemically synthesized
tccttgactcctctcatctctg

SEQ ID NO: 115979 - DNA, 22 bp, Artificial Sequence
  chemically synthesized
gactcctctcatctctgatttt

SEQ ID NO: 115980 - DNA, 22 bp, Artificial Sequence
  chemically synthesized
actcctctcatctctgatttta

SEQ ID NO: 115981 - DNA, 22 bp, Artificial Sequence
  chemically synthesized
ctctcatctctgattttacctt

SEQ ID NO: 115982 - DNA, 22 bp, Artificial Sequence
  chemically synthesized
tcatctctgattttaccttaca

SEQ ID NO: 115983 - DNA, 22 bp, Artificial Sequence
  chemically synthesized
atctctgattttaccttacaac

SEQ ID NO: 115984 - DNA, 22 bp, Artificial Sequence
  chemically synthesized
tgattttaccttacaacctcaa

SEQ ID NO: 115985 - DNA, 22 bp, Artificial Sequence
  chemically synthesized
attttaccttacaacctcaagt

SEQ ID NO: 115986 - DNA, 22 bp, Artificial Sequence
  chemically synthesized
taccttacaacctcaagtctga

SEQ ID NO: 115987 - DNA, 22 bp, Artificial Sequence
  chemically synthesized
accttacaacctcaagtctgac

SEQ ID NO: 115988 - DNA, 22 bp, Artificial Sequence
  chemically synthesized
ccttacaacctcaagtctgaca

SEQ ID NO: 115989 - DNA, 22 bp, Artificial Sequence
  chemically synthesized
acaacctcaagtctgacattaa

SEQ ID NO: 115990 - DNA, 22 bp, Artificial Sequence
  chemically synthesized
caacctcaagtctgacattaag

SEQ ID NO: 115991 - DNA, 22 bp, Artificial Sequence
  chemically synthesized
aagtctgacattaagctacagt

SEQ ID NO: 115992 - DNA, 22 bp, Artificial Sequence
  chemically synthesized
acattaagctacagtcagtatt

SEQ ID NO: 115993 - DNA, 22 bp, Artificial Sequence
  chemically synthesized
agctacagtcagtatttacttg

SEQ ID NO: 115994 - DNA, 22 bp, Artificial Sequence
  chemically synthesized
cagtcagtatttacttgtaggt

SEQ ID NO: 115995 - DNA, 22 bp, Artificial Sequence
  chemically synthesized
acttgtaggtgttttagttgtg

SEQ ID NO: 115996 - DNA, 22 bp, Artificial Sequence
  chemically synthesized
cttgtaggtgttttagttgtgt

SEQ ID NO: 115997 - DNA, 22 bp, Artificial Sequence
  chemically synthesized
gtaggtgttttagttgtgtgat

SEQ ID NO: 115998 - DNA, 22 bp, Artificial Sequence
  chemically synthesized
taggtgttttagttgtgtgata

SEQ ID NO: 115999 - DNA, 22 bp, Artificial Sequence
  chemically synthesized
tagttgtgtgatattgaacaat

SEQ ID NO: 116000 - DNA, 22 bp, Artificial Sequence
  chemically synthesized
agttgtgtgatattgaacaatg

SEQ ID NO: 116001 - DNA, 22 bp, Artificial Sequence
  chemically synthesized
gttgtgtgatattgaacaatga

SEQ ID NO: 116002 - DNA, 22 bp, Artificial Sequence
  chemically synthesized
tgtgatattgaacaatgacatg

SEQ ID NO: 116003 - DNA, 22 bp, Artificial Sequence
  chemically synthesized
aacaatgacatgtaacgtgaga

SEQ ID NO: 116004 - DNA, 22 bp, Artificial Sequence
  chemically synthesized
cagccaaggaaactcacacaaa

SEQ ID NO: 116005 - DNA, 22 bp, Artificial Sequence
  chemically synthesized
agccaaggaaactcacacaaac

SEQ ID NO: 116006 - DNA, 22 bp, Artificial Sequence
  chemically synthesized
acacaaacatattgaagtcaca

SEQ ID NO: 116007 - DNA, 22 bp, Artificial Sequence
  chemically synthesized
aagtcacaatcccattgctcag

SEQ ID NO: 116008 - DNA, 22 bp, Artificial Sequence
  chemically synthesized
ctcaggaggaaataaactttac

SEQ ID NO: 116009 - DNA, 22 bp, Artificial Sequence
  chemically synthesized
aggaggaaataaactttacatt

SEQ ID NO: 116010 - DNA, 22 bp, Artificial Sequence
  chemically synthesized
tacattggctgatcagcctgtc

SEQ ID NO: 116011 - DNA, 22 bp, Artificial Sequence
  chemically synthesized
acattggctgatcagcctgtcc

SEQ ID NO: 116012 - DNA, 22 bp, Artificial Sequence
  chemically synthesized
cattggctgatcagcctgtccc

SEQ ID NO: 116013 - DNA, 22 bp, Artificial Sequence
  chemically synthesized
gctgatcagcctgtccctacga

SEQ ID NO: 116014 - DNA, 22 bp, Artificial Sequence
  chemically synthesized
atcagcctgtccctacgagtga

SEQ ID NO: 116015 - DNA, 22 bp, Artificial Sequence
  chemically synthesized
tccctacgagtgactaaatgca

SEQ ID NO: 116016 - DNA, 22 bp, Artificial Sequence
  chemically synthesized
cgagtgactaaatgcaatcctt

SEQ ID NO: 116017 - DNA, 22 bp, Artificial Sequence
  chemically synthesized
aatgcaatccttgcaggggtct

SEQ ID NO: 116018 - DNA, 22 bp, Artificial Sequence
  chemically synthesized
gcaggggtctcagctttgaaat

SEQ ID NO: 116019 - DNA, 22 bp, Artificial Sequence
  chemically synthesized
caggggtctcagctttgaaatt

SEQ ID NO: 116020 - DNA, 22 bp, Artificial Sequence
  chemically synthesized
agctttgaaattgcttcctcaa

SEQ ID NO: 116021 - DNA, 22 bp, Artificial Sequence
  chemically synthesized
tgaaattgcttcctcaaggaca

SEQ ID NO: 116022 - DNA, 22 bp, Artificial Sequence
  chemically synthesized
gaaattgcttcctcaaggacat

SEQ ID NO: 116023 - DNA, 22 bp, Artificial Sequence
  chemically synthesized
aaattgcttcctcaaggacatt

SEQ ID NO: 116024 - DNA, 22 bp, Artificial Sequence
  chemically synthesized
cttcctcaaggacattttcaca

SEQ ID NO: 116025 - DNA, 22 bp, Artificial Sequence
  chemically synthesized
cctcaaggacattttcacagat

SEQ ID NO: 116026 - DNA, 22 bp, Artificial Sequence
  chemically synthesized
ctcaaggacattttcacagata

SEQ ID NO: 116027 - DNA, 22 bp, Artificial Sequence
  chemically synthesized
aaggacattttcacagatagct

SEQ ID NO: 116028 - DNA, 22 bp, Artificial Sequence
  chemically synthesized
tcacagatagctcctccctttc

SEQ ID NO: 116029 - DNA, 22 bp, Artificial Sequence
  chemically synthesized
cacagatagctcctccctttcc

SEQ ID NO: 116030 - DNA, 22 bp, Artificial Sequence
  chemically synthesized
acagatagctcctccctttcca

SEQ ID NO: 116031 - DNA, 22 bp, Artificial Sequence
  chemically synthesized
ctccctttccaatggtaaagca

SEQ ID NO: 116032 - DNA, 22 bp, Artificial Sequence
  chemically synthesized
cctttccaatggtaaagcacca

SEQ ID NO: 116033 - DNA, 22 bp, Artificial Sequence
  chemically synthesized
tccaatggtaaagcaccaaatg

SEQ ID NO: 116034 - DNA, 22 bp, Artificial Sequence
  chemically synthesized
ccaatggtaaagcaccaaatgc

SEQ ID NO: 116035 - DNA, 22 bp, Artificial Sequence
  chemically synthesized
caatggtaaagcaccaaatgct

SEQ ID NO: 116036 - DNA, 22 bp, Artificial Sequence
  chemically synthesized
catcggtttccttccacagtgc

SEQ ID NO: 116037 - DNA, 22 bp, Artificial Sequence
  chemically synthesized
ccttccacagtgccctgcattt

SEQ ID NO: 116038 - DNA, 22 bp, Artificial Sequence
  chemically synthesized
cttccacagtgccctgcatttc

SEQ ID NO: 116039 - DNA, 22 bp, Artificial Sequence
  chemically synthesized
ccacagtgccctgcatttcccg

SEQ ID NO: 116040 - DNA, 22 bp, Artificial Sequence
  chemically synthesized
cacagtgccctgcatttcccgt

SEQ ID NO: 116041 - DNA, 22 bp, Artificial Sequence
  chemically synthesized
catttcccgttgtaacatttgt

SEQ ID NO: 116042 - DNA, 22 bp, Artificial Sequence
  chemically synthesized
cccgttgtaacatttgtcacac

SEQ ID NO: 116043 - DNA, 22 bp, Artificial Sequence
  chemically synthesized
ccgttgtaacatttgtcacaca

SEQ ID NO: 116044 - DNA, 22 bp, Artificial Sequence
  chemically synthesized
taacatttgtcacacagtaatg

SEQ ID NO: 116045 - DNA, 22 bp, Artificial Sequence
  chemically synthesized
gtcacacagtaatgtcctgttt

SEQ ID NO: 116046 - DNA, 22 bp, Artificial Sequence
  chemically synthesized
tcacacagtaatgtcctgttta

SEQ ID NO: 116047 - DNA, 22 bp, Artificial Sequence
  chemically synthesized
tttatgaaggtgtgtgcatgtg

SEQ ID NO: 116048 - DNA, 22 bp, Artificial Sequence
  chemically synthesized
atgaaggtgtgtgcatgtgtcc

SEQ ID NO: 116049 - DNA, 22 bp, Artificial Sequence
  chemically synthesized
tgaaggtgtgtgcatgtgtcca

SEQ ID NO: 116050 - DNA, 22 bp, Artificial Sequence
  chemically synthesized
gaatgactaaatcaagatccct

SEQ ID NO: 116051 - DNA, 22 bp, Artificial Sequence
  chemically synthesized
aatcaagatccctggaggaatt

SEQ ID NO: 116052 - DNA, 22 bp, Artificial Sequence
  chemically synthesized
gaggaattaggcatgtcttgct

SEQ ID NO: 116053 - DNA, 22 bp, Artificial Sequence
  chemically synthesized
ggcatgtcttgctcgccagtaa

SEQ ID NO: 116054 - DNA, 22 bp, Artificial Sequence
  chemically synthesized
gctcgccagtaaatgtatataa

SEQ ID NO: 116055 - DNA, 22 bp, Artificial Sequence
  chemically synthesized
ctcgccagtaaatgtatataaa

SEQ ID NO: 116056 - DNA, 22 bp, Artificial Sequence
  chemically synthesized
gccagtaaatgtatataaatac

SEQ ID NO: 116057 - DNA, 22 bp, Artificial Sequence
  chemically synthesized
gcacatgccatatactcaataa

SEQ ID NO: 116058 - DNA, 22 bp, Artificial Sequence
  chemically synthesized
aataaatattaaatgtatgcgt

SEQ ID NO: 116059 - DNA, 22 bp, Artificial Sequence
  chemically synthesized
aatgtatgcgtggacatataga

SEQ ID NO: 116060 - DNA, 22 bp, Artificial Sequence
  chemically synthesized
acagaagttctcttcttgtctc

SEQ ID NO: 116061 - DNA, 22 bp, Artificial Sequence
  chemically synthesized
tcttcttgtctcgaggaactcc

SEQ ID NO: 116062 - DNA, 22 bp, Artificial Sequence
  chemically synthesized
ttcttgtctcgaggaactcctc

SEQ ID NO: 116063 - DNA, 22 bp, Artificial Sequence
  chemically synthesized
cttgtctcgaggaactcctcct

SEQ ID NO: 116064 - DNA, 22 bp, Artificial Sequence
  chemically synthesized
ttgtctcgaggaactcctcctc

SEQ ID NO: 116065 - DNA, 22 bp, Artificial Sequence
  chemically synthesized
gtctcgaggaactcctcctctt

SEQ ID NO: 116066 - DNA, 22 bp, Artificial Sequence
  chemically synthesized
tctcgaggaactcctcctcttc

SEQ ID NO: 116067 - DNA, 22 bp, Artificial Sequence
  chemically synthesized
gaggaactcctcctcttcacat

SEQ ID NO: 116068 - DNA, 22 bp, Artificial Sequence
  chemically synthesized
ctcctcttcacattcagaagcc

SEQ ID NO: 116069 - DNA, 22 bp, Artificial Sequence
  chemically synthesized
ctcttcacattcagaagcccaa

SEQ ID NO: 116070 - DNA, 22 bp, Artificial Sequence
  chemically synthesized
ttcacattcagaagcccaagaa

SEQ ID NO: 116071 - DNA, 22 bp, Artificial Sequence
  chemically synthesized
cacattcagaagcccaagaaga

SEQ ID NO: 116072 - DNA, 22 bp, Artificial Sequence
  chemically synthesized
acattcagaagcccaagaagac

SEQ ID NO: 116073 - DNA, 22 bp, Artificial Sequence
  chemically synthesized
agaagcccaagaagacaccttt

SEQ ID NO: 116074 - DNA, 22 bp, Artificial Sequence
  chemically synthesized
tctgctggcatccatcaaggtg

SEQ ID NO: 116075 - DNA, 22 bp, Artificial Sequence
  chemically synthesized
ctgctggcatccatcaaggtgg

SEQ ID NO: 116076 - DNA, 22 bp, Artificial Sequence
  chemically synthesized
tgctggcatccatcaaggtggt

SEQ ID NO: 116077 - DNA, 22 bp, Artificial Sequence
  chemically synthesized
ctggcatccatcaaggtggtat

SEQ ID NO: 116078 - DNA, 22 bp, Artificial Sequence
  chemically synthesized
gcatccatcaaggtggtatatc

SEQ ID NO: 116079 - DNA, 22 bp, Artificial Sequence
  chemically synthesized
cattgtcccagttctactttac

SEQ ID NO: 116080 - DNA, 22 bp, Artificial Sequence
  chemically synthesized
attgtcccagttctactttact

SEQ ID NO: 116081 - DNA, 22 bp, Artificial Sequence
  chemically synthesized
tcccagttctactttactcagg

SEQ ID NO: 116082 - DNA, 22 bp, Artificial Sequence
  chemically synthesized
tactttactcaggccctctgga

SEQ ID NO: 116083 - DNA, 22 bp, Artificial Sequence
  chemically synthesized
ctttactcaggccctctggatc

SEQ ID NO: 116084 - DNA, 22 bp, Artificial Sequence
  chemically synthesized
tactcaggccctctggatcctc

SEQ ID NO: 116085 - DNA, 22 bp, Artificial Sequence
  chemically synthesized
actcaggccctctggatcctcc

SEQ ID NO: 116086 - DNA, 22 bp, Artificial Sequence
  chemically synthesized
ctcaggccctctggatcctccc

SEQ ID NO: 116087 - DNA, 22 bp, Artificial Sequence
  chemically synthesized
aggccctctggatcctcccacc

SEQ ID NO: 116088 - DNA, 22 bp, Artificial Sequence
  chemically synthesized
tggatcctcccacccattctcc

SEQ ID NO: 116089 - DNA, 22 bp, Artificial Sequence
  chemically synthesized
gatcctcccacccattctccta

SEQ ID NO: 116090 - DNA, 22 bp, Artificial Sequence
  chemically synthesized
ccacccattctcctacaggtta

SEQ ID NO: 116091 - DNA, 22 bp, Artificial Sequence
  chemically synthesized
tcctacaggttaaaattaccat

SEQ ID NO: 116092 - DNA, 22 bp, Artificial Sequence
  chemically synthesized
ctacaggttaaaattaccatga

SEQ ID NO: 116093 - DNA, 22 bp, Artificial Sequence
  chemically synthesized
caggttaaaattaccatgaggc

SEQ ID NO: 116094 - DNA, 22 bp, Artificial Sequence
  chemically synthesized
aaattaccatgaggccaggcac

SEQ ID NO: 116095 - DNA, 22 bp, Artificial Sequence
  chemically synthesized
ccatgaggccaggcacggtggc

SEQ ID NO: 116096 - DNA, 22 bp, Artificial Sequence
  chemically synthesized
atgctataatcccagcactttg

SEQ ID NO: 116097 - DNA, 22 bp, Artificial Sequence
  chemically synthesized
tgctataatcccagcactttgg

SEQ ID NO: 116098 - DNA, 22 bp, Artificial Sequence
  chemically synthesized
taatcccagcactttgggagac

SEQ ID NO: 116099 - DNA, 22 bp, Artificial Sequence
  chemically synthesized
tgggagaccaaggtgggaggat

SEQ ID NO: 116100 - DNA, 22 bp, Artificial Sequence
  chemically synthesized
gggagaccaaggtgggaggatt

SEQ ID NO: 116101 - DNA, 22 bp, Artificial Sequence
  chemically synthesized
ggagaccaaggtgggaggattg

SEQ ID NO: 116102 - DNA, 22 bp, Artificial Sequence
  chemically synthesized
ctgaaggccaggagtttgagac

SEQ ID NO: 116103 - DNA, 22 bp, Artificial Sequence
  chemically synthesized
aaggccaggagtttgagaccaa

SEQ ID NO: 116104 - DNA, 22 bp, Artificial Sequence
  chemically synthesized
gagaccaacttcaggcaagaag

SEQ ID NO: 116105 - DNA, 22 bp, Artificial Sequence
  chemically synthesized
agaccaacttcaggcaagaaga

SEQ ID NO: 116106 - DNA, 22 bp, Artificial Sequence
  chemically synthesized
caggcaagaagattacttgagt

SEQ ID NO: 116107 - DNA, 22 bp, Artificial Sequence
  chemically synthesized
aggcaagaagattacttgagtc

SEQ ID NO: 116108 - DNA, 22 bp, Artificial Sequence
  chemically synthesized
cttgagtccaggagtttgagac

SEQ ID NO: 116109 - DNA, 22 bp, Artificial Sequence
  chemically synthesized
gagtccaggagtttgagaccag

SEQ ID NO: 116110 - DNA, 22 bp, Artificial Sequence
  chemically synthesized
agtccaggagtttgagaccagc

SEQ ID NO: 116111 - DNA, 22 bp, Artificial Sequence
  chemically synthesized
gagaccagcctgaacaatacag

SEQ ID NO: 116112 - DNA, 22 bp, Artificial Sequence
  chemically synthesized
agaccagcctgaacaatacagc

SEQ ID NO: 116113 - DNA, 22 bp, Artificial Sequence
  chemically synthesized
aacaatacagcaagaccctatc

SEQ ID NO: 116114 - DNA, 22 bp, Artificial Sequence
  chemically synthesized
tctctacaaaaaaaattaaaat

SEQ ID NO: 116115 - DNA, 22 bp, Artificial Sequence
  chemically synthesized
tacaaaaaaaattaaaattagc

SEQ ID NO: 116116 - DNA, 22 bp, Artificial Sequence
  chemically synthesized
caaaaaaaattaaaattagcca

SEQ ID NO: 116117 - DNA, 22 bp, Artificial Sequence
  chemically synthesized
aaattagccatgtgtggcggtg

SEQ ID NO: 116118 - DNA, 22 bp, Artificial Sequence
  chemically synthesized
gccatgtgtggcggtgcacgtc

SEQ ID NO: 116119 - DNA, 22 bp, Artificial Sequence
  chemically synthesized
tagtctcagctacctgggaggc

SEQ ID NO: 116120 - DNA, 22 bp, Artificial Sequence
  chemically synthesized
agctacctgggaggctgaggtg

SEQ ID NO: 116121 - DNA, 22 bp, Artificial Sequence
  chemically synthesized
cctgggaggctgaggtgggaag

SEQ ID NO: 116122 - DNA, 22 bp, Artificial Sequence
  chemically synthesized
ggaggctgaggtgggaagaatg

SEQ ID NO: 116123 - DNA, 22 bp, Artificial Sequence
  chemically synthesized
aggtgggaagaatgcttgagcc

SEQ ID NO: 116124 - DNA, 22 bp, Artificial Sequence
  chemically synthesized
gagcccaggaggttgaggctgc

SEQ ID NO: 116125 - DNA, 22 bp, Artificial Sequence
  chemically synthesized
agcccaggaggttgaggctgca

SEQ ID NO: 116126 - DNA, 22 bp, Artificial Sequence
  chemically synthesized
aggctgcagtgagccataatca

SEQ ID NO: 116127 - DNA, 22 bp, Artificial Sequence
  chemically synthesized
cagtgagccataatcacactac

SEQ ID NO: 116128 - DNA, 22 bp, Artificial Sequence
  chemically synthesized
ctgcctgggtgaccaagtgaga

SEQ ID NO: 116129 - DNA, 22 bp, Artificial Sequence
  chemically synthesized
cctgggtgaccaagtgagaccc

SEQ ID NO: 116130 - DNA, 22 bp, Artificial Sequence
  chemically synthesized
ggtgaccaagtgagaccccgat

SEQ ID NO: 116131 - DNA, 22 bp, Artificial Sequence
  chemically synthesized
aaaaataaaaaggaaaacaaac

SEQ ID NO: 116132 - DNA, 22 bp, Artificial Sequence
  chemically synthesized
caaagcgaaatttaaaaaagaa

SEQ ID NO: 116133 - DNA, 22 bp, Artificial Sequence
  chemically synthesized
aaaaaagaaccaaactctaaaa

SEQ ID NO: 116134 - DNA, 22 bp, Artificial Sequence
  chemically synthesized
aaaaagaaccaaactctaaaaa

SEQ ID NO: 116135 - DNA, 22 bp, Artificial Sequence
  chemically synthesized
taaaaatatgtatgtatgtttg

SEQ ID NO: 116136 - DNA, 22 bp, Artificial Sequence
  chemically synthesized
aaaatatgtatgtatgtttgtg

SEQ ID NO: 116137 - DNA, 22 bp, Artificial Sequence
  chemically synthesized
gtgcggtttcttgtgtatgttt

SEQ ID NO: 116138 - DNA, 22 bp, Artificial Sequence
  chemically synthesized
tgcggtttcttgtgtatgtttg

SEQ ID NO: 116139 - DNA, 22 bp, Artificial Sequence
  chemically synthesized
cttgtgtatgtttgtgtggtat

SEQ ID NO: 116140 - DNA, 22 bp, Artificial Sequence
  chemically synthesized
ttgtgtatgtttgtgtggtatc

SEQ ID NO: 116141 - DNA, 22 bp, Artificial Sequence
  chemically synthesized
gtgtatgtttgtgtggtatctc

SEQ ID NO: 116142 - DNA, 22 bp, Artificial Sequence
  chemically synthesized
tgtatgtttgtgtggtatctca

SEQ ID NO: 116143 - DNA, 22 bp, Artificial Sequence
  chemically synthesized
gtgtggtatctcatgtttgtat

SEQ ID NO: 116144 - DNA, 22 bp, Artificial Sequence
  chemically synthesized
tgtggtatctcatgtttgtatg

SEQ ID NO: 116145 - DNA, 22 bp, Artificial Sequence
  chemically synthesized
atgtttgtatgtgtgggtgtta

SEQ ID NO: 116146 - DNA, 22 bp, Artificial Sequence
  chemically synthesized
gtatgtgtgggtgttatcagac

SEQ ID NO: 116147 - DNA, 22 bp, Artificial Sequence
  chemically synthesized
tatgtgtgggtgttatcagact

SEQ ID NO: 116148 - DNA, 22 bp, Artificial Sequence
  chemically synthesized
tcagactctcaggcttgggagc

SEQ ID NO: 116149 - DNA, 22 bp, Artificial Sequence
  chemically synthesized
tcaggcttgggagcccctctgg

SEQ ID NO: 116150 - DNA, 22 bp, Artificial Sequence
  chemically synthesized
aggcttgggagcccctctggaa

SEQ ID NO: 116151 - DNA, 22 bp, Artificial Sequence
  chemically synthesized
gggagcccctctggaacccagc

SEQ ID NO: 116152 - DNA, 22 bp, Artificial Sequence
  chemically synthesized
ggagcccctctggaacccagca

SEQ ID NO: 116153 - DNA, 22 bp, Artificial Sequence
  chemically synthesized
tggaacccagcagtttctgcag

SEQ ID NO: 116154 - DNA, 22 bp, Artificial Sequence
  chemically synthesized
gaacccagcagtttctgcagcc

SEQ ID NO: 116155 - DNA, 22 bp, Artificial Sequence
  chemically synthesized
ctgcagccttacaggctggcac

SEQ ID NO: 116156 - DNA, 22 bp, Artificial Sequence
  chemically synthesized
tgcagccttacaggctggcact

SEQ ID NO: 116157 - DNA, 22 bp, Artificial Sequence
  chemically synthesized
cagccttacaggctggcactcc

SEQ ID NO: 116158 - DNA, 22 bp, Artificial Sequence
  chemically synthesized
acaggctggcactccttaaaca

SEQ ID NO: 116159 - DNA, 22 bp, Artificial Sequence
  chemically synthesized
caggctggcactccttaaacat

SEQ ID NO: 116160 - DNA, 22 bp, Artificial Sequence
  chemically synthesized
gcactccttaaacataggttcc

SEQ ID NO: 116161 - DNA, 22 bp, Artificial Sequence
  chemically synthesized
cttaaacataggttccattcta

SEQ ID NO: 116162 - DNA, 22 bp, Artificial Sequence
  chemically synthesized
aaacataggttccattctaaac

SEQ ID NO: 116163 - DNA, 22 bp, Artificial Sequence
  chemically synthesized
aacataggttccattctaaact

SEQ ID NO: 116164 - DNA, 22 bp, Artificial Sequence
  chemically synthesized
cattctaaactttaatttacat

SEQ ID NO: 116165 - DNA, 22 bp, Artificial Sequence
  chemically synthesized
taaactttaatttacatccaca

SEQ ID NO: 116166 - DNA, 22 bp, Artificial Sequence
  chemically synthesized
aactttaatttacatccacata

SEQ ID NO: 116167 - DNA, 22 bp, Artificial Sequence
  chemically synthesized
taatttacatccacatagtagg

SEQ ID NO: 116168 - DNA, 22 bp, Artificial Sequence
  chemically synthesized
aatttacatccacatagtaggc

SEQ ID NO: 116169 - DNA, 22 bp, Artificial Sequence
  chemically synthesized
atttacatccacatagtaggcc

SEQ ID NO: 116170 - DNA, 22 bp, Artificial Sequence
  chemically synthesized
acatccacatagtaggccacat

SEQ ID NO: 116171 - DNA, 22 bp, Artificial Sequence
  chemically synthesized
catccacatagtaggccacatt

SEQ ID NO: 116172 - DNA, 22 bp, Artificial Sequence
  chemically synthesized
ctcaatagcagttccgagactt

SEQ ID NO: 116173 - DNA, 22 bp, Artificial Sequence
  chemically synthesized
aatagcagttccgagacttaga

SEQ ID NO: 116174 - DNA, 22 bp, Artificial Sequence
  chemically synthesized
cgagacttagaatattcttctc

SEQ ID NO: 116175 - DNA, 22 bp, Artificial Sequence
  chemically synthesized
agaatattcttctccatgttga

SEQ ID NO: 116176 - DNA, 22 bp, Artificial Sequence
  chemically synthesized
gaatattcttctccatgttgag

SEQ ID NO: 116177 - DNA, 22 bp, Artificial Sequence
  chemically synthesized
ttctccatgttgagaggaaatt

SEQ ID NO: 116178 - DNA, 22 bp, Artificial Sequence
  chemically synthesized
ctccatgttgagaggaaattcc

SEQ ID NO: 116179 - DNA, 22 bp, Artificial Sequence
  chemically synthesized
tccatgttgagaggaaattcct

SEQ ID NO: 116180 - DNA, 22 bp, Artificial Sequence
  chemically synthesized
catgttgagaggaaattcctat

SEQ ID NO: 116181 - DNA, 22 bp, Artificial Sequence
  chemically synthesized
agaggaaattcctattctatag

SEQ ID NO: 116182 - DNA, 22 bp, Artificial Sequence
  chemically synthesized
ctattctatagatctcatttgg

SEQ ID NO: 116183 - DNA, 22 bp, Artificial Sequence
  chemically synthesized
ttctatagatctcatttggtag

SEQ ID NO: 116184 - DNA, 22 bp, Artificial Sequence
  chemically synthesized
tatagatctcatttggtagaat

SEQ ID NO: 116185 - DNA, 22 bp, Artificial Sequence
  chemically synthesized
tagatctcatttggtagaatgg

SEQ ID NO: 116186 - DNA, 22 bp, Artificial Sequence
  chemically synthesized
atttggtagaatggggtacaaa

SEQ ID NO: 116187 - DNA, 22 bp, Artificial Sequence
  chemically synthesized
ggtagaatggggtacaaaaaat

SEQ ID NO: 116188 - DNA, 22 bp, Artificial Sequence
  chemically synthesized
gtagaatggggtacaaaaaatt

SEQ ID NO: 116189 - DNA, 22 bp, Artificial Sequence
  chemically synthesized
aggatttggatttagattagca

SEQ ID NO: 116190 - DNA, 22 bp, Artificial Sequence
  chemically synthesized
ggatttggatttagattagcac

SEQ ID NO: 116191 - DNA, 22 bp, Artificial Sequence
  chemically synthesized
ggatttagattagcactgaagt

SEQ ID NO: 116192 - DNA, 22 bp, Artificial Sequence
  chemically synthesized
gatttagattagcactgaagtc

SEQ ID NO: 116193 - DNA, 22 bp, Artificial Sequence
  chemically synthesized
agattagcactgaagtcccatt

SEQ ID NO: 116194 - DNA, 22 bp, Artificial Sequence
  chemically synthesized
gattagcactgaagtcccattt

SEQ ID NO: 116195 - DNA, 22 bp, Artificial Sequence
  chemically synthesized
gcactgaagtcccattttgcct

SEQ ID NO: 116196 - DNA, 22 bp, Artificial Sequence
  chemically synthesized
aagtcccattttgcctcttatt

SEQ ID NO: 116197 - DNA, 22 bp, Artificial Sequence
  chemically synthesized
tgcctcttattaacaaatagac

SEQ ID NO: 116198 - DNA, 22 bp, Artificial Sequence
  chemically synthesized
gcctcttattaacaaatagacc

SEQ ID NO: 116199 - DNA, 22 bp, Artificial Sequence
  chemically synthesized
cctcttattaacaaatagacca

SEQ ID NO: 116200 - DNA, 22 bp, Artificial Sequence
  chemically synthesized
ttattaacaaatagaccactga

SEQ ID NO: 116201 - DNA, 22 bp, Artificial Sequence
  chemically synthesized
attaacaaatagaccactgaca

SEQ ID NO: 116202 - DNA, 22 bp, Artificial Sequence
  chemically synthesized
ttaacaaatagaccactgacat

SEQ ID NO: 116203 - DNA, 22 bp, Artificial Sequence
  chemically synthesized
acaaatagaccactgacatcta

SEQ ID NO: 116204 - DNA, 22 bp, Artificial Sequence
  chemically synthesized
acatctaaatttcattttcaaa

SEQ ID NO: 116205 - DNA, 22 bp, Artificial Sequence
  chemically synthesized
aatttcattttcaaattaggaa

SEQ ID NO: 116206 - DNA, 22 bp, Artificial Sequence
  chemically synthesized
cattttcaaattaggaaatacg

SEQ ID NO: 116207 - DNA, 22 bp, Artificial Sequence
  chemically synthesized
attttcaaattaggaaatacgt

SEQ ID NO: 116208 - DNA, 22 bp, Artificial Sequence
  chemically synthesized
tcaaattaggaaatacgtacag

SEQ ID NO: 116209 - DNA, 22 bp, Artificial Sequence
  chemically synthesized
caaattaggaaatacgtacagg

SEQ ID NO: 116210 - DNA, 22 bp, Artificial Sequence
  chemically synthesized
aaattaggaaatacgtacaggt

SEQ ID NO: 116211 - DNA, 22 bp, Artificial Sequence
  chemically synthesized
ggaaatacgtacaggtaataac

SEQ ID NO: 116212 - DNA, 22 bp, Artificial Sequence
  chemically synthesized
gaaaacttctaccttactcaaa

SEQ ID NO: 116213 - DNA, 22 bp, Artificial Sequence
  chemically synthesized
aaaacttctaccttactcaaat

SEQ ID NO: 116214 - DNA, 22 bp, Artificial Sequence
  chemically synthesized
ctaccttactcaaatttaaaat

SEQ ID NO: 116215 - DNA, 22 bp, Artificial Sequence
  chemically synthesized
taccttactcaaatttaaaatg

SEQ ID NO: 116216 - DNA, 22 bp, Artificial Sequence
  chemically synthesized
ccttactcaaatttaaaatgca

SEQ ID NO: 116217 - DNA, 22 bp, Artificial Sequence
  chemically synthesized
actcaaatttaaaatgcaaatt

SEQ ID NO: 116218 - DNA, 22 bp, Artificial Sequence
  chemically synthesized
ctcaaatttaaaatgcaaatta

SEQ ID NO: 116219 - DNA, 22 bp, Artificial Sequence
  chemically synthesized
aaatttaaaatgcaaattaaca

SEQ ID NO: 116220 - DNA, 22 bp, Artificial Sequence
  chemically synthesized
aaaatgcaaattaacatatctt

SEQ ID NO: 116221 - DNA, 22 bp, Artificial Sequence
  chemically synthesized
aaatgcaaattaacatatctta

SEQ ID NO: 116222 - DNA, 22 bp, Artificial Sequence
  chemically synthesized
acatatcttaatttgttactaa

SEQ ID NO: 116223 - DNA, 22 bp, Artificial Sequence
  chemically synthesized
aatttgttactaaacgaatatt

SEQ ID NO: 116224 - DNA, 22 bp, Artificial Sequence
  chemically synthesized
atttgttactaaacgaatattg

SEQ ID NO: 116225 - DNA, 22 bp, Artificial Sequence
  chemically synthesized
gttactaaacgaatattgaaga

SEQ ID NO: 116226 - DNA, 22 bp, Artificial Sequence
  chemically synthesized
ttactaaacgaatattgaagaa

SEQ ID NO: 116227 - DNA, 22 bp, Artificial Sequence
  chemically synthesized
ctaaacgaatattgaagaatag

SEQ ID NO: 116228 - DNA, 22 bp, Artificial Sequence
  chemically synthesized
aacgaatattgaagaatagagt

SEQ ID NO: 116229 - DNA, 22 bp, Artificial Sequence
  chemically synthesized
aagaatagagttaacaatcaat

SEQ ID NO: 116230 - DNA, 22 bp, Artificial Sequence
  chemically synthesized
acaatcaatatctggctgggcg

SEQ ID NO: 116231 - DNA, 22 bp, Artificial Sequence
  chemically synthesized
gctgggcgcggtggctcacgcc

SEQ ID NO: 116232 - DNA, 22 bp, Artificial Sequence
  chemically synthesized
ggcgcggtggctcacgcctgta

SEQ ID NO: 116233 - DNA, 22 bp, Artificial Sequence
  chemically synthesized
acgcctgtaatcccagcactct

SEQ ID NO: 116234 - DNA, 22 bp, Artificial Sequence
  chemically synthesized
taatcccagcactctgggaggc

SEQ ID NO: 116235 - DNA, 22 bp, Artificial Sequence
  chemically synthesized
tgggaggccgaggcgggtggat

SEQ ID NO: 116236 - DNA, 22 bp, Artificial Sequence
  chemically synthesized
ggaggccgaggcgggtggatca

SEQ ID NO: 116237 - DNA, 22 bp, Artificial Sequence
  chemically synthesized
gctaacacggtggaacccagtc

SEQ ID NO: 116238 - DNA, 22 bp, Artificial Sequence
  chemically synthesized
acacggtggaacccagtctcta

SEQ ID NO: 116239 - DNA, 22 bp, Artificial Sequence
  chemically synthesized
tactaaaaatacaaaaagttag

SEQ ID NO: 116240 - DNA, 22 bp, Artificial Sequence
  chemically synthesized
ctaaaaatacaaaaagttagcc

SEQ ID NO: 116241 - DNA, 22 bp, Artificial Sequence
  chemically synthesized
aaaatacaaaaagttagccggg

SEQ ID NO: 116242 - DNA, 22 bp, Artificial Sequence
  chemically synthesized
gccgggcatggtggtgggcacc

SEQ ID NO: 116243 - DNA, 22 bp, Artificial Sequence
  chemically synthesized
tagtcccagctactcaggaggc

SEQ ID NO: 116244 - DNA, 22 bp, Artificial Sequence
  chemically synthesized
ctcaggaggctggggcagcaga

SEQ ID NO: 116245 - DNA, 22 bp, Artificial Sequence
  chemically synthesized
aggaggctggggcagcagaatg

SEQ ID NO: 116246 - DNA, 22 bp, Artificial Sequence
  chemically synthesized
gggcagcagaatggcgtgaacc

SEQ ID NO: 116247 - DNA, 22 bp, Artificial Sequence
  chemically synthesized
gcagtgagccgagatcgtgcca

SEQ ID NO: 116248 - DNA, 22 bp, Artificial Sequence
  chemically synthesized
cagtgagccgagatcgtgccac

SEQ ID NO: 116249 - DNA, 22 bp, Artificial Sequence
  chemically synthesized
cactccagcctgggcaacagag

SEQ ID NO: 116250 - DNA, 22 bp, Artificial Sequence
  chemically synthesized
cagcctgggcaacagagcaaga

SEQ ID NO: 116251 - DNA, 22 bp, Artificial Sequence
  chemically synthesized
ggcaacagagcaagactccttc

SEQ ID NO: 116252 - DNA, 22 bp, Artificial Sequence
  chemically synthesized
cttctcaaaaacaaaaaaaaag

SEQ ID NO: 116253 - DNA, 22 bp, Artificial Sequence
  chemically synthesized
ctcaaaaacaaaaaaaaagaaa

SEQ ID NO: 116254 - DNA, 22 bp, Artificial Sequence
  chemically synthesized
tcaaaaacaaaaaaaaagaaaa

SEQ ID NO: 116255 - DNA, 22 bp, Artificial Sequence
  chemically synthesized
aaaaacaaaaaaaaagaaaaat

SEQ ID NO: 116256 - DNA, 22 bp, Artificial Sequence
  chemically synthesized
tgctgttaagtatgtggtaaaa

SEQ ID NO: 116257 - DNA, 22 bp, Artificial Sequence
  chemically synthesized
ttaagtatgtggtaaaagaggt

SEQ ID NO: 116258 - DNA, 22 bp, Artificial Sequence
  chemically synthesized
agtatgtggtaaaagaggtatt

SEQ ID NO: 116259 - DNA, 22 bp, Artificial Sequence
  chemically synthesized
tcacataccagaatgaaaacat

SEQ ID NO: 116260 - DNA, 22 bp, Artificial Sequence
  chemically synthesized
cacataccagaatgaaaacata

SEQ ID NO: 116261 - DNA, 22 bp, Artificial Sequence
  chemically synthesized
acataccagaatgaaaacataa

SEQ ID NO: 116262 - DNA, 22 bp, Artificial Sequence
  chemically synthesized
aatttgccttttataaaaaaca

SEQ ID NO: 116263 - DNA, 22 bp, Artificial Sequence
  chemically synthesized
atttgccttttataaaaaacaa

SEQ ID NO: 116264 - DNA, 22 bp, Artificial Sequence
  chemically synthesized
gccttttataaaaaacaaaata

SEQ ID NO: 116265 - DNA, 22 bp, Artificial Sequence
  chemically synthesized
ccttttataaaaaacaaaatac

SEQ ID NO: 116266 - DNA, 22 bp, Artificial Sequence
  chemically synthesized
ttataaaaaacaaaatacatca

SEQ ID NO: 116267 - DNA, 22 bp, Artificial Sequence
  chemically synthesized
tataaaaaacaaaatacatcaa

SEQ ID NO: 116268 - DNA, 22 bp, Artificial Sequence
  chemically synthesized
ataaaaaacaaaatacatcaaa

SEQ ID NO: 116269 - DNA, 22 bp, Artificial Sequence
  chemically synthesized
taaaaaacaaaatacatcaaaa

SEQ ID NO: 116270 - DNA, 22 bp, Artificial Sequence
  chemically synthesized
gaaaatattcatgctctgtgtc

SEQ ID NO: 116271 - DNA, 22 bp, Artificial Sequence
  chemically synthesized
aaaatattcatgctctgtgtct

SEQ ID NO: 116272 - DNA, 22 bp, Artificial Sequence
  chemically synthesized
atgctctgtgtctcagaaatgc

SEQ ID NO: 116273 - DNA, 22 bp, Artificial Sequence
  chemically synthesized
tgtgtctcagaaatgccacttc

SEQ ID NO: 116274 - DNA, 22 bp, Artificial Sequence
  chemically synthesized
tgtctcagaaatgccacttcta

SEQ ID NO: 116275 - DNA, 22 bp, Artificial Sequence
  chemically synthesized
agaaatgccacttctaaaaatc

SEQ ID NO: 116276 - DNA, 22 bp, Artificial Sequence
  chemically synthesized
ctaaaaatctgtcctaaataaa

SEQ ID NO: 116277 - DNA, 22 bp, Artificial Sequence
  chemically synthesized
taaaaatctgtcctaaataaat

SEQ ID NO: 116278 - DNA, 22 bp, Artificial Sequence
  chemically synthesized
aaaatctgtcctaaataaatga

SEQ ID NO: 116279 - DNA, 22 bp, Artificial Sequence
  chemically synthesized
tcctaaataaatgataaattaa

SEQ ID NO: 116280 - DNA, 22 bp, Artificial Sequence
  chemically synthesized
aataaatgataaattaaaaatt

SEQ ID NO: 116281 - DNA, 22 bp, Artificial Sequence
  chemically synthesized
aaaatttaggatgtaagctgtt

SEQ ID NO: 116282 - DNA, 22 bp, Artificial Sequence
  chemically synthesized
aggatgtaagctgtttgtggca

SEQ ID NO: 116283 - DNA, 22 bp, Artificial Sequence
  chemically synthesized
ggatgtaagctgtttgtggcaa

SEQ ID NO: 116284 - DNA, 22 bp, Artificial Sequence
  chemically synthesized
tttgtggcaaaatttttttcct

SEQ ID NO: 116285 - DNA, 22 bp, Artificial Sequence
  chemically synthesized
gtggcaaaatttttttcctgtt

SEQ ID NO: 116286 - DNA, 22 bp, Artificial Sequence
  chemically synthesized
tggcaaaatttttttcctgttt

SEQ ID NO: 116287 - DNA, 22 bp, Artificial Sequence
  chemically synthesized
ttttcctgtttgctcacagttc

SEQ ID NO: 116288 - DNA, 22 bp, Artificial Sequence
  chemically synthesized
tttcctgtttgctcacagttct

SEQ ID NO: 116289 - DNA, 22 bp, Artificial Sequence
  chemically synthesized
ttcctgtttgctcacagttcta

SEQ ID NO: 116290 - DNA, 22 bp, Artificial Sequence
  chemically synthesized
tcctgtttgctcacagttctaa

SEQ ID NO: 116291 - DNA, 22 bp, Artificial Sequence
  chemically synthesized
cctgtttgctcacagttctaaa

SEQ ID NO: 116292 - DNA, 22 bp, Artificial Sequence
  chemically synthesized
ctgtttgctcacagttctaaat

SEQ ID NO: 116293 - DNA, 22 bp, Artificial Sequence
  chemically synthesized
tttgctcacagttctaaatcca

SEQ ID NO: 116294 - DNA, 22 bp, Artificial Sequence
  chemically synthesized
gctcacagttctaaatccatct

SEQ ID NO: 116295 - DNA, 22 bp, Artificial Sequence
  chemically synthesized
ctcacagttctaaatccatctc

SEQ ID NO: 116296 - DNA, 22 bp, Artificial Sequence
  chemically synthesized
acagttctaaatccatctccta

SEQ ID NO: 116297 - DNA, 22 bp, Artificial Sequence
  chemically synthesized
taaatccatctcctaggtcagt

SEQ ID NO: 116298 - DNA, 22 bp, Artificial Sequence
  chemically synthesized
aatccatctcctaggtcagtga

SEQ ID NO: 116299 - DNA, 22 bp, Artificial Sequence
  chemically synthesized
ctaggtcagtgatcaataaata

SEQ ID NO: 116300 - DNA, 22 bp, Artificial Sequence
  chemically synthesized
ggtcagtgatcaataaatatgt

SEQ ID NO: 116301 - DNA, 22 bp, Artificial Sequence
  chemically synthesized
aactatttaataagtgaatatt

SEQ ID NO: 116302 - DNA, 22 bp, Artificial Sequence
  chemically synthesized
tttaataagtgaatattataat

SEQ ID NO: 116303 - DNA, 22 bp, Artificial Sequence
  chemically synthesized
aataagtgaatattataatttg

SEQ ID NO: 116304 - DNA, 22 bp, Artificial Sequence
  chemically synthesized
ataagtgaatattataatttgt

SEQ ID NO: 116305 - DNA, 22 bp, Artificial Sequence
  chemically synthesized
taatttgtgttattgttcataa

SEQ ID NO: 116306 - DNA, 22 bp, Artificial Sequence
  chemically synthesized
gtgttattgttcataattttaa

SEQ ID NO: 116307 - DNA, 22 bp, Artificial Sequence
  chemically synthesized
tgttattgttcataattttaag

SEQ ID NO: 116308 - DNA, 22 bp, Artificial Sequence
  chemically synthesized
ttgttcataattttaagaatgt

SEQ ID NO: 116309 - DNA, 22 bp, Artificial Sequence
  chemically synthesized
ttcataattttaagaatgtaag

SEQ ID NO: 116310 - DNA, 22 bp, Artificial Sequence
  chemically synthesized
ataattttaagaatgtaagcat

SEQ ID NO: 116311 - DNA, 22 bp, Artificial Sequence
  chemically synthesized
taagaatgtaagcatacaaaat

SEQ ID NO: 116312 - DNA, 22 bp, Artificial Sequence
  chemically synthesized
aagaatgtaagcatacaaaatg

SEQ ID NO: 116313 - DNA, 22 bp, Artificial Sequence
  chemically synthesized
agaatgtaagcatacaaaatgt

SEQ ID NO: 116314 - DNA, 22 bp, Artificial Sequence
  chemically synthesized
gaataaaaatattacataaatc

SEQ ID NO: 116315 - DNA, 22 bp, Artificial Sequence
  chemically synthesized
cataaatcaaagcatattcatt

SEQ ID NO: 116316 - DNA, 22 bp, Artificial Sequence
  chemically synthesized
atttgatacactattattaaaa

SEQ ID NO: 116317 - DNA, 22 bp, Artificial Sequence
  chemically synthesized
gatacactattattaaaatgac

SEQ ID NO: 116318 - DNA, 22 bp, Artificial Sequence
  chemically synthesized
atacactattattaaaatgaca

SEQ ID NO: 116319 - DNA, 22 bp, Artificial Sequence
  chemically synthesized
ttattaaaatgacatttaaatg

SEQ ID NO: 116320 - DNA, 22 bp, Artificial Sequence
  chemically synthesized
ttaaaatgacatttaaatgctt

SEQ ID NO: 116321 - DNA, 22 bp, Artificial Sequence
  chemically synthesized
aaatgacatttaaatgcttagg

SEQ ID NO: 116322 - DNA, 22 bp, Artificial Sequence
  chemically synthesized
aaatgcttaggaaactgttggc

SEQ ID NO: 116323 - DNA, 22 bp, Artificial Sequence
  chemically synthesized
aatgcttaggaaactgttggca

SEQ ID NO: 116324 - DNA, 22 bp, Artificial Sequence
  chemically synthesized
aggaaactgttggcaaaatatt

SEQ ID NO: 116325 - DNA, 22 bp, Artificial Sequence
  chemically synthesized
ggaaactgttggcaaaatatta

SEQ ID NO: 116326 - DNA, 22 bp, Artificial Sequence
  chemically synthesized
ttggcaaaatattaaataaaaa

SEQ ID NO: 116327 - DNA, 22 bp, Artificial Sequence
  chemically synthesized
gcaaaatattaaataaaaataa

SEQ ID NO: 116328 - DNA, 22 bp, Artificial Sequence
  chemically synthesized
aataaaaataagcaaaattagg

SEQ ID NO: 116329 - DNA, 22 bp, Artificial Sequence
  chemically synthesized
ggtacagaacaatcactatgta

SEQ ID NO: 116330 - DNA, 22 bp, Artificial Sequence
  chemically synthesized
tgtaaaaggctataaatatttg

SEQ ID NO: 116331 - DNA, 22 bp, Artificial Sequence
  chemically synthesized
taaatatttgtatcaaaagaaa

SEQ ID NO: 116332 - DNA, 22 bp, Artificial Sequence
  chemically synthesized
gtatcaaaagaaaaacagctgt

SEQ ID NO: 116333 - DNA, 22 bp, Artificial Sequence
  chemically synthesized
tatcaaaagaaaaacagctgtt

SEQ ID NO: 116334 - DNA, 22 bp, Artificial Sequence
  chemically synthesized
ttatatataatcttattttcta

SEQ ID NO: 116335 - DNA, 22 bp, Artificial Sequence
  chemically synthesized
tatataatcttattttctatat

SEQ ID NO: 116336 - DNA, 22 bp, Artificial Sequence
  chemically synthesized
attttctatatagatttctcta

SEQ ID NO: 116337 - DNA, 22 bp, Artificial Sequence
  chemically synthesized
ttttctatatagatttctctat

SEQ ID NO: 116338 - DNA, 22 bp, Artificial Sequence
  chemically synthesized
tctatatagatttctctatctt

SEQ ID NO: 116339 - DNA, 22 bp, Artificial Sequence
  chemically synthesized
ctatatagatttctctatcttt

SEQ ID NO: 116340 - DNA, 22 bp, Artificial Sequence
  chemically synthesized
tatatagatttctctatctttg

SEQ ID NO: 116341 - DNA, 22 bp, Artificial Sequence
  chemically synthesized
tatagatttctctatctttgcc

SEQ ID NO: 116342 - DNA, 22 bp, Artificial Sequence
  chemically synthesized
ctctatctttgccgtatacaaa

SEQ ID NO: 116343 - DNA, 22 bp, Artificial Sequence
  chemically synthesized
tctatctttgccgtatacaaat

SEQ ID NO: 116344 - DNA, 22 bp, Artificial Sequence
  chemically synthesized
tatctttgccgtatacaaattt

SEQ ID NO: 116345 - DNA, 22 bp, Artificial Sequence
  chemically synthesized
tctttgccgtatacaaattttc

SEQ ID NO: 116346 - DNA, 22 bp, Artificial Sequence
  chemically synthesized
tgccgtatacaaattttctgaa

SEQ ID NO: 116347 - DNA, 22 bp, Artificial Sequence
  chemically synthesized
gccgtatacaaattttctgaag

SEQ ID NO: 116348 - DNA, 22 bp, Artificial Sequence
  chemically synthesized
ccgtatacaaattttctgaaga

SEQ ID NO: 116349 - DNA, 22 bp, Artificial Sequence
  chemically synthesized
tctgaagaagacatttcggttt

SEQ ID NO: 116350 - DNA, 22 bp, Artificial Sequence
  chemically synthesized
ctgaagaagacatttcggtttt

SEQ ID NO: 116351 - DNA, 22 bp, Artificial Sequence
  chemically synthesized
tgaagaagacatttcggtttta

SEQ ID NO: 116352 - DNA, 22 bp, Artificial Sequence
  chemically synthesized
aagaagacatttcggttttata

SEQ ID NO: 116353 - DNA, 22 bp, Artificial Sequence
  chemically synthesized
cggttttataatctaaaaagag

SEQ ID NO: 116354 - DNA, 22 bp, Artificial Sequence
  chemically synthesized
ggttttataatctaaaaagagc

SEQ ID NO: 116355 - DNA, 22 bp, Artificial Sequence
  chemically synthesized
tataatctaaaaagagcatttt

SEQ ID NO: 116356 - DNA, 22 bp, Artificial Sequence
  chemically synthesized
ataatctaaaaagagcatttta

SEQ ID NO: 116357 - DNA, 22 bp, Artificial Sequence
  chemically synthesized
taatctaaaaagagcattttac

SEQ ID NO: 116358 - DNA, 22 bp, Artificial Sequence
  chemically synthesized
aaaagagcattttacaatgact

SEQ ID NO: 116359 - DNA, 22 bp, Artificial Sequence
  chemically synthesized
tacaatgactataaaaagttat

SEQ ID NO: 116360 - DNA, 22 bp, Artificial Sequence
  chemically synthesized
acaatgactataaaaagttata

SEQ ID NO: 116361 - DNA, 22 bp, Artificial Sequence
  chemically synthesized
caatgactataaaaagttatat

SEQ ID NO: 116362 - DNA, 22 bp, Artificial Sequence
  chemically synthesized
taaaaagttatatacgattatg

SEQ ID NO: 116363 - DNA, 22 bp, Artificial Sequence
  chemically synthesized
tatacgattatgctgaagatga

SEQ ID NO: 116364 - DNA, 22 bp, Artificial Sequence
  chemically synthesized
tgctgaagatgacaatgaagat

SEQ ID NO: 116365 - DNA, 22 bp, Artificial Sequence
  chemically synthesized
aagatgacaatgaagatgataa

SEQ ID NO: 116366 - DNA, 22 bp, Artificial Sequence
  chemically synthesized
tgatcatgataaatgctaatgt

SEQ ID NO: 116367 - DNA, 22 bp, Artificial Sequence
  chemically synthesized
atgtttattaagcatttaactc

SEQ ID NO: 116368 - DNA, 22 bp, Artificial Sequence
  chemically synthesized
attaagcatttaactcacggta

SEQ ID NO: 116369 - DNA, 22 bp, Artificial Sequence
  chemically synthesized
ttaagcatttaactcacggtag

SEQ ID NO: 116370 - DNA, 22 bp, Artificial Sequence
  chemically synthesized
agcatttaactcacggtagaga

SEQ ID NO: 116371 - DNA, 22 bp, Artificial Sequence
  chemically synthesized
aactcacggtagagagggctga

SEQ ID NO: 116372 - DNA, 22 bp, Artificial Sequence
  chemically synthesized
actcacggtagagagggctgag

SEQ ID NO: 116373 - DNA, 22 bp, Artificial Sequence
  chemically synthesized
acggtagagagggctgagtact

SEQ ID NO: 116374 - DNA, 22 bp, Artificial Sequence
  chemically synthesized
agtactttttattttcattatt

SEQ ID NO: 116375 - DNA, 22 bp, Artificial Sequence
  chemically synthesized
tttattttcattattttacatt

SEQ ID NO: 116376 - DNA, 22 bp, Artificial Sequence
  chemically synthesized
ttattttcattattttacatta

SEQ ID NO: 116377 - DNA, 22 bp, Artificial Sequence
  chemically synthesized
tattttcattattttacattat

SEQ ID NO: 116378 - DNA, 22 bp, Artificial Sequence
  chemically synthesized
attttcattattttacattatt

SEQ ID NO: 116379 - DNA, 22 bp, Artificial Sequence
  chemically synthesized
ttttcattattttacattattt

SEQ ID NO: 116380 - DNA, 22 bp, Artificial Sequence
  chemically synthesized
tcattattttacattatttcat

SEQ ID NO: 116381 - DNA, 22 bp, Artificial Sequence
  chemically synthesized
cattattttacattatttcatt

SEQ ID NO: 116382 - DNA, 22 bp, Artificial Sequence
  chemically synthesized
attattttacattatttcattt

SEQ ID NO: 116383 - DNA, 22 bp, Artificial Sequence
  chemically synthesized
ttttacattatttcatttaatt

SEQ ID NO: 116384 - DNA, 22 bp, Artificial Sequence
  chemically synthesized
tacattatttcatttaattttc

SEQ ID NO: 116385 - DNA, 22 bp, Artificial Sequence
  chemically synthesized
acattatttcatttaattttct

SEQ ID NO: 116386 - DNA, 22 bp, Artificial Sequence
  chemically synthesized
cattatttcatttaattttctc

SEQ ID NO: 116387 - DNA, 22 bp, Artificial Sequence
  chemically synthesized
tttcatttaattttctcaccaa

SEQ ID NO: 116388 - DNA, 22 bp, Artificial Sequence
  chemically synthesized
catttaattttctcaccaaacc

SEQ ID NO: 116389 - DNA, 22 bp, Artificial Sequence
  chemically synthesized
atttaattttctcaccaaacct

SEQ ID NO: 116390 - DNA, 22 bp, Artificial Sequence
  chemically synthesized
aattttctcaccaaacctgtga

SEQ ID NO: 116391 - DNA, 22 bp, Artificial Sequence
  chemically synthesized
attttctcaccaaacctgtgaa

SEQ ID NO: 116392 - DNA, 22 bp, Artificial Sequence
  chemically synthesized
tctcaccaaacctgtgaagtag

SEQ ID NO: 116393 - DNA, 22 bp, Artificial Sequence
  chemically synthesized
ctcaccaaacctgtgaagtagg

SEQ ID NO: 116394 - DNA, 22 bp, Artificial Sequence
  chemically synthesized
tcaccaaacctgtgaagtaggg

SEQ ID NO: 116395 - DNA, 22 bp, Artificial Sequence
  chemically synthesized
accaaacctgtgaagtagggag

SEQ ID NO: 116396 - DNA, 22 bp, Artificial Sequence
  chemically synthesized
tgaagtagggaggtattattat

SEQ ID NO: 116397 - DNA, 22 bp, Artificial Sequence
  chemically synthesized
ttattttcaatgttttaaaatt

SEQ ID NO: 116398 - DNA, 22 bp, Artificial Sequence
  chemically synthesized
ttttcaatgttttaaaattagg

SEQ ID NO: 116399 - DNA, 22 bp, Artificial Sequence
  chemically synthesized
tcaatgttttaaaattaggaaa

SEQ ID NO: 116400 - DNA, 22 bp, Artificial Sequence
  chemically synthesized
caatgttttaaaattaggaaac

SEQ ID NO: 116401 - DNA, 22 bp, Artificial Sequence
  chemically synthesized
aatgttttaaaattaggaaact

SEQ ID NO: 116402 - DNA, 22 bp, Artificial Sequence
  chemically synthesized
taaaattaggaaactgaggctc

SEQ ID NO: 116403 - DNA, 22 bp, Artificial Sequence
  chemically synthesized
aaaattaggaaactgaggctca

SEQ ID NO: 116404 - DNA, 22 bp, Artificial Sequence
  chemically synthesized
aaattaggaaactgaggctcac

SEQ ID NO: 116405 - DNA, 22 bp, Artificial Sequence
  chemically synthesized
ggaaactgaggctcacagagga

SEQ ID NO: 116406 - DNA, 22 bp, Artificial Sequence
  chemically synthesized
aggctcacagaggaaagcaact

SEQ ID NO: 116407 - DNA, 22 bp, Artificial Sequence
  chemically synthesized
acagaggaaagcaactttcctt

SEQ ID NO: 116408 - DNA, 22 bp, Artificial Sequence
  chemically synthesized
tccttagttaaatcattaatgt

SEQ ID NO: 116409 - DNA, 22 bp, Artificial Sequence
  chemically synthesized
ccttagttaaatcattaatgta

SEQ ID NO: 116410 - DNA, 22 bp, Artificial Sequence
  chemically synthesized
cttagttaaatcattaatgtaa

SEQ ID NO: 116411 - DNA, 22 bp, Artificial Sequence
  chemically synthesized
agttaaatcattaatgtaagtc

SEQ ID NO: 116412 - DNA, 22 bp, Artificial Sequence
  chemically synthesized
gttaaatcattaatgtaagtca

SEQ ID NO: 116413 - DNA, 22 bp, Artificial Sequence
  chemically synthesized
aatcattaatgtaagtcagaac

SEQ ID NO: 116414 - DNA, 22 bp, Artificial Sequence
  chemically synthesized
atgtaagtcagaactgaaattc

SEQ ID NO: 116415 - DNA, 22 bp, Artificial Sequence
  chemically synthesized
aaattcaatatcaagcgcatct

SEQ ID NO: 116416 - DNA, 22 bp, Artificial Sequence
  chemically synthesized
aatatcaagcgcatctgatttt

SEQ ID NO: 116417 - DNA, 22 bp, Artificial Sequence
  chemically synthesized
attttcttaaaccattatgctg

SEQ ID NO: 116418 - DNA, 22 bp, Artificial Sequence
  chemically synthesized
tcttaaaccattatgctggact

SEQ ID NO: 116419 - DNA, 22 bp, Artificial Sequence
  chemically synthesized
cttaaaccattatgctggactc

SEQ ID NO: 116420 - DNA, 22 bp, Artificial Sequence
  chemically synthesized
ttaaaccattatgctggactcc

SEQ ID NO: 116421 - DNA, 22 bp, Artificial Sequence
  chemically synthesized
aaaccattatgctggactcctc

SEQ ID NO: 116422 - DNA, 22 bp, Artificial Sequence
  chemically synthesized
aaccattatgctggactcctct

SEQ ID NO: 116423 - DNA, 22 bp, Artificial Sequence
  chemically synthesized
tgctggactcctctccaaacag

SEQ ID NO: 116424 - DNA, 22 bp, Artificial Sequence
  chemically synthesized
gactcctctccaaacaggacca

SEQ ID NO: 116425 - DNA, 22 bp, Artificial Sequence
  chemically synthesized
ctctccaaacaggaccactcgt

SEQ ID NO: 116426 - DNA, 22 bp, Artificial Sequence
  chemically synthesized
tccaaacaggaccactcgtttc

SEQ ID NO: 116427 - DNA, 22 bp, Artificial Sequence
  chemically synthesized
caaacaggaccactcgtttcag

SEQ ID NO: 116428 - DNA, 22 bp, Artificial Sequence
  chemically synthesized
gtttcagggccatgttttccat

SEQ ID NO: 116429 - DNA, 22 bp, Artificial Sequence
  chemically synthesized
cagggccatgttttccatgtta

SEQ ID NO: 116430 - DNA, 22 bp, Artificial Sequence
  chemically synthesized
agggccatgttttccatgttat

SEQ ID NO: 116431 - DNA, 22 bp, Artificial Sequence
  chemically synthesized
tccatgttatactgaaggaagt

SEQ ID NO: 116432 - DNA, 22 bp, Artificial Sequence
  chemically synthesized
ccatgttatactgaaggaagtc

SEQ ID NO: 116433 - DNA, 22 bp, Artificial Sequence
  chemically synthesized
catgttatactgaaggaagtcc

SEQ ID NO: 116434 - DNA, 22 bp, Artificial Sequence
  chemically synthesized
tactgaaggaagtcccatcatt

SEQ ID NO: 116435 - DNA, 22 bp, Artificial Sequence
  chemically synthesized
aaggaagtcccatcattggctt

SEQ ID NO: 116436 - DNA, 22 bp, Artificial Sequence
  chemically synthesized
gcttctccctaactttttgttc

SEQ ID NO: 116437 - DNA, 22 bp, Artificial Sequence
  chemically synthesized
ctccctaactttttgttccctt

SEQ ID NO: 116438 - DNA, 22 bp, Artificial Sequence
  chemically synthesized
tccctaactttttgttcccttt

SEQ ID NO: 116439 - DNA, 22 bp, Artificial Sequence
  chemically synthesized
cctaactttttgttccctttcc

SEQ ID NO: 116440 - DNA, 22 bp, Artificial Sequence
  chemically synthesized
actttttgttccctttcctaga

SEQ ID NO: 116441 - DNA, 22 bp, Artificial Sequence
  chemically synthesized
tttgttccctttcctagaatat

SEQ ID NO: 116442 - DNA, 22 bp, Artificial Sequence
  chemically synthesized
ttgttccctttcctagaatatg

SEQ ID NO: 116443 - DNA, 22 bp, Artificial Sequence
  chemically synthesized
tgttccctttcctagaatatgt

SEQ ID NO: 116444 - DNA, 22 bp, Artificial Sequence
  chemically synthesized
gttccctttcctagaatatgtt

SEQ ID NO: 116445 - DNA, 22 bp, Artificial Sequence
  chemically synthesized
ttccctttcctagaatatgtta

SEQ ID NO: 116446 - DNA, 22 bp, Artificial Sequence
  chemically synthesized
cctttcctagaatatgttatct

SEQ ID NO: 116447 - DNA, 22 bp, Artificial Sequence
  chemically synthesized
tcctagaatatgttatctattt

SEQ ID NO: 116448 - DNA, 22 bp, Artificial Sequence
  chemically synthesized
cctagaatatgttatctatttt

SEQ ID NO: 116449 - DNA, 22 bp, Artificial Sequence
  chemically synthesized
ctagaatatgttatctattttt

SEQ ID NO: 116450 - DNA, 22 bp, Artificial Sequence
  chemically synthesized
gaatatgttatctatttttcca

SEQ ID NO: 116451 - DNA, 22 bp, Artificial Sequence
  chemically synthesized
tctatttttccatttagtatca

SEQ ID NO: 116452 - DNA, 22 bp, Artificial Sequence
  chemically synthesized
tttttccatttagtatcaggaa

SEQ ID NO: 116453 - DNA, 22 bp, Artificial Sequence
  chemically synthesized
ttccatttagtatcaggaaaag

SEQ ID NO: 116454 - DNA, 22 bp, Artificial Sequence
  chemically synthesized
tccatttagtatcaggaaaaga

SEQ ID NO: 116455 - DNA, 22 bp, Artificial Sequence
  chemically synthesized
ccatttagtatcaggaaaagat

SEQ ID NO: 116456 - DNA, 22 bp, Artificial Sequence
  chemically synthesized
catttagtatcaggaaaagata

SEQ ID NO: 116457 - DNA, 22 bp, Artificial Sequence
  chemically synthesized
agtatcaggaaaagatagcaac

SEQ ID NO: 116458 - DNA, 22 bp, Artificial Sequence
  chemically synthesized
gtatcaggaaaagatagcaaca

SEQ ID NO: 116459 - DNA, 22 bp, Artificial Sequence
  chemically synthesized
ttgtattaaatactttttaata

SEQ ID NO: 116460 - DNA, 22 bp, Artificial Sequence
  chemically synthesized
tattaaatactttttaatagac

SEQ ID NO: 116461 - DNA, 22 bp, Artificial Sequence
  chemically synthesized
aatactttttaatagacttgat

SEQ ID NO: 116462 - DNA, 22 bp, Artificial Sequence
  chemically synthesized
tttaatagacttgattttaaga

SEQ ID NO: 116463 - DNA, 22 bp, Artificial Sequence
  chemically synthesized
ttaatagacttgattttaagag

SEQ ID NO: 116464 - DNA, 22 bp, Artificial Sequence
  chemically synthesized
taatagacttgattttaagagt

SEQ ID NO: 116465 - DNA, 22 bp, Artificial Sequence
  chemically synthesized
aatagacttgattttaagagtt

SEQ ID NO: 116466 - DNA, 22 bp, Artificial Sequence
  chemically synthesized
atagacttgattttaagagtta

SEQ ID NO: 116467 - DNA, 22 bp, Artificial Sequence
  chemically synthesized
gattttaagagttatagattca

SEQ ID NO: 116468 - DNA, 22 bp, Artificial Sequence
  chemically synthesized
attttaagagttatagattcac

SEQ ID NO: 116469 - DNA, 22 bp, Artificial Sequence
  chemically synthesized
taagagttatagattcacagaa

SEQ ID NO: 116470 - DNA, 22 bp, Artificial Sequence
  chemically synthesized
aagagttatagattcacagaaa

SEQ ID NO: 116471 - DNA, 22 bp, Artificial Sequence
  chemically synthesized
agagttatagattcacagaaaa

SEQ ID NO: 116472 - DNA, 22 bp, Artificial Sequence
  chemically synthesized
tagattcacagaaaaactcagt

SEQ ID NO: 116473 - DNA, 22 bp, Artificial Sequence
  chemically synthesized
acagaaaaactcagtagaaggt

SEQ ID NO: 116474 - DNA, 22 bp, Artificial Sequence
  chemically synthesized
agtagaaggtactgagtacctt

SEQ ID NO: 116475 - DNA, 22 bp, Artificial Sequence
  chemically synthesized
agtaccttctattttgcatatc

SEQ ID NO: 116476 - DNA, 22 bp, Artificial Sequence
  chemically synthesized
ctattttgcatatcatggtttt

SEQ ID NO: 116477 - DNA, 22 bp, Artificial Sequence
  chemically synthesized
tattttgcatatcatggttttt

SEQ ID NO: 116478 - DNA, 22 bp, Artificial Sequence
  chemically synthesized
ttttgcatatcatggtttttta

SEQ ID NO: 116479 - DNA, 22 bp, Artificial Sequence
  chemically synthesized
tgcatatcatggttttttaagc

SEQ ID NO: 116480 - DNA, 22 bp, Artificial Sequence
  chemically synthesized
gcatatcatggttttttaagca

SEQ ID NO: 116481 - DNA, 22 bp, Artificial Sequence
  chemically synthesized
catatcatggttttttaagcac

SEQ ID NO: 116482 - DNA, 22 bp, Artificial Sequence
  chemically synthesized
tttaagcacatattataaccta

SEQ ID NO: 116483 - DNA, 22 bp, Artificial Sequence
  chemically synthesized
ttaagcacatattataacctag

SEQ ID NO: 116484 - DNA, 22 bp, Artificial Sequence
  chemically synthesized
taagcacatattataacctagg

SEQ ID NO: 116485 - DNA, 22 bp, Artificial Sequence
  chemically synthesized
aagcacatattataacctaggt

SEQ ID NO: 116486 - DNA, 22 bp, Artificial Sequence
  chemically synthesized
agcacatattataacctaggta

SEQ ID NO: 116487 - DNA, 22 bp, Artificial Sequence
  chemically synthesized
taacctaggtattattctaagg

SEQ ID NO: 116488 - DNA, 22 bp, Artificial Sequence
  chemically synthesized
ggtattattctaagggcataat

SEQ ID NO: 116489 - DNA, 22 bp, Artificial Sequence
  chemically synthesized
ttctaagggcataatacactat

SEQ ID NO: 116490 - DNA, 22 bp, Artificial Sequence
  chemically synthesized
taagggcataatacactataag

SEQ ID NO: 116491 - DNA, 22 bp, Artificial Sequence
  chemically synthesized
agggcataatacactataagtc

SEQ ID NO: 116492 - DNA, 22 bp, Artificial Sequence
  chemically synthesized
taagtcactttatcttgacaat

SEQ ID NO: 116493 - DNA, 22 bp, Artificial Sequence
  chemically synthesized
tatcttgacaataaccttatga

SEQ ID NO: 116494 - DNA, 22 bp, Artificial Sequence
  chemically synthesized
atcttgacaataaccttatgag

SEQ ID NO: 116495 - DNA, 22 bp, Artificial Sequence
  chemically synthesized
tcttgacaataaccttatgaga

SEQ ID NO: 116496 - DNA, 22 bp, Artificial Sequence
  chemically synthesized
gacaataaccttatgagatgga

SEQ ID NO: 116497 - DNA, 22 bp, Artificial Sequence
  chemically synthesized
acaataaccttatgagatggat

SEQ ID NO: 116498 - DNA, 22 bp, Artificial Sequence
  chemically synthesized
atgagatggatactactagatt

SEQ ID NO: 116499 - DNA, 22 bp, Artificial Sequence
  chemically synthesized
tgagatggatactactagatta

SEQ ID NO: 116500 - DNA, 22 bp, Artificial Sequence
  chemically synthesized
ctagattacccattttacagat

SEQ ID NO: 116501 - DNA, 22 bp, Artificial Sequence
  chemically synthesized
gattacccattttacagataag

SEQ ID NO: 116502 - DNA, 22 bp, Artificial Sequence
  chemically synthesized
cccattttacagataagtacac

SEQ ID NO: 116503 - DNA, 22 bp, Artificial Sequence
  chemically synthesized
tacagataagtacactgaggct

SEQ ID NO: 116504 - DNA, 22 bp, Artificial Sequence
  chemically synthesized
acagataagtacactgaggctc

SEQ ID NO: 116505 - DNA, 22 bp, Artificial Sequence
  chemically synthesized
cagataagtacactgaggctca

SEQ ID NO: 116506 - DNA, 22 bp, Artificial Sequence
  chemically synthesized
aggctcagagacaaaatatctt

SEQ ID NO: 116507 - DNA, 22 bp, Artificial Sequence
  chemically synthesized
agagacaaaatatcttgcccaa

SEQ ID NO: 116508 - DNA, 22 bp, Artificial Sequence
  chemically synthesized
gcccaatattataccaagtttg

SEQ ID NO: 116509 - DNA, 22 bp, Artificial Sequence
  chemically synthesized
cccaatattataccaagtttga

SEQ ID NO: 116510 - DNA, 22 bp, Artificial Sequence
  chemically synthesized
taccaagtttgacagttctgac

SEQ ID NO: 116511 - DNA, 22 bp, Artificial Sequence
  chemically synthesized
gacagttctgactgtggtgctt

SEQ ID NO: 116512 - DNA, 22 bp, Artificial Sequence
  chemically synthesized
acagttctgactgtggtgcttg

SEQ ID NO: 116513 - DNA, 22 bp, Artificial Sequence
  chemically synthesized
tgactgtggtgcttgtagtttt

SEQ ID NO: 116514 - DNA, 22 bp, Artificial Sequence
  chemically synthesized
actgtggtgcttgtagttttaa

SEQ ID NO: 116515 - DNA, 22 bp, Artificial Sequence
  chemically synthesized
tggtgcttgtagttttaactat

SEQ ID NO: 116516 - DNA, 22 bp, Artificial Sequence
  chemically synthesized
gtagttttaactatgctccact

SEQ ID NO: 116517 - DNA, 22 bp, Artificial Sequence
  chemically synthesized
tagttttaactatgctccactg

SEQ ID NO: 116518 - DNA, 22 bp, Artificial Sequence
  chemically synthesized
taactatgctccactgattcaa

SEQ ID NO: 116519 - DNA, 22 bp, Artificial Sequence
  chemically synthesized
aactatgctccactgattcaac

SEQ ID NO: 116520 - DNA, 22 bp, Artificial Sequence
  chemically synthesized
actatgctccactgattcaaca

SEQ ID NO: 116521 - DNA, 22 bp, Artificial Sequence
  chemically synthesized
tgctccactgattcaacaacaa

SEQ ID NO: 116522 - DNA, 22 bp, Artificial Sequence
  chemically synthesized
cactgattcaacaacaacaaca

SEQ ID NO: 116523 - DNA, 22 bp, Artificial Sequence
  chemically synthesized
attcaacaacaacaacaaacca

SEQ ID NO: 116524 - DNA, 22 bp, Artificial Sequence
  chemically synthesized
aacaacaacaacaaaccaaaaa

SEQ ID NO: 116525 - DNA, 22 bp, Artificial Sequence
  chemically synthesized
tacatattcctgctaatgacag

SEQ ID NO: 116526 - DNA, 22 bp, Artificial Sequence
  chemically synthesized
ctgctaatgacagtatctgctt

SEQ ID NO: 116527 - DNA, 22 bp, Artificial Sequence
  chemically synthesized
ctaatgacagtatctgctttaa

SEQ ID NO: 116528 - DNA, 22 bp, Artificial Sequence
  chemically synthesized
atgacagtatctgctttaaatc

SEQ ID NO: 116529 - DNA, 22 bp, Artificial Sequence
  chemically synthesized
ctttaaatcatctggcccattc

SEQ ID NO: 116530 - DNA, 22 bp, Artificial Sequence
  chemically synthesized
taaatcatctggcccattcctc

SEQ ID NO: 116531 - DNA, 22 bp, Artificial Sequence
  chemically synthesized
aaatcatctggcccattcctca

SEQ ID NO: 116532 - DNA, 22 bp, Artificial Sequence
  chemically synthesized
aatcatctggcccattcctcag

SEQ ID NO: 116533 - DNA, 22 bp, Artificial Sequence
  chemically synthesized
gcccattcctcagcacaagcct

SEQ ID NO: 116534 - DNA, 22 bp, Artificial Sequence
  chemically synthesized
ctcagcacaagcctatattcct

SEQ ID NO: 116535 - DNA, 22 bp, Artificial Sequence
  chemically synthesized
agcacaagcctatattcctgca

SEQ ID NO: 116536 - DNA, 22 bp, Artificial Sequence
  chemically synthesized
tattcctgcaggcaaaaatctt

SEQ ID NO: 116537 - DNA, 22 bp, Artificial Sequence
  chemically synthesized
ctgcaggcaaaaatctttacaa

SEQ ID NO: 116538 - DNA, 22 bp, Artificial Sequence
  chemically synthesized
caggcaaaaatctttacaacta

SEQ ID NO: 116539 - DNA, 22 bp, Artificial Sequence
  chemically synthesized
tacaactatcccgttatttaat

SEQ ID NO: 116540 - DNA, 22 bp, Artificial Sequence
  chemically synthesized
acaactatcccgttatttaata

SEQ ID NO: 116541 - DNA, 22 bp, Artificial Sequence
  chemically synthesized
caactatcccgttatttaatat

SEQ ID NO: 116542 - DNA, 22 bp, Artificial Sequence
  chemically synthesized
tcccgttatttaatatccacaa

SEQ ID NO: 116543 - DNA, 22 bp, Artificial Sequence
  chemically synthesized
tttaatatccacaagcctctct

SEQ ID NO: 116544 - DNA, 22 bp, Artificial Sequence
  chemically synthesized
aatatccacaagcctctctaag

SEQ ID NO: 116545 - DNA, 22 bp, Artificial Sequence
  chemically synthesized
atatccacaagcctctctaagc

SEQ ID NO: 116546 - DNA, 22 bp, Artificial Sequence
  chemically synthesized
tctaagcctttgaaattgatac

SEQ ID NO: 116547 - DNA, 22 bp, Artificial Sequence
  chemically synthesized
taagcctttgaaattgatactg

SEQ ID NO: 116548 - DNA, 22 bp, Artificial Sequence
  chemically synthesized
agcctttgaaattgatactgta

SEQ ID NO: 116549 - DNA, 22 bp, Artificial Sequence
  chemically synthesized
tgaaattgatactgtatttgta

SEQ ID NO: 116550 - DNA, 22 bp, Artificial Sequence
  chemically synthesized
gaaattgatactgtatttgtaa

SEQ ID NO: 116551 - DNA, 22 bp, Artificial Sequence
  chemically synthesized
aaattgatactgtatttgtaaa

SEQ ID NO: 116552 - DNA, 22 bp, Artificial Sequence
  chemically synthesized
atactgtatttgtaaaacacag

SEQ ID NO: 116553 - DNA, 22 bp, Artificial Sequence
  chemically synthesized
tatttgtaaaacacagatggct

SEQ ID NO: 116554 - DNA, 22 bp, Artificial Sequence
  chemically synthesized
gtaaaacacagatggctcatgt

SEQ ID NO: 116555 - DNA, 22 bp, Artificial Sequence
  chemically synthesized
taaaacacagatggctcatgta

SEQ ID NO: 116556 - DNA, 22 bp, Artificial Sequence
  chemically synthesized
atgtaattgaagttcacagaat

SEQ ID NO: 116557 - DNA, 22 bp, Artificial Sequence
  chemically synthesized
aagttcacagaattttatgttt

SEQ ID NO: 116558 - DNA, 22 bp, Artificial Sequence
  chemically synthesized
acagaattttatgttttgcttt

SEQ ID NO: 116559 - DNA, 22 bp, Artificial Sequence
  chemically synthesized
tatgttttgctttgtgacaact

SEQ ID NO: 116560 - DNA, 22 bp, Artificial Sequence
  chemically synthesized
atgttttgctttgtgacaactc

SEQ ID NO: 116561 - DNA, 22 bp, Artificial Sequence
  chemically synthesized
tgttttgctttgtgacaactct

SEQ ID NO: 116562 - DNA, 22 bp, Artificial Sequence
  chemically synthesized
tgctttgtgacaactctgagcc

SEQ ID NO: 116563 - DNA, 22 bp, Artificial Sequence
  chemically synthesized
gctttgtgacaactctgagcct

SEQ ID NO: 116564 - DNA, 22 bp, Artificial Sequence
  chemically synthesized
ctttgtgacaactctgagcctt

SEQ ID NO: 116565 - DNA, 22 bp, Artificial Sequence
  chemically synthesized
tgtgacaactctgagcctttgt

SEQ ID NO: 116566 - DNA, 22 bp, Artificial Sequence
  chemically synthesized
gtgacaactctgagcctttgta

SEQ ID NO: 116567 - DNA, 22 bp, Artificial Sequence
  chemically synthesized
tgacaactctgagcctttgtac

SEQ ID NO: 116568 - DNA, 22 bp, Artificial Sequence
  chemically synthesized
tgagcctttgtacatgttttcc

SEQ ID NO: 116569 - DNA, 22 bp, Artificial Sequence
  chemically synthesized
agcctttgtacatgttttcccc

SEQ ID NO: 116570 - DNA, 22 bp, Artificial Sequence
  chemically synthesized
tgtacatgttttcccctctatc

SEQ ID NO: 116571 - DNA, 22 bp, Artificial Sequence
  chemically synthesized
gtacatgttttcccctctatct

SEQ ID NO: 116572 - DNA, 22 bp, Artificial Sequence
  chemically synthesized
tacatgttttcccctctatcta

SEQ ID NO: 116573 - DNA, 22 bp, Artificial Sequence
  chemically synthesized
tcccctctatctaaaatgttac

SEQ ID NO: 116574 - DNA, 22 bp, Artificial Sequence
  chemically synthesized
cccctctatctaaaatgttacc

SEQ ID NO: 116575 - DNA, 22 bp, Artificial Sequence
  chemically synthesized
ccctctatctaaaatgttacct

SEQ ID NO: 116576 - DNA, 22 bp, Artificial Sequence
  chemically synthesized
tatctaaaatgttacctatttt

SEQ ID NO: 116577 - DNA, 22 bp, Artificial Sequence
  chemically synthesized
tctaaaatgttacctattttga

SEQ ID NO: 116578 - DNA, 22 bp, Artificial Sequence
  chemically synthesized
aaatgttacctattttgaatga

SEQ ID NO: 116579 - DNA, 22 bp, Artificial Sequence
  chemically synthesized
cctattttgaatgatagtgcag

SEQ ID NO: 116580 - DNA, 22 bp, Artificial Sequence
  chemically synthesized
ttttgaatgatagtgcagacat

SEQ ID NO: 116581 - DNA, 22 bp, Artificial Sequence
  chemically synthesized
tgaatgatagtgcagacattag

SEQ ID NO: 116582 - DNA, 22 bp, Artificial Sequence
  chemically synthesized
gaatgatagtgcagacattagt

SEQ ID NO: 116583 - DNA, 22 bp, Artificial Sequence
  chemically synthesized
aatgatagtgcagacattagta

SEQ ID NO: 116584 - DNA, 22 bp, Artificial Sequence
  chemically synthesized
gtaaggaaagcttgctaaatat

SEQ ID NO: 116585 - DNA, 22 bp, Artificial Sequence
  chemically synthesized
gctaaatatttgtatcacctgg

SEQ ID NO: 116586 - DNA, 22 bp, Artificial Sequence
  chemically synthesized
ctaaatatttgtatcacctggg

SEQ ID NO: 116587 - DNA, 22 bp, Artificial Sequence
  chemically synthesized
aatatttgtatcacctgggaag

SEQ ID NO: 116588 - DNA, 22 bp, Artificial Sequence
  chemically synthesized
gtatcacctgggaagcctgttt

SEQ ID NO: 116589 - DNA, 22 bp, Artificial Sequence
  chemically synthesized
tatcacctgggaagcctgtttt

SEQ ID NO: 116590 - DNA, 22 bp, Artificial Sequence
  chemically synthesized
ggaagcctgtttttgcttcatc

SEQ ID NO: 116591 - DNA, 22 bp, Artificial Sequence
  chemically synthesized
tttttgcttcatcaggggacgt

SEQ ID NO: 116592 - DNA, 22 bp, Artificial Sequence
  chemically synthesized
ttgcttcatcaggggacgttag

SEQ ID NO: 116593 - DNA, 22 bp, Artificial Sequence
  chemically synthesized
tgcttcatcaggggacgttagt

SEQ ID NO: 116594 - DNA, 22 bp, Artificial Sequence
  chemically synthesized
gcttcatcaggggacgttagtt

SEQ ID NO: 116595 - DNA, 22 bp, Artificial Sequence
  chemically synthesized
cttcatcaggggacgttagttt

SEQ ID NO: 116596 - DNA, 22 bp, Artificial Sequence
  chemically synthesized
catcaggggacgttagtttttt

SEQ ID NO: 116597 - DNA, 22 bp, Artificial Sequence
  chemically synthesized
atcaggggacgttagttttttt

SEQ ID NO: 116598 - DNA, 22 bp, Artificial Sequence
  chemically synthesized
gtttttttcacatcaacctcct

SEQ ID NO: 116599 - DNA, 22 bp, Artificial Sequence
  chemically synthesized
ttttcacatcaacctcctgcag

SEQ ID NO: 116600 - DNA, 22 bp, Artificial Sequence
  chemically synthesized
tttcacatcaacctcctgcaga

SEQ ID NO: 116601 - DNA, 22 bp, Artificial Sequence
  chemically synthesized
ttcacatcaacctcctgcagaa

SEQ ID NO: 116602 - DNA, 22 bp, Artificial Sequence
  chemically synthesized
tcacatcaacctcctgcagaag

SEQ ID NO: 116603 - DNA, 22 bp, Artificial Sequence
  chemically synthesized
cacatcaacctcctgcagaaga

SEQ ID NO: 116604 - DNA, 22 bp, Artificial Sequence
  chemically synthesized
acatcaacctcctgcagaagac

SEQ ID NO: 116605 - DNA, 22 bp, Artificial Sequence
  chemically synthesized
ctgcagaagacaatgctttctg

SEQ ID NO: 116606 - DNA, 22 bp, Artificial Sequence
  chemically synthesized
cagaagacaatgctttctgaaa

SEQ ID NO: 116607 - DNA, 22 bp, Artificial Sequence
  chemically synthesized
tctgaaagacagagtttgtgtc

SEQ ID NO: 116608 - DNA, 22 bp, Artificial Sequence
  chemically synthesized
ctgaaagacagagtttgtgtct

SEQ ID NO: 116609 - DNA, 22 bp, Artificial Sequence
  chemically synthesized
tgaaagacagagtttgtgtctt

SEQ ID NO: 116610 - DNA, 22 bp, Artificial Sequence
  chemically synthesized
aaagacagagtttgtgtcttat

SEQ ID NO: 116611 - DNA, 22 bp, Artificial Sequence
  chemically synthesized
gtgtcttattaatgcttgcatt

SEQ ID NO: 116612 - DNA, 22 bp, Artificial Sequence
  chemically synthesized
tgtcttattaatgcttgcattc

SEQ ID NO: 116613 - DNA, 22 bp, Artificial Sequence
  chemically synthesized
attaatgcttgcattcaaatat

SEQ ID NO: 116614 - DNA, 22 bp, Artificial Sequence
  chemically synthesized
ttaatgcttgcattcaaatatc

SEQ ID NO: 116615 - DNA, 22 bp, Artificial Sequence
  chemically synthesized
atgcttgcattcaaatatctga

SEQ ID NO: 116616 - DNA, 22 bp, Artificial Sequence
  chemically synthesized
gcattcaaatatctgacccaaa

SEQ ID NO: 116617 - DNA, 22 bp, Artificial Sequence
  chemically synthesized
cattcaaatatctgacccaaag

SEQ ID NO: 116618 - DNA, 22 bp, Artificial Sequence
  chemically synthesized
aaatatctgacccaaagcttgt

SEQ ID NO: 116619 - DNA, 22 bp, Artificial Sequence
  chemically synthesized
acccaaagcttgtgatctttac

SEQ ID NO: 116620 - DNA, 22 bp, Artificial Sequence
  chemically synthesized
gtgatctttacatacttgctca

SEQ ID NO: 116621 - DNA, 22 bp, Artificial Sequence
  chemically synthesized
tgatctttacatacttgctcag

SEQ ID NO: 116622 - DNA, 22 bp, Artificial Sequence
  chemically synthesized
tacatacttgctcagtgaatga

SEQ ID NO: 116623 - DNA, 22 bp, Artificial Sequence
  chemically synthesized
acatacttgctcagtgaatgac

SEQ ID NO: 116624 - DNA, 22 bp, Artificial Sequence
  chemically synthesized
catacttgctcagtgaatgaca

SEQ ID NO: 116625 - DNA, 22 bp, Artificial Sequence
  chemically synthesized
gctcagtgaatgacagtgaata

SEQ ID NO: 116626 - DNA, 22 bp, Artificial Sequence
  chemically synthesized
ctcagtgaatgacagtgaataa

SEQ ID NO: 116627 - DNA, 22 bp, Artificial Sequence
  chemically synthesized
agtgaatgacagtgaataacta

SEQ ID NO: 116628 - DNA, 22 bp, Artificial Sequence
  chemically synthesized
cctggttgtaaagactgtctca

SEQ ID NO: 116629 - DNA, 22 bp, Artificial Sequence
  chemically synthesized
gttgtaaagactgtctcaaggg

SEQ ID NO: 116630 - DNA, 22 bp, Artificial Sequence
  chemically synthesized
taaagactgtctcaaggggact

SEQ ID NO: 116631 - DNA, 22 bp, Artificial Sequence
  chemically synthesized
tctcaaggggacttttgtctgg

SEQ ID NO: 116632 - DNA, 22 bp, Artificial Sequence
  chemically synthesized
aaggggacttttgtctgggaaa

SEQ ID NO: 116633 - DNA, 22 bp, Artificial Sequence
  chemically synthesized
ttgtctgggaaaagaaaagaaa

SEQ ID NO: 116634 - DNA, 22 bp, Artificial Sequence
  chemically synthesized
tgtctgggaaaagaaaagaaag

SEQ ID NO: 116635 - DNA, 22 bp, Artificial Sequence
  chemically synthesized
gtctgggaaaagaaaagaaaga

SEQ ID NO: 116636 - DNA, 22 bp, Artificial Sequence
  chemically synthesized
tctgggaaaagaaaagaaagac

SEQ ID NO: 116637 - DNA, 22 bp, Artificial Sequence
  chemically synthesized
ggaaaagaaaagaaagacaaaa

SEQ ID NO: 116638 - DNA, 22 bp, Artificial Sequence
  chemically synthesized
agaagcacccaataaattttct

SEQ ID NO: 116639 - DNA, 22 bp, Artificial Sequence
  chemically synthesized
tcttatgaagttggcagctggg

SEQ ID NO: 116640 - DNA, 22 bp, Artificial Sequence
  chemically synthesized
cttatgaagttggcagctgggg

SEQ ID NO: 116641 - DNA, 22 bp, Artificial Sequence
  chemically synthesized
ttatgaagttggcagctgggga

SEQ ID NO: 116642 - DNA, 22 bp, Artificial Sequence
  chemically synthesized
atgaagttggcagctggggaga

SEQ ID NO: 116643 - DNA, 22 bp, Artificial Sequence
  chemically synthesized
tgaagttggcagctggggagag

SEQ ID NO: 116644 - DNA, 22 bp, Artificial Sequence
  chemically synthesized
gcagctggggagagaagacagt

SEQ ID NO: 116645 - DNA, 22 bp, Artificial Sequence
  chemically synthesized
gggagagaagacagtcaaggat

SEQ ID NO: 116646 - DNA, 22 bp, Artificial Sequence
  chemically synthesized
tggctcactgaaatacctccta

SEQ ID NO: 116647 - DNA, 22 bp, Artificial Sequence
  chemically synthesized
gctcactgaaatacctcctaga

SEQ ID NO: 116648 - DNA, 22 bp, Artificial Sequence
  chemically synthesized
actgaaatacctcctagaggta

SEQ ID NO: 116649 - DNA, 22 bp, Artificial Sequence
  chemically synthesized
aaatacctcctagaggtactca

SEQ ID NO: 116650 - DNA, 22 bp, Artificial Sequence
  chemically synthesized
ctagaggtactcatggttcact

SEQ ID NO: 116651 - DNA, 22 bp, Artificial Sequence
  chemically synthesized
gaggtactcatggttcactaaa

SEQ ID NO: 116652 - DNA, 22 bp, Artificial Sequence
  chemically synthesized
atggttcactaaatttccattt

SEQ ID NO: 116653 - DNA, 22 bp, Artificial Sequence
  chemically synthesized
actaaatttccatttaagataa

SEQ ID NO: 116654 - DNA, 22 bp, Artificial Sequence
  chemically synthesized
aatttccatttaagataactgg

SEQ ID NO: 116655 - DNA, 22 bp, Artificial Sequence
  chemically synthesized
ccatttaagataactgggcatc

SEQ ID NO: 116656 - DNA, 22 bp, Artificial Sequence
  chemically synthesized
catttaagataactgggcatct

SEQ ID NO: 116657 - DNA, 22 bp, Artificial Sequence
  chemically synthesized
aagataactgggcatctcaaat

SEQ ID NO: 116658 - DNA, 22 bp, Artificial Sequence
  chemically synthesized
agataactgggcatctcaaatg

SEQ ID NO: 116659 - DNA, 22 bp, Artificial Sequence
  chemically synthesized
ggcatctcaaatgctttggtct

SEQ ID NO: 116660 - DNA, 22 bp, Artificial Sequence
  chemically synthesized
aaatgctttggtctaggaggat

SEQ ID NO: 116661 - DNA, 22 bp, Artificial Sequence
  chemically synthesized
tggtctaggaggatgctaatcc

SEQ ID NO: 116662 - DNA, 22 bp, Artificial Sequence
  chemically synthesized
ggtctaggaggatgctaatccc

SEQ ID NO: 116663 - DNA, 22 bp, Artificial Sequence
  chemically synthesized
gtctaggaggatgctaatccct

SEQ ID NO: 116664 - DNA, 22 bp, Artificial Sequence
  chemically synthesized
ggaggatgctaatccctctttg

SEQ ID NO: 116665 - DNA, 22 bp, Artificial Sequence
  chemically synthesized
atccctctttgacattcatcaa

SEQ ID NO: 116666 - DNA, 22 bp, Artificial Sequence
  chemically synthesized
tttgacattcatcaagtctgcg

SEQ ID NO: 116667 - DNA, 22 bp, Artificial Sequence
  chemically synthesized
tgacattcatcaagtctgcgtc

SEQ ID NO: 116668 - DNA, 22 bp, Artificial Sequence
  chemically synthesized
gacattcatcaagtctgcgtcc

SEQ ID NO: 116669 - DNA, 22 bp, Artificial Sequence
  chemically synthesized
acattcatcaagtctgcgtcca

SEQ ID NO: 116670 - DNA, 22 bp, Artificial Sequence
  chemically synthesized
atcaagtctgcgtccatctagg

SEQ ID NO: 116671 - DNA, 22 bp, Artificial Sequence
  chemically synthesized
cgtccatctagggagattcctt

SEQ ID NO: 116672 - DNA, 22 bp, Artificial Sequence
  chemically synthesized
gggagattcctttgagggccaa

SEQ ID NO: 116673 - DNA, 22 bp, Artificial Sequence
  chemically synthesized
ctttgagggccaaagacccaag

SEQ ID NO: 116674 - DNA, 22 bp, Artificial Sequence
  chemically synthesized
tgagggccaaagacccaaggaa

SEQ ID NO: 116675 - DNA, 22 bp, Artificial Sequence
  chemically synthesized
gagggccaaagacccaaggaag

SEQ ID NO: 116676 - DNA, 22 bp, Artificial Sequence
  chemically synthesized
agggccaaagacccaaggaaga

SEQ ID NO: 116677 - DNA, 22 bp, Artificial Sequence
  chemically synthesized
tataagtgccagtgcagcccac

SEQ ID NO: 116678 - DNA, 22 bp, Artificial Sequence
  chemically synthesized
ataagtgccagtgcagcccacg

SEQ ID NO: 116679 - DNA, 22 bp, Artificial Sequence
  chemically synthesized
taagtgccagtgcagcccacgt

SEQ ID NO: 116680 - DNA, 22 bp, Artificial Sequence
  chemically synthesized
agtcaaatggaagatgctggca

SEQ ID NO: 116681 - DNA, 22 bp, Artificial Sequence
  chemically synthesized
gcatggagtggaagggctgcat

SEQ ID NO: 116682 - DNA, 22 bp, Artificial Sequence
  chemically synthesized
catgagaaagaagctacagaga

SEQ ID NO: 116683 - DNA, 22 bp, Artificial Sequence
  chemically synthesized
cagagaagaaaggaccagtaag

SEQ ID NO: 116684 - DNA, 22 bp, Artificial Sequence
  chemically synthesized
ctgaaggtcctttgttttgtgg

SEQ ID NO: 116685 - DNA, 22 bp, Artificial Sequence
  chemically synthesized
aaggtcctttgttttgtggata

SEQ ID NO: 116686 - DNA, 22 bp, Artificial Sequence
  chemically synthesized
tgttttgtggataaaggaagtc

SEQ ID NO: 116687 - DNA, 22 bp, Artificial Sequence
  chemically synthesized
gttttgtggataaaggaagtca

SEQ ID NO: 116688 - DNA, 22 bp, Artificial Sequence
  chemically synthesized
ttttgtggataaaggaagtcat

SEQ ID NO: 116689 - DNA, 22 bp, Artificial Sequence
  chemically synthesized
tgtggataaaggaagtcattgg

SEQ ID NO: 116690 - DNA, 22 bp, Artificial Sequence
  chemically synthesized
gtggataaaggaagtcattgga

SEQ ID NO: 116691 - DNA, 22 bp, Artificial Sequence
  chemically synthesized
tggataaaggaagtcattggag

SEQ ID NO: 116692 - DNA, 22 bp, Artificial Sequence
  chemically synthesized
gagtgacctctctaatatccct

SEQ ID NO: 116693 - DNA, 22 bp, Artificial Sequence
  chemically synthesized
tctaatatcccttatctagcat

SEQ ID NO: 116694 - DNA, 22 bp, Artificial Sequence
  chemically synthesized
taatatcccttatctagcatga

SEQ ID NO: 116695 - DNA, 22 bp, Artificial Sequence
  chemically synthesized
atatcccttatctagcatgact

SEQ ID NO: 116696 - DNA, 22 bp, Artificial Sequence
  chemically synthesized
atctagcatgactatatgcagg

SEQ ID NO: 116697 - DNA, 22 bp, Artificial Sequence
  chemically synthesized
tctagcatgactatatgcaggg

SEQ ID NO: 116698 - DNA, 22 bp, Artificial Sequence
  chemically synthesized
gcatgactatatgcagggttat

SEQ ID NO: 116699 - DNA, 22 bp, Artificial Sequence
  chemically synthesized
tatgcagggttatggaataggg

SEQ ID NO: 116700 - DNA, 22 bp, Artificial Sequence
  chemically synthesized
tggaatagggcagcttccagga

SEQ ID NO: 116701 - DNA, 22 bp, Artificial Sequence
  chemically synthesized
ccaggaagatggccaatctgtt

SEQ ID NO: 116702 - DNA, 22 bp, Artificial Sequence
  chemically synthesized
caggaagatggccaatctgttg

SEQ ID NO: 116703 - DNA, 22 bp, Artificial Sequence
  chemically synthesized
ttgttagggctgctgttctatc

SEQ ID NO: 116704 - DNA, 22 bp, Artificial Sequence
  chemically synthesized
ttagggctgctgttctatcata

SEQ ID NO: 116705 - DNA, 22 bp, Artificial Sequence
  chemically synthesized
gggctgctgttctatcatatct

SEQ ID NO: 116706 - DNA, 22 bp, Artificial Sequence
  chemically synthesized
ctgttctatcatatctcccgtg

SEQ ID NO: 116707 - DNA, 22 bp, Artificial Sequence
  chemically synthesized
ttctatcatatctcccgtgatg

SEQ ID NO: 116708 - DNA, 22 bp, Artificial Sequence
  chemically synthesized
tatcatatctcccgtgatgttt

SEQ ID NO: 116709 - DNA, 22 bp, Artificial Sequence
  chemically synthesized
tcatatctcccgtgatgttttt

SEQ ID NO: 116710 - DNA, 22 bp, Artificial Sequence
  chemically synthesized
ccgtgatgtttttgatggggaa

SEQ ID NO: 116711 - DNA, 22 bp, Artificial Sequence
  chemically synthesized
ttgatggggaagacagatctgg

SEQ ID NO: 116712 - DNA, 22 bp, Artificial Sequence
  chemically synthesized
tgatggggaagacagatctgga

SEQ ID NO: 116713 - DNA, 22 bp, Artificial Sequence
  chemically synthesized
gatggggaagacagatctggac

SEQ ID NO: 116714 - DNA, 22 bp, Artificial Sequence
  chemically synthesized
atggggaagacagatctggact

SEQ ID NO: 116715 - DNA, 22 bp, Artificial Sequence
  chemically synthesized
gacttgttactgggctatgcct

SEQ ID NO: 116716 - DNA, 22 bp, Artificial Sequence
  chemically synthesized
gttactgggctatgccttgtag

SEQ ID NO: 116717 - DNA, 22 bp, Artificial Sequence
  chemically synthesized
ttactgggctatgccttgtaga

SEQ ID NO: 116718 - DNA, 22 bp, Artificial Sequence
  chemically synthesized
ctgggctatgccttgtagagaa

SEQ ID NO: 116719 - DNA, 22 bp, Artificial Sequence
  chemically synthesized
ggctatgccttgtagagaatga

SEQ ID NO: 116720 - DNA, 22 bp, Artificial Sequence
  chemically synthesized
tgccttgtagagaatgatacag

SEQ ID NO: 116721 - DNA, 22 bp, Artificial Sequence
  chemically synthesized
gtagagaatgatacagggttgt

SEQ ID NO: 116722 - DNA, 22 bp, Artificial Sequence
  chemically synthesized
tagagaatgatacagggttgtg

SEQ ID NO: 116723 - DNA, 22 bp, Artificial Sequence
  chemically synthesized
tggcaggcaaggaaacataatc

SEQ ID NO: 116724 - DNA, 22 bp, Artificial Sequence
  chemically synthesized
agcaattgctccaattgatgaa

SEQ ID NO: 116725 - DNA, 22 bp, Artificial Sequence
  chemically synthesized
ctccaattgatgaagcttctaa

SEQ ID NO: 116726 - DNA, 22 bp, Artificial Sequence
  chemically synthesized
caattgatgaagcttctaacat

SEQ ID NO: 116727 - DNA, 22 bp, Artificial Sequence
  chemically synthesized
atgaagcttctaacatttcaga

SEQ ID NO: 116728 - DNA, 22 bp, Artificial Sequence
  chemically synthesized
ctaacatttcagagtgctttcc

SEQ ID NO: 116729 - DNA, 22 bp, Artificial Sequence
  chemically synthesized
taacatttcagagtgctttcct

SEQ ID NO: 116730 - DNA, 22 bp, Artificial Sequence
  chemically synthesized
acatttcagagtgctttcctcc

SEQ ID NO: 116731 - DNA, 22 bp, Artificial Sequence
  chemically synthesized
cagagtgctttcctccacagcc

SEQ ID NO: 116732 - DNA, 22 bp, Artificial Sequence
  chemically synthesized
agagtgctttcctccacagccc

SEQ ID NO: 116733 - DNA, 22 bp, Artificial Sequence
  chemically synthesized
tcctccacagccccattaaacc

SEQ ID NO: 116734 - DNA, 22 bp, Artificial Sequence
  chemically synthesized
cctccacagccccattaaacct

SEQ ID NO: 116735 - DNA, 22 bp, Artificial Sequence
  chemically synthesized
ctccacagccccattaaaccta

SEQ ID NO: 116736 - DNA, 22 bp, Artificial Sequence
  chemically synthesized
cacagccccattaaacctaatc

SEQ ID NO: 116737 - DNA, 22 bp, Artificial Sequence
  chemically synthesized
aacctaatcatttctctcgaaa

SEQ ID NO: 116738 - DNA, 22 bp, Artificial Sequence
  chemically synthesized
atcatttctctcgaaaagaggc

SEQ ID NO: 116739 - DNA, 22 bp, Artificial Sequence
  chemically synthesized
ctctcgaaaagaggcagggccc

SEQ ID NO: 116740 - DNA, 22 bp, Artificial Sequence
  chemically synthesized
tctcgaaaagaggcagggccca

SEQ ID NO: 116741 - DNA, 22 bp, Artificial Sequence
  chemically synthesized
tcgaaaagaggcagggcccatg

SEQ ID NO: 116742 - DNA, 22 bp, Artificial Sequence
  chemically synthesized
gaaaagaggcagggcccatgtg

SEQ ID NO: 116743 - DNA, 22 bp, Artificial Sequence
  chemically synthesized
tcaacatagtaaaaaagctaag

SEQ ID NO: 116744 - DNA, 22 bp, Artificial Sequence
  chemically synthesized
caacatagtaaaaaagctaagg

SEQ ID NO: 116745 - DNA, 22 bp, Artificial Sequence
  chemically synthesized
aacatagtaaaaaagctaaggt

SEQ ID NO: 116746 - DNA, 22 bp, Artificial Sequence
  chemically synthesized
aggtttagaaagattcagtaac

SEQ ID NO: 116747 - DNA, 22 bp, Artificial Sequence
  chemically synthesized
agaaagattcagtaactttgcc

SEQ ID NO: 116748 - DNA, 22 bp, Artificial Sequence
  chemically synthesized
gaaagattcagtaactttgcca

SEQ ID NO: 116749 - DNA, 22 bp, Artificial Sequence
  chemically synthesized
agtaactttgccaaagccatat

SEQ ID NO: 116750 - DNA, 22 bp, Artificial Sequence
  chemically synthesized
tgccaaagccatatggaaggat

SEQ ID NO: 116751 - DNA, 22 bp, Artificial Sequence
  chemically synthesized
gccaaagccatatggaaggatt

SEQ ID NO: 116752 - DNA, 22 bp, Artificial Sequence
  chemically synthesized
ccaaagccatatggaaggattg

SEQ ID NO: 116753 - DNA, 22 bp, Artificial Sequence
  chemically synthesized
tccaaaaacctgtgcaagagct

SEQ ID NO: 116754 - DNA, 22 bp, Artificial Sequence
  chemically synthesized
tgcaagagctcatggcttccca

SEQ ID NO: 116755 - DNA, 22 bp, Artificial Sequence
  chemically synthesized
atggcttcccactccaaatacc

SEQ ID NO: 116756 - DNA, 22 bp, Artificial Sequence
  chemically synthesized
cccactccaaataccttacgct

SEQ ID NO: 116757 - DNA, 22 bp, Artificial Sequence
  chemically synthesized
ccactccaaataccttacgctt

SEQ ID NO: 116758 - DNA, 22 bp, Artificial Sequence
  chemically synthesized
caaataccttacgcttcattgt

SEQ ID NO: 116759 - DNA, 22 bp, Artificial Sequence
  chemically synthesized
acgcttcattgttgtcagatta

SEQ ID NO: 116760 - DNA, 22 bp, Artificial Sequence
  chemically synthesized
cgcttcattgttgtcagattat

SEQ ID NO: 116761 - DNA, 22 bp, Artificial Sequence
  chemically synthesized
cattgttgtcagattatttttc

SEQ ID NO: 116762 - DNA, 22 bp, Artificial Sequence
  chemically synthesized
attgttgtcagattatttttca

SEQ ID NO: 116763 - DNA, 22 bp, Artificial Sequence
  chemically synthesized
ttgtcagattatttttcaatct

SEQ ID NO: 116764 - DNA, 22 bp, Artificial Sequence
  chemically synthesized
tcagattatttttcaatctttt

SEQ ID NO: 116765 - DNA, 22 bp, Artificial Sequence
  chemically synthesized
tttttcaatcttttcttagagc

SEQ ID NO: 116766 - DNA, 22 bp, Artificial Sequence
  chemically synthesized
ttcaatcttttcttagagctca

SEQ ID NO: 116767 - DNA, 22 bp, Artificial Sequence
  chemically synthesized
tcaatcttttcttagagctcac

SEQ ID NO: 116768 - DNA, 22 bp, Artificial Sequence
  chemically synthesized
caatcttttcttagagctcact

SEQ ID NO: 116769 - DNA, 22 bp, Artificial Sequence
  chemically synthesized
aatcttttcttagagctcactg

SEQ ID NO: 116770 - DNA, 22 bp, Artificial Sequence
  chemically synthesized
ttcttagagctcactgcaacat

SEQ ID NO: 116771 - DNA, 22 bp, Artificial Sequence
  chemically synthesized
tcttagagctcactgcaacatt

SEQ ID NO: 116772 - DNA, 22 bp, Artificial Sequence
  chemically synthesized
cttagagctcactgcaacattg

SEQ ID NO: 116773 - DNA, 22 bp, Artificial Sequence
  chemically synthesized
ttagagctcactgcaacattgc

SEQ ID NO: 116774 - DNA, 22 bp, Artificial Sequence
  chemically synthesized
agagctcactgcaacattgctc

SEQ ID NO: 116775 - DNA, 22 bp, Artificial Sequence
  chemically synthesized
gagctcactgcaacattgctca

SEQ ID NO: 116776 - DNA, 22 bp, Artificial Sequence
  chemically synthesized
actgcaacattgctcactggaa

SEQ ID NO: 116777 - DNA, 22 bp, Artificial Sequence
  chemically synthesized
caacattgctcactggaatgct

SEQ ID NO: 116778 - DNA, 22 bp, Artificial Sequence
  chemically synthesized
ctcactggaatgctggaaagta

SEQ ID NO: 116779 - DNA, 22 bp, Artificial Sequence
  chemically synthesized
actggaatgctggaaagtacaa

SEQ ID NO: 116780 - DNA, 22 bp, Artificial Sequence
  chemically synthesized
gaatgctggaaagtacaactaa

SEQ ID NO: 116781 - DNA, 22 bp, Artificial Sequence
  chemically synthesized
gaaagtacaactaataaaatgt

SEQ ID NO: 116782 - DNA, 22 bp, Artificial Sequence
  chemically synthesized
ataaaatgtgtctattgagtat

SEQ ID NO: 116783 - DNA, 22 bp, Artificial Sequence
  chemically synthesized
ttgagtatttgcttctaactgt

SEQ ID NO: 116784 - DNA, 22 bp, Artificial Sequence
  chemically synthesized
agtatttgcttctaactgtact

SEQ ID NO: 116785 - DNA, 22 bp, Artificial Sequence
  chemically synthesized
gcttctaactgtactccattta

SEQ ID NO: 116786 - DNA, 22 bp, Artificial Sequence
  chemically synthesized
cttctaactgtactccatttaa

SEQ ID NO: 116787 - DNA, 22 bp, Artificial Sequence
  chemically synthesized
ctaactgtactccatttaaaat

SEQ ID NO: 116788 - DNA, 22 bp, Artificial Sequence
  chemically synthesized
taactgtactccatttaaaatt

SEQ ID NO: 116789 - DNA, 22 bp, Artificial Sequence
  chemically synthesized
actgtactccatttaaaattgc

SEQ ID NO: 116790 - DNA, 22 bp, Artificial Sequence
  chemically synthesized
tactccatttaaaattgcatat

SEQ ID NO: 116791 - DNA, 22 bp, Artificial Sequence
  chemically synthesized
catttaaaattgcatatgaatg

SEQ ID NO: 116792 - DNA, 22 bp, Artificial Sequence
  chemically synthesized
aaaattgcatatgaatggctct

SEQ ID NO: 116793 - DNA, 22 bp, Artificial Sequence
  chemically synthesized
aaattgcatatgaatggctctc

SEQ ID NO: 116794 - DNA, 22 bp, Artificial Sequence
  chemically synthesized
catatgaatggctctctaatct

SEQ ID NO: 116795 - DNA, 22 bp, Artificial Sequence
  chemically synthesized
tctaatctatggagtaggtaga

SEQ ID NO: 116796 - DNA, 22 bp, Artificial Sequence
  chemically synthesized
taatctatggagtaggtagaat

SEQ ID NO: 116797 - DNA, 22 bp, Artificial Sequence
  chemically synthesized
atctatggagtaggtagaattg

SEQ ID NO: 116798 - DNA, 22 bp, Artificial Sequence
  chemically synthesized
tggagtaggtagaattgtctca

SEQ ID NO: 116799 - DNA, 22 bp, Artificial Sequence
  chemically synthesized
tctcaatttttcagatgaagaa

SEQ ID NO: 116800 - DNA, 22 bp, Artificial Sequence
  chemically synthesized
aatttttcagatgaagaaacta

SEQ ID NO: 116801 - DNA, 22 bp, Artificial Sequence
  chemically synthesized
ttcagatgaagaaactaagatt

SEQ ID NO: 116802 - DNA, 22 bp, Artificial Sequence
  chemically synthesized
tcagatgaagaaactaagatta

SEQ ID NO: 116803 - DNA, 22 bp, Artificial Sequence
  chemically synthesized
cagatgaagaaactaagattaa

SEQ ID NO: 116804 - DNA, 22 bp, Artificial Sequence
  chemically synthesized
agatgaagaaactaagattaat

SEQ ID NO: 116805 - DNA, 22 bp, Artificial Sequence
  chemically synthesized
agattaatcagatactttgcac

SEQ ID NO: 116806 - DNA, 22 bp, Artificial Sequence
  chemically synthesized
atcagatactttgcacaatcat

SEQ ID NO: 116807 - DNA, 22 bp, Artificial Sequence
  chemically synthesized
tgcacaatcatagagtgaagag

SEQ ID NO: 116808 - DNA, 22 bp, Artificial Sequence
  chemically synthesized
gcacaatcatagagtgaagagc

SEQ ID NO: 116809 - DNA, 22 bp, Artificial Sequence
  chemically synthesized
cacaatcatagagtgaagagct

SEQ ID NO: 116810 - DNA, 22 bp, Artificial Sequence
  chemically synthesized
ttgaagttatgattgtaataca

SEQ ID NO: 116811 - DNA, 22 bp, Artificial Sequence
  chemically synthesized
aagttatgattgtaatacagat

SEQ ID NO: 116812 - DNA, 22 bp, Artificial Sequence
  chemically synthesized
tgattgtaatacagatctggtc

SEQ ID NO: 116813 - DNA, 22 bp, Artificial Sequence
  chemically synthesized
taatacagatctggtcccagag

SEQ ID NO: 116814 - DNA, 22 bp, Artificial Sequence
  chemically synthesized
gtcccagagacactgctcttaa

SEQ ID NO: 116815 - DNA, 22 bp, Artificial Sequence
  chemically synthesized
ctcttaaccacactgcactgcc

SEQ ID NO: 116816 - DNA, 22 bp, Artificial Sequence
  chemically synthesized
ttaaccacactgcactgcctaa

SEQ ID NO: 116817 - DNA, 22 bp, Artificial Sequence
  chemically synthesized
aaccacactgcactgcctaatg

SEQ ID NO: 116818 - DNA, 22 bp, Artificial Sequence
  chemically synthesized
accacactgcactgcctaatga

SEQ ID NO: 116819 - DNA, 22 bp, Artificial Sequence
  chemically synthesized
cactgcctaatgaaaatgtgcc

SEQ ID NO: 116820 - DNA, 22 bp, Artificial Sequence
  chemically synthesized
cctaatgaaaatgtgcctaggc

SEQ ID NO: 116821 - DNA, 22 bp, Artificial Sequence
  chemically synthesized
atgaaaatgtgcctaggctgca

SEQ ID NO: 116822 - DNA, 22 bp, Artificial Sequence
  chemically synthesized
ggctgcaagacagggatgccct

SEQ ID NO: 116823 - DNA, 22 bp, Artificial Sequence
  chemically synthesized
caagacagggatgccctctctc

SEQ ID NO: 116824 - DNA, 22 bp, Artificial Sequence
  chemically synthesized
tctcaccactcctattcaacat

SEQ ID NO: 116825 - DNA, 22 bp, Artificial Sequence
  chemically synthesized
tcaccactcctattcaacatag

SEQ ID NO: 116826 - DNA, 22 bp, Artificial Sequence
  chemically synthesized
accactcctattcaacatagtg

SEQ ID NO: 116827 - DNA, 22 bp, Artificial Sequence
  chemically synthesized
ctattcaacatagtgttggaag

SEQ ID NO: 116828 - DNA, 22 bp, Artificial Sequence
  chemically synthesized
ttcaacatagtgttggaagttc

SEQ ID NO: 116829 - DNA, 22 bp, Artificial Sequence
  chemically synthesized
aacatagtgttggaagttctgg

SEQ ID NO: 116830 - DNA, 22 bp, Artificial Sequence
  chemically synthesized
gaagttctggcccgggcaatcg

SEQ ID NO: 116831 - DNA, 22 bp, Artificial Sequence
  chemically synthesized
tggcccgggcaatcgggcagga

SEQ ID NO: 116832 - DNA, 22 bp, Artificial Sequence
  chemically synthesized
gcccgggcaatcgggcaggaga

SEQ ID NO: 116833 - DNA, 22 bp, Artificial Sequence
  chemically synthesized
aattatgtaaagagaaagtcaa

SEQ ID NO: 116834 - DNA, 22 bp, Artificial Sequence
  chemically synthesized
tgtaaagagaaagtcaaattgt

SEQ ID NO: 116835 - DNA, 22 bp, Artificial Sequence
  chemically synthesized
tccctgtttgcagatgacgtga

SEQ ID NO: 116836 - DNA, 22 bp, Artificial Sequence
  chemically synthesized
tttgcagatgacgtgattgcat

SEQ ID NO: 116837 - DNA, 22 bp, Artificial Sequence
  chemically synthesized
gcagatgacgtgattgcatatc

SEQ ID NO: 116838 - DNA, 22 bp, Artificial Sequence
  chemically synthesized
cagatgacgtgattgcatatct

SEQ ID NO: 116839 - DNA, 22 bp, Artificial Sequence
  chemically synthesized
catatctagaaaaccccattgt

SEQ ID NO: 116840 - DNA, 22 bp, Artificial Sequence
  chemically synthesized
gaaaaccccattgtctcagccc

SEQ ID NO: 116841 - DNA, 22 bp, Artificial Sequence
  chemically synthesized
tctcagcccaaaatccccttaa

SEQ ID NO: 116842 - DNA, 22 bp, Artificial Sequence
  chemically synthesized
agcccaaaatccccttaagctg

SEQ ID NO: 116843 - DNA, 22 bp, Artificial Sequence
  chemically synthesized
aagctgataagcaacttcagca

SEQ ID NO: 116844 - DNA, 22 bp, Artificial Sequence
  chemically synthesized
agctgataagcaacttcagcaa

SEQ ID NO: 116845 - DNA, 22 bp, Artificial Sequence
  chemically synthesized
ataagcaacttcagcaaagtct

SEQ ID NO: 116846 - DNA, 22 bp, Artificial Sequence
  chemically synthesized
cagcaaagtctcaggatacaaa

SEQ ID NO: 116847 - DNA, 22 bp, Artificial Sequence
  chemically synthesized
agcaaagtctcaggatacaaaa

SEQ ID NO: 116848 - DNA, 22 bp, Artificial Sequence
  chemically synthesized
aggatacaaaatcaatgtgcaa

SEQ ID NO: 116849 - DNA, 22 bp, Artificial Sequence
  chemically synthesized
ttatacaccaataacagacaaa

SEQ ID NO: 116850 - DNA, 22 bp, Artificial Sequence
  chemically synthesized
atacaccaataacagacaaaca

SEQ ID NO: 116851 - DNA, 22 bp, Artificial Sequence
  chemically synthesized
tacaccaataacagacaaacag

SEQ ID NO: 116852 - DNA, 22 bp, Artificial Sequence
  chemically synthesized
ccattcacaattgcttcagaga

SEQ ID NO: 116853 - DNA, 22 bp, Artificial Sequence
  chemically synthesized
acaattgcttcagagagaatat

SEQ ID NO: 116854 - DNA, 22 bp, Artificial Sequence
  chemically synthesized
cttcagagagaatataatacct

SEQ ID NO: 116855 - DNA, 22 bp, Artificial Sequence
  chemically synthesized
cagagagaatataatacctagg

SEQ ID NO: 116856 - DNA, 22 bp, Artificial Sequence
  chemically synthesized
agagagaatataatacctagga

SEQ ID NO: 116857 - DNA, 22 bp, Artificial Sequence
  chemically synthesized
ggaatccaacttacaagggatg

SEQ ID NO: 116858 - DNA, 22 bp, Artificial Sequence
  chemically synthesized
acaagggatgtgaaggacctct

SEQ ID NO: 116859 - DNA, 22 bp, Artificial Sequence
  chemically synthesized
caagggatgtgaaggacctctt

SEQ ID NO: 116860 - DNA, 22 bp, Artificial Sequence
  chemically synthesized
ttcaaggagaactacaaaccac

SEQ ID NO: 116861 - DNA, 22 bp, Artificial Sequence
  chemically synthesized
caaggagaactacaaaccactg

SEQ ID NO: 116862 - DNA, 22 bp, Artificial Sequence
  chemically synthesized
aaggagaactacaaaccactgc

SEQ ID NO: 116863 - DNA, 22 bp, Artificial Sequence
  chemically synthesized
caaaccactgctcaaggaaata

SEQ ID NO: 116864 - DNA, 22 bp, Artificial Sequence
  chemically synthesized
ctcaaggaaataagatacaaac

SEQ ID NO: 116865 - DNA, 22 bp, Artificial Sequence
  chemically synthesized
aaggaaataagatacaaacaaa

SEQ ID NO: 116866 - DNA, 22 bp, Artificial Sequence
  chemically synthesized
catgctcatggataggaagaaa

SEQ ID NO: 116867 - DNA, 22 bp, Artificial Sequence
  chemically synthesized
atggataggaagaaacaatatc

SEQ ID NO: 116868 - DNA, 22 bp, Artificial Sequence
  chemically synthesized
cccaaggtaatttatagattca

SEQ ID NO: 116869 - DNA, 22 bp, Artificial Sequence
  chemically synthesized
atagattcaatgccatccccat

SEQ ID NO: 116870 - DNA, 22 bp, Artificial Sequence
  chemically synthesized
tagattcaatgccatccccatc

SEQ ID NO: 116871 - DNA, 22 bp, Artificial Sequence
  chemically synthesized
aatgccatccccatcaagctac

SEQ ID NO: 116872 - DNA, 22 bp, Artificial Sequence
  chemically synthesized
ccaatgactttcttcacagaat

SEQ ID NO: 116873 - DNA, 22 bp, Artificial Sequence
  chemically synthesized
tcttcacagaattggaaaaaac

SEQ ID NO: 116874 - DNA, 22 bp, Artificial Sequence
  chemically synthesized
cttcacagaattggaaaaaact

SEQ ID NO: 116875 - DNA, 22 bp, Artificial Sequence
  chemically synthesized
ttcacagaattggaaaaaacta

SEQ ID NO: 116876 - DNA, 22 bp, Artificial Sequence
  chemically synthesized
cacagaattggaaaaaactact

SEQ ID NO: 116877 - DNA, 22 bp, Artificial Sequence
  chemically synthesized
acagaattggaaaaaactactt

SEQ ID NO: 116878 - DNA, 22 bp, Artificial Sequence
  chemically synthesized
gaaaaaactactttaaagttca

SEQ ID NO: 116879 - DNA, 22 bp, Artificial Sequence
  chemically synthesized
ctttaaagttcatatggaacca

SEQ ID NO: 116880 - DNA, 22 bp, Artificial Sequence
  chemically synthesized
taaagttcatatggaaccaaaa

SEQ ID NO: 116881 - DNA, 22 bp, Artificial Sequence
  chemically synthesized
aaagttcatatggaaccaaaaa

SEQ ID NO: 116882 - DNA, 22 bp, Artificial Sequence
  chemically synthesized
aagttcatatggaaccaaaaaa

SEQ ID NO: 116883 - DNA, 22 bp, Artificial Sequence
  chemically synthesized
atatggaaccaaaaaagagccc

SEQ ID NO: 116884 - DNA, 22 bp, Artificial Sequence
  chemically synthesized
agccaaaagaacaaagctggag

SEQ ID NO: 116885 - DNA, 22 bp, Artificial Sequence
  chemically synthesized
gaggcatcacactacctgattt

SEQ ID NO: 116886 - DNA, 22 bp, Artificial Sequence
  chemically synthesized
cctgatttcaaactatactaca

SEQ ID NO: 116887 - DNA, 22 bp, Artificial Sequence
  chemically synthesized
atttcaaactatactacaaggc

SEQ ID NO: 116888 - DNA, 22 bp, Artificial Sequence
  chemically synthesized
caaactatactacaaggctaca

SEQ ID NO: 116889 - DNA, 22 bp, Artificial Sequence
  chemically synthesized
aaactatactacaaggctacag

SEQ ID NO: 116890 - DNA, 22 bp, Artificial Sequence
  chemically synthesized
tactacaaggctacagtaacca

SEQ ID NO: 116891 - DNA, 22 bp, Artificial Sequence
  chemically synthesized
caaggctacagtaaccaaaaca

SEQ ID NO: 116892 - DNA, 22 bp, Artificial Sequence
  chemically synthesized
cagtaaccaaaacagcatagta

SEQ ID NO: 116893 - DNA, 22 bp, Artificial Sequence
  chemically synthesized
gtaccaaaacagagatatagac

SEQ ID NO: 116894 - DNA, 22 bp, Artificial Sequence
  chemically synthesized
agaaataatgctgtctatctac

SEQ ID NO: 116895 - DNA, 22 bp, Artificial Sequence
  chemically synthesized
tctatctacaactatctgatct

SEQ ID NO: 116896 - DNA, 22 bp, Artificial Sequence
  chemically synthesized
tctacaactatctgatctttga

SEQ ID NO: 116897 - DNA, 22 bp, Artificial Sequence
  chemically synthesized
caactatctgatctttgacaaa

SEQ ID NO: 116898 - DNA, 22 bp, Artificial Sequence
  chemically synthesized
tctgatctttgacaaacctgag

SEQ ID NO: 116899 - DNA, 22 bp, Artificial Sequence
  chemically synthesized
atctttgacaaacctgagaaaa

SEQ ID NO: 116900 - DNA, 22 bp, Artificial Sequence
  chemically synthesized
tgacaaacctgagaaaaacaag

SEQ ID NO: 116901 - DNA, 22 bp, Artificial Sequence
  chemically synthesized
gacaaacctgagaaaaacaaga

SEQ ID NO: 116902 - DNA, 22 bp, Artificial Sequence
  chemically synthesized
acaaacctgagaaaaacaagaa

SEQ ID NO: 116903 - DNA, 22 bp, Artificial Sequence
  chemically synthesized
agaaaaacaagaaatggggaaa

SEQ ID NO: 116904 - DNA, 22 bp, Artificial Sequence
  chemically synthesized
cctgtttaataaatggtgctgg

SEQ ID NO: 116905 - DNA, 22 bp, Artificial Sequence
  chemically synthesized
tttaataaatggtgctgggaaa

SEQ ID NO: 116906 - DNA, 22 bp, Artificial Sequence
  chemically synthesized
aataaatggtgctgggaaaact

SEQ ID NO: 116907 - DNA, 22 bp, Artificial Sequence
  chemically synthesized
ataaatggtgctgggaaaactg

SEQ ID NO: 116908 - DNA, 22 bp, Artificial Sequence
  chemically synthesized
ggaaaactggctagccaaatgt

SEQ ID NO: 116909 - DNA, 22 bp, Artificial Sequence
  chemically synthesized
gctagccaaatgtaggaagctg

SEQ ID NO: 116910 - DNA, 22 bp, Artificial Sequence
  chemically synthesized
gccaaatgtaggaagctgaaac

SEQ ID NO: 116911 - DNA, 22 bp, Artificial Sequence
  chemically synthesized
aaactggatcccttccttacac

SEQ ID NO: 116912 - DNA, 22 bp, Artificial Sequence
  chemically synthesized
gatcccttccttacaccttata

SEQ ID NO: 116913 - DNA, 22 bp, Artificial Sequence
  chemically synthesized
ccttacaccttatacaaaaatt

SEQ ID NO: 116914 - DNA, 22 bp, Artificial Sequence
  chemically synthesized
cttacaccttatacaaaaatta

SEQ ID NO: 116915 - DNA, 22 bp, Artificial Sequence
  chemically synthesized
acaccttatacaaaaattaact

SEQ ID NO: 116916 - DNA, 22 bp, Artificial Sequence
  chemically synthesized
caccttatacaaaaattaactc

SEQ ID NO: 116917 - DNA, 22 bp, Artificial Sequence
  chemically synthesized
atacaaaaattaactcaagatg

SEQ ID NO: 116918 - DNA, 22 bp, Artificial Sequence
  chemically synthesized
tacaaaaattaactcaagatgg

SEQ ID NO: 116919 - DNA, 22 bp, Artificial Sequence
  chemically synthesized
actcaagatggattaaagactt

SEQ ID NO: 116920 - DNA, 22 bp, Artificial Sequence
  chemically synthesized
aagatggattaaagacttaaat

SEQ ID NO: 116921 - DNA, 22 bp, Artificial Sequence
  chemically synthesized
aagacttaaatgttagacctaa

SEQ ID NO: 116922 - DNA, 22 bp, Artificial Sequence
  chemically synthesized
aaatgttagacctaaaaccata

SEQ ID NO: 116923 - DNA, 22 bp, Artificial Sequence
  chemically synthesized
aatgttagacctaaaaccataa

SEQ ID NO: 116924 - DNA, 22 bp, Artificial Sequence
  chemically synthesized
gacctaaaaccataaaaactct

SEQ ID NO: 116925 - DNA, 22 bp, Artificial Sequence
  chemically synthesized
aaaccataaaaactctagaaga

SEQ ID NO: 116926 - DNA, 22 bp, Artificial Sequence
  chemically synthesized
tagaagaaaacctaagcaatac

SEQ ID NO: 116927 - DNA, 22 bp, Artificial Sequence
  chemically synthesized
gaagaaaacctaagcaatacca

SEQ ID NO: 116928 - DNA, 22 bp, Artificial Sequence
  chemically synthesized
agcaataccattcaggacatag

SEQ ID NO: 116929 - DNA, 22 bp, Artificial Sequence
  chemically synthesized
aggacataggcatgggcatgga

SEQ ID NO: 116930 - DNA, 22 bp, Artificial Sequence
  chemically synthesized
catgtctaaaacaccaaaagca

SEQ ID NO: 116931 - DNA, 22 bp, Artificial Sequence
  chemically synthesized
atgtctaaaacaccaaaagcaa

SEQ ID NO: 116932 - DNA, 22 bp, Artificial Sequence
  chemically synthesized
aaacaccaaaagcaatggcaac

SEQ ID NO: 116933 - DNA, 22 bp, Artificial Sequence
  chemically synthesized
actaatgggatctaattaaact

SEQ ID NO: 116934 - DNA, 22 bp, Artificial Sequence
  chemically synthesized
atgggatctaattaaactaaag

SEQ ID NO: 116935 - DNA, 22 bp, Artificial Sequence
  chemically synthesized
attaaactaaagatcttctgca

SEQ ID NO: 116936 - DNA, 22 bp, Artificial Sequence
  chemically synthesized
aactaaagatcttctgcacagc

SEQ ID NO: 116937 - DNA, 22 bp, Artificial Sequence
  chemically synthesized
aagatcttctgcacagcaaaag

SEQ ID NO: 116938 - DNA, 22 bp, Artificial Sequence
  chemically synthesized
ctgcacagcaaaagaaactacc

SEQ ID NO: 116939 - DNA, 22 bp, Artificial Sequence
  chemically synthesized
tgcacagcaaaagaaactacca

SEQ ID NO: 116940 - DNA, 22 bp, Artificial Sequence
  chemically synthesized
cacagcaaaagaaactaccatc

SEQ ID NO: 116941 - DNA, 22 bp, Artificial Sequence
  chemically synthesized
ccatcagagtgaacaggcaacc

SEQ ID NO: 116942 - DNA, 22 bp, Artificial Sequence
  chemically synthesized
cacaatgggagaaaatttttgc

SEQ ID NO: 116943 - DNA, 22 bp, Artificial Sequence
  chemically synthesized
ttgcaatctactcatctgacaa

SEQ ID NO: 116944 - DNA, 22 bp, Artificial Sequence
  chemically synthesized
tgcaatctactcatctgacaaa

SEQ ID NO: 116945 - DNA, 22 bp, Artificial Sequence
  chemically synthesized
gcaatctactcatctgacaaag

SEQ ID NO: 116946 - DNA, 22 bp, Artificial Sequence
  chemically synthesized
caatctactcatctgacaaagg

SEQ ID NO: 116947 - DNA, 22 bp, Artificial Sequence
  chemically synthesized
ctcatctgacaaagggctaata

SEQ ID NO: 116948 - DNA, 22 bp, Artificial Sequence
  chemically synthesized
atctgacaaagggctaatatcc

SEQ ID NO: 116949 - DNA, 22 bp, Artificial Sequence
  chemically synthesized
acaaagggctaatatccagaat

SEQ ID NO: 116950 - DNA, 22 bp, Artificial Sequence
  chemically synthesized
atatccagaatctacaatgaac

SEQ ID NO: 116951 - DNA, 22 bp, Artificial Sequence
  chemically synthesized
caatgaactcaaacaaatttac

SEQ ID NO: 116952 - DNA, 22 bp, Artificial Sequence
  chemically synthesized
aaacaaatttacaagagaaaaa

SEQ ID NO: 116953 - DNA, 22 bp, Artificial Sequence
  chemically synthesized
acaagagaaaaaaaaccccatc

SEQ ID NO: 116954 - DNA, 22 bp, Artificial Sequence
  chemically synthesized
caagagaaaaaaaaccccatca

SEQ ID NO: 116955 - DNA, 22 bp, Artificial Sequence
  chemically synthesized
ctcaaaagaagacatttatgca

SEQ ID NO: 116956 - DNA, 22 bp, Artificial Sequence
  chemically synthesized
tcaaaagaagacatttatgcag

SEQ ID NO: 116957 - DNA, 22 bp, Artificial Sequence
  chemically synthesized
aaaagaagacatttatgcagcc

SEQ ID NO: 116958 - DNA, 22 bp, Artificial Sequence
  chemically synthesized
atgcagccaaaagacacatgaa

SEQ ID NO: 116959 - DNA, 22 bp, Artificial Sequence
  chemically synthesized
tgcagccaaaagacacatgaaa

SEQ ID NO: 116960 - DNA, 22 bp, Artificial Sequence
  chemically synthesized
atcatcactggccatcagagaa

SEQ ID NO: 116961 - DNA, 22 bp, Artificial Sequence
  chemically synthesized
gccatcagagaaatgcaaatca

SEQ ID NO: 116962 - DNA, 22 bp, Artificial Sequence
  chemically synthesized
acaccagttagaatggcaatca

SEQ ID NO: 116963 - DNA, 22 bp, Artificial Sequence
  chemically synthesized
gaatggcaatcattaaaaagtc

SEQ ID NO: 116964 - DNA, 22 bp, Artificial Sequence
  chemically synthesized
aaaagtcaggaaacaacaggtg

SEQ ID NO: 116965 - DNA, 22 bp, Artificial Sequence
  chemically synthesized
gagaggatgtggagaaatagga

SEQ ID NO: 116966 - DNA, 22 bp, Artificial Sequence
  chemically synthesized
ttacactgttggtgggactgta

SEQ ID NO: 116967 - DNA, 22 bp, Artificial Sequence
  chemically synthesized
tacactgttggtgggactgtaa

SEQ ID NO: 116968 - DNA, 22 bp, Artificial Sequence
  chemically synthesized
acactgttggtgggactgtaaa

SEQ ID NO: 116969 - DNA, 22 bp, Artificial Sequence
  chemically synthesized
cactgttggtgggactgtaaac

SEQ ID NO: 116970 - DNA, 22 bp, Artificial Sequence
  chemically synthesized
ttggtgggactgtaaactagtt

SEQ ID NO: 116971 - DNA, 22 bp, Artificial Sequence
  chemically synthesized
gtgggactgtaaactagttcaa

SEQ ID NO: 116972 - DNA, 22 bp, Artificial Sequence
  chemically synthesized
taaactagttcaaacattgtgg

SEQ ID NO: 116973 - DNA, 22 bp, Artificial Sequence
  chemically synthesized
gttcaaacattgtggaagtcag

SEQ ID NO: 116974 - DNA, 22 bp, Artificial Sequence
  chemically synthesized
aaacattgtggaagtcagtgtg

SEQ ID NO: 116975 - DNA, 22 bp, Artificial Sequence
  chemically synthesized
tggaagtcagtgtggtgattcc

SEQ ID NO: 116976 - DNA, 22 bp, Artificial Sequence
  chemically synthesized
ctcagggatctagaactagaaa

SEQ ID NO: 116977 - DNA, 22 bp, Artificial Sequence
  chemically synthesized
agggatctagaactagaaatac

SEQ ID NO: 116978 - DNA, 22 bp, Artificial Sequence
  chemically synthesized
gaactagaaataccatttgacc

SEQ ID NO: 116979 - DNA, 22 bp, Artificial Sequence
  chemically synthesized
gaaataccatttgacccagcca

SEQ ID NO: 116980 - DNA, 22 bp, Artificial Sequence
  chemically synthesized
gacccagccatcccattactgg

SEQ ID NO: 116981 - DNA, 22 bp, Artificial Sequence
  chemically synthesized
acccagccatcccattactggg

SEQ ID NO: 116982 - DNA, 22 bp, Artificial Sequence
  chemically synthesized
ctgggtatacacccaaaggatt

SEQ ID NO: 116983 - DNA, 22 bp, Artificial Sequence
  chemically synthesized
ggtatacacccaaaggattata

SEQ ID NO: 116984 - DNA, 22 bp, Artificial Sequence
  chemically synthesized
taaatcatgctgctataaagac

SEQ ID NO: 116985 - DNA, 22 bp, Artificial Sequence
  chemically synthesized
ctataaagacacatgcacacgt

SEQ ID NO: 116986 - DNA, 22 bp, Artificial Sequence
  chemically synthesized
taaagacacatgcacacgtatg

SEQ ID NO: 116987 - DNA, 22 bp, Artificial Sequence
  chemically synthesized
attgcggcactattcacaatag

SEQ ID NO: 116988 - DNA, 22 bp, Artificial Sequence
  chemically synthesized
ttgcggcactattcacaatagc

SEQ ID NO: 116989 - DNA, 22 bp, Artificial Sequence
  chemically synthesized
cggcactattcacaatagcaaa

SEQ ID NO: 116990 - DNA, 22 bp, Artificial Sequence
  chemically synthesized
ttcacaatagcaaagacttgga

SEQ ID NO: 116991 - DNA, 22 bp, Artificial Sequence
  chemically synthesized
acaatagcaaagacttggaacc

SEQ ID NO: 116992 - DNA, 22 bp, Artificial Sequence
  chemically synthesized
ggaaccaacccaaatgtccaac

SEQ ID NO: 116993 - DNA, 22 bp, Artificial Sequence
  chemically synthesized
gaaccaacccaaatgtccaaca

SEQ ID NO: 116994 - DNA, 22 bp, Artificial Sequence
  chemically synthesized
gattaagaaaatgtggcacata

SEQ ID NO: 116995 - DNA, 22 bp, Artificial Sequence
  chemically synthesized
agaaaatgtggcacatatacac

SEQ ID NO: 116996 - DNA, 22 bp, Artificial Sequence
  chemically synthesized
tgcagccataaaaaatgatgag

SEQ ID NO: 116997 - DNA, 22 bp, Artificial Sequence
  chemically synthesized
atgtcctttgtagggacatgga

SEQ ID NO: 116998 - DNA, 22 bp, Artificial Sequence
  chemically synthesized
tgtagggacatggatgaagctg

SEQ ID NO: 116999 - DNA, 22 bp, Artificial Sequence
  chemically synthesized
gtagggacatggatgaagctgg

SEQ ID NO: 117000 - DNA, 22 bp, Artificial Sequence
  chemically synthesized
tagggacatggatgaagctgga

SEQ ID NO: 117001 - DNA, 22 bp, Artificial Sequence
  chemically synthesized
gaaaccatcattctcagcaaac

SEQ ID NO: 117002 - DNA, 22 bp, Artificial Sequence
  chemically synthesized
tcagcaaactatcacaaggaca

SEQ ID NO: 117003 - DNA, 22 bp, Artificial Sequence
  chemically synthesized
agcaaactatcacaaggacaaa

SEQ ID NO: 117004 - DNA, 22 bp, Artificial Sequence
  chemically synthesized
tcacaaggacaaaaagccaaac

SEQ ID NO: 117005 - DNA, 22 bp, Artificial Sequence
  chemically synthesized
tcactcataggtgggaactgaa

SEQ ID NO: 117006 - DNA, 22 bp, Artificial Sequence
  chemically synthesized
actcataggtgggaactgaaca

SEQ ID NO: 117007 - DNA, 22 bp, Artificial Sequence
  chemically synthesized
ataggtgggaactgaacaatga

SEQ ID NO: 117008 - DNA, 22 bp, Artificial Sequence
  chemically synthesized
aacaatgagaacacatggacac

SEQ ID NO: 117009 - DNA, 22 bp, Artificial Sequence
  chemically synthesized
ttgtggggtgggaggagggggc

SEQ ID NO: 117010 - DNA, 22 bp, Artificial Sequence
  chemically synthesized
tggggtgggaggagggggcagg

SEQ ID NO: 117011 - DNA, 22 bp, Artificial Sequence
  chemically synthesized
ggagatatacctaatgttaaat

SEQ ID NO: 117012 - DNA, 22 bp, Artificial Sequence
  chemically synthesized
atgttaaatggtgagttaatgg

SEQ ID NO: 117013 - DNA, 22 bp, Artificial Sequence
  chemically synthesized
aatggtgagttaatgggtgcag

SEQ ID NO: 117014 - DNA, 22 bp, Artificial Sequence
  chemically synthesized
atgggtgcagcacaccaacatg

SEQ ID NO: 117015 - DNA, 22 bp, Artificial Sequence
  chemically synthesized
acctgcaccttgtgcacatgta

SEQ ID NO: 117016 - DNA, 22 bp, Artificial Sequence
  chemically synthesized
caccttgtgcacatgtacccta

SEQ ID NO: 117017 - DNA, 22 bp, Artificial Sequence
  chemically synthesized
gtgcacatgtaccctaaaactt

SEQ ID NO: 117018 - DNA, 22 bp, Artificial Sequence
  chemically synthesized
tgcacatgtaccctaaaactta

SEQ ID NO: 117019 - DNA, 22 bp, Artificial Sequence
  chemically synthesized
aaacttaaaagtataacaaaaa

SEQ ID NO: 117020 - DNA, 22 bp, Artificial Sequence
  chemically synthesized
aaaagtataacaaaaaataagt

SEQ ID NO: 117021 - DNA, 22 bp, Artificial Sequence
  chemically synthesized
aaagtataacaaaaaataagtt

SEQ ID NO: 117022 - DNA, 22 bp, Artificial Sequence
  chemically synthesized
gaaaaaagaaatttacatatat

SEQ ID NO: 117023 - DNA, 22 bp, Artificial Sequence
  chemically synthesized
acatatattagttatttaaata

SEQ ID NO: 117024 - DNA, 22 bp, Artificial Sequence
  chemically synthesized
catatattagttatttaaatat

SEQ ID NO: 117025 - DNA, 22 bp, Artificial Sequence
  chemically synthesized
gttatttaaatatgctggataa

SEQ ID NO: 117026 - DNA, 22 bp, Artificial Sequence
  chemically synthesized
tttaaatatgctggataaatac

SEQ ID NO: 117027 - DNA, 22 bp, Artificial Sequence
  chemically synthesized
aaatatgctggataaatactat

SEQ ID NO: 117028 - DNA, 22 bp, Artificial Sequence
  chemically synthesized
aatatgctggataaatactatt

SEQ ID NO: 117029 - DNA, 22 bp, Artificial Sequence
  chemically synthesized
gataaatactattacactcatt

SEQ ID NO: 117030 - DNA, 22 bp, Artificial Sequence
  chemically synthesized
ttacactcatttcacaaagata

SEQ ID NO: 117031 - DNA, 22 bp, Artificial Sequence
  chemically synthesized
cactcatttcacaaagatactg

SEQ ID NO: 117032 - DNA, 22 bp, Artificial Sequence
  chemically synthesized
atttcacaaagatactgactct

SEQ ID NO: 117033 - DNA, 22 bp, Artificial Sequence
  chemically synthesized
cacaaagatactgactctatat

SEQ ID NO: 117034 - DNA, 22 bp, Artificial Sequence
  chemically synthesized
acaaagatactgactctatatc

SEQ ID NO: 117035 - DNA, 22 bp, Artificial Sequence
  chemically synthesized
actctatatctttgcttgtttc

SEQ ID NO: 117036 - DNA, 22 bp, Artificial Sequence
  chemically synthesized
tatatctttgcttgtttccctt

SEQ ID NO: 117037 - DNA, 22 bp, Artificial Sequence
  chemically synthesized
tatctttgcttgtttcccttag

SEQ ID NO: 117038 - DNA, 22 bp, Artificial Sequence
  chemically synthesized
tgcttgtttcccttaggttctc

SEQ ID NO: 117039 - DNA, 22 bp, Artificial Sequence
  chemically synthesized
gcttgtttcccttaggttctct

SEQ ID NO: 117040 - DNA, 22 bp, Artificial Sequence
  chemically synthesized
cttgtttcccttaggttctctg

SEQ ID NO: 117041 - DNA, 22 bp, Artificial Sequence
  chemically synthesized
gtttcccttaggttctctggat

SEQ ID NO: 117042 - DNA, 22 bp, Artificial Sequence
  chemically synthesized
tttcccttaggttctctggata

SEQ ID NO: 117043 - DNA, 22 bp, Artificial Sequence
  chemically synthesized
cccttaggttctctggatattg

SEQ ID NO: 117044 - DNA, 22 bp, Artificial Sequence
  chemically synthesized
ccttaggttctctggatattga

SEQ ID NO: 117045 - DNA, 22 bp, Artificial Sequence
  chemically synthesized
aggttctctggatattgagaga

SEQ ID NO: 117046 - DNA, 22 bp, Artificial Sequence
  chemically synthesized
ggttctctggatattgagagag

SEQ ID NO: 117047 - DNA, 22 bp, Artificial Sequence
  chemically synthesized
tctggatattgagagaggctaa

SEQ ID NO: 117048 - DNA, 22 bp, Artificial Sequence
  chemically synthesized
tggatattgagagaggctaatg

SEQ ID NO: 117049 - DNA, 22 bp, Artificial Sequence
  chemically synthesized
gatattgagagaggctaatgta

SEQ ID NO: 117050 - DNA, 22 bp, Artificial Sequence
  chemically synthesized
agagaggctaatgtaattacct

SEQ ID NO: 117051 - DNA, 22 bp, Artificial Sequence
  chemically synthesized
atgtaattacctgggtaattgc

SEQ ID NO: 117052 - DNA, 22 bp, Artificial Sequence
  chemically synthesized
cctgggtaattgctcctcaggg

SEQ ID NO: 117053 - DNA, 22 bp, Artificial Sequence
  chemically synthesized
ggtaattgctcctcagggaacc

SEQ ID NO: 117054 - DNA, 22 bp, Artificial Sequence
  chemically synthesized
ctcctcagggaacctaactttc

SEQ ID NO: 117055 - DNA, 22 bp, Artificial Sequence
  chemically synthesized
ctcagggaacctaactttctcc

SEQ ID NO: 117056 - DNA, 22 bp, Artificial Sequence
  chemically synthesized
agggaacctaactttctcccca

SEQ ID NO: 117057 - DNA, 22 bp, Artificial Sequence
  chemically synthesized
actttctccccattactctact

SEQ ID NO: 117058 - DNA, 22 bp, Artificial Sequence
  chemically synthesized
tctccccattactctactccta

SEQ ID NO: 117059 - DNA, 22 bp, Artificial Sequence
  chemically synthesized
ctccccattactctactcctag

SEQ ID NO: 117060 - DNA, 22 bp, Artificial Sequence
  chemically synthesized
tccccattactctactcctaga

SEQ ID NO: 117061 - DNA, 22 bp, Artificial Sequence
  chemically synthesized
cccattactctactcctagaga

SEQ ID NO: 117062 - DNA, 22 bp, Artificial Sequence
  chemically synthesized
ctctactcctagagactctgat

SEQ ID NO: 117063 - DNA, 22 bp, Artificial Sequence
  chemically synthesized
tactcctagagactctgatcag

SEQ ID NO: 117064 - DNA, 22 bp, Artificial Sequence
  chemically synthesized
ctcctagagactctgatcagct

SEQ ID NO: 117065 - DNA, 22 bp, Artificial Sequence
  chemically synthesized
ctagagactctgatcagctttt

SEQ ID NO: 117066 - DNA, 22 bp, Artificial Sequence
  chemically synthesized
gagactctgatcagctttttca

SEQ ID NO: 117067 - DNA, 22 bp, Artificial Sequence
  chemically synthesized
tgatcagctttttcaaaaaatg

SEQ ID NO: 117068 - DNA, 22 bp, Artificial Sequence
  chemically synthesized
atcagctttttcaaaaaatggg

SEQ ID NO: 117069 - DNA, 22 bp, Artificial Sequence
  chemically synthesized
tttcaaaaaatgggcagcattc

SEQ ID NO: 117070 - DNA, 22 bp, Artificial Sequence
  chemically synthesized
ttcaaaaaatgggcagcattcc

SEQ ID NO: 117071 - DNA, 22 bp, Artificial Sequence
  chemically synthesized
tcaaaaaatgggcagcattcca

SEQ ID NO: 117072 - DNA, 22 bp, Artificial Sequence
  chemically synthesized
caaaaaatgggcagcattccag

SEQ ID NO: 117073 - DNA, 22 bp, Artificial Sequence
  chemically synthesized
aaaaaatgggcagcattccagc

SEQ ID NO: 117074 - DNA, 22 bp, Artificial Sequence
  chemically synthesized
cagccccaggactaagaagata

SEQ ID NO: 117075 - DNA, 22 bp, Artificial Sequence
  chemically synthesized
agaagatatgaatgccacagtg

SEQ ID NO: 117076 - DNA, 22 bp, Artificial Sequence
  chemically synthesized
gctgaagtgagcttccccatcc

SEQ ID NO: 117077 - DNA, 22 bp, Artificial Sequence
  chemically synthesized
ctgaagtgagcttccccatccc

SEQ ID NO: 117078 - DNA, 22 bp, Artificial Sequence
  chemically synthesized
aagtgagcttccccatcccacc

SEQ ID NO: 117079 - DNA, 22 bp, Artificial Sequence
  chemically synthesized
ccccatcccacctgaggctcag

SEQ ID NO: 117080 - DNA, 22 bp, Artificial Sequence
  chemically synthesized
cccatcccacctgaggctcaga

SEQ ID NO: 117081 - DNA, 22 bp, Artificial Sequence
  chemically synthesized
aggctcagaggccagtttcact

SEQ ID NO: 117082 - DNA, 22 bp, Artificial Sequence
  chemically synthesized
agaggccagtttcacttgtggt

SEQ ID NO: 117083 - DNA, 22 bp, Artificial Sequence
  chemically synthesized
cacttgtggtgagtgcacaagc

SEQ ID NO: 117084 - DNA, 22 bp, Artificial Sequence
  chemically synthesized
acttgtggtgagtgcacaagcc

SEQ ID NO: 117085 - DNA, 22 bp, Artificial Sequence
  chemically synthesized
gtggtgagtgcacaagcccatg

SEQ ID NO: 117086 - DNA, 22 bp, Artificial Sequence
  chemically synthesized
tggtgagtgcacaagcccatga

SEQ ID NO: 117087 - DNA, 22 bp, Artificial Sequence
  chemically synthesized
atatggcttggctctgtgtctc

SEQ ID NO: 117088 - DNA, 22 bp, Artificial Sequence
  chemically synthesized
ggctctgtgtctccacccaaat

SEQ ID NO: 117089 - DNA, 22 bp, Artificial Sequence
  chemically synthesized
gctctgtgtctccacccaaatt

SEQ ID NO: 117090 - DNA, 22 bp, Artificial Sequence
  chemically synthesized
tgtgtctccacccaaatttcat

SEQ ID NO: 117091 - DNA, 22 bp, Artificial Sequence
  chemically synthesized
tgtctccacccaaatttcatat

SEQ ID NO: 117092 - DNA, 22 bp, Artificial Sequence
  chemically synthesized
cacccaaatttcatattgaatt

SEQ ID NO: 117093 - DNA, 22 bp, Artificial Sequence
  chemically synthesized
catattgaattgtaatccccat

SEQ ID NO: 117094 - DNA, 22 bp, Artificial Sequence
  chemically synthesized
atattgaattgtaatccccata

SEQ ID NO: 117095 - DNA, 22 bp, Artificial Sequence
  chemically synthesized
aattgtaatccccataatccct

SEQ ID NO: 117096 - DNA, 22 bp, Artificial Sequence
  chemically synthesized
taatccccataatccctatatg

SEQ ID NO: 117097 - DNA, 22 bp, Artificial Sequence
  chemically synthesized
tatgtcgggggagggaccaggt

SEQ ID NO: 117098 - DNA, 22 bp, Artificial Sequence
  chemically synthesized
ttggatcatgggagcagtttcc

SEQ ID NO: 117099 - DNA, 22 bp, Artificial Sequence
  chemically synthesized
gatcatgggagcagtttccccc

SEQ ID NO: 117100 - DNA, 22 bp, Artificial Sequence
  chemically synthesized
cccccatgcagttctcgtgata

SEQ ID NO: 117101 - DNA, 22 bp, Artificial Sequence
  chemically synthesized
ccccatgcagttctcgtgatac

SEQ ID NO: 117102 - DNA, 22 bp, Artificial Sequence
  chemically synthesized
tcgtgatactgagtgagttttc

SEQ ID NO: 117103 - DNA, 22 bp, Artificial Sequence
  chemically synthesized
gtgatactgagtgagttttcat

SEQ ID NO: 117104 - DNA, 22 bp, Artificial Sequence
  chemically synthesized
agtgagttttcatgagatctga

SEQ ID NO: 117105 - DNA, 22 bp, Artificial Sequence
  chemically synthesized
tcatgagatctgatggttttat

SEQ ID NO: 117106 - DNA, 22 bp, Artificial Sequence
  chemically synthesized
catgagatctgatggttttata

SEQ ID NO: 117107 - DNA, 22 bp, Artificial Sequence
  chemically synthesized
atgagatctgatggttttataa

SEQ ID NO: 117108 - DNA, 22 bp, Artificial Sequence
  chemically synthesized
atggttttataaggcagttttc

SEQ ID NO: 117109 - DNA, 22 bp, Artificial Sequence
  chemically synthesized
tataaggcagttttccctcttc

SEQ ID NO: 117110 - DNA, 22 bp, Artificial Sequence
  chemically synthesized
ataaggcagttttccctcttct

SEQ ID NO: 117111 - DNA, 22 bp, Artificial Sequence
  chemically synthesized
taaggcagttttccctcttctt

SEQ ID NO: 117112 - DNA, 22 bp, Artificial Sequence
  chemically synthesized
tccctcttcttgctcactctct

SEQ ID NO: 117113 - DNA, 22 bp, Artificial Sequence
  chemically synthesized
ccctcttcttgctcactctctc

SEQ ID NO: 117114 - DNA, 22 bp, Artificial Sequence
  chemically synthesized
cctcttcttgctcactctctct

SEQ ID NO: 117115 - DNA, 22 bp, Artificial Sequence
  chemically synthesized
ttcttgctcactctctcttgcc

SEQ ID NO: 117116 - DNA, 22 bp, Artificial Sequence
  chemically synthesized
cttgctcactctctcttgcctg

SEQ ID NO: 117117 - DNA, 22 bp, Artificial Sequence
  chemically synthesized
ttgctcactctctcttgcctgc

SEQ ID NO: 117118 - DNA, 22 bp, Artificial Sequence
  chemically synthesized
gctcactctctcttgcctgcca

SEQ ID NO: 117119 - DNA, 22 bp, Artificial Sequence
  chemically synthesized
ctcactctctcttgcctgccac

SEQ ID NO: 117120 - DNA, 22 bp, Artificial Sequence
  chemically synthesized
actctctcttgcctgccaccaa

SEQ ID NO: 117121 - DNA, 22 bp, Artificial Sequence
  chemically synthesized
tctcttgcctgccaccaagtaa

SEQ ID NO: 117122 - DNA, 22 bp, Artificial Sequence
  chemically synthesized
tcttgcctgccaccaagtaaga

SEQ ID NO: 117123 - DNA, 22 bp, Artificial Sequence
  chemically synthesized
ttgcctgccaccaagtaagatg

SEQ ID NO: 117124 - DNA, 22 bp, Artificial Sequence
  chemically synthesized
gcctgccaccaagtaagatgtg

SEQ ID NO: 117125 - DNA, 22 bp, Artificial Sequence
  chemically synthesized
cctgccaccaagtaagatgtgc

SEQ ID NO: 117126 - DNA, 22 bp, Artificial Sequence
  chemically synthesized
ccaccaagtaagatgtgcctgc

SEQ ID NO: 117127 - DNA, 22 bp, Artificial Sequence
  chemically synthesized
cttctccttctgccataattgt

SEQ ID NO: 117128 - DNA, 22 bp, Artificial Sequence
  chemically synthesized
ctccttctgccataattgtaag

SEQ ID NO: 117129 - DNA, 22 bp, Artificial Sequence
  chemically synthesized
tccttctgccataattgtaagt

SEQ ID NO: 117130 - DNA, 22 bp, Artificial Sequence
  chemically synthesized
cttctgccataattgtaagttt

SEQ ID NO: 117131 - DNA, 22 bp, Artificial Sequence
  chemically synthesized
ctgccataattgtaagtttcct

SEQ ID NO: 117132 - DNA, 22 bp, Artificial Sequence
  chemically synthesized
tgccataattgtaagtttcctg

SEQ ID NO: 117133 - DNA, 22 bp, Artificial Sequence
  chemically synthesized
ccataattgtaagtttcctgag

SEQ ID NO: 117134 - DNA, 22 bp, Artificial Sequence
  chemically synthesized
taagtttcctgaggcctcccca

SEQ ID NO: 117135 - DNA, 22 bp, Artificial Sequence
  chemically synthesized
cctgaggcctccccagctatgt

SEQ ID NO: 117136 - DNA, 22 bp, Artificial Sequence
  chemically synthesized
ctgaggcctccccagctatgtg

SEQ ID NO: 117137 - DNA, 22 bp, Artificial Sequence
  chemically synthesized
aggcctccccagctatgtggaa

SEQ ID NO: 117138 - DNA, 22 bp, Artificial Sequence
  chemically synthesized
cccagctatgtggaaatgtgag

SEQ ID NO: 117139 - DNA, 22 bp, Artificial Sequence
  chemically synthesized
tgtggaaatgtgagtcaattaa

SEQ ID NO: 117140 - DNA, 22 bp, Artificial Sequence
  chemically synthesized
aacctcctttgttaataaatta

SEQ ID NO: 117141 - DNA, 22 bp, Artificial Sequence
  chemically synthesized
ctttgttaataaattacccagt

SEQ ID NO: 117142 - DNA, 22 bp, Artificial Sequence
  chemically synthesized
tgttaataaattacccagtctc

SEQ ID NO: 117143 - DNA, 22 bp, Artificial Sequence
  chemically synthesized
gttaataaattacccagtctca

SEQ ID NO: 117144 - DNA, 22 bp, Artificial Sequence
  chemically synthesized
ttaataaattacccagtctcag

SEQ ID NO: 117145 - DNA, 22 bp, Artificial Sequence
  chemically synthesized
ataaattacccagtctcaggta

SEQ ID NO: 117146 - DNA, 22 bp, Artificial Sequence
  chemically synthesized
cccagtctcaggtagtatcttt

SEQ ID NO: 117147 - DNA, 22 bp, Artificial Sequence
  chemically synthesized
aggtagtatctttagagcagtg

SEQ ID NO: 117148 - DNA, 22 bp, Artificial Sequence
  chemically synthesized
tagagcagtgtgagaatgaact

SEQ ID NO: 117149 - DNA, 22 bp, Artificial Sequence
  chemically synthesized
agagcagtgtgagaatgaacta

SEQ ID NO: 117150 - DNA, 22 bp, Artificial Sequence
  chemically synthesized
gagcagtgtgagaatgaactaa

SEQ ID NO: 117151 - DNA, 22 bp, Artificial Sequence
  chemically synthesized
atacaatccccaagccctgcct

SEQ ID NO: 117152 - DNA, 22 bp, Artificial Sequence
  chemically synthesized
ccttctgaagcagcattcagga

SEQ ID NO: 117153 - DNA, 22 bp, Artificial Sequence
  chemically synthesized
ctgaagcagcattcaggactcc

SEQ ID NO: 117154 - DNA, 22 bp, Artificial Sequence
  chemically synthesized
tgaagcagcattcaggactccc

SEQ ID NO: 117155 - DNA, 22 bp, Artificial Sequence
  chemically synthesized
aagcagcattcaggactcccaa

SEQ ID NO: 117156 - DNA, 22 bp, Artificial Sequence
  chemically synthesized
aggactcccaaccccatgtcac

SEQ ID NO: 117157 - DNA, 22 bp, Artificial Sequence
  chemically synthesized
ccaaccccatgtcacagtgtga

SEQ ID NO: 117158 - DNA, 22 bp, Artificial Sequence
  chemically synthesized
agcatttttcctaagacagtag

SEQ ID NO: 117159 - DNA, 22 bp, Artificial Sequence
  chemically synthesized
gcatttttcctaagacagtagt

SEQ ID NO: 117160 - DNA, 22 bp, Artificial Sequence
  chemically synthesized
ttcctaagacagtagtcacctc

SEQ ID NO: 117161 - DNA, 22 bp, Artificial Sequence
  chemically synthesized
tcctaagacagtagtcacctcc

SEQ ID NO: 117162 - DNA, 22 bp, Artificial Sequence
  chemically synthesized
cctaagacagtagtcacctccc

SEQ ID NO: 117163 - DNA, 22 bp, Artificial Sequence
  chemically synthesized
ctaagacagtagtcacctccct

SEQ ID NO: 117164 - DNA, 22 bp, Artificial Sequence
  chemically synthesized
agacagtagtcacctccctagc

SEQ ID NO: 117165 - DNA, 22 bp, Artificial Sequence
  chemically synthesized
cctagcttcttgaacctgtctg

SEQ ID NO: 117166 - DNA, 22 bp, Artificial Sequence
  chemically synthesized
gcttcttgaacctgtctggcag

SEQ ID NO: 117167 - DNA, 22 bp, Artificial Sequence
  chemically synthesized
cttgaacctgtctggcagaagg

SEQ ID NO: 117168 - DNA, 22 bp, Artificial Sequence
  chemically synthesized
ttgaacctgtctggcagaagga

SEQ ID NO: 117169 - DNA, 22 bp, Artificial Sequence
  chemically synthesized
gaacctgtctggcagaaggaga

SEQ ID NO: 117170 - DNA, 22 bp, Artificial Sequence
  chemically synthesized
aacctgtctggcagaaggagag

SEQ ID NO: 117171 - DNA, 22 bp, Artificial Sequence
  chemically synthesized
tctggcagaaggagaggaatca

SEQ ID NO: 117172 - DNA, 22 bp, Artificial Sequence
  chemically synthesized
gcagaaggagaggaatcacatc

SEQ ID NO: 117173 - DNA, 22 bp, Artificial Sequence
  chemically synthesized
aattggtggcagatggaaaaca

SEQ ID NO: 117174 - DNA, 22 bp, Artificial Sequence
  chemically synthesized
gtggcagatggaaaacaaaaca

SEQ ID NO: 117175 - DNA, 22 bp, Artificial Sequence
  chemically synthesized
ttgaaatagttttgccatcata

SEQ ID NO: 117176 - DNA, 22 bp, Artificial Sequence
  chemically synthesized
gaaatagttttgccatcatatt

SEQ ID NO: 117177 - DNA, 22 bp, Artificial Sequence
  chemically synthesized
aaatagttttgccatcatatta

SEQ ID NO: 117178 - DNA, 22 bp, Artificial Sequence
  chemically synthesized
tgccatcatattatcttgggtt

SEQ ID NO: 117179 - DNA, 22 bp, Artificial Sequence
  chemically synthesized
gccatcatattatcttgggtta

SEQ ID NO: 117180 - DNA, 22 bp, Artificial Sequence
  chemically synthesized
ccatcatattatcttgggttac

SEQ ID NO: 117181 - DNA, 22 bp, Artificial Sequence
  chemically synthesized
tcttgggttactcacaaaatgc

SEQ ID NO: 117182 - DNA, 22 bp, Artificial Sequence
  chemically synthesized
gggttactcacaaaatgcttat

SEQ ID NO: 117183 - DNA, 22 bp, Artificial Sequence
  chemically synthesized
ggttactcacaaaatgcttatg

SEQ ID NO: 117184 - DNA, 22 bp, Artificial Sequence
  chemically synthesized
ctcacaaaatgcttatgtctgg

SEQ ID NO: 117185 - DNA, 22 bp, Artificial Sequence
  chemically synthesized
acaaaatgcttatgtctggttt

SEQ ID NO: 117186 - DNA, 22 bp, Artificial Sequence
  chemically synthesized
atgtctggtttatatgctcatc

SEQ ID NO: 117187 - DNA, 22 bp, Artificial Sequence
  chemically synthesized
tgtctggtttatatgctcatct

SEQ ID NO: 117188 - DNA, 22 bp, Artificial Sequence
  chemically synthesized
gtttatatgctcatctattaag

SEQ ID NO: 117189 - DNA, 22 bp, Artificial Sequence
  chemically synthesized
atatgctcatctattaagtggg

SEQ ID NO: 117190 - DNA, 22 bp, Artificial Sequence
  chemically synthesized
tatgctcatctattaagtggga

SEQ ID NO: 117191 - DNA, 22 bp, Artificial Sequence
  chemically synthesized
atctattaagtgggaaattctt

SEQ ID NO: 117192 - DNA, 22 bp, Artificial Sequence
  chemically synthesized
ttaagtgggaaattcttgtctc

SEQ ID NO: 117193 - DNA, 22 bp, Artificial Sequence
  chemically synthesized
agtgggaaattcttgtctcctt

SEQ ID NO: 117194 - DNA, 22 bp, Artificial Sequence
  chemically synthesized
ttgtctccttgtttacctcaca

SEQ ID NO: 117195 - DNA, 22 bp, Artificial Sequence
  chemically synthesized
gtctccttgtttacctcacaga

SEQ ID NO: 117196 - DNA, 22 bp, Artificial Sequence
  chemically synthesized
tctccttgtttacctcacagat

SEQ ID NO: 117197 - DNA, 22 bp, Artificial Sequence
  chemically synthesized
cttgtttacctcacagatgtgg

SEQ ID NO: 117198 - DNA, 22 bp, Artificial Sequence
  chemically synthesized
gtttacctcacagatgtggtct

SEQ ID NO: 117199 - DNA, 22 bp, Artificial Sequence
  chemically synthesized
tttacctcacagatgtggtctg

SEQ ID NO: 117200 - DNA, 22 bp, Artificial Sequence
  chemically synthesized
acctcacagatgtggtctgagt

SEQ ID NO: 117201 - DNA, 22 bp, Artificial Sequence
  chemically synthesized
cctcacagatgtggtctgagta

SEQ ID NO: 117202 - DNA, 22 bp, Artificial Sequence
  chemically synthesized
acagatgtggtctgagtatcag

SEQ ID NO: 117203 - DNA, 22 bp, Artificial Sequence
  chemically synthesized
agtatcagtgagccaataacaa

SEQ ID NO: 117204 - DNA, 22 bp, Artificial Sequence
  chemically synthesized
ttaataaaaagttggaaataag

SEQ ID NO: 117205 - DNA, 22 bp, Artificial Sequence
  chemically synthesized
ataaaaagttggaaataagctg

SEQ ID NO: 117206 - DNA, 22 bp, Artificial Sequence
  chemically synthesized
gaaataagctgactgtgattga

SEQ ID NO: 117207 - DNA, 22 bp, Artificial Sequence
  chemically synthesized
actgtgattgactcctgagaat

SEQ ID NO: 117208 - DNA, 22 bp, Artificial Sequence
  chemically synthesized
tgattgactcctgagaattcct

SEQ ID NO: 117209 - DNA, 22 bp, Artificial Sequence
  chemically synthesized
actcctgagaattcctgaaaga

SEQ ID NO: 117210 - DNA, 22 bp, Artificial Sequence
  chemically synthesized
ctgagaattcctgaaagagata

SEQ ID NO: 117211 - DNA, 22 bp, Artificial Sequence
  chemically synthesized
agaattcctgaaagagatatag

SEQ ID NO: 117212 - DNA, 22 bp, Artificial Sequence
  chemically synthesized
ctgaaagagatatagagtggag

SEQ ID NO: 117213 - DNA, 22 bp, Artificial Sequence
  chemically synthesized
aaagagatatagagtggagaga

SEQ ID NO: 117214 - DNA, 22 bp, Artificial Sequence
  chemically synthesized
acattcactggttgctaaaggc

SEQ ID NO: 117215 - DNA, 22 bp, Artificial Sequence
  chemically synthesized
actggttgctaaaggctcacat

SEQ ID NO: 117216 - DNA, 22 bp, Artificial Sequence
  chemically synthesized
gttgctaaaggctcacattaaa

SEQ ID NO: 117217 - DNA, 22 bp, Artificial Sequence
  chemically synthesized
ctaaaggctcacattaaatatt

SEQ ID NO: 117218 - DNA, 22 bp, Artificial Sequence
  chemically synthesized
aaggctcacattaaatatttag

SEQ ID NO: 117219 - DNA, 22 bp, Artificial Sequence
  chemically synthesized
acattaaatatttagagccagt

SEQ ID NO: 117220 - DNA, 22 bp, Artificial Sequence
  chemically synthesized
aatatttagagccagtccctga

SEQ ID NO: 117221 - DNA, 22 bp, Artificial Sequence
  chemically synthesized
agagccagtccctgaggtaagt

SEQ ID NO: 117222 - DNA, 22 bp, Artificial Sequence
  chemically synthesized
gagccagtccctgaggtaagta

SEQ ID NO: 117223 - DNA, 22 bp, Artificial Sequence
  chemically synthesized
aggtaagtattaacatctttat

SEQ ID NO: 117224 - DNA, 22 bp, Artificial Sequence
  chemically synthesized
acatctttatctttaaaaacaa

SEQ ID NO: 117225 - DNA, 22 bp, Artificial Sequence
  chemically synthesized
tatctttaaaaacaaagatact

SEQ ID NO: 117226 - DNA, 22 bp, Artificial Sequence
  chemically synthesized
atctttaaaaacaaagatacta

SEQ ID NO: 117227 - DNA, 22 bp, Artificial Sequence
  chemically synthesized
tctttaaaaacaaagatactaa

SEQ ID NO: 117228 - DNA, 22 bp, Artificial Sequence
  chemically synthesized
taaaaacaaagatactaatgtg

SEQ ID NO: 117229 - DNA, 22 bp, Artificial Sequence
  chemically synthesized
aaaaacaaagatactaatgtgc

SEQ ID NO: 117230 - DNA, 22 bp, Artificial Sequence
  chemically synthesized
aaaacaaagatactaatgtgca

SEQ ID NO: 117231 - DNA, 22 bp, Artificial Sequence
  chemically synthesized
atgtgcacaaaggtaaagtacg

SEQ ID NO: 117232 - DNA, 22 bp, Artificial Sequence
  chemically synthesized
taccgaacataagattcacctc

SEQ ID NO: 117233 - DNA, 22 bp, Artificial Sequence
  chemically synthesized
acctccaattctgtccagctcc

SEQ ID NO: 117234 - DNA, 22 bp, Artificial Sequence
  chemically synthesized
caattctgtccagctccagggg

SEQ ID NO: 117235 - DNA, 22 bp, Artificial Sequence
  chemically synthesized
tgtccagctccaggggtacagt

SEQ ID NO: 117236 - DNA, 22 bp, Artificial Sequence
  chemically synthesized
tccagctccaggggtacagtca

SEQ ID NO: 117237 - DNA, 22 bp, Artificial Sequence
  chemically synthesized
caggggtacagtcatcactgtc

SEQ ID NO: 117238 - DNA, 22 bp, Artificial Sequence
  chemically synthesized
tcccacattctactttttttct

SEQ ID NO: 117239 - DNA, 22 bp, Artificial Sequence
  chemically synthesized
tactttttttctgatttgttgt

SEQ ID NO: 117240 - DNA, 22 bp, Artificial Sequence
  chemically synthesized
ctttttttctgatttgttgtgt

SEQ ID NO: 117241 - DNA, 22 bp, Artificial Sequence
  chemically synthesized
tttttctgatttgttgtgtcct

SEQ ID NO: 117242 - DNA, 22 bp, Artificial Sequence
  chemically synthesized
ttttctgatttgttgtgtccta

SEQ ID NO: 117243 - DNA, 22 bp, Artificial Sequence
  chemically synthesized
tttctgatttgttgtgtcctat

SEQ ID NO: 117244 - DNA, 22 bp, Artificial Sequence
  chemically synthesized
ttctgatttgttgtgtcctatt

SEQ ID NO: 117245 - DNA, 22 bp, Artificial Sequence
  chemically synthesized
tctgatttgttgtgtcctatta

SEQ ID NO: 117246 - DNA, 22 bp, Artificial Sequence
  chemically synthesized
ctgatttgttgtgtcctattat

SEQ ID NO: 117247 - DNA, 22 bp, Artificial Sequence
  chemically synthesized
tgatttgttgtgtcctattata

SEQ ID NO: 117248 - DNA, 22 bp, Artificial Sequence
  chemically synthesized
atttgttgtgtcctattatact

SEQ ID NO: 117249 - DNA, 22 bp, Artificial Sequence
  chemically synthesized
gttgtgtcctattatactgggc

SEQ ID NO: 117250 - DNA, 22 bp, Artificial Sequence
  chemically synthesized
ttgtgtcctattatactgggct

SEQ ID NO: 117251 - DNA, 22 bp, Artificial Sequence
  chemically synthesized
tgtcctattatactgggctata

SEQ ID NO: 117252 - DNA, 22 bp, Artificial Sequence
  chemically synthesized
ttatactgggctatagactaca

SEQ ID NO: 117253 - DNA, 22 bp, Artificial Sequence
  chemically synthesized
tactgggctatagactacatga

SEQ ID NO: 117254 - DNA, 22 bp, Artificial Sequence
  chemically synthesized
ggctatagactacatgatccct

SEQ ID NO: 117255 - DNA, 22 bp, Artificial Sequence
  chemically synthesized
tagactacatgatcccttttgt

SEQ ID NO: 117256 - DNA, 22 bp, Artificial Sequence
  chemically synthesized
catgatcccttttgtaaccttt

SEQ ID NO: 117257 - DNA, 22 bp, Artificial Sequence
  chemically synthesized
ttgtaacctttcaagctaaaat

SEQ ID NO: 117258 - DNA, 22 bp, Artificial Sequence
  chemically synthesized
tgtaacctttcaagctaaaatg

SEQ ID NO: 117259 - DNA, 22 bp, Artificial Sequence
  chemically synthesized
gtaacctttcaagctaaaatgc

SEQ ID NO: 117260 - DNA, 22 bp, Artificial Sequence
  chemically synthesized
taacctttcaagctaaaatgct

SEQ ID NO: 117261 - DNA, 22 bp, Artificial Sequence
  chemically synthesized
tcaagctaaaatgctcttgtca

SEQ ID NO: 117262 - DNA, 22 bp, Artificial Sequence
  chemically synthesized
caagctaaaatgctcttgtcaa

SEQ ID NO: 117263 - DNA, 22 bp, Artificial Sequence
  chemically synthesized
aagctaaaatgctcttgtcaaa

SEQ ID NO: 117264 - DNA, 22 bp, Artificial Sequence
  chemically synthesized
aaatgctcttgtcaaacaaatc

SEQ ID NO: 117265 - DNA, 22 bp, Artificial Sequence
  chemically synthesized
ttgtcaaacaaatcctaaactc

SEQ ID NO: 117266 - DNA, 22 bp, Artificial Sequence
  chemically synthesized
gtcaaacaaatcctaaactcag

SEQ ID NO: 117267 - DNA, 22 bp, Artificial Sequence
  chemically synthesized
tcaaacaaatcctaaactcagg

SEQ ID NO: 117268 - DNA, 22 bp, Artificial Sequence
  chemically synthesized
aactcaggagaatgattgtgtt

SEQ ID NO: 117269 - DNA, 22 bp, Artificial Sequence
  chemically synthesized
aggagaatgattgtgttttaag

SEQ ID NO: 117270 - DNA, 22 bp, Artificial Sequence
  chemically synthesized
tgttttaagatctctttcaagg

SEQ ID NO: 117271 - DNA, 22 bp, Artificial Sequence
  chemically synthesized
taagatctctttcaaggagatc

SEQ ID NO: 117272 - DNA, 22 bp, Artificial Sequence
  chemically synthesized
aagatctctttcaaggagatct

SEQ ID NO: 117273 - DNA, 22 bp, Artificial Sequence
  chemically synthesized
agatctctttcaaggagatctg

SEQ ID NO: 117274 - DNA, 22 bp, Artificial Sequence
  chemically synthesized
tttcaaggagatctgaccctta

SEQ ID NO: 117275 - DNA, 22 bp, Artificial Sequence
  chemically synthesized
tcaaggagatctgacccttatc

SEQ ID NO: 117276 - DNA, 22 bp, Artificial Sequence
  chemically synthesized
caaggagatctgacccttatct

SEQ ID NO: 117277 - DNA, 22 bp, Artificial Sequence
  chemically synthesized
aaggagatctgacccttatctg

SEQ ID NO: 117278 - DNA, 22 bp, Artificial Sequence
  chemically synthesized
acccttatctggcggtagagac

SEQ ID NO: 117279 - DNA, 22 bp, Artificial Sequence
  chemically synthesized
atctggcggtagagactctgga

SEQ ID NO: 117280 - DNA, 22 bp, Artificial Sequence
  chemically synthesized
tctggcggtagagactctggag

SEQ ID NO: 117281 - DNA, 22 bp, Artificial Sequence
  chemically synthesized
gcggtagagactctggagatgg

SEQ ID NO: 117282 - DNA, 22 bp, Artificial Sequence
  chemically synthesized
tggagatggaaactgagaagga

SEQ ID NO: 117283 - DNA, 22 bp, Artificial Sequence
  chemically synthesized
gagatggaaactgagaaggatg

SEQ ID NO: 117284 - DNA, 22 bp, Artificial Sequence
  chemically synthesized
agaaggatgcaaaaaaaaaaaa

SEQ ID NO: 117285 - DNA, 22 bp, Artificial Sequence
  chemically synthesized
tagtttcaagtatcagtcaaga

SEQ ID NO: 117286 - DNA, 22 bp, Artificial Sequence
  chemically synthesized
gtttcaagtatcagtcaagatt

SEQ ID NO: 117287 - DNA, 22 bp, Artificial Sequence
  chemically synthesized
caagtatcagtcaagatttgtt

SEQ ID NO: 117288 - DNA, 22 bp, Artificial Sequence
  chemically synthesized
aagtatcagtcaagatttgttt

SEQ ID NO: 117289 - DNA, 22 bp, Artificial Sequence
  chemically synthesized
gtttcttccaatatccggttat

SEQ ID NO: 117290 - DNA, 22 bp, Artificial Sequence
  chemically synthesized
tttcttccaatatccggttatt

SEQ ID NO: 117291 - DNA, 22 bp, Artificial Sequence
  chemically synthesized
cttccaatatccggttatttga

SEQ ID NO: 117292 - DNA, 22 bp, Artificial Sequence
  chemically synthesized
ttccaatatccggttatttgag

SEQ ID NO: 117293 - DNA, 22 bp, Artificial Sequence
  chemically synthesized
ccaatatccggttatttgaggt

SEQ ID NO: 117294 - DNA, 22 bp, Artificial Sequence
  chemically synthesized
caatatccggttatttgaggtg

SEQ ID NO: 117295 - DNA, 22 bp, Artificial Sequence
  chemically synthesized
tttgaggtgtggcaggcaagat

SEQ ID NO: 117296 - DNA, 22 bp, Artificial Sequence
  chemically synthesized
gaggtgtggcaggcaagataca

SEQ ID NO: 117297 - DNA, 22 bp, Artificial Sequence
  chemically synthesized
aggtgtggcaggcaagatacag

SEQ ID NO: 117298 - DNA, 22 bp, Artificial Sequence
  chemically synthesized
agtaaggcagcacacgggaaga

SEQ ID NO: 117299 - DNA, 22 bp, Artificial Sequence
  chemically synthesized
ctcaatccagaggcagatcaat

SEQ ID NO: 117300 - DNA, 22 bp, Artificial Sequence
  chemically synthesized
aatccagaggcagatcaatatt

SEQ ID NO: 117301 - DNA, 22 bp, Artificial Sequence
  chemically synthesized
atctgcctctggattgagcagc

SEQ ID NO: 117302 - DNA, 22 bp, Artificial Sequence
  chemically synthesized
cctctggattgagcagctgttc

SEQ ID NO: 117303 - DNA, 22 bp, Artificial Sequence
  chemically synthesized
tggattgagcagctgttcttcc

SEQ ID NO: 117304 - DNA, 22 bp, Artificial Sequence
  chemically synthesized
gattgagcagctgttcttcccg

SEQ ID NO: 117305 - DNA, 22 bp, Artificial Sequence
  chemically synthesized
agcagctgttcttcccgtgtgc

SEQ ID NO: 117306 - DNA, 22 bp, Artificial Sequence
  chemically synthesized
ttcttcccgtgtgctgccttac

SEQ ID NO: 117307 - DNA, 22 bp, Artificial Sequence
  chemically synthesized
ttcccgtgtgctgccttactga

SEQ ID NO: 117308 - DNA, 22 bp, Artificial Sequence
  chemically synthesized
cccgtgtgctgccttactgaat

SEQ ID NO: 117309 - DNA, 22 bp, Artificial Sequence
  chemically synthesized
ccgtgtgctgccttactgaatc

SEQ ID NO: 117310 - DNA, 22 bp, Artificial Sequence
  chemically synthesized
ccttactgaatccttgatccca

SEQ ID NO: 117311 - DNA, 22 bp, Artificial Sequence
  chemically synthesized
actgaatccttgatcccactgc

SEQ ID NO: 117312 - DNA, 22 bp, Artificial Sequence
  chemically synthesized
ctgaatccttgatcccactgca

SEQ ID NO: 117313 - DNA, 22 bp, Artificial Sequence
  chemically synthesized
aatccttgatcccactgcaccc

SEQ ID NO: 117314 - DNA, 22 bp, Artificial Sequence
  chemically synthesized
gatcccactgcaccctgtatct

SEQ ID NO: 117315 - DNA, 22 bp, Artificial Sequence
  chemically synthesized
atcccactgcaccctgtatctt

SEQ ID NO: 117316 - DNA, 22 bp, Artificial Sequence
  chemically synthesized
caccctgtatcttgcctgccac

SEQ ID NO: 117317 - DNA, 22 bp, Artificial Sequence
  chemically synthesized
tatcttgcctgccacacctcaa

SEQ ID NO: 117318 - DNA, 22 bp, Artificial Sequence
  chemically synthesized
gcctgccacacctcaaataacc

SEQ ID NO: 117319 - DNA, 22 bp, Artificial Sequence
  chemically synthesized
cctgccacacctcaaataaccg

SEQ ID NO: 117320 - DNA, 22 bp, Artificial Sequence
  chemically synthesized
ccacacctcaaataaccggata

SEQ ID NO: 117321 - DNA, 22 bp, Artificial Sequence
  chemically synthesized
aaataaccggatattggaagaa

SEQ ID NO: 117322 - DNA, 22 bp, Artificial Sequence
  chemically synthesized
gaagaaacaaatcttgactgat

SEQ ID NO: 117323 - DNA, 22 bp, Artificial Sequence
  chemically synthesized
gactgatacttgaaactagagt

SEQ ID NO: 117324 - DNA, 22 bp, Artificial Sequence
  chemically synthesized
actgatacttgaaactagagtc

SEQ ID NO: 117325 - DNA, 22 bp, Artificial Sequence
  chemically synthesized
atacttgaaactagagtctctc

SEQ ID NO: 117326 - DNA, 22 bp, Artificial Sequence
  chemically synthesized
gaaactagagtctctcctcctc

SEQ ID NO: 117327 - DNA, 22 bp, Artificial Sequence
  chemically synthesized
aaactagagtctctcctcctct

SEQ ID NO: 117328 - DNA, 22 bp, Artificial Sequence
  chemically synthesized
gagtctctcctcctctgccttc

SEQ ID NO: 117329 - DNA, 22 bp, Artificial Sequence
  chemically synthesized
tcctcctctgccttctctgcct

SEQ ID NO: 117330 - DNA, 22 bp, Artificial Sequence
  chemically synthesized
ctcctctgccttctctgcctgt

SEQ ID NO: 117331 - DNA, 22 bp, Artificial Sequence
  chemically synthesized
ctctgccttctctgcctgtctg

SEQ ID NO: 117332 - DNA, 22 bp, Artificial Sequence
  chemically synthesized
tgccttctctgcctgtctgtgg

SEQ ID NO: 117333 - DNA, 22 bp, Artificial Sequence
  chemically synthesized
ccttctctgcctgtctgtggtc

SEQ ID NO: 117334 - DNA, 22 bp, Artificial Sequence
  chemically synthesized
ctctgcctgtctgtggtctctt

SEQ ID NO: 117335 - DNA, 22 bp, Artificial Sequence
  chemically synthesized
tctgcctgtctgtggtctcttt

SEQ ID NO: 117336 - DNA, 22 bp, Artificial Sequence
  chemically synthesized
tgcctgtctgtggtctcttttg

SEQ ID NO: 117337 - DNA, 22 bp, Artificial Sequence
  chemically synthesized
cctgtctgtggtctcttttgtt

SEQ ID NO: 117338 - DNA, 22 bp, Artificial Sequence
  chemically synthesized
tctgtggtctcttttgttttct

SEQ ID NO: 117339 - DNA, 22 bp, Artificial Sequence
  chemically synthesized
tggtctcttttgttttcttcct

SEQ ID NO: 117340 - DNA, 22 bp, Artificial Sequence
  chemically synthesized
ttttgttttcttcctttttttt

SEQ ID NO: 117341 - DNA, 22 bp, Artificial Sequence
  chemically synthesized
ttgttttcttcctttttttttc

SEQ ID NO: 117342 - DNA, 22 bp, Artificial Sequence
  chemically synthesized
tgttttcttcctttttttttct

SEQ ID NO: 117343 - DNA, 22 bp, Artificial Sequence
  chemically synthesized
gttttcttcctttttttttctt

SEQ ID NO: 117344 - DNA, 22 bp, Artificial Sequence
  chemically synthesized
ttttcttcctttttttttcttt

SEQ ID NO: 117345 - DNA, 22 bp, Artificial Sequence
  chemically synthesized
tcttcctttttttttctttctt

SEQ ID NO: 117346 - DNA, 22 bp, Artificial Sequence
  chemically synthesized
cttcctttttttttctttcttg

SEQ ID NO: 117347 - DNA, 22 bp, Artificial Sequence
  chemically synthesized
ttcctttttttttctttcttgc

SEQ ID NO: 117348 - DNA, 22 bp, Artificial Sequence
  chemically synthesized
cctttttttttctttcttgcat

SEQ ID NO: 117349 - DNA, 22 bp, Artificial Sequence
  chemically synthesized
ctttttttttctttcttgcatt

SEQ ID NO: 117350 - DNA, 22 bp, Artificial Sequence
  chemically synthesized
tttttttctttcttgcattttt

SEQ ID NO: 117351 - DNA, 22 bp, Artificial Sequence
  chemically synthesized
ttttttctttcttgcatttttt

SEQ ID NO: 117352 - DNA, 22 bp, Artificial Sequence
  chemically synthesized
tttttctttcttgcattttttt

SEQ ID NO: 117353 - DNA, 22 bp, Artificial Sequence
  chemically synthesized
ttttctttcttgcatttttttt

SEQ ID NO: 117354 - DNA, 22 bp, Artificial Sequence
  chemically synthesized
tttctttcttgcattttttttt

SEQ ID NO: 117355 - DNA, 22 bp, Artificial Sequence
  chemically synthesized
ttctttcttgcatttttttttt

SEQ ID NO: 117356 - DNA, 22 bp, Artificial Sequence
  chemically synthesized
tctttcttgcattttttttttt

SEQ ID NO: 117357 - DNA, 22 bp, Artificial Sequence
  chemically synthesized
ctttcttgcatttttttttttt

SEQ ID NO: 117358 - DNA, 22 bp, Artificial Sequence
  chemically synthesized
tttcttgcattttttttttttt

SEQ ID NO: 117359 - DNA, 22 bp, Artificial Sequence
  chemically synthesized
tcttgcatttttttttttttgc

SEQ ID NO: 117360 - DNA, 22 bp, Artificial Sequence
  chemically synthesized
cttgcatttttttttttttgca

SEQ ID NO: 117361 - DNA, 22 bp, Artificial Sequence
  chemically synthesized
ttgcatttttttttttttgcat

SEQ ID NO: 117362 - DNA, 22 bp, Artificial Sequence
  chemically synthesized
gcatttttttttttttgcatcc

SEQ ID NO: 117363 - DNA, 22 bp, Artificial Sequence
  chemically synthesized
catttttttttttttgcatcct

SEQ ID NO: 117364 - DNA, 22 bp, Artificial Sequence
  chemically synthesized
ttttttttttgcatccttctca

SEQ ID NO: 117365 - DNA, 22 bp, Artificial Sequence
  chemically synthesized
tttttttttgcatccttctcag

SEQ ID NO: 117366 - DNA, 22 bp, Artificial Sequence
  chemically synthesized
ttttttttgcatccttctcagt

SEQ ID NO: 117367 - DNA, 22 bp, Artificial Sequence
  chemically synthesized
tttttttgcatccttctcagtt

SEQ ID NO: 117368 - DNA, 22 bp, Artificial Sequence
  chemically synthesized
ttttttgcatccttctcagttt

SEQ ID NO: 117369 - DNA, 22 bp, Artificial Sequence
  chemically synthesized
tttttgcatccttctcagtttc

SEQ ID NO: 117370 - DNA, 22 bp, Artificial Sequence
  chemically synthesized
ttttgcatccttctcagtttcc

SEQ ID NO: 117371 - DNA, 22 bp, Artificial Sequence
  chemically synthesized
tttgcatccttctcagtttcca

SEQ ID NO: 117372 - DNA, 22 bp, Artificial Sequence
  chemically synthesized
ttgcatccttctcagtttccat

SEQ ID NO: 117373 - DNA, 22 bp, Artificial Sequence
  chemically synthesized
tgcatccttctcagtttccatc

SEQ ID NO: 117374 - DNA, 22 bp, Artificial Sequence
  chemically synthesized
gcatccttctcagtttccatct

SEQ ID NO: 117375 - DNA, 22 bp, Artificial Sequence
  chemically synthesized
catccttctcagtttccatctc

SEQ ID NO: 117376 - DNA, 22 bp, Artificial Sequence
  chemically synthesized
ctcagtttccatctccagagtc

SEQ ID NO: 117377 - DNA, 22 bp, Artificial Sequence
  chemically synthesized
tcagtttccatctccagagtct

SEQ ID NO: 117378 - DNA, 22 bp, Artificial Sequence
  chemically synthesized
agtttccatctccagagtctct

SEQ ID NO: 117379 - DNA, 22 bp, Artificial Sequence
  chemically synthesized
ccatctccagagtctctaccgc

SEQ ID NO: 117380 - DNA, 22 bp, Artificial Sequence
  chemically synthesized
catctccagagtctctaccgcc

SEQ ID NO: 117381 - DNA, 22 bp, Artificial Sequence
  chemically synthesized
cagagtctctaccgccagataa

SEQ ID NO: 117382 - DNA, 22 bp, Artificial Sequence
  chemically synthesized
taccgccagataagggtcagat

SEQ ID NO: 117383 - DNA, 22 bp, Artificial Sequence
  chemically synthesized
ccgccagataagggtcagatct

SEQ ID NO: 117384 - DNA, 22 bp, Artificial Sequence
  chemically synthesized
cttgaaagagatcttaaaacac

SEQ ID NO: 117385 - DNA, 22 bp, Artificial Sequence
  chemically synthesized
gaaagagatcttaaaacacaat

SEQ ID NO: 117386 - DNA, 22 bp, Artificial Sequence
  chemically synthesized
aaagagatcttaaaacacaatc

SEQ ID NO: 117387 - DNA, 22 bp, Artificial Sequence
  chemically synthesized
aaaacacaatcattctcctgag

SEQ ID NO: 117388 - DNA, 22 bp, Artificial Sequence
  chemically synthesized
aaacacaatcattctcctgagt

SEQ ID NO: 117389 - DNA, 22 bp, Artificial Sequence
  chemically synthesized
tcctgagtttaggatttgtttg

SEQ ID NO: 117390 - DNA, 22 bp, Artificial Sequence
  chemically synthesized
ctgagtttaggatttgtttgac

SEQ ID NO: 117391 - DNA, 22 bp, Artificial Sequence
  chemically synthesized
agtttaggatttgtttgacaag

SEQ ID NO: 117392 - DNA, 22 bp, Artificial Sequence
  chemically synthesized
aggatttgtttgacaagagcat

SEQ ID NO: 117393 - DNA, 22 bp, Artificial Sequence
  chemically synthesized
ggatttgtttgacaagagcatt

SEQ ID NO: 117394 - DNA, 22 bp, Artificial Sequence
  chemically synthesized
gtttgacaagagcattttagct

SEQ ID NO: 117395 - DNA, 22 bp, Artificial Sequence
  chemically synthesized
tttgacaagagcattttagctt

SEQ ID NO: 117396 - DNA, 22 bp, Artificial Sequence
  chemically synthesized
gacaagagcattttagcttgaa

SEQ ID NO: 117397 - DNA, 22 bp, Artificial Sequence
  chemically synthesized
acaagagcattttagcttgaaa

SEQ ID NO: 117398 - DNA, 22 bp, Artificial Sequence
  chemically synthesized
tagcttgaaaggttacaaaagg

SEQ ID NO: 117399 - DNA, 22 bp, Artificial Sequence
  chemically synthesized
agcttgaaaggttacaaaaggg

SEQ ID NO: 117400 - DNA, 22 bp, Artificial Sequence
  chemically synthesized
gcttgaaaggttacaaaaggga

SEQ ID NO: 117401 - DNA, 22 bp, Artificial Sequence
  chemically synthesized
gaaaggttacaaaagggatcat

SEQ ID NO: 117402 - DNA, 22 bp, Artificial Sequence
  chemically synthesized
aaaggttacaaaagggatcatg

SEQ ID NO: 117403 - DNA, 22 bp, Artificial Sequence
  chemically synthesized
caaaagggatcatgtagtctat

SEQ ID NO: 117404 - DNA, 22 bp, Artificial Sequence
  chemically synthesized
tagcccagtataataggacaca

SEQ ID NO: 117405 - DNA, 22 bp, Artificial Sequence
  chemically synthesized
tacccctggagctggacagaat

SEQ ID NO: 117406 - DNA, 22 bp, Artificial Sequence
  chemically synthesized
gagctggacagaattggaggtg

SEQ ID NO: 117407 - DNA, 22 bp, Artificial Sequence
  chemically synthesized
gacagaattggaggtgaatctt

SEQ ID NO: 117408 - DNA, 22 bp, Artificial Sequence
  chemically synthesized
gaggtgaatcttatgttcggta

SEQ ID NO: 117409 - DNA, 22 bp, Artificial Sequence
  chemically synthesized
atgttcggtataactttacgta

SEQ ID NO: 117410 - DNA, 22 bp, Artificial Sequence
  chemically synthesized
tgttcggtataactttacgtac

SEQ ID NO: 117411 - DNA, 22 bp, Artificial Sequence
  chemically synthesized
ggtataactttacgtactttac

SEQ ID NO: 117412 - DNA, 22 bp, Artificial Sequence
  chemically synthesized
tacgtactttacctttgtgcac

SEQ ID NO: 117413 - DNA, 22 bp, Artificial Sequence
  chemically synthesized
acgtactttacctttgtgcaca

SEQ ID NO: 117414 - DNA, 22 bp, Artificial Sequence
  chemically synthesized
cgtactttacctttgtgcacat

SEQ ID NO: 117415 - DNA, 22 bp, Artificial Sequence
  chemically synthesized
tacctttgtgcacattagtatc

SEQ ID NO: 117416 - DNA, 22 bp, Artificial Sequence
  chemically synthesized
acctttgtgcacattagtatct

SEQ ID NO: 117417 - DNA, 22 bp, Artificial Sequence
  chemically synthesized
cctttgtgcacattagtatctt

SEQ ID NO: 117418 - DNA, 22 bp, Artificial Sequence
  chemically synthesized
tgtgcacattagtatctttgtt

SEQ ID NO: 117419 - DNA, 22 bp, Artificial Sequence
  chemically synthesized
gtgcacattagtatctttgttt

SEQ ID NO: 117420 - DNA, 22 bp, Artificial Sequence
  chemically synthesized
tgcacattagtatctttgtttt

SEQ ID NO: 117421 - DNA, 22 bp, Artificial Sequence
  chemically synthesized
gtatctttgtttttaaagataa

SEQ ID NO: 117422 - DNA, 22 bp, Artificial Sequence
  chemically synthesized
tgtttttaaagataaagatgtt

SEQ ID NO: 117423 - DNA, 22 bp, Artificial Sequence
  chemically synthesized
gtttttaaagataaagatgtta

SEQ ID NO: 117424 - DNA, 22 bp, Artificial Sequence
  chemically synthesized
tttttaaagataaagatgttaa

SEQ ID NO: 117425 - DNA, 22 bp, Artificial Sequence
  chemically synthesized
ttaaagataaagatgttaatac

SEQ ID NO: 117426 - DNA, 22 bp, Artificial Sequence
  chemically synthesized
taaagataaagatgttaatact

SEQ ID NO: 117427 - DNA, 22 bp, Artificial Sequence
  chemically synthesized
aaagataaagatgttaatactt

SEQ ID NO: 117428 - DNA, 22 bp, Artificial Sequence
  chemically synthesized
aagataaagatgttaatactta

SEQ ID NO: 117429 - DNA, 22 bp, Artificial Sequence
  chemically synthesized
atacttacctcagggactggct

SEQ ID NO: 117430 - DNA, 22 bp, Artificial Sequence
  chemically synthesized
acctcagggactggctctaaat

SEQ ID NO: 117431 - DNA, 22 bp, Artificial Sequence
  chemically synthesized
cctcagggactggctctaaata

SEQ ID NO: 117432 - DNA, 22 bp, Artificial Sequence
  chemically synthesized
agggactggctctaaatattta

SEQ ID NO: 117433 - DNA, 22 bp, Artificial Sequence
  chemically synthesized
gctctaaatatttaatgtgagc

SEQ ID NO: 117434 - DNA, 22 bp, Artificial Sequence
  chemically synthesized
taaatatttaatgtgagccttt

SEQ ID NO: 117435 - DNA, 22 bp, Artificial Sequence
  chemically synthesized
aatatttaatgtgagcctttag

SEQ ID NO: 117436 - DNA, 22 bp, Artificial Sequence
  chemically synthesized
aatgtgagcctttagcaaccag

SEQ ID NO: 117437 - DNA, 22 bp, Artificial Sequence
  chemically synthesized
atgtgagcctttagcaaccagt

SEQ ID NO: 117438 - DNA, 22 bp, Artificial Sequence
  chemically synthesized
tagcaaccagtgaatgttaata

SEQ ID NO: 117439 - DNA, 22 bp, Artificial Sequence
  chemically synthesized
agcaaccagtgaatgttaatat

SEQ ID NO: 117440 - DNA, 22 bp, Artificial Sequence
  chemically synthesized
gcaaccagtgaatgttaatatt

SEQ ID NO: 117441 - DNA, 22 bp, Artificial Sequence
  chemically synthesized
atattctctccactctatatct

SEQ ID NO: 117442 - DNA, 22 bp, Artificial Sequence
  chemically synthesized
tctccactctatatctctttca

SEQ ID NO: 117443 - DNA, 22 bp, Artificial Sequence
  chemically synthesized
tccactctatatctctttcagg

SEQ ID NO: 117444 - DNA, 22 bp, Artificial Sequence
  chemically synthesized
cactctatatctctttcaggaa

SEQ ID NO: 117445 - DNA, 22 bp, Artificial Sequence
  chemically synthesized
tatatctctttcaggaattctc

SEQ ID NO: 117446 - DNA, 22 bp, Artificial Sequence
  chemically synthesized
tatctctttcaggaattctcag

SEQ ID NO: 117447 - DNA, 22 bp, Artificial Sequence
  chemically synthesized
tttcaggaattctcaggagtca

SEQ ID NO: 117448 - DNA, 22 bp, Artificial Sequence
  chemically synthesized
tcaggaattctcaggagtcaat

SEQ ID NO: 117449 - DNA, 22 bp, Artificial Sequence
  chemically synthesized
caggaattctcaggagtcaatc

SEQ ID NO: 117450 - DNA, 22 bp, Artificial Sequence
  chemically synthesized
aggaattctcaggagtcaatca

SEQ ID NO: 117451 - DNA, 22 bp, Artificial Sequence
  chemically synthesized
tcaggagtcaatcacagtcagc

SEQ ID NO: 117452 - DNA, 22 bp, Artificial Sequence
  chemically synthesized
aggagtcaatcacagtcagctt

SEQ ID NO: 117453 - DNA, 22 bp, Artificial Sequence
  chemically synthesized
atttccaactttttattaataa

SEQ ID NO: 117454 - DNA, 22 bp, Artificial Sequence
  chemically synthesized
tttccaactttttattaataat

SEQ ID NO: 117455 - DNA, 22 bp, Artificial Sequence
  chemically synthesized
ccaactttttattaataattgt

SEQ ID NO: 117456 - DNA, 22 bp, Artificial Sequence
  chemically synthesized
caactttttattaataattgtc

SEQ ID NO: 117457 - DNA, 22 bp, Artificial Sequence
  chemically synthesized
tttattaataattgtctttcct

SEQ ID NO: 117458 - DNA, 22 bp, Artificial Sequence
  chemically synthesized
ttattaataattgtctttcctt

SEQ ID NO: 117459 - DNA, 22 bp, Artificial Sequence
  chemically synthesized
tattaataattgtctttccttg

SEQ ID NO: 117460 - DNA, 22 bp, Artificial Sequence
  chemically synthesized
attaataattgtctttccttgt

SEQ ID NO: 117461 - DNA, 22 bp, Artificial Sequence
  chemically synthesized
ttaataattgtctttccttgtt

SEQ ID NO: 117462 - DNA, 22 bp, Artificial Sequence
  chemically synthesized
ataattgtctttccttgttatt

SEQ ID NO: 117463 - DNA, 22 bp, Artificial Sequence
  chemically synthesized
tctttccttgttattggctcac

SEQ ID NO: 117464 - DNA, 22 bp, Artificial Sequence
  chemically synthesized
tccttgttattggctcactgat

SEQ ID NO: 117465 - DNA, 22 bp, Artificial Sequence
  chemically synthesized
ccttgttattggctcactgata

SEQ ID NO: 117466 - DNA, 22 bp, Artificial Sequence
  chemically synthesized
cttgttattggctcactgatac

SEQ ID NO: 117467 - DNA, 22 bp, Artificial Sequence
  chemically synthesized
gttattggctcactgatactca

SEQ ID NO: 117468 - DNA, 22 bp, Artificial Sequence
  chemically synthesized
ttattggctcactgatactcag

SEQ ID NO: 117469 - DNA, 22 bp, Artificial Sequence
  chemically synthesized
ttggctcactgatactcagacc

SEQ ID NO: 117470 - DNA, 22 bp, Artificial Sequence
  chemically synthesized
gctcactgatactcagaccaca

SEQ ID NO: 117471 - DNA, 22 bp, Artificial Sequence
  chemically synthesized
actgatactcagaccacatctg

SEQ ID NO: 117472 - DNA, 22 bp, Artificial Sequence
  chemically synthesized
atactcagaccacatctgtgag

SEQ ID NO: 117473 - DNA, 22 bp, Artificial Sequence
  chemically synthesized
agaccacatctgtgaggtaaac

SEQ ID NO: 117474 - DNA, 22 bp, Artificial Sequence
  chemically synthesized
tgaggtaaacaaggagacaaga

SEQ ID NO: 117475 - DNA, 22 bp, Artificial Sequence
  chemically synthesized
cccacttaatagatgagcatat

SEQ ID NO: 117476 - DNA, 22 bp, Artificial Sequence
  chemically synthesized
ccacttaatagatgagcatata

SEQ ID NO: 117477 - DNA, 22 bp, Artificial Sequence
  chemically synthesized
aatagatgagcatataaaccag

SEQ ID NO: 117478 - DNA, 22 bp, Artificial Sequence
  chemically synthesized
atagatgagcatataaaccaga

SEQ ID NO: 117479 - DNA, 22 bp, Artificial Sequence
  chemically synthesized
tgtgagtaacccaagataatat

SEQ ID NO: 117480 - DNA, 22 bp, Artificial Sequence
  chemically synthesized
gtgagtaacccaagataatatg

SEQ ID NO: 117481 - DNA, 22 bp, Artificial Sequence
  chemically synthesized
tgagtaacccaagataatatga

SEQ ID NO: 117482 - DNA, 22 bp, Artificial Sequence
  chemically synthesized
tttcaagaattcatgatgtgct

SEQ ID NO: 117483 - DNA, 22 bp, Artificial Sequence
  chemically synthesized
caagaattcatgatgtgctctg

SEQ ID NO: 117484 - DNA, 22 bp, Artificial Sequence
  chemically synthesized
aagaattcatgatgtgctctgg

SEQ ID NO: 117485 - DNA, 22 bp, Artificial Sequence
  chemically synthesized
atgatgtgctctggtgtttttg

SEQ ID NO: 117486 - DNA, 22 bp, Artificial Sequence
  chemically synthesized
tggtgtttttgttttgttttcc

SEQ ID NO: 117487 - DNA, 22 bp, Artificial Sequence
  chemically synthesized
gtgtttttgttttgttttccat

SEQ ID NO: 117488 - DNA, 22 bp, Artificial Sequence
  chemically synthesized
ttgttttgttttccatctgcca

SEQ ID NO: 117489 - DNA, 22 bp, Artificial Sequence
  chemically synthesized
tgttttgttttccatctgccac

SEQ ID NO: 117490 - DNA, 22 bp, Artificial Sequence
  chemically synthesized
gttttgttttccatctgccacc

SEQ ID NO: 117491 - DNA, 22 bp, Artificial Sequence
  chemically synthesized
ttttgttttccatctgccacca

SEQ ID NO: 117492 - DNA, 22 bp, Artificial Sequence
  chemically synthesized
tgttttccatctgccaccaatt

SEQ ID NO: 117493 - DNA, 22 bp, Artificial Sequence
  chemically synthesized
gttttccatctgccaccaattt

SEQ ID NO: 117494 - DNA, 22 bp, Artificial Sequence
  chemically synthesized
ttttccatctgccaccaattta

SEQ ID NO: 117495 - DNA, 22 bp, Artificial Sequence
  chemically synthesized
tccatctgccaccaatttagga

SEQ ID NO: 117496 - DNA, 22 bp, Artificial Sequence
  chemically synthesized
ccatctgccaccaatttaggat

SEQ ID NO: 117497 - DNA, 22 bp, Artificial Sequence
  chemically synthesized
catctgccaccaatttaggatg

SEQ ID NO: 117498 - DNA, 22 bp, Artificial Sequence
  chemically synthesized
ccaccaatttaggatgtgattc

SEQ ID NO: 117499 - DNA, 22 bp, Artificial Sequence
  chemically synthesized
aggatgtgattcctctccttct

SEQ ID NO: 117500 - DNA, 22 bp, Artificial Sequence
  chemically synthesized
ggatgtgattcctctccttctg

SEQ ID NO: 117501 - DNA, 22 bp, Artificial Sequence
  chemically synthesized
ctctccttctgccagacaggtt

SEQ ID NO: 117502 - DNA, 22 bp, Artificial Sequence
  chemically synthesized
tccttctgccagacaggttcaa

SEQ ID NO: 117503 - DNA, 22 bp, Artificial Sequence
  chemically synthesized
cttctgccagacaggttcaaga

SEQ ID NO: 117504 - DNA, 22 bp, Artificial Sequence
  chemically synthesized
ctgccagacaggttcaagaagc

SEQ ID NO: 117505 - DNA, 22 bp, Artificial Sequence
  chemically synthesized
tgccagacaggttcaagaagct

SEQ ID NO: 117506 - DNA, 22 bp, Artificial Sequence
  chemically synthesized
ccagacaggttcaagaagctag

SEQ ID NO: 117507 - DNA, 22 bp, Artificial Sequence
  chemically synthesized
aagaagctagggaggtgactac

SEQ ID NO: 117508 - DNA, 22 bp, Artificial Sequence
  chemically synthesized
gggaggtgactactgtcttagg

SEQ ID NO: 117509 - DNA, 22 bp, Artificial Sequence
  chemically synthesized
ctgtcttaggaaaaatgctaag

SEQ ID NO: 117510 - DNA, 22 bp, Artificial Sequence
  chemically synthesized
tcttaggaaaaatgctaagggc

SEQ ID NO: 117511 - DNA, 22 bp, Artificial Sequence
  chemically synthesized
aggaaaaatgctaagggcttca

SEQ ID NO: 117512 - DNA, 22 bp, Artificial Sequence
  chemically synthesized
ggaaaaatgctaagggcttcac

SEQ ID NO: 117513 - DNA, 22 bp, Artificial Sequence
  chemically synthesized
agggcttcacactgtgacatgg

SEQ ID NO: 117514 - DNA, 22 bp, Artificial Sequence
  chemically synthesized
cacactgtgacatggggttggg

SEQ ID NO: 117515 - DNA, 22 bp, Artificial Sequence
  chemically synthesized
acactgtgacatggggttggga

SEQ ID NO: 117516 - DNA, 22 bp, Artificial Sequence
  chemically synthesized
tgacatggggttgggagtcctg

SEQ ID NO: 117517 - DNA, 22 bp, Artificial Sequence
  chemically synthesized
ggagtcctgaatgctgcttcag

SEQ ID NO: 117518 - DNA, 22 bp, Artificial Sequence
  chemically synthesized
aatgctgcttcagaaggcaggg

SEQ ID NO: 117519 - DNA, 22 bp, Artificial Sequence
  chemically synthesized
cttcagaaggcagggcttgggg

SEQ ID NO: 117520 - DNA, 22 bp, Artificial Sequence
  chemically synthesized
cagaaggcagggcttggggatt

SEQ ID NO: 117521 - DNA, 22 bp, Artificial Sequence
  chemically synthesized
agaaggcagggcttggggattg

SEQ ID NO: 117522 - DNA, 22 bp, Artificial Sequence
  chemically synthesized
ggggattgtattagttcattct

SEQ ID NO: 117523 - DNA, 22 bp, Artificial Sequence
  chemically synthesized
gggattgtattagttcattctc

SEQ ID NO: 117524 - DNA, 22 bp, Artificial Sequence
  chemically synthesized
tattagttcattctcacactgc

SEQ ID NO: 117525 - DNA, 22 bp, Artificial Sequence
  chemically synthesized
gttcattctcacactgctctaa

SEQ ID NO: 117526 - DNA, 22 bp, Artificial Sequence
  chemically synthesized
attctcacactgctctaaagat

SEQ ID NO: 117527 - DNA, 22 bp, Artificial Sequence
  chemically synthesized
tcacactgctctaaagatacta

SEQ ID NO: 117528 - DNA, 22 bp, Artificial Sequence
  chemically synthesized
acactgctctaaagatactacc

SEQ ID NO: 117529 - DNA, 22 bp, Artificial Sequence
  chemically synthesized
ctctaaagatactacctgagac

SEQ ID NO: 117530 - DNA, 22 bp, Artificial Sequence
  chemically synthesized
taaagatactacctgagactgg

SEQ ID NO: 117531 - DNA, 22 bp, Artificial Sequence
  chemically synthesized
aagatactacctgagactgggt

SEQ ID NO: 117532 - DNA, 22 bp, Artificial Sequence
  chemically synthesized
cctgagactgggtaatttatta

SEQ ID NO: 117533 - DNA, 22 bp, Artificial Sequence
  chemically synthesized
agactgggtaatttattaacaa

SEQ ID NO: 117534 - DNA, 22 bp, Artificial Sequence
  chemically synthesized
ggtaatttattaacaaaggagg

SEQ ID NO: 117535 - DNA, 22 bp, Artificial Sequence
  chemically synthesized
attaacaaaggaggtttaattg

SEQ ID NO: 117536 - DNA, 22 bp, Artificial Sequence
  chemically synthesized
ttaacaaaggaggtttaattga

SEQ ID NO: 117537 - DNA, 22 bp, Artificial Sequence
  chemically synthesized
acaaaggaggtttaattgactc

SEQ ID NO: 117538 - DNA, 22 bp, Artificial Sequence
  chemically synthesized
aattgactcacatttccacata

SEQ ID NO: 117539 - DNA, 22 bp, Artificial Sequence
  chemically synthesized
attgactcacatttccacatag

SEQ ID NO: 117540 - DNA, 22 bp, Artificial Sequence
  chemically synthesized
actcacatttccacatagctgg

SEQ ID NO: 117541 - DNA, 22 bp, Artificial Sequence
  chemically synthesized
acatttccacatagctggggag

SEQ ID NO: 117542 - DNA, 22 bp, Artificial Sequence
  chemically synthesized
ccacatagctggggaggcctca

SEQ ID NO: 117543 - DNA, 22 bp, Artificial Sequence
  chemically synthesized
cacatagctggggaggcctcag

SEQ ID NO: 117544 - DNA, 22 bp, Artificial Sequence
  chemically synthesized
gggaggcctcaggaaacttaca

SEQ ID NO: 117545 - DNA, 22 bp, Artificial Sequence
  chemically synthesized
aggaaacttacaattatggcag

SEQ ID NO: 117546 - DNA, 22 bp, Artificial Sequence
  chemically synthesized
acaattatggcagaaggagaag

SEQ ID NO: 117547 - DNA, 22 bp, Artificial Sequence
  chemically synthesized
caattatggcagaaggagaagc

SEQ ID NO: 117548 - DNA, 22 bp, Artificial Sequence
  chemically synthesized
tggcagaaggagaagcaggcac

SEQ ID NO: 117549 - DNA, 22 bp, Artificial Sequence
  chemically synthesized
acttggtggcaggcaagagaga

SEQ ID NO: 117550 - DNA, 22 bp, Artificial Sequence
  chemically synthesized
cttggtggcaggcaagagagag

SEQ ID NO: 117551 - DNA, 22 bp, Artificial Sequence
  chemically synthesized
ggtggcaggcaagagagagtga

SEQ ID NO: 117552 - DNA, 22 bp, Artificial Sequence
  chemically synthesized
gtggcaggcaagagagagtgag

SEQ ID NO: 117553 - DNA, 22 bp, Artificial Sequence
  chemically synthesized
ccttataaaaccatcagatctc

SEQ ID NO: 117554 - DNA, 22 bp, Artificial Sequence
  chemically synthesized
ataaaaccatcagatctcatga

SEQ ID NO: 117555 - DNA, 22 bp, Artificial Sequence
  chemically synthesized
taaaaccatcagatctcatgaa

SEQ ID NO: 117556 - DNA, 22 bp, Artificial Sequence
  chemically synthesized
atgaaaactcactcagtatcac

SEQ ID NO: 117557 - DNA, 22 bp, Artificial Sequence
  chemically synthesized
actcagtatcacgagaactgca

SEQ ID NO: 117558 - DNA, 22 bp, Artificial Sequence
  chemically synthesized
agtatcacgagaactgcatggg

SEQ ID NO: 117559 - DNA, 22 bp, Artificial Sequence
  chemically synthesized
catgggggaaactgctcccatg

SEQ ID NO: 117560 - DNA, 22 bp, Artificial Sequence
  chemically synthesized
ctcccatgatccaataatctcc

SEQ ID NO: 117561 - DNA, 22 bp, Artificial Sequence
  chemically synthesized
ccatgatccaataatctcccac

SEQ ID NO: 117562 - DNA, 22 bp, Artificial Sequence
  chemically synthesized
ccacctggtccctcccccgaca

SEQ ID NO: 117563 - DNA, 22 bp, Artificial Sequence
  chemically synthesized
gtccctcccccgacatataggg

SEQ ID NO: 117564 - DNA, 22 bp, Artificial Sequence
  chemically synthesized
ccccgacatatagggattatgg

SEQ ID NO: 117565 - DNA, 22 bp, Artificial Sequence
  chemically synthesized
tggggattacaattcaatatga

SEQ ID NO: 117566 - DNA, 22 bp, Artificial Sequence
  chemically synthesized
caattcaatatgaaatttgggt

SEQ ID NO: 117567 - DNA, 22 bp, Artificial Sequence
  chemically synthesized
aatatgaaatttgggtggagac

SEQ ID NO: 117568 - DNA, 22 bp, Artificial Sequence
  chemically synthesized
gggtggagacacagagccaagc

SEQ ID NO: 117569 - DNA, 22 bp, Artificial Sequence
  chemically synthesized
ggtggagacacagagccaagcc

SEQ ID NO: 117570 - DNA, 22 bp, Artificial Sequence
  chemically synthesized
gtgcactcaccacaagtgaaac

SEQ ID NO: 117571 - DNA, 22 bp, Artificial Sequence
  chemically synthesized
tgcactcaccacaagtgaaact

SEQ ID NO: 117572 - DNA, 22 bp, Artificial Sequence
  chemically synthesized
accacaagtgaaactggcctct

SEQ ID NO: 117573 - DNA, 22 bp, Artificial Sequence
  chemically synthesized
gcctctgagcctcaggtgggat

SEQ ID NO: 117574 - DNA, 22 bp, Artificial Sequence
  chemically synthesized
tgagcctcaggtgggatgggga

SEQ ID NO: 117575 - DNA, 22 bp, Artificial Sequence
  chemically synthesized
agcctcaggtgggatggggaag

SEQ ID NO: 117576 - DNA, 22 bp, Artificial Sequence
  chemically synthesized
aggtgggatggggaagctcact

SEQ ID NO: 117577 - DNA, 22 bp, Artificial Sequence
  chemically synthesized
acttcagcaagtccctgccact

SEQ ID NO: 117578 - DNA, 22 bp, Artificial Sequence
  chemically synthesized
cagcaagtccctgccactgtgg

SEQ ID NO: 117579 - DNA, 22 bp, Artificial Sequence
  chemically synthesized
agcaagtccctgccactgtggc

SEQ ID NO: 117580 - DNA, 22 bp, Artificial Sequence
  chemically synthesized
ccactgtggcattcatatcttc

SEQ ID NO: 117581 - DNA, 22 bp, Artificial Sequence
  chemically synthesized
tggcattcatatcttcttagtc

SEQ ID NO: 117582 - DNA, 22 bp, Artificial Sequence
  chemically synthesized
atatcttcttagtcctggggct

SEQ ID NO: 117583 - DNA, 22 bp, Artificial Sequence
  chemically synthesized
cttagtcctggggctggaatgc

SEQ ID NO: 117584 - DNA, 22 bp, Artificial Sequence
  chemically synthesized
ttagtcctggggctggaatgct

SEQ ID NO: 117585 - DNA, 22 bp, Artificial Sequence
  chemically synthesized
agtcctggggctggaatgctgc

SEQ ID NO: 117586 - DNA, 22 bp, Artificial Sequence
  chemically synthesized
gtcctggggctggaatgctgcc

SEQ ID NO: 117587 - DNA, 22 bp, Artificial Sequence
  chemically synthesized
gggctggaatgctgcccatttt

SEQ ID NO: 117588 - DNA, 22 bp, Artificial Sequence
  chemically synthesized
gaatgctgcccattttttgaaa

SEQ ID NO: 117589 - DNA, 22 bp, Artificial Sequence
  chemically synthesized
cccattttttgaaaaagctgat

SEQ ID NO: 117590 - DNA, 22 bp, Artificial Sequence
  chemically synthesized
tttgaaaaagctgatcagagtc

SEQ ID NO: 117591 - DNA, 22 bp, Artificial Sequence
  chemically synthesized
ttgaaaaagctgatcagagtct

SEQ ID NO: 117592 - DNA, 22 bp, Artificial Sequence
  chemically synthesized
tgaaaaagctgatcagagtctc

SEQ ID NO: 117593 - DNA, 22 bp, Artificial Sequence
  chemically synthesized
gaaaaagctgatcagagtctct

SEQ ID NO: 117594 - DNA, 22 bp, Artificial Sequence
  chemically synthesized
aaaaagctgatcagagtctcta

SEQ ID NO: 117595 - DNA, 22 bp, Artificial Sequence
  chemically synthesized
atcagagtctctaggagtagag

SEQ ID NO: 117596 - DNA, 22 bp, Artificial Sequence
  chemically synthesized
taggagtagagtaatggggaga

SEQ ID NO: 117597 - DNA, 22 bp, Artificial Sequence
  chemically synthesized
ggagtagagtaatggggagaaa

SEQ ID NO: 117598 - DNA, 22 bp, Artificial Sequence
  chemically synthesized
ggttccctgaggagcaattacc

SEQ ID NO: 117599 - DNA, 22 bp, Artificial Sequence
  chemically synthesized
cctgaggagcaattacccaggt

SEQ ID NO: 117600 - DNA, 22 bp, Artificial Sequence
  chemically synthesized
aggagcaattacccaggtaatt

SEQ ID NO: 117601 - DNA, 22 bp, Artificial Sequence
  chemically synthesized
cccaggtaattacattagcctc

SEQ ID NO: 117602 - DNA, 22 bp, Artificial Sequence
  chemically synthesized
cattagcctctctcaatatcca

SEQ ID NO: 117603 - DNA, 22 bp, Artificial Sequence
  chemically synthesized
gcctctctcaatatccagagaa

SEQ ID NO: 117604 - DNA, 22 bp, Artificial Sequence
  chemically synthesized
tctcaatatccagagaacctaa

SEQ ID NO: 117605 - DNA, 22 bp, Artificial Sequence
  chemically synthesized
tcaatatccagagaacctaagg

SEQ ID NO: 117606 - DNA, 22 bp, Artificial Sequence
  chemically synthesized
aatatccagagaacctaaggga

SEQ ID NO: 117607 - DNA, 22 bp, Artificial Sequence
  chemically synthesized
agggaaacaagcaaagatatag

SEQ ID NO: 117608 - DNA, 22 bp, Artificial Sequence
  chemically synthesized
tgtgaaatgagtgtaatagtat

SEQ ID NO: 117609 - DNA, 22 bp, Artificial Sequence
  chemically synthesized
gtgaaatgagtgtaatagtatt

SEQ ID NO: 117610 - DNA, 22 bp, Artificial Sequence
  chemically synthesized
tgaaatgagtgtaatagtattt

SEQ ID NO: 117611 - DNA, 22 bp, Artificial Sequence
  chemically synthesized
atccagcatatttaaataacta

SEQ ID NO: 117612 - DNA, 22 bp, Artificial Sequence
  chemically synthesized
tccagcatatttaaataactaa

SEQ ID NO: 117613 - DNA, 22 bp, Artificial Sequence
  chemically synthesized
aaataactaatatatgtaaatt

SEQ ID NO: 117614 - DNA, 22 bp, Artificial Sequence
  chemically synthesized
aataactaatatatgtaaattt

SEQ ID NO: 117615 - DNA, 22 bp, Artificial Sequence
  chemically synthesized
atatatgtaaatttcttttttc

SEQ ID NO: 117616 - DNA, 22 bp, Artificial Sequence
  chemically synthesized
cttttttctaacttattttttg

SEQ ID NO: 117617 - DNA, 22 bp, Artificial Sequence
  chemically synthesized
ttttttctaacttattttttgt

SEQ ID NO: 117618 - DNA, 22 bp, Artificial Sequence
  chemically synthesized
ttttctaacttattttttgtta

SEQ ID NO: 117619 - DNA, 22 bp, Artificial Sequence
  chemically synthesized
tttctaacttattttttgttat

SEQ ID NO: 117620 - DNA, 22 bp, Artificial Sequence
  chemically synthesized
ttctaacttattttttgttata

SEQ ID NO: 117621 - DNA, 22 bp, Artificial Sequence
  chemically synthesized
tctaacttattttttgttatac

SEQ ID NO: 117622 - DNA, 22 bp, Artificial Sequence
  chemically synthesized
ctaacttattttttgttatact

SEQ ID NO: 117623 - DNA, 22 bp, Artificial Sequence
  chemically synthesized
taacttattttttgttatactt

SEQ ID NO: 117624 - DNA, 22 bp, Artificial Sequence
  chemically synthesized
acttattttttgttatactttt

SEQ ID NO: 117625 - DNA, 22 bp, Artificial Sequence
  chemically synthesized
attttttgttatacttttaagt

SEQ ID NO: 117626 - DNA, 22 bp, Artificial Sequence
  chemically synthesized
ttttttgttatacttttaagtt

SEQ ID NO: 117627 - DNA, 22 bp, Artificial Sequence
  chemically synthesized
tttgttatacttttaagtttta

SEQ ID NO: 117628 - DNA, 22 bp, Artificial Sequence
  chemically synthesized
ttgttatacttttaagttttag

SEQ ID NO: 117629 - DNA, 22 bp, Artificial Sequence
  chemically synthesized
tgttatacttttaagttttagg

SEQ ID NO: 117630 - DNA, 22 bp, Artificial Sequence
  chemically synthesized
gttatacttttaagttttaggg

SEQ ID NO: 117631 - DNA, 22 bp, Artificial Sequence
  chemically synthesized
ttatacttttaagttttagggt

SEQ ID NO: 117632 - DNA, 22 bp, Artificial Sequence
  chemically synthesized
tacttttaagttttagggtaca

SEQ ID NO: 117633 - DNA, 22 bp, Artificial Sequence
  chemically synthesized
ttaagttttagggtacatgtgc

SEQ ID NO: 117634 - DNA, 22 bp, Artificial Sequence
  chemically synthesized
taagttttagggtacatgtgca

SEQ ID NO: 117635 - DNA, 22 bp, Artificial Sequence
  chemically synthesized
aagttttagggtacatgtgcac

SEQ ID NO: 117636 - DNA, 22 bp, Artificial Sequence
  chemically synthesized
agttttagggtacatgtgcaca

SEQ ID NO: 117637 - DNA, 22 bp, Artificial Sequence
  chemically synthesized
tagggtacatgtgcacaaggtg

SEQ ID NO: 117638 - DNA, 22 bp, Artificial Sequence
  chemically synthesized
agggtacatgtgcacaaggtgc

SEQ ID NO: 117639 - DNA, 22 bp, Artificial Sequence
  chemically synthesized
gggtacatgtgcacaaggtgca

SEQ ID NO: 117640 - DNA, 22 bp, Artificial Sequence
  chemically synthesized
gttacatatgtatacatgtgcc

SEQ ID NO: 117641 - DNA, 22 bp, Artificial Sequence
  chemically synthesized
catatgtatacatgtgccatgt

SEQ ID NO: 117642 - DNA, 22 bp, Artificial Sequence
  chemically synthesized
gtgtgctgcacccattaactca

SEQ ID NO: 117643 - DNA, 22 bp, Artificial Sequence
  chemically synthesized
cacccattaactcaccatttaa

SEQ ID NO: 117644 - DNA, 22 bp, Artificial Sequence
  chemically synthesized
actcaccatttaacattaggta

SEQ ID NO: 117645 - DNA, 22 bp, Artificial Sequence
  chemically synthesized
accatttaacattaggtatatc

SEQ ID NO: 117646 - DNA, 22 bp, Artificial Sequence
  chemically synthesized
aacattaggtatatctcctaat

SEQ ID NO: 117647 - DNA, 22 bp, Artificial Sequence
  chemically synthesized
acattaggtatatctcctaatg

SEQ ID NO: 117648 - DNA, 22 bp, Artificial Sequence
  chemically synthesized
ggtatatctcctaatgctatcc

SEQ ID NO: 117649 - DNA, 22 bp, Artificial Sequence
  chemically synthesized
ctaatgctatccctgccccctc

SEQ ID NO: 117650 - DNA, 22 bp, Artificial Sequence
  chemically synthesized
atgctatccctgccccctcctc

SEQ ID NO: 117651 - DNA, 22 bp, Artificial Sequence
  chemically synthesized
tccctgccccctcctcccaccc

SEQ ID NO: 117652 - DNA, 22 bp, Artificial Sequence
  chemically synthesized
ccccctcctcccaccccacaac

SEQ ID NO: 117653 - DNA, 22 bp, Artificial Sequence
  chemically synthesized
ctcccaccccacaacaggcccc

SEQ ID NO: 117654 - DNA, 22 bp, Artificial Sequence
  chemically synthesized
ccaccccacaacaggccccggt

SEQ ID NO: 117655 - DNA, 22 bp, Artificial Sequence
  chemically synthesized
cccttcctgtgtccatgtgttc

SEQ ID NO: 117656 - DNA, 22 bp, Artificial Sequence
  chemically synthesized
cctgtgtccatgtgttctcatt

SEQ ID NO: 117657 - DNA, 22 bp, Artificial Sequence
  chemically synthesized
ctgtgtccatgtgttctcattg

SEQ ID NO: 117658 - DNA, 22 bp, Artificial Sequence
  chemically synthesized
tgtccatgtgttctcattgttc

SEQ ID NO: 117659 - DNA, 22 bp, Artificial Sequence
  chemically synthesized
tcattgttcagttcccacctat

SEQ ID NO: 117660 - DNA, 22 bp, Artificial Sequence
  chemically synthesized
attgttcagttcccacctatga

SEQ ID NO: 117661 - DNA, 22 bp, Artificial Sequence
  chemically synthesized
ttcagttcccacctatgagtga

SEQ ID NO: 117662 - DNA, 22 bp, Artificial Sequence
  chemically synthesized
agttcccacctatgagtgagaa

SEQ ID NO: 117663 - DNA, 22 bp, Artificial Sequence
  chemically synthesized
ccacctatgagtgagaacatgt

SEQ ID NO: 117664 - DNA, 22 bp, Artificial Sequence
  chemically synthesized
tgagtgagaacatgtggtgttt

SEQ ID NO: 117665 - DNA, 22 bp, Artificial Sequence
  chemically synthesized
ggctttttgtccttgtgatagt

SEQ ID NO: 117666 - DNA, 22 bp, Artificial Sequence
  chemically synthesized
gctttttgtccttgtgatagtt

SEQ ID NO: 117667 - DNA, 22 bp, Artificial Sequence
  chemically synthesized
tttgtccttgtgatagtttgct

SEQ ID NO: 117668 - DNA, 22 bp, Artificial Sequence
  chemically synthesized
ttgtccttgtgatagtttgctg

SEQ ID NO: 117669 - DNA, 22 bp, Artificial Sequence
  chemically synthesized
tgtccttgtgatagtttgctga

SEQ ID NO: 117670 - DNA, 22 bp, Artificial Sequence
  chemically synthesized
gtccttgtgatagtttgctgag

SEQ ID NO: 117671 - DNA, 22 bp, Artificial Sequence
  chemically synthesized
tccttgtgatagtttgctgaga

SEQ ID NO: 117672 - DNA, 22 bp, Artificial Sequence
  chemically synthesized
gtgatagtttgctgagaatgat

SEQ ID NO: 117673 - DNA, 22 bp, Artificial Sequence
  chemically synthesized
tgatagtttgctgagaatgatg

SEQ ID NO: 117674 - DNA, 22 bp, Artificial Sequence
  chemically synthesized
gctgagaatgatggtttccagc

SEQ ID NO: 117675 - DNA, 22 bp, Artificial Sequence
  chemically synthesized
ctgagaatgatggtttccagct

SEQ ID NO: 117676 - DNA, 22 bp, Artificial Sequence
  chemically synthesized
agaatgatggtttccagcttca

SEQ ID NO: 117677 - DNA, 22 bp, Artificial Sequence
  chemically synthesized
ccagcttcatccatgtccctac

SEQ ID NO: 117678 - DNA, 22 bp, Artificial Sequence
  chemically synthesized
cagcttcatccatgtccctaca

SEQ ID NO: 117679 - DNA, 22 bp, Artificial Sequence
  chemically synthesized
catccatgtccctacaaaggac

SEQ ID NO: 117680 - DNA, 22 bp, Artificial Sequence
  chemically synthesized
atccatgtccctacaaaggaca

SEQ ID NO: 117681 - DNA, 22 bp, Artificial Sequence
  chemically synthesized
caaaggacatgaactcatcatt

SEQ ID NO: 117682 - DNA, 22 bp, Artificial Sequence
  chemically synthesized
atcattttttatggctgcatag

SEQ ID NO: 117683 - DNA, 22 bp, Artificial Sequence
  chemically synthesized
tttatggctgcatagtattcca

SEQ ID NO: 117684 - DNA, 22 bp, Artificial Sequence
  chemically synthesized
ttatggctgcatagtattccat

SEQ ID NO: 117685 - DNA, 22 bp, Artificial Sequence
  chemically synthesized
tatggctgcatagtattccatg

SEQ ID NO: 117686 - DNA, 22 bp, Artificial Sequence
  chemically synthesized
atggctgcatagtattccatgg

SEQ ID NO: 117687 - DNA, 22 bp, Artificial Sequence
  chemically synthesized
tggctgcatagtattccatggt

SEQ ID NO: 117688 - DNA, 22 bp, Artificial Sequence
  chemically synthesized
catagtattccatggtgtatat

SEQ ID NO: 117689 - DNA, 22 bp, Artificial Sequence
  chemically synthesized
catggtgtatatgtgccacatt

SEQ ID NO: 117690 - DNA, 22 bp, Artificial Sequence
  chemically synthesized
tcttaatccagtctatcattgt

SEQ ID NO: 117691 - DNA, 22 bp, Artificial Sequence
  chemically synthesized
cttaatccagtctatcattgtt

SEQ ID NO: 117692 - DNA, 22 bp, Artificial Sequence
  chemically synthesized
ttaatccagtctatcattgttg

SEQ ID NO: 117693 - DNA, 22 bp, Artificial Sequence
  chemically synthesized
aatccagtctatcattgttgga

SEQ ID NO: 117694 - DNA, 22 bp, Artificial Sequence
  chemically synthesized
atccagtctatcattgttggac

SEQ ID NO: 117695 - DNA, 22 bp, Artificial Sequence
  chemically synthesized
tcattgttggacatttgggttg

SEQ ID NO: 117696 - DNA, 22 bp, Artificial Sequence
  chemically synthesized
ttggacatttgggttggttcca

SEQ ID NO: 117697 - DNA, 22 bp, Artificial Sequence
  chemically synthesized
gacatttgggttggttccaagt

SEQ ID NO: 117698 - DNA, 22 bp, Artificial Sequence
  chemically synthesized
gggttggttccaagtctttgct

SEQ ID NO: 117699 - DNA, 22 bp, Artificial Sequence
  chemically synthesized
ggttggttccaagtctttgcta

SEQ ID NO: 117700 - DNA, 22 bp, Artificial Sequence
  chemically synthesized
gttccaagtctttgctattgtg

SEQ ID NO: 117701 - DNA, 22 bp, Artificial Sequence
  chemically synthesized
caagtctttgctattgtgaata

SEQ ID NO: 117702 - DNA, 22 bp, Artificial Sequence
  chemically synthesized
tgctattgtgaatagtgccgca

SEQ ID NO: 117703 - DNA, 22 bp, Artificial Sequence
  chemically synthesized
gctattgtgaatagtgccgcaa

SEQ ID NO: 117704 - DNA, 22 bp, Artificial Sequence
  chemically synthesized
ctattgtgaatagtgccgcaat

SEQ ID NO: 117705 - DNA, 22 bp, Artificial Sequence
  chemically synthesized
ttgtgaatagtgccgcaataaa

SEQ ID NO: 117706 - DNA, 22 bp, Artificial Sequence
  chemically synthesized
tgaatagtgccgcaataaacat

SEQ ID NO: 117707 - DNA, 22 bp, Artificial Sequence
  chemically synthesized
tatagcagcatgatttataatc

SEQ ID NO: 117708 - DNA, 22 bp, Artificial Sequence
  chemically synthesized
atagcagcatgatttataatcc

SEQ ID NO: 117709 - DNA, 22 bp, Artificial Sequence
  chemically synthesized
tagcagcatgatttataatcct

SEQ ID NO: 117710 - DNA, 22 bp, Artificial Sequence
  chemically synthesized
ataatcctttgggtgtataccc

SEQ ID NO: 117711 - DNA, 22 bp, Artificial Sequence
  chemically synthesized
taatcctttgggtgtataccca

SEQ ID NO: 117712 - DNA, 22 bp, Artificial Sequence
  chemically synthesized
tgggtgtatacccagtaatggg

SEQ ID NO: 117713 - DNA, 22 bp, Artificial Sequence
  chemically synthesized
gggtgtatacccagtaatggga

SEQ ID NO: 117714 - DNA, 22 bp, Artificial Sequence
  chemically synthesized
ggtgtatacccagtaatgggat

SEQ ID NO: 117715 - DNA, 22 bp, Artificial Sequence
  chemically synthesized
ggtcaaatggtatttctagttc

SEQ ID NO: 117716 - DNA, 22 bp, Artificial Sequence
  chemically synthesized
ctagttctagatccctgaggaa

SEQ ID NO: 117717 - DNA, 22 bp, Artificial Sequence
  chemically synthesized
tagttctagatccctgaggaat

SEQ ID NO: 117718 - DNA, 22 bp, Artificial Sequence
  chemically synthesized
gttctagatccctgaggaatca

SEQ ID NO: 117719 - DNA, 22 bp, Artificial Sequence
  chemically synthesized
tagatccctgaggaatcaccac

SEQ ID NO: 117720 - DNA, 22 bp, Artificial Sequence
  chemically synthesized
gatccctgaggaatcaccacac

SEQ ID NO: 117721 - DNA, 22 bp, Artificial Sequence
  chemically synthesized
aggaatcaccacactgacttcc

SEQ ID NO: 117722 - DNA, 22 bp, Artificial Sequence
  chemically synthesized
acttccacaatgtttgaactag

SEQ ID NO: 117723 - DNA, 22 bp, Artificial Sequence
  chemically synthesized
ccacaatgtttgaactagttta

SEQ ID NO: 117724 - DNA, 22 bp, Artificial Sequence
  chemically synthesized
cacaatgtttgaactagtttac

SEQ ID NO: 117725 - DNA, 22 bp, Artificial Sequence
  chemically synthesized
gaactagtttacagtcccacca

SEQ ID NO: 117726 - DNA, 22 bp, Artificial Sequence
  chemically synthesized
aactagtttacagtcccaccaa

SEQ ID NO: 117727 - DNA, 22 bp, Artificial Sequence
  chemically synthesized
gtttacagtcccaccaacagtg

SEQ ID NO: 117728 - DNA, 22 bp, Artificial Sequence
  chemically synthesized
acagtcccaccaacagtgtaaa

SEQ ID NO: 117729 - DNA, 22 bp, Artificial Sequence
  chemically synthesized
cagtcccaccaacagtgtaaaa

SEQ ID NO: 117730 - DNA, 22 bp, Artificial Sequence
  chemically synthesized
ctatttctccacatcctctcca

SEQ ID NO: 117731 - DNA, 22 bp, Artificial Sequence
  chemically synthesized
tttctccacatcctctccagca

SEQ ID NO: 117732 - DNA, 22 bp, Artificial Sequence
  chemically synthesized
ctccacatcctctccagcacct

SEQ ID NO: 117733 - DNA, 22 bp, Artificial Sequence
  chemically synthesized
tccacatcctctccagcacctg

SEQ ID NO: 117734 - DNA, 22 bp, Artificial Sequence
  chemically synthesized
cacatcctctccagcacctgtt

SEQ ID NO: 117735 - DNA, 22 bp, Artificial Sequence
  chemically synthesized
tccagcacctgttgtttcctga

SEQ ID NO: 117736 - DNA, 22 bp, Artificial Sequence
  chemically synthesized
cagcacctgttgtttcctgact

SEQ ID NO: 117737 - DNA, 22 bp, Artificial Sequence
  chemically synthesized
ttgtttcctgactttttaatga

SEQ ID NO: 117738 - DNA, 22 bp, Artificial Sequence
  chemically synthesized
tttcctgactttttaatgattg

SEQ ID NO: 117739 - DNA, 22 bp, Artificial Sequence
  chemically synthesized
cctgactttttaatgattgcca

SEQ ID NO: 117740 - DNA, 22 bp, Artificial Sequence
  chemically synthesized
ctgactttttaatgattgccat

SEQ ID NO: 117741 - DNA, 22 bp, Artificial Sequence
  chemically synthesized
actttttaatgattgccattct

SEQ ID NO: 117742 - DNA, 22 bp, Artificial Sequence
  chemically synthesized
tttaatgattgccattctaact

SEQ ID NO: 117743 - DNA, 22 bp, Artificial Sequence
  chemically synthesized
ttaatgattgccattctaactg

SEQ ID NO: 117744 - DNA, 22 bp, Artificial Sequence
  chemically synthesized
taatgattgccattctaactgg

SEQ ID NO: 117745 - DNA, 22 bp, Artificial Sequence
  chemically synthesized
aatgattgccattctaactggt

SEQ ID NO: 117746 - DNA, 22 bp, Artificial Sequence
  chemically synthesized
atgattgccattctaactggtg

SEQ ID NO: 117747 - DNA, 22 bp, Artificial Sequence
  chemically synthesized
ccattctaactggtgtgagatg

SEQ ID NO: 117748 - DNA, 22 bp, Artificial Sequence
  chemically synthesized
taactggtgtgagatggtatct

SEQ ID NO: 117749 - DNA, 22 bp, Artificial Sequence
  chemically synthesized
actggtgtgagatggtatctca

SEQ ID NO: 117750 - DNA, 22 bp, Artificial Sequence
  chemically synthesized
gtgtgagatggtatctcattgt

SEQ ID NO: 117751 - DNA, 22 bp, Artificial Sequence
  chemically synthesized
attgtggttttgatttgcattt

SEQ ID NO: 117752 - DNA, 22 bp, Artificial Sequence
  chemically synthesized
tggttttgatttgcatttctct

SEQ ID NO: 117753 - DNA, 22 bp, Artificial Sequence
  chemically synthesized
tgatttgcatttctctgatggc

SEQ ID NO: 117754 - DNA, 22 bp, Artificial Sequence
  chemically synthesized
gatttgcatttctctgatggcc

SEQ ID NO: 117755 - DNA, 22 bp, Artificial Sequence
  chemically synthesized
atttgcatttctctgatggcca

SEQ ID NO: 117756 - DNA, 22 bp, Artificial Sequence
  chemically synthesized
gcatttctctgatggccagtga

SEQ ID NO: 117757 - DNA, 22 bp, Artificial Sequence
  chemically synthesized
catttctctgatggccagtgat

SEQ ID NO: 117758 - DNA, 22 bp, Artificial Sequence
  chemically synthesized
ctctgatggccagtgatgatga

SEQ ID NO: 117759 - DNA, 22 bp, Artificial Sequence
  chemically synthesized
tctgatggccagtgatgatgag

SEQ ID NO: 117760 - DNA, 22 bp, Artificial Sequence
  chemically synthesized
tgatggccagtgatgatgagca

SEQ ID NO: 117761 - DNA, 22 bp, Artificial Sequence
  chemically synthesized
atggccagtgatgatgagcatt

SEQ ID NO: 117762 - DNA, 22 bp, Artificial Sequence
  chemically synthesized
tttcatgtgtcttttggctgca

SEQ ID NO: 117763 - DNA, 22 bp, Artificial Sequence
  chemically synthesized
ttcatgtgtcttttggctgcat

SEQ ID NO: 117764 - DNA, 22 bp, Artificial Sequence
  chemically synthesized
tcatgtgtcttttggctgcata

SEQ ID NO: 117765 - DNA, 22 bp, Artificial Sequence
  chemically synthesized
catgtgtcttttggctgcataa

SEQ ID NO: 117766 - DNA, 22 bp, Artificial Sequence
  chemically synthesized
atgtgtcttttggctgcataaa

SEQ ID NO: 117767 - DNA, 22 bp, Artificial Sequence
  chemically synthesized
ttggctgcataaatgtcttctt

SEQ ID NO: 117768 - DNA, 22 bp, Artificial Sequence
  chemically synthesized
tggctgcataaatgtcttcttt

SEQ ID NO: 117769 - DNA, 22 bp, Artificial Sequence
  chemically synthesized
ggctgcataaatgtcttctttt

SEQ ID NO: 117770 - DNA, 22 bp, Artificial Sequence
  chemically synthesized
gctgcataaatgtcttcttttg

SEQ ID NO: 117771 - DNA, 22 bp, Artificial Sequence
  chemically synthesized
cataaatgtcttcttttgagaa

SEQ ID NO: 117772 - DNA, 22 bp, Artificial Sequence
  chemically synthesized
cttttgagaagtgtctgttcat

SEQ ID NO: 117773 - DNA, 22 bp, Artificial Sequence
  chemically synthesized
ttttgagaagtgtctgttcata

SEQ ID NO: 117774 - DNA, 22 bp, Artificial Sequence
  chemically synthesized
ttgagaagtgtctgttcatatc

SEQ ID NO: 117775 - DNA, 22 bp, Artificial Sequence
  chemically synthesized
tgagaagtgtctgttcatatcc

SEQ ID NO: 117776 - DNA, 22 bp, Artificial Sequence
  chemically synthesized
gagaagtgtctgttcatatcct

SEQ ID NO: 117777 - DNA, 22 bp, Artificial Sequence
  chemically synthesized
agaagtgtctgttcatatcctt

SEQ ID NO: 117778 - DNA, 22 bp, Artificial Sequence
  chemically synthesized
ttcatatcctttgcccactttt

SEQ ID NO: 117779 - DNA, 22 bp, Artificial Sequence
  chemically synthesized
atatcctttgcccactttttga

SEQ ID NO: 117780 - DNA, 22 bp, Artificial Sequence
  chemically synthesized
tgcccactttttgatggggttt

SEQ ID NO: 117781 - DNA, 22 bp, Artificial Sequence
  chemically synthesized
gcccactttttgatggggtttt

SEQ ID NO: 117782 - DNA, 22 bp, Artificial Sequence
  chemically synthesized
cccactttttgatggggttttt

SEQ ID NO: 117783 - DNA, 22 bp, Artificial Sequence
  chemically synthesized
tttgatggggttttttttctct

SEQ ID NO: 117784 - DNA, 22 bp, Artificial Sequence
  chemically synthesized
ttgatggggttttttttctctt

SEQ ID NO: 117785 - DNA, 22 bp, Artificial Sequence
  chemically synthesized
tgatggggttttttttctcttg

SEQ ID NO: 117786 - DNA, 22 bp, Artificial Sequence
  chemically synthesized
gatggggttttttttctcttgt

SEQ ID NO: 117787 - DNA, 22 bp, Artificial Sequence
  chemically synthesized
atggggttttttttctcttgta

SEQ ID NO: 117788 - DNA, 22 bp, Artificial Sequence
  chemically synthesized
tttttctcttgtaaatttgttt

SEQ ID NO: 117789 - DNA, 22 bp, Artificial Sequence
  chemically synthesized
ttttctcttgtaaatttgtttg

SEQ ID NO: 117790 - DNA, 22 bp, Artificial Sequence
  chemically synthesized
tttctcttgtaaatttgtttga

SEQ ID NO: 117791 - DNA, 22 bp, Artificial Sequence
  chemically synthesized
ttctcttgtaaatttgtttgag

SEQ ID NO: 117792 - DNA, 22 bp, Artificial Sequence
  chemically synthesized
tctcttgtaaatttgtttgagt

SEQ ID NO: 117793 - DNA, 22 bp, Artificial Sequence
  chemically synthesized
ctcttgtaaatttgtttgagtt

SEQ ID NO: 117794 - DNA, 22 bp, Artificial Sequence
  chemically synthesized
tcttgtaaatttgtttgagttc

SEQ ID NO: 117795 - DNA, 22 bp, Artificial Sequence
  chemically synthesized
ttgtaaatttgtttgagttcat

SEQ ID NO: 117796 - DNA, 22 bp, Artificial Sequence
  chemically synthesized
gtaaatttgtttgagttcattg

SEQ ID NO: 117797 - DNA, 22 bp, Artificial Sequence
  chemically synthesized
taaatttgtttgagttcattgt

SEQ ID NO: 117798 - DNA, 22 bp, Artificial Sequence
  chemically synthesized
gtttgagttcattgtagattct

SEQ ID NO: 117799 - DNA, 22 bp, Artificial Sequence
  chemically synthesized
tttgagttcattgtagattctg

SEQ ID NO: 117800 - DNA, 22 bp, Artificial Sequence
  chemically synthesized
gagttcattgtagattctggat

SEQ ID NO: 117801 - DNA, 22 bp, Artificial Sequence
  chemically synthesized
agttcattgtagattctggata

SEQ ID NO: 117802 - DNA, 22 bp, Artificial Sequence
  chemically synthesized
attgtagattctggatattagc

SEQ ID NO: 117803 - DNA, 22 bp, Artificial Sequence
  chemically synthesized
tagattctggatattagccctt

SEQ ID NO: 117804 - DNA, 22 bp, Artificial Sequence
  chemically synthesized
tggatattagccctttgtcaga

SEQ ID NO: 117805 - DNA, 22 bp, Artificial Sequence
  chemically synthesized
gatattagccctttgtcagatg

SEQ ID NO: 117806 - DNA, 22 bp, Artificial Sequence
  chemically synthesized
gccctttgtcagatgagtagat

SEQ ID NO: 117807 - DNA, 22 bp, Artificial Sequence
  chemically synthesized
tgtcagatgagtagattgcaaa

SEQ ID NO: 117808 - DNA, 22 bp, Artificial Sequence
  chemically synthesized
gtcagatgagtagattgcaaaa

SEQ ID NO: 117809 - DNA, 22 bp, Artificial Sequence
  chemically synthesized
tcagatgagtagattgcaaaaa

SEQ ID NO: 117810 - DNA, 22 bp, Artificial Sequence
  chemically synthesized
caaaaattttctcccattgtgt

SEQ ID NO: 117811 - DNA, 22 bp, Artificial Sequence
  chemically synthesized
tctcccattgtgtaggttgcct

SEQ ID NO: 117812 - DNA, 22 bp, Artificial Sequence
  chemically synthesized
ctcccattgtgtaggttgcctg

SEQ ID NO: 117813 - DNA, 22 bp, Artificial Sequence
  chemically synthesized
tcccattgtgtaggttgcctgt

SEQ ID NO: 117814 - DNA, 22 bp, Artificial Sequence
  chemically synthesized
ccattgtgtaggttgcctgttc

SEQ ID NO: 117815 - DNA, 22 bp, Artificial Sequence
  chemically synthesized
tgtaggttgcctgttcactctg

SEQ ID NO: 117816 - DNA, 22 bp, Artificial Sequence
  chemically synthesized
cctgttcactctgatggtagtt

SEQ ID NO: 117817 - DNA, 22 bp, Artificial Sequence
  chemically synthesized
ttcactctgatggtagtttctt

SEQ ID NO: 117818 - DNA, 22 bp, Artificial Sequence
  chemically synthesized
actctgatggtagtttcttttg

SEQ ID NO: 117819 - DNA, 22 bp, Artificial Sequence
  chemically synthesized
tgatggtagtttcttttgctgt

SEQ ID NO: 117820 - DNA, 22 bp, Artificial Sequence
  chemically synthesized
atggtagtttcttttgctgtgc

SEQ ID NO: 117821 - DNA, 22 bp, Artificial Sequence
  chemically synthesized
cttttgctgtgcagaagatctt

SEQ ID NO: 117822 - DNA, 22 bp, Artificial Sequence
  chemically synthesized
ttttgctgtgcagaagatcttt

SEQ ID NO: 117823 - DNA, 22 bp, Artificial Sequence
  chemically synthesized
ttgctgtgcagaagatctttag

SEQ ID NO: 117824 - DNA, 22 bp, Artificial Sequence
  chemically synthesized
tgctgtgcagaagatctttagt

SEQ ID NO: 117825 - DNA, 22 bp, Artificial Sequence
  chemically synthesized
gctgtgcagaagatctttagtt

SEQ ID NO: 117826 - DNA, 22 bp, Artificial Sequence
  chemically synthesized
ctgtgcagaagatctttagttt

SEQ ID NO: 117827 - DNA, 22 bp, Artificial Sequence
  chemically synthesized
tgcagaagatctttagtttaat

SEQ ID NO: 117828 - DNA, 22 bp, Artificial Sequence
  chemically synthesized
tagtttaattagatcccattag

SEQ ID NO: 117829 - DNA, 22 bp, Artificial Sequence
  chemically synthesized
agtttaattagatcccattagt

SEQ ID NO: 117830 - DNA, 22 bp, Artificial Sequence
  chemically synthesized
gtttaattagatcccattagtg

SEQ ID NO: 117831 - DNA, 22 bp, Artificial Sequence
  chemically synthesized
aattagatcccattagtgaatt

SEQ ID NO: 117832 - DNA, 22 bp, Artificial Sequence
  chemically synthesized
attagatcccattagtgaattt

SEQ ID NO: 117833 - DNA, 22 bp, Artificial Sequence
  chemically synthesized
gatcccattagtgaattttggc

SEQ ID NO: 117834 - DNA, 22 bp, Artificial Sequence
  chemically synthesized
gtgaattttggcttttgttgcc

SEQ ID NO: 117835 - DNA, 22 bp, Artificial Sequence
  chemically synthesized
tggcttttgttgccattgcttt

SEQ ID NO: 117836 - DNA, 22 bp, Artificial Sequence
  chemically synthesized
ggcttttgttgccattgctttt

SEQ ID NO: 117837 - DNA, 22 bp, Artificial Sequence
  chemically synthesized
gcttttgttgccattgcttttg

SEQ ID NO: 117838 - DNA, 22 bp, Artificial Sequence
  chemically synthesized
ttgttgccattgcttttggtgt

SEQ ID NO: 117839 - DNA, 22 bp, Artificial Sequence
  chemically synthesized
tgttgccattgcttttggtgtt

SEQ ID NO: 117840 - DNA, 22 bp, Artificial Sequence
  chemically synthesized
gttgccattgcttttggtgttt

SEQ ID NO: 117841 - DNA, 22 bp, Artificial Sequence
  chemically synthesized
ttgccattgcttttggtgtttt

SEQ ID NO: 117842 - DNA, 22 bp, Artificial Sequence
  chemically synthesized
ccattgcttttggtgttttaga

SEQ ID NO: 117843 - DNA, 22 bp, Artificial Sequence
  chemically synthesized
cttttggtgttttagacatgaa

SEQ ID NO: 117844 - DNA, 22 bp, Artificial Sequence
  chemically synthesized
ttggtgttttagacatgaagtc

SEQ ID NO: 117845 - DNA, 22 bp, Artificial Sequence
  chemically synthesized
tggtgttttagacatgaagtcc

SEQ ID NO: 117846 - DNA, 22 bp, Artificial Sequence
  chemically synthesized
ggtgttttagacatgaagtcca

SEQ ID NO: 117847 - DNA, 22 bp, Artificial Sequence
  chemically synthesized
gtgttttagacatgaagtccat

SEQ ID NO: 117848 - DNA, 22 bp, Artificial Sequence
  chemically synthesized
tagacatgaagtccatgcccat

SEQ ID NO: 117849 - DNA, 22 bp, Artificial Sequence
  chemically synthesized
agacatgaagtccatgcccatg

SEQ ID NO: 117850 - DNA, 22 bp, Artificial Sequence
  chemically synthesized
gacatgaagtccatgcccatgc

SEQ ID NO: 117851 - DNA, 22 bp, Artificial Sequence
  chemically synthesized
tgtcctgaatggtattgcttag

SEQ ID NO: 117852 - DNA, 22 bp, Artificial Sequence
  chemically synthesized
aatggtattgcttaggttttct

SEQ ID NO: 117853 - DNA, 22 bp, Artificial Sequence
  chemically synthesized
cttaggttttcttctagagttt

SEQ ID NO: 117854 - DNA, 22 bp, Artificial Sequence
  chemically synthesized
aggttttcttctagagttttta

SEQ ID NO: 117855 - DNA, 22 bp, Artificial Sequence
  chemically synthesized
ggttttcttctagagtttttat

SEQ ID NO: 117856 - DNA, 22 bp, Artificial Sequence
  chemically synthesized
tcttctagagtttttatggttt

SEQ ID NO: 117857 - DNA, 22 bp, Artificial Sequence
  chemically synthesized
cttctagagtttttatggtttt

SEQ ID NO: 117858 - DNA, 22 bp, Artificial Sequence
  chemically synthesized
ttctagagtttttatggtttta

SEQ ID NO: 117859 - DNA, 22 bp, Artificial Sequence
  chemically synthesized
ctagagtttttatggttttagg

SEQ ID NO: 117860 - DNA, 22 bp, Artificial Sequence
  chemically synthesized
tagagtttttatggttttaggt

SEQ ID NO: 117861 - DNA, 22 bp, Artificial Sequence
  chemically synthesized
gagtttttatggttttaggtct

SEQ ID NO: 117862 - DNA, 22 bp, Artificial Sequence
  chemically synthesized
ttatggttttaggtctaacatt

SEQ ID NO: 117863 - DNA, 22 bp, Artificial Sequence
  chemically synthesized
tatggttttaggtctaacattt

SEQ ID NO: 117864 - DNA, 22 bp, Artificial Sequence
  chemically synthesized
atggttttaggtctaacattta

SEQ ID NO: 117865 - DNA, 22 bp, Artificial Sequence
  chemically synthesized
tggttttaggtctaacatttaa

SEQ ID NO: 117866 - DNA, 22 bp, Artificial Sequence
  chemically synthesized
taggtctaacatttaagtcttt

SEQ ID NO: 117867 - DNA, 22 bp, Artificial Sequence
  chemically synthesized
aggtctaacatttaagtcttta

SEQ ID NO: 117868 - DNA, 22 bp, Artificial Sequence
  chemically synthesized
ggtctaacatttaagtctttaa

SEQ ID NO: 117869 - DNA, 22 bp, Artificial Sequence
  chemically synthesized
acatttaagtctttaatccatc

SEQ ID NO: 117870 - DNA, 22 bp, Artificial Sequence
  chemically synthesized
aagtctttaatccatcttgagt

SEQ ID NO: 117871 - DNA, 22 bp, Artificial Sequence
  chemically synthesized
agtctttaatccatcttgagtt

SEQ ID NO: 117872 - DNA, 22 bp, Artificial Sequence
  chemically synthesized
taatccatcttgagttaatttt

SEQ ID NO: 117873 - DNA, 22 bp, Artificial Sequence
  chemically synthesized
aatccatcttgagttaattttt

SEQ ID NO: 117874 - DNA, 22 bp, Artificial Sequence
  chemically synthesized
atccatcttgagttaatttttg

SEQ ID NO: 117875 - DNA, 22 bp, Artificial Sequence
  chemically synthesized
gagttaatttttgtataaggtg

SEQ ID NO: 117876 - DNA, 22 bp, Artificial Sequence
  chemically synthesized
agttaatttttgtataaggtgt

SEQ ID NO: 117877 - DNA, 22 bp, Artificial Sequence
  chemically synthesized
atttttgtataaggtgtaagga

SEQ ID NO: 117878 - DNA, 22 bp, Artificial Sequence
  chemically synthesized
ttgtataaggtgtaaggaaggg

SEQ ID NO: 117879 - DNA, 22 bp, Artificial Sequence
  chemically synthesized
tgtataaggtgtaaggaaggga

SEQ ID NO: 117880 - DNA, 22 bp, Artificial Sequence
  chemically synthesized
gtataaggtgtaaggaagggat

SEQ ID NO: 117881 - DNA, 22 bp, Artificial Sequence
  chemically synthesized
tataaggtgtaaggaagggatc

SEQ ID NO: 117882 - DNA, 22 bp, Artificial Sequence
  chemically synthesized
cagcttcctacatttggctagc

SEQ ID NO: 117883 - DNA, 22 bp, Artificial Sequence
  chemically synthesized
agcttcctacatttggctagcc

SEQ ID NO: 117884 - DNA, 22 bp, Artificial Sequence
  chemically synthesized
cctacatttggctagccagttt

SEQ ID NO: 117885 - DNA, 22 bp, Artificial Sequence
  chemically synthesized
ctacatttggctagccagtttt

SEQ ID NO: 117886 - DNA, 22 bp, Artificial Sequence
  chemically synthesized
catttggctagccagttttccc

SEQ ID NO: 117887 - DNA, 22 bp, Artificial Sequence
  chemically synthesized
ggctagccagttttcccagcac

SEQ ID NO: 117888 - DNA, 22 bp, Artificial Sequence
  chemically synthesized
gctagccagttttcccagcacc

SEQ ID NO: 117889 - DNA, 22 bp, Artificial Sequence
  chemically synthesized
gccagttttcccagcaccattt

SEQ ID NO: 117890 - DNA, 22 bp, Artificial Sequence
  chemically synthesized
tcccagcaccatttattaaaca

SEQ ID NO: 117891 - DNA, 22 bp, Artificial Sequence
  chemically synthesized
cccagcaccatttattaaacag

SEQ ID NO: 117892 - DNA, 22 bp, Artificial Sequence
  chemically synthesized
ccagcaccatttattaaacagg

SEQ ID NO: 117893 - DNA, 22 bp, Artificial Sequence
  chemically synthesized
attaaacagggaatcctttccc

SEQ ID NO: 117894 - DNA, 22 bp, Artificial Sequence
  chemically synthesized
ttaaacagggaatcctttcccc

SEQ ID NO: 117895 - DNA, 22 bp, Artificial Sequence
  chemically synthesized
aacagggaatcctttccccatt

SEQ ID NO: 117896 - DNA, 22 bp, Artificial Sequence
  chemically synthesized
tccccatttcttgtttttctca

SEQ ID NO: 117897 - DNA, 22 bp, Artificial Sequence
  chemically synthesized
ccccatttcttgtttttctcag

SEQ ID NO: 117898 - DNA, 22 bp, Artificial Sequence
  chemically synthesized
cccatttcttgtttttctcagg

SEQ ID NO: 117899 - DNA, 22 bp, Artificial Sequence
  chemically synthesized
cttgtttttctcaggtttgtca

SEQ ID NO: 117900 - DNA, 22 bp, Artificial Sequence
  chemically synthesized
ttgtttttctcaggtttgtcaa

SEQ ID NO: 117901 - DNA, 22 bp, Artificial Sequence
  chemically synthesized
gtttttctcaggtttgtcaaag

SEQ ID NO: 117902 - DNA, 22 bp, Artificial Sequence
  chemically synthesized
tttttctcaggtttgtcaaaga

SEQ ID NO: 117903 - DNA, 22 bp, Artificial Sequence
  chemically synthesized
ttctcaggtttgtcaaagatca

SEQ ID NO: 117904 - DNA, 22 bp, Artificial Sequence
  chemically synthesized
tctcaggtttgtcaaagatcag

SEQ ID NO: 117905 - DNA, 22 bp, Artificial Sequence
  chemically synthesized
ctcaggtttgtcaaagatcaga

SEQ ID NO: 117906 - DNA, 22 bp, Artificial Sequence
  chemically synthesized
tcaggtttgtcaaagatcagat

SEQ ID NO: 117907 - DNA, 22 bp, Artificial Sequence
  chemically synthesized
aggtttgtcaaagatcagatag

SEQ ID NO: 117908 - DNA, 22 bp, Artificial Sequence
  chemically synthesized
gtcaaagatcagatagttgtag

SEQ ID NO: 117909 - DNA, 22 bp, Artificial Sequence
  chemically synthesized
tcaaagatcagatagttgtaga

SEQ ID NO: 117910 - DNA, 22 bp, Artificial Sequence
  chemically synthesized
tagatagacagcattatttctg

SEQ ID NO: 117911 - DNA, 22 bp, Artificial Sequence
  chemically synthesized
tttctgagggctctgttttgtt

SEQ ID NO: 117912 - DNA, 22 bp, Artificial Sequence
  chemically synthesized
ctgagggctctgttttgttcca

SEQ ID NO: 117913 - DNA, 22 bp, Artificial Sequence
  chemically synthesized
tgagggctctgttttgttccat

SEQ ID NO: 117914 - DNA, 22 bp, Artificial Sequence
  chemically synthesized
agggctctgttttgttccattg

SEQ ID NO: 117915 - DNA, 22 bp, Artificial Sequence
  chemically synthesized
tgttttgttccattggtctata

SEQ ID NO: 117916 - DNA, 22 bp, Artificial Sequence
  chemically synthesized
ttttgttccattggtctatatc

SEQ ID NO: 117917 - DNA, 22 bp, Artificial Sequence
  chemically synthesized
tgttccattggtctatatctct

SEQ ID NO: 117918 - DNA, 22 bp, Artificial Sequence
  chemically synthesized
gttccattggtctatatctctg

SEQ ID NO: 117919 - DNA, 22 bp, Artificial Sequence
  chemically synthesized
ttccattggtctatatctctgt

SEQ ID NO: 117920 - DNA, 22 bp, Artificial Sequence
  chemically synthesized
cattggtctatatctctgtttt

SEQ ID NO: 117921 - DNA, 22 bp, Artificial Sequence
  chemically synthesized
gtctatatctctgttttggtac

SEQ ID NO: 117922 - DNA, 22 bp, Artificial Sequence
  chemically synthesized
tatctctgttttggtaccagta

SEQ ID NO: 117923 - DNA, 22 bp, Artificial Sequence
  chemically synthesized
tgttttggtaccagtactatgc

SEQ ID NO: 117924 - DNA, 22 bp, Artificial Sequence
  chemically synthesized
ttttggtaccagtactatgctg

SEQ ID NO: 117925 - DNA, 22 bp, Artificial Sequence
  chemically synthesized
tggtaccagtactatgctgttt

SEQ ID NO: 117926 - DNA, 22 bp, Artificial Sequence
  chemically synthesized
ggtaccagtactatgctgtttt

SEQ ID NO: 117927 - DNA, 22 bp, Artificial Sequence
  chemically synthesized
gtaccagtactatgctgttttg

SEQ ID NO: 117928 - DNA, 22 bp, Artificial Sequence
  chemically synthesized
tgctgttttggttactgtagcc

SEQ ID NO: 117929 - DNA, 22 bp, Artificial Sequence
  chemically synthesized
ttttggttactgtagccttgta

SEQ ID NO: 117930 - DNA, 22 bp, Artificial Sequence
  chemically synthesized
tggttactgtagccttgtagta

SEQ ID NO: 117931 - DNA, 22 bp, Artificial Sequence
  chemically synthesized
ggttactgtagccttgtagtat

SEQ ID NO: 117932 - DNA, 22 bp, Artificial Sequence
  chemically synthesized
gttactgtagccttgtagtata

SEQ ID NO: 117933 - DNA, 22 bp, Artificial Sequence
  chemically synthesized
ctgtagccttgtagtatagttt

SEQ ID NO: 117934 - DNA, 22 bp, Artificial Sequence
  chemically synthesized
tagccttgtagtatagtttgaa

SEQ ID NO: 117935 - DNA, 22 bp, Artificial Sequence
  chemically synthesized
gtagtatagtttgaaatcaggt

SEQ ID NO: 117936 - DNA, 22 bp, Artificial Sequence
  chemically synthesized
tagtatagtttgaaatcaggta

SEQ ID NO: 117937 - DNA, 22 bp, Artificial Sequence
  chemically synthesized
gaaatcaggtagtgtgatgcct

SEQ ID NO: 117938 - DNA, 22 bp, Artificial Sequence
  chemically synthesized
aaatcaggtagtgtgatgcctc

SEQ ID NO: 117939 - DNA, 22 bp, Artificial Sequence
  chemically synthesized
cagctttgttcttttggcttag

SEQ ID NO: 117940 - DNA, 22 bp, Artificial Sequence
  chemically synthesized
tgttcttttggcttaggattga

SEQ ID NO: 117941 - DNA, 22 bp, Artificial Sequence
  chemically synthesized
gttcttttggcttaggattgac

SEQ ID NO: 117942 - DNA, 22 bp, Artificial Sequence
  chemically synthesized
ttcttttggcttaggattgact

SEQ ID NO: 117943 - DNA, 22 bp, Artificial Sequence
  chemically synthesized
ttttggcttaggattgacttgg

SEQ ID NO: 117944 - DNA, 22 bp, Artificial Sequence
  chemically synthesized
ttggcttaggattgacttggcg

SEQ ID NO: 117945 - DNA, 22 bp, Artificial Sequence
  chemically synthesized
tggcttaggattgacttggcga

SEQ ID NO: 117946 - DNA, 22 bp, Artificial Sequence
  chemically synthesized
ggcttaggattgacttggcgat

SEQ ID NO: 117947 - DNA, 22 bp, Artificial Sequence
  chemically synthesized
gcttaggattgacttggcgatg

SEQ ID NO: 117948 - DNA, 22 bp, Artificial Sequence
  chemically synthesized
aggattgacttggcgatgcggg

SEQ ID NO: 117949 - DNA, 22 bp, Artificial Sequence
  chemically synthesized
ggattgacttggcgatgcgggc

SEQ ID NO: 117950 - DNA, 22 bp, Artificial Sequence
  chemically synthesized
acttggcgatgcgggctctttt

SEQ ID NO: 117951 - DNA, 22 bp, Artificial Sequence
  chemically synthesized
ggcgatgcgggctcttttttgg

SEQ ID NO: 117952 - DNA, 22 bp, Artificial Sequence
  chemically synthesized
gcgatgcgggctcttttttggt

SEQ ID NO: 117953 - DNA, 22 bp, Artificial Sequence
  chemically synthesized
ttttttggttccatatgaactt

SEQ ID NO: 117954 - DNA, 22 bp, Artificial Sequence
  chemically synthesized
ttttggttccatatgaacttta

SEQ ID NO: 117955 - DNA, 22 bp, Artificial Sequence
  chemically synthesized
tttggttccatatgaactttaa

SEQ ID NO: 117956 - DNA, 22 bp, Artificial Sequence
  chemically synthesized
ttggttccatatgaactttaaa

SEQ ID NO: 117957 - DNA, 22 bp, Artificial Sequence
  chemically synthesized
tggttccatatgaactttaaag

SEQ ID NO: 117958 - DNA, 22 bp, Artificial Sequence
  chemically synthesized
ggttccatatgaactttaaagt

SEQ ID NO: 117959 - DNA, 22 bp, Artificial Sequence
  chemically synthesized
gttccatatgaactttaaagta

SEQ ID NO: 117960 - DNA, 22 bp, Artificial Sequence
  chemically synthesized
catatgaactttaaagtagttt

SEQ ID NO: 117961 - DNA, 22 bp, Artificial Sequence
  chemically synthesized
taaagtagttttttccaattct

SEQ ID NO: 117962 - DNA, 22 bp, Artificial Sequence
  chemically synthesized
aaagtagttttttccaattctg

SEQ ID NO: 117963 - DNA, 22 bp, Artificial Sequence
  chemically synthesized
aagtagttttttccaattctgt

SEQ ID NO: 117964 - DNA, 22 bp, Artificial Sequence
  chemically synthesized
tttccaattctgtgaagaaagt

SEQ ID NO: 117965 - DNA, 22 bp, Artificial Sequence
  chemically synthesized
ttccaattctgtgaagaaagtc

SEQ ID NO: 117966 - DNA, 22 bp, Artificial Sequence
  chemically synthesized
tccaattctgtgaagaaagtca

SEQ ID NO: 117967 - DNA, 22 bp, Artificial Sequence
  chemically synthesized
ccaattctgtgaagaaagtcat

SEQ ID NO: 117968 - DNA, 22 bp, Artificial Sequence
  chemically synthesized
caattctgtgaagaaagtcatt

SEQ ID NO: 117969 - DNA, 22 bp, Artificial Sequence
  chemically synthesized
tgtgaagaaagtcattggtagc

SEQ ID NO: 117970 - DNA, 22 bp, Artificial Sequence
  chemically synthesized
tgaagaaagtcattggtagctt

SEQ ID NO: 117971 - DNA, 22 bp, Artificial Sequence
  chemically synthesized
gtagcttgatggggatggcatt

SEQ ID NO: 117972 - DNA, 22 bp, Artificial Sequence
  chemically synthesized
gatggggatggcattgaatcta

SEQ ID NO: 117973 - DNA, 22 bp, Artificial Sequence
  chemically synthesized
atggggatggcattgaatctat

SEQ ID NO: 117974 - DNA, 22 bp, Artificial Sequence
  chemically synthesized
aatctataaattaccttgggca

SEQ ID NO: 117975 - DNA, 22 bp, Artificial Sequence
  chemically synthesized
taaattaccttgggcagtatgg

SEQ ID NO: 117976 - DNA, 22 bp, Artificial Sequence
  chemically synthesized
ccttgggcagtatggccatttt

SEQ ID NO: 117977 - DNA, 22 bp, Artificial Sequence
  chemically synthesized
gggcagtatggccattttcacg

SEQ ID NO: 117978 - DNA, 22 bp, Artificial Sequence
  chemically synthesized
ggcagtatggccattttcacga

SEQ ID NO: 117979 - DNA, 22 bp, Artificial Sequence
  chemically synthesized
tcacgatattgtttcttcctat

SEQ ID NO: 117980 - DNA, 22 bp, Artificial Sequence
  chemically synthesized
cacgatattgtttcttcctatc

SEQ ID NO: 117981 - DNA, 22 bp, Artificial Sequence
  chemically synthesized
acgatattgtttcttcctatcc

SEQ ID NO: 117982 - DNA, 22 bp, Artificial Sequence
  chemically synthesized
tttcttcctatccatgagcatg

SEQ ID NO: 117983 - DNA, 22 bp, Artificial Sequence
  chemically synthesized
cttcctatccatgagcatggaa

SEQ ID NO: 117984 - DNA, 22 bp, Artificial Sequence
  chemically synthesized
ttcctatccatgagcatggaat

SEQ ID NO: 117985 - DNA, 22 bp, Artificial Sequence
  chemically synthesized
cctatccatgagcatggaatgt

SEQ ID NO: 117986 - DNA, 22 bp, Artificial Sequence
  chemically synthesized
ctatccatgagcatggaatgtt

SEQ ID NO: 117987 - DNA, 22 bp, Artificial Sequence
  chemically synthesized
tccatgagcatggaatgttctt

SEQ ID NO: 117988 - DNA, 22 bp, Artificial Sequence
  chemically synthesized
ttccatttgtttgtatcttatt

SEQ ID NO: 117989 - DNA, 22 bp, Artificial Sequence
  chemically synthesized
ccatttgtttgtatcttatttc

SEQ ID NO: 117990 - DNA, 22 bp, Artificial Sequence
  chemically synthesized
catttgtttgtatcttatttcc

SEQ ID NO: 117991 - DNA, 22 bp, Artificial Sequence
  chemically synthesized
gtttgtatcttatttccttgag

SEQ ID NO: 117992 - DNA, 22 bp, Artificial Sequence
  chemically synthesized
tttgtatcttatttccttgagc

SEQ ID NO: 117993 - DNA, 22 bp, Artificial Sequence
  chemically synthesized
gtatcttatttccttgagcagt

SEQ ID NO: 117994 - DNA, 22 bp, Artificial Sequence
  chemically synthesized
tatcttatttccttgagcagtg

SEQ ID NO: 117995 - DNA, 22 bp, Artificial Sequence
  chemically synthesized
atttccttgagcagtggtttgt

SEQ ID NO: 117996 - DNA, 22 bp, Artificial Sequence
  chemically synthesized
tttccttgagcagtggtttgta

SEQ ID NO: 117997 - DNA, 22 bp, Artificial Sequence
  chemically synthesized
ccttgagcagtggtttgtagtt

SEQ ID NO: 117998 - DNA, 22 bp, Artificial Sequence
  chemically synthesized
cttgagcagtggtttgtagttc

SEQ ID NO: 117999 - DNA, 22 bp, Artificial Sequence
  chemically synthesized
gagcagtggtttgtagttctcc

SEQ ID NO: 118000 - DNA, 22 bp, Artificial Sequence
  chemically synthesized
agcagtggtttgtagttctcct

SEQ ID NO: 118001 - DNA, 22 bp, Artificial Sequence
  chemically synthesized
gtagttctccttgaagaggtcc

SEQ ID NO: 118002 - DNA, 22 bp, Artificial Sequence
  chemically synthesized
tagttctccttgaagaggtcct

SEQ ID NO: 118003 - DNA, 22 bp, Artificial Sequence
  chemically synthesized
tccttgaagaggtccttcacat

SEQ ID NO: 118004 - DNA, 22 bp, Artificial Sequence
  chemically synthesized
cttgaagaggtccttcacatcc

SEQ ID NO: 118005 - DNA, 22 bp, Artificial Sequence
  chemically synthesized
gaagaggtccttcacatccctt

SEQ ID NO: 118006 - DNA, 22 bp, Artificial Sequence
  chemically synthesized
aagaggtccttcacatcccttg

SEQ ID NO: 118007 - DNA, 22 bp, Artificial Sequence
  chemically synthesized
cacatcccttgtaagttggatt

SEQ ID NO: 118008 - DNA, 22 bp, Artificial Sequence
  chemically synthesized
acatcccttgtaagttggattc

SEQ ID NO: 118009 - DNA, 22 bp, Artificial Sequence
  chemically synthesized
gtaagttggattcctaggtatt

SEQ ID NO: 118010 - DNA, 22 bp, Artificial Sequence
  chemically synthesized
taagttggattcctaggtatta

SEQ ID NO: 118011 - DNA, 22 bp, Artificial Sequence
  chemically synthesized
gattcctaggtattatattctc

SEQ ID NO: 118012 - DNA, 22 bp, Artificial Sequence
  chemically synthesized
ctaggtattatattctctctga

SEQ ID NO: 118013 - DNA, 22 bp, Artificial Sequence
  chemically synthesized
ggtattatattctctctgaagc

SEQ ID NO: 118014 - DNA, 22 bp, Artificial Sequence
  chemically synthesized
tattctctctgaagcaattgtg

SEQ ID NO: 118015 - DNA, 22 bp, Artificial Sequence
  chemically synthesized
tctctgaagcaattgtgaatgg

SEQ ID NO: 118016 - DNA, 22 bp, Artificial Sequence
  chemically synthesized
tctgaagcaattgtgaatggga

SEQ ID NO: 118017 - DNA, 22 bp, Artificial Sequence
  chemically synthesized
tgaagcaattgtgaatgggagt

SEQ ID NO: 118018 - DNA, 22 bp, Artificial Sequence
  chemically synthesized
aagcaattgtgaatgggagttc

SEQ ID NO: 118019 - DNA, 22 bp, Artificial Sequence
  chemically synthesized
tgaatgggagttcactcactgt

SEQ ID NO: 118020 - DNA, 22 bp, Artificial Sequence
  chemically synthesized
actcactgtttgtctgttattg

SEQ ID NO: 118021 - DNA, 22 bp, Artificial Sequence
  chemically synthesized
actgtttgtctgttattggtgt

SEQ ID NO: 118022 - DNA, 22 bp, Artificial Sequence
  chemically synthesized
tttgtctgttattggtgtataa

SEQ ID NO: 118023 - DNA, 22 bp, Artificial Sequence
  chemically synthesized
gtctgttattggtgtataagaa

SEQ ID NO: 118024 - DNA, 22 bp, Artificial Sequence
  chemically synthesized
tctgttattggtgtataagaat

SEQ ID NO: 118025 - DNA, 22 bp, Artificial Sequence
  chemically synthesized
ttattggtgtataagaatgctt

SEQ ID NO: 118026 - DNA, 22 bp, Artificial Sequence
  chemically synthesized
ttggtgtataagaatgcttgtg

SEQ ID NO: 118027 - DNA, 22 bp, Artificial Sequence
  chemically synthesized
gtgtataagaatgcttgtgatt

SEQ ID NO: 118028 - DNA, 22 bp, Artificial Sequence
  chemically synthesized
gtgatttttgcacattgatttt

SEQ ID NO: 118029 - DNA, 22 bp, Artificial Sequence
  chemically synthesized
tgatttttgcacattgattttg

SEQ ID NO: 118030 - DNA, 22 bp, Artificial Sequence
  chemically synthesized
ttgcacattgattttgtatcct

SEQ ID NO: 118031 - DNA, 22 bp, Artificial Sequence
  chemically synthesized
tgcacattgattttgtatcctg

SEQ ID NO: 118032 - DNA, 22 bp, Artificial Sequence
  chemically synthesized
gcacattgattttgtatcctga

SEQ ID NO: 118033 - DNA, 22 bp, Artificial Sequence
  chemically synthesized
cacattgattttgtatcctgag

SEQ ID NO: 118034 - DNA, 22 bp, Artificial Sequence
  chemically synthesized
attttgtatcctgagactttgc

SEQ ID NO: 118035 - DNA, 22 bp, Artificial Sequence
  chemically synthesized
tgtatcctgagactttgctgaa

SEQ ID NO: 118036 - DNA, 22 bp, Artificial Sequence
  chemically synthesized
gtatcctgagactttgctgaag

SEQ ID NO: 118037 - DNA, 22 bp, Artificial Sequence
  chemically synthesized
tatcctgagactttgctgaagt

SEQ ID NO: 118038 - DNA, 22 bp, Artificial Sequence
  chemically synthesized
agactttgctgaagttgcttat

SEQ ID NO: 118039 - DNA, 22 bp, Artificial Sequence
  chemically synthesized
tgctgaagttgcttatcagctt

SEQ ID NO: 118040 - DNA, 22 bp, Artificial Sequence
  chemically synthesized
gctgaagttgcttatcagctta

SEQ ID NO: 118041 - DNA, 22 bp, Artificial Sequence
  chemically synthesized
ctgaagttgcttatcagcttaa

SEQ ID NO: 118042 - DNA, 22 bp, Artificial Sequence
  chemically synthesized
aagttgcttatcagcttaaggg

SEQ ID NO: 118043 - DNA, 22 bp, Artificial Sequence
  chemically synthesized
cttatcagcttaaggggatttt

SEQ ID NO: 118044 - DNA, 22 bp, Artificial Sequence
  chemically synthesized
atcagcttaaggggattttggg

SEQ ID NO: 118045 - DNA, 22 bp, Artificial Sequence
  chemically synthesized
tcagcttaaggggattttgggc

SEQ ID NO: 118046 - DNA, 22 bp, Artificial Sequence
  chemically synthesized
aaggggattttgggctgagaca

SEQ ID NO: 118047 - DNA, 22 bp, Artificial Sequence
  chemically synthesized
aggggattttgggctgagacaa

SEQ ID NO: 118048 - DNA, 22 bp, Artificial Sequence
  chemically synthesized
tgggctgagacaatggggtttt

SEQ ID NO: 118049 - DNA, 22 bp, Artificial Sequence
  chemically synthesized
gggctgagacaatggggttttc

SEQ ID NO: 118050 - DNA, 22 bp, Artificial Sequence
  chemically synthesized
ggctgagacaatggggttttct

SEQ ID NO: 118051 - DNA, 22 bp, Artificial Sequence
  chemically synthesized
agacaatggggttttctagata

SEQ ID NO: 118052 - DNA, 22 bp, Artificial Sequence
  chemically synthesized
tctagatatgcaatcacgtcat

SEQ ID NO: 118053 - DNA, 22 bp, Artificial Sequence
  chemically synthesized
ctagatatgcaatcacgtcatc

SEQ ID NO: 118054 - DNA, 22 bp, Artificial Sequence
  chemically synthesized
tagatatgcaatcacgtcatct

SEQ ID NO: 118055 - DNA, 22 bp, Artificial Sequence
  chemically synthesized
gatatgcaatcacgtcatctgc

SEQ ID NO: 118056 - DNA, 22 bp, Artificial Sequence
  chemically synthesized
caaacagggacaatttgacttt

SEQ ID NO: 118057 - DNA, 22 bp, Artificial Sequence
  chemically synthesized
gactttctctttacataattga

SEQ ID NO: 118058 - DNA, 22 bp, Artificial Sequence
  chemically synthesized
actttctctttacataattgaa

SEQ ID NO: 118059 - DNA, 22 bp, Artificial Sequence
  chemically synthesized
tctctttacataattgaatgcc

SEQ ID NO: 118060 - DNA, 22 bp, Artificial Sequence
  chemically synthesized
ctctttacataattgaatgcct

SEQ ID NO: 118061 - DNA, 22 bp, Artificial Sequence
  chemically synthesized
tctttacataattgaatgcctt

SEQ ID NO: 118062 - DNA, 22 bp, Artificial Sequence
  chemically synthesized
tttacataattgaatgcctttt

SEQ ID NO: 118063 - DNA, 22 bp, Artificial Sequence
  chemically synthesized
tacataattgaatgccttttat

SEQ ID NO: 118064 - DNA, 22 bp, Artificial Sequence
  chemically synthesized
acataattgaatgccttttatt

SEQ ID NO: 118065 - DNA, 22 bp, Artificial Sequence
  chemically synthesized
cataattgaatgccttttattt

SEQ ID NO: 118066 - DNA, 22 bp, Artificial Sequence
  chemically synthesized
aatgccttttatttccttctcc

SEQ ID NO: 118067 - DNA, 22 bp, Artificial Sequence
  chemically synthesized
ttatttccttctcctgcccgat

SEQ ID NO: 118068 - DNA, 22 bp, Artificial Sequence
  chemically synthesized
tatttccttctcctgcccgatt

SEQ ID NO: 118069 - DNA, 22 bp, Artificial Sequence
  chemically synthesized
atttccttctcctgcccgattg

SEQ ID NO: 118070 - DNA, 22 bp, Artificial Sequence
  chemically synthesized
tttccttctcctgcccgattgc

SEQ ID NO: 118071 - DNA, 22 bp, Artificial Sequence
  chemically synthesized
ccttctcctgcccgattgcccg

SEQ ID NO: 118072 - DNA, 22 bp, Artificial Sequence
  chemically synthesized
cttctcctgcccgattgcccgg

SEQ ID NO: 118073 - DNA, 22 bp, Artificial Sequence
  chemically synthesized
ctcctgcccgattgcccgggcc

SEQ ID NO: 118074 - DNA, 22 bp, Artificial Sequence
  chemically synthesized
tcctgcccgattgcccgggcca

SEQ ID NO: 118075 - DNA, 22 bp, Artificial Sequence
  chemically synthesized
ctgcccgattgcccgggccaga

SEQ ID NO: 118076 - DNA, 22 bp, Artificial Sequence
  chemically synthesized
cccgattgcccgggccagaact

SEQ ID NO: 118077 - DNA, 22 bp, Artificial Sequence
  chemically synthesized
cccgggccagaacttccaacac

SEQ ID NO: 118078 - DNA, 22 bp, Artificial Sequence
  chemically synthesized
ccaacactatgttgaataggag

SEQ ID NO: 118079 - DNA, 22 bp, Artificial Sequence
  chemically synthesized
caacactatgttgaataggagt

SEQ ID NO: 118080 - DNA, 22 bp, Artificial Sequence
  chemically synthesized
tgttgaataggagtggtgagag

SEQ ID NO: 118081 - DNA, 22 bp, Artificial Sequence
  chemically synthesized
aataggagtggtgagagagggc

SEQ ID NO: 118082 - DNA, 22 bp, Artificial Sequence
  chemically synthesized
tcttgcagcctaggcacatttt

SEQ ID NO: 118083 - DNA, 22 bp, Artificial Sequence
  chemically synthesized
gcagcctaggcacattttcatt

SEQ ID NO: 118084 - DNA, 22 bp, Artificial Sequence
  chemically synthesized
cagcctaggcacattttcatta

SEQ ID NO: 118085 - DNA, 22 bp, Artificial Sequence
  chemically synthesized
ggcacattttcattaggcagtg

SEQ ID NO: 118086 - DNA, 22 bp, Artificial Sequence
  chemically synthesized
tcattaggcagtgcagtgtggt

SEQ ID NO: 118087 - DNA, 22 bp, Artificial Sequence
  chemically synthesized
cattaggcagtgcagtgtggtt

SEQ ID NO: 118088 - DNA, 22 bp, Artificial Sequence
  chemically synthesized
attaggcagtgcagtgtggtta

SEQ ID NO: 118089 - DNA, 22 bp, Artificial Sequence
  chemically synthesized
ggcagtgcagtgtggttaagag

SEQ ID NO: 118090 - DNA, 22 bp, Artificial Sequence
  chemically synthesized
agagcagtgtctctgggaccag

SEQ ID NO: 118091 - DNA, 22 bp, Artificial Sequence
  chemically synthesized
tgggaccagatctgtattacaa

SEQ ID NO: 118092 - DNA, 22 bp, Artificial Sequence
  chemically synthesized
ggaccagatctgtattacaatc

SEQ ID NO: 118093 - DNA, 22 bp, Artificial Sequence
  chemically synthesized
tattacaatcataacttcaata

SEQ ID NO: 118094 - DNA, 22 bp, Artificial Sequence
  chemically synthesized
caatcataacttcaatagctct

SEQ ID NO: 118095 - DNA, 22 bp, Artificial Sequence
  chemically synthesized
caatagctcttcactctatgat

SEQ ID NO: 118096 - DNA, 22 bp, Artificial Sequence
  chemically synthesized
aatagctcttcactctatgatt

SEQ ID NO: 118097 - DNA, 22 bp, Artificial Sequence
  chemically synthesized
ttcactctatgattgtgcaaag

SEQ ID NO: 118098 - DNA, 22 bp, Artificial Sequence
  chemically synthesized
cactctatgattgtgcaaagta

SEQ ID NO: 118099 - DNA, 22 bp, Artificial Sequence
  chemically synthesized
actctatgattgtgcaaagtat

SEQ ID NO: 118100 - DNA, 22 bp, Artificial Sequence
  chemically synthesized
tatgattgtgcaaagtatctga

SEQ ID NO: 118101 - DNA, 22 bp, Artificial Sequence
  chemically synthesized
tgattgtgcaaagtatctgatt

SEQ ID NO: 118102 - DNA, 22 bp, Artificial Sequence
  chemically synthesized
tgcaaagtatctgattaatctt

SEQ ID NO: 118103 - DNA, 22 bp, Artificial Sequence
  chemically synthesized
attaatcttagtttcttcatct

SEQ ID NO: 118104 - DNA, 22 bp, Artificial Sequence
  chemically synthesized
atcttagtttcttcatctgaaa

SEQ ID NO: 118105 - DNA, 22 bp, Artificial Sequence
  chemically synthesized
agtttcttcatctgaaaaattg

SEQ ID NO: 118106 - DNA, 22 bp, Artificial Sequence
  chemically synthesized
gtttcttcatctgaaaaattga

SEQ ID NO: 118107 - DNA, 22 bp, Artificial Sequence
  chemically synthesized
cttcatctgaaaaattgagaca

SEQ ID NO: 118108 - DNA, 22 bp, Artificial Sequence
  chemically synthesized
ttcatctgaaaaattgagacaa

SEQ ID NO: 118109 - DNA, 22 bp, Artificial Sequence
  chemically synthesized
catctgaaaaattgagacaatt

SEQ ID NO: 118110 - DNA, 22 bp, Artificial Sequence
  chemically synthesized
atctgaaaaattgagacaattc

SEQ ID NO: 118111 - DNA, 22 bp, Artificial Sequence
  chemically synthesized
aaaaattgagacaattctacct

SEQ ID NO: 118112 - DNA, 22 bp, Artificial Sequence
  chemically synthesized
agacaattctacctactccata

SEQ ID NO: 118113 - DNA, 22 bp, Artificial Sequence
  chemically synthesized
tacctactccatagattagaga

SEQ ID NO: 118114 - DNA, 22 bp, Artificial Sequence
  chemically synthesized
cctactccatagattagagagc

SEQ ID NO: 118115 - DNA, 22 bp, Artificial Sequence
  chemically synthesized
ctccatagattagagagccatt

SEQ ID NO: 118116 - DNA, 22 bp, Artificial Sequence
  chemically synthesized
catagattagagagccattcat

SEQ ID NO: 118117 - DNA, 22 bp, Artificial Sequence
  chemically synthesized
gagagccattcatatgcaattt

SEQ ID NO: 118118 - DNA, 22 bp, Artificial Sequence
  chemically synthesized
atatgcaattttaaatggagta

SEQ ID NO: 118119 - DNA, 22 bp, Artificial Sequence
  chemically synthesized
taaatggagtacagttagaagc

SEQ ID NO: 118120 - DNA, 22 bp, Artificial Sequence
  chemically synthesized
aaatggagtacagttagaagca

SEQ ID NO: 118121 - DNA, 22 bp, Artificial Sequence
  chemically synthesized
aatggagtacagttagaagcaa

SEQ ID NO: 118122 - DNA, 22 bp, Artificial Sequence
  chemically synthesized
gaagcaaatactcaatagacac

SEQ ID NO: 118123 - DNA, 22 bp, Artificial Sequence
  chemically synthesized
aatagacacattttattagttg

SEQ ID NO: 118124 - DNA, 22 bp, Artificial Sequence
  chemically synthesized
tattagttgtactttccagcat

SEQ ID NO: 118125 - DNA, 22 bp, Artificial Sequence
  chemically synthesized
attagttgtactttccagcatt

SEQ ID NO: 118126 - DNA, 22 bp, Artificial Sequence
  chemically synthesized
ttagttgtactttccagcattc

SEQ ID NO: 118127 - DNA, 22 bp, Artificial Sequence
  chemically synthesized
gttgtactttccagcattccag

SEQ ID NO: 118128 - DNA, 22 bp, Artificial Sequence
  chemically synthesized
tactttccagcattccagtgag

SEQ ID NO: 118129 - DNA, 22 bp, Artificial Sequence
  chemically synthesized
tccagcattccagtgagcaatg

SEQ ID NO: 118130 - DNA, 22 bp, Artificial Sequence
  chemically synthesized
ccagcattccagtgagcaatgt

SEQ ID NO: 118131 - DNA, 22 bp, Artificial Sequence
  chemically synthesized
cagcattccagtgagcaatgtt

SEQ ID NO: 118132 - DNA, 22 bp, Artificial Sequence
  chemically synthesized
cagtgagcaatgttgcagtgag

SEQ ID NO: 118133 - DNA, 22 bp, Artificial Sequence
  chemically synthesized
cagtgagctctaagaaaagatt

SEQ ID NO: 118134 - DNA, 22 bp, Artificial Sequence
  chemically synthesized
taagaaaagattgaaaaataat

SEQ ID NO: 118135 - DNA, 22 bp, Artificial Sequence
  chemically synthesized
agaaaagattgaaaaataatct

SEQ ID NO: 118136 - DNA, 22 bp, Artificial Sequence
  chemically synthesized
aaaaataatctgacaacaatga

SEQ ID NO: 118137 - DNA, 22 bp, Artificial Sequence
  chemically synthesized
acaacaatgaagcgtaaggtat

SEQ ID NO: 118138 - DNA, 22 bp, Artificial Sequence
  chemically synthesized
ggagtgggaagccatgagctct

SEQ ID NO: 118139 - DNA, 22 bp, Artificial Sequence
  chemically synthesized
gagtgggaagccatgagctctt

SEQ ID NO: 118140 - DNA, 22 bp, Artificial Sequence
  chemically synthesized
ttgcacaggtttttggacaatc

SEQ ID NO: 118141 - DNA, 22 bp, Artificial Sequence
  chemically synthesized
gcacaggtttttggacaatcct

SEQ ID NO: 118142 - DNA, 22 bp, Artificial Sequence
  chemically synthesized
cacaggtttttggacaatcctt

SEQ ID NO: 118143 - DNA, 22 bp, Artificial Sequence
  chemically synthesized
ttggacaatccttccatatggc

SEQ ID NO: 118144 - DNA, 22 bp, Artificial Sequence
  chemically synthesized
tggacaatccttccatatggct

SEQ ID NO: 118145 - DNA, 22 bp, Artificial Sequence
  chemically synthesized
ggacaatccttccatatggctt

SEQ ID NO: 118146 - DNA, 22 bp, Artificial Sequence
  chemically synthesized
gacaatccttccatatggcttt

SEQ ID NO: 118147 - DNA, 22 bp, Artificial Sequence
  chemically synthesized
ccatatggctttggcaaagtta

SEQ ID NO: 118148 - DNA, 22 bp, Artificial Sequence
  chemically synthesized
catatggctttggcaaagttac

SEQ ID NO: 118149 - DNA, 22 bp, Artificial Sequence
  chemically synthesized
tggcaaagttactgaatctttc

SEQ ID NO: 118150 - DNA, 22 bp, Artificial Sequence
  chemically synthesized
ggcaaagttactgaatctttct

SEQ ID NO: 118151 - DNA, 22 bp, Artificial Sequence
  chemically synthesized
gcaaagttactgaatctttcta

SEQ ID NO: 118152 - DNA, 22 bp, Artificial Sequence
  chemically synthesized
ctgaatctttctaaaccttagc

SEQ ID NO: 118153 - DNA, 22 bp, Artificial Sequence
  chemically synthesized
aatctttctaaaccttagcttt

SEQ ID NO: 118154 - DNA, 22 bp, Artificial Sequence
  chemically synthesized
tctaaaccttagcttttttact

SEQ ID NO: 118155 - DNA, 22 bp, Artificial Sequence
  chemically synthesized
ctaaaccttagcttttttacta

SEQ ID NO: 118156 - DNA, 22 bp, Artificial Sequence
  chemically synthesized
taaaccttagcttttttactat

SEQ ID NO: 118157 - DNA, 22 bp, Artificial Sequence
  chemically synthesized
aaccttagcttttttactatgt

SEQ ID NO: 118158 - DNA, 22 bp, Artificial Sequence
  chemically synthesized
agcttttttactatgttgaaag

SEQ ID NO: 118159 - DNA, 22 bp, Artificial Sequence
  chemically synthesized
gcttttttactatgttgaaaga

SEQ ID NO: 118160 - DNA, 22 bp, Artificial Sequence
  chemically synthesized
ttttactatgttgaaagatttc

SEQ ID NO: 118161 - DNA, 22 bp, Artificial Sequence
  chemically synthesized
tttactatgttgaaagatttcc

SEQ ID NO: 118162 - DNA, 22 bp, Artificial Sequence
  chemically synthesized
ttactatgttgaaagatttcca

SEQ ID NO: 118163 - DNA, 22 bp, Artificial Sequence
  chemically synthesized
tactatgttgaaagatttccac

SEQ ID NO: 118164 - DNA, 22 bp, Artificial Sequence
  chemically synthesized
actatgttgaaagatttccaca

SEQ ID NO: 118165 - DNA, 22 bp, Artificial Sequence
  chemically synthesized
ctatgttgaaagatttccacat

SEQ ID NO: 118166 - DNA, 22 bp, Artificial Sequence
  chemically synthesized
tgttgaaagatttccacatggg

SEQ ID NO: 118167 - DNA, 22 bp, Artificial Sequence
  chemically synthesized
aaagatttccacatgggccctg

SEQ ID NO: 118168 - DNA, 22 bp, Artificial Sequence
  chemically synthesized
ccacatgggccctgcctctttt

SEQ ID NO: 118169 - DNA, 22 bp, Artificial Sequence
  chemically synthesized
cacatgggccctgcctcttttc

SEQ ID NO: 118170 - DNA, 22 bp, Artificial Sequence
  chemically synthesized
cctcttttcgagagaaatgatt

SEQ ID NO: 118171 - DNA, 22 bp, Artificial Sequence
  chemically synthesized
ttttcgagagaaatgattaggt

SEQ ID NO: 118172 - DNA, 22 bp, Artificial Sequence
  chemically synthesized
ttcgagagaaatgattaggttt

SEQ ID NO: 118173 - DNA, 22 bp, Artificial Sequence
  chemically synthesized
tcgagagaaatgattaggttta

SEQ ID NO: 118174 - DNA, 22 bp, Artificial Sequence
  chemically synthesized
cgagagaaatgattaggtttaa

SEQ ID NO: 118175 - DNA, 22 bp, Artificial Sequence
  chemically synthesized
gagagaaatgattaggtttaat

SEQ ID NO: 118176 - DNA, 22 bp, Artificial Sequence
  chemically synthesized
ggtttaatggggctgtggagga

SEQ ID NO: 118177 - DNA, 22 bp, Artificial Sequence
  chemically synthesized
aatggggctgtggaggaaagca

SEQ ID NO: 118178 - DNA, 22 bp, Artificial Sequence
  chemically synthesized
atggggctgtggaggaaagcac

SEQ ID NO: 118179 - DNA, 22 bp, Artificial Sequence
  chemically synthesized
tggaggaaagcactctgaaatg

SEQ ID NO: 118180 - DNA, 22 bp, Artificial Sequence
  chemically synthesized
tgaaatgttagaagcttcatca

SEQ ID NO: 118181 - DNA, 22 bp, Artificial Sequence
  chemically synthesized
aaatgttagaagcttcatcaat

SEQ ID NO: 118182 - DNA, 22 bp, Artificial Sequence
  chemically synthesized
gaagcttcatcaattggagcaa

SEQ ID NO: 118183 - DNA, 22 bp, Artificial Sequence
  chemically synthesized
catcaattggagcaattgctga

SEQ ID NO: 118184 - DNA, 22 bp, Artificial Sequence
  chemically synthesized
atcaattggagcaattgctgag

SEQ ID NO: 118185 - DNA, 22 bp, Artificial Sequence
  chemically synthesized
gagcaattgctgagattatgtt

SEQ ID NO: 118186 - DNA, 22 bp, Artificial Sequence
  chemically synthesized
ctgagattatgtttccttgcct

SEQ ID NO: 118187 - DNA, 22 bp, Artificial Sequence
  chemically synthesized
agattatgtttccttgcctgcc

SEQ ID NO: 118188 - DNA, 22 bp, Artificial Sequence
  chemically synthesized
tgtttccttgcctgccacaacc

SEQ ID NO: 118189 - DNA, 22 bp, Artificial Sequence
  chemically synthesized
ccttgcctgccacaaccctgta

SEQ ID NO: 118190 - DNA, 22 bp, Artificial Sequence
  chemically synthesized
cttgcctgccacaaccctgtat

SEQ ID NO: 118191 - DNA, 22 bp, Artificial Sequence
  chemically synthesized
gcctgccacaaccctgtatcat

SEQ ID NO: 118192 - DNA, 22 bp, Artificial Sequence
  chemically synthesized
cctgccacaaccctgtatcatt

SEQ ID NO: 118193 - DNA, 22 bp, Artificial Sequence
  chemically synthesized
ccacaaccctgtatcattctct

SEQ ID NO: 118194 - DNA, 22 bp, Artificial Sequence
  chemically synthesized
tatcattctctacaaggcatag

SEQ ID NO: 118195 - DNA, 22 bp, Artificial Sequence
  chemically synthesized
tctacaaggcatagcccagtaa

SEQ ID NO: 118196 - DNA, 22 bp, Artificial Sequence
  chemically synthesized
tacaaggcatagcccagtaaca

SEQ ID NO: 118197 - DNA, 22 bp, Artificial Sequence
  chemically synthesized
caaggcatagcccagtaacaag

SEQ ID NO: 118198 - DNA, 22 bp, Artificial Sequence
  chemically synthesized
tcttccccatcaaaaacatcac

SEQ ID NO: 118199 - DNA, 22 bp, Artificial Sequence
  chemically synthesized
ccccatcaaaaacatcacggga

SEQ ID NO: 118200 - DNA, 22 bp, Artificial Sequence
  chemically synthesized
cccatcaaaaacatcacgggag

SEQ ID NO: 118201 - DNA, 22 bp, Artificial Sequence
  chemically synthesized
acaacagattggccatcttcct

SEQ ID NO: 118202 - DNA, 22 bp, Artificial Sequence
  chemically synthesized
gccatcttcctggaagctgccc

SEQ ID NO: 118203 - DNA, 22 bp, Artificial Sequence
  chemically synthesized
cctggaagctgccctattccat

SEQ ID NO: 118204 - DNA, 22 bp, Artificial Sequence
  chemically synthesized
ctggaagctgccctattccata

SEQ ID NO: 118205 - DNA, 22 bp, Artificial Sequence
  chemically synthesized
gaagctgccctattccataacc

SEQ ID NO: 118206 - DNA, 22 bp, Artificial Sequence
  chemically synthesized
ccctattccataaccctgcata

SEQ ID NO: 118207 - DNA, 22 bp, Artificial Sequence
  chemically synthesized
ttccataaccctgcatatagtc

SEQ ID NO: 118208 - DNA, 22 bp, Artificial Sequence
  chemically synthesized
cataaccctgcatatagtcatg

SEQ ID NO: 118209 - DNA, 22 bp, Artificial Sequence
  chemically synthesized
catatagtcatgctagataagg

SEQ ID NO: 118210 - DNA, 22 bp, Artificial Sequence
  chemically synthesized
gataagggatattagagaggtc

SEQ ID NO: 118211 - DNA, 22 bp, Artificial Sequence
  chemically synthesized
gagaggtcactccaatgacttc

SEQ ID NO: 118212 - DNA, 22 bp, Artificial Sequence
  chemically synthesized
caatgacttcctttatccacaa

SEQ ID NO: 118213 - DNA, 22 bp, Artificial Sequence
  chemically synthesized
cctttatccacaaaacaaagga

SEQ ID NO: 118214 - DNA, 22 bp, Artificial Sequence
  chemically synthesized
ctttatccacaaaacaaaggac

SEQ ID NO: 118215 - DNA, 22 bp, Artificial Sequence
  chemically synthesized
tatccacaaaacaaaggacctt

SEQ ID NO: 118216 - DNA, 22 bp, Artificial Sequence
  chemically synthesized
atccacaaaacaaaggaccttc

SEQ ID NO: 118217 - DNA, 22 bp, Artificial Sequence
  chemically synthesized
tccacaaaacaaaggaccttca

SEQ ID NO: 118218 - DNA, 22 bp, Artificial Sequence
  chemically synthesized
cagcaacttactggtcctttct

SEQ ID NO: 118219 - DNA, 22 bp, Artificial Sequence
  chemically synthesized
agcaacttactggtcctttctt

SEQ ID NO: 118220 - DNA, 22 bp, Artificial Sequence
  chemically synthesized
actggtcctttcttctctgtag

SEQ ID NO: 118221 - DNA, 22 bp, Artificial Sequence
  chemically synthesized
ctggtcctttcttctctgtagc

SEQ ID NO: 118222 - DNA, 22 bp, Artificial Sequence
  chemically synthesized
gtcctttcttctctgtagcttc

SEQ ID NO: 118223 - DNA, 22 bp, Artificial Sequence
  chemically synthesized
tcttctctgtagcttctttctc

SEQ ID NO: 118224 - DNA, 22 bp, Artificial Sequence
  chemically synthesized
cttctctgtagcttctttctca

SEQ ID NO: 118225 - DNA, 22 bp, Artificial Sequence
  chemically synthesized
ttctctgtagcttctttctcat

SEQ ID NO: 118226 - DNA, 22 bp, Artificial Sequence
  chemically synthesized
ctctgtagcttctttctcatgc

SEQ ID NO: 118227 - DNA, 22 bp, Artificial Sequence
  chemically synthesized
tctgtagcttctttctcatgca

SEQ ID NO: 118228 - DNA, 22 bp, Artificial Sequence
  chemically synthesized
tgtagcttctttctcatgcagc

SEQ ID NO: 118229 - DNA, 22 bp, Artificial Sequence
  chemically synthesized
tagcttctttctcatgcagccc

SEQ ID NO: 118230 - DNA, 22 bp, Artificial Sequence
  chemically synthesized
ctttctcatgcagcccttccac

SEQ ID NO: 118231 - DNA, 22 bp, Artificial Sequence
  chemically synthesized
tttctcatgcagcccttccact

SEQ ID NO: 118232 - DNA, 22 bp, Artificial Sequence
  chemically synthesized
tctcatgcagcccttccactcc

SEQ ID NO: 118233 - DNA, 22 bp, Artificial Sequence
  chemically synthesized
ctcatgcagcccttccactcca

SEQ ID NO: 118234 - DNA, 22 bp, Artificial Sequence
  chemically synthesized
tcatgcagcccttccactccat

SEQ ID NO: 118235 - DNA, 22 bp, Artificial Sequence
  chemically synthesized
atgcagcccttccactccatgc

SEQ ID NO: 118236 - DNA, 22 bp, Artificial Sequence
  chemically synthesized
ccactccatgccagcatcttcc

SEQ ID NO: 118237 - DNA, 22 bp, Artificial Sequence
  chemically synthesized
cactccatgccagcatcttcca

SEQ ID NO: 118238 - DNA, 22 bp, Artificial Sequence
  chemically synthesized
catgccagcatcttccatttga

SEQ ID NO: 118239 - DNA, 22 bp, Artificial Sequence
  chemically synthesized
ccatttgactcaggatgctgtt

SEQ ID NO: 118240 - DNA, 22 bp, Artificial Sequence
  chemically synthesized
catttgactcaggatgctgttc

SEQ ID NO: 118241 - DNA, 22 bp, Artificial Sequence
  chemically synthesized
gactcaggatgctgttctacgt

SEQ ID NO: 118242 - DNA, 22 bp, Artificial Sequence
  chemically synthesized
actcaggatgctgttctacgtg

SEQ ID NO: 118243 - DNA, 22 bp, Artificial Sequence
  chemically synthesized
aggatgctgttctacgtgggct

SEQ ID NO: 118244 - DNA, 22 bp, Artificial Sequence
  chemically synthesized
ttctacgtgggctgcactggca

SEQ ID NO: 118245 - DNA, 22 bp, Artificial Sequence
  chemically synthesized
tacgtgggctgcactggcactt

SEQ ID NO: 118246 - DNA, 22 bp, Artificial Sequence
  chemically synthesized
cgtgggctgcactggcacttat

SEQ ID NO: 118247 - DNA, 22 bp, Artificial Sequence
  chemically synthesized
cactggcacttataaagctgtc

SEQ ID NO: 118248 - DNA, 22 bp, Artificial Sequence
  chemically synthesized
gcacttataaagctgtctctct

SEQ ID NO: 118249 - DNA, 22 bp, Artificial Sequence
  chemically synthesized
ataaagctgtctctcttccttg

SEQ ID NO: 118250 - DNA, 22 bp, Artificial Sequence
  chemically synthesized
taaagctgtctctcttccttgg

SEQ ID NO: 118251 - DNA, 22 bp, Artificial Sequence
  chemically synthesized
tctctcttccttgggtctttgg

SEQ ID NO: 118252 - DNA, 22 bp, Artificial Sequence
  chemically synthesized
tcttccttgggtctttggccct

SEQ ID NO: 118253 - DNA, 22 bp, Artificial Sequence
  chemically synthesized
ttccttgggtctttggccctca

SEQ ID NO: 118254 - DNA, 22 bp, Artificial Sequence
  chemically synthesized
ccttgggtctttggccctcaaa

SEQ ID NO: 118255 - DNA, 22 bp, Artificial Sequence
  chemically synthesized
cttgggtctttggccctcaaag

SEQ ID NO: 118256 - DNA, 22 bp, Artificial Sequence
  chemically synthesized
gggtctttggccctcaaaggaa

SEQ ID NO: 118257 - DNA, 22 bp, Artificial Sequence
  chemically synthesized
ggtctttggccctcaaaggaat

SEQ ID NO: 118258 - DNA, 22 bp, Artificial Sequence
  chemically synthesized
tggccctcaaaggaatctccct

SEQ ID NO: 118259 - DNA, 22 bp, Artificial Sequence
  chemically synthesized
ggccctcaaaggaatctcccta

SEQ ID NO: 118260 - DNA, 22 bp, Artificial Sequence
  chemically synthesized
gccctcaaaggaatctccctag

SEQ ID NO: 118261 - DNA, 22 bp, Artificial Sequence
  chemically synthesized
aaaggaatctccctagatggac

SEQ ID NO: 118262 - DNA, 22 bp, Artificial Sequence
  chemically synthesized
cctagatggacgcagacttgat

SEQ ID NO: 118263 - DNA, 22 bp, Artificial Sequence
  chemically synthesized
gatggacgcagacttgatgaat

SEQ ID NO: 118264 - DNA, 22 bp, Artificial Sequence
  chemically synthesized
gatgaatgtcaaagagggatta

SEQ ID NO: 118265 - DNA, 22 bp, Artificial Sequence
  chemically synthesized
atgaatgtcaaagagggattag

SEQ ID NO: 118266 - DNA, 22 bp, Artificial Sequence
  chemically synthesized
gcatcctcctagaccaaagcat

SEQ ID NO: 118267 - DNA, 22 bp, Artificial Sequence
  chemically synthesized
ctagaccaaagcatttgagatg

SEQ ID NO: 118268 - DNA, 22 bp, Artificial Sequence
  chemically synthesized
gaccaaagcatttgagatgccc

SEQ ID NO: 118269 - DNA, 22 bp, Artificial Sequence
  chemically synthesized
gagatgcccagttatcttaaat

SEQ ID NO: 118270 - DNA, 22 bp, Artificial Sequence
  chemically synthesized
agatgcccagttatcttaaatg

SEQ ID NO: 118271 - DNA, 22 bp, Artificial Sequence
  chemically synthesized
tcttaaatggaaatttagtgaa

SEQ ID NO: 118272 - DNA, 22 bp, Artificial Sequence
  chemically synthesized
aaatggaaatttagtgaaccat

SEQ ID NO: 118273 - DNA, 22 bp, Artificial Sequence
  chemically synthesized
aatggaaatttagtgaaccatg

SEQ ID NO: 118274 - DNA, 22 bp, Artificial Sequence
  chemically synthesized
agtgaaccatgagtacctctag

SEQ ID NO: 118275 - DNA, 22 bp, Artificial Sequence
  chemically synthesized
gtgaaccatgagtacctctagg

SEQ ID NO: 118276 - DNA, 22 bp, Artificial Sequence
  chemically synthesized
taggaggtatttcagtgagcca

SEQ ID NO: 118277 - DNA, 22 bp, Artificial Sequence
  chemically synthesized
ggaggtatttcagtgagccaga

SEQ ID NO: 118278 - DNA, 22 bp, Artificial Sequence
  chemically synthesized
cagtgagccagaggatccttga

SEQ ID NO: 118279 - DNA, 22 bp, Artificial Sequence
  chemically synthesized
agtgagccagaggatccttgac

SEQ ID NO: 118280 - DNA, 22 bp, Artificial Sequence
  chemically synthesized
gactgtcttctctccccagctg

SEQ ID NO: 118281 - DNA, 22 bp, Artificial Sequence
  chemically synthesized
actgtcttctctccccagctgc

SEQ ID NO: 118282 - DNA, 22 bp, Artificial Sequence
  chemically synthesized
tcttctctccccagctgccaac

SEQ ID NO: 118283 - DNA, 22 bp, Artificial Sequence
  chemically synthesized
ctctccccagctgccaacttca

SEQ ID NO: 118284 - DNA, 22 bp, Artificial Sequence
  chemically synthesized
tctccccagctgccaacttcat

SEQ ID NO: 118285 - DNA, 22 bp, Artificial Sequence
  chemically synthesized
tccccagctgccaacttcataa

SEQ ID NO: 118286 - DNA, 22 bp, Artificial Sequence
  chemically synthesized
cccagctgccaacttcataaga

SEQ ID NO: 118287 - DNA, 22 bp, Artificial Sequence
  chemically synthesized
ccaacttcataagaaaatttat

SEQ ID NO: 118288 - DNA, 22 bp, Artificial Sequence
  chemically synthesized
cataagaaaatttattgggtgc

SEQ ID NO: 118289 - DNA, 22 bp, Artificial Sequence
  chemically synthesized
ataagaaaatttattgggtgct

SEQ ID NO: 118290 - DNA, 22 bp, Artificial Sequence
  chemically synthesized
attgggtgcttctcaatcctct

SEQ ID NO: 118291 - DNA, 22 bp, Artificial Sequence
  chemically synthesized
ttgggtgcttctcaatcctctt

SEQ ID NO: 118292 - DNA, 22 bp, Artificial Sequence
  chemically synthesized
ggtgcttctcaatcctcttttt

SEQ ID NO: 118293 - DNA, 22 bp, Artificial Sequence
  chemically synthesized
ctcaatcctcttttttgtcttt

SEQ ID NO: 118294 - DNA, 22 bp, Artificial Sequence
  chemically synthesized
tcaatcctcttttttgtctttc

SEQ ID NO: 118295 - DNA, 22 bp, Artificial Sequence
  chemically synthesized
aatcctcttttttgtctttctt

SEQ ID NO: 118296 - DNA, 22 bp, Artificial Sequence
  chemically synthesized
ttttttgtctttcttttctttt

SEQ ID NO: 118297 - DNA, 22 bp, Artificial Sequence
  chemically synthesized
ttttgtctttcttttcttttcc

SEQ ID NO: 118298 - DNA, 22 bp, Artificial Sequence
  chemically synthesized
tttgtctttcttttcttttccc

SEQ ID NO: 118299 - DNA, 22 bp, Artificial Sequence
  chemically synthesized
ttgtctttcttttcttttccca

SEQ ID NO: 118300 - DNA, 22 bp, Artificial Sequence
  chemically synthesized
tgtctttcttttcttttcccag

SEQ ID NO: 118301 - DNA, 22 bp, Artificial Sequence
  chemically synthesized
gtctttcttttcttttcccaga

SEQ ID NO: 118302 - DNA, 22 bp, Artificial Sequence
  chemically synthesized
tctttcttttcttttcccagac

SEQ ID NO: 118303 - DNA, 22 bp, Artificial Sequence
  chemically synthesized
tcttttcttttcccagacaaaa

SEQ ID NO: 118304 - DNA, 22 bp, Artificial Sequence
  chemically synthesized
cttttcttttcccagacaaaag

SEQ ID NO: 118305 - DNA, 22 bp, Artificial Sequence
  chemically synthesized
ttttcttttcccagacaaaagt

SEQ ID NO: 118306 - DNA, 22 bp, Artificial Sequence
  chemically synthesized
ttcttttcccagacaaaagtcc

SEQ ID NO: 118307 - DNA, 22 bp, Artificial Sequence
  chemically synthesized
tcttttcccagacaaaagtccc

SEQ ID NO: 118308 - DNA, 22 bp, Artificial Sequence
  chemically synthesized
cttttcccagacaaaagtcccc

SEQ ID NO: 118309 - DNA, 22 bp, Artificial Sequence
  chemically synthesized
ttttcccagacaaaagtcccct

SEQ ID NO: 118310 - DNA, 22 bp, Artificial Sequence
  chemically synthesized
ttcccagacaaaagtccccttg

SEQ ID NO: 118311 - DNA, 22 bp, Artificial Sequence
  chemically synthesized
tcccagacaaaagtccccttga

SEQ ID NO: 118312 - DNA, 22 bp, Artificial Sequence
  chemically synthesized
cccagacaaaagtccccttgag

SEQ ID NO: 118313 - DNA, 22 bp, Artificial Sequence
  chemically synthesized
ccagacaaaagtccccttgaga

SEQ ID NO: 118314 - DNA, 22 bp, Artificial Sequence
  chemically synthesized
gagacagtctttacaaccaggt

SEQ ID NO: 118315 - DNA, 22 bp, Artificial Sequence
  chemically synthesized
agacagtctttacaaccaggta

SEQ ID NO: 118316 - DNA, 22 bp, Artificial Sequence
  chemically synthesized
tacaaccaggtagttattcact

SEQ ID NO: 118317 - DNA, 22 bp, Artificial Sequence
  chemically synthesized
acaaccaggtagttattcactg

SEQ ID NO: 118318 - DNA, 22 bp, Artificial Sequence
  chemically synthesized
caaccaggtagttattcactgt

SEQ ID NO: 118319 - DNA, 22 bp, Artificial Sequence
  chemically synthesized
ttcactgtcattcactgagcaa

SEQ ID NO: 118320 - DNA, 22 bp, Artificial Sequence
  chemically synthesized
actgtcattcactgagcaagta

SEQ ID NO: 118321 - DNA, 22 bp, Artificial Sequence
  chemically synthesized
tcattcactgagcaagtatgta

SEQ ID NO: 118322 - DNA, 22 bp, Artificial Sequence
  chemically synthesized
actgagcaagtatgtaaagatc

SEQ ID NO: 118323 - DNA, 22 bp, Artificial Sequence
  chemically synthesized
agcaagtatgtaaagatcacaa

SEQ ID NO: 118324 - DNA, 22 bp, Artificial Sequence
  chemically synthesized
tgggtcagatatttgaatgcaa

SEQ ID NO: 118325 - DNA, 22 bp, Artificial Sequence
  chemically synthesized
gggtcagatatttgaatgcaag

SEQ ID NO: 118326 - DNA, 22 bp, Artificial Sequence
  chemically synthesized
ggtcagatatttgaatgcaagc

SEQ ID NO: 118327 - DNA, 22 bp, Artificial Sequence
  chemically synthesized
gaatgcaagcattaataagaca

SEQ ID NO: 118328 - DNA, 22 bp, Artificial Sequence
  chemically synthesized
aatgcaagcattaataagacac

SEQ ID NO: 118329 - DNA, 22 bp, Artificial Sequence
  chemically synthesized
ataagacacaaactctgtcttt

SEQ ID NO: 118330 - DNA, 22 bp, Artificial Sequence
  chemically synthesized
tgtctttcagaaagcattgtct

SEQ ID NO: 118331 - DNA, 22 bp, Artificial Sequence
  chemically synthesized
tctttcagaaagcattgtcttc

SEQ ID NO: 118332 - DNA, 22 bp, Artificial Sequence
  chemically synthesized
tcagaaagcattgtcttctgca

SEQ ID NO: 118333 - DNA, 22 bp, Artificial Sequence
  chemically synthesized
cagaaagcattgtcttctgcag

SEQ ID NO: 118334 - DNA, 22 bp, Artificial Sequence
  chemically synthesized
agaaagcattgtcttctgcagg

SEQ ID NO: 118335 - DNA, 22 bp, Artificial Sequence
  chemically synthesized
tcttctgcaggaggttgatgtg

SEQ ID NO: 118336 - DNA, 22 bp, Artificial Sequence
  chemically synthesized
ctgcaggaggttgatgtgaaaa

SEQ ID NO: 118337 - DNA, 22 bp, Artificial Sequence
  chemically synthesized
tgcaggaggttgatgtgaaaaa

SEQ ID NO: 118338 - DNA, 22 bp, Artificial Sequence
  chemically synthesized
caggaggttgatgtgaaaaaaa

SEQ ID NO: 118339 - DNA, 22 bp, Artificial Sequence
  chemically synthesized
atgtgaaaaaaactaacgtccc

SEQ ID NO: 118340 - DNA, 22 bp, Artificial Sequence
  chemically synthesized
acgtcccctgatgaagcaaaaa

SEQ ID NO: 118341 - DNA, 22 bp, Artificial Sequence
  chemically synthesized
atgaagcaaaaacaggcttccc

SEQ ID NO: 118342 - DNA, 22 bp, Artificial Sequence
  chemically synthesized
cccaggtgatacaaatatttag

SEQ ID NO: 118343 - DNA, 22 bp, Artificial Sequence
  chemically synthesized
ccaggtgatacaaatatttagc

SEQ ID NO: 118344 - DNA, 22 bp, Artificial Sequence
  chemically synthesized
agcaagctttccttactaatgt

SEQ ID NO: 118345 - DNA, 22 bp, Artificial Sequence
  chemically synthesized
gcaagctttccttactaatgtc

SEQ ID NO: 118346 - DNA, 22 bp, Artificial Sequence
  chemically synthesized
tccttactaatgtctgcactat

SEQ ID NO: 118347 - DNA, 22 bp, Artificial Sequence
  chemically synthesized
ccttactaatgtctgcactatc

SEQ ID NO: 118348 - DNA, 22 bp, Artificial Sequence
  chemically synthesized
cttactaatgtctgcactatca

SEQ ID NO: 118349 - DNA, 22 bp, Artificial Sequence
  chemically synthesized
actaatgtctgcactatcattc

SEQ ID NO: 118350 - DNA, 22 bp, Artificial Sequence
  chemically synthesized
ctaatgtctgcactatcattca

SEQ ID NO: 118351 - DNA, 22 bp, Artificial Sequence
  chemically synthesized
atgtctgcactatcattcaaaa

SEQ ID NO: 118352 - DNA, 22 bp, Artificial Sequence
  chemically synthesized
cactatcattcaaaataggtaa

SEQ ID NO: 118353 - DNA, 22 bp, Artificial Sequence
  chemically synthesized
tcattcaaaataggtaacattt

SEQ ID NO: 118354 - DNA, 22 bp, Artificial Sequence
  chemically synthesized
aaaataggtaacattttagata

SEQ ID NO: 118355 - DNA, 22 bp, Artificial Sequence
  chemically synthesized
tagatagaggggaaaacatgta

SEQ ID NO: 118356 - DNA, 22 bp, Artificial Sequence
  chemically synthesized
agatagaggggaaaacatgtac

SEQ ID NO: 118357 - DNA, 22 bp, Artificial Sequence
  chemically synthesized
gatagaggggaaaacatgtaca

SEQ ID NO: 118358 - DNA, 22 bp, Artificial Sequence
  chemically synthesized
agagttgtcacaaagcaaaaca

SEQ ID NO: 118359 - DNA, 22 bp, Artificial Sequence
  chemically synthesized
tcacaaagcaaaacataaaatt

SEQ ID NO: 118360 - DNA, 22 bp, Artificial Sequence
  chemically synthesized
tgtgaacttcaattacatgagc

SEQ ID NO: 118361 - DNA, 22 bp, Artificial Sequence
  chemically synthesized
tgaacttcaattacatgagcca

SEQ ID NO: 118362 - DNA, 22 bp, Artificial Sequence
  chemically synthesized
caattacatgagccatctgtgt

SEQ ID NO: 118363 - DNA, 22 bp, Artificial Sequence
  chemically synthesized
aattacatgagccatctgtgtt

SEQ ID NO: 118364 - DNA, 22 bp, Artificial Sequence
  chemically synthesized
catgagccatctgtgttttaca

SEQ ID NO: 118365 - DNA, 22 bp, Artificial Sequence
  chemically synthesized
tgttttacaaatacagtatcaa

SEQ ID NO: 118366 - DNA, 22 bp, Artificial Sequence
  chemically synthesized
tacaaatacagtatcaatttca

SEQ ID NO: 118367 - DNA, 22 bp, Artificial Sequence
  chemically synthesized
acaaatacagtatcaatttcaa

SEQ ID NO: 118368 - DNA, 22 bp, Artificial Sequence
  chemically synthesized
caaatacagtatcaatttcaaa

SEQ ID NO: 118369 - DNA, 22 bp, Artificial Sequence
  chemically synthesized
caaaggcttagagaggcttgtg

SEQ ID NO: 118370 - DNA, 22 bp, Artificial Sequence
  chemically synthesized
aaaggcttagagaggcttgtgg

SEQ ID NO: 118371 - DNA, 22 bp, Artificial Sequence
  chemically synthesized
agagaggcttgtggatattaaa

SEQ ID NO: 118372 - DNA, 22 bp, Artificial Sequence
  chemically synthesized
gagaggcttgtggatattaaat

SEQ ID NO: 118373 - DNA, 22 bp, Artificial Sequence
  chemically synthesized
gtggatattaaataacgggata

SEQ ID NO: 118374 - DNA, 22 bp, Artificial Sequence
  chemically synthesized
tggatattaaataacgggatag

SEQ ID NO: 118375 - DNA, 22 bp, Artificial Sequence
  chemically synthesized
aataacgggatagttgtaaaga

SEQ ID NO: 118376 - DNA, 22 bp, Artificial Sequence
  chemically synthesized
taaagatttttgcctgcaggaa

SEQ ID NO: 118377 - DNA, 22 bp, Artificial Sequence
  chemically synthesized
ttgcctgcaggaatataggctt

SEQ ID NO: 118378 - DNA, 22 bp, Artificial Sequence
  chemically synthesized
tgcctgcaggaatataggcttg

SEQ ID NO: 118379 - DNA, 22 bp, Artificial Sequence
  chemically synthesized
gcctgcaggaatataggcttgt

SEQ ID NO: 118380 - DNA, 22 bp, Artificial Sequence
  chemically synthesized
cctgcaggaatataggcttgtg

SEQ ID NO: 118381 - DNA, 22 bp, Artificial Sequence
  chemically synthesized
caggaatataggcttgtgctga

SEQ ID NO: 118382 - DNA, 22 bp, Artificial Sequence
  chemically synthesized
gtgctgaggaatgggccagatg

SEQ ID NO: 118383 - DNA, 22 bp, Artificial Sequence
  chemically synthesized
tgctgaggaatgggccagatga

SEQ ID NO: 118384 - DNA, 22 bp, Artificial Sequence
  chemically synthesized
aggaatgggccagatgatttaa

SEQ ID NO: 118385 - DNA, 22 bp, Artificial Sequence
  chemically synthesized
aaagcagatactgtcattagca

SEQ ID NO: 118386 - DNA, 22 bp, Artificial Sequence
  chemically synthesized
aagcagatactgtcattagcag

SEQ ID NO: 118387 - DNA, 22 bp, Artificial Sequence
  chemically synthesized
tcattagcaggaatatgtacag

SEQ ID NO: 118388 - DNA, 22 bp, Artificial Sequence
  chemically synthesized
gcaggaatatgtacagctttgg

SEQ ID NO: 118389 - DNA, 22 bp, Artificial Sequence
  chemically synthesized
tggctgattttatgtttttttt

SEQ ID NO: 118390 - DNA, 22 bp, Artificial Sequence
  chemically synthesized
ggctgattttatgttttttttg

SEQ ID NO: 118391 - DNA, 22 bp, Artificial Sequence
  chemically synthesized
gctgattttatgttttttttgg

SEQ ID NO: 118392 - DNA, 22 bp, Artificial Sequence
  chemically synthesized
attttatgttttttttggtttg

SEQ ID NO: 118393 - DNA, 22 bp, Artificial Sequence
  chemically synthesized
tatgttttttttggtttgttgt

SEQ ID NO: 118394 - DNA, 22 bp, Artificial Sequence
  chemically synthesized
atgttttttttggtttgttgtt

SEQ ID NO: 118395 - DNA, 22 bp, Artificial Sequence
  chemically synthesized
tgttttttttggtttgttgttg

SEQ ID NO: 118396 - DNA, 22 bp, Artificial Sequence
  chemically synthesized
tttttggtttgttgttgttgtt

SEQ ID NO: 118397 - DNA, 22 bp, Artificial Sequence
  chemically synthesized
ttttggtttgttgttgttgttg

SEQ ID NO: 118398 - DNA, 22 bp, Artificial Sequence
  chemically synthesized
tttggtttgttgttgttgttga

SEQ ID NO: 118399 - DNA, 22 bp, Artificial Sequence
  chemically synthesized
ttggtttgttgttgttgttgaa

SEQ ID NO: 118400 - DNA, 22 bp, Artificial Sequence
  chemically synthesized
tggtttgttgttgttgttgaat

SEQ ID NO: 118401 - DNA, 22 bp, Artificial Sequence
  chemically synthesized
ggtttgttgttgttgttgaatc

SEQ ID NO: 118402 - DNA, 22 bp, Artificial Sequence
  chemically synthesized
gtttgttgttgttgttgaatca

SEQ ID NO: 118403 - DNA, 22 bp, Artificial Sequence
  chemically synthesized
gttgttgttgttgaatcagtgg

SEQ ID NO: 118404 - DNA, 22 bp, Artificial Sequence
  chemically synthesized
ttgttgttgttgaatcagtgga

SEQ ID NO: 118405 - DNA, 22 bp, Artificial Sequence
  chemically synthesized
ttgttgttgaatcagtggagca

SEQ ID NO: 118406 - DNA, 22 bp, Artificial Sequence
  chemically synthesized
ttgttgaatcagtggagcatag

SEQ ID NO: 118407 - DNA, 22 bp, Artificial Sequence
  chemically synthesized
ttgaatcagtggagcatagtta

SEQ ID NO: 118408 - DNA, 22 bp, Artificial Sequence
  chemically synthesized
aatcagtggagcatagttaaaa

SEQ ID NO: 118409 - DNA, 22 bp, Artificial Sequence
  chemically synthesized
aaactacaagcaccacagtcag

SEQ ID NO: 118410 - DNA, 22 bp, Artificial Sequence
  chemically synthesized
caagcaccacagtcagaactgt

SEQ ID NO: 118411 - DNA, 22 bp, Artificial Sequence
  chemically synthesized
tcaaacttggtataatattggg

SEQ ID NO: 118412 - DNA, 22 bp, Artificial Sequence
  chemically synthesized
ggtataatattgggcaagatat

SEQ ID NO: 118413 - DNA, 22 bp, Artificial Sequence
  chemically synthesized
gtataatattgggcaagatatt

SEQ ID NO: 118414 - DNA, 22 bp, Artificial Sequence
  chemically synthesized
ggcaagatattttgtctctgag

SEQ ID NO: 118415 - DNA, 22 bp, Artificial Sequence
  chemically synthesized
tgtctctgagcctcagtgtact

SEQ ID NO: 118416 - DNA, 22 bp, Artificial Sequence
  chemically synthesized
gtctctgagcctcagtgtactt

SEQ ID NO: 118417 - DNA, 22 bp, Artificial Sequence
  chemically synthesized
tctctgagcctcagtgtactta

SEQ ID NO: 118418 - DNA, 22 bp, Artificial Sequence
  chemically synthesized
tgagcctcagtgtacttatctg

SEQ ID NO: 118419 - DNA, 22 bp, Artificial Sequence
  chemically synthesized
agcctcagtgtacttatctgta

SEQ ID NO: 118420 - DNA, 22 bp, Artificial Sequence
  chemically synthesized
agtgtacttatctgtaaaatgg

SEQ ID NO: 118421 - DNA, 22 bp, Artificial Sequence
  chemically synthesized
atctgtaaaatgggtaatctag

SEQ ID NO: 118422 - DNA, 22 bp, Artificial Sequence
  chemically synthesized
tctgtaaaatgggtaatctagt

SEQ ID NO: 118423 - DNA, 22 bp, Artificial Sequence
  chemically synthesized
taaaatgggtaatctagtagta

SEQ ID NO: 118424 - DNA, 22 bp, Artificial Sequence
  chemically synthesized
gtagtatccatctcataaggtt

SEQ ID NO: 118425 - DNA, 22 bp, Artificial Sequence
  chemically synthesized
ataaggttattgtcaagataaa

SEQ ID NO: 118426 - DNA, 22 bp, Artificial Sequence
  chemically synthesized
ttgtcaagataaagtgacttat

SEQ ID NO: 118427 - DNA, 22 bp, Artificial Sequence
  chemically synthesized
tcaagataaagtgacttatagt

SEQ ID NO: 118428 - DNA, 22 bp, Artificial Sequence
  chemically synthesized
atagtgtattatgcccttagaa

SEQ ID NO: 118429 - DNA, 22 bp, Artificial Sequence
  chemically synthesized
tagtgtattatgcccttagaat

SEQ ID NO: 118430 - DNA, 22 bp, Artificial Sequence
  chemically synthesized
tgcccttagaataatacctagg

SEQ ID NO: 118431 - DNA, 22 bp, Artificial Sequence
  chemically synthesized
agaataatacctaggttataat

SEQ ID NO: 118432 - DNA, 22 bp, Artificial Sequence
  chemically synthesized
gaataatacctaggttataata

SEQ ID NO: 118433 - DNA, 22 bp, Artificial Sequence
  chemically synthesized
ggttataatatgtgcttaaaaa

SEQ ID NO: 118434 - DNA, 22 bp, Artificial Sequence
  chemically synthesized
taatatgtgcttaaaaaaccat

SEQ ID NO: 118435 - DNA, 22 bp, Artificial Sequence
  chemically synthesized
aaaaaaccatgatatgcaaaat

SEQ ID NO: 118436 - DNA, 22 bp, Artificial Sequence
  chemically synthesized
aaaaaccatgatatgcaaaata

SEQ ID NO: 118437 - DNA, 22 bp, Artificial Sequence
  chemically synthesized
agtaccttctactgagtttttc

SEQ ID NO: 118438 - DNA, 22 bp, Artificial Sequence
  chemically synthesized
ctactgagtttttctgtgaatc

SEQ ID NO: 118439 - DNA, 22 bp, Artificial Sequence
  chemically synthesized
tactgagtttttctgtgaatct

SEQ ID NO: 118440 - DNA, 22 bp, Artificial Sequence
  chemically synthesized
ctgagtttttctgtgaatctat

SEQ ID NO: 118441 - DNA, 22 bp, Artificial Sequence
  chemically synthesized
agtttttctgtgaatctataac

SEQ ID NO: 118442 - DNA, 22 bp, Artificial Sequence
  chemically synthesized
ttctgtgaatctataactctta

SEQ ID NO: 118443 - DNA, 22 bp, Artificial Sequence
  chemically synthesized
tctgtgaatctataactcttaa

SEQ ID NO: 118444 - DNA, 22 bp, Artificial Sequence
  chemically synthesized
ctgtgaatctataactcttaaa

SEQ ID NO: 118445 - DNA, 22 bp, Artificial Sequence
  chemically synthesized
tgtgaatctataactcttaaaa

SEQ ID NO: 118446 - DNA, 22 bp, Artificial Sequence
  chemically synthesized
tgaatctataactcttaaaatc

SEQ ID NO: 118447 - DNA, 22 bp, Artificial Sequence
  chemically synthesized
taactcttaaaatcaagtctat

SEQ ID NO: 118448 - DNA, 22 bp, Artificial Sequence
  chemically synthesized
ttaaaatcaagtctattaaaaa

SEQ ID NO: 118449 - DNA, 22 bp, Artificial Sequence
  chemically synthesized
aaaatcaagtctattaaaaagt

SEQ ID NO: 118450 - DNA, 22 bp, Artificial Sequence
  chemically synthesized
aaatcaagtctattaaaaagta

SEQ ID NO: 118451 - DNA, 22 bp, Artificial Sequence
  chemically synthesized
ttaaaaagtatttaatacaata

SEQ ID NO: 118452 - DNA, 22 bp, Artificial Sequence
  chemically synthesized
aaaagtatttaatacaataatt

SEQ ID NO: 118453 - DNA, 22 bp, Artificial Sequence
  chemically synthesized
aatacaataattttatgttact

SEQ ID NO: 118454 - DNA, 22 bp, Artificial Sequence
  chemically synthesized
atacaataattttatgttactg

SEQ ID NO: 118455 - DNA, 22 bp, Artificial Sequence
  chemically synthesized
tatgttactgttttctgttgct

SEQ ID NO: 118456 - DNA, 22 bp, Artificial Sequence
  chemically synthesized
atgttactgttttctgttgcta

SEQ ID NO: 118457 - DNA, 22 bp, Artificial Sequence
  chemically synthesized
tgttactgttttctgttgctat

SEQ ID NO: 118458 - DNA, 22 bp, Artificial Sequence
  chemically synthesized
ctgttttctgttgctatctttt

SEQ ID NO: 118459 - DNA, 22 bp, Artificial Sequence
  chemically synthesized
ttttctgttgctatcttttcct

SEQ ID NO: 118460 - DNA, 22 bp, Artificial Sequence
  chemically synthesized
tctgttgctatcttttcctgat

SEQ ID NO: 118461 - DNA, 22 bp, Artificial Sequence
  chemically synthesized
ctgttgctatcttttcctgata

SEQ ID NO: 118462 - DNA, 22 bp, Artificial Sequence
  chemically synthesized
tgttgctatcttttcctgatac

SEQ ID NO: 118463 - DNA, 22 bp, Artificial Sequence
  chemically synthesized
ttgctatcttttcctgatacta

SEQ ID NO: 118464 - DNA, 22 bp, Artificial Sequence
  chemically synthesized
ctatcttttcctgatactaaat

SEQ ID NO: 118465 - DNA, 22 bp, Artificial Sequence
  chemically synthesized
tcttttcctgatactaaatgga

SEQ ID NO: 118466 - DNA, 22 bp, Artificial Sequence
  chemically synthesized
ttcctgatactaaatggaaaaa

SEQ ID NO: 118467 - DNA, 22 bp, Artificial Sequence
  chemically synthesized
tcctgatactaaatggaaaaat

SEQ ID NO: 118468 - DNA, 22 bp, Artificial Sequence
  chemically synthesized
cctgatactaaatggaaaaata

SEQ ID NO: 118469 - DNA, 22 bp, Artificial Sequence
  chemically synthesized
ctgatactaaatggaaaaatag

SEQ ID NO: 118470 - DNA, 22 bp, Artificial Sequence
  chemically synthesized
atactaaatggaaaaatagata

SEQ ID NO: 118471 - DNA, 22 bp, Artificial Sequence
  chemically synthesized
aatggaaaaatagataacatat

SEQ ID NO: 118472 - DNA, 22 bp, Artificial Sequence
  chemically synthesized
taggaaagggaacaaaaagtta

SEQ ID NO: 118473 - DNA, 22 bp, Artificial Sequence
  chemically synthesized
ggaaagggaacaaaaagttagg

SEQ ID NO: 118474 - DNA, 22 bp, Artificial Sequence
  chemically synthesized
gggagaagccaatgatgggact

SEQ ID NO: 118475 - DNA, 22 bp, Artificial Sequence
  chemically synthesized
ccttcagtataacatggaaaac

SEQ ID NO: 118476 - DNA, 22 bp, Artificial Sequence
  chemically synthesized
cttcagtataacatggaaaaca

SEQ ID NO: 118477 - DNA, 22 bp, Artificial Sequence
  chemically synthesized
cagtataacatggaaaacatgg

SEQ ID NO: 118478 - DNA, 22 bp, Artificial Sequence
  chemically synthesized
agtataacatggaaaacatggc

SEQ ID NO: 118479 - DNA, 22 bp, Artificial Sequence
  chemically synthesized
aaacgagtggtcctgtttggag

SEQ ID NO: 118480 - DNA, 22 bp, Artificial Sequence
  chemically synthesized
tttggagaggagtccagcataa

SEQ ID NO: 118481 - DNA, 22 bp, Artificial Sequence
  chemically synthesized
ggagaggagtccagcataatgg

SEQ ID NO: 118482 - DNA, 22 bp, Artificial Sequence
  chemically synthesized
gagaggagtccagcataatggt

SEQ ID NO: 118483 - DNA, 22 bp, Artificial Sequence
  chemically synthesized
aagaaaatcagatgcgcttgat

SEQ ID NO: 118484 - DNA, 22 bp, Artificial Sequence
  chemically synthesized
agaaaatcagatgcgcttgata

SEQ ID NO: 118485 - DNA, 22 bp, Artificial Sequence
  chemically synthesized
gatattgaatttcagttctgac

SEQ ID NO: 118486 - DNA, 22 bp, Artificial Sequence
  chemically synthesized
atattgaatttcagttctgact

SEQ ID NO: 118487 - DNA, 22 bp, Artificial Sequence
  chemically synthesized
aatttcagttctgacttacatt

SEQ ID NO: 118488 - DNA, 22 bp, Artificial Sequence
  chemically synthesized
cagttctgacttacattaatga

SEQ ID NO: 118489 - DNA, 22 bp, Artificial Sequence
  chemically synthesized
agttctgacttacattaatgat

SEQ ID NO: 118490 - DNA, 22 bp, Artificial Sequence
  chemically synthesized
tgacttacattaatgatttaac

SEQ ID NO: 118491 - DNA, 22 bp, Artificial Sequence
  chemically synthesized
acttacattaatgatttaacta

SEQ ID NO: 118492 - DNA, 22 bp, Artificial Sequence
  chemically synthesized
acattaatgatttaactaagga

SEQ ID NO: 118493 - DNA, 22 bp, Artificial Sequence
  chemically synthesized
cattaatgatttaactaaggaa

SEQ ID NO: 118494 - DNA, 22 bp, Artificial Sequence
  chemically synthesized
atgatttaactaaggaaagttg

SEQ ID NO: 118495 - DNA, 22 bp, Artificial Sequence
  chemically synthesized
aactaaggaaagttgctttcct

SEQ ID NO: 118496 - DNA, 22 bp, Artificial Sequence
  chemically synthesized
actaaggaaagttgctttcctc

SEQ ID NO: 118497 - DNA, 22 bp, Artificial Sequence
  chemically synthesized
aggaaagttgctttcctctgtg

SEQ ID NO: 118498 - DNA, 22 bp, Artificial Sequence
  chemically synthesized
ctttcctctgtgagcctcagtt

SEQ ID NO: 118499 - DNA, 22 bp, Artificial Sequence
  chemically synthesized
tcctctgtgagcctcagtttcc

SEQ ID NO: 118500 - DNA, 22 bp, Artificial Sequence
  chemically synthesized
cctctgtgagcctcagtttcct

SEQ ID NO: 118501 - DNA, 22 bp, Artificial Sequence
  chemically synthesized
ctctgtgagcctcagtttccta

SEQ ID NO: 118502 - DNA, 22 bp, Artificial Sequence
  chemically synthesized
tgtgagcctcagtttcctaatt

SEQ ID NO: 118503 - DNA, 22 bp, Artificial Sequence
  chemically synthesized
tgagcctcagtttcctaatttt

SEQ ID NO: 118504 - DNA, 22 bp, Artificial Sequence
  chemically synthesized
agtttcctaattttaaaacatt

SEQ ID NO: 118505 - DNA, 22 bp, Artificial Sequence
  chemically synthesized
cctaattttaaaacattgaaaa

SEQ ID NO: 118506 - DNA, 22 bp, Artificial Sequence
  chemically synthesized
ctaattttaaaacattgaaaat

SEQ ID NO: 118507 - DNA, 22 bp, Artificial Sequence
  chemically synthesized
attttaaaacattgaaaataat

SEQ ID NO: 118508 - DNA, 22 bp, Artificial Sequence
  chemically synthesized
taaaacattgaaaataataata

SEQ ID NO: 118509 - DNA, 22 bp, Artificial Sequence
  chemically synthesized
aaaacattgaaaataataatac

SEQ ID NO: 118510 - DNA, 22 bp, Artificial Sequence
  chemically synthesized
aaacattgaaaataataatacc

SEQ ID NO: 118511 - DNA, 22 bp, Artificial Sequence
  chemically synthesized
aaaataataatacctccctact

SEQ ID NO: 118512 - DNA, 22 bp, Artificial Sequence
  chemically synthesized
cctacttcacaggtttggtgag

SEQ ID NO: 118513 - DNA, 22 bp, Artificial Sequence
  chemically synthesized
cttcacaggtttggtgagaaaa

SEQ ID NO: 118514 - DNA, 22 bp, Artificial Sequence
  chemically synthesized
cacaggtttggtgagaaaatta

SEQ ID NO: 118515 - DNA, 22 bp, Artificial Sequence
  chemically synthesized
acaggtttggtgagaaaattaa

SEQ ID NO: 118516 - DNA, 22 bp, Artificial Sequence
  chemically synthesized
ggtgagaaaattaaatgaaata

SEQ ID NO: 118517 - DNA, 22 bp, Artificial Sequence
  chemically synthesized
gtgagaaaattaaatgaaataa

SEQ ID NO: 118518 - DNA, 22 bp, Artificial Sequence
  chemically synthesized
aatgaaataatgtaaaataatg

SEQ ID NO: 118519 - DNA, 22 bp, Artificial Sequence
  chemically synthesized
agccctctctaccgtgagttaa

SEQ ID NO: 118520 - DNA, 22 bp, Artificial Sequence
  chemically synthesized
tctaccgtgagttaaatgctta

SEQ ID NO: 118521 - DNA, 22 bp, Artificial Sequence
  chemically synthesized
taccgtgagttaaatgcttaat

SEQ ID NO: 118522 - DNA, 22 bp, Artificial Sequence
  chemically synthesized
ccgtgagttaaatgcttaataa

SEQ ID NO: 118523 - DNA, 22 bp, Artificial Sequence
  chemically synthesized
aatgcttaataaacattagcat

SEQ ID NO: 118524 - DNA, 22 bp, Artificial Sequence
  chemically synthesized
aataaacattagcatttatcat

SEQ ID NO: 118525 - DNA, 22 bp, Artificial Sequence
  chemically synthesized
ataaacattagcatttatcatg

SEQ ID NO: 118526 - DNA, 22 bp, Artificial Sequence
  chemically synthesized
gcatttatcatgatcataatta

SEQ ID NO: 118527 - DNA, 22 bp, Artificial Sequence
  chemically synthesized
atcatgatcataattatcatct

SEQ ID NO: 118528 - DNA, 22 bp, Artificial Sequence
  chemically synthesized
tcatgatcataattatcatctt

SEQ ID NO: 118529 - DNA, 22 bp, Artificial Sequence
  chemically synthesized
tcatcttcattgtcatcttcag

SEQ ID NO: 118530 - DNA, 22 bp, Artificial Sequence
  chemically synthesized
cattgtcatcttcagcataatc

SEQ ID NO: 118531 - DNA, 22 bp, Artificial Sequence
  chemically synthesized
attgtcatcttcagcataatcg

SEQ ID NO: 118532 - DNA, 22 bp, Artificial Sequence
  chemically synthesized
tcatcttcagcataatcgtata

SEQ ID NO: 118533 - DNA, 22 bp, Artificial Sequence
  chemically synthesized
cagcataatcgtatataacttt

SEQ ID NO: 118534 - DNA, 22 bp, Artificial Sequence
  chemically synthesized
agcataatcgtatataactttt

SEQ ID NO: 118535 - DNA, 22 bp, Artificial Sequence
  chemically synthesized
tttatagtcattgtaaaatgct

SEQ ID NO: 118536 - DNA, 22 bp, Artificial Sequence
  chemically synthesized
ttatagtcattgtaaaatgctc

SEQ ID NO: 118537 - DNA, 22 bp, Artificial Sequence
  chemically synthesized
tatagtcattgtaaaatgctct

SEQ ID NO: 118538 - DNA, 22 bp, Artificial Sequence
  chemically synthesized
atagtcattgtaaaatgctctt

SEQ ID NO: 118539 - DNA, 22 bp, Artificial Sequence
  chemically synthesized
tagtcattgtaaaatgctcttt

SEQ ID NO: 118540 - DNA, 22 bp, Artificial Sequence
  chemically synthesized
taaaatgctctttttagattat

SEQ ID NO: 118541 - DNA, 22 bp, Artificial Sequence
  chemically synthesized
tttttagattataaaaccgaaa

SEQ ID NO: 118542 - DNA, 22 bp, Artificial Sequence
  chemically synthesized
tttagattataaaaccgaaatg

SEQ ID NO: 118543 - DNA, 22 bp, Artificial Sequence
  chemically synthesized
ttagattataaaaccgaaatgt

SEQ ID NO: 118544 - DNA, 22 bp, Artificial Sequence
  chemically synthesized
tagattataaaaccgaaatgtc

SEQ ID NO: 118545 - DNA, 22 bp, Artificial Sequence
  chemically synthesized
agattataaaaccgaaatgtct

SEQ ID NO: 118546 - DNA, 22 bp, Artificial Sequence
  chemically synthesized
gattataaaaccgaaatgtctt

SEQ ID NO: 118547 - DNA, 22 bp, Artificial Sequence
  chemically synthesized
taaaaccgaaatgtcttcttca

SEQ ID NO: 118548 - DNA, 22 bp, Artificial Sequence
  chemically synthesized
cttcagaaaatttgtatacggc

SEQ ID NO: 118549 - DNA, 22 bp, Artificial Sequence
  chemically synthesized
ttcagaaaatttgtatacggca

SEQ ID NO: 118550 - DNA, 22 bp, Artificial Sequence
  chemically synthesized
cagaaaatttgtatacggcaaa

SEQ ID NO: 118551 - DNA, 22 bp, Artificial Sequence
  chemically synthesized
agaaaatttgtatacggcaaag

SEQ ID NO: 118552 - DNA, 22 bp, Artificial Sequence
  chemically synthesized
gtatacggcaaagatagagaaa

SEQ ID NO: 118553 - DNA, 22 bp, Artificial Sequence
  chemically synthesized
tatacggcaaagatagagaaat

SEQ ID NO: 118554 - DNA, 22 bp, Artificial Sequence
  chemically synthesized
tatagaaaataagattatatat

SEQ ID NO: 118555 - DNA, 22 bp, Artificial Sequence
  chemically synthesized
tatataacagctgtttttcttt

SEQ ID NO: 118556 - DNA, 22 bp, Artificial Sequence
  chemically synthesized
tttttcttttgatacaaatatt

SEQ ID NO: 118557 - DNA, 22 bp, Artificial Sequence
  chemically synthesized
ttcttttgatacaaatatttat

SEQ ID NO: 118558 - DNA, 22 bp, Artificial Sequence
  chemically synthesized
tcttttgatacaaatatttata

SEQ ID NO: 118559 - DNA, 22 bp, Artificial Sequence
  chemically synthesized
cttttgatacaaatatttatag

SEQ ID NO: 118560 - DNA, 22 bp, Artificial Sequence
  chemically synthesized
ttttgatacaaatatttatagc

SEQ ID NO: 118561 - DNA, 22 bp, Artificial Sequence
  chemically synthesized
ttgatacaaatatttatagcct

SEQ ID NO: 118562 - DNA, 22 bp, Artificial Sequence
  chemically synthesized
tgatacaaatatttatagcctt

SEQ ID NO: 118563 - DNA, 22 bp, Artificial Sequence
  chemically synthesized
gatacaaatatttatagccttt

SEQ ID NO: 118564 - DNA, 22 bp, Artificial Sequence
  chemically synthesized
atacaaatatttatagcctttt

SEQ ID NO: 118565 - DNA, 22 bp, Artificial Sequence
  chemically synthesized
atagccttttacatagtgattg

SEQ ID NO: 118566 - DNA, 22 bp, Artificial Sequence
  chemically synthesized
tagccttttacatagtgattgt

SEQ ID NO: 118567 - DNA, 22 bp, Artificial Sequence
  chemically synthesized
ttacatagtgattgttctgtac

SEQ ID NO: 118568 - DNA, 22 bp, Artificial Sequence
  chemically synthesized
tacatagtgattgttctgtacc

SEQ ID NO: 118569 - DNA, 22 bp, Artificial Sequence
  chemically synthesized
acatagtgattgttctgtacct

SEQ ID NO: 118570 - DNA, 22 bp, Artificial Sequence
  chemically synthesized
catagtgattgttctgtaccta

SEQ ID NO: 118571 - DNA, 22 bp, Artificial Sequence
  chemically synthesized
ttctgtacctaattttgcttat

SEQ ID NO: 118572 - DNA, 22 bp, Artificial Sequence
  chemically synthesized
tgtacctaattttgcttatttt

SEQ ID NO: 118573 - DNA, 22 bp, Artificial Sequence
  chemically synthesized
tacctaattttgcttattttta

SEQ ID NO: 118574 - DNA, 22 bp, Artificial Sequence
  chemically synthesized
attttgcttatttttatttaat

SEQ ID NO: 118575 - DNA, 22 bp, Artificial Sequence
  chemically synthesized
tgcttatttttatttaatattt

SEQ ID NO: 118576 - DNA, 22 bp, Artificial Sequence
  chemically synthesized
gcttatttttatttaatatttt

SEQ ID NO: 118577 - DNA, 22 bp, Artificial Sequence
  chemically synthesized
cttatttttatttaatattttg

SEQ ID NO: 118578 - DNA, 22 bp, Artificial Sequence
  chemically synthesized
atttttatttaatattttgcca

SEQ ID NO: 118579 - DNA, 22 bp, Artificial Sequence
  chemically synthesized
tttttatttaatattttgccaa

SEQ ID NO: 118580 - DNA, 22 bp, Artificial Sequence
  chemically synthesized
ttatttaatattttgccaacag

SEQ ID NO: 118581 - DNA, 22 bp, Artificial Sequence
  chemically synthesized
tatttaatattttgccaacagt

SEQ ID NO: 118582 - DNA, 22 bp, Artificial Sequence
  chemically synthesized
atttaatattttgccaacagtt

SEQ ID NO: 118583 - DNA, 22 bp, Artificial Sequence
  chemically synthesized
tttaatattttgccaacagttt

SEQ ID NO: 118584 - DNA, 22 bp, Artificial Sequence
  chemically synthesized
aatattttgccaacagtttcct

SEQ ID NO: 118585 - DNA, 22 bp, Artificial Sequence
  chemically synthesized
atattttgccaacagtttccta

SEQ ID NO: 118586 - DNA, 22 bp, Artificial Sequence
  chemically synthesized
tgccaacagtttcctaagcatt

SEQ ID NO: 118587 - DNA, 22 bp, Artificial Sequence
  chemically synthesized
gccaacagtttcctaagcattt

SEQ ID NO: 118588 - DNA, 22 bp, Artificial Sequence
  chemically synthesized
ccaacagtttcctaagcattta

SEQ ID NO: 118589 - DNA, 22 bp, Artificial Sequence
  chemically synthesized
cctaagcatttaaatgtcattt

SEQ ID NO: 118590 - DNA, 22 bp, Artificial Sequence
  chemically synthesized
ctaagcatttaaatgtcatttt

SEQ ID NO: 118591 - DNA, 22 bp, Artificial Sequence
  chemically synthesized
agcatttaaatgtcattttaat

SEQ ID NO: 118592 - DNA, 22 bp, Artificial Sequence
  chemically synthesized
aaatgtcattttaataatagtg

SEQ ID NO: 118593 - DNA, 22 bp, Artificial Sequence
  chemically synthesized
aatgtcattttaataatagtgt

SEQ ID NO: 118594 - DNA, 22 bp, Artificial Sequence
  chemically synthesized
taataatagtgtatcaaatgaa

SEQ ID NO: 118595 - DNA, 22 bp, Artificial Sequence
  chemically synthesized
aataatagtgtatcaaatgaat

SEQ ID NO: 118596 - DNA, 22 bp, Artificial Sequence
  chemically synthesized
ataatagtgtatcaaatgaata

SEQ ID NO: 118597 - DNA, 22 bp, Artificial Sequence
  chemically synthesized
tgatttatgtaatatttttatt

SEQ ID NO: 118598 - DNA, 22 bp, Artificial Sequence
  chemically synthesized
gatttatgtaatatttttattc

SEQ ID NO: 118599 - DNA, 22 bp, Artificial Sequence
  chemically synthesized
atttatgtaatatttttattct

SEQ ID NO: 118600 - DNA, 22 bp, Artificial Sequence
  chemically synthesized
atgtaatatttttattctagac

SEQ ID NO: 118601 - DNA, 22 bp, Artificial Sequence
  chemically synthesized
tgtaatatttttattctagaca

SEQ ID NO: 118602 - DNA, 22 bp, Artificial Sequence
  chemically synthesized
ttattctagacattttgtatgc

SEQ ID NO: 118603 - DNA, 22 bp, Artificial Sequence
  chemically synthesized
tattctagacattttgtatgct

SEQ ID NO: 118604 - DNA, 22 bp, Artificial Sequence
  chemically synthesized
attctagacattttgtatgctt

SEQ ID NO: 118605 - DNA, 22 bp, Artificial Sequence
  chemically synthesized
ttctagacattttgtatgctta

SEQ ID NO: 118606 - DNA, 22 bp, Artificial Sequence
  chemically synthesized
tagacattttgtatgcttacat

SEQ ID NO: 118607 - DNA, 22 bp, Artificial Sequence
  chemically synthesized
gacattttgtatgcttacattc

SEQ ID NO: 118608 - DNA, 22 bp, Artificial Sequence
  chemically synthesized
tgtatgcttacattcttaaaat

SEQ ID NO: 118609 - DNA, 22 bp, Artificial Sequence
  chemically synthesized
gtatgcttacattcttaaaatt

SEQ ID NO: 118610 - DNA, 22 bp, Artificial Sequence
  chemically synthesized
tatgcttacattcttaaaatta

SEQ ID NO: 118611 - DNA, 22 bp, Artificial Sequence
  chemically synthesized
acattcttaaaattatgaacaa

SEQ ID NO: 118612 - DNA, 22 bp, Artificial Sequence
  chemically synthesized
cattcttaaaattatgaacaat

SEQ ID NO: 118613 - DNA, 22 bp, Artificial Sequence
  chemically synthesized
ttaaaattatgaacaataacac

SEQ ID NO: 118614 - DNA, 22 bp, Artificial Sequence
  chemically synthesized
aaaattatgaacaataacacaa

SEQ ID NO: 118615 - DNA, 22 bp, Artificial Sequence
  chemically synthesized
aaattatgaacaataacacaaa

SEQ ID NO: 118616 - DNA, 22 bp, Artificial Sequence
  chemically synthesized
tgaacaataacacaaattataa

SEQ ID NO: 118617 - DNA, 22 bp, Artificial Sequence
  chemically synthesized
taatattcacttattaaatagt

SEQ ID NO: 118618 - DNA, 22 bp, Artificial Sequence
  chemically synthesized
acttattaaatagttcaacaca

SEQ ID NO: 118619 - DNA, 22 bp, Artificial Sequence
  chemically synthesized
attaaatagttcaacacatatt

SEQ ID NO: 118620 - DNA, 22 bp, Artificial Sequence
  chemically synthesized
ttaaatagttcaacacatattt

SEQ ID NO: 118621 - DNA, 22 bp, Artificial Sequence
  chemically synthesized
aatagttcaacacatatttatt

SEQ ID NO: 118622 - DNA, 22 bp, Artificial Sequence
  chemically synthesized
aacacatatttattgatcactg

SEQ ID NO: 118623 - DNA, 22 bp, Artificial Sequence
  chemically synthesized
attgatcactgacctaggagat

SEQ ID NO: 118624 - DNA, 22 bp, Artificial Sequence
  chemically synthesized
ttgatcactgacctaggagatg

SEQ ID NO: 118625 - DNA, 22 bp, Artificial Sequence
  chemically synthesized
atcactgacctaggagatggat

SEQ ID NO: 118626 - DNA, 22 bp, Artificial Sequence
  chemically synthesized
acctaggagatggatttagaac

SEQ ID NO: 118627 - DNA, 22 bp, Artificial Sequence
  chemically synthesized
ggagatggatttagaactgtga

SEQ ID NO: 118628 - DNA, 22 bp, Artificial Sequence
  chemically synthesized
agaactgtgagcaaacaggaaa

SEQ ID NO: 118629 - DNA, 22 bp, Artificial Sequence
  chemically synthesized
gaactgtgagcaaacaggaaaa

SEQ ID NO: 118630 - DNA, 22 bp, Artificial Sequence
  chemically synthesized
tgagcaaacaggaaaaaaattt

SEQ ID NO: 118631 - DNA, 22 bp, Artificial Sequence
  chemically synthesized
tgccacaaacagcttacatcct

SEQ ID NO: 118632 - DNA, 22 bp, Artificial Sequence
  chemically synthesized
gccacaaacagcttacatccta

SEQ ID NO: 118633 - DNA, 22 bp, Artificial Sequence
  chemically synthesized
ccacaaacagcttacatcctaa

SEQ ID NO: 118634 - DNA, 22 bp, Artificial Sequence
  chemically synthesized
acatcctaaatttttaatttat

SEQ ID NO: 118635 - DNA, 22 bp, Artificial Sequence
  chemically synthesized
catcctaaatttttaatttatc

SEQ ID NO: 118636 - DNA, 22 bp, Artificial Sequence
  chemically synthesized
aatttttaatttatcatttatt

SEQ ID NO: 118637 - DNA, 22 bp, Artificial Sequence
  chemically synthesized
ttaatttatcatttatttagga

SEQ ID NO: 118638 - DNA, 22 bp, Artificial Sequence
  chemically synthesized
taatttatcatttatttaggac

SEQ ID NO: 118639 - DNA, 22 bp, Artificial Sequence
  chemically synthesized
aatttatcatttatttaggaca

SEQ ID NO: 118640 - DNA, 22 bp, Artificial Sequence
  chemically synthesized
atttatcatttatttaggacag

SEQ ID NO: 118641 - DNA, 22 bp, Artificial Sequence
  chemically synthesized
atcatttatttaggacagattt

SEQ ID NO: 118642 - DNA, 22 bp, Artificial Sequence
  chemically synthesized
tcatttatttaggacagatttt

SEQ ID NO: 118643 - DNA, 22 bp, Artificial Sequence
  chemically synthesized
atttaggacagatttttagaag

SEQ ID NO: 118644 - DNA, 22 bp, Artificial Sequence
  chemically synthesized
tttaggacagatttttagaagt

SEQ ID NO: 118645 - DNA, 22 bp, Artificial Sequence
  chemically synthesized
aggacagatttttagaagtggc

SEQ ID NO: 118646 - DNA, 22 bp, Artificial Sequence
  chemically synthesized
ggacagatttttagaagtggca

SEQ ID NO: 118647 - DNA, 22 bp, Artificial Sequence
  chemically synthesized
ttagaagtggcatttctgagac

SEQ ID NO: 118648 - DNA, 22 bp, Artificial Sequence
  chemically synthesized
tagaagtggcatttctgagaca

SEQ ID NO: 118649 - DNA, 22 bp, Artificial Sequence
  chemically synthesized
agaagtggcatttctgagacac

SEQ ID NO: 118650 - DNA, 22 bp, Artificial Sequence
  chemically synthesized
gaagtggcatttctgagacaca

SEQ ID NO: 118651 - DNA, 22 bp, Artificial Sequence
  chemically synthesized
ctgagacacagagcatgaatat

SEQ ID NO: 118652 - DNA, 22 bp, Artificial Sequence
  chemically synthesized
tgagacacagagcatgaatatt

SEQ ID NO: 118653 - DNA, 22 bp, Artificial Sequence
  chemically synthesized
agacacagagcatgaatatttt

SEQ ID NO: 118654 - DNA, 22 bp, Artificial Sequence
  chemically synthesized
tcaagtcttttgatgtattttg

SEQ ID NO: 118655 - DNA, 22 bp, Artificial Sequence
  chemically synthesized
caagtcttttgatgtattttgt

SEQ ID NO: 118656 - DNA, 22 bp, Artificial Sequence
  chemically synthesized
aagtcttttgatgtattttgtt

SEQ ID NO: 118657 - DNA, 22 bp, Artificial Sequence
  chemically synthesized
ttgatgtattttgttttttata

SEQ ID NO: 118658 - DNA, 22 bp, Artificial Sequence
  chemically synthesized
tgatgtattttgttttttataa

SEQ ID NO: 118659 - DNA, 22 bp, Artificial Sequence
  chemically synthesized
gatgtattttgttttttataaa

SEQ ID NO: 118660 - DNA, 22 bp, Artificial Sequence
  chemically synthesized
atgtattttgttttttataaaa

SEQ ID NO: 118661 - DNA, 22 bp, Artificial Sequence
  chemically synthesized
tgttttttataaaaggcaaatt

SEQ ID NO: 118662 - DNA, 22 bp, Artificial Sequence
  chemically synthesized
gttttttataaaaggcaaatta

SEQ ID NO: 118663 - DNA, 22 bp, Artificial Sequence
  chemically synthesized
ttttttataaaaggcaaattaa

SEQ ID NO: 118664 - DNA, 22 bp, Artificial Sequence
  chemically synthesized
tttataaaaggcaaattaaatt

SEQ ID NO: 118665 - DNA, 22 bp, Artificial Sequence
  chemically synthesized
ttataaaaggcaaattaaatta

SEQ ID NO: 118666 - DNA, 22 bp, Artificial Sequence
  chemically synthesized
tataaaaggcaaattaaattat

SEQ ID NO: 118667 - DNA, 22 bp, Artificial Sequence
  chemically synthesized
ataaaaggcaaattaaattatg

SEQ ID NO: 118668 - DNA, 22 bp, Artificial Sequence
  chemically synthesized
taaaaggcaaattaaattatgt

SEQ ID NO: 118669 - DNA, 22 bp, Artificial Sequence
  chemically synthesized
aattatgttttcattctggtat

SEQ ID NO: 118670 - DNA, 22 bp, Artificial Sequence
  chemically synthesized
tgttttcattctggtatgtgaa

SEQ ID NO: 118671 - DNA, 22 bp, Artificial Sequence
  chemically synthesized
tcattctggtatgtgaaaatac

SEQ ID NO: 118672 - DNA, 22 bp, Artificial Sequence
  chemically synthesized
cattctggtatgtgaaaatacc

SEQ ID NO: 118673 - DNA, 22 bp, Artificial Sequence
  chemically synthesized
attctggtatgtgaaaatacct

SEQ ID NO: 118674 - DNA, 22 bp, Artificial Sequence
  chemically synthesized
tggtatgtgaaaatacctcttt

SEQ ID NO: 118675 - DNA, 22 bp, Artificial Sequence
  chemically synthesized
gtatgtgaaaatacctctttta

SEQ ID NO: 118676 - DNA, 22 bp, Artificial Sequence
  chemically synthesized
ttttaccacatacttaacagca

SEQ ID NO: 118677 - DNA, 22 bp, Artificial Sequence
  chemically synthesized
ttaccacatacttaacagcaca

SEQ ID NO: 118678 - DNA, 22 bp, Artificial Sequence
  chemically synthesized
taccacatacttaacagcacag

SEQ ID NO: 118679 - DNA, 22 bp, Artificial Sequence
  chemically synthesized
accacatacttaacagcacaga

SEQ ID NO: 118680 - DNA, 22 bp, Artificial Sequence
  chemically synthesized
ccacatacttaacagcacagat

SEQ ID NO: 118681 - DNA, 22 bp, Artificial Sequence
  chemically synthesized
aacagcacagatatttatttat

SEQ ID NO: 118682 - DNA, 22 bp, Artificial Sequence
  chemically synthesized
acagcacagatatttatttatt

SEQ ID NO: 118683 - DNA, 22 bp, Artificial Sequence
  chemically synthesized
atttatttttctttttttttgt

SEQ ID NO: 118684 - DNA, 22 bp, Artificial Sequence
  chemically synthesized
tttatttttctttttttttgtt

SEQ ID NO: 118685 - DNA, 22 bp, Artificial Sequence
  chemically synthesized
atttttctttttttttgttttt

SEQ ID NO: 118686 - DNA, 22 bp, Artificial Sequence
  chemically synthesized
tttttctttttttttgtttttg

SEQ ID NO: 118687 - DNA, 22 bp, Artificial Sequence
  chemically synthesized
ttctttttttttgtttttgaga

SEQ ID NO: 118688 - DNA, 22 bp, Artificial Sequence
  chemically synthesized
tctttttttttgtttttgagaa

SEQ ID NO: 118689 - DNA, 22 bp, Artificial Sequence
  chemically synthesized
ctttttttttgtttttgagaag

SEQ ID NO: 118690 - DNA, 22 bp, Artificial Sequence
  chemically synthesized
tttttttttgtttttgagaagg

SEQ ID NO: 118691 - DNA, 22 bp, Artificial Sequence
  chemically synthesized
tttttttgtttttgagaaggag

SEQ ID NO: 118692 - DNA, 22 bp, Artificial Sequence
  chemically synthesized
ttttttgtttttgagaaggagt

SEQ ID NO: 118693 - DNA, 22 bp, Artificial Sequence
  chemically synthesized
tttttgtttttgagaaggagtc

SEQ ID NO: 118694 - DNA, 22 bp, Artificial Sequence
  chemically synthesized
ttttgtttttgagaaggagtct

SEQ ID NO: 118695 - DNA, 22 bp, Artificial Sequence
  chemically synthesized
tttgtttttgagaaggagtctt

SEQ ID NO: 118696 - DNA, 22 bp, Artificial Sequence
  chemically synthesized
ttgtttttgagaaggagtcttg

SEQ ID NO: 118697 - DNA, 22 bp, Artificial Sequence
  chemically synthesized
tgtttttgagaaggagtcttgc

SEQ ID NO: 118698 - DNA, 22 bp, Artificial Sequence
  chemically synthesized
gtttttgagaaggagtcttgct

SEQ ID NO: 118699 - DNA, 22 bp, Artificial Sequence
  chemically synthesized
tttttgagaaggagtcttgctc

SEQ ID NO: 118700 - DNA, 22 bp, Artificial Sequence
  chemically synthesized
ttgagaaggagtcttgctctgt

SEQ ID NO: 118701 - DNA, 22 bp, Artificial Sequence
  chemically synthesized
tgagaaggagtcttgctctgtt

SEQ ID NO: 118702 - DNA, 22 bp, Artificial Sequence
  chemically synthesized
gagaaggagtcttgctctgttg

SEQ ID NO: 118703 - DNA, 22 bp, Artificial Sequence
  chemically synthesized
agaaggagtcttgctctgttgc

SEQ ID NO: 118704 - DNA, 22 bp, Artificial Sequence
  chemically synthesized
gctctgttgcccaggctggagt

SEQ ID NO: 118705 - DNA, 22 bp, Artificial Sequence
  chemically synthesized
ctctgttgcccaggctggagtg

SEQ ID NO: 118706 - DNA, 22 bp, Artificial Sequence
  chemically synthesized
tgttgcccaggctggagtgcag

SEQ ID NO: 118707 - DNA, 22 bp, Artificial Sequence
  chemically synthesized
ttgcccaggctggagtgcagtg

SEQ ID NO: 118708 - DNA, 22 bp, Artificial Sequence
  chemically synthesized
cccaggctggagtgcagtggca

SEQ ID NO: 118709 - DNA, 22 bp, Artificial Sequence
  chemically synthesized
gagtgcagtggcacgatctcgg

SEQ ID NO: 118710 - DNA, 22 bp, Artificial Sequence
  chemically synthesized
ggctcactgcaagctccacctc

SEQ ID NO: 118711 - DNA, 22 bp, Artificial Sequence
  chemically synthesized
actgcaagctccacctcctggg

SEQ ID NO: 118712 - DNA, 22 bp, Artificial Sequence
  chemically synthesized
caagctccacctcctgggttca

SEQ ID NO: 118713 - DNA, 22 bp, Artificial Sequence
  chemically synthesized
cacctcctgggttcacgccatt

SEQ ID NO: 118714 - DNA, 22 bp, Artificial Sequence
  chemically synthesized
ctgggttcacgccattctgctg

SEQ ID NO: 118715 - DNA, 22 bp, Artificial Sequence
  chemically synthesized
ggttcacgccattctgctgccc

SEQ ID NO: 118716 - DNA, 22 bp, Artificial Sequence
  chemically synthesized
acgccattctgctgccccagcc

SEQ ID NO: 118717 - DNA, 22 bp, Artificial Sequence
  chemically synthesized
tgctgccccagcctcctgagta

SEQ ID NO: 118718 - DNA, 22 bp, Artificial Sequence
  chemically synthesized
ctgccccagcctcctgagtagc

SEQ ID NO: 118719 - DNA, 22 bp, Artificial Sequence
  chemically synthesized
ccccagcctcctgagtagctgg

SEQ ID NO: 118720 - DNA, 22 bp, Artificial Sequence
  chemically synthesized
ctgagtagctgggactacaggt

SEQ ID NO: 118721 - DNA, 22 bp, Artificial Sequence
  chemically synthesized
agtagctgggactacaggtgcc

SEQ ID NO: 118722 - DNA, 22 bp, Artificial Sequence
  chemically synthesized
ggactacaggtgcccaccacca

SEQ ID NO: 118723 - DNA, 22 bp, Artificial Sequence
  chemically synthesized
caggtgcccaccaccatgcccg

SEQ ID NO: 118724 - DNA, 22 bp, Artificial Sequence
  chemically synthesized
actttttgtatttttagtagag

SEQ ID NO: 118725 - DNA, 22 bp, Artificial Sequence
  chemically synthesized
tttgtatttttagtagagactg

SEQ ID NO: 118726 - DNA, 22 bp, Artificial Sequence
  chemically synthesized
ttgtatttttagtagagactgg

SEQ ID NO: 118727 - DNA, 22 bp, Artificial Sequence
  chemically synthesized
tgtatttttagtagagactggg

SEQ ID NO: 118728 - DNA, 22 bp, Artificial Sequence
  chemically synthesized
gtatttttagtagagactgggt

SEQ ID NO: 118729 - DNA, 22 bp, Artificial Sequence
  chemically synthesized
tatttttagtagagactgggtt

SEQ ID NO: 118730 - DNA, 22 bp, Artificial Sequence
  chemically synthesized
ttagtagagactgggttccacc

SEQ ID NO: 118731 - DNA, 22 bp, Artificial Sequence
  chemically synthesized
tagtagagactgggttccaccg

SEQ ID NO: 118732 - DNA, 22 bp, Artificial Sequence
  chemically synthesized
agtagagactgggttccaccgt

SEQ ID NO: 118733 - DNA, 22 bp, Artificial Sequence
  chemically synthesized
gtagagactgggttccaccgtg

SEQ ID NO: 118734 - DNA, 22 bp, Artificial Sequence
  chemically synthesized
ggttccaccgtgttagccagga

SEQ ID NO: 118735 - DNA, 22 bp, Artificial Sequence
  chemically synthesized
caccgtgttagccaggatggtc

SEQ ID NO: 118736 - DNA, 22 bp, Artificial Sequence
  chemically synthesized
gccaggatggtctcgatctcct

SEQ ID NO: 118737 - DNA, 22 bp, Artificial Sequence
  chemically synthesized
gatctcctgacctcgtgatcca

SEQ ID NO: 118738 - DNA, 22 bp, Artificial Sequence
  chemically synthesized
ctgacctcgtgatccacccgcc

SEQ ID NO: 118739 - DNA, 22 bp, Artificial Sequence
  chemically synthesized
acctcgtgatccacccgcctcg

SEQ ID NO: 118740 - DNA, 22 bp, Artificial Sequence
  chemically synthesized
gtgatccacccgcctcggcctc

SEQ ID NO: 118741 - DNA, 22 bp, Artificial Sequence
  chemically synthesized
ggcctcccagagtgctgggatt

SEQ ID NO: 118742 - DNA, 22 bp, Artificial Sequence
  chemically synthesized
ccagagtgctgggattacaggc

SEQ ID NO: 118743 - DNA, 22 bp, Artificial Sequence
  chemically synthesized
ggattacaggcgtgagccaccg

SEQ ID NO: 118744 - DNA, 22 bp, Artificial Sequence
  chemically synthesized
caggcgtgagccaccgcgccca

SEQ ID NO: 118745 - DNA, 22 bp, Artificial Sequence
  chemically synthesized
attgttaactctattcttcaat

SEQ ID NO: 118746 - DNA, 22 bp, Artificial Sequence
  chemically synthesized
ttaactctattcttcaatattc

SEQ ID NO: 118747 - DNA, 22 bp, Artificial Sequence
  chemically synthesized
actctattcttcaatattcgtt

SEQ ID NO: 118748 - DNA, 22 bp, Artificial Sequence
  chemically synthesized
tattcttcaatattcgtttagt

SEQ ID NO: 118749 - DNA, 22 bp, Artificial Sequence
  chemically synthesized
ttcttcaatattcgtttagtaa

SEQ ID NO: 118750 - DNA, 22 bp, Artificial Sequence
  chemically synthesized
ttcaatattcgtttagtaacaa

SEQ ID NO: 118751 - DNA, 22 bp, Artificial Sequence
  chemically synthesized
caatattcgtttagtaacaaat

SEQ ID NO: 118752 - DNA, 22 bp, Artificial Sequence
  chemically synthesized
aatattcgtttagtaacaaatt

SEQ ID NO: 118753 - DNA, 22 bp, Artificial Sequence
  chemically synthesized
gtttagtaacaaattaagatat

SEQ ID NO: 118754 - DNA, 22 bp, Artificial Sequence
  chemically synthesized
agtaacaaattaagatatgtta

SEQ ID NO: 118755 - DNA, 22 bp, Artificial Sequence
  chemically synthesized
gtaacaaattaagatatgttaa

SEQ ID NO: 118756 - DNA, 22 bp, Artificial Sequence
  chemically synthesized
agatatgttaatttgcatttta

SEQ ID NO: 118757 - DNA, 22 bp, Artificial Sequence
  chemically synthesized
atttgcattttaaatttgagta

SEQ ID NO: 118758 - DNA, 22 bp, Artificial Sequence
  chemically synthesized
gcattttaaatttgagtaaggt

SEQ ID NO: 118759 - DNA, 22 bp, Artificial Sequence
  chemically synthesized
cattttaaatttgagtaaggta

SEQ ID NO: 118760 - DNA, 22 bp, Artificial Sequence
  chemically synthesized
taaatttgagtaaggtagaagt

SEQ ID NO: 118761 - DNA, 22 bp, Artificial Sequence
  chemically synthesized
aaatttgagtaaggtagaagtt

SEQ ID NO: 118762 - DNA, 22 bp, Artificial Sequence
  chemically synthesized
aatttgagtaaggtagaagttt

SEQ ID NO: 118763 - DNA, 22 bp, Artificial Sequence
  chemically synthesized
gagtaaggtagaagttttcaaa

SEQ ID NO: 118764 - DNA, 22 bp, Artificial Sequence
  chemically synthesized
agtaaggtagaagttttcaaat

SEQ ID NO: 118765 - DNA, 22 bp, Artificial Sequence
  chemically synthesized
tcaaatatgttattacctgtac

SEQ ID NO: 118766 - DNA, 22 bp, Artificial Sequence
  chemically synthesized
caaatatgttattacctgtacg

SEQ ID NO: 118767 - DNA, 22 bp, Artificial Sequence
  chemically synthesized
aaatatgttattacctgtacgt

SEQ ID NO: 118768 - DNA, 22 bp, Artificial Sequence
  chemically synthesized
ttacctgtacgtatttcctaat

SEQ ID NO: 118769 - DNA, 22 bp, Artificial Sequence
  chemically synthesized
cctgtacgtatttcctaatttg

SEQ ID NO: 118770 - DNA, 22 bp, Artificial Sequence
  chemically synthesized
tacgtatttcctaatttgaaaa

SEQ ID NO: 118771 - DNA, 22 bp, Artificial Sequence
  chemically synthesized
cctaatttgaaaatgaaattta

SEQ ID NO: 118772 - DNA, 22 bp, Artificial Sequence
  chemically synthesized
ctaatttgaaaatgaaatttag

SEQ ID NO: 118773 - DNA, 22 bp, Artificial Sequence
  chemically synthesized
atttgaaaatgaaatttagatg

SEQ ID NO: 118774 - DNA, 22 bp, Artificial Sequence
  chemically synthesized
gaaaatgaaatttagatgtcag

SEQ ID NO: 118775 - DNA, 22 bp, Artificial Sequence
  chemically synthesized
aaaatgaaatttagatgtcagt

SEQ ID NO: 118776 - DNA, 22 bp, Artificial Sequence
  chemically synthesized
agatgtcagtggtctatttgtt

SEQ ID NO: 118777 - DNA, 22 bp, Artificial Sequence
  chemically synthesized
gatgtcagtggtctatttgtta

SEQ ID NO: 118778 - DNA, 22 bp, Artificial Sequence
  chemically synthesized
tttgttaataagaggcaaaatg

SEQ ID NO: 118779 - DNA, 22 bp, Artificial Sequence
  chemically synthesized
gttaataagaggcaaaatggga

SEQ ID NO: 118780 - DNA, 22 bp, Artificial Sequence
  chemically synthesized
ttaataagaggcaaaatgggac

SEQ ID NO: 118781 - DNA, 22 bp, Artificial Sequence
  chemically synthesized
ataagaggcaaaatgggacttc

SEQ ID NO: 118782 - DNA, 22 bp, Artificial Sequence
  chemically synthesized
cagtgctaatctaaatccaaat

SEQ ID NO: 118783 - DNA, 22 bp, Artificial Sequence
  chemically synthesized
agtgctaatctaaatccaaatc

SEQ ID NO: 118784 - DNA, 22 bp, Artificial Sequence
  chemically synthesized
atctaaatccaaatcctaaatt

SEQ ID NO: 118785 - DNA, 22 bp, Artificial Sequence
  chemically synthesized
aatccaaatcctaaattttttg

SEQ ID NO: 118786 - DNA, 22 bp, Artificial Sequence
  chemically synthesized
aattttttgtaccccattctac

SEQ ID NO: 118787 - DNA, 22 bp, Artificial Sequence
  chemically synthesized
tttgtaccccattctaccaaat

SEQ ID NO: 118788 - DNA, 22 bp, Artificial Sequence
  chemically synthesized
ttgtaccccattctaccaaatg

SEQ ID NO: 118789 - DNA, 22 bp, Artificial Sequence
  chemically synthesized
tgtaccccattctaccaaatga

SEQ ID NO: 118790 - DNA, 22 bp, Artificial Sequence
  chemically synthesized
gtaccccattctaccaaatgag

SEQ ID NO: 118791 - DNA, 22 bp, Artificial Sequence
  chemically synthesized
taccccattctaccaaatgaga

SEQ ID NO: 118792 - DNA, 22 bp, Artificial Sequence
  chemically synthesized
taccaaatgagatctatagaat

SEQ ID NO: 118793 - DNA, 22 bp, Artificial Sequence
  chemically synthesized
ccaaatgagatctatagaatag

SEQ ID NO: 118794 - DNA, 22 bp, Artificial Sequence
  chemically synthesized
tagaataggaatttcctctcaa

SEQ ID NO: 118795 - DNA, 22 bp, Artificial Sequence
  chemically synthesized
cctctcaacatggagaagaata

SEQ ID NO: 118796 - DNA, 22 bp, Artificial Sequence
  chemically synthesized
ctctcaacatggagaagaatat

SEQ ID NO: 118797 - DNA, 22 bp, Artificial Sequence
  chemically synthesized
tcaacatggagaagaatattct

SEQ ID NO: 118798 - DNA, 22 bp, Artificial Sequence
  chemically synthesized
aacatggagaagaatattctaa

SEQ ID NO: 118799 - DNA, 22 bp, Artificial Sequence
  chemically synthesized
taagtctcggaactgctattga

SEQ ID NO: 118800 - DNA, 22 bp, Artificial Sequence
  chemically synthesized
agtctcggaactgctattgagt

SEQ ID NO: 118801 - DNA, 22 bp, Artificial Sequence
  chemically synthesized
ggaactgctattgagtaatgtg

SEQ ID NO: 118802 - DNA, 22 bp, Artificial Sequence
  chemically synthesized
ctattgagtaatgtggcctact

SEQ ID NO: 118803 - DNA, 22 bp, Artificial Sequence
  chemically synthesized
ttgagtaatgtggcctactatg

SEQ ID NO: 118804 - DNA, 22 bp, Artificial Sequence
  chemically synthesized
agtaatgtggcctactatgtgg

SEQ ID NO: 118805 - DNA, 22 bp, Artificial Sequence
  chemically synthesized
ctatgtggatgtaaattaaagt

SEQ ID NO: 118806 - DNA, 22 bp, Artificial Sequence
  chemically synthesized
tgtggatgtaaattaaagttta

SEQ ID NO: 118807 - DNA, 22 bp, Artificial Sequence
  chemically synthesized
aagtttagaatggaacctatgt

SEQ ID NO: 118808 - DNA, 22 bp, Artificial Sequence
  chemically synthesized
agaatggaacctatgtttaagg

SEQ ID NO: 118809 - DNA, 22 bp, Artificial Sequence
  chemically synthesized
gaatggaacctatgtttaagga

SEQ ID NO: 118810 - DNA, 22 bp, Artificial Sequence
  chemically synthesized
tgtttaaggagtgccagcctgt

SEQ ID NO: 118811 - DNA, 22 bp, Artificial Sequence
  chemically synthesized
aaggagtgccagcctgtaaggc

SEQ ID NO: 118812 - DNA, 22 bp, Artificial Sequence
  chemically synthesized
aggagtgccagcctgtaaggct

SEQ ID NO: 118813 - DNA, 22 bp, Artificial Sequence
  chemically synthesized
taaggctgcagaaactgctggg

SEQ ID NO: 118814 - DNA, 22 bp, Artificial Sequence
  chemically synthesized
cagaaactgctgggttccagag

SEQ ID NO: 118815 - DNA, 22 bp, Artificial Sequence
  chemically synthesized
ctgggttccagaggggctccca

SEQ ID NO: 118816 - DNA, 22 bp, Artificial Sequence
  chemically synthesized
ggttccagaggggctcccaagc

SEQ ID NO: 118817 - DNA, 22 bp, Artificial Sequence
  chemically synthesized
cagaggggctcccaagcctgag

SEQ ID NO: 118818 - DNA, 22 bp, Artificial Sequence
  chemically synthesized
ccaagcctgagagtctgataac

SEQ ID NO: 118819 - DNA, 22 bp, Artificial Sequence
  chemically synthesized
agagtctgataacacccacaca

SEQ ID NO: 118820 - DNA, 22 bp, Artificial Sequence
  chemically synthesized
ataacacccacacatacaaaca

SEQ ID NO: 118821 - DNA, 22 bp, Artificial Sequence
  chemically synthesized
ttagagtttggttcttttttaa

SEQ ID NO: 118822 - DNA, 22 bp, Artificial Sequence
  chemically synthesized
tagagtttggttcttttttaaa

SEQ ID NO: 118823 - DNA, 22 bp, Artificial Sequence
  chemically synthesized
agagtttggttcttttttaaat

SEQ ID NO: 118824 - DNA, 22 bp, Artificial Sequence
  chemically synthesized
gagtttggttcttttttaaatt

SEQ ID NO: 118825 - DNA, 22 bp, Artificial Sequence
  chemically synthesized
ggttcttttttaaatttcgctt

SEQ ID NO: 118826 - DNA, 22 bp, Artificial Sequence
  chemically synthesized
gttcttttttaaatttcgcttt

SEQ ID NO: 118827 - DNA, 22 bp, Artificial Sequence
  chemically synthesized
ttttttaaatttcgctttgtaa

SEQ ID NO: 118828 - DNA, 22 bp, Artificial Sequence
  chemically synthesized
ttttaaatttcgctttgtaatt

SEQ ID NO: 118829 - DNA, 22 bp, Artificial Sequence
  chemically synthesized
tttaaatttcgctttgtaattt

SEQ ID NO: 118830 - DNA, 22 bp, Artificial Sequence
  chemically synthesized
ttaaatttcgctttgtaatttt

SEQ ID NO: 118831 - DNA, 22 bp, Artificial Sequence
  chemically synthesized
taaatttcgctttgtaattttg

SEQ ID NO: 118832 - DNA, 22 bp, Artificial Sequence
  chemically synthesized
aaatttcgctttgtaattttgt

SEQ ID NO: 118833 - DNA, 22 bp, Artificial Sequence
  chemically synthesized
aatttcgctttgtaattttgtt

SEQ ID NO: 118834 - DNA, 22 bp, Artificial Sequence
  chemically synthesized
cgctttgtaattttgtttgttt

SEQ ID NO: 118835 - DNA, 22 bp, Artificial Sequence
  chemically synthesized
gctttgtaattttgtttgtttt

SEQ ID NO: 118836 - DNA, 22 bp, Artificial Sequence
  chemically synthesized
tgtaattttgtttgttttcctt

SEQ ID NO: 118837 - DNA, 22 bp, Artificial Sequence
  chemically synthesized
gtaattttgtttgttttccttt

SEQ ID NO: 118838 - DNA, 22 bp, Artificial Sequence
  chemically synthesized
taattttgtttgttttcctttt

SEQ ID NO: 118839 - DNA, 22 bp, Artificial Sequence
  chemically synthesized
tgtttgttttcctttttatttt

SEQ ID NO: 118840 - DNA, 22 bp, Artificial Sequence
  chemically synthesized
gtttgttttcctttttattttt

SEQ ID NO: 118841 - DNA, 22 bp, Artificial Sequence
  chemically synthesized
tttgttttcctttttatttttg

SEQ ID NO: 118842 - DNA, 22 bp, Artificial Sequence
  chemically synthesized
gttttcctttttatttttgaat

SEQ ID NO: 118843 - DNA, 22 bp, Artificial Sequence
  chemically synthesized
ttttcctttttatttttgaatc

SEQ ID NO: 118844 - DNA, 22 bp, Artificial Sequence
  chemically synthesized
tcctttttatttttgaatcggg

SEQ ID NO: 118845 - DNA, 22 bp, Artificial Sequence
  chemically synthesized
cctttttatttttgaatcgggg

SEQ ID NO: 118846 - DNA, 22 bp, Artificial Sequence
  chemically synthesized
ctttttatttttgaatcggggt

SEQ ID NO: 118847 - DNA, 22 bp, Artificial Sequence
  chemically synthesized
tttatttttgaatcggggtctc

SEQ ID NO: 118848 - DNA, 22 bp, Artificial Sequence
  chemically synthesized
ttatttttgaatcggggtctca

SEQ ID NO: 118849 - DNA, 22 bp, Artificial Sequence
  chemically synthesized
tatttttgaatcggggtctcac

SEQ ID NO: 118850 - DNA, 22 bp, Artificial Sequence
  chemically synthesized
atttttgaatcggggtctcact

SEQ ID NO: 118851 - DNA, 22 bp, Artificial Sequence
  chemically synthesized
tttttgaatcggggtctcactt

SEQ ID NO: 118852 - DNA, 22 bp, Artificial Sequence
  chemically synthesized
ttgaatcggggtctcacttggt

SEQ ID NO: 118853 - DNA, 22 bp, Artificial Sequence
  chemically synthesized
tgaatcggggtctcacttggtc

SEQ ID NO: 118854 - DNA, 22 bp, Artificial Sequence
  chemically synthesized
gaatcggggtctcacttggtca

SEQ ID NO: 118855 - DNA, 22 bp, Artificial Sequence
  chemically synthesized
aatcggggtctcacttggtcac

SEQ ID NO: 118856 - DNA, 22 bp, Artificial Sequence
  chemically synthesized
acttggtcacccaggcagtagt

SEQ ID NO: 118857 - DNA, 22 bp, Artificial Sequence
  chemically synthesized
ggtcacccaggcagtagtgtga

SEQ ID NO: 118858 - DNA, 22 bp, Artificial Sequence
  chemically synthesized
gtcacccaggcagtagtgtgat

SEQ ID NO: 118859 - DNA, 22 bp, Artificial Sequence
  chemically synthesized
tggctcactgcagcctcaacct

SEQ ID NO: 118860 - DNA, 22 bp, Artificial Sequence
  chemically synthesized
actgcagcctcaacctcctggg

SEQ ID NO: 118861 - DNA, 22 bp, Artificial Sequence
  chemically synthesized
cagcctcaacctcctgggctca

SEQ ID NO: 118862 - DNA, 22 bp, Artificial Sequence
  chemically synthesized
aacctcctgggctcaagcattc

SEQ ID NO: 118863 - DNA, 22 bp, Artificial Sequence
  chemically synthesized
ctgggctcaagcattcttccca

SEQ ID NO: 118864 - DNA, 22 bp, Artificial Sequence
  chemically synthesized
ggctcaagcattcttcccacct

SEQ ID NO: 118865 - DNA, 22 bp, Artificial Sequence
  chemically synthesized
aagcattcttcccacctcagcc

SEQ ID NO: 118866 - DNA, 22 bp, Artificial Sequence
  chemically synthesized
ttcccacctcagcctcccaggt

SEQ ID NO: 118867 - DNA, 22 bp, Artificial Sequence
  chemically synthesized
cccacctcagcctcccaggtag

SEQ ID NO: 118868 - DNA, 22 bp, Artificial Sequence
  chemically synthesized
ccacctcagcctcccaggtagc

SEQ ID NO: 118869 - DNA, 22 bp, Artificial Sequence
  chemically synthesized
agcctcccaggtagctgagact

SEQ ID NO: 118870 - DNA, 22 bp, Artificial Sequence
  chemically synthesized
ccaggtagctgagactacagac

SEQ ID NO: 118871 - DNA, 22 bp, Artificial Sequence
  chemically synthesized
agactacagacgtgcaccgcca

SEQ ID NO: 118872 - DNA, 22 bp, Artificial Sequence
  chemically synthesized
cagacgtgcaccgccacacatg

SEQ ID NO: 118873 - DNA, 22 bp, Artificial Sequence
  chemically synthesized
attttaattttttttgtagaga

SEQ ID NO: 118874 - DNA, 22 bp, Artificial Sequence
  chemically synthesized
taattttttttgtagagatagg

SEQ ID NO: 118875 - DNA, 22 bp, Artificial Sequence
  chemically synthesized
aattttttttgtagagataggg

SEQ ID NO: 118876 - DNA, 22 bp, Artificial Sequence
  chemically synthesized
attttttttgtagagatagggt

SEQ ID NO: 118877 - DNA, 22 bp, Artificial Sequence
  chemically synthesized
tttttgtagagatagggtcttg

SEQ ID NO: 118878 - DNA, 22 bp, Artificial Sequence
  chemically synthesized
ttttgtagagatagggtcttgc

SEQ ID NO: 118879 - DNA, 22 bp, Artificial Sequence
  chemically synthesized
tttgtagagatagggtcttgct

SEQ ID NO: 118880 - DNA, 22 bp, Artificial Sequence
  chemically synthesized
ttgtagagatagggtcttgctg

SEQ ID NO: 118881 - DNA, 22 bp, Artificial Sequence
  chemically synthesized
tgtagagatagggtcttgctgt

SEQ ID NO: 118882 - DNA, 22 bp, Artificial Sequence
  chemically synthesized
gtagagatagggtcttgctgta

SEQ ID NO: 118883 - DNA, 22 bp, Artificial Sequence
  chemically synthesized
tagagatagggtcttgctgtat

SEQ ID NO: 118884 - DNA, 22 bp, Artificial Sequence
  chemically synthesized
gctgtattgttcaggctggtct

SEQ ID NO: 118885 - DNA, 22 bp, Artificial Sequence
  chemically synthesized
ctgtattgttcaggctggtctc

SEQ ID NO: 118886 - DNA, 22 bp, Artificial Sequence
  chemically synthesized
tattgttcaggctggtctcaaa

SEQ ID NO: 118887 - DNA, 22 bp, Artificial Sequence
  chemically synthesized
ttcaggctggtctcaaactcct

SEQ ID NO: 118888 - DNA, 22 bp, Artificial Sequence
  chemically synthesized
aggctggtctcaaactcctgga

SEQ ID NO: 118889 - DNA, 22 bp, Artificial Sequence
  chemically synthesized
gtctcaaactcctggactcaag

SEQ ID NO: 118890 - DNA, 22 bp, Artificial Sequence
  chemically synthesized
aaactcctggactcaagtaatc

SEQ ID NO: 118891 - DNA, 22 bp, Artificial Sequence
  chemically synthesized
ctggactcaagtaatcttcttg

SEQ ID NO: 118892 - DNA, 22 bp, Artificial Sequence
  chemically synthesized
gactcaagtaatcttcttgcct

SEQ ID NO: 118893 - DNA, 22 bp, Artificial Sequence
  chemically synthesized
aagtaatcttcttgcctgaagt

SEQ ID NO: 118894 - DNA, 22 bp, Artificial Sequence
  chemically synthesized
cttgcctgaagttggtctcaaa

SEQ ID NO: 118895 - DNA, 22 bp, Artificial Sequence
  chemically synthesized
ttgcctgaagttggtctcaaac

SEQ ID NO: 118896 - DNA, 22 bp, Artificial Sequence
  chemically synthesized
gcctgaagttggtctcaaactc

SEQ ID NO: 118897 - DNA, 22 bp, Artificial Sequence
  chemically synthesized
cctgaagttggtctcaaactcc

SEQ ID NO: 118898 - DNA, 22 bp, Artificial Sequence
  chemically synthesized
aagttggtctcaaactcctggc

SEQ ID NO: 118899 - DNA, 22 bp, Artificial Sequence
  chemically synthesized
gtctcaaactcctggccttcag

SEQ ID NO: 118900 - DNA, 22 bp, Artificial Sequence
  chemically synthesized
aaactcctggccttcagcaatc

SEQ ID NO: 118901 - DNA, 22 bp, Artificial Sequence
  chemically synthesized
ctggccttcagcaatcctccca

SEQ ID NO: 118902 - DNA, 22 bp, Artificial Sequence
  chemically synthesized
gccttcagcaatcctcccacct

SEQ ID NO: 118903 - DNA, 22 bp, Artificial Sequence
  chemically synthesized
cagcaatcctcccaccttggtc

SEQ ID NO: 118904 - DNA, 22 bp, Artificial Sequence
  chemically synthesized
agcaatcctcccaccttggtct

SEQ ID NO: 118905 - DNA, 22 bp, Artificial Sequence
  chemically synthesized
ccaccttggtctcccaaagtgc

SEQ ID NO: 118906 - DNA, 22 bp, Artificial Sequence
  chemically synthesized
ggtctcccaaagtgctgggatt

SEQ ID NO: 118907 - DNA, 22 bp, Artificial Sequence
  chemically synthesized
gtctcccaaagtgctgggatta

SEQ ID NO: 118908 - DNA, 22 bp, Artificial Sequence
  chemically synthesized
ccaaagtgctgggattatagca

SEQ ID NO: 118909 - DNA, 22 bp, Artificial Sequence
  chemically synthesized
ggattatagcataagccaccgt

SEQ ID NO: 118910 - DNA, 22 bp, Artificial Sequence
  chemically synthesized
tagcataagccaccgtgcctgg

SEQ ID NO: 118911 - DNA, 22 bp, Artificial Sequence
  chemically synthesized
gcctcatggtaattttaacctg

SEQ ID NO: 118912 - DNA, 22 bp, Artificial Sequence
  chemically synthesized
atggtaattttaacctgtagga

SEQ ID NO: 118913 - DNA, 22 bp, Artificial Sequence
  chemically synthesized
taacctgtaggagaatgggtgg

SEQ ID NO: 118914 - DNA, 22 bp, Artificial Sequence
  chemically synthesized
aacctgtaggagaatgggtggg

SEQ ID NO: 118915 - DNA, 22 bp, Artificial Sequence
  chemically synthesized
acctgtaggagaatgggtggga

SEQ ID NO: 118916 - DNA, 22 bp, Artificial Sequence
  chemically synthesized
taggagaatgggtgggaggatc

SEQ ID NO: 118917 - DNA, 22 bp, Artificial Sequence
  chemically synthesized
agtaaagtagaactgggacaat

SEQ ID NO: 118918 - DNA, 22 bp, Artificial Sequence
  chemically synthesized
ggacaatgaagatataccacct

SEQ ID NO: 118919 - DNA, 22 bp, Artificial Sequence
  chemically synthesized
gatggatgccagcagaaaggtg

SEQ ID NO: 118920 - DNA, 22 bp, Artificial Sequence
  chemically synthesized
atggatgccagcagaaaggtgt

SEQ ID NO: 118921 - DNA, 22 bp, Artificial Sequence
  chemically synthesized
cttgggcttctgaatgtgaaga

SEQ ID NO: 118922 - DNA, 22 bp, Artificial Sequence
  chemically synthesized
ttgggcttctgaatgtgaagag

SEQ ID NO: 118923 - DNA, 22 bp, Artificial Sequence
  chemically synthesized
gggcttctgaatgtgaagagga

SEQ ID NO: 118924 - DNA, 22 bp, Artificial Sequence
  chemically synthesized
ggcttctgaatgtgaagaggag

SEQ ID NO: 118925 - DNA, 22 bp, Artificial Sequence
  chemically synthesized
ctgaatgtgaagaggaggagtt

SEQ ID NO: 118926 - DNA, 22 bp, Artificial Sequence
  chemically synthesized
tgaatgtgaagaggaggagttc

SEQ ID NO: 118927 - DNA, 22 bp, Artificial Sequence
  chemically synthesized
aatgtgaagaggaggagttcct

SEQ ID NO: 118928 - DNA, 22 bp, Artificial Sequence
  chemically synthesized
ctcgagacaagaagagaacttc

SEQ ID NO: 118929 - DNA, 22 bp, Artificial Sequence
  chemically synthesized
gagacaagaagagaacttctgt

SEQ ID NO: 118930 - DNA, 22 bp, Artificial Sequence
  chemically synthesized
ctgttagctctggatccctctt

SEQ ID NO: 118931 - DNA, 22 bp, Artificial Sequence
  chemically synthesized
tgttagctctggatccctcttt

SEQ ID NO: 118932 - DNA, 22 bp, Artificial Sequence
  chemically synthesized
ttagctctggatccctctttat

SEQ ID NO: 118933 - DNA, 22 bp, Artificial Sequence
  chemically synthesized
gctctggatccctctttatgta

SEQ ID NO: 118934 - DNA, 22 bp, Artificial Sequence
  chemically synthesized
tggatccctctttatgtatcta

SEQ ID NO: 118935 - DNA, 22 bp, Artificial Sequence
  chemically synthesized
gatccctctttatgtatctata

SEQ ID NO: 118936 - DNA, 22 bp, Artificial Sequence
  chemically synthesized
tttatgtatctatatgtccacg

SEQ ID NO: 118937 - DNA, 22 bp, Artificial Sequence
  chemically synthesized
tatgtatctatatgtccacgca

SEQ ID NO: 118938 - DNA, 22 bp, Artificial Sequence
  chemically synthesized
atgtatctatatgtccacgcat

SEQ ID NO: 118939 - DNA, 22 bp, Artificial Sequence
  chemically synthesized
tgtatctatatgtccacgcata

SEQ ID NO: 118940 - DNA, 22 bp, Artificial Sequence
  chemically synthesized
tatgtccacgcatacatttaat

SEQ ID NO: 118941 - DNA, 22 bp, Artificial Sequence
  chemically synthesized
aatatttattgagtatatggca

SEQ ID NO: 118942 - DNA, 22 bp, Artificial Sequence
  chemically synthesized
atatttattgagtatatggcat

SEQ ID NO: 118943 - DNA, 22 bp, Artificial Sequence
  chemically synthesized
attgagtatatggcatgtgcta

SEQ ID NO: 118944 - DNA, 22 bp, Artificial Sequence
  chemically synthesized
ttgagtatatggcatgtgctag

SEQ ID NO: 118945 - DNA, 22 bp, Artificial Sequence
  chemically synthesized
agtatatggcatgtgctaggca

SEQ ID NO: 118946 - DNA, 22 bp, Artificial Sequence
  chemically synthesized
ggcattgtatttatatacattt

SEQ ID NO: 118947 - DNA, 22 bp, Artificial Sequence
  chemically synthesized
tatttatatacatttactggcg

SEQ ID NO: 118948 - DNA, 22 bp, Artificial Sequence
  chemically synthesized
atatacatttactggcgagcaa

SEQ ID NO: 118949 - DNA, 22 bp, Artificial Sequence
  chemically synthesized
tatacatttactggcgagcaag

SEQ ID NO: 118950 - DNA, 22 bp, Artificial Sequence
  chemically synthesized
actggcgagcaagacatgccta

SEQ ID NO: 118951 - DNA, 22 bp, Artificial Sequence
  chemically synthesized
ctggcgagcaagacatgcctaa

SEQ ID NO: 118952 - DNA, 22 bp, Artificial Sequence
  chemically synthesized
gcgagcaagacatgcctaattc

SEQ ID NO: 118953 - DNA, 22 bp, Artificial Sequence
  chemically synthesized
attcctccagggatcttgattt

SEQ ID NO: 118954 - DNA, 22 bp, Artificial Sequence
  chemically synthesized
ctccagggatcttgatttagtc

SEQ ID NO: 118955 - DNA, 22 bp, Artificial Sequence
  chemically synthesized
cagggatcttgatttagtcatt

SEQ ID NO: 118956 - DNA, 22 bp, Artificial Sequence
  chemically synthesized
gatttagtcattctaatggaca

SEQ ID NO: 118957 - DNA, 22 bp, Artificial Sequence
  chemically synthesized
atttagtcattctaatggacac

SEQ ID NO: 118958 - DNA, 22 bp, Artificial Sequence
  chemically synthesized
agtcattctaatggacacatgc

SEQ ID NO: 118959 - DNA, 22 bp, Artificial Sequence
  chemically synthesized
gtcattctaatggacacatgca

SEQ ID NO: 118960 - DNA, 22 bp, Artificial Sequence
  chemically synthesized
taatggacacatgcacacacct

SEQ ID NO: 118961 - DNA, 22 bp, Artificial Sequence
  chemically synthesized
atggacacatgcacacaccttc

SEQ ID NO: 118962 - DNA, 22 bp, Artificial Sequence
  chemically synthesized
cataaacaggacattactgtgt

SEQ ID NO: 118963 - DNA, 22 bp, Artificial Sequence
  chemically synthesized
ataaacaggacattactgtgtg

SEQ ID NO: 118964 - DNA, 22 bp, Artificial Sequence
  chemically synthesized
ctgtgtgacaaatgttacaacg

SEQ ID NO: 118965 - DNA, 22 bp, Artificial Sequence
  chemically synthesized
tgtgacaaatgttacaacggga

SEQ ID NO: 118966 - DNA, 22 bp, Artificial Sequence
  chemically synthesized
caacgggaaatgcagggcactg

SEQ ID NO: 118967 - DNA, 22 bp, Artificial Sequence
  chemically synthesized
tggaaggaaaccgatggagcat

SEQ ID NO: 118968 - DNA, 22 bp, Artificial Sequence
  chemically synthesized
ggtgctttaccattggaaaggg

SEQ ID NO: 118969 - DNA, 22 bp, Artificial Sequence
  chemically synthesized
gtgctttaccattggaaaggga

SEQ ID NO: 118970 - DNA, 22 bp, Artificial Sequence
  chemically synthesized
taccattggaaagggaggagct

SEQ ID NO: 118971 - DNA, 22 bp, Artificial Sequence
  chemically synthesized
accattggaaagggaggagcta

SEQ ID NO: 118972 - DNA, 22 bp, Artificial Sequence
  chemically synthesized
ccattggaaagggaggagctat

SEQ ID NO: 118973 - DNA, 22 bp, Artificial Sequence
  chemically synthesized
gaaagggaggagctatctgtga

SEQ ID NO: 118974 - DNA, 22 bp, Artificial Sequence
  chemically synthesized
tctgtgaaaatgtccttgagga

SEQ ID NO: 118975 - DNA, 22 bp, Artificial Sequence
  chemically synthesized
tgaaaatgtccttgaggaagca

SEQ ID NO: 118976 - DNA, 22 bp, Artificial Sequence
  chemically synthesized
gaggaagcaatttcaaagctga

SEQ ID NO: 118977 - DNA, 22 bp, Artificial Sequence
  chemically synthesized
aggaagcaatttcaaagctgag

SEQ ID NO: 118978 - DNA, 22 bp, Artificial Sequence
  chemically synthesized
caaagctgagacccctgcaagg

SEQ ID NO: 118979 - DNA, 22 bp, Artificial Sequence
  chemically synthesized
aaagctgagacccctgcaagga

SEQ ID NO: 118980 - DNA, 22 bp, Artificial Sequence
  chemically synthesized
agacccctgcaaggattgcatt

SEQ ID NO: 118981 - DNA, 22 bp, Artificial Sequence
  chemically synthesized
caaggattgcatttagtcactc

SEQ ID NO: 118982 - DNA, 22 bp, Artificial Sequence
  chemically synthesized
catttagtcactcgtagggaca

SEQ ID NO: 118983 - DNA, 22 bp, Artificial Sequence
  chemically synthesized
agtcactcgtagggacaggctg

SEQ ID NO: 118984 - DNA, 22 bp, Artificial Sequence
  chemically synthesized
gtcactcgtagggacaggctga

SEQ ID NO: 118985 - DNA, 22 bp, Artificial Sequence
  chemically synthesized
gtagggacaggctgatcagcca

SEQ ID NO: 118986 - DNA, 22 bp, Artificial Sequence
  chemically synthesized
atcagccaatgtaaagtttatt

SEQ ID NO: 118987 - DNA, 22 bp, Artificial Sequence
  chemically synthesized
atttcctcctgagcaatgggat

SEQ ID NO: 118988 - DNA, 22 bp, Artificial Sequence
  chemically synthesized
tttcctcctgagcaatgggatt

SEQ ID NO: 118989 - DNA, 22 bp, Artificial Sequence
  chemically synthesized
cctcctgagcaatgggattgtg

SEQ ID NO: 118990 - DNA, 22 bp, Artificial Sequence
  chemically synthesized
ctcctgagcaatgggattgtga

SEQ ID NO: 118991 - DNA, 22 bp, Artificial Sequence
  chemically synthesized
ctgagcaatgggattgtgactt

SEQ ID NO: 118992 - DNA, 22 bp, Artificial Sequence
  chemically synthesized
agcaatgggattgtgacttcaa

SEQ ID NO: 118993 - DNA, 22 bp, Artificial Sequence
  chemically synthesized
tgacttcaatatgtttgtgtga

SEQ ID NO: 118994 - DNA, 22 bp, Artificial Sequence
  chemically synthesized
caatatgtttgtgtgagtttcc

SEQ ID NO: 118995 - DNA, 22 bp, Artificial Sequence
  chemically synthesized
aatatgtttgtgtgagtttcct

SEQ ID NO: 118996 - DNA, 22 bp, Artificial Sequence
  chemically synthesized
gtgtgagtttccttggctgaag

SEQ ID NO: 118997 - DNA, 22 bp, Artificial Sequence
  chemically synthesized
tgtgagtttccttggctgaagc

SEQ ID NO: 118998 - DNA, 22 bp, Artificial Sequence
  chemically synthesized
ccttggctgaagctttctcacg

SEQ ID NO: 118999 - DNA, 22 bp, Artificial Sequence
  chemically synthesized
cttggctgaagctttctcacgt

SEQ ID NO: 119000 - DNA, 22 bp, Artificial Sequence
  chemically synthesized
ggctgaagctttctcacgttac

SEQ ID NO: 119001 - DNA, 22 bp, Artificial Sequence
  chemically synthesized
gctgaagctttctcacgttaca

SEQ ID NO: 119002 - DNA, 22 bp, Artificial Sequence
  chemically synthesized
aagctttctcacgttacatgtc

SEQ ID NO: 119003 - DNA, 22 bp, Artificial Sequence
  chemically synthesized
tctcacgttacatgtcattgtt

SEQ ID NO: 119004 - DNA, 22 bp, Artificial Sequence
  chemically synthesized
ctcacgttacatgtcattgttc

SEQ ID NO: 119005 - DNA, 22 bp, Artificial Sequence
  chemically synthesized
tcacgttacatgtcattgttca

SEQ ID NO: 119006 - DNA, 22 bp, Artificial Sequence
  chemically synthesized
acgttacatgtcattgttcaat

SEQ ID NO: 119007 - DNA, 22 bp, Artificial Sequence
  chemically synthesized
catgtcattgttcaatatcaca

SEQ ID NO: 119008 - DNA, 22 bp, Artificial Sequence
  chemically synthesized
ttcaatatcacacaactaaaac

SEQ ID NO: 119009 - DNA, 22 bp, Artificial Sequence
  chemically synthesized
aatatcacacaactaaaacacc

SEQ ID NO: 119010 - DNA, 22 bp, Artificial Sequence
  chemically synthesized
aaacacctacaagtaaatactg

SEQ ID NO: 119011 - DNA, 22 bp, Artificial Sequence
  chemically synthesized
caagtaaatactgactgtagct

SEQ ID NO: 119012 - DNA, 22 bp, Artificial Sequence
  chemically synthesized
actgtagcttaatgtcagactt

SEQ ID NO: 119013 - DNA, 22 bp, Artificial Sequence
  chemically synthesized
tagcttaatgtcagacttgagg

SEQ ID NO: 119014 - DNA, 22 bp, Artificial Sequence
  chemically synthesized
aatgtcagacttgaggttgtaa

SEQ ID NO: 119015 - DNA, 22 bp, Artificial Sequence
  chemically synthesized
atgtcagacttgaggttgtaag

SEQ ID NO: 119016 - DNA, 22 bp, Artificial Sequence
  chemically synthesized
gaggttgtaaggtaaaatcaga

SEQ ID NO: 119017 - DNA, 22 bp, Artificial Sequence
  chemically synthesized
aggttgtaaggtaaaatcagag

SEQ ID NO: 119018 - DNA, 22 bp, Artificial Sequence
  chemically synthesized
taaggtaaaatcagagatgaga

SEQ ID NO: 119019 - DNA, 22 bp, Artificial Sequence
  chemically synthesized
ttcttctagaggaatatggtca

SEQ ID NO: 119020 - DNA, 22 bp, Artificial Sequence
  chemically synthesized
cttctagaggaatatggtcagg

SEQ ID NO: 119021 - DNA, 22 bp, Artificial Sequence
  chemically synthesized
ttctagaggaatatggtcagga

SEQ ID NO: 119022 - DNA, 22 bp, Artificial Sequence
  chemically synthesized
ctagaggaatatggtcaggaga

SEQ ID NO: 119023 - DNA, 22 bp, Artificial Sequence
  chemically synthesized
tagaggaatatggtcaggagag

SEQ ID NO: 119024 - DNA, 22 bp, Artificial Sequence
  chemically synthesized
gaggaatatggtcaggagagag

SEQ ID NO: 119025 - DNA, 22 bp, Artificial Sequence
  chemically synthesized
agaaatttgggggggtgttgct

SEQ ID NO: 119026 - DNA, 22 bp, Artificial Sequence
  chemically synthesized
gaaatttgggggggtgttgctt

SEQ ID NO: 119027 - DNA, 22 bp, Artificial Sequence
  chemically synthesized
gggggggtgttgcttgaaacag

SEQ ID NO: 119028 - DNA, 22 bp, Artificial Sequence
  chemically synthesized
ggggggtgttgcttgaaacagg

SEQ ID NO: 119029 - DNA, 22 bp, Artificial Sequence
  chemically synthesized
cttgaaacaggtgttgaggaag

SEQ ID NO: 119030 - DNA, 22 bp, Artificial Sequence
  chemically synthesized
gaaacaggtgttgaggaagaat

SEQ ID NO: 119031 - DNA, 22 bp, Artificial Sequence
  chemically synthesized
aaacaggtgttgaggaagaatg

SEQ ID NO: 119032 - DNA, 22 bp, Artificial Sequence
  chemically synthesized
aggaagaatgcaggagttctga

SEQ ID NO: 119033 - DNA, 22 bp, Artificial Sequence
  chemically synthesized
tgaggtttctgatgtgacttgg

SEQ ID NO: 119034 - DNA, 22 bp, Artificial Sequence
  chemically synthesized
aggtttctgatgtgacttgggg

SEQ ID NO: 119035 - DNA, 22 bp, Artificial Sequence
  chemically synthesized
ctgatgtgacttgggggtctga

SEQ ID NO: 119036 - DNA, 22 bp, Artificial Sequence
  chemically synthesized
tgatgtgacttgggggtctgaa

SEQ ID NO: 119037 - DNA, 22 bp, Artificial Sequence
  chemically synthesized
atgtgacttgggggtctgaaag

SEQ ID NO: 119038 - DNA, 22 bp, Artificial Sequence
  chemically synthesized
gggggtctgaaagttactgctg

SEQ ID NO: 119039 - DNA, 22 bp, Artificial Sequence
  chemically synthesized
ggggtctgaaagttactgctga

SEQ ID NO: 119040 - DNA, 22 bp, Artificial Sequence
  chemically synthesized
aaagttactgctgaccaggata

SEQ ID NO: 119041 - DNA, 22 bp, Artificial Sequence
  chemically synthesized
ctgctgaccaggatagaaaaag

SEQ ID NO: 119042 - DNA, 22 bp, Artificial Sequence
  chemically synthesized
ctgaccaggatagaaaaagatg

SEQ ID NO: 119043 - DNA, 22 bp, Artificial Sequence
  chemically synthesized
accaggatagaaaaagatgaga

SEQ ID NO: 119044 - DNA, 22 bp, Artificial Sequence
  chemically synthesized
ggccaggtagataagatggaag

SEQ ID NO: 119045 - DNA, 22 bp, Artificial Sequence
  chemically synthesized
gccaggtagataagatggaagc

SEQ ID NO: 119046 - DNA, 22 bp, Artificial Sequence
  chemically synthesized
ccggaggtgagttagagcaaat

SEQ ID NO: 119047 - DNA, 22 bp, Artificial Sequence
  chemically synthesized
cggaggtgagttagagcaaatg

SEQ ID NO: 119048 - DNA, 22 bp, Artificial Sequence
  chemically synthesized
gagcaaatggcatttacctggt

SEQ ID NO: 119049 - DNA, 22 bp, Artificial Sequence
  chemically synthesized
acctggtctctgccaggctctc

SEQ ID NO: 119050 - DNA, 22 bp, Artificial Sequence
  chemically synthesized
cctggtctctgccaggctctcc

SEQ ID NO: 119051 - DNA, 22 bp, Artificial Sequence
  chemically synthesized
gtctctgccaggctctcctctg

SEQ ID NO: 119052 - DNA, 22 bp, Artificial Sequence
  chemically synthesized
tgccaggctctcctctgggtgc

SEQ ID NO: 119053 - DNA, 22 bp, Artificial Sequence
  chemically synthesized
ccaggctctcctctgggtgctc

SEQ ID NO: 119054 - DNA, 22 bp, Artificial Sequence
  chemically synthesized
tcctctgggtgctctggtattt

SEQ ID NO: 119055 - DNA, 22 bp, Artificial Sequence
  chemically synthesized
ctctgggtgctctggtatttat

SEQ ID NO: 119056 - DNA, 22 bp, Artificial Sequence
  chemically synthesized
tgggtgctctggtatttattgt

SEQ ID NO: 119057 - DNA, 22 bp, Artificial Sequence
  chemically synthesized
ggtgctctggtatttattgttc

SEQ ID NO: 119058 - DNA, 22 bp, Artificial Sequence
  chemically synthesized
tggtatttattgttctttttag

SEQ ID NO: 119059 - DNA, 22 bp, Artificial Sequence
  chemically synthesized
gtatttattgttctttttagtt

SEQ ID NO: 119060 - DNA, 22 bp, Artificial Sequence
  chemically synthesized
attgttctttttagtttttatt

SEQ ID NO: 119061 - DNA, 22 bp, Artificial Sequence
  chemically synthesized
ttgttctttttagtttttattt

SEQ ID NO: 119062 - DNA, 22 bp, Artificial Sequence
  chemically synthesized
ttctttttagtttttatttagt

SEQ ID NO: 119063 - DNA, 22 bp, Artificial Sequence
  chemically synthesized
tttttagtttttatttagtttc

SEQ ID NO: 119064 - DNA, 22 bp, Artificial Sequence
  chemically synthesized
tttagtttttatttagtttcat

SEQ ID NO: 119065 - DNA, 22 bp, Artificial Sequence
  chemically synthesized
ttagtttttatttagtttcatt

SEQ ID NO: 119066 - DNA, 22 bp, Artificial Sequence
  chemically synthesized
tagtttttatttagtttcattt

SEQ ID NO: 119067 - DNA, 22 bp, Artificial Sequence
  chemically synthesized
agtttttatttagtttcatttt

SEQ ID NO: 119068 - DNA, 22 bp, Artificial Sequence
  chemically synthesized
gtttttatttagtttcatttta

SEQ ID NO: 119069 - DNA, 22 bp, Artificial Sequence
  chemically synthesized
ttatttagtttcattttagttt

SEQ ID NO: 119070 - DNA, 22 bp, Artificial Sequence
  chemically synthesized
tatttagtttcattttagtttt

SEQ ID NO: 119071 - DNA, 22 bp, Artificial Sequence
  chemically synthesized
atttagtttcattttagtttta

SEQ ID NO: 119072 - DNA, 22 bp, Artificial Sequence
  chemically synthesized
tttagtttcattttagttttag

SEQ ID NO: 119073 - DNA, 22 bp, Artificial Sequence
  chemically synthesized
agtttcattttagttttagtta

SEQ ID NO: 119074 - DNA, 22 bp, Artificial Sequence
  chemically synthesized
gtttcattttagttttagttac

SEQ ID NO: 119075 - DNA, 22 bp, Artificial Sequence
  chemically synthesized
cattttagttttagttacattg

SEQ ID NO: 119076 - DNA, 22 bp, Artificial Sequence
  chemically synthesized
attttagttttagttacattga

SEQ ID NO: 119077 - DNA, 22 bp, Artificial Sequence
  chemically synthesized
tagttttagttacattgatgat

SEQ ID NO: 119078 - DNA, 22 bp, Artificial Sequence
  chemically synthesized
agttttagttacattgatgatg

SEQ ID NO: 119079 - DNA, 22 bp, Artificial Sequence
  chemically synthesized
gttttagttacattgatgatga

SEQ ID NO: 119080 - DNA, 22 bp, Artificial Sequence
  chemically synthesized
tagttacattgatgatgacctt

SEQ ID NO: 119081 - DNA, 22 bp, Artificial Sequence
  chemically synthesized
agttacattgatgatgaccttc

SEQ ID NO: 119082 - DNA, 22 bp, Artificial Sequence
  chemically synthesized
gttacattgatgatgaccttca

SEQ ID NO: 119083 - DNA, 22 bp, Artificial Sequence
  chemically synthesized
cattgatgatgaccttcaataa

SEQ ID NO: 119084 - DNA, 22 bp, Artificial Sequence
  chemically synthesized
atgatgaccttcaataaagttg

SEQ ID NO: 119085 - DNA, 22 bp, Artificial Sequence
  chemically synthesized
caataaagttgccttctggata

SEQ ID NO: 119086 - DNA, 22 bp, Artificial Sequence
  chemically synthesized
aataaagttgccttctggatag

SEQ ID NO: 119087 - DNA, 22 bp, Artificial Sequence
  chemically synthesized
ccttctggatagctttgatgct

SEQ ID NO: 119088 - DNA, 22 bp, Artificial Sequence
  chemically synthesized
ctggatagctttgatgctacca

SEQ ID NO: 119089 - DNA, 22 bp, Artificial Sequence
  chemically synthesized
tggatagctttgatgctaccaa

SEQ ID NO: 119090 - DNA, 22 bp, Artificial Sequence
  chemically synthesized
gatagctttgatgctaccaaaa

SEQ ID NO: 119091 - DNA, 22 bp, Artificial Sequence
  chemically synthesized
tgatgctaccaaaaatgccagt

SEQ ID NO: 119092 - DNA, 22 bp, Artificial Sequence
  chemically synthesized
gatgctaccaaaaatgccagtt

SEQ ID NO: 119093 - DNA, 22 bp, Artificial Sequence
  chemically synthesized
atgctaccaaaaatgccagttc

SEQ ID NO: 119094 - DNA, 22 bp, Artificial Sequence
  chemically synthesized
ccaaaaatgccagttctcagct

SEQ ID NO: 119095 - DNA, 22 bp, Artificial Sequence
  chemically synthesized
tcagctgtaggaggagccatta

SEQ ID NO: 119096 - DNA, 22 bp, Artificial Sequence
  chemically synthesized
agctgtaggaggagccattaaa

SEQ ID NO: 119097 - DNA, 22 bp, Artificial Sequence
  chemically synthesized
taggaggagccattaaaatcta

SEQ ID NO: 119098 - DNA, 22 bp, Artificial Sequence
  chemically synthesized
aaatctaagcaagagaagttca

SEQ ID NO: 119099 - DNA, 22 bp, Artificial Sequence
  chemically synthesized
agcaagagaagttcagtttttt

SEQ ID NO: 119100 - DNA, 22 bp, Artificial Sequence
  chemically synthesized
agttttttaaagccacaactcc

SEQ ID NO: 119101 - DNA, 22 bp, Artificial Sequence
  chemically synthesized
tttaaagccacaactccagaca

SEQ ID NO: 119102 - DNA, 22 bp, Artificial Sequence
  chemically synthesized
ttaaagccacaactccagacat

SEQ ID NO: 119103 - DNA, 22 bp, Artificial Sequence
  chemically synthesized
taaagccacaactccagacata

SEQ ID NO: 119104 - DNA, 22 bp, Artificial Sequence
  chemically synthesized
aaagccacaactccagacataa

SEQ ID NO: 119105 - DNA, 22 bp, Artificial Sequence
  chemically synthesized
aagccacaactccagacataaa

SEQ ID NO: 119106 - DNA, 22 bp, Artificial Sequence
  chemically synthesized
cagacataaatttgcccatatt

SEQ ID NO: 119107 - DNA, 22 bp, Artificial Sequence
  chemically synthesized
gcccatattttatttaggacag

SEQ ID NO: 119108 - DNA, 22 bp, Artificial Sequence
  chemically synthesized
cccatattttatttaggacagg

SEQ ID NO: 119109 - DNA, 22 bp, Artificial Sequence
  chemically synthesized
tatttaggacaggggcaaaaaa

SEQ ID NO: 119110 - DNA, 22 bp, Artificial Sequence
  chemically synthesized
atttaggacaggggcaaaaaat

SEQ ID NO: 119111 - DNA, 22 bp, Artificial Sequence
  chemically synthesized
tttaggacaggggcaaaaaatc

SEQ ID NO: 119112 - DNA, 22 bp, Artificial Sequence
  chemically synthesized
aggacaggggcaaaaaatcttt

SEQ ID NO: 119113 - DNA, 22 bp, Artificial Sequence
  chemically synthesized
ggacaggggcaaaaaatcttta

SEQ ID NO: 119114 - DNA, 22 bp, Artificial Sequence
  chemically synthesized
taagagcatgctatatactcaa

SEQ ID NO: 119115 - DNA, 22 bp, Artificial Sequence
  chemically synthesized
aagagcatgctatatactcaat

SEQ ID NO: 119116 - DNA, 22 bp, Artificial Sequence
  chemically synthesized
agagcatgctatatactcaata

SEQ ID NO: 119117 - DNA, 22 bp, Artificial Sequence
  chemically synthesized
tatactcaatactccaaatttt

SEQ ID NO: 119118 - DNA, 22 bp, Artificial Sequence
  chemically synthesized
aatactccaaattttcagtcca

SEQ ID NO: 119119 - DNA, 22 bp, Artificial Sequence
  chemically synthesized
caaattttcagtccaatttggg

SEQ ID NO: 119120 - DNA, 22 bp, Artificial Sequence
  chemically synthesized
tcagtccaatttggggccttct

SEQ ID NO: 119121 - DNA, 22 bp, Artificial Sequence
  chemically synthesized
cagtccaatttggggccttctt

SEQ ID NO: 119122 - DNA, 22 bp, Artificial Sequence
  chemically synthesized
agtccaatttggggccttctta

SEQ ID NO: 119123 - DNA, 22 bp, Artificial Sequence
  chemically synthesized
ggggccttcttataggcctcta

SEQ ID NO: 119124 - DNA, 22 bp, Artificial Sequence
  chemically synthesized
gggccttcttataggcctctag

SEQ ID NO: 119125 - DNA, 22 bp, Artificial Sequence
  chemically synthesized
cttataggcctctagggggagt

SEQ ID NO: 119126 - DNA, 22 bp, Artificial Sequence
  chemically synthesized
ttataggcctctagggggagtt

SEQ ID NO: 119127 - DNA, 22 bp, Artificial Sequence
  chemically synthesized
ataggcctctagggggagtttt

SEQ ID NO: 119128 - DNA, 22 bp, Artificial Sequence
  chemically synthesized
taggcctctagggggagtttta

SEQ ID NO: 119129 - DNA, 22 bp, Artificial Sequence
  chemically synthesized
tagggggagttttagccccagg

SEQ ID NO: 119130 - DNA, 22 bp, Artificial Sequence
  chemically synthesized
gggggagttttagccccaggac

SEQ ID NO: 119131 - DNA, 22 bp, Artificial Sequence
  chemically synthesized
tagccccaggactcatttactg

SEQ ID NO: 119132 - DNA, 22 bp, Artificial Sequence
  chemically synthesized
agccccaggactcatttactgg

SEQ ID NO: 119133 - DNA, 22 bp, Artificial Sequence
  chemically synthesized
gccccaggactcatttactggc

SEQ ID NO: 119134 - DNA, 22 bp, Artificial Sequence
  chemically synthesized
atttactggcctttttaagacc

SEQ ID NO: 119135 - DNA, 22 bp, Artificial Sequence
  chemically synthesized
actggcctttttaagacctagg

SEQ ID NO: 119136 - DNA, 22 bp, Artificial Sequence
  chemically synthesized
ctggcctttttaagacctagga

SEQ ID NO: 119137 - DNA, 22 bp, Artificial Sequence
  chemically synthesized
gcctttttaagacctaggaact

SEQ ID NO: 119138 - DNA, 22 bp, Artificial Sequence
  chemically synthesized
tttaagacctaggaacttgata

SEQ ID NO: 119139 - DNA, 22 bp, Artificial Sequence
  chemically synthesized
ttaagacctaggaacttgataa

SEQ ID NO: 119140 - DNA, 22 bp, Artificial Sequence
  chemically synthesized
taagacctaggaacttgataat

SEQ ID NO: 119141 - DNA, 22 bp, Artificial Sequence
  chemically synthesized
aagacctaggaacttgataatg

SEQ ID NO: 119142 - DNA, 22 bp, Artificial Sequence
  chemically synthesized
agacctaggaacttgataatgg

SEQ ID NO: 119143 - DNA, 22 bp, Artificial Sequence
  chemically synthesized
ggaacttgataatggcacggtg

SEQ ID NO: 119144 - DNA, 22 bp, Artificial Sequence
  chemically synthesized
gataatggcacggtggatctcc

SEQ ID NO: 119145 - DNA, 22 bp, Artificial Sequence
  chemically synthesized
ataatggcacggtggatctcct

SEQ ID NO: 119146 - DNA, 22 bp, Artificial Sequence
  chemically synthesized
cttggtcttaatgctgtatatg

SEQ ID NO: 119147 - DNA, 22 bp, Artificial Sequence
  chemically synthesized
ggtcttaatgctgtatatgatt

SEQ ID NO: 119148 - DNA, 22 bp, Artificial Sequence
  chemically synthesized
gtcttaatgctgtatatgattg

SEQ ID NO: 119149 - DNA, 22 bp, Artificial Sequence
  chemically synthesized
aatgctgtatatgattgggtta

SEQ ID NO: 119150 - DNA, 22 bp, Artificial Sequence
  chemically synthesized
atgctgtatatgattgggttaa

SEQ ID NO: 119151 - DNA, 22 bp, Artificial Sequence
  chemically synthesized
tatatgattgggttaagcatgg

SEQ ID NO: 119152 - DNA, 22 bp, Artificial Sequence
  chemically synthesized
ggttaagcatgggaggcacaaa

SEQ ID NO: 119153 - DNA, 22 bp, Artificial Sequence
  chemically synthesized
agcatgggaggcacaaaaaggt

SEQ ID NO: 119154 - DNA, 22 bp, Artificial Sequence
  chemically synthesized
gccataagaagatgaatagcag

SEQ ID NO: 119155 - DNA, 22 bp, Artificial Sequence
  chemically synthesized
cccaaaacggtgcaccagggac

SEQ ID NO: 119156 - DNA, 22 bp, Artificial Sequence
  chemically synthesized
ccaaaacggtgcaccagggaca

SEQ ID NO: 119157 - DNA, 22 bp, Artificial Sequence
  chemically synthesized
gcacagcacagagaggagcggt

SEQ ID NO: 119158 - DNA, 22 bp, Artificial Sequence
  chemically synthesized
aaaggcacggcgctgctcctct

SEQ ID NO: 119159 - DNA, 22 bp, Artificial Sequence
  chemically synthesized
ctcctcttgggaggccaggcct

SEQ ID NO: 119160 - DNA, 22 bp, Artificial Sequence
  chemically synthesized
ctcttgggaggccaggcctgct

SEQ ID NO: 119161 - DNA, 22 bp, Artificial Sequence
  chemically synthesized
ttgggaggccaggcctgctact

SEQ ID NO: 119162 - DNA, 22 bp, Artificial Sequence
  chemically synthesized
gggaggccaggcctgctactgt

SEQ ID NO: 119163 - DNA, 22 bp, Artificial Sequence
  chemically synthesized
ggaggccaggcctgctactgtg

SEQ ID NO: 119164 - DNA, 22 bp, Artificial Sequence
  chemically synthesized
ctactgtgtgcaggatgagtcc

SEQ ID NO: 119165 - DNA, 22 bp, Artificial Sequence
  chemically synthesized
ctgtgtgcaggatgagtccata

SEQ ID NO: 119166 - DNA, 22 bp, Artificial Sequence
  chemically synthesized
tgtgcaggatgagtccatagga

SEQ ID NO: 119167 - DNA, 22 bp, Artificial Sequence
  chemically synthesized
ccaccatcagtccatacagatt

SEQ ID NO: 119168 - DNA, 22 bp, Artificial Sequence
  chemically synthesized
ttgaaggtgatatctgtgcagg

SEQ ID NO: 119169 - DNA, 22 bp, Artificial Sequence
  chemically synthesized
aaggtgatatctgtgcaggcca

SEQ ID NO: 119170 - DNA, 22 bp, Artificial Sequence
  chemically synthesized
tgcaggccagctgtatcacttc

SEQ ID NO: 119171 - DNA, 22 bp, Artificial Sequence
  chemically synthesized
tatcacttcctggtgcaggcaa

SEQ ID NO: 119172 - DNA, 22 bp, Artificial Sequence
  chemically synthesized
cctggtgcaggcaaaatgagtg

SEQ ID NO: 119173 - DNA, 22 bp, Artificial Sequence
  chemically synthesized
ctggtgcaggcaaaatgagtgg

SEQ ID NO: 119174 - DNA, 22 bp, Artificial Sequence
  chemically synthesized
gtgcaggcaaaatgagtgggag

SEQ ID NO: 119175 - DNA, 22 bp, Artificial Sequence
  chemically synthesized
caggaggaggacaatagggata

SEQ ID NO: 119176 - DNA, 22 bp, Artificial Sequence
  chemically synthesized
aggaggaggacaatagggatag

SEQ ID NO: 119177 - DNA, 22 bp, Artificial Sequence
  chemically synthesized
ggcctgctctgaccacttgctg

SEQ ID NO: 119178 - DNA, 22 bp, Artificial Sequence
  chemically synthesized
ctctgaccacttgctggccagt

SEQ ID NO: 119179 - DNA, 22 bp, Artificial Sequence
  chemically synthesized
tgaccacttgctggccagtgat

SEQ ID NO: 119180 - DNA, 22 bp, Artificial Sequence
  chemically synthesized
accacttgctggccagtgataa

SEQ ID NO: 119181 - DNA, 22 bp, Artificial Sequence
  chemically synthesized
gctggccagtgataatgaccga

SEQ ID NO: 119182 - DNA, 22 bp, Artificial Sequence
  chemically synthesized
ctggccagtgataatgaccgaa

SEQ ID NO: 119183 - DNA, 22 bp, Artificial Sequence
  chemically synthesized
gccagtgataatgaccgaatac

SEQ ID NO: 119184 - DNA, 22 bp, Artificial Sequence
  chemically synthesized
agagggtggcagatggccacaa

SEQ ID NO: 119185 - DNA, 22 bp, Artificial Sequence
  chemically synthesized
aggactccatgaaggaaaaaga

SEQ ID NO: 119186 - DNA, 22 bp, Artificial Sequence
  chemically synthesized
catgaaggaaaaagagtggatg

SEQ ID NO: 119187 - DNA, 22 bp, Artificial Sequence
  chemically synthesized
gatttgacacgctccaaagtag

SEQ ID NO: 119188 - DNA, 22 bp, Artificial Sequence
  chemically synthesized
gacacgctccaaagtagatact

SEQ ID NO: 119189 - DNA, 22 bp, Artificial Sequence
  chemically synthesized
acacgctccaaagtagatacta

SEQ ID NO: 119190 - DNA, 22 bp, Artificial Sequence
  chemically synthesized
caaagtagatactatgggagtt

SEQ ID NO: 119191 - DNA, 22 bp, Artificial Sequence
  chemically synthesized
tgggagttaaaccagaagatcc

SEQ ID NO: 119192 - DNA, 22 bp, Artificial Sequence
  chemically synthesized
aaccagaagatccccatagtgg

SEQ ID NO: 119193 - DNA, 22 bp, Artificial Sequence
  chemically synthesized
gtcttaataatgatcagaatga

SEQ ID NO: 119194 - DNA, 22 bp, Artificial Sequence
  chemically synthesized
aataatgatcagaatgaaacaa

SEQ ID NO: 119195 - DNA, 22 bp, Artificial Sequence
  chemically synthesized
ataatgatcagaatgaaacaat

SEQ ID NO: 119196 - DNA, 22 bp, Artificial Sequence
  chemically synthesized
cctgagatggcaaccatgtaca

SEQ ID NO: 119197 - DNA, 22 bp, Artificial Sequence
  chemically synthesized
agatggcaaccatgtacataaa

SEQ ID NO: 119198 - DNA, 22 bp, Artificial Sequence
  chemically synthesized
gatgccttccaatccaggaaag

SEQ ID NO: 119199 - DNA, 22 bp, Artificial Sequence
  chemically synthesized
atgccttccaatccaggaaagc

SEQ ID NO: 119200 - DNA, 22 bp, Artificial Sequence
  chemically synthesized
ccaatccaggaaagctggtgag

SEQ ID NO: 119201 - DNA, 22 bp, Artificial Sequence
  chemically synthesized
caatccaggaaagctggtgaga

SEQ ID NO: 119202 - DNA, 22 bp, Artificial Sequence
  chemically synthesized
gtgagatagaatatggggctaa

SEQ ID NO: 119203 - DNA, 22 bp, Artificial Sequence
  chemically synthesized
aactgagtaatgttggatagca

SEQ ID NO: 119204 - DNA, 22 bp, Artificial Sequence
  chemically synthesized
agtaatgttggatagcagcatg

SEQ ID NO: 119205 - DNA, 22 bp, Artificial Sequence
  chemically synthesized
gatagcagcatgaattgaggac

SEQ ID NO: 119206 - DNA, 22 bp, Artificial Sequence
  chemically synthesized
aggactgagcgaatattggact

SEQ ID NO: 119207 - DNA, 22 bp, Artificial Sequence
  chemically synthesized
agcgaatattggactgacattc

SEQ ID NO: 119208 - DNA, 22 bp, Artificial Sequence
  chemically synthesized
gactgacattcctcggggattg

SEQ ID NO: 119209 - DNA, 22 bp, Artificial Sequence
  chemically synthesized
acattcctcggggattgagctg

SEQ ID NO: 119210 - DNA, 22 bp, Artificial Sequence
  chemically synthesized
ctcggggattgagctgaaaata

SEQ ID NO: 119211 - DNA, 22 bp, Artificial Sequence
  chemically synthesized
ggggattgagctgaaaataaat

SEQ ID NO: 119212 - DNA, 22 bp, Artificial Sequence
  chemically synthesized
agctgaaaataaatggatattt

SEQ ID NO: 119213 - DNA, 22 bp, Artificial Sequence
  chemically synthesized
aaaataaatggatatttctggt

SEQ ID NO: 119214 - DNA, 22 bp, Artificial Sequence
  chemically synthesized
ctggttattaattcttcagctt

SEQ ID NO: 119215 - DNA, 22 bp, Artificial Sequence
  chemically synthesized
tggttattaattcttcagcttc

SEQ ID NO: 119216 - DNA, 22 bp, Artificial Sequence
  chemically synthesized
gttattaattcttcagcttcac

SEQ ID NO: 119217 - DNA, 22 bp, Artificial Sequence
  chemically synthesized
ttaattcttcagcttcactaac

SEQ ID NO: 119218 - DNA, 22 bp, Artificial Sequence
  chemically synthesized
attcttcagcttcactaacatt

SEQ ID NO: 119219 - DNA, 22 bp, Artificial Sequence
  chemically synthesized
ttcagcttcactaacattcaca

SEQ ID NO: 119220 - DNA, 22 bp, Artificial Sequence
  chemically synthesized
cagcttcactaacattcacaac

SEQ ID NO: 119221 - DNA, 22 bp, Artificial Sequence
  chemically synthesized
agcttcactaacattcacaaca

SEQ ID NO: 119222 - DNA, 22 bp, Artificial Sequence
  chemically synthesized
cactaacattcacaacatcaca

SEQ ID NO: 119223 - DNA, 22 bp, Artificial Sequence
  chemically synthesized
actaacattcacaacatcacaa

SEQ ID NO: 119224 - DNA, 22 bp, Artificial Sequence
  chemically synthesized
acattcacaacatcacaagcag

SEQ ID NO: 119225 - DNA, 22 bp, Artificial Sequence
  chemically synthesized
acaacatcacaagcagtaccat

SEQ ID NO: 119226 - DNA, 22 bp, Artificial Sequence
  chemically synthesized
tagtattatctactccaccctt

SEQ ID NO: 119227 - DNA, 22 bp, Artificial Sequence
  chemically synthesized
agtattatctactccaccctta

SEQ ID NO: 119228 - DNA, 22 bp, Artificial Sequence
  chemically synthesized
gtattatctactccacccttat

SEQ ID NO: 119229 - DNA, 22 bp, Artificial Sequence
  chemically synthesized
tctactccacccttatgaattc

SEQ ID NO: 119230 - DNA, 22 bp, Artificial Sequence
  chemically synthesized
ctccacccttatgaattctgcc

SEQ ID NO: 119231 - DNA, 22 bp, Artificial Sequence
  chemically synthesized
cacccttatgaattctgccaat

SEQ ID NO: 119232 - DNA, 22 bp, Artificial Sequence
  chemically synthesized
atgaattctgccaatctcacta

SEQ ID NO: 119233 - DNA, 22 bp, Artificial Sequence
  chemically synthesized
tgaattctgccaatctcactac

SEQ ID NO: 119234 - DNA, 22 bp, Artificial Sequence
  chemically synthesized
tgccaatctcactactttattg

SEQ ID NO: 119235 - DNA, 22 bp, Artificial Sequence
  chemically synthesized
ccaatctcactactttattgaa

SEQ ID NO: 119236 - DNA, 22 bp, Artificial Sequence
  chemically synthesized
actactttattgaactttcttt

SEQ ID NO: 119237 - DNA, 22 bp, Artificial Sequence
  chemically synthesized
ctttattgaactttctttgata

SEQ ID NO: 119238 - DNA, 22 bp, Artificial Sequence
  chemically synthesized
tattgaactttctttgataacc

SEQ ID NO: 119239 - DNA, 22 bp, Artificial Sequence
  chemically synthesized
attgaactttctttgataacct

SEQ ID NO: 119240 - DNA, 22 bp, Artificial Sequence
  chemically synthesized
ttgaactttctttgataacctc

SEQ ID NO: 119241 - DNA, 22 bp, Artificial Sequence
  chemically synthesized
aactttctttgataacctcgcc

SEQ ID NO: 119242 - DNA, 22 bp, Artificial Sequence
  chemically synthesized
tctttgataacctcgccctcac

SEQ ID NO: 119243 - DNA, 22 bp, Artificial Sequence
  chemically synthesized
ctttgataacctcgccctcacc

SEQ ID NO: 119244 - DNA, 22 bp, Artificial Sequence
  chemically synthesized
tttgataacctcgccctcacca

SEQ ID NO: 119245 - DNA, 22 bp, Artificial Sequence
  chemically synthesized
tgataacctcgccctcaccagt

SEQ ID NO: 119246 - DNA, 22 bp, Artificial Sequence
  chemically synthesized
gataacctcgccctcaccagtt

SEQ ID NO: 119247 - DNA, 22 bp, Artificial Sequence
  chemically synthesized
ataacctcgccctcaccagttt

SEQ ID NO: 119248 - DNA, 22 bp, Artificial Sequence
  chemically synthesized
gccctcaccagttttcctctgt

SEQ ID NO: 119249 - DNA, 22 bp, Artificial Sequence
  chemically synthesized
accagttttcctctgtatttca

SEQ ID NO: 119250 - DNA, 22 bp, Artificial Sequence
  chemically synthesized
tcctctgtatttcaattatttc

SEQ ID NO: 119251 - DNA, 22 bp, Artificial Sequence
  chemically synthesized
cctctgtatttcaattatttca

SEQ ID NO: 119252 - DNA, 22 bp, Artificial Sequence
  chemically synthesized
ctctgtatttcaattatttcag

SEQ ID NO: 119253 - DNA, 22 bp, Artificial Sequence
  chemically synthesized
tgtatttcaattatttcagttc

SEQ ID NO: 119254 - DNA, 22 bp, Artificial Sequence
  chemically synthesized
tatttcaattatttcagttcct

SEQ ID NO: 119255 - DNA, 22 bp, Artificial Sequence
  chemically synthesized
caattatttcagttcctctctg

SEQ ID NO: 119256 - DNA, 22 bp, Artificial Sequence
  chemically synthesized
aattatttcagttcctctctgc

SEQ ID NO: 119257 - DNA, 22 bp, Artificial Sequence
  chemically synthesized
tttcagttcctctctgcctctt

SEQ ID NO: 119258 - DNA, 22 bp, Artificial Sequence
  chemically synthesized
cagttcctctctgcctctttgc

SEQ ID NO: 119259 - DNA, 22 bp, Artificial Sequence
  chemically synthesized
agttcctctctgcctctttgct

SEQ ID NO: 119260 - DNA, 22 bp, Artificial Sequence
  chemically synthesized
ctctctgcctctttgctggtgt

SEQ ID NO: 119261 - DNA, 22 bp, Artificial Sequence
  chemically synthesized
tctgcctctttgctggtgtgcc

SEQ ID NO: 119262 - DNA, 22 bp, Artificial Sequence
  chemically synthesized
tgcctctttgctggtgtgcctt

SEQ ID NO: 119263 - DNA, 22 bp, Artificial Sequence
  chemically synthesized
cctctttgctggtgtgccttta

SEQ ID NO: 119264 - DNA, 22 bp, Artificial Sequence
  chemically synthesized
tttgctggtgtgcctttattgc

SEQ ID NO: 119265 - DNA, 22 bp, Artificial Sequence
  chemically synthesized
tgctggtgtgcctttattgctc

SEQ ID NO: 119266 - DNA, 22 bp, Artificial Sequence
  chemically synthesized
gctggtgtgcctttattgctca

SEQ ID NO: 119267 - DNA, 22 bp, Artificial Sequence
  chemically synthesized
ctggtgtgcctttattgctcaa

SEQ ID NO: 119268 - DNA, 22 bp, Artificial Sequence
  chemically synthesized
gtgtgcctttattgctcaaccc

SEQ ID NO: 119269 - DNA, 22 bp, Artificial Sequence
  chemically synthesized
tattgctcaacccttaagtata

SEQ ID NO: 119270 - DNA, 22 bp, Artificial Sequence
  chemically synthesized
attgctcaacccttaagtatag

SEQ ID NO: 119271 - DNA, 22 bp, Artificial Sequence
  chemically synthesized
ttgctcaacccttaagtatagt

SEQ ID NO: 119272 - DNA, 22 bp, Artificial Sequence
  chemically synthesized
ctcaacccttaagtatagttct

SEQ ID NO: 119273 - DNA, 22 bp, Artificial Sequence
  chemically synthesized
aacccttaagtatagttcttcc

SEQ ID NO: 119274 - DNA, 22 bp, Artificial Sequence
  chemically synthesized
aagtatagttcttcccatcctt

SEQ ID NO: 119275 - DNA, 22 bp, Artificial Sequence
  chemically synthesized
agtatagttcttcccatccttg

SEQ ID NO: 119276 - DNA, 22 bp, Artificial Sequence
  chemically synthesized
ttcccatccttggcaatttcct

SEQ ID NO: 119277 - DNA, 22 bp, Artificial Sequence
  chemically synthesized
cccatccttggcaatttcctgg

SEQ ID NO: 119278 - DNA, 22 bp, Artificial Sequence
  chemically synthesized
ccatccttggcaatttcctggc

SEQ ID NO: 119279 - DNA, 22 bp, Artificial Sequence
  chemically synthesized
ggcaatttcctggccatattct

SEQ ID NO: 119280 - DNA, 22 bp, Artificial Sequence
  chemically synthesized
gcaatttcctggccatattcta

SEQ ID NO: 119281 - DNA, 22 bp, Artificial Sequence
  chemically synthesized
cctggccatattctattatttc

SEQ ID NO: 119282 - DNA, 22 bp, Artificial Sequence
  chemically synthesized
ctggccatattctattatttct

SEQ ID NO: 119283 - DNA, 22 bp, Artificial Sequence
  chemically synthesized
gccatattctattatttcttct

SEQ ID NO: 119284 - DNA, 22 bp, Artificial Sequence
  chemically synthesized
tattatttcttcttaatgtcat

SEQ ID NO: 119285 - DNA, 22 bp, Artificial Sequence
  chemically synthesized
ttatttcttcttaatgtcatcc

SEQ ID NO: 119286 - DNA, 22 bp, Artificial Sequence
  chemically synthesized
tttcttcttaatgtcatccact

SEQ ID NO: 119287 - DNA, 22 bp, Artificial Sequence
  chemically synthesized
cttcttaatgtcatccactacc

SEQ ID NO: 119288 - DNA, 22 bp, Artificial Sequence
  chemically synthesized
ttcttaatgtcatccactacca

SEQ ID NO: 119289 - DNA, 22 bp, Artificial Sequence
  chemically synthesized
cttaatgtcatccactaccatg

SEQ ID NO: 119290 - DNA, 22 bp, Artificial Sequence
  chemically synthesized
ttaatgtcatccactaccatga

SEQ ID NO: 119291 - DNA, 22 bp, Artificial Sequence
  chemically synthesized
aatgtcatccactaccatgatt

SEQ ID NO: 119292 - DNA, 22 bp, Artificial Sequence
  chemically synthesized
atgtcatccactaccatgattt

SEQ ID NO: 119293 - DNA, 22 bp, Artificial Sequence
  chemically synthesized
ccatgatttcatttaccatcca

SEQ ID NO: 119294 - DNA, 22 bp, Artificial Sequence
  chemically synthesized
catttaccatccatatattgat

SEQ ID NO: 119295 - DNA, 22 bp, Artificial Sequence
  chemically synthesized
atttaccatccatatattgata

SEQ ID NO: 119296 - DNA, 22 bp, Artificial Sequence
  chemically synthesized
accatccatatattgataaata

SEQ ID NO: 119297 - DNA, 22 bp, Artificial Sequence
  chemically synthesized
ccatccatatattgataaataa

SEQ ID NO: 119298 - DNA, 22 bp, Artificial Sequence
  chemically synthesized
ataaataacaaatatataattc

SEQ ID NO: 119299 - DNA, 22 bp, Artificial Sequence
  chemically synthesized
cagaacttgtctttctctcttt

SEQ ID NO: 119300 - DNA, 22 bp, Artificial Sequence
  chemically synthesized
gtctttctctcttttgatttcc

SEQ ID NO: 119301 - DNA, 22 bp, Artificial Sequence
  chemically synthesized
tctttctctcttttgatttcca

SEQ ID NO: 119302 - DNA, 22 bp, Artificial Sequence
  chemically synthesized
tctctcttttgatttccagact

SEQ ID NO: 119303 - DNA, 22 bp, Artificial Sequence
  chemically synthesized
ctctcttttgatttccagactc

SEQ ID NO: 119304 - DNA, 22 bp, Artificial Sequence
  chemically synthesized
tctcttttgatttccagactct

SEQ ID NO: 119305 - DNA, 22 bp, Artificial Sequence
  chemically synthesized
tcttttgatttccagactctag

SEQ ID NO: 119306 - DNA, 22 bp, Artificial Sequence
  chemically synthesized
ttttgatttccagactctagca

SEQ ID NO: 119307 - DNA, 22 bp, Artificial Sequence
  chemically synthesized
ttgatttccagactctagcaac

SEQ ID NO: 119308 - DNA, 22 bp, Artificial Sequence
  chemically synthesized
tgatttccagactctagcaaca

SEQ ID NO: 119309 - DNA, 22 bp, Artificial Sequence
  chemically synthesized
gatttccagactctagcaacat

SEQ ID NO: 119310 - DNA, 22 bp, Artificial Sequence
  chemically synthesized
atttccagactctagcaacatc

SEQ ID NO: 119311 - DNA, 22 bp, Artificial Sequence
  chemically synthesized
ccagactctagcaacatctgta

SEQ ID NO: 119312 - DNA, 22 bp, Artificial Sequence
  chemically synthesized
cagactctagcaacatctgtac

SEQ ID NO: 119313 - DNA, 22 bp, Artificial Sequence
  chemically synthesized
tagcaacatctgtacttttcat

SEQ ID NO: 119314 - DNA, 22 bp, Artificial Sequence
  chemically synthesized
gcaacatctgtacttttcatta

SEQ ID NO: 119315 - DNA, 22 bp, Artificial Sequence
  chemically synthesized
tacttttcattatctcagtggc

SEQ ID NO: 119316 - DNA, 22 bp, Artificial Sequence
  chemically synthesized
ttcattatctcagtggctcaag

SEQ ID NO: 119317 - DNA, 22 bp, Artificial Sequence
  chemically synthesized
tcattatctcagtggctcaagt

SEQ ID NO: 119318 - DNA, 22 bp, Artificial Sequence
  chemically synthesized
cattatctcagtggctcaagtc

SEQ ID NO: 119319 - DNA, 22 bp, Artificial Sequence
  chemically synthesized
attatctcagtggctcaagtca

SEQ ID NO: 119320 - DNA, 22 bp, Artificial Sequence
  chemically synthesized
tctcagtggctcaagtcaaatg

SEQ ID NO: 119321 - DNA, 22 bp, Artificial Sequence
  chemically synthesized
agtggctcaagtcaaatgtcat

SEQ ID NO: 119322 - DNA, 22 bp, Artificial Sequence
  chemically synthesized
aagtcaaatgtcatgttttatg

SEQ ID NO: 119323 - DNA, 22 bp, Artificial Sequence
  chemically synthesized
tatgttagacttctccatatca

SEQ ID NO: 119324 - DNA, 22 bp, Artificial Sequence
  chemically synthesized
atgttagacttctccatatcac

SEQ ID NO: 119325 - DNA, 22 bp, Artificial Sequence
  chemically synthesized
tgttagacttctccatatcaca

SEQ ID NO: 119326 - DNA, 22 bp, Artificial Sequence
  chemically synthesized
gacttctccatatcacatctct

SEQ ID NO: 119327 - DNA, 22 bp, Artificial Sequence
  chemically synthesized
ctccatatcacatctctccata

SEQ ID NO: 119328 - DNA, 22 bp, Artificial Sequence
  chemically synthesized
tccatatcacatctctccatag

SEQ ID NO: 119329 - DNA, 22 bp, Artificial Sequence
  chemically synthesized
catatcacatctctccatagta

SEQ ID NO: 119330 - DNA, 22 bp, Artificial Sequence
  chemically synthesized
tccatagtatctaatcaaccaa

SEQ ID NO: 119331 - DNA, 22 bp, Artificial Sequence
  chemically synthesized
catagtatctaatcaaccaatc

SEQ ID NO: 119332 - DNA, 22 bp, Artificial Sequence
  chemically synthesized
atcaaccaatcaccaagtccta

SEQ ID NO: 119333 - DNA, 22 bp, Artificial Sequence
  chemically synthesized
gggtttctgtttactgaatacc

SEQ ID NO: 119334 - DNA, 22 bp, Artificial Sequence
  chemically synthesized
ctgtttactgaatacctcaagt

SEQ ID NO: 119335 - DNA, 22 bp, Artificial Sequence
  chemically synthesized
tgtttactgaatacctcaagtc

SEQ ID NO: 119336 - DNA, 22 bp, Artificial Sequence
  chemically synthesized
tttactgaatacctcaagtctg

SEQ ID NO: 119337 - DNA, 22 bp, Artificial Sequence
  chemically synthesized
actgaatacctcaagtctgttt

SEQ ID NO: 119338 - DNA, 22 bp, Artificial Sequence
  chemically synthesized
ctgaatacctcaagtctgttta

SEQ ID NO: 119339 - DNA, 22 bp, Artificial Sequence
  chemically synthesized
aatacctcaagtctgtttactc

SEQ ID NO: 119340 - DNA, 22 bp, Artificial Sequence
  chemically synthesized
aagtctgtttactcaccgtcac

SEQ ID NO: 119341 - DNA, 22 bp, Artificial Sequence
  chemically synthesized
tttactcaccgtcaccttcatt

SEQ ID NO: 119342 - DNA, 22 bp, Artificial Sequence
  chemically synthesized
actcaccgtcaccttcattgat

SEQ ID NO: 119343 - DNA, 22 bp, Artificial Sequence
  chemically synthesized
ctcaccgtcaccttcattgatg

SEQ ID NO: 119344 - DNA, 22 bp, Artificial Sequence
  chemically synthesized
accgtcaccttcattgatgcta

SEQ ID NO: 119345 - DNA, 22 bp, Artificial Sequence
  chemically synthesized
cattgatgctattctaattcag

SEQ ID NO: 119346 - DNA, 22 bp, Artificial Sequence
  chemically synthesized
attgatgctattctaattcaga

SEQ ID NO: 119347 - DNA, 22 bp, Artificial Sequence
  chemically synthesized
atgctattctaattcagatcac

SEQ ID NO: 119348 - DNA, 22 bp, Artificial Sequence
  chemically synthesized
ttctaattcagatcactctttc

SEQ ID NO: 119349 - DNA, 22 bp, Artificial Sequence
  chemically synthesized
taattcagatcactctttcagg

SEQ ID NO: 119350 - DNA, 22 bp, Artificial Sequence
  chemically synthesized
attcagatcactctttcaggac

SEQ ID NO: 119351 - DNA, 22 bp, Artificial Sequence
  chemically synthesized
agatcactctttcaggactatt

SEQ ID NO: 119352 - DNA, 22 bp, Artificial Sequence
  chemically synthesized
tttcaggactattccagtgact

SEQ ID NO: 119353 - DNA, 22 bp, Artificial Sequence
  chemically synthesized
tcaggactattccagtgactca

SEQ ID NO: 119354 - DNA, 22 bp, Artificial Sequence
  chemically synthesized
caggactattccagtgactcat

SEQ ID NO: 119355 - DNA, 22 bp, Artificial Sequence
  chemically synthesized
aggactattccagtgactcatc

SEQ ID NO: 119356 - DNA, 22 bp, Artificial Sequence
  chemically synthesized
ttccagtgactcatcttttgta

SEQ ID NO: 119357 - DNA, 22 bp, Artificial Sequence
  chemically synthesized
cagtgactcatcttttgtacta

SEQ ID NO: 119358 - DNA, 22 bp, Artificial Sequence
  chemically synthesized
atcttttgtactactgtattca

SEQ ID NO: 119359 - DNA, 22 bp, Artificial Sequence
  chemically synthesized
ttgtactactgtattcagttga

SEQ ID NO: 119360 - DNA, 22 bp, Artificial Sequence
  chemically synthesized
tgtactactgtattcagttgac

SEQ ID NO: 119361 - DNA, 22 bp, Artificial Sequence
  chemically synthesized
gtactactgtattcagttgact

SEQ ID NO: 119362 - DNA, 22 bp, Artificial Sequence
  chemically synthesized
tactactgtattcagttgacta

SEQ ID NO: 119363 - DNA, 22 bp, Artificial Sequence
  chemically synthesized
ctgtattcagttgactactata

SEQ ID NO: 119364 - DNA, 22 bp, Artificial Sequence
  chemically synthesized
tattcagttgactactatatag

SEQ ID NO: 119365 - DNA, 22 bp, Artificial Sequence
  chemically synthesized
agttgactactatatagcaaga

SEQ ID NO: 119366 - DNA, 22 bp, Artificial Sequence
  chemically synthesized
actactatatagcaagagagac

SEQ ID NO: 119367 - DNA, 22 bp, Artificial Sequence
  chemically synthesized
ctatatagcaagagagacgtat

SEQ ID NO: 119368 - DNA, 22 bp, Artificial Sequence
  chemically synthesized
tatagcaagagagacgtataca

SEQ ID NO: 119369 - DNA, 22 bp, Artificial Sequence
  chemically synthesized
ttaatgaagtaaaaaaggttta

SEQ ID NO: 119370 - DNA, 22 bp, Artificial Sequence
  chemically synthesized
taatgaagtaaaaaaggtttaa

SEQ ID NO: 119371 - DNA, 22 bp, Artificial Sequence
  chemically synthesized
aatgaagtaaaaaaggtttaaa

SEQ ID NO: 119372 - DNA, 22 bp, Artificial Sequence
  chemically synthesized
atgaagtaaaaaaggtttaaaa

SEQ ID NO: 119373 - DNA, 22 bp, Artificial Sequence
  chemically synthesized
aaaatgacattcaagaccctac

SEQ ID NO: 119374 - DNA, 22 bp, Artificial Sequence
  chemically synthesized
aaatgacattcaagaccctacc

SEQ ID NO: 119375 - DNA, 22 bp, Artificial Sequence
  chemically synthesized
aagaccctaccttattttctct

SEQ ID NO: 119376 - DNA, 22 bp, Artificial Sequence
  chemically synthesized
ccttattttctctccgtgtata

SEQ ID NO: 119377 - DNA, 22 bp, Artificial Sequence
  chemically synthesized
attttctctccgtgtatatcct

SEQ ID NO: 119378 - DNA, 22 bp, Artificial Sequence
  chemically synthesized
ttttctctccgtgtatatccta

SEQ ID NO: 119379 - DNA, 22 bp, Artificial Sequence
  chemically synthesized
tctctccgtgtatatcctattt

SEQ ID NO: 119380 - DNA, 22 bp, Artificial Sequence
  chemically synthesized
ctctccgtgtatatcctatttt

SEQ ID NO: 119381 - DNA, 22 bp, Artificial Sequence
  chemically synthesized
tctccgtgtatatcctattttc

SEQ ID NO: 119382 - DNA, 22 bp, Artificial Sequence
  chemically synthesized
tccgtgtatatcctattttctt

SEQ ID NO: 119383 - DNA, 22 bp, Artificial Sequence
  chemically synthesized
cgtgtatatcctattttcttat

SEQ ID NO: 119384 - DNA, 22 bp, Artificial Sequence
  chemically synthesized
ttttcttatctatcctaatttc

SEQ ID NO: 119385 - DNA, 22 bp, Artificial Sequence
  chemically synthesized
tcttatctatcctaatttcctc

SEQ ID NO: 119386 - DNA, 22 bp, Artificial Sequence
  chemically synthesized
cttatctatcctaatttcctct

SEQ ID NO: 119387 - DNA, 22 bp, Artificial Sequence
  chemically synthesized
ttatctatcctaatttcctctg

SEQ ID NO: 119388 - DNA, 22 bp, Artificial Sequence
  chemically synthesized
atctatcctaatttcctctgta

SEQ ID NO: 119389 - DNA, 22 bp, Artificial Sequence
  chemically synthesized
tctatcctaatttcctctgtat

SEQ ID NO: 119390 - DNA, 22 bp, Artificial Sequence
  chemically synthesized
tcctaatttcctctgtatattc

SEQ ID NO: 119391 - DNA, 22 bp, Artificial Sequence
  chemically synthesized
atttcctctgtatattcacggt

SEQ ID NO: 119392 - DNA, 22 bp, Artificial Sequence
  chemically synthesized
cctctgtatattcacggtgtta

SEQ ID NO: 119393 - DNA, 22 bp, Artificial Sequence
  chemically synthesized
ctctgtatattcacggtgttaa

SEQ ID NO: 119394 - DNA, 22 bp, Artificial Sequence
  chemically synthesized
tgtatattcacggtgttaatga

SEQ ID NO: 119395 - DNA, 22 bp, Artificial Sequence
  chemically synthesized
tatattcacggtgttaatgaca

SEQ ID NO: 119396 - DNA, 22 bp, Artificial Sequence
  chemically synthesized
acggtgttaatgacactaaaca

SEQ ID NO: 119397 - DNA, 22 bp, Artificial Sequence
  chemically synthesized
atgacactaaacaattcttcca

SEQ ID NO: 119398 - DNA, 22 bp, Artificial Sequence
  chemically synthesized
aacaattcttccagtttatcta

SEQ ID NO: 119399 - DNA, 22 bp, Artificial Sequence
  chemically synthesized
ttccagtttatctagtatgctt

SEQ ID NO: 119400 - DNA, 22 bp, Artificial Sequence
  chemically synthesized
ccagtttatctagtatgcttgc

SEQ ID NO: 119401 - DNA, 22 bp, Artificial Sequence
  chemically synthesized
cagtttatctagtatgcttgct

SEQ ID NO: 119402 - DNA, 22 bp, Artificial Sequence
  chemically synthesized
atctagtatgcttgctcatagg

SEQ ID NO: 119403 - DNA, 22 bp, Artificial Sequence
  chemically synthesized
tctagtatgcttgctcataggt

SEQ ID NO: 119404 - DNA, 22 bp, Artificial Sequence
  chemically synthesized
gtatgcttgctcataggtaaac

SEQ ID NO: 119405 - DNA, 22 bp, Artificial Sequence
  chemically synthesized
gctcataggtaaacatttgtat

SEQ ID NO: 119406 - DNA, 22 bp, Artificial Sequence
  chemically synthesized
ctcataggtaaacatttgtatt

SEQ ID NO: 119407 - DNA, 22 bp, Artificial Sequence
  chemically synthesized
ataggtaaacatttgtattttc

SEQ ID NO: 119408 - DNA, 22 bp, Artificial Sequence
  chemically synthesized
gtattttcattcttcctggaat

SEQ ID NO: 119409 - DNA, 22 bp, Artificial Sequence
  chemically synthesized
tattttcattcttcctggaata

SEQ ID NO: 119410 - DNA, 22 bp, Artificial Sequence
  chemically synthesized
tcattcttcctggaataaaaac

SEQ ID NO: 119411 - DNA, 22 bp, Artificial Sequence
  chemically synthesized
cattcttcctggaataaaaaca

SEQ ID NO: 119412 - DNA, 22 bp, Artificial Sequence
  chemically synthesized
attcttcctggaataaaaacat

SEQ ID NO: 119413 - DNA, 22 bp, Artificial Sequence
  chemically synthesized
ttcctggaataaaaacattttt

SEQ ID NO: 119414 - DNA, 22 bp, Artificial Sequence
  chemically synthesized
cctggaataaaaacattttttc

SEQ ID NO: 119415 - DNA, 22 bp, Artificial Sequence
  chemically synthesized
ctggaataaaaacattttttcc

SEQ ID NO: 119416 - DNA, 22 bp, Artificial Sequence
  chemically synthesized
gaataaaaacattttttcctga

SEQ ID NO: 119417 - DNA, 22 bp, Artificial Sequence
  chemically synthesized
tttcctgaaatagctttccctt

SEQ ID NO: 119418 - DNA, 22 bp, Artificial Sequence
  chemically synthesized
ttcctgaaatagctttccctta

SEQ ID NO: 119419 - DNA, 22 bp, Artificial Sequence
  chemically synthesized
tcctgaaatagctttcccttaa

SEQ ID NO: 119420 - DNA, 22 bp, Artificial Sequence
  chemically synthesized
cctgaaatagctttcccttaat

SEQ ID NO: 119421 - DNA, 22 bp, Artificial Sequence
  chemically synthesized
ctgaaatagctttcccttaatc

SEQ ID NO: 119422 - DNA, 22 bp, Artificial Sequence
  chemically synthesized
aaatagctttcccttaatcttt

SEQ ID NO: 119423 - DNA, 22 bp, Artificial Sequence
  chemically synthesized
tcccttaatctttgtctagtta

SEQ ID NO: 119424 - DNA, 22 bp, Artificial Sequence
  chemically synthesized
cccttaatctttgtctagttaa

SEQ ID NO: 119425 - DNA, 22 bp, Artificial Sequence
  chemically synthesized
ccttaatctttgtctagttaac

SEQ ID NO: 119426 - DNA, 22 bp, Artificial Sequence
  chemically synthesized
aatctttgtctagttaacttct

SEQ ID NO: 119427 - DNA, 22 bp, Artificial Sequence
  chemically synthesized
atctttgtctagttaacttcta

SEQ ID NO: 119428 - DNA, 22 bp, Artificial Sequence
  chemically synthesized
tgtctagttaacttctactaat

SEQ ID NO: 119429 - DNA, 22 bp, Artificial Sequence
  chemically synthesized
gtctagttaacttctactaata

SEQ ID NO: 119430 - DNA, 22 bp, Artificial Sequence
  chemically synthesized
tctagttaacttctactaatat

SEQ ID NO: 119431 - DNA, 22 bp, Artificial Sequence
  chemically synthesized
gttaacttctactaatataacc

SEQ ID NO: 119432 - DNA, 22 bp, Artificial Sequence
  chemically synthesized
acttctactaatataacccacc

SEQ ID NO: 119433 - DNA, 22 bp, Artificial Sequence
  chemically synthesized
ctactaatataacccaccttag

SEQ ID NO: 119434 - DNA, 22 bp, Artificial Sequence
  chemically synthesized
tactaatataacccaccttagc

SEQ ID NO: 119435 - DNA, 22 bp, Artificial Sequence
  chemically synthesized
ctaatataacccaccttagctt

SEQ ID NO: 119436 - DNA, 22 bp, Artificial Sequence
  chemically synthesized
atataacccaccttagcttaga

SEQ ID NO: 119437 - DNA, 22 bp, Artificial Sequence
  chemically synthesized
agcttagatatgatgtccttca

SEQ ID NO: 119438 - DNA, 22 bp, Artificial Sequence
  chemically synthesized
gcttagatatgatgtccttcag

SEQ ID NO: 119439 - DNA, 22 bp, Artificial Sequence
  chemically synthesized
agatatgatgtccttcagaagg

SEQ ID NO: 119440 - DNA, 22 bp, Artificial Sequence
  chemically synthesized
gatatgatgtccttcagaaggc

SEQ ID NO: 119441 - DNA, 22 bp, Artificial Sequence
  chemically synthesized
cagaaggccttcttaaattccc

SEQ ID NO: 119442 - DNA, 22 bp, Artificial Sequence
  chemically synthesized
agaaggccttcttaaattcccc

SEQ ID NO: 119443 - DNA, 22 bp, Artificial Sequence
  chemically synthesized
cttaaattccccaagtttagtt

SEQ ID NO: 119444 - DNA, 22 bp, Artificial Sequence
  chemically synthesized
ttaaattccccaagtttagttt

SEQ ID NO: 119445 - DNA, 22 bp, Artificial Sequence
  chemically synthesized
aaattccccaagtttagtttga

SEQ ID NO: 119446 - DNA, 22 bp, Artificial Sequence
  chemically synthesized
aattccccaagtttagtttgaa

SEQ ID NO: 119447 - DNA, 22 bp, Artificial Sequence
  chemically synthesized
cccaagtttagtttgaataccc

SEQ ID NO: 119448 - DNA, 22 bp, Artificial Sequence
  chemically synthesized
agtttgaataccctctcctatg

SEQ ID NO: 119449 - DNA, 22 bp, Artificial Sequence
  chemically synthesized
gtttgaataccctctcctatgt

SEQ ID NO: 119450 - DNA, 22 bp, Artificial Sequence
  chemically synthesized
gaataccctctcctatgtgttc

SEQ ID NO: 119451 - DNA, 22 bp, Artificial Sequence
  chemically synthesized
aataccctctcctatgtgttcc

SEQ ID NO: 119452 - DNA, 22 bp, Artificial Sequence
  chemically synthesized
tcctatgtgttcctgtagttca

SEQ ID NO: 119453 - DNA, 22 bp, Artificial Sequence
  chemically synthesized
ctatgtgttcctgtagttcact

SEQ ID NO: 119454 - DNA, 22 bp, Artificial Sequence
  chemically synthesized
tgtgttcctgtagttcactatg

SEQ ID NO: 119455 - DNA, 22 bp, Artificial Sequence
  chemically synthesized
ctgtagttcactatgcactaat

SEQ ID NO: 119456 - DNA, 22 bp, Artificial Sequence
  chemically synthesized
tagttcactatgcactaattac

SEQ ID NO: 119457 - DNA, 22 bp, Artificial Sequence
  chemically synthesized
actatgcactaattaccatgat

SEQ ID NO: 119458 - DNA, 22 bp, Artificial Sequence
  chemically synthesized
tgcactaattaccatgatattt

SEQ ID NO: 119459 - DNA, 22 bp, Artificial Sequence
  chemically synthesized
attaccatgatattttccctgc

SEQ ID NO: 119460 - DNA, 22 bp, Artificial Sequence
  chemically synthesized
ccatgatattttccctgcagca

SEQ ID NO: 119461 - DNA, 22 bp, Artificial Sequence
  chemically synthesized
tccctgcagcattgtcaatttc

SEQ ID NO: 119462 - DNA, 22 bp, Artificial Sequence
  chemically synthesized
ccctgcagcattgtcaatttct

SEQ ID NO: 119463 - DNA, 22 bp, Artificial Sequence
  chemically synthesized
cctgcagcattgtcaatttctg

SEQ ID NO: 119464 - DNA, 22 bp, Artificial Sequence
  chemically synthesized
cagcattgtcaatttctgtatt

SEQ ID NO: 119465 - DNA, 22 bp, Artificial Sequence
  chemically synthesized
tcaatttctgtattgcttctat

SEQ ID NO: 119466 - DNA, 22 bp, Artificial Sequence
  chemically synthesized
ctgtattgcttctataatgtga

SEQ ID NO: 119467 - DNA, 22 bp, Artificial Sequence
  chemically synthesized
tgtattgcttctataatgtgaa

SEQ ID NO: 119468 - DNA, 22 bp, Artificial Sequence
  chemically synthesized
tattgcttctataatgtgaatt

SEQ ID NO: 119469 - DNA, 22 bp, Artificial Sequence
  chemically synthesized
cttctataatgtgaattccttg

SEQ ID NO: 119470 - DNA, 22 bp, Artificial Sequence
  chemically synthesized
ctataatgtgaattccttgtgg

SEQ ID NO: 119471 - DNA, 22 bp, Artificial Sequence
  chemically synthesized
tataatgtgaattccttgtgga

SEQ ID NO: 119472 - DNA, 22 bp, Artificial Sequence
  chemically synthesized
taatgtgaattccttgtggaca

SEQ ID NO: 119473 - DNA, 22 bp, Artificial Sequence
  chemically synthesized
cttgtggacataaaccatgact

SEQ ID NO: 119474 - DNA, 22 bp, Artificial Sequence
  chemically synthesized
gtggacataaaccatgactgtc

SEQ ID NO: 119475 - DNA, 22 bp, Artificial Sequence
  chemically synthesized
tggacataaaccatgactgtct

SEQ ID NO: 119476 - DNA, 22 bp, Artificial Sequence
  chemically synthesized
tctcttttttaattttaatatt

SEQ ID NO: 119477 - DNA, 22 bp, Artificial Sequence
  chemically synthesized
ttttttaattttaatattagct

SEQ ID NO: 119478 - DNA, 22 bp, Artificial Sequence
  chemically synthesized
ttttaattttaatattagctct

SEQ ID NO: 119479 - DNA, 22 bp, Artificial Sequence
  chemically synthesized
tttaattttaatattagctcta

SEQ ID NO: 119480 - DNA, 22 bp, Artificial Sequence
  chemically synthesized
ttaattttaatattagctctag

SEQ ID NO: 119481 - DNA, 22 bp, Artificial Sequence
  chemically synthesized
taattttaatattagctctagg

SEQ ID NO: 119482 - DNA, 22 bp, Artificial Sequence
  chemically synthesized
aattttaatattagctctaggg

SEQ ID NO: 119483 - DNA, 22 bp, Artificial Sequence
  chemically synthesized
attttaatattagctctaggga

SEQ ID NO: 119484 - DNA, 22 bp, Artificial Sequence
  chemically synthesized
taatattagctctagggattga

SEQ ID NO: 119485 - DNA, 22 bp, Artificial Sequence
  chemically synthesized
aatattagctctagggattgac

SEQ ID NO: 119486 - DNA, 22 bp, Artificial Sequence
  chemically synthesized
atattagctctagggattgact

SEQ ID NO: 119487 - DNA, 22 bp, Artificial Sequence
  chemically synthesized
gctctagggattgactttttta

SEQ ID NO: 119488 - DNA, 22 bp, Artificial Sequence
  chemically synthesized
tagggattgacttttttagcca

SEQ ID NO: 119489 - DNA, 22 bp, Artificial Sequence
  chemically synthesized
gggattgacttttttagccacc

SEQ ID NO: 119490 - DNA, 22 bp, Artificial Sequence
  chemically synthesized
acttttttagccaccatatcat

SEQ ID NO: 119491 - DNA, 22 bp, Artificial Sequence
  chemically synthesized
ttttagccaccatatcattgga

SEQ ID NO: 119492 - DNA, 22 bp, Artificial Sequence
  chemically synthesized
tttagccaccatatcattggaa

SEQ ID NO: 119493 - DNA, 22 bp, Artificial Sequence
  chemically synthesized
ttagccaccatatcattggaat

SEQ ID NO: 119494 - DNA, 22 bp, Artificial Sequence
  chemically synthesized
tagccaccatatcattggaatc

SEQ ID NO: 119495 - DNA, 22 bp, Artificial Sequence
  chemically synthesized
agccaccatatcattggaatcc

SEQ ID NO: 119496 - DNA, 22 bp, Artificial Sequence
  chemically synthesized
gccaccatatcattggaatcct

SEQ ID NO: 119497 - DNA, 22 bp, Artificial Sequence
  chemically synthesized
gaatcctttaaatattatttga

SEQ ID NO: 119498 - DNA, 22 bp, Artificial Sequence
  chemically synthesized
taaatattatttgaataaatta

SEQ ID NO: 119499 - DNA, 22 bp, Artificial Sequence
  chemically synthesized
aaatattatttgaataaattat

SEQ ID NO: 119500 - DNA, 22 bp, Artificial Sequence
  chemically synthesized
aatattatttgaataaattatt

SEQ ID NO: 119501 - DNA, 22 bp, Artificial Sequence
  chemically synthesized
tttgaataaattattaaatatg

SEQ ID NO: 119502 - DNA, 22 bp, Artificial Sequence
  chemically synthesized
gaataaattattaaatatgtat

SEQ ID NO: 119503 - DNA, 22 bp, Artificial Sequence
  chemically synthesized
aataaattattaaatatgtatc

SEQ ID NO: 119504 - DNA, 22 bp, Artificial Sequence
  chemically synthesized
ttaaatatgtatcattaccatt

SEQ ID NO: 119505 - DNA, 22 bp, Artificial Sequence
  chemically synthesized
aatatgtatcattaccattaat

SEQ ID NO: 119506 - DNA, 22 bp, Artificial Sequence
  chemically synthesized
ccattaatcttatttcaataat

SEQ ID NO: 119507 - DNA, 22 bp, Artificial Sequence
  chemically synthesized
atcttatttcaataattatttc

SEQ ID NO: 119508 - DNA, 22 bp, Artificial Sequence
  chemically synthesized
atttcaataattatttcaatat

SEQ ID NO: 119509 - DNA, 22 bp, Artificial Sequence
  chemically synthesized
tttcaataattatttcaatatt

SEQ ID NO: 119510 - DNA, 22 bp, Artificial Sequence
  chemically synthesized
caataattatttcaatattcaa

SEQ ID NO: 119511 - DNA, 22 bp, Artificial Sequence
  chemically synthesized
aataattatttcaatattcaat

SEQ ID NO: 119512 - DNA, 22 bp, Artificial Sequence
  chemically synthesized
tttcaatattcaattatttcaa

SEQ ID NO: 119513 - DNA, 22 bp, Artificial Sequence
  chemically synthesized
caatattcaattatttcaataa

SEQ ID NO: 119514 - DNA, 22 bp, Artificial Sequence
  chemically synthesized
aatattcaattatttcaataat

SEQ ID NO: 119515 - DNA, 22 bp, Artificial Sequence
  chemically synthesized
aattatttcaataattattcat

SEQ ID NO: 119516 - DNA, 22 bp, Artificial Sequence
  chemically synthesized
tttcaataattattcattaatt

SEQ ID NO: 119517 - DNA, 22 bp, Artificial Sequence
  chemically synthesized
caataattattcattaattgat

SEQ ID NO: 119518 - DNA, 22 bp, Artificial Sequence
  chemically synthesized
aataattattcattaattgatt

SEQ ID NO: 119519 - DNA, 22 bp, Artificial Sequence
  chemically synthesized
ttcattaattgattcaataaat

SEQ ID NO: 119520 - DNA, 22 bp, Artificial Sequence
  chemically synthesized
attaattgattcaataaataca

SEQ ID NO: 119521 - DNA, 22 bp, Artificial Sequence
  chemically synthesized
attgattcaataaatacatatt

SEQ ID NO: 119522 - DNA, 22 bp, Artificial Sequence
  chemically synthesized
attcaataaatacatattgaaa

SEQ ID NO: 119523 - DNA, 22 bp, Artificial Sequence
  chemically synthesized
aataaatacatattgaaattgt

SEQ ID NO: 119524 - DNA, 22 bp, Artificial Sequence
  chemically synthesized
aaattgtattacatggcagaca

SEQ ID NO: 119525 - DNA, 22 bp, Artificial Sequence
  chemically synthesized
tattacatggcagacataattc

SEQ ID NO: 119526 - DNA, 22 bp, Artificial Sequence
  chemically synthesized
catggcagacataattctatta

SEQ ID NO: 119527 - DNA, 22 bp, Artificial Sequence
  chemically synthesized
tattaggttggtgcaaaagtaa

SEQ ID NO: 119528 - DNA, 22 bp, Artificial Sequence
  chemically synthesized
ttaggttggtgcaaaagtaatt

SEQ ID NO: 119529 - DNA, 22 bp, Artificial Sequence
  chemically synthesized
ggttggtgcaaaagtaattgtg

SEQ ID NO: 119530 - DNA, 22 bp, Artificial Sequence
  chemically synthesized
gtgcaaaagtaattgtggtttt

SEQ ID NO: 119531 - DNA, 22 bp, Artificial Sequence
  chemically synthesized
tggtttttaccattactttcaa

SEQ ID NO: 119532 - DNA, 22 bp, Artificial Sequence
  chemically synthesized
ttaccattactttcaatggcaa

SEQ ID NO: 119533 - DNA, 22 bp, Artificial Sequence
  chemically synthesized
taccattactttcaatggcaag

SEQ ID NO: 119534 - DNA, 22 bp, Artificial Sequence
  chemically synthesized
accattactttcaatggcaaga

SEQ ID NO: 119535 - DNA, 22 bp, Artificial Sequence
  chemically synthesized
ccattactttcaatggcaagaa

SEQ ID NO: 119536 - DNA, 22 bp, Artificial Sequence
  chemically synthesized
ctttcaatggcaagaactgcaa

SEQ ID NO: 119537 - DNA, 22 bp, Artificial Sequence
  chemically synthesized
tcaatggcaagaactgcaatta

SEQ ID NO: 119538 - DNA, 22 bp, Artificial Sequence
  chemically synthesized
caatggcaagaactgcaattac

SEQ ID NO: 119539 - DNA, 22 bp, Artificial Sequence
  chemically synthesized
aatggcaagaactgcaattact

SEQ ID NO: 119540 - DNA, 22 bp, Artificial Sequence
  chemically synthesized
caattacttttacacctaggta

SEQ ID NO: 119541 - DNA, 22 bp, Artificial Sequence
  chemically synthesized
cttttacacctaggtactgaaa

SEQ ID NO: 119542 - DNA, 22 bp, Artificial Sequence
  chemically synthesized
ttacacctaggtactgaaaata

SEQ ID NO: 119543 - DNA, 22 bp, Artificial Sequence
  chemically synthesized
tacacctaggtactgaaaatac

SEQ ID NO: 119544 - DNA, 22 bp, Artificial Sequence
  chemically synthesized
acacctaggtactgaaaataca

SEQ ID NO: 119545 - DNA, 22 bp, Artificial Sequence
  chemically synthesized
cacctaggtactgaaaatacaa

SEQ ID NO: 119546 - DNA, 22 bp, Artificial Sequence
  chemically synthesized
ggtactgaaaatacaatgaaca

SEQ ID NO: 119547 - DNA, 22 bp, Artificial Sequence
  chemically synthesized
aaaatacaatgaacagaaacag

SEQ ID NO: 119548 - DNA, 22 bp, Artificial Sequence
  chemically synthesized
caatgcaaggtaatgtaatgca

SEQ ID NO: 119549 - DNA, 22 bp, Artificial Sequence
  chemically synthesized
tatatagggtagtcagagaaga

SEQ ID NO: 119550 - DNA, 22 bp, Artificial Sequence
  chemically synthesized
atatagggtagtcagagaagac

SEQ ID NO: 119551 - DNA, 22 bp, Artificial Sequence
  chemically synthesized
tatagggtagtcagagaagacc

SEQ ID NO: 119552 - DNA, 22 bp, Artificial Sequence
  chemically synthesized
tctgagtaggtaattttagaga

SEQ ID NO: 119553 - DNA, 22 bp, Artificial Sequence
  chemically synthesized
tgagtaggtaattttagagaag

SEQ ID NO: 119554 - DNA, 22 bp, Artificial Sequence
  chemically synthesized
agtaggtaattttagagaagaa

SEQ ID NO: 119555 - DNA, 22 bp, Artificial Sequence
  chemically synthesized
tagagaagaaatcaaaatcaga

SEQ ID NO: 119556 - DNA, 22 bp, Artificial Sequence
  chemically synthesized
agagaagaaatcaaaatcagag

SEQ ID NO: 119557 - DNA, 22 bp, Artificial Sequence
  chemically synthesized
gagaagaaatcaaaatcagagg

SEQ ID NO: 119558 - DNA, 22 bp, Artificial Sequence
  chemically synthesized
tcttagggaaaaacattcaagg

SEQ ID NO: 119559 - DNA, 22 bp, Artificial Sequence
  chemically synthesized
agggaaaaacattcaaggaagg

SEQ ID NO: 119560 - DNA, 22 bp, Artificial Sequence
  chemically synthesized
gggaaaaacattcaaggaagga

SEQ ID NO: 119561 - DNA, 22 bp, Artificial Sequence
  chemically synthesized
aaggaaggaggaagaacaagtg

SEQ ID NO: 119562 - DNA, 22 bp, Artificial Sequence
  chemically synthesized
ctgaagcagagagcagcttgac

SEQ ID NO: 119563 - DNA, 22 bp, Artificial Sequence
  chemically synthesized
aagcagagagcagcttgacaag

SEQ ID NO: 119564 - DNA, 22 bp, Artificial Sequence
  chemically synthesized
gacaagtttaaaagacaaaaga

SEQ ID NO: 119565 - DNA, 22 bp, Artificial Sequence
  chemically synthesized
acaagtttaaaagacaaaagaa

SEQ ID NO: 119566 - DNA, 22 bp, Artificial Sequence
  chemically synthesized
aaaagacaaaagaaggccaatg

SEQ ID NO: 119567 - DNA, 22 bp, Artificial Sequence
  chemically synthesized
aaagacaaaagaaggccaatgt

SEQ ID NO: 119568 - DNA, 22 bp, Artificial Sequence
  chemically synthesized
aatggaggaagcaaggtgggga

SEQ ID NO: 119569 - DNA, 22 bp, Artificial Sequence
  chemically synthesized
gaagtagcagctaaatgctacg

SEQ ID NO: 119570 - DNA, 22 bp, Artificial Sequence
  chemically synthesized
aagtagcagctaaatgctacgt

SEQ ID NO: 119571 - DNA, 22 bp, Artificial Sequence
  chemically synthesized
aatgctacgtcatgtatgatct

SEQ ID NO: 119572 - DNA, 22 bp, Artificial Sequence
  chemically synthesized
cgtcatgtatgatcttgcaggt

SEQ ID NO: 119573 - DNA, 22 bp, Artificial Sequence
  chemically synthesized
gcaggtcacgcaagctactttg

SEQ ID NO: 119574 - DNA, 22 bp, Artificial Sequence
  chemically synthesized
caggtcacgcaagctactttga

SEQ ID NO: 119575 - DNA, 22 bp, Artificial Sequence
  chemically synthesized
ctttgaattttattatacttgt

SEQ ID NO: 119576 - DNA, 22 bp, Artificial Sequence
  chemically synthesized
tgaattttattatacttgtgag

SEQ ID NO: 119577 - DNA, 22 bp, Artificial Sequence
  chemically synthesized
gaattttattatacttgtgagc

SEQ ID NO: 119578 - DNA, 22 bp, Artificial Sequence
  chemically synthesized
aattttattatacttgtgagct

SEQ ID NO: 119579 - DNA, 22 bp, Artificial Sequence
  chemically synthesized
tattatacttgtgagcttcgag

SEQ ID NO: 119580 - DNA, 22 bp, Artificial Sequence
  chemically synthesized
attatacttgtgagcttcgagt

SEQ ID NO: 119581 - DNA, 22 bp, Artificial Sequence
  chemically synthesized
ttatacttgtgagcttcgagtt

SEQ ID NO: 119582 - DNA, 22 bp, Artificial Sequence
  chemically synthesized
tacttgtgagcttcgagttgag

SEQ ID NO: 119583 - DNA, 22 bp, Artificial Sequence
  chemically synthesized
gtgagcttcgagttgagagcag

SEQ ID NO: 119584 - DNA, 22 bp, Artificial Sequence
  chemically synthesized
tgagcttcgagttgagagcaga

SEQ ID NO: 119585 - DNA, 22 bp, Artificial Sequence
  chemically synthesized
cgagttgagagcagaggtgctg

SEQ ID NO: 119586 - DNA, 22 bp, Artificial Sequence
  chemically synthesized
gagttgagagcagaggtgctgc

SEQ ID NO: 119587 - DNA, 22 bp, Artificial Sequence
  chemically synthesized
agagcagaggtgctgcatggat

SEQ ID NO: 119588 - DNA, 22 bp, Artificial Sequence
  chemically synthesized
catggatataaggcttacatca

SEQ ID NO: 119589 - DNA, 22 bp, Artificial Sequence
  chemically synthesized
acatcactttggcaaggggtaa

SEQ ID NO: 119590 - DNA, 22 bp, Artificial Sequence
  chemically synthesized
catcactttggcaaggggtaaa

SEQ ID NO: 119591 - DNA, 22 bp, Artificial Sequence
  chemically synthesized
tggcaaggggtaaaaaatagtc

SEQ ID NO: 119592 - DNA, 22 bp, Artificial Sequence
  chemically synthesized
ggcaaggggtaaaaaatagtcc

SEQ ID NO: 119593 - DNA, 22 bp, Artificial Sequence
  chemically synthesized
gcaaggggtaaaaaatagtcca

SEQ ID NO: 119594 - DNA, 22 bp, Artificial Sequence
  chemically synthesized
atcttttccatttctttacttc

SEQ ID NO: 119595 - DNA, 22 bp, Artificial Sequence
  chemically synthesized
tcttttccatttctttacttct

SEQ ID NO: 119596 - DNA, 22 bp, Artificial Sequence
  chemically synthesized
ttccatttctttacttctcagt

SEQ ID NO: 119597 - DNA, 22 bp, Artificial Sequence
  chemically synthesized
tccatttctttacttctcagtt

SEQ ID NO: 119598 - DNA, 22 bp, Artificial Sequence
  chemically synthesized
ccatttctttacttctcagttt

SEQ ID NO: 119599 - DNA, 22 bp, Artificial Sequence
  chemically synthesized
catttctttacttctcagttta

SEQ ID NO: 119600 - DNA, 22 bp, Artificial Sequence
  chemically synthesized
ctttacttctcagtttactact

SEQ ID NO: 119601 - DNA, 22 bp, Artificial Sequence
  chemically synthesized
tttacttctcagtttactactc

SEQ ID NO: 119602 - DNA, 22 bp, Artificial Sequence
  chemically synthesized
tacttctcagtttactactcaa

SEQ ID NO: 119603 - DNA, 22 bp, Artificial Sequence
  chemically synthesized
acttctcagtttactactcaac

SEQ ID NO: 119604 - DNA, 22 bp, Artificial Sequence
  chemically synthesized
cttctcagtttactactcaacc

SEQ ID NO: 119605 - DNA, 22 bp, Artificial Sequence
  chemically synthesized
ctcagtttactactcaaccaac

SEQ ID NO: 119606 - DNA, 22 bp, Artificial Sequence
  chemically synthesized
tcagtttactactcaaccaacc

SEQ ID NO: 119607 - DNA, 22 bp, Artificial Sequence
  chemically synthesized
agtttactactcaaccaaccac

SEQ ID NO: 119608 - DNA, 22 bp, Artificial Sequence
  chemically synthesized
actactcaaccaaccaccctat

SEQ ID NO: 119609 - DNA, 22 bp, Artificial Sequence
  chemically synthesized
ctactcaaccaaccaccctata

SEQ ID NO: 119610 - DNA, 22 bp, Artificial Sequence
  chemically synthesized
ctcaaccaaccaccctataatg

SEQ ID NO: 119611 - DNA, 22 bp, Artificial Sequence
  chemically synthesized
aaccaaccaccctataatgttt

SEQ ID NO: 119612 - DNA, 22 bp, Artificial Sequence
  chemically synthesized
taatgttttttttaaaacccac

SEQ ID NO: 119613 - DNA, 22 bp, Artificial Sequence
  chemically synthesized
tttttaaaacccacttagctaa

SEQ ID NO: 119614 - DNA, 22 bp, Artificial Sequence
  chemically synthesized
ttttaaaacccacttagctaaa

SEQ ID NO: 119615 - DNA, 22 bp, Artificial Sequence
  chemically synthesized
tttaaaacccacttagctaaag

SEQ ID NO: 119616 - DNA, 22 bp, Artificial Sequence
  chemically synthesized
ttaaaacccacttagctaaagc

SEQ ID NO: 119617 - DNA, 22 bp, Artificial Sequence
  chemically synthesized
taaaacccacttagctaaagca

SEQ ID NO: 119618 - DNA, 22 bp, Artificial Sequence
  chemically synthesized
aaaacccacttagctaaagcaa

SEQ ID NO: 119619 - DNA, 22 bp, Artificial Sequence
  chemically synthesized
aaacccacttagctaaagcaat

SEQ ID NO: 119620 - DNA, 22 bp, Artificial Sequence
  chemically synthesized
agctaaagcaatgctccttaaa

SEQ ID NO: 119621 - DNA, 22 bp, Artificial Sequence
  chemically synthesized
gctaaagcaatgctccttaaat

SEQ ID NO: 119622 - DNA, 22 bp, Artificial Sequence
  chemically synthesized
aagcaatgctccttaaattcac

SEQ ID NO: 119623 - DNA, 22 bp, Artificial Sequence
  chemically synthesized
cttaaattcaccagtgacttct

SEQ ID NO: 119624 - DNA, 22 bp, Artificial Sequence
  chemically synthesized
aaattcaccagtgacttctagg

SEQ ID NO: 119625 - DNA, 22 bp, Artificial Sequence
  chemically synthesized
aattcaccagtgacttctaggg

SEQ ID NO: 119626 - DNA, 22 bp, Artificial Sequence
  chemically synthesized
accagtgacttctaggggccaa

SEQ ID NO: 119627 - DNA, 22 bp, Artificial Sequence
  chemically synthesized
ctaggggccaaatgcaatggag

SEQ ID NO: 119628 - DNA, 22 bp, Artificial Sequence
  chemically synthesized
taggggccaaatgcaatggaga

SEQ ID NO: 119629 - DNA, 22 bp, Artificial Sequence
  chemically synthesized
ggggccaaatgcaatggagagt

SEQ ID NO: 119630 - DNA, 22 bp, Artificial Sequence
  chemically synthesized
aatcatacctgcttttattgat

SEQ ID NO: 119631 - DNA, 22 bp, Artificial Sequence
  chemically synthesized
atcatacctgcttttattgatt

SEQ ID NO: 119632 - DNA, 22 bp, Artificial Sequence
  chemically synthesized
cttttattgatttttttgtgca

SEQ ID NO: 119633 - DNA, 22 bp, Artificial Sequence
  chemically synthesized
ttattgatttttttgtgcaata

SEQ ID NO: 119634 - DNA, 22 bp, Artificial Sequence
  chemically synthesized
tattgatttttttgtgcaatag

SEQ ID NO: 119635 - DNA, 22 bp, Artificial Sequence
  chemically synthesized
attgatttttttgtgcaatagt

SEQ ID NO: 119636 - DNA, 22 bp, Artificial Sequence
  chemically synthesized
ttgatttttttgtgcaatagtt

SEQ ID NO: 119637 - DNA, 22 bp, Artificial Sequence
  chemically synthesized
atttttttgtgcaatagttgtg

SEQ ID NO: 119638 - DNA, 22 bp, Artificial Sequence
  chemically synthesized
ttttgtgcaatagttgtgtgct

SEQ ID NO: 119639 - DNA, 22 bp, Artificial Sequence
  chemically synthesized
tttgtgcaatagttgtgtgctc

SEQ ID NO: 119640 - DNA, 22 bp, Artificial Sequence
  chemically synthesized
ttgtgcaatagttgtgtgctct

SEQ ID NO: 119641 - DNA, 22 bp, Artificial Sequence
  chemically synthesized
tgtgcaatagttgtgtgctctg

SEQ ID NO: 119642 - DNA, 22 bp, Artificial Sequence
  chemically synthesized
gtgcaatagttgtgtgctctgg

SEQ ID NO: 119643 - DNA, 22 bp, Artificial Sequence
  chemically synthesized
tgcaatagttgtgtgctctggc

SEQ ID NO: 119644 - DNA, 22 bp, Artificial Sequence
  chemically synthesized
tgtgctctggccatgccttcct

SEQ ID NO: 119645 - DNA, 22 bp, Artificial Sequence
  chemically synthesized
tggccatgccttcctttttaga

SEQ ID NO: 119646 - DNA, 22 bp, Artificial Sequence
  chemically synthesized
gccatgccttcctttttagagc

SEQ ID NO: 119647 - DNA, 22 bp, Artificial Sequence
  chemically synthesized
cctttttagagctctctctaga

SEQ ID NO: 119648 - DNA, 22 bp, Artificial Sequence
  chemically synthesized
ctttttagagctctctctagaa

SEQ ID NO: 119649 - DNA, 22 bp, Artificial Sequence
  chemically synthesized
tttagagctctctctagaaatt

SEQ ID NO: 119650 - DNA, 22 bp, Artificial Sequence
  chemically synthesized
ttagagctctctctagaaattc

SEQ ID NO: 119651 - DNA, 22 bp, Artificial Sequence
  chemically synthesized
tagagctctctctagaaattct

SEQ ID NO: 119652 - DNA, 22 bp, Artificial Sequence
  chemically synthesized
agagctctctctagaaattctt

SEQ ID NO: 119653 - DNA, 22 bp, Artificial Sequence
  chemically synthesized
gagctctctctagaaattctta

SEQ ID NO: 119654 - DNA, 22 bp, Artificial Sequence
  chemically synthesized
tctctagaaattcttaatgcca

SEQ ID NO: 119655 - DNA, 22 bp, Artificial Sequence
  chemically synthesized
tctagaaattcttaatgccaag

SEQ ID NO: 119656 - DNA, 22 bp, Artificial Sequence
  chemically synthesized
tagaaattcttaatgccaagat

SEQ ID NO: 119657 - DNA, 22 bp, Artificial Sequence
  chemically synthesized
gaaattcttaatgccaagatct

SEQ ID NO: 119658 - DNA, 22 bp, Artificial Sequence
  chemically synthesized
ttaatgccaagatctgctggtt

SEQ ID NO: 119659 - DNA, 22 bp, Artificial Sequence
  chemically synthesized
aatgccaagatctgctggttct

SEQ ID NO: 119660 - DNA, 22 bp, Artificial Sequence
  chemically synthesized
atgccaagatctgctggttctc

SEQ ID NO: 119661 - DNA, 22 bp, Artificial Sequence
  chemically synthesized
ctggttctcttctgatttttgt

SEQ ID NO: 119662 - DNA, 22 bp, Artificial Sequence
  chemically synthesized
gttctcttctgatttttgtgat

SEQ ID NO: 119663 - DNA, 22 bp, Artificial Sequence
  chemically synthesized
tcttctgatttttgtgatagct

SEQ ID NO: 119664 - DNA, 22 bp, Artificial Sequence
  chemically synthesized
ttctgatttttgtgatagcttc

SEQ ID NO: 119665 - DNA, 22 bp, Artificial Sequence
  chemically synthesized
ctgatttttgtgatagcttcta

SEQ ID NO: 119666 - DNA, 22 bp, Artificial Sequence
  chemically synthesized
tgatttttgtgatagcttctat

SEQ ID NO: 119667 - DNA, 22 bp, Artificial Sequence
  chemically synthesized
atttttgtgatagcttctatgc

SEQ ID NO: 119668 - DNA, 22 bp, Artificial Sequence
  chemically synthesized
ttgtgatagcttctatgcactc

SEQ ID NO: 119669 - DNA, 22 bp, Artificial Sequence
  chemically synthesized
tgtgatagcttctatgcactct

SEQ ID NO: 119670 - DNA, 22 bp, Artificial Sequence
  chemically synthesized
gtgatagcttctatgcactctc

SEQ ID NO: 119671 - DNA, 22 bp, Artificial Sequence
  chemically synthesized
tgatagcttctatgcactctct

SEQ ID NO: 119672 - DNA, 22 bp, Artificial Sequence
  chemically synthesized
ctatgcactctcttatttccat

SEQ ID NO: 119673 - DNA, 22 bp, Artificial Sequence
  chemically synthesized
tatgcactctcttatttccatt

SEQ ID NO: 119674 - DNA, 22 bp, Artificial Sequence
  chemically synthesized
tgcactctcttatttccattgc

SEQ ID NO: 119675 - DNA, 22 bp, Artificial Sequence
  chemically synthesized
tcttatttccattgctcaaata

SEQ ID NO: 119676 - DNA, 22 bp, Artificial Sequence
  chemically synthesized
ttatttccattgctcaaatatt

SEQ ID NO: 119677 - DNA, 22 bp, Artificial Sequence
  chemically synthesized
atttccattgctcaaatattta

SEQ ID NO: 119678 - DNA, 22 bp, Artificial Sequence
  chemically synthesized
tttccattgctcaaatatttat

SEQ ID NO: 119679 - DNA, 22 bp, Artificial Sequence
  chemically synthesized
ccattgctcaaatatttatgtt

SEQ ID NO: 119680 - DNA, 22 bp, Artificial Sequence
  chemically synthesized
cattgctcaaatatttatgtta

SEQ ID NO: 119681 - DNA, 22 bp, Artificial Sequence
  chemically synthesized
ctcaaatatttatgttattcag

SEQ ID NO: 119682 - DNA, 22 bp, Artificial Sequence
  chemically synthesized
aaatatttatgttattcagttt

SEQ ID NO: 119683 - DNA, 22 bp, Artificial Sequence
  chemically synthesized
atgttattcagtttactgtcct

SEQ ID NO: 119684 - DNA, 22 bp, Artificial Sequence
  chemically synthesized
tgttattcagtttactgtcctt

SEQ ID NO: 119685 - DNA, 22 bp, Artificial Sequence
  chemically synthesized
ttcagtttactgtccttgaaca

SEQ ID NO: 119686 - DNA, 22 bp, Artificial Sequence
  chemically synthesized
agtttactgtccttgaacacct

SEQ ID NO: 119687 - DNA, 22 bp, Artificial Sequence
  chemically synthesized
actgtccttgaacaccttaact

SEQ ID NO: 119688 - DNA, 22 bp, Artificial Sequence
  chemically synthesized
ctgtccttgaacaccttaactt

SEQ ID NO: 119689 - DNA, 22 bp, Artificial Sequence
  chemically synthesized
tccttgaacaccttaacttctc

SEQ ID NO: 119690 - DNA, 22 bp, Artificial Sequence
  chemically synthesized
gaacaccttaacttctcattca

SEQ ID NO: 119691 - DNA, 22 bp, Artificial Sequence
  chemically synthesized
aacaccttaacttctcattcat

SEQ ID NO: 119692 - DNA, 22 bp, Artificial Sequence
  chemically synthesized
aacttctcattcattatattat

SEQ ID NO: 119693 - DNA, 22 bp, Artificial Sequence
  chemically synthesized
acttctcattcattatattatc

SEQ ID NO: 119694 - DNA, 22 bp, Artificial Sequence
  chemically synthesized
ctcattcattatattatctatt

SEQ ID NO: 119695 - DNA, 22 bp, Artificial Sequence
  chemically synthesized
tcattcattatattatctatta

SEQ ID NO: 119696 - DNA, 22 bp, Artificial Sequence
  chemically synthesized
attcattatattatctattatt

SEQ ID NO: 119697 - DNA, 22 bp, Artificial Sequence
  chemically synthesized
attatattatctattattatta

SEQ ID NO: 119698 - DNA, 22 bp, Artificial Sequence
  chemically synthesized
tattatctattattattattac

SEQ ID NO: 119699 - DNA, 22 bp, Artificial Sequence
  chemically synthesized
tctattattattattacttata

SEQ ID NO: 119700 - DNA, 22 bp, Artificial Sequence
  chemically synthesized
ttattattattacttatacagt

SEQ ID NO: 119701 - DNA, 22 bp, Artificial Sequence
  chemically synthesized
ttattattacttatacagtggt

SEQ ID NO: 119702 - DNA, 22 bp, Artificial Sequence
  chemically synthesized
ttattacttatacagtggtggc

SEQ ID NO: 119703 - DNA, 22 bp, Artificial Sequence
  chemically synthesized
ttacttatacagtggtggctct

SEQ ID NO: 119704 - DNA, 22 bp, Artificial Sequence
  chemically synthesized
cttatacagtggtggctcttag

SEQ ID NO: 119705 - DNA, 22 bp, Artificial Sequence
  chemically synthesized
atacagtggtggctcttagaca

SEQ ID NO: 119706 - DNA, 22 bp, Artificial Sequence
  chemically synthesized
tacagtggtggctcttagacat

SEQ ID NO: 119707 - DNA, 22 bp, Artificial Sequence
  chemically synthesized
ttagacattaatctctagtcca

SEQ ID NO: 119708 - DNA, 22 bp, Artificial Sequence
  chemically synthesized
agacattaatctctagtccaga

SEQ ID NO: 119709 - DNA, 22 bp, Artificial Sequence
  chemically synthesized
gacattaatctctagtccagat

SEQ ID NO: 119710 - DNA, 22 bp, Artificial Sequence
  chemically synthesized
atctctagtccagataactccg

SEQ ID NO: 119711 - DNA, 22 bp, Artificial Sequence
  chemically synthesized
tagtccagataactccgttaca

SEQ ID NO: 119712 - DNA, 22 bp, Artificial Sequence
  chemically synthesized
gtccagataactccgttacata

SEQ ID NO: 119713 - DNA, 22 bp, Artificial Sequence
  chemically synthesized
cgttacatatcaggcctgagtt

SEQ ID NO: 119714 - DNA, 22 bp, Artificial Sequence
  chemically synthesized
catatcaggcctgagtttctgc

SEQ ID NO: 119715 - DNA, 22 bp, Artificial Sequence
  chemically synthesized
agtttctgccttctcactaggt

SEQ ID NO: 119716 - DNA, 22 bp, Artificial Sequence
  chemically synthesized
ctgccttctcactaggtgtttc

SEQ ID NO: 119717 - DNA, 22 bp, Artificial Sequence
  chemically synthesized
tgccttctcactaggtgtttcc

SEQ ID NO: 119718 - DNA, 22 bp, Artificial Sequence
  chemically synthesized
ccttctcactaggtgtttccaa

SEQ ID NO: 119719 - DNA, 22 bp, Artificial Sequence
  chemically synthesized
ctcactaggtgtttccaaaagg

SEQ ID NO: 119720 - DNA, 22 bp, Artificial Sequence
  chemically synthesized
tcactaggtgtttccaaaagga

SEQ ID NO: 119721 - DNA, 22 bp, Artificial Sequence
  chemically synthesized
actaggtgtttccaaaaggata

SEQ ID NO: 119722 - DNA, 22 bp, Artificial Sequence
  chemically synthesized
ggtgtttccaaaaggatactga

SEQ ID NO: 119723 - DNA, 22 bp, Artificial Sequence
  chemically synthesized
ccaaaaggatactgatgaaact

SEQ ID NO: 119724 - DNA, 22 bp, Artificial Sequence
  chemically synthesized
caaaaggatactgatgaaactc

SEQ ID NO: 119725 - DNA, 22 bp, Artificial Sequence
  chemically synthesized
atgaaactcaacacgtctaata

SEQ ID NO: 119726 - DNA, 22 bp, Artificial Sequence
  chemically synthesized
aacacgtctaatattgagccca

SEQ ID NO: 119727 - DNA, 22 bp, Artificial Sequence
  chemically synthesized
atattgagcccagcatccatct

SEQ ID NO: 119728 - DNA, 22 bp, Artificial Sequence
  chemically synthesized
agcccagcatccatcttttcac

SEQ ID NO: 119729 - DNA, 22 bp, Artificial Sequence
  chemically synthesized
ttcacacctgattcttctcata

SEQ ID NO: 119730 - DNA, 22 bp, Artificial Sequence
  chemically synthesized
tcacacctgattcttctcatat

SEQ ID NO: 119731 - DNA, 22 bp, Artificial Sequence
  chemically synthesized
cacacctgattcttctcatatt

SEQ ID NO: 119732 - DNA, 22 bp, Artificial Sequence
  chemically synthesized
acacctgattcttctcatattt

SEQ ID NO: 119733 - DNA, 22 bp, Artificial Sequence
  chemically synthesized
attcttctcatatttatgcatt

SEQ ID NO: 119734 - DNA, 22 bp, Artificial Sequence
  chemically synthesized
ttctcatatttatgcatttttt

SEQ ID NO: 119735 - DNA, 22 bp, Artificial Sequence
  chemically synthesized
ctcatatttatgcattttttat

SEQ ID NO: 119736 - DNA, 22 bp, Artificial Sequence
  chemically synthesized
tcatatttatgcattttttata

SEQ ID NO: 119737 - DNA, 22 bp, Artificial Sequence
  chemically synthesized
atatttatgcattttttataat

SEQ ID NO: 119738 - DNA, 22 bp, Artificial Sequence
  chemically synthesized
atgcattttttataatattatt

SEQ ID NO: 119739 - DNA, 22 bp, Artificial Sequence
  chemically synthesized
tgcattttttataatattattc

SEQ ID NO: 119740 - DNA, 22 bp, Artificial Sequence
  chemically synthesized
tttataatattattcaccattt

SEQ ID NO: 119741 - DNA, 22 bp, Artificial Sequence
  chemically synthesized
ttataatattattcaccatttc

SEQ ID NO: 119742 - DNA, 22 bp, Artificial Sequence
  chemically synthesized
tataatattattcaccatttcc

SEQ ID NO: 119743 - DNA, 22 bp, Artificial Sequence
  chemically synthesized
ataatattattcaccatttcct

SEQ ID NO: 119744 - DNA, 22 bp, Artificial Sequence
  chemically synthesized
taatattattcaccatttcctg

SEQ ID NO: 119745 - DNA, 22 bp, Artificial Sequence
  chemically synthesized
ttcaccatttcctgccattcaa

SEQ ID NO: 119746 - DNA, 22 bp, Artificial Sequence
  chemically synthesized
accatttcctgccattcaagac

SEQ ID NO: 119747 - DNA, 22 bp, Artificial Sequence
  chemically synthesized
cctgccattcaagacaacattt

SEQ ID NO: 119748 - DNA, 22 bp, Artificial Sequence
  chemically synthesized
ctgccattcaagacaacatttt

SEQ ID NO: 119749 - DNA, 22 bp, Artificial Sequence
  chemically synthesized
ccattcaagacaacatttttga

SEQ ID NO: 119750 - DNA, 22 bp, Artificial Sequence
  chemically synthesized
aagacaacatttttgagctgat

SEQ ID NO: 119751 - DNA, 22 bp, Artificial Sequence
  chemically synthesized
ttgagctgatgctctactcaac

SEQ ID NO: 119752 - DNA, 22 bp, Artificial Sequence
  chemically synthesized
tgagctgatgctctactcaacc

SEQ ID NO: 119753 - DNA, 22 bp, Artificial Sequence
  chemically synthesized
gagctgatgctctactcaaccc

SEQ ID NO: 119754 - DNA, 22 bp, Artificial Sequence
  chemically synthesized
agctgatgctctactcaaccct

SEQ ID NO: 119755 - DNA, 22 bp, Artificial Sequence
  chemically synthesized
atgctctactcaaccctctccc

SEQ ID NO: 119756 - DNA, 22 bp, Artificial Sequence
  chemically synthesized
tactcaaccctctccctctttc

SEQ ID NO: 119757 - DNA, 22 bp, Artificial Sequence
  chemically synthesized
ctcaaccctctccctctttctg

SEQ ID NO: 119758 - DNA, 22 bp, Artificial Sequence
  chemically synthesized
aaccctctccctctttctgtat

SEQ ID NO: 119759 - DNA, 22 bp, Artificial Sequence
  chemically synthesized
tccctctttctgtatctaattt

SEQ ID NO: 119760 - DNA, 22 bp, Artificial Sequence
  chemically synthesized
cctctttctgtatctaattttt

SEQ ID NO: 119761 - DNA, 22 bp, Artificial Sequence
  chemically synthesized
tttctgtatctaatttttaact

SEQ ID NO: 119762 - DNA, 22 bp, Artificial Sequence
  chemically synthesized
tctgtatctaatttttaactaa

SEQ ID NO: 119763 - DNA, 22 bp, Artificial Sequence
  chemically synthesized
ctgtatctaatttttaactaag

SEQ ID NO: 119764 - DNA, 22 bp, Artificial Sequence
  chemically synthesized
tgtatctaatttttaactaagt

SEQ ID NO: 119765 - DNA, 22 bp, Artificial Sequence
  chemically synthesized
tatctaatttttaactaagttc

SEQ ID NO: 119766 - DNA, 22 bp, Artificial Sequence
  chemically synthesized
atttttaactaagttcttttaa

SEQ ID NO: 119767 - DNA, 22 bp, Artificial Sequence
  chemically synthesized
ttaactaagttcttttaatcta

SEQ ID NO: 119768 - DNA, 22 bp, Artificial Sequence
  chemically synthesized
taactaagttcttttaatctat

SEQ ID NO: 119769 - DNA, 22 bp, Artificial Sequence
  chemically synthesized
aactaagttcttttaatctatc

SEQ ID NO: 119770 - DNA, 22 bp, Artificial Sequence
  chemically synthesized
actaagttcttttaatctatcc

SEQ ID NO: 119771 - DNA, 22 bp, Artificial Sequence
  chemically synthesized
agttcttttaatctatccctgt

SEQ ID NO: 119772 - DNA, 22 bp, Artificial Sequence
  chemically synthesized
ttttaatctatccctgtaatct

SEQ ID NO: 119773 - DNA, 22 bp, Artificial Sequence
  chemically synthesized
ttaatctatccctgtaatctat

SEQ ID NO: 119774 - DNA, 22 bp, Artificial Sequence
  chemically synthesized
taatctatccctgtaatctatt

SEQ ID NO: 119775 - DNA, 22 bp, Artificial Sequence
  chemically synthesized
aatctatccctgtaatctattc

SEQ ID NO: 119776 - DNA, 22 bp, Artificial Sequence
  chemically synthesized
atctatccctgtaatctattca

SEQ ID NO: 119777 - DNA, 22 bp, Artificial Sequence
  chemically synthesized
tccctgtaatctattcatcttc

SEQ ID NO: 119778 - DNA, 22 bp, Artificial Sequence
  chemically synthesized
taatctattcatcttcatctct

SEQ ID NO: 119779 - DNA, 22 bp, Artificial Sequence
  chemically synthesized
ttcatcttcatctctgtagcca

SEQ ID NO: 119780 - DNA, 22 bp, Artificial Sequence
  chemically synthesized
atcttcatctctgtagccaatg

SEQ ID NO: 119781 - DNA, 22 bp, Artificial Sequence
  chemically synthesized
catctctgtagccaatgtcctt

SEQ ID NO: 119782 - DNA, 22 bp, Artificial Sequence
  chemically synthesized
atctctgtagccaatgtccttg

SEQ ID NO: 119783 - DNA, 22 bp, Artificial Sequence
  chemically synthesized
tgtagccaatgtccttgttctt

SEQ ID NO: 119784 - DNA, 22 bp, Artificial Sequence
  chemically synthesized
tagccaatgtccttgttcttag

SEQ ID NO: 119785 - DNA, 22 bp, Artificial Sequence
  chemically synthesized
gttcttagcttttccacacctg

SEQ ID NO: 119786 - DNA, 22 bp, Artificial Sequence
  chemically synthesized
ttcttagcttttccacacctgc

SEQ ID NO: 119787 - DNA, 22 bp, Artificial Sequence
  chemically synthesized
ttagcttttccacacctgcttg

SEQ ID NO: 119788 - DNA, 22 bp, Artificial Sequence
  chemically synthesized
agcttttccacacctgcttgcc

SEQ ID NO: 119789 - DNA, 22 bp, Artificial Sequence
  chemically synthesized
gcttttccacacctgcttgcct

SEQ ID NO: 119790 - DNA, 22 bp, Artificial Sequence
  chemically synthesized
ttccacacctgcttgcctgacc

SEQ ID NO: 119791 - DNA, 22 bp, Artificial Sequence
  chemically synthesized
tccacacctgcttgcctgacct

SEQ ID NO: 119792 - DNA, 22 bp, Artificial Sequence
  chemically synthesized
ccacacctgcttgcctgacctg

SEQ ID NO: 119793 - DNA, 22 bp, Artificial Sequence
  chemically synthesized
cacacctgcttgcctgacctgt

SEQ ID NO: 119794 - DNA, 22 bp, Artificial Sequence
  chemically synthesized
cttgcctgacctgtcattcaac

SEQ ID NO: 119795 - DNA, 22 bp, Artificial Sequence
  chemically synthesized
gcctgacctgtcattcaacatg

SEQ ID NO: 119796 - DNA, 22 bp, Artificial Sequence
  chemically synthesized
cctgacctgtcattcaacatgc

SEQ ID NO: 119797 - DNA, 22 bp, Artificial Sequence
  chemically synthesized
acctgtcattcaacatgcaaag

SEQ ID NO: 119798 - DNA, 22 bp, Artificial Sequence
  chemically synthesized
tcattcaacatgcaaagccagg

SEQ ID NO: 119799 - DNA, 22 bp, Artificial Sequence
  chemically synthesized
aacatgcaaagccaggctcctc

SEQ ID NO: 119800 - DNA, 22 bp, Artificial Sequence
  chemically synthesized
ctccttcccttggtccatcctc

SEQ ID NO: 119801 - DNA, 22 bp, Artificial Sequence
  chemically synthesized
cttcccttggtccatcctctac

SEQ ID NO: 119802 - DNA, 22 bp, Artificial Sequence
  chemically synthesized
cccttggtccatcctctactgc

SEQ ID NO: 119803 - DNA, 22 bp, Artificial Sequence
  chemically synthesized
ccttggtccatcctctactgca

SEQ ID NO: 119804 - DNA, 22 bp, Artificial Sequence
  chemically synthesized
ggtccatcctctactgcagcca

SEQ ID NO: 119805 - DNA, 22 bp, Artificial Sequence
  chemically synthesized
gtccatcctctactgcagccac

SEQ ID NO: 119806 - DNA, 22 bp, Artificial Sequence
  chemically synthesized
tactgcagccaccgagattatg

SEQ ID NO: 119807 - DNA, 22 bp, Artificial Sequence
  chemically synthesized
ctgcagccaccgagattatgca

SEQ ID NO: 119808 - DNA, 22 bp, Artificial Sequence
  chemically synthesized
cagccaccgagattatgcagaa

SEQ ID NO: 119809 - DNA, 22 bp, Artificial Sequence
  chemically synthesized
tgcagaaagtactaactctatg

SEQ ID NO: 119810 - DNA, 22 bp, Artificial Sequence
  chemically synthesized
actctatgaatcactgcactgt

SEQ ID NO: 119811 - DNA, 22 bp, Artificial Sequence
  chemically synthesized
tatgaatcactgcactgttttc

SEQ ID NO: 119812 - DNA, 22 bp, Artificial Sequence
  chemically synthesized
tgaatcactgcactgttttcag

SEQ ID NO: 119813 - DNA, 22 bp, Artificial Sequence
  chemically synthesized
cactgttttcagtacttcagta

SEQ ID NO: 119814 - DNA, 22 bp, Artificial Sequence
  chemically synthesized
ttttcagtacttcagtagctcc

SEQ ID NO: 119815 - DNA, 22 bp, Artificial Sequence
  chemically synthesized
tcagtacttcagtagctcctat

SEQ ID NO: 119816 - DNA, 22 bp, Artificial Sequence
  chemically synthesized
cagtacttcagtagctcctatc

SEQ ID NO: 119817 - DNA, 22 bp, Artificial Sequence
  chemically synthesized
agtacttcagtagctcctatca

SEQ ID NO: 119818 - DNA, 22 bp, Artificial Sequence
  chemically synthesized
cagtagctcctatcattagaat

SEQ ID NO: 119819 - DNA, 22 bp, Artificial Sequence
  chemically synthesized
agtagctcctatcattagaata

SEQ ID NO: 119820 - DNA, 22 bp, Artificial Sequence
  chemically synthesized
ctatcattagaataaagttcaa

SEQ ID NO: 119821 - DNA, 22 bp, Artificial Sequence
  chemically synthesized
tcattagaataaagttcaaact

SEQ ID NO: 119822 - DNA, 22 bp, Artificial Sequence
  chemically synthesized
gaataaagttcaaacttgtaaa

SEQ ID NO: 119823 - DNA, 22 bp, Artificial Sequence
  chemically synthesized
aaacttgtaaaagatctgtggt

SEQ ID NO: 119824 - DNA, 22 bp, Artificial Sequence
  chemically synthesized
gtaaaagatctgtggtgatagt

SEQ ID NO: 119825 - DNA, 22 bp, Artificial Sequence
  chemically synthesized
taaaagatctgtggtgatagtc

SEQ ID NO: 119826 - DNA, 22 bp, Artificial Sequence
  chemically synthesized
tggtgatagtccaatttattga

SEQ ID NO: 119827 - DNA, 22 bp, Artificial Sequence
  chemically synthesized
attgaggccatacatgatttag

SEQ ID NO: 119828 - DNA, 22 bp, Artificial Sequence
  chemically synthesized
ttgaggccatacatgatttaga

SEQ ID NO: 119829 - DNA, 22 bp, Artificial Sequence
  chemically synthesized
aggccatacatgatttagatgc

SEQ ID NO: 119830 - DNA, 22 bp, Artificial Sequence
  chemically synthesized
agatgctgtgaaaagcttgaca

SEQ ID NO: 119831 - DNA, 22 bp, Artificial Sequence
  chemically synthesized
gatgctgtgaaaagcttgacat

SEQ ID NO: 119832 - DNA, 22 bp, Artificial Sequence
  chemically synthesized
tgaaaagcttgacataatcatg

SEQ ID NO: 119833 - DNA, 22 bp, Artificial Sequence
  chemically synthesized
gacataatcatgaatatttcat

SEQ ID NO: 119834 - DNA, 22 bp, Artificial Sequence
  chemically synthesized
acataatcatgaatatttcatg

SEQ ID NO: 119835 - DNA, 22 bp, Artificial Sequence
  chemically synthesized
catgtaactatgaaacatttta

SEQ ID NO: 119836 - DNA, 22 bp, Artificial Sequence
  chemically synthesized
atgtaactatgaaacattttat

SEQ ID NO: 119837 - DNA, 22 bp, Artificial Sequence
  chemically synthesized
tgaaacattttattactacttc

SEQ ID NO: 119838 - DNA, 22 bp, Artificial Sequence
  chemically synthesized
tattactacttcacaaggagaa

SEQ ID NO: 119839 - DNA, 22 bp, Artificial Sequence
  chemically synthesized
attactacttcacaaggagaaa

SEQ ID NO: 119840 - DNA, 22 bp, Artificial Sequence
  chemically synthesized
ttactacttcacaaggagaaaa

SEQ ID NO: 119841 - DNA, 22 bp, Artificial Sequence
  chemically synthesized
ctacttcacaaggagaaaacta

SEQ ID NO: 119842 - DNA, 22 bp, Artificial Sequence
  chemically synthesized
cttcacaaggagaaaactacaa

SEQ ID NO: 119843 - DNA, 22 bp, Artificial Sequence
  chemically synthesized
cacaaggagaaaactacaaaaa

SEQ ID NO: 119844 - DNA, 22 bp, Artificial Sequence
  chemically synthesized
acaaggagaaaactacaaaaag

SEQ ID NO: 119845 - DNA, 22 bp, Artificial Sequence
  chemically synthesized
caaaaaggtaaacaatcatccc

SEQ ID NO: 119846 - DNA, 22 bp, Artificial Sequence
  chemically synthesized
gtagtgagcgaaaatcaggata

SEQ ID NO: 119847 - DNA, 22 bp, Artificial Sequence
  chemically synthesized
tgtctctctatgcatggccctg

SEQ ID NO: 119848 - DNA, 22 bp, Artificial Sequence
  chemically synthesized
gtctctctatgcatggccctgg

SEQ ID NO: 119849 - DNA, 22 bp, Artificial Sequence
  chemically synthesized
tctctctatgcatggccctggt

SEQ ID NO: 119850 - DNA, 22 bp, Artificial Sequence
  chemically synthesized
tctatgcatggccctggtagcc

SEQ ID NO: 119851 - DNA, 22 bp, Artificial Sequence
  chemically synthesized
tatgcatggccctggtagcctc

SEQ ID NO: 119852 - DNA, 22 bp, Artificial Sequence
  chemically synthesized
tgcatggccctggtagcctcaa

SEQ ID NO: 119853 - DNA, 22 bp, Artificial Sequence
  chemically synthesized
gtagcctcaaacaccctgtaac

SEQ ID NO: 119854 - DNA, 22 bp, Artificial Sequence
  chemically synthesized
aaacaccctgtaacaccatctt

SEQ ID NO: 119855 - DNA, 22 bp, Artificial Sequence
  chemically synthesized
taacaccatctttagcccggtc

SEQ ID NO: 119856 - DNA, 22 bp, Artificial Sequence
  chemically synthesized
tagcccggtccttcttgttttg

SEQ ID NO: 119857 - DNA, 22 bp, Artificial Sequence
  chemically synthesized
agcccggtccttcttgttttgg

SEQ ID NO: 119858 - DNA, 22 bp, Artificial Sequence
  chemically synthesized
gcccggtccttcttgttttggc

SEQ ID NO: 119859 - DNA, 22 bp, Artificial Sequence
  chemically synthesized
cttgttttggcacctttccaaa

SEQ ID NO: 119860 - DNA, 22 bp, Artificial Sequence
  chemically synthesized
ttgttttggcacctttccaaac

SEQ ID NO: 119861 - DNA, 22 bp, Artificial Sequence
  chemically synthesized
gttttggcacctttccaaaccc

SEQ ID NO: 119862 - DNA, 22 bp, Artificial Sequence
  chemically synthesized
ttttggcacctttccaaaccca

SEQ ID NO: 119863 - DNA, 22 bp, Artificial Sequence
  chemically synthesized
tggcacctttccaaacccatct

SEQ ID NO: 119864 - DNA, 22 bp, Artificial Sequence
  chemically synthesized
ggcacctttccaaacccatctt

SEQ ID NO: 119865 - DNA, 22 bp, Artificial Sequence
  chemically synthesized
gcacctttccaaacccatcttt

SEQ ID NO: 119866 - DNA, 22 bp, Artificial Sequence
  chemically synthesized
tccaaacccatcttttcccagt

SEQ ID NO: 119867 - DNA, 22 bp, Artificial Sequence
  chemically synthesized
ccaaacccatcttttcccagtc

SEQ ID NO: 119868 - DNA, 22 bp, Artificial Sequence
  chemically synthesized
caaacccatcttttcccagtca

SEQ ID NO: 119869 - DNA, 22 bp, Artificial Sequence
  chemically synthesized
ttcccagtcaacacacccatat

SEQ ID NO: 119870 - DNA, 22 bp, Artificial Sequence
  chemically synthesized
tcccagtcaacacacccatatc

SEQ ID NO: 119871 - DNA, 22 bp, Artificial Sequence
  chemically synthesized
cccagtcaacacacccatatca

SEQ ID NO: 119872 - DNA, 22 bp, Artificial Sequence
  chemically synthesized
ccagtcaacacacccatatcat

SEQ ID NO: 119873 - DNA, 22 bp, Artificial Sequence
  chemically synthesized
ttttcttcaattccctacacat

SEQ ID NO: 119874 - DNA, 22 bp, Artificial Sequence
  chemically synthesized
tttcttcaattccctacacata

SEQ ID NO: 119875 - DNA, 22 bp, Artificial Sequence
  chemically synthesized
ttcttcaattccctacacatac

SEQ ID NO: 119876 - DNA, 22 bp, Artificial Sequence
  chemically synthesized
tcttcaattccctacacatact

SEQ ID NO: 119877 - DNA, 22 bp, Artificial Sequence
  chemically synthesized
cttcaattccctacacatactt

SEQ ID NO: 119878 - DNA, 22 bp, Artificial Sequence
  chemically synthesized
ttcaattccctacacatacttt

SEQ ID NO: 119879 - DNA, 22 bp, Artificial Sequence
  chemically synthesized
caattccctacacatacttttc

SEQ ID NO: 119880 - DNA, 22 bp, Artificial Sequence
  chemically synthesized
aattccctacacatacttttct

SEQ ID NO: 119881 - DNA, 22 bp, Artificial Sequence
  chemically synthesized
cctacacatacttttcttgttt

SEQ ID NO: 119882 - DNA, 22 bp, Artificial Sequence
  chemically synthesized
cacatacttttcttgtttttat

SEQ ID NO: 119883 - DNA, 22 bp, Artificial Sequence
  chemically synthesized
ttcttgtttttattcttctata

SEQ ID NO: 119884 - DNA, 22 bp, Artificial Sequence
  chemically synthesized
tcttgtttttattcttctatat

SEQ ID NO: 119885 - DNA, 22 bp, Artificial Sequence
  chemically synthesized
cttgtttttattcttctatatt

SEQ ID NO: 119886 - DNA, 22 bp, Artificial Sequence
  chemically synthesized
ttgtttttattcttctatattt

SEQ ID NO: 119887 - DNA, 22 bp, Artificial Sequence
  chemically synthesized
gtttttattcttctatatttat

SEQ ID NO: 119888 - DNA, 22 bp, Artificial Sequence
  chemically synthesized
tttttattcttctatatttatt

SEQ ID NO: 119889 - DNA, 22 bp, Artificial Sequence
  chemically synthesized
ttattcttctatatttattgct

SEQ ID NO: 119890 - DNA, 22 bp, Artificial Sequence
  chemically synthesized
tattcttctatatttattgctt

SEQ ID NO: 119891 - DNA, 22 bp, Artificial Sequence
  chemically synthesized
attcttctatatttattgcttt

SEQ ID NO: 119892 - DNA, 22 bp, Artificial Sequence
  chemically synthesized
ttcttctatatttattgctttc

SEQ ID NO: 119893 - DNA, 22 bp, Artificial Sequence
  chemically synthesized
ttctatatttattgctttcttg

SEQ ID NO: 119894 - DNA, 22 bp, Artificial Sequence
  chemically synthesized
ctatatttattgctttcttggc

SEQ ID NO: 119895 - DNA, 22 bp, Artificial Sequence
  chemically synthesized
tatatttattgctttcttggca

SEQ ID NO: 119896 - DNA, 22 bp, Artificial Sequence
  chemically synthesized
tatttattgctttcttggcaaa

SEQ ID NO: 119897 - DNA, 22 bp, Artificial Sequence
  chemically synthesized
attgctttcttggcaaaaacca

SEQ ID NO: 119898 - DNA, 22 bp, Artificial Sequence
  chemically synthesized
ttgctttcttggcaaaaaccac

SEQ ID NO: 119899 - DNA, 22 bp, Artificial Sequence
  chemically synthesized
ctttcttggcaaaaaccacccc

SEQ ID NO: 119900 - DNA, 22 bp, Artificial Sequence
  chemically synthesized
tcttggcaaaaaccacccctgt

SEQ ID NO: 119901 - DNA, 22 bp, Artificial Sequence
  chemically synthesized
cttggcaaaaaccacccctgtt

SEQ ID NO: 119902 - DNA, 22 bp, Artificial Sequence
  chemically synthesized
ttggcaaaaaccacccctgttt

SEQ ID NO: 119903 - DNA, 22 bp, Artificial Sequence
  chemically synthesized
ggcaaaaaccacccctgttttt

SEQ ID NO: 119904 - DNA, 22 bp, Artificial Sequence
  chemically synthesized
gcaaaaaccacccctgtttttc

SEQ ID NO: 119905 - DNA, 22 bp, Artificial Sequence
  chemically synthesized
tttttccaaccagtaaacactt

SEQ ID NO: 119906 - DNA, 22 bp, Artificial Sequence
  chemically synthesized
ttccaaccagtaaacacttgcg

SEQ ID NO: 119907 - DNA, 22 bp, Artificial Sequence
  chemically synthesized
tccaaccagtaaacacttgcgg

SEQ ID NO: 119908 - DNA, 22 bp, Artificial Sequence
  chemically synthesized
ccaaccagtaaacacttgcgga

SEQ ID NO: 119909 - DNA, 22 bp, Artificial Sequence
  chemically synthesized
caaccagtaaacacttgcggat

SEQ ID NO: 119910 - DNA, 22 bp, Artificial Sequence
  chemically synthesized
gcggatcctttaagacttagta

SEQ ID NO: 119911 - DNA, 22 bp, Artificial Sequence
  chemically synthesized
cggatcctttaagacttagtac

SEQ ID NO: 119912 - DNA, 22 bp, Artificial Sequence
  chemically synthesized
taagacttagtacaaatatcac

SEQ ID NO: 119913 - DNA, 22 bp, Artificial Sequence
  chemically synthesized
aagacttagtacaaatatcact

SEQ ID NO: 119914 - DNA, 22 bp, Artificial Sequence
  chemically synthesized
agacttagtacaaatatcactt

SEQ ID NO: 119915 - DNA, 22 bp, Artificial Sequence
  chemically synthesized
agtacaaatatcacttcttctg

SEQ ID NO: 119916 - DNA, 22 bp, Artificial Sequence
  chemically synthesized
gtacaaatatcacttcttctgt

SEQ ID NO: 119917 - DNA, 22 bp, Artificial Sequence
  chemically synthesized
cttctgtcaaatctctcctgac

SEQ ID NO: 119918 - DNA, 22 bp, Artificial Sequence
  chemically synthesized
ttctgtcaaatctctcctgact

SEQ ID NO: 119919 - DNA, 22 bp, Artificial Sequence
  chemically synthesized
ctgtcaaatctctcctgacttc

SEQ ID NO: 119920 - DNA, 22 bp, Artificial Sequence
  chemically synthesized
tgtcaaatctctcctgacttcc

SEQ ID NO: 119921 - DNA, 22 bp, Artificial Sequence
  chemically synthesized
tcaaatctctcctgacttcctt

SEQ ID NO: 119922 - DNA, 22 bp, Artificial Sequence
  chemically synthesized
tcctgacttccttctgtagcat

SEQ ID NO: 119923 - DNA, 22 bp, Artificial Sequence
  chemically synthesized
ctgacttccttctgtagcatta

SEQ ID NO: 119924 - DNA, 22 bp, Artificial Sequence
  chemically synthesized
acttccttctgtagcattaggt

SEQ ID NO: 119925 - DNA, 22 bp, Artificial Sequence
  chemically synthesized
ccttctgtagcattaggtacat

SEQ ID NO: 119926 - DNA, 22 bp, Artificial Sequence
  chemically synthesized
cttctgtagcattaggtacatc

SEQ ID NO: 119927 - DNA, 22 bp, Artificial Sequence
  chemically synthesized
ctgtagcattaggtacatcttt

SEQ ID NO: 119928 - DNA, 22 bp, Artificial Sequence
  chemically synthesized
tgtagcattaggtacatctttc

SEQ ID NO: 119929 - DNA, 22 bp, Artificial Sequence
  chemically synthesized
tagcattaggtacatctttctc

SEQ ID NO: 119930 - DNA, 22 bp, Artificial Sequence
  chemically synthesized
ggtacatctttctctgttctca

SEQ ID NO: 119931 - DNA, 22 bp, Artificial Sequence
  chemically synthesized
tctctgttctcacgtagtacct

SEQ ID NO: 119932 - DNA, 22 bp, Artificial Sequence
  chemically synthesized
ctctgttctcacgtagtacctg

SEQ ID NO: 119933 - DNA, 22 bp, Artificial Sequence
  chemically synthesized
tctgttctcacgtagtacctgt

SEQ ID NO: 119934 - DNA, 22 bp, Artificial Sequence
  chemically synthesized
tgttctcacgtagtacctgtaa

SEQ ID NO: 119935 - DNA, 22 bp, Artificial Sequence
  chemically synthesized
ttctcacgtagtacctgtaatg

SEQ ID NO: 119936 - DNA, 22 bp, Artificial Sequence
  chemically synthesized
tcacgtagtacctgtaatgtac

SEQ ID NO: 119937 - DNA, 22 bp, Artificial Sequence
  chemically synthesized
acgtagtacctgtaatgtacta

SEQ ID NO: 119938 - DNA, 22 bp, Artificial Sequence
  chemically synthesized
taatgtactattaaggtgtaaa

SEQ ID NO: 119939 - DNA, 22 bp, Artificial Sequence
  chemically synthesized
ttaaggtgtaaatacacacaca

SEQ ID NO: 119940 - DNA, 22 bp, Artificial Sequence
  chemically synthesized
aggtgtaaatacacacacacat

SEQ ID NO: 119941 - DNA, 22 bp, Artificial Sequence
  chemically synthesized
tttatatttttatatttatata

SEQ ID NO: 119942 - DNA, 22 bp, Artificial Sequence
  chemically synthesized
tatatttttatatttatatata

SEQ ID NO: 119943 - DNA, 22 bp, Artificial Sequence
  chemically synthesized
atatttttatatttatatatac

SEQ ID NO: 119944 - DNA, 22 bp, Artificial Sequence
  chemically synthesized
tatttttatatttatatatact

SEQ ID NO: 119945 - DNA, 22 bp, Artificial Sequence
  chemically synthesized
ttatatttatatatacttattg

SEQ ID NO: 119946 - DNA, 22 bp, Artificial Sequence
  chemically synthesized
tatatttatatatacttattga

SEQ ID NO: 119947 - DNA, 22 bp, Artificial Sequence
  chemically synthesized
atatttatatatacttattgat

SEQ ID NO: 119948 - DNA, 22 bp, Artificial Sequence
  chemically synthesized
tatttatatatacttattgata

SEQ ID NO: 119949 - DNA, 22 bp, Artificial Sequence
  chemically synthesized
atatatacttattgatatatat

SEQ ID NO: 119950 - DNA, 22 bp, Artificial Sequence
  chemically synthesized
tatatacttattgatatatata

SEQ ID NO: 119951 - DNA, 22 bp, Artificial Sequence
  chemically synthesized
attgatatatatatagaacata

SEQ ID NO: 119952 - DNA, 22 bp, Artificial Sequence
  chemically synthesized
ttgatatatatatagaacatac

SEQ ID NO: 119953 - DNA, 22 bp, Artificial Sequence
  chemically synthesized
atatatatatagaacatactta

SEQ ID NO: 119954 - DNA, 22 bp, Artificial Sequence
  chemically synthesized
atacatccatataagtacacat

SEQ ID NO: 119955 - DNA, 22 bp, Artificial Sequence
  chemically synthesized
tacatccatataagtacacata

SEQ ID NO: 119956 - DNA, 22 bp, Artificial Sequence
  chemically synthesized
aaataacatataagtgtataga

SEQ ID NO: 119957 - DNA, 22 bp, Artificial Sequence
  chemically synthesized
aataacatataagtgtatagat

SEQ ID NO: 119958 - DNA, 22 bp, Artificial Sequence
  chemically synthesized
actcataaatactttatagaat

SEQ ID NO: 119959 - DNA, 22 bp, Artificial Sequence
  chemically synthesized
ctcataaatactttatagaata

SEQ ID NO: 119960 - DNA, 22 bp, Artificial Sequence
  chemically synthesized
ataaatactttatagaatatac

SEQ ID NO: 119961 - DNA, 22 bp, Artificial Sequence
  chemically synthesized
tatagaatatacattttagtat

SEQ ID NO: 119962 - DNA, 22 bp, Artificial Sequence
  chemically synthesized
atagaatatacattttagtata

SEQ ID NO: 119963 - DNA, 22 bp, Artificial Sequence
  chemically synthesized
tagaatatacattttagtatat

SEQ ID NO: 119964 - DNA, 22 bp, Artificial Sequence
  chemically synthesized
tagtatatacattatatattct

SEQ ID NO: 119965 - DNA, 22 bp, Artificial Sequence
  chemically synthesized
agtatatacattatatattctt

SEQ ID NO: 119966 - DNA, 22 bp, Artificial Sequence
  chemically synthesized
gtatatacattatatattcttt

SEQ ID NO: 119967 - DNA, 22 bp, Artificial Sequence
  chemically synthesized
tatattctttatatactttata

SEQ ID NO: 119968 - DNA, 22 bp, Artificial Sequence
  chemically synthesized
tttatatactttatagattttt

SEQ ID NO: 119969 - DNA, 22 bp, Artificial Sequence
  chemically synthesized
tatatactttatagatttttta

SEQ ID NO: 119970 - DNA, 22 bp, Artificial Sequence
  chemically synthesized
atatactttatagattttttat

SEQ ID NO: 119971 - DNA, 22 bp, Artificial Sequence
  chemically synthesized
tatactttatagattttttata

SEQ ID NO: 119972 - DNA, 22 bp, Artificial Sequence
  chemically synthesized
tatagattttttatatataagt

SEQ ID NO: 119973 - DNA, 22 bp, Artificial Sequence
  chemically synthesized
atagattttttatatataagta

SEQ ID NO: 119974 - DNA, 22 bp, Artificial Sequence
  chemically synthesized
tagattttttatatataagtat

SEQ ID NO: 119975 - DNA, 22 bp, Artificial Sequence
  chemically synthesized
tttatatataagtatagggtat

SEQ ID NO: 119976 - DNA, 22 bp, Artificial Sequence
  chemically synthesized
ttatatataagtatagggtata

SEQ ID NO: 119977 - DNA, 22 bp, Artificial Sequence
  chemically synthesized
tatatataagtatagggtatac

SEQ ID NO: 119978 - DNA, 22 bp, Artificial Sequence
  chemically synthesized
atatataagtatagggtataca

SEQ ID NO: 119979 - DNA, 22 bp, Artificial Sequence
  chemically synthesized
tatataagtatagggtatacat

SEQ ID NO: 119980 - DNA, 22 bp, Artificial Sequence
  chemically synthesized
tatatttatatatgtaaacaaa

SEQ ID NO: 119981 - DNA, 22 bp, Artificial Sequence
  chemically synthesized
atatatgtaaacaaatatacaa

SEQ ID NO: 119982 - DNA, 22 bp, Artificial Sequence
  chemically synthesized
tatatgtaaacaaatatacaaa

SEQ ID NO: 119983 - DNA, 22 bp, Artificial Sequence
  chemically synthesized
gatatttgtacacatatatata

SEQ ID NO: 119984 - DNA, 22 bp, Artificial Sequence
  chemically synthesized
gtacacatatatatactttgta

SEQ ID NO: 119985 - DNA, 22 bp, Artificial Sequence
  chemically synthesized
tacacatatatatactttgtac

SEQ ID NO: 119986 - DNA, 22 bp, Artificial Sequence
  chemically synthesized
tgtacaacatatatattatagg

SEQ ID NO: 119987 - DNA, 22 bp, Artificial Sequence
  chemically synthesized
gtacaacatatatattataggt

SEQ ID NO: 119988 - DNA, 22 bp, Artificial Sequence
  chemically synthesized
tacaacatatatattataggta

SEQ ID NO: 119989 - DNA, 22 bp, Artificial Sequence
  chemically synthesized
taggtagtatttatacgtattc

SEQ ID NO: 119990 - DNA, 22 bp, Artificial Sequence
  chemically synthesized
atacgtattctttattatacat

SEQ ID NO: 119991 - DNA, 22 bp, Artificial Sequence
  chemically synthesized
tacgtattctttattatacatg

SEQ ID NO: 119992 - DNA, 22 bp, Artificial Sequence
  chemically synthesized
tttattatacatgtttagaaca

SEQ ID NO: 119993 - DNA, 22 bp, Artificial Sequence
  chemically synthesized
tattatacatgtttagaacata

SEQ ID NO: 119994 - DNA, 22 bp, Artificial Sequence
  chemically synthesized
attatacatgtttagaacataa

SEQ ID NO: 119995 - DNA, 22 bp, Artificial Sequence
  chemically synthesized
ttatacatgtttagaacataaa

SEQ ID NO: 119996 - DNA, 22 bp, Artificial Sequence
  chemically synthesized
tacatgtttagaacataaattt

SEQ ID NO: 119997 - DNA, 22 bp, Artificial Sequence
  chemically synthesized
agaacataaatttatattggca

SEQ ID NO: 119998 - DNA, 22 bp, Artificial Sequence
  chemically synthesized
gaacataaatttatattggcaa

SEQ ID NO: 119999 - DNA, 22 bp, Artificial Sequence
  chemically synthesized
atattggcaaaaactgccatta

SEQ ID NO: 120000 - DNA, 22 bp, Artificial Sequence
  chemically synthesized
tattggcaaaaactgccattaa

SEQ ID NO: 120001 - DNA, 22 bp, Artificial Sequence
  chemically synthesized
gcaaaaactgccattaattttt

SEQ ID NO: 120002 - DNA, 22 bp, Artificial Sequence
  chemically synthesized
ccattaatttttcaccaaccta

SEQ ID NO: 120003 - DNA, 22 bp, Artificial Sequence
  chemically synthesized
atttttcaccaacctaataatt

SEQ ID NO: 120004 - DNA, 22 bp, Artificial Sequence
  chemically synthesized
ttcaccaacctaataattcatt

SEQ ID NO: 120005 - DNA, 22 bp, Artificial Sequence
  chemically synthesized
tcaccaacctaataattcattt

SEQ ID NO: 120006 - DNA, 22 bp, Artificial Sequence
  chemically synthesized
caccaacctaataattcatttt

SEQ ID NO: 120007 - DNA, 22 bp, Artificial Sequence
  chemically synthesized
accaacctaataattcattttt

SEQ ID NO: 120008 - DNA, 22 bp, Artificial Sequence
  chemically synthesized
ataattcattttttaagttgat

SEQ ID NO: 120009 - DNA, 22 bp, Artificial Sequence
  chemically synthesized
attttttaagttgattagactg

SEQ ID NO: 120010 - DNA, 22 bp, Artificial Sequence
  chemically synthesized
tttaagttgattagactggaat

SEQ ID NO: 120011 - DNA, 22 bp, Artificial Sequence
  chemically synthesized
ttaagttgattagactggaatt

SEQ ID NO: 120012 - DNA, 22 bp, Artificial Sequence
  chemically synthesized
taagttgattagactggaattc

SEQ ID NO: 120013 - DNA, 22 bp, Artificial Sequence
  chemically synthesized
aagttgattagactggaattct

SEQ ID NO: 120014 - DNA, 22 bp, Artificial Sequence
  chemically synthesized
agttgattagactggaattctc

SEQ ID NO: 120015 - DNA, 22 bp, Artificial Sequence
  chemically synthesized
attagactggaattctctaaag

SEQ ID NO: 120016 - DNA, 22 bp, Artificial Sequence
  chemically synthesized
gactggaattctctaaaggccc

SEQ ID NO: 120017 - DNA, 22 bp, Artificial Sequence
  chemically synthesized
gaattctctaaaggcccctgga

SEQ ID NO: 120018 - DNA, 22 bp, Artificial Sequence
  chemically synthesized
tctaaaggcccctggagcctga

SEQ ID NO: 120019 - DNA, 22 bp, Artificial Sequence
  chemically synthesized
taaaggcccctggagcctgaca

SEQ ID NO: 120020 - DNA, 22 bp, Artificial Sequence
  chemically synthesized
aaggcccctggagcctgacagt

SEQ ID NO: 120021 - DNA, 22 bp, Artificial Sequence
  chemically synthesized
gagcctgacagtgtctaagatg

SEQ ID NO: 120022 - DNA, 22 bp, Artificial Sequence
  chemically synthesized
acagtgtctaagatgtggtagg

SEQ ID NO: 120023 - DNA, 22 bp, Artificial Sequence
  chemically synthesized
agatgtggtaggtaccactata

SEQ ID NO: 120024 - DNA, 22 bp, Artificial Sequence
  chemically synthesized
tatatatatttttttgcatgaa

SEQ ID NO: 120025 - DNA, 22 bp, Artificial Sequence
  chemically synthesized
ttttgcatgaaaaactaaatgg

SEQ ID NO: 120026 - DNA, 22 bp, Artificial Sequence
  chemically synthesized
tttgcatgaaaaactaaatggg

SEQ ID NO: 120027 - DNA, 22 bp, Artificial Sequence
  chemically synthesized
ttgcatgaaaaactaaatgggt

SEQ ID NO: 120028 - DNA, 22 bp, Artificial Sequence
  chemically synthesized
tgcatgaaaaactaaatgggtg

SEQ ID NO: 120029 - DNA, 22 bp, Artificial Sequence
  chemically synthesized
gcatgaaaaactaaatgggtga

SEQ ID NO: 120030 - DNA, 22 bp, Artificial Sequence
  chemically synthesized
catgaaaaactaaatgggtgaa

SEQ ID NO: 120031 - DNA, 22 bp, Artificial Sequence
  chemically synthesized
aatgggtgaataaataaagtac

SEQ ID NO: 120032 - DNA, 22 bp, Artificial Sequence
  chemically synthesized
acctcttatcctgattctttgt

SEQ ID NO: 120033 - DNA, 22 bp, Artificial Sequence
  chemically synthesized
ttatcctgattctttgtgcctg

SEQ ID NO: 120034 - DNA, 22 bp, Artificial Sequence
  chemically synthesized
atcctgattctttgtgcctggg

SEQ ID NO: 120035 - DNA, 22 bp, Artificial Sequence
  chemically synthesized
tcctgattctttgtgcctgggg

SEQ ID NO: 120036 - DNA, 22 bp, Artificial Sequence
  chemically synthesized
attctttgtgcctggggttctg

SEQ ID NO: 120037 - DNA, 22 bp, Artificial Sequence
  chemically synthesized
tttgtgcctggggttctgttgt

SEQ ID NO: 120038 - DNA, 22 bp, Artificial Sequence
  chemically synthesized
tgtgcctggggttctgttgtca

SEQ ID NO: 120039 - DNA, 22 bp, Artificial Sequence
  chemically synthesized
gtgcctggggttctgttgtcag

SEQ ID NO: 120040 - DNA, 22 bp, Artificial Sequence
  chemically synthesized
tgcctggggttctgttgtcagc

SEQ ID NO: 120041 - DNA, 22 bp, Artificial Sequence
  chemically synthesized
gggttctgttgtcagctctgtg

SEQ ID NO: 120042 - DNA, 22 bp, Artificial Sequence
  chemically synthesized
tgttgtcagctctgtgttcacc

SEQ ID NO: 120043 - DNA, 22 bp, Artificial Sequence
  chemically synthesized
ttgtcagctctgtgttcaccaa

SEQ ID NO: 120044 - DNA, 22 bp, Artificial Sequence
  chemically synthesized
tcagctctgtgttcaccaactt

SEQ ID NO: 120045 - DNA, 22 bp, Artificial Sequence
  chemically synthesized
tgtgttcaccaacttcagagtg

SEQ ID NO: 120046 - DNA, 22 bp, Artificial Sequence
  chemically synthesized
tgttcaccaacttcagagtgat

SEQ ID NO: 120047 - DNA, 22 bp, Artificial Sequence
  chemically synthesized
accaacttcagagtgatgagat

SEQ ID NO: 120048 - DNA, 22 bp, Artificial Sequence
  chemically synthesized
cagagtgatgagatggacaggg

SEQ ID NO: 120049 - DNA, 22 bp, Artificial Sequence
  chemically synthesized
agagtgatgagatggacaggga

SEQ ID NO: 120050 - DNA, 22 bp, Artificial Sequence
  chemically synthesized
gtagaaacaagatgtctataca

SEQ ID NO: 120051 - DNA, 22 bp, Artificial Sequence
  chemically synthesized
tacagagacaatgacagggctg

SEQ ID NO: 120052 - DNA, 22 bp, Artificial Sequence
  chemically synthesized
ggattatttctcttggaaagta

SEQ ID NO: 120053 - DNA, 22 bp, Artificial Sequence
  chemically synthesized
tttctcttggaaagtatacttc

SEQ ID NO: 120054 - DNA, 22 bp, Artificial Sequence
  chemically synthesized
ctcttggaaagtatacttcctc

SEQ ID NO: 120055 - DNA, 22 bp, Artificial Sequence
  chemically synthesized
tcttggaaagtatacttcctct

SEQ ID NO: 120056 - DNA, 22 bp, Artificial Sequence
  chemically synthesized
ttggaaagtatacttcctcttg

SEQ ID NO: 120057 - DNA, 22 bp, Artificial Sequence
  chemically synthesized
ggaaagtatacttcctcttggg

SEQ ID NO: 120058 - DNA, 22 bp, Artificial Sequence
  chemically synthesized
gaaagtatacttcctcttggga

SEQ ID NO: 120059 - DNA, 22 bp, Artificial Sequence
  chemically synthesized
cctcttgggaagaaagctttag

SEQ ID NO: 120060 - DNA, 22 bp, Artificial Sequence
  chemically synthesized
ctcttgggaagaaagctttagg

SEQ ID NO: 120061 - DNA, 22 bp, Artificial Sequence
  chemically synthesized
ttgggaagaaagctttagggga

SEQ ID NO: 120062 - DNA, 22 bp, Artificial Sequence
  chemically synthesized
gggaagaaagctttaggggatt

SEQ ID NO: 120063 - DNA, 22 bp, Artificial Sequence
  chemically synthesized
ggaagaaagctttaggggattt

SEQ ID NO: 120064 - DNA, 22 bp, Artificial Sequence
  chemically synthesized
taggggatttctcctagcaaga

SEQ ID NO: 120065 - DNA, 22 bp, Artificial Sequence
  chemically synthesized
aggggatttctcctagcaagag

SEQ ID NO: 120066 - DNA, 22 bp, Artificial Sequence
  chemically synthesized
ggggatttctcctagcaagaga

SEQ ID NO: 120067 - DNA, 22 bp, Artificial Sequence
  chemically synthesized
ctcctagcaagagagataatta

SEQ ID NO: 120068 - DNA, 22 bp, Artificial Sequence
  chemically synthesized
tcctagcaagagagataattat

SEQ ID NO: 120069 - DNA, 22 bp, Artificial Sequence
  chemically synthesized
ctagcaagagagataattatcc

SEQ ID NO: 120070 - DNA, 22 bp, Artificial Sequence
  chemically synthesized
gcaagagagataattatccatg

SEQ ID NO: 120071 - DNA, 22 bp, Artificial Sequence
  chemically synthesized
tccatgataggagagcaacagt

SEQ ID NO: 120072 - DNA, 22 bp, Artificial Sequence
  chemically synthesized
tttcatgtctactaagcaatgg

SEQ ID NO: 120073 - DNA, 22 bp, Artificial Sequence
  chemically synthesized
ttcatgtctactaagcaatgga

SEQ ID NO: 120074 - DNA, 22 bp, Artificial Sequence
  chemically synthesized
tcatgtctactaagcaatggag

SEQ ID NO: 120075 - DNA, 22 bp, Artificial Sequence
  chemically synthesized
catgtctactaagcaatggagg

SEQ ID NO: 120076 - DNA, 22 bp, Artificial Sequence
  chemically synthesized
atgtctactaagcaatggagga

SEQ ID NO: 120077 - DNA, 22 bp, Artificial Sequence
  chemically synthesized
ctaagcaatggaggagtccact

SEQ ID NO: 120078 - DNA, 22 bp, Artificial Sequence
  chemically synthesized
agcaatggaggagtccactcag

SEQ ID NO: 120079 - DNA, 22 bp, Artificial Sequence
  chemically synthesized
agagcagtcagttacatctaat

SEQ ID NO: 120080 - DNA, 22 bp, Artificial Sequence
  chemically synthesized
catctaattacaacataattaa

SEQ ID NO: 120081 - DNA, 22 bp, Artificial Sequence
  chemically synthesized
attacaacataattaaaatatt

SEQ ID NO: 120082 - DNA, 22 bp, Artificial Sequence
  chemically synthesized
caacataattaaaatattcaag

SEQ ID NO: 120083 - DNA, 22 bp, Artificial Sequence
  chemically synthesized
aaatattcaaggcagagtagat

SEQ ID NO: 120084 - DNA, 22 bp, Artificial Sequence
  chemically synthesized
aaggcagagtagattcatctta

SEQ ID NO: 120085 - DNA, 22 bp, Artificial Sequence
  chemically synthesized
atcttagatcacaggagaaaat

SEQ ID NO: 120086 - DNA, 22 bp, Artificial Sequence
  chemically synthesized
agatcacaggagaaaattcctg

SEQ ID NO: 120087 - DNA, 22 bp, Artificial Sequence
  chemically synthesized
gatcacaggagaaaattcctga

SEQ ID NO: 120088 - DNA, 22 bp, Artificial Sequence
  chemically synthesized
ctgaaaagagattttcagtata

SEQ ID NO: 120089 - DNA, 22 bp, Artificial Sequence
  chemically synthesized
aaaagagattttcagtatacaa

SEQ ID NO: 120090 - DNA, 22 bp, Artificial Sequence
  chemically synthesized
tcagtatacaatgagtaattgg

SEQ ID NO: 120091 - DNA, 22 bp, Artificial Sequence
  chemically synthesized
cagtatacaatgagtaattggc

SEQ ID NO: 120092 - DNA, 22 bp, Artificial Sequence
  chemically synthesized
agtatacaatgagtaattggct

SEQ ID NO: 120093 - DNA, 22 bp, Artificial Sequence
  chemically synthesized
gctctctacctcacctgtgtct

SEQ ID NO: 120094 - DNA, 22 bp, Artificial Sequence
  chemically synthesized
tctacctcacctgtgtctaaat

SEQ ID NO: 120095 - DNA, 22 bp, Artificial Sequence
  chemically synthesized
tacctcacctgtgtctaaatat

SEQ ID NO: 120096 - DNA, 22 bp, Artificial Sequence
  chemically synthesized
cctcacctgtgtctaaatattc

SEQ ID NO: 120097 - DNA, 22 bp, Artificial Sequence
  chemically synthesized
acctgtgtctaaatattctttt

SEQ ID NO: 120098 - DNA, 22 bp, Artificial Sequence
  chemically synthesized
tgtctaaatattcttttgtttg

SEQ ID NO: 120099 - DNA, 22 bp, Artificial Sequence
  chemically synthesized
aatattcttttgtttgaattta

SEQ ID NO: 120100 - DNA, 22 bp, Artificial Sequence
  chemically synthesized
ttttgtttgaatttaatattag

SEQ ID NO: 120101 - DNA, 22 bp, Artificial Sequence
  chemically synthesized
ttgtttgaatttaatattagtt

SEQ ID NO: 120102 - DNA, 22 bp, Artificial Sequence
  chemically synthesized
tgtttgaatttaatattagtta

SEQ ID NO: 120103 - DNA, 22 bp, Artificial Sequence
  chemically synthesized
gtttgaatttaatattagttat

SEQ ID NO: 120104 - DNA, 22 bp, Artificial Sequence
  chemically synthesized
tttgaatttaatattagttatt

SEQ ID NO: 120105 - DNA, 22 bp, Artificial Sequence
  chemically synthesized
gaatttaatattagttattttt

SEQ ID NO: 120106 - DNA, 22 bp, Artificial Sequence
  chemically synthesized
aatttaatattagttatttttt

SEQ ID NO: 120107 - DNA, 22 bp, Artificial Sequence
  chemically synthesized
aatattagttattttttaatga

SEQ ID NO: 120108 - DNA, 22 bp, Artificial Sequence
  chemically synthesized
atattagttattttttaatgaa

SEQ ID NO: 120109 - DNA, 22 bp, Artificial Sequence
  chemically synthesized
gttattttttaatgaactacat

SEQ ID NO: 120110 - DNA, 22 bp, Artificial Sequence
  chemically synthesized
ttttttaatgaactacattggt

SEQ ID NO: 120111 - DNA, 22 bp, Artificial Sequence
  chemically synthesized
tttaatgaactacattggtgga

SEQ ID NO: 120112 - DNA, 22 bp, Artificial Sequence
  chemically synthesized
ttaatgaactacattggtggag

SEQ ID NO: 120113 - DNA, 22 bp, Artificial Sequence
  chemically synthesized
taatgaactacattggtggagg

SEQ ID NO: 120114 - DNA, 22 bp, Artificial Sequence
  chemically synthesized
aatgaactacattggtggagga

SEQ ID NO: 120115 - DNA, 22 bp, Artificial Sequence
  chemically synthesized
atgaactacattggtggaggat

SEQ ID NO: 120116 - DNA, 22 bp, Artificial Sequence
  chemically synthesized
cattggtggaggatactgtttc

SEQ ID NO: 120117 - DNA, 22 bp, Artificial Sequence
  chemically synthesized
gtggaggatactgtttcttgta

SEQ ID NO: 120118 - DNA, 22 bp, Artificial Sequence
  chemically synthesized
tttcttgtaaataggagaatat

SEQ ID NO: 120119 - DNA, 22 bp, Artificial Sequence
  chemically synthesized
cttgtaaataggagaatatgca

SEQ ID NO: 120120 - DNA, 22 bp, Artificial Sequence
  chemically synthesized
ttgtaaataggagaatatgcaa

SEQ ID NO: 120121 - DNA, 22 bp, Artificial Sequence
  chemically synthesized
gtaaataggagaatatgcaaaa

SEQ ID NO: 120122 - DNA, 22 bp, Artificial Sequence
  chemically synthesized
taaataggagaatatgcaaaag

SEQ ID NO: 120123 - DNA, 22 bp, Artificial Sequence
  chemically synthesized
cacctaaacacaaggacttgaa

SEQ ID NO: 120124 - DNA, 22 bp, Artificial Sequence
  chemically synthesized
aacacaaggacttgaaccagat

SEQ ID NO: 120125 - DNA, 22 bp, Artificial Sequence
  chemically synthesized
gaaccagattattcatttttga

SEQ ID NO: 120126 - DNA, 22 bp, Artificial Sequence
  chemically synthesized
aaccagattattcatttttgaa

SEQ ID NO: 120127 - DNA, 22 bp, Artificial Sequence
  chemically synthesized
ttcatttttgaacccctagaga

SEQ ID NO: 120128 - DNA, 22 bp, Artificial Sequence
  chemically synthesized
atttttgaacccctagagaaca

SEQ ID NO: 120129 - DNA, 22 bp, Artificial Sequence
  chemically synthesized
ttgaacccctagagaacatttc

SEQ ID NO: 120130 - DNA, 22 bp, Artificial Sequence
  chemically synthesized
tgaacccctagagaacatttcc

SEQ ID NO: 120131 - DNA, 22 bp, Artificial Sequence
  chemically synthesized
gaacccctagagaacatttcca

SEQ ID NO: 120132 - DNA, 22 bp, Artificial Sequence
  chemically synthesized
aacccctagagaacatttccac

SEQ ID NO: 120133 - DNA, 22 bp, Artificial Sequence
  chemically synthesized
gagaacatttccacagtggtca

SEQ ID NO: 120134 - DNA, 22 bp, Artificial Sequence
  chemically synthesized
ccacagtggtcaaactcatctg

SEQ ID NO: 120135 - DNA, 22 bp, Artificial Sequence
  chemically synthesized
cacagtggtcaaactcatctgt

SEQ ID NO: 120136 - DNA, 22 bp, Artificial Sequence
  chemically synthesized
atctgtaaacatgcctgttttt

SEQ ID NO: 120137 - DNA, 22 bp, Artificial Sequence
  chemically synthesized
taaacatgcctgtttttagtag

SEQ ID NO: 120138 - DNA, 22 bp, Artificial Sequence
  chemically synthesized
tttttagtaggatagaggagga

SEQ ID NO: 120139 - DNA, 22 bp, Artificial Sequence
  chemically synthesized
ttagtaggatagaggaggattt

SEQ ID NO: 120140 - DNA, 22 bp, Artificial Sequence
  chemically synthesized
tagtaggatagaggaggatttt

SEQ ID NO: 120141 - DNA, 22 bp, Artificial Sequence
  chemically synthesized
agtaggatagaggaggattttg

SEQ ID NO: 120142 - DNA, 22 bp, Artificial Sequence
  chemically synthesized
gtaggatagaggaggattttgg

SEQ ID NO: 120143 - DNA, 22 bp, Artificial Sequence
  chemically synthesized
tggaaggcgaaggccatatcct

SEQ ID NO: 120144 - DNA, 22 bp, Artificial Sequence
  chemically synthesized
ggaaggcgaaggccatatcctg

SEQ ID NO: 120145 - DNA, 22 bp, Artificial Sequence
  chemically synthesized
gaaggcgaaggccatatcctgg

SEQ ID NO: 120146 - DNA, 22 bp, Artificial Sequence
  chemically synthesized
gatactggggaagttacaaggt

SEQ ID NO: 120147 - DNA, 22 bp, Artificial Sequence
  chemically synthesized
gggaagttacaaggtgttgttt

SEQ ID NO: 120148 - DNA, 22 bp, Artificial Sequence
  chemically synthesized
caaggtgttgtttggattaaaa

SEQ ID NO: 120149 - DNA, 22 bp, Artificial Sequence
  chemically synthesized
tttggattaaaataagcagatt

SEQ ID NO: 120150 - DNA, 22 bp, Artificial Sequence
  chemically synthesized
ggattaaaataagcagattgag

SEQ ID NO: 120151 - DNA, 22 bp, Artificial Sequence
  chemically synthesized
gattaaaataagcagattgagg

SEQ ID NO: 120152 - DNA, 22 bp, Artificial Sequence
  chemically synthesized
aaataagcagattgaggatggg

SEQ ID NO: 120153 - DNA, 22 bp, Artificial Sequence
  chemically synthesized
aggatggggtcttttctatgtt

SEQ ID NO: 120154 - DNA, 22 bp, Artificial Sequence
  chemically synthesized
ttctatgttaactggaccagca

SEQ ID NO: 120155 - DNA, 22 bp, Artificial Sequence
  chemically synthesized
tctatgttaactggaccagcat

SEQ ID NO: 120156 - DNA, 22 bp, Artificial Sequence
  chemically synthesized
ctatgttaactggaccagcata

SEQ ID NO: 120157 - DNA, 22 bp, Artificial Sequence
  chemically synthesized
tatgttaactggaccagcatat

SEQ ID NO: 120158 - DNA, 22 bp, Artificial Sequence
  chemically synthesized
tgttaactggaccagcatataa

SEQ ID NO: 120159 - DNA, 22 bp, Artificial Sequence
  chemically synthesized
actggaccagcatataaaatgc

SEQ ID NO: 120160 - DNA, 22 bp, Artificial Sequence
  chemically synthesized
gaccagcatataaaatgcattt

SEQ ID NO: 120161 - DNA, 22 bp, Artificial Sequence
  chemically synthesized
aataatttgttgaataagtgaa

SEQ ID NO: 120162 - DNA, 22 bp, Artificial Sequence
  chemically synthesized
ataatttgttgaataagtgaat

SEQ ID NO: 120163 - DNA, 22 bp, Artificial Sequence
  chemically synthesized
gttgaataagtgaatgactgtt

SEQ ID NO: 120164 - DNA, 22 bp, Artificial Sequence
  chemically synthesized
ttgaataagtgaatgactgttt

SEQ ID NO: 120165 - DNA, 22 bp, Artificial Sequence
  chemically synthesized
aataagtgaatgactgtttttc

SEQ ID NO: 120166 - DNA, 22 bp, Artificial Sequence
  chemically synthesized
tttttctgatgagagtaaggag

SEQ ID NO: 120167 - DNA, 22 bp, Artificial Sequence
  chemically synthesized
ttctgatgagagtaaggagagg

SEQ ID NO: 120168 - DNA, 22 bp, Artificial Sequence
  chemically synthesized
tctgatgagagtaaggagaggg

SEQ ID NO: 120169 - DNA, 22 bp, Artificial Sequence
  chemically synthesized
ctgatgagagtaaggagagggt

SEQ ID NO: 120170 - DNA, 22 bp, Artificial Sequence
  chemically synthesized
tgatgagagtaaggagagggtg

SEQ ID NO: 120171 - DNA, 22 bp, Artificial Sequence
  chemically synthesized
atgagagtaaggagagggtgtg

SEQ ID NO: 120172 - DNA, 22 bp, Artificial Sequence
  chemically synthesized
ggcaggaaagagtatagagacc

SEQ ID NO: 120173 - DNA, 22 bp, Artificial Sequence
  chemically synthesized
ctgccatcctgacttctagaca

SEQ ID NO: 120174 - DNA, 22 bp, Artificial Sequence
  chemically synthesized
tgccatcctgacttctagacat

SEQ ID NO: 120175 - DNA, 22 bp, Artificial Sequence
  chemically synthesized
ccatcctgacttctagacatga

SEQ ID NO: 120176 - DNA, 22 bp, Artificial Sequence
  chemically synthesized
acttctagacatgatccaggga

SEQ ID NO: 120177 - DNA, 22 bp, Artificial Sequence
  chemically synthesized
ctagacatgatccagggagggg

SEQ ID NO: 120178 - DNA, 22 bp, Artificial Sequence
  chemically synthesized
tagacatgatccagggaggggc

SEQ ID NO: 120179 - DNA, 22 bp, Artificial Sequence
  chemically synthesized
gacatgatccagggaggggctg

SEQ ID NO: 120180 - DNA, 22 bp, Artificial Sequence
  chemically synthesized
gcctggccatgcaggcactcat

SEQ ID NO: 120181 - DNA, 22 bp, Artificial Sequence
  chemically synthesized
gccatgcaggcactcatcaggg

SEQ ID NO: 120182 - DNA, 22 bp, Artificial Sequence
  chemically synthesized
atcaggggagtgaggcagccct

SEQ ID NO: 120183 - DNA, 22 bp, Artificial Sequence
  chemically synthesized
cctcctggccttcctaacagaa

SEQ ID NO: 120184 - DNA, 22 bp, Artificial Sequence
  chemically synthesized
ctggccttcctaacagaatact

SEQ ID NO: 120185 - DNA, 22 bp, Artificial Sequence
  chemically synthesized
gccttcctaacagaatactgca

SEQ ID NO: 120186 - DNA, 22 bp, Artificial Sequence
  chemically synthesized
cctaacagaatactgcagatga

SEQ ID NO: 120187 - DNA, 22 bp, Artificial Sequence
  chemically synthesized
ctaacagaatactgcagatgag

SEQ ID NO: 120188 - DNA, 22 bp, Artificial Sequence
  chemically synthesized
acagaatactgcagatgagctc

SEQ ID NO: 120189 - DNA, 22 bp, Artificial Sequence
  chemically synthesized
cagatgagctcgcctcttttcc

SEQ ID NO: 120190 - DNA, 22 bp, Artificial Sequence
  chemically synthesized
gcctcttttccagcaagagaag

SEQ ID NO: 120191 - DNA, 22 bp, Artificial Sequence
  chemically synthesized
ttttccagcaagagaaggtcct

SEQ ID NO: 120192 - DNA, 22 bp, Artificial Sequence
  chemically synthesized
ttccagcaagagaaggtcctgt

SEQ ID NO: 120193 - DNA, 22 bp, Artificial Sequence
  chemically synthesized
tccagcaagagaaggtcctgtt

SEQ ID NO: 120194 - DNA, 22 bp, Artificial Sequence
  chemically synthesized
ccagcaagagaaggtcctgttt

SEQ ID NO: 120195 - DNA, 22 bp, Artificial Sequence
  chemically synthesized
cagcaagagaaggtcctgtttt

SEQ ID NO: 120196 - DNA, 22 bp, Artificial Sequence
  chemically synthesized
ttttctgttctttctctggctc

SEQ ID NO: 120197 - DNA, 22 bp, Artificial Sequence
  chemically synthesized
tctgttctttctctggctctgg

SEQ ID NO: 120198 - DNA, 22 bp, Artificial Sequence
  chemically synthesized
ctgttctttctctggctctggt

SEQ ID NO: 120199 - DNA, 22 bp, Artificial Sequence
  chemically synthesized
tgttctttctctggctctggtt

SEQ ID NO: 120200 - DNA, 22 bp, Artificial Sequence
  chemically synthesized
ttctttctctggctctggttct

SEQ ID NO: 120201 - DNA, 22 bp, Artificial Sequence
  chemically synthesized
tttctctggctctggttctgtg

SEQ ID NO: 120202 - DNA, 22 bp, Artificial Sequence
  chemically synthesized
tctctggctctggttctgtgca

SEQ ID NO: 120203 - DNA, 22 bp, Artificial Sequence
  chemically synthesized
ctctggctctggttctgtgcat

SEQ ID NO: 120204 - DNA, 22 bp, Artificial Sequence
  chemically synthesized
tctggctctggttctgtgcata

SEQ ID NO: 120205 - DNA, 22 bp, Artificial Sequence
  chemically synthesized
tggctctggttctgtgcataga

SEQ ID NO: 120206 - DNA, 22 bp, Artificial Sequence
  chemically synthesized
gctctggttctgtgcatagact

SEQ ID NO: 120207 - DNA, 22 bp, Artificial Sequence
  chemically synthesized
tggttctgtgcatagactctga

SEQ ID NO: 120208 - DNA, 22 bp, Artificial Sequence
  chemically synthesized
gttctgtgcatagactctgaga

SEQ ID NO: 120209 - DNA, 22 bp, Artificial Sequence
  chemically synthesized
tgtgcatagactctgagaatat

SEQ ID NO: 120210 - DNA, 22 bp, Artificial Sequence
  chemically synthesized
tgcatagactctgagaatatca

SEQ ID NO: 120211 - DNA, 22 bp, Artificial Sequence
  chemically synthesized
tgagaatatcagaagagattct

SEQ ID NO: 120212 - DNA, 22 bp, Artificial Sequence
  chemically synthesized
agaatatcagaagagattctgt

SEQ ID NO: 120213 - DNA, 22 bp, Artificial Sequence
  chemically synthesized
tgtgagaaccctggtttctaag

SEQ ID NO: 120214 - DNA, 22 bp, Artificial Sequence
  chemically synthesized
tgagaaccctggtttctaagac

SEQ ID NO: 120215 - DNA, 22 bp, Artificial Sequence
  chemically synthesized
gtttctaagacttcattttcca

SEQ ID NO: 120216 - DNA, 22 bp, Artificial Sequence
  chemically synthesized
ctaagacttcattttccaagtg

SEQ ID NO: 120217 - DNA, 22 bp, Artificial Sequence
  chemically synthesized
taagacttcattttccaagtga

SEQ ID NO: 120218 - DNA, 22 bp, Artificial Sequence
  chemically synthesized
agacttcattttccaagtgaaa

SEQ ID NO: 120219 - DNA, 22 bp, Artificial Sequence
  chemically synthesized
cattttccaagtgaaaaatcta

SEQ ID NO: 120220 - DNA, 22 bp, Artificial Sequence
  chemically synthesized
attttccaagtgaaaaatctaa

SEQ ID NO: 120221 - DNA, 22 bp, Artificial Sequence
  chemically synthesized
tccaagtgaaaaatctaaggcc

SEQ ID NO: 120222 - DNA, 22 bp, Artificial Sequence
  chemically synthesized
ccaagtgaaaaatctaaggccc

SEQ ID NO: 120223 - DNA, 22 bp, Artificial Sequence
  chemically synthesized
caagtgaaaaatctaaggccca

SEQ ID NO: 120224 - DNA, 22 bp, Artificial Sequence
  chemically synthesized
aggcccagactgctgtatatgg

SEQ ID NO: 120225 - DNA, 22 bp, Artificial Sequence
  chemically synthesized
ctgtatatggtggttcacactt

SEQ ID NO: 120226 - DNA, 22 bp, Artificial Sequence
  chemically synthesized
tatatggtggttcacacttata

SEQ ID NO: 120227 - DNA, 22 bp, Artificial Sequence
  chemically synthesized
acacttataatcctggcaactt

SEQ ID NO: 120228 - DNA, 22 bp, Artificial Sequence
  chemically synthesized
ataatcctggcaacttggaaga

SEQ ID NO: 120229 - DNA, 22 bp, Artificial Sequence
  chemically synthesized
taatcctggcaacttggaagaa

SEQ ID NO: 120230 - DNA, 22 bp, Artificial Sequence
  chemically synthesized
gcaacttggaagaataaggtgg

SEQ ID NO: 120231 - DNA, 22 bp, Artificial Sequence
  chemically synthesized
ggaagaataaggtgggaggatt

SEQ ID NO: 120232 - DNA, 22 bp, Artificial Sequence
  chemically synthesized
gaagaataaggtgggaggattg

SEQ ID NO: 120233 - DNA, 22 bp, Artificial Sequence
  chemically synthesized
cttgaatccggtttgagtttac

SEQ ID NO: 120234 - DNA, 22 bp, Artificial Sequence
  chemically synthesized
gaatccggtttgagtttacagt

SEQ ID NO: 120235 - DNA, 22 bp, Artificial Sequence
  chemically synthesized
aatccggtttgagtttacagtg

SEQ ID NO: 120236 - DNA, 22 bp, Artificial Sequence
  chemically synthesized
gagtttacagtgagctatgatt

SEQ ID NO: 120237 - DNA, 22 bp, Artificial Sequence
  chemically synthesized
agtttacagtgagctatgatta

SEQ ID NO: 120238 - DNA, 22 bp, Artificial Sequence
  chemically synthesized
acagtgagctatgattacacca

SEQ ID NO: 120239 - DNA, 22 bp, Artificial Sequence
  chemically synthesized
cagtgagctatgattacaccac

SEQ ID NO: 120240 - DNA, 22 bp, Artificial Sequence
  chemically synthesized
tgattacaccactgcactgtag

SEQ ID NO: 120241 - DNA, 22 bp, Artificial Sequence
  chemically synthesized
caccactgcactgtagcctggg

SEQ ID NO: 120242 - DNA, 22 bp, Artificial Sequence
  chemically synthesized
cactgtagcctgggtaacagag

SEQ ID NO: 120243 - DNA, 22 bp, Artificial Sequence
  chemically synthesized
tagcctgggtaacagagctaga

SEQ ID NO: 120244 - DNA, 22 bp, Artificial Sequence
  chemically synthesized
ggtaacagagctagacctcatt

SEQ ID NO: 120245 - DNA, 22 bp, Artificial Sequence
  chemically synthesized
gacctcatttctaaaaacaaca

SEQ ID NO: 120246 - DNA, 22 bp, Artificial Sequence
  chemically synthesized
atttctaaaaacaacaaacaaa

SEQ ID NO: 120247 - DNA, 22 bp, Artificial Sequence
  chemically synthesized
ctaaaaacaacaaacaaagaaa

SEQ ID NO: 120248 - DNA, 22 bp, Artificial Sequence
  chemically synthesized
taaaaacaacaaacaaagaaac

SEQ ID NO: 120249 - DNA, 22 bp, Artificial Sequence
  chemically synthesized
aaaacaacaaacaaagaaacaa

SEQ ID NO: 120250 - DNA, 22 bp, Artificial Sequence
  chemically synthesized
ggcttagtgcagggaatgtggg

SEQ ID NO: 120251 - DNA, 22 bp, Artificial Sequence
  chemically synthesized
agtgcagggaatgtggggaatc

SEQ ID NO: 120252 - DNA, 22 bp, Artificial Sequence
  chemically synthesized
gtgcagggaatgtggggaatcc

SEQ ID NO: 120253 - DNA, 22 bp, Artificial Sequence
  chemically synthesized
ggctaaggacattcaaacattt

SEQ ID NO: 120254 - DNA, 22 bp, Artificial Sequence
  chemically synthesized
gctaaggacattcaaacatttg

SEQ ID NO: 120255 - DNA, 22 bp, Artificial Sequence
  chemically synthesized
aggacattcaaacatttggggg

SEQ ID NO: 120256 - DNA, 22 bp, Artificial Sequence
  chemically synthesized
aaacatttgggggaaaagcctt

SEQ ID NO: 120257 - DNA, 22 bp, Artificial Sequence
  chemically synthesized
gggggaaaagccttaattgtaa

SEQ ID NO: 120258 - DNA, 22 bp, Artificial Sequence
  chemically synthesized
ggggaaaagccttaattgtaac

SEQ ID NO: 120259 - DNA, 22 bp, Artificial Sequence
  chemically synthesized
aattgtaactgagaccatgtct

SEQ ID NO: 120260 - DNA, 22 bp, Artificial Sequence
  chemically synthesized
attgtaactgagaccatgtctt

SEQ ID NO: 120261 - DNA, 22 bp, Artificial Sequence
  chemically synthesized
taactgagaccatgtctttttg

SEQ ID NO: 120262 - DNA, 22 bp, Artificial Sequence
  chemically synthesized
agaccatgtctttttgggctca

SEQ ID NO: 120263 - DNA, 22 bp, Artificial Sequence
  chemically synthesized
tttgggctcactgcttttgtga

SEQ ID NO: 120264 - DNA, 22 bp, Artificial Sequence
  chemically synthesized
ttgggctcactgcttttgtgat

SEQ ID NO: 120265 - DNA, 22 bp, Artificial Sequence
  chemically synthesized
tgggctcactgcttttgtgata

SEQ ID NO: 120266 - DNA, 22 bp, Artificial Sequence
  chemically synthesized
gggctcactgcttttgtgatac

SEQ ID NO: 120267 - DNA, 22 bp, Artificial Sequence
  chemically synthesized
ggctcactgcttttgtgatacc

SEQ ID NO: 120268 - DNA, 22 bp, Artificial Sequence
  chemically synthesized
actgcttttgtgatacctatgc

SEQ ID NO: 120269 - DNA, 22 bp, Artificial Sequence
  chemically synthesized
cttttgtgatacctatgcattc

SEQ ID NO: 120270 - DNA, 22 bp, Artificial Sequence
  chemically synthesized
ttgtgatacctatgcattccca

SEQ ID NO: 120271 - DNA, 22 bp, Artificial Sequence
  chemically synthesized
tgtgatacctatgcattcccat

SEQ ID NO: 120272 - DNA, 22 bp, Artificial Sequence
  chemically synthesized
gtgatacctatgcattcccatt

SEQ ID NO: 120273 - DNA, 22 bp, Artificial Sequence
  chemically synthesized
tgatacctatgcattcccattt

SEQ ID NO: 120274 - DNA, 22 bp, Artificial Sequence
  chemically synthesized
tgcattcccattttccctcatt

SEQ ID NO: 120275 - DNA, 22 bp, Artificial Sequence
  chemically synthesized
ccattttccctcattttctccc

SEQ ID NO: 120276 - DNA, 22 bp, Artificial Sequence
  chemically synthesized
tccctcattttctccctcctct

SEQ ID NO: 120277 - DNA, 22 bp, Artificial Sequence
  chemically synthesized
ccctcattttctccctcctctc

SEQ ID NO: 120278 - DNA, 22 bp, Artificial Sequence
  chemically synthesized
cctcattttctccctcctctct

SEQ ID NO: 120279 - DNA, 22 bp, Artificial Sequence
  chemically synthesized
attttctccctcctctctccca

SEQ ID NO: 120280 - DNA, 22 bp, Artificial Sequence
  chemically synthesized
tctccctcctctctcccatgtc

SEQ ID NO: 120281 - DNA, 22 bp, Artificial Sequence
  chemically synthesized
ctccctcctctctcccatgtcc

SEQ ID NO: 120282 - DNA, 22 bp, Artificial Sequence
  chemically synthesized
tccctcctctctcccatgtccc

SEQ ID NO: 120283 - DNA, 22 bp, Artificial Sequence
  chemically synthesized
cctcctctctcccatgtccccc

SEQ ID NO: 120284 - DNA, 22 bp, Artificial Sequence
  chemically synthesized
ctctctcccatgtccccctaat

SEQ ID NO: 120285 - DNA, 22 bp, Artificial Sequence
  chemically synthesized
tctcccatgtccccctaattac

SEQ ID NO: 120286 - DNA, 22 bp, Artificial Sequence
  chemically synthesized
tcccatgtccccctaattaccc

SEQ ID NO: 120287 - DNA, 22 bp, Artificial Sequence
  chemically synthesized
ccatgtccccctaattacccac

SEQ ID NO: 120288 - DNA, 22 bp, Artificial Sequence
  chemically synthesized
attacccactcctgaaaccccg

SEQ ID NO: 120289 - DNA, 22 bp, Artificial Sequence
  chemically synthesized
cccactcctgaaaccccggcac

SEQ ID NO: 120290 - DNA, 22 bp, Artificial Sequence
  chemically synthesized
ctgaaaccccggcacaagacag

SEQ ID NO: 120291 - DNA, 22 bp, Artificial Sequence
  chemically synthesized
aaaccccggcacaagacagtag

SEQ ID NO: 120292 - DNA, 22 bp, Artificial Sequence
  chemically synthesized
accagcaggtaataacaaaaat

SEQ ID NO: 120293 - DNA, 22 bp, Artificial Sequence
  chemically synthesized
caaaggaagaaagaagagtata

SEQ ID NO: 120294 - DNA, 22 bp, Artificial Sequence
  chemically synthesized
agaggcacaaggctgtggctgt

SEQ ID NO: 120295 - DNA, 22 bp, Artificial Sequence
  chemically synthesized
tggctgtcacagaaggatttat

SEQ ID NO: 120296 - DNA, 22 bp, Artificial Sequence
  chemically synthesized
tcacagaaggatttatcctcct

SEQ ID NO: 120297 - DNA, 22 bp, Artificial Sequence
  chemically synthesized
atcctcctaaagaccatggctc

SEQ ID NO: 120298 - DNA, 22 bp, Artificial Sequence
  chemically synthesized
tcctcctaaagaccatggctcc

SEQ ID NO: 120299 - DNA, 22 bp, Artificial Sequence
  chemically synthesized
ctaaagaccatggctccagctg

SEQ ID NO: 120300 - DNA, 22 bp, Artificial Sequence
  chemically synthesized
aagaccatggctccagctggga

SEQ ID NO: 120301 - DNA, 22 bp, Artificial Sequence
  chemically synthesized
cagctgggagaacttaatggta

SEQ ID NO: 120302 - DNA, 22 bp, Artificial Sequence
  chemically synthesized
ggagaacttaatggtaaacaaa

SEQ ID NO: 120303 - DNA, 22 bp, Artificial Sequence
  chemically synthesized
aatggtaaacaaagggtcccca

SEQ ID NO: 120304 - DNA, 22 bp, Artificial Sequence
  chemically synthesized
atggtaaacaaagggtccccag

SEQ ID NO: 120305 - DNA, 22 bp, Artificial Sequence
  chemically synthesized
ggaatcctatgggcaggaaact

SEQ ID NO: 120306 - DNA, 22 bp, Artificial Sequence
  chemically synthesized
tgggcaggaaactttctttatc

SEQ ID NO: 120307 - DNA, 22 bp, Artificial Sequence
  chemically synthesized
tctttatctccacccctgtctc

SEQ ID NO: 120308 - DNA, 22 bp, Artificial Sequence
  chemically synthesized
ctttatctccacccctgtctcc

SEQ ID NO: 120309 - DNA, 22 bp, Artificial Sequence
  chemically synthesized
tttatctccacccctgtctcct

SEQ ID NO: 120310 - DNA, 22 bp, Artificial Sequence
  chemically synthesized
tatctccacccctgtctcctga

SEQ ID NO: 120311 - DNA, 22 bp, Artificial Sequence
  chemically synthesized
atctccacccctgtctcctgaa

SEQ ID NO: 120312 - DNA, 22 bp, Artificial Sequence
  chemically synthesized
tctccacccctgtctcctgaag

SEQ ID NO: 120313 - DNA, 22 bp, Artificial Sequence
  chemically synthesized
cacccctgtctcctgaagctga

SEQ ID NO: 120314 - DNA, 22 bp, Artificial Sequence
  chemically synthesized
tctcctgaagctgaagagccct

SEQ ID NO: 120315 - DNA, 22 bp, Artificial Sequence
  chemically synthesized
ctgaagctgaagagccctaact

SEQ ID NO: 120316 - DNA, 22 bp, Artificial Sequence
  chemically synthesized
aagctgaagagccctaactttt

SEQ ID NO: 120317 - DNA, 22 bp, Artificial Sequence
  chemically synthesized
aagagccctaactttttagcat

SEQ ID NO: 120318 - DNA, 22 bp, Artificial Sequence
  chemically synthesized
actttttagcattcagtcccca

SEQ ID NO: 120319 - DNA, 22 bp, Artificial Sequence
  chemically synthesized
tttagcattcagtccccaggtt

SEQ ID NO: 120320 - DNA, 22 bp, Artificial Sequence
  chemically synthesized
ttagcattcagtccccaggttt

SEQ ID NO: 120321 - DNA, 22 bp, Artificial Sequence
  chemically synthesized
tagcattcagtccccaggtttt

SEQ ID NO: 120322 - DNA, 22 bp, Artificial Sequence
  chemically synthesized
agcattcagtccccaggttttg

SEQ ID NO: 120323 - DNA, 22 bp, Artificial Sequence
  chemically synthesized
gcattcagtccccaggttttgg

SEQ ID NO: 120324 - DNA, 22 bp, Artificial Sequence
  chemically synthesized
agtccccaggttttggctacac

SEQ ID NO: 120325 - DNA, 22 bp, Artificial Sequence
  chemically synthesized
tggctacacagacatctgctgc

SEQ ID NO: 120326 - DNA, 22 bp, Artificial Sequence
  chemically synthesized
ggctacacagacatctgctgca

SEQ ID NO: 120327 - DNA, 22 bp, Artificial Sequence
  chemically synthesized
gctacacagacatctgctgcaa

SEQ ID NO: 120328 - DNA, 22 bp, Artificial Sequence
  chemically synthesized
cacagacatctgctgcaacaaa

SEQ ID NO: 120329 - DNA, 22 bp, Artificial Sequence
  chemically synthesized
ctgcaacaaaagtactactgcc

SEQ ID NO: 120330 - DNA, 22 bp, Artificial Sequence
  chemically synthesized
caacaaaagtactactgcctta

SEQ ID NO: 120331 - DNA, 22 bp, Artificial Sequence
  chemically synthesized
ctgccttatctgtttattttta

SEQ ID NO: 120332 - DNA, 22 bp, Artificial Sequence
  chemically synthesized
ccttatctgtttatttttaatt

SEQ ID NO: 120333 - DNA, 22 bp, Artificial Sequence
  chemically synthesized
atctgtttatttttaatttcat

SEQ ID NO: 120334 - DNA, 22 bp, Artificial Sequence
  chemically synthesized
tctgtttatttttaatttcata

SEQ ID NO: 120335 - DNA, 22 bp, Artificial Sequence
  chemically synthesized
tttatttttaatttcataaaga

SEQ ID NO: 120336 - DNA, 22 bp, Artificial Sequence
  chemically synthesized
atttttaatttcataaagaagt

SEQ ID NO: 120337 - DNA, 22 bp, Artificial Sequence
  chemically synthesized
tttttaatttcataaagaagtc

SEQ ID NO: 120338 - DNA, 22 bp, Artificial Sequence
  chemically synthesized
ttaatttcataaagaagtcaat

SEQ ID NO: 120339 - DNA, 22 bp, Artificial Sequence
  chemically synthesized
taatttcataaagaagtcaatt

SEQ ID NO: 120340 - DNA, 22 bp, Artificial Sequence
  chemically synthesized
aatttcataaagaagtcaattc

SEQ ID NO: 120341 - DNA, 22 bp, Artificial Sequence
  chemically synthesized
atttcataaagaagtcaattca

SEQ ID NO: 120342 - DNA, 22 bp, Artificial Sequence
  chemically synthesized
cataaagaagtcaattcatatc

SEQ ID NO: 120343 - DNA, 22 bp, Artificial Sequence
  chemically synthesized
ataaagaagtcaattcatatca

SEQ ID NO: 120344 - DNA, 22 bp, Artificial Sequence
  chemically synthesized
atatcacttatcattttattta

SEQ ID NO: 120345 - DNA, 22 bp, Artificial Sequence
  chemically synthesized
atcattttatttactgtcttct

SEQ ID NO: 120346 - DNA, 22 bp, Artificial Sequence
  chemically synthesized
tcattttatttactgtcttctg

SEQ ID NO: 120347 - DNA, 22 bp, Artificial Sequence
  chemically synthesized
tatttactgtcttctgttatcc

SEQ ID NO: 120348 - DNA, 22 bp, Artificial Sequence
  chemically synthesized
atttactgtcttctgttatcca

SEQ ID NO: 120349 - DNA, 22 bp, Artificial Sequence
  chemically synthesized
tttactgtcttctgttatccac

SEQ ID NO: 120350 - DNA, 22 bp, Artificial Sequence
  chemically synthesized
actgtcttctgttatccactag

SEQ ID NO: 120351 - DNA, 22 bp, Artificial Sequence
  chemically synthesized
ctgtcttctgttatccactagt

SEQ ID NO: 120352 - DNA, 22 bp, Artificial Sequence
  chemically synthesized
tcttctgttatccactagtaat

SEQ ID NO: 120353 - DNA, 22 bp, Artificial Sequence
  chemically synthesized
ctgttatccactagtaatggac

SEQ ID NO: 120354 - DNA, 22 bp, Artificial Sequence
  chemically synthesized
tgttatccactagtaatggacc

SEQ ID NO: 120355 - DNA, 22 bp, Artificial Sequence
  chemically synthesized
ttatccactagtaatggacccg

SEQ ID NO: 120356 - DNA, 22 bp, Artificial Sequence
  chemically synthesized
tccactagtaatggacccgtcg

SEQ ID NO: 120357 - DNA, 22 bp, Artificial Sequence
  chemically synthesized
gtaatggacccgtcgttttcca

SEQ ID NO: 120358 - DNA, 22 bp, Artificial Sequence
  chemically synthesized
tccagagaggtcggatgtagta

SEQ ID NO: 120359 - DNA, 22 bp, Artificial Sequence
  chemically synthesized
ccagagaggtcggatgtagtat

SEQ ID NO: 120360 - DNA, 22 bp, Artificial Sequence
  chemically synthesized
cagagaggtcggatgtagtata

SEQ ID NO: 120361 - DNA, 22 bp, Artificial Sequence
  chemically synthesized
tccatgtgatgttcacagtggc

SEQ ID NO: 120362 - DNA, 22 bp, Artificial Sequence
  chemically synthesized
acagtggcttttaaattgcaca

SEQ ID NO: 120363 - DNA, 22 bp, Artificial Sequence
  chemically synthesized
ttaaattgcacatctgccttga

SEQ ID NO: 120364 - DNA, 22 bp, Artificial Sequence
  chemically synthesized
taaattgcacatctgccttgaa

SEQ ID NO: 120365 - DNA, 22 bp, Artificial Sequence
  chemically synthesized
aaattgcacatctgccttgaag

SEQ ID NO: 120366 - DNA, 22 bp, Artificial Sequence
  chemically synthesized
aattgcacatctgccttgaagc

SEQ ID NO: 120367 - DNA, 22 bp, Artificial Sequence
  chemically synthesized
cacatctgccttgaagcaccac

SEQ ID NO: 120368 - DNA, 22 bp, Artificial Sequence
  chemically synthesized
ccttgaagcaccacaatcacca

SEQ ID NO: 120369 - DNA, 22 bp, Artificial Sequence
  chemically synthesized
gaagcaccacaatcaccactac

SEQ ID NO: 120370 - DNA, 22 bp, Artificial Sequence
  chemically synthesized
aagcaccacaatcaccactact

SEQ ID NO: 120371 - DNA, 22 bp, Artificial Sequence
  chemically synthesized
cttcaagattctctcactcctg

SEQ ID NO: 120372 - DNA, 22 bp, Artificial Sequence
  chemically synthesized
caagattctctcactcctgcac

SEQ ID NO: 120373 - DNA, 22 bp, Artificial Sequence
  chemically synthesized
aagattctctcactcctgcact

SEQ ID NO: 120374 - DNA, 22 bp, Artificial Sequence
  chemically synthesized
tctcactcctgcactcattttc

SEQ ID NO: 120375 - DNA, 22 bp, Artificial Sequence
  chemically synthesized
tcactcctgcactcattttcct

SEQ ID NO: 120376 - DNA, 22 bp, Artificial Sequence
  chemically synthesized
actcctgcactcattttcctgt

SEQ ID NO: 120377 - DNA, 22 bp, Artificial Sequence
  chemically synthesized
ctgcactcattttcctgtctat

SEQ ID NO: 120378 - DNA, 22 bp, Artificial Sequence
  chemically synthesized
cactcattttcctgtctatttt

SEQ ID NO: 120379 - DNA, 22 bp, Artificial Sequence
  chemically synthesized
attttcctgtctatttttatat

SEQ ID NO: 120380 - DNA, 22 bp, Artificial Sequence
  chemically synthesized
tcctgtctatttttatatttcc

SEQ ID NO: 120381 - DNA, 22 bp, Artificial Sequence
  chemically synthesized
cctgtctatttttatatttcca

SEQ ID NO: 120382 - DNA, 22 bp, Artificial Sequence
  chemically synthesized
ctgtctatttttatatttccat

SEQ ID NO: 120383 - DNA, 22 bp, Artificial Sequence
  chemically synthesized
tctatttttatatttccattta

SEQ ID NO: 120384 - DNA, 22 bp, Artificial Sequence
  chemically synthesized
tttttatatttccatttactgc

SEQ ID NO: 120385 - DNA, 22 bp, Artificial Sequence
  chemically synthesized
ttatatttccatttactgcaga

SEQ ID NO: 120386 - DNA, 22 bp, Artificial Sequence
  chemically synthesized
tatatttccatttactgcagat

SEQ ID NO: 120387 - DNA, 22 bp, Artificial Sequence
  chemically synthesized
atatttccatttactgcagata

SEQ ID NO: 120388 - DNA, 22 bp, Artificial Sequence
  chemically synthesized
tatttccatttactgcagataa

SEQ ID NO: 120389 - DNA, 22 bp, Artificial Sequence
  chemically synthesized
ccatttactgcagataattaaa

SEQ ID NO: 120390 - DNA, 22 bp, Artificial Sequence
  chemically synthesized
catttactgcagataattaaat

SEQ ID NO: 120391 - DNA, 22 bp, Artificial Sequence
  chemically synthesized
actgcagataattaaattgccc

SEQ ID NO: 120392 - DNA, 22 bp, Artificial Sequence
  chemically synthesized
ctgcagataattaaattgccct

SEQ ID NO: 120393 - DNA, 22 bp, Artificial Sequence
  chemically synthesized
cagataattaaattgccctcca

SEQ ID NO: 120394 - DNA, 22 bp, Artificial Sequence
  chemically synthesized
aattgccctccatctctgccag

SEQ ID NO: 120395 - DNA, 22 bp, Artificial Sequence
  chemically synthesized
ccctccatctctgccagcctct

SEQ ID NO: 120396 - DNA, 22 bp, Artificial Sequence
  chemically synthesized
catctctgccagcctctatatc

SEQ ID NO: 120397 - DNA, 22 bp, Artificial Sequence
  chemically synthesized
tgccagcctctatatctttgga

SEQ ID NO: 120398 - DNA, 22 bp, Artificial Sequence
  chemically synthesized
ccagcctctatatctttggacc

SEQ ID NO: 120399 - DNA, 22 bp, Artificial Sequence
  chemically synthesized
tatatctttggacctagaagtc

SEQ ID NO: 120400 - DNA, 22 bp, Artificial Sequence
  chemically synthesized
tatctttggacctagaagtcaa

SEQ ID NO: 120401 - DNA, 22 bp, Artificial Sequence
  chemically synthesized
tggacctagaagtcaatcttgc

SEQ ID NO: 120402 - DNA, 22 bp, Artificial Sequence
  chemically synthesized
ggacctagaagtcaatcttgca

SEQ ID NO: 120403 - DNA, 22 bp, Artificial Sequence
  chemically synthesized
gacctagaagtcaatcttgcat

SEQ ID NO: 120404 - DNA, 22 bp, Artificial Sequence
  chemically synthesized
gaagtcaatcttgcatattcaa

SEQ ID NO: 120405 - DNA, 22 bp, Artificial Sequence
  chemically synthesized
gcatattcaatcctaccccaaa

SEQ ID NO: 120406 - DNA, 22 bp, Artificial Sequence
  chemically synthesized
catattcaatcctaccccaaac

SEQ ID NO: 120407 - DNA, 22 bp, Artificial Sequence
  chemically synthesized
aatcctaccccaaacaaatgtc

SEQ ID NO: 120408 - DNA, 22 bp, Artificial Sequence
  chemically synthesized
ccccaaacaaatgtccaggtca

SEQ ID NO: 120409 - DNA, 22 bp, Artificial Sequence
  chemically synthesized
aggctttcccaaagctctctac

SEQ ID NO: 120410 - DNA, 22 bp, Artificial Sequence
  chemically synthesized
tcccaaagctctctacttcatc

SEQ ID NO: 120411 - DNA, 22 bp, Artificial Sequence
  chemically synthesized
cccaaagctctctacttcatct

SEQ ID NO: 120412 - DNA, 22 bp, Artificial Sequence
  chemically synthesized
ccaaagctctctacttcatctt

SEQ ID NO: 120413 - DNA, 22 bp, Artificial Sequence
  chemically synthesized
tctacttcatctttgaatgcac

SEQ ID NO: 120414 - DNA, 22 bp, Artificial Sequence
  chemically synthesized
tacttcatctttgaatgcactg

SEQ ID NO: 120415 - DNA, 22 bp, Artificial Sequence
  chemically synthesized
cttcatctttgaatgcactgga

SEQ ID NO: 120416 - DNA, 22 bp, Artificial Sequence
  chemically synthesized
catctttgaatgcactggactt

SEQ ID NO: 120417 - DNA, 22 bp, Artificial Sequence
  chemically synthesized
atctttgaatgcactggacttt

SEQ ID NO: 120418 - DNA, 22 bp, Artificial Sequence
  chemically synthesized
tgaatgcactggactttccttc

SEQ ID NO: 120419 - DNA, 22 bp, Artificial Sequence
  chemically synthesized
gaatgcactggactttccttca

SEQ ID NO: 120420 - DNA, 22 bp, Artificial Sequence
  chemically synthesized
aatgcactggactttccttcaa

SEQ ID NO: 120421 - DNA, 22 bp, Artificial Sequence
  chemically synthesized
gactttccttcaatgagcccta

SEQ ID NO: 120422 - DNA, 22 bp, Artificial Sequence
  chemically synthesized
tccttcaatgagccctacaaca

SEQ ID NO: 120423 - DNA, 22 bp, Artificial Sequence
  chemically synthesized
ccttcaatgagccctacaacaa

SEQ ID NO: 120424 - DNA, 22 bp, Artificial Sequence
  chemically synthesized
cttcaatgagccctacaacaag

SEQ ID NO: 120425 - DNA, 22 bp, Artificial Sequence
  chemically synthesized
caatgagccctacaacaagtag

SEQ ID NO: 120426 - DNA, 22 bp, Artificial Sequence
  chemically synthesized
aatgagccctacaacaagtagc

SEQ ID NO: 120427 - DNA, 22 bp, Artificial Sequence
  chemically synthesized
caacaagtagcctttacaaaac

SEQ ID NO: 120428 - DNA, 22 bp, Artificial Sequence
  chemically synthesized
tacaaaacttttttccttcttt

SEQ ID NO: 120429 - DNA, 22 bp, Artificial Sequence
  chemically synthesized
acaaaacttttttccttctttt

SEQ ID NO: 120430 - DNA, 22 bp, Artificial Sequence
  chemically synthesized
caaaacttttttccttcttttc

SEQ ID NO: 120431 - DNA, 22 bp, Artificial Sequence
  chemically synthesized
ttttccttcttttctggtagca

SEQ ID NO: 120432 - DNA, 22 bp, Artificial Sequence
  chemically synthesized
tttccttcttttctggtagcaa

SEQ ID NO: 120433 - DNA, 22 bp, Artificial Sequence
  chemically synthesized
ttccttcttttctggtagcaaa

SEQ ID NO: 120434 - DNA, 22 bp, Artificial Sequence
  chemically synthesized
tccttcttttctggtagcaaat

SEQ ID NO: 120435 - DNA, 22 bp, Artificial Sequence
  chemically synthesized
ccttcttttctggtagcaaatg

SEQ ID NO: 120436 - DNA, 22 bp, Artificial Sequence
  chemically synthesized
cttcttttctggtagcaaatgc

SEQ ID NO: 120437 - DNA, 22 bp, Artificial Sequence
  chemically synthesized
cttttctggtagcaaatgccat

SEQ ID NO: 120438 - DNA, 22 bp, Artificial Sequence
  chemically synthesized
ttttctggtagcaaatgccatc

SEQ ID NO: 120439 - DNA, 22 bp, Artificial Sequence
  chemically synthesized
ttctggtagcaaatgccatcaa

SEQ ID NO: 120440 - DNA, 22 bp, Artificial Sequence
  chemically synthesized
tctggtagcaaatgccatcaac

SEQ ID NO: 120441 - DNA, 22 bp, Artificial Sequence
  chemically synthesized
ctggtagcaaatgccatcaaca

SEQ ID NO: 120442 - DNA, 22 bp, Artificial Sequence
  chemically synthesized
tggtagcaaatgccatcaacat

SEQ ID NO: 120443 - DNA, 22 bp, Artificial Sequence
  chemically synthesized
gtagcaaatgccatcaacattt

SEQ ID NO: 120444 - DNA, 22 bp, Artificial Sequence
  chemically synthesized
agaaaaaaaaaaatagtcttgt

SEQ ID NO: 120445 - DNA, 22 bp, Artificial Sequence
  chemically synthesized
gaaaaaaaaaaatagtcttgta

SEQ ID NO: 120446 - DNA, 22 bp, Artificial Sequence
  chemically synthesized
gtacttcttccccagactatgc

SEQ ID NO: 120447 - DNA, 22 bp, Artificial Sequence
  chemically synthesized
tacttcttccccagactatgct

SEQ ID NO: 120448 - DNA, 22 bp, Artificial Sequence
  chemically synthesized
cttccccagactatgctacaga

SEQ ID NO: 120449 - DNA, 22 bp, Artificial Sequence
  chemically synthesized
ttccccagactatgctacagaa

SEQ ID NO: 120450 - DNA, 22 bp, Artificial Sequence
  chemically synthesized
ccccagactatgctacagaacc

SEQ ID NO: 120451 - DNA, 22 bp, Artificial Sequence
  chemically synthesized
cccagactatgctacagaacct

SEQ ID NO: 120452 - DNA, 22 bp, Artificial Sequence
  chemically synthesized
tgctacagaacctgagttaatg

SEQ ID NO: 120453 - DNA, 22 bp, Artificial Sequence
  chemically synthesized
cagaacctgagttaatgtgatc

SEQ ID NO: 120454 - DNA, 22 bp, Artificial Sequence
  chemically synthesized
agttaatgtgatcaggtcatgt

SEQ ID NO: 120455 - DNA, 22 bp, Artificial Sequence
  chemically synthesized
atgtgatcaggtcatgtgtaca

SEQ ID NO: 120456 - DNA, 22 bp, Artificial Sequence
  chemically synthesized
ctcttttctttcaaaactcaca

SEQ ID NO: 120457 - DNA, 22 bp, Artificial Sequence
  chemically synthesized
tcttttctttcaaaactcacac

SEQ ID NO: 120458 - DNA, 22 bp, Artificial Sequence
  chemically synthesized
ttttctttcaaaactcacacac

SEQ ID NO: 120459 - DNA, 22 bp, Artificial Sequence
  chemically synthesized
ttctttcaaaactcacacacaa

SEQ ID NO: 120460 - DNA, 22 bp, Artificial Sequence
  chemically synthesized
tctttcaaaactcacacacaac

SEQ ID NO: 120461 - DNA, 22 bp, Artificial Sequence
  chemically synthesized
ctttcaaaactcacacacaacc

SEQ ID NO: 120462 - DNA, 22 bp, Artificial Sequence
  chemically synthesized
tttcaaaactcacacacaacct

SEQ ID NO: 120463 - DNA, 22 bp, Artificial Sequence
  chemically synthesized
tcaaaactcacacacaacctct

SEQ ID NO: 120464 - DNA, 22 bp, Artificial Sequence
  chemically synthesized
caaaactcacacacaacctctc

SEQ ID NO: 120465 - DNA, 22 bp, Artificial Sequence
  chemically synthesized
aaaactcacacacaacctctcc

SEQ ID NO: 120466 - DNA, 22 bp, Artificial Sequence
  chemically synthesized
acacacaacctctccaccacaa

SEQ ID NO: 120467 - DNA, 22 bp, Artificial Sequence
  chemically synthesized
tccaccacaaacacacacacac

SEQ ID NO: 120468 - DNA, 22 bp, Artificial Sequence
  chemically synthesized
caccacaaacacacacacactc

SEQ ID NO: 120469 - DNA, 22 bp, Artificial Sequence
  chemically synthesized
ttggagactggcatgaagcaag

SEQ ID NO: 120470 - DNA, 22 bp, Artificial Sequence
  chemically synthesized
ggagactggcatgaagcaaggt

SEQ ID NO: 120471 - DNA, 22 bp, Artificial Sequence
  chemically synthesized
gagactggcatgaagcaaggta

SEQ ID NO: 120472 - DNA, 22 bp, Artificial Sequence
  chemically synthesized
gcatgaagcaaggtattacatc

SEQ ID NO: 120473 - DNA, 22 bp, Artificial Sequence
  chemically synthesized
catcctttaaatagggcatggt

SEQ ID NO: 120474 - DNA, 22 bp, Artificial Sequence
  chemically synthesized
taaatagggcatggttgattag

SEQ ID NO: 120475 - DNA, 22 bp, Artificial Sequence
  chemically synthesized
aaatagggcatggttgattaga

SEQ ID NO: 120476 - DNA, 22 bp, Artificial Sequence
  chemically synthesized
aatagggcatggttgattagag

SEQ ID NO: 120477 - DNA, 22 bp, Artificial Sequence
  chemically synthesized
attagagttgtgtggggatgag

SEQ ID NO: 120478 - DNA, 22 bp, Artificial Sequence
  chemically synthesized
gagttgtgtggggatgagctcc

SEQ ID NO: 120479 - DNA, 22 bp, Artificial Sequence
  chemically synthesized
tgtggggatgagctccaaaacg

SEQ ID NO: 120480 - DNA, 22 bp, Artificial Sequence
  chemically synthesized
caaaacggggcatacagatcta

SEQ ID NO: 120481 - DNA, 22 bp, Artificial Sequence
  chemically synthesized
aaaccaggacagagacccatga

SEQ ID NO: 120482 - DNA, 22 bp, Artificial Sequence
  chemically synthesized
atgacatgccattgtgatcaga

SEQ ID NO: 120483 - DNA, 22 bp, Artificial Sequence
  chemically synthesized
tgacatgccattgtgatcagac

SEQ ID NO: 120484 - DNA, 22 bp, Artificial Sequence
  chemically synthesized
tgatcagaccacacccagacag

SEQ ID NO: 120485 - DNA, 22 bp, Artificial Sequence
  chemically synthesized
acaccgggtaagtaactggttg

SEQ ID NO: 120486 - DNA, 22 bp, Artificial Sequence
  chemically synthesized
caccgggtaagtaactggttgt

SEQ ID NO: 120487 - DNA, 22 bp, Artificial Sequence
  chemically synthesized
gttgttagggccagagtgtagg

SEQ ID NO: 120488 - DNA, 22 bp, Artificial Sequence
  chemically synthesized
ttagggccagagtgtaggagag

SEQ ID NO: 120489 - DNA, 22 bp, Artificial Sequence
  chemically synthesized
gggccagagtgtaggagagtca

SEQ ID NO: 120490 - DNA, 22 bp, Artificial Sequence
  chemically synthesized
attaaattgtagttatgaggaa

SEQ ID NO: 120491 - DNA, 22 bp, Artificial Sequence
  chemically synthesized
ttaaattgtagttatgaggaag

SEQ ID NO: 120492 - DNA, 22 bp, Artificial Sequence
  chemically synthesized
aattgtagttatgaggaaggtt

SEQ ID NO: 120493 - DNA, 22 bp, Artificial Sequence
  chemically synthesized
tagttatgaggaaggttctggc

SEQ ID NO: 120494 - DNA, 22 bp, Artificial Sequence
  chemically synthesized
tgaggaaggttctggcttcggt

SEQ ID NO: 120495 - DNA, 22 bp, Artificial Sequence
  chemically synthesized
tggcttcggtacaataggaagg

SEQ ID NO: 120496 - DNA, 22 bp, Artificial Sequence
  chemically synthesized
gcttcggtacaataggaaggag

SEQ ID NO: 120497 - DNA, 22 bp, Artificial Sequence
  chemically synthesized
cggtacaataggaaggagctga

SEQ ID NO: 120498 - DNA, 22 bp, Artificial Sequence
  chemically synthesized
ggtacaataggaaggagctgag

SEQ ID NO: 120499 - DNA, 22 bp, Artificial Sequence
  chemically synthesized
agcatcttcatttaggcttgta

SEQ ID NO: 120500 - DNA, 22 bp, Artificial Sequence
  chemically synthesized
catttaggcttgtaggagaggg

SEQ ID NO: 120501 - DNA, 22 bp, Artificial Sequence
  chemically synthesized
atttaggcttgtaggagagggc

SEQ ID NO: 120502 - DNA, 22 bp, Artificial Sequence
  chemically synthesized
aggcttgtaggagagggcacca

SEQ ID NO: 120503 - DNA, 22 bp, Artificial Sequence
  chemically synthesized
ggcttgtaggagagggcaccac

SEQ ID NO: 120504 - DNA, 22 bp, Artificial Sequence
  chemically synthesized
gtaggagagggcaccactacca

SEQ ID NO: 120505 - DNA, 22 bp, Artificial Sequence
  chemically synthesized
taggagagggcaccactaccag

SEQ ID NO: 120506 - DNA, 22 bp, Artificial Sequence
  chemically synthesized
ccagaaaaatttcagaaaatcc

SEQ ID NO: 120507 - DNA, 22 bp, Artificial Sequence
  chemically synthesized
cagaaaatcctgcatttattaa

SEQ ID NO: 120508 - DNA, 22 bp, Artificial Sequence
  chemically synthesized
agaaaatcctgcatttattaag

SEQ ID NO: 120509 - DNA, 22 bp, Artificial Sequence
  chemically synthesized
catttattaagaacatgatttt

SEQ ID NO: 120510 - DNA, 22 bp, Artificial Sequence
  chemically synthesized
attaagaacatgattttagcct

SEQ ID NO: 120511 - DNA, 22 bp, Artificial Sequence
  chemically synthesized
ttaagaacatgattttagccta

SEQ ID NO: 120512 - DNA, 22 bp, Artificial Sequence
  chemically synthesized
agaacatgattttagcctattt

SEQ ID NO: 120513 - DNA, 22 bp, Artificial Sequence
  chemically synthesized
tagcctatttcactgggatcct

SEQ ID NO: 120514 - DNA, 22 bp, Artificial Sequence
  chemically synthesized
agcctatttcactgggatccta

SEQ ID NO: 120515 - DNA, 22 bp, Artificial Sequence
  chemically synthesized
gcctatttcactgggatcctag

SEQ ID NO: 120516 - DNA, 22 bp, Artificial Sequence
  chemically synthesized
tttcactgggatcctagccaag

SEQ ID NO: 120517 - DNA, 22 bp, Artificial Sequence
  chemically synthesized
cactgggatcctagccaaggac

SEQ ID NO: 120518 - DNA, 22 bp, Artificial Sequence
  chemically synthesized
actgggatcctagccaaggaca

SEQ ID NO: 120519 - DNA, 22 bp, Artificial Sequence
  chemically synthesized
ggatcctagccaaggacagtat

SEQ ID NO: 120520 - DNA, 22 bp, Artificial Sequence
  chemically synthesized
gccaaggacagtataacagcaa

SEQ ID NO: 120521 - DNA, 22 bp, Artificial Sequence
  chemically synthesized
ctattattaccagcaacagcaa

SEQ ID NO: 120522 - DNA, 22 bp, Artificial Sequence
  chemically synthesized
ttattaccagcaacagcaaata

SEQ ID NO: 120523 - DNA, 22 bp, Artificial Sequence
  chemically synthesized
ttaccagcaacagcaaatattg

SEQ ID NO: 120524 - DNA, 22 bp, Artificial Sequence
  chemically synthesized
ccagcaacagcaaatattgcta

SEQ ID NO: 120525 - DNA, 22 bp, Artificial Sequence
  chemically synthesized
ctattattcaggggcatctatc

SEQ ID NO: 120526 - DNA, 22 bp, Artificial Sequence
  chemically synthesized
ttattcaggggcatctatcaca

SEQ ID NO: 120527 - DNA, 22 bp, Artificial Sequence
  chemically synthesized
ttcaggggcatctatcacacat

SEQ ID NO: 120528 - DNA, 22 bp, Artificial Sequence
  chemically synthesized
aggggcatctatcacacataag

SEQ ID NO: 120529 - DNA, 22 bp, Artificial Sequence
  chemically synthesized
tcacacataagataggaaaaca

SEQ ID NO: 120530 - DNA, 22 bp, Artificial Sequence
  chemically synthesized
tcttagcgcaatgtaagagatg

SEQ ID NO: 120531 - DNA, 22 bp, Artificial Sequence
  chemically synthesized
agcgcaatgtaagagatggaca

SEQ ID NO: 120532 - DNA, 22 bp, Artificial Sequence
  chemically synthesized
gcgcaatgtaagagatggacat

SEQ ID NO: 120533 - DNA, 22 bp, Artificial Sequence
  chemically synthesized
tattaatatttgtgggtagcac

SEQ ID NO: 120534 - DNA, 22 bp, Artificial Sequence
  chemically synthesized
atatttgtgggtagcacctggc

SEQ ID NO: 120535 - DNA, 22 bp, Artificial Sequence
  chemically synthesized
gtgggtagcacctggcccacag

SEQ ID NO: 120536 - DNA, 22 bp, Artificial Sequence
  chemically synthesized
tgggtagcacctggcccacagg

SEQ ID NO: 120537 - DNA, 22 bp, Artificial Sequence
  chemically synthesized
gcccacaggtgagggccaggga

SEQ ID NO: 120538 - DNA, 22 bp, Artificial Sequence
  chemically synthesized
agctatgaagactaattaagaa

SEQ ID NO: 120539 - DNA, 22 bp, Artificial Sequence
  chemically synthesized
tgaagactaattaagaatcaac

SEQ ID NO: 120540 - DNA, 22 bp, Artificial Sequence
  chemically synthesized
attaagaatcaaccacagatag

SEQ ID NO: 120541 - DNA, 22 bp, Artificial Sequence
  chemically synthesized
agaatcaaccacagatagggct

SEQ ID NO: 120542 - DNA, 22 bp, Artificial Sequence
  chemically synthesized
tatagaaaggtatttccaaaaa

SEQ ID NO: 120543 - DNA, 22 bp, Artificial Sequence
  chemically synthesized
atagaaaggtatttccaaaaag

SEQ ID NO: 120544 - DNA, 22 bp, Artificial Sequence
  chemically synthesized
tagaaaggtatttccaaaaagg

SEQ ID NO: 120545 - DNA, 22 bp, Artificial Sequence
  chemically synthesized
ccaaaaaggaggggtagtgtaa

SEQ ID NO: 120546 - DNA, 22 bp, Artificial Sequence
  chemically synthesized
caaaaaggaggggtagtgtaag

SEQ ID NO: 120547 - DNA, 22 bp, Artificial Sequence
  chemically synthesized
tttatgtgttttgagaactata

SEQ ID NO: 120548 - DNA, 22 bp, Artificial Sequence
  chemically synthesized
atgtgttttgagaactataaga

SEQ ID NO: 120549 - DNA, 22 bp, Artificial Sequence
  chemically synthesized
tgtgttttgagaactataagat

SEQ ID NO: 120550 - DNA, 22 bp, Artificial Sequence
  chemically synthesized
tgagaactataagattttccgg

SEQ ID NO: 120551 - DNA, 22 bp, Artificial Sequence
  chemically synthesized
gagaactataagattttccggt

SEQ ID NO: 120552 - DNA, 22 bp, Artificial Sequence
  chemically synthesized
agaactataagattttccggtg

SEQ ID NO: 120553 - DNA, 22 bp, Artificial Sequence
  chemically synthesized
taagattttccggtgatcaaat

SEQ ID NO: 120554 - DNA, 22 bp, Artificial Sequence
  chemically synthesized
tccggtgatcaaatataacatt

SEQ ID NO: 120555 - DNA, 22 bp, Artificial Sequence
  chemically synthesized
ccggtgatcaaatataacattt

SEQ ID NO: 120556 - DNA, 22 bp, Artificial Sequence
  chemically synthesized
cggtgatcaaatataacattta

SEQ ID NO: 120557 - DNA, 22 bp, Artificial Sequence
  chemically synthesized
aagagagttaataccttggaat

SEQ ID NO: 120558 - DNA, 22 bp, Artificial Sequence
  chemically synthesized
agagagttaataccttggaata

SEQ ID NO: 120559 - DNA, 22 bp, Artificial Sequence
  chemically synthesized
ataccttggaataaaacagtag

SEQ ID NO: 120560 - DNA, 22 bp, Artificial Sequence
  chemically synthesized
ggaataaaacagtagaggtagg

SEQ ID NO: 120561 - DNA, 22 bp, Artificial Sequence
  chemically synthesized
gaataaaacagtagaggtaggc

SEQ ID NO: 120562 - DNA, 22 bp, Artificial Sequence
  chemically synthesized
aatgagtttatatgacatgtca

SEQ ID NO: 120563 - DNA, 22 bp, Artificial Sequence
  chemically synthesized
atatgacatgtcaaacatggta

SEQ ID NO: 120564 - DNA, 22 bp, Artificial Sequence
  chemically synthesized
tatgacatgtcaaacatggtac

SEQ ID NO: 120565 - DNA, 22 bp, Artificial Sequence
  chemically synthesized
tgatggttgggtttaaaaaggc

SEQ ID NO: 120566 - DNA, 22 bp, Artificial Sequence
  chemically synthesized
gatggttgggtttaaaaaggca

SEQ ID NO: 120567 - DNA, 22 bp, Artificial Sequence
  chemically synthesized
atggttgggtttaaaaaggcag

SEQ ID NO: 120568 - DNA, 22 bp, Artificial Sequence
  chemically synthesized
ggtttaaaaaggcaggagataa

SEQ ID NO: 120569 - DNA, 22 bp, Artificial Sequence
  chemically synthesized
aaaaaggcaggagataacaatc

SEQ ID NO: 120570 - DNA, 22 bp, Artificial Sequence
  chemically synthesized
aaaaggcaggagataacaatca

SEQ ID NO: 120571 - DNA, 22 bp, Artificial Sequence
  chemically synthesized
tccagagtacattgttaacaat

SEQ ID NO: 120572 - DNA, 22 bp, Artificial Sequence
  chemically synthesized
ccagagtacattgttaacaata

SEQ ID NO: 120573 - DNA, 22 bp, Artificial Sequence
  chemically synthesized
cagagtacattgttaacaatat

SEQ ID NO: 120574 - DNA, 22 bp, Artificial Sequence
  chemically synthesized
ttaacaatatgcaggaaggatt

SEQ ID NO: 120575 - DNA, 22 bp, Artificial Sequence
  chemically synthesized
acaatatgcaggaaggatttaa

SEQ ID NO: 120576 - DNA, 22 bp, Artificial Sequence
  chemically synthesized
aaagtctgcactggaaacagat

SEQ ID NO: 120577 - DNA, 22 bp, Artificial Sequence
  chemically synthesized
aagtctgcactggaaacagatg

SEQ ID NO: 120578 - DNA, 22 bp, Artificial Sequence
  chemically synthesized
cactggaaacagatgttatttt

SEQ ID NO: 120579 - DNA, 22 bp, Artificial Sequence
  chemically synthesized
gaaacagatgttattttggtgt

SEQ ID NO: 120580 - DNA, 22 bp, Artificial Sequence
  chemically synthesized
ttttggtgtatggagctggatg

SEQ ID NO: 120581 - DNA, 22 bp, Artificial Sequence
  chemically synthesized
tggtgtatggagctggatgcag

SEQ ID NO: 120582 - DNA, 22 bp, Artificial Sequence
  chemically synthesized
ggtgtatggagctggatgcaga

SEQ ID NO: 120583 - DNA, 22 bp, Artificial Sequence
  chemically synthesized
gtgtatggagctggatgcagat

SEQ ID NO: 120584 - DNA, 22 bp, Artificial Sequence
  chemically synthesized
gatgcagatatgtaattgacag

SEQ ID NO: 120585 - DNA, 22 bp, Artificial Sequence
  chemically synthesized
acagctttttacgtagataaac

SEQ ID NO: 120586 - DNA, 22 bp, Artificial Sequence
  chemically synthesized
tttacgtagataaacaatactg

SEQ ID NO: 120587 - DNA, 22 bp, Artificial Sequence
  chemically synthesized
ttacgtagataaacaatactgt

SEQ ID NO: 120588 - DNA, 22 bp, Artificial Sequence
  chemically synthesized
tacgtagataaacaatactgtt

SEQ ID NO: 120589 - DNA, 22 bp, Artificial Sequence
  chemically synthesized
acgtagataaacaatactgttt

SEQ ID NO: 120590 - DNA, 22 bp, Artificial Sequence
  chemically synthesized
cgtagataaacaatactgttta

SEQ ID NO: 120591 - DNA, 22 bp, Artificial Sequence
  chemically synthesized
tttagtggataacctaccattt

SEQ ID NO: 120592 - DNA, 22 bp, Artificial Sequence
  chemically synthesized
agtggataacctaccatttaga

SEQ ID NO: 120593 - DNA, 22 bp, Artificial Sequence
  chemically synthesized
gtggataacctaccatttagag

SEQ ID NO: 120594 - DNA, 22 bp, Artificial Sequence
  chemically synthesized
ccatttagagatctctaatatt

SEQ ID NO: 120595 - DNA, 22 bp, Artificial Sequence
  chemically synthesized
agagatctctaatatttgctta

SEQ ID NO: 120596 - DNA, 22 bp, Artificial Sequence
  chemically synthesized
gagatctctaatatttgcttac

SEQ ID NO: 120597 - DNA, 22 bp, Artificial Sequence
  chemically synthesized
taatatttgcttacttttttaa

SEQ ID NO: 120598 - DNA, 22 bp, Artificial Sequence
  chemically synthesized
atatttgcttacttttttaaac

SEQ ID NO: 120599 - DNA, 22 bp, Artificial Sequence
  chemically synthesized
gcttacttttttaaactaacat

SEQ ID NO: 120600 - DNA, 22 bp, Artificial Sequence
  chemically synthesized
cttacttttttaaactaacatc

SEQ ID NO: 120601 - DNA, 22 bp, Artificial Sequence
  chemically synthesized
acttttttaaactaacatctgt

SEQ ID NO: 120602 - DNA, 22 bp, Artificial Sequence
  chemically synthesized
cttttttaaactaacatctgta

SEQ ID NO: 120603 - DNA, 22 bp, Artificial Sequence
  chemically synthesized
ttttaaactaacatctgtataa

SEQ ID NO: 120604 - DNA, 22 bp, Artificial Sequence
  chemically synthesized
tttaaactaacatctgtataat

SEQ ID NO: 120605 - DNA, 22 bp, Artificial Sequence
  chemically synthesized
ttaaactaacatctgtataata

SEQ ID NO: 120606 - DNA, 22 bp, Artificial Sequence
  chemically synthesized
taaactaacatctgtataatag

SEQ ID NO: 120607 - DNA, 22 bp, Artificial Sequence
  chemically synthesized
aaactaacatctgtataatagc

SEQ ID NO: 120608 - DNA, 22 bp, Artificial Sequence
  chemically synthesized
aactaacatctgtataatagct

SEQ ID NO: 120609 - DNA, 22 bp, Artificial Sequence
  chemically synthesized
acatctgtataatagctttata

SEQ ID NO: 120610 - DNA, 22 bp, Artificial Sequence
  chemically synthesized
tataatagctttatattctatt

SEQ ID NO: 120611 - DNA, 22 bp, Artificial Sequence
  chemically synthesized
tatattctatttctctgaatta

SEQ ID NO: 120612 - DNA, 22 bp, Artificial Sequence
  chemically synthesized
atattctatttctctgaattat

SEQ ID NO: 120613 - DNA, 22 bp, Artificial Sequence
  chemically synthesized
tattctatttctctgaattata

SEQ ID NO: 120614 - DNA, 22 bp, Artificial Sequence
  chemically synthesized
tatttctctgaattatataatt

SEQ ID NO: 120615 - DNA, 22 bp, Artificial Sequence
  chemically synthesized
tttctctgaattatataattga

SEQ ID NO: 120616 - DNA, 22 bp, Artificial Sequence
  chemically synthesized
ctctgaattatataattgaagg

SEQ ID NO: 120617 - DNA, 22 bp, Artificial Sequence
  chemically synthesized
tctgaattatataattgaagga

SEQ ID NO: 120618 - DNA, 22 bp, Artificial Sequence
  chemically synthesized
tgaattatataattgaaggacc

SEQ ID NO: 120619 - DNA, 22 bp, Artificial Sequence
  chemically synthesized
aattatataattgaaggaccag

SEQ ID NO: 120620 - DNA, 22 bp, Artificial Sequence
  chemically synthesized
tataattgaaggaccagtttcc

SEQ ID NO: 120621 - DNA, 22 bp, Artificial Sequence
  chemically synthesized
aaggaccagtttccaagcaata

SEQ ID NO: 120622 - DNA, 22 bp, Artificial Sequence
  chemically synthesized
ccaagcaatagatttatttgaa

SEQ ID NO: 120623 - DNA, 22 bp, Artificial Sequence
  chemically synthesized
caagcaatagatttatttgaaa

SEQ ID NO: 120624 - DNA, 22 bp, Artificial Sequence
  chemically synthesized
atttgaaaaccaaatgaaagaa

SEQ ID NO: 120625 - DNA, 22 bp, Artificial Sequence
  chemically synthesized
tttgaaaaccaaatgaaagaac

SEQ ID NO: 120626 - DNA, 22 bp, Artificial Sequence
  chemically synthesized
gaaaaccaaatgaaagaactca

SEQ ID NO: 120627 - DNA, 22 bp, Artificial Sequence
  chemically synthesized
aaaaccaaatgaaagaactcag

SEQ ID NO: 120628 - DNA, 22 bp, Artificial Sequence
  chemically synthesized
agcatttttgattctttattgc

SEQ ID NO: 120629 - DNA, 22 bp, Artificial Sequence
  chemically synthesized
ttgattctttattgctctaaat

SEQ ID NO: 120630 - DNA, 22 bp, Artificial Sequence
  chemically synthesized
tgattctttattgctctaaatg

SEQ ID NO: 120631 - DNA, 22 bp, Artificial Sequence
  chemically synthesized
gattctttattgctctaaatga

SEQ ID NO: 120632 - DNA, 22 bp, Artificial Sequence
  chemically synthesized
attctttattgctctaaatgac

SEQ ID NO: 120633 - DNA, 22 bp, Artificial Sequence
  chemically synthesized
tttattgctctaaatgaccttt

SEQ ID NO: 120634 - DNA, 22 bp, Artificial Sequence
  chemically synthesized
tattgctctaaatgacctttag

SEQ ID NO: 120635 - DNA, 22 bp, Artificial Sequence
  chemically synthesized
attgctctaaatgacctttaga

SEQ ID NO: 120636 - DNA, 22 bp, Artificial Sequence
  chemically synthesized
ttgctctaaatgacctttagat

SEQ ID NO: 120637 - DNA, 22 bp, Artificial Sequence
  chemically synthesized
ctctaaatgacctttagatttg

SEQ ID NO: 120638 - DNA, 22 bp, Artificial Sequence
  chemically synthesized
taaatgacctttagatttgttt

SEQ ID NO: 120639 - DNA, 22 bp, Artificial Sequence
  chemically synthesized
aatgacctttagatttgtttta

SEQ ID NO: 120640 - DNA, 22 bp, Artificial Sequence
  chemically synthesized
tagatttgttttatcatatcac

SEQ ID NO: 120641 - DNA, 22 bp, Artificial Sequence
  chemically synthesized
agatttgttttatcatatcaca

SEQ ID NO: 120642 - DNA, 22 bp, Artificial Sequence
  chemically synthesized
gatttgttttatcatatcacaa

SEQ ID NO: 120643 - DNA, 22 bp, Artificial Sequence
  chemically synthesized
gttttatcatatcacaaaatag

SEQ ID NO: 120644 - DNA, 22 bp, Artificial Sequence
  chemically synthesized
ttttatcatatcacaaaatagt

SEQ ID NO: 120645 - DNA, 22 bp, Artificial Sequence
  chemically synthesized
tatcatatcacaaaatagtcct

SEQ ID NO: 120646 - DNA, 22 bp, Artificial Sequence
  chemically synthesized
atcatatcacaaaatagtcctc

SEQ ID NO: 120647 - DNA, 22 bp, Artificial Sequence
  chemically synthesized
tcatatcacaaaatagtcctct

SEQ ID NO: 120648 - DNA, 22 bp, Artificial Sequence
  chemically synthesized
tttgaagtgtgactgaaattac

SEQ ID NO: 120649 - DNA, 22 bp, Artificial Sequence
  chemically synthesized
tgaagtgtgactgaaattacat

SEQ ID NO: 120650 - DNA, 22 bp, Artificial Sequence
  chemically synthesized
gaagtgtgactgaaattacatt

SEQ ID NO: 120651 - DNA, 22 bp, Artificial Sequence
  chemically synthesized
aagtgtgactgaaattacatta

SEQ ID NO: 120652 - DNA, 22 bp, Artificial Sequence
  chemically synthesized
aaattacattaaacattctcat

SEQ ID NO: 120653 - DNA, 22 bp, Artificial Sequence
  chemically synthesized
cattaaacattctcatcaattt

SEQ ID NO: 120654 - DNA, 22 bp, Artificial Sequence
  chemically synthesized
aacattctcatcaattttcatt

SEQ ID NO: 120655 - DNA, 22 bp, Artificial Sequence
  chemically synthesized
tcatcaattttcattgacgtgc

SEQ ID NO: 120656 - DNA, 22 bp, Artificial Sequence
  chemically synthesized
atcaattttcattgacgtgcat

SEQ ID NO: 120657 - DNA, 22 bp, Artificial Sequence
  chemically synthesized
tcattgacgtgcattaagtgcg

SEQ ID NO: 120658 - DNA, 22 bp, Artificial Sequence
  chemically synthesized
cattgacgtgcattaagtgcgt

SEQ ID NO: 120659 - DNA, 22 bp, Artificial Sequence
  chemically synthesized
attgacgtgcattaagtgcgtc

SEQ ID NO: 120660 - DNA, 22 bp, Artificial Sequence
  chemically synthesized
acgtgcattaagtgcgtcctgt

SEQ ID NO: 120661 - DNA, 22 bp, Artificial Sequence
  chemically synthesized
agtgcgtcctgtgagaaactct

SEQ ID NO: 120662 - DNA, 22 bp, Artificial Sequence
  chemically synthesized
tgagaaactctgatcaagaact

SEQ ID NO: 120663 - DNA, 22 bp, Artificial Sequence
  chemically synthesized
tgatcaagaacttgaagataga

SEQ ID NO: 120664 - DNA, 22 bp, Artificial Sequence
  chemically synthesized
atcaagaacttgaagatagaca

SEQ ID NO: 120665 - DNA, 22 bp, Artificial Sequence
  chemically synthesized
gaagatagacagattaacatgt

SEQ ID NO: 120666 - DNA, 22 bp, Artificial Sequence
  chemically synthesized
aagatagacagattaacatgtc

SEQ ID NO: 120667 - DNA, 22 bp, Artificial Sequence
  chemically synthesized
acatgtcatggtcttgccttta

SEQ ID NO: 120668 - DNA, 22 bp, Artificial Sequence
  chemically synthesized
gcctttatgaagctcacattga

SEQ ID NO: 120669 - DNA, 22 bp, Artificial Sequence
  chemically synthesized
cctttatgaagctcacattgag

SEQ ID NO: 120670 - DNA, 22 bp, Artificial Sequence
  chemically synthesized
tatgaagctcacattgagtaaa

SEQ ID NO: 120671 - DNA, 22 bp, Artificial Sequence
  chemically synthesized
atgaagctcacattgagtaaag

SEQ ID NO: 120672 - DNA, 22 bp, Artificial Sequence
  chemically synthesized
tgaagctcacattgagtaaaga

SEQ ID NO: 120673 - DNA, 22 bp, Artificial Sequence
  chemically synthesized
acattgagtaaagatgttagat

SEQ ID NO: 120674 - DNA, 22 bp, Artificial Sequence
  chemically synthesized
agtaaagatgttagattgttca

SEQ ID NO: 120675 - DNA, 22 bp, Artificial Sequence
  chemically synthesized
gattgttcaacgaagtttccaa

SEQ ID NO: 120676 - DNA, 22 bp, Artificial Sequence
  chemically synthesized
ttcaacgaagtttccaaaatag

SEQ ID NO: 120677 - DNA, 22 bp, Artificial Sequence
  chemically synthesized
aacgaagtttccaaaatagggt

SEQ ID NO: 120678 - DNA, 22 bp, Artificial Sequence
  chemically synthesized
ccaaaatagggtcactagccca

SEQ ID NO: 120679 - DNA, 22 bp, Artificial Sequence
  chemically synthesized
caaaatagggtcactagcccag

SEQ ID NO: 120680 - DNA, 22 bp, Artificial Sequence
  chemically synthesized
gcccaggctaggaaggcagagg

SEQ ID NO: 120681 - DNA, 22 bp, Artificial Sequence
  chemically synthesized
ggaaggcagaggtagtttctga

SEQ ID NO: 120682 - DNA, 22 bp, Artificial Sequence
  chemically synthesized
ctgaagcctggaggccaagagg

SEQ ID NO: 120683 - DNA, 22 bp, Artificial Sequence
  chemically synthesized
tgaagcctggaggccaagagga

SEQ ID NO: 120684 - DNA, 22 bp, Artificial Sequence
  chemically synthesized
aagcctggaggccaagaggagg

SEQ ID NO: 120685 - DNA, 22 bp, Artificial Sequence
  chemically synthesized
gaggccaagaggaggatgatgg

SEQ ID NO: 120686 - DNA, 22 bp, Artificial Sequence
  chemically synthesized
ggacctatctctatcactgtgg

SEQ ID NO: 120687 - DNA, 22 bp, Artificial Sequence
  chemically synthesized
tctctatcactgtgggtaatca

SEQ ID NO: 120688 - DNA, 22 bp, Artificial Sequence
  chemically synthesized
tatcactgtgggtaatcatgcg

SEQ ID NO: 120689 - DNA, 22 bp, Artificial Sequence
  chemically synthesized
tcactgtgggtaatcatgcgaa

SEQ ID NO: 120690 - DNA, 22 bp, Artificial Sequence
  chemically synthesized
tgggtaatcatgcgaatattag

SEQ ID NO: 120691 - DNA, 22 bp, Artificial Sequence
  chemically synthesized
ggtgaagtgaatgtgggtgcat

SEQ ID NO: 120692 - DNA, 22 bp, Artificial Sequence
  chemically synthesized
gggaaggtgaagtatcaacaca

SEQ ID NO: 120693 - DNA, 22 bp, Artificial Sequence
  chemically synthesized
gtgtgaggcattcaggccttaa

SEQ ID NO: 120694 - DNA, 22 bp, Artificial Sequence
  chemically synthesized
aggccttaacctttaaggtatt

SEQ ID NO: 120695 - DNA, 22 bp, Artificial Sequence
  chemically synthesized
aacctttaaggtattagaattc

SEQ ID NO: 120696 - DNA, 22 bp, Artificial Sequence
  chemically synthesized
acctttaaggtattagaattca

SEQ ID NO: 120697 - DNA, 22 bp, Artificial Sequence
  chemically synthesized
taaggtattagaattcattatt

SEQ ID NO: 120698 - DNA, 22 bp, Artificial Sequence
  chemically synthesized
aaggtattagaattcattatta

SEQ ID NO: 120699 - DNA, 22 bp, Artificial Sequence
  chemically synthesized
aggtattagaattcattattaa

SEQ ID NO: 120700 - DNA, 22 bp, Artificial Sequence
  chemically synthesized
gaattcattattaaagaatcta

SEQ ID NO: 120701 - DNA, 22 bp, Artificial Sequence
  chemically synthesized
attattaaagaatctaaatcca

SEQ ID NO: 120702 - DNA, 22 bp, Artificial Sequence
  chemically synthesized
ttaaagaatctaaatccattac

SEQ ID NO: 120703 - DNA, 22 bp, Artificial Sequence
  chemically synthesized
aagaatctaaatccattactaa

SEQ ID NO: 120704 - DNA, 22 bp, Artificial Sequence
  chemically synthesized
aatccattactaaaagtgaaaa

SEQ ID NO: 120705 - DNA, 22 bp, Artificial Sequence
  chemically synthesized
ctaaaagtgaaaagtgtcactg

SEQ ID NO: 120706 - DNA, 22 bp, Artificial Sequence
  chemically synthesized
aaagtgaaaagtgtcactgtaa

SEQ ID NO: 120707 - DNA, 22 bp, Artificial Sequence
  chemically synthesized
taacagtgtacctatttgttaa

SEQ ID NO: 120708 - DNA, 22 bp, Artificial Sequence
  chemically synthesized
tttgttaatgtgcaaatggttt

SEQ ID NO: 120709 - DNA, 22 bp, Artificial Sequence
  chemically synthesized
gttaatgtgcaaatggttttca

SEQ ID NO: 120710 - DNA, 22 bp, Artificial Sequence
  chemically synthesized
ttaatgtgcaaatggttttcat

SEQ ID NO: 120711 - DNA, 22 bp, Artificial Sequence
  chemically synthesized
atgtgcaaatggttttcattgc

SEQ ID NO: 120712 - DNA, 22 bp, Artificial Sequence
  chemically synthesized
tcattgcatgtaatattgtttg

SEQ ID NO: 120713 - DNA, 22 bp, Artificial Sequence
  chemically synthesized
cattgcatgtaatattgtttgt

SEQ ID NO: 120714 - DNA, 22 bp, Artificial Sequence
  chemically synthesized
attgcatgtaatattgtttgtg

SEQ ID NO: 120715 - DNA, 22 bp, Artificial Sequence
  chemically synthesized
catgtaatattgtttgtgtgtg

SEQ ID NO: 120716 - DNA, 22 bp, Artificial Sequence
  chemically synthesized
tttgtgtgtgtgtgagagagag

SEQ ID NO: 120717 - DNA, 22 bp, Artificial Sequence
  chemically synthesized
gtgtgtgtgtgagagagagaga

SEQ ID NO: 120718 - DNA, 22 bp, Artificial Sequence
  chemically synthesized
tgtgtgtgtgagagagagagag

SEQ ID NO: 120719 - DNA, 22 bp, Artificial Sequence
  chemically synthesized
gctttcaaggggccagtataag

SEQ ID NO: 120720 - DNA, 22 bp, Artificial Sequence
  chemically synthesized
tcaaggggccagtataagtttt

SEQ ID NO: 120721 - DNA, 22 bp, Artificial Sequence
  chemically synthesized
caaggggccagtataagtttta

SEQ ID NO: 120722 - DNA, 22 bp, Artificial Sequence
  chemically synthesized
aaggggccagtataagttttat

SEQ ID NO: 120723 - DNA, 22 bp, Artificial Sequence
  chemically synthesized
tatttaaggaacctctatccag

SEQ ID NO: 120724 - DNA, 22 bp, Artificial Sequence
  chemically synthesized
atttaaggaacctctatccaga

SEQ ID NO: 120725 - DNA, 22 bp, Artificial Sequence
  chemically synthesized
tttaaggaacctctatccagaa

SEQ ID NO: 120726 - DNA, 22 bp, Artificial Sequence
  chemically synthesized
aaggaacctctatccagaattg

SEQ ID NO: 120727 - DNA, 22 bp, Artificial Sequence
  chemically synthesized
aggaacctctatccagaattga

SEQ ID NO: 120728 - DNA, 22 bp, Artificial Sequence
  chemically synthesized
tatccagaattgatacctagcc

SEQ ID NO: 120729 - DNA, 22 bp, Artificial Sequence
  chemically synthesized
tccagaattgatacctagccag

SEQ ID NO: 120730 - DNA, 22 bp, Artificial Sequence
  chemically synthesized
atacctagccagcccactgagc

SEQ ID NO: 120731 - DNA, 22 bp, Artificial Sequence
  chemically synthesized
gccagcccactgagccaggctt

SEQ ID NO: 120732 - DNA, 22 bp, Artificial Sequence
  chemically synthesized
agccaggcttggtgaagtagga

SEQ ID NO: 120733 - DNA, 22 bp, Artificial Sequence
  chemically synthesized
ggtgaagtaggagattccttca

SEQ ID NO: 120734 - DNA, 22 bp, Artificial Sequence
  chemically synthesized
gtgaagtaggagattccttcag

SEQ ID NO: 120735 - DNA, 22 bp, Artificial Sequence
  chemically synthesized
cttcaggagaactgaatcccca

SEQ ID NO: 120736 - DNA, 22 bp, Artificial Sequence
  chemically synthesized
caggagaactgaatccccaagg

SEQ ID NO: 120737 - DNA, 22 bp, Artificial Sequence
  chemically synthesized
aggagaactgaatccccaaggt

SEQ ID NO: 120738 - DNA, 22 bp, Artificial Sequence
  chemically synthesized
aatccccaaggtctgtacacat

SEQ ID NO: 120739 - DNA, 22 bp, Artificial Sequence
  chemically synthesized
tacacatgctgtggttttccaa

SEQ ID NO: 120740 - DNA, 22 bp, Artificial Sequence
  chemically synthesized
tggttttccaatgtagccacca

SEQ ID NO: 120741 - DNA, 22 bp, Artificial Sequence
  chemically synthesized
tccaatgtagccaccaggggga

SEQ ID NO: 120742 - DNA, 22 bp, Artificial Sequence
  chemically synthesized
ccaatgtagccaccagggggag

SEQ ID NO: 120743 - DNA, 22 bp, Artificial Sequence
  chemically synthesized
caatgtagccaccagggggagc

SEQ ID NO: 120744 - DNA, 22 bp, Artificial Sequence
  chemically synthesized
agcccaaggataggcttaaatt

SEQ ID NO: 120745 - DNA, 22 bp, Artificial Sequence
  chemically synthesized
aaattctgaccagcaccaaggc

SEQ ID NO: 120746 - DNA, 22 bp, Artificial Sequence
  chemically synthesized
aattctgaccagcaccaaggcc

SEQ ID NO: 120747 - DNA, 22 bp, Artificial Sequence
  chemically synthesized
tgaccagcaccaaggccctact

SEQ ID NO: 120748 - DNA, 22 bp, Artificial Sequence
  chemically synthesized
accagcaccaaggccctactat

SEQ ID NO: 120749 - DNA, 22 bp, Artificial Sequence
  chemically synthesized
ctatccccagggcacaagaaaa

SEQ ID NO: 120750 - DNA, 22 bp, Artificial Sequence
  chemically synthesized
tccccagggcacaagaaaatgt

SEQ ID NO: 120751 - DNA, 22 bp, Artificial Sequence
  chemically synthesized
ttcttccagcaccaccttcccg

SEQ ID NO: 120752 - DNA, 22 bp, Artificial Sequence
  chemically synthesized
tcttccagcaccaccttcccgt

SEQ ID NO: 120753 - DNA, 22 bp, Artificial Sequence
  chemically synthesized
cttccagcaccaccttcccgtg

SEQ ID NO: 120754 - DNA, 22 bp, Artificial Sequence
  chemically synthesized
ttccagcaccaccttcccgtgt

SEQ ID NO: 120755 - DNA, 22 bp, Artificial Sequence
  chemically synthesized
ccagcaccaccttcccgtgtcc

SEQ ID NO: 120756 - DNA, 22 bp, Artificial Sequence
  chemically synthesized
cagcaccaccttcccgtgtcct

SEQ ID NO: 120757 - DNA, 22 bp, Artificial Sequence
  chemically synthesized
cccgtgtcctcaatacccacta

SEQ ID NO: 120758 - DNA, 22 bp, Artificial Sequence
  chemically synthesized
ccgtgtcctcaatacccactac

SEQ ID NO: 120759 - DNA, 22 bp, Artificial Sequence
  chemically synthesized
aatacccactacacagctgaaa

SEQ ID NO: 120760 - DNA, 22 bp, Artificial Sequence
  chemically synthesized
cacagctgaaagctgccaacca

SEQ ID NO: 120761 - DNA, 22 bp, Artificial Sequence
  chemically synthesized
aaagctgccaaccagttcattc

SEQ ID NO: 120762 - DNA, 22 bp, Artificial Sequence
  chemically synthesized
ccaaccagttcattcttccttt

SEQ ID NO: 120763 - DNA, 22 bp, Artificial Sequence
  chemically synthesized
attcttcctttgaggatgatct

SEQ ID NO: 120764 - DNA, 22 bp, Artificial Sequence
  chemically synthesized
ttcctttgaggatgatcttcct

SEQ ID NO: 120765 - DNA, 22 bp, Artificial Sequence
  chemically synthesized
cctttgaggatgatcttcctct

SEQ ID NO: 120766 - DNA, 22 bp, Artificial Sequence
  chemically synthesized
ctttgaggatgatcttcctctc

SEQ ID NO: 120767 - DNA, 22 bp, Artificial Sequence
  chemically synthesized
tgaggatgatcttcctctctct

SEQ ID NO: 120768 - DNA, 22 bp, Artificial Sequence
  chemically synthesized
gaggatgatcttcctctctctc

SEQ ID NO: 120769 - DNA, 22 bp, Artificial Sequence
  chemically synthesized
aggatgatcttcctctctctca

SEQ ID NO: 120770 - DNA, 22 bp, Artificial Sequence
  chemically synthesized
cctctctctcatgcacaaaata

SEQ ID NO: 120771 - DNA, 22 bp, Artificial Sequence
  chemically synthesized
ctctctctcatgcacaaaatag

SEQ ID NO: 120772 - DNA, 22 bp, Artificial Sequence
  chemically synthesized
tctctcatgcacaaaatagaca

SEQ ID NO: 120773 - DNA, 22 bp, Artificial Sequence
  chemically synthesized
tctcatgcacaaaatagacata

SEQ ID NO: 120774 - DNA, 22 bp, Artificial Sequence
  chemically synthesized
tcatgcacaaaatagacatatc

SEQ ID NO: 120775 - DNA, 22 bp, Artificial Sequence
  chemically synthesized
atgcacaaaatagacatatcta

SEQ ID NO: 120776 - DNA, 22 bp, Artificial Sequence
  chemically synthesized
catcttacaaacacataaaaac

SEQ ID NO: 120777 - DNA, 22 bp, Artificial Sequence
  chemically synthesized
acaaacacataaaaactaaaat

SEQ ID NO: 120778 - DNA, 22 bp, Artificial Sequence
  chemically synthesized
caaacacataaaaactaaaatt

SEQ ID NO: 120779 - DNA, 22 bp, Artificial Sequence
  chemically synthesized
aaattgatggagagagataggt

SEQ ID NO: 120780 - DNA, 22 bp, Artificial Sequence
  chemically synthesized
atggagagagataggttttctt

SEQ ID NO: 120781 - DNA, 22 bp, Artificial Sequence
  chemically synthesized
tcttagctttttcagattttta

SEQ ID NO: 120782 - DNA, 22 bp, Artificial Sequence
  chemically synthesized
cttagctttttcagatttttac

SEQ ID NO: 120783 - DNA, 22 bp, Artificial Sequence
  chemically synthesized
ttagctttttcagatttttaca

SEQ ID NO: 120784 - DNA, 22 bp, Artificial Sequence
  chemically synthesized
agctttttcagatttttacaga

SEQ ID NO: 120785 - DNA, 22 bp, Artificial Sequence
  chemically synthesized
gctttttcagatttttacagat

SEQ ID NO: 120786 - DNA, 22 bp, Artificial Sequence
  chemically synthesized
tttcagatttttacagatggta

SEQ ID NO: 120787 - DNA, 22 bp, Artificial Sequence
  chemically synthesized
ttcagatttttacagatggtaa

SEQ ID NO: 120788 - DNA, 22 bp, Artificial Sequence
  chemically synthesized
tcagatttttacagatggtaat

SEQ ID NO: 120789 - DNA, 22 bp, Artificial Sequence
  chemically synthesized
cagatttttacagatggtaatc

SEQ ID NO: 120790 - DNA, 22 bp, Artificial Sequence
  chemically synthesized
agatttttacagatggtaatct

SEQ ID NO: 120791 - DNA, 22 bp, Artificial Sequence
  chemically synthesized
ttacagatggtaatctcacaca

SEQ ID NO: 120792 - DNA, 22 bp, Artificial Sequence
  chemically synthesized
tacagatggtaatctcacacaa

SEQ ID NO: 120793 - DNA, 22 bp, Artificial Sequence
  chemically synthesized
acagatggtaatctcacacaaa

SEQ ID NO: 120794 - DNA, 22 bp, Artificial Sequence
  chemically synthesized
cagatggtaatctcacacaaat

SEQ ID NO: 120795 - DNA, 22 bp, Artificial Sequence
  chemically synthesized
acacaaatctatgtgtgtggcc

SEQ ID NO: 120796 - DNA, 22 bp, Artificial Sequence
  chemically synthesized
tgtgtgtggcctttagtcttaa

SEQ ID NO: 120797 - DNA, 22 bp, Artificial Sequence
  chemically synthesized
tagtcttaatcatattgaccaa

SEQ ID NO: 120798 - DNA, 22 bp, Artificial Sequence
  chemically synthesized
agtcttaatcatattgaccaag

SEQ ID NO: 120799 - DNA, 22 bp, Artificial Sequence
  chemically synthesized
gtcttaatcatattgaccaagc

SEQ ID NO: 120800 - DNA, 22 bp, Artificial Sequence
  chemically synthesized
aatcatattgaccaagccttaa

SEQ ID NO: 120801 - DNA, 22 bp, Artificial Sequence
  chemically synthesized
atcatattgaccaagccttaaa

SEQ ID NO: 120802 - DNA, 22 bp, Artificial Sequence
  chemically synthesized
accaagccttaaatccccactc

SEQ ID NO: 120803 - DNA, 22 bp, Artificial Sequence
  chemically synthesized
aaatccccactctgaccagaaa

SEQ ID NO: 120804 - DNA, 22 bp, Artificial Sequence
  chemically synthesized
aatccccactctgaccagaaac

SEQ ID NO: 120805 - DNA, 22 bp, Artificial Sequence
  chemically synthesized
tgaccagaaacagacctaaata

SEQ ID NO: 120806 - DNA, 22 bp, Artificial Sequence
  chemically synthesized
accagaaacagacctaaataaa

SEQ ID NO: 120807 - DNA, 22 bp, Artificial Sequence
  chemically synthesized
aataaaatccttactcacaggg

SEQ ID NO: 120808 - DNA, 22 bp, Artificial Sequence
  chemically synthesized
actcacagggttctcaatgtct

SEQ ID NO: 120809 - DNA, 22 bp, Artificial Sequence
  chemically synthesized
ctcacagggttctcaatgtctc

SEQ ID NO: 120810 - DNA, 22 bp, Artificial Sequence
  chemically synthesized
acagggttctcaatgtctccag

SEQ ID NO: 120811 - DNA, 22 bp, Artificial Sequence
  chemically synthesized
tcaatgtctccagactcacaac

SEQ ID NO: 120812 - DNA, 22 bp, Artificial Sequence
  chemically synthesized
aatgtctccagactcacaacag

SEQ ID NO: 120813 - DNA, 22 bp, Artificial Sequence
  chemically synthesized
cagactcacaacagactctttt

SEQ ID NO: 120814 - DNA, 22 bp, Artificial Sequence
  chemically synthesized
acaacagactctttttaggtgt

SEQ ID NO: 120815 - DNA, 22 bp, Artificial Sequence
  chemically synthesized
tttttaggtgtctctgtcacag

SEQ ID NO: 120816 - DNA, 22 bp, Artificial Sequence
  chemically synthesized
tttaggtgtctctgtcacagaa

SEQ ID NO: 120817 - DNA, 22 bp, Artificial Sequence
  chemically synthesized
ttaggtgtctctgtcacagaaa

SEQ ID NO: 120818 - DNA, 22 bp, Artificial Sequence
  chemically synthesized
taggtgtctctgtcacagaaaa

SEQ ID NO: 120819 - DNA, 22 bp, Artificial Sequence
  chemically synthesized
aggtgtctctgtcacagaaaat

SEQ ID NO: 120820 - DNA, 22 bp, Artificial Sequence
  chemically synthesized
ggtgtctctgtcacagaaaatg

SEQ ID NO: 120821 - DNA, 22 bp, Artificial Sequence
  chemically synthesized
tgtcacagaaaatggccacaag

SEQ ID NO: 120822 - DNA, 22 bp, Artificial Sequence
  chemically synthesized
tcacagaaaatggccacaaggt

SEQ ID NO: 120823 - DNA, 22 bp, Artificial Sequence
  chemically synthesized
actctcaggcctgttagaacaa

SEQ ID NO: 120824 - DNA, 22 bp, Artificial Sequence
  chemically synthesized
tcaggcctgttagaacaagtcc

SEQ ID NO: 120825 - DNA, 22 bp, Artificial Sequence
  chemically synthesized
aggcctgttagaacaagtcctt

SEQ ID NO: 120826 - DNA, 22 bp, Artificial Sequence
  chemically synthesized
ttagaacaagtccttcccagaa

SEQ ID NO: 120827 - DNA, 22 bp, Artificial Sequence
  chemically synthesized
gaacaagtccttcccagaagaa

SEQ ID NO: 120828 - DNA, 22 bp, Artificial Sequence
  chemically synthesized
cccagaagaactccattttgtg

SEQ ID NO: 120829 - DNA, 22 bp, Artificial Sequence
  chemically synthesized
ccagaagaactccattttgtgg

SEQ ID NO: 120830 - DNA, 22 bp, Artificial Sequence
  chemically synthesized
cattttgtggtgtgagatcgat

SEQ ID NO: 120831 - DNA, 22 bp, Artificial Sequence
  chemically synthesized
tgtggtgtgagatcgatgcggg

SEQ ID NO: 120832 - DNA, 22 bp, Artificial Sequence
  chemically synthesized
gtggtgtgagatcgatgcgggt

SEQ ID NO: 120833 - DNA, 22 bp, Artificial Sequence
  chemically synthesized
tggtgtgagatcgatgcgggtc

SEQ ID NO: 120834 - DNA, 22 bp, Artificial Sequence
  chemically synthesized
tcagactggagagacccacaga

SEQ ID NO: 120835 - DNA, 22 bp, Artificial Sequence
  chemically synthesized
cagactggagagacccacagaa

SEQ ID NO: 120836 - DNA, 22 bp, Artificial Sequence
  chemically synthesized
agactggagagacccacagaag

SEQ ID NO: 120837 - DNA, 22 bp, Artificial Sequence
  chemically synthesized
gagagacccacagaagttagga

SEQ ID NO: 120838 - DNA, 22 bp, Artificial Sequence
  chemically synthesized
ggattgccaaaagggtcttctg

SEQ ID NO: 120839 - DNA, 22 bp, Artificial Sequence
  chemically synthesized
ccaaaagggtcttctggactgg

SEQ ID NO: 120840 - DNA, 22 bp, Artificial Sequence
  chemically synthesized
ctggactggtccacagccccta

SEQ ID NO: 120841 - DNA, 22 bp, Artificial Sequence
  chemically synthesized
tggactggtccacagcccctaa

SEQ ID NO: 120842 - DNA, 22 bp, Artificial Sequence
  chemically synthesized
gactggtccacagcccctaaga

SEQ ID NO: 120843 - DNA, 22 bp, Artificial Sequence
  chemically synthesized
gtccacagcccctaagaaattt

SEQ ID NO: 120844 - DNA, 22 bp, Artificial Sequence
  chemically synthesized
agaaattttcatgttgcaattc

SEQ ID NO: 120845 - DNA, 22 bp, Artificial Sequence
  chemically synthesized
tcatgttgcaattcattttgtc

SEQ ID NO: 120846 - DNA, 22 bp, Artificial Sequence
  chemically synthesized
catgttgcaattcattttgtcc

SEQ ID NO: 120847 - DNA, 22 bp, Artificial Sequence
  chemically synthesized
atgttgcaattcattttgtcca

SEQ ID NO: 120848 - DNA, 22 bp, Artificial Sequence
  chemically synthesized
caattcattttgtccatccccc

SEQ ID NO: 120849 - DNA, 22 bp, Artificial Sequence
  chemically synthesized
attttgtccatccccctgcctc

SEQ ID NO: 120850 - DNA, 22 bp, Artificial Sequence
  chemically synthesized
tgtccatccccctgcctccctg

SEQ ID NO: 120851 - DNA, 22 bp, Artificial Sequence
  chemically synthesized
gtccatccccctgcctccctgg

SEQ ID NO: 120852 - DNA, 22 bp, Artificial Sequence
  chemically synthesized
tccatccccctgcctccctgga

SEQ ID NO: 120853 - DNA, 22 bp, Artificial Sequence
  chemically synthesized
cctccctggacacctgcatctg

SEQ ID NO: 120854 - DNA, 22 bp, Artificial Sequence
  chemically synthesized
cctggacacctgcatctgtgtg

SEQ ID NO: 120855 - DNA, 22 bp, Artificial Sequence
  chemically synthesized
gacacctgcatctgtgtgtgca

SEQ ID NO: 120856 - DNA, 22 bp, Artificial Sequence
  chemically synthesized
catctgtgtgtgcacagagagt

SEQ ID NO: 120857 - DNA, 22 bp, Artificial Sequence
  chemically synthesized
tgtgtgcacagagagtctggaa

SEQ ID NO: 120858 - DNA, 22 bp, Artificial Sequence
  chemically synthesized
gaaggtttacagagaagtctcc

SEQ ID NO: 120859 - DNA, 22 bp, Artificial Sequence
  chemically synthesized
acagagaagtctccacatcttc

SEQ ID NO: 120860 - DNA, 22 bp, Artificial Sequence
  chemically synthesized
cagagaagtctccacatcttcc

SEQ ID NO: 120861 - DNA, 22 bp, Artificial Sequence
  chemically synthesized
cacatcttcccacagcaactct

SEQ ID NO: 120862 - DNA, 22 bp, Artificial Sequence
  chemically synthesized
cccacagcaactctttcagaaa

SEQ ID NO: 120863 - DNA, 22 bp, Artificial Sequence
  chemically synthesized
ccacagcaactctttcagaaac

SEQ ID NO: 120864 - DNA, 22 bp, Artificial Sequence
  chemically synthesized
tttcagaaacgccttctttcgt

SEQ ID NO: 120865 - DNA, 22 bp, Artificial Sequence
  chemically synthesized
tcagaaacgccttctttcgtaa

SEQ ID NO: 120866 - DNA, 22 bp, Artificial Sequence
  chemically synthesized
cagaaacgccttctttcgtaac

SEQ ID NO: 120867 - DNA, 22 bp, Artificial Sequence
  chemically synthesized
agaaacgccttctttcgtaaca

SEQ ID NO: 120868 - DNA, 22 bp, Artificial Sequence
  chemically synthesized
ctttcgtaacatcctacctctc

SEQ ID NO: 120869 - DNA, 22 bp, Artificial Sequence
  chemically synthesized
tttcgtaacatcctacctctct

SEQ ID NO: 120870 - DNA, 22 bp, Artificial Sequence
  chemically synthesized
tcgtaacatcctacctctcttc

SEQ ID NO: 120871 - DNA, 22 bp, Artificial Sequence
  chemically synthesized
cgtaacatcctacctctcttca

SEQ ID NO: 120872 - DNA, 22 bp, Artificial Sequence
  chemically synthesized
gtaacatcctacctctcttcag

SEQ ID NO: 120873 - DNA, 22 bp, Artificial Sequence
  chemically synthesized
cctctcttcagtcattatgaaa

SEQ ID NO: 120874 - DNA, 22 bp, Artificial Sequence
  chemically synthesized
tcttcagtcattatgaaaggga

SEQ ID NO: 120875 - DNA, 22 bp, Artificial Sequence
  chemically synthesized
ttcagtcattatgaaagggaac

SEQ ID NO: 120876 - DNA, 22 bp, Artificial Sequence
  chemically synthesized
cagtcattatgaaagggaaccg

SEQ ID NO: 120877 - DNA, 22 bp, Artificial Sequence
  chemically synthesized
agtcattatgaaagggaaccga

SEQ ID NO: 120878 - DNA, 22 bp, Artificial Sequence
  chemically synthesized
tgaaagggaaccgattttcatt

SEQ ID NO: 120879 - DNA, 22 bp, Artificial Sequence
  chemically synthesized
tcattttcattgtgaaaacttt

SEQ ID NO: 120880 - DNA, 22 bp, Artificial Sequence
  chemically synthesized
cattttcattgtgaaaactttt

SEQ ID NO: 120881 - DNA, 22 bp, Artificial Sequence
  chemically synthesized
attttcattgtgaaaacttttc

SEQ ID NO: 120882 - DNA, 22 bp, Artificial Sequence
  chemically synthesized
tcattgtgaaaacttttcagag

SEQ ID NO: 120883 - DNA, 22 bp, Artificial Sequence
  chemically synthesized
cattgtgaaaacttttcagaga

SEQ ID NO: 120884 - DNA, 22 bp, Artificial Sequence
  chemically synthesized
attgtgaaaacttttcagagag

SEQ ID NO: 120885 - DNA, 22 bp, Artificial Sequence
  chemically synthesized
tgaaaacttttcagagagaccc

SEQ ID NO: 120886 - DNA, 22 bp, Artificial Sequence
  chemically synthesized
ttcagagagaccccttttggga

SEQ ID NO: 120887 - DNA, 22 bp, Artificial Sequence
  chemically synthesized
tcagagagaccccttttgggaa

SEQ ID NO: 120888 - DNA, 22 bp, Artificial Sequence
  chemically synthesized
cagagagaccccttttgggaaa

SEQ ID NO: 120889 - DNA, 22 bp, Artificial Sequence
  chemically synthesized
agagagaccccttttgggaaac

SEQ ID NO: 120890 - DNA, 22 bp, Artificial Sequence
  chemically synthesized
ttgggaaaccatctcttctccc

SEQ ID NO: 120891 - DNA, 22 bp, Artificial Sequence
  chemically synthesized
tgggaaaccatctcttctcccc

SEQ ID NO: 120892 - DNA, 22 bp, Artificial Sequence
  chemically synthesized
gggaaaccatctcttctcccca

SEQ ID NO: 120893 - DNA, 22 bp, Artificial Sequence
  chemically synthesized
ggaaaccatctcttctccccac

SEQ ID NO: 120894 - DNA, 22 bp, Artificial Sequence
  chemically synthesized
ttctccccactccaagttgggc

SEQ ID NO: 120895 - DNA, 22 bp, Artificial Sequence
  chemically synthesized
ctccccactccaagttgggcta

SEQ ID NO: 120896 - DNA, 22 bp, Artificial Sequence
  chemically synthesized
tccccactccaagttgggctaa

SEQ ID NO: 120897 - DNA, 22 bp, Artificial Sequence
  chemically synthesized
cccactccaagttgggctaaag

SEQ ID NO: 120898 - DNA, 22 bp, Artificial Sequence
  chemically synthesized
caagttgggctaaagttttagt

SEQ ID NO: 120899 - DNA, 22 bp, Artificial Sequence
  chemically synthesized
ggctaaagttttagtgtatttt

SEQ ID NO: 120900 - DNA, 22 bp, Artificial Sequence
  chemically synthesized
aagttttagtgtattttgcata

SEQ ID NO: 120901 - DNA, 22 bp, Artificial Sequence
  chemically synthesized
tagtgtattttgcatattttga

SEQ ID NO: 120902 - DNA, 22 bp, Artificial Sequence
  chemically synthesized
agtgtattttgcatattttgat

SEQ ID NO: 120903 - DNA, 22 bp, Artificial Sequence
  chemically synthesized
gtgtattttgcatattttgatt

SEQ ID NO: 120904 - DNA, 22 bp, Artificial Sequence
  chemically synthesized
tgcatattttgatttgctataa

SEQ ID NO: 120905 - DNA, 22 bp, Artificial Sequence
  chemically synthesized
gcatattttgatttgctataac

SEQ ID NO: 120906 - DNA, 22 bp, Artificial Sequence
  chemically synthesized
catattttgatttgctataaca

SEQ ID NO: 120907 - DNA, 22 bp, Artificial Sequence
  chemically synthesized
tgatttgctataacagagtacc

SEQ ID NO: 120908 - DNA, 22 bp, Artificial Sequence
  chemically synthesized
gatttgctataacagagtacct

SEQ ID NO: 120909 - DNA, 22 bp, Artificial Sequence
  chemically synthesized
atttgctataacagagtacctg

SEQ ID NO: 120910 - DNA, 22 bp, Artificial Sequence
  chemically synthesized
gctataacagagtacctgagtc

SEQ ID NO: 120911 - DNA, 22 bp, Artificial Sequence
  chemically synthesized
ctataacagagtacctgagtct

SEQ ID NO: 120912 - DNA, 22 bp, Artificial Sequence
  chemically synthesized
taacagagtacctgagtctggg

SEQ ID NO: 120913 - DNA, 22 bp, Artificial Sequence
  chemically synthesized
agtctgggtagcttattttttt

SEQ ID NO: 120914 - DNA, 22 bp, Artificial Sequence
  chemically synthesized
ggtagcttatttttttttttta

SEQ ID NO: 120915 - DNA, 22 bp, Artificial Sequence
  chemically synthesized
attttttttttttaaagttttg

SEQ ID NO: 120916 - DNA, 22 bp, Artificial Sequence
  chemically synthesized
ttttttttttttaaagttttgt

SEQ ID NO: 120917 - DNA, 22 bp, Artificial Sequence
  chemically synthesized
tttttttttaaagttttgtttg

SEQ ID NO: 120918 - DNA, 22 bp, Artificial Sequence
  chemically synthesized
ttttttttaaagttttgtttgg

SEQ ID NO: 120919 - DNA, 22 bp, Artificial Sequence
  chemically synthesized
tttttttaaagttttgtttggt

SEQ ID NO: 120920 - DNA, 22 bp, Artificial Sequence
  chemically synthesized
ttttttaaagttttgtttggtt

SEQ ID NO: 120921 - DNA, 22 bp, Artificial Sequence
  chemically synthesized
tttttaaagttttgtttggttc

SEQ ID NO: 120922 - DNA, 22 bp, Artificial Sequence
  chemically synthesized
ttttaaagttttgtttggttca

SEQ ID NO: 120923 - DNA, 22 bp, Artificial Sequence
  chemically synthesized
tttaaagttttgtttggttcat

SEQ ID NO: 120924 - DNA, 22 bp, Artificial Sequence
  chemically synthesized
ttaaagttttgtttggttcatg

SEQ ID NO: 120925 - DNA, 22 bp, Artificial Sequence
  chemically synthesized
taaagttttgtttggttcatga

SEQ ID NO: 120926 - DNA, 22 bp, Artificial Sequence
  chemically synthesized
aaagttttgtttggttcatgat

SEQ ID NO: 120927 - DNA, 22 bp, Artificial Sequence
  chemically synthesized
aagttttgtttggttcatgatt

SEQ ID NO: 120928 - DNA, 22 bp, Artificial Sequence
  chemically synthesized
tgtttggttcatgattctggtg

SEQ ID NO: 120929 - DNA, 22 bp, Artificial Sequence
  chemically synthesized
gtttggttcatgattctggtga

SEQ ID NO: 120930 - DNA, 22 bp, Artificial Sequence
  chemically synthesized
tttggttcatgattctggtgac

SEQ ID NO: 120931 - DNA, 22 bp, Artificial Sequence
  chemically synthesized
ggttcatgattctggtgactta

SEQ ID NO: 120932 - DNA, 22 bp, Artificial Sequence
  chemically synthesized
gttcatgattctggtgacttaa

SEQ ID NO: 120933 - DNA, 22 bp, Artificial Sequence
  chemically synthesized
atgattctggtgacttaaaagt

SEQ ID NO: 120934 - DNA, 22 bp, Artificial Sequence
  chemically synthesized
tggtgacttaaaagtccaagat

SEQ ID NO: 120935 - DNA, 22 bp, Artificial Sequence
  chemically synthesized
gtgacttaaaagtccaagatcg

SEQ ID NO: 120936 - DNA, 22 bp, Artificial Sequence
  chemically synthesized
aaaagtccaagatcgggcggtt

SEQ ID NO: 120937 - DNA, 22 bp, Artificial Sequence
  chemically synthesized
aaagtccaagatcgggcggttg

SEQ ID NO: 120938 - DNA, 22 bp, Artificial Sequence
  chemically synthesized
catctgataaaggtctcatgct

SEQ ID NO: 120939 - DNA, 22 bp, Artificial Sequence
  chemically synthesized
ataaaggtctcatgctggttcc

SEQ ID NO: 120940 - DNA, 22 bp, Artificial Sequence
  chemically synthesized
atgctggttccaaacatggcag

SEQ ID NO: 120941 - DNA, 22 bp, Artificial Sequence
  chemically synthesized
gttccaaacatggcagaaagca

SEQ ID NO: 120942 - DNA, 22 bp, Artificial Sequence
  chemically synthesized
caaacatggcagaaagcagaca

SEQ ID NO: 120943 - DNA, 22 bp, Artificial Sequence
  chemically synthesized
atgggaaagtatcaagctgtcc

SEQ ID NO: 120944 - DNA, 22 bp, Artificial Sequence
  chemically synthesized
tccaccatatgtgaaattagaa

SEQ ID NO: 120945 - DNA, 22 bp, Artificial Sequence
  chemically synthesized
gaattctaaaaggaaacaaaaa

SEQ ID NO: 120946 - DNA, 22 bp, Artificial Sequence
  chemically synthesized
taaaaggaaacaaaaaatggat

SEQ ID NO: 120947 - DNA, 22 bp, Artificial Sequence
  chemically synthesized
aaaggaaacaaaaaatggatta

SEQ ID NO: 120948 - DNA, 22 bp, Artificial Sequence
  chemically synthesized
aacgttttttgaggaattattg

SEQ ID NO: 120949 - DNA, 22 bp, Artificial Sequence
  chemically synthesized
tttgaggaattattgactgaat

SEQ ID NO: 120950 - DNA, 22 bp, Artificial Sequence
  chemically synthesized
ttgaggaattattgactgaatg

SEQ ID NO: 120951 - DNA, 22 bp, Artificial Sequence
  chemically synthesized
tgaggaattattgactgaatgt

SEQ ID NO: 120952 - DNA, 22 bp, Artificial Sequence
  chemically synthesized
gaggaattattgactgaatgtt

SEQ ID NO: 120953 - DNA, 22 bp, Artificial Sequence
  chemically synthesized
aggaattattgactgaatgttt

SEQ ID NO: 120954 - DNA, 22 bp, Artificial Sequence
  chemically synthesized
ttgactgaatgtttcaacatct

SEQ ID NO: 120955 - DNA, 22 bp, Artificial Sequence
  chemically synthesized
actgaatgtttcaacatctgga

SEQ ID NO: 120956 - DNA, 22 bp, Artificial Sequence
  chemically synthesized
aatgtttcaacatctggacata

SEQ ID NO: 120957 - DNA, 22 bp, Artificial Sequence
  chemically synthesized
caacatctggacataaaatcta

SEQ ID NO: 120958 - DNA, 22 bp, Artificial Sequence
  chemically synthesized
aacatctggacataaaatctat

SEQ ID NO: 120959 - DNA, 22 bp, Artificial Sequence
  chemically synthesized
gacataaaatctattaattcat

SEQ ID NO: 120960 - DNA, 22 bp, Artificial Sequence
  chemically synthesized
ttaattcatatctttagctaac

SEQ ID NO: 120961 - DNA, 22 bp, Artificial Sequence
  chemically synthesized
attcatatctttagctaacctt

SEQ ID NO: 120962 - DNA, 22 bp, Artificial Sequence
  chemically synthesized
atatctttagctaaccttgagc

SEQ ID NO: 120963 - DNA, 22 bp, Artificial Sequence
  chemically synthesized
tagctaaccttgagcaatgtca

SEQ ID NO: 120964 - DNA, 22 bp, Artificial Sequence
  chemically synthesized
agctaaccttgagcaatgtcaa

SEQ ID NO: 120965 - DNA, 22 bp, Artificial Sequence
  chemically synthesized
gctaaccttgagcaatgtcaat

SEQ ID NO: 120966 - DNA, 22 bp, Artificial Sequence
  chemically synthesized
accttgagcaatgtcaattaaa

SEQ ID NO: 120967 - DNA, 22 bp, Artificial Sequence
  chemically synthesized
gagcaatgtcaattaaaaaata

SEQ ID NO: 120968 - DNA, 22 bp, Artificial Sequence
  chemically synthesized
agcaatgtcaattaaaaaataa

SEQ ID NO: 120969 - DNA, 22 bp, Artificial Sequence
  chemically synthesized
aaaaataaaacacaactaaatg

SEQ ID NO: 120970 - DNA, 22 bp, Artificial Sequence
  chemically synthesized
aatgcatatcttacaaatggca

SEQ ID NO: 120971 - DNA, 22 bp, Artificial Sequence
  chemically synthesized
acaaatggcataaacaacaaat

SEQ ID NO: 120972 - DNA, 22 bp, Artificial Sequence
  chemically synthesized
caaatggcataaacaacaaatg

SEQ ID NO: 120973 - DNA, 22 bp, Artificial Sequence
  chemically synthesized
aaaagcagacatagaaaaagac

SEQ ID NO: 120974 - DNA, 22 bp, Artificial Sequence
  chemically synthesized
aaagcagacatagaaaaagaca

SEQ ID NO: 120975 - DNA, 22 bp, Artificial Sequence
  chemically synthesized
catacaagaaaattattagagg

SEQ ID NO: 120976 - DNA, 22 bp, Artificial Sequence
  chemically synthesized
ttagaggaaacaacggaaacct

SEQ ID NO: 120977 - DNA, 22 bp, Artificial Sequence
  chemically synthesized
gaggaaacaacggaaacctgaa

SEQ ID NO: 120978 - DNA, 22 bp, Artificial Sequence
  chemically synthesized
aaaaaataaactggaactttat

SEQ ID NO: 120979 - DNA, 22 bp, Artificial Sequence
  chemically synthesized
gaactttattttttattttttt

SEQ ID NO: 120980 - DNA, 22 bp, Artificial Sequence
  chemically synthesized
tattttttatttttttatttat

SEQ ID NO: 120981 - DNA, 22 bp, Artificial Sequence
  chemically synthesized
attttttatttttttatttatt

SEQ ID NO: 120982 - DNA, 22 bp, Artificial Sequence
  chemically synthesized
ttttttatttttttatttattt

SEQ ID NO: 120983 - DNA, 22 bp, Artificial Sequence
  chemically synthesized
tttatttttttatttattttat

SEQ ID NO: 120984 - DNA, 22 bp, Artificial Sequence
  chemically synthesized
ttatttttttatttattttatt

SEQ ID NO: 120985 - DNA, 22 bp, Artificial Sequence
  chemically synthesized
tatttttttatttattttattt

SEQ ID NO: 120986 - DNA, 22 bp, Artificial Sequence
  chemically synthesized
atttttttatttattttattta

SEQ ID NO: 120987 - DNA, 22 bp, Artificial Sequence
  chemically synthesized
tttttttatttattttatttat

SEQ ID NO: 120988 - DNA, 22 bp, Artificial Sequence
  chemically synthesized
ttttatttattttatttattat

SEQ ID NO: 120989 - DNA, 22 bp, Artificial Sequence
  chemically synthesized
tttatttattttatttattatt

SEQ ID NO: 120990 - DNA, 22 bp, Artificial Sequence
  chemically synthesized
ttatttattttatttattatta

SEQ ID NO: 120991 - DNA, 22 bp, Artificial Sequence
  chemically synthesized
tatttattttatttattattat

SEQ ID NO: 120992 - DNA, 22 bp, Artificial Sequence
  chemically synthesized
atttattttatttattattatt

SEQ ID NO: 120993 - DNA, 22 bp, Artificial Sequence
  chemically synthesized
tttattttatttattattatta

SEQ ID NO: 120994 - DNA, 22 bp, Artificial Sequence
  chemically synthesized
attttatttattattattatta

SEQ ID NO: 120995 - DNA, 22 bp, Artificial Sequence
  chemically synthesized
ttttatttattattattattat

SEQ ID NO: 120996 - DNA, 22 bp, Artificial Sequence
  chemically synthesized
tatttattattattattatact

SEQ ID NO: 120997 - DNA, 22 bp, Artificial Sequence
  chemically synthesized
atttattattattattatactt

SEQ ID NO: 120998 - DNA, 22 bp, Artificial Sequence
  chemically synthesized
tttattattattattatacttt

SEQ ID NO: 120999 - DNA, 22 bp, Artificial Sequence
  chemically synthesized
attattattattatactttaag

SEQ ID NO: 121000 - DNA, 22 bp, Artificial Sequence
  chemically synthesized
ttattattattatactttaaga

SEQ ID NO: 121001 - DNA, 22 bp, Artificial Sequence
  chemically synthesized
ttattattatactttaagattt

SEQ ID NO: 121002 - DNA, 22 bp, Artificial Sequence
  chemically synthesized
ttattatactttaagatttagg

SEQ ID NO: 121003 - DNA, 22 bp, Artificial Sequence
  chemically synthesized
ttatactttaagatttagggta

SEQ ID NO: 121004 - DNA, 22 bp, Artificial Sequence
  chemically synthesized
tactttaagatttagggtacat

SEQ ID NO: 121005 - DNA, 22 bp, Artificial Sequence
  chemically synthesized
taagatttagggtacatgtgca

SEQ ID NO: 121006 - DNA, 22 bp, Artificial Sequence
  chemically synthesized
aagatttagggtacatgtgcat

SEQ ID NO: 121007 - DNA, 22 bp, Artificial Sequence
  chemically synthesized
agatttagggtacatgtgcata

SEQ ID NO: 121008 - DNA, 22 bp, Artificial Sequence
  chemically synthesized
agggtacatgtgcataatgtgc

SEQ ID NO: 121009 - DNA, 22 bp, Artificial Sequence
  chemically synthesized
gggtacatgtgcataatgtgcc

SEQ ID NO: 121010 - DNA, 22 bp, Artificial Sequence
  chemically synthesized
gttacatatgtatacatgtgcc

SEQ ID NO: 121011 - DNA, 22 bp, Artificial Sequence
  chemically synthesized
catatgtatacatgtgccatgt

SEQ ID NO: 121012 - DNA, 22 bp, Artificial Sequence
  chemically synthesized
gtgtgctgcacccattaactcg

SEQ ID NO: 121013 - DNA, 22 bp, Artificial Sequence
  chemically synthesized
cacccattaactcgtaatttag

SEQ ID NO: 121014 - DNA, 22 bp, Artificial Sequence
  chemically synthesized
actcgtaatttagcattaggta

SEQ ID NO: 121015 - DNA, 22 bp, Artificial Sequence
  chemically synthesized
gtaatttagcattaggtatatc

SEQ ID NO: 121016 - DNA, 22 bp, Artificial Sequence
  chemically synthesized
agcattaggtatatctcctaat

SEQ ID NO: 121017 - DNA, 22 bp, Artificial Sequence
  chemically synthesized
gcattaggtatatctcctaatg

SEQ ID NO: 121018 - DNA, 22 bp, Artificial Sequence
  chemically synthesized
ggtatatctcctaatgccatcc

SEQ ID NO: 121019 - DNA, 22 bp, Artificial Sequence
  chemically synthesized
ctaatgccatccctccctgcac

SEQ ID NO: 121020 - DNA, 22 bp, Artificial Sequence
  chemically synthesized
atgccatccctccctgcacccc

SEQ ID NO: 121021 - DNA, 22 bp, Artificial Sequence
  chemically synthesized
cctgcacccccaccccacaaca

SEQ ID NO: 121022 - DNA, 22 bp, Artificial Sequence
  chemically synthesized
cacccccaccccacaacagtcc

SEQ ID NO: 121023 - DNA, 22 bp, Artificial Sequence
  chemically synthesized
cccttcctgtgtccatgtgttc

SEQ ID NO: 121024 - DNA, 22 bp, Artificial Sequence
  chemically synthesized
cctgtgtccatgtgttctcatt

SEQ ID NO: 121025 - DNA, 22 bp, Artificial Sequence
  chemically synthesized
ctgtgtccatgtgttctcattg

SEQ ID NO: 121026 - DNA, 22 bp, Artificial Sequence
  chemically synthesized
tgtccatgtgttctcattgttc

SEQ ID NO: 121027 - DNA, 22 bp, Artificial Sequence
  chemically synthesized
tcattgttcagttcccatctat

SEQ ID NO: 121028 - DNA, 22 bp, Artificial Sequence
  chemically synthesized
attgttcagttcccatctatga

SEQ ID NO: 121029 - DNA, 22 bp, Artificial Sequence
  chemically synthesized
ttcagttcccatctatgagtga

SEQ ID NO: 121030 - DNA, 22 bp, Artificial Sequence
  chemically synthesized
agttcccatctatgagtgagaa

SEQ ID NO: 121031 - DNA, 22 bp, Artificial Sequence
  chemically synthesized
ccatctatgagtgagaatatgt

SEQ ID NO: 121032 - DNA, 22 bp, Artificial Sequence
  chemically synthesized
tgagtgagaatatgtggtgttt

SEQ ID NO: 121033 - DNA, 22 bp, Artificial Sequence
  chemically synthesized
ggttttttgtccttgcgatagt

SEQ ID NO: 121034 - DNA, 22 bp, Artificial Sequence
  chemically synthesized
gttttttgtccttgcgatagtt

SEQ ID NO: 121035 - DNA, 22 bp, Artificial Sequence
  chemically synthesized
tttgtccttgcgatagtttact

SEQ ID NO: 121036 - DNA, 22 bp, Artificial Sequence
  chemically synthesized
ttgtccttgcgatagtttactg

SEQ ID NO: 121037 - DNA, 22 bp, Artificial Sequence
  chemically synthesized
tgtccttgcgatagtttactga

SEQ ID NO: 121038 - DNA, 22 bp, Artificial Sequence
  chemically synthesized
gtccttgcgatagtttactgag

SEQ ID NO: 121039 - DNA, 22 bp, Artificial Sequence
  chemically synthesized
tccttgcgatagtttactgaga

SEQ ID NO: 121040 - DNA, 22 bp, Artificial Sequence
  chemically synthesized
gcgatagtttactgagaatgat

SEQ ID NO: 121041 - DNA, 22 bp, Artificial Sequence
  chemically synthesized
cgatagtttactgagaatgatg

SEQ ID NO: 121042 - DNA, 22 bp, Artificial Sequence
  chemically synthesized
actgagaatgatgatttccaat

SEQ ID NO: 121043 - DNA, 22 bp, Artificial Sequence
  chemically synthesized
ctgagaatgatgatttccaatt

SEQ ID NO: 121044 - DNA, 22 bp, Artificial Sequence
  chemically synthesized
agaatgatgatttccaatttca

SEQ ID NO: 121045 - DNA, 22 bp, Artificial Sequence
  chemically synthesized
ccaatttcatccatgtccctac

SEQ ID NO: 121046 - DNA, 22 bp, Artificial Sequence
  chemically synthesized
caatttcatccatgtccctaca

SEQ ID NO: 121047 - DNA, 22 bp, Artificial Sequence
  chemically synthesized
catccatgtccctacaaaggac

SEQ ID NO: 121048 - DNA, 22 bp, Artificial Sequence
  chemically synthesized
atccatgtccctacaaaggaca

SEQ ID NO: 121049 - DNA, 22 bp, Artificial Sequence
  chemically synthesized
caaaggacatgaactcatcatt

SEQ ID NO: 121050 - DNA, 22 bp, Artificial Sequence
  chemically synthesized
atcatttttatggctgcatagt

SEQ ID NO: 121051 - DNA, 22 bp, Artificial Sequence
  chemically synthesized
ttatggctgcatagtattccat

SEQ ID NO: 121052 - DNA, 22 bp, Artificial Sequence
  chemically synthesized
tatggctgcatagtattccatg

SEQ ID NO: 121053 - DNA, 22 bp, Artificial Sequence
  chemically synthesized
atggctgcatagtattccatgg

SEQ ID NO: 121054 - DNA, 22 bp, Artificial Sequence
  chemically synthesized
tggctgcatagtattccatggt

SEQ ID NO: 121055 - DNA, 22 bp, Artificial Sequence
  chemically synthesized
catagtattccatggtgtatat

SEQ ID NO: 121056 - DNA, 22 bp, Artificial Sequence
  chemically synthesized
catggtgtatatgtgccacatt

SEQ ID NO: 121057 - DNA, 22 bp, Artificial Sequence
  chemically synthesized
tcttaatccagtctatcattgt

SEQ ID NO: 121058 - DNA, 22 bp, Artificial Sequence
  chemically synthesized
cttaatccagtctatcattgtt

SEQ ID NO: 121059 - DNA, 22 bp, Artificial Sequence
  chemically synthesized
ttaatccagtctatcattgttg

SEQ ID NO: 121060 - DNA, 22 bp, Artificial Sequence
  chemically synthesized
aatccagtctatcattgttgga

SEQ ID NO: 121061 - DNA, 22 bp, Artificial Sequence
  chemically synthesized
atccagtctatcattgttggac

SEQ ID NO: 121062 - DNA, 22 bp, Artificial Sequence
  chemically synthesized
tcattgttggacatttgggttg

SEQ ID NO: 121063 - DNA, 22 bp, Artificial Sequence
  chemically synthesized
ttggacatttgggttggttcca

SEQ ID NO: 121064 - DNA, 22 bp, Artificial Sequence
  chemically synthesized
gacatttgggttggttccaagt

SEQ ID NO: 121065 - DNA, 22 bp, Artificial Sequence
  chemically synthesized
gggttggttccaagtctttgct

SEQ ID NO: 121066 - DNA, 22 bp, Artificial Sequence
  chemically synthesized
ggttggttccaagtctttgcta

SEQ ID NO: 121067 - DNA, 22 bp, Artificial Sequence
  chemically synthesized
gttccaagtctttgctattgtg

SEQ ID NO: 121068 - DNA, 22 bp, Artificial Sequence
  chemically synthesized
caagtctttgctattgtgaata

SEQ ID NO: 121069 - DNA, 22 bp, Artificial Sequence
  chemically synthesized
tgctattgtgaatagtaccgca

SEQ ID NO: 121070 - DNA, 22 bp, Artificial Sequence
  chemically synthesized
gctattgtgaatagtaccgcaa

SEQ ID NO: 121071 - DNA, 22 bp, Artificial Sequence
  chemically synthesized
ctattgtgaatagtaccgcaat

SEQ ID NO: 121072 - DNA, 22 bp, Artificial Sequence
  chemically synthesized
ttgtgaatagtaccgcaataaa

SEQ ID NO: 121073 - DNA, 22 bp, Artificial Sequence
  chemically synthesized
tgaatagtaccgcaataaacat

SEQ ID NO: 121074 - DNA, 22 bp, Artificial Sequence
  chemically synthesized
tatagcagcatgatttatattc

SEQ ID NO: 121075 - DNA, 22 bp, Artificial Sequence
  chemically synthesized
atagcagcatgatttatattcc

SEQ ID NO: 121076 - DNA, 22 bp, Artificial Sequence
  chemically synthesized
tagcagcatgatttatattcct

SEQ ID NO: 121077 - DNA, 22 bp, Artificial Sequence
  chemically synthesized
atattcctttgggtatataccc

SEQ ID NO: 121078 - DNA, 22 bp, Artificial Sequence
  chemically synthesized
tattcctttgggtatataccca

SEQ ID NO: 121079 - DNA, 22 bp, Artificial Sequence
  chemically synthesized
ctttgggtatatacccagtaat

SEQ ID NO: 121080 - DNA, 22 bp, Artificial Sequence
  chemically synthesized
tgggtatatacccagtaatggg

SEQ ID NO: 121081 - DNA, 22 bp, Artificial Sequence
  chemically synthesized
gggtatatacccagtaatggga

SEQ ID NO: 121082 - DNA, 22 bp, Artificial Sequence
  chemically synthesized
ggtatatacccagtaatgggat

SEQ ID NO: 121083 - DNA, 22 bp, Artificial Sequence
  chemically synthesized
ggtcaaatggtatttctagttc

SEQ ID NO: 121084 - DNA, 22 bp, Artificial Sequence
  chemically synthesized
ctagttctagatccctgaggaa

SEQ ID NO: 121085 - DNA, 22 bp, Artificial Sequence
  chemically synthesized
tagttctagatccctgaggaat

SEQ ID NO: 121086 - DNA, 22 bp, Artificial Sequence
  chemically synthesized
gttctagatccctgaggaatcg

SEQ ID NO: 121087 - DNA, 22 bp, Artificial Sequence
  chemically synthesized
tagatccctgaggaatcgccac

SEQ ID NO: 121088 - DNA, 22 bp, Artificial Sequence
  chemically synthesized
gatccctgaggaatcgccacac

SEQ ID NO: 121089 - DNA, 22 bp, Artificial Sequence
  chemically synthesized
aggaatcgccacactgacttcc

SEQ ID NO: 121090 - DNA, 22 bp, Artificial Sequence
  chemically synthesized
acttccacaatggttgaactag

SEQ ID NO: 121091 - DNA, 22 bp, Artificial Sequence
  chemically synthesized
ccacaatggttgaactagttta

SEQ ID NO: 121092 - DNA, 22 bp, Artificial Sequence
  chemically synthesized
cacaatggttgaactagtttac

SEQ ID NO: 121093 - DNA, 22 bp, Artificial Sequence
  chemically synthesized
aactagtttacagtcccaccaa

SEQ ID NO: 121094 - DNA, 22 bp, Artificial Sequence
  chemically synthesized
gtttacagtcccaccaagagtg

SEQ ID NO: 121095 - DNA, 22 bp, Artificial Sequence
  chemically synthesized
acagtcccaccaagagtgtaaa

SEQ ID NO: 121096 - DNA, 22 bp, Artificial Sequence
  chemically synthesized
cagtcccaccaagagtgtaaaa

SEQ ID NO: 121097 - DNA, 22 bp, Artificial Sequence
  chemically synthesized
ctatttctccacatcctctcca

SEQ ID NO: 121098 - DNA, 22 bp, Artificial Sequence
  chemically synthesized
tttctccacatcctctccagca

SEQ ID NO: 121099 - DNA, 22 bp, Artificial Sequence
  chemically synthesized
ctccacatcctctccagcacct

SEQ ID NO: 121100 - DNA, 22 bp, Artificial Sequence
  chemically synthesized
tccacatcctctccagcacctg

SEQ ID NO: 121101 - DNA, 22 bp, Artificial Sequence
  chemically synthesized
cacatcctctccagcacctgtt

SEQ ID NO: 121102 - DNA, 22 bp, Artificial Sequence
  chemically synthesized
tccagcacctgttgtttcctga

SEQ ID NO: 121103 - DNA, 22 bp, Artificial Sequence
  chemically synthesized
cagcacctgttgtttcctgact

SEQ ID NO: 121104 - DNA, 22 bp, Artificial Sequence
  chemically synthesized
ttgtttcctgactttttaatga

SEQ ID NO: 121105 - DNA, 22 bp, Artificial Sequence
  chemically synthesized
tttcctgactttttaatgattg

SEQ ID NO: 121106 - DNA, 22 bp, Artificial Sequence
  chemically synthesized
cctgactttttaatgattgcca

SEQ ID NO: 121107 - DNA, 22 bp, Artificial Sequence
  chemically synthesized
ctgactttttaatgattgccat

SEQ ID NO: 121108 - DNA, 22 bp, Artificial Sequence
  chemically synthesized
actttttaatgattgccattct

SEQ ID NO: 121109 - DNA, 22 bp, Artificial Sequence
  chemically synthesized
tttaatgattgccattctaact

SEQ ID NO: 121110 - DNA, 22 bp, Artificial Sequence
  chemically synthesized
ttaatgattgccattctaactg

SEQ ID NO: 121111 - DNA, 22 bp, Artificial Sequence
  chemically synthesized
taatgattgccattctaactgg

SEQ ID NO: 121112 - DNA, 22 bp, Artificial Sequence
  chemically synthesized
aatgattgccattctaactggt

SEQ ID NO: 121113 - DNA, 22 bp, Artificial Sequence
  chemically synthesized
atgattgccattctaactggta

SEQ ID NO: 121114 - DNA, 22 bp, Artificial Sequence
  chemically synthesized
ccattctaactggtatgagatg

SEQ ID NO: 121115 - DNA, 22 bp, Artificial Sequence
  chemically synthesized
taactggtatgagatggtatct

SEQ ID NO: 121116 - DNA, 22 bp, Artificial Sequence
  chemically synthesized
actggtatgagatggtatctca

SEQ ID NO: 121117 - DNA, 22 bp, Artificial Sequence
  chemically synthesized
gtatgagatggtatctcattgt

SEQ ID NO: 121118 - DNA, 22 bp, Artificial Sequence
  chemically synthesized
attgtggttttgatttgcattt

SEQ ID NO: 121119 - DNA, 22 bp, Artificial Sequence
  chemically synthesized
tggttttgatttgcatttctct

SEQ ID NO: 121120 - DNA, 22 bp, Artificial Sequence
  chemically synthesized
tgatttgcatttctctgatggc

SEQ ID NO: 121121 - DNA, 22 bp, Artificial Sequence
  chemically synthesized
gatttgcatttctctgatggcc

SEQ ID NO: 121122 - DNA, 22 bp, Artificial Sequence
  chemically synthesized
atttgcatttctctgatggcca

SEQ ID NO: 121123 - DNA, 22 bp, Artificial Sequence
  chemically synthesized
gcatttctctgatggccagtga

SEQ ID NO: 121124 - DNA, 22 bp, Artificial Sequence
  chemically synthesized
catttctctgatggccagtgat

SEQ ID NO: 121125 - DNA, 22 bp, Artificial Sequence
  chemically synthesized
ctctgatggccagtgatgatga

SEQ ID NO: 121126 - DNA, 22 bp, Artificial Sequence
  chemically synthesized
tctgatggccagtgatgatgag

SEQ ID NO: 121127 - DNA, 22 bp, Artificial Sequence
  chemically synthesized
tgatggccagtgatgatgagca

SEQ ID NO: 121128 - DNA, 22 bp, Artificial Sequence
  chemically synthesized
atggccagtgatgatgagcatt

SEQ ID NO: 121129 - DNA, 22 bp, Artificial Sequence
  chemically synthesized
tttcatgtgtcttttggttgca

SEQ ID NO: 121130 - DNA, 22 bp, Artificial Sequence
  chemically synthesized
ttcatgtgtcttttggttgcat

SEQ ID NO: 121131 - DNA, 22 bp, Artificial Sequence
  chemically synthesized
tcatgtgtcttttggttgcata

SEQ ID NO: 121132 - DNA, 22 bp, Artificial Sequence
  chemically synthesized
catgtgtcttttggttgcataa

SEQ ID NO: 121133 - DNA, 22 bp, Artificial Sequence
  chemically synthesized
atgtgtcttttggttgcataaa

SEQ ID NO: 121134 - DNA, 22 bp, Artificial Sequence
  chemically synthesized
ttggttgcataaatgttttctt

SEQ ID NO: 121135 - DNA, 22 bp, Artificial Sequence
  chemically synthesized
tggttgcataaatgttttcttt

SEQ ID NO: 121136 - DNA, 22 bp, Artificial Sequence
  chemically synthesized
ggttgcataaatgttttctttt

SEQ ID NO: 121137 - DNA, 22 bp, Artificial Sequence
  chemically synthesized
gttgcataaatgttttcttttg

SEQ ID NO: 121138 - DNA, 22 bp, Artificial Sequence
  chemically synthesized
cataaatgttttcttttgagaa

SEQ ID NO: 121139 - DNA, 22 bp, Artificial Sequence
  chemically synthesized
tcttttgagaagtgtctgttca

SEQ ID NO: 121140 - DNA, 22 bp, Artificial Sequence
  chemically synthesized
cttttgagaagtgtctgttcat

SEQ ID NO: 121141 - DNA, 22 bp, Artificial Sequence
  chemically synthesized
ttttgagaagtgtctgttcata

SEQ ID NO: 121142 - DNA, 22 bp, Artificial Sequence
  chemically synthesized
ttgagaagtgtctgttcatatc

SEQ ID NO: 121143 - DNA, 22 bp, Artificial Sequence
  chemically synthesized
tgagaagtgtctgttcatatcc

SEQ ID NO: 121144 - DNA, 22 bp, Artificial Sequence
  chemically synthesized
gagaagtgtctgttcatatcct

SEQ ID NO: 121145 - DNA, 22 bp, Artificial Sequence
  chemically synthesized
agaagtgtctgttcatatcctt

SEQ ID NO: 121146 - DNA, 22 bp, Artificial Sequence
  chemically synthesized
ttcatatcctttgcccacttgt

SEQ ID NO: 121147 - DNA, 22 bp, Artificial Sequence
  chemically synthesized
atatcctttgcccacttgttga

SEQ ID NO: 121148 - DNA, 22 bp, Artificial Sequence
  chemically synthesized
tgcccacttgttgatggggctg

SEQ ID NO: 121149 - DNA, 22 bp, Artificial Sequence
  chemically synthesized
gcccacttgttgatggggctgt

SEQ ID NO: 121150 - DNA, 22 bp, Artificial Sequence
  chemically synthesized
cccacttgttgatggggctgtt

SEQ ID NO: 121151 - DNA, 22 bp, Artificial Sequence
  chemically synthesized
gttgatggggctgtttgttttt

SEQ ID NO: 121152 - DNA, 22 bp, Artificial Sequence
  chemically synthesized
ttgatggggctgtttgtttttt

SEQ ID NO: 121153 - DNA, 22 bp, Artificial Sequence
  chemically synthesized
atggggctgtttgtttttttct

SEQ ID NO: 121154 - DNA, 22 bp, Artificial Sequence
  chemically synthesized
tttgtttttttcttgtaaattt

SEQ ID NO: 121155 - DNA, 22 bp, Artificial Sequence
  chemically synthesized
gtttttttcttgtaaatttgtt

SEQ ID NO: 121156 - DNA, 22 bp, Artificial Sequence
  chemically synthesized
tttttttcttgtaaatttgttt

SEQ ID NO: 121157 - DNA, 22 bp, Artificial Sequence
  chemically synthesized
ttttcttgtaaatttgtttgag

SEQ ID NO: 121158 - DNA, 22 bp, Artificial Sequence
  chemically synthesized
tttcttgtaaatttgtttgagt

SEQ ID NO: 121159 - DNA, 22 bp, Artificial Sequence
  chemically synthesized
ttcttgtaaatttgtttgagtt

SEQ ID NO: 121160 - DNA, 22 bp, Artificial Sequence
  chemically synthesized
tcttgtaaatttgtttgagttc

SEQ ID NO: 121161 - DNA, 22 bp, Artificial Sequence
  chemically synthesized
cttgtaaatttgtttgagttca

SEQ ID NO: 121162 - DNA, 22 bp, Artificial Sequence
  chemically synthesized
ttgtaaatttgtttgagttcat

SEQ ID NO: 121163 - DNA, 22 bp, Artificial Sequence
  chemically synthesized
gtaaatttgtttgagttcatta

SEQ ID NO: 121164 - DNA, 22 bp, Artificial Sequence
  chemically synthesized
taaatttgtttgagttcattat

SEQ ID NO: 121165 - DNA, 22 bp, Artificial Sequence
  chemically synthesized
gtttgagttcattatagattct

SEQ ID NO: 121166 - DNA, 22 bp, Artificial Sequence
  chemically synthesized
tttgagttcattatagattctg

SEQ ID NO: 121167 - DNA, 22 bp, Artificial Sequence
  chemically synthesized
gagttcattatagattctggat

SEQ ID NO: 121168 - DNA, 22 bp, Artificial Sequence
  chemically synthesized
agttcattatagattctggata

SEQ ID NO: 121169 - DNA, 22 bp, Artificial Sequence
  chemically synthesized
attatagattctggatattagc

SEQ ID NO: 121170 - DNA, 22 bp, Artificial Sequence
  chemically synthesized
tagattctggatattagccctt

SEQ ID NO: 121171 - DNA, 22 bp, Artificial Sequence
  chemically synthesized
tggatattagccctttgtcaga

SEQ ID NO: 121172 - DNA, 22 bp, Artificial Sequence
  chemically synthesized
gatattagccctttgtcagatg

SEQ ID NO: 121173 - DNA, 22 bp, Artificial Sequence
  chemically synthesized
gccctttgtcagatgagtaggt

SEQ ID NO: 121174 - DNA, 22 bp, Artificial Sequence
  chemically synthesized
tgtcagatgagtaggttgtgaa

SEQ ID NO: 121175 - DNA, 22 bp, Artificial Sequence
  chemically synthesized
gtcagatgagtaggttgtgaaa

SEQ ID NO: 121176 - DNA, 22 bp, Artificial Sequence
  chemically synthesized
tcagatgagtaggttgtgaaaa

SEQ ID NO: 121177 - DNA, 22 bp, Artificial Sequence
  chemically synthesized
tgaaaattttctcccattgtgt

SEQ ID NO: 121178 - DNA, 22 bp, Artificial Sequence
  chemically synthesized
tctcccattgtgtaggttgcct

SEQ ID NO: 121179 - DNA, 22 bp, Artificial Sequence
  chemically synthesized
ctcccattgtgtaggttgcctg

SEQ ID NO: 121180 - DNA, 22 bp, Artificial Sequence
  chemically synthesized
tcccattgtgtaggttgcctgt

SEQ ID NO: 121181 - DNA, 22 bp, Artificial Sequence
  chemically synthesized
ccattgtgtaggttgcctgttc

SEQ ID NO: 121182 - DNA, 22 bp, Artificial Sequence
  chemically synthesized
tgtaggttgcctgttcactctg

SEQ ID NO: 121183 - DNA, 22 bp, Artificial Sequence
  chemically synthesized
cctgttcactctgatggtagtt

SEQ ID NO: 121184 - DNA, 22 bp, Artificial Sequence
  chemically synthesized
ttcactctgatggtagtttctt

SEQ ID NO: 121185 - DNA, 22 bp, Artificial Sequence
  chemically synthesized
actctgatggtagtttctttag

SEQ ID NO: 121186 - DNA, 22 bp, Artificial Sequence
  chemically synthesized
tgatggtagtttctttagctgt

SEQ ID NO: 121187 - DNA, 22 bp, Artificial Sequence
  chemically synthesized
atggtagtttctttagctgtgc

SEQ ID NO: 121188 - DNA, 22 bp, Artificial Sequence
  chemically synthesized
ctttagctgtgcagaagctctt

SEQ ID NO: 121189 - DNA, 22 bp, Artificial Sequence
  chemically synthesized
tttagctgtgcagaagctcttt

SEQ ID NO: 121190 - DNA, 22 bp, Artificial Sequence
  chemically synthesized
tagctgtgcagaagctctttag

SEQ ID NO: 121191 - DNA, 22 bp, Artificial Sequence
  chemically synthesized
agctgtgcagaagctctttagt

SEQ ID NO: 121192 - DNA, 22 bp, Artificial Sequence
  chemically synthesized
gctgtgcagaagctctttagtt

SEQ ID NO: 121193 - DNA, 22 bp, Artificial Sequence
  chemically synthesized
tgcagaagctctttagtttcat

SEQ ID NO: 121194 - DNA, 22 bp, Artificial Sequence
  chemically synthesized
tttagtttcattagatcccatt

SEQ ID NO: 121195 - DNA, 22 bp, Artificial Sequence
  chemically synthesized
tagtttcattagatcccattag

SEQ ID NO: 121196 - DNA, 22 bp, Artificial Sequence
  chemically synthesized
agtttcattagatcccattagt

SEQ ID NO: 121197 - DNA, 22 bp, Artificial Sequence
  chemically synthesized
gtttcattagatcccattagtg

SEQ ID NO: 121198 - DNA, 22 bp, Artificial Sequence
  chemically synthesized
cattagatcccattagtgaatt

SEQ ID NO: 121199 - DNA, 22 bp, Artificial Sequence
  chemically synthesized
attagatcccattagtgaattt

SEQ ID NO: 121200 - DNA, 22 bp, Artificial Sequence
  chemically synthesized
gatcccattagtgaattttggc

SEQ ID NO: 121201 - DNA, 22 bp, Artificial Sequence
  chemically synthesized
gtgaattttggcttttgttgcc

SEQ ID NO: 121202 - DNA, 22 bp, Artificial Sequence
  chemically synthesized
tggcttttgttgccatcgcttt

SEQ ID NO: 121203 - DNA, 22 bp, Artificial Sequence
  chemically synthesized
ggcttttgttgccatcgctttt

SEQ ID NO: 121204 - DNA, 22 bp, Artificial Sequence
  chemically synthesized
gcttttgttgccatcgcttttg

SEQ ID NO: 121205 - DNA, 22 bp, Artificial Sequence
  chemically synthesized
ttgttgccatcgcttttggtgt

SEQ ID NO: 121206 - DNA, 22 bp, Artificial Sequence
  chemically synthesized
tgttgccatcgcttttggtgtt

SEQ ID NO: 121207 - DNA, 22 bp, Artificial Sequence
  chemically synthesized
gttgccatcgcttttggtgttt

SEQ ID NO: 121208 - DNA, 22 bp, Artificial Sequence
  chemically synthesized
ttgccatcgcttttggtgtttt

SEQ ID NO: 121209 - DNA, 22 bp, Artificial Sequence
  chemically synthesized
ccatcgcttttggtgttttaga

SEQ ID NO: 121210 - DNA, 22 bp, Artificial Sequence
  chemically synthesized
ttggtgttttagacatgaagtc

SEQ ID NO: 121211 - DNA, 22 bp, Artificial Sequence
  chemically synthesized
tggtgttttagacatgaagtcc

SEQ ID NO: 121212 - DNA, 22 bp, Artificial Sequence
  chemically synthesized
ggtgttttagacatgaagtcct

SEQ ID NO: 121213 - DNA, 22 bp, Artificial Sequence
  chemically synthesized
gtgttttagacatgaagtcctt

SEQ ID NO: 121214 - DNA, 22 bp, Artificial Sequence
  chemically synthesized
tagacatgaagtccttgcccat

SEQ ID NO: 121215 - DNA, 22 bp, Artificial Sequence
  chemically synthesized
agacatgaagtccttgcccatg

SEQ ID NO: 121216 - DNA, 22 bp, Artificial Sequence
  chemically synthesized
gacatgaagtccttgcccatgc

SEQ ID NO: 121217 - DNA, 22 bp, Artificial Sequence
  chemically synthesized
gcccatgcctatgtcctgaatg

SEQ ID NO: 121218 - DNA, 22 bp, Artificial Sequence
  chemically synthesized
cccatgcctatgtcctgaatgg

SEQ ID NO: 121219 - DNA, 22 bp, Artificial Sequence
  chemically synthesized
tgtcctgaatggtaatgcctgc

SEQ ID NO: 121220 - DNA, 22 bp, Artificial Sequence
  chemically synthesized
aatggtaatgcctgcgttttct

SEQ ID NO: 121221 - DNA, 22 bp, Artificial Sequence
  chemically synthesized
cgttttcttctagggtttttat

SEQ ID NO: 121222 - DNA, 22 bp, Artificial Sequence
  chemically synthesized
tcttctagggtttttatggttt

SEQ ID NO: 121223 - DNA, 22 bp, Artificial Sequence
  chemically synthesized
cttctagggtttttatggtttt

SEQ ID NO: 121224 - DNA, 22 bp, Artificial Sequence
  chemically synthesized
ttctagggtttttatggtttta

SEQ ID NO: 121225 - DNA, 22 bp, Artificial Sequence
  chemically synthesized
ctagggtttttatggttttagg

SEQ ID NO: 121226 - DNA, 22 bp, Artificial Sequence
  chemically synthesized
tagggtttttatggttttaggt

SEQ ID NO: 121227 - DNA, 22 bp, Artificial Sequence
  chemically synthesized
gggtttttatggttttaggtct

SEQ ID NO: 121228 - DNA, 22 bp, Artificial Sequence
  chemically synthesized
ttatggttttaggtctaatgtt

SEQ ID NO: 121229 - DNA, 22 bp, Artificial Sequence
  chemically synthesized
tatggttttaggtctaatgttt

SEQ ID NO: 121230 - DNA, 22 bp, Artificial Sequence
  chemically synthesized
atggttttaggtctaatgttta

SEQ ID NO: 121231 - DNA, 22 bp, Artificial Sequence
  chemically synthesized
tggttttaggtctaatgtttaa

SEQ ID NO: 121232 - DNA, 22 bp, Artificial Sequence
  chemically synthesized
taggtctaatgtttaagtcttt

SEQ ID NO: 121233 - DNA, 22 bp, Artificial Sequence
  chemically synthesized
aggtctaatgtttaagtcttta

SEQ ID NO: 121234 - DNA, 22 bp, Artificial Sequence
  chemically synthesized
ggtctaatgtttaagtctttaa

SEQ ID NO: 121235 - DNA, 22 bp, Artificial Sequence
  chemically synthesized
atgtttaagtctttaatccatc

SEQ ID NO: 121236 - DNA, 22 bp, Artificial Sequence
  chemically synthesized
aagtctttaatccatcttgaat

SEQ ID NO: 121237 - DNA, 22 bp, Artificial Sequence
  chemically synthesized
agtctttaatccatcttgaatt

SEQ ID NO: 121238 - DNA, 22 bp, Artificial Sequence
  chemically synthesized
taatccatcttgaattaatttt

SEQ ID NO: 121239 - DNA, 22 bp, Artificial Sequence
  chemically synthesized
aatccatcttgaattaattttt

SEQ ID NO: 121240 - DNA, 22 bp, Artificial Sequence
  chemically synthesized
atccatcttgaattaatttttg

SEQ ID NO: 121241 - DNA, 22 bp, Artificial Sequence
  chemically synthesized
gaattaatttttgtataaggtg

SEQ ID NO: 121242 - DNA, 22 bp, Artificial Sequence
  chemically synthesized
aattaatttttgtataaggtgt

SEQ ID NO: 121243 - DNA, 22 bp, Artificial Sequence
  chemically synthesized
atttttgtataaggtgtaagga

SEQ ID NO: 121244 - DNA, 22 bp, Artificial Sequence
  chemically synthesized
ttgtataaggtgtaaggaaggg

SEQ ID NO: 121245 - DNA, 22 bp, Artificial Sequence
  chemically synthesized
tgtataaggtgtaaggaaggga

SEQ ID NO: 121246 - DNA, 22 bp, Artificial Sequence
  chemically synthesized
gtataaggtgtaaggaagggat

SEQ ID NO: 121247 - DNA, 22 bp, Artificial Sequence
  chemically synthesized
tataaggtgtaaggaagggatc

SEQ ID NO: 121248 - DNA, 22 bp, Artificial Sequence
  chemically synthesized
cagcattctacatatggctagc

SEQ ID NO: 121249 - DNA, 22 bp, Artificial Sequence
  chemically synthesized
agcattctacatatggctagcc

SEQ ID NO: 121250 - DNA, 22 bp, Artificial Sequence
  chemically synthesized
tacatatggctagccagttctc

SEQ ID NO: 121251 - DNA, 22 bp, Artificial Sequence
  chemically synthesized
catatggctagccagttctccc

SEQ ID NO: 121252 - DNA, 22 bp, Artificial Sequence
  chemically synthesized
gccagttctcccagcaccattt

SEQ ID NO: 121253 - DNA, 22 bp, Artificial Sequence
  chemically synthesized
tcccagcaccatttattaaata

SEQ ID NO: 121254 - DNA, 22 bp, Artificial Sequence
  chemically synthesized
ccagcaccatttattaaatagg

SEQ ID NO: 121255 - DNA, 22 bp, Artificial Sequence
  chemically synthesized
attaaatagggaatcctttccc

SEQ ID NO: 121256 - DNA, 22 bp, Artificial Sequence
  chemically synthesized
ttaaatagggaatcctttcccc

SEQ ID NO: 121257 - DNA, 22 bp, Artificial Sequence
  chemically synthesized
aatagggaatcctttccccatt

SEQ ID NO: 121258 - DNA, 22 bp, Artificial Sequence
  chemically synthesized
tccccatttcttgtttttctca

SEQ ID NO: 121259 - DNA, 22 bp, Artificial Sequence
  chemically synthesized
ccccatttcttgtttttctcag

SEQ ID NO: 121260 - DNA, 22 bp, Artificial Sequence
  chemically synthesized
cccatttcttgtttttctcagg

SEQ ID NO: 121261 - DNA, 22 bp, Artificial Sequence
  chemically synthesized
cttgtttttctcaggtttttca

SEQ ID NO: 121262 - DNA, 22 bp, Artificial Sequence
  chemically synthesized
ttgtttttctcaggtttttcaa

SEQ ID NO: 121263 - DNA, 22 bp, Artificial Sequence
  chemically synthesized
gtttttctcaggtttttcaaag

SEQ ID NO: 121264 - DNA, 22 bp, Artificial Sequence
  chemically synthesized
tttttctcaggtttttcaaaga

SEQ ID NO: 121265 - DNA, 22 bp, Artificial Sequence
  chemically synthesized
ttctcaggtttttcaaagatca

SEQ ID NO: 121266 - DNA, 22 bp, Artificial Sequence
  chemically synthesized
tctcaggtttttcaaagatcag

SEQ ID NO: 121267 - DNA, 22 bp, Artificial Sequence
  chemically synthesized
ctcaggtttttcaaagatcaga

SEQ ID NO: 121268 - DNA, 22 bp, Artificial Sequence
  chemically synthesized
tcaggtttttcaaagatcagat

SEQ ID NO: 121269 - DNA, 22 bp, Artificial Sequence
  chemically synthesized
aggtttttcaaagatcagatag

SEQ ID NO: 121270 - DNA, 22 bp, Artificial Sequence
  chemically synthesized
ttcaaagatcagatagttgtag

SEQ ID NO: 121271 - DNA, 22 bp, Artificial Sequence
  chemically synthesized
tcaaagatcagatagttgtaga

SEQ ID NO: 121272 - DNA, 22 bp, Artificial Sequence
  chemically synthesized
caaagatcagatagttgtagat

SEQ ID NO: 121273 - DNA, 22 bp, Artificial Sequence
  chemically synthesized
aaagatcagatagttgtagata

SEQ ID NO: 121274 - DNA, 22 bp, Artificial Sequence
  chemically synthesized
tagatatgcgtcgttatttctg

SEQ ID NO: 121275 - DNA, 22 bp, Artificial Sequence
  chemically synthesized
tttctgagggctctgttctgtt

SEQ ID NO: 121276 - DNA, 22 bp, Artificial Sequence
  chemically synthesized
ctgagggctctgttctgttcca

SEQ ID NO: 121277 - DNA, 22 bp, Artificial Sequence
  chemically synthesized
tgagggctctgttctgttccat

SEQ ID NO: 121278 - DNA, 22 bp, Artificial Sequence
  chemically synthesized
agggctctgttctgttccattg

SEQ ID NO: 121279 - DNA, 22 bp, Artificial Sequence
  chemically synthesized
tgttctgttccattgatctata

SEQ ID NO: 121280 - DNA, 22 bp, Artificial Sequence
  chemically synthesized
ttctgttccattgatctatatc

SEQ ID NO: 121281 - DNA, 22 bp, Artificial Sequence
  chemically synthesized
tgttccattgatctatatctgt

SEQ ID NO: 121282 - DNA, 22 bp, Artificial Sequence
  chemically synthesized
ttccattgatctatatctgtgt

SEQ ID NO: 121283 - DNA, 22 bp, Artificial Sequence
  chemically synthesized
cattgatctatatctgtgtttt

SEQ ID NO: 121284 - DNA, 22 bp, Artificial Sequence
  chemically synthesized
atctatatctgtgttttggtac

SEQ ID NO: 121285 - DNA, 22 bp, Artificial Sequence
  chemically synthesized
tatctgtgttttggtaccagta

SEQ ID NO: 121286 - DNA, 22 bp, Artificial Sequence
  chemically synthesized
tgttttggtaccagtaacatgc

SEQ ID NO: 121287 - DNA, 22 bp, Artificial Sequence
  chemically synthesized
tggtaccagtaacatgctgttt

SEQ ID NO: 121288 - DNA, 22 bp, Artificial Sequence
  chemically synthesized
ggtaccagtaacatgctgtttt

SEQ ID NO: 121289 - DNA, 22 bp, Artificial Sequence
  chemically synthesized
gtaccagtaacatgctgttttg

SEQ ID NO: 121290 - DNA, 22 bp, Artificial Sequence
  chemically synthesized
ttttggttactgtagccttgta

SEQ ID NO: 121291 - DNA, 22 bp, Artificial Sequence
  chemically synthesized
tggttactgtagccttgtagta

SEQ ID NO: 121292 - DNA, 22 bp, Artificial Sequence
  chemically synthesized
ggttactgtagccttgtagtat

SEQ ID NO: 121293 - DNA, 22 bp, Artificial Sequence
  chemically synthesized
gttactgtagccttgtagtata

SEQ ID NO: 121294 - DNA, 22 bp, Artificial Sequence
  chemically synthesized
ctgtagccttgtagtatagttt

SEQ ID NO: 121295 - DNA, 22 bp, Artificial Sequence
  chemically synthesized
tagccttgtagtatagtttgaa

SEQ ID NO: 121296 - DNA, 22 bp, Artificial Sequence
  chemically synthesized
gtagtatagtttgaagtgaggt

SEQ ID NO: 121297 - DNA, 22 bp, Artificial Sequence
  chemically synthesized
tagtatagtttgaagtgaggta

SEQ ID NO: 121298 - DNA, 22 bp, Artificial Sequence
  chemically synthesized
gaagtgaggtagcctgatgcct

SEQ ID NO: 121299 - DNA, 22 bp, Artificial Sequence
  chemically synthesized
aagtgaggtagcctgatgcctc

SEQ ID NO: 121300 - DNA, 22 bp, Artificial Sequence
  chemically synthesized
atgcctccagctttgttctttt

SEQ ID NO: 121301 - DNA, 22 bp, Artificial Sequence
  chemically synthesized
cagctttgttcttttggcttag

SEQ ID NO: 121302 - DNA, 22 bp, Artificial Sequence
  chemically synthesized
tgttcttttggcttaggattga

SEQ ID NO: 121303 - DNA, 22 bp, Artificial Sequence
  chemically synthesized
gttcttttggcttaggattgac

SEQ ID NO: 121304 - DNA, 22 bp, Artificial Sequence
  chemically synthesized
ttcttttggcttaggattgact

SEQ ID NO: 121305 - DNA, 22 bp, Artificial Sequence
  chemically synthesized
ttttggcttaggattgacttgg

SEQ ID NO: 121306 - DNA, 22 bp, Artificial Sequence
  chemically synthesized
ttggcttaggattgacttggca

SEQ ID NO: 121307 - DNA, 22 bp, Artificial Sequence
  chemically synthesized
tggcttaggattgacttggcaa

SEQ ID NO: 121308 - DNA, 22 bp, Artificial Sequence
  chemically synthesized
ggcttaggattgacttggcaat

SEQ ID NO: 121309 - DNA, 22 bp, Artificial Sequence
  chemically synthesized
gcttaggattgacttggcaatg

SEQ ID NO: 121310 - DNA, 22 bp, Artificial Sequence
  chemically synthesized
aggattgacttggcaatgcagg

SEQ ID NO: 121311 - DNA, 22 bp, Artificial Sequence
  chemically synthesized
ggattgacttggcaatgcaggc

SEQ ID NO: 121312 - DNA, 22 bp, Artificial Sequence
  chemically synthesized
acttggcaatgcaggctctttt

SEQ ID NO: 121313 - DNA, 22 bp, Artificial Sequence
  chemically synthesized
ggcaatgcaggctcttttttgg

SEQ ID NO: 121314 - DNA, 22 bp, Artificial Sequence
  chemically synthesized
gcaatgcaggctcttttttggt

SEQ ID NO: 121315 - DNA, 22 bp, Artificial Sequence
  chemically synthesized
ttttttggttccatatgaactt

SEQ ID NO: 121316 - DNA, 22 bp, Artificial Sequence
  chemically synthesized
ttttggttccatatgaacttta

SEQ ID NO: 121317 - DNA, 22 bp, Artificial Sequence
  chemically synthesized
tttggttccatatgaactttaa

SEQ ID NO: 121318 - DNA, 22 bp, Artificial Sequence
  chemically synthesized
ttggttccatatgaactttaaa

SEQ ID NO: 121319 - DNA, 22 bp, Artificial Sequence
  chemically synthesized
tggttccatatgaactttaaag

SEQ ID NO: 121320 - DNA, 22 bp, Artificial Sequence
  chemically synthesized
ggttccatatgaactttaaagt

SEQ ID NO: 121321 - DNA, 22 bp, Artificial Sequence
  chemically synthesized
gttccatatgaactttaaagtc

SEQ ID NO: 121322 - DNA, 22 bp, Artificial Sequence
  chemically synthesized
catatgaactttaaagtcgttt

SEQ ID NO: 121323 - DNA, 22 bp, Artificial Sequence
  chemically synthesized
taaagtcgtttttccaattctg

SEQ ID NO: 121324 - DNA, 22 bp, Artificial Sequence
  chemically synthesized
aaagtcgtttttccaattctgt

SEQ ID NO: 121325 - DNA, 22 bp, Artificial Sequence
  chemically synthesized
aagtcgtttttccaattctgtg

SEQ ID NO: 121326 - DNA, 22 bp, Artificial Sequence
  chemically synthesized
ttccaattctgtgaagaaaatc

SEQ ID NO: 121327 - DNA, 22 bp, Artificial Sequence
  chemically synthesized
tccaattctgtgaagaaaatca

SEQ ID NO: 121328 - DNA, 22 bp, Artificial Sequence
  chemically synthesized
ccaattctgtgaagaaaatcat

SEQ ID NO: 121329 - DNA, 22 bp, Artificial Sequence
  chemically synthesized
caattctgtgaagaaaatcatt

SEQ ID NO: 121330 - DNA, 22 bp, Artificial Sequence
  chemically synthesized
tgtgaagaaaatcattggtagc

SEQ ID NO: 121331 - DNA, 22 bp, Artificial Sequence
  chemically synthesized
tgaagaaaatcattggtagctt

SEQ ID NO: 121332 - DNA, 22 bp, Artificial Sequence
  chemically synthesized
gtagcttgatggggatggcatt

SEQ ID NO: 121333 - DNA, 22 bp, Artificial Sequence
  chemically synthesized
gatggggatggcattgaatcta

SEQ ID NO: 121334 - DNA, 22 bp, Artificial Sequence
  chemically synthesized
atggggatggcattgaatctat

SEQ ID NO: 121335 - DNA, 22 bp, Artificial Sequence
  chemically synthesized
aatctataaattaccttgggca

SEQ ID NO: 121336 - DNA, 22 bp, Artificial Sequence
  chemically synthesized
taaattaccttgggcattatgg

SEQ ID NO: 121337 - DNA, 22 bp, Artificial Sequence
  chemically synthesized
ccttgggcattatggccatttt

SEQ ID NO: 121338 - DNA, 22 bp, Artificial Sequence
  chemically synthesized
gggcattatggccattttgatg

SEQ ID NO: 121339 - DNA, 22 bp, Artificial Sequence
  chemically synthesized
ggcattatggccattttgatga

SEQ ID NO: 121340 - DNA, 22 bp, Artificial Sequence
  chemically synthesized
tggccattttgatgatattgat

SEQ ID NO: 121341 - DNA, 22 bp, Artificial Sequence
  chemically synthesized
tgatgatattgattcttcctac

SEQ ID NO: 121342 - DNA, 22 bp, Artificial Sequence
  chemically synthesized
gatgatattgattcttcctacc

SEQ ID NO: 121343 - DNA, 22 bp, Artificial Sequence
  chemically synthesized
atgatattgattcttcctaccc

SEQ ID NO: 121344 - DNA, 22 bp, Artificial Sequence
  chemically synthesized
attcttcctacccataagcatg

SEQ ID NO: 121345 - DNA, 22 bp, Artificial Sequence
  chemically synthesized
ttcctacccataagcatggaat

SEQ ID NO: 121346 - DNA, 22 bp, Artificial Sequence
  chemically synthesized
cctacccataagcatggaatgt

SEQ ID NO: 121347 - DNA, 22 bp, Artificial Sequence
  chemically synthesized
ctacccataagcatggaatgtt

SEQ ID NO: 121348 - DNA, 22 bp, Artificial Sequence
  chemically synthesized
cccataagcatggaatgttctt

SEQ ID NO: 121349 - DNA, 22 bp, Artificial Sequence
  chemically synthesized
ttccatttgtttgtatcttctt

SEQ ID NO: 121350 - DNA, 22 bp, Artificial Sequence
  chemically synthesized
ccatttgtttgtatcttctttt

SEQ ID NO: 121351 - DNA, 22 bp, Artificial Sequence
  chemically synthesized
catttgtttgtatcttctttta

SEQ ID NO: 121352 - DNA, 22 bp, Artificial Sequence
  chemically synthesized
gtttgtatcttcttttatttca

SEQ ID NO: 121353 - DNA, 22 bp, Artificial Sequence
  chemically synthesized
tttgtatcttcttttatttcat

SEQ ID NO: 121354 - DNA, 22 bp, Artificial Sequence
  chemically synthesized
gtatcttcttttatttcattga

SEQ ID NO: 121355 - DNA, 22 bp, Artificial Sequence
  chemically synthesized
tatcttcttttatttcattgag

SEQ ID NO: 121356 - DNA, 22 bp, Artificial Sequence
  chemically synthesized
cttttatttcattgagcagtgg

SEQ ID NO: 121357 - DNA, 22 bp, Artificial Sequence
  chemically synthesized
ttttatttcattgagcagtggt

SEQ ID NO: 121358 - DNA, 22 bp, Artificial Sequence
  chemically synthesized
ttatttcattgagcagtggttt

SEQ ID NO: 121359 - DNA, 22 bp, Artificial Sequence
  chemically synthesized
tatttcattgagcagtggtttg

SEQ ID NO: 121360 - DNA, 22 bp, Artificial Sequence
  chemically synthesized
atttcattgagcagtggtttgt

SEQ ID NO: 121361 - DNA, 22 bp, Artificial Sequence
  chemically synthesized
tttcattgagcagtggtttgta

SEQ ID NO: 121362 - DNA, 22 bp, Artificial Sequence
  chemically synthesized
cattgagcagtggtttgtagtt

SEQ ID NO: 121363 - DNA, 22 bp, Artificial Sequence
  chemically synthesized
attgagcagtggtttgtagttc

SEQ ID NO: 121364 - DNA, 22 bp, Artificial Sequence
  chemically synthesized
agcagtggtttgtagttctcct

SEQ ID NO: 121365 - DNA, 22 bp, Artificial Sequence
  chemically synthesized
gtagttctccttgaagaggtcc

SEQ ID NO: 121366 - DNA, 22 bp, Artificial Sequence
  chemically synthesized
tagttctccttgaagaggtcct

SEQ ID NO: 121367 - DNA, 22 bp, Artificial Sequence
  chemically synthesized
tccttgaagaggtccttcacat

SEQ ID NO: 121368 - DNA, 22 bp, Artificial Sequence
  chemically synthesized
cttgaagaggtccttcacatcc

SEQ ID NO: 121369 - DNA, 22 bp, Artificial Sequence
  chemically synthesized
gaagaggtccttcacatccctt

SEQ ID NO: 121370 - DNA, 22 bp, Artificial Sequence
  chemically synthesized
aagaggtccttcacatcccttg

SEQ ID NO: 121371 - DNA, 22 bp, Artificial Sequence
  chemically synthesized
cacatcccttgtaagttggatt

SEQ ID NO: 121372 - DNA, 22 bp, Artificial Sequence
  chemically synthesized
acatcccttgtaagttggattc

SEQ ID NO: 121373 - DNA, 22 bp, Artificial Sequence
  chemically synthesized
gtaagttggattcctaggtatt

SEQ ID NO: 121374 - DNA, 22 bp, Artificial Sequence
  chemically synthesized
taagttggattcctaggtattt

SEQ ID NO: 121375 - DNA, 22 bp, Artificial Sequence
  chemically synthesized
gattcctaggtattttattctc

SEQ ID NO: 121376 - DNA, 22 bp, Artificial Sequence
  chemically synthesized
ctaggtattttattctctttga

SEQ ID NO: 121377 - DNA, 22 bp, Artificial Sequence
  chemically synthesized
ggtattttattctctttgaagc

SEQ ID NO: 121378 - DNA, 22 bp, Artificial Sequence
  chemically synthesized
tattctctttgaagcaattgtg

SEQ ID NO: 121379 - DNA, 22 bp, Artificial Sequence
  chemically synthesized
attctctttgaagcaattgtga

SEQ ID NO: 121380 - DNA, 22 bp, Artificial Sequence
  chemically synthesized
ttctctttgaagcaattgtgaa

SEQ ID NO: 121381 - DNA, 22 bp, Artificial Sequence
  chemically synthesized
tctttgaagcaattgtgaatgg

SEQ ID NO: 121382 - DNA, 22 bp, Artificial Sequence
  chemically synthesized
tttgaagcaattgtgaatggga

SEQ ID NO: 121383 - DNA, 22 bp, Artificial Sequence
  chemically synthesized
tgaagcaattgtgaatgggagt

SEQ ID NO: 121384 - DNA, 22 bp, Artificial Sequence
  chemically synthesized
gaagcaattgtgaatgggagtt

SEQ ID NO: 121385 - DNA, 22 bp, Artificial Sequence
  chemically synthesized
aagcaattgtgaatgggagttc

SEQ ID NO: 121386 - DNA, 22 bp, Artificial Sequence
  chemically synthesized
tgaatgggagttccctcatgat

SEQ ID NO: 121387 - DNA, 22 bp, Artificial Sequence
  chemically synthesized
cctcatgatttggctctctgtt

SEQ ID NO: 121388 - DNA, 22 bp, Artificial Sequence
  chemically synthesized
atgatttggctctctgtttgtc

SEQ ID NO: 121389 - DNA, 22 bp, Artificial Sequence
  chemically synthesized
ggctctctgtttgtctgttatt

SEQ ID NO: 121390 - DNA, 22 bp, Artificial Sequence
  chemically synthesized
gctctctgtttgtctgttattg

SEQ ID NO: 121391 - DNA, 22 bp, Artificial Sequence
  chemically synthesized
tctgtttgtctgttattggtgt

SEQ ID NO: 121392 - DNA, 22 bp, Artificial Sequence
  chemically synthesized
tgtttgtctgttattggtgtat

SEQ ID NO: 121393 - DNA, 22 bp, Artificial Sequence
  chemically synthesized
tttgtctgttattggtgtataa

SEQ ID NO: 121394 - DNA, 22 bp, Artificial Sequence
  chemically synthesized
gtctgttattggtgtataagaa

SEQ ID NO: 121395 - DNA, 22 bp, Artificial Sequence
  chemically synthesized
tctgttattggtgtataagaat

SEQ ID NO: 121396 - DNA, 22 bp, Artificial Sequence
  chemically synthesized
ttattggtgtataagaatgctt

SEQ ID NO: 121397 - DNA, 22 bp, Artificial Sequence
  chemically synthesized
ttggtgtataagaatgcttgtg

SEQ ID NO: 121398 - DNA, 22 bp, Artificial Sequence
  chemically synthesized
gtgtataagaatgcttgtgatt

SEQ ID NO: 121399 - DNA, 22 bp, Artificial Sequence
  chemically synthesized
gtgatttttgcacattggtttt

SEQ ID NO: 121400 - DNA, 22 bp, Artificial Sequence
  chemically synthesized
tgatttttgcacattggttttg

SEQ ID NO: 121401 - DNA, 22 bp, Artificial Sequence
  chemically synthesized
ttgcacattggttttgtatcct

SEQ ID NO: 121402 - DNA, 22 bp, Artificial Sequence
  chemically synthesized
tgcacattggttttgtatcctg

SEQ ID NO: 121403 - DNA, 22 bp, Artificial Sequence
  chemically synthesized
gcacattggttttgtatcctga

SEQ ID NO: 121404 - DNA, 22 bp, Artificial Sequence
  chemically synthesized
cacattggttttgtatcctgag

SEQ ID NO: 121405 - DNA, 22 bp, Artificial Sequence
  chemically synthesized
gttttgtatcctgaggctttgc

SEQ ID NO: 121406 - DNA, 22 bp, Artificial Sequence
  chemically synthesized
tgtatcctgaggctttgctgaa

SEQ ID NO: 121407 - DNA, 22 bp, Artificial Sequence
  chemically synthesized
gtatcctgaggctttgctgaag

SEQ ID NO: 121408 - DNA, 22 bp, Artificial Sequence
  chemically synthesized
tatcctgaggctttgctgaagt

SEQ ID NO: 121409 - DNA, 22 bp, Artificial Sequence
  chemically synthesized
aggctttgctgaagttgcttat

SEQ ID NO: 121410 - DNA, 22 bp, Artificial Sequence
  chemically synthesized
tgctgaagttgcttatcagctt

SEQ ID NO: 121411 - DNA, 22 bp, Artificial Sequence
  chemically synthesized
gctgaagttgcttatcagctta

SEQ ID NO: 121412 - DNA, 22 bp, Artificial Sequence
  chemically synthesized
ctgaagttgcttatcagcttaa

SEQ ID NO: 121413 - DNA, 22 bp, Artificial Sequence
  chemically synthesized
aagttgcttatcagcttaagga

SEQ ID NO: 121414 - DNA, 22 bp, Artificial Sequence
  chemically synthesized
cttatcagcttaaggagatttt

SEQ ID NO: 121415 - DNA, 22 bp, Artificial Sequence
  chemically synthesized
atcagcttaaggagattttggg

SEQ ID NO: 121416 - DNA, 22 bp, Artificial Sequence
  chemically synthesized
tcagcttaaggagattttgggc

SEQ ID NO: 121417 - DNA, 22 bp, Artificial Sequence
  chemically synthesized
aaggagattttgggctgagaca

SEQ ID NO: 121418 - DNA, 22 bp, Artificial Sequence
  chemically synthesized
aggagattttgggctgagacaa

SEQ ID NO: 121419 - DNA, 22 bp, Artificial Sequence
  chemically synthesized
tgggctgagacaagggggtttt

SEQ ID NO: 121420 - DNA, 22 bp, Artificial Sequence
  chemically synthesized
gggctgagacaagggggttttc

SEQ ID NO: 121421 - DNA, 22 bp, Artificial Sequence
  chemically synthesized
ggctgagacaagggggttttct

SEQ ID NO: 121422 - DNA, 22 bp, Artificial Sequence
  chemically synthesized
agacaagggggttttctagata

SEQ ID NO: 121423 - DNA, 22 bp, Artificial Sequence
  chemically synthesized
tctagatatacaatcatgtcgt

SEQ ID NO: 121424 - DNA, 22 bp, Artificial Sequence
  chemically synthesized
ctagatatacaatcatgtcgtc

SEQ ID NO: 121425 - DNA, 22 bp, Artificial Sequence
  chemically synthesized
tagatatacaatcatgtcgtct

SEQ ID NO: 121426 - DNA, 22 bp, Artificial Sequence
  chemically synthesized
gatatacaatcatgtcgtctgc

SEQ ID NO: 121427 - DNA, 22 bp, Artificial Sequence
  chemically synthesized
caaacagggacaatttgacttc

SEQ ID NO: 121428 - DNA, 22 bp, Artificial Sequence
  chemically synthesized
gacttcctcttttcttaattga

SEQ ID NO: 121429 - DNA, 22 bp, Artificial Sequence
  chemically synthesized
acttcctcttttcttaattgaa

SEQ ID NO: 121430 - DNA, 22 bp, Artificial Sequence
  chemically synthesized
cctcttttcttaattgaatacc

SEQ ID NO: 121431 - DNA, 22 bp, Artificial Sequence
  chemically synthesized
ctcttttcttaattgaataccc

SEQ ID NO: 121432 - DNA, 22 bp, Artificial Sequence
  chemically synthesized
ttttcttaattgaatacccttt

SEQ ID NO: 121433 - DNA, 22 bp, Artificial Sequence
  chemically synthesized
ttcttaattgaatacccttttt

SEQ ID NO: 121434 - DNA, 22 bp, Artificial Sequence
  chemically synthesized
tcttaattgaataccctttttt

SEQ ID NO: 121435 - DNA, 22 bp, Artificial Sequence
  chemically synthesized
cttaattgaatacccttttttc

SEQ ID NO: 121436 - DNA, 22 bp, Artificial Sequence
  chemically synthesized
ttaattgaatacccttttttcc

SEQ ID NO: 121437 - DNA, 22 bp, Artificial Sequence
  chemically synthesized
aattgaatacccttttttcctg

SEQ ID NO: 121438 - DNA, 22 bp, Artificial Sequence
  chemically synthesized
attgaatacccttttttcctgt

SEQ ID NO: 121439 - DNA, 22 bp, Artificial Sequence
  chemically synthesized
aatacccttttttcctgtcttc

SEQ ID NO: 121440 - DNA, 22 bp, Artificial Sequence
  chemically synthesized
ttttcctgtcttctgcctaatt

SEQ ID NO: 121441 - DNA, 22 bp, Artificial Sequence
  chemically synthesized
tttcctgtcttctgcctaattg

SEQ ID NO: 121442 - DNA, 22 bp, Artificial Sequence
  chemically synthesized
ttcctgtcttctgcctaattgc

SEQ ID NO: 121443 - DNA, 22 bp, Artificial Sequence
  chemically synthesized
tcctgtcttctgcctaattgcc

SEQ ID NO: 121444 - DNA, 22 bp, Artificial Sequence
  chemically synthesized
cctgtcttctgcctaattgccc

SEQ ID NO: 121445 - DNA, 22 bp, Artificial Sequence
  chemically synthesized
ctgtcttctgcctaattgccct

SEQ ID NO: 121446 - DNA, 22 bp, Artificial Sequence
  chemically synthesized
tcttctgcctaattgccctggc

SEQ ID NO: 121447 - DNA, 22 bp, Artificial Sequence
  chemically synthesized
ctgcctaattgccctggccaga

SEQ ID NO: 121448 - DNA, 22 bp, Artificial Sequence
  chemically synthesized
tgcctaattgccctggccagaa

SEQ ID NO: 121449 - DNA, 22 bp, Artificial Sequence
  chemically synthesized
cctaattgccctggccagaact

SEQ ID NO: 121450 - DNA, 22 bp, Artificial Sequence
  chemically synthesized
attgccctggccagaacttcca

SEQ ID NO: 121451 - DNA, 22 bp, Artificial Sequence
  chemically synthesized
ccctggccagaacttccaacac

SEQ ID NO: 121452 - DNA, 22 bp, Artificial Sequence
  chemically synthesized
gccagaacttccaacactatgt

SEQ ID NO: 121453 - DNA, 22 bp, Artificial Sequence
  chemically synthesized
ccaacactatgttgaataggag

SEQ ID NO: 121454 - DNA, 22 bp, Artificial Sequence
  chemically synthesized
caacactatgttgaataggagt

SEQ ID NO: 121455 - DNA, 22 bp, Artificial Sequence
  chemically synthesized
tgttgaataggagtagtgagag

SEQ ID NO: 121456 - DNA, 22 bp, Artificial Sequence
  chemically synthesized
aataggagtagtgagagagggc

SEQ ID NO: 121457 - DNA, 22 bp, Artificial Sequence
  chemically synthesized
tcttgtgccagtttacaaaggg

SEQ ID NO: 121458 - DNA, 22 bp, Artificial Sequence
  chemically synthesized
gtgccagtttacaaagggaatg

SEQ ID NO: 121459 - DNA, 22 bp, Artificial Sequence
  chemically synthesized
tgccagtttacaaagggaatgc

SEQ ID NO: 121460 - DNA, 22 bp, Artificial Sequence
  chemically synthesized
acaaagggaatgcttccagttt

SEQ ID NO: 121461 - DNA, 22 bp, Artificial Sequence
  chemically synthesized
caaagggaatgcttccagtttt

SEQ ID NO: 121462 - DNA, 22 bp, Artificial Sequence
  chemically synthesized
ccagtttttgcccattcagtat

SEQ ID NO: 121463 - DNA, 22 bp, Artificial Sequence
  chemically synthesized
cagtttttgcccattcagtatg

SEQ ID NO: 121464 - DNA, 22 bp, Artificial Sequence
  chemically synthesized
ttgcccattcagtatgatattg

SEQ ID NO: 121465 - DNA, 22 bp, Artificial Sequence
  chemically synthesized
tgcccattcagtatgatattgg

SEQ ID NO: 121466 - DNA, 22 bp, Artificial Sequence
  chemically synthesized
gcccattcagtatgatattggc

SEQ ID NO: 121467 - DNA, 22 bp, Artificial Sequence
  chemically synthesized
cccattcagtatgatattggct

SEQ ID NO: 121468 - DNA, 22 bp, Artificial Sequence
  chemically synthesized
agtatgatattggctgtgggtt

SEQ ID NO: 121469 - DNA, 22 bp, Artificial Sequence
  chemically synthesized
gctgtgggtttgtcatagatag

SEQ ID NO: 121470 - DNA, 22 bp, Artificial Sequence
  chemically synthesized
tgggtttgtcatagatagctct

SEQ ID NO: 121471 - DNA, 22 bp, Artificial Sequence
  chemically synthesized
gtcatagatagctcttattatt

SEQ ID NO: 121472 - DNA, 22 bp, Artificial Sequence
  chemically synthesized
tcatagatagctcttattattt

SEQ ID NO: 121473 - DNA, 22 bp, Artificial Sequence
  chemically synthesized
ttattattttgagatatgtccc

SEQ ID NO: 121474 - DNA, 22 bp, Artificial Sequence
  chemically synthesized
attattttgagatatgtcccat

SEQ ID NO: 121475 - DNA, 22 bp, Artificial Sequence
  chemically synthesized
ttattttgagatatgtcccatc

SEQ ID NO: 121476 - DNA, 22 bp, Artificial Sequence
  chemically synthesized
ttttgagatatgtcccatcaat

SEQ ID NO: 121477 - DNA, 22 bp, Artificial Sequence
  chemically synthesized
tgagatatgtcccatcaatacc

SEQ ID NO: 121478 - DNA, 22 bp, Artificial Sequence
  chemically synthesized
gagatatgtcccatcaatacct

SEQ ID NO: 121479 - DNA, 22 bp, Artificial Sequence
  chemically synthesized
agatatgtcccatcaataccta

SEQ ID NO: 121480 - DNA, 22 bp, Artificial Sequence
  chemically synthesized
atttattgaaagtttttagcat

SEQ ID NO: 121481 - DNA, 22 bp, Artificial Sequence
  chemically synthesized
attgaaagtttttagcatgaag

SEQ ID NO: 121482 - DNA, 22 bp, Artificial Sequence
  chemically synthesized
ttgaaagtttttagcatgaagg

SEQ ID NO: 121483 - DNA, 22 bp, Artificial Sequence
  chemically synthesized
aaagtttttagcatgaagggtt

SEQ ID NO: 121484 - DNA, 22 bp, Artificial Sequence
  chemically synthesized
ttagcatgaagggttgttgaat

SEQ ID NO: 121485 - DNA, 22 bp, Artificial Sequence
  chemically synthesized
tagcatgaagggttgttgaatt

SEQ ID NO: 121486 - DNA, 22 bp, Artificial Sequence
  chemically synthesized
agcatgaagggttgttgaattt

SEQ ID NO: 121487 - DNA, 22 bp, Artificial Sequence
  chemically synthesized
gcatgaagggttgttgaatttt

SEQ ID NO: 121488 - DNA, 22 bp, Artificial Sequence
  chemically synthesized
ttgaattttgtcaaaggccttt

SEQ ID NO: 121489 - DNA, 22 bp, Artificial Sequence
  chemically synthesized
aattttgtcaaaggccttttct

SEQ ID NO: 121490 - DNA, 22 bp, Artificial Sequence
  chemically synthesized
tgtcaaaggccttttctgcatc

SEQ ID NO: 121491 - DNA, 22 bp, Artificial Sequence
  chemically synthesized
gtcaaaggccttttctgcatct

SEQ ID NO: 121492 - DNA, 22 bp, Artificial Sequence
  chemically synthesized
tcaaaggccttttctgcatcta

SEQ ID NO: 121493 - DNA, 22 bp, Artificial Sequence
  chemically synthesized
ttctgcatctattgagataatc

SEQ ID NO: 121494 - DNA, 22 bp, Artificial Sequence
  chemically synthesized
tctgcatctattgagataatca

SEQ ID NO: 121495 - DNA, 22 bp, Artificial Sequence
  chemically synthesized
ctgcatctattgagataatcat

SEQ ID NO: 121496 - DNA, 22 bp, Artificial Sequence
  chemically synthesized
tgcatctattgagataatcatg

SEQ ID NO: 121497 - DNA, 22 bp, Artificial Sequence
  chemically synthesized
catctattgagataatcatgtg

SEQ ID NO: 121498 - DNA, 22 bp, Artificial Sequence
  chemically synthesized
ttgagataatcatgtggttttt

SEQ ID NO: 121499 - DNA, 22 bp, Artificial Sequence
  chemically synthesized
agataatcatgtggtttttgtc

SEQ ID NO: 121500 - DNA, 22 bp, Artificial Sequence
  chemically synthesized
ttgtctttggttctgtttatat

SEQ ID NO: 121501 - DNA, 22 bp, Artificial Sequence
  chemically synthesized
tgtctttggttctgtttatatg

SEQ ID NO: 121502 - DNA, 22 bp, Artificial Sequence
  chemically synthesized
gtctttggttctgtttatatgc

SEQ ID NO: 121503 - DNA, 22 bp, Artificial Sequence
  chemically synthesized
tctttggttctgtttatatgct

SEQ ID NO: 121504 - DNA, 22 bp, Artificial Sequence
  chemically synthesized
tggttctgtttatatgctggat

SEQ ID NO: 121505 - DNA, 22 bp, Artificial Sequence
  chemically synthesized
ggttctgtttatatgctggatt

SEQ ID NO: 121506 - DNA, 22 bp, Artificial Sequence
  chemically synthesized
gttctgtttatatgctggatta

SEQ ID NO: 121507 - DNA, 22 bp, Artificial Sequence
  chemically synthesized
tgtttatatgctggattacatt

SEQ ID NO: 121508 - DNA, 22 bp, Artificial Sequence
  chemically synthesized
tttatatgctggattacattta

SEQ ID NO: 121509 - DNA, 22 bp, Artificial Sequence
  chemically synthesized
atatgctggattacatttattg

SEQ ID NO: 121510 - DNA, 22 bp, Artificial Sequence
  chemically synthesized
tatgctggattacatttattga

SEQ ID NO: 121511 - DNA, 22 bp, Artificial Sequence
  chemically synthesized
gattacatttattgatttgcat

SEQ ID NO: 121512 - DNA, 22 bp, Artificial Sequence
  chemically synthesized
catttattgatttgcatatatt

SEQ ID NO: 121513 - DNA, 22 bp, Artificial Sequence
  chemically synthesized
attgatttgcatatattgaacc

SEQ ID NO: 121514 - DNA, 22 bp, Artificial Sequence
  chemically synthesized
ttgatttgcatatattgaacca

SEQ ID NO: 121515 - DNA, 22 bp, Artificial Sequence
  chemically synthesized
atttgcatatattgaaccagcc

SEQ ID NO: 121516 - DNA, 22 bp, Artificial Sequence
  chemically synthesized
gcatatattgaaccagccttgc

SEQ ID NO: 121517 - DNA, 22 bp, Artificial Sequence
  chemically synthesized
catatattgaaccagccttgca

SEQ ID NO: 121518 - DNA, 22 bp, Artificial Sequence
  chemically synthesized
aaccagccttgcatcccaggga

SEQ ID NO: 121519 - DNA, 22 bp, Artificial Sequence
  chemically synthesized
gcatcccagggatgaagtccac

SEQ ID NO: 121520 - DNA, 22 bp, Artificial Sequence
  chemically synthesized
catcccagggatgaagtccact

SEQ ID NO: 121521 - DNA, 22 bp, Artificial Sequence
  chemically synthesized
gatcatcgtggataagcttttt

SEQ ID NO: 121522 - DNA, 22 bp, Artificial Sequence
  chemically synthesized
atcatcgtggataagctttttg

SEQ ID NO: 121523 - DNA, 22 bp, Artificial Sequence
  chemically synthesized
tttgatgtgctgctggattcgg

SEQ ID NO: 121524 - DNA, 22 bp, Artificial Sequence
  chemically synthesized
ttgatgtgctgctggattcggt

SEQ ID NO: 121525 - DNA, 22 bp, Artificial Sequence
  chemically synthesized
tgatgtgctgctggattcggtt

SEQ ID NO: 121526 - DNA, 22 bp, Artificial Sequence
  chemically synthesized
gatgtgctgctggattcggttt

SEQ ID NO: 121527 - DNA, 22 bp, Artificial Sequence
  chemically synthesized
atgtgctgctggattcggtttg

SEQ ID NO: 121528 - DNA, 22 bp, Artificial Sequence
  chemically synthesized
ctggattcggtttgccagtatt

SEQ ID NO: 121529 - DNA, 22 bp, Artificial Sequence
  chemically synthesized
gattcggtttgccagtatttta

SEQ ID NO: 121530 - DNA, 22 bp, Artificial Sequence
  chemically synthesized
ggtttgccagtattttattgag

SEQ ID NO: 121531 - DNA, 22 bp, Artificial Sequence
  chemically synthesized
gccagtattttattgaggattt

SEQ ID NO: 121532 - DNA, 22 bp, Artificial Sequence
  chemically synthesized
ccagtattttattgaggatttt

SEQ ID NO: 121533 - DNA, 22 bp, Artificial Sequence
  chemically synthesized
tattgaggatttttgcatcgat

SEQ ID NO: 121534 - DNA, 22 bp, Artificial Sequence
  chemically synthesized
attgaggatttttgcatcgatg

SEQ ID NO: 121535 - DNA, 22 bp, Artificial Sequence
  chemically synthesized
ttgaggatttttgcatcgatgt

SEQ ID NO: 121536 - DNA, 22 bp, Artificial Sequence
  chemically synthesized
aggatttttgcatcgatgttca

SEQ ID NO: 121537 - DNA, 22 bp, Artificial Sequence
  chemically synthesized
ttgcatcgatgttcatcaggga

SEQ ID NO: 121538 - DNA, 22 bp, Artificial Sequence
  chemically synthesized
tgcatcgatgttcatcagggat

SEQ ID NO: 121539 - DNA, 22 bp, Artificial Sequence
  chemically synthesized
gcatcgatgttcatcagggata

SEQ ID NO: 121540 - DNA, 22 bp, Artificial Sequence
  chemically synthesized
catcgatgttcatcagggatat

SEQ ID NO: 121541 - DNA, 22 bp, Artificial Sequence
  chemically synthesized
atcagggatattcatctaaaat

SEQ ID NO: 121542 - DNA, 22 bp, Artificial Sequence
  chemically synthesized
atctaaaattctcttttttggt

SEQ ID NO: 121543 - DNA, 22 bp, Artificial Sequence
  chemically synthesized
aaattctcttttttggttgtgt

SEQ ID NO: 121544 - DNA, 22 bp, Artificial Sequence
  chemically synthesized
tcttttttggttgtgtctcttt

SEQ ID NO: 121545 - DNA, 22 bp, Artificial Sequence
  chemically synthesized
ttttttggttgtgtctctttct

SEQ ID NO: 121546 - DNA, 22 bp, Artificial Sequence
  chemically synthesized
ttttggttgtgtctctttctgg

SEQ ID NO: 121547 - DNA, 22 bp, Artificial Sequence
  chemically synthesized
tttggttgtgtctctttctggc

SEQ ID NO: 121548 - DNA, 22 bp, Artificial Sequence
  chemically synthesized
ttggttgtgtctctttctggct

SEQ ID NO: 121549 - DNA, 22 bp, Artificial Sequence
  chemically synthesized
tggttgtgtctctttctggctt

SEQ ID NO: 121550 - DNA, 22 bp, Artificial Sequence
  chemically synthesized
ggttgtgtctctttctggcttt

SEQ ID NO: 121551 - DNA, 22 bp, Artificial Sequence
  chemically synthesized
gttgtgtctctttctggctttg

SEQ ID NO: 121552 - DNA, 22 bp, Artificial Sequence
  chemically synthesized
tgtctctttctggctttggtat

SEQ ID NO: 121553 - DNA, 22 bp, Artificial Sequence
  chemically synthesized
tttctggctttggtattaggat

SEQ ID NO: 121554 - DNA, 22 bp, Artificial Sequence
  chemically synthesized
tctggctttggtattaggatga

SEQ ID NO: 121555 - DNA, 22 bp, Artificial Sequence
  chemically synthesized
ctggctttggtattaggatgat

SEQ ID NO: 121556 - DNA, 22 bp, Artificial Sequence
  chemically synthesized
tggctttggtattaggatgatg

SEQ ID NO: 121557 - DNA, 22 bp, Artificial Sequence
  chemically synthesized
gctttggtattaggatgatgct

SEQ ID NO: 121558 - DNA, 22 bp, Artificial Sequence
  chemically synthesized
tggtattaggatgatgctggcc

SEQ ID NO: 121559 - DNA, 22 bp, Artificial Sequence
  chemically synthesized
ggtattaggatgatgctggcct

SEQ ID NO: 121560 - DNA, 22 bp, Artificial Sequence
  chemically synthesized
gtattaggatgatgctggcctc

SEQ ID NO: 121561 - DNA, 22 bp, Artificial Sequence
  chemically synthesized
ggatgatgctggcctcataaaa

SEQ ID NO: 121562 - DNA, 22 bp, Artificial Sequence
  chemically synthesized
gcctcataaaatgagttaggga

SEQ ID NO: 121563 - DNA, 22 bp, Artificial Sequence
  chemically synthesized
ataaaatgagttagggaggatt

SEQ ID NO: 121564 - DNA, 22 bp, Artificial Sequence
  chemically synthesized
gggaggattccttctttttctg

SEQ ID NO: 121565 - DNA, 22 bp, Artificial Sequence
  chemically synthesized
cttctttttctgttgattggaa

SEQ ID NO: 121566 - DNA, 22 bp, Artificial Sequence
  chemically synthesized
ctttttctgttgattggaatag

SEQ ID NO: 121567 - DNA, 22 bp, Artificial Sequence
  chemically synthesized
tttttctgttgattggaatagt

SEQ ID NO: 121568 - DNA, 22 bp, Artificial Sequence
  chemically synthesized
tttctgttgattggaatagttt

SEQ ID NO: 121569 - DNA, 22 bp, Artificial Sequence
  chemically synthesized
ttctgttgattggaatagtttc

SEQ ID NO: 121570 - DNA, 22 bp, Artificial Sequence
  chemically synthesized
tctgttgattggaatagtttca

SEQ ID NO: 121571 - DNA, 22 bp, Artificial Sequence
  chemically synthesized
ctgttgattggaatagtttcag

SEQ ID NO: 121572 - DNA, 22 bp, Artificial Sequence
  chemically synthesized
tgttgattggaatagtttcaga

SEQ ID NO: 121573 - DNA, 22 bp, Artificial Sequence
  chemically synthesized
ttgattggaatagtttcagaag

SEQ ID NO: 121574 - DNA, 22 bp, Artificial Sequence
  chemically synthesized
attggaatagtttcagaaggaa

SEQ ID NO: 121575 - DNA, 22 bp, Artificial Sequence
  chemically synthesized
gaatagtttcagaaggaatggt

SEQ ID NO: 121576 - DNA, 22 bp, Artificial Sequence
  chemically synthesized
cagaaggaatggtaccaattcc

SEQ ID NO: 121577 - DNA, 22 bp, Artificial Sequence
  chemically synthesized
agaaggaatggtaccaattcct

SEQ ID NO: 121578 - DNA, 22 bp, Artificial Sequence
  chemically synthesized
ctccttgtacctctgttagaat

SEQ ID NO: 121579 - DNA, 22 bp, Artificial Sequence
  chemically synthesized
cttgtacctctgttagaatttg

SEQ ID NO: 121580 - DNA, 22 bp, Artificial Sequence
  chemically synthesized
gtacctctgttagaatttggct

SEQ ID NO: 121581 - DNA, 22 bp, Artificial Sequence
  chemically synthesized
tacctctgttagaatttggctg

SEQ ID NO: 121582 - DNA, 22 bp, Artificial Sequence
  chemically synthesized
tgttagaatttggctgtgaatc

SEQ ID NO: 121583 - DNA, 22 bp, Artificial Sequence
  chemically synthesized
ttagaatttggctgtgaatcca

SEQ ID NO: 121584 - DNA, 22 bp, Artificial Sequence
  chemically synthesized
gaatttggctgtgaatccatct

SEQ ID NO: 121585 - DNA, 22 bp, Artificial Sequence
  chemically synthesized
ggctgtgaatccatctggtcct

SEQ ID NO: 121586 - DNA, 22 bp, Artificial Sequence
  chemically synthesized
gctgtgaatccatctggtcctg

SEQ ID NO: 121587 - DNA, 22 bp, Artificial Sequence
  chemically synthesized
tgaatccatctggtcctggact

SEQ ID NO: 121588 - DNA, 22 bp, Artificial Sequence
  chemically synthesized
gtcctggactctttttggttgg

SEQ ID NO: 121589 - DNA, 22 bp, Artificial Sequence
  chemically synthesized
gactctttttggttggtaagct

SEQ ID NO: 121590 - DNA, 22 bp, Artificial Sequence
  chemically synthesized
tttttggttggtaagctattga

SEQ ID NO: 121591 - DNA, 22 bp, Artificial Sequence
  chemically synthesized
tttggttggtaagctattgatt

SEQ ID NO: 121592 - DNA, 22 bp, Artificial Sequence
  chemically synthesized
ttggttggtaagctattgatta

SEQ ID NO: 121593 - DNA, 22 bp, Artificial Sequence
  chemically synthesized
tggttggtaagctattgattat

SEQ ID NO: 121594 - DNA, 22 bp, Artificial Sequence
  chemically synthesized
ggttggtaagctattgattatt

SEQ ID NO: 121595 - DNA, 22 bp, Artificial Sequence
  chemically synthesized
gttggtaagctattgattattg

SEQ ID NO: 121596 - DNA, 22 bp, Artificial Sequence
  chemically synthesized
gtaagctattgattattgccac

SEQ ID NO: 121597 - DNA, 22 bp, Artificial Sequence
  chemically synthesized
ttgattattgccacaatttcag

SEQ ID NO: 121598 - DNA, 22 bp, Artificial Sequence
  chemically synthesized
attattgccacaatttcagatc

SEQ ID NO: 121599 - DNA, 22 bp, Artificial Sequence
  chemically synthesized
ttgccacaatttcagatcctgt

SEQ ID NO: 121600 - DNA, 22 bp, Artificial Sequence
  chemically synthesized
ccacaatttcagatcctgttat

SEQ ID NO: 121601 - DNA, 22 bp, Artificial Sequence
  chemically synthesized
cagatcctgttattggtctatt

SEQ ID NO: 121602 - DNA, 22 bp, Artificial Sequence
  chemically synthesized
agatcctgttattggtctattc

SEQ ID NO: 121603 - DNA, 22 bp, Artificial Sequence
  chemically synthesized
ttattggtctattcagagattc

SEQ ID NO: 121604 - DNA, 22 bp, Artificial Sequence
  chemically synthesized
ttggtctattcagagattcaac

SEQ ID NO: 121605 - DNA, 22 bp, Artificial Sequence
  chemically synthesized
gtctattcagagattcaacttc

SEQ ID NO: 121606 - DNA, 22 bp, Artificial Sequence
  chemically synthesized
ttcagagattcaacttcttcct

SEQ ID NO: 121607 - DNA, 22 bp, Artificial Sequence
  chemically synthesized
agagattcaacttcttcctggt

SEQ ID NO: 121608 - DNA, 22 bp, Artificial Sequence
  chemically synthesized
aacttcttcctggtttagtctt

SEQ ID NO: 121609 - DNA, 22 bp, Artificial Sequence
  chemically synthesized
cttcctggtttagtcttgggat

SEQ ID NO: 121610 - DNA, 22 bp, Artificial Sequence
  chemically synthesized
ttcctggtttagtcttgggata

SEQ ID NO: 121611 - DNA, 22 bp, Artificial Sequence
  chemically synthesized
cctggtttagtcttgggatagt

SEQ ID NO: 121612 - DNA, 22 bp, Artificial Sequence
  chemically synthesized
ctggtttagtcttgggatagtg

SEQ ID NO: 121613 - DNA, 22 bp, Artificial Sequence
  chemically synthesized
gtttagtcttgggatagtgtat

SEQ ID NO: 121614 - DNA, 22 bp, Artificial Sequence
  chemically synthesized
agtcttgggatagtgtatgtgt

SEQ ID NO: 121615 - DNA, 22 bp, Artificial Sequence
  chemically synthesized
gtcttgggatagtgtatgtgtc

SEQ ID NO: 121616 - DNA, 22 bp, Artificial Sequence
  chemically synthesized
gggatagtgtatgtgtccagga

SEQ ID NO: 121617 - DNA, 22 bp, Artificial Sequence
  chemically synthesized
ggatagtgtatgtgtccaggaa

SEQ ID NO: 121618 - DNA, 22 bp, Artificial Sequence
  chemically synthesized
atccatttcttctagattttct

SEQ ID NO: 121619 - DNA, 22 bp, Artificial Sequence
  chemically synthesized
tccatttcttctagattttcta

SEQ ID NO: 121620 - DNA, 22 bp, Artificial Sequence
  chemically synthesized
cttctagattttctagtttatt

SEQ ID NO: 121621 - DNA, 22 bp, Artificial Sequence
  chemically synthesized
ttctagattttctagtttattt

SEQ ID NO: 121622 - DNA, 22 bp, Artificial Sequence
  chemically synthesized
ctagattttctagtttatttgc

SEQ ID NO: 121623 - DNA, 22 bp, Artificial Sequence
  chemically synthesized
tagattttctagtttatttgcg

SEQ ID NO: 121624 - DNA, 22 bp, Artificial Sequence
  chemically synthesized
gattttctagtttatttgcgta

SEQ ID NO: 121625 - DNA, 22 bp, Artificial Sequence
  chemically synthesized
tctagtttatttgcgtagaggt

SEQ ID NO: 121626 - DNA, 22 bp, Artificial Sequence
  chemically synthesized
ctagtttatttgcgtagaggtg

SEQ ID NO: 121627 - DNA, 22 bp, Artificial Sequence
  chemically synthesized
tagtttatttgcgtagaggtgt

SEQ ID NO: 121628 - DNA, 22 bp, Artificial Sequence
  chemically synthesized
gtttatttgcgtagaggtgttt

SEQ ID NO: 121629 - DNA, 22 bp, Artificial Sequence
  chemically synthesized
atttgcgtagaggtgtttgtag

SEQ ID NO: 121630 - DNA, 22 bp, Artificial Sequence
  chemically synthesized
tttgcgtagaggtgtttgtagt

SEQ ID NO: 121631 - DNA, 22 bp, Artificial Sequence
  chemically synthesized
gcgtagaggtgtttgtagtatt

SEQ ID NO: 121632 - DNA, 22 bp, Artificial Sequence
  chemically synthesized
cgtagaggtgtttgtagtattc

SEQ ID NO: 121633 - DNA, 22 bp, Artificial Sequence
  chemically synthesized
gtagtattctctgatggcagtt

SEQ ID NO: 121634 - DNA, 22 bp, Artificial Sequence
  chemically synthesized
tagtattctctgatggcagttt

SEQ ID NO: 121635 - DNA, 22 bp, Artificial Sequence
  chemically synthesized
tctgatggcagtttgtatttct

SEQ ID NO: 121636 - DNA, 22 bp, Artificial Sequence
  chemically synthesized
tgatggcagtttgtatttctgt

SEQ ID NO: 121637 - DNA, 22 bp, Artificial Sequence
  chemically synthesized
atggcagtttgtatttctgtgg

SEQ ID NO: 121638 - DNA, 22 bp, Artificial Sequence
  chemically synthesized
gtatttctgtgggatcggtggt

SEQ ID NO: 121639 - DNA, 22 bp, Artificial Sequence
  chemically synthesized
tatttctgtgggatcggtggtg

SEQ ID NO: 121640 - DNA, 22 bp, Artificial Sequence
  chemically synthesized
ctgtgggatcggtggtgatatc

SEQ ID NO: 121641 - DNA, 22 bp, Artificial Sequence
  chemically synthesized
tgtgggatcggtggtgatatcc

SEQ ID NO: 121642 - DNA, 22 bp, Artificial Sequence
  chemically synthesized
tgggatcggtggtgatatcccc

SEQ ID NO: 121643 - DNA, 22 bp, Artificial Sequence
  chemically synthesized
tatcatttttttattgtgtcta

SEQ ID NO: 121644 - DNA, 22 bp, Artificial Sequence
  chemically synthesized
atcatttttttattgtgtctat

SEQ ID NO: 121645 - DNA, 22 bp, Artificial Sequence
  chemically synthesized
tcatttttttattgtgtctatt

SEQ ID NO: 121646 - DNA, 22 bp, Artificial Sequence
  chemically synthesized
ttttattgtgtctatttgattc

SEQ ID NO: 121647 - DNA, 22 bp, Artificial Sequence
  chemically synthesized
tttattgtgtctatttgattct

SEQ ID NO: 121648 - DNA, 22 bp, Artificial Sequence
  chemically synthesized
ttattgtgtctatttgattctt

SEQ ID NO: 121649 - DNA, 22 bp, Artificial Sequence
  chemically synthesized
tattgtgtctatttgattcttc

SEQ ID NO: 121650 - DNA, 22 bp, Artificial Sequence
  chemically synthesized
attgtgtctatttgattcttct

SEQ ID NO: 121651 - DNA, 22 bp, Artificial Sequence
  chemically synthesized
ttgtgtctatttgattcttctc

SEQ ID NO: 121652 - DNA, 22 bp, Artificial Sequence
  chemically synthesized
tgtctatttgattcttctctct

SEQ ID NO: 121653 - DNA, 22 bp, Artificial Sequence
  chemically synthesized
tttgattcttctctcttttctt

SEQ ID NO: 121654 - DNA, 22 bp, Artificial Sequence
  chemically synthesized
gattcttctctcttttcttatt

SEQ ID NO: 121655 - DNA, 22 bp, Artificial Sequence
  chemically synthesized
attcttctctcttttcttatta

SEQ ID NO: 121656 - DNA, 22 bp, Artificial Sequence
  chemically synthesized
ttctctcttttcttattagtct

SEQ ID NO: 121657 - DNA, 22 bp, Artificial Sequence
  chemically synthesized
ctctcttttcttattagtcttg

SEQ ID NO: 121658 - DNA, 22 bp, Artificial Sequence
  chemically synthesized
tctcttttcttattagtcttgc

SEQ ID NO: 121659 - DNA, 22 bp, Artificial Sequence
  chemically synthesized
tcttttcttattagtcttgcta

SEQ ID NO: 121660 - DNA, 22 bp, Artificial Sequence
  chemically synthesized
ttttcttattagtcttgctagc

SEQ ID NO: 121661 - DNA, 22 bp, Artificial Sequence
  chemically synthesized
ttcttattagtcttgctagcgg

SEQ ID NO: 121662 - DNA, 22 bp, Artificial Sequence
  chemically synthesized
tcttattagtcttgctagcggt

SEQ ID NO: 121663 - DNA, 22 bp, Artificial Sequence
  chemically synthesized
cttattagtcttgctagcggtc

SEQ ID NO: 121664 - DNA, 22 bp, Artificial Sequence
  chemically synthesized
ttattagtcttgctagcggtct

SEQ ID NO: 121665 - DNA, 22 bp, Artificial Sequence
  chemically synthesized
attagtcttgctagcggtctat

SEQ ID NO: 121666 - DNA, 22 bp, Artificial Sequence
  chemically synthesized
ttagtcttgctagcggtctatc

SEQ ID NO: 121667 - DNA, 22 bp, Artificial Sequence
  chemically synthesized
gtcttgctagcggtctatcagt

SEQ ID NO: 121668 - DNA, 22 bp, Artificial Sequence
  chemically synthesized
gctagcggtctatcagttttgt

SEQ ID NO: 121669 - DNA, 22 bp, Artificial Sequence
  chemically synthesized
ctagcggtctatcagttttgtt

SEQ ID NO: 121670 - DNA, 22 bp, Artificial Sequence
  chemically synthesized
gcggtctatcagttttgttgat

SEQ ID NO: 121671 - DNA, 22 bp, Artificial Sequence
  chemically synthesized
tcagttttgttgatcctttcaa

SEQ ID NO: 121672 - DNA, 22 bp, Artificial Sequence
  chemically synthesized
tgttgatcctttcaaaaaacca

SEQ ID NO: 121673 - DNA, 22 bp, Artificial Sequence
  chemically synthesized
gttgatcctttcaaaaaaccag

SEQ ID NO: 121674 - DNA, 22 bp, Artificial Sequence
  chemically synthesized
ttgatcctttcaaaaaaccagc

SEQ ID NO: 121675 - DNA, 22 bp, Artificial Sequence
  chemically synthesized
atcctttcaaaaaaccagctcc

SEQ ID NO: 121676 - DNA, 22 bp, Artificial Sequence
  chemically synthesized
tcaaaaaaccagctcccagatt

SEQ ID NO: 121677 - DNA, 22 bp, Artificial Sequence
  chemically synthesized
caaaaaaccagctcccagattc

SEQ ID NO: 121678 - DNA, 22 bp, Artificial Sequence
  chemically synthesized
aaaaaaccagctcccagattca

SEQ ID NO: 121679 - DNA, 22 bp, Artificial Sequence
  chemically synthesized
ccagattcattaattttttgaa

SEQ ID NO: 121680 - DNA, 22 bp, Artificial Sequence
  chemically synthesized
attaattttttgaagggttttt

SEQ ID NO: 121681 - DNA, 22 bp, Artificial Sequence
  chemically synthesized
attttttgaagggttttttgtg

SEQ ID NO: 121682 - DNA, 22 bp, Artificial Sequence
  chemically synthesized
tttgaagggttttttgtgtctc

SEQ ID NO: 121683 - DNA, 22 bp, Artificial Sequence
  chemically synthesized
ttgaagggttttttgtgtctct

SEQ ID NO: 121684 - DNA, 22 bp, Artificial Sequence
  chemically synthesized
tgaagggttttttgtgtctctg

SEQ ID NO: 121685 - DNA, 22 bp, Artificial Sequence
  chemically synthesized
gaagggttttttgtgtctctgt

SEQ ID NO: 121686 - DNA, 22 bp, Artificial Sequence
  chemically synthesized
aagggttttttgtgtctctgtt

SEQ ID NO: 121687 - DNA, 22 bp, Artificial Sequence
  chemically synthesized
tttgtgtctctgtttccttcag

SEQ ID NO: 121688 - DNA, 22 bp, Artificial Sequence
  chemically synthesized
ttgtgtctctgtttccttcagt

SEQ ID NO: 121689 - DNA, 22 bp, Artificial Sequence
  chemically synthesized
tgtgtctctgtttccttcagtt

SEQ ID NO: 121690 - DNA, 22 bp, Artificial Sequence
  chemically synthesized
gtgtctctgtttccttcagttc

SEQ ID NO: 121691 - DNA, 22 bp, Artificial Sequence
  chemically synthesized
tgtctctgtttccttcagttct

SEQ ID NO: 121692 - DNA, 22 bp, Artificial Sequence
  chemically synthesized
tgtttccttcagttctgctctg

SEQ ID NO: 121693 - DNA, 22 bp, Artificial Sequence
  chemically synthesized
tttccttcagttctgctctgat

SEQ ID NO: 121694 - DNA, 22 bp, Artificial Sequence
  chemically synthesized
ccttcagttctgctctgatttt

SEQ ID NO: 121695 - DNA, 22 bp, Artificial Sequence
  chemically synthesized
cttcagttctgctctgatttta

SEQ ID NO: 121696 - DNA, 22 bp, Artificial Sequence
  chemically synthesized
cagttctgctctgattttagtt

SEQ ID NO: 121697 - DNA, 22 bp, Artificial Sequence
  chemically synthesized
agttctgctctgattttagtta

SEQ ID NO: 121698 - DNA, 22 bp, Artificial Sequence
  chemically synthesized
tgctctgattttagttatttct

SEQ ID NO: 121699 - DNA, 22 bp, Artificial Sequence
  chemically synthesized
ctctgattttagttatttcttg

SEQ ID NO: 121700 - DNA, 22 bp, Artificial Sequence
  chemically synthesized
tgattttagttatttcttgact

SEQ ID NO: 121701 - DNA, 22 bp, Artificial Sequence
  chemically synthesized
attttagttatttcttgacttc

SEQ ID NO: 121702 - DNA, 22 bp, Artificial Sequence
  chemically synthesized
tagttatttcttgacttctgct

SEQ ID NO: 121703 - DNA, 22 bp, Artificial Sequence
  chemically synthesized
agttatttcttgacttctgcta

SEQ ID NO: 121704 - DNA, 22 bp, Artificial Sequence
  chemically synthesized
gttatttcttgacttctgctag

SEQ ID NO: 121705 - DNA, 22 bp, Artificial Sequence
  chemically synthesized
tttcttgacttctgctagcttt

SEQ ID NO: 121706 - DNA, 22 bp, Artificial Sequence
  chemically synthesized
cttgacttctgctagcttttga

SEQ ID NO: 121707 - DNA, 22 bp, Artificial Sequence
  chemically synthesized
ttgacttctgctagcttttgaa

SEQ ID NO: 121708 - DNA, 22 bp, Artificial Sequence
  chemically synthesized
gacttctgctagcttttgaatg

SEQ ID NO: 121709 - DNA, 22 bp, Artificial Sequence
  chemically synthesized
acttctgctagcttttgaatgt

SEQ ID NO: 121710 - DNA, 22 bp, Artificial Sequence
  chemically synthesized
ctgctagcttttgaatgtgttt

SEQ ID NO: 121711 - DNA, 22 bp, Artificial Sequence
  chemically synthesized
tgctagcttttgaatgtgtttg

SEQ ID NO: 121712 - DNA, 22 bp, Artificial Sequence
  chemically synthesized
ctagcttttgaatgtgtttgct

SEQ ID NO: 121713 - DNA, 22 bp, Artificial Sequence
  chemically synthesized
gcttttgaatgtgtttgctctt

SEQ ID NO: 121714 - DNA, 22 bp, Artificial Sequence
  chemically synthesized
ttgaatgtgtttgctcttgctt

SEQ ID NO: 121715 - DNA, 22 bp, Artificial Sequence
  chemically synthesized
tgaatgtgtttgctcttgctta

SEQ ID NO: 121716 - DNA, 22 bp, Artificial Sequence
  chemically synthesized
gaatgtgtttgctcttgcttat

SEQ ID NO: 121717 - DNA, 22 bp, Artificial Sequence
  chemically synthesized
aatgtgtttgctcttgcttatc

SEQ ID NO: 121718 - DNA, 22 bp, Artificial Sequence
  chemically synthesized
gctcttgcttatctagttcttt

SEQ ID NO: 121719 - DNA, 22 bp, Artificial Sequence
  chemically synthesized
ctcttgcttatctagttctttt

SEQ ID NO: 121720 - DNA, 22 bp, Artificial Sequence
  chemically synthesized
ttgcttatctagttcttttaat

SEQ ID NO: 121721 - DNA, 22 bp, Artificial Sequence
  chemically synthesized
gcttatctagttcttttaattg

SEQ ID NO: 121722 - DNA, 22 bp, Artificial Sequence
  chemically synthesized
cttatctagttcttttaattgt

SEQ ID NO: 121723 - DNA, 22 bp, Artificial Sequence
  chemically synthesized
atctagttcttttaattgtgat

SEQ ID NO: 121724 - DNA, 22 bp, Artificial Sequence
  chemically synthesized
tctagttcttttaattgtgatg

SEQ ID NO: 121725 - DNA, 22 bp, Artificial Sequence
  chemically synthesized
gttcttttaattgtgatgttag

SEQ ID NO: 121726 - DNA, 22 bp, Artificial Sequence
  chemically synthesized
ttttaattgtgatgttagggtg

SEQ ID NO: 121727 - DNA, 22 bp, Artificial Sequence
  chemically synthesized
ttaattgtgatgttagggtgtc

SEQ ID NO: 121728 - DNA, 22 bp, Artificial Sequence
  chemically synthesized
taattgtgatgttagggtgtca

SEQ ID NO: 121729 - DNA, 22 bp, Artificial Sequence
  chemically synthesized
aattgtgatgttagggtgtcaa

SEQ ID NO: 121730 - DNA, 22 bp, Artificial Sequence
  chemically synthesized
attgtgatgttagggtgtcaat

SEQ ID NO: 121731 - DNA, 22 bp, Artificial Sequence
  chemically synthesized
tgatgttagggtgtcaattttg

SEQ ID NO: 121732 - DNA, 22 bp, Artificial Sequence
  chemically synthesized
gggtgtcaattttggatctttc

SEQ ID NO: 121733 - DNA, 22 bp, Artificial Sequence
  chemically synthesized
tggatctttcttgctttctctt

SEQ ID NO: 121734 - DNA, 22 bp, Artificial Sequence
  chemically synthesized
ggatctttcttgctttctcttg

SEQ ID NO: 121735 - DNA, 22 bp, Artificial Sequence
  chemically synthesized
gatctttcttgctttctcttgt

SEQ ID NO: 121736 - DNA, 22 bp, Artificial Sequence
  chemically synthesized
tcttgctttctcttgtgggcgt

SEQ ID NO: 121737 - DNA, 22 bp, Artificial Sequence
  chemically synthesized
cttgctttctcttgtgggcgtt

SEQ ID NO: 121738 - DNA, 22 bp, Artificial Sequence
  chemically synthesized
ttgctttctcttgtgggcgttt

SEQ ID NO: 121739 - DNA, 22 bp, Artificial Sequence
  chemically synthesized
gctttctcttgtgggcgtttag

SEQ ID NO: 121740 - DNA, 22 bp, Artificial Sequence
  chemically synthesized
ctttctcttgtgggcgtttagt

SEQ ID NO: 121741 - DNA, 22 bp, Artificial Sequence
  chemically synthesized
tctcttgtgggcgtttagtgct

SEQ ID NO: 121742 - DNA, 22 bp, Artificial Sequence
  chemically synthesized
ctcttgtgggcgtttagtgcta

SEQ ID NO: 121743 - DNA, 22 bp, Artificial Sequence
  chemically synthesized
tcttgtgggcgtttagtgctat

SEQ ID NO: 121744 - DNA, 22 bp, Artificial Sequence
  chemically synthesized
ttgtgggcgtttagtgctataa

SEQ ID NO: 121745 - DNA, 22 bp, Artificial Sequence
  chemically synthesized
gtgggcgtttagtgctataaat

SEQ ID NO: 121746 - DNA, 22 bp, Artificial Sequence
  chemically synthesized
tgggcgtttagtgctataaatt

SEQ ID NO: 121747 - DNA, 22 bp, Artificial Sequence
  chemically synthesized
agtgctataaatttccccctac

SEQ ID NO: 121748 - DNA, 22 bp, Artificial Sequence
  chemically synthesized
gtgctataaatttccccctaca

SEQ ID NO: 121749 - DNA, 22 bp, Artificial Sequence
  chemically synthesized
taaatttccccctacacactga

SEQ ID NO: 121750 - DNA, 22 bp, Artificial Sequence
  chemically synthesized
ccccctacacactgattcgaat

SEQ ID NO: 121751 - DNA, 22 bp, Artificial Sequence
  chemically synthesized
cccctacacactgattcgaatg

SEQ ID NO: 121752 - DNA, 22 bp, Artificial Sequence
  chemically synthesized
cacactgattcgaatgtgtccc

SEQ ID NO: 121753 - DNA, 22 bp, Artificial Sequence
  chemically synthesized
attcgaatgtgtcccagagatt

SEQ ID NO: 121754 - DNA, 22 bp, Artificial Sequence
  chemically synthesized
gaatgtgtcccagagattctgg

SEQ ID NO: 121755 - DNA, 22 bp, Artificial Sequence
  chemically synthesized
tggtatgttgtgtctttgttct

SEQ ID NO: 121756 - DNA, 22 bp, Artificial Sequence
  chemically synthesized
gtatgttgtgtctttgttctca

SEQ ID NO: 121757 - DNA, 22 bp, Artificial Sequence
  chemically synthesized
tgtctttgttctcattggtttc

SEQ ID NO: 121758 - DNA, 22 bp, Artificial Sequence
  chemically synthesized
tgttctcattggtttcaaagaa

SEQ ID NO: 121759 - DNA, 22 bp, Artificial Sequence
  chemically synthesized
gttctcattggtttcaaagaac

SEQ ID NO: 121760 - DNA, 22 bp, Artificial Sequence
  chemically synthesized
ttctcattggtttcaaagaaca

SEQ ID NO: 121761 - DNA, 22 bp, Artificial Sequence
  chemically synthesized
tcattggtttcaaagaacatct

SEQ ID NO: 121762 - DNA, 22 bp, Artificial Sequence
  chemically synthesized
attggtttcaaagaacatcttt

SEQ ID NO: 121763 - DNA, 22 bp, Artificial Sequence
  chemically synthesized
gtttcaaagaacatctttattt

SEQ ID NO: 121764 - DNA, 22 bp, Artificial Sequence
  chemically synthesized
caaagaacatctttatttctgc

SEQ ID NO: 121765 - DNA, 22 bp, Artificial Sequence
  chemically synthesized
aaagaacatctttatttctgcc

SEQ ID NO: 121766 - DNA, 22 bp, Artificial Sequence
  chemically synthesized
tatttctgccttcatttcgtta

SEQ ID NO: 121767 - DNA, 22 bp, Artificial Sequence
  chemically synthesized
atttctgccttcatttcgttat

SEQ ID NO: 121768 - DNA, 22 bp, Artificial Sequence
  chemically synthesized
tttctgccttcatttcgttatg

SEQ ID NO: 121769 - DNA, 22 bp, Artificial Sequence
  chemically synthesized
ctgccttcatttcgttatgtac

SEQ ID NO: 121770 - DNA, 22 bp, Artificial Sequence
  chemically synthesized
tgccttcatttcgttatgtacc

SEQ ID NO: 121771 - DNA, 22 bp, Artificial Sequence
  chemically synthesized
ccttcatttcgttatgtaccca

SEQ ID NO: 121772 - DNA, 22 bp, Artificial Sequence
  chemically synthesized
catttcgttatgtacccagtag

SEQ ID NO: 121773 - DNA, 22 bp, Artificial Sequence
  chemically synthesized
atttcgttatgtacccagtagt

SEQ ID NO: 121774 - DNA, 22 bp, Artificial Sequence
  chemically synthesized
cgttatgtacccagtagtcatt

SEQ ID NO: 121775 - DNA, 22 bp, Artificial Sequence
  chemically synthesized
gttatgtacccagtagtcattc

SEQ ID NO: 121776 - DNA, 22 bp, Artificial Sequence
  chemically synthesized
tgtacccagtagtcattcagga

SEQ ID NO: 121777 - DNA, 22 bp, Artificial Sequence
  chemically synthesized
aggagcaggttgttcagtttcc

SEQ ID NO: 121778 - DNA, 22 bp, Artificial Sequence
  chemically synthesized
ttcagtttccatgtagttgagt

SEQ ID NO: 121779 - DNA, 22 bp, Artificial Sequence
  chemically synthesized
agtttccatgtagttgagtggt

SEQ ID NO: 121780 - DNA, 22 bp, Artificial Sequence
  chemically synthesized
ccatgtagttgagtggttttga

SEQ ID NO: 121781 - DNA, 22 bp, Artificial Sequence
  chemically synthesized
catgtagttgagtggttttgag

SEQ ID NO: 121782 - DNA, 22 bp, Artificial Sequence
  chemically synthesized
agtggttttgagtgagtttctt

SEQ ID NO: 121783 - DNA, 22 bp, Artificial Sequence
  chemically synthesized
tgagtgagtttcttaatcctga

SEQ ID NO: 121784 - DNA, 22 bp, Artificial Sequence
  chemically synthesized
gagtgagtttcttaatcctgag

SEQ ID NO: 121785 - DNA, 22 bp, Artificial Sequence
  chemically synthesized
agtgagtttcttaatcctgagt

SEQ ID NO: 121786 - DNA, 22 bp, Artificial Sequence
  chemically synthesized
cttaatcctgagttctagtttg

SEQ ID NO: 121787 - DNA, 22 bp, Artificial Sequence
  chemically synthesized
ttaatcctgagttctagtttga

SEQ ID NO: 121788 - DNA, 22 bp, Artificial Sequence
  chemically synthesized
aatcctgagttctagtttgatt

SEQ ID NO: 121789 - DNA, 22 bp, Artificial Sequence
  chemically synthesized
atcctgagttctagtttgattg

SEQ ID NO: 121790 - DNA, 22 bp, Artificial Sequence
  chemically synthesized
agttctagtttgattgcactgt

SEQ ID NO: 121791 - DNA, 22 bp, Artificial Sequence
  chemically synthesized
tagtttgattgcactgtggtct

SEQ ID NO: 121792 - DNA, 22 bp, Artificial Sequence
  chemically synthesized
gtttgattgcactgtggtctga

SEQ ID NO: 121793 - DNA, 22 bp, Artificial Sequence
  chemically synthesized
gattgcactgtggtctgagaga

SEQ ID NO: 121794 - DNA, 22 bp, Artificial Sequence
  chemically synthesized
attgcactgtggtctgagagac

SEQ ID NO: 121795 - DNA, 22 bp, Artificial Sequence
  chemically synthesized
cactgtggtctgagagacagtt

SEQ ID NO: 121796 - DNA, 22 bp, Artificial Sequence
  chemically synthesized
tggtctgagagacagtttgtta

SEQ ID NO: 121797 - DNA, 22 bp, Artificial Sequence
  chemically synthesized
agagacagtttgttataatttc

SEQ ID NO: 121798 - DNA, 22 bp, Artificial Sequence
  chemically synthesized
gttataatttctgttcttttat

SEQ ID NO: 121799 - DNA, 22 bp, Artificial Sequence
  chemically synthesized
ttataatttctgttcttttata

SEQ ID NO: 121800 - DNA, 22 bp, Artificial Sequence
  chemically synthesized
taatttctgttcttttatattt

SEQ ID NO: 121801 - DNA, 22 bp, Artificial Sequence
  chemically synthesized
ctgttcttttatatttgctgag

SEQ ID NO: 121802 - DNA, 22 bp, Artificial Sequence
  chemically synthesized
tgttcttttatatttgctgagg

SEQ ID NO: 121803 - DNA, 22 bp, Artificial Sequence
  chemically synthesized
ttcttttatatttgctgaggag

SEQ ID NO: 121804 - DNA, 22 bp, Artificial Sequence
  chemically synthesized
ttttatatttgctgaggagagc

SEQ ID NO: 121805 - DNA, 22 bp, Artificial Sequence
  chemically synthesized
ttatatttgctgaggagagctt

SEQ ID NO: 121806 - DNA, 22 bp, Artificial Sequence
  chemically synthesized
tatatttgctgaggagagcttt

SEQ ID NO: 121807 - DNA, 22 bp, Artificial Sequence
  chemically synthesized
atatttgctgaggagagcttta

SEQ ID NO: 121808 - DNA, 22 bp, Artificial Sequence
  chemically synthesized
tatttgctgaggagagctttac

SEQ ID NO: 121809 - DNA, 22 bp, Artificial Sequence
  chemically synthesized
gctgaggagagctttacttcca

SEQ ID NO: 121810 - DNA, 22 bp, Artificial Sequence
  chemically synthesized
ctgaggagagctttacttccaa

SEQ ID NO: 121811 - DNA, 22 bp, Artificial Sequence
  chemically synthesized
aggagagctttacttccaagta

SEQ ID NO: 121812 - DNA, 22 bp, Artificial Sequence
  chemically synthesized
tacttccaagtatgtggtcaat

SEQ ID NO: 121813 - DNA, 22 bp, Artificial Sequence
  chemically synthesized
acttccaagtatgtggtcaatt

SEQ ID NO: 121814 - DNA, 22 bp, Artificial Sequence
  chemically synthesized
cttccaagtatgtggtcaattt

SEQ ID NO: 121815 - DNA, 22 bp, Artificial Sequence
  chemically synthesized
ccaagtatgtggtcaattttgg

SEQ ID NO: 121816 - DNA, 22 bp, Artificial Sequence
  chemically synthesized
caagtatgtggtcaattttgga

SEQ ID NO: 121817 - DNA, 22 bp, Artificial Sequence
  chemically synthesized
tggaataggtgttgtgtggtgc

SEQ ID NO: 121818 - DNA, 22 bp, Artificial Sequence
  chemically synthesized
ggaataggtgttgtgtggtgct

SEQ ID NO: 121819 - DNA, 22 bp, Artificial Sequence
  chemically synthesized
gaataggtgttgtgtggtgctg

SEQ ID NO: 121820 - DNA, 22 bp, Artificial Sequence
  chemically synthesized
tgtggtgctgaaaaaaaatgta

SEQ ID NO: 121821 - DNA, 22 bp, Artificial Sequence
  chemically synthesized
aaaaaaaatgtatattctgttg

SEQ ID NO: 121822 - DNA, 22 bp, Artificial Sequence
  chemically synthesized
tgttgatttggggtggagagtt

SEQ ID NO: 121823 - DNA, 22 bp, Artificial Sequence
  chemically synthesized
ttgatttggggtggagagttct

SEQ ID NO: 121824 - DNA, 22 bp, Artificial Sequence
  chemically synthesized
atttggggtggagagttctgta

SEQ ID NO: 121825 - DNA, 22 bp, Artificial Sequence
  chemically synthesized
ggggtggagagttctgtagatg

SEQ ID NO: 121826 - DNA, 22 bp, Artificial Sequence
  chemically synthesized
gggtggagagttctgtagatgt

SEQ ID NO: 121827 - DNA, 22 bp, Artificial Sequence
  chemically synthesized
tgtagatgtctattaggtctgc

SEQ ID NO: 121828 - DNA, 22 bp, Artificial Sequence
  chemically synthesized
tagatgtctattaggtctgctt

SEQ ID NO: 121829 - DNA, 22 bp, Artificial Sequence
  chemically synthesized
ttaggtctgcttggtgcagagc

SEQ ID NO: 121830 - DNA, 22 bp, Artificial Sequence
  chemically synthesized
ggtctgcttggtgcagagctgt

SEQ ID NO: 121831 - DNA, 22 bp, Artificial Sequence
  chemically synthesized
cttggtgcagagctgtgttcaa

SEQ ID NO: 121832 - DNA, 22 bp, Artificial Sequence
  chemically synthesized
ggtgcagagctgtgttcaattc

SEQ ID NO: 121833 - DNA, 22 bp, Artificial Sequence
  chemically synthesized
gtgcagagctgtgttcaattcc

SEQ ID NO: 121834 - DNA, 22 bp, Artificial Sequence
  chemically synthesized
tgttcaattcctggatatcctt

SEQ ID NO: 121835 - DNA, 22 bp, Artificial Sequence
  chemically synthesized
aattcctggatatccttgttaa

SEQ ID NO: 121836 - DNA, 22 bp, Artificial Sequence
  chemically synthesized
ctggatatccttgttaactttc

SEQ ID NO: 121837 - DNA, 22 bp, Artificial Sequence
  chemically synthesized
gatatccttgttaactttctgt

SEQ ID NO: 121838 - DNA, 22 bp, Artificial Sequence
  chemically synthesized
gttaactttctgtctcgttgat

SEQ ID NO: 121839 - DNA, 22 bp, Artificial Sequence
  chemically synthesized
ttaactttctgtctcgttgatc

SEQ ID NO: 121840 - DNA, 22 bp, Artificial Sequence
  chemically synthesized
actttctgtctcgttgatctgt

SEQ ID NO: 121841 - DNA, 22 bp, Artificial Sequence
  chemically synthesized
tctgtctcgttgatctgtctaa

SEQ ID NO: 121842 - DNA, 22 bp, Artificial Sequence
  chemically synthesized
ctgtctcgttgatctgtctaat

SEQ ID NO: 121843 - DNA, 22 bp, Artificial Sequence
  chemically synthesized
tgtctcgttgatctgtctaatg

SEQ ID NO: 121844 - DNA, 22 bp, Artificial Sequence
  chemically synthesized
tctcgttgatctgtctaatgtt

SEQ ID NO: 121845 - DNA, 22 bp, Artificial Sequence
  chemically synthesized
gttgatctgtctaatgttgaca

SEQ ID NO: 121846 - DNA, 22 bp, Artificial Sequence
  chemically synthesized
atctgtctaatgttgacagtgg

SEQ ID NO: 121847 - DNA, 22 bp, Artificial Sequence
  chemically synthesized
tctaatgttgacagtggggtat

SEQ ID NO: 121848 - DNA, 22 bp, Artificial Sequence
  chemically synthesized
atgttgacagtggggtattaaa

SEQ ID NO: 121849 - DNA, 22 bp, Artificial Sequence
  chemically synthesized
acagtggggtattaaagtctcc

SEQ ID NO: 121850 - DNA, 22 bp, Artificial Sequence
  chemically synthesized
aagtctcccattattaaagtgt

SEQ ID NO: 121851 - DNA, 22 bp, Artificial Sequence
  chemically synthesized
ccattattaaagtgtgggagtc

SEQ ID NO: 121852 - DNA, 22 bp, Artificial Sequence
  chemically synthesized
ttaaagtgtgggagtctaagtc

SEQ ID NO: 121853 - DNA, 22 bp, Artificial Sequence
  chemically synthesized
aagtgtgggagtctaagtctct

SEQ ID NO: 121854 - DNA, 22 bp, Artificial Sequence
  chemically synthesized
agtctctttgtaggtctctaag

SEQ ID NO: 121855 - DNA, 22 bp, Artificial Sequence
  chemically synthesized
tttgtaggtctctaaggacttg

SEQ ID NO: 121856 - DNA, 22 bp, Artificial Sequence
  chemically synthesized
tgtaggtctctaaggacttgct

SEQ ID NO: 121857 - DNA, 22 bp, Artificial Sequence
  chemically synthesized
gtaggtctctaaggacttgctt

SEQ ID NO: 121858 - DNA, 22 bp, Artificial Sequence
  chemically synthesized
taggtctctaaggacttgcttt

SEQ ID NO: 121859 - DNA, 22 bp, Artificial Sequence
  chemically synthesized
taaggacttgctttatgaatct

SEQ ID NO: 121860 - DNA, 22 bp, Artificial Sequence
  chemically synthesized
aggacttgctttatgaatctgg

SEQ ID NO: 121861 - DNA, 22 bp, Artificial Sequence
  chemically synthesized
gctttatgaatctgggtgctcc

SEQ ID NO: 121862 - DNA, 22 bp, Artificial Sequence
  chemically synthesized
ctttatgaatctgggtgctcct

SEQ ID NO: 121863 - DNA, 22 bp, Artificial Sequence
  chemically synthesized
tatgaatctgggtgctcctgta

SEQ ID NO: 121864 - DNA, 22 bp, Artificial Sequence
  chemically synthesized
atgaatctgggtgctcctgtat

SEQ ID NO: 121865 - DNA, 22 bp, Artificial Sequence
  chemically synthesized
tgaatctgggtgctcctgtatt

SEQ ID NO: 121866 - DNA, 22 bp, Artificial Sequence
  chemically synthesized
ggtgctcctgtattgggtgcat

SEQ ID NO: 121867 - DNA, 22 bp, Artificial Sequence
  chemically synthesized
ctgtattgggtgcatatatatt

SEQ ID NO: 121868 - DNA, 22 bp, Artificial Sequence
  chemically synthesized
tattgggtgcatatatatttag

SEQ ID NO: 121869 - DNA, 22 bp, Artificial Sequence
  chemically synthesized
ggtgcatatatatttaggatag

SEQ ID NO: 121870 - DNA, 22 bp, Artificial Sequence
  chemically synthesized
aggatagttagctcttcttgtt

SEQ ID NO: 121871 - DNA, 22 bp, Artificial Sequence
  chemically synthesized
ggatagttagctcttcttgttg

SEQ ID NO: 121872 - DNA, 22 bp, Artificial Sequence
  chemically synthesized
gctcttcttgttgaattgatcc

SEQ ID NO: 121873 - DNA, 22 bp, Artificial Sequence
  chemically synthesized
ttcttgttgaattgatcccttt

SEQ ID NO: 121874 - DNA, 22 bp, Artificial Sequence
  chemically synthesized
cttgttgaattgatccctttac

SEQ ID NO: 121875 - DNA, 22 bp, Artificial Sequence
  chemically synthesized
ttgttgaattgatccctttacc

SEQ ID NO: 121876 - DNA, 22 bp, Artificial Sequence
  chemically synthesized
gttgaattgatccctttaccat

SEQ ID NO: 121877 - DNA, 22 bp, Artificial Sequence
  chemically synthesized
ttgaattgatccctttaccatt

SEQ ID NO: 121878 - DNA, 22 bp, Artificial Sequence
  chemically synthesized
aattgatccctttaccattatg

SEQ ID NO: 121879 - DNA, 22 bp, Artificial Sequence
  chemically synthesized
atccctttaccattatgtaatg

SEQ ID NO: 121880 - DNA, 22 bp, Artificial Sequence
  chemically synthesized
taccattatgtaatggccttct

SEQ ID NO: 121881 - DNA, 22 bp, Artificial Sequence
  chemically synthesized
accattatgtaatggccttctt

SEQ ID NO: 121882 - DNA, 22 bp, Artificial Sequence
  chemically synthesized
ccattatgtaatggccttcttt

SEQ ID NO: 121883 - DNA, 22 bp, Artificial Sequence
  chemically synthesized
tgtaatggccttctttgtctct

SEQ ID NO: 121884 - DNA, 22 bp, Artificial Sequence
  chemically synthesized
ctttgtctcttttgatctttgt

SEQ ID NO: 121885 - DNA, 22 bp, Artificial Sequence
  chemically synthesized
tttgtctcttttgatctttgtt

SEQ ID NO: 121886 - DNA, 22 bp, Artificial Sequence
  chemically synthesized
tgtctcttttgatctttgttgg

SEQ ID NO: 121887 - DNA, 22 bp, Artificial Sequence
  chemically synthesized
gtctcttttgatctttgttggt

SEQ ID NO: 121888 - DNA, 22 bp, Artificial Sequence
  chemically synthesized
tctcttttgatctttgttggtt

SEQ ID NO: 121889 - DNA, 22 bp, Artificial Sequence
  chemically synthesized
ttttgatctttgttggtttaaa

SEQ ID NO: 121890 - DNA, 22 bp, Artificial Sequence
  chemically synthesized
ttgatctttgttggtttaaagc

SEQ ID NO: 121891 - DNA, 22 bp, Artificial Sequence
  chemically synthesized
tgatctttgttggtttaaagcc

SEQ ID NO: 121892 - DNA, 22 bp, Artificial Sequence
  chemically synthesized
gatctttgttggtttaaagcct

SEQ ID NO: 121893 - DNA, 22 bp, Artificial Sequence
  chemically synthesized
atctttgttggtttaaagcctg

SEQ ID NO: 121894 - DNA, 22 bp, Artificial Sequence
  chemically synthesized
tgttggtttaaagcctgtttta

SEQ ID NO: 121895 - DNA, 22 bp, Artificial Sequence
  chemically synthesized
gttggtttaaagcctgttttat

SEQ ID NO: 121896 - DNA, 22 bp, Artificial Sequence
  chemically synthesized
ttggtttaaagcctgttttatc

SEQ ID NO: 121897 - DNA, 22 bp, Artificial Sequence
  chemically synthesized
gtttaaagcctgttttatcaga

SEQ ID NO: 121898 - DNA, 22 bp, Artificial Sequence
  chemically synthesized
aaagcctgttttatcagagact

SEQ ID NO: 121899 - DNA, 22 bp, Artificial Sequence
  chemically synthesized
aagcctgttttatcagagacta

SEQ ID NO: 121900 - DNA, 22 bp, Artificial Sequence
  chemically synthesized
ttttatcagagactaggattgc

SEQ ID NO: 121901 - DNA, 22 bp, Artificial Sequence
  chemically synthesized
tatcagagactaggattgcaac

SEQ ID NO: 121902 - DNA, 22 bp, Artificial Sequence
  chemically synthesized
atcagagactaggattgcaacc

SEQ ID NO: 121903 - DNA, 22 bp, Artificial Sequence
  chemically synthesized
tcagagactaggattgcaaccc

SEQ ID NO: 121904 - DNA, 22 bp, Artificial Sequence
  chemically synthesized
ggattgcaacccctgccttttt

SEQ ID NO: 121905 - DNA, 22 bp, Artificial Sequence
  chemically synthesized
caacccctgcctttttttgttt

SEQ ID NO: 121906 - DNA, 22 bp, Artificial Sequence
  chemically synthesized
cctttttttgttttccatttgc

SEQ ID NO: 121907 - DNA, 22 bp, Artificial Sequence
  chemically synthesized
tttttgttttccatttgcttgg

SEQ ID NO: 121908 - DNA, 22 bp, Artificial Sequence
  chemically synthesized
ttttgttttccatttgcttggt

SEQ ID NO: 121909 - DNA, 22 bp, Artificial Sequence
  chemically synthesized
tttgttttccatttgcttggta

SEQ ID NO: 121910 - DNA, 22 bp, Artificial Sequence
  chemically synthesized
ttgttttccatttgcttggtag

SEQ ID NO: 121911 - DNA, 22 bp, Artificial Sequence
  chemically synthesized
tgttttccatttgcttggtaga

SEQ ID NO: 121912 - DNA, 22 bp, Artificial Sequence
  chemically synthesized
gttttccatttgcttggtagat

SEQ ID NO: 121913 - DNA, 22 bp, Artificial Sequence
  chemically synthesized
ttttccatttgcttggtagatc

SEQ ID NO: 121914 - DNA, 22 bp, Artificial Sequence
  chemically synthesized
tccatttgcttggtagatcttc

SEQ ID NO: 121915 - DNA, 22 bp, Artificial Sequence
  chemically synthesized
ccatttgcttggtagatcttcc

SEQ ID NO: 121916 - DNA, 22 bp, Artificial Sequence
  chemically synthesized
catttgcttggtagatcttcct

SEQ ID NO: 121917 - DNA, 22 bp, Artificial Sequence
  chemically synthesized
gcttggtagatcttcctccatc

SEQ ID NO: 121918 - DNA, 22 bp, Artificial Sequence
  chemically synthesized
cttggtagatcttcctccatcc

SEQ ID NO: 121919 - DNA, 22 bp, Artificial Sequence
  chemically synthesized
ggtagatcttcctccatccttt

SEQ ID NO: 121920 - DNA, 22 bp, Artificial Sequence
  chemically synthesized
gtagatcttcctccatcctttt

SEQ ID NO: 121921 - DNA, 22 bp, Artificial Sequence
  chemically synthesized
cctccatccttttattttgagc

SEQ ID NO: 121922 - DNA, 22 bp, Artificial Sequence
  chemically synthesized
ctccatccttttattttgagcc

SEQ ID NO: 121923 - DNA, 22 bp, Artificial Sequence
  chemically synthesized
catccttttattttgagcctat

SEQ ID NO: 121924 - DNA, 22 bp, Artificial Sequence
  chemically synthesized
ttattttgagcctatgtgtgtg

SEQ ID NO: 121925 - DNA, 22 bp, Artificial Sequence
  chemically synthesized
tattttgagcctatgtgtgtgt

SEQ ID NO: 121926 - DNA, 22 bp, Artificial Sequence
  chemically synthesized
attttgagcctatgtgtgtgtg

SEQ ID NO: 121927 - DNA, 22 bp, Artificial Sequence
  chemically synthesized
ttttgagcctatgtgtgtgtgt

SEQ ID NO: 121928 - DNA, 22 bp, Artificial Sequence
  chemically synthesized
tgagcctatgtgtgtgtgtgca

SEQ ID NO: 121929 - DNA, 22 bp, Artificial Sequence
  chemically synthesized
gagcctatgtgtgtgtgtgcac

SEQ ID NO: 121930 - DNA, 22 bp, Artificial Sequence
  chemically synthesized
agcctatgtgtgtgtgtgcaca

SEQ ID NO: 121931 - DNA, 22 bp, Artificial Sequence
  chemically synthesized
tgtgtgtgtgtgcacatgagat

SEQ ID NO: 121932 - DNA, 22 bp, Artificial Sequence
  chemically synthesized
cctgaatacactctttatccaa

SEQ ID NO: 121933 - DNA, 22 bp, Artificial Sequence
  chemically synthesized
ctgaatacactctttatccaat

SEQ ID NO: 121934 - DNA, 22 bp, Artificial Sequence
  chemically synthesized
aatacactctttatccaatttg

SEQ ID NO: 121935 - DNA, 22 bp, Artificial Sequence
  chemically synthesized
tttatccaatttgccagtctgt

SEQ ID NO: 121936 - DNA, 22 bp, Artificial Sequence
  chemically synthesized
tatccaatttgccagtctgtgt

SEQ ID NO: 121937 - DNA, 22 bp, Artificial Sequence
  chemically synthesized
atccaatttgccagtctgtgtc

SEQ ID NO: 121938 - DNA, 22 bp, Artificial Sequence
  chemically synthesized
tccaatttgccagtctgtgtct

SEQ ID NO: 121939 - DNA, 22 bp, Artificial Sequence
  chemically synthesized
gccagtctgtgtctttcaattg

SEQ ID NO: 121940 - DNA, 22 bp, Artificial Sequence
  chemically synthesized
ccagtctgtgtctttcaattgg

SEQ ID NO: 121941 - DNA, 22 bp, Artificial Sequence
  chemically synthesized
tgtctttcaattggagcactta

SEQ ID NO: 121942 - DNA, 22 bp, Artificial Sequence
  chemically synthesized
tcaattggagcacttagtccat

SEQ ID NO: 121943 - DNA, 22 bp, Artificial Sequence
  chemically synthesized
caattggagcacttagtccatt

SEQ ID NO: 121944 - DNA, 22 bp, Artificial Sequence
  chemically synthesized
aattggagcacttagtccattt

SEQ ID NO: 121945 - DNA, 22 bp, Artificial Sequence
  chemically synthesized
gagcacttagtccatttacatt

SEQ ID NO: 121946 - DNA, 22 bp, Artificial Sequence
  chemically synthesized
agtccatttacatttaaagtta

SEQ ID NO: 121947 - DNA, 22 bp, Artificial Sequence
  chemically synthesized
gtccatttacatttaaagttaa

SEQ ID NO: 121948 - DNA, 22 bp, Artificial Sequence
  chemically synthesized
acatttaaagttaatattgtat

SEQ ID NO: 121949 - DNA, 22 bp, Artificial Sequence
  chemically synthesized
catttaaagttaatattgtatg

SEQ ID NO: 121950 - DNA, 22 bp, Artificial Sequence
  chemically synthesized
aaagttaatattgtatgtgtga

SEQ ID NO: 121951 - DNA, 22 bp, Artificial Sequence
  chemically synthesized
aagttaatattgtatgtgtgaa

SEQ ID NO: 121952 - DNA, 22 bp, Artificial Sequence
  chemically synthesized
atattgtatgtgtgaatttgat

SEQ ID NO: 121953 - DNA, 22 bp, Artificial Sequence
  chemically synthesized
tatgtgtgaatttgatcctgtc

SEQ ID NO: 121954 - DNA, 22 bp, Artificial Sequence
  chemically synthesized
gatcctgtcattatgatagctg

SEQ ID NO: 121955 - DNA, 22 bp, Artificial Sequence
  chemically synthesized
atcctgtcattatgatagctgg

SEQ ID NO: 121956 - DNA, 22 bp, Artificial Sequence
  chemically synthesized
tcattatgatagctggttattt

SEQ ID NO: 121957 - DNA, 22 bp, Artificial Sequence
  chemically synthesized
tgatagctggttattttgctcg

SEQ ID NO: 121958 - DNA, 22 bp, Artificial Sequence
  chemically synthesized
gttattttgctcgttagttgat

SEQ ID NO: 121959 - DNA, 22 bp, Artificial Sequence
  chemically synthesized
ttttgctcgttagttgatgcag

SEQ ID NO: 121960 - DNA, 22 bp, Artificial Sequence
  chemically synthesized
tgctcgttagttgatgcagttt

SEQ ID NO: 121961 - DNA, 22 bp, Artificial Sequence
  chemically synthesized
gctcgttagttgatgcagtttc

SEQ ID NO: 121962 - DNA, 22 bp, Artificial Sequence
  chemically synthesized
ctcgttagttgatgcagtttct

SEQ ID NO: 121963 - DNA, 22 bp, Artificial Sequence
  chemically synthesized
gttagttgatgcagtttcttcc

SEQ ID NO: 121964 - DNA, 22 bp, Artificial Sequence
  chemically synthesized
gttgatgcagtttcttcctagt

SEQ ID NO: 121965 - DNA, 22 bp, Artificial Sequence
  chemically synthesized
atgcagtttcttcctagtcttg

SEQ ID NO: 121966 - DNA, 22 bp, Artificial Sequence
  chemically synthesized
cttcctagtcttgatggtcttc

SEQ ID NO: 121967 - DNA, 22 bp, Artificial Sequence
  chemically synthesized
ttcctagtcttgatggtcttca

SEQ ID NO: 121968 - DNA, 22 bp, Artificial Sequence
  chemically synthesized
cctagtcttgatggtcttcaca

SEQ ID NO: 121969 - DNA, 22 bp, Artificial Sequence
  chemically synthesized
ctagtcttgatggtcttcacat

SEQ ID NO: 121970 - DNA, 22 bp, Artificial Sequence
  chemically synthesized
gtcttgatggtcttcacatttt

SEQ ID NO: 121971 - DNA, 22 bp, Artificial Sequence
  chemically synthesized
gatggtcttcacattttggcct

SEQ ID NO: 121972 - DNA, 22 bp, Artificial Sequence
  chemically synthesized
atggtcttcacattttggcctg

SEQ ID NO: 121973 - DNA, 22 bp, Artificial Sequence
  chemically synthesized
cacattttggcctgattttgca

SEQ ID NO: 121974 - DNA, 22 bp, Artificial Sequence
  chemically synthesized
acattttggcctgattttgcag

SEQ ID NO: 121975 - DNA, 22 bp, Artificial Sequence
  chemically synthesized
tggcctgattttgcagtggctg

SEQ ID NO: 121976 - DNA, 22 bp, Artificial Sequence
  chemically synthesized
ggcctgattttgcagtggctgg

SEQ ID NO: 121977 - DNA, 22 bp, Artificial Sequence
  chemically synthesized
gcctgattttgcagtggctggt

SEQ ID NO: 121978 - DNA, 22 bp, Artificial Sequence
  chemically synthesized
attttgcagtggctggtaccgg

SEQ ID NO: 121979 - DNA, 22 bp, Artificial Sequence
  chemically synthesized
tgcagtggctggtaccggttgt

SEQ ID NO: 121980 - DNA, 22 bp, Artificial Sequence
  chemically synthesized
gcagtggctggtaccggttgtg

SEQ ID NO: 121981 - DNA, 22 bp, Artificial Sequence
  chemically synthesized
cagtggctggtaccggttgtgc

SEQ ID NO: 121982 - DNA, 22 bp, Artificial Sequence
  chemically synthesized
gtaccggttgtgcctttccatg

SEQ ID NO: 121983 - DNA, 22 bp, Artificial Sequence
  chemically synthesized
tgcctttccatgtttagtgctt

SEQ ID NO: 121984 - DNA, 22 bp, Artificial Sequence
  chemically synthesized
tccatgtttagtgcttccttca

SEQ ID NO: 121985 - DNA, 22 bp, Artificial Sequence
  chemically synthesized
ccatgtttagtgcttccttcag

SEQ ID NO: 121986 - DNA, 22 bp, Artificial Sequence
  chemically synthesized
catgtttagtgcttccttcagg

SEQ ID NO: 121987 - DNA, 22 bp, Artificial Sequence
  chemically synthesized
agtgcttccttcaggagctctt

SEQ ID NO: 121988 - DNA, 22 bp, Artificial Sequence
  chemically synthesized
gtgcttccttcaggagctcttt

SEQ ID NO: 121989 - DNA, 22 bp, Artificial Sequence
  chemically synthesized
ccttcaggagctcttttaggtc

SEQ ID NO: 121990 - DNA, 22 bp, Artificial Sequence
  chemically synthesized
cttcaggagctcttttaggtca

SEQ ID NO: 121991 - DNA, 22 bp, Artificial Sequence
  chemically synthesized
caggagctcttttaggtcaggc

SEQ ID NO: 121992 - DNA, 22 bp, Artificial Sequence
  chemically synthesized
aggagctcttttaggtcaggcc

SEQ ID NO: 121993 - DNA, 22 bp, Artificial Sequence
  chemically synthesized
ttttaggtcaggcctggtgatg

SEQ ID NO: 121994 - DNA, 22 bp, Artificial Sequence
  chemically synthesized
ttaggtcaggcctggtgatgac

SEQ ID NO: 121995 - DNA, 22 bp, Artificial Sequence
  chemically synthesized
taggtcaggcctggtgatgaca

SEQ ID NO: 121996 - DNA, 22 bp, Artificial Sequence
  chemically synthesized
aggtcaggcctggtgatgacaa

SEQ ID NO: 121997 - DNA, 22 bp, Artificial Sequence
  chemically synthesized
ggtcaggcctggtgatgacaaa

SEQ ID NO: 121998 - DNA, 22 bp, Artificial Sequence
  chemically synthesized
gtgatgacaaaatctctcagca

SEQ ID NO: 121999 - DNA, 22 bp, Artificial Sequence
  chemically synthesized
tcagcatttgcttgtctgtaaa

SEQ ID NO: 122000 - DNA, 22 bp, Artificial Sequence
  chemically synthesized
agcatttgcttgtctgtaaagt

SEQ ID NO: 122001 - DNA, 22 bp, Artificial Sequence
  chemically synthesized
gcttgtctgtaaagtattttat

SEQ ID NO: 122002 - DNA, 22 bp, Artificial Sequence
  chemically synthesized
cttgtctgtaaagtattttatt

SEQ ID NO: 122003 - DNA, 22 bp, Artificial Sequence
  chemically synthesized
gtctgtaaagtattttatttct

SEQ ID NO: 122004 - DNA, 22 bp, Artificial Sequence
  chemically synthesized
tctgtaaagtattttatttctc

SEQ ID NO: 122005 - DNA, 22 bp, Artificial Sequence
  chemically synthesized
taaagtattttatttctccttc

SEQ ID NO: 122006 - DNA, 22 bp, Artificial Sequence
  chemically synthesized
tatttctccttcacttatgaag

SEQ ID NO: 122007 - DNA, 22 bp, Artificial Sequence
  chemically synthesized
atttctccttcacttatgaagc

SEQ ID NO: 122008 - DNA, 22 bp, Artificial Sequence
  chemically synthesized
tttctccttcacttatgaagct

SEQ ID NO: 122009 - DNA, 22 bp, Artificial Sequence
  chemically synthesized
ctccttcacttatgaagcttag

SEQ ID NO: 122010 - DNA, 22 bp, Artificial Sequence
  chemically synthesized
tccttcacttatgaagcttagt

SEQ ID NO: 122011 - DNA, 22 bp, Artificial Sequence
  chemically synthesized
cttcacttatgaagcttagttt

SEQ ID NO: 122012 - DNA, 22 bp, Artificial Sequence
  chemically synthesized
cacttatgaagcttagtttggc

SEQ ID NO: 122013 - DNA, 22 bp, Artificial Sequence
  chemically synthesized
acttatgaagcttagtttggct

SEQ ID NO: 122014 - DNA, 22 bp, Artificial Sequence
  chemically synthesized
atgaagcttagtttggctggat

SEQ ID NO: 122015 - DNA, 22 bp, Artificial Sequence
  chemically synthesized
tgaagcttagtttggctggata

SEQ ID NO: 122016 - DNA, 22 bp, Artificial Sequence
  chemically synthesized
agtttggctggatattaaattc

SEQ ID NO: 122017 - DNA, 22 bp, Artificial Sequence
  chemically synthesized
gtttggctggatattaaattct

SEQ ID NO: 122018 - DNA, 22 bp, Artificial Sequence
  chemically synthesized
ggctggatattaaattctgtgt

SEQ ID NO: 122019 - DNA, 22 bp, Artificial Sequence
  chemically synthesized
gctggatattaaattctgtgtt

SEQ ID NO: 122020 - DNA, 22 bp, Artificial Sequence
  chemically synthesized
gatattaaattctgtgttgaaa

SEQ ID NO: 122021 - DNA, 22 bp, Artificial Sequence
  chemically synthesized
aattctgtgttgaaaattcttt

SEQ ID NO: 122022 - DNA, 22 bp, Artificial Sequence
  chemically synthesized
tgtgttgaaaattctttccttt

SEQ ID NO: 122023 - DNA, 22 bp, Artificial Sequence
  chemically synthesized
tgttgaaaattctttcctttaa

SEQ ID NO: 122024 - DNA, 22 bp, Artificial Sequence
  chemically synthesized
aaaattctttcctttaaggatg

SEQ ID NO: 122025 - DNA, 22 bp, Artificial Sequence
  chemically synthesized
tttcctttaaggatgttgaata

SEQ ID NO: 122026 - DNA, 22 bp, Artificial Sequence
  chemically synthesized
tcctttaaggatgttgaatatt

SEQ ID NO: 122027 - DNA, 22 bp, Artificial Sequence
  chemically synthesized
cctttaaggatgttgaatattg

SEQ ID NO: 122028 - DNA, 22 bp, Artificial Sequence
  chemically synthesized
ctttaaggatgttgaatattgg

SEQ ID NO: 122029 - DNA, 22 bp, Artificial Sequence
  chemically synthesized
taaggatgttgaatattggccc

SEQ ID NO: 122030 - DNA, 22 bp, Artificial Sequence
  chemically synthesized
aaggatgttgaatattggcccc

SEQ ID NO: 122031 - DNA, 22 bp, Artificial Sequence
  chemically synthesized
aggatgttgaatattggccccc

SEQ ID NO: 122032 - DNA, 22 bp, Artificial Sequence
  chemically synthesized
aatattggcccccactctcttc

SEQ ID NO: 122033 - DNA, 22 bp, Artificial Sequence
  chemically synthesized
gcccccactctcttctggcttg

SEQ ID NO: 122034 - DNA, 22 bp, Artificial Sequence
  chemically synthesized
tcttctggcttgtagagtttct

SEQ ID NO: 122035 - DNA, 22 bp, Artificial Sequence
  chemically synthesized
ttctggcttgtagagtttctgc

SEQ ID NO: 122036 - DNA, 22 bp, Artificial Sequence
  chemically synthesized
ctggcttgtagagtttctgcca

SEQ ID NO: 122037 - DNA, 22 bp, Artificial Sequence
  chemically synthesized
tggcttgtagagtttctgccaa

SEQ ID NO: 122038 - DNA, 22 bp, Artificial Sequence
  chemically synthesized
gcttgtagagtttctgccaaga

SEQ ID NO: 122039 - DNA, 22 bp, Artificial Sequence
  chemically synthesized
gtagagtttctgccaagagagc

SEQ ID NO: 122040 - DNA, 22 bp, Artificial Sequence
  chemically synthesized
tagagtttctgccaagagagct

SEQ ID NO: 122041 - DNA, 22 bp, Artificial Sequence
  chemically synthesized
ctgccaagagagctgctgttag

SEQ ID NO: 122042 - DNA, 22 bp, Artificial Sequence
  chemically synthesized
tgccaagagagctgctgttagt

SEQ ID NO: 122043 - DNA, 22 bp, Artificial Sequence
  chemically synthesized
ccaagagagctgctgttagtct

SEQ ID NO: 122044 - DNA, 22 bp, Artificial Sequence
  chemically synthesized
ctgttagtctgatgggcttccc

SEQ ID NO: 122045 - DNA, 22 bp, Artificial Sequence
  chemically synthesized
ttagtctgatgggcttcccttt

SEQ ID NO: 122046 - DNA, 22 bp, Artificial Sequence
  chemically synthesized
gtctgatgggcttccctttgtg

SEQ ID NO: 122047 - DNA, 22 bp, Artificial Sequence
  chemically synthesized
atgggcttccctttgtgggtaa

SEQ ID NO: 122048 - DNA, 22 bp, Artificial Sequence
  chemically synthesized
ccctttgtgggtaacccgacct

SEQ ID NO: 122049 - DNA, 22 bp, Artificial Sequence
  chemically synthesized
cctttgtgggtaacccgacctt

SEQ ID NO: 122050 - DNA, 22 bp, Artificial Sequence
  chemically synthesized
tgtgggtaacccgacctttctc

SEQ ID NO: 122051 - DNA, 22 bp, Artificial Sequence
  chemically synthesized
gtgggtaacccgacctttctct

SEQ ID NO: 122052 - DNA, 22 bp, Artificial Sequence
  chemically synthesized
tgggtaacccgacctttctctc

SEQ ID NO: 122053 - DNA, 22 bp, Artificial Sequence
  chemically synthesized
tctctctggctgcccttaacat

SEQ ID NO: 122054 - DNA, 22 bp, Artificial Sequence
  chemically synthesized
ctctctggctgcccttaacatt

SEQ ID NO: 122055 - DNA, 22 bp, Artificial Sequence
  chemically synthesized
tctctggctgcccttaacattt

SEQ ID NO: 122056 - DNA, 22 bp, Artificial Sequence
  chemically synthesized
tctggctgcccttaacattttt

SEQ ID NO: 122057 - DNA, 22 bp, Artificial Sequence
  chemically synthesized
tggctgcccttaacattttttc

SEQ ID NO: 122058 - DNA, 22 bp, Artificial Sequence
  chemically synthesized
gctgcccttaacattttttcct

SEQ ID NO: 122059 - DNA, 22 bp, Artificial Sequence
  chemically synthesized
cccttaacattttttccttcat

SEQ ID NO: 122060 - DNA, 22 bp, Artificial Sequence
  chemically synthesized
aacattttttccttcatttcaa

SEQ ID NO: 122061 - DNA, 22 bp, Artificial Sequence
  chemically synthesized
acattttttccttcatttcaac

SEQ ID NO: 122062 - DNA, 22 bp, Artificial Sequence
  chemically synthesized
tttccttcatttcaactttggt

SEQ ID NO: 122063 - DNA, 22 bp, Artificial Sequence
  chemically synthesized
ttccttcatttcaactttggtg

SEQ ID NO: 122064 - DNA, 22 bp, Artificial Sequence
  chemically synthesized
tccttcatttcaactttggtga

SEQ ID NO: 122065 - DNA, 22 bp, Artificial Sequence
  chemically synthesized
ccttcatttcaactttggtgaa

SEQ ID NO: 122066 - DNA, 22 bp, Artificial Sequence
  chemically synthesized
cttcatttcaactttggtgaat

SEQ ID NO: 122067 - DNA, 22 bp, Artificial Sequence
  chemically synthesized
catttcaactttggtgaatctg

SEQ ID NO: 122068 - DNA, 22 bp, Artificial Sequence
  chemically synthesized
atttcaactttggtgaatctga

SEQ ID NO: 122069 - DNA, 22 bp, Artificial Sequence
  chemically synthesized
caactttggtgaatctgacaat

SEQ ID NO: 122070 - DNA, 22 bp, Artificial Sequence
  chemically synthesized
aactttggtgaatctgacaatt

SEQ ID NO: 122071 - DNA, 22 bp, Artificial Sequence
  chemically synthesized
tggtgaatctgacaattatgtg

SEQ ID NO: 122072 - DNA, 22 bp, Artificial Sequence
  chemically synthesized
ggtgaatctgacaattatgtgt

SEQ ID NO: 122073 - DNA, 22 bp, Artificial Sequence
  chemically synthesized
gtgaatctgacaattatgtgtc

SEQ ID NO: 122074 - DNA, 22 bp, Artificial Sequence
  chemically synthesized
acaattatgtgtcttggagttg

SEQ ID NO: 122075 - DNA, 22 bp, Artificial Sequence
  chemically synthesized
tgtgtcttggagttgctcttct

SEQ ID NO: 122076 - DNA, 22 bp, Artificial Sequence
  chemically synthesized
ggagttgctcttctcgaggagt

SEQ ID NO: 122077 - DNA, 22 bp, Artificial Sequence
  chemically synthesized
gagttgctcttctcgaggagta

SEQ ID NO: 122078 - DNA, 22 bp, Artificial Sequence
  chemically synthesized
ctcttctcgaggagtatgtttg

SEQ ID NO: 122079 - DNA, 22 bp, Artificial Sequence
  chemically synthesized
ttctcgaggagtatgtttgtgg

SEQ ID NO: 122080 - DNA, 22 bp, Artificial Sequence
  chemically synthesized
ctcgaggagtatgtttgtggcg

SEQ ID NO: 122081 - DNA, 22 bp, Artificial Sequence
  chemically synthesized
tcgaggagtatgtttgtggcgt

SEQ ID NO: 122082 - DNA, 22 bp, Artificial Sequence
  chemically synthesized
gaggagtatgtttgtggcgttc

SEQ ID NO: 122083 - DNA, 22 bp, Artificial Sequence
  chemically synthesized
gtggcgttctctgtatttcctg

SEQ ID NO: 122084 - DNA, 22 bp, Artificial Sequence
  chemically synthesized
tggcgttctctgtatttcctga

SEQ ID NO: 122085 - DNA, 22 bp, Artificial Sequence
  chemically synthesized
tctgtatttcctgaatctgaat

SEQ ID NO: 122086 - DNA, 22 bp, Artificial Sequence
  chemically synthesized
tgtatttcctgaatctgaatgt

SEQ ID NO: 122087 - DNA, 22 bp, Artificial Sequence
  chemically synthesized
tatttcctgaatctgaatgttg

SEQ ID NO: 122088 - DNA, 22 bp, Artificial Sequence
  chemically synthesized
cctgaatctgaatgttggcctg

SEQ ID NO: 122089 - DNA, 22 bp, Artificial Sequence
  chemically synthesized
ctgaatctgaatgttggcctgc

SEQ ID NO: 122090 - DNA, 22 bp, Artificial Sequence
  chemically synthesized
aatctgaatgttggcctgcctt

SEQ ID NO: 122091 - DNA, 22 bp, Artificial Sequence
  chemically synthesized
aatgttggcctgccttgctaga

SEQ ID NO: 122092 - DNA, 22 bp, Artificial Sequence
  chemically synthesized
gcctgccttgctagattgggga

SEQ ID NO: 122093 - DNA, 22 bp, Artificial Sequence
  chemically synthesized
ccttgctagattggggaagttc

SEQ ID NO: 122094 - DNA, 22 bp, Artificial Sequence
  chemically synthesized
gctagattggggaagttctcct

SEQ ID NO: 122095 - DNA, 22 bp, Artificial Sequence
  chemically synthesized
ctagattggggaagttctcctg

SEQ ID NO: 122096 - DNA, 22 bp, Artificial Sequence
  chemically synthesized
gattggggaagttctcctggat

SEQ ID NO: 122097 - DNA, 22 bp, Artificial Sequence
  chemically synthesized
gggaagttctcctggataatat

SEQ ID NO: 122098 - DNA, 22 bp, Artificial Sequence
  chemically synthesized
tcctggataatatcctgcagag

SEQ ID NO: 122099 - DNA, 22 bp, Artificial Sequence
  chemically synthesized
ctggataatatcctgcagagtg

SEQ ID NO: 122100 - DNA, 22 bp, Artificial Sequence
  chemically synthesized
gataatatcctgcagagtgttt

SEQ ID NO: 122101 - DNA, 22 bp, Artificial Sequence
  chemically synthesized
cagagtgttttccaacttggtt

SEQ ID NO: 122102 - DNA, 22 bp, Artificial Sequence
  chemically synthesized
tccaacttggttcgattctccc

SEQ ID NO: 122103 - DNA, 22 bp, Artificial Sequence
  chemically synthesized
ccaacttggttcgattctcccc

SEQ ID NO: 122104 - DNA, 22 bp, Artificial Sequence
  chemically synthesized
caacttggttcgattctccccg

SEQ ID NO: 122105 - DNA, 22 bp, Artificial Sequence
  chemically synthesized
ggttcgattctccccgtcactt

SEQ ID NO: 122106 - DNA, 22 bp, Artificial Sequence
  chemically synthesized
gttcgattctccccgtcacttt

SEQ ID NO: 122107 - DNA, 22 bp, Artificial Sequence
  chemically synthesized
gattctccccgtcactttcagg

SEQ ID NO: 122108 - DNA, 22 bp, Artificial Sequence
  chemically synthesized
tccccgtcactttcaggtacac

SEQ ID NO: 122109 - DNA, 22 bp, Artificial Sequence
  chemically synthesized
cccgtcactttcaggtacacca

SEQ ID NO: 122110 - DNA, 22 bp, Artificial Sequence
  chemically synthesized
tcaggtacaccaatcagaccta

SEQ ID NO: 122111 - DNA, 22 bp, Artificial Sequence
  chemically synthesized
caggtacaccaatcagacctag

SEQ ID NO: 122112 - DNA, 22 bp, Artificial Sequence
  chemically synthesized
aggtacaccaatcagacctaga

SEQ ID NO: 122113 - DNA, 22 bp, Artificial Sequence
  chemically synthesized
gatttgatcttttcacatagtc

SEQ ID NO: 122114 - DNA, 22 bp, Artificial Sequence
  chemically synthesized
gatcttttcacatagtcccata

SEQ ID NO: 122115 - DNA, 22 bp, Artificial Sequence
  chemically synthesized
atcttttcacatagtcccatat

SEQ ID NO: 122116 - DNA, 22 bp, Artificial Sequence
  chemically synthesized
ttcacatagtcccatatttctt

SEQ ID NO: 122117 - DNA, 22 bp, Artificial Sequence
  chemically synthesized
tcacatagtcccatatttcttg

SEQ ID NO: 122118 - DNA, 22 bp, Artificial Sequence
  chemically synthesized
cacatagtcccatatttcttgg

SEQ ID NO: 122119 - DNA, 22 bp, Artificial Sequence
  chemically synthesized
acatagtcccatatttcttgga

SEQ ID NO: 122120 - DNA, 22 bp, Artificial Sequence
  chemically synthesized
cttggaggctttgttcatttct

SEQ ID NO: 122121 - DNA, 22 bp, Artificial Sequence
  chemically synthesized
ttggaggctttgttcatttctt

SEQ ID NO: 122122 - DNA, 22 bp, Artificial Sequence
  chemically synthesized
ggaggctttgttcatttctttt

SEQ ID NO: 122123 - DNA, 22 bp, Artificial Sequence
  chemically synthesized
gaggctttgttcatttcttttt

SEQ ID NO: 122124 - DNA, 22 bp, Artificial Sequence
  chemically synthesized
tgttcatttctttttattcttt

SEQ ID NO: 122125 - DNA, 22 bp, Artificial Sequence
  chemically synthesized
gttcatttctttttattctttt

SEQ ID NO: 122126 - DNA, 22 bp, Artificial Sequence
  chemically synthesized
ttcatttctttttattcttttt

SEQ ID NO: 122127 - DNA, 22 bp, Artificial Sequence
  chemically synthesized
atttctttttattcttttttct

SEQ ID NO: 122128 - DNA, 22 bp, Artificial Sequence
  chemically synthesized
ctttttattcttttttctctaa

SEQ ID NO: 122129 - DNA, 22 bp, Artificial Sequence
  chemically synthesized
tttttattcttttttctctaaa

SEQ ID NO: 122130 - DNA, 22 bp, Artificial Sequence
  chemically synthesized
tttattcttttttctctaaact

SEQ ID NO: 122131 - DNA, 22 bp, Artificial Sequence
  chemically synthesized
ttattcttttttctctaaactt

SEQ ID NO: 122132 - DNA, 22 bp, Artificial Sequence
  chemically synthesized
tattcttttttctctaaacttc

SEQ ID NO: 122133 - DNA, 22 bp, Artificial Sequence
  chemically synthesized
attcttttttctctaaacttcc

SEQ ID NO: 122134 - DNA, 22 bp, Artificial Sequence
  chemically synthesized
ttcttttttctctaaacttccc

SEQ ID NO: 122135 - DNA, 22 bp, Artificial Sequence
  chemically synthesized
ttttttctctaaacttcccttc

SEQ ID NO: 122136 - DNA, 22 bp, Artificial Sequence
  chemically synthesized
ttttctctaaacttcccttctc

SEQ ID NO: 122137 - DNA, 22 bp, Artificial Sequence
  chemically synthesized
tttctctaaacttcccttctcg

SEQ ID NO: 122138 - DNA, 22 bp, Artificial Sequence
  chemically synthesized
ttctctaaacttcccttctcgc

SEQ ID NO: 122139 - DNA, 22 bp, Artificial Sequence
  chemically synthesized
tctctaaacttcccttctcgct

SEQ ID NO: 122140 - DNA, 22 bp, Artificial Sequence
  chemically synthesized
ctctaaacttcccttctcgctt

SEQ ID NO: 122141 - DNA, 22 bp, Artificial Sequence
  chemically synthesized
tctaaacttcccttctcgcttc

SEQ ID NO: 122142 - DNA, 22 bp, Artificial Sequence
  chemically synthesized
taaacttcccttctcgcttcat

SEQ ID NO: 122143 - DNA, 22 bp, Artificial Sequence
  chemically synthesized
aacttcccttctcgcttcattt

SEQ ID NO: 122144 - DNA, 22 bp, Artificial Sequence
  chemically synthesized
cccttctcgcttcatttcattt

SEQ ID NO: 122145 - DNA, 22 bp, Artificial Sequence
  chemically synthesized
ccttctcgcttcatttcattta

SEQ ID NO: 122146 - DNA, 22 bp, Artificial Sequence
  chemically synthesized
ctcgcttcatttcatttatttc

SEQ ID NO: 122147 - DNA, 22 bp, Artificial Sequence
  chemically synthesized
tcgcttcatttcatttatttca

SEQ ID NO: 122148 - DNA, 22 bp, Artificial Sequence
  chemically synthesized
gcttcatttcatttatttcatc

SEQ ID NO: 122149 - DNA, 22 bp, Artificial Sequence
  chemically synthesized
catttcatttatttcatcttcc

SEQ ID NO: 122150 - DNA, 22 bp, Artificial Sequence
  chemically synthesized
atttcatttatttcatcttcca

SEQ ID NO: 122151 - DNA, 22 bp, Artificial Sequence
  chemically synthesized
catttatttcatcttccatcac

SEQ ID NO: 122152 - DNA, 22 bp, Artificial Sequence
  chemically synthesized
atttatttcatcttccatcact

SEQ ID NO: 122153 - DNA, 22 bp, Artificial Sequence
  chemically synthesized
atttcatcttccatcactgata

SEQ ID NO: 122154 - DNA, 22 bp, Artificial Sequence
  chemically synthesized
tttcatcttccatcactgatac

SEQ ID NO: 122155 - DNA, 22 bp, Artificial Sequence
  chemically synthesized
catcttccatcactgataccct

SEQ ID NO: 122156 - DNA, 22 bp, Artificial Sequence
  chemically synthesized
atcttccatcactgataccctt

SEQ ID NO: 122157 - DNA, 22 bp, Artificial Sequence
  chemically synthesized
ccatcactgataccctttcttc

SEQ ID NO: 122158 - DNA, 22 bp, Artificial Sequence
  chemically synthesized
catcactgataccctttcttcc

SEQ ID NO: 122159 - DNA, 22 bp, Artificial Sequence
  chemically synthesized
ataccctttcttccagttgatc

SEQ ID NO: 122160 - DNA, 22 bp, Artificial Sequence
  chemically synthesized
tcttccagttgatcgcatcagc

SEQ ID NO: 122161 - DNA, 22 bp, Artificial Sequence
  chemically synthesized
cttccagttgatcgcatcagct

SEQ ID NO: 122162 - DNA, 22 bp, Artificial Sequence
  chemically synthesized
ttccagttgatcgcatcagctc

SEQ ID NO: 122163 - DNA, 22 bp, Artificial Sequence
  chemically synthesized
ccagttgatcgcatcagctcct

SEQ ID NO: 122164 - DNA, 22 bp, Artificial Sequence
  chemically synthesized
cagttgatcgcatcagctcctg

SEQ ID NO: 122165 - DNA, 22 bp, Artificial Sequence
  chemically synthesized
atcgcatcagctcctgaggctt

SEQ ID NO: 122166 - DNA, 22 bp, Artificial Sequence
  chemically synthesized
ctgaggcttctccattcttcac

SEQ ID NO: 122167 - DNA, 22 bp, Artificial Sequence
  chemically synthesized
aggcttctccattcttcacgtc

SEQ ID NO: 122168 - DNA, 22 bp, Artificial Sequence
  chemically synthesized
ctccattcttcacgtcattctc

SEQ ID NO: 122169 - DNA, 22 bp, Artificial Sequence
  chemically synthesized
tccattcttcacgtcattctcg

SEQ ID NO: 122170 - DNA, 22 bp, Artificial Sequence
  chemically synthesized
cattcttcacgtcattctcgag

SEQ ID NO: 122171 - DNA, 22 bp, Artificial Sequence
  chemically synthesized
ttcacgtcattctcgagccttg

SEQ ID NO: 122172 - DNA, 22 bp, Artificial Sequence
  chemically synthesized
cacgtcattctcgagccttggc

SEQ ID NO: 122173 - DNA, 22 bp, Artificial Sequence
  chemically synthesized
acgtcattctcgagccttggct

SEQ ID NO: 122174 - DNA, 22 bp, Artificial Sequence
  chemically synthesized
tcgagccttggctttcagctcc

SEQ ID NO: 122175 - DNA, 22 bp, Artificial Sequence
  chemically synthesized
gagccttggctttcagctccat

SEQ ID NO: 122176 - DNA, 22 bp, Artificial Sequence
  chemically synthesized
ggctttcagctccatcagctcc

SEQ ID NO: 122177 - DNA, 22 bp, Artificial Sequence
  chemically synthesized
gctttcagctccatcagctcct

SEQ ID NO: 122178 - DNA, 22 bp, Artificial Sequence
  chemically synthesized
tcagctccatcagctcctttaa

SEQ ID NO: 122179 - DNA, 22 bp, Artificial Sequence
  chemically synthesized
cagctccatcagctcctttaag

SEQ ID NO: 122180 - DNA, 22 bp, Artificial Sequence
  chemically synthesized
agctccatcagctcctttaagc

SEQ ID NO: 122181 - DNA, 22 bp, Artificial Sequence
  chemically synthesized
catcagctcctttaagcacttc

SEQ ID NO: 122182 - DNA, 22 bp, Artificial Sequence
  chemically synthesized
ctttaagcacttctctgtattg

SEQ ID NO: 122183 - DNA, 22 bp, Artificial Sequence
  chemically synthesized
taagcacttctctgtattggtt

SEQ ID NO: 122184 - DNA, 22 bp, Artificial Sequence
  chemically synthesized
aagcacttctctgtattggtta

SEQ ID NO: 122185 - DNA, 22 bp, Artificial Sequence
  chemically synthesized
agcacttctctgtattggttat

SEQ ID NO: 122186 - DNA, 22 bp, Artificial Sequence
  chemically synthesized
ctctgtattggttattctagtt

SEQ ID NO: 122187 - DNA, 22 bp, Artificial Sequence
  chemically synthesized
tctgtattggttattctagtta

SEQ ID NO: 122188 - DNA, 22 bp, Artificial Sequence
  chemically synthesized
tgtattggttattctagttata

SEQ ID NO: 122189 - DNA, 22 bp, Artificial Sequence
  chemically synthesized
tattggttattctagttataca

SEQ ID NO: 122190 - DNA, 22 bp, Artificial Sequence
  chemically synthesized
gttattctagttatacattcat

SEQ ID NO: 122191 - DNA, 22 bp, Artificial Sequence
  chemically synthesized
ttctagttatacattcatctaa

SEQ ID NO: 122192 - DNA, 22 bp, Artificial Sequence
  chemically synthesized
tagttatacattcatctaaatt

SEQ ID NO: 122193 - DNA, 22 bp, Artificial Sequence
  chemically synthesized
gttatacattcatctaaatttt

SEQ ID NO: 122194 - DNA, 22 bp, Artificial Sequence
  chemically synthesized
tacattcatctaaatttttttt

SEQ ID NO: 122195 - DNA, 22 bp, Artificial Sequence
  chemically synthesized
atctaaattttttttcaaagtt

SEQ ID NO: 122196 - DNA, 22 bp, Artificial Sequence
  chemically synthesized
aattttttttcaaagtttttat

SEQ ID NO: 122197 - DNA, 22 bp, Artificial Sequence
  chemically synthesized
tttttcaaagtttttatcttct

SEQ ID NO: 122198 - DNA, 22 bp, Artificial Sequence
  chemically synthesized
ttttcaaagtttttatcttctt

SEQ ID NO: 122199 - DNA, 22 bp, Artificial Sequence
  chemically synthesized
tttcaaagtttttatcttcttt

SEQ ID NO: 122200 - DNA, 22 bp, Artificial Sequence
  chemically synthesized
ttcaaagtttttatcttctttg

SEQ ID NO: 122201 - DNA, 22 bp, Artificial Sequence
  chemically synthesized
tcaaagtttttatcttctttgc

SEQ ID NO: 122202 - DNA, 22 bp, Artificial Sequence
  chemically synthesized
caaagtttttatcttctttgcc

SEQ ID NO: 122203 - DNA, 22 bp, Artificial Sequence
  chemically synthesized
aaagtttttatcttctttgcct

SEQ ID NO: 122204 - DNA, 22 bp, Artificial Sequence
  chemically synthesized
ttatcttctttgcctttggttt

SEQ ID NO: 122205 - DNA, 22 bp, Artificial Sequence
  chemically synthesized
tatcttctttgcctttggtttg

SEQ ID NO: 122206 - DNA, 22 bp, Artificial Sequence
  chemically synthesized
atcttctttgcctttggtttga

SEQ ID NO: 122207 - DNA, 22 bp, Artificial Sequence
  chemically synthesized
tcttctttgcctttggtttgaa

SEQ ID NO: 122208 - DNA, 22 bp, Artificial Sequence
  chemically synthesized
ctttgcctttggtttgaatttc

SEQ ID NO: 122209 - DNA, 22 bp, Artificial Sequence
  chemically synthesized
tttgcctttggtttgaatttcc

SEQ ID NO: 122210 - DNA, 22 bp, Artificial Sequence
  chemically synthesized
tgcctttggtttgaatttcctc

SEQ ID NO: 122211 - DNA, 22 bp, Artificial Sequence
  chemically synthesized
gcctttggtttgaatttcctcc

SEQ ID NO: 122212 - DNA, 22 bp, Artificial Sequence
  chemically synthesized
cctttggtttgaatttcctcct

SEQ ID NO: 122213 - DNA, 22 bp, Artificial Sequence
  chemically synthesized
tggtttgaatttcctcctgtag

SEQ ID NO: 122214 - DNA, 22 bp, Artificial Sequence
  chemically synthesized
ggtttgaatttcctcctgtagc

SEQ ID NO: 122215 - DNA, 22 bp, Artificial Sequence
  chemically synthesized
gtttgaatttcctcctgtagct

SEQ ID NO: 122216 - DNA, 22 bp, Artificial Sequence
  chemically synthesized
gaatttcctcctgtagctcgga

SEQ ID NO: 122217 - DNA, 22 bp, Artificial Sequence
  chemically synthesized
aatttcctcctgtagctcggag

SEQ ID NO: 122218 - DNA, 22 bp, Artificial Sequence
  chemically synthesized
cctcctgtagctcggagtagtt

SEQ ID NO: 122219 - DNA, 22 bp, Artificial Sequence
  chemically synthesized
ctcctgtagctcggagtagttt

SEQ ID NO: 122220 - DNA, 22 bp, Artificial Sequence
  chemically synthesized
ctgtagctcggagtagtttcat

SEQ ID NO: 122221 - DNA, 22 bp, Artificial Sequence
  chemically synthesized
tagctcggagtagtttcatcgt

SEQ ID NO: 122222 - DNA, 22 bp, Artificial Sequence
  chemically synthesized
ggagtagtttcatcgtctgaag

SEQ ID NO: 122223 - DNA, 22 bp, Artificial Sequence
  chemically synthesized
catcgtctgaagtcttcttctc

SEQ ID NO: 122224 - DNA, 22 bp, Artificial Sequence
  chemically synthesized
atcgtctgaagtcttcttctct

SEQ ID NO: 122225 - DNA, 22 bp, Artificial Sequence
  chemically synthesized
aagtcttcttctctcagctcgt

SEQ ID NO: 122226 - DNA, 22 bp, Artificial Sequence
  chemically synthesized
cttctctcagctcgtcaaagtc

SEQ ID NO: 122227 - DNA, 22 bp, Artificial Sequence
  chemically synthesized
ttctctcagctcgtcaaagtca

SEQ ID NO: 122228 - DNA, 22 bp, Artificial Sequence
  chemically synthesized
ctctcagctcgtcaaagtcatt

SEQ ID NO: 122229 - DNA, 22 bp, Artificial Sequence
  chemically synthesized
tctcagctcgtcaaagtcattc

SEQ ID NO: 122230 - DNA, 22 bp, Artificial Sequence
  chemically synthesized
tcagctcgtcaaagtcattctc

SEQ ID NO: 122231 - DNA, 22 bp, Artificial Sequence
  chemically synthesized
agctcgtcaaagtcattctcca

SEQ ID NO: 122232 - DNA, 22 bp, Artificial Sequence
  chemically synthesized
gtcaaagtcattctccatccag

SEQ ID NO: 122233 - DNA, 22 bp, Artificial Sequence
  chemically synthesized
tccatccagctttgttccgttg

SEQ ID NO: 122234 - DNA, 22 bp, Artificial Sequence
  chemically synthesized
catccagctttgttccgttgct

SEQ ID NO: 122235 - DNA, 22 bp, Artificial Sequence
  chemically synthesized
tgttccgttgctggtgaggaac

SEQ ID NO: 122236 - DNA, 22 bp, Artificial Sequence
  chemically synthesized
gttccgttgctggtgaggaact

SEQ ID NO: 122237 - DNA, 22 bp, Artificial Sequence
  chemically synthesized
ttccgttgctggtgaggaactg

SEQ ID NO: 122238 - DNA, 22 bp, Artificial Sequence
  chemically synthesized
cgttgctggtgaggaactgctt

SEQ ID NO: 122239 - DNA, 22 bp, Artificial Sequence
  chemically synthesized
ctggtgaggaactgctttcctt

SEQ ID NO: 122240 - DNA, 22 bp, Artificial Sequence
  chemically synthesized
gtgaggaactgctttcctttgg

SEQ ID NO: 122241 - DNA, 22 bp, Artificial Sequence
  chemically synthesized
ctttcctttggaggaggaaagg

SEQ ID NO: 122242 - DNA, 22 bp, Artificial Sequence
  chemically synthesized
tcctttggaggaggaaaggtgc

SEQ ID NO: 122243 - DNA, 22 bp, Artificial Sequence
  chemically synthesized
cctttggaggaggaaaggtgct

SEQ ID NO: 122244 - DNA, 22 bp, Artificial Sequence
  chemically synthesized
ctttggaggaggaaaggtgctc

SEQ ID NO: 122245 - DNA, 22 bp, Artificial Sequence
  chemically synthesized
tggaggaggaaaggtgctctgc

SEQ ID NO: 122246 - DNA, 22 bp, Artificial Sequence
  chemically synthesized
ggaggaggaaaggtgctctgct

SEQ ID NO: 122247 - DNA, 22 bp, Artificial Sequence
  chemically synthesized
gaggaggaaaggtgctctgctt

SEQ ID NO: 122248 - DNA, 22 bp, Artificial Sequence
  chemically synthesized
tgctttttagagtttccagttt

SEQ ID NO: 122249 - DNA, 22 bp, Artificial Sequence
  chemically synthesized
ctttttagagtttccagttttt

SEQ ID NO: 122250 - DNA, 22 bp, Artificial Sequence
  chemically synthesized
tttagagtttccagtttttctg

SEQ ID NO: 122251 - DNA, 22 bp, Artificial Sequence
  chemically synthesized
ttagagtttccagtttttctgc

SEQ ID NO: 122252 - DNA, 22 bp, Artificial Sequence
  chemically synthesized
tagagtttccagtttttctgct

SEQ ID NO: 122253 - DNA, 22 bp, Artificial Sequence
  chemically synthesized
agagtttccagtttttctgctc

SEQ ID NO: 122254 - DNA, 22 bp, Artificial Sequence
  chemically synthesized
gagtttccagtttttctgctct

SEQ ID NO: 122255 - DNA, 22 bp, Artificial Sequence
  chemically synthesized
ccagtttttctgctctgttttt

SEQ ID NO: 122256 - DNA, 22 bp, Artificial Sequence
  chemically synthesized
cagtttttctgctctgtttttt

SEQ ID NO: 122257 - DNA, 22 bp, Artificial Sequence
  chemically synthesized
ttctgctctgttttttccccaa

SEQ ID NO: 122258 - DNA, 22 bp, Artificial Sequence
  chemically synthesized
tctgctctgttttttccccaac

SEQ ID NO: 122259 - DNA, 22 bp, Artificial Sequence
  chemically synthesized
ctgctctgttttttccccaact

SEQ ID NO: 122260 - DNA, 22 bp, Artificial Sequence
  chemically synthesized
tgctctgttttttccccaactt

SEQ ID NO: 122261 - DNA, 22 bp, Artificial Sequence
  chemically synthesized
ctctgttttttccccaactttg

SEQ ID NO: 122262 - DNA, 22 bp, Artificial Sequence
  chemically synthesized
tgttttttccccaactttgtgg

SEQ ID NO: 122263 - DNA, 22 bp, Artificial Sequence
  chemically synthesized
ttttttccccaactttgtggtt

SEQ ID NO: 122264 - DNA, 22 bp, Artificial Sequence
  chemically synthesized
tttccccaactttgtggttgta

SEQ ID NO: 122265 - DNA, 22 bp, Artificial Sequence
  chemically synthesized
ttccccaactttgtggttgtat

SEQ ID NO: 122266 - DNA, 22 bp, Artificial Sequence
  chemically synthesized
tccccaactttgtggttgtatc

SEQ ID NO: 122267 - DNA, 22 bp, Artificial Sequence
  chemically synthesized
ccccaactttgtggttgtatct

SEQ ID NO: 122268 - DNA, 22 bp, Artificial Sequence
  chemically synthesized
cccaactttgtggttgtatcta

SEQ ID NO: 122269 - DNA, 22 bp, Artificial Sequence
  chemically synthesized
tgtggttgtatctacttttggt

SEQ ID NO: 122270 - DNA, 22 bp, Artificial Sequence
  chemically synthesized
gtggttgtatctacttttggtc

SEQ ID NO: 122271 - DNA, 22 bp, Artificial Sequence
  chemically synthesized
tggttgtatctacttttggtct

SEQ ID NO: 122272 - DNA, 22 bp, Artificial Sequence
  chemically synthesized
tatctacttttggtctttgatg

SEQ ID NO: 122273 - DNA, 22 bp, Artificial Sequence
  chemically synthesized
cttttggtctttgatgatagtg

SEQ ID NO: 122274 - DNA, 22 bp, Artificial Sequence
  chemically synthesized
ttggtctttgatgatagtgatg

SEQ ID NO: 122275 - DNA, 22 bp, Artificial Sequence
  chemically synthesized
tggtctttgatgatagtgatgt

SEQ ID NO: 122276 - DNA, 22 bp, Artificial Sequence
  chemically synthesized
ggtctttgatgatagtgatgta

SEQ ID NO: 122277 - DNA, 22 bp, Artificial Sequence
  chemically synthesized
gtctttgatgatagtgatgtac

SEQ ID NO: 122278 - DNA, 22 bp, Artificial Sequence
  chemically synthesized
tgatgatagtgatgtaccgatg

SEQ ID NO: 122279 - DNA, 22 bp, Artificial Sequence
  chemically synthesized
gatgatagtgatgtaccgatgg

SEQ ID NO: 122280 - DNA, 22 bp, Artificial Sequence
  chemically synthesized
atgatagtgatgtaccgatggg

SEQ ID NO: 122281 - DNA, 22 bp, Artificial Sequence
  chemically synthesized
ttggtgtggatgtcctttctgt

SEQ ID NO: 122282 - DNA, 22 bp, Artificial Sequence
  chemically synthesized
tggtgtggatgtcctttctgtt

SEQ ID NO: 122283 - DNA, 22 bp, Artificial Sequence
  chemically synthesized
ggtgtggatgtcctttctgttt

SEQ ID NO: 122284 - DNA, 22 bp, Artificial Sequence
  chemically synthesized
gtgtggatgtcctttctgtttg

SEQ ID NO: 122285 - DNA, 22 bp, Artificial Sequence
  chemically synthesized
tctgtttgttagttttccttct

SEQ ID NO: 122286 - DNA, 22 bp, Artificial Sequence
  chemically synthesized
ctgtttgttagttttccttcta

SEQ ID NO: 122287 - DNA, 22 bp, Artificial Sequence
  chemically synthesized
tgtttgttagttttccttctaa

SEQ ID NO: 122288 - DNA, 22 bp, Artificial Sequence
  chemically synthesized
tttgttagttttccttctaaca

SEQ ID NO: 122289 - DNA, 22 bp, Artificial Sequence
  chemically synthesized
gttagttttccttctaacagac

SEQ ID NO: 122290 - DNA, 22 bp, Artificial Sequence
  chemically synthesized
ttagttttccttctaacagaca

SEQ ID NO: 122291 - DNA, 22 bp, Artificial Sequence
  chemically synthesized
gttttccttctaacagacagga

SEQ ID NO: 122292 - DNA, 22 bp, Artificial Sequence
  chemically synthesized
tccttctaacagacaggaccct

SEQ ID NO: 122293 - DNA, 22 bp, Artificial Sequence
  chemically synthesized
ccttctaacagacaggaccctc

SEQ ID NO: 122294 - DNA, 22 bp, Artificial Sequence
  chemically synthesized
cttctaacagacaggaccctca

SEQ ID NO: 122295 - DNA, 22 bp, Artificial Sequence
  chemically synthesized
ctaacagacaggaccctcagct

SEQ ID NO: 122296 - DNA, 22 bp, Artificial Sequence
  chemically synthesized
taacagacaggaccctcagctg

SEQ ID NO: 122297 - DNA, 22 bp, Artificial Sequence
  chemically synthesized
acagacaggaccctcagctgca

SEQ ID NO: 122298 - DNA, 22 bp, Artificial Sequence
  chemically synthesized
agctgcaggtctgttggagttt

SEQ ID NO: 122299 - DNA, 22 bp, Artificial Sequence
  chemically synthesized
caggtctgttggagtttgctag

SEQ ID NO: 122300 - DNA, 22 bp, Artificial Sequence
  chemically synthesized
ttggagtttgctagaggtccac

SEQ ID NO: 122301 - DNA, 22 bp, Artificial Sequence
  chemically synthesized
gagtttgctagaggtccactcc

SEQ ID NO: 122302 - DNA, 22 bp, Artificial Sequence
  chemically synthesized
gctagaggtccactccagaccc

SEQ ID NO: 122303 - DNA, 22 bp, Artificial Sequence
  chemically synthesized
ctagaggtccactccagaccct

SEQ ID NO: 122304 - DNA, 22 bp, Artificial Sequence
  chemically synthesized
gaggtccactccagaccctgtt

SEQ ID NO: 122305 - DNA, 22 bp, Artificial Sequence
  chemically synthesized
cagaccctgtttgcctgggtat

SEQ ID NO: 122306 - DNA, 22 bp, Artificial Sequence
  chemically synthesized
tttgcctgggtatcagcagcgg

SEQ ID NO: 122307 - DNA, 22 bp, Artificial Sequence
  chemically synthesized
gcctgggtatcagcagcggtgt

SEQ ID NO: 122308 - DNA, 22 bp, Artificial Sequence
  chemically synthesized
cctgggtatcagcagcggtgtc

SEQ ID NO: 122309 - DNA, 22 bp, Artificial Sequence
  chemically synthesized
ggtatcagcagcggtgtctgca

SEQ ID NO: 122310 - DNA, 22 bp, Artificial Sequence
  chemically synthesized
cagaaccgcagattttcgtgat

SEQ ID NO: 122311 - DNA, 22 bp, Artificial Sequence
  chemically synthesized
tcgtgatccgcgaatgctgctg

SEQ ID NO: 122312 - DNA, 22 bp, Artificial Sequence
  chemically synthesized
cgtgatccgcgaatgctgctgt

SEQ ID NO: 122313 - DNA, 22 bp, Artificial Sequence
  chemically synthesized
gtgatccgcgaatgctgctgtc

SEQ ID NO: 122314 - DNA, 22 bp, Artificial Sequence
  chemically synthesized
ctgtctgatcgttcctctggaa

SEQ ID NO: 122315 - DNA, 22 bp, Artificial Sequence
  chemically synthesized
tctgatcgttcctctggaagtt

SEQ ID NO: 122316 - DNA, 22 bp, Artificial Sequence
  chemically synthesized
atcgttcctctggaagttttgt

SEQ ID NO: 122317 - DNA, 22 bp, Artificial Sequence
  chemically synthesized
ctctggaagttttgtctcagag

SEQ ID NO: 122318 - DNA, 22 bp, Artificial Sequence
  chemically synthesized
tggaagttttgtctcagaggag

SEQ ID NO: 122319 - DNA, 22 bp, Artificial Sequence
  chemically synthesized
gaagttttgtctcagaggagta

SEQ ID NO: 122320 - DNA, 22 bp, Artificial Sequence
  chemically synthesized
tgtctcagaggagtacctggcc

SEQ ID NO: 122321 - DNA, 22 bp, Artificial Sequence
  chemically synthesized
gtctcagaggagtacctggccg

SEQ ID NO: 122322 - DNA, 22 bp, Artificial Sequence
  chemically synthesized
tctcagaggagtacctggccgt

SEQ ID NO: 122323 - DNA, 22 bp, Artificial Sequence
  chemically synthesized
agaggagtacctggccgtgtga

SEQ ID NO: 122324 - DNA, 22 bp, Artificial Sequence
  chemically synthesized
gccgtgtgaggtgtcagtctgc

SEQ ID NO: 122325 - DNA, 22 bp, Artificial Sequence
  chemically synthesized
cccttacttgggggtgcctccc

SEQ ID NO: 122326 - DNA, 22 bp, Artificial Sequence
  chemically synthesized
acttgggggtgcctcccagtta

SEQ ID NO: 122327 - DNA, 22 bp, Artificial Sequence
  chemically synthesized
cttgggggtgcctcccagttag

SEQ ID NO: 122328 - DNA, 22 bp, Artificial Sequence
  chemically synthesized
gggggtgcctcccagttaggct

SEQ ID NO: 122329 - DNA, 22 bp, Artificial Sequence
  chemically synthesized
ggggtgcctcccagttaggctg

SEQ ID NO: 122330 - DNA, 22 bp, Artificial Sequence
  chemically synthesized
ccagttaggctgctcgggggtc

SEQ ID NO: 122331 - DNA, 22 bp, Artificial Sequence
  chemically synthesized
ggctgctcgggggtcaggggtc

SEQ ID NO: 122332 - DNA, 22 bp, Artificial Sequence
  chemically synthesized
ctcgggggtcaggggtcaggga

SEQ ID NO: 122333 - DNA, 22 bp, Artificial Sequence
  chemically synthesized
gggggtcaggggtcagggaccc

SEQ ID NO: 122334 - DNA, 22 bp, Artificial Sequence
  chemically synthesized
gaggaggcagtctgcccgttct

SEQ ID NO: 122335 - DNA, 22 bp, Artificial Sequence
  chemically synthesized
aggaggcagtctgcccgttctc

SEQ ID NO: 122336 - DNA, 22 bp, Artificial Sequence
  chemically synthesized
cccgttctcagatctccagctg

SEQ ID NO: 122337 - DNA, 22 bp, Artificial Sequence
  chemically synthesized
tcagatctccagctgtgtgctg

SEQ ID NO: 122338 - DNA, 22 bp, Artificial Sequence
  chemically synthesized
agatctccagctgtgtgctggg

SEQ ID NO: 122339 - DNA, 22 bp, Artificial Sequence
  chemically synthesized
cagctgtgtgctgggagaacca

SEQ ID NO: 122340 - DNA, 22 bp, Artificial Sequence
  chemically synthesized
tgtgctgggagaaccactgctc

SEQ ID NO: 122341 - DNA, 22 bp, Artificial Sequence
  chemically synthesized
ggagaaccactgctctcctcaa

SEQ ID NO: 122342 - DNA, 22 bp, Artificial Sequence
  chemically synthesized
ctctcctcaaagctgtcagaca

SEQ ID NO: 122343 - DNA, 22 bp, Artificial Sequence
  chemically synthesized
tcctcaaagctgtcagacaggg

SEQ ID NO: 122344 - DNA, 22 bp, Artificial Sequence
  chemically synthesized
ctcaaagctgtcagacagggac

SEQ ID NO: 122345 - DNA, 22 bp, Artificial Sequence
  chemically synthesized
aaagctgtcagacagggacatt

SEQ ID NO: 122346 - DNA, 22 bp, Artificial Sequence
  chemically synthesized
tcagacagggacatttaagtct

SEQ ID NO: 122347 - DNA, 22 bp, Artificial Sequence
  chemically synthesized
aagtctgcagaggttactgctg

SEQ ID NO: 122348 - DNA, 22 bp, Artificial Sequence
  chemically synthesized
agtctgcagaggttactgctgt

SEQ ID NO: 122349 - DNA, 22 bp, Artificial Sequence
  chemically synthesized
cagaggttactgctgtcttttt

SEQ ID NO: 122350 - DNA, 22 bp, Artificial Sequence
  chemically synthesized
ctgctgtctttttgtttgtctg

SEQ ID NO: 122351 - DNA, 22 bp, Artificial Sequence
  chemically synthesized
ctgtctttttgtttgtctgtgc

SEQ ID NO: 122352 - DNA, 22 bp, Artificial Sequence
  chemically synthesized
tctttttgtttgtctgtgccct

SEQ ID NO: 122353 - DNA, 22 bp, Artificial Sequence
  chemically synthesized
tttgtttgtctgtgccctgccc

SEQ ID NO: 122354 - DNA, 22 bp, Artificial Sequence
  chemically synthesized
ttgtttgtctgtgccctgcccc

SEQ ID NO: 122355 - DNA, 22 bp, Artificial Sequence
  chemically synthesized
tgtttgtctgtgccctgccccc

SEQ ID NO: 122356 - DNA, 22 bp, Artificial Sequence
  chemically synthesized
gtttgtctgtgccctgccccca

SEQ ID NO: 122357 - DNA, 22 bp, Artificial Sequence
  chemically synthesized
tttgtctgtgccctgcccccaa

SEQ ID NO: 122358 - DNA, 22 bp, Artificial Sequence
  chemically synthesized
gtctgtgccctgcccccaaagg

SEQ ID NO: 122359 - DNA, 22 bp, Artificial Sequence
  chemically synthesized
tctgtgccctgcccccaaaggt

SEQ ID NO: 122360 - DNA, 22 bp, Artificial Sequence
  chemically synthesized
tgccctgcccccaaaggtggag

SEQ ID NO: 122361 - DNA, 22 bp, Artificial Sequence
  chemically synthesized
cccccaaaggtggagcctacag

SEQ ID NO: 122362 - DNA, 22 bp, Artificial Sequence
  chemically synthesized
cagaggcaggcaggcctccttg

SEQ ID NO: 122363 - DNA, 22 bp, Artificial Sequence
  chemically synthesized
cttgagctgtggtggggtccac

SEQ ID NO: 122364 - DNA, 22 bp, Artificial Sequence
  chemically synthesized
gagctgtggtggggtccaccca

SEQ ID NO: 122365 - DNA, 22 bp, Artificial Sequence
  chemically synthesized
agctgtggtggggtccacccag

SEQ ID NO: 122366 - DNA, 22 bp, Artificial Sequence
  chemically synthesized
tggtggggtccacccagtttga

SEQ ID NO: 122367 - DNA, 22 bp, Artificial Sequence
  chemically synthesized
gagcttcctggctgctttgttt

SEQ ID NO: 122368 - DNA, 22 bp, Artificial Sequence
  chemically synthesized
agcttcctggctgctttgttta

SEQ ID NO: 122369 - DNA, 22 bp, Artificial Sequence
  chemically synthesized
cctggctgctttgtttacctaa

SEQ ID NO: 122370 - DNA, 22 bp, Artificial Sequence
  chemically synthesized
ctggctgctttgtttacctaag

SEQ ID NO: 122371 - DNA, 22 bp, Artificial Sequence
  chemically synthesized
gctgctttgtttacctaagcaa

SEQ ID NO: 122372 - DNA, 22 bp, Artificial Sequence
  chemically synthesized
ctttgtttacctaagcaagcct

SEQ ID NO: 122373 - DNA, 22 bp, Artificial Sequence
  chemically synthesized
tgtttacctaagcaagcctggg

SEQ ID NO: 122374 - DNA, 22 bp, Artificial Sequence
  chemically synthesized
gtttacctaagcaagcctgggc

SEQ ID NO: 122375 - DNA, 22 bp, Artificial Sequence
  chemically synthesized
tttacctaagcaagcctgggca

SEQ ID NO: 122376 - DNA, 22 bp, Artificial Sequence
  chemically synthesized
acctaagcaagcctgggcaatg

SEQ ID NO: 122377 - DNA, 22 bp, Artificial Sequence
  chemically synthesized
cctaagcaagcctgggcaatgg

SEQ ID NO: 122378 - DNA, 22 bp, Artificial Sequence
  chemically synthesized
agcaagcctgggcaatggcggc

SEQ ID NO: 122379 - DNA, 22 bp, Artificial Sequence
  chemically synthesized
ggcaatggcggctgcccctccc

SEQ ID NO: 122380 - DNA, 22 bp, Artificial Sequence
  chemically synthesized
cccctcccccagcctcgctgcc

SEQ ID NO: 122381 - DNA, 22 bp, Artificial Sequence
  chemically synthesized
ccccagcctcgctgccaccttg

SEQ ID NO: 122382 - DNA, 22 bp, Artificial Sequence
  chemically synthesized
gctgccaccttgcagtttgatc

SEQ ID NO: 122383 - DNA, 22 bp, Artificial Sequence
  chemically synthesized
ccaccttgcagtttgatctcag

SEQ ID NO: 122384 - DNA, 22 bp, Artificial Sequence
  chemically synthesized
gcagtttgatctcagactgctg

SEQ ID NO: 122385 - DNA, 22 bp, Artificial Sequence
  chemically synthesized
cagtttgatctcagactgctgt

SEQ ID NO: 122386 - DNA, 22 bp, Artificial Sequence
  chemically synthesized
gatctcagactgctgtgctagc

SEQ ID NO: 122387 - DNA, 22 bp, Artificial Sequence
  chemically synthesized
atctcagactgctgtgctagca

SEQ ID NO: 122388 - DNA, 22 bp, Artificial Sequence
  chemically synthesized
agactgctgtgctagcaatcag

SEQ ID NO: 122389 - DNA, 22 bp, Artificial Sequence
  chemically synthesized
ctgtgctagcaatcagggagac

SEQ ID NO: 122390 - DNA, 22 bp, Artificial Sequence
  chemically synthesized
tgctagcaatcagggagactcc

SEQ ID NO: 122391 - DNA, 22 bp, Artificial Sequence
  chemically synthesized
gcaatcagggagactccgtggg

SEQ ID NO: 122392 - DNA, 22 bp, Artificial Sequence
  chemically synthesized
cgtgggcgtaggaccctcggag

SEQ ID NO: 122393 - DNA, 22 bp, Artificial Sequence
  chemically synthesized
ggagccatgtgcaggatataat

SEQ ID NO: 122394 - DNA, 22 bp, Artificial Sequence
  chemically synthesized
ctggtgcgccatttcctaagcc

SEQ ID NO: 122395 - DNA, 22 bp, Artificial Sequence
  chemically synthesized
gtgcgccatttcctaagcctgt

SEQ ID NO: 122396 - DNA, 22 bp, Artificial Sequence
  chemically synthesized
cctaagcctgtcagaaaagcac

SEQ ID NO: 122397 - DNA, 22 bp, Artificial Sequence
  chemically synthesized
ctaagcctgtcagaaaagcaca

SEQ ID NO: 122398 - DNA, 22 bp, Artificial Sequence
  chemically synthesized
agcctgtcagaaaagcacagta

SEQ ID NO: 122399 - DNA, 22 bp, Artificial Sequence
  chemically synthesized
tcagaaaagcacagtattcggg

SEQ ID NO: 122400 - DNA, 22 bp, Artificial Sequence
  chemically synthesized
gggtgggagtggcccaattttc

SEQ ID NO: 122401 - DNA, 22 bp, Artificial Sequence
  chemically synthesized
tccaggtgccgtatgtcacccc

SEQ ID NO: 122402 - DNA, 22 bp, Artificial Sequence
  chemically synthesized
ccaggtgccgtatgtcacccct

SEQ ID NO: 122403 - DNA, 22 bp, Artificial Sequence
  chemically synthesized
caggtgccgtatgtcacccctt

SEQ ID NO: 122404 - DNA, 22 bp, Artificial Sequence
  chemically synthesized
tccttgaccaggaaagggaact

SEQ ID NO: 122405 - DNA, 22 bp, Artificial Sequence
  chemically synthesized
ccttgaccaggaaagggaactc

SEQ ID NO: 122406 - DNA, 22 bp, Artificial Sequence
  chemically synthesized
cttgaccaggaaagggaactcc

SEQ ID NO: 122407 - DNA, 22 bp, Artificial Sequence
  chemically synthesized
gaccaggaaagggaactccatg

SEQ ID NO: 122408 - DNA, 22 bp, Artificial Sequence
  chemically synthesized
accaggaaagggaactccatga

SEQ ID NO: 122409 - DNA, 22 bp, Artificial Sequence
  chemically synthesized
catgaccccttgtgcttcccaa

SEQ ID NO: 122410 - DNA, 22 bp, Artificial Sequence
  chemically synthesized
gtgcttcccaagtgaggcaatg

SEQ ID NO: 122411 - DNA, 22 bp, Artificial Sequence
  chemically synthesized
tgcttcccaagtgaggcaatgc

SEQ ID NO: 122412 - DNA, 22 bp, Artificial Sequence
  chemically synthesized
cccaagtgaggcaatgcctcac

SEQ ID NO: 122413 - DNA, 22 bp, Artificial Sequence
  chemically synthesized
ccaagtgaggcaatgcctcacc

SEQ ID NO: 122414 - DNA, 22 bp, Artificial Sequence
  chemically synthesized
accctgcttcggctggtgcatg

SEQ ID NO: 122415 - DNA, 22 bp, Artificial Sequence
  chemically synthesized
cttcggctggtgcatggtgtgc

SEQ ID NO: 122416 - DNA, 22 bp, Artificial Sequence
  chemically synthesized
cggctggtgcatggtgtgctgc

SEQ ID NO: 122417 - DNA, 22 bp, Artificial Sequence
  chemically synthesized
ggctggtgcatggtgtgctgca

SEQ ID NO: 122418 - DNA, 22 bp, Artificial Sequence
  chemically synthesized
gtgcatggtgtgctgcacccac

SEQ ID NO: 122419 - DNA, 22 bp, Artificial Sequence
  chemically synthesized
cacccactgacctgtgcccact

SEQ ID NO: 122420 - DNA, 22 bp, Artificial Sequence
  chemically synthesized
acctgtgcccactgtctggcac

SEQ ID NO: 122421 - DNA, 22 bp, Artificial Sequence
  chemically synthesized
tgcccactgtctggcactccct

SEQ ID NO: 122422 - DNA, 22 bp, Artificial Sequence
  chemically synthesized
tctggcactccctagcgagatg

SEQ ID NO: 122423 - DNA, 22 bp, Artificial Sequence
  chemically synthesized
gcactccctagcgagatgaacc

SEQ ID NO: 122424 - DNA, 22 bp, Artificial Sequence
  chemically synthesized
cctagcgagatgaaccccatac

SEQ ID NO: 122425 - DNA, 22 bp, Artificial Sequence
  chemically synthesized
gcgagatgaaccccatacctca

SEQ ID NO: 122426 - DNA, 22 bp, Artificial Sequence
  chemically synthesized
agatggaaatgcagaaatcacc

SEQ ID NO: 122427 - DNA, 22 bp, Artificial Sequence
  chemically synthesized
ctgtgttgttcacgctgggagc

SEQ ID NO: 122428 - DNA, 22 bp, Artificial Sequence
  chemically synthesized
tgtgttgttcacgctgggagct

SEQ ID NO: 122429 - DNA, 22 bp, Artificial Sequence
  chemically synthesized
tgttgttcacgctgggagctgt

SEQ ID NO: 122430 - DNA, 22 bp, Artificial Sequence
  chemically synthesized
ttcacgctgggagctgtagacc

SEQ ID NO: 122431 - DNA, 22 bp, Artificial Sequence
  chemically synthesized
acgctgggagctgtagaccaga

SEQ ID NO: 122432 - DNA, 22 bp, Artificial Sequence
  chemically synthesized
ggagctgtagaccagagctgtt

SEQ ID NO: 122433 - DNA, 22 bp, Artificial Sequence
  chemically synthesized
tagaccagagctgttcctattt

SEQ ID NO: 122434 - DNA, 22 bp, Artificial Sequence
  chemically synthesized
ttcctatttggccatcttggct

SEQ ID NO: 122435 - DNA, 22 bp, Artificial Sequence
  chemically synthesized
ctatttggccatcttggctcaa

SEQ ID NO: 122436 - DNA, 22 bp, Artificial Sequence
  chemically synthesized
tttggccatcttggctcaaaaa

SEQ ID NO: 122437 - DNA, 22 bp, Artificial Sequence
  chemically synthesized
ggccatcttggctcaaaaactg

SEQ ID NO: 122438 - DNA, 22 bp, Artificial Sequence
  chemically synthesized
gccatcttggctcaaaaactgg

SEQ ID NO: 122439 - DNA, 22 bp, Artificial Sequence
  chemically synthesized
ggctcaaaaactggaactttat

SEQ ID NO: 122440 - DNA, 22 bp, Artificial Sequence
  chemically synthesized
gctcaaaaactggaactttatt

SEQ ID NO: 122441 - DNA, 22 bp, Artificial Sequence
  chemically synthesized
aaaaactggaactttatttgtg

SEQ ID NO: 122442 - DNA, 22 bp, Artificial Sequence
  chemically synthesized
gaactttatttgtgaaagaaaa

SEQ ID NO: 122443 - DNA, 22 bp, Artificial Sequence
  chemically synthesized
tatttgtgaaagaaaaaatcga

SEQ ID NO: 122444 - DNA, 22 bp, Artificial Sequence
  chemically synthesized
atttgtgaaagaaaaaatcgat

SEQ ID NO: 122445 - DNA, 22 bp, Artificial Sequence
  chemically synthesized
tttgtgaaagaaaaaatcgatc

SEQ ID NO: 122446 - DNA, 22 bp, Artificial Sequence
  chemically synthesized
gtgaaagaaaaaatcgatcaat

SEQ ID NO: 122447 - DNA, 22 bp, Artificial Sequence
  chemically synthesized
tgaaagaaaaaatcgatcaata

SEQ ID NO: 122448 - DNA, 22 bp, Artificial Sequence
  chemically synthesized
ccagtgaaaattttcttcaaat

SEQ ID NO: 122449 - DNA, 22 bp, Artificial Sequence
  chemically synthesized
cagtgaaaattttcttcaaatc

SEQ ID NO: 122450 - DNA, 22 bp, Artificial Sequence
  chemically synthesized
tcttcaaatcaagacaatatct

SEQ ID NO: 122451 - DNA, 22 bp, Artificial Sequence
  chemically synthesized
cttcaaatcaagacaatatcta

SEQ ID NO: 122452 - DNA, 22 bp, Artificial Sequence
  chemically synthesized
ttcaaatcaagacaatatctaa

SEQ ID NO: 122453 - DNA, 22 bp, Artificial Sequence
  chemically synthesized
caaatcaagacaatatctaaaa

SEQ ID NO: 122454 - DNA, 22 bp, Artificial Sequence
  chemically synthesized
aaatcaagacaatatctaaaaa

SEQ ID NO: 122455 - DNA, 22 bp, Artificial Sequence
  chemically synthesized
aaaaattgccgagactgatatc

SEQ ID NO: 122456 - DNA, 22 bp, Artificial Sequence
  chemically synthesized
ccgagactgatatcaagcagct

SEQ ID NO: 122457 - DNA, 22 bp, Artificial Sequence
  chemically synthesized
atatcaagcagctatctctata

SEQ ID NO: 122458 - DNA, 22 bp, Artificial Sequence
  chemically synthesized
tctctatacatgttcttccagg

SEQ ID NO: 122459 - DNA, 22 bp, Artificial Sequence
  chemically synthesized
tatacatgttcttccaggagtt

SEQ ID NO: 122460 - DNA, 22 bp, Artificial Sequence
  chemically synthesized
tacatgttcttccaggagtttt

SEQ ID NO: 122461 - DNA, 22 bp, Artificial Sequence
  chemically synthesized
ttccaggagttttgtgatttca

SEQ ID NO: 122462 - DNA, 22 bp, Artificial Sequence
  chemically synthesized
ccaggagttttgtgatttcagg

SEQ ID NO: 122463 - DNA, 22 bp, Artificial Sequence
  chemically synthesized
caggagttttgtgatttcaggt

SEQ ID NO: 122464 - DNA, 22 bp, Artificial Sequence
  chemically synthesized
tgtgatttcaggtcttacattt

SEQ ID NO: 122465 - DNA, 22 bp, Artificial Sequence
  chemically synthesized
gtgatttcaggtcttacattta

SEQ ID NO: 122466 - DNA, 22 bp, Artificial Sequence
  chemically synthesized
tgatttcaggtcttacatttat

SEQ ID NO: 122467 - DNA, 22 bp, Artificial Sequence
  chemically synthesized
caggtcttacatttatgtcttt

SEQ ID NO: 122468 - DNA, 22 bp, Artificial Sequence
  chemically synthesized
aggtcttacatttatgtcttta

SEQ ID NO: 122469 - DNA, 22 bp, Artificial Sequence
  chemically synthesized
acatttatgtctttaatctatt

SEQ ID NO: 122470 - DNA, 22 bp, Artificial Sequence
  chemically synthesized
catttatgtctttaatctattt

SEQ ID NO: 122471 - DNA, 22 bp, Artificial Sequence
  chemically synthesized
atgtctttaatctattttgagt

SEQ ID NO: 122472 - DNA, 22 bp, Artificial Sequence
  chemically synthesized
tgtctttaatctattttgagtt

SEQ ID NO: 122473 - DNA, 22 bp, Artificial Sequence
  chemically synthesized
taatctattttgagttgactta

SEQ ID NO: 122474 - DNA, 22 bp, Artificial Sequence
  chemically synthesized
aatctattttgagttgacttat

SEQ ID NO: 122475 - DNA, 22 bp, Artificial Sequence
  chemically synthesized
atctattttgagttgacttatg

SEQ ID NO: 122476 - DNA, 22 bp, Artificial Sequence
  chemically synthesized
ttttgagttgacttatggctta

SEQ ID NO: 122477 - DNA, 22 bp, Artificial Sequence
  chemically synthesized
tgagttgacttatggcttaagg

SEQ ID NO: 122478 - DNA, 22 bp, Artificial Sequence
  chemically synthesized
gagttgacttatggcttaaggt

SEQ ID NO: 122479 - DNA, 22 bp, Artificial Sequence
  chemically synthesized
agttgacttatggcttaaggta

SEQ ID NO: 122480 - DNA, 22 bp, Artificial Sequence
  chemically synthesized
acttatggcttaaggtaaaggt

SEQ ID NO: 122481 - DNA, 22 bp, Artificial Sequence
  chemically synthesized
atggcttaaggtaaaggtccaa

SEQ ID NO: 122482 - DNA, 22 bp, Artificial Sequence
  chemically synthesized
tggcttaaggtaaaggtccaat

SEQ ID NO: 122483 - DNA, 22 bp, Artificial Sequence
  chemically synthesized
aaggtaaaggtccaattttatt

SEQ ID NO: 122484 - DNA, 22 bp, Artificial Sequence
  chemically synthesized
aggtaaaggtccaattttattc

SEQ ID NO: 122485 - DNA, 22 bp, Artificial Sequence
  chemically synthesized
tattcttttgcatttggatatc

SEQ ID NO: 122486 - DNA, 22 bp, Artificial Sequence
  chemically synthesized
attcttttgcatttggatatcc

SEQ ID NO: 122487 - DNA, 22 bp, Artificial Sequence
  chemically synthesized
ttcttttgcatttggatatcca

SEQ ID NO: 122488 - DNA, 22 bp, Artificial Sequence
  chemically synthesized
ttttgcatttggatatccagtt

SEQ ID NO: 122489 - DNA, 22 bp, Artificial Sequence
  chemically synthesized
ttgcatttggatatccagtttt

SEQ ID NO: 122490 - DNA, 22 bp, Artificial Sequence
  chemically synthesized
tgcatttggatatccagttttc

SEQ ID NO: 122491 - DNA, 22 bp, Artificial Sequence
  chemically synthesized
gcatttggatatccagttttcc

SEQ ID NO: 122492 - DNA, 22 bp, Artificial Sequence
  chemically synthesized
catttggatatccagttttccc

SEQ ID NO: 122493 - DNA, 22 bp, Artificial Sequence
  chemically synthesized
ggatatccagttttcccaacac

SEQ ID NO: 122494 - DNA, 22 bp, Artificial Sequence
  chemically synthesized
gatatccagttttcccaacact

SEQ ID NO: 122495 - DNA, 22 bp, Artificial Sequence
  chemically synthesized
tcccaacactatttgttgagga

SEQ ID NO: 122496 - DNA, 22 bp, Artificial Sequence
  chemically synthesized
cccaacactatttgttgaggag

SEQ ID NO: 122497 - DNA, 22 bp, Artificial Sequence
  chemically synthesized
ccaacactatttgttgaggaga

SEQ ID NO: 122498 - DNA, 22 bp, Artificial Sequence
  chemically synthesized
tttgttgaggagactatccttc

SEQ ID NO: 122499 - DNA, 22 bp, Artificial Sequence
  chemically synthesized
gttgaggagactatccttcccc

SEQ ID NO: 122500 - DNA, 22 bp, Artificial Sequence
  chemically synthesized
ttgaggagactatccttcccct

SEQ ID NO: 122501 - DNA, 22 bp, Artificial Sequence
  chemically synthesized
aggagactatccttcccctatt

SEQ ID NO: 122502 - DNA, 22 bp, Artificial Sequence
  chemically synthesized
tccttcccctattgtgttggtg

SEQ ID NO: 122503 - DNA, 22 bp, Artificial Sequence
  chemically synthesized
cccctattgtgttggtggcctt

SEQ ID NO: 122504 - DNA, 22 bp, Artificial Sequence
  chemically synthesized
ccctattgtgttggtggccttg

SEQ ID NO: 122505 - DNA, 22 bp, Artificial Sequence
  chemically synthesized
ttgtgttggtggccttgttgag

SEQ ID NO: 122506 - DNA, 22 bp, Artificial Sequence
  chemically synthesized
tgttggtggccttgttgagaat

SEQ ID NO: 122507 - DNA, 22 bp, Artificial Sequence
  chemically synthesized
gtggccttgttgagaattactg

SEQ ID NO: 122508 - DNA, 22 bp, Artificial Sequence
  chemically synthesized
gttgagaattactggactgtat

SEQ ID NO: 122509 - DNA, 22 bp, Artificial Sequence
  chemically synthesized
ttgagaattactggactgtata

SEQ ID NO: 122510 - DNA, 22 bp, Artificial Sequence
  chemically synthesized
agaattactggactgtatatac

SEQ ID NO: 122511 - DNA, 22 bp, Artificial Sequence
  chemically synthesized
ctggactgtatatacgtaaatt

SEQ ID NO: 122512 - DNA, 22 bp, Artificial Sequence
  chemically synthesized
gactgtatatacgtaaatttat

SEQ ID NO: 122513 - DNA, 22 bp, Artificial Sequence
  chemically synthesized
tatatacgtaaatttatttctg

SEQ ID NO: 122514 - DNA, 22 bp, Artificial Sequence
  chemically synthesized
atttctgggctctttattctgt

SEQ ID NO: 122515 - DNA, 22 bp, Artificial Sequence
  chemically synthesized
tttctgggctctttattctgtt

SEQ ID NO: 122516 - DNA, 22 bp, Artificial Sequence
  chemically synthesized
ctgggctctttattctgttcaa

SEQ ID NO: 122517 - DNA, 22 bp, Artificial Sequence
  chemically synthesized
tgggctctttattctgttcaat

SEQ ID NO: 122518 - DNA, 22 bp, Artificial Sequence
  chemically synthesized
ggctctttattctgttcaattt

SEQ ID NO: 122519 - DNA, 22 bp, Artificial Sequence
  chemically synthesized
tttattctgttcaatttggtct

SEQ ID NO: 122520 - DNA, 22 bp, Artificial Sequence
  chemically synthesized
tattctgttcaatttggtctat

SEQ ID NO: 122521 - DNA, 22 bp, Artificial Sequence
  chemically synthesized
attctgttcaatttggtctatg

SEQ ID NO: 122522 - DNA, 22 bp, Artificial Sequence
  chemically synthesized
ttctgttcaatttggtctatgt

SEQ ID NO: 122523 - DNA, 22 bp, Artificial Sequence
  chemically synthesized
tgttcaatttggtctatgtgtc

SEQ ID NO: 122524 - DNA, 22 bp, Artificial Sequence
  chemically synthesized
ttcaatttggtctatgtgtcta

SEQ ID NO: 122525 - DNA, 22 bp, Artificial Sequence
  chemically synthesized
aatttggtctatgtgtctattt

SEQ ID NO: 122526 - DNA, 22 bp, Artificial Sequence
  chemically synthesized
ggtctatgtgtctatttatgtg

SEQ ID NO: 122527 - DNA, 22 bp, Artificial Sequence
  chemically synthesized
gtctatgtgtctatttatgtga

SEQ ID NO: 122528 - DNA, 22 bp, Artificial Sequence
  chemically synthesized
tgtgtctatttatgtgatagta

SEQ ID NO: 122529 - DNA, 22 bp, Artificial Sequence
  chemically synthesized
tttatgtgatagtaccatactt

SEQ ID NO: 122530 - DNA, 22 bp, Artificial Sequence
  chemically synthesized
atgtgatagtaccatacttttt

SEQ ID NO: 122531 - DNA, 22 bp, Artificial Sequence
  chemically synthesized
tgtgatagtaccatactttttt

SEQ ID NO: 122532 - DNA, 22 bp, Artificial Sequence
  chemically synthesized
ttttggttactatagctttgta

SEQ ID NO: 122533 - DNA, 22 bp, Artificial Sequence
  chemically synthesized
tttggttactatagctttgtaa

SEQ ID NO: 122534 - DNA, 22 bp, Artificial Sequence
  chemically synthesized
ttggttactatagctttgtaat

SEQ ID NO: 122535 - DNA, 22 bp, Artificial Sequence
  chemically synthesized
tggttactatagctttgtaata

SEQ ID NO: 122536 - DNA, 22 bp, Artificial Sequence
  chemically synthesized
ggttactatagctttgtaatat

SEQ ID NO: 122537 - DNA, 22 bp, Artificial Sequence
  chemically synthesized
gttactatagctttgtaatata

SEQ ID NO: 122538 - DNA, 22 bp, Artificial Sequence
  chemically synthesized
ctatagctttgtaatataattt

SEQ ID NO: 122539 - DNA, 22 bp, Artificial Sequence
  chemically synthesized
tagctttgtaatataatttgaa

SEQ ID NO: 122540 - DNA, 22 bp, Artificial Sequence
  chemically synthesized
tgtaatataatttgaaatcaga

SEQ ID NO: 122541 - DNA, 22 bp, Artificial Sequence
  chemically synthesized
gtaatataatttgaaatcagaa

SEQ ID NO: 122542 - DNA, 22 bp, Artificial Sequence
  chemically synthesized
taatataatttgaaatcagaac

SEQ ID NO: 122543 - DNA, 22 bp, Artificial Sequence
  chemically synthesized
gaaatcagaacgtgtgctgcca

SEQ ID NO: 122544 - DNA, 22 bp, Artificial Sequence
  chemically synthesized
aaatcagaacgtgtgctgccat

SEQ ID NO: 122545 - DNA, 22 bp, Artificial Sequence
  chemically synthesized
ccatcaagttggtttttctttc

SEQ ID NO: 122546 - DNA, 22 bp, Artificial Sequence
  chemically synthesized
gtttttctttctcaagattgtt

SEQ ID NO: 122547 - DNA, 22 bp, Artificial Sequence
  chemically synthesized
ttctttctcaagattgttttgg

SEQ ID NO: 122548 - DNA, 22 bp, Artificial Sequence
  chemically synthesized
tctttctcaagattgttttggc

SEQ ID NO: 122549 - DNA, 22 bp, Artificial Sequence
  chemically synthesized
ctttctcaagattgttttggcc

SEQ ID NO: 122550 - DNA, 22 bp, Artificial Sequence
  chemically synthesized
tttctcaagattgttttggcca

SEQ ID NO: 122551 - DNA, 22 bp, Artificial Sequence
  chemically synthesized
tctcaagattgttttggccatt

SEQ ID NO: 122552 - DNA, 22 bp, Artificial Sequence
  chemically synthesized
ctcaagattgttttggccattt

SEQ ID NO: 122553 - DNA, 22 bp, Artificial Sequence
  chemically synthesized
tcaagattgttttggccatttg

SEQ ID NO: 122554 - DNA, 22 bp, Artificial Sequence
  chemically synthesized
aagattgttttggccatttggg

SEQ ID NO: 122555 - DNA, 22 bp, Artificial Sequence
  chemically synthesized
ttttggccatttgggggtgttc

SEQ ID NO: 122556 - DNA, 22 bp, Artificial Sequence
  chemically synthesized
tggccatttgggggtgttctgt

SEQ ID NO: 122557 - DNA, 22 bp, Artificial Sequence
  chemically synthesized
ggccatttgggggtgttctgtg

SEQ ID NO: 122558 - DNA, 22 bp, Artificial Sequence
  chemically synthesized
gccatttgggggtgttctgtgg

SEQ ID NO: 122559 - DNA, 22 bp, Artificial Sequence
  chemically synthesized
gggggtgttctgtggtttcata

SEQ ID NO: 122560 - DNA, 22 bp, Artificial Sequence
  chemically synthesized
ggggtgttctgtggtttcatac

SEQ ID NO: 122561 - DNA, 22 bp, Artificial Sequence
  chemically synthesized
tgtggtttcatacaaattttca

SEQ ID NO: 122562 - DNA, 22 bp, Artificial Sequence
  chemically synthesized
tggtttcatacaaattttcaaa

SEQ ID NO: 122563 - DNA, 22 bp, Artificial Sequence
  chemically synthesized
catacaaattttcaaattgttt

SEQ ID NO: 122564 - DNA, 22 bp, Artificial Sequence
  chemically synthesized
atacaaattttcaaattgtttt

SEQ ID NO: 122565 - DNA, 22 bp, Artificial Sequence
  chemically synthesized
tcaaattgttttctgtaaaatg

SEQ ID NO: 122566 - DNA, 22 bp, Artificial Sequence
  chemically synthesized
caaattgttttctgtaaaatgt

SEQ ID NO: 122567 - DNA, 22 bp, Artificial Sequence
  chemically synthesized
aaattgttttctgtaaaatgtg

SEQ ID NO: 122568 - DNA, 22 bp, Artificial Sequence
  chemically synthesized
ttttctgtaaaatgtgccagag

SEQ ID NO: 122569 - DNA, 22 bp, Artificial Sequence
  chemically synthesized
tctgtaaaatgtgccagagctc

SEQ ID NO: 122570 - DNA, 22 bp, Artificial Sequence
  chemically synthesized
ctgtaaaatgtgccagagctca

SEQ ID NO: 122571 - DNA, 22 bp, Artificial Sequence
  chemically synthesized
tgtaaaatgtgccagagctcag

SEQ ID NO: 122572 - DNA, 22 bp, Artificial Sequence
  chemically synthesized
taaaatgtgccagagctcaggt

SEQ ID NO: 122573 - DNA, 22 bp, Artificial Sequence
  chemically synthesized
aggtaacaaaagcaaaaataaa

SEQ ID NO: 122574 - DNA, 22 bp, Artificial Sequence
  chemically synthesized
aatattttctgcacagcaaaga

SEQ ID NO: 122575 - DNA, 22 bp, Artificial Sequence
  chemically synthesized
tctgcacagcaaagaaaacaat

SEQ ID NO: 122576 - DNA, 22 bp, Artificial Sequence
  chemically synthesized
ctgcacagcaaagaaaacaatc

SEQ ID NO: 122577 - DNA, 22 bp, Artificial Sequence
  chemically synthesized
tgcacagcaaagaaaacaatca

SEQ ID NO: 122578 - DNA, 22 bp, Artificial Sequence
  chemically synthesized
cacagcaaagaaaacaatcatc

SEQ ID NO: 122579 - DNA, 22 bp, Artificial Sequence
  chemically synthesized
gggagaaaatatttacagatca

SEQ ID NO: 122580 - DNA, 22 bp, Artificial Sequence
  chemically synthesized
ggagaaaatatttacagatcat

SEQ ID NO: 122581 - DNA, 22 bp, Artificial Sequence
  chemically synthesized
acagatcatatatctgatacaa

SEQ ID NO: 122582 - DNA, 22 bp, Artificial Sequence
  chemically synthesized
cagatcatatatctgatacaag

SEQ ID NO: 122583 - DNA, 22 bp, Artificial Sequence
  chemically synthesized
atacaagtctaatacccaaaat

SEQ ID NO: 122584 - DNA, 22 bp, Artificial Sequence
  chemically synthesized
atacccaaaatatataaggaac

SEQ ID NO: 122585 - DNA, 22 bp, Artificial Sequence
  chemically synthesized
aatcaactaaatatgaaaaaat

SEQ ID NO: 122586 - DNA, 22 bp, Artificial Sequence
  chemically synthesized
aatatgaaaaaatataatagta

SEQ ID NO: 122587 - DNA, 22 bp, Artificial Sequence
  chemically synthesized
agtaaaaatgggcaaaggatct

SEQ ID NO: 122588 - DNA, 22 bp, Artificial Sequence
  chemically synthesized
aatatacatttctctgaagaca

SEQ ID NO: 122589 - DNA, 22 bp, Artificial Sequence
  chemically synthesized
ctctgaagacatgcaaatggtc

SEQ ID NO: 122590 - DNA, 22 bp, Artificial Sequence
  chemically synthesized
tctgaagacatgcaaatggtca

SEQ ID NO: 122591 - DNA, 22 bp, Artificial Sequence
  chemically synthesized
tgaagacatgcaaatggtcagc

SEQ ID NO: 122592 - DNA, 22 bp, Artificial Sequence
  chemically synthesized
aagacatgcaaatggtcagcag

SEQ ID NO: 122593 - DNA, 22 bp, Artificial Sequence
  chemically synthesized
catcaccaatcatcaggaaaat

SEQ ID NO: 122594 - DNA, 22 bp, Artificial Sequence
  chemically synthesized
acacctgttgagatggctatta

SEQ ID NO: 122595 - DNA, 22 bp, Artificial Sequence
  chemically synthesized
ttgagatggctattatcaaaaa

SEQ ID NO: 122596 - DNA, 22 bp, Artificial Sequence
  chemically synthesized
agatggctattatcaaaaaaga

SEQ ID NO: 122597 - DNA, 22 bp, Artificial Sequence
  chemically synthesized
ttatcaaaaaagacaagagata

SEQ ID NO: 122598 - DNA, 22 bp, Artificial Sequence
  chemically synthesized
tcaaaaaagacaagagataggg

SEQ ID NO: 122599 - DNA, 22 bp, Artificial Sequence
  chemically synthesized
gagaggctgtggagaaaggaga

SEQ ID NO: 122600 - DNA, 22 bp, Artificial Sequence
  chemically synthesized
tggagaaaggagaactcttgtg

SEQ ID NO: 122601 - DNA, 22 bp, Artificial Sequence
  chemically synthesized
ttgtgcatagctggtgggaatg

SEQ ID NO: 122602 - DNA, 22 bp, Artificial Sequence
  chemically synthesized
gtgcatagctggtgggaatgta

SEQ ID NO: 122603 - DNA, 22 bp, Artificial Sequence
  chemically synthesized
tgcatagctggtgggaatgtaa

SEQ ID NO: 122604 - DNA, 22 bp, Artificial Sequence
  chemically synthesized
gtgggaatgtaagttaacatag

SEQ ID NO: 122605 - DNA, 22 bp, Artificial Sequence
  chemically synthesized
acatagccattatagaaaacgt

SEQ ID NO: 122606 - DNA, 22 bp, Artificial Sequence
  chemically synthesized
tagaaaacgtatggaagtttct

SEQ ID NO: 122607 - DNA, 22 bp, Artificial Sequence
  chemically synthesized
ctcaaacaactaaaaatagagt

SEQ ID NO: 122608 - DNA, 22 bp, Artificial Sequence
  chemically synthesized
tcaaacaactaaaaatagagtt

SEQ ID NO: 122609 - DNA, 22 bp, Artificial Sequence
  chemically synthesized
aaacaactaaaaatagagttat

SEQ ID NO: 122610 - DNA, 22 bp, Artificial Sequence
  chemically synthesized
aaaatagagttattgtatgatg

SEQ ID NO: 122611 - DNA, 22 bp, Artificial Sequence
  chemically synthesized
ttgtatgatgaagaaatttctc

SEQ ID NO: 122612 - DNA, 22 bp, Artificial Sequence
  chemically synthesized
tatgatgaagaaatttctctgc

SEQ ID NO: 122613 - DNA, 22 bp, Artificial Sequence
  chemically synthesized
ctctgctgtatatgtatccaaa

SEQ ID NO: 122614 - DNA, 22 bp, Artificial Sequence
  chemically synthesized
tctgctgtatatgtatccaaaa

SEQ ID NO: 122615 - DNA, 22 bp, Artificial Sequence
  chemically synthesized
tgctgtatatgtatccaaaata

SEQ ID NO: 122616 - DNA, 22 bp, Artificial Sequence
  chemically synthesized
ctgtatatgtatccaaaataaa

SEQ ID NO: 122617 - DNA, 22 bp, Artificial Sequence
  chemically synthesized
tatatgtatccaaaataaataa

SEQ ID NO: 122618 - DNA, 22 bp, Artificial Sequence
  chemically synthesized
tctagagctatctgcactctca

SEQ ID NO: 122619 - DNA, 22 bp, Artificial Sequence
  chemically synthesized
ctagagctatctgcactctcat

SEQ ID NO: 122620 - DNA, 22 bp, Artificial Sequence
  chemically synthesized
tagagctatctgcactctcatg

SEQ ID NO: 122621 - DNA, 22 bp, Artificial Sequence
  chemically synthesized
gagctatctgcactctcatgtt

SEQ ID NO: 122622 - DNA, 22 bp, Artificial Sequence
  chemically synthesized
tctgcactctcatgttaattgc

SEQ ID NO: 122623 - DNA, 22 bp, Artificial Sequence
  chemically synthesized
cactctcatgttaattgcagca

SEQ ID NO: 122624 - DNA, 22 bp, Artificial Sequence
  chemically synthesized
tcatgttaattgcagcattatt

SEQ ID NO: 122625 - DNA, 22 bp, Artificial Sequence
  chemically synthesized
atgttaattgcagcattattca

SEQ ID NO: 122626 - DNA, 22 bp, Artificial Sequence
  chemically synthesized
attgcagcattattcacaatag

SEQ ID NO: 122627 - DNA, 22 bp, Artificial Sequence
  chemically synthesized
cagcattattcacaatagccaa

SEQ ID NO: 122628 - DNA, 22 bp, Artificial Sequence
  chemically synthesized
ttcacaatagccaagacatgga

SEQ ID NO: 122629 - DNA, 22 bp, Artificial Sequence
  chemically synthesized
acaatagccaagacatggaaac

SEQ ID NO: 122630 - DNA, 22 bp, Artificial Sequence
  chemically synthesized
agtggtatctatatatagatga

SEQ ID NO: 122631 - DNA, 22 bp, Artificial Sequence
  chemically synthesized
tatatagatgaacagataaaga

SEQ ID NO: 122632 - DNA, 22 bp, Artificial Sequence
  chemically synthesized
tgacaggtctgtatatgatatt

SEQ ID NO: 122633 - DNA, 22 bp, Artificial Sequence
  chemically synthesized
tatatgatattgtgatatatgt

SEQ ID NO: 122634 - DNA, 22 bp, Artificial Sequence
  chemically synthesized
tgatatatgtcatatgtatgta

SEQ ID NO: 122635 - DNA, 22 bp, Artificial Sequence
  chemically synthesized
ttcagccttaaaaaaggagatg

SEQ ID NO: 122636 - DNA, 22 bp, Artificial Sequence
  chemically synthesized
agccttaaaaaaggagatgggg

SEQ ID NO: 122637 - DNA, 22 bp, Artificial Sequence
  chemically synthesized
aaaaaaggagatggggggaatg

SEQ ID NO: 122638 - DNA, 22 bp, Artificial Sequence
  chemically synthesized
aaaaaggagatggggggaatgt

SEQ ID NO: 122639 - DNA, 22 bp, Artificial Sequence
  chemically synthesized
gagtacattttgctaagtgaaa

SEQ ID NO: 122640 - DNA, 22 bp, Artificial Sequence
  chemically synthesized
tgctaagtgaaataaaccagac

SEQ ID NO: 122641 - DNA, 22 bp, Artificial Sequence
  chemically synthesized
gctaagtgaaataaaccagaca

SEQ ID NO: 122642 - DNA, 22 bp, Artificial Sequence
  chemically synthesized
ctaagtgaaataaaccagacac

SEQ ID NO: 122643 - DNA, 22 bp, Artificial Sequence
  chemically synthesized
agtgaaataaaccagacacaga

SEQ ID NO: 122644 - DNA, 22 bp, Artificial Sequence
  chemically synthesized
cttatatgtggaatctcaaaag

SEQ ID NO: 122645 - DNA, 22 bp, Artificial Sequence
  chemically synthesized
atatgtggaatctcaaaagaaa

SEQ ID NO: 122646 - DNA, 22 bp, Artificial Sequence
  chemically synthesized
tatgtggaatctcaaaagaaaa

SEQ ID NO: 122647 - DNA, 22 bp, Artificial Sequence
  chemically synthesized
aaaagaaaaataaggtcaaatg

SEQ ID NO: 122648 - DNA, 22 bp, Artificial Sequence
  chemically synthesized
taaacttgcagctgtataggat

SEQ ID NO: 122649 - DNA, 22 bp, Artificial Sequence
  chemically synthesized
gcagctgtataggataaataag

SEQ ID NO: 122650 - DNA, 22 bp, Artificial Sequence
  chemically synthesized
cagctgtataggataaataagt

SEQ ID NO: 122651 - DNA, 22 bp, Artificial Sequence
  chemically synthesized
tataggataaataagtttagag

SEQ ID NO: 122652 - DNA, 22 bp, Artificial Sequence
  chemically synthesized
agagatctagtgtatggcatga

SEQ ID NO: 122653 - DNA, 22 bp, Artificial Sequence
  chemically synthesized
gagatctagtgtatggcatgaa

SEQ ID NO: 122654 - DNA, 22 bp, Artificial Sequence
  chemically synthesized
gtgtatggcatgaagacttaat

SEQ ID NO: 122655 - DNA, 22 bp, Artificial Sequence
  chemically synthesized
aatactgtactgtaaactaaac

SEQ ID NO: 122656 - DNA, 22 bp, Artificial Sequence
  chemically synthesized
atactgtactgtaaactaaaca

SEQ ID NO: 122657 - DNA, 22 bp, Artificial Sequence
  chemically synthesized
tactgtaaactaaacatttgtt

SEQ ID NO: 122658 - DNA, 22 bp, Artificial Sequence
  chemically synthesized
taaactaaacatttgttatgac

SEQ ID NO: 122659 - DNA, 22 bp, Artificial Sequence
  chemically synthesized
aacatttgttatgacagtagat

SEQ ID NO: 122660 - DNA, 22 bp, Artificial Sequence
  chemically synthesized
gttatgacagtagatgttagat

SEQ ID NO: 122661 - DNA, 22 bp, Artificial Sequence
  chemically synthesized
ttatgacagtagatgttagatg

SEQ ID NO: 122662 - DNA, 22 bp, Artificial Sequence
  chemically synthesized
tgacagtagatgttagatgccc

SEQ ID NO: 122663 - DNA, 22 bp, Artificial Sequence
  chemically synthesized
gatgcccttacacaaagaaaaa

SEQ ID NO: 122664 - DNA, 22 bp, Artificial Sequence
  chemically synthesized
acacaaagaaaaagcaaaaggt

SEQ ID NO: 122665 - DNA, 22 bp, Artificial Sequence
  chemically synthesized
cacaaagaaaaagcaaaaggta

SEQ ID NO: 122666 - DNA, 22 bp, Artificial Sequence
  chemically synthesized
tggaaggtgttgtattgatgga

SEQ ID NO: 122667 - DNA, 22 bp, Artificial Sequence
  chemically synthesized
tattgatggataggttaatttg

SEQ ID NO: 122668 - DNA, 22 bp, Artificial Sequence
  chemically synthesized
atggataggttaatttgcttga

SEQ ID NO: 122669 - DNA, 22 bp, Artificial Sequence
  chemically synthesized
atttgcttgattgaagtaatca

SEQ ID NO: 122670 - DNA, 22 bp, Artificial Sequence
  chemically synthesized
gcttgattgaagtaatcatctc

SEQ ID NO: 122671 - DNA, 22 bp, Artificial Sequence
  chemically synthesized
cttgattgaagtaatcatctca

SEQ ID NO: 122672 - DNA, 22 bp, Artificial Sequence
  chemically synthesized
gattgaagtaatcatctcacta

SEQ ID NO: 122673 - DNA, 22 bp, Artificial Sequence
  chemically synthesized
attgaagtaatcatctcactat

SEQ ID NO: 122674 - DNA, 22 bp, Artificial Sequence
  chemically synthesized
aagtaatcatctcactatgtac

SEQ ID NO: 122675 - DNA, 22 bp, Artificial Sequence
  chemically synthesized
actatgtacacatatatcctat

SEQ ID NO: 122676 - DNA, 22 bp, Artificial Sequence
  chemically synthesized
tgtacacatatatcctatattt

SEQ ID NO: 122677 - DNA, 22 bp, Artificial Sequence
  chemically synthesized
tattttttgaacaagcttactt

SEQ ID NO: 122678 - DNA, 22 bp, Artificial Sequence
  chemically synthesized
tttgaacaagcttacttgtttc

SEQ ID NO: 122679 - DNA, 22 bp, Artificial Sequence
  chemically synthesized
ttgaacaagcttacttgtttca

SEQ ID NO: 122680 - DNA, 22 bp, Artificial Sequence
  chemically synthesized
tgaacaagcttacttgtttcag

SEQ ID NO: 122681 - DNA, 22 bp, Artificial Sequence
  chemically synthesized
gaacaagcttacttgtttcaga

SEQ ID NO: 122682 - DNA, 22 bp, Artificial Sequence
  chemically synthesized
aacaagcttacttgtttcagat

SEQ ID NO: 122683 - DNA, 22 bp, Artificial Sequence
  chemically synthesized
acttgtttcagataaaatattt

SEQ ID NO: 122684 - DNA, 22 bp, Artificial Sequence
  chemically synthesized
cttgtttcagataaaatatttt

SEQ ID NO: 122685 - DNA, 22 bp, Artificial Sequence
  chemically synthesized
gtttcagataaaatattttaaa

SEQ ID NO: 122686 - DNA, 22 bp, Artificial Sequence
  chemically synthesized
tttcagataaaatattttaaaa

SEQ ID NO: 122687 - DNA, 22 bp, Artificial Sequence
  chemically synthesized
cagataaaatattttaaaagct

SEQ ID NO: 122688 - DNA, 22 bp, Artificial Sequence
  chemically synthesized
agataaaatattttaaaagctt

SEQ ID NO: 122689 - DNA, 22 bp, Artificial Sequence
  chemically synthesized
taaaagcttttatctgaagcaa

SEQ ID NO: 122690 - DNA, 22 bp, Artificial Sequence
  chemically synthesized
aaaagcttttatctgaagcaag

SEQ ID NO: 122691 - DNA, 22 bp, Artificial Sequence
  chemically synthesized
aaagcttttatctgaagcaagt

SEQ ID NO: 122692 - DNA, 22 bp, Artificial Sequence
  chemically synthesized
ttatctgaagcaagtcaaattt

SEQ ID NO: 122693 - DNA, 22 bp, Artificial Sequence
  chemically synthesized
tatctgaagcaagtcaaatttc

SEQ ID NO: 122694 - DNA, 22 bp, Artificial Sequence
  chemically synthesized
atctgaagcaagtcaaatttct

SEQ ID NO: 122695 - DNA, 22 bp, Artificial Sequence
  chemically synthesized
tctgaagcaagtcaaatttctg

SEQ ID NO: 122696 - DNA, 22 bp, Artificial Sequence
  chemically synthesized
aagcaagtcaaatttctgtttc

SEQ ID NO: 122697 - DNA, 22 bp, Artificial Sequence
  chemically synthesized
ctgtttcctaattgtttagggt

SEQ ID NO: 122698 - DNA, 22 bp, Artificial Sequence
  chemically synthesized
tgtttcctaattgtttagggtc

SEQ ID NO: 122699 - DNA, 22 bp, Artificial Sequence
  chemically synthesized
tttcctaattgtttagggtcct

SEQ ID NO: 122700 - DNA, 22 bp, Artificial Sequence
  chemically synthesized
cctaattgtttagggtccttca

SEQ ID NO: 122701 - DNA, 22 bp, Artificial Sequence
  chemically synthesized
ctaattgtttagggtccttcat

SEQ ID NO: 122702 - DNA, 22 bp, Artificial Sequence
  chemically synthesized
attgtttagggtccttcatgtt

SEQ ID NO: 122703 - DNA, 22 bp, Artificial Sequence
  chemically synthesized
tttagggtccttcatgttattt

SEQ ID NO: 122704 - DNA, 22 bp, Artificial Sequence
  chemically synthesized
agggtccttcatgttatttcca

SEQ ID NO: 122705 - DNA, 22 bp, Artificial Sequence
  chemically synthesized
gggtccttcatgttatttccac

SEQ ID NO: 122706 - DNA, 22 bp, Artificial Sequence
  chemically synthesized
catgttatttccactcttaaaa

SEQ ID NO: 122707 - DNA, 22 bp, Artificial Sequence
  chemically synthesized
atgttatttccactcttaaaac

SEQ ID NO: 122708 - DNA, 22 bp, Artificial Sequence
  chemically synthesized
tttccactcttaaaacttatgt

SEQ ID NO: 122709 - DNA, 22 bp, Artificial Sequence
  chemically synthesized
ccactcttaaaacttatgtaac

SEQ ID NO: 122710 - DNA, 22 bp, Artificial Sequence
  chemically synthesized
cactcttaaaacttatgtaacc

SEQ ID NO: 122711 - DNA, 22 bp, Artificial Sequence
  chemically synthesized
ttaaaacttatgtaaccctttg

SEQ ID NO: 122712 - DNA, 22 bp, Artificial Sequence
  chemically synthesized
aaaacttatgtaaccctttgga

SEQ ID NO: 122713 - DNA, 22 bp, Artificial Sequence
  chemically synthesized
aaacttatgtaaccctttggat

SEQ ID NO: 122714 - DNA, 22 bp, Artificial Sequence
  chemically synthesized
atgtaaccctttggatataatg

SEQ ID NO: 122715 - DNA, 22 bp, Artificial Sequence
  chemically synthesized
tgtaaccctttggatataatga

SEQ ID NO: 122716 - DNA, 22 bp, Artificial Sequence
  chemically synthesized
tggatataatgagatatatgtt

SEQ ID NO: 122717 - DNA, 22 bp, Artificial Sequence
  chemically synthesized
ggatataatgagatatatgttt

SEQ ID NO: 122718 - DNA, 22 bp, Artificial Sequence
  chemically synthesized
gatataatgagatatatgtttt

SEQ ID NO: 122719 - DNA, 22 bp, Artificial Sequence
  chemically synthesized
ttctctatttttaatatcagta

SEQ ID NO: 122720 - DNA, 22 bp, Artificial Sequence
  chemically synthesized
tctctatttttaatatcagtac

SEQ ID NO: 122721 - DNA, 22 bp, Artificial Sequence
  chemically synthesized
ctctatttttaatatcagtact

SEQ ID NO: 122722 - DNA, 22 bp, Artificial Sequence
  chemically synthesized
tctatttttaatatcagtactc

SEQ ID NO: 122723 - DNA, 22 bp, Artificial Sequence
  chemically synthesized
tatttttaatatcagtactctt

SEQ ID NO: 122724 - DNA, 22 bp, Artificial Sequence
  chemically synthesized
tttttaatatcagtactcttta

SEQ ID NO: 122725 - DNA, 22 bp, Artificial Sequence
  chemically synthesized
ttaatatcagtactctttagat

SEQ ID NO: 122726 - DNA, 22 bp, Artificial Sequence
  chemically synthesized
taatatcagtactctttagata

SEQ ID NO: 122727 - DNA, 22 bp, Artificial Sequence
  chemically synthesized
aatatcagtactctttagatac

SEQ ID NO: 122728 - DNA, 22 bp, Artificial Sequence
  chemically synthesized
atatcagtactctttagataca

SEQ ID NO: 122729 - DNA, 22 bp, Artificial Sequence
  chemically synthesized
tttagatacagctatcactgtc

SEQ ID NO: 122730 - DNA, 22 bp, Artificial Sequence
  chemically synthesized
tagatacagctatcactgtctc

SEQ ID NO: 122731 - DNA, 22 bp, Artificial Sequence
  chemically synthesized
agatacagctatcactgtctct

SEQ ID NO: 122732 - DNA, 22 bp, Artificial Sequence
  chemically synthesized
gatacagctatcactgtctctc

SEQ ID NO: 122733 - DNA, 22 bp, Artificial Sequence
  chemically synthesized
tcactgtctctcagggtacctc

SEQ ID NO: 122734 - DNA, 22 bp, Artificial Sequence
  chemically synthesized
tctctcagggtacctctgcctc

SEQ ID NO: 122735 - DNA, 22 bp, Artificial Sequence
  chemically synthesized
tcagggtacctctgcctctggt

SEQ ID NO: 122736 - DNA, 22 bp, Artificial Sequence
  chemically synthesized
agggtacctctgcctctggtca

SEQ ID NO: 122737 - DNA, 22 bp, Artificial Sequence
  chemically synthesized
tgcctctggtcattttgttcat

SEQ ID NO: 122738 - DNA, 22 bp, Artificial Sequence
  chemically synthesized
cctctggtcattttgttcattc

SEQ ID NO: 122739 - DNA, 22 bp, Artificial Sequence
  chemically synthesized
tggtcattttgttcattcttta

SEQ ID NO: 122740 - DNA, 22 bp, Artificial Sequence
  chemically synthesized
gtcattttgttcattctttatg

SEQ ID NO: 122741 - DNA, 22 bp, Artificial Sequence
  chemically synthesized
tgttcattctttatgttgaaat

SEQ ID NO: 122742 - DNA, 22 bp, Artificial Sequence
  chemically synthesized
gttcattctttatgttgaaatt

SEQ ID NO: 122743 - DNA, 22 bp, Artificial Sequence
  chemically synthesized
ttcattctttatgttgaaattt

SEQ ID NO: 122744 - DNA, 22 bp, Artificial Sequence
  chemically synthesized
attctttatgttgaaattttat

SEQ ID NO: 122745 - DNA, 22 bp, Artificial Sequence
  chemically synthesized
tttatgttgaaattttatatct

SEQ ID NO: 122746 - DNA, 22 bp, Artificial Sequence
  chemically synthesized
tatgttgaaattttatatctcc

SEQ ID NO: 122747 - DNA, 22 bp, Artificial Sequence
  chemically synthesized
atgttgaaattttatatctccg

SEQ ID NO: 122748 - DNA, 22 bp, Artificial Sequence
  chemically synthesized
tgttgaaattttatatctccgg

SEQ ID NO: 122749 - DNA, 22 bp, Artificial Sequence
  chemically synthesized
aaattttatatctccggcctac

SEQ ID NO: 122750 - DNA, 22 bp, Artificial Sequence
  chemically synthesized
tatatctccggcctacaactca

SEQ ID NO: 122751 - DNA, 22 bp, Artificial Sequence
  chemically synthesized
atatctccggcctacaactcag

SEQ ID NO: 122752 - DNA, 22 bp, Artificial Sequence
  chemically synthesized
tatctccggcctacaactcagg

SEQ ID NO: 122753 - DNA, 22 bp, Artificial Sequence
  chemically synthesized
cggcctacaactcagggtttta

SEQ ID NO: 122754 - DNA, 22 bp, Artificial Sequence
  chemically synthesized
caactcagggttttacagtttc

SEQ ID NO: 122755 - DNA, 22 bp, Artificial Sequence
  chemically synthesized
agggttttacagtttcatcaat

SEQ ID NO: 122756 - DNA, 22 bp, Artificial Sequence
  chemically synthesized
tacagtttcatcaatgtctcta

SEQ ID NO: 122757 - DNA, 22 bp, Artificial Sequence
  chemically synthesized
acagtttcatcaatgtctctat

SEQ ID NO: 122758 - DNA, 22 bp, Artificial Sequence
  chemically synthesized
cagtttcatcaatgtctctatt

SEQ ID NO: 122759 - DNA, 22 bp, Artificial Sequence
  chemically synthesized
catcaatgtctctattaaatgt

SEQ ID NO: 122760 - DNA, 22 bp, Artificial Sequence
  chemically synthesized
atcaatgtctctattaaatgtt

SEQ ID NO: 122761 - DNA, 22 bp, Artificial Sequence
  chemically synthesized
tattaaatgtttatgagccaca

SEQ ID NO: 122762 - DNA, 22 bp, Artificial Sequence
  chemically synthesized
ttaaatgtttatgagccacaga

SEQ ID NO: 122763 - DNA, 22 bp, Artificial Sequence
  chemically synthesized
aatgtttatgagccacagagaa

SEQ ID NO: 122764 - DNA, 22 bp, Artificial Sequence
  chemically synthesized
atgagccacagagaatgagaat

SEQ ID NO: 122765 - DNA, 22 bp, Artificial Sequence
  chemically synthesized
tgagccacagagaatgagaatt

SEQ ID NO: 122766 - DNA, 22 bp, Artificial Sequence
  chemically synthesized
tatgttcaatttttttgaactt

SEQ ID NO: 122767 - DNA, 22 bp, Artificial Sequence
  chemically synthesized
aatttttttgaacttctgtgtt

SEQ ID NO: 122768 - DNA, 22 bp, Artificial Sequence
  chemically synthesized
ttttgaacttctgtgtttgagt

SEQ ID NO: 122769 - DNA, 22 bp, Artificial Sequence
  chemically synthesized
tttgaacttctgtgtttgagtt

SEQ ID NO: 122770 - DNA, 22 bp, Artificial Sequence
  chemically synthesized
ttgaacttctgtgtttgagttt

SEQ ID NO: 122771 - DNA, 22 bp, Artificial Sequence
  chemically synthesized
tgaacttctgtgtttgagtttt

SEQ ID NO: 122772 - DNA, 22 bp, Artificial Sequence
  chemically synthesized
gaacttctgtgtttgagtttta

SEQ ID NO: 122773 - DNA, 22 bp, Artificial Sequence
  chemically synthesized
aacttctgtgtttgagttttaa

SEQ ID NO: 122774 - DNA, 22 bp, Artificial Sequence
  chemically synthesized
ctgtgtttgagttttaaaaaaa

SEQ ID NO: 122775 - DNA, 22 bp, Artificial Sequence
  chemically synthesized
tgtgtttgagttttaaaaaaat

SEQ ID NO: 122776 - DNA, 22 bp, Artificial Sequence
  chemically synthesized
tgtttgagttttaaaaaaatta

SEQ ID NO: 122777 - DNA, 22 bp, Artificial Sequence
  chemically synthesized
gagttttaaaaaaattaaccta

SEQ ID NO: 122778 - DNA, 22 bp, Artificial Sequence
  chemically synthesized
agttttaaaaaaattaacctaa

SEQ ID NO: 122779 - DNA, 22 bp, Artificial Sequence
  chemically synthesized
taaaaaaattaacctaatgtga

SEQ ID NO: 122780 - DNA, 22 bp, Artificial Sequence
  chemically synthesized
aaaaaaattaacctaatgtgaa

SEQ ID NO: 122781 - DNA, 22 bp, Artificial Sequence
  chemically synthesized
aaaaaattaacctaatgtgaaa

SEQ ID NO: 122782 - DNA, 22 bp, Artificial Sequence
  chemically synthesized
acctaatgtgaaagaccctaga

SEQ ID NO: 122783 - DNA, 22 bp, Artificial Sequence
  chemically synthesized
atgtgaaagaccctagatccgg

SEQ ID NO: 122784 - DNA, 22 bp, Artificial Sequence
  chemically synthesized
gatccggggaaaggtgctgtgt

SEQ ID NO: 122785 - DNA, 22 bp, Artificial Sequence
  chemically synthesized
tgtggcttagagtataaacatc

SEQ ID NO: 122786 - DNA, 22 bp, Artificial Sequence
  chemically synthesized
agagtataaacatcagaatgtg

SEQ ID NO: 122787 - DNA, 22 bp, Artificial Sequence
  chemically synthesized
gagtataaacatcagaatgtgc

SEQ ID NO: 122788 - DNA, 22 bp, Artificial Sequence
  chemically synthesized
tggactttctagaatatttcag

SEQ ID NO: 122789 - DNA, 22 bp, Artificial Sequence
  chemically synthesized
tctagaatatttcagtgccctt

SEQ ID NO: 122790 - DNA, 22 bp, Artificial Sequence
  chemically synthesized
ctagaatatttcagtgcccttg

SEQ ID NO: 122791 - DNA, 22 bp, Artificial Sequence
  chemically synthesized
tagaatatttcagtgcccttgt

SEQ ID NO: 122792 - DNA, 22 bp, Artificial Sequence
  chemically synthesized
gaatatttcagtgcccttgtat

SEQ ID NO: 122793 - DNA, 22 bp, Artificial Sequence
  chemically synthesized
cagtgcccttgtatatcctcag

SEQ ID NO: 122794 - DNA, 22 bp, Artificial Sequence
  chemically synthesized
agtgcccttgtatatcctcaga

SEQ ID NO: 122795 - DNA, 22 bp, Artificial Sequence
  chemically synthesized
gtatatcctcagaatgtgtgga

SEQ ID NO: 122796 - DNA, 22 bp, Artificial Sequence
  chemically synthesized
tatatcctcagaatgtgtggag

SEQ ID NO: 122797 - DNA, 22 bp, Artificial Sequence
  chemically synthesized
agaatgtgtggagagtaattcc

SEQ ID NO: 122798 - DNA, 22 bp, Artificial Sequence
  chemically synthesized
caaaacaaagcccttacttcaa

SEQ ID NO: 122799 - DNA, 22 bp, Artificial Sequence
  chemically synthesized
acttcaatatccatggtggtcc

SEQ ID NO: 122800 - DNA, 22 bp, Artificial Sequence
  chemically synthesized
cttcaatatccatggtggtcca

SEQ ID NO: 122801 - DNA, 22 bp, Artificial Sequence
  chemically synthesized
caatatccatggtggtccatag

SEQ ID NO: 122802 - DNA, 22 bp, Artificial Sequence
  chemically synthesized
aatatccatggtggtccatagc

SEQ ID NO: 122803 - DNA, 22 bp, Artificial Sequence
  chemically synthesized
gggctagcagaaggaagggttc

SEQ ID NO: 122804 - DNA, 22 bp, Artificial Sequence
  chemically synthesized
gcagaaggaagggttcaaaatc

SEQ ID NO: 122805 - DNA, 22 bp, Artificial Sequence
  chemically synthesized
aaaatcactatttttatcactc

SEQ ID NO: 122806 - DNA, 22 bp, Artificial Sequence
  chemically synthesized
tttttatcactcaaattatctg

SEQ ID NO: 122807 - DNA, 22 bp, Artificial Sequence
  chemically synthesized
ttatcactcaaattatctgctc

SEQ ID NO: 122808 - DNA, 22 bp, Artificial Sequence
  chemically synthesized
tatcactcaaattatctgctct

SEQ ID NO: 122809 - DNA, 22 bp, Artificial Sequence
  chemically synthesized
atcactcaaattatctgctctt

SEQ ID NO: 122810 - DNA, 22 bp, Artificial Sequence
  chemically synthesized
tcactcaaattatctgctcttg

SEQ ID NO: 122811 - DNA, 22 bp, Artificial Sequence
  chemically synthesized
aaattatctgctcttggaaaaa

SEQ ID NO: 122812 - DNA, 22 bp, Artificial Sequence
  chemically synthesized
tctgctcttggaaaaaccagtc

SEQ ID NO: 122813 - DNA, 22 bp, Artificial Sequence
  chemically synthesized
ctcttggaaaaaccagtccctt

SEQ ID NO: 122814 - DNA, 22 bp, Artificial Sequence
  chemically synthesized
ttggaaaaaccagtccctttgg

SEQ ID NO: 122815 - DNA, 22 bp, Artificial Sequence
  chemically synthesized
ggaaaaaccagtccctttgggt

SEQ ID NO: 122816 - DNA, 22 bp, Artificial Sequence
  chemically synthesized
gaaaaaccagtccctttgggta

SEQ ID NO: 122817 - DNA, 22 bp, Artificial Sequence
  chemically synthesized
tgggtagccccaatcatgtgta

SEQ ID NO: 122818 - DNA, 22 bp, Artificial Sequence
  chemically synthesized
gggtagccccaatcatgtgtaa

SEQ ID NO: 122819 - DNA, 22 bp, Artificial Sequence
  chemically synthesized
ggtagccccaatcatgtgtaag

SEQ ID NO: 122820 - DNA, 22 bp, Artificial Sequence
  chemically synthesized
tttcctgaagtatgatcatatg

SEQ ID NO: 122821 - DNA, 22 bp, Artificial Sequence
  chemically synthesized
ttcctgaagtatgatcatatgg

SEQ ID NO: 122822 - DNA, 22 bp, Artificial Sequence
  chemically synthesized
tcctgaagtatgatcatatggt

SEQ ID NO: 122823 - DNA, 22 bp, Artificial Sequence
  chemically synthesized
cctgaagtatgatcatatggtt

SEQ ID NO: 122824 - DNA, 22 bp, Artificial Sequence
  chemically synthesized
ctgaagtatgatcatatggttc

SEQ ID NO: 122825 - DNA, 22 bp, Artificial Sequence
  chemically synthesized
aagtatgatcatatggttctct

SEQ ID NO: 122826 - DNA, 22 bp, Artificial Sequence
  chemically synthesized
tcttccttctgtctgctcattg

SEQ ID NO: 122827 - DNA, 22 bp, Artificial Sequence
  chemically synthesized
ttccttctgtctgctcattgaa

SEQ ID NO: 122828 - DNA, 22 bp, Artificial Sequence
  chemically synthesized
ccttctgtctgctcattgaacc

SEQ ID NO: 122829 - DNA, 22 bp, Artificial Sequence
  chemically synthesized
cttctgtctgctcattgaacca

SEQ ID NO: 122830 - DNA, 22 bp, Artificial Sequence
  chemically synthesized
ctgtctgctcattgaaccagag

SEQ ID NO: 122831 - DNA, 22 bp, Artificial Sequence
  chemically synthesized
tgtctgctcattgaaccagagc

SEQ ID NO: 122832 - DNA, 22 bp, Artificial Sequence
  chemically synthesized
tctgctcattgaaccagagctc

SEQ ID NO: 122833 - DNA, 22 bp, Artificial Sequence
  chemically synthesized
ctcattgaaccagagctccagg

SEQ ID NO: 122834 - DNA, 22 bp, Artificial Sequence
  chemically synthesized
attgaaccagagctccaggacc

SEQ ID NO: 122835 - DNA, 22 bp, Artificial Sequence
  chemically synthesized
aaccagagctccaggaccaata

SEQ ID NO: 122836 - DNA, 22 bp, Artificial Sequence
  chemically synthesized
caggaccaataccactatggca

SEQ ID NO: 122837 - DNA, 22 bp, Artificial Sequence
  chemically synthesized
tggcaatacttcttttgcctct

SEQ ID NO: 122838 - DNA, 22 bp, Artificial Sequence
  chemically synthesized
cttttgcctctacaactctcag

SEQ ID NO: 122839 - DNA, 22 bp, Artificial Sequence
  chemically synthesized
ttttgcctctacaactctcagg

SEQ ID NO: 122840 - DNA, 22 bp, Artificial Sequence
  chemically synthesized
ttgcctctacaactctcaggtc

SEQ ID NO: 122841 - DNA, 22 bp, Artificial Sequence
  chemically synthesized
tgcctctacaactctcaggtca

SEQ ID NO: 122842 - DNA, 22 bp, Artificial Sequence
  chemically synthesized
gcctctacaactctcaggtcac

SEQ ID NO: 122843 - DNA, 22 bp, Artificial Sequence
  chemically synthesized
cctctacaactctcaggtcaca

SEQ ID NO: 122844 - DNA, 22 bp, Artificial Sequence
  chemically synthesized
tacaactctcaggtcacagctg

SEQ ID NO: 122845 - DNA, 22 bp, Artificial Sequence
  chemically synthesized
caactctcaggtcacagctgaa

SEQ ID NO: 122846 - DNA, 22 bp, Artificial Sequence
  chemically synthesized
tcaggtcacagctgaaatatta

SEQ ID NO: 122847 - DNA, 22 bp, Artificial Sequence
  chemically synthesized
aggtcacagctgaaatattacc

SEQ ID NO: 122848 - DNA, 22 bp, Artificial Sequence
  chemically synthesized
aaatattacctcctctcagaac

SEQ ID NO: 122849 - DNA, 22 bp, Artificial Sequence
  chemically synthesized
cctcctctcagaacccgcattt

SEQ ID NO: 122850 - DNA, 22 bp, Artificial Sequence
  chemically synthesized
ctctcagaacccgcatttgtca

SEQ ID NO: 122851 - DNA, 22 bp, Artificial Sequence
  chemically synthesized
tcagaacccgcatttgtcacac

SEQ ID NO: 122852 - DNA, 22 bp, Artificial Sequence
  chemically synthesized
agaacccgcatttgtcacacta

SEQ ID NO: 122853 - DNA, 22 bp, Artificial Sequence
  chemically synthesized
gtcacactagcttacataaatt

SEQ ID NO: 122854 - DNA, 22 bp, Artificial Sequence
  chemically synthesized
tcacactagcttacataaattt

SEQ ID NO: 122855 - DNA, 22 bp, Artificial Sequence
  chemically synthesized
gcttacataaattttgttattc

SEQ ID NO: 122856 - DNA, 22 bp, Artificial Sequence
  chemically synthesized
acataaattttgttattctcta

SEQ ID NO: 122857 - DNA, 22 bp, Artificial Sequence
  chemically synthesized
cataaattttgttattctctat

SEQ ID NO: 122858 - DNA, 22 bp, Artificial Sequence
  chemically synthesized
tgttattctctattgcatcaaa

SEQ ID NO: 122859 - DNA, 22 bp, Artificial Sequence
  chemically synthesized
gttattctctattgcatcaaat

SEQ ID NO: 122860 - DNA, 22 bp, Artificial Sequence
  chemically synthesized
ttattctctattgcatcaaatt

SEQ ID NO: 122861 - DNA, 22 bp, Artificial Sequence
  chemically synthesized
ttctctattgcatcaaattttt

SEQ ID NO: 122862 - DNA, 22 bp, Artificial Sequence
  chemically synthesized
tctattgcatcaaattttttct

SEQ ID NO: 122863 - DNA, 22 bp, Artificial Sequence
  chemically synthesized
tattgcatcaaattttttcttt

SEQ ID NO: 122864 - DNA, 22 bp, Artificial Sequence
  chemically synthesized
ttgcatcaaattttttctttct

SEQ ID NO: 122865 - DNA, 22 bp, Artificial Sequence
  chemically synthesized
catcaaattttttctttctttc

SEQ ID NO: 122866 - DNA, 22 bp, Artificial Sequence
  chemically synthesized
tttctttctttcatagcagcta

SEQ ID NO: 122867 - DNA, 22 bp, Artificial Sequence
  chemically synthesized
ttctttctttcatagcagctat

SEQ ID NO: 122868 - DNA, 22 bp, Artificial Sequence
  chemically synthesized
tctttctttcatagcagctata

SEQ ID NO: 122869 - DNA, 22 bp, Artificial Sequence
  chemically synthesized
ctttctttcatagcagctatat

SEQ ID NO: 122870 - DNA, 22 bp, Artificial Sequence
  chemically synthesized
tttctttcatagcagctatatg

SEQ ID NO: 122871 - DNA, 22 bp, Artificial Sequence
  chemically synthesized
tctttcatagcagctatatgag

SEQ ID NO: 122872 - DNA, 22 bp, Artificial Sequence
  chemically synthesized
ctttcatagcagctatatgagg

SEQ ID NO: 122873 - DNA, 22 bp, Artificial Sequence
  chemically synthesized
tttcatagcagctatatgaggt

SEQ ID NO: 122874 - DNA, 22 bp, Artificial Sequence
  chemically synthesized
tcatagcagctatatgaggttg

SEQ ID NO: 122875 - DNA, 22 bp, Artificial Sequence
  chemically synthesized
catagcagctatatgaggttgt

SEQ ID NO: 122876 - DNA, 22 bp, Artificial Sequence
  chemically synthesized
atagcagctatatgaggttgta

SEQ ID NO: 122877 - DNA, 22 bp, Artificial Sequence
  chemically synthesized
tatgaggttgtaattatttttg

SEQ ID NO: 122878 - DNA, 22 bp, Artificial Sequence
  chemically synthesized
taattatttttgtcactttttt

SEQ ID NO: 122879 - DNA, 22 bp, Artificial Sequence
  chemically synthesized
tttttgtcacttttttattatt

SEQ ID NO: 122880 - DNA, 22 bp, Artificial Sequence
  chemically synthesized
ttgtcacttttttattatttcc

SEQ ID NO: 122881 - DNA, 22 bp, Artificial Sequence
  chemically synthesized
tgtcacttttttattatttcct

SEQ ID NO: 122882 - DNA, 22 bp, Artificial Sequence
  chemically synthesized
gtcacttttttattatttcctt

SEQ ID NO: 122883 - DNA, 22 bp, Artificial Sequence
  chemically synthesized
tcacttttttattatttccttt

SEQ ID NO: 122884 - DNA, 22 bp, Artificial Sequence
  chemically synthesized
ttttattatttcctttccgtta

SEQ ID NO: 122885 - DNA, 22 bp, Artificial Sequence
  chemically synthesized
tttattatttcctttccgttaa

SEQ ID NO: 122886 - DNA, 22 bp, Artificial Sequence
  chemically synthesized
ttattatttcctttccgttaaa

SEQ ID NO: 122887 - DNA, 22 bp, Artificial Sequence
  chemically synthesized
tattatttcctttccgttaaaa

SEQ ID NO: 122888 - DNA, 22 bp, Artificial Sequence
  chemically synthesized
attatttcctttccgttaaaat

SEQ ID NO: 122889 - DNA, 22 bp, Artificial Sequence
  chemically synthesized
ttatttcctttccgttaaaata

SEQ ID NO: 122890 - DNA, 22 bp, Artificial Sequence
  chemically synthesized
tttcctttccgttaaaatacaa

SEQ ID NO: 122891 - DNA, 22 bp, Artificial Sequence
  chemically synthesized
cctttccgttaaaatacaagct

SEQ ID NO: 122892 - DNA, 22 bp, Artificial Sequence
  chemically synthesized
ctttccgttaaaatacaagctt

SEQ ID NO: 122893 - DNA, 22 bp, Artificial Sequence
  chemically synthesized
tccgttaaaatacaagcttcat

SEQ ID NO: 122894 - DNA, 22 bp, Artificial Sequence
  chemically synthesized
ccgttaaaatacaagcttcata

SEQ ID NO: 122895 - DNA, 22 bp, Artificial Sequence
  chemically synthesized
cgttaaaatacaagcttcatag

SEQ ID NO: 122896 - DNA, 22 bp, Artificial Sequence
  chemically synthesized
aaatacaagcttcataggaaca

SEQ ID NO: 122897 - DNA, 22 bp, Artificial Sequence
  chemically synthesized
cataggaacagagaatatatgc

SEQ ID NO: 122898 - DNA, 22 bp, Artificial Sequence
  chemically synthesized
ataggaacagagaatatatgca

SEQ ID NO: 122899 - DNA, 22 bp, Artificial Sequence
  chemically synthesized
ttgtacccagtagttgctaaaa

SEQ ID NO: 122900 - DNA, 22 bp, Artificial Sequence
  chemically synthesized
tgtacccagtagttgctaaaat

SEQ ID NO: 122901 - DNA, 22 bp, Artificial Sequence
  chemically synthesized
gtacccagtagttgctaaaata

SEQ ID NO: 122902 - DNA, 22 bp, Artificial Sequence
  chemically synthesized
tacccagtagttgctaaaatag

SEQ ID NO: 122903 - DNA, 22 bp, Artificial Sequence
  chemically synthesized
ctaaaatagagaagcctctcat

SEQ ID NO: 122904 - DNA, 22 bp, Artificial Sequence
  chemically synthesized
aaatagagaagcctctcattag

SEQ ID NO: 122905 - DNA, 22 bp, Artificial Sequence
  chemically synthesized
tcattagataaacaaacaacta

SEQ ID NO: 122906 - DNA, 22 bp, Artificial Sequence
  chemically synthesized
attagataaacaaacaactaaa

SEQ ID NO: 122907 - DNA, 22 bp, Artificial Sequence
  chemically synthesized
gataaacaaacaactaaacaat

SEQ ID NO: 122908 - DNA, 22 bp, Artificial Sequence
  chemically synthesized
aacaatgaccgcttgttaaata

SEQ ID NO: 122909 - DNA, 22 bp, Artificial Sequence
  chemically synthesized
gttaaataaatgtatttagtta

SEQ ID NO: 122910 - DNA, 22 bp, Artificial Sequence
  chemically synthesized
ttaaataaatgtatttagttat

SEQ ID NO: 122911 - DNA, 22 bp, Artificial Sequence
  chemically synthesized
aataaatgtatttagttattct

SEQ ID NO: 122912 - DNA, 22 bp, Artificial Sequence
  chemically synthesized
agttattctattattcatttct

SEQ ID NO: 122913 - DNA, 22 bp, Artificial Sequence
  chemically synthesized
gttattctattattcatttcta

SEQ ID NO: 122914 - DNA, 22 bp, Artificial Sequence
  chemically synthesized
ttctattattcatttctaaaca

SEQ ID NO: 122915 - DNA, 22 bp, Artificial Sequence
  chemically synthesized
tattattcatttctaaacacag

SEQ ID NO: 122916 - DNA, 22 bp, Artificial Sequence
  chemically synthesized
ttattcatttctaaacacagaa

SEQ ID NO: 122917 - DNA, 22 bp, Artificial Sequence
  chemically synthesized
ttcatttctaaacacagaaaga

SEQ ID NO: 122918 - DNA, 22 bp, Artificial Sequence
  chemically synthesized
atttctaaacacagaaagagtg

SEQ ID NO: 122919 - DNA, 22 bp, Artificial Sequence
  chemically synthesized
ctaaacacagaaagagtgagaa

SEQ ID NO: 122920 - DNA, 22 bp, Artificial Sequence
  chemically synthesized
taaacacagaaagagtgagaaa

SEQ ID NO: 122921 - DNA, 22 bp, Artificial Sequence
  chemically synthesized
aacacagaaagagtgagaaagg

SEQ ID NO: 122922 - DNA, 22 bp, Artificial Sequence
  chemically synthesized
tctggcattaaattattgccct

SEQ ID NO: 122923 - DNA, 22 bp, Artificial Sequence
  chemically synthesized
ctggcattaaattattgccctc

SEQ ID NO: 122924 - DNA, 22 bp, Artificial Sequence
  chemically synthesized
tggcattaaattattgccctca

SEQ ID NO: 122925 - DNA, 22 bp, Artificial Sequence
  chemically synthesized
gcattaaattattgccctcaaa

SEQ ID NO: 122926 - DNA, 22 bp, Artificial Sequence
  chemically synthesized
aattattgccctcaaattggac

SEQ ID NO: 122927 - DNA, 22 bp, Artificial Sequence
  chemically synthesized
ttgccctcaaattggacagaga

SEQ ID NO: 122928 - DNA, 22 bp, Artificial Sequence
  chemically synthesized
ccctcaaattggacagagacat

SEQ ID NO: 122929 - DNA, 22 bp, Artificial Sequence
  chemically synthesized
aaattggacagagacataccaa

SEQ ID NO: 122930 - DNA, 22 bp, Artificial Sequence
  chemically synthesized
gacagagacataccaacaaatg

SEQ ID NO: 122931 - DNA, 22 bp, Artificial Sequence
  chemically synthesized
tgaagatttgaatttaattttc

SEQ ID NO: 122932 - DNA, 22 bp, Artificial Sequence
  chemically synthesized
aagatttgaatttaattttccc

SEQ ID NO: 122933 - DNA, 22 bp, Artificial Sequence
  chemically synthesized
gaatttaattttccctgtaaat

SEQ ID NO: 122934 - DNA, 22 bp, Artificial Sequence
  chemically synthesized
aatttaattttccctgtaaatt

SEQ ID NO: 122935 - DNA, 22 bp, Artificial Sequence
  chemically synthesized
aattttccctgtaaattgctct

SEQ ID NO: 122936 - DNA, 22 bp, Artificial Sequence
  chemically synthesized
attttccctgtaaattgctctg

SEQ ID NO: 122937 - DNA, 22 bp, Artificial Sequence
  chemically synthesized
tccctgtaaattgctctgacct

SEQ ID NO: 122938 - DNA, 22 bp, Artificial Sequence
  chemically synthesized
ccctgtaaattgctctgacctg

SEQ ID NO: 122939 - DNA, 22 bp, Artificial Sequence
  chemically synthesized
cctgtaaattgctctgacctga

SEQ ID NO: 122940 - DNA, 22 bp, Artificial Sequence
  chemically synthesized
taaattgctctgacctgacaac

SEQ ID NO: 122941 - DNA, 22 bp, Artificial Sequence
  chemically synthesized
ctctgacctgacaacccagcta

SEQ ID NO: 122942 - DNA, 22 bp, Artificial Sequence
  chemically synthesized
tgacctgacaacccagctattt

SEQ ID NO: 122943 - DNA, 22 bp, Artificial Sequence
  chemically synthesized
acctgacaacccagctatttta

SEQ ID NO: 122944 - DNA, 22 bp, Artificial Sequence
  chemically synthesized
acaacccagctattttagttta

SEQ ID NO: 122945 - DNA, 22 bp, Artificial Sequence
  chemically synthesized
ttttagtttagtctttgcagat

SEQ ID NO: 122946 - DNA, 22 bp, Artificial Sequence
  chemically synthesized
tagtttagtctttgcagatgat

SEQ ID NO: 122947 - DNA, 22 bp, Artificial Sequence
  chemically synthesized
agtttagtctttgcagatgata

SEQ ID NO: 122948 - DNA, 22 bp, Artificial Sequence
  chemically synthesized
gtttagtctttgcagatgatat

SEQ ID NO: 122949 - DNA, 22 bp, Artificial Sequence
  chemically synthesized
agtctttgcagatgatatacat

SEQ ID NO: 122950 - DNA, 22 bp, Artificial Sequence
  chemically synthesized
gtctttgcagatgatatacata

SEQ ID NO: 122951 - DNA, 22 bp, Artificial Sequence
  chemically synthesized
tgcagatgatatacataaaatg

SEQ ID NO: 122952 - DNA, 22 bp, Artificial Sequence
  chemically synthesized
gcagatgatatacataaaatgc

SEQ ID NO: 122953 - DNA, 22 bp, Artificial Sequence
  chemically synthesized
cagatgatatacataaaatgcc

SEQ ID NO: 122954 - DNA, 22 bp, Artificial Sequence
  chemically synthesized
tctcactttgctgtagcatttc

SEQ ID NO: 122955 - DNA, 22 bp, Artificial Sequence
  chemically synthesized
actttgctgtagcatttccaat

SEQ ID NO: 122956 - DNA, 22 bp, Artificial Sequence
  chemically synthesized
tgctgtagcatttccaatcctg

SEQ ID NO: 122957 - DNA, 22 bp, Artificial Sequence
  chemically synthesized
gctgtagcatttccaatcctgg

SEQ ID NO: 122958 - DNA, 22 bp, Artificial Sequence
  chemically synthesized
ctgtagcatttccaatcctgga

SEQ ID NO: 122959 - DNA, 22 bp, Artificial Sequence
  chemically synthesized
tagcatttccaatcctggacag

SEQ ID NO: 122960 - DNA, 22 bp, Artificial Sequence
  chemically synthesized
ccaatcctggacagtcagcata

SEQ ID NO: 122961 - DNA, 22 bp, Artificial Sequence
  chemically synthesized
caatcctggacagtcagcataa

SEQ ID NO: 122962 - DNA, 22 bp, Artificial Sequence
  chemically synthesized
gacagtcagcataaaagatact

SEQ ID NO: 122963 - DNA, 22 bp, Artificial Sequence
  chemically synthesized
tcgtcacttatttaatatttca

SEQ ID NO: 122964 - DNA, 22 bp, Artificial Sequence
  chemically synthesized
atttaatatttcatagcattaa

SEQ ID NO: 122965 - DNA, 22 bp, Artificial Sequence
  chemically synthesized
tttaatatttcatagcattaaa

SEQ ID NO: 122966 - DNA, 22 bp, Artificial Sequence
  chemically synthesized
aatatttcatagcattaaacat

SEQ ID NO: 122967 - DNA, 22 bp, Artificial Sequence
  chemically synthesized
atatttcatagcattaaacatt

SEQ ID NO: 122968 - DNA, 22 bp, Artificial Sequence
  chemically synthesized
catagcattaaacattcaaacc

SEQ ID NO: 122969 - DNA, 22 bp, Artificial Sequence
  chemically synthesized
atagcattaaacattcaaacct

SEQ ID NO: 122970 - DNA, 22 bp, Artificial Sequence
  chemically synthesized
aacattcaaaccttcaacttta

SEQ ID NO: 122971 - DNA, 22 bp, Artificial Sequence
  chemically synthesized
aaaccttcaactttaggattta

SEQ ID NO: 122972 - DNA, 22 bp, Artificial Sequence
  chemically synthesized
caactttaggatttactataaa

SEQ ID NO: 122973 - DNA, 22 bp, Artificial Sequence
  chemically synthesized
aactttaggatttactataaaa

SEQ ID NO: 122974 - DNA, 22 bp, Artificial Sequence
  chemically synthesized
taggatttactataaaagactg

SEQ ID NO: 122975 - DNA, 22 bp, Artificial Sequence
  chemically synthesized
aggatttactataaaagactgt

SEQ ID NO: 122976 - DNA, 22 bp, Artificial Sequence
  chemically synthesized
ggatttactataaaagactgtg

SEQ ID NO: 122977 - DNA, 22 bp, Artificial Sequence
  chemically synthesized
actataaaagactgtgactgtt

SEQ ID NO: 122978 - DNA, 22 bp, Artificial Sequence
  chemically synthesized
ctataaaagactgtgactgtta

SEQ ID NO: 122979 - DNA, 22 bp, Artificial Sequence
  chemically synthesized
taaaagactgtgactgttaatg

SEQ ID NO: 122980 - DNA, 22 bp, Artificial Sequence
  chemically synthesized
tgactgttaatgataataataa

SEQ ID NO: 122981 - DNA, 22 bp, Artificial Sequence
  chemically synthesized
ttaatgataataataaatacat

SEQ ID NO: 122982 - DNA, 22 bp, Artificial Sequence
  chemically synthesized
atgataataataaatacattga

SEQ ID NO: 122983 - DNA, 22 bp, Artificial Sequence
  chemically synthesized
atgattatgagcattattttta

SEQ ID NO: 122984 - DNA, 22 bp, Artificial Sequence
  chemically synthesized
tgagcattatttttaaattaca

SEQ ID NO: 122985 - DNA, 22 bp, Artificial Sequence
  chemically synthesized
tttttaaattacaacttggtag

SEQ ID NO: 122986 - DNA, 22 bp, Artificial Sequence
  chemically synthesized
ttaaattacaacttggtagcct

SEQ ID NO: 122987 - DNA, 22 bp, Artificial Sequence
  chemically synthesized
taaattacaacttggtagcctc

SEQ ID NO: 122988 - DNA, 22 bp, Artificial Sequence
  chemically synthesized
aaattacaacttggtagcctct

SEQ ID NO: 122989 - DNA, 22 bp, Artificial Sequence
  chemically synthesized
aattacaacttggtagcctcta

SEQ ID NO: 122990 - DNA, 22 bp, Artificial Sequence
  chemically synthesized
caacttggtagcctctagcatt

SEQ ID NO: 122991 - DNA, 22 bp, Artificial Sequence
  chemically synthesized
ggtagcctctagcatttatata

SEQ ID NO: 122992 - DNA, 22 bp, Artificial Sequence
  chemically synthesized
gtagcctctagcatttatatac

SEQ ID NO: 122993 - DNA, 22 bp, Artificial Sequence
  chemically synthesized
tagcatttatatacctgtattt

SEQ ID NO: 122994 - DNA, 22 bp, Artificial Sequence
  chemically synthesized
gcatttatatacctgtattttc

SEQ ID NO: 122995 - DNA, 22 bp, Artificial Sequence
  chemically synthesized
atatacctgtattttctatatg

SEQ ID NO: 122996 - DNA, 22 bp, Artificial Sequence
  chemically synthesized
tatacctgtattttctatatgc

SEQ ID NO: 122997 - DNA, 22 bp, Artificial Sequence
  chemically synthesized
tattttctatatgcatttctat

SEQ ID NO: 122998 - DNA, 22 bp, Artificial Sequence
  chemically synthesized
tctatatgcatttctatagaag

SEQ ID NO: 122999 - DNA, 22 bp, Artificial Sequence
  chemically synthesized
ctatatgcatttctatagaagc

SEQ ID NO: 123000 - DNA, 22 bp, Artificial Sequence
  chemically synthesized
tatatgcatttctatagaagca

SEQ ID NO: 123001 - DNA, 22 bp, Artificial Sequence
  chemically synthesized
tatgcatttctatagaagcagc

SEQ ID NO: 123002 - DNA, 22 bp, Artificial Sequence
  chemically synthesized
ctatagaagcagcttgcacatg

SEQ ID NO: 123003 - DNA, 22 bp, Artificial Sequence
  chemically synthesized
tatagaagcagcttgcacatgc

SEQ ID NO: 123004 - DNA, 22 bp, Artificial Sequence
  chemically synthesized
tagaagcagcttgcacatgctg

SEQ ID NO: 123005 - DNA, 22 bp, Artificial Sequence
  chemically synthesized
gcacatgctgtacaaaccataa

SEQ ID NO: 123006 - DNA, 22 bp, Artificial Sequence
  chemically synthesized
cacatgctgtacaaaccataag

SEQ ID NO: 123007 - DNA, 22 bp, Artificial Sequence
  chemically synthesized
tacaaaccataagatggcagga

SEQ ID NO: 123008 - DNA, 22 bp, Artificial Sequence
  chemically synthesized
gtggaacactgactctcctggg

SEQ ID NO: 123009 - DNA, 22 bp, Artificial Sequence
  chemically synthesized
tggaacactgactctcctgggg

SEQ ID NO: 123010 - DNA, 22 bp, Artificial Sequence
  chemically synthesized
actctcctggggccatgcagag

SEQ ID NO: 123011 - DNA, 22 bp, Artificial Sequence
  chemically synthesized
tcctggggccatgcagagggag

SEQ ID NO: 123012 - DNA, 22 bp, Artificial Sequence
  chemically synthesized
ctggggccatgcagagggaggt

SEQ ID NO: 123013 - DNA, 22 bp, Artificial Sequence
  chemically synthesized
gggccatgcagagggaggtttg

SEQ ID NO: 123014 - DNA, 22 bp, Artificial Sequence
  chemically synthesized
gaagatcttgttgatacagatt

SEQ ID NO: 123015 - DNA, 22 bp, Artificial Sequence
  chemically synthesized
aagatcttgttgatacagattg

SEQ ID NO: 123016 - DNA, 22 bp, Artificial Sequence
  chemically synthesized
gttgatacagattgacacagaa

SEQ ID NO: 123017 - DNA, 22 bp, Artificial Sequence
  chemically synthesized
ttgatacagattgacacagaat

SEQ ID NO: 123018 - DNA, 22 bp, Artificial Sequence
  chemically synthesized
atacagattgacacagaatacc

SEQ ID NO: 123019 - DNA, 22 bp, Artificial Sequence
  chemically synthesized
acacagaataccaaagcctctt

SEQ ID NO: 123020 - DNA, 22 bp, Artificial Sequence
  chemically synthesized
tttccccactgcctttccttga

SEQ ID NO: 123021 - DNA, 22 bp, Artificial Sequence
  chemically synthesized
tccccactgcctttccttgagt

SEQ ID NO: 123022 - DNA, 22 bp, Artificial Sequence
  chemically synthesized
ccccactgcctttccttgagta

SEQ ID NO: 123023 - DNA, 22 bp, Artificial Sequence
  chemically synthesized
cccactgcctttccttgagtaa

SEQ ID NO: 123024 - DNA, 22 bp, Artificial Sequence
  chemically synthesized
cctttccttgagtaaaaatcct

SEQ ID NO: 123025 - DNA, 22 bp, Artificial Sequence
  chemically synthesized
tccttgagtaaaaatcctgaga

SEQ ID NO: 123026 - DNA, 22 bp, Artificial Sequence
  chemically synthesized
ccttgagtaaaaatcctgagaa

SEQ ID NO: 123027 - DNA, 22 bp, Artificial Sequence
  chemically synthesized
cttgagtaaaaatcctgagaaa

SEQ ID NO: 123028 - DNA, 22 bp, Artificial Sequence
  chemically synthesized
gagtaaaaatcctgagaaaatg

SEQ ID NO: 123029 - DNA, 22 bp, Artificial Sequence
  chemically synthesized
agtaaaaatcctgagaaaatgt

SEQ ID NO: 123030 - DNA, 22 bp, Artificial Sequence
  chemically synthesized
agaaaatgtcttccctttcttt

SEQ ID NO: 123031 - DNA, 22 bp, Artificial Sequence
  chemically synthesized
ccctttctttctatgttgatag

SEQ ID NO: 123032 - DNA, 22 bp, Artificial Sequence
  chemically synthesized
cctttctttctatgttgatagc

SEQ ID NO: 123033 - DNA, 22 bp, Artificial Sequence
  chemically synthesized
tctttctatgttgatagcaaaa

SEQ ID NO: 123034 - DNA, 22 bp, Artificial Sequence
  chemically synthesized
ctttctatgttgatagcaaaac

SEQ ID NO: 123035 - DNA, 22 bp, Artificial Sequence
  chemically synthesized
tttctatgttgatagcaaaacc

SEQ ID NO: 123036 - DNA, 22 bp, Artificial Sequence
  chemically synthesized
tctatgttgatagcaaaaccaa

SEQ ID NO: 123037 - DNA, 22 bp, Artificial Sequence
  chemically synthesized
ctatgttgatagcaaaaccaat

SEQ ID NO: 123038 - DNA, 22 bp, Artificial Sequence
  chemically synthesized
tatgttgatagcaaaaccaatg

SEQ ID NO: 123039 - DNA, 22 bp, Artificial Sequence
  chemically synthesized
tgttgatagcaaaaccaatgag

SEQ ID NO: 123040 - DNA, 22 bp, Artificial Sequence
  chemically synthesized
atagcaaaaccaatgaggtcat

SEQ ID NO: 123041 - DNA, 22 bp, Artificial Sequence
  chemically synthesized
ttaacaactgttgacttatttt

SEQ ID NO: 123042 - DNA, 22 bp, Artificial Sequence
  chemically synthesized
taacaactgttgacttattttg

SEQ ID NO: 123043 - DNA, 22 bp, Artificial Sequence
  chemically synthesized
aacaactgttgacttattttgg

SEQ ID NO: 123044 - DNA, 22 bp, Artificial Sequence
  chemically synthesized
acaactgttgacttattttgga

SEQ ID NO: 123045 - DNA, 22 bp, Artificial Sequence
  chemically synthesized
ttgacttattttggattttagt

SEQ ID NO: 123046 - DNA, 22 bp, Artificial Sequence
  chemically synthesized
acttattttggattttagtcta

SEQ ID NO: 123047 - DNA, 22 bp, Artificial Sequence
  chemically synthesized
attttggattttagtctacatt

SEQ ID NO: 123048 - DNA, 22 bp, Artificial Sequence
  chemically synthesized
ttttggattttagtctacattc

SEQ ID NO: 123049 - DNA, 22 bp, Artificial Sequence
  chemically synthesized
tggattttagtctacattcact

SEQ ID NO: 123050 - DNA, 22 bp, Artificial Sequence
  chemically synthesized
ggattttagtctacattcactg

SEQ ID NO: 123051 - DNA, 22 bp, Artificial Sequence
  chemically synthesized
gattttagtctacattcactgt

SEQ ID NO: 123052 - DNA, 22 bp, Artificial Sequence
  chemically synthesized
tagtctacattcactgtaacac

SEQ ID NO: 123053 - DNA, 22 bp, Artificial Sequence
  chemically synthesized
agtctacattcactgtaacaca

SEQ ID NO: 123054 - DNA, 22 bp, Artificial Sequence
  chemically synthesized
gtctacattcactgtaacacaa

SEQ ID NO: 123055 - DNA, 22 bp, Artificial Sequence
  chemically synthesized
cattcactgtaacacaaaaatg

SEQ ID NO: 123056 - DNA, 22 bp, Artificial Sequence
  chemically synthesized
actgtaacacaaaaatgcagac

SEQ ID NO: 123057 - DNA, 22 bp, Artificial Sequence
  chemically synthesized
taacacaaaaatgcagacaagc

SEQ ID NO: 123058 - DNA, 22 bp, Artificial Sequence
  chemically synthesized
attttagtgtggcatcatggaa

SEQ ID NO: 123059 - DNA, 22 bp, Artificial Sequence
  chemically synthesized
tagtgtggcatcatggaaataa

SEQ ID NO: 123060 - DNA, 22 bp, Artificial Sequence
  chemically synthesized
agtgtggcatcatggaaataac

SEQ ID NO: 123061 - DNA, 22 bp, Artificial Sequence
  chemically synthesized
gtgtggcatcatggaaataaca

SEQ ID NO: 123062 - DNA, 22 bp, Artificial Sequence
  chemically synthesized
cacatagcccttgctaccagcc

SEQ ID NO: 123063 - DNA, 22 bp, Artificial Sequence
  chemically synthesized
gctaccagccaataggactatt

SEQ ID NO: 123064 - DNA, 22 bp, Artificial Sequence
  chemically synthesized
ctaccagccaataggactattt

SEQ ID NO: 123065 - DNA, 22 bp, Artificial Sequence
  chemically synthesized
ccagccaataggactatttatt

SEQ ID NO: 123066 - DNA, 22 bp, Artificial Sequence
  chemically synthesized
tttatttgagtatgttcatata

SEQ ID NO: 123067 - DNA, 22 bp, Artificial Sequence
  chemically synthesized
atttgagtatgttcatatatgt

SEQ ID NO: 123068 - DNA, 22 bp, Artificial Sequence
  chemically synthesized
tttgagtatgttcatatatgta

SEQ ID NO: 123069 - DNA, 22 bp, Artificial Sequence
  chemically synthesized
gagtatgttcatatatgtatat

SEQ ID NO: 123070 - DNA, 22 bp, Artificial Sequence
  chemically synthesized
agtatgttcatatatgtatata

SEQ ID NO: 123071 - DNA, 22 bp, Artificial Sequence
  chemically synthesized
atatatgtatatataaatgtgt

SEQ ID NO: 123072 - DNA, 22 bp, Artificial Sequence
  chemically synthesized
cagagaaatgtatggcagatta

SEQ ID NO: 123073 - DNA, 22 bp, Artificial Sequence
  chemically synthesized
taaagggaaattatctccaggg

SEQ ID NO: 123074 - DNA, 22 bp, Artificial Sequence
  chemically synthesized
tctccagggaggatagaaaggt

SEQ ID NO: 123075 - DNA, 22 bp, Artificial Sequence
  chemically synthesized
cagggaggatagaaaggtaagg

SEQ ID NO: 123076 - DNA, 22 bp, Artificial Sequence
  chemically synthesized
tactttatatttaatatacatg

SEQ ID NO: 123077 - DNA, 22 bp, Artificial Sequence
  chemically synthesized
actttatatttaatatacatgg

SEQ ID NO: 123078 - DNA, 22 bp, Artificial Sequence
  chemically synthesized
ctttatatttaatatacatgga

SEQ ID NO: 123079 - DNA, 22 bp, Artificial Sequence
  chemically synthesized
tatatttaatatacatggagta

SEQ ID NO: 123080 - DNA, 22 bp, Artificial Sequence
  chemically synthesized
atatttaatatacatggagtat

SEQ ID NO: 123081 - DNA, 22 bp, Artificial Sequence
  chemically synthesized
tatttaatatacatggagtata

SEQ ID NO: 123082 - DNA, 22 bp, Artificial Sequence
  chemically synthesized
aatatacatggagtatatataa

SEQ ID NO: 123083 - DNA, 22 bp, Artificial Sequence
  chemically synthesized
atatacatggagtatatataat

SEQ ID NO: 123084 - DNA, 22 bp, Artificial Sequence
  chemically synthesized
tttaaattatatcatagacata

SEQ ID NO: 123085 - DNA, 22 bp, Artificial Sequence
  chemically synthesized
ttaaattatatcatagacatat

SEQ ID NO: 123086 - DNA, 22 bp, Artificial Sequence
  chemically synthesized
taaattatatcatagacatatt

SEQ ID NO: 123087 - DNA, 22 bp, Artificial Sequence
  chemically synthesized
aaattatatcatagacatattt

SEQ ID NO: 123088 - DNA, 22 bp, Artificial Sequence
  chemically synthesized
aattatatcatagacatattta

SEQ ID NO: 123089 - DNA, 22 bp, Artificial Sequence
  chemically synthesized
tatcatagacatatttaggata

SEQ ID NO: 123090 - DNA, 22 bp, Artificial Sequence
  chemically synthesized
aggatagtgaatggaaaatttt

SEQ ID NO: 123091 - DNA, 22 bp, Artificial Sequence
  chemically synthesized
ggatagtgaatggaaaatttta

SEQ ID NO: 123092 - DNA, 22 bp, Artificial Sequence
  chemically synthesized
taaaaatacaactacttactag

SEQ ID NO: 123093 - DNA, 22 bp, Artificial Sequence
  chemically synthesized
aaaaatacaactacttactagt

SEQ ID NO: 123094 - DNA, 22 bp, Artificial Sequence
  chemically synthesized
aaaatacaactacttactagtt

SEQ ID NO: 123095 - DNA, 22 bp, Artificial Sequence
  chemically synthesized
cttactagttgtatactttttt

SEQ ID NO: 123096 - DNA, 22 bp, Artificial Sequence
  chemically synthesized
actagttgtatacttttttaaa

SEQ ID NO: 123097 - DNA, 22 bp, Artificial Sequence
  chemically synthesized
ctagttgtatacttttttaaat

SEQ ID NO: 123098 - DNA, 22 bp, Artificial Sequence
  chemically synthesized
gttgtatacttttttaaatgtc

SEQ ID NO: 123099 - DNA, 22 bp, Artificial Sequence
  chemically synthesized
tatacttttttaaatgtctcaa

SEQ ID NO: 123100 - DNA, 22 bp, Artificial Sequence
  chemically synthesized
ttttaaatgtctcaaattatca

SEQ ID NO: 123101 - DNA, 22 bp, Artificial Sequence
  chemically synthesized
tttaaatgtctcaaattatcag

SEQ ID NO: 123102 - DNA, 22 bp, Artificial Sequence
  chemically synthesized
ttaaatgtctcaaattatcaga

SEQ ID NO: 123103 - DNA, 22 bp, Artificial Sequence
  chemically synthesized
taaatgtctcaaattatcagat

SEQ ID NO: 123104 - DNA, 22 bp, Artificial Sequence
  chemically synthesized
aaatgtctcaaattatcagatt

SEQ ID NO: 123105 - DNA, 22 bp, Artificial Sequence
  chemically synthesized
aatgtctcaaattatcagattt

SEQ ID NO: 123106 - DNA, 22 bp, Artificial Sequence
  chemically synthesized
aaattatcagattttatttttt

SEQ ID NO: 123107 - DNA, 22 bp, Artificial Sequence
  chemically synthesized
tcagattttattttttatccag

SEQ ID NO: 123108 - DNA, 22 bp, Artificial Sequence
  chemically synthesized
tattttttatccagaaaaaata

SEQ ID NO: 123109 - DNA, 22 bp, Artificial Sequence
  chemically synthesized
attttttatccagaaaaaatat

SEQ ID NO: 123110 - DNA, 22 bp, Artificial Sequence
  chemically synthesized
ttttttatccagaaaaaatata

SEQ ID NO: 123111 - DNA, 22 bp, Artificial Sequence
  chemically synthesized
tttatccagaaaaaatatataa

SEQ ID NO: 123112 - DNA, 22 bp, Artificial Sequence
  chemically synthesized
ttatccagaaaaaatatataaa

SEQ ID NO: 123113 - DNA, 22 bp, Artificial Sequence
  chemically synthesized
tatccagaaaaaatatataaaa

SEQ ID NO: 123114 - DNA, 22 bp, Artificial Sequence
  chemically synthesized
atccagaaaaaatatataaaaa

SEQ ID NO: 123115 - DNA, 22 bp, Artificial Sequence
  chemically synthesized
tccagaaaaaatatataaaaag

SEQ ID NO: 123116 - DNA, 22 bp, Artificial Sequence
  chemically synthesized
tttcatagagttttactgaggt

SEQ ID NO: 123117 - DNA, 22 bp, Artificial Sequence
  chemically synthesized
catagagttttactgaggtata

SEQ ID NO: 123118 - DNA, 22 bp, Artificial Sequence
  chemically synthesized
atagagttttactgaggtataa

SEQ ID NO: 123119 - DNA, 22 bp, Artificial Sequence
  chemically synthesized
tactgaggtataatagatgtaa

SEQ ID NO: 123120 - DNA, 22 bp, Artificial Sequence
  chemically synthesized
actgaggtataatagatgtaat

SEQ ID NO: 123121 - DNA, 22 bp, Artificial Sequence
  chemically synthesized
ctgaggtataatagatgtaatt

SEQ ID NO: 123122 - DNA, 22 bp, Artificial Sequence
  chemically synthesized
aggtataatagatgtaattctc

SEQ ID NO: 123123 - DNA, 22 bp, Artificial Sequence
  chemically synthesized
tcctaaaagtgttatattttgc

SEQ ID NO: 123124 - DNA, 22 bp, Artificial Sequence
  chemically synthesized
ctaaaagtgttatattttgcaa

SEQ ID NO: 123125 - DNA, 22 bp, Artificial Sequence
  chemically synthesized
aaagtgttatattttgcaaata

SEQ ID NO: 123126 - DNA, 22 bp, Artificial Sequence
  chemically synthesized
tattttgcaaatagtggctgct

SEQ ID NO: 123127 - DNA, 22 bp, Artificial Sequence
  chemically synthesized
tgcaaatagtggctgctaaaat

SEQ ID NO: 123128 - DNA, 22 bp, Artificial Sequence
  chemically synthesized
gcaaatagtggctgctaaaata

SEQ ID NO: 123129 - DNA, 22 bp, Artificial Sequence
  chemically synthesized
caaatagtggctgctaaaatat

SEQ ID NO: 123130 - DNA, 22 bp, Artificial Sequence
  chemically synthesized
ctaaaatattattgttaatagt

SEQ ID NO: 123131 - DNA, 22 bp, Artificial Sequence
  chemically synthesized
aaatattattgttaatagtatt

SEQ ID NO: 123132 - DNA, 22 bp, Artificial Sequence
  chemically synthesized
ttgttaatagtattccactaac

SEQ ID NO: 123133 - DNA, 22 bp, Artificial Sequence
  chemically synthesized
ttaatagtattccactaactag

SEQ ID NO: 123134 - DNA, 22 bp, Artificial Sequence
  chemically synthesized
atagtattccactaactagtaa

SEQ ID NO: 123135 - DNA, 22 bp, Artificial Sequence
  chemically synthesized
cactaactagtaataataactt

SEQ ID NO: 123136 - DNA, 22 bp, Artificial Sequence
  chemically synthesized
actagtaataataactttaatt

SEQ ID NO: 123137 - DNA, 22 bp, Artificial Sequence
  chemically synthesized
gtaataataactttaattaata

SEQ ID NO: 123138 - DNA, 22 bp, Artificial Sequence
  chemically synthesized
taattaatatttgttaagccgt

SEQ ID NO: 123139 - DNA, 22 bp, Artificial Sequence
  chemically synthesized
aattaatatttgttaagccgtg

SEQ ID NO: 123140 - DNA, 22 bp, Artificial Sequence
  chemically synthesized
attaatatttgttaagccgtga

SEQ ID NO: 123141 - DNA, 22 bp, Artificial Sequence
  chemically synthesized
atatttgttaagccgtgacttt

SEQ ID NO: 123142 - DNA, 22 bp, Artificial Sequence
  chemically synthesized
gttaagccgtgactttgtttct

SEQ ID NO: 123143 - DNA, 22 bp, Artificial Sequence
  chemically synthesized
ttaagccgtgactttgtttcta

SEQ ID NO: 123144 - DNA, 22 bp, Artificial Sequence
  chemically synthesized
agccgtgactttgtttctacta

SEQ ID NO: 123145 - DNA, 22 bp, Artificial Sequence
  chemically synthesized
tgtttctactaccccacacaca

SEQ ID NO: 123146 - DNA, 22 bp, Artificial Sequence
  chemically synthesized
gtttctactaccccacacacat

SEQ ID NO: 123147 - DNA, 22 bp, Artificial Sequence
  chemically synthesized
tttctactaccccacacacatg

SEQ ID NO: 123148 - DNA, 22 bp, Artificial Sequence
  chemically synthesized
ctactaccccacacacatgggc

SEQ ID NO: 123149 - DNA, 22 bp, Artificial Sequence
  chemically synthesized
tactaccccacacacatgggca

SEQ ID NO: 123150 - DNA, 22 bp, Artificial Sequence
  chemically synthesized
ctaccccacacacatgggcata

SEQ ID NO: 123151 - DNA, 22 bp, Artificial Sequence
  chemically synthesized
ccccacacacatgggcatacat

SEQ ID NO: 123152 - DNA, 22 bp, Artificial Sequence
  chemically synthesized
cttctatcatgttggcctcatt

SEQ ID NO: 123153 - DNA, 22 bp, Artificial Sequence
  chemically synthesized
ttctatcatgttggcctcattc

SEQ ID NO: 123154 - DNA, 22 bp, Artificial Sequence
  chemically synthesized
ctatcatgttggcctcattcag

SEQ ID NO: 123155 - DNA, 22 bp, Artificial Sequence
  chemically synthesized
tatcatgttggcctcattcagt

SEQ ID NO: 123156 - DNA, 22 bp, Artificial Sequence
  chemically synthesized
tcatgttggcctcattcagtac

SEQ ID NO: 123157 - DNA, 22 bp, Artificial Sequence
  chemically synthesized
gcctcattcagtacagtactag

SEQ ID NO: 123158 - DNA, 22 bp, Artificial Sequence
  chemically synthesized
attcagtacagtactagaaaat

SEQ ID NO: 123159 - DNA, 22 bp, Artificial Sequence
  chemically synthesized
agtacagtactagaaaatcagt

SEQ ID NO: 123160 - DNA, 22 bp, Artificial Sequence
  chemically synthesized
gaaaatcagtagggactcaggt

SEQ ID NO: 123161 - DNA, 22 bp, Artificial Sequence
  chemically synthesized
aggttatatgtgtgaatggatg

SEQ ID NO: 123162 - DNA, 22 bp, Artificial Sequence
  chemically synthesized
tatgtgtgaatggatgaataaa

SEQ ID NO: 123163 - DNA, 22 bp, Artificial Sequence
  chemically synthesized
tttttaaagacttcatcctttc

SEQ ID NO: 123164 - DNA, 22 bp, Artificial Sequence
  chemically synthesized
ttaaagacttcatcctttctgt

SEQ ID NO: 123165 - DNA, 22 bp, Artificial Sequence
  chemically synthesized
taaagacttcatcctttctgta

SEQ ID NO: 123166 - DNA, 22 bp, Artificial Sequence
  chemically synthesized
aaagacttcatcctttctgtat

SEQ ID NO: 123167 - DNA, 22 bp, Artificial Sequence
  chemically synthesized
aagacttcatcctttctgtatg

SEQ ID NO: 123168 - DNA, 22 bp, Artificial Sequence
  chemically synthesized
catcctttctgtatgtctaacc

SEQ ID NO: 123169 - DNA, 22 bp, Artificial Sequence
  chemically synthesized
atcctttctgtatgtctaacct

SEQ ID NO: 123170 - DNA, 22 bp, Artificial Sequence
  chemically synthesized
tctgtatgtctaaccttagatt

SEQ ID NO: 123171 - DNA, 22 bp, Artificial Sequence
  chemically synthesized
ctgtatgtctaaccttagattc

SEQ ID NO: 123172 - DNA, 22 bp, Artificial Sequence
  chemically synthesized
tgtatgtctaaccttagattct

SEQ ID NO: 123173 - DNA, 22 bp, Artificial Sequence
  chemically synthesized
tatgtctaaccttagattctag

SEQ ID NO: 123174 - DNA, 22 bp, Artificial Sequence
  chemically synthesized
accttagattctagtcatggcc

SEQ ID NO: 123175 - DNA, 22 bp, Artificial Sequence
  chemically synthesized
agattctagtcatggccatatg

SEQ ID NO: 123176 - DNA, 22 bp, Artificial Sequence
  chemically synthesized
gattctagtcatggccatatgt

SEQ ID NO: 123177 - DNA, 22 bp, Artificial Sequence
  chemically synthesized
tagtcatggccatatgtctcta

SEQ ID NO: 123178 - DNA, 22 bp, Artificial Sequence
  chemically synthesized
gtcatggccatatgtctctagg

SEQ ID NO: 123179 - DNA, 22 bp, Artificial Sequence
  chemically synthesized
taggtggcccaaccaccctatc

SEQ ID NO: 123180 - DNA, 22 bp, Artificial Sequence
  chemically synthesized
ggtggcccaaccaccctatcac

SEQ ID NO: 123181 - DNA, 22 bp, Artificial Sequence
  chemically synthesized
tcacagattctgcttcaaaggc

SEQ ID NO: 123182 - DNA, 22 bp, Artificial Sequence
  chemically synthesized
tgcttcaaaggcactcatcttg

SEQ ID NO: 123183 - DNA, 22 bp, Artificial Sequence
  chemically synthesized
cttcaaaggcactcatcttggt

SEQ ID NO: 123184 - DNA, 22 bp, Artificial Sequence
  chemically synthesized
caaaggcactcatcttggtgaa

SEQ ID NO: 123185 - DNA, 22 bp, Artificial Sequence
  chemically synthesized
aaaggcactcatcttggtgaat

SEQ ID NO: 123186 - DNA, 22 bp, Artificial Sequence
  chemically synthesized
atcttggtgaatgaatatctag

SEQ ID NO: 123187 - DNA, 22 bp, Artificial Sequence
  chemically synthesized
ggtgaatgaatatctagtccca

SEQ ID NO: 123188 - DNA, 22 bp, Artificial Sequence
  chemically synthesized
gtgaatgaatatctagtcccag

SEQ ID NO: 123189 - DNA, 22 bp, Artificial Sequence
  chemically synthesized
gtcccagaaggaggctaaaaac

SEQ ID NO: 123190 - DNA, 22 bp, Artificial Sequence
  chemically synthesized
aaaactatcttgtccacatcta

SEQ ID NO: 123191 - DNA, 22 bp, Artificial Sequence
  chemically synthesized
tcttgtccacatctagttggct

SEQ ID NO: 123192 - DNA, 22 bp, Artificial Sequence
  chemically synthesized
gtccacatctagttggctgaca

SEQ ID NO: 123193 - DNA, 22 bp, Artificial Sequence
  chemically synthesized
tccacatctagttggctgacac

SEQ ID NO: 123194 - DNA, 22 bp, Artificial Sequence
  chemically synthesized
gttggctgacacacaatttagg

SEQ ID NO: 123195 - DNA, 22 bp, Artificial Sequence
  chemically synthesized
gctgacacacaatttaggcttc

SEQ ID NO: 123196 - DNA, 22 bp, Artificial Sequence
  chemically synthesized
acacacaatttaggcttcttgg

SEQ ID NO: 123197 - DNA, 22 bp, Artificial Sequence
  chemically synthesized
aggcttcttgggtgtaatcaga

SEQ ID NO: 123198 - DNA, 22 bp, Artificial Sequence
  chemically synthesized
ggcttcttgggtgtaatcagat

SEQ ID NO: 123199 - DNA, 22 bp, Artificial Sequence
  chemically synthesized
cttgggtgtaatcagatctgta

SEQ ID NO: 123200 - DNA, 22 bp, Artificial Sequence
  chemically synthesized
ttgggtgtaatcagatctgtaa

SEQ ID NO: 123201 - DNA, 22 bp, Artificial Sequence
  chemically synthesized
gggtgtaatcagatctgtaagc

SEQ ID NO: 123202 - DNA, 22 bp, Artificial Sequence
  chemically synthesized
ggtgtaatcagatctgtaagca

SEQ ID NO: 123203 - DNA, 22 bp, Artificial Sequence
  chemically synthesized
taagcatgatccggaaagaaaa

SEQ ID NO: 123204 - DNA, 22 bp, Artificial Sequence
  chemically synthesized
ctgaacagaggcttccaacatc

SEQ ID NO: 123205 - DNA, 22 bp, Artificial Sequence
  chemically synthesized
aacagaggcttccaacatcctc

SEQ ID NO: 123206 - DNA, 22 bp, Artificial Sequence
  chemically synthesized
ccaacatcctcagaaggaaacc

SEQ ID NO: 123207 - DNA, 22 bp, Artificial Sequence
  chemically synthesized
caacatcctcagaaggaaacct

SEQ ID NO: 123208 - DNA, 22 bp, Artificial Sequence
  chemically synthesized
agaaggaaacctctcttaatcc

SEQ ID NO: 123209 - DNA, 22 bp, Artificial Sequence
  chemically synthesized
tcttaatccacataagaatggt

SEQ ID NO: 123210 - DNA, 22 bp, Artificial Sequence
  chemically synthesized
ttaatccacataagaatggtgt

SEQ ID NO: 123211 - DNA, 22 bp, Artificial Sequence
  chemically synthesized
aatccacataagaatggtgtaa

SEQ ID NO: 123212 - DNA, 22 bp, Artificial Sequence
  chemically synthesized
atccacataagaatggtgtaaa

SEQ ID NO: 123213 - DNA, 22 bp, Artificial Sequence
  chemically synthesized
caacatcttgctcctaagaaca

SEQ ID NO: 123214 - DNA, 22 bp, Artificial Sequence
  chemically synthesized
gctcctaagaacactttgccct

SEQ ID NO: 123215 - DNA, 22 bp, Artificial Sequence
  chemically synthesized
ctcctaagaacactttgccctg

SEQ ID NO: 123216 - DNA, 22 bp, Artificial Sequence
  chemically synthesized
ctaagaacactttgccctgggg

SEQ ID NO: 123217 - DNA, 22 bp, Artificial Sequence
  chemically synthesized
agaacactttgccctgggggaa

SEQ ID NO: 123218 - DNA, 22 bp, Artificial Sequence
  chemically synthesized
tgccctgggggaaaaaaagaaa

SEQ ID NO: 123219 - DNA, 22 bp, Artificial Sequence
  chemically synthesized
gccctgggggaaaaaaagaaaa

SEQ ID NO: 123220 - DNA, 22 bp, Artificial Sequence
  chemically synthesized
ccctgggggaaaaaaagaaaag

SEQ ID NO: 123221 - DNA, 22 bp, Artificial Sequence
  chemically synthesized
ggggaaaaaaagaaaagccatc

SEQ ID NO: 123222 - DNA, 22 bp, Artificial Sequence
  chemically synthesized
tcagaaggcctatgctgaggtt

SEQ ID NO: 123223 - DNA, 22 bp, Artificial Sequence
  chemically synthesized
cagaaggcctatgctgaggttt

SEQ ID NO: 123224 - DNA, 22 bp, Artificial Sequence
  chemically synthesized
agaaggcctatgctgaggtttt

SEQ ID NO: 123225 - DNA, 22 bp, Artificial Sequence
  chemically synthesized
tgctgaggttttgcttccttca

SEQ ID NO: 123226 - DNA, 22 bp, Artificial Sequence
  chemically synthesized
aggttttgcttccttcagtttt

SEQ ID NO: 123227 - DNA, 22 bp, Artificial Sequence
  chemically synthesized
tgcttccttcagttttaaagca

SEQ ID NO: 123228 - DNA, 22 bp, Artificial Sequence
  chemically synthesized
gcttccttcagttttaaagcat

SEQ ID NO: 123229 - DNA, 22 bp, Artificial Sequence
  chemically synthesized
cttccttcagttttaaagcata

SEQ ID NO: 123230 - DNA, 22 bp, Artificial Sequence
  chemically synthesized
ccttcagttttaaagcataata

SEQ ID NO: 123231 - DNA, 22 bp, Artificial Sequence
  chemically synthesized
cttcagttttaaagcataatat

SEQ ID NO: 123232 - DNA, 22 bp, Artificial Sequence
  chemically synthesized
cagttttaaagcataatatttt

SEQ ID NO: 123233 - DNA, 22 bp, Artificial Sequence
  chemically synthesized
agttttaaagcataatattttg

SEQ ID NO: 123234 - DNA, 22 bp, Artificial Sequence
  chemically synthesized
taaagcataatattttgagtaa

SEQ ID NO: 123235 - DNA, 22 bp, Artificial Sequence
  chemically synthesized
aaagcataatattttgagtaac

SEQ ID NO: 123236 - DNA, 22 bp, Artificial Sequence
  chemically synthesized
aagcataatattttgagtaact

SEQ ID NO: 123237 - DNA, 22 bp, Artificial Sequence
  chemically synthesized
tgagtaactcaatgtttagaaa

SEQ ID NO: 123238 - DNA, 22 bp, Artificial Sequence
  chemically synthesized
gagtaactcaatgtttagaaac

SEQ ID NO: 123239 - DNA, 22 bp, Artificial Sequence
  chemically synthesized
agtaactcaatgtttagaaacc

SEQ ID NO: 123240 - DNA, 22 bp, Artificial Sequence
  chemically synthesized
aatgtttagaaacctcaaattt

SEQ ID NO: 123241 - DNA, 22 bp, Artificial Sequence
  chemically synthesized
agaaacctcaaattttgctctt

SEQ ID NO: 123242 - DNA, 22 bp, Artificial Sequence
  chemically synthesized
gaaacctcaaattttgctcttg

SEQ ID NO: 123243 - DNA, 22 bp, Artificial Sequence
  chemically synthesized
aaattttgctcttgacagataa

SEQ ID NO: 123244 - DNA, 22 bp, Artificial Sequence
  chemically synthesized
tgctcttgacagataaaactga

SEQ ID NO: 123245 - DNA, 22 bp, Artificial Sequence
  chemically synthesized
gctcttgacagataaaactgaa

SEQ ID NO: 123246 - DNA, 22 bp, Artificial Sequence
  chemically synthesized
ctcttgacagataaaactgaaa

SEQ ID NO: 123247 - DNA, 22 bp, Artificial Sequence
  chemically synthesized
ttgacagataaaactgaaacct

SEQ ID NO: 123248 - DNA, 22 bp, Artificial Sequence
  chemically synthesized
gacagataaaactgaaacctct

SEQ ID NO: 123249 - DNA, 22 bp, Artificial Sequence
  chemically synthesized
acagataaaactgaaacctcta

SEQ ID NO: 123250 - DNA, 22 bp, Artificial Sequence
  chemically synthesized
aaacctctactatgctctgctt

SEQ ID NO: 123251 - DNA, 22 bp, Artificial Sequence
  chemically synthesized
tactatgctctgctttctcaca

SEQ ID NO: 123252 - DNA, 22 bp, Artificial Sequence
  chemically synthesized
ctatgctctgctttctcacagg

SEQ ID NO: 123253 - DNA, 22 bp, Artificial Sequence
  chemically synthesized
tgctctgctttctcacaggatg

SEQ ID NO: 123254 - DNA, 22 bp, Artificial Sequence
  chemically synthesized
tgctttctcacaggatgcatgt

SEQ ID NO: 123255 - DNA, 22 bp, Artificial Sequence
  chemically synthesized
ctttctcacaggatgcatgtga

SEQ ID NO: 123256 - DNA, 22 bp, Artificial Sequence
  chemically synthesized
tctcacaggatgcatgtgagaa

SEQ ID NO: 123257 - DNA, 22 bp, Artificial Sequence
  chemically synthesized
ctcacaggatgcatgtgagaat

SEQ ID NO: 123258 - DNA, 22 bp, Artificial Sequence
  chemically synthesized
tcacaggatgcatgtgagaata

SEQ ID NO: 123259 - DNA, 22 bp, Artificial Sequence
  chemically synthesized
acaggatgcatgtgagaataaa

SEQ ID NO: 123260 - DNA, 22 bp, Artificial Sequence
  chemically synthesized
tatgttagaatatcttgtgtaa

SEQ ID NO: 123261 - DNA, 22 bp, Artificial Sequence
  chemically synthesized
atgttagaatatcttgtgtaac

SEQ ID NO: 123262 - DNA, 22 bp, Artificial Sequence
  chemically synthesized
tgttagaatatcttgtgtaact

SEQ ID NO: 123263 - DNA, 22 bp, Artificial Sequence
  chemically synthesized
gaatatcttgtgtaacttcaag

SEQ ID NO: 123264 - DNA, 22 bp, Artificial Sequence
  chemically synthesized
gtgtaacttcaagtattacgat

SEQ ID NO: 123265 - DNA, 22 bp, Artificial Sequence
  chemically synthesized
tgtaacttcaagtattacgatt

SEQ ID NO: 123266 - DNA, 22 bp, Artificial Sequence
  chemically synthesized
caagtattacgattgtgagaga

SEQ ID NO: 123267 - DNA, 22 bp, Artificial Sequence
  chemically synthesized
aagtattacgattgtgagagag

SEQ ID NO: 123268 - DNA, 22 bp, Artificial Sequence
  chemically synthesized
cgattgtgagagagctttttaa

SEQ ID NO: 123269 - DNA, 22 bp, Artificial Sequence
  chemically synthesized
tgagagagctttttaaaggttt

SEQ ID NO: 123270 - DNA, 22 bp, Artificial Sequence
  chemically synthesized
tttaaaggtttttattttcttt

SEQ ID NO: 123271 - DNA, 22 bp, Artificial Sequence
  chemically synthesized
ttaaaggtttttattttctttg

SEQ ID NO: 123272 - DNA, 22 bp, Artificial Sequence
  chemically synthesized
taaaggtttttattttctttgt

SEQ ID NO: 123273 - DNA, 22 bp, Artificial Sequence
  chemically synthesized
aaaggtttttattttctttgtc

SEQ ID NO: 123274 - DNA, 22 bp, Artificial Sequence
  chemically synthesized
aaggtttttattttctttgtca

SEQ ID NO: 123275 - DNA, 22 bp, Artificial Sequence
  chemically synthesized
ttattttctttgtcagagctag

SEQ ID NO: 123276 - DNA, 22 bp, Artificial Sequence
  chemically synthesized
tattttctttgtcagagctaga

SEQ ID NO: 123277 - DNA, 22 bp, Artificial Sequence
  chemically synthesized
attttctttgtcagagctagac

SEQ ID NO: 123278 - DNA, 22 bp, Artificial Sequence
  chemically synthesized
ttttctttgtcagagctagaca

SEQ ID NO: 123279 - DNA, 22 bp, Artificial Sequence
  chemically synthesized
tctttgtcagagctagacagag

SEQ ID NO: 123280 - DNA, 22 bp, Artificial Sequence
  chemically synthesized
ctttgtcagagctagacagagt

SEQ ID NO: 123281 - DNA, 22 bp, Artificial Sequence
  chemically synthesized
tttgtcagagctagacagagta

SEQ ID NO: 123282 - DNA, 22 bp, Artificial Sequence
  chemically synthesized
tgtcagagctagacagagtatc

SEQ ID NO: 123283 - DNA, 22 bp, Artificial Sequence
  chemically synthesized
gtcagagctagacagagtatct

SEQ ID NO: 123284 - DNA, 22 bp, Artificial Sequence
  chemically synthesized
tcagagctagacagagtatctt

SEQ ID NO: 123285 - DNA, 22 bp, Artificial Sequence
  chemically synthesized
gacagagtatcttctcagccca

SEQ ID NO: 123286 - DNA, 22 bp, Artificial Sequence
  chemically synthesized
ctcagcccaaaggtcaaattgt

SEQ ID NO: 123287 - DNA, 22 bp, Artificial Sequence
  chemically synthesized
tcagcccaaaggtcaaattgtc

SEQ ID NO: 123288 - DNA, 22 bp, Artificial Sequence
  chemically synthesized
agcccaaaggtcaaattgtctc

SEQ ID NO: 123289 - DNA, 22 bp, Artificial Sequence
  chemically synthesized
tctcattttcacaaaattttca

SEQ ID NO: 123290 - DNA, 22 bp, Artificial Sequence
  chemically synthesized
attttcacaaaattttcaatga

SEQ ID NO: 123291 - DNA, 22 bp, Artificial Sequence
  chemically synthesized
tcacaaaattttcaatgatgat

SEQ ID NO: 123292 - DNA, 22 bp, Artificial Sequence
  chemically synthesized
cacaaaattttcaatgatgatt

SEQ ID NO: 123293 - DNA, 22 bp, Artificial Sequence
  chemically synthesized
acaaaattttcaatgatgatta

SEQ ID NO: 123294 - DNA, 22 bp, Artificial Sequence
  chemically synthesized
tcaatgatgattatagtaataa

SEQ ID NO: 123295 - DNA, 22 bp, Artificial Sequence
  chemically synthesized
caatgatgattatagtaataat

SEQ ID NO: 123296 - DNA, 22 bp, Artificial Sequence
  chemically synthesized
aatgatgattatagtaataata

SEQ ID NO: 123297 - DNA, 22 bp, Artificial Sequence
  chemically synthesized
tagtaataatagcaatgatttc

SEQ ID NO: 123298 - DNA, 22 bp, Artificial Sequence
  chemically synthesized
ctataatacttacaatggacca

SEQ ID NO: 123299 - DNA, 22 bp, Artificial Sequence
  chemically synthesized
tataatacttacaatggaccag

SEQ ID NO: 123300 - DNA, 22 bp, Artificial Sequence
  chemically synthesized
taatacttacaatggaccaggc

SEQ ID NO: 123301 - DNA, 22 bp, Artificial Sequence
  chemically synthesized
acaatggaccaggcactattga

SEQ ID NO: 123302 - DNA, 22 bp, Artificial Sequence
  chemically synthesized
caatggaccaggcactattgaa

SEQ ID NO: 123303 - DNA, 22 bp, Artificial Sequence
  chemically synthesized
ttgaacacgttagacatattaa

SEQ ID NO: 123304 - DNA, 22 bp, Artificial Sequence
  chemically synthesized
aacacgttagacatattaatgt

SEQ ID NO: 123305 - DNA, 22 bp, Artificial Sequence
  chemically synthesized
gacatattaatgtatttaatca

SEQ ID NO: 123306 - DNA, 22 bp, Artificial Sequence
  chemically synthesized
atgtatttaatcattaaaataa

SEQ ID NO: 123307 - DNA, 22 bp, Artificial Sequence
  chemically synthesized
aatcattaaaataattcaacca

SEQ ID NO: 123308 - DNA, 22 bp, Artificial Sequence
  chemically synthesized
atcattaaaataattcaaccat

SEQ ID NO: 123309 - DNA, 22 bp, Artificial Sequence
  chemically synthesized
aaataattcaaccatgtgggta

SEQ ID NO: 123310 - DNA, 22 bp, Artificial Sequence
  chemically synthesized
aaccatgtgggtactattggta

SEQ ID NO: 123311 - DNA, 22 bp, Artificial Sequence
  chemically synthesized
ttggtatccccacttaaagatg

SEQ ID NO: 123312 - DNA, 22 bp, Artificial Sequence
  chemically synthesized
gtatccccacttaaagatgagt

SEQ ID NO: 123313 - DNA, 22 bp, Artificial Sequence
  chemically synthesized
aaagatgagtggaccaaaacac

SEQ ID NO: 123314 - DNA, 22 bp, Artificial Sequence
  chemically synthesized
aagatgagtggaccaaaacaca

SEQ ID NO: 123315 - DNA, 22 bp, Artificial Sequence
  chemically synthesized
ctttgctatagggtacgcagcc

SEQ ID NO: 123316 - DNA, 22 bp, Artificial Sequence
  chemically synthesized
tgctatagggtacgcagccaat

SEQ ID NO: 123317 - DNA, 22 bp, Artificial Sequence
  chemically synthesized
gctatagggtacgcagccaata

SEQ ID NO: 123318 - DNA, 22 bp, Artificial Sequence
  chemically synthesized
ctatagggtacgcagccaataa

SEQ ID NO: 123319 - DNA, 22 bp, Artificial Sequence
  chemically synthesized
tagggtacgcagccaataagtg

SEQ ID NO: 123320 - DNA, 22 bp, Artificial Sequence
  chemically synthesized
taaaccaaactgtttaattccc

SEQ ID NO: 123321 - DNA, 22 bp, Artificial Sequence
  chemically synthesized
tttaattcccaaaactactgca

SEQ ID NO: 123322 - DNA, 22 bp, Artificial Sequence
  chemically synthesized
aattcccaaaactactgcataa

SEQ ID NO: 123323 - DNA, 22 bp, Artificial Sequence
  chemically synthesized
attcccaaaactactgcataag

SEQ ID NO: 123324 - DNA, 22 bp, Artificial Sequence
  chemically synthesized
ccaaaactactgcataagactg

SEQ ID NO: 123325 - DNA, 22 bp, Artificial Sequence
  chemically synthesized
ctgcataagactgtatgaagaa

SEQ ID NO: 123326 - DNA, 22 bp, Artificial Sequence
  chemically synthesized
cataagactgtatgaagaagca

SEQ ID NO: 123327 - DNA, 22 bp, Artificial Sequence
  chemically synthesized
tatgaagaagcatgaaacaata

SEQ ID NO: 123328 - DNA, 22 bp, Artificial Sequence
  chemically synthesized
caagaagcctacagaacactta

SEQ ID NO: 123329 - DNA, 22 bp, Artificial Sequence
  chemically synthesized
aagaagcctacagaacacttaa

SEQ ID NO: 123330 - DNA, 22 bp, Artificial Sequence
  chemically synthesized
cagaacacttaacaggattttt

SEQ ID NO: 123331 - DNA, 22 bp, Artificial Sequence
  chemically synthesized
aacaggatttttcatgctggtt

SEQ ID NO: 123332 - DNA, 22 bp, Artificial Sequence
  chemically synthesized
acaggatttttcatgctggttc

SEQ ID NO: 123333 - DNA, 22 bp, Artificial Sequence
  chemically synthesized
ttcatgctggttcatagttaag

SEQ ID NO: 123334 - DNA, 22 bp, Artificial Sequence
  chemically synthesized
tcatgctggttcatagttaagt

SEQ ID NO: 123335 - DNA, 22 bp, Artificial Sequence
  chemically synthesized
catgctggttcatagttaagtt

SEQ ID NO: 123336 - DNA, 22 bp, Artificial Sequence
  chemically synthesized
atgctggttcatagttaagtta

SEQ ID NO: 123337 - DNA, 22 bp, Artificial Sequence
  chemically synthesized
gttcatagttaagttattggtt

SEQ ID NO: 123338 - DNA, 22 bp, Artificial Sequence
  chemically synthesized
atagttaagttattggttgaag

SEQ ID NO: 123339 - DNA, 22 bp, Artificial Sequence
  chemically synthesized
agttattggttgaagatgcaac

SEQ ID NO: 123340 - DNA, 22 bp, Artificial Sequence
  chemically synthesized
ttggttgaagatgcaacaaatc

SEQ ID NO: 123341 - DNA, 22 bp, Artificial Sequence
  chemically synthesized
gttgaagatgcaacaaatctga

SEQ ID NO: 123342 - DNA, 22 bp, Artificial Sequence
  chemically synthesized
aagatgcaacaaatctgaatgg

SEQ ID NO: 123343 - DNA, 22 bp, Artificial Sequence
  chemically synthesized
aatggcagaggaaaaaacaaag

SEQ ID NO: 123344 - DNA, 22 bp, Artificial Sequence
  chemically synthesized
tgagtgagcctgggtctccata

SEQ ID NO: 123345 - DNA, 22 bp, Artificial Sequence
  chemically synthesized
agtgagcctgggtctccatagg

SEQ ID NO: 123346 - DNA, 22 bp, Artificial Sequence
  chemically synthesized
ggtctccataggagcaaagaac

SEQ ID NO: 123347 - DNA, 22 bp, Artificial Sequence
  chemically synthesized
cataggagcaaagaaccaagtg

SEQ ID NO: 123348 - DNA, 22 bp, Artificial Sequence
  chemically synthesized
gggttagttgtggggtgtaaga

SEQ ID NO: 123349 - DNA, 22 bp, Artificial Sequence
  chemically synthesized
ggttagttgtggggtgtaagat

SEQ ID NO: 123350 - DNA, 22 bp, Artificial Sequence
  chemically synthesized
gttgtggggtgtaagatataat

SEQ ID NO: 123351 - DNA, 22 bp, Artificial Sequence
  chemically synthesized
tggggtgtaagatataattaga

SEQ ID NO: 123352 - DNA, 22 bp, Artificial Sequence
  chemically synthesized
gaagagaagtagctctactctg

SEQ ID NO: 123353 - DNA, 22 bp, Artificial Sequence
  chemically synthesized
tactctggtagaagtgaaactt

SEQ ID NO: 123354 - DNA, 22 bp, Artificial Sequence
  chemically synthesized
ctctggtagaagtgaaactttg

SEQ ID NO: 123355 - DNA, 22 bp, Artificial Sequence
  chemically synthesized
tggtagaagtgaaactttgaag

SEQ ID NO: 123356 - DNA, 22 bp, Artificial Sequence
  chemically synthesized
gtagaagtgaaactttgaagaa

SEQ ID NO: 123357 - DNA, 22 bp, Artificial Sequence
  chemically synthesized
tgaagaatgtctgattcctcac

SEQ ID NO: 123358 - DNA, 22 bp, Artificial Sequence
  chemically synthesized
gaagaatgtctgattcctcaca

SEQ ID NO: 123359 - DNA, 22 bp, Artificial Sequence
  chemically synthesized
aagaatgtctgattcctcacaa

SEQ ID NO: 123360 - DNA, 22 bp, Artificial Sequence
  chemically synthesized
attcctcacaaactgctgagta

SEQ ID NO: 123361 - DNA, 22 bp, Artificial Sequence
  chemically synthesized
ctcacaaactgctgagtaagga

SEQ ID NO: 123362 - DNA, 22 bp, Artificial Sequence
  chemically synthesized
acaaactgctgagtaaggatag

SEQ ID NO: 123363 - DNA, 22 bp, Artificial Sequence
  chemically synthesized
ctgagtaaggataggaaaatgc

SEQ ID NO: 123364 - DNA, 22 bp, Artificial Sequence
  chemically synthesized
agtaaggataggaaaatgcata

SEQ ID NO: 123365 - DNA, 22 bp, Artificial Sequence
  chemically synthesized
ggtcaagatttaagcatgagga

SEQ ID NO: 123366 - DNA, 22 bp, Artificial Sequence
  chemically synthesized
gtcaagatttaagcatgaggac

SEQ ID NO: 123367 - DNA, 22 bp, Artificial Sequence
  chemically synthesized
aagcatgaggacataaaaatag

SEQ ID NO: 123368 - DNA, 22 bp, Artificial Sequence
  chemically synthesized
agcatgaggacataaaaataga

SEQ ID NO: 123369 - DNA, 22 bp, Artificial Sequence
  chemically synthesized
ttgaatgcatatattgtgcaag

SEQ ID NO: 123370 - DNA, 22 bp, Artificial Sequence
  chemically synthesized
tgaatgcatatattgtgcaagt

SEQ ID NO: 123371 - DNA, 22 bp, Artificial Sequence
  chemically synthesized
gaatgcatatattgtgcaagtg

SEQ ID NO: 123372 - DNA, 22 bp, Artificial Sequence
  chemically synthesized
aatgcatatattgtgcaagtgc

SEQ ID NO: 123373 - DNA, 22 bp, Artificial Sequence
  chemically synthesized
tgcaagtgcctctattctgggt

SEQ ID NO: 123374 - DNA, 22 bp, Artificial Sequence
  chemically synthesized
tattctgggtgctagcatacca

SEQ ID NO: 123375 - DNA, 22 bp, Artificial Sequence
  chemically synthesized
ttctgggtgctagcataccaga

SEQ ID NO: 123376 - DNA, 22 bp, Artificial Sequence
  chemically synthesized
tgggtgctagcataccagaaac

SEQ ID NO: 123377 - DNA, 22 bp, Artificial Sequence
  chemically synthesized
ggtgctagcataccagaaacaa

SEQ ID NO: 123378 - DNA, 22 bp, Artificial Sequence
  chemically synthesized
gcataccagaaacaacattttt

SEQ ID NO: 123379 - DNA, 22 bp, Artificial Sequence
  chemically synthesized
ttgttccttttgtcagaggcat

SEQ ID NO: 123380 - DNA, 22 bp, Artificial Sequence
  chemically synthesized
tgttccttttgtcagaggcatt

SEQ ID NO: 123381 - DNA, 22 bp, Artificial Sequence
  chemically synthesized
gttccttttgtcagaggcattt

SEQ ID NO: 123382 - DNA, 22 bp, Artificial Sequence
  chemically synthesized
ttccttttgtcagaggcatttg

SEQ ID NO: 123383 - DNA, 22 bp, Artificial Sequence
  chemically synthesized
cttttgtcagaggcatttgaac

SEQ ID NO: 123384 - DNA, 22 bp, Artificial Sequence
  chemically synthesized
ttgtcagaggcatttgaaccag

SEQ ID NO: 123385 - DNA, 22 bp, Artificial Sequence
  chemically synthesized
tgtcagaggcatttgaaccaga

SEQ ID NO: 123386 - DNA, 22 bp, Artificial Sequence
  chemically synthesized
gtcagaggcatttgaaccagag

SEQ ID NO: 123387 - DNA, 22 bp, Artificial Sequence
  chemically synthesized
tcagaggcatttgaaccagagc

SEQ ID NO: 123388 - DNA, 22 bp, Artificial Sequence
  chemically synthesized
gaaccagagcaactccatctta

SEQ ID NO: 123389 - DNA, 22 bp, Artificial Sequence
  chemically synthesized
aaccagagcaactccatcttaa

SEQ ID NO: 123390 - DNA, 22 bp, Artificial Sequence
  chemically synthesized
catcttaaataggagctgggta

SEQ ID NO: 123391 - DNA, 22 bp, Artificial Sequence
  chemically synthesized
aaataggagctgggtacaataa

SEQ ID NO: 123392 - DNA, 22 bp, Artificial Sequence
  chemically synthesized
aataggagctgggtacaataag

SEQ ID NO: 123393 - DNA, 22 bp, Artificial Sequence
  chemically synthesized
ggtacaataaggctgagaccta

SEQ ID NO: 123394 - DNA, 22 bp, Artificial Sequence
  chemically synthesized
agacctactgggctgtattccc

SEQ ID NO: 123395 - DNA, 22 bp, Artificial Sequence
  chemically synthesized
ctgggctgtattcccagaaagt

SEQ ID NO: 123396 - DNA, 22 bp, Artificial Sequence
  chemically synthesized
ggctgtattcccagaaagttag

SEQ ID NO: 123397 - DNA, 22 bp, Artificial Sequence
  chemically synthesized
tattcccagaaagttaggcatt

SEQ ID NO: 123398 - DNA, 22 bp, Artificial Sequence
  chemically synthesized
ccagaaagttaggcattctcag

SEQ ID NO: 123399 - DNA, 22 bp, Artificial Sequence
  chemically synthesized
ggcattctcagtcacaggatga

SEQ ID NO: 123400 - DNA, 22 bp, Artificial Sequence
  chemically synthesized
tcagtcacaggatgagataaga

SEQ ID NO: 123401 - DNA, 22 bp, Artificial Sequence
  chemically synthesized
agtcacaggatgagataagagg

SEQ ID NO: 123402 - DNA, 22 bp, Artificial Sequence
  chemically synthesized
gcacaagatacaggtcataaag

SEQ ID NO: 123403 - DNA, 22 bp, Artificial Sequence
  chemically synthesized
gctgaaaaaacagtttgcagta

SEQ ID NO: 123404 - DNA, 22 bp, Artificial Sequence
  chemically synthesized
ctgaaaaaacagtttgcagtaa

SEQ ID NO: 123405 - DNA, 22 bp, Artificial Sequence
  chemically synthesized
aaaaaacagtttgcagtaaaga

SEQ ID NO: 123406 - DNA, 22 bp, Artificial Sequence
  chemically synthesized
gcagtaaagaagctggctgaaa

SEQ ID NO: 123407 - DNA, 22 bp, Artificial Sequence
  chemically synthesized
cagtaaagaagctggctgaaac

SEQ ID NO: 123408 - DNA, 22 bp, Artificial Sequence
  chemically synthesized
gctgaaacccaccaaaccaaga

SEQ ID NO: 123409 - DNA, 22 bp, Artificial Sequence
  chemically synthesized
aaacccaccaaaccaagattgt

SEQ ID NO: 123410 - DNA, 22 bp, Artificial Sequence
  chemically synthesized
tgatgagagtgacctctggtag

SEQ ID NO: 123411 - DNA, 22 bp, Artificial Sequence
  chemically synthesized
tggtagtcctcactgctactct

SEQ ID NO: 123412 - DNA, 22 bp, Artificial Sequence
  chemically synthesized
gtagtcctcactgctactctcc

SEQ ID NO: 123413 - DNA, 22 bp, Artificial Sequence
  chemically synthesized
actgctactctcccaccagcac

SEQ ID NO: 123414 - DNA, 22 bp, Artificial Sequence
  chemically synthesized
ctactctcccaccagcactatg

SEQ ID NO: 123415 - DNA, 22 bp, Artificial Sequence
  chemically synthesized
ctctcccaccagcactatgact

SEQ ID NO: 123416 - DNA, 22 bp, Artificial Sequence
  chemically synthesized
tcccaccagcactatgactgtt

SEQ ID NO: 123417 - DNA, 22 bp, Artificial Sequence
  chemically synthesized
ccaccagcactatgactgttta

SEQ ID NO: 123418 - DNA, 22 bp, Artificial Sequence
  chemically synthesized
tgactgtttagaaatgccatgg

SEQ ID NO: 123419 - DNA, 22 bp, Artificial Sequence
  chemically synthesized
tttagaaatgccatggcaacat

SEQ ID NO: 123420 - DNA, 22 bp, Artificial Sequence
  chemically synthesized
agaaatgccatggcaacatcag

SEQ ID NO: 123421 - DNA, 22 bp, Artificial Sequence
  chemically synthesized
gaaatgccatggcaacatcagg

SEQ ID NO: 123422 - DNA, 22 bp, Artificial Sequence
  chemically synthesized
cgctaagcggtctgaaaagggg

SEQ ID NO: 123423 - DNA, 22 bp, Artificial Sequence
  chemically synthesized
agcggtctgaaaaggggaggca

SEQ ID NO: 123424 - DNA, 22 bp, Artificial Sequence
  chemically synthesized
aaaaggggaggcatgaataatc

SEQ ID NO: 123425 - DNA, 22 bp, Artificial Sequence
  chemically synthesized
gtttagcatatcatcaataaat

SEQ ID NO: 123426 - DNA, 22 bp, Artificial Sequence
  chemically synthesized
tttagcatatcatcaataaata

SEQ ID NO: 123427 - DNA, 22 bp, Artificial Sequence
  chemically synthesized
agcatatcatcaataaataacc

SEQ ID NO: 123428 - DNA, 22 bp, Artificial Sequence
  chemically synthesized
gcatatcatcaataaataacca

SEQ ID NO: 123429 - DNA, 22 bp, Artificial Sequence
  chemically synthesized
aggactgttctgcctatagggt

SEQ ID NO: 123430 - DNA, 22 bp, Artificial Sequence
  chemically synthesized
ttctgcctatagggtagccatt

SEQ ID NO: 123431 - DNA, 22 bp, Artificial Sequence
  chemically synthesized
tgcctatagggtagccattatt

SEQ ID NO: 123432 - DNA, 22 bp, Artificial Sequence
  chemically synthesized
cctatagggtagccattatttt

SEQ ID NO: 123433 - DNA, 22 bp, Artificial Sequence
  chemically synthesized
tagggtagccattattttactc

SEQ ID NO: 123434 - DNA, 22 bp, Artificial Sequence
  chemically synthesized
ttttactcctttactttcttaa

SEQ ID NO: 123435 - DNA, 22 bp, Artificial Sequence
  chemically synthesized
tactcctttactttcttaatta

SEQ ID NO: 123436 - DNA, 22 bp, Artificial Sequence
  chemically synthesized
actcctttactttcttaattaa

SEQ ID NO: 123437 - DNA, 22 bp, Artificial Sequence
  chemically synthesized
ctcctttactttcttaattaac

SEQ ID NO: 123438 - DNA, 22 bp, Artificial Sequence
  chemically synthesized
ctttactttcttaattaacttg

SEQ ID NO: 123439 - DNA, 22 bp, Artificial Sequence
  chemically synthesized
tactttcttaattaacttgctt

SEQ ID NO: 123440 - DNA, 22 bp, Artificial Sequence
  chemically synthesized
actttcttaattaacttgcttt

SEQ ID NO: 123441 - DNA, 22 bp, Artificial Sequence
  chemically synthesized
ctttcttaattaacttgctttc

SEQ ID NO: 123442 - DNA, 22 bp, Artificial Sequence
  chemically synthesized
tcttaattaacttgctttcact

SEQ ID NO: 123443 - DNA, 22 bp, Artificial Sequence
  chemically synthesized
cttaattaacttgctttcactt

SEQ ID NO: 123444 - DNA, 22 bp, Artificial Sequence
  chemically synthesized
ttaattaacttgctttcacttt

SEQ ID NO: 123445 - DNA, 22 bp, Artificial Sequence
  chemically synthesized
aattaacttgctttcacttttc

SEQ ID NO: 123446 - DNA, 22 bp, Artificial Sequence
  chemically synthesized
attaacttgctttcacttttct

SEQ ID NO: 123447 - DNA, 22 bp, Artificial Sequence
  chemically synthesized
acttgctttcacttttctgtat

SEQ ID NO: 123448 - DNA, 22 bp, Artificial Sequence
  chemically synthesized
gctttcacttttctgtatggat

SEQ ID NO: 123449 - DNA, 22 bp, Artificial Sequence
  chemically synthesized
ctttcacttttctgtatggatt

SEQ ID NO: 123450 - DNA, 22 bp, Artificial Sequence
  chemically synthesized
tcacttttctgtatggatttgc

SEQ ID NO: 123451 - DNA, 22 bp, Artificial Sequence
  chemically synthesized
cacttttctgtatggatttgcc

SEQ ID NO: 123452 - DNA, 22 bp, Artificial Sequence
  chemically synthesized
acttttctgtatggatttgccc

SEQ ID NO: 123453 - DNA, 22 bp, Artificial Sequence
  chemically synthesized
ttctgtatggatttgccccaaa

SEQ ID NO: 123454 - DNA, 22 bp, Artificial Sequence
  chemically synthesized
tctgtatggatttgccccaaat

SEQ ID NO: 123455 - DNA, 22 bp, Artificial Sequence
  chemically synthesized
ctgtatggatttgccccaaatt

SEQ ID NO: 123456 - DNA, 22 bp, Artificial Sequence
  chemically synthesized
tgtatggatttgccccaaattc

SEQ ID NO: 123457 - DNA, 22 bp, Artificial Sequence
  chemically synthesized
tatggatttgccccaaattctt

SEQ ID NO: 123458 - DNA, 22 bp, Artificial Sequence
  chemically synthesized
gccccaaattctttcttgggca

SEQ ID NO: 123459 - DNA, 22 bp, Artificial Sequence
  chemically synthesized
ccccaaattctttcttgggcac

SEQ ID NO: 123460 - DNA, 22 bp, Artificial Sequence
  chemically synthesized
tttcttgggcacgaaatccaag

SEQ ID NO: 123461 - DNA, 22 bp, Artificial Sequence
  chemically synthesized
tcttgggcacgaaatccaagaa

SEQ ID NO: 123462 - DNA, 22 bp, Artificial Sequence
  chemically synthesized
cttgggcacgaaatccaagaac

SEQ ID NO: 123463 - DNA, 22 bp, Artificial Sequence
  chemically synthesized
ttgggcacgaaatccaagaacc

SEQ ID NO: 123464 - DNA, 22 bp, Artificial Sequence
  chemically synthesized
gggcacgaaatccaagaaccct

SEQ ID NO: 123465 - DNA, 22 bp, Artificial Sequence
  chemically synthesized
ggcacgaaatccaagaaccctc

SEQ ID NO: 123466 - DNA, 22 bp, Artificial Sequence
  chemically synthesized
tcttagggtctggattgtgact

SEQ ID NO: 123467 - DNA, 22 bp, Artificial Sequence
  chemically synthesized
ttagggtctggattgtgactcc

SEQ ID NO: 123468 - DNA, 22 bp, Artificial Sequence
  chemically synthesized
agggtctggattgtgactcctt

SEQ ID NO: 123469 - DNA, 22 bp, Artificial Sequence
  chemically synthesized
gggtctggattgtgactccttt

SEQ ID NO: 123470 - DNA, 22 bp, Artificial Sequence
  chemically synthesized
gattgtgactcctttctggcaa

SEQ ID NO: 123471 - DNA, 22 bp, Artificial Sequence
  chemically synthesized
tgactcctttctggcaatgctt

SEQ ID NO: 123472 - DNA, 22 bp, Artificial Sequence
  chemically synthesized
ctttctggcaatgcttttaact

SEQ ID NO: 123473 - DNA, 22 bp, Artificial Sequence
  chemically synthesized
tctggcaatgcttttaacttca

SEQ ID NO: 123474 - DNA, 22 bp, Artificial Sequence
  chemically synthesized
ctggcaatgcttttaacttcaa

SEQ ID NO: 123475 - DNA, 22 bp, Artificial Sequence
  chemically synthesized
tggcaatgcttttaacttcaaa

SEQ ID NO: 123476 - DNA, 22 bp, Artificial Sequence
  chemically synthesized
gcaatgcttttaacttcaaaaa

SEQ ID NO: 123477 - DNA, 22 bp, Artificial Sequence
  chemically synthesized
ttaacttcaaaaatctcctttc

SEQ ID NO: 123478 - DNA, 22 bp, Artificial Sequence
  chemically synthesized
taacttcaaaaatctcctttca

SEQ ID NO: 123479 - DNA, 22 bp, Artificial Sequence
  chemically synthesized
aacttcaaaaatctcctttcaa

SEQ ID NO: 123480 - DNA, 22 bp, Artificial Sequence
  chemically synthesized
acttcaaaaatctcctttcaaa

SEQ ID NO: 123481 - DNA, 22 bp, Artificial Sequence
  chemically synthesized
caaaaatctcctttcaaaatga

SEQ ID NO: 123482 - DNA, 22 bp, Artificial Sequence
  chemically synthesized
aaaaatctcctttcaaaatgat

SEQ ID NO: 123483 - DNA, 22 bp, Artificial Sequence
  chemically synthesized
ctttcaaaatgattttattcca

SEQ ID NO: 123484 - DNA, 22 bp, Artificial Sequence
  chemically synthesized
tcaaaatgattttattccagtt

SEQ ID NO: 123485 - DNA, 22 bp, Artificial Sequence
  chemically synthesized
caaaatgattttattccagttc

SEQ ID NO: 123486 - DNA, 22 bp, Artificial Sequence
  chemically synthesized
aaaatgattttattccagttca

SEQ ID NO: 123487 - DNA, 22 bp, Artificial Sequence
  chemically synthesized
tattccagttcacaatgaaata

SEQ ID NO: 123488 - DNA, 22 bp, Artificial Sequence
  chemically synthesized
attccagttcacaatgaaataa

SEQ ID NO: 123489 - DNA, 22 bp, Artificial Sequence
  chemically synthesized
ttccagttcacaatgaaataac

SEQ ID NO: 123490 - DNA, 22 bp, Artificial Sequence
  chemically synthesized
cagttcacaatgaaataactaa

SEQ ID NO: 123491 - DNA, 22 bp, Artificial Sequence
  chemically synthesized
acaatgaaataactaaaactct

SEQ ID NO: 123492 - DNA, 22 bp, Artificial Sequence
  chemically synthesized
aaactctgtgtcactaagtggc

SEQ ID NO: 123493 - DNA, 22 bp, Artificial Sequence
  chemically synthesized
tgtgtcactaagtggctttgca

SEQ ID NO: 123494 - DNA, 22 bp, Artificial Sequence
  chemically synthesized
tgtcactaagtggctttgcaag

SEQ ID NO: 123495 - DNA, 22 bp, Artificial Sequence
  chemically synthesized
agtggctttgcaaggtggcatg

SEQ ID NO: 123496 - DNA, 22 bp, Artificial Sequence
  chemically synthesized
tgcaaggtggcatgtgtatgtg

SEQ ID NO: 123497 - DNA, 22 bp, Artificial Sequence
  chemically synthesized
gcaaggtggcatgtgtatgtgt

SEQ ID NO: 123498 - DNA, 22 bp, Artificial Sequence
  chemically synthesized
caaggtggcatgtgtatgtgtg

SEQ ID NO: 123499 - DNA, 22 bp, Artificial Sequence
  chemically synthesized
ctcttccttcagaaccacattc

SEQ ID NO: 123500 - DNA, 22 bp, Artificial Sequence
  chemically synthesized
tcttccttcagaaccacattcc

SEQ ID NO: 123501 - DNA, 22 bp, Artificial Sequence
  chemically synthesized
ttccttcagaaccacattcctg

SEQ ID NO: 123502 - DNA, 22 bp, Artificial Sequence
  chemically synthesized
ccttcagaaccacattcctgag

SEQ ID NO: 123503 - DNA, 22 bp, Artificial Sequence
  chemically synthesized
cttcagaaccacattcctgaga

SEQ ID NO: 123504 - DNA, 22 bp, Artificial Sequence
  chemically synthesized
cagaaccacattcctgagactt

SEQ ID NO: 123505 - DNA, 22 bp, Artificial Sequence
  chemically synthesized
agaaccacattcctgagacttg

SEQ ID NO: 123506 - DNA, 22 bp, Artificial Sequence
  chemically synthesized
ctgagacttgagagaatgtctt

SEQ ID NO: 123507 - DNA, 22 bp, Artificial Sequence
  chemically synthesized
agacttgagagaatgtctttgg

SEQ ID NO: 123508 - DNA, 22 bp, Artificial Sequence
  chemically synthesized
gagagaatgtctttggtctctg

SEQ ID NO: 123509 - DNA, 22 bp, Artificial Sequence
  chemically synthesized
agagaatgtctttggtctctgc

SEQ ID NO: 123510 - DNA, 22 bp, Artificial Sequence
  chemically synthesized
tggtctctgctgctagagaatt

SEQ ID NO: 123511 - DNA, 22 bp, Artificial Sequence
  chemically synthesized
ggtctctgctgctagagaattt

SEQ ID NO: 123512 - DNA, 22 bp, Artificial Sequence
  chemically synthesized
gtctctgctgctagagaatttt

SEQ ID NO: 123513 - DNA, 22 bp, Artificial Sequence
  chemically synthesized
tgctgctagagaattttatcct

SEQ ID NO: 123514 - DNA, 22 bp, Artificial Sequence
  chemically synthesized
ctgctagagaattttatcctgg

SEQ ID NO: 123515 - DNA, 22 bp, Artificial Sequence
  chemically synthesized
ctagagaattttatcctggttc

SEQ ID NO: 123516 - DNA, 22 bp, Artificial Sequence
  chemically synthesized
gagaattttatcctggttcatg

SEQ ID NO: 123517 - DNA, 22 bp, Artificial Sequence
  chemically synthesized
tatcctggttcatggactgcag

SEQ ID NO: 123518 - DNA, 22 bp, Artificial Sequence
  chemically synthesized
atcctggttcatggactgcagc

SEQ ID NO: 123519 - DNA, 22 bp, Artificial Sequence
  chemically synthesized
tcctggttcatggactgcagcg

SEQ ID NO: 123520 - DNA, 22 bp, Artificial Sequence
  chemically synthesized
gttcatggactgcagcgggagg

SEQ ID NO: 123521 - DNA, 22 bp, Artificial Sequence
  chemically synthesized
atggactgcagcgggaggtgga

SEQ ID NO: 123522 - DNA, 22 bp, Artificial Sequence
  chemically synthesized
cagcgggaggtggaagcatttt

SEQ ID NO: 123523 - DNA, 22 bp, Artificial Sequence
  chemically synthesized
tcaaactttgggaggggaatgt

SEQ ID NO: 123524 - DNA, 22 bp, Artificial Sequence
  chemically synthesized
caaactttgggaggggaatgtt

SEQ ID NO: 123525 - DNA, 22 bp, Artificial Sequence
  chemically synthesized
aaactttgggaggggaatgtta

SEQ ID NO: 123526 - DNA, 22 bp, Artificial Sequence
  chemically synthesized
tgggaggggaatgttaggagac

SEQ ID NO: 123527 - DNA, 22 bp, Artificial Sequence
  chemically synthesized
gggaggggaatgttaggagacc

SEQ ID NO: 123528 - DNA, 22 bp, Artificial Sequence
  chemically synthesized
ggaggggaatgttaggagacca

SEQ ID NO: 123529 - DNA, 22 bp, Artificial Sequence
  chemically synthesized
ggagaccattaggcatgtgctc

SEQ ID NO: 123530 - DNA, 22 bp, Artificial Sequence
  chemically synthesized
ggcatgtgctcaagagatgaca

SEQ ID NO: 123531 - DNA, 22 bp, Artificial Sequence
  chemically synthesized
aagagatgacaccaagtccagg

SEQ ID NO: 123532 - DNA, 22 bp, Artificial Sequence
  chemically synthesized
aaactttgtgcctgttgtctca

SEQ ID NO: 123533 - DNA, 22 bp, Artificial Sequence
  chemically synthesized
tgtgcctgttgtctcatgaatc

SEQ ID NO: 123534 - DNA, 22 bp, Artificial Sequence
  chemically synthesized
gtgcctgttgtctcatgaatca

SEQ ID NO: 123535 - DNA, 22 bp, Artificial Sequence
  chemically synthesized
tgcctgttgtctcatgaatcag

SEQ ID NO: 123536 - DNA, 22 bp, Artificial Sequence
  chemically synthesized
ttgtctcatgaatcagatagca

SEQ ID NO: 123537 - DNA, 22 bp, Artificial Sequence
  chemically synthesized
tctcatgaatcagatagcaccc

SEQ ID NO: 123538 - DNA, 22 bp, Artificial Sequence
  chemically synthesized
atgaatcagatagcacccctgc

SEQ ID NO: 123539 - DNA, 22 bp, Artificial Sequence
  chemically synthesized
cctaaaccttcccagtcctgca

SEQ ID NO: 123540 - DNA, 22 bp, Artificial Sequence
  chemically synthesized
aaccttcccagtcctgcattgc

SEQ ID NO: 123541 - DNA, 22 bp, Artificial Sequence
  chemically synthesized
cccagtcctgcattgcacagag

SEQ ID NO: 123542 - DNA, 22 bp, Artificial Sequence
  chemically synthesized
ccagtcctgcattgcacagaga

SEQ ID NO: 123543 - DNA, 22 bp, Artificial Sequence
  chemically synthesized
cattgcacagagacccgtgctt

SEQ ID NO: 123544 - DNA, 22 bp, Artificial Sequence
  chemically synthesized
cacagagacccgtgcttgggat

SEQ ID NO: 123545 - DNA, 22 bp, Artificial Sequence
  chemically synthesized
gggattggaattagtcatcaat

SEQ ID NO: 123546 - DNA, 22 bp, Artificial Sequence
  chemically synthesized
ggattggaattagtcatcaata

SEQ ID NO: 123547 - DNA, 22 bp, Artificial Sequence
  chemically synthesized
gaattagtcatcaatacaaact

SEQ ID NO: 123548 - DNA, 22 bp, Artificial Sequence
  chemically synthesized
gtcatcaatacaaacttatttt

SEQ ID NO: 123549 - DNA, 22 bp, Artificial Sequence
  chemically synthesized
attttcccaaattttaattttt

SEQ ID NO: 123550 - DNA, 22 bp, Artificial Sequence
  chemically synthesized
ttttcccaaattttaattttta

SEQ ID NO: 123551 - DNA, 22 bp, Artificial Sequence
  chemically synthesized
tcccaaattttaatttttattc

SEQ ID NO: 123552 - DNA, 22 bp, Artificial Sequence
  chemically synthesized
cccaaattttaatttttattct

SEQ ID NO: 123553 - DNA, 22 bp, Artificial Sequence
  chemically synthesized
ccaaattttaatttttattcta

SEQ ID NO: 123554 - DNA, 22 bp, Artificial Sequence
  chemically synthesized
taatttttattctaaagacttt

SEQ ID NO: 123555 - DNA, 22 bp, Artificial Sequence
  chemically synthesized
aatttttattctaaagactttg

SEQ ID NO: 123556 - DNA, 22 bp, Artificial Sequence
  chemically synthesized
atttttattctaaagactttga

SEQ ID NO: 123557 - DNA, 22 bp, Artificial Sequence
  chemically synthesized
ttattctaaagactttgaatct

SEQ ID NO: 123558 - DNA, 22 bp, Artificial Sequence
  chemically synthesized
tattctaaagactttgaatctc

SEQ ID NO: 123559 - DNA, 22 bp, Artificial Sequence
  chemically synthesized
attctaaagactttgaatctca

SEQ ID NO: 123560 - DNA, 22 bp, Artificial Sequence
  chemically synthesized
ttctaaagactttgaatctcaa

SEQ ID NO: 123561 - DNA, 22 bp, Artificial Sequence
  chemically synthesized
taaagactttgaatctcaagtg

SEQ ID NO: 123562 - DNA, 22 bp, Artificial Sequence
  chemically synthesized
aagactttgaatctcaagtgaa

SEQ ID NO: 123563 - DNA, 22 bp, Artificial Sequence
  chemically synthesized
tgaatctcaagtgaataccctg

SEQ ID NO: 123564 - DNA, 22 bp, Artificial Sequence
  chemically synthesized
gaatctcaagtgaataccctga

SEQ ID NO: 123565 - DNA, 22 bp, Artificial Sequence
  chemically synthesized
aatctcaagtgaataccctgat

SEQ ID NO: 123566 - DNA, 22 bp, Artificial Sequence
  chemically synthesized
aagtgaataccctgatttcctt

SEQ ID NO: 123567 - DNA, 22 bp, Artificial Sequence
  chemically synthesized
atttccttccttccttctttcc

SEQ ID NO: 123568 - DNA, 22 bp, Artificial Sequence
  chemically synthesized
ccttccttccttctttcctttc

SEQ ID NO: 123569 - DNA, 22 bp, Artificial Sequence
  chemically synthesized
cttccttccttctttcctttcc

SEQ ID NO: 123570 - DNA, 22 bp, Artificial Sequence
  chemically synthesized
ccttccttctttcctttccttt

SEQ ID NO: 123571 - DNA, 22 bp, Artificial Sequence
  chemically synthesized
cttccttctttcctttcctttc

SEQ ID NO: 123572 - DNA, 22 bp, Artificial Sequence
  chemically synthesized
ccttctttcctttcctttcctc

SEQ ID NO: 123573 - DNA, 22 bp, Artificial Sequence
  chemically synthesized
cttctttcctttcctttcctcc

SEQ ID NO: 123574 - DNA, 22 bp, Artificial Sequence
  chemically synthesized
ctttcctttcctttcctcctcc

SEQ ID NO: 123575 - DNA, 22 bp, Artificial Sequence
  chemically synthesized
tttcctttcctttcctcctcct

SEQ ID NO: 123576 - DNA, 22 bp, Artificial Sequence
  chemically synthesized
tcctttcctttcctcctcctct

SEQ ID NO: 123577 - DNA, 22 bp, Artificial Sequence
  chemically synthesized
cctttcctttcctcctcctcta

SEQ ID NO: 123578 - DNA, 22 bp, Artificial Sequence
  chemically synthesized
ctttcctttcctcctcctctac

SEQ ID NO: 123579 - DNA, 22 bp, Artificial Sequence
  chemically synthesized
tcctttcctcctcctctacttt

SEQ ID NO: 123580 - DNA, 22 bp, Artificial Sequence
  chemically synthesized
cctttcctcctcctctactttt

SEQ ID NO: 123581 - DNA, 22 bp, Artificial Sequence
  chemically synthesized
ctttcctcctcctctacttttt

SEQ ID NO: 123582 - DNA, 22 bp, Artificial Sequence
  chemically synthesized
tcctcctcctctactttttctt

SEQ ID NO: 123583 - DNA, 22 bp, Artificial Sequence
  chemically synthesized
cctcctcctctactttttcttc

SEQ ID NO: 123584 - DNA, 22 bp, Artificial Sequence
  chemically synthesized
ctcctcctctactttttcttct

SEQ ID NO: 123585 - DNA, 22 bp, Artificial Sequence
  chemically synthesized
ctcctctactttttcttctcct

SEQ ID NO: 123586 - DNA, 22 bp, Artificial Sequence
  chemically synthesized
ctctactttttcttctccttct

SEQ ID NO: 123587 - DNA, 22 bp, Artificial Sequence
  chemically synthesized
tactttttcttctccttctcct

SEQ ID NO: 123588 - DNA, 22 bp, Artificial Sequence
  chemically synthesized
ctttttcttctccttctccttc

SEQ ID NO: 123589 - DNA, 22 bp, Artificial Sequence
  chemically synthesized
tttcttctccttctccttcttc

SEQ ID NO: 123590 - DNA, 22 bp, Artificial Sequence
  chemically synthesized
ttcttctccttctccttcttct

SEQ ID NO: 123591 - DNA, 22 bp, Artificial Sequence
  chemically synthesized
tcttctccttctccttcttctt

SEQ ID NO: 123592 - DNA, 22 bp, Artificial Sequence
  chemically synthesized
cttctccttctccttcttcttc

SEQ ID NO: 123593 - DNA, 22 bp, Artificial Sequence
  chemically synthesized
ttctccttctccttcttcttct

SEQ ID NO: 123594 - DNA, 22 bp, Artificial Sequence
  chemically synthesized
ctccttctccttcttcttcttc

SEQ ID NO: 123595 - DNA, 22 bp, Artificial Sequence
  chemically synthesized
tccttctccttcttcttcttct

SEQ ID NO: 123596 - DNA, 22 bp, Artificial Sequence
  chemically synthesized
cttctccttcttcttcttcttc

SEQ ID NO: 123597 - DNA, 22 bp, Artificial Sequence
  chemically synthesized
ctccttcttcttcttcttctct

SEQ ID NO: 123598 - DNA, 22 bp, Artificial Sequence
  chemically synthesized
tccttcttcttcttcttctctt

SEQ ID NO: 123599 - DNA, 22 bp, Artificial Sequence
  chemically synthesized
cttcttcttcttcttctcttcc

SEQ ID NO: 123600 - DNA, 22 bp, Artificial Sequence
  chemically synthesized
cttcttcttcttctcttccttc

SEQ ID NO: 123601 - DNA, 22 bp, Artificial Sequence
  chemically synthesized
ttcttcttcttctcttccttcc

SEQ ID NO: 123602 - DNA, 22 bp, Artificial Sequence
  chemically synthesized
cttcttcttctcttccttcctt

SEQ ID NO: 123603 - DNA, 22 bp, Artificial Sequence
  chemically synthesized
ttcttcttctcttccttccttt

SEQ ID NO: 123604 - DNA, 22 bp, Artificial Sequence
  chemically synthesized
cttcttctcttccttcctttcc

SEQ ID NO: 123605 - DNA, 22 bp, Artificial Sequence
  chemically synthesized
ttcttctcttccttcctttcct

SEQ ID NO: 123606 - DNA, 22 bp, Artificial Sequence
  chemically synthesized
cttctcttccttcctttccttc

SEQ ID NO: 123607 - DNA, 22 bp, Artificial Sequence
  chemically synthesized
ttctcttccttcctttccttcc

SEQ ID NO: 123608 - DNA, 22 bp, Artificial Sequence
  chemically synthesized
ctcttccttcctttccttccct

SEQ ID NO: 123609 - DNA, 22 bp, Artificial Sequence
  chemically synthesized
tcttccttcctttccttccctt

SEQ ID NO: 123610 - DNA, 22 bp, Artificial Sequence
  chemically synthesized
ttccttcctttccttcccttcc

SEQ ID NO: 123611 - DNA, 22 bp, Artificial Sequence
  chemically synthesized
ccttcctttccttcccttcctt

SEQ ID NO: 123612 - DNA, 22 bp, Artificial Sequence
  chemically synthesized
cttcctttccttcccttccttc

SEQ ID NO: 123613 - DNA, 22 bp, Artificial Sequence
  chemically synthesized
cctttccttcccttccttcctc

SEQ ID NO: 123614 - DNA, 22 bp, Artificial Sequence
  chemically synthesized
ctttccttcccttccttcctcc

SEQ ID NO: 123615 - DNA, 22 bp, Artificial Sequence
  chemically synthesized
tccttcccttccttcctccctc

SEQ ID NO: 123616 - DNA, 22 bp, Artificial Sequence
  chemically synthesized
ccttcccttccttcctccctcc

SEQ ID NO: 123617 - DNA, 22 bp, Artificial Sequence
  chemically synthesized
cttcccttccttcctccctccc

SEQ ID NO: 123618 - DNA, 22 bp, Artificial Sequence
  chemically synthesized
cccttccttcctccctccctac

SEQ ID NO: 123619 - DNA, 22 bp, Artificial Sequence
  chemically synthesized
ccttccttcctccctccctacc

SEQ ID NO: 123620 - DNA, 22 bp, Artificial Sequence
  chemically synthesized
ccttcctccctccctacctctc

SEQ ID NO: 123621 - DNA, 22 bp, Artificial Sequence
  chemically synthesized
cttcctccctccctacctctct

SEQ ID NO: 123622 - DNA, 22 bp, Artificial Sequence
  chemically synthesized
cctccctccctacctctctctc

SEQ ID NO: 123623 - DNA, 22 bp, Artificial Sequence
  chemically synthesized
ctccctccctacctctctctct

SEQ ID NO: 123624 - DNA, 22 bp, Artificial Sequence
  chemically synthesized
cctccctacctctctctctttc

SEQ ID NO: 123625 - DNA, 22 bp, Artificial Sequence
  chemically synthesized
cctacctctctctctttctcta

SEQ ID NO: 123626 - DNA, 22 bp, Artificial Sequence
  chemically synthesized
cctctctctctttctctatttc

SEQ ID NO: 123627 - DNA, 22 bp, Artificial Sequence
  chemically synthesized
tctctctttctctatttctttc

SEQ ID NO: 123628 - DNA, 22 bp, Artificial Sequence
  chemically synthesized
tctctttctctatttctttctc

SEQ ID NO: 123629 - DNA, 22 bp, Artificial Sequence
  chemically synthesized
tctttctctatttctttctcat

SEQ ID NO: 123630 - DNA, 22 bp, Artificial Sequence
  chemically synthesized
tttctctatttctttctcatct

SEQ ID NO: 123631 - DNA, 22 bp, Artificial Sequence
  chemically synthesized
tctctatttctttctcatcttg

SEQ ID NO: 123632 - DNA, 22 bp, Artificial Sequence
  chemically synthesized
ctctatttctttctcatcttgc

SEQ ID NO: 123633 - DNA, 22 bp, Artificial Sequence
  chemically synthesized
tctatttctttctcatcttgct

SEQ ID NO: 123634 - DNA, 22 bp, Artificial Sequence
  chemically synthesized
tatttctttctcatcttgcttt

SEQ ID NO: 123635 - DNA, 22 bp, Artificial Sequence
  chemically synthesized
tttctttctcatcttgcttttg

SEQ ID NO: 123636 - DNA, 22 bp, Artificial Sequence
  chemically synthesized
ctttctcatcttgcttttgcct

SEQ ID NO: 123637 - DNA, 22 bp, Artificial Sequence
  chemically synthesized
tttctcatcttgcttttgcctt

SEQ ID NO: 123638 - DNA, 22 bp, Artificial Sequence
  chemically synthesized
tctcatcttgcttttgccttcc

SEQ ID NO: 123639 - DNA, 22 bp, Artificial Sequence
  chemically synthesized
ctcatcttgcttttgccttcca

SEQ ID NO: 123640 - DNA, 22 bp, Artificial Sequence
  chemically synthesized
tcatcttgcttttgccttccag

SEQ ID NO: 123641 - DNA, 22 bp, Artificial Sequence
  chemically synthesized
atcttgcttttgccttccaggc

SEQ ID NO: 123642 - DNA, 22 bp, Artificial Sequence
  chemically synthesized
gcttttgccttccaggctgctg

SEQ ID NO: 123643 - DNA, 22 bp, Artificial Sequence
  chemically synthesized
cttttgccttccaggctgctgg

SEQ ID NO: 123644 - DNA, 22 bp, Artificial Sequence
  chemically synthesized
ttgccttccaggctgctggagt

SEQ ID NO: 123645 - DNA, 22 bp, Artificial Sequence
  chemically synthesized
tgccttccaggctgctggagtg

SEQ ID NO: 123646 - DNA, 22 bp, Artificial Sequence
  chemically synthesized
gccttccaggctgctggagtgc

SEQ ID NO: 123647 - DNA, 22 bp, Artificial Sequence
  chemically synthesized
ccttccaggctgctggagtgca

SEQ ID NO: 123648 - DNA, 22 bp, Artificial Sequence
  chemically synthesized
ccaggctgctggagtgcaatgg

SEQ ID NO: 123649 - DNA, 22 bp, Artificial Sequence
  chemically synthesized
caggctgctggagtgcaatggc

SEQ ID NO: 123650 - DNA, 22 bp, Artificial Sequence
  chemically synthesized
ctggagtgcaatggcgcgatct

SEQ ID NO: 123651 - DNA, 22 bp, Artificial Sequence
  chemically synthesized
gagtgcaatggcgcgatctcgg

SEQ ID NO: 123652 - DNA, 22 bp, Artificial Sequence
  chemically synthesized
ggctcactgcaacctccgcctc

SEQ ID NO: 123653 - DNA, 22 bp, Artificial Sequence
  chemically synthesized
actgcaacctccgcctcccagg

SEQ ID NO: 123654 - DNA, 22 bp, Artificial Sequence
  chemically synthesized
caacctccgcctcccaggttca

SEQ ID NO: 123655 - DNA, 22 bp, Artificial Sequence
  chemically synthesized
cgcctcccaggttcaagcgatt

SEQ ID NO: 123656 - DNA, 22 bp, Artificial Sequence
  chemically synthesized
ccaggttcaagcgattctccta

SEQ ID NO: 123657 - DNA, 22 bp, Artificial Sequence
  chemically synthesized
aagcgattctcctacctcagcc

SEQ ID NO: 123658 - DNA, 22 bp, Artificial Sequence
  chemically synthesized
tcctacctcagcctcctgtgta

SEQ ID NO: 123659 - DNA, 22 bp, Artificial Sequence
  chemically synthesized
ctacctcagcctcctgtgtagc

SEQ ID NO: 123660 - DNA, 22 bp, Artificial Sequence
  chemically synthesized
cctcagcctcctgtgtagctgc

SEQ ID NO: 123661 - DNA, 22 bp, Artificial Sequence
  chemically synthesized
agcctcctgtgtagctgcaatt

SEQ ID NO: 123662 - DNA, 22 bp, Artificial Sequence
  chemically synthesized
ctgtgtagctgcaattacaggc

SEQ ID NO: 123663 - DNA, 22 bp, Artificial Sequence
  chemically synthesized
tgtagctgcaattacaggcatc

SEQ ID NO: 123664 - DNA, 22 bp, Artificial Sequence
  chemically synthesized
caattacaggcatctgccacca

SEQ ID NO: 123665 - DNA, 22 bp, Artificial Sequence
  chemically synthesized
caggcatctgccaccaggccct

SEQ ID NO: 123666 - DNA, 22 bp, Artificial Sequence
  chemically synthesized
ccaccaggccctgctaattttt

SEQ ID NO: 123667 - DNA, 22 bp, Artificial Sequence
  chemically synthesized
ctaatttttttgtatttttatt

SEQ ID NO: 123668 - DNA, 22 bp, Artificial Sequence
  chemically synthesized
atttttttgtatttttattaga

SEQ ID NO: 123669 - DNA, 22 bp, Artificial Sequence
  chemically synthesized
ttttgtatttttattagagaca

SEQ ID NO: 123670 - DNA, 22 bp, Artificial Sequence
  chemically synthesized
tttgtatttttattagagacag

SEQ ID NO: 123671 - DNA, 22 bp, Artificial Sequence
  chemically synthesized
ttgtatttttattagagacagg

SEQ ID NO: 123672 - DNA, 22 bp, Artificial Sequence
  chemically synthesized
tgtatttttattagagacaggg

SEQ ID NO: 123673 - DNA, 22 bp, Artificial Sequence
  chemically synthesized
gtatttttattagagacagggt

SEQ ID NO: 123674 - DNA, 22 bp, Artificial Sequence
  chemically synthesized
tatttttattagagacagggtt

SEQ ID NO: 123675 - DNA, 22 bp, Artificial Sequence
  chemically synthesized
ttattagagacagggtttcacc

SEQ ID NO: 123676 - DNA, 22 bp, Artificial Sequence
  chemically synthesized
tattagagacagggtttcacca

SEQ ID NO: 123677 - DNA, 22 bp, Artificial Sequence
  chemically synthesized
attagagacagggtttcaccat

SEQ ID NO: 123678 - DNA, 22 bp, Artificial Sequence
  chemically synthesized
ttagagacagggtttcaccatg

SEQ ID NO: 123679 - DNA, 22 bp, Artificial Sequence
  chemically synthesized
gagacagggtttcaccatgttg

SEQ ID NO: 123680 - DNA, 22 bp, Artificial Sequence
  chemically synthesized
caccatgttggtcaggctggtc

SEQ ID NO: 123681 - DNA, 22 bp, Artificial Sequence
  chemically synthesized
accatgttggtcaggctggtct

SEQ ID NO: 123682 - DNA, 22 bp, Artificial Sequence
  chemically synthesized
gtcaggctggtctcgaactctt

SEQ ID NO: 123683 - DNA, 22 bp, Artificial Sequence
  chemically synthesized
gtctcgaactcttgccctcagg

SEQ ID NO: 123684 - DNA, 22 bp, Artificial Sequence
  chemically synthesized
gaactcttgccctcaggtgatc

SEQ ID NO: 123685 - DNA, 22 bp, Artificial Sequence
  chemically synthesized
ttgccctcaggtgatcctcctg

SEQ ID NO: 123686 - DNA, 22 bp, Artificial Sequence
  chemically synthesized
gccctcaggtgatcctcctgcc

SEQ ID NO: 123687 - DNA, 22 bp, Artificial Sequence
  chemically synthesized
ccctcaggtgatcctcctgcct

SEQ ID NO: 123688 - DNA, 22 bp, Artificial Sequence
  chemically synthesized
aggtgatcctcctgcctcagcc

SEQ ID NO: 123689 - DNA, 22 bp, Artificial Sequence
  chemically synthesized
ctgcctcagccacccaaagtgc

SEQ ID NO: 123690 - DNA, 22 bp, Artificial Sequence
  chemically synthesized
cctcagccacccaaagtgctgg

SEQ ID NO: 123691 - DNA, 22 bp, Artificial Sequence
  chemically synthesized
agccacccaaagtgctgggatt

SEQ ID NO: 123692 - DNA, 22 bp, Artificial Sequence
  chemically synthesized
ggattacaggcatgagtctgta

SEQ ID NO: 123693 - DNA, 22 bp, Artificial Sequence
  chemically synthesized
caggcatgagtctgtaatgtag

SEQ ID NO: 123694 - DNA, 22 bp, Artificial Sequence
  chemically synthesized
taatgtagccttttctttaaca

SEQ ID NO: 123695 - DNA, 22 bp, Artificial Sequence
  chemically synthesized
ttctttaacaggctacccacag

SEQ ID NO: 123696 - DNA, 22 bp, Artificial Sequence
  chemically synthesized
tctttaacaggctacccacaga

SEQ ID NO: 123697 - DNA, 22 bp, Artificial Sequence
  chemically synthesized
ctttaacaggctacccacagag

SEQ ID NO: 123698 - DNA, 22 bp, Artificial Sequence
  chemically synthesized
tttaacaggctacccacagagg

SEQ ID NO: 123699 - DNA, 22 bp, Artificial Sequence
  chemically synthesized
taacaggctacccacagaggaa

SEQ ID NO: 123700 - DNA, 22 bp, Artificial Sequence
  chemically synthesized
aacaggctacccacagaggaac

SEQ ID NO: 123701 - DNA, 22 bp, Artificial Sequence
  chemically synthesized
acaggctacccacagaggaacc

SEQ ID NO: 123702 - DNA, 22 bp, Artificial Sequence
  chemically synthesized
cccacagaggaaccttcccttg

SEQ ID NO: 123703 - DNA, 22 bp, Artificial Sequence
  chemically synthesized
cccttgagctccttttcagatt

SEQ ID NO: 123704 - DNA, 22 bp, Artificial Sequence
  chemically synthesized
ccttgagctccttttcagattc

SEQ ID NO: 123705 - DNA, 22 bp, Artificial Sequence
  chemically synthesized
gagctccttttcagattcttcc

SEQ ID NO: 123706 - DNA, 22 bp, Artificial Sequence
  chemically synthesized
agctccttttcagattcttcct

SEQ ID NO: 123707 - DNA, 22 bp, Artificial Sequence
  chemically synthesized
cttttcagattcttccttctgt

SEQ ID NO: 123708 - DNA, 22 bp, Artificial Sequence
  chemically synthesized
ttcagattcttccttctgtttc

SEQ ID NO: 123709 - DNA, 22 bp, Artificial Sequence
  chemically synthesized
tcagattcttccttctgtttct

SEQ ID NO: 123710 - DNA, 22 bp, Artificial Sequence
  chemically synthesized
cagattcttccttctgtttctc

SEQ ID NO: 123711 - DNA, 22 bp, Artificial Sequence
  chemically synthesized
agattcttccttctgtttctct

SEQ ID NO: 123712 - DNA, 22 bp, Artificial Sequence
  chemically synthesized
ttccttctgtttctctggccct

SEQ ID NO: 123713 - DNA, 22 bp, Artificial Sequence
  chemically synthesized
ccttctgtttctctggcccttt

SEQ ID NO: 123714 - DNA, 22 bp, Artificial Sequence
  chemically synthesized
cttctgtttctctggccctttc

SEQ ID NO: 123715 - DNA, 22 bp, Artificial Sequence
  chemically synthesized
ctgtttctctggccctttctcc

SEQ ID NO: 123716 - DNA, 22 bp, Artificial Sequence
  chemically synthesized
tgtttctctggccctttctcct

SEQ ID NO: 123717 - DNA, 22 bp, Artificial Sequence
  chemically synthesized
tttctctggccctttctccttt

SEQ ID NO: 123718 - DNA, 22 bp, Artificial Sequence
  chemically synthesized
ctctggccctttctcctttgtc

SEQ ID NO: 123719 - DNA, 22 bp, Artificial Sequence
  chemically synthesized
tctggccctttctcctttgtct

SEQ ID NO: 123720 - DNA, 22 bp, Artificial Sequence
  chemically synthesized
tggccctttctcctttgtcttc

SEQ ID NO: 123721 - DNA, 22 bp, Artificial Sequence
  chemically synthesized
gccctttctcctttgtcttcta

SEQ ID NO: 123722 - DNA, 22 bp, Artificial Sequence
  chemically synthesized
tctcctttgtcttctatacttt

SEQ ID NO: 123723 - DNA, 22 bp, Artificial Sequence
  chemically synthesized
ctcctttgtcttctatactttc

SEQ ID NO: 123724 - DNA, 22 bp, Artificial Sequence
  chemically synthesized
tcctttgtcttctatactttcc

SEQ ID NO: 123725 - DNA, 22 bp, Artificial Sequence
  chemically synthesized
ctttgtcttctatactttccta

SEQ ID NO: 123726 - DNA, 22 bp, Artificial Sequence
  chemically synthesized
tgtcttctatactttcctactg

SEQ ID NO: 123727 - DNA, 22 bp, Artificial Sequence
  chemically synthesized
gtcttctatactttcctactga

SEQ ID NO: 123728 - DNA, 22 bp, Artificial Sequence
  chemically synthesized
tcttctatactttcctactgat

SEQ ID NO: 123729 - DNA, 22 bp, Artificial Sequence
  chemically synthesized
ctatactttcctactgattttc

SEQ ID NO: 123730 - DNA, 22 bp, Artificial Sequence
  chemically synthesized
tatactttcctactgattttcc

SEQ ID NO: 123731 - DNA, 22 bp, Artificial Sequence
  chemically synthesized
tactttcctactgattttcctt

SEQ ID NO: 123732 - DNA, 22 bp, Artificial Sequence
  chemically synthesized
tcctactgattttccttcctgt

SEQ ID NO: 123733 - DNA, 22 bp, Artificial Sequence
  chemically synthesized
cctactgattttccttcctgtt

SEQ ID NO: 123734 - DNA, 22 bp, Artificial Sequence
  chemically synthesized
ctactgattttccttcctgttt

SEQ ID NO: 123735 - DNA, 22 bp, Artificial Sequence
  chemically synthesized
ctgattttccttcctgtttccc

SEQ ID NO: 123736 - DNA, 22 bp, Artificial Sequence
  chemically synthesized
attttccttcctgtttccctca

SEQ ID NO: 123737 - DNA, 22 bp, Artificial Sequence
  chemically synthesized
tccttcctgtttccctcatcct

SEQ ID NO: 123738 - DNA, 22 bp, Artificial Sequence
  chemically synthesized
ccttcctgtttccctcatcctt

SEQ ID NO: 123739 - DNA, 22 bp, Artificial Sequence
  chemically synthesized
cttcctgtttccctcatcctta

SEQ ID NO: 123740 - DNA, 22 bp, Artificial Sequence
  chemically synthesized
cctgtttccctcatccttaact

SEQ ID NO: 123741 - DNA, 22 bp, Artificial Sequence
  chemically synthesized
ctgtttccctcatccttaactt

SEQ ID NO: 123742 - DNA, 22 bp, Artificial Sequence
  chemically synthesized
tttccctcatccttaacttcct

SEQ ID NO: 123743 - DNA, 22 bp, Artificial Sequence
  chemically synthesized
ccctcatccttaacttcctact

SEQ ID NO: 123744 - DNA, 22 bp, Artificial Sequence
  chemically synthesized
cctcatccttaacttcctactt

SEQ ID NO: 123745 - DNA, 22 bp, Artificial Sequence
  chemically synthesized
atccttaacttcctacttaagg

SEQ ID NO: 123746 - DNA, 22 bp, Artificial Sequence
  chemically synthesized
aacttcctacttaaggcttgct

SEQ ID NO: 123747 - DNA, 22 bp, Artificial Sequence
  chemically synthesized
acttcctacttaaggcttgctc

SEQ ID NO: 123748 - DNA, 22 bp, Artificial Sequence
  chemically synthesized
cctacttaaggcttgctctatc

SEQ ID NO: 123749 - DNA, 22 bp, Artificial Sequence
  chemically synthesized
ctacttaaggcttgctctatcc

SEQ ID NO: 123750 - DNA, 22 bp, Artificial Sequence
  chemically synthesized
cttaaggcttgctctatcctct

SEQ ID NO: 123751 - DNA, 22 bp, Artificial Sequence
  chemically synthesized
aaggcttgctctatcctcttca

SEQ ID NO: 123752 - DNA, 22 bp, Artificial Sequence
  chemically synthesized
aggcttgctctatcctcttcac

SEQ ID NO: 123753 - DNA, 22 bp, Artificial Sequence
  chemically synthesized
gctctatcctcttcacatactg

SEQ ID NO: 123754 - DNA, 22 bp, Artificial Sequence
  chemically synthesized
ctctatcctcttcacatactgt

SEQ ID NO: 123755 - DNA, 22 bp, Artificial Sequence
  chemically synthesized
tatcctcttcacatactgtttc

SEQ ID NO: 123756 - DNA, 22 bp, Artificial Sequence
  chemically synthesized
tcctcttcacatactgtttctt

SEQ ID NO: 123757 - DNA, 22 bp, Artificial Sequence
  chemically synthesized
ttcacatactgtttcttatttt

SEQ ID NO: 123758 - DNA, 22 bp, Artificial Sequence
  chemically synthesized
cacatactgtttcttattttgc

SEQ ID NO: 123759 - DNA, 22 bp, Artificial Sequence
  chemically synthesized
acatactgtttcttattttgcc

SEQ ID NO: 123760 - DNA, 22 bp, Artificial Sequence
  chemically synthesized
tttcttattttgcccactgggt

SEQ ID NO: 123761 - DNA, 22 bp, Artificial Sequence
  chemically synthesized
cttattttgcccactgggttca

SEQ ID NO: 123762 - DNA, 22 bp, Artificial Sequence
  chemically synthesized
ttattttgcccactgggttcac

SEQ ID NO: 123763 - DNA, 22 bp, Artificial Sequence
  chemically synthesized
attttgcccactgggttcacct

SEQ ID NO: 123764 - DNA, 22 bp, Artificial Sequence
  chemically synthesized
ttttgcccactgggttcacctc

SEQ ID NO: 123765 - DNA, 22 bp, Artificial Sequence
  chemically synthesized
tgcccactgggttcacctctaa

SEQ ID NO: 123766 - DNA, 22 bp, Artificial Sequence
  chemically synthesized
gcccactgggttcacctctaag

SEQ ID NO: 123767 - DNA, 22 bp, Artificial Sequence
  chemically synthesized
cccactgggttcacctctaagt

SEQ ID NO: 123768 - DNA, 22 bp, Artificial Sequence
  chemically synthesized
ggttcacctctaagtcacacac

SEQ ID NO: 123769 - DNA, 22 bp, Artificial Sequence
  chemically synthesized
acctctaagtcacacacaactg

SEQ ID NO: 123770 - DNA, 22 bp, Artificial Sequence
  chemically synthesized
taagtcacacacaactggacaa

SEQ ID NO: 123771 - DNA, 22 bp, Artificial Sequence
  chemically synthesized
agtcacacacaactggacaagt

SEQ ID NO: 123772 - DNA, 22 bp, Artificial Sequence
  chemically synthesized
gacaagtaagcatacccctcag

SEQ ID NO: 123773 - DNA, 22 bp, Artificial Sequence
  chemically synthesized
agcaactcttccattaacagcc

SEQ ID NO: 123774 - DNA, 22 bp, Artificial Sequence
  chemically synthesized
ttccattaacagcccccaaaca

SEQ ID NO: 123775 - DNA, 22 bp, Artificial Sequence
  chemically synthesized
ccattaacagcccccaaacatg

SEQ ID NO: 123776 - DNA, 22 bp, Artificial Sequence
  chemically synthesized
cattaacagcccccaaacatgc

SEQ ID NO: 123777 - DNA, 22 bp, Artificial Sequence
  chemically synthesized
acagcccccaaacatgctgatt

SEQ ID NO: 123778 - DNA, 22 bp, Artificial Sequence
  chemically synthesized
attacctggctgctccataggg

SEQ ID NO: 123779 - DNA, 22 bp, Artificial Sequence
  chemically synthesized
cctggctgctccatagggtggt

SEQ ID NO: 123780 - DNA, 22 bp, Artificial Sequence
  chemically synthesized
gctgctccatagggtggttggt

SEQ ID NO: 123781 - DNA, 22 bp, Artificial Sequence
  chemically synthesized
ctccatagggtggttggttggt

SEQ ID NO: 123782 - DNA, 22 bp, Artificial Sequence
  chemically synthesized
catagggtggttggttggtctt

SEQ ID NO: 123783 - DNA, 22 bp, Artificial Sequence
  chemically synthesized
gttggtcttaagtctcccacta

SEQ ID NO: 123784 - DNA, 22 bp, Artificial Sequence
  chemically synthesized
gtcttaagtctcccactagcca

SEQ ID NO: 123785 - DNA, 22 bp, Artificial Sequence
  chemically synthesized
aagtctcccactagccagcacc

SEQ ID NO: 123786 - DNA, 22 bp, Artificial Sequence
  chemically synthesized
agtctcccactagccagcacct

SEQ ID NO: 123787 - DNA, 22 bp, Artificial Sequence
  chemically synthesized
ccactagccagcacctagcagt

SEQ ID NO: 123788 - DNA, 22 bp, Artificial Sequence
  chemically synthesized
gccagcacctagcagttcttca

SEQ ID NO: 123789 - DNA, 22 bp, Artificial Sequence
  chemically synthesized
gcagttcttcagtttgtgtggt

SEQ ID NO: 123790 - DNA, 22 bp, Artificial Sequence
  chemically synthesized
ttcagtttgtgtggttctcagt

SEQ ID NO: 123791 - DNA, 22 bp, Artificial Sequence
  chemically synthesized
cagtttgtgtggttctcagtgc

SEQ ID NO: 123792 - DNA, 22 bp, Artificial Sequence
  chemically synthesized
agtttgtgtggttctcagtgct

SEQ ID NO: 123793 - DNA, 22 bp, Artificial Sequence
  chemically synthesized
gtgtggttctcagtgctggtga

SEQ ID NO: 123794 - DNA, 22 bp, Artificial Sequence
  chemically synthesized
tgtggttctcagtgctggtgat

SEQ ID NO: 123795 - DNA, 22 bp, Artificial Sequence
  chemically synthesized
tcagtgctggtgatcatgctga

SEQ ID NO: 123796 - DNA, 22 bp, Artificial Sequence
  chemically synthesized
agtgctggtgatcatgctgagc

SEQ ID NO: 123797 - DNA, 22 bp, Artificial Sequence
  chemically synthesized
gtgatcatgctgagcctgcccc

SEQ ID NO: 123798 - DNA, 22 bp, Artificial Sequence
  chemically synthesized
agcctgcccccttcatgcctct

SEQ ID NO: 123799 - DNA, 22 bp, Artificial Sequence
  chemically synthesized
cccccttcatgcctctctggtc

SEQ ID NO: 123800 - DNA, 22 bp, Artificial Sequence
  chemically synthesized
catgcctctctggtcagtcaga

SEQ ID NO: 123801 - DNA, 22 bp, Artificial Sequence
  chemically synthesized
atgcctctctggtcagtcagac

SEQ ID NO: 123802 - DNA, 22 bp, Artificial Sequence
  chemically synthesized
tctggtcagtcagacccttcag

SEQ ID NO: 123803 - DNA, 22 bp, Artificial Sequence
  chemically synthesized
tggtcagtcagacccttcagaa

SEQ ID NO: 123804 - DNA, 22 bp, Artificial Sequence
  chemically synthesized
gtcagtcagacccttcagaacc

SEQ ID NO: 123805 - DNA, 22 bp, Artificial Sequence
  chemically synthesized
cagaacccaagaggtaagcaga

SEQ ID NO: 123806 - DNA, 22 bp, Artificial Sequence
  chemically synthesized
agaacccaagaggtaagcagag

SEQ ID NO: 123807 - DNA, 22 bp, Artificial Sequence
  chemically synthesized
ctctaagaatggttagcaactt

SEQ ID NO: 123808 - DNA, 22 bp, Artificial Sequence
  chemically synthesized
taagaatggttagcaacttaaa

SEQ ID NO: 123809 - DNA, 22 bp, Artificial Sequence
  chemically synthesized
agaatggttagcaacttaaact

SEQ ID NO: 123810 - DNA, 22 bp, Artificial Sequence
  chemically synthesized
gcaacttaaacttcatcctgtc

SEQ ID NO: 123811 - DNA, 22 bp, Artificial Sequence
  chemically synthesized
aaacttcatcctgtcatcaagc

SEQ ID NO: 123812 - DNA, 22 bp, Artificial Sequence
  chemically synthesized
aacttcatcctgtcatcaagcc

SEQ ID NO: 123813 - DNA, 22 bp, Artificial Sequence
  chemically synthesized
catcctgtcatcaagccagcac

SEQ ID NO: 123814 - DNA, 22 bp, Artificial Sequence
  chemically synthesized
atcctgtcatcaagccagcaca

SEQ ID NO: 123815 - DNA, 22 bp, Artificial Sequence
  chemically synthesized
tcatcaagccagcacatactaa

SEQ ID NO: 123816 - DNA, 22 bp, Artificial Sequence
  chemically synthesized
agcatctataatgtgctagaca

SEQ ID NO: 123817 - DNA, 22 bp, Artificial Sequence
  chemically synthesized
taatgtgctagacaatgtgggt

SEQ ID NO: 123818 - DNA, 22 bp, Artificial Sequence
  chemically synthesized
gacaatgtgggtaatggaggtg

SEQ ID NO: 123819 - DNA, 22 bp, Artificial Sequence
  chemically synthesized
gattataatatctgccctcaaa

SEQ ID NO: 123820 - DNA, 22 bp, Artificial Sequence
  chemically synthesized
taatatctgccctcaaaagctt

SEQ ID NO: 123821 - DNA, 22 bp, Artificial Sequence
  chemically synthesized
ccctcaaaagcttatatctatt

SEQ ID NO: 123822 - DNA, 22 bp, Artificial Sequence
  chemically synthesized
aaaagcttatatctatttttta

SEQ ID NO: 123823 - DNA, 22 bp, Artificial Sequence
  chemically synthesized
atatctattttttaaataatta

SEQ ID NO: 123824 - DNA, 22 bp, Artificial Sequence
  chemically synthesized
tatctattttttaaataattac

SEQ ID NO: 123825 - DNA, 22 bp, Artificial Sequence
  chemically synthesized
ttttttaaataattacaggaca

SEQ ID NO: 123826 - DNA, 22 bp, Artificial Sequence
  chemically synthesized
tttaaataattacaggacaatt

SEQ ID NO: 123827 - DNA, 22 bp, Artificial Sequence
  chemically synthesized
ttaaataattacaggacaattt

SEQ ID NO: 123828 - DNA, 22 bp, Artificial Sequence
  chemically synthesized
taaataattacaggacaattta

SEQ ID NO: 123829 - DNA, 22 bp, Artificial Sequence
  chemically synthesized
aaataattacaggacaatttaa

SEQ ID NO: 123830 - DNA, 22 bp, Artificial Sequence
  chemically synthesized
aataattacaggacaatttaaa

SEQ ID NO: 123831 - DNA, 22 bp, Artificial Sequence
  chemically synthesized
caggacaatttaaatgtatcag

SEQ ID NO: 123832 - DNA, 22 bp, Artificial Sequence
  chemically synthesized
aaatgtatcagtttgggttgaa

SEQ ID NO: 123833 - DNA, 22 bp, Artificial Sequence
  chemically synthesized
aatgtatcagtttgggttgaat

SEQ ID NO: 123834 - DNA, 22 bp, Artificial Sequence
  chemically synthesized
gggttgaataaaatcagggatg

SEQ ID NO: 123835 - DNA, 22 bp, Artificial Sequence
  chemically synthesized
ggttgaataaaatcagggatgt

SEQ ID NO: 123836 - DNA, 22 bp, Artificial Sequence
  chemically synthesized
aataaaatcagggatgtttctc

SEQ ID NO: 123837 - DNA, 22 bp, Artificial Sequence
  chemically synthesized
ctcattagggcctcaacacatt

SEQ ID NO: 123838 - DNA, 22 bp, Artificial Sequence
  chemically synthesized
tcattagggcctcaacacattt

SEQ ID NO: 123839 - DNA, 22 bp, Artificial Sequence
  chemically synthesized
attagggcctcaacacatttgg

SEQ ID NO: 123840 - DNA, 22 bp, Artificial Sequence
  chemically synthesized
gggcctcaacacatttggaggt

SEQ ID NO: 123841 - DNA, 22 bp, Artificial Sequence
  chemically synthesized
aacacatttggaggtgtgttaa

SEQ ID NO: 123842 - DNA, 22 bp, Artificial Sequence
  chemically synthesized
ggaggtgtgttaagacagtagt

SEQ ID NO: 123843 - DNA, 22 bp, Artificial Sequence
  chemically synthesized
gaggtgtgttaagacagtagtc

SEQ ID NO: 123844 - DNA, 22 bp, Artificial Sequence
  chemically synthesized
agacagtagtcagattcacacc

SEQ ID NO: 123845 - DNA, 22 bp, Artificial Sequence
  chemically synthesized
acaccaagagccctgtcatggc

SEQ ID NO: 123846 - DNA, 22 bp, Artificial Sequence
  chemically synthesized
tcatggcaaaccgatgtcatgt

SEQ ID NO: 123847 - DNA, 22 bp, Artificial Sequence
  chemically synthesized
gataatgtttttgtgtatcaat

SEQ ID NO: 123848 - DNA, 22 bp, Artificial Sequence
  chemically synthesized
ttgtgtatcaatatgctttgtg

SEQ ID NO: 123849 - DNA, 22 bp, Artificial Sequence
  chemically synthesized
tgtgtatcaatatgctttgtga

SEQ ID NO: 123850 - DNA, 22 bp, Artificial Sequence
  chemically synthesized
gtgtatcaatatgctttgtgaa

SEQ ID NO: 123851 - DNA, 22 bp, Artificial Sequence
  chemically synthesized
tgtatcaatatgctttgtgaaa

SEQ ID NO: 123852 - DNA, 22 bp, Artificial Sequence
  chemically synthesized
tgtgaaaaaacttcgaggtagt

SEQ ID NO: 123853 - DNA, 22 bp, Artificial Sequence
  chemically synthesized
gtgaaaaaacttcgaggtagta

SEQ ID NO: 123854 - DNA, 22 bp, Artificial Sequence
  chemically synthesized
tgaaaaaacttcgaggtagtac

SEQ ID NO: 123855 - DNA, 22 bp, Artificial Sequence
  chemically synthesized
cgaggtagtacagccatatcct

SEQ ID NO: 123856 - DNA, 22 bp, Artificial Sequence
  chemically synthesized
gaggtagtacagccatatccta

SEQ ID NO: 123857 - DNA, 22 bp, Artificial Sequence
  chemically synthesized
tcctgtgcatagacaggaaaat

SEQ ID NO: 123858 - DNA, 22 bp, Artificial Sequence
  chemically synthesized
tgcatagacaggaaaatggttg

SEQ ID NO: 123859 - DNA, 22 bp, Artificial Sequence
  chemically synthesized
ctgactggcagaccagaattgg

SEQ ID NO: 123860 - DNA, 22 bp, Artificial Sequence
  chemically synthesized
actggcagaccagaattgggtt

SEQ ID NO: 123861 - DNA, 22 bp, Artificial Sequence
  chemically synthesized
gcagaccagaattgggttacct

SEQ ID NO: 123862 - DNA, 22 bp, Artificial Sequence
  chemically synthesized
ggttaccttttcatctaaatgc

SEQ ID NO: 123863 - DNA, 22 bp, Artificial Sequence
  chemically synthesized
ccttttcatctaaatgcatctc

SEQ ID NO: 123864 - DNA, 22 bp, Artificial Sequence
  chemically synthesized
ttcatctaaatgcatctctcca

SEQ ID NO: 123865 - DNA, 22 bp, Artificial Sequence
  chemically synthesized
tcatctaaatgcatctctccac

SEQ ID NO: 123866 - DNA, 22 bp, Artificial Sequence
  chemically synthesized
catctaaatgcatctctccaca

SEQ ID NO: 123867 - DNA, 22 bp, Artificial Sequence
  chemically synthesized
atctaaatgcatctctccacag

SEQ ID NO: 123868 - DNA, 22 bp, Artificial Sequence
  chemically synthesized
aatgcatctctccacagcgatt

SEQ ID NO: 123869 - DNA, 22 bp, Artificial Sequence
  chemically synthesized
tccacagcgatttctacagtat

SEQ ID NO: 123870 - DNA, 22 bp, Artificial Sequence
  chemically synthesized
cacagcgatttctacagtatgc

SEQ ID NO: 123871 - DNA, 22 bp, Artificial Sequence
  chemically synthesized
ctacagtatgcttgatcttgtc

SEQ ID NO: 123872 - DNA, 22 bp, Artificial Sequence
  chemically synthesized
tacagtatgcttgatcttgtct

SEQ ID NO: 123873 - DNA, 22 bp, Artificial Sequence
  chemically synthesized
cagtatgcttgatcttgtctct

SEQ ID NO: 123874 - DNA, 22 bp, Artificial Sequence
  chemically synthesized
gatcttgtctctcatcccatat

SEQ ID NO: 123875 - DNA, 22 bp, Artificial Sequence
  chemically synthesized
atcttgtctctcatcccatatt

SEQ ID NO: 123876 - DNA, 22 bp, Artificial Sequence
  chemically synthesized
gtctctcatcccatatttggtt

SEQ ID NO: 123877 - DNA, 22 bp, Artificial Sequence
  chemically synthesized
tctctcatcccatatttggtta

SEQ ID NO: 123878 - DNA, 22 bp, Artificial Sequence
  chemically synthesized
tcatcccatatttggttacttg

SEQ ID NO: 123879 - DNA, 22 bp, Artificial Sequence
  chemically synthesized
atcccatatttggttacttgtt

SEQ ID NO: 123880 - DNA, 22 bp, Artificial Sequence
  chemically synthesized
ggttacttgttgccatgccggg

SEQ ID NO: 123881 - DNA, 22 bp, Artificial Sequence
  chemically synthesized
gttacttgttgccatgccggga

SEQ ID NO: 123882 - DNA, 22 bp, Artificial Sequence
  chemically synthesized
cttgttgccatgccgggaccag

SEQ ID NO: 123883 - DNA, 22 bp, Artificial Sequence
  chemically synthesized
gttgccatgccgggaccagcca

SEQ ID NO: 123884 - DNA, 22 bp, Artificial Sequence
  chemically synthesized
ttgccatgccgggaccagccat

SEQ ID NO: 123885 - DNA, 22 bp, Artificial Sequence
  chemically synthesized
ccatgccgggaccagccatgca

SEQ ID NO: 123886 - DNA, 22 bp, Artificial Sequence
  chemically synthesized
gtttgcctttggcatcagtgta

SEQ ID NO: 123887 - DNA, 22 bp, Artificial Sequence
  chemically synthesized
gcctttggcatcagtgtatgct

SEQ ID NO: 123888 - DNA, 22 bp, Artificial Sequence
  chemically synthesized
cctttggcatcagtgtatgctc

SEQ ID NO: 123889 - DNA, 22 bp, Artificial Sequence
  chemically synthesized
tggcatcagtgtatgctctata

SEQ ID NO: 123890 - DNA, 22 bp, Artificial Sequence
  chemically synthesized
ggcatcagtgtatgctctatac

SEQ ID NO: 123891 - DNA, 22 bp, Artificial Sequence
  chemically synthesized
gcatcagtgtatgctctatacc

SEQ ID NO: 123892 - DNA, 22 bp, Artificial Sequence
  chemically synthesized
tatacccatgttttccacagct

SEQ ID NO: 123893 - DNA, 22 bp, Artificial Sequence
  chemically synthesized
tacccatgttttccacagctgg

SEQ ID NO: 123894 - DNA, 22 bp, Artificial Sequence
  chemically synthesized
tccacagctggcaaacaccagt

SEQ ID NO: 123895 - DNA, 22 bp, Artificial Sequence
  chemically synthesized
ccacagctggcaaacaccagtg

SEQ ID NO: 123896 - DNA, 22 bp, Artificial Sequence
  chemically synthesized
cacagctggcaaacaccagtgg

SEQ ID NO: 123897 - DNA, 22 bp, Artificial Sequence
  chemically synthesized
gcaaacaccagtggtattctaa

SEQ ID NO: 123898 - DNA, 22 bp, Artificial Sequence
  chemically synthesized
taataacactgttctcaccacc

SEQ ID NO: 123899 - DNA, 22 bp, Artificial Sequence
  chemically synthesized
ataacactgttctcaccaccag

SEQ ID NO: 123900 - DNA, 22 bp, Artificial Sequence
  chemically synthesized
ttctcaccaccagcccttctgg

SEQ ID NO: 123901 - DNA, 22 bp, Artificial Sequence
  chemically synthesized
tcaccaccagcccttctggttc

SEQ ID NO: 123902 - DNA, 22 bp, Artificial Sequence
  chemically synthesized
accaccagcccttctggttcac

SEQ ID NO: 123903 - DNA, 22 bp, Artificial Sequence
  chemically synthesized
ctggttcactagatgtttccat

SEQ ID NO: 123904 - DNA, 22 bp, Artificial Sequence
  chemically synthesized
tggttcactagatgtttccatg

SEQ ID NO: 123905 - DNA, 22 bp, Artificial Sequence
  chemically synthesized
gttcactagatgtttccatgga

SEQ ID NO: 123906 - DNA, 22 bp, Artificial Sequence
  chemically synthesized
actagatgtttccatggagtcc

SEQ ID NO: 123907 - DNA, 22 bp, Artificial Sequence
  chemically synthesized
gatgtttccatggagtcctgat

SEQ ID NO: 123908 - DNA, 22 bp, Artificial Sequence
  chemically synthesized
ccatggagtcctgatataatag

SEQ ID NO: 123909 - DNA, 22 bp, Artificial Sequence
  chemically synthesized
catggagtcctgatataataga

SEQ ID NO: 123910 - DNA, 22 bp, Artificial Sequence
  chemically synthesized
atataatagacaacttatttta

SEQ ID NO: 123911 - DNA, 22 bp, Artificial Sequence
  chemically synthesized
attttaaacacagttgccagcc

SEQ ID NO: 123912 - DNA, 22 bp, Artificial Sequence
  chemically synthesized
ttttaaacacagttgccagccc

SEQ ID NO: 123913 - DNA, 22 bp, Artificial Sequence
  chemically synthesized
taaacacagttgccagccctac

SEQ ID NO: 123914 - DNA, 22 bp, Artificial Sequence
  chemically synthesized
aaacacagttgccagccctaca

SEQ ID NO: 123915 - DNA, 22 bp, Artificial Sequence
  chemically synthesized
aacacagttgccagccctacac

SEQ ID NO: 123916 - DNA, 22 bp, Artificial Sequence
  chemically synthesized
ccagccctacactctaaatgtc

SEQ ID NO: 123917 - DNA, 22 bp, Artificial Sequence
  chemically synthesized
cactctaaatgtctacagaact

SEQ ID NO: 123918 - DNA, 22 bp, Artificial Sequence
  chemically synthesized
taaatgtctacagaactcacca

SEQ ID NO: 123919 - DNA, 22 bp, Artificial Sequence
  chemically synthesized
aatgtctacagaactcaccaga

SEQ ID NO: 123920 - DNA, 22 bp, Artificial Sequence
  chemically synthesized
cagaactcaccagacaaagaag

SEQ ID NO: 123921 - DNA, 22 bp, Artificial Sequence
  chemically synthesized
accagacaaagaagaaaagtta

SEQ ID NO: 123922 - DNA, 22 bp, Artificial Sequence
  chemically synthesized
tttagcagttgtgataagctac

SEQ ID NO: 123923 - DNA, 22 bp, Artificial Sequence
  chemically synthesized
agcagttgtgataagctaccac

SEQ ID NO: 123924 - DNA, 22 bp, Artificial Sequence
  chemically synthesized
gcagttgtgataagctaccact

SEQ ID NO: 123925 - DNA, 22 bp, Artificial Sequence
  chemically synthesized
tgataagctaccacttgaattc

SEQ ID NO: 123926 - DNA, 22 bp, Artificial Sequence
  chemically synthesized
ccacttgaattcaaggttatta

SEQ ID NO: 123927 - DNA, 22 bp, Artificial Sequence
  chemically synthesized
gaattcaaggttattacaagca

SEQ ID NO: 123928 - DNA, 22 bp, Artificial Sequence
  chemically synthesized
aattcaaggttattacaagcat

SEQ ID NO: 123929 - DNA, 22 bp, Artificial Sequence
  chemically synthesized
aaggttattacaagcatgatta

SEQ ID NO: 123930 - DNA, 22 bp, Artificial Sequence
  chemically synthesized
ttacaagcatgattattgacac

SEQ ID NO: 123931 - DNA, 22 bp, Artificial Sequence
  chemically synthesized
caagcatgattattgacacatt

SEQ ID NO: 123932 - DNA, 22 bp, Artificial Sequence
  chemically synthesized
ttgacacatttggttttattga

SEQ ID NO: 123933 - DNA, 22 bp, Artificial Sequence
  chemically synthesized
acacatttggttttattgagtg

SEQ ID NO: 123934 - DNA, 22 bp, Artificial Sequence
  chemically synthesized
ggttttattgagtgtcccttat

SEQ ID NO: 123935 - DNA, 22 bp, Artificial Sequence
  chemically synthesized
gttttattgagtgtcccttatt

SEQ ID NO: 123936 - DNA, 22 bp, Artificial Sequence
  chemically synthesized
tattgagtgtcccttatttgcc

SEQ ID NO: 123937 - DNA, 22 bp, Artificial Sequence
  chemically synthesized
attgagtgtcccttatttgccc

SEQ ID NO: 123938 - DNA, 22 bp, Artificial Sequence
  chemically synthesized
ttgagtgtcccttatttgccca

SEQ ID NO: 123939 - DNA, 22 bp, Artificial Sequence
  chemically synthesized
agtgtcccttatttgcccaaga

SEQ ID NO: 123940 - DNA, 22 bp, Artificial Sequence
  chemically synthesized
atttgcccaagattcattgctg

SEQ ID NO: 123941 - DNA, 22 bp, Artificial Sequence
  chemically synthesized
tttgcccaagattcattgctgt

SEQ ID NO: 123942 - DNA, 22 bp, Artificial Sequence
  chemically synthesized
gcccaagattcattgctgtgac

SEQ ID NO: 123943 - DNA, 22 bp, Artificial Sequence
  chemically synthesized
cccaagattcattgctgtgaca

SEQ ID NO: 123944 - DNA, 22 bp, Artificial Sequence
  chemically synthesized
attgctgtgacaagaatgacaa

SEQ ID NO: 123945 - DNA, 22 bp, Artificial Sequence
  chemically synthesized
ctgtgacaagaatgacaagaag

SEQ ID NO: 123946 - DNA, 22 bp, Artificial Sequence
  chemically synthesized
tgacaagaatgacaagaagaag

SEQ ID NO: 123947 - DNA, 22 bp, Artificial Sequence
  chemically synthesized
cttgagaaatccccttgtagcc

SEQ ID NO: 123948 - DNA, 22 bp, Artificial Sequence
  chemically synthesized
gagaaatccccttgtagccttc

SEQ ID NO: 123949 - DNA, 22 bp, Artificial Sequence
  chemically synthesized
agaaatccccttgtagccttct

SEQ ID NO: 123950 - DNA, 22 bp, Artificial Sequence
  chemically synthesized
gtagccttctgttacttcattt

SEQ ID NO: 123951 - DNA, 22 bp, Artificial Sequence
  chemically synthesized
tagccttctgttacttcatttt

SEQ ID NO: 123952 - DNA, 22 bp, Artificial Sequence
  chemically synthesized
ctgttacttcatttttttccct

SEQ ID NO: 123953 - DNA, 22 bp, Artificial Sequence
  chemically synthesized
tgttacttcatttttttccctc

SEQ ID NO: 123954 - DNA, 22 bp, Artificial Sequence
  chemically synthesized
ttacttcatttttttccctctc

SEQ ID NO: 123955 - DNA, 22 bp, Artificial Sequence
  chemically synthesized
cttcatttttttccctctctct

SEQ ID NO: 123956 - DNA, 22 bp, Artificial Sequence
  chemically synthesized
catttttttccctctctctctg

SEQ ID NO: 123957 - DNA, 22 bp, Artificial Sequence
  chemically synthesized
atttttttccctctctctctgc

SEQ ID NO: 123958 - DNA, 22 bp, Artificial Sequence
  chemically synthesized
ttttccctctctctctgcttct

SEQ ID NO: 123959 - DNA, 22 bp, Artificial Sequence
  chemically synthesized
tttccctctctctctgcttctc

SEQ ID NO: 123960 - DNA, 22 bp, Artificial Sequence
  chemically synthesized
ttccctctctctctgcttctcc

SEQ ID NO: 123961 - DNA, 22 bp, Artificial Sequence
  chemically synthesized
tccctctctctctgcttctcct

SEQ ID NO: 123962 - DNA, 22 bp, Artificial Sequence
  chemically synthesized
ccctctctctctgcttctcctt

SEQ ID NO: 123963 - DNA, 22 bp, Artificial Sequence
  chemically synthesized
cctctctctctgcttctccttg

SEQ ID NO: 123964 - DNA, 22 bp, Artificial Sequence
  chemically synthesized
tctctctgcttctccttgtgta

SEQ ID NO: 123965 - DNA, 22 bp, Artificial Sequence
  chemically synthesized
tctctgcttctccttgtgtatc

SEQ ID NO: 123966 - DNA, 22 bp, Artificial Sequence
  chemically synthesized
tctgcttctccttgtgtatcca

SEQ ID NO: 123967 - DNA, 22 bp, Artificial Sequence
  chemically synthesized
tgcttctccttgtgtatccacc

SEQ ID NO: 123968 - DNA, 22 bp, Artificial Sequence
  chemically synthesized
cttctccttgtgtatccaccat

SEQ ID NO: 123969 - DNA, 22 bp, Artificial Sequence
  chemically synthesized
ctccttgtgtatccaccataga

SEQ ID NO: 123970 - DNA, 22 bp, Artificial Sequence
  chemically synthesized
tccttgtgtatccaccatagaa

SEQ ID NO: 123971 - DNA, 22 bp, Artificial Sequence
  chemically synthesized
cttgtgtatccaccatagaagc

SEQ ID NO: 123972 - DNA, 22 bp, Artificial Sequence
  chemically synthesized
gtgtatccaccatagaagctac

SEQ ID NO: 123973 - DNA, 22 bp, Artificial Sequence
  chemically synthesized
tgtatccaccatagaagctaca

SEQ ID NO: 123974 - DNA, 22 bp, Artificial Sequence
  chemically synthesized
caatgattaaaaattatttact

SEQ ID NO: 123975 - DNA, 22 bp, Artificial Sequence
  chemically synthesized
aaaattatttactaaaatcatt

SEQ ID NO: 123976 - DNA, 22 bp, Artificial Sequence
  chemically synthesized
tttactaaaatcatttaataaa

SEQ ID NO: 123977 - DNA, 22 bp, Artificial Sequence
  chemically synthesized
actaaaatcatttaataaaact

SEQ ID NO: 123978 - DNA, 22 bp, Artificial Sequence
  chemically synthesized
ctaaaatcatttaataaaacta

SEQ ID NO: 123979 - DNA, 22 bp, Artificial Sequence
  chemically synthesized
aaatcatttaataaaactatat

SEQ ID NO: 123980 - DNA, 22 bp, Artificial Sequence
  chemically synthesized
aataaaactatattaaatggaa

SEQ ID NO: 123981 - DNA, 22 bp, Artificial Sequence
  chemically synthesized
ataaaactatattaaatggaaa

SEQ ID NO: 123982 - DNA, 22 bp, Artificial Sequence
  chemically synthesized
tattaaatggaaattcaccaat

SEQ ID NO: 123983 - DNA, 22 bp, Artificial Sequence
  chemically synthesized
aatggaaattcaccaatagaaa

SEQ ID NO: 123984 - DNA, 22 bp, Artificial Sequence
  chemically synthesized
accaatagaaacttaggaaagg

SEQ ID NO: 123985 - DNA, 22 bp, Artificial Sequence
  chemically synthesized
aggaaaggtaacaaagtcctgt

SEQ ID NO: 123986 - DNA, 22 bp, Artificial Sequence
  chemically synthesized
ggaaaggtaacaaagtcctgtg

SEQ ID NO: 123987 - DNA, 22 bp, Artificial Sequence
  chemically synthesized
tgaggttggcttcagcatatcc

SEQ ID NO: 123988 - DNA, 22 bp, Artificial Sequence
  chemically synthesized
gcttcagcatatccagaacaca

SEQ ID NO: 123989 - DNA, 22 bp, Artificial Sequence
  chemically synthesized
cagcatatccagaacacatgct

SEQ ID NO: 123990 - DNA, 22 bp, Artificial Sequence
  chemically synthesized
agcatatccagaacacatgctc

SEQ ID NO: 123991 - DNA, 22 bp, Artificial Sequence
  chemically synthesized
aggaaggaagagggtgggggga

SEQ ID NO: 123992 - DNA, 22 bp, Artificial Sequence
  chemically synthesized
taaacaagggactttgatcatt

SEQ ID NO: 123993 - DNA, 22 bp, Artificial Sequence
  chemically synthesized
tgatcattcactttgaagagtc

SEQ ID NO: 123994 - DNA, 22 bp, Artificial Sequence
  chemically synthesized
gatcattcactttgaagagtct

SEQ ID NO: 123995 - DNA, 22 bp, Artificial Sequence
  chemically synthesized
atcattcactttgaagagtctt

SEQ ID NO: 123996 - DNA, 22 bp, Artificial Sequence
  chemically synthesized
actttgaagagtcttctgtcat

SEQ ID NO: 123997 - DNA, 22 bp, Artificial Sequence
  chemically synthesized
tgaagagtcttctgtcatatgc

SEQ ID NO: 123998 - DNA, 22 bp, Artificial Sequence
  chemically synthesized
gaagagtcttctgtcatatgct

SEQ ID NO: 123999 - DNA, 22 bp, Artificial Sequence
  chemically synthesized
aagagtcttctgtcatatgctg

SEQ ID NO: 124000 - DNA, 22 bp, Artificial Sequence
  chemically synthesized
ctgtcatatgctggatgggcaa

SEQ ID NO: 124001 - DNA, 22 bp, Artificial Sequence
  chemically synthesized
tgtcatatgctggatgggcaaa

SEQ ID NO: 124002 - DNA, 22 bp, Artificial Sequence
  chemically synthesized
tcatatgctggatgggcaaaca

SEQ ID NO: 124003 - DNA, 22 bp, Artificial Sequence
  chemically synthesized
gatgggcaaacagcttagaggg

SEQ ID NO: 124004 - DNA, 22 bp, Artificial Sequence
  chemically synthesized
agagggctgccttagagtgcac

SEQ ID NO: 124005 - DNA, 22 bp, Artificial Sequence
  chemically synthesized
gagggctgccttagagtgcaca

SEQ ID NO: 124006 - DNA, 22 bp, Artificial Sequence
  chemically synthesized
ccttagagtgcacaaaatcaga

SEQ ID NO: 124007 - DNA, 22 bp, Artificial Sequence
  chemically synthesized
agagtgcacaaaatcagagata

SEQ ID NO: 124008 - DNA, 22 bp, Artificial Sequence
  chemically synthesized
gagtgcacaaaatcagagatat

SEQ ID NO: 124009 - DNA, 22 bp, Artificial Sequence
  chemically synthesized
agagatgcacatgaggatggag

SEQ ID NO: 124010 - DNA, 22 bp, Artificial Sequence
  chemically synthesized
tcacgcttagtttattttttca

SEQ ID NO: 124011 - DNA, 22 bp, Artificial Sequence
  chemically synthesized
acgcttagtttattttttcatt

SEQ ID NO: 124012 - DNA, 22 bp, Artificial Sequence
  chemically synthesized
agtttattttttcatttaatac

SEQ ID NO: 124013 - DNA, 22 bp, Artificial Sequence
  chemically synthesized
gtttattttttcatttaataca

SEQ ID NO: 124014 - DNA, 22 bp, Artificial Sequence
  chemically synthesized
attttttcatttaatacagaat

SEQ ID NO: 124015 - DNA, 22 bp, Artificial Sequence
  chemically synthesized
ttttttcatttaatacagaata

SEQ ID NO: 124016 - DNA, 22 bp, Artificial Sequence
  chemically synthesized
tttcatttaatacagaatattt

SEQ ID NO: 124017 - DNA, 22 bp, Artificial Sequence
  chemically synthesized
ttcatttaatacagaatatttt

SEQ ID NO: 124018 - DNA, 22 bp, Artificial Sequence
  chemically synthesized
tcatttaatacagaatattttt

SEQ ID NO: 124019 - DNA, 22 bp, Artificial Sequence
  chemically synthesized
catttaatacagaatatttttt

SEQ ID NO: 124020 - DNA, 22 bp, Artificial Sequence
  chemically synthesized
atttaatacagaatatttttta

SEQ ID NO: 124021 - DNA, 22 bp, Artificial Sequence
  chemically synthesized
aatacagaatattttttaagct

SEQ ID NO: 124022 - DNA, 22 bp, Artificial Sequence
  chemically synthesized
atacagaatattttttaagctc

SEQ ID NO: 124023 - DNA, 22 bp, Artificial Sequence
  chemically synthesized
tttaagctcctactctcttcaa

SEQ ID NO: 124024 - DNA, 22 bp, Artificial Sequence
  chemically synthesized
ttaagctcctactctcttcaaa

SEQ ID NO: 124025 - DNA, 22 bp, Artificial Sequence
  chemically synthesized
taagctcctactctcttcaaag

SEQ ID NO: 124026 - DNA, 22 bp, Artificial Sequence
  chemically synthesized
aagctcctactctcttcaaagc

SEQ ID NO: 124027 - DNA, 22 bp, Artificial Sequence
  chemically synthesized
agctcctactctcttcaaagca

SEQ ID NO: 124028 - DNA, 22 bp, Artificial Sequence
  chemically synthesized
ctactctcttcaaagcactgtg

SEQ ID NO: 124029 - DNA, 22 bp, Artificial Sequence
  chemically synthesized
ctctcttcaaagcactgtgctt

SEQ ID NO: 124030 - DNA, 22 bp, Artificial Sequence
  chemically synthesized
tcttcaaagcactgtgcttaaa

SEQ ID NO: 124031 - DNA, 22 bp, Artificial Sequence
  chemically synthesized
ttcaaagcactgtgcttaaagc

SEQ ID NO: 124032 - DNA, 22 bp, Artificial Sequence
  chemically synthesized
caaagcactgtgcttaaagctg

SEQ ID NO: 124033 - DNA, 22 bp, Artificial Sequence
  chemically synthesized
aaagcactgtgcttaaagctgg

SEQ ID NO: 124034 - DNA, 22 bp, Artificial Sequence
  chemically synthesized
tgcttaaagctggcatgtagtt

SEQ ID NO: 124035 - DNA, 22 bp, Artificial Sequence
  chemically synthesized
aaagctggcatgtagttgaatt

SEQ ID NO: 124036 - DNA, 22 bp, Artificial Sequence
  chemically synthesized
aagctggcatgtagttgaattt

SEQ ID NO: 124037 - DNA, 22 bp, Artificial Sequence
  chemically synthesized
gcatgtagttgaatttatagtc

SEQ ID NO: 124038 - DNA, 22 bp, Artificial Sequence
  chemically synthesized
aatttatagtccagcaaggaga

SEQ ID NO: 124039 - DNA, 22 bp, Artificial Sequence
  chemically synthesized
atagtccagcaaggagactgac

SEQ ID NO: 124040 - DNA, 22 bp, Artificial Sequence
  chemically synthesized
tagtccagcaaggagactgacc

SEQ ID NO: 124041 - DNA, 22 bp, Artificial Sequence
  chemically synthesized
accattgagaattacaaatatg

SEQ ID NO: 124042 - DNA, 22 bp, Artificial Sequence
  chemically synthesized
agaattacaaatatggcaggaa

SEQ ID NO: 124043 - DNA, 22 bp, Artificial Sequence
  chemically synthesized
caaatatggcaggaatttctaa

SEQ ID NO: 124044 - DNA, 22 bp, Artificial Sequence
  chemically synthesized
ctaaacagaaagatgtgcagct

SEQ ID NO: 124045 - DNA, 22 bp, Artificial Sequence
  chemically synthesized
taaacagaaagatgtgcagctc

SEQ ID NO: 124046 - DNA, 22 bp, Artificial Sequence
  chemically synthesized
aacagaaagatgtgcagctctc

SEQ ID NO: 124047 - DNA, 22 bp, Artificial Sequence
  chemically synthesized
tcatatcctgtcacagaaatga

SEQ ID NO: 124048 - DNA, 22 bp, Artificial Sequence
  chemically synthesized
atatcctgtcacagaaatgaca

SEQ ID NO: 124049 - DNA, 22 bp, Artificial Sequence
  chemically synthesized
tcacagaaatgacacatcacat

SEQ ID NO: 124050 - DNA, 22 bp, Artificial Sequence
  chemically synthesized
ctaaactgcatcatagccttac

SEQ ID NO: 124051 - DNA, 22 bp, Artificial Sequence
  chemically synthesized
aactgcatcatagccttaccat

SEQ ID NO: 124052 - DNA, 22 bp, Artificial Sequence
  chemically synthesized
catcatagccttaccatgacct

SEQ ID NO: 124053 - DNA, 22 bp, Artificial Sequence
  chemically synthesized
accatgacctcctgtttctgca

SEQ ID NO: 124054 - DNA, 22 bp, Artificial Sequence
  chemically synthesized
ccatgacctcctgtttctgcat

SEQ ID NO: 124055 - DNA, 22 bp, Artificial Sequence
  chemically synthesized
ctgtttctgcatttggcttgcc

SEQ ID NO: 124056 - DNA, 22 bp, Artificial Sequence
  chemically synthesized
tttctgcatttggcttgcctcc

SEQ ID NO: 124057 - DNA, 22 bp, Artificial Sequence
  chemically synthesized
ctgcatttggcttgcctccata

SEQ ID NO: 124058 - DNA, 22 bp, Artificial Sequence
  chemically synthesized
tgcatttggcttgcctccatat

SEQ ID NO: 124059 - DNA, 22 bp, Artificial Sequence
  chemically synthesized
catttggcttgcctccatatca

SEQ ID NO: 124060 - DNA, 22 bp, Artificial Sequence
  chemically synthesized
ggcttgcctccatatcacccca

SEQ ID NO: 124061 - DNA, 22 bp, Artificial Sequence
  chemically synthesized
gcttgcctccatatcaccccaa

SEQ ID NO: 124062 - DNA, 22 bp, Artificial Sequence
  chemically synthesized
gcctccatatcaccccaaattc

SEQ ID NO: 124063 - DNA, 22 bp, Artificial Sequence
  chemically synthesized
cctccatatcaccccaaattcc

SEQ ID NO: 124064 - DNA, 22 bp, Artificial Sequence
  chemically synthesized
catatcaccccaaattccaatg

SEQ ID NO: 124065 - DNA, 22 bp, Artificial Sequence
  chemically synthesized
caatggttttgtgaagtcaaga

SEQ ID NO: 124066 - DNA, 22 bp, Artificial Sequence
  chemically synthesized
tgtgaagtcaagattggtggtc

SEQ ID NO: 124067 - DNA, 22 bp, Artificial Sequence
  chemically synthesized
gtgaagtcaagattggtggtca

SEQ ID NO: 124068 - DNA, 22 bp, Artificial Sequence
  chemically synthesized
tgaagtcaagattggtggtcaa

SEQ ID NO: 124069 - DNA, 22 bp, Artificial Sequence
  chemically synthesized
gtggtcaaggtcgagggaaagt

SEQ ID NO: 124070 - DNA, 22 bp, Artificial Sequence
  chemically synthesized
atctaactatgtcaaactttgt

SEQ ID NO: 124071 - DNA, 22 bp, Artificial Sequence
  chemically synthesized
actatgtcaaactttgtcatag

SEQ ID NO: 124072 - DNA, 22 bp, Artificial Sequence
  chemically synthesized
tgtcaaactttgtcatagctag

SEQ ID NO: 124073 - DNA, 22 bp, Artificial Sequence
  chemically synthesized
tgtcatagctagatgagctttt

SEQ ID NO: 124074 - DNA, 22 bp, Artificial Sequence
  chemically synthesized
gtcatagctagatgagcttttt

SEQ ID NO: 124075 - DNA, 22 bp, Artificial Sequence
  chemically synthesized
tcatagctagatgagctttttg

SEQ ID NO: 124076 - DNA, 22 bp, Artificial Sequence
  chemically synthesized
gatgagctttttgaacttaaag

SEQ ID NO: 124077 - DNA, 22 bp, Artificial Sequence
  chemically synthesized
tttgaacttaaagtttgtcaaa

SEQ ID NO: 124078 - DNA, 22 bp, Artificial Sequence
  chemically synthesized
ttgaacttaaagtttgtcaaaa

SEQ ID NO: 124079 - DNA, 22 bp, Artificial Sequence
  chemically synthesized
tgaacttaaagtttgtcaaaat

SEQ ID NO: 124080 - DNA, 22 bp, Artificial Sequence
  chemically synthesized
gaacttaaagtttgtcaaaatt

SEQ ID NO: 124081 - DNA, 22 bp, Artificial Sequence
  chemically synthesized
aacttaaagtttgtcaaaattt

SEQ ID NO: 124082 - DNA, 22 bp, Artificial Sequence
  chemically synthesized
aaagtttgtcaaaatttaggaa

SEQ ID NO: 124083 - DNA, 22 bp, Artificial Sequence
  chemically synthesized
aagtttgtcaaaatttaggaaa

SEQ ID NO: 124084 - DNA, 22 bp, Artificial Sequence
  chemically synthesized
gtcaaaatttaggaaaatattt

SEQ ID NO: 124085 - DNA, 22 bp, Artificial Sequence
  chemically synthesized
tcaaaatttaggaaaatatttt

SEQ ID NO: 124086 - DNA, 22 bp, Artificial Sequence
  chemically synthesized
aggaaaatattttgcccttagg

SEQ ID NO: 124087 - DNA, 22 bp, Artificial Sequence
  chemically synthesized
ggaaaatattttgcccttaggt

SEQ ID NO: 124088 - DNA, 22 bp, Artificial Sequence
  chemically synthesized
tgcccttaggtggtcgcttgtt

SEQ ID NO: 124089 - DNA, 22 bp, Artificial Sequence
  chemically synthesized
gcccttaggtggtcgcttgttg

SEQ ID NO: 124090 - DNA, 22 bp, Artificial Sequence
  chemically synthesized
cccttaggtggtcgcttgttga

SEQ ID NO: 124091 - DNA, 22 bp, Artificial Sequence
  chemically synthesized
aggtggtcgcttgttgaaccct

SEQ ID NO: 124092 - DNA, 22 bp, Artificial Sequence
  chemically synthesized
ggtggtcgcttgttgaaccctg

SEQ ID NO: 124093 - DNA, 22 bp, Artificial Sequence
  chemically synthesized
gttgaaccctgaaaattttact

SEQ ID NO: 124094 - DNA, 22 bp, Artificial Sequence
  chemically synthesized
ttgaaccctgaaaattttactc

SEQ ID NO: 124095 - DNA, 22 bp, Artificial Sequence
  chemically synthesized
aaccctgaaaattttactcttt

SEQ ID NO: 124096 - DNA, 22 bp, Artificial Sequence
  chemically synthesized
aaaattttactctttctttagt

SEQ ID NO: 124097 - DNA, 22 bp, Artificial Sequence
  chemically synthesized
tactctttctttagtgttgaga

SEQ ID NO: 124098 - DNA, 22 bp, Artificial Sequence
  chemically synthesized
actctttctttagtgttgagat

SEQ ID NO: 124099 - DNA, 22 bp, Artificial Sequence
  chemically synthesized
ctctttctttagtgttgagata

SEQ ID NO: 124100 - DNA, 22 bp, Artificial Sequence
  chemically synthesized
tttctttagtgttgagatacct

SEQ ID NO: 124101 - DNA, 22 bp, Artificial Sequence
  chemically synthesized
tctttagtgttgagatacctct

SEQ ID NO: 124102 - DNA, 22 bp, Artificial Sequence
  chemically synthesized
ctttagtgttgagatacctctt

SEQ ID NO: 124103 - DNA, 22 bp, Artificial Sequence
  chemically synthesized
tttagtgttgagatacctcttc

SEQ ID NO: 124104 - DNA, 22 bp, Artificial Sequence
  chemically synthesized
tagtgttgagatacctcttcct

SEQ ID NO: 124105 - DNA, 22 bp, Artificial Sequence
  chemically synthesized
agtgttgagatacctcttcctt

SEQ ID NO: 124106 - DNA, 22 bp, Artificial Sequence
  chemically synthesized
gtgttgagatacctcttccttt

SEQ ID NO: 124107 - DNA, 22 bp, Artificial Sequence
  chemically synthesized
agatacctcttcctttattgaa

SEQ ID NO: 124108 - DNA, 22 bp, Artificial Sequence
  chemically synthesized
ttcctttattgaatctataatc

SEQ ID NO: 124109 - DNA, 22 bp, Artificial Sequence
  chemically synthesized
cctttattgaatctataatcga

SEQ ID NO: 124110 - DNA, 22 bp, Artificial Sequence
  chemically synthesized
ctttattgaatctataatcgac

SEQ ID NO: 124111 - DNA, 22 bp, Artificial Sequence
  chemically synthesized
tattgaatctataatcgacctt

SEQ ID NO: 124112 - DNA, 22 bp, Artificial Sequence
  chemically synthesized
attgaatctataatcgacctta

SEQ ID NO: 124113 - DNA, 22 bp, Artificial Sequence
  chemically synthesized
ttgaatctataatcgaccttat

SEQ ID NO: 124114 - DNA, 22 bp, Artificial Sequence
  chemically synthesized
aatctataatcgaccttattgc

SEQ ID NO: 124115 - DNA, 22 bp, Artificial Sequence
  chemically synthesized
taatcgaccttattgcaaccat

SEQ ID NO: 124116 - DNA, 22 bp, Artificial Sequence
  chemically synthesized
attgcaaccatggagaatgaga

SEQ ID NO: 124117 - DNA, 22 bp, Artificial Sequence
  chemically synthesized
ttgcaaccatggagaatgagat

SEQ ID NO: 124118 - DNA, 22 bp, Artificial Sequence
  chemically synthesized
caaccatggagaatgagatagt

SEQ ID NO: 124119 - DNA, 22 bp, Artificial Sequence
  chemically synthesized
gctcagaggtccacatcacata

SEQ ID NO: 124120 - DNA, 22 bp, Artificial Sequence
  chemically synthesized
agaggtccacatcacataatat

SEQ ID NO: 124121 - DNA, 22 bp, Artificial Sequence
  chemically synthesized
tcactacactgttgtgaagccc

SEQ ID NO: 124122 - DNA, 22 bp, Artificial Sequence
  chemically synthesized
cactgttgtgaagccctgttct

SEQ ID NO: 124123 - DNA, 22 bp, Artificial Sequence
  chemically synthesized
ttgtgaagccctgttctccagc

SEQ ID NO: 124124 - DNA, 22 bp, Artificial Sequence
  chemically synthesized
tgaagccctgttctccagccca

SEQ ID NO: 124125 - DNA, 22 bp, Artificial Sequence
  chemically synthesized
ttctccagcccaggcattcttc

SEQ ID NO: 124126 - DNA, 22 bp, Artificial Sequence
  chemically synthesized
tccagcccaggcattcttccat

SEQ ID NO: 124127 - DNA, 22 bp, Artificial Sequence
  chemically synthesized
cagcccaggcattcttccattc

SEQ ID NO: 124128 - DNA, 22 bp, Artificial Sequence
  chemically synthesized
ttccattcctaacacaagcttc

SEQ ID NO: 124129 - DNA, 22 bp, Artificial Sequence
  chemically synthesized
ccattcctaacacaagcttctc

SEQ ID NO: 124130 - DNA, 22 bp, Artificial Sequence
  chemically synthesized
cattcctaacacaagcttctcc

SEQ ID NO: 124131 - DNA, 22 bp, Artificial Sequence
  chemically synthesized
ctaacacaagcttctcctcctt

SEQ ID NO: 124132 - DNA, 22 bp, Artificial Sequence
  chemically synthesized
acacaagcttctcctcctttac

SEQ ID NO: 124133 - DNA, 22 bp, Artificial Sequence
  chemically synthesized
ctcctcctttacagaaatgggt

SEQ ID NO: 124134 - DNA, 22 bp, Artificial Sequence
  chemically synthesized
tcctcctttacagaaatgggtc

SEQ ID NO: 124135 - DNA, 22 bp, Artificial Sequence
  chemically synthesized
ctcctttacagaaatgggtctg

SEQ ID NO: 124136 - DNA, 22 bp, Artificial Sequence
  chemically synthesized
ctttacagaaatgggtctgagt

SEQ ID NO: 124137 - DNA, 22 bp, Artificial Sequence
  chemically synthesized
tacagaaatgggtctgagttgc

SEQ ID NO: 124138 - DNA, 22 bp, Artificial Sequence
  chemically synthesized
acagaaatgggtctgagttgcc

SEQ ID NO: 124139 - DNA, 22 bp, Artificial Sequence
  chemically synthesized
cagaaatgggtctgagttgcct

SEQ ID NO: 124140 - DNA, 22 bp, Artificial Sequence
  chemically synthesized
agttgcctatttttatacctgc

SEQ ID NO: 124141 - DNA, 22 bp, Artificial Sequence
  chemically synthesized
cctatttttatacctgccatgt

SEQ ID NO: 124142 - DNA, 22 bp, Artificial Sequence
  chemically synthesized
tttttatacctgccatgtcatg

SEQ ID NO: 124143 - DNA, 22 bp, Artificial Sequence
  chemically synthesized
ttatacctgccatgtcatgctg

SEQ ID NO: 124144 - DNA, 22 bp, Artificial Sequence
  chemically synthesized
tatacctgccatgtcatgctga

SEQ ID NO: 124145 - DNA, 22 bp, Artificial Sequence
  chemically synthesized
atacctgccatgtcatgctgag

SEQ ID NO: 124146 - DNA, 22 bp, Artificial Sequence
  chemically synthesized
tacctgccatgtcatgctgagt

SEQ ID NO: 124147 - DNA, 22 bp, Artificial Sequence
  chemically synthesized
ccatgtcatgctgagtgggggc

SEQ ID NO: 124148 - DNA, 22 bp, Artificial Sequence
  chemically synthesized
agtgggggctggggtttgcaaa

SEQ ID NO: 124149 - DNA, 22 bp, Artificial Sequence
  chemically synthesized
gggtttgcaaagagagaagaca

SEQ ID NO: 124150 - DNA, 22 bp, Artificial Sequence
  chemically synthesized
gcaaagagagaagacagctagg

SEQ ID NO: 124151 - DNA, 22 bp, Artificial Sequence
  chemically synthesized
caaagagagaagacagctaggg

SEQ ID NO: 124152 - DNA, 22 bp, Artificial Sequence
  chemically synthesized
gggaacataattgctatggtaa

SEQ ID NO: 124153 - DNA, 22 bp, Artificial Sequence
  chemically synthesized
ctatggtaattgctttctattg

SEQ ID NO: 124154 - DNA, 22 bp, Artificial Sequence
  chemically synthesized
tggtaattgctttctattgtac

SEQ ID NO: 124155 - DNA, 22 bp, Artificial Sequence
  chemically synthesized
ctttctattgtacactaaatat

SEQ ID NO: 124156 - DNA, 22 bp, Artificial Sequence
  chemically synthesized
tctattgtacactaaatatagt

SEQ ID NO: 124157 - DNA, 22 bp, Artificial Sequence
  chemically synthesized
ctattgtacactaaatatagtc

SEQ ID NO: 124158 - DNA, 22 bp, Artificial Sequence
  chemically synthesized
tattgtacactaaatatagtct

SEQ ID NO: 124159 - DNA, 22 bp, Artificial Sequence
  chemically synthesized
ttgtacactaaatatagtctgg

SEQ ID NO: 124160 - DNA, 22 bp, Artificial Sequence
  chemically synthesized
tacactaaatatagtctggatg

SEQ ID NO: 124161 - DNA, 22 bp, Artificial Sequence
  chemically synthesized
aatatagtctggatgtattgca

SEQ ID NO: 124162 - DNA, 22 bp, Artificial Sequence
  chemically synthesized
gatgtattgcatatggtcccta

SEQ ID NO: 124163 - DNA, 22 bp, Artificial Sequence
  chemically synthesized
catatggtccctagtttttaat

SEQ ID NO: 124164 - DNA, 22 bp, Artificial Sequence
  chemically synthesized
gtttttaatagaatcctcatga

SEQ ID NO: 124165 - DNA, 22 bp, Artificial Sequence
  chemically synthesized
ttaatagaatcctcatgaaaat

SEQ ID NO: 124166 - DNA, 22 bp, Artificial Sequence
  chemically synthesized
taatagaatcctcatgaaaatg

SEQ ID NO: 124167 - DNA, 22 bp, Artificial Sequence
  chemically synthesized
aatagaatcctcatgaaaatgc

SEQ ID NO: 124168 - DNA, 22 bp, Artificial Sequence
  chemically synthesized
atagaatcctcatgaaaatgct

SEQ ID NO: 124169 - DNA, 22 bp, Artificial Sequence
  chemically synthesized
atgaaaatgctactttcccgct

SEQ ID NO: 124170 - DNA, 22 bp, Artificial Sequence
  chemically synthesized
ctttcccgctttccaataacag

SEQ ID NO: 124171 - DNA, 22 bp, Artificial Sequence
  chemically synthesized
tcccgctttccaataacagaat

SEQ ID NO: 124172 - DNA, 22 bp, Artificial Sequence
  chemically synthesized
cccgctttccaataacagaatg

SEQ ID NO: 124173 - DNA, 22 bp, Artificial Sequence
  chemically synthesized
ccgctttccaataacagaatga

SEQ ID NO: 124174 - DNA, 22 bp, Artificial Sequence
  chemically synthesized
tccaataacagaatgatggaaa

SEQ ID NO: 124175 - DNA, 22 bp, Artificial Sequence
  chemically synthesized
ccaataacagaatgatggaaag

SEQ ID NO: 124176 - DNA, 22 bp, Artificial Sequence
  chemically synthesized
caataacagaatgatggaaaga

SEQ ID NO: 124177 - DNA, 22 bp, Artificial Sequence
  chemically synthesized
cacaagtccaaacacaagcaaa

SEQ ID NO: 124178 - DNA, 22 bp, Artificial Sequence
  chemically synthesized
acaagtccaaacacaagcaaat

SEQ ID NO: 124179 - DNA, 22 bp, Artificial Sequence
  chemically synthesized
ttctttttctgtgtcacataag

SEQ ID NO: 124180 - DNA, 22 bp, Artificial Sequence
  chemically synthesized
tttttctgtgtcacataagatt

SEQ ID NO: 124181 - DNA, 22 bp, Artificial Sequence
  chemically synthesized
tttctgtgtcacataagattcc

SEQ ID NO: 124182 - DNA, 22 bp, Artificial Sequence
  chemically synthesized
ttctgtgtcacataagattcca

SEQ ID NO: 124183 - DNA, 22 bp, Artificial Sequence
  chemically synthesized
tctgtgtcacataagattccag

SEQ ID NO: 124184 - DNA, 22 bp, Artificial Sequence
  chemically synthesized
ctgtgtcacataagattccaga

SEQ ID NO: 124185 - DNA, 22 bp, Artificial Sequence
  chemically synthesized
tgtgtcacataagattccagac

SEQ ID NO: 124186 - DNA, 22 bp, Artificial Sequence
  chemically synthesized
tgtcacataagattccagacaa

SEQ ID NO: 124187 - DNA, 22 bp, Artificial Sequence
  chemically synthesized
cagacaatataatcttagtagt

SEQ ID NO: 124188 - DNA, 22 bp, Artificial Sequence
  chemically synthesized
agtagtatctatgagaaaaatc

SEQ ID NO: 124189 - DNA, 22 bp, Artificial Sequence
  chemically synthesized
gtagtatctatgagaaaaatct

SEQ ID NO: 124190 - DNA, 22 bp, Artificial Sequence
  chemically synthesized
tgagaaaaatctacctcaatat

SEQ ID NO: 124191 - DNA, 22 bp, Artificial Sequence
  chemically synthesized
cctcaatatatcttctttctgc

SEQ ID NO: 124192 - DNA, 22 bp, Artificial Sequence
  chemically synthesized
aatatatcttctttctgcattc

SEQ ID NO: 124193 - DNA, 22 bp, Artificial Sequence
  chemically synthesized
ctttctgcattcacactcaaaa

SEQ ID NO: 124194 - DNA, 22 bp, Artificial Sequence
  chemically synthesized
tttctgcattcacactcaaaaa

SEQ ID NO: 124195 - DNA, 22 bp, Artificial Sequence
  chemically synthesized
tctgcattcacactcaaaaact

SEQ ID NO: 124196 - DNA, 22 bp, Artificial Sequence
  chemically synthesized
ctgcattcacactcaaaaactt

SEQ ID NO: 124197 - DNA, 22 bp, Artificial Sequence
  chemically synthesized
tgcattcacactcaaaaacttg

SEQ ID NO: 124198 - DNA, 22 bp, Artificial Sequence
  chemically synthesized
cattcacactcaaaaacttggt

SEQ ID NO: 124199 - DNA, 22 bp, Artificial Sequence
  chemically synthesized
acactcaaaaacttggtatctg

SEQ ID NO: 124200 - DNA, 22 bp, Artificial Sequence
  chemically synthesized
aaaaacttggtatctgtgcttg

SEQ ID NO: 124201 - DNA, 22 bp, Artificial Sequence
  chemically synthesized
ggtatctgtgcttggtttaata

SEQ ID NO: 124202 - DNA, 22 bp, Artificial Sequence
  chemically synthesized
gtatctgtgcttggtttaataa

SEQ ID NO: 124203 - DNA, 22 bp, Artificial Sequence
  chemically synthesized
tgcttggtttaataaaagtagt

SEQ ID NO: 124204 - DNA, 22 bp, Artificial Sequence
  chemically synthesized
ggtttaataaaagtagtgagtg

SEQ ID NO: 124205 - DNA, 22 bp, Artificial Sequence
  chemically synthesized
gtttaataaaagtagtgagtgt

SEQ ID NO: 124206 - DNA, 22 bp, Artificial Sequence
  chemically synthesized
aataaaagtagtgagtgtacct

SEQ ID NO: 124207 - DNA, 22 bp, Artificial Sequence
  chemically synthesized
ataaaagtagtgagtgtacctc

SEQ ID NO: 124208 - DNA, 22 bp, Artificial Sequence
  chemically synthesized
atggagctgagtggtggtgatg

SEQ ID NO: 124209 - DNA, 22 bp, Artificial Sequence
  chemically synthesized
agtggtggtgatgtgtgtttat

SEQ ID NO: 124210 - DNA, 22 bp, Artificial Sequence
  chemically synthesized
atgattgtgtgtgtggcgcttt

SEQ ID NO: 124211 - DNA, 22 bp, Artificial Sequence
  chemically synthesized
tgattgtgtgtgtggcgctttt

SEQ ID NO: 124212 - DNA, 22 bp, Artificial Sequence
  chemically synthesized
tgtgtgtggcgcttttgtgtga

SEQ ID NO: 124213 - DNA, 22 bp, Artificial Sequence
  chemically synthesized
ttgtgtgagagagagagtgtgt

SEQ ID NO: 124214 - DNA, 22 bp, Artificial Sequence
  chemically synthesized
tgtgtgagagagagagtgtgtg

SEQ ID NO: 124215 - DNA, 22 bp, Artificial Sequence
  chemically synthesized
gtgtgagagagagagtgtgtgt

SEQ ID NO: 124216 - DNA, 22 bp, Artificial Sequence
  chemically synthesized
tgtgagagagagagtgtgtgtg

SEQ ID NO: 124217 - DNA, 22 bp, Artificial Sequence
  chemically synthesized
agggcttaaaggaacaattaat

SEQ ID NO: 124218 - DNA, 22 bp, Artificial Sequence
  chemically synthesized
aaaggaacaattaattggtgat

SEQ ID NO: 124219 - DNA, 22 bp, Artificial Sequence
  chemically synthesized
aaggaacaattaattggtgatt

SEQ ID NO: 124220 - DNA, 22 bp, Artificial Sequence
  chemically synthesized
attggtgattaggatcatgtac

SEQ ID NO: 124221 - DNA, 22 bp, Artificial Sequence
  chemically synthesized
gtgattaggatcatgtactcaa

SEQ ID NO: 124222 - DNA, 22 bp, Artificial Sequence
  chemically synthesized
ggatcatgtactcaacaccata

SEQ ID NO: 124223 - DNA, 22 bp, Artificial Sequence
  chemically synthesized
aacaccatagcttgaagtaaaa

SEQ ID NO: 124224 - DNA, 22 bp, Artificial Sequence
  chemically synthesized
gaagtaaaaaaaaacaaaaacc

SEQ ID NO: 124225 - DNA, 22 bp, Artificial Sequence
  chemically synthesized
aagtaaaaaaaaacaaaaacca

SEQ ID NO: 124226 - DNA, 22 bp, Artificial Sequence
  chemically synthesized
taattccaatactgctgcatca

SEQ ID NO: 124227 - DNA, 22 bp, Artificial Sequence
  chemically synthesized
caatactgctgcatcatgactt

SEQ ID NO: 124228 - DNA, 22 bp, Artificial Sequence
  chemically synthesized
ctgcatcatgacttgaaaaacg

SEQ ID NO: 124229 - DNA, 22 bp, Artificial Sequence
  chemically synthesized
catcatgacttgaaaaacgatg

SEQ ID NO: 124230 - DNA, 22 bp, Artificial Sequence
  chemically synthesized
gaaaaacgatgtctgtccactc

SEQ ID NO: 124231 - DNA, 22 bp, Artificial Sequence
  chemically synthesized
aaaaacgatgtctgtccactca

SEQ ID NO: 124232 - DNA, 22 bp, Artificial Sequence
  chemically synthesized
tccactcaccggtgtgtgtgtg

SEQ ID NO: 124233 - DNA, 22 bp, Artificial Sequence
  chemically synthesized
accggtgtgtgtgtgtgtgtgt

SEQ ID NO: 124234 - DNA, 22 bp, Artificial Sequence
  chemically synthesized
ggttcgttgtggggaaacactt

SEQ ID NO: 124235 - DNA, 22 bp, Artificial Sequence
  chemically synthesized
gttgtggggaaacacttgagat

SEQ ID NO: 124236 - DNA, 22 bp, Artificial Sequence
  chemically synthesized
tggggaaacacttgagatcctg

SEQ ID NO: 124237 - DNA, 22 bp, Artificial Sequence
  chemically synthesized
gagatcctgtattgatgaaaaa

SEQ ID NO: 124238 - DNA, 22 bp, Artificial Sequence
  chemically synthesized
agatcctgtattgatgaaaaat

SEQ ID NO: 124239 - DNA, 22 bp, Artificial Sequence
  chemically synthesized
tattgatgaaaaatgatttctc

SEQ ID NO: 124240 - DNA, 22 bp, Artificial Sequence
  chemically synthesized
atgaaaaatgatttctccagac

SEQ ID NO: 124241 - DNA, 22 bp, Artificial Sequence
  chemically synthesized
ctccagactaatcattctgttc

SEQ ID NO: 124242 - DNA, 22 bp, Artificial Sequence
  chemically synthesized
tccagactaatcattctgttcg

SEQ ID NO: 124243 - DNA, 22 bp, Artificial Sequence
  chemically synthesized
cagactaatcattctgttcgta

SEQ ID NO: 124244 - DNA, 22 bp, Artificial Sequence
  chemically synthesized
atcattctgttcgtaaaacttt

SEQ ID NO: 124245 - DNA, 22 bp, Artificial Sequence
  chemically synthesized
tgttcgtaaaactttgagtttt

SEQ ID NO: 124246 - DNA, 22 bp, Artificial Sequence
  chemically synthesized
ttcgtaaaactttgagttttga

SEQ ID NO: 124247 - DNA, 22 bp, Artificial Sequence
  chemically synthesized
gtaaaactttgagttttgaaga

SEQ ID NO: 124248 - DNA, 22 bp, Artificial Sequence
  chemically synthesized
tgagttttgaagacactcaggg

SEQ ID NO: 124249 - DNA, 22 bp, Artificial Sequence
  chemically synthesized
gagttttgaagacactcagggt

SEQ ID NO: 124250 - DNA, 22 bp, Artificial Sequence
  chemically synthesized
agttttgaagacactcagggtc

SEQ ID NO: 124251 - DNA, 22 bp, Artificial Sequence
  chemically synthesized
tgaagacactcagggtctcttt

SEQ ID NO: 124252 - DNA, 22 bp, Artificial Sequence
  chemically synthesized
gaagacactcagggtctctttc

SEQ ID NO: 124253 - DNA, 22 bp, Artificial Sequence
  chemically synthesized
aagacactcagggtctctttct

SEQ ID NO: 124254 - DNA, 22 bp, Artificial Sequence
  chemically synthesized
agggtctctttcttcccttaag

SEQ ID NO: 124255 - DNA, 22 bp, Artificial Sequence
  chemically synthesized
tttcttcccttaagctttctct

SEQ ID NO: 124256 - DNA, 22 bp, Artificial Sequence
  chemically synthesized
tcttcccttaagctttctctca

SEQ ID NO: 124257 - DNA, 22 bp, Artificial Sequence
  chemically synthesized
cttcccttaagctttctctcat

SEQ ID NO: 124258 - DNA, 22 bp, Artificial Sequence
  chemically synthesized
ttcccttaagctttctctcatg

SEQ ID NO: 124259 - DNA, 22 bp, Artificial Sequence
  chemically synthesized
cccttaagctttctctcatgga

SEQ ID NO: 124260 - DNA, 22 bp, Artificial Sequence
  chemically synthesized
ccttaagctttctctcatggag

SEQ ID NO: 124261 - DNA, 22 bp, Artificial Sequence
  chemically synthesized
aagctttctctcatggaggaat

SEQ ID NO: 124262 - DNA, 22 bp, Artificial Sequence
  chemically synthesized
agctttctctcatggaggaatg

SEQ ID NO: 124263 - DNA, 22 bp, Artificial Sequence
  chemically synthesized
tctctcatggaggaatgccact

SEQ ID NO: 124264 - DNA, 22 bp, Artificial Sequence
  chemically synthesized
ctctcatggaggaatgccactc

SEQ ID NO: 124265 - DNA, 22 bp, Artificial Sequence
  chemically synthesized
tctcatggaggaatgccactca

SEQ ID NO: 124266 - DNA, 22 bp, Artificial Sequence
  chemically synthesized
tcatggaggaatgccactcaga

SEQ ID NO: 124267 - DNA, 22 bp, Artificial Sequence
  chemically synthesized
atggaggaatgccactcagaca

SEQ ID NO: 124268 - DNA, 22 bp, Artificial Sequence
  chemically synthesized
agacatctacttagcacatttt

SEQ ID NO: 124269 - DNA, 22 bp, Artificial Sequence
  chemically synthesized
cttagcacattttacaacactt

SEQ ID NO: 124270 - DNA, 22 bp, Artificial Sequence
  chemically synthesized
agcacattttacaacacttgca

SEQ ID NO: 124271 - DNA, 22 bp, Artificial Sequence
  chemically synthesized
gcacattttacaacacttgcat

SEQ ID NO: 124272 - DNA, 22 bp, Artificial Sequence
  chemically synthesized
tacaacacttgcatttccttgg

SEQ ID NO: 124273 - DNA, 22 bp, Artificial Sequence
  chemically synthesized
acaacacttgcatttccttggg

SEQ ID NO: 124274 - DNA, 22 bp, Artificial Sequence
  chemically synthesized
caacacttgcatttccttgggc

SEQ ID NO: 124275 - DNA, 22 bp, Artificial Sequence
  chemically synthesized
gcatttccttgggctccttttc

SEQ ID NO: 124276 - DNA, 22 bp, Artificial Sequence
  chemically synthesized
catttccttgggctccttttcc

SEQ ID NO: 124277 - DNA, 22 bp, Artificial Sequence
  chemically synthesized
ccttgggctccttttccttgtt

SEQ ID NO: 124278 - DNA, 22 bp, Artificial Sequence
  chemically synthesized
cttgggctccttttccttgttt

SEQ ID NO: 124279 - DNA, 22 bp, Artificial Sequence
  chemically synthesized
gggctccttttccttgttttca

SEQ ID NO: 124280 - DNA, 22 bp, Artificial Sequence
  chemically synthesized
ggctccttttccttgttttcaa

SEQ ID NO: 124281 - DNA, 22 bp, Artificial Sequence
  chemically synthesized
cttttccttgttttcaaccttc

SEQ ID NO: 124282 - DNA, 22 bp, Artificial Sequence
  chemically synthesized
ttccttgttttcaaccttcatg

SEQ ID NO: 124283 - DNA, 22 bp, Artificial Sequence
  chemically synthesized
tccttgttttcaaccttcatgc

SEQ ID NO: 124284 - DNA, 22 bp, Artificial Sequence
  chemically synthesized
ccttgttttcaaccttcatgcc

SEQ ID NO: 124285 - DNA, 22 bp, Artificial Sequence
  chemically synthesized
cttgttttcaaccttcatgccc

SEQ ID NO: 124286 - DNA, 22 bp, Artificial Sequence
  chemically synthesized
gttttcaaccttcatgccccaa

SEQ ID NO: 124287 - DNA, 22 bp, Artificial Sequence
  chemically synthesized
ttttcaaccttcatgccccaat

SEQ ID NO: 124288 - DNA, 22 bp, Artificial Sequence
  chemically synthesized
tcaaccttcatgccccaatccc

SEQ ID NO: 124289 - DNA, 22 bp, Artificial Sequence
  chemically synthesized
caaccttcatgccccaatccct

SEQ ID NO: 124290 - DNA, 22 bp, Artificial Sequence
  chemically synthesized
aaccttcatgccccaatccctg

SEQ ID NO: 124291 - DNA, 22 bp, Artificial Sequence
  chemically synthesized
catgccccaatccctgcctaac

SEQ ID NO: 124292 - DNA, 22 bp, Artificial Sequence
  chemically synthesized
atgccccaatccctgcctaact

SEQ ID NO: 124293 - DNA, 22 bp, Artificial Sequence
  chemically synthesized
cctaacttctattatttctttt

SEQ ID NO: 124294 - DNA, 22 bp, Artificial Sequence
  chemically synthesized
acttctattatttctttttttt

SEQ ID NO: 124295 - DNA, 22 bp, Artificial Sequence
  chemically synthesized
ctattatttctttttttttttt

SEQ ID NO: 124296 - DNA, 22 bp, Artificial Sequence
  chemically synthesized
tattatttctttttttttttta

SEQ ID NO: 124297 - DNA, 22 bp, Artificial Sequence
  chemically synthesized
ttatttcttttttttttttaat

SEQ ID NO: 124298 - DNA, 22 bp, Artificial Sequence
  chemically synthesized
tttcttttttttttttaatgcc

SEQ ID NO: 124299 - DNA, 22 bp, Artificial Sequence
  chemically synthesized
cttttttttttttaatgccata

SEQ ID NO: 124300 - DNA, 22 bp, Artificial Sequence
  chemically synthesized
ttttttttttttaatgccatac

SEQ ID NO: 124301 - DNA, 22 bp, Artificial Sequence
  chemically synthesized
ttttttttttaatgccatacat

SEQ ID NO: 124302 - DNA, 22 bp, Artificial Sequence
  chemically synthesized
tttttttttaatgccatacatc

SEQ ID NO: 124303 - DNA, 22 bp, Artificial Sequence
  chemically synthesized
ttttttttaatgccatacatct

SEQ ID NO: 124304 - DNA, 22 bp, Artificial Sequence
  chemically synthesized
tttttttaatgccatacatctg

SEQ ID NO: 124305 - DNA, 22 bp, Artificial Sequence
  chemically synthesized
ttttttaatgccatacatctgc

SEQ ID NO: 124306 - DNA, 22 bp, Artificial Sequence
  chemically synthesized
tttttaatgccatacatctgca

SEQ ID NO: 124307 - DNA, 22 bp, Artificial Sequence
  chemically synthesized
ttttaatgccatacatctgcat

SEQ ID NO: 124308 - DNA, 22 bp, Artificial Sequence
  chemically synthesized
tttaatgccatacatctgcatt

SEQ ID NO: 124309 - DNA, 22 bp, Artificial Sequence
  chemically synthesized
ttaatgccatacatctgcattt

SEQ ID NO: 124310 - DNA, 22 bp, Artificial Sequence
  chemically synthesized
taatgccatacatctgcattta

SEQ ID NO: 124311 - DNA, 22 bp, Artificial Sequence
  chemically synthesized
aatgccatacatctgcatttat

SEQ ID NO: 124312 - DNA, 22 bp, Artificial Sequence
  chemically synthesized
atgccatacatctgcatttatt

SEQ ID NO: 124313 - DNA, 22 bp, Artificial Sequence
  chemically synthesized
catttattataagcaacaggcg

SEQ ID NO: 124314 - DNA, 22 bp, Artificial Sequence
  chemically synthesized
attataagcaacaggcgggaca

SEQ ID NO: 124315 - DNA, 22 bp, Artificial Sequence
  chemically synthesized
ttataagcaacaggcgggacac

SEQ ID NO: 124316 - DNA, 22 bp, Artificial Sequence
  chemically synthesized
taagcaacaggcgggacacttc

SEQ ID NO: 124317 - DNA, 22 bp, Artificial Sequence
  chemically synthesized
ccagcaatagaaagaaaactta

SEQ ID NO: 124318 - DNA, 22 bp, Artificial Sequence
  chemically synthesized
cagcaatagaaagaaaacttaa

SEQ ID NO: 124319 - DNA, 22 bp, Artificial Sequence
  chemically synthesized
aatttacaaaagcagggattca

SEQ ID NO: 124320 - DNA, 22 bp, Artificial Sequence
  chemically synthesized
atttacaaaagcagggattcag

SEQ ID NO: 124321 - DNA, 22 bp, Artificial Sequence
  chemically synthesized
acaaaagcagggattcagtgaa

SEQ ID NO: 124322 - DNA, 22 bp, Artificial Sequence
  chemically synthesized
caaaagcagggattcagtgaag

SEQ ID NO: 124323 - DNA, 22 bp, Artificial Sequence
  chemically synthesized
agtgaagccacctggttgttac

SEQ ID NO: 124324 - DNA, 22 bp, Artificial Sequence
  chemically synthesized
gttgttactcttgggcactcac

SEQ ID NO: 124325 - DNA, 22 bp, Artificial Sequence
  chemically synthesized
ttactcttgggcactcacatgt

SEQ ID NO: 124326 - DNA, 22 bp, Artificial Sequence
  chemically synthesized
ctcttgggcactcacatgtaga

SEQ ID NO: 124327 - DNA, 22 bp, Artificial Sequence
  chemically synthesized
ttgggcactcacatgtagatgc

SEQ ID NO: 124328 - DNA, 22 bp, Artificial Sequence
  chemically synthesized
gggcactcacatgtagatgcca

SEQ ID NO: 124329 - DNA, 22 bp, Artificial Sequence
  chemically synthesized
ggcactcacatgtagatgccaa

SEQ ID NO: 124330 - DNA, 22 bp, Artificial Sequence
  chemically synthesized
acatgtagatgccaacccagag

SEQ ID NO: 124331 - DNA, 22 bp, Artificial Sequence
  chemically synthesized
caaagcccatgaagagtgaggc

SEQ ID NO: 124332 - DNA, 22 bp, Artificial Sequence
  chemically synthesized
aaagcccatgaagagtgaggcc

SEQ ID NO: 124333 - DNA, 22 bp, Artificial Sequence
  chemically synthesized
tttatagatatcacaagtgtac

SEQ ID NO: 124334 - DNA, 22 bp, Artificial Sequence
  chemically synthesized
tatagatatcacaagtgtactt

SEQ ID NO: 124335 - DNA, 22 bp, Artificial Sequence
  chemically synthesized
atagatatcacaagtgtacttg

SEQ ID NO: 124336 - DNA, 22 bp, Artificial Sequence
  chemically synthesized
tagatatcacaagtgtacttgg

SEQ ID NO: 124337 - DNA, 22 bp, Artificial Sequence
  chemically synthesized
ggtagaggtgacctcgtaaaca

SEQ ID NO: 124338 - DNA, 22 bp, Artificial Sequence
  chemically synthesized
gtagaggtgacctcgtaaacaa

SEQ ID NO: 124339 - DNA, 22 bp, Artificial Sequence
  chemically synthesized
gtaaacaaagaaccaggtggtg

SEQ ID NO: 124340 - DNA, 22 bp, Artificial Sequence
  chemically synthesized
tacaatcagatgggggaagaca

SEQ ID NO: 124341 - DNA, 22 bp, Artificial Sequence
  chemically synthesized
caatcagatgggggaagacagc

SEQ ID NO: 124342 - DNA, 22 bp, Artificial Sequence
  chemically synthesized
ggttgaccgggctgttgtatct

SEQ ID NO: 124343 - DNA, 22 bp, Artificial Sequence
  chemically synthesized
accgggctgttgtatctgctca

SEQ ID NO: 124344 - DNA, 22 bp, Artificial Sequence
  chemically synthesized
ttgtatctgctcatggccttga

SEQ ID NO: 124345 - DNA, 22 bp, Artificial Sequence
  chemically synthesized
tatctgctcatggccttgagct

SEQ ID NO: 124346 - DNA, 22 bp, Artificial Sequence
  chemically synthesized
ctcatggccttgagctccattt

SEQ ID NO: 124347 - DNA, 22 bp, Artificial Sequence
  chemically synthesized
atggccttgagctccattttgc

SEQ ID NO: 124348 - DNA, 22 bp, Artificial Sequence
  chemically synthesized
gagctccattttgccccagcag

SEQ ID NO: 124349 - DNA, 22 bp, Artificial Sequence
  chemically synthesized
agctccattttgccccagcagg

SEQ ID NO: 124350 - DNA, 22 bp, Artificial Sequence
  chemically synthesized
cattttgccccagcaggctaag

SEQ ID NO: 124351 - DNA, 22 bp, Artificial Sequence
  chemically synthesized
tgccccagcaggctaagccacc

SEQ ID NO: 124352 - DNA, 22 bp, Artificial Sequence
  chemically synthesized
gccccagcaggctaagccacca

SEQ ID NO: 124353 - DNA, 22 bp, Artificial Sequence
  chemically synthesized
ccccagcaggctaagccaccac

SEQ ID NO: 124354 - DNA, 22 bp, Artificial Sequence
  chemically synthesized
agccaccactctgccaccagaa

SEQ ID NO: 124355 - DNA, 22 bp, Artificial Sequence
  chemically synthesized
tgccaccagaagacttctgtta

SEQ ID NO: 124356 - DNA, 22 bp, Artificial Sequence
  chemically synthesized
ccaccagaagacttctgttatt

SEQ ID NO: 124357 - DNA, 22 bp, Artificial Sequence
  chemically synthesized
ctgttatttcttatcttttgct

SEQ ID NO: 124358 - DNA, 22 bp, Artificial Sequence
  chemically synthesized
tgttatttcttatcttttgctt

SEQ ID NO: 124359 - DNA, 22 bp, Artificial Sequence
  chemically synthesized
ttatttcttatcttttgctttc

SEQ ID NO: 124360 - DNA, 22 bp, Artificial Sequence
  chemically synthesized
tttcttatcttttgctttcctg

SEQ ID NO: 124361 - DNA, 22 bp, Artificial Sequence
  chemically synthesized
cttatcttttgctttcctgact

SEQ ID NO: 124362 - DNA, 22 bp, Artificial Sequence
  chemically synthesized
ttatcttttgctttcctgactt

SEQ ID NO: 124363 - DNA, 22 bp, Artificial Sequence
  chemically synthesized
atcttttgctttcctgacttca

SEQ ID NO: 124364 - DNA, 22 bp, Artificial Sequence
  chemically synthesized
tcttttgctttcctgacttcat

SEQ ID NO: 124365 - DNA, 22 bp, Artificial Sequence
  chemically synthesized
ttgctttcctgacttcatctct

SEQ ID NO: 124366 - DNA, 22 bp, Artificial Sequence
  chemically synthesized
tgctttcctgacttcatctctg

SEQ ID NO: 124367 - DNA, 22 bp, Artificial Sequence
  chemically synthesized
gctttcctgacttcatctctgc

SEQ ID NO: 124368 - DNA, 22 bp, Artificial Sequence
  chemically synthesized
ctttcctgacttcatctctgct

SEQ ID NO: 124369 - DNA, 22 bp, Artificial Sequence
  chemically synthesized
tcctgacttcatctctgctctc

SEQ ID NO: 124370 - DNA, 22 bp, Artificial Sequence
  chemically synthesized
cctgacttcatctctgctctct

SEQ ID NO: 124371 - DNA, 22 bp, Artificial Sequence
  chemically synthesized
ctgacttcatctctgctctctg

SEQ ID NO: 124372 - DNA, 22 bp, Artificial Sequence
  chemically synthesized
acttcatctctgctctctgact

SEQ ID NO: 124373 - DNA, 22 bp, Artificial Sequence
  chemically synthesized
catctctgctctctgactaggt

SEQ ID NO: 124374 - DNA, 22 bp, Artificial Sequence
  chemically synthesized
atctctgctctctgactaggta

SEQ ID NO: 124375 - DNA, 22 bp, Artificial Sequence
  chemically synthesized
tgctctctgactaggtaattat

SEQ ID NO: 124376 - DNA, 22 bp, Artificial Sequence
  chemically synthesized
ctctctgactaggtaattatat

SEQ ID NO: 124377 - DNA, 22 bp, Artificial Sequence
  chemically synthesized
tctgactaggtaattatatcta

SEQ ID NO: 124378 - DNA, 22 bp, Artificial Sequence
  chemically synthesized
tgactaggtaattatatctaac

SEQ ID NO: 124379 - DNA, 22 bp, Artificial Sequence
  chemically synthesized
actaggtaattatatctaacaa

SEQ ID NO: 124380 - DNA, 22 bp, Artificial Sequence
  chemically synthesized
ggtaattatatctaacaatgtt

SEQ ID NO: 124381 - DNA, 22 bp, Artificial Sequence
  chemically synthesized
tatctaacaatgttatctattc

SEQ ID NO: 124382 - DNA, 22 bp, Artificial Sequence
  chemically synthesized
acaatgttatctattctgattc

SEQ ID NO: 124383 - DNA, 22 bp, Artificial Sequence
  chemically synthesized
tctattctgattcatagtatcc

SEQ ID NO: 124384 - DNA, 22 bp, Artificial Sequence
  chemically synthesized
ttctgattcatagtatccagta

SEQ ID NO: 124385 - DNA, 22 bp, Artificial Sequence
  chemically synthesized
tgattcatagtatccagtagac

SEQ ID NO: 124386 - DNA, 22 bp, Artificial Sequence
  chemically synthesized
attcatagtatccagtagacct

SEQ ID NO: 124387 - DNA, 22 bp, Artificial Sequence
  chemically synthesized
atagtatccagtagacctgatt

SEQ ID NO: 124388 - DNA, 22 bp, Artificial Sequence
  chemically synthesized
atttaatcatcacattctcatt

SEQ ID NO: 124389 - DNA, 22 bp, Artificial Sequence
  chemically synthesized
aatcatcacattctcattataa

SEQ ID NO: 124390 - DNA, 22 bp, Artificial Sequence
  chemically synthesized
atcatcacattctcattataag

SEQ ID NO: 124391 - DNA, 22 bp, Artificial Sequence
  chemically synthesized
tcattataaggctcaacaacta

SEQ ID NO: 124392 - DNA, 22 bp, Artificial Sequence
  chemically synthesized
attataaggctcaacaactaat

SEQ ID NO: 124393 - DNA, 22 bp, Artificial Sequence
  chemically synthesized
taaggctcaacaactaatgttc

SEQ ID NO: 124394 - DNA, 22 bp, Artificial Sequence
  chemically synthesized
aacaactaatgttcacaatttt

SEQ ID NO: 124395 - DNA, 22 bp, Artificial Sequence
  chemically synthesized
atgttcacaattttccaaagcc

SEQ ID NO: 124396 - DNA, 22 bp, Artificial Sequence
  chemically synthesized
acaattttccaaagccatagac

SEQ ID NO: 124397 - DNA, 22 bp, Artificial Sequence
  chemically synthesized
tccaaagccatagactgatcat

SEQ ID NO: 124398 - DNA, 22 bp, Artificial Sequence
  chemically synthesized
ccaaagccatagactgatcatc

SEQ ID NO: 124399 - DNA, 22 bp, Artificial Sequence
  chemically synthesized
caaagccatagactgatcatct

SEQ ID NO: 124400 - DNA, 22 bp, Artificial Sequence
  chemically synthesized
atcatctgatctacaaatacac

SEQ ID NO: 124401 - DNA, 22 bp, Artificial Sequence
  chemically synthesized
atctacaaatacactaaattcc

SEQ ID NO: 124402 - DNA, 22 bp, Artificial Sequence
  chemically synthesized
caaatacactaaattcctgacc

SEQ ID NO: 124403 - DNA, 22 bp, Artificial Sequence
  chemically synthesized
aattcctgaccatcttcgtagt

SEQ ID NO: 124404 - DNA, 22 bp, Artificial Sequence
  chemically synthesized
ctgaccatcttcgtagttgatt

SEQ ID NO: 124405 - DNA, 22 bp, Artificial Sequence
  chemically synthesized
accatcttcgtagttgattatg

SEQ ID NO: 124406 - DNA, 22 bp, Artificial Sequence
  chemically synthesized
cgtagttgattatggctctgaa

SEQ ID NO: 124407 - DNA, 22 bp, Artificial Sequence
  chemically synthesized
gtagttgattatggctctgaat

SEQ ID NO: 124408 - DNA, 22 bp, Artificial Sequence
  chemically synthesized
attatggctctgaatggctttt

SEQ ID NO: 124409 - DNA, 22 bp, Artificial Sequence
  chemically synthesized
tggctctgaatggctttttgcc

SEQ ID NO: 124410 - DNA, 22 bp, Artificial Sequence
  chemically synthesized
tgaatggctttttgcccaaagc

SEQ ID NO: 124411 - DNA, 22 bp, Artificial Sequence
  chemically synthesized
aatggctttttgcccaaagcat

SEQ ID NO: 124412 - DNA, 22 bp, Artificial Sequence
  chemically synthesized
tttgcccaaagcatccagcacc

SEQ ID NO: 124413 - DNA, 22 bp, Artificial Sequence
  chemically synthesized
ttgcccaaagcatccagcacca

SEQ ID NO: 124414 - DNA, 22 bp, Artificial Sequence
  chemically synthesized
tgcccaaagcatccagcaccat

SEQ ID NO: 124415 - DNA, 22 bp, Artificial Sequence
  chemically synthesized
gcccaaagcatccagcaccatt

SEQ ID NO: 124416 - DNA, 22 bp, Artificial Sequence
  chemically synthesized
cccaaagcatccagcaccattt

SEQ ID NO: 124417 - DNA, 22 bp, Artificial Sequence
  chemically synthesized
tcatctgggtagtttcccctgc

SEQ ID NO: 124418 - DNA, 22 bp, Artificial Sequence
  chemically synthesized
catctgggtagtttcccctgct

SEQ ID NO: 124419 - DNA, 22 bp, Artificial Sequence
  chemically synthesized
atctgggtagtttcccctgctg

SEQ ID NO: 124420 - DNA, 22 bp, Artificial Sequence
  chemically synthesized
ggtagtttcccctgctggtaaa

SEQ ID NO: 124421 - DNA, 22 bp, Artificial Sequence
  chemically synthesized
cccctgctggtaaaaatagtaa

SEQ ID NO: 124422 - DNA, 22 bp, Artificial Sequence
  chemically synthesized
ccctgctggtaaaaatagtaaa

SEQ ID NO: 124423 - DNA, 22 bp, Artificial Sequence
  chemically synthesized
ctggtaaaaatagtaaacactt

SEQ ID NO: 124424 - DNA, 22 bp, Artificial Sequence
  chemically synthesized
gtaaaaatagtaaacacttttc

SEQ ID NO: 124425 - DNA, 22 bp, Artificial Sequence
  chemically synthesized
ttccttatctactcccatcccc

SEQ ID NO: 124426 - DNA, 22 bp, Artificial Sequence
  chemically synthesized
tccttatctactcccatccccc

SEQ ID NO: 124427 - DNA, 22 bp, Artificial Sequence
  chemically synthesized
ccttatctactcccatcccccg

SEQ ID NO: 124428 - DNA, 22 bp, Artificial Sequence
  chemically synthesized
cttatctactcccatcccccga

SEQ ID NO: 124429 - DNA, 22 bp, Artificial Sequence
  chemically synthesized
atctactcccatcccccgacag

SEQ ID NO: 124430 - DNA, 22 bp, Artificial Sequence
  chemically synthesized
tctactcccatcccccgacaga

SEQ ID NO: 124431 - DNA, 22 bp, Artificial Sequence
  chemically synthesized
ctcccatcccccgacagaaaca

SEQ ID NO: 124432 - DNA, 22 bp, Artificial Sequence
  chemically synthesized
ccatcccccgacagaaacacgg

SEQ ID NO: 124433 - DNA, 22 bp, Artificial Sequence
  chemically synthesized
tcactctctatctgggtgtggt

SEQ ID NO: 124434 - DNA, 22 bp, Artificial Sequence
  chemically synthesized
tctatctgggtgtggttgagat

SEQ ID NO: 124435 - DNA, 22 bp, Artificial Sequence
  chemically synthesized
tatctgggtgtggttgagatct

SEQ ID NO: 124436 - DNA, 22 bp, Artificial Sequence
  chemically synthesized
tctgggtgtggttgagatcttc

SEQ ID NO: 124437 - DNA, 22 bp, Artificial Sequence
  chemically synthesized
ggtgtggttgagatcttcaaaa

SEQ ID NO: 124438 - DNA, 22 bp, Artificial Sequence
  chemically synthesized
agatcttcaaaatctgcagtgc

SEQ ID NO: 124439 - DNA, 22 bp, Artificial Sequence
  chemically synthesized
caaaatctgcagtgctgatagc

SEQ ID NO: 124440 - DNA, 22 bp, Artificial Sequence
  chemically synthesized
aaaatctgcagtgctgatagct

SEQ ID NO: 124441 - DNA, 22 bp, Artificial Sequence
  chemically synthesized
cagtgctgatagctcagcatgg

SEQ ID NO: 124442 - DNA, 22 bp, Artificial Sequence
  chemically synthesized
atagctcagcatggaatgaagt

SEQ ID NO: 124443 - DNA, 22 bp, Artificial Sequence
  chemically synthesized
agcatggaatgaagtgaaccaa

SEQ ID NO: 124444 - DNA, 22 bp, Artificial Sequence
  chemically synthesized
tctctgactttggtttataagg

SEQ ID NO: 124445 - DNA, 22 bp, Artificial Sequence
  chemically synthesized
tctgactttggtttataaggat

SEQ ID NO: 124446 - DNA, 22 bp, Artificial Sequence
  chemically synthesized
tgactttggtttataaggattt

SEQ ID NO: 124447 - DNA, 22 bp, Artificial Sequence
  chemically synthesized
actttggtttataaggatttgc

SEQ ID NO: 124448 - DNA, 22 bp, Artificial Sequence
  chemically synthesized
tggtttataaggatttgcatac

SEQ ID NO: 124449 - DNA, 22 bp, Artificial Sequence
  chemically synthesized
ggtttataaggatttgcataca

SEQ ID NO: 124450 - DNA, 22 bp, Artificial Sequence
  chemically synthesized
gtttataaggatttgcatacat

SEQ ID NO: 124451 - DNA, 22 bp, Artificial Sequence
  chemically synthesized
ataaggatttgcatacattttc

SEQ ID NO: 124452 - DNA, 22 bp, Artificial Sequence
  chemically synthesized
taaggatttgcatacattttct

SEQ ID NO: 124453 - DNA, 22 bp, Artificial Sequence
  chemically synthesized
gcatacattttctgatggatac

SEQ ID NO: 124454 - DNA, 22 bp, Artificial Sequence
  chemically synthesized
catacattttctgatggatact

SEQ ID NO: 124455 - DNA, 22 bp, Artificial Sequence
  chemically synthesized
tctgatggatactaggctcatt

SEQ ID NO: 124456 - DNA, 22 bp, Artificial Sequence
  chemically synthesized
ctgatggatactaggctcattt

SEQ ID NO: 124457 - DNA, 22 bp, Artificial Sequence
  chemically synthesized
tgatggatactaggctcatttc

SEQ ID NO: 124458 - DNA, 22 bp, Artificial Sequence
  chemically synthesized
atggatactaggctcatttctg

SEQ ID NO: 124459 - DNA, 22 bp, Artificial Sequence
  chemically synthesized
ggctcatttctgggaatatgca

SEQ ID NO: 124460 - DNA, 22 bp, Artificial Sequence
  chemically synthesized
atttctgggaatatgcagcaat

SEQ ID NO: 124461 - DNA, 22 bp, Artificial Sequence
  chemically synthesized
ctgggaatatgcagcaatttaa

SEQ ID NO: 124462 - DNA, 22 bp, Artificial Sequence
  chemically synthesized
tgggaatatgcagcaatttaaa

SEQ ID NO: 124463 - DNA, 22 bp, Artificial Sequence
  chemically synthesized
ggaatatgcagcaatttaaagc

SEQ ID NO: 124464 - DNA, 22 bp, Artificial Sequence
  chemically synthesized
aaagcattgtgcctcatgtcaa

SEQ ID NO: 124465 - DNA, 22 bp, Artificial Sequence
  chemically synthesized
aagcattgtgcctcatgtcaaa

SEQ ID NO: 124466 - DNA, 22 bp, Artificial Sequence
  chemically synthesized
tgcctcatgtcaaagtttgctt

SEQ ID NO: 124467 - DNA, 22 bp, Artificial Sequence
  chemically synthesized
atgtcaaagtttgctttactca

SEQ ID NO: 124468 - DNA, 22 bp, Artificial Sequence
  chemically synthesized
gctttactcaatctgacactaa

SEQ ID NO: 124469 - DNA, 22 bp, Artificial Sequence
  chemically synthesized
ctttactcaatctgacactaat

SEQ ID NO: 124470 - DNA, 22 bp, Artificial Sequence
  chemically synthesized
tactcaatctgacactaatcta

SEQ ID NO: 124471 - DNA, 22 bp, Artificial Sequence
  chemically synthesized
actcaatctgacactaatctat

SEQ ID NO: 124472 - DNA, 22 bp, Artificial Sequence
  chemically synthesized
ctcaatctgacactaatctatt

SEQ ID NO: 124473 - DNA, 22 bp, Artificial Sequence
  chemically synthesized
aatctgacactaatctatttgg

SEQ ID NO: 124474 - DNA, 22 bp, Artificial Sequence
  chemically synthesized
acactaatctatttggtaagtt

SEQ ID NO: 124475 - DNA, 22 bp, Artificial Sequence
  chemically synthesized
atctatttggtaagtttttctt

SEQ ID NO: 124476 - DNA, 22 bp, Artificial Sequence
  chemically synthesized
tttggtaagtttttctttctgt

SEQ ID NO: 124477 - DNA, 22 bp, Artificial Sequence
  chemically synthesized
ggtaagtttttctttctgttag

SEQ ID NO: 124478 - DNA, 22 bp, Artificial Sequence
  chemically synthesized
gtaagtttttctttctgttagt

SEQ ID NO: 124479 - DNA, 22 bp, Artificial Sequence
  chemically synthesized
ttctttctgttagtctataccc

SEQ ID NO: 124480 - DNA, 22 bp, Artificial Sequence
  chemically synthesized
tctttctgttagtctataccct

SEQ ID NO: 124481 - DNA, 22 bp, Artificial Sequence
  chemically synthesized
ctttctgttagtctataccctt

SEQ ID NO: 124482 - DNA, 22 bp, Artificial Sequence
  chemically synthesized
tttctgttagtctatacccttg

SEQ ID NO: 124483 - DNA, 22 bp, Artificial Sequence
  chemically synthesized
tctgttagtctatacccttgtc

SEQ ID NO: 124484 - DNA, 22 bp, Artificial Sequence
  chemically synthesized
ctgttagtctatacccttgtca

SEQ ID NO: 124485 - DNA, 22 bp, Artificial Sequence
  chemically synthesized
tgttagtctatacccttgtcat

SEQ ID NO: 124486 - DNA, 22 bp, Artificial Sequence
  chemically synthesized
ttagtctatacccttgtcatta

SEQ ID NO: 124487 - DNA, 22 bp, Artificial Sequence
  chemically synthesized
gtctatacccttgtcattacag

SEQ ID NO: 124488 - DNA, 22 bp, Artificial Sequence
  chemically synthesized
tacccttgtcattacagtgtcc

SEQ ID NO: 124489 - DNA, 22 bp, Artificial Sequence
  chemically synthesized
gtcattacagtgtcccctatcc

SEQ ID NO: 124490 - DNA, 22 bp, Artificial Sequence
  chemically synthesized
tcattacagtgtcccctatcct

SEQ ID NO: 124491 - DNA, 22 bp, Artificial Sequence
  chemically synthesized
cagtgtcccctatcctcactct

SEQ ID NO: 124492 - DNA, 22 bp, Artificial Sequence
  chemically synthesized
tcctcactctaacttcatcttt

SEQ ID NO: 124493 - DNA, 22 bp, Artificial Sequence
  chemically synthesized
actctaacttcatcttttttgg

SEQ ID NO: 124494 - DNA, 22 bp, Artificial Sequence
  chemically synthesized
taacttcatcttttttgggagt

SEQ ID NO: 124495 - DNA, 22 bp, Artificial Sequence
  chemically synthesized
acttcatcttttttgggagtaa

SEQ ID NO: 124496 - DNA, 22 bp, Artificial Sequence
  chemically synthesized
catcttttttgggagtaagtac

SEQ ID NO: 124497 - DNA, 22 bp, Artificial Sequence
  chemically synthesized
atcttttttgggagtaagtact

SEQ ID NO: 124498 - DNA, 22 bp, Artificial Sequence
  chemically synthesized
ttttgggagtaagtacttggta

SEQ ID NO: 124499 - DNA, 22 bp, Artificial Sequence
  chemically synthesized
tttgggagtaagtacttggtag

SEQ ID NO: 124500 - DNA, 22 bp, Artificial Sequence
  chemically synthesized
ttgggagtaagtacttggtaga

SEQ ID NO: 124501 - DNA, 22 bp, Artificial Sequence
  chemically synthesized
tgggagtaagtacttggtagaa

SEQ ID NO: 124502 - DNA, 22 bp, Artificial Sequence
  chemically synthesized
gggagtaagtacttggtagaac

SEQ ID NO: 124503 - DNA, 22 bp, Artificial Sequence
  chemically synthesized
ggagtaagtacttggtagaaca

SEQ ID NO: 124504 - DNA, 22 bp, Artificial Sequence
  chemically synthesized
ggtagaacacatagaggcaaag

SEQ ID NO: 124505 - DNA, 22 bp, Artificial Sequence
  chemically synthesized
gtagaacacatagaggcaaaga

SEQ ID NO: 124506 - DNA, 22 bp, Artificial Sequence
  chemically synthesized
gtttatgcagcccgaagagagc

SEQ ID NO: 124507 - DNA, 22 bp, Artificial Sequence
  chemically synthesized
atgcagcccgaagagagcaaca

SEQ ID NO: 124508 - DNA, 22 bp, Artificial Sequence
  chemically synthesized
tgcagcccgaagagagcaacaa

SEQ ID NO: 124509 - DNA, 22 bp, Artificial Sequence
  chemically synthesized
gaactacaccagagatatcatt

SEQ ID NO: 124510 - DNA, 22 bp, Artificial Sequence
  chemically synthesized
caccagagatatcattctgtat

SEQ ID NO: 124511 - DNA, 22 bp, Artificial Sequence
  chemically synthesized
tgtattcccgtggattttcaac

SEQ ID NO: 124512 - DNA, 22 bp, Artificial Sequence
  chemically synthesized
tattcccgtggattttcaactt

SEQ ID NO: 124513 - DNA, 22 bp, Artificial Sequence
  chemically synthesized
ccgtggattttcaacttgattt

SEQ ID NO: 124514 - DNA, 22 bp, Artificial Sequence
  chemically synthesized
tcaacttgattttttcctaact

SEQ ID NO: 124515 - DNA, 22 bp, Artificial Sequence
  chemically synthesized
caacttgattttttcctaacta

SEQ ID NO: 124516 - DNA, 22 bp, Artificial Sequence
  chemically synthesized
aacttgattttttcctaactag

SEQ ID NO: 124517 - DNA, 22 bp, Artificial Sequence
  chemically synthesized
gattttttcctaactagatcac

SEQ ID NO: 124518 - DNA, 22 bp, Artificial Sequence
  chemically synthesized
attttttcctaactagatcact

SEQ ID NO: 124519 - DNA, 22 bp, Artificial Sequence
  chemically synthesized
tttcctaactagatcactctgc

SEQ ID NO: 124520 - DNA, 22 bp, Artificial Sequence
  chemically synthesized
ttcctaactagatcactctgct

SEQ ID NO: 124521 - DNA, 22 bp, Artificial Sequence
  chemically synthesized
tcctaactagatcactctgcta

SEQ ID NO: 124522 - DNA, 22 bp, Artificial Sequence
  chemically synthesized
cctaactagatcactctgctag

SEQ ID NO: 124523 - DNA, 22 bp, Artificial Sequence
  chemically synthesized
ctaactagatcactctgctagg

SEQ ID NO: 124524 - DNA, 22 bp, Artificial Sequence
  chemically synthesized
actagatcactctgctagggaa

SEQ ID NO: 124525 - DNA, 22 bp, Artificial Sequence
  chemically synthesized
gatcactctgctagggaatgaa

SEQ ID NO: 124526 - DNA, 22 bp, Artificial Sequence
  chemically synthesized
tgctagggaatgaaaaaggaga

SEQ ID NO: 124527 - DNA, 22 bp, Artificial Sequence
  chemically synthesized
ctagggaatgaaaaaggagatc

SEQ ID NO: 124528 - DNA, 22 bp, Artificial Sequence
  chemically synthesized
gggaatgaaaaaggagatctag

SEQ ID NO: 124529 - DNA, 22 bp, Artificial Sequence
  chemically synthesized
ggattttccctcttctaggaat

SEQ ID NO: 124530 - DNA, 22 bp, Artificial Sequence
  chemically synthesized
tccctcttctaggaatttgcaa

SEQ ID NO: 124531 - DNA, 22 bp, Artificial Sequence
  chemically synthesized
ccctcttctaggaatttgcaaa

SEQ ID NO: 124532 - DNA, 22 bp, Artificial Sequence
  chemically synthesized
cctcttctaggaatttgcaaaa

SEQ ID NO: 124533 - DNA, 22 bp, Artificial Sequence
  chemically synthesized
ttctaggaatttgcaaaagaga

SEQ ID NO: 124534 - DNA, 22 bp, Artificial Sequence
  chemically synthesized
ctaggaatttgcaaaagagatt

SEQ ID NO: 124535 - DNA, 22 bp, Artificial Sequence
  chemically synthesized
taggaatttgcaaaagagatta

SEQ ID NO: 124536 - DNA, 22 bp, Artificial Sequence
  chemically synthesized
ggaatttgcaaaagagattatt

SEQ ID NO: 124537 - DNA, 22 bp, Artificial Sequence
  chemically synthesized
gcaaaagagattattcagaagc

SEQ ID NO: 124538 - DNA, 22 bp, Artificial Sequence
  chemically synthesized
caaaagagattattcagaagcc

SEQ ID NO: 124539 - DNA, 22 bp, Artificial Sequence
  chemically synthesized
ttcagaagccaagttctaaaga

SEQ ID NO: 124540 - DNA, 22 bp, Artificial Sequence
  chemically synthesized
agaagccaagttctaaagattt

SEQ ID NO: 124541 - DNA, 22 bp, Artificial Sequence
  chemically synthesized
taaagattttagggagtctttg

SEQ ID NO: 124542 - DNA, 22 bp, Artificial Sequence
  chemically synthesized
aagattttagggagtctttggg

SEQ ID NO: 124543 - DNA, 22 bp, Artificial Sequence
  chemically synthesized
tagggagtctttgggatgatag

SEQ ID NO: 124544 - DNA, 22 bp, Artificial Sequence
  chemically synthesized
agggagtctttgggatgataga

SEQ ID NO: 124545 - DNA, 22 bp, Artificial Sequence
  chemically synthesized
gggagtctttgggatgatagat

SEQ ID NO: 124546 - DNA, 22 bp, Artificial Sequence
  chemically synthesized
tgggatgatagattcttatacc

SEQ ID NO: 124547 - DNA, 22 bp, Artificial Sequence
  chemically synthesized
gggatgatagattcttataccc

SEQ ID NO: 124548 - DNA, 22 bp, Artificial Sequence
  chemically synthesized
ggatgatagattcttatacccc

SEQ ID NO: 124549 - DNA, 22 bp, Artificial Sequence
  chemically synthesized
ttataccccatcacatcttgac

SEQ ID NO: 124550 - DNA, 22 bp, Artificial Sequence
  chemically synthesized
ataccccatcacatcttgactg

SEQ ID NO: 124551 - DNA, 22 bp, Artificial Sequence
  chemically synthesized
taccccatcacatcttgactga

SEQ ID NO: 124552 - DNA, 22 bp, Artificial Sequence
  chemically synthesized
gactgatacattactgcatttc

SEQ ID NO: 124553 - DNA, 22 bp, Artificial Sequence
  chemically synthesized
actgatacattactgcatttcc

SEQ ID NO: 124554 - DNA, 22 bp, Artificial Sequence
  chemically synthesized
atacattactgcatttccctct

SEQ ID NO: 124555 - DNA, 22 bp, Artificial Sequence
  chemically synthesized
ctgcatttccctctctgcaatc

SEQ ID NO: 124556 - DNA, 22 bp, Artificial Sequence
  chemically synthesized
catttccctctctgcaatctct

SEQ ID NO: 124557 - DNA, 22 bp, Artificial Sequence
  chemically synthesized
ccctctctgcaatctctgataa

SEQ ID NO: 124558 - DNA, 22 bp, Artificial Sequence
  chemically synthesized
cctctctgcaatctctgataag

SEQ ID NO: 124559 - DNA, 22 bp, Artificial Sequence
  chemically synthesized
tctgcaatctctgataagccaa

SEQ ID NO: 124560 - DNA, 22 bp, Artificial Sequence
  chemically synthesized
tgcaatctctgataagccaacc

SEQ ID NO: 124561 - DNA, 22 bp, Artificial Sequence
  chemically synthesized
caatctctgataagccaaccgt

SEQ ID NO: 124562 - DNA, 22 bp, Artificial Sequence
  chemically synthesized
tgataagccaaccgtctactgc

SEQ ID NO: 124563 - DNA, 22 bp, Artificial Sequence
  chemically synthesized
ataagccaaccgtctactgctc

SEQ ID NO: 124564 - DNA, 22 bp, Artificial Sequence
  chemically synthesized
ctgctcattcctatgcggagcc

SEQ ID NO: 124565 - DNA, 22 bp, Artificial Sequence
  chemically synthesized
ctcattcctatgcggagcctct

SEQ ID NO: 124566 - DNA, 22 bp, Artificial Sequence
  chemically synthesized
attcctatgcggagcctctagg

SEQ ID NO: 124567 - DNA, 22 bp, Artificial Sequence
  chemically synthesized
ctatgcggagcctctaggccaa

SEQ ID NO: 124568 - DNA, 22 bp, Artificial Sequence
  chemically synthesized
tgcggagcctctaggccaagac

SEQ ID NO: 124569 - DNA, 22 bp, Artificial Sequence
  chemically synthesized
taggccaagacacactggagtt

SEQ ID NO: 124570 - DNA, 22 bp, Artificial Sequence
  chemically synthesized
ggccaagacacactggagttct

SEQ ID NO: 124571 - DNA, 22 bp, Artificial Sequence
  chemically synthesized
gagttctttaccgacctgttca

SEQ ID NO: 124572 - DNA, 22 bp, Artificial Sequence
  chemically synthesized
tttaccgacctgttcataagtc

SEQ ID NO: 124573 - DNA, 22 bp, Artificial Sequence
  chemically synthesized
taccgacctgttcataagtctg

SEQ ID NO: 124574 - DNA, 22 bp, Artificial Sequence
  chemically synthesized
accgacctgttcataagtctgt

SEQ ID NO: 124575 - DNA, 22 bp, Artificial Sequence
  chemically synthesized
ccgacctgttcataagtctgtt

SEQ ID NO: 124576 - DNA, 22 bp, Artificial Sequence
  chemically synthesized
ttcataagtctgttcattgttg

SEQ ID NO: 124577 - DNA, 22 bp, Artificial Sequence
  chemically synthesized
ataagtctgttcattgttgcca

SEQ ID NO: 124578 - DNA, 22 bp, Artificial Sequence
  chemically synthesized
ttcattgttgccacagatgtga

SEQ ID NO: 124579 - DNA, 22 bp, Artificial Sequence
  chemically synthesized
attgttgccacagatgtgacta

SEQ ID NO: 124580 - DNA, 22 bp, Artificial Sequence
  chemically synthesized
ttgccacagatgtgactatgaa

SEQ ID NO: 124581 - DNA, 22 bp, Artificial Sequence
  chemically synthesized
ccacagatgtgactatgaaccc

SEQ ID NO: 124582 - DNA, 22 bp, Artificial Sequence
  chemically synthesized
tgaacccctaagcctggtcaag

SEQ ID NO: 124583 - DNA, 22 bp, Artificial Sequence
  chemically synthesized
agcctggtcaagatattggatc

SEQ ID NO: 124584 - DNA, 22 bp, Artificial Sequence
  chemically synthesized
gtcaagatattggatccaacac

SEQ ID NO: 124585 - DNA, 22 bp, Artificial Sequence
  chemically synthesized
gatccaacaccaactttttaga

SEQ ID NO: 124586 - DNA, 22 bp, Artificial Sequence
  chemically synthesized
tttagactatactcagaagcca

SEQ ID NO: 124587 - DNA, 22 bp, Artificial Sequence
  chemically synthesized
ttagactatactcagaagccaa

SEQ ID NO: 124588 - DNA, 22 bp, Artificial Sequence
  chemically synthesized
tagactatactcagaagccaag

SEQ ID NO: 124589 - DNA, 22 bp, Artificial Sequence
  chemically synthesized
agactatactcagaagccaagc

SEQ ID NO: 124590 - DNA, 22 bp, Artificial Sequence
  chemically synthesized
gactatactcagaagccaagct

SEQ ID NO: 124591 - DNA, 22 bp, Artificial Sequence
  chemically synthesized
tactcagaagccaagctgcaaa

SEQ ID NO: 124592 - DNA, 22 bp, Artificial Sequence
  chemically synthesized
agaagccaagctgcaaagaaaa

SEQ ID NO: 124593 - DNA, 22 bp, Artificial Sequence
  chemically synthesized
caaagaaaattagtttcagaaa

SEQ ID NO: 124594 - DNA, 22 bp, Artificial Sequence
  chemically synthesized
gtttcagaaactcctccctacg

SEQ ID NO: 124595 - DNA, 22 bp, Artificial Sequence
  chemically synthesized
cagaaactcctccctacggccc

SEQ ID NO: 124596 - DNA, 22 bp, Artificial Sequence
  chemically synthesized
agaaactcctccctacggccca

SEQ ID NO: 124597 - DNA, 22 bp, Artificial Sequence
  chemically synthesized
ctccctacggcccactcctctc

SEQ ID NO: 124598 - DNA, 22 bp, Artificial Sequence
  chemically synthesized
cctacggcccactcctctctcc

SEQ ID NO: 124599 - DNA, 22 bp, Artificial Sequence
  chemically synthesized
cggcccactcctctctcctccc

SEQ ID NO: 124600 - DNA, 22 bp, Artificial Sequence
  chemically synthesized
ctctctcctccctccttcttta

SEQ ID NO: 124601 - DNA, 22 bp, Artificial Sequence
  chemically synthesized
tctcctccctccttctttattc

SEQ ID NO: 124602 - DNA, 22 bp, Artificial Sequence
  chemically synthesized
tcctccctccttctttattctc

SEQ ID NO: 124603 - DNA, 22 bp, Artificial Sequence
  chemically synthesized
ctccctccttctttattctccc

SEQ ID NO: 124604 - DNA, 22 bp, Artificial Sequence
  chemically synthesized
cctccttctttattctcccagc

SEQ ID NO: 124605 - DNA, 22 bp, Artificial Sequence
  chemically synthesized
cttctttattctcccagcctga

SEQ ID NO: 124606 - DNA, 22 bp, Artificial Sequence
  chemically synthesized
ctttattctcccagcctgaggg

SEQ ID NO: 124607 - DNA, 22 bp, Artificial Sequence
  chemically synthesized
tttattctcccagcctgaggga

SEQ ID NO: 124608 - DNA, 22 bp, Artificial Sequence
  chemically synthesized
tattctcccagcctgagggatt

SEQ ID NO: 124609 - DNA, 22 bp, Artificial Sequence
  chemically synthesized
attctcccagcctgagggattt

SEQ ID NO: 124610 - DNA, 22 bp, Artificial Sequence
  chemically synthesized
ttctcccagcctgagggattta

SEQ ID NO: 124611 - DNA, 22 bp, Artificial Sequence
  chemically synthesized
tcccagcctgagggatttagaa

SEQ ID NO: 124612 - DNA, 22 bp, Artificial Sequence
  chemically synthesized
ccagcctgagggatttagaact

SEQ ID NO: 124613 - DNA, 22 bp, Artificial Sequence
  chemically synthesized
agggatttagaactttggaaca

SEQ ID NO: 124614 - DNA, 22 bp, Artificial Sequence
  chemically synthesized
agaactttggaacaggagtcgc

SEQ ID NO: 124615 - DNA, 22 bp, Artificial Sequence
  chemically synthesized
gaactttggaacaggagtcgct

SEQ ID NO: 124616 - DNA, 22 bp, Artificial Sequence
  chemically synthesized
tggaacaggagtcgctaaggtt

SEQ ID NO: 124617 - DNA, 22 bp, Artificial Sequence
  chemically synthesized
ggaacaggagtcgctaaggttt

SEQ ID NO: 124618 - DNA, 22 bp, Artificial Sequence
  chemically synthesized
gaacaggagtcgctaaggtttc

SEQ ID NO: 124619 - DNA, 22 bp, Artificial Sequence
  chemically synthesized
aggtttcttcctgcatctaggt

SEQ ID NO: 124620 - DNA, 22 bp, Artificial Sequence
  chemically synthesized
cttcctgcatctaggttaggga

SEQ ID NO: 124621 - DNA, 22 bp, Artificial Sequence
  chemically synthesized
ttcctgcatctaggttagggaa

SEQ ID NO: 124622 - DNA, 22 bp, Artificial Sequence
  chemically synthesized
cctgcatctaggttagggaatt

SEQ ID NO: 124623 - DNA, 22 bp, Artificial Sequence
  chemically synthesized
ctgcatctaggttagggaatta

SEQ ID NO: 124624 - DNA, 22 bp, Artificial Sequence
  chemically synthesized
catctaggttagggaattagcc

SEQ ID NO: 124625 - DNA, 22 bp, Artificial Sequence
  chemically synthesized
ggttagggaattagccacatct

SEQ ID NO: 124626 - DNA, 22 bp, Artificial Sequence
  chemically synthesized
gggaattagccacatctccaga

SEQ ID NO: 124627 - DNA, 22 bp, Artificial Sequence
  chemically synthesized
gccacatctccagaaataagat

SEQ ID NO: 124628 - DNA, 22 bp, Artificial Sequence
  chemically synthesized
cagaaataagatttattttaag

SEQ ID NO: 124629 - DNA, 22 bp, Artificial Sequence
  chemically synthesized
attttaagcatcacataggggt

SEQ ID NO: 124630 - DNA, 22 bp, Artificial Sequence
  chemically synthesized
ttttaagcatcacataggggta

SEQ ID NO: 124631 - DNA, 22 bp, Artificial Sequence
  chemically synthesized
taagcatcacataggggtagaa

SEQ ID NO: 124632 - DNA, 22 bp, Artificial Sequence
  chemically synthesized
aagcatcacataggggtagaaa

SEQ ID NO: 124633 - DNA, 22 bp, Artificial Sequence
  chemically synthesized
agcatcacataggggtagaaaa

SEQ ID NO: 124634 - DNA, 22 bp, Artificial Sequence
  chemically synthesized
tttgcagcagatttctttcttt

SEQ ID NO: 124635 - DNA, 22 bp, Artificial Sequence
  chemically synthesized
ttgcagcagatttctttctttc

SEQ ID NO: 124636 - DNA, 22 bp, Artificial Sequence
  chemically synthesized
tgcagcagatttctttctttct

SEQ ID NO: 124637 - DNA, 22 bp, Artificial Sequence
  chemically synthesized
gcagcagatttctttctttctt

SEQ ID NO: 124638 - DNA, 22 bp, Artificial Sequence
  chemically synthesized
cagcagatttctttctttcttt

SEQ ID NO: 124639 - DNA, 22 bp, Artificial Sequence
  chemically synthesized
ctttctttctttcttttattat

SEQ ID NO: 124640 - DNA, 22 bp, Artificial Sequence
  chemically synthesized
tttctttctttcttttattatt

SEQ ID NO: 124641 - DNA, 22 bp, Artificial Sequence
  chemically synthesized
tctttctttcttttattattat

SEQ ID NO: 124642 - DNA, 22 bp, Artificial Sequence
  chemically synthesized
ctttctttcttttattattata

SEQ ID NO: 124643 - DNA, 22 bp, Artificial Sequence
  chemically synthesized
tttctttcttttattattatac

SEQ ID NO: 124644 - DNA, 22 bp, Artificial Sequence
  chemically synthesized
tctttcttttattattatactt

SEQ ID NO: 124645 - DNA, 22 bp, Artificial Sequence
  chemically synthesized
ctttcttttattattatacttt

SEQ ID NO: 124646 - DNA, 22 bp, Artificial Sequence
  chemically synthesized
tttcttttattattatacttta

SEQ ID NO: 124647 - DNA, 22 bp, Artificial Sequence
  chemically synthesized
tcttttattattatactttaag

SEQ ID NO: 124648 - DNA, 22 bp, Artificial Sequence
  chemically synthesized
cttttattattatactttaagt

SEQ ID NO: 124649 - DNA, 22 bp, Artificial Sequence
  chemically synthesized
ttttattattatactttaagtt

SEQ ID NO: 124650 - DNA, 22 bp, Artificial Sequence
  chemically synthesized
ttattattatactttaagtttt

SEQ ID NO: 124651 - DNA, 22 bp, Artificial Sequence
  chemically synthesized
tattattatactttaagtttta

SEQ ID NO: 124652 - DNA, 22 bp, Artificial Sequence
  chemically synthesized
attattatactttaagttttag

SEQ ID NO: 124653 - DNA, 22 bp, Artificial Sequence
  chemically synthesized
ttattatactttaagttttagg

SEQ ID NO: 124654 - DNA, 22 bp, Artificial Sequence
  chemically synthesized
ttatactttaagttttagggta

SEQ ID NO: 124655 - DNA, 22 bp, Artificial Sequence
  chemically synthesized
tactttaagttttagggtacat

SEQ ID NO: 124656 - DNA, 22 bp, Artificial Sequence
  chemically synthesized
taagttttagggtacatttgca

SEQ ID NO: 124657 - DNA, 22 bp, Artificial Sequence
  chemically synthesized
aagttttagggtacatttgcac

SEQ ID NO: 124658 - DNA, 22 bp, Artificial Sequence
  chemically synthesized
agttttagggtacatttgcaca

SEQ ID NO: 124659 - DNA, 22 bp, Artificial Sequence
  chemically synthesized
tagggtacatttgcacaacgtg

SEQ ID NO: 124660 - DNA, 22 bp, Artificial Sequence
  chemically synthesized
agggtacatttgcacaacgtgc

SEQ ID NO: 124661 - DNA, 22 bp, Artificial Sequence
  chemically synthesized
gggtacatttgcacaacgtgca

SEQ ID NO: 124662 - DNA, 22 bp, Artificial Sequence
  chemically synthesized
gcacaacgtgcaggtttgttac

SEQ ID NO: 124663 - DNA, 22 bp, Artificial Sequence
  chemically synthesized
cacaacgtgcaggtttgttaca

SEQ ID NO: 124664 - DNA, 22 bp, Artificial Sequence
  chemically synthesized
gttacatatgtatacatgtgcc

SEQ ID NO: 124665 - DNA, 22 bp, Artificial Sequence
  chemically synthesized
ttacatatgtatacatgtgcca

SEQ ID NO: 124666 - DNA, 22 bp, Artificial Sequence
  chemically synthesized
catatgtatacatgtgccatgt

SEQ ID NO: 124667 - DNA, 22 bp, Artificial Sequence
  chemically synthesized
gtgtgctgcacccattaactcg

SEQ ID NO: 124668 - DNA, 22 bp, Artificial Sequence
  chemically synthesized
cacccattaactcgtcacttag

SEQ ID NO: 124669 - DNA, 22 bp, Artificial Sequence
  chemically synthesized
actcgtcacttagcattaggta

SEQ ID NO: 124670 - DNA, 22 bp, Artificial Sequence
  chemically synthesized
gtcacttagcattaggtatatc

SEQ ID NO: 124671 - DNA, 22 bp, Artificial Sequence
  chemically synthesized
agcattaggtatatctcctaat

SEQ ID NO: 124672 - DNA, 22 bp, Artificial Sequence
  chemically synthesized
gcattaggtatatctcctaatg

SEQ ID NO: 124673 - DNA, 22 bp, Artificial Sequence
  chemically synthesized
ggtatatctcctaatgctatcc

SEQ ID NO: 124674 - DNA, 22 bp, Artificial Sequence
  chemically synthesized
ctaatgctatccctccccccga

SEQ ID NO: 124675 - DNA, 22 bp, Artificial Sequence
  chemically synthesized
atgctatccctccccccgaccc

SEQ ID NO: 124676 - DNA, 22 bp, Artificial Sequence
  chemically synthesized
tccctccccccgacccccaccc

SEQ ID NO: 124677 - DNA, 22 bp, Artificial Sequence
  chemically synthesized
cccccgacccccaccccactgc

SEQ ID NO: 124678 - DNA, 22 bp, Artificial Sequence
  chemically synthesized
caggccctggtgtgtgatgttc

SEQ ID NO: 124679 - DNA, 22 bp, Artificial Sequence
  chemically synthesized
gtgtgtgatgttccccttcctg

SEQ ID NO: 124680 - DNA, 22 bp, Artificial Sequence
  chemically synthesized
cccttcctgtgtccatgtgttc

SEQ ID NO: 124681 - DNA, 22 bp, Artificial Sequence
  chemically synthesized
cctgtgtccatgtgttctcatt

SEQ ID NO: 124682 - DNA, 22 bp, Artificial Sequence
  chemically synthesized
ctgtgtccatgtgttctcattg

SEQ ID NO: 124683 - DNA, 22 bp, Artificial Sequence
  chemically synthesized
tgtccatgtgttctcattgttc

SEQ ID NO: 124684 - DNA, 22 bp, Artificial Sequence
  chemically synthesized
tcattgttcaattcccacctat

SEQ ID NO: 124685 - DNA, 22 bp, Artificial Sequence
  chemically synthesized
attgttcaattcccacctatga

SEQ ID NO: 124686 - DNA, 22 bp, Artificial Sequence
  chemically synthesized
ttcaattcccacctatgagtga

SEQ ID NO: 124687 - DNA, 22 bp, Artificial Sequence
  chemically synthesized
aattcccacctatgagtgagaa

SEQ ID NO: 124688 - DNA, 22 bp, Artificial Sequence
  chemically synthesized
ccacctatgagtgagaacatgc

SEQ ID NO: 124689 - DNA, 22 bp, Artificial Sequence
  chemically synthesized
tgagtgagaacatgcagtgttt

SEQ ID NO: 124690 - DNA, 22 bp, Artificial Sequence
  chemically synthesized
ggtttttgtccttgcgatagtt

SEQ ID NO: 124691 - DNA, 22 bp, Artificial Sequence
  chemically synthesized
gtttttgtccttgcgatagttt

SEQ ID NO: 124692 - DNA, 22 bp, Artificial Sequence
  chemically synthesized
ttgtccttgcgatagtttgctg

SEQ ID NO: 124693 - DNA, 22 bp, Artificial Sequence
  chemically synthesized
tgtccttgcgatagtttgctga

SEQ ID NO: 124694 - DNA, 22 bp, Artificial Sequence
  chemically synthesized
gtccttgcgatagtttgctgag

SEQ ID NO: 124695 - DNA, 22 bp, Artificial Sequence
  chemically synthesized
tccttgcgatagtttgctgaga

SEQ ID NO: 124696 - DNA, 22 bp, Artificial Sequence
  chemically synthesized
gcgatagtttgctgagaatgat

SEQ ID NO: 124697 - DNA, 22 bp, Artificial Sequence
  chemically synthesized
cgatagtttgctgagaatgatg

SEQ ID NO: 124698 - DNA, 22 bp, Artificial Sequence
  chemically synthesized
gctgagaatgatggtttccagc

SEQ ID NO: 124699 - DNA, 22 bp, Artificial Sequence
  chemically synthesized
ctgagaatgatggtttccagct

SEQ ID NO: 124700 - DNA, 22 bp, Artificial Sequence
  chemically synthesized
agaatgatggtttccagcttca

SEQ ID NO: 124701 - DNA, 22 bp, Artificial Sequence
  chemically synthesized
ccagcttcatccatgtccctac

SEQ ID NO: 124702 - DNA, 22 bp, Artificial Sequence
  chemically synthesized
cagcttcatccatgtccctaca

SEQ ID NO: 124703 - DNA, 22 bp, Artificial Sequence
  chemically synthesized
catccatgtccctacaaaggac

SEQ ID NO: 124704 - DNA, 22 bp, Artificial Sequence
  chemically synthesized
atccatgtccctacaaaggaca

SEQ ID NO: 124705 - DNA, 22 bp, Artificial Sequence
  chemically synthesized
caaaggacatgaactcttcatt

SEQ ID NO: 124706 - DNA, 22 bp, Artificial Sequence
  chemically synthesized
ttcattttttatggctgcatag

SEQ ID NO: 124707 - DNA, 22 bp, Artificial Sequence
  chemically synthesized
cattttttatggctgcatagta

SEQ ID NO: 124708 - DNA, 22 bp, Artificial Sequence
  chemically synthesized
attttttatggctgcatagtat

SEQ ID NO: 124709 - DNA, 22 bp, Artificial Sequence
  chemically synthesized
tttatggctgcatagtattcca

SEQ ID NO: 124710 - DNA, 22 bp, Artificial Sequence
  chemically synthesized
ttatggctgcatagtattccat

SEQ ID NO: 124711 - DNA, 22 bp, Artificial Sequence
  chemically synthesized
tatggctgcatagtattccatg

SEQ ID NO: 124712 - DNA, 22 bp, Artificial Sequence
  chemically synthesized
atggctgcatagtattccatgg

SEQ ID NO: 124713 - DNA, 22 bp, Artificial Sequence
  chemically synthesized
tggctgcatagtattccatggt

SEQ ID NO: 124714 - DNA, 22 bp, Artificial Sequence
  chemically synthesized
catagtattccatggtgtatat

SEQ ID NO: 124715 - DNA, 22 bp, Artificial Sequence
  chemically synthesized
catggtgtatatgtgccacgtt

SEQ ID NO: 124716 - DNA, 22 bp, Artificial Sequence
  chemically synthesized
tcttaatccagtctatcattgt

SEQ ID NO: 124717 - DNA, 22 bp, Artificial Sequence
  chemically synthesized
cttaatccagtctatcattgtt

SEQ ID NO: 124718 - DNA, 22 bp, Artificial Sequence
  chemically synthesized
ttaatccagtctatcattgttg

SEQ ID NO: 124719 - DNA, 22 bp, Artificial Sequence
  chemically synthesized
aatccagtctatcattgttgga

SEQ ID NO: 124720 - DNA, 22 bp, Artificial Sequence
  chemically synthesized
atccagtctatcattgttggac

SEQ ID NO: 124721 - DNA, 22 bp, Artificial Sequence
  chemically synthesized
tcattgttggacatttgggttg

SEQ ID NO: 124722 - DNA, 22 bp, Artificial Sequence
  chemically synthesized
ttggacatttgggttggttcca

SEQ ID NO: 124723 - DNA, 22 bp, Artificial Sequence
  chemically synthesized
gacatttgggttggttccaagt

SEQ ID NO: 124724 - DNA, 22 bp, Artificial Sequence
  chemically synthesized
gggttggttccaagtctttgct

SEQ ID NO: 124725 - DNA, 22 bp, Artificial Sequence
  chemically synthesized
ggttggttccaagtctttgcta

SEQ ID NO: 124726 - DNA, 22 bp, Artificial Sequence
  chemically synthesized
gttccaagtctttgctattgtg

SEQ ID NO: 124727 - DNA, 22 bp, Artificial Sequence
  chemically synthesized
caagtctttgctattgtgaata

SEQ ID NO: 124728 - DNA, 22 bp, Artificial Sequence
  chemically synthesized
tgctattgtgaatagtgccaca

SEQ ID NO: 124729 - DNA, 22 bp, Artificial Sequence
  chemically synthesized
gctattgtgaatagtgccacaa

SEQ ID NO: 124730 - DNA, 22 bp, Artificial Sequence
  chemically synthesized
ctattgtgaatagtgccacaat

SEQ ID NO: 124731 - DNA, 22 bp, Artificial Sequence
  chemically synthesized
ttgtgaatagtgccacaataaa

SEQ ID NO: 124732 - DNA, 22 bp, Artificial Sequence
  chemically synthesized
tgaatagtgccacaataaacat

SEQ ID NO: 124733 - DNA, 22 bp, Artificial Sequence
  chemically synthesized
tatagcagcatgatttataatc

SEQ ID NO: 124734 - DNA, 22 bp, Artificial Sequence
  chemically synthesized
atagcagcatgatttataatcc

SEQ ID NO: 124735 - DNA, 22 bp, Artificial Sequence
  chemically synthesized
tagcagcatgatttataatcct

SEQ ID NO: 124736 - DNA, 22 bp, Artificial Sequence
  chemically synthesized
ataatcctttgagtatgtaccc

SEQ ID NO: 124737 - DNA, 22 bp, Artificial Sequence
  chemically synthesized
taatcctttgagtatgtaccca

SEQ ID NO: 124738 - DNA, 22 bp, Artificial Sequence
  chemically synthesized
tgagtatgtacccagtaatggg

SEQ ID NO: 124739 - DNA, 22 bp, Artificial Sequence
  chemically synthesized
gagtatgtacccagtaatggga

SEQ ID NO: 124740 - DNA, 22 bp, Artificial Sequence
  chemically synthesized
agtatgtacccagtaatgggat

SEQ ID NO: 124741 - DNA, 22 bp, Artificial Sequence
  chemically synthesized
ggtcaaatggtatttctagttc

SEQ ID NO: 124742 - DNA, 22 bp, Artificial Sequence
  chemically synthesized
ctagttctagatccctgaggaa

SEQ ID NO: 124743 - DNA, 22 bp, Artificial Sequence
  chemically synthesized
tagttctagatccctgaggaat

SEQ ID NO: 124744 - DNA, 22 bp, Artificial Sequence
  chemically synthesized
gttctagatccctgaggaatcg

SEQ ID NO: 124745 - DNA, 22 bp, Artificial Sequence
  chemically synthesized
tagatccctgaggaatcgccac

SEQ ID NO: 124746 - DNA, 22 bp, Artificial Sequence
  chemically synthesized
gatccctgaggaatcgccacac

SEQ ID NO: 124747 - DNA, 22 bp, Artificial Sequence
  chemically synthesized
aggaatcgccacactgacttcc

SEQ ID NO: 124748 - DNA, 22 bp, Artificial Sequence
  chemically synthesized
acttccacaatggttgaactag

SEQ ID NO: 124749 - DNA, 22 bp, Artificial Sequence
  chemically synthesized
ccacaatggttgaactagttta

SEQ ID NO: 124750 - DNA, 22 bp, Artificial Sequence
  chemically synthesized
cacaatggttgaactagtttac

SEQ ID NO: 124751 - DNA, 22 bp, Artificial Sequence
  chemically synthesized
aactagtttacagtctcaccaa

SEQ ID NO: 124752 - DNA, 22 bp, Artificial Sequence
  chemically synthesized
gtttacagtctcaccaacagtg

SEQ ID NO: 124753 - DNA, 22 bp, Artificial Sequence
  chemically synthesized
acagtctcaccaacagtgtaaa

SEQ ID NO: 124754 - DNA, 22 bp, Artificial Sequence
  chemically synthesized
cagtctcaccaacagtgtaaaa

SEQ ID NO: 124755 - DNA, 22 bp, Artificial Sequence
  chemically synthesized
accaacagtgtaaaagtgttcc

SEQ ID NO: 124756 - DNA, 22 bp, Artificial Sequence
  chemically synthesized
ctacttcttcacatcctctcca

SEQ ID NO: 124757 - DNA, 22 bp, Artificial Sequence
  chemically synthesized
cttcttcacatcctctccagca

SEQ ID NO: 124758 - DNA, 22 bp, Artificial Sequence
  chemically synthesized
cttcacatcctctccagcacct

SEQ ID NO: 124759 - DNA, 22 bp, Artificial Sequence
  chemically synthesized
ttcacatcctctccagcacctg

SEQ ID NO: 124760 - DNA, 22 bp, Artificial Sequence
  chemically synthesized
cacatcctctccagcacctgtt

SEQ ID NO: 124761 - DNA, 22 bp, Artificial Sequence
  chemically synthesized
acatcctctccagcacctgttg

SEQ ID NO: 124762 - DNA, 22 bp, Artificial Sequence
  chemically synthesized
tccagcacctgttgtttcctga

SEQ ID NO: 124763 - DNA, 22 bp, Artificial Sequence
  chemically synthesized
cagcacctgttgtttcctgact

SEQ ID NO: 124764 - DNA, 22 bp, Artificial Sequence
  chemically synthesized
ttgtttcctgactttttaatga

SEQ ID NO: 124765 - DNA, 22 bp, Artificial Sequence
  chemically synthesized
tttcctgactttttaatgatcg

SEQ ID NO: 124766 - DNA, 22 bp, Artificial Sequence
  chemically synthesized
cctgactttttaatgatcgcca

SEQ ID NO: 124767 - DNA, 22 bp, Artificial Sequence
  chemically synthesized
ctgactttttaatgatcgccat

SEQ ID NO: 124768 - DNA, 22 bp, Artificial Sequence
  chemically synthesized
actttttaatgatcgccattct

SEQ ID NO: 124769 - DNA, 22 bp, Artificial Sequence
  chemically synthesized
tttaatgatcgccattctaact

SEQ ID NO: 124770 - DNA, 22 bp, Artificial Sequence
  chemically synthesized
ttaatgatcgccattctaactg

SEQ ID NO: 124771 - DNA, 22 bp, Artificial Sequence
  chemically synthesized
taatgatcgccattctaactgg

SEQ ID NO: 124772 - DNA, 22 bp, Artificial Sequence
  chemically synthesized
aatgatcgccattctaactggt

SEQ ID NO: 124773 - DNA, 22 bp, Artificial Sequence
  chemically synthesized
atgatcgccattctaactggtg

SEQ ID NO: 124774 - DNA, 22 bp, Artificial Sequence
  chemically synthesized
taactggtgtgagatggtatct

SEQ ID NO: 124775 - DNA, 22 bp, Artificial Sequence
  chemically synthesized
actggtgtgagatggtatctca

SEQ ID NO: 124776 - DNA, 22 bp, Artificial Sequence
  chemically synthesized
gtgtgagatggtatctcactgt

SEQ ID NO: 124777 - DNA, 22 bp, Artificial Sequence
  chemically synthesized
actgtggttttgatttgtattt

SEQ ID NO: 124778 - DNA, 22 bp, Artificial Sequence
  chemically synthesized
tggttttgatttgtatttctct

SEQ ID NO: 124779 - DNA, 22 bp, Artificial Sequence
  chemically synthesized
tgatttgtatttctctgatggc

SEQ ID NO: 124780 - DNA, 22 bp, Artificial Sequence
  chemically synthesized
gatttgtatttctctgatggcc

SEQ ID NO: 124781 - DNA, 22 bp, Artificial Sequence
  chemically synthesized
atttgtatttctctgatggcca

SEQ ID NO: 124782 - DNA, 22 bp, Artificial Sequence
  chemically synthesized
gtatttctctgatggccagtga

SEQ ID NO: 124783 - DNA, 22 bp, Artificial Sequence
  chemically synthesized
tatttctctgatggccagtgat

SEQ ID NO: 124784 - DNA, 22 bp, Artificial Sequence
  chemically synthesized
ctctgatggccagtgatgatga

SEQ ID NO: 124785 - DNA, 22 bp, Artificial Sequence
  chemically synthesized
tctgatggccagtgatgatgag

SEQ ID NO: 124786 - DNA, 22 bp, Artificial Sequence
  chemically synthesized
tgatggccagtgatgatgagca

SEQ ID NO: 124787 - DNA, 22 bp, Artificial Sequence
  chemically synthesized
atggccagtgatgatgagcatt

SEQ ID NO: 124788 - DNA, 22 bp, Artificial Sequence
  chemically synthesized
tttcatgtgtctgttgactgca

SEQ ID NO: 124789 - DNA, 22 bp, Artificial Sequence
  chemically synthesized
ttcatgtgtctgttgactgcat

SEQ ID NO: 124790 - DNA, 22 bp, Artificial Sequence
  chemically synthesized
tcatgtgtctgttgactgcata

SEQ ID NO: 124791 - DNA, 22 bp, Artificial Sequence
  chemically synthesized
catgtgtctgttgactgcataa

SEQ ID NO: 124792 - DNA, 22 bp, Artificial Sequence
  chemically synthesized
atgtgtctgttgactgcataaa

SEQ ID NO: 124793 - DNA, 22 bp, Artificial Sequence
  chemically synthesized
ttgactgcataaatgtcttctt

SEQ ID NO: 124794 - DNA, 22 bp, Artificial Sequence
  chemically synthesized
actgcataaatgtcttcttttg

SEQ ID NO: 124795 - DNA, 22 bp, Artificial Sequence
  chemically synthesized
cataaatgtcttcttttgagaa

SEQ ID NO: 124796 - DNA, 22 bp, Artificial Sequence
  chemically synthesized
cttttgagaagtgtctgttcat

SEQ ID NO: 124797 - DNA, 22 bp, Artificial Sequence
  chemically synthesized
ttttgagaagtgtctgttcata

SEQ ID NO: 124798 - DNA, 22 bp, Artificial Sequence
  chemically synthesized
ttgagaagtgtctgttcatatc

SEQ ID NO: 124799 - DNA, 22 bp, Artificial Sequence
  chemically synthesized
tgagaagtgtctgttcatatcc

SEQ ID NO: 124800 - DNA, 22 bp, Artificial Sequence
  chemically synthesized
gagaagtgtctgttcatatcct

SEQ ID NO: 124801 - DNA, 22 bp, Artificial Sequence
  chemically synthesized
agaagtgtctgttcatatcctt

SEQ ID NO: 124802 - DNA, 22 bp, Artificial Sequence
  chemically synthesized
ttcatatcctttgcccactttt

SEQ ID NO: 124803 - DNA, 22 bp, Artificial Sequence
  chemically synthesized
atatcctttgcccactttttga

SEQ ID NO: 124804 - DNA, 22 bp, Artificial Sequence
  chemically synthesized
tgcccactttttgatggggttg

SEQ ID NO: 124805 - DNA, 22 bp, Artificial Sequence
  chemically synthesized
gcccactttttgatggggttgt

SEQ ID NO: 124806 - DNA, 22 bp, Artificial Sequence
  chemically synthesized
cccactttttgatggggttgtt

SEQ ID NO: 124807 - DNA, 22 bp, Artificial Sequence
  chemically synthesized
tttgatggggttgtttttttct

SEQ ID NO: 124808 - DNA, 22 bp, Artificial Sequence
  chemically synthesized
ttgatggggttgtttttttctt

SEQ ID NO: 124809 - DNA, 22 bp, Artificial Sequence
  chemically synthesized
tgatggggttgtttttttcttg

SEQ ID NO: 124810 - DNA, 22 bp, Artificial Sequence
  chemically synthesized
gatggggttgtttttttcttgt

SEQ ID NO: 124811 - DNA, 22 bp, Artificial Sequence
  chemically synthesized
atggggttgtttttttcttgta

SEQ ID NO: 124812 - DNA, 22 bp, Artificial Sequence
  chemically synthesized
tttttttcttgtaaatttgttt

SEQ ID NO: 124813 - DNA, 22 bp, Artificial Sequence
  chemically synthesized
ttttcttgtaaatttgtttgag

SEQ ID NO: 124814 - DNA, 22 bp, Artificial Sequence
  chemically synthesized
tttcttgtaaatttgtttgagt

SEQ ID NO: 124815 - DNA, 22 bp, Artificial Sequence
  chemically synthesized
ttcttgtaaatttgtttgagtt

SEQ ID NO: 124816 - DNA, 22 bp, Artificial Sequence
  chemically synthesized
tcttgtaaatttgtttgagttc

SEQ ID NO: 124817 - DNA, 22 bp, Artificial Sequence
  chemically synthesized
cttgtaaatttgtttgagttca

SEQ ID NO: 124818 - DNA, 22 bp, Artificial Sequence
  chemically synthesized
ttgtaaatttgtttgagttcat

SEQ ID NO: 124819 - DNA, 22 bp, Artificial Sequence
  chemically synthesized
gtaaatttgtttgagttcatca

SEQ ID NO: 124820 - DNA, 22 bp, Artificial Sequence
  chemically synthesized
taaatttgtttgagttcatcat

SEQ ID NO: 124821 - DNA, 22 bp, Artificial Sequence
  chemically synthesized
gtttgagttcatcatagattct

SEQ ID NO: 124822 - DNA, 22 bp, Artificial Sequence
  chemically synthesized
tttgagttcatcatagattctg

SEQ ID NO: 124823 - DNA, 22 bp, Artificial Sequence
  chemically synthesized
gagttcatcatagattctggat

SEQ ID NO: 124824 - DNA, 22 bp, Artificial Sequence
  chemically synthesized
agttcatcatagattctggata

SEQ ID NO: 124825 - DNA, 22 bp, Artificial Sequence
  chemically synthesized
atcatagattctggatattagc

SEQ ID NO: 124826 - DNA, 22 bp, Artificial Sequence
  chemically synthesized
tggatattagccctttgtcgga

SEQ ID NO: 124827 - DNA, 22 bp, Artificial Sequence
  chemically synthesized
gatattagccctttgtcggatg

SEQ ID NO: 124828 - DNA, 22 bp, Artificial Sequence
  chemically synthesized
gccctttgtcggatgagtagat

SEQ ID NO: 124829 - DNA, 22 bp, Artificial Sequence
  chemically synthesized
tgtcggatgagtagattgcaaa

SEQ ID NO: 124830 - DNA, 22 bp, Artificial Sequence
  chemically synthesized
gtcggatgagtagattgcaaaa

SEQ ID NO: 124831 - DNA, 22 bp, Artificial Sequence
  chemically synthesized
tcggatgagtagattgcaaaaa

SEQ ID NO: 124832 - DNA, 22 bp, Artificial Sequence
  chemically synthesized
caaaaattttctcccattctgt

SEQ ID NO: 124833 - DNA, 22 bp, Artificial Sequence
  chemically synthesized
tctcccattctgtatgttgcct

SEQ ID NO: 124834 - DNA, 22 bp, Artificial Sequence
  chemically synthesized
ctcccattctgtatgttgcctg

SEQ ID NO: 124835 - DNA, 22 bp, Artificial Sequence
  chemically synthesized
tcccattctgtatgttgcctgt

SEQ ID NO: 124836 - DNA, 22 bp, Artificial Sequence
  chemically synthesized
ccattctgtatgttgcctgttc

SEQ ID NO: 124837 - DNA, 22 bp, Artificial Sequence
  chemically synthesized
tgtatgttgcctgttcactctg

SEQ ID NO: 124838 - DNA, 22 bp, Artificial Sequence
  chemically synthesized
tatgttgcctgttcactctgat

SEQ ID NO: 124839 - DNA, 22 bp, Artificial Sequence
  chemically synthesized
cctgttcactctgatggtagtt

SEQ ID NO: 124840 - DNA, 22 bp, Artificial Sequence
  chemically synthesized
ttcactctgatggtagtttctt

SEQ ID NO: 124841 - DNA, 22 bp, Artificial Sequence
  chemically synthesized
actctgatggtagtttcttttg

SEQ ID NO: 124842 - DNA, 22 bp, Artificial Sequence
  chemically synthesized
tgatggtagtttcttttgctgt

SEQ ID NO: 124843 - DNA, 22 bp, Artificial Sequence
  chemically synthesized
atggtagtttcttttgctgtgc

SEQ ID NO: 124844 - DNA, 22 bp, Artificial Sequence
  chemically synthesized
cttttgctgtgcagaagctctt

SEQ ID NO: 124845 - DNA, 22 bp, Artificial Sequence
  chemically synthesized
ttttgctgtgcagaagctcttt

SEQ ID NO: 124846 - DNA, 22 bp, Artificial Sequence
  chemically synthesized
ttgctgtgcagaagctctttag

SEQ ID NO: 124847 - DNA, 22 bp, Artificial Sequence
  chemically synthesized
tgctgtgcagaagctctttagt

SEQ ID NO: 124848 - DNA, 22 bp, Artificial Sequence
  chemically synthesized
gctgtgcagaagctctttagtt

SEQ ID NO: 124849 - DNA, 22 bp, Artificial Sequence
  chemically synthesized
ctgtgcagaagctctttagttt

SEQ ID NO: 124850 - DNA, 22 bp, Artificial Sequence
  chemically synthesized
tgcagaagctctttagtttaat

SEQ ID NO: 124851 - DNA, 22 bp, Artificial Sequence
  chemically synthesized
tttagtttaattagatcccatt

SEQ ID NO: 124852 - DNA, 22 bp, Artificial Sequence
  chemically synthesized
tagtttaattagatcccatttg

SEQ ID NO: 124853 - DNA, 22 bp, Artificial Sequence
  chemically synthesized
agtttaattagatcccatttgt

SEQ ID NO: 124854 - DNA, 22 bp, Artificial Sequence
  chemically synthesized
gtttaattagatcccatttgtc

SEQ ID NO: 124855 - DNA, 22 bp, Artificial Sequence
  chemically synthesized
aattagatcccatttgtccatt

SEQ ID NO: 124856 - DNA, 22 bp, Artificial Sequence
  chemically synthesized
attagatcccatttgtccattt

SEQ ID NO: 124857 - DNA, 22 bp, Artificial Sequence
  chemically synthesized
gatcccatttgtccattttggc

SEQ ID NO: 124858 - DNA, 22 bp, Artificial Sequence
  chemically synthesized
gtccattttggcttttgttgcc

SEQ ID NO: 124859 - DNA, 22 bp, Artificial Sequence
  chemically synthesized
tccattttggcttttgttgcca

SEQ ID NO: 124860 - DNA, 22 bp, Artificial Sequence
  chemically synthesized
tggcttttgttgccattgcttt

SEQ ID NO: 124861 - DNA, 22 bp, Artificial Sequence
  chemically synthesized
ggcttttgttgccattgctttt

SEQ ID NO: 124862 - DNA, 22 bp, Artificial Sequence
  chemically synthesized
gcttttgttgccattgcttttg

SEQ ID NO: 124863 - DNA, 22 bp, Artificial Sequence
  chemically synthesized
ttgttgccattgcttttggtgt

SEQ ID NO: 124864 - DNA, 22 bp, Artificial Sequence
  chemically synthesized
tgttgccattgcttttggtgtt

SEQ ID NO: 124865 - DNA, 22 bp, Artificial Sequence
  chemically synthesized
gttgccattgcttttggtgttt

SEQ ID NO: 124866 - DNA, 22 bp, Artificial Sequence
  chemically synthesized
ttgccattgcttttggtgtttt

SEQ ID NO: 124867 - DNA, 22 bp, Artificial Sequence
  chemically synthesized
ccattgcttttggtgttttaga

SEQ ID NO: 124868 - DNA, 22 bp, Artificial Sequence
  chemically synthesized
cttttggtgttttagacatgaa

SEQ ID NO: 124869 - DNA, 22 bp, Artificial Sequence
  chemically synthesized
ttggtgttttagacatgaagtc

SEQ ID NO: 124870 - DNA, 22 bp, Artificial Sequence
  chemically synthesized
tggtgttttagacatgaagtcc

SEQ ID NO: 124871 - DNA, 22 bp, Artificial Sequence
  chemically synthesized
ggtgttttagacatgaagtcct

SEQ ID NO: 124872 - DNA, 22 bp, Artificial Sequence
  chemically synthesized
gtgttttagacatgaagtcctt

SEQ ID NO: 124873 - DNA, 22 bp, Artificial Sequence
  chemically synthesized
tagacatgaagtccttgcccat

SEQ ID NO: 124874 - DNA, 22 bp, Artificial Sequence
  chemically synthesized
agacatgaagtccttgcccatg

SEQ ID NO: 124875 - DNA, 22 bp, Artificial Sequence
  chemically synthesized
gacatgaagtccttgcccatgc

SEQ ID NO: 124876 - DNA, 22 bp, Artificial Sequence
  chemically synthesized
gcccatgcctatgtcctgaatg

SEQ ID NO: 124877 - DNA, 22 bp, Artificial Sequence
  chemically synthesized
cccatgcctatgtcctgaatgg

SEQ ID NO: 124878 - DNA, 22 bp, Artificial Sequence
  chemically synthesized
tgtcctgaatggtattgcctag

SEQ ID NO: 124879 - DNA, 22 bp, Artificial Sequence
  chemically synthesized
aatggtattgcctaggttttct

SEQ ID NO: 124880 - DNA, 22 bp, Artificial Sequence
  chemically synthesized
cctaggttttcttccagagttt

SEQ ID NO: 124881 - DNA, 22 bp, Artificial Sequence
  chemically synthesized
ggttttcttccagagtttttat

SEQ ID NO: 124882 - DNA, 22 bp, Artificial Sequence
  chemically synthesized
tcttccagagtttttatggttt

SEQ ID NO: 124883 - DNA, 22 bp, Artificial Sequence
  chemically synthesized
cttccagagtttttatggtttt

SEQ ID NO: 124884 - DNA, 22 bp, Artificial Sequence
  chemically synthesized
ttccagagtttttatggttttc

SEQ ID NO: 124885 - DNA, 22 bp, Artificial Sequence
  chemically synthesized
ccagagtttttatggttttcag

SEQ ID NO: 124886 - DNA, 22 bp, Artificial Sequence
  chemically synthesized
cagagtttttatggttttcagt

SEQ ID NO: 124887 - DNA, 22 bp, Artificial Sequence
  chemically synthesized
ttatggttttcagtctaacatt

SEQ ID NO: 124888 - DNA, 22 bp, Artificial Sequence
  chemically synthesized
tatggttttcagtctaacattt

SEQ ID NO: 124889 - DNA, 22 bp, Artificial Sequence
  chemically synthesized
atggttttcagtctaacattta

SEQ ID NO: 124890 - DNA, 22 bp, Artificial Sequence
  chemically synthesized
tggttttcagtctaacatttaa

SEQ ID NO: 124891 - DNA, 22 bp, Artificial Sequence
  chemically synthesized
tcagtctaacatttaagtctgt

SEQ ID NO: 124892 - DNA, 22 bp, Artificial Sequence
  chemically synthesized
cagtctaacatttaagtctgta

SEQ ID NO: 124893 - DNA, 22 bp, Artificial Sequence
  chemically synthesized
agtctaacatttaagtctgtaa

SEQ ID NO: 124894 - DNA, 22 bp, Artificial Sequence
  chemically synthesized
acatttaagtctgtaatccatc

SEQ ID NO: 124895 - DNA, 22 bp, Artificial Sequence
  chemically synthesized
aagtctgtaatccatcttgaat

SEQ ID NO: 124896 - DNA, 22 bp, Artificial Sequence
  chemically synthesized
agtctgtaatccatcttgaatt

SEQ ID NO: 124897 - DNA, 22 bp, Artificial Sequence
  chemically synthesized
taatccatcttgaattaatttt

SEQ ID NO: 124898 - DNA, 22 bp, Artificial Sequence
  chemically synthesized
gaattaatttttgtataaggtg

SEQ ID NO: 124899 - DNA, 22 bp, Artificial Sequence
  chemically synthesized
aattaatttttgtataaggtgt

SEQ ID NO: 124900 - DNA, 22 bp, Artificial Sequence
  chemically synthesized
atttttgtataaggtgtaagaa

SEQ ID NO: 124901 - DNA, 22 bp, Artificial Sequence
  chemically synthesized
ttgtataaggtgtaagaaaggg

SEQ ID NO: 124902 - DNA, 22 bp, Artificial Sequence
  chemically synthesized
tgtataaggtgtaagaaaggga

SEQ ID NO: 124903 - DNA, 22 bp, Artificial Sequence
  chemically synthesized
gtataaggtgtaagaaagggat

SEQ ID NO: 124904 - DNA, 22 bp, Artificial Sequence
  chemically synthesized
tataaggtgtaagaaagggatc

SEQ ID NO: 124905 - DNA, 22 bp, Artificial Sequence
  chemically synthesized
cagctttctgcgtatggttagc

SEQ ID NO: 124906 - DNA, 22 bp, Artificial Sequence
  chemically synthesized
agctttctgcgtatggttagcc

SEQ ID NO: 124907 - DNA, 22 bp, Artificial Sequence
  chemically synthesized
tctgcgtatggttagccagttt

SEQ ID NO: 124908 - DNA, 22 bp, Artificial Sequence
  chemically synthesized
ctgcgtatggttagccagtttt

SEQ ID NO: 124909 - DNA, 22 bp, Artificial Sequence
  chemically synthesized
tgcgtatggttagccagttttc

SEQ ID NO: 124910 - DNA, 22 bp, Artificial Sequence
  chemically synthesized
cgtatggttagccagttttccc

SEQ ID NO: 124911 - DNA, 22 bp, Artificial Sequence
  chemically synthesized
gccagttttcccagcaccattt

SEQ ID NO: 124912 - DNA, 22 bp, Artificial Sequence
  chemically synthesized
tcccagcaccatttattaaata

SEQ ID NO: 124913 - DNA, 22 bp, Artificial Sequence
  chemically synthesized
cccagcaccatttattaaatag

SEQ ID NO: 124914 - DNA, 22 bp, Artificial Sequence
  chemically synthesized
ccagcaccatttattaaatagg

SEQ ID NO: 124915 - DNA, 22 bp, Artificial Sequence
  chemically synthesized
attaaatagggaatcctttccc

SEQ ID NO: 124916 - DNA, 22 bp, Artificial Sequence
  chemically synthesized
ttaaatagggaatcctttcccc

SEQ ID NO: 124917 - DNA, 22 bp, Artificial Sequence
  chemically synthesized
aatagggaatcctttccccatt

SEQ ID NO: 124918 - DNA, 22 bp, Artificial Sequence
  chemically synthesized
tccccatttgttttttttgtca

SEQ ID NO: 124919 - DNA, 22 bp, Artificial Sequence
  chemically synthesized
ccccatttgttttttttgtcag

SEQ ID NO: 124920 - DNA, 22 bp, Artificial Sequence
  chemically synthesized
cccatttgttttttttgtcagg

SEQ ID NO: 124921 - DNA, 22 bp, Artificial Sequence
  chemically synthesized
gttttttttgtcaggtttgtca

SEQ ID NO: 124922 - DNA, 22 bp, Artificial Sequence
  chemically synthesized
ttttttttgtcaggtttgtcaa

SEQ ID NO: 124923 - DNA, 22 bp, Artificial Sequence
  chemically synthesized
tttttgtcaggtttgtcaaaga

SEQ ID NO: 124924 - DNA, 22 bp, Artificial Sequence
  chemically synthesized
ttttgtcaggtttgtcaaagat

SEQ ID NO: 124925 - DNA, 22 bp, Artificial Sequence
  chemically synthesized
tttgtcaggtttgtcaaagatc

SEQ ID NO: 124926 - DNA, 22 bp, Artificial Sequence
  chemically synthesized
ttgtcaggtttgtcaaagatca

SEQ ID NO: 124927 - DNA, 22 bp, Artificial Sequence
  chemically synthesized
tgtcaggtttgtcaaagatcag

SEQ ID NO: 124928 - DNA, 22 bp, Artificial Sequence
  chemically synthesized
gtcaggtttgtcaaagatcaga

SEQ ID NO: 124929 - DNA, 22 bp, Artificial Sequence
  chemically synthesized
tcaggtttgtcaaagatcagat

SEQ ID NO: 124930 - DNA, 22 bp, Artificial Sequence
  chemically synthesized
gtcaaagatcagatggttgtag

SEQ ID NO: 124931 - DNA, 22 bp, Artificial Sequence
  chemically synthesized
tcaaagatcagatggttgtaga

SEQ ID NO: 124932 - DNA, 22 bp, Artificial Sequence
  chemically synthesized
tagacatgcggcattatttctg

SEQ ID NO: 124933 - DNA, 22 bp, Artificial Sequence
  chemically synthesized
tttctgaggcctctgttctgtt

SEQ ID NO: 124934 - DNA, 22 bp, Artificial Sequence
  chemically synthesized
ctgaggcctctgttctgttcca

SEQ ID NO: 124935 - DNA, 22 bp, Artificial Sequence
  chemically synthesized
tgaggcctctgttctgttccat

SEQ ID NO: 124936 - DNA, 22 bp, Artificial Sequence
  chemically synthesized
aggcctctgttctgttccattg

SEQ ID NO: 124937 - DNA, 22 bp, Artificial Sequence
  chemically synthesized
tgttctgttccattggtctata

SEQ ID NO: 124938 - DNA, 22 bp, Artificial Sequence
  chemically synthesized
ttctgttccattggtctatatc

SEQ ID NO: 124939 - DNA, 22 bp, Artificial Sequence
  chemically synthesized
tgttccattggtctatatctct

SEQ ID NO: 124940 - DNA, 22 bp, Artificial Sequence
  chemically synthesized
ttccattggtctatatctctgt

SEQ ID NO: 124941 - DNA, 22 bp, Artificial Sequence
  chemically synthesized
cattggtctatatctctgtttt

SEQ ID NO: 124942 - DNA, 22 bp, Artificial Sequence
  chemically synthesized
gtctatatctctgttttggtac

SEQ ID NO: 124943 - DNA, 22 bp, Artificial Sequence
  chemically synthesized
tatctctgttttggtaccagta

SEQ ID NO: 124944 - DNA, 22 bp, Artificial Sequence
  chemically synthesized
tgttttggtaccagtaccatgc

SEQ ID NO: 124945 - DNA, 22 bp, Artificial Sequence
  chemically synthesized
ttttggtaccagtaccatgctg

SEQ ID NO: 124946 - DNA, 22 bp, Artificial Sequence
  chemically synthesized
tggtaccagtaccatgctgttt

SEQ ID NO: 124947 - DNA, 22 bp, Artificial Sequence
  chemically synthesized
ggtaccagtaccatgctgtttt

SEQ ID NO: 124948 - DNA, 22 bp, Artificial Sequence
  chemically synthesized
gtaccagtaccatgctgttttg

SEQ ID NO: 124949 - DNA, 22 bp, Artificial Sequence
  chemically synthesized
ttttggttactgtagccttgta

SEQ ID NO: 124950 - DNA, 22 bp, Artificial Sequence
  chemically synthesized
tggttactgtagccttgtagta

SEQ ID NO: 124951 - DNA, 22 bp, Artificial Sequence
  chemically synthesized
ggttactgtagccttgtagtat

SEQ ID NO: 124952 - DNA, 22 bp, Artificial Sequence
  chemically synthesized
gttactgtagccttgtagtata

SEQ ID NO: 124953 - DNA, 22 bp, Artificial Sequence
  chemically synthesized
ctgtagccttgtagtatagttt

SEQ ID NO: 124954 - DNA, 22 bp, Artificial Sequence
  chemically synthesized
tagccttgtagtatagtttgaa

SEQ ID NO: 124955 - DNA, 22 bp, Artificial Sequence
  chemically synthesized
gtagtatagtttgaagtcaggt

SEQ ID NO: 124956 - DNA, 22 bp, Artificial Sequence
  chemically synthesized
tagtatagtttgaagtcaggta

SEQ ID NO: 124957 - DNA, 22 bp, Artificial Sequence
  chemically synthesized
gaagtcaggtagcgtgatgcct

SEQ ID NO: 124958 - DNA, 22 bp, Artificial Sequence
  chemically synthesized
aagtcaggtagcgtgatgcctc

SEQ ID NO: 124959 - DNA, 22 bp, Artificial Sequence
  chemically synthesized
cagctttgttcttttggcttag

SEQ ID NO: 124960 - DNA, 22 bp, Artificial Sequence
  chemically synthesized
tgttcttttggcttaggattgg

SEQ ID NO: 124961 - DNA, 22 bp, Artificial Sequence
  chemically synthesized
gttcttttggcttaggattggc

SEQ ID NO: 124962 - DNA, 22 bp, Artificial Sequence
  chemically synthesized
ttcttttggcttaggattggca

SEQ ID NO: 124963 - DNA, 22 bp, Artificial Sequence
  chemically synthesized
ttttggcttaggattggcatgt

SEQ ID NO: 124964 - DNA, 22 bp, Artificial Sequence
  chemically synthesized
ttggcttaggattggcatgtca

SEQ ID NO: 124965 - DNA, 22 bp, Artificial Sequence
  chemically synthesized
tggcttaggattggcatgtcaa

SEQ ID NO: 124966 - DNA, 22 bp, Artificial Sequence
  chemically synthesized
ggcttaggattggcatgtcaat

SEQ ID NO: 124967 - DNA, 22 bp, Artificial Sequence
  chemically synthesized
gcttaggattggcatgtcaatg

SEQ ID NO: 124968 - DNA, 22 bp, Artificial Sequence
  chemically synthesized
aggattggcatgtcaatgtggg

SEQ ID NO: 124969 - DNA, 22 bp, Artificial Sequence
  chemically synthesized
ggattggcatgtcaatgtgggc

SEQ ID NO: 124970 - DNA, 22 bp, Artificial Sequence
  chemically synthesized
gcatgtcaatgtgggctctttt

SEQ ID NO: 124971 - DNA, 22 bp, Artificial Sequence
  chemically synthesized
ttttttggttccatatgaactt

SEQ ID NO: 124972 - DNA, 22 bp, Artificial Sequence
  chemically synthesized
ttttggttccatatgaacttta

SEQ ID NO: 124973 - DNA, 22 bp, Artificial Sequence
  chemically synthesized
tttggttccatatgaactttaa

SEQ ID NO: 124974 - DNA, 22 bp, Artificial Sequence
  chemically synthesized
ttggttccatatgaactttaaa

SEQ ID NO: 124975 - DNA, 22 bp, Artificial Sequence
  chemically synthesized
tggttccatatgaactttaaag

SEQ ID NO: 124976 - DNA, 22 bp, Artificial Sequence
  chemically synthesized
ggttccatatgaactttaaagt

SEQ ID NO: 124977 - DNA, 22 bp, Artificial Sequence
  chemically synthesized
gttccatatgaactttaaagta

SEQ ID NO: 124978 - DNA, 22 bp, Artificial Sequence
  chemically synthesized
catatgaactttaaagtagttt

SEQ ID NO: 124979 - DNA, 22 bp, Artificial Sequence
  chemically synthesized
taaagtagttttttccaattct

SEQ ID NO: 124980 - DNA, 22 bp, Artificial Sequence
  chemically synthesized
aaagtagttttttccaattctg

SEQ ID NO: 124981 - DNA, 22 bp, Artificial Sequence
  chemically synthesized
aagtagttttttccaattctgt

SEQ ID NO: 124982 - DNA, 22 bp, Artificial Sequence
  chemically synthesized
tttccaattctgtgaagaaagt

SEQ ID NO: 124983 - DNA, 22 bp, Artificial Sequence
  chemically synthesized
ttccaattctgtgaagaaagtc

SEQ ID NO: 124984 - DNA, 22 bp, Artificial Sequence
  chemically synthesized
tccaattctgtgaagaaagtca

SEQ ID NO: 124985 - DNA, 22 bp, Artificial Sequence
  chemically synthesized
ccaattctgtgaagaaagtcat

SEQ ID NO: 124986 - DNA, 22 bp, Artificial Sequence
  chemically synthesized
caattctgtgaagaaagtcatt

SEQ ID NO: 124987 - DNA, 22 bp, Artificial Sequence
  chemically synthesized
tgtgaagaaagtcattggtagc

SEQ ID NO: 124988 - DNA, 22 bp, Artificial Sequence
  chemically synthesized
tgaagaaagtcattggtagctt

SEQ ID NO: 124989 - DNA, 22 bp, Artificial Sequence
  chemically synthesized
gtagcttgatggggatggcatt

SEQ ID NO: 124990 - DNA, 22 bp, Artificial Sequence
  chemically synthesized
gatggggatggcattgaatcta

SEQ ID NO: 124991 - DNA, 22 bp, Artificial Sequence
  chemically synthesized
atggggatggcattgaatctat

SEQ ID NO: 124992 - DNA, 22 bp, Artificial Sequence
  chemically synthesized
aatctataaattaccttgggct

SEQ ID NO: 124993 - DNA, 22 bp, Artificial Sequence
  chemically synthesized
taaattaccttgggctgtatgg

SEQ ID NO: 124994 - DNA, 22 bp, Artificial Sequence
  chemically synthesized
ccttgggctgtatggccatttt

SEQ ID NO: 124995 - DNA, 22 bp, Artificial Sequence
  chemically synthesized
gggctgtatggccattttcatg

SEQ ID NO: 124996 - DNA, 22 bp, Artificial Sequence
  chemically synthesized
ggctgtatggccattttcatga

SEQ ID NO: 124997 - DNA, 22 bp, Artificial Sequence
  chemically synthesized
tatggccattttcatgatattg

SEQ ID NO: 124998 - DNA, 22 bp, Artificial Sequence
  chemically synthesized
tcatgatattgattcttcctac

SEQ ID NO: 124999 - DNA, 22 bp, Artificial Sequence
  chemically synthesized
catgatattgattcttcctacc

SEQ ID NO: 125000 - DNA, 22 bp, Artificial Sequence
  chemically synthesized
atgatattgattcttcctaccc

SEQ ID NO: 125001 - DNA, 22 bp, Artificial Sequence
  chemically synthesized
attcttcctacccatgagcatg

SEQ ID NO: 125002 - DNA, 22 bp, Artificial Sequence
  chemically synthesized
ttcctacccatgagcatggaat

SEQ ID NO: 125003 - DNA, 22 bp, Artificial Sequence
  chemically synthesized
cctacccatgagcatggaatgt

SEQ ID NO: 125004 - DNA, 22 bp, Artificial Sequence
  chemically synthesized
ctacccatgagcatggaatgtt

SEQ ID NO: 125005 - DNA, 22 bp, Artificial Sequence
  chemically synthesized
cccatgagcatggaatgttctt

SEQ ID NO: 125006 - DNA, 22 bp, Artificial Sequence
  chemically synthesized
ttccatttgtttgtatcttctt

SEQ ID NO: 125007 - DNA, 22 bp, Artificial Sequence
  chemically synthesized
ccatttgtttgtatcttctttt

SEQ ID NO: 125008 - DNA, 22 bp, Artificial Sequence
  chemically synthesized
catttgtttgtatcttctttta

SEQ ID NO: 125009 - DNA, 22 bp, Artificial Sequence
  chemically synthesized
gtttgtatcttcttttatttca

SEQ ID NO: 125010 - DNA, 22 bp, Artificial Sequence
  chemically synthesized
tttgtatcttcttttatttcat

SEQ ID NO: 125011 - DNA, 22 bp, Artificial Sequence
  chemically synthesized
gtatcttcttttatttcattca

SEQ ID NO: 125012 - DNA, 22 bp, Artificial Sequence
  chemically synthesized
tatcttcttttatttcattcag

SEQ ID NO: 125013 - DNA, 22 bp, Artificial Sequence
  chemically synthesized
cttttatttcattcagcagtgg

SEQ ID NO: 125014 - DNA, 22 bp, Artificial Sequence
  chemically synthesized
ttttatttcattcagcagtggt

SEQ ID NO: 125015 - DNA, 22 bp, Artificial Sequence
  chemically synthesized
ttatttcattcagcagtggttt

SEQ ID NO: 125016 - DNA, 22 bp, Artificial Sequence
  chemically synthesized
tatttcattcagcagtggtttg

SEQ ID NO: 125017 - DNA, 22 bp, Artificial Sequence
  chemically synthesized
atttcattcagcagtggtttgt

SEQ ID NO: 125018 - DNA, 22 bp, Artificial Sequence
  chemically synthesized
tttcattcagcagtggtttgta

SEQ ID NO: 125019 - DNA, 22 bp, Artificial Sequence
  chemically synthesized
cattcagcagtggtttgtagtt

SEQ ID NO: 125020 - DNA, 22 bp, Artificial Sequence
  chemically synthesized
attcagcagtggtttgtagttc

SEQ ID NO: 125021 - DNA, 22 bp, Artificial Sequence
  chemically synthesized
agcagtggtttgtagttctcct

SEQ ID NO: 125022 - DNA, 22 bp, Artificial Sequence
  chemically synthesized
gtagttctccttgaagaggtcc

SEQ ID NO: 125023 - DNA, 22 bp, Artificial Sequence
  chemically synthesized
tagttctccttgaagaggtcct

SEQ ID NO: 125024 - DNA, 22 bp, Artificial Sequence
  chemically synthesized
tccttgaagaggtccttcacct

SEQ ID NO: 125025 - DNA, 22 bp, Artificial Sequence
  chemically synthesized
cttgaagaggtccttcacctct

SEQ ID NO: 125026 - DNA, 22 bp, Artificial Sequence
  chemically synthesized
gaagaggtccttcacctctctt

SEQ ID NO: 125027 - DNA, 22 bp, Artificial Sequence
  chemically synthesized
aagaggtccttcacctctcttg

SEQ ID NO: 125028 - DNA, 22 bp, Artificial Sequence
  chemically synthesized
cacctctcttgtaagttggatt

SEQ ID NO: 125029 - DNA, 22 bp, Artificial Sequence
  chemically synthesized
acctctcttgtaagttggattc

SEQ ID NO: 125030 - DNA, 22 bp, Artificial Sequence
  chemically synthesized
tcttgtaagttggattcctagg

SEQ ID NO: 125031 - DNA, 22 bp, Artificial Sequence
  chemically synthesized
ttgtaagttggattcctaggta

SEQ ID NO: 125032 - DNA, 22 bp, Artificial Sequence
  chemically synthesized
gtaagttggattcctaggtatt

SEQ ID NO: 125033 - DNA, 22 bp, Artificial Sequence
  chemically synthesized
taagttggattcctaggtattt

SEQ ID NO: 125034 - DNA, 22 bp, Artificial Sequence
  chemically synthesized
gattcctaggtattttattctc

SEQ ID NO: 125035 - DNA, 22 bp, Artificial Sequence
  chemically synthesized
ctaggtattttattctctttga

SEQ ID NO: 125036 - DNA, 22 bp, Artificial Sequence
  chemically synthesized
ggtattttattctctttgaagc

SEQ ID NO: 125037 - DNA, 22 bp, Artificial Sequence
  chemically synthesized
tattctctttgaagcaattgtg

SEQ ID NO: 125038 - DNA, 22 bp, Artificial Sequence
  chemically synthesized
attctctttgaagcaattgtga

SEQ ID NO: 125039 - DNA, 22 bp, Artificial Sequence
  chemically synthesized
ttctctttgaagcaattgtgaa

SEQ ID NO: 125040 - DNA, 22 bp, Artificial Sequence
  chemically synthesized
tctttgaagcaattgtgaatgg

SEQ ID NO: 125041 - DNA, 22 bp, Artificial Sequence
  chemically synthesized
tttgaagcaattgtgaatggga

SEQ ID NO: 125042 - DNA, 22 bp, Artificial Sequence
  chemically synthesized
tgaagcaattgtgaatgggagt

SEQ ID NO: 125043 - DNA, 22 bp, Artificial Sequence
  chemically synthesized
gaagcaattgtgaatgggagtt

SEQ ID NO: 125044 - DNA, 22 bp, Artificial Sequence
  chemically synthesized
aagcaattgtgaatgggagttc

SEQ ID NO: 125045 - DNA, 22 bp, Artificial Sequence
  chemically synthesized
tgaatgggagttccctcatgat

SEQ ID NO: 125046 - DNA, 22 bp, Artificial Sequence
  chemically synthesized
cctcatgatttggctctctgtt

SEQ ID NO: 125047 - DNA, 22 bp, Artificial Sequence
  chemically synthesized
atgatttggctctctgtttgtc

SEQ ID NO: 125048 - DNA, 22 bp, Artificial Sequence
  chemically synthesized
ggctctctgtttgtctgttatt

SEQ ID NO: 125049 - DNA, 22 bp, Artificial Sequence
  chemically synthesized
gctctctgtttgtctgttattg

SEQ ID NO: 125050 - DNA, 22 bp, Artificial Sequence
  chemically synthesized
tctgtttgtctgttattggtgt

SEQ ID NO: 125051 - DNA, 22 bp, Artificial Sequence
  chemically synthesized
tgtttgtctgttattggtgtat

SEQ ID NO: 125052 - DNA, 22 bp, Artificial Sequence
  chemically synthesized
tttgtctgttattggtgtataa

SEQ ID NO: 125053 - DNA, 22 bp, Artificial Sequence
  chemically synthesized
gtctgttattggtgtataagaa

SEQ ID NO: 125054 - DNA, 22 bp, Artificial Sequence
  chemically synthesized
tctgttattggtgtataagaat

SEQ ID NO: 125055 - DNA, 22 bp, Artificial Sequence
  chemically synthesized
ttattggtgtataagaatgctt

SEQ ID NO: 125056 - DNA, 22 bp, Artificial Sequence
  chemically synthesized
ttggtgtataagaatgcttgtg

SEQ ID NO: 125057 - DNA, 22 bp, Artificial Sequence
  chemically synthesized
gtgtataagaatgcttgtgatt

SEQ ID NO: 125058 - DNA, 22 bp, Artificial Sequence
  chemically synthesized
gtgatttttgcacattgatttt

SEQ ID NO: 125059 - DNA, 22 bp, Artificial Sequence
  chemically synthesized
tgatttttgcacattgattttg

SEQ ID NO: 125060 - DNA, 22 bp, Artificial Sequence
  chemically synthesized
ttgcacattgattttgtatcct

SEQ ID NO: 125061 - DNA, 22 bp, Artificial Sequence
  chemically synthesized
tgcacattgattttgtatcctg

SEQ ID NO: 125062 - DNA, 22 bp, Artificial Sequence
  chemically synthesized
gcacattgattttgtatcctga

SEQ ID NO: 125063 - DNA, 22 bp, Artificial Sequence
  chemically synthesized
cacattgattttgtatcctgag

SEQ ID NO: 125064 - DNA, 22 bp, Artificial Sequence
  chemically synthesized
attttgtatcctgagactttgc

SEQ ID NO: 125065 - DNA, 22 bp, Artificial Sequence
  chemically synthesized
tgtatcctgagactttgctgaa

SEQ ID NO: 125066 - DNA, 22 bp, Artificial Sequence
  chemically synthesized
gtatcctgagactttgctgaag

SEQ ID NO: 125067 - DNA, 22 bp, Artificial Sequence
  chemically synthesized
tatcctgagactttgctgaagt

SEQ ID NO: 125068 - DNA, 22 bp, Artificial Sequence
  chemically synthesized
agactttgctgaagttgcctat

SEQ ID NO: 125069 - DNA, 22 bp, Artificial Sequence
  chemically synthesized
tgctgaagttgcctatcagttt

SEQ ID NO: 125070 - DNA, 22 bp, Artificial Sequence
  chemically synthesized
gctgaagttgcctatcagttta

SEQ ID NO: 125071 - DNA, 22 bp, Artificial Sequence
  chemically synthesized
ctgaagttgcctatcagtttaa

SEQ ID NO: 125072 - DNA, 22 bp, Artificial Sequence
  chemically synthesized
aagttgcctatcagtttaagga

SEQ ID NO: 125073 - DNA, 22 bp, Artificial Sequence
  chemically synthesized
cctatcagtttaaggacatttt

SEQ ID NO: 125074 - DNA, 22 bp, Artificial Sequence
  chemically synthesized
tcagtttaaggacattttgggc

SEQ ID NO: 125075 - DNA, 22 bp, Artificial Sequence
  chemically synthesized
aaggacattttgggctgagaca

SEQ ID NO: 125076 - DNA, 22 bp, Artificial Sequence
  chemically synthesized
aggacattttgggctgagacag

SEQ ID NO: 125077 - DNA, 22 bp, Artificial Sequence
  chemically synthesized
tgggctgagacagtggggtttt

SEQ ID NO: 125078 - DNA, 22 bp, Artificial Sequence
  chemically synthesized
gggctgagacagtggggttttc

SEQ ID NO: 125079 - DNA, 22 bp, Artificial Sequence
  chemically synthesized
ggctgagacagtggggttttct

SEQ ID NO: 125080 - DNA, 22 bp, Artificial Sequence
  chemically synthesized
agacagtggggttttctagata

SEQ ID NO: 125081 - DNA, 22 bp, Artificial Sequence
  chemically synthesized
tctagatatacaatcgtgtcat

SEQ ID NO: 125082 - DNA, 22 bp, Artificial Sequence
  chemically synthesized
ctagatatacaatcgtgtcatc

SEQ ID NO: 125083 - DNA, 22 bp, Artificial Sequence
  chemically synthesized
tagatatacaatcgtgtcatct

SEQ ID NO: 125084 - DNA, 22 bp, Artificial Sequence
  chemically synthesized
gatatacaatcgtgtcatctgc

SEQ ID NO: 125085 - DNA, 22 bp, Artificial Sequence
  chemically synthesized
caaacagggacaatttgacttc

SEQ ID NO: 125086 - DNA, 22 bp, Artificial Sequence
  chemically synthesized
gacttcctcttttcctaattga

SEQ ID NO: 125087 - DNA, 22 bp, Artificial Sequence
  chemically synthesized
acttcctcttttcctaattgaa

SEQ ID NO: 125088 - DNA, 22 bp, Artificial Sequence
  chemically synthesized
cctcttttcctaattgaatacc

SEQ ID NO: 125089 - DNA, 22 bp, Artificial Sequence
  chemically synthesized
ctcttttcctaattgaatacct

SEQ ID NO: 125090 - DNA, 22 bp, Artificial Sequence
  chemically synthesized
ttttcctaattgaatacctttt

SEQ ID NO: 125091 - DNA, 22 bp, Artificial Sequence
  chemically synthesized
ttcctaattgaatacctttttt

SEQ ID NO: 125092 - DNA, 22 bp, Artificial Sequence
  chemically synthesized
tcctaattgaataccttttttt

SEQ ID NO: 125093 - DNA, 22 bp, Artificial Sequence
  chemically synthesized
cctaattgaatacctttttttc

SEQ ID NO: 125094 - DNA, 22 bp, Artificial Sequence
  chemically synthesized
ctaattgaatacctttttttcc

SEQ ID NO: 125095 - DNA, 22 bp, Artificial Sequence
  chemically synthesized
attgaatacctttttttccttc

SEQ ID NO: 125096 - DNA, 22 bp, Artificial Sequence
  chemically synthesized
aatacctttttttccttctcct

SEQ ID NO: 125097 - DNA, 22 bp, Artificial Sequence
  chemically synthesized
tttttccttctcctgcctaatt

SEQ ID NO: 125098 - DNA, 22 bp, Artificial Sequence
  chemically synthesized
ttttccttctcctgcctaattg

SEQ ID NO: 125099 - DNA, 22 bp, Artificial Sequence
  chemically synthesized
tttccttctcctgcctaattgc

SEQ ID NO: 125100 - DNA, 22 bp, Artificial Sequence
  chemically synthesized
ttccttctcctgcctaattgcc

SEQ ID NO: 125101 - DNA, 22 bp, Artificial Sequence
  chemically synthesized
tccttctcctgcctaattgccc

SEQ ID NO: 125102 - DNA, 22 bp, Artificial Sequence
  chemically synthesized
ccttctcctgcctaattgccct

SEQ ID NO: 125103 - DNA, 22 bp, Artificial Sequence
  chemically synthesized
cttctcctgcctaattgccctg

SEQ ID NO: 125104 - DNA, 22 bp, Artificial Sequence
  chemically synthesized
ctcctgcctaattgccctggcc

SEQ ID NO: 125105 - DNA, 22 bp, Artificial Sequence
  chemically synthesized
tcctgcctaattgccctggcca

SEQ ID NO: 125106 - DNA, 22 bp, Artificial Sequence
  chemically synthesized
ctgcctaattgccctggccaga

SEQ ID NO: 125107 - DNA, 22 bp, Artificial Sequence
  chemically synthesized
cctaattgccctggccagaaat

SEQ ID NO: 125108 - DNA, 22 bp, Artificial Sequence
  chemically synthesized
attgccctggccagaaattcca

SEQ ID NO: 125109 - DNA, 22 bp, Artificial Sequence
  chemically synthesized
ccctggccagaaattccaacac

SEQ ID NO: 125110 - DNA, 22 bp, Artificial Sequence
  chemically synthesized
gccagaaattccaacactatgt

SEQ ID NO: 125111 - DNA, 22 bp, Artificial Sequence
  chemically synthesized
caacactatgttgaataggagt

SEQ ID NO: 125112 - DNA, 22 bp, Artificial Sequence
  chemically synthesized
tgttgaataggagtagtgagag

SEQ ID NO: 125113 - DNA, 22 bp, Artificial Sequence
  chemically synthesized
aataggagtagtgagagagggc

SEQ ID NO: 125114 - DNA, 22 bp, Artificial Sequence
  chemically synthesized
tcttgtgccagttttcaaaggg

SEQ ID NO: 125115 - DNA, 22 bp, Artificial Sequence
  chemically synthesized
gtgccagttttcaaagggaatg

SEQ ID NO: 125116 - DNA, 22 bp, Artificial Sequence
  chemically synthesized
tgccagttttcaaagggaatgc

SEQ ID NO: 125117 - DNA, 22 bp, Artificial Sequence
  chemically synthesized
tcaaagggaatgcttccagttt

SEQ ID NO: 125118 - DNA, 22 bp, Artificial Sequence
  chemically synthesized
caaagggaatgcttccagtttt

SEQ ID NO: 125119 - DNA, 22 bp, Artificial Sequence
  chemically synthesized
aaagggaatgcttccagttttt

SEQ ID NO: 125120 - DNA, 22 bp, Artificial Sequence
  chemically synthesized
ccagtttttgtccattcagtat

SEQ ID NO: 125121 - DNA, 22 bp, Artificial Sequence
  chemically synthesized
cagtttttgtccattcagtatg

SEQ ID NO: 125122 - DNA, 22 bp, Artificial Sequence
  chemically synthesized
ttgtccattcagtatgatattg

SEQ ID NO: 125123 - DNA, 22 bp, Artificial Sequence
  chemically synthesized
tgtccattcagtatgatattgg

SEQ ID NO: 125124 - DNA, 22 bp, Artificial Sequence
  chemically synthesized
gtccattcagtatgatattggc

SEQ ID NO: 125125 - DNA, 22 bp, Artificial Sequence
  chemically synthesized
tccattcagtatgatattggct

SEQ ID NO: 125126 - DNA, 22 bp, Artificial Sequence
  chemically synthesized
agtatgatattggctgtgggtt

SEQ ID NO: 125127 - DNA, 22 bp, Artificial Sequence
  chemically synthesized
gctgtgggtttgtcatagatgg

SEQ ID NO: 125128 - DNA, 22 bp, Artificial Sequence
  chemically synthesized
tgggtttgtcatagatggctct

SEQ ID NO: 125129 - DNA, 22 bp, Artificial Sequence
  chemically synthesized
gtcatagatggctcttattatt

SEQ ID NO: 125130 - DNA, 22 bp, Artificial Sequence
  chemically synthesized
tcatagatggctcttattattt

SEQ ID NO: 125131 - DNA, 22 bp, Artificial Sequence
  chemically synthesized
ttattattttgagatacgtccc

SEQ ID NO: 125132 - DNA, 22 bp, Artificial Sequence
  chemically synthesized
attattttgagatacgtcccat

SEQ ID NO: 125133 - DNA, 22 bp, Artificial Sequence
  chemically synthesized
ttattttgagatacgtcccatc

SEQ ID NO: 125134 - DNA, 22 bp, Artificial Sequence
  chemically synthesized
ttttgagatacgtcccatcaat

SEQ ID NO: 125135 - DNA, 22 bp, Artificial Sequence
  chemically synthesized
tgagatacgtcccatcaatacc

SEQ ID NO: 125136 - DNA, 22 bp, Artificial Sequence
  chemically synthesized
gagatacgtcccatcaatacct

SEQ ID NO: 125137 - DNA, 22 bp, Artificial Sequence
  chemically synthesized
agatacgtcccatcaataccta

SEQ ID NO: 125138 - DNA, 22 bp, Artificial Sequence
  chemically synthesized
atttattgagagtttttagcat

SEQ ID NO: 125139 - DNA, 22 bp, Artificial Sequence
  chemically synthesized
attgagagtttttagcatgaag

SEQ ID NO: 125140 - DNA, 22 bp, Artificial Sequence
  chemically synthesized
ttgagagtttttagcatgaagg

SEQ ID NO: 125141 - DNA, 22 bp, Artificial Sequence
  chemically synthesized
agagtttttagcatgaagggtt

SEQ ID NO: 125142 - DNA, 22 bp, Artificial Sequence
  chemically synthesized
ttagcatgaagggttgttgaat

SEQ ID NO: 125143 - DNA, 22 bp, Artificial Sequence
  chemically synthesized
tagcatgaagggttgttgaatt

SEQ ID NO: 125144 - DNA, 22 bp, Artificial Sequence
  chemically synthesized
agcatgaagggttgttgaattt

SEQ ID NO: 125145 - DNA, 22 bp, Artificial Sequence
  chemically synthesized
gcatgaagggttgttgaatttt

SEQ ID NO: 125146 - DNA, 22 bp, Artificial Sequence
  chemically synthesized
ttgaattttgtcaaaggccttt

SEQ ID NO: 125147 - DNA, 22 bp, Artificial Sequence
  chemically synthesized
aattttgtcaaaggccttttct

SEQ ID NO: 125148 - DNA, 22 bp, Artificial Sequence
  chemically synthesized
tgtcaaaggccttttctgcatc

SEQ ID NO: 125149 - DNA, 22 bp, Artificial Sequence
  chemically synthesized
gtcaaaggccttttctgcatct

SEQ ID NO: 125150 - DNA, 22 bp, Artificial Sequence
  chemically synthesized
tcaaaggccttttctgcatcta

SEQ ID NO: 125151 - DNA, 22 bp, Artificial Sequence
  chemically synthesized
ttctgcatctattgagataatc

SEQ ID NO: 125152 - DNA, 22 bp, Artificial Sequence
  chemically synthesized
tctgcatctattgagataatca

SEQ ID NO: 125153 - DNA, 22 bp, Artificial Sequence
  chemically synthesized
ctgcatctattgagataatcat

SEQ ID NO: 125154 - DNA, 22 bp, Artificial Sequence
  chemically synthesized
tgcatctattgagataatcatg

SEQ ID NO: 125155 - DNA, 22 bp, Artificial Sequence
  chemically synthesized
catctattgagataatcatgtg

SEQ ID NO: 125156 - DNA, 22 bp, Artificial Sequence
  chemically synthesized
ttgagataatcatgtggttttt

SEQ ID NO: 125157 - DNA, 22 bp, Artificial Sequence
  chemically synthesized
agataatcatgtggtttttgtc

SEQ ID NO: 125158 - DNA, 22 bp, Artificial Sequence
  chemically synthesized
ttgtctttggttctgtttatat

SEQ ID NO: 125159 - DNA, 22 bp, Artificial Sequence
  chemically synthesized
tgtctttggttctgtttatatg

SEQ ID NO: 125160 - DNA, 22 bp, Artificial Sequence
  chemically synthesized
gtctttggttctgtttatatgc

SEQ ID NO: 125161 - DNA, 22 bp, Artificial Sequence
  chemically synthesized
tctttggttctgtttatatgct

SEQ ID NO: 125162 - DNA, 22 bp, Artificial Sequence
  chemically synthesized
tggttctgtttatatgctggat

SEQ ID NO: 125163 - DNA, 22 bp, Artificial Sequence
  chemically synthesized
ggttctgtttatatgctggatt

SEQ ID NO: 125164 - DNA, 22 bp, Artificial Sequence
  chemically synthesized
gttctgtttatatgctggatta

SEQ ID NO: 125165 - DNA, 22 bp, Artificial Sequence
  chemically synthesized
tgtttatatgctggattacatt

SEQ ID NO: 125166 - DNA, 22 bp, Artificial Sequence
  chemically synthesized
tttatatgctggattacattta

SEQ ID NO: 125167 - DNA, 22 bp, Artificial Sequence
  chemically synthesized
atatgctggattacatttattg

SEQ ID NO: 125168 - DNA, 22 bp, Artificial Sequence
  chemically synthesized
tatgctggattacatttattga

SEQ ID NO: 125169 - DNA, 22 bp, Artificial Sequence
  chemically synthesized
gattacatttattgatttgcat

SEQ ID NO: 125170 - DNA, 22 bp, Artificial Sequence
  chemically synthesized
catttattgatttgcatatgtt

SEQ ID NO: 125171 - DNA, 22 bp, Artificial Sequence
  chemically synthesized
attgatttgcatatgttgaacc

SEQ ID NO: 125172 - DNA, 22 bp, Artificial Sequence
  chemically synthesized
ttgatttgcatatgttgaacca

SEQ ID NO: 125173 - DNA, 22 bp, Artificial Sequence
  chemically synthesized
atttgcatatgttgaaccagcc

SEQ ID NO: 125174 - DNA, 22 bp, Artificial Sequence
  chemically synthesized
gcatatgttgaaccagccttgc

SEQ ID NO: 125175 - DNA, 22 bp, Artificial Sequence
  chemically synthesized
catatgttgaaccagccttgca

SEQ ID NO: 125176 - DNA, 22 bp, Artificial Sequence
  chemically synthesized
aaccagccttgcatcccaggga

SEQ ID NO: 125177 - DNA, 22 bp, Artificial Sequence
  chemically synthesized
gcatcccagggatgaagcccac

SEQ ID NO: 125178 - DNA, 22 bp, Artificial Sequence
  chemically synthesized
catcccagggatgaagcccact

SEQ ID NO: 125179 - DNA, 22 bp, Artificial Sequence
  chemically synthesized
gatcatggtggataagcttttg

SEQ ID NO: 125180 - DNA, 22 bp, Artificial Sequence
  chemically synthesized
atcatggtggataagcttttgg

SEQ ID NO: 125181 - DNA, 22 bp, Artificial Sequence
  chemically synthesized
ttggatgtgctgctggatttgc

SEQ ID NO: 125182 - DNA, 22 bp, Artificial Sequence
  chemically synthesized
tggatgtgctgctggatttgct

SEQ ID NO: 125183 - DNA, 22 bp, Artificial Sequence
  chemically synthesized
ggatgtgctgctggatttgctt

SEQ ID NO: 125184 - DNA, 22 bp, Artificial Sequence
  chemically synthesized
gatgtgctgctggatttgcttt

SEQ ID NO: 125185 - DNA, 22 bp, Artificial Sequence
  chemically synthesized
ctggatttgctttgccagtatt

SEQ ID NO: 125186 - DNA, 22 bp, Artificial Sequence
  chemically synthesized
gatttgctttgccagtatttta

SEQ ID NO: 125187 - DNA, 22 bp, Artificial Sequence
  chemically synthesized
gctttgccagtattttattgag

SEQ ID NO: 125188 - DNA, 22 bp, Artificial Sequence
  chemically synthesized
ctttgccagtattttattgagg

SEQ ID NO: 125189 - DNA, 22 bp, Artificial Sequence
  chemically synthesized
tgccagtattttattgaggttt

SEQ ID NO: 125190 - DNA, 22 bp, Artificial Sequence
  chemically synthesized
gccagtattttattgaggtttt

SEQ ID NO: 125191 - DNA, 22 bp, Artificial Sequence
  chemically synthesized
ccagtattttattgaggttttt

SEQ ID NO: 125192 - DNA, 22 bp, Artificial Sequence
  chemically synthesized
tattgaggttttttgcatcgat

SEQ ID NO: 125193 - DNA, 22 bp, Artificial Sequence
  chemically synthesized
attgaggttttttgcatcgatg

SEQ ID NO: 125194 - DNA, 22 bp, Artificial Sequence
  chemically synthesized
ttgaggttttttgcatcgatgt

SEQ ID NO: 125195 - DNA, 22 bp, Artificial Sequence
  chemically synthesized
aggttttttgcatcgatgtcca

SEQ ID NO: 125196 - DNA, 22 bp, Artificial Sequence
  chemically synthesized
tttgcatcgatgtccatcaggg

SEQ ID NO: 125197 - DNA, 22 bp, Artificial Sequence
  chemically synthesized
ttgcatcgatgtccatcaggga

SEQ ID NO: 125198 - DNA, 22 bp, Artificial Sequence
  chemically synthesized
tgcatcgatgtccatcagggat

SEQ ID NO: 125199 - DNA, 22 bp, Artificial Sequence
  chemically synthesized
gcatcgatgtccatcagggata

SEQ ID NO: 125200 - DNA, 22 bp, Artificial Sequence
  chemically synthesized
catcgatgtccatcagggatat

SEQ ID NO: 125201 - DNA, 22 bp, Artificial Sequence
  chemically synthesized
gtctaaaattctctttttttgt

SEQ ID NO: 125202 - DNA, 22 bp, Artificial Sequence
  chemically synthesized
aaattctctttttttgttgtgt

SEQ ID NO: 125203 - DNA, 22 bp, Artificial Sequence
  chemically synthesized
tctttttttgttgtgtctctgc

SEQ ID NO: 125204 - DNA, 22 bp, Artificial Sequence
  chemically synthesized
tttttttgttgtgtctctgccc

SEQ ID NO: 125205 - DNA, 22 bp, Artificial Sequence
  chemically synthesized
tttttgttgtgtctctgcccgg

SEQ ID NO: 125206 - DNA, 22 bp, Artificial Sequence
  chemically synthesized
ttttgttgtgtctctgcccggc

SEQ ID NO: 125207 - DNA, 22 bp, Artificial Sequence
  chemically synthesized
tttgttgtgtctctgcccggct

SEQ ID NO: 125208 - DNA, 22 bp, Artificial Sequence
  chemically synthesized
ttgttgtgtctctgcccggctt

SEQ ID NO: 125209 - DNA, 22 bp, Artificial Sequence
  chemically synthesized
tgttgtgtctctgcccggcttt

SEQ ID NO: 125210 - DNA, 22 bp, Artificial Sequence
  chemically synthesized
gttgtgtctctgcccggctttg

SEQ ID NO: 125211 - DNA, 22 bp, Artificial Sequence
  chemically synthesized
ttgtgtctctgcccggctttgg

SEQ ID NO: 125212 - DNA, 22 bp, Artificial Sequence
  chemically synthesized
tgtctctgcccggctttggtat

SEQ ID NO: 125213 - DNA, 22 bp, Artificial Sequence
  chemically synthesized
tgcccggctttggtatcaggat

SEQ ID NO: 125214 - DNA, 22 bp, Artificial Sequence
  chemically synthesized
cccggctttggtatcaggatga

SEQ ID NO: 125215 - DNA, 22 bp, Artificial Sequence
  chemically synthesized
tggtatcaggatgatgctggcc

SEQ ID NO: 125216 - DNA, 22 bp, Artificial Sequence
  chemically synthesized
ggtatcaggatgatgctggcct

SEQ ID NO: 125217 - DNA, 22 bp, Artificial Sequence
  chemically synthesized
gtatcaggatgatgctggcctc

SEQ ID NO: 125218 - DNA, 22 bp, Artificial Sequence
  chemically synthesized
gcctcataaaatgagttaggga

SEQ ID NO: 125219 - DNA, 22 bp, Artificial Sequence
  chemically synthesized
ataaaatgagttagggaggatt

SEQ ID NO: 125220 - DNA, 22 bp, Artificial Sequence
  chemically synthesized
gggaggattccctcttttacta

SEQ ID NO: 125221 - DNA, 22 bp, Artificial Sequence
  chemically synthesized
cctcttttactattgattcgaa

SEQ ID NO: 125222 - DNA, 22 bp, Artificial Sequence
  chemically synthesized
ttttactattgattcgaatagt

SEQ ID NO: 125223 - DNA, 22 bp, Artificial Sequence
  chemically synthesized
ttactattgattcgaatagttt

SEQ ID NO: 125224 - DNA, 22 bp, Artificial Sequence
  chemically synthesized
tactattgattcgaatagtttc

SEQ ID NO: 125225 - DNA, 22 bp, Artificial Sequence
  chemically synthesized
actattgattcgaatagtttca

SEQ ID NO: 125226 - DNA, 22 bp, Artificial Sequence
  chemically synthesized
ctattgattcgaatagtttcag

SEQ ID NO: 125227 - DNA, 22 bp, Artificial Sequence
  chemically synthesized
ttgattcgaatagtttcagagg

SEQ ID NO: 125228 - DNA, 22 bp, Artificial Sequence
  chemically synthesized
attcgaatagtttcagagggaa

SEQ ID NO: 125229 - DNA, 22 bp, Artificial Sequence
  chemically synthesized
gaatagtttcagagggaatggt

SEQ ID NO: 125230 - DNA, 22 bp, Artificial Sequence
  chemically synthesized
cagagggaatggtaccagctcc

SEQ ID NO: 125231 - DNA, 22 bp, Artificial Sequence
  chemically synthesized
agagggaatggtaccagctcct

SEQ ID NO: 125232 - DNA, 22 bp, Artificial Sequence
  chemically synthesized
ctccttgtacctctggtagaat

SEQ ID NO: 125233 - DNA, 22 bp, Artificial Sequence
  chemically synthesized
cttgtacctctggtagaatttg

SEQ ID NO: 125234 - DNA, 22 bp, Artificial Sequence
  chemically synthesized
gtacctctggtagaatttggct

SEQ ID NO: 125235 - DNA, 22 bp, Artificial Sequence
  chemically synthesized
tacctctggtagaatttggctg

SEQ ID NO: 125236 - DNA, 22 bp, Artificial Sequence
  chemically synthesized
tggtagaatttggctgtgactc

SEQ ID NO: 125237 - DNA, 22 bp, Artificial Sequence
  chemically synthesized
gtagaatttggctgtgactcca

SEQ ID NO: 125238 - DNA, 22 bp, Artificial Sequence
  chemically synthesized
ggctgtgactccatctggtcct

SEQ ID NO: 125239 - DNA, 22 bp, Artificial Sequence
  chemically synthesized
gctgtgactccatctggtcctg

SEQ ID NO: 125240 - DNA, 22 bp, Artificial Sequence
  chemically synthesized
tgactccatctggtcctggact

SEQ ID NO: 125241 - DNA, 22 bp, Artificial Sequence
  chemically synthesized
catctggtcctggactgttttt

SEQ ID NO: 125242 - DNA, 22 bp, Artificial Sequence
  chemically synthesized
gtcctggactgtttttggttgg

SEQ ID NO: 125243 - DNA, 22 bp, Artificial Sequence
  chemically synthesized
gactgtttttggttggtaagct

SEQ ID NO: 125244 - DNA, 22 bp, Artificial Sequence
  chemically synthesized
tttttggttggtaagctattaa

SEQ ID NO: 125245 - DNA, 22 bp, Artificial Sequence
  chemically synthesized
ttggttggtaagctattaatta

SEQ ID NO: 125246 - DNA, 22 bp, Artificial Sequence
  chemically synthesized
tggttggtaagctattaattat

SEQ ID NO: 125247 - DNA, 22 bp, Artificial Sequence
  chemically synthesized
ggttggtaagctattaattatt

SEQ ID NO: 125248 - DNA, 22 bp, Artificial Sequence
  chemically synthesized
gttggtaagctattaattattg

SEQ ID NO: 125249 - DNA, 22 bp, Artificial Sequence
  chemically synthesized
gtaagctattaattattgcctc

SEQ ID NO: 125250 - DNA, 22 bp, Artificial Sequence
  chemically synthesized
ttaattattgcctcaatttcag

SEQ ID NO: 125251 - DNA, 22 bp, Artificial Sequence
  chemically synthesized
attattgcctcaatttcagatc

SEQ ID NO: 125252 - DNA, 22 bp, Artificial Sequence
  chemically synthesized
ttgcctcaatttcagatcctgt

SEQ ID NO: 125253 - DNA, 22 bp, Artificial Sequence
  chemically synthesized
cctcaatttcagatcctgttat

SEQ ID NO: 125254 - DNA, 22 bp, Artificial Sequence
  chemically synthesized
aatttcagatcctgttattggt

SEQ ID NO: 125255 - DNA, 22 bp, Artificial Sequence
  chemically synthesized
cagatcctgttattggtctatt

SEQ ID NO: 125256 - DNA, 22 bp, Artificial Sequence
  chemically synthesized
agatcctgttattggtctattc

SEQ ID NO: 125257 - DNA, 22 bp, Artificial Sequence
  chemically synthesized
ttattggtctattcagagattc

SEQ ID NO: 125258 - DNA, 22 bp, Artificial Sequence
  chemically synthesized
ttggtctattcagagattcaac

SEQ ID NO: 125259 - DNA, 22 bp, Artificial Sequence
  chemically synthesized
gtctattcagagattcaacttc

SEQ ID NO: 125260 - DNA, 22 bp, Artificial Sequence
  chemically synthesized
ttcagagattcaacttcttcct

SEQ ID NO: 125261 - DNA, 22 bp, Artificial Sequence
  chemically synthesized
agagattcaacttcttcctggt

SEQ ID NO: 125262 - DNA, 22 bp, Artificial Sequence
  chemically synthesized
aacttcttcctggtttagtctt

SEQ ID NO: 125263 - DNA, 22 bp, Artificial Sequence
  chemically synthesized
cttcctggtttagtcttgggag

SEQ ID NO: 125264 - DNA, 22 bp, Artificial Sequence
  chemically synthesized
ttcctggtttagtcttgggagg

SEQ ID NO: 125265 - DNA, 22 bp, Artificial Sequence
  chemically synthesized
cctggtttagtcttgggagggt

SEQ ID NO: 125266 - DNA, 22 bp, Artificial Sequence
  chemically synthesized
ctggtttagtcttgggagggtg

SEQ ID NO: 125267 - DNA, 22 bp, Artificial Sequence
  chemically synthesized
gtttagtcttgggagggtgtat

SEQ ID NO: 125268 - DNA, 22 bp, Artificial Sequence
  chemically synthesized
agtcttgggagggtgtatgtgt

SEQ ID NO: 125269 - DNA, 22 bp, Artificial Sequence
  chemically synthesized
gtcttgggagggtgtatgtgtc

SEQ ID NO: 125270 - DNA, 22 bp, Artificial Sequence
  chemically synthesized
gggagggtgtatgtgtcaagga

SEQ ID NO: 125271 - DNA, 22 bp, Artificial Sequence
  chemically synthesized
ggagggtgtatgtgtcaaggaa

SEQ ID NO: 125272 - DNA, 22 bp, Artificial Sequence
  chemically synthesized
atccatttcttctagattttct

SEQ ID NO: 125273 - DNA, 22 bp, Artificial Sequence
  chemically synthesized
tccatttcttctagattttcta

SEQ ID NO: 125274 - DNA, 22 bp, Artificial Sequence
  chemically synthesized
cttctagattttctagtttatt

SEQ ID NO: 125275 - DNA, 22 bp, Artificial Sequence
  chemically synthesized
ttctagattttctagtttattt

SEQ ID NO: 125276 - DNA, 22 bp, Artificial Sequence
  chemically synthesized
ctagattttctagtttatttgt

SEQ ID NO: 125277 - DNA, 22 bp, Artificial Sequence
  chemically synthesized
tagattttctagtttatttgtg

SEQ ID NO: 125278 - DNA, 22 bp, Artificial Sequence
  chemically synthesized
gattttctagtttatttgtgta

SEQ ID NO: 125279 - DNA, 22 bp, Artificial Sequence
  chemically synthesized
tctagtttatttgtgtagaggt

SEQ ID NO: 125280 - DNA, 22 bp, Artificial Sequence
  chemically synthesized
ctagtttatttgtgtagaggtg

SEQ ID NO: 125281 - DNA, 22 bp, Artificial Sequence
  chemically synthesized
tagtttatttgtgtagaggtgt

SEQ ID NO: 125282 - DNA, 22 bp, Artificial Sequence
  chemically synthesized
gtttatttgtgtagaggtgttt

SEQ ID NO: 125283 - DNA, 22 bp, Artificial Sequence
  chemically synthesized
atttgtgtagaggtgtttatag

SEQ ID NO: 125284 - DNA, 22 bp, Artificial Sequence
  chemically synthesized
tttgtgtagaggtgtttatagt

SEQ ID NO: 125285 - DNA, 22 bp, Artificial Sequence
  chemically synthesized
gtgtagaggtgtttatagtatt

SEQ ID NO: 125286 - DNA, 22 bp, Artificial Sequence
  chemically synthesized
tgtagaggtgtttatagtattc

SEQ ID NO: 125287 - DNA, 22 bp, Artificial Sequence
  chemically synthesized
atagtattctctgatggtggtt

SEQ ID NO: 125288 - DNA, 22 bp, Artificial Sequence
  chemically synthesized
tagtattctctgatggtggttt

SEQ ID NO: 125289 - DNA, 22 bp, Artificial Sequence
  chemically synthesized
tctgatggtggtttgtatttct

SEQ ID NO: 125290 - DNA, 22 bp, Artificial Sequence
  chemically synthesized
tgatggtggtttgtatttctgt

SEQ ID NO: 125291 - DNA, 22 bp, Artificial Sequence
  chemically synthesized
atggtggtttgtatttctgtgg

SEQ ID NO: 125292 - DNA, 22 bp, Artificial Sequence
  chemically synthesized
gtatttctgtgggatcggtggt

SEQ ID NO: 125293 - DNA, 22 bp, Artificial Sequence
  chemically synthesized
tatttctgtgggatcggtggtg

SEQ ID NO: 125294 - DNA, 22 bp, Artificial Sequence
  chemically synthesized
ctgtgggatcggtggtgatata

SEQ ID NO: 125295 - DNA, 22 bp, Artificial Sequence
  chemically synthesized
tgtgggatcggtggtgatatac

SEQ ID NO: 125296 - DNA, 22 bp, Artificial Sequence
  chemically synthesized
tgggatcggtggtgatataccc

SEQ ID NO: 125297 - DNA, 22 bp, Artificial Sequence
  chemically synthesized
tatcattttttattgcatctat

SEQ ID NO: 125298 - DNA, 22 bp, Artificial Sequence
  chemically synthesized
atcattttttattgcatctatt

SEQ ID NO: 125299 - DNA, 22 bp, Artificial Sequence
  chemically synthesized
tcattttttattgcatctattt

SEQ ID NO: 125300 - DNA, 22 bp, Artificial Sequence
  chemically synthesized
tttattgcatctatttgattct

SEQ ID NO: 125301 - DNA, 22 bp, Artificial Sequence
  chemically synthesized
ttattgcatctatttgattctt

SEQ ID NO: 125302 - DNA, 22 bp, Artificial Sequence
  chemically synthesized
tattgcatctatttgattcttc

SEQ ID NO: 125303 - DNA, 22 bp, Artificial Sequence
  chemically synthesized
attgcatctatttgattcttct

SEQ ID NO: 125304 - DNA, 22 bp, Artificial Sequence
  chemically synthesized
ttgcatctatttgattcttctc

SEQ ID NO: 125305 - DNA, 22 bp, Artificial Sequence
  chemically synthesized
catctatttgattcttctctct

SEQ ID NO: 125306 - DNA, 22 bp, Artificial Sequence
  chemically synthesized
tttgattcttctctcttttctt

SEQ ID NO: 125307 - DNA, 22 bp, Artificial Sequence
  chemically synthesized
gattcttctctcttttcttctt

SEQ ID NO: 125308 - DNA, 22 bp, Artificial Sequence
  chemically synthesized
attcttctctcttttcttcttt

SEQ ID NO: 125309 - DNA, 22 bp, Artificial Sequence
  chemically synthesized
ttctctcttttcttctttatta

SEQ ID NO: 125310 - DNA, 22 bp, Artificial Sequence
  chemically synthesized
ctctcttttcttctttattagt

SEQ ID NO: 125311 - DNA, 22 bp, Artificial Sequence
  chemically synthesized
tctcttttcttctttattagtc

SEQ ID NO: 125312 - DNA, 22 bp, Artificial Sequence
  chemically synthesized
tcttttcttctttattagtctt

SEQ ID NO: 125313 - DNA, 22 bp, Artificial Sequence
  chemically synthesized
ttttcttctttattagtcttgc

SEQ ID NO: 125314 - DNA, 22 bp, Artificial Sequence
  chemically synthesized
ttcttctttattagtcttgcta

SEQ ID NO: 125315 - DNA, 22 bp, Artificial Sequence
  chemically synthesized
tcttctttattagtcttgctag

SEQ ID NO: 125316 - DNA, 22 bp, Artificial Sequence
  chemically synthesized
cttctttattagtcttgctagc

SEQ ID NO: 125317 - DNA, 22 bp, Artificial Sequence
  chemically synthesized
ttctttattagtcttgctagca

SEQ ID NO: 125318 - DNA, 22 bp, Artificial Sequence
  chemically synthesized
ctttattagtcttgctagcagt

SEQ ID NO: 125319 - DNA, 22 bp, Artificial Sequence
  chemically synthesized
tttattagtcttgctagcagtc

SEQ ID NO: 125320 - DNA, 22 bp, Artificial Sequence
  chemically synthesized
tattagtcttgctagcagtcta

SEQ ID NO: 125321 - DNA, 22 bp, Artificial Sequence
  chemically synthesized
attagtcttgctagcagtctat

SEQ ID NO: 125322 - DNA, 22 bp, Artificial Sequence
  chemically synthesized
ttagtcttgctagcagtctatc

SEQ ID NO: 125323 - DNA, 22 bp, Artificial Sequence
  chemically synthesized
gtcttgctagcagtctatcaat

SEQ ID NO: 125324 - DNA, 22 bp, Artificial Sequence
  chemically synthesized
gctagcagtctatcaattttgt

SEQ ID NO: 125325 - DNA, 22 bp, Artificial Sequence
  chemically synthesized
ctagcagtctatcaattttgtt

SEQ ID NO: 125326 - DNA, 22 bp, Artificial Sequence
  chemically synthesized
gcagtctatcaattttgttgat

SEQ ID NO: 125327 - DNA, 22 bp, Artificial Sequence
  chemically synthesized
tcaattttgttgatctttttga

SEQ ID NO: 125328 - DNA, 22 bp, Artificial Sequence
  chemically synthesized
tgttgatctttttgaaaaacca

SEQ ID NO: 125329 - DNA, 22 bp, Artificial Sequence
  chemically synthesized
gttgatctttttgaaaaaccag

SEQ ID NO: 125330 - DNA, 22 bp, Artificial Sequence
  chemically synthesized
ttgatctttttgaaaaaccagc

SEQ ID NO: 125331 - DNA, 22 bp, Artificial Sequence
  chemically synthesized
atctttttgaaaaaccagcttc

SEQ ID NO: 125332 - DNA, 22 bp, Artificial Sequence
  chemically synthesized
tttgaaaaaccagcttctggat

SEQ ID NO: 125333 - DNA, 22 bp, Artificial Sequence
  chemically synthesized
ttgaaaaaccagcttctggatt

SEQ ID NO: 125334 - DNA, 22 bp, Artificial Sequence
  chemically synthesized
tgaaaaaccagcttctggattc

SEQ ID NO: 125335 - DNA, 22 bp, Artificial Sequence
  chemically synthesized
gaaaaaccagcttctggattca

SEQ ID NO: 125336 - DNA, 22 bp, Artificial Sequence
  chemically synthesized
aaaaaccagcttctggattcat

SEQ ID NO: 125337 - DNA, 22 bp, Artificial Sequence
  chemically synthesized
ctggattcattgattttttgaa

SEQ ID NO: 125338 - DNA, 22 bp, Artificial Sequence
  chemically synthesized
tggattcattgattttttgaag

SEQ ID NO: 125339 - DNA, 22 bp, Artificial Sequence
  chemically synthesized
gattcattgattttttgaaggg

SEQ ID NO: 125340 - DNA, 22 bp, Artificial Sequence
  chemically synthesized
attgattttttgaagggttttt

SEQ ID NO: 125341 - DNA, 22 bp, Artificial Sequence
  chemically synthesized
attttttgaagggtttttttgt

SEQ ID NO: 125342 - DNA, 22 bp, Artificial Sequence
  chemically synthesized
tttgaagggtttttttgtgtct

SEQ ID NO: 125343 - DNA, 22 bp, Artificial Sequence
  chemically synthesized
ttgaagggtttttttgtgtctc

SEQ ID NO: 125344 - DNA, 22 bp, Artificial Sequence
  chemically synthesized
tgaagggtttttttgtgtctct

SEQ ID NO: 125345 - DNA, 22 bp, Artificial Sequence
  chemically synthesized
gaagggtttttttgtgtctcta

SEQ ID NO: 125346 - DNA, 22 bp, Artificial Sequence
  chemically synthesized
aagggtttttttgtgtctctat

SEQ ID NO: 125347 - DNA, 22 bp, Artificial Sequence
  chemically synthesized
ttttgtgtctctatttccttca

SEQ ID NO: 125348 - DNA, 22 bp, Artificial Sequence
  chemically synthesized
tttgtgtctctatttccttcag

SEQ ID NO: 125349 - DNA, 22 bp, Artificial Sequence
  chemically synthesized
ttgtgtctctatttccttcagt

SEQ ID NO: 125350 - DNA, 22 bp, Artificial Sequence
  chemically synthesized
tgtgtctctatttccttcagtt

SEQ ID NO: 125351 - DNA, 22 bp, Artificial Sequence
  chemically synthesized
gtgtctctatttccttcagttc

SEQ ID NO: 125352 - DNA, 22 bp, Artificial Sequence
  chemically synthesized
tgtctctatttccttcagttct

SEQ ID NO: 125353 - DNA, 22 bp, Artificial Sequence
  chemically synthesized
tatttccttcagttctgctctg

SEQ ID NO: 125354 - DNA, 22 bp, Artificial Sequence
  chemically synthesized
tttccttcagttctgctctgat

SEQ ID NO: 125355 - DNA, 22 bp, Artificial Sequence
  chemically synthesized
ccttcagttctgctctgatttt

SEQ ID NO: 125356 - DNA, 22 bp, Artificial Sequence
  chemically synthesized
cttcagttctgctctgatttta

SEQ ID NO: 125357 - DNA, 22 bp, Artificial Sequence
  chemically synthesized
cagttctgctctgattttagtt

SEQ ID NO: 125358 - DNA, 22 bp, Artificial Sequence
  chemically synthesized
agttctgctctgattttagtta

SEQ ID NO: 125359 - DNA, 22 bp, Artificial Sequence
  chemically synthesized
tgctctgattttagttatttct

SEQ ID NO: 125360 - DNA, 22 bp, Artificial Sequence
  chemically synthesized
ctctgattttagttatttcttg

SEQ ID NO: 125361 - DNA, 22 bp, Artificial Sequence
  chemically synthesized
tgattttagttatttcttgcct

SEQ ID NO: 125362 - DNA, 22 bp, Artificial Sequence
  chemically synthesized
attttagttatttcttgccttc

SEQ ID NO: 125363 - DNA, 22 bp, Artificial Sequence
  chemically synthesized
tagttatttcttgccttctgct

SEQ ID NO: 125364 - DNA, 22 bp, Artificial Sequence
  chemically synthesized
agttatttcttgccttctgcta

SEQ ID NO: 125365 - DNA, 22 bp, Artificial Sequence
  chemically synthesized
gttatttcttgccttctgctag

SEQ ID NO: 125366 - DNA, 22 bp, Artificial Sequence
  chemically synthesized
tttcttgccttctgctagcatt

SEQ ID NO: 125367 - DNA, 22 bp, Artificial Sequence
  chemically synthesized
cttgccttctgctagcatttga

SEQ ID NO: 125368 - DNA, 22 bp, Artificial Sequence
  chemically synthesized
ttgccttctgctagcatttgaa

SEQ ID NO: 125369 - DNA, 22 bp, Artificial Sequence
  chemically synthesized
gccttctgctagcatttgaatg

SEQ ID NO: 125370 - DNA, 22 bp, Artificial Sequence
  chemically synthesized
ccttctgctagcatttgaatgt

SEQ ID NO: 125371 - DNA, 22 bp, Artificial Sequence
  chemically synthesized
ctgctagcatttgaatgtgttt

SEQ ID NO: 125372 - DNA, 22 bp, Artificial Sequence
  chemically synthesized
tgctagcatttgaatgtgtttg

SEQ ID NO: 125373 - DNA, 22 bp, Artificial Sequence
  chemically synthesized
ctagcatttgaatgtgtttgct

SEQ ID NO: 125374 - DNA, 22 bp, Artificial Sequence
  chemically synthesized
gcatttgaatgtgtttgctctt

SEQ ID NO: 125375 - DNA, 22 bp, Artificial Sequence
  chemically synthesized
gaatgtgtttgctcttgcttct

SEQ ID NO: 125376 - DNA, 22 bp, Artificial Sequence
  chemically synthesized
aatgtgtttgctcttgcttctc

SEQ ID NO: 125377 - DNA, 22 bp, Artificial Sequence
  chemically synthesized
gctcttgcttctctagttcttt

SEQ ID NO: 125378 - DNA, 22 bp, Artificial Sequence
  chemically synthesized
ctcttgcttctctagttctttt

SEQ ID NO: 125379 - DNA, 22 bp, Artificial Sequence
  chemically synthesized
ttgcttctctagttcttttaat

SEQ ID NO: 125380 - DNA, 22 bp, Artificial Sequence
  chemically synthesized
gcttctctagttcttttaattg

SEQ ID NO: 125381 - DNA, 22 bp, Artificial Sequence
  chemically synthesized
cttctctagttcttttaattgt

SEQ ID NO: 125382 - DNA, 22 bp, Artificial Sequence
  chemically synthesized
ctctagttcttttaattgtgat

SEQ ID NO: 125383 - DNA, 22 bp, Artificial Sequence
  chemically synthesized
tctagttcttttaattgtgatg

SEQ ID NO: 125384 - DNA, 22 bp, Artificial Sequence
  chemically synthesized
tagttcttttaattgtgatgtt

SEQ ID NO: 125385 - DNA, 22 bp, Artificial Sequence
  chemically synthesized
gttcttttaattgtgatgttag

SEQ ID NO: 125386 - DNA, 22 bp, Artificial Sequence
  chemically synthesized
ttttaattgtgatgttagggtg

SEQ ID NO: 125387 - DNA, 22 bp, Artificial Sequence
  chemically synthesized
ttaattgtgatgttagggtgtc

SEQ ID NO: 125388 - DNA, 22 bp, Artificial Sequence
  chemically synthesized
taattgtgatgttagggtgtca

SEQ ID NO: 125389 - DNA, 22 bp, Artificial Sequence
  chemically synthesized
aattgtgatgttagggtgtcaa

SEQ ID NO: 125390 - DNA, 22 bp, Artificial Sequence
  chemically synthesized
attgtgatgttagggtgtcaat

SEQ ID NO: 125391 - DNA, 22 bp, Artificial Sequence
  chemically synthesized
tgatgttagggtgtcaatttta

SEQ ID NO: 125392 - DNA, 22 bp, Artificial Sequence
  chemically synthesized
gggtgtcaattttagatctttc

SEQ ID NO: 125393 - DNA, 22 bp, Artificial Sequence
  chemically synthesized
tagatctttcctgctttctctt

SEQ ID NO: 125394 - DNA, 22 bp, Artificial Sequence
  chemically synthesized
agatctttcctgctttctcttc

SEQ ID NO: 125395 - DNA, 22 bp, Artificial Sequence
  chemically synthesized
gatctttcctgctttctcttct

SEQ ID NO: 125396 - DNA, 22 bp, Artificial Sequence
  chemically synthesized
tcctgctttctcttctgggcgt

SEQ ID NO: 125397 - DNA, 22 bp, Artificial Sequence
  chemically synthesized
cctgctttctcttctgggcgtt

SEQ ID NO: 125398 - DNA, 22 bp, Artificial Sequence
  chemically synthesized
ctgctttctcttctgggcgttt

SEQ ID NO: 125399 - DNA, 22 bp, Artificial Sequence
  chemically synthesized
ctttctcttctgggcgtttagt

SEQ ID NO: 125400 - DNA, 22 bp, Artificial Sequence
  chemically synthesized
tctcttctgggcgtttagtgct

SEQ ID NO: 125401 - DNA, 22 bp, Artificial Sequence
  chemically synthesized
ctcttctgggcgtttagtgcta

SEQ ID NO: 125402 - DNA, 22 bp, Artificial Sequence
  chemically synthesized
tcttctgggcgtttagtgctat

SEQ ID NO: 125403 - DNA, 22 bp, Artificial Sequence
  chemically synthesized
ttctgggcgtttagtgctataa

SEQ ID NO: 125404 - DNA, 22 bp, Artificial Sequence
  chemically synthesized
ctgggcgtttagtgctataaat

SEQ ID NO: 125405 - DNA, 22 bp, Artificial Sequence
  chemically synthesized
tgggcgtttagtgctataaatt

SEQ ID NO: 125406 - DNA, 22 bp, Artificial Sequence
  chemically synthesized
ggcgtttagtgctataaatttc

SEQ ID NO: 125407 - DNA, 22 bp, Artificial Sequence
  chemically synthesized
agtgctataaatttccctctac

SEQ ID NO: 125408 - DNA, 22 bp, Artificial Sequence
  chemically synthesized
gtgctataaatttccctctaca

SEQ ID NO: 125409 - DNA, 22 bp, Artificial Sequence
  chemically synthesized
taaatttccctctacacactgc

SEQ ID NO: 125410 - DNA, 22 bp, Artificial Sequence
  chemically synthesized
ccctctacacactgctttgaat

SEQ ID NO: 125411 - DNA, 22 bp, Artificial Sequence
  chemically synthesized
cctctacacactgctttgaatg

SEQ ID NO: 125412 - DNA, 22 bp, Artificial Sequence
  chemically synthesized
tacacactgctttgaatgtgtc

SEQ ID NO: 125413 - DNA, 22 bp, Artificial Sequence
  chemically synthesized
cacactgctttgaatgtgtccc

SEQ ID NO: 125414 - DNA, 22 bp, Artificial Sequence
  chemically synthesized
ctttgaatgtgtcccagagatt

SEQ ID NO: 125415 - DNA, 22 bp, Artificial Sequence
  chemically synthesized
tgaatgtgtcccagagattctg

SEQ ID NO: 125416 - DNA, 22 bp, Artificial Sequence
  chemically synthesized
gaatgtgtcccagagattctgg

SEQ ID NO: 125417 - DNA, 22 bp, Artificial Sequence
  chemically synthesized
aatgtgtcccagagattctggt

SEQ ID NO: 125418 - DNA, 22 bp, Artificial Sequence
  chemically synthesized
tggtatgttgtgtctttgttct

SEQ ID NO: 125419 - DNA, 22 bp, Artificial Sequence
  chemically synthesized
gtatgttgtgtctttgttctct

SEQ ID NO: 125420 - DNA, 22 bp, Artificial Sequence
  chemically synthesized
tgtctttgttctctttggttcc

SEQ ID NO: 125421 - DNA, 22 bp, Artificial Sequence
  chemically synthesized
tgttctctttggttccaaagaa

SEQ ID NO: 125422 - DNA, 22 bp, Artificial Sequence
  chemically synthesized
gttctctttggttccaaagaac

SEQ ID NO: 125423 - DNA, 22 bp, Artificial Sequence
  chemically synthesized
ttctctttggttccaaagaaca

SEQ ID NO: 125424 - DNA, 22 bp, Artificial Sequence
  chemically synthesized
tctttggttccaaagaacattt

SEQ ID NO: 125425 - DNA, 22 bp, Artificial Sequence
  chemically synthesized
tttggttccaaagaacattttt

SEQ ID NO: 125426 - DNA, 22 bp, Artificial Sequence
  chemically synthesized
tggttccaaagaacatttttat

SEQ ID NO: 125427 - DNA, 22 bp, Artificial Sequence
  chemically synthesized
ggttccaaagaacatttttatt

SEQ ID NO: 125428 - DNA, 22 bp, Artificial Sequence
  chemically synthesized
gttccaaagaacatttttattt

SEQ ID NO: 125429 - DNA, 22 bp, Artificial Sequence
  chemically synthesized
caaagaacatttttatttctgc

SEQ ID NO: 125430 - DNA, 22 bp, Artificial Sequence
  chemically synthesized
ttatttctgccttcattttgtt

SEQ ID NO: 125431 - DNA, 22 bp, Artificial Sequence
  chemically synthesized
tatttctgccttcattttgtta

SEQ ID NO: 125432 - DNA, 22 bp, Artificial Sequence
  chemically synthesized
atttctgccttcattttgttat

SEQ ID NO: 125433 - DNA, 22 bp, Artificial Sequence
  chemically synthesized
tttctgccttcattttgttatg

SEQ ID NO: 125434 - DNA, 22 bp, Artificial Sequence
  chemically synthesized
ctgccttcattttgttatgaac

SEQ ID NO: 125435 - DNA, 22 bp, Artificial Sequence
  chemically synthesized
tgccttcattttgttatgaacc

SEQ ID NO: 125436 - DNA, 22 bp, Artificial Sequence
  chemically synthesized
ccttcattttgttatgaaccca

SEQ ID NO: 125437 - DNA, 22 bp, Artificial Sequence
  chemically synthesized
cattttgttatgaacccagtag

SEQ ID NO: 125438 - DNA, 22 bp, Artificial Sequence
  chemically synthesized
attttgttatgaacccagtagt

SEQ ID NO: 125439 - DNA, 22 bp, Artificial Sequence
  chemically synthesized
tgttatgaacccagtagtcatt

SEQ ID NO: 125440 - DNA, 22 bp, Artificial Sequence
  chemically synthesized
gttatgaacccagtagtcattc

SEQ ID NO: 125441 - DNA, 22 bp, Artificial Sequence
  chemically synthesized
ttatgaacccagtagtcattca

SEQ ID NO: 125442 - DNA, 22 bp, Artificial Sequence
  chemically synthesized
tgaacccagtagtcattcagga

SEQ ID NO: 125443 - DNA, 22 bp, Artificial Sequence
  chemically synthesized
aggagcaatttgttcggtttcc

SEQ ID NO: 125444 - DNA, 22 bp, Artificial Sequence
  chemically synthesized
gttcggtttccatgtagttgag

SEQ ID NO: 125445 - DNA, 22 bp, Artificial Sequence
  chemically synthesized
ttcggtttccatgtagttgagc

SEQ ID NO: 125446 - DNA, 22 bp, Artificial Sequence
  chemically synthesized
ggtttccatgtagttgagcggt

SEQ ID NO: 125447 - DNA, 22 bp, Artificial Sequence
  chemically synthesized
ccatgtagttgagcggttttga

SEQ ID NO: 125448 - DNA, 22 bp, Artificial Sequence
  chemically synthesized
catgtagttgagcggttttgag

SEQ ID NO: 125449 - DNA, 22 bp, Artificial Sequence
  chemically synthesized
agcggttttgagtgagtttctt

SEQ ID NO: 125450 - DNA, 22 bp, Artificial Sequence
  chemically synthesized
tgagtgagtttcttaatcctga

SEQ ID NO: 125451 - DNA, 22 bp, Artificial Sequence
  chemically synthesized
gagtgagtttcttaatcctgag

SEQ ID NO: 125452 - DNA, 22 bp, Artificial Sequence
  chemically synthesized
agtgagtttcttaatcctgagt

SEQ ID NO: 125453 - DNA, 22 bp, Artificial Sequence
  chemically synthesized
cttaatcctgagttctagtttg

SEQ ID NO: 125454 - DNA, 22 bp, Artificial Sequence
  chemically synthesized
ttaatcctgagttctagtttga

SEQ ID NO: 125455 - DNA, 22 bp, Artificial Sequence
  chemically synthesized
aatcctgagttctagtttgatt

SEQ ID NO: 125456 - DNA, 22 bp, Artificial Sequence
  chemically synthesized
atcctgagttctagtttgattg

SEQ ID NO: 125457 - DNA, 22 bp, Artificial Sequence
  chemically synthesized
agttctagtttgattgcactgt

SEQ ID NO: 125458 - DNA, 22 bp, Artificial Sequence
  chemically synthesized
tagtttgattgcactgtggtct

SEQ ID NO: 125459 - DNA, 22 bp, Artificial Sequence
  chemically synthesized
gtttgattgcactgtggtctga

SEQ ID NO: 125460 - DNA, 22 bp, Artificial Sequence
  chemically synthesized
gattgcactgtggtctgagaga

SEQ ID NO: 125461 - DNA, 22 bp, Artificial Sequence
  chemically synthesized
attgcactgtggtctgagagac

SEQ ID NO: 125462 - DNA, 22 bp, Artificial Sequence
  chemically synthesized
cactgtggtctgagagacagtt

SEQ ID NO: 125463 - DNA, 22 bp, Artificial Sequence
  chemically synthesized
tggtctgagagacagtttgtta

SEQ ID NO: 125464 - DNA, 22 bp, Artificial Sequence
  chemically synthesized
agagacagtttgttataatttc

SEQ ID NO: 125465 - DNA, 22 bp, Artificial Sequence
  chemically synthesized
gttataatttctgttcttttac

SEQ ID NO: 125466 - DNA, 22 bp, Artificial Sequence
  chemically synthesized
ttataatttctgttcttttaca

SEQ ID NO: 125467 - DNA, 22 bp, Artificial Sequence
  chemically synthesized
taatttctgttcttttacattt

SEQ ID NO: 125468 - DNA, 22 bp, Artificial Sequence
  chemically synthesized
ctgttcttttacatttgctgag

SEQ ID NO: 125469 - DNA, 22 bp, Artificial Sequence
  chemically synthesized
tgttcttttacatttgctgagg

SEQ ID NO: 125470 - DNA, 22 bp, Artificial Sequence
  chemically synthesized
ttcttttacatttgctgaggag

SEQ ID NO: 125471 - DNA, 22 bp, Artificial Sequence
  chemically synthesized
ttttacatttgctgaggagtgc

SEQ ID NO: 125472 - DNA, 22 bp, Artificial Sequence
  chemically synthesized
ttacatttgctgaggagtgctt

SEQ ID NO: 125473 - DNA, 22 bp, Artificial Sequence
  chemically synthesized
tacatttgctgaggagtgcttt

SEQ ID NO: 125474 - DNA, 22 bp, Artificial Sequence
  chemically synthesized
acatttgctgaggagtgcttta

SEQ ID NO: 125475 - DNA, 22 bp, Artificial Sequence
  chemically synthesized
catttgctgaggagtgctttac

SEQ ID NO: 125476 - DNA, 22 bp, Artificial Sequence
  chemically synthesized
gctgaggagtgctttacttcca

SEQ ID NO: 125477 - DNA, 22 bp, Artificial Sequence
  chemically synthesized
ctgaggagtgctttacttccaa

SEQ ID NO: 125478 - DNA, 22 bp, Artificial Sequence
  chemically synthesized
aggagtgctttacttccaacta

SEQ ID NO: 125479 - DNA, 22 bp, Artificial Sequence
  chemically synthesized
tacttccaactatgtggtcaat

SEQ ID NO: 125480 - DNA, 22 bp, Artificial Sequence
  chemically synthesized
acttccaactatgtggtcaatt

SEQ ID NO: 125481 - DNA, 22 bp, Artificial Sequence
  chemically synthesized
cttccaactatgtggtcaattt

SEQ ID NO: 125482 - DNA, 22 bp, Artificial Sequence
  chemically synthesized
ccaactatgtggtcaattttgg

SEQ ID NO: 125483 - DNA, 22 bp, Artificial Sequence
  chemically synthesized
caactatgtggtcaattttgga

SEQ ID NO: 125484 - DNA, 22 bp, Artificial Sequence
  chemically synthesized
tgtggtcaattttggaataggt

SEQ ID NO: 125485 - DNA, 22 bp, Artificial Sequence
  chemically synthesized
tggaataggtgtggtgtggtgc

SEQ ID NO: 125486 - DNA, 22 bp, Artificial Sequence
  chemically synthesized
ggaataggtgtggtgtggtgct

SEQ ID NO: 125487 - DNA, 22 bp, Artificial Sequence
  chemically synthesized
gaataggtgtggtgtggtgctg

SEQ ID NO: 125488 - DNA, 22 bp, Artificial Sequence
  chemically synthesized
aaaagaatgtatattctgttga

SEQ ID NO: 125489 - DNA, 22 bp, Artificial Sequence
  chemically synthesized
tgttgatttggggtggagagtt

SEQ ID NO: 125490 - DNA, 22 bp, Artificial Sequence
  chemically synthesized
ttgatttggggtggagagttct

SEQ ID NO: 125491 - DNA, 22 bp, Artificial Sequence
  chemically synthesized
atttggggtggagagttctgta

SEQ ID NO: 125492 - DNA, 22 bp, Artificial Sequence
  chemically synthesized
ggggtggagagttctgtagatg

SEQ ID NO: 125493 - DNA, 22 bp, Artificial Sequence
  chemically synthesized
gggtggagagttctgtagatgt

SEQ ID NO: 125494 - DNA, 22 bp, Artificial Sequence
  chemically synthesized
tgtagatgtctattaggtccgc

SEQ ID NO: 125495 - DNA, 22 bp, Artificial Sequence
  chemically synthesized
tagatgtctattaggtccgctt

SEQ ID NO: 125496 - DNA, 22 bp, Artificial Sequence
  chemically synthesized
ttaggtccgcttggtgcagagc

SEQ ID NO: 125497 - DNA, 22 bp, Artificial Sequence
  chemically synthesized
ggtccgcttggtgcagagctga

SEQ ID NO: 125498 - DNA, 22 bp, Artificial Sequence
  chemically synthesized
ggtgcagagctgagttcaattc

SEQ ID NO: 125499 - DNA, 22 bp, Artificial Sequence
  chemically synthesized
gtgcagagctgagttcaattcc

SEQ ID NO: 125500 - DNA, 22 bp, Artificial Sequence
  chemically synthesized
agttcaattcctggatatcctt

SEQ ID NO: 125501 - DNA, 22 bp, Artificial Sequence
  chemically synthesized
aattcctggatatccttgttaa

SEQ ID NO: 125502 - DNA, 22 bp, Artificial Sequence
  chemically synthesized
ctggatatccttgttaactttc

SEQ ID NO: 125503 - DNA, 22 bp, Artificial Sequence
  chemically synthesized
gatatccttgttaactttctgt

SEQ ID NO: 125504 - DNA, 22 bp, Artificial Sequence
  chemically synthesized
gttaactttctgtctcgttgat

SEQ ID NO: 125505 - DNA, 22 bp, Artificial Sequence
  chemically synthesized
ttaactttctgtctcgttgatc

SEQ ID NO: 125506 - DNA, 22 bp, Artificial Sequence
  chemically synthesized
actttctgtctcgttgatctgt

SEQ ID NO: 125507 - DNA, 22 bp, Artificial Sequence
  chemically synthesized
tctgtctcgttgatctgtctaa

SEQ ID NO: 125508 - DNA, 22 bp, Artificial Sequence
  chemically synthesized
ctgtctcgttgatctgtctaat

SEQ ID NO: 125509 - DNA, 22 bp, Artificial Sequence
  chemically synthesized
tgtctcgttgatctgtctaatg

SEQ ID NO: 125510 - DNA, 22 bp, Artificial Sequence
  chemically synthesized
tctcgttgatctgtctaatgtt

SEQ ID NO: 125511 - DNA, 22 bp, Artificial Sequence
  chemically synthesized
gttgatctgtctaatgttgatc

SEQ ID NO: 125512 - DNA, 22 bp, Artificial Sequence
  chemically synthesized
atctgtctaatgttgatctgtc

SEQ ID NO: 125513 - DNA, 22 bp, Artificial Sequence
  chemically synthesized
tctaatgttgatctgtctaatg

SEQ ID NO: 125514 - DNA, 22 bp, Artificial Sequence
  chemically synthesized
atgttgatctgtctaatgttga

SEQ ID NO: 125515 - DNA, 22 bp, Artificial Sequence
  chemically synthesized
atctgtctaatgttgacagtgg

SEQ ID NO: 125516 - DNA, 22 bp, Artificial Sequence
  chemically synthesized
tctaatgttgacagtggggtgt

SEQ ID NO: 125517 - DNA, 22 bp, Artificial Sequence
  chemically synthesized
atgttgacagtggggtgttaaa

SEQ ID NO: 125518 - DNA, 22 bp, Artificial Sequence
  chemically synthesized
acagtggggtgttaaagtctcc

SEQ ID NO: 125519 - DNA, 22 bp, Artificial Sequence
  chemically synthesized
aagtctcccattgttattgtgt

SEQ ID NO: 125520 - DNA, 22 bp, Artificial Sequence
  chemically synthesized
ccattgttattgtgtgagagtc

SEQ ID NO: 125521 - DNA, 22 bp, Artificial Sequence
  chemically synthesized
ttattgtgtgagagtctaagtc

SEQ ID NO: 125522 - DNA, 22 bp, Artificial Sequence
  chemically synthesized
ttgtgtgagagtctaagtctct

SEQ ID NO: 125523 - DNA, 22 bp, Artificial Sequence
  chemically synthesized
tgtgagagtctaagtctctttg

SEQ ID NO: 125524 - DNA, 22 bp, Artificial Sequence
  chemically synthesized
agtctctttgtaggtctctaag

SEQ ID NO: 125525 - DNA, 22 bp, Artificial Sequence
  chemically synthesized
tttgtaggtctctaaggacttg

SEQ ID NO: 125526 - DNA, 22 bp, Artificial Sequence
  chemically synthesized
tgtaggtctctaaggacttgct

SEQ ID NO: 125527 - DNA, 22 bp, Artificial Sequence
  chemically synthesized
gtaggtctctaaggacttgctt

SEQ ID NO: 125528 - DNA, 22 bp, Artificial Sequence
  chemically synthesized
taggtctctaaggacttgcttt

SEQ ID NO: 125529 - DNA, 22 bp, Artificial Sequence
  chemically synthesized
taaggacttgctttatgaacct

SEQ ID NO: 125530 - DNA, 22 bp, Artificial Sequence
  chemically synthesized
aggacttgctttatgaacctgg

SEQ ID NO: 125531 - DNA, 22 bp, Artificial Sequence
  chemically synthesized
gctttatgaacctgggtgttcc

SEQ ID NO: 125532 - DNA, 22 bp, Artificial Sequence
  chemically synthesized
ctttatgaacctgggtgttcct

SEQ ID NO: 125533 - DNA, 22 bp, Artificial Sequence
  chemically synthesized
tatgaacctgggtgttcctgta

SEQ ID NO: 125534 - DNA, 22 bp, Artificial Sequence
  chemically synthesized
atgaacctgggtgttcctgtat

SEQ ID NO: 125535 - DNA, 22 bp, Artificial Sequence
  chemically synthesized
tgaacctgggtgttcctgtatt

SEQ ID NO: 125536 - DNA, 22 bp, Artificial Sequence
  chemically synthesized
ggtgttcctgtattgggtgcat

SEQ ID NO: 125537 - DNA, 22 bp, Artificial Sequence
  chemically synthesized
ctgtattgggtgcatatatgtt

SEQ ID NO: 125538 - DNA, 22 bp, Artificial Sequence
  chemically synthesized
tattgggtgcatatatgtttag

SEQ ID NO: 125539 - DNA, 22 bp, Artificial Sequence
  chemically synthesized
ggtgcatatatgtttaggatag

SEQ ID NO: 125540 - DNA, 22 bp, Artificial Sequence
  chemically synthesized
aggatagttagctcttcttgtt

SEQ ID NO: 125541 - DNA, 22 bp, Artificial Sequence
  chemically synthesized
ggatagttagctcttcttgttg

SEQ ID NO: 125542 - DNA, 22 bp, Artificial Sequence
  chemically synthesized
gctcttcttgttgaattgatcc

SEQ ID NO: 125543 - DNA, 22 bp, Artificial Sequence
  chemically synthesized
ttcttgttgaattgatcccttt

SEQ ID NO: 125544 - DNA, 22 bp, Artificial Sequence
  chemically synthesized
cttgttgaattgatccctttac

SEQ ID NO: 125545 - DNA, 22 bp, Artificial Sequence
  chemically synthesized
ttgttgaattgatccctttacc

SEQ ID NO: 125546 - DNA, 22 bp, Artificial Sequence
  chemically synthesized
gttgaattgatccctttaccat

SEQ ID NO: 125547 - DNA, 22 bp, Artificial Sequence
  chemically synthesized
ttgaattgatccctttaccatt

SEQ ID NO: 125548 - DNA, 22 bp, Artificial Sequence
  chemically synthesized
aattgatccctttaccattatg

SEQ ID NO: 125549 - DNA, 22 bp, Artificial Sequence
  chemically synthesized
atccctttaccattatgtaatg

SEQ ID NO: 125550 - DNA, 22 bp, Artificial Sequence
  chemically synthesized
taccattatgtaatggccttct

SEQ ID NO: 125551 - DNA, 22 bp, Artificial Sequence
  chemically synthesized
accattatgtaatggccttctt

SEQ ID NO: 125552 - DNA, 22 bp, Artificial Sequence
  chemically synthesized
ccattatgtaatggccttcttt

SEQ ID NO: 125553 - DNA, 22 bp, Artificial Sequence
  chemically synthesized
tgtaatggccttctttgtctct

SEQ ID NO: 125554 - DNA, 22 bp, Artificial Sequence
  chemically synthesized
ctttgtctcttttgatctttgt

SEQ ID NO: 125555 - DNA, 22 bp, Artificial Sequence
  chemically synthesized
tttgtctcttttgatctttgtt

SEQ ID NO: 125556 - DNA, 22 bp, Artificial Sequence
  chemically synthesized
tgtctcttttgatctttgttgg

SEQ ID NO: 125557 - DNA, 22 bp, Artificial Sequence
  chemically synthesized
gtctcttttgatctttgttggt

SEQ ID NO: 125558 - DNA, 22 bp, Artificial Sequence
  chemically synthesized
tctcttttgatctttgttggtt

SEQ ID NO: 125559 - DNA, 22 bp, Artificial Sequence
  chemically synthesized
ttttgatctttgttggtttaaa

SEQ ID NO: 125560 - DNA, 22 bp, Artificial Sequence
  chemically synthesized
ttgatctttgttggtttaaagc

SEQ ID NO: 125561 - DNA, 22 bp, Artificial Sequence
  chemically synthesized
tgatctttgttggtttaaagcc

SEQ ID NO: 125562 - DNA, 22 bp, Artificial Sequence
  chemically synthesized
gatctttgttggtttaaagcct

SEQ ID NO: 125563 - DNA, 22 bp, Artificial Sequence
  chemically synthesized
atctttgttggtttaaagcctg

SEQ ID NO: 125564 - DNA, 22 bp, Artificial Sequence
  chemically synthesized
tgttggtttaaagcctgtttta

SEQ ID NO: 125565 - DNA, 22 bp, Artificial Sequence
  chemically synthesized
gttggtttaaagcctgttttat

SEQ ID NO: 125566 - DNA, 22 bp, Artificial Sequence
  chemically synthesized
ttggtttaaagcctgttttatc

SEQ ID NO: 125567 - DNA, 22 bp, Artificial Sequence
  chemically synthesized
gtttaaagcctgttttatcaga

SEQ ID NO: 125568 - DNA, 22 bp, Artificial Sequence
  chemically synthesized
aaagcctgttttatcagagatg

SEQ ID NO: 125569 - DNA, 22 bp, Artificial Sequence
  chemically synthesized
aagcctgttttatcagagatga

SEQ ID NO: 125570 - DNA, 22 bp, Artificial Sequence
  chemically synthesized
ttttatcagagatgaggattgc

SEQ ID NO: 125571 - DNA, 22 bp, Artificial Sequence
  chemically synthesized
tatcagagatgaggattgcaac

SEQ ID NO: 125572 - DNA, 22 bp, Artificial Sequence
  chemically synthesized
atcagagatgaggattgcaacc

SEQ ID NO: 125573 - DNA, 22 bp, Artificial Sequence
  chemically synthesized
tcagagatgaggattgcaaccc

SEQ ID NO: 125574 - DNA, 22 bp, Artificial Sequence
  chemically synthesized
caacccctgcctttttttgttt

SEQ ID NO: 125575 - DNA, 22 bp, Artificial Sequence
  chemically synthesized
cctttttttgttttccattttc

SEQ ID NO: 125576 - DNA, 22 bp, Artificial Sequence
  chemically synthesized
tttttgttttccattttcttgg

SEQ ID NO: 125577 - DNA, 22 bp, Artificial Sequence
  chemically synthesized
ttttgttttccattttcttggt

SEQ ID NO: 125578 - DNA, 22 bp, Artificial Sequence
  chemically synthesized
tttgttttccattttcttggta

SEQ ID NO: 125579 - DNA, 22 bp, Artificial Sequence
  chemically synthesized
ttgttttccattttcttggtag

SEQ ID NO: 125580 - DNA, 22 bp, Artificial Sequence
  chemically synthesized
tgttttccattttcttggtaga

SEQ ID NO: 125581 - DNA, 22 bp, Artificial Sequence
  chemically synthesized
gttttccattttcttggtagat

SEQ ID NO: 125582 - DNA, 22 bp, Artificial Sequence
  chemically synthesized
ttttccattttcttggtagatc

SEQ ID NO: 125583 - DNA, 22 bp, Artificial Sequence
  chemically synthesized
tccattttcttggtagatcttc

SEQ ID NO: 125584 - DNA, 22 bp, Artificial Sequence
  chemically synthesized
ccattttcttggtagatcttcc

SEQ ID NO: 125585 - DNA, 22 bp, Artificial Sequence
  chemically synthesized
cattttcttggtagatcttcct

SEQ ID NO: 125586 - DNA, 22 bp, Artificial Sequence
  chemically synthesized
tcttggtagatcttcctccatc

SEQ ID NO: 125587 - DNA, 22 bp, Artificial Sequence
  chemically synthesized
cttggtagatcttcctccatcc

SEQ ID NO: 125588 - DNA, 22 bp, Artificial Sequence
  chemically synthesized
ttggtagatcttcctccatccc

SEQ ID NO: 125589 - DNA, 22 bp, Artificial Sequence
  chemically synthesized
ggtagatcttcctccatccctt

SEQ ID NO: 125590 - DNA, 22 bp, Artificial Sequence
  chemically synthesized
gtagatcttcctccatcccttt

SEQ ID NO: 125591 - DNA, 22 bp, Artificial Sequence
  chemically synthesized
cctccatccctttattttgagc

SEQ ID NO: 125592 - DNA, 22 bp, Artificial Sequence
  chemically synthesized
ctccatccctttattttgagcc

SEQ ID NO: 125593 - DNA, 22 bp, Artificial Sequence
  chemically synthesized
catccctttattttgagcctat

SEQ ID NO: 125594 - DNA, 22 bp, Artificial Sequence
  chemically synthesized
tattttgagcctatgtgtgtgt

SEQ ID NO: 125595 - DNA, 22 bp, Artificial Sequence
  chemically synthesized
attttgagcctatgtgtgtgtg

SEQ ID NO: 125596 - DNA, 22 bp, Artificial Sequence
  chemically synthesized
ttttgagcctatgtgtgtgtgt

SEQ ID NO: 125597 - DNA, 22 bp, Artificial Sequence
  chemically synthesized
tgagcctatgtgtgtgtgtgca

SEQ ID NO: 125598 - DNA, 22 bp, Artificial Sequence
  chemically synthesized
gagcctatgtgtgtgtgtgcac

SEQ ID NO: 125599 - DNA, 22 bp, Artificial Sequence
  chemically synthesized
agcctatgtgtgtgtgtgcaca

SEQ ID NO: 125600 - DNA, 22 bp, Artificial Sequence
  chemically synthesized
tgtgtgtgtgtgcacatgagat

SEQ ID NO: 125601 - DNA, 22 bp, Artificial Sequence
  chemically synthesized
cctgaatacagcacactgatgg

SEQ ID NO: 125602 - DNA, 22 bp, Artificial Sequence
  chemically synthesized
ctgaatacagcacactgatggg

SEQ ID NO: 125603 - DNA, 22 bp, Artificial Sequence
  chemically synthesized
aatacagcacactgatgggtct

SEQ ID NO: 125604 - DNA, 22 bp, Artificial Sequence
  chemically synthesized
atgggtcttgactctttatcta

SEQ ID NO: 125605 - DNA, 22 bp, Artificial Sequence
  chemically synthesized
gactctttatctaatttgcccg

SEQ ID NO: 125606 - DNA, 22 bp, Artificial Sequence
  chemically synthesized
actctttatctaatttgcccgt

SEQ ID NO: 125607 - DNA, 22 bp, Artificial Sequence
  chemically synthesized
tttatctaatttgcccgtctgt

SEQ ID NO: 125608 - DNA, 22 bp, Artificial Sequence
  chemically synthesized
tatctaatttgcccgtctgtgt

SEQ ID NO: 125609 - DNA, 22 bp, Artificial Sequence
  chemically synthesized
atctaatttgcccgtctgtgtc

SEQ ID NO: 125610 - DNA, 22 bp, Artificial Sequence
  chemically synthesized
tctaatttgcccgtctgtgtct

SEQ ID NO: 125611 - DNA, 22 bp, Artificial Sequence
  chemically synthesized
atttgcccgtctgtgtcttttt

SEQ ID NO: 125612 - DNA, 22 bp, Artificial Sequence
  chemically synthesized
gcccgtctgtgtctttttactg

SEQ ID NO: 125613 - DNA, 22 bp, Artificial Sequence
  chemically synthesized
cccgtctgtgtctttttactgg

SEQ ID NO: 125614 - DNA, 22 bp, Artificial Sequence
  chemically synthesized
tgtctttttactggagcattta

SEQ ID NO: 125615 - DNA, 22 bp, Artificial Sequence
  chemically synthesized
tttactggagcatttagcccat

SEQ ID NO: 125616 - DNA, 22 bp, Artificial Sequence
  chemically synthesized
ttactggagcatttagcccatt

SEQ ID NO: 125617 - DNA, 22 bp, Artificial Sequence
  chemically synthesized
tactggagcatttagcccattt

SEQ ID NO: 125618 - DNA, 22 bp, Artificial Sequence
  chemically synthesized
actggagcatttagcccattta

SEQ ID NO: 125619 - DNA, 22 bp, Artificial Sequence
  chemically synthesized
ctggagcatttagcccatttac

SEQ ID NO: 125620 - DNA, 22 bp, Artificial Sequence
  chemically synthesized
gagcatttagcccatttacatt

SEQ ID NO: 125621 - DNA, 22 bp, Artificial Sequence
  chemically synthesized
agcccatttacattaaggttaa

SEQ ID NO: 125622 - DNA, 22 bp, Artificial Sequence
  chemically synthesized
gcccatttacattaaggttaat

SEQ ID NO: 125623 - DNA, 22 bp, Artificial Sequence
  chemically synthesized
acattaaggttaatattgttat

SEQ ID NO: 125624 - DNA, 22 bp, Artificial Sequence
  chemically synthesized
cattaaggttaatattgttatg

SEQ ID NO: 125625 - DNA, 22 bp, Artificial Sequence
  chemically synthesized
aggttaatattgttatgtgtga

SEQ ID NO: 125626 - DNA, 22 bp, Artificial Sequence
  chemically synthesized
atattgttatgtgtgaatttga

SEQ ID NO: 125627 - DNA, 22 bp, Artificial Sequence
  chemically synthesized
ttatgtgtgaatttgatcctgt

SEQ ID NO: 125628 - DNA, 22 bp, Artificial Sequence
  chemically synthesized
tgtgtgaatttgatcctgtcat

SEQ ID NO: 125629 - DNA, 22 bp, Artificial Sequence
  chemically synthesized
gatcctgtcattatgatgttag

SEQ ID NO: 125630 - DNA, 22 bp, Artificial Sequence
  chemically synthesized
atcctgtcattatgatgttagc

SEQ ID NO: 125631 - DNA, 22 bp, Artificial Sequence
  chemically synthesized
tcattatgatgttagctggtta

SEQ ID NO: 125632 - DNA, 22 bp, Artificial Sequence
  chemically synthesized
tgatgttagctggttattttgc

SEQ ID NO: 125633 - DNA, 22 bp, Artificial Sequence
  chemically synthesized
gctggttattttgctcattagt

SEQ ID NO: 125634 - DNA, 22 bp, Artificial Sequence
  chemically synthesized
gttattttgctcattagttgat

SEQ ID NO: 125635 - DNA, 22 bp, Artificial Sequence
  chemically synthesized
ttttgctcattagttgatgcag

SEQ ID NO: 125636 - DNA, 22 bp, Artificial Sequence
  chemically synthesized
tgctcattagttgatgcagttt

SEQ ID NO: 125637 - DNA, 22 bp, Artificial Sequence
  chemically synthesized
gctcattagttgatgcagtttc

SEQ ID NO: 125638 - DNA, 22 bp, Artificial Sequence
  chemically synthesized
ctcattagttgatgcagtttct

SEQ ID NO: 125639 - DNA, 22 bp, Artificial Sequence
  chemically synthesized
attagttgatgcagtttcttcc

SEQ ID NO: 125640 - DNA, 22 bp, Artificial Sequence
  chemically synthesized
gttgatgcagtttcttcctagc

SEQ ID NO: 125641 - DNA, 22 bp, Artificial Sequence
  chemically synthesized
atgcagtttcttcctagcctca

SEQ ID NO: 125642 - DNA, 22 bp, Artificial Sequence
  chemically synthesized
cttcctagcctcaatggtcttt

SEQ ID NO: 125643 - DNA, 22 bp, Artificial Sequence
  chemically synthesized
ttcctagcctcaatggtcttta

SEQ ID NO: 125644 - DNA, 22 bp, Artificial Sequence
  chemically synthesized
cctagcctcaatggtctttaca

SEQ ID NO: 125645 - DNA, 22 bp, Artificial Sequence
  chemically synthesized
ctagcctcaatggtctttacaa

SEQ ID NO: 125646 - DNA, 22 bp, Artificial Sequence
  chemically synthesized
gcctcaatggtctttacaattt

SEQ ID NO: 125647 - DNA, 22 bp, Artificial Sequence
  chemically synthesized
aatggtctttacaatttggcat

SEQ ID NO: 125648 - DNA, 22 bp, Artificial Sequence
  chemically synthesized
tacaatttggcatgtttttgca

SEQ ID NO: 125649 - DNA, 22 bp, Artificial Sequence
  chemically synthesized
acaatttggcatgtttttgcag

SEQ ID NO: 125650 - DNA, 22 bp, Artificial Sequence
  chemically synthesized
caatttggcatgtttttgcagt

SEQ ID NO: 125651 - DNA, 22 bp, Artificial Sequence
  chemically synthesized
ggcatgtttttgcagtggctgg

SEQ ID NO: 125652 - DNA, 22 bp, Artificial Sequence
  chemically synthesized
gcatgtttttgcagtggctggt

SEQ ID NO: 125653 - DNA, 22 bp, Artificial Sequence
  chemically synthesized
ttgcagtggctggtaccggttg

SEQ ID NO: 125654 - DNA, 22 bp, Artificial Sequence
  chemically synthesized
tgcagtggctggtaccggttgt

SEQ ID NO: 125655 - DNA, 22 bp, Artificial Sequence
  chemically synthesized
gcagtggctggtaccggttgtg

SEQ ID NO: 125656 - DNA, 22 bp, Artificial Sequence
  chemically synthesized
cagtggctggtaccggttgtgc

SEQ ID NO: 125657 - DNA, 22 bp, Artificial Sequence
  chemically synthesized
gtaccggttgtgcctttccata

SEQ ID NO: 125658 - DNA, 22 bp, Artificial Sequence
  chemically synthesized
tgcctttccatatttagtgctt

SEQ ID NO: 125659 - DNA, 22 bp, Artificial Sequence
  chemically synthesized
tccatatttagtgcttccttca

SEQ ID NO: 125660 - DNA, 22 bp, Artificial Sequence
  chemically synthesized
ccatatttagtgcttccttcag

SEQ ID NO: 125661 - DNA, 22 bp, Artificial Sequence
  chemically synthesized
catatttagtgcttccttcagg

SEQ ID NO: 125662 - DNA, 22 bp, Artificial Sequence
  chemically synthesized
agtgcttccttcaggagctctt

SEQ ID NO: 125663 - DNA, 22 bp, Artificial Sequence
  chemically synthesized
gtgcttccttcaggagctcttt

SEQ ID NO: 125664 - DNA, 22 bp, Artificial Sequence
  chemically synthesized
ccttcaggagctcttttaggtc

SEQ ID NO: 125665 - DNA, 22 bp, Artificial Sequence
  chemically synthesized
cttcaggagctcttttaggtca

SEQ ID NO: 125666 - DNA, 22 bp, Artificial Sequence
  chemically synthesized
caggagctcttttaggtcaggc

SEQ ID NO: 125667 - DNA, 22 bp, Artificial Sequence
  chemically synthesized
aggagctcttttaggtcaggcc

SEQ ID NO: 125668 - DNA, 22 bp, Artificial Sequence
  chemically synthesized
ttttaggtcaggcctggtgatg

SEQ ID NO: 125669 - DNA, 22 bp, Artificial Sequence
  chemically synthesized
ttaggtcaggcctggtgatgac

SEQ ID NO: 125670 - DNA, 22 bp, Artificial Sequence
  chemically synthesized
taggtcaggcctggtgatgaca

SEQ ID NO: 125671 - DNA, 22 bp, Artificial Sequence
  chemically synthesized
aggtcaggcctggtgatgacaa

SEQ ID NO: 125672 - DNA, 22 bp, Artificial Sequence
  chemically synthesized
ggtcaggcctggtgatgacaaa

SEQ ID NO: 125673 - DNA, 22 bp, Artificial Sequence
  chemically synthesized
gtgatgacaaaatctctcagca

SEQ ID NO: 125674 - DNA, 22 bp, Artificial Sequence
  chemically synthesized
tcagcatttgcttgtctgtaaa

SEQ ID NO: 125675 - DNA, 22 bp, Artificial Sequence
  chemically synthesized
agcatttgcttgtctgtaaagt

SEQ ID NO: 125676 - DNA, 22 bp, Artificial Sequence
  chemically synthesized
gcttgtctgtaaagtattttat

SEQ ID NO: 125677 - DNA, 22 bp, Artificial Sequence
  chemically synthesized
cttgtctgtaaagtattttatt

SEQ ID NO: 125678 - DNA, 22 bp, Artificial Sequence
  chemically synthesized
gtctgtaaagtattttatttct

SEQ ID NO: 125679 - DNA, 22 bp, Artificial Sequence
  chemically synthesized
tctgtaaagtattttatttctc

SEQ ID NO: 125680 - DNA, 22 bp, Artificial Sequence
  chemically synthesized
taaagtattttatttctccttc

SEQ ID NO: 125681 - DNA, 22 bp, Artificial Sequence
  chemically synthesized
tatttctccttcacttatgaag

SEQ ID NO: 125682 - DNA, 22 bp, Artificial Sequence
  chemically synthesized
atttctccttcacttatgaagc

SEQ ID NO: 125683 - DNA, 22 bp, Artificial Sequence
  chemically synthesized
tttctccttcacttatgaagct

SEQ ID NO: 125684 - DNA, 22 bp, Artificial Sequence
  chemically synthesized
ctccttcacttatgaagcttag

SEQ ID NO: 125685 - DNA, 22 bp, Artificial Sequence
  chemically synthesized
tccttcacttatgaagcttagt

SEQ ID NO: 125686 - DNA, 22 bp, Artificial Sequence
  chemically synthesized
cttcacttatgaagcttagttt

SEQ ID NO: 125687 - DNA, 22 bp, Artificial Sequence
  chemically synthesized
cacttatgaagcttagtttggc

SEQ ID NO: 125688 - DNA, 22 bp, Artificial Sequence
  chemically synthesized
acttatgaagcttagtttggct

SEQ ID NO: 125689 - DNA, 22 bp, Artificial Sequence
  chemically synthesized
atgaagcttagtttggctggat

SEQ ID NO: 125690 - DNA, 22 bp, Artificial Sequence
  chemically synthesized
tgaagcttagtttggctggata

SEQ ID NO: 125691 - DNA, 22 bp, Artificial Sequence
  chemically synthesized
agtttggctggatatgaaattc

SEQ ID NO: 125692 - DNA, 22 bp, Artificial Sequence
  chemically synthesized
gtttggctggatatgaaattct

SEQ ID NO: 125693 - DNA, 22 bp, Artificial Sequence
  chemically synthesized
ggctggatatgaaattctgtgt

SEQ ID NO: 125694 - DNA, 22 bp, Artificial Sequence
  chemically synthesized
gctggatatgaaattctgtgtt

SEQ ID NO: 125695 - DNA, 22 bp, Artificial Sequence
  chemically synthesized
gatatgaaattctgtgttgaaa

SEQ ID NO: 125696 - DNA, 22 bp, Artificial Sequence
  chemically synthesized
tgtgttgaaaattctttccttt

SEQ ID NO: 125697 - DNA, 22 bp, Artificial Sequence
  chemically synthesized
tgttgaaaattctttcctttaa

SEQ ID NO: 125698 - DNA, 22 bp, Artificial Sequence
  chemically synthesized
aaaattctttcctttaaggatg

SEQ ID NO: 125699 - DNA, 22 bp, Artificial Sequence
  chemically synthesized
tttcctttaaggatgttgaata

SEQ ID NO: 125700 - DNA, 22 bp, Artificial Sequence
  chemically synthesized
tcctttaaggatgttgaatatt

SEQ ID NO: 125701 - DNA, 22 bp, Artificial Sequence
  chemically synthesized
cctttaaggatgttgaatattg

SEQ ID NO: 125702 - DNA, 22 bp, Artificial Sequence
  chemically synthesized
ctttaaggatgttgaatattgg

SEQ ID NO: 125703 - DNA, 22 bp, Artificial Sequence
  chemically synthesized
taaggatgttgaatattggccc

SEQ ID NO: 125704 - DNA, 22 bp, Artificial Sequence
  chemically synthesized
aaggatgttgaatattggcccc

SEQ ID NO: 125705 - DNA, 22 bp, Artificial Sequence
  chemically synthesized
aggatgttgaatattggccccc

SEQ ID NO: 125706 - DNA, 22 bp, Artificial Sequence
  chemically synthesized
aatattggcccccactctcttc

SEQ ID NO: 125707 - DNA, 22 bp, Artificial Sequence
  chemically synthesized
gcccccactctcttctggcttg

SEQ ID NO: 125708 - DNA, 22 bp, Artificial Sequence
  chemically synthesized
tcttctggcttgtagagtttct

SEQ ID NO: 125709 - DNA, 22 bp, Artificial Sequence
  chemically synthesized
ttctggcttgtagagtttctgc

SEQ ID NO: 125710 - DNA, 22 bp, Artificial Sequence
  chemically synthesized
ctggcttgtagagtttctgctg

SEQ ID NO: 125711 - DNA, 22 bp, Artificial Sequence
  chemically synthesized
tggcttgtagagtttctgctga

SEQ ID NO: 125712 - DNA, 22 bp, Artificial Sequence
  chemically synthesized
gcttgtagagtttctgctgaga

SEQ ID NO: 125713 - DNA, 22 bp, Artificial Sequence
  chemically synthesized
gtagagtttctgctgagagatc

SEQ ID NO: 125714 - DNA, 22 bp, Artificial Sequence
  chemically synthesized
tagagtttctgctgagagatct

SEQ ID NO: 125715 - DNA, 22 bp, Artificial Sequence
  chemically synthesized
ctgctgagagatctgctgttat

SEQ ID NO: 125716 - DNA, 22 bp, Artificial Sequence
  chemically synthesized
tgctgagagatctgctgttatt

SEQ ID NO: 125717 - DNA, 22 bp, Artificial Sequence
  chemically synthesized
ctgagagatctgctgttattct

SEQ ID NO: 125718 - DNA, 22 bp, Artificial Sequence
  chemically synthesized
agagatctgctgttattctgat

SEQ ID NO: 125719 - DNA, 22 bp, Artificial Sequence
  chemically synthesized
ctgttattctgatgggcttccc

SEQ ID NO: 125720 - DNA, 22 bp, Artificial Sequence
  chemically synthesized
ttattctgatgggcttcccttt

SEQ ID NO: 125721 - DNA, 22 bp, Artificial Sequence
  chemically synthesized
ttctgatgggcttccctttgtg

SEQ ID NO: 125722 - DNA, 22 bp, Artificial Sequence
  chemically synthesized
tgatgggcttccctttgtgggt

SEQ ID NO: 125723 - DNA, 22 bp, Artificial Sequence
  chemically synthesized
atgggcttccctttgtgggtaa

SEQ ID NO: 125724 - DNA, 22 bp, Artificial Sequence
  chemically synthesized
ccctttgtgggtaacccgacct

SEQ ID NO: 125725 - DNA, 22 bp, Artificial Sequence
  chemically synthesized
cctttgtgggtaacccgacctt

SEQ ID NO: 125726 - DNA, 22 bp, Artificial Sequence
  chemically synthesized
tgtgggtaacccgacctttctc

SEQ ID NO: 125727 - DNA, 22 bp, Artificial Sequence
  chemically synthesized
gtgggtaacccgacctttctct

SEQ ID NO: 125728 - DNA, 22 bp, Artificial Sequence
  chemically synthesized
tgggtaacccgacctttctctc

SEQ ID NO: 125729 - DNA, 22 bp, Artificial Sequence
  chemically synthesized
tctctctggctacccttaacat

SEQ ID NO: 125730 - DNA, 22 bp, Artificial Sequence
  chemically synthesized
ctctctggctacccttaacatt

SEQ ID NO: 125731 - DNA, 22 bp, Artificial Sequence
  chemically synthesized
tctctggctacccttaacattt

SEQ ID NO: 125732 - DNA, 22 bp, Artificial Sequence
  chemically synthesized
tctggctacccttaacattttt

SEQ ID NO: 125733 - DNA, 22 bp, Artificial Sequence
  chemically synthesized
tggctacccttaacatttttcc

SEQ ID NO: 125734 - DNA, 22 bp, Artificial Sequence
  chemically synthesized
gctacccttaacatttttccct

SEQ ID NO: 125735 - DNA, 22 bp, Artificial Sequence
  chemically synthesized
cccttaacatttttcccttcat

SEQ ID NO: 125736 - DNA, 22 bp, Artificial Sequence
  chemically synthesized
aacatttttcccttcatttcaa

SEQ ID NO: 125737 - DNA, 22 bp, Artificial Sequence
  chemically synthesized
acatttttcccttcatttcaac

SEQ ID NO: 125738 - DNA, 22 bp, Artificial Sequence
  chemically synthesized
ttcccttcatttcaactttggt

SEQ ID NO: 125739 - DNA, 22 bp, Artificial Sequence
  chemically synthesized
tcccttcatttcaactttggtg

SEQ ID NO: 125740 - DNA, 22 bp, Artificial Sequence
  chemically synthesized
cccttcatttcaactttggtga

SEQ ID NO: 125741 - DNA, 22 bp, Artificial Sequence
  chemically synthesized
ccttcatttcaactttggtgaa

SEQ ID NO: 125742 - DNA, 22 bp, Artificial Sequence
  chemically synthesized
catttcaactttggtgaatctg

SEQ ID NO: 125743 - DNA, 22 bp, Artificial Sequence
  chemically synthesized
atttcaactttggtgaatctga

SEQ ID NO: 125744 - DNA, 22 bp, Artificial Sequence
  chemically synthesized
caactttggtgaatctgacaat

SEQ ID NO: 125745 - DNA, 22 bp, Artificial Sequence
  chemically synthesized
aactttggtgaatctgacaatt

SEQ ID NO: 125746 - DNA, 22 bp, Artificial Sequence
  chemically synthesized
tggtgaatctgacaattatgtg

SEQ ID NO: 125747 - DNA, 22 bp, Artificial Sequence
  chemically synthesized
ggtgaatctgacaattatgtgc

SEQ ID NO: 125748 - DNA, 22 bp, Artificial Sequence
  chemically synthesized
gtgaatctgacaattatgtgcc

SEQ ID NO: 125749 - DNA, 22 bp, Artificial Sequence
  chemically synthesized
acaattatgtgccttgtagttg

SEQ ID NO: 125750 - DNA, 22 bp, Artificial Sequence
  chemically synthesized
tgtgccttgtagttgctcttct

SEQ ID NO: 125751 - DNA, 22 bp, Artificial Sequence
  chemically synthesized
gtagttgctcttctcaaggagt

SEQ ID NO: 125752 - DNA, 22 bp, Artificial Sequence
  chemically synthesized
tagttgctcttctcaaggagta

SEQ ID NO: 125753 - DNA, 22 bp, Artificial Sequence
  chemically synthesized
ctcttctcaaggagtatctttg

SEQ ID NO: 125754 - DNA, 22 bp, Artificial Sequence
  chemically synthesized
ttctcaaggagtatctttgtgg

SEQ ID NO: 125755 - DNA, 22 bp, Artificial Sequence
  chemically synthesized
ctcaaggagtatctttgtggcg

SEQ ID NO: 125756 - DNA, 22 bp, Artificial Sequence
  chemically synthesized
tcaaggagtatctttgtggcgt

SEQ ID NO: 125757 - DNA, 22 bp, Artificial Sequence
  chemically synthesized
aaggagtatctttgtggcgttc

SEQ ID NO: 125758 - DNA, 22 bp, Artificial Sequence
  chemically synthesized
tgtggcgttctctgtatttcct

SEQ ID NO: 125759 - DNA, 22 bp, Artificial Sequence
  chemically synthesized
gtggcgttctctgtatttcctg

SEQ ID NO: 125760 - DNA, 22 bp, Artificial Sequence
  chemically synthesized
tggcgttctctgtatttcctga

SEQ ID NO: 125761 - DNA, 22 bp, Artificial Sequence
  chemically synthesized
tctgtatttcctgaatttgaat

SEQ ID NO: 125762 - DNA, 22 bp, Artificial Sequence
  chemically synthesized
tgtatttcctgaatttgaatgt

SEQ ID NO: 125763 - DNA, 22 bp, Artificial Sequence
  chemically synthesized
tatttcctgaatttgaatgttg

SEQ ID NO: 125764 - DNA, 22 bp, Artificial Sequence
  chemically synthesized
cctgaatttgaatgttgacctg

SEQ ID NO: 125765 - DNA, 22 bp, Artificial Sequence
  chemically synthesized
ctgaatttgaatgttgacctgc

SEQ ID NO: 125766 - DNA, 22 bp, Artificial Sequence
  chemically synthesized
aatttgaatgttgacctgcctt

SEQ ID NO: 125767 - DNA, 22 bp, Artificial Sequence
  chemically synthesized
gaatgttgacctgccttgctag

SEQ ID NO: 125768 - DNA, 22 bp, Artificial Sequence
  chemically synthesized
aatgttgacctgccttgctaga

SEQ ID NO: 125769 - DNA, 22 bp, Artificial Sequence
  chemically synthesized
acctgccttgctagattgggga

SEQ ID NO: 125770 - DNA, 22 bp, Artificial Sequence
  chemically synthesized
ccttgctagattggggaagttc

SEQ ID NO: 125771 - DNA, 22 bp, Artificial Sequence
  chemically synthesized
gctagattggggaagttctcct

SEQ ID NO: 125772 - DNA, 22 bp, Artificial Sequence
  chemically synthesized
ctagattggggaagttctcctg

SEQ ID NO: 125773 - DNA, 22 bp, Artificial Sequence
  chemically synthesized
gattggggaagttctcctggat

SEQ ID NO: 125774 - DNA, 22 bp, Artificial Sequence
  chemically synthesized
gggaagttctcctggataatat

SEQ ID NO: 125775 - DNA, 22 bp, Artificial Sequence
  chemically synthesized
tcctggataatatcctgcagag

SEQ ID NO: 125776 - DNA, 22 bp, Artificial Sequence
  chemically synthesized
ctggataatatcctgcagagtg

SEQ ID NO: 125777 - DNA, 22 bp, Artificial Sequence
  chemically synthesized
gataatatcctgcagagtgttt

SEQ ID NO: 125778 - DNA, 22 bp, Artificial Sequence
  chemically synthesized
cagagtgttttccaacttggtt

SEQ ID NO: 125779 - DNA, 22 bp, Artificial Sequence
  chemically synthesized
tccaacttggttccattctgcc

SEQ ID NO: 125780 - DNA, 22 bp, Artificial Sequence
  chemically synthesized
ccaacttggttccattctgccc

SEQ ID NO: 125781 - DNA, 22 bp, Artificial Sequence
  chemically synthesized
caacttggttccattctgcccg

SEQ ID NO: 125782 - DNA, 22 bp, Artificial Sequence
  chemically synthesized
ggttccattctgcccgtcactt

SEQ ID NO: 125783 - DNA, 22 bp, Artificial Sequence
  chemically synthesized
gttccattctgcccgtcacttt

SEQ ID NO: 125784 - DNA, 22 bp, Artificial Sequence
  chemically synthesized
cattctgcccgtcactttcagg

SEQ ID NO: 125785 - DNA, 22 bp, Artificial Sequence
  chemically synthesized
tgcccgtcactttcaggtacac

SEQ ID NO: 125786 - DNA, 22 bp, Artificial Sequence
  chemically synthesized
cccgtcactttcaggtacacca

SEQ ID NO: 125787 - DNA, 22 bp, Artificial Sequence
  chemically synthesized
tcaggtacaccaatcagatata

SEQ ID NO: 125788 - DNA, 22 bp, Artificial Sequence
  chemically synthesized
caggtacaccaatcagatatag

SEQ ID NO: 125789 - DNA, 22 bp, Artificial Sequence
  chemically synthesized
aggtacaccaatcagatataga

SEQ ID NO: 125790 - DNA, 22 bp, Artificial Sequence
  chemically synthesized
ggtcttttcacatagtcccata

SEQ ID NO: 125791 - DNA, 22 bp, Artificial Sequence
  chemically synthesized
gtcttttcacatagtcccatat

SEQ ID NO: 125792 - DNA, 22 bp, Artificial Sequence
  chemically synthesized
ttcacatagtcccatatttctt

SEQ ID NO: 125793 - DNA, 22 bp, Artificial Sequence
  chemically synthesized
tcacatagtcccatatttcttg

SEQ ID NO: 125794 - DNA, 22 bp, Artificial Sequence
  chemically synthesized
cacatagtcccatatttcttgg

SEQ ID NO: 125795 - DNA, 22 bp, Artificial Sequence
  chemically synthesized
acatagtcccatatttcttgga

SEQ ID NO: 125796 - DNA, 22 bp, Artificial Sequence
  chemically synthesized
cttggaggctttgttcatttct

SEQ ID NO: 125797 - DNA, 22 bp, Artificial Sequence
  chemically synthesized
ttggaggctttgttcatttctt

SEQ ID NO: 125798 - DNA, 22 bp, Artificial Sequence
  chemically synthesized
ggaggctttgttcatttctttt

SEQ ID NO: 125799 - DNA, 22 bp, Artificial Sequence
  chemically synthesized
gaggctttgttcatttcttttt

SEQ ID NO: 125800 - DNA, 22 bp, Artificial Sequence
  chemically synthesized
tgttcatttctttttattcttt

SEQ ID NO: 125801 - DNA, 22 bp, Artificial Sequence
  chemically synthesized
gttcatttctttttattctttt

SEQ ID NO: 125802 - DNA, 22 bp, Artificial Sequence
  chemically synthesized
ttcatttctttttattcttttt

SEQ ID NO: 125803 - DNA, 22 bp, Artificial Sequence
  chemically synthesized
atttctttttattcttttttct

SEQ ID NO: 125804 - DNA, 22 bp, Artificial Sequence
  chemically synthesized
ctttttattcttttttctctaa

SEQ ID NO: 125805 - DNA, 22 bp, Artificial Sequence
  chemically synthesized
tttttattcttttttctctaaa

SEQ ID NO: 125806 - DNA, 22 bp, Artificial Sequence
  chemically synthesized
tttattcttttttctctaaact

SEQ ID NO: 125807 - DNA, 22 bp, Artificial Sequence
  chemically synthesized
ttattcttttttctctaaactt

SEQ ID NO: 125808 - DNA, 22 bp, Artificial Sequence
  chemically synthesized
tattcttttttctctaaacttc

SEQ ID NO: 125809 - DNA, 22 bp, Artificial Sequence
  chemically synthesized
attcttttttctctaaacttct

SEQ ID NO: 125810 - DNA, 22 bp, Artificial Sequence
  chemically synthesized
ttcttttttctctaaacttctc

SEQ ID NO: 125811 - DNA, 22 bp, Artificial Sequence
  chemically synthesized
ttttttctctaaacttctcttc

SEQ ID NO: 125812 - DNA, 22 bp, Artificial Sequence
  chemically synthesized
ttttctctaaacttctcttctt

SEQ ID NO: 125813 - DNA, 22 bp, Artificial Sequence
  chemically synthesized
tttctctaaacttctcttcttg

SEQ ID NO: 125814 - DNA, 22 bp, Artificial Sequence
  chemically synthesized
ttctctaaacttctcttcttgc

SEQ ID NO: 125815 - DNA, 22 bp, Artificial Sequence
  chemically synthesized
tctctaaacttctcttcttgct

SEQ ID NO: 125816 - DNA, 22 bp, Artificial Sequence
  chemically synthesized
ctctaaacttctcttcttgctt

SEQ ID NO: 125817 - DNA, 22 bp, Artificial Sequence
  chemically synthesized
tctaaacttctcttcttgcttc

SEQ ID NO: 125818 - DNA, 22 bp, Artificial Sequence
  chemically synthesized
taaacttctcttcttgcttcat

SEQ ID NO: 125819 - DNA, 22 bp, Artificial Sequence
  chemically synthesized
aacttctcttcttgcttcattt

SEQ ID NO: 125820 - DNA, 22 bp, Artificial Sequence
  chemically synthesized
ctcttcttgcttcatttcattc

SEQ ID NO: 125821 - DNA, 22 bp, Artificial Sequence
  chemically synthesized
tcttcttgcttcatttcattca

SEQ ID NO: 125822 - DNA, 22 bp, Artificial Sequence
  chemically synthesized
ttcttgcttcatttcattcatt

SEQ ID NO: 125823 - DNA, 22 bp, Artificial Sequence
  chemically synthesized
cttgcttcatttcattcatttg

SEQ ID NO: 125824 - DNA, 22 bp, Artificial Sequence
  chemically synthesized
ttgcttcatttcattcatttga

SEQ ID NO: 125825 - DNA, 22 bp, Artificial Sequence
  chemically synthesized
gcttcatttcattcatttgatc

SEQ ID NO: 125826 - DNA, 22 bp, Artificial Sequence
  chemically synthesized
cttcatttcattcatttgatct

SEQ ID NO: 125827 - DNA, 22 bp, Artificial Sequence
  chemically synthesized
catttcattcatttgatcttcc

SEQ ID NO: 125828 - DNA, 22 bp, Artificial Sequence
  chemically synthesized
atttcattcatttgatcttcca

SEQ ID NO: 125829 - DNA, 22 bp, Artificial Sequence
  chemically synthesized
cattcatttgatcttccatcac

SEQ ID NO: 125830 - DNA, 22 bp, Artificial Sequence
  chemically synthesized
attcatttgatcttccatcact

SEQ ID NO: 125831 - DNA, 22 bp, Artificial Sequence
  chemically synthesized
atttgatcttccatcactgata

SEQ ID NO: 125832 - DNA, 22 bp, Artificial Sequence
  chemically synthesized
gatcttccatcactgataccct

SEQ ID NO: 125833 - DNA, 22 bp, Artificial Sequence
  chemically synthesized
atcttccatcactgataccctt

SEQ ID NO: 125834 - DNA, 22 bp, Artificial Sequence
  chemically synthesized
ccatcactgataccctttcttc

SEQ ID NO: 125835 - DNA, 22 bp, Artificial Sequence
  chemically synthesized
catcactgataccctttcttcc

SEQ ID NO: 125836 - DNA, 22 bp, Artificial Sequence
  chemically synthesized
ataccctttcttccagttgatc

SEQ ID NO: 125837 - DNA, 22 bp, Artificial Sequence
  chemically synthesized
tcttccagttgatcgaatcagc

SEQ ID NO: 125838 - DNA, 22 bp, Artificial Sequence
  chemically synthesized
cttccagttgatcgaatcagct

SEQ ID NO: 125839 - DNA, 22 bp, Artificial Sequence
  chemically synthesized
ttccagttgatcgaatcagcta

SEQ ID NO: 125840 - DNA, 22 bp, Artificial Sequence
  chemically synthesized
ccagttgatcgaatcagctact

SEQ ID NO: 125841 - DNA, 22 bp, Artificial Sequence
  chemically synthesized
cagttgatcgaatcagctactg

SEQ ID NO: 125842 - DNA, 22 bp, Artificial Sequence
  chemically synthesized
atcgaatcagctactgagtctt

SEQ ID NO: 125843 - DNA, 22 bp, Artificial Sequence
  chemically synthesized
ctgagtcttgtgcattcatcat

SEQ ID NO: 125844 - DNA, 22 bp, Artificial Sequence
  chemically synthesized
agtcttgtgcattcatcatgta

SEQ ID NO: 125845 - DNA, 22 bp, Artificial Sequence
  chemically synthesized
gtgcattcatcatgtagttctc

SEQ ID NO: 125846 - DNA, 22 bp, Artificial Sequence
  chemically synthesized
tgcattcatcatgtagttctca

SEQ ID NO: 125847 - DNA, 22 bp, Artificial Sequence
  chemically synthesized
atcatgtagttctcatgccttg

SEQ ID NO: 125848 - DNA, 22 bp, Artificial Sequence
  chemically synthesized
tcatgccttggttttcagctcc

SEQ ID NO: 125849 - DNA, 22 bp, Artificial Sequence
  chemically synthesized
atgccttggttttcagctccat

SEQ ID NO: 125850 - DNA, 22 bp, Artificial Sequence
  chemically synthesized
ggttttcagctccatcaggtcc

SEQ ID NO: 125851 - DNA, 22 bp, Artificial Sequence
  chemically synthesized
gttttcagctccatcaggtcct

SEQ ID NO: 125852 - DNA, 22 bp, Artificial Sequence
  chemically synthesized
tcagctccatcaggtcctttaa

SEQ ID NO: 125853 - DNA, 22 bp, Artificial Sequence
  chemically synthesized
cagctccatcaggtcctttaag

SEQ ID NO: 125854 - DNA, 22 bp, Artificial Sequence
  chemically synthesized
agctccatcaggtcctttaagg

SEQ ID NO: 125855 - DNA, 22 bp, Artificial Sequence
  chemically synthesized
catcaggtcctttaaggacttc

SEQ ID NO: 125856 - DNA, 22 bp, Artificial Sequence
  chemically synthesized
taaggacttctctgtattggtt

SEQ ID NO: 125857 - DNA, 22 bp, Artificial Sequence
  chemically synthesized
aaggacttctctgtattggtta

SEQ ID NO: 125858 - DNA, 22 bp, Artificial Sequence
  chemically synthesized
aggacttctctgtattggttat

SEQ ID NO: 125859 - DNA, 22 bp, Artificial Sequence
  chemically synthesized
ctctgtattggttattctagtt

SEQ ID NO: 125860 - DNA, 22 bp, Artificial Sequence
  chemically synthesized
tctgtattggttattctagtta

SEQ ID NO: 125861 - DNA, 22 bp, Artificial Sequence
  chemically synthesized
tgtattggttattctagttagc

SEQ ID NO: 125862 - DNA, 22 bp, Artificial Sequence
  chemically synthesized
tattggttattctagttagcca

SEQ ID NO: 125863 - DNA, 22 bp, Artificial Sequence
  chemically synthesized
gttattctagttagccattagt

SEQ ID NO: 125864 - DNA, 22 bp, Artificial Sequence
  chemically synthesized
ttctagttagccattagtctaa

SEQ ID NO: 125865 - DNA, 22 bp, Artificial Sequence
  chemically synthesized
tagttagccattagtctaattt

SEQ ID NO: 125866 - DNA, 22 bp, Artificial Sequence
  chemically synthesized
gttagccattagtctaatttat

SEQ ID NO: 125867 - DNA, 22 bp, Artificial Sequence
  chemically synthesized
gccattagtctaatttattttc

SEQ ID NO: 125868 - DNA, 22 bp, Artificial Sequence
  chemically synthesized
gtctaatttattttcaaggttt

SEQ ID NO: 125869 - DNA, 22 bp, Artificial Sequence
  chemically synthesized
atttattttcaaggtttttaac

SEQ ID NO: 125870 - DNA, 22 bp, Artificial Sequence
  chemically synthesized
attttcaaggtttttaactttt

SEQ ID NO: 125871 - DNA, 22 bp, Artificial Sequence
  chemically synthesized
ttttcaaggtttttaacttttt

SEQ ID NO: 125872 - DNA, 22 bp, Artificial Sequence
  chemically synthesized
tcaaggtttttaacttttttgc

SEQ ID NO: 125873 - DNA, 22 bp, Artificial Sequence
  chemically synthesized
caaggtttttaacttttttgcc

SEQ ID NO: 125874 - DNA, 22 bp, Artificial Sequence
  chemically synthesized
aaggtttttaacttttttgcca

SEQ ID NO: 125875 - DNA, 22 bp, Artificial Sequence
  chemically synthesized
ttaacttttttgccatgggttc

SEQ ID NO: 125876 - DNA, 22 bp, Artificial Sequence
  chemically synthesized
taacttttttgccatgggttcg

SEQ ID NO: 125877 - DNA, 22 bp, Artificial Sequence
  chemically synthesized
aacttttttgccatgggttcga

SEQ ID NO: 125878 - DNA, 22 bp, Artificial Sequence
  chemically synthesized
acttttttgccatgggttcgag

SEQ ID NO: 125879 - DNA, 22 bp, Artificial Sequence
  chemically synthesized
ttttgccatgggttcgagcttc

SEQ ID NO: 125880 - DNA, 22 bp, Artificial Sequence
  chemically synthesized
tttgccatgggttcgagcttcc

SEQ ID NO: 125881 - DNA, 22 bp, Artificial Sequence
  chemically synthesized
ttgccatgggttcgagcttcct

SEQ ID NO: 125882 - DNA, 22 bp, Artificial Sequence
  chemically synthesized
tgccatgggttcgagcttcctc

SEQ ID NO: 125883 - DNA, 22 bp, Artificial Sequence
  chemically synthesized
gccatgggttcgagcttcctcc

SEQ ID NO: 125884 - DNA, 22 bp, Artificial Sequence
  chemically synthesized
ccatgggttcgagcttcctcct

SEQ ID NO: 125885 - DNA, 22 bp, Artificial Sequence
  chemically synthesized
gagcttcctcctttagctcgga

SEQ ID NO: 125886 - DNA, 22 bp, Artificial Sequence
  chemically synthesized
cctcctttagctcggagtagtt

SEQ ID NO: 125887 - DNA, 22 bp, Artificial Sequence
  chemically synthesized
ctcctttagctcggagtagttt

SEQ ID NO: 125888 - DNA, 22 bp, Artificial Sequence
  chemically synthesized
ctttagctcggagtagtttgat

SEQ ID NO: 125889 - DNA, 22 bp, Artificial Sequence
  chemically synthesized
tagctcggagtagtttgatcgt

SEQ ID NO: 125890 - DNA, 22 bp, Artificial Sequence
  chemically synthesized
agctcggagtagtttgatcgtc

SEQ ID NO: 125891 - DNA, 22 bp, Artificial Sequence
  chemically synthesized
gctcggagtagtttgatcgtct

SEQ ID NO: 125892 - DNA, 22 bp, Artificial Sequence
  chemically synthesized
ggagtagtttgatcgtctgaag

SEQ ID NO: 125893 - DNA, 22 bp, Artificial Sequence
  chemically synthesized
gatcgtctgaagccttcttctc

SEQ ID NO: 125894 - DNA, 22 bp, Artificial Sequence
  chemically synthesized
atcgtctgaagccttcttctct

SEQ ID NO: 125895 - DNA, 22 bp, Artificial Sequence
  chemically synthesized
aagccttcttctctcaacttgt

SEQ ID NO: 125896 - DNA, 22 bp, Artificial Sequence
  chemically synthesized
cttctctcaacttgtcaaagtc

SEQ ID NO: 125897 - DNA, 22 bp, Artificial Sequence
  chemically synthesized
ttctctcaacttgtcaaagtca

SEQ ID NO: 125898 - DNA, 22 bp, Artificial Sequence
  chemically synthesized
ctctcaacttgtcaaagtcatt

SEQ ID NO: 125899 - DNA, 22 bp, Artificial Sequence
  chemically synthesized
tctcaacttgtcaaagtcattc

SEQ ID NO: 125900 - DNA, 22 bp, Artificial Sequence
  chemically synthesized
tcaacttgtcaaagtcattctc

SEQ ID NO: 125901 - DNA, 22 bp, Artificial Sequence
  chemically synthesized
aacttgtcaaagtcattctctg

SEQ ID NO: 125902 - DNA, 22 bp, Artificial Sequence
  chemically synthesized
gtcaaagtcattctctgtccag

SEQ ID NO: 125903 - DNA, 22 bp, Artificial Sequence
  chemically synthesized
tcaaagtcattctctgtccagc

SEQ ID NO: 125904 - DNA, 22 bp, Artificial Sequence
  chemically synthesized
tctgtccagctttgtaccgttg

SEQ ID NO: 125905 - DNA, 22 bp, Artificial Sequence
  chemically synthesized
tgtccagctttgtaccgttgct

SEQ ID NO: 125906 - DNA, 22 bp, Artificial Sequence
  chemically synthesized
tccagctttgtaccgttgctgg

SEQ ID NO: 125907 - DNA, 22 bp, Artificial Sequence
  chemically synthesized
tgtaccgttgctggtgaggagc

SEQ ID NO: 125908 - DNA, 22 bp, Artificial Sequence
  chemically synthesized
gtaccgttgctggtgaggagct

SEQ ID NO: 125909 - DNA, 22 bp, Artificial Sequence
  chemically synthesized
taccgttgctggtgaggagctg

SEQ ID NO: 125910 - DNA, 22 bp, Artificial Sequence
  chemically synthesized
ctggtgaggagctgcattcctt

SEQ ID NO: 125911 - DNA, 22 bp, Artificial Sequence
  chemically synthesized
gtgaggagctgcattcctttgg

SEQ ID NO: 125912 - DNA, 22 bp, Artificial Sequence
  chemically synthesized
cattcctttggaggaggagagg

SEQ ID NO: 125913 - DNA, 22 bp, Artificial Sequence
  chemically synthesized
ctttggaggaggagaggcactc

SEQ ID NO: 125914 - DNA, 22 bp, Artificial Sequence
  chemically synthesized
tggaggaggagaggcactctga

SEQ ID NO: 125915 - DNA, 22 bp, Artificial Sequence
  chemically synthesized
ggaggaggagaggcactctgat

SEQ ID NO: 125916 - DNA, 22 bp, Artificial Sequence
  chemically synthesized
gaggaggagaggcactctgatt

SEQ ID NO: 125917 - DNA, 22 bp, Artificial Sequence
  chemically synthesized
tgatttttagagtttccagttt

SEQ ID NO: 125918 - DNA, 22 bp, Artificial Sequence
  chemically synthesized
atttttagagtttccagttttt

SEQ ID NO: 125919 - DNA, 22 bp, Artificial Sequence
  chemically synthesized
ttagagtttccagtttttctgc

SEQ ID NO: 125920 - DNA, 22 bp, Artificial Sequence
  chemically synthesized
tagagtttccagtttttctgct

SEQ ID NO: 125921 - DNA, 22 bp, Artificial Sequence
  chemically synthesized
agagtttccagtttttctgctc

SEQ ID NO: 125922 - DNA, 22 bp, Artificial Sequence
  chemically synthesized
gagtttccagtttttctgctct

SEQ ID NO: 125923 - DNA, 22 bp, Artificial Sequence
  chemically synthesized
ccagtttttctgctctgttttt

SEQ ID NO: 125924 - DNA, 22 bp, Artificial Sequence
  chemically synthesized
cagtttttctgctctgtttttc

SEQ ID NO: 125925 - DNA, 22 bp, Artificial Sequence
  chemically synthesized
ttctgctctgtttttccccatc

SEQ ID NO: 125926 - DNA, 22 bp, Artificial Sequence
  chemically synthesized
tctgctctgtttttccccatct

SEQ ID NO: 125927 - DNA, 22 bp, Artificial Sequence
  chemically synthesized
ctgctctgtttttccccatctt

SEQ ID NO: 125928 - DNA, 22 bp, Artificial Sequence
  chemically synthesized
tgctctgtttttccccatcttt

SEQ ID NO: 125929 - DNA, 22 bp, Artificial Sequence
  chemically synthesized
ctctgtttttccccatctttgt

SEQ ID NO: 125930 - DNA, 22 bp, Artificial Sequence
  chemically synthesized
tgtttttccccatctttgtggt

SEQ ID NO: 125931 - DNA, 22 bp, Artificial Sequence
  chemically synthesized
tttttccccatctttgtggttt

SEQ ID NO: 125932 - DNA, 22 bp, Artificial Sequence
  chemically synthesized
ttccccatctttgtggttttat

SEQ ID NO: 125933 - DNA, 22 bp, Artificial Sequence
  chemically synthesized
tccccatctttgtggttttatc

SEQ ID NO: 125934 - DNA, 22 bp, Artificial Sequence
  chemically synthesized
ccccatctttgtggttttatct

SEQ ID NO: 125935 - DNA, 22 bp, Artificial Sequence
  chemically synthesized
cccatctttgtggttttatcta

SEQ ID NO: 125936 - DNA, 22 bp, Artificial Sequence
  chemically synthesized
tgtggttttatctacctttggt

SEQ ID NO: 125937 - DNA, 22 bp, Artificial Sequence
  chemically synthesized
gtggttttatctacctttggtc

SEQ ID NO: 125938 - DNA, 22 bp, Artificial Sequence
  chemically synthesized
tggttttatctacctttggtct

SEQ ID NO: 125939 - DNA, 22 bp, Artificial Sequence
  chemically synthesized
tatctacctttggtctttgatg

SEQ ID NO: 125940 - DNA, 22 bp, Artificial Sequence
  chemically synthesized
atctacctttggtctttgatga

SEQ ID NO: 125941 - DNA, 22 bp, Artificial Sequence
  chemically synthesized
tctacctttggtctttgatgat

SEQ ID NO: 125942 - DNA, 22 bp, Artificial Sequence
  chemically synthesized
cctttggtctttgatgatggtg

SEQ ID NO: 125943 - DNA, 22 bp, Artificial Sequence
  chemically synthesized
tggtctttgatgatggtgacgt

SEQ ID NO: 125944 - DNA, 22 bp, Artificial Sequence
  chemically synthesized
ggtctttgatgatggtgacgta

SEQ ID NO: 125945 - DNA, 22 bp, Artificial Sequence
  chemically synthesized
gtctttgatgatggtgacgtac

SEQ ID NO: 125946 - DNA, 22 bp, Artificial Sequence
  chemically synthesized
tgatgatggtgacgtacagatg

SEQ ID NO: 125947 - DNA, 22 bp, Artificial Sequence
  chemically synthesized
gatgatggtgacgtacagatgg

SEQ ID NO: 125948 - DNA, 22 bp, Artificial Sequence
  chemically synthesized
atgatggtgacgtacagatggg

SEQ ID NO: 125949 - DNA, 22 bp, Artificial Sequence
  chemically synthesized
ttggtgtggatgtcctttctgt

SEQ ID NO: 125950 - DNA, 22 bp, Artificial Sequence
  chemically synthesized
tggtgtggatgtcctttctgtt

SEQ ID NO: 125951 - DNA, 22 bp, Artificial Sequence
  chemically synthesized
ggtgtggatgtcctttctgttt

SEQ ID NO: 125952 - DNA, 22 bp, Artificial Sequence
  chemically synthesized
gtgtggatgtcctttctgtttg

SEQ ID NO: 125953 - DNA, 22 bp, Artificial Sequence
  chemically synthesized
tctgtttgttagttttccttct

SEQ ID NO: 125954 - DNA, 22 bp, Artificial Sequence
  chemically synthesized
ctgtttgttagttttccttcta

SEQ ID NO: 125955 - DNA, 22 bp, Artificial Sequence
  chemically synthesized
tgtttgttagttttccttctaa

SEQ ID NO: 125956 - DNA, 22 bp, Artificial Sequence
  chemically synthesized
tttgttagttttccttctaaca

SEQ ID NO: 125957 - DNA, 22 bp, Artificial Sequence
  chemically synthesized
gttagttttccttctaacagga

SEQ ID NO: 125958 - DNA, 22 bp, Artificial Sequence
  chemically synthesized
ttagttttccttctaacaggac

SEQ ID NO: 125959 - DNA, 22 bp, Artificial Sequence
  chemically synthesized
gttttccttctaacaggaccct

SEQ ID NO: 125960 - DNA, 22 bp, Artificial Sequence
  chemically synthesized
tccttctaacaggaccctcagc

SEQ ID NO: 125961 - DNA, 22 bp, Artificial Sequence
  chemically synthesized
ccttctaacaggaccctcagct

SEQ ID NO: 125962 - DNA, 22 bp, Artificial Sequence
  chemically synthesized
cttctaacaggaccctcagctt

SEQ ID NO: 125963 - DNA, 22 bp, Artificial Sequence
  chemically synthesized
ctaacaggaccctcagcttgca

SEQ ID NO: 125964 - DNA, 22 bp, Artificial Sequence
  chemically synthesized
taacaggaccctcagcttgcag

SEQ ID NO: 125965 - DNA, 22 bp, Artificial Sequence
  chemically synthesized
acaggaccctcagcttgcagca

SEQ ID NO: 125966 - DNA, 22 bp, Artificial Sequence
  chemically synthesized
agcttgcagcagatttttaaaa

SEQ ID NO: 125967 - DNA, 22 bp, Artificial Sequence
  chemically synthesized
gcagcagatttttaaaagaact

SEQ ID NO: 125968 - DNA, 22 bp, Artificial Sequence
  chemically synthesized
cagcagatttttaaaagaactt

SEQ ID NO: 125969 - DNA, 22 bp, Artificial Sequence
  chemically synthesized
ttaaaagaacttccaggacctt

SEQ ID NO: 125970 - DNA, 22 bp, Artificial Sequence
  chemically synthesized
taaaagaacttccaggaccttg

SEQ ID NO: 125971 - DNA, 22 bp, Artificial Sequence
  chemically synthesized
aaaagaacttccaggaccttgt

SEQ ID NO: 125972 - DNA, 22 bp, Artificial Sequence
  chemically synthesized
aaagaacttccaggaccttgtc

SEQ ID NO: 125973 - DNA, 22 bp, Artificial Sequence
  chemically synthesized
ccaggaccttgtctgtatattg

SEQ ID NO: 125974 - DNA, 22 bp, Artificial Sequence
  chemically synthesized
caggaccttgtctgtatattga

SEQ ID NO: 125975 - DNA, 22 bp, Artificial Sequence
  chemically synthesized
gtctgtatattgacgcctatgt

SEQ ID NO: 125976 - DNA, 22 bp, Artificial Sequence
  chemically synthesized
tctgtatattgacgcctatgtc

SEQ ID NO: 125977 - DNA, 22 bp, Artificial Sequence
  chemically synthesized
tatattgacgcctatgtcacta

SEQ ID NO: 125978 - DNA, 22 bp, Artificial Sequence
  chemically synthesized
acgcctatgtcactacaggaat

SEQ ID NO: 125979 - DNA, 22 bp, Artificial Sequence
  chemically synthesized
tgtcactacaggaatcagagca

SEQ ID NO: 125980 - DNA, 22 bp, Artificial Sequence
  chemically synthesized
caggaatcagagcagggcatta

SEQ ID NO: 125981 - DNA, 22 bp, Artificial Sequence
  chemically synthesized
cattgatcctttaagaaaattt

SEQ ID NO: 125982 - DNA, 22 bp, Artificial Sequence
  chemically synthesized
atcctttaagaaaattttgcta

SEQ ID NO: 125983 - DNA, 22 bp, Artificial Sequence
  chemically synthesized
taagaaaattttgctaccctat

SEQ ID NO: 125984 - DNA, 22 bp, Artificial Sequence
  chemically synthesized
aagaaaattttgctaccctata

SEQ ID NO: 125985 - DNA, 22 bp, Artificial Sequence
  chemically synthesized
agaaaattttgctaccctatac

SEQ ID NO: 125986 - DNA, 22 bp, Artificial Sequence
  chemically synthesized
tgctaccctataccccttgacc

SEQ ID NO: 125987 - DNA, 22 bp, Artificial Sequence
  chemically synthesized
gctaccctataccccttgaccc

SEQ ID NO: 125988 - DNA, 22 bp, Artificial Sequence
  chemically synthesized
ctaccctataccccttgaccct

SEQ ID NO: 125989 - DNA, 22 bp, Artificial Sequence
  chemically synthesized
ccctataccccttgaccctact

SEQ ID NO: 125990 - DNA, 22 bp, Artificial Sequence
  chemically synthesized
taccccttgaccctactctttt

SEQ ID NO: 125991 - DNA, 22 bp, Artificial Sequence
  chemically synthesized
gaccctactctttttttttttt

SEQ ID NO: 125992 - DNA, 22 bp, Artificial Sequence
  chemically synthesized
accctactcttttttttttttt

SEQ ID NO: 125993 - DNA, 22 bp, Artificial Sequence
  chemically synthesized
ctcttttttttttttttaattt

SEQ ID NO: 125994 - DNA, 22 bp, Artificial Sequence
  chemically synthesized
ttttttttttttttaattttta

SEQ ID NO: 125995 - DNA, 22 bp, Artificial Sequence
  chemically synthesized
ttttttttttttaatttttaaa

SEQ ID NO: 125996 - DNA, 22 bp, Artificial Sequence
  chemically synthesized
tttttttttttaatttttaaag

SEQ ID NO: 125997 - DNA, 22 bp, Artificial Sequence
  chemically synthesized
ttttttttttaatttttaaagg

SEQ ID NO: 125998 - DNA, 22 bp, Artificial Sequence
  chemically synthesized
tttttttttaatttttaaaggt

SEQ ID NO: 125999 - DNA, 22 bp, Artificial Sequence
  chemically synthesized
ttttttttaatttttaaaggta

SEQ ID NO: 126000 - DNA, 22 bp, Artificial Sequence
  chemically synthesized
tttttttaatttttaaaggtaa

SEQ ID NO: 126001 - DNA, 22 bp, Artificial Sequence
  chemically synthesized
ttttttaatttttaaaggtaat

SEQ ID NO: 126002 - DNA, 22 bp, Artificial Sequence
  chemically synthesized
tttttaatttttaaaggtaatt

SEQ ID NO: 126003 - DNA, 22 bp, Artificial Sequence
  chemically synthesized
ttttaatttttaaaggtaattg

SEQ ID NO: 126004 - DNA, 22 bp, Artificial Sequence
  chemically synthesized
tttaatttttaaaggtaattgt

SEQ ID NO: 126005 - DNA, 22 bp, Artificial Sequence
  chemically synthesized
ttaatttttaaaggtaattgtt

SEQ ID NO: 126006 - DNA, 22 bp, Artificial Sequence
  chemically synthesized
taatttttaaaggtaattgtta

SEQ ID NO: 126007 - DNA, 22 bp, Artificial Sequence
  chemically synthesized
aatttttaaaggtaattgttag

SEQ ID NO: 126008 - DNA, 22 bp, Artificial Sequence
  chemically synthesized
atttttaaaggtaattgttaga

SEQ ID NO: 126009 - DNA, 22 bp, Artificial Sequence
  chemically synthesized
ttaaaggtaattgttagaaatt

SEQ ID NO: 126010 - DNA, 22 bp, Artificial Sequence
  chemically synthesized
taaaggtaattgttagaaattt

SEQ ID NO: 126011 - DNA, 22 bp, Artificial Sequence
  chemically synthesized
aaaggtaattgttagaaatttc

SEQ ID NO: 126012 - DNA, 22 bp, Artificial Sequence
  chemically synthesized
aaggtaattgttagaaatttcc

SEQ ID NO: 126013 - DNA, 22 bp, Artificial Sequence
  chemically synthesized
ttagaaatttcccaaggtttat

SEQ ID NO: 126014 - DNA, 22 bp, Artificial Sequence
  chemically synthesized
gaaatttcccaaggtttatttg

SEQ ID NO: 126015 - DNA, 22 bp, Artificial Sequence
  chemically synthesized
cccaaggtttatttgaaatgac

SEQ ID NO: 126016 - DNA, 22 bp, Artificial Sequence
  chemically synthesized
ccaaggtttatttgaaatgaca

SEQ ID NO: 126017 - DNA, 22 bp, Artificial Sequence
  chemically synthesized
atttgaaatgacacaccactga

SEQ ID NO: 126018 - DNA, 22 bp, Artificial Sequence
  chemically synthesized
tttgaaatgacacaccactgaa

SEQ ID NO: 126019 - DNA, 22 bp, Artificial Sequence
  chemically synthesized
gaaatgacacaccactgaaaac

SEQ ID NO: 126020 - DNA, 22 bp, Artificial Sequence
  chemically synthesized
aaatgacacaccactgaaaaca

SEQ ID NO: 126021 - DNA, 22 bp, Artificial Sequence
  chemically synthesized
aaaacataacttttacagatga

SEQ ID NO: 126022 - DNA, 22 bp, Artificial Sequence
  chemically synthesized
ttacagatgatttgtggataca

SEQ ID NO: 126023 - DNA, 22 bp, Artificial Sequence
  chemically synthesized
tacagatgatttgtggatacag

SEQ ID NO: 126024 - DNA, 22 bp, Artificial Sequence
  chemically synthesized
acagatgatttgtggatacagt

SEQ ID NO: 126025 - DNA, 22 bp, Artificial Sequence
  chemically synthesized
cagatgatttgtggatacagta

SEQ ID NO: 126026 - DNA, 22 bp, Artificial Sequence
  chemically synthesized
gtggatacagtacacatcacct

SEQ ID NO: 126027 - DNA, 22 bp, Artificial Sequence
  chemically synthesized
tggatacagtacacatcaccta

SEQ ID NO: 126028 - DNA, 22 bp, Artificial Sequence
  chemically synthesized
tcttactttaggacagtctgtg

SEQ ID NO: 126029 - DNA, 22 bp, Artificial Sequence
  chemically synthesized
actttaggacagtctgtgaaga

SEQ ID NO: 126030 - DNA, 22 bp, Artificial Sequence
  chemically synthesized
ctttaggacagtctgtgaagat

SEQ ID NO: 126031 - DNA, 22 bp, Artificial Sequence
  chemically synthesized
taggacagtctgtgaagatgat

SEQ ID NO: 126032 - DNA, 22 bp, Artificial Sequence
  chemically synthesized
aggacagtctgtgaagatgata

SEQ ID NO: 126033 - DNA, 22 bp, Artificial Sequence
  chemically synthesized
ggacagtctgtgaagatgatat

SEQ ID NO: 126034 - DNA, 22 bp, Artificial Sequence
  chemically synthesized
tgaagatgatatttttcctgct

SEQ ID NO: 126035 - DNA, 22 bp, Artificial Sequence
  chemically synthesized
ttcctgctgcagttcctttgtc

SEQ ID NO: 126036 - DNA, 22 bp, Artificial Sequence
  chemically synthesized
tcctgctgcagttcctttgtca

SEQ ID NO: 126037 - DNA, 22 bp, Artificial Sequence
  chemically synthesized
cctgctgcagttcctttgtcaa

SEQ ID NO: 126038 - DNA, 22 bp, Artificial Sequence
  chemically synthesized
ctgctgcagttcctttgtcaag

SEQ ID NO: 126039 - DNA, 22 bp, Artificial Sequence
  chemically synthesized
ctgcagttcctttgtcaagtga

SEQ ID NO: 126040 - DNA, 22 bp, Artificial Sequence
  chemically synthesized
cagttcctttgtcaagtgactt

SEQ ID NO: 126041 - DNA, 22 bp, Artificial Sequence
  chemically synthesized
ctttgtcaagtgactttagaca

SEQ ID NO: 126042 - DNA, 22 bp, Artificial Sequence
  chemically synthesized
tgtcaagtgactttagacagat

SEQ ID NO: 126043 - DNA, 22 bp, Artificial Sequence
  chemically synthesized
gtcaagtgactttagacagata

SEQ ID NO: 126044 - DNA, 22 bp, Artificial Sequence
  chemically synthesized
tcaagtgactttagacagatac

SEQ ID NO: 126045 - DNA, 22 bp, Artificial Sequence
  chemically synthesized
tagacagatacaggactgcaag

SEQ ID NO: 126046 - DNA, 22 bp, Artificial Sequence
  chemically synthesized
agacagatacaggactgcaaga

SEQ ID NO: 126047 - DNA, 22 bp, Artificial Sequence
  chemically synthesized
gacagatacaggactgcaagag

SEQ ID NO: 126048 - DNA, 22 bp, Artificial Sequence
  chemically synthesized
caagagtgactcaggtcatgct

SEQ ID NO: 126049 - DNA, 22 bp, Artificial Sequence
  chemically synthesized
aggtcatgctggcataggagaa

SEQ ID NO: 126050 - DNA, 22 bp, Artificial Sequence
  chemically synthesized
gcataggagaagcaggtgctag

SEQ ID NO: 126051 - DNA, 22 bp, Artificial Sequence
  chemically synthesized
gtgtttcacttgaactagttgt

SEQ ID NO: 126052 - DNA, 22 bp, Artificial Sequence
  chemically synthesized
cacttgaactagttgttgggct

SEQ ID NO: 126053 - DNA, 22 bp, Artificial Sequence
  chemically synthesized
acttgaactagttgttgggctg

SEQ ID NO: 126054 - DNA, 22 bp, Artificial Sequence
  chemically synthesized
gaactagttgttgggctggggt

SEQ ID NO: 126055 - DNA, 22 bp, Artificial Sequence
  chemically synthesized
aactagttgttgggctggggtg

SEQ ID NO: 126056 - DNA, 22 bp, Artificial Sequence
  chemically synthesized
gttgttgggctggggtggaatg

SEQ ID NO: 126057 - DNA, 22 bp, Artificial Sequence
  chemically synthesized
ttgggctggggtggaatgaaag

SEQ ID NO: 126058 - DNA, 22 bp, Artificial Sequence
  chemically synthesized
ggctggggtggaatgaaagctc

SEQ ID NO: 126059 - DNA, 22 bp, Artificial Sequence
  chemically synthesized
gggtggaatgaaagctccctag

SEQ ID NO: 126060 - DNA, 22 bp, Artificial Sequence
  chemically synthesized
cctaggccatgaggacatcttt

SEQ ID NO: 126061 - DNA, 22 bp, Artificial Sequence
  chemically synthesized
ggccatgaggacatctttgcaa

SEQ ID NO: 126062 - DNA, 22 bp, Artificial Sequence
  chemically synthesized
tgcaatgtggagaggacccaaa

SEQ ID NO: 126063 - DNA, 22 bp, Artificial Sequence
  chemically synthesized
gcaatgtggagaggacccaaat

SEQ ID NO: 126064 - DNA, 22 bp, Artificial Sequence
  chemically synthesized
caatgtggagaggacccaaatc

SEQ ID NO: 126065 - DNA, 22 bp, Artificial Sequence
  chemically synthesized
ctctttgaatgttgaaggcctt

SEQ ID NO: 126066 - DNA, 22 bp, Artificial Sequence
  chemically synthesized
tttgaatgttgaaggccttgtc

SEQ ID NO: 126067 - DNA, 22 bp, Artificial Sequence
  chemically synthesized
tgaatgttgaaggccttgtcag

SEQ ID NO: 126068 - DNA, 22 bp, Artificial Sequence
  chemically synthesized
gaatgttgaaggccttgtcagc

SEQ ID NO: 126069 - DNA, 22 bp, Artificial Sequence
  chemically synthesized
aatgttgaaggccttgtcagca

SEQ ID NO: 126070 - DNA, 22 bp, Artificial Sequence
  chemically synthesized
aaggccttgtcagcatactggt

SEQ ID NO: 126071 - DNA, 22 bp, Artificial Sequence
  chemically synthesized
gtcagcatactggtcacccagt

SEQ ID NO: 126072 - DNA, 22 bp, Artificial Sequence
  chemically synthesized
tcagcatactggtcacccagtt

SEQ ID NO: 126073 - DNA, 22 bp, Artificial Sequence
  chemically synthesized
gtcacccagtttcatcatcact

SEQ ID NO: 126074 - DNA, 22 bp, Artificial Sequence
  chemically synthesized
catcatcacttcatactgtttg

SEQ ID NO: 126075 - DNA, 22 bp, Artificial Sequence
  chemically synthesized
atcatcacttcatactgtttgt

SEQ ID NO: 126076 - DNA, 22 bp, Artificial Sequence
  chemically synthesized
catactgtttgtaccaaagcac

SEQ ID NO: 126077 - DNA, 22 bp, Artificial Sequence
  chemically synthesized
atactgtttgtaccaaagcacc

SEQ ID NO: 126078 - DNA, 22 bp, Artificial Sequence
  chemically synthesized
tttgtaccaaagcaccacagtt

SEQ ID NO: 126079 - DNA, 22 bp, Artificial Sequence
  chemically synthesized
gtaccaaagcaccacagtttcc

SEQ ID NO: 126080 - DNA, 22 bp, Artificial Sequence
  chemically synthesized
taccaaagcaccacagtttcct

SEQ ID NO: 126081 - DNA, 22 bp, Artificial Sequence
  chemically synthesized
ccttatgaaacttagcttcaag

SEQ ID NO: 126082 - DNA, 22 bp, Artificial Sequence
  chemically synthesized
cttatgaaacttagcttcaagg

SEQ ID NO: 126083 - DNA, 22 bp, Artificial Sequence
  chemically synthesized
atgaaacttagcttcaaggctg

SEQ ID NO: 126084 - DNA, 22 bp, Artificial Sequence
  chemically synthesized
tgaaacttagcttcaaggctgg

SEQ ID NO: 126085 - DNA, 22 bp, Artificial Sequence
  chemically synthesized
agcttcaaggctggagatgttt

SEQ ID NO: 126086 - DNA, 22 bp, Artificial Sequence
  chemically synthesized
gcttcaaggctggagatgtttt

SEQ ID NO: 126087 - DNA, 22 bp, Artificial Sequence
  chemically synthesized
caaggctggagatgtttttgaa

SEQ ID NO: 126088 - DNA, 22 bp, Artificial Sequence
  chemically synthesized
aaggctggagatgtttttgaaa

SEQ ID NO: 126089 - DNA, 22 bp, Artificial Sequence
  chemically synthesized
gagatgtttttgaaagtattaa

SEQ ID NO: 126090 - DNA, 22 bp, Artificial Sequence
  chemically synthesized
ttgaaagtattaatataaaatc

SEQ ID NO: 126091 - DNA, 22 bp, Artificial Sequence
  chemically synthesized
tgaaagtattaatataaaatcc

SEQ ID NO: 126092 - DNA, 22 bp, Artificial Sequence
  chemically synthesized
gaaagtattaatataaaatcca

SEQ ID NO: 126093 - DNA, 22 bp, Artificial Sequence
  chemically synthesized
aaagtattaatataaaatccaa

SEQ ID NO: 126094 - DNA, 22 bp, Artificial Sequence
  chemically synthesized
atataaaatccaattcgtcttg

SEQ ID NO: 126095 - DNA, 22 bp, Artificial Sequence
  chemically synthesized
gtcttgactataataatggtaa

SEQ ID NO: 126096 - DNA, 22 bp, Artificial Sequence
  chemically synthesized
gactataataatggtaactttt

SEQ ID NO: 126097 - DNA, 22 bp, Artificial Sequence
  chemically synthesized
actataataatggtaacttttc

SEQ ID NO: 126098 - DNA, 22 bp, Artificial Sequence
  chemically synthesized
taataatggtaacttttcttgt

SEQ ID NO: 126099 - DNA, 22 bp, Artificial Sequence
  chemically synthesized
ttcttgtaagtcaccattaaac

SEQ ID NO: 126100 - DNA, 22 bp, Artificial Sequence
  chemically synthesized
tcttgtaagtcaccattaaact

SEQ ID NO: 126101 - DNA, 22 bp, Artificial Sequence
  chemically synthesized
cttgtaagtcaccattaaactc

SEQ ID NO: 126102 - DNA, 22 bp, Artificial Sequence
  chemically synthesized
ttgtaagtcaccattaaactct

SEQ ID NO: 126103 - DNA, 22 bp, Artificial Sequence
  chemically synthesized
gtaagtcaccattaaactcttc

SEQ ID NO: 126104 - DNA, 22 bp, Artificial Sequence
  chemically synthesized
taagtcaccattaaactcttca

SEQ ID NO: 126105 - DNA, 22 bp, Artificial Sequence
  chemically synthesized
aactcttcaaactttctctatg

SEQ ID NO: 126106 - DNA, 22 bp, Artificial Sequence
  chemically synthesized
ttcaaactttctctatgctttc

SEQ ID NO: 126107 - DNA, 22 bp, Artificial Sequence
  chemically synthesized
caaactttctctatgctttctg

SEQ ID NO: 126108 - DNA, 22 bp, Artificial Sequence
  chemically synthesized
aaactttctctatgctttctga

SEQ ID NO: 126109 - DNA, 22 bp, Artificial Sequence
  chemically synthesized
tctctatgctttctgaaattct

SEQ ID NO: 126110 - DNA, 22 bp, Artificial Sequence
  chemically synthesized
ctctatgctttctgaaattcta

SEQ ID NO: 126111 - DNA, 22 bp, Artificial Sequence
  chemically synthesized
tctatgctttctgaaattctac

SEQ ID NO: 126112 - DNA, 22 bp, Artificial Sequence
  chemically synthesized
tatgctttctgaaattctactt

SEQ ID NO: 126113 - DNA, 22 bp, Artificial Sequence
  chemically synthesized
tgctttctgaaattctacttct

SEQ ID NO: 126114 - DNA, 22 bp, Artificial Sequence
  chemically synthesized
tctgaaattctacttctgcctt

SEQ ID NO: 126115 - DNA, 22 bp, Artificial Sequence
  chemically synthesized
ctgaaattctacttctgcctta

SEQ ID NO: 126116 - DNA, 22 bp, Artificial Sequence
  chemically synthesized
tgaaattctacttctgccttag

SEQ ID NO: 126117 - DNA, 22 bp, Artificial Sequence
  chemically synthesized
aaattctacttctgccttagac

SEQ ID NO: 126118 - DNA, 22 bp, Artificial Sequence
  chemically synthesized
tacttctgccttagacagaggc

SEQ ID NO: 126119 - DNA, 22 bp, Artificial Sequence
  chemically synthesized
cttctgccttagacagaggctc

SEQ ID NO: 126120 - DNA, 22 bp, Artificial Sequence
  chemically synthesized
ctgccttagacagaggctccta

SEQ ID NO: 126121 - DNA, 22 bp, Artificial Sequence
  chemically synthesized
tgccttagacagaggctcctat

SEQ ID NO: 126122 - DNA, 22 bp, Artificial Sequence
  chemically synthesized
ccttagacagaggctcctatcc

SEQ ID NO: 126123 - DNA, 22 bp, Artificial Sequence
  chemically synthesized
agacagaggctcctatccttcc

SEQ ID NO: 126124 - DNA, 22 bp, Artificial Sequence
  chemically synthesized
gacagaggctcctatccttcct

SEQ ID NO: 126125 - DNA, 22 bp, Artificial Sequence
  chemically synthesized
ctatccttcctcctgaagctct

SEQ ID NO: 126126 - DNA, 22 bp, Artificial Sequence
  chemically synthesized
tccttcctcctgaagctctgtt

SEQ ID NO: 126127 - DNA, 22 bp, Artificial Sequence
  chemically synthesized
cctcctgaagctctgttgagcc

SEQ ID NO: 126128 - DNA, 22 bp, Artificial Sequence
  chemically synthesized
ctcctgaagctctgttgagccc

SEQ ID NO: 126129 - DNA, 22 bp, Artificial Sequence
  chemically synthesized
ctgaagctctgttgagcccgat

SEQ ID NO: 126130 - DNA, 22 bp, Artificial Sequence
  chemically synthesized
aagctctgttgagcccgatgga

SEQ ID NO: 126131 - DNA, 22 bp, Artificial Sequence
  chemically synthesized
tgttgagcccgatggaggtggg

SEQ ID NO: 126132 - DNA, 22 bp, Artificial Sequence
  chemically synthesized
ttgagcccgatggaggtgggca

SEQ ID NO: 126133 - DNA, 22 bp, Artificial Sequence
  chemically synthesized
agcccgatggaggtgggcaggc

SEQ ID NO: 126134 - DNA, 22 bp, Artificial Sequence
  chemically synthesized
tcatagtccgtaagcttcctgc

SEQ ID NO: 126135 - DNA, 22 bp, Artificial Sequence
  chemically synthesized
cctgctgcacttggtgatgtga

SEQ ID NO: 126136 - DNA, 22 bp, Artificial Sequence
  chemically synthesized
ctgctgcacttggtgatgtgat

SEQ ID NO: 126137 - DNA, 22 bp, Artificial Sequence
  chemically synthesized
ctgcacttggtgatgtgattct

SEQ ID NO: 126138 - DNA, 22 bp, Artificial Sequence
  chemically synthesized
cacttggtgatgtgattcttca

SEQ ID NO: 126139 - DNA, 22 bp, Artificial Sequence
  chemically synthesized
ggtgatgtgattcttcaagtca

SEQ ID NO: 126140 - DNA, 22 bp, Artificial Sequence
  chemically synthesized
gtgatgtgattcttcaagtcag

SEQ ID NO: 126141 - DNA, 22 bp, Artificial Sequence
  chemically synthesized
ttcaagtcaggaaattggtcca

SEQ ID NO: 126142 - DNA, 22 bp, Artificial Sequence
  chemically synthesized
caagtcaggaaattggtccagg

SEQ ID NO: 126143 - DNA, 22 bp, Artificial Sequence
  chemically synthesized
aagtcaggaaattggtccaggt

SEQ ID NO: 126144 - DNA, 22 bp, Artificial Sequence
  chemically synthesized
gtccaggtagttttccagtgtt

SEQ ID NO: 126145 - DNA, 22 bp, Artificial Sequence
  chemically synthesized
tccagtgttagcaaggatgcat

SEQ ID NO: 126146 - DNA, 22 bp, Artificial Sequence
  chemically synthesized
ccagtgttagcaaggatgcatc

SEQ ID NO: 126147 - DNA, 22 bp, Artificial Sequence
  chemically synthesized
cagtgttagcaaggatgcatcc

SEQ ID NO: 126148 - DNA, 22 bp, Artificial Sequence
  chemically synthesized
gcaaggatgcatccatgagttt

SEQ ID NO: 126149 - DNA, 22 bp, Artificial Sequence
  chemically synthesized
tttgtggatatcctcccagagc

SEQ ID NO: 126150 - DNA, 22 bp, Artificial Sequence
  chemically synthesized
ttgtggatatcctcccagagca

SEQ ID NO: 126151 - DNA, 22 bp, Artificial Sequence
  chemically synthesized
tgtggatatcctcccagagcac

SEQ ID NO: 126152 - DNA, 22 bp, Artificial Sequence
  chemically synthesized
gtggatatcctcccagagcaca

SEQ ID NO: 126153 - DNA, 22 bp, Artificial Sequence
  chemically synthesized
tggatatcctcccagagcacat

SEQ ID NO: 126154 - DNA, 22 bp, Artificial Sequence
  chemically synthesized
ccagagcacatcacctttctca

SEQ ID NO: 126155 - DNA, 22 bp, Artificial Sequence
  chemically synthesized
tctcaccaaccattttcacacc

SEQ ID NO: 126156 - DNA, 22 bp, Artificial Sequence
  chemically synthesized
ctcaccaaccattttcacacct

SEQ ID NO: 126157 - DNA, 22 bp, Artificial Sequence
  chemically synthesized
tcaccaaccattttcacacctt

SEQ ID NO: 126158 - DNA, 22 bp, Artificial Sequence
  chemically synthesized
accaaccattttcacaccttcc

SEQ ID NO: 126159 - DNA, 22 bp, Artificial Sequence
  chemically synthesized
tcacaccttcctgcccagacca

SEQ ID NO: 126160 - DNA, 22 bp, Artificial Sequence
  chemically synthesized
cacaccttcctgcccagaccaa

SEQ ID NO: 126161 - DNA, 22 bp, Artificial Sequence
  chemically synthesized
acaccttcctgcccagaccaat

SEQ ID NO: 126162 - DNA, 22 bp, Artificial Sequence
  chemically synthesized
cctgcccagaccaatccagcgc

SEQ ID NO: 126163 - DNA, 22 bp, Artificial Sequence
  chemically synthesized
ctgcccagaccaatccagcgca

SEQ ID NO: 126164 - DNA, 22 bp, Artificial Sequence
  chemically synthesized
cccagaccaatccagcgcacag

SEQ ID NO: 126165 - DNA, 22 bp, Artificial Sequence
  chemically synthesized
cacacagtgactcagcttcgtc

SEQ ID NO: 126166 - DNA, 22 bp, Artificial Sequence
  chemically synthesized
acacagtgactcagcttcgtca

SEQ ID NO: 126167 - DNA, 22 bp, Artificial Sequence
  chemically synthesized
agcttcgtcaaggtctcttgaa

SEQ ID NO: 126168 - DNA, 22 bp, Artificial Sequence
  chemically synthesized
cgtcaaggtctcttgaatgcct

SEQ ID NO: 126169 - DNA, 22 bp, Artificial Sequence
  chemically synthesized
gtcaaggtctcttgaatgcctt

SEQ ID NO: 126170 - DNA, 22 bp, Artificial Sequence
  chemically synthesized
ttgaatgcctttgattgcttct

SEQ ID NO: 126171 - DNA, 22 bp, Artificial Sequence
  chemically synthesized
gaatgcctttgattgcttctaa

SEQ ID NO: 126172 - DNA, 22 bp, Artificial Sequence
  chemically synthesized
aatgcctttgattgcttctaaa

SEQ ID NO: 126173 - DNA, 22 bp, Artificial Sequence
  chemically synthesized
tgattgcttctaaacatcctca

SEQ ID NO: 126174 - DNA, 22 bp, Artificial Sequence
  chemically synthesized
gattgcttctaaacatcctcag

SEQ ID NO: 126175 - DNA, 22 bp, Artificial Sequence
  chemically synthesized
attgcttctaaacatcctcaga

SEQ ID NO: 126176 - DNA, 22 bp, Artificial Sequence
  chemically synthesized
cttctaaacatcctcagagttc

SEQ ID NO: 126177 - DNA, 22 bp, Artificial Sequence
  chemically synthesized
ctaaacatcctcagagttctct

SEQ ID NO: 126178 - DNA, 22 bp, Artificial Sequence
  chemically synthesized
taaacatcctcagagttctctc

SEQ ID NO: 126179 - DNA, 22 bp, Artificial Sequence
  chemically synthesized
aacatcctcagagttctctcag

SEQ ID NO: 126180 - DNA, 22 bp, Artificial Sequence
  chemically synthesized
agagttctctcaggtctggtac

SEQ ID NO: 126181 - DNA, 22 bp, Artificial Sequence
  chemically synthesized
tctcaggtctggtaccctctgc

SEQ ID NO: 126182 - DNA, 22 bp, Artificial Sequence
  chemically synthesized
tcaggtctggtaccctctgctt

SEQ ID NO: 126183 - DNA, 22 bp, Artificial Sequence
  chemically synthesized
aggtctggtaccctctgcttct

SEQ ID NO: 126184 - DNA, 22 bp, Artificial Sequence
  chemically synthesized
gtaccctctgcttcttgtggct

SEQ ID NO: 126185 - DNA, 22 bp, Artificial Sequence
  chemically synthesized
tgcttcttgtggcttgaagttc

SEQ ID NO: 126186 - DNA, 22 bp, Artificial Sequence
  chemically synthesized
cttcttgtggcttgaagttctg

SEQ ID NO: 126187 - DNA, 22 bp, Artificial Sequence
  chemically synthesized
cttgtggcttgaagttctggac

SEQ ID NO: 126188 - DNA, 22 bp, Artificial Sequence
  chemically synthesized
ttgtggcttgaagttctggaca

SEQ ID NO: 126189 - DNA, 22 bp, Artificial Sequence
  chemically synthesized
gtggcttgaagttctggacata

SEQ ID NO: 126190 - DNA, 22 bp, Artificial Sequence
  chemically synthesized
tggcttgaagttctggacatat

SEQ ID NO: 126191 - DNA, 22 bp, Artificial Sequence
  chemically synthesized
gaagttctggacatattcttca

SEQ ID NO: 126192 - DNA, 22 bp, Artificial Sequence
  chemically synthesized
aagttctggacatattcttcaa

SEQ ID NO: 126193 - DNA, 22 bp, Artificial Sequence
  chemically synthesized
tggacatattcttcaaactgtt

SEQ ID NO: 126194 - DNA, 22 bp, Artificial Sequence
  chemically synthesized
gacatattcttcaaactgtttg

SEQ ID NO: 126195 - DNA, 22 bp, Artificial Sequence
  chemically synthesized
ttcaaactgtttgtcttttgtc

SEQ ID NO: 126196 - DNA, 22 bp, Artificial Sequence
  chemically synthesized
caaactgtttgtcttttgtctc

SEQ ID NO: 126197 - DNA, 22 bp, Artificial Sequence
  chemically synthesized
aaactgtttgtcttttgtctca

SEQ ID NO: 126198 - DNA, 22 bp, Artificial Sequence
  chemically synthesized
tttgtcttttgtctcagcagct

SEQ ID NO: 126199 - DNA, 22 bp, Artificial Sequence
  chemically synthesized
gtcttttgtctcagcagctttc

SEQ ID NO: 126200 - DNA, 22 bp, Artificial Sequence
  chemically synthesized
tcttttgtctcagcagctttcc

SEQ ID NO: 126201 - DNA, 22 bp, Artificial Sequence
  chemically synthesized
ttgtctcagcagctttccctgg

SEQ ID NO: 126202 - DNA, 22 bp, Artificial Sequence
  chemically synthesized
tgtctcagcagctttccctggc

SEQ ID NO: 126203 - DNA, 22 bp, Artificial Sequence
  chemically synthesized
gtctcagcagctttccctggct

SEQ ID NO: 126204 - DNA, 22 bp, Artificial Sequence
  chemically synthesized
tctcagcagctttccctggctt

SEQ ID NO: 126205 - DNA, 22 bp, Artificial Sequence
  chemically synthesized
agcagctttccctggcttctgg

SEQ ID NO: 126206 - DNA, 22 bp, Artificial Sequence
  chemically synthesized
tccctggcttctggaggacgtt

SEQ ID NO: 126207 - DNA, 22 bp, Artificial Sequence
  chemically synthesized
ccctggcttctggaggacgttt

SEQ ID NO: 126208 - DNA, 22 bp, Artificial Sequence
  chemically synthesized
cctggcttctggaggacgtttt

SEQ ID NO: 126209 - DNA, 22 bp, Artificial Sequence
  chemically synthesized
gcttctggaggacgttttcctg

SEQ ID NO: 126210 - DNA, 22 bp, Artificial Sequence
  chemically synthesized
ctggaggacgttttcctgtgag

SEQ ID NO: 126211 - DNA, 22 bp, Artificial Sequence
  chemically synthesized
tggaggacgttttcctgtgagt

SEQ ID NO: 126212 - DNA, 22 bp, Artificial Sequence
  chemically synthesized
gaggacgttttcctgtgagtgg

SEQ ID NO: 126213 - DNA, 22 bp, Artificial Sequence
  chemically synthesized
tcctgtgagtggctgagtctct

SEQ ID NO: 126214 - DNA, 22 bp, Artificial Sequence
  chemically synthesized
cctgtgagtggctgagtctctt

SEQ ID NO: 126215 - DNA, 22 bp, Artificial Sequence
  chemically synthesized
ctgtgagtggctgagtctcttc

SEQ ID NO: 126216 - DNA, 22 bp, Artificial Sequence
  chemically synthesized
tgagtggctgagtctcttccag

SEQ ID NO: 126217 - DNA, 22 bp, Artificial Sequence
  chemically synthesized
agtctcttccaggcattcttgg

SEQ ID NO: 126218 - DNA, 22 bp, Artificial Sequence
  chemically synthesized
ttccaggcattcttggcaaaga

SEQ ID NO: 126219 - DNA, 22 bp, Artificial Sequence
  chemically synthesized
ccaggcattcttggcaaagatg

SEQ ID NO: 126220 - DNA, 22 bp, Artificial Sequence
  chemically synthesized
caggcattcttggcaaagatgc

SEQ ID NO: 126221 - DNA, 22 bp, Artificial Sequence
  chemically synthesized
ttggcaaagatgccctcttgat

SEQ ID NO: 126222 - DNA, 22 bp, Artificial Sequence
  chemically synthesized
ggcaaagatgccctcttgatgt

SEQ ID NO: 126223 - DNA, 22 bp, Artificial Sequence
  chemically synthesized
gcaaagatgccctcttgatgtt

SEQ ID NO: 126224 - DNA, 22 bp, Artificial Sequence
  chemically synthesized
ttgatgttggccagggctgcag

SEQ ID NO: 126225 - DNA, 22 bp, Artificial Sequence
  chemically synthesized
gatgttggccagggctgcaggt

SEQ ID NO: 126226 - DNA, 22 bp, Artificial Sequence
  chemically synthesized
atgttggccagggctgcaggtc

SEQ ID NO: 126227 - DNA, 22 bp, Artificial Sequence
  chemically synthesized
gccagggctgcaggtccaggac

SEQ ID NO: 126228 - DNA, 22 bp, Artificial Sequence
  chemically synthesized
caggtccaggacctgggaggag

SEQ ID NO: 126229 - DNA, 22 bp, Artificial Sequence
  chemically synthesized
ggaggagctgagcgctcagtgt

SEQ ID NO: 126230 - DNA, 22 bp, Artificial Sequence
  chemically synthesized
agcgctcagtgtggctggtggc

SEQ ID NO: 126231 - DNA, 22 bp, Artificial Sequence
  chemically synthesized
agtgtggctggtggcgtggagg

SEQ ID NO: 126232 - DNA, 22 bp, Artificial Sequence
  chemically synthesized
gtggcgtggaggggcgggagga

SEQ ID NO: 126233 - DNA, 22 bp, Artificial Sequence
  chemically synthesized
cgaccctactgttgatatgttg

SEQ ID NO: 126234 - DNA, 22 bp, Artificial Sequence
  chemically synthesized
gaccctactgttgatatgttgt

SEQ ID NO: 126235 - DNA, 22 bp, Artificial Sequence
  chemically synthesized
ctgttgatatgttgttcaggga

SEQ ID NO: 126236 - DNA, 22 bp, Artificial Sequence
  chemically synthesized
ttgatatgttgttcagggacca

SEQ ID NO: 126237 - DNA, 22 bp, Artificial Sequence
  chemically synthesized
atatgttgttcagggaccatcg

SEQ ID NO: 126238 - DNA, 22 bp, Artificial Sequence
  chemically synthesized
ttcagggaccatcgggagccca

SEQ ID NO: 126239 - DNA, 22 bp, Artificial Sequence
  chemically synthesized
agggaccatcgggagcccagag

SEQ ID NO: 126240 - DNA, 22 bp, Artificial Sequence
  chemically synthesized
tgctctgtttcacgggactcca

SEQ ID NO: 126241 - DNA, 22 bp, Artificial Sequence
  chemically synthesized
ctctgtttcacgggactccaca

SEQ ID NO: 126242 - DNA, 22 bp, Artificial Sequence
  chemically synthesized
tgtttcacgggactccacaaag

SEQ ID NO: 126243 - DNA, 22 bp, Artificial Sequence
  chemically synthesized
tttcacgggactccacaaagag

SEQ ID NO: 126244 - DNA, 22 bp, Artificial Sequence
  chemically synthesized
cacgggactccacaaagagaac

SEQ ID NO: 126245 - DNA, 22 bp, Artificial Sequence
  chemically synthesized
acgggactccacaaagagaact

SEQ ID NO: 126246 - DNA, 22 bp, Artificial Sequence
  chemically synthesized
cacaaagagaactgcaagtccc

SEQ ID NO: 126247 - DNA, 22 bp, Artificial Sequence
  chemically synthesized
caagtcccagtctttcacctct

SEQ ID NO: 126248 - DNA, 22 bp, Artificial Sequence
  chemically synthesized
tcacctctcttggactttttat

SEQ ID NO: 126249 - DNA, 22 bp, Artificial Sequence
  chemically synthesized
cacctctcttggactttttatc

SEQ ID NO: 126250 - DNA, 22 bp, Artificial Sequence
  chemically synthesized
acctctcttggactttttatct

SEQ ID NO: 126251 - DNA, 22 bp, Artificial Sequence
  chemically synthesized
tcttggactttttatcttgtct

SEQ ID NO: 126252 - DNA, 22 bp, Artificial Sequence
  chemically synthesized
ttggactttttatcttgtctct

SEQ ID NO: 126253 - DNA, 22 bp, Artificial Sequence
  chemically synthesized
ggactttttatcttgtctcttc

SEQ ID NO: 126254 - DNA, 22 bp, Artificial Sequence
  chemically synthesized
gactttttatcttgtctcttca

SEQ ID NO: 126255 - DNA, 22 bp, Artificial Sequence
  chemically synthesized
tttatcttgtctcttcatcaca

SEQ ID NO: 126256 - DNA, 22 bp, Artificial Sequence
  chemically synthesized
ttatcttgtctcttcatcacat

SEQ ID NO: 126257 - DNA, 22 bp, Artificial Sequence
  chemically synthesized
tatcttgtctcttcatcacatc

SEQ ID NO: 126258 - DNA, 22 bp, Artificial Sequence
  chemically synthesized
atcttgtctcttcatcacatct

SEQ ID NO: 126259 - DNA, 22 bp, Artificial Sequence
  chemically synthesized
tcttgtctcttcatcacatctc

SEQ ID NO: 126260 - DNA, 22 bp, Artificial Sequence
  chemically synthesized
gtctcttcatcacatctcttca

SEQ ID NO: 126261 - DNA, 22 bp, Artificial Sequence
  chemically synthesized
tctcttcatcacatctcttcag

SEQ ID NO: 126262 - DNA, 22 bp, Artificial Sequence
  chemically synthesized
ttcatcacatctcttcagtata

SEQ ID NO: 126263 - DNA, 22 bp, Artificial Sequence
  chemically synthesized
catcacatctcttcagtataag

SEQ ID NO: 126264 - DNA, 22 bp, Artificial Sequence
  chemically synthesized
atcacatctcttcagtataagg

SEQ ID NO: 126265 - DNA, 22 bp, Artificial Sequence
  chemically synthesized
ttcagtataaggaagaacagaa

SEQ ID NO: 126266 - DNA, 22 bp, Artificial Sequence
  chemically synthesized
cagtataaggaagaacagaaag

SEQ ID NO: 126267 - DNA, 22 bp, Artificial Sequence
  chemically synthesized
agtataaggaagaacagaaagg

SEQ ID NO: 126268 - DNA, 22 bp, Artificial Sequence
  chemically synthesized
agggttgtcagtcaaatgtgtc

SEQ ID NO: 126269 - DNA, 22 bp, Artificial Sequence
  chemically synthesized
tcagtcaaatgtgtccatttac

SEQ ID NO: 126270 - DNA, 22 bp, Artificial Sequence
  chemically synthesized
acagaatttataaaatgtattg

SEQ ID NO: 126271 - DNA, 22 bp, Artificial Sequence
  chemically synthesized
cagaatttataaaatgtattgt

SEQ ID NO: 126272 - DNA, 22 bp, Artificial Sequence
  chemically synthesized
ataaaatgtattgttatcctag

SEQ ID NO: 126273 - DNA, 22 bp, Artificial Sequence
  chemically synthesized
taaaatgtattgttatcctagt

SEQ ID NO: 126274 - DNA, 22 bp, Artificial Sequence
  chemically synthesized
ttatcctagttatctttatact

SEQ ID NO: 126275 - DNA, 22 bp, Artificial Sequence
  chemically synthesized
tcctagttatctttatactagc

SEQ ID NO: 126276 - DNA, 22 bp, Artificial Sequence
  chemically synthesized
gttatctttatactagcctgct

SEQ ID NO: 126277 - DNA, 22 bp, Artificial Sequence
  chemically synthesized
tctttatactagcctgctatgg

SEQ ID NO: 126278 - DNA, 22 bp, Artificial Sequence
  chemically synthesized
tatactagcctgctatggcagg

SEQ ID NO: 126279 - DNA, 22 bp, Artificial Sequence
  chemically synthesized
atactagcctgctatggcaggt

SEQ ID NO: 126280 - DNA, 22 bp, Artificial Sequence
  chemically synthesized
tactagcctgctatggcaggtt

SEQ ID NO: 126281 - DNA, 22 bp, Artificial Sequence
  chemically synthesized
gcctgctatggcaggtttcagg

SEQ ID NO: 126282 - DNA, 22 bp, Artificial Sequence
  chemically synthesized
ctatggcaggtttcaggatcac

SEQ ID NO: 126283 - DNA, 22 bp, Artificial Sequence
  chemically synthesized
tggcaggtttcaggatcactgg

SEQ ID NO: 126284 - DNA, 22 bp, Artificial Sequence
  chemically synthesized
caggatcactggacctagaggg

SEQ ID NO: 126285 - DNA, 22 bp, Artificial Sequence
  chemically synthesized
aggatcactggacctagagggt

SEQ ID NO: 126286 - DNA, 22 bp, Artificial Sequence
  chemically synthesized
gacctagagggtgagtcaagaa

SEQ ID NO: 126287 - DNA, 22 bp, Artificial Sequence
  chemically synthesized
gagggtgagtcaagaaagattt

SEQ ID NO: 126288 - DNA, 22 bp, Artificial Sequence
  chemically synthesized
tctttgatgtggcttagatccc

SEQ ID NO: 126289 - DNA, 22 bp, Artificial Sequence
  chemically synthesized
ctttgatgtggcttagatcccc

SEQ ID NO: 126290 - DNA, 22 bp, Artificial Sequence
  chemically synthesized
tttgatgtggcttagatccccc

SEQ ID NO: 126291 - DNA, 22 bp, Artificial Sequence
  chemically synthesized
tgatgtggcttagatccccctg

SEQ ID NO: 126292 - DNA, 22 bp, Artificial Sequence
  chemically synthesized
gatgtggcttagatccccctga

SEQ ID NO: 126293 - DNA, 22 bp, Artificial Sequence
  chemically synthesized
atgtggcttagatccccctgaa

SEQ ID NO: 126294 - DNA, 22 bp, Artificial Sequence
  chemically synthesized
agatccccctgaattcattccc

SEQ ID NO: 126295 - DNA, 22 bp, Artificial Sequence
  chemically synthesized
gatccccctgaattcattccca

SEQ ID NO: 126296 - DNA, 22 bp, Artificial Sequence
  chemically synthesized
aattcattcccaaaagcccaag

SEQ ID NO: 126297 - DNA, 22 bp, Artificial Sequence
  chemically synthesized
attcccaaaagcccaagggaag

SEQ ID NO: 126298 - DNA, 22 bp, Artificial Sequence
  chemically synthesized
ccaaaagcccaagggaagaaag

SEQ ID NO: 126299 - DNA, 22 bp, Artificial Sequence
  chemically synthesized
agtatacattgcccatatcttg

SEQ ID NO: 126300 - DNA, 22 bp, Artificial Sequence
  chemically synthesized
cccatatcttggaagacaatac

SEQ ID NO: 126301 - DNA, 22 bp, Artificial Sequence
  chemically synthesized
ggaagacaatacagagagcagt

SEQ ID NO: 126302 - DNA, 22 bp, Artificial Sequence
  chemically synthesized
gaagacaatacagagagcagta

SEQ ID NO: 126303 - DNA, 22 bp, Artificial Sequence
  chemically synthesized
gcagacacacagaaagacatgg

SEQ ID NO: 126304 - DNA, 22 bp, Artificial Sequence
  chemically synthesized
taaattttatttattcatttta

SEQ ID NO: 126305 - DNA, 22 bp, Artificial Sequence
  chemically synthesized
aaattttatttattcattttaa

SEQ ID NO: 126306 - DNA, 22 bp, Artificial Sequence
  chemically synthesized
aattttatttattcattttaat

SEQ ID NO: 126307 - DNA, 22 bp, Artificial Sequence
  chemically synthesized
tatttattcattttaatgaaaa

SEQ ID NO: 126308 - DNA, 22 bp, Artificial Sequence
  chemically synthesized
atttattcattttaatgaaaaa

SEQ ID NO: 126309 - DNA, 22 bp, Artificial Sequence
  chemically synthesized
tttattcattttaatgaaaaat

SEQ ID NO: 126310 - DNA, 22 bp, Artificial Sequence
  chemically synthesized
attcattttaatgaaaaattat

SEQ ID NO: 126311 - DNA, 22 bp, Artificial Sequence
  chemically synthesized
ttcattttaatgaaaaattata

SEQ ID NO: 126312 - DNA, 22 bp, Artificial Sequence
  chemically synthesized
attttaatgaaaaattatattt

SEQ ID NO: 126313 - DNA, 22 bp, Artificial Sequence
  chemically synthesized
taatgaaaaattatattttgtt

SEQ ID NO: 126314 - DNA, 22 bp, Artificial Sequence
  chemically synthesized
aatgaaaaattatattttgtta

SEQ ID NO: 126315 - DNA, 22 bp, Artificial Sequence
  chemically synthesized
atgaaaaattatattttgttaa

SEQ ID NO: 126316 - DNA, 22 bp, Artificial Sequence
  chemically synthesized
tattttgttaaaaatggtctat

SEQ ID NO: 126317 - DNA, 22 bp, Artificial Sequence
  chemically synthesized
tgttaaaaatggtctatgtgag

SEQ ID NO: 126318 - DNA, 22 bp, Artificial Sequence
  chemically synthesized
gttaaaaatggtctatgtgaga

SEQ ID NO: 126319 - DNA, 22 bp, Artificial Sequence
  chemically synthesized
ttaaaaatggtctatgtgagaa

SEQ ID NO: 126320 - DNA, 22 bp, Artificial Sequence
  chemically synthesized
aaaatggtctatgtgagaagtt

SEQ ID NO: 126321 - DNA, 22 bp, Artificial Sequence
  chemically synthesized
tgtgagaagttctgtaatacag

SEQ ID NO: 126322 - DNA, 22 bp, Artificial Sequence
  chemically synthesized
tgtaatacagtagggaataaga

SEQ ID NO: 126323 - DNA, 22 bp, Artificial Sequence
  chemically synthesized
taatacagtagggaataagaac

SEQ ID NO: 126324 - DNA, 22 bp, Artificial Sequence
  chemically synthesized
tgttatatttaccatcctcgag

SEQ ID NO: 126325 - DNA, 22 bp, Artificial Sequence
  chemically synthesized
tatttaccatcctcgagcacac

SEQ ID NO: 126326 - DNA, 22 bp, Artificial Sequence
  chemically synthesized
accatcctcgagcacacagtca

SEQ ID NO: 126327 - DNA, 22 bp, Artificial Sequence
  chemically synthesized
ccatcctcgagcacacagtcaa

SEQ ID NO: 126328 - DNA, 22 bp, Artificial Sequence
  chemically synthesized
gagcacacagtcaagaagctac

SEQ ID NO: 126329 - DNA, 22 bp, Artificial Sequence
  chemically synthesized
caaaagagaaaggcaaatttca

SEQ ID NO: 126330 - DNA, 22 bp, Artificial Sequence
  chemically synthesized
cacacacagccaagttgagtaa

SEQ ID NO: 126331 - DNA, 22 bp, Artificial Sequence
  chemically synthesized
acacacagccaagttgagtaaa

SEQ ID NO: 126332 - DNA, 22 bp, Artificial Sequence
  chemically synthesized
agtaaaacaaacaaaatctttt

SEQ ID NO: 126333 - DNA, 22 bp, Artificial Sequence
  chemically synthesized
ttggtctaatcagataaagatc

SEQ ID NO: 126334 - DNA, 22 bp, Artificial Sequence
  chemically synthesized
tggtctaatcagataaagatca

SEQ ID NO: 126335 - DNA, 22 bp, Artificial Sequence
  chemically synthesized
ggtctaatcagataaagatcat

SEQ ID NO: 126336 - DNA, 22 bp, Artificial Sequence
  chemically synthesized
gtctaatcagataaagatcatt

SEQ ID NO: 126337 - DNA, 22 bp, Artificial Sequence
  chemically synthesized
atcagataaagatcatttacta

SEQ ID NO: 126338 - DNA, 22 bp, Artificial Sequence
  chemically synthesized
actagcctggaaactattgtga

SEQ ID NO: 126339 - DNA, 22 bp, Artificial Sequence
  chemically synthesized
ctagcctggaaactattgtgaa

SEQ ID NO: 126340 - DNA, 22 bp, Artificial Sequence
  chemically synthesized
gcctggaaactattgtgaaggt

SEQ ID NO: 126341 - DNA, 22 bp, Artificial Sequence
  chemically synthesized
gaaactattgtgaaggtattat

SEQ ID NO: 126342 - DNA, 22 bp, Artificial Sequence
  chemically synthesized
ttgtgaaggtattattttattt

SEQ ID NO: 126343 - DNA, 22 bp, Artificial Sequence
  chemically synthesized
tgaaggtattattttatttttg

SEQ ID NO: 126344 - DNA, 22 bp, Artificial Sequence
  chemically synthesized
ttttatttttgttttctctgtg

SEQ ID NO: 126345 - DNA, 22 bp, Artificial Sequence
  chemically synthesized
tatttttgttttctctgtgtta

SEQ ID NO: 126346 - DNA, 22 bp, Artificial Sequence
  chemically synthesized
atttttgttttctctgtgttat

SEQ ID NO: 126347 - DNA, 22 bp, Artificial Sequence
  chemically synthesized
tttttgttttctctgtgttatt

SEQ ID NO: 126348 - DNA, 22 bp, Artificial Sequence
  chemically synthesized
ttgttttctctgtgttatttat

SEQ ID NO: 126349 - DNA, 22 bp, Artificial Sequence
  chemically synthesized
tgttttctctgtgttatttata

SEQ ID NO: 126350 - DNA, 22 bp, Artificial Sequence
  chemically synthesized
gttttctctgtgttatttatac

SEQ ID NO: 126351 - DNA, 22 bp, Artificial Sequence
  chemically synthesized
ttttctctgtgttatttataca

SEQ ID NO: 126352 - DNA, 22 bp, Artificial Sequence
  chemically synthesized
tctctgtgttatttatacatcc

SEQ ID NO: 126353 - DNA, 22 bp, Artificial Sequence
  chemically synthesized
ctctgtgttatttatacatccc

SEQ ID NO: 126354 - DNA, 22 bp, Artificial Sequence
  chemically synthesized
tctgtgttatttatacatccca

SEQ ID NO: 126355 - DNA, 22 bp, Artificial Sequence
  chemically synthesized
tgtgttatttatacatcccaag

SEQ ID NO: 126356 - DNA, 22 bp, Artificial Sequence
  chemically synthesized
tgttatttatacatcccaagaa

SEQ ID NO: 126357 - DNA, 22 bp, Artificial Sequence
  chemically synthesized
tttatacatcccaagaatccta

SEQ ID NO: 126358 - DNA, 22 bp, Artificial Sequence
  chemically synthesized
atacatcccaagaatcctaaaa

SEQ ID NO: 126359 - DNA, 22 bp, Artificial Sequence
  chemically synthesized
tacatcccaagaatcctaaaaa

SEQ ID NO: 126360 - DNA, 22 bp, Artificial Sequence
  chemically synthesized
aaaaatccccacctttctgtga

SEQ ID NO: 126361 - DNA, 22 bp, Artificial Sequence
  chemically synthesized
tctgtgatgaagagtaggtggg

SEQ ID NO: 126362 - DNA, 22 bp, Artificial Sequence
  chemically synthesized
ctgtgatgaagagtaggtgggc

SEQ ID NO: 126363 - DNA, 22 bp, Artificial Sequence
  chemically synthesized
tgtgatgaagagtaggtgggca

SEQ ID NO: 126364 - DNA, 22 bp, Artificial Sequence
  chemically synthesized
tgatgaagagtaggtgggcagc

SEQ ID NO: 126365 - DNA, 22 bp, Artificial Sequence
  chemically synthesized
agtgtcagtatgacagaggcca

SEQ ID NO: 126366 - DNA, 22 bp, Artificial Sequence
  chemically synthesized
actggtcactgggtggcccctt

SEQ ID NO: 126367 - DNA, 22 bp, Artificial Sequence
  chemically synthesized
gtcactgggtggccccttgtgt

SEQ ID NO: 126368 - DNA, 22 bp, Artificial Sequence
  chemically synthesized
ggtggccccttgtgtagtccaa

SEQ ID NO: 126369 - DNA, 22 bp, Artificial Sequence
  chemically synthesized
gtgtagtccaagcacatcatac

SEQ ID NO: 126370 - DNA, 22 bp, Artificial Sequence
  chemically synthesized
tgtagtccaagcacatcatacc

SEQ ID NO: 126371 - DNA, 22 bp, Artificial Sequence
  chemically synthesized
tattttggtcaaaagaatatct

SEQ ID NO: 126372 - DNA, 22 bp, Artificial Sequence
  chemically synthesized
tggtcaaaagaatatctttctt

SEQ ID NO: 126373 - DNA, 22 bp, Artificial Sequence
  chemically synthesized
ggtcaaaagaatatctttcttt

SEQ ID NO: 126374 - DNA, 22 bp, Artificial Sequence
  chemically synthesized
gtcaaaagaatatctttctttt

SEQ ID NO: 126375 - DNA, 22 bp, Artificial Sequence
  chemically synthesized
tcttttaaaattaatttaaaac

SEQ ID NO: 126376 - DNA, 22 bp, Artificial Sequence
  chemically synthesized
cttttaaaattaatttaaaact

SEQ ID NO: 126377 - DNA, 22 bp, Artificial Sequence
  chemically synthesized
ttttaaaattaatttaaaactt

SEQ ID NO: 126378 - DNA, 22 bp, Artificial Sequence
  chemically synthesized
ttaaaattaatttaaaacttat

SEQ ID NO: 126379 - DNA, 22 bp, Artificial Sequence
  chemically synthesized
taaaattaatttaaaacttatc

SEQ ID NO: 126380 - DNA, 22 bp, Artificial Sequence
  chemically synthesized
aaaattaatttaaaacttatca

SEQ ID NO: 126381 - DNA, 22 bp, Artificial Sequence
  chemically synthesized
aaattaatttaaaacttatcat

SEQ ID NO: 126382 - DNA, 22 bp, Artificial Sequence
  chemically synthesized
atttaaaacttatcatttgagt

SEQ ID NO: 126383 - DNA, 22 bp, Artificial Sequence
  chemically synthesized
aaaacttatcatttgagtcatg

SEQ ID NO: 126384 - DNA, 22 bp, Artificial Sequence
  chemically synthesized
aaacttatcatttgagtcatgg

SEQ ID NO: 126385 - DNA, 22 bp, Artificial Sequence
  chemically synthesized
atcatttgagtcatggatactg

SEQ ID NO: 126386 - DNA, 22 bp, Artificial Sequence
  chemically synthesized
tcatttgagtcatggatactgg

SEQ ID NO: 126387 - DNA, 22 bp, Artificial Sequence
  chemically synthesized
gagtcatggatactggctcttc

SEQ ID NO: 126388 - DNA, 22 bp, Artificial Sequence
  chemically synthesized
agtcatggatactggctcttca

SEQ ID NO: 126389 - DNA, 22 bp, Artificial Sequence
  chemically synthesized
gctcttcacctggccataggac

SEQ ID NO: 126390 - DNA, 22 bp, Artificial Sequence
  chemically synthesized
ttcacctggccataggaccaca

SEQ ID NO: 126391 - DNA, 22 bp, Artificial Sequence
  chemically synthesized
cacctggccataggaccacaaa

SEQ ID NO: 126392 - DNA, 22 bp, Artificial Sequence
  chemically synthesized
acctggccataggaccacaaac

SEQ ID NO: 126393 - DNA, 22 bp, Artificial Sequence
  chemically synthesized
gccataggaccacaaaccccct

SEQ ID NO: 126394 - DNA, 22 bp, Artificial Sequence
  chemically synthesized
ttctcatgcctagactctgaaa

SEQ ID NO: 126395 - DNA, 22 bp, Artificial Sequence
  chemically synthesized
ctcatgcctagactctgaaaag

SEQ ID NO: 126396 - DNA, 22 bp, Artificial Sequence
  chemically synthesized
tcatgcctagactctgaaaaga

SEQ ID NO: 126397 - DNA, 22 bp, Artificial Sequence
  chemically synthesized
atgcctagactctgaaaagaat

SEQ ID NO: 126398 - DNA, 22 bp, Artificial Sequence
  chemically synthesized
gactctgaaaagaatcaaaagt

SEQ ID NO: 126399 - DNA, 22 bp, Artificial Sequence
  chemically synthesized
tgaaaagaatcaaaagtatttg

SEQ ID NO: 126400 - DNA, 22 bp, Artificial Sequence
  chemically synthesized
aaaagaatcaaaagtatttgga

SEQ ID NO: 126401 - DNA, 22 bp, Artificial Sequence
  chemically synthesized
ggagccagaaaaggccatttta

SEQ ID NO: 126402 - DNA, 22 bp, Artificial Sequence
  chemically synthesized
gagccagaaaaggccattttat

SEQ ID NO: 126403 - DNA, 22 bp, Artificial Sequence
  chemically synthesized
tatcttctagttatgagcattg

SEQ ID NO: 126404 - DNA, 22 bp, Artificial Sequence
  chemically synthesized
atcttctagttatgagcattgc

SEQ ID NO: 126405 - DNA, 22 bp, Artificial Sequence
  chemically synthesized
tcttctagttatgagcattgcc

SEQ ID NO: 126406 - DNA, 22 bp, Artificial Sequence
  chemically synthesized
ctagttatgagcattgcctcca

SEQ ID NO: 126407 - DNA, 22 bp, Artificial Sequence
  chemically synthesized
tagttatgagcattgcctccat

SEQ ID NO: 126408 - DNA, 22 bp, Artificial Sequence
  chemically synthesized
gttatgagcattgcctccatcc

SEQ ID NO: 126409 - DNA, 22 bp, Artificial Sequence
  chemically synthesized
tgagcattgcctccatcctctc

SEQ ID NO: 126410 - DNA, 22 bp, Artificial Sequence
  chemically synthesized
cctccatcctctcccttcctcc

SEQ ID NO: 126411 - DNA, 22 bp, Artificial Sequence
  chemically synthesized
catcctctcccttcctccccac

SEQ ID NO: 126412 - DNA, 22 bp, Artificial Sequence
  chemically synthesized
tcccttcctccccactctccac

SEQ ID NO: 126413 - DNA, 22 bp, Artificial Sequence
  chemically synthesized
ccttcctccccactctccacat

SEQ ID NO: 126414 - DNA, 22 bp, Artificial Sequence
  chemically synthesized
cctccccactctccacatatga

SEQ ID NO: 126415 - DNA, 22 bp, Artificial Sequence
  chemically synthesized
ctccccactctccacatatgac

SEQ ID NO: 126416 - DNA, 22 bp, Artificial Sequence
  chemically synthesized
cccactctccacatatgaccaa

SEQ ID NO: 126417 - DNA, 22 bp, Artificial Sequence
  chemically synthesized
tccacatatgaccaactgtttg

SEQ ID NO: 126418 - DNA, 22 bp, Artificial Sequence
  chemically synthesized
cacatatgaccaactgtttgtt

SEQ ID NO: 126419 - DNA, 22 bp, Artificial Sequence
  chemically synthesized
tttgtttttcaactctgctatt

SEQ ID NO: 126420 - DNA, 22 bp, Artificial Sequence
  chemically synthesized
gtttttcaactctgctattttg

SEQ ID NO: 126421 - DNA, 22 bp, Artificial Sequence
  chemically synthesized
tttttcaactctgctattttgc

SEQ ID NO: 126422 - DNA, 22 bp, Artificial Sequence
  chemically synthesized
ttcaactctgctattttgcaca

SEQ ID NO: 126423 - DNA, 22 bp, Artificial Sequence
  chemically synthesized
tcaactctgctattttgcacat

SEQ ID NO: 126424 - DNA, 22 bp, Artificial Sequence
  chemically synthesized
caactctgctattttgcacatg

SEQ ID NO: 126425 - DNA, 22 bp, Artificial Sequence
  chemically synthesized
aactctgctattttgcacatgc

SEQ ID NO: 126426 - DNA, 22 bp, Artificial Sequence
  chemically synthesized
tgctattttgcacatgccagac

SEQ ID NO: 126427 - DNA, 22 bp, Artificial Sequence
  chemically synthesized
ctattttgcacatgccagacac

SEQ ID NO: 126428 - DNA, 22 bp, Artificial Sequence
  chemically synthesized
ttttgcacatgccagacacccc

SEQ ID NO: 126429 - DNA, 22 bp, Artificial Sequence
  chemically synthesized
tgcacatgccagacacccctat

SEQ ID NO: 126430 - DNA, 22 bp, Artificial Sequence
  chemically synthesized
gcacatgccagacacccctatc

SEQ ID NO: 126431 - DNA, 22 bp, Artificial Sequence
  chemically synthesized
cacatgccagacacccctatct

SEQ ID NO: 126432 - DNA, 22 bp, Artificial Sequence
  chemically synthesized
tctagtcttatctctgatgttc

SEQ ID NO: 126433 - DNA, 22 bp, Artificial Sequence
  chemically synthesized
gtcttatctctgatgttcccct

SEQ ID NO: 126434 - DNA, 22 bp, Artificial Sequence
  chemically synthesized
atctctgatgttcccctaaacc

SEQ ID NO: 126435 - DNA, 22 bp, Artificial Sequence
  chemically synthesized
tctctgatgttcccctaaacca

SEQ ID NO: 126436 - DNA, 22 bp, Artificial Sequence
  chemically synthesized
tgatgttcccctaaaccagacc

SEQ ID NO: 126437 - DNA, 22 bp, Artificial Sequence
  chemically synthesized
atgttcccctaaaccagacctc

SEQ ID NO: 126438 - DNA, 22 bp, Artificial Sequence
  chemically synthesized
ccctaaaccagacctctcatac

SEQ ID NO: 126439 - DNA, 22 bp, Artificial Sequence
  chemically synthesized
aaccagacctctcataccactt

SEQ ID NO: 126440 - DNA, 22 bp, Artificial Sequence
  chemically synthesized
tcataccactttatgaaaatgc

SEQ ID NO: 126441 - DNA, 22 bp, Artificial Sequence
  chemically synthesized
ataccactttatgaaaatgcat

SEQ ID NO: 126442 - DNA, 22 bp, Artificial Sequence
  chemically synthesized
tatgaaaatgcatctctctgtt

SEQ ID NO: 126443 - DNA, 22 bp, Artificial Sequence
  chemically synthesized
atgaaaatgcatctctctgttc

SEQ ID NO: 126444 - DNA, 22 bp, Artificial Sequence
  chemically synthesized
tgaaaatgcatctctctgttca

SEQ ID NO: 126445 - DNA, 22 bp, Artificial Sequence
  chemically synthesized
tctgttcagtagtaactggaat

SEQ ID NO: 126446 - DNA, 22 bp, Artificial Sequence
  chemically synthesized
tgttcagtagtaactggaatta

SEQ ID NO: 126447 - DNA, 22 bp, Artificial Sequence
  chemically synthesized
ttcagtagtaactggaattaac

SEQ ID NO: 126448 - DNA, 22 bp, Artificial Sequence
  chemically synthesized
agtagtaactggaattaactat

SEQ ID NO: 126449 - DNA, 22 bp, Artificial Sequence
  chemically synthesized
gaattaactatcaagacaatgg

SEQ ID NO: 126450 - DNA, 22 bp, Artificial Sequence
  chemically synthesized
actatcaagacaatggtcatct

SEQ ID NO: 126451 - DNA, 22 bp, Artificial Sequence
  chemically synthesized
tcaagacaatggtcatctgaat

SEQ ID NO: 126452 - DNA, 22 bp, Artificial Sequence
  chemically synthesized
aattagaaattatatctctgtt

SEQ ID NO: 126453 - DNA, 22 bp, Artificial Sequence
  chemically synthesized
gaaattatatctctgttttcaa

SEQ ID NO: 126454 - DNA, 22 bp, Artificial Sequence
  chemically synthesized
tatctctgttttcaaattatta

SEQ ID NO: 126455 - DNA, 22 bp, Artificial Sequence
  chemically synthesized
tgttttcaaattattatcaata

SEQ ID NO: 126456 - DNA, 22 bp, Artificial Sequence
  chemically synthesized
ttttcaaattattatcaatatt

SEQ ID NO: 126457 - DNA, 22 bp, Artificial Sequence
  chemically synthesized
tcaaattattatcaatattatt

SEQ ID NO: 126458 - DNA, 22 bp, Artificial Sequence
  chemically synthesized
caaattattatcaatattattt

SEQ ID NO: 126459 - DNA, 22 bp, Artificial Sequence
  chemically synthesized
aaattattatcaatattatttg

SEQ ID NO: 126460 - DNA, 22 bp, Artificial Sequence
  chemically synthesized
ttatcaatattatttgataaat

SEQ ID NO: 126461 - DNA, 22 bp, Artificial Sequence
  chemically synthesized
tcaatattatttgataaatgtt

SEQ ID NO: 126462 - DNA, 22 bp, Artificial Sequence
  chemically synthesized
tttgataaatgttaaccaaagt

SEQ ID NO: 126463 - DNA, 22 bp, Artificial Sequence
  chemically synthesized
gataaatgttaaccaaagtttt

SEQ ID NO: 126464 - DNA, 22 bp, Artificial Sequence
  chemically synthesized
ataaatgttaaccaaagtttta

SEQ ID NO: 126465 - DNA, 22 bp, Artificial Sequence
  chemically synthesized
accaaagttttaactgaacaca

SEQ ID NO: 126466 - DNA, 22 bp, Artificial Sequence
  chemically synthesized
taactgaacacatttctcatag

SEQ ID NO: 126467 - DNA, 22 bp, Artificial Sequence
  chemically synthesized
aactgaacacatttctcataga

SEQ ID NO: 126468 - DNA, 22 bp, Artificial Sequence
  chemically synthesized
actgaacacatttctcatagag

SEQ ID NO: 126469 - DNA, 22 bp, Artificial Sequence
  chemically synthesized
aacacatttctcatagagatac

SEQ ID NO: 126470 - DNA, 22 bp, Artificial Sequence
  chemically synthesized
ctcatagagatactttccctag

SEQ ID NO: 126471 - DNA, 22 bp, Artificial Sequence
  chemically synthesized
tcatagagatactttccctaga

SEQ ID NO: 126472 - DNA, 22 bp, Artificial Sequence
  chemically synthesized
atagagatactttccctagact

SEQ ID NO: 126473 - DNA, 22 bp, Artificial Sequence
  chemically synthesized
tccctagactcatcattttgaa

SEQ ID NO: 126474 - DNA, 22 bp, Artificial Sequence
  chemically synthesized
ccctagactcatcattttgaat

SEQ ID NO: 126475 - DNA, 22 bp, Artificial Sequence
  chemically synthesized
cctagactcatcattttgaatt

SEQ ID NO: 126476 - DNA, 22 bp, Artificial Sequence
  chemically synthesized
gactcatcattttgaattgagg

SEQ ID NO: 126477 - DNA, 22 bp, Artificial Sequence
  chemically synthesized
atcattttgaattgagggaaat

SEQ ID NO: 126478 - DNA, 22 bp, Artificial Sequence
  chemically synthesized
tgaattgagggaaatggtttac

SEQ ID NO: 126479 - DNA, 22 bp, Artificial Sequence
  chemically synthesized
gaattgagggaaatggtttacc

SEQ ID NO: 126480 - DNA, 22 bp, Artificial Sequence
  chemically synthesized
aattgagggaaatggtttaccc

SEQ ID NO: 126481 - DNA, 22 bp, Artificial Sequence
  chemically synthesized
agggaaatggtttaccctcatt

SEQ ID NO: 126482 - DNA, 22 bp, Artificial Sequence
  chemically synthesized
accctcattgaagaaagtaatt

SEQ ID NO: 126483 - DNA, 22 bp, Artificial Sequence
  chemically synthesized
ccctcattgaagaaagtaattg

SEQ ID NO: 126484 - DNA, 22 bp, Artificial Sequence
  chemically synthesized
attgaagaaagtaattgaggga

SEQ ID NO: 126485 - DNA, 22 bp, Artificial Sequence
  chemically synthesized
aagaaagtaattgagggaaatg

SEQ ID NO: 126486 - DNA, 22 bp, Artificial Sequence
  chemically synthesized
agggaaatggcttactctcatt

SEQ ID NO: 126487 - DNA, 22 bp, Artificial Sequence
  chemically synthesized
actctcattgaagaaagtctca

SEQ ID NO: 126488 - DNA, 22 bp, Artificial Sequence
  chemically synthesized
ctctcattgaagaaagtctcat

SEQ ID NO: 126489 - DNA, 22 bp, Artificial Sequence
  chemically synthesized
tcattgaagaaagtctcatttc

SEQ ID NO: 126490 - DNA, 22 bp, Artificial Sequence
  chemically synthesized
attgaagaaagtctcatttctt

SEQ ID NO: 126491 - DNA, 22 bp, Artificial Sequence
  chemically synthesized
aagaaagtctcatttcttcacg

SEQ ID NO: 126492 - DNA, 22 bp, Artificial Sequence
  chemically synthesized
atttcttcacgtgcaattttct

SEQ ID NO: 126493 - DNA, 22 bp, Artificial Sequence
  chemically synthesized
cttcacgtgcaattttctagaa

SEQ ID NO: 126494 - DNA, 22 bp, Artificial Sequence
  chemically synthesized
ttcacgtgcaattttctagaaa

SEQ ID NO: 126495 - DNA, 22 bp, Artificial Sequence
  chemically synthesized
cacgtgcaattttctagaaaca

SEQ ID NO: 126496 - DNA, 22 bp, Artificial Sequence
  chemically synthesized
acgtgcaattttctagaaacag

SEQ ID NO: 126497 - DNA, 22 bp, Artificial Sequence
  chemically synthesized
tctagaaacagcagccagctcc

SEQ ID NO: 126498 - DNA, 22 bp, Artificial Sequence
  chemically synthesized
ctagaaacagcagccagctcca

SEQ ID NO: 126499 - DNA, 22 bp, Artificial Sequence
  chemically synthesized
tagaaacagcagccagctccat

SEQ ID NO: 126500 - DNA, 22 bp, Artificial Sequence
  chemically synthesized
gaaacagcagccagctccatat

SEQ ID NO: 126501 - DNA, 22 bp, Artificial Sequence
  chemically synthesized
catatatgcaagagaactggat

SEQ ID NO: 126502 - DNA, 22 bp, Artificial Sequence
  chemically synthesized
gatgtatgtctgaagccaaaaa

SEQ ID NO: 126503 - DNA, 22 bp, Artificial Sequence
  chemically synthesized
aagccaaaaatgccttattcct

SEQ ID NO: 126504 - DNA, 22 bp, Artificial Sequence
  chemically synthesized
attcctatgtataacaggacta

SEQ ID NO: 126505 - DNA, 22 bp, Artificial Sequence
  chemically synthesized
ttcctatgtataacaggactaa

SEQ ID NO: 126506 - DNA, 22 bp, Artificial Sequence
  chemically synthesized
ctatgtataacaggactaatat

SEQ ID NO: 126507 - DNA, 22 bp, Artificial Sequence
  chemically synthesized
tgtataacaggactaatatatg

SEQ ID NO: 126508 - DNA, 22 bp, Artificial Sequence
  chemically synthesized
atatatgcaagccatatggaga

SEQ ID NO: 126509 - DNA, 22 bp, Artificial Sequence
  chemically synthesized
actgaaatgccggtgacccaaa

SEQ ID NO: 126510 - DNA, 22 bp, Artificial Sequence
  chemically synthesized
aaatgccggtgacccaaatcat

SEQ ID NO: 126511 - DNA, 22 bp, Artificial Sequence
  chemically synthesized
tatatataattggttcatatat

SEQ ID NO: 126512 - DNA, 22 bp, Artificial Sequence
  chemically synthesized
gttcatatatatatattattta

SEQ ID NO: 126513 - DNA, 22 bp, Artificial Sequence
  chemically synthesized
atatatatatattatttatata

SEQ ID NO: 126514 - DNA, 22 bp, Artificial Sequence
  chemically synthesized
tttatataatatatataaacac

SEQ ID NO: 126515 - DNA, 22 bp, Artificial Sequence
  chemically synthesized
atataatatatataaacacaca

SEQ ID NO: 126516 - DNA, 22 bp, Artificial Sequence
  chemically synthesized
tataatatatataaacacacac

SEQ ID NO: 126517 - DNA, 22 bp, Artificial Sequence
  chemically synthesized
ttatatattaagtatatataat

SEQ ID NO: 126518 - DNA, 22 bp, Artificial Sequence
  chemically synthesized
tatattaagtatatataatagt

SEQ ID NO: 126519 - DNA, 22 bp, Artificial Sequence
  chemically synthesized
agtatatataatagtgtgtatt

SEQ ID NO: 126520 - DNA, 22 bp, Artificial Sequence
  chemically synthesized
tatatattaaatatatataata

SEQ ID NO: 126521 - DNA, 22 bp, Artificial Sequence
  chemically synthesized
aatatatataatagtgtatggg

SEQ ID NO: 126522 - DNA, 22 bp, Artificial Sequence
  chemically synthesized
tgtgtgtatatgtatgtgtgta

SEQ ID NO: 126523 - DNA, 22 bp, Artificial Sequence
  chemically synthesized
atcaaacaatgtgagttaaatt

SEQ ID NO: 126524 - DNA, 22 bp, Artificial Sequence
  chemically synthesized
aattacctgagaaaacaatatc

SEQ ID NO: 126525 - DNA, 22 bp, Artificial Sequence
  chemically synthesized
cctgagaaaacaatatcagttg

SEQ ID NO: 126526 - DNA, 22 bp, Artificial Sequence
  chemically synthesized
agaaaacaatatcagttgagca

SEQ ID NO: 126527 - DNA, 22 bp, Artificial Sequence
  chemically synthesized
agcactgagatatgtacttagt

SEQ ID NO: 126528 - DNA, 22 bp, Artificial Sequence
  chemically synthesized
agatatgtacttagtgttgtac

SEQ ID NO: 126529 - DNA, 22 bp, Artificial Sequence
  chemically synthesized
agtgttgtacatatatcttata

SEQ ID NO: 126530 - DNA, 22 bp, Artificial Sequence
  chemically synthesized
gtgttgtacatatatcttatac

SEQ ID NO: 126531 - DNA, 22 bp, Artificial Sequence
  chemically synthesized
tacatatatcttatacaaatca

SEQ ID NO: 126532 - DNA, 22 bp, Artificial Sequence
  chemically synthesized
atacaaatcagcaatagacagg

SEQ ID NO: 126533 - DNA, 22 bp, Artificial Sequence
  chemically synthesized
tacaaatcagcaatagacaggc

SEQ ID NO: 126534 - DNA, 22 bp, Artificial Sequence
  chemically synthesized
taagtagcagagggattgactg

SEQ ID NO: 126535 - DNA, 22 bp, Artificial Sequence
  chemically synthesized
agtagcagagggattgactgat

SEQ ID NO: 126536 - DNA, 22 bp, Artificial Sequence
  chemically synthesized
actgatttccactgaaatgctc

SEQ ID NO: 126537 - DNA, 22 bp, Artificial Sequence
  chemically synthesized
atttccactgaaatgctcaggg

SEQ ID NO: 126538 - DNA, 22 bp, Artificial Sequence
  chemically synthesized
ccactgaaatgctcagggattg

SEQ ID NO: 126539 - DNA, 22 bp, Artificial Sequence
  chemically synthesized
cactgaaatgctcagggattga

SEQ ID NO: 126540 - DNA, 22 bp, Artificial Sequence
  chemically synthesized
aaatgctcagggattgattagt

SEQ ID NO: 126541 - DNA, 22 bp, Artificial Sequence
  chemically synthesized
agggattgattagttctcattg

SEQ ID NO: 126542 - DNA, 22 bp, Artificial Sequence
  chemically synthesized
attagttctcattgaaatgact

SEQ ID NO: 126543 - DNA, 22 bp, Artificial Sequence
  chemically synthesized
gttctcattgaaatgactttcc

SEQ ID NO: 126544 - DNA, 22 bp, Artificial Sequence
  chemically synthesized
tcattgaaatgactttccctag

SEQ ID NO: 126545 - DNA, 22 bp, Artificial Sequence
  chemically synthesized
attgaaatgactttccctagtt

SEQ ID NO: 126546 - DNA, 22 bp, Artificial Sequence
  chemically synthesized
aaatgactttccctagttactt

SEQ ID NO: 126547 - DNA, 22 bp, Artificial Sequence
  chemically synthesized
tccctagttacttatgctggca

SEQ ID NO: 126548 - DNA, 22 bp, Artificial Sequence
  chemically synthesized
ccctagttacttatgctggcaa

SEQ ID NO: 126549 - DNA, 22 bp, Artificial Sequence
  chemically synthesized
cctagttacttatgctggcaac

SEQ ID NO: 126550 - DNA, 22 bp, Artificial Sequence
  chemically synthesized
gttacttatgctggcaacattg

SEQ ID NO: 126551 - DNA, 22 bp, Artificial Sequence
  chemically synthesized
cttatgctggcaacattgtcat

SEQ ID NO: 126552 - DNA, 22 bp, Artificial Sequence
  chemically synthesized
atgctggcaacattgtcatcct

SEQ ID NO: 126553 - DNA, 22 bp, Artificial Sequence
  chemically synthesized
tgctggcaacattgtcatcctg

SEQ ID NO: 126554 - DNA, 22 bp, Artificial Sequence
  chemically synthesized
gcaacattgtcatcctgtccag

SEQ ID NO: 126555 - DNA, 22 bp, Artificial Sequence
  chemically synthesized
tcatcctgtccaggtcccctga

SEQ ID NO: 126556 - DNA, 22 bp, Artificial Sequence
  chemically synthesized
tccaggtcccctgaattattcc

SEQ ID NO: 126557 - DNA, 22 bp, Artificial Sequence
  chemically synthesized
aattattcctcagagaccagtg

SEQ ID NO: 126558 - DNA, 22 bp, Artificial Sequence
  chemically synthesized
ttcctcagagaccagtgaaaca

SEQ ID NO: 126559 - DNA, 22 bp, Artificial Sequence
  chemically synthesized
ctcagagaccagtgaaacaatg

SEQ ID NO: 126560 - DNA, 22 bp, Artificial Sequence
  chemically synthesized
agagaccagtgaaacaatgtca

SEQ ID NO: 126561 - DNA, 22 bp, Artificial Sequence
  chemically synthesized
tagagtgaggcagagagaataa

SEQ ID NO: 126562 - DNA, 22 bp, Artificial Sequence
  chemically synthesized
gagtgaggcagagagaataaac

SEQ ID NO: 126563 - DNA, 22 bp, Artificial Sequence
  chemically synthesized
tgaatctgcttagttttaatgc

SEQ ID NO: 126564 - DNA, 22 bp, Artificial Sequence
  chemically synthesized
aatctgcttagttttaatgcta

SEQ ID NO: 126565 - DNA, 22 bp, Artificial Sequence
  chemically synthesized
cttagttttaatgctatagata

SEQ ID NO: 126566 - DNA, 22 bp, Artificial Sequence
  chemically synthesized
agttttaatgctatagataaat

SEQ ID NO: 126567 - DNA, 22 bp, Artificial Sequence
  chemically synthesized
gttttaatgctatagataaatg

SEQ ID NO: 126568 - DNA, 22 bp, Artificial Sequence
  chemically synthesized
taatgctatagataaatgggtt

SEQ ID NO: 126569 - DNA, 22 bp, Artificial Sequence
  chemically synthesized
aatgctatagataaatgggttc

SEQ ID NO: 126570 - DNA, 22 bp, Artificial Sequence
  chemically synthesized
atgctatagataaatgggttca

SEQ ID NO: 126571 - DNA, 22 bp, Artificial Sequence
  chemically synthesized
tagataaatgggttcataaaag

SEQ ID NO: 126572 - DNA, 22 bp, Artificial Sequence
  chemically synthesized
ataaaaggtgggaaaaggaagt

SEQ ID NO: 126573 - DNA, 22 bp, Artificial Sequence
  chemically synthesized
attgtgatgtgaacgacatgag

SEQ ID NO: 126574 - DNA, 22 bp, Artificial Sequence
  chemically synthesized
tgatgtgaacgacatgaggaac

SEQ ID NO: 126575 - DNA, 22 bp, Artificial Sequence
  chemically synthesized
tccaaacctatgaataaatgtc

SEQ ID NO: 126576 - DNA, 22 bp, Artificial Sequence
  chemically synthesized
ccaaacctatgaataaatgtca

SEQ ID NO: 126577 - DNA, 22 bp, Artificial Sequence
  chemically synthesized
caaacctatgaataaatgtcag

SEQ ID NO: 126578 - DNA, 22 bp, Artificial Sequence
  chemically synthesized
tgaataaatgtcagacaaacta

SEQ ID NO: 126579 - DNA, 22 bp, Artificial Sequence
  chemically synthesized
cagtgacatagaagaccaggat

SEQ ID NO: 126580 - DNA, 22 bp, Artificial Sequence
  chemically synthesized
agggccttggccctttctcctc

SEQ ID NO: 126581 - DNA, 22 bp, Artificial Sequence
  chemically synthesized
ggccctttctcctccagaacca

SEQ ID NO: 126582 - DNA, 22 bp, Artificial Sequence
  chemically synthesized
gccctttctcctccagaaccaa

SEQ ID NO: 126583 - DNA, 22 bp, Artificial Sequence
  chemically synthesized
tctcctccagaaccaatgccca

SEQ ID NO: 126584 - DNA, 22 bp, Artificial Sequence
  chemically synthesized
ctcctccagaaccaatgcccat

SEQ ID NO: 126585 - DNA, 22 bp, Artificial Sequence
  chemically synthesized
tcctccagaaccaatgcccatg

SEQ ID NO: 126586 - DNA, 22 bp, Artificial Sequence
  chemically synthesized
ctccagaaccaatgcccatgac

SEQ ID NO: 126587 - DNA, 22 bp, Artificial Sequence
  chemically synthesized
cagaaccaatgcccatgacagt

SEQ ID NO: 126588 - DNA, 22 bp, Artificial Sequence
  chemically synthesized
gagaatcaaaatgtaggagaaa

SEQ ID NO: 126589 - DNA, 22 bp, Artificial Sequence
  chemically synthesized
agaatcaaaatgtaggagaaaa

SEQ ID NO: 126590 - DNA, 22 bp, Artificial Sequence
  chemically synthesized
caaataaaactacaactggata

SEQ ID NO: 126591 - DNA, 22 bp, Artificial Sequence
  chemically synthesized
caactggatagagacggttgaa

SEQ ID NO: 126592 - DNA, 22 bp, Artificial Sequence
  chemically synthesized
gatagagacggttgaaggtgat

SEQ ID NO: 126593 - DNA, 22 bp, Artificial Sequence
  chemically synthesized
aaggtgatgtcagcacaggcta

SEQ ID NO: 126594 - DNA, 22 bp, Artificial Sequence
  chemically synthesized
gcttgatgacatcttggtgtag

SEQ ID NO: 126595 - DNA, 22 bp, Artificial Sequence
  chemically synthesized
gatgacatcttggtgtagacag

SEQ ID NO: 126596 - DNA, 22 bp, Artificial Sequence
  chemically synthesized
atgacatcttggtgtagacaga

SEQ ID NO: 126597 - DNA, 22 bp, Artificial Sequence
  chemically synthesized
ggtgtagacagaaagcatggga

SEQ ID NO: 126598 - DNA, 22 bp, Artificial Sequence
  chemically synthesized
gtgtagacagaaagcatgggag

SEQ ID NO: 126599 - DNA, 22 bp, Artificial Sequence
  chemically synthesized
ttggcataatggacagaccagc

SEQ ID NO: 126600 - DNA, 22 bp, Artificial Sequence
  chemically synthesized
gcataatggacagaccagccct

SEQ ID NO: 126601 - DNA, 22 bp, Artificial Sequence
  chemically synthesized
gtcaatacccgcacaccaatct

SEQ ID NO: 126602 - DNA, 22 bp, Artificial Sequence
  chemically synthesized
tcaatacccgcacaccaatctt

SEQ ID NO: 126603 - DNA, 22 bp, Artificial Sequence
  chemically synthesized
cattacctgggtgttggtcagg

SEQ ID NO: 126604 - DNA, 22 bp, Artificial Sequence
  chemically synthesized
attacctgggtgttggtcagga

SEQ ID NO: 126605 - DNA, 22 bp, Artificial Sequence
  chemically synthesized
cctgggtgttggtcaggataga

SEQ ID NO: 126606 - DNA, 22 bp, Artificial Sequence
  chemically synthesized
ggtgttggtcaggatagaggta

SEQ ID NO: 126607 - DNA, 22 bp, Artificial Sequence
  chemically synthesized
gtcaggatagaggtatatctta

SEQ ID NO: 126608 - DNA, 22 bp, Artificial Sequence
  chemically synthesized
aaggggctgcggatggtaatga

SEQ ID NO: 126609 - DNA, 22 bp, Artificial Sequence
  chemically synthesized
aggggctgcggatggtaatgaa

SEQ ID NO: 126610 - DNA, 22 bp, Artificial Sequence
  chemically synthesized
cggatggtaatgaaacagtcat

SEQ ID NO: 126611 - DNA, 22 bp, Artificial Sequence
  chemically synthesized
actccatgacagaaagagtatg

SEQ ID NO: 126612 - DNA, 22 bp, Artificial Sequence
  chemically synthesized
catgacagaaagagtatggata

SEQ ID NO: 126613 - DNA, 22 bp, Artificial Sequence
  chemically synthesized
agagaagcaggctccatggcca

SEQ ID NO: 126614 - DNA, 22 bp, Artificial Sequence
  chemically synthesized
catggccaatctccctgtgatc

SEQ ID NO: 126615 - DNA, 22 bp, Artificial Sequence
  chemically synthesized
cctgtgatctaaccacagaaca

SEQ ID NO: 126616 - DNA, 22 bp, Artificial Sequence
  chemically synthesized
tgatctaaccacagaacaccta

SEQ ID NO: 126617 - DNA, 22 bp, Artificial Sequence
  chemically synthesized
accacagaacacctagcactgt

SEQ ID NO: 126618 - DNA, 22 bp, Artificial Sequence
  chemically synthesized
gcactgtgggcattgtggtcaa

SEQ ID NO: 126619 - DNA, 22 bp, Artificial Sequence
  chemically synthesized
tgggcattgtggtcaatgtcac

SEQ ID NO: 126620 - DNA, 22 bp, Artificial Sequence
  chemically synthesized
tggtcaatgtcactccgaggtc

SEQ ID NO: 126621 - DNA, 22 bp, Artificial Sequence
  chemically synthesized
cgaggtctgtagctgccaacat

SEQ ID NO: 126622 - DNA, 22 bp, Artificial Sequence
  chemically synthesized
tagctgccaacatagctaagaa

SEQ ID NO: 126623 - DNA, 22 bp, Artificial Sequence
  chemically synthesized
ccaacatagctaagaaatagta

SEQ ID NO: 126624 - DNA, 22 bp, Artificial Sequence
  chemically synthesized
agaaatagtacatgggctcatg

SEQ ID NO: 126625 - DNA, 22 bp, Artificial Sequence
  chemically synthesized
atggaggttatgatcattcctg

SEQ ID NO: 126626 - DNA, 22 bp, Artificial Sequence
  chemically synthesized
tgatcattcctgatgagaaaga

SEQ ID NO: 126627 - DNA, 22 bp, Artificial Sequence
  chemically synthesized
ctgatgagaaagagaagagtgc

SEQ ID NO: 126628 - DNA, 22 bp, Artificial Sequence
  chemically synthesized
atgagaaagagaagagtgccat

SEQ ID NO: 126629 - DNA, 22 bp, Artificial Sequence
  chemically synthesized
ccaagaagtatggagatgtagg

SEQ ID NO: 126630 - DNA, 22 bp, Artificial Sequence
  chemically synthesized
ccaataatgggatgaatatcca

SEQ ID NO: 126631 - DNA, 22 bp, Artificial Sequence
  chemically synthesized
ctccatgcctgggaagccagta

SEQ ID NO: 126632 - DNA, 22 bp, Artificial Sequence
  chemically synthesized
tccatgcctgggaagccagtaa

SEQ ID NO: 126633 - DNA, 22 bp, Artificial Sequence
  chemically synthesized
catgcctgggaagccagtaagc

SEQ ID NO: 126634 - DNA, 22 bp, Artificial Sequence
  chemically synthesized
ggaagccagtaagctggaaggt

SEQ ID NO: 126635 - DNA, 22 bp, Artificial Sequence
  chemically synthesized
gaaggtggaagcagacttattg

SEQ ID NO: 126636 - DNA, 22 bp, Artificial Sequence
  chemically synthesized
attgagccccattgccagcttt

SEQ ID NO: 126637 - DNA, 22 bp, Artificial Sequence
  chemically synthesized
ttgagccccattgccagctttg

SEQ ID NO: 126638 - DNA, 22 bp, Artificial Sequence
  chemically synthesized
agccccattgccagctttgcaa

SEQ ID NO: 126639 - DNA, 22 bp, Artificial Sequence
  chemically synthesized
ccagctttgcaaagaggcaaat

SEQ ID NO: 126640 - DNA, 22 bp, Artificial Sequence
  chemically synthesized
tgcaaagaggcaaatatttact

SEQ ID NO: 126641 - DNA, 22 bp, Artificial Sequence
  chemically synthesized
gcaaagaggcaaatatttactc

SEQ ID NO: 126642 - DNA, 22 bp, Artificial Sequence
  chemically synthesized
caaagaggcaaatatttactcc

SEQ ID NO: 126643 - DNA, 22 bp, Artificial Sequence
  chemically synthesized
actccaggtaaagcaatagtaa

SEQ ID NO: 126644 - DNA, 22 bp, Artificial Sequence
  chemically synthesized
ctccaggtaaagcaatagtaat

SEQ ID NO: 126645 - DNA, 22 bp, Artificial Sequence
  chemically synthesized
caggtaaagcaatagtaatcag

SEQ ID NO: 126646 - DNA, 22 bp, Artificial Sequence
  chemically synthesized
tataaaagttgctccttgagaa

SEQ ID NO: 126647 - DNA, 22 bp, Artificial Sequence
  chemically synthesized
ctccttgagaattctacctgtt

SEQ ID NO: 126648 - DNA, 22 bp, Artificial Sequence
  chemically synthesized
cttgagaattctacctgttcat

SEQ ID NO: 126649 - DNA, 22 bp, Artificial Sequence
  chemically synthesized
gagaattctacctgttcataag

SEQ ID NO: 126650 - DNA, 22 bp, Artificial Sequence
  chemically synthesized
agaattctacctgttcataaga

SEQ ID NO: 126651 - DNA, 22 bp, Artificial Sequence
  chemically synthesized
tacctgttcataagatgttcac

SEQ ID NO: 126652 - DNA, 22 bp, Artificial Sequence
  chemically synthesized
cctgttcataagatgttcacca

SEQ ID NO: 126653 - DNA, 22 bp, Artificial Sequence
  chemically synthesized
ttcataagatgttcaccagtcc

SEQ ID NO: 126654 - DNA, 22 bp, Artificial Sequence
  chemically synthesized
ataagatgttcaccagtcctga

SEQ ID NO: 126655 - DNA, 22 bp, Artificial Sequence
  chemically synthesized
accagtcctgactttcagtgac

SEQ ID NO: 126656 - DNA, 22 bp, Artificial Sequence
  chemically synthesized
actttcagtgacagcaaggatg

SEQ ID NO: 126657 - DNA, 22 bp, Artificial Sequence
  chemically synthesized
tcagtgacagcaaggatgataa

SEQ ID NO: 126658 - DNA, 22 bp, Artificial Sequence
  chemically synthesized
cagtgacagcaaggatgataat

SEQ ID NO: 126659 - DNA, 22 bp, Artificial Sequence
  chemically synthesized
agtgacagcaaggatgataatt

SEQ ID NO: 126660 - DNA, 22 bp, Artificial Sequence
  chemically synthesized
agtcattcctgggagatcctag

SEQ ID NO: 126661 - DNA, 22 bp, Artificial Sequence
  chemically synthesized
gtcattcctgggagatcctagg

SEQ ID NO: 126662 - DNA, 22 bp, Artificial Sequence
  chemically synthesized
ctgggagatcctaggtatggga

SEQ ID NO: 126663 - DNA, 22 bp, Artificial Sequence
  chemically synthesized
ggagatcctaggtatgggaaaa

SEQ ID NO: 126664 - DNA, 22 bp, Artificial Sequence
  chemically synthesized
ggtatgggaaaatagaatgtat

SEQ ID NO: 126665 - DNA, 22 bp, Artificial Sequence
  chemically synthesized
tttagggtttactctatgtaag

SEQ ID NO: 126666 - DNA, 22 bp, Artificial Sequence
  chemically synthesized
agggtttactctatgtaagatt

SEQ ID NO: 126667 - DNA, 22 bp, Artificial Sequence
  chemically synthesized
gggtttactctatgtaagatta

SEQ ID NO: 126668 - DNA, 22 bp, Artificial Sequence
  chemically synthesized
actctatgtaagattattggat

SEQ ID NO: 126669 - DNA, 22 bp, Artificial Sequence
  chemically synthesized
ctctatgtaagattattggata

SEQ ID NO: 126670 - DNA, 22 bp, Artificial Sequence
  chemically synthesized
tatgtaagattattggatacta

SEQ ID NO: 126671 - DNA, 22 bp, Artificial Sequence
  chemically synthesized
tgtaagattattggatactacg

SEQ ID NO: 126672 - DNA, 22 bp, Artificial Sequence
  chemically synthesized
ttggatactacgttggggatac

SEQ ID NO: 126673 - DNA, 22 bp, Artificial Sequence
  chemically synthesized
gatactacgttggggatacagc

SEQ ID NO: 126674 - DNA, 22 bp, Artificial Sequence
  chemically synthesized
cgttggggatacagctattcat

SEQ ID NO: 126675 - DNA, 22 bp, Artificial Sequence
  chemically synthesized
gggatacagctattcatgcaga

SEQ ID NO: 126676 - DNA, 22 bp, Artificial Sequence
  chemically synthesized
ttcatgcagaataaacattgtt

SEQ ID NO: 126677 - DNA, 22 bp, Artificial Sequence
  chemically synthesized
atgcagaataaacattgttgaa

SEQ ID NO: 126678 - DNA, 22 bp, Artificial Sequence
  chemically synthesized
ttgaattcattgtaaatcatat

SEQ ID NO: 126679 - DNA, 22 bp, Artificial Sequence
  chemically synthesized
aattcattgtaaatcatataac

SEQ ID NO: 126680 - DNA, 22 bp, Artificial Sequence
  chemically synthesized
attgtaaatcatataacccaga

SEQ ID NO: 126681 - DNA, 22 bp, Artificial Sequence
  chemically synthesized
taaatcatataacccagaaaat

SEQ ID NO: 126682 - DNA, 22 bp, Artificial Sequence
  chemically synthesized
tatttgaatagtgctgtaatgg

SEQ ID NO: 126683 - DNA, 22 bp, Artificial Sequence
  chemically synthesized
gaatagtgctgtaatggcctga

SEQ ID NO: 126684 - DNA, 22 bp, Artificial Sequence
  chemically synthesized
aatagtgctgtaatggcctgaa

SEQ ID NO: 126685 - DNA, 22 bp, Artificial Sequence
  chemically synthesized
taatggcctgaaacttataggt

SEQ ID NO: 126686 - DNA, 22 bp, Artificial Sequence
  chemically synthesized
aaacttataggtcacttttcat

SEQ ID NO: 126687 - DNA, 22 bp, Artificial Sequence
  chemically synthesized
ataggtcacttttcatggtgct

SEQ ID NO: 126688 - DNA, 22 bp, Artificial Sequence
  chemically synthesized
taggtcacttttcatggtgctc

SEQ ID NO: 126689 - DNA, 22 bp, Artificial Sequence
  chemically synthesized
ttcatggtgctcttcatcctga

SEQ ID NO: 126690 - DNA, 22 bp, Artificial Sequence
  chemically synthesized
tcatggtgctcttcatcctgac

SEQ ID NO: 126691 - DNA, 22 bp, Artificial Sequence
  chemically synthesized
catggtgctcttcatcctgact

SEQ ID NO: 126692 - DNA, 22 bp, Artificial Sequence
  chemically synthesized
atggtgctcttcatcctgactg

SEQ ID NO: 126693 - DNA, 22 bp, Artificial Sequence
  chemically synthesized
ttcatcctgactggtggtatta

SEQ ID NO: 126694 - DNA, 22 bp, Artificial Sequence
  chemically synthesized
catcctgactggtggtattata

SEQ ID NO: 126695 - DNA, 22 bp, Artificial Sequence
  chemically synthesized
atcctgactggtggtattatag

SEQ ID NO: 126696 - DNA, 22 bp, Artificial Sequence
  chemically synthesized
actggtggtattatagggtgga

SEQ ID NO: 126697 - DNA, 22 bp, Artificial Sequence
  chemically synthesized
gtggtattatagggtggatgta

SEQ ID NO: 126698 - DNA, 22 bp, Artificial Sequence
  chemically synthesized
tagggtggatgtaaaggtttcc

SEQ ID NO: 126699 - DNA, 22 bp, Artificial Sequence
  chemically synthesized
cccaggctatgtgagacctaaa

SEQ ID NO: 126700 - DNA, 22 bp, Artificial Sequence
  chemically synthesized
ccaggctatgtgagacctaaaa

SEQ ID NO: 126701 - DNA, 22 bp, Artificial Sequence
  chemically synthesized
tgtgagacctaaaagatcagta

SEQ ID NO: 126702 - DNA, 22 bp, Artificial Sequence
  chemically synthesized
aaagatcagtagaaaaatggtt

SEQ ID NO: 126703 - DNA, 22 bp, Artificial Sequence
  chemically synthesized
taagcactattggaaaagcaga

SEQ ID NO: 126704 - DNA, 22 bp, Artificial Sequence
  chemically synthesized
agcactattggaaaagcagata

SEQ ID NO: 126705 - DNA, 22 bp, Artificial Sequence
  chemically synthesized
ttggaaaagcagatataaagat

SEQ ID NO: 126706 - DNA, 22 bp, Artificial Sequence
  chemically synthesized
gaaaagcagatataaagattat

SEQ ID NO: 126707 - DNA, 22 bp, Artificial Sequence
  chemically synthesized
tatggaaaaacaaatacacaag

SEQ ID NO: 126708 - DNA, 22 bp, Artificial Sequence
  chemically synthesized
cagagattgacttttcttcaat

SEQ ID NO: 126709 - DNA, 22 bp, Artificial Sequence
  chemically synthesized
agagattgacttttcttcaata

SEQ ID NO: 126710 - DNA, 22 bp, Artificial Sequence
  chemically synthesized
acttttcttcaatattcctgga

SEQ ID NO: 126711 - DNA, 22 bp, Artificial Sequence
  chemically synthesized
ttcttcaatattcctggaggga

SEQ ID NO: 126712 - DNA, 22 bp, Artificial Sequence
  chemically synthesized
tcttcaatattcctggagggaa

SEQ ID NO: 126713 - DNA, 22 bp, Artificial Sequence
  chemically synthesized
cttcaatattcctggagggaaa

SEQ ID NO: 126714 - DNA, 22 bp, Artificial Sequence
  chemically synthesized
ttcaatattcctggagggaaaa

SEQ ID NO: 126715 - DNA, 22 bp, Artificial Sequence
  chemically synthesized
caatattcctggagggaaaatt

SEQ ID NO: 126716 - DNA, 22 bp, Artificial Sequence
  chemically synthesized
aatattcctggagggaaaattc

SEQ ID NO: 126717 - DNA, 22 bp, Artificial Sequence
  chemically synthesized
ctggagggaaaattcaattgat

SEQ ID NO: 126718 - DNA, 22 bp, Artificial Sequence
  chemically synthesized
gagggaaaattcaattgatgaa

SEQ ID NO: 126719 - DNA, 22 bp, Artificial Sequence
  chemically synthesized
aattgatgaagctccagagact

SEQ ID NO: 126720 - DNA, 22 bp, Artificial Sequence
  chemically synthesized
atgaagctccagagacttttgg

SEQ ID NO: 126721 - DNA, 22 bp, Artificial Sequence
  chemically synthesized
cagagacttttgggtagttaga

SEQ ID NO: 126722 - DNA, 22 bp, Artificial Sequence
  chemically synthesized
ttgggtagttagaaaatgacgt

SEQ ID NO: 126723 - DNA, 22 bp, Artificial Sequence
  chemically synthesized
tgggtagttagaaaatgacgta

SEQ ID NO: 126724 - DNA, 22 bp, Artificial Sequence
  chemically synthesized
gggtagttagaaaatgacgtaa

SEQ ID NO: 126725 - DNA, 22 bp, Artificial Sequence
  chemically synthesized
ggtagttagaaaatgacgtaag

SEQ ID NO: 126726 - DNA, 22 bp, Artificial Sequence
  chemically synthesized
gaaaatgacgtaagagtgactt

SEQ ID NO: 126727 - DNA, 22 bp, Artificial Sequence
  chemically synthesized
acctgtgtgtgtttccaaagca

SEQ ID NO: 126728 - DNA, 22 bp, Artificial Sequence
  chemically synthesized
cctgtgtgtgtttccaaagcac

SEQ ID NO: 126729 - DNA, 22 bp, Artificial Sequence
  chemically synthesized
tgtgtgtttccaaagcacatag

SEQ ID NO: 126730 - DNA, 22 bp, Artificial Sequence
  chemically synthesized
ccaaagcacatagaactctaag

SEQ ID NO: 126731 - DNA, 22 bp, Artificial Sequence
  chemically synthesized
caaagcacatagaactctaagt

SEQ ID NO: 126732 - DNA, 22 bp, Artificial Sequence
  chemically synthesized
taagttgcccagctttataacc

SEQ ID NO: 126733 - DNA, 22 bp, Artificial Sequence
  chemically synthesized
agttgcccagctttataaccct

SEQ ID NO: 126734 - DNA, 22 bp, Artificial Sequence
  chemically synthesized
cccagctttataaccctagtta

SEQ ID NO: 126735 - DNA, 22 bp, Artificial Sequence
  chemically synthesized
tataaccctagttattgataca

SEQ ID NO: 126736 - DNA, 22 bp, Artificial Sequence
  chemically synthesized
ataaccctagttattgatacac

SEQ ID NO: 126737 - DNA, 22 bp, Artificial Sequence
  chemically synthesized
taaccctagttattgatacact

SEQ ID NO: 126738 - DNA, 22 bp, Artificial Sequence
  chemically synthesized
gttattgatacactgcttcaaa

SEQ ID NO: 126739 - DNA, 22 bp, Artificial Sequence
  chemically synthesized
ttgatacactgcttcaaagaat

SEQ ID NO: 126740 - DNA, 22 bp, Artificial Sequence
  chemically synthesized
atacactgcttcaaagaattca

SEQ ID NO: 126741 - DNA, 22 bp, Artificial Sequence
  chemically synthesized
cttcaaagaattcaaattttca

SEQ ID NO: 126742 - DNA, 22 bp, Artificial Sequence
  chemically synthesized
caaagaattcaaattttcataa

SEQ ID NO: 126743 - DNA, 22 bp, Artificial Sequence
  chemically synthesized
aaagaattcaaattttcataat

SEQ ID NO: 126744 - DNA, 22 bp, Artificial Sequence
  chemically synthesized
aaattttcataatataaattga

SEQ ID NO: 126745 - DNA, 22 bp, Artificial Sequence
  chemically synthesized
tcataatataaattgaagaata

SEQ ID NO: 126746 - DNA, 22 bp, Artificial Sequence
  chemically synthesized
cataatataaattgaagaataa

SEQ ID NO: 126747 - DNA, 22 bp, Artificial Sequence
  chemically synthesized
ataatataaattgaagaataaa

SEQ ID NO: 126748 - DNA, 22 bp, Artificial Sequence
  chemically synthesized
aagaataaacagtaaaatgtgg

SEQ ID NO: 126749 - DNA, 22 bp, Artificial Sequence
  chemically synthesized
gatgataagcttttgaaggcac

SEQ ID NO: 126750 - DNA, 22 bp, Artificial Sequence
  chemically synthesized
atgataagcttttgaaggcact

SEQ ID NO: 126751 - DNA, 22 bp, Artificial Sequence
  chemically synthesized
ttgaaggcactaattgataata

SEQ ID NO: 126752 - DNA, 22 bp, Artificial Sequence
  chemically synthesized
tgaaggcactaattgataatag

SEQ ID NO: 126753 - DNA, 22 bp, Artificial Sequence
  chemically synthesized
gaaggcactaattgataatagc

SEQ ID NO: 126754 - DNA, 22 bp, Artificial Sequence
  chemically synthesized
aaggcactaattgataatagca

SEQ ID NO: 126755 - DNA, 22 bp, Artificial Sequence
  chemically synthesized
attgataatagcaccaaactac

SEQ ID NO: 126756 - DNA, 22 bp, Artificial Sequence
  chemically synthesized
ataatagcaccaaactactgtt

SEQ ID NO: 126757 - DNA, 22 bp, Artificial Sequence
  chemically synthesized
ctgttgcatatcacctacttgg

SEQ ID NO: 126758 - DNA, 22 bp, Artificial Sequence
  chemically synthesized
ttgcatatcacctacttggtga

SEQ ID NO: 126759 - DNA, 22 bp, Artificial Sequence
  chemically synthesized
catatcacctacttggtgatgc

SEQ ID NO: 126760 - DNA, 22 bp, Artificial Sequence
  chemically synthesized
cttggtgatgcaaaaataaaaa

SEQ ID NO: 126761 - DNA, 22 bp, Artificial Sequence
  chemically synthesized
ggtgatgcaaaaataaaaattg

SEQ ID NO: 126762 - DNA, 22 bp, Artificial Sequence
  chemically synthesized
gtgatgcaaaaataaaaattgg

SEQ ID NO: 126763 - DNA, 22 bp, Artificial Sequence
  chemically synthesized
gtaatttaggcaagatcaagga

SEQ ID NO: 126764 - DNA, 22 bp, Artificial Sequence
  chemically synthesized
aggcaagatcaaggagaatttt

SEQ ID NO: 126765 - DNA, 22 bp, Artificial Sequence
  chemically synthesized
ggcaagatcaaggagaattttt

SEQ ID NO: 126766 - DNA, 22 bp, Artificial Sequence
  chemically synthesized
tttttttaaaactatggaatct

SEQ ID NO: 126767 - DNA, 22 bp, Artificial Sequence
  chemically synthesized
ttttttaaaactatggaatctg

SEQ ID NO: 126768 - DNA, 22 bp, Artificial Sequence
  chemically synthesized
tttttaaaactatggaatctga

SEQ ID NO: 126769 - DNA, 22 bp, Artificial Sequence
  chemically synthesized
ttttaaaactatggaatctgat

SEQ ID NO: 126770 - DNA, 22 bp, Artificial Sequence
  chemically synthesized
tttaaaactatggaatctgatg

SEQ ID NO: 126771 - DNA, 22 bp, Artificial Sequence
  chemically synthesized
ttaaaactatggaatctgatgg

SEQ ID NO: 126772 - DNA, 22 bp, Artificial Sequence
  chemically synthesized
taaaactatggaatctgatggg

SEQ ID NO: 126773 - DNA, 22 bp, Artificial Sequence
  chemically synthesized
aaaactatggaatctgatggga

SEQ ID NO: 126774 - DNA, 22 bp, Artificial Sequence
  chemically synthesized
aaactatggaatctgatgggat

SEQ ID NO: 126775 - DNA, 22 bp, Artificial Sequence
  chemically synthesized
tggaatctgatgggatttgaca

SEQ ID NO: 126776 - DNA, 22 bp, Artificial Sequence
  chemically synthesized
atgggatttgacaaaagtgaga

SEQ ID NO: 126777 - DNA, 22 bp, Artificial Sequence
  chemically synthesized
gacaaaagtgagaaggctctgt

SEQ ID NO: 126778 - DNA, 22 bp, Artificial Sequence
  chemically synthesized
acaaaagtgagaaggctctgtg

SEQ ID NO: 126779 - DNA, 22 bp, Artificial Sequence
  chemically synthesized
tgtgactcattagaattctaag

SEQ ID NO: 126780 - DNA, 22 bp, Artificial Sequence
  chemically synthesized
tgactcattagaattctaagat

SEQ ID NO: 126781 - DNA, 22 bp, Artificial Sequence
  chemically synthesized
attagaattctaagatttcagc

SEQ ID NO: 126782 - DNA, 22 bp, Artificial Sequence
  chemically synthesized
gaattctaagatttcagctggt

SEQ ID NO: 126783 - DNA, 22 bp, Artificial Sequence
  chemically synthesized
taagatttcagctggtgcaggc

SEQ ID NO: 126784 - DNA, 22 bp, Artificial Sequence
  chemically synthesized
agatttcagctggtgcaggcag

SEQ ID NO: 126785 - DNA, 22 bp, Artificial Sequence
  chemically synthesized
cagctggtgcaggcagccaacc

SEQ ID NO: 126786 - DNA, 22 bp, Artificial Sequence
  chemically synthesized
agctggtgcaggcagccaacct

SEQ ID NO: 126787 - DNA, 22 bp, Artificial Sequence
  chemically synthesized
gtgcaggcagccaacctctgag

SEQ ID NO: 126788 - DNA, 22 bp, Artificial Sequence
  chemically synthesized
tgagaatacataaattgtgtgt

SEQ ID NO: 126789 - DNA, 22 bp, Artificial Sequence
  chemically synthesized
agaatacataaattgtgtgttg

SEQ ID NO: 126790 - DNA, 22 bp, Artificial Sequence
  chemically synthesized
tgtgttggtggcatgagccaga

SEQ ID NO: 126791 - DNA, 22 bp, Artificial Sequence
  chemically synthesized
gtggcatgagccagagaaaata

SEQ ID NO: 126792 - DNA, 22 bp, Artificial Sequence
  chemically synthesized
ctcttatggttggtttggacta

SEQ ID NO: 126793 - DNA, 22 bp, Artificial Sequence
  chemically synthesized
tcttatggttggtttggactat

SEQ ID NO: 126794 - DNA, 22 bp, Artificial Sequence
  chemically synthesized
ttatggttggtttggactatac

SEQ ID NO: 126795 - DNA, 22 bp, Artificial Sequence
  chemically synthesized
atggttggtttggactatacat

SEQ ID NO: 126796 - DNA, 22 bp, Artificial Sequence
  chemically synthesized
tggttggtttggactatacatc

SEQ ID NO: 126797 - DNA, 22 bp, Artificial Sequence
  chemically synthesized
gtttggactatacatctcatat

SEQ ID NO: 126798 - DNA, 22 bp, Artificial Sequence
  chemically synthesized
ggactatacatctcatatacta

SEQ ID NO: 126799 - DNA, 22 bp, Artificial Sequence
  chemically synthesized
gactatacatctcatatactat

SEQ ID NO: 126800 - DNA, 22 bp, Artificial Sequence
  chemically synthesized
tacatctcatatactattgaaa

SEQ ID NO: 126801 - DNA, 22 bp, Artificial Sequence
  chemically synthesized
atatactattgaaagagcatat

SEQ ID NO: 126802 - DNA, 22 bp, Artificial Sequence
  chemically synthesized
ttgaaagagcatattgatgtaa

SEQ ID NO: 126803 - DNA, 22 bp, Artificial Sequence
  chemically synthesized
aaagagcatattgatgtaaatt

SEQ ID NO: 126804 - DNA, 22 bp, Artificial Sequence
  chemically synthesized
atgtaaatttatgcacgattta

SEQ ID NO: 126805 - DNA, 22 bp, Artificial Sequence
  chemically synthesized
atgcacgatttacaagacctct

SEQ ID NO: 126806 - DNA, 22 bp, Artificial Sequence
  chemically synthesized
tgcacgatttacaagacctctt

SEQ ID NO: 126807 - DNA, 22 bp, Artificial Sequence
  chemically synthesized
acaagacctctttctgtccatg

SEQ ID NO: 126808 - DNA, 22 bp, Artificial Sequence
  chemically synthesized
caagacctctttctgtccatga

SEQ ID NO: 126809 - DNA, 22 bp, Artificial Sequence
  chemically synthesized
tttctgtccatgaaaagaatgc

SEQ ID NO: 126810 - DNA, 22 bp, Artificial Sequence
  chemically synthesized
tctgtccatgaaaagaatgcat

SEQ ID NO: 126811 - DNA, 22 bp, Artificial Sequence
  chemically synthesized
ctgtccatgaaaagaatgcatc

SEQ ID NO: 126812 - DNA, 22 bp, Artificial Sequence
  chemically synthesized
tgtccatgaaaagaatgcatcc

SEQ ID NO: 126813 - DNA, 22 bp, Artificial Sequence
  chemically synthesized
tccatgaaaagaatgcatccaa

SEQ ID NO: 126814 - DNA, 22 bp, Artificial Sequence
  chemically synthesized
ctggactttcattttcagaaga

SEQ ID NO: 126815 - DNA, 22 bp, Artificial Sequence
  chemically synthesized
gactttcattttcagaagaatt

SEQ ID NO: 126816 - DNA, 22 bp, Artificial Sequence
  chemically synthesized
tcattttcagaagaatttgttg

SEQ ID NO: 126817 - DNA, 22 bp, Artificial Sequence
  chemically synthesized
cattttcagaagaatttgttga

SEQ ID NO: 126818 - DNA, 22 bp, Artificial Sequence
  chemically synthesized
attttcagaagaatttgttgaa

SEQ ID NO: 126819 - DNA, 22 bp, Artificial Sequence
  chemically synthesized
tcagaagaatttgttgaagttt

SEQ ID NO: 126820 - DNA, 22 bp, Artificial Sequence
  chemically synthesized
cagaagaatttgttgaagtttc

SEQ ID NO: 126821 - DNA, 22 bp, Artificial Sequence
  chemically synthesized
agaagaatttgttgaagtttca

SEQ ID NO: 126822 - DNA, 22 bp, Artificial Sequence
  chemically synthesized
gttgaagtttcagctctgctct

SEQ ID NO: 126823 - DNA, 22 bp, Artificial Sequence
  chemically synthesized
ttgaagtttcagctctgctctt

SEQ ID NO: 126824 - DNA, 22 bp, Artificial Sequence
  chemically synthesized
aagtttcagctctgctctttct

SEQ ID NO: 126825 - DNA, 22 bp, Artificial Sequence
  chemically synthesized
cagctctgctctttctaacaat

SEQ ID NO: 126826 - DNA, 22 bp, Artificial Sequence
  chemically synthesized
agctctgctctttctaacaata

SEQ ID NO: 126827 - DNA, 22 bp, Artificial Sequence
  chemically synthesized
tgctctttctaacaataatgat

SEQ ID NO: 126828 - DNA, 22 bp, Artificial Sequence
  chemically synthesized
ctctttctaacaataatgatct

SEQ ID NO: 126829 - DNA, 22 bp, Artificial Sequence
  chemically synthesized
tttctaacaataatgatcttgg

SEQ ID NO: 126830 - DNA, 22 bp, Artificial Sequence
  chemically synthesized
tctaacaataatgatcttggga

SEQ ID NO: 126831 - DNA, 22 bp, Artificial Sequence
  chemically synthesized
ctaacaataatgatcttgggaa

SEQ ID NO: 126832 - DNA, 22 bp, Artificial Sequence
  chemically synthesized
taacaataatgatcttgggaaa

SEQ ID NO: 126833 - DNA, 22 bp, Artificial Sequence
  chemically synthesized
acaataatgatcttgggaaagt

SEQ ID NO: 126834 - DNA, 22 bp, Artificial Sequence
  chemically synthesized
gggaaagtaatttaatcttgag

SEQ ID NO: 126835 - DNA, 22 bp, Artificial Sequence
  chemically synthesized
ggaaagtaatttaatcttgaga

SEQ ID NO: 126836 - DNA, 22 bp, Artificial Sequence
  chemically synthesized
aatcttgagatttggttacata

SEQ ID NO: 126837 - DNA, 22 bp, Artificial Sequence
  chemically synthesized
atcttgagatttggttacataa

SEQ ID NO: 126838 - DNA, 22 bp, Artificial Sequence
  chemically synthesized
gagatttggttacataacctgt

SEQ ID NO: 126839 - DNA, 22 bp, Artificial Sequence
  chemically synthesized
agatttggttacataacctgta

SEQ ID NO: 126840 - DNA, 22 bp, Artificial Sequence
  chemically synthesized
ggttacataacctgtaaagact

SEQ ID NO: 126841 - DNA, 22 bp, Artificial Sequence
  chemically synthesized
gttacataacctgtaaagacta

SEQ ID NO: 126842 - DNA, 22 bp, Artificial Sequence
  chemically synthesized
cataacctgtaaagactactag

SEQ ID NO: 126843 - DNA, 22 bp, Artificial Sequence
  chemically synthesized
taaagactactagtgatttctg

SEQ ID NO: 126844 - DNA, 22 bp, Artificial Sequence
  chemically synthesized
ctagtgatttctgtcttctcag

SEQ ID NO: 126845 - DNA, 22 bp, Artificial Sequence
  chemically synthesized
gtgatttctgtcttctcagtca

SEQ ID NO: 126846 - DNA, 22 bp, Artificial Sequence
  chemically synthesized
ctgtcttctcagtcattctctt

SEQ ID NO: 126847 - DNA, 22 bp, Artificial Sequence
  chemically synthesized
tgtcttctcagtcattctcttg

SEQ ID NO: 126848 - DNA, 22 bp, Artificial Sequence
  chemically synthesized
tcttctcagtcattctcttgac

SEQ ID NO: 126849 - DNA, 22 bp, Artificial Sequence
  chemically synthesized
ctcagtcattctcttgacacaa

SEQ ID NO: 126850 - DNA, 22 bp, Artificial Sequence
  chemically synthesized
tcagtcattctcttgacacaaa

SEQ ID NO: 126851 - DNA, 22 bp, Artificial Sequence
  chemically synthesized
agtcattctcttgacacaaagt

SEQ ID NO: 126852 - DNA, 22 bp, Artificial Sequence
  chemically synthesized
tcttgacacaaagtaaggggaa

SEQ ID NO: 126853 - DNA, 22 bp, Artificial Sequence
  chemically synthesized
ttgacacaaagtaaggggaaat

SEQ ID NO: 126854 - DNA, 22 bp, Artificial Sequence
  chemically synthesized
gacacaaagtaaggggaaatgt

SEQ ID NO: 126855 - DNA, 22 bp, Artificial Sequence
  chemically synthesized
acacaaagtaaggggaaatgtt

SEQ ID NO: 126856 - DNA, 22 bp, Artificial Sequence
  chemically synthesized
tgtaaagagtggataatttttt

SEQ ID NO: 126857 - DNA, 22 bp, Artificial Sequence
  chemically synthesized
gtaaagagtggataattttttt

SEQ ID NO: 126858 - DNA, 22 bp, Artificial Sequence
  chemically synthesized
taaagagtggataattttttta

SEQ ID NO: 126859 - DNA, 22 bp, Artificial Sequence
  chemically synthesized
ttttatttttgtgtttttgtta

SEQ ID NO: 126860 - DNA, 22 bp, Artificial Sequence
  chemically synthesized
tttatttttgtgtttttgttat

SEQ ID NO: 126861 - DNA, 22 bp, Artificial Sequence
  chemically synthesized
ttatttttgtgtttttgttatt

SEQ ID NO: 126862 - DNA, 22 bp, Artificial Sequence
  chemically synthesized
tatttttgtgtttttgttattg

SEQ ID NO: 126863 - DNA, 22 bp, Artificial Sequence
  chemically synthesized
atttttgtgtttttgttattgt

SEQ ID NO: 126864 - DNA, 22 bp, Artificial Sequence
  chemically synthesized
tttttgtgtttttgttattgtt

SEQ ID NO: 126865 - DNA, 22 bp, Artificial Sequence
  chemically synthesized
ttgtgtttttgttattgtttca

SEQ ID NO: 126866 - DNA, 22 bp, Artificial Sequence
  chemically synthesized
tgtgtttttgttattgtttcag

SEQ ID NO: 126867 - DNA, 22 bp, Artificial Sequence
  chemically synthesized
gtgtttttgttattgtttcaga

SEQ ID NO: 126868 - DNA, 22 bp, Artificial Sequence
  chemically synthesized
tgtttttgttattgtttcagag

SEQ ID NO: 126869 - DNA, 22 bp, Artificial Sequence
  chemically synthesized
ttgttattgtttcagagaagta

SEQ ID NO: 126870 - DNA, 22 bp, Artificial Sequence
  chemically synthesized
tgttattgtttcagagaagtac

SEQ ID NO: 126871 - DNA, 22 bp, Artificial Sequence
  chemically synthesized
gttattgtttcagagaagtacc

SEQ ID NO: 126872 - DNA, 22 bp, Artificial Sequence
  chemically synthesized
ttattgtttcagagaagtacct

SEQ ID NO: 126873 - DNA, 22 bp, Artificial Sequence
  chemically synthesized
ttgtttcagagaagtacctcct

SEQ ID NO: 126874 - DNA, 22 bp, Artificial Sequence
  chemically synthesized
tttcagagaagtacctcctttc

SEQ ID NO: 126875 - DNA, 22 bp, Artificial Sequence
  chemically synthesized
cagagaagtacctcctttctct

SEQ ID NO: 126876 - DNA, 22 bp, Artificial Sequence
  chemically synthesized
agagaagtacctcctttctctt

SEQ ID NO: 126877 - DNA, 22 bp, Artificial Sequence
  chemically synthesized
ctttctctttctctagtgagta

SEQ ID NO: 126878 - DNA, 22 bp, Artificial Sequence
  chemically synthesized
tctctttctctagtgagtacat

SEQ ID NO: 126879 - DNA, 22 bp, Artificial Sequence
  chemically synthesized
ctctttctctagtgagtacatg

SEQ ID NO: 126880 - DNA, 22 bp, Artificial Sequence
  chemically synthesized
tctttctctagtgagtacatgt

SEQ ID NO: 126881 - DNA, 22 bp, Artificial Sequence
  chemically synthesized
tttctctagtgagtacatgtca

SEQ ID NO: 126882 - DNA, 22 bp, Artificial Sequence
  chemically synthesized
tctctagtgagtacatgtcagg

SEQ ID NO: 126883 - DNA, 22 bp, Artificial Sequence
  chemically synthesized
ctctagtgagtacatgtcagga

SEQ ID NO: 126884 - DNA, 22 bp, Artificial Sequence
  chemically synthesized
tctagtgagtacatgtcaggat

SEQ ID NO: 126885 - DNA, 22 bp, Artificial Sequence
  chemically synthesized
tagtgagtacatgtcaggatta

SEQ ID NO: 126886 - DNA, 22 bp, Artificial Sequence
  chemically synthesized
gtgagtacatgtcaggattatt

SEQ ID NO: 126887 - DNA, 22 bp, Artificial Sequence
  chemically synthesized
ttcacccagaggtgtgtcaaat

SEQ ID NO: 126888 - DNA, 22 bp, Artificial Sequence
  chemically synthesized
acccagaggtgtgtcaaatgat

SEQ ID NO: 126889 - DNA, 22 bp, Artificial Sequence
  chemically synthesized
cctttttttctgtggaagcctt

SEQ ID NO: 126890 - DNA, 22 bp, Artificial Sequence
  chemically synthesized
ctttttttctgtggaagccttg

SEQ ID NO: 126891 - DNA, 22 bp, Artificial Sequence
  chemically synthesized
tttttctgtggaagccttggga

SEQ ID NO: 126892 - DNA, 22 bp, Artificial Sequence
  chemically synthesized
ttttctgtggaagccttgggaa

SEQ ID NO: 126893 - DNA, 22 bp, Artificial Sequence
  chemically synthesized
tttctgtggaagccttgggaac

SEQ ID NO: 126894 - DNA, 22 bp, Artificial Sequence
  chemically synthesized
ttctgtggaagccttgggaaca

SEQ ID NO: 126895 - DNA, 22 bp, Artificial Sequence
  chemically synthesized
tctgtggaagccttgggaacag

SEQ ID NO: 126896 - DNA, 22 bp, Artificial Sequence
  chemically synthesized
ctgtggaagccttgggaacaga

SEQ ID NO: 126897 - DNA, 22 bp, Artificial Sequence
  chemically synthesized
tgtggaagccttgggaacagat

SEQ ID NO: 126898 - DNA, 22 bp, Artificial Sequence
  chemically synthesized
tggaagccttgggaacagatat

SEQ ID NO: 126899 - DNA, 22 bp, Artificial Sequence
  chemically synthesized
gggaacagatataagatgatga

SEQ ID NO: 126900 - DNA, 22 bp, Artificial Sequence
  chemically synthesized
ggaacagatataagatgatgat

SEQ ID NO: 126901 - DNA, 22 bp, Artificial Sequence
  chemically synthesized
ttaggagcctgtgtttgacttt

SEQ ID NO: 126902 - DNA, 22 bp, Artificial Sequence
  chemically synthesized
taggagcctgtgtttgacttta

SEQ ID NO: 126903 - DNA, 22 bp, Artificial Sequence
  chemically synthesized
aggagcctgtgtttgactttaa

SEQ ID NO: 126904 - DNA, 22 bp, Artificial Sequence
  chemically synthesized
ggagcctgtgtttgactttaaa

SEQ ID NO: 126905 - DNA, 22 bp, Artificial Sequence
  chemically synthesized
tgtttgactttaaataaagata

SEQ ID NO: 126906 - DNA, 22 bp, Artificial Sequence
  chemically synthesized
gactttaaataaagatattaaa

SEQ ID NO: 126907 - DNA, 22 bp, Artificial Sequence
  chemically synthesized
actttaaataaagatattaaac

SEQ ID NO: 126908 - DNA, 22 bp, Artificial Sequence
  chemically synthesized
taaataaagatattaaactata

SEQ ID NO: 126909 - DNA, 22 bp, Artificial Sequence
  chemically synthesized
aaataaagatattaaactatag

SEQ ID NO: 126910 - DNA, 22 bp, Artificial Sequence
  chemically synthesized
aataaagatattaaactatagt

SEQ ID NO: 126911 - DNA, 22 bp, Artificial Sequence
  chemically synthesized
aactatagtttctctaatcagc

SEQ ID NO: 126912 - DNA, 22 bp, Artificial Sequence
  chemically synthesized
tagtttctctaatcagcagata

SEQ ID NO: 126913 - DNA, 22 bp, Artificial Sequence
  chemically synthesized
ctctaatcagcagataaaatgt

SEQ ID NO: 126914 - DNA, 22 bp, Artificial Sequence
  chemically synthesized
tctaatcagcagataaaatgtg

SEQ ID NO: 126915 - DNA, 22 bp, Artificial Sequence
  chemically synthesized
taatcagcagataaaatgtgat

SEQ ID NO: 126916 - DNA, 22 bp, Artificial Sequence
  chemically synthesized
atcagcagataaaatgtgatat

SEQ ID NO: 126917 - DNA, 22 bp, Artificial Sequence
  chemically synthesized
ggtgggaaagggaaaggagaaa

SEQ ID NO: 126918 - DNA, 22 bp, Artificial Sequence
  chemically synthesized
atgagccaatgtgggaacttct

SEQ ID NO: 126919 - DNA, 22 bp, Artificial Sequence
  chemically synthesized
ctgacatagctaaaagtaacgt

SEQ ID NO: 126920 - DNA, 22 bp, Artificial Sequence
  chemically synthesized
tgacatagctaaaagtaacgtt

SEQ ID NO: 126921 - DNA, 22 bp, Artificial Sequence
  chemically synthesized
acatagctaaaagtaacgttga

SEQ ID NO: 126922 - DNA, 22 bp, Artificial Sequence
  chemically synthesized
aaagtaacgttgagcctggggc

SEQ ID NO: 126923 - DNA, 22 bp, Artificial Sequence
  chemically synthesized
agcctggggcattgggactgag

SEQ ID NO: 126924 - DNA, 22 bp, Artificial Sequence
  chemically synthesized
gggcattgggactgagggaagt

SEQ ID NO: 126925 - DNA, 22 bp, Artificial Sequence
  chemically synthesized
ggactgagggaagtagagggga

SEQ ID NO: 126926 - DNA, 22 bp, Artificial Sequence
  chemically synthesized
agggaagtagaggggaaagcaa

SEQ ID NO: 126927 - DNA, 22 bp, Artificial Sequence
  chemically synthesized
tgtcctcaaaaagtgagaaaag

SEQ ID NO: 126928 - DNA, 22 bp, Artificial Sequence
  chemically synthesized
tcctcaaaaagtgagaaaagga

SEQ ID NO: 126929 - DNA, 22 bp, Artificial Sequence
  chemically synthesized
aaaaagtgagaaaaggaggtat

SEQ ID NO: 126930 - DNA, 22 bp, Artificial Sequence
  chemically synthesized
ttgctcaatctgcctgccagtg

SEQ ID NO: 126931 - DNA, 22 bp, Artificial Sequence
  chemically synthesized
ctcaatctgcctgccagtgaga

SEQ ID NO: 126932 - DNA, 22 bp, Artificial Sequence
  chemically synthesized
aatctgcctgccagtgagaggt

SEQ ID NO: 126933 - DNA, 22 bp, Artificial Sequence
  chemically synthesized
cctgccagtgagaggttcagac

SEQ ID NO: 126934 - DNA, 22 bp, Artificial Sequence
  chemically synthesized
ccagtgagaggttcagacaata

SEQ ID NO: 126935 - DNA, 22 bp, Artificial Sequence
  chemically synthesized
agacaatactcagcttatgcag

SEQ ID NO: 126936 - DNA, 22 bp, Artificial Sequence
  chemically synthesized
agcttatgcaggattaaagaag

SEQ ID NO: 126937 - DNA, 22 bp, Artificial Sequence
  chemically synthesized
atgcaggattaaagaagcagta

SEQ ID NO: 126938 - DNA, 22 bp, Artificial Sequence
  chemically synthesized
tgcaggattaaagaagcagtat

SEQ ID NO: 126939 - DNA, 22 bp, Artificial Sequence
  chemically synthesized
aagaagcagtatggcaaataaa

SEQ ID NO: 126940 - DNA, 22 bp, Artificial Sequence
  chemically synthesized
tacataggtatataacttattg

SEQ ID NO: 126941 - DNA, 22 bp, Artificial Sequence
  chemically synthesized
attgttttattataggtattca

SEQ ID NO: 126942 - DNA, 22 bp, Artificial Sequence
  chemically synthesized
ttgttttattataggtattcat

SEQ ID NO: 126943 - DNA, 22 bp, Artificial Sequence
  chemically synthesized
ttttattataggtattcattgt

SEQ ID NO: 126944 - DNA, 22 bp, Artificial Sequence
  chemically synthesized
tattataggtattcattgttaa

SEQ ID NO: 126945 - DNA, 22 bp, Artificial Sequence
  chemically synthesized
attataggtattcattgttaaa

SEQ ID NO: 126946 - DNA, 22 bp, Artificial Sequence
  chemically synthesized
ttataggtattcattgttaaat

SEQ ID NO: 126947 - DNA, 22 bp, Artificial Sequence
  chemically synthesized
taggtattcattgttaaatgat

SEQ ID NO: 126948 - DNA, 22 bp, Artificial Sequence
  chemically synthesized
attgttaaatgattaccataat

SEQ ID NO: 126949 - DNA, 22 bp, Artificial Sequence
  chemically synthesized
ttaaatgattaccataatcaaa

SEQ ID NO: 126950 - DNA, 22 bp, Artificial Sequence
  chemically synthesized
aatgattaccataatcaaacta

SEQ ID NO: 126951 - DNA, 22 bp, Artificial Sequence
  chemically synthesized
ccataatcaaactaattaatat

SEQ ID NO: 126952 - DNA, 22 bp, Artificial Sequence
  chemically synthesized
attaatatatctatcacctcac

SEQ ID NO: 126953 - DNA, 22 bp, Artificial Sequence
  chemically synthesized
atatatctatcacctcacataa

SEQ ID NO: 126954 - DNA, 22 bp, Artificial Sequence
  chemically synthesized
tcacctcacataataactttaa

SEQ ID NO: 126955 - DNA, 22 bp, Artificial Sequence
  chemically synthesized
acataataactttaattttttt

SEQ ID NO: 126956 - DNA, 22 bp, Artificial Sequence
  chemically synthesized
taatttttttggtagtaaaaat

SEQ ID NO: 126957 - DNA, 22 bp, Artificial Sequence
  chemically synthesized
aatttttttggtagtaaaaata

SEQ ID NO: 126958 - DNA, 22 bp, Artificial Sequence
  chemically synthesized
atttttttggtagtaaaaatat

SEQ ID NO: 126959 - DNA, 22 bp, Artificial Sequence
  chemically synthesized
ttttggtagtaaaaatatgtga

SEQ ID NO: 126960 - DNA, 22 bp, Artificial Sequence
  chemically synthesized
tttggtagtaaaaatatgtgag

SEQ ID NO: 126961 - DNA, 22 bp, Artificial Sequence
  chemically synthesized
ttggtagtaaaaatatgtgagg

SEQ ID NO: 126962 - DNA, 22 bp, Artificial Sequence
  chemically synthesized
tggtagtaaaaatatgtgaggt

SEQ ID NO: 126963 - DNA, 22 bp, Artificial Sequence
  chemically synthesized
ggtagtaaaaatatgtgaggtc

SEQ ID NO: 126964 - DNA, 22 bp, Artificial Sequence
  chemically synthesized
gtagtaaaaatatgtgaggtct

SEQ ID NO: 126965 - DNA, 22 bp, Artificial Sequence
  chemically synthesized
ctttcttagcaaattttaaata

SEQ ID NO: 126966 - DNA, 22 bp, Artificial Sequence
  chemically synthesized
tcttagcaaattttaaatatac

SEQ ID NO: 126967 - DNA, 22 bp, Artificial Sequence
  chemically synthesized
cttagcaaattttaaatatacc

SEQ ID NO: 126968 - DNA, 22 bp, Artificial Sequence
  chemically synthesized
ttagcaaattttaaatatacct

SEQ ID NO: 126969 - DNA, 22 bp, Artificial Sequence
  chemically synthesized
agcaaattttaaatatacctaa

SEQ ID NO: 126970 - DNA, 22 bp, Artificial Sequence
  chemically synthesized
gcaaattttaaatatacctaaa

SEQ ID NO: 126971 - DNA, 22 bp, Artificial Sequence
  chemically synthesized
taaatatacctaaataaagctg

SEQ ID NO: 126972 - DNA, 22 bp, Artificial Sequence
  chemically synthesized
aaatatacctaaataaagctgg

SEQ ID NO: 126973 - DNA, 22 bp, Artificial Sequence
  chemically synthesized
aatatacctaaataaagctggg

SEQ ID NO: 126974 - DNA, 22 bp, Artificial Sequence
  chemically synthesized
aataaagctgggagggaaaaga

SEQ ID NO: 126975 - DNA, 22 bp, Artificial Sequence
  chemically synthesized
ggagggaaaagataatacagaa

SEQ ID NO: 126976 - DNA, 22 bp, Artificial Sequence
  chemically synthesized
atctagttaattgtgttatatt

SEQ ID NO: 126977 - DNA, 22 bp, Artificial Sequence
  chemically synthesized
gttaattgtgttatattactac

SEQ ID NO: 126978 - DNA, 22 bp, Artificial Sequence
  chemically synthesized
attgtgttatattactactaaa

SEQ ID NO: 126979 - DNA, 22 bp, Artificial Sequence
  chemically synthesized
tgttatattactactaaataaa

SEQ ID NO: 126980 - DNA, 22 bp, Artificial Sequence
  chemically synthesized
tattactactaaataaacatat

SEQ ID NO: 126981 - DNA, 22 bp, Artificial Sequence
  chemically synthesized
ctactaaataaacatataattg

SEQ ID NO: 126982 - DNA, 22 bp, Artificial Sequence
  chemically synthesized
ctaaataaacatataattgata

SEQ ID NO: 126983 - DNA, 22 bp, Artificial Sequence
  chemically synthesized
aataaacatataattgataaat

SEQ ID NO: 126984 - DNA, 22 bp, Artificial Sequence
  chemically synthesized
ataaattaaaaaaaaacaggag

SEQ ID NO: 126985 - DNA, 22 bp, Artificial Sequence
  chemically synthesized
aaaaaaaacaggagtaggaata

SEQ ID NO: 126986 - DNA, 22 bp, Artificial Sequence
  chemically synthesized
agaaacaaatgtatggaacaaa

SEQ ID NO: 126987 - DNA, 22 bp, Artificial Sequence
  chemically synthesized
ttgaatttctaccgtgtgtcaa

SEQ ID NO: 126988 - DNA, 22 bp, Artificial Sequence
  chemically synthesized
aatttctaccgtgtgtcaagta

SEQ ID NO: 126989 - DNA, 22 bp, Artificial Sequence
  chemically synthesized
ctaccgtgtgtcaagtattgga

SEQ ID NO: 126990 - DNA, 22 bp, Artificial Sequence
  chemically synthesized
taccgtgtgtcaagtattggac

SEQ ID NO: 126991 - DNA, 22 bp, Artificial Sequence
  chemically synthesized
ccgtgtgtcaagtattggactg

SEQ ID NO: 126992 - DNA, 22 bp, Artificial Sequence
  chemically synthesized
gactggggcattatatacacct

SEQ ID NO: 126993 - DNA, 22 bp, Artificial Sequence
  chemically synthesized
gggcattatatacacctcattt

SEQ ID NO: 126994 - DNA, 22 bp, Artificial Sequence
  chemically synthesized
tatacacctcattttttgggaa

SEQ ID NO: 126995 - DNA, 22 bp, Artificial Sequence
  chemically synthesized
attttttgggaagaatccttaa

SEQ ID NO: 126996 - DNA, 22 bp, Artificial Sequence
  chemically synthesized
tttgggaagaatccttaaaata

SEQ ID NO: 126997 - DNA, 22 bp, Artificial Sequence
  chemically synthesized
ttgggaagaatccttaaaatag

SEQ ID NO: 126998 - DNA, 22 bp, Artificial Sequence
  chemically synthesized
tgggaagaatccttaaaatagc

SEQ ID NO: 126999 - DNA, 22 bp, Artificial Sequence
  chemically synthesized
gggaagaatccttaaaatagct

SEQ ID NO: 127000 - DNA, 22 bp, Artificial Sequence
  chemically synthesized
ggaagaatccttaaaatagctg

SEQ ID NO: 127001 - DNA, 22 bp, Artificial Sequence
  chemically synthesized
aaaatagctgtttgtcttgtct

SEQ ID NO: 127002 - DNA, 22 bp, Artificial Sequence
  chemically synthesized
aaatagctgtttgtcttgtctg

SEQ ID NO: 127003 - DNA, 22 bp, Artificial Sequence
  chemically synthesized
tttgtcttgtctgttttcatat

SEQ ID NO: 127004 - DNA, 22 bp, Artificial Sequence
  chemically synthesized
gtcttgtctgttttcatattga

SEQ ID NO: 127005 - DNA, 22 bp, Artificial Sequence
  chemically synthesized
tcttgtctgttttcatattgaa

SEQ ID NO: 127006 - DNA, 22 bp, Artificial Sequence
  chemically synthesized
gtctgttttcatattgaaaact

SEQ ID NO: 127007 - DNA, 22 bp, Artificial Sequence
  chemically synthesized
tctgttttcatattgaaaactg

SEQ ID NO: 127008 - DNA, 22 bp, Artificial Sequence
  chemically synthesized
ttttcatattgaaaactgagtg

SEQ ID NO: 127009 - DNA, 22 bp, Artificial Sequence
  chemically synthesized
tcatattgaaaactgagtgctt

SEQ ID NO: 127010 - DNA, 22 bp, Artificial Sequence
  chemically synthesized
catattgaaaactgagtgcttt

SEQ ID NO: 127011 - DNA, 22 bp, Artificial Sequence
  chemically synthesized
atattgaaaactgagtgctttc

SEQ ID NO: 127012 - DNA, 22 bp, Artificial Sequence
  chemically synthesized
aaaactgagtgctttcacttga

SEQ ID NO: 127013 - DNA, 22 bp, Artificial Sequence
  chemically synthesized
agtgctttcacttgattcactc

SEQ ID NO: 127014 - DNA, 22 bp, Artificial Sequence
  chemically synthesized
tcacttgattcactcagttgct

SEQ ID NO: 127015 - DNA, 22 bp, Artificial Sequence
  chemically synthesized
cacttgattcactcagttgctt

SEQ ID NO: 127016 - DNA, 22 bp, Artificial Sequence
  chemically synthesized
acttgattcactcagttgcttt

SEQ ID NO: 127017 - DNA, 22 bp, Artificial Sequence
  chemically synthesized
gattcactcagttgcttttgtg

SEQ ID NO: 127018 - DNA, 22 bp, Artificial Sequence
  chemically synthesized
attcactcagttgcttttgtgg

SEQ ID NO: 127019 - DNA, 22 bp, Artificial Sequence
  chemically synthesized
actcagttgcttttgtggtata

SEQ ID NO: 127020 - DNA, 22 bp, Artificial Sequence
  chemically synthesized
agttgcttttgtggtatatgag

SEQ ID NO: 127021 - DNA, 22 bp, Artificial Sequence
  chemically synthesized
cttttgtggtatatgagatgat

SEQ ID NO: 127022 - DNA, 22 bp, Artificial Sequence
  chemically synthesized
ttgtggtatatgagatgatctg

SEQ ID NO: 127023 - DNA, 22 bp, Artificial Sequence
  chemically synthesized
tgtggtatatgagatgatctgt

SEQ ID NO: 127024 - DNA, 22 bp, Artificial Sequence
  chemically synthesized
gtggtatatgagatgatctgtg

SEQ ID NO: 127025 - DNA, 22 bp, Artificial Sequence
  chemically synthesized
tggtatatgagatgatctgtga

SEQ ID NO: 127026 - DNA, 22 bp, Artificial Sequence
  chemically synthesized
tgagtttcagaggggataaaaa

SEQ ID NO: 127027 - DNA, 22 bp, Artificial Sequence
  chemically synthesized
cagaggggataaaaatctaaaa

SEQ ID NO: 127028 - DNA, 22 bp, Artificial Sequence
  chemically synthesized
agaggggataaaaatctaaaac

SEQ ID NO: 127029 - DNA, 22 bp, Artificial Sequence
  chemically synthesized
aaacctttgcctcatccctgca

SEQ ID NO: 127030 - DNA, 22 bp, Artificial Sequence
  chemically synthesized
tgcctcatccctgcagccattc

SEQ ID NO: 127031 - DNA, 22 bp, Artificial Sequence
  chemically synthesized
gcctcatccctgcagccattca

SEQ ID NO: 127032 - DNA, 22 bp, Artificial Sequence
  chemically synthesized
cctcatccctgcagccattcac

SEQ ID NO: 127033 - DNA, 22 bp, Artificial Sequence
  chemically synthesized
atccctgcagccattcaccctc

SEQ ID NO: 127034 - DNA, 22 bp, Artificial Sequence
  chemically synthesized
cagccattcaccctcttccagg

SEQ ID NO: 127035 - DNA, 22 bp, Artificial Sequence
  chemically synthesized
accctcttccagggtctctgtc

SEQ ID NO: 127036 - DNA, 22 bp, Artificial Sequence
  chemically synthesized
ttccagggtctctgtcatagaa

SEQ ID NO: 127037 - DNA, 22 bp, Artificial Sequence
  chemically synthesized
ccagggtctctgtcatagaata

SEQ ID NO: 127038 - DNA, 22 bp, Artificial Sequence
  chemically synthesized
cagggtctctgtcatagaatag

SEQ ID NO: 127039 - DNA, 22 bp, Artificial Sequence
  chemically synthesized
tgtcatagaatagacttgagtt

SEQ ID NO: 127040 - DNA, 22 bp, Artificial Sequence
  chemically synthesized
tcatagaatagacttgagtttt

SEQ ID NO: 127041 - DNA, 22 bp, Artificial Sequence
  chemically synthesized
gagtttttattaatgagaaact

SEQ ID NO: 127042 - DNA, 22 bp, Artificial Sequence
  chemically synthesized
agtttttattaatgagaaacta

SEQ ID NO: 127043 - DNA, 22 bp, Artificial Sequence
  chemically synthesized
ttattaatgagaaactaattct

SEQ ID NO: 127044 - DNA, 22 bp, Artificial Sequence
  chemically synthesized
tattaatgagaaactaattctc

SEQ ID NO: 127045 - DNA, 22 bp, Artificial Sequence
  chemically synthesized
attaatgagaaactaattctca

SEQ ID NO: 127046 - DNA, 22 bp, Artificial Sequence
  chemically synthesized
ttaatgagaaactaattctcaa

SEQ ID NO: 127047 - DNA, 22 bp, Artificial Sequence
  chemically synthesized
atgagaaactaattctcaaagt

SEQ ID NO: 127048 - DNA, 22 bp, Artificial Sequence
  chemically synthesized
attctcaaagtctcaaactctg

SEQ ID NO: 127049 - DNA, 22 bp, Artificial Sequence
  chemically synthesized
tcaaagtctcaaactctgccgc

SEQ ID NO: 127050 - DNA, 22 bp, Artificial Sequence
  chemically synthesized
aaagtctcaaactctgccgcat

SEQ ID NO: 127051 - DNA, 22 bp, Artificial Sequence
  chemically synthesized
aaactctgccgcataaactgat

SEQ ID NO: 127052 - DNA, 22 bp, Artificial Sequence
  chemically synthesized
tgccgcataaactgatggctct

SEQ ID NO: 127053 - DNA, 22 bp, Artificial Sequence
  chemically synthesized
ccgcataaactgatggctctat

SEQ ID NO: 127054 - DNA, 22 bp, Artificial Sequence
  chemically synthesized
atggctctatgcagacacctca

SEQ ID NO: 127055 - DNA, 22 bp, Artificial Sequence
  chemically synthesized
tatgcagacacctcagcaggag

SEQ ID NO: 127056 - DNA, 22 bp, Artificial Sequence
  chemically synthesized
tgcagacacctcagcaggagcc

SEQ ID NO: 127057 - DNA, 22 bp, Artificial Sequence
  chemically synthesized
agcaggagcccattcagatgtt

SEQ ID NO: 127058 - DNA, 22 bp, Artificial Sequence
  chemically synthesized
agatgttaactttcatatattc

SEQ ID NO: 127059 - DNA, 22 bp, Artificial Sequence
  chemically synthesized
actttcatatattctctcacct

SEQ ID NO: 127060 - DNA, 22 bp, Artificial Sequence
  chemically synthesized
tcatatattctctcaccttccc

SEQ ID NO: 127061 - DNA, 22 bp, Artificial Sequence
  chemically synthesized
catatattctctcaccttccct

SEQ ID NO: 127062 - DNA, 22 bp, Artificial Sequence
  chemically synthesized
atatattctctcaccttccctt

SEQ ID NO: 127063 - DNA, 22 bp, Artificial Sequence
  chemically synthesized
tctcaccttccctttggctttt

SEQ ID NO: 127064 - DNA, 22 bp, Artificial Sequence
  chemically synthesized
tcaccttccctttggctttttt

SEQ ID NO: 127065 - DNA, 22 bp, Artificial Sequence
  chemically synthesized
accttccctttggcttttttcc

SEQ ID NO: 127066 - DNA, 22 bp, Artificial Sequence
  chemically synthesized
ccctttggcttttttccttcac

SEQ ID NO: 127067 - DNA, 22 bp, Artificial Sequence
  chemically synthesized
cctttggcttttttccttcact

SEQ ID NO: 127068 - DNA, 22 bp, Artificial Sequence
  chemically synthesized
tggcttttttccttcacttttc

SEQ ID NO: 127069 - DNA, 22 bp, Artificial Sequence
  chemically synthesized
ggcttttttccttcacttttcc

SEQ ID NO: 127070 - DNA, 22 bp, Artificial Sequence
  chemically synthesized
gcttttttccttcacttttcct

SEQ ID NO: 127071 - DNA, 22 bp, Artificial Sequence
  chemically synthesized
ttttccttcacttttcctgaca

SEQ ID NO: 127072 - DNA, 22 bp, Artificial Sequence
  chemically synthesized
tttccttcacttttcctgacac

SEQ ID NO: 127073 - DNA, 22 bp, Artificial Sequence
  chemically synthesized
ttccttcacttttcctgacact

SEQ ID NO: 127074 - DNA, 22 bp, Artificial Sequence
  chemically synthesized
tccttcacttttcctgacactc

SEQ ID NO: 127075 - DNA, 22 bp, Artificial Sequence
  chemically synthesized
ccttcacttttcctgacactct

SEQ ID NO: 127076 - DNA, 22 bp, Artificial Sequence
  chemically synthesized
cttcacttttcctgacactctt

SEQ ID NO: 127077 - DNA, 22 bp, Artificial Sequence
  chemically synthesized
cacttttcctgacactcttttc

SEQ ID NO: 127078 - DNA, 22 bp, Artificial Sequence
  chemically synthesized
acttttcctgacactcttttct

SEQ ID NO: 127079 - DNA, 22 bp, Artificial Sequence
  chemically synthesized
ttcctgacactcttttctgtct

SEQ ID NO: 127080 - DNA, 22 bp, Artificial Sequence
  chemically synthesized
tcctgacactcttttctgtctc

SEQ ID NO: 127081 - DNA, 22 bp, Artificial Sequence
  chemically synthesized
cctgacactcttttctgtctca

SEQ ID NO: 127082 - DNA, 22 bp, Artificial Sequence
  chemically synthesized
ctgacactcttttctgtctcaa

SEQ ID NO: 127083 - DNA, 22 bp, Artificial Sequence
  chemically synthesized
acactcttttctgtctcaagca

SEQ ID NO: 127084 - DNA, 22 bp, Artificial Sequence
  chemically synthesized
ttttctgtctcaagcacttagt

SEQ ID NO: 127085 - DNA, 22 bp, Artificial Sequence
  chemically synthesized
ttctgtctcaagcacttagtat

SEQ ID NO: 127086 - DNA, 22 bp, Artificial Sequence
  chemically synthesized
tctgtctcaagcacttagtatc

SEQ ID NO: 127087 - DNA, 22 bp, Artificial Sequence
  chemically synthesized
ctgtctcaagcacttagtatct

SEQ ID NO: 127088 - DNA, 22 bp, Artificial Sequence
  chemically synthesized
tgtctcaagcacttagtatctc

SEQ ID NO: 127089 - DNA, 22 bp, Artificial Sequence
  chemically synthesized
tctcaagcacttagtatctcca

SEQ ID NO: 127090 - DNA, 22 bp, Artificial Sequence
  chemically synthesized
aagcacttagtatctccatcct

SEQ ID NO: 127091 - DNA, 22 bp, Artificial Sequence
  chemically synthesized
agtatctccatcctttttttac

SEQ ID NO: 127092 - DNA, 22 bp, Artificial Sequence
  chemically synthesized
gtatctccatcctttttttacc

SEQ ID NO: 127093 - DNA, 22 bp, Artificial Sequence
  chemically synthesized
catcctttttttacccccttac

SEQ ID NO: 127094 - DNA, 22 bp, Artificial Sequence
  chemically synthesized
tttttacccccttacctttggc

SEQ ID NO: 127095 - DNA, 22 bp, Artificial Sequence
  chemically synthesized
ttttacccccttacctttggct

SEQ ID NO: 127096 - DNA, 22 bp, Artificial Sequence
  chemically synthesized
tttacccccttacctttggcta

SEQ ID NO: 127097 - DNA, 22 bp, Artificial Sequence
  chemically synthesized
ttacccccttacctttggctat

SEQ ID NO: 127098 - DNA, 22 bp, Artificial Sequence
  chemically synthesized
tacccccttacctttggctatt

SEQ ID NO: 127099 - DNA, 22 bp, Artificial Sequence
  chemically synthesized
acccccttacctttggctatta

SEQ ID NO: 127100 - DNA, 22 bp, Artificial Sequence
  chemically synthesized
cccccttacctttggctattat

SEQ ID NO: 127101 - DNA, 22 bp, Artificial Sequence
  chemically synthesized
acctttggctattatcctttct

SEQ ID NO: 127102 - DNA, 22 bp, Artificial Sequence
  chemically synthesized
cctttggctattatcctttctg

SEQ ID NO: 127103 - DNA, 22 bp, Artificial Sequence
  chemically synthesized
tggctattatcctttctgtgat

SEQ ID NO: 127104 - DNA, 22 bp, Artificial Sequence
  chemically synthesized
ggctattatcctttctgtgatg

SEQ ID NO: 127105 - DNA, 22 bp, Artificial Sequence
  chemically synthesized
gctattatcctttctgtgatgg

SEQ ID NO: 127106 - DNA, 22 bp, Artificial Sequence
  chemically synthesized
ttatcctttctgtgatggttaa

SEQ ID NO: 127107 - DNA, 22 bp, Artificial Sequence
  chemically synthesized
tcctttctgtgatggttaatat

SEQ ID NO: 127108 - DNA, 22 bp, Artificial Sequence
  chemically synthesized
tctgtgatggttaatattgagt

SEQ ID NO: 127109 - DNA, 22 bp, Artificial Sequence
  chemically synthesized
ctgtgatggttaatattgagtg

SEQ ID NO: 127110 - DNA, 22 bp, Artificial Sequence
  chemically synthesized
tgtgatggttaatattgagtgc

SEQ ID NO: 127111 - DNA, 22 bp, Artificial Sequence
  chemically synthesized
tgatggttaatattgagtgcaa

SEQ ID NO: 127112 - DNA, 22 bp, Artificial Sequence
  chemically synthesized
atattgagtgcaaacttgattg

SEQ ID NO: 127113 - DNA, 22 bp, Artificial Sequence
  chemically synthesized
agtgcaaacttgattggattga

SEQ ID NO: 127114 - DNA, 22 bp, Artificial Sequence
  chemically synthesized
gattggattgaaggatgcaaag

SEQ ID NO: 127115 - DNA, 22 bp, Artificial Sequence
  chemically synthesized
attggattgaaggatgcaaagt

SEQ ID NO: 127116 - DNA, 22 bp, Artificial Sequence
  chemically synthesized
gattgaaggatgcaaagtattg

SEQ ID NO: 127117 - DNA, 22 bp, Artificial Sequence
  chemically synthesized
aaggatgcaaagtattgttcct

SEQ ID NO: 127118 - DNA, 22 bp, Artificial Sequence
  chemically synthesized
ttcctgggtgtgctgtaagggt

SEQ ID NO: 127119 - DNA, 22 bp, Artificial Sequence
  chemically synthesized
ctgggtgtgctgtaagggtgtt

SEQ ID NO: 127120 - DNA, 22 bp, Artificial Sequence
  chemically synthesized
ggtgtgctgtaagggtgttgcc

SEQ ID NO: 127121 - DNA, 22 bp, Artificial Sequence
  chemically synthesized
taagggtgttgccaaaggagat

SEQ ID NO: 127122 - DNA, 22 bp, Artificial Sequence
  chemically synthesized
ccaaaggagattaacatttgag

SEQ ID NO: 127123 - DNA, 22 bp, Artificial Sequence
  chemically synthesized
acatttgagtcagtagactggg

SEQ ID NO: 127124 - DNA, 22 bp, Artificial Sequence
  chemically synthesized
gagtcagtagactgggagaggc

SEQ ID NO: 127125 - DNA, 22 bp, Artificial Sequence
  chemically synthesized
agtcagtagactgggagaggca

SEQ ID NO: 127126 - DNA, 22 bp, Artificial Sequence
  chemically synthesized
ggagaggcagacccacccaccc

SEQ ID NO: 127127 - DNA, 22 bp, Artificial Sequence
  chemically synthesized
cgtctgggtgggtactatctaa

SEQ ID NO: 127128 - DNA, 22 bp, Artificial Sequence
  chemically synthesized
ggtgggtactatctaatcagct

SEQ ID NO: 127129 - DNA, 22 bp, Artificial Sequence
  chemically synthesized
tctaatcagctgccagggcggc

SEQ ID NO: 127130 - DNA, 22 bp, Artificial Sequence
  chemically synthesized
atcagctgccagggcggctaga

SEQ ID NO: 127131 - DNA, 22 bp, Artificial Sequence
  chemically synthesized
ccagggcggctagaagaaagca

SEQ ID NO: 127132 - DNA, 22 bp, Artificial Sequence
  chemically synthesized
gaagaaagcaggcaaaagaaga

SEQ ID NO: 127133 - DNA, 22 bp, Artificial Sequence
  chemically synthesized
ttacacaatataaacctttcca

SEQ ID NO: 127134 - DNA, 22 bp, Artificial Sequence
  chemically synthesized
cacaatataaacctttccaggt

SEQ ID NO: 127135 - DNA, 22 bp, Artificial Sequence
  chemically synthesized
tccaggtgctaaagtcacacag

SEQ ID NO: 127136 - DNA, 22 bp, Artificial Sequence
  chemically synthesized
ccaggtgctaaagtcacacagg

SEQ ID NO: 127137 - DNA, 22 bp, Artificial Sequence
  chemically synthesized
caggtgctaaagtcacacaggc

SEQ ID NO: 127138 - DNA, 22 bp, Artificial Sequence
  chemically synthesized
aagtcacacaggctatgtgaat

SEQ ID NO: 127139 - DNA, 22 bp, Artificial Sequence
  chemically synthesized
tgtgaatctgtacccctgatcc

SEQ ID NO: 127140 - DNA, 22 bp, Artificial Sequence
  chemically synthesized
tacccctgatccagaggcacac

SEQ ID NO: 127141 - DNA, 22 bp, Artificial Sequence
  chemically synthesized
atccagaggcacacataaccca

SEQ ID NO: 127142 - DNA, 22 bp, Artificial Sequence
  chemically synthesized
cgtccaagcttaattttgaatt

SEQ ID NO: 127143 - DNA, 22 bp, Artificial Sequence
  chemically synthesized
aattttgaattggtttattagt

SEQ ID NO: 127144 - DNA, 22 bp, Artificial Sequence
  chemically synthesized
attttgaattggtttattagtc

SEQ ID NO: 127145 - DNA, 22 bp, Artificial Sequence
  chemically synthesized
tgaattggtttattagtcatat

SEQ ID NO: 127146 - DNA, 22 bp, Artificial Sequence
  chemically synthesized
gaattggtttattagtcatatg

SEQ ID NO: 127147 - DNA, 22 bp, Artificial Sequence
  chemically synthesized
aattggtttattagtcatatgg

SEQ ID NO: 127148 - DNA, 22 bp, Artificial Sequence
  chemically synthesized
gtttattagtcatatggtcaga

SEQ ID NO: 127149 - DNA, 22 bp, Artificial Sequence
  chemically synthesized
attagtcatatggtcagatagt

SEQ ID NO: 127150 - DNA, 22 bp, Artificial Sequence
  chemically synthesized
ttagtcatatggtcagatagtg

SEQ ID NO: 127151 - DNA, 22 bp, Artificial Sequence
  chemically synthesized
gtcatatggtcagatagtgact

SEQ ID NO: 127152 - DNA, 22 bp, Artificial Sequence
  chemically synthesized
tttttctagaaagtatttgaac

SEQ ID NO: 127153 - DNA, 22 bp, Artificial Sequence
  chemically synthesized
ttttctagaaagtatttgaacc

SEQ ID NO: 127154 - DNA, 22 bp, Artificial Sequence
  chemically synthesized
tttctagaaagtatttgaacct

SEQ ID NO: 127155 - DNA, 22 bp, Artificial Sequence
  chemically synthesized
ttctagaaagtatttgaacctc

SEQ ID NO: 127156 - DNA, 22 bp, Artificial Sequence
  chemically synthesized
tctagaaagtatttgaacctct

SEQ ID NO: 127157 - DNA, 22 bp, Artificial Sequence
  chemically synthesized
ctagaaagtatttgaacctctg

SEQ ID NO: 127158 - DNA, 22 bp, Artificial Sequence
  chemically synthesized
tagaaagtatttgaacctctga

SEQ ID NO: 127159 - DNA, 22 bp, Artificial Sequence
  chemically synthesized
gaaagtatttgaacctctgatg

SEQ ID NO: 127160 - DNA, 22 bp, Artificial Sequence
  chemically synthesized
gaacctctgatgattacagagg

SEQ ID NO: 127161 - DNA, 22 bp, Artificial Sequence
  chemically synthesized
aacctctgatgattacagaggt

SEQ ID NO: 127162 - DNA, 22 bp, Artificial Sequence
  chemically synthesized
tgatgattacagaggtatacct

SEQ ID NO: 127163 - DNA, 22 bp, Artificial Sequence
  chemically synthesized
atgattacagaggtatacctcc

SEQ ID NO: 127164 - DNA, 22 bp, Artificial Sequence
  chemically synthesized
cagaggtatacctcctcaagaa

SEQ ID NO: 127165 - DNA, 22 bp, Artificial Sequence
  chemically synthesized
ctcaagaatttggaagagttga

SEQ ID NO: 127166 - DNA, 22 bp, Artificial Sequence
  chemically synthesized
aagaatttggaagagttgattc

SEQ ID NO: 127167 - DNA, 22 bp, Artificial Sequence
  chemically synthesized
ggaagagttgattctatatttg

SEQ ID NO: 127168 - DNA, 22 bp, Artificial Sequence
  chemically synthesized
gaagagttgattctatatttgg

SEQ ID NO: 127169 - DNA, 22 bp, Artificial Sequence
  chemically synthesized
attctatatttggcacttatct

SEQ ID NO: 127170 - DNA, 22 bp, Artificial Sequence
  chemically synthesized
tatatttggcacttatctggac

SEQ ID NO: 127171 - DNA, 22 bp, Artificial Sequence
  chemically synthesized
tatttggcacttatctggactt

SEQ ID NO: 127172 - DNA, 22 bp, Artificial Sequence
  chemically synthesized
ggcacttatctggacttctaag

SEQ ID NO: 127173 - DNA, 22 bp, Artificial Sequence
  chemically synthesized
gcacttatctggacttctaagg

SEQ ID NO: 127174 - DNA, 22 bp, Artificial Sequence
  chemically synthesized
atctggacttctaaggtaaaag

SEQ ID NO: 127175 - DNA, 22 bp, Artificial Sequence
  chemically synthesized
tctggacttctaaggtaaaaga

SEQ ID NO: 127176 - DNA, 22 bp, Artificial Sequence
  chemically synthesized
gacttctaaggtaaaagacatg

SEQ ID NO: 127177 - DNA, 22 bp, Artificial Sequence
  chemically synthesized
ctaaggtaaaagacatggggtt

SEQ ID NO: 127178 - DNA, 22 bp, Artificial Sequence
  chemically synthesized
taaggtaaaagacatggggttg

SEQ ID NO: 127179 - DNA, 22 bp, Artificial Sequence
  chemically synthesized
aggtaaaagacatggggttggg

SEQ ID NO: 127180 - DNA, 22 bp, Artificial Sequence
  chemically synthesized
ggggcagggggactctcagggt

SEQ ID NO: 127181 - DNA, 22 bp, Artificial Sequence
  chemically synthesized
tcagggttagaatggaagccag

SEQ ID NO: 127182 - DNA, 22 bp, Artificial Sequence
  chemically synthesized
agggttagaatggaagccagag

SEQ ID NO: 127183 - DNA, 22 bp, Artificial Sequence
  chemically synthesized
gaatggaagccagagagattaa

SEQ ID NO: 127184 - DNA, 22 bp, Artificial Sequence
  chemically synthesized
aagaatcagtcaggtggagaga

SEQ ID NO: 127185 - DNA, 22 bp, Artificial Sequence
  chemically synthesized
ctacaaccccataattcatgcc

SEQ ID NO: 127186 - DNA, 22 bp, Artificial Sequence
  chemically synthesized
caaccccataattcatgcctga

SEQ ID NO: 127187 - DNA, 22 bp, Artificial Sequence
  chemically synthesized
atgcctgagtcaacacccatgc

SEQ ID NO: 127188 - DNA, 22 bp, Artificial Sequence
  chemically synthesized
agtcaacacccatgctctggtt

SEQ ID NO: 127189 - DNA, 22 bp, Artificial Sequence
  chemically synthesized
tggtttgttcgtagaattgttt

SEQ ID NO: 127190 - DNA, 22 bp, Artificial Sequence
  chemically synthesized
gtttgttcgtagaattgtttgc

SEQ ID NO: 127191 - DNA, 22 bp, Artificial Sequence
  chemically synthesized
gttcgtagaattgtttgcctta

SEQ ID NO: 127192 - DNA, 22 bp, Artificial Sequence
  chemically synthesized
ttcgtagaattgtttgccttat

SEQ ID NO: 127193 - DNA, 22 bp, Artificial Sequence
  chemically synthesized
gtagaattgtttgccttatgtg

SEQ ID NO: 127194 - DNA, 22 bp, Artificial Sequence
  chemically synthesized
tttgccttatgtgttccagaat

SEQ ID NO: 127195 - DNA, 22 bp, Artificial Sequence
  chemically synthesized
gccttatgtgttccagaatcta

SEQ ID NO: 127196 - DNA, 22 bp, Artificial Sequence
  chemically synthesized
ccttatgtgttccagaatctat

SEQ ID NO: 127197 - DNA, 22 bp, Artificial Sequence
  chemically synthesized
atgtgttccagaatctatcctt

SEQ ID NO: 127198 - DNA, 22 bp, Artificial Sequence
  chemically synthesized
tgtgttccagaatctatccttc

SEQ ID NO: 127199 - DNA, 22 bp, Artificial Sequence
  chemically synthesized
cagaatctatccttcacttttt

SEQ ID NO: 127200 - DNA, 22 bp, Artificial Sequence
  chemically synthesized
tccttcacttttttatatttga

SEQ ID NO: 127201 - DNA, 22 bp, Artificial Sequence
  chemically synthesized
cacttttttatatttgaagagg

SEQ ID NO: 127202 - DNA, 22 bp, Artificial Sequence
  chemically synthesized
acttttttatatttgaagaggt

SEQ ID NO: 127203 - DNA, 22 bp, Artificial Sequence
  chemically synthesized
ttttatatttgaagaggtaact

SEQ ID NO: 127204 - DNA, 22 bp, Artificial Sequence
  chemically synthesized
tttatatttgaagaggtaactc

SEQ ID NO: 127205 - DNA, 22 bp, Artificial Sequence
  chemically synthesized
ttatatttgaagaggtaactct

SEQ ID NO: 127206 - DNA, 22 bp, Artificial Sequence
  chemically synthesized
tatatttgaagaggtaactctc

SEQ ID NO: 127207 - DNA, 22 bp, Artificial Sequence
  chemically synthesized
atatttgaagaggtaactctca

SEQ ID NO: 127208 - DNA, 22 bp, Artificial Sequence
  chemically synthesized
tatttgaagaggtaactctcaa

SEQ ID NO: 127209 - DNA, 22 bp, Artificial Sequence
  chemically synthesized
gaagaggtaactctcaaagaaa

SEQ ID NO: 127210 - DNA, 22 bp, Artificial Sequence
  chemically synthesized
aagaggtaactctcaaagaaac

SEQ ID NO: 127211 - DNA, 22 bp, Artificial Sequence
  chemically synthesized
tcaaagaaaccaagttttagag

SEQ ID NO: 127212 - DNA, 22 bp, Artificial Sequence
  chemically synthesized
aaagaaaccaagttttagagat

SEQ ID NO: 127213 - DNA, 22 bp, Artificial Sequence
  chemically synthesized
tagagatgtcagggagtcttta

SEQ ID NO: 127214 - DNA, 22 bp, Artificial Sequence
  chemically synthesized
agagatgtcagggagtctttag

SEQ ID NO: 127215 - DNA, 22 bp, Artificial Sequence
  chemically synthesized
gagatgtcagggagtctttagg

SEQ ID NO: 127216 - DNA, 22 bp, Artificial Sequence
  chemically synthesized
taggacccatgcctactacata

SEQ ID NO: 127217 - DNA, 22 bp, Artificial Sequence
  chemically synthesized
aggacccatgcctactacatat

SEQ ID NO: 127218 - DNA, 22 bp, Artificial Sequence
  chemically synthesized
ggacccatgcctactacatata

SEQ ID NO: 127219 - DNA, 22 bp, Artificial Sequence
  chemically synthesized
ctacatatatctactcttagca

SEQ ID NO: 127220 - DNA, 22 bp, Artificial Sequence
  chemically synthesized
catatatctactcttagcagac

SEQ ID NO: 127221 - DNA, 22 bp, Artificial Sequence
  chemically synthesized
ctcttagcagacaacactatta

SEQ ID NO: 127222 - DNA, 22 bp, Artificial Sequence
  chemically synthesized
ttagcagacaacactattactt

SEQ ID NO: 127223 - DNA, 22 bp, Artificial Sequence
  chemically synthesized
agcagacaacactattactttt

SEQ ID NO: 127224 - DNA, 22 bp, Artificial Sequence
  chemically synthesized
gcagacaacactattacttttc

SEQ ID NO: 127225 - DNA, 22 bp, Artificial Sequence
  chemically synthesized
ttacttttctcttgctaagaaa

SEQ ID NO: 127226 - DNA, 22 bp, Artificial Sequence
  chemically synthesized
cttttctcttgctaagaaatca

SEQ ID NO: 127227 - DNA, 22 bp, Artificial Sequence
  chemically synthesized
ttctcttgctaagaaatcagct

SEQ ID NO: 127228 - DNA, 22 bp, Artificial Sequence
  chemically synthesized
tctcttgctaagaaatcagctt

SEQ ID NO: 127229 - DNA, 22 bp, Artificial Sequence
  chemically synthesized
ctcttgctaagaaatcagcttc

SEQ ID NO: 127230 - DNA, 22 bp, Artificial Sequence
  chemically synthesized
tcttgctaagaaatcagcttcg

SEQ ID NO: 127231 - DNA, 22 bp, Artificial Sequence
  chemically synthesized
ttgctaagaaatcagcttcgat

SEQ ID NO: 127232 - DNA, 22 bp, Artificial Sequence
  chemically synthesized
gctaagaaatcagcttcgatct

SEQ ID NO: 127233 - DNA, 22 bp, Artificial Sequence
  chemically synthesized
ctaagaaatcagcttcgatctc

SEQ ID NO: 127234 - DNA, 22 bp, Artificial Sequence
  chemically synthesized
agaaatcagcttcgatctctct

SEQ ID NO: 127235 - DNA, 22 bp, Artificial Sequence
  chemically synthesized
cgatctctctgttttttttttg

SEQ ID NO: 127236 - DNA, 22 bp, Artificial Sequence
  chemically synthesized
gatctctctgttttttttttgc

SEQ ID NO: 127237 - DNA, 22 bp, Artificial Sequence
  chemically synthesized
tctgttttttttttgccttggt

SEQ ID NO: 127238 - DNA, 22 bp, Artificial Sequence
  chemically synthesized
tgttttttttttgccttggttc

SEQ ID NO: 127239 - DNA, 22 bp, Artificial Sequence
  chemically synthesized
ttttttttttgccttggttcct

SEQ ID NO: 127240 - DNA, 22 bp, Artificial Sequence
  chemically synthesized
tttttttgccttggttcctgca

SEQ ID NO: 127241 - DNA, 22 bp, Artificial Sequence
  chemically synthesized
ttttttgccttggttcctgcaa

SEQ ID NO: 127242 - DNA, 22 bp, Artificial Sequence
  chemically synthesized
tttttgccttggttcctgcaat

SEQ ID NO: 127243 - DNA, 22 bp, Artificial Sequence
  chemically synthesized
ttttgccttggttcctgcaatg

SEQ ID NO: 127244 - DNA, 22 bp, Artificial Sequence
  chemically synthesized
tttgccttggttcctgcaatga

SEQ ID NO: 127245 - DNA, 22 bp, Artificial Sequence
  chemically synthesized
ttgccttggttcctgcaatgag

SEQ ID NO: 127246 - DNA, 22 bp, Artificial Sequence
  chemically synthesized
tgccttggttcctgcaatgaga

SEQ ID NO: 127247 - DNA, 22 bp, Artificial Sequence
  chemically synthesized
gccttggttcctgcaatgagat

SEQ ID NO: 127248 - DNA, 22 bp, Artificial Sequence
  chemically synthesized
ccttggttcctgcaatgagatc

SEQ ID NO: 127249 - DNA, 22 bp, Artificial Sequence
  chemically synthesized
ggttcctgcaatgagatcttac

SEQ ID NO: 127250 - DNA, 22 bp, Artificial Sequence
  chemically synthesized
gttcctgcaatgagatcttaca

SEQ ID NO: 127251 - DNA, 22 bp, Artificial Sequence
  chemically synthesized
ctgcaatgagatcttacagagg

SEQ ID NO: 127252 - DNA, 22 bp, Artificial Sequence
  chemically synthesized
caatgagatcttacagaggaga

SEQ ID NO: 127253 - DNA, 22 bp, Artificial Sequence
  chemically synthesized
acagaggagattcattaaatac

SEQ ID NO: 127254 - DNA, 22 bp, Artificial Sequence
  chemically synthesized
cagaggagattcattaaatacc

SEQ ID NO: 127255 - DNA, 22 bp, Artificial Sequence
  chemically synthesized
attaaataccctcactgacctg

SEQ ID NO: 127256 - DNA, 22 bp, Artificial Sequence
  chemically synthesized
aataccctcactgacctgaaac

SEQ ID NO: 127257 - DNA, 22 bp, Artificial Sequence
  chemically synthesized
actgacctgaaactttgttccc

SEQ ID NO: 127258 - DNA, 22 bp, Artificial Sequence
  chemically synthesized
acctgaaactttgttcccttcc

SEQ ID NO: 127259 - DNA, 22 bp, Artificial Sequence
  chemically synthesized
aaactttgttcccttccattct

SEQ ID NO: 127260 - DNA, 22 bp, Artificial Sequence
  chemically synthesized
tgttcccttccattcttcagtt

SEQ ID NO: 127261 - DNA, 22 bp, Artificial Sequence
  chemically synthesized
gttcccttccattcttcagttc

SEQ ID NO: 127262 - DNA, 22 bp, Artificial Sequence
  chemically synthesized
ttcccttccattcttcagttcc

SEQ ID NO: 127263 - DNA, 22 bp, Artificial Sequence
  chemically synthesized
ccttccattcttcagttccata

SEQ ID NO: 127264 - DNA, 22 bp, Artificial Sequence
  chemically synthesized
ccattcttcagttccatagtca

SEQ ID NO: 127265 - DNA, 22 bp, Artificial Sequence
  chemically synthesized
cattcttcagttccatagtcat

SEQ ID NO: 127266 - DNA, 22 bp, Artificial Sequence
  chemically synthesized
ttcagttccatagtcatgtatc

SEQ ID NO: 127267 - DNA, 22 bp, Artificial Sequence
  chemically synthesized
cagttccatagtcatgtatctc

SEQ ID NO: 127268 - DNA, 22 bp, Artificial Sequence
  chemically synthesized
agttccatagtcatgtatctca

SEQ ID NO: 127269 - DNA, 22 bp, Artificial Sequence
  chemically synthesized
catagtcatgtatctcacatct

SEQ ID NO: 127270 - DNA, 22 bp, Artificial Sequence
  chemically synthesized
acatctttagccgtatgaaaga

SEQ ID NO: 127271 - DNA, 22 bp, Artificial Sequence
  chemically synthesized
tagccgtatgaaagatttgggc

SEQ ID NO: 127272 - DNA, 22 bp, Artificial Sequence
  chemically synthesized
agccgtatgaaagatttgggca

SEQ ID NO: 127273 - DNA, 22 bp, Artificial Sequence
  chemically synthesized
gccgtatgaaagatttgggcat

SEQ ID NO: 127274 - DNA, 22 bp, Artificial Sequence
  chemically synthesized
gggcatcatcttttcagaatct

SEQ ID NO: 127275 - DNA, 22 bp, Artificial Sequence
  chemically synthesized
ggcatcatcttttcagaatctg

SEQ ID NO: 127276 - DNA, 22 bp, Artificial Sequence
  chemically synthesized
ttcagaatctgcacatgagcct

SEQ ID NO: 127277 - DNA, 22 bp, Artificial Sequence
  chemically synthesized
tcagaatctgcacatgagcctg

SEQ ID NO: 127278 - DNA, 22 bp, Artificial Sequence
  chemically synthesized
cagaatctgcacatgagcctgg

SEQ ID NO: 127279 - DNA, 22 bp, Artificial Sequence
  chemically synthesized
agaatctgcacatgagcctggc

SEQ ID NO: 127280 - DNA, 22 bp, Artificial Sequence
  chemically synthesized
cacatgagcctggctggtagga

SEQ ID NO: 127281 - DNA, 22 bp, Artificial Sequence
  chemically synthesized
gctggtaggaacatttatttta

SEQ ID NO: 127282 - DNA, 22 bp, Artificial Sequence
  chemically synthesized
gtaggaacatttattttagaag

SEQ ID NO: 127283 - DNA, 22 bp, Artificial Sequence
  chemically synthesized
attttagaagctcctccccaga

SEQ ID NO: 127284 - DNA, 22 bp, Artificial Sequence
  chemically synthesized
ttttagaagctcctccccagag

SEQ ID NO: 127285 - DNA, 22 bp, Artificial Sequence
  chemically synthesized
tagaagctcctccccagagacc

SEQ ID NO: 127286 - DNA, 22 bp, Artificial Sequence
  chemically synthesized
agaagctcctccccagagacca

SEQ ID NO: 127287 - DNA, 22 bp, Artificial Sequence
  chemically synthesized
gaagctcctccccagagaccat

SEQ ID NO: 127288 - DNA, 22 bp, Artificial Sequence
  chemically synthesized
ctccccagagaccattcctgat

SEQ ID NO: 127289 - DNA, 22 bp, Artificial Sequence
  chemically synthesized
cccagagaccattcctgattta

SEQ ID NO: 127290 - DNA, 22 bp, Artificial Sequence
  chemically synthesized
ctgatttagataattattgttc

SEQ ID NO: 127291 - DNA, 22 bp, Artificial Sequence
  chemically synthesized
atttagataattattgttcttc

SEQ ID NO: 127292 - DNA, 22 bp, Artificial Sequence
  chemically synthesized
agataattattgttcttccctc

SEQ ID NO: 127293 - DNA, 22 bp, Artificial Sequence
  chemically synthesized
gataattattgttcttccctcc

SEQ ID NO: 127294 - DNA, 22 bp, Artificial Sequence
  chemically synthesized
ttgttcttccctccctccctct

SEQ ID NO: 127295 - DNA, 22 bp, Artificial Sequence
  chemically synthesized
ttcttccctccctccctcttct

SEQ ID NO: 127296 - DNA, 22 bp, Artificial Sequence
  chemically synthesized
ttccctccctccctcttctgct

SEQ ID NO: 127297 - DNA, 22 bp, Artificial Sequence
  chemically synthesized
ccctccctccctcttctgctcc

SEQ ID NO: 127298 - DNA, 22 bp, Artificial Sequence
  chemically synthesized
cctccctccctcttctgctccc

SEQ ID NO: 127299 - DNA, 22 bp, Artificial Sequence
  chemically synthesized
cctccctcttctgctccctcct

SEQ ID NO: 127300 - DNA, 22 bp, Artificial Sequence
  chemically synthesized
cctcttctgctccctcctctct

SEQ ID NO: 127301 - DNA, 22 bp, Artificial Sequence
  chemically synthesized
ttctgctccctcctctcttccc

SEQ ID NO: 127302 - DNA, 22 bp, Artificial Sequence
  chemically synthesized
ctgctccctcctctcttccctc

SEQ ID NO: 127303 - DNA, 22 bp, Artificial Sequence
  chemically synthesized
tgctccctcctctcttccctct

SEQ ID NO: 127304 - DNA, 22 bp, Artificial Sequence
  chemically synthesized
ctccctcctctcttccctctct

SEQ ID NO: 127305 - DNA, 22 bp, Artificial Sequence
  chemically synthesized
cctcctctcttccctctctccc

SEQ ID NO: 127306 - DNA, 22 bp, Artificial Sequence
  chemically synthesized
ctctcttccctctctccctacc

SEQ ID NO: 127307 - DNA, 22 bp, Artificial Sequence
  chemically synthesized
tcttccctctctccctacctcc

SEQ ID NO: 127308 - DNA, 22 bp, Artificial Sequence
  chemically synthesized
ttccctctctccctacctcctt

SEQ ID NO: 127309 - DNA, 22 bp, Artificial Sequence
  chemically synthesized
ccctctctccctacctccttcc

SEQ ID NO: 127310 - DNA, 22 bp, Artificial Sequence
  chemically synthesized
cctctctccctacctccttcct

SEQ ID NO: 127311 - DNA, 22 bp, Artificial Sequence
  chemically synthesized
tctccctacctccttccttcca

SEQ ID NO: 127312 - DNA, 22 bp, Artificial Sequence
  chemically synthesized
tccctacctccttccttccatc

SEQ ID NO: 127313 - DNA, 22 bp, Artificial Sequence
  chemically synthesized
cctacctccttccttccatctt

SEQ ID NO: 127314 - DNA, 22 bp, Artificial Sequence
  chemically synthesized
cctccttccttccatctttttc

SEQ ID NO: 127315 - DNA, 22 bp, Artificial Sequence
  chemically synthesized
cttccttccatctttttctcta

SEQ ID NO: 127316 - DNA, 22 bp, Artificial Sequence
  chemically synthesized
ccttccatctttttctctatta

SEQ ID NO: 127317 - DNA, 22 bp, Artificial Sequence
  chemically synthesized
cttccatctttttctctattat

SEQ ID NO: 127318 - DNA, 22 bp, Artificial Sequence
  chemically synthesized
ccatctttttctctattatttg

SEQ ID NO: 127319 - DNA, 22 bp, Artificial Sequence
  chemically synthesized
catctttttctctattatttgt

SEQ ID NO: 127320 - DNA, 22 bp, Artificial Sequence
  chemically synthesized
tttctctattatttgtgccctc

SEQ ID NO: 127321 - DNA, 22 bp, Artificial Sequence
  chemically synthesized
ttctctattatttgtgccctca

SEQ ID NO: 127322 - DNA, 22 bp, Artificial Sequence
  chemically synthesized
tctctattatttgtgccctcag

SEQ ID NO: 127323 - DNA, 22 bp, Artificial Sequence
  chemically synthesized
ctctattatttgtgccctcagc

SEQ ID NO: 127324 - DNA, 22 bp, Artificial Sequence
  chemically synthesized
tctattatttgtgccctcagcc

SEQ ID NO: 127325 - DNA, 22 bp, Artificial Sequence
  chemically synthesized
tattatttgtgccctcagcctt

SEQ ID NO: 127326 - DNA, 22 bp, Artificial Sequence
  chemically synthesized
ttatttgtgccctcagccttgt

SEQ ID NO: 127327 - DNA, 22 bp, Artificial Sequence
  chemically synthesized
tttgtgccctcagccttgtggg

SEQ ID NO: 127328 - DNA, 22 bp, Artificial Sequence
  chemically synthesized
gtgccctcagccttgtgggtat

SEQ ID NO: 127329 - DNA, 22 bp, Artificial Sequence
  chemically synthesized
tgccctcagccttgtgggtatt

SEQ ID NO: 127330 - DNA, 22 bp, Artificial Sequence
  chemically synthesized
agccttgtgggtattgggcttt

SEQ ID NO: 127331 - DNA, 22 bp, Artificial Sequence
  chemically synthesized
gtgggtattgggctttgaacag

SEQ ID NO: 127332 - DNA, 22 bp, Artificial Sequence
  chemically synthesized
tgggtattgggctttgaacagc

SEQ ID NO: 127333 - DNA, 22 bp, Artificial Sequence
  chemically synthesized
ggctttgaacagcacaactcaa

SEQ ID NO: 127334 - DNA, 22 bp, Artificial Sequence
  chemically synthesized
tgaacagcacaactcaagatct

SEQ ID NO: 127335 - DNA, 22 bp, Artificial Sequence
  chemically synthesized
gaacagcacaactcaagatctc

SEQ ID NO: 127336 - DNA, 22 bp, Artificial Sequence
  chemically synthesized
aacagcacaactcaagatctct

SEQ ID NO: 127337 - DNA, 22 bp, Artificial Sequence
  chemically synthesized
aagatctctgtctctgtcctgg

SEQ ID NO: 127338 - DNA, 22 bp, Artificial Sequence
  chemically synthesized
tgtctctgtcctggcttttact

SEQ ID NO: 127339 - DNA, 22 bp, Artificial Sequence
  chemically synthesized
tctctgtcctggcttttactgg

SEQ ID NO: 127340 - DNA, 22 bp, Artificial Sequence
  chemically synthesized
tgtcctggcttttactggaggt

SEQ ID NO: 127341 - DNA, 22 bp, Artificial Sequence
  chemically synthesized
tcctggcttttactggaggttt

SEQ ID NO: 127342 - DNA, 22 bp, Artificial Sequence
  chemically synthesized
gcttttactggaggttttcctc

SEQ ID NO: 127343 - DNA, 22 bp, Artificial Sequence
  chemically synthesized
ttactggaggttttcctctgtt

SEQ ID NO: 127344 - DNA, 22 bp, Artificial Sequence
  chemically synthesized
tactggaggttttcctctgttg

SEQ ID NO: 127345 - DNA, 22 bp, Artificial Sequence
  chemically synthesized
actggaggttttcctctgttgg

SEQ ID NO: 127346 - DNA, 22 bp, Artificial Sequence
  chemically synthesized
ctggaggttttcctctgttgga

SEQ ID NO: 127347 - DNA, 22 bp, Artificial Sequence
  chemically synthesized
gaggttttcctctgttggaggt

SEQ ID NO: 127348 - DNA, 22 bp, Artificial Sequence
  chemically synthesized
tcctctgttggaggttgaatat

SEQ ID NO: 127349 - DNA, 22 bp, Artificial Sequence
  chemically synthesized
cctctgttggaggttgaatatt

SEQ ID NO: 127350 - DNA, 22 bp, Artificial Sequence
  chemically synthesized
ctctgttggaggttgaatattt

SEQ ID NO: 127351 - DNA, 22 bp, Artificial Sequence
  chemically synthesized
tgttggaggttgaatattttgt

SEQ ID NO: 127352 - DNA, 22 bp, Artificial Sequence
  chemically synthesized
ttggaggttgaatattttgtct

SEQ ID NO: 127353 - DNA, 22 bp, Artificial Sequence
  chemically synthesized
gaggttgaatattttgtctaca

SEQ ID NO: 127354 - DNA, 22 bp, Artificial Sequence
  chemically synthesized
aatattttgtctacattgtggc

SEQ ID NO: 127355 - DNA, 22 bp, Artificial Sequence
  chemically synthesized
tgtctacattgtggctttggct

SEQ ID NO: 127356 - DNA, 22 bp, Artificial Sequence
  chemically synthesized
gtctacattgtggctttggctc

SEQ ID NO: 127357 - DNA, 22 bp, Artificial Sequence
  chemically synthesized
tctacattgtggctttggctct

SEQ ID NO: 127358 - DNA, 22 bp, Artificial Sequence
  chemically synthesized
cattgtggctttggctcttgct

SEQ ID NO: 127359 - DNA, 22 bp, Artificial Sequence
  chemically synthesized
tggctttggctcttgctgtgct

SEQ ID NO: 127360 - DNA, 22 bp, Artificial Sequence
  chemically synthesized
tggctcttgctgtgctactttg

SEQ ID NO: 127361 - DNA, 22 bp, Artificial Sequence
  chemically synthesized
ggctcttgctgtgctactttgg

SEQ ID NO: 127362 - DNA, 22 bp, Artificial Sequence
  chemically synthesized
gctcttgctgtgctactttgga

SEQ ID NO: 127363 - DNA, 22 bp, Artificial Sequence
  chemically synthesized
ttgctgtgctactttggaatta

SEQ ID NO: 127364 - DNA, 22 bp, Artificial Sequence
  chemically synthesized
gctgtgctactttggaattatt

SEQ ID NO: 127365 - DNA, 22 bp, Artificial Sequence
  chemically synthesized
ctgtgctactttggaattattt

SEQ ID NO: 127366 - DNA, 22 bp, Artificial Sequence
  chemically synthesized
tgctactttggaattattttat

SEQ ID NO: 127367 - DNA, 22 bp, Artificial Sequence
  chemically synthesized
ctttggaattattttatctcat

SEQ ID NO: 127368 - DNA, 22 bp, Artificial Sequence
  chemically synthesized
tggaattattttatctcattgc

SEQ ID NO: 127369 - DNA, 22 bp, Artificial Sequence
  chemically synthesized
ggaattattttatctcattgca

SEQ ID NO: 127370 - DNA, 22 bp, Artificial Sequence
  chemically synthesized
gaattattttatctcattgcat

SEQ ID NO: 127371 - DNA, 22 bp, Artificial Sequence
  chemically synthesized
ttttatctcattgcatttcata

SEQ ID NO: 127372 - DNA, 22 bp, Artificial Sequence
  chemically synthesized
tatctcattgcatttcatagtc

SEQ ID NO: 127373 - DNA, 22 bp, Artificial Sequence
  chemically synthesized
atctcattgcatttcatagtcc

SEQ ID NO: 127374 - DNA, 22 bp, Artificial Sequence
  chemically synthesized
tctcattgcatttcatagtcct

SEQ ID NO: 127375 - DNA, 22 bp, Artificial Sequence
  chemically synthesized
attgcatttcatagtccttact

SEQ ID NO: 127376 - DNA, 22 bp, Artificial Sequence
  chemically synthesized
catttcatagtccttactgtaa

SEQ ID NO: 127377 - DNA, 22 bp, Artificial Sequence
  chemically synthesized
catagtccttactgtaaaacgc

SEQ ID NO: 127378 - DNA, 22 bp, Artificial Sequence
  chemically synthesized
atagtccttactgtaaaacgca

SEQ ID NO: 127379 - DNA, 22 bp, Artificial Sequence
  chemically synthesized
actgtaaaacgcatataataat

SEQ ID NO: 127380 - DNA, 22 bp, Artificial Sequence
  chemically synthesized
ctgtaaaacgcatataataatt

SEQ ID NO: 127381 - DNA, 22 bp, Artificial Sequence
  chemically synthesized
taaaacgcatataataattgcc

SEQ ID NO: 127382 - DNA, 22 bp, Artificial Sequence
  chemically synthesized
ccatcacaaagtgatgtggtgt

SEQ ID NO: 127383 - DNA, 22 bp, Artificial Sequence
  chemically synthesized
ggctgaagcaccatgtgatgag

SEQ ID NO: 127384 - DNA, 22 bp, Artificial Sequence
  chemically synthesized
gctgaagcaccatgtgatgagt

SEQ ID NO: 127385 - DNA, 22 bp, Artificial Sequence
  chemically synthesized
aagcaccatgtgatgagtatgc

SEQ ID NO: 127386 - DNA, 22 bp, Artificial Sequence
  chemically synthesized
ctgcatcccctggaaaagagaa

SEQ ID NO: 127387 - DNA, 22 bp, Artificial Sequence
  chemically synthesized
catcccctggaaaagagaaaac

SEQ ID NO: 127388 - DNA, 22 bp, Artificial Sequence
  chemically synthesized
gaaaagagaaaacttctggtag

SEQ ID NO: 127389 - DNA, 22 bp, Artificial Sequence
  chemically synthesized
ctggtaggctaaactcaagaag

SEQ ID NO: 127390 - DNA, 22 bp, Artificial Sequence
  chemically synthesized
tggtaggctaaactcaagaagg

SEQ ID NO: 127391 - DNA, 22 bp, Artificial Sequence
  chemically synthesized
gtaggctaaactcaagaaggga

SEQ ID NO: 127392 - DNA, 22 bp, Artificial Sequence
  chemically synthesized
aactcaagaagggaatagttag

SEQ ID NO: 127393 - DNA, 22 bp, Artificial Sequence
  chemically synthesized
aagaagggaatagttagtgata

SEQ ID NO: 127394 - DNA, 22 bp, Artificial Sequence
  chemically synthesized
gtgataactgcagaatgtgcgt

SEQ ID NO: 127395 - DNA, 22 bp, Artificial Sequence
  chemically synthesized
cagaatgtgcgttcacgttggg

SEQ ID NO: 127396 - DNA, 22 bp, Artificial Sequence
  chemically synthesized
acgttgggtactagagaaggct

SEQ ID NO: 127397 - DNA, 22 bp, Artificial Sequence
  chemically synthesized
ggtactagagaaggctgcctga

SEQ ID NO: 127398 - DNA, 22 bp, Artificial Sequence
  chemically synthesized
gagaaggctgcctgaattttat

SEQ ID NO: 127399 - DNA, 22 bp, Artificial Sequence
  chemically synthesized
cctgaattttattatattgact

SEQ ID NO: 127400 - DNA, 22 bp, Artificial Sequence
  chemically synthesized
aattttattatattgactctag

SEQ ID NO: 127401 - DNA, 22 bp, Artificial Sequence
  chemically synthesized
tattatattgactctagtctat

SEQ ID NO: 127402 - DNA, 22 bp, Artificial Sequence
  chemically synthesized
attatattgactctagtctatc

SEQ ID NO: 127403 - DNA, 22 bp, Artificial Sequence
  chemically synthesized
ttatattgactctagtctatct

SEQ ID NO: 127404 - DNA, 22 bp, Artificial Sequence
  chemically synthesized
tattgactctagtctatctagc

SEQ ID NO: 127405 - DNA, 22 bp, Artificial Sequence
  chemically synthesized
actctagtctatctagctctct

SEQ ID NO: 127406 - DNA, 22 bp, Artificial Sequence
  chemically synthesized
tagtctatctagctctctgctt

SEQ ID NO: 127407 - DNA, 22 bp, Artificial Sequence
  chemically synthesized
gtctatctagctctctgctttc

SEQ ID NO: 127408 - DNA, 22 bp, Artificial Sequence
  chemically synthesized
tctagctctctgctttcaagct

SEQ ID NO: 127409 - DNA, 22 bp, Artificial Sequence
  chemically synthesized
gctctctgctttcaagctttct

SEQ ID NO: 127410 - DNA, 22 bp, Artificial Sequence
  chemically synthesized
tctgctttcaagctttctctga

SEQ ID NO: 127411 - DNA, 22 bp, Artificial Sequence
  chemically synthesized
tgctttcaagctttctctgatc

SEQ ID NO: 127412 - DNA, 22 bp, Artificial Sequence
  chemically synthesized
ctttcaagctttctctgatcta

SEQ ID NO: 127413 - DNA, 22 bp, Artificial Sequence
  chemically synthesized
tcaagctttctctgatctaaac

SEQ ID NO: 127414 - DNA, 22 bp, Artificial Sequence
  chemically synthesized
caagctttctctgatctaaacc

SEQ ID NO: 127415 - DNA, 22 bp, Artificial Sequence
  chemically synthesized
aagctttctctgatctaaacca

SEQ ID NO: 127416 - DNA, 22 bp, Artificial Sequence
  chemically synthesized
tctctgatctaaaccaagcagg

SEQ ID NO: 127417 - DNA, 22 bp, Artificial Sequence
  chemically synthesized
ctctgatctaaaccaagcagga

SEQ ID NO: 127418 - DNA, 22 bp, Artificial Sequence
  chemically synthesized
tctgatctaaaccaagcaggaa

SEQ ID NO: 127419 - DNA, 22 bp, Artificial Sequence
  chemically synthesized
tgatctaaaccaagcaggaaat

SEQ ID NO: 127420 - DNA, 22 bp, Artificial Sequence
  chemically synthesized
atctaaaccaagcaggaaatat

SEQ ID NO: 127421 - DNA, 22 bp, Artificial Sequence
  chemically synthesized
aaccaagcaggaaatatagtag

SEQ ID NO: 127422 - DNA, 22 bp, Artificial Sequence
  chemically synthesized
aggttacataggccaagaagat

SEQ ID NO: 127423 - DNA, 22 bp, Artificial Sequence
  chemically synthesized
cataggccaagaagatatatag

SEQ ID NO: 127424 - DNA, 22 bp, Artificial Sequence
  chemically synthesized
tctcttgagataaactgggaaa

SEQ ID NO: 127425 - DNA, 22 bp, Artificial Sequence
  chemically synthesized
ctcttgagataaactgggaaag

SEQ ID NO: 127426 - DNA, 22 bp, Artificial Sequence
  chemically synthesized
tcttgagataaactgggaaaga

SEQ ID NO: 127427 - DNA, 22 bp, Artificial Sequence
  chemically synthesized
ttgagataaactgggaaagatt

SEQ ID NO: 127428 - DNA, 22 bp, Artificial Sequence
  chemically synthesized
gagataaactgggaaagatttg

SEQ ID NO: 127429 - DNA, 22 bp, Artificial Sequence
  chemically synthesized
agataaactgggaaagatttga

SEQ ID NO: 127430 - DNA, 22 bp, Artificial Sequence
  chemically synthesized
ggaaagatttgactgttgaagt

SEQ ID NO: 127431 - DNA, 22 bp, Artificial Sequence
  chemically synthesized
gactgttgaagtaaatgtaggg

SEQ ID NO: 127432 - DNA, 22 bp, Artificial Sequence
  chemically synthesized
actgttgaagtaaatgtaggga

SEQ ID NO: 127433 - DNA, 22 bp, Artificial Sequence
  chemically synthesized
ttgaagtaaatgtagggaataa

SEQ ID NO: 127434 - DNA, 22 bp, Artificial Sequence
  chemically synthesized
aagtaaatgtagggaataaatt

SEQ ID NO: 127435 - DNA, 22 bp, Artificial Sequence
  chemically synthesized
cctcccagaggtgataccagag

SEQ ID NO: 127436 - DNA, 22 bp, Artificial Sequence
  chemically synthesized
ccagaggtgataccagagtctg

SEQ ID NO: 127437 - DNA, 22 bp, Artificial Sequence
  chemically synthesized
ctggggctatgaagacaggctg

SEQ ID NO: 127438 - DNA, 22 bp, Artificial Sequence
  chemically synthesized
gggctatgaagacaggctgtct

SEQ ID NO: 127439 - DNA, 22 bp, Artificial Sequence
  chemically synthesized
tgaagacaggctgtctgattcc

SEQ ID NO: 127440 - DNA, 22 bp, Artificial Sequence
  chemically synthesized
tctgattccccacacataaagg

SEQ ID NO: 127441 - DNA, 22 bp, Artificial Sequence
  chemically synthesized
attccccacacataaaggtcct

SEQ ID NO: 127442 - DNA, 22 bp, Artificial Sequence
  chemically synthesized
cccacacataaaggtcctacca

SEQ ID NO: 127443 - DNA, 22 bp, Artificial Sequence
  chemically synthesized
ccagtggcttgattcagccagt

SEQ ID NO: 127444 - DNA, 22 bp, Artificial Sequence
  chemically synthesized
gattcagccagtaacttatttg

SEQ ID NO: 127445 - DNA, 22 bp, Artificial Sequence
  chemically synthesized
attcagccagtaacttatttga

SEQ ID NO: 127446 - DNA, 22 bp, Artificial Sequence
  chemically synthesized
agccagtaacttatttgaaaaa

SEQ ID NO: 127447 - DNA, 22 bp, Artificial Sequence
  chemically synthesized
atttgaaaaaagaaagattatt

SEQ ID NO: 127448 - DNA, 22 bp, Artificial Sequence
  chemically synthesized
tttgaaaaaagaaagattattt

SEQ ID NO: 127449 - DNA, 22 bp, Artificial Sequence
  chemically synthesized
gaaaaaagaaagattatttaaa

SEQ ID NO: 127450 - DNA, 22 bp, Artificial Sequence
  chemically synthesized
aaaaaagaaagattatttaaaa

SEQ ID NO: 127451 - DNA, 22 bp, Artificial Sequence
  chemically synthesized
tttaaaagcttggggggactaa

SEQ ID NO: 127452 - DNA, 22 bp, Artificial Sequence
  chemically synthesized
aaaagcttggggggactaatta

SEQ ID NO: 127453 - DNA, 22 bp, Artificial Sequence
  chemically synthesized
aaagcttggggggactaattaa

SEQ ID NO: 127454 - DNA, 22 bp, Artificial Sequence
  chemically synthesized
ggggggactaattaagtgttcc

SEQ ID NO: 127455 - DNA, 22 bp, Artificial Sequence
  chemically synthesized
gggggactaattaagtgttcca

SEQ ID NO: 127456 - DNA, 22 bp, Artificial Sequence
  chemically synthesized
attaagtgttccagctccctct

SEQ ID NO: 127457 - DNA, 22 bp, Artificial Sequence
  chemically synthesized
agtgttccagctccctctaagg

SEQ ID NO: 127458 - DNA, 22 bp, Artificial Sequence
  chemically synthesized
cagctccctctaaggaggagtt

SEQ ID NO: 127459 - DNA, 22 bp, Artificial Sequence
  chemically synthesized
cctctaaggaggagttaataca

SEQ ID NO: 127460 - DNA, 22 bp, Artificial Sequence
  chemically synthesized
taaggaggagttaatacagagt

SEQ ID NO: 127461 - DNA, 22 bp, Artificial Sequence
  chemically synthesized
aggaggagttaatacagagtaa

SEQ ID NO: 127462 - DNA, 22 bp, Artificial Sequence
  chemically synthesized
atacagagtaaatatttcttaa

SEQ ID NO: 127463 - DNA, 22 bp, Artificial Sequence
  chemically synthesized
cttaagatccaagttggctata

SEQ ID NO: 127464 - DNA, 22 bp, Artificial Sequence
  chemically synthesized
ttaagatccaagttggctataa

SEQ ID NO: 127465 - DNA, 22 bp, Artificial Sequence
  chemically synthesized
aagatccaagttggctataaaa

SEQ ID NO: 127466 - DNA, 22 bp, Artificial Sequence
  chemically synthesized
agatccaagttggctataaaag

SEQ ID NO: 127467 - DNA, 22 bp, Artificial Sequence
  chemically synthesized
gctataaaagggagacatctgg

SEQ ID NO: 127468 - DNA, 22 bp, Artificial Sequence
  chemically synthesized
taaaagggagacatctgggaag

SEQ ID NO: 127469 - DNA, 22 bp, Artificial Sequence
  chemically synthesized
ggaaggtgctatctttattaat

SEQ ID NO: 127470 - DNA, 22 bp, Artificial Sequence
  chemically synthesized
tctttattaataaccacagtga

SEQ ID NO: 127471 - DNA, 22 bp, Artificial Sequence
  chemically synthesized
tattaataaccacagtgactgc

SEQ ID NO: 127472 - DNA, 22 bp, Artificial Sequence
  chemically synthesized
attaataaccacagtgactgct

SEQ ID NO: 127473 - DNA, 22 bp, Artificial Sequence
  chemically synthesized
ttaataaccacagtgactgctt

SEQ ID NO: 127474 - DNA, 22 bp, Artificial Sequence
  chemically synthesized
ataaccacagtgactgcttctc

SEQ ID NO: 127475 - DNA, 22 bp, Artificial Sequence
  chemically synthesized
cttctcttcacagatgttgaga

SEQ ID NO: 127476 - DNA, 22 bp, Artificial Sequence
  chemically synthesized
ctcttcacagatgttgagaagg

SEQ ID NO: 127477 - DNA, 22 bp, Artificial Sequence
  chemically synthesized
tcttcacagatgttgagaagga

SEQ ID NO: 127478 - DNA, 22 bp, Artificial Sequence
  chemically synthesized
ttcacagatgttgagaaggaac

SEQ ID NO: 127479 - DNA, 22 bp, Artificial Sequence
  chemically synthesized
cacagatgttgagaaggaacaa

SEQ ID NO: 127480 - DNA, 22 bp, Artificial Sequence
  chemically synthesized
acagatgttgagaaggaacaac

SEQ ID NO: 127481 - DNA, 22 bp, Artificial Sequence
  chemically synthesized
agaaggaacaacatgatctaag

SEQ ID NO: 127482 - DNA, 22 bp, Artificial Sequence
  chemically synthesized
agtctttaggtaagacacaaga

SEQ ID NO: 127483 - DNA, 22 bp, Artificial Sequence
  chemically synthesized
taggtaagacacaagaaccctg

SEQ ID NO: 127484 - DNA, 22 bp, Artificial Sequence
  chemically synthesized
aggtaagacacaagaaccctgc

SEQ ID NO: 127485 - DNA, 22 bp, Artificial Sequence
  chemically synthesized
ggtaagacacaagaaccctgct

SEQ ID NO: 127486 - DNA, 22 bp, Artificial Sequence
  chemically synthesized
ctcttcctcaccatcaaacaag

SEQ ID NO: 127487 - DNA, 22 bp, Artificial Sequence
  chemically synthesized
ttcctcaccatcaaacaagtta

SEQ ID NO: 127488 - DNA, 22 bp, Artificial Sequence
  chemically synthesized
cctcaccatcaaacaagttatg

SEQ ID NO: 127489 - DNA, 22 bp, Artificial Sequence
  chemically synthesized
ctcaccatcaaacaagttatgg

SEQ ID NO: 127490 - DNA, 22 bp, Artificial Sequence
  chemically synthesized
accatcaaacaagttatggtac

SEQ ID NO: 127491 - DNA, 22 bp, Artificial Sequence
  chemically synthesized
tggtacctgggagtatggtgaa

SEQ ID NO: 127492 - DNA, 22 bp, Artificial Sequence
  chemically synthesized
ggagtatggtgaaatactccta

SEQ ID NO: 127493 - DNA, 22 bp, Artificial Sequence
  chemically synthesized
ctagatatataaagagtgtact

SEQ ID NO: 127494 - DNA, 22 bp, Artificial Sequence
  chemically synthesized
gatatataaagagtgtactagg

SEQ ID NO: 127495 - DNA, 22 bp, Artificial Sequence
  chemically synthesized
ggagactcctctataagctctc

SEQ ID NO: 127496 - DNA, 22 bp, Artificial Sequence
  chemically synthesized
ctctataagctctccagagaaa

SEQ ID NO: 127497 - DNA, 22 bp, Artificial Sequence
  chemically synthesized
tataagctctccagagaaagat

SEQ ID NO: 127498 - DNA, 22 bp, Artificial Sequence
  chemically synthesized
taagctctccagagaaagatac

SEQ ID NO: 127499 - DNA, 22 bp, Artificial Sequence
  chemically synthesized
tccagagaaagatacggagaag

SEQ ID NO: 127500 - DNA, 22 bp, Artificial Sequence
  chemically synthesized
cagagaaagatacggagaagaa

SEQ ID NO: 127501 - DNA, 22 bp, Artificial Sequence
  chemically synthesized
aatagtccacagctttggatgt

SEQ ID NO: 127502 - DNA, 22 bp, Artificial Sequence
  chemically synthesized
tggatgtgtgcacagatttcag

SEQ ID NO: 127503 - DNA, 22 bp, Artificial Sequence
  chemically synthesized
ggatgtgtgcacagatttcagt

SEQ ID NO: 127504 - DNA, 22 bp, Artificial Sequence
  chemically synthesized
gatgtgtgcacagatttcagtc

SEQ ID NO: 127505 - DNA, 22 bp, Artificial Sequence
  chemically synthesized
cagtctgaagttgatagaactt

SEQ ID NO: 127506 - DNA, 22 bp, Artificial Sequence
  chemically synthesized
agtctgaagttgatagaacttc

SEQ ID NO: 127507 - DNA, 22 bp, Artificial Sequence
  chemically synthesized
aagttgatagaacttcaaaagc

SEQ ID NO: 127508 - DNA, 22 bp, Artificial Sequence
  chemically synthesized
atagaacttcaaaagcaattcc

SEQ ID NO: 127509 - DNA, 22 bp, Artificial Sequence
  chemically synthesized
caaaagcaattccaagtgctac

SEQ ID NO: 127510 - DNA, 22 bp, Artificial Sequence
  chemically synthesized
aaaagcaattccaagtgctacc

SEQ ID NO: 127511 - DNA, 22 bp, Artificial Sequence
  chemically synthesized
caagtgctaccaaccaactacc

SEQ ID NO: 127512 - DNA, 22 bp, Artificial Sequence
  chemically synthesized
ccaaccaactacctaagacctt

SEQ ID NO: 127513 - DNA, 22 bp, Artificial Sequence
  chemically synthesized
cctaagaccttctgtactcagt

SEQ ID NO: 127514 - DNA, 22 bp, Artificial Sequence
  chemically synthesized
agaccttctgtactcagtgatg

SEQ ID NO: 127515 - DNA, 22 bp, Artificial Sequence
  chemically synthesized
ctgtactcagtgatgtgaatat

SEQ ID NO: 127516 - DNA, 22 bp, Artificial Sequence
  chemically synthesized
tgtactcagtgatgtgaatatg

SEQ ID NO: 127517 - DNA, 22 bp, Artificial Sequence
  chemically synthesized
tactcagtgatgtgaatatgat

SEQ ID NO: 127518 - DNA, 22 bp, Artificial Sequence
  chemically synthesized
agtgatgtgaatatgattgacc

SEQ ID NO: 127519 - DNA, 22 bp, Artificial Sequence
  chemically synthesized
accctctcatatgtcttctttc

SEQ ID NO: 127520 - DNA, 22 bp, Artificial Sequence
  chemically synthesized
tcatatgtcttctttcctttct

SEQ ID NO: 127521 - DNA, 22 bp, Artificial Sequence
  chemically synthesized
atatgtcttctttcctttctaa

SEQ ID NO: 127522 - DNA, 22 bp, Artificial Sequence
  chemically synthesized
ctttcctttctaaaagatgaac

SEQ ID NO: 127523 - DNA, 22 bp, Artificial Sequence
  chemically synthesized
tttcctttctaaaagatgaaca

SEQ ID NO: 127524 - DNA, 22 bp, Artificial Sequence
  chemically synthesized
tcctttctaaaagatgaacagg

SEQ ID NO: 127525 - DNA, 22 bp, Artificial Sequence
  chemically synthesized
cctttctaaaagatgaacagga

SEQ ID NO: 127526 - DNA, 22 bp, Artificial Sequence
  chemically synthesized
ctttctaaaagatgaacaggaa

SEQ ID NO: 127527 - DNA, 22 bp, Artificial Sequence
  chemically synthesized
tctaaaagatgaacaggaaggc

SEQ ID NO: 127528 - DNA, 22 bp, Artificial Sequence
  chemically synthesized
ctaaaagatgaacaggaaggca

SEQ ID NO: 127529 - DNA, 22 bp, Artificial Sequence
  chemically synthesized
taaaagatgaacaggaaggcac

SEQ ID NO: 127530 - DNA, 22 bp, Artificial Sequence
  chemically synthesized
aaagatgaacaggaaggcacct

SEQ ID NO: 127531 - DNA, 22 bp, Artificial Sequence
  chemically synthesized
ttattctactacattttacttt

SEQ ID NO: 127532 - DNA, 22 bp, Artificial Sequence
  chemically synthesized
attctactacattttacttttt

SEQ ID NO: 127533 - DNA, 22 bp, Artificial Sequence
  chemically synthesized
ttctactacattttacttttta

SEQ ID NO: 127534 - DNA, 22 bp, Artificial Sequence
  chemically synthesized
tactacattttactttttaaac

SEQ ID NO: 127535 - DNA, 22 bp, Artificial Sequence
  chemically synthesized
ctacattttactttttaaacaa

SEQ ID NO: 127536 - DNA, 22 bp, Artificial Sequence
  chemically synthesized
cattttactttttaaacaaagc

SEQ ID NO: 127537 - DNA, 22 bp, Artificial Sequence
  chemically synthesized
tactttttaaacaaagcagaga

SEQ ID NO: 127538 - DNA, 22 bp, Artificial Sequence
  chemically synthesized
actttttaaacaaagcagagaa

SEQ ID NO: 127539 - DNA, 22 bp, Artificial Sequence
  chemically synthesized
ctttttaaacaaagcagagaaa

SEQ ID NO: 127540 - DNA, 22 bp, Artificial Sequence
  chemically synthesized
tttaaacaaagcagagaaaaat

SEQ ID NO: 127541 - DNA, 22 bp, Artificial Sequence
  chemically synthesized
ttaaacaaagcagagaaaaatt

SEQ ID NO: 127542 - DNA, 22 bp, Artificial Sequence
  chemically synthesized
taaacaaagcagagaaaaatta

SEQ ID NO: 127543 - DNA, 22 bp, Artificial Sequence
  chemically synthesized
aaacaaagcagagaaaaattat

SEQ ID NO: 127544 - DNA, 22 bp, Artificial Sequence
  chemically synthesized
aacaaagcagagaaaaattatg

SEQ ID NO: 127545 - DNA, 22 bp, Artificial Sequence
  chemically synthesized
tggctgtaaatgttagaagttt

SEQ ID NO: 127546 - DNA, 22 bp, Artificial Sequence
  chemically synthesized
taaatgttagaagtttatctga

SEQ ID NO: 127547 - DNA, 22 bp, Artificial Sequence
  chemically synthesized
gaagtttatctgattttctagg

SEQ ID NO: 127548 - DNA, 22 bp, Artificial Sequence
  chemically synthesized
atctgattttctaggtgttcca

SEQ ID NO: 127549 - DNA, 22 bp, Artificial Sequence
  chemically synthesized
tctgattttctaggtgttccat

SEQ ID NO: 127550 - DNA, 22 bp, Artificial Sequence
  chemically synthesized
attttctaggtgttccattata

SEQ ID NO: 127551 - DNA, 22 bp, Artificial Sequence
  chemically synthesized
tctaggtgttccattatagaat

SEQ ID NO: 127552 - DNA, 22 bp, Artificial Sequence
  chemically synthesized
ctaggtgttccattatagaatc

SEQ ID NO: 127553 - DNA, 22 bp, Artificial Sequence
  chemically synthesized
taggtgttccattatagaatct

SEQ ID NO: 127554 - DNA, 22 bp, Artificial Sequence
  chemically synthesized
ggtgttccattatagaatcttc

SEQ ID NO: 127555 - DNA, 22 bp, Artificial Sequence
  chemically synthesized
cattatagaatcttcttgcttc

SEQ ID NO: 127556 - DNA, 22 bp, Artificial Sequence
  chemically synthesized
tagaatcttcttgcttctatcc

SEQ ID NO: 127557 - DNA, 22 bp, Artificial Sequence
  chemically synthesized
cttgcttctatcctcagtcttt

SEQ ID NO: 127558 - DNA, 22 bp, Artificial Sequence
  chemically synthesized
ttgcttctatcctcagtcttta

SEQ ID NO: 127559 - DNA, 22 bp, Artificial Sequence
  chemically synthesized
gcttctatcctcagtctttatg

SEQ ID NO: 127560 - DNA, 22 bp, Artificial Sequence
  chemically synthesized
cttctatcctcagtctttatga

SEQ ID NO: 127561 - DNA, 22 bp, Artificial Sequence
  chemically synthesized
ctatcctcagtctttatgatct

SEQ ID NO: 127562 - DNA, 22 bp, Artificial Sequence
  chemically synthesized
tatcctcagtctttatgatctc

SEQ ID NO: 127563 - DNA, 22 bp, Artificial Sequence
  chemically synthesized
tcctcagtctttatgatctctt

SEQ ID NO: 127564 - DNA, 22 bp, Artificial Sequence
  chemically synthesized
agtctttatgatctctttcctt

SEQ ID NO: 127565 - DNA, 22 bp, Artificial Sequence
  chemically synthesized
tatgatctctttccttccctat

SEQ ID NO: 127566 - DNA, 22 bp, Artificial Sequence
  chemically synthesized
atgatctctttccttccctata

SEQ ID NO: 127567 - DNA, 22 bp, Artificial Sequence
  chemically synthesized
tgatctctttccttccctatat

SEQ ID NO: 127568 - DNA, 22 bp, Artificial Sequence
  chemically synthesized
tttccttccctatatttttttt

SEQ ID NO: 127569 - DNA, 22 bp, Artificial Sequence
  chemically synthesized
tccttccctatattttttttcc

SEQ ID NO: 127570 - DNA, 22 bp, Artificial Sequence
  chemically synthesized
ccttccctatattttttttcct

SEQ ID NO: 127571 - DNA, 22 bp, Artificial Sequence
  chemically synthesized
cttccctatattttttttcctc

SEQ ID NO: 127572 - DNA, 22 bp, Artificial Sequence
  chemically synthesized
ccctatattttttttcctcagc

SEQ ID NO: 127573 - DNA, 22 bp, Artificial Sequence
  chemically synthesized
cctatattttttttcctcagct

SEQ ID NO: 127574 - DNA, 22 bp, Artificial Sequence
  chemically synthesized
tattttttttcctcagctttta

SEQ ID NO: 127575 - DNA, 22 bp, Artificial Sequence
  chemically synthesized
tttttcctcagcttttatctct

SEQ ID NO: 127576 - DNA, 22 bp, Artificial Sequence
  chemically synthesized
ttttcctcagcttttatctctt

SEQ ID NO: 127577 - DNA, 22 bp, Artificial Sequence
  chemically synthesized
tttcctcagcttttatctcttc

SEQ ID NO: 127578 - DNA, 22 bp, Artificial Sequence
  chemically synthesized
ttcctcagcttttatctcttct

SEQ ID NO: 127579 - DNA, 22 bp, Artificial Sequence
  chemically synthesized
tcctcagcttttatctcttctc

SEQ ID NO: 127580 - DNA, 22 bp, Artificial Sequence
  chemically synthesized
cctcagcttttatctcttctct

SEQ ID NO: 127581 - DNA, 22 bp, Artificial Sequence
  chemically synthesized
ctcagcttttatctcttctctc

SEQ ID NO: 127582 - DNA, 22 bp, Artificial Sequence
  chemically synthesized
agcttttatctcttctctcatt

SEQ ID NO: 127583 - DNA, 22 bp, Artificial Sequence
  chemically synthesized
ttatctcttctctcattgtctt

SEQ ID NO: 127584 - DNA, 22 bp, Artificial Sequence
  chemically synthesized
tatctcttctctcattgtcttt

SEQ ID NO: 127585 - DNA, 22 bp, Artificial Sequence
  chemically synthesized
atctcttctctcattgtctttc

SEQ ID NO: 127586 - DNA, 22 bp, Artificial Sequence
  chemically synthesized
tctcttctctcattgtctttct

SEQ ID NO: 127587 - DNA, 22 bp, Artificial Sequence
  chemically synthesized
ttctctcattgtctttcttctc

SEQ ID NO: 127588 - DNA, 22 bp, Artificial Sequence
  chemically synthesized
ctctcattgtctttcttctcag

SEQ ID NO: 127589 - DNA, 22 bp, Artificial Sequence
  chemically synthesized
tctcattgtctttcttctcaga

SEQ ID NO: 127590 - DNA, 22 bp, Artificial Sequence
  chemically synthesized
tcattgtctttcttctcagaaa

SEQ ID NO: 127591 - DNA, 22 bp, Artificial Sequence
  chemically synthesized
attgtctttcttctcagaaacc

SEQ ID NO: 127592 - DNA, 22 bp, Artificial Sequence
  chemically synthesized
tctttcttctcagaaaccaaga

SEQ ID NO: 127593 - DNA, 22 bp, Artificial Sequence
  chemically synthesized
tcttctcagaaaccaagagcca

SEQ ID NO: 127594 - DNA, 22 bp, Artificial Sequence
  chemically synthesized
cttctcagaaaccaagagccac

SEQ ID NO: 127595 - DNA, 22 bp, Artificial Sequence
  chemically synthesized
ttctcagaaaccaagagccacg

SEQ ID NO: 127596 - DNA, 22 bp, Artificial Sequence
  chemically synthesized
ctcagaaaccaagagccacgac

SEQ ID NO: 127597 - DNA, 22 bp, Artificial Sequence
  chemically synthesized
tcagaaaccaagagccacgact

SEQ ID NO: 127598 - DNA, 22 bp, Artificial Sequence
  chemically synthesized
agaaaccaagagccacgactag

SEQ ID NO: 127599 - DNA, 22 bp, Artificial Sequence
  chemically synthesized
gctgaggacacaagaattttca

SEQ ID NO: 127600 - DNA, 22 bp, Artificial Sequence
  chemically synthesized
aggacacaagaattttcacaaa

SEQ ID NO: 127601 - DNA, 22 bp, Artificial Sequence
  chemically synthesized
tcacaaaacaaagtagagtgat

SEQ ID NO: 127602 - DNA, 22 bp, Artificial Sequence
  chemically synthesized
cacaaaacaaagtagagtgatt

SEQ ID NO: 127603 - DNA, 22 bp, Artificial Sequence
  chemically synthesized
acaaaacaaagtagagtgattc

SEQ ID NO: 127604 - DNA, 22 bp, Artificial Sequence
  chemically synthesized
catagatcactattatagctgc

SEQ ID NO: 127605 - DNA, 22 bp, Artificial Sequence
  chemically synthesized
ttatagctgcattaccaggtat

SEQ ID NO: 127606 - DNA, 22 bp, Artificial Sequence
  chemically synthesized
tagctgcattaccaggtatgtc

SEQ ID NO: 127607 - DNA, 22 bp, Artificial Sequence
  chemically synthesized
cattaccaggtatgtctgcatg

SEQ ID NO: 127608 - DNA, 22 bp, Artificial Sequence
  chemically synthesized
ccaggtatgtctgcatggaatt

SEQ ID NO: 127609 - DNA, 22 bp, Artificial Sequence
  chemically synthesized
catggaattcttgggaatggag

SEQ ID NO: 127610 - DNA, 22 bp, Artificial Sequence
  chemically synthesized
ttgggaatggagaaggaggaaa

SEQ ID NO: 127611 - DNA, 22 bp, Artificial Sequence
  chemically synthesized
gggaatggagaaggaggaaact

SEQ ID NO: 127612 - DNA, 22 bp, Artificial Sequence
  chemically synthesized
ggaatggagaaggaggaaactt

SEQ ID NO: 127613 - DNA, 22 bp, Artificial Sequence
  chemically synthesized
taagttgcaggttattattggc

SEQ ID NO: 127614 - DNA, 22 bp, Artificial Sequence
  chemically synthesized
aagttgcaggttattattggca

SEQ ID NO: 127615 - DNA, 22 bp, Artificial Sequence
  chemically synthesized
agttgcaggttattattggcaa

SEQ ID NO: 127616 - DNA, 22 bp, Artificial Sequence
  chemically synthesized
caggttattattggcaaaatac

SEQ ID NO: 127617 - DNA, 22 bp, Artificial Sequence
  chemically synthesized
ttattggcaaaatacaatcatt

SEQ ID NO: 127618 - DNA, 22 bp, Artificial Sequence
  chemically synthesized
ttggcaaaatacaatcattgcc

SEQ ID NO: 127619 - DNA, 22 bp, Artificial Sequence
  chemically synthesized
gcaaaatacaatcattgcctta

SEQ ID NO: 127620 - DNA, 22 bp, Artificial Sequence
  chemically synthesized
ccttacagtttggttagctttc

SEQ ID NO: 127621 - DNA, 22 bp, Artificial Sequence
  chemically synthesized
acagtttggttagctttccctg

SEQ ID NO: 127622 - DNA, 22 bp, Artificial Sequence
  chemically synthesized
cagtttggttagctttccctgt

SEQ ID NO: 127623 - DNA, 22 bp, Artificial Sequence
  chemically synthesized
ggttagctttccctgtagtgat

SEQ ID NO: 127624 - DNA, 22 bp, Artificial Sequence
  chemically synthesized
gttagctttccctgtagtgatt

SEQ ID NO: 127625 - DNA, 22 bp, Artificial Sequence
  chemically synthesized
gctttccctgtagtgattcatc

SEQ ID NO: 127626 - DNA, 22 bp, Artificial Sequence
  chemically synthesized
tccctgtagtgattcatcactt

SEQ ID NO: 127627 - DNA, 22 bp, Artificial Sequence
  chemically synthesized
ccctgtagtgattcatcacttg

SEQ ID NO: 127628 - DNA, 22 bp, Artificial Sequence
  chemically synthesized
cctgtagtgattcatcacttgt

SEQ ID NO: 127629 - DNA, 22 bp, Artificial Sequence
  chemically synthesized
tagtgattcatcacttgtgctg

SEQ ID NO: 127630 - DNA, 22 bp, Artificial Sequence
  chemically synthesized
atcacttgtgctgcatattctc

SEQ ID NO: 127631 - DNA, 22 bp, Artificial Sequence
  chemically synthesized
gtgctgcatattctctgataag

SEQ ID NO: 127632 - DNA, 22 bp, Artificial Sequence
  chemically synthesized
tgctgcatattctctgataaga

SEQ ID NO: 127633 - DNA, 22 bp, Artificial Sequence
  chemically synthesized
catattctctgataagaaggaa

SEQ ID NO: 127634 - DNA, 22 bp, Artificial Sequence
  chemically synthesized
tctgataagaaggaatttttca

SEQ ID NO: 127635 - DNA, 22 bp, Artificial Sequence
  chemically synthesized
tgataagaaggaatttttcaca

SEQ ID NO: 127636 - DNA, 22 bp, Artificial Sequence
  chemically synthesized
ataagaaggaatttttcacaaa

SEQ ID NO: 127637 - DNA, 22 bp, Artificial Sequence
  chemically synthesized
ttcacaaagttgagatacagtg

SEQ ID NO: 127638 - DNA, 22 bp, Artificial Sequence
  chemically synthesized
tcacaaagttgagatacagtga

SEQ ID NO: 127639 - DNA, 22 bp, Artificial Sequence
  chemically synthesized
cacaaagttgagatacagtgaa

SEQ ID NO: 127640 - DNA, 22 bp, Artificial Sequence
  chemically synthesized
acaaagttgagatacagtgaaa

SEQ ID NO: 127641 - DNA, 22 bp, Artificial Sequence
  chemically synthesized
agatacagtgaaagattaggtt

SEQ ID NO: 127642 - DNA, 22 bp, Artificial Sequence
  chemically synthesized
ggttaaaggagattattgctga

SEQ ID NO: 127643 - DNA, 22 bp, Artificial Sequence
  chemically synthesized
aaggagattattgctgaaacgt

SEQ ID NO: 127644 - DNA, 22 bp, Artificial Sequence
  chemically synthesized
ttgctgaaacgtcagagaagta

SEQ ID NO: 127645 - DNA, 22 bp, Artificial Sequence
  chemically synthesized
ctgaaacgtcagagaagtaaga

SEQ ID NO: 127646 - DNA, 22 bp, Artificial Sequence
  chemically synthesized
aaacgtcagagaagtaagagtg

SEQ ID NO: 127647 - DNA, 22 bp, Artificial Sequence
  chemically synthesized
acagagaaatgaagtacataga

SEQ ID NO: 127648 - DNA, 22 bp, Artificial Sequence
  chemically synthesized
agctggattatctttgcgtcta

SEQ ID NO: 127649 - DNA, 22 bp, Artificial Sequence
  chemically synthesized
gattatctttgcgtctagtaac

SEQ ID NO: 127650 - DNA, 22 bp, Artificial Sequence
  chemically synthesized
tctttgcgtctagtaactgaag

SEQ ID NO: 127651 - DNA, 22 bp, Artificial Sequence
  chemically synthesized
tgcgtctagtaactgaagaata

SEQ ID NO: 127652 - DNA, 22 bp, Artificial Sequence
  chemically synthesized
gcgtctagtaactgaagaatat

SEQ ID NO: 127653 - DNA, 22 bp, Artificial Sequence
  chemically synthesized
cgtctagtaactgaagaatata

SEQ ID NO: 127654 - DNA, 22 bp, Artificial Sequence
  chemically synthesized
gtaactgaagaatatacatcac

SEQ ID NO: 127655 - DNA, 22 bp, Artificial Sequence
  chemically synthesized
aagaatatacatcactcattgt

SEQ ID NO: 127656 - DNA, 22 bp, Artificial Sequence
  chemically synthesized
attgtatgttcagtaggcactg

SEQ ID NO: 127657 - DNA, 22 bp, Artificial Sequence
  chemically synthesized
tatgttcagtaggcactgaatt

SEQ ID NO: 127658 - DNA, 22 bp, Artificial Sequence
  chemically synthesized
agtaggcactgaattctggttt

SEQ ID NO: 127659 - DNA, 22 bp, Artificial Sequence
  chemically synthesized
aattctggtttatgtctctcag

SEQ ID NO: 127660 - DNA, 22 bp, Artificial Sequence
  chemically synthesized
tggtttatgtctctcagtccta

SEQ ID NO: 127661 - DNA, 22 bp, Artificial Sequence
  chemically synthesized
gtttatgtctctcagtcctagg

SEQ ID NO: 127662 - DNA, 22 bp, Artificial Sequence
  chemically synthesized
atgtctctcagtcctaggacag

SEQ ID NO: 127663 - DNA, 22 bp, Artificial Sequence
  chemically synthesized
tgtctctcagtcctaggacaga

SEQ ID NO: 127664 - DNA, 22 bp, Artificial Sequence
  chemically synthesized
tcagtcctaggacagaatatgg

SEQ ID NO: 127665 - DNA, 22 bp, Artificial Sequence
  chemically synthesized
agtcctaggacagaatatggat

SEQ ID NO: 127666 - DNA, 22 bp, Artificial Sequence
  chemically synthesized
ggacagaatatggatgctgaaa

SEQ ID NO: 127667 - DNA, 22 bp, Artificial Sequence
  chemically synthesized
aaaaatgattctttcaaagtgc

SEQ ID NO: 127668 - DNA, 22 bp, Artificial Sequence
  chemically synthesized
tttcaaagtgctgagttgttgc

SEQ ID NO: 127669 - DNA, 22 bp, Artificial Sequence
  chemically synthesized
tcaaagtgctgagttgttgcct

SEQ ID NO: 127670 - DNA, 22 bp, Artificial Sequence
  chemically synthesized
caaagtgctgagttgttgcctc

SEQ ID NO: 127671 - DNA, 22 bp, Artificial Sequence
  chemically synthesized
aaagtgctgagttgttgcctca

SEQ ID NO: 127672 - DNA, 22 bp, Artificial Sequence
  chemically synthesized
agttgttgcctcacgcccagtt

SEQ ID NO: 127673 - DNA, 22 bp, Artificial Sequence
  chemically synthesized
ttgcctcacgcccagttgtctg

SEQ ID NO: 127674 - DNA, 22 bp, Artificial Sequence
  chemically synthesized
cctcacgcccagttgtctggca

SEQ ID NO: 127675 - DNA, 22 bp, Artificial Sequence
  chemically synthesized
acgcccagttgtctggcatctc

SEQ ID NO: 127676 - DNA, 22 bp, Artificial Sequence
  chemically synthesized
tctggcatctcttcactgaaac

SEQ ID NO: 127677 - DNA, 22 bp, Artificial Sequence
  chemically synthesized
gcatctcttcactgaaactatt

SEQ ID NO: 127678 - DNA, 22 bp, Artificial Sequence
  chemically synthesized
ttcactgaaactattacagtta

SEQ ID NO: 127679 - DNA, 22 bp, Artificial Sequence
  chemically synthesized
cactgaaactattacagttaga

SEQ ID NO: 127680 - DNA, 22 bp, Artificial Sequence
  chemically synthesized
actgaaactattacagttagat

SEQ ID NO: 127681 - DNA, 22 bp, Artificial Sequence
  chemically synthesized
aaactattacagttagatctca

SEQ ID NO: 127682 - DNA, 22 bp, Artificial Sequence
  chemically synthesized
ttacagttagatctcatctcta

SEQ ID NO: 127683 - DNA, 22 bp, Artificial Sequence
  chemically synthesized
cagttagatctcatctctatgg

SEQ ID NO: 127684 - DNA, 22 bp, Artificial Sequence
  chemically synthesized
gatctcatctctatgggtggaa

SEQ ID NO: 127685 - DNA, 22 bp, Artificial Sequence
  chemically synthesized
atctctatgggtggaaggtaag

SEQ ID NO: 127686 - DNA, 22 bp, Artificial Sequence
  chemically synthesized
tatgggtggaaggtaagaggat

SEQ ID NO: 127687 - DNA, 22 bp, Artificial Sequence
  chemically synthesized
tgggtggaaggtaagaggatcg

SEQ ID NO: 127688 - DNA, 22 bp, Artificial Sequence
  chemically synthesized
cctttggtggcatctttagggt

SEQ ID NO: 127689 - DNA, 22 bp, Artificial Sequence
  chemically synthesized
ctttggtggcatctttagggta

SEQ ID NO: 127690 - DNA, 22 bp, Artificial Sequence
  chemically synthesized
tggtggcatctttagggtagtg

SEQ ID NO: 127691 - DNA, 22 bp, Artificial Sequence
  chemically synthesized
ggtggcatctttagggtagtgc

SEQ ID NO: 127692 - DNA, 22 bp, Artificial Sequence
  chemically synthesized
gtggcatctttagggtagtgcc

SEQ ID NO: 127693 - DNA, 22 bp, Artificial Sequence
  chemically synthesized
tagggtagtgccttacactgac

SEQ ID NO: 127694 - DNA, 22 bp, Artificial Sequence
  chemically synthesized
agggtagtgccttacactgaca

SEQ ID NO: 127695 - DNA, 22 bp, Artificial Sequence
  chemically synthesized
gggtagtgccttacactgacaa

SEQ ID NO: 127696 - DNA, 22 bp, Artificial Sequence
  chemically synthesized
acactgacaaagtaactctgaa

SEQ ID NO: 127697 - DNA, 22 bp, Artificial Sequence
  chemically synthesized
cactgacaaagtaactctgaag

SEQ ID NO: 127698 - DNA, 22 bp, Artificial Sequence
  chemically synthesized
acaaagtaactctgaaggggta

SEQ ID NO: 127699 - DNA, 22 bp, Artificial Sequence
  chemically synthesized
tgaaggggtatatttggatacg

SEQ ID NO: 127700 - DNA, 22 bp, Artificial Sequence
  chemically synthesized
aaggggtatatttggatacgac

SEQ ID NO: 127701 - DNA, 22 bp, Artificial Sequence
  chemically synthesized
ggatacgaccatctttttaact

SEQ ID NO: 127702 - DNA, 22 bp, Artificial Sequence
  chemically synthesized
gatacgaccatctttttaactt

SEQ ID NO: 127703 - DNA, 22 bp, Artificial Sequence
  chemically synthesized
tttaacttaggataaaaacaac

SEQ ID NO: 127704 - DNA, 22 bp, Artificial Sequence
  chemically synthesized
ttaacttaggataaaaacaact

SEQ ID NO: 127705 - DNA, 22 bp, Artificial Sequence
  chemically synthesized
taacttaggataaaaacaactt

SEQ ID NO: 127706 - DNA, 22 bp, Artificial Sequence
  chemically synthesized
aacttaggataaaaacaacttc

SEQ ID NO: 127707 - DNA, 22 bp, Artificial Sequence
  chemically synthesized
acttaggataaaaacaacttca

SEQ ID NO: 127708 - DNA, 22 bp, Artificial Sequence
  chemically synthesized
aggataaaaacaacttcaagaa

SEQ ID NO: 127709 - DNA, 22 bp, Artificial Sequence
  chemically synthesized
ggataaaaacaacttcaagaag

SEQ ID NO: 127710 - DNA, 22 bp, Artificial Sequence
  chemically synthesized
caagaagttgttctggcatgtg

SEQ ID NO: 127711 - DNA, 22 bp, Artificial Sequence
  chemically synthesized
aagaagttgttctggcatgtga

SEQ ID NO: 127712 - DNA, 22 bp, Artificial Sequence
  chemically synthesized
ttctggcatgtgacaagaaaaa

SEQ ID NO: 127713 - DNA, 22 bp, Artificial Sequence
  chemically synthesized
tggcatgtgacaagaaaaaaaa

SEQ ID NO: 127714 - DNA, 22 bp, Artificial Sequence
  chemically synthesized
gcatgtgacaagaaaaaaaagc

SEQ ID NO: 127715 - DNA, 22 bp, Artificial Sequence
  chemically synthesized
gctctaattcagctatatttac

SEQ ID NO: 127716 - DNA, 22 bp, Artificial Sequence
  chemically synthesized
ctctaattcagctatatttact

SEQ ID NO: 127717 - DNA, 22 bp, Artificial Sequence
  chemically synthesized
taattcagctatatttactaat

SEQ ID NO: 127718 - DNA, 22 bp, Artificial Sequence
  chemically synthesized
attcagctatatttactaatga

SEQ ID NO: 127719 - DNA, 22 bp, Artificial Sequence
  chemically synthesized
agctatatttactaatgactct

SEQ ID NO: 127720 - DNA, 22 bp, Artificial Sequence
  chemically synthesized
tatttactaatgactcttgatt

SEQ ID NO: 127721 - DNA, 22 bp, Artificial Sequence
  chemically synthesized
actaatgactcttgatttcctc

SEQ ID NO: 127722 - DNA, 22 bp, Artificial Sequence
  chemically synthesized
ctaatgactcttgatttcctca

SEQ ID NO: 127723 - DNA, 22 bp, Artificial Sequence
  chemically synthesized
atgactcttgatttcctcacaa

SEQ ID NO: 127724 - DNA, 22 bp, Artificial Sequence
  chemically synthesized
ttgatttcctcacaagtgaata

SEQ ID NO: 127725 - DNA, 22 bp, Artificial Sequence
  chemically synthesized
gatttcctcacaagtgaatatg

SEQ ID NO: 127726 - DNA, 22 bp, Artificial Sequence
  chemically synthesized
atttcctcacaagtgaatatgt

SEQ ID NO: 127727 - DNA, 22 bp, Artificial Sequence
  chemically synthesized
cctcacaagtgaatatgtatcc

SEQ ID NO: 127728 - DNA, 22 bp, Artificial Sequence
  chemically synthesized
ctcacaagtgaatatgtatccc

SEQ ID NO: 127729 - DNA, 22 bp, Artificial Sequence
  chemically synthesized
acaagtgaatatgtatccccct

SEQ ID NO: 127730 - DNA, 22 bp, Artificial Sequence
  chemically synthesized
agacttccattttgagtaaatg

SEQ ID NO: 127731 - DNA, 22 bp, Artificial Sequence
  chemically synthesized
ccattttgagtaaatggcttca

SEQ ID NO: 127732 - DNA, 22 bp, Artificial Sequence
  chemically synthesized
cattttgagtaaatggcttcac

SEQ ID NO: 127733 - DNA, 22 bp, Artificial Sequence
  chemically synthesized
tgagtaaatggcttcaccattc

SEQ ID NO: 127734 - DNA, 22 bp, Artificial Sequence
  chemically synthesized
gagtaaatggcttcaccattct

SEQ ID NO: 127735 - DNA, 22 bp, Artificial Sequence
  chemically synthesized
agtaaatggcttcaccattctt

SEQ ID NO: 127736 - DNA, 22 bp, Artificial Sequence
  chemically synthesized
caccattctttcatttgttcaa

SEQ ID NO: 127737 - DNA, 22 bp, Artificial Sequence
  chemically synthesized
accattctttcatttgttcaaa

SEQ ID NO: 127738 - DNA, 22 bp, Artificial Sequence
  chemically synthesized
tttcatttgttcaaacagaaat

SEQ ID NO: 127739 - DNA, 22 bp, Artificial Sequence
  chemically synthesized
tcatttgttcaaacagaaatct

SEQ ID NO: 127740 - DNA, 22 bp, Artificial Sequence
  chemically synthesized
catttgttcaaacagaaatcta

SEQ ID NO: 127741 - DNA, 22 bp, Artificial Sequence
  chemically synthesized
atttgttcaaacagaaatctag

SEQ ID NO: 127742 - DNA, 22 bp, Artificial Sequence
  chemically synthesized
gttcaaacagaaatctagggga

SEQ ID NO: 127743 - DNA, 22 bp, Artificial Sequence
  chemically synthesized
ttcaaacagaaatctaggggaa

SEQ ID NO: 127744 - DNA, 22 bp, Artificial Sequence
  chemically synthesized
aaacagaaatctaggggaaacc

SEQ ID NO: 127745 - DNA, 22 bp, Artificial Sequence
  chemically synthesized
ggggaaacctcatttgattttt

SEQ ID NO: 127746 - DNA, 22 bp, Artificial Sequence
  chemically synthesized
atttgatttttccctcactccc

SEQ ID NO: 127747 - DNA, 22 bp, Artificial Sequence
  chemically synthesized
gatttttccctcactcccattt

SEQ ID NO: 127748 - DNA, 22 bp, Artificial Sequence
  chemically synthesized
atttttccctcactcccatttt

SEQ ID NO: 127749 - DNA, 22 bp, Artificial Sequence
  chemically synthesized
ttccctcactcccatttttaat

SEQ ID NO: 127750 - DNA, 22 bp, Artificial Sequence
  chemically synthesized
tccctcactcccatttttaata

SEQ ID NO: 127751 - DNA, 22 bp, Artificial Sequence
  chemically synthesized
ccctcactcccatttttaatat

SEQ ID NO: 127752 - DNA, 22 bp, Artificial Sequence
  chemically synthesized
cctcactcccatttttaatata

SEQ ID NO: 127753 - DNA, 22 bp, Artificial Sequence
  chemically synthesized
actcccatttttaatatatcag

SEQ ID NO: 127754 - DNA, 22 bp, Artificial Sequence
  chemically synthesized
ccatttttaatatatcagcaaa

SEQ ID NO: 127755 - DNA, 22 bp, Artificial Sequence
  chemically synthesized
ttaatatatcagcaaatcttgg

SEQ ID NO: 127756 - DNA, 22 bp, Artificial Sequence
  chemically synthesized
taatatatcagcaaatcttggc

SEQ ID NO: 127757 - DNA, 22 bp, Artificial Sequence
  chemically synthesized
aatatatcagcaaatcttggca

SEQ ID NO: 127758 - DNA, 22 bp, Artificial Sequence
  chemically synthesized
atatatcagcaaatcttggcac

SEQ ID NO: 127759 - DNA, 22 bp, Artificial Sequence
  chemically synthesized
ggcactacttcaaaaatgcatc

SEQ ID NO: 127760 - DNA, 22 bp, Artificial Sequence
  chemically synthesized
gcactacttcaaaaatgcatct

SEQ ID NO: 127761 - DNA, 22 bp, Artificial Sequence
  chemically synthesized
cttcaaaaatgcatctgtctct

SEQ ID NO: 127762 - DNA, 22 bp, Artificial Sequence
  chemically synthesized
caaaaatgcatctgtctctgtt

SEQ ID NO: 127763 - DNA, 22 bp, Artificial Sequence
  chemically synthesized
aaaaatgcatctgtctctgttt

SEQ ID NO: 127764 - DNA, 22 bp, Artificial Sequence
  chemically synthesized
tctctgtttaagtttttctatt

SEQ ID NO: 127765 - DNA, 22 bp, Artificial Sequence
  chemically synthesized
tgtttaagtttttctatttttc

SEQ ID NO: 127766 - DNA, 22 bp, Artificial Sequence
  chemically synthesized
tttaagtttttctatttttctc

SEQ ID NO: 127767 - DNA, 22 bp, Artificial Sequence
  chemically synthesized
aagtttttctatttttctcttt

SEQ ID NO: 127768 - DNA, 22 bp, Artificial Sequence
  chemically synthesized
agtttttctatttttctctttt

SEQ ID NO: 127769 - DNA, 22 bp, Artificial Sequence
  chemically synthesized
ttctatttttctctttttttca

SEQ ID NO: 127770 - DNA, 22 bp, Artificial Sequence
  chemically synthesized
tctatttttctctttttttcat

SEQ ID NO: 127771 - DNA, 22 bp, Artificial Sequence
  chemically synthesized
ctatttttctctttttttcatt

SEQ ID NO: 127772 - DNA, 22 bp, Artificial Sequence
  chemically synthesized
tatttttctctttttttcattt

SEQ ID NO: 127773 - DNA, 22 bp, Artificial Sequence
  chemically synthesized
tttttctctttttttcatttcc

SEQ ID NO: 127774 - DNA, 22 bp, Artificial Sequence
  chemically synthesized
ttctctttttttcatttcccct

SEQ ID NO: 127775 - DNA, 22 bp, Artificial Sequence
  chemically synthesized
tctctttttttcatttcccctg

SEQ ID NO: 127776 - DNA, 22 bp, Artificial Sequence
  chemically synthesized
ctctttttttcatttcccctgc

SEQ ID NO: 127777 - DNA, 22 bp, Artificial Sequence
  chemically synthesized
tctttttttcatttcccctgct

SEQ ID NO: 127778 - DNA, 22 bp, Artificial Sequence
  chemically synthesized
tttttttcatttcccctgcttc

SEQ ID NO: 127779 - DNA, 22 bp, Artificial Sequence
  chemically synthesized
tttttcatttcccctgcttctc

SEQ ID NO: 127780 - DNA, 22 bp, Artificial Sequence
  chemically synthesized
ttttcatttcccctgcttctct

SEQ ID NO: 127781 - DNA, 22 bp, Artificial Sequence
  chemically synthesized
tttcatttcccctgcttctctc

SEQ ID NO: 127782 - DNA, 22 bp, Artificial Sequence
  chemically synthesized
ttcatttcccctgcttctctcc

SEQ ID NO: 127783 - DNA, 22 bp, Artificial Sequence
  chemically synthesized
tcatttcccctgcttctctcct

SEQ ID NO: 127784 - DNA, 22 bp, Artificial Sequence
  chemically synthesized
catttcccctgcttctctccta

SEQ ID NO: 127785 - DNA, 22 bp, Artificial Sequence
  chemically synthesized
atttcccctgcttctctcctag

SEQ ID NO: 127786 - DNA, 22 bp, Artificial Sequence
  chemically synthesized
cccctgcttctctcctagtcaa

SEQ ID NO: 127787 - DNA, 22 bp, Artificial Sequence
  chemically synthesized
ccctgcttctctcctagtcaag

SEQ ID NO: 127788 - DNA, 22 bp, Artificial Sequence
  chemically synthesized
cttctctcctagtcaaggtcac

SEQ ID NO: 127789 - DNA, 22 bp, Artificial Sequence
  chemically synthesized
ctctcctagtcaaggtcaccat

SEQ ID NO: 127790 - DNA, 22 bp, Artificial Sequence
  chemically synthesized
tctcctagtcaaggtcaccatg

SEQ ID NO: 127791 - DNA, 22 bp, Artificial Sequence
  chemically synthesized
tcctagtcaaggtcaccatgac

SEQ ID NO: 127792 - DNA, 22 bp, Artificial Sequence
  chemically synthesized
ctagtcaaggtcaccatgactc

SEQ ID NO: 127793 - DNA, 22 bp, Artificial Sequence
  chemically synthesized
gtcaaggtcaccatgactcttc

SEQ ID NO: 127794 - DNA, 22 bp, Artificial Sequence
  chemically synthesized
ttcatatggatttttaaaatag

SEQ ID NO: 127795 - DNA, 22 bp, Artificial Sequence
  chemically synthesized
catatggatttttaaaatagct

SEQ ID NO: 127796 - DNA, 22 bp, Artificial Sequence
  chemically synthesized
atatggatttttaaaatagctt

SEQ ID NO: 127797 - DNA, 22 bp, Artificial Sequence
  chemically synthesized
ttaaaatagctttctaactcat

SEQ ID NO: 127798 - DNA, 22 bp, Artificial Sequence
  chemically synthesized
taaaatagctttctaactcatc

SEQ ID NO: 127799 - DNA, 22 bp, Artificial Sequence
  chemically synthesized
aaaatagctttctaactcatct

SEQ ID NO: 127800 - DNA, 22 bp, Artificial Sequence
  chemically synthesized
aaatagctttctaactcatctc

SEQ ID NO: 127801 - DNA, 22 bp, Artificial Sequence
  chemically synthesized
tctaactcatctcttttcttgt

SEQ ID NO: 127802 - DNA, 22 bp, Artificial Sequence
  chemically synthesized
ctaactcatctcttttcttgtc

SEQ ID NO: 127803 - DNA, 22 bp, Artificial Sequence
  chemically synthesized
taactcatctcttttcttgtct

SEQ ID NO: 127804 - DNA, 22 bp, Artificial Sequence
  chemically synthesized
actcatctcttttcttgtctct

SEQ ID NO: 127805 - DNA, 22 bp, Artificial Sequence
  chemically synthesized
atctcttttcttgtctcttgct

SEQ ID NO: 127806 - DNA, 22 bp, Artificial Sequence
  chemically synthesized
ttttcttgtctcttgcttagtc

SEQ ID NO: 127807 - DNA, 22 bp, Artificial Sequence
  chemically synthesized
ttcttgtctcttgcttagtctt

SEQ ID NO: 127808 - DNA, 22 bp, Artificial Sequence
  chemically synthesized
tcttgtctcttgcttagtcttc

SEQ ID NO: 127809 - DNA, 22 bp, Artificial Sequence
  chemically synthesized
cttgtctcttgcttagtcttct

SEQ ID NO: 127810 - DNA, 22 bp, Artificial Sequence
  chemically synthesized
ttgtctcttgcttagtcttctt

SEQ ID NO: 127811 - DNA, 22 bp, Artificial Sequence
  chemically synthesized
gtctcttgcttagtcttcttca

SEQ ID NO: 127812 - DNA, 22 bp, Artificial Sequence
  chemically synthesized
tctcttgcttagtcttcttcac

SEQ ID NO: 127813 - DNA, 22 bp, Artificial Sequence
  chemically synthesized
ttgcttagtcttcttcacatag

SEQ ID NO: 127814 - DNA, 22 bp, Artificial Sequence
  chemically synthesized
gcttagtcttcttcacatagca

SEQ ID NO: 127815 - DNA, 22 bp, Artificial Sequence
  chemically synthesized
cttagtcttcttcacatagcag

SEQ ID NO: 127816 - DNA, 22 bp, Artificial Sequence
  chemically synthesized
agtcttcttcacatagcagtct

SEQ ID NO: 127817 - DNA, 22 bp, Artificial Sequence
  chemically synthesized
gtcttcttcacatagcagtcta

SEQ ID NO: 127818 - DNA, 22 bp, Artificial Sequence
  chemically synthesized
cttcacatagcagtctaagtga

SEQ ID NO: 127819 - DNA, 22 bp, Artificial Sequence
  chemically synthesized
ttcacatagcagtctaagtgag

SEQ ID NO: 127820 - DNA, 22 bp, Artificial Sequence
  chemically synthesized
cacatagcagtctaagtgagta

SEQ ID NO: 127821 - DNA, 22 bp, Artificial Sequence
  chemically synthesized
acatagcagtctaagtgagtaa

SEQ ID NO: 127822 - DNA, 22 bp, Artificial Sequence
  chemically synthesized
agtgagtaatttaaaaatacaa

SEQ ID NO: 127823 - DNA, 22 bp, Artificial Sequence
  chemically synthesized
aaaaatacaaatcagaatatat

SEQ ID NO: 127824 - DNA, 22 bp, Artificial Sequence
  chemically synthesized
aaaatacaaatcagaatatatc

SEQ ID NO: 127825 - DNA, 22 bp, Artificial Sequence
  chemically synthesized
ttttccattgtgattttcaaag

SEQ ID NO: 127826 - DNA, 22 bp, Artificial Sequence
  chemically synthesized
tccattgtgattttcaaagtgt

SEQ ID NO: 127827 - DNA, 22 bp, Artificial Sequence
  chemically synthesized
ccattgtgattttcaaagtgtc

SEQ ID NO: 127828 - DNA, 22 bp, Artificial Sequence
  chemically synthesized
cattgtgattttcaaagtgtcc

SEQ ID NO: 127829 - DNA, 22 bp, Artificial Sequence
  chemically synthesized
tgattttcaaagtgtcctaatg

SEQ ID NO: 127830 - DNA, 22 bp, Artificial Sequence
  chemically synthesized
tcaaagtgtcctaatgtcttta

SEQ ID NO: 127831 - DNA, 22 bp, Artificial Sequence
  chemically synthesized
caaagtgtcctaatgtctttac

SEQ ID NO: 127832 - DNA, 22 bp, Artificial Sequence
  chemically synthesized
aaagtgtcctaatgtctttact

SEQ ID NO: 127833 - DNA, 22 bp, Artificial Sequence
  chemically synthesized
atgtctttactacatttatagt

SEQ ID NO: 127834 - DNA, 22 bp, Artificial Sequence
  chemically synthesized
tactacatttatagtaagaaga

SEQ ID NO: 127835 - DNA, 22 bp, Artificial Sequence
  chemically synthesized
actacatttatagtaagaagaa

SEQ ID NO: 127836 - DNA, 22 bp, Artificial Sequence
  chemically synthesized
ctacatttatagtaagaagaaa

SEQ ID NO: 127837 - DNA, 22 bp, Artificial Sequence
  chemically synthesized
catttatagtaagaagaaaaca

SEQ ID NO: 127838 - DNA, 22 bp, Artificial Sequence
  chemically synthesized
atagtaagaagaaaacaaaaca

SEQ ID NO: 127839 - DNA, 22 bp, Artificial Sequence
  chemically synthesized
tagtaagaagaaaacaaaacaa

SEQ ID NO: 127840 - DNA, 22 bp, Artificial Sequence
  chemically synthesized
cgtggtggtctgtaaggcccta

SEQ ID NO: 127841 - DNA, 22 bp, Artificial Sequence
  chemically synthesized
taaggccctatgacacttgatt

SEQ ID NO: 127842 - DNA, 22 bp, Artificial Sequence
  chemically synthesized
tgacacttgattactacctgct

SEQ ID NO: 127843 - DNA, 22 bp, Artificial Sequence
  chemically synthesized
gattactacctgcttctttgac

SEQ ID NO: 127844 - DNA, 22 bp, Artificial Sequence
  chemically synthesized
attactacctgcttctttgaca

SEQ ID NO: 127845 - DNA, 22 bp, Artificial Sequence
  chemically synthesized
ctacctgcttctttgacatcat

SEQ ID NO: 127846 - DNA, 22 bp, Artificial Sequence
  chemically synthesized
cctgcttctttgacatcatcta

SEQ ID NO: 127847 - DNA, 22 bp, Artificial Sequence
  chemically synthesized
cttctttgacatcatctattgt

SEQ ID NO: 127848 - DNA, 22 bp, Artificial Sequence
  chemically synthesized
ctttgacatcatctattgtccc

SEQ ID NO: 127849 - DNA, 22 bp, Artificial Sequence
  chemically synthesized
tttgacatcatctattgtccct

SEQ ID NO: 127850 - DNA, 22 bp, Artificial Sequence
  chemically synthesized
tgacatcatctattgtccctct

SEQ ID NO: 127851 - DNA, 22 bp, Artificial Sequence
  chemically synthesized
gacatcatctattgtccctctc

SEQ ID NO: 127852 - DNA, 22 bp, Artificial Sequence
  chemically synthesized
acatcatctattgtccctctcc

SEQ ID NO: 127853 - DNA, 22 bp, Artificial Sequence
  chemically synthesized
ttgtccctctcctgttttctta

SEQ ID NO: 127854 - DNA, 22 bp, Artificial Sequence
  chemically synthesized
tccctctcctgttttcttatca

SEQ ID NO: 127855 - DNA, 22 bp, Artificial Sequence
  chemically synthesized
tcctgttttcttatcaaatgcc

SEQ ID NO: 127856 - DNA, 22 bp, Artificial Sequence
  chemically synthesized
ctgttttcttatcaaatgccag

SEQ ID NO: 127857 - DNA, 22 bp, Artificial Sequence
  chemically synthesized
ttttcttatcaaatgccagtca

SEQ ID NO: 127858 - DNA, 22 bp, Artificial Sequence
  chemically synthesized
tcttatcaaatgccagtcatgc

SEQ ID NO: 127859 - DNA, 22 bp, Artificial Sequence
  chemically synthesized
cttatcaaatgccagtcatgct

SEQ ID NO: 127860 - DNA, 22 bp, Artificial Sequence
  chemically synthesized
ttatcaaatgccagtcatgctg

SEQ ID NO: 127861 - DNA, 22 bp, Artificial Sequence
  chemically synthesized
atcaaatgccagtcatgctgat

SEQ ID NO: 127862 - DNA, 22 bp, Artificial Sequence
  chemically synthesized
tcaaatgccagtcatgctgatt

SEQ ID NO: 127863 - DNA, 22 bp, Artificial Sequence
  chemically synthesized
attttccctctggaacagtttt

SEQ ID NO: 127864 - DNA, 22 bp, Artificial Sequence
  chemically synthesized
tccctctggaacagttttcctc

SEQ ID NO: 127865 - DNA, 22 bp, Artificial Sequence
  chemically synthesized
ccctctggaacagttttcctct

SEQ ID NO: 127866 - DNA, 22 bp, Artificial Sequence
  chemically synthesized
cctctggaacagttttcctcta

SEQ ID NO: 127867 - DNA, 22 bp, Artificial Sequence
  chemically synthesized
tggaacagttttcctctaggtc

SEQ ID NO: 127868 - DNA, 22 bp, Artificial Sequence
  chemically synthesized
gaacagttttcctctaggtctg

SEQ ID NO: 127869 - DNA, 22 bp, Artificial Sequence
  chemically synthesized
tcctctaggtctgtatacggtc

SEQ ID NO: 127870 - DNA, 22 bp, Artificial Sequence
  chemically synthesized
cctctaggtctgtatacggtca

SEQ ID NO: 127871 - DNA, 22 bp, Artificial Sequence
  chemically synthesized
ctctaggtctgtatacggtcag

SEQ ID NO: 127872 - DNA, 22 bp, Artificial Sequence
  chemically synthesized
taggtctgtatacggtcaggtt

SEQ ID NO: 127873 - DNA, 22 bp, Artificial Sequence
  chemically synthesized
ggtctgtatacggtcaggtttt

SEQ ID NO: 127874 - DNA, 22 bp, Artificial Sequence
  chemically synthesized
tatacggtcaggttttcttttg

SEQ ID NO: 127875 - DNA, 22 bp, Artificial Sequence
  chemically synthesized
tcttttgtattgaggtctcagt

SEQ ID NO: 127876 - DNA, 22 bp, Artificial Sequence
  chemically synthesized
cttttgtattgaggtctcagtt

SEQ ID NO: 127877 - DNA, 22 bp, Artificial Sequence
  chemically synthesized
ttttgtattgaggtctcagttc

SEQ ID NO: 127878 - DNA, 22 bp, Artificial Sequence
  chemically synthesized
ttgtattgaggtctcagttcaa

SEQ ID NO: 127879 - DNA, 22 bp, Artificial Sequence
  chemically synthesized
tgtattgaggtctcagttcaaa

SEQ ID NO: 127880 - DNA, 22 bp, Artificial Sequence
  chemically synthesized
gtattgaggtctcagttcaaat

SEQ ID NO: 127881 - DNA, 22 bp, Artificial Sequence
  chemically synthesized
tattgaggtctcagttcaaatg

SEQ ID NO: 127882 - DNA, 22 bp, Artificial Sequence
  chemically synthesized
aggtctcagttcaaatgggacc

SEQ ID NO: 127883 - DNA, 22 bp, Artificial Sequence
  chemically synthesized
agttcaaatgggacctcctcat

SEQ ID NO: 127884 - DNA, 22 bp, Artificial Sequence
  chemically synthesized
aaatgggacctcctcataggtg

SEQ ID NO: 127885 - DNA, 22 bp, Artificial Sequence
  chemically synthesized
ctcataggtgcagttctaggcc

SEQ ID NO: 127886 - DNA, 22 bp, Artificial Sequence
  chemically synthesized
ataggtgcagttctaggcccct

SEQ ID NO: 127887 - DNA, 22 bp, Artificial Sequence
  chemically synthesized
taggcccctcaaactgctatac

SEQ ID NO: 127888 - DNA, 22 bp, Artificial Sequence
  chemically synthesized
ggcccctcaaactgctatacta

SEQ ID NO: 127889 - DNA, 22 bp, Artificial Sequence
  chemically synthesized
aaactgctatactatcttgtat

SEQ ID NO: 127890 - DNA, 22 bp, Artificial Sequence
  chemically synthesized
ctatactatcttgtatacaata

SEQ ID NO: 127891 - DNA, 22 bp, Artificial Sequence
  chemically synthesized
tactatcttgtatacaatacca

SEQ ID NO: 127892 - DNA, 22 bp, Artificial Sequence
  chemically synthesized
tcttgtatacaataccatccaa

SEQ ID NO: 127893 - DNA, 22 bp, Artificial Sequence
  chemically synthesized
gtatacaataccatccaattaa

SEQ ID NO: 127894 - DNA, 22 bp, Artificial Sequence
  chemically synthesized
tatacaataccatccaattaat

SEQ ID NO: 127895 - DNA, 22 bp, Artificial Sequence
  chemically synthesized
atctacatcaagtagtactgtt

SEQ ID NO: 127896 - DNA, 22 bp, Artificial Sequence
  chemically synthesized
catcaagtagtactgttttatg

SEQ ID NO: 127897 - DNA, 22 bp, Artificial Sequence
  chemically synthesized
ttttatgttaaacttgcattta

SEQ ID NO: 127898 - DNA, 22 bp, Artificial Sequence
  chemically synthesized
tatgttaaacttgcatttatat

SEQ ID NO: 127899 - DNA, 22 bp, Artificial Sequence
  chemically synthesized
atgttaaacttgcatttatatt

SEQ ID NO: 127900 - DNA, 22 bp, Artificial Sequence
  chemically synthesized
tgttaaacttgcatttatattt

SEQ ID NO: 127901 - DNA, 22 bp, Artificial Sequence
  chemically synthesized
aacttgcatttatatttgttta

SEQ ID NO: 127902 - DNA, 22 bp, Artificial Sequence
  chemically synthesized
gcatttatatttgtttaaaatt

SEQ ID NO: 127903 - DNA, 22 bp, Artificial Sequence
  chemically synthesized
catttatatttgtttaaaattg

SEQ ID NO: 127904 - DNA, 22 bp, Artificial Sequence
  chemically synthesized
atatttgtttaaaattgtctta

SEQ ID NO: 127905 - DNA, 22 bp, Artificial Sequence
  chemically synthesized
tatttgtttaaaattgtcttat

SEQ ID NO: 127906 - DNA, 22 bp, Artificial Sequence
  chemically synthesized
gtttaaaattgtcttatttatt

SEQ ID NO: 127907 - DNA, 22 bp, Artificial Sequence
  chemically synthesized
tttaaaattgtcttatttattt

SEQ ID NO: 127908 - DNA, 22 bp, Artificial Sequence
  chemically synthesized
aaaattgtcttatttatttttc

SEQ ID NO: 127909 - DNA, 22 bp, Artificial Sequence
  chemically synthesized
aaattgtcttatttatttttca

SEQ ID NO: 127910 - DNA, 22 bp, Artificial Sequence
  chemically synthesized
tcttatttatttttcaacttaa

SEQ ID NO: 127911 - DNA, 22 bp, Artificial Sequence
  chemically synthesized
atttatttttcaacttaattta

SEQ ID NO: 127912 - DNA, 22 bp, Artificial Sequence
  chemically synthesized
tttatttttcaacttaatttat

SEQ ID NO: 127913 - DNA, 22 bp, Artificial Sequence
  chemically synthesized
atttttcaacttaatttatggt

SEQ ID NO: 127914 - DNA, 22 bp, Artificial Sequence
  chemically synthesized
tttttcaacttaatttatggtt

SEQ ID NO: 127915 - DNA, 22 bp, Artificial Sequence
  chemically synthesized
ttcaacttaatttatggtttat

SEQ ID NO: 127916 - DNA, 22 bp, Artificial Sequence
  chemically synthesized
tcaacttaatttatggtttata

SEQ ID NO: 127917 - DNA, 22 bp, Artificial Sequence
  chemically synthesized
caacttaatttatggtttataa

SEQ ID NO: 127918 - DNA, 22 bp, Artificial Sequence
  chemically synthesized
aacttaatttatggtttataag

SEQ ID NO: 127919 - DNA, 22 bp, Artificial Sequence
  chemically synthesized
aatttatggtttataagattag

SEQ ID NO: 127920 - DNA, 22 bp, Artificial Sequence
  chemically synthesized
atttatggtttataagattagg

SEQ ID NO: 127921 - DNA, 22 bp, Artificial Sequence
  chemically synthesized
atggtttataagattagggact

SEQ ID NO: 127922 - DNA, 22 bp, Artificial Sequence
  chemically synthesized
tggtttataagattagggactt

SEQ ID NO: 127923 - DNA, 22 bp, Artificial Sequence
  chemically synthesized
ataagattagggactttgtctt

SEQ ID NO: 127924 - DNA, 22 bp, Artificial Sequence
  chemically synthesized
taagattagggactttgtctta

SEQ ID NO: 127925 - DNA, 22 bp, Artificial Sequence
  chemically synthesized
gggactttgtcttattaccatt

SEQ ID NO: 127926 - DNA, 22 bp, Artificial Sequence
  chemically synthesized
tgtcttattaccatttaattcc

SEQ ID NO: 127927 - DNA, 22 bp, Artificial Sequence
  chemically synthesized
gtcttattaccatttaattcca

SEQ ID NO: 127928 - DNA, 22 bp, Artificial Sequence
  chemically synthesized
tcttattaccatttaattccag

SEQ ID NO: 127929 - DNA, 22 bp, Artificial Sequence
  chemically synthesized
attaccatttaattccagagag

SEQ ID NO: 127930 - DNA, 22 bp, Artificial Sequence
  chemically synthesized
ttaccatttaattccagagagc

SEQ ID NO: 127931 - DNA, 22 bp, Artificial Sequence
  chemically synthesized
ccatttaattccagagagcttt

SEQ ID NO: 127932 - DNA, 22 bp, Artificial Sequence
  chemically synthesized
aattccagagagctttaaatat

SEQ ID NO: 127933 - DNA, 22 bp, Artificial Sequence
  chemically synthesized
attccagagagctttaaatatc

SEQ ID NO: 127934 - DNA, 22 bp, Artificial Sequence
  chemically synthesized
cagagagctttaaatatcatgg

SEQ ID NO: 127935 - DNA, 22 bp, Artificial Sequence
  chemically synthesized
taaatatcatggctgtcacatg

SEQ ID NO: 127936 - DNA, 22 bp, Artificial Sequence
  chemically synthesized
aaatatcatggctgtcacatga

SEQ ID NO: 127937 - DNA, 22 bp, Artificial Sequence
  chemically synthesized
aatatcatggctgtcacatgat

SEQ ID NO: 127938 - DNA, 22 bp, Artificial Sequence
  chemically synthesized
tcacatgatgcgtgttcacaaa

SEQ ID NO: 127939 - DNA, 22 bp, Artificial Sequence
  chemically synthesized
acaaatattaggtgaactaaga

SEQ ID NO: 127940 - DNA, 22 bp, Artificial Sequence
  chemically synthesized
ggtgaactaagaaatgtttatc

SEQ ID NO: 127941 - DNA, 22 bp, Artificial Sequence
  chemically synthesized
agaaatgtttatcagtcacatg

SEQ ID NO: 127942 - DNA, 22 bp, Artificial Sequence
  chemically synthesized
atcagtcacatgttagatactt

SEQ ID NO: 127943 - DNA, 22 bp, Artificial Sequence
  chemically synthesized
tcagtcacatgttagatacttt

SEQ ID NO: 127944 - DNA, 22 bp, Artificial Sequence
  chemically synthesized
gatactttgcaaggtgttgagc

SEQ ID NO: 127945 - DNA, 22 bp, Artificial Sequence
  chemically synthesized
tgcaaggtgttgagcaaagcaa

SEQ ID NO: 127946 - DNA, 22 bp, Artificial Sequence
  chemically synthesized
gcaaggtgttgagcaaagcaaa

SEQ ID NO: 127947 - DNA, 22 bp, Artificial Sequence
  chemically synthesized
caaggtgttgagcaaagcaaat

SEQ ID NO: 127948 - DNA, 22 bp, Artificial Sequence
  chemically synthesized
agcaaagcaaataaacaccatg

SEQ ID NO: 127949 - DNA, 22 bp, Artificial Sequence
  chemically synthesized
tatgcaagaagcccctagtcta

SEQ ID NO: 127950 - DNA, 22 bp, Artificial Sequence
  chemically synthesized
gtctagtggcagaaggaatatt

SEQ ID NO: 127951 - DNA, 22 bp, Artificial Sequence
  chemically synthesized
gtggcagaaggaatattaaaac

SEQ ID NO: 127952 - DNA, 22 bp, Artificial Sequence
  chemically synthesized
aaaccttctcaaaggactaatc

SEQ ID NO: 127953 - DNA, 22 bp, Artificial Sequence
  chemically synthesized
ctcaaaggactaatctcttctc

SEQ ID NO: 127954 - DNA, 22 bp, Artificial Sequence
  chemically synthesized
tcaaaggactaatctcttctct

SEQ ID NO: 127955 - DNA, 22 bp, Artificial Sequence
  chemically synthesized
aaaggactaatctcttctcttc

SEQ ID NO: 127956 - DNA, 22 bp, Artificial Sequence
  chemically synthesized
atctcttctcttcagtaaaaga

SEQ ID NO: 127957 - DNA, 22 bp, Artificial Sequence
  chemically synthesized
ttctcttcagtaaaagacagca

SEQ ID NO: 127958 - DNA, 22 bp, Artificial Sequence
  chemically synthesized
ctcttcagtaaaagacagcacc

SEQ ID NO: 127959 - DNA, 22 bp, Artificial Sequence
  chemically synthesized
tcttcagtaaaagacagcacca

SEQ ID NO: 127960 - DNA, 22 bp, Artificial Sequence
  chemically synthesized
ttcagtaaaagacagcaccacg

SEQ ID NO: 127961 - DNA, 22 bp, Artificial Sequence
  chemically synthesized
cagtaaaagacagcaccacgtt

SEQ ID NO: 127962 - DNA, 22 bp, Artificial Sequence
  chemically synthesized
agtaaaagacagcaccacgttt

SEQ ID NO: 127963 - DNA, 22 bp, Artificial Sequence
  chemically synthesized
aagcagggaaatagctctcact

SEQ ID NO: 127964 - DNA, 22 bp, Artificial Sequence
  chemically synthesized
agcagggaaatagctctcactc

SEQ ID NO: 127965 - DNA, 22 bp, Artificial Sequence
  chemically synthesized
tcactcagtattggggagaaca

SEQ ID NO: 127966 - DNA, 22 bp, Artificial Sequence
  chemically synthesized
actcagtattggggagaacaga

SEQ ID NO: 127967 - DNA, 22 bp, Artificial Sequence
  chemically synthesized
agtattggggagaacagattca

SEQ ID NO: 127968 - DNA, 22 bp, Artificial Sequence
  chemically synthesized
gggagaacagattcagaagcct

SEQ ID NO: 127969 - DNA, 22 bp, Artificial Sequence
  chemically synthesized
agaagcctatggctggggataa

SEQ ID NO: 127970 - DNA, 22 bp, Artificial Sequence
  chemically synthesized
tggctggggataaagggaagga

SEQ ID NO: 127971 - DNA, 22 bp, Artificial Sequence
  chemically synthesized
gggataaagggaaggaaaccag

SEQ ID NO: 127972 - DNA, 22 bp, Artificial Sequence
  chemically synthesized
aaatataaatggagaacttgaa

SEQ ID NO: 127973 - DNA, 22 bp, Artificial Sequence
  chemically synthesized
aatataaatggagaacttgaaa

SEQ ID NO: 127974 - DNA, 22 bp, Artificial Sequence
  chemically synthesized
gaaatgagagaggtcagattct

SEQ ID NO: 127975 - DNA, 22 bp, Artificial Sequence
  chemically synthesized
aaatgagagaggtcagattcta

SEQ ID NO: 127976 - DNA, 22 bp, Artificial Sequence
  chemically synthesized
tagggaattacttcagtaggcc

SEQ ID NO: 127977 - DNA, 22 bp, Artificial Sequence
  chemically synthesized
gggaattacttcagtaggccta

SEQ ID NO: 127978 - DNA, 22 bp, Artificial Sequence
  chemically synthesized
cttcagtaggcctatagaaaaa

SEQ ID NO: 127979 - DNA, 22 bp, Artificial Sequence
  chemically synthesized
cagtaggcctatagaaaaataa

SEQ ID NO: 127980 - DNA, 22 bp, Artificial Sequence
  chemically synthesized
agtaggcctatagaaaaataat

SEQ ID NO: 127981 - DNA, 22 bp, Artificial Sequence
  chemically synthesized
tagaaaaataatttaaaaagaa

SEQ ID NO: 127982 - DNA, 22 bp, Artificial Sequence
  chemically synthesized
aaaaagaaaaagacactacttg

SEQ ID NO: 127983 - DNA, 22 bp, Artificial Sequence
  chemically synthesized
aaaagaaaaagacactacttgt

SEQ ID NO: 127984 - DNA, 22 bp, Artificial Sequence
  chemically synthesized
cttgtaaataagaaacagtaag

SEQ ID NO: 127985 - DNA, 22 bp, Artificial Sequence
  chemically synthesized
gtaaataagaaacagtaagatg

SEQ ID NO: 127986 - DNA, 22 bp, Artificial Sequence
  chemically synthesized
taaataagaaacagtaagatgt

SEQ ID NO: 127987 - DNA, 22 bp, Artificial Sequence
  chemically synthesized
aaactgaaggagatacactatt

SEQ ID NO: 127988 - DNA, 22 bp, Artificial Sequence
  chemically synthesized
aactgaaggagatacactatta

SEQ ID NO: 127989 - DNA, 22 bp, Artificial Sequence
  chemically synthesized
aaggagatacactattataagt

SEQ ID NO: 127990 - DNA, 22 bp, Artificial Sequence
  chemically synthesized
ttataagtgatgtctttggctg

SEQ ID NO: 127991 - DNA, 22 bp, Artificial Sequence
  chemically synthesized
taagtgatgtctttggctggcc

SEQ ID NO: 127992 - DNA, 22 bp, Artificial Sequence
  chemically synthesized
tggctggcctaatcatttattc

SEQ ID NO: 127993 - DNA, 22 bp, Artificial Sequence
  chemically synthesized
ggctggcctaatcatttattcc

SEQ ID NO: 127994 - DNA, 22 bp, Artificial Sequence
  chemically synthesized
gctggcctaatcatttattcca

SEQ ID NO: 127995 - DNA, 22 bp, Artificial Sequence
  chemically synthesized
gcctaatcatttattccagccc

SEQ ID NO: 127996 - DNA, 22 bp, Artificial Sequence
  chemically synthesized
atcatttattccagccccaaag

SEQ ID NO: 127997 - DNA, 22 bp, Artificial Sequence
  chemically synthesized
attccagccccaaagtctaact

SEQ ID NO: 127998 - DNA, 22 bp, Artificial Sequence
  chemically synthesized
ttccagccccaaagtctaactt

SEQ ID NO: 127999 - DNA, 22 bp, Artificial Sequence
  chemically synthesized
cagccccaaagtctaacttata

SEQ ID NO: 128000 - DNA, 22 bp, Artificial Sequence
  chemically synthesized
acttataattagactgagctat

SEQ ID NO: 128001 - DNA, 22 bp, Artificial Sequence
  chemically synthesized
ataattagactgagctattgtc

SEQ ID NO: 128002 - DNA, 22 bp, Artificial Sequence
  chemically synthesized
taattagactgagctattgtca

SEQ ID NO: 128003 - DNA, 22 bp, Artificial Sequence
  chemically synthesized
gactgagctattgtcacaagta

SEQ ID NO: 128004 - DNA, 22 bp, Artificial Sequence
  chemically synthesized
agctattgtcacaagtagtgag

SEQ ID NO: 128005 - DNA, 22 bp, Artificial Sequence
  chemically synthesized
ttgtcacaagtagtgagtagta

SEQ ID NO: 128006 - DNA, 22 bp, Artificial Sequence
  chemically synthesized
tcacaagtagtgagtagtactg

SEQ ID NO: 128007 - DNA, 22 bp, Artificial Sequence
  chemically synthesized
aaggattctacaagagggtaat

SEQ ID NO: 128008 - DNA, 22 bp, Artificial Sequence
  chemically synthesized
tacaagagggtaattcacacta

SEQ ID NO: 128009 - DNA, 22 bp, Artificial Sequence
  chemically synthesized
caagagggtaattcacactaat

SEQ ID NO: 128010 - DNA, 22 bp, Artificial Sequence
  chemically synthesized
acactaatcgtgaatgtctgtt

SEQ ID NO: 128011 - DNA, 22 bp, Artificial Sequence
  chemically synthesized
atcgtgaatgtctgttccccat

SEQ ID NO: 128012 - DNA, 22 bp, Artificial Sequence
  chemically synthesized
ttccccatcactagtccatgaa

SEQ ID NO: 128013 - DNA, 22 bp, Artificial Sequence
  chemically synthesized
cccatcactagtccatgaaatc

SEQ ID NO: 128014 - DNA, 22 bp, Artificial Sequence
  chemically synthesized
gtccatgaaatctggaggccaa

SEQ ID NO: 128015 - DNA, 22 bp, Artificial Sequence
  chemically synthesized
gaggccaagtgtctctttctca

SEQ ID NO: 128016 - DNA, 22 bp, Artificial Sequence
  chemically synthesized
tttctcaatctgactgctcctt

SEQ ID NO: 128017 - DNA, 22 bp, Artificial Sequence
  chemically synthesized
tctcaatctgactgctccttag

SEQ ID NO: 128018 - DNA, 22 bp, Artificial Sequence
  chemically synthesized
ctcaatctgactgctccttagc

SEQ ID NO: 128019 - DNA, 22 bp, Artificial Sequence
  chemically synthesized
tcaatctgactgctccttagct

SEQ ID NO: 128020 - DNA, 22 bp, Artificial Sequence
  chemically synthesized
aatctgactgctccttagctac

SEQ ID NO: 128021 - DNA, 22 bp, Artificial Sequence
  chemically synthesized
actgctccttagctacagtggt

SEQ ID NO: 128022 - DNA, 22 bp, Artificial Sequence
  chemically synthesized
ctccttagctacagtggtagtg

SEQ ID NO: 128023 - DNA, 22 bp, Artificial Sequence
  chemically synthesized
cttagctacagtggtagtggca

SEQ ID NO: 128024 - DNA, 22 bp, Artificial Sequence
  chemically synthesized
agctacagtggtagtggcagag

SEQ ID NO: 128025 - DNA, 22 bp, Artificial Sequence
  chemically synthesized
gctacagtggtagtggcagagt

SEQ ID NO: 128026 - DNA, 22 bp, Artificial Sequence
  chemically synthesized
cagtggtagtggcagagtttct

SEQ ID NO: 128027 - DNA, 22 bp, Artificial Sequence
  chemically synthesized
ctcttcccacacttttctttct

SEQ ID NO: 128028 - DNA, 22 bp, Artificial Sequence
  chemically synthesized
tcttcccacacttttctttctt

SEQ ID NO: 128029 - DNA, 22 bp, Artificial Sequence
  chemically synthesized
ttcccacacttttctttcttag

SEQ ID NO: 128030 - DNA, 22 bp, Artificial Sequence
  chemically synthesized
cccacacttttctttcttaggc

SEQ ID NO: 128031 - DNA, 22 bp, Artificial Sequence
  chemically synthesized
ccacacttttctttcttaggct

SEQ ID NO: 128032 - DNA, 22 bp, Artificial Sequence
  chemically synthesized
ttctttcttaggctgttgagac

SEQ ID NO: 128033 - DNA, 22 bp, Artificial Sequence
  chemically synthesized
tctttcttaggctgttgagact

SEQ ID NO: 128034 - DNA, 22 bp, Artificial Sequence
  chemically synthesized
ctttcttaggctgttgagactt

SEQ ID NO: 128035 - DNA, 22 bp, Artificial Sequence
  chemically synthesized
tttcttaggctgttgagacttt

SEQ ID NO: 128036 - DNA, 22 bp, Artificial Sequence
  chemically synthesized
tcttaggctgttgagactttag

SEQ ID NO: 128037 - DNA, 22 bp, Artificial Sequence
  chemically synthesized
cttaggctgttgagactttagc

SEQ ID NO: 128038 - DNA, 22 bp, Artificial Sequence
  chemically synthesized
ttaggctgttgagactttagct

SEQ ID NO: 128039 - DNA, 22 bp, Artificial Sequence
  chemically synthesized
aggctgttgagactttagctga

SEQ ID NO: 128040 - DNA, 22 bp, Artificial Sequence
  chemically synthesized
ggctgttgagactttagctgat

SEQ ID NO: 128041 - DNA, 22 bp, Artificial Sequence
  chemically synthesized
ttgagactttagctgataattc

SEQ ID NO: 128042 - DNA, 22 bp, Artificial Sequence
  chemically synthesized
agactttagctgataattcagg

SEQ ID NO: 128043 - DNA, 22 bp, Artificial Sequence
  chemically synthesized
tagctgataattcaggtaagtc

SEQ ID NO: 128044 - DNA, 22 bp, Artificial Sequence
  chemically synthesized
agctgataattcaggtaagtct

SEQ ID NO: 128045 - DNA, 22 bp, Artificial Sequence
  chemically synthesized
gctgataattcaggtaagtctt

SEQ ID NO: 128046 - DNA, 22 bp, Artificial Sequence
  chemically synthesized
ataattcaggtaagtctttaca

SEQ ID NO: 128047 - DNA, 22 bp, Artificial Sequence
  chemically synthesized
aggtaagtctttacatgcagga

SEQ ID NO: 128048 - DNA, 22 bp, Artificial Sequence
  chemically synthesized
tacatgcaggaaaatgtggatt

SEQ ID NO: 128049 - DNA, 22 bp, Artificial Sequence
  chemically synthesized
acatgcaggaaaatgtggatta

SEQ ID NO: 128050 - DNA, 22 bp, Artificial Sequence
  chemically synthesized
catgcaggaaaatgtggattag

SEQ ID NO: 128051 - DNA, 22 bp, Artificial Sequence
  chemically synthesized
gggatcactactgtgaaggcaa

SEQ ID NO: 128052 - DNA, 22 bp, Artificial Sequence
  chemically synthesized
ctgtgaaggcaattacaggttt

SEQ ID NO: 128053 - DNA, 22 bp, Artificial Sequence
  chemically synthesized
tgaaggcaattacaggtttagg

SEQ ID NO: 128054 - DNA, 22 bp, Artificial Sequence
  chemically synthesized
caggtttaggtggtagaccaga

SEQ ID NO: 128055 - DNA, 22 bp, Artificial Sequence
  chemically synthesized
aggtggtagaccagaaaaaaat

SEQ ID NO: 128056 - DNA, 22 bp, Artificial Sequence
  chemically synthesized
ggtggtagaccagaaaaaaatt

SEQ ID NO: 128057 - DNA, 22 bp, Artificial Sequence
  chemically synthesized
gtgttagctttctggaaatccc

SEQ ID NO: 128058 - DNA, 22 bp, Artificial Sequence
  chemically synthesized
gctttctggaaatccccttgaa

SEQ ID NO: 128059 - DNA, 22 bp, Artificial Sequence
  chemically synthesized
tctggaaatccccttgaatgcc

SEQ ID NO: 128060 - DNA, 22 bp, Artificial Sequence
  chemically synthesized
ctggaaatccccttgaatgccc

SEQ ID NO: 128061 - DNA, 22 bp, Artificial Sequence
  chemically synthesized
tggaaatccccttgaatgcccc

SEQ ID NO: 128062 - DNA, 22 bp, Artificial Sequence
  chemically synthesized
gaaatccccttgaatgccccat

SEQ ID NO: 128063 - DNA, 22 bp, Artificial Sequence
  chemically synthesized
gaatgccccatagaatacgaat

SEQ ID NO: 128064 - DNA, 22 bp, Artificial Sequence
  chemically synthesized
aatgccccatagaatacgaatt

SEQ ID NO: 128065 - DNA, 22 bp, Artificial Sequence
  chemically synthesized
tttaaaatctgcatagttaagg

SEQ ID NO: 128066 - DNA, 22 bp, Artificial Sequence
  chemically synthesized
taaaatctgcatagttaagggt

SEQ ID NO: 128067 - DNA, 22 bp, Artificial Sequence
  chemically synthesized
aaaatctgcatagttaagggta

SEQ ID NO: 128068 - DNA, 22 bp, Artificial Sequence
  chemically synthesized
aaatctgcatagttaagggtaa

SEQ ID NO: 128069 - DNA, 22 bp, Artificial Sequence
  chemically synthesized
catagttaagggtaacagttta

SEQ ID NO: 128070 - DNA, 22 bp, Artificial Sequence
  chemically synthesized
agggtaacagtttagaagttgt

SEQ ID NO: 128071 - DNA, 22 bp, Artificial Sequence
  chemically synthesized
agaagttgtagtttacataatt

SEQ ID NO: 128072 - DNA, 22 bp, Artificial Sequence
  chemically synthesized
gaagttgtagtttacataattt

SEQ ID NO: 128073 - DNA, 22 bp, Artificial Sequence
  chemically synthesized
tagtttacataattttttttct

SEQ ID NO: 128074 - DNA, 22 bp, Artificial Sequence
  chemically synthesized
acataattttttttctgaagag

SEQ ID NO: 128075 - DNA, 22 bp, Artificial Sequence
  chemically synthesized
cataattttttttctgaagaga

SEQ ID NO: 128076 - DNA, 22 bp, Artificial Sequence
  chemically synthesized
tttttctgaagagaatgcttaa

SEQ ID NO: 128077 - DNA, 22 bp, Artificial Sequence
  chemically synthesized
ttttctgaagagaatgcttaaa

SEQ ID NO: 128078 - DNA, 22 bp, Artificial Sequence
  chemically synthesized
tttctgaagagaatgcttaaat

SEQ ID NO: 128079 - DNA, 22 bp, Artificial Sequence
  chemically synthesized
ttctgaagagaatgcttaaatg

SEQ ID NO: 128080 - DNA, 22 bp, Artificial Sequence
  chemically synthesized
tctgaagagaatgcttaaatgc

SEQ ID NO: 128081 - DNA, 22 bp, Artificial Sequence
  chemically synthesized
ctgaagagaatgcttaaatgca

SEQ ID NO: 128082 - DNA, 22 bp, Artificial Sequence
  chemically synthesized
tgaagagaatgcttaaatgcat

SEQ ID NO: 128083 - DNA, 22 bp, Artificial Sequence
  chemically synthesized
aagagaatgcttaaatgcatat

SEQ ID NO: 128084 - DNA, 22 bp, Artificial Sequence
  chemically synthesized
aaatgcatataaacagttgaaa

SEQ ID NO: 128085 - DNA, 22 bp, Artificial Sequence
  chemically synthesized
aatgcatataaacagttgaaac

SEQ ID NO: 128086 - DNA, 22 bp, Artificial Sequence
  chemically synthesized
aaactccaagaatttgattacg

SEQ ID NO: 128087 - DNA, 22 bp, Artificial Sequence
  chemically synthesized
caagaatttgattacgtaggta

SEQ ID NO: 128088 - DNA, 22 bp, Artificial Sequence
  chemically synthesized
gattacgtaggtaggagataga

SEQ ID NO: 128089 - DNA, 22 bp, Artificial Sequence
  chemically synthesized
attacgtaggtaggagatagat

SEQ ID NO: 128090 - DNA, 22 bp, Artificial Sequence
  chemically synthesized
cgtaggtaggagatagatcctg

SEQ ID NO: 128091 - DNA, 22 bp, Artificial Sequence
  chemically synthesized
gaatgtgcagttaagaatacaa

SEQ ID NO: 128092 - DNA, 22 bp, Artificial Sequence
  chemically synthesized
agaatacaaatagtatgagtaa

SEQ ID NO: 128093 - DNA, 22 bp, Artificial Sequence
  chemically synthesized
agaatgtattttgagaaacaat

SEQ ID NO: 128094 - DNA, 22 bp, Artificial Sequence
  chemically synthesized
tgagaaacaatcacttatattg

SEQ ID NO: 128095 - DNA, 22 bp, Artificial Sequence
  chemically synthesized
gagaaacaatcacttatattga

SEQ ID NO: 128096 - DNA, 22 bp, Artificial Sequence
  chemically synthesized
agaaacaatcacttatattgat

SEQ ID NO: 128097 - DNA, 22 bp, Artificial Sequence
  chemically synthesized
atattgatgtcattattatctt

SEQ ID NO: 128098 - DNA, 22 bp, Artificial Sequence
  chemically synthesized
tattgatgtcattattatcttt

SEQ ID NO: 128099 - DNA, 22 bp, Artificial Sequence
  chemically synthesized
atgtcattattatctttaggaa

SEQ ID NO: 128100 - DNA, 22 bp, Artificial Sequence
  chemically synthesized
ttatctttaggaaaaaattctg

SEQ ID NO: 128101 - DNA, 22 bp, Artificial Sequence
  chemically synthesized
tctttaggaaaaaattctgaga

SEQ ID NO: 128102 - DNA, 22 bp, Artificial Sequence
  chemically synthesized
taggaaaaaattctgagaatga

SEQ ID NO: 128103 - DNA, 22 bp, Artificial Sequence
  chemically synthesized
aggaaaaaattctgagaatgat

SEQ ID NO: 128104 - DNA, 22 bp, Artificial Sequence
  chemically synthesized
ggaaaaaattctgagaatgata

SEQ ID NO: 128105 - DNA, 22 bp, Artificial Sequence
  chemically synthesized
tgagaatgatatagtcgaagtg

SEQ ID NO: 128106 - DNA, 22 bp, Artificial Sequence
  chemically synthesized
agaatgatatagtcgaagtgat

SEQ ID NO: 128107 - DNA, 22 bp, Artificial Sequence
  chemically synthesized
gaaggtagaactgtgcactgtg

SEQ ID NO: 128108 - DNA, 22 bp, Artificial Sequence
  chemically synthesized
aaggtagaactgtgcactgtgg

SEQ ID NO: 128109 - DNA, 22 bp, Artificial Sequence
  chemically synthesized
tgcactgtggtaataacagaaa

SEQ ID NO: 128110 - DNA, 22 bp, Artificial Sequence
  chemically synthesized
tggtaataacagaaacagaaag

SEQ ID NO: 128111 - DNA, 22 bp, Artificial Sequence
  chemically synthesized
cttctatataaacccaggatgt

SEQ ID NO: 128112 - DNA, 22 bp, Artificial Sequence
  chemically synthesized
ttctatataaacccaggatgtc

SEQ ID NO: 128113 - DNA, 22 bp, Artificial Sequence
  chemically synthesized
ctatataaacccaggatgtcgt

SEQ ID NO: 128114 - DNA, 22 bp, Artificial Sequence
  chemically synthesized
tatataaacccaggatgtcgtc

SEQ ID NO: 128115 - DNA, 22 bp, Artificial Sequence
  chemically synthesized
tataaacccaggatgtcgtcca

SEQ ID NO: 128116 - DNA, 22 bp, Artificial Sequence
  chemically synthesized
ccatcccttcctattgactggt

SEQ ID NO: 128117 - DNA, 22 bp, Artificial Sequence
  chemically synthesized
cctattgactggttttccaggc

SEQ ID NO: 128118 - DNA, 22 bp, Artificial Sequence
  chemically synthesized
ctattgactggttttccaggct

SEQ ID NO: 128119 - DNA, 22 bp, Artificial Sequence
  chemically synthesized
ttgactggttttccaggcttgg

SEQ ID NO: 128120 - DNA, 22 bp, Artificial Sequence
  chemically synthesized
actggttttccaggcttggagg

SEQ ID NO: 128121 - DNA, 22 bp, Artificial Sequence
  chemically synthesized
gttttccaggcttggaggaagc

SEQ ID NO: 128122 - DNA, 22 bp, Artificial Sequence
  chemically synthesized
tccaggcttggaggaagctcat

SEQ ID NO: 128123 - DNA, 22 bp, Artificial Sequence
  chemically synthesized
ccaggcttggaggaagctcatc

SEQ ID NO: 128124 - DNA, 22 bp, Artificial Sequence
  chemically synthesized
caggcttggaggaagctcatca

SEQ ID NO: 128125 - DNA, 22 bp, Artificial Sequence
  chemically synthesized
ggaggaagctcatcactggatt

SEQ ID NO: 128126 - DNA, 22 bp, Artificial Sequence
  chemically synthesized
gaggaagctcatcactggattt

SEQ ID NO: 128127 - DNA, 22 bp, Artificial Sequence
  chemically synthesized
atcactggatttccgtattttt

SEQ ID NO: 128128 - DNA, 22 bp, Artificial Sequence
  chemically synthesized
gatttccgtatttttcttgttc

SEQ ID NO: 128129 - DNA, 22 bp, Artificial Sequence
  chemically synthesized
ccgtatttttcttgttcatgta

SEQ ID NO: 128130 - DNA, 22 bp, Artificial Sequence
  chemically synthesized
cgtatttttcttgttcatgtat

SEQ ID NO: 128131 - DNA, 22 bp, Artificial Sequence
  chemically synthesized
ttcttgttcatgtatatatcca

SEQ ID NO: 128132 - DNA, 22 bp, Artificial Sequence
  chemically synthesized
tcttgttcatgtatatatccat

SEQ ID NO: 128133 - DNA, 22 bp, Artificial Sequence
  chemically synthesized
cttgttcatgtatatatccatc

SEQ ID NO: 128134 - DNA, 22 bp, Artificial Sequence
  chemically synthesized
ttgttcatgtatatatccatcc

SEQ ID NO: 128135 - DNA, 22 bp, Artificial Sequence
  chemically synthesized
gttcatgtatatatccatcctt

SEQ ID NO: 128136 - DNA, 22 bp, Artificial Sequence
  chemically synthesized
ttcatgtatatatccatccttt

SEQ ID NO: 128137 - DNA, 22 bp, Artificial Sequence
  chemically synthesized
atgtatatatccatcctttttg

SEQ ID NO: 128138 - DNA, 22 bp, Artificial Sequence
  chemically synthesized
tttggcaatggcaccctccttc

SEQ ID NO: 128139 - DNA, 22 bp, Artificial Sequence
  chemically synthesized
ttggcaatggcaccctccttct

SEQ ID NO: 128140 - DNA, 22 bp, Artificial Sequence
  chemically synthesized
tggcaatggcaccctccttctt

SEQ ID NO: 128141 - DNA, 22 bp, Artificial Sequence
  chemically synthesized
ggcaatggcaccctccttcttc

SEQ ID NO: 128142 - DNA, 22 bp, Artificial Sequence
  chemically synthesized
gcaatggcaccctccttcttct

SEQ ID NO: 128143 - DNA, 22 bp, Artificial Sequence
  chemically synthesized
cttcttctcattaaggaagatc

SEQ ID NO: 128144 - DNA, 22 bp, Artificial Sequence
  chemically synthesized
cttctcattaaggaagatcaca

SEQ ID NO: 128145 - DNA, 22 bp, Artificial Sequence
  chemically synthesized
ttctcattaaggaagatcacaa

SEQ ID NO: 128146 - DNA, 22 bp, Artificial Sequence
  chemically synthesized
ctcattaaggaagatcacaatc

SEQ ID NO: 128147 - DNA, 22 bp, Artificial Sequence
  chemically synthesized
tcattaaggaagatcacaatct

SEQ ID NO: 128148 - DNA, 22 bp, Artificial Sequence
  chemically synthesized
attaaggaagatcacaatcttc

SEQ ID NO: 128149 - DNA, 22 bp, Artificial Sequence
  chemically synthesized
aggaagatcacaatcttcatga

SEQ ID NO: 128150 - DNA, 22 bp, Artificial Sequence
  chemically synthesized
catgagcccatgtacttctttc

SEQ ID NO: 128151 - DNA, 22 bp, Artificial Sequence
  chemically synthesized
atgagcccatgtacttctttct

SEQ ID NO: 128152 - DNA, 22 bp, Artificial Sequence
  chemically synthesized
ctttctggccatgctggctgcc

SEQ ID NO: 128153 - DNA, 22 bp, Artificial Sequence
  chemically synthesized
tttctggccatgctggctgcca

SEQ ID NO: 128154 - DNA, 22 bp, Artificial Sequence
  chemically synthesized
tctggccatgctggctgccaca

SEQ ID NO: 128155 - DNA, 22 bp, Artificial Sequence
  chemically synthesized
ctggccatgctggctgccacag

SEQ ID NO: 128156 - DNA, 22 bp, Artificial Sequence
  chemically synthesized
tggccatgctggctgccacaga

SEQ ID NO: 128157 - DNA, 22 bp, Artificial Sequence
  chemically synthesized
gccatgctggctgccacagacc

SEQ ID NO: 128158 - DNA, 22 bp, Artificial Sequence
  chemically synthesized
gctgccacagacctggggctgg

SEQ ID NO: 128159 - DNA, 22 bp, Artificial Sequence
  chemically synthesized
ccacagacctggggctggccct

SEQ ID NO: 128160 - DNA, 22 bp, Artificial Sequence
  chemically synthesized
gggctggccctgaccacaatgc

SEQ ID NO: 128161 - DNA, 22 bp, Artificial Sequence
  chemically synthesized
gccctgaccacaatgcccacgg

SEQ ID NO: 128162 - DNA, 22 bp, Artificial Sequence
  chemically synthesized
accacaatgcccacggtgctgg

SEQ ID NO: 128163 - DNA, 22 bp, Artificial Sequence
  chemically synthesized
ggagtcctctggctggatcaca

SEQ ID NO: 128164 - DNA, 22 bp, Artificial Sequence
  chemically synthesized
tggctggatcacagggagattg

SEQ ID NO: 128165 - DNA, 22 bp, Artificial Sequence
  chemically synthesized
gctggatcacagggagattgga

SEQ ID NO: 128166 - DNA, 22 bp, Artificial Sequence
  chemically synthesized
gatcacagggagattggaagtg

SEQ ID NO: 128167 - DNA, 22 bp, Artificial Sequence
  chemically synthesized
gaagtgcggcctgcttttccca

SEQ ID NO: 128168 - DNA, 22 bp, Artificial Sequence
  chemically synthesized
cttttcccaggcctactttata

SEQ ID NO: 128169 - DNA, 22 bp, Artificial Sequence
  chemically synthesized
ttcccaggcctactttatacac

SEQ ID NO: 128170 - DNA, 22 bp, Artificial Sequence
  chemically synthesized
tcccaggcctactttatacact

SEQ ID NO: 128171 - DNA, 22 bp, Artificial Sequence
  chemically synthesized
cccaggcctactttatacactc

SEQ ID NO: 128172 - DNA, 22 bp, Artificial Sequence
  chemically synthesized
ccaggcctactttatacactca

SEQ ID NO: 128173 - DNA, 22 bp, Artificial Sequence
  chemically synthesized
ctttatacactcactttccttt

SEQ ID NO: 128174 - DNA, 22 bp, Artificial Sequence
  chemically synthesized
tatacactcactttcctttctc

SEQ ID NO: 128175 - DNA, 22 bp, Artificial Sequence
  chemically synthesized
atacactcactttcctttctcg

SEQ ID NO: 128176 - DNA, 22 bp, Artificial Sequence
  chemically synthesized
tacactcactttcctttctcga

SEQ ID NO: 128177 - DNA, 22 bp, Artificial Sequence
  chemically synthesized
actttcctttctcgagtctggc

SEQ ID NO: 128178 - DNA, 22 bp, Artificial Sequence
  chemically synthesized
tcctttctcgagtctggcattc

SEQ ID NO: 128179 - DNA, 22 bp, Artificial Sequence
  chemically synthesized
cctttctcgagtctggcattct

SEQ ID NO: 128180 - DNA, 22 bp, Artificial Sequence
  chemically synthesized
ctttctcgagtctggcattctg

SEQ ID NO: 128181 - DNA, 22 bp, Artificial Sequence
  chemically synthesized
tctcgagtctggcattctgctt

SEQ ID NO: 128182 - DNA, 22 bp, Artificial Sequence
  chemically synthesized
ctcgagtctggcattctgcttg

SEQ ID NO: 128183 - DNA, 22 bp, Artificial Sequence
  chemically synthesized
tcgagtctggcattctgcttgc

SEQ ID NO: 128184 - DNA, 22 bp, Artificial Sequence
  chemically synthesized
gagtctggcattctgcttgcca

SEQ ID NO: 128185 - DNA, 22 bp, Artificial Sequence
  chemically synthesized
gcattctgcttgccatggccta

SEQ ID NO: 128186 - DNA, 22 bp, Artificial Sequence
  chemically synthesized
tgcttgccatggcctatgaccg

SEQ ID NO: 128187 - DNA, 22 bp, Artificial Sequence
  chemically synthesized
cttgccatggcctatgaccgtt

SEQ ID NO: 128188 - DNA, 22 bp, Artificial Sequence
  chemically synthesized
gccatggcctatgaccgtttta

SEQ ID NO: 128189 - DNA, 22 bp, Artificial Sequence
  chemically synthesized
ccatggcctatgaccgttttat

SEQ ID NO: 128190 - DNA, 22 bp, Artificial Sequence
  chemically synthesized
tgaccgttttattgccatctgc

SEQ ID NO: 128191 - DNA, 22 bp, Artificial Sequence
  chemically synthesized
tattgccatctgcaaccctctt

SEQ ID NO: 128192 - DNA, 22 bp, Artificial Sequence
  chemically synthesized
attgccatctgcaaccctctta

SEQ ID NO: 128193 - DNA, 22 bp, Artificial Sequence
  chemically synthesized
ttgccatctgcaaccctcttag

SEQ ID NO: 128194 - DNA, 22 bp, Artificial Sequence
  chemically synthesized
ccatctgcaaccctcttagata

SEQ ID NO: 128195 - DNA, 22 bp, Artificial Sequence
  chemically synthesized
caaccctcttagatatacctct

SEQ ID NO: 128196 - DNA, 22 bp, Artificial Sequence
  chemically synthesized
ttagatatacctctgtacttac

SEQ ID NO: 128197 - DNA, 22 bp, Artificial Sequence
  chemically synthesized
agatatacctctgtacttacta

SEQ ID NO: 128198 - DNA, 22 bp, Artificial Sequence
  chemically synthesized
gatatacctctgtacttactaa

SEQ ID NO: 128199 - DNA, 22 bp, Artificial Sequence
  chemically synthesized
tgtacttactaatactcgagta

SEQ ID NO: 128200 - DNA, 22 bp, Artificial Sequence
  chemically synthesized
tacttactaatactcgagtagt

SEQ ID NO: 128201 - DNA, 22 bp, Artificial Sequence
  chemically synthesized
actaatactcgagtagtgaaga

SEQ ID NO: 128202 - DNA, 22 bp, Artificial Sequence
  chemically synthesized
ctaatactcgagtagtgaagat

SEQ ID NO: 128203 - DNA, 22 bp, Artificial Sequence
  chemically synthesized
atactcgagtagtgaagattgg

SEQ ID NO: 128204 - DNA, 22 bp, Artificial Sequence
  chemically synthesized
gagtagtgaagattgggctggg

SEQ ID NO: 128205 - DNA, 22 bp, Artificial Sequence
  chemically synthesized
ggctgggagttctgatgagggg

SEQ ID NO: 128206 - DNA, 22 bp, Artificial Sequence
  chemically synthesized
ggagttctgatgaggggatttg

SEQ ID NO: 128207 - DNA, 22 bp, Artificial Sequence
  chemically synthesized
tgatgaggggatttgtatccgt

SEQ ID NO: 128208 - DNA, 22 bp, Artificial Sequence
  chemically synthesized
atgaggggatttgtatccgttg

SEQ ID NO: 128209 - DNA, 22 bp, Artificial Sequence
  chemically synthesized
gtatccgttgttcccccaatca

SEQ ID NO: 128210 - DNA, 22 bp, Artificial Sequence
  chemically synthesized
tatccgttgttcccccaatcag

SEQ ID NO: 128211 - DNA, 22 bp, Artificial Sequence
  chemically synthesized
ttcccccaatcaggcccctcta

SEQ ID NO: 128212 - DNA, 22 bp, Artificial Sequence
  chemically synthesized
ccccaatcaggcccctctattt

SEQ ID NO: 128213 - DNA, 22 bp, Artificial Sequence
  chemically synthesized
tatttttttctgtattgtcact

SEQ ID NO: 128214 - DNA, 22 bp, Artificial Sequence
  chemically synthesized
tttttttctgtattgtcactcc

SEQ ID NO: 128215 - DNA, 22 bp, Artificial Sequence
  chemically synthesized
ttttctgtattgtcactcccat

SEQ ID NO: 128216 - DNA, 22 bp, Artificial Sequence
  chemically synthesized
tttctgtattgtcactcccatg

SEQ ID NO: 128217 - DNA, 22 bp, Artificial Sequence
  chemically synthesized
ttctgtattgtcactcccatgt

SEQ ID NO: 128218 - DNA, 22 bp, Artificial Sequence
  chemically synthesized
tctgtattgtcactcccatgtt

SEQ ID NO: 128219 - DNA, 22 bp, Artificial Sequence
  chemically synthesized
ctgtattgtcactcccatgttc

SEQ ID NO: 128220 - DNA, 22 bp, Artificial Sequence
  chemically synthesized
tgtattgtcactcccatgttct

SEQ ID NO: 128221 - DNA, 22 bp, Artificial Sequence
  chemically synthesized
tattgtcactcccatgttcttt

SEQ ID NO: 128222 - DNA, 22 bp, Artificial Sequence
  chemically synthesized
tcactcccatgttctttcacat

SEQ ID NO: 128223 - DNA, 22 bp, Artificial Sequence
  chemically synthesized
ccatgttctttcacatgcattc

SEQ ID NO: 128224 - DNA, 22 bp, Artificial Sequence
  chemically synthesized
tttcacatgcattctgccttca

SEQ ID NO: 128225 - DNA, 22 bp, Artificial Sequence
  chemically synthesized
tcacatgcattctgccttcacc

SEQ ID NO: 128226 - DNA, 22 bp, Artificial Sequence
  chemically synthesized
cacatgcattctgccttcacca

SEQ ID NO: 128227 - DNA, 22 bp, Artificial Sequence
  chemically synthesized
acatgcattctgccttcaccag

SEQ ID NO: 128228 - DNA, 22 bp, Artificial Sequence
  chemically synthesized
tgccttcaccaggatgtcatta

SEQ ID NO: 128229 - DNA, 22 bp, Artificial Sequence
  chemically synthesized
ccttcaccaggatgtcattaaa

SEQ ID NO: 128230 - DNA, 22 bp, Artificial Sequence
  chemically synthesized
caccaggatgtcattaaactcg

SEQ ID NO: 128231 - DNA, 22 bp, Artificial Sequence
  chemically synthesized
accaggatgtcattaaactcgc

SEQ ID NO: 128232 - DNA, 22 bp, Artificial Sequence
  chemically synthesized
aactcgcctgtgctgataccac

SEQ ID NO: 128233 - DNA, 22 bp, Artificial Sequence
  chemically synthesized
gcctgtgctgataccaccttca

SEQ ID NO: 128234 - DNA, 22 bp, Artificial Sequence
  chemically synthesized
tgctgataccaccttcaaccga

SEQ ID NO: 128235 - DNA, 22 bp, Artificial Sequence
  chemically synthesized
ataccaccttcaaccgactgta

SEQ ID NO: 128236 - DNA, 22 bp, Artificial Sequence
  chemically synthesized
caaccgactgtacccagctgtg

SEQ ID NO: 128237 - DNA, 22 bp, Artificial Sequence
  chemically synthesized
aaccgactgtacccagctgtgc

SEQ ID NO: 128238 - DNA, 22 bp, Artificial Sequence
  chemically synthesized
tacccagctgtgcttgtagtct

SEQ ID NO: 128239 - DNA, 22 bp, Artificial Sequence
  chemically synthesized
tgcttgtagtctttatatttgt

SEQ ID NO: 128240 - DNA, 22 bp, Artificial Sequence
  chemically synthesized
gtagtctttatatttgtgctgg

SEQ ID NO: 128241 - DNA, 22 bp, Artificial Sequence
  chemically synthesized
tagtctttatatttgtgctgga

SEQ ID NO: 128242 - DNA, 22 bp, Artificial Sequence
  chemically synthesized
tatatttgtgctggattatctg

SEQ ID NO: 128243 - DNA, 22 bp, Artificial Sequence
  chemically synthesized
atatttgtgctggattatctga

SEQ ID NO: 128244 - DNA, 22 bp, Artificial Sequence
  chemically synthesized
tatttgtgctggattatctgat

SEQ ID NO: 128245 - DNA, 22 bp, Artificial Sequence
  chemically synthesized
gtgctggattatctgattatct

SEQ ID NO: 128246 - DNA, 22 bp, Artificial Sequence
  chemically synthesized
tgctggattatctgattatctt

SEQ ID NO: 128247 - DNA, 22 bp, Artificial Sequence
  chemically synthesized
gattatctgattatcttcatct

SEQ ID NO: 128248 - DNA, 22 bp, Artificial Sequence
  chemically synthesized
tctgattatcttcatctcctat

SEQ ID NO: 128249 - DNA, 22 bp, Artificial Sequence
  chemically synthesized
attatcttcatctcctatgtgt

SEQ ID NO: 128250 - DNA, 22 bp, Artificial Sequence
  chemically synthesized
tcttcatctcctatgtgttgat

SEQ ID NO: 128251 - DNA, 22 bp, Artificial Sequence
  chemically synthesized
catctcctatgtgttgatactc

SEQ ID NO: 128252 - DNA, 22 bp, Artificial Sequence
  chemically synthesized
atctcctatgtgttgatactca

SEQ ID NO: 128253 - DNA, 22 bp, Artificial Sequence
  chemically synthesized
ctatgtgttgatactcaagact

SEQ ID NO: 128254 - DNA, 22 bp, Artificial Sequence
  chemically synthesized
tgtgttgatactcaagactgtc

SEQ ID NO: 128255 - DNA, 22 bp, Artificial Sequence
  chemically synthesized
atactcaagactgtcctgagca

SEQ ID NO: 128256 - DNA, 22 bp, Artificial Sequence
  chemically synthesized
aagactgtcctgagcattgcct

SEQ ID NO: 128257 - DNA, 22 bp, Artificial Sequence
  chemically synthesized
tcctgagcattgcctccagaga

SEQ ID NO: 128258 - DNA, 22 bp, Artificial Sequence
  chemically synthesized
agcattgcctccagagaggaga

SEQ ID NO: 128259 - DNA, 22 bp, Artificial Sequence
  chemically synthesized
cctccagagaggagagggccaa

SEQ ID NO: 128260 - DNA, 22 bp, Artificial Sequence
  chemically synthesized
cagagaggagagggccaaggct

SEQ ID NO: 128261 - DNA, 22 bp, Artificial Sequence
  chemically synthesized
tcattacctgtgtctcccatat

SEQ ID NO: 128262 - DNA, 22 bp, Artificial Sequence
  chemically synthesized
attacctgtgtctcccatatct

SEQ ID NO: 128263 - DNA, 22 bp, Artificial Sequence
  chemically synthesized
cctgtgtctcccatatctgctg

SEQ ID NO: 128264 - DNA, 22 bp, Artificial Sequence
  chemically synthesized
tgtctcccatatctgctgtgtc

SEQ ID NO: 128265 - DNA, 22 bp, Artificial Sequence
  chemically synthesized
ccatatctgctgtgtcctggtt

SEQ ID NO: 128266 - DNA, 22 bp, Artificial Sequence
  chemically synthesized
ctgtgtcctggttttttatgtc

SEQ ID NO: 128267 - DNA, 22 bp, Artificial Sequence
  chemically synthesized
tgtcctggttttttatgtcaca

SEQ ID NO: 128268 - DNA, 22 bp, Artificial Sequence
  chemically synthesized
gttttttatgtcacagtgattg

SEQ ID NO: 128269 - DNA, 22 bp, Artificial Sequence
  chemically synthesized
tttatgtcacagtgattggatt

SEQ ID NO: 128270 - DNA, 22 bp, Artificial Sequence
  chemically synthesized
ttatgtcacagtgattggattg

SEQ ID NO: 128271 - DNA, 22 bp, Artificial Sequence
  chemically synthesized
tatgtcacagtgattggattgt

SEQ ID NO: 128272 - DNA, 22 bp, Artificial Sequence
  chemically synthesized
atgtcacagtgattggattgtc

SEQ ID NO: 128273 - DNA, 22 bp, Artificial Sequence
  chemically synthesized
tgtcacagtgattggattgtct

SEQ ID NO: 128274 - DNA, 22 bp, Artificial Sequence
  chemically synthesized
gattgtctctgattcatcgttt

SEQ ID NO: 128275 - DNA, 22 bp, Artificial Sequence
  chemically synthesized
tctctgattcatcgttttggaa

SEQ ID NO: 128276 - DNA, 22 bp, Artificial Sequence
  chemically synthesized
tgattcatcgttttggaaagca

SEQ ID NO: 128277 - DNA, 22 bp, Artificial Sequence
  chemically synthesized
attcatcgttttggaaagcagg

SEQ ID NO: 128278 - DNA, 22 bp, Artificial Sequence
  chemically synthesized
atcgttttggaaagcaggttcc

SEQ ID NO: 128279 - DNA, 22 bp, Artificial Sequence
  chemically synthesized
tggaaagcaggttccacatatt

SEQ ID NO: 128280 - DNA, 22 bp, Artificial Sequence
  chemically synthesized
ggaaagcaggttccacatattg

SEQ ID NO: 128281 - DNA, 22 bp, Artificial Sequence
  chemically synthesized
gaaagcaggttccacatattgt

SEQ ID NO: 128282 - DNA, 22 bp, Artificial Sequence
  chemically synthesized
cacatattgttcacctcattat

SEQ ID NO: 128283 - DNA, 22 bp, Artificial Sequence
  chemically synthesized
ttcacctcattatgagctatgc

SEQ ID NO: 128284 - DNA, 22 bp, Artificial Sequence
  chemically synthesized
acctcattatgagctatgccta

SEQ ID NO: 128285 - DNA, 22 bp, Artificial Sequence
  chemically synthesized
attatgagctatgcctattttc

SEQ ID NO: 128286 - DNA, 22 bp, Artificial Sequence
  chemically synthesized
tgagctatgcctattttctgtt

SEQ ID NO: 128287 - DNA, 22 bp, Artificial Sequence
  chemically synthesized
tgcctattttctgttccctcca

SEQ ID NO: 128288 - DNA, 22 bp, Artificial Sequence
  chemically synthesized
ttttctgttccctccactaatg

SEQ ID NO: 128289 - DNA, 22 bp, Artificial Sequence
  chemically synthesized
tctgttccctccactaatgaat

SEQ ID NO: 128290 - DNA, 22 bp, Artificial Sequence
  chemically synthesized
ctgttccctccactaatgaatc

SEQ ID NO: 128291 - DNA, 22 bp, Artificial Sequence
  chemically synthesized
tgttccctccactaatgaatcc

SEQ ID NO: 128292 - DNA, 22 bp, Artificial Sequence
  chemically synthesized
ttccctccactaatgaatccta

SEQ ID NO: 128293 - DNA, 22 bp, Artificial Sequence
  chemically synthesized
cctccactaatgaatcctataa

SEQ ID NO: 128294 - DNA, 22 bp, Artificial Sequence
  chemically synthesized
cactaatgaatcctataacata

SEQ ID NO: 128295 - DNA, 22 bp, Artificial Sequence
  chemically synthesized
atgaatcctataacatatagtg

SEQ ID NO: 128296 - DNA, 22 bp, Artificial Sequence
  chemically synthesized
taacatatagtgtcaagaccaa

SEQ ID NO: 128297 - DNA, 22 bp, Artificial Sequence
  chemically synthesized
agaatgccattcttcacctttt

SEQ ID NO: 128298 - DNA, 22 bp, Artificial Sequence
  chemically synthesized
ttcacctttttactacccatag

SEQ ID NO: 128299 - DNA, 22 bp, Artificial Sequence
  chemically synthesized
cacctttttactacccatagaa

SEQ ID NO: 128300 - DNA, 22 bp, Artificial Sequence
  chemically synthesized
acctttttactacccatagaat

SEQ ID NO: 128301 - DNA, 22 bp, Artificial Sequence
  chemically synthesized
tttactacccatagaattggaa

SEQ ID NO: 128302 - DNA, 22 bp, Artificial Sequence
  chemically synthesized
ttactacccatagaattggaac

SEQ ID NO: 128303 - DNA, 22 bp, Artificial Sequence
  chemically synthesized
tactacccatagaattggaacc

SEQ ID NO: 128304 - DNA, 22 bp, Artificial Sequence
  chemically synthesized
actacccatagaattggaacct

SEQ ID NO: 128305 - DNA, 22 bp, Artificial Sequence
  chemically synthesized
ctacccatagaattggaacctg

SEQ ID NO: 128306 - DNA, 22 bp, Artificial Sequence
  chemically synthesized
cccatagaattggaacctgatc

SEQ ID NO: 128307 - DNA, 22 bp, Artificial Sequence
  chemically synthesized
gaacctgatctccaatcatcac

SEQ ID NO: 128308 - DNA, 22 bp, Artificial Sequence
  chemically synthesized
atctccaatcatcacagtcact

SEQ ID NO: 128309 - DNA, 22 bp, Artificial Sequence
  chemically synthesized
caatcatcacagtcactctcac

SEQ ID NO: 128310 - DNA, 22 bp, Artificial Sequence
  chemically synthesized
tcacagaatgtaaaaactctaa

SEQ ID NO: 128311 - DNA, 22 bp, Artificial Sequence
  chemically synthesized
acagaatgtaaaaactctaata

SEQ ID NO: 128312 - DNA, 22 bp, Artificial Sequence
  chemically synthesized
taatatttagcaggagagcaaa

SEQ ID NO: 128313 - DNA, 22 bp, Artificial Sequence
  chemically synthesized
atatttagcaggagagcaaaga

SEQ ID NO: 128314 - DNA, 22 bp, Artificial Sequence
  chemically synthesized
agcaggagagcaaagaagtctc

SEQ ID NO: 128315 - DNA, 22 bp, Artificial Sequence
  chemically synthesized
gcaggagagcaaagaagtctca

SEQ ID NO: 128316 - DNA, 22 bp, Artificial Sequence
  chemically synthesized
atatctagcatgcatgctcata

SEQ ID NO: 128317 - DNA, 22 bp, Artificial Sequence
  chemically synthesized
gcatgcatgctcatatgacttg

SEQ ID NO: 128318 - DNA, 22 bp, Artificial Sequence
  chemically synthesized
atatgacttggtaaaataggtg

SEQ ID NO: 128319 - DNA, 22 bp, Artificial Sequence
  chemically synthesized
ggtaaaataggtgttaaaatac

SEQ ID NO: 128320 - DNA, 22 bp, Artificial Sequence
  chemically synthesized
gtaaaataggtgttaaaataca

SEQ ID NO: 128321 - DNA, 22 bp, Artificial Sequence
  chemically synthesized
aaatacagcttcaagtttccct

SEQ ID NO: 128322 - DNA, 22 bp, Artificial Sequence
  chemically synthesized
caagtttccctaaggtatctct

SEQ ID NO: 128323 - DNA, 22 bp, Artificial Sequence
  chemically synthesized
aagtttccctaaggtatctctt

SEQ ID NO: 128324 - DNA, 22 bp, Artificial Sequence
  chemically synthesized
ccctaaggtatctctttaagcc

SEQ ID NO: 128325 - DNA, 22 bp, Artificial Sequence
  chemically synthesized
cctaaggtatctctttaagccc

SEQ ID NO: 128326 - DNA, 22 bp, Artificial Sequence
  chemically synthesized
aggtatctctttaagcccaact

SEQ ID NO: 128327 - DNA, 22 bp, Artificial Sequence
  chemically synthesized
tttaagcccaactctttagcta

SEQ ID NO: 128328 - DNA, 22 bp, Artificial Sequence
  chemically synthesized
taagcccaactctttagctaaa

SEQ ID NO: 128329 - DNA, 22 bp, Artificial Sequence
  chemically synthesized
aagcccaactctttagctaaat

SEQ ID NO: 128330 - DNA, 22 bp, Artificial Sequence
  chemically synthesized
agcccaactctttagctaaatg

SEQ ID NO: 128331 - DNA, 22 bp, Artificial Sequence
  chemically synthesized
tttagctaaatgtagtttgtac

SEQ ID NO: 128332 - DNA, 22 bp, Artificial Sequence
  chemically synthesized
tagctaaatgtagtttgtacaa

SEQ ID NO: 128333 - DNA, 22 bp, Artificial Sequence
  chemically synthesized
agctaaatgtagtttgtacaaa

SEQ ID NO: 128334 - DNA, 22 bp, Artificial Sequence
  chemically synthesized
gctaaatgtagtttgtacaaat

SEQ ID NO: 128335 - DNA, 22 bp, Artificial Sequence
  chemically synthesized
aatgtagtttgtacaaattttt

SEQ ID NO: 128336 - DNA, 22 bp, Artificial Sequence
  chemically synthesized
gtacaaatttttgttgcattcc

SEQ ID NO: 128337 - DNA, 22 bp, Artificial Sequence
  chemically synthesized
tacaaatttttgttgcattcct

SEQ ID NO: 128338 - DNA, 22 bp, Artificial Sequence
  chemically synthesized
ttgttgcattcctgtaaacgga

SEQ ID NO: 128339 - DNA, 22 bp, Artificial Sequence
  chemically synthesized
tgttgcattcctgtaaacggaa

SEQ ID NO: 128340 - DNA, 22 bp, Artificial Sequence
  chemically synthesized
gttgcattcctgtaaacggaat

SEQ ID NO: 128341 - DNA, 22 bp, Artificial Sequence
  chemically synthesized
ttgcattcctgtaaacggaata

SEQ ID NO: 128342 - DNA, 22 bp, Artificial Sequence
  chemically synthesized
cattcctgtaaacggaatattt

SEQ ID NO: 128343 - DNA, 22 bp, Artificial Sequence
  chemically synthesized
ctgtaaacggaatatttctcta

SEQ ID NO: 128344 - DNA, 22 bp, Artificial Sequence
  chemically synthesized
taaacggaatatttctctaagc

SEQ ID NO: 128345 - DNA, 22 bp, Artificial Sequence
  chemically synthesized
ctctaagctttccactaaatta

SEQ ID NO: 128346 - DNA, 22 bp, Artificial Sequence
  chemically synthesized
tctaagctttccactaaattat

SEQ ID NO: 128347 - DNA, 22 bp, Artificial Sequence
  chemically synthesized
taagctttccactaaattattg

SEQ ID NO: 128348 - DNA, 22 bp, Artificial Sequence
  chemically synthesized
agctttccactaaattattgtg

SEQ ID NO: 128349 - DNA, 22 bp, Artificial Sequence
  chemically synthesized
tccactaaattattgtgataac

SEQ ID NO: 128350 - DNA, 22 bp, Artificial Sequence
  chemically synthesized
ccactaaattattgtgataaca

SEQ ID NO: 128351 - DNA, 22 bp, Artificial Sequence
  chemically synthesized
cactaaattattgtgataacaa

SEQ ID NO: 128352 - DNA, 22 bp, Artificial Sequence
  chemically synthesized
aattattgtgataacaatacct

SEQ ID NO: 128353 - DNA, 22 bp, Artificial Sequence
  chemically synthesized
ttgtgataacaataccttaggc

SEQ ID NO: 128354 - DNA, 22 bp, Artificial Sequence
  chemically synthesized
tgataacaataccttaggcatc

SEQ ID NO: 128355 - DNA, 22 bp, Artificial Sequence
  chemically synthesized
aggcatctattggtatgtctat

SEQ ID NO: 128356 - DNA, 22 bp, Artificial Sequence
  chemically synthesized
ggcatctattggtatgtctata

SEQ ID NO: 128357 - DNA, 22 bp, Artificial Sequence
  chemically synthesized
ttggtatgtctataatgtaact

SEQ ID NO: 128358 - DNA, 22 bp, Artificial Sequence
  chemically synthesized
gtatgtctataatgtaactaac

SEQ ID NO: 128359 - DNA, 22 bp, Artificial Sequence
  chemically synthesized
taatgtaactaacatatgttta

SEQ ID NO: 128360 - DNA, 22 bp, Artificial Sequence
  chemically synthesized
acatatgtttatttcatggtat

SEQ ID NO: 128361 - DNA, 22 bp, Artificial Sequence
  chemically synthesized
atttcatggtataaagttagca

SEQ ID NO: 128362 - DNA, 22 bp, Artificial Sequence
  chemically synthesized
tttcatggtataaagttagcag

SEQ ID NO: 128363 - DNA, 22 bp, Artificial Sequence
  chemically synthesized
catggtataaagttagcagata

SEQ ID NO: 128364 - DNA, 22 bp, Artificial Sequence
  chemically synthesized
atggtataaagttagcagatag

SEQ ID NO: 128365 - DNA, 22 bp, Artificial Sequence
  chemically synthesized
gcagataggaacagaatcataa

SEQ ID NO: 128366 - DNA, 22 bp, Artificial Sequence
  chemically synthesized
ttagttggttcgagtgaaatgg

SEQ ID NO: 128367 - DNA, 22 bp, Artificial Sequence
  chemically synthesized
gttggttcgagtgaaatggaat

SEQ ID NO: 128368 - DNA, 22 bp, Artificial Sequence
  chemically synthesized
gttcgagtgaaatggaatagag

SEQ ID NO: 128369 - DNA, 22 bp, Artificial Sequence
  chemically synthesized
gagtgaaatggaatagagtttg

SEQ ID NO: 128370 - DNA, 22 bp, Artificial Sequence
  chemically synthesized
ggtttactatgtcaaatctaat

SEQ ID NO: 128371 - DNA, 22 bp, Artificial Sequence
  chemically synthesized
gtttactatgtcaaatctaatt

SEQ ID NO: 128372 - DNA, 22 bp, Artificial Sequence
  chemically synthesized
actatgtcaaatctaatttcca

SEQ ID NO: 128373 - DNA, 22 bp, Artificial Sequence
  chemically synthesized
ctatgtcaaatctaatttccaa

SEQ ID NO: 128374 - DNA, 22 bp, Artificial Sequence
  chemically synthesized
tgtcaaatctaatttccaactc

SEQ ID NO: 128375 - DNA, 22 bp, Artificial Sequence
  chemically synthesized
atttccaactcttatgaatttc

SEQ ID NO: 128376 - DNA, 22 bp, Artificial Sequence
  chemically synthesized
ccaactcttatgaatttctctg

SEQ ID NO: 128377 - DNA, 22 bp, Artificial Sequence
  chemically synthesized
caactcttatgaatttctctgc

SEQ ID NO: 128378 - DNA, 22 bp, Artificial Sequence
  chemically synthesized
ttatgaatttctctgcaggtgt

SEQ ID NO: 128379 - DNA, 22 bp, Artificial Sequence
  chemically synthesized
atgaatttctctgcaggtgtcc

SEQ ID NO: 128380 - DNA, 22 bp, Artificial Sequence
  chemically synthesized
tgaatttctctgcaggtgtcca

SEQ ID NO: 128381 - DNA, 22 bp, Artificial Sequence
  chemically synthesized
ctctgcaggtgtccatacaaac

SEQ ID NO: 128382 - DNA, 22 bp, Artificial Sequence
  chemically synthesized
tctgcaggtgtccatacaaaca

SEQ ID NO: 128383 - DNA, 22 bp, Artificial Sequence
  chemically synthesized
tgcaggtgtccatacaaacaat

SEQ ID NO: 128384 - DNA, 22 bp, Artificial Sequence
  chemically synthesized
caggtgtccatacaaacaatgg

SEQ ID NO: 128385 - DNA, 22 bp, Artificial Sequence
  chemically synthesized
taaatttggtcactgaagtcca

SEQ ID NO: 128386 - DNA, 22 bp, Artificial Sequence
  chemically synthesized
ggtcactgaagtccaggaattt

SEQ ID NO: 128387 - DNA, 22 bp, Artificial Sequence
  chemically synthesized
gtcactgaagtccaggaatttt

SEQ ID NO: 128388 - DNA, 22 bp, Artificial Sequence
  chemically synthesized
aagtccaggaattttcctgcaa

SEQ ID NO: 128389 - DNA, 22 bp, Artificial Sequence
  chemically synthesized
tcctgcaaaaaagaatataatc

SEQ ID NO: 128390 - DNA, 22 bp, Artificial Sequence
  chemically synthesized
cctgcaaaaaagaatataatct

SEQ ID NO: 128391 - DNA, 22 bp, Artificial Sequence
  chemically synthesized
ctgcaaaaaagaatataatctt

SEQ ID NO: 128392 - DNA, 22 bp, Artificial Sequence
  chemically synthesized
caaaaaagaatataatcttctt

SEQ ID NO: 128393 - DNA, 22 bp, Artificial Sequence
  chemically synthesized
ctttgatcagtgacctaattac

SEQ ID NO: 128394 - DNA, 22 bp, Artificial Sequence
  chemically synthesized
tttgatcagtgacctaattact

SEQ ID NO: 128395 - DNA, 22 bp, Artificial Sequence
  chemically synthesized
tgatcagtgacctaattactta

SEQ ID NO: 128396 - DNA, 22 bp, Artificial Sequence
  chemically synthesized
gatcagtgacctaattacttat

SEQ ID NO: 128397 - DNA, 22 bp, Artificial Sequence
  chemically synthesized
atcagtgacctaattacttatc

SEQ ID NO: 128398 - DNA, 22 bp, Artificial Sequence
  chemically synthesized
attacttatcatctcaacagtc

SEQ ID NO: 128399 - DNA, 22 bp, Artificial Sequence
  chemically synthesized
cttatcatctcaacagtctagt

SEQ ID NO: 128400 - DNA, 22 bp, Artificial Sequence
  chemically synthesized
atcatctcaacagtctagttgg

SEQ ID NO: 128401 - DNA, 22 bp, Artificial Sequence
  chemically synthesized
tcatctcaacagtctagttggt

SEQ ID NO: 128402 - DNA, 22 bp, Artificial Sequence
  chemically synthesized
aacagtctagttggttcctcct

SEQ ID NO: 128403 - DNA, 22 bp, Artificial Sequence
  chemically synthesized
gttggttcctcctccctccatc

SEQ ID NO: 128404 - DNA, 22 bp, Artificial Sequence
  chemically synthesized
gttcctcctccctccatcaaat

SEQ ID NO: 128405 - DNA, 22 bp, Artificial Sequence
  chemically synthesized
ctcctccctccatcaaattata

SEQ ID NO: 128406 - DNA, 22 bp, Artificial Sequence
  chemically synthesized
ctccctccatcaaattataatg

SEQ ID NO: 128407 - DNA, 22 bp, Artificial Sequence
  chemically synthesized
cctccatcaaattataatgaat

SEQ ID NO: 128408 - DNA, 22 bp, Artificial Sequence
  chemically synthesized
catcaaattataatgaatttgt

SEQ ID NO: 128409 - DNA, 22 bp, Artificial Sequence
  chemically synthesized
taatgaatttgtctcaaaaacc

SEQ ID NO: 128410 - DNA, 22 bp, Artificial Sequence
  chemically synthesized
gtctcaaaaaccataaactcat

SEQ ID NO: 128411 - DNA, 22 bp, Artificial Sequence
  chemically synthesized
tctcaaaaaccataaactcata

SEQ ID NO: 128412 - DNA, 22 bp, Artificial Sequence
  chemically synthesized
aaaaaccataaactcatattta

SEQ ID NO: 128413 - DNA, 22 bp, Artificial Sequence
  chemically synthesized
atatttattccccaaggcagta

SEQ ID NO: 128414 - DNA, 22 bp, Artificial Sequence
  chemically synthesized
attccccaaggcagtaccttct

SEQ ID NO: 128415 - DNA, 22 bp, Artificial Sequence
  chemically synthesized
ttccccaaggcagtaccttctg

SEQ ID NO: 128416 - DNA, 22 bp, Artificial Sequence
  chemically synthesized
cccaaggcagtaccttctgaca

SEQ ID NO: 128417 - DNA, 22 bp, Artificial Sequence
  chemically synthesized
ctgacaaacttgtaacaaaaaa

SEQ ID NO: 128418 - DNA, 22 bp, Artificial Sequence
  chemically synthesized
tgacaaacttgtaacaaaaaaa

SEQ ID NO: 128419 - DNA, 22 bp, Artificial Sequence
  chemically synthesized
acaaacttgtaacaaaaaaatg

SEQ ID NO: 128420 - DNA, 22 bp, Artificial Sequence
  chemically synthesized
gtaacaaaaaaatgtgagaaga

SEQ ID NO: 128421 - DNA, 22 bp, Artificial Sequence
  chemically synthesized
taacaaaaaaatgtgagaagag

SEQ ID NO: 128422 - DNA, 22 bp, Artificial Sequence
  chemically synthesized
cttctatcttgctctcattctt

SEQ ID NO: 128423 - DNA, 22 bp, Artificial Sequence
  chemically synthesized
ctatcttgctctcattcttatt

SEQ ID NO: 128424 - DNA, 22 bp, Artificial Sequence
  chemically synthesized
tatcttgctctcattcttattc

SEQ ID NO: 128425 - DNA, 22 bp, Artificial Sequence
  chemically synthesized
tcttgctctcattcttattcta

SEQ ID NO: 128426 - DNA, 22 bp, Artificial Sequence
  chemically synthesized
gctctcattcttattctactac

SEQ ID NO: 128427 - DNA, 22 bp, Artificial Sequence
  chemically synthesized
ctctcattcttattctactacc

SEQ ID NO: 128428 - DNA, 22 bp, Artificial Sequence
  chemically synthesized
tcattcttattctactacccta

SEQ ID NO: 128429 - DNA, 22 bp, Artificial Sequence
  chemically synthesized
attcttattctactaccctagt

SEQ ID NO: 128430 - DNA, 22 bp, Artificial Sequence
  chemically synthesized
ttattctactaccctagttgct

SEQ ID NO: 128431 - DNA, 22 bp, Artificial Sequence
  chemically synthesized
attctactaccctagttgctag

SEQ ID NO: 128432 - DNA, 22 bp, Artificial Sequence
  chemically synthesized
ttctactaccctagttgctagc

SEQ ID NO: 128433 - DNA, 22 bp, Artificial Sequence
  chemically synthesized
tactaccctagttgctagctcc

SEQ ID NO: 128434 - DNA, 22 bp, Artificial Sequence
  chemically synthesized
ctaccctagttgctagctccaa

SEQ ID NO: 128435 - DNA, 22 bp, Artificial Sequence
  chemically synthesized
ccctagttgctagctccaatgt

SEQ ID NO: 128436 - DNA, 22 bp, Artificial Sequence
  chemically synthesized
gttgctagctccaatgttgagg

SEQ ID NO: 128437 - DNA, 22 bp, Artificial Sequence
  chemically synthesized
ctagctccaatgttgaggccat

SEQ ID NO: 128438 - DNA, 22 bp, Artificial Sequence
  chemically synthesized
gctccaatgttgaggccatcct

SEQ ID NO: 128439 - DNA, 22 bp, Artificial Sequence
  chemically synthesized
caatgttgaggccatcctcaga

SEQ ID NO: 128440 - DNA, 22 bp, Artificial Sequence
  chemically synthesized
aggccatcctcagatatctacg

SEQ ID NO: 128441 - DNA, 22 bp, Artificial Sequence
  chemically synthesized
agatatctacgctggctgacta

SEQ ID NO: 128442 - DNA, 22 bp, Artificial Sequence
  chemically synthesized
cgctggctgactagtccaaatt

SEQ ID NO: 128443 - DNA, 22 bp, Artificial Sequence
  chemically synthesized
gctgactagtccaaattagtgg

SEQ ID NO: 128444 - DNA, 22 bp, Artificial Sequence
  chemically synthesized
actagtccaaattagtggaaga

SEQ ID NO: 128445 - DNA, 22 bp, Artificial Sequence
  chemically synthesized
gtccaaattagtggaagagaca

SEQ ID NO: 128446 - DNA, 22 bp, Artificial Sequence
  chemically synthesized
gtggaagagacagttccttcac

SEQ ID NO: 128447 - DNA, 22 bp, Artificial Sequence
  chemically synthesized
cttcaccctccttttgctatga

SEQ ID NO: 128448 - DNA, 22 bp, Artificial Sequence
  chemically synthesized
caccctccttttgctatgaaaa

SEQ ID NO: 128449 - DNA, 22 bp, Artificial Sequence
  chemically synthesized
accctccttttgctatgaaaaa

SEQ ID NO: 128450 - DNA, 22 bp, Artificial Sequence
  chemically synthesized
cttttgctatgaaaaaggtctg

SEQ ID NO: 128451 - DNA, 22 bp, Artificial Sequence
  chemically synthesized
ttgctatgaaaaaggtctgaag

SEQ ID NO: 128452 - DNA, 22 bp, Artificial Sequence
  chemically synthesized
tgctatgaaaaaggtctgaagg

SEQ ID NO: 128453 - DNA, 22 bp, Artificial Sequence
  chemically synthesized
gctatgaaaaaggtctgaagga

SEQ ID NO: 128454 - DNA, 22 bp, Artificial Sequence
  chemically synthesized
ctatgaaaaaggtctgaaggaa

SEQ ID NO: 128455 - DNA, 22 bp, Artificial Sequence
  chemically synthesized
tgaaaaaggtctgaaggaacaa

SEQ ID NO: 128456 - DNA, 22 bp, Artificial Sequence
  chemically synthesized
aaggaacaaaaaaaaataggtt

SEQ ID NO: 128457 - DNA, 22 bp, Artificial Sequence
  chemically synthesized
ctgcatttttttgaagaatgat

SEQ ID NO: 128458 - DNA, 22 bp, Artificial Sequence
  chemically synthesized
tgcatttttttgaagaatgatt

SEQ ID NO: 128459 - DNA, 22 bp, Artificial Sequence
  chemically synthesized
catttttttgaagaatgattgc

SEQ ID NO: 128460 - DNA, 22 bp, Artificial Sequence
  chemically synthesized
ttttgaagaatgattgctttct

SEQ ID NO: 128461 - DNA, 22 bp, Artificial Sequence
  chemically synthesized
tttgaagaatgattgctttctg

SEQ ID NO: 128462 - DNA, 22 bp, Artificial Sequence
  chemically synthesized
ttgaagaatgattgctttctgt

SEQ ID NO: 128463 - DNA, 22 bp, Artificial Sequence
  chemically synthesized
tgaagaatgattgctttctgta

SEQ ID NO: 128464 - DNA, 22 bp, Artificial Sequence
  chemically synthesized
gaagaatgattgctttctgtac

SEQ ID NO: 128465 - DNA, 22 bp, Artificial Sequence
  chemically synthesized
aagaatgattgctttctgtaca

SEQ ID NO: 128466 - DNA, 22 bp, Artificial Sequence
  chemically synthesized
ctttctgtacatacattctgat

SEQ ID NO: 128467 - DNA, 22 bp, Artificial Sequence
  chemically synthesized
tctgtacatacattctgattcc

SEQ ID NO: 128468 - DNA, 22 bp, Artificial Sequence
  chemically synthesized
ctgtacatacattctgattcca

SEQ ID NO: 128469 - DNA, 22 bp, Artificial Sequence
  chemically synthesized
tgtacatacattctgattccat

SEQ ID NO: 128470 - DNA, 22 bp, Artificial Sequence
  chemically synthesized
tacatacattctgattccatgt

SEQ ID NO: 128471 - DNA, 22 bp, Artificial Sequence
  chemically synthesized
tgattccatgtaataagtgtaa

SEQ ID NO: 128472 - DNA, 22 bp, Artificial Sequence
  chemically synthesized
attccatgtaataagtgtaaat

SEQ ID NO: 128473 - DNA, 22 bp, Artificial Sequence
  chemically synthesized
catgtaataagtgtaaatttcc

SEQ ID NO: 128474 - DNA, 22 bp, Artificial Sequence
  chemically synthesized
cccaaagaatacaacaatgtca

SEQ ID NO: 128475 - DNA, 22 bp, Artificial Sequence
  chemically synthesized
ccaaagaatacaacaatgtcat

SEQ ID NO: 128476 - DNA, 22 bp, Artificial Sequence
  chemically synthesized
tcatttgattaaaattgtctga

SEQ ID NO: 128477 - DNA, 22 bp, Artificial Sequence
  chemically synthesized
atttgattaaaattgtctgatg

SEQ ID NO: 128478 - DNA, 22 bp, Artificial Sequence
  chemically synthesized
gattaaaattgtctgatgagtt

SEQ ID NO: 128479 - DNA, 22 bp, Artificial Sequence
  chemically synthesized
attaaaattgtctgatgagtta

SEQ ID NO: 128480 - DNA, 22 bp, Artificial Sequence
  chemically synthesized
aaattgtctgatgagttaggaa

SEQ ID NO: 128481 - DNA, 22 bp, Artificial Sequence
  chemically synthesized
tctgatgagttaggaagggacc

SEQ ID NO: 128482 - DNA, 22 bp, Artificial Sequence
  chemically synthesized
atgagttaggaagggacccata

SEQ ID NO: 128483 - DNA, 22 bp, Artificial Sequence
  chemically synthesized
ggaagggacccataactcaatt

SEQ ID NO: 128484 - DNA, 22 bp, Artificial Sequence
  chemically synthesized
aatttaaaatatcctaaaaaga

SEQ ID NO: 128485 - DNA, 22 bp, Artificial Sequence
  chemically synthesized
aaaatatcctaaaaagagggag

SEQ ID NO: 128486 - DNA, 22 bp, Artificial Sequence
  chemically synthesized
aaatatcctaaaaagagggagg

SEQ ID NO: 128487 - DNA, 22 bp, Artificial Sequence
  chemically synthesized
aaaagagggaggttatgtctta

SEQ ID NO: 128488 - DNA, 22 bp, Artificial Sequence
  chemically synthesized
tgtcttaattatactttaatca

SEQ ID NO: 128489 - DNA, 22 bp, Artificial Sequence
  chemically synthesized
aattatactttaatcagagcaa

SEQ ID NO: 128490 - DNA, 22 bp, Artificial Sequence
  chemically synthesized
attatactttaatcagagcaaa

SEQ ID NO: 128491 - DNA, 22 bp, Artificial Sequence
  chemically synthesized
tactttaatcagagcaaaaata

SEQ ID NO: 128492 - DNA, 22 bp, Artificial Sequence
  chemically synthesized
taatcagagcaaaaataatact

SEQ ID NO: 128493 - DNA, 22 bp, Artificial Sequence
  chemically synthesized
aatcagagcaaaaataatactt

SEQ ID NO: 128494 - DNA, 22 bp, Artificial Sequence
  chemically synthesized
atcagagcaaaaataatacttc

SEQ ID NO: 128495 - DNA, 22 bp, Artificial Sequence
  chemically synthesized
cagtgagacaagagaggggact

SEQ ID NO: 128496 - DNA, 22 bp, Artificial Sequence
  chemically synthesized
agtgagacaagagaggggacta

SEQ ID NO: 128497 - DNA, 22 bp, Artificial Sequence
  chemically synthesized
tatagaagatattgtttatgtc

SEQ ID NO: 128498 - DNA, 22 bp, Artificial Sequence
  chemically synthesized
tttatgtctttggtgttttacc

SEQ ID NO: 128499 - DNA, 22 bp, Artificial Sequence
  chemically synthesized
atgtctttggtgttttaccccg

SEQ ID NO: 128500 - DNA, 22 bp, Artificial Sequence
  chemically synthesized
tgtctttggtgttttaccccga

SEQ ID NO: 128501 - DNA, 22 bp, Artificial Sequence
  chemically synthesized
tggtgttttaccccgatcattt

SEQ ID NO: 128502 - DNA, 22 bp, Artificial Sequence
  chemically synthesized
ggtgttttaccccgatcatttt

SEQ ID NO: 128503 - DNA, 22 bp, Artificial Sequence
  chemically synthesized
gtgttttaccccgatcatttta

SEQ ID NO: 128504 - DNA, 22 bp, Artificial Sequence
  chemically synthesized
taccccgatcattttacagaat

SEQ ID NO: 128505 - DNA, 22 bp, Artificial Sequence
  chemically synthesized
accccgatcattttacagaatt

SEQ ID NO: 128506 - DNA, 22 bp, Artificial Sequence
  chemically synthesized
ccccgatcattttacagaattg

SEQ ID NO: 128507 - DNA, 22 bp, Artificial Sequence
  chemically synthesized
tacagaattgtgcacctgtgaa

SEQ ID NO: 128508 - DNA, 22 bp, Artificial Sequence
  chemically synthesized
acagaattgtgcacctgtgaat

SEQ ID NO: 128509 - DNA, 22 bp, Artificial Sequence
  chemically synthesized
cagaattgtgcacctgtgaatg

SEQ ID NO: 128510 - DNA, 22 bp, Artificial Sequence
  chemically synthesized
tgcacctgtgaatgttggctgc

SEQ ID NO: 128511 - DNA, 22 bp, Artificial Sequence
  chemically synthesized
tgaatgttggctgctcattgtt

SEQ ID NO: 128512 - DNA, 22 bp, Artificial Sequence
  chemically synthesized
gctgctcattgttcatgtttct

SEQ ID NO: 128513 - DNA, 22 bp, Artificial Sequence
  chemically synthesized
ctcattgttcatgtttctgctt

SEQ ID NO: 128514 - DNA, 22 bp, Artificial Sequence
  chemically synthesized
attgttcatgtttctgctttct

SEQ ID NO: 128515 - DNA, 22 bp, Artificial Sequence
  chemically synthesized
ttcatgtttctgctttctgcag

SEQ ID NO: 128516 - DNA, 22 bp, Artificial Sequence
  chemically synthesized
atgtttctgctttctgcaggtt

SEQ ID NO: 128517 - DNA, 22 bp, Artificial Sequence
  chemically synthesized
ctgctttctgcaggttgttgtt

SEQ ID NO: 128518 - DNA, 22 bp, Artificial Sequence
  chemically synthesized
tgctttctgcaggttgttgttc

SEQ ID NO: 128519 - DNA, 22 bp, Artificial Sequence
  chemically synthesized
ctttctgcaggttgttgttctc

SEQ ID NO: 128520 - DNA, 22 bp, Artificial Sequence
  chemically synthesized
tctgcaggttgttgttctcaac

SEQ ID NO: 128521 - DNA, 22 bp, Artificial Sequence
  chemically synthesized
ctgcaggttgttgttctcaact

SEQ ID NO: 128522 - DNA, 22 bp, Artificial Sequence
  chemically synthesized
tgcaggttgttgttctcaactc

SEQ ID NO: 128523 - DNA, 22 bp, Artificial Sequence
  chemically synthesized
caggttgttgttctcaactcag

SEQ ID NO: 128524 - DNA, 22 bp, Artificial Sequence
  chemically synthesized
ttgttctcaactcagcaggaaa

SEQ ID NO: 128525 - DNA, 22 bp, Artificial Sequence
  chemically synthesized
ttctcaactcagcaggaaatgt

SEQ ID NO: 128526 - DNA, 22 bp, Artificial Sequence
  chemically synthesized
tcaactcagcaggaaatgtctt

SEQ ID NO: 128527 - DNA, 22 bp, Artificial Sequence
  chemically synthesized
aactcagcaggaaatgtcttat

SEQ ID NO: 128528 - DNA, 22 bp, Artificial Sequence
  chemically synthesized
agcaggaaatgtcttatgaaga

SEQ ID NO: 128529 - DNA, 22 bp, Artificial Sequence
  chemically synthesized
atgaagaaaatggcccctgctc

SEQ ID NO: 128530 - DNA, 22 bp, Artificial Sequence
  chemically synthesized
tgaagaaaatggcccctgctcc

SEQ ID NO: 128531 - DNA, 22 bp, Artificial Sequence
  chemically synthesized
ctccttaggtagcaggccatag

SEQ ID NO: 128532 - DNA, 22 bp, Artificial Sequence
  chemically synthesized
cttaggtagcaggccataggca

SEQ ID NO: 128533 - DNA, 22 bp, Artificial Sequence
  chemically synthesized
aggtagcaggccataggcaaat

SEQ ID NO: 128534 - DNA, 22 bp, Artificial Sequence
  chemically synthesized
ggtagcaggccataggcaaata

SEQ ID NO: 128535 - DNA, 22 bp, Artificial Sequence
  chemically synthesized
accctcttgccttctgaagcta

SEQ ID NO: 128536 - DNA, 22 bp, Artificial Sequence
  chemically synthesized
ttgccttctgaagctaagctcc

SEQ ID NO: 128537 - DNA, 22 bp, Artificial Sequence
  chemically synthesized
gccttctgaagctaagctccag

SEQ ID NO: 128538 - DNA, 22 bp, Artificial Sequence
  chemically synthesized
ccttctgaagctaagctccagc

SEQ ID NO: 128539 - DNA, 22 bp, Artificial Sequence
  chemically synthesized
ctgaagctaagctccagcttca

SEQ ID NO: 128540 - DNA, 22 bp, Artificial Sequence
  chemically synthesized
tgaagctaagctccagcttcag

SEQ ID NO: 128541 - DNA, 22 bp, Artificial Sequence
  chemically synthesized
aagctaagctccagcttcagta

SEQ ID NO: 128542 - DNA, 22 bp, Artificial Sequence
  chemically synthesized
agctccagcttcagtatgcact

SEQ ID NO: 128543 - DNA, 22 bp, Artificial Sequence
  chemically synthesized
cagcttcagtatgcacttgctt

SEQ ID NO: 128544 - DNA, 22 bp, Artificial Sequence
  chemically synthesized
cagtatgcacttgcttacctcc

SEQ ID NO: 128545 - DNA, 22 bp, Artificial Sequence
  chemically synthesized
agtatgcacttgcttacctcct

SEQ ID NO: 128546 - DNA, 22 bp, Artificial Sequence
  chemically synthesized
gcttacctccttcccctgtcca

SEQ ID NO: 128547 - DNA, 22 bp, Artificial Sequence
  chemically synthesized
cttacctccttcccctgtccac

SEQ ID NO: 128548 - DNA, 22 bp, Artificial Sequence
  chemically synthesized
acctccttcccctgtccacact

SEQ ID NO: 128549 - DNA, 22 bp, Artificial Sequence
  chemically synthesized
cctccttcccctgtccacactg

SEQ ID NO: 128550 - DNA, 22 bp, Artificial Sequence
  chemically synthesized
cttcccctgtccacactgcttt

SEQ ID NO: 128551 - DNA, 22 bp, Artificial Sequence
  chemically synthesized
cccctgtccacactgcttttac

SEQ ID NO: 128552 - DNA, 22 bp, Artificial Sequence
  chemically synthesized
ccctgtccacactgcttttact

SEQ ID NO: 128553 - DNA, 22 bp, Artificial Sequence
  chemically synthesized
tccacactgcttttacttgctc

SEQ ID NO: 128554 - DNA, 22 bp, Artificial Sequence
  chemically synthesized
cttttacttgctccctgtctcc

SEQ ID NO: 128555 - DNA, 22 bp, Artificial Sequence
  chemically synthesized
ttacttgctccctgtctcctga

SEQ ID NO: 128556 - DNA, 22 bp, Artificial Sequence
  chemically synthesized
tacttgctccctgtctcctgag

SEQ ID NO: 128557 - DNA, 22 bp, Artificial Sequence
  chemically synthesized
acttgctccctgtctcctgaga

SEQ ID NO: 128558 - DNA, 22 bp, Artificial Sequence
  chemically synthesized
cttgctccctgtctcctgagag

SEQ ID NO: 128559 - DNA, 22 bp, Artificial Sequence
  chemically synthesized
gctccctgtctcctgagagcat

SEQ ID NO: 128560 - DNA, 22 bp, Artificial Sequence
  chemically synthesized
ctccctgtctcctgagagcatt

SEQ ID NO: 128561 - DNA, 22 bp, Artificial Sequence
  chemically synthesized
cctgtctcctgagagcattcat

SEQ ID NO: 128562 - DNA, 22 bp, Artificial Sequence
  chemically synthesized
tctcctgagagcattcattaat

SEQ ID NO: 128563 - DNA, 22 bp, Artificial Sequence
  chemically synthesized
ctgagagcattcattaataaat

SEQ ID NO: 128564 - DNA, 22 bp, Artificial Sequence
  chemically synthesized
agagcattcattaataaattgc

SEQ ID NO: 128565 - DNA, 22 bp, Artificial Sequence
  chemically synthesized
attaataaattgcacacatttg

SEQ ID NO: 128566 - DNA, 22 bp, Artificial Sequence
  chemically synthesized
ataaattgcacacatttgaatc

SEQ ID NO: 128567 - DNA, 22 bp, Artificial Sequence
  chemically synthesized
cacacatttgaatccctatctc

SEQ ID NO: 128568 - DNA, 22 bp, Artificial Sequence
  chemically synthesized
gaatccctatctcaggtattgc

SEQ ID NO: 128569 - DNA, 22 bp, Artificial Sequence
  chemically synthesized
aatccctatctcaggtattgct

SEQ ID NO: 128570 - DNA, 22 bp, Artificial Sequence
  chemically synthesized
tctcaggtattgctcatagaga

SEQ ID NO: 128571 - DNA, 22 bp, Artificial Sequence
  chemically synthesized
aggtattgctcatagagagtcc

SEQ ID NO: 128572 - DNA, 22 bp, Artificial Sequence
  chemically synthesized
ctcatagagagtccaacttaag

SEQ ID NO: 128573 - DNA, 22 bp, Artificial Sequence
  chemically synthesized
atagagagtccaacttaagaaa

SEQ ID NO: 128574 - DNA, 22 bp, Artificial Sequence
  chemically synthesized
aagaaaaactgcaatccttatt

SEQ ID NO: 128575 - DNA, 22 bp, Artificial Sequence
  chemically synthesized
agaaaaactgcaatccttattt

SEQ ID NO: 128576 - DNA, 22 bp, Artificial Sequence
  chemically synthesized
caatccttatttatattctgtt

SEQ ID NO: 128577 - DNA, 22 bp, Artificial Sequence
  chemically synthesized
atttatattctgtttcattaag

SEQ ID NO: 128578 - DNA, 22 bp, Artificial Sequence
  chemically synthesized
tttatattctgtttcattaaga

SEQ ID NO: 128579 - DNA, 22 bp, Artificial Sequence
  chemically synthesized
atattctgtttcattaagagat

SEQ ID NO: 128580 - DNA, 22 bp, Artificial Sequence
  chemically synthesized
tattctgtttcattaagagatg

SEQ ID NO: 128581 - DNA, 22 bp, Artificial Sequence
  chemically synthesized
tgtttcattaagagatgtaatt

SEQ ID NO: 128582 - DNA, 22 bp, Artificial Sequence
  chemically synthesized
tttcattaagagatgtaattgt

SEQ ID NO: 128583 - DNA, 22 bp, Artificial Sequence
  chemically synthesized
cattaagagatgtaattgtgaa

SEQ ID NO: 128584 - DNA, 22 bp, Artificial Sequence
  chemically synthesized
attaagagatgtaattgtgaaa

SEQ ID NO: 128585 - DNA, 22 bp, Artificial Sequence
  chemically synthesized
agagatgtaattgtgaaagaac

SEQ ID NO: 128586 - DNA, 22 bp, Artificial Sequence
  chemically synthesized
tgaaagaactgaacatataaaa

SEQ ID NO: 128587 - DNA, 22 bp, Artificial Sequence
  chemically synthesized
aacatataaaaaaatcagcttt

SEQ ID NO: 128588 - DNA, 22 bp, Artificial Sequence
  chemically synthesized
tatcatgttttttatccttgtc

SEQ ID NO: 128589 - DNA, 22 bp, Artificial Sequence
  chemically synthesized
atcatgttttttatccttgtca

SEQ ID NO: 128590 - DNA, 22 bp, Artificial Sequence
  chemically synthesized
tcatgttttttatccttgtcac

SEQ ID NO: 128591 - DNA, 22 bp, Artificial Sequence
  chemically synthesized
tttatccttgtcacgccatgtc

SEQ ID NO: 128592 - DNA, 22 bp, Artificial Sequence
  chemically synthesized
ttatccttgtcacgccatgtca

SEQ ID NO: 128593 - DNA, 22 bp, Artificial Sequence
  chemically synthesized
tatccttgtcacgccatgtcac

SEQ ID NO: 128594 - DNA, 22 bp, Artificial Sequence
  chemically synthesized
atccttgtcacgccatgtcacc

SEQ ID NO: 128595 - DNA, 22 bp, Artificial Sequence
  chemically synthesized
tccttgtcacgccatgtcacct

SEQ ID NO: 128596 - DNA, 22 bp, Artificial Sequence
  chemically synthesized
gtcacgccatgtcacctgagca

SEQ ID NO: 128597 - DNA, 22 bp, Artificial Sequence
  chemically synthesized
tcacgccatgtcacctgagcaa

SEQ ID NO: 128598 - DNA, 22 bp, Artificial Sequence
  chemically synthesized
agcaacacagtctgaatactaa

SEQ ID NO: 128599 - DNA, 22 bp, Artificial Sequence
  chemically synthesized
aatactaaattgtgagtgtgag

SEQ ID NO: 128600 - DNA, 22 bp, Artificial Sequence
  chemically synthesized
aattgtgagtgtgagtgcatat

SEQ ID NO: 128601 - DNA, 22 bp, Artificial Sequence
  chemically synthesized
tgagtgtgagtgcatatatgtg

SEQ ID NO: 128602 - DNA, 22 bp, Artificial Sequence
  chemically synthesized
ttgtcctgttttcaatcattca

SEQ ID NO: 128603 - DNA, 22 bp, Artificial Sequence
  chemically synthesized
tgtcctgttttcaatcattcat

SEQ ID NO: 128604 - DNA, 22 bp, Artificial Sequence
  chemically synthesized
gtcctgttttcaatcattcata

SEQ ID NO: 128605 - DNA, 22 bp, Artificial Sequence
  chemically synthesized
tcctgttttcaatcattcataa

SEQ ID NO: 128606 - DNA, 22 bp, Artificial Sequence
  chemically synthesized
ttttcaatcattcataaaacca

SEQ ID NO: 128607 - DNA, 22 bp, Artificial Sequence
  chemically synthesized
tcaatcattcataaaaccaaac

SEQ ID NO: 128608 - DNA, 22 bp, Artificial Sequence
  chemically synthesized
caatcattcataaaaccaaaca

SEQ ID NO: 128609 - DNA, 22 bp, Artificial Sequence
  chemically synthesized
aatcattcataaaaccaaacat

SEQ ID NO: 128610 - DNA, 22 bp, Artificial Sequence
  chemically synthesized
ataaaaccaaacatgtgtccct

SEQ ID NO: 128611 - DNA, 22 bp, Artificial Sequence
  chemically synthesized
aattatgctctactacatccac

SEQ ID NO: 128612 - DNA, 22 bp, Artificial Sequence
  chemically synthesized
attatgctctactacatccaca

SEQ ID NO: 128613 - DNA, 22 bp, Artificial Sequence
  chemically synthesized
tgctctactacatccacaactt

SEQ ID NO: 128614 - DNA, 22 bp, Artificial Sequence
  chemically synthesized
tactacatccacaacttatttt

SEQ ID NO: 128615 - DNA, 22 bp, Artificial Sequence
  chemically synthesized
ctacatccacaacttattttat

SEQ ID NO: 128616 - DNA, 22 bp, Artificial Sequence
  chemically synthesized
catccacaacttattttattca

SEQ ID NO: 128617 - DNA, 22 bp, Artificial Sequence
  chemically synthesized
attttattcataaaaatattgt

SEQ ID NO: 128618 - DNA, 22 bp, Artificial Sequence
  chemically synthesized
ttttattcataaaaatattgtg

SEQ ID NO: 128619 - DNA, 22 bp, Artificial Sequence
  chemically synthesized
tattcataaaaatattgtgggg

SEQ ID NO: 128620 - DNA, 22 bp, Artificial Sequence
  chemically synthesized
attcataaaaatattgtggggt

SEQ ID NO: 128621 - DNA, 22 bp, Artificial Sequence
  chemically synthesized
ttcataaaaatattgtggggta

SEQ ID NO: 128622 - DNA, 22 bp, Artificial Sequence
  chemically synthesized
ataaaaatattgtggggtagat

SEQ ID NO: 128623 - DNA, 22 bp, Artificial Sequence
  chemically synthesized
tggggtagatattatcactgtt

SEQ ID NO: 128624 - DNA, 22 bp, Artificial Sequence
  chemically synthesized
tcactgttttcttgatggggaa

SEQ ID NO: 128625 - DNA, 22 bp, Artificial Sequence
  chemically synthesized
ttttcttgatggggaaatttaa

SEQ ID NO: 128626 - DNA, 22 bp, Artificial Sequence
  chemically synthesized
tcttgatggggaaatttaatat

SEQ ID NO: 128627 - DNA, 22 bp, Artificial Sequence
  chemically synthesized
cttgatggggaaatttaatata

SEQ ID NO: 128628 - DNA, 22 bp, Artificial Sequence
  chemically synthesized
ttgatggggaaatttaatataa

SEQ ID NO: 128629 - DNA, 22 bp, Artificial Sequence
  chemically synthesized
gatggggaaatttaatataaaa

SEQ ID NO: 128630 - DNA, 22 bp, Artificial Sequence
  chemically synthesized
atggggaaatttaatataaaaa

SEQ ID NO: 128631 - DNA, 22 bp, Artificial Sequence
  chemically synthesized
aatataaaaaagttaaatattc

SEQ ID NO: 128632 - DNA, 22 bp, Artificial Sequence
  chemically synthesized
atataaaaaagttaaatattcc

SEQ ID NO: 128633 - DNA, 22 bp, Artificial Sequence
  chemically synthesized
aatattccctccaagggcataa

SEQ ID NO: 128634 - DNA, 22 bp, Artificial Sequence
  chemically synthesized
cctccaagggcataacattttt

SEQ ID NO: 128635 - DNA, 22 bp, Artificial Sequence
  chemically synthesized
caagggcataacatttttaatt

SEQ ID NO: 128636 - DNA, 22 bp, Artificial Sequence
  chemically synthesized
ttaattggtatagtcatgattc

SEQ ID NO: 128637 - DNA, 22 bp, Artificial Sequence
  chemically synthesized
taattggtatagtcatgattca

SEQ ID NO: 128638 - DNA, 22 bp, Artificial Sequence
  chemically synthesized
aattggtatagtcatgattcaa

SEQ ID NO: 128639 - DNA, 22 bp, Artificial Sequence
  chemically synthesized
attggtatagtcatgattcaaa

SEQ ID NO: 128640 - DNA, 22 bp, Artificial Sequence
  chemically synthesized
gtatagtcatgattcaaattta

SEQ ID NO: 128641 - DNA, 22 bp, Artificial Sequence
  chemically synthesized
aaatttatatcttctaactata

SEQ ID NO: 128642 - DNA, 22 bp, Artificial Sequence
  chemically synthesized
atatcttctaactataaggcca

SEQ ID NO: 128643 - DNA, 22 bp, Artificial Sequence
  chemically synthesized
tatcttctaactataaggccag

SEQ ID NO: 128644 - DNA, 22 bp, Artificial Sequence
  chemically synthesized
ctaactataaggccagtgtgaa

SEQ ID NO: 128645 - DNA, 22 bp, Artificial Sequence
  chemically synthesized
taactataaggccagtgtgaat

SEQ ID NO: 128646 - DNA, 22 bp, Artificial Sequence
  chemically synthesized
actataaggccagtgtgaatgg

SEQ ID NO: 128647 - DNA, 22 bp, Artificial Sequence
  chemically synthesized
taaggccagtgtgaatggtact

SEQ ID NO: 128648 - DNA, 22 bp, Artificial Sequence
  chemically synthesized
cactacagtagactatccttag

SEQ ID NO: 128649 - DNA, 22 bp, Artificial Sequence
  chemically synthesized
cagtagactatccttagtggct

SEQ ID NO: 128650 - DNA, 22 bp, Artificial Sequence
  chemically synthesized
tccttagtggcttctacttttt

SEQ ID NO: 128651 - DNA, 22 bp, Artificial Sequence
  chemically synthesized
agtggcttctactttttgcctt

SEQ ID NO: 128652 - DNA, 22 bp, Artificial Sequence
  chemically synthesized
gtggcttctactttttgccttg

SEQ ID NO: 128653 - DNA, 22 bp, Artificial Sequence
  chemically synthesized
ctactttttgccttgtattccg

SEQ ID NO: 128654 - DNA, 22 bp, Artificial Sequence
  chemically synthesized
tactttttgccttgtattccgt

SEQ ID NO: 128655 - DNA, 22 bp, Artificial Sequence
  chemically synthesized
ctttttgccttgtattccgtca

SEQ ID NO: 128656 - DNA, 22 bp, Artificial Sequence
  chemically synthesized
tttgccttgtattccgtcatgc

SEQ ID NO: 128657 - DNA, 22 bp, Artificial Sequence
  chemically synthesized
ttgccttgtattccgtcatgct

SEQ ID NO: 128658 - DNA, 22 bp, Artificial Sequence
  chemically synthesized
tgccttgtattccgtcatgctt

SEQ ID NO: 128659 - DNA, 22 bp, Artificial Sequence
  chemically synthesized
gccttgtattccgtcatgcttg

SEQ ID NO: 128660 - DNA, 22 bp, Artificial Sequence
  chemically synthesized
ccttgtattccgtcatgcttgt

SEQ ID NO: 128661 - DNA, 22 bp, Artificial Sequence
  chemically synthesized
gtattccgtcatgcttgtagta

SEQ ID NO: 128662 - DNA, 22 bp, Artificial Sequence
  chemically synthesized
tattccgtcatgcttgtagtac

SEQ ID NO: 128663 - DNA, 22 bp, Artificial Sequence
  chemically synthesized
cgtcatgcttgtagtacctact

SEQ ID NO: 128664 - DNA, 22 bp, Artificial Sequence
  chemically synthesized
gtagtacctactttctttttct

SEQ ID NO: 128665 - DNA, 22 bp, Artificial Sequence
  chemically synthesized
tagtacctactttctttttctg

SEQ ID NO: 128666 - DNA, 22 bp, Artificial Sequence
  chemically synthesized
ctttctttttctgaaaatttct

SEQ ID NO: 128667 - DNA, 22 bp, Artificial Sequence
  chemically synthesized
tctttttctgaaaatttctcct

SEQ ID NO: 128668 - DNA, 22 bp, Artificial Sequence
  chemically synthesized
ctttttctgaaaatttctcctc

SEQ ID NO: 128669 - DNA, 22 bp, Artificial Sequence
  chemically synthesized
tttttctgaaaatttctcctcc

SEQ ID NO: 128670 - DNA, 22 bp, Artificial Sequence
  chemically synthesized
tttctgaaaatttctcctcctt

SEQ ID NO: 128671 - DNA, 22 bp, Artificial Sequence
  chemically synthesized
ttctgaaaatttctcctccttc

SEQ ID NO: 128672 - DNA, 22 bp, Artificial Sequence
  chemically synthesized
tctgaaaatttctcctccttct

SEQ ID NO: 128673 - DNA, 22 bp, Artificial Sequence
  chemically synthesized
ctgaaaatttctcctccttcta

SEQ ID NO: 128674 - DNA, 22 bp, Artificial Sequence
  chemically synthesized
tgaaaatttctcctccttctac

SEQ ID NO: 128675 - DNA, 22 bp, Artificial Sequence
  chemically synthesized
aaaatttctcctccttctactc

SEQ ID NO: 128676 - DNA, 22 bp, Artificial Sequence
  chemically synthesized
ctcctccttctactccaaaaat

SEQ ID NO: 128677 - DNA, 22 bp, Artificial Sequence
  chemically synthesized
tcctccttctactccaaaaata

SEQ ID NO: 128678 - DNA, 22 bp, Artificial Sequence
  chemically synthesized
ctccttctactccaaaaatatt

SEQ ID NO: 128679 - DNA, 22 bp, Artificial Sequence
  chemically synthesized
cttctactccaaaaatattgtt

SEQ ID NO: 128680 - DNA, 22 bp, Artificial Sequence
  chemically synthesized
ctactccaaaaatattgttccc

SEQ ID NO: 128681 - DNA, 22 bp, Artificial Sequence
  chemically synthesized
tactccaaaaatattgttccct

SEQ ID NO: 128682 - DNA, 22 bp, Artificial Sequence
  chemically synthesized
ctccaaaaatattgttccctat

SEQ ID NO: 128683 - DNA, 22 bp, Artificial Sequence
  chemically synthesized
caaaaatattgttccctatgaa

SEQ ID NO: 128684 - DNA, 22 bp, Artificial Sequence
  chemically synthesized
ttccctatgaaaactgatattt

SEQ ID NO: 128685 - DNA, 22 bp, Artificial Sequence
  chemically synthesized
cctatgaaaactgatattttgc

SEQ ID NO: 128686 - DNA, 22 bp, Artificial Sequence
  chemically synthesized
tgaaaactgatattttgcattg

SEQ ID NO: 128687 - DNA, 22 bp, Artificial Sequence
  chemically synthesized
atattttgcattgtatctccaa

SEQ ID NO: 128688 - DNA, 22 bp, Artificial Sequence
  chemically synthesized
tgcattgtatctccaaactcct

SEQ ID NO: 128689 - DNA, 22 bp, Artificial Sequence
  chemically synthesized
gcattgtatctccaaactccta

SEQ ID NO: 128690 - DNA, 22 bp, Artificial Sequence
  chemically synthesized
cattgtatctccaaactcctaa

SEQ ID NO: 128691 - DNA, 22 bp, Artificial Sequence
  chemically synthesized
tatctccaaactcctaaccgca

SEQ ID NO: 128692 - DNA, 22 bp, Artificial Sequence
  chemically synthesized
caaactcctaaccgcagtagaa

SEQ ID NO: 128693 - DNA, 22 bp, Artificial Sequence
  chemically synthesized
ctaaccgcagtagaagaacttt

SEQ ID NO: 128694 - DNA, 22 bp, Artificial Sequence
  chemically synthesized
accgcagtagaagaactttttt

SEQ ID NO: 128695 - DNA, 22 bp, Artificial Sequence
  chemically synthesized
ttttaaaaagaatttttcaata

SEQ ID NO: 128696 - DNA, 22 bp, Artificial Sequence
  chemically synthesized
tttaaaaagaatttttcaatat

SEQ ID NO: 128697 - DNA, 22 bp, Artificial Sequence
  chemically synthesized
ttaaaaagaatttttcaatatg

SEQ ID NO: 128698 - DNA, 22 bp, Artificial Sequence
  chemically synthesized
taaaaagaatttttcaatatga

SEQ ID NO: 128699 - DNA, 22 bp, Artificial Sequence
  chemically synthesized
aaaaagaatttttcaatatgac

SEQ ID NO: 128700 - DNA, 22 bp, Artificial Sequence
  chemically synthesized
aaaagaatttttcaatatgaca

SEQ ID NO: 128701 - DNA, 22 bp, Artificial Sequence
  chemically synthesized
ttcaatatgacattgcaaaaaa

SEQ ID NO: 128702 - DNA, 22 bp, Artificial Sequence
  chemically synthesized
tcaatatgacattgcaaaaaaa

SEQ ID NO: 128703 - DNA, 22 bp, Artificial Sequence
  chemically synthesized
caatatgacattgcaaaaaaaa

SEQ ID NO: 128704 - DNA, 22 bp, Artificial Sequence
  chemically synthesized
aatatgacattgcaaaaaaaaa

SEQ ID NO: 128705 - DNA, 22 bp, Artificial Sequence
  chemically synthesized
caaaaaaaaaaagagtaatgct

SEQ ID NO: 128706 - DNA, 22 bp, Artificial Sequence
  chemically synthesized
ttgttgtagaattactaaaatg

SEQ ID NO: 128707 - DNA, 22 bp, Artificial Sequence
  chemically synthesized
tgttgtagaattactaaaatgc

SEQ ID NO: 128708 - DNA, 22 bp, Artificial Sequence
  chemically synthesized
gttgtagaattactaaaatgca

SEQ ID NO: 128709 - DNA, 22 bp, Artificial Sequence
  chemically synthesized
ttgtagaattactaaaatgcaa

SEQ ID NO: 128710 - DNA, 22 bp, Artificial Sequence
  chemically synthesized
tagaattactaaaatgcaatgc

SEQ ID NO: 128711 - DNA, 22 bp, Artificial Sequence
  chemically synthesized
ctaaaatgcaatgcttagaatt

SEQ ID NO: 128712 - DNA, 22 bp, Artificial Sequence
  chemically synthesized
aaatgcaatgcttagaattgtt

SEQ ID NO: 128713 - DNA, 22 bp, Artificial Sequence
  chemically synthesized
agaattgttaatgacaatgttt

SEQ ID NO: 128714 - DNA, 22 bp, Artificial Sequence
  chemically synthesized
gaattgttaatgacaatgtttt

SEQ ID NO: 128715 - DNA, 22 bp, Artificial Sequence
  chemically synthesized
ttaatgacaatgtttttcatca

SEQ ID NO: 128716 - DNA, 22 bp, Artificial Sequence
  chemically synthesized
atgacaatgtttttcatcaggc

SEQ ID NO: 128717 - DNA, 22 bp, Artificial Sequence
  chemically synthesized
ttcatcaggcaagtgacttcaa

SEQ ID NO: 128718 - DNA, 22 bp, Artificial Sequence
  chemically synthesized
tcatcaggcaagtgacttcaaa

SEQ ID NO: 128719 - DNA, 22 bp, Artificial Sequence
  chemically synthesized
catcaggcaagtgacttcaaac

SEQ ID NO: 128720 - DNA, 22 bp, Artificial Sequence
  chemically synthesized
atcaggcaagtgacttcaaact

SEQ ID NO: 128721 - DNA, 22 bp, Artificial Sequence
  chemically synthesized
caaactataataaatatttaga

SEQ ID NO: 128722 - DNA, 22 bp, Artificial Sequence
  chemically synthesized
aaactataataaatatttagag

SEQ ID NO: 128723 - DNA, 22 bp, Artificial Sequence
  chemically synthesized
taataaatatttagagtaaatt

SEQ ID NO: 128724 - DNA, 22 bp, Artificial Sequence
  chemically synthesized
agagtaaattatagataaagaa

SEQ ID NO: 128725 - DNA, 22 bp, Artificial Sequence
  chemically synthesized
gagtaaattatagataaagaaa

SEQ ID NO: 128726 - DNA, 22 bp, Artificial Sequence
  chemically synthesized
tagataaagaaatgataataaa

SEQ ID NO: 128727 - DNA, 22 bp, Artificial Sequence
  chemically synthesized
caaatctctgattccatgtttt

SEQ ID NO: 128728 - DNA, 22 bp, Artificial Sequence
  chemically synthesized
aaatctctgattccatgttttc

SEQ ID NO: 128729 - DNA, 22 bp, Artificial Sequence
  chemically synthesized
tgattccatgttttcctgagac

SEQ ID NO: 128730 - DNA, 22 bp, Artificial Sequence
  chemically synthesized
attccatgttttcctgagactc

SEQ ID NO: 128731 - DNA, 22 bp, Artificial Sequence
  chemically synthesized
catgttttcctgagactcagtg

SEQ ID NO: 128732 - DNA, 22 bp, Artificial Sequence
  chemically synthesized
tcctgagactcagtgacaagga

SEQ ID NO: 128733 - DNA, 22 bp, Artificial Sequence
  chemically synthesized
cctgagactcagtgacaaggag

SEQ ID NO: 128734 - DNA, 22 bp, Artificial Sequence
  chemically synthesized
ctgagactcagtgacaaggagg

SEQ ID NO: 128735 - DNA, 22 bp, Artificial Sequence
  chemically synthesized
agactcagtgacaaggaggaca

SEQ ID NO: 128736 - DNA, 22 bp, Artificial Sequence
  chemically synthesized
agtgacaaggaggacagtttga

SEQ ID NO: 128737 - DNA, 22 bp, Artificial Sequence
  chemically synthesized
gaatcttttttttgattccaca

SEQ ID NO: 128738 - DNA, 22 bp, Artificial Sequence
  chemically synthesized
aatcttttttttgattccacag

SEQ ID NO: 128739 - DNA, 22 bp, Artificial Sequence
  chemically synthesized
ttttttgattccacagcctaat

SEQ ID NO: 128740 - DNA, 22 bp, Artificial Sequence
  chemically synthesized
tttttgattccacagcctaata

SEQ ID NO: 128741 - DNA, 22 bp, Artificial Sequence
  chemically synthesized
ttttgattccacagcctaataa

SEQ ID NO: 128742 - DNA, 22 bp, Artificial Sequence
  chemically synthesized
tttgattccacagcctaataaa

SEQ ID NO: 128743 - DNA, 22 bp, Artificial Sequence
  chemically synthesized
ttgattccacagcctaataaac

SEQ ID NO: 128744 - DNA, 22 bp, Artificial Sequence
  chemically synthesized
tgattccacagcctaataaact

SEQ ID NO: 128745 - DNA, 22 bp, Artificial Sequence
  chemically synthesized
gattccacagcctaataaactc

SEQ ID NO: 128746 - DNA, 22 bp, Artificial Sequence
  chemically synthesized
attccacagcctaataaactcc

SEQ ID NO: 128747 - DNA, 22 bp, Artificial Sequence
  chemically synthesized
cacagcctaataaactcctctt

SEQ ID NO: 128748 - DNA, 22 bp, Artificial Sequence
  chemically synthesized
ataaactcctcttcttgtaatt

SEQ ID NO: 128749 - DNA, 22 bp, Artificial Sequence
  chemically synthesized
ctcttcttgtaatttgttttgt

SEQ ID NO: 128750 - DNA, 22 bp, Artificial Sequence
  chemically synthesized
ttcttgtaatttgttttgttca

SEQ ID NO: 128751 - DNA, 22 bp, Artificial Sequence
  chemically synthesized
cttgtaatttgttttgttcagc

SEQ ID NO: 128752 - DNA, 22 bp, Artificial Sequence
  chemically synthesized
ttgtaatttgttttgttcagcc

SEQ ID NO: 128753 - DNA, 22 bp, Artificial Sequence
  chemically synthesized
gtaatttgttttgttcagccta

SEQ ID NO: 128754 - DNA, 22 bp, Artificial Sequence
  chemically synthesized
taatttgttttgttcagcctag

SEQ ID NO: 128755 - DNA, 22 bp, Artificial Sequence
  chemically synthesized
gttttgttcagcctagtttcag

SEQ ID NO: 128756 - DNA, 22 bp, Artificial Sequence
  chemically synthesized
ttttgttcagcctagtttcagt

SEQ ID NO: 128757 - DNA, 22 bp, Artificial Sequence
  chemically synthesized
tgttcagcctagtttcagttga

SEQ ID NO: 128758 - DNA, 22 bp, Artificial Sequence
  chemically synthesized
gttcagcctagtttcagttgag

SEQ ID NO: 128759 - DNA, 22 bp, Artificial Sequence
  chemically synthesized
ttcagcctagtttcagttgagt

SEQ ID NO: 128760 - DNA, 22 bp, Artificial Sequence
  chemically synthesized
agcctagtttcagttgagtttc

SEQ ID NO: 128761 - DNA, 22 bp, Artificial Sequence
  chemically synthesized
gtttcagttgagtttcacttat

SEQ ID NO: 128762 - DNA, 22 bp, Artificial Sequence
  chemically synthesized
cagttgagtttcacttataacc

SEQ ID NO: 128763 - DNA, 22 bp, Artificial Sequence
  chemically synthesized
agttgagtttcacttataacca

SEQ ID NO: 128764 - DNA, 22 bp, Artificial Sequence
  chemically synthesized
agtttcacttataaccaaaggc

SEQ ID NO: 128765 - DNA, 22 bp, Artificial Sequence
  chemically synthesized
cacttataaccaaaggctatta

SEQ ID NO: 128766 - DNA, 22 bp, Artificial Sequence
  chemically synthesized
acttataaccaaaggctattaa

SEQ ID NO: 128767 - DNA, 22 bp, Artificial Sequence
  chemically synthesized
ataaccaaaggctattaataat

SEQ ID NO: 128768 - DNA, 22 bp, Artificial Sequence
  chemically synthesized
taaccaaaggctattaataatt

SEQ ID NO: 128769 - DNA, 22 bp, Artificial Sequence
  chemically synthesized
ttaataattatatcatctcagt

SEQ ID NO: 128770 - DNA, 22 bp, Artificial Sequence
  chemically synthesized
ataattatatcatctcagttat

SEQ ID NO: 128771 - DNA, 22 bp, Artificial Sequence
  chemically synthesized
tatcatctcagttatagatatg

SEQ ID NO: 128772 - DNA, 22 bp, Artificial Sequence
  chemically synthesized
agttatagatatgtgaatcttc

SEQ ID NO: 128773 - DNA, 22 bp, Artificial Sequence
  chemically synthesized
tagatatgtgaatcttctctaa

SEQ ID NO: 128774 - DNA, 22 bp, Artificial Sequence
  chemically synthesized
ctctaactaatatttaaaactg

SEQ ID NO: 128775 - DNA, 22 bp, Artificial Sequence
  chemically synthesized
tctaactaatatttaaaactgg

SEQ ID NO: 128776 - DNA, 22 bp, Artificial Sequence
  chemically synthesized
taactaatatttaaaactggaa

SEQ ID NO: 128777 - DNA, 22 bp, Artificial Sequence
  chemically synthesized
actaatatttaaaactggaaaa

SEQ ID NO: 128778 - DNA, 22 bp, Artificial Sequence
  chemically synthesized
atatttaaaactggaaaatact

SEQ ID NO: 128779 - DNA, 22 bp, Artificial Sequence
  chemically synthesized
aaaactggaaaatactgttagg

SEQ ID NO: 128780 - DNA, 22 bp, Artificial Sequence
  chemically synthesized
aaactggaaaatactgttaggt

SEQ ID NO: 128781 - DNA, 22 bp, Artificial Sequence
  chemically synthesized
gaaaatactgttaggtagaaga

SEQ ID NO: 128782 - DNA, 22 bp, Artificial Sequence
  chemically synthesized
ttaggtagaagagctgcctctt

SEQ ID NO: 128783 - DNA, 22 bp, Artificial Sequence
  chemically synthesized
ggtagaagagctgcctcttttt

SEQ ID NO: 128784 - DNA, 22 bp, Artificial Sequence
  chemically synthesized
cctctttttctaaaatacagga

SEQ ID NO: 128785 - DNA, 22 bp, Artificial Sequence
  chemically synthesized
tttttctaaaatacaggaaatg

SEQ ID NO: 128786 - DNA, 22 bp, Artificial Sequence
  chemically synthesized
tttctaaaatacaggaaatgga

SEQ ID NO: 128787 - DNA, 22 bp, Artificial Sequence
  chemically synthesized
ttctaaaatacaggaaatggaa

SEQ ID NO: 128788 - DNA, 22 bp, Artificial Sequence
  chemically synthesized
tctaaaatacaggaaatggaac

SEQ ID NO: 128789 - DNA, 22 bp, Artificial Sequence
  chemically synthesized
ctaaaatacaggaaatggaacc

SEQ ID NO: 128790 - DNA, 22 bp, Artificial Sequence
  chemically synthesized
taaaatacaggaaatggaacct

SEQ ID NO: 128791 - DNA, 22 bp, Artificial Sequence
  chemically synthesized
aaatacaggaaatggaacctaa

SEQ ID NO: 128792 - DNA, 22 bp, Artificial Sequence
  chemically synthesized
aaaatggcaggaaagttgacca

SEQ ID NO: 128793 - DNA, 22 bp, Artificial Sequence
  chemically synthesized
accatttggtgaatgatttatg

SEQ ID NO: 128794 - DNA, 22 bp, Artificial Sequence
  chemically synthesized
ggtgaatgatttatgaagttat

SEQ ID NO: 128795 - DNA, 22 bp, Artificial Sequence
  chemically synthesized
gtgaatgatttatgaagttatt

SEQ ID NO: 128796 - DNA, 22 bp, Artificial Sequence
  chemically synthesized
atgaagttatttcccttgttta

SEQ ID NO: 128797 - DNA, 22 bp, Artificial Sequence
  chemically synthesized
tgaagttatttcccttgtttaa

SEQ ID NO: 128798 - DNA, 22 bp, Artificial Sequence
  chemically synthesized
tttcccttgtttaagaagttca

SEQ ID NO: 128799 - DNA, 22 bp, Artificial Sequence
  chemically synthesized
cccttgtttaagaagttcattt

SEQ ID NO: 128800 - DNA, 22 bp, Artificial Sequence
  chemically synthesized
ccttgtttaagaagttcatttc

SEQ ID NO: 128801 - DNA, 22 bp, Artificial Sequence
  chemically synthesized
gtttaagaagttcatttctgac

SEQ ID NO: 128802 - DNA, 22 bp, Artificial Sequence
  chemically synthesized
tttaagaagttcatttctgact

SEQ ID NO: 128803 - DNA, 22 bp, Artificial Sequence
  chemically synthesized
aagaagttcatttctgacttga

SEQ ID NO: 128804 - DNA, 22 bp, Artificial Sequence
  chemically synthesized
agaagttcatttctgacttgaa

SEQ ID NO: 128805 - DNA, 22 bp, Artificial Sequence
  chemically synthesized
atttctgacttgaaagtaagtg

SEQ ID NO: 128806 - DNA, 22 bp, Artificial Sequence
  chemically synthesized
ctgacttgaaagtaagtgtgaa

SEQ ID NO: 128807 - DNA, 22 bp, Artificial Sequence
  chemically synthesized
tgacttgaaagtaagtgtgaaa

SEQ ID NO: 128808 - DNA, 22 bp, Artificial Sequence
  chemically synthesized
acttgaaagtaagtgtgaaact

SEQ ID NO: 128809 - DNA, 22 bp, Artificial Sequence
  chemically synthesized
gaaagtaagtgtgaaactaaat

SEQ ID NO: 128810 - DNA, 22 bp, Artificial Sequence
  chemically synthesized
aaagtaagtgtgaaactaaatt

SEQ ID NO: 128811 - DNA, 22 bp, Artificial Sequence
  chemically synthesized
aattcactgagaagatgctgta

SEQ ID NO: 128812 - DNA, 22 bp, Artificial Sequence
  chemically synthesized
actgagaagatgctgtaggatg

SEQ ID NO: 128813 - DNA, 22 bp, Artificial Sequence
  chemically synthesized
agaagatgctgtaggatgaata

SEQ ID NO: 128814 - DNA, 22 bp, Artificial Sequence
  chemically synthesized
taggatgaatacagacacagga

SEQ ID NO: 128815 - DNA, 22 bp, Artificial Sequence
  chemically synthesized
aataattatctcaaacttagtt

SEQ ID NO: 128816 - DNA, 22 bp, Artificial Sequence
  chemically synthesized
tctcaaacttagttatacagaa

SEQ ID NO: 128817 - DNA, 22 bp, Artificial Sequence
  chemically synthesized
aaacttagttatacagaaggct

SEQ ID NO: 128818 - DNA, 22 bp, Artificial Sequence
  chemically synthesized
agttatacagaaggctacatgg

SEQ ID NO: 128819 - DNA, 22 bp, Artificial Sequence
  chemically synthesized
gttatacagaaggctacatggt

SEQ ID NO: 128820 - DNA, 22 bp, Artificial Sequence
  chemically synthesized
tacagaaggctacatggtggaa

SEQ ID NO: 128821 - DNA, 22 bp, Artificial Sequence
  chemically synthesized
catggtggaaatccactcagac

SEQ ID NO: 128822 - DNA, 22 bp, Artificial Sequence
  chemically synthesized
agacatgtttttctattcaaaa

SEQ ID NO: 128823 - DNA, 22 bp, Artificial Sequence
  chemically synthesized
ttctattcaaaacccattgtaa

SEQ ID NO: 128824 - DNA, 22 bp, Artificial Sequence
  chemically synthesized
tctattcaaaacccattgtaac

SEQ ID NO: 128825 - DNA, 22 bp, Artificial Sequence
  chemically synthesized
ctattcaaaacccattgtaaca

SEQ ID NO: 128826 - DNA, 22 bp, Artificial Sequence
  chemically synthesized
tattcaaaacccattgtaacaa

SEQ ID NO: 128827 - DNA, 22 bp, Artificial Sequence
  chemically synthesized
ttcaaaacccattgtaacaatc

SEQ ID NO: 128828 - DNA, 22 bp, Artificial Sequence
  chemically synthesized
aaaacccattgtaacaatcaac

SEQ ID NO: 128829 - DNA, 22 bp, Artificial Sequence
  chemically synthesized
taacaatcaacataaacacagt

SEQ ID NO: 128830 - DNA, 22 bp, Artificial Sequence
  chemically synthesized
gtattatcataaaatttagaac

SEQ ID NO: 128831 - DNA, 22 bp, Artificial Sequence
  chemically synthesized
tcataaaatttagaactttctg

SEQ ID NO: 128832 - DNA, 22 bp, Artificial Sequence
  chemically synthesized
agaactttctgtgatctcctac

SEQ ID NO: 128833 - DNA, 22 bp, Artificial Sequence
  chemically synthesized
gaactttctgtgatctcctaca

SEQ ID NO: 128834 - DNA, 22 bp, Artificial Sequence
  chemically synthesized
tctgtgatctcctacaagtctt

SEQ ID NO: 128835 - DNA, 22 bp, Artificial Sequence
  chemically synthesized
ctgtgatctcctacaagtcttc

SEQ ID NO: 128836 - DNA, 22 bp, Artificial Sequence
  chemically synthesized
tgtgatctcctacaagtcttcc

SEQ ID NO: 128837 - DNA, 22 bp, Artificial Sequence
  chemically synthesized
tgatctcctacaagtcttcctg

SEQ ID NO: 128838 - DNA, 22 bp, Artificial Sequence
  chemically synthesized
ctacaagtcttcctgtggtaaa

SEQ ID NO: 128839 - DNA, 22 bp, Artificial Sequence
  chemically synthesized
caagtcttcctgtggtaaaatg

SEQ ID NO: 128840 - DNA, 22 bp, Artificial Sequence
  chemically synthesized
cctgtggtaaaatgctatgtac

SEQ ID NO: 128841 - DNA, 22 bp, Artificial Sequence
  chemically synthesized
ctgtggtaaaatgctatgtact

SEQ ID NO: 128842 - DNA, 22 bp, Artificial Sequence
  chemically synthesized
tggtaaaatgctatgtactatt

SEQ ID NO: 128843 - DNA, 22 bp, Artificial Sequence
  chemically synthesized
tgtactattagaagccttagca

SEQ ID NO: 128844 - DNA, 22 bp, Artificial Sequence
  chemically synthesized
ttagaagccttagcaaattaat

SEQ ID NO: 128845 - DNA, 22 bp, Artificial Sequence
  chemically synthesized
gaagccttagcaaattaataca

SEQ ID NO: 128846 - DNA, 22 bp, Artificial Sequence
  chemically synthesized
agcaaattaatacaggaacaga

SEQ ID NO: 128847 - DNA, 22 bp, Artificial Sequence
  chemically synthesized
gcaaattaatacaggaacagaa

SEQ ID NO: 128848 - DNA, 22 bp, Artificial Sequence
  chemically synthesized
atacaggaacagaaaaccaaat

SEQ ID NO: 128849 - DNA, 22 bp, Artificial Sequence
  chemically synthesized
tcacttatgagtgggagctaaa

SEQ ID NO: 128850 - DNA, 22 bp, Artificial Sequence
  chemically synthesized
acttatgagtgggagctaaatg

SEQ ID NO: 128851 - DNA, 22 bp, Artificial Sequence
  chemically synthesized
atgagtgggagctaaatgatga

SEQ ID NO: 128852 - DNA, 22 bp, Artificial Sequence
  chemically synthesized
tgagtgggagctaaatgatgag

SEQ ID NO: 128853 - DNA, 22 bp, Artificial Sequence
  chemically synthesized
aatgatgagaacacatggacac

SEQ ID NO: 128854 - DNA, 22 bp, Artificial Sequence
  chemically synthesized
gggcctattggaggatggaggg

SEQ ID NO: 128855 - DNA, 22 bp, Artificial Sequence
  chemically synthesized
ttggaggatggagggtgaaagg

SEQ ID NO: 128856 - DNA, 22 bp, Artificial Sequence
  chemically synthesized
gaggatggagggtgaaaggagg

SEQ ID NO: 128857 - DNA, 22 bp, Artificial Sequence
  chemically synthesized
ggcttaatacctgagtgagtga

SEQ ID NO: 128858 - DNA, 22 bp, Artificial Sequence
  chemically synthesized
aatacctgagtgagtgatgaca

SEQ ID NO: 128859 - DNA, 22 bp, Artificial Sequence
  chemically synthesized
atacctgagtgagtgatgacat

SEQ ID NO: 128860 - DNA, 22 bp, Artificial Sequence
  chemically synthesized
agtgagtgatgacataatctgt

SEQ ID NO: 128861 - DNA, 22 bp, Artificial Sequence
  chemically synthesized
tacaacaaaccctcgtgacaca

SEQ ID NO: 128862 - DNA, 22 bp, Artificial Sequence
  chemically synthesized
gtgacacaagtttaaatatgta

SEQ ID NO: 128863 - DNA, 22 bp, Artificial Sequence
  chemically synthesized
aaatatgtaacagacctgctct

SEQ ID NO: 128864 - DNA, 22 bp, Artificial Sequence
  chemically synthesized
aatatgtaacagacctgctctt

SEQ ID NO: 128865 - DNA, 22 bp, Artificial Sequence
  chemically synthesized
ctcttgtactcctgaacctaaa

SEQ ID NO: 128866 - DNA, 22 bp, Artificial Sequence
  chemically synthesized
ttgtactcctgaacctaaaata

SEQ ID NO: 128867 - DNA, 22 bp, Artificial Sequence
  chemically synthesized
gtactcctgaacctaaaataaa

SEQ ID NO: 128868 - DNA, 22 bp, Artificial Sequence
  chemically synthesized
tactcctgaacctaaaataaaa

SEQ ID NO: 128869 - DNA, 22 bp, Artificial Sequence
  chemically synthesized
ctgaacctaaaataaaagttag

SEQ ID NO: 128870 - DNA, 22 bp, Artificial Sequence
  chemically synthesized
aacctaaaataaaagttagtta

SEQ ID NO: 128871 - DNA, 22 bp, Artificial Sequence
  chemically synthesized
aaataaaagttagttaggaaaa

SEQ ID NO: 128872 - DNA, 22 bp, Artificial Sequence
  chemically synthesized
gttaggaaaagaagcctattta

SEQ ID NO: 128873 - DNA, 22 bp, Artificial Sequence
  chemically synthesized
ggaaaagaagcctatttataac

SEQ ID NO: 128874 - DNA, 22 bp, Artificial Sequence
  chemically synthesized
tttataacactatctcctagga

SEQ ID NO: 128875 - DNA, 22 bp, Artificial Sequence
  chemically synthesized
ataacactatctcctaggaaac

SEQ ID NO: 128876 - DNA, 22 bp, Artificial Sequence
  chemically synthesized
taacactatctcctaggaaaca

SEQ ID NO: 128877 - DNA, 22 bp, Artificial Sequence
  chemically synthesized
tctcctaggaaacactgcacat

SEQ ID NO: 128878 - DNA, 22 bp, Artificial Sequence
  chemically synthesized
ctaggaaacactgcacatgaat

SEQ ID NO: 128879 - DNA, 22 bp, Artificial Sequence
  chemically synthesized
ggaaacactgcacatgaatttg

SEQ ID NO: 128880 - DNA, 22 bp, Artificial Sequence
  chemically synthesized
cacatgaatttgtattcataag

SEQ ID NO: 128881 - DNA, 22 bp, Artificial Sequence
  chemically synthesized
gtattcataagaagagtagaat

SEQ ID NO: 128882 - DNA, 22 bp, Artificial Sequence
  chemically synthesized
tattcataagaagagtagaatt

SEQ ID NO: 128883 - DNA, 22 bp, Artificial Sequence
  chemically synthesized
ataagaagagtagaattcagag

SEQ ID NO: 128884 - DNA, 22 bp, Artificial Sequence
  chemically synthesized
agagtggtccagtggactaaca

SEQ ID NO: 128885 - DNA, 22 bp, Artificial Sequence
  chemically synthesized
acaaactggtgaaccaccttct

SEQ ID NO: 128886 - DNA, 22 bp, Artificial Sequence
  chemically synthesized
gtgaaccaccttcttacagcag

SEQ ID NO: 128887 - DNA, 22 bp, Artificial Sequence
  chemically synthesized
cttacagcaggtgaagcctgta

SEQ ID NO: 128888 - DNA, 22 bp, Artificial Sequence
  chemically synthesized
ttacagcaggtgaagcctgtaa

SEQ ID NO: 128889 - DNA, 22 bp, Artificial Sequence
  chemically synthesized
acagcaggtgaagcctgtaatt

SEQ ID NO: 128890 - DNA, 22 bp, Artificial Sequence
  chemically synthesized
cagcaggtgaagcctgtaattc

SEQ ID NO: 128891 - DNA, 22 bp, Artificial Sequence
  chemically synthesized
taattcagcttttcatcattca

SEQ ID NO: 128892 - DNA, 22 bp, Artificial Sequence
  chemically synthesized
agcttttcatcattcaagactg

SEQ ID NO: 128893 - DNA, 22 bp, Artificial Sequence
  chemically synthesized
ttcatcattcaagactgaaaga

SEQ ID NO: 128894 - DNA, 22 bp, Artificial Sequence
  chemically synthesized
tcatcattcaagactgaaagaa

SEQ ID NO: 128895 - DNA, 22 bp, Artificial Sequence
  chemically synthesized
catcattcaagactgaaagaag

SEQ ID NO: 128896 - DNA, 22 bp, Artificial Sequence
  chemically synthesized
atcattcaagactgaaagaaga

SEQ ID NO: 128897 - DNA, 22 bp, Artificial Sequence
  chemically synthesized
aagactgaaagaagaatataac

SEQ ID NO: 128898 - DNA, 22 bp, Artificial Sequence
  chemically synthesized
aaagaagaatataacttatata

SEQ ID NO: 128899 - DNA, 22 bp, Artificial Sequence
  chemically synthesized
atatagagaaggacctcatgag

SEQ ID NO: 128900 - DNA, 22 bp, Artificial Sequence
  chemically synthesized
tatagagaaggacctcatgagg

SEQ ID NO: 128901 - DNA, 22 bp, Artificial Sequence
  chemically synthesized
atgaggaataaatttcatggtg

SEQ ID NO: 128902 - DNA, 22 bp, Artificial Sequence
  chemically synthesized
catggtgcctattaagataaat

SEQ ID NO: 128903 - DNA, 22 bp, Artificial Sequence
  chemically synthesized
atggtgcctattaagataaata

SEQ ID NO: 128904 - DNA, 22 bp, Artificial Sequence
  chemically synthesized
ttaagataaataagtaccatgt

SEQ ID NO: 128905 - DNA, 22 bp, Artificial Sequence
  chemically synthesized
agataaataagtaccatgtagt

SEQ ID NO: 128906 - DNA, 22 bp, Artificial Sequence
  chemically synthesized
tgggaaatctaaggtgtaaaag

SEQ ID NO: 128907 - DNA, 22 bp, Artificial Sequence
  chemically synthesized
aggtgtaaaagaatatacatta

SEQ ID NO: 128908 - DNA, 22 bp, Artificial Sequence
  chemically synthesized
aaaaaagcccttgccaaatacc

SEQ ID NO: 128909 - DNA, 22 bp, Artificial Sequence
  chemically synthesized
gccaaataccatcctttctttt

SEQ ID NO: 128910 - DNA, 22 bp, Artificial Sequence
  chemically synthesized
ccaaataccatcctttcttttt

SEQ ID NO: 128911 - DNA, 22 bp, Artificial Sequence
  chemically synthesized
tctttttcaaataataatatac

SEQ ID NO: 128912 - DNA, 22 bp, Artificial Sequence
  chemically synthesized
ctttttcaaataataatatact

SEQ ID NO: 128913 - DNA, 22 bp, Artificial Sequence
  chemically synthesized
tttttcaaataataatatactt

SEQ ID NO: 128914 - DNA, 22 bp, Artificial Sequence
  chemically synthesized
tttcaaataataatatacttgt

SEQ ID NO: 128915 - DNA, 22 bp, Artificial Sequence
  chemically synthesized
ttcaaataataatatacttgtg

SEQ ID NO: 128916 - DNA, 22 bp, Artificial Sequence
  chemically synthesized
tcaaataataatatacttgtgt

SEQ ID NO: 128917 - DNA, 22 bp, Artificial Sequence
  chemically synthesized
caaataataatatacttgtgta

SEQ ID NO: 128918 - DNA, 22 bp, Artificial Sequence
  chemically synthesized
aaataataatatacttgtgtag

SEQ ID NO: 128919 - DNA, 22 bp, Artificial Sequence
  chemically synthesized
gtgtagtatgggcttgaaggga

SEQ ID NO: 128920 - DNA, 22 bp, Artificial Sequence
  chemically synthesized
tgtagtatgggcttgaagggat

SEQ ID NO: 128921 - DNA, 22 bp, Artificial Sequence
  chemically synthesized
gaagggataacataccataaga

SEQ ID NO: 128922 - DNA, 22 bp, Artificial Sequence
  chemically synthesized
aagggataacataccataagaa

SEQ ID NO: 128923 - DNA, 22 bp, Artificial Sequence
  chemically synthesized
aatttgagtcaggaaatgaaag

SEQ ID NO: 128924 - DNA, 22 bp, Artificial Sequence
  chemically synthesized
atttgagtcaggaaatgaaagg

SEQ ID NO: 128925 - DNA, 22 bp, Artificial Sequence
  chemically synthesized
gagtcaggaaatgaaaggctaa

SEQ ID NO: 128926 - DNA, 22 bp, Artificial Sequence
  chemically synthesized
agtcaggaaatgaaaggctaag

SEQ ID NO: 128927 - DNA, 22 bp, Artificial Sequence
  chemically synthesized
agtgtgcatttctgtagactaa

SEQ ID NO: 128928 - DNA, 22 bp, Artificial Sequence
  chemically synthesized
ctgtagactaagccaatcttag

SEQ ID NO: 128929 - DNA, 22 bp, Artificial Sequence
  chemically synthesized
tgtagactaagccaatcttaga

SEQ ID NO: 128930 - DNA, 22 bp, Artificial Sequence
  chemically synthesized
tagactaagccaatcttagaaa

SEQ ID NO: 128931 - DNA, 22 bp, Artificial Sequence
  chemically synthesized
agccaatcttagaaatgattaa

SEQ ID NO: 128932 - DNA, 22 bp, Artificial Sequence
  chemically synthesized
agaaatgattaagaagacgtgg

SEQ ID NO: 128933 - DNA, 22 bp, Artificial Sequence
  chemically synthesized
gaaatgattaagaagacgtgga

SEQ ID NO: 128934 - DNA, 22 bp, Artificial Sequence
  chemically synthesized
agaagacgtggaagaatcttag

SEQ ID NO: 128935 - DNA, 22 bp, Artificial Sequence
  chemically synthesized
agagacacactgaaaaaatatg

SEQ ID NO: 128936 - DNA, 22 bp, Artificial Sequence
  chemically synthesized
gagacacactgaaaaaatatgt

SEQ ID NO: 128937 - DNA, 22 bp, Artificial Sequence
  chemically synthesized
aaaaaatatgtatggtctaatg

SEQ ID NO: 128938 - DNA, 22 bp, Artificial Sequence
  chemically synthesized
atgagtttacagatcacttttc

SEQ ID NO: 128939 - DNA, 22 bp, Artificial Sequence
  chemically synthesized
acagatcacttttcctcccata

SEQ ID NO: 128940 - DNA, 22 bp, Artificial Sequence
  chemically synthesized
cagatcacttttcctcccatat

SEQ ID NO: 128941 - DNA, 22 bp, Artificial Sequence
  chemically synthesized
ttcctcccatataaaatgaatt

SEQ ID NO: 128942 - DNA, 22 bp, Artificial Sequence
  chemically synthesized
tcctcccatataaaatgaattt

SEQ ID NO: 128943 - DNA, 22 bp, Artificial Sequence
  chemically synthesized
cctcccatataaaatgaattta

SEQ ID NO: 128944 - DNA, 22 bp, Artificial Sequence
  chemically synthesized
ctcccatataaaatgaatttat

SEQ ID NO: 128945 - DNA, 22 bp, Artificial Sequence
  chemically synthesized
ccatataaaatgaatttatact

SEQ ID NO: 128946 - DNA, 22 bp, Artificial Sequence
  chemically synthesized
atactagataaggggaagatga

SEQ ID NO: 128947 - DNA, 22 bp, Artificial Sequence
  chemically synthesized
tactagataaggggaagatgaa

SEQ ID NO: 128948 - DNA, 22 bp, Artificial Sequence
  chemically synthesized
gataaggggaagatgaacttta

SEQ ID NO: 128949 - DNA, 22 bp, Artificial Sequence
  chemically synthesized
tattcctctcattaacaaataa

SEQ ID NO: 128950 - DNA, 22 bp, Artificial Sequence
  chemically synthesized
attcctctcattaacaaataat

SEQ ID NO: 128951 - DNA, 22 bp, Artificial Sequence
  chemically synthesized
ttcctctcattaacaaataatt

SEQ ID NO: 128952 - DNA, 22 bp, Artificial Sequence
  chemically synthesized
ctctcattaacaaataattgct

SEQ ID NO: 128953 - DNA, 22 bp, Artificial Sequence
  chemically synthesized
tcattaacaaataattgctggg

SEQ ID NO: 128954 - DNA, 22 bp, Artificial Sequence
  chemically synthesized
attaacaaataattgctgggtt

SEQ ID NO: 128955 - DNA, 22 bp, Artificial Sequence
  chemically synthesized
acaaataattgctgggttcctt

SEQ ID NO: 128956 - DNA, 22 bp, Artificial Sequence
  chemically synthesized
ctgggttccttcaccagagatg

SEQ ID NO: 128957 - DNA, 22 bp, Artificial Sequence
  chemically synthesized
ggttccttcaccagagatgcag

SEQ ID NO: 128958 - DNA, 22 bp, Artificial Sequence
  chemically synthesized
cttcaccagagatgcagatttt

SEQ ID NO: 128959 - DNA, 22 bp, Artificial Sequence
  chemically synthesized
caccagagatgcagatttttat

SEQ ID NO: 128960 - DNA, 22 bp, Artificial Sequence
  chemically synthesized
accagagatgcagatttttata

SEQ ID NO: 128961 - DNA, 22 bp, Artificial Sequence
  chemically synthesized
ttatagggtaaatgaaaggtga

SEQ ID NO: 128962 - DNA, 22 bp, Artificial Sequence
  chemically synthesized
tatagggtaaatgaaaggtgat

SEQ ID NO: 128963 - DNA, 22 bp, Artificial Sequence
  chemically synthesized
atagggtaaatgaaaggtgata

SEQ ID NO: 128964 - DNA, 22 bp, Artificial Sequence
  chemically synthesized
tagggtaaatgaaaggtgatat

SEQ ID NO: 128965 - DNA, 22 bp, Artificial Sequence
  chemically synthesized
aaagatacttactagattatat

SEQ ID NO: 128966 - DNA, 22 bp, Artificial Sequence
  chemically synthesized
aagatacttactagattatatg

SEQ ID NO: 128967 - DNA, 22 bp, Artificial Sequence
  chemically synthesized
actagattatatgagtattaaa

SEQ ID NO: 128968 - DNA, 22 bp, Artificial Sequence
  chemically synthesized
ctagattatatgagtattaaat

SEQ ID NO: 128969 - DNA, 22 bp, Artificial Sequence
  chemically synthesized
gattatatgagtattaaattgg

SEQ ID NO: 128970 - DNA, 22 bp, Artificial Sequence
  chemically synthesized
tatgagtattaaattgggcagc

SEQ ID NO: 128971 - DNA, 22 bp, Artificial Sequence
  chemically synthesized
aattgggcagcaaggatgatta

SEQ ID NO: 128972 - DNA, 22 bp, Artificial Sequence
  chemically synthesized
ggcagcaaggatgattagaaat

SEQ ID NO: 128973 - DNA, 22 bp, Artificial Sequence
  chemically synthesized
gaaatgattaaggacccagagg

SEQ ID NO: 128974 - DNA, 22 bp, Artificial Sequence
  chemically synthesized
aggacccagaggtctccatgtc

SEQ ID NO: 128975 - DNA, 22 bp, Artificial Sequence
  chemically synthesized
catgtccaattaaagaatgtaa

SEQ ID NO: 128976 - DNA, 22 bp, Artificial Sequence
  chemically synthesized
aagaatgtaaatctgtttttga

SEQ ID NO: 128977 - DNA, 22 bp, Artificial Sequence
  chemically synthesized
tttttgattttatagcctaaat

SEQ ID NO: 128978 - DNA, 22 bp, Artificial Sequence
  chemically synthesized
ttgattttatagcctaaatcct

SEQ ID NO: 128979 - DNA, 22 bp, Artificial Sequence
  chemically synthesized
tgattttatagcctaaatcctt

SEQ ID NO: 128980 - DNA, 22 bp, Artificial Sequence
  chemically synthesized
gattttatagcctaaatcctta

SEQ ID NO: 128981 - DNA, 22 bp, Artificial Sequence
  chemically synthesized
attttatagcctaaatccttag

SEQ ID NO: 128982 - DNA, 22 bp, Artificial Sequence
  chemically synthesized
tatagcctaaatccttagacac

SEQ ID NO: 128983 - DNA, 22 bp, Artificial Sequence
  chemically synthesized
atagcctaaatccttagacaca

SEQ ID NO: 128984 - DNA, 22 bp, Artificial Sequence
  chemically synthesized
tagcctaaatccttagacacag

SEQ ID NO: 128985 - DNA, 22 bp, Artificial Sequence
  chemically synthesized
aatccttagacacagtcattgt

SEQ ID NO: 128986 - DNA, 22 bp, Artificial Sequence
  chemically synthesized
agacacagtcattgttattaat

SEQ ID NO: 128987 - DNA, 22 bp, Artificial Sequence
  chemically synthesized
gacacagtcattgttattaata

SEQ ID NO: 128988 - DNA, 22 bp, Artificial Sequence
  chemically synthesized
ttattaataaactcatagacaa

SEQ ID NO: 128989 - DNA, 22 bp, Artificial Sequence
  chemically synthesized
ttaataaactcatagacaaaat

SEQ ID NO: 128990 - DNA, 22 bp, Artificial Sequence
  chemically synthesized
ataaactcatagacaaaattta

SEQ ID NO: 128991 - DNA, 22 bp, Artificial Sequence
  chemically synthesized
atagacaaaatttattttatgg

SEQ ID NO: 128992 - DNA, 22 bp, Artificial Sequence
  chemically synthesized
attttatgggaaatttaggagt

SEQ ID NO: 128993 - DNA, 22 bp, Artificial Sequence
  chemically synthesized
ttttatgggaaatttaggagtt

SEQ ID NO: 128994 - DNA, 22 bp, Artificial Sequence
  chemically synthesized
tatgggaaatttaggagtttat

SEQ ID NO: 128995 - DNA, 22 bp, Artificial Sequence
  chemically synthesized
atgggaaatttaggagtttatg

SEQ ID NO: 128996 - DNA, 22 bp, Artificial Sequence
  chemically synthesized
tgggaaatttaggagtttatgt

SEQ ID NO: 128997 - DNA, 22 bp, Artificial Sequence
  chemically synthesized
aggagtttatgtccctagattt

SEQ ID NO: 128998 - DNA, 22 bp, Artificial Sequence
  chemically synthesized
ggagtttatgtccctagatttc

SEQ ID NO: 128999 - DNA, 22 bp, Artificial Sequence
  chemically synthesized
atgtccctagatttcaagtaca

SEQ ID NO: 129000 - DNA, 22 bp, Artificial Sequence
  chemically synthesized
tgtccctagatttcaagtacat

SEQ ID NO: 129001 - DNA, 22 bp, Artificial Sequence
  chemically synthesized
gatttcaagtacatgccaccaa

SEQ ID NO: 129002 - DNA, 22 bp, Artificial Sequence
  chemically synthesized
caagtacatgccaccaaactga

SEQ ID NO: 129003 - DNA, 22 bp, Artificial Sequence
  chemically synthesized
aagtacatgccaccaaactgac

SEQ ID NO: 129004 - DNA, 22 bp, Artificial Sequence
  chemically synthesized
acagatgacagtgattagtcac

SEQ ID NO: 129005 - DNA, 22 bp, Artificial Sequence
  chemically synthesized
gtcacaaagtgcctcaaaaata

SEQ ID NO: 129006 - DNA, 22 bp, Artificial Sequence
  chemically synthesized
aaaaatagatggccctatgtta

SEQ ID NO: 129007 - DNA, 22 bp, Artificial Sequence
  chemically synthesized
tgttagtcatggttctccagaa

SEQ ID NO: 129008 - DNA, 22 bp, Artificial Sequence
  chemically synthesized
gtcatggttctccagaaaaata

SEQ ID NO: 129009 - DNA, 22 bp, Artificial Sequence
  chemically synthesized
tccagaaaaatagaatcaacag

SEQ ID NO: 129010 - DNA, 22 bp, Artificial Sequence
  chemically synthesized
cagaaaaatagaatcaacagga

SEQ ID NO: 129011 - DNA, 22 bp, Artificial Sequence
  chemically synthesized
acccaacttcaaattatactac

SEQ ID NO: 129012 - DNA, 22 bp, Artificial Sequence
  chemically synthesized
cccaacttcaaattatactaca

SEQ ID NO: 129013 - DNA, 22 bp, Artificial Sequence
  chemically synthesized
caaattatactacaaggtgaca

SEQ ID NO: 129014 - DNA, 22 bp, Artificial Sequence
  chemically synthesized
aaattatactacaaggtgacag

SEQ ID NO: 129015 - DNA, 22 bp, Artificial Sequence
  chemically synthesized
tactacaaggtgacagtaacta

SEQ ID NO: 129016 - DNA, 22 bp, Artificial Sequence
  chemically synthesized
caaggtgacagtaactaactga

SEQ ID NO: 129017 - DNA, 22 bp, Artificial Sequence
  chemically synthesized
actgaaacagcatggtactgat

SEQ ID NO: 129018 - DNA, 22 bp, Artificial Sequence
  chemically synthesized
aaacagcatggtactgatacca

SEQ ID NO: 129019 - DNA, 22 bp, Artificial Sequence
  chemically synthesized
ataccaaacagacacactgact

SEQ ID NO: 129020 - DNA, 22 bp, Artificial Sequence
  chemically synthesized
actaatggaacagaatggagaa

SEQ ID NO: 129021 - DNA, 22 bp, Artificial Sequence
  chemically synthesized
atggaacagaatggagaactca

SEQ ID NO: 129022 - DNA, 22 bp, Artificial Sequence
  chemically synthesized
agaagtaagaccgcgcatctga

SEQ ID NO: 129023 - DNA, 22 bp, Artificial Sequence
  chemically synthesized
aaacaatctgatcttcaacaaa

SEQ ID NO: 129024 - DNA, 22 bp, Artificial Sequence
  chemically synthesized
atcttcaacaaacctggtaaaa

SEQ ID NO: 129025 - DNA, 22 bp, Artificial Sequence
  chemically synthesized
caacaaacctggtaaaaacaag

SEQ ID NO: 129026 - DNA, 22 bp, Artificial Sequence
  chemically synthesized
aacaaacctggtaaaaacaagt

SEQ ID NO: 129027 - DNA, 22 bp, Artificial Sequence
  chemically synthesized
gtaaaaacaagtaatggggaag

SEQ ID NO: 129028 - DNA, 22 bp, Artificial Sequence
  chemically synthesized
cctattttataaattgtgctgg

SEQ ID NO: 129029 - DNA, 22 bp, Artificial Sequence
  chemically synthesized
ttttataaattgtgctgggaga

SEQ ID NO: 129030 - DNA, 22 bp, Artificial Sequence
  chemically synthesized
tataaattgtgctgggagaact

SEQ ID NO: 129031 - DNA, 22 bp, Artificial Sequence
  chemically synthesized
ataaattgtgctgggagaactg

SEQ ID NO: 129032 - DNA, 22 bp, Artificial Sequence
  chemically synthesized
taaattgtgctgggagaactgg

SEQ ID NO: 129033 - DNA, 22 bp, Artificial Sequence
  chemically synthesized
tgctgggagaactggctagcca

SEQ ID NO: 129034 - DNA, 22 bp, Artificial Sequence
  chemically synthesized
ggagaactggctagccatatgc

SEQ ID NO: 129035 - DNA, 22 bp, Artificial Sequence
  chemically synthesized
gctagccatatgcagaaaattg

SEQ ID NO: 129036 - DNA, 22 bp, Artificial Sequence
  chemically synthesized
gccatatgcagaaaattgaaac

SEQ ID NO: 129037 - DNA, 22 bp, Artificial Sequence
  chemically synthesized
aaactggaccccttccttacat

SEQ ID NO: 129038 - DNA, 22 bp, Artificial Sequence
  chemically synthesized
gaccccttccttacatcttata

SEQ ID NO: 129039 - DNA, 22 bp, Artificial Sequence
  chemically synthesized
ccttacatcttatacataaatt

SEQ ID NO: 129040 - DNA, 22 bp, Artificial Sequence
  chemically synthesized
cttacatcttatacataaatta

SEQ ID NO: 129041 - DNA, 22 bp, Artificial Sequence
  chemically synthesized
acatcttatacataaattaact

SEQ ID NO: 129042 - DNA, 22 bp, Artificial Sequence
  chemically synthesized
catcttatacataaattaactc

SEQ ID NO: 129043 - DNA, 22 bp, Artificial Sequence
  chemically synthesized
atacataaattaactcaagatg

SEQ ID NO: 129044 - DNA, 22 bp, Artificial Sequence
  chemically synthesized
tacataaattaactcaagatgc

SEQ ID NO: 129045 - DNA, 22 bp, Artificial Sequence
  chemically synthesized
actcaagatgcattaaagactt

SEQ ID NO: 129046 - DNA, 22 bp, Artificial Sequence
  chemically synthesized
aagatgcattaaagacttaagt

SEQ ID NO: 129047 - DNA, 22 bp, Artificial Sequence
  chemically synthesized
aagacttaagtgtaaaacccaa

SEQ ID NO: 129048 - DNA, 22 bp, Artificial Sequence
  chemically synthesized
aagtgtaaaacccaaaactata

SEQ ID NO: 129049 - DNA, 22 bp, Artificial Sequence
  chemically synthesized
agtgtaaaacccaaaactataa

SEQ ID NO: 129050 - DNA, 22 bp, Artificial Sequence
  chemically synthesized
taaaaactttagaagaaaacct

SEQ ID NO: 129051 - DNA, 22 bp, Artificial Sequence
  chemically synthesized
tagaagaaaacctaggcaatac

SEQ ID NO: 129052 - DNA, 22 bp, Artificial Sequence
  chemically synthesized
agaagaaaacctaggcaatacc

SEQ ID NO: 129053 - DNA, 22 bp, Artificial Sequence
  chemically synthesized
gaagaaaacctaggcaatacca

SEQ ID NO: 129054 - DNA, 22 bp, Artificial Sequence
  chemically synthesized
ggcaataccattccggacatag

SEQ ID NO: 129055 - DNA, 22 bp, Artificial Sequence
  chemically synthesized
cggacatagacacaggcaaaga

SEQ ID NO: 129056 - DNA, 22 bp, Artificial Sequence
  chemically synthesized
catgatgaaaatgtcaaaaaca

SEQ ID NO: 129057 - DNA, 22 bp, Artificial Sequence
  chemically synthesized
atgatgaaaatgtcaaaaacaa

SEQ ID NO: 129058 - DNA, 22 bp, Artificial Sequence
  chemically synthesized
caacaaaagcaaacactgtcaa

SEQ ID NO: 129059 - DNA, 22 bp, Artificial Sequence
  chemically synthesized
tcaaatgagatctaattaaact

SEQ ID NO: 129060 - DNA, 22 bp, Artificial Sequence
  chemically synthesized
attaaactaaagagatcgggca

SEQ ID NO: 129061 - DNA, 22 bp, Artificial Sequence
  chemically synthesized
aactaaagagatcgggcatggt

SEQ ID NO: 129062 - DNA, 22 bp, Artificial Sequence
  chemically synthesized
aagagatcgggcatggtggctc

SEQ ID NO: 129063 - DNA, 22 bp, Artificial Sequence
  chemically synthesized
acgcctgtaatcccagcacttt

SEQ ID NO: 129064 - DNA, 22 bp, Artificial Sequence
  chemically synthesized
taatcccagcactttgggaggc

SEQ ID NO: 129065 - DNA, 22 bp, Artificial Sequence
  chemically synthesized
tgggaggccaaggtgggtggat

SEQ ID NO: 129066 - DNA, 22 bp, Artificial Sequence
  chemically synthesized
gggaggccaaggtgggtggatc

SEQ ID NO: 129067 - DNA, 22 bp, Artificial Sequence
  chemically synthesized
ggaggccaaggtgggtggatca

SEQ ID NO: 129068 - DNA, 22 bp, Artificial Sequence
  chemically synthesized
gaggtggggagtataagagcag

SEQ ID NO: 129069 - DNA, 22 bp, Artificial Sequence
  chemically synthesized
aggtggggagtataagagcagc

SEQ ID NO: 129070 - DNA, 22 bp, Artificial Sequence
  chemically synthesized
gccaacatggtgaaactccatc

SEQ ID NO: 129071 - DNA, 22 bp, Artificial Sequence
  chemically synthesized
catctctactaaaaatacaaaa

SEQ ID NO: 129072 - DNA, 22 bp, Artificial Sequence
  chemically synthesized
tactaaaaatacaaaaaatgtg

SEQ ID NO: 129073 - DNA, 22 bp, Artificial Sequence
  chemically synthesized
ctaaaaatacaaaaaatgtgct

SEQ ID NO: 129074 - DNA, 22 bp, Artificial Sequence
  chemically synthesized
aaaatacaaaaaatgtgctggg

SEQ ID NO: 129075 - DNA, 22 bp, Artificial Sequence
  chemically synthesized
ggtatggtggtgcgtacctgta

SEQ ID NO: 129076 - DNA, 22 bp, Artificial Sequence
  chemically synthesized
taatctcagctactcaggaggc

SEQ ID NO: 129077 - DNA, 22 bp, Artificial Sequence
  chemically synthesized
agctactcaggaggctgaggca

SEQ ID NO: 129078 - DNA, 22 bp, Artificial Sequence
  chemically synthesized
ctcaggaggctgaggcaggaga

SEQ ID NO: 129079 - DNA, 22 bp, Artificial Sequence
  chemically synthesized
aggaggctgaggcaggagaatt

SEQ ID NO: 129080 - DNA, 22 bp, Artificial Sequence
  chemically synthesized
aggcaggagaattgcttgaacc

SEQ ID NO: 129081 - DNA, 22 bp, Artificial Sequence
  chemically synthesized
cttgaacccaggaggcagaggt

SEQ ID NO: 129082 - DNA, 22 bp, Artificial Sequence
  chemically synthesized
gaacccaggaggcagaggttgc

SEQ ID NO: 129083 - DNA, 22 bp, Artificial Sequence
  chemically synthesized
aacccaggaggcagaggttgca

SEQ ID NO: 129084 - DNA, 22 bp, Artificial Sequence
  chemically synthesized
cagtgagctgagatcgcaccac

SEQ ID NO: 129085 - DNA, 22 bp, Artificial Sequence
  chemically synthesized
agatcgcaccactgcactctag

SEQ ID NO: 129086 - DNA, 22 bp, Artificial Sequence
  chemically synthesized
cactctagcatgggtgaaagag

SEQ ID NO: 129087 - DNA, 22 bp, Artificial Sequence
  chemically synthesized
tagcatgggtgaaagagtgaga

SEQ ID NO: 129088 - DNA, 22 bp, Artificial Sequence
  chemically synthesized
gcatgggtgaaagagtgagact

SEQ ID NO: 129089 - DNA, 22 bp, Artificial Sequence
  chemically synthesized
catctcaaaataaagaaaaata

SEQ ID NO: 129090 - DNA, 22 bp, Artificial Sequence
  chemically synthesized
atctcaaaataaagaaaaatac

SEQ ID NO: 129091 - DNA, 22 bp, Artificial Sequence
  chemically synthesized
aaaataaagaaaaatacaatta

SEQ ID NO: 129092 - DNA, 22 bp, Artificial Sequence
  chemically synthesized
aatacagagcttctaaacagca

SEQ ID NO: 129093 - DNA, 22 bp, Artificial Sequence
  chemically synthesized
ctaaacagcaaaataaactatc

SEQ ID NO: 129094 - DNA, 22 bp, Artificial Sequence
  chemically synthesized
taaacagcaaaataaactatca

SEQ ID NO: 129095 - DNA, 22 bp, Artificial Sequence
  chemically synthesized
aacagcaaaataaactatcatc

SEQ ID NO: 129096 - DNA, 22 bp, Artificial Sequence
  chemically synthesized
tcatcagagcgaacaggcaacc

SEQ ID NO: 129097 - DNA, 22 bp, Artificial Sequence
  chemically synthesized
cagaatgggagaaaatttctgc

SEQ ID NO: 129098 - DNA, 22 bp, Artificial Sequence
  chemically synthesized
ctgcaatctacccatctgacaa

SEQ ID NO: 129099 - DNA, 22 bp, Artificial Sequence
  chemically synthesized
tgcaatctacccatctgacaaa

SEQ ID NO: 129100 - DNA, 22 bp, Artificial Sequence
  chemically synthesized
caatctacccatctgacaaagg

SEQ ID NO: 129101 - DNA, 22 bp, Artificial Sequence
  chemically synthesized
cccatctgacaaaggtctaata

SEQ ID NO: 129102 - DNA, 22 bp, Artificial Sequence
  chemically synthesized
acaaaggtctaatatccagaat

SEQ ID NO: 129103 - DNA, 22 bp, Artificial Sequence
  chemically synthesized
atatccagaatctatgaggaac

SEQ ID NO: 129104 - DNA, 22 bp, Artificial Sequence
  chemically synthesized
tgaggaacttagacatatttac

SEQ ID NO: 129105 - DNA, 22 bp, Artificial Sequence
  chemically synthesized
agacatatttacaaaagaaaca

SEQ ID NO: 129106 - DNA, 22 bp, Artificial Sequence
  chemically synthesized
gacatatttacaaaagaaacac

SEQ ID NO: 129107 - DNA, 22 bp, Artificial Sequence
  chemically synthesized
acaaaagaaacacacaaacaac

SEQ ID NO: 129108 - DNA, 22 bp, Artificial Sequence
  chemically synthesized
caaaagaaacacacaaacaacc

SEQ ID NO: 129109 - DNA, 22 bp, Artificial Sequence
  chemically synthesized
aaaagtgggcaaaggacatgaa

SEQ ID NO: 129110 - DNA, 22 bp, Artificial Sequence
  chemically synthesized
ctcaaaagaagacatttatgtg

SEQ ID NO: 129111 - DNA, 22 bp, Artificial Sequence
  chemically synthesized
tcaaaagaagacatttatgtgg

SEQ ID NO: 129112 - DNA, 22 bp, Artificial Sequence
  chemically synthesized
aaaagaagacatttatgtggct

SEQ ID NO: 129113 - DNA, 22 bp, Artificial Sequence
  chemically synthesized
atgtggctaagaaacatacgaa

SEQ ID NO: 129114 - DNA, 22 bp, Artificial Sequence
  chemically synthesized
tgtggctaagaaacatacgaaa

SEQ ID NO: 129115 - DNA, 22 bp, Artificial Sequence
  chemically synthesized
agaaacatacgaaaaaagtctc

SEQ ID NO: 129116 - DNA, 22 bp, Artificial Sequence
  chemically synthesized
aatgtcactgatcattagagaa

SEQ ID NO: 129117 - DNA, 22 bp, Artificial Sequence
  chemically synthesized
atcattagagaaatgcaaatca

SEQ ID NO: 129118 - DNA, 22 bp, Artificial Sequence
  chemically synthesized
gagaaatgcaaatcaaaaccac

SEQ ID NO: 129119 - DNA, 22 bp, Artificial Sequence
  chemically synthesized
acaccagtcagaatggtggttt

SEQ ID NO: 129120 - DNA, 22 bp, Artificial Sequence
  chemically synthesized
ttaaagtcaagaaacaacagat

SEQ ID NO: 129121 - DNA, 22 bp, Artificial Sequence
  chemically synthesized
taaagtcaagaaacaacagatg

SEQ ID NO: 129122 - DNA, 22 bp, Artificial Sequence
  chemically synthesized
aaagtcaagaaacaacagatgc

SEQ ID NO: 129123 - DNA, 22 bp, Artificial Sequence
  chemically synthesized
aagtcaagaaacaacagatgct

SEQ ID NO: 129124 - DNA, 22 bp, Artificial Sequence
  chemically synthesized
gcaaggttgcagagaaatagga

SEQ ID NO: 129125 - DNA, 22 bp, Artificial Sequence
  chemically synthesized
cagagaaataggaacactttta

SEQ ID NO: 129126 - DNA, 22 bp, Artificial Sequence
  chemically synthesized
ttacactgttggtgggactgta

SEQ ID NO: 129127 - DNA, 22 bp, Artificial Sequence
  chemically synthesized
tacactgttggtgggactgtaa

SEQ ID NO: 129128 - DNA, 22 bp, Artificial Sequence
  chemically synthesized
acactgttggtgggactgtaaa

SEQ ID NO: 129129 - DNA, 22 bp, Artificial Sequence
  chemically synthesized
cactgttggtgggactgtaaac

SEQ ID NO: 129130 - DNA, 22 bp, Artificial Sequence
  chemically synthesized
ttggtgggactgtaaactaatt

SEQ ID NO: 129131 - DNA, 22 bp, Artificial Sequence
  chemically synthesized
gtgggactgtaaactaattcaa

SEQ ID NO: 129132 - DNA, 22 bp, Artificial Sequence
  chemically synthesized
taaactaattcaaccattgtgg

SEQ ID NO: 129133 - DNA, 22 bp, Artificial Sequence
  chemically synthesized
attcaaccattgtggaagacag

SEQ ID NO: 129134 - DNA, 22 bp, Artificial Sequence
  chemically synthesized
aaccattgtggaagacagtgtg

SEQ ID NO: 129135 - DNA, 22 bp, Artificial Sequence
  chemically synthesized
tggaagacagtgtggcaattcc

SEQ ID NO: 129136 - DNA, 22 bp, Artificial Sequence
  chemically synthesized
ctcaaagatttagaaccagaaa

SEQ ID NO: 129137 - DNA, 22 bp, Artificial Sequence
  chemically synthesized
aaagatttagaaccagaaatac

SEQ ID NO: 129138 - DNA, 22 bp, Artificial Sequence
  chemically synthesized
agaaccagaaataccatttgac

SEQ ID NO: 129139 - DNA, 22 bp, Artificial Sequence
  chemically synthesized
gaaccagaaataccatttgacc

SEQ ID NO: 129140 - DNA, 22 bp, Artificial Sequence
  chemically synthesized
gacctcacaatcccattactgg

SEQ ID NO: 129141 - DNA, 22 bp, Artificial Sequence
  chemically synthesized
acctcacaatcccattactggg

SEQ ID NO: 129142 - DNA, 22 bp, Artificial Sequence
  chemically synthesized
acaatcccattactgggtatat

SEQ ID NO: 129143 - DNA, 22 bp, Artificial Sequence
  chemically synthesized
ctgggtatatacctaaaggagt

SEQ ID NO: 129144 - DNA, 22 bp, Artificial Sequence
  chemically synthesized
ggtatatacctaaaggagtata

SEQ ID NO: 129145 - DNA, 22 bp, Artificial Sequence
  chemically synthesized
aaggagtataaatcattctatt

SEQ ID NO: 129146 - DNA, 22 bp, Artificial Sequence
  chemically synthesized
tattactaagatacatgcacat

SEQ ID NO: 129147 - DNA, 22 bp, Artificial Sequence
  chemically synthesized
ttactaagatacatgcacatgt

SEQ ID NO: 129148 - DNA, 22 bp, Artificial Sequence
  chemically synthesized
ctaagatacatgcacatgtatg

SEQ ID NO: 129149 - DNA, 22 bp, Artificial Sequence
  chemically synthesized
agatacatgcacatgtatgttc

SEQ ID NO: 129150 - DNA, 22 bp, Artificial Sequence
  chemically synthesized
attgtagcactattcacaatag

SEQ ID NO: 129151 - DNA, 22 bp, Artificial Sequence
  chemically synthesized
tagcactattcacaatagcaaa

SEQ ID NO: 129152 - DNA, 22 bp, Artificial Sequence
  chemically synthesized
ttcacaatagcaaagacataga

SEQ ID NO: 129153 - DNA, 22 bp, Artificial Sequence
  chemically synthesized
acaatagcaaagacatagaatc

SEQ ID NO: 129154 - DNA, 22 bp, Artificial Sequence
  chemically synthesized
aaaaaatgtggtacatataaac

SEQ ID NO: 129155 - DNA, 22 bp, Artificial Sequence
  chemically synthesized
aaaaatgtggtacatataaacc

SEQ ID NO: 129156 - DNA, 22 bp, Artificial Sequence
  chemically synthesized
tctaaccataaaaagggatgag

SEQ ID NO: 129157 - DNA, 22 bp, Artificial Sequence
  chemically synthesized
accataaaaagggatgagatca

SEQ ID NO: 129158 - DNA, 22 bp, Artificial Sequence
  chemically synthesized
tgctgggacatggatggagccg

SEQ ID NO: 129159 - DNA, 22 bp, Artificial Sequence
  chemically synthesized
gctgggacatggatggagccga

SEQ ID NO: 129160 - DNA, 22 bp, Artificial Sequence
  chemically synthesized
ctgggacatggatggagccgaa

SEQ ID NO: 129161 - DNA, 22 bp, Artificial Sequence
  chemically synthesized
ggacatggatggagccgaaagc

SEQ ID NO: 129162 - DNA, 22 bp, Artificial Sequence
  chemically synthesized
tcttcagtaaactaatgcagga

SEQ ID NO: 129163 - DNA, 22 bp, Artificial Sequence
  chemically synthesized
cagtaaactaatgcaggaacag

SEQ ID NO: 129164 - DNA, 22 bp, Artificial Sequence
  chemically synthesized
agtaaactaatgcaggaacaga

SEQ ID NO: 129165 - DNA, 22 bp, Artificial Sequence
  chemically synthesized
atgcaggaacagaaaaccaaac

SEQ ID NO: 129166 - DNA, 22 bp, Artificial Sequence
  chemically synthesized
tcacttagaagtgggagctgaa

SEQ ID NO: 129167 - DNA, 22 bp, Artificial Sequence
  chemically synthesized
acttagaagtgggagctgaaca

SEQ ID NO: 129168 - DNA, 22 bp, Artificial Sequence
  chemically synthesized
agaagtgggagctgaacaatga

SEQ ID NO: 129169 - DNA, 22 bp, Artificial Sequence
  chemically synthesized
gaagtgggagctgaacaatgag

SEQ ID NO: 129170 - DNA, 22 bp, Artificial Sequence
  chemically synthesized
aacaatgagaatgagaacacat

SEQ ID NO: 129171 - DNA, 22 bp, Artificial Sequence
  chemically synthesized
gagcctgtcagggcatggggtg

SEQ ID NO: 129172 - DNA, 22 bp, Artificial Sequence
  chemically synthesized
tcagggcatggggtgtggtgaa

SEQ ID NO: 129173 - DNA, 22 bp, Artificial Sequence
  chemically synthesized
gaaaaaatagctaatgcatgct

SEQ ID NO: 129174 - DNA, 22 bp, Artificial Sequence
  chemically synthesized
atgcatgctgggcttaacacct

SEQ ID NO: 129175 - DNA, 22 bp, Artificial Sequence
  chemically synthesized
ggcttaacacctaggtgatggg

SEQ ID NO: 129176 - DNA, 22 bp, Artificial Sequence
  chemically synthesized
aacacctaggtgatgggttgat

SEQ ID NO: 129177 - DNA, 22 bp, Artificial Sequence
  chemically synthesized
acacctaggtgatgggttgata

SEQ ID NO: 129178 - DNA, 22 bp, Artificial Sequence
  chemically synthesized
ggtgatgggttgataggtacag

SEQ ID NO: 129179 - DNA, 22 bp, Artificial Sequence
  chemically synthesized
ataggtacagcaaaccaccatt

SEQ ID NO: 129180 - DNA, 22 bp, Artificial Sequence
  chemically synthesized
cacacatttacgtatgtaataa

SEQ ID NO: 129181 - DNA, 22 bp, Artificial Sequence
  chemically synthesized
acgtatgtaataaacctgcaca

SEQ ID NO: 129182 - DNA, 22 bp, Artificial Sequence
  chemically synthesized
cgtatgtaataaacctgcacat

SEQ ID NO: 129183 - DNA, 22 bp, Artificial Sequence
  chemically synthesized
cacatcctgcacatgtacctca

SEQ ID NO: 129184 - DNA, 22 bp, Artificial Sequence
  chemically synthesized
cacatgtacctcagaacttaaa

SEQ ID NO: 129185 - DNA, 22 bp, Artificial Sequence
  chemically synthesized
agaacttaaaaattaaaaaaat

SEQ ID NO: 129186 - DNA, 22 bp, Artificial Sequence
  chemically synthesized
aaaaattaaaaaaattgaatgt

SEQ ID NO: 129187 - DNA, 22 bp, Artificial Sequence
  chemically synthesized
aaaattaaaaaaattgaatgta

SEQ ID NO: 129188 - DNA, 22 bp, Artificial Sequence
  chemically synthesized
aaaaaattgaatgtacataaaa

SEQ ID NO: 129189 - DNA, 22 bp, Artificial Sequence
  chemically synthesized
aatgtacataaaaatatggaaa

SEQ ID NO: 129190 - DNA, 22 bp, Artificial Sequence
  chemically synthesized
ataaatgtaattcactgcatta

SEQ ID NO: 129191 - DNA, 22 bp, Artificial Sequence
  chemically synthesized
actgcattaaaaaaaaataatg

SEQ ID NO: 129192 - DNA, 22 bp, Artificial Sequence
  chemically synthesized
cattaaaaaaaaataatggcaa

SEQ ID NO: 129193 - DNA, 22 bp, Artificial Sequence
  chemically synthesized
aaaaaaaataatggcaaaaact

SEQ ID NO: 129194 - DNA, 22 bp, Artificial Sequence
  chemically synthesized
caattactgttgcaccaaccta

SEQ ID NO: 129195 - DNA, 22 bp, Artificial Sequence
  chemically synthesized
ctgttgcaccaacctaatataa

SEQ ID NO: 129196 - DNA, 22 bp, Artificial Sequence
  chemically synthesized
ttgcaccaacctaatataagga

SEQ ID NO: 129197 - DNA, 22 bp, Artificial Sequence
  chemically synthesized
caccaacctaatataaggaaat

SEQ ID NO: 129198 - DNA, 22 bp, Artificial Sequence
  chemically synthesized
atataaggaaatagcagatgtg

SEQ ID NO: 129199 - DNA, 22 bp, Artificial Sequence
  chemically synthesized
tggaggaaggcaagtcccaaga

SEQ ID NO: 129200 - DNA, 22 bp, Artificial Sequence
  chemically synthesized
aaaactcaagagagcctggtag

SEQ ID NO: 129201 - DNA, 22 bp, Artificial Sequence
  chemically synthesized
aagagagcctggtagtttagtc

SEQ ID NO: 129202 - DNA, 22 bp, Artificial Sequence
  chemically synthesized
gtagtttagtcccagtccaagt

SEQ ID NO: 129203 - DNA, 22 bp, Artificial Sequence
  chemically synthesized
agtcccagtccaagtctgaagg

SEQ ID NO: 129204 - DNA, 22 bp, Artificial Sequence
  chemically synthesized
gtcccagtccaagtctgaaggc

SEQ ID NO: 129205 - DNA, 22 bp, Artificial Sequence
  chemically synthesized
aaggcctgggaaacaggaggat

SEQ ID NO: 129206 - DNA, 22 bp, Artificial Sequence
  chemically synthesized
ggaaacaggaggattgatggtg

SEQ ID NO: 129207 - DNA, 22 bp, Artificial Sequence
  chemically synthesized
atggtgtacttgcaacccaaaa

SEQ ID NO: 129208 - DNA, 22 bp, Artificial Sequence
  chemically synthesized
gcaacccaaaagccatcaggct

SEQ ID NO: 129209 - DNA, 22 bp, Artificial Sequence
  chemically synthesized
caacccaaaagccatcaggctt

SEQ ID NO: 129210 - DNA, 22 bp, Artificial Sequence
  chemically synthesized
cagacccaggaagttttgatgt

SEQ ID NO: 129211 - DNA, 22 bp, Artificial Sequence
  chemically synthesized
agacccaggaagttttgatgtt

SEQ ID NO: 129212 - DNA, 22 bp, Artificial Sequence
  chemically synthesized
tgatgtttcagttcaatctaaa

SEQ ID NO: 129213 - DNA, 22 bp, Artificial Sequence
  chemically synthesized
gatgtttcagttcaatctaaag

SEQ ID NO: 129214 - DNA, 22 bp, Artificial Sequence
  chemically synthesized
atgtttcagttcaatctaaagg

SEQ ID NO: 129215 - DNA, 22 bp, Artificial Sequence
  chemically synthesized
cagttcaatctaaaggcagaaa

SEQ ID NO: 129216 - DNA, 22 bp, Artificial Sequence
  chemically synthesized
agttcaatctaaaggcagaaaa

SEQ ID NO: 129217 - DNA, 22 bp, Artificial Sequence
  chemically synthesized
aatctaaaggcagaaaaaaagg

SEQ ID NO: 129218 - DNA, 22 bp, Artificial Sequence
  chemically synthesized
aaggcagaaaaaaaggtctaga

SEQ ID NO: 129219 - DNA, 22 bp, Artificial Sequence
  chemically synthesized
gattccagtttgaaggccatca

SEQ ID NO: 129220 - DNA, 22 bp, Artificial Sequence
  chemically synthesized
cagtttgaaggccatcaataag

SEQ ID NO: 129221 - DNA, 22 bp, Artificial Sequence
  chemically synthesized
gaaggccatcaataaggaataa

SEQ ID NO: 129222 - DNA, 22 bp, Artificial Sequence
  chemically synthesized
aaggccatcaataaggaataat

SEQ ID NO: 129223 - DNA, 22 bp, Artificial Sequence
  chemically synthesized
tctctgatttggggaagggtca

SEQ ID NO: 129224 - DNA, 22 bp, Artificial Sequence
  chemically synthesized
tctgatttggggaagggtcaga

SEQ ID NO: 129225 - DNA, 22 bp, Artificial Sequence
  chemically synthesized
tgatttggggaagggtcagact

SEQ ID NO: 129226 - DNA, 22 bp, Artificial Sequence
  chemically synthesized
atttggggaagggtcagacttt

SEQ ID NO: 129227 - DNA, 22 bp, Artificial Sequence
  chemically synthesized
ggggaagggtcagactttttgt

SEQ ID NO: 129228 - DNA, 22 bp, Artificial Sequence
  chemically synthesized
gggaagggtcagactttttgtt

SEQ ID NO: 129229 - DNA, 22 bp, Artificial Sequence
  chemically synthesized
tttgttctattcaggttttcaa

SEQ ID NO: 129230 - DNA, 22 bp, Artificial Sequence
  chemically synthesized
ttgttctattcaggttttcaac

SEQ ID NO: 129231 - DNA, 22 bp, Artificial Sequence
  chemically synthesized
tgttctattcaggttttcaact

SEQ ID NO: 129232 - DNA, 22 bp, Artificial Sequence
  chemically synthesized
gttctattcaggttttcaactg

SEQ ID NO: 129233 - DNA, 22 bp, Artificial Sequence
  chemically synthesized
ttctattcaggttttcaactga

SEQ ID NO: 129234 - DNA, 22 bp, Artificial Sequence
  chemically synthesized
tattcaggttttcaactgattg

SEQ ID NO: 129235 - DNA, 22 bp, Artificial Sequence
  chemically synthesized
ttcaggttttcaactgattgga

SEQ ID NO: 129236 - DNA, 22 bp, Artificial Sequence
  chemically synthesized
aggttttcaactgattggagga

SEQ ID NO: 129237 - DNA, 22 bp, Artificial Sequence
  chemically synthesized
tcaactgattggaggaagccgc

SEQ ID NO: 129238 - DNA, 22 bp, Artificial Sequence
  chemically synthesized
caactgattggaggaagccgcc

SEQ ID NO: 129239 - DNA, 22 bp, Artificial Sequence
  chemically synthesized
aactgattggaggaagccgcct

SEQ ID NO: 129240 - DNA, 22 bp, Artificial Sequence
  chemically synthesized
attggaggaagccgcctgcaat

SEQ ID NO: 129241 - DNA, 22 bp, Artificial Sequence
  chemically synthesized
gaggaagccgcctgcaatagga

SEQ ID NO: 129242 - DNA, 22 bp, Artificial Sequence
  chemically synthesized
caataggaaggaccatctgctc

SEQ ID NO: 129243 - DNA, 22 bp, Artificial Sequence
  chemically synthesized
ctctacttggtctaccgattta

SEQ ID NO: 129244 - DNA, 22 bp, Artificial Sequence
  chemically synthesized
tacttggtctaccgatttaaat

SEQ ID NO: 129245 - DNA, 22 bp, Artificial Sequence
  chemically synthesized
cttggtctaccgatttaaatgt

SEQ ID NO: 129246 - DNA, 22 bp, Artificial Sequence
  chemically synthesized
ggtctaccgatttaaatgttaa

SEQ ID NO: 129247 - DNA, 22 bp, Artificial Sequence
  chemically synthesized
gtctaccgatttaaatgttaat

SEQ ID NO: 129248 - DNA, 22 bp, Artificial Sequence
  chemically synthesized
ccgatttaaatgttaatcttgc

SEQ ID NO: 129249 - DNA, 22 bp, Artificial Sequence
  chemically synthesized
aaatgttaatcttgcctaaaaa

SEQ ID NO: 129250 - DNA, 22 bp, Artificial Sequence
  chemically synthesized
aatgttaatcttgcctaaaaac

SEQ ID NO: 129251 - DNA, 22 bp, Artificial Sequence
  chemically synthesized
atcttgcctaaaaacaccctca

SEQ ID NO: 129252 - DNA, 22 bp, Artificial Sequence
  chemically synthesized
gcctaaaaacaccctcacaaaa

SEQ ID NO: 129253 - DNA, 22 bp, Artificial Sequence
  chemically synthesized
cctaaaaacaccctcacaaaaa

SEQ ID NO: 129254 - DNA, 22 bp, Artificial Sequence
  chemically synthesized
aaaacaccctcacaaaaacatc

SEQ ID NO: 129255 - DNA, 22 bp, Artificial Sequence
  chemically synthesized
acaaaaacatctagaataatgt

SEQ ID NO: 129256 - DNA, 22 bp, Artificial Sequence
  chemically synthesized
gaataatgtttgacaaatattt

SEQ ID NO: 129257 - DNA, 22 bp, Artificial Sequence
  chemically synthesized
gacaaatatttgggcaccccat

SEQ ID NO: 129258 - DNA, 22 bp, Artificial Sequence
  chemically synthesized
acaaatatttgggcaccccatg

SEQ ID NO: 129259 - DNA, 22 bp, Artificial Sequence
  chemically synthesized
gggcaccccatggcccagtcaa

SEQ ID NO: 129260 - DNA, 22 bp, Artificial Sequence
  chemically synthesized
ggcaccccatggcccagtcaaa

SEQ ID NO: 129261 - DNA, 22 bp, Artificial Sequence
  chemically synthesized
gcatataaaattaaccatcaga

SEQ ID NO: 129262 - DNA, 22 bp, Artificial Sequence
  chemically synthesized
accatcagagcctgtagaggat

SEQ ID NO: 129263 - DNA, 22 bp, Artificial Sequence
  chemically synthesized
tagaggatgagttaaaggatgg

SEQ ID NO: 129264 - DNA, 22 bp, Artificial Sequence
  chemically synthesized
aaggatggaatcttcggagata

SEQ ID NO: 129265 - DNA, 22 bp, Artificial Sequence
  chemically synthesized
cggagataattgtggaatccag

SEQ ID NO: 129266 - DNA, 22 bp, Artificial Sequence
  chemically synthesized
ggagataattgtggaatccaga

SEQ ID NO: 129267 - DNA, 22 bp, Artificial Sequence
  chemically synthesized
tggaatccagaaggctgacaga

SEQ ID NO: 129268 - DNA, 22 bp, Artificial Sequence
  chemically synthesized
acagataatagaatcaaactac

SEQ ID NO: 129269 - DNA, 22 bp, Artificial Sequence
  chemically synthesized
cacagaaaaaaaaaaaaaagaa

SEQ ID NO: 129270 - DNA, 22 bp, Artificial Sequence
  chemically synthesized
gtattgtcagcacagacttact

SEQ ID NO: 129271 - DNA, 22 bp, Artificial Sequence
  chemically synthesized
tcagcacagacttactcaacaa

SEQ ID NO: 129272 - DNA, 22 bp, Artificial Sequence
  chemically synthesized
actcaacaaacagcaaaaatcc

SEQ ID NO: 129273 - DNA, 22 bp, Artificial Sequence
  chemically synthesized
ctcaacaaacagcaaaaatcct

SEQ ID NO: 129274 - DNA, 22 bp, Artificial Sequence
  chemically synthesized
aacaaacagcaaaaatcctagg

SEQ ID NO: 129275 - DNA, 22 bp, Artificial Sequence
  chemically synthesized
ggatagagaccttcctgaatcg

SEQ ID NO: 129276 - DNA, 22 bp, Artificial Sequence
  chemically synthesized
cctgaatcgttagcgatataag

SEQ ID NO: 129277 - DNA, 22 bp, Artificial Sequence
  chemically synthesized
ctgaatcgttagcgatataagc

SEQ ID NO: 129278 - DNA, 22 bp, Artificial Sequence
  chemically synthesized
aatcgttagcgatataagctta

SEQ ID NO: 129279 - DNA, 22 bp, Artificial Sequence
  chemically synthesized
gcgatataagcttattatactt

SEQ ID NO: 129280 - DNA, 22 bp, Artificial Sequence
  chemically synthesized
attatacttgaatgttgccttc

SEQ ID NO: 129281 - DNA, 22 bp, Artificial Sequence
  chemically synthesized
ttatacttgaatgttgccttcc

SEQ ID NO: 129282 - DNA, 22 bp, Artificial Sequence
  chemically synthesized
tacttgaatgttgccttcctat

SEQ ID NO: 129283 - DNA, 22 bp, Artificial Sequence
  chemically synthesized
gaatgttgccttcctatatgcc

SEQ ID NO: 129284 - DNA, 22 bp, Artificial Sequence
  chemically synthesized
aatgttgccttcctatatgcca

SEQ ID NO: 129285 - DNA, 22 bp, Artificial Sequence
  chemically synthesized
ccttcctatatgccatatgtaa

SEQ ID NO: 129286 - DNA, 22 bp, Artificial Sequence
  chemically synthesized
cctatatgccatatgtaatata

SEQ ID NO: 129287 - DNA, 22 bp, Artificial Sequence
  chemically synthesized
ctatatgccatatgtaatataa

SEQ ID NO: 129288 - DNA, 22 bp, Artificial Sequence
  chemically synthesized
tatgccatatgtaatataaggc

SEQ ID NO: 129289 - DNA, 22 bp, Artificial Sequence
  chemically synthesized
gatatagactgtgatgccagag

SEQ ID NO: 129290 - DNA, 22 bp, Artificial Sequence
  chemically synthesized
tgatgccagagctcagaccaag

SEQ ID NO: 129291 - DNA, 22 bp, Artificial Sequence
  chemically synthesized
agaccaagagccaaggaatagg

SEQ ID NO: 129292 - DNA, 22 bp, Artificial Sequence
  chemically synthesized
tcattttaaaaagttaggtaat

SEQ ID NO: 129293 - DNA, 22 bp, Artificial Sequence
  chemically synthesized
cattttaaaaagttaggtaatt

SEQ ID NO: 129294 - DNA, 22 bp, Artificial Sequence
  chemically synthesized
attttaaaaagttaggtaattt

SEQ ID NO: 129295 - DNA, 22 bp, Artificial Sequence
  chemically synthesized
taaaaagttaggtaatttctaa

SEQ ID NO: 129296 - DNA, 22 bp, Artificial Sequence
  chemically synthesized
aaaaagttaggtaatttctaat

SEQ ID NO: 129297 - DNA, 22 bp, Artificial Sequence
  chemically synthesized
aaaagttaggtaatttctaata

SEQ ID NO: 129298 - DNA, 22 bp, Artificial Sequence
  chemically synthesized
ggtaatttctaataatgtggct

SEQ ID NO: 129299 - DNA, 22 bp, Artificial Sequence
  chemically synthesized
ctaataatgtggctgcctgagt

SEQ ID NO: 129300 - DNA, 22 bp, Artificial Sequence
  chemically synthesized
taataatgtggctgcctgagta

SEQ ID NO: 129301 - DNA, 22 bp, Artificial Sequence
  chemically synthesized
ataatgtggctgcctgagtatt

SEQ ID NO: 129302 - DNA, 22 bp, Artificial Sequence
  chemically synthesized
cctgagtattttcagcacagat

SEQ ID NO: 129303 - DNA, 22 bp, Artificial Sequence
  chemically synthesized
agtattttcagcacagatattc

SEQ ID NO: 129304 - DNA, 22 bp, Artificial Sequence
  chemically synthesized
tcagcacagatattctaataaa

SEQ ID NO: 129305 - DNA, 22 bp, Artificial Sequence
  chemically synthesized
cagcacagatattctaataaat

SEQ ID NO: 129306 - DNA, 22 bp, Artificial Sequence
  chemically synthesized
agcacagatattctaataaata

SEQ ID NO: 129307 - DNA, 22 bp, Artificial Sequence
  chemically synthesized
taataaatattgtgttatgtga

SEQ ID NO: 129308 - DNA, 22 bp, Artificial Sequence
  chemically synthesized
ataaatattgtgttatgtgatt

SEQ ID NO: 129309 - DNA, 22 bp, Artificial Sequence
  chemically synthesized
tgttatgtgatttagaaagaga

SEQ ID NO: 129310 - DNA, 22 bp, Artificial Sequence
  chemically synthesized
tgtgatttagaaagagacaggc

SEQ ID NO: 129311 - DNA, 22 bp, Artificial Sequence
  chemically synthesized
agaaagagacaggcactcagcg

SEQ ID NO: 129312 - DNA, 22 bp, Artificial Sequence
  chemically synthesized
gaaagagacaggcactcagcgg

SEQ ID NO: 129313 - DNA, 22 bp, Artificial Sequence
  chemically synthesized
agcggatgacccttgtcaggaa

SEQ ID NO: 129314 - DNA, 22 bp, Artificial Sequence
  chemically synthesized
gtcaggaaacactgcatcaaag

SEQ ID NO: 129315 - DNA, 22 bp, Artificial Sequence
  chemically synthesized
tcaggaaacactgcatcaaaga

SEQ ID NO: 129316 - DNA, 22 bp, Artificial Sequence
  chemically synthesized
catcaaagaaggcttttattac

SEQ ID NO: 129317 - DNA, 22 bp, Artificial Sequence
  chemically synthesized
ttattacaggagatggaggtcc

SEQ ID NO: 129318 - DNA, 22 bp, Artificial Sequence
  chemically synthesized
tattacaggagatggaggtcct

SEQ ID NO: 129319 - DNA, 22 bp, Artificial Sequence
  chemically synthesized
attacaggagatggaggtcctt

SEQ ID NO: 129320 - DNA, 22 bp, Artificial Sequence
  chemically synthesized
ttacaggagatggaggtccttc

SEQ ID NO: 129321 - DNA, 22 bp, Artificial Sequence
  chemically synthesized
caggagatggaggtccttccca

SEQ ID NO: 129322 - DNA, 22 bp, Artificial Sequence
  chemically synthesized
cccaatctgagattatgctgct

SEQ ID NO: 129323 - DNA, 22 bp, Artificial Sequence
  chemically synthesized
ccaatctgagattatgctgctg

SEQ ID NO: 129324 - DNA, 22 bp, Artificial Sequence
  chemically synthesized
agattatgctgctgtgacatga

SEQ ID NO: 129325 - DNA, 22 bp, Artificial Sequence
  chemically synthesized
tgctgctgtgacatgatacttt

SEQ ID NO: 129326 - DNA, 22 bp, Artificial Sequence
  chemically synthesized
ctgtgacatgatactttacttc

SEQ ID NO: 129327 - DNA, 22 bp, Artificial Sequence
  chemically synthesized
tgacatgatactttacttcaca

SEQ ID NO: 129328 - DNA, 22 bp, Artificial Sequence
  chemically synthesized
tacttcacaggcaatacagcag

SEQ ID NO: 129329 - DNA, 22 bp, Artificial Sequence
  chemically synthesized
acttcacaggcaatacagcagg

SEQ ID NO: 129330 - DNA, 22 bp, Artificial Sequence
  chemically synthesized
cttcacaggcaatacagcagga

SEQ ID NO: 129331 - DNA, 22 bp, Artificial Sequence
  chemically synthesized
cacaggcaatacagcaggaaat

SEQ ID NO: 129332 - DNA, 22 bp, Artificial Sequence
  chemically synthesized
acaggcaatacagcaggaaata

SEQ ID NO: 129333 - DNA, 22 bp, Artificial Sequence
  chemically synthesized
agaaaatacatgaatgagagac

SEQ ID NO: 129334 - DNA, 22 bp, Artificial Sequence
  chemically synthesized
gaaaatacatgaatgagagaca

SEQ ID NO: 129335 - DNA, 22 bp, Artificial Sequence
  chemically synthesized
tttaaggaaatagaagatattt

SEQ ID NO: 129336 - DNA, 22 bp, Artificial Sequence
  chemically synthesized
aaggaaatagaagatattttgg

SEQ ID NO: 129337 - DNA, 22 bp, Artificial Sequence
  chemically synthesized
aggaaatagaagatattttggg

SEQ ID NO: 129338 - DNA, 22 bp, Artificial Sequence
  chemically synthesized
tgggtgccctgcctacttcctc

SEQ ID NO: 129339 - DNA, 22 bp, Artificial Sequence
  chemically synthesized
gggtgccctgcctacttcctcc

SEQ ID NO: 129340 - DNA, 22 bp, Artificial Sequence
  chemically synthesized
ggtgccctgcctacttcctccc

SEQ ID NO: 129341 - DNA, 22 bp, Artificial Sequence
  chemically synthesized
cctacttcctcccagtgcccct

SEQ ID NO: 129342 - DNA, 22 bp, Artificial Sequence
  chemically synthesized
cttcctcccagtgcccctaagc

SEQ ID NO: 129343 - DNA, 22 bp, Artificial Sequence
  chemically synthesized
cctcccagtgcccctaagcttg

SEQ ID NO: 129344 - DNA, 22 bp, Artificial Sequence
  chemically synthesized
ctcccagtgcccctaagcttgg

SEQ ID NO: 129345 - DNA, 22 bp, Artificial Sequence
  chemically synthesized
ccagtgcccctaagcttggtga

SEQ ID NO: 129346 - DNA, 22 bp, Artificial Sequence
  chemically synthesized
agcttggtgactttgagtgttg

SEQ ID NO: 129347 - DNA, 22 bp, Artificial Sequence
  chemically synthesized
ggtgactttgagtgttggctga

SEQ ID NO: 129348 - DNA, 22 bp, Artificial Sequence
  chemically synthesized
gtgactttgagtgttggctgat

SEQ ID NO: 129349 - DNA, 22 bp, Artificial Sequence
  chemically synthesized
tgagtgttggctgataatagtt

SEQ ID NO: 129350 - DNA, 22 bp, Artificial Sequence
  chemically synthesized
gagtgttggctgataatagttg

SEQ ID NO: 129351 - DNA, 22 bp, Artificial Sequence
  chemically synthesized
agtgttggctgataatagttgt

SEQ ID NO: 129352 - DNA, 22 bp, Artificial Sequence
  chemically synthesized
gctgataatagttgttcccatt

SEQ ID NO: 129353 - DNA, 22 bp, Artificial Sequence
  chemically synthesized
ataatagttgttcccattctct

SEQ ID NO: 129354 - DNA, 22 bp, Artificial Sequence
  chemically synthesized
ttcccattctctggaggcttat

SEQ ID NO: 129355 - DNA, 22 bp, Artificial Sequence
  chemically synthesized
ccattctctggaggcttatcct

SEQ ID NO: 129356 - DNA, 22 bp, Artificial Sequence
  chemically synthesized
tctggaggcttatcctccacca

SEQ ID NO: 129357 - DNA, 22 bp, Artificial Sequence
  chemically synthesized
tggaggcttatcctccaccaac

SEQ ID NO: 129358 - DNA, 22 bp, Artificial Sequence
  chemically synthesized
gaggcttatcctccaccaacag

SEQ ID NO: 129359 - DNA, 22 bp, Artificial Sequence
  chemically synthesized
atcctccaccaacagtgtcact

SEQ ID NO: 129360 - DNA, 22 bp, Artificial Sequence
  chemically synthesized
tcctccaccaacagtgtcactt

SEQ ID NO: 129361 - DNA, 22 bp, Artificial Sequence
  chemically synthesized
caccaacagtgtcacttcacat

SEQ ID NO: 129362 - DNA, 22 bp, Artificial Sequence
  chemically synthesized
cacatgagattttatcccaact

SEQ ID NO: 129363 - DNA, 22 bp, Artificial Sequence
  chemically synthesized
acatgagattttatcccaactc

SEQ ID NO: 129364 - DNA, 22 bp, Artificial Sequence
  chemically synthesized
tatcccaactctggggcagtct

SEQ ID NO: 129365 - DNA, 22 bp, Artificial Sequence
  chemically synthesized
atcccaactctggggcagtctg

SEQ ID NO: 129366 - DNA, 22 bp, Artificial Sequence
  chemically synthesized
tcccaactctggggcagtctgc

SEQ ID NO: 129367 - DNA, 22 bp, Artificial Sequence
  chemically synthesized
tggggcagtctgcaggaaatta

SEQ ID NO: 129368 - DNA, 22 bp, Artificial Sequence
  chemically synthesized
gggcagtctgcaggaaattact

SEQ ID NO: 129369 - DNA, 22 bp, Artificial Sequence
  chemically synthesized
caggaaattactttatatctgt

SEQ ID NO: 129370 - DNA, 22 bp, Artificial Sequence
  chemically synthesized
ctttatatctgttctaagataa

SEQ ID NO: 129371 - DNA, 22 bp, Artificial Sequence
  chemically synthesized
tatatctgttctaagataagtg

SEQ ID NO: 129372 - DNA, 22 bp, Artificial Sequence
  chemically synthesized
atatctgttctaagataagtga

SEQ ID NO: 129373 - DNA, 22 bp, Artificial Sequence
  chemically synthesized
tatctgttctaagataagtgat

SEQ ID NO: 129374 - DNA, 22 bp, Artificial Sequence
  chemically synthesized
ttctaagataagtgatgtttcc

SEQ ID NO: 129375 - DNA, 22 bp, Artificial Sequence
  chemically synthesized
taagataagtgatgtttccagg

SEQ ID NO: 129376 - DNA, 22 bp, Artificial Sequence
  chemically synthesized
agataagtgatgtttccaggaa

SEQ ID NO: 129377 - DNA, 22 bp, Artificial Sequence
  chemically synthesized
ccaggaatagagtcatatttat

SEQ ID NO: 129378 - DNA, 22 bp, Artificial Sequence
  chemically synthesized
caggaatagagtcatatttatg

SEQ ID NO: 129379 - DNA, 22 bp, Artificial Sequence
  chemically synthesized
atggggcagaagattcgtgtac

SEQ ID NO: 129380 - DNA, 22 bp, Artificial Sequence
  chemically synthesized
tggggcagaagattcgtgtact

SEQ ID NO: 129381 - DNA, 22 bp, Artificial Sequence
  chemically synthesized
gtgtactgccagtgagagggtc

SEQ ID NO: 129382 - DNA, 22 bp, Artificial Sequence
  chemically synthesized
ccagtgagagggtcaatatacc

SEQ ID NO: 129383 - DNA, 22 bp, Artificial Sequence
  chemically synthesized
ctaatgaaatgggagggcagcc

SEQ ID NO: 129384 - DNA, 22 bp, Artificial Sequence
  chemically synthesized
atgaaatgggagggcagcctga

SEQ ID NO: 129385 - DNA, 22 bp, Artificial Sequence
  chemically synthesized
aaattaaatcagttatctcagg

SEQ ID NO: 129386 - DNA, 22 bp, Artificial Sequence
  chemically synthesized
aatcagttatctcagggtctta

SEQ ID NO: 129387 - DNA, 22 bp, Artificial Sequence
  chemically synthesized
tctcagggtcttactacctcac

SEQ ID NO: 129388 - DNA, 22 bp, Artificial Sequence
  chemically synthesized
agggtcttactacctcacctca

SEQ ID NO: 129389 - DNA, 22 bp, Artificial Sequence
  chemically synthesized
actacctcacctcattttaagt

SEQ ID NO: 129390 - DNA, 22 bp, Artificial Sequence
  chemically synthesized
ctacctcacctcattttaagtt

SEQ ID NO: 129391 - DNA, 22 bp, Artificial Sequence
  chemically synthesized
cctcacctcattttaagttcaa

SEQ ID NO: 129392 - DNA, 22 bp, Artificial Sequence
  chemically synthesized
acctcattttaagttcaaagca

SEQ ID NO: 129393 - DNA, 22 bp, Artificial Sequence
  chemically synthesized
attttaagttcaaagcatggct

SEQ ID NO: 129394 - DNA, 22 bp, Artificial Sequence
  chemically synthesized
taagttcaaagcatggctcccc

SEQ ID NO: 129395 - DNA, 22 bp, Artificial Sequence
  chemically synthesized
aagttcaaagcatggctcccct

SEQ ID NO: 129396 - DNA, 22 bp, Artificial Sequence
  chemically synthesized
agttcaaagcatggctccccta

SEQ ID NO: 129397 - DNA, 22 bp, Artificial Sequence
  chemically synthesized
aaagcatggctcccctaaatca

SEQ ID NO: 129398 - DNA, 22 bp, Artificial Sequence
  chemically synthesized
ccctaaatcaatccagacctaa

SEQ ID NO: 129399 - DNA, 22 bp, Artificial Sequence
  chemically synthesized
aatcaatccagacctaaatttt

SEQ ID NO: 129400 - DNA, 22 bp, Artificial Sequence
  chemically synthesized
aattttaacttagtacaaagag

SEQ ID NO: 129401 - DNA, 22 bp, Artificial Sequence
  chemically synthesized
taacttagtacaaagaggacac

SEQ ID NO: 129402 - DNA, 22 bp, Artificial Sequence
  chemically synthesized
aacttagtacaaagaggacaca

SEQ ID NO: 129403 - DNA, 22 bp, Artificial Sequence
  chemically synthesized
acttagtacaaagaggacacac

SEQ ID NO: 129404 - DNA, 22 bp, Artificial Sequence
  chemically synthesized
agtacaaagaggacacacaaat

SEQ ID NO: 129405 - DNA, 22 bp, Artificial Sequence
  chemically synthesized
gtacaaagaggacacacaaatt

SEQ ID NO: 129406 - DNA, 22 bp, Artificial Sequence
  chemically synthesized
tcagacttaagccatttccaga

SEQ ID NO: 129407 - DNA, 22 bp, Artificial Sequence
  chemically synthesized
cagacttaagccatttccagag

SEQ ID NO: 129408 - DNA, 22 bp, Artificial Sequence
  chemically synthesized
agacttaagccatttccagaga

SEQ ID NO: 129409 - DNA, 22 bp, Artificial Sequence
  chemically synthesized
aagccatttccagagactgact

SEQ ID NO: 129410 - DNA, 22 bp, Artificial Sequence
  chemically synthesized
agccatttccagagactgactt

SEQ ID NO: 129411 - DNA, 22 bp, Artificial Sequence
  chemically synthesized
ccagagactgacttttaatcat

SEQ ID NO: 129412 - DNA, 22 bp, Artificial Sequence
  chemically synthesized
cagagactgacttttaatcatg

SEQ ID NO: 129413 - DNA, 22 bp, Artificial Sequence
  chemically synthesized
acttttaatcatgatttcctac

SEQ ID NO: 129414 - DNA, 22 bp, Artificial Sequence
  chemically synthesized
ttaatcatgatttcctactact

SEQ ID NO: 129415 - DNA, 22 bp, Artificial Sequence
  chemically synthesized
taatcatgatttcctactacta

SEQ ID NO: 129416 - DNA, 22 bp, Artificial Sequence
  chemically synthesized
aatcatgatttcctactactat

SEQ ID NO: 129417 - DNA, 22 bp, Artificial Sequence
  chemically synthesized
atcatgatttcctactactatt

SEQ ID NO: 129418 - DNA, 22 bp, Artificial Sequence
  chemically synthesized
cctactactattctgcttacat

SEQ ID NO: 129419 - DNA, 22 bp, Artificial Sequence
  chemically synthesized
ctactactattctgcttacatt

SEQ ID NO: 129420 - DNA, 22 bp, Artificial Sequence
  chemically synthesized
ctactattctgcttacatttag

SEQ ID NO: 129421 - DNA, 22 bp, Artificial Sequence
  chemically synthesized
ctattctgcttacatttaggaa

SEQ ID NO: 129422 - DNA, 22 bp, Artificial Sequence
  chemically synthesized
ttctgcttacatttaggaagac

SEQ ID NO: 129423 - DNA, 22 bp, Artificial Sequence
  chemically synthesized
tgcttacatttaggaagaccta

SEQ ID NO: 129424 - DNA, 22 bp, Artificial Sequence
  chemically synthesized
cttacatttaggaagacctatg

SEQ ID NO: 129425 - DNA, 22 bp, Artificial Sequence
  chemically synthesized
acatttaggaagacctatgagc

SEQ ID NO: 129426 - DNA, 22 bp, Artificial Sequence
  chemically synthesized
catttaggaagacctatgagca

SEQ ID NO: 129427 - DNA, 22 bp, Artificial Sequence
  chemically synthesized
aggaagacctatgagcagaatg

SEQ ID NO: 129428 - DNA, 22 bp, Artificial Sequence
  chemically synthesized
ggaagacctatgagcagaatgc

SEQ ID NO: 129429 - DNA, 22 bp, Artificial Sequence
  chemically synthesized
tgagcagaatgcagttcaggag

SEQ ID NO: 129430 - DNA, 22 bp, Artificial Sequence
  chemically synthesized
aggaggaacttaactgatgtga

SEQ ID NO: 129431 - DNA, 22 bp, Artificial Sequence
  chemically synthesized
aactgatgtgaaatgtcaggca

SEQ ID NO: 129432 - DNA, 22 bp, Artificial Sequence
  chemically synthesized
actgatgtgaaatgtcaggcac

SEQ ID NO: 129433 - DNA, 22 bp, Artificial Sequence
  chemically synthesized
atgtgaaatgtcaggcaccaaa

SEQ ID NO: 129434 - DNA, 22 bp, Artificial Sequence
  chemically synthesized
atggttcaccacattgcaccca

SEQ ID NO: 129435 - DNA, 22 bp, Artificial Sequence
  chemically synthesized
accacattgcacccatactcat

SEQ ID NO: 129436 - DNA, 22 bp, Artificial Sequence
  chemically synthesized
cacccatactcattttaaaatc

SEQ ID NO: 129437 - DNA, 22 bp, Artificial Sequence
  chemically synthesized
attttaaaatctcatagttggg

SEQ ID NO: 129438 - DNA, 22 bp, Artificial Sequence
  chemically synthesized
taaaatctcatagttgggctaa

SEQ ID NO: 129439 - DNA, 22 bp, Artificial Sequence
  chemically synthesized
aaaatctcatagttgggctaag

SEQ ID NO: 129440 - DNA, 22 bp, Artificial Sequence
  chemically synthesized
aaatctcatagttgggctaagt

SEQ ID NO: 129441 - DNA, 22 bp, Artificial Sequence
  chemically synthesized
atagttgggctaagttccagga

SEQ ID NO: 129442 - DNA, 22 bp, Artificial Sequence
  chemically synthesized
ggctaagttccaggataaattt

SEQ ID NO: 129443 - DNA, 22 bp, Artificial Sequence
  chemically synthesized
agttccaggataaatttaggat

SEQ ID NO: 129444 - DNA, 22 bp, Artificial Sequence
  chemically synthesized
caggataaatttaggatttaag

SEQ ID NO: 129445 - DNA, 22 bp, Artificial Sequence
  chemically synthesized
aggatttaagactgatgagaca

SEQ ID NO: 129446 - DNA, 22 bp, Artificial Sequence
  chemically synthesized
ggatttaagactgatgagacaa

SEQ ID NO: 129447 - DNA, 22 bp, Artificial Sequence
  chemically synthesized
aagactgatgagacaatagaaa

SEQ ID NO: 129448 - DNA, 22 bp, Artificial Sequence
  chemically synthesized
agactgatgagacaatagaaat

SEQ ID NO: 129449 - DNA, 22 bp, Artificial Sequence
  chemically synthesized
atgagacaatagaaattctcag

SEQ ID NO: 129450 - DNA, 22 bp, Artificial Sequence
  chemically synthesized
tcagatccttatttctctgaca

SEQ ID NO: 129451 - DNA, 22 bp, Artificial Sequence
  chemically synthesized
agatccttatttctctgacaga

SEQ ID NO: 129452 - DNA, 22 bp, Artificial Sequence
  chemically synthesized
atttctctgacagactatgaga

SEQ ID NO: 129453 - DNA, 22 bp, Artificial Sequence
  chemically synthesized
tttctctgacagactatgagat

SEQ ID NO: 129454 - DNA, 22 bp, Artificial Sequence
  chemically synthesized
ctctgacagactatgagatgat

SEQ ID NO: 129455 - DNA, 22 bp, Artificial Sequence
  chemically synthesized
tctgacagactatgagatgatt

SEQ ID NO: 129456 - DNA, 22 bp, Artificial Sequence
  chemically synthesized
tgacagactatgagatgattgt

SEQ ID NO: 129457 - DNA, 22 bp, Artificial Sequence
  chemically synthesized
acagactatgagatgattgtat

SEQ ID NO: 129458 - DNA, 22 bp, Artificial Sequence
  chemically synthesized
tgagatgattgtattcaagtac

SEQ ID NO: 129459 - DNA, 22 bp, Artificial Sequence
  chemically synthesized
tattcaagtacaaattgtcaga

SEQ ID NO: 129460 - DNA, 22 bp, Artificial Sequence
  chemically synthesized
aagtacaaattgtcagacaaag

SEQ ID NO: 129461 - DNA, 22 bp, Artificial Sequence
  chemically synthesized
tcagacaaagccagggattaaa

SEQ ID NO: 129462 - DNA, 22 bp, Artificial Sequence
  chemically synthesized
aagaatacctccaccatgtccc

SEQ ID NO: 129463 - DNA, 22 bp, Artificial Sequence
  chemically synthesized
caccatgtcccctttttaacat

SEQ ID NO: 129464 - DNA, 22 bp, Artificial Sequence
  chemically synthesized
tttaacattactacaggacact

SEQ ID NO: 129465 - DNA, 22 bp, Artificial Sequence
  chemically synthesized
ttaacattactacaggacactt

SEQ ID NO: 129466 - DNA, 22 bp, Artificial Sequence
  chemically synthesized
taacattactacaggacactta

SEQ ID NO: 129467 - DNA, 22 bp, Artificial Sequence
  chemically synthesized
aacattactacaggacacttaa

SEQ ID NO: 129468 - DNA, 22 bp, Artificial Sequence
  chemically synthesized
acattactacaggacacttaaa

SEQ ID NO: 129469 - DNA, 22 bp, Artificial Sequence
  chemically synthesized
ctacaggacacttaaataaaat

SEQ ID NO: 129470 - DNA, 22 bp, Artificial Sequence
  chemically synthesized
caggacacttaaataaaatttt

SEQ ID NO: 129471 - DNA, 22 bp, Artificial Sequence
  chemically synthesized
aaataaaattttttaaacttga

SEQ ID NO: 129472 - DNA, 22 bp, Artificial Sequence
  chemically synthesized
aataaaattttttaaacttgat

SEQ ID NO: 129473 - DNA, 22 bp, Artificial Sequence
  chemically synthesized
tttaaacttgatttatattgct

SEQ ID NO: 129474 - DNA, 22 bp, Artificial Sequence
  chemically synthesized
ttaaacttgatttatattgctc

SEQ ID NO: 129475 - DNA, 22 bp, Artificial Sequence
  chemically synthesized
taaacttgatttatattgctcc

SEQ ID NO: 129476 - DNA, 22 bp, Artificial Sequence
  chemically synthesized
aaacttgatttatattgctcca

SEQ ID NO: 129477 - DNA, 22 bp, Artificial Sequence
  chemically synthesized
aacttgatttatattgctccag

SEQ ID NO: 129478 - DNA, 22 bp, Artificial Sequence
  chemically synthesized
gatttatattgctccagaagca

SEQ ID NO: 129479 - DNA, 22 bp, Artificial Sequence
  chemically synthesized
atttatattgctccagaagcag

SEQ ID NO: 129480 - DNA, 22 bp, Artificial Sequence
  chemically synthesized
atattgctccagaagcagtaac

SEQ ID NO: 129481 - DNA, 22 bp, Artificial Sequence
  chemically synthesized
tattgctccagaagcagtaact

SEQ ID NO: 129482 - DNA, 22 bp, Artificial Sequence
  chemically synthesized
ctccagaagcagtaactctgat

SEQ ID NO: 129483 - DNA, 22 bp, Artificial Sequence
  chemically synthesized
cagaagcagtaactctgattct

SEQ ID NO: 129484 - DNA, 22 bp, Artificial Sequence
  chemically synthesized
tgattcttgggcaagacttacc

SEQ ID NO: 129485 - DNA, 22 bp, Artificial Sequence
  chemically synthesized
attcttgggcaagacttaccaa

SEQ ID NO: 129486 - DNA, 22 bp, Artificial Sequence
  chemically synthesized
ttgggcaagacttaccaagaga

SEQ ID NO: 129487 - DNA, 22 bp, Artificial Sequence
  chemically synthesized
gggcaagacttaccaagagaca

SEQ ID NO: 129488 - DNA, 22 bp, Artificial Sequence
  chemically synthesized
ggcaagacttaccaagagacag

SEQ ID NO: 129489 - DNA, 22 bp, Artificial Sequence
  chemically synthesized
accaagagacagaaaacaagct

SEQ ID NO: 129490 - DNA, 22 bp, Artificial Sequence
  chemically synthesized
ccaagagacagaaaacaagctt

SEQ ID NO: 129491 - DNA, 22 bp, Artificial Sequence
  chemically synthesized
actgtttgaaagaacttatcag

SEQ ID NO: 129492 - DNA, 22 bp, Artificial Sequence
  chemically synthesized
ctgtttgaaagaacttatcagc

SEQ ID NO: 129493 - DNA, 22 bp, Artificial Sequence
  chemically synthesized
tttgaaagaacttatcagcagc

SEQ ID NO: 129494 - DNA, 22 bp, Artificial Sequence
  chemically synthesized
gaaagaacttatcagcagcact

SEQ ID NO: 129495 - DNA, 22 bp, Artificial Sequence
  chemically synthesized
aaagaacttatcagcagcactc

SEQ ID NO: 129496 - DNA, 22 bp, Artificial Sequence
  chemically synthesized
atcagcagcactcatttgtgag

SEQ ID NO: 129497 - DNA, 22 bp, Artificial Sequence
  chemically synthesized
tcagcagcactcatttgtgagt

SEQ ID NO: 129498 - DNA, 22 bp, Artificial Sequence
  chemically synthesized
atttgtgagtatatataacaaa

SEQ ID NO: 129499 - DNA, 22 bp, Artificial Sequence
  chemically synthesized
gtgagtatatataacaaacaat

SEQ ID NO: 129500 - DNA, 22 bp, Artificial Sequence
  chemically synthesized
tgagtatatataacaaacaatc

SEQ ID NO: 129501 - DNA, 22 bp, Artificial Sequence
  chemically synthesized
atttgaaaccaagaaaagatta

SEQ ID NO: 129502 - DNA, 22 bp, Artificial Sequence
  chemically synthesized
tttgaaaccaagaaaagattaa

SEQ ID NO: 129503 - DNA, 22 bp, Artificial Sequence
  chemically synthesized
gaaaccaagaaaagattaagtg

SEQ ID NO: 129504 - DNA, 22 bp, Artificial Sequence
  chemically synthesized
aaaccaagaaaagattaagtgt

SEQ ID NO: 129505 - DNA, 22 bp, Artificial Sequence
  chemically synthesized
agtgtgagggattattaagctt

SEQ ID NO: 129506 - DNA, 22 bp, Artificial Sequence
  chemically synthesized
ttaagctttgtctaagttgagt

SEQ ID NO: 129507 - DNA, 22 bp, Artificial Sequence
  chemically synthesized
agctttgtctaagttgagtgag

SEQ ID NO: 129508 - DNA, 22 bp, Artificial Sequence
  chemically synthesized
tgtctaagttgagtgagcttat

SEQ ID NO: 129509 - DNA, 22 bp, Artificial Sequence
  chemically synthesized
gtctaagttgagtgagcttatt

SEQ ID NO: 129510 - DNA, 22 bp, Artificial Sequence
  chemically synthesized
tctaagttgagtgagcttattg

SEQ ID NO: 129511 - DNA, 22 bp, Artificial Sequence
  chemically synthesized
agttgagtgagcttattggcta

SEQ ID NO: 129512 - DNA, 22 bp, Artificial Sequence
  chemically synthesized
agtgagcttattggctacaggg

SEQ ID NO: 129513 - DNA, 22 bp, Artificial Sequence
  chemically synthesized
attggctacagggttaaggaat

SEQ ID NO: 129514 - DNA, 22 bp, Artificial Sequence
  chemically synthesized
ttggctacagggttaaggaata

SEQ ID NO: 129515 - DNA, 22 bp, Artificial Sequence
  chemically synthesized
gctacagggttaaggaataaca

SEQ ID NO: 129516 - DNA, 22 bp, Artificial Sequence
  chemically synthesized
cagggttaaggaataacaaaag

SEQ ID NO: 129517 - DNA, 22 bp, Artificial Sequence
  chemically synthesized
aggaataacaaaagtaggcttc

SEQ ID NO: 129518 - DNA, 22 bp, Artificial Sequence
  chemically synthesized
cacggtatcttctttttgaggt

SEQ ID NO: 129519 - DNA, 22 bp, Artificial Sequence
  chemically synthesized
acggtatcttctttttgaggtg

SEQ ID NO: 129520 - DNA, 22 bp, Artificial Sequence
  chemically synthesized
ctttttgaggtggggaatcata

SEQ ID NO: 129521 - DNA, 22 bp, Artificial Sequence
  chemically synthesized
tttttgaggtggggaatcatac

SEQ ID NO: 129522 - DNA, 22 bp, Artificial Sequence
  chemically synthesized
tttgaggtggggaatcatacaa

SEQ ID NO: 129523 - DNA, 22 bp, Artificial Sequence
  chemically synthesized
ttgaggtggggaatcatacaag

SEQ ID NO: 129524 - DNA, 22 bp, Artificial Sequence
  chemically synthesized
tgaggtggggaatcatacaagg

SEQ ID NO: 129525 - DNA, 22 bp, Artificial Sequence
  chemically synthesized
gaggtggggaatcatacaaggc

SEQ ID NO: 129526 - DNA, 22 bp, Artificial Sequence
  chemically synthesized
aggtggggaatcatacaaggca

SEQ ID NO: 129527 - DNA, 22 bp, Artificial Sequence
  chemically synthesized
gatagcatgacttccatgtgct

SEQ ID NO: 129528 - DNA, 22 bp, Artificial Sequence
  chemically synthesized
ccatgtgctggatgaagctaca

SEQ ID NO: 129529 - DNA, 22 bp, Artificial Sequence
  chemically synthesized
catgtgctggatgaagctacaa

SEQ ID NO: 129530 - DNA, 22 bp, Artificial Sequence
  chemically synthesized
gatgaagctacaattctgtttt

SEQ ID NO: 129531 - DNA, 22 bp, Artificial Sequence
  chemically synthesized
caattctgttttctttttgcaa

SEQ ID NO: 129532 - DNA, 22 bp, Artificial Sequence
  chemically synthesized
tgttttctttttgcaaagaaaa

SEQ ID NO: 129533 - DNA, 22 bp, Artificial Sequence
  chemically synthesized
ttttctttttgcaaagaaaata

SEQ ID NO: 129534 - DNA, 22 bp, Artificial Sequence
  chemically synthesized
tctttttgcaaagaaaatatgg

SEQ ID NO: 129535 - DNA, 22 bp, Artificial Sequence
  chemically synthesized
ctttttgcaaagaaaatatggg

SEQ ID NO: 129536 - DNA, 22 bp, Artificial Sequence
  chemically synthesized
tttttgcaaagaaaatatgggg

SEQ ID NO: 129537 - DNA, 22 bp, Artificial Sequence
  chemically synthesized
tttgcaaagaaaatatggggct

SEQ ID NO: 129538 - DNA, 22 bp, Artificial Sequence
  chemically synthesized
ttgcaaagaaaatatggggctt

SEQ ID NO: 129539 - DNA, 22 bp, Artificial Sequence
  chemically synthesized
tgcaaagaaaatatggggcttt

SEQ ID NO: 129540 - DNA, 22 bp, Artificial Sequence
  chemically synthesized
gcaaagaaaatatggggcttta

SEQ ID NO: 129541 - DNA, 22 bp, Artificial Sequence
  chemically synthesized
caaagaaaatatggggctttaa

SEQ ID NO: 129542 - DNA, 22 bp, Artificial Sequence
  chemically synthesized
taagaacacagttctggagccc

SEQ ID NO: 129543 - DNA, 22 bp, Artificial Sequence
  chemically synthesized
aagaacacagttctggagccca

SEQ ID NO: 129544 - DNA, 22 bp, Artificial Sequence
  chemically synthesized
agaacacagttctggagcccac

SEQ ID NO: 129545 - DNA, 22 bp, Artificial Sequence
  chemically synthesized
tggagcccacttccttctccaa

SEQ ID NO: 129546 - DNA, 22 bp, Artificial Sequence
  chemically synthesized
gagcccacttccttctccaaag

SEQ ID NO: 129547 - DNA, 22 bp, Artificial Sequence
  chemically synthesized
ccttctccaaaggaggcttgaa

SEQ ID NO: 129548 - DNA, 22 bp, Artificial Sequence
  chemically synthesized
cttctccaaaggaggcttgaaa

SEQ ID NO: 129549 - DNA, 22 bp, Artificial Sequence
  chemically synthesized
ctccaaaggaggcttgaaaaaa

SEQ ID NO: 129550 - DNA, 22 bp, Artificial Sequence
  chemically synthesized
tccaaaggaggcttgaaaaaaa

SEQ ID NO: 129551 - DNA, 22 bp, Artificial Sequence
  chemically synthesized
caaaggaggcttgaaaaaaaat

SEQ ID NO: 129552 - DNA, 22 bp, Artificial Sequence
  chemically synthesized
gaaaaaaaatatcccagtagcc

SEQ ID NO: 129553 - DNA, 22 bp, Artificial Sequence
  chemically synthesized
aaaaaaaatatcccagtagcct

SEQ ID NO: 129554 - DNA, 22 bp, Artificial Sequence
  chemically synthesized
attatccagcatcaagacagat

SEQ ID NO: 129555 - DNA, 22 bp, Artificial Sequence
  chemically synthesized
tccagcatcaagacagatactg

SEQ ID NO: 129556 - DNA, 22 bp, Artificial Sequence
  chemically synthesized
gggaacaattttgaatacaaat

SEQ ID NO: 129557 - DNA, 22 bp, Artificial Sequence
  chemically synthesized
tgaatacaaataacctcacaaa

SEQ ID NO: 129558 - DNA, 22 bp, Artificial Sequence
  chemically synthesized
gaatacaaataacctcacaaat

SEQ ID NO: 129559 - DNA, 22 bp, Artificial Sequence
  chemically synthesized
aatacaaataacctcacaaatt

SEQ ID NO: 129560 - DNA, 22 bp, Artificial Sequence
  chemically synthesized
acaaattaaccctgttagcagt

SEQ ID NO: 129561 - DNA, 22 bp, Artificial Sequence
  chemically synthesized
accctgttagcagtcttcagag

SEQ ID NO: 129562 - DNA, 22 bp, Artificial Sequence
  chemically synthesized
ttagcagtcttcagagatacca

SEQ ID NO: 129563 - DNA, 22 bp, Artificial Sequence
  chemically synthesized
gcagtcttcagagataccattt

SEQ ID NO: 129564 - DNA, 22 bp, Artificial Sequence
  chemically synthesized
cagagataccatttaaaccaat

SEQ ID NO: 129565 - DNA, 22 bp, Artificial Sequence
  chemically synthesized
agagataccatttaaaccaatt

SEQ ID NO: 129566 - DNA, 22 bp, Artificial Sequence
  chemically synthesized
aaaccaatttctacaccaggac

SEQ ID NO: 129567 - DNA, 22 bp, Artificial Sequence
  chemically synthesized
aaccaatttctacaccaggact

SEQ ID NO: 129568 - DNA, 22 bp, Artificial Sequence
  chemically synthesized
ctacaccaggactcagcaatta

SEQ ID NO: 129569 - DNA, 22 bp, Artificial Sequence
  chemically synthesized
tacaccaggactcagcaattac

SEQ ID NO: 129570 - DNA, 22 bp, Artificial Sequence
  chemically synthesized
caccaggactcagcaattacct

SEQ ID NO: 129571 - DNA, 22 bp, Artificial Sequence
  chemically synthesized
agcaattacctctccccttaat

SEQ ID NO: 129572 - DNA, 22 bp, Artificial Sequence
  chemically synthesized
cctctccccttaatttctgata

SEQ ID NO: 129573 - DNA, 22 bp, Artificial Sequence
  chemically synthesized
tccccttaatttctgatacccc

SEQ ID NO: 129574 - DNA, 22 bp, Artificial Sequence
  chemically synthesized
cccttaatttctgataccccag

SEQ ID NO: 129575 - DNA, 22 bp, Artificial Sequence
  chemically synthesized
aatttctgataccccaggtcag

SEQ ID NO: 129576 - DNA, 22 bp, Artificial Sequence
  chemically synthesized
atttctgataccccaggtcagg

SEQ ID NO: 129577 - DNA, 22 bp, Artificial Sequence
  chemically synthesized
ctgataccccaggtcaggctct

SEQ ID NO: 129578 - DNA, 22 bp, Artificial Sequence
  chemically synthesized
tgataccccaggtcaggctcta

SEQ ID NO: 129579 - DNA, 22 bp, Artificial Sequence
  chemically synthesized
ataccccaggtcaggctctagt

SEQ ID NO: 129580 - DNA, 22 bp, Artificial Sequence
  chemically synthesized
tagtgactatgggagaatggaa

SEQ ID NO: 129581 - DNA, 22 bp, Artificial Sequence
  chemically synthesized
gtgactatgggagaatggaatg

SEQ ID NO: 129582 - DNA, 22 bp, Artificial Sequence
  chemically synthesized
tgggagaatggaatgaaggtaa

SEQ ID NO: 129583 - DNA, 22 bp, Artificial Sequence
  chemically synthesized
agaggaaaataaagactaatct

SEQ ID NO: 129584 - DNA, 22 bp, Artificial Sequence
  chemically synthesized
atcttcttggattctcttccac

SEQ ID NO: 129585 - DNA, 22 bp, Artificial Sequence
  chemically synthesized
cttggattctcttccaccacat

SEQ ID NO: 129586 - DNA, 22 bp, Artificial Sequence
  chemically synthesized
ttggattctcttccaccacata

SEQ ID NO: 129587 - DNA, 22 bp, Artificial Sequence
  chemically synthesized
ggattctcttccaccacatagt

SEQ ID NO: 129588 - DNA, 22 bp, Artificial Sequence
  chemically synthesized
gattctcttccaccacatagtt

SEQ ID NO: 129589 - DNA, 22 bp, Artificial Sequence
  chemically synthesized
tcttccaccacatagttgttgc

SEQ ID NO: 129590 - DNA, 22 bp, Artificial Sequence
  chemically synthesized
ttccaccacatagttgttgcaa

SEQ ID NO: 129591 - DNA, 22 bp, Artificial Sequence
  chemically synthesized
ccaccacatagttgttgcaaga

SEQ ID NO: 129592 - DNA, 22 bp, Artificial Sequence
  chemically synthesized
caccacatagttgttgcaagag

SEQ ID NO: 129593 - DNA, 22 bp, Artificial Sequence
  chemically synthesized
ttgcaagagggtaaatagagaa

SEQ ID NO: 129594 - DNA, 22 bp, Artificial Sequence
  chemically synthesized
caagagggtaaatagagaaaag

SEQ ID NO: 129595 - DNA, 22 bp, Artificial Sequence
  chemically synthesized
tatctacagattctgccgggtg

SEQ ID NO: 129596 - DNA, 22 bp, Artificial Sequence
  chemically synthesized
cagattctgccgggtgtatcaa

SEQ ID NO: 129597 - DNA, 22 bp, Artificial Sequence
  chemically synthesized
tgccgggtgtatcaacctccaa

SEQ ID NO: 129598 - DNA, 22 bp, Artificial Sequence
  chemically synthesized
ccgggtgtatcaacctccaaca

SEQ ID NO: 129599 - DNA, 22 bp, Artificial Sequence
  chemically synthesized
caacataaaagttcaacttcct

SEQ ID NO: 129600 - DNA, 22 bp, Artificial Sequence
  chemically synthesized
aacttcctagcaaatgttaact

SEQ ID NO: 129601 - DNA, 22 bp, Artificial Sequence
  chemically synthesized
cctagcaaatgttaactctgaa

SEQ ID NO: 129602 - DNA, 22 bp, Artificial Sequence
  chemically synthesized
ctagcaaatgttaactctgaaa

SEQ ID NO: 129603 - DNA, 22 bp, Artificial Sequence
  chemically synthesized
gcaaatgttaactctgaaataa

SEQ ID NO: 129604 - DNA, 22 bp, Artificial Sequence
  chemically synthesized
actctgaaataaaaacagtagt

SEQ ID NO: 129605 - DNA, 22 bp, Artificial Sequence
  chemically synthesized
tgaaataaaaacagtagtttta

SEQ ID NO: 129606 - DNA, 22 bp, Artificial Sequence
  chemically synthesized
aaataaaaacagtagttttatg

SEQ ID NO: 129607 - DNA, 22 bp, Artificial Sequence
  chemically synthesized
tatgtgatgggtgcttacatga

SEQ ID NO: 129608 - DNA, 22 bp, Artificial Sequence
  chemically synthesized
atgtgatgggtgcttacatgaa

SEQ ID NO: 129609 - DNA, 22 bp, Artificial Sequence
  chemically synthesized
tgtgatgggtgcttacatgaat

SEQ ID NO: 129610 - DNA, 22 bp, Artificial Sequence
  chemically synthesized
acatgaataattaagagttctg

SEQ ID NO: 129611 - DNA, 22 bp, Artificial Sequence
  chemically synthesized
catgaataattaagagttctga

SEQ ID NO: 129612 - DNA, 22 bp, Artificial Sequence
  chemically synthesized
agagttctgagttgatatctag

SEQ ID NO: 129613 - DNA, 22 bp, Artificial Sequence
  chemically synthesized
tgagttgatatctagaagttct

SEQ ID NO: 129614 - DNA, 22 bp, Artificial Sequence
  chemically synthesized
agttgatatctagaagttcttg

SEQ ID NO: 129615 - DNA, 22 bp, Artificial Sequence
  chemically synthesized
atatctagaagttcttgttagc

SEQ ID NO: 129616 - DNA, 22 bp, Artificial Sequence
  chemically synthesized
gaagttcttgttagctcagcgc

SEQ ID NO: 129617 - DNA, 22 bp, Artificial Sequence
  chemically synthesized
ttgttagctcagcgctattaag

SEQ ID NO: 129618 - DNA, 22 bp, Artificial Sequence
  chemically synthesized
gttagctcagcgctattaagaa

SEQ ID NO: 129619 - DNA, 22 bp, Artificial Sequence
  chemically synthesized
ttagctcagcgctattaagaac

SEQ ID NO: 129620 - DNA, 22 bp, Artificial Sequence
  chemically synthesized
gctcagcgctattaagaacact

SEQ ID NO: 129621 - DNA, 22 bp, Artificial Sequence
  chemically synthesized
agcgctattaagaacacttttc

SEQ ID NO: 129622 - DNA, 22 bp, Artificial Sequence
  chemically synthesized
ttaagaacacttttcctacaat

SEQ ID NO: 129623 - DNA, 22 bp, Artificial Sequence
  chemically synthesized
agaacacttttcctacaataga

SEQ ID NO: 129624 - DNA, 22 bp, Artificial Sequence
  chemically synthesized
ttcctacaatagaaattttctt

SEQ ID NO: 129625 - DNA, 22 bp, Artificial Sequence
  chemically synthesized
tcctacaatagaaattttcttt

SEQ ID NO: 129626 - DNA, 22 bp, Artificial Sequence
  chemically synthesized
cctacaatagaaattttctttg

SEQ ID NO: 129627 - DNA, 22 bp, Artificial Sequence
  chemically synthesized
ctacaatagaaattttctttgg

SEQ ID NO: 129628 - DNA, 22 bp, Artificial Sequence
  chemically synthesized
caatagaaattttctttggaag

SEQ ID NO: 129629 - DNA, 22 bp, Artificial Sequence
  chemically synthesized
tctttggaagaggcaggagagg

SEQ ID NO: 129630 - DNA, 22 bp, Artificial Sequence
  chemically synthesized
ctttggaagaggcaggagagga

SEQ ID NO: 129631 - DNA, 22 bp, Artificial Sequence
  chemically synthesized
tttggaagaggcaggagaggaa

SEQ ID NO: 129632 - DNA, 22 bp, Artificial Sequence
  chemically synthesized
tggaagaggcaggagaggaaag

SEQ ID NO: 129633 - DNA, 22 bp, Artificial Sequence
  chemically synthesized
ggaagaggcaggagaggaaaga

SEQ ID NO: 129634 - DNA, 22 bp, Artificial Sequence
  chemically synthesized
gaagaggcaggagaggaaagag

SEQ ID NO: 129635 - DNA, 22 bp, Artificial Sequence
  chemically synthesized
actctgggagtgaatgtgcagg

SEQ ID NO: 129636 - DNA, 22 bp, Artificial Sequence
  chemically synthesized
tgggagtgaatgtgcagggtgg

SEQ ID NO: 129637 - DNA, 22 bp, Artificial Sequence
  chemically synthesized
ggagtgaatgtgcagggtgggg

SEQ ID NO: 129638 - DNA, 22 bp, Artificial Sequence
  chemically synthesized
taggtctctatactacctctcc

SEQ ID NO: 129639 - DNA, 22 bp, Artificial Sequence
  chemically synthesized
tatactacctctcctcctcctc

SEQ ID NO: 129640 - DNA, 22 bp, Artificial Sequence
  chemically synthesized
tactacctctcctcctcctctt

SEQ ID NO: 129641 - DNA, 22 bp, Artificial Sequence
  chemically synthesized
cctctcctcctcctcttgatgc

SEQ ID NO: 129642 - DNA, 22 bp, Artificial Sequence
  chemically synthesized
tcctcctcctcttgatgcagtt

SEQ ID NO: 129643 - DNA, 22 bp, Artificial Sequence
  chemically synthesized
ctcctcctcttgatgcagttct

SEQ ID NO: 129644 - DNA, 22 bp, Artificial Sequence
  chemically synthesized
ctcctcttgatgcagttctcta

SEQ ID NO: 129645 - DNA, 22 bp, Artificial Sequence
  chemically synthesized
ctcttgatgcagttctctaggc

SEQ ID NO: 129646 - DNA, 22 bp, Artificial Sequence
  chemically synthesized
ttgatgcagttctctaggctca

SEQ ID NO: 129647 - DNA, 22 bp, Artificial Sequence
  chemically synthesized
gatgcagttctctaggctcagt

SEQ ID NO: 129648 - DNA, 22 bp, Artificial Sequence
  chemically synthesized
atgcagttctctaggctcagtt

SEQ ID NO: 129649 - DNA, 22 bp, Artificial Sequence
  chemically synthesized
tctaggctcagttttctctatc

SEQ ID NO: 129650 - DNA, 22 bp, Artificial Sequence
  chemically synthesized
taggctcagttttctctatctt

SEQ ID NO: 129651 - DNA, 22 bp, Artificial Sequence
  chemically synthesized
ggctcagttttctctatcttac

SEQ ID NO: 129652 - DNA, 22 bp, Artificial Sequence
  chemically synthesized
agttttctctatcttacatcca

SEQ ID NO: 129653 - DNA, 22 bp, Artificial Sequence
  chemically synthesized
tctctatcttacatccacctat

SEQ ID NO: 129654 - DNA, 22 bp, Artificial Sequence
  chemically synthesized
ctctatcttacatccacctatg

SEQ ID NO: 129655 - DNA, 22 bp, Artificial Sequence
  chemically synthesized
tctatcttacatccacctatgt

SEQ ID NO: 129656 - DNA, 22 bp, Artificial Sequence
  chemically synthesized
tatcttacatccacctatgttc

SEQ ID NO: 129657 - DNA, 22 bp, Artificial Sequence
  chemically synthesized
tcttacatccacctatgttccc

SEQ ID NO: 129658 - DNA, 22 bp, Artificial Sequence
  chemically synthesized
acatccacctatgttccctttc

SEQ ID NO: 129659 - DNA, 22 bp, Artificial Sequence
  chemically synthesized
catccacctatgttccctttct

SEQ ID NO: 129660 - DNA, 22 bp, Artificial Sequence
  chemically synthesized
tgttccctttctgccttcttcc

SEQ ID NO: 129661 - DNA, 22 bp, Artificial Sequence
  chemically synthesized
cctttctgccttcttcctcctc

SEQ ID NO: 129662 - DNA, 22 bp, Artificial Sequence
  chemically synthesized
tctgccttcttcctcctctact

SEQ ID NO: 129663 - DNA, 22 bp, Artificial Sequence
  chemically synthesized
ctgccttcttcctcctctactt

SEQ ID NO: 129664 - DNA, 22 bp, Artificial Sequence
  chemically synthesized
tgccttcttcctcctctacttt

SEQ ID NO: 129665 - DNA, 22 bp, Artificial Sequence
  chemically synthesized
ccttcttcctcctctactttgt

SEQ ID NO: 129666 - DNA, 22 bp, Artificial Sequence
  chemically synthesized
cttcctcctctactttgtagct

SEQ ID NO: 129667 - DNA, 22 bp, Artificial Sequence
  chemically synthesized
ttcctcctctactttgtagctc

SEQ ID NO: 129668 - DNA, 22 bp, Artificial Sequence
  chemically synthesized
cctcctctactttgtagctccc

SEQ ID NO: 129669 - DNA, 22 bp, Artificial Sequence
  chemically synthesized
ctcctctactttgtagctccca

SEQ ID NO: 129670 - DNA, 22 bp, Artificial Sequence
  chemically synthesized
ctctactttgtagctcccacat

SEQ ID NO: 129671 - DNA, 22 bp, Artificial Sequence
  chemically synthesized
tactttgtagctcccacatttt

SEQ ID NO: 129672 - DNA, 22 bp, Artificial Sequence
  chemically synthesized
ctttgtagctcccacattttca

SEQ ID NO: 129673 - DNA, 22 bp, Artificial Sequence
  chemically synthesized
tgtagctcccacattttcagct

SEQ ID NO: 129674 - DNA, 22 bp, Artificial Sequence
  chemically synthesized
gtagctcccacattttcagctt

SEQ ID NO: 129675 - DNA, 22 bp, Artificial Sequence
  chemically synthesized
tagctcccacattttcagctta

SEQ ID NO: 129676 - DNA, 22 bp, Artificial Sequence
  chemically synthesized
ccacattttcagcttatatatt

SEQ ID NO: 129677 - DNA, 22 bp, Artificial Sequence
  chemically synthesized
tcagcttatatattagccaatt

SEQ ID NO: 129678 - DNA, 22 bp, Artificial Sequence
  chemically synthesized
cagcttatatattagccaatta

SEQ ID NO: 129679 - DNA, 22 bp, Artificial Sequence
  chemically synthesized
agcttatatattagccaattag

SEQ ID NO: 129680 - DNA, 22 bp, Artificial Sequence
  chemically synthesized
atatattagccaattagtatat

SEQ ID NO: 129681 - DNA, 22 bp, Artificial Sequence
  chemically synthesized
tatattagccaattagtatatt

SEQ ID NO: 129682 - DNA, 22 bp, Artificial Sequence
  chemically synthesized
gccaattagtatattagtaata

SEQ ID NO: 129683 - DNA, 22 bp, Artificial Sequence
  chemically synthesized
gtatattagtaatattttgaag

SEQ ID NO: 129684 - DNA, 22 bp, Artificial Sequence
  chemically synthesized
gtaatattttgaagtcactgtt

SEQ ID NO: 129685 - DNA, 22 bp, Artificial Sequence
  chemically synthesized
tgaagtcactgttcttacctaa

SEQ ID NO: 129686 - DNA, 22 bp, Artificial Sequence
  chemically synthesized
gaagtcactgttcttacctaag

SEQ ID NO: 129687 - DNA, 22 bp, Artificial Sequence
  chemically synthesized
aagtcactgttcttacctaagt

SEQ ID NO: 129688 - DNA, 22 bp, Artificial Sequence
  chemically synthesized
ttcttacctaagtcagtttaac

SEQ ID NO: 129689 - DNA, 22 bp, Artificial Sequence
  chemically synthesized
ttacctaagtcagtttaacaat

SEQ ID NO: 129690 - DNA, 22 bp, Artificial Sequence
  chemically synthesized
acctaagtcagtttaacaatca

SEQ ID NO: 129691 - DNA, 22 bp, Artificial Sequence
  chemically synthesized
cctaagtcagtttaacaatcag

SEQ ID NO: 129692 - DNA, 22 bp, Artificial Sequence
  chemically synthesized
agtcagtttaacaatcagcata

SEQ ID NO: 129693 - DNA, 22 bp, Artificial Sequence
  chemically synthesized
aacaatcagcataccagtcagt

SEQ ID NO: 129694 - DNA, 22 bp, Artificial Sequence
  chemically synthesized
acaatcagcataccagtcagtt

SEQ ID NO: 129695 - DNA, 22 bp, Artificial Sequence
  chemically synthesized
gtgatcaatgtgttaatcataa

SEQ ID NO: 129696 - DNA, 22 bp, Artificial Sequence
  chemically synthesized
atcataaagtaattaaaatttt

SEQ ID NO: 129697 - DNA, 22 bp, Artificial Sequence
  chemically synthesized
aaattttataaataaccttaca

SEQ ID NO: 129698 - DNA, 22 bp, Artificial Sequence
  chemically synthesized
tataaataaccttacaatcaat

SEQ ID NO: 129699 - DNA, 22 bp, Artificial Sequence
  chemically synthesized
ataaataaccttacaatcaata

SEQ ID NO: 129700 - DNA, 22 bp, Artificial Sequence
  chemically synthesized
taaataaccttacaatcaatat

SEQ ID NO: 129701 - DNA, 22 bp, Artificial Sequence
  chemically synthesized
acaatcaatatgtcaaactctg

SEQ ID NO: 129702 - DNA, 22 bp, Artificial Sequence
  chemically synthesized
caatcaatatgtcaaactctgt

SEQ ID NO: 129703 - DNA, 22 bp, Artificial Sequence
  chemically synthesized
tgtcattgcttccagggccatt

SEQ ID NO: 129704 - DNA, 22 bp, Artificial Sequence
  chemically synthesized
tcattgcttccagggccattgg

SEQ ID NO: 129705 - DNA, 22 bp, Artificial Sequence
  chemically synthesized
cttccagggccattggtgtgtt

SEQ ID NO: 129706 - DNA, 22 bp, Artificial Sequence
  chemically synthesized
ccagggccattggtgtgttaat

SEQ ID NO: 129707 - DNA, 22 bp, Artificial Sequence
  chemically synthesized
cagggccattggtgtgttaata

SEQ ID NO: 129708 - DNA, 22 bp, Artificial Sequence
  chemically synthesized
gtgtgttaatacaacacttagt

SEQ ID NO: 129709 - DNA, 22 bp, Artificial Sequence
  chemically synthesized
atacaacacttagtaaagtaag

SEQ ID NO: 129710 - DNA, 22 bp, Artificial Sequence
  chemically synthesized
agtaaagtaagcaatgttagtg

SEQ ID NO: 129711 - DNA, 22 bp, Artificial Sequence
  chemically synthesized
gtaaagtaagcaatgttagtgt

SEQ ID NO: 129712 - DNA, 22 bp, Artificial Sequence
  chemically synthesized
gtgttggagtgggagtagaacc

SEQ ID NO: 129713 - DNA, 22 bp, Artificial Sequence
  chemically synthesized
gagtgggagtagaaccgtgttt

SEQ ID NO: 129714 - DNA, 22 bp, Artificial Sequence
  chemically synthesized
tttactacaatgagttagagcc

SEQ ID NO: 129715 - DNA, 22 bp, Artificial Sequence
  chemically synthesized
ttactacaatgagttagagcca

SEQ ID NO: 129716 - DNA, 22 bp, Artificial Sequence
  chemically synthesized
tactacaatgagttagagccac

SEQ ID NO: 129717 - DNA, 22 bp, Artificial Sequence
  chemically synthesized
actacaatgagttagagccact

SEQ ID NO: 129718 - DNA, 22 bp, Artificial Sequence
  chemically synthesized
ctacaatgagttagagccacta

SEQ ID NO: 129719 - DNA, 22 bp, Artificial Sequence
  chemically synthesized
caatgagttagagccactaggt

SEQ ID NO: 129720 - DNA, 22 bp, Artificial Sequence
  chemically synthesized
gagccactaggtctgagagact

SEQ ID NO: 129721 - DNA, 22 bp, Artificial Sequence
  chemically synthesized
ggtctgagagactagtaaaaga

SEQ ID NO: 129722 - DNA, 22 bp, Artificial Sequence
  chemically synthesized
agagactagtaaaagaatgtaa

SEQ ID NO: 129723 - DNA, 22 bp, Artificial Sequence
  chemically synthesized
gtaaaagaatgtaaacagtaaa

SEQ ID NO: 129724 - DNA, 22 bp, Artificial Sequence
  chemically synthesized
tgtgctaagttttatgctaaag

SEQ ID NO: 129725 - DNA, 22 bp, Artificial Sequence
  chemically synthesized
gtgctaagttttatgctaaagt

SEQ ID NO: 129726 - DNA, 22 bp, Artificial Sequence
  chemically synthesized
tgctaagttttatgctaaagtc

SEQ ID NO: 129727 - DNA, 22 bp, Artificial Sequence
  chemically synthesized
agttttatgctaaagtctgggt

SEQ ID NO: 129728 - DNA, 22 bp, Artificial Sequence
  chemically synthesized
tatgctaaagtctgggtgatgc

SEQ ID NO: 129729 - DNA, 22 bp, Artificial Sequence
  chemically synthesized
atgctaaagtctgggtgatgca

SEQ ID NO: 129730 - DNA, 22 bp, Artificial Sequence
  chemically synthesized
tgctaaagtctgggtgatgcaa

SEQ ID NO: 129731 - DNA, 22 bp, Artificial Sequence
  chemically synthesized
aagtctgggtgatgcaaaagag

SEQ ID NO: 129732 - DNA, 22 bp, Artificial Sequence
  chemically synthesized
ggtgatgcaaaagagacatctg

SEQ ID NO: 129733 - DNA, 22 bp, Artificial Sequence
  chemically synthesized
gggtttagttagagagggcaaa

SEQ ID NO: 129734 - DNA, 22 bp, Artificial Sequence
  chemically synthesized
agttagagagggcaaaataaga

SEQ ID NO: 129735 - DNA, 22 bp, Artificial Sequence
  chemically synthesized
gttagagagggcaaaataagag

SEQ ID NO: 129736 - DNA, 22 bp, Artificial Sequence
  chemically synthesized
gagagggcaaaataagagacaa

SEQ ID NO: 129737 - DNA, 22 bp, Artificial Sequence
  chemically synthesized
caccctatgtacctgagcagat

SEQ ID NO: 129738 - DNA, 22 bp, Artificial Sequence
  chemically synthesized
tgtacctgagcagatggtgcag

SEQ ID NO: 129739 - DNA, 22 bp, Artificial Sequence
  chemically synthesized
agcagatggtgcagaaatgatc

SEQ ID NO: 129740 - DNA, 22 bp, Artificial Sequence
  chemically synthesized
cccagccaagcccagcctaaat

SEQ ID NO: 129741 - DNA, 22 bp, Artificial Sequence
  chemically synthesized
aataagttgaaccatgcattag

SEQ ID NO: 129742 - DNA, 22 bp, Artificial Sequence
  chemically synthesized
aaccatgcattagagtgaaaaa

SEQ ID NO: 129743 - DNA, 22 bp, Artificial Sequence
  chemically synthesized
gagtgaaaaataaatgtttaat

SEQ ID NO: 129744 - DNA, 22 bp, Artificial Sequence
  chemically synthesized
aatgttgtcagccactgatgct

SEQ ID NO: 129745 - DNA, 22 bp, Artificial Sequence
  chemically synthesized
atgttgtcagccactgatgcta

SEQ ID NO: 129746 - DNA, 22 bp, Artificial Sequence
  chemically synthesized
tcagccactgatgctatacagg

SEQ ID NO: 129747 - DNA, 22 bp, Artificial Sequence
  chemically synthesized
atgctatacagggctttgtgat

SEQ ID NO: 129748 - DNA, 22 bp, Artificial Sequence
  chemically synthesized
tacagggctttgtgatgtgaca

SEQ ID NO: 129749 - DNA, 22 bp, Artificial Sequence
  chemically synthesized
tgtgatgtgacaattctgtgat

SEQ ID NO: 129750 - DNA, 22 bp, Artificial Sequence
  chemically synthesized
gtgatgtgacaattctgtgata

SEQ ID NO: 129751 - DNA, 22 bp, Artificial Sequence
  chemically synthesized
tgatgtgacaattctgtgataa

SEQ ID NO: 129752 - DNA, 22 bp, Artificial Sequence
  chemically synthesized
tgtgataatagataaatgatac

SEQ ID NO: 129753 - DNA, 22 bp, Artificial Sequence
  chemically synthesized
tgataatagataaatgatacaa

SEQ ID NO: 129754 - DNA, 22 bp, Artificial Sequence
  chemically synthesized
acataaaccctgtaaatattag

SEQ ID NO: 129755 - DNA, 22 bp, Artificial Sequence
  chemically synthesized
cataaaccctgtaaatattagt

SEQ ID NO: 129756 - DNA, 22 bp, Artificial Sequence
  chemically synthesized
taaatattagtttattatagaa

SEQ ID NO: 129757 - DNA, 22 bp, Artificial Sequence
  chemically synthesized
gtttattatagaactctataaa

SEQ ID NO: 129758 - DNA, 22 bp, Artificial Sequence
  chemically synthesized
attatagaactctataaactct

SEQ ID NO: 129759 - DNA, 22 bp, Artificial Sequence
  chemically synthesized
ttatagaactctataaactctt

SEQ ID NO: 129760 - DNA, 22 bp, Artificial Sequence
  chemically synthesized
tagaactctataaactcttaat

SEQ ID NO: 129761 - DNA, 22 bp, Artificial Sequence
  chemically synthesized
tataaactcttaataaaatatg

SEQ ID NO: 129762 - DNA, 22 bp, Artificial Sequence
  chemically synthesized
taaactcttaataaaatatgga

SEQ ID NO: 129763 - DNA, 22 bp, Artificial Sequence
  chemically synthesized
ttaataaaatatggataatagt

SEQ ID NO: 129764 - DNA, 22 bp, Artificial Sequence
  chemically synthesized
aataaaatatggataatagtaa

SEQ ID NO: 129765 - DNA, 22 bp, Artificial Sequence
  chemically synthesized
ataaaatatggataatagtaat

SEQ ID NO: 129766 - DNA, 22 bp, Artificial Sequence
  chemically synthesized
tgcattagttttctattgttat

SEQ ID NO: 129767 - DNA, 22 bp, Artificial Sequence
  chemically synthesized
gcattagttttctattgttata

SEQ ID NO: 129768 - DNA, 22 bp, Artificial Sequence
  chemically synthesized
cattagttttctattgttatac

SEQ ID NO: 129769 - DNA, 22 bp, Artificial Sequence
  chemically synthesized
gttttctattgttatacataaa

SEQ ID NO: 129770 - DNA, 22 bp, Artificial Sequence
  chemically synthesized
tctattgttatacataaattac

SEQ ID NO: 129771 - DNA, 22 bp, Artificial Sequence
  chemically synthesized
ctattgttatacataaattact

SEQ ID NO: 129772 - DNA, 22 bp, Artificial Sequence
  chemically synthesized
tattgttatacataaattactg

SEQ ID NO: 129773 - DNA, 22 bp, Artificial Sequence
  chemically synthesized
ttgttatacataaattactgca

SEQ ID NO: 129774 - DNA, 22 bp, Artificial Sequence
  chemically synthesized
ttatacataaattactgcaact

SEQ ID NO: 129775 - DNA, 22 bp, Artificial Sequence
  chemically synthesized
tacataaattactgcaacttga

SEQ ID NO: 129776 - DNA, 22 bp, Artificial Sequence
  chemically synthesized
ctgcaacttgagctgcttcaaa

SEQ ID NO: 129777 - DNA, 22 bp, Artificial Sequence
  chemically synthesized
caacttgagctgcttcaaacat

SEQ ID NO: 129778 - DNA, 22 bp, Artificial Sequence
  chemically synthesized
gagctgcttcaaacattattag

SEQ ID NO: 129779 - DNA, 22 bp, Artificial Sequence
  chemically synthesized
agctgcttcaaacattattagt

SEQ ID NO: 129780 - DNA, 22 bp, Artificial Sequence
  chemically synthesized
cttcaaacattattagtttatt

SEQ ID NO: 129781 - DNA, 22 bp, Artificial Sequence
  chemically synthesized
caaacattattagtttattata

SEQ ID NO: 129782 - DNA, 22 bp, Artificial Sequence
  chemically synthesized
aaacattattagtttattatat

SEQ ID NO: 129783 - DNA, 22 bp, Artificial Sequence
  chemically synthesized
ttagtttattatatcacatttc

SEQ ID NO: 129784 - DNA, 22 bp, Artificial Sequence
  chemically synthesized
gtttattatatcacatttctat

SEQ ID NO: 129785 - DNA, 22 bp, Artificial Sequence
  chemically synthesized
attatatcacatttctataggt

SEQ ID NO: 129786 - DNA, 22 bp, Artificial Sequence
  chemically synthesized
ttatatcacatttctataggtc

SEQ ID NO: 129787 - DNA, 22 bp, Artificial Sequence
  chemically synthesized
tatcacatttctataggtctgc

SEQ ID NO: 129788 - DNA, 22 bp, Artificial Sequence
  chemically synthesized
ctataggtctgcactctcatag

SEQ ID NO: 129789 - DNA, 22 bp, Artificial Sequence
  chemically synthesized
tataggtctgcactctcatagg

SEQ ID NO: 129790 - DNA, 22 bp, Artificial Sequence
  chemically synthesized
taggtctgcactctcataggct

SEQ ID NO: 129791 - DNA, 22 bp, Artificial Sequence
  chemically synthesized
cactctcataggcttaactgag

SEQ ID NO: 129792 - DNA, 22 bp, Artificial Sequence
  chemically synthesized
tcataggcttaactgagttctc

SEQ ID NO: 129793 - DNA, 22 bp, Artificial Sequence
  chemically synthesized
ataggcttaactgagttctctg

SEQ ID NO: 129794 - DNA, 22 bp, Artificial Sequence
  chemically synthesized
aactgagttctctgcttagggt

SEQ ID NO: 129795 - DNA, 22 bp, Artificial Sequence
  chemically synthesized
actgagttctctgcttagggta

SEQ ID NO: 129796 - DNA, 22 bp, Artificial Sequence
  chemically synthesized
agttctctgcttagggtatcat

SEQ ID NO: 129797 - DNA, 22 bp, Artificial Sequence
  chemically synthesized
tctgcttagggtatcataaggt

SEQ ID NO: 129798 - DNA, 22 bp, Artificial Sequence
  chemically synthesized
tgcttagggtatcataaggtca

SEQ ID NO: 129799 - DNA, 22 bp, Artificial Sequence
  chemically synthesized
cttagggtatcataaggtcaaa

SEQ ID NO: 129800 - DNA, 22 bp, Artificial Sequence
  chemically synthesized
agggtatcataaggtcaaattc

SEQ ID NO: 129801 - DNA, 22 bp, Artificial Sequence
  chemically synthesized
gggtatcataaggtcaaattca

SEQ ID NO: 129802 - DNA, 22 bp, Artificial Sequence
  chemically synthesized
aaaatatcgggagggctgggct

SEQ ID NO: 129803 - DNA, 22 bp, Artificial Sequence
  chemically synthesized
ggctcttatccaaaggctctgg

SEQ ID NO: 129804 - DNA, 22 bp, Artificial Sequence
  chemically synthesized
ttatccaaaggctctggggaag

SEQ ID NO: 129805 - DNA, 22 bp, Artificial Sequence
  chemically synthesized
atccaaaggctctggggaagaa

SEQ ID NO: 129806 - DNA, 22 bp, Artificial Sequence
  chemically synthesized
tccaaaggctctggggaagaat

SEQ ID NO: 129807 - DNA, 22 bp, Artificial Sequence
  chemically synthesized
tggggaagaattcgcttccacg

SEQ ID NO: 129808 - DNA, 22 bp, Artificial Sequence
  chemically synthesized
gggaagaattcgcttccacgtt

SEQ ID NO: 129809 - DNA, 22 bp, Artificial Sequence
  chemically synthesized
gcttccacgttcattcagattg

SEQ ID NO: 129810 - DNA, 22 bp, Artificial Sequence
  chemically synthesized
ccacgttcattcagattgtagt

SEQ ID NO: 129811 - DNA, 22 bp, Artificial Sequence
  chemically synthesized
cacgttcattcagattgtagtc

SEQ ID NO: 129812 - DNA, 22 bp, Artificial Sequence
  chemically synthesized
attcagattgtagtcagagctc

SEQ ID NO: 129813 - DNA, 22 bp, Artificial Sequence
  chemically synthesized
agattgtagtcagagctcagtt

SEQ ID NO: 129814 - DNA, 22 bp, Artificial Sequence
  chemically synthesized
tagtcagagctcagtttctttt

SEQ ID NO: 129815 - DNA, 22 bp, Artificial Sequence
  chemically synthesized
agtttctttttttttctttttt

SEQ ID NO: 129816 - DNA, 22 bp, Artificial Sequence
  chemically synthesized
ctttttttttcttttttttttt

SEQ ID NO: 129817 - DNA, 22 bp, Artificial Sequence
  chemically synthesized
tttttttttctttttttttttt

SEQ ID NO: 129818 - DNA, 22 bp, Artificial Sequence
  chemically synthesized
tttttttctttttttttttttt

SEQ ID NO: 129819 - DNA, 22 bp, Artificial Sequence
  chemically synthesized
ttttttcttttttttttttttt

SEQ ID NO: 129820 - DNA, 22 bp, Artificial Sequence
  chemically synthesized
tttttctttttttttttttttt

SEQ ID NO: 129821 - DNA, 22 bp, Artificial Sequence
  chemically synthesized
ttttcttttttttttttttttt

SEQ ID NO: 129822 - DNA, 22 bp, Artificial Sequence
  chemically synthesized
tttctttttttttttttttttt

SEQ ID NO: 129823 - DNA, 22 bp, Artificial Sequence
  chemically synthesized
ttcttttttttttttttttttt

SEQ ID NO: 129824 - DNA, 22 bp, Artificial Sequence
  chemically synthesized
tctttttttttttttttttttt

SEQ ID NO: 129825 - DNA, 22 bp, Artificial Sequence
  chemically synthesized
cttttttttttttttttttttg

SEQ ID NO: 129826 - DNA, 22 bp, Artificial Sequence
  chemically synthesized
ttttttttttttttttttttga

SEQ ID NO: 129827 - DNA, 22 bp, Artificial Sequence
  chemically synthesized
ttttttttttttttttttgaga

SEQ ID NO: 129828 - DNA, 22 bp, Artificial Sequence
  chemically synthesized
tttttttttttttttttgagat

SEQ ID NO: 129829 - DNA, 22 bp, Artificial Sequence
  chemically synthesized
ttttttttttttttttgagatg

SEQ ID NO: 129830 - DNA, 22 bp, Artificial Sequence
  chemically synthesized
tttttttttttttttgagatgg

SEQ ID NO: 129831 - DNA, 22 bp, Artificial Sequence
  chemically synthesized
ttttttttttttttgagatgga

SEQ ID NO: 129832 - DNA, 22 bp, Artificial Sequence
  chemically synthesized
tttttttttttttgagatggag

SEQ ID NO: 129833 - DNA, 22 bp, Artificial Sequence
  chemically synthesized
ttttttttttttgagatggagt

SEQ ID NO: 129834 - DNA, 22 bp, Artificial Sequence
  chemically synthesized
tttttttttttgagatggagtc

SEQ ID NO: 129835 - DNA, 22 bp, Artificial Sequence
  chemically synthesized
ttttttttttgagatggagtct

SEQ ID NO: 129836 - DNA, 22 bp, Artificial Sequence
  chemically synthesized
tttttttttgagatggagtctc

SEQ ID NO: 129837 - DNA, 22 bp, Artificial Sequence
  chemically synthesized
ttttttttgagatggagtctcg

SEQ ID NO: 129838 - DNA, 22 bp, Artificial Sequence
  chemically synthesized
tttttttgagatggagtctcgc

SEQ ID NO: 129839 - DNA, 22 bp, Artificial Sequence
  chemically synthesized
ttttttgagatggagtctcgct

SEQ ID NO: 129840 - DNA, 22 bp, Artificial Sequence
  chemically synthesized
tttttgagatggagtctcgctc

SEQ ID NO: 129841 - DNA, 22 bp, Artificial Sequence
  chemically synthesized
ttttgagatggagtctcgctct

SEQ ID NO: 129842 - DNA, 22 bp, Artificial Sequence
  chemically synthesized
tttgagatggagtctcgctctg

SEQ ID NO: 129843 - DNA, 22 bp, Artificial Sequence
  chemically synthesized
ttgagatggagtctcgctctgt

SEQ ID NO: 129844 - DNA, 22 bp, Artificial Sequence
  chemically synthesized
tgagatggagtctcgctctgtc

SEQ ID NO: 129845 - DNA, 22 bp, Artificial Sequence
  chemically synthesized
gagatggagtctcgctctgtca

SEQ ID NO: 129846 - DNA, 22 bp, Artificial Sequence
  chemically synthesized
agatggagtctcgctctgtcac

SEQ ID NO: 129847 - DNA, 22 bp, Artificial Sequence
  chemically synthesized
gctctgtcacccagcctggagt

SEQ ID NO: 129848 - DNA, 22 bp, Artificial Sequence
  chemically synthesized
tgtcacccagcctggagtgcag

SEQ ID NO: 129849 - DNA, 22 bp, Artificial Sequence
  chemically synthesized
tcacccagcctggagtgcagtg

SEQ ID NO: 129850 - DNA, 22 bp, Artificial Sequence
  chemically synthesized
gagtgcagtggcacaatctctt

SEQ ID NO: 129851 - DNA, 22 bp, Artificial Sequence
  chemically synthesized
ttgctccctgcaacctgtgcct

SEQ ID NO: 129852 - DNA, 22 bp, Artificial Sequence
  chemically synthesized
gctccctgcaacctgtgcctcc

SEQ ID NO: 129853 - DNA, 22 bp, Artificial Sequence
  chemically synthesized
ctccctgcaacctgtgcctccc

SEQ ID NO: 129854 - DNA, 22 bp, Artificial Sequence
  chemically synthesized
cctgcaacctgtgcctcccggg

SEQ ID NO: 129855 - DNA, 22 bp, Artificial Sequence
  chemically synthesized
caacctgtgcctcccgggttca

SEQ ID NO: 129856 - DNA, 22 bp, Artificial Sequence
  chemically synthesized
tgcctcccgggttcaagcaatt

SEQ ID NO: 129857 - DNA, 22 bp, Artificial Sequence
  chemically synthesized
ccgggttcaagcaattctcctg

SEQ ID NO: 129858 - DNA, 22 bp, Artificial Sequence
  chemically synthesized
aagcaattctcctgcctcagtt

SEQ ID NO: 129859 - DNA, 22 bp, Artificial Sequence
  chemically synthesized
tcctgcctcagtttcccaagta

SEQ ID NO: 129860 - DNA, 22 bp, Artificial Sequence
  chemically synthesized
ctgcctcagtttcccaagtagc

SEQ ID NO: 129861 - DNA, 22 bp, Artificial Sequence
  chemically synthesized
cctcagtttcccaagtagctgg

SEQ ID NO: 129862 - DNA, 22 bp, Artificial Sequence
  chemically synthesized
agtttcccaagtagctggaact

SEQ ID NO: 129863 - DNA, 22 bp, Artificial Sequence
  chemically synthesized
cccaagtagctggaactacagg

SEQ ID NO: 129864 - DNA, 22 bp, Artificial Sequence
  chemically synthesized
ccaagtagctggaactacaggc

SEQ ID NO: 129865 - DNA, 22 bp, Artificial Sequence
  chemically synthesized
gaactacaggcaactgcaacca

SEQ ID NO: 129866 - DNA, 22 bp, Artificial Sequence
  chemically synthesized
caggcaactgcaaccacacctg

SEQ ID NO: 129867 - DNA, 22 bp, Artificial Sequence
  chemically synthesized
caaccacacctggctaattttt

SEQ ID NO: 129868 - DNA, 22 bp, Artificial Sequence
  chemically synthesized
gctaatttttatattttttggt

SEQ ID NO: 129869 - DNA, 22 bp, Artificial Sequence
  chemically synthesized
atttttatattttttggtaggg

SEQ ID NO: 129870 - DNA, 22 bp, Artificial Sequence
  chemically synthesized
ttatattttttggtagggatgg

SEQ ID NO: 129871 - DNA, 22 bp, Artificial Sequence
  chemically synthesized
tatattttttggtagggatgga

SEQ ID NO: 129872 - DNA, 22 bp, Artificial Sequence
  chemically synthesized
atattttttggtagggatggaa

SEQ ID NO: 129873 - DNA, 22 bp, Artificial Sequence
  chemically synthesized
tattttttggtagggatggaat

SEQ ID NO: 129874 - DNA, 22 bp, Artificial Sequence
  chemically synthesized
tttggtagggatggaatttcac

SEQ ID NO: 129875 - DNA, 22 bp, Artificial Sequence
  chemically synthesized
ttggtagggatggaatttcacc

SEQ ID NO: 129876 - DNA, 22 bp, Artificial Sequence
  chemically synthesized
tggtagggatggaatttcacca

SEQ ID NO: 129877 - DNA, 22 bp, Artificial Sequence
  chemically synthesized
ggtagggatggaatttcaccat

SEQ ID NO: 129878 - DNA, 22 bp, Artificial Sequence
  chemically synthesized
gtagggatggaatttcaccatg

SEQ ID NO: 129879 - DNA, 22 bp, Artificial Sequence
  chemically synthesized
caccatgttggccaggctggtc

SEQ ID NO: 129880 - DNA, 22 bp, Artificial Sequence
  chemically synthesized
accatgttggccaggctggtct

SEQ ID NO: 129881 - DNA, 22 bp, Artificial Sequence
  chemically synthesized
gccaggctggtctggaactcct

SEQ ID NO: 129882 - DNA, 22 bp, Artificial Sequence
  chemically synthesized
gtctggaactcctgacctcagg

SEQ ID NO: 129883 - DNA, 22 bp, Artificial Sequence
  chemically synthesized
gaactcctgacctcaggtgatc

SEQ ID NO: 129884 - DNA, 22 bp, Artificial Sequence
  chemically synthesized
ctgacctcaggtgatccgcccg

SEQ ID NO: 129885 - DNA, 22 bp, Artificial Sequence
  chemically synthesized
acctcaggtgatccgcccgcct

SEQ ID NO: 129886 - DNA, 22 bp, Artificial Sequence
  chemically synthesized
aggtgatccgcccgccttggcc

SEQ ID NO: 129887 - DNA, 22 bp, Artificial Sequence
  chemically synthesized
ggcctcccaaagtgctgggatt

SEQ ID NO: 129888 - DNA, 22 bp, Artificial Sequence
  chemically synthesized
gcctcccaaagtgctgggatta

SEQ ID NO: 129889 - DNA, 22 bp, Artificial Sequence
  chemically synthesized
ccaaagtgctgggattacaggc

SEQ ID NO: 129890 - DNA, 22 bp, Artificial Sequence
  chemically synthesized
ggattacaggcttgaatgagcc

SEQ ID NO: 129891 - DNA, 22 bp, Artificial Sequence
  chemically synthesized
caggcttgaatgagccattgca

SEQ ID NO: 129892 - DNA, 22 bp, Artificial Sequence
  chemically synthesized
gaatgagccattgcacccggct

SEQ ID NO: 129893 - DNA, 22 bp, Artificial Sequence
  chemically synthesized
aatgagccattgcacccggctg

SEQ ID NO: 129894 - DNA, 22 bp, Artificial Sequence
  chemically synthesized
cacccggctgtcagagttcagt

SEQ ID NO: 129895 - DNA, 22 bp, Artificial Sequence
  chemically synthesized
tcagagttcagtttcctactgc

SEQ ID NO: 129896 - DNA, 22 bp, Artificial Sequence
  chemically synthesized
agtttcctactgctgaactctg

SEQ ID NO: 129897 - DNA, 22 bp, Artificial Sequence
  chemically synthesized
cctactgctgaactctgaagtc

SEQ ID NO: 129898 - DNA, 22 bp, Artificial Sequence
  chemically synthesized
ctactgctgaactctgaagtcc

SEQ ID NO: 129899 - DNA, 22 bp, Artificial Sequence
  chemically synthesized
ctgctgaactctgaagtccctg

SEQ ID NO: 129900 - DNA, 22 bp, Artificial Sequence
  chemically synthesized
ctgaactctgaagtccctgttt

SEQ ID NO: 129901 - DNA, 22 bp, Artificial Sequence
  chemically synthesized
aactctgaagtccctgtttgtt

SEQ ID NO: 129902 - DNA, 22 bp, Artificial Sequence
  chemically synthesized
tgaagtccctgtttgtttttgt

SEQ ID NO: 129903 - DNA, 22 bp, Artificial Sequence
  chemically synthesized
aagtccctgtttgtttttgttt

SEQ ID NO: 129904 - DNA, 22 bp, Artificial Sequence
  chemically synthesized
tttgtttttgtttttgtttttt

SEQ ID NO: 129905 - DNA, 22 bp, Artificial Sequence
  chemically synthesized
gtttttgtttttgttttttgtt

SEQ ID NO: 129906 - DNA, 22 bp, Artificial Sequence
  chemically synthesized
tttttgtttttgttttttgttt

SEQ ID NO: 129907 - DNA, 22 bp, Artificial Sequence
  chemically synthesized
ttgtttttgttttttgtttgtt

SEQ ID NO: 129908 - DNA, 22 bp, Artificial Sequence
  chemically synthesized
tgtttttgttttttgtttgttt

SEQ ID NO: 129909 - DNA, 22 bp, Artificial Sequence
  chemically synthesized
gtttttgttttttgtttgtttg

SEQ ID NO: 129910 - DNA, 22 bp, Artificial Sequence
  chemically synthesized
tttttgttttttgtttgtttgt

SEQ ID NO: 129911 - DNA, 22 bp, Artificial Sequence
  chemically synthesized
ttgttttttgtttgtttgtttg

SEQ ID NO: 129912 - DNA, 22 bp, Artificial Sequence
  chemically synthesized
tgttttttgtttgtttgtttgc

SEQ ID NO: 129913 - DNA, 22 bp, Artificial Sequence
  chemically synthesized
gttttttgtttgtttgtttgca

SEQ ID NO: 129914 - DNA, 22 bp, Artificial Sequence
  chemically synthesized
ttttttgtttgtttgtttgcag

SEQ ID NO: 129915 - DNA, 22 bp, Artificial Sequence
  chemically synthesized
tttgtttgtttgtttgcaggct

SEQ ID NO: 129916 - DNA, 22 bp, Artificial Sequence
  chemically synthesized
ttgtttgtttgtttgcaggctg

SEQ ID NO: 129917 - DNA, 22 bp, Artificial Sequence
  chemically synthesized
tgtttgtttgtttgcaggctgt

SEQ ID NO: 129918 - DNA, 22 bp, Artificial Sequence
  chemically synthesized
gtttgtttgtttgcaggctgtt

SEQ ID NO: 129919 - DNA, 22 bp, Artificial Sequence
  chemically synthesized
tttgtttgtttgcaggctgtta

SEQ ID NO: 129920 - DNA, 22 bp, Artificial Sequence
  chemically synthesized
gtttgtttgcaggctgttagct

SEQ ID NO: 129921 - DNA, 22 bp, Artificial Sequence
  chemically synthesized
tttgtttgcaggctgttagcta

SEQ ID NO: 129922 - DNA, 22 bp, Artificial Sequence
  chemically synthesized
gtttgcaggctgttagctagga

SEQ ID NO: 129923 - DNA, 22 bp, Artificial Sequence
  chemically synthesized
tttgcaggctgttagctaggat

SEQ ID NO: 129924 - DNA, 22 bp, Artificial Sequence
  chemically synthesized
gcaggctgttagctaggatgcc

SEQ ID NO: 129925 - DNA, 22 bp, Artificial Sequence
  chemically synthesized
caggctgttagctaggatgccc

SEQ ID NO: 129926 - DNA, 22 bp, Artificial Sequence
  chemically synthesized
ttagctaggatgcccgttctgt

SEQ ID NO: 129927 - DNA, 22 bp, Artificial Sequence
  chemically synthesized
gctaggatgcccgttctgtacc

SEQ ID NO: 129928 - DNA, 22 bp, Artificial Sequence
  chemically synthesized
ggatgcccgttctgtacctagg

SEQ ID NO: 129929 - DNA, 22 bp, Artificial Sequence
  chemically synthesized
tgtacctaggggcttcttgcat

SEQ ID NO: 129930 - DNA, 22 bp, Artificial Sequence
  chemically synthesized
tacctaggggcttcttgcattc

SEQ ID NO: 129931 - DNA, 22 bp, Artificial Sequence
  chemically synthesized
ggggcttcttgcattccttctt

SEQ ID NO: 129932 - DNA, 22 bp, Artificial Sequence
  chemically synthesized
cttgcattccttcttttgtgac

SEQ ID NO: 129933 - DNA, 22 bp, Artificial Sequence
  chemically synthesized
ttgcattccttcttttgtgacc

SEQ ID NO: 129934 - DNA, 22 bp, Artificial Sequence
  chemically synthesized
gcattccttcttttgtgacctc

SEQ ID NO: 129935 - DNA, 22 bp, Artificial Sequence
  chemically synthesized
cattccttcttttgtgacctcc

SEQ ID NO: 129936 - DNA, 22 bp, Artificial Sequence
  chemically synthesized
cttcttttgtgacctccttata

SEQ ID NO: 129937 - DNA, 22 bp, Artificial Sequence
  chemically synthesized
cttttgtgacctccttatattt

SEQ ID NO: 129938 - DNA, 22 bp, Artificial Sequence
  chemically synthesized
ttttgtgacctccttatatttc

SEQ ID NO: 129939 - DNA, 22 bp, Artificial Sequence
  chemically synthesized
ttgtgacctccttatatttcaa

SEQ ID NO: 129940 - DNA, 22 bp, Artificial Sequence
  chemically synthesized
tgtgacctccttatatttcaaa

SEQ ID NO: 129941 - DNA, 22 bp, Artificial Sequence
  chemically synthesized
gtgacctccttatatttcaaac

SEQ ID NO: 129942 - DNA, 22 bp, Artificial Sequence
  chemically synthesized
tgacctccttatatttcaaacc

SEQ ID NO: 129943 - DNA, 22 bp, Artificial Sequence
  chemically synthesized
cttatatttcaaaccagcaact

SEQ ID NO: 129944 - DNA, 22 bp, Artificial Sequence
  chemically synthesized
atatttcaaaccagcaactgac

SEQ ID NO: 129945 - DNA, 22 bp, Artificial Sequence
  chemically synthesized
tatttcaaaccagcaactgacc

SEQ ID NO: 129946 - DNA, 22 bp, Artificial Sequence
  chemically synthesized
caaaccagcaactgacccatga

SEQ ID NO: 129947 - DNA, 22 bp, Artificial Sequence
  chemically synthesized
aaaccagcaactgacccatgaa

SEQ ID NO: 129948 - DNA, 22 bp, Artificial Sequence
  chemically synthesized
acccatgaacctttctcaaatt

SEQ ID NO: 129949 - DNA, 22 bp, Artificial Sequence
  chemically synthesized
tctcaaattttgaatatgtctg

SEQ ID NO: 129950 - DNA, 22 bp, Artificial Sequence
  chemically synthesized
ctcaaattttgaatatgtctgg

SEQ ID NO: 129951 - DNA, 22 bp, Artificial Sequence
  chemically synthesized
tcaaattttgaatatgtctggc

SEQ ID NO: 129952 - DNA, 22 bp, Artificial Sequence
  chemically synthesized
aaattttgaatatgtctggctt

SEQ ID NO: 129953 - DNA, 22 bp, Artificial Sequence
  chemically synthesized
tgaatatgtctggcttcctatt

SEQ ID NO: 129954 - DNA, 22 bp, Artificial Sequence
  chemically synthesized
gaatatgtctggcttcctattc

SEQ ID NO: 129955 - DNA, 22 bp, Artificial Sequence
  chemically synthesized
aatatgtctggcttcctattct

SEQ ID NO: 129956 - DNA, 22 bp, Artificial Sequence
  chemically synthesized
gcttcctattctcctactactt

SEQ ID NO: 129957 - DNA, 22 bp, Artificial Sequence
  chemically synthesized
cctattctcctactacttggtg

SEQ ID NO: 129958 - DNA, 22 bp, Artificial Sequence
  chemically synthesized
ctattctcctactacttggtga

SEQ ID NO: 129959 - DNA, 22 bp, Artificial Sequence
  chemically synthesized
ttctcctactacttggtgaaaa

SEQ ID NO: 129960 - DNA, 22 bp, Artificial Sequence
  chemically synthesized
tcctactacttggtgaaaactc

SEQ ID NO: 129961 - DNA, 22 bp, Artificial Sequence
  chemically synthesized
ctactacttggtgaaaactctg

SEQ ID NO: 129962 - DNA, 22 bp, Artificial Sequence
  chemically synthesized
ctacttggtgaaaactctgctt

SEQ ID NO: 129963 - DNA, 22 bp, Artificial Sequence
  chemically synthesized
cttggtgaaaactctgctttta

SEQ ID NO: 129964 - DNA, 22 bp, Artificial Sequence
  chemically synthesized
ggtgaaaactctgcttttaggg

SEQ ID NO: 129965 - DNA, 22 bp, Artificial Sequence
  chemically synthesized
gtgaaaactctgcttttagggg

SEQ ID NO: 129966 - DNA, 22 bp, Artificial Sequence
  chemically synthesized
tgcttttaggggctcatggaat

SEQ ID NO: 129967 - DNA, 22 bp, Artificial Sequence
  chemically synthesized
cttttaggggctcatggaatta

SEQ ID NO: 129968 - DNA, 22 bp, Artificial Sequence
  chemically synthesized
ttaggggctcatggaattagac

SEQ ID NO: 129969 - DNA, 22 bp, Artificial Sequence
  chemically synthesized
taggggctcatggaattagact

SEQ ID NO: 129970 - DNA, 22 bp, Artificial Sequence
  chemically synthesized
aggggctcatggaattagacta

SEQ ID NO: 129971 - DNA, 22 bp, Artificial Sequence
  chemically synthesized
ggggctcatggaattagactag

SEQ ID NO: 129972 - DNA, 22 bp, Artificial Sequence
  chemically synthesized
atggaattagactaggttcccc

SEQ ID NO: 129973 - DNA, 22 bp, Artificial Sequence
  chemically synthesized
gactaggttcccctgagtaatt

SEQ ID NO: 129974 - DNA, 22 bp, Artificial Sequence
  chemically synthesized
ggttcccctgagtaatttcctt

SEQ ID NO: 129975 - DNA, 22 bp, Artificial Sequence
  chemically synthesized
ccctgagtaatttccttttcaa

SEQ ID NO: 129976 - DNA, 22 bp, Artificial Sequence
  chemically synthesized
agtaatttccttttcaattaac

SEQ ID NO: 129977 - DNA, 22 bp, Artificial Sequence
  chemically synthesized
ccttttcaattaactcaaagtc

SEQ ID NO: 129978 - DNA, 22 bp, Artificial Sequence
  chemically synthesized
cttttcaattaactcaaagtca

SEQ ID NO: 129979 - DNA, 22 bp, Artificial Sequence
  chemically synthesized
ttcaattaactcaaagtcaata

SEQ ID NO: 129980 - DNA, 22 bp, Artificial Sequence
  chemically synthesized
tcaattaactcaaagtcaatag

SEQ ID NO: 129981 - DNA, 22 bp, Artificial Sequence
  chemically synthesized
caattaactcaaagtcaataga

SEQ ID NO: 129982 - DNA, 22 bp, Artificial Sequence
  chemically synthesized
aattaactcaaagtcaatagat

SEQ ID NO: 129983 - DNA, 22 bp, Artificial Sequence
  chemically synthesized
actcaaagtcaatagatcagca

SEQ ID NO: 129984 - DNA, 22 bp, Artificial Sequence
  chemically synthesized
aaagtcaatagatcagcaactt

SEQ ID NO: 129985 - DNA, 22 bp, Artificial Sequence
  chemically synthesized
taattacatctgtataacccca

SEQ ID NO: 129986 - DNA, 22 bp, Artificial Sequence
  chemically synthesized
aattacatctgtataaccccaa

SEQ ID NO: 129987 - DNA, 22 bp, Artificial Sequence
  chemically synthesized
attacatctgtataaccccaag

SEQ ID NO: 129988 - DNA, 22 bp, Artificial Sequence
  chemically synthesized
catctgtataaccccaagcatg

SEQ ID NO: 129989 - DNA, 22 bp, Artificial Sequence
  chemically synthesized
tataaccccaagcatgatattg

SEQ ID NO: 129990 - DNA, 22 bp, Artificial Sequence
  chemically synthesized
tatcatattcacagtcctagaa

SEQ ID NO: 129991 - DNA, 22 bp, Artificial Sequence
  chemically synthesized
acagtcctagaaattaggatag

SEQ ID NO: 129992 - DNA, 22 bp, Artificial Sequence
  chemically synthesized
gaaattaggataggaaatcttg

SEQ ID NO: 129993 - DNA, 22 bp, Artificial Sequence
  chemically synthesized
ggataggaaatcttgtggtaga

SEQ ID NO: 129994 - DNA, 22 bp, Artificial Sequence
  chemically synthesized
gtggtagaaaggtttttaaaat

SEQ ID NO: 129995 - DNA, 22 bp, Artificial Sequence
  chemically synthesized
tggtagaaaggtttttaaaatt

SEQ ID NO: 129996 - DNA, 22 bp, Artificial Sequence
  chemically synthesized
ttaaaattatgcctatcacacc

SEQ ID NO: 129997 - DNA, 22 bp, Artificial Sequence
  chemically synthesized
taaaattatgcctatcacacca

SEQ ID NO: 129998 - DNA, 22 bp, Artificial Sequence
  chemically synthesized
aaaattatgcctatcacaccat

SEQ ID NO: 129999 - DNA, 22 bp, Artificial Sequence
  chemically synthesized
aaattatgcctatcacaccatt

SEQ ID NO: 130000 - DNA, 22 bp, Artificial Sequence
  chemically synthesized
tgcctatcacaccatttaaaaa

SEQ ID NO: 130001 - DNA, 22 bp, Artificial Sequence
  chemically synthesized
tcacaccatttaaaaaatagct

SEQ ID NO: 130002 - DNA, 22 bp, Artificial Sequence
  chemically synthesized
aaaaaatagctagtgagagagg

SEQ ID NO: 130003 - DNA, 22 bp, Artificial Sequence
  chemically synthesized
aaaaatagctagtgagagagga

SEQ ID NO: 130004 - DNA, 22 bp, Artificial Sequence
  chemically synthesized
gtgagagaggagactttctttt

SEQ ID NO: 130005 - DNA, 22 bp, Artificial Sequence
  chemically synthesized
tcttttccaatatatgtgttag

SEQ ID NO: 130006 - DNA, 22 bp, Artificial Sequence
  chemically synthesized
cttttccaatatatgtgttagt

SEQ ID NO: 130007 - DNA, 22 bp, Artificial Sequence
  chemically synthesized
ttttccaatatatgtgttagtt

SEQ ID NO: 130008 - DNA, 22 bp, Artificial Sequence
  chemically synthesized
ttccaatatatgtgttagtttt

SEQ ID NO: 130009 - DNA, 22 bp, Artificial Sequence
  chemically synthesized
tccaatatatgtgttagtttta

SEQ ID NO: 130010 - DNA, 22 bp, Artificial Sequence
  chemically synthesized
ccaatatatgtgttagttttaa

SEQ ID NO: 130011 - DNA, 22 bp, Artificial Sequence
  chemically synthesized
caatatatgtgttagttttaaa

SEQ ID NO: 130012 - DNA, 22 bp, Artificial Sequence
  chemically synthesized
gttttaaagtatgtgtgaaata

SEQ ID NO: 130013 - DNA, 22 bp, Artificial Sequence
  chemically synthesized
taaagtatgtgtgaaataattt

SEQ ID NO: 130014 - DNA, 22 bp, Artificial Sequence
  chemically synthesized
aaagtatgtgtgaaataatttt

SEQ ID NO: 130015 - DNA, 22 bp, Artificial Sequence
  chemically synthesized
aagtatgtgtgaaataattttt

SEQ ID NO: 130016 - DNA, 22 bp, Artificial Sequence
  chemically synthesized
ttattcttaacatttttttgat

SEQ ID NO: 130017 - DNA, 22 bp, Artificial Sequence
  chemically synthesized
tattcttaacatttttttgatg

SEQ ID NO: 130018 - DNA, 22 bp, Artificial Sequence
  chemically synthesized
attcttaacatttttttgatga

SEQ ID NO: 130019 - DNA, 22 bp, Artificial Sequence
  chemically synthesized
ttcttaacatttttttgatgaa

SEQ ID NO: 130020 - DNA, 22 bp, Artificial Sequence
  chemically synthesized
ttaacatttttttgatgaagca

SEQ ID NO: 130021 - DNA, 22 bp, Artificial Sequence
  chemically synthesized
aacatttttttgatgaagcaca

SEQ ID NO: 130022 - DNA, 22 bp, Artificial Sequence
  chemically synthesized
acatttttttgatgaagcacaa

SEQ ID NO: 130023 - DNA, 22 bp, Artificial Sequence
  chemically synthesized
ttttgatgaagcacaatgtctg

SEQ ID NO: 130024 - DNA, 22 bp, Artificial Sequence
  chemically synthesized
tttgatgaagcacaatgtctga

SEQ ID NO: 130025 - DNA, 22 bp, Artificial Sequence
  chemically synthesized
ttgatgaagcacaatgtctgaa

SEQ ID NO: 130026 - DNA, 22 bp, Artificial Sequence
  chemically synthesized
tgatgaagcacaatgtctgaaa

SEQ ID NO: 130027 - DNA, 22 bp, Artificial Sequence
  chemically synthesized
gatgaagcacaatgtctgaaag

SEQ ID NO: 130028 - DNA, 22 bp, Artificial Sequence
  chemically synthesized
atgaagcacaatgtctgaaagg

SEQ ID NO: 130029 - DNA, 22 bp, Artificial Sequence
  chemically synthesized
aaagggtggtagaaagcagctg

SEQ ID NO: 130030 - DNA, 22 bp, Artificial Sequence
  chemically synthesized
gagtcgaaactgaggatgaagt

SEQ ID NO: 130031 - DNA, 22 bp, Artificial Sequence
  chemically synthesized
aggatgaagtcgtatagtctag

SEQ ID NO: 130032 - DNA, 22 bp, Artificial Sequence
  chemically synthesized
gagctgtgctgtccaaaacagt

SEQ ID NO: 130033 - DNA, 22 bp, Artificial Sequence
  chemically synthesized
tgctgtccaaaacagtagcatc

SEQ ID NO: 130034 - DNA, 22 bp, Artificial Sequence
  chemically synthesized
tccaaaacagtagcatctggtt

SEQ ID NO: 130035 - DNA, 22 bp, Artificial Sequence
  chemically synthesized
gttagcttgagtcagaattttc

SEQ ID NO: 130036 - DNA, 22 bp, Artificial Sequence
  chemically synthesized
gcttgagtcagaattttctgta

SEQ ID NO: 130037 - DNA, 22 bp, Artificial Sequence
  chemically synthesized
gagtcagaattttctgtaagtg

SEQ ID NO: 130038 - DNA, 22 bp, Artificial Sequence
  chemically synthesized
agtcagaattttctgtaagtgt

SEQ ID NO: 130039 - DNA, 22 bp, Artificial Sequence
  chemically synthesized
tctgtaagtgtaaacactcgat

SEQ ID NO: 130040 - DNA, 22 bp, Artificial Sequence
  chemically synthesized
ctgtaagtgtaaacactcgatt

SEQ ID NO: 130041 - DNA, 22 bp, Artificial Sequence
  chemically synthesized
tgtaagtgtaaacactcgattt

SEQ ID NO: 130042 - DNA, 22 bp, Artificial Sequence
  chemically synthesized
taagtgtaaacactcgattttg

SEQ ID NO: 130043 - DNA, 22 bp, Artificial Sequence
  chemically synthesized
gattttgaagaatttgtaccaa

SEQ ID NO: 130044 - DNA, 22 bp, Artificial Sequence
  chemically synthesized
tgaagaatttgtaccaaaaaaa

SEQ ID NO: 130045 - DNA, 22 bp, Artificial Sequence
  chemically synthesized
gaagaatttgtaccaaaaaaaa

SEQ ID NO: 130046 - DNA, 22 bp, Artificial Sequence
  chemically synthesized
aagaatttgtaccaaaaaaaaa

SEQ ID NO: 130047 - DNA, 22 bp, Artificial Sequence
  chemically synthesized
gtaccaaaaaaaaatcgtggga

SEQ ID NO: 130048 - DNA, 22 bp, Artificial Sequence
  chemically synthesized
taccaaaaaaaaatcgtgggaa

SEQ ID NO: 130049 - DNA, 22 bp, Artificial Sequence
  chemically synthesized
tctcatatatgatttttatgct

SEQ ID NO: 130050 - DNA, 22 bp, Artificial Sequence
  chemically synthesized
atatatgatttttatgctgatt

SEQ ID NO: 130051 - DNA, 22 bp, Artificial Sequence
  chemically synthesized
ttatgctgattatctattaaaa

SEQ ID NO: 130052 - DNA, 22 bp, Artificial Sequence
  chemically synthesized
tatgctgattatctattaaaat

SEQ ID NO: 130053 - DNA, 22 bp, Artificial Sequence
  chemically synthesized
atgctgattatctattaaaatg

SEQ ID NO: 130054 - DNA, 22 bp, Artificial Sequence
  chemically synthesized
tgctgattatctattaaaatga

SEQ ID NO: 130055 - DNA, 22 bp, Artificial Sequence
  chemically synthesized
attatctattaaaatgataata

SEQ ID NO: 130056 - DNA, 22 bp, Artificial Sequence
  chemically synthesized
tctattaaaatgataatatttt

SEQ ID NO: 130057 - DNA, 22 bp, Artificial Sequence
  chemically synthesized
ttaaaatgataatatttttgat

SEQ ID NO: 130058 - DNA, 22 bp, Artificial Sequence
  chemically synthesized
aaatgataatatttttgatata

SEQ ID NO: 130059 - DNA, 22 bp, Artificial Sequence
  chemically synthesized
ttgatatagtagcttaaataag

SEQ ID NO: 130060 - DNA, 22 bp, Artificial Sequence
  chemically synthesized
tgatatagtagcttaaataaga

SEQ ID NO: 130061 - DNA, 22 bp, Artificial Sequence
  chemically synthesized
gatatagtagcttaaataagac

SEQ ID NO: 130062 - DNA, 22 bp, Artificial Sequence
  chemically synthesized
atatagtagcttaaataagaca

SEQ ID NO: 130063 - DNA, 22 bp, Artificial Sequence
  chemically synthesized
aaataagacatactaatattaa

SEQ ID NO: 130064 - DNA, 22 bp, Artificial Sequence
  chemically synthesized
aataagacatactaatattaat

SEQ ID NO: 130065 - DNA, 22 bp, Artificial Sequence
  chemically synthesized
atattaattttaccacttttct

SEQ ID NO: 130066 - DNA, 22 bp, Artificial Sequence
  chemically synthesized
attttaccacttttctttttac

SEQ ID NO: 130067 - DNA, 22 bp, Artificial Sequence
  chemically synthesized
taccacttttctttttactcct

SEQ ID NO: 130068 - DNA, 22 bp, Artificial Sequence
  chemically synthesized
accacttttctttttactcctt

SEQ ID NO: 130069 - DNA, 22 bp, Artificial Sequence
  chemically synthesized
ccacttttctttttactccttt

SEQ ID NO: 130070 - DNA, 22 bp, Artificial Sequence
  chemically synthesized
ttctttttactccttttaatgt

SEQ ID NO: 130071 - DNA, 22 bp, Artificial Sequence
  chemically synthesized
tctttttactccttttaatgtg

SEQ ID NO: 130072 - DNA, 22 bp, Artificial Sequence
  chemically synthesized
ctttttactccttttaatgtga

SEQ ID NO: 130073 - DNA, 22 bp, Artificial Sequence
  chemically synthesized
tttttactccttttaatgtgac

SEQ ID NO: 130074 - DNA, 22 bp, Artificial Sequence
  chemically synthesized
tttactccttttaatgtgacta

SEQ ID NO: 130075 - DNA, 22 bp, Artificial Sequence
  chemically synthesized
ttactccttttaatgtgactac

SEQ ID NO: 130076 - DNA, 22 bp, Artificial Sequence
  chemically synthesized
tactccttttaatgtgactacc

SEQ ID NO: 130077 - DNA, 22 bp, Artificial Sequence
  chemically synthesized
actccttttaatgtgactacca

SEQ ID NO: 130078 - DNA, 22 bp, Artificial Sequence
  chemically synthesized
ctccttttaatgtgactaccag

SEQ ID NO: 130079 - DNA, 22 bp, Artificial Sequence
  chemically synthesized
cttttaatgtgactaccagaac

SEQ ID NO: 130080 - DNA, 22 bp, Artificial Sequence
  chemically synthesized
ttaatgtgactaccagaacatt

SEQ ID NO: 130081 - DNA, 22 bp, Artificial Sequence
  chemically synthesized
taatgtgactaccagaacattt

SEQ ID NO: 130082 - DNA, 22 bp, Artificial Sequence
  chemically synthesized
aatgtgactaccagaacattta

SEQ ID NO: 130083 - DNA, 22 bp, Artificial Sequence
  chemically synthesized
atgtgactaccagaacatttaa

SEQ ID NO: 130084 - DNA, 22 bp, Artificial Sequence
  chemically synthesized
ccagaacatttaacatcacata

SEQ ID NO: 130085 - DNA, 22 bp, Artificial Sequence
  chemically synthesized
aacatcacatatttagctctaa

SEQ ID NO: 130086 - DNA, 22 bp, Artificial Sequence
  chemically synthesized
acatcacatatttagctctaat

SEQ ID NO: 130087 - DNA, 22 bp, Artificial Sequence
  chemically synthesized
agctctaattatatttccacca

SEQ ID NO: 130088 - DNA, 22 bp, Artificial Sequence
  chemically synthesized
gctctaattatatttccaccac

SEQ ID NO: 130089 - DNA, 22 bp, Artificial Sequence
  chemically synthesized
taattatatttccaccacatag

SEQ ID NO: 130090 - DNA, 22 bp, Artificial Sequence
  chemically synthesized
attatatttccaccacatagtg

SEQ ID NO: 130091 - DNA, 22 bp, Artificial Sequence
  chemically synthesized
tatttccaccacatagtgctgg

SEQ ID NO: 130092 - DNA, 22 bp, Artificial Sequence
  chemically synthesized
ccaccacatagtgctggtctag

SEQ ID NO: 130093 - DNA, 22 bp, Artificial Sequence
  chemically synthesized
caccacatagtgctggtctaga

SEQ ID NO: 130094 - DNA, 22 bp, Artificial Sequence
  chemically synthesized
gtctagagagctgttttgtttg

SEQ ID NO: 130095 - DNA, 22 bp, Artificial Sequence
  chemically synthesized
gagagctgttttgtttgtttgt

SEQ ID NO: 130096 - DNA, 22 bp, Artificial Sequence
  chemically synthesized
ttttgtttgtttgtttctcctc

SEQ ID NO: 130097 - DNA, 22 bp, Artificial Sequence
  chemically synthesized
tgtttgtttgtttctcctcagg

SEQ ID NO: 130098 - DNA, 22 bp, Artificial Sequence
  chemically synthesized
gtttgtttgtttctcctcaggt

SEQ ID NO: 130099 - DNA, 22 bp, Artificial Sequence
  chemically synthesized
tttgtttgtttctcctcaggta

SEQ ID NO: 130100 - DNA, 22 bp, Artificial Sequence
  chemically synthesized
gtttgtttctcctcaggtatcc

SEQ ID NO: 130101 - DNA, 22 bp, Artificial Sequence
  chemically synthesized
tttgtttctcctcaggtatcca

SEQ ID NO: 130102 - DNA, 22 bp, Artificial Sequence
  chemically synthesized
gtttctcctcaggtatccacca

SEQ ID NO: 130103 - DNA, 22 bp, Artificial Sequence
  chemically synthesized
tttctcctcaggtatccaccat

SEQ ID NO: 130104 - DNA, 22 bp, Artificial Sequence
  chemically synthesized
ctcctcaggtatccaccatgtc

SEQ ID NO: 130105 - DNA, 22 bp, Artificial Sequence
  chemically synthesized
tcctcaggtatccaccatgtca

SEQ ID NO: 130106 - DNA, 22 bp, Artificial Sequence
  chemically synthesized
ctcaggtatccaccatgtcacc

SEQ ID NO: 130107 - DNA, 22 bp, Artificial Sequence
  chemically synthesized
aggtatccaccatgtcacccac

SEQ ID NO: 130108 - DNA, 22 bp, Artificial Sequence
  chemically synthesized
ctgctgccccttttctcctcac

SEQ ID NO: 130109 - DNA, 22 bp, Artificial Sequence
  chemically synthesized
ctgccccttttctcctcactgg

SEQ ID NO: 130110 - DNA, 22 bp, Artificial Sequence
  chemically synthesized
ccccttttctcctcactggctt

SEQ ID NO: 130111 - DNA, 22 bp, Artificial Sequence
  chemically synthesized
ttctcctcactggctttccagg

SEQ ID NO: 130112 - DNA, 22 bp, Artificial Sequence
  chemically synthesized
tctcctcactggctttccaggt

SEQ ID NO: 130113 - DNA, 22 bp, Artificial Sequence
  chemically synthesized
ctcctcactggctttccaggtc

SEQ ID NO: 130114 - DNA, 22 bp, Artificial Sequence
  chemically synthesized
tcctcactggctttccaggtct

SEQ ID NO: 130115 - DNA, 22 bp, Artificial Sequence
  chemically synthesized
ctcactggctttccaggtctgg

SEQ ID NO: 130116 - DNA, 22 bp, Artificial Sequence
  chemically synthesized
actggctttccaggtctggaga

SEQ ID NO: 130117 - DNA, 22 bp, Artificial Sequence
  chemically synthesized
gctttccaggtctggagagatt

SEQ ID NO: 130118 - DNA, 22 bp, Artificial Sequence
  chemically synthesized
tccaggtctggagagatttcat

SEQ ID NO: 130119 - DNA, 22 bp, Artificial Sequence
  chemically synthesized
ccaggtctggagagatttcatc

SEQ ID NO: 130120 - DNA, 22 bp, Artificial Sequence
  chemically synthesized
caggtctggagagatttcatcc

SEQ ID NO: 130121 - DNA, 22 bp, Artificial Sequence
  chemically synthesized
gagagatttcatccttggagtt

SEQ ID NO: 130122 - DNA, 22 bp, Artificial Sequence
  chemically synthesized
catccttggagttctatctcct

SEQ ID NO: 130123 - DNA, 22 bp, Artificial Sequence
  chemically synthesized
atccttggagttctatctcctt

SEQ ID NO: 130124 - DNA, 22 bp, Artificial Sequence
  chemically synthesized
ggagttctatctccttctttat

SEQ ID NO: 130125 - DNA, 22 bp, Artificial Sequence
  chemically synthesized
gagttctatctccttctttatc

SEQ ID NO: 130126 - DNA, 22 bp, Artificial Sequence
  chemically synthesized
tatctccttctttatcatctat

SEQ ID NO: 130127 - DNA, 22 bp, Artificial Sequence
  chemically synthesized
tctccttctttatcatctatgt

SEQ ID NO: 130128 - DNA, 22 bp, Artificial Sequence
  chemically synthesized
cttctttatcatctatgtctct

SEQ ID NO: 130129 - DNA, 22 bp, Artificial Sequence
  chemically synthesized
ctttatcatctatgtctctaca

SEQ ID NO: 130130 - DNA, 22 bp, Artificial Sequence
  chemically synthesized
tttatcatctatgtctctacag

SEQ ID NO: 130131 - DNA, 22 bp, Artificial Sequence
  chemically synthesized
tatcatctatgtctctacagtc

SEQ ID NO: 130132 - DNA, 22 bp, Artificial Sequence
  chemically synthesized
atcatctatgtctctacagtcc

SEQ ID NO: 130133 - DNA, 22 bp, Artificial Sequence
  chemically synthesized
tcatctatgtctctacagtcct

SEQ ID NO: 130134 - DNA, 22 bp, Artificial Sequence
  chemically synthesized
tgtctctacagtccttggcaat

SEQ ID NO: 130135 - DNA, 22 bp, Artificial Sequence
  chemically synthesized
tacagtccttggcaatggcagc

SEQ ID NO: 130136 - DNA, 22 bp, Artificial Sequence
  chemically synthesized
cagtccttggcaatggcagcct

SEQ ID NO: 130137 - DNA, 22 bp, Artificial Sequence
  chemically synthesized
ggcaatggcagcctcctcctct

SEQ ID NO: 130138 - DNA, 22 bp, Artificial Sequence
  chemically synthesized
gcaatggcagcctcctcctctt

SEQ ID NO: 130139 - DNA, 22 bp, Artificial Sequence
  chemically synthesized
ctcctctttatcagagaagact

SEQ ID NO: 130140 - DNA, 22 bp, Artificial Sequence
  chemically synthesized
ctctttatcagagaagactgca

SEQ ID NO: 130141 - DNA, 22 bp, Artificial Sequence
  chemically synthesized
tttatcagagaagactgcactc

SEQ ID NO: 130142 - DNA, 22 bp, Artificial Sequence
  chemically synthesized
tatcagagaagactgcactctt

SEQ ID NO: 130143 - DNA, 22 bp, Artificial Sequence
  chemically synthesized
atcagagaagactgcactcttc

SEQ ID NO: 130144 - DNA, 22 bp, Artificial Sequence
  chemically synthesized
tcagagaagactgcactcttca

SEQ ID NO: 130145 - DNA, 22 bp, Artificial Sequence
  chemically synthesized
cactcttcatgagcccgtgtac

SEQ ID NO: 130146 - DNA, 22 bp, Artificial Sequence
  chemically synthesized
ttcatgagcccgtgtactactc

SEQ ID NO: 130147 - DNA, 22 bp, Artificial Sequence
  chemically synthesized
catgagcccgtgtactactctc

SEQ ID NO: 130148 - DNA, 22 bp, Artificial Sequence
  chemically synthesized
atgagcccgtgtactactctct

SEQ ID NO: 130149 - DNA, 22 bp, Artificial Sequence
  chemically synthesized
ctctctgactatactggcagcc

SEQ ID NO: 130150 - DNA, 22 bp, Artificial Sequence
  chemically synthesized
tctgactatactggcagccata

SEQ ID NO: 130151 - DNA, 22 bp, Artificial Sequence
  chemically synthesized
tgactatactggcagccataga

SEQ ID NO: 130152 - DNA, 22 bp, Artificial Sequence
  chemically synthesized
actatactggcagccatagacc

SEQ ID NO: 130153 - DNA, 22 bp, Artificial Sequence
  chemically synthesized
tactggcagccatagaccttgg

SEQ ID NO: 130154 - DNA, 22 bp, Artificial Sequence
  chemically synthesized
gcagccatagaccttggtgtaa

SEQ ID NO: 130155 - DNA, 22 bp, Artificial Sequence
  chemically synthesized
ggtgtaactttgacaacaatgt

SEQ ID NO: 130156 - DNA, 22 bp, Artificial Sequence
  chemically synthesized
gtgtaactttgacaacaatgtc

SEQ ID NO: 130157 - DNA, 22 bp, Artificial Sequence
  chemically synthesized
tgacaacaatgtccactgtcct

SEQ ID NO: 130158 - DNA, 22 bp, Artificial Sequence
  chemically synthesized
gacaacaatgtccactgtcctt

SEQ ID NO: 130159 - DNA, 22 bp, Artificial Sequence
  chemically synthesized
acaacaatgtccactgtccttg

SEQ ID NO: 130160 - DNA, 22 bp, Artificial Sequence
  chemically synthesized
tccttggtgttctctggctaga

SEQ ID NO: 130161 - DNA, 22 bp, Artificial Sequence
  chemically synthesized
ggtgttctctggctagatcaca

SEQ ID NO: 130162 - DNA, 22 bp, Artificial Sequence
  chemically synthesized
gtgttctctggctagatcacag

SEQ ID NO: 130163 - DNA, 22 bp, Artificial Sequence
  chemically synthesized
tctggctagatcacaggaaaat

SEQ ID NO: 130164 - DNA, 22 bp, Artificial Sequence
  chemically synthesized
tggctagatcacaggaaaatga

SEQ ID NO: 130165 - DNA, 22 bp, Artificial Sequence
  chemically synthesized
gctagatcacaggaaaatgagc

SEQ ID NO: 130166 - DNA, 22 bp, Artificial Sequence
  chemically synthesized
gatcacaggaaaatgagccatg

SEQ ID NO: 130167 - DNA, 22 bp, Artificial Sequence
  chemically synthesized
cttcctccaggcctatctaatc

SEQ ID NO: 130168 - DNA, 22 bp, Artificial Sequence
  chemically synthesized
cctccaggcctatctaatccac

SEQ ID NO: 130169 - DNA, 22 bp, Artificial Sequence
  chemically synthesized
ctccaggcctatctaatccact

SEQ ID NO: 130170 - DNA, 22 bp, Artificial Sequence
  chemically synthesized
caggcctatctaatccactccc

SEQ ID NO: 130171 - DNA, 22 bp, Artificial Sequence
  chemically synthesized
tctaatccactccctctctatc

SEQ ID NO: 130172 - DNA, 22 bp, Artificial Sequence
  chemically synthesized
atccactccctctctatcgtgg

SEQ ID NO: 130173 - DNA, 22 bp, Artificial Sequence
  chemically synthesized
cctctctatcgtggagtccaga

SEQ ID NO: 130174 - DNA, 22 bp, Artificial Sequence
  chemically synthesized
tctatcgtggagtccagagtgt

SEQ ID NO: 130175 - DNA, 22 bp, Artificial Sequence
  chemically synthesized
tatcgtggagtccagagtgttg

SEQ ID NO: 130176 - DNA, 22 bp, Artificial Sequence
  chemically synthesized
tcgtggagtccagagtgttgct

SEQ ID NO: 130177 - DNA, 22 bp, Artificial Sequence
  chemically synthesized
ctcatcatggcccatgactgtt

SEQ ID NO: 130178 - DNA, 22 bp, Artificial Sequence
  chemically synthesized
atcatggcccatgactgtttta

SEQ ID NO: 130179 - DNA, 22 bp, Artificial Sequence
  chemically synthesized
ttttattggcatccataatccc

SEQ ID NO: 130180 - DNA, 22 bp, Artificial Sequence
  chemically synthesized
tattggcatccataatcccctg

SEQ ID NO: 130181 - DNA, 22 bp, Artificial Sequence
  chemically synthesized
attggcatccataatcccctga

SEQ ID NO: 130182 - DNA, 22 bp, Artificial Sequence
  chemically synthesized
ttggcatccataatcccctgag

SEQ ID NO: 130183 - DNA, 22 bp, Artificial Sequence
  chemically synthesized
gcatccataatcccctgagata

SEQ ID NO: 130184 - DNA, 22 bp, Artificial Sequence
  chemically synthesized
agatacacctccattctcacca

SEQ ID NO: 130185 - DNA, 22 bp, Artificial Sequence
  chemically synthesized
cattctcaccaatgctaaggtg

SEQ ID NO: 130186 - DNA, 22 bp, Artificial Sequence
  chemically synthesized
tcaccaatgctaaggtggtgaa

SEQ ID NO: 130187 - DNA, 22 bp, Artificial Sequence
  chemically synthesized
accaatgctaaggtggtgaaga

SEQ ID NO: 130188 - DNA, 22 bp, Artificial Sequence
  chemically synthesized
aggtggtgaagatagatctggg

SEQ ID NO: 130189 - DNA, 22 bp, Artificial Sequence
  chemically synthesized
ggggttcaaatgaggggatttg

SEQ ID NO: 130190 - DNA, 22 bp, Artificial Sequence
  chemically synthesized
aaatgaggggatttgttatgct

SEQ ID NO: 130191 - DNA, 22 bp, Artificial Sequence
  chemically synthesized
gttatgctaattgtgcccataa

SEQ ID NO: 130192 - DNA, 22 bp, Artificial Sequence
  chemically synthesized
ttatgctaattgtgcccataat

SEQ ID NO: 130193 - DNA, 22 bp, Artificial Sequence
  chemically synthesized
tgctaattgtgcccataatcat

SEQ ID NO: 130194 - DNA, 22 bp, Artificial Sequence
  chemically synthesized
attgtgcccataatcatcaccc

SEQ ID NO: 130195 - DNA, 22 bp, Artificial Sequence
  chemically synthesized
tgcccataatcatcaccctctc

SEQ ID NO: 130196 - DNA, 22 bp, Artificial Sequence
  chemically synthesized
tctggattcccctactgtcaat

SEQ ID NO: 130197 - DNA, 22 bp, Artificial Sequence
  chemically synthesized
tggattcccctactgtcaatcc

SEQ ID NO: 130198 - DNA, 22 bp, Artificial Sequence
  chemically synthesized
gattcccctactgtcaatccca

SEQ ID NO: 130199 - DNA, 22 bp, Artificial Sequence
  chemically synthesized
ccctactgtcaatcccatgtcc

SEQ ID NO: 130200 - DNA, 22 bp, Artificial Sequence
  chemically synthesized
ctgtcaatcccatgtcctctcc

SEQ ID NO: 130201 - DNA, 22 bp, Artificial Sequence
  chemically synthesized
tcaatcccatgtcctctcccat

SEQ ID NO: 130202 - DNA, 22 bp, Artificial Sequence
  chemically synthesized
tcccatgctttctgcctgcacc

SEQ ID NO: 130203 - DNA, 22 bp, Artificial Sequence
  chemically synthesized
ccatgctttctgcctgcaccag

SEQ ID NO: 130204 - DNA, 22 bp, Artificial Sequence
  chemically synthesized
tctgcctgcaccagatgtgatc

SEQ ID NO: 130205 - DNA, 22 bp, Artificial Sequence
  chemically synthesized
ctgcctgcaccagatgtgatca

SEQ ID NO: 130206 - DNA, 22 bp, Artificial Sequence
  chemically synthesized
tgcctgcaccagatgtgatcaa

SEQ ID NO: 130207 - DNA, 22 bp, Artificial Sequence
  chemically synthesized
cctgcaccagatgtgatcaaac

SEQ ID NO: 130208 - DNA, 22 bp, Artificial Sequence
  chemically synthesized
caccagatgtgatcaaactggc

SEQ ID NO: 130209 - DNA, 22 bp, Artificial Sequence
  chemically synthesized
gcctgtgcagacatcaccttta

SEQ ID NO: 130210 - DNA, 22 bp, Artificial Sequence
  chemically synthesized
tgcagacatcacctttaataga

SEQ ID NO: 130211 - DNA, 22 bp, Artificial Sequence
  chemically synthesized
taatagactttatcctatagtc

SEQ ID NO: 130212 - DNA, 22 bp, Artificial Sequence
  chemically synthesized
aatagactttatcctatagtcc

SEQ ID NO: 130213 - DNA, 22 bp, Artificial Sequence
  chemically synthesized
atagactttatcctatagtcct

SEQ ID NO: 130214 - DNA, 22 bp, Artificial Sequence
  chemically synthesized
tatcctatagtcctggtctcat

SEQ ID NO: 130215 - DNA, 22 bp, Artificial Sequence
  chemically synthesized
atcctatagtcctggtctcatc

SEQ ID NO: 130216 - DNA, 22 bp, Artificial Sequence
  chemically synthesized
tcctatagtcctggtctcatca

SEQ ID NO: 130217 - DNA, 22 bp, Artificial Sequence
  chemically synthesized
tagtcctggtctcatcaactgg

SEQ ID NO: 130218 - DNA, 22 bp, Artificial Sequence
  chemically synthesized
gtctcatcaactggtttcttgg

SEQ ID NO: 130219 - DNA, 22 bp, Artificial Sequence
  chemically synthesized
atcaactggtttcttggacttt

SEQ ID NO: 130220 - DNA, 22 bp, Artificial Sequence
  chemically synthesized
gtttcttggactttgtgcttat

SEQ ID NO: 130221 - DNA, 22 bp, Artificial Sequence
  chemically synthesized
cttggactttgtgcttatcctt

SEQ ID NO: 130222 - DNA, 22 bp, Artificial Sequence
  chemically synthesized
ttggactttgtgcttatcctta

SEQ ID NO: 130223 - DNA, 22 bp, Artificial Sequence
  chemically synthesized
ggactttgtgcttatccttatc

SEQ ID NO: 130224 - DNA, 22 bp, Artificial Sequence
  chemically synthesized
gactttgtgcttatccttatct

SEQ ID NO: 130225 - DNA, 22 bp, Artificial Sequence
  chemically synthesized
tgtgcttatccttatctcttac

SEQ ID NO: 130226 - DNA, 22 bp, Artificial Sequence
  chemically synthesized
gtgcttatccttatctcttaca

SEQ ID NO: 130227 - DNA, 22 bp, Artificial Sequence
  chemically synthesized
tgcttatccttatctcttacat

SEQ ID NO: 130228 - DNA, 22 bp, Artificial Sequence
  chemically synthesized
atccttatctcttacattctga

SEQ ID NO: 130229 - DNA, 22 bp, Artificial Sequence
  chemically synthesized
tccttatctcttacattctgat

SEQ ID NO: 130230 - DNA, 22 bp, Artificial Sequence
  chemically synthesized
atctcttacattctgatcctta

SEQ ID NO: 130231 - DNA, 22 bp, Artificial Sequence
  chemically synthesized
tctcttacattctgatccttaa

SEQ ID NO: 130232 - DNA, 22 bp, Artificial Sequence
  chemically synthesized
ttacattctgatccttaagaag

SEQ ID NO: 130233 - DNA, 22 bp, Artificial Sequence
  chemically synthesized
acattctgatccttaagaaggt

SEQ ID NO: 130234 - DNA, 22 bp, Artificial Sequence
  chemically synthesized
cattctgatccttaagaaggtc

SEQ ID NO: 130235 - DNA, 22 bp, Artificial Sequence
  chemically synthesized
tgatccttaagaaggtcatggg

SEQ ID NO: 130236 - DNA, 22 bp, Artificial Sequence
  chemically synthesized
atccttaagaaggtcatgggaa

SEQ ID NO: 130237 - DNA, 22 bp, Artificial Sequence
  chemically synthesized
aagaaggtcatgggaattgcct

SEQ ID NO: 130238 - DNA, 22 bp, Artificial Sequence
  chemically synthesized
agaaggtcatgggaattgcctc

SEQ ID NO: 130239 - DNA, 22 bp, Artificial Sequence
  chemically synthesized
cctcagacaaggagcagactaa

SEQ ID NO: 130240 - DNA, 22 bp, Artificial Sequence
  chemically synthesized
agacaaggagcagactaaggcc

SEQ ID NO: 130241 - DNA, 22 bp, Artificial Sequence
  chemically synthesized
aggccctaaatacttgtatttc

SEQ ID NO: 130242 - DNA, 22 bp, Artificial Sequence
  chemically synthesized
aatacttgtatttctcacatta

SEQ ID NO: 130243 - DNA, 22 bp, Artificial Sequence
  chemically synthesized
gtatttctcacattagctgtgt

SEQ ID NO: 130244 - DNA, 22 bp, Artificial Sequence
  chemically synthesized
tatttctcacattagctgtgtt

SEQ ID NO: 130245 - DNA, 22 bp, Artificial Sequence
  chemically synthesized
ctcacattagctgtgttctggt

SEQ ID NO: 130246 - DNA, 22 bp, Artificial Sequence
  chemically synthesized
tcacattagctgtgttctggtt

SEQ ID NO: 130247 - DNA, 22 bp, Artificial Sequence
  chemically synthesized
acattagctgtgttctggtttt

SEQ ID NO: 130248 - DNA, 22 bp, Artificial Sequence
  chemically synthesized
gctgtgttctggtttttaatgt

SEQ ID NO: 130249 - DNA, 22 bp, Artificial Sequence
  chemically synthesized
tgttctggtttttaatgtcact

SEQ ID NO: 130250 - DNA, 22 bp, Artificial Sequence
  chemically synthesized
tggtttttaatgtcacttgatt

SEQ ID NO: 130251 - DNA, 22 bp, Artificial Sequence
  chemically synthesized
gtttttaatgtcacttgattgg

SEQ ID NO: 130252 - DNA, 22 bp, Artificial Sequence
  chemically synthesized
ttaatgtcacttgattgggcta

SEQ ID NO: 130253 - DNA, 22 bp, Artificial Sequence
  chemically synthesized
taatgtcacttgattgggctac

SEQ ID NO: 130254 - DNA, 22 bp, Artificial Sequence
  chemically synthesized
aatgtcacttgattgggctacc

SEQ ID NO: 130255 - DNA, 22 bp, Artificial Sequence
  chemically synthesized
atgtcacttgattgggctacca

SEQ ID NO: 130256 - DNA, 22 bp, Artificial Sequence
  chemically synthesized
gattgggctaccaccctttcag

SEQ ID NO: 130257 - DNA, 22 bp, Artificial Sequence
  chemically synthesized
attgggctaccaccctttcaga

SEQ ID NO: 130258 - DNA, 22 bp, Artificial Sequence
  chemically synthesized
ggctaccaccctttcagacact

SEQ ID NO: 130259 - DNA, 22 bp, Artificial Sequence
  chemically synthesized
ccaccctttcagacactgtgct

SEQ ID NO: 130260 - DNA, 22 bp, Artificial Sequence
  chemically synthesized
tcagacactgtgcttcatcaaa

SEQ ID NO: 130261 - DNA, 22 bp, Artificial Sequence
  chemically synthesized
cagacactgtgcttcatcaaaa

SEQ ID NO: 130262 - DNA, 22 bp, Artificial Sequence
  chemically synthesized
agacactgtgcttcatcaaaaa

SEQ ID NO: 130263 - DNA, 22 bp, Artificial Sequence
  chemically synthesized
tgcttcatcaaaaaaatgttaa

SEQ ID NO: 130264 - DNA, 22 bp, Artificial Sequence
  chemically synthesized
catcaaaaaaatgttaagaata

SEQ ID NO: 130265 - DNA, 22 bp, Artificial Sequence
  chemically synthesized
atcaaaaaaatgttaagaataa

SEQ ID NO: 130266 - DNA, 22 bp, Artificial Sequence
  chemically synthesized
agaataaaaattatttcacaca

SEQ ID NO: 130267 - DNA, 22 bp, Artificial Sequence
  chemically synthesized
tttcacacatactttaaaacta

SEQ ID NO: 130268 - DNA, 22 bp, Artificial Sequence
  chemically synthesized
cacacatactttaaaactaaca

SEQ ID NO: 130269 - DNA, 22 bp, Artificial Sequence
  chemically synthesized
acacatactttaaaactaacac

SEQ ID NO: 130270 - DNA, 22 bp, Artificial Sequence
  chemically synthesized
taaaactaacacgtcacaatgc

SEQ ID NO: 130271 - DNA, 22 bp, Artificial Sequence
  chemically synthesized
aaaactaacacgtcacaatgca

SEQ ID NO: 130272 - DNA, 22 bp, Artificial Sequence
  chemically synthesized
aaactaacacgtcacaatgcaa

SEQ ID NO: 130273 - DNA, 22 bp, Artificial Sequence
  chemically synthesized
acacgtcacaatgcaaatcaaa

SEQ ID NO: 130274 - DNA, 22 bp, Artificial Sequence
  chemically synthesized
acaccagttagaatggcaatca

SEQ ID NO: 130275 - DNA, 22 bp, Artificial Sequence
  chemically synthesized
gaatggcaatcattaaaaagtc

SEQ ID NO: 130276 - DNA, 22 bp, Artificial Sequence
  chemically synthesized
aaaagtcagggaacaacaggtg

SEQ ID NO: 130277 - DNA, 22 bp, Artificial Sequence
  chemically synthesized
gagaggatgtggagaaatagga

SEQ ID NO: 130278 - DNA, 22 bp, Artificial Sequence
  chemically synthesized
ttacactcttggtgggactgta

SEQ ID NO: 130279 - DNA, 22 bp, Artificial Sequence
  chemically synthesized
tacactcttggtgggactgtaa

SEQ ID NO: 130280 - DNA, 22 bp, Artificial Sequence
  chemically synthesized
acactcttggtgggactgtaaa

SEQ ID NO: 130281 - DNA, 22 bp, Artificial Sequence
  chemically synthesized
cactcttggtgggactgtaaac

SEQ ID NO: 130282 - DNA, 22 bp, Artificial Sequence
  chemically synthesized
ttggtgggactgtaaactagtt

SEQ ID NO: 130283 - DNA, 22 bp, Artificial Sequence
  chemically synthesized
ggtgggactgtaaactagttca

SEQ ID NO: 130284 - DNA, 22 bp, Artificial Sequence
  chemically synthesized
gtgggactgtaaactagttcaa

SEQ ID NO: 130285 - DNA, 22 bp, Artificial Sequence
  chemically synthesized
taaactagttcaaccattgtgg

SEQ ID NO: 130286 - DNA, 22 bp, Artificial Sequence
  chemically synthesized
gttcaaccattgtggaagtcag

SEQ ID NO: 130287 - DNA, 22 bp, Artificial Sequence
  chemically synthesized
aaccattgtggaagtcagtgtg

SEQ ID NO: 130288 - DNA, 22 bp, Artificial Sequence
  chemically synthesized
tggaagtcagtgtggcgattcc

SEQ ID NO: 130289 - DNA, 22 bp, Artificial Sequence
  chemically synthesized
ctcagggatctagaactagaaa

SEQ ID NO: 130290 - DNA, 22 bp, Artificial Sequence
  chemically synthesized
agggatctagaactagaaatac

SEQ ID NO: 130291 - DNA, 22 bp, Artificial Sequence
  chemically synthesized
gaactagaaataccatttgacc

SEQ ID NO: 130292 - DNA, 22 bp, Artificial Sequence
  chemically synthesized
gaaataccatttgacccagcca

SEQ ID NO: 130293 - DNA, 22 bp, Artificial Sequence
  chemically synthesized
gacccagccatcccattactgg

SEQ ID NO: 130294 - DNA, 22 bp, Artificial Sequence
  chemically synthesized
acccagccatcccattactggg

SEQ ID NO: 130295 - DNA, 22 bp, Artificial Sequence
  chemically synthesized
ctgggtatatacccaacggatt

SEQ ID NO: 130296 - DNA, 22 bp, Artificial Sequence
  chemically synthesized
ggtatatacccaacggattata

SEQ ID NO: 130297 - DNA, 22 bp, Artificial Sequence
  chemically synthesized
taaatcatgctgctataaagac

SEQ ID NO: 130298 - DNA, 22 bp, Artificial Sequence
  chemically synthesized
ctataaagacacatgcacacgt

SEQ ID NO: 130299 - DNA, 22 bp, Artificial Sequence
  chemically synthesized
taaagacacatgcacacgtatg

SEQ ID NO: 130300 - DNA, 22 bp, Artificial Sequence
  chemically synthesized
actgtggcactattcacaatag

SEQ ID NO: 130301 - DNA, 22 bp, Artificial Sequence
  chemically synthesized
ctgtggcactattcacaatagc

SEQ ID NO: 130302 - DNA, 22 bp, Artificial Sequence
  chemically synthesized
tggcactattcacaatagcaaa

SEQ ID NO: 130303 - DNA, 22 bp, Artificial Sequence
  chemically synthesized
ttcacaatagcaaagacttgga

SEQ ID NO: 130304 - DNA, 22 bp, Artificial Sequence
  chemically synthesized
acaatagcaaagacttggaacc

SEQ ID NO: 130305 - DNA, 22 bp, Artificial Sequence
  chemically synthesized
ggaaccaacccaaatgtccaac

SEQ ID NO: 130306 - DNA, 22 bp, Artificial Sequence
  chemically synthesized
gaaccaacccaaatgtccaaca

SEQ ID NO: 130307 - DNA, 22 bp, Artificial Sequence
  chemically synthesized
aattaagaaaatgtggcacata

SEQ ID NO: 130308 - DNA, 22 bp, Artificial Sequence
  chemically synthesized
agaaaatgtggcacatatacac

SEQ ID NO: 130309 - DNA, 22 bp, Artificial Sequence
  chemically synthesized
tgcagccataaaaaatgaagag

SEQ ID NO: 130310 - DNA, 22 bp, Artificial Sequence
  chemically synthesized
atgtcatttgtagggacatgga

SEQ ID NO: 130311 - DNA, 22 bp, Artificial Sequence
  chemically synthesized
gtagggacatggatgaaactgg

SEQ ID NO: 130312 - DNA, 22 bp, Artificial Sequence
  chemically synthesized
tagggacatggatgaaactgga

SEQ ID NO: 130313 - DNA, 22 bp, Artificial Sequence
  chemically synthesized
gaaaccatcattctcagcaaac

SEQ ID NO: 130314 - DNA, 22 bp, Artificial Sequence
  chemically synthesized
tcagcaaactatcgcaaggaca

SEQ ID NO: 130315 - DNA, 22 bp, Artificial Sequence
  chemically synthesized
agcaaactatcgcaaggacaaa

SEQ ID NO: 130316 - DNA, 22 bp, Artificial Sequence
  chemically synthesized
tcgcaaggacaaaaaaccaagc

SEQ ID NO: 130317 - DNA, 22 bp, Artificial Sequence
  chemically synthesized
catgttctcactcataggtggg

SEQ ID NO: 130318 - DNA, 22 bp, Artificial Sequence
  chemically synthesized
tcactcataggtgggaattgaa

SEQ ID NO: 130319 - DNA, 22 bp, Artificial Sequence
  chemically synthesized
actcataggtgggaattgaaca

SEQ ID NO: 130320 - DNA, 22 bp, Artificial Sequence
  chemically synthesized
ataggtgggaattgaacaatga

SEQ ID NO: 130321 - DNA, 22 bp, Artificial Sequence
  chemically synthesized
aacaatgagaacacatggacac

SEQ ID NO: 130322 - DNA, 22 bp, Artificial Sequence
  chemically synthesized
cggggactgttgtgaggtgggg

SEQ ID NO: 130323 - DNA, 22 bp, Artificial Sequence
  chemically synthesized
ttgtgaggtggggggaaggggg

SEQ ID NO: 130324 - DNA, 22 bp, Artificial Sequence
  chemically synthesized
tgaggtggggggaagggggaga

SEQ ID NO: 130325 - DNA, 22 bp, Artificial Sequence
  chemically synthesized
ggagatatacctaatgctaagt

SEQ ID NO: 130326 - DNA, 22 bp, Artificial Sequence
  chemically synthesized
atgctaagtgacaagttaatgg

SEQ ID NO: 130327 - DNA, 22 bp, Artificial Sequence
  chemically synthesized
agtgacaagttaatgggtgcag

SEQ ID NO: 130328 - DNA, 22 bp, Artificial Sequence
  chemically synthesized
atgggtgcagcacaccaacatg

SEQ ID NO: 130329 - DNA, 22 bp, Artificial Sequence
  chemically synthesized
cacattgtgcacatgtacccta

SEQ ID NO: 130330 - DNA, 22 bp, Artificial Sequence
  chemically synthesized
tgcacatgtaccctaaaactta

SEQ ID NO: 130331 - DNA, 22 bp, Artificial Sequence
  chemically synthesized
aaacttaaagtataataataat

SEQ ID NO: 130332 - DNA, 22 bp, Artificial Sequence
  chemically synthesized
aaagtataataataataataat

SEQ ID NO: 130333 - DNA, 22 bp, Artificial Sequence
  chemically synthesized
aagtataataataataataata

SEQ ID NO: 130334 - DNA, 22 bp, Artificial Sequence
  chemically synthesized
ttttggattaacaaaaaccaac

SEQ ID NO: 130335 - DNA, 22 bp, Artificial Sequence
  chemically synthesized
tggattaacaaaaaccaacagg

SEQ ID NO: 130336 - DNA, 22 bp, Artificial Sequence
  chemically synthesized
ggattaacaaaaaccaacaggc

SEQ ID NO: 130337 - DNA, 22 bp, Artificial Sequence
  chemically synthesized
gattaacaaaaaccaacaggct

SEQ ID NO: 130338 - DNA, 22 bp, Artificial Sequence
  chemically synthesized
acaaaaaccaacaggctaccac

SEQ ID NO: 130339 - DNA, 22 bp, Artificial Sequence
  chemically synthesized
ccacagattctctttgtgttca

SEQ ID NO: 130340 - DNA, 22 bp, Artificial Sequence
  chemically synthesized
tctttgtgttcaattttctcac

SEQ ID NO: 130341 - DNA, 22 bp, Artificial Sequence
  chemically synthesized
tttgtgttcaattttctcacat

SEQ ID NO: 130342 - DNA, 22 bp, Artificial Sequence
  chemically synthesized
tgtgttcaattttctcacatgt

SEQ ID NO: 130343 - DNA, 22 bp, Artificial Sequence
  chemically synthesized
gtgttcaattttctcacatgtt

SEQ ID NO: 130344 - DNA, 22 bp, Artificial Sequence
  chemically synthesized
tgttcaattttctcacatgttt

SEQ ID NO: 130345 - DNA, 22 bp, Artificial Sequence
  chemically synthesized
aattttctcacatgttttgtta

SEQ ID NO: 130346 - DNA, 22 bp, Artificial Sequence
  chemically synthesized
tctcacatgttttgttattctg

SEQ ID NO: 130347 - DNA, 22 bp, Artificial Sequence
  chemically synthesized
ctcacatgttttgttattctgg

SEQ ID NO: 130348 - DNA, 22 bp, Artificial Sequence
  chemically synthesized
tcacatgttttgttattctggc

SEQ ID NO: 130349 - DNA, 22 bp, Artificial Sequence
  chemically synthesized
acatgttttgttattctggctc

SEQ ID NO: 130350 - DNA, 22 bp, Artificial Sequence
  chemically synthesized
tgttattctggctctgctagaa

SEQ ID NO: 130351 - DNA, 22 bp, Artificial Sequence
  chemically synthesized
gttattctggctctgctagaat

SEQ ID NO: 130352 - DNA, 22 bp, Artificial Sequence
  chemically synthesized
ttattctggctctgctagaatt

SEQ ID NO: 130353 - DNA, 22 bp, Artificial Sequence
  chemically synthesized
ttctggctctgctagaattctc

SEQ ID NO: 130354 - DNA, 22 bp, Artificial Sequence
  chemically synthesized
tggctctgctagaattctcttg

SEQ ID NO: 130355 - DNA, 22 bp, Artificial Sequence
  chemically synthesized
gctctgctagaattctcttgat

SEQ ID NO: 130356 - DNA, 22 bp, Artificial Sequence
  chemically synthesized
tgctagaattctcttgatttga

SEQ ID NO: 130357 - DNA, 22 bp, Artificial Sequence
  chemically synthesized
ctagaattctcttgatttgagt

SEQ ID NO: 130358 - DNA, 22 bp, Artificial Sequence
  chemically synthesized
gaattctcttgatttgagtttg

SEQ ID NO: 130359 - DNA, 22 bp, Artificial Sequence
  chemically synthesized
tcttgatttgagtttgtcatat

SEQ ID NO: 130360 - DNA, 22 bp, Artificial Sequence
  chemically synthesized
ttgatttgagtttgtcatattt

SEQ ID NO: 130361 - DNA, 22 bp, Artificial Sequence
  chemically synthesized
gatttgagtttgtcatattttc

SEQ ID NO: 130362 - DNA, 22 bp, Artificial Sequence
  chemically synthesized
atttgagtttgtcatattttct

SEQ ID NO: 130363 - DNA, 22 bp, Artificial Sequence
  chemically synthesized
gagtttgtcatattttctcttt

SEQ ID NO: 130364 - DNA, 22 bp, Artificial Sequence
  chemically synthesized
agtttgtcatattttctctttc

SEQ ID NO: 130365 - DNA, 22 bp, Artificial Sequence
  chemically synthesized
gtcatattttctctttccccat

SEQ ID NO: 130366 - DNA, 22 bp, Artificial Sequence
  chemically synthesized
tcatattttctctttccccata

SEQ ID NO: 130367 - DNA, 22 bp, Artificial Sequence
  chemically synthesized
tctctttccccatagcctgtgt

SEQ ID NO: 130368 - DNA, 22 bp, Artificial Sequence
  chemically synthesized
ctctttccccatagcctgtgta

SEQ ID NO: 130369 - DNA, 22 bp, Artificial Sequence
  chemically synthesized
tctttccccatagcctgtgtat

SEQ ID NO: 130370 - DNA, 22 bp, Artificial Sequence
  chemically synthesized
tttccccatagcctgtgtattt

SEQ ID NO: 130371 - DNA, 22 bp, Artificial Sequence
  chemically synthesized
tccccatagcctgtgtattttt

SEQ ID NO: 130372 - DNA, 22 bp, Artificial Sequence
  chemically synthesized
ccccatagcctgtgtatttttt

SEQ ID NO: 130373 - DNA, 22 bp, Artificial Sequence
  chemically synthesized
cccatagcctgtgtattttttc

SEQ ID NO: 130374 - DNA, 22 bp, Artificial Sequence
  chemically synthesized
tgtattttttcttcctttataa

SEQ ID NO: 130375 - DNA, 22 bp, Artificial Sequence
  chemically synthesized
tttcttcctttataaactgtac

SEQ ID NO: 130376 - DNA, 22 bp, Artificial Sequence
  chemically synthesized
ttcttcctttataaactgtacc

SEQ ID NO: 130377 - DNA, 22 bp, Artificial Sequence
  chemically synthesized
tcttcctttataaactgtaccc

SEQ ID NO: 130378 - DNA, 22 bp, Artificial Sequence
  chemically synthesized
cttcctttataaactgtacccc

SEQ ID NO: 130379 - DNA, 22 bp, Artificial Sequence
  chemically synthesized
ttcctttataaactgtacccca

SEQ ID NO: 130380 - DNA, 22 bp, Artificial Sequence
  chemically synthesized
cctttataaactgtaccccact

SEQ ID NO: 130381 - DNA, 22 bp, Artificial Sequence
  chemically synthesized
ctttataaactgtaccccactt

SEQ ID NO: 130382 - DNA, 22 bp, Artificial Sequence
  chemically synthesized
tataaactgtaccccacttata

SEQ ID NO: 130383 - DNA, 22 bp, Artificial Sequence
  chemically synthesized
ataaactgtaccccacttatac

SEQ ID NO: 130384 - DNA, 22 bp, Artificial Sequence
  chemically synthesized
taaactgtaccccacttataca

SEQ ID NO: 130385 - DNA, 22 bp, Artificial Sequence
  chemically synthesized
taccccacttatacaaacacta

SEQ ID NO: 130386 - DNA, 22 bp, Artificial Sequence
  chemically synthesized
atacaaacactatatttgttac

SEQ ID NO: 130387 - DNA, 22 bp, Artificial Sequence
  chemically synthesized
tacaaacactatatttgttacc

SEQ ID NO: 130388 - DNA, 22 bp, Artificial Sequence
  chemically synthesized
tatttgttaccttccttgtttt

SEQ ID NO: 130389 - DNA, 22 bp, Artificial Sequence
  chemically synthesized
gttaccttccttgtttttcaat

SEQ ID NO: 130390 - DNA, 22 bp, Artificial Sequence
  chemically synthesized
ttaccttccttgtttttcaatt

SEQ ID NO: 130391 - DNA, 22 bp, Artificial Sequence
  chemically synthesized
ccttccttgtttttcaattatt

SEQ ID NO: 130392 - DNA, 22 bp, Artificial Sequence
  chemically synthesized
ccttgtttttcaattattagct

SEQ ID NO: 130393 - DNA, 22 bp, Artificial Sequence
  chemically synthesized
cttgtttttcaattattagctt

SEQ ID NO: 130394 - DNA, 22 bp, Artificial Sequence
  chemically synthesized
gtttttcaattattagcttaaa

SEQ ID NO: 130395 - DNA, 22 bp, Artificial Sequence
  chemically synthesized
tttttcaattattagcttaaat

SEQ ID NO: 130396 - DNA, 22 bp, Artificial Sequence
  chemically synthesized
ttcaattattagcttaaataat

SEQ ID NO: 130397 - DNA, 22 bp, Artificial Sequence
  chemically synthesized
tcaattattagcttaaataata

SEQ ID NO: 130398 - DNA, 22 bp, Artificial Sequence
  chemically synthesized
caattattagcttaaataatat

SEQ ID NO: 130399 - DNA, 22 bp, Artificial Sequence
  chemically synthesized
aattattagcttaaataatatt

SEQ ID NO: 130400 - DNA, 22 bp, Artificial Sequence
  chemically synthesized
ttagcttaaataatatttcttt

SEQ ID NO: 130401 - DNA, 22 bp, Artificial Sequence
  chemically synthesized
gcttaaataatatttcttttga

SEQ ID NO: 130402 - DNA, 22 bp, Artificial Sequence
  chemically synthesized
aaataatatttcttttgagaaa

SEQ ID NO: 130403 - DNA, 22 bp, Artificial Sequence
  chemically synthesized
aataatatttcttttgagaaat

SEQ ID NO: 130404 - DNA, 22 bp, Artificial Sequence
  chemically synthesized
cttttgagaaattttcccctgc

SEQ ID NO: 130405 - DNA, 22 bp, Artificial Sequence
  chemically synthesized
ttttgagaaattttcccctgcc

SEQ ID NO: 130406 - DNA, 22 bp, Artificial Sequence
  chemically synthesized
ttgagaaattttcccctgcccc

SEQ ID NO: 130407 - DNA, 22 bp, Artificial Sequence
  chemically synthesized
tgagaaattttcccctgcccca

SEQ ID NO: 130408 - DNA, 22 bp, Artificial Sequence
  chemically synthesized
gagaaattttcccctgccccaa

SEQ ID NO: 130409 - DNA, 22 bp, Artificial Sequence
  chemically synthesized
agaaattttcccctgccccaaa

SEQ ID NO: 130410 - DNA, 22 bp, Artificial Sequence
  chemically synthesized
tcccctgccccaaagatgcttt

SEQ ID NO: 130411 - DNA, 22 bp, Artificial Sequence
  chemically synthesized
cccctgccccaaagatgctttc

SEQ ID NO: 130412 - DNA, 22 bp, Artificial Sequence
  chemically synthesized
ccctgccccaaagatgctttct

SEQ ID NO: 130413 - DNA, 22 bp, Artificial Sequence
  chemically synthesized
ccccaaagatgctttctgtggg

SEQ ID NO: 130414 - DNA, 22 bp, Artificial Sequence
  chemically synthesized
tctgtgggctccctttagcatg

SEQ ID NO: 130415 - DNA, 22 bp, Artificial Sequence
  chemically synthesized
ctgtgggctccctttagcatgc

SEQ ID NO: 130416 - DNA, 22 bp, Artificial Sequence
  chemically synthesized
tgtgggctccctttagcatgct

SEQ ID NO: 130417 - DNA, 22 bp, Artificial Sequence
  chemically synthesized
tgggctccctttagcatgctac

SEQ ID NO: 130418 - DNA, 22 bp, Artificial Sequence
  chemically synthesized
cctttagcatgctaccatctat

SEQ ID NO: 130419 - DNA, 22 bp, Artificial Sequence
  chemically synthesized
tagcatgctaccatctatgcag

SEQ ID NO: 130420 - DNA, 22 bp, Artificial Sequence
  chemically synthesized
agcatgctaccatctatgcagt

SEQ ID NO: 130421 - DNA, 22 bp, Artificial Sequence
  chemically synthesized
gcatgctaccatctatgcagta

SEQ ID NO: 130422 - DNA, 22 bp, Artificial Sequence
  chemically synthesized
ccatctatgcagtaatgatagt

SEQ ID NO: 130423 - DNA, 22 bp, Artificial Sequence
  chemically synthesized
tgcagtaatgatagtgctatga

SEQ ID NO: 130424 - DNA, 22 bp, Artificial Sequence
  chemically synthesized
tgaaaatttgtggtaactattt

SEQ ID NO: 130425 - DNA, 22 bp, Artificial Sequence
  chemically synthesized
gtggtaactattttctttatat

SEQ ID NO: 130426 - DNA, 22 bp, Artificial Sequence
  chemically synthesized
tggtaactattttctttatatt

SEQ ID NO: 130427 - DNA, 22 bp, Artificial Sequence
  chemically synthesized
ttttctttatattacacactat

SEQ ID NO: 130428 - DNA, 22 bp, Artificial Sequence
  chemically synthesized
tctttatattacacactattta

SEQ ID NO: 130429 - DNA, 22 bp, Artificial Sequence
  chemically synthesized
ctttatattacacactatttac

SEQ ID NO: 130430 - DNA, 22 bp, Artificial Sequence
  chemically synthesized
tttatattacacactatttaca

SEQ ID NO: 130431 - DNA, 22 bp, Artificial Sequence
  chemically synthesized
tatattacacactatttacatt

SEQ ID NO: 130432 - DNA, 22 bp, Artificial Sequence
  chemically synthesized
atattacacactatttacattc

SEQ ID NO: 130433 - DNA, 22 bp, Artificial Sequence
  chemically synthesized
tattacacactatttacattct

SEQ ID NO: 130434 - DNA, 22 bp, Artificial Sequence
  chemically synthesized
cacactatttacattctgtgaa

SEQ ID NO: 130435 - DNA, 22 bp, Artificial Sequence
  chemically synthesized
tttacattctgtgaataaagac

SEQ ID NO: 130436 - DNA, 22 bp, Artificial Sequence
  chemically synthesized
acattctgtgaataaagactat

SEQ ID NO: 130437 - DNA, 22 bp, Artificial Sequence
  chemically synthesized
cattctgtgaataaagactatg

SEQ ID NO: 130438 - DNA, 22 bp, Artificial Sequence
  chemically synthesized
tgtgaataaagactatgctcct

SEQ ID NO: 130439 - DNA, 22 bp, Artificial Sequence
  chemically synthesized
tgaataaagactatgctcctca

SEQ ID NO: 130440 - DNA, 22 bp, Artificial Sequence
  chemically synthesized
tgctcctcattgtgtatctggc

SEQ ID NO: 130441 - DNA, 22 bp, Artificial Sequence
  chemically synthesized
ctcattgtgtatctggcaaaaa

SEQ ID NO: 130442 - DNA, 22 bp, Artificial Sequence
  chemically synthesized
attgtgtatctggcaaaaaaaa

SEQ ID NO: 130443 - DNA, 22 bp, Artificial Sequence
  chemically synthesized
tgtatctggcaaaaaaaaaaaa

SEQ ID NO: 130444 - DNA, 22 bp, Artificial Sequence
  chemically synthesized
gcaaaaaaaaaaaaaaagggca

SEQ ID NO: 130445 - DNA, 22 bp, Artificial Sequence
  chemically synthesized
caagtaatataattttaagata

SEQ ID NO: 130446 - DNA, 22 bp, Artificial Sequence
  chemically synthesized
taagataaaaagctgaatgtca

SEQ ID NO: 130447 - DNA, 22 bp, Artificial Sequence
  chemically synthesized
aagataaaaagctgaatgtcag

SEQ ID NO: 130448 - DNA, 22 bp, Artificial Sequence
  chemically synthesized
agataaaaagctgaatgtcagc

SEQ ID NO: 130449 - DNA, 22 bp, Artificial Sequence
  chemically synthesized
aatgtcagccgggcgcagtgac

SEQ ID NO: 130450 - DNA, 22 bp, Artificial Sequence
  chemically synthesized
acacctgcaatcccagcacttt

SEQ ID NO: 130451 - DNA, 22 bp, Artificial Sequence
  chemically synthesized
caatcccagcactttgggaggc

SEQ ID NO: 130452 - DNA, 22 bp, Artificial Sequence
  chemically synthesized
tgggaggccaaggagggtggat

SEQ ID NO: 130453 - DNA, 22 bp, Artificial Sequence
  chemically synthesized
gggaggccaaggagggtggatc

SEQ ID NO: 130454 - DNA, 22 bp, Artificial Sequence
  chemically synthesized
ggaggccaaggagggtggatca

SEQ ID NO: 130455 - DNA, 22 bp, Artificial Sequence
  chemically synthesized
gccaatatggtgaaaccccgtg

SEQ ID NO: 130456 - DNA, 22 bp, Artificial Sequence
  chemically synthesized
ctaaaaatacaaaaattagctg

SEQ ID NO: 130457 - DNA, 22 bp, Artificial Sequence
  chemically synthesized
aaaatacaaaaattagctgggt

SEQ ID NO: 130458 - DNA, 22 bp, Artificial Sequence
  chemically synthesized
gctgggtgtggtgacgcgctac

SEQ ID NO: 130459 - DNA, 22 bp, Artificial Sequence
  chemically synthesized
ggtgtggtgacgcgctactgta

SEQ ID NO: 130460 - DNA, 22 bp, Artificial Sequence
  chemically synthesized
ctgtagtcccagcttctcagga

SEQ ID NO: 130461 - DNA, 22 bp, Artificial Sequence
  chemically synthesized
tagtcccagcttctcaggaggc

SEQ ID NO: 130462 - DNA, 22 bp, Artificial Sequence
  chemically synthesized
ctcaggaggctgtggcaggaga

SEQ ID NO: 130463 - DNA, 22 bp, Artificial Sequence
  chemically synthesized
tcaggaggctgtggcaggagaa

SEQ ID NO: 130464 - DNA, 22 bp, Artificial Sequence
  chemically synthesized
aggaggctgtggcaggagaatc

SEQ ID NO: 130465 - DNA, 22 bp, Artificial Sequence
  chemically synthesized
tggcaggagaatcacttgaacc

SEQ ID NO: 130466 - DNA, 22 bp, Artificial Sequence
  chemically synthesized
gaacctgggaggtggagtttgc

SEQ ID NO: 130467 - DNA, 22 bp, Artificial Sequence
  chemically synthesized
aacctgggaggtggagtttgca

SEQ ID NO: 130468 - DNA, 22 bp, Artificial Sequence
  chemically synthesized
ggaggtggagtttgcagtgagc

SEQ ID NO: 130469 - DNA, 22 bp, Artificial Sequence
  chemically synthesized
gcagtgagctgagattgtgcta

SEQ ID NO: 130470 - DNA, 22 bp, Artificial Sequence
  chemically synthesized
cagtgagctgagattgtgctac

SEQ ID NO: 130471 - DNA, 22 bp, Artificial Sequence
  chemically synthesized
agattgtgctactgcactccag

SEQ ID NO: 130472 - DNA, 22 bp, Artificial Sequence
  chemically synthesized
tgctactgcactccagcctggc

SEQ ID NO: 130473 - DNA, 22 bp, Artificial Sequence
  chemically synthesized
ctgcactccagcctggcgacag

SEQ ID NO: 130474 - DNA, 22 bp, Artificial Sequence
  chemically synthesized
cactccagcctggcgacagagt

SEQ ID NO: 130475 - DNA, 22 bp, Artificial Sequence
  chemically synthesized
cagcctggcgacagagtgagac

SEQ ID NO: 130476 - DNA, 22 bp, Artificial Sequence
  chemically synthesized
gcgacagagtgagactctatct

SEQ ID NO: 130477 - DNA, 22 bp, Artificial Sequence
  chemically synthesized
tatctaaaaaaaaaaaaaaaaa

SEQ ID NO: 130478 - DNA, 22 bp, Artificial Sequence
  chemically synthesized
tctaaaaaaaaaaaaaaaaaaa

SEQ ID NO: 130479 - DNA, 22 bp, Artificial Sequence
  chemically synthesized
aaaaaaaaaaaaaaaaaaaaaa

SEQ ID NO: 130480 - DNA, 22 bp, Artificial Sequence
  chemically synthesized
aatgtcatgaatctgcatgact

SEQ ID NO: 130481 - DNA, 22 bp, Artificial Sequence
  chemically synthesized
catgactattaacagatccatt

SEQ ID NO: 130482 - DNA, 22 bp, Artificial Sequence
  chemically synthesized
ttaacagatccattgaagttcc

SEQ ID NO: 130483 - DNA, 22 bp, Artificial Sequence
  chemically synthesized
acagatccattgaagttccagt

SEQ ID NO: 130484 - DNA, 22 bp, Artificial Sequence
  chemically synthesized
aagttccagtagataagaacaa

SEQ ID NO: 130485 - DNA, 22 bp, Artificial Sequence
  chemically synthesized
cagtagataagaacaaatttta

SEQ ID NO: 130486 - DNA, 22 bp, Artificial Sequence
  chemically synthesized
taccaaagtaacaggaaagaca

SEQ ID NO: 130487 - DNA, 22 bp, Artificial Sequence
  chemically synthesized
accaaagtaacaggaaagacaa

SEQ ID NO: 130488 - DNA, 22 bp, Artificial Sequence
  chemically synthesized
ccaaagtaacaggaaagacaaa

SEQ ID NO: 130489 - DNA, 22 bp, Artificial Sequence
  chemically synthesized
gaattcataagctctaggaccc

SEQ ID NO: 130490 - DNA, 22 bp, Artificial Sequence
  chemically synthesized
ataagctctaggacccgtagag

SEQ ID NO: 130491 - DNA, 22 bp, Artificial Sequence
  chemically synthesized
taggacccgtagaggtacatat

SEQ ID NO: 130492 - DNA, 22 bp, Artificial Sequence
  chemically synthesized
ggacccgtagaggtacatatga

SEQ ID NO: 130493 - DNA, 22 bp, Artificial Sequence
  chemically synthesized
aagacaaccgatatcccctaac

SEQ ID NO: 130494 - DNA, 22 bp, Artificial Sequence
  chemically synthesized
accctttcaaataaactaagtt

SEQ ID NO: 130495 - DNA, 22 bp, Artificial Sequence
  chemically synthesized
tcaaataaactaagttatgatg

SEQ ID NO: 130496 - DNA, 22 bp, Artificial Sequence
  chemically synthesized
caaataaactaagttatgatgc

SEQ ID NO: 130497 - DNA, 22 bp, Artificial Sequence
  chemically synthesized
aaataaactaagttatgatgct

SEQ ID NO: 130498 - DNA, 22 bp, Artificial Sequence
  chemically synthesized
agttatgatgctgagcctcctt

SEQ ID NO: 130499 - DNA, 22 bp, Artificial Sequence
  chemically synthesized
tgatgctgagcctccttgggtc

SEQ ID NO: 130500 - DNA, 22 bp, Artificial Sequence
  chemically synthesized
agcctccttgggtcacataacc

SEQ ID NO: 130501 - DNA, 22 bp, Artificial Sequence
  chemically synthesized
cttgggtcacataaccaagccc

SEQ ID NO: 130502 - DNA, 22 bp, Artificial Sequence
  chemically synthesized
gggtcacataaccaagccctgg

SEQ ID NO: 130503 - DNA, 22 bp, Artificial Sequence
  chemically synthesized
ggtcacataaccaagccctggt

SEQ ID NO: 130504 - DNA, 22 bp, Artificial Sequence
  chemically synthesized
gtatccctatcttacatcagct

SEQ ID NO: 130505 - DNA, 22 bp, Artificial Sequence
  chemically synthesized
tcttacatcagctggtttttga

SEQ ID NO: 130506 - DNA, 22 bp, Artificial Sequence
  chemically synthesized
acatcagctggtttttgaattt

SEQ ID NO: 130507 - DNA, 22 bp, Artificial Sequence
  chemically synthesized
catcagctggtttttgaatttc

SEQ ID NO: 130508 - DNA, 22 bp, Artificial Sequence
  chemically synthesized
gtttttgaatttcaaattttcc

SEQ ID NO: 130509 - DNA, 22 bp, Artificial Sequence
  chemically synthesized
ttgaatttcaaattttcctcac

SEQ ID NO: 130510 - DNA, 22 bp, Artificial Sequence
  chemically synthesized
tgaatttcaaattttcctcacc

SEQ ID NO: 130511 - DNA, 22 bp, Artificial Sequence
  chemically synthesized
gaatttcaaattttcctcaccc

SEQ ID NO: 130512 - DNA, 22 bp, Artificial Sequence
  chemically synthesized
aatttcaaattttcctcacccc

SEQ ID NO: 130513 - DNA, 22 bp, Artificial Sequence
  chemically synthesized
caaattttcctcaccccattct

SEQ ID NO: 130514 - DNA, 22 bp, Artificial Sequence
  chemically synthesized
aaattttcctcaccccattctt

SEQ ID NO: 130515 - DNA, 22 bp, Artificial Sequence
  chemically synthesized
tcctcaccccattcttcaggaa

SEQ ID NO: 130516 - DNA, 22 bp, Artificial Sequence
  chemically synthesized
cctcaccccattcttcaggaaa

SEQ ID NO: 130517 - DNA, 22 bp, Artificial Sequence
  chemically synthesized
ctcaccccattcttcaggaaac

SEQ ID NO: 130518 - DNA, 22 bp, Artificial Sequence
  chemically synthesized
accccattcttcaggaaacacc

SEQ ID NO: 130519 - DNA, 22 bp, Artificial Sequence
  chemically synthesized
ttcaggaaacacctgaaaatcc

SEQ ID NO: 130520 - DNA, 22 bp, Artificial Sequence
  chemically synthesized
caggaaacacctgaaaatcccg

SEQ ID NO: 130521 - DNA, 22 bp, Artificial Sequence
  chemically synthesized
aggaaacacctgaaaatcccga

SEQ ID NO: 130522 - DNA, 22 bp, Artificial Sequence
  chemically synthesized
aaaatcccgaggacatcagttg

SEQ ID NO: 130523 - DNA, 22 bp, Artificial Sequence
  chemically synthesized
tggggccctgttcctcccgaac

SEQ ID NO: 130524 - DNA, 22 bp, Artificial Sequence
  chemically synthesized
ttcctcccgaacagagaagaga

SEQ ID NO: 130525 - DNA, 22 bp, Artificial Sequence
  chemically synthesized
ctcccgaacagagaagagaggg

SEQ ID NO: 130526 - DNA, 22 bp, Artificial Sequence
  chemically synthesized
ccgaacagagaagagagggaag

SEQ ID NO: 130527 - DNA, 22 bp, Artificial Sequence
  chemically synthesized
ctgagatgctagaaagatgaaa

SEQ ID NO: 130528 - DNA, 22 bp, Artificial Sequence
  chemically synthesized
agatgctagaaagatgaaactc

SEQ ID NO: 130529 - DNA, 22 bp, Artificial Sequence
  chemically synthesized
gaaagatgaaactcaggggagg

SEQ ID NO: 130530 - DNA, 22 bp, Artificial Sequence
  chemically synthesized
aggggaggtgatttccacatgc

SEQ ID NO: 130531 - DNA, 22 bp, Artificial Sequence
  chemically synthesized
ccacatgcataagctttaaaat

SEQ ID NO: 130532 - DNA, 22 bp, Artificial Sequence
  chemically synthesized
cacatgcataagctttaaaatg

SEQ ID NO: 130533 - DNA, 22 bp, Artificial Sequence
  chemically synthesized
taaaatgaggcctcatgagagg

SEQ ID NO: 130534 - DNA, 22 bp, Artificial Sequence
  chemically synthesized
aaaatgaggcctcatgagaggt

SEQ ID NO: 130535 - DNA, 22 bp, Artificial Sequence
  chemically synthesized
aaatgaggcctcatgagaggtc

SEQ ID NO: 130536 - DNA, 22 bp, Artificial Sequence
  chemically synthesized
atgagaggtctgtgagtgaatg

SEQ ID NO: 130537 - DNA, 22 bp, Artificial Sequence
  chemically synthesized
tgagtgaatgatctgaactgag

SEQ ID NO: 130538 - DNA, 22 bp, Artificial Sequence
  chemically synthesized
aactgagtcctcaaagaggaca

SEQ ID NO: 130539 - DNA, 22 bp, Artificial Sequence
  chemically synthesized
agtcctcaaagaggacaggaat

SEQ ID NO: 130540 - DNA, 22 bp, Artificial Sequence
  chemically synthesized
aaagaggacaggaataggttcc

SEQ ID NO: 130541 - DNA, 22 bp, Artificial Sequence
  chemically synthesized
ctattttagccacaatactgtg

SEQ ID NO: 130542 - DNA, 22 bp, Artificial Sequence
  chemically synthesized
ttttagccacaatactgtgagt

SEQ ID NO: 130543 - DNA, 22 bp, Artificial Sequence
  chemically synthesized
tagccacaatactgtgagtggg

SEQ ID NO: 130544 - DNA, 22 bp, Artificial Sequence
  chemically synthesized
agccacaatactgtgagtgggt

SEQ ID NO: 130545 - DNA, 22 bp, Artificial Sequence
  chemically synthesized
gccacaatactgtgagtgggtg

SEQ ID NO: 130546 - DNA, 22 bp, Artificial Sequence
  chemically synthesized
tgagtgggtgagtgccaggaac

SEQ ID NO: 130547 - DNA, 22 bp, Artificial Sequence
  chemically synthesized
gaatatggaatgattcctctct

SEQ ID NO: 130548 - DNA, 22 bp, Artificial Sequence
  chemically synthesized
aatatggaatgattcctctctc

SEQ ID NO: 130549 - DNA, 22 bp, Artificial Sequence
  chemically synthesized
ctctctcttctgatgtgagatg

SEQ ID NO: 130550 - DNA, 22 bp, Artificial Sequence
  chemically synthesized
tctcttctgatgtgagatgcac

SEQ ID NO: 130551 - DNA, 22 bp, Artificial Sequence
  chemically synthesized
tcttctgatgtgagatgcactc

SEQ ID NO: 130552 - DNA, 22 bp, Artificial Sequence
  chemically synthesized
ttctgatgtgagatgcactcaa

SEQ ID NO: 130553 - DNA, 22 bp, Artificial Sequence
  chemically synthesized
ctgatgtgagatgcactcaagg

SEQ ID NO: 130554 - DNA, 22 bp, Artificial Sequence
  chemically synthesized
tgatgtgagatgcactcaagga

SEQ ID NO: 130555 - DNA, 22 bp, Artificial Sequence
  chemically synthesized
atgtgagatgcactcaaggaaa

SEQ ID NO: 130556 - DNA, 22 bp, Artificial Sequence
  chemically synthesized
aaggaaagcatataagaaggtt

SEQ ID NO: 130557 - DNA, 22 bp, Artificial Sequence
  chemically synthesized
tccagaggtctgcctagaggta

SEQ ID NO: 130558 - DNA, 22 bp, Artificial Sequence
  chemically synthesized
ccagaggtctgcctagaggtaa

SEQ ID NO: 130559 - DNA, 22 bp, Artificial Sequence
  chemically synthesized
cagaggtctgcctagaggtaaa

SEQ ID NO: 130560 - DNA, 22 bp, Artificial Sequence
  chemically synthesized
cctagaggtaaagatcacagct

SEQ ID NO: 130561 - DNA, 22 bp, Artificial Sequence
  chemically synthesized
gaggtaaagatcacagctgagg

SEQ ID NO: 130562 - DNA, 22 bp, Artificial Sequence
  chemically synthesized
aggtgggatatcctacagcaca

SEQ ID NO: 130563 - DNA, 22 bp, Artificial Sequence
  chemically synthesized
cagcacagatttttttttttct

SEQ ID NO: 130564 - DNA, 22 bp, Artificial Sequence
  chemically synthesized
ttttttttcttttttgaaagag

SEQ ID NO: 130565 - DNA, 22 bp, Artificial Sequence
  chemically synthesized
tttttttcttttttgaaagagt

SEQ ID NO: 130566 - DNA, 22 bp, Artificial Sequence
  chemically synthesized
ttttttcttttttgaaagagta

SEQ ID NO: 130567 - DNA, 22 bp, Artificial Sequence
  chemically synthesized
tttttcttttttgaaagagtat

SEQ ID NO: 130568 - DNA, 22 bp, Artificial Sequence
  chemically synthesized
ttttcttttttgaaagagtatt

SEQ ID NO: 130569 - DNA, 22 bp, Artificial Sequence
  chemically synthesized
tttcttttttgaaagagtattt

SEQ ID NO: 130570 - DNA, 22 bp, Artificial Sequence
  chemically synthesized
ttcttttttgaaagagtattta

SEQ ID NO: 130571 - DNA, 22 bp, Artificial Sequence
  chemically synthesized
tcttttttgaaagagtatttaa

SEQ ID NO: 130572 - DNA, 22 bp, Artificial Sequence
  chemically synthesized
cttttttgaaagagtatttaag

SEQ ID NO: 130573 - DNA, 22 bp, Artificial Sequence
  chemically synthesized
ttttttgaaagagtatttaagg

SEQ ID NO: 130574 - DNA, 22 bp, Artificial Sequence
  chemically synthesized
ttttgaaagagtatttaaggaa

SEQ ID NO: 130575 - DNA, 22 bp, Artificial Sequence
  chemically synthesized
tttgaaagagtatttaaggaac

SEQ ID NO: 130576 - DNA, 22 bp, Artificial Sequence
  chemically synthesized
ttgaaagagtatttaaggaact

SEQ ID NO: 130577 - DNA, 22 bp, Artificial Sequence
  chemically synthesized
tgaaagagtatttaaggaactg

SEQ ID NO: 130578 - DNA, 22 bp, Artificial Sequence
  chemically synthesized
gaaagagtatttaaggaactgt

SEQ ID NO: 130579 - DNA, 22 bp, Artificial Sequence
  chemically synthesized
aaagagtatttaaggaactgtg

SEQ ID NO: 130580 - DNA, 22 bp, Artificial Sequence
  chemically synthesized
aaggaactgtgatagatttagg

SEQ ID NO: 130581 - DNA, 22 bp, Artificial Sequence
  chemically synthesized
aggaactgtgatagatttaggt

SEQ ID NO: 130582 - DNA, 22 bp, Artificial Sequence
  chemically synthesized
tgatagatttaggttttctaat

SEQ ID NO: 130583 - DNA, 22 bp, Artificial Sequence
  chemically synthesized
aggttttctaatctgggaccct

SEQ ID NO: 130584 - DNA, 22 bp, Artificial Sequence
  chemically synthesized
ggttttctaatctgggaccctt

SEQ ID NO: 130585 - DNA, 22 bp, Artificial Sequence
  chemically synthesized
tctaatctgggacccttggatt

SEQ ID NO: 130586 - DNA, 22 bp, Artificial Sequence
  chemically synthesized
ctaatctgggacccttggattg

SEQ ID NO: 130587 - DNA, 22 bp, Artificial Sequence
  chemically synthesized
taatctgggacccttggattgg

SEQ ID NO: 130588 - DNA, 22 bp, Artificial Sequence
  chemically synthesized
atctgggacccttggattggca

SEQ ID NO: 130589 - DNA, 22 bp, Artificial Sequence
  chemically synthesized
ggacccttggattggcataagt

SEQ ID NO: 130590 - DNA, 22 bp, Artificial Sequence
  chemically synthesized
ggattggcataagtataattgt

SEQ ID NO: 130591 - DNA, 22 bp, Artificial Sequence
  chemically synthesized
gattggcataagtataattgtt

SEQ ID NO: 130592 - DNA, 22 bp, Artificial Sequence
  chemically synthesized
gcataagtataattgttaatgc

SEQ ID NO: 130593 - DNA, 22 bp, Artificial Sequence
  chemically synthesized
ttaatgctcagaactgcatgtg

SEQ ID NO: 130594 - DNA, 22 bp, Artificial Sequence
  chemically synthesized
atgctcagaactgcatgtgtca

SEQ ID NO: 130595 - DNA, 22 bp, Artificial Sequence
  chemically synthesized
agaactgcatgtgtcattgtgc

SEQ ID NO: 130596 - DNA, 22 bp, Artificial Sequence
  chemically synthesized
catgtgtcattgtgcattctta

SEQ ID NO: 130597 - DNA, 22 bp, Artificial Sequence
  chemically synthesized
tgcattcttactcatttttcta

SEQ ID NO: 130598 - DNA, 22 bp, Artificial Sequence
  chemically synthesized
ttactcatttttctatgtagat

SEQ ID NO: 130599 - DNA, 22 bp, Artificial Sequence
  chemically synthesized
actcatttttctatgtagatgt

SEQ ID NO: 130600 - DNA, 22 bp, Artificial Sequence
  chemically synthesized
ctcatttttctatgtagatgtt

SEQ ID NO: 130601 - DNA, 22 bp, Artificial Sequence
  chemically synthesized
atttttctatgtagatgtttat

SEQ ID NO: 130602 - DNA, 22 bp, Artificial Sequence
  chemically synthesized
ttctatgtagatgtttatagct

SEQ ID NO: 130603 - DNA, 22 bp, Artificial Sequence
  chemically synthesized
tctatgtagatgtttatagctt

SEQ ID NO: 130604 - DNA, 22 bp, Artificial Sequence
  chemically synthesized
ctatgtagatgtttatagcttt

SEQ ID NO: 130605 - DNA, 22 bp, Artificial Sequence
  chemically synthesized
tatgtagatgtttatagctttt

SEQ ID NO: 130606 - DNA, 22 bp, Artificial Sequence
  chemically synthesized
tgtagatgtttatagctttttt

SEQ ID NO: 130607 - DNA, 22 bp, Artificial Sequence
  chemically synthesized
atagcttttttttcagagaata

SEQ ID NO: 130608 - DNA, 22 bp, Artificial Sequence
  chemically synthesized
tagcttttttttcagagaatat

SEQ ID NO: 130609 - DNA, 22 bp, Artificial Sequence
  chemically synthesized
ttttttcagagaatatttcttc

SEQ ID NO: 130610 - DNA, 22 bp, Artificial Sequence
  chemically synthesized
tttttcagagaatatttcttca

SEQ ID NO: 130611 - DNA, 22 bp, Artificial Sequence
  chemically synthesized
ttttcagagaatatttcttcat

SEQ ID NO: 130612 - DNA, 22 bp, Artificial Sequence
  chemically synthesized
tttcagagaatatttcttcatt

SEQ ID NO: 130613 - DNA, 22 bp, Artificial Sequence
  chemically synthesized
ttcagagaatatttcttcattc

SEQ ID NO: 130614 - DNA, 22 bp, Artificial Sequence
  chemically synthesized
tcagagaatatttcttcattcc

SEQ ID NO: 130615 - DNA, 22 bp, Artificial Sequence
  chemically synthesized
cagagaatatttcttcattcca

SEQ ID NO: 130616 - DNA, 22 bp, Artificial Sequence
  chemically synthesized
agagaatatttcttcattccaa

SEQ ID NO: 130617 - DNA, 22 bp, Artificial Sequence
  chemically synthesized
cttcattccaaaacagctttgt

SEQ ID NO: 130618 - DNA, 22 bp, Artificial Sequence
  chemically synthesized
ttcattccaaaacagctttgtt

SEQ ID NO: 130619 - DNA, 22 bp, Artificial Sequence
  chemically synthesized
cattccaaaacagctttgttat

SEQ ID NO: 130620 - DNA, 22 bp, Artificial Sequence
  chemically synthesized
attccaaaacagctttgttatc

SEQ ID NO: 130621 - DNA, 22 bp, Artificial Sequence
  chemically synthesized
caaaacagctttgttatcactc

SEQ ID NO: 130622 - DNA, 22 bp, Artificial Sequence
  chemically synthesized
tgttatcactcacctcctttgt

SEQ ID NO: 130623 - DNA, 22 bp, Artificial Sequence
  chemically synthesized
gttatcactcacctcctttgtt

SEQ ID NO: 130624 - DNA, 22 bp, Artificial Sequence
  chemically synthesized
ttatcactcacctcctttgttc

SEQ ID NO: 130625 - DNA, 22 bp, Artificial Sequence
  chemically synthesized
tcactcacctcctttgttcagt

SEQ ID NO: 130626 - DNA, 22 bp, Artificial Sequence
  chemically synthesized
acctcctttgttcagttattgg

SEQ ID NO: 130627 - DNA, 22 bp, Artificial Sequence
  chemically synthesized
ctttgttcagttattggtaaat

SEQ ID NO: 130628 - DNA, 22 bp, Artificial Sequence
  chemically synthesized
tgttcagttattggtaaatata

SEQ ID NO: 130629 - DNA, 22 bp, Artificial Sequence
  chemically synthesized
gttcagttattggtaaatatat

SEQ ID NO: 130630 - DNA, 22 bp, Artificial Sequence
  chemically synthesized
ttcagttattggtaaatatatt

SEQ ID NO: 130631 - DNA, 22 bp, Artificial Sequence
  chemically synthesized
agttattggtaaatatattaca

SEQ ID NO: 130632 - DNA, 22 bp, Artificial Sequence
  chemically synthesized
ttggtaaatatattacatttat

SEQ ID NO: 130633 - DNA, 22 bp, Artificial Sequence
  chemically synthesized
gtaaatatattacatttatatt

SEQ ID NO: 130634 - DNA, 22 bp, Artificial Sequence
  chemically synthesized
catttatatttgtaatagttcc

SEQ ID NO: 130635 - DNA, 22 bp, Artificial Sequence
  chemically synthesized
atatttgtaatagttccagcaa

SEQ ID NO: 130636 - DNA, 22 bp, Artificial Sequence
  chemically synthesized
tatttgtaatagttccagcaat

SEQ ID NO: 130637 - DNA, 22 bp, Artificial Sequence
  chemically synthesized
gtaatagttccagcaatgcaat

SEQ ID NO: 130638 - DNA, 22 bp, Artificial Sequence
  chemically synthesized
taatagttccagcaatgcaatt

SEQ ID NO: 130639 - DNA, 22 bp, Artificial Sequence
  chemically synthesized
cagcaatgcaattctatttttt

SEQ ID NO: 130640 - DNA, 22 bp, Artificial Sequence
  chemically synthesized
tattttttattgtaatacattc

SEQ ID NO: 130641 - DNA, 22 bp, Artificial Sequence
  chemically synthesized
ttttttattgtaatacattcat

SEQ ID NO: 130642 - DNA, 22 bp, Artificial Sequence
  chemically synthesized
tttattgtaatacattcatttt

SEQ ID NO: 130643 - DNA, 22 bp, Artificial Sequence
  chemically synthesized
ttattgtaatacattcattttt

SEQ ID NO: 130644 - DNA, 22 bp, Artificial Sequence
  chemically synthesized
tattgtaatacattcatttttg

SEQ ID NO: 130645 - DNA, 22 bp, Artificial Sequence
  chemically synthesized
attgtaatacattcatttttga

SEQ ID NO: 130646 - DNA, 22 bp, Artificial Sequence
  chemically synthesized
ttgtaatacattcatttttgaa

SEQ ID NO: 130647 - DNA, 22 bp, Artificial Sequence
  chemically synthesized
taatacattcatttttgaaaat

SEQ ID NO: 130648 - DNA, 22 bp, Artificial Sequence
  chemically synthesized
atttttgaaaataagaagcaga

SEQ ID NO: 130649 - DNA, 22 bp, Artificial Sequence
  chemically synthesized
ttgaaaataagaagcagaaagg

SEQ ID NO: 130650 - DNA, 22 bp, Artificial Sequence
  chemically synthesized
tgaaaataagaagcagaaagga

SEQ ID NO: 130651 - DNA, 22 bp, Artificial Sequence
  chemically synthesized
gaaaataagaagcagaaaggaa

SEQ ID NO: 130652 - DNA, 22 bp, Artificial Sequence
  chemically synthesized
aaaataagaagcagaaaggaat

SEQ ID NO: 130653 - DNA, 22 bp, Artificial Sequence
  chemically synthesized
ctataatgacatgactatcttt

SEQ ID NO: 130654 - DNA, 22 bp, Artificial Sequence
  chemically synthesized
tataatgacatgactatcttta

SEQ ID NO: 130655 - DNA, 22 bp, Artificial Sequence
  chemically synthesized
taatgacatgactatctttact

SEQ ID NO: 130656 - DNA, 22 bp, Artificial Sequence
  chemically synthesized
tctttactggtgcttttgtcat

SEQ ID NO: 130657 - DNA, 22 bp, Artificial Sequence
  chemically synthesized
tactggtgcttttgtcatttta

SEQ ID NO: 130658 - DNA, 22 bp, Artificial Sequence
  chemically synthesized
actggtgcttttgtcattttat

SEQ ID NO: 130659 - DNA, 22 bp, Artificial Sequence
  chemically synthesized
ctggtgcttttgtcattttatg

SEQ ID NO: 130660 - DNA, 22 bp, Artificial Sequence
  chemically synthesized
gtgcttttgtcattttatgtag

SEQ ID NO: 130661 - DNA, 22 bp, Artificial Sequence
  chemically synthesized
ttgtcattttatgtagattcaa

SEQ ID NO: 130662 - DNA, 22 bp, Artificial Sequence
  chemically synthesized
tgtcattttatgtagattcaaa

SEQ ID NO: 130663 - DNA, 22 bp, Artificial Sequence
  chemically synthesized
gtcattttatgtagattcaaat

SEQ ID NO: 130664 - DNA, 22 bp, Artificial Sequence
  chemically synthesized
tcattttatgtagattcaaatg

SEQ ID NO: 130665 - DNA, 22 bp, Artificial Sequence
  chemically synthesized
tatgtagattcaaatgatcatc

SEQ ID NO: 130666 - DNA, 22 bp, Artificial Sequence
  chemically synthesized
atgtagattcaaatgatcatct

SEQ ID NO: 130667 - DNA, 22 bp, Artificial Sequence
  chemically synthesized
tgtagattcaaatgatcatctt

SEQ ID NO: 130668 - DNA, 22 bp, Artificial Sequence
  chemically synthesized
aaatgatcatctttggtcattt

SEQ ID NO: 130669 - DNA, 22 bp, Artificial Sequence
  chemically synthesized
tggtcatttggtttcaacttag

SEQ ID NO: 130670 - DNA, 22 bp, Artificial Sequence
  chemically synthesized
ggtcatttggtttcaacttagt

SEQ ID NO: 130671 - DNA, 22 bp, Artificial Sequence
  chemically synthesized
gtcatttggtttcaacttagtt

SEQ ID NO: 130672 - DNA, 22 bp, Artificial Sequence
  chemically synthesized
ggtttcaacttagttgaaatca

SEQ ID NO: 130673 - DNA, 22 bp, Artificial Sequence
  chemically synthesized
gtttcaacttagttgaaatcaa

SEQ ID NO: 130674 - DNA, 22 bp, Artificial Sequence
  chemically synthesized
caacttagttgaaatcaactca

SEQ ID NO: 130675 - DNA, 22 bp, Artificial Sequence
  chemically synthesized
aacttagttgaaatcaactcag

SEQ ID NO: 130676 - DNA, 22 bp, Artificial Sequence
  chemically synthesized
agttgaaatcaactcagttttt

SEQ ID NO: 130677 - DNA, 22 bp, Artificial Sequence
  chemically synthesized
gttgaaatcaactcagtttttg

SEQ ID NO: 130678 - DNA, 22 bp, Artificial Sequence
  chemically synthesized
aaatcaactcagtttttgttta

SEQ ID NO: 130679 - DNA, 22 bp, Artificial Sequence
  chemically synthesized
agtttttgtttatccagaaagg

SEQ ID NO: 130680 - DNA, 22 bp, Artificial Sequence
  chemically synthesized
ttgtttatccagaaagggctta

SEQ ID NO: 130681 - DNA, 22 bp, Artificial Sequence
  chemically synthesized
tgtttatccagaaagggcttat

SEQ ID NO: 130682 - DNA, 22 bp, Artificial Sequence
  chemically synthesized
gtttatccagaaagggcttatt

SEQ ID NO: 130683 - DNA, 22 bp, Artificial Sequence
  chemically synthesized
tttatccagaaagggcttattt

SEQ ID NO: 130684 - DNA, 22 bp, Artificial Sequence
  chemically synthesized
atccagaaagggcttattttac

SEQ ID NO: 130685 - DNA, 22 bp, Artificial Sequence
  chemically synthesized
tccagaaagggcttattttacg

SEQ ID NO: 130686 - DNA, 22 bp, Artificial Sequence
  chemically synthesized
attttacgtttattttttattg

SEQ ID NO: 130687 - DNA, 22 bp, Artificial Sequence
  chemically synthesized
ttttacgtttattttttattga

SEQ ID NO: 130688 - DNA, 22 bp, Artificial Sequence
  chemically synthesized
tacgtttattttttattgataa

SEQ ID NO: 130689 - DNA, 22 bp, Artificial Sequence
  chemically synthesized
acgtttattttttattgataac

SEQ ID NO: 130690 - DNA, 22 bp, Artificial Sequence
  chemically synthesized
cgtttattttttattgataact

SEQ ID NO: 130691 - DNA, 22 bp, Artificial Sequence
  chemically synthesized
attttttattgataactttcct

SEQ ID NO: 130692 - DNA, 22 bp, Artificial Sequence
  chemically synthesized
ttttttattgataactttcctg

SEQ ID NO: 130693 - DNA, 22 bp, Artificial Sequence
  chemically synthesized
tttattgataactttcctgttc

SEQ ID NO: 130694 - DNA, 22 bp, Artificial Sequence
  chemically synthesized
ttattgataactttcctgttca

SEQ ID NO: 130695 - DNA, 22 bp, Artificial Sequence
  chemically synthesized
tattgataactttcctgttcag

SEQ ID NO: 130696 - DNA, 22 bp, Artificial Sequence
  chemically synthesized
attgataactttcctgttcaga

SEQ ID NO: 130697 - DNA, 22 bp, Artificial Sequence
  chemically synthesized
ttgataactttcctgttcagag

SEQ ID NO: 130698 - DNA, 22 bp, Artificial Sequence
  chemically synthesized
ataactttcctgttcagaggat

SEQ ID NO: 130699 - DNA, 22 bp, Artificial Sequence
  chemically synthesized
tcctgttcagaggattttttgt

SEQ ID NO: 130700 - DNA, 22 bp, Artificial Sequence
  chemically synthesized
cctgttcagaggattttttgtt

SEQ ID NO: 130701 - DNA, 22 bp, Artificial Sequence
  chemically synthesized
ctgttcagaggattttttgttg

SEQ ID NO: 130702 - DNA, 22 bp, Artificial Sequence
  chemically synthesized
ttcagaggattttttgttgata

SEQ ID NO: 130703 - DNA, 22 bp, Artificial Sequence
  chemically synthesized
agaggattttttgttgatagtt

SEQ ID NO: 130704 - DNA, 22 bp, Artificial Sequence
  chemically synthesized
tttgttgatagtttttctctga

SEQ ID NO: 130705 - DNA, 22 bp, Artificial Sequence
  chemically synthesized
ttgttgatagtttttctctgaa

SEQ ID NO: 130706 - DNA, 22 bp, Artificial Sequence
  chemically synthesized
tgttgatagtttttctctgaag

SEQ ID NO: 130707 - DNA, 22 bp, Artificial Sequence
  chemically synthesized
gttgatagtttttctctgaaga

SEQ ID NO: 130708 - DNA, 22 bp, Artificial Sequence
  chemically synthesized
ttgatagtttttctctgaagag

SEQ ID NO: 130709 - DNA, 22 bp, Artificial Sequence
  chemically synthesized
atagtttttctctgaagagtag

SEQ ID NO: 130710 - DNA, 22 bp, Artificial Sequence
  chemically synthesized
ttctctgaagagtagacaaaaa

SEQ ID NO: 130711 - DNA, 22 bp, Artificial Sequence
  chemically synthesized
tctctgaagagtagacaaaaaa

SEQ ID NO: 130712 - DNA, 22 bp, Artificial Sequence
  chemically synthesized
ctctgaagagtagacaaaaaat

SEQ ID NO: 130713 - DNA, 22 bp, Artificial Sequence
  chemically synthesized
tctgaagagtagacaaaaaatt

SEQ ID NO: 130714 - DNA, 22 bp, Artificial Sequence
  chemically synthesized
tgaagagtagacaaaaaattct

SEQ ID NO: 130715 - DNA, 22 bp, Artificial Sequence
  chemically synthesized
aagagtagacaaaaaattctga

SEQ ID NO: 130716 - DNA, 22 bp, Artificial Sequence
  chemically synthesized
tgaatcgagttgaaaggcttag

SEQ ID NO: 130717 - DNA, 22 bp, Artificial Sequence
  chemically synthesized
aatcgagttgaaaggcttagaa

SEQ ID NO: 130718 - DNA, 22 bp, Artificial Sequence
  chemically synthesized
aaaggcttagaaaagggcagcc

SEQ ID NO: 130719 - DNA, 22 bp, Artificial Sequence
  chemically synthesized
agaaaagggcagccaaattaag

SEQ ID NO: 130720 - DNA, 22 bp, Artificial Sequence
  chemically synthesized
gaaaagggcagccaaattaaga

SEQ ID NO: 130721 - DNA, 22 bp, Artificial Sequence
  chemically synthesized
agatctaagaaagcaaattgga

SEQ ID NO: 130722 - DNA, 22 bp, Artificial Sequence
  chemically synthesized
agaaagcaaattggattgaaaa

SEQ ID NO: 130723 - DNA, 22 bp, Artificial Sequence
  chemically synthesized
gattgaaaatgaaatcatattg

SEQ ID NO: 130724 - DNA, 22 bp, Artificial Sequence
  chemically synthesized
aaaatgaaatcatattgatggc

SEQ ID NO: 130725 - DNA, 22 bp, Artificial Sequence
  chemically synthesized
atggcagatgataatatattgg

SEQ ID NO: 130726 - DNA, 22 bp, Artificial Sequence
  chemically synthesized
gactgggttggagaaggcagga

SEQ ID NO: 130727 - DNA, 22 bp, Artificial Sequence
  chemically synthesized
ggttggagaaggcaggaggaat

SEQ ID NO: 130728 - DNA, 22 bp, Artificial Sequence
  chemically synthesized
gagaaggcaggaggaatttaac

SEQ ID NO: 130729 - DNA, 22 bp, Artificial Sequence
  chemically synthesized
aacttgtggacaatagaaatct

SEQ ID NO: 130730 - DNA, 22 bp, Artificial Sequence
  chemically synthesized
acttgtggacaatagaaatctg

SEQ ID NO: 130731 - DNA, 22 bp, Artificial Sequence
  chemically synthesized
gtggacaatagaaatctgagag

SEQ ID NO: 130732 - DNA, 22 bp, Artificial Sequence
  chemically synthesized
tggacaatagaaatctgagagt

SEQ ID NO: 130733 - DNA, 22 bp, Artificial Sequence
  chemically synthesized
agagttgggtagtcccaactgt

SEQ ID NO: 130734 - DNA, 22 bp, Artificial Sequence
  chemically synthesized
ggtagtcccaactgtcaggccc

SEQ ID NO: 130735 - DNA, 22 bp, Artificial Sequence
  chemically synthesized
tcaggccctcaggactggggcc

SEQ ID NO: 130736 - DNA, 22 bp, Artificial Sequence
  chemically synthesized
aggactggggccaaatggagga

SEQ ID NO: 130737 - DNA, 22 bp, Artificial Sequence
  chemically synthesized
gggccaaatggaggactcactt

SEQ ID NO: 130738 - DNA, 22 bp, Artificial Sequence
  chemically synthesized
acttttttgaagattaaagaca

SEQ ID NO: 130739 - DNA, 22 bp, Artificial Sequence
  chemically synthesized
ttttgaagattaaagacaatgc

SEQ ID NO: 130740 - DNA, 22 bp, Artificial Sequence
  chemically synthesized
tttgaagattaaagacaatgcg

SEQ ID NO: 130741 - DNA, 22 bp, Artificial Sequence
  chemically synthesized
ttgaagattaaagacaatgcgt

SEQ ID NO: 130742 - DNA, 22 bp, Artificial Sequence
  chemically synthesized
tgaagattaaagacaatgcgtg

SEQ ID NO: 130743 - DNA, 22 bp, Artificial Sequence
  chemically synthesized
gaagattaaagacaatgcgtga

SEQ ID NO: 130744 - DNA, 22 bp, Artificial Sequence
  chemically synthesized
aagattaaagacaatgcgtgag

SEQ ID NO: 130745 - DNA, 22 bp, Artificial Sequence
  chemically synthesized
aagacaatgcgtgagagcacgg

SEQ ID NO: 130746 - DNA, 22 bp, Artificial Sequence
  chemically synthesized
tgaacctaaacaggctgagctt

SEQ ID NO: 130747 - DNA, 22 bp, Artificial Sequence
  chemically synthesized
aacctaaacaggctgagcttct

SEQ ID NO: 130748 - DNA, 22 bp, Artificial Sequence
  chemically synthesized
aacaggctgagcttctgcactc

SEQ ID NO: 130749 - DNA, 22 bp, Artificial Sequence
  chemically synthesized
agcttctgcactctgctaagat

SEQ ID NO: 130750 - DNA, 22 bp, Artificial Sequence
  chemically synthesized
ctgcactctgctaagatcctga

SEQ ID NO: 130751 - DNA, 22 bp, Artificial Sequence
  chemically synthesized
tgcactctgctaagatcctgaa

SEQ ID NO: 130752 - DNA, 22 bp, Artificial Sequence
  chemically synthesized
cactctgctaagatcctgaaat

SEQ ID NO: 130753 - DNA, 22 bp, Artificial Sequence
  chemically synthesized
tgctaagatcctgaaatttata

SEQ ID NO: 130754 - DNA, 22 bp, Artificial Sequence
  chemically synthesized
ctaagatcctgaaatttataga

SEQ ID NO: 130755 - DNA, 22 bp, Artificial Sequence
  chemically synthesized
agatcctgaaatttatagaaag

SEQ ID NO: 130756 - DNA, 22 bp, Artificial Sequence
  chemically synthesized
aaatttatagaaagaaaagtca

SEQ ID NO: 130757 - DNA, 22 bp, Artificial Sequence
  chemically synthesized
atagaaagaaaagtcaccattt

SEQ ID NO: 130758 - DNA, 22 bp, Artificial Sequence
  chemically synthesized
tagaaagaaaagtcaccatttt

SEQ ID NO: 130759 - DNA, 22 bp, Artificial Sequence
  chemically synthesized
taacatataacaatttaattta

SEQ ID NO: 130760 - DNA, 22 bp, Artificial Sequence
  chemically synthesized
aacatataacaatttaatttat

SEQ ID NO: 130761 - DNA, 22 bp, Artificial Sequence
  chemically synthesized
acatataacaatttaatttata

SEQ ID NO: 130762 - DNA, 22 bp, Artificial Sequence
  chemically synthesized
aatttataagatccaaacaaca

SEQ ID NO: 130763 - DNA, 22 bp, Artificial Sequence
  chemically synthesized
atttataagatccaaacaacac

SEQ ID NO: 130764 - DNA, 22 bp, Artificial Sequence
  chemically synthesized
ataagatccaaacaacacccct

SEQ ID NO: 130765 - DNA, 22 bp, Artificial Sequence
  chemically synthesized
taagatccaaacaacacccctt

SEQ ID NO: 130766 - DNA, 22 bp, Artificial Sequence
  chemically synthesized
gaaacacacacatgcatgtgtg

SEQ ID NO: 130767 - DNA, 22 bp, Artificial Sequence
  chemically synthesized
aaacacacacatgcatgtgtgt

SEQ ID NO: 130768 - DNA, 22 bp, Artificial Sequence
  chemically synthesized
tgtgtttgtttgaagaactgct

SEQ ID NO: 130769 - DNA, 22 bp, Artificial Sequence
  chemically synthesized
gtttgaagaactgctctaagag

SEQ ID NO: 130770 - DNA, 22 bp, Artificial Sequence
  chemically synthesized
tttgaagaactgctctaagaga

SEQ ID NO: 130771 - DNA, 22 bp, Artificial Sequence
  chemically synthesized
gaagaactgctctaagagatgg

SEQ ID NO: 130772 - DNA, 22 bp, Artificial Sequence
  chemically synthesized
aagaactgctctaagagatggc

SEQ ID NO: 130773 - DNA, 22 bp, Artificial Sequence
  chemically synthesized
ctctaagagatggcatgagtag

SEQ ID NO: 130774 - DNA, 22 bp, Artificial Sequence
  chemically synthesized
taagagatggcatgagtagtca

SEQ ID NO: 130775 - DNA, 22 bp, Artificial Sequence
  chemically synthesized
agagatggcatgagtagtcagt

SEQ ID NO: 130776 - DNA, 22 bp, Artificial Sequence
  chemically synthesized
actagaaaaattctagagacag

SEQ ID NO: 130777 - DNA, 22 bp, Artificial Sequence
  chemically synthesized
gaaaaattctagagacagggcc

SEQ ID NO: 130778 - DNA, 22 bp, Artificial Sequence
  chemically synthesized
tagagacagggcccatctcctt

SEQ ID NO: 130779 - DNA, 22 bp, Artificial Sequence
  chemically synthesized
gagacagggcccatctccttag

SEQ ID NO: 130780 - DNA, 22 bp, Artificial Sequence
  chemically synthesized
cttaggaaggtgcggggacaca

SEQ ID NO: 130781 - DNA, 22 bp, Artificial Sequence
  chemically synthesized
aggaaggtgcggggacacatct

SEQ ID NO: 130782 - DNA, 22 bp, Artificial Sequence
  chemically synthesized
ggaaggtgcggggacacatctt

SEQ ID NO: 130783 - DNA, 22 bp, Artificial Sequence
  chemically synthesized
ccatccaactcagaaggagggc

SEQ ID NO: 130784 - DNA, 22 bp, Artificial Sequence
  chemically synthesized
catccaactcagaaggagggca

SEQ ID NO: 130785 - DNA, 22 bp, Artificial Sequence
  chemically synthesized
agaaggagggcagagtaggaaa

SEQ ID NO: 130786 - DNA, 22 bp, Artificial Sequence
  chemically synthesized
tttcctctttcacttgtttatg

SEQ ID NO: 130787 - DNA, 22 bp, Artificial Sequence
  chemically synthesized
ttcctctttcacttgtttatgt

SEQ ID NO: 130788 - DNA, 22 bp, Artificial Sequence
  chemically synthesized
tcctctttcacttgtttatgta

SEQ ID NO: 130789 - DNA, 22 bp, Artificial Sequence
  chemically synthesized
cctctttcacttgtttatgtag

SEQ ID NO: 130790 - DNA, 22 bp, Artificial Sequence
  chemically synthesized
ctctttcacttgtttatgtaga

SEQ ID NO: 130791 - DNA, 22 bp, Artificial Sequence
  chemically synthesized
tttcacttgtttatgtagactg

SEQ ID NO: 130792 - DNA, 22 bp, Artificial Sequence
  chemically synthesized
tcacttgtttatgtagactgta

SEQ ID NO: 130793 - DNA, 22 bp, Artificial Sequence
  chemically synthesized
cacttgtttatgtagactgtat

SEQ ID NO: 130794 - DNA, 22 bp, Artificial Sequence
  chemically synthesized
acttgtttatgtagactgtata

SEQ ID NO: 130795 - DNA, 22 bp, Artificial Sequence
  chemically synthesized
gtttatgtagactgtataatag

SEQ ID NO: 130796 - DNA, 22 bp, Artificial Sequence
  chemically synthesized
tttatgtagactgtataataga

SEQ ID NO: 130797 - DNA, 22 bp, Artificial Sequence
  chemically synthesized
atgtagactgtataatagattc

SEQ ID NO: 130798 - DNA, 22 bp, Artificial Sequence
  chemically synthesized
tgtagactgtataatagattca

SEQ ID NO: 130799 - DNA, 22 bp, Artificial Sequence
  chemically synthesized
tataatagattcactatttact

SEQ ID NO: 130800 - DNA, 22 bp, Artificial Sequence
  chemically synthesized
actatttactacattttcttga

SEQ ID NO: 130801 - DNA, 22 bp, Artificial Sequence
  chemically synthesized
tttactacattttcttgaggct

SEQ ID NO: 130802 - DNA, 22 bp, Artificial Sequence
  chemically synthesized
actacattttcttgaggctaac

SEQ ID NO: 130803 - DNA, 22 bp, Artificial Sequence
  chemically synthesized
ctacattttcttgaggctaaca

SEQ ID NO: 130804 - DNA, 22 bp, Artificial Sequence
  chemically synthesized
cattttcttgaggctaacagat

SEQ ID NO: 130805 - DNA, 22 bp, Artificial Sequence
  chemically synthesized
tcttgaggctaacagatctttc

SEQ ID NO: 130806 - DNA, 22 bp, Artificial Sequence
  chemically synthesized
cttgaggctaacagatctttcc

SEQ ID NO: 130807 - DNA, 22 bp, Artificial Sequence
  chemically synthesized
ttgaggctaacagatctttcct

SEQ ID NO: 130808 - DNA, 22 bp, Artificial Sequence
  chemically synthesized
gaggctaacagatctttcctgt

SEQ ID NO: 130809 - DNA, 22 bp, Artificial Sequence
  chemically synthesized
aggctaacagatctttcctgtc

SEQ ID NO: 130810 - DNA, 22 bp, Artificial Sequence
  chemically synthesized
acagatctttcctgtctgttcc

SEQ ID NO: 130811 - DNA, 22 bp, Artificial Sequence
  chemically synthesized
tcctgtctgttccttcttcata

SEQ ID NO: 130812 - DNA, 22 bp, Artificial Sequence
  chemically synthesized
cctgtctgttccttcttcatac

SEQ ID NO: 130813 - DNA, 22 bp, Artificial Sequence
  chemically synthesized
ctgtctgttccttcttcatact

SEQ ID NO: 130814 - DNA, 22 bp, Artificial Sequence
  chemically synthesized
tctgttccttcttcatactaca

SEQ ID NO: 130815 - DNA, 22 bp, Artificial Sequence
  chemically synthesized
ttccttcttcatactacaaagt

SEQ ID NO: 130816 - DNA, 22 bp, Artificial Sequence
  chemically synthesized
cttcttcatactacaaagttcc

SEQ ID NO: 130817 - DNA, 22 bp, Artificial Sequence
  chemically synthesized
cttcatactacaaagttccctc

SEQ ID NO: 130818 - DNA, 22 bp, Artificial Sequence
  chemically synthesized
ttcatactacaaagttccctct

SEQ ID NO: 130819 - DNA, 22 bp, Artificial Sequence
  chemically synthesized
catactacaaagttccctctgt

SEQ ID NO: 130820 - DNA, 22 bp, Artificial Sequence
  chemically synthesized
atactacaaagttccctctgtc

SEQ ID NO: 130821 - DNA, 22 bp, Artificial Sequence
  chemically synthesized
caaagttccctctgtctccttt

SEQ ID NO: 130822 - DNA, 22 bp, Artificial Sequence
  chemically synthesized
cctctgtctcctttactccctt

SEQ ID NO: 130823 - DNA, 22 bp, Artificial Sequence
  chemically synthesized
tgtctcctttactcccttgtat

SEQ ID NO: 130824 - DNA, 22 bp, Artificial Sequence
  chemically synthesized
tctcctttactcccttgtatct

SEQ ID NO: 130825 - DNA, 22 bp, Artificial Sequence
  chemically synthesized
ctttactcccttgtatctggta

SEQ ID NO: 130826 - DNA, 22 bp, Artificial Sequence
  chemically synthesized
tactcccttgtatctggtaaca

SEQ ID NO: 130827 - DNA, 22 bp, Artificial Sequence
  chemically synthesized
actcccttgtatctggtaacat

SEQ ID NO: 130828 - DNA, 22 bp, Artificial Sequence
  chemically synthesized
ctcccttgtatctggtaacatt

SEQ ID NO: 130829 - DNA, 22 bp, Artificial Sequence
  chemically synthesized
ccttgtatctggtaacattcaa

SEQ ID NO: 130830 - DNA, 22 bp, Artificial Sequence
  chemically synthesized
gtatctggtaacattcaaatta

SEQ ID NO: 130831 - DNA, 22 bp, Artificial Sequence
  chemically synthesized
tatctggtaacattcaaattat

SEQ ID NO: 130832 - DNA, 22 bp, Artificial Sequence
  chemically synthesized
gtaacattcaaattatgttctc

SEQ ID NO: 130833 - DNA, 22 bp, Artificial Sequence
  chemically synthesized
aaattatgttctcaaagtgagc

SEQ ID NO: 130834 - DNA, 22 bp, Artificial Sequence
  chemically synthesized
tgttctcaaagtgagcatgaca

SEQ ID NO: 130835 - DNA, 22 bp, Artificial Sequence
  chemically synthesized
tcaaagtgagcatgacaacttt

SEQ ID NO: 130836 - DNA, 22 bp, Artificial Sequence
  chemically synthesized
aaagtgagcatgacaacttttt

SEQ ID NO: 130837 - DNA, 22 bp, Artificial Sequence
  chemically synthesized
ttttccatggacctgtatgtat

SEQ ID NO: 130838 - DNA, 22 bp, Artificial Sequence
  chemically synthesized
tttccatggacctgtatgtatt

SEQ ID NO: 130839 - DNA, 22 bp, Artificial Sequence
  chemically synthesized
ttccatggacctgtatgtattt

SEQ ID NO: 130840 - DNA, 22 bp, Artificial Sequence
  chemically synthesized
tccatggacctgtatgtattta

SEQ ID NO: 130841 - DNA, 22 bp, Artificial Sequence
  chemically synthesized
ccatggacctgtatgtatttat

SEQ ID NO: 130842 - DNA, 22 bp, Artificial Sequence
  chemically synthesized
catggacctgtatgtatttatg

SEQ ID NO: 130843 - DNA, 22 bp, Artificial Sequence
  chemically synthesized
tatgtatttatgcatcttggtg

SEQ ID NO: 130844 - DNA, 22 bp, Artificial Sequence
  chemically synthesized
atgcatcttggtgagagtgttg

SEQ ID NO: 130845 - DNA, 22 bp, Artificial Sequence
  chemically synthesized
tgcatcttggtgagagtgttgc

SEQ ID NO: 130846 - DNA, 22 bp, Artificial Sequence
  chemically synthesized
ggtgagagtgttgctacaagta

SEQ ID NO: 130847 - DNA, 22 bp, Artificial Sequence
  chemically synthesized
gtgagagtgttgctacaagtat

SEQ ID NO: 130848 - DNA, 22 bp, Artificial Sequence
  chemically synthesized
ctacaagtataggaatcttatt

SEQ ID NO: 130849 - DNA, 22 bp, Artificial Sequence
  chemically synthesized
caagtataggaatcttattcat

SEQ ID NO: 130850 - DNA, 22 bp, Artificial Sequence
  chemically synthesized
attcatctagaaatatatcatc

SEQ ID NO: 130851 - DNA, 22 bp, Artificial Sequence
  chemically synthesized
ttcatctagaaatatatcatca

SEQ ID NO: 130852 - DNA, 22 bp, Artificial Sequence
  chemically synthesized
atctagaaatatatcatcatgt

SEQ ID NO: 130853 - DNA, 22 bp, Artificial Sequence
  chemically synthesized
gaaatatatcatcatgtgaaat

SEQ ID NO: 130854 - DNA, 22 bp, Artificial Sequence
  chemically synthesized
aggtcaatagaacatctagaat

SEQ ID NO: 130855 - DNA, 22 bp, Artificial Sequence
  chemically synthesized
gaatgaagctagaatgaagcag

SEQ ID NO: 130856 - DNA, 22 bp, Artificial Sequence
  chemically synthesized
gaatgaagcagggcttagatct

SEQ ID NO: 130857 - DNA, 22 bp, Artificial Sequence
  chemically synthesized
agatctatgatttttctcaagt

SEQ ID NO: 130858 - DNA, 22 bp, Artificial Sequence
  chemically synthesized
gatctatgatttttctcaagtt

SEQ ID NO: 130859 - DNA, 22 bp, Artificial Sequence
  chemically synthesized
tgatttttctcaagttttcagc

SEQ ID NO: 130860 - DNA, 22 bp, Artificial Sequence
  chemically synthesized
ttctcaagttttcagcattatg

SEQ ID NO: 130861 - DNA, 22 bp, Artificial Sequence
  chemically synthesized
tctcaagttttcagcattatgg

SEQ ID NO: 130862 - DNA, 22 bp, Artificial Sequence
  chemically synthesized
ctcaagttttcagcattatgga

SEQ ID NO: 130863 - DNA, 22 bp, Artificial Sequence
  chemically synthesized
tcaagttttcagcattatggat

SEQ ID NO: 130864 - DNA, 22 bp, Artificial Sequence
  chemically synthesized
aagttttcagcattatggatcc

SEQ ID NO: 130865 - DNA, 22 bp, Artificial Sequence
  chemically synthesized
tcagcattatggatcctgttga

SEQ ID NO: 130866 - DNA, 22 bp, Artificial Sequence
  chemically synthesized
cagcattatggatcctgttgag

SEQ ID NO: 130867 - DNA, 22 bp, Artificial Sequence
  chemically synthesized
agcattatggatcctgttgaga

SEQ ID NO: 130868 - DNA, 22 bp, Artificial Sequence
  chemically synthesized
tggatcctgttgagacattcaa

SEQ ID NO: 130869 - DNA, 22 bp, Artificial Sequence
  chemically synthesized
ttgagacattcaagggcaatat

SEQ ID NO: 130870 - DNA, 22 bp, Artificial Sequence
  chemically synthesized
agacattcaagggcaatattct

SEQ ID NO: 130871 - DNA, 22 bp, Artificial Sequence
  chemically synthesized
aagggcaatattctgcataaaa

SEQ ID NO: 130872 - DNA, 22 bp, Artificial Sequence
  chemically synthesized
tgcataaaattgaagggagaat

SEQ ID NO: 130873 - DNA, 22 bp, Artificial Sequence
  chemically synthesized
cataaaattgaagggagaatat

SEQ ID NO: 130874 - DNA, 22 bp, Artificial Sequence
  chemically synthesized
aagggagaatattaagcactat

SEQ ID NO: 130875 - DNA, 22 bp, Artificial Sequence
  chemically synthesized
agcactattataaactcatagg

SEQ ID NO: 130876 - DNA, 22 bp, Artificial Sequence
  chemically synthesized
ttataaactcataggccatatt

SEQ ID NO: 130877 - DNA, 22 bp, Artificial Sequence
  chemically synthesized
taaactcataggccatattgag

SEQ ID NO: 130878 - DNA, 22 bp, Artificial Sequence
  chemically synthesized
ataggccatattgagagcttct

SEQ ID NO: 130879 - DNA, 22 bp, Artificial Sequence
  chemically synthesized
agagcttcttaagagcagactg

SEQ ID NO: 130880 - DNA, 22 bp, Artificial Sequence
  chemically synthesized
cttaagagcagactgtgcttat

SEQ ID NO: 130881 - DNA, 22 bp, Artificial Sequence
  chemically synthesized
ttaagagcagactgtgcttatt

SEQ ID NO: 130882 - DNA, 22 bp, Artificial Sequence
  chemically synthesized
aagagcagactgtgcttattac

SEQ ID NO: 130883 - DNA, 22 bp, Artificial Sequence
  chemically synthesized
agagcagactgtgcttattaca

SEQ ID NO: 130884 - DNA, 22 bp, Artificial Sequence
  chemically synthesized
tgcttattacatggttatttag

SEQ ID NO: 130885 - DNA, 22 bp, Artificial Sequence
  chemically synthesized
attacatggttatttagaacta

SEQ ID NO: 130886 - DNA, 22 bp, Artificial Sequence
  chemically synthesized
ttacatggttatttagaactaa

SEQ ID NO: 130887 - DNA, 22 bp, Artificial Sequence
  chemically synthesized
catggttatttagaactaaaca

SEQ ID NO: 130888 - DNA, 22 bp, Artificial Sequence
  chemically synthesized
tttagaactaaacacagtgcag

SEQ ID NO: 130889 - DNA, 22 bp, Artificial Sequence
  chemically synthesized
agaactaaacacagtgcagttg

SEQ ID NO: 130890 - DNA, 22 bp, Artificial Sequence
  chemically synthesized
gaactaaacacagtgcagttgt

SEQ ID NO: 130891 - DNA, 22 bp, Artificial Sequence
  chemically synthesized
aacacagtgcagttgtgtggca

SEQ ID NO: 130892 - DNA, 22 bp, Artificial Sequence
  chemically synthesized
tgtggcatgtgctcaccaattc

SEQ ID NO: 130893 - DNA, 22 bp, Artificial Sequence
  chemically synthesized
accaattctgtgctgactcaaa

SEQ ID NO: 130894 - DNA, 22 bp, Artificial Sequence
  chemically synthesized
tgtgctgactcaaaatagtcat

SEQ ID NO: 130895 - DNA, 22 bp, Artificial Sequence
  chemically synthesized
tgctgactcaaaatagtcattt

SEQ ID NO: 130896 - DNA, 22 bp, Artificial Sequence
  chemically synthesized
actcaaaatagtcattttccaa

SEQ ID NO: 130897 - DNA, 22 bp, Artificial Sequence
  chemically synthesized
aaaatagtcattttccaacttg

SEQ ID NO: 130898 - DNA, 22 bp, Artificial Sequence
  chemically synthesized
tccaacttgtcccagatggtat

SEQ ID NO: 130899 - DNA, 22 bp, Artificial Sequence
  chemically synthesized
ccaacttgtcccagatggtatt

SEQ ID NO: 130900 - DNA, 22 bp, Artificial Sequence
  chemically synthesized
caacttgtcccagatggtattg

SEQ ID NO: 130901 - DNA, 22 bp, Artificial Sequence
  chemically synthesized
gtcccagatggtattggtgaat

SEQ ID NO: 130902 - DNA, 22 bp, Artificial Sequence
  chemically synthesized
tcccagatggtattggtgaatg

SEQ ID NO: 130903 - DNA, 22 bp, Artificial Sequence
  chemically synthesized
gtgaatggagctcctacaggtt

SEQ ID NO: 130904 - DNA, 22 bp, Artificial Sequence
  chemically synthesized
ctacaggttgcttatatcttca

SEQ ID NO: 130905 - DNA, 22 bp, Artificial Sequence
  chemically synthesized
caggttgcttatatcttcatat

SEQ ID NO: 130906 - DNA, 22 bp, Artificial Sequence
  chemically synthesized
cttatatcttcatatatgatat

SEQ ID NO: 130907 - DNA, 22 bp, Artificial Sequence
  chemically synthesized
atatcttcatatatgatatatc

SEQ ID NO: 130908 - DNA, 22 bp, Artificial Sequence
  chemically synthesized
tatcttcatatatgatatatca

SEQ ID NO: 130909 - DNA, 22 bp, Artificial Sequence
  chemically synthesized
catatatgatatatcagttcaa

SEQ ID NO: 130910 - DNA, 22 bp, Artificial Sequence
  chemically synthesized
atatatgatatatcagttcaag

SEQ ID NO: 130911 - DNA, 22 bp, Artificial Sequence
  chemically synthesized
aaggaaaaatcatcacacatca

SEQ ID NO: 130912 - DNA, 22 bp, Artificial Sequence
  chemically synthesized
aggaaatcactaaacatttatg

SEQ ID NO: 130913 - DNA, 22 bp, Artificial Sequence
  chemically synthesized
ggaaatcactaaacatttatgt

SEQ ID NO: 130914 - DNA, 22 bp, Artificial Sequence
  chemically synthesized
aacatttatgttctgagttgag

SEQ ID NO: 130915 - DNA, 22 bp, Artificial Sequence
  chemically synthesized
atgttctgagttgagagctgcc

SEQ ID NO: 130916 - DNA, 22 bp, Artificial Sequence
  chemically synthesized
tgttctgagttgagagctgcct

SEQ ID NO: 130917 - DNA, 22 bp, Artificial Sequence
  chemically synthesized
tgagttgagagctgcctatcaa

SEQ ID NO: 130918 - DNA, 22 bp, Artificial Sequence
  chemically synthesized
agttgagagctgcctatcaatt

SEQ ID NO: 130919 - DNA, 22 bp, Artificial Sequence
  chemically synthesized
agagctgcctatcaatttcaca

SEQ ID NO: 130920 - DNA, 22 bp, Artificial Sequence
  chemically synthesized
cctatcaatttcacagccatag

SEQ ID NO: 130921 - DNA, 22 bp, Artificial Sequence
  chemically synthesized
tcaatttcacagccatagctgc

SEQ ID NO: 130922 - DNA, 22 bp, Artificial Sequence
  chemically synthesized
cacagccatagctgctccacct

SEQ ID NO: 130923 - DNA, 22 bp, Artificial Sequence
  chemically synthesized
acagccatagctgctccacctt

SEQ ID NO: 130924 - DNA, 22 bp, Artificial Sequence
  chemically synthesized
ctccacctttatccagaaaaac

SEQ ID NO: 130925 - DNA, 22 bp, Artificial Sequence
  chemically synthesized
cacctttatccagaaaaactag

SEQ ID NO: 130926 - DNA, 22 bp, Artificial Sequence
  chemically synthesized
tatccagaaaaactagttcttg

SEQ ID NO: 130927 - DNA, 22 bp, Artificial Sequence
  chemically synthesized
atccagaaaaactagttcttgt

SEQ ID NO: 130928 - DNA, 22 bp, Artificial Sequence
  chemically synthesized
tccagaaaaactagttcttgtg

SEQ ID NO: 130929 - DNA, 22 bp, Artificial Sequence
  chemically synthesized
gttcttgtgcttctagtataat

SEQ ID NO: 130930 - DNA, 22 bp, Artificial Sequence
  chemically synthesized
ttgtgcttctagtataattttc

SEQ ID NO: 130931 - DNA, 22 bp, Artificial Sequence
  chemically synthesized
gtgcttctagtataattttctt

SEQ ID NO: 130932 - DNA, 22 bp, Artificial Sequence
  chemically synthesized
tgcttctagtataattttctta

SEQ ID NO: 130933 - DNA, 22 bp, Artificial Sequence
  chemically synthesized
ctagtataattttcttaacact

SEQ ID NO: 130934 - DNA, 22 bp, Artificial Sequence
  chemically synthesized
tagtataattttcttaacactt

SEQ ID NO: 130935 - DNA, 22 bp, Artificial Sequence
  chemically synthesized
gtataattttcttaacacttgt

SEQ ID NO: 130936 - DNA, 22 bp, Artificial Sequence
  chemically synthesized
tcttaacacttgttaatagcta

SEQ ID NO: 130937 - DNA, 22 bp, Artificial Sequence
  chemically synthesized
cttaacacttgttaatagctaa

SEQ ID NO: 130938 - DNA, 22 bp, Artificial Sequence
  chemically synthesized
ttaacacttgttaatagctaag

SEQ ID NO: 130939 - DNA, 22 bp, Artificial Sequence
  chemically synthesized
aacacttgttaatagctaagcc

SEQ ID NO: 130940 - DNA, 22 bp, Artificial Sequence
  chemically synthesized
acacttgttaatagctaagcca

SEQ ID NO: 130941 - DNA, 22 bp, Artificial Sequence
  chemically synthesized
gttaatagctaagccatctgaa

SEQ ID NO: 130942 - DNA, 22 bp, Artificial Sequence
  chemically synthesized
ttaatagctaagccatctgaat

SEQ ID NO: 130943 - DNA, 22 bp, Artificial Sequence
  chemically synthesized
atagctaagccatctgaatgga

SEQ ID NO: 130944 - DNA, 22 bp, Artificial Sequence
  chemically synthesized
agccatctgaatggaattttgc

SEQ ID NO: 130945 - DNA, 22 bp, Artificial Sequence
  chemically synthesized
aatggaattttgccacatagtg

SEQ ID NO: 130946 - DNA, 22 bp, Artificial Sequence
  chemically synthesized
tgccacatagtgcagccttggg

SEQ ID NO: 130947 - DNA, 22 bp, Artificial Sequence
  chemically synthesized
gccacatagtgcagccttggga

SEQ ID NO: 130948 - DNA, 22 bp, Artificial Sequence
  chemically synthesized
ccacatagtgcagccttgggag

SEQ ID NO: 130949 - DNA, 22 bp, Artificial Sequence
  chemically synthesized
gggagcatgcatacagtatggc

SEQ ID NO: 130950 - DNA, 22 bp, Artificial Sequence
  chemically synthesized
ggagcatgcatacagtatggct

SEQ ID NO: 130951 - DNA, 22 bp, Artificial Sequence
  chemically synthesized
catctctggtgacactgcttat

SEQ ID NO: 130952 - DNA, 22 bp, Artificial Sequence
  chemically synthesized
atctctggtgacactgcttata

SEQ ID NO: 130953 - DNA, 22 bp, Artificial Sequence
  chemically synthesized
tggtgacactgcttatagtggg

SEQ ID NO: 130954 - DNA, 22 bp, Artificial Sequence
  chemically synthesized
gtgacactgcttatagtgggcc

SEQ ID NO: 130955 - DNA, 22 bp, Artificial Sequence
  chemically synthesized
cttatagtgggcctcagtttga

SEQ ID NO: 130956 - DNA, 22 bp, Artificial Sequence
  chemically synthesized
atagtgggcctcagtttgatga

SEQ ID NO: 130957 - DNA, 22 bp, Artificial Sequence
  chemically synthesized
tagtgggcctcagtttgatgac

SEQ ID NO: 130958 - DNA, 22 bp, Artificial Sequence
  chemically synthesized
agtttgatgacagtatctagct

SEQ ID NO: 130959 - DNA, 22 bp, Artificial Sequence
  chemically synthesized
gatgacagtatctagctctcct

SEQ ID NO: 130960 - DNA, 22 bp, Artificial Sequence
  chemically synthesized
atgacagtatctagctctccta

SEQ ID NO: 130961 - DNA, 22 bp, Artificial Sequence
  chemically synthesized
gctctcctagaatccccacacg

SEQ ID NO: 130962 - DNA, 22 bp, Artificial Sequence
  chemically synthesized
tcctagaatccccacacgcctg

SEQ ID NO: 130963 - DNA, 22 bp, Artificial Sequence
  chemically synthesized
ctagaatccccacacgcctgcc

SEQ ID NO: 130964 - DNA, 22 bp, Artificial Sequence
  chemically synthesized
gaatccccacacgcctgcctct

SEQ ID NO: 130965 - DNA, 22 bp, Artificial Sequence
  chemically synthesized
cctctgggtaaatatcaacggc

SEQ ID NO: 130966 - DNA, 22 bp, Artificial Sequence
  chemically synthesized
tgggtaaatatcaacggcttcc

SEQ ID NO: 130967 - DNA, 22 bp, Artificial Sequence
  chemically synthesized
ggtaaatatcaacggcttccca

SEQ ID NO: 130968 - DNA, 22 bp, Artificial Sequence
  chemically synthesized
cccagtgttgggcaggcttctt

SEQ ID NO: 130969 - DNA, 22 bp, Artificial Sequence
  chemically synthesized
ccagtgttgggcaggcttcttt

SEQ ID NO: 130970 - DNA, 22 bp, Artificial Sequence
  chemically synthesized
ggcaggcttcttttgtgtttct

SEQ ID NO: 130971 - DNA, 22 bp, Artificial Sequence
  chemically synthesized
cttttgtgtttctttttattcc

SEQ ID NO: 130972 - DNA, 22 bp, Artificial Sequence
  chemically synthesized
ttttgtgtttctttttattccc

SEQ ID NO: 130973 - DNA, 22 bp, Artificial Sequence
  chemically synthesized
ttgtgtttctttttattcccaa

SEQ ID NO: 130974 - DNA, 22 bp, Artificial Sequence
  chemically synthesized
tgtgtttctttttattcccaaa

SEQ ID NO: 130975 - DNA, 22 bp, Artificial Sequence
  chemically synthesized
gtgtttctttttattcccaaaa

SEQ ID NO: 130976 - DNA, 22 bp, Artificial Sequence
  chemically synthesized
tgtttctttttattcccaaaat

SEQ ID NO: 130977 - DNA, 22 bp, Artificial Sequence
  chemically synthesized
ctttttattcccaaaatctcag

SEQ ID NO: 130978 - DNA, 22 bp, Artificial Sequence
  chemically synthesized
tttttattcccaaaatctcaga

SEQ ID NO: 130979 - DNA, 22 bp, Artificial Sequence
  chemically synthesized
tttattcccaaaatctcagaca

SEQ ID NO: 130980 - DNA, 22 bp, Artificial Sequence
  chemically synthesized
ttattcccaaaatctcagacat

SEQ ID NO: 130981 - DNA, 22 bp, Artificial Sequence
  chemically synthesized
tattcccaaaatctcagacatg

SEQ ID NO: 130982 - DNA, 22 bp, Artificial Sequence
  chemically synthesized
attcccaaaatctcagacatga

SEQ ID NO: 130983 - DNA, 22 bp, Artificial Sequence
  chemically synthesized
ttcccaaaatctcagacatgat

SEQ ID NO: 130984 - DNA, 22 bp, Artificial Sequence
  chemically synthesized
ccaaaatctcagacatgattta

SEQ ID NO: 130985 - DNA, 22 bp, Artificial Sequence
  chemically synthesized
agacatgatttacctttcattt

SEQ ID NO: 130986 - DNA, 22 bp, Artificial Sequence
  chemically synthesized
acctttcattttctttgaggta

SEQ ID NO: 130987 - DNA, 22 bp, Artificial Sequence
  chemically synthesized
cctttcattttctttgaggtac

SEQ ID NO: 130988 - DNA, 22 bp, Artificial Sequence
  chemically synthesized
tcattttctttgaggtaccata

SEQ ID NO: 130989 - DNA, 22 bp, Artificial Sequence
  chemically synthesized
cattttctttgaggtaccataa

SEQ ID NO: 130990 - DNA, 22 bp, Artificial Sequence
  chemically synthesized
attttctttgaggtaccataac

SEQ ID NO: 130991 - DNA, 22 bp, Artificial Sequence
  chemically synthesized
tctttgaggtaccataaccttc

SEQ ID NO: 130992 - DNA, 22 bp, Artificial Sequence
  chemically synthesized
ctttgaggtaccataaccttcc

SEQ ID NO: 130993 - DNA, 22 bp, Artificial Sequence
  chemically synthesized
tttgaggtaccataaccttccc

SEQ ID NO: 130994 - DNA, 22 bp, Artificial Sequence
  chemically synthesized
tgaggtaccataaccttccctg

SEQ ID NO: 130995 - DNA, 22 bp, Artificial Sequence
  chemically synthesized
gaggtaccataaccttccctgt

SEQ ID NO: 130996 - DNA, 22 bp, Artificial Sequence
  chemically synthesized
aggtaccataaccttccctgtc

SEQ ID NO: 130997 - DNA, 22 bp, Artificial Sequence
  chemically synthesized
ccctgtcttacttttaatgacc

SEQ ID NO: 130998 - DNA, 22 bp, Artificial Sequence
  chemically synthesized
cctgtcttacttttaatgaccc

SEQ ID NO: 130999 - DNA, 22 bp, Artificial Sequence
  chemically synthesized
tcttacttttaatgacccaagc

SEQ ID NO: 131000 - DNA, 22 bp, Artificial Sequence
  chemically synthesized
acttttaatgacccaagcttag

SEQ ID NO: 131001 - DNA, 22 bp, Artificial Sequence
  chemically synthesized
cttttaatgacccaagcttaga

SEQ ID NO: 131002 - DNA, 22 bp, Artificial Sequence
  chemically synthesized
ttaatgacccaagcttagagat

SEQ ID NO: 131003 - DNA, 22 bp, Artificial Sequence
  chemically synthesized
taatgacccaagcttagagatg

SEQ ID NO: 131004 - DNA, 22 bp, Artificial Sequence
  chemically synthesized
aatgacccaagcttagagatgg

SEQ ID NO: 131005 - DNA, 22 bp, Artificial Sequence
  chemically synthesized
atgacccaagcttagagatgga

SEQ ID NO: 131006 - DNA, 22 bp, Artificial Sequence
  chemically synthesized
agagatggagggagatatgact

SEQ ID NO: 131007 - DNA, 22 bp, Artificial Sequence
  chemically synthesized
gagatggagggagatatgactg

SEQ ID NO: 131008 - DNA, 22 bp, Artificial Sequence
  chemically synthesized
taaacatttttttctgctcata

SEQ ID NO: 131009 - DNA, 22 bp, Artificial Sequence
  chemically synthesized
ttttctgctcataaatataata

SEQ ID NO: 131010 - DNA, 22 bp, Artificial Sequence
  chemically synthesized
tttctgctcataaatataataa

SEQ ID NO: 131011 - DNA, 22 bp, Artificial Sequence
  chemically synthesized
ttctgctcataaatataataaa

SEQ ID NO: 131012 - DNA, 22 bp, Artificial Sequence
  chemically synthesized
tctgctcataaatataataaaa

SEQ ID NO: 131013 - DNA, 22 bp, Artificial Sequence
  chemically synthesized
ctgctcataaatataataaaaa

SEQ ID NO: 131014 - DNA, 22 bp, Artificial Sequence
  chemically synthesized
tgctcataaatataataaaaaa

SEQ ID NO: 131015 - DNA, 22 bp, Artificial Sequence
  chemically synthesized
ctcataaatataataaaaaact

SEQ ID NO: 131016 - DNA, 22 bp, Artificial Sequence
  chemically synthesized
ataaatataataaaaaactttc

SEQ ID NO: 131017 - DNA, 22 bp, Artificial Sequence
  chemically synthesized
tcttttttggtttcaagtgttt

SEQ ID NO: 131018 - DNA, 22 bp, Artificial Sequence
  chemically synthesized
cttttttggtttcaagtgtttt

SEQ ID NO: 131019 - DNA, 22 bp, Artificial Sequence
  chemically synthesized
ttttttggtttcaagtgtttta

SEQ ID NO: 131020 - DNA, 22 bp, Artificial Sequence
  chemically synthesized
ttttggtttcaagtgttttatg

SEQ ID NO: 131021 - DNA, 22 bp, Artificial Sequence
  chemically synthesized
tttggtttcaagtgttttatgg

SEQ ID NO: 131022 - DNA, 22 bp, Artificial Sequence
  chemically synthesized
ttggtttcaagtgttttatggc

SEQ ID NO: 131023 - DNA, 22 bp, Artificial Sequence
  chemically synthesized
tggtttcaagtgttttatggcc

SEQ ID NO: 131024 - DNA, 22 bp, Artificial Sequence
  chemically synthesized
ggtttcaagtgttttatggcca

SEQ ID NO: 131025 - DNA, 22 bp, Artificial Sequence
  chemically synthesized
gtttcaagtgttttatggccaa

SEQ ID NO: 131026 - DNA, 22 bp, Artificial Sequence
  chemically synthesized
caagtgttttatggccaatttc

SEQ ID NO: 131027 - DNA, 22 bp, Artificial Sequence
  chemically synthesized
aagtgttttatggccaatttct

SEQ ID NO: 131028 - DNA, 22 bp, Artificial Sequence
  chemically synthesized
tatggccaatttctctaaagac

SEQ ID NO: 131029 - DNA, 22 bp, Artificial Sequence
  chemically synthesized
atggccaatttctctaaagacg

SEQ ID NO: 131030 - DNA, 22 bp, Artificial Sequence
  chemically synthesized
tggccaatttctctaaagacgt

SEQ ID NO: 131031 - DNA, 22 bp, Artificial Sequence
  chemically synthesized
ctctaaagacgttattgttttt

SEQ ID NO: 131032 - DNA, 22 bp, Artificial Sequence
  chemically synthesized
tctaaagacgttattgtttttt

SEQ ID NO: 131033 - DNA, 22 bp, Artificial Sequence
  chemically synthesized
taaagacgttattgttttttaa

SEQ ID NO: 131034 - DNA, 22 bp, Artificial Sequence
  chemically synthesized
aagacgttattgttttttaagg

SEQ ID NO: 131035 - DNA, 22 bp, Artificial Sequence
  chemically synthesized
ttgttttttaaggaaaagctca

SEQ ID NO: 131036 - DNA, 22 bp, Artificial Sequence
  chemically synthesized
ttttttaaggaaaagctcacaa

SEQ ID NO: 131037 - DNA, 22 bp, Artificial Sequence
  chemically synthesized
tttaaggaaaagctcacaaaca

SEQ ID NO: 131038 - DNA, 22 bp, Artificial Sequence
  chemically synthesized
ttaaggaaaagctcacaaacat

SEQ ID NO: 131039 - DNA, 22 bp, Artificial Sequence
  chemically synthesized
taaggaaaagctcacaaacatt

SEQ ID NO: 131040 - DNA, 22 bp, Artificial Sequence
  chemically synthesized
aaggaaaagctcacaaacattt

SEQ ID NO: 131041 - DNA, 22 bp, Artificial Sequence
  chemically synthesized
aggaaaagctcacaaacatttt

SEQ ID NO: 131042 - DNA, 22 bp, Artificial Sequence
  chemically synthesized
acaaacattttaaaaagtactt

SEQ ID NO: 131043 - DNA, 22 bp, Artificial Sequence
  chemically synthesized
taaaaagtacttgtgctctgga

SEQ ID NO: 131044 - DNA, 22 bp, Artificial Sequence
  chemically synthesized
aaaaagtacttgtgctctggaa

SEQ ID NO: 131045 - DNA, 22 bp, Artificial Sequence
  chemically synthesized
aaaagtacttgtgctctggaaa

SEQ ID NO: 131046 - DNA, 22 bp, Artificial Sequence
  chemically synthesized
gtgctctggaaatctagtttga

SEQ ID NO: 131047 - DNA, 22 bp, Artificial Sequence
  chemically synthesized
tgctctggaaatctagtttgat

SEQ ID NO: 131048 - DNA, 22 bp, Artificial Sequence
  chemically synthesized
tggaaatctagtttgatcctta

SEQ ID NO: 131049 - DNA, 22 bp, Artificial Sequence
  chemically synthesized
gaaatctagtttgatccttaca

SEQ ID NO: 131050 - DNA, 22 bp, Artificial Sequence
  chemically synthesized
gtttgatccttacacaattttt

SEQ ID NO: 131051 - DNA, 22 bp, Artificial Sequence
  chemically synthesized
gatccttacacaatttttttta

SEQ ID NO: 131052 - DNA, 22 bp, Artificial Sequence
  chemically synthesized
atccttacacaattttttttaa

SEQ ID NO: 131053 - DNA, 22 bp, Artificial Sequence
  chemically synthesized
acacaattttttttaaaggaat

SEQ ID NO: 131054 - DNA, 22 bp, Artificial Sequence
  chemically synthesized
cacaattttttttaaaggaatc

SEQ ID NO: 131055 - DNA, 22 bp, Artificial Sequence
  chemically synthesized
tttttaaaggaatcccagattt

SEQ ID NO: 131056 - DNA, 22 bp, Artificial Sequence
  chemically synthesized
ttttaaaggaatcccagatttt

SEQ ID NO: 131057 - DNA, 22 bp, Artificial Sequence
  chemically synthesized
tttaaaggaatcccagatttta

SEQ ID NO: 131058 - DNA, 22 bp, Artificial Sequence
  chemically synthesized
ttaaaggaatcccagattttat

SEQ ID NO: 131059 - DNA, 22 bp, Artificial Sequence
  chemically synthesized
taaaggaatcccagattttatg

SEQ ID NO: 131060 - DNA, 22 bp, Artificial Sequence
  chemically synthesized
aaaggaatcccagattttatgg

SEQ ID NO: 131061 - DNA, 22 bp, Artificial Sequence
  chemically synthesized
aaggaatcccagattttatggc

SEQ ID NO: 131062 - DNA, 22 bp, Artificial Sequence
  chemically synthesized
tatggctttctttttaaaaatt

SEQ ID NO: 131063 - DNA, 22 bp, Artificial Sequence
  chemically synthesized
atggctttctttttaaaaattt

SEQ ID NO: 131064 - DNA, 22 bp, Artificial Sequence
  chemically synthesized
tggctttctttttaaaaatttt

SEQ ID NO: 131065 - DNA, 22 bp, Artificial Sequence
  chemically synthesized
tctttttaaaaattttttattt

SEQ ID NO: 131066 - DNA, 22 bp, Artificial Sequence
  chemically synthesized
ctttttaaaaattttttatttt

SEQ ID NO: 131067 - DNA, 22 bp, Artificial Sequence
  chemically synthesized
tttttaaaaattttttattttt

SEQ ID NO: 131068 - DNA, 22 bp, Artificial Sequence
  chemically synthesized
tttaaaaattttttatttttaa

SEQ ID NO: 131069 - DNA, 22 bp, Artificial Sequence
  chemically synthesized
ttaaaaattttttatttttaaa

SEQ ID NO: 131070 - DNA, 22 bp, Artificial Sequence
  chemically synthesized
taaaaattttttatttttaaaa

SEQ ID NO: 131071 - DNA, 22 bp, Artificial Sequence
  chemically synthesized
aaaaattttttatttttaaaat

SEQ ID NO: 131072 - DNA, 22 bp, Artificial Sequence
  chemically synthesized
aaaattttttatttttaaaatt

SEQ ID NO: 131073 - DNA, 22 bp, Artificial Sequence
  chemically synthesized
tttatttttaaaattttttaaa

SEQ ID NO: 131074 - DNA, 22 bp, Artificial Sequence
  chemically synthesized
ttatttttaaaattttttaaaa

SEQ ID NO: 131075 - DNA, 22 bp, Artificial Sequence
  chemically synthesized
tatttttaaaattttttaaaac

SEQ ID NO: 131076 - DNA, 22 bp, Artificial Sequence
  chemically synthesized
atttttaaaattttttaaaact

SEQ ID NO: 131077 - DNA, 22 bp, Artificial Sequence
  chemically synthesized
tttttaaaattttttaaaactt

SEQ ID NO: 131078 - DNA, 22 bp, Artificial Sequence
  chemically synthesized
ttaaaattttttaaaactttaa

SEQ ID NO: 131079 - DNA, 22 bp, Artificial Sequence
  chemically synthesized
taaaattttttaaaactttaat

SEQ ID NO: 131080 - DNA, 22 bp, Artificial Sequence
  chemically synthesized
aaaattttttaaaactttaatt

SEQ ID NO: 131081 - DNA, 22 bp, Artificial Sequence
  chemically synthesized
aaattttttaaaactttaatta

SEQ ID NO: 131082 - DNA, 22 bp, Artificial Sequence
  chemically synthesized
tttaaaactttaattaaaaaaa

SEQ ID NO: 131083 - DNA, 22 bp, Artificial Sequence
  chemically synthesized
ttaaaactttaattaaaaaaaa

SEQ ID NO: 131084 - DNA, 22 bp, Artificial Sequence
  chemically synthesized
taaaactttaattaaaaaaaat

SEQ ID NO: 131085 - DNA, 22 bp, Artificial Sequence
  chemically synthesized
aaaactttaattaaaaaaaatt

SEQ ID NO: 131086 - DNA, 22 bp, Artificial Sequence
  chemically synthesized
aaactttaattaaaaaaaattt

SEQ ID NO: 131087 - DNA, 22 bp, Artificial Sequence
  chemically synthesized
taattaaaaaaaattttaatgt

SEQ ID NO: 131088 - DNA, 22 bp, Artificial Sequence
  chemically synthesized
aattaaaaaaaattttaatgtg

SEQ ID NO: 131089 - DNA, 22 bp, Artificial Sequence
  chemically synthesized
attaaaaaaaattttaatgtga

SEQ ID NO: 131090 - DNA, 22 bp, Artificial Sequence
  chemically synthesized
aaaaaaattttaatgtgacttt

SEQ ID NO: 131091 - DNA, 22 bp, Artificial Sequence
  chemically synthesized
taatgtgactttcttctatgtt

SEQ ID NO: 131092 - DNA, 22 bp, Artificial Sequence
  chemically synthesized
aatgtgactttcttctatgttt

SEQ ID NO: 131093 - DNA, 22 bp, Artificial Sequence
  chemically synthesized
atgtgactttcttctatgttta

SEQ ID NO: 131094 - DNA, 22 bp, Artificial Sequence
  chemically synthesized
tcttctatgtttacccttcaga

SEQ ID NO: 131095 - DNA, 22 bp, Artificial Sequence
  chemically synthesized
cttctatgtttacccttcagaa

SEQ ID NO: 131096 - DNA, 22 bp, Artificial Sequence
  chemically synthesized
ttctatgtttacccttcagaat

SEQ ID NO: 131097 - DNA, 22 bp, Artificial Sequence
  chemically synthesized
ctatgtttacccttcagaatat

SEQ ID NO: 131098 - DNA, 22 bp, Artificial Sequence
  chemically synthesized
tatgtttacccttcagaatatg

SEQ ID NO: 131099 - DNA, 22 bp, Artificial Sequence
  chemically synthesized
tgtttacccttcagaatatgtg

SEQ ID NO: 131100 - DNA, 22 bp, Artificial Sequence
  chemically synthesized
acccttcagaatatgtgtcacc

SEQ ID NO: 131101 - DNA, 22 bp, Artificial Sequence
  chemically synthesized
cccttcagaatatgtgtcacca

SEQ ID NO: 131102 - DNA, 22 bp, Artificial Sequence
  chemically synthesized
cagaatatgtgtcaccaatttg

SEQ ID NO: 131103 - DNA, 22 bp, Artificial Sequence
  chemically synthesized
agaatatgtgtcaccaatttgt

SEQ ID NO: 131104 - DNA, 22 bp, Artificial Sequence
  chemically synthesized
gtcctttctctaatctgccatt

SEQ ID NO: 131105 - DNA, 22 bp, Artificial Sequence
  chemically synthesized
tcctttctctaatctgccattc

SEQ ID NO: 131106 - DNA, 22 bp, Artificial Sequence
  chemically synthesized
tctctaatctgccattctcttc

SEQ ID NO: 131107 - DNA, 22 bp, Artificial Sequence
  chemically synthesized
ctctaatctgccattctcttcc

SEQ ID NO: 131108 - DNA, 22 bp, Artificial Sequence
  chemically synthesized
tctaatctgccattctcttcct

SEQ ID NO: 131109 - DNA, 22 bp, Artificial Sequence
  chemically synthesized
taatctgccattctcttcctcc

SEQ ID NO: 131110 - DNA, 22 bp, Artificial Sequence
  chemically synthesized
atctgccattctcttcctccta

SEQ ID NO: 131111 - DNA, 22 bp, Artificial Sequence
  chemically synthesized
ccattctcttcctcctatacct

SEQ ID NO: 131112 - DNA, 22 bp, Artificial Sequence
  chemically synthesized
tcttcctcctatacctcattcc

SEQ ID NO: 131113 - DNA, 22 bp, Artificial Sequence
  chemically synthesized
ttcctcctatacctcattccgt

SEQ ID NO: 131114 - DNA, 22 bp, Artificial Sequence
  chemically synthesized
cctcctatacctcattccgtac

SEQ ID NO: 131115 - DNA, 22 bp, Artificial Sequence
  chemically synthesized
ctcctatacctcattccgtaca

SEQ ID NO: 131116 - DNA, 22 bp, Artificial Sequence
  chemically synthesized
ctatacctcattccgtacatcc

SEQ ID NO: 131117 - DNA, 22 bp, Artificial Sequence
  chemically synthesized
tacctcattccgtacatcctct

SEQ ID NO: 131118 - DNA, 22 bp, Artificial Sequence
  chemically synthesized
attccgtacatcctcttattcc

SEQ ID NO: 131119 - DNA, 22 bp, Artificial Sequence
  chemically synthesized
cgtacatcctcttattcctcaa

SEQ ID NO: 131120 - DNA, 22 bp, Artificial Sequence
  chemically synthesized
ttattcctcaatctgtgttttt

SEQ ID NO: 131121 - DNA, 22 bp, Artificial Sequence
  chemically synthesized
attcctcaatctgtgtttttaa

SEQ ID NO: 131122 - DNA, 22 bp, Artificial Sequence
  chemically synthesized
ttcctcaatctgtgtttttaag

SEQ ID NO: 131123 - DNA, 22 bp, Artificial Sequence
  chemically synthesized
ctcaatctgtgtttttaagcat

SEQ ID NO: 131124 - DNA, 22 bp, Artificial Sequence
  chemically synthesized
aatctgtgtttttaagcatgaa

SEQ ID NO: 131125 - DNA, 22 bp, Artificial Sequence
  chemically synthesized
tgtttttaagcatgaaggatct

SEQ ID NO: 131126 - DNA, 22 bp, Artificial Sequence
  chemically synthesized
ttaagcatgaaggatctttcga

SEQ ID NO: 131127 - DNA, 22 bp, Artificial Sequence
  chemically synthesized
taagcatgaaggatctttcgaa

SEQ ID NO: 131128 - DNA, 22 bp, Artificial Sequence
  chemically synthesized
aagcatgaaggatctttcgaag

SEQ ID NO: 131129 - DNA, 22 bp, Artificial Sequence
  chemically synthesized
agcatgaaggatctttcgaagg

SEQ ID NO: 131130 - DNA, 22 bp, Artificial Sequence
  chemically synthesized
tcgaaggtagaacaacatttgt

SEQ ID NO: 131131 - DNA, 22 bp, Artificial Sequence
  chemically synthesized
cgaaggtagaacaacatttgtg

SEQ ID NO: 131132 - DNA, 22 bp, Artificial Sequence
  chemically synthesized
gaaggtagaacaacatttgtgt

SEQ ID NO: 131133 - DNA, 22 bp, Artificial Sequence
  chemically synthesized
gtgtaataattataattcagtc

SEQ ID NO: 131134 - DNA, 22 bp, Artificial Sequence
  chemically synthesized
tgtaataattataattcagtct

SEQ ID NO: 131135 - DNA, 22 bp, Artificial Sequence
  chemically synthesized
taattcagtcttctatatgaat

SEQ ID NO: 131136 - DNA, 22 bp, Artificial Sequence
  chemically synthesized
agtcttctatatgaattcaatg

SEQ ID NO: 131137 - DNA, 22 bp, Artificial Sequence
  chemically synthesized
ctatatgaattcaatgtgattt

SEQ ID NO: 131138 - DNA, 22 bp, Artificial Sequence
  chemically synthesized
tatatgaattcaatgtgattta

SEQ ID NO: 131139 - DNA, 22 bp, Artificial Sequence
  chemically synthesized
tatgaattcaatgtgatttaat

SEQ ID NO: 131140 - DNA, 22 bp, Artificial Sequence
  chemically synthesized
aatgtgatttaattttagggat

SEQ ID NO: 131141 - DNA, 22 bp, Artificial Sequence
  chemically synthesized
aattttagggattccctagtgt

SEQ ID NO: 131142 - DNA, 22 bp, Artificial Sequence
  chemically synthesized
attttagggattccctagtgtt

SEQ ID NO: 131143 - DNA, 22 bp, Artificial Sequence
  chemically synthesized
tagggattccctagtgttggtg

SEQ ID NO: 131144 - DNA, 22 bp, Artificial Sequence
  chemically synthesized
agggattccctagtgttggtga

SEQ ID NO: 131145 - DNA, 22 bp, Artificial Sequence
  chemically synthesized
gggattccctagtgttggtgat

SEQ ID NO: 131146 - DNA, 22 bp, Artificial Sequence
  chemically synthesized
cctagtgttggtgatttcaatc

SEQ ID NO: 131147 - DNA, 22 bp, Artificial Sequence
  chemically synthesized
gtgttggtgatttcaatctcag

SEQ ID NO: 131148 - DNA, 22 bp, Artificial Sequence
  chemically synthesized
gtgatttcaatctcagtaagtt

SEQ ID NO: 131149 - DNA, 22 bp, Artificial Sequence
  chemically synthesized
caatctcagtaagttagtaatc

SEQ ID NO: 131150 - DNA, 22 bp, Artificial Sequence
  chemically synthesized
aatctcagtaagttagtaatcc

SEQ ID NO: 131151 - DNA, 22 bp, Artificial Sequence
  chemically synthesized
agtaagttagtaatcctgactc

SEQ ID NO: 131152 - DNA, 22 bp, Artificial Sequence
  chemically synthesized
gtaatcctgactcacaggagct

SEQ ID NO: 131153 - DNA, 22 bp, Artificial Sequence
  chemically synthesized
actcacaggagctgatacagag

SEQ ID NO: 131154 - DNA, 22 bp, Artificial Sequence
  chemically synthesized
acaggagctgatacagaggtag

SEQ ID NO: 131155 - DNA, 22 bp, Artificial Sequence
  chemically synthesized
atacagaggtagcatcagaaca

SEQ ID NO: 131156 - DNA, 22 bp, Artificial Sequence
  chemically synthesized
ccttatacaatatgaaatgctt

SEQ ID NO: 131157 - DNA, 22 bp, Artificial Sequence
  chemically synthesized
cttatacaatatgaaatgcttt

SEQ ID NO: 131158 - DNA, 22 bp, Artificial Sequence
  chemically synthesized
atacaatatgaaatgctttgtg

SEQ ID NO: 131159 - DNA, 22 bp, Artificial Sequence
  chemically synthesized
tacaatatgaaatgctttgtga

SEQ ID NO: 131160 - DNA, 22 bp, Artificial Sequence
  chemically synthesized
tgtgatttcttctgattctgat

SEQ ID NO: 131161 - DNA, 22 bp, Artificial Sequence
  chemically synthesized
gtgatttcttctgattctgatt

SEQ ID NO: 131162 - DNA, 22 bp, Artificial Sequence
  chemically synthesized
tgatttcttctgattctgattt

SEQ ID NO: 131163 - DNA, 22 bp, Artificial Sequence
  chemically synthesized
cttctgattctgatttattttt

SEQ ID NO: 131164 - DNA, 22 bp, Artificial Sequence
  chemically synthesized
ttctgattctgatttatttttg

SEQ ID NO: 131165 - DNA, 22 bp, Artificial Sequence
  chemically synthesized
ctgattctgatttatttttgat

SEQ ID NO: 131166 - DNA, 22 bp, Artificial Sequence
  chemically synthesized
tgattctgatttatttttgata

SEQ ID NO: 131167 - DNA, 22 bp, Artificial Sequence
  chemically synthesized
attctgatttatttttgatact

SEQ ID NO: 131168 - DNA, 22 bp, Artificial Sequence
  chemically synthesized
tgatttatttttgatactgagg

SEQ ID NO: 131169 - DNA, 22 bp, Artificial Sequence
  chemically synthesized
atttatttttgatactgaggcc

SEQ ID NO: 131170 - DNA, 22 bp, Artificial Sequence
  chemically synthesized
atttttgatactgaggccattt

SEQ ID NO: 131171 - DNA, 22 bp, Artificial Sequence
  chemically synthesized
tttttgatactgaggccatttt

SEQ ID NO: 131172 - DNA, 22 bp, Artificial Sequence
  chemically synthesized
ttgatactgaggccattttatg

SEQ ID NO: 131173 - DNA, 22 bp, Artificial Sequence
  chemically synthesized
tgatactgaggccattttatga

SEQ ID NO: 131174 - DNA, 22 bp, Artificial Sequence
  chemically synthesized
gatactgaggccattttatgaa

SEQ ID NO: 131175 - DNA, 22 bp, Artificial Sequence
  chemically synthesized
atactgaggccattttatgaag

SEQ ID NO: 131176 - DNA, 22 bp, Artificial Sequence
  chemically synthesized
aggccattttatgaagaaaact

SEQ ID NO: 131177 - DNA, 22 bp, Artificial Sequence
  chemically synthesized
tatgaagaaaactgctaggtgc

SEQ ID NO: 131178 - DNA, 22 bp, Artificial Sequence
  chemically synthesized
atgaagaaaactgctaggtgct

SEQ ID NO: 131179 - DNA, 22 bp, Artificial Sequence
  chemically synthesized
tgaagaaaactgctaggtgcta

SEQ ID NO: 131180 - DNA, 22 bp, Artificial Sequence
  chemically synthesized
ctaggtgctaaagacttgcctc

SEQ ID NO: 131181 - DNA, 22 bp, Artificial Sequence
  chemically synthesized
ggtgctaaagacttgcctccag

SEQ ID NO: 131182 - DNA, 22 bp, Artificial Sequence
  chemically synthesized
aagacttgcctccaggattctg

SEQ ID NO: 131183 - DNA, 22 bp, Artificial Sequence
  chemically synthesized
gcctccaggattctgaatttct

SEQ ID NO: 131184 - DNA, 22 bp, Artificial Sequence
  chemically synthesized
cctccaggattctgaatttctc

SEQ ID NO: 131185 - DNA, 22 bp, Artificial Sequence
  chemically synthesized
caggattctgaatttctcgtta

SEQ ID NO: 131186 - DNA, 22 bp, Artificial Sequence
  chemically synthesized
tgaatttctcgttaaataagac

SEQ ID NO: 131187 - DNA, 22 bp, Artificial Sequence
  chemically synthesized
aatttctcgttaaataagactg

SEQ ID NO: 131188 - DNA, 22 bp, Artificial Sequence
  chemically synthesized
ctcgttaaataagactgcagca

SEQ ID NO: 131189 - DNA, 22 bp, Artificial Sequence
  chemically synthesized
tcgttaaataagactgcagcag

SEQ ID NO: 131190 - DNA, 22 bp, Artificial Sequence
  chemically synthesized
gttaaataagactgcagcagag

SEQ ID NO: 131191 - DNA, 22 bp, Artificial Sequence
  chemically synthesized
aataagactgcagcagagctgg

SEQ ID NO: 131192 - DNA, 22 bp, Artificial Sequence
  chemically synthesized
cagcagagctggtaataagctt

SEQ ID NO: 131193 - DNA, 22 bp, Artificial Sequence
  chemically synthesized
gtaataagcttcttctttctcc

SEQ ID NO: 131194 - DNA, 22 bp, Artificial Sequence
  chemically synthesized
cttctttctcccatacccctct

SEQ ID NO: 131195 - DNA, 22 bp, Artificial Sequence
  chemically synthesized
ttctttctcccatacccctctt

SEQ ID NO: 131196 - DNA, 22 bp, Artificial Sequence
  chemically synthesized
ctttctcccatacccctcttgg

SEQ ID NO: 131197 - DNA, 22 bp, Artificial Sequence
  chemically synthesized
tttctcccatacccctcttgga

SEQ ID NO: 131198 - DNA, 22 bp, Artificial Sequence
  chemically synthesized
tctcccatacccctcttggatc

SEQ ID NO: 131199 - DNA, 22 bp, Artificial Sequence
  chemically synthesized
ctcccatacccctcttggatcg

SEQ ID NO: 131200 - DNA, 22 bp, Artificial Sequence
  chemically synthesized
tcccatacccctcttggatcgt

SEQ ID NO: 131201 - DNA, 22 bp, Artificial Sequence
  chemically synthesized
ccatacccctcttggatcgtgg

SEQ ID NO: 131202 - DNA, 22 bp, Artificial Sequence
  chemically synthesized
ttggatcgtggcaaccaagaaa

SEQ ID NO: 131203 - DNA, 22 bp, Artificial Sequence
  chemically synthesized
ggatcgtggcaaccaagaaaac

SEQ ID NO: 131204 - DNA, 22 bp, Artificial Sequence
  chemically synthesized
gatcgtggcaaccaagaaaaca

SEQ ID NO: 131205 - DNA, 22 bp, Artificial Sequence
  chemically synthesized
gcatccttaggctgtggaaaca

SEQ ID NO: 131206 - DNA, 22 bp, Artificial Sequence
  chemically synthesized
aggctgtggaaacattataatt

SEQ ID NO: 131207 - DNA, 22 bp, Artificial Sequence
  chemically synthesized
ggctgtggaaacattataattt

SEQ ID NO: 131208 - DNA, 22 bp, Artificial Sequence
  chemically synthesized
tggaaacattataattttacct

SEQ ID NO: 131209 - DNA, 22 bp, Artificial Sequence
  chemically synthesized
taattttacctgttacagaact

SEQ ID NO: 131210 - DNA, 22 bp, Artificial Sequence
  chemically synthesized
tacctgttacagaactgcaaca

SEQ ID NO: 131211 - DNA, 22 bp, Artificial Sequence
  chemically synthesized
acctgttacagaactgcaacag

SEQ ID NO: 131212 - DNA, 22 bp, Artificial Sequence
  chemically synthesized
cctgttacagaactgcaacagt

SEQ ID NO: 131213 - DNA, 22 bp, Artificial Sequence
  chemically synthesized
ttacagaactgcaacagttcct

SEQ ID NO: 131214 - DNA, 22 bp, Artificial Sequence
  chemically synthesized
cagaactgcaacagttcctcag

SEQ ID NO: 131215 - DNA, 22 bp, Artificial Sequence
  chemically synthesized
caacagttcctcaggagtttgg

SEQ ID NO: 131216 - DNA, 22 bp, Artificial Sequence
  chemically synthesized
ctcaggagtttggagttgatgg

SEQ ID NO: 131217 - DNA, 22 bp, Artificial Sequence
  chemically synthesized
aggagtttggagttgatggaaa

SEQ ID NO: 131218 - DNA, 22 bp, Artificial Sequence
  chemically synthesized
ggagttgatggaaaagcagaga

SEQ ID NO: 131219 - DNA, 22 bp, Artificial Sequence
  chemically synthesized
gagttgatggaaaagcagagag

SEQ ID NO: 131220 - DNA, 22 bp, Artificial Sequence
  chemically synthesized
atggaaaagcagagagaggtaa

SEQ ID NO: 131221 - DNA, 22 bp, Artificial Sequence
  chemically synthesized
agtatttaattatgggaaataa

SEQ ID NO: 131222 - DNA, 22 bp, Artificial Sequence
  chemically synthesized
aattatgggaaataatgttgga

SEQ ID NO: 131223 - DNA, 22 bp, Artificial Sequence
  chemically synthesized
attatgggaaataatgttggaa

SEQ ID NO: 131224 - DNA, 22 bp, Artificial Sequence
  chemically synthesized
tgggaaataatgttggaaaggg

SEQ ID NO: 131225 - DNA, 22 bp, Artificial Sequence
  chemically synthesized
gaaagggcaagtggcagaaaga

SEQ ID NO: 131226 - DNA, 22 bp, Artificial Sequence
  chemically synthesized
tatgaagatatttggagaaaat

SEQ ID NO: 131227 - DNA, 22 bp, Artificial Sequence
  chemically synthesized
ggagaaaatgagaaaatcaact

SEQ ID NO: 131228 - DNA, 22 bp, Artificial Sequence
  chemically synthesized
gagaaaatgagaaaatcaactg

SEQ ID NO: 131229 - DNA, 22 bp, Artificial Sequence
  chemically synthesized
gatggaagcattaaaaggtttc

SEQ ID NO: 131230 - DNA, 22 bp, Artificial Sequence
  chemically synthesized
aaaggtttctatctcgaaagat

SEQ ID NO: 131231 - DNA, 22 bp, Artificial Sequence
  chemically synthesized
ctatctcgaaagatggattagg

SEQ ID NO: 131232 - DNA, 22 bp, Artificial Sequence
  chemically synthesized
tatctcgaaagatggattaggt

SEQ ID NO: 131233 - DNA, 22 bp, Artificial Sequence
  chemically synthesized
tctcgaaagatggattaggtat

SEQ ID NO: 131234 - DNA, 22 bp, Artificial Sequence
  chemically synthesized
gaaagatggattaggtatgaaa

SEQ ID NO: 131235 - DNA, 22 bp, Artificial Sequence
  chemically synthesized
ggtatgaaatgcttatagcagt

SEQ ID NO: 131236 - DNA, 22 bp, Artificial Sequence
  chemically synthesized
atagcagtgatgcccagacatt

SEQ ID NO: 131237 - DNA, 22 bp, Artificial Sequence
  chemically synthesized
tagcagtgatgcccagacattg

SEQ ID NO: 131238 - DNA, 22 bp, Artificial Sequence
  chemically synthesized
ttttgcactggaatcacctgag

SEQ ID NO: 131239 - DNA, 22 bp, Artificial Sequence
  chemically synthesized
tgcactggaatcacctgaggac

SEQ ID NO: 131240 - DNA, 22 bp, Artificial Sequence
  chemically synthesized
gcactggaatcacctgaggacc

SEQ ID NO: 131241 - DNA, 22 bp, Artificial Sequence
  chemically synthesized
cactggaatcacctgaggacct

SEQ ID NO: 131242 - DNA, 22 bp, Artificial Sequence
  chemically synthesized
gaatcacctgaggacctgaaaa

SEQ ID NO: 131243 - DNA, 22 bp, Artificial Sequence
  chemically synthesized
aggacctgaaaaaagcgaattt

SEQ ID NO: 131244 - DNA, 22 bp, Artificial Sequence
  chemically synthesized
aaaaaagcgaatttgattcaga

SEQ ID NO: 131245 - DNA, 22 bp, Artificial Sequence
  chemically synthesized
gattcagaatgttggaaggggc

SEQ ID NO: 131246 - DNA, 22 bp, Artificial Sequence
  chemically synthesized
attcagaatgttggaaggggca

SEQ ID NO: 131247 - DNA, 22 bp, Artificial Sequence
  chemically synthesized
agaatgttggaaggggcagaat

SEQ ID NO: 131248 - DNA, 22 bp, Artificial Sequence
  chemically synthesized
gaaggggcagaatctgaggctg

SEQ ID NO: 131249 - DNA, 22 bp, Artificial Sequence
  chemically synthesized
aggctgcatgcctaacaagccc

SEQ ID NO: 131250 - DNA, 22 bp, Artificial Sequence
  chemically synthesized
catgcctaacaagcccgctgct

SEQ ID NO: 131251 - DNA, 22 bp, Artificial Sequence
  chemically synthesized
acaagcccgctgcttgttagct

SEQ ID NO: 131252 - DNA, 22 bp, Artificial Sequence
  chemically synthesized
cttgttagctgcgtctagtctg

SEQ ID NO: 131253 - DNA, 22 bp, Artificial Sequence
  chemically synthesized
gttagctgcgtctagtctgtga

SEQ ID NO: 131254 - DNA, 22 bp, Artificial Sequence
  chemically synthesized
ttagctgcgtctagtctgtgat

SEQ ID NO: 131255 - DNA, 22 bp, Artificial Sequence
  chemically synthesized
gctgcgtctagtctgtgatcca

SEQ ID NO: 131256 - DNA, 22 bp, Artificial Sequence
  chemically synthesized
cgtctagtctgtgatccacaac

SEQ ID NO: 131257 - DNA, 22 bp, Artificial Sequence
  chemically synthesized
gtctgtgatccacaactctggt

SEQ ID NO: 131258 - DNA, 22 bp, Artificial Sequence
  chemically synthesized
tgatccacaactctggtggcca

SEQ ID NO: 131259 - DNA, 22 bp, Artificial Sequence
  chemically synthesized
tggtggccaagctcaagtaact

SEQ ID NO: 131260 - DNA, 22 bp, Artificial Sequence
  chemically synthesized
gtggccaagctcaagtaactgt

SEQ ID NO: 131261 - DNA, 22 bp, Artificial Sequence
  chemically synthesized
aagtaactgttagagtgacaaa

SEQ ID NO: 131262 - DNA, 22 bp, Artificial Sequence
  chemically synthesized
ttagagtgacaaagccgttcat

SEQ ID NO: 131263 - DNA, 22 bp, Artificial Sequence
  chemically synthesized
gagtgacaaagccgttcattgg

SEQ ID NO: 131264 - DNA, 22 bp, Artificial Sequence
  chemically synthesized
attggtagtgatggtgatgcac

SEQ ID NO: 131265 - DNA, 22 bp, Artificial Sequence
  chemically synthesized
gtagtgatggtgatgcacgcta

SEQ ID NO: 131266 - DNA, 22 bp, Artificial Sequence
  chemically synthesized
tagtgcataaaacactgacatt

SEQ ID NO: 131267 - DNA, 22 bp, Artificial Sequence
  chemically synthesized
acattcaatttccaaaaaaaat

SEQ ID NO: 131268 - DNA, 22 bp, Artificial Sequence
  chemically synthesized
aatttccaaaaaaaatgagaaa

SEQ ID NO: 131269 - DNA, 22 bp, Artificial Sequence
  chemically synthesized
ccaaaaaaaatgagaaaaactg

SEQ ID NO: 131270 - DNA, 22 bp, Artificial Sequence
  chemically synthesized
caaaaaaaatgagaaaaactgc

SEQ ID NO: 131271 - DNA, 22 bp, Artificial Sequence
  chemically synthesized
cattaactgaaaaaactgtctt

SEQ ID NO: 131272 - DNA, 22 bp, Artificial Sequence
  chemically synthesized
actgaaaaaactgtcttcatca

SEQ ID NO: 131273 - DNA, 22 bp, Artificial Sequence
  chemically synthesized
aaaaaactgtcttcatcataat

SEQ ID NO: 131274 - DNA, 22 bp, Artificial Sequence
  chemically synthesized
tcttcatcataatcgtgaaatg

SEQ ID NO: 131275 - DNA, 22 bp, Artificial Sequence
  chemically synthesized
catcataatcgtgaaatgtaaa

SEQ ID NO: 131276 - DNA, 22 bp, Artificial Sequence
  chemically synthesized
atcataatcgtgaaatgtaaaa

SEQ ID NO: 131277 - DNA, 22 bp, Artificial Sequence
  chemically synthesized
caacaatcatttccaaatggtc

SEQ ID NO: 131278 - DNA, 22 bp, Artificial Sequence
  chemically synthesized
ccaaatggtcagtaatcacagc

SEQ ID NO: 131279 - DNA, 22 bp, Artificial Sequence
  chemically synthesized
caaatggtcagtaatcacagca

SEQ ID NO: 131280 - DNA, 22 bp, Artificial Sequence
  chemically synthesized
agccagattattatccatttat

SEQ ID NO: 131281 - DNA, 22 bp, Artificial Sequence
  chemically synthesized
ttatccatttatgtatatttat

SEQ ID NO: 131282 - DNA, 22 bp, Artificial Sequence
  chemically synthesized
tccatttatgtatatttatgtt

SEQ ID NO: 131283 - DNA, 22 bp, Artificial Sequence
  chemically synthesized
atgtatatttatgttatgtgtt

SEQ ID NO: 131284 - DNA, 22 bp, Artificial Sequence
  chemically synthesized
tgtatatttatgttatgtgttt

SEQ ID NO: 131285 - DNA, 22 bp, Artificial Sequence
  chemically synthesized
atgttatgtgtttttgttatca

SEQ ID NO: 131286 - DNA, 22 bp, Artificial Sequence
  chemically synthesized
tgttatgtgtttttgttatcac

SEQ ID NO: 131287 - DNA, 22 bp, Artificial Sequence
  chemically synthesized
tgtgtttttgttatcactgttg

SEQ ID NO: 131288 - DNA, 22 bp, Artificial Sequence
  chemically synthesized
ttgttatcactgttgttgcaaa

SEQ ID NO: 131289 - DNA, 22 bp, Artificial Sequence
  chemically synthesized
tgttatcactgttgttgcaaat

SEQ ID NO: 131290 - DNA, 22 bp, Artificial Sequence
  chemically synthesized
gttatcactgttgttgcaaata

SEQ ID NO: 131291 - DNA, 22 bp, Artificial Sequence
  chemically synthesized
ttatcactgttgttgcaaatat

SEQ ID NO: 131292 - DNA, 22 bp, Artificial Sequence
  chemically synthesized
tcactgttgttgcaaatattta

SEQ ID NO: 131293 - DNA, 22 bp, Artificial Sequence
  chemically synthesized
ttgttgcaaatatttataagta

SEQ ID NO: 131294 - DNA, 22 bp, Artificial Sequence
  chemically synthesized
ttgcaaatatttataagtaccc

SEQ ID NO: 131295 - DNA, 22 bp, Artificial Sequence
  chemically synthesized
caaatatttataagtaccctca

SEQ ID NO: 131296 - DNA, 22 bp, Artificial Sequence
  chemically synthesized
ataagtaccctcaaaatagttg

SEQ ID NO: 131297 - DNA, 22 bp, Artificial Sequence
  chemically synthesized
taagtaccctcaaaatagttgc

SEQ ID NO: 131298 - DNA, 22 bp, Artificial Sequence
  chemically synthesized
aaaatagttgcggataatatat

SEQ ID NO: 131299 - DNA, 22 bp, Artificial Sequence
  chemically synthesized
cggataatatatttaaaattaa

SEQ ID NO: 131300 - DNA, 22 bp, Artificial Sequence
  chemically synthesized
aaaattaatgaaaaatttttga

SEQ ID NO: 131301 - DNA, 22 bp, Artificial Sequence
  chemically synthesized
aaattaatgaaaaatttttgaa

SEQ ID NO: 131302 - DNA, 22 bp, Artificial Sequence
  chemically synthesized
atgaaaaatttttgaatttgag

SEQ ID NO: 131303 - DNA, 22 bp, Artificial Sequence
  chemically synthesized
ttgaatttgagaaaaatcgaac

SEQ ID NO: 131304 - DNA, 22 bp, Artificial Sequence
  chemically synthesized
tgaatttgagaaaaatcgaacc

SEQ ID NO: 131305 - DNA, 22 bp, Artificial Sequence
  chemically synthesized
gaatttgagaaaaatcgaacca

SEQ ID NO: 131306 - DNA, 22 bp, Artificial Sequence
  chemically synthesized
aatttgagaaaaatcgaaccat

SEQ ID NO: 131307 - DNA, 22 bp, Artificial Sequence
  chemically synthesized
gagaaaaatcgaaccattaact

SEQ ID NO: 131308 - DNA, 22 bp, Artificial Sequence
  chemically synthesized
agaaaaatcgaaccattaactc

SEQ ID NO: 131309 - DNA, 22 bp, Artificial Sequence
  chemically synthesized
actcagtattttttctaattag

SEQ ID NO: 131310 - DNA, 22 bp, Artificial Sequence
  chemically synthesized
agtattttttctaattagggaa

SEQ ID NO: 131311 - DNA, 22 bp, Artificial Sequence
  chemically synthesized
tttctaattagggaaaaaacca

SEQ ID NO: 131312 - DNA, 22 bp, Artificial Sequence
  chemically synthesized
ttctaattagggaaaaaaccat

SEQ ID NO: 131313 - DNA, 22 bp, Artificial Sequence
  chemically synthesized
tctaattagggaaaaaaccata

SEQ ID NO: 131314 - DNA, 22 bp, Artificial Sequence
  chemically synthesized
ctaattagggaaaaaaccatag

SEQ ID NO: 131315 - DNA, 22 bp, Artificial Sequence
  chemically synthesized
taattagggaaaaaaccatagt

SEQ ID NO: 131316 - DNA, 22 bp, Artificial Sequence
  chemically synthesized
attagggaaaaaaccatagtct

SEQ ID NO: 131317 - DNA, 22 bp, Artificial Sequence
  chemically synthesized
gggaaaaaaccatagtctgtac

SEQ ID NO: 131318 - DNA, 22 bp, Artificial Sequence
  chemically synthesized
tacatgctattcttcttcagga

SEQ ID NO: 131319 - DNA, 22 bp, Artificial Sequence
  chemically synthesized
ttcttcttcaggaaaatagttg

SEQ ID NO: 131320 - DNA, 22 bp, Artificial Sequence
  chemically synthesized
ttcttcaggaaaatagttgcag

SEQ ID NO: 131321 - DNA, 22 bp, Artificial Sequence
  chemically synthesized
cttcaggaaaatagttgcagag

SEQ ID NO: 131322 - DNA, 22 bp, Artificial Sequence
  chemically synthesized
ttcaggaaaatagttgcagagt

SEQ ID NO: 131323 - DNA, 22 bp, Artificial Sequence
  chemically synthesized
caggaaaatagttgcagagtca

SEQ ID NO: 131324 - DNA, 22 bp, Artificial Sequence
  chemically synthesized
aggaaaatagttgcagagtcaa

SEQ ID NO: 131325 - DNA, 22 bp, Artificial Sequence
  chemically synthesized
cagagtcaaatttatcacacca

SEQ ID NO: 131326 - DNA, 22 bp, Artificial Sequence
  chemically synthesized
atcacaccagttaatcatctcc

SEQ ID NO: 131327 - DNA, 22 bp, Artificial Sequence
  chemically synthesized
tcacaccagttaatcatctcca

SEQ ID NO: 131328 - DNA, 22 bp, Artificial Sequence
  chemically synthesized
atcatctccaagcaggaagatt

SEQ ID NO: 131329 - DNA, 22 bp, Artificial Sequence
  chemically synthesized
caagcaggaagattggaggctc

SEQ ID NO: 131330 - DNA, 22 bp, Artificial Sequence
  chemically synthesized
gaggctcctggtttcaaggttt

SEQ ID NO: 131331 - DNA, 22 bp, Artificial Sequence
  chemically synthesized
ctggtttcaaggtttcaagaaa

SEQ ID NO: 131332 - DNA, 22 bp, Artificial Sequence
  chemically synthesized
gtttcaaggtttcaagaaatct

SEQ ID NO: 131333 - DNA, 22 bp, Artificial Sequence
  chemically synthesized
caaggtttcaagaaatctgatc

SEQ ID NO: 131334 - DNA, 22 bp, Artificial Sequence
  chemically synthesized
aaggtttcaagaaatctgatct

SEQ ID NO: 131335 - DNA, 22 bp, Artificial Sequence
  chemically synthesized
caagaaatctgatctttaccgg

SEQ ID NO: 131336 - DNA, 22 bp, Artificial Sequence
  chemically synthesized
aagaaatctgatctttaccggt

SEQ ID NO: 131337 - DNA, 22 bp, Artificial Sequence
  chemically synthesized
atctttaccggtggatacacta

SEQ ID NO: 131338 - DNA, 22 bp, Artificial Sequence
  chemically synthesized
taccggtggatacactatgtgg

SEQ ID NO: 131339 - DNA, 22 bp, Artificial Sequence
  chemically synthesized
accggtggatacactatgtggc

SEQ ID NO: 131340 - DNA, 22 bp, Artificial Sequence
  chemically synthesized
ccggtggatacactatgtggcc

SEQ ID NO: 131341 - DNA, 22 bp, Artificial Sequence
  chemically synthesized
tgtggcccaatattactgcagc

SEQ ID NO: 131342 - DNA, 22 bp, Artificial Sequence
  chemically synthesized
ctgcagccccttttttgctgac

SEQ ID NO: 131343 - DNA, 22 bp, Artificial Sequence
  chemically synthesized
cagccccttttttgctgactgg

SEQ ID NO: 131344 - DNA, 22 bp, Artificial Sequence
  chemically synthesized
ttttgctgactggctttccagg

SEQ ID NO: 131345 - DNA, 22 bp, Artificial Sequence
  chemically synthesized
tttgctgactggctttccaggg

SEQ ID NO: 131346 - DNA, 22 bp, Artificial Sequence
  chemically synthesized
ttgctgactggctttccagggc

SEQ ID NO: 131347 - DNA, 22 bp, Artificial Sequence
  chemically synthesized
tgctgactggctttccagggct

SEQ ID NO: 131348 - DNA, 22 bp, Artificial Sequence
  chemically synthesized
gctgactggctttccagggctg

SEQ ID NO: 131349 - DNA, 22 bp, Artificial Sequence
  chemically synthesized
ctgactggctttccagggctgg

SEQ ID NO: 131350 - DNA, 22 bp, Artificial Sequence
  chemically synthesized
actggctttccagggctggagg

SEQ ID NO: 131351 - DNA, 22 bp, Artificial Sequence
  chemically synthesized
gctttccagggctggaggcagc

SEQ ID NO: 131352 - DNA, 22 bp, Artificial Sequence
  chemically synthesized
tccagggctggaggcagctcat

SEQ ID NO: 131353 - DNA, 22 bp, Artificial Sequence
  chemically synthesized
ccagggctggaggcagctcatc

SEQ ID NO: 131354 - DNA, 22 bp, Artificial Sequence
  chemically synthesized
cagggctggaggcagctcatca

SEQ ID NO: 131355 - DNA, 22 bp, Artificial Sequence
  chemically synthesized
gaggcagctcatcactggatct

SEQ ID NO: 131356 - DNA, 22 bp, Artificial Sequence
  chemically synthesized
atcactggatctccatcccctt

SEQ ID NO: 131357 - DNA, 22 bp, Artificial Sequence
  chemically synthesized
gatctccatccccttctttgct

SEQ ID NO: 131358 - DNA, 22 bp, Artificial Sequence
  chemically synthesized
catccccttctttgctgtttat

SEQ ID NO: 131359 - DNA, 22 bp, Artificial Sequence
  chemically synthesized
ctttgctgtttatgtgtgcatc

SEQ ID NO: 131360 - DNA, 22 bp, Artificial Sequence
  chemically synthesized
tttgctgtttatgtgtgcatcc

SEQ ID NO: 131361 - DNA, 22 bp, Artificial Sequence
  chemically synthesized
tgctgtttatgtgtgcatcctt

SEQ ID NO: 131362 - DNA, 22 bp, Artificial Sequence
  chemically synthesized
gctgtttatgtgtgcatccttc

SEQ ID NO: 131363 - DNA, 22 bp, Artificial Sequence
  chemically synthesized
ctgtttatgtgtgcatccttct

SEQ ID NO: 131364 - DNA, 22 bp, Artificial Sequence
  chemically synthesized
tttatgtgtgcatccttctggg

SEQ ID NO: 131365 - DNA, 22 bp, Artificial Sequence
  chemically synthesized
atgtgtgcatccttctgggcaa

SEQ ID NO: 131366 - DNA, 22 bp, Artificial Sequence
  chemically synthesized
tgtgtgcatccttctgggcaat

SEQ ID NO: 131367 - DNA, 22 bp, Artificial Sequence
  chemically synthesized
ctgggcaatggcatgctcctct

SEQ ID NO: 131368 - DNA, 22 bp, Artificial Sequence
  chemically synthesized
tgggcaatggcatgctcctcta

SEQ ID NO: 131369 - DNA, 22 bp, Artificial Sequence
  chemically synthesized
ggcaatggcatgctcctctacc

SEQ ID NO: 131370 - DNA, 22 bp, Artificial Sequence
  chemically synthesized
ctctacctcatcaagcatgacc

SEQ ID NO: 131371 - DNA, 22 bp, Artificial Sequence
  chemically synthesized
tacctcatcaagcatgaccaca

SEQ ID NO: 131372 - DNA, 22 bp, Artificial Sequence
  chemically synthesized
cctcatcaagcatgaccacagt

SEQ ID NO: 131373 - DNA, 22 bp, Artificial Sequence
  chemically synthesized
atcaagcatgaccacagtcttc

SEQ ID NO: 131374 - DNA, 22 bp, Artificial Sequence
  chemically synthesized
catgagcccatgtactacttcc

SEQ ID NO: 131375 - DNA, 22 bp, Artificial Sequence
  chemically synthesized
atgagcccatgtactacttcct

SEQ ID NO: 131376 - DNA, 22 bp, Artificial Sequence
  chemically synthesized
cttcctcaccatgctggcaggc

SEQ ID NO: 131377 - DNA, 22 bp, Artificial Sequence
  chemically synthesized
cctcaccatgctggcaggcaca

SEQ ID NO: 131378 - DNA, 22 bp, Artificial Sequence
  chemically synthesized
ctcaccatgctggcaggcacag

SEQ ID NO: 131379 - DNA, 22 bp, Artificial Sequence
  chemically synthesized
accatgctggcaggcacagacc

SEQ ID NO: 131380 - DNA, 22 bp, Artificial Sequence
  chemically synthesized
gcaggcacagacctcatggtga

SEQ ID NO: 131381 - DNA, 22 bp, Artificial Sequence
  chemically synthesized
atggtgacattgaccacgatgc

SEQ ID NO: 131382 - DNA, 22 bp, Artificial Sequence
  chemically synthesized
accacgatgcctactgtaatgg

SEQ ID NO: 131383 - DNA, 22 bp, Artificial Sequence
  chemically synthesized
ctgtaatgggcatcctatgggt

SEQ ID NO: 131384 - DNA, 22 bp, Artificial Sequence
  chemically synthesized
taatgggcatcctatgggtgaa

SEQ ID NO: 131385 - DNA, 22 bp, Artificial Sequence
  chemically synthesized
tgggtgaatcacagggagatta

SEQ ID NO: 131386 - DNA, 22 bp, Artificial Sequence
  chemically synthesized
gcagtgtgggctgcttcctaca

SEQ ID NO: 131387 - DNA, 22 bp, Artificial Sequence
  chemically synthesized
cttcctacaggcttactttatt

SEQ ID NO: 131388 - DNA, 22 bp, Artificial Sequence
  chemically synthesized
cctacaggcttactttattcac

SEQ ID NO: 131389 - DNA, 22 bp, Artificial Sequence
  chemically synthesized
ctacaggcttactttattcact

SEQ ID NO: 131390 - DNA, 22 bp, Artificial Sequence
  chemically synthesized
caggcttactttattcactccc

SEQ ID NO: 131391 - DNA, 22 bp, Artificial Sequence
  chemically synthesized
actttattcactccctttctgt

SEQ ID NO: 131392 - DNA, 22 bp, Artificial Sequence
  chemically synthesized
ctttattcactccctttctgtt

SEQ ID NO: 131393 - DNA, 22 bp, Artificial Sequence
  chemically synthesized
tattcactccctttctgttgtg

SEQ ID NO: 131394 - DNA, 22 bp, Artificial Sequence
  chemically synthesized
attcactccctttctgttgtgg

SEQ ID NO: 131395 - DNA, 22 bp, Artificial Sequence
  chemically synthesized
ttcactccctttctgttgtgga

SEQ ID NO: 131396 - DNA, 22 bp, Artificial Sequence
  chemically synthesized
actccctttctgttgtggaatc

SEQ ID NO: 131397 - DNA, 22 bp, Artificial Sequence
  chemically synthesized
cctttctgttgtggaatcaggt

SEQ ID NO: 131398 - DNA, 22 bp, Artificial Sequence
  chemically synthesized
tctgttgtggaatcaggttccc

SEQ ID NO: 131399 - DNA, 22 bp, Artificial Sequence
  chemically synthesized
ctgttgtggaatcaggttccct

SEQ ID NO: 131400 - DNA, 22 bp, Artificial Sequence
  chemically synthesized
tgttgtggaatcaggttccctc

SEQ ID NO: 131401 - DNA, 22 bp, Artificial Sequence
  chemically synthesized
ttgtggaatcaggttccctcct

SEQ ID NO: 131402 - DNA, 22 bp, Artificial Sequence
  chemically synthesized
tggaatcaggttccctcctggc

SEQ ID NO: 131403 - DNA, 22 bp, Artificial Sequence
  chemically synthesized
cctcctggcaatggcatatgat

SEQ ID NO: 131404 - DNA, 22 bp, Artificial Sequence
  chemically synthesized
ctggcaatggcatatgattgtt

SEQ ID NO: 131405 - DNA, 22 bp, Artificial Sequence
  chemically synthesized
gcaatggcatatgattgtttca

SEQ ID NO: 131406 - DNA, 22 bp, Artificial Sequence
  chemically synthesized
tttcattgccatccgcaatcct

SEQ ID NO: 131407 - DNA, 22 bp, Artificial Sequence
  chemically synthesized
cattgccatccgcaatcctttg

SEQ ID NO: 131408 - DNA, 22 bp, Artificial Sequence
  chemically synthesized
attgccatccgcaatcctttga

SEQ ID NO: 131409 - DNA, 22 bp, Artificial Sequence
  chemically synthesized
ccatccgcaatcctttgagata

SEQ ID NO: 131410 - DNA, 22 bp, Artificial Sequence
  chemically synthesized
tgagatatgcttccattctcac

SEQ ID NO: 131411 - DNA, 22 bp, Artificial Sequence
  chemically synthesized
gagatatgcttccattctcacc

SEQ ID NO: 131412 - DNA, 22 bp, Artificial Sequence
  chemically synthesized
agatatgcttccattctcacca

SEQ ID NO: 131413 - DNA, 22 bp, Artificial Sequence
  chemically synthesized
ccattctcaccaatactagagt

SEQ ID NO: 131414 - DNA, 22 bp, Artificial Sequence
  chemically synthesized
cattctcaccaatactagagtc

SEQ ID NO: 131415 - DNA, 22 bp, Artificial Sequence
  chemically synthesized
tcaccaatactagagtcatagc

SEQ ID NO: 131416 - DNA, 22 bp, Artificial Sequence
  chemically synthesized
accaatactagagtcatagcgt

SEQ ID NO: 131417 - DNA, 22 bp, Artificial Sequence
  chemically synthesized
gagtcatagcgttaggagtggg

SEQ ID NO: 131418 - DNA, 22 bp, Artificial Sequence
  chemically synthesized
ggagtgggagtgtttctaaggg

SEQ ID NO: 131419 - DNA, 22 bp, Artificial Sequence
  chemically synthesized
ctaaggggttttgtatccatcc

SEQ ID NO: 131420 - DNA, 22 bp, Artificial Sequence
  chemically synthesized
taaggggttttgtatccatcct

SEQ ID NO: 131421 - DNA, 22 bp, Artificial Sequence
  chemically synthesized
aggggttttgtatccatcctgc

SEQ ID NO: 131422 - DNA, 22 bp, Artificial Sequence
  chemically synthesized
tgtatccatcctgcctgtaatt

SEQ ID NO: 131423 - DNA, 22 bp, Artificial Sequence
  chemically synthesized
gtatccatcctgcctgtaattt

SEQ ID NO: 131424 - DNA, 22 bp, Artificial Sequence
  chemically synthesized
tatccatcctgcctgtaatttt

SEQ ID NO: 131425 - DNA, 22 bp, Artificial Sequence
  chemically synthesized
cctgtaattttgcgtctttttt

SEQ ID NO: 131426 - DNA, 22 bp, Artificial Sequence
  chemically synthesized
taattttgcgtcttttttcatt

SEQ ID NO: 131427 - DNA, 22 bp, Artificial Sequence
  chemically synthesized
tgcgtcttttttcattttcata

SEQ ID NO: 131428 - DNA, 22 bp, Artificial Sequence
  chemically synthesized
gcgtcttttttcattttcatat

SEQ ID NO: 131429 - DNA, 22 bp, Artificial Sequence
  chemically synthesized
cgtcttttttcattttcatatt

SEQ ID NO: 131430 - DNA, 22 bp, Artificial Sequence
  chemically synthesized
ttttcattttcatattgcaaat

SEQ ID NO: 131431 - DNA, 22 bp, Artificial Sequence
  chemically synthesized
tttcattttcatattgcaaatc

SEQ ID NO: 131432 - DNA, 22 bp, Artificial Sequence
  chemically synthesized
ttcattttcatattgcaaatct

SEQ ID NO: 131433 - DNA, 22 bp, Artificial Sequence
  chemically synthesized
tcattttcatattgcaaatctc

SEQ ID NO: 131434 - DNA, 22 bp, Artificial Sequence
  chemically synthesized
cattttcatattgcaaatctca

SEQ ID NO: 131435 - DNA, 22 bp, Artificial Sequence
  chemically synthesized
attttcatattgcaaatctcat

SEQ ID NO: 131436 - DNA, 22 bp, Artificial Sequence
  chemically synthesized
tcatattgcaaatctcatgtta

SEQ ID NO: 131437 - DNA, 22 bp, Artificial Sequence
  chemically synthesized
catattgcaaatctcatgttat

SEQ ID NO: 131438 - DNA, 22 bp, Artificial Sequence
  chemically synthesized
atattgcaaatctcatgttatc

SEQ ID NO: 131439 - DNA, 22 bp, Artificial Sequence
  chemically synthesized
caaatctcatgttatcacacgt

SEQ ID NO: 131440 - DNA, 22 bp, Artificial Sequence
  chemically synthesized
atgttatcacacgtgctttctg

SEQ ID NO: 131441 - DNA, 22 bp, Artificial Sequence
  chemically synthesized
tcacacgtgctttctgcctcca

SEQ ID NO: 131442 - DNA, 22 bp, Artificial Sequence
  chemically synthesized
tctgcctccaccaagaaatcat

SEQ ID NO: 131443 - DNA, 22 bp, Artificial Sequence
  chemically synthesized
ctgcctccaccaagaaatcatg

SEQ ID NO: 131444 - DNA, 22 bp, Artificial Sequence
  chemically synthesized
tgcctccaccaagaaatcatga

SEQ ID NO: 131445 - DNA, 22 bp, Artificial Sequence
  chemically synthesized
cctccaccaagaaatcatgaga

SEQ ID NO: 131446 - DNA, 22 bp, Artificial Sequence
  chemically synthesized
caccaagaaatcatgagactgg

SEQ ID NO: 131447 - DNA, 22 bp, Artificial Sequence
  chemically synthesized
gcttgtgctgacataactttca

SEQ ID NO: 131448 - DNA, 22 bp, Artificial Sequence
  chemically synthesized
gtgctgacataactttcaatag

SEQ ID NO: 131449 - DNA, 22 bp, Artificial Sequence
  chemically synthesized
tgctgacataactttcaataga

SEQ ID NO: 131450 - DNA, 22 bp, Artificial Sequence
  chemically synthesized
acataactttcaatagacttta

SEQ ID NO: 131451 - DNA, 22 bp, Artificial Sequence
  chemically synthesized
tcaatagactttaccctgtaat

SEQ ID NO: 131452 - DNA, 22 bp, Artificial Sequence
  chemically synthesized
caatagactttaccctgtaatt

SEQ ID NO: 131453 - DNA, 22 bp, Artificial Sequence
  chemically synthesized
aatagactttaccctgtaattt

SEQ ID NO: 131454 - DNA, 22 bp, Artificial Sequence
  chemically synthesized
taccctgtaattttgatctctt

SEQ ID NO: 131455 - DNA, 22 bp, Artificial Sequence
  chemically synthesized
accctgtaattttgatctcttt

SEQ ID NO: 131456 - DNA, 22 bp, Artificial Sequence
  chemically synthesized
ccctgtaattttgatctcttta

SEQ ID NO: 131457 - DNA, 22 bp, Artificial Sequence
  chemically synthesized
taattttgatctctttaacaat

SEQ ID NO: 131458 - DNA, 22 bp, Artificial Sequence
  chemically synthesized
tgatctctttaacaatcttcct

SEQ ID NO: 131459 - DNA, 22 bp, Artificial Sequence
  chemically synthesized
gatctctttaacaatcttccta

SEQ ID NO: 131460 - DNA, 22 bp, Artificial Sequence
  chemically synthesized
atctctttaacaatcttcctag

SEQ ID NO: 131461 - DNA, 22 bp, Artificial Sequence
  chemically synthesized
tttaacaatcttcctagactgt

SEQ ID NO: 131462 - DNA, 22 bp, Artificial Sequence
  chemically synthesized
taacaatcttcctagactgtct

SEQ ID NO: 131463 - DNA, 22 bp, Artificial Sequence
  chemically synthesized
aacaatcttcctagactgtctg

SEQ ID NO: 131464 - DNA, 22 bp, Artificial Sequence
  chemically synthesized
acaatcttcctagactgtctga

SEQ ID NO: 131465 - DNA, 22 bp, Artificial Sequence
  chemically synthesized
cctagactgtctgatcatcctc

SEQ ID NO: 131466 - DNA, 22 bp, Artificial Sequence
  chemically synthesized
ctagactgtctgatcatcctct

SEQ ID NO: 131467 - DNA, 22 bp, Artificial Sequence
  chemically synthesized
gactgtctgatcatcctcttct

SEQ ID NO: 131468 - DNA, 22 bp, Artificial Sequence
  chemically synthesized
tctgatcatcctcttctcctat

SEQ ID NO: 131469 - DNA, 22 bp, Artificial Sequence
  chemically synthesized
atcatcctcttctcctatattc

SEQ ID NO: 131470 - DNA, 22 bp, Artificial Sequence
  chemically synthesized
ttctcctatattctaattctta

SEQ ID NO: 131471 - DNA, 22 bp, Artificial Sequence
  chemically synthesized
ctcctatattctaattcttaat

SEQ ID NO: 131472 - DNA, 22 bp, Artificial Sequence
  chemically synthesized
tcctatattctaattcttaata

SEQ ID NO: 131473 - DNA, 22 bp, Artificial Sequence
  chemically synthesized
ctatattctaattcttaatact

SEQ ID NO: 131474 - DNA, 22 bp, Artificial Sequence
  chemically synthesized
tattctaattcttaatactgtc

SEQ ID NO: 131475 - DNA, 22 bp, Artificial Sequence
  chemically synthesized
taattcttaatactgtcatagg

SEQ ID NO: 131476 - DNA, 22 bp, Artificial Sequence
  chemically synthesized
attcttaatactgtcataggca

SEQ ID NO: 131477 - DNA, 22 bp, Artificial Sequence
  chemically synthesized
ttaatactgtcataggcattgc

SEQ ID NO: 131478 - DNA, 22 bp, Artificial Sequence
  chemically synthesized
aatactgtcataggcattgctt

SEQ ID NO: 131479 - DNA, 22 bp, Artificial Sequence
  chemically synthesized
atactgtcataggcattgcttc

SEQ ID NO: 131480 - DNA, 22 bp, Artificial Sequence
  chemically synthesized
tcataggcattgcttctggtga

SEQ ID NO: 131481 - DNA, 22 bp, Artificial Sequence
  chemically synthesized
cttctggtgaagagagagccaa

SEQ ID NO: 131482 - DNA, 22 bp, Artificial Sequence
  chemically synthesized
ctggtgaagagagagccaaagc

SEQ ID NO: 131483 - DNA, 22 bp, Artificial Sequence
  chemically synthesized
tggtgaagagagagccaaagcc

SEQ ID NO: 131484 - DNA, 22 bp, Artificial Sequence
  chemically synthesized
gtgaagagagagccaaagccct

SEQ ID NO: 131485 - DNA, 22 bp, Artificial Sequence
  chemically synthesized
aatacctgtatctcccacatta

SEQ ID NO: 131486 - DNA, 22 bp, Artificial Sequence
  chemically synthesized
tatctcccacattagttgtgtt

SEQ ID NO: 131487 - DNA, 22 bp, Artificial Sequence
  chemically synthesized
ccacattagttgtgttcttatc

SEQ ID NO: 131488 - DNA, 22 bp, Artificial Sequence
  chemically synthesized
gttgtgttcttatcttctatgt

SEQ ID NO: 131489 - DNA, 22 bp, Artificial Sequence
  chemically synthesized
tgttcttatcttctatgttaca

SEQ ID NO: 131490 - DNA, 22 bp, Artificial Sequence
  chemically synthesized
ttatcttctatgttacagtgat

SEQ ID NO: 131491 - DNA, 22 bp, Artificial Sequence
  chemically synthesized
atcttctatgttacagtgatgg

SEQ ID NO: 131492 - DNA, 22 bp, Artificial Sequence
  chemically synthesized
tcttctatgttacagtgatggg

SEQ ID NO: 131493 - DNA, 22 bp, Artificial Sequence
  chemically synthesized
ctatgttacagtgatgggtttg

SEQ ID NO: 131494 - DNA, 22 bp, Artificial Sequence
  chemically synthesized
tatgttacagtgatgggtttga

SEQ ID NO: 131495 - DNA, 22 bp, Artificial Sequence
  chemically synthesized
tgttacagtgatgggtttgaca

SEQ ID NO: 131496 - DNA, 22 bp, Artificial Sequence
  chemically synthesized
cagtgatgggtttgacattcat

SEQ ID NO: 131497 - DNA, 22 bp, Artificial Sequence
  chemically synthesized
gacattcatttacagatttggg

SEQ ID NO: 131498 - DNA, 22 bp, Artificial Sequence
  chemically synthesized
acattcatttacagatttggga

SEQ ID NO: 131499 - DNA, 22 bp, Artificial Sequence
  chemically synthesized
atttacagatttgggaagaatg

SEQ ID NO: 131500 - DNA, 22 bp, Artificial Sequence
  chemically synthesized
acagatttgggaagaatgtgcc

SEQ ID NO: 131501 - DNA, 22 bp, Artificial Sequence
  chemically synthesized
cagatttgggaagaatgtgcca

SEQ ID NO: 131502 - DNA, 22 bp, Artificial Sequence
  chemically synthesized
gggaagaatgtgccagaggttg

SEQ ID NO: 131503 - DNA, 22 bp, Artificial Sequence
  chemically synthesized
ggaagaatgtgccagaggttgt

SEQ ID NO: 131504 - DNA, 22 bp, Artificial Sequence
  chemically synthesized
tccacattatcatgagttacat

SEQ ID NO: 131505 - DNA, 22 bp, Artificial Sequence
  chemically synthesized
tcatgagttacatctacttcct

SEQ ID NO: 131506 - DNA, 22 bp, Artificial Sequence
  chemically synthesized
catctacttcctctttcctcct

SEQ ID NO: 131507 - DNA, 22 bp, Artificial Sequence
  chemically synthesized
cttcctctttcctcctttaatg

SEQ ID NO: 131508 - DNA, 22 bp, Artificial Sequence
  chemically synthesized
cctctttcctcctttaatgaac

SEQ ID NO: 131509 - DNA, 22 bp, Artificial Sequence
  chemically synthesized
ctctttcctcctttaatgaacc

SEQ ID NO: 131510 - DNA, 22 bp, Artificial Sequence
  chemically synthesized
tttcctcctttaatgaaccctg

SEQ ID NO: 131511 - DNA, 22 bp, Artificial Sequence
  chemically synthesized
tcctcctttaatgaaccctgtc

SEQ ID NO: 131512 - DNA, 22 bp, Artificial Sequence
  chemically synthesized
cctcctttaatgaaccctgtca

SEQ ID NO: 131513 - DNA, 22 bp, Artificial Sequence
  chemically synthesized
ctcctttaatgaaccctgtcat

SEQ ID NO: 131514 - DNA, 22 bp, Artificial Sequence
  chemically synthesized
ctttaatgaaccctgtcatcta

SEQ ID NO: 131515 - DNA, 22 bp, Artificial Sequence
  chemically synthesized
taatgaaccctgtcatctacag

SEQ ID NO: 131516 - DNA, 22 bp, Artificial Sequence
  chemically synthesized
aatgaaccctgtcatctacagc

SEQ ID NO: 131517 - DNA, 22 bp, Artificial Sequence
  chemically synthesized
atgaaccctgtcatctacagca

SEQ ID NO: 131518 - DNA, 22 bp, Artificial Sequence
  chemically synthesized
tcatctacagcatcaaaaccaa

SEQ ID NO: 131519 - DNA, 22 bp, Artificial Sequence
  chemically synthesized
cagcatcaaaaccaagcaaata

SEQ ID NO: 131520 - DNA, 22 bp, Artificial Sequence
  chemically synthesized
tccgccttttatctaaacatag

SEQ ID NO: 131521 - DNA, 22 bp, Artificial Sequence
  chemically synthesized
ttatctaaacataggtttagta

SEQ ID NO: 131522 - DNA, 22 bp, Artificial Sequence
  chemically synthesized
tatctaaacataggtttagtag

SEQ ID NO: 131523 - DNA, 22 bp, Artificial Sequence
  chemically synthesized
atctaaacataggtttagtagt

SEQ ID NO: 131524 - DNA, 22 bp, Artificial Sequence
  chemically synthesized
tctaaacataggtttagtagtt

SEQ ID NO: 131525 - DNA, 22 bp, Artificial Sequence
  chemically synthesized
aacataggtttagtagttaaac

SEQ ID NO: 131526 - DNA, 22 bp, Artificial Sequence
  chemically synthesized
agtagttaaactcggatctgga

SEQ ID NO: 131527 - DNA, 22 bp, Artificial Sequence
  chemically synthesized
gtagttaaactcggatctggag

SEQ ID NO: 131528 - DNA, 22 bp, Artificial Sequence
  chemically synthesized
aactcggatctggagaatcaga

SEQ ID NO: 131529 - DNA, 22 bp, Artificial Sequence
  chemically synthesized
ggatctggagaatcagacacag

SEQ ID NO: 131530 - DNA, 22 bp, Artificial Sequence
  chemically synthesized
gagaatcagacacagacataaa

SEQ ID NO: 131531 - DNA, 22 bp, Artificial Sequence
  chemically synthesized
gagttctttcttagcaaagagc

SEQ ID NO: 131532 - DNA, 22 bp, Artificial Sequence
  chemically synthesized
tttcttagcaaagagcaagggt

SEQ ID NO: 131533 - DNA, 22 bp, Artificial Sequence
  chemically synthesized
tcttagcaaagagcaagggtat

SEQ ID NO: 131534 - DNA, 22 bp, Artificial Sequence
  chemically synthesized
cttagcaaagagcaagggtata

SEQ ID NO: 131535 - DNA, 22 bp, Artificial Sequence
  chemically synthesized
ttagcaaagagcaagggtatac

SEQ ID NO: 131536 - DNA, 22 bp, Artificial Sequence
  chemically synthesized
agcaaagagcaagggtatactg

SEQ ID NO: 131537 - DNA, 22 bp, Artificial Sequence
  chemically synthesized
gcaaagagcaagggtatactgg

SEQ ID NO: 131538 - DNA, 22 bp, Artificial Sequence
  chemically synthesized
gaagacaatgttgtcactcaca

SEQ ID NO: 131539 - DNA, 22 bp, Artificial Sequence
  chemically synthesized
tcactcacaaggacttaagtac

SEQ ID NO: 131540 - DNA, 22 bp, Artificial Sequence
  chemically synthesized
acaaggacttaagtactttacc

SEQ ID NO: 131541 - DNA, 22 bp, Artificial Sequence
  chemically synthesized
aagtactttaccatagggttgg

SEQ ID NO: 131542 - DNA, 22 bp, Artificial Sequence
  chemically synthesized
agtactttaccatagggttggg

SEQ ID NO: 131543 - DNA, 22 bp, Artificial Sequence
  chemically synthesized
taccatagggttgggggcatat

SEQ ID NO: 131544 - DNA, 22 bp, Artificial Sequence
  chemically synthesized
accatagggttgggggcatatc

SEQ ID NO: 131545 - DNA, 22 bp, Artificial Sequence
  chemically synthesized
ccatagggttgggggcatatct

SEQ ID NO: 131546 - DNA, 22 bp, Artificial Sequence
  chemically synthesized
ggggcatatcttaggagaagtc

SEQ ID NO: 131547 - DNA, 22 bp, Artificial Sequence
  chemically synthesized
aggagaagtctggtgacagaac

SEQ ID NO: 131548 - DNA, 22 bp, Artificial Sequence
  chemically synthesized
ggagaagtctggtgacagaaca

SEQ ID NO: 131549 - DNA, 22 bp, Artificial Sequence
  chemically synthesized
gtgacagaacactgaatagacc

SEQ ID NO: 131550 - DNA, 22 bp, Artificial Sequence
  chemically synthesized
aatagaccatatggaactgaaa

SEQ ID NO: 131551 - DNA, 22 bp, Artificial Sequence
  chemically synthesized
aaaaagtctatatttaaattct

SEQ ID NO: 131552 - DNA, 22 bp, Artificial Sequence
  chemically synthesized
tatttaaattcttctttcaaat

SEQ ID NO: 131553 - DNA, 22 bp, Artificial Sequence
  chemically synthesized
aaattcttctttcaaatgcacc

SEQ ID NO: 131554 - DNA, 22 bp, Artificial Sequence
  chemically synthesized
aattcttctttcaaatgcacct

SEQ ID NO: 131555 - DNA, 22 bp, Artificial Sequence
  chemically synthesized
ttctttcaaatgcacctgaaat

SEQ ID NO: 131556 - DNA, 22 bp, Artificial Sequence
  chemically synthesized
ctttcaaatgcacctgaaatta

SEQ ID NO: 131557 - DNA, 22 bp, Artificial Sequence
  chemically synthesized
tttcaaatgcacctgaaattag

SEQ ID NO: 131558 - DNA, 22 bp, Artificial Sequence
  chemically synthesized
tcaaatgcacctgaaattagcc

SEQ ID NO: 131559 - DNA, 22 bp, Artificial Sequence
  chemically synthesized
caaatgcacctgaaattagcca

SEQ ID NO: 131560 - DNA, 22 bp, Artificial Sequence
  chemically synthesized
aaatgcacctgaaattagccac

SEQ ID NO: 131561 - DNA, 22 bp, Artificial Sequence
  chemically synthesized
aaattagccacctcagtgaaat

SEQ ID NO: 131562 - DNA, 22 bp, Artificial Sequence
  chemically synthesized
gccacctcagtgaaatttgagg

SEQ ID NO: 131563 - DNA, 22 bp, Artificial Sequence
  chemically synthesized
agtgaaatttgaggaaaaggca

SEQ ID NO: 131564 - DNA, 22 bp, Artificial Sequence
  chemically synthesized
gaggaaaaggcagaacatataa

SEQ ID NO: 131565 - DNA, 22 bp, Artificial Sequence
  chemically synthesized
aggaaaaggcagaacatataat

SEQ ID NO: 131566 - DNA, 22 bp, Artificial Sequence
  chemically synthesized
tatgaaaaacttttgcctcagt

SEQ ID NO: 131567 - DNA, 22 bp, Artificial Sequence
  chemically synthesized
tgaaaaacttttgcctcagtgt

SEQ ID NO: 131568 - DNA, 22 bp, Artificial Sequence
  chemically synthesized
ttgcctcagtgtgcacatttgt

SEQ ID NO: 131569 - DNA, 22 bp, Artificial Sequence
  chemically synthesized
tgcctcagtgtgcacatttgtg

SEQ ID NO: 131570 - DNA, 22 bp, Artificial Sequence
  chemically synthesized
gcctcagtgtgcacatttgtgc

SEQ ID NO: 131571 - DNA, 22 bp, Artificial Sequence
  chemically synthesized
cctcagtgtgcacatttgtgca

SEQ ID NO: 131572 - DNA, 22 bp, Artificial Sequence
  chemically synthesized
agtgtgcacatttgtgcataca

SEQ ID NO: 131573 - DNA, 22 bp, Artificial Sequence
  chemically synthesized
gtgcatacatgtttatgtgttt

SEQ ID NO: 131574 - DNA, 22 bp, Artificial Sequence
  chemically synthesized
tgcatacatgtttatgtgtttg

SEQ ID NO: 131575 - DNA, 22 bp, Artificial Sequence
  chemically synthesized
atgtgtttgcataggctaatgc

SEQ ID NO: 131576 - DNA, 22 bp, Artificial Sequence
  chemically synthesized
tgtgtttgcataggctaatgca

SEQ ID NO: 131577 - DNA, 22 bp, Artificial Sequence
  chemically synthesized
gcataggctaatgcacacaagt

SEQ ID NO: 131578 - DNA, 22 bp, Artificial Sequence
  chemically synthesized
cataggctaatgcacacaagtg

SEQ ID NO: 131579 - DNA, 22 bp, Artificial Sequence
  chemically synthesized
atgcacacaagtgtaaaaaaaa

SEQ ID NO: 131580 - DNA, 22 bp, Artificial Sequence
  chemically synthesized
atcatcattctctagaaataaa

SEQ ID NO: 131581 - DNA, 22 bp, Artificial Sequence
  chemically synthesized
tctagaaataaattcttattta

SEQ ID NO: 131582 - DNA, 22 bp, Artificial Sequence
  chemically synthesized
tagaaataaattcttatttaaa

SEQ ID NO: 131583 - DNA, 22 bp, Artificial Sequence
  chemically synthesized
gaaataaattcttatttaaaat

SEQ ID NO: 131584 - DNA, 22 bp, Artificial Sequence
  chemically synthesized
ttatttaaaattttcattattc

SEQ ID NO: 131585 - DNA, 22 bp, Artificial Sequence
  chemically synthesized
atttaaaattttcattattctc

SEQ ID NO: 131586 - DNA, 22 bp, Artificial Sequence
  chemically synthesized
tttaaaattttcattattctca

SEQ ID NO: 131587 - DNA, 22 bp, Artificial Sequence
  chemically synthesized
aaaattttcattattctcatgg

SEQ ID NO: 131588 - DNA, 22 bp, Artificial Sequence
  chemically synthesized
aaattttcattattctcatggc

SEQ ID NO: 131589 - DNA, 22 bp, Artificial Sequence
  chemically synthesized
tcattattctcatggcaaatat

SEQ ID NO: 131590 - DNA, 22 bp, Artificial Sequence
  chemically synthesized
cattattctcatggcaaatata

SEQ ID NO: 131591 - DNA, 22 bp, Artificial Sequence
  chemically synthesized
attattctcatggcaaatatag

SEQ ID NO: 131592 - DNA, 22 bp, Artificial Sequence
  chemically synthesized
ttctcatggcaaatatagtgat

SEQ ID NO: 131593 - DNA, 22 bp, Artificial Sequence
  chemically synthesized
tcatggcaaatatagtgataag

SEQ ID NO: 131594 - DNA, 22 bp, Artificial Sequence
  chemically synthesized
atggcaaatatagtgataagaa

SEQ ID NO: 131595 - DNA, 22 bp, Artificial Sequence
  chemically synthesized
acattttaaatttacttttaaa

SEQ ID NO: 131596 - DNA, 22 bp, Artificial Sequence
  chemically synthesized
taaatttacttttaaataagta

SEQ ID NO: 131597 - DNA, 22 bp, Artificial Sequence
  chemically synthesized
aaatttacttttaaataagtaa

SEQ ID NO: 131598 - DNA, 22 bp, Artificial Sequence
  chemically synthesized
aatttacttttaaataagtaag

SEQ ID NO: 131599 - DNA, 22 bp, Artificial Sequence
  chemically synthesized
acttttaaataagtaagtgttg

SEQ ID NO: 131600 - DNA, 22 bp, Artificial Sequence
  chemically synthesized
cttttaaataagtaagtgttgg

SEQ ID NO: 131601 - DNA, 22 bp, Artificial Sequence
  chemically synthesized
ttaaataagtaagtgttggtta

SEQ ID NO: 131602 - DNA, 22 bp, Artificial Sequence
  chemically synthesized
taaataagtaagtgttggttat

SEQ ID NO: 131603 - DNA, 22 bp, Artificial Sequence
  chemically synthesized
aaataagtaagtgttggttatc

SEQ ID NO: 131604 - DNA, 22 bp, Artificial Sequence
  chemically synthesized
aataagtaagtgttggttatct

SEQ ID NO: 131605 - DNA, 22 bp, Artificial Sequence
  chemically synthesized
gttatcttttaactgtcctcta

SEQ ID NO: 131606 - DNA, 22 bp, Artificial Sequence
  chemically synthesized
tcttttaactgtcctctaccct

SEQ ID NO: 131607 - DNA, 22 bp, Artificial Sequence
  chemically synthesized
ttaactgtcctctaccctgagt

SEQ ID NO: 131608 - DNA, 22 bp, Artificial Sequence
  chemically synthesized
taactgtcctctaccctgagtt

SEQ ID NO: 131609 - DNA, 22 bp, Artificial Sequence
  chemically synthesized
aactgtcctctaccctgagtta

SEQ ID NO: 131610 - DNA, 22 bp, Artificial Sequence
  chemically synthesized
actgtcctctaccctgagttag

SEQ ID NO: 131611 - DNA, 22 bp, Artificial Sequence
  chemically synthesized
tcctctaccctgagttagggta

SEQ ID NO: 131612 - DNA, 22 bp, Artificial Sequence
  chemically synthesized
taccctgagttagggtactctc

SEQ ID NO: 131613 - DNA, 22 bp, Artificial Sequence
  chemically synthesized
ccctgagttagggtactctcta

SEQ ID NO: 131614 - DNA, 22 bp, Artificial Sequence
  chemically synthesized
agttagggtactctctagggcc

SEQ ID NO: 131615 - DNA, 22 bp, Artificial Sequence
  chemically synthesized
gggtactctctagggccatgat

SEQ ID NO: 131616 - DNA, 22 bp, Artificial Sequence
  chemically synthesized
tctagggccatgatttgcattt

SEQ ID NO: 131617 - DNA, 22 bp, Artificial Sequence
  chemically synthesized
tagggccatgatttgcatttaa

SEQ ID NO: 131618 - DNA, 22 bp, Artificial Sequence
  chemically synthesized
gggccatgatttgcatttaata

SEQ ID NO: 131619 - DNA, 22 bp, Artificial Sequence
  chemically synthesized
gcatttaatattttctaaatac

SEQ ID NO: 131620 - DNA, 22 bp, Artificial Sequence
  chemically synthesized
catttaatattttctaaataca

SEQ ID NO: 131621 - DNA, 22 bp, Artificial Sequence
  chemically synthesized
aatattttctaaatacagtcgt

SEQ ID NO: 131622 - DNA, 22 bp, Artificial Sequence
  chemically synthesized
atattttctaaatacagtcgta

SEQ ID NO: 131623 - DNA, 22 bp, Artificial Sequence
  chemically synthesized
tctaaatacagtcgtaagtcac

SEQ ID NO: 131624 - DNA, 22 bp, Artificial Sequence
  chemically synthesized
ctaaatacagtcgtaagtcact

SEQ ID NO: 131625 - DNA, 22 bp, Artificial Sequence
  chemically synthesized
taaatacagtcgtaagtcactt

SEQ ID NO: 131626 - DNA, 22 bp, Artificial Sequence
  chemically synthesized
aatacagtcgtaagtcacttac

SEQ ID NO: 131627 - DNA, 22 bp, Artificial Sequence
  chemically synthesized
acagagtatttcaataagagct

SEQ ID NO: 131628 - DNA, 22 bp, Artificial Sequence
  chemically synthesized
cagagtatttcaataagagctt

SEQ ID NO: 131629 - DNA, 22 bp, Artificial Sequence
  chemically synthesized
caataagagctttttaattttc

SEQ ID NO: 131630 - DNA, 22 bp, Artificial Sequence
  chemically synthesized
aataagagctttttaattttca

SEQ ID NO: 131631 - DNA, 22 bp, Artificial Sequence
  chemically synthesized
tttaattttcaatacattcctt

SEQ ID NO: 131632 - DNA, 22 bp, Artificial Sequence
  chemically synthesized
ttaattttcaatacattccttg

SEQ ID NO: 131633 - DNA, 22 bp, Artificial Sequence
  chemically synthesized
taattttcaatacattccttgc

SEQ ID NO: 131634 - DNA, 22 bp, Artificial Sequence
  chemically synthesized
aattttcaatacattccttgca

SEQ ID NO: 131635 - DNA, 22 bp, Artificial Sequence
  chemically synthesized
attttcaatacattccttgcag

SEQ ID NO: 131636 - DNA, 22 bp, Artificial Sequence
  chemically synthesized
tcaatacattccttgcaggatg

SEQ ID NO: 131637 - DNA, 22 bp, Artificial Sequence
  chemically synthesized
caatacattccttgcaggatgt

SEQ ID NO: 131638 - DNA, 22 bp, Artificial Sequence
  chemically synthesized
aatacattccttgcaggatgtc

SEQ ID NO: 131639 - DNA, 22 bp, Artificial Sequence
  chemically synthesized
cttgcaggatgtctggatttta

SEQ ID NO: 131640 - DNA, 22 bp, Artificial Sequence
  chemically synthesized
gcaggatgtctggattttataa

SEQ ID NO: 131641 - DNA, 22 bp, Artificial Sequence
  chemically synthesized
caggatgtctggattttataaa

SEQ ID NO: 131642 - DNA, 22 bp, Artificial Sequence
  chemically synthesized
gattttataaaagtgtatttct

SEQ ID NO: 131643 - DNA, 22 bp, Artificial Sequence
  chemically synthesized
tataaaagtgtatttctttacc

SEQ ID NO: 131644 - DNA, 22 bp, Artificial Sequence
  chemically synthesized
ataaaagtgtatttctttacct

SEQ ID NO: 131645 - DNA, 22 bp, Artificial Sequence
  chemically synthesized
taaaagtgtatttctttacctc

SEQ ID NO: 131646 - DNA, 22 bp, Artificial Sequence
  chemically synthesized
ctttacctcattcttctataaa

SEQ ID NO: 131647 - DNA, 22 bp, Artificial Sequence
  chemically synthesized
tttacctcattcttctataaat

SEQ ID NO: 131648 - DNA, 22 bp, Artificial Sequence
  chemically synthesized
tacctcattcttctataaatat

SEQ ID NO: 131649 - DNA, 22 bp, Artificial Sequence
  chemically synthesized
acctcattcttctataaatatt

SEQ ID NO: 131650 - DNA, 22 bp, Artificial Sequence
  chemically synthesized
cctcattcttctataaatattc

SEQ ID NO: 131651 - DNA, 22 bp, Artificial Sequence
  chemically synthesized
attcttctataaatattctttt

SEQ ID NO: 131652 - DNA, 22 bp, Artificial Sequence
  chemically synthesized
ttctataaatattcttttgccc

SEQ ID NO: 131653 - DNA, 22 bp, Artificial Sequence
  chemically synthesized
ctataaatattcttttgcccaa

SEQ ID NO: 131654 - DNA, 22 bp, Artificial Sequence
  chemically synthesized
tataaatattcttttgcccaaa

SEQ ID NO: 131655 - DNA, 22 bp, Artificial Sequence
  chemically synthesized
taaatattcttttgcccaaaaa

SEQ ID NO: 131656 - DNA, 22 bp, Artificial Sequence
  chemically synthesized
ttttgcccaaaaaaatcttaga

SEQ ID NO: 131657 - DNA, 22 bp, Artificial Sequence
  chemically synthesized
ttgcccaaaaaaatcttagaag

SEQ ID NO: 131658 - DNA, 22 bp, Artificial Sequence
  chemically synthesized
tgcccaaaaaaatcttagaagg

SEQ ID NO: 131659 - DNA, 22 bp, Artificial Sequence
  chemically synthesized
gcccaaaaaaatcttagaagga

SEQ ID NO: 131660 - DNA, 22 bp, Artificial Sequence
  chemically synthesized
cccaaaaaaatcttagaaggaa

SEQ ID NO: 131661 - DNA, 22 bp, Artificial Sequence
  chemically synthesized
agaaggaaaaacctagacaagc

SEQ ID NO: 131662 - DNA, 22 bp, Artificial Sequence
  chemically synthesized
gaaggaaaaacctagacaagct

SEQ ID NO: 131663 - DNA, 22 bp, Artificial Sequence
  chemically synthesized
gacaagcttcttgtcagctcgt

SEQ ID NO: 131664 - DNA, 22 bp, Artificial Sequence
  chemically synthesized
cttgtcagctcgtaaaaaagta

SEQ ID NO: 131665 - DNA, 22 bp, Artificial Sequence
  chemically synthesized
ttgtcagctcgtaaaaaagtaa

SEQ ID NO: 131666 - DNA, 22 bp, Artificial Sequence
  chemically synthesized
gtcagctcgtaaaaaagtaaaa

SEQ ID NO: 131667 - DNA, 22 bp, Artificial Sequence
  chemically synthesized
tcagctcgtaaaaaagtaaaaa

SEQ ID NO: 131668 - DNA, 22 bp, Artificial Sequence
  chemically synthesized
gtaaaaaagtaaaaagtgagtt

SEQ ID NO: 131669 - DNA, 22 bp, Artificial Sequence
  chemically synthesized
ttaagagtatgtttgctcttca

SEQ ID NO: 131670 - DNA, 22 bp, Artificial Sequence
  chemically synthesized
taagagtatgtttgctcttcag

SEQ ID NO: 131671 - DNA, 22 bp, Artificial Sequence
  chemically synthesized
aagagtatgtttgctcttcaga

SEQ ID NO: 131672 - DNA, 22 bp, Artificial Sequence
  chemically synthesized
agagtatgtttgctcttcagat

SEQ ID NO: 131673 - DNA, 22 bp, Artificial Sequence
  chemically synthesized
gctcttcagatgattttaacat

SEQ ID NO: 131674 - DNA, 22 bp, Artificial Sequence
  chemically synthesized
ctcttcagatgattttaacata

SEQ ID NO: 131675 - DNA, 22 bp, Artificial Sequence
  chemically synthesized
ttcagatgattttaacatactt

SEQ ID NO: 131676 - DNA, 22 bp, Artificial Sequence
  chemically synthesized
cagatgattttaacatactttt

SEQ ID NO: 131677 - DNA, 22 bp, Artificial Sequence
  chemically synthesized
agatgattttaacatacttttc

SEQ ID NO: 131678 - DNA, 22 bp, Artificial Sequence
  chemically synthesized
taacatacttttcccttggcct

SEQ ID NO: 131679 - DNA, 22 bp, Artificial Sequence
  chemically synthesized
aacatacttttcccttggccta

SEQ ID NO: 131680 - DNA, 22 bp, Artificial Sequence
  chemically synthesized
acatacttttcccttggcctaa

SEQ ID NO: 131681 - DNA, 22 bp, Artificial Sequence
  chemically synthesized
ttcccttggcctaataatagga

SEQ ID NO: 131682 - DNA, 22 bp, Artificial Sequence
  chemically synthesized
tcccttggcctaataataggaa

SEQ ID NO: 131683 - DNA, 22 bp, Artificial Sequence
  chemically synthesized
cccttggcctaataataggaag

SEQ ID NO: 131684 - DNA, 22 bp, Artificial Sequence
  chemically synthesized
ccttggcctaataataggaagg

SEQ ID NO: 131685 - DNA, 22 bp, Artificial Sequence
  chemically synthesized
ggcctaataataggaagggtca

SEQ ID NO: 131686 - DNA, 22 bp, Artificial Sequence
  chemically synthesized
gcctaataataggaagggtcaa

SEQ ID NO: 131687 - DNA, 22 bp, Artificial Sequence
  chemically synthesized
ataataggaagggtcaaggctc

SEQ ID NO: 131688 - DNA, 22 bp, Artificial Sequence
  chemically synthesized
tattcaaaaatagaaaatatag

SEQ ID NO: 131689 - DNA, 22 bp, Artificial Sequence
  chemically synthesized
ttcaaaaatagaaaatatagcc

SEQ ID NO: 131690 - DNA, 22 bp, Artificial Sequence
  chemically synthesized
aaaaatagaaaatatagccatt

SEQ ID NO: 131691 - DNA, 22 bp, Artificial Sequence
  chemically synthesized
tagaatgaaaaatatgagacat

SEQ ID NO: 131692 - DNA, 22 bp, Artificial Sequence
  chemically synthesized
gaatgaaaaatatgagacatca

SEQ ID NO: 131693 - DNA, 22 bp, Artificial Sequence
  chemically synthesized
cttcacaagttatatatacttt

SEQ ID NO: 131694 - DNA, 22 bp, Artificial Sequence
  chemically synthesized
cacaagttatatatactttata

SEQ ID NO: 131695 - DNA, 22 bp, Artificial Sequence
  chemically synthesized
acaagttatatatactttatat

SEQ ID NO: 131696 - DNA, 22 bp, Artificial Sequence
  chemically synthesized
tatatactttatatatgttcag

SEQ ID NO: 131697 - DNA, 22 bp, Artificial Sequence
  chemically synthesized
tatatatgttcagagggaaaaa

SEQ ID NO: 131698 - DNA, 22 bp, Artificial Sequence
  chemically synthesized
atatatgttcagagggaaaaat

SEQ ID NO: 131699 - DNA, 22 bp, Artificial Sequence
  chemically synthesized
tatatgttcagagggaaaaatt

SEQ ID NO: 131700 - DNA, 22 bp, Artificial Sequence
  chemically synthesized
agagggaaaaattagaaatggt

SEQ ID NO: 131701 - DNA, 22 bp, Artificial Sequence
  chemically synthesized
gaaatggtgattcttttgccat

SEQ ID NO: 131702 - DNA, 22 bp, Artificial Sequence
  chemically synthesized
ttttgccataaatactttctct

SEQ ID NO: 131703 - DNA, 22 bp, Artificial Sequence
  chemically synthesized
ttgccataaatactttctctga

SEQ ID NO: 131704 - DNA, 22 bp, Artificial Sequence
  chemically synthesized
tgccataaatactttctctgac

SEQ ID NO: 131705 - DNA, 22 bp, Artificial Sequence
  chemically synthesized
gccataaatactttctctgaca

SEQ ID NO: 131706 - DNA, 22 bp, Artificial Sequence
  chemically synthesized
ccataaatactttctctgacat

SEQ ID NO: 131707 - DNA, 22 bp, Artificial Sequence
  chemically synthesized
tctctgacatctactgtaaact

SEQ ID NO: 131708 - DNA, 22 bp, Artificial Sequence
  chemically synthesized
ctctgacatctactgtaaactc

SEQ ID NO: 131709 - DNA, 22 bp, Artificial Sequence
  chemically synthesized
tctgacatctactgtaaactct

SEQ ID NO: 131710 - DNA, 22 bp, Artificial Sequence
  chemically synthesized
tgacatctactgtaaactctct

SEQ ID NO: 131711 - DNA, 22 bp, Artificial Sequence
  chemically synthesized
acatctactgtaaactctctat

SEQ ID NO: 131712 - DNA, 22 bp, Artificial Sequence
  chemically synthesized
ctgtaaactctctatattagga

SEQ ID NO: 131713 - DNA, 22 bp, Artificial Sequence
  chemically synthesized
taaactctctatattaggaaga

SEQ ID NO: 131714 - DNA, 22 bp, Artificial Sequence
  chemically synthesized
tctatattaggaagaccaacaa

SEQ ID NO: 131715 - DNA, 22 bp, Artificial Sequence
  chemically synthesized
tatattaggaagaccaacaatg

SEQ ID NO: 131716 - DNA, 22 bp, Artificial Sequence
  chemically synthesized
tattaggaagaccaacaatgtt

SEQ ID NO: 131717 - DNA, 22 bp, Artificial Sequence
  chemically synthesized
ggaagaccaacaatgttgagag

SEQ ID NO: 131718 - DNA, 22 bp, Artificial Sequence
  chemically synthesized
agagaaatggatttcaattcat

SEQ ID NO: 131719 - DNA, 22 bp, Artificial Sequence
  chemically synthesized
caattcatccaatgactaaaaa

SEQ ID NO: 131720 - DNA, 22 bp, Artificial Sequence
  chemically synthesized
aattcatccaatgactaaaaaa

SEQ ID NO: 131721 - DNA, 22 bp, Artificial Sequence
  chemically synthesized
atccaatgactaaaaaattgtg

SEQ ID NO: 131722 - DNA, 22 bp, Artificial Sequence
  chemically synthesized
aaaaattgtggtgggaggagtt

SEQ ID NO: 131723 - DNA, 22 bp, Artificial Sequence
  chemically synthesized
tggtgggaggagtttttgtgtg

SEQ ID NO: 131724 - DNA, 22 bp, Artificial Sequence
  chemically synthesized
ttgtgtgactgtgtactaaaag

SEQ ID NO: 131725 - DNA, 22 bp, Artificial Sequence
  chemically synthesized
tgtgtgactgtgtactaaaagc

SEQ ID NO: 131726 - DNA, 22 bp, Artificial Sequence
  chemically synthesized
gtgtgactgtgtactaaaagct

SEQ ID NO: 131727 - DNA, 22 bp, Artificial Sequence
  chemically synthesized
tgtgactgtgtactaaaagctt

SEQ ID NO: 131728 - DNA, 22 bp, Artificial Sequence
  chemically synthesized
tgtactaaaagcttcttttaga

SEQ ID NO: 131729 - DNA, 22 bp, Artificial Sequence
  chemically synthesized
aaagcttcttttagactgattt

SEQ ID NO: 131730 - DNA, 22 bp, Artificial Sequence
  chemically synthesized
cttttagactgatttaattgtg

SEQ ID NO: 131731 - DNA, 22 bp, Artificial Sequence
  chemically synthesized
ttttagactgatttaattgtga

SEQ ID NO: 131732 - DNA, 22 bp, Artificial Sequence
  chemically synthesized
ttagactgatttaattgtgaaa

SEQ ID NO: 131733 - DNA, 22 bp, Artificial Sequence
  chemically synthesized
tagactgatttaattgtgaaac

SEQ ID NO: 131734 - DNA, 22 bp, Artificial Sequence
  chemically synthesized
agactgatttaattgtgaaaca

SEQ ID NO: 131735 - DNA, 22 bp, Artificial Sequence
  chemically synthesized
gactgatttaattgtgaaacag

SEQ ID NO: 131736 - DNA, 22 bp, Artificial Sequence
  chemically synthesized
atttaattgtgaaacaggattt

SEQ ID NO: 131737 - DNA, 22 bp, Artificial Sequence
  chemically synthesized
aattgtgaaacaggattttcat

SEQ ID NO: 131738 - DNA, 22 bp, Artificial Sequence
  chemically synthesized
attgtgaaacaggattttcatc

SEQ ID NO: 131739 - DNA, 22 bp, Artificial Sequence
  chemically synthesized
tgaaacaggattttcatccaca

SEQ ID NO: 131740 - DNA, 22 bp, Artificial Sequence
  chemically synthesized
tcatccacaaatttcaaaaggg

SEQ ID NO: 131741 - DNA, 22 bp, Artificial Sequence
  chemically synthesized
catccacaaatttcaaaagggg

SEQ ID NO: 131742 - DNA, 22 bp, Artificial Sequence
  chemically synthesized
atccacaaatttcaaaagggga

SEQ ID NO: 131743 - DNA, 22 bp, Artificial Sequence
  chemically synthesized
caaaaggggaaaacctatctca

SEQ ID NO: 131744 - DNA, 22 bp, Artificial Sequence
  chemically synthesized
aaaaggggaaaacctatctcag

SEQ ID NO: 131745 - DNA, 22 bp, Artificial Sequence
  chemically synthesized
tctcagagtataatgttcaagt

SEQ ID NO: 131746 - DNA, 22 bp, Artificial Sequence
  chemically synthesized
agagtataatgttcaagttatt

SEQ ID NO: 131747 - DNA, 22 bp, Artificial Sequence
  chemically synthesized
aagttattgatgctgaatataa

SEQ ID NO: 131748 - DNA, 22 bp, Artificial Sequence
  chemically synthesized
ttgatgctgaatataaactcaa

SEQ ID NO: 131749 - DNA, 22 bp, Artificial Sequence
  chemically synthesized
atgctgaatataaactcaaatc

SEQ ID NO: 131750 - DNA, 22 bp, Artificial Sequence
  chemically synthesized
aatataaactcaaatcctaaaa

SEQ ID NO: 131751 - DNA, 22 bp, Artificial Sequence
  chemically synthesized
aaatcctaaaagtcagttatct

SEQ ID NO: 131752 - DNA, 22 bp, Artificial Sequence
  chemically synthesized
aaagtcagttatctaccaaaga

SEQ ID NO: 131753 - DNA, 22 bp, Artificial Sequence
  chemically synthesized
tctaccaaagactttctctgtt

SEQ ID NO: 131754 - DNA, 22 bp, Artificial Sequence
  chemically synthesized
ccaaagactttctctgttcctt

SEQ ID NO: 131755 - DNA, 22 bp, Artificial Sequence
  chemically synthesized
tctctgttccttatatgtgacc

SEQ ID NO: 131756 - DNA, 22 bp, Artificial Sequence
  chemically synthesized
ctctgttccttatatgtgacca

SEQ ID NO: 131757 - DNA, 22 bp, Artificial Sequence
  chemically synthesized
tctgttccttatatgtgaccat

SEQ ID NO: 131758 - DNA, 22 bp, Artificial Sequence
  chemically synthesized
tgttccttatatgtgaccatga

SEQ ID NO: 131759 - DNA, 22 bp, Artificial Sequence
  chemically synthesized
ttccttatatgtgaccatgagg

SEQ ID NO: 131760 - DNA, 22 bp, Artificial Sequence
  chemically synthesized
cttatatgtgaccatgaggtct

SEQ ID NO: 131761 - DNA, 22 bp, Artificial Sequence
  chemically synthesized
atatgtgaccatgaggtctata

SEQ ID NO: 131762 - DNA, 22 bp, Artificial Sequence
  chemically synthesized
tatgtgaccatgaggtctataa

SEQ ID NO: 131763 - DNA, 22 bp, Artificial Sequence
  chemically synthesized
taatacatctaggcatcttaat

SEQ ID NO: 131764 - DNA, 22 bp, Artificial Sequence
  chemically synthesized
ggcatcttaatggaaaaatctc

SEQ ID NO: 131765 - DNA, 22 bp, Artificial Sequence
  chemically synthesized
aatggaaaaatctcatttcgga

SEQ ID NO: 131766 - DNA, 22 bp, Artificial Sequence
  chemically synthesized
atggaaaaatctcatttcggat

SEQ ID NO: 131767 - DNA, 22 bp, Artificial Sequence
  chemically synthesized
atttcggataattcccatcttg

SEQ ID NO: 131768 - DNA, 22 bp, Artificial Sequence
  chemically synthesized
cggataattcccatcttgattt

SEQ ID NO: 131769 - DNA, 22 bp, Artificial Sequence
  chemically synthesized
ggataattcccatcttgatttg

SEQ ID NO: 131770 - DNA, 22 bp, Artificial Sequence
  chemically synthesized
ccatcttgatttgctatcttga

SEQ ID NO: 131771 - DNA, 22 bp, Artificial Sequence
  chemically synthesized
gatttgctatcttgatgcagaa

SEQ ID NO: 131772 - DNA, 22 bp, Artificial Sequence
  chemically synthesized
atttgctatcttgatgcagaac

SEQ ID NO: 131773 - DNA, 22 bp, Artificial Sequence
  chemically synthesized
gctatcttgatgcagaacctct

SEQ ID NO: 131774 - DNA, 22 bp, Artificial Sequence
  chemically synthesized
ctatcttgatgcagaacctctt

SEQ ID NO: 131775 - DNA, 22 bp, Artificial Sequence
  chemically synthesized
tcttgatgcagaacctcttgta

SEQ ID NO: 131776 - DNA, 22 bp, Artificial Sequence
  chemically synthesized
gatgcagaacctcttgtagctg

SEQ ID NO: 131777 - DNA, 22 bp, Artificial Sequence
  chemically synthesized
atgcagaacctcttgtagctga

SEQ ID NO: 131778 - DNA, 22 bp, Artificial Sequence
  chemically synthesized
ttgtagctgaggaaagcctgcc

SEQ ID NO: 131779 - DNA, 22 bp, Artificial Sequence
  chemically synthesized
gtagctgaggaaagcctgcctt

SEQ ID NO: 131780 - DNA, 22 bp, Artificial Sequence
  chemically synthesized
tagctgaggaaagcctgccttt

SEQ ID NO: 131781 - DNA, 22 bp, Artificial Sequence
  chemically synthesized
aggaaagcctgcctttgtttcc

SEQ ID NO: 131782 - DNA, 22 bp, Artificial Sequence
  chemically synthesized
cctttgtttcccatctttgtag

SEQ ID NO: 131783 - DNA, 22 bp, Artificial Sequence
  chemically synthesized
tgtttcccatctttgtagaaca

SEQ ID NO: 131784 - DNA, 22 bp, Artificial Sequence
  chemically synthesized
gtttcccatctttgtagaacag

SEQ ID NO: 131785 - DNA, 22 bp, Artificial Sequence
  chemically synthesized
tttcccatctttgtagaacaga

SEQ ID NO: 131786 - DNA, 22 bp, Artificial Sequence
  chemically synthesized
cccatctttgtagaacagaagc

SEQ ID NO: 131787 - DNA, 22 bp, Artificial Sequence
  chemically synthesized
ccatctttgtagaacagaagct

SEQ ID NO: 131788 - DNA, 22 bp, Artificial Sequence
  chemically synthesized
tgtagaacagaagctgtgggac

SEQ ID NO: 131789 - DNA, 22 bp, Artificial Sequence
  chemically synthesized
gtagaacagaagctgtgggaca

SEQ ID NO: 131790 - DNA, 22 bp, Artificial Sequence
  chemically synthesized
tagaacagaagctgtgggacat

SEQ ID NO: 131791 - DNA, 22 bp, Artificial Sequence
  chemically synthesized
tgggacatcacaagttgctgtg

SEQ ID NO: 131792 - DNA, 22 bp, Artificial Sequence
  chemically synthesized
ctgtggtaatcacaagttactg

SEQ ID NO: 131793 - DNA, 22 bp, Artificial Sequence
  chemically synthesized
tggtaatcacaagttactgcga

SEQ ID NO: 131794 - DNA, 22 bp, Artificial Sequence
  chemically synthesized
ctgcgatattatatccccatct

SEQ ID NO: 131795 - DNA, 22 bp, Artificial Sequence
  chemically synthesized
cgatattatatccccatctgat

SEQ ID NO: 131796 - DNA, 22 bp, Artificial Sequence
  chemically synthesized
tatccccatctgatatctaaat

SEQ ID NO: 131797 - DNA, 22 bp, Artificial Sequence
  chemically synthesized
atatctaaattttgaggatagg

SEQ ID NO: 131798 - DNA, 22 bp, Artificial Sequence
  chemically synthesized
aattttgaggataggctatctg

SEQ ID NO: 131799 - DNA, 22 bp, Artificial Sequence
  chemically synthesized
tgaggataggctatctgtttta

SEQ ID NO: 131800 - DNA, 22 bp, Artificial Sequence
  chemically synthesized
gaggataggctatctgttttac

SEQ ID NO: 131801 - DNA, 22 bp, Artificial Sequence
  chemically synthesized
aggataggctatctgttttaca

SEQ ID NO: 131802 - DNA, 22 bp, Artificial Sequence
  chemically synthesized
tctgttttacagtgatacattt

SEQ ID NO: 131803 - DNA, 22 bp, Artificial Sequence
  chemically synthesized
ttttacagtgatacatttgatg

SEQ ID NO: 131804 - DNA, 22 bp, Artificial Sequence
  chemically synthesized
tacagtgatacatttgatggaa

SEQ ID NO: 131805 - DNA, 22 bp, Artificial Sequence
  chemically synthesized
acagtgatacatttgatggaag

SEQ ID NO: 131806 - DNA, 22 bp, Artificial Sequence
  chemically synthesized
cagtgatacatttgatggaagg

SEQ ID NO: 131807 - DNA, 22 bp, Artificial Sequence
  chemically synthesized
gatggaaggactcttagtttaa

SEQ ID NO: 131808 - DNA, 22 bp, Artificial Sequence
  chemically synthesized
atggaaggactcttagtttaac

SEQ ID NO: 131809 - DNA, 22 bp, Artificial Sequence
  chemically synthesized
ttagtttaactggccaaggcca

SEQ ID NO: 131810 - DNA, 22 bp, Artificial Sequence
  chemically synthesized
agtttaactggccaaggccagg

SEQ ID NO: 131811 - DNA, 22 bp, Artificial Sequence
  chemically synthesized
gtttaactggccaaggccagga

SEQ ID NO: 131812 - DNA, 22 bp, Artificial Sequence
  chemically synthesized
aactggccaaggccaggacttc

SEQ ID NO: 131813 - DNA, 22 bp, Artificial Sequence
  chemically synthesized
actggccaaggccaggacttca

SEQ ID NO: 131814 - DNA, 22 bp, Artificial Sequence
  chemically synthesized
gccaaggccaggacttcaagcc

SEQ ID NO: 131815 - DNA, 22 bp, Artificial Sequence
  chemically synthesized
caagccatagtttaattacctg

SEQ ID NO: 131816 - DNA, 22 bp, Artificial Sequence
  chemically synthesized
aagccatagtttaattacctgc

SEQ ID NO: 131817 - DNA, 22 bp, Artificial Sequence
  chemically synthesized
aattacctgccacatgtgtgag

SEQ ID NO: 131818 - DNA, 22 bp, Artificial Sequence
  chemically synthesized
attacctgccacatgtgtgaga

SEQ ID NO: 131819 - DNA, 22 bp, Artificial Sequence
  chemically synthesized
cctgccacatgtgtgagaaata

SEQ ID NO: 131820 - DNA, 22 bp, Artificial Sequence
  chemically synthesized
ccacatgtgtgagaaataagga

SEQ ID NO: 131821 - DNA, 22 bp, Artificial Sequence
  chemically synthesized
caaaccatgatggagcagcatc

SEQ ID NO: 131822 - DNA, 22 bp, Artificial Sequence
  chemically synthesized
aaaccatgatggagcagcatca

SEQ ID NO: 131823 - DNA, 22 bp, Artificial Sequence
  chemically synthesized
gcatgccttttgtgtatatggt

SEQ ID NO: 131824 - DNA, 22 bp, Artificial Sequence
  chemically synthesized
ttgtgtatatggtgggttgagg

SEQ ID NO: 131825 - DNA, 22 bp, Artificial Sequence
  chemically synthesized
tgtgtatatggtgggttgagga

SEQ ID NO: 131826 - DNA, 22 bp, Artificial Sequence
  chemically synthesized
gtgtatatggtgggttgaggat

SEQ ID NO: 131827 - DNA, 22 bp, Artificial Sequence
  chemically synthesized
tgtatatggtgggttgaggata

SEQ ID NO: 131828 - DNA, 22 bp, Artificial Sequence
  chemically synthesized
aggatatggcaatattgcagcc

SEQ ID NO: 131829 - DNA, 22 bp, Artificial Sequence
  chemically synthesized
cagcctcactgaataggtataa

SEQ ID NO: 131830 - DNA, 22 bp, Artificial Sequence
  chemically synthesized
actgaataggtataaggaggtg

SEQ ID NO: 131831 - DNA, 22 bp, Artificial Sequence
  chemically synthesized
aataggtataaggaggtgctta

SEQ ID NO: 131832 - DNA, 22 bp, Artificial Sequence
  chemically synthesized
actttggataagcagtgttgtt

SEQ ID NO: 131833 - DNA, 22 bp, Artificial Sequence
  chemically synthesized
ctttggataagcagtgttgttt

SEQ ID NO: 131834 - DNA, 22 bp, Artificial Sequence
  chemically synthesized
tggataagcagtgttgtttcca

SEQ ID NO: 131835 - DNA, 22 bp, Artificial Sequence
  chemically synthesized
ggataagcagtgttgtttccaa

SEQ ID NO: 131836 - DNA, 22 bp, Artificial Sequence
  chemically synthesized
gataagcagtgttgtttccaag

SEQ ID NO: 131837 - DNA, 22 bp, Artificial Sequence
  chemically synthesized
tttccaagatgaaagaagccca

SEQ ID NO: 131838 - DNA, 22 bp, Artificial Sequence
  chemically synthesized
ccaagatgaaagaagcccaaat

SEQ ID NO: 131839 - DNA, 22 bp, Artificial Sequence
  chemically synthesized
caagatgaaagaagcccaaatt

SEQ ID NO: 131840 - DNA, 22 bp, Artificial Sequence
  chemically synthesized
ttgggaaatatgtttattatta

SEQ ID NO: 131841 - DNA, 22 bp, Artificial Sequence
  chemically synthesized
ggaaatatgtttattattaatg

SEQ ID NO: 131842 - DNA, 22 bp, Artificial Sequence
  chemically synthesized
attattaatgacgttgtcctta

SEQ ID NO: 131843 - DNA, 22 bp, Artificial Sequence
  chemically synthesized
ttattaatgacgttgtccttaa

SEQ ID NO: 131844 - DNA, 22 bp, Artificial Sequence
  chemically synthesized
ttaatgacgttgtccttaaact

SEQ ID NO: 131845 - DNA, 22 bp, Artificial Sequence
  chemically synthesized
atgacgttgtccttaaactggt

SEQ ID NO: 131846 - DNA, 22 bp, Artificial Sequence
  chemically synthesized
tccttaaactggtttagacgtt

SEQ ID NO: 131847 - DNA, 22 bp, Artificial Sequence
  chemically synthesized
aaactggtttagacgttgaatt

SEQ ID NO: 131848 - DNA, 22 bp, Artificial Sequence
  chemically synthesized
aactggtttagacgttgaattc

SEQ ID NO: 131849 - DNA, 22 bp, Artificial Sequence
  chemically synthesized
gtttagacgttgaattctctgt

SEQ ID NO: 131850 - DNA, 22 bp, Artificial Sequence
  chemically synthesized
agacgttgaattctctgttctt

SEQ ID NO: 131851 - DNA, 22 bp, Artificial Sequence
  chemically synthesized
gacgttgaattctctgttcttg

SEQ ID NO: 131852 - DNA, 22 bp, Artificial Sequence
  chemically synthesized
aattctctgttcttggtgcctt

SEQ ID NO: 131853 - DNA, 22 bp, Artificial Sequence
  chemically synthesized
tctgttcttggtgccttcatgg

SEQ ID NO: 131854 - DNA, 22 bp, Artificial Sequence
  chemically synthesized
tgttcttggtgccttcatggtt

SEQ ID NO: 131855 - DNA, 22 bp, Artificial Sequence
  chemically synthesized
ttcttggtgccttcatggttgt

SEQ ID NO: 131856 - DNA, 22 bp, Artificial Sequence
  chemically synthesized
ttggtgccttcatggttgttta

SEQ ID NO: 131857 - DNA, 22 bp, Artificial Sequence
  chemically synthesized
ggtgccttcatggttgtttaaa

SEQ ID NO: 131858 - DNA, 22 bp, Artificial Sequence
  chemically synthesized
gtgccttcatggttgtttaaag

SEQ ID NO: 131859 - DNA, 22 bp, Artificial Sequence
  chemically synthesized
catggttgtttaaagaaaatat

SEQ ID NO: 131860 - DNA, 22 bp, Artificial Sequence
  chemically synthesized
atggttgtttaaagaaaatatt

SEQ ID NO: 131861 - DNA, 22 bp, Artificial Sequence
  chemically synthesized
tttaaagaaaatatttttcaaa

SEQ ID NO: 131862 - DNA, 22 bp, Artificial Sequence
  chemically synthesized
aaagaaaatatttttcaaattg

SEQ ID NO: 131863 - DNA, 22 bp, Artificial Sequence
  chemically synthesized
aagaaaatatttttcaaattga

SEQ ID NO: 131864 - DNA, 22 bp, Artificial Sequence
  chemically synthesized
ttcaaattgattctaagagggt

SEQ ID NO: 131865 - DNA, 22 bp, Artificial Sequence
  chemically synthesized
tcaaattgattctaagagggtg

SEQ ID NO: 131866 - DNA, 22 bp, Artificial Sequence
  chemically synthesized
caaattgattctaagagggtga

SEQ ID NO: 131867 - DNA, 22 bp, Artificial Sequence
  chemically synthesized
aaattgattctaagagggtgat

SEQ ID NO: 131868 - DNA, 22 bp, Artificial Sequence
  chemically synthesized
attctaagagggtgatctgaat

SEQ ID NO: 131869 - DNA, 22 bp, Artificial Sequence
  chemically synthesized
taagagggtgatctgaatccac

SEQ ID NO: 131870 - DNA, 22 bp, Artificial Sequence
  chemically synthesized
agagggtgatctgaatccacta

SEQ ID NO: 131871 - DNA, 22 bp, Artificial Sequence
  chemically synthesized
aatccactagcattttatttca

SEQ ID NO: 131872 - DNA, 22 bp, Artificial Sequence
  chemically synthesized
gcattttatttcattgagactt

SEQ ID NO: 131873 - DNA, 22 bp, Artificial Sequence
  chemically synthesized
tatttcattgagacttttcatc

SEQ ID NO: 131874 - DNA, 22 bp, Artificial Sequence
  chemically synthesized
atttcattgagacttttcatct

SEQ ID NO: 131875 - DNA, 22 bp, Artificial Sequence
  chemically synthesized
tttcattgagacttttcatctt

SEQ ID NO: 131876 - DNA, 22 bp, Artificial Sequence
  chemically synthesized
cattgagacttttcatctttta

SEQ ID NO: 131877 - DNA, 22 bp, Artificial Sequence
  chemically synthesized
attgagacttttcatcttttac

SEQ ID NO: 131878 - DNA, 22 bp, Artificial Sequence
  chemically synthesized
agacttttcatcttttacatag

SEQ ID NO: 131879 - DNA, 22 bp, Artificial Sequence
  chemically synthesized
ttcatcttttacatagaaggaa

SEQ ID NO: 131880 - DNA, 22 bp, Artificial Sequence
  chemically synthesized
tcatcttttacatagaaggaaa

SEQ ID NO: 131881 - DNA, 22 bp, Artificial Sequence
  chemically synthesized
catcttttacatagaaggaaac

SEQ ID NO: 131882 - DNA, 22 bp, Artificial Sequence
  chemically synthesized
atcttttacatagaaggaaact

SEQ ID NO: 131883 - DNA, 22 bp, Artificial Sequence
  chemically synthesized
ttacatagaaggaaactaagtt

SEQ ID NO: 131884 - DNA, 22 bp, Artificial Sequence
  chemically synthesized
tacatagaaggaaactaagtta

SEQ ID NO: 131885 - DNA, 22 bp, Artificial Sequence
  chemically synthesized
acatagaaggaaactaagttat

SEQ ID NO: 131886 - DNA, 22 bp, Artificial Sequence
  chemically synthesized
catagaaggaaactaagttatt

SEQ ID NO: 131887 - DNA, 22 bp, Artificial Sequence
  chemically synthesized
agttattagtgctctgaaatat

SEQ ID NO: 131888 - DNA, 22 bp, Artificial Sequence
  chemically synthesized
ttagtgctctgaaatatcaact

SEQ ID NO: 131889 - DNA, 22 bp, Artificial Sequence
  chemically synthesized
gtgctctgaaatatcaactttc

SEQ ID NO: 131890 - DNA, 22 bp, Artificial Sequence
  chemically synthesized
tgaaatatcaactttcatgata

SEQ ID NO: 131891 - DNA, 22 bp, Artificial Sequence
  chemically synthesized
aaatatcaactttcatgataaa

SEQ ID NO: 131892 - DNA, 22 bp, Artificial Sequence
  chemically synthesized
tcatgataaaagatacacagtc

SEQ ID NO: 131893 - DNA, 22 bp, Artificial Sequence
  chemically synthesized
catgataaaagatacacagtcc

SEQ ID NO: 131894 - DNA, 22 bp, Artificial Sequence
  chemically synthesized
atgataaaagatacacagtccc

SEQ ID NO: 131895 - DNA, 22 bp, Artificial Sequence
  chemically synthesized
ctgagggcacaagccaatactt

SEQ ID NO: 131896 - DNA, 22 bp, Artificial Sequence
  chemically synthesized
tgagggcacaagccaatacttc

SEQ ID NO: 131897 - DNA, 22 bp, Artificial Sequence
  chemically synthesized
agggcacaagccaatacttcat

SEQ ID NO: 131898 - DNA, 22 bp, Artificial Sequence
  chemically synthesized
cattaaaccaaaccagctatca

SEQ ID NO: 131899 - DNA, 22 bp, Artificial Sequence
  chemically synthesized
attaaaccaaaccagctatcac

SEQ ID NO: 131900 - DNA, 22 bp, Artificial Sequence
  chemically synthesized
aaccaaaccagctatcactctt

SEQ ID NO: 131901 - DNA, 22 bp, Artificial Sequence
  chemically synthesized
tcactcttctgtcatattttta

SEQ ID NO: 131902 - DNA, 22 bp, Artificial Sequence
  chemically synthesized
ttctgtcatatttttaataagg

SEQ ID NO: 131903 - DNA, 22 bp, Artificial Sequence
  chemically synthesized
ctgtcatatttttaataaggag

SEQ ID NO: 131904 - DNA, 22 bp, Artificial Sequence
  chemically synthesized
tgtcatatttttaataaggagg

SEQ ID NO: 131905 - DNA, 22 bp, Artificial Sequence
  chemically synthesized
tcatatttttaataaggaggac

SEQ ID NO: 131906 - DNA, 22 bp, Artificial Sequence
  chemically synthesized
ttaataaggaggacagcttcct

SEQ ID NO: 131907 - DNA, 22 bp, Artificial Sequence
  chemically synthesized
taataaggaggacagcttcctt

SEQ ID NO: 131908 - DNA, 22 bp, Artificial Sequence
  chemically synthesized
aataaggaggacagcttccttt

SEQ ID NO: 131909 - DNA, 22 bp, Artificial Sequence
  chemically synthesized
ataaggaggacagcttccttta

SEQ ID NO: 131910 - DNA, 22 bp, Artificial Sequence
  chemically synthesized
cctttaaattctctaaaaacaa

SEQ ID NO: 131911 - DNA, 22 bp, Artificial Sequence
  chemically synthesized
ctttaaattctctaaaaacaaa

SEQ ID NO: 131912 - DNA, 22 bp, Artificial Sequence
  chemically synthesized
taaattctctaaaaacaaaata

SEQ ID NO: 131913 - DNA, 22 bp, Artificial Sequence
  chemically synthesized
aaattctctaaaaacaaaataa

SEQ ID NO: 131914 - DNA, 22 bp, Artificial Sequence
  chemically synthesized
aattctctaaaaacaaaataat

SEQ ID NO: 131915 - DNA, 22 bp, Artificial Sequence
  chemically synthesized
tctaaaaacaaaataatatcct

SEQ ID NO: 131916 - DNA, 22 bp, Artificial Sequence
  chemically synthesized
taaaaacaaaataatatcctta

SEQ ID NO: 131917 - DNA, 22 bp, Artificial Sequence
  chemically synthesized
aaaacaaaataatatccttatt

SEQ ID NO: 131918 - DNA, 22 bp, Artificial Sequence
  chemically synthesized
attcagccttcccactttacca

SEQ ID NO: 131919 - DNA, 22 bp, Artificial Sequence
  chemically synthesized
ttcagccttcccactttaccac

SEQ ID NO: 131920 - DNA, 22 bp, Artificial Sequence
  chemically synthesized
agccttcccactttaccacatg

SEQ ID NO: 131921 - DNA, 22 bp, Artificial Sequence
  chemically synthesized
cccactttaccacatgacctga

SEQ ID NO: 131922 - DNA, 22 bp, Artificial Sequence
  chemically synthesized
ccactttaccacatgacctgat

SEQ ID NO: 131923 - DNA, 22 bp, Artificial Sequence
  chemically synthesized
taccacatgacctgattaacct

SEQ ID NO: 131924 - DNA, 22 bp, Artificial Sequence
  chemically synthesized
accacatgacctgattaaccta

SEQ ID NO: 131925 - DNA, 22 bp, Artificial Sequence
  chemically synthesized
ccacatgacctgattaacctat

SEQ ID NO: 131926 - DNA, 22 bp, Artificial Sequence
  chemically synthesized
attaacctattaatgacactgt

SEQ ID NO: 131927 - DNA, 22 bp, Artificial Sequence
  chemically synthesized
acctattaatgacactgtacta

SEQ ID NO: 131928 - DNA, 22 bp, Artificial Sequence
  chemically synthesized
ttaatgacactgtactatgtca

SEQ ID NO: 131929 - DNA, 22 bp, Artificial Sequence
  chemically synthesized
atgacactgtactatgtcaatt

SEQ ID NO: 131930 - DNA, 22 bp, Artificial Sequence
  chemically synthesized
tactatgtcaattatgatatcc

SEQ ID NO: 131931 - DNA, 22 bp, Artificial Sequence
  chemically synthesized
tgtcaattatgatatcctgtct

SEQ ID NO: 131932 - DNA, 22 bp, Artificial Sequence
  chemically synthesized
tgatatcctgtctttacctata

SEQ ID NO: 131933 - DNA, 22 bp, Artificial Sequence
  chemically synthesized
tctttacctatatgttaatgaa

SEQ ID NO: 131934 - DNA, 22 bp, Artificial Sequence
  chemically synthesized
tacctatatgttaatgaaactg

SEQ ID NO: 131935 - DNA, 22 bp, Artificial Sequence
  chemically synthesized
acctatatgttaatgaaactgt

SEQ ID NO: 131936 - DNA, 22 bp, Artificial Sequence
  chemically synthesized
cctatatgttaatgaaactgtt

SEQ ID NO: 131937 - DNA, 22 bp, Artificial Sequence
  chemically synthesized
tatgttaatgaaactgttagaa

SEQ ID NO: 131938 - DNA, 22 bp, Artificial Sequence
  chemically synthesized
atgaaactgttagaaaagaaaa

SEQ ID NO: 131939 - DNA, 22 bp, Artificial Sequence
  chemically synthesized
ttagaaaagaaaatgatatgag

SEQ ID NO: 131940 - DNA, 22 bp, Artificial Sequence
  chemically synthesized
gaaaagaaaatgatatgagtaa

SEQ ID NO: 131941 - DNA, 22 bp, Artificial Sequence
  chemically synthesized
tctccagggtatcctttgtgca

SEQ ID NO: 131942 - DNA, 22 bp, Artificial Sequence
  chemically synthesized
ctccagggtatcctttgtgcaa

SEQ ID NO: 131943 - DNA, 22 bp, Artificial Sequence
  chemically synthesized
tccagggtatcctttgtgcaaa

SEQ ID NO: 131944 - DNA, 22 bp, Artificial Sequence
  chemically synthesized
cagggtatcctttgtgcaaagc

SEQ ID NO: 131945 - DNA, 22 bp, Artificial Sequence
  chemically synthesized
tgtgcaaagcacttcattgaaa

SEQ ID NO: 131946 - DNA, 22 bp, Artificial Sequence
  chemically synthesized
gtgcaaagcacttcattgaaac

SEQ ID NO: 131947 - DNA, 22 bp, Artificial Sequence
  chemically synthesized
tgcaaagcacttcattgaaact

SEQ ID NO: 131948 - DNA, 22 bp, Artificial Sequence
  chemically synthesized
cattgaaactgattctcttcat

SEQ ID NO: 131949 - DNA, 22 bp, Artificial Sequence
  chemically synthesized
attgaaactgattctcttcatc

SEQ ID NO: 131950 - DNA, 22 bp, Artificial Sequence
  chemically synthesized
aaactgattctcttcatctttt

SEQ ID NO: 131951 - DNA, 22 bp, Artificial Sequence
  chemically synthesized
attctcttcatcttttctacaa

SEQ ID NO: 131952 - DNA, 22 bp, Artificial Sequence
  chemically synthesized
tcttcatcttttctacaaagtc

SEQ ID NO: 131953 - DNA, 22 bp, Artificial Sequence
  chemically synthesized
ttcatcttttctacaaagtcag

SEQ ID NO: 131954 - DNA, 22 bp, Artificial Sequence
  chemically synthesized
catcttttctacaaagtcagca

SEQ ID NO: 131955 - DNA, 22 bp, Artificial Sequence
  chemically synthesized
atcttttctacaaagtcagcat

SEQ ID NO: 131956 - DNA, 22 bp, Artificial Sequence
  chemically synthesized
ttctacaaagtcagcatgtaaa

SEQ ID NO: 131957 - DNA, 22 bp, Artificial Sequence
  chemically synthesized
tctacaaagtcagcatgtaaaa

SEQ ID NO: 131958 - DNA, 22 bp, Artificial Sequence
  chemically synthesized
ctacaaagtcagcatgtaaaac

SEQ ID NO: 131959 - DNA, 22 bp, Artificial Sequence
  chemically synthesized
tacaaagtcagcatgtaaaaca

SEQ ID NO: 131960 - DNA, 22 bp, Artificial Sequence
  chemically synthesized
caaagtcagcatgtaaaacact

SEQ ID NO: 131961 - DNA, 22 bp, Artificial Sequence
  chemically synthesized
attaatgtacaatgaccaatca

SEQ ID NO: 131962 - DNA, 22 bp, Artificial Sequence
  chemically synthesized
atgtacaatgaccaatcaataa

SEQ ID NO: 131963 - DNA, 22 bp, Artificial Sequence
  chemically synthesized
ttgattagtgaataaagtcatt

SEQ ID NO: 131964 - DNA, 22 bp, Artificial Sequence
  chemically synthesized
attagtgaataaagtcattatc

SEQ ID NO: 131965 - DNA, 22 bp, Artificial Sequence
  chemically synthesized
gtgaataaagtcattatcttct

SEQ ID NO: 131966 - DNA, 22 bp, Artificial Sequence
  chemically synthesized
tcttcttgtgataactatggaa

SEQ ID NO: 131967 - DNA, 22 bp, Artificial Sequence
  chemically synthesized
cttgtgataactatggaagtca

SEQ ID NO: 131968 - DNA, 22 bp, Artificial Sequence
  chemically synthesized
ttgtgataactatggaagtcaa

SEQ ID NO: 131969 - DNA, 22 bp, Artificial Sequence
  chemically synthesized
gtgataactatggaagtcaatg

SEQ ID NO: 131970 - DNA, 22 bp, Artificial Sequence
  chemically synthesized
tgataactatggaagtcaatgg

SEQ ID NO: 131971 - DNA, 22 bp, Artificial Sequence
  chemically synthesized
tggaagtcaatggaactactct

SEQ ID NO: 131972 - DNA, 22 bp, Artificial Sequence
  chemically synthesized
ctctccattcagcaaaactcag

SEQ ID NO: 131973 - DNA, 22 bp, Artificial Sequence
  chemically synthesized
tccattcagcaaaactcagaaa

SEQ ID NO: 131974 - DNA, 22 bp, Artificial Sequence
  chemically synthesized
cattcagcaaaactcagaaatt

SEQ ID NO: 131975 - DNA, 22 bp, Artificial Sequence
  chemically synthesized
agcaaaactcagaaattcaggt

SEQ ID NO: 131976 - DNA, 22 bp, Artificial Sequence
  chemically synthesized
agaaattcaggtggcattactt

SEQ ID NO: 131977 - DNA, 22 bp, Artificial Sequence
  chemically synthesized
aggtggcattacttacgcttct

SEQ ID NO: 131978 - DNA, 22 bp, Artificial Sequence
  chemically synthesized
cttacgcttctttctctttaat

SEQ ID NO: 131979 - DNA, 22 bp, Artificial Sequence
  chemically synthesized
acgcttctttctctttaatcta

SEQ ID NO: 131980 - DNA, 22 bp, Artificial Sequence
  chemically synthesized
cgcttctttctctttaatctac

SEQ ID NO: 131981 - DNA, 22 bp, Artificial Sequence
  chemically synthesized
ctttctctttaatctactacct

SEQ ID NO: 131982 - DNA, 22 bp, Artificial Sequence
  chemically synthesized
tttctctttaatctactacctt

SEQ ID NO: 131983 - DNA, 22 bp, Artificial Sequence
  chemically synthesized
tctctttaatctactaccttca

SEQ ID NO: 131984 - DNA, 22 bp, Artificial Sequence
  chemically synthesized
ctctttaatctactaccttcaa

SEQ ID NO: 131985 - DNA, 22 bp, Artificial Sequence
  chemically synthesized
tctttaatctactaccttcaat

SEQ ID NO: 131986 - DNA, 22 bp, Artificial Sequence
  chemically synthesized
tttaatctactaccttcaatca

SEQ ID NO: 131987 - DNA, 22 bp, Artificial Sequence
  chemically synthesized
taatctactaccttcaatcact

SEQ ID NO: 131988 - DNA, 22 bp, Artificial Sequence
  chemically synthesized
aatctactaccttcaatcactc

SEQ ID NO: 131989 - DNA, 22 bp, Artificial Sequence
  chemically synthesized
atctactaccttcaatcactca

SEQ ID NO: 131990 - DNA, 22 bp, Artificial Sequence
  chemically synthesized
ctaccttcaatcactcagttct

SEQ ID NO: 131991 - DNA, 22 bp, Artificial Sequence
  chemically synthesized
ccttcaatcactcagttctatt

SEQ ID NO: 131992 - DNA, 22 bp, Artificial Sequence
  chemically synthesized
caatcactcagttctattctaa

SEQ ID NO: 131993 - DNA, 22 bp, Artificial Sequence
  chemically synthesized
aatcactcagttctattctaag

SEQ ID NO: 131994 - DNA, 22 bp, Artificial Sequence
  chemically synthesized
agttctattctaagtcatagaa

SEQ ID NO: 131995 - DNA, 22 bp, Artificial Sequence
  chemically synthesized
tattctaagtcatagaatctct

SEQ ID NO: 131996 - DNA, 22 bp, Artificial Sequence
  chemically synthesized
ttctaagtcatagaatctctct

SEQ ID NO: 131997 - DNA, 22 bp, Artificial Sequence
  chemically synthesized
taagtcatagaatctctcttct

SEQ ID NO: 131998 - DNA, 22 bp, Artificial Sequence
  chemically synthesized
agtcatagaatctctcttctat

SEQ ID NO: 131999 - DNA, 22 bp, Artificial Sequence
  chemically synthesized
tcttctattcaagcctttctaa

SEQ ID NO: 132000 - DNA, 22 bp, Artificial Sequence
  chemically synthesized
ttctattcaagcctttctaatg

SEQ ID NO: 132001 - DNA, 22 bp, Artificial Sequence
  chemically synthesized
ctattcaagcctttctaatgct

SEQ ID NO: 132002 - DNA, 22 bp, Artificial Sequence
  chemically synthesized
tattcaagcctttctaatgcta

SEQ ID NO: 132003 - DNA, 22 bp, Artificial Sequence
  chemically synthesized
ttcaagcctttctaatgctact

SEQ ID NO: 132004 - DNA, 22 bp, Artificial Sequence
  chemically synthesized
aagcctttctaatgctactgat

SEQ ID NO: 132005 - DNA, 22 bp, Artificial Sequence
  chemically synthesized
tctaatgctactgataacaact

SEQ ID NO: 132006 - DNA, 22 bp, Artificial Sequence
  chemically synthesized
ctaatgctactgataacaacta

SEQ ID NO: 132007 - DNA, 22 bp, Artificial Sequence
  chemically synthesized
taatgctactgataacaactag

SEQ ID NO: 132008 - DNA, 22 bp, Artificial Sequence
  chemically synthesized
atgctactgataacaactagtc

SEQ ID NO: 132009 - DNA, 22 bp, Artificial Sequence
  chemically synthesized
ctgataacaactagtcaaaacc

SEQ ID NO: 132010 - DNA, 22 bp, Artificial Sequence
  chemically synthesized
ataacaactagtcaaaaccaca

SEQ ID NO: 132011 - DNA, 22 bp, Artificial Sequence
  chemically synthesized
gtcaaaaccacaccaacacaat

SEQ ID NO: 132012 - DNA, 22 bp, Artificial Sequence
  chemically synthesized
gacacgtgtattgtcatatcct

SEQ ID NO: 132013 - DNA, 22 bp, Artificial Sequence
  chemically synthesized
acacgtgtattgtcatatcctg

SEQ ID NO: 132014 - DNA, 22 bp, Artificial Sequence
  chemically synthesized
tcatatcctgatacttctttta

SEQ ID NO: 132015 - DNA, 22 bp, Artificial Sequence
  chemically synthesized
atacttcttttacctgttctcc

SEQ ID NO: 132016 - DNA, 22 bp, Artificial Sequence
  chemically synthesized
cttttacctgttctcccccttt

SEQ ID NO: 132017 - DNA, 22 bp, Artificial Sequence
  chemically synthesized
ttttacctgttctccccctttt

SEQ ID NO: 132018 - DNA, 22 bp, Artificial Sequence
  chemically synthesized
ttacctgttctcccccttttcc

SEQ ID NO: 132019 - DNA, 22 bp, Artificial Sequence
  chemically synthesized
tacctgttctcccccttttcca

SEQ ID NO: 132020 - DNA, 22 bp, Artificial Sequence
  chemically synthesized
acctgttctcccccttttccaa

SEQ ID NO: 132021 - DNA, 22 bp, Artificial Sequence
  chemically synthesized
cctgttctcccccttttccaac

SEQ ID NO: 132022 - DNA, 22 bp, Artificial Sequence
  chemically synthesized
ttctcccccttttccaacatgt

SEQ ID NO: 132023 - DNA, 22 bp, Artificial Sequence
  chemically synthesized
tcccccttttccaacatgtttc

SEQ ID NO: 132024 - DNA, 22 bp, Artificial Sequence
  chemically synthesized
ccccttttccaacatgtttctc

SEQ ID NO: 132025 - DNA, 22 bp, Artificial Sequence
  chemically synthesized
ttccaacatgtttctcatactg

SEQ ID NO: 132026 - DNA, 22 bp, Artificial Sequence
  chemically synthesized
tccaacatgtttctcatactgt

SEQ ID NO: 132027 - DNA, 22 bp, Artificial Sequence
  chemically synthesized
ccaacatgtttctcatactgta

SEQ ID NO: 132028 - DNA, 22 bp, Artificial Sequence
  chemically synthesized
caacatgtttctcatactgtag

SEQ ID NO: 132029 - DNA, 22 bp, Artificial Sequence
  chemically synthesized
ctcatactgtagccatagtaac

SEQ ID NO: 132030 - DNA, 22 bp, Artificial Sequence
  chemically synthesized
tcatactgtagccatagtaact

SEQ ID NO: 132031 - DNA, 22 bp, Artificial Sequence
  chemically synthesized
atactgtagccatagtaacttt

SEQ ID NO: 132032 - DNA, 22 bp, Artificial Sequence
  chemically synthesized
tagccatagtaactttaaacaa

SEQ ID NO: 132033 - DNA, 22 bp, Artificial Sequence
  chemically synthesized
taaacaataactacttgattat

SEQ ID NO: 132034 - DNA, 22 bp, Artificial Sequence
  chemically synthesized
aaacaataactacttgattata

SEQ ID NO: 132035 - DNA, 22 bp, Artificial Sequence
  chemically synthesized
aacaataactacttgattataa

SEQ ID NO: 132036 - DNA, 22 bp, Artificial Sequence
  chemically synthesized
cttgattataagtactcatcat

SEQ ID NO: 132037 - DNA, 22 bp, Artificial Sequence
  chemically synthesized
gattataagtactcatcatacc

SEQ ID NO: 132038 - DNA, 22 bp, Artificial Sequence
  chemically synthesized
attataagtactcatcatacct

SEQ ID NO: 132039 - DNA, 22 bp, Artificial Sequence
  chemically synthesized
taagtactcatcatacctcttg

SEQ ID NO: 132040 - DNA, 22 bp, Artificial Sequence
  chemically synthesized
atcatacctcttgttttatatt

SEQ ID NO: 132041 - DNA, 22 bp, Artificial Sequence
  chemically synthesized
ttgttttatattcattccctta

SEQ ID NO: 132042 - DNA, 22 bp, Artificial Sequence
  chemically synthesized
gttttatattcattcccttatg

SEQ ID NO: 132043 - DNA, 22 bp, Artificial Sequence
  chemically synthesized
ttttatattcattcccttatgg

SEQ ID NO: 132044 - DNA, 22 bp, Artificial Sequence
  chemically synthesized
tatattcattcccttatggtaa

SEQ ID NO: 132045 - DNA, 22 bp, Artificial Sequence
  chemically synthesized
atattcattcccttatggtaat

SEQ ID NO: 132046 - DNA, 22 bp, Artificial Sequence
  chemically synthesized
tattcattcccttatggtaatg

SEQ ID NO: 132047 - DNA, 22 bp, Artificial Sequence
  chemically synthesized
attcccttatggtaatgtcaaa

SEQ ID NO: 132048 - DNA, 22 bp, Artificial Sequence
  chemically synthesized
ccttatggtaatgtcaaaatgt

SEQ ID NO: 132049 - DNA, 22 bp, Artificial Sequence
  chemically synthesized
atggtaatgtcaaaatgtttta

SEQ ID NO: 132050 - DNA, 22 bp, Artificial Sequence
  chemically synthesized
tggtaatgtcaaaatgttttac

SEQ ID NO: 132051 - DNA, 22 bp, Artificial Sequence
  chemically synthesized
tacatgatttgcaagatatatt

SEQ ID NO: 132052 - DNA, 22 bp, Artificial Sequence
  chemically synthesized
acatgatttgcaagatatattg

SEQ ID NO: 132053 - DNA, 22 bp, Artificial Sequence
  chemically synthesized
catgatttgcaagatatattgt

SEQ ID NO: 132054 - DNA, 22 bp, Artificial Sequence
  chemically synthesized
gcaagatatattgtgatcagaa

SEQ ID NO: 132055 - DNA, 22 bp, Artificial Sequence
  chemically synthesized
caagatatattgtgatcagaac

SEQ ID NO: 132056 - DNA, 22 bp, Artificial Sequence
  chemically synthesized
tgatcagaacctgctactacta

SEQ ID NO: 132057 - DNA, 22 bp, Artificial Sequence
  chemically synthesized
ctactactacagattcattttc

SEQ ID NO: 132058 - DNA, 22 bp, Artificial Sequence
  chemically synthesized
ctactacagattcattttctct

SEQ ID NO: 132059 - DNA, 22 bp, Artificial Sequence
  chemically synthesized
ctacagattcattttctctcaa

SEQ ID NO: 132060 - DNA, 22 bp, Artificial Sequence
  chemically synthesized
cagattcattttctctcaagct

SEQ ID NO: 132061 - DNA, 22 bp, Artificial Sequence
  chemically synthesized
attttctctcaagctttttttc

SEQ ID NO: 132062 - DNA, 22 bp, Artificial Sequence
  chemically synthesized
tctctcaagctttttttcatgt

SEQ ID NO: 132063 - DNA, 22 bp, Artificial Sequence
  chemically synthesized
ctctcaagctttttttcatgta

SEQ ID NO: 132064 - DNA, 22 bp, Artificial Sequence
  chemically synthesized
tctcaagctttttttcatgtat

SEQ ID NO: 132065 - DNA, 22 bp, Artificial Sequence
  chemically synthesized
tcaagctttttttcatgtattg

SEQ ID NO: 132066 - DNA, 22 bp, Artificial Sequence
  chemically synthesized
aagctttttttcatgtattgtt

SEQ ID NO: 132067 - DNA, 22 bp, Artificial Sequence
  chemically synthesized
tttttcatgtattgttgttcaa

SEQ ID NO: 132068 - DNA, 22 bp, Artificial Sequence
  chemically synthesized
ttttcatgtattgttgttcaag

SEQ ID NO: 132069 - DNA, 22 bp, Artificial Sequence
  chemically synthesized
tttcatgtattgttgttcaaga

SEQ ID NO: 132070 - DNA, 22 bp, Artificial Sequence
  chemically synthesized
ttcatgtattgttgttcaagag

SEQ ID NO: 132071 - DNA, 22 bp, Artificial Sequence
  chemically synthesized
tcatgtattgttgttcaagaga

SEQ ID NO: 132072 - DNA, 22 bp, Artificial Sequence
  chemically synthesized
catgtattgttgttcaagagat

SEQ ID NO: 132073 - DNA, 22 bp, Artificial Sequence
  chemically synthesized
atgtattgttgttcaagagata

SEQ ID NO: 132074 - DNA, 22 bp, Artificial Sequence
  chemically synthesized
ttgttcaagagatattatactt

SEQ ID NO: 132075 - DNA, 22 bp, Artificial Sequence
  chemically synthesized
ttcaagagatattatacttcct

SEQ ID NO: 132076 - DNA, 22 bp, Artificial Sequence
  chemically synthesized
aagagatattatacttccttaa

SEQ ID NO: 132077 - DNA, 22 bp, Artificial Sequence
  chemically synthesized
tacttccttaatgtatattttg

SEQ ID NO: 132078 - DNA, 22 bp, Artificial Sequence
  chemically synthesized
ccttaatgtatattttgaataa

SEQ ID NO: 132079 - DNA, 22 bp, Artificial Sequence
  chemically synthesized
cttaatgtatattttgaataaa

SEQ ID NO: 132080 - DNA, 22 bp, Artificial Sequence
  chemically synthesized
aatgtatattttgaataaaatt

SEQ ID NO: 132081 - DNA, 22 bp, Artificial Sequence
  chemically synthesized
atgtatattttgaataaaatta

SEQ ID NO: 132082 - DNA, 22 bp, Artificial Sequence
  chemically synthesized
tgaataaaattatttttatttg

SEQ ID NO: 132083 - DNA, 22 bp, Artificial Sequence
  chemically synthesized
gaataaaattatttttatttga

SEQ ID NO: 132084 - DNA, 22 bp, Artificial Sequence
  chemically synthesized
aataaaattatttttatttgaa

SEQ ID NO: 132085 - DNA, 22 bp, Artificial Sequence
  chemically synthesized
tttttatttgaatttatagtat

SEQ ID NO: 132086 - DNA, 22 bp, Artificial Sequence
  chemically synthesized
ttatttgaatttatagtattta

SEQ ID NO: 132087 - DNA, 22 bp, Artificial Sequence
  chemically synthesized
tatttgaatttatagtatttaa

SEQ ID NO: 132088 - DNA, 22 bp, Artificial Sequence
  chemically synthesized
atttgaatttatagtatttaat

SEQ ID NO: 132089 - DNA, 22 bp, Artificial Sequence
  chemically synthesized
tttgaatttatagtatttaatc

SEQ ID NO: 132090 - DNA, 22 bp, Artificial Sequence
  chemically synthesized
gaatttatagtatttaatcttg

SEQ ID NO: 132091 - DNA, 22 bp, Artificial Sequence
  chemically synthesized
aatttatagtatttaatcttgc

SEQ ID NO: 132092 - DNA, 22 bp, Artificial Sequence
  chemically synthesized
atagtatttaatcttgccccat

SEQ ID NO: 132093 - DNA, 22 bp, Artificial Sequence
  chemically synthesized
tagtatttaatcttgccccatt

SEQ ID NO: 132094 - DNA, 22 bp, Artificial Sequence
  chemically synthesized
aatcttgccccattaccaatgt

SEQ ID NO: 132095 - DNA, 22 bp, Artificial Sequence
  chemically synthesized
atcttgccccattaccaatgta

SEQ ID NO: 132096 - DNA, 22 bp, Artificial Sequence
  chemically synthesized
gccccattaccaatgtacattt

SEQ ID NO: 132097 - DNA, 22 bp, Artificial Sequence
  chemically synthesized
ccccattaccaatgtacatttt

SEQ ID NO: 132098 - DNA, 22 bp, Artificial Sequence
  chemically synthesized
ccaatgtacattttacaaactt

SEQ ID NO: 132099 - DNA, 22 bp, Artificial Sequence
  chemically synthesized
tacaaactttaatttgtttact

SEQ ID NO: 132100 - DNA, 22 bp, Artificial Sequence
  chemically synthesized
acaaactttaatttgtttactt

SEQ ID NO: 132101 - DNA, 22 bp, Artificial Sequence
  chemically synthesized
caaactttaatttgtttacttg

SEQ ID NO: 132102 - DNA, 22 bp, Artificial Sequence
  chemically synthesized
taatttgtttacttgtttcgtt

SEQ ID NO: 132103 - DNA, 22 bp, Artificial Sequence
  chemically synthesized
aatttgtttacttgtttcgttt

SEQ ID NO: 132104 - DNA, 22 bp, Artificial Sequence
  chemically synthesized
atttgtttacttgtttcgtttt

SEQ ID NO: 132105 - DNA, 22 bp, Artificial Sequence
  chemically synthesized
gtttacttgtttcgttttgtgt

SEQ ID NO: 132106 - DNA, 22 bp, Artificial Sequence
  chemically synthesized
tttacttgtttcgttttgtgtt

SEQ ID NO: 132107 - DNA, 22 bp, Artificial Sequence
  chemically synthesized
acttgtttcgttttgtgtttgt

SEQ ID NO: 132108 - DNA, 22 bp, Artificial Sequence
  chemically synthesized
cttgtttcgttttgtgtttgtt

SEQ ID NO: 132109 - DNA, 22 bp, Artificial Sequence
  chemically synthesized
gtttcgttttgtgtttgttctt

SEQ ID NO: 132110 - DNA, 22 bp, Artificial Sequence
  chemically synthesized
tttcgttttgtgtttgttcttt

SEQ ID NO: 132111 - DNA, 22 bp, Artificial Sequence
  chemically synthesized
cgttttgtgtttgttcttttca

SEQ ID NO: 132112 - DNA, 22 bp, Artificial Sequence
  chemically synthesized
gttttgtgtttgttcttttcac

SEQ ID NO: 132113 - DNA, 22 bp, Artificial Sequence
  chemically synthesized
tgtgtttgttcttttcacctgt

SEQ ID NO: 132114 - DNA, 22 bp, Artificial Sequence
  chemically synthesized
gtgtttgttcttttcacctgta

SEQ ID NO: 132115 - DNA, 22 bp, Artificial Sequence
  chemically synthesized
tgtttgttcttttcacctgtac

SEQ ID NO: 132116 - DNA, 22 bp, Artificial Sequence
  chemically synthesized
gttcttttcacctgtacgcaat

SEQ ID NO: 132117 - DNA, 22 bp, Artificial Sequence
  chemically synthesized
ttcttttcacctgtacgcaatg

SEQ ID NO: 132118 - DNA, 22 bp, Artificial Sequence
  chemically synthesized
ttttcacctgtacgcaatgatt

SEQ ID NO: 132119 - DNA, 22 bp, Artificial Sequence
  chemically synthesized
ttcacctgtacgcaatgattgc

SEQ ID NO: 132120 - DNA, 22 bp, Artificial Sequence
  chemically synthesized
tcacctgtacgcaatgattgca

SEQ ID NO: 132121 - DNA, 22 bp, Artificial Sequence
  chemically synthesized
cacctgtacgcaatgattgcac

SEQ ID NO: 132122 - DNA, 22 bp, Artificial Sequence
  chemically synthesized
acctgtacgcaatgattgcact

SEQ ID NO: 132123 - DNA, 22 bp, Artificial Sequence
  chemically synthesized
tacgcaatgattgcactacccc

SEQ ID NO: 132124 - DNA, 22 bp, Artificial Sequence
  chemically synthesized
cactaccccaccaaatactact

SEQ ID NO: 132125 - DNA, 22 bp, Artificial Sequence
  chemically synthesized
ccccaccaaatactactacact

SEQ ID NO: 132126 - DNA, 22 bp, Artificial Sequence
  chemically synthesized
ctacactactaatatagtagca

SEQ ID NO: 132127 - DNA, 22 bp, Artificial Sequence
  chemically synthesized
cactactaatatagtagcattt

SEQ ID NO: 132128 - DNA, 22 bp, Artificial Sequence
  chemically synthesized
ctaatatagtagcatttaattc

SEQ ID NO: 132129 - DNA, 22 bp, Artificial Sequence
  chemically synthesized
atatagtagcatttaattctca

SEQ ID NO: 132130 - DNA, 22 bp, Artificial Sequence
  chemically synthesized
aattctcagcttaagtagcatt

SEQ ID NO: 132131 - DNA, 22 bp, Artificial Sequence
  chemically synthesized
attctcagcttaagtagcattt

SEQ ID NO: 132132 - DNA, 22 bp, Artificial Sequence
  chemically synthesized
tcagcttaagtagcatttcttc

SEQ ID NO: 132133 - DNA, 22 bp, Artificial Sequence
  chemically synthesized
agcttaagtagcatttcttctg

SEQ ID NO: 132134 - DNA, 22 bp, Artificial Sequence
  chemically synthesized
aagtagcatttcttctggaaaa

SEQ ID NO: 132135 - DNA, 22 bp, Artificial Sequence
  chemically synthesized
agtagcatttcttctggaaaat

SEQ ID NO: 132136 - DNA, 22 bp, Artificial Sequence
  chemically synthesized
cttctggaaaatgttccctgat

SEQ ID NO: 132137 - DNA, 22 bp, Artificial Sequence
  chemically synthesized
ttctggaaaatgttccctgatc

SEQ ID NO: 132138 - DNA, 22 bp, Artificial Sequence
  chemically synthesized
ctggaaaatgttccctgatccc

SEQ ID NO: 132139 - DNA, 22 bp, Artificial Sequence
  chemically synthesized
tggaaaatgttccctgatccca

SEQ ID NO: 132140 - DNA, 22 bp, Artificial Sequence
  chemically synthesized
gaaaatgttccctgatcccaga

SEQ ID NO: 132141 - DNA, 22 bp, Artificial Sequence
  chemically synthesized
cctgatcccagaaatttatttg

SEQ ID NO: 132142 - DNA, 22 bp, Artificial Sequence
  chemically synthesized
atcccagaaatttatttgatgt

SEQ ID NO: 132143 - DNA, 22 bp, Artificial Sequence
  chemically synthesized
atttgatgtgtctctcatagca

SEQ ID NO: 132144 - DNA, 22 bp, Artificial Sequence
  chemically synthesized
tttgatgtgtctctcatagcac

SEQ ID NO: 132145 - DNA, 22 bp, Artificial Sequence
  chemically synthesized
gatgtgtctctcatagcacact

SEQ ID NO: 132146 - DNA, 22 bp, Artificial Sequence
  chemically synthesized
atgtgtctctcatagcacacta

SEQ ID NO: 132147 - DNA, 22 bp, Artificial Sequence
  chemically synthesized
tcatagcacactaatattcacg

SEQ ID NO: 132148 - DNA, 22 bp, Artificial Sequence
  chemically synthesized
atagcacactaatattcacgta

SEQ ID NO: 132149 - DNA, 22 bp, Artificial Sequence
  chemically synthesized
atattcacgtagtaatgatagt

SEQ ID NO: 132150 - DNA, 22 bp, Artificial Sequence
  chemically synthesized
acgtagtaatgatagtgttgta

SEQ ID NO: 132151 - DNA, 22 bp, Artificial Sequence
  chemically synthesized
tatgaattcatggtaaatattt

SEQ ID NO: 132152 - DNA, 22 bp, Artificial Sequence
  chemically synthesized
atggtaaatattttctttctag

SEQ ID NO: 132153 - DNA, 22 bp, Artificial Sequence
  chemically synthesized
tctttctagtgcctgcttgggt

SEQ ID NO: 132154 - DNA, 22 bp, Artificial Sequence
  chemically synthesized
ctttctagtgcctgcttgggtt

SEQ ID NO: 132155 - DNA, 22 bp, Artificial Sequence
  chemically synthesized
tttctagtgcctgcttgggttt

SEQ ID NO: 132156 - DNA, 22 bp, Artificial Sequence
  chemically synthesized
tctagtgcctgcttgggtttta

SEQ ID NO: 132157 - DNA, 22 bp, Artificial Sequence
  chemically synthesized
ctagtgcctgcttgggttttaa

SEQ ID NO: 132158 - DNA, 22 bp, Artificial Sequence
  chemically synthesized
tagtgcctgcttgggttttaaa

SEQ ID NO: 132159 - DNA, 22 bp, Artificial Sequence
  chemically synthesized
gtgcctgcttgggttttaaatt

SEQ ID NO: 132160 - DNA, 22 bp, Artificial Sequence
  chemically synthesized
cttgggttttaaatttcaataa

SEQ ID NO: 132161 - DNA, 22 bp, Artificial Sequence
  chemically synthesized
gggttttaaatttcaataaaaa

SEQ ID NO: 132162 - DNA, 22 bp, Artificial Sequence
  chemically synthesized
ggttttaaatttcaataaaaag

SEQ ID NO: 132163 - DNA, 22 bp, Artificial Sequence
  chemically synthesized
taaatttcaataaaaagaacaa

SEQ ID NO: 132164 - DNA, 22 bp, Artificial Sequence
  chemically synthesized
aaatttcaataaaaagaacaag

SEQ ID NO: 132165 - DNA, 22 bp, Artificial Sequence
  chemically synthesized
aatttcaataaaaagaacaagt

SEQ ID NO: 132166 - DNA, 22 bp, Artificial Sequence
  chemically synthesized
caataaaaagaacaagtcctag

SEQ ID NO: 132167 - DNA, 22 bp, Artificial Sequence
  chemically synthesized
aataaaaagaacaagtcctagg

SEQ ID NO: 132168 - DNA, 22 bp, Artificial Sequence
  chemically synthesized
ggtatttcattttctttgtggc

SEQ ID NO: 132169 - DNA, 22 bp, Artificial Sequence
  chemically synthesized
cattttctttgtggctgttctt

SEQ ID NO: 132170 - DNA, 22 bp, Artificial Sequence
  chemically synthesized
attttctttgtggctgttctta

SEQ ID NO: 132171 - DNA, 22 bp, Artificial Sequence
  chemically synthesized
tctttgtggctgttcttaatgg

SEQ ID NO: 132172 - DNA, 22 bp, Artificial Sequence
  chemically synthesized
ctttgtggctgttcttaatggg

SEQ ID NO: 132173 - DNA, 22 bp, Artificial Sequence
  chemically synthesized
tttgtggctgttcttaatggga

SEQ ID NO: 132174 - DNA, 22 bp, Artificial Sequence
  chemically synthesized
tgtggctgttcttaatgggatt

SEQ ID NO: 132175 - DNA, 22 bp, Artificial Sequence
  chemically synthesized
gtggctgttcttaatgggattg

SEQ ID NO: 132176 - DNA, 22 bp, Artificial Sequence
  chemically synthesized
tggctgttcttaatgggattgt

SEQ ID NO: 132177 - DNA, 22 bp, Artificial Sequence
  chemically synthesized
ttcttaatgggattgtgttctc

SEQ ID NO: 132178 - DNA, 22 bp, Artificial Sequence
  chemically synthesized
ttaatgggattgtgttctcgat

SEQ ID NO: 132179 - DNA, 22 bp, Artificial Sequence
  chemically synthesized
aatgggattgtgttctcgattt

SEQ ID NO: 132180 - DNA, 22 bp, Artificial Sequence
  chemically synthesized
atgggattgtgttctcgatttg

SEQ ID NO: 132181 - DNA, 22 bp, Artificial Sequence
  chemically synthesized
tgttctcgatttgactctcagc

SEQ ID NO: 132182 - DNA, 22 bp, Artificial Sequence
  chemically synthesized
tcgatttgactctcagcctggg

SEQ ID NO: 132183 - DNA, 22 bp, Artificial Sequence
  chemically synthesized
gatttgactctcagcctgggcc

SEQ ID NO: 132184 - DNA, 22 bp, Artificial Sequence
  chemically synthesized
gactctcagcctgggccttatt

SEQ ID NO: 132185 - DNA, 22 bp, Artificial Sequence
  chemically synthesized
actctcagcctgggccttattg

SEQ ID NO: 132186 - DNA, 22 bp, Artificial Sequence
  chemically synthesized
tcagcctgggccttattggtgt

SEQ ID NO: 132187 - DNA, 22 bp, Artificial Sequence
  chemically synthesized
agcctgggccttattggtgtat

SEQ ID NO: 132188 - DNA, 22 bp, Artificial Sequence
  chemically synthesized
ggccttattggtgtatggaaat

SEQ ID NO: 132189 - DNA, 22 bp, Artificial Sequence
  chemically synthesized
attggtgtatggaaatgctact

SEQ ID NO: 132190 - DNA, 22 bp, Artificial Sequence
  chemically synthesized
ttggtgtatggaaatgctactg

SEQ ID NO: 132191 - DNA, 22 bp, Artificial Sequence
  chemically synthesized
gtgtatggaaatgctactgatt

SEQ ID NO: 132192 - DNA, 22 bp, Artificial Sequence
  chemically synthesized
ctgatttttgtatgtgattttg

SEQ ID NO: 132193 - DNA, 22 bp, Artificial Sequence
  chemically synthesized
atttttgtatgtgattttgtat

SEQ ID NO: 132194 - DNA, 22 bp, Artificial Sequence
  chemically synthesized
ttgtatgtgattttgtatcctg

SEQ ID NO: 132195 - DNA, 22 bp, Artificial Sequence
  chemically synthesized
tgtatgtgattttgtatcctga

SEQ ID NO: 132196 - DNA, 22 bp, Artificial Sequence
  chemically synthesized
gtatgtgattttgtatcctgaa

SEQ ID NO: 132197 - DNA, 22 bp, Artificial Sequence
  chemically synthesized
tatgtgattttgtatcctgaaa

SEQ ID NO: 132198 - DNA, 22 bp, Artificial Sequence
  chemically synthesized
tgtatcctgaaaccttgctaaa

SEQ ID NO: 132199 - DNA, 22 bp, Artificial Sequence
  chemically synthesized
gtatcctgaaaccttgctaaaa

SEQ ID NO: 132200 - DNA, 22 bp, Artificial Sequence
  chemically synthesized
tatcctgaaaccttgctaaaat

SEQ ID NO: 132201 - DNA, 22 bp, Artificial Sequence
  chemically synthesized
aaaccttgctaaaattgtttat

SEQ ID NO: 132202 - DNA, 22 bp, Artificial Sequence
  chemically synthesized
gctaaaattgtttatcagttct

SEQ ID NO: 132203 - DNA, 22 bp, Artificial Sequence
  chemically synthesized
ctaaaattgtttatcagttcta

SEQ ID NO: 132204 - DNA, 22 bp, Artificial Sequence
  chemically synthesized
aaattgtttatcagttctagca

SEQ ID NO: 132205 - DNA, 22 bp, Artificial Sequence
  chemically synthesized
tttatcagttctagcagccttt

SEQ ID NO: 132206 - DNA, 22 bp, Artificial Sequence
  chemically synthesized
atcagttctagcagccttttgg

SEQ ID NO: 132207 - DNA, 22 bp, Artificial Sequence
  chemically synthesized
tcagttctagcagccttttgga

SEQ ID NO: 132208 - DNA, 22 bp, Artificial Sequence
  chemically synthesized
tagcagccttttggaagaatct

SEQ ID NO: 132209 - DNA, 22 bp, Artificial Sequence
  chemically synthesized
gcagccttttggaagaatctgt

SEQ ID NO: 132210 - DNA, 22 bp, Artificial Sequence
  chemically synthesized
ttggaagaatctgtaggatttt

SEQ ID NO: 132211 - DNA, 22 bp, Artificial Sequence
  chemically synthesized
tggaagaatctgtaggattttc

SEQ ID NO: 132212 - DNA, 22 bp, Artificial Sequence
  chemically synthesized
ggaagaatctgtaggattttct

SEQ ID NO: 132213 - DNA, 22 bp, Artificial Sequence
  chemically synthesized
gaagaatctgtaggattttcta

SEQ ID NO: 132214 - DNA, 22 bp, Artificial Sequence
  chemically synthesized
taggattttctaagtatagagt

SEQ ID NO: 132215 - DNA, 22 bp, Artificial Sequence
  chemically synthesized
tctaagtatagagtcatatcat

SEQ ID NO: 132216 - DNA, 22 bp, Artificial Sequence
  chemically synthesized
ctaagtatagagtcatatcatc

SEQ ID NO: 132217 - DNA, 22 bp, Artificial Sequence
  chemically synthesized
taagtatagagtcatatcatca

SEQ ID NO: 132218 - DNA, 22 bp, Artificial Sequence
  chemically synthesized
agtatagagtcatatcatcagc

SEQ ID NO: 132219 - DNA, 22 bp, Artificial Sequence
  chemically synthesized
ggcttattgtcctattttgatg

SEQ ID NO: 132220 - DNA, 22 bp, Artificial Sequence
  chemically synthesized
gcttattgtcctattttgatgc

SEQ ID NO: 132221 - DNA, 22 bp, Artificial Sequence
  chemically synthesized
attgtcctattttgatgccatt

SEQ ID NO: 132222 - DNA, 22 bp, Artificial Sequence
  chemically synthesized
ttgtcctattttgatgccattt

SEQ ID NO: 132223 - DNA, 22 bp, Artificial Sequence
  chemically synthesized
tcctattttgatgccatttctt

SEQ ID NO: 132224 - DNA, 22 bp, Artificial Sequence
  chemically synthesized
ttttgatgccatttctttcttt

SEQ ID NO: 132225 - DNA, 22 bp, Artificial Sequence
  chemically synthesized
tgatgccatttctttctttctc

SEQ ID NO: 132226 - DNA, 22 bp, Artificial Sequence
  chemically synthesized
gatgccatttctttctttctct

SEQ ID NO: 132227 - DNA, 22 bp, Artificial Sequence
  chemically synthesized
atgccatttctttctttctctc

SEQ ID NO: 132228 - DNA, 22 bp, Artificial Sequence
  chemically synthesized
ctttctttctctcgcctgattg

SEQ ID NO: 132229 - DNA, 22 bp, Artificial Sequence
  chemically synthesized
tttctttctctcgcctgattgc

SEQ ID NO: 132230 - DNA, 22 bp, Artificial Sequence
  chemically synthesized
tctttctctcgcctgattgccc

SEQ ID NO: 132231 - DNA, 22 bp, Artificial Sequence
  chemically synthesized
ctttctctcgcctgattgccct

SEQ ID NO: 132232 - DNA, 22 bp, Artificial Sequence
  chemically synthesized
tttctctcgcctgattgccctg

SEQ ID NO: 132233 - DNA, 22 bp, Artificial Sequence
  chemically synthesized
tctctcgcctgattgccctggt

SEQ ID NO: 132234 - DNA, 22 bp, Artificial Sequence
  chemically synthesized
ctctcgcctgattgccctggtt

SEQ ID NO: 132235 - DNA, 22 bp, Artificial Sequence
  chemically synthesized
tctcgcctgattgccctggtta

SEQ ID NO: 132236 - DNA, 22 bp, Artificial Sequence
  chemically synthesized
tcgcctgattgccctggttagg

SEQ ID NO: 132237 - DNA, 22 bp, Artificial Sequence
  chemically synthesized
gcctgattgccctggttaggac

SEQ ID NO: 132238 - DNA, 22 bp, Artificial Sequence
  chemically synthesized
attgccctggttaggacttcca

SEQ ID NO: 132239 - DNA, 22 bp, Artificial Sequence
  chemically synthesized
ccctggttaggacttccaattt

SEQ ID NO: 132240 - DNA, 22 bp, Artificial Sequence
  chemically synthesized
gttaggacttccaattttatgt

SEQ ID NO: 132241 - DNA, 22 bp, Artificial Sequence
  chemically synthesized
ggacttccaattttatgttcac

SEQ ID NO: 132242 - DNA, 22 bp, Artificial Sequence
  chemically synthesized
ccaattttatgttcactaggag

SEQ ID NO: 132243 - DNA, 22 bp, Artificial Sequence
  chemically synthesized
caattttatgttcactaggagt

SEQ ID NO: 132244 - DNA, 22 bp, Artificial Sequence
  chemically synthesized
tatgttcactaggagtggtgag

SEQ ID NO: 132245 - DNA, 22 bp, Artificial Sequence
  chemically synthesized
atgttcactaggagtggtgaga

SEQ ID NO: 132246 - DNA, 22 bp, Artificial Sequence
  chemically synthesized
tgttcactaggagtggtgagaa

SEQ ID NO: 132247 - DNA, 22 bp, Artificial Sequence
  chemically synthesized
actaggagtggtgagaatggga

SEQ ID NO: 132248 - DNA, 22 bp, Artificial Sequence
  chemically synthesized
ggagtggtgagaatgggaatcc

SEQ ID NO: 132249 - DNA, 22 bp, Artificial Sequence
  chemically synthesized
gtcttgttgcagttttcgagga

SEQ ID NO: 132250 - DNA, 22 bp, Artificial Sequence
  chemically synthesized
tcttgttgcagttttcgaggag

SEQ ID NO: 132251 - DNA, 22 bp, Artificial Sequence
  chemically synthesized
gttgcagttttcgaggagaata

SEQ ID NO: 132252 - DNA, 22 bp, Artificial Sequence
  chemically synthesized
ttgcagttttcgaggagaatag

SEQ ID NO: 132253 - DNA, 22 bp, Artificial Sequence
  chemically synthesized
cagttttcgaggagaatagttc

SEQ ID NO: 132254 - DNA, 22 bp, Artificial Sequence
  chemically synthesized
tcgaggagaatagttccagctt

SEQ ID NO: 132255 - DNA, 22 bp, Artificial Sequence
  chemically synthesized
cgaggagaatagttccagcttt

SEQ ID NO: 132256 - DNA, 22 bp, Artificial Sequence
  chemically synthesized
gaggagaatagttccagctttt

SEQ ID NO: 132257 - DNA, 22 bp, Artificial Sequence
  chemically synthesized
cagcttttgcccattcagtatg

SEQ ID NO: 132258 - DNA, 22 bp, Artificial Sequence
  chemically synthesized
ttgcccattcagtatggttttg

SEQ ID NO: 132259 - DNA, 22 bp, Artificial Sequence
  chemically synthesized
tgcccattcagtatggttttgg

SEQ ID NO: 132260 - DNA, 22 bp, Artificial Sequence
  chemically synthesized
gcccattcagtatggttttggt

SEQ ID NO: 132261 - DNA, 22 bp, Artificial Sequence
  chemically synthesized
cccattcagtatggttttggtt

SEQ ID NO: 132262 - DNA, 22 bp, Artificial Sequence
  chemically synthesized
agtatggttttggttatgggtt

SEQ ID NO: 132263 - DNA, 22 bp, Artificial Sequence
  chemically synthesized
tggttatgggtttttcatacgt

SEQ ID NO: 132264 - DNA, 22 bp, Artificial Sequence
  chemically synthesized
ggttatgggtttttcatacgtg

SEQ ID NO: 132265 - DNA, 22 bp, Artificial Sequence
  chemically synthesized
gttatgggtttttcatacgtgg

SEQ ID NO: 132266 - DNA, 22 bp, Artificial Sequence
  chemically synthesized
tgggtttttcatacgtggcttt

SEQ ID NO: 132267 - DNA, 22 bp, Artificial Sequence
  chemically synthesized
ttcatacgtggcttttattctt

SEQ ID NO: 132268 - DNA, 22 bp, Artificial Sequence
  chemically synthesized
tcatacgtggcttttattcttt

SEQ ID NO: 132269 - DNA, 22 bp, Artificial Sequence
  chemically synthesized
catacgtggcttttattctttt

SEQ ID NO: 132270 - DNA, 22 bp, Artificial Sequence
  chemically synthesized
atacgtggcttttattcttttg

SEQ ID NO: 132271 - DNA, 22 bp, Artificial Sequence
  chemically synthesized
ttattcttttgaggtatgttcc

SEQ ID NO: 132272 - DNA, 22 bp, Artificial Sequence
  chemically synthesized
tattcttttgaggtatgttcct

SEQ ID NO: 132273 - DNA, 22 bp, Artificial Sequence
  chemically synthesized
attcttttgaggtatgttcctt

SEQ ID NO: 132274 - DNA, 22 bp, Artificial Sequence
  chemically synthesized
ttcttttgaggtatgttccttt

SEQ ID NO: 132275 - DNA, 22 bp, Artificial Sequence
  chemically synthesized
ttttgaggtatgttcctttgat

SEQ ID NO: 132276 - DNA, 22 bp, Artificial Sequence
  chemically synthesized
ttgaggtatgttcctttgatgc

SEQ ID NO: 132277 - DNA, 22 bp, Artificial Sequence
  chemically synthesized
tgaggtatgttcctttgatgcc

SEQ ID NO: 132278 - DNA, 22 bp, Artificial Sequence
  chemically synthesized
gaggtatgttcctttgatgcct

SEQ ID NO: 132279 - DNA, 22 bp, Artificial Sequence
  chemically synthesized
aggtatgttcctttgatgccta

SEQ ID NO: 132280 - DNA, 22 bp, Artificial Sequence
  chemically synthesized
ctttgatgcctagtctgttgga

SEQ ID NO: 132281 - DNA, 22 bp, Artificial Sequence
  chemically synthesized
tgatgcctagtctgttggaggt

SEQ ID NO: 132282 - DNA, 22 bp, Artificial Sequence
  chemically synthesized
gatgcctagtctgttggaggtt

SEQ ID NO: 132283 - DNA, 22 bp, Artificial Sequence
  chemically synthesized
atgcctagtctgttggaggttt

SEQ ID NO: 132284 - DNA, 22 bp, Artificial Sequence
  chemically synthesized
gtctgttggaggtttttatcat

SEQ ID NO: 132285 - DNA, 22 bp, Artificial Sequence
  chemically synthesized
ttggaggtttttatcatgaagg

SEQ ID NO: 132286 - DNA, 22 bp, Artificial Sequence
  chemically synthesized
gaggtttttatcatgaagggat

SEQ ID NO: 132287 - DNA, 22 bp, Artificial Sequence
  chemically synthesized
ttatcatgaagggatgttgaat

SEQ ID NO: 132288 - DNA, 22 bp, Artificial Sequence
  chemically synthesized
tatcatgaagggatgttgaatt

SEQ ID NO: 132289 - DNA, 22 bp, Artificial Sequence
  chemically synthesized
atcatgaagggatgttgaattt

SEQ ID NO: 132290 - DNA, 22 bp, Artificial Sequence
  chemically synthesized
tcatgaagggatgttgaatttt

SEQ ID NO: 132291 - DNA, 22 bp, Artificial Sequence
  chemically synthesized
aattttattgaaaggtttttct

SEQ ID NO: 132292 - DNA, 22 bp, Artificial Sequence
  chemically synthesized
tattgaaaggtttttctcagtc

SEQ ID NO: 132293 - DNA, 22 bp, Artificial Sequence
  chemically synthesized
attgaaaggtttttctcagtct

SEQ ID NO: 132294 - DNA, 22 bp, Artificial Sequence
  chemically synthesized
ttgaaaggtttttctcagtcta

SEQ ID NO: 132295 - DNA, 22 bp, Artificial Sequence
  chemically synthesized
aaaggtttttctcagtctattg

SEQ ID NO: 132296 - DNA, 22 bp, Artificial Sequence
  chemically synthesized
ttctcagtctattgagatgatc

SEQ ID NO: 132297 - DNA, 22 bp, Artificial Sequence
  chemically synthesized
tctcagtctattgagatgatca

SEQ ID NO: 132298 - DNA, 22 bp, Artificial Sequence
  chemically synthesized
ctcagtctattgagatgatcat

SEQ ID NO: 132299 - DNA, 22 bp, Artificial Sequence
  chemically synthesized
tcagtctattgagatgatcata

SEQ ID NO: 132300 - DNA, 22 bp, Artificial Sequence
  chemically synthesized
agtctattgagatgatcatatg

SEQ ID NO: 132301 - DNA, 22 bp, Artificial Sequence
  chemically synthesized
ttgagatgatcatatggtttgt

SEQ ID NO: 132302 - DNA, 22 bp, Artificial Sequence
  chemically synthesized
agatgatcatatggtttgtggg

SEQ ID NO: 132303 - DNA, 22 bp, Artificial Sequence
  chemically synthesized
gtgggaggtgaaagatctctac

SEQ ID NO: 132304 - DNA, 22 bp, Artificial Sequence
  chemically synthesized
tgggaggtgaaagatctctaca

SEQ ID NO: 132305 - DNA, 22 bp, Artificial Sequence
  chemically synthesized
tacaaggagaactacaaaacac

SEQ ID NO: 132306 - DNA, 22 bp, Artificial Sequence
  chemically synthesized
caaggagaactacaaaacactg

SEQ ID NO: 132307 - DNA, 22 bp, Artificial Sequence
  chemically synthesized
caaaacactgctgaaagaaatc

SEQ ID NO: 132308 - DNA, 22 bp, Artificial Sequence
  chemically synthesized
ctgaaagaaatcagaaacaaca

SEQ ID NO: 132309 - DNA, 22 bp, Artificial Sequence
  chemically synthesized
aaagaaatcagaaacaacacaa

SEQ ID NO: 132310 - DNA, 22 bp, Artificial Sequence
  chemically synthesized
tccaggctcatggattggaaga

SEQ ID NO: 132311 - DNA, 22 bp, Artificial Sequence
  chemically synthesized
ccaggctcatggattggaagaa

SEQ ID NO: 132312 - DNA, 22 bp, Artificial Sequence
  chemically synthesized
caggctcatggattggaagaat

SEQ ID NO: 132313 - DNA, 22 bp, Artificial Sequence
  chemically synthesized
atggattggaagaatcaatatg

SEQ ID NO: 132314 - DNA, 22 bp, Artificial Sequence
  chemically synthesized
gaagaatcaatatgaatttaaa

SEQ ID NO: 132315 - DNA, 22 bp, Artificial Sequence
  chemically synthesized
aaatggccatactgctcaaagc

SEQ ID NO: 132316 - DNA, 22 bp, Artificial Sequence
  chemically synthesized
aatggccatactgctcaaagca

SEQ ID NO: 132317 - DNA, 22 bp, Artificial Sequence
  chemically synthesized
ctcaaagcaatttagacattca

SEQ ID NO: 132318 - DNA, 22 bp, Artificial Sequence
  chemically synthesized
aaagcaatttagacattcattg

SEQ ID NO: 132319 - DNA, 22 bp, Artificial Sequence
  chemically synthesized
agacattcattgcaatttctat

SEQ ID NO: 132320 - DNA, 22 bp, Artificial Sequence
  chemically synthesized
gacattcattgcaatttctatc

SEQ ID NO: 132321 - DNA, 22 bp, Artificial Sequence
  chemically synthesized
attgcaatttctatccaattac

SEQ ID NO: 132322 - DNA, 22 bp, Artificial Sequence
  chemically synthesized
caatttctatccaattaccaat

SEQ ID NO: 132323 - DNA, 22 bp, Artificial Sequence
  chemically synthesized
ctatccaattaccaatgtcatt

SEQ ID NO: 132324 - DNA, 22 bp, Artificial Sequence
  chemically synthesized
tatccaattaccaatgtcattc

SEQ ID NO: 132325 - DNA, 22 bp, Artificial Sequence
  chemically synthesized
tccaattaccaatgtcattctt

SEQ ID NO: 132326 - DNA, 22 bp, Artificial Sequence
  chemically synthesized
ccaatgtcattcttcacagtat

SEQ ID NO: 132327 - DNA, 22 bp, Artificial Sequence
  chemically synthesized
ttcacagtattagaaaaactag

SEQ ID NO: 132328 - DNA, 22 bp, Artificial Sequence
  chemically synthesized
cacagtattagaaaaactagtt

SEQ ID NO: 132329 - DNA, 22 bp, Artificial Sequence
  chemically synthesized
acagtattagaaaaactagttt

SEQ ID NO: 132330 - DNA, 22 bp, Artificial Sequence
  chemically synthesized
gaaaaactagtttaaaattcat

SEQ ID NO: 132331 - DNA, 22 bp, Artificial Sequence
  chemically synthesized
gtttaaaattcatatggaacca

SEQ ID NO: 132332 - DNA, 22 bp, Artificial Sequence
  chemically synthesized
aaaattcatatggaaccaaaaa

SEQ ID NO: 132333 - DNA, 22 bp, Artificial Sequence
  chemically synthesized
aaattcatatggaaccaaaaag

SEQ ID NO: 132334 - DNA, 22 bp, Artificial Sequence
  chemically synthesized
atatggaaccaaaaagagcctg

SEQ ID NO: 132335 - DNA, 22 bp, Artificial Sequence
  chemically synthesized
aacaggcaaagcaatcttaagc

SEQ ID NO: 132336 - DNA, 22 bp, Artificial Sequence
  chemically synthesized
aagcagaaagaacaaaattgga

SEQ ID NO: 132337 - DNA, 22 bp, Artificial Sequence
  chemically synthesized
agcagaaagaacaaaattggaa

SEQ ID NO: 132338 - DNA, 22 bp, Artificial Sequence
  chemically synthesized
gaagcaccacaccacctgactt

SEQ ID NO: 132339 - DNA, 22 bp, Artificial Sequence
  chemically synthesized
acttgaaactacaggccaggca

SEQ ID NO: 132340 - DNA, 22 bp, Artificial Sequence
  chemically synthesized
gaaactacaggccaggcacggt

SEQ ID NO: 132341 - DNA, 22 bp, Artificial Sequence
  chemically synthesized
aaactacaggccaggcacggtg

SEQ ID NO: 132342 - DNA, 22 bp, Artificial Sequence
  chemically synthesized
caggccaggcacggtggctcac

SEQ ID NO: 132343 - DNA, 22 bp, Artificial Sequence
  chemically synthesized
acgcctgtaactctagcacttt

SEQ ID NO: 132344 - DNA, 22 bp, Artificial Sequence
  chemically synthesized
taactctagcactttagggggc

SEQ ID NO: 132345 - DNA, 22 bp, Artificial Sequence
  chemically synthesized
tagcactttagggggctgaggt

SEQ ID NO: 132346 - DNA, 22 bp, Artificial Sequence
  chemically synthesized
gcactttagggggctgaggtgg

SEQ ID NO: 132347 - DNA, 22 bp, Artificial Sequence
  chemically synthesized
tagggggctgaggtgggtgtat

SEQ ID NO: 132348 - DNA, 22 bp, Artificial Sequence
  chemically synthesized
agggggctgaggtgggtgtatc

SEQ ID NO: 132349 - DNA, 22 bp, Artificial Sequence
  chemically synthesized
gggggctgaggtgggtgtatca

SEQ ID NO: 132350 - DNA, 22 bp, Artificial Sequence
  chemically synthesized
aggtgggtgtatcacctgaggt

SEQ ID NO: 132351 - DNA, 22 bp, Artificial Sequence
  chemically synthesized
aggtcaggagttcaagaccagc

SEQ ID NO: 132352 - DNA, 22 bp, Artificial Sequence
  chemically synthesized
aagaccagcctggtcaacatgg

SEQ ID NO: 132353 - DNA, 22 bp, Artificial Sequence
  chemically synthesized
gtcaacatggtgaaacactgtc

SEQ ID NO: 132354 - DNA, 22 bp, Artificial Sequence
  chemically synthesized
tctctactaaaaatacaaaatt

SEQ ID NO: 132355 - DNA, 22 bp, Artificial Sequence
  chemically synthesized
tactaaaaatacaaaattagcc

SEQ ID NO: 132356 - DNA, 22 bp, Artificial Sequence
  chemically synthesized
ctaaaaatacaaaattagccgg

SEQ ID NO: 132357 - DNA, 22 bp, Artificial Sequence
  chemically synthesized
aaaatacaaaattagccggctg

SEQ ID NO: 132358 - DNA, 22 bp, Artificial Sequence
  chemically synthesized
gccggctgtggtggtgggggct

SEQ ID NO: 132359 - DNA, 22 bp, Artificial Sequence
  chemically synthesized
tggtggtgggggctgtaatccc

SEQ ID NO: 132360 - DNA, 22 bp, Artificial Sequence
  chemically synthesized
taatcccagctactcggaaggc

SEQ ID NO: 132361 - DNA, 22 bp, Artificial Sequence
  chemically synthesized
ctcggaaggctgaggcaggaga

SEQ ID NO: 132362 - DNA, 22 bp, Artificial Sequence
  chemically synthesized
ggaaggctgaggcaggagaatt

SEQ ID NO: 132363 - DNA, 22 bp, Artificial Sequence
  chemically synthesized
aggcaggagaattgcttgaact

SEQ ID NO: 132364 - DNA, 22 bp, Artificial Sequence
  chemically synthesized
cttgaactctggaggcagacgg

SEQ ID NO: 132365 - DNA, 22 bp, Artificial Sequence
  chemically synthesized
gaactctggaggcagacggtgc

SEQ ID NO: 132366 - DNA, 22 bp, Artificial Sequence
  chemically synthesized
aactctggaggcagacggtgca

SEQ ID NO: 132367 - DNA, 22 bp, Artificial Sequence
  chemically synthesized
tggaggcagacggtgcagtgag

SEQ ID NO: 132368 - DNA, 22 bp, Artificial Sequence
  chemically synthesized
gaggcagacggtgcagtgagcc

SEQ ID NO: 132369 - DNA, 22 bp, Artificial Sequence
  chemically synthesized
cactccagcctgggtgacagag

SEQ ID NO: 132370 - DNA, 22 bp, Artificial Sequence
  chemically synthesized
cagcctgggtgacagagtgaaa

SEQ ID NO: 132371 - DNA, 22 bp, Artificial Sequence
  chemically synthesized
ggtgacagagtgaaactctgaa

SEQ ID NO: 132372 - DNA, 22 bp, Artificial Sequence
  chemically synthesized
tgaaaaaataaaaaaagaaaga

SEQ ID NO: 132373 - DNA, 22 bp, Artificial Sequence
  chemically synthesized
aaaaaataaaaaaagaaagaaa

SEQ ID NO: 132374 - DNA, 22 bp, Artificial Sequence
  chemically synthesized
cattataaggccacagtacccc

SEQ ID NO: 132375 - DNA, 22 bp, Artificial Sequence
  chemically synthesized
taaggccacagtaccccaaaca

SEQ ID NO: 132376 - DNA, 22 bp, Artificial Sequence
  chemically synthesized
ttacaaaaatagacacattgac

SEQ ID NO: 132377 - DNA, 22 bp, Artificial Sequence
  chemically synthesized
caaaaatagacacattgactaa

SEQ ID NO: 132378 - DNA, 22 bp, Artificial Sequence
  chemically synthesized
actaaggaaacacaatagaaaa

SEQ ID NO: 132379 - DNA, 22 bp, Artificial Sequence
  chemically synthesized
aggaaacacaatagaaaactca

SEQ ID NO: 132380 - DNA, 22 bp, Artificial Sequence
  chemically synthesized
aaaaataaagctacatagttac

SEQ ID NO: 132381 - DNA, 22 bp, Artificial Sequence
  chemically synthesized
catagttacaaccatctgatct

SEQ ID NO: 132382 - DNA, 22 bp, Artificial Sequence
  chemically synthesized
caaccatctgatcttcaacaac

SEQ ID NO: 132383 - DNA, 22 bp, Artificial Sequence
  chemically synthesized
atcttcaacaacactgacaaaa

SEQ ID NO: 132384 - DNA, 22 bp, Artificial Sequence
  chemically synthesized
caacaacactgacaaaaacaag

SEQ ID NO: 132385 - DNA, 22 bp, Artificial Sequence
  chemically synthesized
aacaacactgacaaaaacaagc

SEQ ID NO: 132386 - DNA, 22 bp, Artificial Sequence
  chemically synthesized
acaaaaacaagcagcgggaaaa

SEQ ID NO: 132387 - DNA, 22 bp, Artificial Sequence
  chemically synthesized
cctatccaataaactgtgctgg

SEQ ID NO: 132388 - DNA, 22 bp, Artificial Sequence
  chemically synthesized
tccaataaactgtgctggaata

SEQ ID NO: 132389 - DNA, 22 bp, Artificial Sequence
  chemically synthesized
tgctggaatacgtggctagcca

SEQ ID NO: 132390 - DNA, 22 bp, Artificial Sequence
  chemically synthesized
gaatacgtggctagccatatgc

SEQ ID NO: 132391 - DNA, 22 bp, Artificial Sequence
  chemically synthesized
gccatatgcagaagaatgaaac

SEQ ID NO: 132392 - DNA, 22 bp, Artificial Sequence
  chemically synthesized
gacccttaccttacaccattta

SEQ ID NO: 132393 - DNA, 22 bp, Artificial Sequence
  chemically synthesized
accttacaccatttagagaaat

SEQ ID NO: 132394 - DNA, 22 bp, Artificial Sequence
  chemically synthesized
ccttacaccatttagagaaatc

SEQ ID NO: 132395 - DNA, 22 bp, Artificial Sequence
  chemically synthesized
acaccatttagagaaatcaact

SEQ ID NO: 132396 - DNA, 22 bp, Artificial Sequence
  chemically synthesized
caccatttagagaaatcaactg

SEQ ID NO: 132397 - DNA, 22 bp, Artificial Sequence
  chemically synthesized
agagaaatcaactgaaaatgaa

SEQ ID NO: 132398 - DNA, 22 bp, Artificial Sequence
  chemically synthesized
gagaaatcaactgaaaatgaat

SEQ ID NO: 132399 - DNA, 22 bp, Artificial Sequence
  chemically synthesized
aaaatgaattcaaaacttaaat

SEQ ID NO: 132400 - DNA, 22 bp, Artificial Sequence
  chemically synthesized
aaaacttaaatgtaagatctca

SEQ ID NO: 132401 - DNA, 22 bp, Artificial Sequence
  chemically synthesized
aaatgtaagatctcaaatctta

SEQ ID NO: 132402 - DNA, 22 bp, Artificial Sequence
  chemically synthesized
aatgtaagatctcaaatcttac

SEQ ID NO: 132403 - DNA, 22 bp, Artificial Sequence
  chemically synthesized
aaatcttacctgcactggcagt

SEQ ID NO: 132404 - DNA, 22 bp, Artificial Sequence
  chemically synthesized
acctgcactggcagtgcatttt

SEQ ID NO: 132405 - DNA, 22 bp, Artificial Sequence
  chemically synthesized
cctgcactggcagtgcattttt

SEQ ID NO: 132406 - DNA, 22 bp, Artificial Sequence
  chemically synthesized
cactggcagtgcatttttggct

SEQ ID NO: 132407 - DNA, 22 bp, Artificial Sequence
  chemically synthesized
gcagtgcatttttggctaagcc

SEQ ID NO: 132408 - DNA, 22 bp, Artificial Sequence
  chemically synthesized
ttggctaagcccccaaaagcaa

SEQ ID NO: 132409 - DNA, 22 bp, Artificial Sequence
  chemically synthesized
tggctaagcccccaaaagcaat

SEQ ID NO: 132410 - DNA, 22 bp, Artificial Sequence
  chemically synthesized
ggctaagcccccaaaagcaatt

SEQ ID NO: 132411 - DNA, 22 bp, Artificial Sequence
  chemically synthesized
gctaagcccccaaaagcaattg

SEQ ID NO: 132412 - DNA, 22 bp, Artificial Sequence
  chemically synthesized
agcccccaaaagcaattgcaat

SEQ ID NO: 132413 - DNA, 22 bp, Artificial Sequence
  chemically synthesized
caatgcaaagaaaaattcacaa

SEQ ID NO: 132414 - DNA, 22 bp, Artificial Sequence
  chemically synthesized
acaagtggaacctaattaaact

SEQ ID NO: 132415 - DNA, 22 bp, Artificial Sequence
  chemically synthesized
attaaactaaagagcttcacta

SEQ ID NO: 132416 - DNA, 22 bp, Artificial Sequence
  chemically synthesized
aactaaagagcttcactattca

SEQ ID NO: 132417 - DNA, 22 bp, Artificial Sequence
  chemically synthesized
aagagcttcactattcacaata

SEQ ID NO: 132418 - DNA, 22 bp, Artificial Sequence
  chemically synthesized
cactattcacaataacaaagac

SEQ ID NO: 132419 - DNA, 22 bp, Artificial Sequence
  chemically synthesized
actattcacaataacaaagact

SEQ ID NO: 132420 - DNA, 22 bp, Artificial Sequence
  chemically synthesized
ttcacaataacaaagacttgga

SEQ ID NO: 132421 - DNA, 22 bp, Artificial Sequence
  chemically synthesized
acaataacaaagacttggaacc

SEQ ID NO: 132422 - DNA, 22 bp, Artificial Sequence
  chemically synthesized
ggaaccaacccaaatgtccaac

SEQ ID NO: 132423 - DNA, 22 bp, Artificial Sequence
  chemically synthesized
gaaccaacccaaatgtccaaca

SEQ ID NO: 132424 - DNA, 22 bp, Artificial Sequence
  chemically synthesized
agaaaatgtggcacatatacac

SEQ ID NO: 132425 - DNA, 22 bp, Artificial Sequence
  chemically synthesized
tgcagccataaaaaatgatgag

SEQ ID NO: 132426 - DNA, 22 bp, Artificial Sequence
  chemically synthesized
atgtcctttgtagggacatgga

SEQ ID NO: 132427 - DNA, 22 bp, Artificial Sequence
  chemically synthesized
tgtagggacatggatgaagctg

SEQ ID NO: 132428 - DNA, 22 bp, Artificial Sequence
  chemically synthesized
gtagggacatggatgaagctgg

SEQ ID NO: 132429 - DNA, 22 bp, Artificial Sequence
  chemically synthesized
tagggacatggatgaagctgga

SEQ ID NO: 132430 - DNA, 22 bp, Artificial Sequence
  chemically synthesized
gaaaccatcattctcagcaaac

SEQ ID NO: 132431 - DNA, 22 bp, Artificial Sequence
  chemically synthesized
tcagcaaactatcacaaggaca

SEQ ID NO: 132432 - DNA, 22 bp, Artificial Sequence
  chemically synthesized
agcaaactatcacaaggacaaa

SEQ ID NO: 132433 - DNA, 22 bp, Artificial Sequence
  chemically synthesized
tcacaaggacaaaaaaccaaat

SEQ ID NO: 132434 - DNA, 22 bp, Artificial Sequence
  chemically synthesized
tcacttataggtgggaattgaa

SEQ ID NO: 132435 - DNA, 22 bp, Artificial Sequence
  chemically synthesized
acttataggtgggaattgaaca

SEQ ID NO: 132436 - DNA, 22 bp, Artificial Sequence
  chemically synthesized
ataggtgggaattgaacaatga

SEQ ID NO: 132437 - DNA, 22 bp, Artificial Sequence
  chemically synthesized
taggtgggaattgaacaatgag

SEQ ID NO: 132438 - DNA, 22 bp, Artificial Sequence
  chemically synthesized
aacaatgagaacacttggacag

SEQ ID NO: 132439 - DNA, 22 bp, Artificial Sequence
  chemically synthesized
ggacagaggaaggggaacatca

SEQ ID NO: 132440 - DNA, 22 bp, Artificial Sequence
  chemically synthesized
gacagaggaaggggaacatcac

SEQ ID NO: 132441 - DNA, 22 bp, Artificial Sequence
  chemically synthesized
ttgtggggtgggggtggggggt

SEQ ID NO: 132442 - DNA, 22 bp, Artificial Sequence
  chemically synthesized
tggggtgggggtggggggtgga

SEQ ID NO: 132443 - DNA, 22 bp, Artificial Sequence
  chemically synthesized
ggagatatacctaatgtaaatg

SEQ ID NO: 132444 - DNA, 22 bp, Artificial Sequence
  chemically synthesized
atgtaaatgatgagttaatggg

SEQ ID NO: 132445 - DNA, 22 bp, Artificial Sequence
  chemically synthesized
atgggtgcagcacaccaacatg

SEQ ID NO: 132446 - DNA, 22 bp, Artificial Sequence
  chemically synthesized
cacgttgcgcacatgtacccta

SEQ ID NO: 132447 - DNA, 22 bp, Artificial Sequence
  chemically synthesized
cgcacatgtaccctagaactta

SEQ ID NO: 132448 - DNA, 22 bp, Artificial Sequence
  chemically synthesized
gaacttaaagtataataataat

SEQ ID NO: 132449 - DNA, 22 bp, Artificial Sequence
  chemically synthesized
aaagtataataataataataaa

SEQ ID NO: 132450 - DNA, 22 bp, Artificial Sequence
  chemically synthesized
aagtataataataataataaaa

SEQ ID NO: 132451 - DNA, 22 bp, Artificial Sequence
  chemically synthesized
ctgtgcagcagaagaaactatc

SEQ ID NO: 132452 - DNA, 22 bp, Artificial Sequence
  chemically synthesized
tgtgcagcagaagaaactatca

SEQ ID NO: 132453 - DNA, 22 bp, Artificial Sequence
  chemically synthesized
tgcagcagaagaaactatcaac

SEQ ID NO: 132454 - DNA, 22 bp, Artificial Sequence
  chemically synthesized
tcaacagagtaaactgacaatc

SEQ ID NO: 132455 - DNA, 22 bp, Artificial Sequence
  chemically synthesized
acaatctacaggataggagaaa

SEQ ID NO: 132456 - DNA, 22 bp, Artificial Sequence
  chemically synthesized
caggataggagaaactattcac

SEQ ID NO: 132457 - DNA, 22 bp, Artificial Sequence
  chemically synthesized
ttcacaaactgtgcatctggaa

SEQ ID NO: 132458 - DNA, 22 bp, Artificial Sequence
  chemically synthesized
acaaactgtgcatctggaaaag

SEQ ID NO: 132459 - DNA, 22 bp, Artificial Sequence
  chemically synthesized
tgcatctggaaaaggtctaata

SEQ ID NO: 132460 - DNA, 22 bp, Artificial Sequence
  chemically synthesized
gaaaaggtctaatattcagaat

SEQ ID NO: 132461 - DNA, 22 bp, Artificial Sequence
  chemically synthesized
atattcagaatctataaggaat

SEQ ID NO: 132462 - DNA, 22 bp, Artificial Sequence
  chemically synthesized
agaatctataaggaattcgaac

SEQ ID NO: 132463 - DNA, 22 bp, Artificial Sequence
  chemically synthesized
taaggaattcgaacatatcagc

SEQ ID NO: 132464 - DNA, 22 bp, Artificial Sequence
  chemically synthesized
gaacatatcagcaagcaaaaag

SEQ ID NO: 132465 - DNA, 22 bp, Artificial Sequence
  chemically synthesized
catttaaaaatgggcaaaatcc

SEQ ID NO: 132466 - DNA, 22 bp, Artificial Sequence
  chemically synthesized
aaaaatgggcaaaatccacgaa

SEQ ID NO: 132467 - DNA, 22 bp, Artificial Sequence
  chemically synthesized
aaaatgggcaaaatccacgaac

SEQ ID NO: 132468 - DNA, 22 bp, Artificial Sequence
  chemically synthesized
ttctcaagagaagacatacagg

SEQ ID NO: 132469 - DNA, 22 bp, Artificial Sequence
  chemically synthesized
ctcaagagaagacatacaggca

SEQ ID NO: 132470 - DNA, 22 bp, Artificial Sequence
  chemically synthesized
tcaagagaagacatacaggcag

SEQ ID NO: 132471 - DNA, 22 bp, Artificial Sequence
  chemically synthesized
aagagaagacatacaggcagcc

SEQ ID NO: 132472 - DNA, 22 bp, Artificial Sequence
  chemically synthesized
atgagagaaatgcaaatcaaaa

SEQ ID NO: 132473 - DNA, 22 bp, Artificial Sequence
  chemically synthesized
tctcataccagtcagaatagct

SEQ ID NO: 132474 - DNA, 22 bp, Artificial Sequence
  chemically synthesized
ataccagtcagaatagctattt

SEQ ID NO: 132475 - DNA, 22 bp, Artificial Sequence
  chemically synthesized
tttttaaaaagccaaaaaacag

SEQ ID NO: 132476 - DNA, 22 bp, Artificial Sequence
  chemically synthesized
ttaaaaagccaaaaaacagatt

SEQ ID NO: 132477 - DNA, 22 bp, Artificial Sequence
  chemically synthesized
taaaaagccaaaaaacagattc

SEQ ID NO: 132478 - DNA, 22 bp, Artificial Sequence
  chemically synthesized
aaaaagccaaaaaacagattct

SEQ ID NO: 132479 - DNA, 22 bp, Artificial Sequence
  chemically synthesized
aaaagccaaaaaacagattctc

SEQ ID NO: 132480 - DNA, 22 bp, Artificial Sequence
  chemically synthesized
tcatgaggctatggagaaaagg

SEQ ID NO: 132481 - DNA, 22 bp, Artificial Sequence
  chemically synthesized
atgaggctatggagaaaaggga

SEQ ID NO: 132482 - DNA, 22 bp, Artificial Sequence
  chemically synthesized
tggagaaaagggaacacttata

SEQ ID NO: 132483 - DNA, 22 bp, Artificial Sequence
  chemically synthesized
atacaatgatgatggggatgta

SEQ ID NO: 132484 - DNA, 22 bp, Artificial Sequence
  chemically synthesized
tacaatgatgatggggatgtaa

SEQ ID NO: 132485 - DNA, 22 bp, Artificial Sequence
  chemically synthesized
gttcaaccactgcagaaaacag

SEQ ID NO: 132486 - DNA, 22 bp, Artificial Sequence
  chemically synthesized
aaccactgcagaaaacagtttg

SEQ ID NO: 132487 - DNA, 22 bp, Artificial Sequence
  chemically synthesized
cagaaaacagtttggagagtct

SEQ ID NO: 132488 - DNA, 22 bp, Artificial Sequence
  chemically synthesized
ggagagtcttcaaagaacttta

SEQ ID NO: 132489 - DNA, 22 bp, Artificial Sequence
  chemically synthesized
gagagtcttcaaagaactttaa

SEQ ID NO: 132490 - DNA, 22 bp, Artificial Sequence
  chemically synthesized
caaagaactttaagcagagcta

SEQ ID NO: 132491 - DNA, 22 bp, Artificial Sequence
  chemically synthesized
aaagaactttaagcagagctac

SEQ ID NO: 132492 - DNA, 22 bp, Artificial Sequence
  chemically synthesized
taagcagagctacaatttgaca

SEQ ID NO: 132493 - DNA, 22 bp, Artificial Sequence
  chemically synthesized
aagcagagctacaatttgacac

SEQ ID NO: 132494 - DNA, 22 bp, Artificial Sequence
  chemically synthesized
agcagagctacaatttgacaca

SEQ ID NO: 132495 - DNA, 22 bp, Artificial Sequence
  chemically synthesized
caatttgacacagcaatcccgc

SEQ ID NO: 132496 - DNA, 22 bp, Artificial Sequence
  chemically synthesized
gacacagcaatcccgctactgg

SEQ ID NO: 132497 - DNA, 22 bp, Artificial Sequence
  chemically synthesized
acacagcaatcccgctactggg

SEQ ID NO: 132498 - DNA, 22 bp, Artificial Sequence
  chemically synthesized
ctgggtatatatccataggaaa

SEQ ID NO: 132499 - DNA, 22 bp, Artificial Sequence
  chemically synthesized
ggtatatatccataggaaaaca

SEQ ID NO: 132500 - DNA, 22 bp, Artificial Sequence
  chemically synthesized
gaccaactagacacatgcactt

SEQ ID NO: 132501 - DNA, 22 bp, Artificial Sequence
  chemically synthesized
gacacatgcacttgcatgttca

SEQ ID NO: 132502 - DNA, 22 bp, Artificial Sequence
  chemically synthesized
gcatgttcactgtaatgctgtt

SEQ ID NO: 132503 - DNA, 22 bp, Artificial Sequence
  chemically synthesized
catgttcactgtaatgctgttt

SEQ ID NO: 132504 - DNA, 22 bp, Artificial Sequence
  chemically synthesized
actgtaatgctgtttagaatag

SEQ ID NO: 132505 - DNA, 22 bp, Artificial Sequence
  chemically synthesized
taatgctgtttagaatagcaaa

SEQ ID NO: 132506 - DNA, 22 bp, Artificial Sequence
  chemically synthesized
tttagaatagcaaatacaaata

SEQ ID NO: 132507 - DNA, 22 bp, Artificial Sequence
  chemically synthesized
agaatagcaaatacaaataact

SEQ ID NO: 132508 - DNA, 22 bp, Artificial Sequence
  chemically synthesized
gaatagcaaatacaaataactg

SEQ ID NO: 132509 - DNA, 22 bp, Artificial Sequence
  chemically synthesized
gcctaggtgtctatcaaaggcg

SEQ ID NO: 132510 - DNA, 22 bp, Artificial Sequence
  chemically synthesized
ggtgtctatcaaaggcggacgg

SEQ ID NO: 132511 - DNA, 22 bp, Artificial Sequence
  chemically synthesized
tcaaaggcggacgggataaaga

SEQ ID NO: 132512 - DNA, 22 bp, Artificial Sequence
  chemically synthesized
tggtacatatacaccaccacta

SEQ ID NO: 132513 - DNA, 22 bp, Artificial Sequence
  chemically synthesized
tgtggcaataagaacaaatgaa

SEQ ID NO: 132514 - DNA, 22 bp, Artificial Sequence
  chemically synthesized
ttcagcaacatgggtggagctg

SEQ ID NO: 132515 - DNA, 22 bp, Artificial Sequence
  chemically synthesized
tcagcaacatgggtggagctgg

SEQ ID NO: 132516 - DNA, 22 bp, Artificial Sequence
  chemically synthesized
cagcaacatgggtggagctgga

SEQ ID NO: 132517 - DNA, 22 bp, Artificial Sequence
  chemically synthesized
agcaacatgggtggagctggag

SEQ ID NO: 132518 - DNA, 22 bp, Artificial Sequence
  chemically synthesized
gaggctataatcctaagcaaat

SEQ ID NO: 132519 - DNA, 22 bp, Artificial Sequence
  chemically synthesized
taatcctaagcaaattaacgca

SEQ ID NO: 132520 - DNA, 22 bp, Artificial Sequence
  chemically synthesized
agcaaattaacgcaagaacaca

SEQ ID NO: 132521 - DNA, 22 bp, Artificial Sequence
  chemically synthesized
acgcaagaacacaaaagcaaat

SEQ ID NO: 132522 - DNA, 22 bp, Artificial Sequence
  chemically synthesized
tcatttataagtggaagctaaa

SEQ ID NO: 132523 - DNA, 22 bp, Artificial Sequence
  chemically synthesized
atttataagtggaagctaaaca

SEQ ID NO: 132524 - DNA, 22 bp, Artificial Sequence
  chemically synthesized
ataagtggaagctaaacattga

SEQ ID NO: 132525 - DNA, 22 bp, Artificial Sequence
  chemically synthesized
taagtggaagctaaacattgag

SEQ ID NO: 132526 - DNA, 22 bp, Artificial Sequence
  chemically synthesized
aacattgagtacacgtggatat

SEQ ID NO: 132527 - DNA, 22 bp, Artificial Sequence
  chemically synthesized
agtacacgtggatataaacatg

SEQ ID NO: 132528 - DNA, 22 bp, Artificial Sequence
  chemically synthesized
gaaactactacaaggggcaggg

SEQ ID NO: 132529 - DNA, 22 bp, Artificial Sequence
  chemically synthesized
aaactactacaaggggcaggga

SEQ ID NO: 132530 - DNA, 22 bp, Artificial Sequence
  chemically synthesized
ctacaaggggcagggagagatg

SEQ ID NO: 132531 - DNA, 22 bp, Artificial Sequence
  chemically synthesized
caaggggcagggagagatgcgg

SEQ ID NO: 132532 - DNA, 22 bp, Artificial Sequence
  chemically synthesized
aaaaatctattggatagtatgc

SEQ ID NO: 132533 - DNA, 22 bp, Artificial Sequence
  chemically synthesized
ttggatagtatgctcaccactg

SEQ ID NO: 132534 - DNA, 22 bp, Artificial Sequence
  chemically synthesized
gatagtatgctcaccactgcat

SEQ ID NO: 132535 - DNA, 22 bp, Artificial Sequence
  chemically synthesized
accactgcatgcaatatatcca

SEQ ID NO: 132536 - DNA, 22 bp, Artificial Sequence
  chemically synthesized
catgcaatatatccatgtaaaa

SEQ ID NO: 132537 - DNA, 22 bp, Artificial Sequence
  chemically synthesized
cacaagtacccactgtatctaa

SEQ ID NO: 132538 - DNA, 22 bp, Artificial Sequence
  chemically synthesized
tatctaaagtaaatgttgaaaa

SEQ ID NO: 132539 - DNA, 22 bp, Artificial Sequence
  chemically synthesized
aagtaaatgttgaaaatttaaa

SEQ ID NO: 132540 - DNA, 22 bp, Artificial Sequence
  chemically synthesized
aaaatttaaaagaaaaaacaaa

SEQ ID NO: 132541 - DNA, 22 bp, Artificial Sequence
  chemically synthesized
aaaagaaaaaacaaataaataa

SEQ ID NO: 132542 - DNA, 22 bp, Artificial Sequence
  chemically synthesized
aaagaaaaaacaaataaataaa

SEQ ID NO: 132543 - DNA, 22 bp, Artificial Sequence
  chemically synthesized
tcctgaacctggtatgaaatgg

SEQ ID NO: 132544 - DNA, 22 bp, Artificial Sequence
  chemically synthesized
aacctggtatgaaatgggcagt

SEQ ID NO: 132545 - DNA, 22 bp, Artificial Sequence
  chemically synthesized
gtatgaaatgggcagtgatttt

SEQ ID NO: 132546 - DNA, 22 bp, Artificial Sequence
  chemically synthesized
ttatataaacaaagttatttta

SEQ ID NO: 132547 - DNA, 22 bp, Artificial Sequence
  chemically synthesized
tatataaacaaagttattttaa

SEQ ID NO: 132548 - DNA, 22 bp, Artificial Sequence
  chemically synthesized
atataaacaaagttattttaag

SEQ ID NO: 132549 - DNA, 22 bp, Artificial Sequence
  chemically synthesized
tataaacaaagttattttaaga

SEQ ID NO: 132550 - DNA, 22 bp, Artificial Sequence
  chemically synthesized
ttttaagacaaaatataatagg

SEQ ID NO: 132551 - DNA, 22 bp, Artificial Sequence
  chemically synthesized
taagacaaaatataataggccc

SEQ ID NO: 132552 - DNA, 22 bp, Artificial Sequence
  chemically synthesized
aagacaaaatataataggccct

SEQ ID NO: 132553 - DNA, 22 bp, Artificial Sequence
  chemically synthesized
agacaaaatataataggccctt

SEQ ID NO: 132554 - DNA, 22 bp, Artificial Sequence
  chemically synthesized
catttacttggctattaataga

SEQ ID NO: 132555 - DNA, 22 bp, Artificial Sequence
  chemically synthesized
atttacttggctattaatagat

SEQ ID NO: 132556 - DNA, 22 bp, Artificial Sequence
  chemically synthesized
acttggctattaatagatccat

SEQ ID NO: 132557 - DNA, 22 bp, Artificial Sequence
  chemically synthesized
cttggctattaatagatccatt

SEQ ID NO: 132558 - DNA, 22 bp, Artificial Sequence
  chemically synthesized
ggctattaatagatccattgag

SEQ ID NO: 132559 - DNA, 22 bp, Artificial Sequence
  chemically synthesized
gctattaatagatccattgagg

SEQ ID NO: 132560 - DNA, 22 bp, Artificial Sequence
  chemically synthesized
ttaatagatccattgaggttcc

SEQ ID NO: 132561 - DNA, 22 bp, Artificial Sequence
  chemically synthesized
atagatccattgaggttcctgt

SEQ ID NO: 132562 - DNA, 22 bp, Artificial Sequence
  chemically synthesized
aggttcctgtggatcagaactg

SEQ ID NO: 132563 - DNA, 22 bp, Artificial Sequence
  chemically synthesized
ctgtggatcagaactgattttc

SEQ ID NO: 132564 - DNA, 22 bp, Artificial Sequence
  chemically synthesized
tggatcagaactgattttccca

SEQ ID NO: 132565 - DNA, 22 bp, Artificial Sequence
  chemically synthesized
attttcccaaagtatcagaaaa

SEQ ID NO: 132566 - DNA, 22 bp, Artificial Sequence
  chemically synthesized
tcccaaagtatcagaaaagaca

SEQ ID NO: 132567 - DNA, 22 bp, Artificial Sequence
  chemically synthesized
cccaaagtatcagaaaagacaa

SEQ ID NO: 132568 - DNA, 22 bp, Artificial Sequence
  chemically synthesized
ccaaagtatcagaaaagacaac

SEQ ID NO: 132569 - DNA, 22 bp, Artificial Sequence
  chemically synthesized
aaatgcataaactccaggacaa

SEQ ID NO: 132570 - DNA, 22 bp, Artificial Sequence
  chemically synthesized
caggacaaagacacatgtgacc

SEQ ID NO: 132571 - DNA, 22 bp, Artificial Sequence
  chemically synthesized
cattcaactagtatctctcaat

SEQ ID NO: 132572 - DNA, 22 bp, Artificial Sequence
  chemically synthesized
aactagtatctctcaatacttt

SEQ ID NO: 132573 - DNA, 22 bp, Artificial Sequence
  chemically synthesized
gtatctctcaatactttgcatt

SEQ ID NO: 132574 - DNA, 22 bp, Artificial Sequence
  chemically synthesized
tcaatactttgcattgtattga

SEQ ID NO: 132575 - DNA, 22 bp, Artificial Sequence
  chemically synthesized
aatactttgcattgtattgaga

SEQ ID NO: 132576 - DNA, 22 bp, Artificial Sequence
  chemically synthesized
tgcattgtattgagacagacaa

SEQ ID NO: 132577 - DNA, 22 bp, Artificial Sequence
  chemically synthesized
gcattgtattgagacagacaat

SEQ ID NO: 132578 - DNA, 22 bp, Artificial Sequence
  chemically synthesized
cattgtattgagacagacaatg

SEQ ID NO: 132579 - DNA, 22 bp, Artificial Sequence
  chemically synthesized
tattgagacagacaatgcaaag

SEQ ID NO: 132580 - DNA, 22 bp, Artificial Sequence
  chemically synthesized
agacagacaatgcaaagtacac

SEQ ID NO: 132581 - DNA, 22 bp, Artificial Sequence
  chemically synthesized
tgtactgatgcttagggtcctg

SEQ ID NO: 132582 - DNA, 22 bp, Artificial Sequence
  chemically synthesized
atgcttagggtcctgaagggtc

SEQ ID NO: 132583 - DNA, 22 bp, Artificial Sequence
  chemically synthesized
agggtcctgaagggtcacataa

SEQ ID NO: 132584 - DNA, 22 bp, Artificial Sequence
  chemically synthesized
gggtcctgaagggtcacataat

SEQ ID NO: 132585 - DNA, 22 bp, Artificial Sequence
  chemically synthesized
aagggtcacataattaagtcct

SEQ ID NO: 132586 - DNA, 22 bp, Artificial Sequence
  chemically synthesized
agtcctggcatcccaatgtaga

SEQ ID NO: 132587 - DNA, 22 bp, Artificial Sequence
  chemically synthesized
gcatcccaatgtagaggtggca

SEQ ID NO: 132588 - DNA, 22 bp, Artificial Sequence
  chemically synthesized
gagtatgcagcttttctcatcc

SEQ ID NO: 132589 - DNA, 22 bp, Artificial Sequence
  chemically synthesized
ttctcatccatccttggagaaa

SEQ ID NO: 132590 - DNA, 22 bp, Artificial Sequence
  chemically synthesized
tctcatccatccttggagaaat

SEQ ID NO: 132591 - DNA, 22 bp, Artificial Sequence
  chemically synthesized
ctcatccatccttggagaaata

SEQ ID NO: 132592 - DNA, 22 bp, Artificial Sequence
  chemically synthesized
tcatccatccttggagaaatac

SEQ ID NO: 132593 - DNA, 22 bp, Artificial Sequence
  chemically synthesized
atccatccttggagaaatacct

SEQ ID NO: 132594 - DNA, 22 bp, Artificial Sequence
  chemically synthesized
ggagaaatacctgaaagttccg

SEQ ID NO: 132595 - DNA, 22 bp, Artificial Sequence
  chemically synthesized
gagaaatacctgaaagttccga

SEQ ID NO: 132596 - DNA, 22 bp, Artificial Sequence
  chemically synthesized
aaagttccgaggacattggttg

SEQ ID NO: 132597 - DNA, 22 bp, Artificial Sequence
  chemically synthesized
cgaggacattggttgagcgtcc

SEQ ID NO: 132598 - DNA, 22 bp, Artificial Sequence
  chemically synthesized
gttgagcgtccctgcttctccc

SEQ ID NO: 132599 - DNA, 22 bp, Artificial Sequence
  chemically synthesized
agcgtccctgcttctcccagac

SEQ ID NO: 132600 - DNA, 22 bp, Artificial Sequence
  chemically synthesized
cttctcccagacagaggaggga

SEQ ID NO: 132601 - DNA, 22 bp, Artificial Sequence
  chemically synthesized
ctcccagacagaggagggaggg

SEQ ID NO: 132602 - DNA, 22 bp, Artificial Sequence
  chemically synthesized
tcccagacagaggagggagggg

SEQ ID NO: 132603 - DNA, 22 bp, Artificial Sequence
  chemically synthesized
ccagacagaggagggaggggag

SEQ ID NO: 132604 - DNA, 22 bp, Artificial Sequence
  chemically synthesized
ttctgagtatttggaaagagga

SEQ ID NO: 132605 - DNA, 22 bp, Artificial Sequence
  chemically synthesized
ctgagtatttggaaagaggaaa

SEQ ID NO: 132606 - DNA, 22 bp, Artificial Sequence
  chemically synthesized
tgagtatttggaaagaggaaac

SEQ ID NO: 132607 - DNA, 22 bp, Artificial Sequence
  chemically synthesized
agtatttggaaagaggaaactc

SEQ ID NO: 132608 - DNA, 22 bp, Artificial Sequence
  chemically synthesized
ggaaagaggaaactctggggaa

SEQ ID NO: 132609 - DNA, 22 bp, Artificial Sequence
  chemically synthesized
gaaagaggaaactctggggaag

SEQ ID NO: 132610 - DNA, 22 bp, Artificial Sequence
  chemically synthesized
tggggaagtgatttccacatac

SEQ ID NO: 132611 - DNA, 22 bp, Artificial Sequence
  chemically synthesized
gggaagtgatttccacatacat

SEQ ID NO: 132612 - DNA, 22 bp, Artificial Sequence
  chemically synthesized
ccacatacataaactctctaat

SEQ ID NO: 132613 - DNA, 22 bp, Artificial Sequence
  chemically synthesized
cacatacataaactctctaatt

SEQ ID NO: 132614 - DNA, 22 bp, Artificial Sequence
  chemically synthesized
tctaatttggcctcttgaatag

SEQ ID NO: 132615 - DNA, 22 bp, Artificial Sequence
  chemically synthesized
taatttggcctcttgaatagtc

SEQ ID NO: 132616 - DNA, 22 bp, Artificial Sequence
  chemically synthesized
atttggcctcttgaatagtctt

SEQ ID NO: 132617 - DNA, 22 bp, Artificial Sequence
  chemically synthesized
ggcctcttgaatagtctttgag

SEQ ID NO: 132618 - DNA, 22 bp, Artificial Sequence
  chemically synthesized
gcctcttgaatagtctttgaga

SEQ ID NO: 132619 - DNA, 22 bp, Artificial Sequence
  chemically synthesized
ttgaatagtctttgagaagtga

SEQ ID NO: 132620 - DNA, 22 bp, Artificial Sequence
  chemically synthesized
gaatagtctttgagaagtgagt

SEQ ID NO: 132621 - DNA, 22 bp, Artificial Sequence
  chemically synthesized
aatagtctttgagaagtgagtg

SEQ ID NO: 132622 - DNA, 22 bp, Artificial Sequence
  chemically synthesized
tgagaagtgagtgtctgaactg

SEQ ID NO: 132623 - DNA, 22 bp, Artificial Sequence
  chemically synthesized
gagaagtgagtgtctgaactga

SEQ ID NO: 132624 - DNA, 22 bp, Artificial Sequence
  chemically synthesized
agaagtgagtgtctgaactgag

SEQ ID NO: 132625 - DNA, 22 bp, Artificial Sequence
  chemically synthesized
aactgagtcttcaaatagagca

SEQ ID NO: 132626 - DNA, 22 bp, Artificial Sequence
  chemically synthesized
agtcttcaaatagagcaggaat

SEQ ID NO: 132627 - DNA, 22 bp, Artificial Sequence
  chemically synthesized
caaatagagcaggaatgggtcc

SEQ ID NO: 132628 - DNA, 22 bp, Artificial Sequence
  chemically synthesized
aaatagagcaggaatgggtcct

SEQ ID NO: 132629 - DNA, 22 bp, Artificial Sequence
  chemically synthesized
attccagcaagaaaatgacagc

SEQ ID NO: 132630 - DNA, 22 bp, Artificial Sequence
  chemically synthesized
ttccagcaagaaaatgacagca

SEQ ID NO: 132631 - DNA, 22 bp, Artificial Sequence
  chemically synthesized
cagcaagaaaatgacagcatag

SEQ ID NO: 132632 - DNA, 22 bp, Artificial Sequence
  chemically synthesized
ctcttccttcttatgttagatg

SEQ ID NO: 132633 - DNA, 22 bp, Artificial Sequence
  chemically synthesized
ttccttcttatgttagatgcag

SEQ ID NO: 132634 - DNA, 22 bp, Artificial Sequence
  chemically synthesized
ccttcttatgttagatgcagcg

SEQ ID NO: 132635 - DNA, 22 bp, Artificial Sequence
  chemically synthesized
cttcttatgttagatgcagcga

SEQ ID NO: 132636 - DNA, 22 bp, Artificial Sequence
  chemically synthesized
cttatgttagatgcagcgaaga

SEQ ID NO: 132637 - DNA, 22 bp, Artificial Sequence
  chemically synthesized
ttatgttagatgcagcgaagag

SEQ ID NO: 132638 - DNA, 22 bp, Artificial Sequence
  chemically synthesized
atgttagatgcagcgaagagaa

SEQ ID NO: 132639 - DNA, 22 bp, Artificial Sequence
  chemically synthesized
tgttagatgcagcgaagagaag

SEQ ID NO: 132640 - DNA, 22 bp, Artificial Sequence
  chemically synthesized
gatgcagcgaagagaagatagg

SEQ ID NO: 132641 - DNA, 22 bp, Artificial Sequence
  chemically synthesized
tcagaggtctgcataggagaac

SEQ ID NO: 132642 - DNA, 22 bp, Artificial Sequence
  chemically synthesized
cagaggtctgcataggagaaca

SEQ ID NO: 132643 - DNA, 22 bp, Artificial Sequence
  chemically synthesized
agaggtctgcataggagaacat

SEQ ID NO: 132644 - DNA, 22 bp, Artificial Sequence
  chemically synthesized
cataggagaacatactccatct

SEQ ID NO: 132645 - DNA, 22 bp, Artificial Sequence
  chemically synthesized
catctgggatgaccaacaccta

SEQ ID NO: 132646 - DNA, 22 bp, Artificial Sequence
  chemically synthesized
ggatgaccaacacctaaagcac

SEQ ID NO: 132647 - DNA, 22 bp, Artificial Sequence
  chemically synthesized
aagcacagactttttcatctca

SEQ ID NO: 132648 - DNA, 22 bp, Artificial Sequence
  chemically synthesized
tttcatctcaacacatgtttca

SEQ ID NO: 132649 - DNA, 22 bp, Artificial Sequence
  chemically synthesized
ttcatctcaacacatgtttcaa

SEQ ID NO: 132650 - DNA, 22 bp, Artificial Sequence
  chemically synthesized
tcatctcaacacatgtttcaag

SEQ ID NO: 132651 - DNA, 22 bp, Artificial Sequence
  chemically synthesized
catctcaacacatgtttcaagg

SEQ ID NO: 132652 - DNA, 22 bp, Artificial Sequence
  chemically synthesized
atctcaacacatgtttcaaggc

SEQ ID NO: 132653 - DNA, 22 bp, Artificial Sequence
  chemically synthesized
aacacatgtttcaaggcaggct

SEQ ID NO: 132654 - DNA, 22 bp, Artificial Sequence
  chemically synthesized
caaggcaggcttgaagtttcaa

SEQ ID NO: 132655 - DNA, 22 bp, Artificial Sequence
  chemically synthesized
aaggcaggcttgaagtttcaaa

SEQ ID NO: 132656 - DNA, 22 bp, Artificial Sequence
  chemically synthesized
gaagtttcaaatgtggtgctca

SEQ ID NO: 132657 - DNA, 22 bp, Artificial Sequence
  chemically synthesized
aagtttcaaatgtggtgctcat

SEQ ID NO: 132658 - DNA, 22 bp, Artificial Sequence
  chemically synthesized
caaatgtggtgctcatggatta

SEQ ID NO: 132659 - DNA, 22 bp, Artificial Sequence
  chemically synthesized
aaatgtggtgctcatggattag

SEQ ID NO: 132660 - DNA, 22 bp, Artificial Sequence
  chemically synthesized
atggattagcttcaggaaaacg

SEQ ID NO: 132661 - DNA, 22 bp, Artificial Sequence
  chemically synthesized
gcttcaggaaaacgtgtgaata

SEQ ID NO: 132662 - DNA, 22 bp, Artificial Sequence
  chemically synthesized
caggaaaacgtgtgaatatttt

SEQ ID NO: 132663 - DNA, 22 bp, Artificial Sequence
  chemically synthesized
aggaaaacgtgtgaatattttt

SEQ ID NO: 132664 - DNA, 22 bp, Artificial Sequence
  chemically synthesized
ttagactaaatgtgacgtcacc

SEQ ID NO: 132665 - DNA, 22 bp, Artificial Sequence
  chemically synthesized
tagactaaatgtgacgtcacct

SEQ ID NO: 132666 - DNA, 22 bp, Artificial Sequence
  chemically synthesized
agactaaatgtgacgtcacctg

SEQ ID NO: 132667 - DNA, 22 bp, Artificial Sequence
  chemically synthesized
gactaaatgtgacgtcacctgc

SEQ ID NO: 132668 - DNA, 22 bp, Artificial Sequence
  chemically synthesized
aatgtgacgtcacctgcttttg

SEQ ID NO: 132669 - DNA, 22 bp, Artificial Sequence
  chemically synthesized
cttttgtccatttttctccaca

SEQ ID NO: 132670 - DNA, 22 bp, Artificial Sequence
  chemically synthesized
ttgtccatttttctccacagag

SEQ ID NO: 132671 - DNA, 22 bp, Artificial Sequence
  chemically synthesized
tgtccatttttctccacagagg

SEQ ID NO: 132672 - DNA, 22 bp, Artificial Sequence
  chemically synthesized
gtccatttttctccacagaggg

SEQ ID NO: 132673 - DNA, 22 bp, Artificial Sequence
  chemically synthesized
tccatttttctccacagagggc

SEQ ID NO: 132674 - DNA, 22 bp, Artificial Sequence
  chemically synthesized
ttctccacagagggctcatggc

SEQ ID NO: 132675 - DNA, 22 bp, Artificial Sequence
  chemically synthesized
tctccacagagggctcatggct

SEQ ID NO: 132676 - DNA, 22 bp, Artificial Sequence
  chemically synthesized
ctccacagagggctcatggctt

SEQ ID NO: 132677 - DNA, 22 bp, Artificial Sequence
  chemically synthesized
tccacagagggctcatggcttt

SEQ ID NO: 132678 - DNA, 22 bp, Artificial Sequence
  chemically synthesized
cacagagggctcatggcttttg

SEQ ID NO: 132679 - DNA, 22 bp, Artificial Sequence
  chemically synthesized
atggcttttgttagaattccat

SEQ ID NO: 132680 - DNA, 22 bp, Artificial Sequence
  chemically synthesized
ttgttagaattccataaaacat

SEQ ID NO: 132681 - DNA, 22 bp, Artificial Sequence
  chemically synthesized
tgttagaattccataaaacatt

SEQ ID NO: 132682 - DNA, 22 bp, Artificial Sequence
  chemically synthesized
gttagaattccataaaacatta

SEQ ID NO: 132683 - DNA, 22 bp, Artificial Sequence
  chemically synthesized
ttagaattccataaaacattaa

SEQ ID NO: 132684 - DNA, 22 bp, Artificial Sequence
  chemically synthesized
gaattccataaaacattaacat

SEQ ID NO: 132685 - DNA, 22 bp, Artificial Sequence
  chemically synthesized
cataaaacattaacattctatt

SEQ ID NO: 132686 - DNA, 22 bp, Artificial Sequence
  chemically synthesized
acattctatttcaaaactaaac

SEQ ID NO: 132687 - DNA, 22 bp, Artificial Sequence
  chemically synthesized
tatttcaaaactaaacaaagaa

SEQ ID NO: 132688 - DNA, 22 bp, Artificial Sequence
  chemically synthesized
tttcaaaactaaacaaagaaaa

SEQ ID NO: 132689 - DNA, 22 bp, Artificial Sequence
  chemically synthesized
caaaactaaacaaagaaaagtt

SEQ ID NO: 132690 - DNA, 22 bp, Artificial Sequence
  chemically synthesized
aaaactaaacaaagaaaagttt

SEQ ID NO: 132691 - DNA, 22 bp, Artificial Sequence
  chemically synthesized
aacaaagaaaagttttctaaca

SEQ ID NO: 132692 - DNA, 22 bp, Artificial Sequence
  chemically synthesized
tctaacaaaacactatgtctat

SEQ ID NO: 132693 - DNA, 22 bp, Artificial Sequence
  chemically synthesized
ctaacaaaacactatgtctata

SEQ ID NO: 132694 - DNA, 22 bp, Artificial Sequence
  chemically synthesized
taacaaaacactatgtctatat

SEQ ID NO: 132695 - DNA, 22 bp, Artificial Sequence
  chemically synthesized
acaaaacactatgtctatatca

SEQ ID NO: 132696 - DNA, 22 bp, Artificial Sequence
  chemically synthesized
tgtctatatcatgattgtgaaa

SEQ ID NO: 132697 - DNA, 22 bp, Artificial Sequence
  chemically synthesized
tatcatgattgtgaaacataaa

SEQ ID NO: 132698 - DNA, 22 bp, Artificial Sequence
  chemically synthesized
tgaaacataaaataaaaatcaa

SEQ ID NO: 132699 - DNA, 22 bp, Artificial Sequence
  chemically synthesized
aaatgtatccaaatatgcaatt

SEQ ID NO: 132700 - DNA, 22 bp, Artificial Sequence
  chemically synthesized
aatgtatccaaatatgcaatta

SEQ ID NO: 132701 - DNA, 22 bp, Artificial Sequence
  chemically synthesized
agctaagcagcaggttaactat

SEQ ID NO: 132702 - DNA, 22 bp, Artificial Sequence
  chemically synthesized
agcagcaggttaactatgtaca

SEQ ID NO: 132703 - DNA, 22 bp, Artificial Sequence
  chemically synthesized
actatgtacaattattatctaa

SEQ ID NO: 132704 - DNA, 22 bp, Artificial Sequence
  chemically synthesized
tgtacaattattatctaattgc

SEQ ID NO: 132705 - DNA, 22 bp, Artificial Sequence
  chemically synthesized
ttatctaattgcatatatttgc

SEQ ID NO: 132706 - DNA, 22 bp, Artificial Sequence
  chemically synthesized
tctaattgcatatatttgcctt

SEQ ID NO: 132707 - DNA, 22 bp, Artificial Sequence
  chemically synthesized
attgcatatatttgccttcttt

SEQ ID NO: 132708 - DNA, 22 bp, Artificial Sequence
  chemically synthesized
catatatttgccttcttttttg

SEQ ID NO: 132709 - DNA, 22 bp, Artificial Sequence
  chemically synthesized
gccttcttttttgttactattg

SEQ ID NO: 132710 - DNA, 22 bp, Artificial Sequence
  chemically synthesized
ccttcttttttgttactattgg

SEQ ID NO: 132711 - DNA, 22 bp, Artificial Sequence
  chemically synthesized
cttttttgttactattggttca

SEQ ID NO: 132712 - DNA, 22 bp, Artificial Sequence
  chemically synthesized
ttttttgttactattggttcaa

SEQ ID NO: 132713 - DNA, 22 bp, Artificial Sequence
  chemically synthesized
ttttgttactattggttcaaac

SEQ ID NO: 132714 - DNA, 22 bp, Artificial Sequence
  chemically synthesized
tttgttactattggttcaaaca

SEQ ID NO: 132715 - DNA, 22 bp, Artificial Sequence
  chemically synthesized
ttgttactattggttcaaacat

SEQ ID NO: 132716 - DNA, 22 bp, Artificial Sequence
  chemically synthesized
tgttactattggttcaaacatt

SEQ ID NO: 132717 - DNA, 22 bp, Artificial Sequence
  chemically synthesized
gttactattggttcaaacattg

SEQ ID NO: 132718 - DNA, 22 bp, Artificial Sequence
  chemically synthesized
ttactattggttcaaacattgt

SEQ ID NO: 132719 - DNA, 22 bp, Artificial Sequence
  chemically synthesized
ctattggttcaaacattgtgca

SEQ ID NO: 132720 - DNA, 22 bp, Artificial Sequence
  chemically synthesized
ttggttcaaacattgtgcagca

SEQ ID NO: 132721 - DNA, 22 bp, Artificial Sequence
  chemically synthesized
gttcaaacattgtgcagcaagc

SEQ ID NO: 132722 - DNA, 22 bp, Artificial Sequence
  chemically synthesized
aaacattgtgcagcaagcacac

SEQ ID NO: 132723 - DNA, 22 bp, Artificial Sequence
  chemically synthesized
tgcagcaagcacaccacagagg

SEQ ID NO: 132724 - DNA, 22 bp, Artificial Sequence
  chemically synthesized
tttaaaatgtgttttttagatt

SEQ ID NO: 132725 - DNA, 22 bp, Artificial Sequence
  chemically synthesized
ttaaaatgtgttttttagatta

SEQ ID NO: 132726 - DNA, 22 bp, Artificial Sequence
  chemically synthesized
taaaatgtgttttttagattaa

SEQ ID NO: 132727 - DNA, 22 bp, Artificial Sequence
  chemically synthesized
aaaatgtgttttttagattaag

SEQ ID NO: 132728 - DNA, 22 bp, Artificial Sequence
  chemically synthesized
aaatgtgttttttagattaaga

SEQ ID NO: 132729 - DNA, 22 bp, Artificial Sequence
  chemically synthesized
tttagattaagaatgcttaact

SEQ ID NO: 132730 - DNA, 22 bp, Artificial Sequence
  chemically synthesized
ttagattaagaatgcttaacta

SEQ ID NO: 132731 - DNA, 22 bp, Artificial Sequence
  chemically synthesized
tagattaagaatgcttaactac

SEQ ID NO: 132732 - DNA, 22 bp, Artificial Sequence
  chemically synthesized
agattaagaatgcttaactact

SEQ ID NO: 132733 - DNA, 22 bp, Artificial Sequence
  chemically synthesized
gattaagaatgcttaactactt

SEQ ID NO: 132734 - DNA, 22 bp, Artificial Sequence
  chemically synthesized
agaatgcttaactacttaatta

SEQ ID NO: 132735 - DNA, 22 bp, Artificial Sequence
  chemically synthesized
aactacttaattattcataact

SEQ ID NO: 132736 - DNA, 22 bp, Artificial Sequence
  chemically synthesized
actacttaattattcataactg

SEQ ID NO: 132737 - DNA, 22 bp, Artificial Sequence
  chemically synthesized
cttaattattcataactgaaga

SEQ ID NO: 132738 - DNA, 22 bp, Artificial Sequence
  chemically synthesized
aattattcataactgaagaaat

SEQ ID NO: 132739 - DNA, 22 bp, Artificial Sequence
  chemically synthesized
attattcataactgaagaaatg

SEQ ID NO: 132740 - DNA, 22 bp, Artificial Sequence
  chemically synthesized
ttcataactgaagaaatgatca

SEQ ID NO: 132741 - DNA, 22 bp, Artificial Sequence
  chemically synthesized
ataactgaagaaatgatcatca

SEQ ID NO: 132742 - DNA, 22 bp, Artificial Sequence
  chemically synthesized
aagaaatgatcatcattcctta

SEQ ID NO: 132743 - DNA, 22 bp, Artificial Sequence
  chemically synthesized
cttatctctagcacagtctata

SEQ ID NO: 132744 - DNA, 22 bp, Artificial Sequence
  chemically synthesized
atctctagcacagtctataaat

SEQ ID NO: 132745 - DNA, 22 bp, Artificial Sequence
  chemically synthesized
tctctagcacagtctataaatg

SEQ ID NO: 132746 - DNA, 22 bp, Artificial Sequence
  chemically synthesized
tagcacagtctataaatgtatt

SEQ ID NO: 132747 - DNA, 22 bp, Artificial Sequence
  chemically synthesized
gcacagtctataaatgtattgc

SEQ ID NO: 132748 - DNA, 22 bp, Artificial Sequence
  chemically synthesized
taaatgtattgctcttctataa

SEQ ID NO: 132749 - DNA, 22 bp, Artificial Sequence
  chemically synthesized
ctcttctataagaaaattgttg

SEQ ID NO: 132750 - DNA, 22 bp, Artificial Sequence
  chemically synthesized
ttctataagaaaattgttgcac

SEQ ID NO: 132751 - DNA, 22 bp, Artificial Sequence
  chemically synthesized
ctataagaaaattgttgcacat

SEQ ID NO: 132752 - DNA, 22 bp, Artificial Sequence
  chemically synthesized
tataagaaaattgttgcacatt

SEQ ID NO: 132753 - DNA, 22 bp, Artificial Sequence
  chemically synthesized
taagaaaattgttgcacattca

SEQ ID NO: 132754 - DNA, 22 bp, Artificial Sequence
  chemically synthesized
ttgcacattcatgcatatacca

SEQ ID NO: 132755 - DNA, 22 bp, Artificial Sequence
  chemically synthesized
cacattcatgcatataccaata

SEQ ID NO: 132756 - DNA, 22 bp, Artificial Sequence
  chemically synthesized
atgcatataccaataaattatt

SEQ ID NO: 132757 - DNA, 22 bp, Artificial Sequence
  chemically synthesized
ttgctaaatatgaatattagga

SEQ ID NO: 132758 - DNA, 22 bp, Artificial Sequence
  chemically synthesized
ctaaatatgaatattaggattg

SEQ ID NO: 132759 - DNA, 22 bp, Artificial Sequence
  chemically synthesized
aatatgaatattaggattgagg

SEQ ID NO: 132760 - DNA, 22 bp, Artificial Sequence
  chemically synthesized
ggattgaggctgcagaaataca

SEQ ID NO: 132761 - DNA, 22 bp, Artificial Sequence
  chemically synthesized
aggctgcagaaatacagtttca

SEQ ID NO: 132762 - DNA, 22 bp, Artificial Sequence
  chemically synthesized
cagaaatacagtttcacaagaa

SEQ ID NO: 132763 - DNA, 22 bp, Artificial Sequence
  chemically synthesized
cacaagaaggtagtaaaaactg

SEQ ID NO: 132764 - DNA, 22 bp, Artificial Sequence
  chemically synthesized
acaagaaggtagtaaaaactga

SEQ ID NO: 132765 - DNA, 22 bp, Artificial Sequence
  chemically synthesized
ataaggcagggatttcagtgta

SEQ ID NO: 132766 - DNA, 22 bp, Artificial Sequence
  chemically synthesized
cagtgtaatagtttctataaag

SEQ ID NO: 132767 - DNA, 22 bp, Artificial Sequence
  chemically synthesized
agtgtaatagtttctataaagc

SEQ ID NO: 132768 - DNA, 22 bp, Artificial Sequence
  chemically synthesized
ctataaagctacttgccacttg

SEQ ID NO: 132769 - DNA, 22 bp, Artificial Sequence
  chemically synthesized
tataaagctacttgccacttgt

SEQ ID NO: 132770 - DNA, 22 bp, Artificial Sequence
  chemically synthesized
taaagctacttgccacttgtga

SEQ ID NO: 132771 - DNA, 22 bp, Artificial Sequence
  chemically synthesized
cttgccacttgtgaacacacaa

SEQ ID NO: 132772 - DNA, 22 bp, Artificial Sequence
  chemically synthesized
gccacttgtgaacacacaatgc

SEQ ID NO: 132773 - DNA, 22 bp, Artificial Sequence
  chemically synthesized
ccacttgtgaacacacaatgcg

SEQ ID NO: 132774 - DNA, 22 bp, Artificial Sequence
  chemically synthesized
gtgaacacacaatgcggctcct

SEQ ID NO: 132775 - DNA, 22 bp, Artificial Sequence
  chemically synthesized
tgaacacacaatgcggctcctt

SEQ ID NO: 132776 - DNA, 22 bp, Artificial Sequence
  chemically synthesized
cttttttgctgcctggcttttc

SEQ ID NO: 132777 - DNA, 22 bp, Artificial Sequence
  chemically synthesized
ttttgctgcctggcttttcagt

SEQ ID NO: 132778 - DNA, 22 bp, Artificial Sequence
  chemically synthesized
tttgctgcctggcttttcagta

SEQ ID NO: 132779 - DNA, 22 bp, Artificial Sequence
  chemically synthesized
ttgctgcctggcttttcagtac

SEQ ID NO: 132780 - DNA, 22 bp, Artificial Sequence
  chemically synthesized
tgctgcctggcttttcagtact

SEQ ID NO: 132781 - DNA, 22 bp, Artificial Sequence
  chemically synthesized
gctgcctggcttttcagtactg

SEQ ID NO: 132782 - DNA, 22 bp, Artificial Sequence
  chemically synthesized
ctgcctggcttttcagtactgg

SEQ ID NO: 132783 - DNA, 22 bp, Artificial Sequence
  chemically synthesized
cctggcttttcagtactggagg

SEQ ID NO: 132784 - DNA, 22 bp, Artificial Sequence
  chemically synthesized
gcttttcagtactggaggcaac

SEQ ID NO: 132785 - DNA, 22 bp, Artificial Sequence
  chemically synthesized
ttcagtactggaggcaacttat

SEQ ID NO: 132786 - DNA, 22 bp, Artificial Sequence
  chemically synthesized
tcagtactggaggcaacttatc

SEQ ID NO: 132787 - DNA, 22 bp, Artificial Sequence
  chemically synthesized
cagtactggaggcaacttatca

SEQ ID NO: 132788 - DNA, 22 bp, Artificial Sequence
  chemically synthesized
agtactggaggcaacttatcac

SEQ ID NO: 132789 - DNA, 22 bp, Artificial Sequence
  chemically synthesized
gaggcaacttatcactcgatct

SEQ ID NO: 132790 - DNA, 22 bp, Artificial Sequence
  chemically synthesized
atcactcgatctccatcccctt

SEQ ID NO: 132791 - DNA, 22 bp, Artificial Sequence
  chemically synthesized
tcactcgatctccatccccttc

SEQ ID NO: 132792 - DNA, 22 bp, Artificial Sequence
  chemically synthesized
gatctccatccccttctttgct

SEQ ID NO: 132793 - DNA, 22 bp, Artificial Sequence
  chemically synthesized
catccccttctttgctgtttat

SEQ ID NO: 132794 - DNA, 22 bp, Artificial Sequence
  chemically synthesized
ctttgctgtttatgtgtgcgtc

SEQ ID NO: 132795 - DNA, 22 bp, Artificial Sequence
  chemically synthesized
tttgctgtttatgtgtgcgtcc

SEQ ID NO: 132796 - DNA, 22 bp, Artificial Sequence
  chemically synthesized
tgctgtttatgtgtgcgtcctt

SEQ ID NO: 132797 - DNA, 22 bp, Artificial Sequence
  chemically synthesized
gctgtttatgtgtgcgtccttc

SEQ ID NO: 132798 - DNA, 22 bp, Artificial Sequence
  chemically synthesized
ctgtttatgtgtgcgtccttct

SEQ ID NO: 132799 - DNA, 22 bp, Artificial Sequence
  chemically synthesized
tttatgtgtgcgtccttcttgg

SEQ ID NO: 132800 - DNA, 22 bp, Artificial Sequence
  chemically synthesized
atgtgtgcgtccttcttggcaa

SEQ ID NO: 132801 - DNA, 22 bp, Artificial Sequence
  chemically synthesized
tgtgtgcgtccttcttggcaat

SEQ ID NO: 132802 - DNA, 22 bp, Artificial Sequence
  chemically synthesized
cttggcaatggcaagctcctct

SEQ ID NO: 132803 - DNA, 22 bp, Artificial Sequence
  chemically synthesized
ttggcaatggcaagctcctcta

SEQ ID NO: 132804 - DNA, 22 bp, Artificial Sequence
  chemically synthesized
ggcaatggcaagctcctctacc

SEQ ID NO: 132805 - DNA, 22 bp, Artificial Sequence
  chemically synthesized
gcaatggcaagctcctctacct

SEQ ID NO: 132806 - DNA, 22 bp, Artificial Sequence
  chemically synthesized
ctctacctcatcaagcatgacc

SEQ ID NO: 132807 - DNA, 22 bp, Artificial Sequence
  chemically synthesized
tacctcatcaagcatgaccaca

SEQ ID NO: 132808 - DNA, 22 bp, Artificial Sequence
  chemically synthesized
cctcatcaagcatgaccacagt

SEQ ID NO: 132809 - DNA, 22 bp, Artificial Sequence
  chemically synthesized
atcaagcatgaccacagtcttc

SEQ ID NO: 132810 - DNA, 22 bp, Artificial Sequence
  chemically synthesized
cacgaacccatgtactgtttcc

SEQ ID NO: 132811 - DNA, 22 bp, Artificial Sequence
  chemically synthesized
acgaacccatgtactgtttcct

SEQ ID NO: 132812 - DNA, 22 bp, Artificial Sequence
  chemically synthesized
tttccttgccacactgaggcaa

SEQ ID NO: 132813 - DNA, 22 bp, Artificial Sequence
  chemically synthesized
ccttgccacactgaggcaagac

SEQ ID NO: 132814 - DNA, 22 bp, Artificial Sequence
  chemically synthesized
cttgccacactgaggcaagacc

SEQ ID NO: 132815 - DNA, 22 bp, Artificial Sequence
  chemically synthesized
gccacactgaggcaagacctca

SEQ ID NO: 132816 - DNA, 22 bp, Artificial Sequence
  chemically synthesized
ccacactgaggcaagacctcat

SEQ ID NO: 132817 - DNA, 22 bp, Artificial Sequence
  chemically synthesized
aggcaagacctcatggtgaaat

SEQ ID NO: 132818 - DNA, 22 bp, Artificial Sequence
  chemically synthesized
atggtgaaattgaccatgatgc

SEQ ID NO: 132819 - DNA, 22 bp, Artificial Sequence
  chemically synthesized
accatgatgcccactgtaatgg

SEQ ID NO: 132820 - DNA, 22 bp, Artificial Sequence
  chemically synthesized
taatgggcgtcttgtggatgaa

SEQ ID NO: 132821 - DNA, 22 bp, Artificial Sequence
  chemically synthesized
gtggatgaatcacaaagaggtt

SEQ ID NO: 132822 - DNA, 22 bp, Artificial Sequence
  chemically synthesized
tggatgaatcacaaagaggtta

SEQ ID NO: 132823 - DNA, 22 bp, Artificial Sequence
  chemically synthesized
tccatggggcctgcttcttgca

SEQ ID NO: 132824 - DNA, 22 bp, Artificial Sequence
  chemically synthesized
cttcttgcaggtttacattatc

SEQ ID NO: 132825 - DNA, 22 bp, Artificial Sequence
  chemically synthesized
cttgcaggtttacattatccac

SEQ ID NO: 132826 - DNA, 22 bp, Artificial Sequence
  chemically synthesized
ttgcaggtttacattatccact

SEQ ID NO: 132827 - DNA, 22 bp, Artificial Sequence
  chemically synthesized
gcaggtttacattatccactcc

SEQ ID NO: 132828 - DNA, 22 bp, Artificial Sequence
  chemically synthesized
caggtttacattatccactccc

SEQ ID NO: 132829 - DNA, 22 bp, Artificial Sequence
  chemically synthesized
acattatccactcccattatcc

SEQ ID NO: 132830 - DNA, 22 bp, Artificial Sequence
  chemically synthesized
cattatccactcccattatcca

SEQ ID NO: 132831 - DNA, 22 bp, Artificial Sequence
  chemically synthesized
tccactcccattatccacttgc

SEQ ID NO: 132832 - DNA, 22 bp, Artificial Sequence
  chemically synthesized
ccattatccacttgcagaatca

SEQ ID NO: 132833 - DNA, 22 bp, Artificial Sequence
  chemically synthesized
tccacttgcagaatcaggtatt

SEQ ID NO: 132834 - DNA, 22 bp, Artificial Sequence
  chemically synthesized
gcagaatcaggtattctcctgt

SEQ ID NO: 132835 - DNA, 22 bp, Artificial Sequence
  chemically synthesized
cagaatcaggtattctcctgtc

SEQ ID NO: 132836 - DNA, 22 bp, Artificial Sequence
  chemically synthesized
tcctgtcaatggcctatgaccg

SEQ ID NO: 132837 - DNA, 22 bp, Artificial Sequence
  chemically synthesized
ctgtcaatggcctatgaccgtt

SEQ ID NO: 132838 - DNA, 22 bp, Artificial Sequence
  chemically synthesized
tcaatggcctatgaccgtttca

SEQ ID NO: 132839 - DNA, 22 bp, Artificial Sequence
  chemically synthesized
tgaccgtttcattatcatccac

SEQ ID NO: 132840 - DNA, 22 bp, Artificial Sequence
  chemically synthesized
cattatcatccacatgcttctc

SEQ ID NO: 132841 - DNA, 22 bp, Artificial Sequence
  chemically synthesized
attatcatccacatgcttctca

SEQ ID NO: 132842 - DNA, 22 bp, Artificial Sequence
  chemically synthesized
tcatccacatgcttctcaggta

SEQ ID NO: 132843 - DNA, 22 bp, Artificial Sequence
  chemically synthesized
ctcaggtataactatttctact

SEQ ID NO: 132844 - DNA, 22 bp, Artificial Sequence
  chemically synthesized
tcaggtataactatttctacta

SEQ ID NO: 132845 - DNA, 22 bp, Artificial Sequence
  chemically synthesized
aggtataactatttctactaaa

SEQ ID NO: 132846 - DNA, 22 bp, Artificial Sequence
  chemically synthesized
tttctactaaatcttgggtgaa

SEQ ID NO: 132847 - DNA, 22 bp, Artificial Sequence
  chemically synthesized
ctactaaatcttgggtgaagat

SEQ ID NO: 132848 - DNA, 22 bp, Artificial Sequence
  chemically synthesized
tactaaatcttgggtgaagata

SEQ ID NO: 132849 - DNA, 22 bp, Artificial Sequence
  chemically synthesized
ctaaatcttgggtgaagataga

SEQ ID NO: 132850 - DNA, 22 bp, Artificial Sequence
  chemically synthesized
aatcttgggtgaagatagaact

SEQ ID NO: 132851 - DNA, 22 bp, Artificial Sequence
  chemically synthesized
gggtgaagatagaactgtggct

SEQ ID NO: 132852 - DNA, 22 bp, Artificial Sequence
  chemically synthesized
ggtgaagatagaactgtggcta

SEQ ID NO: 132853 - DNA, 22 bp, Artificial Sequence
  chemically synthesized
tggctatttatgagggactttt

SEQ ID NO: 132854 - DNA, 22 bp, Artificial Sequence
  chemically synthesized
tttatgagggactttttatccc

SEQ ID NO: 132855 - DNA, 22 bp, Artificial Sequence
  chemically synthesized
atgagggactttttatccctcg

SEQ ID NO: 132856 - DNA, 22 bp, Artificial Sequence
  chemically synthesized
tgagggactttttatccctcgt

SEQ ID NO: 132857 - DNA, 22 bp, Artificial Sequence
  chemically synthesized
tttatccctcgtgcctccaatt

SEQ ID NO: 132858 - DNA, 22 bp, Artificial Sequence
  chemically synthesized
ttatccctcgtgcctccaattc

SEQ ID NO: 132859 - DNA, 22 bp, Artificial Sequence
  chemically synthesized
tatccctcgtgcctccaattct

SEQ ID NO: 132860 - DNA, 22 bp, Artificial Sequence
  chemically synthesized
atccctcgtgcctccaattctg

SEQ ID NO: 132861 - DNA, 22 bp, Artificial Sequence
  chemically synthesized
tccctcgtgcctccaattctgc

SEQ ID NO: 132862 - DNA, 22 bp, Artificial Sequence
  chemically synthesized
gtgcctccaattctgccactcc

SEQ ID NO: 132863 - DNA, 22 bp, Artificial Sequence
  chemically synthesized
caattctgccactccattgctt

SEQ ID NO: 132864 - DNA, 22 bp, Artificial Sequence
  chemically synthesized
tgccactccattgcttcccata

SEQ ID NO: 132865 - DNA, 22 bp, Artificial Sequence
  chemically synthesized
ccactccattgcttcccatatt

SEQ ID NO: 132866 - DNA, 22 bp, Artificial Sequence
  chemically synthesized
cattgcttcccatattgtcatt

SEQ ID NO: 132867 - DNA, 22 bp, Artificial Sequence
  chemically synthesized
cttcccatattgtcattcccat

SEQ ID NO: 132868 - DNA, 22 bp, Artificial Sequence
  chemically synthesized
cccatattgtcattcccatgtt

SEQ ID NO: 132869 - DNA, 22 bp, Artificial Sequence
  chemically synthesized
ccatattgtcattcccatgttc

SEQ ID NO: 132870 - DNA, 22 bp, Artificial Sequence
  chemically synthesized
tcattcccatgttctcttccac

SEQ ID NO: 132871 - DNA, 22 bp, Artificial Sequence
  chemically synthesized
ccatgttctcttccacaccttt

SEQ ID NO: 132872 - DNA, 22 bp, Artificial Sequence
  chemically synthesized
tcttccacaccttttttctcca

SEQ ID NO: 132873 - DNA, 22 bp, Artificial Sequence
  chemically synthesized
ttccacaccttttttctccatc

SEQ ID NO: 132874 - DNA, 22 bp, Artificial Sequence
  chemically synthesized
ccacaccttttttctccatcaa

SEQ ID NO: 132875 - DNA, 22 bp, Artificial Sequence
  chemically synthesized
cacaccttttttctccatcaag

SEQ ID NO: 132876 - DNA, 22 bp, Artificial Sequence
  chemically synthesized
ttttctccatcaagatgtcctg

SEQ ID NO: 132877 - DNA, 22 bp, Artificial Sequence
  chemically synthesized
tttctccatcaagatgtcctga

SEQ ID NO: 132878 - DNA, 22 bp, Artificial Sequence
  chemically synthesized
ttctccatcaagatgtcctgaa

SEQ ID NO: 132879 - DNA, 22 bp, Artificial Sequence
  chemically synthesized
tctccatcaagatgtcctgaaa

SEQ ID NO: 132880 - DNA, 22 bp, Artificial Sequence
  chemically synthesized
ctccatcaagatgtcctgaaac

SEQ ID NO: 132881 - DNA, 22 bp, Artificial Sequence
  chemically synthesized
tccatcaagatgtcctgaaact

SEQ ID NO: 132882 - DNA, 22 bp, Artificial Sequence
  chemically synthesized
catcaagatgtcctgaaacttg

SEQ ID NO: 132883 - DNA, 22 bp, Artificial Sequence
  chemically synthesized
aaacttgcctgtgctgatatta

SEQ ID NO: 132884 - DNA, 22 bp, Artificial Sequence
  chemically synthesized
gcctgtgctgatattacattca

SEQ ID NO: 132885 - DNA, 22 bp, Artificial Sequence
  chemically synthesized
cctgtgctgatattacattcaa

SEQ ID NO: 132886 - DNA, 22 bp, Artificial Sequence
  chemically synthesized
tgctgatattacattcaatcac

SEQ ID NO: 132887 - DNA, 22 bp, Artificial Sequence
  chemically synthesized
atattacattcaatcacttata

SEQ ID NO: 132888 - DNA, 22 bp, Artificial Sequence
  chemically synthesized
cattcaatcacttatacccagc

SEQ ID NO: 132889 - DNA, 22 bp, Artificial Sequence
  chemically synthesized
aatcacttatacccagctattc

SEQ ID NO: 132890 - DNA, 22 bp, Artificial Sequence
  chemically synthesized
atacccagctattctggttgct

SEQ ID NO: 132891 - DNA, 22 bp, Artificial Sequence
  chemically synthesized
tacccagctattctggttgctt

SEQ ID NO: 132892 - DNA, 22 bp, Artificial Sequence
  chemically synthesized
ttctggttgctttgattttctt

SEQ ID NO: 132893 - DNA, 22 bp, Artificial Sequence
  chemically synthesized
tggttgctttgattttcttcct

SEQ ID NO: 132894 - DNA, 22 bp, Artificial Sequence
  chemically synthesized
gttgctttgattttcttcctag

SEQ ID NO: 132895 - DNA, 22 bp, Artificial Sequence
  chemically synthesized
ctttgattttcttcctagacgc

SEQ ID NO: 132896 - DNA, 22 bp, Artificial Sequence
  chemically synthesized
tgattttcttcctagacgctct

SEQ ID NO: 132897 - DNA, 22 bp, Artificial Sequence
  chemically synthesized
gattttcttcctagacgctctg

SEQ ID NO: 132898 - DNA, 22 bp, Artificial Sequence
  chemically synthesized
attttcttcctagacgctctga

SEQ ID NO: 132899 - DNA, 22 bp, Artificial Sequence
  chemically synthesized
tcttcctagacgctctgatcat

SEQ ID NO: 132900 - DNA, 22 bp, Artificial Sequence
  chemically synthesized
cttcctagacgctctgatcatt

SEQ ID NO: 132901 - DNA, 22 bp, Artificial Sequence
  chemically synthesized
ttcctagacgctctgatcattg

SEQ ID NO: 132902 - DNA, 22 bp, Artificial Sequence
  chemically synthesized
cctagacgctctgatcattgtc

SEQ ID NO: 132903 - DNA, 22 bp, Artificial Sequence
  chemically synthesized
ctagacgctctgatcattgtct

SEQ ID NO: 132904 - DNA, 22 bp, Artificial Sequence
  chemically synthesized
gacgctctgatcattgtctttt

SEQ ID NO: 132905 - DNA, 22 bp, Artificial Sequence
  chemically synthesized
tgatcattgtcttttcttatat

SEQ ID NO: 132906 - DNA, 22 bp, Artificial Sequence
  chemically synthesized
atcattgtcttttcttatatcc

SEQ ID NO: 132907 - DNA, 22 bp, Artificial Sequence
  chemically synthesized
tcttttcttatatcctgatcct

SEQ ID NO: 132908 - DNA, 22 bp, Artificial Sequence
  chemically synthesized
ttcttatatcctgatccttaaa

SEQ ID NO: 132909 - DNA, 22 bp, Artificial Sequence
  chemically synthesized
tcttatatcctgatccttaaaa

SEQ ID NO: 132910 - DNA, 22 bp, Artificial Sequence
  chemically synthesized
cttatatcctgatccttaaaac

SEQ ID NO: 132911 - DNA, 22 bp, Artificial Sequence
  chemically synthesized
ttatatcctgatccttaaaaca

SEQ ID NO: 132912 - DNA, 22 bp, Artificial Sequence
  chemically synthesized
atatcctgatccttaaaacagt

SEQ ID NO: 132913 - DNA, 22 bp, Artificial Sequence
  chemically synthesized
tatcctgatccttaaaacagtt

SEQ ID NO: 132914 - DNA, 22 bp, Artificial Sequence
  chemically synthesized
atccttaaaacagttaaaggta

SEQ ID NO: 132915 - DNA, 22 bp, Artificial Sequence
  chemically synthesized
aaaacagttaaaggtattgcct

SEQ ID NO: 132916 - DNA, 22 bp, Artificial Sequence
  chemically synthesized
aaacagttaaaggtattgcctc

SEQ ID NO: 132917 - DNA, 22 bp, Artificial Sequence
  chemically synthesized
aaggtattgcctccagaaaaga

SEQ ID NO: 132918 - DNA, 22 bp, Artificial Sequence
  chemically synthesized
cctccagaaaagagcaagccaa

SEQ ID NO: 132919 - DNA, 22 bp, Artificial Sequence
  chemically synthesized
cagaaaagagcaagccaaagct

SEQ ID NO: 132920 - DNA, 22 bp, Artificial Sequence
  chemically synthesized
tcaacatgtgtgtctcccatat

SEQ ID NO: 132921 - DNA, 22 bp, Artificial Sequence
  chemically synthesized
aacatgtgtgtctcccatatca

SEQ ID NO: 132922 - DNA, 22 bp, Artificial Sequence
  chemically synthesized
ccatatcagctgtgtcttggta

SEQ ID NO: 132923 - DNA, 22 bp, Artificial Sequence
  chemically synthesized
tgtcttggtatttcacatcacc

SEQ ID NO: 132924 - DNA, 22 bp, Artificial Sequence
  chemically synthesized
ggtatttcacatcaccgtgatc

SEQ ID NO: 132925 - DNA, 22 bp, Artificial Sequence
  chemically synthesized
gtatttcacatcaccgtgatca

SEQ ID NO: 132926 - DNA, 22 bp, Artificial Sequence
  chemically synthesized
cacatcaccgtgatcagtgaga

SEQ ID NO: 132927 - DNA, 22 bp, Artificial Sequence
  chemically synthesized
acatcaccgtgatcagtgagac

SEQ ID NO: 132928 - DNA, 22 bp, Artificial Sequence
  chemically synthesized
tcattcacaggtttgggaaaca

SEQ ID NO: 132929 - DNA, 22 bp, Artificial Sequence
  chemically synthesized
cattcacaggtttgggaaacat

SEQ ID NO: 132930 - DNA, 22 bp, Artificial Sequence
  chemically synthesized
attcacaggtttgggaaacatg

SEQ ID NO: 132931 - DNA, 22 bp, Artificial Sequence
  chemically synthesized
acaggtttgggaaacatgcacc

SEQ ID NO: 132932 - DNA, 22 bp, Artificial Sequence
  chemically synthesized
gggaaacatgcaccacatgtgg

SEQ ID NO: 132933 - DNA, 22 bp, Artificial Sequence
  chemically synthesized
ggaaacatgcaccacatgtggt

SEQ ID NO: 132934 - DNA, 22 bp, Artificial Sequence
  chemically synthesized
ccgtgagctaatgactcatttc

SEQ ID NO: 132935 - DNA, 22 bp, Artificial Sequence
  chemically synthesized
atgactcatttctttttcctcc

SEQ ID NO: 132936 - DNA, 22 bp, Artificial Sequence
  chemically synthesized
atttctttttcctccattcatg

SEQ ID NO: 132937 - DNA, 22 bp, Artificial Sequence
  chemically synthesized
ctttttcctccattcatgaacc

SEQ ID NO: 132938 - DNA, 22 bp, Artificial Sequence
  chemically synthesized
tttttcctccattcatgaaccc

SEQ ID NO: 132939 - DNA, 22 bp, Artificial Sequence
  chemically synthesized
tttcctccattcatgaacccta

SEQ ID NO: 132940 - DNA, 22 bp, Artificial Sequence
  chemically synthesized
ttcctccattcatgaaccctat

SEQ ID NO: 132941 - DNA, 22 bp, Artificial Sequence
  chemically synthesized
tcctccattcatgaaccctatt

SEQ ID NO: 132942 - DNA, 22 bp, Artificial Sequence
  chemically synthesized
cctccattcatgaaccctatta

SEQ ID NO: 132943 - DNA, 22 bp, Artificial Sequence
  chemically synthesized
ctccattcatgaaccctattat

SEQ ID NO: 132944 - DNA, 22 bp, Artificial Sequence
  chemically synthesized
cattcatgaaccctattatata

SEQ ID NO: 132945 - DNA, 22 bp, Artificial Sequence
  chemically synthesized
atgaaccctattatatacagca

SEQ ID NO: 132946 - DNA, 22 bp, Artificial Sequence
  chemically synthesized
ttatatacagcatcaaaccaag

SEQ ID NO: 132947 - DNA, 22 bp, Artificial Sequence
  chemically synthesized
tatacagcatcaaaccaagcag

SEQ ID NO: 132948 - DNA, 22 bp, Artificial Sequence
  chemically synthesized
ttcgcctattttctgggcacag

SEQ ID NO: 132949 - DNA, 22 bp, Artificial Sequence
  chemically synthesized
gcctattttctgggcacagaat

SEQ ID NO: 132950 - DNA, 22 bp, Artificial Sequence
  chemically synthesized
ttttctgggcacagaatggctt

SEQ ID NO: 132951 - DNA, 22 bp, Artificial Sequence
  chemically synthesized
tctgggcacagaatggcttgag

SEQ ID NO: 132952 - DNA, 22 bp, Artificial Sequence
  chemically synthesized
ctgggcacagaatggcttgagc

SEQ ID NO: 132953 - DNA, 22 bp, Artificial Sequence
  chemically synthesized
tgggcacagaatggcttgagcc

SEQ ID NO: 132954 - DNA, 22 bp, Artificial Sequence
  chemically synthesized
ggcacagaatggcttgagccct

SEQ ID NO: 132955 - DNA, 22 bp, Artificial Sequence
  chemically synthesized
gagcccttttttcagaattttg

SEQ ID NO: 132956 - DNA, 22 bp, Artificial Sequence
  chemically synthesized
agcccttttttcagaattttgt

SEQ ID NO: 132957 - DNA, 22 bp, Artificial Sequence
  chemically synthesized
ttttcagaattttgtgatcttc

SEQ ID NO: 132958 - DNA, 22 bp, Artificial Sequence
  chemically synthesized
tttcagaattttgtgatcttca

SEQ ID NO: 132959 - DNA, 22 bp, Artificial Sequence
  chemically synthesized
ttcagaattttgtgatcttcat

SEQ ID NO: 132960 - DNA, 22 bp, Artificial Sequence
  chemically synthesized
tcagaattttgtgatcttcatg

SEQ ID NO: 132961 - DNA, 22 bp, Artificial Sequence
  chemically synthesized
cagaattttgtgatcttcatga

SEQ ID NO: 132962 - DNA, 22 bp, Artificial Sequence
  chemically synthesized
agaattttgtgatcttcatgat

SEQ ID NO: 132963 - DNA, 22 bp, Artificial Sequence
  chemically synthesized
tgtgatcttcatgatttctggg

SEQ ID NO: 132964 - DNA, 22 bp, Artificial Sequence
  chemically synthesized
gtgatcttcatgatttctgggc

SEQ ID NO: 132965 - DNA, 22 bp, Artificial Sequence
  chemically synthesized
tgatcttcatgatttctgggcc

SEQ ID NO: 132966 - DNA, 22 bp, Artificial Sequence
  chemically synthesized
catgatttctgggccttttgag

SEQ ID NO: 132967 - DNA, 22 bp, Artificial Sequence
  chemically synthesized
atgatttctgggccttttgagt

SEQ ID NO: 132968 - DNA, 22 bp, Artificial Sequence
  chemically synthesized
ctgggccttttgagtaattgga

SEQ ID NO: 132969 - DNA, 22 bp, Artificial Sequence
  chemically synthesized
tgggccttttgagtaattggaa

SEQ ID NO: 132970 - DNA, 22 bp, Artificial Sequence
  chemically synthesized
ggccttttgagtaattggaaag

SEQ ID NO: 132971 - DNA, 22 bp, Artificial Sequence
  chemically synthesized
ttgagtaattggaaaggagctt

SEQ ID NO: 132972 - DNA, 22 bp, Artificial Sequence
  chemically synthesized
tgagtaattggaaaggagctta

SEQ ID NO: 132973 - DNA, 22 bp, Artificial Sequence
  chemically synthesized
gagtaattggaaaggagcttat

SEQ ID NO: 132974 - DNA, 22 bp, Artificial Sequence
  chemically synthesized
agtaattggaaaggagcttatt

SEQ ID NO: 132975 - DNA, 22 bp, Artificial Sequence
  chemically synthesized
gaaaggagcttattttataccc

SEQ ID NO: 132976 - DNA, 22 bp, Artificial Sequence
  chemically synthesized
attttatacccaatatctcttg

SEQ ID NO: 132977 - DNA, 22 bp, Artificial Sequence
  chemically synthesized
ttttatacccaatatctcttgt

SEQ ID NO: 132978 - DNA, 22 bp, Artificial Sequence
  chemically synthesized
tatacccaatatctcttgtatc

SEQ ID NO: 132979 - DNA, 22 bp, Artificial Sequence
  chemically synthesized
atacccaatatctcttgtatca

SEQ ID NO: 132980 - DNA, 22 bp, Artificial Sequence
  chemically synthesized
tacccaatatctcttgtatcag

SEQ ID NO: 132981 - DNA, 22 bp, Artificial Sequence
  chemically synthesized
ttgtatcagtgttagataggct

SEQ ID NO: 132982 - DNA, 22 bp, Artificial Sequence
  chemically synthesized
gtatcagtgttagataggcttt

SEQ ID NO: 132983 - DNA, 22 bp, Artificial Sequence
  chemically synthesized
tatcagtgttagataggcttta

SEQ ID NO: 132984 - DNA, 22 bp, Artificial Sequence
  chemically synthesized
gataggctttaactattatcta

SEQ ID NO: 132985 - DNA, 22 bp, Artificial Sequence
  chemically synthesized
taactattatctaaagtgaaaa

SEQ ID NO: 132986 - DNA, 22 bp, Artificial Sequence
  chemically synthesized
aactattatctaaagtgaaaag

SEQ ID NO: 132987 - DNA, 22 bp, Artificial Sequence
  chemically synthesized
actattatctaaagtgaaaagc

SEQ ID NO: 132988 - DNA, 22 bp, Artificial Sequence
  chemically synthesized
ttatctaaagtgaaaagctaca

SEQ ID NO: 132989 - DNA, 22 bp, Artificial Sequence
  chemically synthesized
tctaaagtgaaaagctacatgg

SEQ ID NO: 132990 - DNA, 22 bp, Artificial Sequence
  chemically synthesized
aagtgaaaagctacatggaaca

SEQ ID NO: 132991 - DNA, 22 bp, Artificial Sequence
  chemically synthesized
catggaacaataatacaatgaa

SEQ ID NO: 132992 - DNA, 22 bp, Artificial Sequence
  chemically synthesized
atcaattgataaatacataaat

SEQ ID NO: 132993 - DNA, 22 bp, Artificial Sequence
  chemically synthesized
ataaatacataaatatatgtat

SEQ ID NO: 132994 - DNA, 22 bp, Artificial Sequence
  chemically synthesized
atatgtagatgtaaagctttat

SEQ ID NO: 132995 - DNA, 22 bp, Artificial Sequence
  chemically synthesized
tatcgagggagatatatctata

SEQ ID NO: 132996 - DNA, 22 bp, Artificial Sequence
  chemically synthesized
atcgagggagatatatctataa

SEQ ID NO: 132997 - DNA, 22 bp, Artificial Sequence
  chemically synthesized
tcgagggagatatatctataat

SEQ ID NO: 132998 - DNA, 22 bp, Artificial Sequence
  chemically synthesized
taatttacctatctattgagag

SEQ ID NO: 132999 - DNA, 22 bp, Artificial Sequence
  chemically synthesized
acctatctattgagagatacta

SEQ ID NO: 133000 - DNA, 22 bp, Artificial Sequence
  chemically synthesized
cctatctattgagagatactag

SEQ ID NO: 133001 - DNA, 22 bp, Artificial Sequence
  chemically synthesized
tctattgagagatactaggaaa

SEQ ID NO: 133002 - DNA, 22 bp, Artificial Sequence
  chemically synthesized
ttgagagatactaggaaagtgg

SEQ ID NO: 133003 - DNA, 22 bp, Artificial Sequence
  chemically synthesized
agagatactaggaaagtggaat

SEQ ID NO: 133004 - DNA, 22 bp, Artificial Sequence
  chemically synthesized
ggaaagtggaatactattgaat

SEQ ID NO: 133005 - DNA, 22 bp, Artificial Sequence
  chemically synthesized
ttgaatatggagataaaacatg

SEQ ID NO: 133006 - DNA, 22 bp, Artificial Sequence
  chemically synthesized
aatatggagataaaacatgtag

SEQ ID NO: 133007 - DNA, 22 bp, Artificial Sequence
  chemically synthesized
ataatcagggaaaatatggtta

SEQ ID NO: 133008 - DNA, 22 bp, Artificial Sequence
  chemically synthesized
ttcataacctgtattcataaga

SEQ ID NO: 133009 - DNA, 22 bp, Artificial Sequence
  chemically synthesized
ataacctgtattcataagaact

SEQ ID NO: 133010 - DNA, 22 bp, Artificial Sequence
  chemically synthesized
tattcataagaactgaaagtac

SEQ ID NO: 133011 - DNA, 22 bp, Artificial Sequence
  chemically synthesized
ataagaactgaaagtaccattt

SEQ ID NO: 133012 - DNA, 22 bp, Artificial Sequence
  chemically synthesized
aaagtaccattttaggaagagt

SEQ ID NO: 133013 - DNA, 22 bp, Artificial Sequence
  chemically synthesized
taggaagagtcaagtggccagt

SEQ ID NO: 133014 - DNA, 22 bp, Artificial Sequence
  chemically synthesized
aggaagagtcaagtggccagtc

SEQ ID NO: 133015 - DNA, 22 bp, Artificial Sequence
  chemically synthesized
ggaagagtcaagtggccagtct

SEQ ID NO: 133016 - DNA, 22 bp, Artificial Sequence
  chemically synthesized
gttcaaccaaagcctacagaag

SEQ ID NO: 133017 - DNA, 22 bp, Artificial Sequence
  chemically synthesized
aaccaaagcctacagaaggaaa

SEQ ID NO: 133018 - DNA, 22 bp, Artificial Sequence
  chemically synthesized
cagaaggaaaaatgtgcaattg

SEQ ID NO: 133019 - DNA, 22 bp, Artificial Sequence
  chemically synthesized
cagatctagttttggccatata

SEQ ID NO: 133020 - DNA, 22 bp, Artificial Sequence
  chemically synthesized
gttttggccatataaagatgaa

SEQ ID NO: 133021 - DNA, 22 bp, Artificial Sequence
  chemically synthesized
tggccatataaagatgaattat

SEQ ID NO: 133022 - DNA, 22 bp, Artificial Sequence
  chemically synthesized
ggccatataaagatgaattata

SEQ ID NO: 133023 - DNA, 22 bp, Artificial Sequence
  chemically synthesized
gccatataaagatgaattatag

SEQ ID NO: 133024 - DNA, 22 bp, Artificial Sequence
  chemically synthesized
tagcatgtgaattgaggtcatg

SEQ ID NO: 133025 - DNA, 22 bp, Artificial Sequence
  chemically synthesized
aggtcatggaactctactataa

SEQ ID NO: 133026 - DNA, 22 bp, Artificial Sequence
  chemically synthesized
tactataatctcaaaactactc

SEQ ID NO: 133027 - DNA, 22 bp, Artificial Sequence
  chemically synthesized
ctataatctcaaaactactcta

SEQ ID NO: 133028 - DNA, 22 bp, Artificial Sequence
  chemically synthesized
taatctcaaaactactctattt

SEQ ID NO: 133029 - DNA, 22 bp, Artificial Sequence
  chemically synthesized
aaaactactctatttcagggta

SEQ ID NO: 133030 - DNA, 22 bp, Artificial Sequence
  chemically synthesized
ctctatttcagggtagattttc

SEQ ID NO: 133031 - DNA, 22 bp, Artificial Sequence
  chemically synthesized
tatttcagggtagattttcctt

SEQ ID NO: 133032 - DNA, 22 bp, Artificial Sequence
  chemically synthesized
tttcagggtagattttcctttt

SEQ ID NO: 133033 - DNA, 22 bp, Artificial Sequence
  chemically synthesized
cagggtagattttccttttttt

SEQ ID NO: 133034 - DNA, 22 bp, Artificial Sequence
  chemically synthesized
agggtagattttcctttttttt

SEQ ID NO: 133035 - DNA, 22 bp, Artificial Sequence
  chemically synthesized
tcctttttttttttttttttta

SEQ ID NO: 133036 - DNA, 22 bp, Artificial Sequence
  chemically synthesized
ccttttttttttttttttttaa

SEQ ID NO: 133037 - DNA, 22 bp, Artificial Sequence
  chemically synthesized
cttttttttttttttttttaaa

SEQ ID NO: 133038 - DNA, 22 bp, Artificial Sequence
  chemically synthesized
ttttttttttttttttaaaata

SEQ ID NO: 133039 - DNA, 22 bp, Artificial Sequence
  chemically synthesized
tttttttttttttttaaaatag

SEQ ID NO: 133040 - DNA, 22 bp, Artificial Sequence
  chemically synthesized
ttttttttttttttaaaataga

SEQ ID NO: 133041 - DNA, 22 bp, Artificial Sequence
  chemically synthesized
tttttttttttttaaaatagat

SEQ ID NO: 133042 - DNA, 22 bp, Artificial Sequence
  chemically synthesized
ttttttttttttaaaatagatt

SEQ ID NO: 133043 - DNA, 22 bp, Artificial Sequence
  chemically synthesized
tttttttttttaaaatagattt

SEQ ID NO: 133044 - DNA, 22 bp, Artificial Sequence
  chemically synthesized
ttttttttttaaaatagatttt

SEQ ID NO: 133045 - DNA, 22 bp, Artificial Sequence
  chemically synthesized
tttttttttaaaatagatttta

SEQ ID NO: 133046 - DNA, 22 bp, Artificial Sequence
  chemically synthesized
ttttttttaaaatagattttat

SEQ ID NO: 133047 - DNA, 22 bp, Artificial Sequence
  chemically synthesized
tttttttaaaatagattttatt

SEQ ID NO: 133048 - DNA, 22 bp, Artificial Sequence
  chemically synthesized
ttttttaaaatagattttattt

SEQ ID NO: 133049 - DNA, 22 bp, Artificial Sequence
  chemically synthesized
tttttaaaatagattttatttt

SEQ ID NO: 133050 - DNA, 22 bp, Artificial Sequence
  chemically synthesized
ttttaaaatagattttattttc

SEQ ID NO: 133051 - DNA, 22 bp, Artificial Sequence
  chemically synthesized
tttaaaatagattttattttcc

SEQ ID NO: 133052 - DNA, 22 bp, Artificial Sequence
  chemically synthesized
ttaaaatagattttattttcct

SEQ ID NO: 133053 - DNA, 22 bp, Artificial Sequence
  chemically synthesized
taaaatagattttattttcctt

SEQ ID NO: 133054 - DNA, 22 bp, Artificial Sequence
  chemically synthesized
aaaatagattttattttccttc

SEQ ID NO: 133055 - DNA, 22 bp, Artificial Sequence
  chemically synthesized
aaatagattttattttccttca

SEQ ID NO: 133056 - DNA, 22 bp, Artificial Sequence
  chemically synthesized
tattttccttcaacttattagg

SEQ ID NO: 133057 - DNA, 22 bp, Artificial Sequence
  chemically synthesized
attttccttcaacttattaggt

SEQ ID NO: 133058 - DNA, 22 bp, Artificial Sequence
  chemically synthesized
ttttccttcaacttattaggta

SEQ ID NO: 133059 - DNA, 22 bp, Artificial Sequence
  chemically synthesized
tccttcaacttattaggtaggt

SEQ ID NO: 133060 - DNA, 22 bp, Artificial Sequence
  chemically synthesized
ccttcaacttattaggtaggtg

SEQ ID NO: 133061 - DNA, 22 bp, Artificial Sequence
  chemically synthesized
cttcaacttattaggtaggtgc

SEQ ID NO: 133062 - DNA, 22 bp, Artificial Sequence
  chemically synthesized
caacttattaggtaggtgcaaa

SEQ ID NO: 133063 - DNA, 22 bp, Artificial Sequence
  chemically synthesized
aacttattaggtaggtgcaaag

SEQ ID NO: 133064 - DNA, 22 bp, Artificial Sequence
  chemically synthesized
attaggtaggtgcaaaggtaat

SEQ ID NO: 133065 - DNA, 22 bp, Artificial Sequence
  chemically synthesized
ttaggtaggtgcaaaggtaatt

SEQ ID NO: 133066 - DNA, 22 bp, Artificial Sequence
  chemically synthesized
ggtaggtgcaaaggtaattgca

SEQ ID NO: 133067 - DNA, 22 bp, Artificial Sequence
  chemically synthesized
cagttcacagaaattacttttg

SEQ ID NO: 133068 - DNA, 22 bp, Artificial Sequence
  chemically synthesized
acagaaattacttttgtaccaa

SEQ ID NO: 133069 - DNA, 22 bp, Artificial Sequence
  chemically synthesized
cttttgtaccaacataatatat

SEQ ID NO: 133070 - DNA, 22 bp, Artificial Sequence
  chemically synthesized
ttgtaccaacataatatatttt

SEQ ID NO: 133071 - DNA, 22 bp, Artificial Sequence
  chemically synthesized
tgtaccaacataatatatttta

SEQ ID NO: 133072 - DNA, 22 bp, Artificial Sequence
  chemically synthesized
gtaccaacataatatattttaa

SEQ ID NO: 133073 - DNA, 22 bp, Artificial Sequence
  chemically synthesized
taccaacataatatattttaag

SEQ ID NO: 133074 - DNA, 22 bp, Artificial Sequence
  chemically synthesized
taagttccagggcacatgtgca

SEQ ID NO: 133075 - DNA, 22 bp, Artificial Sequence
  chemically synthesized
aagttccagggcacatgtgcag

SEQ ID NO: 133076 - DNA, 22 bp, Artificial Sequence
  chemically synthesized
agttccagggcacatgtgcagg

SEQ ID NO: 133077 - DNA, 22 bp, Artificial Sequence
  chemically synthesized
cagggcacatgtgcaggatgtg

SEQ ID NO: 133078 - DNA, 22 bp, Artificial Sequence
  chemically synthesized
attacataggtaaatgtgtgcc

SEQ ID NO: 133079 - DNA, 22 bp, Artificial Sequence
  chemically synthesized
ttacataggtaaatgtgtgcca

SEQ ID NO: 133080 - DNA, 22 bp, Artificial Sequence
  chemically synthesized
cataggtaaatgtgtgccatgc

SEQ ID NO: 133081 - DNA, 22 bp, Artificial Sequence
  chemically synthesized
gctgcattcgttagctattctt

SEQ ID NO: 133082 - DNA, 22 bp, Artificial Sequence
  chemically synthesized
ctgcattcgttagctattcttc

SEQ ID NO: 133083 - DNA, 22 bp, Artificial Sequence
  chemically synthesized
cattcgttagctattcttcctg

SEQ ID NO: 133084 - DNA, 22 bp, Artificial Sequence
  chemically synthesized
gttagctattcttcctggtgct

SEQ ID NO: 133085 - DNA, 22 bp, Artificial Sequence
  chemically synthesized
gctattcttcctggtgctctcc

SEQ ID NO: 133086 - DNA, 22 bp, Artificial Sequence
  chemically synthesized
ttcttcctggtgctctccctct

SEQ ID NO: 133087 - DNA, 22 bp, Artificial Sequence
  chemically synthesized
ttcctggtgctctccctctcct

SEQ ID NO: 133088 - DNA, 22 bp, Artificial Sequence
  chemically synthesized
cctggtgctctccctctcctcc

SEQ ID NO: 133089 - DNA, 22 bp, Artificial Sequence
  chemically synthesized
ctggtgctctccctctcctccc

SEQ ID NO: 133090 - DNA, 22 bp, Artificial Sequence
  chemically synthesized
gtgctctccctctcctccccac

SEQ ID NO: 133091 - DNA, 22 bp, Artificial Sequence
  chemically synthesized
tccctctcctccccacccacta

SEQ ID NO: 133092 - DNA, 22 bp, Artificial Sequence
  chemically synthesized
cctctcctccccacccactacc

SEQ ID NO: 133093 - DNA, 22 bp, Artificial Sequence
  chemically synthesized
tcctccccacccactaccggac

SEQ ID NO: 133094 - DNA, 22 bp, Artificial Sequence
  chemically synthesized
ctccccacccactaccggacag

SEQ ID NO: 133095 - DNA, 22 bp, Artificial Sequence
  chemically synthesized
cccacccactaccggacaggcc

SEQ ID NO: 133096 - DNA, 22 bp, Artificial Sequence
  chemically synthesized
ccggacaggcccctgtgtgtgt

SEQ ID NO: 133097 - DNA, 22 bp, Artificial Sequence
  chemically synthesized
tgtgtgttgttccccacaagtg

SEQ ID NO: 133098 - DNA, 22 bp, Artificial Sequence
  chemically synthesized
ttccccacaagtgtccatgtgt

SEQ ID NO: 133099 - DNA, 22 bp, Artificial Sequence
  chemically synthesized
cccacaagtgtccatgtgttct

SEQ ID NO: 133100 - DNA, 22 bp, Artificial Sequence
  chemically synthesized
tcactgttcagctcccatttct

SEQ ID NO: 133101 - DNA, 22 bp, Artificial Sequence
  chemically synthesized
actgttcagctcccatttctgt

SEQ ID NO: 133102 - DNA, 22 bp, Artificial Sequence
  chemically synthesized
ttcagctcccatttctgtgtga

SEQ ID NO: 133103 - DNA, 22 bp, Artificial Sequence
  chemically synthesized
agctcccatttctgtgtgagaa

SEQ ID NO: 133104 - DNA, 22 bp, Artificial Sequence
  chemically synthesized
ccatttctgtgtgagaacatgt

SEQ ID NO: 133105 - DNA, 22 bp, Artificial Sequence
  chemically synthesized
ctgtgtgagaacatgtgtgttt

SEQ ID NO: 133106 - DNA, 22 bp, Artificial Sequence
  chemically synthesized
tgtgtgagaacatgtgtgtttg

SEQ ID NO: 133107 - DNA, 22 bp, Artificial Sequence
  chemically synthesized
tgtgagaacatgtgtgtttggt

SEQ ID NO: 133108 - DNA, 22 bp, Artificial Sequence
  chemically synthesized
ggttttctgttcctgtgttagt

SEQ ID NO: 133109 - DNA, 22 bp, Artificial Sequence
  chemically synthesized
gttttctgttcctgtgttagtt

SEQ ID NO: 133110 - DNA, 22 bp, Artificial Sequence
  chemically synthesized
tctgttcctgtgttagtttgat

SEQ ID NO: 133111 - DNA, 22 bp, Artificial Sequence
  chemically synthesized
ctgttcctgtgttagtttgatg

SEQ ID NO: 133112 - DNA, 22 bp, Artificial Sequence
  chemically synthesized
tgttcctgtgttagtttgatga

SEQ ID NO: 133113 - DNA, 22 bp, Artificial Sequence
  chemically synthesized
ttcctgtgttagtttgatgagg

SEQ ID NO: 133114 - DNA, 22 bp, Artificial Sequence
  chemically synthesized
ctgtgttagtttgatgaggata

SEQ ID NO: 133115 - DNA, 22 bp, Artificial Sequence
  chemically synthesized
tgttagtttgatgaggataatg

SEQ ID NO: 133116 - DNA, 22 bp, Artificial Sequence
  chemically synthesized
gtttgatgaggataatggcttc

SEQ ID NO: 133117 - DNA, 22 bp, Artificial Sequence
  chemically synthesized
gatgaggataatggcttccagc

SEQ ID NO: 133118 - DNA, 22 bp, Artificial Sequence
  chemically synthesized
atgaggataatggcttccagct

SEQ ID NO: 133119 - DNA, 22 bp, Artificial Sequence
  chemically synthesized
ccagctccattcatgtccctgc

SEQ ID NO: 133120 - DNA, 22 bp, Artificial Sequence
  chemically synthesized
cagctccattcatgtccctgca

SEQ ID NO: 133121 - DNA, 22 bp, Artificial Sequence
  chemically synthesized
cattcatgtccctgcaaggaac

SEQ ID NO: 133122 - DNA, 22 bp, Artificial Sequence
  chemically synthesized
atgtccctgcaaggaacacaat

SEQ ID NO: 133123 - DNA, 22 bp, Artificial Sequence
  chemically synthesized
caaggaacacaatccttttcct

SEQ ID NO: 133124 - DNA, 22 bp, Artificial Sequence
  chemically synthesized
ttcctttttatggctgtatagt

SEQ ID NO: 133125 - DNA, 22 bp, Artificial Sequence
  chemically synthesized
tcctttttatggctgtatagta

SEQ ID NO: 133126 - DNA, 22 bp, Artificial Sequence
  chemically synthesized
cctttttatggctgtatagtat

SEQ ID NO: 133127 - DNA, 22 bp, Artificial Sequence
  chemically synthesized
ctttttatggctgtatagtatt

SEQ ID NO: 133128 - DNA, 22 bp, Artificial Sequence
  chemically synthesized
tttatggctgtatagtattcca

SEQ ID NO: 133129 - DNA, 22 bp, Artificial Sequence
  chemically synthesized
ttatggctgtatagtattccat

SEQ ID NO: 133130 - DNA, 22 bp, Artificial Sequence
  chemically synthesized
tatggctgtatagtattccatg

SEQ ID NO: 133131 - DNA, 22 bp, Artificial Sequence
  chemically synthesized
atggctgtatagtattccatgg

SEQ ID NO: 133132 - DNA, 22 bp, Artificial Sequence
  chemically synthesized
tggctgtatagtattccatggt

SEQ ID NO: 133133 - DNA, 22 bp, Artificial Sequence
  chemically synthesized
tatagtattccatggtatatat

SEQ ID NO: 133134 - DNA, 22 bp, Artificial Sequence
  chemically synthesized
catggtatatatgtaccacgtt

SEQ ID NO: 133135 - DNA, 22 bp, Artificial Sequence
  chemically synthesized
tctttatccactctatcattga

SEQ ID NO: 133136 - DNA, 22 bp, Artificial Sequence
  chemically synthesized
ctttatccactctatcattgat

SEQ ID NO: 133137 - DNA, 22 bp, Artificial Sequence
  chemically synthesized
tttatccactctatcattgatg

SEQ ID NO: 133138 - DNA, 22 bp, Artificial Sequence
  chemically synthesized
tatccactctatcattgatgga

SEQ ID NO: 133139 - DNA, 22 bp, Artificial Sequence
  chemically synthesized
atccactctatcattgatggac

SEQ ID NO: 133140 - DNA, 22 bp, Artificial Sequence
  chemically synthesized
tccactctatcattgatggaca

SEQ ID NO: 133141 - DNA, 22 bp, Artificial Sequence
  chemically synthesized
tatcattgatggacatttgggt

SEQ ID NO: 133142 - DNA, 22 bp, Artificial Sequence
  chemically synthesized
tcattgatggacatttgggttg

SEQ ID NO: 133143 - DNA, 22 bp, Artificial Sequence
  chemically synthesized
atggacatttgggttgattcca

SEQ ID NO: 133144 - DNA, 22 bp, Artificial Sequence
  chemically synthesized
gggttgattccacatcttggct

SEQ ID NO: 133145 - DNA, 22 bp, Artificial Sequence
  chemically synthesized
ggttgattccacatcttggcta

SEQ ID NO: 133146 - DNA, 22 bp, Artificial Sequence
  chemically synthesized
attccacatcttggctattatg

SEQ ID NO: 133147 - DNA, 22 bp, Artificial Sequence
  chemically synthesized
cacatcttggctattatgaata

SEQ ID NO: 133148 - DNA, 22 bp, Artificial Sequence
  chemically synthesized
ggctattatgaataatgctgca

SEQ ID NO: 133149 - DNA, 22 bp, Artificial Sequence
  chemically synthesized
gctattatgaataatgctgcaa

SEQ ID NO: 133150 - DNA, 22 bp, Artificial Sequence
  chemically synthesized
ttatgaataatgctgcaatgaa

SEQ ID NO: 133151 - DNA, 22 bp, Artificial Sequence
  chemically synthesized
tgaataatgctgcaatgaacat

SEQ ID NO: 133152 - DNA, 22 bp, Artificial Sequence
  chemically synthesized
caatgaacataagcatgcctgt

SEQ ID NO: 133153 - DNA, 22 bp, Artificial Sequence
  chemically synthesized
tatttttataatagattgattt

SEQ ID NO: 133154 - DNA, 22 bp, Artificial Sequence
  chemically synthesized
ttataatagattgatttatatt

SEQ ID NO: 133155 - DNA, 22 bp, Artificial Sequence
  chemically synthesized
tataatagattgatttatattc

SEQ ID NO: 133156 - DNA, 22 bp, Artificial Sequence
  chemically synthesized
ataatagattgatttatattcc

SEQ ID NO: 133157 - DNA, 22 bp, Artificial Sequence
  chemically synthesized
taatagattgatttatattcct

SEQ ID NO: 133158 - DNA, 22 bp, Artificial Sequence
  chemically synthesized
atttatattcctttgggtatat

SEQ ID NO: 133159 - DNA, 22 bp, Artificial Sequence
  chemically synthesized
atattcctttgggtatataccc

SEQ ID NO: 133160 - DNA, 22 bp, Artificial Sequence
  chemically synthesized
tattcctttgggtatataccca

SEQ ID NO: 133161 - DNA, 22 bp, Artificial Sequence
  chemically synthesized
ctttgggtatatacccagtaat

SEQ ID NO: 133162 - DNA, 22 bp, Artificial Sequence
  chemically synthesized
tgggtatatacccagtaatgag

SEQ ID NO: 133163 - DNA, 22 bp, Artificial Sequence
  chemically synthesized
gggtatatacccagtaatgaga

SEQ ID NO: 133164 - DNA, 22 bp, Artificial Sequence
  chemically synthesized
ggtatatacccagtaatgagat

SEQ ID NO: 133165 - DNA, 22 bp, Artificial Sequence
  chemically synthesized
ctgagtcaagtggtatttctgc

SEQ ID NO: 133166 - DNA, 22 bp, Artificial Sequence
  chemically synthesized
agtcaagtggtatttctgcttc

SEQ ID NO: 133167 - DNA, 22 bp, Artificial Sequence
  chemically synthesized
ctgcttctacatctttgaggaa

SEQ ID NO: 133168 - DNA, 22 bp, Artificial Sequence
  chemically synthesized
tgcttctacatctttgaggaaa

SEQ ID NO: 133169 - DNA, 22 bp, Artificial Sequence
  chemically synthesized
cttctacatctttgaggaaagg

SEQ ID NO: 133170 - DNA, 22 bp, Artificial Sequence
  chemically synthesized
ctacatctttgaggaaaggcta

SEQ ID NO: 133171 - DNA, 22 bp, Artificial Sequence
  chemically synthesized
tacatctttgaggaaaggctac

SEQ ID NO: 133172 - DNA, 22 bp, Artificial Sequence
  chemically synthesized
catctttgaggaaaggctacac

SEQ ID NO: 133173 - DNA, 22 bp, Artificial Sequence
  chemically synthesized
tgaggaaaggctacactctctt

SEQ ID NO: 133174 - DNA, 22 bp, Artificial Sequence
  chemically synthesized
gaggaaaggctacactctcttc

SEQ ID NO: 133175 - DNA, 22 bp, Artificial Sequence
  chemically synthesized
aggaaaggctacactctcttcc

SEQ ID NO: 133176 - DNA, 22 bp, Artificial Sequence
  chemically synthesized
cactctcttccacaatgtttga

SEQ ID NO: 133177 - DNA, 22 bp, Artificial Sequence
  chemically synthesized
tcttccacaatgtttgaactaa

SEQ ID NO: 133178 - DNA, 22 bp, Artificial Sequence
  chemically synthesized
ttccacaatgtttgaactaatt

SEQ ID NO: 133179 - DNA, 22 bp, Artificial Sequence
  chemically synthesized
ccacaatgtttgaactaattta

SEQ ID NO: 133180 - DNA, 22 bp, Artificial Sequence
  chemically synthesized
cacaatgtttgaactaatttac

SEQ ID NO: 133181 - DNA, 22 bp, Artificial Sequence
  chemically synthesized
gaactaatttactctcccgtta

SEQ ID NO: 133182 - DNA, 22 bp, Artificial Sequence
  chemically synthesized
aactaatttactctcccgttaa

SEQ ID NO: 133183 - DNA, 22 bp, Artificial Sequence
  chemically synthesized
atttactctcccgttaacagtg

SEQ ID NO: 133184 - DNA, 22 bp, Artificial Sequence
  chemically synthesized
actctcccgttaacagtgtaaa

SEQ ID NO: 133185 - DNA, 22 bp, Artificial Sequence
  chemically synthesized
ctctcccgttaacagtgtaaaa

SEQ ID NO: 133186 - DNA, 22 bp, Artificial Sequence
  chemically synthesized
tcccgttaacagtgtaaaagca

SEQ ID NO: 133187 - DNA, 22 bp, Artificial Sequence
  chemically synthesized
ccgttaacagtgtaaaagcatt

SEQ ID NO: 133188 - DNA, 22 bp, Artificial Sequence
  chemically synthesized
acagtgtaaaagcattccattc

SEQ ID NO: 133189 - DNA, 22 bp, Artificial Sequence
  chemically synthesized
cattcctttctctctgcaacct

SEQ ID NO: 133190 - DNA, 22 bp, Artificial Sequence
  chemically synthesized
ctttctctctgcaaccttgcca

SEQ ID NO: 133191 - DNA, 22 bp, Artificial Sequence
  chemically synthesized
tctctctgcaaccttgccagca

SEQ ID NO: 133192 - DNA, 22 bp, Artificial Sequence
  chemically synthesized
ctctctgcaaccttgccagcaa

SEQ ID NO: 133193 - DNA, 22 bp, Artificial Sequence
  chemically synthesized
tctctgcaaccttgccagcaac

SEQ ID NO: 133194 - DNA, 22 bp, Artificial Sequence
  chemically synthesized
tctgcaaccttgccagcaactg

SEQ ID NO: 133195 - DNA, 22 bp, Artificial Sequence
  chemically synthesized
tgcaaccttgccagcaactgtt

SEQ ID NO: 133196 - DNA, 22 bp, Artificial Sequence
  chemically synthesized
caaccttgccagcaactgttgt

SEQ ID NO: 133197 - DNA, 22 bp, Artificial Sequence
  chemically synthesized
gccagcaactgttgtttcttga

SEQ ID NO: 133198 - DNA, 22 bp, Artificial Sequence
  chemically synthesized
ccagcaactgttgtttcttgac

SEQ ID NO: 133199 - DNA, 22 bp, Artificial Sequence
  chemically synthesized
ttgtttcttgactttttaataa

SEQ ID NO: 133200 - DNA, 22 bp, Artificial Sequence
  chemically synthesized
tttcttgactttttaataattg

SEQ ID NO: 133201 - DNA, 22 bp, Artificial Sequence
  chemically synthesized
cttgactttttaataattgcca

SEQ ID NO: 133202 - DNA, 22 bp, Artificial Sequence
  chemically synthesized
ttgactttttaataattgccat

SEQ ID NO: 133203 - DNA, 22 bp, Artificial Sequence
  chemically synthesized
gactttttaataattgccattc

SEQ ID NO: 133204 - DNA, 22 bp, Artificial Sequence
  chemically synthesized
actttttaataattgccattct

SEQ ID NO: 133205 - DNA, 22 bp, Artificial Sequence
  chemically synthesized
tttaataattgccattctgact

SEQ ID NO: 133206 - DNA, 22 bp, Artificial Sequence
  chemically synthesized
ttaataattgccattctgactg

SEQ ID NO: 133207 - DNA, 22 bp, Artificial Sequence
  chemically synthesized
taataattgccattctgactgg

SEQ ID NO: 133208 - DNA, 22 bp, Artificial Sequence
  chemically synthesized
aataattgccattctgactggt

SEQ ID NO: 133209 - DNA, 22 bp, Artificial Sequence
  chemically synthesized
ataattgccattctgactggtg

SEQ ID NO: 133210 - DNA, 22 bp, Artificial Sequence
  chemically synthesized
ccattctgactggtgtgagatg

SEQ ID NO: 133211 - DNA, 22 bp, Artificial Sequence
  chemically synthesized
tgactggtgtgagatggtatcc

SEQ ID NO: 133212 - DNA, 22 bp, Artificial Sequence
  chemically synthesized
actggtgtgagatggtatccca

SEQ ID NO: 133213 - DNA, 22 bp, Artificial Sequence
  chemically synthesized
gtgtgagatggtatcccattgt

SEQ ID NO: 133214 - DNA, 22 bp, Artificial Sequence
  chemically synthesized
tggttttgatttgcatttttct

SEQ ID NO: 133215 - DNA, 22 bp, Artificial Sequence
  chemically synthesized
tgatttgcatttttctaatgac

SEQ ID NO: 133216 - DNA, 22 bp, Artificial Sequence
  chemically synthesized
gatttgcatttttctaatgacc

SEQ ID NO: 133217 - DNA, 22 bp, Artificial Sequence
  chemically synthesized
atttgcatttttctaatgacca

SEQ ID NO: 133218 - DNA, 22 bp, Artificial Sequence
  chemically synthesized
gcatttttctaatgaccagtaa

SEQ ID NO: 133219 - DNA, 22 bp, Artificial Sequence
  chemically synthesized
catttttctaatgaccagtaag

SEQ ID NO: 133220 - DNA, 22 bp, Artificial Sequence
  chemically synthesized
ttctaatgaccagtaaggttga

SEQ ID NO: 133221 - DNA, 22 bp, Artificial Sequence
  chemically synthesized
tctaatgaccagtaaggttgag

SEQ ID NO: 133222 - DNA, 22 bp, Artificial Sequence
  chemically synthesized
ctaatgaccagtaaggttgagc

SEQ ID NO: 133223 - DNA, 22 bp, Artificial Sequence
  chemically synthesized
taatgaccagtaaggttgagct

SEQ ID NO: 133224 - DNA, 22 bp, Artificial Sequence
  chemically synthesized
atgaccagtaaggttgagcttt

SEQ ID NO: 133225 - DNA, 22 bp, Artificial Sequence
  chemically synthesized
agctttttttttttcatatgtt

SEQ ID NO: 133226 - DNA, 22 bp, Artificial Sequence
  chemically synthesized
tttttttttcatatgtttatta

SEQ ID NO: 133227 - DNA, 22 bp, Artificial Sequence
  chemically synthesized
ttttttttcatatgtttattag

SEQ ID NO: 133228 - DNA, 22 bp, Artificial Sequence
  chemically synthesized
tttttttcatatgtttattaga

SEQ ID NO: 133229 - DNA, 22 bp, Artificial Sequence
  chemically synthesized
ttttttcatatgtttattagaa

SEQ ID NO: 133230 - DNA, 22 bp, Artificial Sequence
  chemically synthesized
tttttcatatgtttattagaag

SEQ ID NO: 133231 - DNA, 22 bp, Artificial Sequence
  chemically synthesized
ttttcatatgtttattagaagc

SEQ ID NO: 133232 - DNA, 22 bp, Artificial Sequence
  chemically synthesized
tttcatatgtttattagaagca

SEQ ID NO: 133233 - DNA, 22 bp, Artificial Sequence
  chemically synthesized
ttcatatgtttattagaagcat

SEQ ID NO: 133234 - DNA, 22 bp, Artificial Sequence
  chemically synthesized
tcatatgtttattagaagcatg

SEQ ID NO: 133235 - DNA, 22 bp, Artificial Sequence
  chemically synthesized
catatgtttattagaagcatga

SEQ ID NO: 133236 - DNA, 22 bp, Artificial Sequence
  chemically synthesized
atatgtttattagaagcatgaa

SEQ ID NO: 133237 - DNA, 22 bp, Artificial Sequence
  chemically synthesized
attagaagcatgaatgtcttct

SEQ ID NO: 133238 - DNA, 22 bp, Artificial Sequence
  chemically synthesized
ttagaagcatgaatgtcttctt

SEQ ID NO: 133239 - DNA, 22 bp, Artificial Sequence
  chemically synthesized
gaagcatgaatgtcttctttag

SEQ ID NO: 133240 - DNA, 22 bp, Artificial Sequence
  chemically synthesized
ctttagagaagtgtctattcat

SEQ ID NO: 133241 - DNA, 22 bp, Artificial Sequence
  chemically synthesized
tttagagaagtgtctattcatg

SEQ ID NO: 133242 - DNA, 22 bp, Artificial Sequence
  chemically synthesized
tagagaagtgtctattcatgtc

SEQ ID NO: 133243 - DNA, 22 bp, Artificial Sequence
  chemically synthesized
agagaagtgtctattcatgtca

SEQ ID NO: 133244 - DNA, 22 bp, Artificial Sequence
  chemically synthesized
gagaagtgtctattcatgtcat

SEQ ID NO: 133245 - DNA, 22 bp, Artificial Sequence
  chemically synthesized
ttcatgtcattccccacttttt

SEQ ID NO: 133246 - DNA, 22 bp, Artificial Sequence
  chemically synthesized
atgtcattccccactttttaat

SEQ ID NO: 133247 - DNA, 22 bp, Artificial Sequence
  chemically synthesized
cccactttttaatggggttgtt

SEQ ID NO: 133248 - DNA, 22 bp, Artificial Sequence
  chemically synthesized
tttaatggggttgtttttttct

SEQ ID NO: 133249 - DNA, 22 bp, Artificial Sequence
  chemically synthesized
ttaatggggttgtttttttctt

SEQ ID NO: 133250 - DNA, 22 bp, Artificial Sequence
  chemically synthesized
taatggggttgtttttttcttg

SEQ ID NO: 133251 - DNA, 22 bp, Artificial Sequence
  chemically synthesized
aatggggttgtttttttcttgt

SEQ ID NO: 133252 - DNA, 22 bp, Artificial Sequence
  chemically synthesized
atggggttgtttttttcttgta

SEQ ID NO: 133253 - DNA, 22 bp, Artificial Sequence
  chemically synthesized
tttttttcttgtaaatttgttt

SEQ ID NO: 133254 - DNA, 22 bp, Artificial Sequence
  chemically synthesized
ttttcttgtaaatttgttttag

SEQ ID NO: 133255 - DNA, 22 bp, Artificial Sequence
  chemically synthesized
tttcttgtaaatttgttttagt

SEQ ID NO: 133256 - DNA, 22 bp, Artificial Sequence
  chemically synthesized
ttcttgtaaatttgttttagtt

SEQ ID NO: 133257 - DNA, 22 bp, Artificial Sequence
  chemically synthesized
tcttgtaaatttgttttagttc

SEQ ID NO: 133258 - DNA, 22 bp, Artificial Sequence
  chemically synthesized
cttgtaaatttgttttagttcc

SEQ ID NO: 133259 - DNA, 22 bp, Artificial Sequence
  chemically synthesized
ttgtaaatttgttttagttcct

SEQ ID NO: 133260 - DNA, 22 bp, Artificial Sequence
  chemically synthesized
gtaaatttgttttagttcctca

SEQ ID NO: 133261 - DNA, 22 bp, Artificial Sequence
  chemically synthesized
taaatttgttttagttcctcat

SEQ ID NO: 133262 - DNA, 22 bp, Artificial Sequence
  chemically synthesized
gttttagttcctcatagactcc

SEQ ID NO: 133263 - DNA, 22 bp, Artificial Sequence
  chemically synthesized
ttttagttcctcatagactcca

SEQ ID NO: 133264 - DNA, 22 bp, Artificial Sequence
  chemically synthesized
tagttcctcatagactccagat

SEQ ID NO: 133265 - DNA, 22 bp, Artificial Sequence
  chemically synthesized
agttcctcatagactccagata

SEQ ID NO: 133266 - DNA, 22 bp, Artificial Sequence
  chemically synthesized
gttcctcatagactccagatat

SEQ ID NO: 133267 - DNA, 22 bp, Artificial Sequence
  chemically synthesized
ctcatagactccagatattaga

SEQ ID NO: 133268 - DNA, 22 bp, Artificial Sequence
  chemically synthesized
atagactccagatattagactt

SEQ ID NO: 133269 - DNA, 22 bp, Artificial Sequence
  chemically synthesized
cagatattagacttttgtcaga

SEQ ID NO: 133270 - DNA, 22 bp, Artificial Sequence
  chemically synthesized
gacttttgtcagatggagaaat

SEQ ID NO: 133271 - DNA, 22 bp, Artificial Sequence
  chemically synthesized
ttgtcagatggagaaattgcaa

SEQ ID NO: 133272 - DNA, 22 bp, Artificial Sequence
  chemically synthesized
tgtcagatggagaaattgcaaa

SEQ ID NO: 133273 - DNA, 22 bp, Artificial Sequence
  chemically synthesized
gtcagatggagaaattgcaaaa

SEQ ID NO: 133274 - DNA, 22 bp, Artificial Sequence
  chemically synthesized
tcagatggagaaattgcaaaaa

SEQ ID NO: 133275 - DNA, 22 bp, Artificial Sequence
  chemically synthesized
caaaaattttcttctattctgt

SEQ ID NO: 133276 - DNA, 22 bp, Artificial Sequence
  chemically synthesized
tcttctattctgtaggttgtct

SEQ ID NO: 133277 - DNA, 22 bp, Artificial Sequence
  chemically synthesized
cttctattctgtaggttgtctg

SEQ ID NO: 133278 - DNA, 22 bp, Artificial Sequence
  chemically synthesized
ttctattctgtaggttgtctgt

SEQ ID NO: 133279 - DNA, 22 bp, Artificial Sequence
  chemically synthesized
ctattctgtaggttgtctgtta

SEQ ID NO: 133280 - DNA, 22 bp, Artificial Sequence
  chemically synthesized
tattctgtaggttgtctgttat

SEQ ID NO: 133281 - DNA, 22 bp, Artificial Sequence
  chemically synthesized
ttctgtaggttgtctgttatct

SEQ ID NO: 133282 - DNA, 22 bp, Artificial Sequence
  chemically synthesized
tgtaggttgtctgttatctctg

SEQ ID NO: 133283 - DNA, 22 bp, Artificial Sequence
  chemically synthesized
taggttgtctgttatctctgat

SEQ ID NO: 133284 - DNA, 22 bp, Artificial Sequence
  chemically synthesized
tctgttatctctgatgatagtt

SEQ ID NO: 133285 - DNA, 22 bp, Artificial Sequence
  chemically synthesized
ttatctctgatgatagtttctt

SEQ ID NO: 133286 - DNA, 22 bp, Artificial Sequence
  chemically synthesized
tctctgatgatagtttcttttg

SEQ ID NO: 133287 - DNA, 22 bp, Artificial Sequence
  chemically synthesized
tgatgatagtttcttttgctgt

SEQ ID NO: 133288 - DNA, 22 bp, Artificial Sequence
  chemically synthesized
atgatagtttcttttgctgtgc

SEQ ID NO: 133289 - DNA, 22 bp, Artificial Sequence
  chemically synthesized
cttttgctgtgcagaagctctt

SEQ ID NO: 133290 - DNA, 22 bp, Artificial Sequence
  chemically synthesized
ttttgctgtgcagaagctcttt

SEQ ID NO: 133291 - DNA, 22 bp, Artificial Sequence
  chemically synthesized
ttgctgtgcagaagctctttaa

SEQ ID NO: 133292 - DNA, 22 bp, Artificial Sequence
  chemically synthesized
tgctgtgcagaagctctttaat

SEQ ID NO: 133293 - DNA, 22 bp, Artificial Sequence
  chemically synthesized
gctgtgcagaagctctttaatt

SEQ ID NO: 133294 - DNA, 22 bp, Artificial Sequence
  chemically synthesized
ctgtgcagaagctctttaattt

SEQ ID NO: 133295 - DNA, 22 bp, Artificial Sequence
  chemically synthesized
tgcagaagctctttaatttaat

SEQ ID NO: 133296 - DNA, 22 bp, Artificial Sequence
  chemically synthesized
tttaatttaattagatcccatt

SEQ ID NO: 133297 - DNA, 22 bp, Artificial Sequence
  chemically synthesized
taatttaattagatcccatttg

SEQ ID NO: 133298 - DNA, 22 bp, Artificial Sequence
  chemically synthesized
aatttaattagatcccatttgt

SEQ ID NO: 133299 - DNA, 22 bp, Artificial Sequence
  chemically synthesized
atttaattagatcccatttgtc

SEQ ID NO: 133300 - DNA, 22 bp, Artificial Sequence
  chemically synthesized
aattagatcccatttgtcaatt

SEQ ID NO: 133301 - DNA, 22 bp, Artificial Sequence
  chemically synthesized
attagatcccatttgtcaattt

SEQ ID NO: 133302 - DNA, 22 bp, Artificial Sequence
  chemically synthesized
gatcccatttgtcaattttttt

SEQ ID NO: 133303 - DNA, 22 bp, Artificial Sequence
  chemically synthesized
gtcaatttttttttgcagttgc

SEQ ID NO: 133304 - DNA, 22 bp, Artificial Sequence
  chemically synthesized
tcaatttttttttgcagttgct

SEQ ID NO: 133305 - DNA, 22 bp, Artificial Sequence
  chemically synthesized
ttttttgcagttgcttttggtg

SEQ ID NO: 133306 - DNA, 22 bp, Artificial Sequence
  chemically synthesized
tttttgcagttgcttttggtgt

SEQ ID NO: 133307 - DNA, 22 bp, Artificial Sequence
  chemically synthesized
ttttgcagttgcttttggtgtc

SEQ ID NO: 133308 - DNA, 22 bp, Artificial Sequence
  chemically synthesized
tttgcagttgcttttggtgtct

SEQ ID NO: 133309 - DNA, 22 bp, Artificial Sequence
  chemically synthesized
ttgcagttgcttttggtgtctt

SEQ ID NO: 133310 - DNA, 22 bp, Artificial Sequence
  chemically synthesized
tgcagttgcttttggtgtcttg

SEQ ID NO: 133311 - DNA, 22 bp, Artificial Sequence
  chemically synthesized
gcagttgcttttggtgtcttga

SEQ ID NO: 133312 - DNA, 22 bp, Artificial Sequence
  chemically synthesized
cagttgcttttggtgtcttgag

SEQ ID NO: 133313 - DNA, 22 bp, Artificial Sequence
  chemically synthesized
cttttggtgtcttgagttttct

SEQ ID NO: 133314 - DNA, 22 bp, Artificial Sequence
  chemically synthesized
ttggtgtcttgagttttctttc

SEQ ID NO: 133315 - DNA, 22 bp, Artificial Sequence
  chemically synthesized
tggtgtcttgagttttctttca

SEQ ID NO: 133316 - DNA, 22 bp, Artificial Sequence
  chemically synthesized
ggtgtcttgagttttctttcaa

SEQ ID NO: 133317 - DNA, 22 bp, Artificial Sequence
  chemically synthesized
gtgtcttgagttttctttcaaa

SEQ ID NO: 133318 - DNA, 22 bp, Artificial Sequence
  chemically synthesized
gagttttctttcaaaatgatac

SEQ ID NO: 133319 - DNA, 22 bp, Artificial Sequence
  chemically synthesized
agttttctttcaaaatgataca

SEQ ID NO: 133320 - DNA, 22 bp, Artificial Sequence
  chemically synthesized
tctttcaaaatgatacaatgtc

SEQ ID NO: 133321 - DNA, 22 bp, Artificial Sequence
  chemically synthesized
ctttcaaaatgatacaatgtca

SEQ ID NO: 133322 - DNA, 22 bp, Artificial Sequence
  chemically synthesized
tttcaaaatgatacaatgtcat

SEQ ID NO: 133323 - DNA, 22 bp, Artificial Sequence
  chemically synthesized
tcaaaatgatacaatgtcatct

SEQ ID NO: 133324 - DNA, 22 bp, Artificial Sequence
  chemically synthesized
caaaatgatacaatgtcatcta

SEQ ID NO: 133325 - DNA, 22 bp, Artificial Sequence
  chemically synthesized
aaaatgatacaatgtcatctat

SEQ ID NO: 133326 - DNA, 22 bp, Artificial Sequence
  chemically synthesized
taaagttttacagtagagactc

SEQ ID NO: 133327 - DNA, 22 bp, Artificial Sequence
  chemically synthesized
tacagtagagactctctaaatt

SEQ ID NO: 133328 - DNA, 22 bp, Artificial Sequence
  chemically synthesized
acagtagagactctctaaattc

SEQ ID NO: 133329 - DNA, 22 bp, Artificial Sequence
  chemically synthesized
cagtagagactctctaaattca

SEQ ID NO: 133330 - DNA, 22 bp, Artificial Sequence
  chemically synthesized
tctaaattcataaatttcctag

SEQ ID NO: 133331 - DNA, 22 bp, Artificial Sequence
  chemically synthesized
taaattcataaatttcctagtt

SEQ ID NO: 133332 - DNA, 22 bp, Artificial Sequence
  chemically synthesized
aattcataaatttcctagttgc

SEQ ID NO: 133333 - DNA, 22 bp, Artificial Sequence
  chemically synthesized
ataaatttcctagttgctcatt

SEQ ID NO: 133334 - DNA, 22 bp, Artificial Sequence
  chemically synthesized
cctagttgctcatttcatgagt

SEQ ID NO: 133335 - DNA, 22 bp, Artificial Sequence
  chemically synthesized
ctagttgctcatttcatgagtt

SEQ ID NO: 133336 - DNA, 22 bp, Artificial Sequence
  chemically synthesized
gttgctcatttcatgagttaat

SEQ ID NO: 133337 - DNA, 22 bp, Artificial Sequence
  chemically synthesized
ctcatttcatgagttaatgtat

SEQ ID NO: 133338 - DNA, 22 bp, Artificial Sequence
  chemically synthesized
atttcatgagttaatgtatttc

SEQ ID NO: 133339 - DNA, 22 bp, Artificial Sequence
  chemically synthesized
catgagttaatgtatttctttt

SEQ ID NO: 133340 - DNA, 22 bp, Artificial Sequence
  chemically synthesized
atgagttaatgtatttcttttg

SEQ ID NO: 133341 - DNA, 22 bp, Artificial Sequence
  chemically synthesized
atgtatttcttttgatcttgtg

SEQ ID NO: 133342 - DNA, 22 bp, Artificial Sequence
  chemically synthesized
cttttgatcttgtgttctctct

SEQ ID NO: 133343 - DNA, 22 bp, Artificial Sequence
  chemically synthesized
ttttgatcttgtgttctctcta

SEQ ID NO: 133344 - DNA, 22 bp, Artificial Sequence
  chemically synthesized
ttgatcttgtgttctctctaaa

SEQ ID NO: 133345 - DNA, 22 bp, Artificial Sequence
  chemically synthesized
tgatcttgtgttctctctaaat

SEQ ID NO: 133346 - DNA, 22 bp, Artificial Sequence
  chemically synthesized
gatcttgtgttctctctaaatg

SEQ ID NO: 133347 - DNA, 22 bp, Artificial Sequence
  chemically synthesized
atcttgtgttctctctaaatgc

SEQ ID NO: 133348 - DNA, 22 bp, Artificial Sequence
  chemically synthesized
gtgttctctctaaatgctggat

SEQ ID NO: 133349 - DNA, 22 bp, Artificial Sequence
  chemically synthesized
tgttctctctaaatgctggata

SEQ ID NO: 133350 - DNA, 22 bp, Artificial Sequence
  chemically synthesized
tctctaaatgctggatagaaac

SEQ ID NO: 133351 - DNA, 22 bp, Artificial Sequence
  chemically synthesized
tctaaatgctggatagaaacat

SEQ ID NO: 133352 - DNA, 22 bp, Artificial Sequence
  chemically synthesized
taaatgctggatagaaacattt

SEQ ID NO: 133353 - DNA, 22 bp, Artificial Sequence
  chemically synthesized
aatgctggatagaaacatttct

SEQ ID NO: 133354 - DNA, 22 bp, Artificial Sequence
  chemically synthesized
gatagaaacatttctgatatgt

SEQ ID NO: 133355 - DNA, 22 bp, Artificial Sequence
  chemically synthesized
ctgatatgtccaatagatgaaa

SEQ ID NO: 133356 - DNA, 22 bp, Artificial Sequence
  chemically synthesized
tgatatgtccaatagatgaaat

SEQ ID NO: 133357 - DNA, 22 bp, Artificial Sequence
  chemically synthesized
atatgtccaatagatgaaatat

SEQ ID NO: 133358 - DNA, 22 bp, Artificial Sequence
  chemically synthesized
atattttcctttttgtatattc

SEQ ID NO: 133359 - DNA, 22 bp, Artificial Sequence
  chemically synthesized
tcctttttgtatattcaattta

SEQ ID NO: 133360 - DNA, 22 bp, Artificial Sequence
  chemically synthesized
cctttttgtatattcaatttat

SEQ ID NO: 133361 - DNA, 22 bp, Artificial Sequence
  chemically synthesized
ctttttgtatattcaatttatt

SEQ ID NO: 133362 - DNA, 22 bp, Artificial Sequence
  chemically synthesized
tttgtatattcaatttattttt

SEQ ID NO: 133363 - DNA, 22 bp, Artificial Sequence
  chemically synthesized
ttgtatattcaatttatttttt

SEQ ID NO: 133364 - DNA, 22 bp, Artificial Sequence
  chemically synthesized
tgtatattcaatttatttttta

SEQ ID NO: 133365 - DNA, 22 bp, Artificial Sequence
  chemically synthesized
gtatattcaatttattttttat

SEQ ID NO: 133366 - DNA, 22 bp, Artificial Sequence
  chemically synthesized
tatattcaatttattttttatt

SEQ ID NO: 133367 - DNA, 22 bp, Artificial Sequence
  chemically synthesized
aatttattttttattctaataa

SEQ ID NO: 133368 - DNA, 22 bp, Artificial Sequence
  chemically synthesized
attttttattctaataaatcac

SEQ ID NO: 133369 - DNA, 22 bp, Artificial Sequence
  chemically synthesized
ttttttattctaataaatcaca

SEQ ID NO: 133370 - DNA, 22 bp, Artificial Sequence
  chemically synthesized
tttattctaataaatcacaagt

SEQ ID NO: 133371 - DNA, 22 bp, Artificial Sequence
  chemically synthesized
ttattctaataaatcacaagtg

SEQ ID NO: 133372 - DNA, 22 bp, Artificial Sequence
  chemically synthesized
tattctaataaatcacaagtga

SEQ ID NO: 133373 - DNA, 22 bp, Artificial Sequence
  chemically synthesized
attctaataaatcacaagtgat

SEQ ID NO: 133374 - DNA, 22 bp, Artificial Sequence
  chemically synthesized
ttctaataaatcacaagtgatc

SEQ ID NO: 133375 - DNA, 22 bp, Artificial Sequence
  chemically synthesized
taataaatcacaagtgatctca

SEQ ID NO: 133376 - DNA, 22 bp, Artificial Sequence
  chemically synthesized
ataaatcacaagtgatctcaat

SEQ ID NO: 133377 - DNA, 22 bp, Artificial Sequence
  chemically synthesized
aatttgttgcagcaacttggaa

SEQ ID NO: 133378 - DNA, 22 bp, Artificial Sequence
  chemically synthesized
gttgcagcaacttggaaatctc

SEQ ID NO: 133379 - DNA, 22 bp, Artificial Sequence
  chemically synthesized
ttgcagcaacttggaaatctca

SEQ ID NO: 133380 - DNA, 22 bp, Artificial Sequence
  chemically synthesized
cagcaacttggaaatctcacta

SEQ ID NO: 133381 - DNA, 22 bp, Artificial Sequence
  chemically synthesized
ggaaatctcactaggatttatt

SEQ ID NO: 133382 - DNA, 22 bp, Artificial Sequence
  chemically synthesized
gaaatctcactaggatttattt

SEQ ID NO: 133383 - DNA, 22 bp, Artificial Sequence
  chemically synthesized
actaggatttatttgatcatat

SEQ ID NO: 133384 - DNA, 22 bp, Artificial Sequence
  chemically synthesized
ggatttatttgatcatatattt

SEQ ID NO: 133385 - DNA, 22 bp, Artificial Sequence
  chemically synthesized
atttgatcatatattttgctaa

SEQ ID NO: 133386 - DNA, 22 bp, Artificial Sequence
  chemically synthesized
tttgatcatatattttgctaat

SEQ ID NO: 133387 - DNA, 22 bp, Artificial Sequence
  chemically synthesized
gatcatatattttgctaatttt

SEQ ID NO: 133388 - DNA, 22 bp, Artificial Sequence
  chemically synthesized
atcatatattttgctaattttc

SEQ ID NO: 133389 - DNA, 22 bp, Artificial Sequence
  chemically synthesized
tgctaattttcatccttttata

SEQ ID NO: 133390 - DNA, 22 bp, Artificial Sequence
  chemically synthesized
gctaattttcatccttttataa

SEQ ID NO: 133391 - DNA, 22 bp, Artificial Sequence
  chemically synthesized
ctaattttcatccttttataat

SEQ ID NO: 133392 - DNA, 22 bp, Artificial Sequence
  chemically synthesized
attttcatccttttataattga

SEQ ID NO: 133393 - DNA, 22 bp, Artificial Sequence
  chemically synthesized
tcatccttttataattgatttt

SEQ ID NO: 133394 - DNA, 22 bp, Artificial Sequence
  chemically synthesized
catccttttataattgatttta

SEQ ID NO: 133395 - DNA, 22 bp, Artificial Sequence
  chemically synthesized
atccttttataattgattttaa

SEQ ID NO: 133396 - DNA, 22 bp, Artificial Sequence
  chemically synthesized
ttataattgattttaagaagtt

SEQ ID NO: 133397 - DNA, 22 bp, Artificial Sequence
  chemically synthesized
tataattgattttaagaagttt

SEQ ID NO: 133398 - DNA, 22 bp, Artificial Sequence
  chemically synthesized
ataattgattttaagaagttta

SEQ ID NO: 133399 - DNA, 22 bp, Artificial Sequence
  chemically synthesized
taattgattttaagaagtttat

SEQ ID NO: 133400 - DNA, 22 bp, Artificial Sequence
  chemically synthesized
attttaagaagtttattatgta

SEQ ID NO: 133401 - DNA, 22 bp, Artificial Sequence
  chemically synthesized
taagaagtttattatgtattat

SEQ ID NO: 133402 - DNA, 22 bp, Artificial Sequence
  chemically synthesized
aagaagtttattatgtattatc

SEQ ID NO: 133403 - DNA, 22 bp, Artificial Sequence
  chemically synthesized
agaagtttattatgtattatct

SEQ ID NO: 133404 - DNA, 22 bp, Artificial Sequence
  chemically synthesized
attatgtattatctctagtgtt

SEQ ID NO: 133405 - DNA, 22 bp, Artificial Sequence
  chemically synthesized
ttatgtattatctctagtgttt

SEQ ID NO: 133406 - DNA, 22 bp, Artificial Sequence
  chemically synthesized
tgtattatctctagtgttttat

SEQ ID NO: 133407 - DNA, 22 bp, Artificial Sequence
  chemically synthesized
tctctagtgttttatttttagt

SEQ ID NO: 133408 - DNA, 22 bp, Artificial Sequence
  chemically synthesized
tagtgttttatttttagtgtac

SEQ ID NO: 133409 - DNA, 22 bp, Artificial Sequence
  chemically synthesized
gtgttttatttttagtgtacgt

SEQ ID NO: 133410 - DNA, 22 bp, Artificial Sequence
  chemically synthesized
tatttttagtgtacgtattttc

SEQ ID NO: 133411 - DNA, 22 bp, Artificial Sequence
  chemically synthesized
atttttagtgtacgtattttcc

SEQ ID NO: 133412 - DNA, 22 bp, Artificial Sequence
  chemically synthesized
tttttagtgtacgtattttccc

SEQ ID NO: 133413 - DNA, 22 bp, Artificial Sequence
  chemically synthesized
ttagtgtacgtattttcccagt

SEQ ID NO: 133414 - DNA, 22 bp, Artificial Sequence
  chemically synthesized
tagtgtacgtattttcccagtt

SEQ ID NO: 133415 - DNA, 22 bp, Artificial Sequence
  chemically synthesized
agtgtacgtattttcccagttt

SEQ ID NO: 133416 - DNA, 22 bp, Artificial Sequence
  chemically synthesized
gtgtacgtattttcccagtttt

SEQ ID NO: 133417 - DNA, 22 bp, Artificial Sequence
  chemically synthesized
tcccagttttctgtttgtcttg

SEQ ID NO: 133418 - DNA, 22 bp, Artificial Sequence
  chemically synthesized
cccagttttctgtttgtcttgc

SEQ ID NO: 133419 - DNA, 22 bp, Artificial Sequence
  chemically synthesized
ccagttttctgtttgtcttgct

SEQ ID NO: 133420 - DNA, 22 bp, Artificial Sequence
  chemically synthesized
tctgtttgtcttgctatataca

SEQ ID NO: 133421 - DNA, 22 bp, Artificial Sequence
  chemically synthesized
ctgtttgtcttgctatatacac

SEQ ID NO: 133422 - DNA, 22 bp, Artificial Sequence
  chemically synthesized
tgtttgtcttgctatatacaca

SEQ ID NO: 133423 - DNA, 22 bp, Artificial Sequence
  chemically synthesized
tttgtcttgctatatacacaat

SEQ ID NO: 133424 - DNA, 22 bp, Artificial Sequence
  chemically synthesized
gtcttgctatatacacaattta

SEQ ID NO: 133425 - DNA, 22 bp, Artificial Sequence
  chemically synthesized
tcttgctatatacacaatttaa

SEQ ID NO: 133426 - DNA, 22 bp, Artificial Sequence
  chemically synthesized
gctatatacacaatttaaaagc

SEQ ID NO: 133427 - DNA, 22 bp, Artificial Sequence
  chemically synthesized
ctatatacacaatttaaaagct

SEQ ID NO: 133428 - DNA, 22 bp, Artificial Sequence
  chemically synthesized
tatacacaatttaaaagcttac

SEQ ID NO: 133429 - DNA, 22 bp, Artificial Sequence
  chemically synthesized
aaaagcttacatatacattatt

SEQ ID NO: 133430 - DNA, 22 bp, Artificial Sequence
  chemically synthesized
aaagcttacatatacattattt

SEQ ID NO: 133431 - DNA, 22 bp, Artificial Sequence
  chemically synthesized
acatatacattattttattatt

SEQ ID NO: 133432 - DNA, 22 bp, Artificial Sequence
  chemically synthesized
catatacattattttattattt

SEQ ID NO: 133433 - DNA, 22 bp, Artificial Sequence
  chemically synthesized
ttttattatttactttatctac

SEQ ID NO: 133434 - DNA, 22 bp, Artificial Sequence
  chemically synthesized
tattatttactttatctactga

SEQ ID NO: 133435 - DNA, 22 bp, Artificial Sequence
  chemically synthesized
attatttactttatctactgaa

SEQ ID NO: 133436 - DNA, 22 bp, Artificial Sequence
  chemically synthesized
ttatttactttatctactgaag

SEQ ID NO: 133437 - DNA, 22 bp, Artificial Sequence
  chemically synthesized
tttactttatctactgaagtat

SEQ ID NO: 133438 - DNA, 22 bp, Artificial Sequence
  chemically synthesized
actttatctactgaagtattgg

SEQ ID NO: 133439 - DNA, 22 bp, Artificial Sequence
  chemically synthesized
ctttatctactgaagtattgga

SEQ ID NO: 133440 - DNA, 22 bp, Artificial Sequence
  chemically synthesized
tatctactgaagtattggagcc

SEQ ID NO: 133441 - DNA, 22 bp, Artificial Sequence
  chemically synthesized
atctactgaagtattggagcca

SEQ ID NO: 133442 - DNA, 22 bp, Artificial Sequence
  chemically synthesized
tctactgaagtattggagccat

SEQ ID NO: 133443 - DNA, 22 bp, Artificial Sequence
  chemically synthesized
ctgaagtattggagccatacta

SEQ ID NO: 133444 - DNA, 22 bp, Artificial Sequence
  chemically synthesized
aagtattggagccatactatca

SEQ ID NO: 133445 - DNA, 22 bp, Artificial Sequence
  chemically synthesized
gagccatactatcaaagccctt

SEQ ID NO: 133446 - DNA, 22 bp, Artificial Sequence
  chemically synthesized
tcaaagcccttgctgacttcag

SEQ ID NO: 133447 - DNA, 22 bp, Artificial Sequence
  chemically synthesized
gctgacttcaggtttatttata

SEQ ID NO: 133448 - DNA, 22 bp, Artificial Sequence
  chemically synthesized
ctgacttcaggtttatttatat

SEQ ID NO: 133449 - DNA, 22 bp, Artificial Sequence
  chemically synthesized
acttcaggtttatttatatctt

SEQ ID NO: 133450 - DNA, 22 bp, Artificial Sequence
  chemically synthesized
caggtttatttatatctttttc

SEQ ID NO: 133451 - DNA, 22 bp, Artificial Sequence
  chemically synthesized
aggtttatttatatctttttct

SEQ ID NO: 133452 - DNA, 22 bp, Artificial Sequence
  chemically synthesized
atttatatctttttcttatact

SEQ ID NO: 133453 - DNA, 22 bp, Artificial Sequence
  chemically synthesized
tttatatctttttcttatactt

SEQ ID NO: 133454 - DNA, 22 bp, Artificial Sequence
  chemically synthesized
atatctttttcttatacttttg

SEQ ID NO: 133455 - DNA, 22 bp, Artificial Sequence
  chemically synthesized
tatctttttcttatacttttgc

SEQ ID NO: 133456 - DNA, 22 bp, Artificial Sequence
  chemically synthesized
tttcttatacttttgcctaatt

SEQ ID NO: 133457 - DNA, 22 bp, Artificial Sequence
  chemically synthesized
ttcttatacttttgcctaattt

SEQ ID NO: 133458 - DNA, 22 bp, Artificial Sequence
  chemically synthesized
tcttatacttttgcctaattta

SEQ ID NO: 133459 - DNA, 22 bp, Artificial Sequence
  chemically synthesized
cttatacttttgcctaatttat

SEQ ID NO: 133460 - DNA, 22 bp, Artificial Sequence
  chemically synthesized
ttatacttttgcctaatttatt

SEQ ID NO: 133461 - DNA, 22 bp, Artificial Sequence
  chemically synthesized
atacttttgcctaatttatttg

SEQ ID NO: 133462 - DNA, 22 bp, Artificial Sequence
  chemically synthesized
tacttttgcctaatttatttgt

SEQ ID NO: 133463 - DNA, 22 bp, Artificial Sequence
  chemically synthesized
ttgcctaatttatttgtacata

SEQ ID NO: 133464 - DNA, 22 bp, Artificial Sequence
  chemically synthesized
tgcctaatttatttgtacatat

SEQ ID NO: 133465 - DNA, 22 bp, Artificial Sequence
  chemically synthesized
gcctaatttatttgtacatatc

SEQ ID NO: 133466 - DNA, 22 bp, Artificial Sequence
  chemically synthesized
cctaatttatttgtacatatcc

SEQ ID NO: 133467 - DNA, 22 bp, Artificial Sequence
  chemically synthesized
atttatttgtacatatcctatg

SEQ ID NO: 133468 - DNA, 22 bp, Artificial Sequence
  chemically synthesized
atttgtacatatcctatgttta

SEQ ID NO: 133469 - DNA, 22 bp, Artificial Sequence
  chemically synthesized
tttgtacatatcctatgtttaa

SEQ ID NO: 133470 - DNA, 22 bp, Artificial Sequence
  chemically synthesized
gtacatatcctatgtttaaaag

SEQ ID NO: 133471 - DNA, 22 bp, Artificial Sequence
  chemically synthesized
tacatatcctatgtttaaaagg

SEQ ID NO: 133472 - DNA, 22 bp, Artificial Sequence
  chemically synthesized
tgtttaaaagggtttgtgtttg

SEQ ID NO: 133473 - DNA, 22 bp, Artificial Sequence
  chemically synthesized
aaaagggtttgtgtttggagga

SEQ ID NO: 133474 - DNA, 22 bp, Artificial Sequence
  chemically synthesized
aaagggtttgtgtttggaggag

SEQ ID NO: 133475 - DNA, 22 bp, Artificial Sequence
  chemically synthesized
gtgtttggaggagagtaggact

SEQ ID NO: 133476 - DNA, 22 bp, Artificial Sequence
  chemically synthesized
tgtttggaggagagtaggactt

SEQ ID NO: 133477 - DNA, 22 bp, Artificial Sequence
  chemically synthesized
ggaggagagtaggactttaaat

SEQ ID NO: 133478 - DNA, 22 bp, Artificial Sequence
  chemically synthesized
gaggagagtaggactttaaatc

SEQ ID NO: 133479 - DNA, 22 bp, Artificial Sequence
  chemically synthesized
taaatcattcctcatgtgccta

SEQ ID NO: 133480 - DNA, 22 bp, Artificial Sequence
  chemically synthesized
aaatcattcctcatgtgcctat

SEQ ID NO: 133481 - DNA, 22 bp, Artificial Sequence
  chemically synthesized
aatcattcctcatgtgcctatt

SEQ ID NO: 133482 - DNA, 22 bp, Artificial Sequence
  chemically synthesized
ctcatgtgcctattttcgtgga

SEQ ID NO: 133483 - DNA, 22 bp, Artificial Sequence
  chemically synthesized
atgtgcctattttcgtggaaac

SEQ ID NO: 133484 - DNA, 22 bp, Artificial Sequence
  chemically synthesized
ttttcgtggaaacaccactaat

SEQ ID NO: 133485 - DNA, 22 bp, Artificial Sequence
  chemically synthesized
tcgtggaaacaccactaatatt

SEQ ID NO: 133486 - DNA, 22 bp, Artificial Sequence
  chemically synthesized
cgtggaaacaccactaatattt

SEQ ID NO: 133487 - DNA, 22 bp, Artificial Sequence
  chemically synthesized
gtggaaacaccactaatattta

SEQ ID NO: 133488 - DNA, 22 bp, Artificial Sequence
  chemically synthesized
atatttaatcattcctttggtt

SEQ ID NO: 133489 - DNA, 22 bp, Artificial Sequence
  chemically synthesized
aatcattcctttggttaatttt

SEQ ID NO: 133490 - DNA, 22 bp, Artificial Sequence
  chemically synthesized
atcattcctttggttaattttt

SEQ ID NO: 133491 - DNA, 22 bp, Artificial Sequence
  chemically synthesized
ctttggttaattttttaagggc

SEQ ID NO: 133492 - DNA, 22 bp, Artificial Sequence
  chemically synthesized
tggttaattttttaagggcact

SEQ ID NO: 133493 - DNA, 22 bp, Artificial Sequence
  chemically synthesized
ggttaattttttaagggcacta

SEQ ID NO: 133494 - DNA, 22 bp, Artificial Sequence
  chemically synthesized
gttaattttttaagggcactat

SEQ ID NO: 133495 - DNA, 22 bp, Artificial Sequence
  chemically synthesized
attttttaagggcactattatg

SEQ ID NO: 133496 - DNA, 22 bp, Artificial Sequence
  chemically synthesized
tttaagggcactattatgggtc

SEQ ID NO: 133497 - DNA, 22 bp, Artificial Sequence
  chemically synthesized
ttaagggcactattatgggtca

SEQ ID NO: 133498 - DNA, 22 bp, Artificial Sequence
  chemically synthesized
taagggcactattatgggtcac

SEQ ID NO: 133499 - DNA, 22 bp, Artificial Sequence
  chemically synthesized
aagggcactattatgggtcacc

SEQ ID NO: 133500 - DNA, 22 bp, Artificial Sequence
  chemically synthesized
agggcactattatgggtcacct

SEQ ID NO: 133501 - DNA, 22 bp, Artificial Sequence
  chemically synthesized
ttatgggtcaccttgctaagca

SEQ ID NO: 133502 - DNA, 22 bp, Artificial Sequence
  chemically synthesized
tgggtcaccttgctaagcaaaa

SEQ ID NO: 133503 - DNA, 22 bp, Artificial Sequence
  chemically synthesized
gctaagcaaaaatgatataaga

SEQ ID NO: 133504 - DNA, 22 bp, Artificial Sequence
  chemically synthesized
ctaagcaaaaatgatataagag

SEQ ID NO: 133505 - DNA, 22 bp, Artificial Sequence
  chemically synthesized
agcaaaaatgatataagagagc

SEQ ID NO: 133506 - DNA, 22 bp, Artificial Sequence
  chemically synthesized
ttcttcttaaagtcttcaaata

SEQ ID NO: 133507 - DNA, 22 bp, Artificial Sequence
  chemically synthesized
tcttcttaaagtcttcaaataa

SEQ ID NO: 133508 - DNA, 22 bp, Artificial Sequence
  chemically synthesized
cttcttaaagtcttcaaataag

SEQ ID NO: 133509 - DNA, 22 bp, Artificial Sequence
  chemically synthesized
ttcttaaagtcttcaaataagt

SEQ ID NO: 133510 - DNA, 22 bp, Artificial Sequence
  chemically synthesized
cttaaagtcttcaaataagtgg

SEQ ID NO: 133511 - DNA, 22 bp, Artificial Sequence
  chemically synthesized
ttaaagtcttcaaataagtggg

SEQ ID NO: 133512 - DNA, 22 bp, Artificial Sequence
  chemically synthesized
aaagtcttcaaataagtgggga

SEQ ID NO: 133513 - DNA, 22 bp, Artificial Sequence
  chemically synthesized
aagtcttcaaataagtggggac

SEQ ID NO: 133514 - DNA, 22 bp, Artificial Sequence
  chemically synthesized
caaataagtggggactcaaaga

SEQ ID NO: 133515 - DNA, 22 bp, Artificial Sequence
  chemically synthesized
aaataagtggggactcaaagaa

SEQ ID NO: 133516 - DNA, 22 bp, Artificial Sequence
  chemically synthesized
aaagaataaaagaaatccaaat

SEQ ID NO: 133517 - DNA, 22 bp, Artificial Sequence
  chemically synthesized
aaaacaagtgctgtgattaatc

SEQ ID NO: 133518 - DNA, 22 bp, Artificial Sequence
  chemically synthesized
aaacaagtgctgtgattaatca

SEQ ID NO: 133519 - DNA, 22 bp, Artificial Sequence
  chemically synthesized
tgattaatcataaagcagaaag

SEQ ID NO: 133520 - DNA, 22 bp, Artificial Sequence
  chemically synthesized
atcataaagcagaaagaagaca

SEQ ID NO: 133521 - DNA, 22 bp, Artificial Sequence
  chemically synthesized
aatggagagtgtgggtctcaaa

SEQ ID NO: 133522 - DNA, 22 bp, Artificial Sequence
  chemically synthesized
aaaaaaggcttgaggttatggc

SEQ ID NO: 133523 - DNA, 22 bp, Artificial Sequence
  chemically synthesized
gaggttatggcttgaaataagg

SEQ ID NO: 133524 - DNA, 22 bp, Artificial Sequence
  chemically synthesized
aggttatggcttgaaataaggg

SEQ ID NO: 133525 - DNA, 22 bp, Artificial Sequence
  chemically synthesized
tggcttgaaataagggtaagat

SEQ ID NO: 133526 - DNA, 22 bp, Artificial Sequence
  chemically synthesized
gaaataagggtaagattccctg

SEQ ID NO: 133527 - DNA, 22 bp, Artificial Sequence
  chemically synthesized
aaataagggtaagattccctga

SEQ ID NO: 133528 - DNA, 22 bp, Artificial Sequence
  chemically synthesized
cctgagaaagtgtcccttcagc

SEQ ID NO: 133529 - DNA, 22 bp, Artificial Sequence
  chemically synthesized
agaaagtgtcccttcagctgag

SEQ ID NO: 133530 - DNA, 22 bp, Artificial Sequence
  chemically synthesized
cagctgagacctgaaaatggat

SEQ ID NO: 133531 - DNA, 22 bp, Artificial Sequence
  chemically synthesized
agctgagacctgaaaatggatt

SEQ ID NO: 133532 - DNA, 22 bp, Artificial Sequence
  chemically synthesized
agacctgaaaatggattagaaa

SEQ ID NO: 133533 - DNA, 22 bp, Artificial Sequence
  chemically synthesized
aaaatggattagaaactaactg

SEQ ID NO: 133534 - DNA, 22 bp, Artificial Sequence
  chemically synthesized
gaaactaactggtgaaaataca

SEQ ID NO: 133535 - DNA, 22 bp, Artificial Sequence
  chemically synthesized
actggtgaaaatacagacaaga

SEQ ID NO: 133536 - DNA, 22 bp, Artificial Sequence
  chemically synthesized
gtgaaaatacagacaagaatat

SEQ ID NO: 133537 - DNA, 22 bp, Artificial Sequence
  chemically synthesized
taagactgaaggagtgtgtgtg

SEQ ID NO: 133538 - DNA, 22 bp, Artificial Sequence
  chemically synthesized
agactgaaggagtgtgtgtgga

SEQ ID NO: 133539 - DNA, 22 bp, Artificial Sequence
  chemically synthesized
aaggagtgtgtgtggagacctc

SEQ ID NO: 133540 - DNA, 22 bp, Artificial Sequence
  chemically synthesized
agctaggttggtttatattagg

SEQ ID NO: 133541 - DNA, 22 bp, Artificial Sequence
  chemically synthesized
ggttggtttatattagggaagg

SEQ ID NO: 133542 - DNA, 22 bp, Artificial Sequence
  chemically synthesized
gtttatattagggaaggtggct

SEQ ID NO: 133543 - DNA, 22 bp, Artificial Sequence
  chemically synthesized
atattagggaaggtggctactg

SEQ ID NO: 133544 - DNA, 22 bp, Artificial Sequence
  chemically synthesized
tattagggaaggtggctactgg

SEQ ID NO: 133545 - DNA, 22 bp, Artificial Sequence
  chemically synthesized
gggaaggtggctactggaagag

SEQ ID NO: 133546 - DNA, 22 bp, Artificial Sequence
  chemically synthesized
ctggaagagggtgtttgctttg

SEQ ID NO: 133547 - DNA, 22 bp, Artificial Sequence
  chemically synthesized
gaagagggtgtttgctttgaga

SEQ ID NO: 133548 - DNA, 22 bp, Artificial Sequence
  chemically synthesized
gctttgagaagaggctgaagag

SEQ ID NO: 133549 - DNA, 22 bp, Artificial Sequence
  chemically synthesized
ctttgagaagaggctgaagagg

SEQ ID NO: 133550 - DNA, 22 bp, Artificial Sequence
  chemically synthesized
tgagaagaggctgaagagggaa

SEQ ID NO: 133551 - DNA, 22 bp, Artificial Sequence
  chemically synthesized
gagaagaggctgaagagggaag

SEQ ID NO: 133552 - DNA, 22 bp, Artificial Sequence
  chemically synthesized
agaagaggctgaagagggaagg

SEQ ID NO: 133553 - DNA, 22 bp, Artificial Sequence
  chemically synthesized
aagagggaaggaatggccttat

SEQ ID NO: 133554 - DNA, 22 bp, Artificial Sequence
  chemically synthesized
attggtcatcataagagtttga

SEQ ID NO: 133555 - DNA, 22 bp, Artificial Sequence
  chemically synthesized
ttggtcatcataagagtttgag

SEQ ID NO: 133556 - DNA, 22 bp, Artificial Sequence
  chemically synthesized
gtcatcataagagtttgagtct

SEQ ID NO: 133557 - DNA, 22 bp, Artificial Sequence
  chemically synthesized
gagtctctactcggagtcatgg

SEQ ID NO: 133558 - DNA, 22 bp, Artificial Sequence
  chemically synthesized
agtctctactcggagtcatgga

SEQ ID NO: 133559 - DNA, 22 bp, Artificial Sequence
  chemically synthesized
tactcggagtcatggaaagcta

SEQ ID NO: 133560 - DNA, 22 bp, Artificial Sequence
  chemically synthesized
ctcggagtcatggaaagctact

SEQ ID NO: 133561 - DNA, 22 bp, Artificial Sequence
  chemically synthesized
ggagtcatggaaagctactgaa

SEQ ID NO: 133562 - DNA, 22 bp, Artificial Sequence
  chemically synthesized
ctgaaagaagctgcataattca

SEQ ID NO: 133563 - DNA, 22 bp, Artificial Sequence
  chemically synthesized
aaagaagctgcataattcattg

SEQ ID NO: 133564 - DNA, 22 bp, Artificial Sequence
  chemically synthesized
cataattcattgatgttttaaa

SEQ ID NO: 133565 - DNA, 22 bp, Artificial Sequence
  chemically synthesized
attgatgttttaaaattacttc

SEQ ID NO: 133566 - DNA, 22 bp, Artificial Sequence
  chemically synthesized
atgttttaaaattacttcaata

SEQ ID NO: 133567 - DNA, 22 bp, Artificial Sequence
  chemically synthesized
taaaattacttcaatattattt

SEQ ID NO: 133568 - DNA, 22 bp, Artificial Sequence
  chemically synthesized
aaaattacttcaatattattta

SEQ ID NO: 133569 - DNA, 22 bp, Artificial Sequence
  chemically synthesized
aaattacttcaatattatttat

SEQ ID NO: 133570 - DNA, 22 bp, Artificial Sequence
  chemically synthesized
cttcaatattatttataaaatg

SEQ ID NO: 133571 - DNA, 22 bp, Artificial Sequence
  chemically synthesized
caatattatttataaaatggaa

SEQ ID NO: 133572 - DNA, 22 bp, Artificial Sequence
  chemically synthesized
aatattatttataaaatggaat

SEQ ID NO: 133573 - DNA, 22 bp, Artificial Sequence
  chemically synthesized
tttataaaatggaattgaggga

SEQ ID NO: 133574 - DNA, 22 bp, Artificial Sequence
  chemically synthesized
ataaaatggaattgagggaggc

SEQ ID NO: 133575 - DNA, 22 bp, Artificial Sequence
  chemically synthesized
taaaatggaattgagggaggca

SEQ ID NO: 133576 - DNA, 22 bp, Artificial Sequence
  chemically synthesized
agggaggcagggaaagggcaga

SEQ ID NO: 133577 - DNA, 22 bp, Artificial Sequence
  chemically synthesized
gagtaatttgaagaaagataat

SEQ ID NO: 133578 - DNA, 22 bp, Artificial Sequence
  chemically synthesized
gaagaaagataatagtaactca

SEQ ID NO: 133579 - DNA, 22 bp, Artificial Sequence
  chemically synthesized
aagaaagataatagtaactcaa

SEQ ID NO: 133580 - DNA, 22 bp, Artificial Sequence
  chemically synthesized
aatttaggaaagtggaaatggt

SEQ ID NO: 133581 - DNA, 22 bp, Artificial Sequence
  chemically synthesized
aggaaagtggaaatggtaatgg

SEQ ID NO: 133582 - DNA, 22 bp, Artificial Sequence
  chemically synthesized
ggaaagtggaaatggtaatgga

SEQ ID NO: 133583 - DNA, 22 bp, Artificial Sequence
  chemically synthesized
aaggtctaaatataataaggtt

SEQ ID NO: 133584 - DNA, 22 bp, Artificial Sequence
  chemically synthesized
aggtctaaatataataaggttt

SEQ ID NO: 133585 - DNA, 22 bp, Artificial Sequence
  chemically synthesized
aatataataaggtttacaggtt

SEQ ID NO: 133586 - DNA, 22 bp, Artificial Sequence
  chemically synthesized
acaggttatttagaaaagcaga

SEQ ID NO: 133587 - DNA, 22 bp, Artificial Sequence
  chemically synthesized
caggttatttagaaaagcagag

SEQ ID NO: 133588 - DNA, 22 bp, Artificial Sequence
  chemically synthesized
tttagaaaagcagaggaaagaa

SEQ ID NO: 133589 - DNA, 22 bp, Artificial Sequence
  chemically synthesized
agaaaagcagaggaaagaaaga

SEQ ID NO: 133590 - DNA, 22 bp, Artificial Sequence
  chemically synthesized
gaaaagcagaggaaagaaagag

SEQ ID NO: 133591 - DNA, 22 bp, Artificial Sequence
  chemically synthesized
gaaaggagcaaaaatcaccatc

SEQ ID NO: 133592 - DNA, 22 bp, Artificial Sequence
  chemically synthesized
ctgacatgttcttggaagaaag

SEQ ID NO: 133593 - DNA, 22 bp, Artificial Sequence
  chemically synthesized
tgacatgttcttggaagaaagg

SEQ ID NO: 133594 - DNA, 22 bp, Artificial Sequence
  chemically synthesized
acatgttcttggaagaaaggca

SEQ ID NO: 133595 - DNA, 22 bp, Artificial Sequence
  chemically synthesized
ttggaagaaaggcagtgccaaa

SEQ ID NO: 133596 - DNA, 22 bp, Artificial Sequence
  chemically synthesized
ggaagaaaggcagtgccaaaag

SEQ ID NO: 133597 - DNA, 22 bp, Artificial Sequence
  chemically synthesized
gaagaaaggcagtgccaaaaga

SEQ ID NO: 133598 - DNA, 22 bp, Artificial Sequence
  chemically synthesized
attatgtattgtctataaataa

SEQ ID NO: 133599 - DNA, 22 bp, Artificial Sequence
  chemically synthesized
tgtattgtctataaataagaag

SEQ ID NO: 133600 - DNA, 22 bp, Artificial Sequence
  chemically synthesized
tctataaataagaagaatcatt

SEQ ID NO: 133601 - DNA, 22 bp, Artificial Sequence
  chemically synthesized
taaataagaagaatcattataa

SEQ ID NO: 133602 - DNA, 22 bp, Artificial Sequence
  chemically synthesized
taatttttaaagttgtgggaca

SEQ ID NO: 133603 - DNA, 22 bp, Artificial Sequence
  chemically synthesized
ttaaagttgtgggacactgaga

SEQ ID NO: 133604 - DNA, 22 bp, Artificial Sequence
  chemically synthesized
taaagttgtgggacactgagaa

SEQ ID NO: 133605 - DNA, 22 bp, Artificial Sequence
  chemically synthesized
aaagttgtgggacactgagaat

SEQ ID NO: 133606 - DNA, 22 bp, Artificial Sequence
  chemically synthesized
aagttgtgggacactgagaatg

SEQ ID NO: 133607 - DNA, 22 bp, Artificial Sequence
  chemically synthesized
tgggacactgagaatgagtcaa

SEQ ID NO: 133608 - DNA, 22 bp, Artificial Sequence
  chemically synthesized
agaatgagtcaaaataataaac

SEQ ID NO: 133609 - DNA, 22 bp, Artificial Sequence
  chemically synthesized
aagaaagcaattgaaggaagta

SEQ ID NO: 133610 - DNA, 22 bp, Artificial Sequence
  chemically synthesized
agaaagcaattgaaggaagtat

SEQ ID NO: 133611 - DNA, 22 bp, Artificial Sequence
  chemically synthesized
aaggaagtatttcaaactgtag

SEQ ID NO: 133612 - DNA, 22 bp, Artificial Sequence
  chemically synthesized
caaactgtagaactagactttt

SEQ ID NO: 133613 - DNA, 22 bp, Artificial Sequence
  chemically synthesized
aaactgtagaactagactttta

SEQ ID NO: 133614 - DNA, 22 bp, Artificial Sequence
  chemically synthesized
tagaactagacttttaaaaaca

SEQ ID NO: 133615 - DNA, 22 bp, Artificial Sequence
  chemically synthesized
gacttttaaaaacaaaatatta

SEQ ID NO: 133616 - DNA, 22 bp, Artificial Sequence
  chemically synthesized
ttaaaaacaaaatattagctta

SEQ ID NO: 133617 - DNA, 22 bp, Artificial Sequence
  chemically synthesized
taaaaacaaaatattagcttaa

SEQ ID NO: 133618 - DNA, 22 bp, Artificial Sequence
  chemically synthesized
aaaaacaaaatattagcttaat

SEQ ID NO: 133619 - DNA, 22 bp, Artificial Sequence
  chemically synthesized
aaaacaaaatattagcttaata

SEQ ID NO: 133620 - DNA, 22 bp, Artificial Sequence
  chemically synthesized
gcttaataattaaaaaaatcat

SEQ ID NO: 133621 - DNA, 22 bp, Artificial Sequence
  chemically synthesized
aataattaaaaaaatcattcat

SEQ ID NO: 133622 - DNA, 22 bp, Artificial Sequence
  chemically synthesized
ataattaaaaaaatcattcatt

SEQ ID NO: 133623 - DNA, 22 bp, Artificial Sequence
  chemically synthesized
aaaaaatcattcattcaaatca

SEQ ID NO: 133624 - DNA, 22 bp, Artificial Sequence
  chemically synthesized
attcaaatcatttcagtatgta

SEQ ID NO: 133625 - DNA, 22 bp, Artificial Sequence
  chemically synthesized
aaatcatttcagtatgtatttc

SEQ ID NO: 133626 - DNA, 22 bp, Artificial Sequence
  chemically synthesized
cagtatgtatttctttttgcct

SEQ ID NO: 133627 - DNA, 22 bp, Artificial Sequence
  chemically synthesized
agtatgtatttctttttgcctg

SEQ ID NO: 133628 - DNA, 22 bp, Artificial Sequence
  chemically synthesized
ctttttgcctgatcatgaagag

SEQ ID NO: 133629 - DNA, 22 bp, Artificial Sequence
  chemically synthesized
tttttgcctgatcatgaagagt

SEQ ID NO: 133630 - DNA, 22 bp, Artificial Sequence
  chemically synthesized
tttgcctgatcatgaagagtca

SEQ ID NO: 133631 - DNA, 22 bp, Artificial Sequence
  chemically synthesized
ttgcctgatcatgaagagtcat

SEQ ID NO: 133632 - DNA, 22 bp, Artificial Sequence
  chemically synthesized
tgcctgatcatgaagagtcata

SEQ ID NO: 133633 - DNA, 22 bp, Artificial Sequence
  chemically synthesized
gcctgatcatgaagagtcatag

SEQ ID NO: 133634 - DNA, 22 bp, Artificial Sequence
  chemically synthesized
cctgatcatgaagagtcatagt

SEQ ID NO: 133635 - DNA, 22 bp, Artificial Sequence
  chemically synthesized
atcatgaagagtcatagtaaag

SEQ ID NO: 133636 - DNA, 22 bp, Artificial Sequence
  chemically synthesized
acagatgcaagacaacagaaac

SEQ ID NO: 133637 - DNA, 22 bp, Artificial Sequence
  chemically synthesized
cagatgcaagacaacagaaaca

SEQ ID NO: 133638 - DNA, 22 bp, Artificial Sequence
  chemically synthesized
aagcagatgacacccaaagaag

SEQ ID NO: 133639 - DNA, 22 bp, Artificial Sequence
  chemically synthesized
actatcctaggagaaagcagga

SEQ ID NO: 133640 - DNA, 22 bp, Artificial Sequence
  chemically synthesized
tcctaggagaaagcaggataga

SEQ ID NO: 133641 - DNA, 22 bp, Artificial Sequence
  chemically synthesized
ggagaaagcaggatagatccgg

SEQ ID NO: 133642 - DNA, 22 bp, Artificial Sequence
  chemically synthesized
ttcttgggtgtcattcactgaa

SEQ ID NO: 133643 - DNA, 22 bp, Artificial Sequence
  chemically synthesized
tcttgggtgtcattcactgaag

SEQ ID NO: 133644 - DNA, 22 bp, Artificial Sequence
  chemically synthesized
cttgggtgtcattcactgaagt

SEQ ID NO: 133645 - DNA, 22 bp, Artificial Sequence
  chemically synthesized
ttgggtgtcattcactgaagta

SEQ ID NO: 133646 - DNA, 22 bp, Artificial Sequence
  chemically synthesized
gggtgtcattcactgaagtaga

SEQ ID NO: 133647 - DNA, 22 bp, Artificial Sequence
  chemically synthesized
ggtgtcattcactgaagtagac

SEQ ID NO: 133648 - DNA, 22 bp, Artificial Sequence
  chemically synthesized
actgaagtagacccagttttaa

SEQ ID NO: 133649 - DNA, 22 bp, Artificial Sequence
  chemically synthesized
aagtagacccagttttaaaata

SEQ ID NO: 133650 - DNA, 22 bp, Artificial Sequence
  chemically synthesized
taaaatagcagtccaaaaaata

SEQ ID NO: 133651 - DNA, 22 bp, Artificial Sequence
  chemically synthesized
aaaatagcagtccaaaaaatac

SEQ ID NO: 133652 - DNA, 22 bp, Artificial Sequence
  chemically synthesized
aaatagcagtccaaaaaatact

SEQ ID NO: 133653 - DNA, 22 bp, Artificial Sequence
  chemically synthesized
ccaaacgtgagataatatatca

SEQ ID NO: 133654 - DNA, 22 bp, Artificial Sequence
  chemically synthesized
tatgatacaactggttagagcc

SEQ ID NO: 133655 - DNA, 22 bp, Artificial Sequence
  chemically synthesized
gttagagccagataatctgata

SEQ ID NO: 133656 - DNA, 22 bp, Artificial Sequence
  chemically synthesized
gagccagataatctgatacaaa

SEQ ID NO: 133657 - DNA, 22 bp, Artificial Sequence
  chemically synthesized
atacaaacataaataggaagat

SEQ ID NO: 133658 - DNA, 22 bp, Artificial Sequence
  chemically synthesized
actaaattctgaattaccagat

SEQ ID NO: 133659 - DNA, 22 bp, Artificial Sequence
  chemically synthesized
aattctgaattaccagatgagt

SEQ ID NO: 133660 - DNA, 22 bp, Artificial Sequence
  chemically synthesized
tgaattaccagatgagtaaata

SEQ ID NO: 133661 - DNA, 22 bp, Artificial Sequence
  chemically synthesized
aattaccagatgagtaaataac

SEQ ID NO: 133662 - DNA, 22 bp, Artificial Sequence
  chemically synthesized
ccagatgagtaaataacaagaa

SEQ ID NO: 133663 - DNA, 22 bp, Artificial Sequence
  chemically synthesized
attgaaaaatgaagttttttca

SEQ ID NO: 133664 - DNA, 22 bp, Artificial Sequence
  chemically synthesized
ttgaaaaatgaagttttttcat

SEQ ID NO: 133665 - DNA, 22 bp, Artificial Sequence
  chemically synthesized
aaaaatgaagttttttcatgag

SEQ ID NO: 133666 - DNA, 22 bp, Artificial Sequence
  chemically synthesized
tttcatgagtgcttatgttagt

SEQ ID NO: 133667 - DNA, 22 bp, Artificial Sequence
  chemically synthesized
ttcatgagtgcttatgttagtt

SEQ ID NO: 133668 - DNA, 22 bp, Artificial Sequence
  chemically synthesized
tcatgagtgcttatgttagtta

SEQ ID NO: 133669 - DNA, 22 bp, Artificial Sequence
  chemically synthesized
catgagtgcttatgttagttac

SEQ ID NO: 133670 - DNA, 22 bp, Artificial Sequence
  chemically synthesized
atgagtgcttatgttagttacc

SEQ ID NO: 133671 - DNA, 22 bp, Artificial Sequence
  chemically synthesized
atgttagttaccctagatttgc

SEQ ID NO: 133672 - DNA, 22 bp, Artificial Sequence
  chemically synthesized
tgttagttaccctagatttgcg

SEQ ID NO: 133673 - DNA, 22 bp, Artificial Sequence
  chemically synthesized
gttaccctagatttgcggcatg

SEQ ID NO: 133674 - DNA, 22 bp, Artificial Sequence
  chemically synthesized
ccctagatttgcggcatgcctt

SEQ ID NO: 133675 - DNA, 22 bp, Artificial Sequence
  chemically synthesized
gatttgcggcatgccttcacag

SEQ ID NO: 133676 - DNA, 22 bp, Artificial Sequence
  chemically synthesized
gcggcatgccttcacagatgtc

SEQ ID NO: 133677 - DNA, 22 bp, Artificial Sequence
  chemically synthesized
cggcatgccttcacagatgtcc

SEQ ID NO: 133678 - DNA, 22 bp, Artificial Sequence
  chemically synthesized
cacagatgtccaatcatagata

SEQ ID NO: 133679 - DNA, 22 bp, Artificial Sequence
  chemically synthesized
acagatgtccaatcatagatat

SEQ ID NO: 133680 - DNA, 22 bp, Artificial Sequence
  chemically synthesized
gaggaggaccatatggaactga

SEQ ID NO: 133681 - DNA, 22 bp, Artificial Sequence
  chemically synthesized
aggaggaccatatggaactgaa

SEQ ID NO: 133682 - DNA, 22 bp, Artificial Sequence
  chemically synthesized
aaaataatctatgcttgattct

SEQ ID NO: 133683 - DNA, 22 bp, Artificial Sequence
  chemically synthesized
tgcttgattctttctctcaagt

SEQ ID NO: 133684 - DNA, 22 bp, Artificial Sequence
  chemically synthesized
gattctttctctcaagtgaaat

SEQ ID NO: 133685 - DNA, 22 bp, Artificial Sequence
  chemically synthesized
attctttctctcaagtgaaatt

SEQ ID NO: 133686 - DNA, 22 bp, Artificial Sequence
  chemically synthesized
tttctctcaagtgaaattgttg

SEQ ID NO: 133687 - DNA, 22 bp, Artificial Sequence
  chemically synthesized
tctctcaagtgaaattgttgag

SEQ ID NO: 133688 - DNA, 22 bp, Artificial Sequence
  chemically synthesized
ctctcaagtgaaattgttgagt

SEQ ID NO: 133689 - DNA, 22 bp, Artificial Sequence
  chemically synthesized
tctcaagtgaaattgttgagtc

SEQ ID NO: 133690 - DNA, 22 bp, Artificial Sequence
  chemically synthesized
tcaagtgaaattgttgagtcaa

SEQ ID NO: 133691 - DNA, 22 bp, Artificial Sequence
  chemically synthesized
aagtgaaattgttgagtcaacc

SEQ ID NO: 133692 - DNA, 22 bp, Artificial Sequence
  chemically synthesized
ttgagtcaaccatcctattcta

SEQ ID NO: 133693 - DNA, 22 bp, Artificial Sequence
  chemically synthesized
agtcaaccatcctattctattt

SEQ ID NO: 133694 - DNA, 22 bp, Artificial Sequence
  chemically synthesized
ttctatttattaaaatcaaata

SEQ ID NO: 133695 - DNA, 22 bp, Artificial Sequence
  chemically synthesized
tatttattaaaatcaaataaat

SEQ ID NO: 133696 - DNA, 22 bp, Artificial Sequence
  chemically synthesized
tttattaaaatcaaataaatgg

SEQ ID NO: 133697 - DNA, 22 bp, Artificial Sequence
  chemically synthesized
attaaaatcaaataaatggtct

SEQ ID NO: 133698 - DNA, 22 bp, Artificial Sequence
  chemically synthesized
ttaaaatcaaataaatggtctt

SEQ ID NO: 133699 - DNA, 22 bp, Artificial Sequence
  chemically synthesized
aaatcaaataaatggtctttaa

SEQ ID NO: 133700 - DNA, 22 bp, Artificial Sequence
  chemically synthesized
taagatataagagactttatcc

SEQ ID NO: 133701 - DNA, 22 bp, Artificial Sequence
  chemically synthesized
aagatataagagactttatcct

SEQ ID NO: 133702 - DNA, 22 bp, Artificial Sequence
  chemically synthesized
agatataagagactttatccta

SEQ ID NO: 133703 - DNA, 22 bp, Artificial Sequence
  chemically synthesized
tatcctagtatgtatatatata

SEQ ID NO: 133704 - DNA, 22 bp, Artificial Sequence
  chemically synthesized
atcctagtatgtatatatatag

SEQ ID NO: 133705 - DNA, 22 bp, Artificial Sequence
  chemically synthesized
tcctagtatgtatatatatagt

SEQ ID NO: 133706 - DNA, 22 bp, Artificial Sequence
  chemically synthesized
gtatgtatatatatagttgtgt

SEQ ID NO: 133707 - DNA, 22 bp, Artificial Sequence
  chemically synthesized
tgtttgcatgtgtgtgtggaca

SEQ ID NO: 133708 - DNA, 22 bp, Artificial Sequence
  chemically synthesized
gcatgtgtgtgtggacacctgc

SEQ ID NO: 133709 - DNA, 22 bp, Artificial Sequence
  chemically synthesized
catgtgtgtgtggacacctgca

SEQ ID NO: 133710 - DNA, 22 bp, Artificial Sequence
  chemically synthesized
cacatgtggaataaatctttta

SEQ ID NO: 133711 - DNA, 22 bp, Artificial Sequence
  chemically synthesized
ttaatattttatcttagacata

SEQ ID NO: 133712 - DNA, 22 bp, Artificial Sequence
  chemically synthesized
taatattttatcttagacataa

SEQ ID NO: 133713 - DNA, 22 bp, Artificial Sequence
  chemically synthesized
aatattttatcttagacataat

SEQ ID NO: 133714 - DNA, 22 bp, Artificial Sequence
  chemically synthesized
atattttatcttagacataatt

SEQ ID NO: 133715 - DNA, 22 bp, Artificial Sequence
  chemically synthesized
tatcttagacataatttttaac

SEQ ID NO: 133716 - DNA, 22 bp, Artificial Sequence
  chemically synthesized
atcttagacataatttttaacc

SEQ ID NO: 133717 - DNA, 22 bp, Artificial Sequence
  chemically synthesized
tcttagacataatttttaacct

SEQ ID NO: 133718 - DNA, 22 bp, Artificial Sequence
  chemically synthesized
agacataatttttaacctcaaa

SEQ ID NO: 133719 - DNA, 22 bp, Artificial Sequence
  chemically synthesized
gacataatttttaacctcaaac

SEQ ID NO: 133720 - DNA, 22 bp, Artificial Sequence
  chemically synthesized
ttaacctcaaactcttgttttt

SEQ ID NO: 133721 - DNA, 22 bp, Artificial Sequence
  chemically synthesized
taacctcaaactcttgttttta

SEQ ID NO: 133722 - DNA, 22 bp, Artificial Sequence
  chemically synthesized
aacctcaaactcttgtttttaa

SEQ ID NO: 133723 - DNA, 22 bp, Artificial Sequence
  chemically synthesized
acctcaaactcttgtttttaaa

SEQ ID NO: 133724 - DNA, 22 bp, Artificial Sequence
  chemically synthesized
aaactcttgtttttaaaccttt

SEQ ID NO: 133725 - DNA, 22 bp, Artificial Sequence
  chemically synthesized
ttgtttttaaacctttcacaat

SEQ ID NO: 133726 - DNA, 22 bp, Artificial Sequence
  chemically synthesized
gtttttaaacctttcacaataa

SEQ ID NO: 133727 - DNA, 22 bp, Artificial Sequence
  chemically synthesized
tttttaaacctttcacaataaa

SEQ ID NO: 133728 - DNA, 22 bp, Artificial Sequence
  chemically synthesized
ttaaacctttcacaataaattt

SEQ ID NO: 133729 - DNA, 22 bp, Artificial Sequence
  chemically synthesized
taaacctttcacaataaattta

SEQ ID NO: 133730 - DNA, 22 bp, Artificial Sequence
  chemically synthesized
aaacctttcacaataaatttaa

SEQ ID NO: 133731 - DNA, 22 bp, Artificial Sequence
  chemically synthesized
aacctttcacaataaatttaat

SEQ ID NO: 133732 - DNA, 22 bp, Artificial Sequence
  chemically synthesized
tcacaataaatttaatgaattg

SEQ ID NO: 133733 - DNA, 22 bp, Artificial Sequence
  chemically synthesized
cacaataaatttaatgaattga

SEQ ID NO: 133734 - DNA, 22 bp, Artificial Sequence
  chemically synthesized
acaataaatttaatgaattgaa

SEQ ID NO: 133735 - DNA, 22 bp, Artificial Sequence
  chemically synthesized
aatgaattgaaatacatttatt

SEQ ID NO: 133736 - DNA, 22 bp, Artificial Sequence
  chemically synthesized
atgaattgaaatacatttattg

SEQ ID NO: 133737 - DNA, 22 bp, Artificial Sequence
  chemically synthesized
aaatacatttattgttttattt

SEQ ID NO: 133738 - DNA, 22 bp, Artificial Sequence
  chemically synthesized
attgttttatttttatagtggt

SEQ ID NO: 133739 - DNA, 22 bp, Artificial Sequence
  chemically synthesized
ttgttttatttttatagtggta

SEQ ID NO: 133740 - DNA, 22 bp, Artificial Sequence
  chemically synthesized
ttttatttttatagtggtaata

SEQ ID NO: 133741 - DNA, 22 bp, Artificial Sequence
  chemically synthesized
tatttttatagtggtaatatat

SEQ ID NO: 133742 - DNA, 22 bp, Artificial Sequence
  chemically synthesized
atttttatagtggtaatatata

SEQ ID NO: 133743 - DNA, 22 bp, Artificial Sequence
  chemically synthesized
tttttatagtggtaatatatac

SEQ ID NO: 133744 - DNA, 22 bp, Artificial Sequence
  chemically synthesized
ttatagtggtaatatatacaat

SEQ ID NO: 133745 - DNA, 22 bp, Artificial Sequence
  chemically synthesized
tatagtggtaatatatacaatt

SEQ ID NO: 133746 - DNA, 22 bp, Artificial Sequence
  chemically synthesized
atagtggtaatatatacaattt

SEQ ID NO: 133747 - DNA, 22 bp, Artificial Sequence
  chemically synthesized
tagtggtaatatatacaatttg

SEQ ID NO: 133748 - DNA, 22 bp, Artificial Sequence
  chemically synthesized
gccactttagcctttttataat

SEQ ID NO: 133749 - DNA, 22 bp, Artificial Sequence
  chemically synthesized
ccactttagcctttttataatg

SEQ ID NO: 133750 - DNA, 22 bp, Artificial Sequence
  chemically synthesized
tagcctttttataatgtataat

SEQ ID NO: 133751 - DNA, 22 bp, Artificial Sequence
  chemically synthesized
agcctttttataatgtataatg

SEQ ID NO: 133752 - DNA, 22 bp, Artificial Sequence
  chemically synthesized
gcctttttataatgtataatgc

SEQ ID NO: 133753 - DNA, 22 bp, Artificial Sequence
  chemically synthesized
tttataatgtataatgcagtgg

SEQ ID NO: 133754 - DNA, 22 bp, Artificial Sequence
  chemically synthesized
ttataatgtataatgcagtggc

SEQ ID NO: 133755 - DNA, 22 bp, Artificial Sequence
  chemically synthesized
tataatgtataatgcagtggca

SEQ ID NO: 133756 - DNA, 22 bp, Artificial Sequence
  chemically synthesized
ataatgtataatgcagtggcac

SEQ ID NO: 133757 - DNA, 22 bp, Artificial Sequence
  chemically synthesized
taatgtataatgcagtggcact

SEQ ID NO: 133758 - DNA, 22 bp, Artificial Sequence
  chemically synthesized
attacatttgccatgttgtgca

SEQ ID NO: 133759 - DNA, 22 bp, Artificial Sequence
  chemically synthesized
ttacatttgccatgttgtgcaa

SEQ ID NO: 133760 - DNA, 22 bp, Artificial Sequence
  chemically synthesized
catttgccatgttgtgcaatca

SEQ ID NO: 133761 - DNA, 22 bp, Artificial Sequence
  chemically synthesized
gccatgttgtgcaatcaccacc

SEQ ID NO: 133762 - DNA, 22 bp, Artificial Sequence
  chemically synthesized
ccatgttgtgcaatcaccacca

SEQ ID NO: 133763 - DNA, 22 bp, Artificial Sequence
  chemically synthesized
tgcaatcaccaccactatttct

SEQ ID NO: 133764 - DNA, 22 bp, Artificial Sequence
  chemically synthesized
tttctaaaattttgtattacac

SEQ ID NO: 133765 - DNA, 22 bp, Artificial Sequence
  chemically synthesized
ctaaaattttgtattacaccaa

SEQ ID NO: 133766 - DNA, 22 bp, Artificial Sequence
  chemically synthesized
taaaattttgtattacaccaaa

SEQ ID NO: 133767 - DNA, 22 bp, Artificial Sequence
  chemically synthesized
aaattttgtattacaccaaata

SEQ ID NO: 133768 - DNA, 22 bp, Artificial Sequence
  chemically synthesized
tgtattacaccaaataaaaact

SEQ ID NO: 133769 - DNA, 22 bp, Artificial Sequence
  chemically synthesized
gtattacaccaaataaaaactc

SEQ ID NO: 133770 - DNA, 22 bp, Artificial Sequence
  chemically synthesized
tattacaccaaataaaaactct

SEQ ID NO: 133771 - DNA, 22 bp, Artificial Sequence
  chemically synthesized
caccaaataaaaactctatatt

SEQ ID NO: 133772 - DNA, 22 bp, Artificial Sequence
  chemically synthesized
tatattgattaatcagttactc

SEQ ID NO: 133773 - DNA, 22 bp, Artificial Sequence
  chemically synthesized
tattgattaatcagttactccc

SEQ ID NO: 133774 - DNA, 22 bp, Artificial Sequence
  chemically synthesized
attaatcagttactccccaatc

SEQ ID NO: 133775 - DNA, 22 bp, Artificial Sequence
  chemically synthesized
atcagttactccccaatccatg

SEQ ID NO: 133776 - DNA, 22 bp, Artificial Sequence
  chemically synthesized
ctccccaatccatgttcttcct

SEQ ID NO: 133777 - DNA, 22 bp, Artificial Sequence
  chemically synthesized
cccaatccatgttcttcctaca

SEQ ID NO: 133778 - DNA, 22 bp, Artificial Sequence
  chemically synthesized
ttcctacactctggtaacttct

SEQ ID NO: 133779 - DNA, 22 bp, Artificial Sequence
  chemically synthesized
cctacactctggtaacttctaa

SEQ ID NO: 133780 - DNA, 22 bp, Artificial Sequence
  chemically synthesized
ctacactctggtaacttctaat

SEQ ID NO: 133781 - DNA, 22 bp, Artificial Sequence
  chemically synthesized
cactctggtaacttctaatcta

SEQ ID NO: 133782 - DNA, 22 bp, Artificial Sequence
  chemically synthesized
tggtaacttctaatctactttt

SEQ ID NO: 133783 - DNA, 22 bp, Artificial Sequence
  chemically synthesized
gtaacttctaatctactttttg

SEQ ID NO: 133784 - DNA, 22 bp, Artificial Sequence
  chemically synthesized
ctaatctactttttgtctctat

SEQ ID NO: 133785 - DNA, 22 bp, Artificial Sequence
  chemically synthesized
taatctactttttgtctctatg

SEQ ID NO: 133786 - DNA, 22 bp, Artificial Sequence
  chemically synthesized
atctactttttgtctctatgaa

SEQ ID NO: 133787 - DNA, 22 bp, Artificial Sequence
  chemically synthesized
ctttttgtctctatgaatttgc

SEQ ID NO: 133788 - DNA, 22 bp, Artificial Sequence
  chemically synthesized
tttgtctctatgaatttgccta

SEQ ID NO: 133789 - DNA, 22 bp, Artificial Sequence
  chemically synthesized
ttgtctctatgaatttgcctat

SEQ ID NO: 133790 - DNA, 22 bp, Artificial Sequence
  chemically synthesized
tgtctctatgaatttgcctatt

SEQ ID NO: 133791 - DNA, 22 bp, Artificial Sequence
  chemically synthesized
gtctctatgaatttgcctattc

SEQ ID NO: 133792 - DNA, 22 bp, Artificial Sequence
  chemically synthesized
tctctatgaatttgcctattct

SEQ ID NO: 133793 - DNA, 22 bp, Artificial Sequence
  chemically synthesized
tatgaatttgcctattctagat

SEQ ID NO: 133794 - DNA, 22 bp, Artificial Sequence
  chemically synthesized
tgaatttgcctattctagatag

SEQ ID NO: 133795 - DNA, 22 bp, Artificial Sequence
  chemically synthesized
gcctattctagatagctcatgt

SEQ ID NO: 133796 - DNA, 22 bp, Artificial Sequence
  chemically synthesized
cctattctagatagctcatgta

SEQ ID NO: 133797 - DNA, 22 bp, Artificial Sequence
  chemically synthesized
ttctagatagctcatgtaagtg

SEQ ID NO: 133798 - DNA, 22 bp, Artificial Sequence
  chemically synthesized
tagatagctcatgtaagtgaaa

SEQ ID NO: 133799 - DNA, 22 bp, Artificial Sequence
  chemically synthesized
gatagctcatgtaagtgaaatc

SEQ ID NO: 133800 - DNA, 22 bp, Artificial Sequence
  chemically synthesized
atgtaagtgaaatcagacaatg

SEQ ID NO: 133801 - DNA, 22 bp, Artificial Sequence
  chemically synthesized
ttttgcgtatgacttattgcac

SEQ ID NO: 133802 - DNA, 22 bp, Artificial Sequence
  chemically synthesized
ttgcgtatgacttattgcactt

SEQ ID NO: 133803 - DNA, 22 bp, Artificial Sequence
  chemically synthesized
tgcgtatgacttattgcactta

SEQ ID NO: 133804 - DNA, 22 bp, Artificial Sequence
  chemically synthesized
gcgtatgacttattgcacttag

SEQ ID NO: 133805 - DNA, 22 bp, Artificial Sequence
  chemically synthesized
cgtatgacttattgcacttagg

SEQ ID NO: 133806 - DNA, 22 bp, Artificial Sequence
  chemically synthesized
attgcacttaggatagtttttt

SEQ ID NO: 133807 - DNA, 22 bp, Artificial Sequence
  chemically synthesized
ttgcacttaggatagtttttta

SEQ ID NO: 133808 - DNA, 22 bp, Artificial Sequence
  chemically synthesized
cacttaggatagttttttaagg

SEQ ID NO: 133809 - DNA, 22 bp, Artificial Sequence
  chemically synthesized
aggatagttttttaaggtttat

SEQ ID NO: 133810 - DNA, 22 bp, Artificial Sequence
  chemically synthesized
ggatagttttttaaggtttatt

SEQ ID NO: 133811 - DNA, 22 bp, Artificial Sequence
  chemically synthesized
tttaaggtttattcatgttgta

SEQ ID NO: 133812 - DNA, 22 bp, Artificial Sequence
  chemically synthesized
ttaaggtttattcatgttgtag

SEQ ID NO: 133813 - DNA, 22 bp, Artificial Sequence
  chemically synthesized
taaggtttattcatgttgtagc

SEQ ID NO: 133814 - DNA, 22 bp, Artificial Sequence
  chemically synthesized
aaggtttattcatgttgtagca

SEQ ID NO: 133815 - DNA, 22 bp, Artificial Sequence
  chemically synthesized
aggtttattcatgttgtagcat

SEQ ID NO: 133816 - DNA, 22 bp, Artificial Sequence
  chemically synthesized
attcatgttgtagcatgtgtca

SEQ ID NO: 133817 - DNA, 22 bp, Artificial Sequence
  chemically synthesized
ttcatgttgtagcatgtgtcag

SEQ ID NO: 133818 - DNA, 22 bp, Artificial Sequence
  chemically synthesized
atgttgtagcatgtgtcagacc

SEQ ID NO: 133819 - DNA, 22 bp, Artificial Sequence
  chemically synthesized
tagcatgtgtcagacctacttt

SEQ ID NO: 133820 - DNA, 22 bp, Artificial Sequence
  chemically synthesized
ctttttatagataaataatatt

SEQ ID NO: 133821 - DNA, 22 bp, Artificial Sequence
  chemically synthesized
tttatagataaataatattcta

SEQ ID NO: 133822 - DNA, 22 bp, Artificial Sequence
  chemically synthesized
ttatagataaataatattctat

SEQ ID NO: 133823 - DNA, 22 bp, Artificial Sequence
  chemically synthesized
tatagataaataatattctatc

SEQ ID NO: 133824 - DNA, 22 bp, Artificial Sequence
  chemically synthesized
atagataaataatattctatca

SEQ ID NO: 133825 - DNA, 22 bp, Artificial Sequence
  chemically synthesized
tagataaataatattctatcac

SEQ ID NO: 133826 - DNA, 22 bp, Artificial Sequence
  chemically synthesized
tatcacatatataagacatttt

SEQ ID NO: 133827 - DNA, 22 bp, Artificial Sequence
  chemically synthesized
tcacatatataagacattttgt

SEQ ID NO: 133828 - DNA, 22 bp, Artificial Sequence
  chemically synthesized
tgttgatatacgcatctgttga

SEQ ID NO: 133829 - DNA, 22 bp, Artificial Sequence
  chemically synthesized
gttgatatacgcatctgttgat

SEQ ID NO: 133830 - DNA, 22 bp, Artificial Sequence
  chemically synthesized
ttgatatacgcatctgttgata

SEQ ID NO: 133831 - DNA, 22 bp, Artificial Sequence
  chemically synthesized
atatacgcatctgttgatagat

SEQ ID NO: 133832 - DNA, 22 bp, Artificial Sequence
  chemically synthesized
ttgatagatacttgtattgttt

SEQ ID NO: 133833 - DNA, 22 bp, Artificial Sequence
  chemically synthesized
atagatacttgtattgtttcta

SEQ ID NO: 133834 - DNA, 22 bp, Artificial Sequence
  chemically synthesized
gtattgtttctattccttggct

SEQ ID NO: 133835 - DNA, 22 bp, Artificial Sequence
  chemically synthesized
tattgtttctattccttggcta

SEQ ID NO: 133836 - DNA, 22 bp, Artificial Sequence
  chemically synthesized
tttctattccttggctactgtg

SEQ ID NO: 133837 - DNA, 22 bp, Artificial Sequence
  chemically synthesized
ctattccttggctactgtgaat

SEQ ID NO: 133838 - DNA, 22 bp, Artificial Sequence
  chemically synthesized
tattccttggctactgtgaatt

SEQ ID NO: 133839 - DNA, 22 bp, Artificial Sequence
  chemically synthesized
ttccttggctactgtgaattat

SEQ ID NO: 133840 - DNA, 22 bp, Artificial Sequence
  chemically synthesized
cttggctactgtgaattattga

SEQ ID NO: 133841 - DNA, 22 bp, Artificial Sequence
  chemically synthesized
ggctactgtgaattattgatgt

SEQ ID NO: 133842 - DNA, 22 bp, Artificial Sequence
  chemically synthesized
gctactgtgaattattgatgtc

SEQ ID NO: 133843 - DNA, 22 bp, Artificial Sequence
  chemically synthesized
ctgtgaattattgatgtcttcc

SEQ ID NO: 133844 - DNA, 22 bp, Artificial Sequence
  chemically synthesized
tgaattattgatgtcttccctt

SEQ ID NO: 133845 - DNA, 22 bp, Artificial Sequence
  chemically synthesized
ttgatgtcttcccttcaatatg

SEQ ID NO: 133846 - DNA, 22 bp, Artificial Sequence
  chemically synthesized
atgtcttcccttcaatatgccc

SEQ ID NO: 133847 - DNA, 22 bp, Artificial Sequence
  chemically synthesized
cccttcaatatgcccagattct

SEQ ID NO: 133848 - DNA, 22 bp, Artificial Sequence
  chemically synthesized
ccttcaatatgcccagattcta

SEQ ID NO: 133849 - DNA, 22 bp, Artificial Sequence
  chemically synthesized
caatatgcccagattctaccta

SEQ ID NO: 133850 - DNA, 22 bp, Artificial Sequence
  chemically synthesized
aatatgcccagattctacctaa

SEQ ID NO: 133851 - DNA, 22 bp, Artificial Sequence
  chemically synthesized
tacctaaatatatctctctact

SEQ ID NO: 133852 - DNA, 22 bp, Artificial Sequence
  chemically synthesized
cctaaatatatctctctacttc

SEQ ID NO: 133853 - DNA, 22 bp, Artificial Sequence
  chemically synthesized
aatatatctctctacttcctct

SEQ ID NO: 133854 - DNA, 22 bp, Artificial Sequence
  chemically synthesized
tctacttcctctcactctgaat

SEQ ID NO: 133855 - DNA, 22 bp, Artificial Sequence
  chemically synthesized
tacttcctctcactctgaatat

SEQ ID NO: 133856 - DNA, 22 bp, Artificial Sequence
  chemically synthesized
cttcctctcactctgaatattc

SEQ ID NO: 133857 - DNA, 22 bp, Artificial Sequence
  chemically synthesized
cctctcactctgaatattctgc

SEQ ID NO: 133858 - DNA, 22 bp, Artificial Sequence
  chemically synthesized
ctctcactctgaatattctgct

SEQ ID NO: 133859 - DNA, 22 bp, Artificial Sequence
  chemically synthesized
tcactctgaatattctgctttt

SEQ ID NO: 133860 - DNA, 22 bp, Artificial Sequence
  chemically synthesized
actctgaatattctgcttttca

SEQ ID NO: 133861 - DNA, 22 bp, Artificial Sequence
  chemically synthesized
tgaatattctgcttttcaaaga

SEQ ID NO: 133862 - DNA, 22 bp, Artificial Sequence
  chemically synthesized
aatattctgcttttcaaagaat

SEQ ID NO: 133863 - DNA, 22 bp, Artificial Sequence
  chemically synthesized
tgcttttcaaagaatattcctt

SEQ ID NO: 133864 - DNA, 22 bp, Artificial Sequence
  chemically synthesized
cttttcaaagaatattccttgg

SEQ ID NO: 133865 - DNA, 22 bp, Artificial Sequence
  chemically synthesized
ttcaaagaatattccttggaat

SEQ ID NO: 133866 - DNA, 22 bp, Artificial Sequence
  chemically synthesized
tcaaagaatattccttggaata

SEQ ID NO: 133867 - DNA, 22 bp, Artificial Sequence
  chemically synthesized
caaagaatattccttggaatat

SEQ ID NO: 133868 - DNA, 22 bp, Artificial Sequence
  chemically synthesized
aaagaatattccttggaatatt

SEQ ID NO: 133869 - DNA, 22 bp, Artificial Sequence
  chemically synthesized
cttggaatattccatggaagaa

SEQ ID NO: 133870 - DNA, 22 bp, Artificial Sequence
  chemically synthesized
ggaatattccatggaagaagaa

SEQ ID NO: 133871 - DNA, 22 bp, Artificial Sequence
  chemically synthesized
gaatattccatggaagaagaaa

SEQ ID NO: 133872 - DNA, 22 bp, Artificial Sequence
  chemically synthesized
catggaagaagaaaatgagaca

SEQ ID NO: 133873 - DNA, 22 bp, Artificial Sequence
  chemically synthesized
tctggagaaaggaagttttcag

SEQ ID NO: 133874 - DNA, 22 bp, Artificial Sequence
  chemically synthesized
ctggagaaaggaagttttcagt

SEQ ID NO: 133875 - DNA, 22 bp, Artificial Sequence
  chemically synthesized
tggagaaaggaagttttcagtg

SEQ ID NO: 133876 - DNA, 22 bp, Artificial Sequence
  chemically synthesized
gagaaaggaagttttcagtgcc

SEQ ID NO: 133877 - DNA, 22 bp, Artificial Sequence
  chemically synthesized
tcagtgccttgatctcggctga

SEQ ID NO: 133878 - DNA, 22 bp, Artificial Sequence
  chemically synthesized
cagtgccttgatctcggctgac

SEQ ID NO: 133879 - DNA, 22 bp, Artificial Sequence
  chemically synthesized
agtgccttgatctcggctgact

SEQ ID NO: 133880 - DNA, 22 bp, Artificial Sequence
  chemically synthesized
gatctcggctgactgcaacctc

SEQ ID NO: 133881 - DNA, 22 bp, Artificial Sequence
  chemically synthesized
atctcggctgactgcaacctct

SEQ ID NO: 133882 - DNA, 22 bp, Artificial Sequence
  chemically synthesized
ggctgactgcaacctctgcctc

SEQ ID NO: 133883 - DNA, 22 bp, Artificial Sequence
  chemically synthesized
actgcaacctctgcctcctggg

SEQ ID NO: 133884 - DNA, 22 bp, Artificial Sequence
  chemically synthesized
caacctctgcctcctgggttca

SEQ ID NO: 133885 - DNA, 22 bp, Artificial Sequence
  chemically synthesized
tgcctcctgggttcagttttca

SEQ ID NO: 133886 - DNA, 22 bp, Artificial Sequence
  chemically synthesized
cctcctgggttcagttttcagt

SEQ ID NO: 133887 - DNA, 22 bp, Artificial Sequence
  chemically synthesized
ctgggttcagttttcagttaaa

SEQ ID NO: 133888 - DNA, 22 bp, Artificial Sequence
  chemically synthesized
ggttcagttttcagttaaagaa

SEQ ID NO: 133889 - DNA, 22 bp, Artificial Sequence
  chemically synthesized
agttttcagttaaagaaatgat

SEQ ID NO: 133890 - DNA, 22 bp, Artificial Sequence
  chemically synthesized
tcagttaaagaaatgatttaac

SEQ ID NO: 133891 - DNA, 22 bp, Artificial Sequence
  chemically synthesized
cagttaaagaaatgatttaaca

SEQ ID NO: 133892 - DNA, 22 bp, Artificial Sequence
  chemically synthesized
agttaaagaaatgatttaacaa

SEQ ID NO: 133893 - DNA, 22 bp, Artificial Sequence
  chemically synthesized
aagaaatgatttaacaaatttt

SEQ ID NO: 133894 - DNA, 22 bp, Artificial Sequence
  chemically synthesized
aacaaattttttcactcaacta

SEQ ID NO: 133895 - DNA, 22 bp, Artificial Sequence
  chemically synthesized
acaaattttttcactcaactag

SEQ ID NO: 133896 - DNA, 22 bp, Artificial Sequence
  chemically synthesized
tttcactcaactagagatttta

SEQ ID NO: 133897 - DNA, 22 bp, Artificial Sequence
  chemically synthesized
ttcactcaactagagattttat

SEQ ID NO: 133898 - DNA, 22 bp, Artificial Sequence
  chemically synthesized
tcactcaactagagattttatg

SEQ ID NO: 133899 - DNA, 22 bp, Artificial Sequence
  chemically synthesized
cactcaactagagattttatga

SEQ ID NO: 133900 - DNA, 22 bp, Artificial Sequence
  chemically synthesized
actcaactagagattttatgat

SEQ ID NO: 133901 - DNA, 22 bp, Artificial Sequence
  chemically synthesized
aactagagattttatgataatg

SEQ ID NO: 133902 - DNA, 22 bp, Artificial Sequence
  chemically synthesized
gagattttatgataatgcaata

SEQ ID NO: 133903 - DNA, 22 bp, Artificial Sequence
  chemically synthesized
tatgataatgcaatacagataa

SEQ ID NO: 133904 - DNA, 22 bp, Artificial Sequence
  chemically synthesized
atgataatgcaatacagataaa

SEQ ID NO: 133905 - DNA, 22 bp, Artificial Sequence
  chemically synthesized
tgataatgcaatacagataaaa

SEQ ID NO: 133906 - DNA, 22 bp, Artificial Sequence
  chemically synthesized
ccagacctaaaaatatgtggca

SEQ ID NO: 133907 - DNA, 22 bp, Artificial Sequence
  chemically synthesized
cagacctaaaaatatgtggcat

SEQ ID NO: 133908 - DNA, 22 bp, Artificial Sequence
  chemically synthesized
aaaatatgtggcatccacattt

SEQ ID NO: 133909 - DNA, 22 bp, Artificial Sequence
  chemically synthesized
tacaggtacattttcacggaga

SEQ ID NO: 133910 - DNA, 22 bp, Artificial Sequence
  chemically synthesized
acaggtacattttcacggagaa

SEQ ID NO: 133911 - DNA, 22 bp, Artificial Sequence
  chemically synthesized
caggtacattttcacggagaaa

SEQ ID NO: 133912 - DNA, 22 bp, Artificial Sequence
  chemically synthesized
tcacggagaaagataagaactg

SEQ ID NO: 133913 - DNA, 22 bp, Artificial Sequence
  chemically synthesized
cacggagaaagataagaactgg

SEQ ID NO: 133914 - DNA, 22 bp, Artificial Sequence
  chemically synthesized
acggagaaagataagaactggt

SEQ ID NO: 133915 - DNA, 22 bp, Artificial Sequence
  chemically synthesized
gtgatttgtttgcaacaaatct

SEQ ID NO: 133916 - DNA, 22 bp, Artificial Sequence
  chemically synthesized
gtttgcaacaaatctttgctct

SEQ ID NO: 133917 - DNA, 22 bp, Artificial Sequence
  chemically synthesized
tttgcaacaaatctttgctctg

SEQ ID NO: 133918 - DNA, 22 bp, Artificial Sequence
  chemically synthesized
gcaacaaatctttgctctggac

SEQ ID NO: 133919 - DNA, 22 bp, Artificial Sequence
  chemically synthesized
caacaaatctttgctctggact

SEQ ID NO: 133920 - DNA, 22 bp, Artificial Sequence
  chemically synthesized
tgctctggacttcactgagtaa

SEQ ID NO: 133921 - DNA, 22 bp, Artificial Sequence
  chemically synthesized
gctctggacttcactgagtaaa

SEQ ID NO: 133922 - DNA, 22 bp, Artificial Sequence
  chemically synthesized
ctctggacttcactgagtaaag

SEQ ID NO: 133923 - DNA, 22 bp, Artificial Sequence
  chemically synthesized
tggacttcactgagtaaagttt

SEQ ID NO: 133924 - DNA, 22 bp, Artificial Sequence
  chemically synthesized
gacttcactgagtaaagttttt

SEQ ID NO: 133925 - DNA, 22 bp, Artificial Sequence
  chemically synthesized
cactgagtaaagttttttttgc

SEQ ID NO: 133926 - DNA, 22 bp, Artificial Sequence
  chemically synthesized
actgagtaaagttttttttgct

SEQ ID NO: 133927 - DNA, 22 bp, Artificial Sequence
  chemically synthesized
agtaaagttttttttgctttgt

SEQ ID NO: 133928 - DNA, 22 bp, Artificial Sequence
  chemically synthesized
tttttgctttgttttgttttgt

SEQ ID NO: 133929 - DNA, 22 bp, Artificial Sequence
  chemically synthesized
ttttgctttgttttgttttgtt

SEQ ID NO: 133930 - DNA, 22 bp, Artificial Sequence
  chemically synthesized
tttgctttgttttgttttgttt

SEQ ID NO: 133931 - DNA, 22 bp, Artificial Sequence
  chemically synthesized
ttgctttgttttgttttgtttt

SEQ ID NO: 133932 - DNA, 22 bp, Artificial Sequence
  chemically synthesized
tgctttgttttgttttgttttt

SEQ ID NO: 133933 - DNA, 22 bp, Artificial Sequence
  chemically synthesized
gctttgttttgttttgtttttg

SEQ ID NO: 133934 - DNA, 22 bp, Artificial Sequence
  chemically synthesized
ctttgttttgttttgtttttga

SEQ ID NO: 133935 - DNA, 22 bp, Artificial Sequence
  chemically synthesized
tgttttgttttgtttttgagat

SEQ ID NO: 133936 - DNA, 22 bp, Artificial Sequence
  chemically synthesized
gttttgttttgtttttgagatg

SEQ ID NO: 133937 - DNA, 22 bp, Artificial Sequence
  chemically synthesized
ttttgttttgtttttgagatgg

SEQ ID NO: 133938 - DNA, 22 bp, Artificial Sequence
  chemically synthesized
tgttttgtttttgagatggagt

SEQ ID NO: 133939 - DNA, 22 bp, Artificial Sequence
  chemically synthesized
gttttgtttttgagatggagtc

SEQ ID NO: 133940 - DNA, 22 bp, Artificial Sequence
  chemically synthesized
ttttgtttttgagatggagtct

SEQ ID NO: 133941 - DNA, 22 bp, Artificial Sequence
  chemically synthesized
tgtttttgagatggagtctcgc

SEQ ID NO: 133942 - DNA, 22 bp, Artificial Sequence
  chemically synthesized
gtttttgagatggagtctcgct

SEQ ID NO: 133943 - DNA, 22 bp, Artificial Sequence
  chemically synthesized
tttttgagatggagtctcgctc

SEQ ID NO: 133944 - DNA, 22 bp, Artificial Sequence
  chemically synthesized
ttgagatggagtctcgctctgt

SEQ ID NO: 133945 - DNA, 22 bp, Artificial Sequence
  chemically synthesized
tgagatggagtctcgctctgtc

SEQ ID NO: 133946 - DNA, 22 bp, Artificial Sequence
  chemically synthesized
gagatggagtctcgctctgtcg

SEQ ID NO: 133947 - DNA, 22 bp, Artificial Sequence
  chemically synthesized
agatggagtctcgctctgtcgc

SEQ ID NO: 133948 - DNA, 22 bp, Artificial Sequence
  chemically synthesized
gctctgtcgcccaggctggagt

SEQ ID NO: 133949 - DNA, 22 bp, Artificial Sequence
  chemically synthesized
tgtcgcccaggctggagtgcag

SEQ ID NO: 133950 - DNA, 22 bp, Artificial Sequence
  chemically synthesized
tcgcccaggctggagtgcagtg

SEQ ID NO: 133951 - DNA, 22 bp, Artificial Sequence
  chemically synthesized
gagtgcagtggcgtgatctcag

SEQ ID NO: 133952 - DNA, 22 bp, Artificial Sequence
  chemically synthesized
agctcactgcaagctctgcctc

SEQ ID NO: 133953 - DNA, 22 bp, Artificial Sequence
  chemically synthesized
actgcaagctctgcctcccggg

SEQ ID NO: 133954 - DNA, 22 bp, Artificial Sequence
  chemically synthesized
caagctctgcctcccgggttca

SEQ ID NO: 133955 - DNA, 22 bp, Artificial Sequence
  chemically synthesized
tgcctcccgggttcacgccatt

SEQ ID NO: 133956 - DNA, 22 bp, Artificial Sequence
  chemically synthesized
cctcccgggttcacgccattct

SEQ ID NO: 133957 - DNA, 22 bp, Artificial Sequence
  chemically synthesized
ccgggttcacgccattctcctg

SEQ ID NO: 133958 - DNA, 22 bp, Artificial Sequence
  chemically synthesized
acgccattctcctgcctcagcc

SEQ ID NO: 133959 - DNA, 22 bp, Artificial Sequence
  chemically synthesized
tcctgcctcagcctcccgagta

SEQ ID NO: 133960 - DNA, 22 bp, Artificial Sequence
  chemically synthesized
ctgcctcagcctcccgagtagc

SEQ ID NO: 133961 - DNA, 22 bp, Artificial Sequence
  chemically synthesized
cctcagcctcccgagtagctgg

SEQ ID NO: 133962 - DNA, 22 bp, Artificial Sequence
  chemically synthesized
agcctcccgagtagctgggact

SEQ ID NO: 133963 - DNA, 22 bp, Artificial Sequence
  chemically synthesized
ccgagtagctgggactacaggc

SEQ ID NO: 133964 - DNA, 22 bp, Artificial Sequence
  chemically synthesized
ggactacaggcgcccgccacca

SEQ ID NO: 133965 - DNA, 22 bp, Artificial Sequence
  chemically synthesized
caggcgcccgccaccacgccag

SEQ ID NO: 133966 - DNA, 22 bp, Artificial Sequence
  chemically synthesized
ttttgtctttttagtagagacg

SEQ ID NO: 133967 - DNA, 22 bp, Artificial Sequence
  chemically synthesized
tttgtctttttagtagagacgg

SEQ ID NO: 133968 - DNA, 22 bp, Artificial Sequence
  chemically synthesized
ttgtctttttagtagagacggg

SEQ ID NO: 133969 - DNA, 22 bp, Artificial Sequence
  chemically synthesized
tgtctttttagtagagacgggg

SEQ ID NO: 133970 - DNA, 22 bp, Artificial Sequence
  chemically synthesized
gtctttttagtagagacggggt

SEQ ID NO: 133971 - DNA, 22 bp, Artificial Sequence
  chemically synthesized
tctttttagtagagacggggtt

SEQ ID NO: 133972 - DNA, 22 bp, Artificial Sequence
  chemically synthesized
tttagtagagacggggtttcac

SEQ ID NO: 133973 - DNA, 22 bp, Artificial Sequence
  chemically synthesized
ttagtagagacggggtttcact

SEQ ID NO: 133974 - DNA, 22 bp, Artificial Sequence
  chemically synthesized
tagtagagacggggtttcactg

SEQ ID NO: 133975 - DNA, 22 bp, Artificial Sequence
  chemically synthesized
agtagagacggggtttcactgt

SEQ ID NO: 133976 - DNA, 22 bp, Artificial Sequence
  chemically synthesized
gtagagacggggtttcactgtg

SEQ ID NO: 133977 - DNA, 22 bp, Artificial Sequence
  chemically synthesized
cactgtgttagccaggatggtc

SEQ ID NO: 133978 - DNA, 22 bp, Artificial Sequence
  chemically synthesized
actgtgttagccaggatggtct

SEQ ID NO: 133979 - DNA, 22 bp, Artificial Sequence
  chemically synthesized
tgttagccaggatggtctcgat

SEQ ID NO: 133980 - DNA, 22 bp, Artificial Sequence
  chemically synthesized
gccaggatggtctcgatctccc

SEQ ID NO: 133981 - DNA, 22 bp, Artificial Sequence
  chemically synthesized
gatctcccgacctcgtgatcca

SEQ ID NO: 133982 - DNA, 22 bp, Artificial Sequence
  chemically synthesized
ccgacctcgtgatccacccgcc

SEQ ID NO: 133983 - DNA, 22 bp, Artificial Sequence
  chemically synthesized
gtgatccacccgcctcggcctc

SEQ ID NO: 133984 - DNA, 22 bp, Artificial Sequence
  chemically synthesized
ggcctcccaaagtgctgggatt

SEQ ID NO: 133985 - DNA, 22 bp, Artificial Sequence
  chemically synthesized
ccaaagtgctgggattacaggc

SEQ ID NO: 133986 - DNA, 22 bp, Artificial Sequence
  chemically synthesized
ggattacaggcgtgagccaccg

SEQ ID NO: 133987 - DNA, 22 bp, Artificial Sequence
  chemically synthesized
caggcgtgagccaccgcgcccg

SEQ ID NO: 133988 - DNA, 22 bp, Artificial Sequence
  chemically synthesized
agtaaagttttatattgggaag

SEQ ID NO: 133989 - DNA, 22 bp, Artificial Sequence
  chemically synthesized
tatattgggaagacataaaaat

SEQ ID NO: 133990 - DNA, 22 bp, Artificial Sequence
  chemically synthesized
atattgggaagacataaaaatg

SEQ ID NO: 133991 - DNA, 22 bp, Artificial Sequence
  chemically synthesized
tattgggaagacataaaaatgt

SEQ ID NO: 133992 - DNA, 22 bp, Artificial Sequence
  chemically synthesized
ggaagacataaaaatgtggaga

SEQ ID NO: 133993 - DNA, 22 bp, Artificial Sequence
  chemically synthesized
tggaatgcttaaaaaaataggt

SEQ ID NO: 133994 - DNA, 22 bp, Artificial Sequence
  chemically synthesized
aaaaaaataggtgtaggcgcaa

SEQ ID NO: 133995 - DNA, 22 bp, Artificial Sequence
  chemically synthesized
aaaaaataggtgtaggcgcaag

SEQ ID NO: 133996 - DNA, 22 bp, Artificial Sequence
  chemically synthesized
tctgtatgtccttgtattaaaa

SEQ ID NO: 133997 - DNA, 22 bp, Artificial Sequence
  chemically synthesized
ctgtatgtccttgtattaaaac

SEQ ID NO: 133998 - DNA, 22 bp, Artificial Sequence
  chemically synthesized
tgtatgtccttgtattaaaact

SEQ ID NO: 133999 - DNA, 22 bp, Artificial Sequence
  chemically synthesized
tatgtccttgtattaaaacttt

SEQ ID NO: 134000 - DNA, 22 bp, Artificial Sequence
  chemically synthesized
gtattaaaactttttcatactg

SEQ ID NO: 134001 - DNA, 22 bp, Artificial Sequence
  chemically synthesized
tattaaaactttttcatactga

SEQ ID NO: 134002 - DNA, 22 bp, Artificial Sequence
  chemically synthesized
aaactttttcatactgaatcaa

SEQ ID NO: 134003 - DNA, 22 bp, Artificial Sequence
  chemically synthesized
tttcatactgaatcaattgtaa

SEQ ID NO: 134004 - DNA, 22 bp, Artificial Sequence
  chemically synthesized
ttcatactgaatcaattgtaaa

SEQ ID NO: 134005 - DNA, 22 bp, Artificial Sequence
  chemically synthesized
tcatactgaatcaattgtaaaa

SEQ ID NO: 134006 - DNA, 22 bp, Artificial Sequence
  chemically synthesized
catactgaatcaattgtaaaac

SEQ ID NO: 134007 - DNA, 22 bp, Artificial Sequence
  chemically synthesized
atactgaatcaattgtaaaacc

SEQ ID NO: 134008 - DNA, 22 bp, Artificial Sequence
  chemically synthesized
aatcaattgtaaaaccgattat

SEQ ID NO: 134009 - DNA, 22 bp, Artificial Sequence
  chemically synthesized
taaaaccgattatttacccaat

SEQ ID NO: 134010 - DNA, 22 bp, Artificial Sequence
  chemically synthesized
tttacccaatgcatgctgtaag

SEQ ID NO: 134011 - DNA, 22 bp, Artificial Sequence
  chemically synthesized
acccaatgcatgctgtaagcaa

SEQ ID NO: 134012 - DNA, 22 bp, Artificial Sequence
  chemically synthesized
cccaatgcatgctgtaagcaaa

SEQ ID NO: 134013 - DNA, 22 bp, Artificial Sequence
  chemically synthesized
taagcaaaattatatgctattg

SEQ ID NO: 134014 - DNA, 22 bp, Artificial Sequence
  chemically synthesized
tatgctattgagtacaatgttt

SEQ ID NO: 134015 - DNA, 22 bp, Artificial Sequence
  chemically synthesized
ttgagtacaatgtttaagctat

SEQ ID NO: 134016 - DNA, 22 bp, Artificial Sequence
  chemically synthesized
agtacaatgtttaagctattga

SEQ ID NO: 134017 - DNA, 22 bp, Artificial Sequence
  chemically synthesized
aagctattgatactgagtataa

SEQ ID NO: 134018 - DNA, 22 bp, Artificial Sequence
  chemically synthesized
agctattgatactgagtataaa

SEQ ID NO: 134019 - DNA, 22 bp, Artificial Sequence
  chemically synthesized
ttgatactgagtataaacacaa

SEQ ID NO: 134020 - DNA, 22 bp, Artificial Sequence
  chemically synthesized
atactgagtataaacacaaatc

SEQ ID NO: 134021 - DNA, 22 bp, Artificial Sequence
  chemically synthesized
agtataaacacaaatcttaaaa

SEQ ID NO: 134022 - DNA, 22 bp, Artificial Sequence
  chemically synthesized
aaaatctggttatcccccaaag

SEQ ID NO: 134023 - DNA, 22 bp, Artificial Sequence
  chemically synthesized
aaatctggttatcccccaaaga

SEQ ID NO: 134024 - DNA, 22 bp, Artificial Sequence
  chemically synthesized
gttatcccccaaagactcctct

SEQ ID NO: 134025 - DNA, 22 bp, Artificial Sequence
  chemically synthesized
tcccccaaagactcctctgttt

SEQ ID NO: 134026 - DNA, 22 bp, Artificial Sequence
  chemically synthesized
ctctgtttctcataatgtgccc

SEQ ID NO: 134027 - DNA, 22 bp, Artificial Sequence
  chemically synthesized
tgtttctcataatgtgcccagt

SEQ ID NO: 134028 - DNA, 22 bp, Artificial Sequence
  chemically synthesized
tttctcataatgtgcccagtaa

SEQ ID NO: 134029 - DNA, 22 bp, Artificial Sequence
  chemically synthesized
ctcataatgtgcccagtaagtt

SEQ ID NO: 134030 - DNA, 22 bp, Artificial Sequence
  chemically synthesized
tcataatgtgcccagtaagttc

SEQ ID NO: 134031 - DNA, 22 bp, Artificial Sequence
  chemically synthesized
ataatgtgcccagtaagttcct

SEQ ID NO: 134032 - DNA, 22 bp, Artificial Sequence
  chemically synthesized
ctaatgtttattagtgtgttgg

SEQ ID NO: 134033 - DNA, 22 bp, Artificial Sequence
  chemically synthesized
atgtttattagtgtgttggtag

SEQ ID NO: 134034 - DNA, 22 bp, Artificial Sequence
  chemically synthesized
attagtgtgttggtaggaaatt

SEQ ID NO: 134035 - DNA, 22 bp, Artificial Sequence
  chemically synthesized
ttagtgtgttggtaggaaattt

SEQ ID NO: 134036 - DNA, 22 bp, Artificial Sequence
  chemically synthesized
gtgtgttggtaggaaatttcaa

SEQ ID NO: 134037 - DNA, 22 bp, Artificial Sequence
  chemically synthesized
gtaggaaatttcaaccccgatc

SEQ ID NO: 134038 - DNA, 22 bp, Artificial Sequence
  chemically synthesized
caaccccgatcatttccatctt

SEQ ID NO: 134039 - DNA, 22 bp, Artificial Sequence
  chemically synthesized
aaccccgatcatttccatcttg

SEQ ID NO: 134040 - DNA, 22 bp, Artificial Sequence
  chemically synthesized
ccatcttgatttgctgacctgg

SEQ ID NO: 134041 - DNA, 22 bp, Artificial Sequence
  chemically synthesized
catcttgatttgctgacctggg

SEQ ID NO: 134042 - DNA, 22 bp, Artificial Sequence
  chemically synthesized
gatttgctgacctgggtgcagg

SEQ ID NO: 134043 - DNA, 22 bp, Artificial Sequence
  chemically synthesized
atttgctgacctgggtgcaggt

SEQ ID NO: 134044 - DNA, 22 bp, Artificial Sequence
  chemically synthesized
gctgacctgggtgcaggttctt

SEQ ID NO: 134045 - DNA, 22 bp, Artificial Sequence
  chemically synthesized
ctgacctgggtgcaggttctta

SEQ ID NO: 134046 - DNA, 22 bp, Artificial Sequence
  chemically synthesized
acctgggtgcaggttcttatga

SEQ ID NO: 134047 - DNA, 22 bp, Artificial Sequence
  chemically synthesized
ggtgcaggttcttatgacagag

SEQ ID NO: 134048 - DNA, 22 bp, Artificial Sequence
  chemically synthesized
ttatgacagaggaaagactgtc

SEQ ID NO: 134049 - DNA, 22 bp, Artificial Sequence
  chemically synthesized
atgacagaggaaagactgtctt

SEQ ID NO: 134050 - DNA, 22 bp, Artificial Sequence
  chemically synthesized
tgacagaggaaagactgtcttt

SEQ ID NO: 134051 - DNA, 22 bp, Artificial Sequence
  chemically synthesized
tctttgtaagttattttggaag

SEQ ID NO: 134052 - DNA, 22 bp, Artificial Sequence
  chemically synthesized
tgtaagttattttggaagaata

SEQ ID NO: 134053 - DNA, 22 bp, Artificial Sequence
  chemically synthesized
gtaagttattttggaagaatag

SEQ ID NO: 134054 - DNA, 22 bp, Artificial Sequence
  chemically synthesized
taagttattttggaagaataga

SEQ ID NO: 134055 - DNA, 22 bp, Artificial Sequence
  chemically synthesized
ttttggaagaatagaaactgtg

SEQ ID NO: 134056 - DNA, 22 bp, Artificial Sequence
  chemically synthesized
tggaagaatagaaactgtgaaa

SEQ ID NO: 134057 - DNA, 22 bp, Artificial Sequence
  chemically synthesized
ggaagaatagaaactgtgaaaa

SEQ ID NO: 134058 - DNA, 22 bp, Artificial Sequence
  chemically synthesized
gaagaatagaaactgtgaaaaa

SEQ ID NO: 134059 - DNA, 22 bp, Artificial Sequence
  chemically synthesized
tgaaaaatatatggcttctttg

SEQ ID NO: 134060 - DNA, 22 bp, Artificial Sequence
  chemically synthesized
ctttggtgctcatgaggtattt

SEQ ID NO: 134061 - DNA, 22 bp, Artificial Sequence
  chemically synthesized
tttggtgctcatgaggtatttt

SEQ ID NO: 134062 - DNA, 22 bp, Artificial Sequence
  chemically synthesized
tggtgctcatgaggtattttga

SEQ ID NO: 134063 - DNA, 22 bp, Artificial Sequence
  chemically synthesized
ggtgctcatgaggtattttgat

SEQ ID NO: 134064 - DNA, 22 bp, Artificial Sequence
  chemically synthesized
gtgctcatgaggtattttgata

SEQ ID NO: 134065 - DNA, 22 bp, Artificial Sequence
  chemically synthesized
atgaggtattttgatactgcat

SEQ ID NO: 134066 - DNA, 22 bp, Artificial Sequence
  chemically synthesized
tgatactgcatgctgctccaat

SEQ ID NO: 134067 - DNA, 22 bp, Artificial Sequence
  chemically synthesized
gatactgcatgctgctccaata

SEQ ID NO: 134068 - DNA, 22 bp, Artificial Sequence
  chemically synthesized
atactgcatgctgctccaatat

SEQ ID NO: 134069 - DNA, 22 bp, Artificial Sequence
  chemically synthesized
catgctgctccaatatctaaat

SEQ ID NO: 134070 - DNA, 22 bp, Artificial Sequence
  chemically synthesized
ctccaatatctaaattatacat

SEQ ID NO: 134071 - DNA, 22 bp, Artificial Sequence
  chemically synthesized
caatatctaaattatacatctg

SEQ ID NO: 134072 - DNA, 22 bp, Artificial Sequence
  chemically synthesized
aattatacatctgctcctcttt

SEQ ID NO: 134073 - DNA, 22 bp, Artificial Sequence
  chemically synthesized
tacatctgctcctcttttacag

SEQ ID NO: 134074 - DNA, 22 bp, Artificial Sequence
  chemically synthesized
ctcctcttttacagctttatct

SEQ ID NO: 134075 - DNA, 22 bp, Artificial Sequence
  chemically synthesized
ctcttttacagctttatcttag

SEQ ID NO: 134076 - DNA, 22 bp, Artificial Sequence
  chemically synthesized
ttttacagctttatcttaggtg

SEQ ID NO: 134077 - DNA, 22 bp, Artificial Sequence
  chemically synthesized
ttacagctttatcttaggtgga

SEQ ID NO: 134078 - DNA, 22 bp, Artificial Sequence
  chemically synthesized
tacagctttatcttaggtggaa

SEQ ID NO: 134079 - DNA, 22 bp, Artificial Sequence
  chemically synthesized
acagctttatcttaggtggaag

SEQ ID NO: 134080 - DNA, 22 bp, Artificial Sequence
  chemically synthesized
cagctttatcttaggtggaagg

SEQ ID NO: 134081 - DNA, 22 bp, Artificial Sequence
  chemically synthesized
tatcttaggtggaagggacttc

SEQ ID NO: 134082 - DNA, 22 bp, Artificial Sequence
  chemically synthesized
atcttaggtggaagggacttca

SEQ ID NO: 134083 - DNA, 22 bp, Artificial Sequence
  chemically synthesized
tcttaggtggaagggacttcag

SEQ ID NO: 134084 - DNA, 22 bp, Artificial Sequence
  chemically synthesized
aggtggaagggacttcagctaa

SEQ ID NO: 134085 - DNA, 22 bp, Artificial Sequence
  chemically synthesized
ggtggaagggacttcagctaag

SEQ ID NO: 134086 - DNA, 22 bp, Artificial Sequence
  chemically synthesized
cagctaagttggctaaggccct

SEQ ID NO: 134087 - DNA, 22 bp, Artificial Sequence
  chemically synthesized
agctaagttggctaaggccctt

SEQ ID NO: 134088 - DNA, 22 bp, Artificial Sequence
  chemically synthesized
agttggctaaggcccttcaaat

SEQ ID NO: 134089 - DNA, 22 bp, Artificial Sequence
  chemically synthesized
gctaaggcccttcaaattaaaa

SEQ ID NO: 134090 - DNA, 22 bp, Artificial Sequence
  chemically synthesized
aggcccttcaaattaaaactct

SEQ ID NO: 134091 - DNA, 22 bp, Artificial Sequence
  chemically synthesized
caaattaaaactctgttagttt

SEQ ID NO: 134092 - DNA, 22 bp, Artificial Sequence
  chemically synthesized
aaattaaaactctgttagtttt

SEQ ID NO: 134093 - DNA, 22 bp, Artificial Sequence
  chemically synthesized
aaactctgttagtttttctcat

SEQ ID NO: 134094 - DNA, 22 bp, Artificial Sequence
  chemically synthesized
tgttagtttttctcatgcttag

SEQ ID NO: 134095 - DNA, 22 bp, Artificial Sequence
  chemically synthesized
ttagtttttctcatgcttagtg

SEQ ID NO: 134096 - DNA, 22 bp, Artificial Sequence
  chemically synthesized
gtttttctcatgcttagtgaga

SEQ ID NO: 134097 - DNA, 22 bp, Artificial Sequence
  chemically synthesized
ttctcatgcttagtgagaaaga

SEQ ID NO: 134098 - DNA, 22 bp, Artificial Sequence
  chemically synthesized
tctcatgcttagtgagaaagat

SEQ ID NO: 134099 - DNA, 22 bp, Artificial Sequence
  chemically synthesized
ctcatgcttagtgagaaagatg

SEQ ID NO: 134100 - DNA, 22 bp, Artificial Sequence
  chemically synthesized
tcatgcttagtgagaaagatgc

SEQ ID NO: 134101 - DNA, 22 bp, Artificial Sequence
  chemically synthesized
atgcttagtgagaaagatgcca

SEQ ID NO: 134102 - DNA, 22 bp, Artificial Sequence
  chemically synthesized
agtgagaaagatgccaactttc

SEQ ID NO: 134103 - DNA, 22 bp, Artificial Sequence
  chemically synthesized
gtgagaaagatgccaactttct

SEQ ID NO: 134104 - DNA, 22 bp, Artificial Sequence
  chemically synthesized
tctgctatgaaacttcaagtta

SEQ ID NO: 134105 - DNA, 22 bp, Artificial Sequence
  chemically synthesized
ctgctatgaaacttcaagttat

SEQ ID NO: 134106 - DNA, 22 bp, Artificial Sequence
  chemically synthesized
tgctatgaaacttcaagttata

SEQ ID NO: 134107 - DNA, 22 bp, Artificial Sequence
  chemically synthesized
ctatgaaacttcaagttatagt

SEQ ID NO: 134108 - DNA, 22 bp, Artificial Sequence
  chemically synthesized
tgaaacttcaagttatagtttt

SEQ ID NO: 134109 - DNA, 22 bp, Artificial Sequence
  chemically synthesized
caagttatagttttttcaataa

SEQ ID NO: 134110 - DNA, 22 bp, Artificial Sequence
  chemically synthesized
aagttatagttttttcaataac

SEQ ID NO: 134111 - DNA, 22 bp, Artificial Sequence
  chemically synthesized
tagttttttcaataacctgcaa

SEQ ID NO: 134112 - DNA, 22 bp, Artificial Sequence
  chemically synthesized
tttcaataacctgcaatttacg

SEQ ID NO: 134113 - DNA, 22 bp, Artificial Sequence
  chemically synthesized
ttcaataacctgcaatttacgt

SEQ ID NO: 134114 - DNA, 22 bp, Artificial Sequence
  chemically synthesized
tcaataacctgcaatttacgtc

SEQ ID NO: 134115 - DNA, 22 bp, Artificial Sequence
  chemically synthesized
caataacctgcaatttacgtcc

SEQ ID NO: 134116 - DNA, 22 bp, Artificial Sequence
  chemically synthesized
aataacctgcaatttacgtcca

SEQ ID NO: 134117 - DNA, 22 bp, Artificial Sequence
  chemically synthesized
caatttacgtccaagaagaaag

SEQ ID NO: 134118 - DNA, 22 bp, Artificial Sequence
  chemically synthesized
acgtccaagaagaaaggaagat

SEQ ID NO: 134119 - DNA, 22 bp, Artificial Sequence
  chemically synthesized
cgtccaagaagaaaggaagatt

SEQ ID NO: 134120 - DNA, 22 bp, Artificial Sequence
  chemically synthesized
aatctatcttcagtgatgacca

SEQ ID NO: 134121 - DNA, 22 bp, Artificial Sequence
  chemically synthesized
tcttcagtgatgaccagcatca

SEQ ID NO: 134122 - DNA, 22 bp, Artificial Sequence
  chemically synthesized
cagtgatgaccagcatcactga

SEQ ID NO: 134123 - DNA, 22 bp, Artificial Sequence
  chemically synthesized
agtgatgaccagcatcactgaa

SEQ ID NO: 134124 - DNA, 22 bp, Artificial Sequence
  chemically synthesized
aacggttatctgggcctgttgt

SEQ ID NO: 134125 - DNA, 22 bp, Artificial Sequence
  chemically synthesized
tctgggcctgttgtggattgtg

SEQ ID NO: 134126 - DNA, 22 bp, Artificial Sequence
  chemically synthesized
ggcctgttgtggattgtgaata

SEQ ID NO: 134127 - DNA, 22 bp, Artificial Sequence
  chemically synthesized
ttgtggattgtgaatatgacaa

SEQ ID NO: 134128 - DNA, 22 bp, Artificial Sequence
  chemically synthesized
tggattgtgaatatgacaatat

SEQ ID NO: 134129 - DNA, 22 bp, Artificial Sequence
  chemically synthesized
tgaatatgacaatatttgaatc

SEQ ID NO: 134130 - DNA, 22 bp, Artificial Sequence
  chemically synthesized
gaatctctctgacgaggtataa

SEQ ID NO: 134131 - DNA, 22 bp, Artificial Sequence
  chemically synthesized
aatctctctgacgaggtataag

SEQ ID NO: 134132 - DNA, 22 bp, Artificial Sequence
  chemically synthesized
tctgacgaggtataagagaggg

SEQ ID NO: 134133 - DNA, 22 bp, Artificial Sequence
  chemically synthesized
tgacgaggtataagagagggac

SEQ ID NO: 134134 - DNA, 22 bp, Artificial Sequence
  chemically synthesized
acgaggtataagagagggacac

SEQ ID NO: 134135 - DNA, 22 bp, Artificial Sequence
  chemically synthesized
acttttgaatatgcagggctgt

SEQ ID NO: 134136 - DNA, 22 bp, Artificial Sequence
  chemically synthesized
ttgaatatgcagggctgtttcc

SEQ ID NO: 134137 - DNA, 22 bp, Artificial Sequence
  chemically synthesized
tgaatatgcagggctgtttcca

SEQ ID NO: 134138 - DNA, 22 bp, Artificial Sequence
  chemically synthesized
gaatatgcagggctgtttccat

SEQ ID NO: 134139 - DNA, 22 bp, Artificial Sequence
  chemically synthesized
aatatgcagggctgtttccatg

SEQ ID NO: 134140 - DNA, 22 bp, Artificial Sequence
  chemically synthesized
tttccatgatggaggaaagaga

SEQ ID NO: 134141 - DNA, 22 bp, Artificial Sequence
  chemically synthesized
ccatgatggaggaaagagattg

SEQ ID NO: 134142 - DNA, 22 bp, Artificial Sequence
  chemically synthesized
catgatggaggaaagagattgg

SEQ ID NO: 134143 - DNA, 22 bp, Artificial Sequence
  chemically synthesized
gaggaatgtagatttatgggtg

SEQ ID NO: 134144 - DNA, 22 bp, Artificial Sequence
  chemically synthesized
atgggtgaagttgtttggcttg

SEQ ID NO: 134145 - DNA, 22 bp, Artificial Sequence
  chemically synthesized
tgggtgaagttgtttggcttgg

SEQ ID NO: 134146 - DNA, 22 bp, Artificial Sequence
  chemically synthesized
tttggcttggaagttggatggt

SEQ ID NO: 134147 - DNA, 22 bp, Artificial Sequence
  chemically synthesized
ggcttggaagttggatggtcag

SEQ ID NO: 134148 - DNA, 22 bp, Artificial Sequence
  chemically synthesized
gcttggaagttggatggtcagt

SEQ ID NO: 134149 - DNA, 22 bp, Artificial Sequence
  chemically synthesized
ggaagttggatggtcagttcca

SEQ ID NO: 134150 - DNA, 22 bp, Artificial Sequence
  chemically synthesized
gaagttggatggtcagttccag

SEQ ID NO: 134151 - DNA, 22 bp, Artificial Sequence
  chemically synthesized
gatggtcagttccaggtgctac

SEQ ID NO: 134152 - DNA, 22 bp, Artificial Sequence
  chemically synthesized
caggtgctaccattggtgctga

SEQ ID NO: 134153 - DNA, 22 bp, Artificial Sequence
  chemically synthesized
ccattggtgctgaaggagaacg

SEQ ID NO: 134154 - DNA, 22 bp, Artificial Sequence
  chemically synthesized
gtgctgaaggagaacgtttcca

SEQ ID NO: 134155 - DNA, 22 bp, Artificial Sequence
  chemically synthesized
aaggagaacgtttccaaaatgt

SEQ ID NO: 134156 - DNA, 22 bp, Artificial Sequence
  chemically synthesized
ccaaaatgtctttggggaaata

SEQ ID NO: 134157 - DNA, 22 bp, Artificial Sequence
  chemically synthesized
caaaatgtctttggggaaatac

SEQ ID NO: 134158 - DNA, 22 bp, Artificial Sequence
  chemically synthesized
tggggaaatacaatttcctatc

SEQ ID NO: 134159 - DNA, 22 bp, Artificial Sequence
  chemically synthesized
ggggaaatacaatttcctatcg

SEQ ID NO: 134160 - DNA, 22 bp, Artificial Sequence
  chemically synthesized
gggaaatacaatttcctatcgt

SEQ ID NO: 134161 - DNA, 22 bp, Artificial Sequence
  chemically synthesized
cctatcgttttgtttagttgac

SEQ ID NO: 134162 - DNA, 22 bp, Artificial Sequence
  chemically synthesized
ctatcgttttgtttagttgaca

SEQ ID NO: 134163 - DNA, 22 bp, Artificial Sequence
  chemically synthesized
tcgttttgtttagttgacacaa

SEQ ID NO: 134164 - DNA, 22 bp, Artificial Sequence
  chemically synthesized
tgtttagttgacacaaaatctt

SEQ ID NO: 134165 - DNA, 22 bp, Artificial Sequence
  chemically synthesized
gtttagttgacacaaaatctta

SEQ ID NO: 134166 - DNA, 22 bp, Artificial Sequence
  chemically synthesized
tttagttgacacaaaatcttac

SEQ ID NO: 134167 - DNA, 22 bp, Artificial Sequence
  chemically synthesized
agttgacacaaaatcttactca

SEQ ID NO: 134168 - DNA, 22 bp, Artificial Sequence
  chemically synthesized
gttgacacaaaatcttactcag

SEQ ID NO: 134169 - DNA, 22 bp, Artificial Sequence
  chemically synthesized
acacaaaatcttactcagcagg

SEQ ID NO: 134170 - DNA, 22 bp, Artificial Sequence
  chemically synthesized
actcagcaggggcccaaagtgc

SEQ ID NO: 134171 - DNA, 22 bp, Artificial Sequence
  chemically synthesized
ctcagcaggggcccaaagtgca

SEQ ID NO: 134172 - DNA, 22 bp, Artificial Sequence
  chemically synthesized
agcaggggcccaaagtgcaatt

SEQ ID NO: 134173 - DNA, 22 bp, Artificial Sequence
  chemically synthesized
gtctatattatcaactcctcta

SEQ ID NO: 134174 - DNA, 22 bp, Artificial Sequence
  chemically synthesized
tattatcaactcctctatacat

SEQ ID NO: 134175 - DNA, 22 bp, Artificial Sequence
  chemically synthesized
tcaactcctctatacatattta

SEQ ID NO: 134176 - DNA, 22 bp, Artificial Sequence
  chemically synthesized
ctctatacatatttagacactt

SEQ ID NO: 134177 - DNA, 22 bp, Artificial Sequence
  chemically synthesized
tatacatatttagacacttcgc

SEQ ID NO: 134178 - DNA, 22 bp, Artificial Sequence
  chemically synthesized
tacatatttagacacttcgcag

SEQ ID NO: 134179 - DNA, 22 bp, Artificial Sequence
  chemically synthesized
agacacttcgcaggtatcaagt

SEQ ID NO: 134180 - DNA, 22 bp, Artificial Sequence
  chemically synthesized
gacacttcgcaggtatcaagtc

SEQ ID NO: 134181 - DNA, 22 bp, Artificial Sequence
  chemically synthesized
cgcaggtatcaagtcattacca

SEQ ID NO: 134182 - DNA, 22 bp, Artificial Sequence
  chemically synthesized
gcaggtatcaagtcattaccag

SEQ ID NO: 134183 - DNA, 22 bp, Artificial Sequence
  chemically synthesized
ccaggagcaccagcttagttgt

SEQ ID NO: 134184 - DNA, 22 bp, Artificial Sequence
  chemically synthesized
agttgtttcatcttctacaacc

SEQ ID NO: 134185 - DNA, 22 bp, Artificial Sequence
  chemically synthesized
gttgtttcatcttctacaacct

SEQ ID NO: 134186 - DNA, 22 bp, Artificial Sequence
  chemically synthesized
tttcatcttctacaacctcatt

SEQ ID NO: 134187 - DNA, 22 bp, Artificial Sequence
  chemically synthesized
catcttctacaacctcattaga

SEQ ID NO: 134188 - DNA, 22 bp, Artificial Sequence
  chemically synthesized
atcttctacaacctcattagat

SEQ ID NO: 134189 - DNA, 22 bp, Artificial Sequence
  chemically synthesized
ctacaacctcattagattgact

SEQ ID NO: 134190 - DNA, 22 bp, Artificial Sequence
  chemically synthesized
tacaacctcattagattgactg

SEQ ID NO: 134191 - DNA, 22 bp, Artificial Sequence
  chemically synthesized
caacctcattagattgactgac

SEQ ID NO: 134192 - DNA, 22 bp, Artificial Sequence
  chemically synthesized
attagattgactgactgtaact

SEQ ID NO: 134193 - DNA, 22 bp, Artificial Sequence
  chemically synthesized
gattgactgactgtaacttctt

SEQ ID NO: 134194 - DNA, 22 bp, Artificial Sequence
  chemically synthesized
actgactgtaacttctttcaac

SEQ ID NO: 134195 - DNA, 22 bp, Artificial Sequence
  chemically synthesized
actgtaacttctttcaacgtaa

SEQ ID NO: 134196 - DNA, 22 bp, Artificial Sequence
  chemically synthesized
taacttctttcaacgtaatctc

SEQ ID NO: 134197 - DNA, 22 bp, Artificial Sequence
  chemically synthesized
ctttcaacgtaatctccagaaa

SEQ ID NO: 134198 - DNA, 22 bp, Artificial Sequence
  chemically synthesized
tttcaacgtaatctccagaaaa

SEQ ID NO: 134199 - DNA, 22 bp, Artificial Sequence
  chemically synthesized
tcaacgtaatctccagaaaaca

SEQ ID NO: 134200 - DNA, 22 bp, Artificial Sequence
  chemically synthesized
caacgtaatctccagaaaacaa

SEQ ID NO: 134201 - DNA, 22 bp, Artificial Sequence
  chemically synthesized
aacgtaatctccagaaaacaag

SEQ ID NO: 134202 - DNA, 22 bp, Artificial Sequence
  chemically synthesized
cagaaaacaagttttactgcat

SEQ ID NO: 134203 - DNA, 22 bp, Artificial Sequence
  chemically synthesized
tactgcataccttcaaccttaa

SEQ ID NO: 134204 - DNA, 22 bp, Artificial Sequence
  chemically synthesized
actgcataccttcaaccttaaa

SEQ ID NO: 134205 - DNA, 22 bp, Artificial Sequence
  chemically synthesized
ctgcataccttcaaccttaaaa

SEQ ID NO: 134206 - DNA, 22 bp, Artificial Sequence
  chemically synthesized
cataccttcaaccttaaaatgt

SEQ ID NO: 134207 - DNA, 22 bp, Artificial Sequence
  chemically synthesized
caaccttaaaatgtctcctttc

SEQ ID NO: 134208 - DNA, 22 bp, Artificial Sequence
  chemically synthesized
aaccttaaaatgtctcctttca

SEQ ID NO: 134209 - DNA, 22 bp, Artificial Sequence
  chemically synthesized
aaaatgtctcctttcagccttg

SEQ ID NO: 134210 - DNA, 22 bp, Artificial Sequence
  chemically synthesized
aaatgtctcctttcagccttgt

SEQ ID NO: 134211 - DNA, 22 bp, Artificial Sequence
  chemically synthesized
ctttcagccttgtccctgtact

SEQ ID NO: 134212 - DNA, 22 bp, Artificial Sequence
  chemically synthesized
tcagccttgtccctgtactatt

SEQ ID NO: 134213 - DNA, 22 bp, Artificial Sequence
  chemically synthesized
cagccttgtccctgtactatta

SEQ ID NO: 134214 - DNA, 22 bp, Artificial Sequence
  chemically synthesized
agccttgtccctgtactattag

SEQ ID NO: 134215 - DNA, 22 bp, Artificial Sequence
  chemically synthesized
gtccctgtactattagtcctat

SEQ ID NO: 134216 - DNA, 22 bp, Artificial Sequence
  chemically synthesized
tccctgtactattagtcctatt

SEQ ID NO: 134217 - DNA, 22 bp, Artificial Sequence
  chemically synthesized
tactattagtcctatttgcctt

SEQ ID NO: 134218 - DNA, 22 bp, Artificial Sequence
  chemically synthesized
ttagtcctatttgccttgcata

SEQ ID NO: 134219 - DNA, 22 bp, Artificial Sequence
  chemically synthesized
gtcctatttgccttgcatagat

SEQ ID NO: 134220 - DNA, 22 bp, Artificial Sequence
  chemically synthesized
tttgccttgcatagatgtgaga

SEQ ID NO: 134221 - DNA, 22 bp, Artificial Sequence
  chemically synthesized
gccttgcatagatgtgagatgg

SEQ ID NO: 134222 - DNA, 22 bp, Artificial Sequence
  chemically synthesized
ccttgcatagatgtgagatggt

SEQ ID NO: 134223 - DNA, 22 bp, Artificial Sequence
  chemically synthesized
gcatagatgtgagatggtacac

SEQ ID NO: 134224 - DNA, 22 bp, Artificial Sequence
  chemically synthesized
catagatgtgagatggtacaca

SEQ ID NO: 134225 - DNA, 22 bp, Artificial Sequence
  chemically synthesized
cacttataattttctttctctt

SEQ ID NO: 134226 - DNA, 22 bp, Artificial Sequence
  chemically synthesized
acttataattttctttctcttc

SEQ ID NO: 134227 - DNA, 22 bp, Artificial Sequence
  chemically synthesized
ataattttctttctcttcctat

SEQ ID NO: 134228 - DNA, 22 bp, Artificial Sequence
  chemically synthesized
taattttctttctcttcctata

SEQ ID NO: 134229 - DNA, 22 bp, Artificial Sequence
  chemically synthesized
tctttctcttcctatatggtaa

SEQ ID NO: 134230 - DNA, 22 bp, Artificial Sequence
  chemically synthesized
ctttctcttcctatatggtaac

SEQ ID NO: 134231 - DNA, 22 bp, Artificial Sequence
  chemically synthesized
tttctcttcctatatggtaaca

SEQ ID NO: 134232 - DNA, 22 bp, Artificial Sequence
  chemically synthesized
tctcttcctatatggtaacata

SEQ ID NO: 134233 - DNA, 22 bp, Artificial Sequence
  chemically synthesized
ctcttcctatatggtaacataa

SEQ ID NO: 134234 - DNA, 22 bp, Artificial Sequence
  chemically synthesized
tcttcctatatggtaacataac

SEQ ID NO: 134235 - DNA, 22 bp, Artificial Sequence
  chemically synthesized
ttcctatatggtaacataactg

SEQ ID NO: 134236 - DNA, 22 bp, Artificial Sequence
  chemically synthesized
cctatatggtaacataactgat

SEQ ID NO: 134237 - DNA, 22 bp, Artificial Sequence
  chemically synthesized
ctatatggtaacataactgata

SEQ ID NO: 134238 - DNA, 22 bp, Artificial Sequence
  chemically synthesized
tatggtaacataactgataaga

SEQ ID NO: 134239 - DNA, 22 bp, Artificial Sequence
  chemically synthesized
ataagacacaaagaagataaaa

SEQ ID NO: 134240 - DNA, 22 bp, Artificial Sequence
  chemically synthesized
atatattattgttggggtacag

SEQ ID NO: 134241 - DNA, 22 bp, Artificial Sequence
  chemically synthesized
ttgttggggtacagttctttat

SEQ ID NO: 134242 - DNA, 22 bp, Artificial Sequence
  chemically synthesized
ttggggtacagttctttattga

SEQ ID NO: 134243 - DNA, 22 bp, Artificial Sequence
  chemically synthesized
gggtacagttctttattgagaa

SEQ ID NO: 134244 - DNA, 22 bp, Artificial Sequence
  chemically synthesized
tttattgagaataagagtttct

SEQ ID NO: 134245 - DNA, 22 bp, Artificial Sequence
  chemically synthesized
tattgagaataagagtttcttt

SEQ ID NO: 134246 - DNA, 22 bp, Artificial Sequence
  chemically synthesized
attgagaataagagtttctttt

SEQ ID NO: 134247 - DNA, 22 bp, Artificial Sequence
  chemically synthesized
ttgagaataagagtttcttttc

SEQ ID NO: 134248 - DNA, 22 bp, Artificial Sequence
  chemically synthesized
agaataagagtttcttttcatg

SEQ ID NO: 134249 - DNA, 22 bp, Artificial Sequence
  chemically synthesized
cttttcatgtattggtctagct

SEQ ID NO: 134250 - DNA, 22 bp, Artificial Sequence
  chemically synthesized
ttttcatgtattggtctagcta

SEQ ID NO: 134251 - DNA, 22 bp, Artificial Sequence
  chemically synthesized
ttcatgtattggtctagctatt

SEQ ID NO: 134252 - DNA, 22 bp, Artificial Sequence
  chemically synthesized
tcatgtattggtctagctattt

SEQ ID NO: 134253 - DNA, 22 bp, Artificial Sequence
  chemically synthesized
catgtattggtctagctattta

SEQ ID NO: 134254 - DNA, 22 bp, Artificial Sequence
  chemically synthesized
atgtattggtctagctatttag

SEQ ID NO: 134255 - DNA, 22 bp, Artificial Sequence
  chemically synthesized
gtctagctatttagtagtatag

SEQ ID NO: 134256 - DNA, 22 bp, Artificial Sequence
  chemically synthesized
gctatttagtagtatagataga

SEQ ID NO: 134257 - DNA, 22 bp, Artificial Sequence
  chemically synthesized
tttagtagtatagatagatcac

SEQ ID NO: 134258 - DNA, 22 bp, Artificial Sequence
  chemically synthesized
agtagtatagatagatcacagg

SEQ ID NO: 134259 - DNA, 22 bp, Artificial Sequence
  chemically synthesized
gtagtatagatagatcacagga

SEQ ID NO: 134260 - DNA, 22 bp, Artificial Sequence
  chemically synthesized
tagacttggtgtatttagacat

SEQ ID NO: 134261 - DNA, 22 bp, Artificial Sequence
  chemically synthesized
ggtgtatttagacatcaacaaa

SEQ ID NO: 134262 - DNA, 22 bp, Artificial Sequence
  chemically synthesized
gtgtatttagacatcaacaaaa

SEQ ID NO: 134263 - DNA, 22 bp, Artificial Sequence
  chemically synthesized
agacatcaacaaaaacattttc

SEQ ID NO: 134264 - DNA, 22 bp, Artificial Sequence
  chemically synthesized
gacatcaacaaaaacattttca

SEQ ID NO: 134265 - DNA, 22 bp, Artificial Sequence
  chemically synthesized
tcaaagtagtcttttcattgga

SEQ ID NO: 134266 - DNA, 22 bp, Artificial Sequence
  chemically synthesized
caaagtagtcttttcattggaa

SEQ ID NO: 134267 - DNA, 22 bp, Artificial Sequence
  chemically synthesized
aaagtagtcttttcattggaat

SEQ ID NO: 134268 - DNA, 22 bp, Artificial Sequence
  chemically synthesized
ttcattggaatgggagaatata

SEQ ID NO: 134269 - DNA, 22 bp, Artificial Sequence
  chemically synthesized
tcattggaatgggagaatataa

SEQ ID NO: 134270 - DNA, 22 bp, Artificial Sequence
  chemically synthesized
cattggaatgggagaatataag

SEQ ID NO: 134271 - DNA, 22 bp, Artificial Sequence
  chemically synthesized
attggaatgggagaatataagt

SEQ ID NO: 134272 - DNA, 22 bp, Artificial Sequence
  chemically synthesized
gaatgggagaatataagttcca

SEQ ID NO: 134273 - DNA, 22 bp, Artificial Sequence
  chemically synthesized
cataagtggttaaaacatctta

SEQ ID NO: 134274 - DNA, 22 bp, Artificial Sequence
  chemically synthesized
aaacatcttaccttgagactca

SEQ ID NO: 134275 - DNA, 22 bp, Artificial Sequence
  chemically synthesized
accttgagactcacttgcagcc

SEQ ID NO: 134276 - DNA, 22 bp, Artificial Sequence
  chemically synthesized
ccttgagactcacttgcagcca

SEQ ID NO: 134277 - DNA, 22 bp, Artificial Sequence
  chemically synthesized
gagactcacttgcagccaaagt

SEQ ID NO: 134278 - DNA, 22 bp, Artificial Sequence
  chemically synthesized
agactcacttgcagccaaagta

SEQ ID NO: 134279 - DNA, 22 bp, Artificial Sequence
  chemically synthesized
acttgcagccaaagtactaaga

SEQ ID NO: 134280 - DNA, 22 bp, Artificial Sequence
  chemically synthesized
gcagccaaagtactaagaagga

SEQ ID NO: 134281 - DNA, 22 bp, Artificial Sequence
  chemically synthesized
cagccaaagtactaagaaggaa

SEQ ID NO: 134282 - DNA, 22 bp, Artificial Sequence
  chemically synthesized
agaaggaaaaaaacacataaat

SEQ ID NO: 134283 - DNA, 22 bp, Artificial Sequence
  chemically synthesized
ttctcatgtggtcacagctatt

SEQ ID NO: 134284 - DNA, 22 bp, Artificial Sequence
  chemically synthesized
ctcatgtggtcacagctatttg

SEQ ID NO: 134285 - DNA, 22 bp, Artificial Sequence
  chemically synthesized
tcatgtggtcacagctatttgg

SEQ ID NO: 134286 - DNA, 22 bp, Artificial Sequence
  chemically synthesized
atgtggtcacagctatttggga

SEQ ID NO: 134287 - DNA, 22 bp, Artificial Sequence
  chemically synthesized
tttgggaggctgaggtgtaaaa

SEQ ID NO: 134288 - DNA, 22 bp, Artificial Sequence
  chemically synthesized
gggaggctgaggtgtaaaaatc

SEQ ID NO: 134289 - DNA, 22 bp, Artificial Sequence
  chemically synthesized
ggaggctgaggtgtaaaaatca

SEQ ID NO: 134290 - DNA, 22 bp, Artificial Sequence
  chemically synthesized
aggtgtaaaaatcacttaagcc

SEQ ID NO: 134291 - DNA, 22 bp, Artificial Sequence
  chemically synthesized
aagcctaaaagcttgaggctgc

SEQ ID NO: 134292 - DNA, 22 bp, Artificial Sequence
  chemically synthesized
agcctaaaagcttgaggctgca

SEQ ID NO: 134293 - DNA, 22 bp, Artificial Sequence
  chemically synthesized
aaagcttgaggctgcagtaaac

SEQ ID NO: 134294 - DNA, 22 bp, Artificial Sequence
  chemically synthesized
gaggctgcagtaaactatgatc

SEQ ID NO: 134295 - DNA, 22 bp, Artificial Sequence
  chemically synthesized
aggctgcagtaaactatgatct

SEQ ID NO: 134296 - DNA, 22 bp, Artificial Sequence
  chemically synthesized
cagtaaactatgatctcaccac

SEQ ID NO: 134297 - DNA, 22 bp, Artificial Sequence
  chemically synthesized
tgatctcaccactgcactccct

SEQ ID NO: 134298 - DNA, 22 bp, Artificial Sequence
  chemically synthesized
accactgcactccctcctgggt

SEQ ID NO: 134299 - DNA, 22 bp, Artificial Sequence
  chemically synthesized
cactccctcctgggtgacagag

SEQ ID NO: 134300 - DNA, 22 bp, Artificial Sequence
  chemically synthesized
cctcctgggtgacagagcaaga

SEQ ID NO: 134301 - DNA, 22 bp, Artificial Sequence
  chemically synthesized
ctgggtgacagagcaagacact

SEQ ID NO: 134302 - DNA, 22 bp, Artificial Sequence
  chemically synthesized
ggtgacagagcaagacactgtc

SEQ ID NO: 134303 - DNA, 22 bp, Artificial Sequence
  chemically synthesized
tctcaaaagagaggaaagaaaa

SEQ ID NO: 134304 - DNA, 22 bp, Artificial Sequence
  chemically synthesized
aaaagagaggaaagaaaagaaa

SEQ ID NO: 134305 - DNA, 22 bp, Artificial Sequence
  chemically synthesized
caaaaaatctttcttcttgatg

SEQ ID NO: 134306 - DNA, 22 bp, Artificial Sequence
  chemically synthesized
aaaaaatctttcttcttgatgt

SEQ ID NO: 134307 - DNA, 22 bp, Artificial Sequence
  chemically synthesized
tcttcttgatgttgttatggat

SEQ ID NO: 134308 - DNA, 22 bp, Artificial Sequence
  chemically synthesized
cttcttgatgttgttatggatt

SEQ ID NO: 134309 - DNA, 22 bp, Artificial Sequence
  chemically synthesized
ttcttgatgttgttatggattt

SEQ ID NO: 134310 - DNA, 22 bp, Artificial Sequence
  chemically synthesized
cttgatgttgttatggattttt

SEQ ID NO: 134311 - DNA, 22 bp, Artificial Sequence
  chemically synthesized
ttgatgttgttatggatttttc

SEQ ID NO: 134312 - DNA, 22 bp, Artificial Sequence
  chemically synthesized
gatgttgttatggatttttctc

SEQ ID NO: 134313 - DNA, 22 bp, Artificial Sequence
  chemically synthesized
atgttgttatggatttttctct

SEQ ID NO: 134314 - DNA, 22 bp, Artificial Sequence
  chemically synthesized
ttatggatttttctctgaacca

SEQ ID NO: 134315 - DNA, 22 bp, Artificial Sequence
  chemically synthesized
tggatttttctctgaaccatga

SEQ ID NO: 134316 - DNA, 22 bp, Artificial Sequence
  chemically synthesized
ttctctgaaccatgattgatgt

SEQ ID NO: 134317 - DNA, 22 bp, Artificial Sequence
  chemically synthesized
tctctgaaccatgattgatgta

SEQ ID NO: 134318 - DNA, 22 bp, Artificial Sequence
  chemically synthesized
ctctgaaccatgattgatgtaa

SEQ ID NO: 134319 - DNA, 22 bp, Artificial Sequence
  chemically synthesized
tctgaaccatgattgatgtaaa

SEQ ID NO: 134320 - DNA, 22 bp, Artificial Sequence
  chemically synthesized
tgaaccatgattgatgtaaaaa

SEQ ID NO: 134321 - DNA, 22 bp, Artificial Sequence
  chemically synthesized
aaccatgattgatgtaaaaatt

SEQ ID NO: 134322 - DNA, 22 bp, Artificial Sequence
  chemically synthesized
atgtaaaaattagagacatcga

SEQ ID NO: 134323 - DNA, 22 bp, Artificial Sequence
  chemically synthesized
gagacatcgaagtactaaacaa

SEQ ID NO: 134324 - DNA, 22 bp, Artificial Sequence
  chemically synthesized
aacaataaagaaaaggagatag

SEQ ID NO: 134325 - DNA, 22 bp, Artificial Sequence
  chemically synthesized
tttggcatgcttgaactagtaa

SEQ ID NO: 134326 - DNA, 22 bp, Artificial Sequence
  chemically synthesized
ggcatgcttgaactagtaatct

SEQ ID NO: 134327 - DNA, 22 bp, Artificial Sequence
  chemically synthesized
gcatgcttgaactagtaatctt

SEQ ID NO: 134328 - DNA, 22 bp, Artificial Sequence
  chemically synthesized
gaactagtaatcttattacaaa

SEQ ID NO: 134329 - DNA, 22 bp, Artificial Sequence
  chemically synthesized
aactagtaatcttattacaaac

SEQ ID NO: 134330 - DNA, 22 bp, Artificial Sequence
  chemically synthesized
gtaatcttattacaaacagatg

SEQ ID NO: 134331 - DNA, 22 bp, Artificial Sequence
  chemically synthesized
attacaaacagatgtagaggtt

SEQ ID NO: 134332 - DNA, 22 bp, Artificial Sequence
  chemically synthesized
ttacaaacagatgtagaggttg

SEQ ID NO: 134333 - DNA, 22 bp, Artificial Sequence
  chemically synthesized
caaacagatgtagaggttgtaa

SEQ ID NO: 134334 - DNA, 22 bp, Artificial Sequence
  chemically synthesized
taaaggtctacaatttggctac

SEQ ID NO: 134335 - DNA, 22 bp, Artificial Sequence
  chemically synthesized
caatttggctacaaaaccaatg

SEQ ID NO: 134336 - DNA, 22 bp, Artificial Sequence
  chemically synthesized
ggctacaaaaccaatggcttga

SEQ ID NO: 134337 - DNA, 22 bp, Artificial Sequence
  chemically synthesized
gctacaaaaccaatggcttgat

SEQ ID NO: 134338 - DNA, 22 bp, Artificial Sequence
  chemically synthesized
caaaaccaatggcttgatcaca

SEQ ID NO: 134339 - DNA, 22 bp, Artificial Sequence
  chemically synthesized
gatcacaagaatagcattcatt

SEQ ID NO: 134340 - DNA, 22 bp, Artificial Sequence
  chemically synthesized
atcacaagaatagcattcattt

SEQ ID NO: 134341 - DNA, 22 bp, Artificial Sequence
  chemically synthesized
atttgcttaactagtacttact

SEQ ID NO: 134342 - DNA, 22 bp, Artificial Sequence
  chemically synthesized
gcttaactagtacttactgagc

SEQ ID NO: 134343 - DNA, 22 bp, Artificial Sequence
  chemically synthesized
cttaactagtacttactgagca

SEQ ID NO: 134344 - DNA, 22 bp, Artificial Sequence
  chemically synthesized
aactagtacttactgagcaccc

SEQ ID NO: 134345 - DNA, 22 bp, Artificial Sequence
  chemically synthesized
actagtacttactgagcaccca

SEQ ID NO: 134346 - DNA, 22 bp, Artificial Sequence
  chemically synthesized
gtacttactgagcacccactat

SEQ ID NO: 134347 - DNA, 22 bp, Artificial Sequence
  chemically synthesized
actgagcacccactatatgtta

SEQ ID NO: 134348 - DNA, 22 bp, Artificial Sequence
  chemically synthesized
ctgagcacccactatatgttaa

SEQ ID NO: 134349 - DNA, 22 bp, Artificial Sequence
  chemically synthesized
agcacccactatatgttaagct

SEQ ID NO: 134350 - DNA, 22 bp, Artificial Sequence
  chemically synthesized
tatgttaagctccattttaagc

SEQ ID NO: 134351 - DNA, 22 bp, Artificial Sequence
  chemically synthesized
agctccattttaagcactgaaa

SEQ ID NO: 134352 - DNA, 22 bp, Artificial Sequence
  chemically synthesized
cattttaagcactgaaaatgtc

SEQ ID NO: 134353 - DNA, 22 bp, Artificial Sequence
  chemically synthesized
taagcactgaaaatgtcactca

SEQ ID NO: 134354 - DNA, 22 bp, Artificial Sequence
  chemically synthesized
aagcactgaaaatgtcactcac

SEQ ID NO: 134355 - DNA, 22 bp, Artificial Sequence
  chemically synthesized
agcactgaaaatgtcactcact

SEQ ID NO: 134356 - DNA, 22 bp, Artificial Sequence
  chemically synthesized
aaaatgtcactcacttaaaatc

SEQ ID NO: 134357 - DNA, 22 bp, Artificial Sequence
  chemically synthesized
acttaaaatctttcagaagttt

SEQ ID NO: 134358 - DNA, 22 bp, Artificial Sequence
  chemically synthesized
aaaatctttcagaagttttgtt

SEQ ID NO: 134359 - DNA, 22 bp, Artificial Sequence
  chemically synthesized
aaatctttcagaagttttgttt

SEQ ID NO: 134360 - DNA, 22 bp, Artificial Sequence
  chemically synthesized
tcagaagttttgttttactgtg

SEQ ID NO: 134361 - DNA, 22 bp, Artificial Sequence
  chemically synthesized
cagaagttttgttttactgtga

SEQ ID NO: 134362 - DNA, 22 bp, Artificial Sequence
  chemically synthesized
agaagttttgttttactgtgag

SEQ ID NO: 134363 - DNA, 22 bp, Artificial Sequence
  chemically synthesized
tgttttactgtgagtacaaaga

SEQ ID NO: 134364 - DNA, 22 bp, Artificial Sequence
  chemically synthesized
gttttactgtgagtacaaagag

SEQ ID NO: 134365 - DNA, 22 bp, Artificial Sequence
  chemically synthesized
ttttactgtgagtacaaagaga

SEQ ID NO: 134366 - DNA, 22 bp, Artificial Sequence
  chemically synthesized
tactgtgagtacaaagagaact

SEQ ID NO: 134367 - DNA, 22 bp, Artificial Sequence
  chemically synthesized
actgtgagtacaaagagaactg

SEQ ID NO: 134368 - DNA, 22 bp, Artificial Sequence
  chemically synthesized
ctgtgagtacaaagagaactga

SEQ ID NO: 134369 - DNA, 22 bp, Artificial Sequence
  chemically synthesized
tgagtacaaagagaactgactt

SEQ ID NO: 134370 - DNA, 22 bp, Artificial Sequence
  chemically synthesized
actttatgatatggttatttac

SEQ ID NO: 134371 - DNA, 22 bp, Artificial Sequence
  chemically synthesized
tatgatatggttatttaccaag

SEQ ID NO: 134372 - DNA, 22 bp, Artificial Sequence
  chemically synthesized
atgatatggttatttaccaagc

SEQ ID NO: 134373 - DNA, 22 bp, Artificial Sequence
  chemically synthesized
tgatatggttatttaccaagcc

SEQ ID NO: 134374 - DNA, 22 bp, Artificial Sequence
  chemically synthesized
tttaccaagccgtcacttctta

SEQ ID NO: 134375 - DNA, 22 bp, Artificial Sequence
  chemically synthesized
accaagccgtcacttcttagct

SEQ ID NO: 134376 - DNA, 22 bp, Artificial Sequence
  chemically synthesized
ccaagccgtcacttcttagcta

SEQ ID NO: 134377 - DNA, 22 bp, Artificial Sequence
  chemically synthesized
cttagctacaagtctagaatca

SEQ ID NO: 134378 - DNA, 22 bp, Artificial Sequence
  chemically synthesized
ttagctacaagtctagaatcaa

SEQ ID NO: 134379 - DNA, 22 bp, Artificial Sequence
  chemically synthesized
agctacaagtctagaatcaaca

SEQ ID NO: 134380 - DNA, 22 bp, Artificial Sequence
  chemically synthesized
gctacaagtctagaatcaacag

SEQ ID NO: 134381 - DNA, 22 bp, Artificial Sequence
  chemically synthesized
caagtctagaatcaacaggttc

SEQ ID NO: 134382 - DNA, 22 bp, Artificial Sequence
  chemically synthesized
gaatcaacaggttctgcaaaat

SEQ ID NO: 134383 - DNA, 22 bp, Artificial Sequence
  chemically synthesized
tgcaaaatgaattctggaatgc

SEQ ID NO: 134384 - DNA, 22 bp, Artificial Sequence
  chemically synthesized
caaaatgaattctggaatgcat

SEQ ID NO: 134385 - DNA, 22 bp, Artificial Sequence
  chemically synthesized
tggaatgcatttattgctgtat

SEQ ID NO: 134386 - DNA, 22 bp, Artificial Sequence
  chemically synthesized
gaatgcatttattgctgtatga

SEQ ID NO: 134387 - DNA, 22 bp, Artificial Sequence
  chemically synthesized
attgctgtatgacctaaaatca

SEQ ID NO: 134388 - DNA, 22 bp, Artificial Sequence
  chemically synthesized
ttgctgtatgacctaaaatcac

SEQ ID NO: 134389 - DNA, 22 bp, Artificial Sequence
  chemically synthesized
ctgtatgacctaaaatcacgtt

SEQ ID NO: 134390 - DNA, 22 bp, Artificial Sequence
  chemically synthesized
tatgacctaaaatcacgttttg

SEQ ID NO: 134391 - DNA, 22 bp, Artificial Sequence
  chemically synthesized
aaatcacgttttggcaaaatct

SEQ ID NO: 134392 - DNA, 22 bp, Artificial Sequence
  chemically synthesized
tggcaaaatcttacctgaatat

SEQ ID NO: 134393 - DNA, 22 bp, Artificial Sequence
  chemically synthesized
ggcaaaatcttacctgaatata

SEQ ID NO: 134394 - DNA, 22 bp, Artificial Sequence
  chemically synthesized
gcaaaatcttacctgaatatat

SEQ ID NO: 134395 - DNA, 22 bp, Artificial Sequence
  chemically synthesized
acctgaatatatgagaggatat

SEQ ID NO: 134396 - DNA, 22 bp, Artificial Sequence
  chemically synthesized
cctgaatatatgagaggatatt

SEQ ID NO: 134397 - DNA, 22 bp, Artificial Sequence
  chemically synthesized
aatatatgagaggatatttagg

SEQ ID NO: 134398 - DNA, 22 bp, Artificial Sequence
  chemically synthesized
aggtttttttcccctaagtata

SEQ ID NO: 134399 - DNA, 22 bp, Artificial Sequence
  chemically synthesized
ggtttttttcccctaagtataa

SEQ ID NO: 134400 - DNA, 22 bp, Artificial Sequence
  chemically synthesized
ttttcccctaagtataaacagg

SEQ ID NO: 134401 - DNA, 22 bp, Artificial Sequence
  chemically synthesized
tttcccctaagtataaacaggt

SEQ ID NO: 134402 - DNA, 22 bp, Artificial Sequence
  chemically synthesized
ttcccctaagtataaacaggtg

SEQ ID NO: 134403 - DNA, 22 bp, Artificial Sequence
  chemically synthesized
tcccctaagtataaacaggtga

SEQ ID NO: 134404 - DNA, 22 bp, Artificial Sequence
  chemically synthesized
cccctaagtataaacaggtgat

SEQ ID NO: 134405 - DNA, 22 bp, Artificial Sequence
  chemically synthesized
ccctaagtataaacaggtgata

SEQ ID NO: 134406 - DNA, 22 bp, Artificial Sequence
  chemically synthesized
agtataaacaggtgatagtaaa

SEQ ID NO: 134407 - DNA, 22 bp, Artificial Sequence
  chemically synthesized
gctgcgagtgtcacatatatta

SEQ ID NO: 134408 - DNA, 22 bp, Artificial Sequence
  chemically synthesized
ctgcgagtgtcacatatattat

SEQ ID NO: 134409 - DNA, 22 bp, Artificial Sequence
  chemically synthesized
cgagtgtcacatatattatgta

SEQ ID NO: 134410 - DNA, 22 bp, Artificial Sequence
  chemically synthesized
tgtagaatatgcattttatcac

SEQ ID NO: 134411 - DNA, 22 bp, Artificial Sequence
  chemically synthesized
tatcactattttaaatctgaaa

SEQ ID NO: 134412 - DNA, 22 bp, Artificial Sequence
  chemically synthesized
atcactattttaaatctgaaag

SEQ ID NO: 134413 - DNA, 22 bp, Artificial Sequence
  chemically synthesized
tcactattttaaatctgaaaga

SEQ ID NO: 134414 - DNA, 22 bp, Artificial Sequence
  chemically synthesized
ttttaaatctgaaagactgaat

SEQ ID NO: 134415 - DNA, 22 bp, Artificial Sequence
  chemically synthesized
taaatctgaaagactgaatttg

SEQ ID NO: 134416 - DNA, 22 bp, Artificial Sequence
  chemically synthesized
aaatctgaaagactgaatttga

SEQ ID NO: 134417 - DNA, 22 bp, Artificial Sequence
  chemically synthesized
aatctgaaagactgaatttgac

SEQ ID NO: 134418 - DNA, 22 bp, Artificial Sequence
  chemically synthesized
aaagactgaatttgacatgttt

SEQ ID NO: 134419 - DNA, 22 bp, Artificial Sequence
  chemically synthesized
aatttgacatgttttgagataa

SEQ ID NO: 134420 - DNA, 22 bp, Artificial Sequence
  chemically synthesized
gacatgttttgagataagagtt

SEQ ID NO: 134421 - DNA, 22 bp, Artificial Sequence
  chemically synthesized
acatgttttgagataagagttt

SEQ ID NO: 134422 - DNA, 22 bp, Artificial Sequence
  chemically synthesized
tgagataagagtttagggtaga

SEQ ID NO: 134423 - DNA, 22 bp, Artificial Sequence
  chemically synthesized
gagataagagtttagggtagag

SEQ ID NO: 134424 - DNA, 22 bp, Artificial Sequence
  chemically synthesized
agataagagtttagggtagagt

SEQ ID NO: 134425 - DNA, 22 bp, Artificial Sequence
  chemically synthesized
agggtagagttgtgtatctgca

SEQ ID NO: 134426 - DNA, 22 bp, Artificial Sequence
  chemically synthesized
gggtagagttgtgtatctgcac

SEQ ID NO: 134427 - DNA, 22 bp, Artificial Sequence
  chemically synthesized
tgtatctgcacgatcttagact

SEQ ID NO: 134428 - DNA, 22 bp, Artificial Sequence
  chemically synthesized
cacgatcttagactacttaaat

SEQ ID NO: 134429 - DNA, 22 bp, Artificial Sequence
  chemically synthesized
agactacttaaatagaaactca

SEQ ID NO: 134430 - DNA, 22 bp, Artificial Sequence
  chemically synthesized
gactacttaaatagaaactcag

SEQ ID NO: 134431 - DNA, 22 bp, Artificial Sequence
  chemically synthesized
cttaaatagaaactcagcacat

SEQ ID NO: 134432 - DNA, 22 bp, Artificial Sequence
  chemically synthesized
aaatagaaactcagcacataat

SEQ ID NO: 134433 - DNA, 22 bp, Artificial Sequence
  chemically synthesized
aatagaaactcagcacataatc

SEQ ID NO: 134434 - DNA, 22 bp, Artificial Sequence
  chemically synthesized
agcacataatccaatgaaaaaa

SEQ ID NO: 134435 - DNA, 22 bp, Artificial Sequence
  chemically synthesized
cagaatgggactaatatgacaa

SEQ ID NO: 134436 - DNA, 22 bp, Artificial Sequence
  chemically synthesized
agaatgggactaatatgacaac

SEQ ID NO: 134437 - DNA, 22 bp, Artificial Sequence
  chemically synthesized
atatgacaacatctggattatt

SEQ ID NO: 134438 - DNA, 22 bp, Artificial Sequence
  chemically synthesized
gattattatgttcaataaggtg

SEQ ID NO: 134439 - DNA, 22 bp, Artificial Sequence
  chemically synthesized
ttatgttcaataaggtggagca

SEQ ID NO: 134440 - DNA, 22 bp, Artificial Sequence
  chemically synthesized
tgttcaataaggtggagcatca

SEQ ID NO: 134441 - DNA, 22 bp, Artificial Sequence
  chemically synthesized
aataaggtggagcatcatagga

SEQ ID NO: 134442 - DNA, 22 bp, Artificial Sequence
  chemically synthesized
ggaataattacatgataaacat

SEQ ID NO: 134443 - DNA, 22 bp, Artificial Sequence
  chemically synthesized
catgataaacatttaaaggact

SEQ ID NO: 134444 - DNA, 22 bp, Artificial Sequence
  chemically synthesized
aaaggactgttgatattggttc

SEQ ID NO: 134445 - DNA, 22 bp, Artificial Sequence
  chemically synthesized
aaggactgttgatattggttca

SEQ ID NO: 134446 - DNA, 22 bp, Artificial Sequence
  chemically synthesized
ttgatattggttcacccatcag

SEQ ID NO: 134447 - DNA, 22 bp, Artificial Sequence
  chemically synthesized
atattggttcacccatcaggaa

SEQ ID NO: 134448 - DNA, 22 bp, Artificial Sequence
  chemically synthesized
gttcacccatcaggaaagaagt

SEQ ID NO: 134449 - DNA, 22 bp, Artificial Sequence
  chemically synthesized
acccatcaggaaagaagtctta

SEQ ID NO: 134450 - DNA, 22 bp, Artificial Sequence
  chemically synthesized
agggtttttaatgcagatatct

SEQ ID NO: 134451 - DNA, 22 bp, Artificial Sequence
  chemically synthesized
gggtttttaatgcagatatctt

SEQ ID NO: 134452 - DNA, 22 bp, Artificial Sequence
  chemically synthesized
ttaatgcagatatctttataca

SEQ ID NO: 134453 - DNA, 22 bp, Artificial Sequence
  chemically synthesized
taatgcagatatctttatacat

SEQ ID NO: 134454 - DNA, 22 bp, Artificial Sequence
  chemically synthesized
aatgcagatatctttatacatc

SEQ ID NO: 134455 - DNA, 22 bp, Artificial Sequence
  chemically synthesized
atgcagatatctttatacatct

SEQ ID NO: 134456 - DNA, 22 bp, Artificial Sequence
  chemically synthesized
tatacatctagaaaaaaattat

SEQ ID NO: 134457 - DNA, 22 bp, Artificial Sequence
  chemically synthesized
atacatctagaaaaaaattatg

SEQ ID NO: 134458 - DNA, 22 bp, Artificial Sequence
  chemically synthesized
tacatctagaaaaaaattatgt

SEQ ID NO: 134459 - DNA, 22 bp, Artificial Sequence
  chemically synthesized
gaaaaaaattatgtatgaatat

SEQ ID NO: 134460 - DNA, 22 bp, Artificial Sequence
  chemically synthesized
tgtatgaatataatggctaata

SEQ ID NO: 134461 - DNA, 22 bp, Artificial Sequence
  chemically synthesized
atatatggttattttattctgg

SEQ ID NO: 134462 - DNA, 22 bp, Artificial Sequence
  chemically synthesized
ttttattctggagatcagacct

SEQ ID NO: 134463 - DNA, 22 bp, Artificial Sequence
  chemically synthesized
tattctggagatcagacctaaa

SEQ ID NO: 134464 - DNA, 22 bp, Artificial Sequence
  chemically synthesized
attctggagatcagacctaaat

SEQ ID NO: 134465 - DNA, 22 bp, Artificial Sequence
  chemically synthesized
ttctggagatcagacctaaata

SEQ ID NO: 134466 - DNA, 22 bp, Artificial Sequence
  chemically synthesized
tggagatcagacctaaatataa

SEQ ID NO: 134467 - DNA, 22 bp, Artificial Sequence
  chemically synthesized
gagatcagacctaaatataagg

SEQ ID NO: 134468 - DNA, 22 bp, Artificial Sequence
  chemically synthesized
aatataaggagtagatattata

SEQ ID NO: 134469 - DNA, 22 bp, Artificial Sequence
  chemically synthesized
tatgtttcagagaagtatatgt

SEQ ID NO: 134470 - DNA, 22 bp, Artificial Sequence
  chemically synthesized
cagagaagtatatgtctctctc

SEQ ID NO: 134471 - DNA, 22 bp, Artificial Sequence
  chemically synthesized
agagaagtatatgtctctctct

SEQ ID NO: 134472 - DNA, 22 bp, Artificial Sequence
  chemically synthesized
tctctctctctcactgtctctg

SEQ ID NO: 134473 - DNA, 22 bp, Artificial Sequence
  chemically synthesized
tctctctctcactgtctctgtc

SEQ ID NO: 134474 - DNA, 22 bp, Artificial Sequence
  chemically synthesized
tctctctcactgtctctgtctg

SEQ ID NO: 134475 - DNA, 22 bp, Artificial Sequence
  chemically synthesized
tctctcactgtctctgtctgtg

SEQ ID NO: 134476 - DNA, 22 bp, Artificial Sequence
  chemically synthesized
tctcactgtctctgtctgtgaa

SEQ ID NO: 134477 - DNA, 22 bp, Artificial Sequence
  chemically synthesized
tcactgtctctgtctgtgaata

SEQ ID NO: 134478 - DNA, 22 bp, Artificial Sequence
  chemically synthesized
actgtctctgtctgtgaatata

SEQ ID NO: 134479 - DNA, 22 bp, Artificial Sequence
  chemically synthesized
tctctgtctgtgaatatatata

SEQ ID NO: 134480 - DNA, 22 bp, Artificial Sequence
  chemically synthesized
tgtctgtgaatatatatataca

SEQ ID NO: 134481 - DNA, 22 bp, Artificial Sequence
  chemically synthesized
tctgtgaatatatatatacaca

SEQ ID NO: 134482 - DNA, 22 bp, Artificial Sequence
  chemically synthesized
tgaatatatatatacacacaca

SEQ ID NO: 134483 - DNA, 22 bp, Artificial Sequence
  chemically synthesized
tgcatacatatattgatagtaa

SEQ ID NO: 134484 - DNA, 22 bp, Artificial Sequence
  chemically synthesized
atagtaaataccatatatacat

SEQ ID NO: 134485 - DNA, 22 bp, Artificial Sequence
  chemically synthesized
aataattaaatgaaacccacat

SEQ ID NO: 134486 - DNA, 22 bp, Artificial Sequence
  chemically synthesized
aatgaaacccacatatatatga

SEQ ID NO: 134487 - DNA, 22 bp, Artificial Sequence
  chemically synthesized
agggtagggtagtgagttttga

SEQ ID NO: 134488 - DNA, 22 bp, Artificial Sequence
  chemically synthesized
tgaatcaatagaaagaataaat

SEQ ID NO: 134489 - DNA, 22 bp, Artificial Sequence
  chemically synthesized
gaatcaatagaaagaataaata

SEQ ID NO: 134490 - DNA, 22 bp, Artificial Sequence
  chemically synthesized
aatcaatagaaagaataaataa

SEQ ID NO: 134491 - DNA, 22 bp, Artificial Sequence
  chemically synthesized
atgaataatcatcaagacgaaa

SEQ ID NO: 134492 - DNA, 22 bp, Artificial Sequence
  chemically synthesized
ggtggtggctcaaggattttgt

SEQ ID NO: 134493 - DNA, 22 bp, Artificial Sequence
  chemically synthesized
gtggtggctcaaggattttgta

SEQ ID NO: 134494 - DNA, 22 bp, Artificial Sequence
  chemically synthesized
aaggattttgtaaagggttgaa

SEQ ID NO: 134495 - DNA, 22 bp, Artificial Sequence
  chemically synthesized
tgtaaagggttgaattagagaa

SEQ ID NO: 134496 - DNA, 22 bp, Artificial Sequence
  chemically synthesized
gtaaagggttgaattagagaat

SEQ ID NO: 134497 - DNA, 22 bp, Artificial Sequence
  chemically synthesized
taaagggttgaattagagaata

SEQ ID NO: 134498 - DNA, 22 bp, Artificial Sequence
  chemically synthesized
aattagagaatataatacagtt

SEQ ID NO: 134499 - DNA, 22 bp, Artificial Sequence
  chemically synthesized
gagaatataatacagtttgaaa

SEQ ID NO: 134500 - DNA, 22 bp, Artificial Sequence
  chemically synthesized
gaaaaggggcaatgttcttcaa

SEQ ID NO: 134501 - DNA, 22 bp, Artificial Sequence
  chemically synthesized
aaaaggggcaatgttcttcaaa

SEQ ID NO: 134502 - DNA, 22 bp, Artificial Sequence
  chemically synthesized
ttcaaatgttaacatttacaaa

SEQ ID NO: 134503 - DNA, 22 bp, Artificial Sequence
  chemically synthesized
caaatgttaacatttacaaaga

SEQ ID NO: 134504 - DNA, 22 bp, Artificial Sequence
  chemically synthesized
aaatgttaacatttacaaagac

SEQ ID NO: 134505 - DNA, 22 bp, Artificial Sequence
  chemically synthesized
acatttacaaagacaaagtgac

SEQ ID NO: 134506 - DNA, 22 bp, Artificial Sequence
  chemically synthesized
acaaagacaaagtgactggtct

SEQ ID NO: 134507 - DNA, 22 bp, Artificial Sequence
  chemically synthesized
caaagacaaagtgactggtctt

SEQ ID NO: 134508 - DNA, 22 bp, Artificial Sequence
  chemically synthesized
gtcttcccactctaagaccaat

SEQ ID NO: 134509 - DNA, 22 bp, Artificial Sequence
  chemically synthesized
cccactctaagaccaatggaac

SEQ ID NO: 134510 - DNA, 22 bp, Artificial Sequence
  chemically synthesized
ccactctaagaccaatggaaca

SEQ ID NO: 134511 - DNA, 22 bp, Artificial Sequence
  chemically synthesized
taagaccaatggaacacttgag

SEQ ID NO: 134512 - DNA, 22 bp, Artificial Sequence
  chemically synthesized
agaccaatggaacacttgagag

SEQ ID NO: 134513 - DNA, 22 bp, Artificial Sequence
  chemically synthesized
gagagtgactcatttcggtcat

SEQ ID NO: 134514 - DNA, 22 bp, Artificial Sequence
  chemically synthesized
agagtgactcatttcggtcatg

SEQ ID NO: 134515 - DNA, 22 bp, Artificial Sequence
  chemically synthesized
atttcggtcatgcctcatctga

SEQ ID NO: 134516 - DNA, 22 bp, Artificial Sequence
  chemically synthesized
cggtcatgcctcatctgatgtt

SEQ ID NO: 134517 - DNA, 22 bp, Artificial Sequence
  chemically synthesized
ggtcatgcctcatctgatgtta

SEQ ID NO: 134518 - DNA, 22 bp, Artificial Sequence
  chemically synthesized
atctgatgttagagacacaact

SEQ ID NO: 134519 - DNA, 22 bp, Artificial Sequence
  chemically synthesized
atgttagagacacaacttctct

SEQ ID NO: 134520 - DNA, 22 bp, Artificial Sequence
  chemically synthesized
gagacacaacttctcttagaga

SEQ ID NO: 134521 - DNA, 22 bp, Artificial Sequence
  chemically synthesized
ctcttagagactctccttccaa

SEQ ID NO: 134522 - DNA, 22 bp, Artificial Sequence
  chemically synthesized
tcttagagactctccttccaaa

SEQ ID NO: 134523 - DNA, 22 bp, Artificial Sequence
  chemically synthesized
ttagagactctccttccaaaga

SEQ ID NO: 134524 - DNA, 22 bp, Artificial Sequence
  chemically synthesized
agagactctccttccaaagaaa

SEQ ID NO: 134525 - DNA, 22 bp, Artificial Sequence
  chemically synthesized
gagactctccttccaaagaaaa

SEQ ID NO: 134526 - DNA, 22 bp, Artificial Sequence
  chemically synthesized
tccttccaaagaaaaaataaag

SEQ ID NO: 134527 - DNA, 22 bp, Artificial Sequence
  chemically synthesized
cttccaaagaaaaaataaaggc

SEQ ID NO: 134528 - DNA, 22 bp, Artificial Sequence
  chemically synthesized
ccaaagaaaaaataaaggccat

SEQ ID NO: 134529 - DNA, 22 bp, Artificial Sequence
  chemically synthesized
caaagaaaaaataaaggccatg

SEQ ID NO: 134530 - DNA, 22 bp, Artificial Sequence
  chemically synthesized
caatggcccagatctttcccag

SEQ ID NO: 134531 - DNA, 22 bp, Artificial Sequence
  chemically synthesized
aatggcccagatctttcccagg

SEQ ID NO: 134532 - DNA, 22 bp, Artificial Sequence
  chemically synthesized
tcccaggttggggaggaaaaga

SEQ ID NO: 134533 - DNA, 22 bp, Artificial Sequence
  chemically synthesized
cccaggttggggaggaaaagag

SEQ ID NO: 134534 - DNA, 22 bp, Artificial Sequence
  chemically synthesized
ccaggttggggaggaaaagaga

SEQ ID NO: 134535 - DNA, 22 bp, Artificial Sequence
  chemically synthesized
gggaggaaaagagaattatttg

SEQ ID NO: 134536 - DNA, 22 bp, Artificial Sequence
  chemically synthesized
tttggtacactattcccaaata

SEQ ID NO: 134537 - DNA, 22 bp, Artificial Sequence
  chemically synthesized
ggtacactattcccaaatatcc

SEQ ID NO: 134538 - DNA, 22 bp, Artificial Sequence
  chemically synthesized
gtacactattcccaaatatcct

SEQ ID NO: 134539 - DNA, 22 bp, Artificial Sequence
  chemically synthesized
ttcccaaatatcctatgtggaa

SEQ ID NO: 134540 - DNA, 22 bp, Artificial Sequence
  chemically synthesized
ccaaatatcctatgtggaaatg

SEQ ID NO: 134541 - DNA, 22 bp, Artificial Sequence
  chemically synthesized
tgtggaaatgagctagaataac

SEQ ID NO: 134542 - DNA, 22 bp, Artificial Sequence
  chemically synthesized
gaataaccccttgagagttgtt

SEQ ID NO: 134543 - DNA, 22 bp, Artificial Sequence
  chemically synthesized
gagagttgtttgtgtaacaaat

SEQ ID NO: 134544 - DNA, 22 bp, Artificial Sequence
  chemically synthesized
agagttgtttgtgtaacaaata

SEQ ID NO: 134545 - DNA, 22 bp, Artificial Sequence
  chemically synthesized
tttgtgtaacaaatatatctct

SEQ ID NO: 134546 - DNA, 22 bp, Artificial Sequence
  chemically synthesized
gtgtaacaaatatatctctcat

SEQ ID NO: 134547 - DNA, 22 bp, Artificial Sequence
  chemically synthesized
tgtaacaaatatatctctcatc

SEQ ID NO: 134548 - DNA, 22 bp, Artificial Sequence
  chemically synthesized
tcatcagaattaagagtaaata

SEQ ID NO: 134549 - DNA, 22 bp, Artificial Sequence
  chemically synthesized
atcagaattaagagtaaatact

SEQ ID NO: 134550 - DNA, 22 bp, Artificial Sequence
  chemically synthesized
agagtaaatactgaggatatag

SEQ ID NO: 134551 - DNA, 22 bp, Artificial Sequence
  chemically synthesized
aggatatagcaaacaaccaata

SEQ ID NO: 134552 - DNA, 22 bp, Artificial Sequence
  chemically synthesized
aggtcatgctcagaaaccgcaa

SEQ ID NO: 134553 - DNA, 22 bp, Artificial Sequence
  chemically synthesized
agaaaccgcaaagagaaaactg

SEQ ID NO: 134554 - DNA, 22 bp, Artificial Sequence
  chemically synthesized
tggctcaggtaagaaaagccaa

SEQ ID NO: 134555 - DNA, 22 bp, Artificial Sequence
  chemically synthesized
aggtaagaaaagccaaggattc

SEQ ID NO: 134556 - DNA, 22 bp, Artificial Sequence
  chemically synthesized
aaatacgggaagcaagtttaac

SEQ ID NO: 134557 - DNA, 22 bp, Artificial Sequence
  chemically synthesized
aaccatttccatttgatggaca

SEQ ID NO: 134558 - DNA, 22 bp, Artificial Sequence
  chemically synthesized
accatttccatttgatggacat

SEQ ID NO: 134559 - DNA, 22 bp, Artificial Sequence
  chemically synthesized
ccatttgatggacattggttga

SEQ ID NO: 134560 - DNA, 22 bp, Artificial Sequence
  chemically synthesized
catttgatggacattggttgag

SEQ ID NO: 134561 - DNA, 22 bp, Artificial Sequence
  chemically synthesized
gatggacattggttgagaatat

SEQ ID NO: 134562 - DNA, 22 bp, Artificial Sequence
  chemically synthesized
atggacattggttgagaatatg

SEQ ID NO: 134563 - DNA, 22 bp, Artificial Sequence
  chemically synthesized
gttgagaatatgagcttgggtt

SEQ ID NO: 134564 - DNA, 22 bp, Artificial Sequence
  chemically synthesized
agaatatgagcttgggttttgg

SEQ ID NO: 134565 - DNA, 22 bp, Artificial Sequence
  chemically synthesized
gggttttgggttagataaacct

SEQ ID NO: 134566 - DNA, 22 bp, Artificial Sequence
  chemically synthesized
ggttttgggttagataaacctg

SEQ ID NO: 134567 - DNA, 22 bp, Artificial Sequence
  chemically synthesized
tgggttagataaacctgtgttt

SEQ ID NO: 134568 - DNA, 22 bp, Artificial Sequence
  chemically synthesized
gggttagataaacctgtgtttg

SEQ ID NO: 134569 - DNA, 22 bp, Artificial Sequence
  chemically synthesized
ggttagataaacctgtgtttga

SEQ ID NO: 134570 - DNA, 22 bp, Artificial Sequence
  chemically synthesized
gataaacctgtgtttgaattcc

SEQ ID NO: 134571 - DNA, 22 bp, Artificial Sequence
  chemically synthesized
tgtttgaattcctttatgacac

SEQ ID NO: 134572 - DNA, 22 bp, Artificial Sequence
  chemically synthesized
gaattcctttatgacacatatt

SEQ ID NO: 134573 - DNA, 22 bp, Artificial Sequence
  chemically synthesized
aattcctttatgacacatatta

SEQ ID NO: 134574 - DNA, 22 bp, Artificial Sequence
  chemically synthesized
ctttatgacacatattagttgc

SEQ ID NO: 134575 - DNA, 22 bp, Artificial Sequence
  chemically synthesized
tatgacacatattagttgcgtg

SEQ ID NO: 134576 - DNA, 22 bp, Artificial Sequence
  chemically synthesized
atgacacatattagttgcgtga

SEQ ID NO: 134577 - DNA, 22 bp, Artificial Sequence
  chemically synthesized
tgacacatattagttgcgtgat

SEQ ID NO: 134578 - DNA, 22 bp, Artificial Sequence
  chemically synthesized
gttgcgtgatcttaggctaatt

SEQ ID NO: 134579 - DNA, 22 bp, Artificial Sequence
  chemically synthesized
cgtgatcttaggctaattgctt

SEQ ID NO: 134580 - DNA, 22 bp, Artificial Sequence
  chemically synthesized
aggctaattgcttaacttgtct

SEQ ID NO: 134581 - DNA, 22 bp, Artificial Sequence
  chemically synthesized
ggctaattgcttaacttgtcta

SEQ ID NO: 134582 - DNA, 22 bp, Artificial Sequence
  chemically synthesized
attgcttaacttgtctaaggct

SEQ ID NO: 134583 - DNA, 22 bp, Artificial Sequence
  chemically synthesized
cttaacttgtctaaggctcaat

SEQ ID NO: 134584 - DNA, 22 bp, Artificial Sequence
  chemically synthesized
aacttgtctaaggctcaatttc

SEQ ID NO: 134585 - DNA, 22 bp, Artificial Sequence
  chemically synthesized
acttgtctaaggctcaatttcc

SEQ ID NO: 134586 - DNA, 22 bp, Artificial Sequence
  chemically synthesized
gtctaaggctcaatttcctcac

SEQ ID NO: 134587 - DNA, 22 bp, Artificial Sequence
  chemically synthesized
tctaaggctcaatttcctcacc

SEQ ID NO: 134588 - DNA, 22 bp, Artificial Sequence
  chemically synthesized
aggctcaatttcctcaccataa

SEQ ID NO: 134589 - DNA, 22 bp, Artificial Sequence
  chemically synthesized
aatttcctcaccataacaatat

SEQ ID NO: 134590 - DNA, 22 bp, Artificial Sequence
  chemically synthesized
cctcaccataacaatataaata

SEQ ID NO: 134591 - DNA, 22 bp, Artificial Sequence
  chemically synthesized
ctcaccataacaatataaataa

SEQ ID NO: 134592 - DNA, 22 bp, Artificial Sequence
  chemically synthesized
accataacaatataaataaaat

SEQ ID NO: 134593 - DNA, 22 bp, Artificial Sequence
  chemically synthesized
tctttactttcttgttttttac

SEQ ID NO: 134594 - DNA, 22 bp, Artificial Sequence
  chemically synthesized
tactttcttgttttttactcac

SEQ ID NO: 134595 - DNA, 22 bp, Artificial Sequence
  chemically synthesized
actttcttgttttttactcact

SEQ ID NO: 134596 - DNA, 22 bp, Artificial Sequence
  chemically synthesized
ctttcttgttttttactcactt

SEQ ID NO: 134597 - DNA, 22 bp, Artificial Sequence
  chemically synthesized
tcttgttttttactcacttttc

SEQ ID NO: 134598 - DNA, 22 bp, Artificial Sequence
  chemically synthesized
cttgttttttactcacttttct

SEQ ID NO: 134599 - DNA, 22 bp, Artificial Sequence
  chemically synthesized
ttgttttttactcacttttctt

SEQ ID NO: 134600 - DNA, 22 bp, Artificial Sequence
  chemically synthesized
gttttttactcacttttctttt

SEQ ID NO: 134601 - DNA, 22 bp, Artificial Sequence
  chemically synthesized
ttttttactcacttttcttttc

SEQ ID NO: 134602 - DNA, 22 bp, Artificial Sequence
  chemically synthesized
tttactcacttttcttttctct

SEQ ID NO: 134603 - DNA, 22 bp, Artificial Sequence
  chemically synthesized
ttactcacttttcttttctctc

SEQ ID NO: 134604 - DNA, 22 bp, Artificial Sequence
  chemically synthesized
tactcacttttcttttctctct

SEQ ID NO: 134605 - DNA, 22 bp, Artificial Sequence
  chemically synthesized
actcacttttcttttctctctc

SEQ ID NO: 134606 - DNA, 22 bp, Artificial Sequence
  chemically synthesized
ctcacttttcttttctctctct

SEQ ID NO: 134607 - DNA, 22 bp, Artificial Sequence
  chemically synthesized
acttttcttttctctctctctc

SEQ ID NO: 134608 - DNA, 22 bp, Artificial Sequence
  chemically synthesized
ttcttttctctctctctcttta

SEQ ID NO: 134609 - DNA, 22 bp, Artificial Sequence
  chemically synthesized
tcttttctctctctctctttaa

SEQ ID NO: 134610 - DNA, 22 bp, Artificial Sequence
  chemically synthesized
cttttctctctctctctttaac

SEQ ID NO: 134611 - DNA, 22 bp, Artificial Sequence
  chemically synthesized
ttttctctctctctctttaaca

SEQ ID NO: 134612 - DNA, 22 bp, Artificial Sequence
  chemically synthesized
ttctctctctctctttaacaga

SEQ ID NO: 134613 - DNA, 22 bp, Artificial Sequence
  chemically synthesized
tctctctctctctttaacagat

SEQ ID NO: 134614 - DNA, 22 bp, Artificial Sequence
  chemically synthesized
ctctctctctctttaacagatt

SEQ ID NO: 134615 - DNA, 22 bp, Artificial Sequence
  chemically synthesized
tctctctctctttaacagattt

SEQ ID NO: 134616 - DNA, 22 bp, Artificial Sequence
  chemically synthesized
tctctctctttaacagattttt

SEQ ID NO: 134617 - DNA, 22 bp, Artificial Sequence
  chemically synthesized
tctctctttaacagatttttct

SEQ ID NO: 134618 - DNA, 22 bp, Artificial Sequence
  chemically synthesized
tctctttaacagatttttctct

SEQ ID NO: 134619 - DNA, 22 bp, Artificial Sequence
  chemically synthesized
tctttaacagatttttctctgt

SEQ ID NO: 134620 - DNA, 22 bp, Artificial Sequence
  chemically synthesized
tttaacagatttttctctgttg

SEQ ID NO: 134621 - DNA, 22 bp, Artificial Sequence
  chemically synthesized
taacagatttttctctgttgcc

SEQ ID NO: 134622 - DNA, 22 bp, Artificial Sequence
  chemically synthesized
aacagatttttctctgttgccc

SEQ ID NO: 134623 - DNA, 22 bp, Artificial Sequence
  chemically synthesized
acagatttttctctgttgccca

SEQ ID NO: 134624 - DNA, 22 bp, Artificial Sequence
  chemically synthesized
ttctctgttgcccaggctagag

SEQ ID NO: 134625 - DNA, 22 bp, Artificial Sequence
  chemically synthesized
tctctgttgcccaggctagagt

SEQ ID NO: 134626 - DNA, 22 bp, Artificial Sequence
  chemically synthesized
ctctgttgcccaggctagagtg

SEQ ID NO: 134627 - DNA, 22 bp, Artificial Sequence
  chemically synthesized
tctgttgcccaggctagagtgc

SEQ ID NO: 134628 - DNA, 22 bp, Artificial Sequence
  chemically synthesized
tgttgcccaggctagagtgcag

SEQ ID NO: 134629 - DNA, 22 bp, Artificial Sequence
  chemically synthesized
ttgcccaggctagagtgcagtg

SEQ ID NO: 134630 - DNA, 22 bp, Artificial Sequence
  chemically synthesized
cccaggctagagtgcagtggtg

SEQ ID NO: 134631 - DNA, 22 bp, Artificial Sequence
  chemically synthesized
gagtgcagtggtgcgatctcag

SEQ ID NO: 134632 - DNA, 22 bp, Artificial Sequence
  chemically synthesized
agctcactgcgacctcctccac

SEQ ID NO: 134633 - DNA, 22 bp, Artificial Sequence
  chemically synthesized
actgcgacctcctccaccaggg

SEQ ID NO: 134634 - DNA, 22 bp, Artificial Sequence
  chemically synthesized
cgacctcctccaccagggttca

SEQ ID NO: 134635 - DNA, 22 bp, Artificial Sequence
  chemically synthesized
ctccaccagggttcaggggatt

SEQ ID NO: 134636 - DNA, 22 bp, Artificial Sequence
  chemically synthesized
caccagggttcaggggattctc

SEQ ID NO: 134637 - DNA, 22 bp, Artificial Sequence
  chemically synthesized
aggggattctcatgcctcagcc

SEQ ID NO: 134638 - DNA, 22 bp, Artificial Sequence
  chemically synthesized
tcatgcctcagcctccagagta

SEQ ID NO: 134639 - DNA, 22 bp, Artificial Sequence
  chemically synthesized
atgcctcagcctccagagtagc

SEQ ID NO: 134640 - DNA, 22 bp, Artificial Sequence
  chemically synthesized
agcctccagagtagctgggatt

SEQ ID NO: 134641 - DNA, 22 bp, Artificial Sequence
  chemically synthesized
cagagtagctgggattatgatc

SEQ ID NO: 134642 - DNA, 22 bp, Artificial Sequence
  chemically synthesized
ggattatgatcatgtgccacca

SEQ ID NO: 134643 - DNA, 22 bp, Artificial Sequence
  chemically synthesized
tgatcatgtgccaccacacctg

SEQ ID NO: 134644 - DNA, 22 bp, Artificial Sequence
  chemically synthesized
gcttatttttgtaattatagta

SEQ ID NO: 134645 - DNA, 22 bp, Artificial Sequence
  chemically synthesized
atttttgtaattatagtagtga

SEQ ID NO: 134646 - DNA, 22 bp, Artificial Sequence
  chemically synthesized
tttttgtaattatagtagtgat

SEQ ID NO: 134647 - DNA, 22 bp, Artificial Sequence
  chemically synthesized
ttgtaattatagtagtgatggt

SEQ ID NO: 134648 - DNA, 22 bp, Artificial Sequence
  chemically synthesized
tgtaattatagtagtgatggtg

SEQ ID NO: 134649 - DNA, 22 bp, Artificial Sequence
  chemically synthesized
gtaattatagtagtgatggtgt

SEQ ID NO: 134650 - DNA, 22 bp, Artificial Sequence
  chemically synthesized
taattatagtagtgatggtgtt

SEQ ID NO: 134651 - DNA, 22 bp, Artificial Sequence
  chemically synthesized
tagtagtgatggtgttttgcca

SEQ ID NO: 134652 - DNA, 22 bp, Artificial Sequence
  chemically synthesized
tgccatgttggcccagctggtc

SEQ ID NO: 134653 - DNA, 22 bp, Artificial Sequence
  chemically synthesized
gccatgttggcccagctggtct

SEQ ID NO: 134654 - DNA, 22 bp, Artificial Sequence
  chemically synthesized
ccatgttggcccagctggtctc

SEQ ID NO: 134655 - DNA, 22 bp, Artificial Sequence
  chemically synthesized
gcccagctggtctcgaactcct

SEQ ID NO: 134656 - DNA, 22 bp, Artificial Sequence
  chemically synthesized
gtctcgaactcctgaactcaag

SEQ ID NO: 134657 - DNA, 22 bp, Artificial Sequence
  chemically synthesized
gaactcctgaactcaagtgatc

SEQ ID NO: 134658 - DNA, 22 bp, Artificial Sequence
  chemically synthesized
ctgaactcaagtgatccaccct

SEQ ID NO: 134659 - DNA, 22 bp, Artificial Sequence
  chemically synthesized
aactcaagtgatccaccctcct

SEQ ID NO: 134660 - DNA, 22 bp, Artificial Sequence
  chemically synthesized
aagtgatccaccctcctcggcc

SEQ ID NO: 134661 - DNA, 22 bp, Artificial Sequence
  chemically synthesized
ctcggcctcccaaagtgctggg

SEQ ID NO: 134662 - DNA, 22 bp, Artificial Sequence
  chemically synthesized
ggcctcccaaagtgctgggatt

SEQ ID NO: 134663 - DNA, 22 bp, Artificial Sequence
  chemically synthesized
ccaaagtgctgggattataggc

SEQ ID NO: 134664 - DNA, 22 bp, Artificial Sequence
  chemically synthesized
ggattataggcatgagccaccg

SEQ ID NO: 134665 - DNA, 22 bp, Artificial Sequence
  chemically synthesized
taggcatgagccaccgtgccca

SEQ ID NO: 134666 - DNA, 22 bp, Artificial Sequence
  chemically synthesized
ttttttactcactttttgtctc

SEQ ID NO: 134667 - DNA, 22 bp, Artificial Sequence
  chemically synthesized
tttactcactttttgtctcaca

SEQ ID NO: 134668 - DNA, 22 bp, Artificial Sequence
  chemically synthesized
ttactcactttttgtctcacag

SEQ ID NO: 134669 - DNA, 22 bp, Artificial Sequence
  chemically synthesized
tactcactttttgtctcacagt

SEQ ID NO: 134670 - DNA, 22 bp, Artificial Sequence
  chemically synthesized
actcactttttgtctcacagtc

SEQ ID NO: 134671 - DNA, 22 bp, Artificial Sequence
  chemically synthesized
ctcactttttgtctcacagtca

SEQ ID NO: 134672 - DNA, 22 bp, Artificial Sequence
  chemically synthesized
actttttgtctcacagtcatta

SEQ ID NO: 134673 - DNA, 22 bp, Artificial Sequence
  chemically synthesized
tttgtctcacagtcattaggca

SEQ ID NO: 134674 - DNA, 22 bp, Artificial Sequence
  chemically synthesized
ttgtctcacagtcattaggcat

SEQ ID NO: 134675 - DNA, 22 bp, Artificial Sequence
  chemically synthesized
tgtctcacagtcattaggcatt

SEQ ID NO: 134676 - DNA, 22 bp, Artificial Sequence
  chemically synthesized
gtctcacagtcattaggcattc

SEQ ID NO: 134677 - DNA, 22 bp, Artificial Sequence
  chemically synthesized
tctcacagtcattaggcattca

SEQ ID NO: 134678 - DNA, 22 bp, Artificial Sequence
  chemically synthesized
acagtcattaggcattcatttc

SEQ ID NO: 134679 - DNA, 22 bp, Artificial Sequence
  chemically synthesized
ggcattcatttctgccattatg

SEQ ID NO: 134680 - DNA, 22 bp, Artificial Sequence
  chemically synthesized
atttctgccattatgttgaaat

SEQ ID NO: 134681 - DNA, 22 bp, Artificial Sequence
  chemically synthesized
ctgccattatgttgaaattgtc

SEQ ID NO: 134682 - DNA, 22 bp, Artificial Sequence
  chemically synthesized
tgccattatgttgaaattgtca

SEQ ID NO: 134683 - DNA, 22 bp, Artificial Sequence
  chemically synthesized
ccattatgttgaaattgtcaat

SEQ ID NO: 134684 - DNA, 22 bp, Artificial Sequence
  chemically synthesized
tgttgaaattgtcaatattacc

SEQ ID NO: 134685 - DNA, 22 bp, Artificial Sequence
  chemically synthesized
aaattgtcaatattaccaaaga

SEQ ID NO: 134686 - DNA, 22 bp, Artificial Sequence
  chemically synthesized
tcaatattaccaaagacctagt

SEQ ID NO: 134687 - DNA, 22 bp, Artificial Sequence
  chemically synthesized
ccaaagacctagttgccccaaa

SEQ ID NO: 134688 - DNA, 22 bp, Artificial Sequence
  chemically synthesized
gttgccccaaacaatcaacacc

SEQ ID NO: 134689 - DNA, 22 bp, Artificial Sequence
  chemically synthesized
ccccaaacaatcaacacctcta

SEQ ID NO: 134690 - DNA, 22 bp, Artificial Sequence
  chemically synthesized
tatgtttatattaattgataat

SEQ ID NO: 134691 - DNA, 22 bp, Artificial Sequence
  chemically synthesized
tgtttatattaattgataattc

SEQ ID NO: 134692 - DNA, 22 bp, Artificial Sequence
  chemically synthesized
atattaattgataattctatat

SEQ ID NO: 134693 - DNA, 22 bp, Artificial Sequence
  chemically synthesized
tattaattgataattctatatt

SEQ ID NO: 134694 - DNA, 22 bp, Artificial Sequence
  chemically synthesized
attgataattctatatttttca

SEQ ID NO: 134695 - DNA, 22 bp, Artificial Sequence
  chemically synthesized
ataattctatatttttcactat

SEQ ID NO: 134696 - DNA, 22 bp, Artificial Sequence
  chemically synthesized
tatatttttcactattaaccta

SEQ ID NO: 134697 - DNA, 22 bp, Artificial Sequence
  chemically synthesized
tatttttcactattaacctacc

SEQ ID NO: 134698 - DNA, 22 bp, Artificial Sequence
  chemically synthesized
ttcactattaacctaccatagt

SEQ ID NO: 134699 - DNA, 22 bp, Artificial Sequence
  chemically synthesized
tcactattaacctaccatagta

SEQ ID NO: 134700 - DNA, 22 bp, Artificial Sequence
  chemically synthesized
cactattaacctaccatagtat

SEQ ID NO: 134701 - DNA, 22 bp, Artificial Sequence
  chemically synthesized
actattaacctaccatagtatc

SEQ ID NO: 134702 - DNA, 22 bp, Artificial Sequence
  chemically synthesized
ttaacctaccatagtatccact

SEQ ID NO: 134703 - DNA, 22 bp, Artificial Sequence
  chemically synthesized
acctaccatagtatccactcct

SEQ ID NO: 134704 - DNA, 22 bp, Artificial Sequence
  chemically synthesized
ccatagtatccactcctataaa

SEQ ID NO: 134705 - DNA, 22 bp, Artificial Sequence
  chemically synthesized
ctataaacttcccttttcattg

SEQ ID NO: 134706 - DNA, 22 bp, Artificial Sequence
  chemically synthesized
taaacttcccttttcattgttt

SEQ ID NO: 134707 - DNA, 22 bp, Artificial Sequence
  chemically synthesized
cccttttcattgtttttttgta

SEQ ID NO: 134708 - DNA, 22 bp, Artificial Sequence
  chemically synthesized
ccttttcattgtttttttgtaa

SEQ ID NO: 134709 - DNA, 22 bp, Artificial Sequence
  chemically synthesized
ttcattgtttttttgtaaatac

SEQ ID NO: 134710 - DNA, 22 bp, Artificial Sequence
  chemically synthesized
tcattgtttttttgtaaataca

SEQ ID NO: 134711 - DNA, 22 bp, Artificial Sequence
  chemically synthesized
cattgtttttttgtaaatacag

SEQ ID NO: 134712 - DNA, 22 bp, Artificial Sequence
  chemically synthesized
attgtttttttgtaaatacaga

SEQ ID NO: 134713 - DNA, 22 bp, Artificial Sequence
  chemically synthesized
tttttttgtaaatacagatcaa

SEQ ID NO: 134714 - DNA, 22 bp, Artificial Sequence
  chemically synthesized
ttttgtaaatacagatcaactt

SEQ ID NO: 134715 - DNA, 22 bp, Artificial Sequence
  chemically synthesized
tttgtaaatacagatcaacttt

SEQ ID NO: 134716 - DNA, 22 bp, Artificial Sequence
  chemically synthesized
ttgtaaatacagatcaactttg

SEQ ID NO: 134717 - DNA, 22 bp, Artificial Sequence
  chemically synthesized
tgtaaatacagatcaactttgc

SEQ ID NO: 134718 - DNA, 22 bp, Artificial Sequence
  chemically synthesized
gtaaatacagatcaactttgct

SEQ ID NO: 134719 - DNA, 22 bp, Artificial Sequence
  chemically synthesized
taaatacagatcaactttgcta

SEQ ID NO: 134720 - DNA, 22 bp, Artificial Sequence
  chemically synthesized
tgctatcctcttacatctgtgc

SEQ ID NO: 134721 - DNA, 22 bp, Artificial Sequence
  chemically synthesized
gctatcctcttacatctgtgcc

SEQ ID NO: 134722 - DNA, 22 bp, Artificial Sequence
  chemically synthesized
ctatcctcttacatctgtgcct

SEQ ID NO: 134723 - DNA, 22 bp, Artificial Sequence
  chemically synthesized
tcctcttacatctgtgcctgct

SEQ ID NO: 134724 - DNA, 22 bp, Artificial Sequence
  chemically synthesized
ttacatctgtgcctgcttcttt

SEQ ID NO: 134725 - DNA, 22 bp, Artificial Sequence
  chemically synthesized
acatctgtgcctgcttctttgt

SEQ ID NO: 134726 - DNA, 22 bp, Artificial Sequence
  chemically synthesized
catctgtgcctgcttctttgtc

SEQ ID NO: 134727 - DNA, 22 bp, Artificial Sequence
  chemically synthesized
tgcctgcttctttgtctatctc

SEQ ID NO: 134728 - DNA, 22 bp, Artificial Sequence
  chemically synthesized
cttctttgtctatctcctttga

SEQ ID NO: 134729 - DNA, 22 bp, Artificial Sequence
  chemically synthesized
ctttgtctatctcctttgagat

SEQ ID NO: 134730 - DNA, 22 bp, Artificial Sequence
  chemically synthesized
tttgtctatctcctttgagatc

SEQ ID NO: 134731 - DNA, 22 bp, Artificial Sequence
  chemically synthesized
tgtctatctcctttgagatctt

SEQ ID NO: 134732 - DNA, 22 bp, Artificial Sequence
  chemically synthesized
gtctatctcctttgagatcttt

SEQ ID NO: 134733 - DNA, 22 bp, Artificial Sequence
  chemically synthesized
tctatctcctttgagatctttc

SEQ ID NO: 134734 - DNA, 22 bp, Artificial Sequence
  chemically synthesized
tctcctttgagatctttctttt

SEQ ID NO: 134735 - DNA, 22 bp, Artificial Sequence
  chemically synthesized
ctttgagatctttctttttact

SEQ ID NO: 134736 - DNA, 22 bp, Artificial Sequence
  chemically synthesized
tgagatctttctttttactgag

SEQ ID NO: 134737 - DNA, 22 bp, Artificial Sequence
  chemically synthesized
gagatctttctttttactgaga

SEQ ID NO: 134738 - DNA, 22 bp, Artificial Sequence
  chemically synthesized
agatctttctttttactgagag

SEQ ID NO: 134739 - DNA, 22 bp, Artificial Sequence
  chemically synthesized
tctttttactgagagcaaaatt

SEQ ID NO: 134740 - DNA, 22 bp, Artificial Sequence
  chemically synthesized
ctttttactgagagcaaaattt

SEQ ID NO: 134741 - DNA, 22 bp, Artificial Sequence
  chemically synthesized
tttttactgagagcaaaatttg

SEQ ID NO: 134742 - DNA, 22 bp, Artificial Sequence
  chemically synthesized
tttactgagagcaaaatttgtc

SEQ ID NO: 134743 - DNA, 22 bp, Artificial Sequence
  chemically synthesized
ttactgagagcaaaatttgtcc

SEQ ID NO: 134744 - DNA, 22 bp, Artificial Sequence
  chemically synthesized
tactgagagcaaaatttgtcct

SEQ ID NO: 134745 - DNA, 22 bp, Artificial Sequence
  chemically synthesized
actgagagcaaaatttgtccta

SEQ ID NO: 134746 - DNA, 22 bp, Artificial Sequence
  chemically synthesized
ctgagagcaaaatttgtcctag

SEQ ID NO: 134747 - DNA, 22 bp, Artificial Sequence
  chemically synthesized
agagcaaaatttgtcctagttt

SEQ ID NO: 134748 - DNA, 22 bp, Artificial Sequence
  chemically synthesized
gtcctagtttcccaatgtttct

SEQ ID NO: 134749 - DNA, 22 bp, Artificial Sequence
  chemically synthesized
tcctagtttcccaatgtttctc

SEQ ID NO: 134750 - DNA, 22 bp, Artificial Sequence
  chemically synthesized
gtttcccaatgtttctctccaa

SEQ ID NO: 134751 - DNA, 22 bp, Artificial Sequence
  chemically synthesized
cccaatgtttctctccaaacct

SEQ ID NO: 134752 - DNA, 22 bp, Artificial Sequence
  chemically synthesized
ccaatgtttctctccaaacctt

SEQ ID NO: 134753 - DNA, 22 bp, Artificial Sequence
  chemically synthesized
ctctccaaaccttttttttttt

SEQ ID NO: 134754 - DNA, 22 bp, Artificial Sequence
  chemically synthesized
tctccaaacctttttttttttt

SEQ ID NO: 134755 - DNA, 22 bp, Artificial Sequence
  chemically synthesized
tccaaacctttttttttttttt

SEQ ID NO: 134756 - DNA, 22 bp, Artificial Sequence
  chemically synthesized
caaacctttttttttttttttt

SEQ ID NO: 134757 - DNA, 22 bp, Artificial Sequence
  chemically synthesized
ttttttttttttttttgagaca

SEQ ID NO: 134758 - DNA, 22 bp, Artificial Sequence
  chemically synthesized
tttttttttttttttgagacag

SEQ ID NO: 134759 - DNA, 22 bp, Artificial Sequence
  chemically synthesized
ttttttttttttttgagacaga

SEQ ID NO: 134760 - DNA, 22 bp, Artificial Sequence
  chemically synthesized
tttttttttttttgagacagag

SEQ ID NO: 134761 - DNA, 22 bp, Artificial Sequence
  chemically synthesized
ttttttttttttgagacagagc

SEQ ID NO: 134762 - DNA, 22 bp, Artificial Sequence
  chemically synthesized
tttttttttttgagacagagcc

SEQ ID NO: 134763 - DNA, 22 bp, Artificial Sequence
  chemically synthesized
ttttttttttgagacagagcct

SEQ ID NO: 134764 - DNA, 22 bp, Artificial Sequence
  chemically synthesized
tttttttttgagacagagcctt

SEQ ID NO: 134765 - DNA, 22 bp, Artificial Sequence
  chemically synthesized
ttttttttgagacagagccttg

SEQ ID NO: 134766 - DNA, 22 bp, Artificial Sequence
  chemically synthesized
tttttttgagacagagccttgc

SEQ ID NO: 134767 - DNA, 22 bp, Artificial Sequence
  chemically synthesized
ttttttgagacagagccttgct

SEQ ID NO: 134768 - DNA, 22 bp, Artificial Sequence
  chemically synthesized
tttttgagacagagccttgctt

SEQ ID NO: 134769 - DNA, 22 bp, Artificial Sequence
  chemically synthesized
ttttgagacagagccttgcttt

SEQ ID NO: 134770 - DNA, 22 bp, Artificial Sequence
  chemically synthesized
tttgagacagagccttgctttg

SEQ ID NO: 134771 - DNA, 22 bp, Artificial Sequence
  chemically synthesized
ttgagacagagccttgctttgt

SEQ ID NO: 134772 - DNA, 22 bp, Artificial Sequence
  chemically synthesized
tgagacagagccttgctttgtc

SEQ ID NO: 134773 - DNA, 22 bp, Artificial Sequence
  chemically synthesized
gagacagagccttgctttgtcg
